United States Patent 12,590,386 (RECOMBINANT POLYCLONAL PROTEINS AND METHODS OF USE THEREOF) - sequence listing, part 2

SEQ ID NO: 27735 - protein, 9 aa, Homo sapiens
  light chain complementarity determining region 3 for antibody 13868
QQSYSTPYT

SEQ ID NO: 27736 - protein, 17 aa, Homo sapiens
  heavy chain complementarity determining region 3 for antibody 13868
ARDGSYGDRMYCYGMDV

SEQ ID NO: 27737 - protein, 9 aa, Homo sapiens
  light chain complementarity determining region 3 for antibody 13869
QQSYSTPYT

SEQ ID NO: 27738 - protein, 10 aa, Homo sapiens
  heavy chain complementarity determining region 3 for antibody 13869
ARAIAAAGAY

SEQ ID NO: 27739 - protein, 9 aa, Homo sapiens
  light chain complementarity determining region 3 for antibody 13870
QQSYSTPYP

SEQ ID NO: 27740 - protein, 15 aa, Homo sapiens
  heavy chain complementarity determining region 3 for antibody 13870
VKARGSTWGTYRWDV

SEQ ID NO: 27741 - protein, 9 aa, Homo sapiens
  light chain complementarity determining region 3 for antibody 13871
QQSYSTPYP

SEQ ID NO: 27742 - protein, 17 aa, Homo sapiens
  heavy chain complementarity determining region 3 for antibody 13871
ARGSYYDVDLNRFYFDY

SEQ ID NO: 27743 - protein, 9 aa, Homo sapiens
  light chain complementarity determining region 3 for antibody 13872
QQSYSTPYP

SEQ ID NO: 27744 - protein, 17 aa, Homo sapiens
  heavy chain complementarity determining region 3 for antibody 13872
ARGSYYDVDLITYYFDH

SEQ ID NO: 27745 - protein, 9 aa, Homo sapiens
  light chain complementarity determining region 3 for antibody 13873
QQSYSTPWT

SEQ ID NO: 27746 - protein, 13 aa, Homo sapiens
  heavy chain complementarity determining region 3 for antibody 13873
TRTYGSGRNWFDP

SEQ ID NO: 27747 - protein, 9 aa, Homo sapiens
  light chain complementarity determining region 3 for antibody 13874
QQSYSTPWT

SEQ ID NO: 27748 - protein, 15 aa, Homo sapiens
  heavy chain complementarity determining region 3 for antibody 13874
ARAPPIAVVINGMDV

SEQ ID NO: 27749 - protein, 10 aa, Homo sapiens
  light chain complementarity determining region 3 for antibody 13875
QQSYSTPSWT

SEQ ID NO: 27750 - protein, 19 aa, Homo sapiens
  heavy chain complementarity determining region 3 for antibody 13875
ARDKVEGDYAQWDYYGMDV

SEQ ID NO: 27751 - protein, 9 aa, Homo sapiens
  light chain complementarity determining region 3 for antibody 13876
QQSYSTPST

SEQ ID NO: 27752 - protein, 14 aa, Homo sapiens
  heavy chain complementarity determining region 3 for antibody 13876
ARLPGRYPRYGMDV

SEQ ID NO: 27753 - protein, 9 aa, Homo sapiens
  light chain complementarity determining region 3 for antibody 13877
QQSYSTPST

SEQ ID NO: 27754 - protein, 15 aa, Homo sapiens
  heavy chain complementarity determining region 3 for antibody 13877
ARGDCRDETCYPGAY

SEQ ID NO: 27755 - protein, 9 aa, Homo sapiens
  light chain complementarity determining region 3 for antibody 13878
QQSYSTPRT

SEQ ID NO: 27756 - protein, 18 aa, Homo sapiens
  heavy chain complementarity determining region 3 for antibody 13878
VREKVGDYCTGSCSFYKN

SEQ ID NO: 27757 - protein, 9 aa, Homo sapiens
  light chain complementarity determining region 3 for antibody 13879
QQSYSTPRT

SEQ ID NO: 27758 - protein, 17 aa, Homo sapiens
  heavy chain complementarity determining region 3 for antibody 13879
TKDYYGDYMAQYNWCDS

SEQ ID NO: 27759 - protein, 9 aa, Homo sapiens
  light chain complementarity determining region 3 for antibody 13880
QQSYSTPRT

SEQ ID NO: 27760 - protein, 14 aa, Homo sapiens
  heavy chain complementarity determining region 3 for antibody 13880
ARVQVGYSNYGCDS

SEQ ID NO: 27761 - protein, 9 aa, Homo sapiens
  light chain complementarity determining region 3 for antibody 13881
QQSYSTPRT

SEQ ID NO: 27762 - protein, 14 aa, Homo sapiens
  heavy chain complementarity determining region 3 for antibody 13881
ARVQVDYSSYGCDS

SEQ ID NO: 27763 - protein, 9 aa, Homo sapiens
  light chain complementarity determining region 3 for antibody 13882
QQSYSTPRT

SEQ ID NO: 27764 - protein, 14 aa, Homo sapiens
  heavy chain complementarity determining region 3 for antibody 13882
ARVQVDYSNYGCDA

SEQ ID NO: 27765 - protein, 9 aa, Homo sapiens
  light chain complementarity determining region 3 for antibody 13883
QQSYSTPRT

SEQ ID NO: 27766 - protein, 14 aa, Homo sapiens
  heavy chain complementarity determining region 3 for antibody 13883
ARVQVDYSNSGCDS

SEQ ID NO: 27767 - protein, 9 aa, Homo sapiens
  light chain complementarity determining region 3 for antibody 13884
QQSYSTPRT

SEQ ID NO: 27768 - protein, 14 aa, Homo sapiens
  heavy chain complementarity determining region 3 for antibody 13884
ARVKVDYSNYGCDS

SEQ ID NO: 27769 - protein, 9 aa, Homo sapiens
  light chain complementarity determining region 3 for antibody 13885
QQSYSTPRT

SEQ ID NO: 27770 - protein, 14 aa, Homo sapiens
  heavy chain complementarity determining region 3 for antibody 13885
ARAQVDYSNYGCDS

SEQ ID NO: 27771 - protein, 9 aa, Homo sapiens
  light chain complementarity determining region 3 for antibody 13886
QQSYSTPRT

SEQ ID NO: 27772 - protein, 15 aa, Homo sapiens
  heavy chain complementarity determining region 3 for antibody 13886
AKDSADEYYGSEFDP

SEQ ID NO: 27773 - protein, 9 aa, Homo sapiens
  light chain complementarity determining region 3 for antibody 13887
QQSYSTPRP

SEQ ID NO: 27774 - protein, 14 aa, Homo sapiens
  heavy chain complementarity determining region 3 for antibody 13887
ARVQVDYSNYGCDS

SEQ ID NO: 27775 - protein, 9 aa, Homo sapiens
  light chain complementarity determining region 3 for antibody 13888
QQSYSTPPT

SEQ ID NO: 27776 - protein, 19 aa, Homo sapiens
  heavy chain complementarity determining region 3 for antibody 13888
ARENGGRGWVSYYYYGMDV

SEQ ID NO: 27777 - protein, 9 aa, Homo sapiens
  light chain complementarity determining region 3 for antibody 13889
QQSYSTPLT

SEQ ID NO: 27778 - protein, 14 aa, Homo sapiens
  heavy chain complementarity determining region 3 for antibody 13889
ARLPGRYPRYGMDV

SEQ ID NO: 27779 - protein, 9 aa, Homo sapiens
  light chain complementarity determining region 3 for antibody 13890
QQSYSTPKT

SEQ ID NO: 27780 - protein, 15 aa, Homo sapiens
  heavy chain complementarity determining region 3 for antibody 13890
ARDYYVSERGYYFDS

SEQ ID NO: 27781 - protein, 9 aa, Homo sapiens
  light chain complementarity determining region 3 for antibody 13891
QQSYSTPIT

SEQ ID NO: 27782 - protein, 14 aa, Homo sapiens
  heavy chain complementarity determining region 3 for antibody 13891
TRFPYGDHVKFFDY

SEQ ID NO: 27783 - protein, 9 aa, Homo sapiens
  light chain complementarity determining region 3 for antibody 13892
QQSYSTPHT

SEQ ID NO: 27784 - protein, 12 aa, Homo sapiens
  heavy chain complementarity determining region 3 for antibody 13892
AVELGYGDIPIA

SEQ ID NO: 27785 - protein, 9 aa, Homo sapiens
  light chain complementarity determining region 3 for antibody 13893
QQSYSTPFT

SEQ ID NO: 27786 - protein, 14 aa, Homo sapiens
  heavy chain complementarity determining region 3 for antibody 13893
ARLPGSYPRHGFDV

SEQ ID NO: 27787 - protein, 9 aa, Homo sapiens
  light chain complementarity determining region 3 for antibody 13894
QQSYSTPFP

SEQ ID NO: 27788 - protein, 14 aa, Homo sapiens
  heavy chain complementarity determining region 3 for antibody 13894
ARLPGRYPRHGFDV

SEQ ID NO: 27789 - protein, 8 aa, Homo sapiens
  light chain complementarity determining region 3 for antibody 13895
QQSYSTLT

SEQ ID NO: 27790 - protein, 11 aa, Homo sapiens
  heavy chain complementarity determining region 3 for antibody 13895
ARHVYYYHLDA

SEQ ID NO: 27791 - protein, 10 aa, Homo sapiens
  light chain complementarity determining region 3 for antibody 13896
QQSYSTLSWT

SEQ ID NO: 27792 - protein, 19 aa, Homo sapiens
  heavy chain complementarity determining region 3 for antibody 13896
ARDKVEGDYAQWDYSGMDV

SEQ ID NO: 27793 - protein, 9 aa, Homo sapiens
  light chain complementarity determining region 3 for antibody 13897
QQSYSTHRT

SEQ ID NO: 27794 - protein, 14 aa, Homo sapiens
  heavy chain complementarity determining region 3 for antibody 13897
ARVQVDYSNYGCDS

SEQ ID NO: 27795 - protein, 9 aa, Homo sapiens
  light chain complementarity determining region 3 for antibody 13898
QQSYSSTWT

SEQ ID NO: 27796 - protein, 23 aa, Homo sapiens
  heavy chain complementarity determining region 3 for antibody 13898
ARGVIGPYASNWYESDYYYGTDV

SEQ ID NO: 27797 - protein, 8 aa, Homo sapiens
  light chain complementarity determining region 3 for antibody 13899
QQSYSSLT

SEQ ID NO: 27798 - protein, 19 aa, Homo sapiens
  heavy chain complementarity determining region 3 for antibody 13899
VRDSLRYVDWIRPTNWFDA

SEQ ID NO: 27799 - protein, 9 aa, Homo sapiens
  light chain complementarity determining region 3 for antibody 13900
QQSYSPPQA

SEQ ID NO: 27800 - protein, 14 aa, Homo sapiens
  heavy chain complementarity determining region 3 for antibody 13900
ARSKEWFLGAAFDY

SEQ ID NO: 27801 - protein, 9 aa, Homo sapiens
  light chain complementarity determining region 3 for antibody 13901
QQSYRVPYS

SEQ ID NO: 27802 - protein, 13 aa, Homo sapiens
  heavy chain complementarity determining region 3 for antibody 13901
ARGSIYGSGKYEY

SEQ ID NO: 27803 - protein, 9 aa, Homo sapiens
  light chain complementarity determining region 3 for antibody 13902
QQSYRPPKA

SEQ ID NO: 27804 - protein, 14 aa, Homo sapiens
  heavy chain complementarity determining region 3 for antibody 13902
ARSKEWFLGAAFDY

SEQ ID NO: 27805 - protein, 8 aa, Homo sapiens
  light chain complementarity determining region 3 for antibody 13903
QQSYRGLS

SEQ ID NO: 27806 - protein, 10 aa, Homo sapiens
  heavy chain complementarity determining region 3 for antibody 13903
AHLSRGVNFF

SEQ ID NO: 27807 - protein, 8 aa, Homo sapiens
  light chain complementarity determining region 3 for antibody 13904
QQSYPALS

SEQ ID NO: 27808 - protein, 10 aa, Homo sapiens
  heavy chain complementarity determining region 3 for antibody 13904
AHLSRGVNFF

SEQ ID NO: 27809 - protein, 9 aa, Homo sapiens
  light chain complementarity determining region 3 for antibody 13905
QQSYNTPYT

SEQ ID NO: 27810 - protein, 17 aa, Homo sapiens
  heavy chain complementarity determining region 3 for antibody 13905
ARGSYYDVDLNRFYFDY

SEQ ID NO: 27811 - protein, 9 aa, Homo sapiens
  light chain complementarity determining region 3 for antibody 13906
QQSYNTPWT

SEQ ID NO: 27812 - protein, 14 aa, Homo sapiens
  heavy chain complementarity determining region 3 for antibody 13906
AAAKVWGYCYGMDV

SEQ ID NO: 27813 - protein, 9 aa, Homo sapiens
  light chain complementarity determining region 3 for antibody 13907
QQSYNLRWT

SEQ ID NO: 27814 - protein, 14 aa, Homo sapiens
  heavy chain complementarity determining region 3 for antibody 13907
ARAGPSGTCSGFDS

SEQ ID NO: 27815 - protein, 9 aa, Homo sapiens
  light chain complementarity determining region 3 for antibody 13908
QQSYITPRT

SEQ ID NO: 27816 - protein, 13 aa, Homo sapiens
  heavy chain complementarity determining region 3 for antibody 13908
ARVYSGGADWFDP

SEQ ID NO: 27817 - protein, 9 aa, Homo sapiens
  light chain complementarity determining region 3 for antibody 13909
QQSYIRRWT

SEQ ID NO: 27818 - protein, 11 aa, Homo sapiens
  heavy chain complementarity determining region 3 for antibody 13909
ARGGGNTWANL

SEQ ID NO: 27819 - protein, 10 aa, Homo sapiens
  light chain complementarity determining region 3 for antibody 13910
QQSYIAHMYT

SEQ ID NO: 27820 - protein, 21 aa, Homo sapiens
  heavy chain complementarity determining region 3 for antibody 13910
ARGYLESLDGDHSHFHYAMDV

SEQ ID NO: 27821 - protein, 9 aa, Homo sapiens
  light chain complementarity determining region 3 for antibody 13911
QQSYGTPFT

SEQ ID NO: 27822 - protein, 14 aa, Homo sapiens
  heavy chain complementarity determining region 3 for antibody 13911
ARLPGRYPRYGMDV

SEQ ID NO: 27823 - protein, 9 aa, Homo sapiens
  light chain complementarity determining region 3 for antibody 13912
QQSYGPPQA

SEQ ID NO: 27824 - protein, 14 aa, Homo sapiens
  heavy chain complementarity determining region 3 for antibody 13912
ARSKEWFLGAAFDY

SEQ ID NO: 27825 - protein, 9 aa, Homo sapiens
  light chain complementarity determining region 3 for antibody 13913
QQSYGLPYP

SEQ ID NO: 27826 - protein, 15 aa, Homo sapiens
  heavy chain complementarity determining region 3 for antibody 13913
ARGGAVRPRYYGMDV

SEQ ID NO: 27827 - protein, 9 aa, Homo sapiens
  light chain complementarity determining region 3 for antibody 13914
QQSYGGPIT

SEQ ID NO: 27828 - protein, 13 aa, Homo sapiens
  heavy chain complementarity determining region 3 for antibody 13914
ARGKDSGSWMFDY

SEQ ID NO: 27829 - protein, 9 aa, Homo sapiens
  light chain complementarity determining region 3 for antibody 13915
QQSNTYPLT

SEQ ID NO: 27830 - protein, 17 aa, Homo sapiens
  heavy chain complementarity determining region 3 for antibody 13915
AKDLSGVHYDIHHGLDV

SEQ ID NO: 27831 - protein, 9 aa, Homo sapiens
  light chain complementarity determining region 3 for antibody 13916
QQSLTVPLT

SEQ ID NO: 27832 - protein, 17 aa, Homo sapiens
  heavy chain complementarity determining region 3 for antibody 13916
TRSIVSGSGWNAGGFDC

SEQ ID NO: 27833 - protein, 9 aa, Homo sapiens
  light chain complementarity determining region 3 for antibody 13917
QQSLTAPPT

SEQ ID NO: 27834 - protein, 17 aa, Homo sapiens
  heavy chain complementarity determining region 3 for antibody 13917
TRSIVSGSGWNAGGFDC

SEQ ID NO: 27835 - protein, 9 aa, Homo sapiens
  light chain complementarity determining region 3 for antibody 13918
QQSLTAPLT

SEQ ID NO: 27836 - protein, 17 aa, Homo sapiens
  heavy chain complementarity determining region 3 for antibody 13918
TRSIVSGSGWNAGGFDR

SEQ ID NO: 27837 - protein, 9 aa, Homo sapiens
  light chain complementarity determining region 3 for antibody 13919
QQSLTAPLT

SEQ ID NO: 27838 - protein, 17 aa, Homo sapiens
  heavy chain complementarity determining region 3 for antibody 13919
TRSIVAGSGWNAGGFDC

SEQ ID NO: 27839 - protein, 9 aa, Homo sapiens
  light chain complementarity determining region 3 for antibody 13920
QQSHSTPNT

SEQ ID NO: 27840 - protein, 17 aa, Homo sapiens
  heavy chain complementarity determining region 3 for antibody 13920
AREIDDSSGYYLPECDY

SEQ ID NO: 27841 - protein, 8 aa, Homo sapiens
  light chain complementarity determining region 3 for antibody 13921
QQSFTSPA

SEQ ID NO: 27842 - protein, 16 aa, Homo sapiens
  heavy chain complementarity determining region 3 for antibody 13921
ARVGTTNMSRYYPMDV

SEQ ID NO: 27843 - protein, 9 aa, Homo sapiens
  light chain complementarity determining region 3 for antibody 13922
QQSFTIPFT

SEQ ID NO: 27844 - protein, 13 aa, Homo sapiens
  heavy chain complementarity determining region 3 for antibody 13922
TTDRCVGFSCADS

SEQ ID NO: 27845 - protein, 9 aa, Homo sapiens
  light chain complementarity determining region 3 for antibody 13923
QQSFSPPWP

SEQ ID NO: 27846 - protein, 19 aa, Homo sapiens
  heavy chain complementarity determining region 3 for antibody 13923
ATMRYGSGELTYDYYGMDV

SEQ ID NO: 27847 - protein, 9 aa, Homo sapiens
  light chain complementarity determining region 3 for antibody 13924
QQSFSPPWA

SEQ ID NO: 27848 - protein, 19 aa, Homo sapiens
  heavy chain complementarity determining region 3 for antibody 13924
ATMRYGSGELTCDYYGMDV

SEQ ID NO: 27849 - protein, 9 aa, Homo sapiens
  light chain complementarity determining region 3 for antibody 13925
QQSFSPPWA

SEQ ID NO: 27850 - protein, 19 aa, Homo sapiens
  heavy chain complementarity determining region 3 for antibody 13925
ATLRYISGERTYDYYGMDV

SEQ ID NO: 27851 - protein, 9 aa, Homo sapiens
  light chain complementarity determining region 3 for antibody 13926
QQSFSPPWA

SEQ ID NO: 27852 - protein, 19 aa, Homo sapiens
  heavy chain complementarity determining region 3 for antibody 13926
ATIRYGSGELTYDYYGMDV

SEQ ID NO: 27853 - protein, 9 aa, Homo sapiens
  light chain complementarity determining region 3 for antibody 13927
QQSFSPPWA

SEQ ID NO: 27854 - protein, 19 aa, Homo sapiens
  heavy chain complementarity determining region 3 for antibody 13927
AAMRYGSGELTYDYYGMDV

SEQ ID NO: 27855 - protein, 9 aa, Homo sapiens
  light chain complementarity determining region 3 for antibody 13928
QQSFSPPGA

SEQ ID NO: 27856 - protein, 19 aa, Homo sapiens
  heavy chain complementarity determining region 3 for antibody 13928
ATMRYGSGELTYDYYGMDV

SEQ ID NO: 27857 - protein, 9 aa, Homo sapiens
  light chain complementarity determining region 3 for antibody 13929
QQSFSKIRT

SEQ ID NO: 27858 - protein, 18 aa, Homo sapiens
  heavy chain complementarity determining region 3 for antibody 13929
ARDSRYCTSPKCYFWFDS

SEQ ID NO: 27859 - protein, 9 aa, Homo sapiens
  light chain complementarity determining region 3 for antibody 13930
QQRYTFPWT

SEQ ID NO: 27860 - protein, 14 aa, Homo sapiens
  heavy chain complementarity determining region 3 for antibody 13930
ATDPPTDGYNSLDF

SEQ ID NO: 27861 - protein, 9 aa, Homo sapiens
  light chain complementarity determining region 3 for antibody 13931
QQRYTALYT

SEQ ID NO: 27862 - protein, 16 aa, Homo sapiens
  heavy chain complementarity determining region 3 for antibody 13931
ARGGYLTSTPYYGMDV

SEQ ID NO: 27863 - protein, 9 aa, Homo sapiens
  light chain complementarity determining region 3 for antibody 13932
QQRYSVPYS

SEQ ID NO: 27864 - protein, 13 aa, Homo sapiens
  heavy chain complementarity determining region 3 for antibody 13932
ARGSIYGSGKYEY

SEQ ID NO: 27865 - protein, 9 aa, Homo sapiens
  light chain complementarity determining region 3 for antibody 13933
QQRYSTPYT

SEQ ID NO: 27866 - protein, 15 aa, Homo sapiens
  heavy chain complementarity determining region 3 for antibody 13933
ARGGAVRPRYYGVDV

SEQ ID NO: 27867 - protein, 9 aa, Homo sapiens
  light chain complementarity determining region 3 for antibody 13934
QQRYSTPFT

SEQ ID NO: 27868 - protein, 14 aa, Homo sapiens
  heavy chain complementarity determining region 3 for antibody 13934
ARLPGRYPRYGMDV

SEQ ID NO: 27869 - protein, 9 aa, Homo sapiens
  light chain complementarity determining region 3 for antibody 13935
QQRYSTPFT

SEQ ID NO: 27870 - protein, 14 aa, Homo sapiens
  heavy chain complementarity determining region 3 for antibody 13935
ARLPGRYPRHGFDV

SEQ ID NO: 27871 - protein, 10 aa, Homo sapiens
  light chain complementarity determining region 3 for antibody 13936
QQRYSTLSWT

SEQ ID NO: 27872 - protein, 19 aa, Homo sapiens
  heavy chain complementarity determining region 3 for antibody 13936
ARDKVEGDYAQWDYYGMDV

SEQ ID NO: 27873 - protein, 9 aa, Homo sapiens
  light chain complementarity determining region 3 for antibody 13937
QQRYSDPLT

SEQ ID NO: 27874 - protein, 13 aa, Homo sapiens
  heavy chain complementarity determining region 3 for antibody 13937
ARGRSDASDALDV

SEQ ID NO: 27875 - protein, 11 aa, Homo sapiens
  light chain complementarity determining region 3 for antibody 13938
QQRYSAPPENT

SEQ ID NO: 27876 - protein, 16 aa, Homo sapiens
  heavy chain complementarity determining region 3 for antibody 13938
AREAGEDYYYKDIFDI

SEQ ID NO: 27877 - protein, 9 aa, Homo sapiens
  light chain complementarity determining region 3 for antibody 13939
QQRYRPPQA

SEQ ID NO: 27878 - protein, 14 aa, Homo sapiens
  heavy chain complementarity determining region 3 for antibody 13939
ARSKEWFLGAAFDY

SEQ ID NO: 27879 - protein, 10 aa, Homo sapiens
  light chain complementarity determining region 3 for antibody 13940
QQRTRWPPLT

SEQ ID NO: 27880 - protein, 12 aa, Homo sapiens
  heavy chain complementarity determining region 3 for antibody 13940
TDTHVTGGDRDY

SEQ ID NO: 27881 - protein, 10 aa, Homo sapiens
  light chain complementarity determining region 3 for antibody 13941
QQRTRWPPLT

SEQ ID NO: 27882 - protein, 12 aa, Homo sapiens
  heavy chain complementarity determining region 3 for antibody 13941
TDAHVTGGDWDY

SEQ ID NO: 27883 - protein, 10 aa, Homo sapiens
  light chain complementarity determining region 3 for antibody 13942
QQRTDWPPFT

SEQ ID NO: 27884 - protein, 19 aa, Homo sapiens
  heavy chain complementarity determining region 3 for antibody 13942
ARQANSSPAKTGGQYYLDS

SEQ ID NO: 27885 - protein, 11 aa, Homo sapiens
  light chain complementarity determining region 3 for antibody 13943
QQRSTWPLSLP

SEQ ID NO: 27886 - protein, 12 aa, Homo sapiens
  heavy chain complementarity determining region 3 for antibody 13943
AKNLGVGTSTDF

SEQ ID NO: 27887 - protein, 10 aa, Homo sapiens
  light chain complementarity determining region 3 for antibody 13944
QQRSTWPIFT

SEQ ID NO: 27888 - protein, 14 aa, Homo sapiens
  heavy chain complementarity determining region 3 for antibody 13944
ARLNKMTRIRYFDS

SEQ ID NO: 27889 - protein, 10 aa, Homo sapiens
  light chain complementarity determining region 3 for antibody 13945
QQRSSWPGTT

SEQ ID NO: 27890 - protein, 14 aa, Homo sapiens
  heavy chain complementarity determining region 3 for antibody 13945
AHSEREWLSGWPDP

SEQ ID NO: 27891 - protein, 8 aa, Homo sapiens
  light chain complementarity determining region 3 for antibody 13946
QQRSPWLT

SEQ ID NO: 27892 - protein, 16 aa, Homo sapiens
  heavy chain complementarity determining region 3 for antibody 13946
ARATDYTGDLPWYFDL

SEQ ID NO: 27893 - protein, 9 aa, Homo sapiens
  light chain complementarity determining region 3 for antibody 13947
QQRSNWRET

SEQ ID NO: 27894 - protein, 15 aa, Homo sapiens
  heavy chain complementarity determining region 3 for antibody 13947
ARGRGGEISRAYSDF

SEQ ID NO: 27895 - protein, 9 aa, Homo sapiens
  light chain complementarity determining region 3 for antibody 13948
QQRSNWPRP

SEQ ID NO: 27896 - protein, 21 aa, Homo sapiens
  heavy chain complementarity determining region 3 for antibody 13948
ARDVTYYHDMSSPQTPSWFDP

SEQ ID NO: 27897 - protein, 9 aa, Homo sapiens
  light chain complementarity determining region 3 for antibody 13949
QQRSNWPPT

SEQ ID NO: 27898 - protein, 16 aa, Homo sapiens
  heavy chain complementarity determining region 3 for antibody 13949
VRDRGADYYYFYGMDV

SEQ ID NO: 27899 - protein, 9 aa, Homo sapiens
  light chain complementarity determining region 3 for antibody 13950
QQRSNWPPT

SEQ ID NO: 27900 - protein, 16 aa, Homo sapiens
  heavy chain complementarity determining region 3 for antibody 13950
VRDRAIDYYYFYGMDV

SEQ ID NO: 27901 - protein, 11 aa, Homo sapiens
  light chain complementarity determining region 3 for antibody 13951
QQRSNWPPSFT

SEQ ID NO: 27902 - protein, 16 aa, Homo sapiens
  heavy chain complementarity determining region 3 for antibody 13951
ARGALVVLVDLNAFDI

SEQ ID NO: 27903 - protein, 11 aa, Homo sapiens
  light chain complementarity determining region 3 for antibody 13952
QQRSNWPPGYT

SEQ ID NO: 27904 - protein, 17 aa, Homo sapiens
  heavy chain complementarity determining region 3 for antibody 13952
AREGAGYGGTPDVAFDI

SEQ ID NO: 27905 - protein, 9 aa, Homo sapiens
  light chain complementarity determining region 3 for antibody 13953
QQRSNWPLT

SEQ ID NO: 27906 - protein, 19 aa, Homo sapiens
  heavy chain complementarity determining region 3 for antibody 13953
ARGARDYGDSGCGVYYFDY

SEQ ID NO: 27907 - protein, 9 aa, Homo sapiens
  light chain complementarity determining region 3 for antibody 13954
QQRSNWPLT

SEQ ID NO: 27908 - protein, 18 aa, Homo sapiens
  heavy chain complementarity determining region 3 for antibody 13954
ARDLGQQLVYGYSYGMDV

SEQ ID NO: 27909 - protein, 9 aa, Homo sapiens
  light chain complementarity determining region 3 for antibody 13955
QQRSNWPLP

SEQ ID NO: 27910 - protein, 17 aa, Homo sapiens
  heavy chain complementarity determining region 3 for antibody 13955
AKASSTPSHRGFYYMDV

SEQ ID NO: 27911 - protein, 10 aa, Homo sapiens
  light chain complementarity determining region 3 for antibody 13956
QQRSNWPIFT

SEQ ID NO: 27912 - protein, 14 aa, Homo sapiens
  heavy chain complementarity determining region 3 for antibody 13956
ARLNKMTRIRYFNS

SEQ ID NO: 27913 - protein, 10 aa, Homo sapiens
  light chain complementarity determining region 3 for antibody 13957
QQRSNWPIFT

SEQ ID NO: 27914 - protein, 14 aa, Homo sapiens
  heavy chain complementarity determining region 3 for antibody 13957
ARLNKMTRIRYFDY

SEQ ID NO: 27915 - protein, 10 aa, Homo sapiens
  light chain complementarity determining region 3 for antibody 13958
QQRSNWPIFT

SEQ ID NO: 27916 - protein, 14 aa, Homo sapiens
  heavy chain complementarity determining region 3 for antibody 13958
ARLNKMTRFRYFDS

SEQ ID NO: 27917 - protein, 10 aa, Homo sapiens
  light chain complementarity determining region 3 for antibody 13959
QQRSNWPIFT

SEQ ID NO: 27918 - protein, 14 aa, Homo sapiens
  heavy chain complementarity determining region 3 for antibody 13959
ARLNKITRIRYFDS

SEQ ID NO: 27919 - protein, 10 aa, Homo sapiens
  light chain complementarity determining region 3 for antibody 13960
QQRSNWPIFT

SEQ ID NO: 27920 - protein, 14 aa, Homo sapiens
  heavy chain complementarity determining region 3 for antibody 13960
ARINKMTRIRYFDS

SEQ ID NO: 27921 - protein, 10 aa, Homo sapiens
  light chain complementarity determining region 3 for antibody 13961
QQRSNWPIFT

SEQ ID NO: 27922 - protein, 22 aa, Homo sapiens
  heavy chain complementarity determining region 3 for antibody 13961
ARHSGYSNTWYMNYYYYYGMDV

SEQ ID NO: 27923 - protein, 8 aa, Homo sapiens
  light chain complementarity determining region 3 for antibody 13962
QQRSNWLT

SEQ ID NO: 27924 - protein, 19 aa, Homo sapiens
  heavy chain complementarity determining region 3 for antibody 13962
ARRFYPDSNGYYGTPLDGP

SEQ ID NO: 27925 - protein, 8 aa, Homo sapiens
  light chain complementarity determining region 3 for antibody 13963
QQRSNWLT

SEQ ID NO: 27926 - protein, 19 aa, Homo sapiens
  heavy chain complementarity determining region 3 for antibody 13963
ARRCYPDSNGYYGTPLDDP

SEQ ID NO: 27927 - protein, 8 aa, Homo sapiens
  light chain complementarity determining region 3 for antibody 13964
QQRSHWLT

SEQ ID NO: 27928 - protein, 16 aa, Homo sapiens
  heavy chain complementarity determining region 3 for antibody 13964
ARATDYSGDLPWYFDL

SEQ ID NO: 27929 - protein, 8 aa, Homo sapiens
  light chain complementarity determining region 3 for antibody 13965
QQRSHWLP

SEQ ID NO: 27930 - protein, 16 aa, Homo sapiens
  heavy chain complementarity determining region 3 for antibody 13965
ARATDYTGDLPWYFDL

SEQ ID NO: 27931 - protein, 8 aa, Homo sapiens
  light chain complementarity determining region 3 for antibody 13966
QQRSHCLT

SEQ ID NO: 27932 - protein, 16 aa, Homo sapiens
  heavy chain complementarity determining region 3 for antibody 13966
ARATDYTGDLPWYFDL

SEQ ID NO: 27933 - protein, 9 aa, Homo sapiens
  light chain complementarity determining region 3 for antibody 13967
QQRSGWPST

SEQ ID NO: 27934 - protein, 16 aa, Homo sapiens
  heavy chain complementarity determining region 3 for antibody 13967
ARVFYGSGPNANWFDP

SEQ ID NO: 27935 - protein, 9 aa, Homo sapiens
  light chain complementarity determining region 3 for antibody 13968
QQRSGWPPT

SEQ ID NO: 27936 - protein, 16 aa, Homo sapiens
  heavy chain complementarity determining region 3 for antibody 13968
ARVSYGSGPNANWFDP

SEQ ID NO: 27937 - protein, 9 aa, Homo sapiens
  light chain complementarity determining region 3 for antibody 13969
QQRSGWPPT

SEQ ID NO: 27938 - protein, 16 aa, Homo sapiens
  heavy chain complementarity determining region 3 for antibody 13969
ARVFYGSGTNANWFDP

SEQ ID NO: 27939 - protein, 9 aa, Homo sapiens
  light chain complementarity determining region 3 for antibody 13970
QQRSGWPPT

SEQ ID NO: 27940 - protein, 16 aa, Homo sapiens
  heavy chain complementarity determining region 3 for antibody 13970
ARVFYGSGPNASWFDP

SEQ ID NO: 27941 - protein, 9 aa, Homo sapiens
  light chain complementarity determining region 3 for antibody 13971
QQRRGWPPT

SEQ ID NO: 27942 - protein, 16 aa, Homo sapiens
  heavy chain complementarity determining region 3 for antibody 13971
ARVFYGSGPNANWFDP

SEQ ID NO: 27943 - protein, 9 aa, Homo sapiens
  light chain complementarity determining region 3 for antibody 13972
QQRRDWPIT

SEQ ID NO: 27944 - protein, 10 aa, Homo sapiens
  heavy chain complementarity determining region 3 for antibody 13972
ARDADRKDDF

SEQ ID NO: 27945 - protein, 9 aa, Homo sapiens
  light chain complementarity determining region 3 for antibody 13973
QQRNNWGPT

SEQ ID NO: 27946 - protein, 22 aa, Homo sapiens
  heavy chain complementarity determining region 3 for antibody 13973
ARHSGYSNTWYMNYYYYYGMDV

SEQ ID NO: 27947 - protein, 9 aa, Homo sapiens
  light chain complementarity determining region 3 for antibody 13974
QQRNNWGLT

SEQ ID NO: 27948 - protein, 22 aa, Homo sapiens
  heavy chain complementarity determining region 3 for antibody 13974
ARHSGYSNTWYMSYYYYYGMDV

SEQ ID NO: 27949 - protein, 9 aa, Homo sapiens
  light chain complementarity determining region 3 for antibody 13975
QQRNNWGLT

SEQ ID NO: 27950 - protein, 22 aa, Homo sapiens
  heavy chain complementarity determining region 3 for antibody 13975
ARHSGYSNTWYMNYYYYYGIDV

SEQ ID NO: 27951 - protein, 9 aa, Homo sapiens
  light chain complementarity determining region 3 for antibody 13976
QQRNNWGLT

SEQ ID NO: 27952 - protein, 22 aa, Homo sapiens
  heavy chain complementarity determining region 3 for antibody 13976
ARHSGYSNTWYMNYYYCYGMDV

SEQ ID NO: 27953 - protein, 9 aa, Homo sapiens
  light chain complementarity determining region 3 for antibody 13977
QQRNNWGLT

SEQ ID NO: 27954 - protein, 22 aa, Homo sapiens
  heavy chain complementarity determining region 3 for antibody 13977
ARHSGYSNTRYMNYYYYYGMDV

SEQ ID NO: 27955 - protein, 9 aa, Homo sapiens
  light chain complementarity determining region 3 for antibody 13978
QQRNNWGFT

SEQ ID NO: 27956 - protein, 22 aa, Homo sapiens
  heavy chain complementarity determining region 3 for antibody 13978
ARHSGYSNTWYMNYYYYYGMDV

SEQ ID NO: 27957 - protein, 9 aa, Homo sapiens
  light chain complementarity determining region 3 for antibody 13979
QQRHSLPFT

SEQ ID NO: 27958 - protein, 19 aa, Homo sapiens
  heavy chain complementarity determining region 3 for antibody 13979
ARSDYSGDTDRYYDYGMDV

SEQ ID NO: 27959 - protein, 10 aa, Homo sapiens
  light chain complementarity determining region 3 for antibody 13980
QQRGNWPPIT

SEQ ID NO: 27960 - protein, 18 aa, Homo sapiens
  heavy chain complementarity determining region 3 for antibody 13980
AKDLAPSMRVVAQGALGI

SEQ ID NO: 27961 - protein, 10 aa, Homo sapiens
  light chain complementarity determining region 3 for antibody 13981
QQRGNWPPIT

SEQ ID NO: 27962 - protein, 18 aa, Homo sapiens
  heavy chain complementarity determining region 3 for antibody 13981
AKDLAPSMGVVAQGALDI

SEQ ID NO: 27963 - protein, 9 aa, Homo sapiens
  light chain complementarity determining region 3 for antibody 13982
QQRGNWLWT

SEQ ID NO: 27964 - protein, 12 aa, Homo sapiens
  heavy chain complementarity determining region 3 for antibody 13982
ATTRSPPDGLDV

SEQ ID NO: 27965 - protein, 9 aa, Homo sapiens
  light chain complementarity determining region 3 for antibody 13983
QQRGGWPPT

SEQ ID NO: 27966 - protein, 16 aa, Homo sapiens
  heavy chain complementarity determining region 3 for antibody 13983
AAGVKAYRRAVRYFDY

SEQ ID NO: 27967 - protein, 9 aa, Homo sapiens
  light chain complementarity determining region 3 for antibody 13984
QQRGGWPLS

SEQ ID NO: 27968 - protein, 16 aa, Homo sapiens
  heavy chain complementarity determining region 3 for antibody 13984
AAGVKAYRRAVRYFDY

SEQ ID NO: 27969 - protein, 9 aa, Homo sapiens
  light chain complementarity determining region 3 for antibody 13985
QQRGGGPPT

SEQ ID NO: 27970 - protein, 16 aa, Homo sapiens
  heavy chain complementarity determining region 3 for antibody 13985
AAGVKAYRRAVRYFDY

SEQ ID NO: 27971 - protein, 9 aa, Homo sapiens
  light chain complementarity determining region 3 for antibody 13986
QQRGGGPPA

SEQ ID NO: 27972 - protein, 16 aa, Homo sapiens
  heavy chain complementarity determining region 3 for antibody 13986
AAGVKAYRRAVRYFDY

SEQ ID NO: 27973 - protein, 9 aa, Homo sapiens
  light chain complementarity determining region 3 for antibody 13987
QQRGGGAPA

SEQ ID NO: 27974 - protein, 16 aa, Homo sapiens
  heavy chain complementarity determining region 3 for antibody 13987
AAGVKAYRRAVRYFDY

SEQ ID NO: 27975 - protein, 9 aa, Homo sapiens
  light chain complementarity determining region 3 for antibody 13988
QQRGGGALT

SEQ ID NO: 27976 - protein, 16 aa, Homo sapiens
  heavy chain complementarity determining region 3 for antibody 13988
AAGVKAYRRAVRYFDY

SEQ ID NO: 27977 - protein, 9 aa, Homo sapiens
  light chain complementarity determining region 3 for antibody 13989
QQRGGGALA

SEQ ID NO: 27978 - protein, 16 aa, Homo sapiens
  heavy chain complementarity determining region 3 for antibody 13989
AAGVKAYRRAVRYFDY

SEQ ID NO: 27979 - protein, 10 aa, Homo sapiens
  light chain complementarity determining region 3 for antibody 13990
QQRFSPPSLT

SEQ ID NO: 27980 - protein, 10 aa, Homo sapiens
  heavy chain complementarity determining region 3 for antibody 13990
ARDWGWGFDP

SEQ ID NO: 27981 - protein, 11 aa, Homo sapiens
  light chain complementarity determining region 3 for antibody 13991
QQRDNWPPLYA

SEQ ID NO: 27982 - protein, 14 aa, Homo sapiens
  heavy chain complementarity determining region 3 for antibody 13991
ARGPNYKDPRLHDY

SEQ ID NO: 27983 - protein, 9 aa, Homo sapiens
  light chain complementarity determining region 3 for antibody 13992
QQQYSGQWT

SEQ ID NO: 27984 - protein, 15 aa, Homo sapiens
  heavy chain complementarity determining region 3 for antibody 13992
AKEGCSGGICYGFDV

SEQ ID NO: 27985 - protein, 9 aa, Homo sapiens
  light chain complementarity determining region 3 for antibody 13993
QQPDSLPLT

SEQ ID NO: 27986 - protein, 13 aa, Homo sapiens
  heavy chain complementarity determining region 3 for antibody 13993
ARDLGGNYYILDL

SEQ ID NO: 27987 - protein, 10 aa, Homo sapiens
  light chain complementarity determining region 3 for antibody 13994
QQNYSSPPPT

SEQ ID NO: 27988 - protein, 17 aa, Homo sapiens
  heavy chain complementarity determining region 3 for antibody 13994
ARLTPYTSNWNPFYCDY

SEQ ID NO: 27989 - protein, 9 aa, Homo sapiens
  light chain complementarity determining region 3 for antibody 13995
QQNYNTPST

SEQ ID NO: 27990 - protein, 20 aa, Homo sapiens
  heavy chain complementarity determining region 3 for antibody 13995
TTDDILLVPADPRDDNWVDP

SEQ ID NO: 27991 - protein, 9 aa, Homo sapiens
  light chain complementarity determining region 3 for antibody 13996
QQNYNTPRT

SEQ ID NO: 27992 - protein, 20 aa, Homo sapiens
  heavy chain complementarity determining region 3 for antibody 13996
TTDDSLLVPADPRDDNWVDP

SEQ ID NO: 27993 - protein, 10 aa, Homo sapiens
  light chain complementarity determining region 3 for antibody 13997
QQNVPSHKYT

SEQ ID NO: 27994 - protein, 22 aa, Homo sapiens
  heavy chain complementarity determining region 3 for antibody 13997
ARHSPFLEMLGERWLQFGAFDI

SEQ ID NO: 27995 - protein, 9 aa, Homo sapiens
  light chain complementarity determining region 3 for antibody 13998
QQNSTFPYT

SEQ ID NO: 27996 - protein, 17 aa, Homo sapiens
  heavy chain complementarity determining region 3 for antibody 13998
AREDWNDVDLRQFYFDY

SEQ ID NO: 27997 - protein, 9 aa, Homo sapiens
  light chain complementarity determining region 3 for antibody 13999
QQNNGRSLT

SEQ ID NO: 27998 - protein, 11 aa, Homo sapiens
  heavy chain complementarity determining region 3 for antibody 13999
ARIQQLGALAH

SEQ ID NO: 27999 - protein, 9 aa, Homo sapiens
  light chain complementarity determining region 3 for antibody 14000
QQNGSSRYT

SEQ ID NO: 28000 - protein, 23 aa, Homo sapiens
  heavy chain complementarity determining region 3 for antibody 14000
ARVGCSGEKCSSMSGYYYYPLDV

SEQ ID NO: 28001 - protein, 9 aa, Homo sapiens
  light chain complementarity determining region 3 for antibody 14001
QQNDSFPYT

SEQ ID NO: 28002 - protein, 17 aa, Homo sapiens
  heavy chain complementarity determining region 3 for antibody 14001
AREDWSDVDLRAFYFDS

SEQ ID NO: 28003 - protein, 10 aa, Homo sapiens
  light chain complementarity determining region 3 for antibody 14002
QQNDNLPPFT

SEQ ID NO: 28004 - protein, 16 aa, Homo sapiens
  heavy chain complementarity determining region 3 for antibody 14002
ARELFKGEYDYYAMDV

SEQ ID NO: 28005 - protein, 8 aa, Homo sapiens
  light chain complementarity determining region 3 for antibody 14003
QQLSSYPA

SEQ ID NO: 28006 - protein, 23 aa, Homo sapiens
  heavy chain complementarity determining region 3 for antibody 14003
SHIAVTSRDVPLGTHYYYYGMDV

SEQ ID NO: 28007 - protein, 9 aa, Homo sapiens
  light chain complementarity determining region 3 for antibody 14004
QQLSIYPLA

SEQ ID NO: 28008 - protein, 17 aa, Homo sapiens
  heavy chain complementarity determining region 3 for antibody 14004
ARGGNPSGNHYYYGLDV

SEQ ID NO: 28009 - protein, 10 aa, Homo sapiens
  light chain complementarity determining region 3 for antibody 14005
QQLNTYPPIT

SEQ ID NO: 28010 - protein, 14 aa, Homo sapiens
  heavy chain complementarity determining region 3 for antibody 14005
AGDADTPHRRSFDV

SEQ ID NO: 28011 - protein, 9 aa, Homo sapiens
  light chain complementarity determining region 3 for antibody 14006
QQLNTYPLT

SEQ ID NO: 28012 - protein, 18 aa, Homo sapiens
  heavy chain complementarity determining region 3 for antibody 14006
VRGSGAPVGLYYYYAMDV

SEQ ID NO: 28013 - protein, 10 aa, Homo sapiens
  light chain complementarity determining region 3 for antibody 14007
QQLNSYPRFT

SEQ ID NO: 28014 - protein, 16 aa, Homo sapiens
  heavy chain complementarity determining region 3 for antibody 14007
ARGGTYASVYYYGMDV

SEQ ID NO: 28015 - protein, 11 aa, Homo sapiens
  light chain complementarity determining region 3 for antibody 14008
QQLNDFTRGIT

SEQ ID NO: 28016 - protein, 17 aa, Homo sapiens
  heavy chain complementarity determining region 3 for antibody 14008
ARERQCCSHLSCYGEDY

SEQ ID NO: 28017 - protein, 9 aa, Homo sapiens
  light chain complementarity determining region 3 for antibody 14009
QQLHGYTLT

SEQ ID NO: 28018 - protein, 21 aa, Homo sapiens
  heavy chain complementarity determining region 3 for antibody 14009
ARDWAQSNGYPVGHYYYGMDV

SEQ ID NO: 28019 - protein, 9 aa, Homo sapiens
  light chain complementarity determining region 3 for antibody 14010
QQLHGYPLT

SEQ ID NO: 28020 - protein, 21 aa, Homo sapiens
  heavy chain complementarity determining region 3 for antibody 14010
ARDWAQSNGYPVGHYYYGRDV

SEQ ID NO: 28021 - protein, 9 aa, Homo sapiens
  light chain complementarity determining region 3 for antibody 14011
QQLHGYPLT

SEQ ID NO: 28022 - protein, 21 aa, Homo sapiens
  heavy chain complementarity determining region 3 for antibody 14011
ARDWAQSNGYPAGHYYYGMDV

SEQ ID NO: 28023 - protein, 9 aa, Homo sapiens
  light chain complementarity determining region 3 for antibody 14012
QQLHGYPLT

SEQ ID NO: 28024 - protein, 21 aa, Homo sapiens
  heavy chain complementarity determining region 3 for antibody 14012
ARDWAQSKGYPVGHYYYGMDV

SEQ ID NO: 28025 - protein, 9 aa, Homo sapiens
  light chain complementarity determining region 3 for antibody 14013
QQLHGYPLT

SEQ ID NO: 28026 - protein, 21 aa, Homo sapiens
  heavy chain complementarity determining region 3 for antibody 14013
ARDWAQSDGYPVGHYYYGMDV

SEQ ID NO: 28027 - protein, 9 aa, Homo sapiens
  light chain complementarity determining region 3 for antibody 14014
QQLHGYPLT

SEQ ID NO: 28028 - protein, 21 aa, Homo sapiens
  heavy chain complementarity determining region 3 for antibody 14014
ARDWAKSNGYPVGHYYYGMDV

SEQ ID NO: 28029 - protein, 9 aa, Homo sapiens
  light chain complementarity determining region 3 for antibody 14015
QQLHGYPLP

SEQ ID NO: 28030 - protein, 11 aa, Homo sapiens
  heavy chain complementarity determining region 3 for antibody 14015
AKDTQWQPFDH

SEQ ID NO: 28031 - protein, 9 aa, Homo sapiens
  light chain complementarity determining region 3 for antibody 14016
QQLHGSPLT

SEQ ID NO: 28032 - protein, 21 aa, Homo sapiens
  heavy chain complementarity determining region 3 for antibody 14016
ARDWAQSNGYPVGHYYYGMDV

SEQ ID NO: 28033 - protein, 10 aa, Homo sapiens
  light chain complementarity determining region 3 for antibody 14017
QQLADYPPYT

SEQ ID NO: 28034 - protein, 13 aa, Homo sapiens
  heavy chain complementarity determining region 3 for antibody 14017
ARGRDGVHRYFDV

SEQ ID NO: 28035 - protein, 9 aa, Homo sapiens
  light chain complementarity determining region 3 for antibody 14018
QQIHGYPLT

SEQ ID NO: 28036 - protein, 21 aa, Homo sapiens
  heavy chain complementarity determining region 3 for antibody 14018
ARDWAQSNGYPVGHYYYGMDV

SEQ ID NO: 28037 - protein, 9 aa, Homo sapiens
  light chain complementarity determining region 3 for antibody 14019
QQIDIVALT

SEQ ID NO: 28038 - protein, 10 aa, Homo sapiens
  heavy chain complementarity determining region 3 for antibody 14019
ASGRGWESSI

SEQ ID NO: 28039 - protein, 9 aa, Homo sapiens
  light chain complementarity determining region 3 for antibody 14020
QQHNTYPYT

SEQ ID NO: 28040 - protein, 19 aa, Homo sapiens
  heavy chain complementarity determining region 3 for antibody 14020
ARDQSSSYGDYYYYYGMDV

SEQ ID NO: 28041 - protein, 9 aa, Homo sapiens
  light chain complementarity determining region 3 for antibody 14021
QQHNSYPRT

SEQ ID NO: 28042 - protein, 19 aa, Homo sapiens
  heavy chain complementarity determining region 3 for antibody 14021
ARDSPSVRKRPTEYYGMDV

SEQ ID NO: 28043 - protein, 9 aa, Homo sapiens
  light chain complementarity determining region 3 for antibody 14022
QQHNSFPWT

SEQ ID NO: 28044 - protein, 17 aa, Homo sapiens
  heavy chain complementarity determining region 3 for antibody 14022
ARRSGLYYFDAHNYYDF

SEQ ID NO: 28045 - protein, 9 aa, Homo sapiens
  light chain complementarity determining region 3 for antibody 14023
QQHHSYPLT

SEQ ID NO: 28046 - protein, 15 aa, Homo sapiens
  heavy chain complementarity determining region 3 for antibody 14023
ARGGIHYDILTGLDY

SEQ ID NO: 28047 - protein, 9 aa, Homo sapiens
  light chain complementarity determining region 3 for antibody 14024
QQHGTSPLT

SEQ ID NO: 28048 - protein, 16 aa, Homo sapiens
  heavy chain complementarity determining region 3 for antibody 14024
ARWGAVPESRKNCFDY

SEQ ID NO: 28049 - protein, 9 aa, Homo sapiens
  light chain complementarity determining region 3 for antibody 14025
QQHGSSPRT

SEQ ID NO: 28050 - protein, 17 aa, Homo sapiens
  heavy chain complementarity determining region 3 for antibody 14025
ARDDFVSDRIFYKGMDV

SEQ ID NO: 28051 - protein, 10 aa, Homo sapiens
  light chain complementarity determining region 3 for antibody 14026
QQHGDSPLVT

SEQ ID NO: 28052 - protein, 16 aa, Homo sapiens
  heavy chain complementarity determining region 3 for antibody 14026
TRRIVGTWLVPYYFDY

SEQ ID NO: 28053 - protein, 10 aa, Homo sapiens
  light chain complementarity determining region 3 for antibody 14027
QQHFNWPLIT

SEQ ID NO: 28054 - protein, 15 aa, Homo sapiens
  heavy chain complementarity determining region 3 for antibody 14027
ASMFEFDSGTYYSNY

SEQ ID NO: 28055 - protein, 9 aa, Homo sapiens
  light chain complementarity determining region 3 for antibody 14028
QQHESVPPT

SEQ ID NO: 28056 - protein, 20 aa, Homo sapiens
  heavy chain complementarity determining region 3 for antibody 14028
AKDRPVDTSMDDYYYHGMDV

SEQ ID NO: 28057 - protein, 9 aa, Homo sapiens
  light chain complementarity determining region 3 for antibody 14029
QQHESVPLT

SEQ ID NO: 28058 - protein, 20 aa, Homo sapiens
  heavy chain complementarity determining region 3 for antibody 14029
AKDRPVDTSMDDYYCHGMDV

SEQ ID NO: 28059 - protein, 9 aa, Homo sapiens
  light chain complementarity determining region 3 for antibody 14030
QQGYSTPFT

SEQ ID NO: 28060 - protein, 14 aa, Homo sapiens
  heavy chain complementarity determining region 3 for antibody 14030
ARLPGRYPRYGMDV

SEQ ID NO: 28061 - protein, 9 aa, Homo sapiens
  light chain complementarity determining region 3 for antibody 14031
QQGYSFPFT

SEQ ID NO: 28062 - protein, 19 aa, Homo sapiens
  heavy chain complementarity determining region 3 for antibody 14031
ARSDYSGDTDRYYDHGIDV

SEQ ID NO: 28063 - protein, 9 aa, Homo sapiens
  light chain complementarity determining region 3 for antibody 14032
QQGYNLPYP

SEQ ID NO: 28064 - protein, 18 aa, Homo sapiens
  heavy chain complementarity determining region 3 for antibody 14032
ARLYGYDSAAYFFTHFDY

SEQ ID NO: 28065 - protein, 9 aa, Homo sapiens
  light chain complementarity determining region 3 for antibody 14033
QQGTSFPFT

SEQ ID NO: 28066 - protein, 19 aa, Homo sapiens
  heavy chain complementarity determining region 3 for antibody 14033
ARTDCSGDTDRYYDFGMDV

SEQ ID NO: 28067 - protein, 9 aa, Homo sapiens
  light chain complementarity determining region 3 for antibody 14034
QQGSYWPPP

SEQ ID NO: 28068 - protein, 15 aa, Homo sapiens
  heavy chain complementarity determining region 3 for antibody 14034
AHYRNGWYSEPIYDY

SEQ ID NO: 28069 - protein, 9 aa, Homo sapiens
  light chain complementarity determining region 3 for antibody 14035
QQGNSVPWT

SEQ ID NO: 28070 - protein, 17 aa, Homo sapiens
  heavy chain complementarity determining region 3 for antibody 14035
ARVHDSSNYHVAEYLQY

SEQ ID NO: 28071 - protein, 9 aa, Homo sapiens
  light chain complementarity determining region 3 for antibody 14036
QQGNSVPCT

SEQ ID NO: 28072 - protein, 17 aa, Homo sapiens
  heavy chain complementarity determining region 3 for antibody 14036
ARVHDSSNYHVAEYFQY

SEQ ID NO: 28073 - protein, 9 aa, Homo sapiens
  light chain complementarity determining region 3 for antibody 14037
QQGNSFPWT

SEQ ID NO: 28074 - protein, 17 aa, Homo sapiens
  heavy chain complementarity determining region 3 for antibody 14037
ARVHDSSNYYVAEYFHY

SEQ ID NO: 28075 - protein, 9 aa, Homo sapiens
  light chain complementarity determining region 3 for antibody 14038
QQGNSFPGT

SEQ ID NO: 28076 - protein, 17 aa, Homo sapiens
  heavy chain complementarity determining region 3 for antibody 14038
ARVHDSSNYYVAEYFQY

SEQ ID NO: 28077 - protein, 9 aa, Homo sapiens
  light chain complementarity determining region 3 for antibody 14039
QQGNSFPFT

SEQ ID NO: 28078 - protein, 19 aa, Homo sapiens
  heavy chain complementarity determining region 3 for antibody 14039
ARTDCSGDTDRYYDFGMGV

SEQ ID NO: 28079 - protein, 9 aa, Homo sapiens
  light chain complementarity determining region 3 for antibody 14040
QQGNSFPFT

SEQ ID NO: 28080 - protein, 19 aa, Homo sapiens
  heavy chain complementarity determining region 3 for antibody 14040
ARTDCSGDTDRYYDFGMEV

SEQ ID NO: 28081 - protein, 9 aa, Homo sapiens
  light chain complementarity determining region 3 for antibody 14041
QQGHSLPFT

SEQ ID NO: 28082 - protein, 19 aa, Homo sapiens
  heavy chain complementarity determining region 3 for antibody 14041
ARSDYSGDTDRYYDYGMGV

SEQ ID NO: 28083 - protein, 9 aa, Homo sapiens
  light chain complementarity determining region 3 for antibody 14042
QQGHSLPFT

SEQ ID NO: 28084 - protein, 19 aa, Homo sapiens
  heavy chain complementarity determining region 3 for antibody 14042
ARSDYSGDPDRYYDYGMDV

SEQ ID NO: 28085 - protein, 9 aa, Homo sapiens
  light chain complementarity determining region 3 for antibody 14043
QQGHSLPFP

SEQ ID NO: 28086 - protein, 19 aa, Homo sapiens
  heavy chain complementarity determining region 3 for antibody 14043
ARSDYSGETDRYYDYGLDV

SEQ ID NO: 28087 - protein, 9 aa, Homo sapiens
  light chain complementarity determining region 3 for antibody 14044
QQGHSFPFT

SEQ ID NO: 28088 - protein, 19 aa, Homo sapiens
  heavy chain complementarity determining region 3 for antibody 14044
ARSDYSGGTDRYYDYGMDV

SEQ ID NO: 28089 - protein, 9 aa, Homo sapiens
  light chain complementarity determining region 3 for antibody 14045
QQGDSLPFT

SEQ ID NO: 28090 - protein, 19 aa, Homo sapiens
  heavy chain complementarity determining region 3 for antibody 14045
ARSDYSGDTDRYYDSGMDV

SEQ ID NO: 28091 - protein, 9 aa, Homo sapiens
  light chain complementarity determining region 3 for antibody 14046
QQGDSLPFT

SEQ ID NO: 28092 - protein, 19 aa, Homo sapiens
  heavy chain complementarity determining region 3 for antibody 14046
ARSDYSGDADRYYDYGMDV

SEQ ID NO: 28093 - protein, 9 aa, Homo sapiens
  light chain complementarity determining region 3 for antibody 14047
QQFSPYSCS

SEQ ID NO: 28094 - protein, 13 aa, Homo sapiens
  heavy chain complementarity determining region 3 for antibody 14047
VRIGAAAGTAFDY

SEQ ID NO: 28095 - protein, 9 aa, Homo sapiens
  light chain complementarity determining region 3 for antibody 14048
QQFSNLPRT

SEQ ID NO: 28096 - protein, 13 aa, Homo sapiens
  heavy chain complementarity determining region 3 for antibody 14048
AKEGSSPGPDFDS

SEQ ID NO: 28097 - protein, 9 aa, Homo sapiens
  light chain complementarity determining region 3 for antibody 14049
QQFQSYPIT

SEQ ID NO: 28098 - protein, 16 aa, Homo sapiens
  heavy chain complementarity determining region 3 for antibody 14049
ARTQGTRDYYYYAMDV

SEQ ID NO: 28099 - protein, 9 aa, Homo sapiens
  light chain complementarity determining region 3 for antibody 14050
QQFNTYPLT

SEQ ID NO: 28100 - protein, 17 aa, Homo sapiens
  heavy chain complementarity determining region 3 for antibody 14050
AKDRSGVHYDIHHGLDV

SEQ ID NO: 28101 - protein, 9 aa, Homo sapiens
  light chain complementarity determining region 3 for antibody 14051
QQFNTYPLT

SEQ ID NO: 28102 - protein, 17 aa, Homo sapiens
  heavy chain complementarity determining region 3 for antibody 14051
AKDPSGVHYDIHHGLDV

SEQ ID NO: 28103 - protein, 9 aa, Homo sapiens
  light chain complementarity determining region 3 for antibody 14052
QQFNTYPLT

SEQ ID NO: 28104 - protein, 17 aa, Homo sapiens
  heavy chain complementarity determining region 3 for antibody 14052
AKDLSRVHYDIHHGLDV

SEQ ID NO: 28105 - protein, 9 aa, Homo sapiens
  light chain complementarity determining region 3 for antibody 14053
QQFNTYPLT

SEQ ID NO: 28106 - protein, 17 aa, Homo sapiens
  heavy chain complementarity determining region 3 for antibody 14053
AKDLSGVHYDIHHGSDV

SEQ ID NO: 28107 - protein, 9 aa, Homo sapiens
  light chain complementarity determining region 3 for antibody 14054
QQFNTYPLI

SEQ ID NO: 28108 - protein, 17 aa, Homo sapiens
  heavy chain complementarity determining region 3 for antibody 14054
AKDLSGVHYDIHHGLDV

SEQ ID NO: 28109 - protein, 9 aa, Homo sapiens
  light chain complementarity determining region 3 for antibody 14055
QQFNTYPIT

SEQ ID NO: 28110 - protein, 17 aa, Homo sapiens
  heavy chain complementarity determining region 3 for antibody 14055
AKDLSGVHYDIHHGLDV

SEQ ID NO: 28111 - protein, 9 aa, Homo sapiens
  light chain complementarity determining region 3 for antibody 14056
QQFNTYHLT

SEQ ID NO: 28112 - protein, 17 aa, Homo sapiens
  heavy chain complementarity determining region 3 for antibody 14056
AKDLSGVHYDIHHGLDV

SEQ ID NO: 28113 - protein, 9 aa, Homo sapiens
  light chain complementarity determining region 3 for antibody 14057
QQFNSYPWT

SEQ ID NO: 28114 - protein, 14 aa, Homo sapiens
  heavy chain complementarity determining region 3 for antibody 14057
ARDFSNYVHNGFDI

SEQ ID NO: 28115 - protein, 9 aa, Homo sapiens
  light chain complementarity determining region 3 for antibody 14058
QQFNSYPLT

SEQ ID NO: 28116 - protein, 11 aa, Homo sapiens
  heavy chain complementarity determining region 3 for antibody 14058
ARGIPRYYFDY

SEQ ID NO: 28117 - protein, 9 aa, Homo sapiens
  light chain complementarity determining region 3 for antibody 14059
QQFNSYPIT

SEQ ID NO: 28118 - protein, 16 aa, Homo sapiens
  heavy chain complementarity determining region 3 for antibody 14059
ARTQGTRDYYYYAMDV

SEQ ID NO: 28119 - protein, 9 aa, Homo sapiens
  light chain complementarity determining region 3 for antibody 14060
QQFNSYLCT

SEQ ID NO: 28120 - protein, 17 aa, Homo sapiens
  heavy chain complementarity determining region 3 for antibody 14060
ATSYCDNARCFPVGSDY

SEQ ID NO: 28121 - protein, 9 aa, Homo sapiens
  light chain complementarity determining region 3 for antibody 14061
QQFNNYPQT

SEQ ID NO: 28122 - protein, 11 aa, Homo sapiens
  heavy chain complementarity determining region 3 for antibody 14061
AREATRGYRQN

SEQ ID NO: 28123 - protein, 9 aa, Homo sapiens
  light chain complementarity determining region 3 for antibody 14062
QQFHSYSIT

SEQ ID NO: 28124 - protein, 16 aa, Homo sapiens
  heavy chain complementarity determining region 3 for antibody 14062
ARTQGTRDYYYYAMDV

SEQ ID NO: 28125 - protein, 9 aa, Homo sapiens
  light chain complementarity determining region 3 for antibody 14063
QQFHSYQIT

SEQ ID NO: 28126 - protein, 16 aa, Homo sapiens
  heavy chain complementarity determining region 3 for antibody 14063
ARTQGTRDYYYYAMDV

SEQ ID NO: 28127 - protein, 9 aa, Homo sapiens
  light chain complementarity determining region 3 for antibody 14064
QQFHSYPIT

SEQ ID NO: 28128 - protein, 16 aa, Homo sapiens
  heavy chain complementarity determining region 3 for antibody 14064
ARTQSTRDYYYYAMDV

SEQ ID NO: 28129 - protein, 9 aa, Homo sapiens
  light chain complementarity determining region 3 for antibody 14065
QQFHSYPIT

SEQ ID NO: 28130 - protein, 16 aa, Homo sapiens
  heavy chain complementarity determining region 3 for antibody 14065
ARTQGTRGYYYYAMDV

SEQ ID NO: 28131 - protein, 9 aa, Homo sapiens
  light chain complementarity determining region 3 for antibody 14066
QQFHSYPIT

SEQ ID NO: 28132 - protein, 16 aa, Homo sapiens
  heavy chain complementarity determining region 3 for antibody 14066
ARTQGTRDYYYYAVDV

SEQ ID NO: 28133 - protein, 9 aa, Homo sapiens
  light chain complementarity determining region 3 for antibody 14067
QQFHSYPIT

SEQ ID NO: 28134 - protein, 16 aa, Homo sapiens
  heavy chain complementarity determining region 3 for antibody 14067
ARTQGTRDYYYYAMEV

SEQ ID NO: 28135 - protein, 9 aa, Homo sapiens
  light chain complementarity determining region 3 for antibody 14068
QQFHSYPIT

SEQ ID NO: 28136 - protein, 16 aa, Homo sapiens
  heavy chain complementarity determining region 3 for antibody 14068
ARTQGTRDYYYYAMDI

SEQ ID NO: 28137 - protein, 9 aa, Homo sapiens
  light chain complementarity determining region 3 for antibody 14069
QQFHSYPIT

SEQ ID NO: 28138 - protein, 16 aa, Homo sapiens
  heavy chain complementarity determining region 3 for antibody 14069
ARTQGTRDYYYYAIDV

SEQ ID NO: 28139 - protein, 9 aa, Homo sapiens
  light chain complementarity determining region 3 for antibody 14070
QQFHSYPIT

SEQ ID NO: 28140 - protein, 16 aa, Homo sapiens
  heavy chain complementarity determining region 3 for antibody 14070
ARTQGTRDYYYDAMDV

SEQ ID NO: 28141 - protein, 9 aa, Homo sapiens
  light chain complementarity determining region 3 for antibody 14071
QQFHSYPIT

SEQ ID NO: 28142 - protein, 16 aa, Homo sapiens
  heavy chain complementarity determining region 3 for antibody 14071
ARTQGTRDYYHYAMDV

SEQ ID NO: 28143 - protein, 9 aa, Homo sapiens
  light chain complementarity determining region 3 for antibody 14072
QQFHSYPIT

SEQ ID NO: 28144 - protein, 16 aa, Homo sapiens
  heavy chain complementarity determining region 3 for antibody 14072
ARTQGTRDYYDYAMDV

SEQ ID NO: 28145 - protein, 9 aa, Homo sapiens
  light chain complementarity determining region 3 for antibody 14073
QQFHSYPIT

SEQ ID NO: 28146 - protein, 16 aa, Homo sapiens
  heavy chain complementarity determining region 3 for antibody 14073
ARTQGTRDYDYYAMDV

SEQ ID NO: 28147 - protein, 9 aa, Homo sapiens
  light chain complementarity determining region 3 for antibody 14074
QQFHSYPIT

SEQ ID NO: 28148 - protein, 16 aa, Homo sapiens
  heavy chain complementarity determining region 3 for antibody 14074
ARTQGTRAYYYYAMDV

SEQ ID NO: 28149 - protein, 9 aa, Homo sapiens
  light chain complementarity determining region 3 for antibody 14075
QQFHSYPIT

SEQ ID NO: 28150 - protein, 16 aa, Homo sapiens
  heavy chain complementarity determining region 3 for antibody 14075
ARTQGTKDYYYYAMDV

SEQ ID NO: 28151 - protein, 9 aa, Homo sapiens
  light chain complementarity determining region 3 for antibody 14076
QQFHSYPIT

SEQ ID NO: 28152 - protein, 16 aa, Homo sapiens
  heavy chain complementarity determining region 3 for antibody 14076
ARTKGTRDYYYYAMDV

SEQ ID NO: 28153 - protein, 9 aa, Homo sapiens
  light chain complementarity determining region 3 for antibody 14077
QQFHSYPIT

SEQ ID NO: 28154 - protein, 16 aa, Homo sapiens
  heavy chain complementarity determining region 3 for antibody 14077
ARSQGTRDYYYYAMDV

SEQ ID NO: 28155 - protein, 9 aa, Homo sapiens
  light chain complementarity determining region 3 for antibody 14078
QQFHSYPII

SEQ ID NO: 28156 - protein, 16 aa, Homo sapiens
  heavy chain complementarity determining region 3 for antibody 14078
ARTQGTRDYYYYAMDV

SEQ ID NO: 28157 - protein, 9 aa, Homo sapiens
  light chain complementarity determining region 3 for antibody 14079
QQFHSHPIT

SEQ ID NO: 28158 - protein, 16 aa, Homo sapiens
  heavy chain complementarity determining region 3 for antibody 14079
ARTQGTRDYYYYAMDV

SEQ ID NO: 28159 - protein, 9 aa, Homo sapiens
  light chain complementarity determining region 3 for antibody 14080
QQFHSCPIT

SEQ ID NO: 28160 - protein, 16 aa, Homo sapiens
  heavy chain complementarity determining region 3 for antibody 14080
ARTQGTRDYYYYAMDV

SEQ ID NO: 28161 - protein, 9 aa, Homo sapiens
  light chain complementarity determining region 3 for antibody 14081
QQFHRYPIT

SEQ ID NO: 28162 - protein, 16 aa, Homo sapiens
  heavy chain complementarity determining region 3 for antibody 14081
ARTQGTRDYYYYAMDV

SEQ ID NO: 28163 - protein, 9 aa, Homo sapiens
  light chain complementarity determining region 3 for antibody 14082
QQFHGYPLT

SEQ ID NO: 28164 - protein, 21 aa, Homo sapiens
  heavy chain complementarity determining region 3 for antibody 14082
ARDWAQSNGYPVGHYYYGMDV

SEQ ID NO: 28165 - protein, 9 aa, Homo sapiens
  light chain complementarity determining region 3 for antibody 14083
QQFGSSRLT

SEQ ID NO: 28166 - protein, 14 aa, Homo sapiens
  heavy chain complementarity determining region 3 for antibody 14083
ALLSSGWYVGAFDI

SEQ ID NO: 28167 - protein, 9 aa, Homo sapiens
  light chain complementarity determining region 3 for antibody 14084
QQFDNYPQT

SEQ ID NO: 28168 - protein, 11 aa, Homo sapiens
  heavy chain complementarity determining region 3 for antibody 14084
AREATRGYSQN

SEQ ID NO: 28169 - protein, 9 aa, Homo sapiens
  light chain complementarity determining region 3 for antibody 14085
QQFDGSRRT

SEQ ID NO: 28170 - protein, 21 aa, Homo sapiens
  heavy chain complementarity determining region 3 for antibody 14085
VREGYYHAGNYYYYDYYGMDV

SEQ ID NO: 28171 - protein, 9 aa, Homo sapiens
  light chain complementarity determining region 3 for antibody 14086
QQDYTSPLT

SEQ ID NO: 28172 - protein, 17 aa, Homo sapiens
  heavy chain complementarity determining region 3 for antibody 14086
ARERSVAGAVRFYGMDV

SEQ ID NO: 28173 - protein, 11 aa, Homo sapiens
  light chain complementarity determining region 3 for antibody 14087
QQDSHYEQGIT

SEQ ID NO: 28174 - protein, 17 aa, Homo sapiens
  heavy chain complementarity determining region 3 for antibody 14087
ARERQYCYGDRCYGEDL

SEQ ID NO: 28175 - protein, 9 aa, Homo sapiens
  light chain complementarity determining region 3 for antibody 14088
QQDNSVPWT

SEQ ID NO: 28176 - protein, 17 aa, Homo sapiens
  heavy chain complementarity determining region 3 for antibody 14088
ARVHDSSNYHVAEYFQY

SEQ ID NO: 28177 - protein, 9 aa, Homo sapiens
  light chain complementarity determining region 3 for antibody 14089
QQDNNLPYT

SEQ ID NO: 28178 - protein, 13 aa, Homo sapiens
  heavy chain complementarity determining region 3 for antibody 14089
ARAKWDLFGYFDF

SEQ ID NO: 28179 - protein, 9 aa, Homo sapiens
  light chain complementarity determining region 3 for antibody 14090
QQDGSSRYT

SEQ ID NO: 28180 - protein, 22 aa, Homo sapiens
  heavy chain complementarity determining region 3 for antibody 14090
ARIYDDSAKQYSAGYYYYAMDV

SEQ ID NO: 28181 - protein, 10 aa, Homo sapiens
  light chain complementarity determining region 3 for antibody 14091
QQDGSSPAGT

SEQ ID NO: 28182 - protein, 17 aa, Homo sapiens
  heavy chain complementarity determining region 3 for antibody 14091
AREDWSDVDLRAFYFDS

SEQ ID NO: 28183 - protein, 11 aa, Homo sapiens
  light chain complementarity determining region 3 for antibody 14092
QQCYSSPPEKT

SEQ ID NO: 28184 - protein, 16 aa, Homo sapiens
  heavy chain complementarity determining region 3 for antibody 14092
AREAGEDYYYKDIFDI

SEQ ID NO: 28185 - protein, 8 aa, Homo sapiens
  light chain complementarity determining region 3 for antibody 14093
QQCTTTPT

SEQ ID NO: 28186 - protein, 13 aa, Homo sapiens
  heavy chain complementarity determining region 3 for antibody 14093
AKAFADASDALQI

SEQ ID NO: 28187 - protein, 9 aa, Homo sapiens
  light chain complementarity determining region 3 for antibody 14094
QQCETLPVT

SEQ ID NO: 28188 - protein, 15 aa, Homo sapiens
  heavy chain complementarity determining region 3 for antibody 14094
ARHRFGGSSSENFDF

SEQ ID NO: 28189 - protein, 9 aa, Homo sapiens
  light chain complementarity determining region 3 for antibody 14095
QQCDSLPLT

SEQ ID NO: 28190 - protein, 18 aa, Homo sapiens
  heavy chain complementarity determining region 3 for antibody 14095
ARAPGDYDMLRRGYYFDH

SEQ ID NO: 28191 - protein, 9 aa, Homo sapiens
  light chain complementarity determining region 3 for antibody 14096
QQAYSFPLT

SEQ ID NO: 28192 - protein, 13 aa, Homo sapiens
  heavy chain complementarity determining region 3 for antibody 14096
VRTYGSGRNWFDP

SEQ ID NO: 28193 - protein, 9 aa, Homo sapiens
  light chain complementarity determining region 3 for antibody 14097
QQAYRFSLS

SEQ ID NO: 28194 - protein, 13 aa, Homo sapiens
  heavy chain complementarity determining region 3 for antibody 14097
TRTYGSGRNWFDP

SEQ ID NO: 28195 - protein, 9 aa, Homo sapiens
  light chain complementarity determining region 3 for antibody 14098
QQAYRFPLS

SEQ ID NO: 28196 - protein, 13 aa, Homo sapiens
  heavy chain complementarity determining region 3 for antibody 14098
TRTYGSGRNGFDP

SEQ ID NO: 28197 - protein, 9 aa, Homo sapiens
  light chain complementarity determining region 3 for antibody 14099
QQAYRFPLS

SEQ ID NO: 28198 - protein, 13 aa, Homo sapiens
  heavy chain complementarity determining region 3 for antibody 14099
TRTYGSGGNWFDP

SEQ ID NO: 28199 - protein, 9 aa, Homo sapiens
  light chain complementarity determining region 3 for antibody 14100
QQAYRFPLS

SEQ ID NO: 28200 - protein, 13 aa, Homo sapiens
  heavy chain complementarity determining region 3 for antibody 14100
TRTYGLGRNWFDP

SEQ ID NO: 28201 - protein, 9 aa, Homo sapiens
  light chain complementarity determining region 3 for antibody 14101
QQAYRFPLS

SEQ ID NO: 28202 - protein, 13 aa, Homo sapiens
  heavy chain complementarity determining region 3 for antibody 14101
TRTCGSGRNWFDP

SEQ ID NO: 28203 - protein, 9 aa, Homo sapiens
  light chain complementarity determining region 3 for antibody 14102
QQAYRFLLS

SEQ ID NO: 28204 - protein, 13 aa, Homo sapiens
  heavy chain complementarity determining region 3 for antibody 14102
TRTYGSGRNWFDP

SEQ ID NO: 28205 - protein, 9 aa, Homo sapiens
  light chain complementarity determining region 3 for antibody 14103
QQANTFPHT

SEQ ID NO: 28206 - protein, 13 aa, Homo sapiens
  heavy chain complementarity determining region 3 for antibody 14103
ARGRKFENQYFDY

SEQ ID NO: 28207 - protein, 9 aa, Homo sapiens
  light chain complementarity determining region 3 for antibody 14104
QQANSSPWT

SEQ ID NO: 28208 - protein, 14 aa, Homo sapiens
  heavy chain complementarity determining region 3 for antibody 14104
ARLNKMTRIRYFDS

SEQ ID NO: 28209 - protein, 9 aa, Homo sapiens
  light chain complementarity determining region 3 for antibody 14105
QQANSLPPT

SEQ ID NO: 28210 - protein, 14 aa, Homo sapiens
  heavy chain complementarity determining region 3 for antibody 14105
ARDRSVTYGKYFGH

SEQ ID NO: 28211 - protein, 9 aa, Homo sapiens
  light chain complementarity determining region 3 for antibody 14106
QQANSLPLT

SEQ ID NO: 28212 - protein, 19 aa, Homo sapiens
  heavy chain complementarity determining region 3 for antibody 14106
ARNDYSGDTDRYYDFGMDV

SEQ ID NO: 28213 - protein, 9 aa, Homo sapiens
  light chain complementarity determining region 3 for antibody 14107
QQANSLPFP

SEQ ID NO: 28214 - protein, 19 aa, Homo sapiens
  heavy chain complementarity determining region 3 for antibody 14107
ARADYSGETDRYYDYGMDV

SEQ ID NO: 28215 - protein, 9 aa, Homo sapiens
  light chain complementarity determining region 3 for antibody 14108
QQANSFPYT

SEQ ID NO: 28216 - protein, 22 aa, Homo sapiens
  heavy chain complementarity determining region 3 for antibody 14108
ARDRVGEAAAGTRYYRYYGMDV

SEQ ID NO: 28217 - protein, 9 aa, Homo sapiens
  light chain complementarity determining region 3 for antibody 14109
QQANSFPYT

SEQ ID NO: 28218 - protein, 22 aa, Homo sapiens
  heavy chain complementarity determining region 3 for antibody 14109
ARDRVGEAAAGTRYYPYYGMDV

SEQ ID NO: 28219 - protein, 9 aa, Homo sapiens
  light chain complementarity determining region 3 for antibody 14110
QQANSFPWT

SEQ ID NO: 28220 - protein, 14 aa, Homo sapiens
  heavy chain complementarity determining region 3 for antibody 14110
ARRNKMTRIRYFDS

SEQ ID NO: 28221 - protein, 9 aa, Homo sapiens
  light chain complementarity determining region 3 for antibody 14111
QQANSFPWT

SEQ ID NO: 28222 - protein, 14 aa, Homo sapiens
  heavy chain complementarity determining region 3 for antibody 14111
ARLSKMTRIRYFDS

SEQ ID NO: 28223 - protein, 9 aa, Homo sapiens
  light chain complementarity determining region 3 for antibody 14112
QQANSFPRT

SEQ ID NO: 28224 - protein, 20 aa, Homo sapiens
  heavy chain complementarity determining region 3 for antibody 14112
ARDVVYSSRIEVCYYYGMDV

SEQ ID NO: 28225 - protein, 9 aa, Homo sapiens
  light chain complementarity determining region 3 for antibody 14113
QQANSFPRT

SEQ ID NO: 28226 - protein, 16 aa, Homo sapiens
  heavy chain complementarity determining region 3 for antibody 14113
AKLAGPFNLPYYALEL

SEQ ID NO: 28227 - protein, 9 aa, Homo sapiens
  light chain complementarity determining region 3 for antibody 14114
QQANSFPLT

SEQ ID NO: 28228 - protein, 19 aa, Homo sapiens
  heavy chain complementarity determining region 3 for antibody 14114
ANFRLTSYDAYYYYYGMDV

SEQ ID NO: 28229 - protein, 9 aa, Homo sapiens
  light chain complementarity determining region 3 for antibody 14115
QQANSFPLP

SEQ ID NO: 28230 - protein, 14 aa, Homo sapiens
  heavy chain complementarity determining region 3 for antibody 14115
VRGRYYDSSGPIDY

SEQ ID NO: 28231 - protein, 9 aa, Homo sapiens
  light chain complementarity determining region 3 for antibody 14116
QQANSFPFT

SEQ ID NO: 28232 - protein, 16 aa, Homo sapiens
  heavy chain complementarity determining region 3 for antibody 14116
ARGGFGKLGLQNALDI

SEQ ID NO: 28233 - protein, 9 aa, Homo sapiens
  light chain complementarity determining region 3 for antibody 14117
QQANSFPFT

SEQ ID NO: 28234 - protein, 21 aa, Homo sapiens
  heavy chain complementarity determining region 3 for antibody 14117
ARDRSYGSGSYEYYYYYGMDV

SEQ ID NO: 28235 - protein, 9 aa, Homo sapiens
  light chain complementarity determining region 3 for antibody 14118
QQANSFPFT

SEQ ID NO: 28236 - protein, 19 aa, Homo sapiens
  heavy chain complementarity determining region 3 for antibody 14118
ARADYSGDTDRYYDYGMDA

SEQ ID NO: 28237 - protein, 10 aa, Homo sapiens
  light chain complementarity determining region 3 for antibody 14119
QQANSFLSIP

SEQ ID NO: 28238 - protein, 11 aa, Homo sapiens
  heavy chain complementarity determining region 3 for antibody 14119
AREQTGYYPLY

SEQ ID NO: 28239 - protein, 9 aa, Homo sapiens
  light chain complementarity determining region 3 for antibody 14120
QQANSFHRT

SEQ ID NO: 28240 - protein, 20 aa, Homo sapiens
  heavy chain complementarity determining region 3 for antibody 14120
ARDVVYSSRIEVYYYYGMDV

SEQ ID NO: 28241 - protein, 9 aa, Homo sapiens
  light chain complementarity determining region 3 for antibody 14121
QQAKTFPHT

SEQ ID NO: 28242 - protein, 13 aa, Homo sapiens
  heavy chain complementarity determining region 3 for antibody 14121
ARGRKCENQYFDY

SEQ ID NO: 28243 - protein, 9 aa, Homo sapiens
  light chain complementarity determining region 3 for antibody 14122
QQAKSFPTT

SEQ ID NO: 28244 - protein, 19 aa, Homo sapiens
  heavy chain complementarity determining region 3 for antibody 14122
ATDRYCSRPNCPQGNWFDP

SEQ ID NO: 28245 - protein, 8 aa, Homo sapiens
  light chain complementarity determining region 3 for antibody 14123
QQAHSFPP

SEQ ID NO: 28246 - protein, 22 aa, Homo sapiens
  heavy chain complementarity determining region 3 for antibody 14123
ARHSGYSNTWYVNYYYYYGMDV

SEQ ID NO: 28247 - protein, 8 aa, Homo sapiens
  light chain complementarity determining region 3 for antibody 14124
QQAHSFPP

SEQ ID NO: 28248 - protein, 22 aa, Homo sapiens
  heavy chain complementarity determining region 3 for antibody 14124
ARHSGYSNTWYMNYYYYYGMEV

SEQ ID NO: 28249 - protein, 8 aa, Homo sapiens
  light chain complementarity determining region 3 for antibody 14125
QQAHSFPP

SEQ ID NO: 28250 - protein, 22 aa, Homo sapiens
  heavy chain complementarity determining region 3 for antibody 14125
ARHSGYSNTWYMNYYYYDGMDV

SEQ ID NO: 28251 - protein, 8 aa, Homo sapiens
  light chain complementarity determining region 3 for antibody 14126
QQAHSFPP

SEQ ID NO: 28252 - protein, 22 aa, Homo sapiens
  heavy chain complementarity determining region 3 for antibody 14126
ARHSGYSNTWYMNYYYCYGMDV

SEQ ID NO: 28253 - protein, 8 aa, Homo sapiens
  light chain complementarity determining region 3 for antibody 14127
QQAHSFPP

SEQ ID NO: 28254 - protein, 22 aa, Homo sapiens
  heavy chain complementarity determining region 3 for antibody 14127
ARHSGYSNTWYMKYYYYYGMDV

SEQ ID NO: 28255 - protein, 8 aa, Homo sapiens
  light chain complementarity determining region 3 for antibody 14128
QQAHSFPP

SEQ ID NO: 28256 - protein, 22 aa, Homo sapiens
  heavy chain complementarity determining region 3 for antibody 14128
ARHSGYSNTWCMNYYYYYGMDV

SEQ ID NO: 28257 - protein, 8 aa, Homo sapiens
  light chain complementarity determining region 3 for antibody 14129
QQAHSFPP

SEQ ID NO: 28258 - protein, 22 aa, Homo sapiens
  heavy chain complementarity determining region 3 for antibody 14129
ARHSGYGNTWYMNYYYYYGMDV

SEQ ID NO: 28259 - protein, 8 aa, Homo sapiens
  light chain complementarity determining region 3 for antibody 14130
QQAHSFPP

SEQ ID NO: 28260 - protein, 22 aa, Homo sapiens
  heavy chain complementarity determining region 3 for antibody 14130
ARHPGYSNTWYMNYYYYYGMDV

SEQ ID NO: 28261 - protein, 8 aa, Homo sapiens
  light chain complementarity determining region 3 for antibody 14131
QQAHSFPP

SEQ ID NO: 28262 - protein, 22 aa, Homo sapiens
  heavy chain complementarity determining region 3 for antibody 14131
ARHFGYSNTWYMNYYYYYGMDV

SEQ ID NO: 28263 - protein, 8 aa, Homo sapiens
  light chain complementarity determining region 3 for antibody 14132
QQAHSFPL

SEQ ID NO: 28264 - protein, 22 aa, Homo sapiens
  heavy chain complementarity determining region 3 for antibody 14132
ARHSGYSNTWYMNYYYYYGMDV

SEQ ID NO: 28265 - protein, 8 aa, Homo sapiens
  light chain complementarity determining region 3 for antibody 14133
QQAHSFHP

SEQ ID NO: 28266 - protein, 22 aa, Homo sapiens
  heavy chain complementarity determining region 3 for antibody 14133
ARHSGYSNTWYMNYYYYYGMDV

SEQ ID NO: 28267 - protein, 8 aa, Homo sapiens
  light chain complementarity determining region 3 for antibody 14134
QQAHRFPP

SEQ ID NO: 28268 - protein, 22 aa, Homo sapiens
  heavy chain complementarity determining region 3 for antibody 14134
ARHSGYSNTWYMNYYYYYGMDV

SEQ ID NO: 28269 - protein, 19 aa, Homo sapiens
  light chain complementarity determining region 3 for antibody 14135
QQADSFPHSRRRDQGGDRT

SEQ ID NO: 28270 - protein, 10 aa, Homo sapiens
  heavy chain complementarity determining region 3 for antibody 14135
AKEWQRNLDH

SEQ ID NO: 28271 - protein, 9 aa, Homo sapiens
  light chain complementarity determining region 3 for antibody 14136
QQACRFPLS

SEQ ID NO: 28272 - protein, 13 aa, Homo sapiens
  heavy chain complementarity determining region 3 for antibody 14136
TRTYGSGRNWFDP

SEQ ID NO: 28273 - protein, 9 aa, Homo sapiens
  light chain complementarity determining region 3 for antibody 14137
QPYYTIPGT

SEQ ID NO: 28274 - protein, 16 aa, Homo sapiens
  heavy chain complementarity determining region 3 for antibody 14137
ARRRCSGGSCYGVVDY

SEQ ID NO: 28275 - protein, 8 aa, Homo sapiens
  light chain complementarity determining region 3 for antibody 14138
QPYYGVKT

SEQ ID NO: 28276 - protein, 9 aa, Homo sapiens
  heavy chain complementarity determining region 3 for antibody 14138
VKEAYYFDI

SEQ ID NO: 28277 - protein, 9 aa, Homo sapiens
  light chain complementarity determining region 3 for antibody 14139
QPYYGGPIT

SEQ ID NO: 28278 - protein, 13 aa, Homo sapiens
  heavy chain complementarity determining region 3 for antibody 14139
ARGKDSGSWMFDY

SEQ ID NO: 28279 - protein, 10 aa, Homo sapiens
  light chain complementarity determining region 3 for antibody 14140
QPYVSSALYT

SEQ ID NO: 28280 - protein, 16 aa, Homo sapiens
  heavy chain complementarity determining region 3 for antibody 14140
ARELFKGEYDYYAMDV

SEQ ID NO: 28281 - protein, 9 aa, Homo sapiens
  light chain complementarity determining region 3 for antibody 14141
QPYSTFPYT

SEQ ID NO: 28282 - protein, 17 aa, Homo sapiens
  heavy chain complementarity determining region 3 for antibody 14141
AREQYNDVDLRQFFFDY

SEQ ID NO: 28283 - protein, 9 aa, Homo sapiens
  light chain complementarity determining region 3 for antibody 14142
QPYHSTPYT

SEQ ID NO: 28284 - protein, 21 aa, Homo sapiens
  heavy chain complementarity determining region 3 for antibody 14142
ARPGGQYCSGSNCYYDNWFGS

SEQ ID NO: 28285 - protein, 7 aa, Homo sapiens
  light chain complementarity determining region 3 for antibody 14143
QPYGSSR

SEQ ID NO: 28286 - protein, 16 aa, Homo sapiens
  heavy chain complementarity determining region 3 for antibody 14143
TTTYGDYPPYYYAMVV

SEQ ID NO: 28287 - protein, 8 aa, Homo sapiens
  light chain complementarity determining region 3 for antibody 14144
QPYGSSLT

SEQ ID NO: 28288 - protein, 17 aa, Homo sapiens
  heavy chain complementarity determining region 3 for antibody 14144
AKVYRPHCGSYCFYFDS

SEQ ID NO: 28289 - protein, 9 aa, Homo sapiens
  light chain complementarity determining region 3 for antibody 14145
QPSYTIPYT

SEQ ID NO: 28290 - protein, 11 aa, Homo sapiens
  heavy chain complementarity determining region 3 for antibody 14145
ARVRGSSWIDY

SEQ ID NO: 28291 - protein, 8 aa, Homo sapiens
  light chain complementarity determining region 3 for antibody 14146
QPRYRALS

SEQ ID NO: 28292 - protein, 10 aa, Homo sapiens
  heavy chain complementarity determining region 3 for antibody 14146
AHLSRGVNFF

SEQ ID NO: 28293 - protein, 9 aa, Homo sapiens
  light chain complementarity determining region 3 for antibody 14147
QPQFTGRWT

SEQ ID NO: 28294 - protein, 15 aa, Homo sapiens
  heavy chain complementarity determining region 3 for antibody 14147
AKEGCSGGICYGFDV

SEQ ID NO: 28295 - protein, 9 aa, Homo sapiens
  light chain complementarity determining region 3 for antibody 14148
QPNYRPSPA

SEQ ID NO: 28296 - protein, 11 aa, Homo sapiens
  heavy chain complementarity determining region 3 for antibody 14148
TRDPPGNGMDV

SEQ ID NO: 28297 - protein, 9 aa, Homo sapiens
  light chain complementarity determining region 3 for antibody 14149
QPFNTYPLT

SEQ ID NO: 28298 - protein, 17 aa, Homo sapiens
  heavy chain complementarity determining region 3 for antibody 14149
AKDLSGVHYDIHHGLDV

SEQ ID NO: 28299 - protein, 9 aa, Homo sapiens
  light chain complementarity determining region 3 for antibody 14150
QPFNNYPQT

SEQ ID NO: 28300 - protein, 11 aa, Homo sapiens
  heavy chain complementarity determining region 3 for antibody 14150
AREATRGYSQN

SEQ ID NO: 28301 - protein, 9 aa, Homo sapiens
  light chain complementarity determining region 3 for antibody 14151
QPAKSFPIT

SEQ ID NO: 28302 - protein, 19 aa, Homo sapiens
  heavy chain complementarity determining region 3 for antibody 14151
ATDRYCSRPNCPQGNWFDP

SEQ ID NO: 28303 - protein, 9 aa, Homo sapiens
  light chain complementarity determining region 3 for antibody 14152
QNYDSSPRV

SEQ ID NO: 28304 - protein, 13 aa, Homo sapiens
  heavy chain complementarity determining region 3 for antibody 14152
TRDEDGNNTPFDY

SEQ ID NO: 28305 - protein, 9 aa, Homo sapiens
  light chain complementarity determining region 3 for antibody 14153
QNRSNRPGT

SEQ ID NO: 28306 - protein, 18 aa, Homo sapiens
  heavy chain complementarity determining region 3 for antibody 14153
ALEPQTEFGSGNYGYFDY

SEQ ID NO: 28307 - protein, 8 aa, Homo sapiens
  light chain complementarity determining region 3 for antibody 14154
QNLNSHPT

SEQ ID NO: 28308 - protein, 11 aa, Homo sapiens
  heavy chain complementarity determining region 3 for antibody 14154
ARSHTENAFDV

SEQ ID NO: 28309 - protein, 9 aa, Homo sapiens
  light chain complementarity determining region 3 for antibody 14155
QMYGDSTWP

SEQ ID NO: 28310 - protein, 9 aa, Homo sapiens
  heavy chain complementarity determining region 3 for antibody 14155
ARWNQAFDY

SEQ ID NO: 28311 - protein, 11 aa, Homo sapiens
  light chain complementarity determining region 3 for antibody 14156
QLLNSHSGGFT

SEQ ID NO: 28312 - protein, 19 aa, Homo sapiens
  heavy chain complementarity determining region 3 for antibody 14156
ARGGPRSGTTCFSYYGVDV

SEQ ID NO: 28313 - protein, 11 aa, Homo sapiens
  light chain complementarity determining region 3 for antibody 14157
QLLNSHSGGFT

SEQ ID NO: 28314 - protein, 19 aa, Homo sapiens
  heavy chain complementarity determining region 3 for antibody 14157
ARGGPCSSTTCFSYYGVDV

SEQ ID NO: 28315 - protein, 11 aa, Homo sapiens
  light chain complementarity determining region 3 for antibody 14158
QLLNSHSGGFT

SEQ ID NO: 28316 - protein, 19 aa, Homo sapiens
  heavy chain complementarity determining region 3 for antibody 14158
ARGGPCSGTTCLSYYGVDV

SEQ ID NO: 28317 - protein, 11 aa, Homo sapiens
  light chain complementarity determining region 3 for antibody 14159
QLLNIHSGGFT

SEQ ID NO: 28318 - protein, 19 aa, Homo sapiens
  heavy chain complementarity determining region 3 for antibody 14159
ARGGPCSGTTCFSYYGVDV

SEQ ID NO: 28319 - protein, 10 aa, Homo sapiens
  light chain complementarity determining region 3 for antibody 14160
QLFGNSPRYT

SEQ ID NO: 28320 - protein, 20 aa, Homo sapiens
  heavy chain complementarity determining region 3 for antibody 14160
TRDRGGRSSSFTNYQYNMDV

SEQ ID NO: 28321 - protein, 10 aa, Homo sapiens
  light chain complementarity determining region 3 for antibody 14161
QLFGNSPRYT

SEQ ID NO: 28322 - protein, 20 aa, Homo sapiens
  heavy chain complementarity determining region 3 for antibody 14161
ARGRGGRSSSFTNYQYNMDV

SEQ ID NO: 28323 - protein, 10 aa, Homo sapiens
  light chain complementarity determining region 3 for antibody 14162
QLFGNSPRYT

SEQ ID NO: 28324 - protein, 20 aa, Homo sapiens
  heavy chain complementarity determining region 3 for antibody 14162
ARDRGGRSSSLTNYQYNMDV

SEQ ID NO: 28325 - protein, 9 aa, Homo sapiens
  light chain complementarity determining region 3 for antibody 14163
QKYNSAPWT

SEQ ID NO: 28326 - protein, 16 aa, Homo sapiens
  heavy chain complementarity determining region 3 for antibody 14163
ARLDRVDCASEGCRDY

SEQ ID NO: 28327 - protein, 9 aa, Homo sapiens
  light chain complementarity determining region 3 for antibody 14164
QKYNSAPRT

SEQ ID NO: 28328 - protein, 20 aa, Homo sapiens
  heavy chain complementarity determining region 3 for antibody 14164
ARGGKYSSNFPYCYHYGLDV

SEQ ID NO: 28329 - protein, 10 aa, Homo sapiens
  light chain complementarity determining region 3 for antibody 14165
QKYDSAPPLT

SEQ ID NO: 28330 - protein, 19 aa, Homo sapiens
  heavy chain complementarity determining region 3 for antibody 14165
ARELDFDILTGYLGGLFQH

SEQ ID NO: 28331 - protein, 8 aa, Homo sapiens
  light chain complementarity determining region 3 for antibody 14166
QKSYRALS

SEQ ID NO: 28332 - protein, 10 aa, Homo sapiens
  heavy chain complementarity determining region 3 for antibody 14166
AHLSRGVNFF

SEQ ID NO: 28333 - protein, 9 aa, Homo sapiens
  light chain complementarity determining region 3 for antibody 14167
QKNNSAPWT

SEQ ID NO: 28334 - protein, 16 aa, Homo sapiens
  heavy chain complementarity determining region 3 for antibody 14167
ARLDRVDCTSEGCRDY

SEQ ID NO: 28335 - protein, 10 aa, Homo sapiens
  light chain complementarity determining region 3 for antibody 14168
QKNNNVPPFT

SEQ ID NO: 28336 - protein, 17 aa, Homo sapiens
  heavy chain complementarity determining region 3 for antibody 14168
ASDPTYGDSYYYSGMDL

SEQ ID NO: 28337 - protein, 9 aa, Homo sapiens
  light chain complementarity determining region 3 for antibody 14169
QKHNSAPIT

SEQ ID NO: 28338 - protein, 22 aa, Homo sapiens
  heavy chain complementarity determining region 3 for antibody 14169
ARGLGTINYNDILTGYFQYFDL

SEQ ID NO: 28339 - protein, 9 aa, Homo sapiens
  light chain complementarity determining region 3 for antibody 14170
QKDNSAPLT

SEQ ID NO: 28340 - protein, 22 aa, Homo sapiens
  heavy chain complementarity determining region 3 for antibody 14170
ARDRWFRIEEDGFRTIRHPFDY

SEQ ID NO: 28341 - protein, 9 aa, Homo sapiens
  light chain complementarity determining region 3 for antibody 14171
QHYYTIPGT

SEQ ID NO: 28342 - protein, 16 aa, Homo sapiens
  heavy chain complementarity determining region 3 for antibody 14171
ARRRCSGGSCYGVVDY

SEQ ID NO: 28343 - protein, 9 aa, Homo sapiens
  light chain complementarity determining region 3 for antibody 14172
QHYYSYPIT

SEQ ID NO: 28344 - protein, 12 aa, Homo sapiens
  heavy chain complementarity determining region 3 for antibody 14172
APSIAVAGFLDY

SEQ ID NO: 28345 - protein, 8 aa, Homo sapiens
  light chain complementarity determining region 3 for antibody 14173
QHYNNWPL

SEQ ID NO: 28346 - protein, 18 aa, Homo sapiens
  heavy chain complementarity determining region 3 for antibody 14173
AKDAAVDVILGNRGYFDF

SEQ ID NO: 28347 - protein, 10 aa, Homo sapiens
  light chain complementarity determining region 3 for antibody 14174
QHYGSSPPVT

SEQ ID NO: 28348 - protein, 17 aa, Homo sapiens
  heavy chain complementarity determining region 3 for antibody 14174
AGAHYDILTGYFYGMDV

SEQ ID NO: 28349 - protein, 9 aa, Homo sapiens
  light chain complementarity determining region 3 for antibody 14175
QHYETSPFT

SEQ ID NO: 28350 - protein, 11 aa, Homo sapiens
  heavy chain complementarity determining region 3 for antibody 14175
GRGSVTPDMGY

SEQ ID NO: 28351 - protein, 9 aa, Homo sapiens
  light chain complementarity determining region 3 for antibody 14176
QHYDNLLLT

SEQ ID NO: 28352 - protein, 16 aa, Homo sapiens
  heavy chain complementarity determining region 3 for antibody 14176
ARAHGSGYAYGYIFDN

SEQ ID NO: 28353 - protein, 9 aa, Homo sapiens
  light chain complementarity determining region 3 for antibody 14177
QHYDNLLLP

SEQ ID NO: 28354 - protein, 16 aa, Homo sapiens
  heavy chain complementarity determining region 3 for antibody 14177
ARAHGSGYTYGYIFDN

SEQ ID NO: 28355 - protein, 9 aa, Homo sapiens
  light chain complementarity determining region 3 for antibody 14178
QHYDDLLFT

SEQ ID NO: 28356 - protein, 18 aa, Homo sapiens
  heavy chain complementarity determining region 3 for antibody 14178
VRLTRRFEELHTCYGMDV

SEQ ID NO: 28357 - protein, 9 aa, Homo sapiens
  light chain complementarity determining region 3 for antibody 14179
QHTYRPSPA

SEQ ID NO: 28358 - protein, 11 aa, Homo sapiens
  heavy chain complementarity determining region 3 for antibody 14179
TRDPPGNGMDV

SEQ ID NO: 28359 - protein, 9 aa, Homo sapiens
  light chain complementarity determining region 3 for antibody 14180
QHSYRPSPA

SEQ ID NO: 28360 - protein, 11 aa, Homo sapiens
  heavy chain complementarity determining region 3 for antibody 14180
TRDPPGNGMDV

SEQ ID NO: 28361 - protein, 9 aa, Homo sapiens
  light chain complementarity determining region 3 for antibody 14181
QHRSNWSGT

SEQ ID NO: 28362 - protein, 11 aa, Homo sapiens
  heavy chain complementarity determining region 3 for antibody 14181
ARGDPYGDSDH

SEQ ID NO: 28363 - protein, 10 aa, Homo sapiens
  light chain complementarity determining region 3 for antibody 14182
QHRSNWPIFT

SEQ ID NO: 28364 - protein, 14 aa, Homo sapiens
  heavy chain complementarity determining region 3 for antibody 14182
ARLNKMTRIRYFDS

SEQ ID NO: 28365 - protein, 9 aa, Homo sapiens
  light chain complementarity determining region 3 for antibody 14183
QHRNNWRLT

SEQ ID NO: 28366 - protein, 22 aa, Homo sapiens
  heavy chain complementarity determining region 3 for antibody 14183
ARHSGYSNTWYMNYYYYYGMDV

SEQ ID NO: 28367 - protein, 9 aa, Homo sapiens
  light chain complementarity determining region 3 for antibody 14184
QHQFTGRWT

SEQ ID NO: 28368 - protein, 15 aa, Homo sapiens
  heavy chain complementarity determining region 3 for antibody 14184
AKEGCSGGICYGFDV

SEQ ID NO: 28369 - protein, 9 aa, Homo sapiens
  light chain complementarity determining region 3 for antibody 14185
QHNYRSSPA

SEQ ID NO: 28370 - protein, 11 aa, Homo sapiens
  heavy chain complementarity determining region 3 for antibody 14185
TRDPPGNGMDV

SEQ ID NO: 28371 - protein, 9 aa, Homo sapiens
  light chain complementarity determining region 3 for antibody 14186
QHNYRPSPV

SEQ ID NO: 28372 - protein, 11 aa, Homo sapiens
  heavy chain complementarity determining region 3 for antibody 14186
TRDPPGNGMDV

SEQ ID NO: 28373 - protein, 9 aa, Homo sapiens
  light chain complementarity determining region 3 for antibody 14187
QHNYRPSPE

SEQ ID NO: 28374 - protein, 11 aa, Homo sapiens
  heavy chain complementarity determining region 3 for antibody 14187
TRDPPGNGMDV

SEQ ID NO: 28375 - protein, 9 aa, Homo sapiens
  light chain complementarity determining region 3 for antibody 14188
QHNYRPSPA

SEQ ID NO: 28376 - protein, 11 aa, Homo sapiens
  heavy chain complementarity determining region 3 for antibody 14188
TRVPPGNGMDV

SEQ ID NO: 28377 - protein, 9 aa, Homo sapiens
  light chain complementarity determining region 3 for antibody 14189
QHNYRPSPA

SEQ ID NO: 28378 - protein, 11 aa, Homo sapiens
  heavy chain complementarity determining region 3 for antibody 14189
TRDTPGNGMDV

SEQ ID NO: 28379 - protein, 9 aa, Homo sapiens
  light chain complementarity determining region 3 for antibody 14190
QHNYRPSPA

SEQ ID NO: 28380 - protein, 11 aa, Homo sapiens
  heavy chain complementarity determining region 3 for antibody 14190
TRDSPGNGMDV

SEQ ID NO: 28381 - protein, 9 aa, Homo sapiens
  light chain complementarity determining region 3 for antibody 14191
QHNYRPSPA

SEQ ID NO: 28382 - protein, 11 aa, Homo sapiens
  heavy chain complementarity determining region 3 for antibody 14191
TRDPTGNGMDV

SEQ ID NO: 28383 - protein, 9 aa, Homo sapiens
  light chain complementarity determining region 3 for antibody 14192
QHNYRPSPA

SEQ ID NO: 28384 - protein, 11 aa, Homo sapiens
  heavy chain complementarity determining region 3 for antibody 14192
TRDPPGNGMDD

SEQ ID NO: 28385 - protein, 9 aa, Homo sapiens
  light chain complementarity determining region 3 for antibody 14193
QHNYRPSPA

SEQ ID NO: 28386 - protein, 11 aa, Homo sapiens
  heavy chain complementarity determining region 3 for antibody 14193
TRDPPGNGIDV

SEQ ID NO: 28387 - protein, 9 aa, Homo sapiens
  light chain complementarity determining region 3 for antibody 14194
QHNYRPSPA

SEQ ID NO: 28388 - protein, 11 aa, Homo sapiens
  heavy chain complementarity determining region 3 for antibody 14194
TRDPHGNGMDV

SEQ ID NO: 28389 - protein, 9 aa, Homo sapiens
  light chain complementarity determining region 3 for antibody 14195
QHNYRPSPA

SEQ ID NO: 28390 - protein, 11 aa, Homo sapiens
  heavy chain complementarity determining region 3 for antibody 14195
TGDPPGNGMDV

SEQ ID NO: 28391 - protein, 9 aa, Homo sapiens
  light chain complementarity determining region 3 for antibody 14196
QHNYRPSPA

SEQ ID NO: 28392 - protein, 11 aa, Homo sapiens
  heavy chain complementarity determining region 3 for antibody 14196
KRDPPGNGMDV

SEQ ID NO: 28393 - protein, 9 aa, Homo sapiens
  light chain complementarity determining region 3 for antibody 14197
QHNYIPSPA

SEQ ID NO: 28394 - protein, 11 aa, Homo sapiens
  heavy chain complementarity determining region 3 for antibody 14197
TRDPPGNGMDV

SEQ ID NO: 28395 - protein, 11 aa, Homo sapiens
  light chain complementarity determining region 3 for antibody 14198
QHNGSSPPGNT

SEQ ID NO: 28396 - protein, 17 aa, Homo sapiens
  heavy chain complementarity determining region 3 for antibody 14198
ARENYDVLTGANYGMDV

SEQ ID NO: 28397 - protein, 11 aa, Homo sapiens
  light chain complementarity determining region 3 for antibody 14199
QHNGSSPPETT

SEQ ID NO: 28398 - protein, 17 aa, Homo sapiens
  heavy chain complementarity determining region 3 for antibody 14199
ARENYDVLTGSNYGMDV

SEQ ID NO: 28399 - protein, 11 aa, Homo sapiens
  light chain complementarity determining region 3 for antibody 14200
QHNGSSPPENP

SEQ ID NO: 28400 - protein, 17 aa, Homo sapiens
  heavy chain complementarity determining region 3 for antibody 14200
ARETYDVLTGSNFGMDV

SEQ ID NO: 28401 - protein, 11 aa, Homo sapiens
  light chain complementarity determining region 3 for antibody 14201
QHNGSSPPENP

SEQ ID NO: 28402 - protein, 17 aa, Homo sapiens
  heavy chain complementarity determining region 3 for antibody 14201
ARENYDVLTGSNYGMDV

SEQ ID NO: 28403 - protein, 11 aa, Homo sapiens
  light chain complementarity determining region 3 for antibody 14202
QHNGSSPPANT

SEQ ID NO: 28404 - protein, 17 aa, Homo sapiens
  heavy chain complementarity determining region 3 for antibody 14202
ARENYDVLTGSNYGMDV

SEQ ID NO: 28405 - protein, 11 aa, Homo sapiens
  light chain complementarity determining region 3 for antibody 14203
QHNGSPPPENT

SEQ ID NO: 28406 - protein, 17 aa, Homo sapiens
  heavy chain complementarity determining region 3 for antibody 14203
ARENYDVLTGANYGMDV

SEQ ID NO: 28407 - protein, 10 aa, Homo sapiens
  light chain complementarity determining region 3 for antibody 14204
QHLSIYHAIT

SEQ ID NO: 28408 - protein, 17 aa, Homo sapiens
  heavy chain complementarity determining region 3 for antibody 14204
AKDLGAGAKDYYYGMDV

SEQ ID NO: 28409 - protein, 10 aa, Homo sapiens
  light chain complementarity determining region 3 for antibody 14205
QHLGNSPLYT

SEQ ID NO: 28410 - protein, 12 aa, Homo sapiens
  heavy chain complementarity determining region 3 for antibody 14205
AKGILGRGGMDV

SEQ ID NO: 28411 - protein, 9 aa, Homo sapiens
  light chain complementarity determining region 3 for antibody 14206
QHFYDYPLS

SEQ ID NO: 28412 - protein, 12 aa, Homo sapiens
  heavy chain complementarity determining region 3 for antibody 14206
ASGGRISGKYGS

SEQ ID NO: 28413 - protein, 9 aa, Homo sapiens
  light chain complementarity determining region 3 for antibody 14207
QHFNTYPLT

SEQ ID NO: 28414 - protein, 17 aa, Homo sapiens
  heavy chain complementarity determining region 3 for antibody 14207
AKDLSGIHYDSHHGLDV

SEQ ID NO: 28415 - protein, 9 aa, Homo sapiens
  light chain complementarity determining region 3 for antibody 14208
QHCYHFSIT

SEQ ID NO: 28416 - protein, 15 aa, Homo sapiens
  heavy chain complementarity determining region 3 for antibody 14208
ARDPTAAGFPAHFDY

SEQ ID NO: 28417 - protein, 9 aa, Homo sapiens
  light chain complementarity determining region 3 for antibody 14209
QHCDHFSTT

SEQ ID NO: 28418 - protein, 15 aa, Homo sapiens
  heavy chain complementarity determining region 3 for antibody 14209
ARDPTAAGFPAHFDY

SEQ ID NO: 28419 - protein, 9 aa, Homo sapiens
  light chain complementarity determining region 3 for antibody 14210
QHCDHFSIT

SEQ ID NO: 28420 - protein, 15 aa, Homo sapiens
  heavy chain complementarity determining region 3 for antibody 14210
ARDPTAAGLPAHFDY

SEQ ID NO: 28421 - protein, 9 aa, Homo sapiens
  light chain complementarity determining region 3 for antibody 14211
QHCDHFSIT

SEQ ID NO: 28422 - protein, 15 aa, Homo sapiens
  heavy chain complementarity determining region 3 for antibody 14211
ARDPTAAGFPARFDY

SEQ ID NO: 28423 - protein, 9 aa, Homo sapiens
  light chain complementarity determining region 3 for antibody 14212
QHCDHFSIT

SEQ ID NO: 28424 - protein, 15 aa, Homo sapiens
  heavy chain complementarity determining region 3 for antibody 14212
ARDPTAAGFPAHFDH

SEQ ID NO: 28425 - protein, 9 aa, Homo sapiens
  light chain complementarity determining region 3 for antibody 14213
QGYNNSPWT

SEQ ID NO: 28426 - protein, 15 aa, Homo sapiens
  heavy chain complementarity determining region 3 for antibody 14213
GRHRYSSSQGYGMDV

SEQ ID NO: 28427 - protein, 9 aa, Homo sapiens
  light chain complementarity determining region 3 for antibody 14214
QGYNNAPWT

SEQ ID NO: 28428 - protein, 15 aa, Homo sapiens
  heavy chain complementarity determining region 3 for antibody 14214
GRNRYSSSQGYGMDV

SEQ ID NO: 28429 - protein, 9 aa, Homo sapiens
  light chain complementarity determining region 3 for antibody 14215
QGYNNAPWT

SEQ ID NO: 28430 - protein, 15 aa, Homo sapiens
  heavy chain complementarity determining region 3 for antibody 14215
GRHRYSSSQGYGIDV

SEQ ID NO: 28431 - protein, 9 aa, Homo sapiens
  light chain complementarity determining region 3 for antibody 14216
QGYKNAPWT

SEQ ID NO: 28432 - protein, 15 aa, Homo sapiens
  heavy chain complementarity determining region 3 for antibody 14216
GRHRYSSSQGYGMDV

SEQ ID NO: 28433 - protein, 10 aa, Homo sapiens
  light chain complementarity determining region 3 for antibody 14217
QGDGSSPPIT

SEQ ID NO: 28434 - protein, 22 aa, Homo sapiens
  heavy chain complementarity determining region 3 for antibody 14217
ARDGYGDYDAALGDYYYYGMDV

SEQ ID NO: 28435 - protein, 10 aa, Homo sapiens
  light chain complementarity determining region 3 for antibody 14218
QFYSDWPGWT

SEQ ID NO: 28436 - protein, 17 aa, Homo sapiens
  heavy chain complementarity determining region 3 for antibody 14218
AKEIWIVNRPGGDAFDM

SEQ ID NO: 28437 - protein, 9 aa, Homo sapiens
  light chain complementarity determining region 3 for antibody 14219
QEYNSYSLT

SEQ ID NO: 28438 - protein, 7 aa, Homo sapiens
  heavy chain complementarity determining region 3 for antibody 14219
ARVPGYS

SEQ ID NO: 28439 - protein, 9 aa, Homo sapiens
  light chain complementarity determining region 3 for antibody 14220
QDYGGSPYT

SEQ ID NO: 28440 - protein, 14 aa, Homo sapiens
  heavy chain complementarity determining region 3 for antibody 14220
ARDSTRLGGGDFDY

SEQ ID NO: 28441 - protein, 10 aa, Homo sapiens
  light chain complementarity determining region 3 for antibody 14221
QCHGYSPLYT

SEQ ID NO: 28442 - protein, 12 aa, Homo sapiens
  heavy chain complementarity determining region 3 for antibody 14221
AKGILGRGGMDV

SEQ ID NO: 28443 - protein, 9 aa, Homo sapiens
  light chain complementarity determining region 3 for antibody 14222
PQYYDTPRT

SEQ ID NO: 28444 - protein, 23 aa, Homo sapiens
  heavy chain complementarity determining region 3 for antibody 14222
ARGGPYRPAPYFYDISGPQYFQH

SEQ ID NO: 28445 - protein, 9 aa, Homo sapiens
  light chain complementarity determining region 3 for antibody 14223
PQYNSYPRT

SEQ ID NO: 28446 - protein, 19 aa, Homo sapiens
  heavy chain complementarity determining region 3 for antibody 14223
ARDSPSVRKRPTEYYGMDV

SEQ ID NO: 28447 - protein, 9 aa, Homo sapiens
  light chain complementarity determining region 3 for antibody 14224
PQYNSFPWT

SEQ ID NO: 28448 - protein, 17 aa, Homo sapiens
  heavy chain complementarity determining region 3 for antibody 14224
ARRSGLYYFDAHNYYDF

SEQ ID NO: 28449 - protein, 9 aa, Homo sapiens
  light chain complementarity determining region 3 for antibody 14225
PQYITFPYT

SEQ ID NO: 28450 - protein, 17 aa, Homo sapiens
  heavy chain complementarity determining region 3 for antibody 14225
AREQWSDVDLRQFYFDY

SEQ ID NO: 28451 - protein, 10 aa, Homo sapiens
  light chain complementarity determining region 3 for antibody 14226
PQRTRWPPLT

SEQ ID NO: 28452 - protein, 12 aa, Homo sapiens
  heavy chain complementarity determining region 3 for antibody 14226
TDTHVTGGDWDY

SEQ ID NO: 28453 - protein, 9 aa, Homo sapiens
  light chain complementarity determining region 3 for antibody 14227
MQTQQTRPT

SEQ ID NO: 28454 - protein, 16 aa, Homo sapiens
  heavy chain complementarity determining region 3 for antibody 14227
ARVDSGSSFYFYGMDV

SEQ ID NO: 28455 - protein, 9 aa, Homo sapiens
  light chain complementarity determining region 3 for antibody 14228
MQTLQTPWT

SEQ ID NO: 28456 - protein, 12 aa, Homo sapiens
  heavy chain complementarity determining region 3 for antibody 14228
ARLDWNYRAFDI

SEQ ID NO: 28457 - protein, 8 aa, Homo sapiens
  light chain complementarity determining region 3 for antibody 14229
MQTLQRFT

SEQ ID NO: 28458 - protein, 12 aa, Homo sapiens
  heavy chain complementarity determining region 3 for antibody 14229
ARNGYSYGKFDY

SEQ ID NO: 28459 - protein, 9 aa, Homo sapiens
  light chain complementarity determining region 3 for antibody 14230
MQTLHTLYN

SEQ ID NO: 28460 - protein, 10 aa, Homo sapiens
  heavy chain complementarity determining region 3 for antibody 14230
ARSRHPAMDV

SEQ ID NO: 28461 - protein, 8 aa, Homo sapiens
  light chain complementarity determining region 3 for antibody 14231
MQGVYWAT

SEQ ID NO: 28462 - protein, 13 aa, Homo sapiens
  heavy chain complementarity determining region 3 for antibody 14231
VCGSWYGSESFSS

SEQ ID NO: 28463 - protein, 9 aa, Homo sapiens
  light chain complementarity determining region 3 for antibody 14232
MQGTYWPRT

SEQ ID NO: 28464 - protein, 15 aa, Homo sapiens
  heavy chain complementarity determining region 3 for antibody 14232
VRDRLHVLTGSSIDS

SEQ ID NO: 28465 - protein, 9 aa, Homo sapiens
  light chain complementarity determining region 3 for antibody 14233
MQGTNWPQT

SEQ ID NO: 28466 - protein, 20 aa, Homo sapiens
  heavy chain complementarity determining region 3 for antibody 14233
ARDGGYYDSSGYYYGASPEY

SEQ ID NO: 28467 - protein, 9 aa, Homo sapiens
  light chain complementarity determining region 3 for antibody 14234
MQGTHWPWT

SEQ ID NO: 28468 - protein, 11 aa, Homo sapiens
  heavy chain complementarity determining region 3 for antibody 14234
ARHVYYDHLDV

SEQ ID NO: 28469 - protein, 9 aa, Homo sapiens
  light chain complementarity determining region 3 for antibody 14235
MQGTHWPTT

SEQ ID NO: 28470 - protein, 14 aa, Homo sapiens
  heavy chain complementarity determining region 3 for antibody 14235
VKDKNHILTDHLDY

SEQ ID NO: 28471 - protein, 8 aa, Homo sapiens
  light chain complementarity determining region 3 for antibody 14236
MQGTHWPT

SEQ ID NO: 28472 - protein, 12 aa, Homo sapiens
  heavy chain complementarity determining region 3 for antibody 14236
AHDWDFNYGMDV

SEQ ID NO: 28473 - protein, 9 aa, Homo sapiens
  light chain complementarity determining region 3 for antibody 14237
MQGTHWPRT

SEQ ID NO: 28474 - protein, 11 aa, Homo sapiens
  heavy chain complementarity determining region 3 for antibody 14237
ARHVYYYHLDV

SEQ ID NO: 28475 - protein, 9 aa, Homo sapiens
  light chain complementarity determining region 3 for antibody 14238
MQGTHWPRT

SEQ ID NO: 28476 - protein, 13 aa, Homo sapiens
  heavy chain complementarity determining region 3 for antibody 14238
ARAYSRTFILLGY

SEQ ID NO: 28477 - protein, 9 aa, Homo sapiens
  light chain complementarity determining region 3 for antibody 14239
MQGTHWPPP

SEQ ID NO: 28478 - protein, 15 aa, Homo sapiens
  heavy chain complementarity determining region 3 for antibody 14239
ARGRRGFQEGMGLDV

SEQ ID NO: 28479 - protein, 10 aa, Homo sapiens
  light chain complementarity determining region 3 for antibody 14240
MQGTHWPPLN

SEQ ID NO: 28480 - protein, 26 aa, Homo sapiens
  heavy chain complementarity determining region 3 for antibody 14240
ARELITSIATPGHELPNYYYYYGMDV

SEQ ID NO: 28481 - protein, 10 aa, Homo sapiens
  light chain complementarity determining region 3 for antibody 14241
MQGTHWPPIP

SEQ ID NO: 28482 - protein, 8 aa, Homo sapiens
  heavy chain complementarity determining region 3 for antibody 14241
VTLFGFDD

SEQ ID NO: 28483 - protein, 8 aa, Homo sapiens
  light chain complementarity determining region 3 for antibody 14242
MQGTHWPN

SEQ ID NO: 28484 - protein, 12 aa, Homo sapiens
  heavy chain complementarity determining region 3 for antibody 14242
THDWDFNYGMDV

SEQ ID NO: 28485 - protein, 9 aa, Homo sapiens
  light chain complementarity determining region 3 for antibody 14243
MQGTHWPKT

SEQ ID NO: 28486 - protein, 20 aa, Homo sapiens
  heavy chain complementarity determining region 3 for antibody 14243
ARDGGYYDSSGYYYGASPDS

SEQ ID NO: 28487 - protein, 9 aa, Homo sapiens
  light chain complementarity determining region 3 for antibody 14244
MQGTHWPGT

SEQ ID NO: 28488 - protein, 16 aa, Homo sapiens
  heavy chain complementarity determining region 3 for antibody 14244
TTHFAPRRWLVREGDH

SEQ ID NO: 28489 - protein, 9 aa, Homo sapiens
  light chain complementarity determining region 3 for antibody 14245
MQGTHGPQT

SEQ ID NO: 28490 - protein, 20 aa, Homo sapiens
  heavy chain complementarity determining region 3 for antibody 14245
ARDGGYYDSSGYYYGASPEY

SEQ ID NO: 28491 - protein, 10 aa, Homo sapiens
  light chain complementarity determining region 3 for antibody 14246
MQGTHGPPLN

SEQ ID NO: 28492 - protein, 26 aa, Homo sapiens
  heavy chain complementarity determining region 3 for antibody 14246
ARELITSIATPGHEFPNYYYYYGMDV

SEQ ID NO: 28493 - protein, 9 aa, Homo sapiens
  light chain complementarity determining region 3 for antibody 14247
MQGLQTPLT

SEQ ID NO: 28494 - protein, 16 aa, Homo sapiens
  heavy chain complementarity determining region 3 for antibody 14247
ARGGFGELSLHNAFDV

SEQ ID NO: 28495 - protein, 9 aa, Homo sapiens
  light chain complementarity determining region 3 for antibody 14248
MQGLQTPLT

SEQ ID NO: 28496 - protein, 16 aa, Homo sapiens
  heavy chain complementarity determining region 3 for antibody 14248
AGGGFGELGLHNAFDV

SEQ ID NO: 28497 - protein, 9 aa, Homo sapiens
  light chain complementarity determining region 3 for antibody 14249
MQGLQTPLN

SEQ ID NO: 28498 - protein, 16 aa, Homo sapiens
  heavy chain complementarity determining region 3 for antibody 14249
ARGGFGELGLHNAFDV

SEQ ID NO: 28499 - protein, 7 aa, Homo sapiens
  light chain complementarity determining region 3 for antibody 14250
MQGLQIG

SEQ ID NO: 28500 - protein, 23 aa, Homo sapiens
  heavy chain complementarity determining region 3 for antibody 14250
ARTYDILTNHFRIGYDYHYNMDV

SEQ ID NO: 28501 - protein, 9 aa, Homo sapiens
  light chain complementarity determining region 3 for antibody 14251
MQGLQFPLP

SEQ ID NO: 28502 - protein, 19 aa, Homo sapiens
  heavy chain complementarity determining region 3 for antibody 14251
ARVAYYYDEEDHYYYAMDV

SEQ ID NO: 28503 - protein, 9 aa, Homo sapiens
  light chain complementarity determining region 3 for antibody 14252
MQGLPFPLT

SEQ ID NO: 28504 - protein, 19 aa, Homo sapiens
  heavy chain complementarity determining region 3 for antibody 14252
ARVAYYYDEEDHYYYAMDV

SEQ ID NO: 28505 - protein, 9 aa, Homo sapiens
  light chain complementarity determining region 3 for antibody 14253
MQGLLTPPA

SEQ ID NO: 28506 - protein, 18 aa, Homo sapiens
  heavy chain complementarity determining region 3 for antibody 14253
ARTRVGLYSGGAPFMFNP

SEQ ID NO: 28507 - protein, 9 aa, Homo sapiens
  light chain complementarity determining region 3 for antibody 14254
MQGLLSPPA

SEQ ID NO: 28508 - protein, 18 aa, Homo sapiens
  heavy chain complementarity determining region 3 for antibody 14254
ARTRVGVYGGGSPFMFDP

SEQ ID NO: 28509 - protein, 9 aa, Homo sapiens
  light chain complementarity determining region 3 for antibody 14255
MQGLHFPFT

SEQ ID NO: 28510 - protein, 19 aa, Homo sapiens
  heavy chain complementarity determining region 3 for antibody 14255
ARVAYYYDEEDHYYYAMDV

SEQ ID NO: 28511 - protein, 9 aa, Homo sapiens
  light chain complementarity determining region 3 for antibody 14256
MQGKHWPWT

SEQ ID NO: 28512 - protein, 11 aa, Homo sapiens
  heavy chain complementarity determining region 3 for antibody 14256
ARHVYYYHLDV

SEQ ID NO: 28513 - protein, 9 aa, Homo sapiens
  light chain complementarity determining region 3 for antibody 14257
MQAVQTHRT

SEQ ID NO: 28514 - protein, 14 aa, Homo sapiens
  heavy chain complementarity determining region 3 for antibody 14257
AREGQRQLAGDFDC

SEQ ID NO: 28515 - protein, 9 aa, Homo sapiens
  light chain complementarity determining region 3 for antibody 14258
MQAVQNPRT

SEQ ID NO: 28516 - protein, 14 aa, Homo sapiens
  heavy chain complementarity determining region 3 for antibody 14258
AREGQRQLAGDFDC

SEQ ID NO: 28517 - protein, 10 aa, Homo sapiens
  light chain complementarity determining region 3 for antibody 14259
MQATHWPPVT

SEQ ID NO: 28518 - protein, 8 aa, Homo sapiens
  heavy chain complementarity determining region 3 for antibody 14259
ARDASGSI

SEQ ID NO: 28519 - protein, 9 aa, Homo sapiens
  light chain complementarity determining region 3 for antibody 14260
MQATHWPPA

SEQ ID NO: 28520 - protein, 17 aa, Homo sapiens
  heavy chain complementarity determining region 3 for antibody 14260
ARGFLDRGSGWTYYLDY

SEQ ID NO: 28521 - protein, 9 aa, Homo sapiens
  light chain complementarity determining region 3 for antibody 14261
MQALRTPFT

SEQ ID NO: 28522 - protein, 19 aa, Homo sapiens
  heavy chain complementarity determining region 3 for antibody 14261
ARLDRYCTGSRCYSFWFEP

SEQ ID NO: 28523 - protein, 8 aa, Homo sapiens
  light chain complementarity determining region 3 for antibody 14262
MQALQTVP

SEQ ID NO: 28524 - protein, 18 aa, Homo sapiens
  heavy chain complementarity determining region 3 for antibody 14262
ARAPYYGDHGDRPNWFDP

SEQ ID NO: 28525 - protein, 9 aa, Homo sapiens
  light chain complementarity determining region 3 for antibody 14263
MQALQTPST

SEQ ID NO: 28526 - protein, 19 aa, Homo sapiens
  heavy chain complementarity determining region 3 for antibody 14263
ARLDRYCTGSRCYSFWFEP

SEQ ID NO: 28527 - protein, 9 aa, Homo sapiens
  light chain complementarity determining region 3 for antibody 14264
MQALQTPPT

SEQ ID NO: 28528 - protein, 19 aa, Homo sapiens
  heavy chain complementarity determining region 3 for antibody 14264
ARGFFDYDSSAYRSGWFDP

SEQ ID NO: 28529 - protein, 9 aa, Homo sapiens
  light chain complementarity determining region 3 for antibody 14265
MQALQTPPT

SEQ ID NO: 28530 - protein, 15 aa, Homo sapiens
  heavy chain complementarity determining region 3 for antibody 14265
ARAFGFGDSSHGMDV

SEQ ID NO: 28531 - protein, 9 aa, Homo sapiens
  light chain complementarity determining region 3 for antibody 14266
MQALQTPPA

SEQ ID NO: 28532 - protein, 15 aa, Homo sapiens
  heavy chain complementarity determining region 3 for antibody 14266
ARLTQLWPDYYGMDV

SEQ ID NO: 28533 - protein, 9 aa, Homo sapiens
  light chain complementarity determining region 3 for antibody 14267
MQALQTPFT

SEQ ID NO: 28534 - protein, 19 aa, Homo sapiens
  heavy chain complementarity determining region 3 for antibody 14267
VRLDRYCTGSRCYSFWFEP

SEQ ID NO: 28535 - protein, 9 aa, Homo sapiens
  light chain complementarity determining region 3 for antibody 14268
MQALQTPFN

SEQ ID NO: 28536 - protein, 19 aa, Homo sapiens
  heavy chain complementarity determining region 3 for antibody 14268
ARLDRYCTGSRCYSFWFEP

SEQ ID NO: 28537 - protein, 10 aa, Homo sapiens
  light chain complementarity determining region 3 for antibody 14269
MQALQTPAGT

SEQ ID NO: 28538 - protein, 19 aa, Homo sapiens
  heavy chain complementarity determining region 3 for antibody 14269
ARHGSWGDTVRAYPLPTDY

SEQ ID NO: 28539 - protein, 10 aa, Homo sapiens
  light chain complementarity determining region 3 for antibody 14270
MQALQTPAAT

SEQ ID NO: 28540 - protein, 19 aa, Homo sapiens
  heavy chain complementarity determining region 3 for antibody 14270
ARHGSWGDTVRAYPLPTDY

SEQ ID NO: 28541 - protein, 8 aa, Homo sapiens
  light chain complementarity determining region 3 for antibody 14271
MQALQTFT

SEQ ID NO: 28542 - protein, 11 aa, Homo sapiens
  heavy chain complementarity determining region 3 for antibody 14271
VHRQSRLNFDY

SEQ ID NO: 28543 - protein, 8 aa, Homo sapiens
  light chain complementarity determining region 3 for antibody 14272
MQALQRGT

SEQ ID NO: 28544 - protein, 17 aa, Homo sapiens
  heavy chain complementarity determining region 3 for antibody 14272
ARDSGEIEGPTSVPFVY

SEQ ID NO: 28545 - protein, 8 aa, Homo sapiens
  light chain complementarity determining region 3 for antibody 14273
MQALQPRP

SEQ ID NO: 28546 - protein, 16 aa, Homo sapiens
  heavy chain complementarity determining region 3 for antibody 14273
ARGGFGELGLHNAFDI

SEQ ID NO: 28547 - protein, 9 aa, Homo sapiens
  light chain complementarity determining region 3 for antibody 14274
MQALQPPFT

SEQ ID NO: 28548 - protein, 19 aa, Homo sapiens
  heavy chain complementarity determining region 3 for antibody 14274
ARLDRYCTGSRCYSFWFEP

SEQ ID NO: 28549 - protein, 9 aa, Homo sapiens
  light chain complementarity determining region 3 for antibody 14275
MQALQLPFT

SEQ ID NO: 28550 - protein, 19 aa, Homo sapiens
  heavy chain complementarity determining region 3 for antibody 14275
VRHDRYCSGDRCFSLWFDP

SEQ ID NO: 28551 - protein, 9 aa, Homo sapiens
  light chain complementarity determining region 3 for antibody 14276
MQALQIPFT

SEQ ID NO: 28552 - protein, 19 aa, Homo sapiens
  heavy chain complementarity determining region 3 for antibody 14276
VRHDRYCSGDRCFSFWFDP

SEQ ID NO: 28553 - protein, 9 aa, Homo sapiens
  light chain complementarity determining region 3 for antibody 14277
MQALPTPFT

SEQ ID NO: 28554 - protein, 19 aa, Homo sapiens
  heavy chain complementarity determining region 3 for antibody 14277
ARLDRYCTGSRCYSFWFEP

SEQ ID NO: 28555 - protein, 9 aa, Homo sapiens
  light chain complementarity determining region 3 for antibody 14278
MQALLPPIT

SEQ ID NO: 28556 - protein, 19 aa, Homo sapiens
  heavy chain complementarity determining region 3 for antibody 14278
ARGDFHYYSGSGGSFGMDV

SEQ ID NO: 28557 - protein, 9 aa, Homo sapiens
  light chain complementarity determining region 3 for antibody 14279
MQALKTSIT

SEQ ID NO: 28558 - protein, 14 aa, Homo sapiens
  heavy chain complementarity determining region 3 for antibody 14279
ARMWWTQLDHGPDV

SEQ ID NO: 28559 - protein, 6 aa, Homo sapiens
  light chain complementarity determining region 3 for antibody 14280
MQALKT

SEQ ID NO: 28560 - protein, 15 aa, Homo sapiens
  heavy chain complementarity determining region 3 for antibody 14280
ARGLLDTAMAFSFDY

SEQ ID NO: 28561 - protein, 9 aa, Homo sapiens
  light chain complementarity determining region 3 for antibody 14281
MQALHTPCT

SEQ ID NO: 28562 - protein, 19 aa, Homo sapiens
  heavy chain complementarity determining region 3 for antibody 14281
VRGLYSTYWSGYVGDGFDM

SEQ ID NO: 28563 - protein, 9 aa, Homo sapiens
  light chain complementarity determining region 3 for antibody 14282
MPGLQTPLT

SEQ ID NO: 28564 - protein, 16 aa, Homo sapiens
  heavy chain complementarity determining region 3 for antibody 14282
ARGGFGELGLHNAFDV

SEQ ID NO: 28565 - protein, 9 aa, Homo sapiens
  light chain complementarity determining region 3 for antibody 14283
MPGLLTPPA

SEQ ID NO: 28566 - protein, 18 aa, Homo sapiens
  heavy chain complementarity determining region 3 for antibody 14283
ARTRVGVYSGSSPFMFDP

SEQ ID NO: 28567 - protein, 9 aa, Homo sapiens
  light chain complementarity determining region 3 for antibody 14284
MPALQLPFT

SEQ ID NO: 28568 - protein, 19 aa, Homo sapiens
  heavy chain complementarity determining region 3 for antibody 14284
VRHDRYCSGDRCFSFWFDP

SEQ ID NO: 28569 - protein, 9 aa, Homo sapiens
  light chain complementarity determining region 3 for antibody 14285
MHGLLTPPA

SEQ ID NO: 28570 - protein, 18 aa, Homo sapiens
  heavy chain complementarity determining region 3 for antibody 14285
ARTRVGVYSGSSPFMFDP

SEQ ID NO: 28571 - protein, 9 aa, Homo sapiens
  light chain complementarity determining region 3 for antibody 14286
MHALQLPFT

SEQ ID NO: 28572 - protein, 19 aa, Homo sapiens
  heavy chain complementarity determining region 3 for antibody 14286
VRHDRYCSGDRCFSFWFDP

SEQ ID NO: 28573 - protein, 9 aa, Homo sapiens
  light chain complementarity determining region 3 for antibody 14287
MERTHWPPP

SEQ ID NO: 28574 - protein, 14 aa, Homo sapiens
  heavy chain complementarity determining region 3 for antibody 14287
ARVEVTVGATHFDS

SEQ ID NO: 28575 - protein, 10 aa, Homo sapiens
  light chain complementarity determining region 3 for antibody 14288
LRYVSSELFT

SEQ ID NO: 28576 - protein, 16 aa, Homo sapiens
  heavy chain complementarity determining region 3 for antibody 14288
ARELFKGEYDCYGMDV

SEQ ID NO: 28577 - protein, 10 aa, Homo sapiens
  light chain complementarity determining region 3 for antibody 14289
LRYVSSDLFT

SEQ ID NO: 28578 - protein, 16 aa, Homo sapiens
  heavy chain complementarity determining region 3 for antibody 14289
ARELFKGEYDYYGMDV

SEQ ID NO: 28579 - protein, 10 aa, Homo sapiens
  light chain complementarity determining region 3 for antibody 14290
LRDVSSELFT

SEQ ID NO: 28580 - protein, 16 aa, Homo sapiens
  heavy chain complementarity determining region 3 for antibody 14290
ARELFKGEYDYYGMDV

SEQ ID NO: 28581 - protein, 9 aa, Homo sapiens
  light chain complementarity determining region 3 for antibody 14291
LQYNNWPWT

SEQ ID NO: 28582 - protein, 16 aa, Homo sapiens
  heavy chain complementarity determining region 3 for antibody 14291
ARDSGIESRGLWYFDL

SEQ ID NO: 28583 - protein, 9 aa, Homo sapiens
  light chain complementarity determining region 3 for antibody 14292
LQYNNWPRT

SEQ ID NO: 28584 - protein, 16 aa, Homo sapiens
  heavy chain complementarity determining region 3 for antibody 14292
ARNSGIESRGLWYFDL

SEQ ID NO: 28585 - protein, 9 aa, Homo sapiens
  light chain complementarity determining region 3 for antibody 14293
LQYNNWPRT

SEQ ID NO: 28586 - protein, 16 aa, Homo sapiens
  heavy chain complementarity determining region 3 for antibody 14293
ARDSGIESRGSWYFDL

SEQ ID NO: 28587 - protein, 9 aa, Homo sapiens
  light chain complementarity determining region 3 for antibody 14294
LQYDSYSWT

SEQ ID NO: 28588 - protein, 16 aa, Homo sapiens
  heavy chain complementarity determining region 3 for antibody 14294
ARVGMWDGYNLPGVGV

SEQ ID NO: 28589 - protein, 9 aa, Homo sapiens
  light chain complementarity determining region 3 for antibody 14295
LQRYRTPWT

SEQ ID NO: 28590 - protein, 12 aa, Homo sapiens
  heavy chain complementarity determining region 3 for antibody 14295
ARDWGTGDHFKY

SEQ ID NO: 28591 - protein, 9 aa, Homo sapiens
  light chain complementarity determining region 3 for antibody 14296
LQRSAWPPT

SEQ ID NO: 28592 - protein, 12 aa, Homo sapiens
  heavy chain complementarity determining region 3 for antibody 14296
ARDTGGDWYFDY

SEQ ID NO: 28593 - protein, 12 aa, Homo sapiens
  light chain complementarity determining region 3 for antibody 14297
LQHDNFPLDVRT

SEQ ID NO: 28594 - protein, 11 aa, Homo sapiens
  heavy chain complementarity determining region 3 for antibody 14297
AREQTGYYPLY

SEQ ID NO: 28595 - protein, 9 aa, Homo sapiens
  light chain complementarity determining region 3 for antibody 14298
LQGYKYPRT

SEQ ID NO: 28596 - protein, 18 aa, Homo sapiens
  heavy chain complementarity determining region 3 for antibody 14298
ARDTSPGDSSAWYDAFDI

SEQ ID NO: 28597 - protein, 9 aa, Homo sapiens
  light chain complementarity determining region 3 for antibody 14299
LQGLLTPPA

SEQ ID NO: 28598 - protein, 18 aa, Homo sapiens
  heavy chain complementarity determining region 3 for antibody 14299
ARTRVGLYSGGSPFMFDP

SEQ ID NO: 28599 - protein, 9 aa, Homo sapiens
  light chain complementarity determining region 3 for antibody 14300
LQESTYPLT

SEQ ID NO: 28600 - protein, 19 aa, Homo sapiens
  heavy chain complementarity determining region 3 for antibody 14300
AREEGYYDGSGSWHPDSDN

SEQ ID NO: 28601 - protein, 9 aa, Homo sapiens
  light chain complementarity determining region 3 for antibody 14301
LQDYKYPRT

SEQ ID NO: 28602 - protein, 16 aa, Homo sapiens
  heavy chain complementarity determining region 3 for antibody 14301
ATTTGYSNYYYYGMDV

SEQ ID NO: 28603 - protein, 9 aa, Homo sapiens
  light chain complementarity determining region 3 for antibody 14302
LQDYKYPRT

SEQ ID NO: 28604 - protein, 18 aa, Homo sapiens
  heavy chain complementarity determining region 3 for antibody 14302
ARDTSPGESSAWYDAFDI

SEQ ID NO: 28605 - protein, 9 aa, Homo sapiens
  light chain complementarity determining region 3 for antibody 14303
LQDYKYPRT

SEQ ID NO: 28606 - protein, 18 aa, Homo sapiens
  heavy chain complementarity determining region 3 for antibody 14303
ARDTSPGDSSTWYDAFDI

SEQ ID NO: 28607 - protein, 9 aa, Homo sapiens
  light chain complementarity determining region 3 for antibody 14304
LQDYKYPRT

SEQ ID NO: 28608 - protein, 18 aa, Homo sapiens
  heavy chain complementarity determining region 3 for antibody 14304
ARDTSPGDSSAWYGAFDI

SEQ ID NO: 28609 - protein, 9 aa, Homo sapiens
  light chain complementarity determining region 3 for antibody 14305
LQDYKYPRT

SEQ ID NO: 28610 - protein, 18 aa, Homo sapiens
  heavy chain complementarity determining region 3 for antibody 14305
ARDTSPGDSSAWYDAFDT

SEQ ID NO: 28611 - protein, 9 aa, Homo sapiens
  light chain complementarity determining region 3 for antibody 14306
LQDYKYPRT

SEQ ID NO: 28612 - protein, 12 aa, Homo sapiens
  heavy chain complementarity determining region 3 for antibody 14306
AKGILGRGGMDV

SEQ ID NO: 28613 - protein, 9 aa, Homo sapiens
  light chain complementarity determining region 3 for antibody 14307
LQDYKHPRT

SEQ ID NO: 28614 - protein, 18 aa, Homo sapiens
  heavy chain complementarity determining region 3 for antibody 14307
ARDTSPGDSSAWYDAFDI

SEQ ID NO: 28615 - protein, 9 aa, Homo sapiens
  light chain complementarity determining region 3 for antibody 14308
LQAYRFPLS

SEQ ID NO: 28616 - protein, 13 aa, Homo sapiens
  heavy chain complementarity determining region 3 for antibody 14308
TRTYGSGRNWFDP

SEQ ID NO: 28617 - protein, 9 aa, Homo sapiens
  light chain complementarity determining region 3 for antibody 14309
LQATHWPYT

SEQ ID NO: 28618 - protein, 11 aa, Homo sapiens
  heavy chain complementarity determining region 3 for antibody 14309
AKDTQWRPFDC

SEQ ID NO: 28619 - protein, 9 aa, Homo sapiens
  light chain complementarity determining region 3 for antibody 14310
LQATHWPHT

SEQ ID NO: 28620 - protein, 11 aa, Homo sapiens
  heavy chain complementarity determining region 3 for antibody 14310
AKDTQWLPFDC

SEQ ID NO: 28621 - protein, 9 aa, Homo sapiens
  light chain complementarity determining region 3 for antibody 14311
LQANTYPLT

SEQ ID NO: 28622 - protein, 19 aa, Homo sapiens
  heavy chain complementarity determining region 3 for antibody 14311
AREEGYYDGSGSFHPESDY

SEQ ID NO: 28623 - protein, 9 aa, Homo sapiens
  light chain complementarity determining region 3 for antibody 14312
LPATHWPYT

SEQ ID NO: 28624 - protein, 11 aa, Homo sapiens
  heavy chain complementarity determining region 3 for antibody 14312
AKDTQWLPFDC

SEQ ID NO: 28625 - protein, 9 aa, Homo sapiens
  light chain complementarity determining region 3 for antibody 14313
LKDYKYPRT

SEQ ID NO: 28626 - protein, 18 aa, Homo sapiens
  heavy chain complementarity determining region 3 for antibody 14313
ARDTSPGDSSAWYDAFDI

SEQ ID NO: 28627 - protein, 9 aa, Homo sapiens
  light chain complementarity determining region 3 for antibody 14314
KQYGTSWYT

SEQ ID NO: 28628 - protein, 20 aa, Homo sapiens
  heavy chain complementarity determining region 3 for antibody 14314
ARDPHRYGGKDLLYHYGMDV

SEQ ID NO: 28629 - protein, 9 aa, Homo sapiens
  light chain complementarity determining region 3 for antibody 14315
KQSFSPPWA

SEQ ID NO: 28630 - protein, 19 aa, Homo sapiens
  heavy chain complementarity determining region 3 for antibody 14315
ATMRYGSGELTYDYYGMDV

SEQ ID NO: 28631 - protein, 9 aa, Homo sapiens
  light chain complementarity determining region 3 for antibody 14316
KQANSFPRT

SEQ ID NO: 28632 - protein, 20 aa, Homo sapiens
  heavy chain complementarity determining region 3 for antibody 14316
ARDVVYSSRIEVYYYYGMDV

SEQ ID NO: 28633 - protein, 6 aa, Homo sapiens
  light chain complementarity determining region 3 for antibody 14317
HYYGNS

SEQ ID NO: 28634 - protein, 18 aa, Homo sapiens
  heavy chain complementarity determining region 3 for antibody 14317
ATRHADYFNGYYYCALDV

SEQ ID NO: 28635 - protein, 8 aa, Homo sapiens
  light chain complementarity determining region 3 for antibody 14318
HQYYSTPT

SEQ ID NO: 28636 - protein, 28 aa, Homo sapiens
  heavy chain complementarity determining region 3 for antibody 14318
ARTRREAPYYDPLTGYYESVHYYYAMDV

SEQ ID NO: 28637 - protein, 8 aa, Homo sapiens
  light chain complementarity determining region 3 for antibody 14319
HQYYSPGT

SEQ ID NO: 28638 - protein, 18 aa, Homo sapiens
  heavy chain complementarity determining region 3 for antibody 14319
ARAEGRYYDSSGYLPLGY

SEQ ID NO: 28639 - protein, 9 aa, Homo sapiens
  light chain complementarity determining region 3 for antibody 14320
HQYSVSRGT

SEQ ID NO: 28640 - protein, 21 aa, Homo sapiens
  heavy chain complementarity determining region 3 for antibody 14320
ARERGGDFHGDSSYYNRPFDY

SEQ ID NO: 28641 - protein, 9 aa, Homo sapiens
  light chain complementarity determining region 3 for antibody 14321
HQYSVSRGT

SEQ ID NO: 28642 - protein, 21 aa, Homo sapiens
  heavy chain complementarity determining region 3 for antibody 14321
ARDRGGDFHGDSSYYNRPCDY

SEQ ID NO: 28643 - protein, 9 aa, Homo sapiens
  light chain complementarity determining region 3 for antibody 14322
HQYSVSRGN

SEQ ID NO: 28644 - protein, 21 aa, Homo sapiens
  heavy chain complementarity determining region 3 for antibody 14322
ARDRGGDFHGDSSYYNRPFDY

SEQ ID NO: 28645 - protein, 9 aa, Homo sapiens
  light chain complementarity determining region 3 for antibody 14323
HQYSVSRGA

SEQ ID NO: 28646 - protein, 21 aa, Homo sapiens
  heavy chain complementarity determining region 3 for antibody 14323
ARDRGGDFHGDSSYYNRPFDY

SEQ ID NO: 28647 - protein, 9 aa, Homo sapiens
  light chain complementarity determining region 3 for antibody 14324
HQYSIVPHT

SEQ ID NO: 28648 - protein, 18 aa, Homo sapiens
  heavy chain complementarity determining region 3 for antibody 14324
ARPRGCSSSSCFYDPFDY

SEQ ID NO: 28649 - protein, 10 aa, Homo sapiens
  light chain complementarity determining region 3 for antibody 14325
HQYNNWPPGT

SEQ ID NO: 28650 - protein, 19 aa, Homo sapiens
  heavy chain complementarity determining region 3 for antibody 14325
VTDYDFPRHSSSWSPWFDP

SEQ ID NO: 28651 - protein, 9 aa, Homo sapiens
  light chain complementarity determining region 3 for antibody 14326
HQYGTSRGT

SEQ ID NO: 28652 - protein, 21 aa, Homo sapiens
  heavy chain complementarity determining region 3 for antibody 14326
ATDRGGGYYRKSGYYYRPFDY

SEQ ID NO: 28653 - protein, 10 aa, Homo sapiens
  light chain complementarity determining region 3 for antibody 14327
HQYGSSLPDT

SEQ ID NO: 28654 - protein, 12 aa, Homo sapiens
  heavy chain complementarity determining region 3 for antibody 14327
AREYYGSASFGN

SEQ ID NO: 28655 - protein, 10 aa, Homo sapiens
  light chain complementarity determining region 3 for antibody 14328
HQYGGSPPST

SEQ ID NO: 28656 - protein, 13 aa, Homo sapiens
  heavy chain complementarity determining region 3 for antibody 14328
AKEGTVVAAPLDV

SEQ ID NO: 28657 - protein, 9 aa, Homo sapiens
  light chain complementarity determining region 3 for antibody 14329
HQYATLPLT

SEQ ID NO: 28658 - protein, 10 aa, Homo sapiens
  heavy chain complementarity determining region 3 for antibody 14329
GYSNGWLVHY

SEQ ID NO: 28659 - protein, 8 aa, Homo sapiens
  light chain complementarity determining region 3 for antibody 14330
HQTNSFPP

SEQ ID NO: 28660 - protein, 22 aa, Homo sapiens
  heavy chain complementarity determining region 3 for antibody 14330
ARHSGYSNTRYMNYYYYYGMDV

SEQ ID NO: 28661 - protein, 9 aa, Homo sapiens
  light chain complementarity determining region 3 for antibody 14331
HQSYSTPRT

SEQ ID NO: 28662 - protein, 17 aa, Homo sapiens
  heavy chain complementarity determining region 3 for antibody 14331
TKDYYGDYMAQYNWFDS

SEQ ID NO: 28663 - protein, 10 aa, Homo sapiens
  light chain complementarity determining region 3 for antibody 14332
HQSTIFPRLT

SEQ ID NO: 28664 - protein, 18 aa, Homo sapiens
  heavy chain complementarity determining region 3 for antibody 14332
ARDVGYDRSANYHWYFDV

SEQ ID NO: 28665 - protein, 10 aa, Homo sapiens
  light chain complementarity determining region 3 for antibody 14333
HQSSSLPRLT

SEQ ID NO: 28666 - protein, 18 aa, Homo sapiens
  heavy chain complementarity determining region 3 for antibody 14333
ARDVGYDSNAHYHLYFDL

SEQ ID NO: 28667 - protein, 9 aa, Homo sapiens
  light chain complementarity determining region 3 for antibody 14334
HQSRSLPWT

SEQ ID NO: 28668 - protein, 15 aa, Homo sapiens
  heavy chain complementarity determining region 3 for antibody 14334
ATLRVVGITSEWSGS

SEQ ID NO: 28669 - protein, 9 aa, Homo sapiens
  light chain complementarity determining region 3 for antibody 14335
HQSLTAPLT

SEQ ID NO: 28670 - protein, 17 aa, Homo sapiens
  heavy chain complementarity determining region 3 for antibody 14335
TRSIVSGSGWNAGGFDC

SEQ ID NO: 28671 - protein, 10 aa, Homo sapiens
  light chain complementarity determining region 3 for antibody 14336
HQSFSPPPLT

SEQ ID NO: 28672 - protein, 10 aa, Homo sapiens
  heavy chain complementarity determining region 3 for antibody 14336
ARDWGWGFDP

SEQ ID NO: 28673 - protein, 10 aa, Homo sapiens
  light chain complementarity determining region 3 for antibody 14337
HQRSNCPPFT

SEQ ID NO: 28674 - protein, 15 aa, Homo sapiens
  heavy chain complementarity determining region 3 for antibody 14337
ARDGCSGASCYSFEH

SEQ ID NO: 28675 - protein, 10 aa, Homo sapiens
  light chain complementarity determining region 3 for antibody 14338
HQRGSLPRLT

SEQ ID NO: 28676 - protein, 18 aa, Homo sapiens
  heavy chain complementarity determining region 3 for antibody 14338
ARDVGYDSRANYHWYFDL

SEQ ID NO: 28677 - protein, 9 aa, Homo sapiens
  light chain complementarity determining region 3 for antibody 14339
HQRGNWPPT

SEQ ID NO: 28678 - protein, 13 aa, Homo sapiens
  heavy chain complementarity determining region 3 for antibody 14339
ARDGVWSTSSAGL

SEQ ID NO: 28679 - protein, 9 aa, Homo sapiens
  light chain complementarity determining region 3 for antibody 14340
HQRGNWPPT

SEQ ID NO: 28680 - protein, 13 aa, Homo sapiens
  heavy chain complementarity determining region 3 for antibody 14340
ARDGVWSASSADL

SEQ ID NO: 28681 - protein, 9 aa, Homo sapiens
  light chain complementarity determining region 3 for antibody 14341
HQRGNCPPT

SEQ ID NO: 28682 - protein, 13 aa, Homo sapiens
  heavy chain complementarity determining region 3 for antibody 14341
ARDGVWSTSSADL

SEQ ID NO: 28683 - protein, 9 aa, Homo sapiens
  light chain complementarity determining region 3 for antibody 14342
HQNSVSRGT

SEQ ID NO: 28684 - protein, 21 aa, Homo sapiens
  heavy chain complementarity determining region 3 for antibody 14342
ARDRGGDFHGDSSYYNRPFDY

SEQ ID NO: 28685 - protein, 9 aa, Homo sapiens
  light chain complementarity determining region 3 for antibody 14343
HQFHSYPIT

SEQ ID NO: 28686 - protein, 16 aa, Homo sapiens
  heavy chain complementarity determining region 3 for antibody 14343
ARTQGTRDYYYYAMDV

SEQ ID NO: 28687 - protein, 9 aa, Homo sapiens
  light chain complementarity determining region 3 for antibody 14344
HQAYRFPLS

SEQ ID NO: 28688 - protein, 13 aa, Homo sapiens
  heavy chain complementarity determining region 3 for antibody 14344
TRTYGSGRNWFDP

SEQ ID NO: 28689 - protein, 8 aa, Homo sapiens
  light chain complementarity determining region 3 for antibody 14345
HQANSFPP

SEQ ID NO: 28690 - protein, 22 aa, Homo sapiens
  heavy chain complementarity determining region 3 for antibody 14345
TRHSGYSNTWYMNYYYCYGMDV

SEQ ID NO: 28691 - protein, 8 aa, Homo sapiens
  light chain complementarity determining region 3 for antibody 14346
HQANSFPP

SEQ ID NO: 28692 - protein, 22 aa, Homo sapiens
  heavy chain complementarity determining region 3 for antibody 14346
ARHSGYSNTWYMNYYYYYGMDV

SEQ ID NO: 28693 - protein, 9 aa, Homo sapiens
  light chain complementarity determining region 3 for antibody 14347
HPYYSPSLT

SEQ ID NO: 28694 - protein, 13 aa, Homo sapiens
  heavy chain complementarity determining region 3 for antibody 14347
ARGEGSEFYGMDV

SEQ ID NO: 28695 - protein, 8 aa, Homo sapiens
  light chain complementarity determining region 3 for antibody 14348
HPYYSIPT

SEQ ID NO: 28696 - protein, 28 aa, Homo sapiens
  heavy chain complementarity determining region 3 for antibody 14348
ARTRREAPYYDPLTGYYESVHYYYAMDV

SEQ ID NO: 28697 - protein, 10 aa, Homo sapiens
  light chain complementarity determining region 3 for antibody 14349
EYHGYSPLYT

SEQ ID NO: 28698 - protein, 12 aa, Homo sapiens
  heavy chain complementarity determining region 3 for antibody 14349
AKGILGRGGMDV

SEQ ID NO: 28699 - protein, 9 aa, Homo sapiens
  light chain complementarity determining region 3 for antibody 14350
AQALQTPIT

SEQ ID NO: 28700 - protein, 21 aa, Homo sapiens
  heavy chain complementarity determining region 3 for antibody 14350
VRGEAYNDILTGLPRLRRLDN

SEQ ID NO: 28701 - protein, 9 aa, Homo sapiens
  light chain complementarity determining region 3 for antibody 14351
VQGTHWPLT

SEQ ID NO: 28702 - protein, 13 aa, Homo sapiens
  heavy chain complementarity determining region 3 for antibody 14351
ARAYSRTFILLGY

SEQ ID NO: 28703 - protein, 9 aa, Homo sapiens
  light chain complementarity determining region 3 for antibody 14352
VQDLQTPIT

SEQ ID NO: 28704 - protein, 21 aa, Homo sapiens
  heavy chain complementarity determining region 3 for antibody 14352
VRGEAYNDILTGLPRLRRLDN

SEQ ID NO: 28705 - protein, 9 aa, Homo sapiens
  light chain complementarity determining region 3 for antibody 14353
VQATHWPPA

SEQ ID NO: 28706 - protein, 17 aa, Homo sapiens
  heavy chain complementarity determining region 3 for antibody 14353
ARGFLDRGSGWTYYFDY

SEQ ID NO: 28707 - protein, 9 aa, Homo sapiens
  light chain complementarity determining region 3 for antibody 14354
VQALQTPST

SEQ ID NO: 28708 - protein, 21 aa, Homo sapiens
  heavy chain complementarity determining region 3 for antibody 14354
VRGEAYNDILTGLPRLRRLDN

SEQ ID NO: 28709 - protein, 9 aa, Homo sapiens
  light chain complementarity determining region 3 for antibody 14355
VQALQTPLT

SEQ ID NO: 28710 - protein, 18 aa, Homo sapiens
  heavy chain complementarity determining region 3 for antibody 14355
GRDGRGGGISVAAPGFDL

SEQ ID NO: 28711 - protein, 9 aa, Homo sapiens
  light chain complementarity determining region 3 for antibody 14356
VQALQTPIT

SEQ ID NO: 28712 - protein, 21 aa, Homo sapiens
  heavy chain complementarity determining region 3 for antibody 14356
VRGEAYNEILTGLPRLRRLDN

SEQ ID NO: 28713 - protein, 9 aa, Homo sapiens
  light chain complementarity determining region 3 for antibody 14357
VQALQTPIT

SEQ ID NO: 28714 - protein, 21 aa, Homo sapiens
  heavy chain complementarity determining region 3 for antibody 14357
VRGEAYNDIWTGLPRLRRLDN

SEQ ID NO: 28715 - protein, 9 aa, Homo sapiens
  light chain complementarity determining region 3 for antibody 14358
VQALQTPIT

SEQ ID NO: 28716 - protein, 21 aa, Homo sapiens
  heavy chain complementarity determining region 3 for antibody 14358
VRGEAYNDILTGLPRLRRLVN

SEQ ID NO: 28717 - protein, 9 aa, Homo sapiens
  light chain complementarity determining region 3 for antibody 14359
VQALQTPIT

SEQ ID NO: 28718 - protein, 21 aa, Homo sapiens
  heavy chain complementarity determining region 3 for antibody 14359
VRGEAYNDILTGFPRLRRLDN

SEQ ID NO: 28719 - protein, 8 aa, Homo sapiens
  light chain complementarity determining region 3 for antibody 14360
VQALQTFT

SEQ ID NO: 28720 - protein, 16 aa, Homo sapiens
  heavy chain complementarity determining region 3 for antibody 14360
ARVGVSDTNYYYGMDV

SEQ ID NO: 28721 - protein, 9 aa, Homo sapiens
  light chain complementarity determining region 3 for antibody 14361
VQALKTPIT

SEQ ID NO: 28722 - protein, 21 aa, Homo sapiens
  heavy chain complementarity determining region 3 for antibody 14361
VRGEAYNDILTGLPRLRRLDN

SEQ ID NO: 28723 - protein, 9 aa, Homo sapiens
  light chain complementarity determining region 3 for antibody 14362
VHGTHAGFT

SEQ ID NO: 28724 - protein, 10 aa, Homo sapiens
  heavy chain complementarity determining region 3 for antibody 14362
AKYLRRAFDV

SEQ ID NO: 28725 - protein, 9 aa, Homo sapiens
  light chain complementarity determining region 3 for antibody 14363
TQGTYWPLT

SEQ ID NO: 28726 - protein, 15 aa, Homo sapiens
  heavy chain complementarity determining region 3 for antibody 14363
VRDRLHVLTGSSIDS

SEQ ID NO: 28727 - protein, 7 aa, Homo sapiens
  light chain complementarity determining region 3 for antibody 14364
TQGTNNT

SEQ ID NO: 28728 - protein, 14 aa, Homo sapiens
  heavy chain complementarity determining region 3 for antibody 14364
ARSLYGDYANWIDP

SEQ ID NO: 28729 - protein, 9 aa, Homo sapiens
  light chain complementarity determining region 3 for antibody 14365
TQGLLTPPA

SEQ ID NO: 28730 - protein, 18 aa, Homo sapiens
  heavy chain complementarity determining region 3 for antibody 14365
ARTRVGLYSGGSPFMFNP

SEQ ID NO: 28731 - protein, 9 aa, Homo sapiens
  light chain complementarity determining region 3 for antibody 14366
SQSYSTPYT

SEQ ID NO: 28732 - protein, 17 aa, Homo sapiens
  heavy chain complementarity determining region 3 for antibody 14366
ARGSYYDVDLNRFYFDY

SEQ ID NO: 28733 - protein, 9 aa, Homo sapiens
  light chain complementarity determining region 3 for antibody 14367
RQYYFTPYT

SEQ ID NO: 28734 - protein, 20 aa, Homo sapiens
  heavy chain complementarity determining region 3 for antibody 14367
ATAHQSCSGNTCYSEGWFDS

SEQ ID NO: 28735 - protein, 10 aa, Homo sapiens
  light chain complementarity determining region 3 for antibody 14368
RQYVSSALYT

SEQ ID NO: 28736 - protein, 16 aa, Homo sapiens
  heavy chain complementarity determining region 3 for antibody 14368
ARELFKGEYDYYAMDV

SEQ ID NO: 28737 - protein, 10 aa, Homo sapiens
  light chain complementarity determining region 3 for antibody 14369
RQYSSSPQLT

SEQ ID NO: 28738 - protein, 13 aa, Homo sapiens
  heavy chain complementarity determining region 3 for antibody 14369
ARSAGYYPNWLES

SEQ ID NO: 28739 - protein, 9 aa, Homo sapiens
  light chain complementarity determining region 3 for antibody 14370
RQYNNWPRS

SEQ ID NO: 28740 - protein, 15 aa, Homo sapiens
  heavy chain complementarity determining region 3 for antibody 14370
VKSGTYSSSSGWFDT

SEQ ID NO: 28741 - protein, 9 aa, Homo sapiens
  light chain complementarity determining region 3 for antibody 14371
RQYKTYPYT

SEQ ID NO: 28742 - protein, 17 aa, Homo sapiens
  heavy chain complementarity determining region 3 for antibody 14371
AREDWNDVDLREYYFDY

SEQ ID NO: 28743 - protein, 9 aa, Homo sapiens
  light chain complementarity determining region 3 for antibody 14372
RQYHSYPLT

SEQ ID NO: 28744 - protein, 15 aa, Homo sapiens
  heavy chain complementarity determining region 3 for antibody 14372
ARGGIHYDILTGLDY

SEQ ID NO: 28745 - protein, 10 aa, Homo sapiens
  light chain complementarity determining region 3 for antibody 14373
RQYDNLPPFT

SEQ ID NO: 28746 - protein, 16 aa, Homo sapiens
  heavy chain complementarity determining region 3 for antibody 14373
ARELFKGEYDYYAMDV

SEQ ID NO: 28747 - protein, 9 aa, Homo sapiens
  light chain complementarity determining region 3 for antibody 14374
RQVNSYDYT

SEQ ID NO: 28748 - protein, 16 aa, Homo sapiens
  heavy chain complementarity determining region 3 for antibody 14374
ASTTGFSNKYYYGMDV

SEQ ID NO: 28749 - protein, 9 aa, Homo sapiens
  light chain complementarity determining region 3 for antibody 14375
RQSYSSPTT

SEQ ID NO: 28750 - protein, 14 aa, Homo sapiens
  heavy chain complementarity determining region 3 for antibody 14375
ARASERSGYYEIDY

SEQ ID NO: 28751 - protein, 9 aa, Homo sapiens
  light chain complementarity determining region 3 for antibody 14376
RQSFSPPWA

SEQ ID NO: 28752 - protein, 19 aa, Homo sapiens
  heavy chain complementarity determining region 3 for antibody 14376
ATMRYGSGELTYDYYGMDV

SEQ ID NO: 28753 - protein, 9 aa, Homo sapiens
  light chain complementarity determining region 3 for antibody 14377
RQLNSYPLT

SEQ ID NO: 28754 - protein, 16 aa, Homo sapiens
  heavy chain complementarity determining region 3 for antibody 14377
AGSRREGYNWVWYFDL

SEQ ID NO: 28755 - protein, 9 aa, Homo sapiens
  light chain complementarity determining region 3 for antibody 14378
RQLHGYPLT

SEQ ID NO: 28756 - protein, 21 aa, Homo sapiens
  heavy chain complementarity determining region 3 for antibody 14378
ARDWAQSNGYPVGHYYYGMDV

SEQ ID NO: 28757 - protein, 9 aa, Homo sapiens
  light chain complementarity determining region 3 for antibody 14379
RQFHSYPIT

SEQ ID NO: 28758 - protein, 16 aa, Homo sapiens
  heavy chain complementarity determining region 3 for antibody 14379
ARTQGTRDYYYYAMDV

SEQ ID NO: 28759 - protein, 9 aa, Homo sapiens
  light chain complementarity determining region 3 for antibody 14380
RQFEYLPLT

SEQ ID NO: 28760 - protein, 19 aa, Homo sapiens
  heavy chain complementarity determining region 3 for antibody 14380
ARHKFRIGQSDYYYYKTDV

SEQ ID NO: 28761 - protein, 9 aa, Homo sapiens
  light chain complementarity determining region 3 for antibody 14381
RQFDTYPIT

SEQ ID NO: 28762 - protein, 12 aa, Homo sapiens
  heavy chain complementarity determining region 3 for antibody 14381
TRLAVPTSSVDY

SEQ ID NO: 28763 - protein, 9 aa, Homo sapiens
  light chain complementarity determining region 3 for antibody 14382
RQFDNYPIT

SEQ ID NO: 28764 - protein, 12 aa, Homo sapiens
  heavy chain complementarity determining region 3 for antibody 14382
TRLAVPTSRVDY

SEQ ID NO: 28765 - protein, 9 aa, Homo sapiens
  light chain complementarity determining region 3 for antibody 14383
RQFATYPIT

SEQ ID NO: 28766 - protein, 12 aa, Homo sapiens
  heavy chain complementarity determining region 3 for antibody 14383
TRLAVPTSRVDY

SEQ ID NO: 28767 - protein, 10 aa, Homo sapiens
  light chain complementarity determining region 3 for antibody 14384
QYYGYSPLYT

SEQ ID NO: 28768 - protein, 12 aa, Homo sapiens
  heavy chain complementarity determining region 3 for antibody 14384
AKGILGRGGMDV

SEQ ID NO: 28769 - protein, 9 aa, Homo sapiens
  light chain complementarity determining region 3 for antibody 14385
QYYGGSPYT

SEQ ID NO: 28770 - protein, 14 aa, Homo sapiens
  heavy chain complementarity determining region 3 for antibody 14385
ARGSTRLGGGDFDY

SEQ ID NO: 28771 - protein, 9 aa, Homo sapiens
  light chain complementarity determining region 3 for antibody 14386
QYYGGSPYT

SEQ ID NO: 28772 - protein, 14 aa, Homo sapiens
  heavy chain complementarity determining region 3 for antibody 14386
ARDSTRRGGGDFDY

SEQ ID NO: 28773 - protein, 10 aa, Homo sapiens
  light chain complementarity determining region 3 for antibody 14387
QYNGYSPLYP

SEQ ID NO: 28774 - protein, 12 aa, Homo sapiens
  heavy chain complementarity determining region 3 for antibody 14387
AKGILGRGGMDV

SEQ ID NO: 28775 - protein, 10 aa, Homo sapiens
  light chain complementarity determining region 3 for antibody 14388
QYNGYSPLST

SEQ ID NO: 28776 - protein, 12 aa, Homo sapiens
  heavy chain complementarity determining region 3 for antibody 14388
AKGILGRGGMDV

SEQ ID NO: 28777 - protein, 11 aa, Homo sapiens
  light chain complementarity determining region 3 for antibody 14389
QYNGSSPPETT

SEQ ID NO: 28778 - protein, 17 aa, Homo sapiens
  heavy chain complementarity determining region 3 for antibody 14389
ARESYDVLTGYNYGMDV

SEQ ID NO: 28779 - protein, 10 aa, Homo sapiens
  light chain complementarity determining region 3 for antibody 14390
QYHGYTPLYT

SEQ ID NO: 28780 - protein, 12 aa, Homo sapiens
  heavy chain complementarity determining region 3 for antibody 14390
AKGILGRGGMDV

SEQ ID NO: 28781 - protein, 10 aa, Homo sapiens
  light chain complementarity determining region 3 for antibody 14391
QYHGYSSLYT

SEQ ID NO: 28782 - protein, 12 aa, Homo sapiens
  heavy chain complementarity determining region 3 for antibody 14391
AKGILGRGGMDV

SEQ ID NO: 28783 - protein, 10 aa, Homo sapiens
  light chain complementarity determining region 3 for antibody 14392
QYHGYSPLYT

SEQ ID NO: 28784 - protein, 12 aa, Homo sapiens
  heavy chain complementarity determining region 3 for antibody 14392
EKGILGRGGMDV

SEQ ID NO: 28785 - protein, 10 aa, Homo sapiens
  light chain complementarity determining region 3 for antibody 14393
QYHGYSPLYT

SEQ ID NO: 28786 - protein, 12 aa, Homo sapiens
  heavy chain complementarity determining region 3 for antibody 14393
AVELGYGDIPIA

SEQ ID NO: 28787 - protein, 10 aa, Homo sapiens
  light chain complementarity determining region 3 for antibody 14394
QYHGYSPLYT

SEQ ID NO: 28788 - protein, 13 aa, Homo sapiens
  heavy chain complementarity determining region 3 for antibody 14394
ASGLHSGYDYFDY

SEQ ID NO: 28789 - protein, 10 aa, Homo sapiens
  light chain complementarity determining region 3 for antibody 14395
QYHGYSPLYT

SEQ ID NO: 28790 - protein, 14 aa, Homo sapiens
  heavy chain complementarity determining region 3 for antibody 14395
ARVQVDYSNYGCDS

SEQ ID NO: 28791 - protein, 10 aa, Homo sapiens
  light chain complementarity determining region 3 for antibody 14396
QYHGYSPLYT

SEQ ID NO: 28792 - protein, 16 aa, Homo sapiens
  heavy chain complementarity determining region 3 for antibody 14396
ARTQGTRDYYYYAMDV

SEQ ID NO: 28793 - protein, 10 aa, Homo sapiens
  light chain complementarity determining region 3 for antibody 14397
QYHGYSPLYT

SEQ ID NO: 28794 - protein, 13 aa, Homo sapiens
  heavy chain complementarity determining region 3 for antibody 14397
ARSAGYYPNWLES

SEQ ID NO: 28795 - protein, 10 aa, Homo sapiens
  light chain complementarity determining region 3 for antibody 14398
QYHGYSPLYT

SEQ ID NO: 28796 - protein, 14 aa, Homo sapiens
  heavy chain complementarity determining region 3 for antibody 14398
ARLNKMTRIRYFDS

SEQ ID NO: 28797 - protein, 10 aa, Homo sapiens
  light chain complementarity determining region 3 for antibody 14399
QYHGYSPLYT

SEQ ID NO: 28798 - protein, 22 aa, Homo sapiens
  heavy chain complementarity determining region 3 for antibody 14399
ARHSPFLEMLGERWLQFGAFDI

SEQ ID NO: 28799 - protein, 10 aa, Homo sapiens
  light chain complementarity determining region 3 for antibody 14400
QYHGYSPLYT

SEQ ID NO: 28800 - protein, 22 aa, Homo sapiens
  heavy chain complementarity determining region 3 for antibody 14400
ARHSGYSNTWYMNYYYYYGMDV

SEQ ID NO: 28801 - protein, 10 aa, Homo sapiens
  light chain complementarity determining region 3 for antibody 14401
QYHGYSPLYT

SEQ ID NO: 28802 - protein, 16 aa, Homo sapiens
  heavy chain complementarity determining region 3 for antibody 14401
AREIFKGEIDYYAMDV

SEQ ID NO: 28803 - protein, 10 aa, Homo sapiens
  light chain complementarity determining region 3 for antibody 14402
QYHGYSPLYT

SEQ ID NO: 28804 - protein, 16 aa, Homo sapiens
  heavy chain complementarity determining region 3 for antibody 14402
ARATDYTGDLPWYFDL

SEQ ID NO: 28805 - protein, 10 aa, Homo sapiens
  light chain complementarity determining region 3 for antibody 14403
QYHGYSPLYT

SEQ ID NO: 28806 - protein, 12 aa, Homo sapiens
  heavy chain complementarity determining region 3 for antibody 14403
AKGNLGRGGMDV

SEQ ID NO: 28807 - protein, 10 aa, Homo sapiens
  light chain complementarity determining region 3 for antibody 14404
QYHGYSPLYT

SEQ ID NO: 28808 - protein, 12 aa, Homo sapiens
  heavy chain complementarity determining region 3 for antibody 14404
AKGLLGRGGMDV

SEQ ID NO: 28809 - protein, 10 aa, Homo sapiens
  light chain complementarity determining region 3 for antibody 14405
QYHGYSPLYT

SEQ ID NO: 28810 - protein, 12 aa, Homo sapiens
  heavy chain complementarity determining region 3 for antibody 14405
AKGILGWGGMDV

SEQ ID NO: 28811 - protein, 10 aa, Homo sapiens
  light chain complementarity determining region 3 for antibody 14406
QYHGYSPLYT

SEQ ID NO: 28812 - protein, 12 aa, Homo sapiens
  heavy chain complementarity determining region 3 for antibody 14406
AKGILGRGGMYV

SEQ ID NO: 28813 - protein, 10 aa, Homo sapiens
  light chain complementarity determining region 3 for antibody 14407
QYHGYSPLYT

SEQ ID NO: 28814 - protein, 12 aa, Homo sapiens
  heavy chain complementarity determining region 3 for antibody 14407
AKGILGRGGMVV

SEQ ID NO: 28815 - protein, 10 aa, Homo sapiens
  light chain complementarity determining region 3 for antibody 14408
QYHGYSPLYT

SEQ ID NO: 28816 - protein, 12 aa, Homo sapiens
  heavy chain complementarity determining region 3 for antibody 14408
AKGILGRGGMDD

SEQ ID NO: 28817 - protein, 10 aa, Homo sapiens
  light chain complementarity determining region 3 for antibody 14409
QYHGYSPLYT

SEQ ID NO: 28818 - protein, 12 aa, Homo sapiens
  heavy chain complementarity determining region 3 for antibody 14409
AKGILGGGGMDV

SEQ ID NO: 28819 - protein, 10 aa, Homo sapiens
  light chain complementarity determining region 3 for antibody 14410
QYHGYSPLYT

SEQ ID NO: 28820 - protein, 4 aa, Homo sapiens
  heavy chain complementarity determining region 3 for antibody 14410
AKGI

SEQ ID NO: 28821 - protein, 10 aa, Homo sapiens
  light chain complementarity determining region 3 for antibody 14411
QYHGYSPLYT

SEQ ID NO: 28822 - protein, 17 aa, Homo sapiens
  heavy chain complementarity determining region 3 for antibody 14411
AKDLSGVHYDIHHGLDV

SEQ ID NO: 28823 - protein, 10 aa, Homo sapiens
  light chain complementarity determining region 3 for antibody 14412
QYHGYSPLYT

SEQ ID NO: 28824 - protein, 17 aa, Homo sapiens
  heavy chain complementarity determining region 3 for antibody 14412
AHTPWDAGYANDCHFDY

SEQ ID NO: 28825 - protein, 10 aa, Homo sapiens
  light chain complementarity determining region 3 for antibody 14413
QYHGYSPLYT

SEQ ID NO: 28826 - protein, 16 aa, Homo sapiens
  heavy chain complementarity determining region 3 for antibody 14413
AHRFYYGTNGSVAFDI

SEQ ID NO: 28827 - protein, 10 aa, Homo sapiens
  light chain complementarity determining region 3 for antibody 14414
QYHGYSPLTT

SEQ ID NO: 28828 - protein, 12 aa, Homo sapiens
  heavy chain complementarity determining region 3 for antibody 14414
AKGILGRGGMDV

SEQ ID NO: 28829 - protein, 10 aa, Homo sapiens
  light chain complementarity determining region 3 for antibody 14415
QYHGYSHPYT

SEQ ID NO: 28830 - protein, 12 aa, Homo sapiens
  heavy chain complementarity determining region 3 for antibody 14415
AKGILGRGGMDV

SEQ ID NO: 28831 - protein, 10 aa, Homo sapiens
  light chain complementarity determining region 3 for antibody 14416
QYHGCSPLYT

SEQ ID NO: 28832 - protein, 12 aa, Homo sapiens
  heavy chain complementarity determining region 3 for antibody 14416
AKGILGRGGMDV

SEQ ID NO: 28833 - protein, 10 aa, Homo sapiens
  light chain complementarity determining region 3 for antibody 14417
QYHCHSPLYT

SEQ ID NO: 28834 - protein, 12 aa, Homo sapiens
  heavy chain complementarity determining region 3 for antibody 14417
AKGILGRGGMDV

SEQ ID NO: 28835 - protein, 10 aa, Homo sapiens
  light chain complementarity determining region 3 for antibody 14418
QYHAYSPLYP

SEQ ID NO: 28836 - protein, 12 aa, Homo sapiens
  heavy chain complementarity determining region 3 for antibody 14418
AKGILGRGGMDV

SEQ ID NO: 28837 - protein, 9 aa, Homo sapiens
  light chain complementarity determining region 3 for antibody 14419
QYCGGSPYT

SEQ ID NO: 28838 - protein, 14 aa, Homo sapiens
  heavy chain complementarity determining region 3 for antibody 14419
ARDSTRLGGGDFDY

SEQ ID NO: 28839 - protein, 9 aa, Homo sapiens
  light chain complementarity determining region 3 for antibody 14420
QWYDNVPLT

SEQ ID NO: 28840 - protein, 16 aa, Homo sapiens
  heavy chain complementarity determining region 3 for antibody 14420
GRVDRLRLGELSGRFY

SEQ ID NO: 28841 - protein, 9 aa, Homo sapiens
  light chain complementarity determining region 3 for antibody 14421
QWSYSTPLT

SEQ ID NO: 28842 - protein, 19 aa, Homo sapiens
  heavy chain complementarity determining region 3 for antibody 14421
AQEMTDFSGYGAPIYHFDY

SEQ ID NO: 28843 - protein, 9 aa, Homo sapiens
  light chain complementarity determining region 3 for antibody 14422
QWSYSTPLT

SEQ ID NO: 28844 - protein, 19 aa, Homo sapiens
  heavy chain complementarity determining region 3 for antibody 14422
AQEMADFSGYGAPIYYFDY

SEQ ID NO: 28845 - protein, 9 aa, Homo sapiens
  light chain complementarity determining region 3 for antibody 14423
QWSYSNPLT

SEQ ID NO: 28846 - protein, 19 aa, Homo sapiens
  heavy chain complementarity determining region 3 for antibody 14423
AQEMTDFSGYGAPIYYFDY

SEQ ID NO: 28847 - protein, 9 aa, Homo sapiens
  light chain complementarity determining region 3 for antibody 14424
QWGYSTPLT

SEQ ID NO: 28848 - protein, 19 aa, Homo sapiens
  heavy chain complementarity determining region 3 for antibody 14424
AQEMTDFSGYGAPIYYFDY

SEQ ID NO: 28849 - protein, 9 aa, Homo sapiens
  light chain complementarity determining region 3 for antibody 14425
QVYKSAPHT

SEQ ID NO: 28850 - protein, 14 aa, Homo sapiens
  heavy chain complementarity determining region 3 for antibody 14425
CRGWLDPATPHYDF

SEQ ID NO: 28851 - protein, 9 aa, Homo sapiens
  light chain complementarity determining region 3 for antibody 14426
QVAYSFPLT

SEQ ID NO: 28852 - protein, 13 aa, Homo sapiens
  heavy chain complementarity determining region 3 for antibody 14426
ARTYGSGRNWFDS

SEQ ID NO: 28853 - protein, 9 aa, Homo sapiens
  light chain complementarity determining region 3 for antibody 14427
QVAYRLPLT

SEQ ID NO: 28854 - protein, 13 aa, Homo sapiens
  heavy chain complementarity determining region 3 for antibody 14427
ARTYGSGRNWFDS

SEQ ID NO: 28855 - protein, 9 aa, Homo sapiens
  light chain complementarity determining region 3 for antibody 14428
QVAYRFPLT

SEQ ID NO: 28856 - protein, 13 aa, Homo sapiens
  heavy chain complementarity determining region 3 for antibody 14428
ARTYGAGRNWFDS

SEQ ID NO: 28857 - protein, 9 aa, Homo sapiens
  light chain complementarity determining region 3 for antibody 14429
QVAYRFPLT

SEQ ID NO: 28858 - protein, 13 aa, Homo sapiens
  heavy chain complementarity determining region 3 for antibody 14429
ARTHGSGRNWFDS

SEQ ID NO: 28859 - protein, 9 aa, Homo sapiens
  light chain complementarity determining region 3 for antibody 14430
QVAYRFPLP

SEQ ID NO: 28860 - protein, 13 aa, Homo sapiens
  heavy chain complementarity determining region 3 for antibody 14430
ARTYGSGRNWFDS

SEQ ID NO: 28861 - protein, 9 aa, Homo sapiens
  light chain complementarity determining region 3 for antibody 14431
QTLTIYPLA

SEQ ID NO: 28862 - protein, 17 aa, Homo sapiens
  heavy chain complementarity determining region 3 for antibody 14431
ARGGNPSGNHYYYGLDV

SEQ ID NO: 28863 - protein, 9 aa, Homo sapiens
  light chain complementarity determining region 3 for antibody 14432
QRYYTTPLT

SEQ ID NO: 28864 - protein, 17 aa, Homo sapiens
  heavy chain complementarity determining region 3 for antibody 14432
ARERSVAGAVRFYGMDV

SEQ ID NO: 28865 - protein, 10 aa, Homo sapiens
  light chain complementarity determining region 3 for antibody 14433
QRYVSSELFT

SEQ ID NO: 28866 - protein, 16 aa, Homo sapiens
  heavy chain complementarity determining region 3 for antibody 14433
AREIFKGEIDYYAMDV

SEQ ID NO: 28867 - protein, 10 aa, Homo sapiens
  light chain complementarity determining region 3 for antibody 14434
QRYVSSALYT

SEQ ID NO: 28868 - protein, 16 aa, Homo sapiens
  heavy chain complementarity determining region 3 for antibody 14434
ARELFKGEYDYYAMDV

SEQ ID NO: 28869 - protein, 10 aa, Homo sapiens
  light chain complementarity determining region 3 for antibody 14435
QRYSSSPQLT

SEQ ID NO: 28870 - protein, 13 aa, Homo sapiens
  heavy chain complementarity determining region 3 for antibody 14435
ARSAGYYPNWLES

SEQ ID NO: 28871 - protein, 9 aa, Homo sapiens
  light chain complementarity determining region 3 for antibody 14436
QRYNSYSHT

SEQ ID NO: 28872 - protein, 21 aa, Homo sapiens
  heavy chain complementarity determining region 3 for antibody 14436
AREQSYTVAGINYYYYYAMDV

SEQ ID NO: 28873 - protein, 9 aa, Homo sapiens
  light chain complementarity determining region 3 for antibody 14437
QRYNSYPRT

SEQ ID NO: 28874 - protein, 19 aa, Homo sapiens
  heavy chain complementarity determining region 3 for antibody 14437
ARDSPSVRKRPTEYYGMDV

SEQ ID NO: 28875 - protein, 9 aa, Homo sapiens
  light chain complementarity determining region 3 for antibody 14438
QRYNSAPRA

SEQ ID NO: 28876 - protein, 20 aa, Homo sapiens
  heavy chain complementarity determining region 3 for antibody 14438
ARGGRYSDDFPYFYNYGLDV

SEQ ID NO: 28877 - protein, 9 aa, Homo sapiens
  light chain complementarity determining region 3 for antibody 14439
QRYNSAPLT

SEQ ID NO: 28878 - protein, 22 aa, Homo sapiens
  heavy chain complementarity determining region 3 for antibody 14439
ARGGPERDYYDSIDSIYDAFDI

SEQ ID NO: 28879 - protein, 10 aa, Homo sapiens
  light chain complementarity determining region 3 for antibody 14440
QRYNDWPPNT

SEQ ID NO: 28880 - protein, 14 aa, Homo sapiens
  heavy chain complementarity determining region 3 for antibody 14440
ARASKYQMLFYLDY

SEQ ID NO: 28881 - protein, 9 aa, Homo sapiens
  light chain complementarity determining region 3 for antibody 14441
QRYKSYPRT

SEQ ID NO: 28882 - protein, 24 aa, Homo sapiens
  heavy chain complementarity determining region 3 for antibody 14441
ARGSTDGTVTTFGVPVLERYYFDY

SEQ ID NO: 28883 - protein, 9 aa, Homo sapiens
  light chain complementarity determining region 3 for antibody 14442
QRYKSNSYT

SEQ ID NO: 28884 - protein, 10 aa, Homo sapiens
  heavy chain complementarity determining region 3 for antibody 14442
TRGGLGTFDD

SEQ ID NO: 28885 - protein, 9 aa, Homo sapiens
  light chain complementarity determining region 3 for antibody 14443
QRYHSTPYT

SEQ ID NO: 28886 - protein, 21 aa, Homo sapiens
  heavy chain complementarity determining region 3 for antibody 14443
ARPGGQYCSGSNCYYDNWFGS

SEQ ID NO: 28887 - protein, 10 aa, Homo sapiens
  light chain complementarity determining region 3 for antibody 14444
QRYGWSPPVT

SEQ ID NO: 28888 - protein, 12 aa, Homo sapiens
  heavy chain complementarity determining region 3 for antibody 14444
AGDPGLRNGADV

SEQ ID NO: 28889 - protein, 10 aa, Homo sapiens
  light chain complementarity determining region 3 for antibody 14445
QRYGGFPLFT

SEQ ID NO: 28890 - protein, 16 aa, Homo sapiens
  heavy chain complementarity determining region 3 for antibody 14445
ARELFKGEIDYYGMDV

SEQ ID NO: 28891 - protein, 9 aa, Homo sapiens
  light chain complementarity determining region 3 for antibody 14446
QRYDSYPYT

SEQ ID NO: 28892 - protein, 17 aa, Homo sapiens
  heavy chain complementarity determining region 3 for antibody 14446
AREDWSDVDLQTYYFDN

SEQ ID NO: 28893 - protein, 8 aa, Homo sapiens
  light chain complementarity determining region 3 for antibody 14447
QRYDSALT

SEQ ID NO: 28894 - protein, 15 aa, Homo sapiens
  heavy chain complementarity determining region 3 for antibody 14447
AKGPGWAVAKRFFNY

SEQ ID NO: 28895 - protein, 9 aa, Homo sapiens
  light chain complementarity determining region 3 for antibody 14448
QRYDNVPLT

SEQ ID NO: 28896 - protein, 16 aa, Homo sapiens
  heavy chain complementarity determining region 3 for antibody 14448
GRVDRLRVGELSGRFY

SEQ ID NO: 28897 - protein, 9 aa, Homo sapiens
  light chain complementarity determining region 3 for antibody 14449
QRYDNSPYT

SEQ ID NO: 28898 - protein, 15 aa, Homo sapiens
  heavy chain complementarity determining region 3 for antibody 14449
ARSSIVALGYYGMNV

SEQ ID NO: 28899 - protein, 9 aa, Homo sapiens
  light chain complementarity determining region 3 for antibody 14450
QRYDNSPST

SEQ ID NO: 28900 - protein, 15 aa, Homo sapiens
  heavy chain complementarity determining region 3 for antibody 14450
ARSSIVALGYYGMDV

SEQ ID NO: 28901 - protein, 9 aa, Homo sapiens
  light chain complementarity determining region 3 for antibody 14451
QRYDNLPLT

SEQ ID NO: 28902 - protein, 18 aa, Homo sapiens
  heavy chain complementarity determining region 3 for antibody 14451
ARAPGDYDMLRRGYYFDH

SEQ ID NO: 28903 - protein, 9 aa, Homo sapiens
  light chain complementarity determining region 3 for antibody 14452
QRYDKVPLT

SEQ ID NO: 28904 - protein, 20 aa, Homo sapiens
  heavy chain complementarity determining region 3 for antibody 14452
AKDRRRDTSMDYFYYSAMGV

SEQ ID NO: 28905 - protein, 9 aa, Homo sapiens
  light chain complementarity determining region 3 for antibody 14453
QRVMNFPIT

SEQ ID NO: 28906 - protein, 11 aa, Homo sapiens
  heavy chain complementarity determining region 3 for antibody 14453
ARNYDSSGFDY

SEQ ID NO: 28907 - protein, 9 aa, Homo sapiens
  light chain complementarity determining region 3 for antibody 14454
QRTYNAPWP

SEQ ID NO: 28908 - protein, 19 aa, Homo sapiens
  heavy chain complementarity determining region 3 for antibody 14454
ARQVGDTMVRGLIYDAFDI

SEQ ID NO: 28909 - protein, 7 aa, Homo sapiens
  light chain complementarity determining region 3 for antibody 14455
QRTYIAP

SEQ ID NO: 28910 - protein, 23 aa, Homo sapiens
  heavy chain complementarity determining region 3 for antibody 14455
AKGPYCSGSSCDRDAYYYYGMDV

SEQ ID NO: 28911 - protein, 9 aa, Homo sapiens
  light chain complementarity determining region 3 for antibody 14456
QRTCNAPVT

SEQ ID NO: 28912 - protein, 9 aa, Homo sapiens
  heavy chain complementarity determining region 3 for antibody 14456
VRGYDVFDY

SEQ ID NO: 28913 - protein, 9 aa, Homo sapiens
  light chain complementarity determining region 3 for antibody 14457
QRTCNAPIT

SEQ ID NO: 28914 - protein, 9 aa, Homo sapiens
  heavy chain complementarity determining region 3 for antibody 14457
VRGYDAFDY

SEQ ID NO: 28915 - protein, 9 aa, Homo sapiens
  light chain complementarity determining region 3 for antibody 14458
QRSYSTPYT

SEQ ID NO: 28916 - protein, 19 aa, Homo sapiens
  heavy chain complementarity determining region 3 for antibody 14458
ARQSGDTMVRGVISDGFDI

SEQ ID NO: 28917 - protein, 9 aa, Homo sapiens
  light chain complementarity determining region 3 for antibody 14459
QRSYSTPYT

SEQ ID NO: 28918 - protein, 17 aa, Homo sapiens
  heavy chain complementarity determining region 3 for antibody 14459
ARGSYYDVDLITYYFDH

SEQ ID NO: 28919 - protein, 9 aa, Homo sapiens
  light chain complementarity determining region 3 for antibody 14460
QRSYRPPQA

SEQ ID NO: 28920 - protein, 14 aa, Homo sapiens
  heavy chain complementarity determining region 3 for antibody 14460
ARSKEWFLGAAFDY

SEQ ID NO: 28921 - protein, 9 aa, Homo sapiens
  light chain complementarity determining region 3 for antibody 14461
QRSYNLRWT

SEQ ID NO: 28922 - protein, 14 aa, Homo sapiens
  heavy chain complementarity determining region 3 for antibody 14461
ARAGPSGTYSGFDS

SEQ ID NO: 28923 - protein, 8 aa, Homo sapiens
  light chain complementarity determining region 3 for antibody 14462
QRSYGSPT

SEQ ID NO: 28924 - protein, 13 aa, Homo sapiens
  heavy chain complementarity determining region 3 for antibody 14462
ARDRPGTYYVFDY

SEQ ID NO: 28925 - protein, 9 aa, Homo sapiens
  light chain complementarity determining region 3 for antibody 14463
QRSNSYPYT

SEQ ID NO: 28926 - protein, 9 aa, Homo sapiens
  heavy chain complementarity determining region 3 for antibody 14463
VAYLSGYPR

SEQ ID NO: 28927 - protein, 11 aa, Homo sapiens
  light chain complementarity determining region 3 for antibody 14464
QRRSNWPPGFT

SEQ ID NO: 28928 - protein, 14 aa, Homo sapiens
  heavy chain complementarity determining region 3 for antibody 14464
ARDPYSYGLNCLDY

SEQ ID NO: 28929 - protein, 11 aa, Homo sapiens
  light chain complementarity determining region 3 for antibody 14465
QRRSNWPPGFP

SEQ ID NO: 28930 - protein, 14 aa, Homo sapiens
  heavy chain complementarity determining region 3 for antibody 14465
ARDPYSYGLNYLDY

SEQ ID NO: 28931 - protein, 10 aa, Homo sapiens
  light chain complementarity determining region 3 for antibody 14466
QRRSNWPIFT

SEQ ID NO: 28932 - protein, 14 aa, Homo sapiens
  heavy chain complementarity determining region 3 for antibody 14466
ARLNKMTRIRYFDS

SEQ ID NO: 28933 - protein, 9 aa, Homo sapiens
  light chain complementarity determining region 3 for antibody 14467
QRRNSYPYT

SEQ ID NO: 28934 - protein, 9 aa, Homo sapiens
  heavy chain complementarity determining region 3 for antibody 14467
VAYLAGYQR

SEQ ID NO: 28935 - protein, 8 aa, Homo sapiens
  light chain complementarity determining region 3 for antibody 14468
QRRGNRPA

SEQ ID NO: 28936 - protein, 17 aa, Homo sapiens
  heavy chain complementarity determining region 3 for antibody 14468
TIDHYYHRSGYSYYFEY

SEQ ID NO: 28937 - protein, 9 aa, Homo sapiens
  light chain complementarity determining region 3 for antibody 14469
QRRDNWPLT

SEQ ID NO: 28938 - protein, 14 aa, Homo sapiens
  heavy chain complementarity determining region 3 for antibody 14469
ARRFDGSNSNWFDP

SEQ ID NO: 28939 - protein, 10 aa, Homo sapiens
  light chain complementarity determining region 3 for antibody 14470
QRPYNVSPIT

SEQ ID NO: 28940 - protein, 17 aa, Homo sapiens
  heavy chain complementarity determining region 3 for antibody 14470
ARRFGLYYFGASDYYDY

SEQ ID NO: 28941 - protein, 9 aa, Homo sapiens
  light chain complementarity determining region 3 for antibody 14471
QRNYRPSPA

SEQ ID NO: 28942 - protein, 11 aa, Homo sapiens
  heavy chain complementarity determining region 3 for antibody 14471
TRDPPGNGMDV

SEQ ID NO: 28943 - protein, 10 aa, Homo sapiens
  light chain complementarity determining region 3 for antibody 14472
QRHGGSPLFT

SEQ ID NO: 28944 - protein, 16 aa, Homo sapiens
  heavy chain complementarity determining region 3 for antibody 14472
AREVFKGEIDYYGMDV

SEQ ID NO: 28945 - protein, 9 aa, Homo sapiens
  light chain complementarity determining region 3 for antibody 14473
QRFTGAPRT

SEQ ID NO: 28946 - protein, 18 aa, Homo sapiens
  heavy chain complementarity determining region 3 for antibody 14473
ARPKSPYYGDYDPVGLDS

SEQ ID NO: 28947 - protein, 9 aa, Homo sapiens
  light chain complementarity determining region 3 for antibody 14474
QRFHSYPIT

SEQ ID NO: 28948 - protein, 16 aa, Homo sapiens
  heavy chain complementarity determining region 3 for antibody 14474
ARTQGTRDYYYYAMDV

SEQ ID NO: 28949 - protein, 11 aa, Homo sapiens
  light chain complementarity determining region 3 for antibody 14475
QRCYSSPPENT

SEQ ID NO: 28950 - protein, 16 aa, Homo sapiens
  heavy chain complementarity determining region 3 for antibody 14475
AREAGEDYYYKDIFDI

SEQ ID NO: 28951 - protein, 9 aa, Homo sapiens
  light chain complementarity determining region 3 for antibody 14476
QRCYSDPLT

SEQ ID NO: 28952 - protein, 13 aa, Homo sapiens
  heavy chain complementarity determining region 3 for antibody 14476
ARGRSDASDALDV

SEQ ID NO: 28953 - protein, 9 aa, Homo sapiens
  light chain complementarity determining region 3 for antibody 14477
QRCNSYTYT

SEQ ID NO: 28954 - protein, 9 aa, Homo sapiens
  heavy chain complementarity determining region 3 for antibody 14477
VAYLAGYPR

SEQ ID NO: 28955 - protein, 9 aa, Homo sapiens
  light chain complementarity determining region 3 for antibody 14478
QRCNSYPYT

SEQ ID NO: 28956 - protein, 9 aa, Homo sapiens
  heavy chain complementarity determining region 3 for antibody 14478
VVYLAGYPR

SEQ ID NO: 28957 - protein, 9 aa, Homo sapiens
  light chain complementarity determining region 3 for antibody 14479
QRCNSYPYT

SEQ ID NO: 28958 - protein, 9 aa, Homo sapiens
  heavy chain complementarity determining region 3 for antibody 14479
VEYLAGYPR

SEQ ID NO: 28959 - protein, 9 aa, Homo sapiens
  light chain complementarity determining region 3 for antibody 14480
QRCNSYPYT

SEQ ID NO: 28960 - protein, 9 aa, Homo sapiens
  heavy chain complementarity determining region 3 for antibody 14480
VAYSAGYPR

SEQ ID NO: 28961 - protein, 9 aa, Homo sapiens
  light chain complementarity determining region 3 for antibody 14481
QRCNSYPYT

SEQ ID NO: 28962 - protein, 9 aa, Homo sapiens
  heavy chain complementarity determining region 3 for antibody 14481
VAYLSGYQR

SEQ ID NO: 28963 - protein, 9 aa, Homo sapiens
  light chain complementarity determining region 3 for antibody 14482
QRCNSYPYT

SEQ ID NO: 28964 - protein, 9 aa, Homo sapiens
  heavy chain complementarity determining region 3 for antibody 14482
VAYLDGYPR

SEQ ID NO: 28965 - protein, 9 aa, Homo sapiens
  light chain complementarity determining region 3 for antibody 14483
QRCNSYPYT

SEQ ID NO: 28966 - protein, 9 aa, Homo sapiens
  heavy chain complementarity determining region 3 for antibody 14483
VAYLAGYTR

SEQ ID NO: 28967 - protein, 9 aa, Homo sapiens
  light chain complementarity determining region 3 for antibody 14484
QRCNSYPYT

SEQ ID NO: 28968 - protein, 9 aa, Homo sapiens
  heavy chain complementarity determining region 3 for antibody 14484
VAYLAGHPR

SEQ ID NO: 28969 - protein, 9 aa, Homo sapiens
  light chain complementarity determining region 3 for antibody 14485
QRCNSYPYT

SEQ ID NO: 28970 - protein, 9 aa, Homo sapiens
  heavy chain complementarity determining region 3 for antibody 14485
VAHLSGYPR

SEQ ID NO: 28971 - protein, 9 aa, Homo sapiens
  light chain complementarity determining region 3 for antibody 14486
QRCNSYPYT

SEQ ID NO: 28972 - protein, 9 aa, Homo sapiens
  heavy chain complementarity determining region 3 for antibody 14486
VAHLAGYPR

SEQ ID NO: 28973 - protein, 9 aa, Homo sapiens
  light chain complementarity determining region 3 for antibody 14487
QRCNSYPYT

SEQ ID NO: 28974 - protein, 19 aa, Homo sapiens
  heavy chain complementarity determining region 3 for antibody 14487
ARSDYSGDTDRYYDYGMDV

SEQ ID NO: 28975 - protein, 9 aa, Homo sapiens
  light chain complementarity determining region 3 for antibody 14488
QRCNSYLYT

SEQ ID NO: 28976 - protein, 9 aa, Homo sapiens
  heavy chain complementarity determining region 3 for antibody 14488
VAYLAGYPR

SEQ ID NO: 28977 - protein, 9 aa, Homo sapiens
  light chain complementarity determining region 3 for antibody 14489
QRCNSSPYT

SEQ ID NO: 28978 - protein, 9 aa, Homo sapiens
  heavy chain complementarity determining region 3 for antibody 14489
VAYLSGYPR

SEQ ID NO: 28979 - protein, 9 aa, Homo sapiens
  light chain complementarity determining region 3 for antibody 14490
QRCHSYPYT

SEQ ID NO: 28980 - protein, 9 aa, Homo sapiens
  heavy chain complementarity determining region 3 for antibody 14490
VAYLAGYPR

SEQ ID NO: 28981 - protein, 9 aa, Homo sapiens
  light chain complementarity determining region 3 for antibody 14491
QRCDSYPYT

SEQ ID NO: 28982 - protein, 9 aa, Homo sapiens
  heavy chain complementarity determining region 3 for antibody 14491
VAYLAGYPR

SEQ ID NO: 28983 - protein, 9 aa, Homo sapiens
  light chain complementarity determining region 3 for antibody 14492
QQYYTYSVT

SEQ ID NO: 28984 - protein, 19 aa, Homo sapiens
  heavy chain complementarity determining region 3 for antibody 14492
ATVKGDQGELDYDYHGVDV

SEQ ID NO: 28985 - protein, 9 aa, Homo sapiens
  light chain complementarity determining region 3 for antibody 14493
QQYYTYSET

SEQ ID NO: 28986 - protein, 19 aa, Homo sapiens
  heavy chain complementarity determining region 3 for antibody 14493
ATVKGGQGELDYDYHGVDV

SEQ ID NO: 28987 - protein, 9 aa, Homo sapiens
  light chain complementarity determining region 3 for antibody 14494
QQYYTYSET

SEQ ID NO: 28988 - protein, 19 aa, Homo sapiens
  heavy chain complementarity determining region 3 for antibody 14494
ATVKGDQGELYYDYHGVDV

SEQ ID NO: 28989 - protein, 9 aa, Homo sapiens
  light chain complementarity determining region 3 for antibody 14495
QQYYTYSET

SEQ ID NO: 28990 - protein, 19 aa, Homo sapiens
  heavy chain complementarity determining region 3 for antibody 14495
ATVKGDQGELEYDYHGVDV

SEQ ID NO: 28991 - protein, 9 aa, Homo sapiens
  light chain complementarity determining region 3 for antibody 14496
QQYYTYSET

SEQ ID NO: 28992 - protein, 19 aa, Homo sapiens
  heavy chain complementarity determining region 3 for antibody 14496
ATVKGDQGELDYDYHGVDA

SEQ ID NO: 28993 - protein, 9 aa, Homo sapiens
  light chain complementarity determining region 3 for antibody 14497
QQYYTYSET

SEQ ID NO: 28994 - protein, 19 aa, Homo sapiens
  heavy chain complementarity determining region 3 for antibody 14497
ATVKGDQGELDYDSHGVDV

SEQ ID NO: 28995 - protein, 9 aa, Homo sapiens
  light chain complementarity determining region 3 for antibody 14498
QQYYTYSET

SEQ ID NO: 28996 - protein, 19 aa, Homo sapiens
  heavy chain complementarity determining region 3 for antibody 14498
ATVKGDQGEIDYDYHGVDV

SEQ ID NO: 28997 - protein, 9 aa, Homo sapiens
  light chain complementarity determining region 3 for antibody 14499
QQYYTYSET

SEQ ID NO: 28998 - protein, 19 aa, Homo sapiens
  heavy chain complementarity determining region 3 for antibody 14499
ATVKGDEGELDYDYHGVDV

SEQ ID NO: 28999 - protein, 9 aa, Homo sapiens
  light chain complementarity determining region 3 for antibody 14500
QQYYTYSET

SEQ ID NO: 29000 - protein, 19 aa, Homo sapiens
  heavy chain complementarity determining region 3 for antibody 14500
ATMKGDQGELDYDYHGVDV

SEQ ID NO: 29001 - protein, 9 aa, Homo sapiens
  light chain complementarity determining region 3 for antibody 14501
QQYYTYSET

SEQ ID NO: 29002 - protein, 19 aa, Homo sapiens
  heavy chain complementarity determining region 3 for antibody 14501
AAVKGDQGELDYDYHGVDV

SEQ ID NO: 29003 - protein, 9 aa, Homo sapiens
  light chain complementarity determining region 3 for antibody 14502
QQYYTYSER

SEQ ID NO: 29004 - protein, 19 aa, Homo sapiens
  heavy chain complementarity determining region 3 for antibody 14502
ATVKGDQGELDYDYHGVDV

SEQ ID NO: 29005 - protein, 9 aa, Homo sapiens
  light chain complementarity determining region 3 for antibody 14503
QQYYTYSEK

SEQ ID NO: 29006 - protein, 19 aa, Homo sapiens
  heavy chain complementarity determining region 3 for antibody 14503
ATVKGDQGELDYDYHGVDV

SEQ ID NO: 29007 - protein, 9 aa, Homo sapiens
  light chain complementarity determining region 3 for antibody 14504
QQYYTTPGT

SEQ ID NO: 29008 - protein, 16 aa, Homo sapiens
  heavy chain complementarity determining region 3 for antibody 14504
ARRRCSGGSCYGVVDY

SEQ ID NO: 29009 - protein, 9 aa, Homo sapiens
  light chain complementarity determining region 3 for antibody 14505
QQYYTSPPT

SEQ ID NO: 29010 - protein, 17 aa, Homo sapiens
  heavy chain complementarity determining region 3 for antibody 14505
ARERSVAGAVRFYGMDV

SEQ ID NO: 29011 - protein, 9 aa, Homo sapiens
  light chain complementarity determining region 3 for antibody 14506
QQYYTKPPT

SEQ ID NO: 29012 - protein, 25 aa, Homo sapiens
  heavy chain complementarity determining region 3 for antibody 14506
GRERGDVLLWFGESLDPERRDAFDV

SEQ ID NO: 29013 - protein, 9 aa, Homo sapiens
  light chain complementarity determining region 3 for antibody 14507
QQYYTIPGT

SEQ ID NO: 29014 - protein, 16 aa, Homo sapiens
  heavy chain complementarity determining region 3 for antibody 14507
ARRRCSGGNCYGVVDY

SEQ ID NO: 29015 - protein, 9 aa, Homo sapiens
  light chain complementarity determining region 3 for antibody 14508
QQYYTFSET

SEQ ID NO: 29016 - protein, 19 aa, Homo sapiens
  heavy chain complementarity determining region 3 for antibody 14508
ATVKGDQGELDYDYHGVDV

SEQ ID NO: 29017 - protein, 9 aa, Homo sapiens
  light chain complementarity determining region 3 for antibody 14509
QQYYSYPYT

SEQ ID NO: 29018 - protein, 17 aa, Homo sapiens
  heavy chain complementarity determining region 3 for antibody 14509
AREEFADVDLRQYYFDY

SEQ ID NO: 29019 - protein, 9 aa, Homo sapiens
  light chain complementarity determining region 3 for antibody 14510
QQYYSTSWT

SEQ ID NO: 29020 - protein, 16 aa, Homo sapiens
  heavy chain complementarity determining region 3 for antibody 14510
ATNIAVPNYYYFGLDV

SEQ ID NO: 29021 - protein, 9 aa, Homo sapiens
  light chain complementarity determining region 3 for antibody 14511
QQYYSTPWT

SEQ ID NO: 29022 - protein, 16 aa, Homo sapiens
  heavy chain complementarity determining region 3 for antibody 14511
IRQGECSVGGCPFPGY

SEQ ID NO: 29023 - protein, 8 aa, Homo sapiens
  light chain complementarity determining region 3 for antibody 14512
QQYYSTPT

SEQ ID NO: 29024 - protein, 14 aa, Homo sapiens
  heavy chain complementarity determining region 3 for antibody 14512
ARQGSGVGMTYFEN

SEQ ID NO: 29025 - protein, 9 aa, Homo sapiens
  light chain complementarity determining region 3 for antibody 14513
QQYYSTPSS

SEQ ID NO: 29026 - protein, 13 aa, Homo sapiens
  heavy chain complementarity determining region 3 for antibody 14513
AKATSDGSGALHY

SEQ ID NO: 29027 - protein, 9 aa, Homo sapiens
  light chain complementarity determining region 3 for antibody 14514
QQYYSTPRT

SEQ ID NO: 29028 - protein, 22 aa, Homo sapiens
  heavy chain complementarity determining region 3 for antibody 14514
ARDQIGGEAGDALTDLHGSFDL

SEQ ID NO: 29029 - protein, 9 aa, Homo sapiens
  light chain complementarity determining region 3 for antibody 14515
QQYYSTPRT

SEQ ID NO: 29030 - protein, 22 aa, Homo sapiens
  heavy chain complementarity determining region 3 for antibody 14515
AKDQIGGEAGDVLTDLHGSFDL

SEQ ID NO: 29031 - protein, 9 aa, Homo sapiens
  light chain complementarity determining region 3 for antibody 14516
QQYYSTPPT

SEQ ID NO: 29032 - protein, 16 aa, Homo sapiens
  heavy chain complementarity determining region 3 for antibody 14516
AKAMAPGLGGENWFDS

SEQ ID NO: 29033 - protein, 9 aa, Homo sapiens
  light chain complementarity determining region 3 for antibody 14517
QQYYSTPNT

SEQ ID NO: 29034 - protein, 13 aa, Homo sapiens
  heavy chain complementarity determining region 3 for antibody 14517
AKATSDGSGALHY

SEQ ID NO: 29035 - protein, 9 aa, Homo sapiens
  light chain complementarity determining region 3 for antibody 14518
QQYYSTPLT

SEQ ID NO: 29036 - protein, 20 aa, Homo sapiens
  heavy chain complementarity determining region 3 for antibody 14518
VRLAGYCSGGRCSGDYAMDV

SEQ ID NO: 29037 - protein, 9 aa, Homo sapiens
  light chain complementarity determining region 3 for antibody 14519
QQYYSTPLT

SEQ ID NO: 29038 - protein, 16 aa, Homo sapiens
  heavy chain complementarity determining region 3 for antibody 14519
ERARAPGLGGENWFDP

SEQ ID NO: 29039 - protein, 8 aa, Homo sapiens
  light chain complementarity determining region 3 for antibody 14520
QQYYSTLT

SEQ ID NO: 29040 - protein, 14 aa, Homo sapiens
  heavy chain complementarity determining region 3 for antibody 14520
ASPGIMIAFDCFDY

SEQ ID NO: 29041 - protein, 10 aa, Homo sapiens
  light chain complementarity determining region 3 for antibody 14521
QQYYSTLPLT

SEQ ID NO: 29042 - protein, 18 aa, Homo sapiens
  heavy chain complementarity determining region 3 for antibody 14521
ARYPQTPGYFYEGSWFDP

SEQ ID NO: 29043 - protein, 9 aa, Homo sapiens
  light chain complementarity determining region 3 for antibody 14522
QQYYSSPYS

SEQ ID NO: 29044 - protein, 14 aa, Homo sapiens
  heavy chain complementarity determining region 3 for antibody 14522
TTDPRNDSFRGMDV

SEQ ID NO: 29045 - protein, 9 aa, Homo sapiens
  light chain complementarity determining region 3 for antibody 14523
QQYYSSPYS

SEQ ID NO: 29046 - protein, 14 aa, Homo sapiens
  heavy chain complementarity determining region 3 for antibody 14523
PPDPRHDSFRGMDV

SEQ ID NO: 29047 - protein, 9 aa, Homo sapiens
  light chain complementarity determining region 3 for antibody 14524
QQYYSSPYS

SEQ ID NO: 29048 - protein, 14 aa, Homo sapiens
  heavy chain complementarity determining region 3 for antibody 14524
ATDPRHDSFRGMDV

SEQ ID NO: 29049 - protein, 9 aa, Homo sapiens
  light chain complementarity determining region 3 for antibody 14525
QQYYSNPPT

SEQ ID NO: 29050 - protein, 19 aa, Homo sapiens
  heavy chain complementarity determining region 3 for antibody 14525
AHGSYYDSNDYYYSEYFQH

SEQ ID NO: 29051 - protein, 8 aa, Homo sapiens
  light chain complementarity determining region 3 for antibody 14526
QQYYSNLL

SEQ ID NO: 29052 - protein, 22 aa, Homo sapiens
  heavy chain complementarity determining region 3 for antibody 14526
VHRSTVTNWPERHYYYNYGMEV

SEQ ID NO: 29053 - protein, 9 aa, Homo sapiens
  light chain complementarity determining region 3 for antibody 14527
QQYYSIPYP

SEQ ID NO: 29054 - protein, 7 aa, Homo sapiens
  heavy chain complementarity determining region 3 for antibody 14527
TTEDNKN

SEQ ID NO: 29055 - protein, 9 aa, Homo sapiens
  light chain complementarity determining region 3 for antibody 14528
QQYYRNPPT

SEQ ID NO: 29056 - protein, 19 aa, Homo sapiens
  heavy chain complementarity determining region 3 for antibody 14528
AHGSYYDSNDYYYSEYFQH

SEQ ID NO: 29057 - protein, 9 aa, Homo sapiens
  light chain complementarity determining region 3 for antibody 14529
QQYYRIPYT

SEQ ID NO: 29058 - protein, 7 aa, Homo sapiens
  heavy chain complementarity determining region 3 for antibody 14529
TTEDNKN

SEQ ID NO: 29059 - protein, 9 aa, Homo sapiens
  light chain complementarity determining region 3 for antibody 14530
QQYYNYSET

SEQ ID NO: 29060 - protein, 19 aa, Homo sapiens
  heavy chain complementarity determining region 3 for antibody 14530
ATVKGDQGELDYDYHGVDV

SEQ ID NO: 29061 - protein, 8 aa, Homo sapiens
  light chain complementarity determining region 3 for antibody 14531
QQYYNSPT

SEQ ID NO: 29062 - protein, 21 aa, Homo sapiens
  heavy chain complementarity determining region 3 for antibody 14531
ARVLRFGDLLPGSLFFYGMDV

SEQ ID NO: 29063 - protein, 9 aa, Homo sapiens
  light chain complementarity determining region 3 for antibody 14532
QQYYNNPQT

SEQ ID NO: 29064 - protein, 17 aa, Homo sapiens
  heavy chain complementarity determining region 3 for antibody 14532
ARGPTTMIMGTKGYFDY

SEQ ID NO: 29065 - protein, 9 aa, Homo sapiens
  light chain complementarity determining region 3 for antibody 14533
QQYYISPPT

SEQ ID NO: 29066 - protein, 15 aa, Homo sapiens
  heavy chain complementarity determining region 3 for antibody 14533
ARTHPKSSSWIFFDY

SEQ ID NO: 29067 - protein, 9 aa, Homo sapiens
  light chain complementarity determining region 3 for antibody 14534
QQYYISPLP

SEQ ID NO: 29068 - protein, 15 aa, Homo sapiens
  heavy chain complementarity determining region 3 for antibody 14534
ARDHPKSSSWIFFDY

SEQ ID NO: 29069 - protein, 9 aa, Homo sapiens
  light chain complementarity determining region 3 for antibody 14535
QQYYGSPLP

SEQ ID NO: 29070 - protein, 15 aa, Homo sapiens
  heavy chain complementarity determining region 3 for antibody 14535
ATSLTYGGDSFLCDS

SEQ ID NO: 29071 - protein, 9 aa, Homo sapiens
  light chain complementarity determining region 3 for antibody 14536
QQYYGGPIT

SEQ ID NO: 29072 - protein, 13 aa, Homo sapiens
  heavy chain complementarity determining region 3 for antibody 14536
ARGKDSGSWMFEY

SEQ ID NO: 29073 - protein, 9 aa, Homo sapiens
  light chain complementarity determining region 3 for antibody 14537
QQYYGGPIT

SEQ ID NO: 29074 - protein, 13 aa, Homo sapiens
  heavy chain complementarity determining region 3 for antibody 14537
ARGKDSGSWIFDY

SEQ ID NO: 29075 - protein, 9 aa, Homo sapiens
  light chain complementarity determining region 3 for antibody 14538
QQYYFTPYP

SEQ ID NO: 29076 - protein, 20 aa, Homo sapiens
  heavy chain complementarity determining region 3 for antibody 14538
ATAHQSCSGNTCYSEGWFDS

SEQ ID NO: 29077 - protein, 9 aa, Homo sapiens
  light chain complementarity determining region 3 for antibody 14539
QQYYFNPYT

SEQ ID NO: 29078 - protein, 20 aa, Homo sapiens
  heavy chain complementarity determining region 3 for antibody 14539
ATAHQSCSGNTCYSEGWFDS

SEQ ID NO: 29079 - protein, 9 aa, Homo sapiens
  light chain complementarity determining region 3 for antibody 14540
QQYYFNPWT

SEQ ID NO: 29080 - protein, 19 aa, Homo sapiens
  heavy chain complementarity determining region 3 for antibody 14540
ARAKREQLVDSYSFHGLDV

SEQ ID NO: 29081 - protein, 9 aa, Homo sapiens
  light chain complementarity determining region 3 for antibody 14541
QQYYFIPWT

SEQ ID NO: 29082 - protein, 19 aa, Homo sapiens
  heavy chain complementarity determining region 3 for antibody 14541
ARAKREQLVDSYSFHGLDV

SEQ ID NO: 29083 - protein, 10 aa, Homo sapiens
  light chain complementarity determining region 3 for antibody 14542
QQYYDWPPWP

SEQ ID NO: 29084 - protein, 18 aa, Homo sapiens
  heavy chain complementarity determining region 3 for antibody 14542
ARALNFYDRSGYTGHFDY

SEQ ID NO: 29085 - protein, 9 aa, Homo sapiens
  light chain complementarity determining region 3 for antibody 14543
QQYYDTVWM

SEQ ID NO: 29086 - protein, 16 aa, Homo sapiens
  heavy chain complementarity determining region 3 for antibody 14543
TTQGGLWFGYWQGATS

SEQ ID NO: 29087 - protein, 9 aa, Homo sapiens
  light chain complementarity determining region 3 for antibody 14544
QQYYDTPWT

SEQ ID NO: 29088 - protein, 15 aa, Homo sapiens
  heavy chain complementarity determining region 3 for antibody 14544
VKDMNKGGSGWPCDY

SEQ ID NO: 29089 - protein, 9 aa, Homo sapiens
  light chain complementarity determining region 3 for antibody 14545
QQYYDTPRT

SEQ ID NO: 29090 - protein, 23 aa, Homo sapiens
  heavy chain complementarity determining region 3 for antibody 14545
ARGGPYRPAAYFYDISGPQYFQH

SEQ ID NO: 29091 - protein, 9 aa, Homo sapiens
  light chain complementarity determining region 3 for antibody 14546
QQYYDPVWT

SEQ ID NO: 29092 - protein, 16 aa, Homo sapiens
  heavy chain complementarity determining region 3 for antibody 14546
TTQGGLWFGYWQGATS

SEQ ID NO: 29093 - protein, 9 aa, Homo sapiens
  light chain complementarity determining region 3 for antibody 14547
QQYVTYPYT

SEQ ID NO: 29094 - protein, 12 aa, Homo sapiens
  heavy chain complementarity determining region 3 for antibody 14547
AKGILGRGGMDV

SEQ ID NO: 29095 - protein, 9 aa, Homo sapiens
  light chain complementarity determining region 3 for antibody 14548
QQYVTTPRT

SEQ ID NO: 29096 - protein, 12 aa, Homo sapiens
  heavy chain complementarity determining region 3 for antibody 14548
ARDVGWYWHFDF

SEQ ID NO: 29097 - protein, 9 aa, Homo sapiens
  light chain complementarity determining region 3 for antibody 14549
QQYVTLPVT

SEQ ID NO: 29098 - protein, 15 aa, Homo sapiens
  heavy chain complementarity determining region 3 for antibody 14549
ARHRFGGSSSENFDF

SEQ ID NO: 29099 - protein, 10 aa, Homo sapiens
  light chain complementarity determining region 3 for antibody 14550
QQYVSSTLYT

SEQ ID NO: 29100 - protein, 16 aa, Homo sapiens
  heavy chain complementarity determining region 3 for antibody 14550
ARELFKGEYDYYAMDV

SEQ ID NO: 29101 - protein, 10 aa, Homo sapiens
  light chain complementarity determining region 3 for antibody 14551
QQYVSSKLFT

SEQ ID NO: 29102 - protein, 16 aa, Homo sapiens
  heavy chain complementarity determining region 3 for antibody 14551
AREIFKGEIDYYAMDV

SEQ ID NO: 29103 - protein, 10 aa, Homo sapiens
  light chain complementarity determining region 3 for antibody 14552
QQYVSSGLFT

SEQ ID NO: 29104 - protein, 16 aa, Homo sapiens
  heavy chain complementarity determining region 3 for antibody 14552
AREIFKGEIDYYAMDV

SEQ ID NO: 29105 - protein, 10 aa, Homo sapiens
  light chain complementarity determining region 3 for antibody 14553
QQYVSSELFT

SEQ ID NO: 29106 - protein, 16 aa, Homo sapiens
  heavy chain complementarity determining region 3 for antibody 14553
ARTQGTRDYYYYAMDV

SEQ ID NO: 29107 - protein, 10 aa, Homo sapiens
  light chain complementarity determining region 3 for antibody 14554
QQYVSSELFT

SEQ ID NO: 29108 - protein, 16 aa, Homo sapiens
  heavy chain complementarity determining region 3 for antibody 14554
AREVFKGEIDYYAMDV

SEQ ID NO: 29109 - protein, 10 aa, Homo sapiens
  light chain complementarity determining region 3 for antibody 14555
QQYVSSELFT

SEQ ID NO: 29110 - protein, 16 aa, Homo sapiens
  heavy chain complementarity determining region 3 for antibody 14555
AREMFKGEIDYYAMDV

SEQ ID NO: 29111 - protein, 10 aa, Homo sapiens
  light chain complementarity determining region 3 for antibody 14556
QQYVSSELFT

SEQ ID NO: 29112 - protein, 16 aa, Homo sapiens
  heavy chain complementarity determining region 3 for antibody 14556
AREILKGEIDYYAMDV

SEQ ID NO: 29113 - protein, 10 aa, Homo sapiens
  light chain complementarity determining region 3 for antibody 14557
QQYVSSELFT

SEQ ID NO: 29114 - protein, 16 aa, Homo sapiens
  heavy chain complementarity determining region 3 for antibody 14557
AREIFRGEIDYYAMDV

SEQ ID NO: 29115 - protein, 10 aa, Homo sapiens
  light chain complementarity determining region 3 for antibody 14558
QQYVSSELFT

SEQ ID NO: 29116 - protein, 16 aa, Homo sapiens
  heavy chain complementarity determining region 3 for antibody 14558
AREIFKGETDYYAMDV

SEQ ID NO: 29117 - protein, 10 aa, Homo sapiens
  light chain complementarity determining region 3 for antibody 14559
QQYVSSELFT

SEQ ID NO: 29118 - protein, 16 aa, Homo sapiens
  heavy chain complementarity determining region 3 for antibody 14559
AREIFKGENDYYAMDV

SEQ ID NO: 29119 - protein, 10 aa, Homo sapiens
  light chain complementarity determining region 3 for antibody 14560
QQYVSSELFT

SEQ ID NO: 29120 - protein, 16 aa, Homo sapiens
  heavy chain complementarity determining region 3 for antibody 14560
AREIFKGEIDYYDMDV

SEQ ID NO: 29121 - protein, 10 aa, Homo sapiens
  light chain complementarity determining region 3 for antibody 14561
QQYVSSELFT

SEQ ID NO: 29122 - protein, 16 aa, Homo sapiens
  heavy chain complementarity determining region 3 for antibody 14561
AREIFKGEIDYYARDV

SEQ ID NO: 29123 - protein, 10 aa, Homo sapiens
  light chain complementarity determining region 3 for antibody 14562
QQYVSSELFT

SEQ ID NO: 29124 - protein, 16 aa, Homo sapiens
  heavy chain complementarity determining region 3 for antibody 14562
AREIFKGEIDYYALDV

SEQ ID NO: 29125 - protein, 10 aa, Homo sapiens
  light chain complementarity determining region 3 for antibody 14563
QQYVSSELFT

SEQ ID NO: 29126 - protein, 16 aa, Homo sapiens
  heavy chain complementarity determining region 3 for antibody 14563
AREIFKGEIDYYAIDV

SEQ ID NO: 29127 - protein, 10 aa, Homo sapiens
  light chain complementarity determining region 3 for antibody 14564
QQYVSSELFT

SEQ ID NO: 29128 - protein, 16 aa, Homo sapiens
  heavy chain complementarity determining region 3 for antibody 14564
AREIFKGEIDYSAMDV

SEQ ID NO: 29129 - protein, 10 aa, Homo sapiens
  light chain complementarity determining region 3 for antibody 14565
QQYVSSELFT

SEQ ID NO: 29130 - protein, 16 aa, Homo sapiens
  heavy chain complementarity determining region 3 for antibody 14565
AREIFKGEIDYHAMDV

SEQ ID NO: 29131 - protein, 10 aa, Homo sapiens
  light chain complementarity determining region 3 for antibody 14566
QQYVSSELFT

SEQ ID NO: 29132 - protein, 16 aa, Homo sapiens
  heavy chain complementarity determining region 3 for antibody 14566
AREIFKGDIDYYAMDV

SEQ ID NO: 29133 - protein, 10 aa, Homo sapiens
  light chain complementarity determining region 3 for antibody 14567
QQYVSSEFFT

SEQ ID NO: 29134 - protein, 16 aa, Homo sapiens
  heavy chain complementarity determining region 3 for antibody 14567
AREIFKGEIDYYAMDV

SEQ ID NO: 29135 - protein, 10 aa, Homo sapiens
  light chain complementarity determining region 3 for antibody 14568
QQYVSSDLFT

SEQ ID NO: 29136 - protein, 16 aa, Homo sapiens
  heavy chain complementarity determining region 3 for antibody 14568
ARELFKGEYDYYALDV

SEQ ID NO: 29137 - protein, 10 aa, Homo sapiens
  light chain complementarity determining region 3 for antibody 14569
QQYVSSAPYT

SEQ ID NO: 29138 - protein, 16 aa, Homo sapiens
  heavy chain complementarity determining region 3 for antibody 14569
ARELFKGEYDYYAMDV

SEQ ID NO: 29139 - protein, 10 aa, Homo sapiens
  light chain complementarity determining region 3 for antibody 14570
QQYVSSALYT

SEQ ID NO: 29140 - protein, 16 aa, Homo sapiens
  heavy chain complementarity determining region 3 for antibody 14570
AREVFKGEIDYYAMDV

SEQ ID NO: 29141 - protein, 10 aa, Homo sapiens
  light chain complementarity determining region 3 for antibody 14571
QQYVSSALYT

SEQ ID NO: 29142 - protein, 16 aa, Homo sapiens
  heavy chain complementarity determining region 3 for antibody 14571
ARELVKGEYDYYAMDV

SEQ ID NO: 29143 - protein, 10 aa, Homo sapiens
  light chain complementarity determining region 3 for antibody 14572
QQYVSSALYT

SEQ ID NO: 29144 - protein, 16 aa, Homo sapiens
  heavy chain complementarity determining region 3 for antibody 14572
ARELSKGEYDYYAMDV

SEQ ID NO: 29145 - protein, 10 aa, Homo sapiens
  light chain complementarity determining region 3 for antibody 14573
QQYVSSALYT

SEQ ID NO: 29146 - protein, 16 aa, Homo sapiens
  heavy chain complementarity determining region 3 for antibody 14573
ARELLKGEYDYYAMDV

SEQ ID NO: 29147 - protein, 10 aa, Homo sapiens
  light chain complementarity determining region 3 for antibody 14574
QQYVSSALYT

SEQ ID NO: 29148 - protein, 16 aa, Homo sapiens
  heavy chain complementarity determining region 3 for antibody 14574
ARELFKGEYDYYAMEV

SEQ ID NO: 29149 - protein, 10 aa, Homo sapiens
  light chain complementarity determining region 3 for antibody 14575
QQYVSSALYT

SEQ ID NO: 29150 - protein, 16 aa, Homo sapiens
  heavy chain complementarity determining region 3 for antibody 14575
ARELFKGEYDYYAMDD

SEQ ID NO: 29151 - protein, 10 aa, Homo sapiens
  light chain complementarity determining region 3 for antibody 14576
QQYVSSALYT

SEQ ID NO: 29152 - protein, 16 aa, Homo sapiens
  heavy chain complementarity determining region 3 for antibody 14576
ARELFKGEYDYYAIDV

SEQ ID NO: 29153 - protein, 10 aa, Homo sapiens
  light chain complementarity determining region 3 for antibody 14577
QQYVSSALYT

SEQ ID NO: 29154 - protein, 16 aa, Homo sapiens
  heavy chain complementarity determining region 3 for antibody 14577
ARELFKGDYDYYAMDV

SEQ ID NO: 29155 - protein, 10 aa, Homo sapiens
  light chain complementarity determining region 3 for antibody 14578
QQYVSSALFT

SEQ ID NO: 29156 - protein, 16 aa, Homo sapiens
  heavy chain complementarity determining region 3 for antibody 14578
ARELFKGEYDYYAMDV

SEQ ID NO: 29157 - protein, 10 aa, Homo sapiens
  light chain complementarity determining region 3 for antibody 14579
QQYVSSALFT

SEQ ID NO: 29158 - protein, 16 aa, Homo sapiens
  heavy chain complementarity determining region 3 for antibody 14579
AREIFKGEIDYYAMDV

SEQ ID NO: 29159 - protein, 10 aa, Homo sapiens
  light chain complementarity determining region 3 for antibody 14580
QQYVSSALFP

SEQ ID NO: 29160 - protein, 16 aa, Homo sapiens
  heavy chain complementarity determining region 3 for antibody 14580
ARELFKGEYDYYALDV

SEQ ID NO: 29161 - protein, 10 aa, Homo sapiens
  light chain complementarity determining region 3 for antibody 14581
QQYVSPALYT

SEQ ID NO: 29162 - protein, 16 aa, Homo sapiens
  heavy chain complementarity determining region 3 for antibody 14581
ARELFKGEYDYYAMDV

SEQ ID NO: 29163 - protein, 10 aa, Homo sapiens
  light chain complementarity determining region 3 for antibody 14582
QQYVSLELFT

SEQ ID NO: 29164 - protein, 16 aa, Homo sapiens
  heavy chain complementarity determining region 3 for antibody 14582
AREIFKGEIDYYAMDV

SEQ ID NO: 29165 - protein, 10 aa, Homo sapiens
  light chain complementarity determining region 3 for antibody 14583
QQYVSLALYT

SEQ ID NO: 29166 - protein, 16 aa, Homo sapiens
  heavy chain complementarity determining region 3 for antibody 14583
ARELFKGEYDYYALDV

SEQ ID NO: 29167 - protein, 10 aa, Homo sapiens
  light chain complementarity determining region 3 for antibody 14584
QQYVRSDLFT

SEQ ID NO: 29168 - protein, 16 aa, Homo sapiens
  heavy chain complementarity determining region 3 for antibody 14584
ARELFKGQIDSYGIDV

SEQ ID NO: 29169 - protein, 10 aa, Homo sapiens
  light chain complementarity determining region 3 for antibody 14585
QQYVRPDLFT

SEQ ID NO: 29170 - protein, 16 aa, Homo sapiens
  heavy chain complementarity determining region 3 for antibody 14585
ARELFKGQIDYYGIDV

SEQ ID NO: 29171 - protein, 10 aa, Homo sapiens
  light chain complementarity determining region 3 for antibody 14586
QQYVPSYKYT

SEQ ID NO: 29172 - protein, 22 aa, Homo sapiens
  heavy chain complementarity determining region 3 for antibody 14586
ARHSPFLEMLGERWLQFGAFDI

SEQ ID NO: 29173 - protein, 10 aa, Homo sapiens
  light chain complementarity determining region 3 for antibody 14587
QQYVPSHTYT

SEQ ID NO: 29174 - protein, 22 aa, Homo sapiens
  heavy chain complementarity determining region 3 for antibody 14587
ARHSPFLEMLGERWLQFGAFDI

SEQ ID NO: 29175 - protein, 10 aa, Homo sapiens
  light chain complementarity determining region 3 for antibody 14588
QQYVPSHKYT

SEQ ID NO: 29176 - protein, 13 aa, Homo sapiens
  heavy chain complementarity determining region 3 for antibody 14588
ARVGAVAGRAFDV

SEQ ID NO: 29177 - protein, 10 aa, Homo sapiens
  light chain complementarity determining region 3 for antibody 14589
QQYVPSHKYT

SEQ ID NO: 29178 - protein, 22 aa, Homo sapiens
  heavy chain complementarity determining region 3 for antibody 14589
ARHSPFLEVLGERWLQFGAFDI

SEQ ID NO: 29179 - protein, 10 aa, Homo sapiens
  light chain complementarity determining region 3 for antibody 14590
QQYVPSHKYT

SEQ ID NO: 29180 - protein, 22 aa, Homo sapiens
  heavy chain complementarity determining region 3 for antibody 14590
ARHSPFLEMLGERWLQCGAFDI

SEQ ID NO: 29181 - protein, 10 aa, Homo sapiens
  light chain complementarity determining region 3 for antibody 14591
QQYVPSHKNT

SEQ ID NO: 29182 - protein, 22 aa, Homo sapiens
  heavy chain complementarity determining region 3 for antibody 14591
ARHSPFLEMLGERWLQFGAFDI

SEQ ID NO: 29183 - protein, 10 aa, Homo sapiens
  light chain complementarity determining region 3 for antibody 14592
QQYVNSALFT

SEQ ID NO: 29184 - protein, 16 aa, Homo sapiens
  heavy chain complementarity determining region 3 for antibody 14592
AREVVKGEIDYYAMDV

SEQ ID NO: 29185 - protein, 10 aa, Homo sapiens
  light chain complementarity determining region 3 for antibody 14593
QQYVNSAFFT

SEQ ID NO: 29186 - protein, 16 aa, Homo sapiens
  heavy chain complementarity determining region 3 for antibody 14593
AREVFKGEIDYYAMDV

SEQ ID NO: 29187 - protein, 10 aa, Homo sapiens
  light chain complementarity determining region 3 for antibody 14594
QQYVNLPSVT

SEQ ID NO: 29188 - protein, 11 aa, Homo sapiens
  heavy chain complementarity determining region 3 for antibody 14594
AKSGGFWSFDY

SEQ ID NO: 29189 - protein, 9 aa, Homo sapiens
  light chain complementarity determining region 3 for antibody 14595
QQYVNLPLT

SEQ ID NO: 29190 - protein, 18 aa, Homo sapiens
  heavy chain complementarity determining region 3 for antibody 14595
ARAPGDYDMLRRGYYFDH

SEQ ID NO: 29191 - protein, 10 aa, Homo sapiens
  light chain complementarity determining region 3 for antibody 14596
QQYVGSPEFT

SEQ ID NO: 29192 - protein, 21 aa, Homo sapiens
  heavy chain complementarity determining region 3 for antibody 14596
ARDQGVLVWFREVLMFNAFNM

SEQ ID NO: 29193 - protein, 10 aa, Homo sapiens
  light chain complementarity determining region 3 for antibody 14597
QQYVGSELFT

SEQ ID NO: 29194 - protein, 16 aa, Homo sapiens
  heavy chain complementarity determining region 3 for antibody 14597
AREIFKGEIDYYAMDV

SEQ ID NO: 29195 - protein, 9 aa, Homo sapiens
  light chain complementarity determining region 3 for antibody 14598
QQYVFPLVI

SEQ ID NO: 29196 - protein, 18 aa, Homo sapiens
  heavy chain complementarity determining region 3 for antibody 14598
ARRVWPYYDDASGYYFDF

SEQ ID NO: 29197 - protein, 9 aa, Homo sapiens
  light chain complementarity determining region 3 for antibody 14599
QQYTTDPWT

SEQ ID NO: 29198 - protein, 10 aa, Homo sapiens
  heavy chain complementarity determining region 3 for antibody 14599
IRHEEYVRPY

SEQ ID NO: 29199 - protein, 9 aa, Homo sapiens
  light chain complementarity determining region 3 for antibody 14600
QQYTSYWYT

SEQ ID NO: 29200 - protein, 20 aa, Homo sapiens
  heavy chain complementarity determining region 3 for antibody 14600
AGTYGSGTYSPDYYYFGMDV

SEQ ID NO: 29201 - protein, 9 aa, Homo sapiens
  light chain complementarity determining region 3 for antibody 14601
QQYTSYPYT

SEQ ID NO: 29202 - protein, 19 aa, Homo sapiens
  heavy chain complementarity determining region 3 for antibody 14601
ARDQSSSYGDYYYYYGMDV

SEQ ID NO: 29203 - protein, 9 aa, Homo sapiens
  light chain complementarity determining region 3 for antibody 14602
QQYTSYPRT

SEQ ID NO: 29204 - protein, 24 aa, Homo sapiens
  heavy chain complementarity determining region 3 for antibody 14602
ARGSTDGTVTTFGVPVLEYYYFDN

SEQ ID NO: 29205 - protein, 9 aa, Homo sapiens
  light chain complementarity determining region 3 for antibody 14603
QQYTNLPYT

SEQ ID NO: 29206 - protein, 13 aa, Homo sapiens
  heavy chain complementarity determining region 3 for antibody 14603
ARAKWDLFGYFDF

SEQ ID NO: 29207 - protein, 9 aa, Homo sapiens
  light chain complementarity determining region 3 for antibody 14604
QQYSVSRGT

SEQ ID NO: 29208 - protein, 21 aa, Homo sapiens
  heavy chain complementarity determining region 3 for antibody 14604
ARDRGGDFHGDSSYYNRPFDY

SEQ ID NO: 29209 - protein, 9 aa, Homo sapiens
  light chain complementarity determining region 3 for antibody 14605
QQYSTYSET

SEQ ID NO: 29210 - protein, 19 aa, Homo sapiens
  heavy chain complementarity determining region 3 for antibody 14605
ATVKGDQGELDYDYHGVDV

SEQ ID NO: 29211 - protein, 9 aa, Homo sapiens
  light chain complementarity determining region 3 for antibody 14606
QQYSTYPLT

SEQ ID NO: 29212 - protein, 15 aa, Homo sapiens
  heavy chain complementarity determining region 3 for antibody 14606
ARGGIHYDVLTGLDY

SEQ ID NO: 29213 - protein, 9 aa, Homo sapiens
  light chain complementarity determining region 3 for antibody 14607
QQYSTYPLT

SEQ ID NO: 29214 - protein, 15 aa, Homo sapiens
  heavy chain complementarity determining region 3 for antibody 14607
ARGGIHYDISTGLDY

SEQ ID NO: 29215 - protein, 10 aa, Homo sapiens
  light chain complementarity determining region 3 for antibody 14608
QQYSTSPQLT

SEQ ID NO: 29216 - protein, 13 aa, Homo sapiens
  heavy chain complementarity determining region 3 for antibody 14608
ARSAGYYPNWLES

SEQ ID NO: 29217 - protein, 9 aa, Homo sapiens
  light chain complementarity determining region 3 for antibody 14609
QQYSTSPGT

SEQ ID NO: 29218 - protein, 18 aa, Homo sapiens
  heavy chain complementarity determining region 3 for antibody 14609
ARYLYHDYWGGLLHPFDN

SEQ ID NO: 29219 - protein, 9 aa, Homo sapiens
  light chain complementarity determining region 3 for antibody 14610
QQYSTFPYT

SEQ ID NO: 29220 - protein, 9 aa, Homo sapiens
  heavy chain complementarity determining region 3 for antibody 14610
VAYLAGYPR

SEQ ID NO: 29221 - protein, 9 aa, Homo sapiens
  light chain complementarity determining region 3 for antibody 14611
QQYSTFPYT

SEQ ID NO: 29222 - protein, 17 aa, Homo sapiens
  heavy chain complementarity determining region 3 for antibody 14611
AREDWNDVDLRQFYFDS

SEQ ID NO: 29223 - protein, 9 aa, Homo sapiens
  light chain complementarity determining region 3 for antibody 14612
QQYSTFPYP

SEQ ID NO: 29224 - protein, 17 aa, Homo sapiens
  heavy chain complementarity determining region 3 for antibody 14612
AREQWNDVDLRQFYFDY

SEQ ID NO: 29225 - protein, 9 aa, Homo sapiens
  light chain complementarity determining region 3 for antibody 14613
QQYSTFPST

SEQ ID NO: 29226 - protein, 17 aa, Homo sapiens
  heavy chain complementarity determining region 3 for antibody 14613
AREVWNDVDLRQYYFDY

SEQ ID NO: 29227 - protein, 9 aa, Homo sapiens
  light chain complementarity determining region 3 for antibody 14614
QQYSTFPHT

SEQ ID NO: 29228 - protein, 17 aa, Homo sapiens
  heavy chain complementarity determining region 3 for antibody 14614
AREDWNDVDLRQFYFDY

SEQ ID NO: 29229 - protein, 9 aa, Homo sapiens
  light chain complementarity determining region 3 for antibody 14615
QQYSTFPDT

SEQ ID NO: 29230 - protein, 17 aa, Homo sapiens
  heavy chain complementarity determining region 3 for antibody 14615
AREQYNDVDLRQFFFDY

SEQ ID NO: 29231 - protein, 9 aa, Homo sapiens
  light chain complementarity determining region 3 for antibody 14616
QQYSSYWYT

SEQ ID NO: 29232 - protein, 20 aa, Homo sapiens
  heavy chain complementarity determining region 3 for antibody 14616
AGTYGSGTYSPDYYYFGMDV

SEQ ID NO: 29233 - protein, 9 aa, Homo sapiens
  light chain complementarity determining region 3 for antibody 14617
QQYSSYPYT

SEQ ID NO: 29234 - protein, 17 aa, Homo sapiens
  heavy chain complementarity determining region 3 for antibody 14617
VREDYSDVDLREWYFDY

SEQ ID NO: 29235 - protein, 9 aa, Homo sapiens
  light chain complementarity determining region 3 for antibody 14618
QQYSSYPYT

SEQ ID NO: 29236 - protein, 17 aa, Homo sapiens
  heavy chain complementarity determining region 3 for antibody 14618
VREDWTDVDLREWYFDY

SEQ ID NO: 29237 - protein, 9 aa, Homo sapiens
  light chain complementarity determining region 3 for antibody 14619
QQYSSYPRT

SEQ ID NO: 29238 - protein, 17 aa, Homo sapiens
  heavy chain complementarity determining region 3 for antibody 14619
ARRFGLYYFGASDYYDY

SEQ ID NO: 29239 - protein, 9 aa, Homo sapiens
  light chain complementarity determining region 3 for antibody 14620
QQYSSYPLT

SEQ ID NO: 29240 - protein, 15 aa, Homo sapiens
  heavy chain complementarity determining region 3 for antibody 14620
ARGGIYCDILVGLDS

SEQ ID NO: 29241 - protein, 9 aa, Homo sapiens
  light chain complementarity determining region 3 for antibody 14621
QQYSSYPIT

SEQ ID NO: 29242 - protein, 13 aa, Homo sapiens
  heavy chain complementarity determining region 3 for antibody 14621
ASGLHSGYDYFDY

SEQ ID NO: 29243 - protein, 10 aa, Homo sapiens
  light chain complementarity determining region 3 for antibody 14622
QQYSSWPPWT

SEQ ID NO: 29244 - protein, 9 aa, Homo sapiens
  heavy chain complementarity determining region 3 for antibody 14622
ARGYSYGNL

SEQ ID NO: 29245 - protein, 9 aa, Homo sapiens
  light chain complementarity determining region 3 for antibody 14623
QQYSSSRYT

SEQ ID NO: 29246 - protein, 23 aa, Homo sapiens
  heavy chain complementarity determining region 3 for antibody 14623
ARVGCSGEKCSSMSGYYYCALDV

SEQ ID NO: 29247 - protein, 8 aa, Homo sapiens
  light chain complementarity determining region 3 for antibody 14624
QQYSSSPT

SEQ ID NO: 29248 - protein, 19 aa, Homo sapiens
  heavy chain complementarity determining region 3 for antibody 14624
ARDRFPSSGWNSPSDAFDI

SEQ ID NO: 29249 - protein, 10 aa, Homo sapiens
  light chain complementarity determining region 3 for antibody 14625
QQYSSSPQPT

SEQ ID NO: 29250 - protein, 13 aa, Homo sapiens
  heavy chain complementarity determining region 3 for antibody 14625
ARSAGYYPNWLES

SEQ ID NO: 29251 - protein, 10 aa, Homo sapiens
  light chain complementarity determining region 3 for antibody 14626
QQYSSSPQLT

SEQ ID NO: 29252 - protein, 13 aa, Homo sapiens
  heavy chain complementarity determining region 3 for antibody 14626
ARSASYYPNWLES

SEQ ID NO: 29253 - protein, 10 aa, Homo sapiens
  light chain complementarity determining region 3 for antibody 14627
QQYSSSPQLT

SEQ ID NO: 29254 - protein, 13 aa, Homo sapiens
  heavy chain complementarity determining region 3 for antibody 14627
ARSAGYYPNWPES

SEQ ID NO: 29255 - protein, 10 aa, Homo sapiens
  light chain complementarity determining region 3 for antibody 14628
QQYSSSPQLT

SEQ ID NO: 29256 - protein, 13 aa, Homo sapiens
  heavy chain complementarity determining region 3 for antibody 14628
ARSAGYYPNRLES

SEQ ID NO: 29257 - protein, 10 aa, Homo sapiens
  light chain complementarity determining region 3 for antibody 14629
QQYSSSPQLT

SEQ ID NO: 29258 - protein, 13 aa, Homo sapiens
  heavy chain complementarity determining region 3 for antibody 14629
ARSAGYYPNLLES

SEQ ID NO: 29259 - protein, 10 aa, Homo sapiens
  light chain complementarity determining region 3 for antibody 14630
QQYSSSPQLT

SEQ ID NO: 29260 - protein, 13 aa, Homo sapiens
  heavy chain complementarity determining region 3 for antibody 14630
ARSAGHYPNWLES

SEQ ID NO: 29261 - protein, 10 aa, Homo sapiens
  light chain complementarity determining region 3 for antibody 14631
QQYSSSPQLT

SEQ ID NO: 29262 - protein, 13 aa, Homo sapiens
  heavy chain complementarity determining region 3 for antibody 14631
ARPAGYYPNWLES

SEQ ID NO: 29263 - protein, 10 aa, Homo sapiens
  light chain complementarity determining region 3 for antibody 14632
QQYSSSPQLT

SEQ ID NO: 29264 - protein, 18 aa, Homo sapiens
  heavy chain complementarity determining region 3 for antibody 14632
ARAPGDYDMLRRGYYFDH

SEQ ID NO: 29265 - protein, 10 aa, Homo sapiens
  light chain complementarity determining region 3 for antibody 14633
QQYSSSPQLT

SEQ ID NO: 29266 - protein, 13 aa, Homo sapiens
  heavy chain complementarity determining region 3 for antibody 14633
ARAAGYYPNWLES

SEQ ID NO: 29267 - protein, 10 aa, Homo sapiens
  light chain complementarity determining region 3 for antibody 14634
QQYSSSPQLT

SEQ ID NO: 29268 - protein, 12 aa, Homo sapiens
  heavy chain complementarity determining region 3 for antibody 14634
AKGILGRGGMDV

SEQ ID NO: 29269 - protein, 10 aa, Homo sapiens
  light chain complementarity determining region 3 for antibody 14635
QQYSSSPQIT

SEQ ID NO: 29270 - protein, 13 aa, Homo sapiens
  heavy chain complementarity determining region 3 for antibody 14635
ARSAGYYPNWLES

SEQ ID NO: 29271 - protein, 9 aa, Homo sapiens
  light chain complementarity determining region 3 for antibody 14636
QQYSSSPAT

SEQ ID NO: 29272 - protein, 19 aa, Homo sapiens
  heavy chain complementarity determining region 3 for antibody 14636
ARRVIVVLPAARGYYGMDV

SEQ ID NO: 29273 - protein, 10 aa, Homo sapiens
  light chain complementarity determining region 3 for antibody 14637
QQYSSSHQLT

SEQ ID NO: 29274 - protein, 13 aa, Homo sapiens
  heavy chain complementarity determining region 3 for antibody 14637
ARSAGYYPNWLES

SEQ ID NO: 29275 - protein, 9 aa, Homo sapiens
  light chain complementarity determining region 3 for antibody 14638
QQYSSLPLP

SEQ ID NO: 29276 - protein, 16 aa, Homo sapiens
  heavy chain complementarity determining region 3 for antibody 14638
ARWGKTPTTMVDAFDI

SEQ ID NO: 29277 - protein, 9 aa, Homo sapiens
  light chain complementarity determining region 3 for antibody 14639
QQYSSLPIT

SEQ ID NO: 29278 - protein, 19 aa, Homo sapiens
  heavy chain complementarity determining region 3 for antibody 14639
ARDRDYTIVDDYGSGVFDY

SEQ ID NO: 29279 - protein, 9 aa, Homo sapiens
  light chain complementarity determining region 3 for antibody 14640
QQYSSFPWT

SEQ ID NO: 29280 - protein, 17 aa, Homo sapiens
  heavy chain complementarity determining region 3 for antibody 14640
ARRSGLYYFDAHNYYDF

SEQ ID NO: 29281 - protein, 9 aa, Homo sapiens
  light chain complementarity determining region 3 for antibody 14641
QQYSRYPYP

SEQ ID NO: 29282 - protein, 17 aa, Homo sapiens
  heavy chain complementarity determining region 3 for antibody 14641
VREDWTDVDLREWYFDY

SEQ ID NO: 29283 - protein, 9 aa, Homo sapiens
  light chain complementarity determining region 3 for antibody 14642
QQYSRYPWT

SEQ ID NO: 29284 - protein, 11 aa, Homo sapiens
  heavy chain complementarity determining region 3 for antibody 14642
AREQTGYYPLY

SEQ ID NO: 29285 - protein, 9 aa, Homo sapiens
  light chain complementarity determining region 3 for antibody 14643
QQYSRYPVT

SEQ ID NO: 29286 - protein, 11 aa, Homo sapiens
  heavy chain complementarity determining region 3 for antibody 14643
AREQTGYYPLD

SEQ ID NO: 29287 - protein, 10 aa, Homo sapiens
  light chain complementarity determining region 3 for antibody 14644
QQYSRSPQLT

SEQ ID NO: 29288 - protein, 13 aa, Homo sapiens
  heavy chain complementarity determining region 3 for antibody 14644
ARSAGYYPNWLES

SEQ ID NO: 29289 - protein, 9 aa, Homo sapiens
  light chain complementarity determining region 3 for antibody 14645
QQYSRLPYT

SEQ ID NO: 29290 - protein, 17 aa, Homo sapiens
  heavy chain complementarity determining region 3 for antibody 14645
AREQWNDVDLRQFYFDY

SEQ ID NO: 29291 - protein, 10 aa, Homo sapiens
  light chain complementarity determining region 3 for antibody 14646
QQYSRGPPWT

SEQ ID NO: 29292 - protein, 9 aa, Homo sapiens
  heavy chain complementarity determining region 3 for antibody 14646
ARGYSYGNL

SEQ ID NO: 29293 - protein, 9 aa, Homo sapiens
  light chain complementarity determining region 3 for antibody 14647
QQYSNYPYS

SEQ ID NO: 29294 - protein, 17 aa, Homo sapiens
  heavy chain complementarity determining region 3 for antibody 14647
ASEDWADVDLRLYYFDY

SEQ ID NO: 29295 - protein, 9 aa, Homo sapiens
  light chain complementarity determining region 3 for antibody 14648
QQYSNYPYS

SEQ ID NO: 29296 - protein, 17 aa, Homo sapiens
  heavy chain complementarity determining region 3 for antibody 14648
ARGDWADVDLRLYYFDY

SEQ ID NO: 29297 - protein, 9 aa, Homo sapiens
  light chain complementarity determining region 3 for antibody 14649
QQYSNYPYS

SEQ ID NO: 29298 - protein, 17 aa, Homo sapiens
  heavy chain complementarity determining region 3 for antibody 14649
AREDWADVDVRLYYFDY

SEQ ID NO: 29299 - protein, 9 aa, Homo sapiens
  light chain complementarity determining region 3 for antibody 14650
QQYSNYPYS

SEQ ID NO: 29300 - protein, 17 aa, Homo sapiens
  heavy chain complementarity determining region 3 for antibody 14650
AREDWADVDLRLYYLDY

SEQ ID NO: 29301 - protein, 8 aa, Homo sapiens
  light chain complementarity determining region 3 for antibody 14651
QQYSNWPS

SEQ ID NO: 29302 - protein, 12 aa, Homo sapiens
  heavy chain complementarity determining region 3 for antibody 14651
VQGNGAGSYSRH

SEQ ID NO: 29303 - protein, 9 aa, Homo sapiens
  light chain complementarity determining region 3 for antibody 14652
QQYSNLPYT

SEQ ID NO: 29304 - protein, 13 aa, Homo sapiens
  heavy chain complementarity determining region 3 for antibody 14652
ARAKWDLFGYFDF

SEQ ID NO: 29305 - protein, 12 aa, Homo sapiens
  light chain complementarity determining region 3 for antibody 14653
QQYSKWPPAGYT

SEQ ID NO: 29306 - protein, 21 aa, Homo sapiens
  heavy chain complementarity determining region 3 for antibody 14653
ARDQSDFTIVDVPSYFYGLDV

SEQ ID NO: 29307 - protein, 9 aa, Homo sapiens
  light chain complementarity determining region 3 for antibody 14654
QQYSKWPLT

SEQ ID NO: 29308 - protein, 24 aa, Homo sapiens
  heavy chain complementarity determining region 3 for antibody 14654
AKDTKAIGAMLVGIPNHLNNWFDP

SEQ ID NO: 29309 - protein, 9 aa, Homo sapiens
  light chain complementarity determining region 3 for antibody 14655
QQYSGYYYT

SEQ ID NO: 29310 - protein, 21 aa, Homo sapiens
  heavy chain complementarity determining region 3 for antibody 14655
ARGGYYDTSGYRRFHFYSLDV

SEQ ID NO: 29311 - protein, 8 aa, Homo sapiens
  light chain complementarity determining region 3 for antibody 14656
QQYSGSVT

SEQ ID NO: 29312 - protein, 20 aa, Homo sapiens
  heavy chain complementarity determining region 3 for antibody 14656
VRGQYCGGDCSPGPGHAFDI

SEQ ID NO: 29313 - protein, 10 aa, Homo sapiens
  light chain complementarity determining region 3 for antibody 14657
QQYSGNSLWT

SEQ ID NO: 29314 - protein, 13 aa, Homo sapiens
  heavy chain complementarity determining region 3 for antibody 14657
AADSYYSSADFDH

SEQ ID NO: 29315 - protein, 9 aa, Homo sapiens
  light chain complementarity determining region 3 for antibody 14658
QQYSGLPIT

SEQ ID NO: 29316 - protein, 17 aa, Homo sapiens
  heavy chain complementarity determining region 3 for antibody 14658
ARVDGYILTGYPYHSDY

SEQ ID NO: 29317 - protein, 9 aa, Homo sapiens
  light chain complementarity determining region 3 for antibody 14659
QQYSGGPIT

SEQ ID NO: 29318 - protein, 13 aa, Homo sapiens
  heavy chain complementarity determining region 3 for antibody 14659
ARGKDSGSWMFDY

SEQ ID NO: 29319 - protein, 9 aa, Homo sapiens
  light chain complementarity determining region 3 for antibody 14660
QQYSGFPLT

SEQ ID NO: 29320 - protein, 13 aa, Homo sapiens
  heavy chain complementarity determining region 3 for antibody 14660
ARMKDDFYYGIDV

SEQ ID NO: 29321 - protein, 9 aa, Homo sapiens
  light chain complementarity determining region 3 for antibody 14661
QQYRTFPYT

SEQ ID NO: 29322 - protein, 17 aa, Homo sapiens
  heavy chain complementarity determining region 3 for antibody 14661
AREQWNDVDLRQFYFDY

SEQ ID NO: 29323 - protein, 9 aa, Homo sapiens
  light chain complementarity determining region 3 for antibody 14662
QQYRTFPYT

SEQ ID NO: 29324 - protein, 17 aa, Homo sapiens
  heavy chain complementarity determining region 3 for antibody 14662
AREDWNDVDLRQFYFDY

SEQ ID NO: 29325 - protein, 9 aa, Homo sapiens
  light chain complementarity determining region 3 for antibody 14663
QQYRTDPWT

SEQ ID NO: 29326 - protein, 10 aa, Homo sapiens
  heavy chain complementarity determining region 3 for antibody 14663
IRHEEYVRPY

SEQ ID NO: 29327 - protein, 9 aa, Homo sapiens
  light chain complementarity determining region 3 for antibody 14664
QQYRRYPVT

SEQ ID NO: 29328 - protein, 11 aa, Homo sapiens
  heavy chain complementarity determining region 3 for antibody 14664
AREQTGYYPLY

SEQ ID NO: 29329 - protein, 9 aa, Homo sapiens
  light chain complementarity determining region 3 for antibody 14665
QQYQSYPLT

SEQ ID NO: 29330 - protein, 10 aa, Homo sapiens
  heavy chain complementarity determining region 3 for antibody 14665
ATDREQAGDN

SEQ ID NO: 29331 - protein, 9 aa, Homo sapiens
  light chain complementarity determining region 3 for antibody 14666
QQYQSYPLP

SEQ ID NO: 29332 - protein, 10 aa, Homo sapiens
  heavy chain complementarity determining region 3 for antibody 14666
ATDLEQAGDN

SEQ ID NO: 29333 - protein, 8 aa, Homo sapiens
  light chain complementarity determining region 3 for antibody 14667
QQYNTYWT

SEQ ID NO: 29334 - protein, 19 aa, Homo sapiens
  heavy chain complementarity determining region 3 for antibody 14667
AKGRGQYVGRGAAYYGLDA

SEQ ID NO: 29335 - protein, 9 aa, Homo sapiens
  light chain complementarity determining region 3 for antibody 14668
QQYNTYSWT

SEQ ID NO: 29336 - protein, 20 aa, Homo sapiens
  heavy chain complementarity determining region 3 for antibody 14668
ARGSGETYYDILTGYCYFDH

SEQ ID NO: 29337 - protein, 9 aa, Homo sapiens
  light chain complementarity determining region 3 for antibody 14669
QQYNTYPYT

SEQ ID NO: 29338 - protein, 19 aa, Homo sapiens
  heavy chain complementarity determining region 3 for antibody 14669
ARGQSSSYGDYYYYYGMDV

SEQ ID NO: 29339 - protein, 9 aa, Homo sapiens
  light chain complementarity determining region 3 for antibody 14670
QQYNTYPYT

SEQ ID NO: 29340 - protein, 19 aa, Homo sapiens
  heavy chain complementarity determining region 3 for antibody 14670
ARDQSSSYGDYYCHYGMDV

SEQ ID NO: 29341 - protein, 8 aa, Homo sapiens
  light chain complementarity determining region 3 for antibody 14671
QQYNTWPS

SEQ ID NO: 29342 - protein, 12 aa, Homo sapiens
  heavy chain complementarity determining region 3 for antibody 14671
VQGNGAGSYSRH

SEQ ID NO: 29343 - protein, 9 aa, Homo sapiens
  light chain complementarity determining region 3 for antibody 14672
QQYNTLPLT

SEQ ID NO: 29344 - protein, 19 aa, Homo sapiens
  heavy chain complementarity determining region 3 for antibody 14672
ARDRDYTIVDDYGSGDFDY

SEQ ID NO: 29345 - protein, 9 aa, Homo sapiens
  light chain complementarity determining region 3 for antibody 14673
QQYNTDWWT

SEQ ID NO: 29346 - protein, 19 aa, Homo sapiens
  heavy chain complementarity determining region 3 for antibody 14673
AKDKSHGGFGEILFEYFDH

SEQ ID NO: 29347 - protein, 9 aa, Homo sapiens
  light chain complementarity determining region 3 for antibody 14674
QQYNTDPWT

SEQ ID NO: 29348 - protein, 10 aa, Homo sapiens
  heavy chain complementarity determining region 3 for antibody 14674
IRHEEYVRPY

SEQ ID NO: 29349 - protein, 9 aa, Homo sapiens
  light chain complementarity determining region 3 for antibody 14675
QQYNTAPTP

SEQ ID NO: 29350 - protein, 13 aa, Homo sapiens
  heavy chain complementarity determining region 3 for antibody 14675
ARDGHGFGLPFDI

SEQ ID NO: 29351 - protein, 9 aa, Homo sapiens
  light chain complementarity determining region 3 for antibody 14676
QQYNSYYRT

SEQ ID NO: 29352 - protein, 13 aa, Homo sapiens
  heavy chain complementarity determining region 3 for antibody 14676
ARAGRDFYYGMDV

SEQ ID NO: 29353 - protein, 9 aa, Homo sapiens
  light chain complementarity determining region 3 for antibody 14677
QQYNSYWYT

SEQ ID NO: 29354 - protein, 16 aa, Homo sapiens
  heavy chain complementarity determining region 3 for antibody 14677
ARTQGTRDYYYYAMDV

SEQ ID NO: 29355 - protein, 9 aa, Homo sapiens
  light chain complementarity determining region 3 for antibody 14678
QQYNSYWYT

SEQ ID NO: 29356 - protein, 12 aa, Homo sapiens
  heavy chain complementarity determining region 3 for antibody 14678
ARRSWDSGYDPS

SEQ ID NO: 29357 - protein, 9 aa, Homo sapiens
  light chain complementarity determining region 3 for antibody 14679
QQYNSYWYT

SEQ ID NO: 29358 - protein, 17 aa, Homo sapiens
  heavy chain complementarity determining region 3 for antibody 14679
ARASYFGASYYYYGMDV

SEQ ID NO: 29359 - protein, 9 aa, Homo sapiens
  light chain complementarity determining region 3 for antibody 14680
QQYNSYWYT

SEQ ID NO: 29360 - protein, 20 aa, Homo sapiens
  heavy chain complementarity determining region 3 for antibody 14680
AGTYGSWTYSPDYYYFGMDV

SEQ ID NO: 29361 - protein, 9 aa, Homo sapiens
  light chain complementarity determining region 3 for antibody 14681
QQYNSYWYT

SEQ ID NO: 29362 - protein, 20 aa, Homo sapiens
  heavy chain complementarity determining region 3 for antibody 14681
AGTYGSRTYSPDYYYFGMDV

SEQ ID NO: 29363 - protein, 9 aa, Homo sapiens
  light chain complementarity determining region 3 for antibody 14682
QQYNSYWYT

SEQ ID NO: 29364 - protein, 20 aa, Homo sapiens
  heavy chain complementarity determining region 3 for antibody 14682
AGTYGSGTYSQDYYYFGMDV

SEQ ID NO: 29365 - protein, 9 aa, Homo sapiens
  light chain complementarity determining region 3 for antibody 14683
QQYNSYWYT

SEQ ID NO: 29366 - protein, 20 aa, Homo sapiens
  heavy chain complementarity determining region 3 for antibody 14683
AGTYGSGTYSPDYYYFSMDV

SEQ ID NO: 29367 - protein, 9 aa, Homo sapiens
  light chain complementarity determining region 3 for antibody 14684
QQYNSYWYT

SEQ ID NO: 29368 - protein, 20 aa, Homo sapiens
  heavy chain complementarity determining region 3 for antibody 14684
AGTYGSGTYSPDYYYFGVDV

SEQ ID NO: 29369 - protein, 9 aa, Homo sapiens
  light chain complementarity determining region 3 for antibody 14685
QQYNSYWYT

SEQ ID NO: 29370 - protein, 20 aa, Homo sapiens
  heavy chain complementarity determining region 3 for antibody 14685
AGTYGSGTYSPDYYCCGMDV

SEQ ID NO: 29371 - protein, 9 aa, Homo sapiens
  light chain complementarity determining region 3 for antibody 14686
QQYNSYWYT

SEQ ID NO: 29372 - protein, 20 aa, Homo sapiens
  heavy chain complementarity determining region 3 for antibody 14686
AGTYGSGTYSPDYDYFGMDV

SEQ ID NO: 29373 - protein, 9 aa, Homo sapiens
  light chain complementarity determining region 3 for antibody 14687
QQYNSYWYT

SEQ ID NO: 29374 - protein, 20 aa, Homo sapiens
  heavy chain complementarity determining region 3 for antibody 14687
AGTYGSGTYSPDSYYFGMDV

SEQ ID NO: 29375 - protein, 9 aa, Homo sapiens
  light chain complementarity determining region 3 for antibody 14688
QQYNSYWYT

SEQ ID NO: 29376 - protein, 20 aa, Homo sapiens
  heavy chain complementarity determining region 3 for antibody 14688
AGTYGSGTYSPAYYYFGMDV

SEQ ID NO: 29377 - protein, 9 aa, Homo sapiens
  light chain complementarity determining region 3 for antibody 14689
QQYNSYWYT

SEQ ID NO: 29378 - protein, 20 aa, Homo sapiens
  heavy chain complementarity determining region 3 for antibody 14689
AGTYGSGTYAPDYYYFGMDV

SEQ ID NO: 29379 - protein, 9 aa, Homo sapiens
  light chain complementarity determining region 3 for antibody 14690
QQYNSYWYT

SEQ ID NO: 29380 - protein, 20 aa, Homo sapiens
  heavy chain complementarity determining region 3 for antibody 14690
AGTYGSGTHSPDYYYFGMDV

SEQ ID NO: 29381 - protein, 9 aa, Homo sapiens
  light chain complementarity determining region 3 for antibody 14691
QQYNSYWYT

SEQ ID NO: 29382 - protein, 20 aa, Homo sapiens
  heavy chain complementarity determining region 3 for antibody 14691
AGTYGSGPYSPDYYYFGMDV

SEQ ID NO: 29383 - protein, 9 aa, Homo sapiens
  light chain complementarity determining region 3 for antibody 14692
QQYNSYWYT

SEQ ID NO: 29384 - protein, 20 aa, Homo sapiens
  heavy chain complementarity determining region 3 for antibody 14692
AGTYDSGTYSPDYYYFGMDV

SEQ ID NO: 29385 - protein, 9 aa, Homo sapiens
  light chain complementarity determining region 3 for antibody 14693
QQYNSYWYT

SEQ ID NO: 29386 - protein, 20 aa, Homo sapiens
  heavy chain complementarity determining region 3 for antibody 14693
AGTCGSGTYSPDYYYFGMDV

SEQ ID NO: 29387 - protein, 9 aa, Homo sapiens
  light chain complementarity determining region 3 for antibody 14694
QQYNSYWYN

SEQ ID NO: 29388 - protein, 20 aa, Homo sapiens
  heavy chain complementarity determining region 3 for antibody 14694
AGTYGSGTYSPDYYYFGMDV

SEQ ID NO: 29389 - protein, 9 aa, Homo sapiens
  light chain complementarity determining region 3 for antibody 14695
QQYNSYWYA

SEQ ID NO: 29390 - protein, 20 aa, Homo sapiens
  heavy chain complementarity determining region 3 for antibody 14695
AGTYGSGTYSPDYYYFGMDV

SEQ ID NO: 29391 - protein, 9 aa, Homo sapiens
  light chain complementarity determining region 3 for antibody 14696
QQYNSYWHT

SEQ ID NO: 29392 - protein, 20 aa, Homo sapiens
  heavy chain complementarity determining region 3 for antibody 14696
AGTYGSGTYSPDYYYFGMDV

SEQ ID NO: 29393 - protein, 9 aa, Homo sapiens
  light chain complementarity determining region 3 for antibody 14697
QQYNSYTYT

SEQ ID NO: 29394 - protein, 17 aa, Homo sapiens
  heavy chain complementarity determining region 3 for antibody 14697
AREDYSDVDLRLFYHDF

SEQ ID NO: 29395 - protein, 9 aa, Homo sapiens
  light chain complementarity determining region 3 for antibody 14698
QQYNSYSYT

SEQ ID NO: 29396 - protein, 19 aa, Homo sapiens
  heavy chain complementarity determining region 3 for antibody 14698
ARDTRFGEYTQAPLNYLQH

SEQ ID NO: 29397 - protein, 10 aa, Homo sapiens
  light chain complementarity determining region 3 for antibody 14699
QQYNSYSQRA

SEQ ID NO: 29398 - protein, 14 aa, Homo sapiens
  heavy chain complementarity determining region 3 for antibody 14699
AKDDTGDYPSYFDH

SEQ ID NO: 29399 - protein, 10 aa, Homo sapiens
  light chain complementarity determining region 3 for antibody 14700
QQYNSYSPWA

SEQ ID NO: 29400 - protein, 16 aa, Homo sapiens
  heavy chain complementarity determining region 3 for antibody 14700
AKDGQSYGDCPGYLDL

SEQ ID NO: 29401 - protein, 10 aa, Homo sapiens
  light chain complementarity determining region 3 for antibody 14701
QQYNSYSPRA

SEQ ID NO: 29402 - protein, 16 aa, Homo sapiens
  heavy chain complementarity determining region 3 for antibody 14701
AKDGQSYGDYPGYLDL

SEQ ID NO: 29403 - protein, 10 aa, Homo sapiens
  light chain complementarity determining region 3 for antibody 14702
QQYNSYSPGA

SEQ ID NO: 29404 - protein, 14 aa, Homo sapiens
  heavy chain complementarity determining region 3 for antibody 14702
AKDDTGDYPSYFDH

SEQ ID NO: 29405 - protein, 10 aa, Homo sapiens
  light chain complementarity determining region 3 for antibody 14703
QQYNSYSLLT

SEQ ID NO: 29406 - protein, 13 aa, Homo sapiens
  heavy chain complementarity determining region 3 for antibody 14703
ARSDYEILTAFNY

SEQ ID NO: 29407 - protein, 9 aa, Homo sapiens
  light chain complementarity determining region 3 for antibody 14704
QQYNSYSHT

SEQ ID NO: 29408 - protein, 21 aa, Homo sapiens
  heavy chain complementarity determining region 3 for antibody 14704
ARELSYTVAGINYYYYYAMDV

SEQ ID NO: 29409 - protein, 8 aa, Homo sapiens
  light chain complementarity determining region 3 for antibody 14705
QQYNSYSA

SEQ ID NO: 29410 - protein, 15 aa, Homo sapiens
  heavy chain complementarity determining region 3 for antibody 14705
ARAYSSGWYPESFDS

SEQ ID NO: 29411 - protein, 8 aa, Homo sapiens
  light chain complementarity determining region 3 for antibody 14706
QQYNSYSA

SEQ ID NO: 29412 - protein, 15 aa, Homo sapiens
  heavy chain complementarity determining region 3 for antibody 14706
ARAYSSGWYPERFDF

SEQ ID NO: 29413 - protein, 9 aa, Homo sapiens
  light chain complementarity determining region 3 for antibody 14707
QQYNSYPYT

SEQ ID NO: 29414 - protein, 11 aa, Homo sapiens
  heavy chain complementarity determining region 3 for antibody 14707
AREMSGGTHDY

SEQ ID NO: 29415 - protein, 9 aa, Homo sapiens
  light chain complementarity determining region 3 for antibody 14708
QQYNSYPYT

SEQ ID NO: 29416 - protein, 18 aa, Homo sapiens
  heavy chain complementarity determining region 3 for antibody 14708
ARDQSSSYGDYYYYGMDV

SEQ ID NO: 29417 - protein, 9 aa, Homo sapiens
  light chain complementarity determining region 3 for antibody 14709
QQYNSYPYT

SEQ ID NO: 29418 - protein, 19 aa, Homo sapiens
  heavy chain complementarity determining region 3 for antibody 14709
ARDQGSSYGDYYYYYGMDV

SEQ ID NO: 29419 - protein, 9 aa, Homo sapiens
  light chain complementarity determining region 3 for antibody 14710
QQYNSYPYT

SEQ ID NO: 29420 - protein, 17 aa, Homo sapiens
  heavy chain complementarity determining region 3 for antibody 14710
AKVRSPMVRGVISHLDY

SEQ ID NO: 29421 - protein, 9 aa, Homo sapiens
  light chain complementarity determining region 3 for antibody 14711
QQYNSYPYT

SEQ ID NO: 29422 - protein, 12 aa, Homo sapiens
  heavy chain complementarity determining region 3 for antibody 14711
AKGILGRGGMDV

SEQ ID NO: 29423 - protein, 9 aa, Homo sapiens
  light chain complementarity determining region 3 for antibody 14712
QQYNSYPYT

SEQ ID NO: 29424 - protein, 20 aa, Homo sapiens
  heavy chain complementarity determining region 3 for antibody 14712
AGTYGSGTYSPDYYYFGMDV

SEQ ID NO: 29425 - protein, 9 aa, Homo sapiens
  light chain complementarity determining region 3 for antibody 14713
QQYNSYPWT

SEQ ID NO: 29426 - protein, 20 aa, Homo sapiens
  heavy chain complementarity determining region 3 for antibody 14713
VTDYRGRTFPRFSHEHGLRV

SEQ ID NO: 29427 - protein, 9 aa, Homo sapiens
  light chain complementarity determining region 3 for antibody 14714
QQYNSYPWT

SEQ ID NO: 29428 - protein, 20 aa, Homo sapiens
  heavy chain complementarity determining region 3 for antibody 14714
VTDYRGRTCPRFSHEHGLGV

SEQ ID NO: 29429 - protein, 9 aa, Homo sapiens
  light chain complementarity determining region 3 for antibody 14715
QQYNSYPWT

SEQ ID NO: 29430 - protein, 17 aa, Homo sapiens
  heavy chain complementarity determining region 3 for antibody 14715
ARRPGLYYFDAHNYYDY

SEQ ID NO: 29431 - protein, 9 aa, Homo sapiens
  light chain complementarity determining region 3 for antibody 14716
QQYNSYPWT

SEQ ID NO: 29432 - protein, 11 aa, Homo sapiens
  heavy chain complementarity determining region 3 for antibody 14716
ARIVARKPDDY

SEQ ID NO: 29433 - protein, 9 aa, Homo sapiens
  light chain complementarity determining region 3 for antibody 14717
QQYNSYPWT

SEQ ID NO: 29434 - protein, 17 aa, Homo sapiens
  heavy chain complementarity determining region 3 for antibody 14717
ARGVRRQEIVPEYYFDY

SEQ ID NO: 29435 - protein, 9 aa, Homo sapiens
  light chain complementarity determining region 3 for antibody 14718
QQYNSYPTT

SEQ ID NO: 29436 - protein, 13 aa, Homo sapiens
  heavy chain complementarity determining region 3 for antibody 14718
ASGLHSGYDYFDY

SEQ ID NO: 29437 - protein, 9 aa, Homo sapiens
  light chain complementarity determining region 3 for antibody 14719
QQYNSYPST

SEQ ID NO: 29438 - protein, 17 aa, Homo sapiens
  heavy chain complementarity determining region 3 for antibody 14719
AKVRSPMVRGVISHFDY

SEQ ID NO: 29439 - protein, 9 aa, Homo sapiens
  light chain complementarity determining region 3 for antibody 14720
QQYNSYPRT

SEQ ID NO: 29440 - protein, 19 aa, Homo sapiens
  heavy chain complementarity determining region 3 for antibody 14720
ERDSPSVRKRPTEYYGMDV

SEQ ID NO: 29441 - protein, 9 aa, Homo sapiens
  light chain complementarity determining region 3 for antibody 14721
QQYNSYPRT

SEQ ID NO: 29442 - protein, 17 aa, Homo sapiens
  heavy chain complementarity determining region 3 for antibody 14721
ARRSGLYYFDAHNYYDY

SEQ ID NO: 29443 - protein, 9 aa, Homo sapiens
  light chain complementarity determining region 3 for antibody 14722
QQYNSYPRT

SEQ ID NO: 29444 - protein, 24 aa, Homo sapiens
  heavy chain complementarity determining region 3 for antibody 14722
ARGSTDGTVTTFGVPVLEYYYFDN

SEQ ID NO: 29445 - protein, 9 aa, Homo sapiens
  light chain complementarity determining region 3 for antibody 14723
QQYNSYPRT

SEQ ID NO: 29446 - protein, 24 aa, Homo sapiens
  heavy chain complementarity determining region 3 for antibody 14723
ARGSTDGTVTTFGVPVLERYYFDY

SEQ ID NO: 29447 - protein, 9 aa, Homo sapiens
  light chain complementarity determining region 3 for antibody 14724
QQYNSYPRT

SEQ ID NO: 29448 - protein, 19 aa, Homo sapiens
  heavy chain complementarity determining region 3 for antibody 14724
ARDSPYVRKRPTEYYGMDV

SEQ ID NO: 29449 - protein, 9 aa, Homo sapiens
  light chain complementarity determining region 3 for antibody 14725
QQYNSYPRT

SEQ ID NO: 29450 - protein, 19 aa, Homo sapiens
  heavy chain complementarity determining region 3 for antibody 14725
ARDSPSVRRRPTEYYGMDV

SEQ ID NO: 29451 - protein, 9 aa, Homo sapiens
  light chain complementarity determining region 3 for antibody 14726
QQYNSYPRT

SEQ ID NO: 29452 - protein, 19 aa, Homo sapiens
  heavy chain complementarity determining region 3 for antibody 14726
ARDSPSVRKRPTEYHGMDV

SEQ ID NO: 29453 - protein, 9 aa, Homo sapiens
  light chain complementarity determining region 3 for antibody 14727
QQYNSYPRT

SEQ ID NO: 29454 - protein, 19 aa, Homo sapiens
  heavy chain complementarity determining region 3 for antibody 14727
ARDSPSVRKRPTEYDGMDV

SEQ ID NO: 29455 - protein, 9 aa, Homo sapiens
  light chain complementarity determining region 3 for antibody 14728
QQYNSYPRT

SEQ ID NO: 29456 - protein, 19 aa, Homo sapiens
  heavy chain complementarity determining region 3 for antibody 14728
ARDSPSVRKRPTEHYGMDV

SEQ ID NO: 29457 - protein, 9 aa, Homo sapiens
  light chain complementarity determining region 3 for antibody 14729
QQYNSYPRT

SEQ ID NO: 29458 - protein, 19 aa, Homo sapiens
  heavy chain complementarity determining region 3 for antibody 14729
ARDSPSVRKRPTECYGMDV

SEQ ID NO: 29459 - protein, 9 aa, Homo sapiens
  light chain complementarity determining region 3 for antibody 14730
QQYNSYPRT

SEQ ID NO: 29460 - protein, 19 aa, Homo sapiens
  heavy chain complementarity determining region 3 for antibody 14730
ARDSLSVRKRPTEYYGMDV

SEQ ID NO: 29461 - protein, 9 aa, Homo sapiens
  light chain complementarity determining region 3 for antibody 14731
QQYNSYPRT

SEQ ID NO: 29462 - protein, 19 aa, Homo sapiens
  heavy chain complementarity determining region 3 for antibody 14731
ARDSASVRKRPTEYYGMDV

SEQ ID NO: 29463 - protein, 9 aa, Homo sapiens
  light chain complementarity determining region 3 for antibody 14732
QQYNSYPRT

SEQ ID NO: 29464 - protein, 19 aa, Homo sapiens
  heavy chain complementarity determining region 3 for antibody 14732
ARDPPSVRKRPTEYYGMDV

SEQ ID NO: 29465 - protein, 9 aa, Homo sapiens
  light chain complementarity determining region 3 for antibody 14733
QQYNSYPRT

SEQ ID NO: 29466 - protein, 15 aa, Homo sapiens
  heavy chain complementarity determining region 3 for antibody 14733
ARAYSSGWYPESFDF

SEQ ID NO: 29467 - protein, 9 aa, Homo sapiens
  light chain complementarity determining region 3 for antibody 14734
QQYNSYPRT

SEQ ID NO: 29468 - protein, 17 aa, Homo sapiens
  heavy chain complementarity determining region 3 for antibody 14734
AKERGMSVHYYYYGMDV

SEQ ID NO: 29469 - protein, 9 aa, Homo sapiens
  light chain complementarity determining region 3 for antibody 14735
QQYNSYPRK

SEQ ID NO: 29470 - protein, 19 aa, Homo sapiens
  heavy chain complementarity determining region 3 for antibody 14735
ARDSPSVRKRPTEYYGMDV

SEQ ID NO: 29471 - protein, 9 aa, Homo sapiens
  light chain complementarity determining region 3 for antibody 14736
QQYNSYPRA

SEQ ID NO: 29472 - protein, 19 aa, Homo sapiens
  heavy chain complementarity determining region 3 for antibody 14736
ARDSPSVRKRPTEYYGMDV

SEQ ID NO: 29473 - protein, 9 aa, Homo sapiens
  light chain complementarity determining region 3 for antibody 14737
QQYNSYPPP

SEQ ID NO: 29474 - protein, 14 aa, Homo sapiens
  heavy chain complementarity determining region 3 for antibody 14737
ARVFVIAAAGTYDY

SEQ ID NO: 29475 - protein, 9 aa, Homo sapiens
  light chain complementarity determining region 3 for antibody 14738
QQYNSYPLT

SEQ ID NO: 29476 - protein, 15 aa, Homo sapiens
  heavy chain complementarity determining region 3 for antibody 14738
ARGGIYYDILAGLDS

SEQ ID NO: 29477 - protein, 9 aa, Homo sapiens
  light chain complementarity determining region 3 for antibody 14739
QQYNSYPLT

SEQ ID NO: 29478 - protein, 15 aa, Homo sapiens
  heavy chain complementarity determining region 3 for antibody 14739
ARGGIHYDILTGLDY

SEQ ID NO: 29479 - protein, 9 aa, Homo sapiens
  light chain complementarity determining region 3 for antibody 14740
QQYNSYPLT

SEQ ID NO: 29480 - protein, 19 aa, Homo sapiens
  heavy chain complementarity determining region 3 for antibody 14740
ARDHSHTTMDPGGEGSFDY

SEQ ID NO: 29481 - protein, 9 aa, Homo sapiens
  light chain complementarity determining region 3 for antibody 14741
QQYNSYPIT

SEQ ID NO: 29482 - protein, 13 aa, Homo sapiens
  heavy chain complementarity determining region 3 for antibody 14741
ASGRHSGYDYFDY

SEQ ID NO: 29483 - protein, 9 aa, Homo sapiens
  light chain complementarity determining region 3 for antibody 14742
QQYNSYPIT

SEQ ID NO: 29484 - protein, 13 aa, Homo sapiens
  heavy chain complementarity determining region 3 for antibody 14742
ASGPHSGYDYFDY

SEQ ID NO: 29485 - protein, 9 aa, Homo sapiens
  light chain complementarity determining region 3 for antibody 14743
QQYNSYPIT

SEQ ID NO: 29486 - protein, 13 aa, Homo sapiens
  heavy chain complementarity determining region 3 for antibody 14743
ASGLNSGYDYFDY

SEQ ID NO: 29487 - protein, 9 aa, Homo sapiens
  light chain complementarity determining region 3 for antibody 14744
QQYNSYPIT

SEQ ID NO: 29488 - protein, 13 aa, Homo sapiens
  heavy chain complementarity determining region 3 for antibody 14744
ASGLHSGYDYFDD

SEQ ID NO: 29489 - protein, 9 aa, Homo sapiens
  light chain complementarity determining region 3 for antibody 14745
QQYNSYPIT

SEQ ID NO: 29490 - protein, 13 aa, Homo sapiens
  heavy chain complementarity determining region 3 for antibody 14745
ASGLHSGCDYFDY

SEQ ID NO: 29491 - protein, 9 aa, Homo sapiens
  light chain complementarity determining region 3 for antibody 14746
QQYNSYPIT

SEQ ID NO: 29492 - protein, 13 aa, Homo sapiens
  heavy chain complementarity determining region 3 for antibody 14746
ASDLHSGYDYFDY

SEQ ID NO: 29493 - protein, 9 aa, Homo sapiens
  light chain complementarity determining region 3 for antibody 14747
QQYNSYPIT

SEQ ID NO: 29494 - protein, 13 aa, Homo sapiens
  heavy chain complementarity determining region 3 for antibody 14747
ARGLHSGYDYFDY

SEQ ID NO: 29495 - protein, 9 aa, Homo sapiens
  light chain complementarity determining region 3 for antibody 14748
QQYNSYPHT

SEQ ID NO: 29496 - protein, 17 aa, Homo sapiens
  heavy chain complementarity determining region 3 for antibody 14748
AREDWSDVDLRLFYLDC

SEQ ID NO: 29497 - protein, 9 aa, Homo sapiens
  light chain complementarity determining region 3 for antibody 14749
QQYNSYPGT

SEQ ID NO: 29498 - protein, 17 aa, Homo sapiens
  heavy chain complementarity determining region 3 for antibody 14749
ARQSDIVVEIVSDGLDV

SEQ ID NO: 29499 - protein, 9 aa, Homo sapiens
  light chain complementarity determining region 3 for antibody 14750
QQYNSYPGT

SEQ ID NO: 29500 - protein, 17 aa, Homo sapiens
  heavy chain complementarity determining region 3 for antibody 14750
ARQIDIVVEIVSDCLDV

SEQ ID NO: 29501 - protein, 9 aa, Homo sapiens
  light chain complementarity determining region 3 for antibody 14751
QQYNSYPGP

SEQ ID NO: 29502 - protein, 17 aa, Homo sapiens
  heavy chain complementarity determining region 3 for antibody 14751
ARQIDIVVEIVSDGLDV

SEQ ID NO: 29503 - protein, 9 aa, Homo sapiens
  light chain complementarity determining region 3 for antibody 14752
QQYNSYPFT

SEQ ID NO: 29504 - protein, 13 aa, Homo sapiens
  heavy chain complementarity determining region 3 for antibody 14752
ASGLHSGYDYFDY

SEQ ID NO: 29505 - protein, 9 aa, Homo sapiens
  light chain complementarity determining region 3 for antibody 14753
QQYNSYLYT

SEQ ID NO: 29506 - protein, 20 aa, Homo sapiens
  heavy chain complementarity determining region 3 for antibody 14753
AGTYGSGTYSPDYYYFGMDV

SEQ ID NO: 29507 - protein, 9 aa, Homo sapiens
  light chain complementarity determining region 3 for antibody 14754
QQYNSYLWK

SEQ ID NO: 29508 - protein, 12 aa, Homo sapiens
  heavy chain complementarity determining region 3 for antibody 14754
AKELESTKVFDY

SEQ ID NO: 29509 - protein, 8 aa, Homo sapiens
  light chain complementarity determining region 3 for antibody 14755
QQYNSVWT

SEQ ID NO: 29510 - protein, 17 aa, Homo sapiens
  heavy chain complementarity determining region 3 for antibody 14755
ARGFVVDFWSGYSPFDH

SEQ ID NO: 29511 - protein, 9 aa, Homo sapiens
  light chain complementarity determining region 3 for antibody 14756
QQYNSSPYT

SEQ ID NO: 29512 - protein, 17 aa, Homo sapiens
  heavy chain complementarity determining region 3 for antibody 14756
AREDWSDVDLRLFYLDC

SEQ ID NO: 29513 - protein, 9 aa, Homo sapiens
  light chain complementarity determining region 3 for antibody 14757
QQYNSRPLT

SEQ ID NO: 29514 - protein, 12 aa, Homo sapiens
  heavy chain complementarity determining region 3 for antibody 14757
ARRFSTSEFVEY

SEQ ID NO: 29515 - protein, 6 aa, Homo sapiens
  light chain complementarity determining region 3 for antibody 14758
QQYNSR

SEQ ID NO: 29516 - protein, 16 aa, Homo sapiens
  heavy chain complementarity determining region 3 for antibody 14758
AREHSRTYWDHDAFDM

SEQ ID NO: 29517 - protein, 9 aa, Homo sapiens
  light chain complementarity determining region 3 for antibody 14759
QQYNSPLNT

SEQ ID NO: 29518 - protein, 20 aa, Homo sapiens
  heavy chain complementarity determining region 3 for antibody 14759
ARDPTYDISTAYHPHRAIDY

SEQ ID NO: 29519 - protein, 9 aa, Homo sapiens
  light chain complementarity determining region 3 for antibody 14760
QQYNSLPYT

SEQ ID NO: 29520 - protein, 17 aa, Homo sapiens
  heavy chain complementarity determining region 3 for antibody 14760
AREDWNDVDLQLYYLDY

SEQ ID NO: 29521 - protein, 9 aa, Homo sapiens
  light chain complementarity determining region 3 for antibody 14761
QQYNSLPTT

SEQ ID NO: 29522 - protein, 19 aa, Homo sapiens
  heavy chain complementarity determining region 3 for antibody 14761
ARDRDYTIVDDYGSGVFDY

SEQ ID NO: 29523 - protein, 9 aa, Homo sapiens
  light chain complementarity determining region 3 for antibody 14762
QQYNSLPIT

SEQ ID NO: 29524 - protein, 19 aa, Homo sapiens
  heavy chain complementarity determining region 3 for antibody 14762
ARGRDYTIVDDYGSGVFDY

SEQ ID NO: 29525 - protein, 9 aa, Homo sapiens
  light chain complementarity determining region 3 for antibody 14763
QQYNSLPIT

SEQ ID NO: 29526 - protein, 19 aa, Homo sapiens
  heavy chain complementarity determining region 3 for antibody 14763
ARDRDYTTVDDYGSGVFDY

SEQ ID NO: 29527 - protein, 9 aa, Homo sapiens
  light chain complementarity determining region 3 for antibody 14764
QQYNSLPIT

SEQ ID NO: 29528 - protein, 19 aa, Homo sapiens
  heavy chain complementarity determining region 3 for antibody 14764
ARDRDYTRVDDYGSGVFDY

SEQ ID NO: 29529 - protein, 9 aa, Homo sapiens
  light chain complementarity determining region 3 for antibody 14765
QQYNSLPIT

SEQ ID NO: 29530 - protein, 19 aa, Homo sapiens
  heavy chain complementarity determining region 3 for antibody 14765
ARDRDYTIVDDYGSGVFGY

SEQ ID NO: 29531 - protein, 9 aa, Homo sapiens
  light chain complementarity determining region 3 for antibody 14766
QQYNSLPIT

SEQ ID NO: 29532 - protein, 17 aa, Homo sapiens
  heavy chain complementarity determining region 3 for antibody 14766
ARDGYYASSGYFPYFDY

SEQ ID NO: 29533 - protein, 9 aa, Homo sapiens
  light chain complementarity determining region 3 for antibody 14767
QQYNSLPIP

SEQ ID NO: 29534 - protein, 19 aa, Homo sapiens
  heavy chain complementarity determining region 3 for antibody 14767
ARDRDYTIVDDYGSGVFDY

SEQ ID NO: 29535 - protein, 9 aa, Homo sapiens
  light chain complementarity determining region 3 for antibody 14768
QQYNSFPYT

SEQ ID NO: 29536 - protein, 17 aa, Homo sapiens
  heavy chain complementarity determining region 3 for antibody 14768
AREDYNDVDLRLIYFDC

SEQ ID NO: 29537 - protein, 9 aa, Homo sapiens
  light chain complementarity determining region 3 for antibody 14769
QQYNSFPYT

SEQ ID NO: 29538 - protein, 17 aa, Homo sapiens
  heavy chain complementarity determining region 3 for antibody 14769
AREDFSDVVLRLFYLDY

SEQ ID NO: 29539 - protein, 9 aa, Homo sapiens
  light chain complementarity determining region 3 for antibody 14770
QQYNSFPYT

SEQ ID NO: 29540 - protein, 17 aa, Homo sapiens
  heavy chain complementarity determining region 3 for antibody 14770
AREDDNDVDLRLFYFDC

SEQ ID NO: 29541 - protein, 9 aa, Homo sapiens
  light chain complementarity determining region 3 for antibody 14771
QQYNSFPWT

SEQ ID NO: 29542 - protein, 13 aa, Homo sapiens
  heavy chain complementarity determining region 3 for antibody 14771
TTDRGGGRYGMDV

SEQ ID NO: 29543 - protein, 9 aa, Homo sapiens
  light chain complementarity determining region 3 for antibody 14772
QQYNSFPWT

SEQ ID NO: 29544 - protein, 17 aa, Homo sapiens
  heavy chain complementarity determining region 3 for antibody 14772
ARRSGLYYFGAHNYYDF

SEQ ID NO: 29545 - protein, 9 aa, Homo sapiens
  light chain complementarity determining region 3 for antibody 14773
QQYNSFPWT

SEQ ID NO: 29546 - protein, 17 aa, Homo sapiens
  heavy chain complementarity determining region 3 for antibody 14773
ARRSGLYYFDAHSYYDF

SEQ ID NO: 29547 - protein, 9 aa, Homo sapiens
  light chain complementarity determining region 3 for antibody 14774
QQYNSFPWT

SEQ ID NO: 29548 - protein, 17 aa, Homo sapiens
  heavy chain complementarity determining region 3 for antibody 14774
ARRSGLYYFDAHNDYDF

SEQ ID NO: 29549 - protein, 9 aa, Homo sapiens
  light chain complementarity determining region 3 for antibody 14775
QQYNSFPWT

SEQ ID NO: 29550 - protein, 17 aa, Homo sapiens
  heavy chain complementarity determining region 3 for antibody 14775
ARAGGFAGTFPYYGMDV

SEQ ID NO: 29551 - protein, 9 aa, Homo sapiens
  light chain complementarity determining region 3 for antibody 14776
QQYNSFPWP

SEQ ID NO: 29552 - protein, 17 aa, Homo sapiens
  heavy chain complementarity determining region 3 for antibody 14776
ARRSGLYYFDAHNYYDF

SEQ ID NO: 29553 - protein, 9 aa, Homo sapiens
  light chain complementarity determining region 3 for antibody 14777
QQYNSFPVT

SEQ ID NO: 29554 - protein, 12 aa, Homo sapiens
  heavy chain complementarity determining region 3 for antibody 14777
AKGILGRGGMDV

SEQ ID NO: 29555 - protein, 9 aa, Homo sapiens
  light chain complementarity determining region 3 for antibody 14778
QQYNSFPRT

SEQ ID NO: 29556 - protein, 17 aa, Homo sapiens
  heavy chain complementarity determining region 3 for antibody 14778
ARRSGLYYFDAHNYYDF

SEQ ID NO: 29557 - protein, 9 aa, Homo sapiens
  light chain complementarity determining region 3 for antibody 14779
QQYNSFPPT

SEQ ID NO: 29558 - protein, 17 aa, Homo sapiens
  heavy chain complementarity determining region 3 for antibody 14779
ARHRTTGSLYCYSGMDV

SEQ ID NO: 29559 - protein, 9 aa, Homo sapiens
  light chain complementarity determining region 3 for antibody 14780
QQYNSFPPT

SEQ ID NO: 29560 - protein, 19 aa, Homo sapiens
  heavy chain complementarity determining region 3 for antibody 14780
AKGPHPVVVGELLEPVFDH

SEQ ID NO: 29561 - protein, 9 aa, Homo sapiens
  light chain complementarity determining region 3 for antibody 14781
QQYNSFPPT

SEQ ID NO: 29562 - protein, 19 aa, Homo sapiens
  heavy chain complementarity determining region 3 for antibody 14781
AKDPHPVVVGELLEPVFDP

SEQ ID NO: 29563 - protein, 9 aa, Homo sapiens
  light chain complementarity determining region 3 for antibody 14782
QQYNSFPPT

SEQ ID NO: 29564 - protein, 19 aa, Homo sapiens
  heavy chain complementarity determining region 3 for antibody 14782
AKDPHPVVVGDLLEPVFDH

SEQ ID NO: 29565 - protein, 9 aa, Homo sapiens
  light chain complementarity determining region 3 for antibody 14783
QQYNSFPPT

SEQ ID NO: 29566 - protein, 19 aa, Homo sapiens
  heavy chain complementarity determining region 3 for antibody 14783
AKDPHPVVIGDLSEPVFDH

SEQ ID NO: 29567 - protein, 9 aa, Homo sapiens
  light chain complementarity determining region 3 for antibody 14784
QQYNSFPPT

SEQ ID NO: 29568 - protein, 19 aa, Homo sapiens
  heavy chain complementarity determining region 3 for antibody 14784
AKDPHPVVAGELLEPVFDH

SEQ ID NO: 29569 - protein, 9 aa, Homo sapiens
  light chain complementarity determining region 3 for antibody 14785
QQYNSFPPT

SEQ ID NO: 29570 - protein, 19 aa, Homo sapiens
  heavy chain complementarity determining region 3 for antibody 14785
AKAPHPVVVGELLEPVFDH

SEQ ID NO: 29571 - protein, 9 aa, Homo sapiens
  light chain complementarity determining region 3 for antibody 14786
QQYNSCPRT

SEQ ID NO: 29572 - protein, 19 aa, Homo sapiens
  heavy chain complementarity determining region 3 for antibody 14786
ARDSPSVRKRPTEYYGMDV

SEQ ID NO: 29573 - protein, 9 aa, Homo sapiens
  light chain complementarity determining region 3 for antibody 14787
QQYNSCPGT

SEQ ID NO: 29574 - protein, 17 aa, Homo sapiens
  heavy chain complementarity determining region 3 for antibody 14787
ARQIDIVVEIVSDGLDV

SEQ ID NO: 29575 - protein, 11 aa, Homo sapiens
  light chain complementarity determining region 3 for antibody 14788
QQYNSAPPIFT

SEQ ID NO: 29576 - protein, 11 aa, Homo sapiens
  heavy chain complementarity determining region 3 for antibody 14788
ARDHEGYGYYY

SEQ ID NO: 29577 - protein, 9 aa, Homo sapiens
  light chain complementarity determining region 3 for antibody 14789
QQYNSAPLT

SEQ ID NO: 29578 - protein, 22 aa, Homo sapiens
  heavy chain complementarity determining region 3 for antibody 14789
ARDRWFRIEEDGFRTIRHPFDY

SEQ ID NO: 29579 - protein, 9 aa, Homo sapiens
  light chain complementarity determining region 3 for antibody 14790
QQYNSAPIT

SEQ ID NO: 29580 - protein, 22 aa, Homo sapiens
  heavy chain complementarity determining region 3 for antibody 14790
ARGLGTINYNDILTGYFQYFDL

SEQ ID NO: 29581 - protein, 8 aa, Homo sapiens
  light chain complementarity determining region 3 for antibody 14791
QQYNRVWT

SEQ ID NO: 29582 - protein, 17 aa, Homo sapiens
  heavy chain complementarity determining region 3 for antibody 14791
ARGFIVDFWSGYSPFDH

SEQ ID NO: 29583 - protein, 9 aa, Homo sapiens
  light chain complementarity determining region 3 for antibody 14792
QQYNNYPYP

SEQ ID NO: 29584 - protein, 17 aa, Homo sapiens
  heavy chain complementarity determining region 3 for antibody 14792
AKGQDSYYYDISGYCDH

SEQ ID NO: 29585 - protein, 9 aa, Homo sapiens
  light chain complementarity determining region 3 for antibody 14793
QQYNNYPIT

SEQ ID NO: 29586 - protein, 22 aa, Homo sapiens
  heavy chain complementarity determining region 3 for antibody 14793
ARENAHSDYDLGDFSPYDVFDI

SEQ ID NO: 29587 - protein, 9 aa, Homo sapiens
  light chain complementarity determining region 3 for antibody 14794
QQYNNWPYT

SEQ ID NO: 29588 - protein, 16 aa, Homo sapiens
  heavy chain complementarity determining region 3 for antibody 14794
AKDGGAYQNYGLYFHH

SEQ ID NO: 29589 - protein, 8 aa, Homo sapiens
  light chain complementarity determining region 3 for antibody 14795
QQYNNWPR

SEQ ID NO: 29590 - protein, 12 aa, Homo sapiens
  heavy chain complementarity determining region 3 for antibody 14795
VQGNGAGSYSRH

SEQ ID NO: 29591 - protein, 9 aa, Homo sapiens
  light chain complementarity determining region 3 for antibody 14796
QQYNNWPRS

SEQ ID NO: 29592 - protein, 15 aa, Homo sapiens
  heavy chain complementarity determining region 3 for antibody 14796
VKSGTYSSSSGWFDP

SEQ ID NO: 29593 - protein, 9 aa, Homo sapiens
  light chain complementarity determining region 3 for antibody 14797
QQYNNWPRS

SEQ ID NO: 29594 - protein, 22 aa, Homo sapiens
  heavy chain complementarity determining region 3 for antibody 14797
ARHSGYSNTWYMNYYYYYGMDV

SEQ ID NO: 29595 - protein, 9 aa, Homo sapiens
  light chain complementarity determining region 3 for antibody 14798
QQYNNWPRR

SEQ ID NO: 29596 - protein, 15 aa, Homo sapiens
  heavy chain complementarity determining region 3 for antibody 14798
VKSGTYSSSSGWFDP

SEQ ID NO: 29597 - protein, 9 aa, Homo sapiens
  light chain complementarity determining region 3 for antibody 14799
QQYNNWPRC

SEQ ID NO: 29598 - protein, 15 aa, Homo sapiens
  heavy chain complementarity determining region 3 for antibody 14799
VKSGTYSSSSGWFDT

SEQ ID NO: 29599 - protein, 9 aa, Homo sapiens
  light chain complementarity determining region 3 for antibody 14800
QQYNNWPRA

SEQ ID NO: 29600 - protein, 17 aa, Homo sapiens
  heavy chain complementarity determining region 3 for antibody 14800
AKEAVVVVHANSRYFQH

SEQ ID NO: 29601 - protein, 10 aa, Homo sapiens [sequence omitted]

SEQ ID NO: 29602 - protein, 20 aa, Homo sapiens
  heavy chain complementarity determining region 3 for antibody 14801
ARDGGYYDSSGYYYGASPEY

SEQ ID NO: 29603 - protein, 10 aa, Homo sapiens [sequence omitted]

SEQ ID NO: 29604 - protein, 14 aa, Homo sapiens
  heavy chain complementarity determining region 3 for antibody 14802
AKGERYLMHQFFDF

SEQ ID NO: 29605 - protein, 11 aa, Homo sapiens
  light chain complementarity determining region 3 for antibody 14803
QQYNNWPPWGT

SEQ ID NO: 29606 - protein, 10 aa, Homo sapiens
  heavy chain complementarity determining region 3 for antibody 14803
AKDLTEDPTG

SEQ ID NO: 29607 - protein, 9 aa, Homo sapiens
  light chain complementarity determining region 3 for antibody 14804
QQYNNWPPT

SEQ ID NO: 29608 - protein, 13 aa, Homo sapiens
  heavy chain complementarity determining region 3 for antibody 14804
AKSHERAYRIGDS

SEQ ID NO: 29609 - protein, 10 aa, Homo sapiens
  light chain complementarity determining region 3 for antibody 14805
QQYNNWPPLT

SEQ ID NO: 29610 - protein, 15 aa, Homo sapiens
  heavy chain complementarity determining region 3 for antibody 14805
AKLYKFPAVGNWLDY

SEQ ID NO: 29611 - protein, 10 aa, Homo sapiens
  light chain complementarity determining region 3 for antibody 14806
QQYNNWPPIP

SEQ ID NO: 29612 - protein, 9 aa, Homo sapiens
  heavy chain complementarity determining region 3 for antibody 14806
ARDPDWLEY

SEQ ID NO: 29613 - protein, 10 aa, Homo sapiens
  light chain complementarity determining region 3 for antibody 14807
QQYNNWPPHP

SEQ ID NO: 29614 - protein, 21 aa, Homo sapiens
  heavy chain complementarity determining region 3 for antibody 14807
ARSMFTGYHYDSSGYSNWFDP

SEQ ID NO: 29615 - protein, 11 aa, Homo sapiens
  light chain complementarity determining region 3 for antibody 14808
QQYNNWPPEDT

SEQ ID NO: 29616 - protein, 22 aa, Homo sapiens
  heavy chain complementarity determining region 3 for antibody 14808
ARGRPFPDTHINRNYYYHGMDV

SEQ ID NO: 29617 - protein, 9 aa, Homo sapiens
  light chain complementarity determining region 3 for antibody 14809
QQYNNWPLT

SEQ ID NO: 29618 - protein, 13 aa, Homo sapiens
  heavy chain complementarity determining region 3 for antibody 14809
ARSHERAYRIGDQ

SEQ ID NO: 29619 - protein, 8 aa, Homo sapiens
  light chain complementarity determining region 3 for antibody 14810
QQYNNWPG

SEQ ID NO: 29620 - protein, 12 aa, Homo sapiens
  heavy chain complementarity determining region 3 for antibody 14810
VQGNGAGSYSRH

SEQ ID NO: 29621 - protein, 10 aa, Homo sapiens
  light chain complementarity determining region 3 for antibody 14811
QQYNNVPPFT

SEQ ID NO: 29622 - protein, 17 aa, Homo sapiens
  heavy chain complementarity determining region 3 for antibody 14811
ASDPTYGDSYYYSGMDL

SEQ ID NO: 29623 - protein, 9 aa, Homo sapiens
  light chain complementarity determining region 3 for antibody 14812
QQYNNLPYT

SEQ ID NO: 29624 - protein, 12 aa, Homo sapiens
  heavy chain complementarity determining region 3 for antibody 14812
AVELGYGDIPIA

SEQ ID NO: 29625 - protein, 9 aa, Homo sapiens
  light chain complementarity determining region 3 for antibody 14813
QQYNNLPYT

SEQ ID NO: 29626 - protein, 13 aa, Homo sapiens
  heavy chain complementarity determining region 3 for antibody 14813
ARVKWDLFGYFDF

SEQ ID NO: 29627 - protein, 9 aa, Homo sapiens
  light chain complementarity determining region 3 for antibody 14814
QQYNNLPYT

SEQ ID NO: 29628 - protein, 15 aa, Homo sapiens
  heavy chain complementarity determining region 3 for antibody 14814
ARGGAVRPRYYGVDV

SEQ ID NO: 29629 - protein, 9 aa, Homo sapiens
  light chain complementarity determining region 3 for antibody 14815
QQYNNLPYT

SEQ ID NO: 29630 - protein, 13 aa, Homo sapiens
  heavy chain complementarity determining region 3 for antibody 14815
ARARWDLFGYFDF

SEQ ID NO: 29631 - protein, 9 aa, Homo sapiens
  light chain complementarity determining region 3 for antibody 14816
QQYNNLPYT

SEQ ID NO: 29632 - protein, 13 aa, Homo sapiens
  heavy chain complementarity determining region 3 for antibody 14816
ARAKWDLLGYFDF

SEQ ID NO: 29633 - protein, 9 aa, Homo sapiens
  light chain complementarity determining region 3 for antibody 14817
QQYNNLPYT

SEQ ID NO: 29634 - protein, 13 aa, Homo sapiens
  heavy chain complementarity determining region 3 for antibody 14817
ARAKWDLFGYFGF

SEQ ID NO: 29635 - protein, 9 aa, Homo sapiens
  light chain complementarity determining region 3 for antibody 14818
QQYNNLPYT

SEQ ID NO: 29636 - protein, 13 aa, Homo sapiens
  heavy chain complementarity determining region 3 for antibody 14818
ARAKWDLFGYFDV

SEQ ID NO: 29637 - protein, 9 aa, Homo sapiens
  light chain complementarity determining region 3 for antibody 14819
QQYNNLPYT

SEQ ID NO: 29638 - protein, 13 aa, Homo sapiens
  heavy chain complementarity determining region 3 for antibody 14819
ARAKWDLFGFFDF

SEQ ID NO: 29639 - protein, 9 aa, Homo sapiens
  light chain complementarity determining region 3 for antibody 14820
QQYNNLPYT

SEQ ID NO: 29640 - protein, 13 aa, Homo sapiens
  heavy chain complementarity determining region 3 for antibody 14820
ARAKWDFFGYFDF

SEQ ID NO: 29641 - protein, 9 aa, Homo sapiens
  light chain complementarity determining region 3 for antibody 14821
QQYNNLPYT

SEQ ID NO: 29642 - protein, 13 aa, Homo sapiens
  heavy chain complementarity determining region 3 for antibody 14821
ARAKWALFGYFDF

SEQ ID NO: 29643 - protein, 9 aa, Homo sapiens
  light chain complementarity determining region 3 for antibody 14822
QQYNNLPYT

SEQ ID NO: 29644 - protein, 13 aa, Homo sapiens
  heavy chain complementarity determining region 3 for antibody 14822
AQAKWDLFGYFDF

SEQ ID NO: 29645 - protein, 9 aa, Homo sapiens
  light chain complementarity determining region 3 for antibody 14823
QQYNNLPYT

SEQ ID NO: 29646 - protein, 12 aa, Homo sapiens
  heavy chain complementarity determining region 3 for antibody 14823
AKGILGRGGMDV

SEQ ID NO: 29647 - protein, 9 aa, Homo sapiens
  light chain complementarity determining region 3 for antibody 14824
QQYNNLPYP

SEQ ID NO: 29648 - protein, 13 aa, Homo sapiens
  heavy chain complementarity determining region 3 for antibody 14824
ARAKWDLFGYFDF

SEQ ID NO: 29649 - protein, 10 aa, Homo sapiens
  light chain complementarity determining region 3 for antibody 14825
QQYNNLPPFT

SEQ ID NO: 29650 - protein, 16 aa, Homo sapiens
  heavy chain complementarity determining region 3 for antibody 14825
ARELFKGEYDYYAMDV

SEQ ID NO: 29651 - protein, 9 aa, Homo sapiens
  light chain complementarity determining region 3 for antibody 14826
QQYNNAPLT

SEQ ID NO: 29652 - protein, 17 aa, Homo sapiens
  heavy chain complementarity determining region 3 for antibody 14826
AAPRFTSSWPAEKPFDY

SEQ ID NO: 29653 - protein, 9 aa, Homo sapiens
  light chain complementarity determining region 3 for antibody 14827
QQYNLYSFT

SEQ ID NO: 29654 - protein, 23 aa, Homo sapiens
  heavy chain complementarity determining region 3 for antibody 14827
ARPRCSGTTCLLVANNYHYAMDV

SEQ ID NO: 29655 - protein, 9 aa, Homo sapiens
  light chain complementarity determining region 3 for antibody 14828
QQYNKWPKT

SEQ ID NO: 29656 - protein, 23 aa, Homo sapiens
  heavy chain complementarity determining region 3 for antibody 14828
ARSDVKPSVIRGVTAYLLGPFDY

SEQ ID NO: 29657 - protein, 9 aa, Homo sapiens
  light chain complementarity determining region 3 for antibody 14829
QQYNGRSPT

SEQ ID NO: 29658 - protein, 11 aa, Homo sapiens
  heavy chain complementarity determining region 3 for antibody 14829
ARIQQLGALAH

SEQ ID NO: 29659 - protein, 9 aa, Homo sapiens
  light chain complementarity determining region 3 for antibody 14830
QQYNGRSLT

SEQ ID NO: 29660 - protein, 11 aa, Homo sapiens
  heavy chain complementarity determining region 3 for antibody 14830
ARVQQLGALAH

SEQ ID NO: 29661 - protein, 9 aa, Homo sapiens
  light chain complementarity determining region 3 for antibody 14831
QQYNGRSLA

SEQ ID NO: 29662 - protein, 11 aa, Homo sapiens
  heavy chain complementarity determining region 3 for antibody 14831
ARIQQLGALAH

SEQ ID NO: 29663 - protein, 9 aa, Homo sapiens
  light chain complementarity determining region 3 for antibody 14832
QQYNFYPYP

SEQ ID NO: 29664 - protein, 16 aa, Homo sapiens
  heavy chain complementarity determining region 3 for antibody 14832
ARWLVRGVVKGSYFDY

SEQ ID NO: 29665 - protein, 9 aa, Homo sapiens
  light chain complementarity determining region 3 for antibody 14833
QQYNDWPPT

SEQ ID NO: 29666 - protein, 16 aa, Homo sapiens
  heavy chain complementarity determining region 3 for antibody 14833
AKVWSESAYNPILCDC

SEQ ID NO: 29667 - protein, 9 aa, Homo sapiens
  light chain complementarity determining region 3 for antibody 14834
QQYNDWPPT

SEQ ID NO: 29668 - protein, 16 aa, Homo sapiens
  heavy chain complementarity determining region 3 for antibody 14834
AKVWPESAYNPILFDC

SEQ ID NO: 29669 - protein, 10 aa, Homo sapiens
  light chain complementarity determining region 3 for antibody 14835
QQYNDWPPNT

SEQ ID NO: 29670 - protein, 14 aa, Homo sapiens
  heavy chain complementarity determining region 3 for antibody 14835
ARASEYQMLFYLDY

SEQ ID NO: 29671 - protein, 10 aa, Homo sapiens
  light chain complementarity determining region 3 for antibody 14836
QQYNDGPTQS

SEQ ID NO: 29672 - protein, 12 aa, Homo sapiens
  heavy chain complementarity determining region 3 for antibody 14836
ARPGPSGYGMDV

SEQ ID NO: 29673 - protein, 9 aa, Homo sapiens
  light chain complementarity determining region 3 for antibody 14837
QQYNAYPLT

SEQ ID NO: 29674 - protein, 16 aa, Homo sapiens
  heavy chain complementarity determining region 3 for antibody 14837
ARGKYSDFDSGHGMDV

SEQ ID NO: 29675 - protein, 9 aa, Homo sapiens
  light chain complementarity determining region 3 for antibody 14838
QQYNAYALT

SEQ ID NO: 29676 - protein, 16 aa, Homo sapiens
  heavy chain complementarity determining region 3 for antibody 14838
AGGKYSDFDSGHGMDV

SEQ ID NO: 29677 - protein, 9 aa, Homo sapiens
  light chain complementarity determining region 3 for antibody 14839
QQYNAWPPT

SEQ ID NO: 29678 - protein, 16 aa, Homo sapiens
  heavy chain complementarity determining region 3 for antibody 14839
AKVWSESAYNPILFDC

SEQ ID NO: 29679 - protein, 9 aa, Homo sapiens
  light chain complementarity determining region 3 for antibody 14840
QQYLTYPLT

SEQ ID NO: 29680 - protein, 18 aa, Homo sapiens
  heavy chain complementarity determining region 3 for antibody 14840
AGGSYCDSSSWCPYGFDI

SEQ ID NO: 29681 - protein, 9 aa, Homo sapiens
  light chain complementarity determining region 3 for antibody 14841
QQYLSRPWT

SEQ ID NO: 29682 - protein, 13 aa, Homo sapiens
  heavy chain complementarity determining region 3 for antibody 14841
ARFEIGGFYYAVY

SEQ ID NO: 29683 - protein, 8 aa, Homo sapiens
  light chain complementarity determining region 3 for antibody 14842
QQYLSHFP

SEQ ID NO: 29684 - protein, 11 aa, Homo sapiens
  heavy chain complementarity determining region 3 for antibody 14842
ARDRGGGALDH

SEQ ID NO: 29685 - protein, 9 aa, Homo sapiens
  light chain complementarity determining region 3 for antibody 14843
QQYKTYPYT

SEQ ID NO: 29686 - protein, 17 aa, Homo sapiens
  heavy chain complementarity determining region 3 for antibody 14843
AREDGNDVDLREYYFDY

SEQ ID NO: 29687 - protein, 9 aa, Homo sapiens
  light chain complementarity determining region 3 for antibody 14844
QQYKTYPYP

SEQ ID NO: 29688 - protein, 17 aa, Homo sapiens
  heavy chain complementarity determining region 3 for antibody 14844
AREDWNDVDLREYYFDY

SEQ ID NO: 29689 - protein, 9 aa, Homo sapiens
  light chain complementarity determining region 3 for antibody 14845
QQYKTYPHT

SEQ ID NO: 29690 - protein, 17 aa, Homo sapiens
  heavy chain complementarity determining region 3 for antibody 14845
AREDWNDVDLREYYFDY

SEQ ID NO: 29691 - protein, 9 aa, Homo sapiens
  light chain complementarity determining region 3 for antibody 14846
QQYKTVPWT

SEQ ID NO: 29692 - protein, 10 aa, Homo sapiens
  heavy chain complementarity determining region 3 for antibody 14846
IRHEEYVRPY

SEQ ID NO: 29693 - protein, 9 aa, Homo sapiens
  light chain complementarity determining region 3 for antibody 14847
QQYKTLPLT

SEQ ID NO: 29694 - protein, 19 aa, Homo sapiens
  heavy chain complementarity determining region 3 for antibody 14847
ARDRGYTIVDDYGSGDFDY

SEQ ID NO: 29695 - protein, 9 aa, Homo sapiens
  light chain complementarity determining region 3 for antibody 14848
QQYKTDPWT

SEQ ID NO: 29696 - protein, 10 aa, Homo sapiens
  heavy chain complementarity determining region 3 for antibody 14848
TRHEEYVRPY

SEQ ID NO: 29697 - protein, 9 aa, Homo sapiens
  light chain complementarity determining region 3 for antibody 14849
QQYKTDPWT

SEQ ID NO: 29698 - protein, 10 aa, Homo sapiens
  heavy chain complementarity determining region 3 for antibody 14849
IRHEEHVRPY

SEQ ID NO: 29699 - protein, 9 aa, Homo sapiens
  light chain complementarity determining region 3 for antibody 14850
QQYKTDPRT

SEQ ID NO: 29700 - protein, 10 aa, Homo sapiens
  heavy chain complementarity determining region 3 for antibody 14850
IRHEEYVRPY

SEQ ID NO: 29701 - protein, 9 aa, Homo sapiens
  light chain complementarity determining region 3 for antibody 14851
QQYKSYPRT

SEQ ID NO: 29702 - protein, 24 aa, Homo sapiens
  heavy chain complementarity determining region 3 for antibody 14851
ARGRTDGTVTTFGVPVLEYYYFDN

SEQ ID NO: 29703 - protein, 9 aa, Homo sapiens
  light chain complementarity determining region 3 for antibody 14852
QQYKSYPPT

SEQ ID NO: 29704 - protein, 26 aa, Homo sapiens
  heavy chain complementarity determining region 3 for antibody 14852
ARDQGVSIVPTGQNIPEGDTEGTFDY

SEQ ID NO: 29705 - protein, 9 aa, Homo sapiens
  light chain complementarity determining region 3 for antibody 14853
QQYKSYPPT

SEQ ID NO: 29706 - protein, 26 aa, Homo sapiens
  heavy chain complementarity determining region 3 for antibody 14853
ARDQGVKIVPTGQNIPEGDTEGTFDY

SEQ ID NO: 29707 - protein, 9 aa, Homo sapiens
  light chain complementarity determining region 3 for antibody 14854
QQYKSYPPP

SEQ ID NO: 29708 - protein, 26 aa, Homo sapiens
  heavy chain complementarity determining region 3 for antibody 14854
ARDQGVNIVPTGQNIPEGDTEGTFDY

SEQ ID NO: 29709 - protein, 9 aa, Homo sapiens
  light chain complementarity determining region 3 for antibody 14855
QQYKSTSYT

SEQ ID NO: 29710 - protein, 10 aa, Homo sapiens
  heavy chain complementarity determining region 3 for antibody 14855
TRGGLGTFDD

SEQ ID NO: 29711 - protein, 9 aa, Homo sapiens
  light chain complementarity determining region 3 for antibody 14856
QQYKSSPFT

SEQ ID NO: 29712 - protein, 13 aa, Homo sapiens
  heavy chain complementarity determining region 3 for antibody 14856
ASGGEQWVAWFDP

SEQ ID NO: 29713 - protein, 8 aa, Homo sapiens
  light chain complementarity determining region 3 for antibody 14857
QQYKSGWT

SEQ ID NO: 29714 - protein, 13 aa, Homo sapiens
  heavy chain complementarity determining region 3 for antibody 14857
AKVRDGDYDSLDF

SEQ ID NO: 29715 - protein, 8 aa, Homo sapiens
  light chain complementarity determining region 3 for antibody 14858
QQYKSEWT

SEQ ID NO: 29716 - protein, 13 aa, Homo sapiens
  heavy chain complementarity determining region 3 for antibody 14858
AKVRDGDYDSLDF

SEQ ID NO: 29717 - protein, 9 aa, Homo sapiens
  light chain complementarity determining region 3 for antibody 14859
QQYKNYPLT

SEQ ID NO: 29718 - protein, 22 aa, Homo sapiens
  heavy chain complementarity determining region 3 for antibody 14859
ARENAHSDYDLGDFSPYDVFDI

SEQ ID NO: 29719 - protein, 9 aa, Homo sapiens
  light chain complementarity determining region 3 for antibody 14860
QQYKNYPIT

SEQ ID NO: 29720 - protein, 22 aa, Homo sapiens
  heavy chain complementarity determining region 3 for antibody 14860
AIENAHSDYDLGDFSPYDVFDI

SEQ ID NO: 29721 - protein, 10 aa, Homo sapiens
  light chain complementarity determining region 3 for antibody 14861
QQYKNWPPLT

SEQ ID NO: 29722 - protein, 15 aa, Homo sapiens
  heavy chain complementarity determining region 3 for antibody 14861
ARVVSGWYAPRWFDS

SEQ ID NO: 29723 - protein, 10 aa, Homo sapiens
  light chain complementarity determining region 3 for antibody 14862
QQYKNWPPLP

SEQ ID NO: 29724 - protein, 15 aa, Homo sapiens
  heavy chain complementarity determining region 3 for antibody 14862
ARVVSGWYAPRWFDT

SEQ ID NO: 29725 - protein, 9 aa, Homo sapiens
  light chain complementarity determining region 3 for antibody 14863
QQYKDYPWA

SEQ ID NO: 29726 - protein, 13 aa, Homo sapiens
  heavy chain complementarity determining region 3 for antibody 14863
ATGGYDGTTARVD

SEQ ID NO: 29727 - protein, 9 aa, Homo sapiens
  light chain complementarity determining region 3 for antibody 14864
QQYKDYPLA

SEQ ID NO: 29728 - protein, 13 aa, Homo sapiens
  heavy chain complementarity determining region 3 for antibody 14864
ATGGYDGTIARVD

SEQ ID NO: 29729 - protein, 8 aa, Homo sapiens
  light chain complementarity determining region 3 for antibody 14865
QQYISFWT

SEQ ID NO: 29730 - protein, 17 aa, Homo sapiens
  heavy chain complementarity determining region 3 for antibody 14865
AGGYSDYDRNGPFYFDF

SEQ ID NO: 29731 - protein, 8 aa, Homo sapiens
  light chain complementarity determining region 3 for antibody 14866
QQYISFRT

SEQ ID NO: 29732 - protein, 17 aa, Homo sapiens
  heavy chain complementarity determining region 3 for antibody 14866
ARGYSDYDRNGPFYFDF

SEQ ID NO: 29733 - protein, 10 aa, Homo sapiens
  light chain complementarity determining region 3 for antibody 14867
QQYINWPPWT

SEQ ID NO: 29734 - protein, 9 aa, Homo sapiens
  heavy chain complementarity determining region 3 for antibody 14867
VTGYSYGDT

SEQ ID NO: 29735 - protein, 10 aa, Homo sapiens
  light chain complementarity determining region 3 for antibody 14868
QQYIKWPPWT

SEQ ID NO: 29736 - protein, 9 aa, Homo sapiens
  heavy chain complementarity determining region 3 for antibody 14868
VTGYSYGDS

SEQ ID NO: 29737 - protein, 10 aa, Homo sapiens
  light chain complementarity determining region 3 for antibody 14869
QQYIKWPPWT

SEQ ID NO: 29738 - protein, 9 aa, Homo sapiens
  heavy chain complementarity determining region 3 for antibody 14869
VTGYSDGDT

SEQ ID NO: 29739 - protein, 9 aa, Homo sapiens
  light chain complementarity determining region 3 for antibody 14870
QQYHTYPRT

SEQ ID NO: 29740 - protein, 14 aa, Homo sapiens
  heavy chain complementarity determining region 3 for antibody 14870
ERESYSGYDLDIDQ

SEQ ID NO: 29741 - protein, 9 aa, Homo sapiens
  light chain complementarity determining region 3 for antibody 14871
QQYHTYPQT

SEQ ID NO: 29742 - protein, 14 aa, Homo sapiens
  heavy chain complementarity determining region 3 for antibody 14871
ARESYSGYDLDIDQ

SEQ ID NO: 29743 - protein, 8 aa, Homo sapiens
  light chain complementarity determining region 3 for antibody 14872
QQYHTFST

SEQ ID NO: 29744 - protein, 18 aa, Homo sapiens
  heavy chain complementarity determining region 3 for antibody 14872
ARARRTQRRSDYYDGLDV

SEQ ID NO: 29745 - protein, 8 aa, Homo sapiens
  light chain complementarity determining region 3 for antibody 14873
QQYHTFST

SEQ ID NO: 29746 - protein, 18 aa, Homo sapiens
  heavy chain complementarity determining region 3 for antibody 14873
ARARRTQHRSDYYAGLDV

SEQ ID NO: 29747 - protein, 8 aa, Homo sapiens
  light chain complementarity determining region 3 for antibody 14874
QQYHTFST

SEQ ID NO: 29748 - protein, 18 aa, Homo sapiens
  heavy chain complementarity determining region 3 for antibody 14874
ARARRTHHRSDYYDGLDV

SEQ ID NO: 29749 - protein, 8 aa, Homo sapiens
  light chain complementarity determining region 3 for antibody 14875
QQYHTFST

SEQ ID NO: 29750 - protein, 18 aa, Homo sapiens
  heavy chain complementarity determining region 3 for antibody 14875
ARARRAQHRSDYYDGLDV

SEQ ID NO: 29751 - protein, 8 aa, Homo sapiens
  light chain complementarity determining region 3 for antibody 14876
QQYHTFST

SEQ ID NO: 29752 - protein, 18 aa, Homo sapiens
  heavy chain complementarity determining region 3 for antibody 14876
AGARRTQHRSDYYDGLDV

SEQ ID NO: 29753 - protein, 10 aa, Homo sapiens
  light chain complementarity determining region 3 for antibody 14877
QQYHSYSPEA

SEQ ID NO: 29754 - protein, 14 aa, Homo sapiens
  heavy chain complementarity determining region 3 for antibody 14877
AKDRGLLWFGESSH

SEQ ID NO: 29755 - protein, 10 aa, Homo sapiens
  light chain complementarity determining region 3 for antibody 14878
QQYHSYSLLT

SEQ ID NO: 29756 - protein, 13 aa, Homo sapiens
  heavy chain complementarity determining region 3 for antibody 14878
ARSDYEILTAFDY

SEQ ID NO: 29757 - protein, 9 aa, Homo sapiens
  light chain complementarity determining region 3 for antibody 14879
QQYHSYSHT

SEQ ID NO: 29758 - protein, 21 aa, Homo sapiens
  heavy chain complementarity determining region 3 for antibody 14879
AREQAYTVAGINYYYYYAMDV

SEQ ID NO: 29759 - protein, 10 aa, Homo sapiens
  light chain complementarity determining region 3 for antibody 14880
QQYHSYSGYA

SEQ ID NO: 29760 - protein, 15 aa, Homo sapiens
  heavy chain complementarity determining region 3 for antibody 14880
AKNWEASSPPGYFDY

SEQ ID NO: 29761 - protein, 9 aa, Homo sapiens
  light chain complementarity determining region 3 for antibody 14881
QQYHSYPYT

SEQ ID NO: 29762 - protein, 17 aa, Homo sapiens
  heavy chain complementarity determining region 3 for antibody 14881
AREQFNYVDLRQYFFDY

SEQ ID NO: 29763 - protein, 9 aa, Homo sapiens
  light chain complementarity determining region 3 for antibody 14882
QQYHSYPYT

SEQ ID NO: 29764 - protein, 17 aa, Homo sapiens
  heavy chain complementarity determining region 3 for antibody 14882
AREQFADVDSRQYYFDY

SEQ ID NO: 29765 - protein, 9 aa, Homo sapiens
  light chain complementarity determining region 3 for antibody 14883
QQYHSYPYT

SEQ ID NO: 29766 - protein, 17 aa, Homo sapiens
  heavy chain complementarity determining region 3 for antibody 14883
AREQFADVDLRQYVFDY

SEQ ID NO: 29767 - protein, 9 aa, Homo sapiens
  light chain complementarity determining region 3 for antibody 14884
QQYHSYPYP

SEQ ID NO: 29768 - protein, 17 aa, Homo sapiens
  heavy chain complementarity determining region 3 for antibody 14884
AREQFNDVDLRQYFFDY

SEQ ID NO: 29769 - protein, 9 aa, Homo sapiens
  light chain complementarity determining region 3 for antibody 14885
QQYHSYPYP

SEQ ID NO: 29770 - protein, 17 aa, Homo sapiens
  heavy chain complementarity determining region 3 for antibody 14885
AREQFADVDLRQYYFDY

SEQ ID NO: 29771 - protein, 9 aa, Homo sapiens
  light chain complementarity determining region 3 for antibody 14886
QQYHSYPST

SEQ ID NO: 29772 - protein, 17 aa, Homo sapiens
  heavy chain complementarity determining region 3 for antibody 14886
AREQFADVDLRQYFFDY

SEQ ID NO: 29773 - protein, 9 aa, Homo sapiens
  light chain complementarity determining region 3 for antibody 14887
QQYHSYPLT

SEQ ID NO: 29774 - protein, 15 aa, Homo sapiens
  heavy chain complementarity determining region 3 for antibody 14887
ARGRIHYDILTGLDY

SEQ ID NO: 29775 - protein, 9 aa, Homo sapiens
  light chain complementarity determining region 3 for antibody 14888
QQYHSYPLT

SEQ ID NO: 29776 - protein, 15 aa, Homo sapiens
  heavy chain complementarity determining region 3 for antibody 14888
ARGGTHYDILTGLDY

SEQ ID NO: 29777 - protein, 9 aa, Homo sapiens
  light chain complementarity determining region 3 for antibody 14889
QQYHSYPLT

SEQ ID NO: 29778 - protein, 15 aa, Homo sapiens
  heavy chain complementarity determining region 3 for antibody 14889
ARGGIHYDILPGLDY

SEQ ID NO: 29779 - protein, 9 aa, Homo sapiens
  light chain complementarity determining region 3 for antibody 14890
QQYHSYPLT

SEQ ID NO: 29780 - protein, 15 aa, Homo sapiens
  heavy chain complementarity determining region 3 for antibody 14890
ARGGIHYDILAGLDY

SEQ ID NO: 29781 - protein, 9 aa, Homo sapiens
  light chain complementarity determining region 3 for antibody 14891
QQYHSYPIT

SEQ ID NO: 29782 - protein, 15 aa, Homo sapiens
  heavy chain complementarity determining region 3 for antibody 14891
ARGGIHYDILTGLDY

SEQ ID NO: 29783 - protein, 10 aa, Homo sapiens
  light chain complementarity determining region 3 for antibody 14892
QQYHSWPPIT

SEQ ID NO: 29784 - protein, 14 aa, Homo sapiens
  heavy chain complementarity determining region 3 for antibody 14892
ARDFSTGIYGWFDP

SEQ ID NO: 29785 - protein, 8 aa, Homo sapiens
  light chain complementarity determining region 3 for antibody 14893
QQYHSVWT

SEQ ID NO: 29786 - protein, 15 aa, Homo sapiens
  heavy chain complementarity determining region 3 for antibody 14893
ARCVRGGDTYDAFDI

SEQ ID NO: 29787 - protein, 8 aa, Homo sapiens
  light chain complementarity determining region 3 for antibody 14894
QQYHSVWT

SEQ ID NO: 29788 - protein, 13 aa, Homo sapiens
  heavy chain complementarity determining region 3 for antibody 14894
AKVRAGYYDSLDY

SEQ ID NO: 29789 - protein, 8 aa, Homo sapiens
  light chain complementarity determining region 3 for antibody 14895
QQYHSVWT

SEQ ID NO: 29790 - protein, 13 aa, Homo sapiens
  heavy chain complementarity determining region 3 for antibody 14895
AKVRAGGYDSLDY

SEQ ID NO: 29791 - protein, 8 aa, Homo sapiens
  light chain complementarity determining region 3 for antibody 14896
QQYHSVWT

SEQ ID NO: 29792 - protein, 13 aa, Homo sapiens
  heavy chain complementarity determining region 3 for antibody 14896
AKVRAGDYDSPDY

SEQ ID NO: 29793 - protein, 8 aa, Homo sapiens
  light chain complementarity determining region 3 for antibody 14897
QQYHSVWT

SEQ ID NO: 29794 - protein, 13 aa, Homo sapiens
  heavy chain complementarity determining region 3 for antibody 14897
AKVRAGDYDSLGY

SEQ ID NO: 29795 - protein, 8 aa, Homo sapiens
  light chain complementarity determining region 3 for antibody 14898
QQYHSVWT

SEQ ID NO: 29796 - protein, 13 aa, Homo sapiens
  heavy chain complementarity determining region 3 for antibody 14898
AKVRAGDCDSLDY

SEQ ID NO: 29797 - protein, 9 aa, Homo sapiens
  light chain complementarity determining region 3 for antibody 14899
QQYHSTPYT

SEQ ID NO: 29798 - protein, 21 aa, Homo sapiens
  heavy chain complementarity determining region 3 for antibody 14899
ARTGGQYCSGSNCYYDNWFGS

SEQ ID NO: 29799 - protein, 9 aa, Homo sapiens
  light chain complementarity determining region 3 for antibody 14900
QQYHSTPYT

SEQ ID NO: 29800 - protein, 21 aa, Homo sapiens
  heavy chain complementarity determining region 3 for antibody 14900
ARPGGQYCSGSNCSYDNWFGS

SEQ ID NO: 29801 - protein, 9 aa, Homo sapiens
  light chain complementarity determining region 3 for antibody 14901
QQYHSTPST

SEQ ID NO: 29802 - protein, 21 aa, Homo sapiens
  heavy chain complementarity determining region 3 for antibody 14901
ARPGGQYCSGSNCYYDNWFGS

SEQ ID NO: 29803 - protein, 9 aa, Homo sapiens
  light chain complementarity determining region 3 for antibody 14902
QQYHSTPDT

SEQ ID NO: 29804 - protein, 21 aa, Homo sapiens
  heavy chain complementarity determining region 3 for antibody 14902
ARPGGQYCSGSNCYYDNWFGS

SEQ ID NO: 29805 - protein, 9 aa, Homo sapiens
  light chain complementarity determining region 3 for antibody 14903
QQYHSPTYT

SEQ ID NO: 29806 - protein, 13 aa, Homo sapiens
  heavy chain complementarity determining region 3 for antibody 14903
AHIGCRGASCYPV

SEQ ID NO: 29807 - protein, 9 aa, Homo sapiens
  light chain complementarity determining region 3 for antibody 14904
QQYHSPMYT

SEQ ID NO: 29808 - protein, 13 aa, Homo sapiens
  heavy chain complementarity determining region 3 for antibody 14904
AHTGCRGASCYPV

SEQ ID NO: 29809 - protein, 9 aa, Homo sapiens
  light chain complementarity determining region 3 for antibody 14905
QQYHSPAIT

SEQ ID NO: 29810 - protein, 15 aa, Homo sapiens
  heavy chain complementarity determining region 3 for antibody 14905
AKEKSVQQWSEYFSN

SEQ ID NO: 29811 - protein, 8 aa, Homo sapiens
  light chain complementarity determining region 3 for antibody 14906
QQYHSGWT

SEQ ID NO: 29812 - protein, 15 aa, Homo sapiens
  heavy chain complementarity determining region 3 for antibody 14906
ARCARGGDTYDAFDI

SEQ ID NO: 29813 - protein, 8 aa, Homo sapiens
  light chain complementarity determining region 3 for antibody 14907
QQYHSDWT

SEQ ID NO: 29814 - protein, 13 aa, Homo sapiens
  heavy chain complementarity determining region 3 for antibody 14907
AKVRAGDYDSLDY

SEQ ID NO: 29815 - protein, 9 aa, Homo sapiens
  light chain complementarity determining region 3 for antibody 14908
QQYHRYPLT

SEQ ID NO: 29816 - protein, 13 aa, Homo sapiens
  heavy chain complementarity determining region 3 for antibody 14908
AGASRAQFEAFDI

SEQ ID NO: 29817 - protein, 9 aa, Homo sapiens
  light chain complementarity determining region 3 for antibody 14909
QQYHRYPLP

SEQ ID NO: 29818 - protein, 13 aa, Homo sapiens
  heavy chain complementarity determining region 3 for antibody 14909
ASASRAQFEAFDI

SEQ ID NO: 29819 - protein, 9 aa, Homo sapiens
  light chain complementarity determining region 3 for antibody 14910
QQYHRTPYT

SEQ ID NO: 29820 - protein, 21 aa, Homo sapiens
  heavy chain complementarity determining region 3 for antibody 14910
ARPGGQYCSGSNCYYDNWFGS

SEQ ID NO: 29821 - protein, 9 aa, Homo sapiens
  light chain complementarity determining region 3 for antibody 14911
QQYHNYPYT

SEQ ID NO: 29822 - protein, 17 aa, Homo sapiens
  heavy chain complementarity determining region 3 for antibody 14911
ARQIDIVVEIVSDGSDV

SEQ ID NO: 29823 - protein, 9 aa, Homo sapiens
  light chain complementarity determining region 3 for antibody 14912
QQYHNYPYT

SEQ ID NO: 29824 - protein, 17 aa, Homo sapiens
  heavy chain complementarity determining region 3 for antibody 14912
ARQIDIVVEIGSDGLDV

SEQ ID NO: 29825 - protein, 10 aa, Homo sapiens
  light chain complementarity determining region 3 for antibody 14913
QQYHNYPPIT

SEQ ID NO: 29826 - protein, 21 aa, Homo sapiens
  heavy chain complementarity determining region 3 for antibody 14913
ARDQVGIAGRRWTCEYYGMDV

SEQ ID NO: 29827 - protein, 10 aa, Homo sapiens
  light chain complementarity determining region 3 for antibody 14914
QQYHNWPPLT

SEQ ID NO: 29828 - protein, 16 aa, Homo sapiens
  heavy chain complementarity determining region 3 for antibody 14914
VKDGWKQVWLRGSFDV

SEQ ID NO: 29829 - protein, 10 aa, Homo sapiens
  light chain complementarity determining region 3 for antibody 14915
QQYHNWPPIP

SEQ ID NO: 29830 - protein, 14 aa, Homo sapiens
  heavy chain complementarity determining region 3 for antibody 14915
ARDFSTGIYGWFDP

SEQ ID NO: 29831 - protein, 10 aa, Homo sapiens
  light chain complementarity determining region 3 for antibody 14916
QQYHNWPPIN

SEQ ID NO: 29832 - protein, 14 aa, Homo sapiens
  heavy chain complementarity determining region 3 for antibody 14916
ARDFSTGIYGWFDP

SEQ ID NO: 29833 - protein, 9 aa, Homo sapiens
  light chain complementarity determining region 3 for antibody 14917
QQYHNLPYT

SEQ ID NO: 29834 - protein, 13 aa, Homo sapiens
  heavy chain complementarity determining region 3 for antibody 14917
ARAKWDLFGYFDF

SEQ ID NO: 29835 - protein, 9 aa, Homo sapiens
  light chain complementarity determining region 3 for antibody 14918
QQYHNIPIT

SEQ ID NO: 29836 - protein, 19 aa, Homo sapiens
  heavy chain complementarity determining region 3 for antibody 14918
VREGSPGGAYNRIFRAFDL

SEQ ID NO: 29837 - protein, 9 aa, Homo sapiens
  light chain complementarity determining region 3 for antibody 14919
QQYGTSWYT

SEQ ID NO: 29838 - protein, 20 aa, Homo sapiens
  heavy chain complementarity determining region 3 for antibody 14919
AREPHRYGGKDLLYHYGMDV

SEQ ID NO: 29839 - protein, 9 aa, Homo sapiens
  light chain complementarity determining region 3 for antibody 14920
QQYGTSWYT

SEQ ID NO: 29840 - protein, 20 aa, Homo sapiens
  heavy chain complementarity determining region 3 for antibody 14920
ARDPHRYGGKGLLYHYGMDV

SEQ ID NO: 29841 - protein, 9 aa, Homo sapiens
  light chain complementarity determining region 3 for antibody 14921
QQYGTSWYT

SEQ ID NO: 29842 - protein, 20 aa, Homo sapiens
  heavy chain complementarity determining region 3 for antibody 14921
ARDPHRYGGKDLRYHYGMDV

SEQ ID NO: 29843 - protein, 9 aa, Homo sapiens
  light chain complementarity determining region 3 for antibody 14922
QQYGTSWYT

SEQ ID NO: 29844 - protein, 20 aa, Homo sapiens
  heavy chain complementarity determining region 3 for antibody 14922
ARDPHRYGGKDLLYRYGMDV

SEQ ID NO: 29845 - protein, 9 aa, Homo sapiens
  light chain complementarity determining region 3 for antibody 14923
QQYGTSWDT

SEQ ID NO: 29846 - protein, 20 aa, Homo sapiens
  heavy chain complementarity determining region 3 for antibody 14923
ARDPHRYGGKALLYHYGMDV

SEQ ID NO: 29847 - protein, 9 aa, Homo sapiens
  light chain complementarity determining region 3 for antibody 14924
QQYGTSRYT

SEQ ID NO: 29848 - protein, 23 aa, Homo sapiens
  heavy chain complementarity determining region 3 for antibody 14924
ARVGCSGEKCSSMSGYYYYPFDV

SEQ ID NO: 29849 - protein, 9 aa, Homo sapiens
  light chain complementarity determining region 3 for antibody 14925
QQYGTSRYT

SEQ ID NO: 29850 - protein, 23 aa, Homo sapiens
  heavy chain complementarity determining region 3 for antibody 14925
ARVGCSGEKCASTAGYYYYPLDV

SEQ ID NO: 29851 - protein, 10 aa, Homo sapiens
  light chain complementarity determining region 3 for antibody 14926
QQYGTSRPIT

SEQ ID NO: 29852 - protein, 18 aa, Homo sapiens
  heavy chain complementarity determining region 3 for antibody 14926
AADWGRVTATYSHYGLDA

SEQ ID NO: 29853 - protein, 10 aa, Homo sapiens
  light chain complementarity determining region 3 for antibody 14927
QQYGTSRPIP

SEQ ID NO: 29854 - protein, 18 aa, Homo sapiens
  heavy chain complementarity determining region 3 for antibody 14927
AADWGRVTATYSHYGLDV

SEQ ID NO: 29855 - protein, 8 aa, Homo sapiens
  light chain complementarity determining region 3 for antibody 14928
QQYGTSQT

SEQ ID NO: 29856 - protein, 14 aa, Homo sapiens
  heavy chain complementarity determining region 3 for antibody 14928
AREGGFTLTNWFDL

SEQ ID NO: 29857 - protein, 9 aa, Homo sapiens
  light chain complementarity determining region 3 for antibody 14929
QQYGTSPYT

SEQ ID NO: 29858 - protein, 12 aa, Homo sapiens
  heavy chain complementarity determining region 3 for antibody 14929
AGPHSGPYAFDI

SEQ ID NO: 29859 - protein, 8 aa, Homo sapiens
  light chain complementarity determining region 3 for antibody 14930
QQYGTSPT

SEQ ID NO: 29860 - protein, 12 aa, Homo sapiens
  heavy chain complementarity determining region 3 for antibody 14930
ARGGVGDLSLPY

SEQ ID NO: 29861 - protein, 10 aa, Homo sapiens
  light chain complementarity determining region 3 for antibody 14931
QQYGTSPRHT

SEQ ID NO: 29862 - protein, 12 aa, Homo sapiens
  heavy chain complementarity determining region 3 for antibody 14931
AGGISSRFYFDY

SEQ ID NO: 29863 - protein, 9 aa, Homo sapiens
  light chain complementarity determining region 3 for antibody 14932
QQYGTSPLT

SEQ ID NO: 29864 - protein, 16 aa, Homo sapiens
  heavy chain complementarity determining region 3 for antibody 14932
ARWGAVPESRENCFDY

SEQ ID NO: 29865 - protein, 9 aa, Homo sapiens
  light chain complementarity determining region 3 for antibody 14933
QQYGTSPFT

SEQ ID NO: 29866 - protein, 20 aa, Homo sapiens
  heavy chain complementarity determining region 3 for antibody 14933
ATDSFIAAEDMMMPWGAFEI

SEQ ID NO: 29867 - protein, 10 aa, Homo sapiens
  light chain complementarity determining region 3 for antibody 14934
QQYGTSLPVT

SEQ ID NO: 29868 - protein, 17 aa, Homo sapiens
  heavy chain complementarity determining region 3 for antibody 14934
VRDREFYYNSGGQTCDC

SEQ ID NO: 29869 - protein, 10 aa, Homo sapiens
  light chain complementarity determining region 3 for antibody 14935
QQYGTSLPVT

SEQ ID NO: 29870 - protein, 17 aa, Homo sapiens
  heavy chain complementarity determining region 3 for antibody 14935
VRDRECYYNSGGPTCDC

SEQ ID NO: 29871 - protein, 8 aa, Homo sapiens
  light chain complementarity determining region 3 for antibody 14936
QQYGTSKT

SEQ ID NO: 29872 - protein, 14 aa, Homo sapiens
  heavy chain complementarity determining region 3 for antibody 14936
AREGGLTLTNWFDL

SEQ ID NO: 29873 - protein, 8 aa, Homo sapiens
  light chain complementarity determining region 3 for antibody 14937
QQYGTSIT

SEQ ID NO: 29874 - protein, 18 aa, Homo sapiens
  heavy chain complementarity determining region 3 for antibody 14937
ARGDVEESGVFLNWYFDL

SEQ ID NO: 29875 - protein, 9 aa, Homo sapiens
  light chain complementarity determining region 3 for antibody 14938
QQYGTLSQS

SEQ ID NO: 29876 - protein, 13 aa, Homo sapiens
  heavy chain complementarity determining region 3 for antibody 14938
NTWVGGRGDLFDY

SEQ ID NO: 29877 - protein, 9 aa, Homo sapiens
  light chain complementarity determining region 3 for antibody 14939
QQYGTLPQS

SEQ ID NO: 29878 - protein, 13 aa, Homo sapiens
  heavy chain complementarity determining region 3 for antibody 14939
NTWVGGRGGLFDY

SEQ ID NO: 29879 - protein, 9 aa, Homo sapiens
  light chain complementarity determining region 3 for antibody 14940
QQYGTLPQL

SEQ ID NO: 29880 - protein, 13 aa, Homo sapiens
  heavy chain complementarity determining region 3 for antibody 14940
NTWVGGRGDLFDY

SEQ ID NO: 29881 - protein, 7 aa, Homo sapiens
  light chain complementarity determining region 3 for antibody 14941
QQYGSYR

SEQ ID NO: 29882 - protein, 16 aa, Homo sapiens
  heavy chain complementarity determining region 3 for antibody 14941
TTTYGDYPPYYYAMVV

SEQ ID NO: 29883 - protein, 9 aa, Homo sapiens
  light chain complementarity determining region 3 for antibody 14942
QQYGSYPLT

SEQ ID NO: 29884 - protein, 20 aa, Homo sapiens
  heavy chain complementarity determining region 3 for antibody 14942
ARDREAVAGAFRIINDFFDF

SEQ ID NO: 29885 - protein, 9 aa, Homo sapiens
  light chain complementarity determining region 3 for antibody 14943
QQYGSSWWT

SEQ ID NO: 29886 - protein, 19 aa, Homo sapiens
  heavy chain complementarity determining region 3 for antibody 14943
ARVGGGYNKLGYYYYPIDV

SEQ ID NO: 29887 - protein, 9 aa, Homo sapiens
  light chain complementarity determining region 3 for antibody 14944
QQYGSSWWT

SEQ ID NO: 29888 - protein, 19 aa, Homo sapiens
  heavy chain complementarity determining region 3 for antibody 14944
ARVGDGYNNLGYYYYPIDV

SEQ ID NO: 29889 - protein, 9 aa, Homo sapiens
  light chain complementarity determining region 3 for antibody 14945
QQYGSSWWT

SEQ ID NO: 29890 - protein, 19 aa, Homo sapiens
  heavy chain complementarity determining region 3 for antibody 14945
ARVGDGYNKRGYYYYPIDV

SEQ ID NO: 29891 - protein, 9 aa, Homo sapiens
  light chain complementarity determining region 3 for antibody 14946
QQYGSSTYT

SEQ ID NO: 29892 - protein, 21 aa, Homo sapiens
  heavy chain complementarity determining region 3 for antibody 14946
AGSGAGVGDHPLGYYYYAMDV

SEQ ID NO: 29893 - protein, 9 aa, Homo sapiens
  light chain complementarity determining region 3 for antibody 14947
QQYGSSTYN

SEQ ID NO: 29894 - protein, 21 aa, Homo sapiens
  heavy chain complementarity determining region 3 for antibody 14947
AGIGAGVGDHPLGYYYYAMDV

SEQ ID NO: 29895 - protein, 8 aa, Homo sapiens
  light chain complementarity determining region 3 for antibody 14948
QQYGSSTT

SEQ ID NO: 29896 - protein, 21 aa, Homo sapiens
  heavy chain complementarity determining region 3 for antibody 14948
ATRTSGKYSSSDDYYYYGMDV

SEQ ID NO: 29897 - protein, 9 aa, Homo sapiens
  light chain complementarity determining region 3 for antibody 14949
QQYGSSTLT

SEQ ID NO: 29898 - protein, 12 aa, Homo sapiens
  heavy chain complementarity determining region 3 for antibody 14949
ARVNRSGSPVGS

SEQ ID NO: 29899 - protein, 9 aa, Homo sapiens
  light chain complementarity determining region 3 for antibody 14950
QQYGSSTLP

SEQ ID NO: 29900 - protein, 23 aa, Homo sapiens
  heavy chain complementarity determining region 3 for antibody 14950
AKAYCTDGECYRGDYYYYYAMDV

SEQ ID NO: 29901 - protein, 9 aa, Homo sapiens
  light chain complementarity determining region 3 for antibody 14951
QQYGSSTIT

SEQ ID NO: 29902 - protein, 6 aa, Homo sapiens
  heavy chain complementarity determining region 3 for antibody 14951
AIMILG

SEQ ID NO: 29903 - protein, 9 aa, Homo sapiens
  light chain complementarity determining region 3 for antibody 14952
QQYGSSSWT

SEQ ID NO: 29904 - protein, 14 aa, Homo sapiens
  heavy chain complementarity determining region 3 for antibody 14952
ARSGHDYGSLGIDP

SEQ ID NO: 29905 - protein, 9 aa, Homo sapiens
  light chain complementarity determining region 3 for antibody 14953
QQYGSSSWT

SEQ ID NO: 29906 - protein, 12 aa, Homo sapiens
  heavy chain complementarity determining region 3 for antibody 14953
ARNGRFLNWFDP

SEQ ID NO: 29907 - protein, 8 aa, Homo sapiens
  light chain complementarity determining region 3 for antibody 14954
QQYGSSST

SEQ ID NO: 29908 - protein, 12 aa, Homo sapiens
  heavy chain complementarity determining region 3 for antibody 14954
AVELGYGDIPIA

SEQ ID NO: 29909 - protein, 9 aa, Homo sapiens
  light chain complementarity determining region 3 for antibody 14955
QQYGSSRYT

SEQ ID NO: 29910 - protein, 23 aa, Homo sapiens
  heavy chain complementarity determining region 3 for antibody 14955
ARVGCSGEKCSSKSGYYYYPLDV

SEQ ID NO: 29911 - protein, 9 aa, Homo sapiens
  light chain complementarity determining region 3 for antibody 14956
QQYGSSRYP

SEQ ID NO: 29912 - protein, 23 aa, Homo sapiens
  heavy chain complementarity determining region 3 for antibody 14956
ARVGCSGEKCSSTSGYYYYALDV

SEQ ID NO: 29913 - protein, 7 aa, Homo sapiens
  light chain complementarity determining region 3 for antibody 14957
QQYGSSR

SEQ ID NO: 29914 - protein, 16 aa, Homo sapiens
  heavy chain complementarity determining region 3 for antibody 14957
TTTYGDYPSYYYAMVV

SEQ ID NO: 29915 - protein, 7 aa, Homo sapiens
  light chain complementarity determining region 3 for antibody 14958
QQYGSSR

SEQ ID NO: 29916 - protein, 16 aa, Homo sapiens
  heavy chain complementarity determining region 3 for antibody 14958
TTTYGDYPPYYCAMVV

SEQ ID NO: 29917 - protein, 9 aa, Homo sapiens
  light chain complementarity determining region 3 for antibody 14959
QQYGSSRST

SEQ ID NO: 29918 - protein, 20 aa, Homo sapiens
  heavy chain complementarity determining region 3 for antibody 14959
ARWNDSSGYNFGIYYYAMDV

SEQ ID NO: 29919 - protein, 10 aa, Homo sapiens
  light chain complementarity determining region 3 for antibody 14960
QQYGSSRLIT

SEQ ID NO: 29920 - protein, 14 aa, Homo sapiens
  heavy chain complementarity determining region 3 for antibody 14960
ARAWVGPTLRAFDI

SEQ ID NO: 29921 - protein, 9 aa, Homo sapiens
  light chain complementarity determining region 3 for antibody 14961
QQYGSSPYT

SEQ ID NO: 29922 - protein, 21 aa, Homo sapiens
  heavy chain complementarity determining region 3 for antibody 14961
ASHSSGTYYVLPYYSFHSMDV

SEQ ID NO: 29923 - protein, 9 aa, Homo sapiens
  light chain complementarity determining region 3 for antibody 14962
QQYGSSPYT

SEQ ID NO: 29924 - protein, 21 aa, Homo sapiens
  heavy chain complementarity determining region 3 for antibody 14962
ASHSSGTYYVLPYDSFHIMDV

SEQ ID NO: 29925 - protein, 9 aa, Homo sapiens
  light chain complementarity determining region 3 for antibody 14963
QQYGSSPYT

SEQ ID NO: 29926 - protein, 21 aa, Homo sapiens
  heavy chain complementarity determining region 3 for antibody 14963
ASHISGTYYVLPYYSFHIMDV

SEQ ID NO: 29927 - protein, 9 aa, Homo sapiens
  light chain complementarity determining region 3 for antibody 14964
QQYGSSPYT

SEQ ID NO: 29928 - protein, 14 aa, Homo sapiens
  heavy chain complementarity determining region 3 for antibody 14964
ARGMTSYSSAPYDP

SEQ ID NO: 29929 - protein, 9 aa, Homo sapiens
  light chain complementarity determining region 3 for antibody 14965
QQYGSSPYT

SEQ ID NO: 29930 - protein, 13 aa, Homo sapiens
  heavy chain complementarity determining region 3 for antibody 14965
ARGFRYGSGHYVH

SEQ ID NO: 29931 - protein, 9 aa, Homo sapiens
  light chain complementarity determining region 3 for antibody 14966
QQYGSSPYP

SEQ ID NO: 29932 - protein, 13 aa, Homo sapiens
  heavy chain complementarity determining region 3 for antibody 14966
ARGFRYGSGPYVH

SEQ ID NO: 29933 - protein, 9 aa, Homo sapiens
  light chain complementarity determining region 3 for antibody 14967
QQYGSSPWP

SEQ ID NO: 29934 - protein, 14 aa, Homo sapiens
  heavy chain complementarity determining region 3 for antibody 14967
AKDALVIGHDAFDV

SEQ ID NO: 29935 - protein, 9 aa, Homo sapiens
  light chain complementarity determining region 3 for antibody 14968
QQYGSSPWK

SEQ ID NO: 29936 - protein, 17 aa, Homo sapiens
  heavy chain complementarity determining region 3 for antibody 14968
ARHAQPLYYDISGLIDY

SEQ ID NO: 29937 - protein, 8 aa, Homo sapiens
  light chain complementarity determining region 3 for antibody 14969
QQYGSSPT

SEQ ID NO: 29938 - protein, 21 aa, Homo sapiens
  heavy chain complementarity determining region 3 for antibody 14969
ATRTSGKYSSSDDCYYYGMDV

SEQ ID NO: 29939 - protein, 8 aa, Homo sapiens
  light chain complementarity determining region 3 for antibody 14970
QQYGSSPT

SEQ ID NO: 29940 - protein, 21 aa, Homo sapiens
  heavy chain complementarity determining region 3 for antibody 14970
ATRASGKYSSSDDYYYYGMDV

SEQ ID NO: 29941 - protein, 9 aa, Homo sapiens
  light chain complementarity determining region 3 for antibody 14971
QQYGSSPST

SEQ ID NO: 29942 - protein, 13 aa, Homo sapiens
  heavy chain complementarity determining region 3 for antibody 14971
ARGTIYNSGPYSL

SEQ ID NO: 29943 - protein, 10 aa, Homo sapiens
  light chain complementarity determining region 3 for antibody 14972
QQYGSSPSIT

SEQ ID NO: 29944 - protein, 20 aa, Homo sapiens
  heavy chain complementarity determining region 3 for antibody 14972
ARDTERGSQIWSYYYYGVDV

SEQ ID NO: 29945 - protein, 9 aa, Homo sapiens
  light chain complementarity determining region 3 for antibody 14973
QQYGSSPRT

SEQ ID NO: 29946 - protein, 16 aa, Homo sapiens
  heavy chain complementarity determining region 3 for antibody 14973
ATATGYSNYYYYGMDV

SEQ ID NO: 29947 - protein, 9 aa, Homo sapiens
  light chain complementarity determining region 3 for antibody 14974
QQYGSSPRT

SEQ ID NO: 29948 - protein, 11 aa, Homo sapiens
  heavy chain complementarity determining region 3 for antibody 14974
ARSPRGYSADC

SEQ ID NO: 29949 - protein, 9 aa, Homo sapiens
  light chain complementarity determining region 3 for antibody 14975
QQYGSSPRT

SEQ ID NO: 29950 - protein, 17 aa, Homo sapiens
  heavy chain complementarity determining region 3 for antibody 14975
ARLPGGVISDFYYGMDV

SEQ ID NO: 29951 - protein, 9 aa, Homo sapiens
  light chain complementarity determining region 3 for antibody 14976
QQYGSSPRP

SEQ ID NO: 29952 - protein, 16 aa, Homo sapiens
  heavy chain complementarity determining region 3 for antibody 14976
ATTTGYSNYYYYGMDV

SEQ ID NO: 29953 - protein, 9 aa, Homo sapiens
  light chain complementarity determining region 3 for antibody 14977
QQYGSSPQT

SEQ ID NO: 29954 - protein, 15 aa, Homo sapiens
  heavy chain complementarity determining region 3 for antibody 14977
AREMKGRGNYYGMDV

SEQ ID NO: 29955 - protein, 10 aa, Homo sapiens
  light chain complementarity determining region 3 for antibody 14978
QQYGSSPQLT

SEQ ID NO: 29956 - protein, 13 aa, Homo sapiens
  heavy chain complementarity determining region 3 for antibody 14978
ARSAGYYPNWLES

SEQ ID NO: 29957 - protein, 10 aa, Homo sapiens
  light chain complementarity determining region 3 for antibody 14979
QQYGSSPPWT

SEQ ID NO: 29958 - protein, 11 aa, Homo sapiens
  heavy chain complementarity determining region 3 for antibody 14979
ARGIPHYYLDL

SEQ ID NO: 29959 - protein, 10 aa, Homo sapiens
  light chain complementarity determining region 3 for antibody 14980
QQYGSSPPVT

SEQ ID NO: 29960 - protein, 17 aa, Homo sapiens
  heavy chain complementarity determining region 3 for antibody 14980
AGAHYDILAGYFYGMDV

SEQ ID NO: 29961 - protein, 9 aa, Homo sapiens
  light chain complementarity determining region 3 for antibody 14981
QQYGSSPPT

SEQ ID NO: 29962 - protein, 12 aa, Homo sapiens
  heavy chain complementarity determining region 3 for antibody 14981
ASGFVEWSLYEY

SEQ ID NO: 29963 - protein, 9 aa, Homo sapiens
  light chain complementarity determining region 3 for antibody 14982
QQYGSSPPT

SEQ ID NO: 29964 - protein, 12 aa, Homo sapiens
  heavy chain complementarity determining region 3 for antibody 14982
ASGFLEWSLYDY

SEQ ID NO: 29965 - protein, 9 aa, Homo sapiens
  light chain complementarity determining region 3 for antibody 14983
QQYGSSPPT

SEQ ID NO: 29966 - protein, 12 aa, Homo sapiens
  heavy chain complementarity determining region 3 for antibody 14983
ASGFLEWLLYEY

SEQ ID NO: 29967 - protein, 9 aa, Homo sapiens
  light chain complementarity determining region 3 for antibody 14984
QQYGSSPPT

SEQ ID NO: 29968 - protein, 11 aa, Homo sapiens
  heavy chain complementarity determining region 3 for antibody 14984
ARDRKFGESAD

SEQ ID NO: 29969 - protein, 10 aa, Homo sapiens
  light chain complementarity determining region 3 for antibody 14985
QQYGSSPPRH

SEQ ID NO: 29970 - protein, 15 aa, Homo sapiens
  heavy chain complementarity determining region 3 for antibody 14985
ARSGVAAAGTGWFDP

SEQ ID NO: 29971 - protein, 9 aa, Homo sapiens
  light chain complementarity determining region 3 for antibody 14986
QQYGSSPPP

SEQ ID NO: 29972 - protein, 23 aa, Homo sapiens
  heavy chain complementarity determining region 3 for antibody 14986
ARTDYYDSSGYYPPFYHYYGMDV

SEQ ID NO: 29973 - protein, 11 aa, Homo sapiens
  light chain complementarity determining region 3 for antibody 14987
QQYGSSPPLYT

SEQ ID NO: 29974 - protein, 18 aa, Homo sapiens
  heavy chain complementarity determining region 3 for antibody 14987
ARAAGYYDSSGYLAPLHY

SEQ ID NO: 29975 - protein, 10 aa, Homo sapiens
  light chain complementarity determining region 3 for antibody 14988
QQYGSSPPIP

SEQ ID NO: 29976 - protein, 12 aa, Homo sapiens
  heavy chain complementarity determining region 3 for antibody 14988
AVELGYGDIPIA

SEQ ID NO: 29977 - protein, 10 aa, Homo sapiens
  light chain complementarity determining region 3 for antibody 14989
QQYGSSPPFT

SEQ ID NO: 29978 - protein, 17 aa, Homo sapiens
  heavy chain complementarity determining region 3 for antibody 14989
AGAHYDILTGYFYGMDV

SEQ ID NO: 29979 - protein, 10 aa, Homo sapiens
  light chain complementarity determining region 3 for antibody 14990
QQYGSSPPDT

SEQ ID NO: 29980 - protein, 14 aa, Homo sapiens
  heavy chain complementarity determining region 3 for antibody 14990
AREVAVSGTFYFYY

SEQ ID NO: 29981 - protein, 8 aa, Homo sapiens
  light chain complementarity determining region 3 for antibody 14991
QQYGSSPP

SEQ ID NO: 29982 - protein, 21 aa, Homo sapiens
  heavy chain complementarity determining region 3 for antibody 14991
ATRTSGKYSSSDDYYYYGMDV

SEQ ID NO: 29983 - protein, 9 aa, Homo sapiens
  light chain complementarity determining region 3 for antibody 14992
QQYGSSPLT

SEQ ID NO: 29984 - protein, 12 aa, Homo sapiens
  heavy chain complementarity determining region 3 for antibody 14992
VAWYSSWSAFEY

SEQ ID NO: 29985 - protein, 9 aa, Homo sapiens
  light chain complementarity determining region 3 for antibody 14993
QQYGSSPLT

SEQ ID NO: 29986 - protein, 13 aa, Homo sapiens
  heavy chain complementarity determining region 3 for antibody 14993
TRCGATAIEYFQH

SEQ ID NO: 29987 - protein, 9 aa, Homo sapiens
  light chain complementarity determining region 3 for antibody 14994
QQYGSSPLT

SEQ ID NO: 29988 - protein, 11 aa, Homo sapiens
  heavy chain complementarity determining region 3 for antibody 14994
THYSSGWSFDF

SEQ ID NO: 29989 - protein, 9 aa, Homo sapiens
  light chain complementarity determining region 3 for antibody 14995
QQYGSSPLT

SEQ ID NO: 29990 - protein, 17 aa, Homo sapiens
  heavy chain complementarity determining region 3 for antibody 14995
AREDDWQQLAKGGFFDY

SEQ ID NO: 29991 - protein, 9 aa, Homo sapiens
  light chain complementarity determining region 3 for antibody 14996
QQYGSSPLT

SEQ ID NO: 29992 - protein, 20 aa, Homo sapiens
  heavy chain complementarity determining region 3 for antibody 14996
ARDREAVAGAFRIINDFSDF

SEQ ID NO: 29993 - protein, 9 aa, Homo sapiens
  light chain complementarity determining region 3 for antibody 14997
QQYGSSPLT

SEQ ID NO: 29994 - protein, 20 aa, Homo sapiens
  heavy chain complementarity determining region 3 for antibody 14997
ARDREAVAGAFRIINDCFDF

SEQ ID NO: 29995 - protein, 9 aa, Homo sapiens
  light chain complementarity determining region 3 for antibody 14998
QQYGSSPLT

SEQ ID NO: 29996 - protein, 20 aa, Homo sapiens
  heavy chain complementarity determining region 3 for antibody 14998
ARDREAVAGACRIINDFFDF

SEQ ID NO: 29997 - protein, 9 aa, Homo sapiens
  light chain complementarity determining region 3 for antibody 14999
QQYGSSPLT

SEQ ID NO: 29998 - protein, 20 aa, Homo sapiens
  heavy chain complementarity determining region 3 for antibody 14999
ARDCEAVAGAFRIINDFFDF

SEQ ID NO: 29999 - protein, 9 aa, Homo sapiens
  light chain complementarity determining region 3 for antibody 15000
QQYGSSPIT

SEQ ID NO: 30000 - protein, 16 aa, Homo sapiens
  heavy chain complementarity determining region 3 for antibody 15000
ATCHCSRNICYANFDS

SEQ ID NO: 30001 - protein, 9 aa, Homo sapiens
  light chain complementarity determining region 3 for antibody 15001
QQYGSSPIT

SEQ ID NO: 30002 - protein, 6 aa, Homo sapiens
  heavy chain complementarity determining region 3 for antibody 15001
AITIFG

SEQ ID NO: 30003 - protein, 9 aa, Homo sapiens
  light chain complementarity determining region 3 for antibody 15002
QQYGSSPIT

SEQ ID NO: 30004 - protein, 6 aa, Homo sapiens
  heavy chain complementarity determining region 3 for antibody 15002
AIMILV

SEQ ID NO: 30005 - protein, 9 aa, Homo sapiens
  light chain complementarity determining region 3 for antibody 15003
QQYGSSPIP

SEQ ID NO: 30006 - protein, 16 aa, Homo sapiens
  heavy chain complementarity determining region 3 for antibody 15003
ATYHCSRNICYANFDS

SEQ ID NO: 30007 - protein, 9 aa, Homo sapiens
  light chain complementarity determining region 3 for antibody 15004
QQYGSSPHT

SEQ ID NO: 30008 - protein, 13 aa, Homo sapiens
  heavy chain complementarity determining region 3 for antibody 15004
ARGSTYGSGTYTS

SEQ ID NO: 30009 - protein, 10 aa, Homo sapiens
  light chain complementarity determining region 3 for antibody 15005
QQYGSSPHLT

SEQ ID NO: 30010 - protein, 20 aa, Homo sapiens
  heavy chain complementarity determining region 3 for antibody 15005
ARDSEYSSVGVVSSYYGMDV

SEQ ID NO: 30011 - protein, 9 aa, Homo sapiens
  light chain complementarity determining region 3 for antibody 15006
QQYGSSPGT

SEQ ID NO: 30012 - protein, 13 aa, Homo sapiens
  heavy chain complementarity determining region 3 for antibody 15006
ATRPLDSSGYFDS

SEQ ID NO: 30013 - protein, 9 aa, Homo sapiens
  light chain complementarity determining region 3 for antibody 15007
QQYGSSPGT

SEQ ID NO: 30014 - protein, 12 aa, Homo sapiens
  heavy chain complementarity determining region 3 for antibody 15007
ARVGRYLNWFDP

SEQ ID NO: 30015 - protein, 9 aa, Homo sapiens
  light chain complementarity determining region 3 for antibody 15008
QQYGSSPGT

SEQ ID NO: 30016 - protein, 17 aa, Homo sapiens
  heavy chain complementarity determining region 3 for antibody 15008
ARGSYYDVDLNRFYFDY

SEQ ID NO: 30017 - protein, 9 aa, Homo sapiens
  light chain complementarity determining region 3 for antibody 15009
QQYGSSPGT

SEQ ID NO: 30018 - protein, 11 aa, Homo sapiens
  heavy chain complementarity determining region 3 for antibody 15009
AKDTQWQPFDH

SEQ ID NO: 30019 - protein, 9 aa, Homo sapiens
  light chain complementarity determining region 3 for antibody 15010
QQYGSSPGT

SEQ ID NO: 30020 - protein, 12 aa, Homo sapiens
  heavy chain complementarity determining region 3 for antibody 15010
AGGFLERLLFEY

SEQ ID NO: 30021 - protein, 9 aa, Homo sapiens
  light chain complementarity determining region 3 for antibody 15011
QQYGSSPFT

SEQ ID NO: 30022 - protein, 17 aa, Homo sapiens
  heavy chain complementarity determining region 3 for antibody 15011
ARDGSYGDRMYYYGMDV

SEQ ID NO: 30023 - protein, 9 aa, Homo sapiens
  light chain complementarity determining region 3 for antibody 15012
QQYGSSPFP

SEQ ID NO: 30024 - protein, 17 aa, Homo sapiens
  heavy chain complementarity determining region 3 for antibody 15012
AREDDWQQLAKGGFFDY

SEQ ID NO: 30025 - protein, 9 aa, Homo sapiens
  light chain complementarity determining region 3 for antibody 15013
QQYGSSPET

SEQ ID NO: 30026 - protein, 19 aa, Homo sapiens
  heavy chain complementarity determining region 3 for antibody 15013
TTLRYGSGELTYDYYGMDV

SEQ ID NO: 30027 - protein, 9 aa, Homo sapiens
  light chain complementarity determining region 3 for antibody 15014
QQYGSSPDT

SEQ ID NO: 30028 - protein, 13 aa, Homo sapiens
  heavy chain complementarity determining region 3 for antibody 15014
ARGTIYNSGPYSL

SEQ ID NO: 30029 - protein, 9 aa, Homo sapiens
  light chain complementarity determining region 3 for antibody 15015
QQYGSSPDT

SEQ ID NO: 30030 - protein, 14 aa, Homo sapiens
  heavy chain complementarity determining region 3 for antibody 15015
ARGMTSYNSAPYDP

SEQ ID NO: 30031 - protein, 9 aa, Homo sapiens
  light chain complementarity determining region 3 for antibody 15016
QQYGSSPDT

SEQ ID NO: 30032 - protein, 10 aa, Homo sapiens
  heavy chain complementarity determining region 3 for antibody 15016
ARESMGSMEY

SEQ ID NO: 30033 - protein, 9 aa, Homo sapiens
  light chain complementarity determining region 3 for antibody 15017
QQYGSSPCT

SEQ ID NO: 30034 - protein, 13 aa, Homo sapiens
  heavy chain complementarity determining region 3 for antibody 15017
ARGFRYGSGPYVH

SEQ ID NO: 30035 - protein, 10 aa, Homo sapiens
  light chain complementarity determining region 3 for antibody 15018
QQYGSSPAPT

SEQ ID NO: 30036 - protein, 13 aa, Homo sapiens
  heavy chain complementarity determining region 3 for antibody 15018
ARTNSGRPTQSRL

SEQ ID NO: 30037 - protein, 10 aa, Homo sapiens
  light chain complementarity determining region 3 for antibody 15019
QQYGSSPAGT

SEQ ID NO: 30038 - protein, 17 aa, Homo sapiens
  heavy chain complementarity determining region 3 for antibody 15019
AREDWSDVDLRAFYFGS

SEQ ID NO: 30039 - protein, 10 aa, Homo sapiens
  light chain complementarity determining region 3 for antibody 15020
QQYGSSPAGT

SEQ ID NO: 30040 - protein, 17 aa, Homo sapiens
  heavy chain complementarity determining region 3 for antibody 15020
AREDWSDVDLRAFYFDP

SEQ ID NO: 30041 - protein, 10 aa, Homo sapiens
  light chain complementarity determining region 3 for antibody 15021
QQYGSSPAGT

SEQ ID NO: 30042 - protein, 17 aa, Homo sapiens
  heavy chain complementarity determining region 3 for antibody 15021
AREDWSDVDLRAFYFDA

SEQ ID NO: 30043 - protein, 10 aa, Homo sapiens
  light chain complementarity determining region 3 for antibody 15022
QQYGSSPAGT

SEQ ID NO: 30044 - protein, 17 aa, Homo sapiens
  heavy chain complementarity determining region 3 for antibody 15022
AREDWSDVDLRAFHFDS

SEQ ID NO: 30045 - protein, 10 aa, Homo sapiens
  light chain complementarity determining region 3 for antibody 15023
QQYGSSPAGA

SEQ ID NO: 30046 - protein, 17 aa, Homo sapiens
  heavy chain complementarity determining region 3 for antibody 15023
AREDWSDVDLRAFYFDS

SEQ ID NO: 30047 - protein, 9 aa, Homo sapiens
  light chain complementarity determining region 3 for antibody 15024
QQYGSSLWT

SEQ ID NO: 30048 - protein, 15 aa, Homo sapiens
  heavy chain complementarity determining region 3 for antibody 15024
ARSVLPDYYAGAFHL

SEQ ID NO: 30049 - protein, 9 aa, Homo sapiens
  light chain complementarity determining region 3 for antibody 15025
QQYGSSLWT

SEQ ID NO: 30050 - protein, 20 aa, Homo sapiens
  heavy chain complementarity determining region 3 for antibody 15025
ARDTLLRYFDWPPPLVGVDV

SEQ ID NO: 30051 - protein, 9 aa, Homo sapiens
  light chain complementarity determining region 3 for antibody 15026
QQYGSSLWP

SEQ ID NO: 30052 - protein, 15 aa, Homo sapiens
  heavy chain complementarity determining region 3 for antibody 15026
ARNVLPDYYAGAFHL

SEQ ID NO: 30053 - protein, 9 aa, Homo sapiens
  light chain complementarity determining region 3 for antibody 15027
QQYGSSLWA

SEQ ID NO: 30054 - protein, 15 aa, Homo sapiens
  heavy chain complementarity determining region 3 for antibody 15027
ARNVLPDYYAGAFHL

SEQ ID NO: 30055 - protein, 8 aa, Homo sapiens
  light chain complementarity determining region 3 for antibody 15028
QQYGSSLT

SEQ ID NO: 30056 - protein, 14 aa, Homo sapiens
  heavy chain complementarity determining region 3 for antibody 15028
ARDRWGSRLDAFDI

SEQ ID NO: 30057 - protein, 9 aa, Homo sapiens
  light chain complementarity determining region 3 for antibody 15029
QQYGSSLST

SEQ ID NO: 30058 - protein, 21 aa, Homo sapiens
  heavy chain complementarity determining region 3 for antibody 15029
AREGRKQLGRIDYYFYHAMDV

SEQ ID NO: 30059 - protein, 10 aa, Homo sapiens
  light chain complementarity determining region 3 for antibody 15030
QQYGSSLPGT

SEQ ID NO: 30060 - protein, 14 aa, Homo sapiens
  heavy chain complementarity determining region 3 for antibody 15030
ARDRNNNWWGGIDY

SEQ ID NO: 30061 - protein, 8 aa, Homo sapiens
  light chain complementarity determining region 3 for antibody 15031
QQYGSSLP

SEQ ID NO: 30062 - protein, 17 aa, Homo sapiens
  heavy chain complementarity determining region 3 for antibody 15031
AKVYRPHCGSYCFYFDS

SEQ ID NO: 30063 - protein, 10 aa, Homo sapiens
  light chain complementarity determining region 3 for antibody 15032
QQYGSSFPGT

SEQ ID NO: 30064 - protein, 18 aa, Homo sapiens
  heavy chain complementarity determining region 3 for antibody 15032
ARPNYYYASGSYYPQFDH

SEQ ID NO: 30065 - protein, 9 aa, Homo sapiens
  light chain complementarity determining region 3 for antibody 15033
QQYGSSCYT

SEQ ID NO: 30066 - protein, 20 aa, Homo sapiens
  heavy chain complementarity determining region 3 for antibody 15033
ARWNDSSGYNFGIYYYAMDV

SEQ ID NO: 30067 - protein, 9 aa, Homo sapiens
  light chain complementarity determining region 3 for antibody 15034
QQYGSSATT

SEQ ID NO: 30068 - protein, 23 aa, Homo sapiens
  heavy chain complementarity determining region 3 for antibody 15034
ARQPRSPSSWGTVAAGTINWFDP

SEQ ID NO: 30069 - protein, 9 aa, Homo sapiens
  light chain complementarity determining region 3 for antibody 15035
QQYGSSATT

SEQ ID NO: 30070 - protein, 23 aa, Homo sapiens
  heavy chain complementarity determining region 3 for antibody 15035
ARQPRSPSSWGIVAAGTISWFDP

SEQ ID NO: 30071 - protein, 10 aa, Homo sapiens
  light chain complementarity determining region 3 for antibody 15036
QQYGSSALFT

SEQ ID NO: 30072 - protein, 16 aa, Homo sapiens
  heavy chain complementarity determining region 3 for antibody 15036
ARELFKGEIDYYGMDV

SEQ ID NO: 30073 - protein, 9 aa, Homo sapiens
  light chain complementarity determining region 3 for antibody 15037
QQYGSPWLT

SEQ ID NO: 30074 - protein, 22 aa, Homo sapiens
  heavy chain complementarity determining region 3 for antibody 15037
ARQGACGGDCYSLGYYYYAMDV

SEQ ID NO: 30075 - protein, 9 aa, Homo sapiens
  light chain complementarity determining region 3 for antibody 15038
QQYGSPPVT

SEQ ID NO: 30076 - protein, 13 aa, Homo sapiens
  heavy chain complementarity determining region 3 for antibody 15038
ATRPLDSSGYFDS

SEQ ID NO: 30077 - protein, 10 aa, Homo sapiens
  light chain complementarity determining region 3 for antibody 15039
QQYGSPPPIT

SEQ ID NO: 30078 - protein, 12 aa, Homo sapiens
  heavy chain complementarity determining region 3 for antibody 15039
AVELGYGDIPIA

SEQ ID NO: 30079 - protein, 8 aa, Homo sapiens
  light chain complementarity determining region 3 for antibody 15040
QQYGSPLT

SEQ ID NO: 30080 - protein, 17 aa, Homo sapiens
  heavy chain complementarity determining region 3 for antibody 15040
AKVYRPHCGSYCFYFDS

SEQ ID NO: 30081 - protein, 9 aa, Homo sapiens
  light chain complementarity determining region 3 for antibody 15041
QQYGSLPYT

SEQ ID NO: 30082 - protein, 13 aa, Homo sapiens
  heavy chain complementarity determining region 3 for antibody 15041
ARGSTYGSGTYTS

SEQ ID NO: 30083 - protein, 12 aa, Homo sapiens
  light chain complementarity determining region 3 for antibody 15042
QQYGSGSSPPYT

SEQ ID NO: 30084 - protein, 12 aa, Homo sapiens
  heavy chain complementarity determining region 3 for antibody 15042
ASCIYGSGTLNV

SEQ ID NO: 30085 - protein, 12 aa, Homo sapiens
  light chain complementarity determining region 3 for antibody 15043
QQYGSGSSPPYT

SEQ ID NO: 30086 - protein, 12 aa, Homo sapiens
  heavy chain complementarity determining region 3 for antibody 15043
ASCIYGSGTLEV

SEQ ID NO: 30087 - protein, 12 aa, Homo sapiens
  light chain complementarity determining region 3 for antibody 15044
QQYGSGSSPPNT

SEQ ID NO: 30088 - protein, 12 aa, Homo sapiens
  heavy chain complementarity determining region 3 for antibody 15044
ASCIYGSGTLKV

SEQ ID NO: 30089 - protein, 9 aa, Homo sapiens
  light chain complementarity determining region 3 for antibody 15045
QQYGSFRYT

SEQ ID NO: 30090 - protein, 22 aa, Homo sapiens
  heavy chain complementarity determining region 3 for antibody 15045
ARIYDDSAKYYSAGYYYYAMDV

SEQ ID NO: 30091 - protein, 9 aa, Homo sapiens
  light chain complementarity determining region 3 for antibody 15046
QQYGSFFQT

SEQ ID NO: 30092 - protein, 13 aa, Homo sapiens
  heavy chain complementarity determining region 3 for antibody 15046
AGGHGSTSGLIDY

SEQ ID NO: 30093 - protein, 9 aa, Homo sapiens
  light chain complementarity determining region 3 for antibody 15047
QQYGSAPPT

SEQ ID NO: 30094 - protein, 12 aa, Homo sapiens
  heavy chain complementarity determining region 3 for antibody 15047
AAWYSSWSAFDY

SEQ ID NO: 30095 - protein, 10 aa, Homo sapiens
  light chain complementarity determining region 3 for antibody 15048
QQYGRWPPWT

SEQ ID NO: 30096 - protein, 9 aa, Homo sapiens
  heavy chain complementarity determining region 3 for antibody 15048
ARGYSYGNL

SEQ ID NO: 30097 - protein, 10 aa, Homo sapiens
  light chain complementarity determining region 3 for antibody 15049
QQYGRSPRYI

SEQ ID NO: 30098 - protein, 12 aa, Homo sapiens
  heavy chain complementarity determining region 3 for antibody 15049
TRDLGSRYGMGV

SEQ ID NO: 30099 - protein, 9 aa, Homo sapiens
  light chain complementarity determining region 3 for antibody 15050
QQYGRSPNT

SEQ ID NO: 30100 - protein, 13 aa, Homo sapiens
  heavy chain complementarity determining region 3 for antibody 15050
ARGSRSNSSPYDY

SEQ ID NO: 30101 - protein, 9 aa, Homo sapiens
  light chain complementarity determining region 3 for antibody 15051
QQYGRSPHT

SEQ ID NO: 30102 - protein, 13 aa, Homo sapiens
  heavy chain complementarity determining region 3 for antibody 15051
ARGSRSNSSPYDY

SEQ ID NO: 30103 - protein, 10 aa, Homo sapiens
  light chain complementarity determining region 3 for antibody 15052
QQYGRSDLFT

SEQ ID NO: 30104 - protein, 16 aa, Homo sapiens
  heavy chain complementarity determining region 3 for antibody 15052
ARELFKGQIDYYGIDV

SEQ ID NO: 30105 - protein, 9 aa, Homo sapiens
  light chain complementarity determining region 3 for antibody 15053
QQYGRPPST

SEQ ID NO: 30106 - protein, 13 aa, Homo sapiens
  heavy chain complementarity determining region 3 for antibody 15053
ARGSRSNSSPYDY

SEQ ID NO: 30107 - protein, 10 aa, Homo sapiens
  light chain complementarity determining region 3 for antibody 15054
QQYGRPAGDT

SEQ ID NO: 30108 - protein, 11 aa, Homo sapiens
  heavy chain complementarity determining region 3 for antibody 15054
ARGPATGDFDY

SEQ ID NO: 30109 - protein, 8 aa, Homo sapiens
  light chain complementarity determining region 3 for antibody 15055
QQYGQFPT

SEQ ID NO: 30110 - protein, 20 aa, Homo sapiens
  heavy chain complementarity determining region 3 for antibody 15055
ATDRGTYFRSGSYYHYPLDY

SEQ ID NO: 30111 - protein, 9 aa, Homo sapiens
  light chain complementarity determining region 3 for antibody 15056
QQYGNVPIT

SEQ ID NO: 30112 - protein, 16 aa, Homo sapiens
  heavy chain complementarity determining region 3 for antibody 15056
TTRKYSYAYASVSFDH

SEQ ID NO: 30113 - protein, 9 aa, Homo sapiens
  light chain complementarity determining region 3 for antibody 15057
QQYGNSPRT

SEQ ID NO: 30114 - protein, 17 aa, Homo sapiens
  heavy chain complementarity determining region 3 for antibody 15057
ARDDFVSDRIFYKGMDV

SEQ ID NO: 30115 - protein, 10 aa, Homo sapiens
  light chain complementarity determining region 3 for antibody 15058
QQYGNSPLTT

SEQ ID NO: 30116 - protein, 12 aa, Homo sapiens
  heavy chain complementarity determining region 3 for antibody 15058
ARGPLRGRHFDY

SEQ ID NO: 30117 - protein, 10 aa, Homo sapiens
  light chain complementarity determining region 3 for antibody 15059
QQYGNSPLIT

SEQ ID NO: 30118 - protein, 12 aa, Homo sapiens
  heavy chain complementarity determining region 3 for antibody 15059
ARGPLRGRNFDY

SEQ ID NO: 30119 - protein, 10 aa, Homo sapiens
  light chain complementarity determining region 3 for antibody 15060
QQYGNSPLIP

SEQ ID NO: 30120 - protein, 12 aa, Homo sapiens
  heavy chain complementarity determining region 3 for antibody 15060
ARGPLRGRHFDY

SEQ ID NO: 30121 - protein, 10 aa, Homo sapiens
  light chain complementarity determining region 3 for antibody 15061
QQYGNSGLFT

SEQ ID NO: 30122 - protein, 16 aa, Homo sapiens
  heavy chain complementarity determining region 3 for antibody 15061
AREVFKGQIDYYGMDV

SEQ ID NO: 30123 - protein, 10 aa, Homo sapiens
  light chain complementarity determining region 3 for antibody 15062
QQYGNSGLFI

SEQ ID NO: 30124 - protein, 16 aa, Homo sapiens
  heavy chain complementarity determining region 3 for antibody 15062
AREIFKGEIDYYAMDV

SEQ ID NO: 30125 - protein, 10 aa, Homo sapiens
  light chain complementarity determining region 3 for antibody 15063
QQYGNPPLIT

SEQ ID NO: 30126 - protein, 12 aa, Homo sapiens
  heavy chain complementarity determining region 3 for antibody 15063
ARGPLRGRHFDY

SEQ ID NO: 30127 - protein, 10 aa, Homo sapiens
  light chain complementarity determining region 3 for antibody 15064
QQYGNLPPFT

SEQ ID NO: 30128 - protein, 16 aa, Homo sapiens
  heavy chain complementarity determining region 3 for antibody 15064
ARELFKGEYDYYAMDV

SEQ ID NO: 30129 - protein, 8 aa, Homo sapiens
  light chain complementarity determining region 3 for antibody 15065
QQYGNLLT

SEQ ID NO: 30130 - protein, 20 aa, Homo sapiens
  heavy chain complementarity determining region 3 for antibody 15065
SKDRYVNAAMDYYYYSAMDV

SEQ ID NO: 30131 - protein, 8 aa, Homo sapiens
  light chain complementarity determining region 3 for antibody 15066
QQYGNLLT

SEQ ID NO: 30132 - protein, 20 aa, Homo sapiens
  heavy chain complementarity determining region 3 for antibody 15066
SKDRSVNAAVDYYYYSAMDV

SEQ ID NO: 30133 - protein, 8 aa, Homo sapiens
  light chain complementarity determining region 3 for antibody 15067
QQYGNLLT

SEQ ID NO: 30134 - protein, 20 aa, Homo sapiens
  heavy chain complementarity determining region 3 for antibody 15067
SKDRSVNAATDYYYYSAMDV

SEQ ID NO: 30135 - protein, 8 aa, Homo sapiens
  light chain complementarity determining region 3 for antibody 15068
QQYGNLLT

SEQ ID NO: 30136 - protein, 20 aa, Homo sapiens
  heavy chain complementarity determining region 3 for antibody 15068
SKDRSVNAAMEYYYYSAMDV

SEQ ID NO: 30137 - protein, 8 aa, Homo sapiens
  light chain complementarity determining region 3 for antibody 15069
QQYGNLLT

SEQ ID NO: 30138 - protein, 20 aa, Homo sapiens
  heavy chain complementarity determining region 3 for antibody 15069
SKDRSVNAAMDYYYYSSMDV

SEQ ID NO: 30139 - protein, 8 aa, Homo sapiens
  light chain complementarity determining region 3 for antibody 15070
QQYGNLLT

SEQ ID NO: 30140 - protein, 20 aa, Homo sapiens
  heavy chain complementarity determining region 3 for antibody 15070
SKDRSVNAAMDYYYYSAMGV

SEQ ID NO: 30141 - protein, 8 aa, Homo sapiens
  light chain complementarity determining region 3 for antibody 15071
QQYGNLLT

SEQ ID NO: 30142 - protein, 20 aa, Homo sapiens
  heavy chain complementarity determining region 3 for antibody 15071
SKDRSVNAAMDYYSYSAMDV

SEQ ID NO: 30143 - protein, 8 aa, Homo sapiens
  light chain complementarity determining region 3 for antibody 15072
QQYGNILT

SEQ ID NO: 30144 - protein, 20 aa, Homo sapiens
  heavy chain complementarity determining region 3 for antibody 15072
SKDRSVNAAMDYYYYSAMDV

SEQ ID NO: 30145 - protein, 8 aa, Homo sapiens
  light chain complementarity determining region 3 for antibody 15073
QQYGNFLT

SEQ ID NO: 30146 - protein, 20 aa, Homo sapiens
  heavy chain complementarity determining region 3 for antibody 15073
SKDRSVNAAMDYYYYSAMDV

SEQ ID NO: 30147 - protein, 9 aa, Homo sapiens
  light chain complementarity determining region 3 for antibody 15074
QQYGISPYT

SEQ ID NO: 30148 - protein, 14 aa, Homo sapiens
  heavy chain complementarity determining region 3 for antibody 15074
ARVQSSVSSVPHAY

SEQ ID NO: 30149 - protein, 9 aa, Homo sapiens
  light chain complementarity determining region 3 for antibody 15075
QQYGISPYT

SEQ ID NO: 30150 - protein, 14 aa, Homo sapiens
  heavy chain complementarity determining region 3 for antibody 15075
ARGQSSVSSVSHAY

SEQ ID NO: 30151 - protein, 9 aa, Homo sapiens
  light chain complementarity determining region 3 for antibody 15076
QQYGISPYT

SEQ ID NO: 30152 - protein, 14 aa, Homo sapiens
  heavy chain complementarity determining region 3 for antibody 15076
ARGQSSVPSVPHAY

SEQ ID NO: 30153 - protein, 10 aa, Homo sapiens
  light chain complementarity determining region 3 for antibody 15077
QQYGISPGWA

SEQ ID NO: 30154 - protein, 14 aa, Homo sapiens
  heavy chain complementarity determining region 3 for antibody 15077
TRRSITHYYNGMDV

SEQ ID NO: 30155 - protein, 9 aa, Homo sapiens
  light chain complementarity determining region 3 for antibody 15078
QQYGISPFT

SEQ ID NO: 30156 - protein, 20 aa, Homo sapiens
  heavy chain complementarity determining region 3 for antibody 15078
ARGGKYSDNYPYYYSYGLDV

SEQ ID NO: 30157 - protein, 9 aa, Homo sapiens
  light chain complementarity determining region 3 for antibody 15079
QQYGILPYT

SEQ ID NO: 30158 - protein, 14 aa, Homo sapiens
  heavy chain complementarity determining region 3 for antibody 15079
ARGQSSVSSVPHAY

SEQ ID NO: 30159 - protein, 9 aa, Homo sapiens
  light chain complementarity determining region 3 for antibody 15080
QQYGGSRDT

SEQ ID NO: 30160 - protein, 11 aa, Homo sapiens
  heavy chain complementarity determining region 3 for antibody 15080
AHTTYGYYFDY

SEQ ID NO: 30161 - protein, 10 aa, Homo sapiens
  light chain complementarity determining region 3 for antibody 15081
QQYGGSPRYI

SEQ ID NO: 30162 - protein, 12 aa, Homo sapiens
  heavy chain complementarity determining region 3 for antibody 15081
TRDLGSRYGMDV

SEQ ID NO: 30163 - protein, 10 aa, Homo sapiens
  light chain complementarity determining region 3 for antibody 15082
QQYGGSPMYT

SEQ ID NO: 30164 - protein, 20 aa, Homo sapiens
  heavy chain complementarity determining region 3 for antibody 15082
AREFPLAVVDGYYHLYGMNV

SEQ ID NO: 30165 - protein, 10 aa, Homo sapiens
  light chain complementarity determining region 3 for antibody 15083
QQYGGSPMNT

SEQ ID NO: 30166 - protein, 20 aa, Homo sapiens
  heavy chain complementarity determining region 3 for antibody 15083
AREFPLAVVDGYYHFYGMNV

SEQ ID NO: 30167 - protein, 9 aa, Homo sapiens
  light chain complementarity determining region 3 for antibody 15084
QQYGGSPLP

SEQ ID NO: 30168 - protein, 12 aa, Homo sapiens
  heavy chain complementarity determining region 3 for antibody 15084
AAWYGSWSAFDH

SEQ ID NO: 30169 - protein, 9 aa, Homo sapiens
  light chain complementarity determining region 3 for antibody 15085
QQYGGLPLT

SEQ ID NO: 30170 - protein, 10 aa, Homo sapiens
  heavy chain complementarity determining region 3 for antibody 15085
ATDYKGAFDS

SEQ ID NO: 30171 - protein, 9 aa, Homo sapiens
  light chain complementarity determining region 3 for antibody 15086
QQYGGLPIT

SEQ ID NO: 30172 - protein, 17 aa, Homo sapiens
  heavy chain complementarity determining region 3 for antibody 15086
ARVDGYVLTGYPYHSDY

SEQ ID NO: 30173 - protein, 9 aa, Homo sapiens
  light chain complementarity determining region 3 for antibody 15087
QQYGDTPLA

SEQ ID NO: 30174 - protein, 15 aa, Homo sapiens
  heavy chain complementarity determining region 3 for antibody 15087
TKGPGYASSKRYFDL

SEQ ID NO: 30175 - protein, 10 aa, Homo sapiens
  light chain complementarity determining region 3 for antibody 15088
QQYGDSPLVT

SEQ ID NO: 30176 - protein, 16 aa, Homo sapiens
  heavy chain complementarity determining region 3 for antibody 15088
TRRIVGTWLVPCYFDY

SEQ ID NO: 30177 - protein, 9 aa, Homo sapiens
  light chain complementarity determining region 3 for antibody 15089
QQYGDSPLT

SEQ ID NO: 30178 - protein, 12 aa, Homo sapiens
  heavy chain complementarity determining region 3 for antibody 15089
AAWYATWSAFDH

SEQ ID NO: 30179 - protein, 10 aa, Homo sapiens
  light chain complementarity determining region 3 for antibody 15090
QQYGDSPLGT

SEQ ID NO: 30180 - protein, 16 aa, Homo sapiens
  heavy chain complementarity determining region 3 for antibody 15090
TRRIVGTWLVPYYFDY

SEQ ID NO: 30181 - protein, 10 aa, Homo sapiens
  light chain complementarity determining region 3 for antibody 15091
QQYGDSPLAT

SEQ ID NO: 30182 - protein, 16 aa, Homo sapiens
  heavy chain complementarity determining region 3 for antibody 15091
TRRIVGTWLVPYYFDY

SEQ ID NO: 30183 - protein, 10 aa, Homo sapiens
  light chain complementarity determining region 3 for antibody 15092
QQYGDSPFVT

SEQ ID NO: 30184 - protein, 16 aa, Homo sapiens
  heavy chain complementarity determining region 3 for antibody 15092
TRRIVGTWLVPYYFDY

SEQ ID NO: 30185 - protein, 9 aa, Homo sapiens
  light chain complementarity determining region 3 for antibody 15093
QQYGDPPLT

SEQ ID NO: 30186 - protein, 15 aa, Homo sapiens
  heavy chain complementarity determining region 3 for antibody 15093
TKGPGYASSKRYFDL

SEQ ID NO: 30187 - protein, 10 aa, Homo sapiens
  light chain complementarity determining region 3 for antibody 15094
QQYGALPPRT

SEQ ID NO: 30188 - protein, 16 aa, Homo sapiens
  heavy chain complementarity determining region 3 for antibody 15094
ARGGIEAWRYFYGMDV

SEQ ID NO: 30189 - protein, 8 aa, Homo sapiens
  light chain complementarity determining region 3 for antibody 15095
QQYFTYPT

SEQ ID NO: 30190 - protein, 15 aa, Homo sapiens
  heavy chain complementarity determining region 3 for antibody 15095
AKAFATESSYGYFDA

SEQ ID NO: 30191 - protein, 9 aa, Homo sapiens
  light chain complementarity determining region 3 for antibody 15096
QQYFTSPPK

SEQ ID NO: 30192 - protein, 20 aa, Homo sapiens
  heavy chain complementarity determining region 3 for antibody 15096
TRGMLYGSNYFNFGYWNFDL

SEQ ID NO: 30193 - protein, 8 aa, Homo sapiens
  light chain complementarity determining region 3 for antibody 15097
QQYFSYST

SEQ ID NO: 30194 - protein, 17 aa, Homo sapiens
  heavy chain complementarity determining region 3 for antibody 15097
AKDWMHISSSIMYYFDL

SEQ ID NO: 30195 - protein, 10 aa, Homo sapiens
  light chain complementarity determining region 3 for antibody 15098
QQYFNWPLIT

SEQ ID NO: 30196 - protein, 15 aa, Homo sapiens
  heavy chain complementarity determining region 3 for antibody 15098
ASMLEFDSGTYYSNY

SEQ ID NO: 30197 - protein, 10 aa, Homo sapiens
  light chain complementarity determining region 3 for antibody 15099
QQYFNWPLIT

SEQ ID NO: 30198 - protein, 15 aa, Homo sapiens
  heavy chain complementarity determining region 3 for antibody 15099
ASMFECDSGTYYSNY

SEQ ID NO: 30199 - protein, 10 aa, Homo sapiens
  light chain complementarity determining region 3 for antibody 15100
QQYFNWPLIT

SEQ ID NO: 30200 - protein, 15 aa, Homo sapiens
  heavy chain complementarity determining region 3 for antibody 15100
ANMFEFDSGTYYSNY

SEQ ID NO: 30201 - protein, 10 aa, Homo sapiens
  light chain complementarity determining region 3 for antibody 15101
QQYFNWPLIT

SEQ ID NO: 30202 - protein, 12 aa, Homo sapiens
  heavy chain complementarity determining region 3 for antibody 15101
AKGILGRGGMDV

SEQ ID NO: 30203 - protein, 10 aa, Homo sapiens
  light chain complementarity determining region 3 for antibody 15102
QQYFNWPLIP

SEQ ID NO: 30204 - protein, 15 aa, Homo sapiens
  heavy chain complementarity determining region 3 for antibody 15102
ASMFEFDSGTYYSNY

SEQ ID NO: 30205 - protein, 10 aa, Homo sapiens
  light chain complementarity determining region 3 for antibody 15103
QQYFNWHLIT

SEQ ID NO: 30206 - protein, 15 aa, Homo sapiens
  heavy chain complementarity determining region 3 for antibody 15103
ASMFEFDSGTYYSNY

SEQ ID NO: 30207 - protein, 10 aa, Homo sapiens
  light chain complementarity determining region 3 for antibody 15104
QQYFNRPLIT

SEQ ID NO: 30208 - protein, 15 aa, Homo sapiens
  heavy chain complementarity determining region 3 for antibody 15104
ASMFEFDSGTYYSNY

SEQ ID NO: 30209 - protein, 9 aa, Homo sapiens
  light chain complementarity determining region 3 for antibody 15105
QQYETSHFT

SEQ ID NO: 30210 - protein, 11 aa, Homo sapiens
  heavy chain complementarity determining region 3 for antibody 15105
GRGSVTPDMGY

SEQ ID NO: 30211 - protein, 9 aa, Homo sapiens
  light chain complementarity determining region 3 for antibody 15106
QQYETPPFT

SEQ ID NO: 30212 - protein, 11 aa, Homo sapiens
  heavy chain complementarity determining region 3 for antibody 15106
GRGSVTPDMGY

SEQ ID NO: 30213 - protein, 9 aa, Homo sapiens
  light chain complementarity determining region 3 for antibody 15107
QQYETLPVT

SEQ ID NO: 30214 - protein, 15 aa, Homo sapiens
  heavy chain complementarity determining region 3 for antibody 15107
ARHRFGGSSPENFDF

SEQ ID NO: 30215 - protein, 9 aa, Homo sapiens
  light chain complementarity determining region 3 for antibody 15108
QQYETFPVT

SEQ ID NO: 30216 - protein, 15 aa, Homo sapiens
  heavy chain complementarity determining region 3 for antibody 15108
ARHRFGGSSSENFDF

SEQ ID NO: 30217 - protein, 9 aa, Homo sapiens
  light chain complementarity determining region 3 for antibody 15109
QQYESFPYT

SEQ ID NO: 30218 - protein, 17 aa, Homo sapiens
  heavy chain complementarity determining region 3 for antibody 15109
AREDYSDVDLRPYYFDT

SEQ ID NO: 30219 - protein, 9 aa, Homo sapiens
  light chain complementarity determining region 3 for antibody 15110
QQYESFPYT

SEQ ID NO: 30220 - protein, 17 aa, Homo sapiens
  heavy chain complementarity determining region 3 for antibody 15110
AREDYSDVDLRLYYFDA

SEQ ID NO: 30221 - protein, 9 aa, Homo sapiens
  light chain complementarity determining region 3 for antibody 15111
QQYDTYSYT

SEQ ID NO: 30222 - protein, 20 aa, Homo sapiens
  heavy chain complementarity determining region 3 for antibody 15111
ARFSYGSGDCYRAHYYGMDV

SEQ ID NO: 30223 - protein, 9 aa, Homo sapiens
  light chain complementarity determining region 3 for antibody 15112
QQYDTYQLT

SEQ ID NO: 30224 - protein, 19 aa, Homo sapiens
  heavy chain complementarity determining region 3 for antibody 15112
ARDRSDTSMDPGGEGCFDH

SEQ ID NO: 30225 - protein, 9 aa, Homo sapiens
  light chain complementarity determining region 3 for antibody 15113
QQYDTYPWT

SEQ ID NO: 30226 - protein, 16 aa, Homo sapiens
  heavy chain complementarity determining region 3 for antibody 15113
AALGSGSLYDPYALDV

SEQ ID NO: 30227 - protein, 9 aa, Homo sapiens
  light chain complementarity determining region 3 for antibody 15114
QQYDTYPLT

SEQ ID NO: 30228 - protein, 16 aa, Homo sapiens
  heavy chain complementarity determining region 3 for antibody 15114
AREAGEDYYYKDIFDI

SEQ ID NO: 30229 - protein, 9 aa, Homo sapiens
  light chain complementarity determining region 3 for antibody 15115
QQYDTYPLT

SEQ ID NO: 30230 - protein, 19 aa, Homo sapiens
  heavy chain complementarity determining region 3 for antibody 15115
ARDRSDTSMYPGGEGCFDH

SEQ ID NO: 30231 - protein, 9 aa, Homo sapiens
  light chain complementarity determining region 3 for antibody 15116
QQYDTYPLT

SEQ ID NO: 30232 - protein, 19 aa, Homo sapiens
  heavy chain complementarity determining region 3 for antibody 15116
ARDRSDTSMGPGGEGCFDH

SEQ ID NO: 30233 - protein, 9 aa, Homo sapiens
  light chain complementarity determining region 3 for antibody 15117
QQYDTWPWT

SEQ ID NO: 30234 - protein, 17 aa, Homo sapiens
  heavy chain complementarity determining region 3 for antibody 15117
VTHYYHDSGIYHDFFNY

SEQ ID NO: 30235 - protein, 8 aa, Homo sapiens
  light chain complementarity determining region 3 for antibody 15118
QQYDTTIT

SEQ ID NO: 30236 - protein, 19 aa, Homo sapiens
  heavy chain complementarity determining region 3 for antibody 15118
ARLESYFDNSGYFREKFRH

SEQ ID NO: 30237 - protein, 8 aa, Homo sapiens
  light chain complementarity determining region 3 for antibody 15119
QQYDTSRT

SEQ ID NO: 30238 - protein, 17 aa, Homo sapiens
  heavy chain complementarity determining region 3 for antibody 15119
ARVHFYGSKAYSYWFDP

SEQ ID NO: 30239 - protein, 8 aa, Homo sapiens
  light chain complementarity determining region 3 for antibody 15120
QQYDSYWA

SEQ ID NO: 30240 - protein, 18 aa, Homo sapiens
  heavy chain complementarity determining region 3 for antibody 15120
AREGEITTHQPLCWFFDL

SEQ ID NO: 30241 - protein, 10 aa, Homo sapiens
  light chain complementarity determining region 3 for antibody 15121
QQYDSYSGEA

SEQ ID NO: 30242 - protein, 21 aa, Homo sapiens
  heavy chain complementarity determining region 3 for antibody 15121
TKDRIAGDSTGYVFIGEYFQD

SEQ ID NO: 30243 - protein, 8 aa, Homo sapiens
  light chain complementarity determining region 3 for antibody 15122
QQYDSYSA

SEQ ID NO: 30244 - protein, 18 aa, Homo sapiens
  heavy chain complementarity determining region 3 for antibody 15122
AREGEITTHQPLGWFFDL

SEQ ID NO: 30245 - protein, 9 aa, Homo sapiens
  light chain complementarity determining region 3 for antibody 15123
QQYDSYPYT

SEQ ID NO: 30246 - protein, 17 aa, Homo sapiens
  heavy chain complementarity determining region 3 for antibody 15123
AREDWSDVDLQTYCFDN

SEQ ID NO: 30247 - protein, 9 aa, Homo sapiens
  light chain complementarity determining region 3 for antibody 15124
QQYDSYPWT

SEQ ID NO: 30248 - protein, 14 aa, Homo sapiens
  heavy chain complementarity determining region 3 for antibody 15124
VKESNIGQYRTADF

SEQ ID NO: 30249 - protein, 9 aa, Homo sapiens
  light chain complementarity determining region 3 for antibody 15125
QQYDSYPWT

SEQ ID NO: 30250 - protein, 14 aa, Homo sapiens
  heavy chain complementarity determining region 3 for antibody 15125
VKESNIGPSRTADF

SEQ ID NO: 30251 - protein, 9 aa, Homo sapiens
  light chain complementarity determining region 3 for antibody 15126
QQYDSYPWP

SEQ ID NO: 30252 - protein, 11 aa, Homo sapiens
  heavy chain complementarity determining region 3 for antibody 15126
ARNRQEGQNDY

SEQ ID NO: 30253 - protein, 9 aa, Homo sapiens
  light chain complementarity determining region 3 for antibody 15127
QQYDSYPST

SEQ ID NO: 30254 - protein, 17 aa, Homo sapiens
  heavy chain complementarity determining region 3 for antibody 15127
ARENWNDVDLRQFYFDF

SEQ ID NO: 30255 - protein, 9 aa, Homo sapiens
  light chain complementarity determining region 3 for antibody 15128
QQYDSYPIT

SEQ ID NO: 30256 - protein, 19 aa, Homo sapiens
  heavy chain complementarity determining region 3 for antibody 15128
AKDIRGGCIGGNRWEMFDS

SEQ ID NO: 30257 - protein, 9 aa, Homo sapiens
  light chain complementarity determining region 3 for antibody 15129
QQYDSYPHT

SEQ ID NO: 30258 - protein, 17 aa, Homo sapiens
  heavy chain complementarity determining region 3 for antibody 15129
ARENWNDVDLRQFYFDF

SEQ ID NO: 30259 - protein, 9 aa, Homo sapiens
  light chain complementarity determining region 3 for antibody 15130
QQYDSSTLT

SEQ ID NO: 30260 - protein, 21 aa, Homo sapiens
  heavy chain complementarity determining region 3 for antibody 15130
AHTESTTIFGVVLSYYNWFDP

SEQ ID NO: 30261 - protein, 9 aa, Homo sapiens
  light chain complementarity determining region 3 for antibody 15131
QQYDSSPWT

SEQ ID NO: 30262 - protein, 17 aa, Homo sapiens
  heavy chain complementarity determining region 3 for antibody 15131
ARGVYGAYLGYYSGMDV

SEQ ID NO: 30263 - protein, 9 aa, Homo sapiens
  light chain complementarity determining region 3 for antibody 15132
QQYDSSPWT

SEQ ID NO: 30264 - protein, 13 aa, Homo sapiens
  heavy chain complementarity determining region 3 for antibody 15132
ARAKWDLFGYFDF

SEQ ID NO: 30265 - protein, 9 aa, Homo sapiens
  light chain complementarity determining region 3 for antibody 15133
QQYDSSPWT

SEQ ID NO: 30266 - protein, 17 aa, Homo sapiens
  heavy chain complementarity determining region 3 for antibody 15133
AGGVYGAYLGYYFGMDV

SEQ ID NO: 30267 - protein, 9 aa, Homo sapiens
  light chain complementarity determining region 3 for antibody 15134
QQYDSSPWP

SEQ ID NO: 30268 - protein, 12 aa, Homo sapiens
  heavy chain complementarity determining region 3 for antibody 15134
VKDPRNSWLPNA

SEQ ID NO: 30269 - protein, 9 aa, Homo sapiens
  light chain complementarity determining region 3 for antibody 15135
QQYDSSPPT

SEQ ID NO: 30270 - protein, 19 aa, Homo sapiens
  heavy chain complementarity determining region 3 for antibody 15135
ARDPTVEGFRPKSDNWFAP

SEQ ID NO: 30271 - protein, 10 aa, Homo sapiens
  light chain complementarity determining region 3 for antibody 15136
QQYDSSELFT

SEQ ID NO: 30272 - protein, 16 aa, Homo sapiens
  heavy chain complementarity determining region 3 for antibody 15136
AREIFKGEIDYYAMDV

SEQ ID NO: 30273 - protein, 10 aa, Homo sapiens
  light chain complementarity determining region 3 for antibody 15137
QQYDSPSLFT

SEQ ID NO: 30274 - protein, 22 aa, Homo sapiens
  heavy chain complementarity determining region 3 for antibody 15137
ARHWYASGSPYGGHYYYFGMDV

SEQ ID NO: 30275 - protein, 9 aa, Homo sapiens
  light chain complementarity determining region 3 for antibody 15138
QQYDSLPYT

SEQ ID NO: 30276 - protein, 17 aa, Homo sapiens
  heavy chain complementarity determining region 3 for antibody 15138
AREDWSDVDLRAFYFDS

SEQ ID NO: 30277 - protein, 9 aa, Homo sapiens
  light chain complementarity determining region 3 for antibody 15139
QQYDSLPLT

SEQ ID NO: 30278 - protein, 18 aa, Homo sapiens
  heavy chain complementarity determining region 3 for antibody 15139
VRAPGDYDMLRRGYYFDH

SEQ ID NO: 30279 - protein, 9 aa, Homo sapiens
  light chain complementarity determining region 3 for antibody 15140
QQYDSLPLT

SEQ ID NO: 30280 - protein, 13 aa, Homo sapiens
  heavy chain complementarity determining region 3 for antibody 15140
TRTYGSGRNWFDP

SEQ ID NO: 30281 - protein, 9 aa, Homo sapiens
  light chain complementarity determining region 3 for antibody 15141
QQYDSLPLT

SEQ ID NO: 30282 - protein, 18 aa, Homo sapiens
  heavy chain complementarity determining region 3 for antibody 15141
SRAPGDYDMLRRGYYFDH

SEQ ID NO: 30283 - protein, 9 aa, Homo sapiens
  light chain complementarity determining region 3 for antibody 15142
QQYDSLPLT

SEQ ID NO: 30284 - protein, 18 aa, Homo sapiens
  heavy chain complementarity determining region 3 for antibody 15142
ASAPGDYDMLRRGYYFDH

SEQ ID NO: 30285 - protein, 9 aa, Homo sapiens
  light chain complementarity determining region 3 for antibody 15143
QQYDSLPLT

SEQ ID NO: 30286 - protein, 17 aa, Homo sapiens
  heavy chain complementarity determining region 3 for antibody 15143
ARLTPYTSNWNPFYCDY

SEQ ID NO: 30287 - protein, 9 aa, Homo sapiens
  light chain complementarity determining region 3 for antibody 15144
QQYDSLPLT

SEQ ID NO: 30288 - protein, 18 aa, Homo sapiens
  heavy chain complementarity determining region 3 for antibody 15144
ARAPGDYGMLRRGYYFDH

SEQ ID NO: 30289 - protein, 9 aa, Homo sapiens
  light chain complementarity determining region 3 for antibody 15145
QQYDSLPLT

SEQ ID NO: 30290 - protein, 18 aa, Homo sapiens
  heavy chain complementarity determining region 3 for antibody 15145
ARAPGDYDMWRRGYYFDH

SEQ ID NO: 30291 - protein, 9 aa, Homo sapiens
  light chain complementarity determining region 3 for antibody 15146
QQYDSLPLT

SEQ ID NO: 30292 - protein, 18 aa, Homo sapiens
  heavy chain complementarity determining region 3 for antibody 15146
ARAPGDYDMLSRGYYFDH

SEQ ID NO: 30293 - protein, 9 aa, Homo sapiens
  light chain complementarity determining region 3 for antibody 15147
QQYDSLPLT

SEQ ID NO: 30294 - protein, 18 aa, Homo sapiens
  heavy chain complementarity determining region 3 for antibody 15147
ARAPGDYDMLRRGYYLDH

SEQ ID NO: 30295 - protein, 9 aa, Homo sapiens
  light chain complementarity determining region 3 for antibody 15148
QQYDSLPLT

SEQ ID NO: 30296 - protein, 18 aa, Homo sapiens
  heavy chain complementarity determining region 3 for antibody 15148
ARAPGDYDMLRRGYYFDP

SEQ ID NO: 30297 - protein, 9 aa, Homo sapiens
  light chain complementarity determining region 3 for antibody 15149
QQYDSLPLT

SEQ ID NO: 30298 - protein, 18 aa, Homo sapiens
  heavy chain complementarity determining region 3 for antibody 15149
ARAPGDYDMLRRGYHFDH

SEQ ID NO: 30299 - protein, 9 aa, Homo sapiens
  light chain complementarity determining region 3 for antibody 15150
QQYDSLPLT

SEQ ID NO: 30300 - protein, 18 aa, Homo sapiens
  heavy chain complementarity determining region 3 for antibody 15150
ARAPGDYDMLRRGYCFDH

SEQ ID NO: 30301 - protein, 9 aa, Homo sapiens
  light chain complementarity determining region 3 for antibody 15151
QQYDSLPLT

SEQ ID NO: 30302 - protein, 18 aa, Homo sapiens
  heavy chain complementarity determining region 3 for antibody 15151
ARAPGDYDMLRQGYYFDH

SEQ ID NO: 30303 - protein, 9 aa, Homo sapiens
  light chain complementarity determining region 3 for antibody 15152
QQYDSLPLT

SEQ ID NO: 30304 - protein, 18 aa, Homo sapiens
  heavy chain complementarity determining region 3 for antibody 15152
ARAPGDSDMLRRGYYFDH

SEQ ID NO: 30305 - protein, 9 aa, Homo sapiens
  light chain complementarity determining region 3 for antibody 15153
QQYDSLPLT

SEQ ID NO: 30306 - protein, 12 aa, Homo sapiens
  heavy chain complementarity determining region 3 for antibody 15153
AKGILGRGGMDV

SEQ ID NO: 30307 - protein, 9 aa, Homo sapiens
  light chain complementarity determining region 3 for antibody 15154
QQYDSLPLT

SEQ ID NO: 30308 - protein, 16 aa, Homo sapiens
  heavy chain complementarity determining region 3 for antibody 15154
AKDKILRDFDWLLFDS

SEQ ID NO: 30309 - protein, 9 aa, Homo sapiens
  light chain complementarity determining region 3 for antibody 15155
QQYDSLPLI

SEQ ID NO: 30310 - protein, 18 aa, Homo sapiens
  heavy chain complementarity determining region 3 for antibody 15155
ARAPGDYDMLRRGYYFDH

SEQ ID NO: 30311 - protein, 9 aa, Homo sapiens
  light chain complementarity determining region 3 for antibody 15156
QQYDSFPYT

SEQ ID NO: 30312 - protein, 17 aa, Homo sapiens
  heavy chain complementarity determining region 3 for antibody 15156
AREDWSDVDLRDFYFDS

SEQ ID NO: 30313 - protein, 9 aa, Homo sapiens
  light chain complementarity determining region 3 for antibody 15157
QQYDSFPYT

SEQ ID NO: 30314 - protein, 17 aa, Homo sapiens
  heavy chain complementarity determining region 3 for antibody 15157
AREDWSDVDLRAFYVDS

SEQ ID NO: 30315 - protein, 9 aa, Homo sapiens
  light chain complementarity determining region 3 for antibody 15158
QQYDSFPYT

SEQ ID NO: 30316 - protein, 17 aa, Homo sapiens
  heavy chain complementarity determining region 3 for antibody 15158
AREDWSDVDLRAFYLDS

SEQ ID NO: 30317 - protein, 9 aa, Homo sapiens
  light chain complementarity determining region 3 for antibody 15159
QQYDSFPYT

SEQ ID NO: 30318 - protein, 17 aa, Homo sapiens
  heavy chain complementarity determining region 3 for antibody 15159
AREDWSDVDLRAFYFDY

SEQ ID NO: 30319 - protein, 9 aa, Homo sapiens
  light chain complementarity determining region 3 for antibody 15160
QQYDSFPYT

SEQ ID NO: 30320 - protein, 17 aa, Homo sapiens
  heavy chain complementarity determining region 3 for antibody 15160
AREDWSDVDLRACYFDS

SEQ ID NO: 30321 - protein, 9 aa, Homo sapiens
  light chain complementarity determining region 3 for antibody 15161
QQYDSFPYT

SEQ ID NO: 30322 - protein, 17 aa, Homo sapiens
  heavy chain complementarity determining region 3 for antibody 15161
AREDWSDVALRAFYFDS

SEQ ID NO: 30323 - protein, 9 aa, Homo sapiens
  light chain complementarity determining region 3 for antibody 15162
QQYDSFPYT

SEQ ID NO: 30324 - protein, 17 aa, Homo sapiens
  heavy chain complementarity determining region 3 for antibody 15162
AREDCSDVDLRAFYFDS

SEQ ID NO: 30325 - protein, 9 aa, Homo sapiens
  light chain complementarity determining region 3 for antibody 15163
QQYDSFPYT

SEQ ID NO: 30326 - protein, 17 aa, Homo sapiens
  heavy chain complementarity determining region 3 for antibody 15163
ARDDWSDVDLRAFYFDS

SEQ ID NO: 30327 - protein, 9 aa, Homo sapiens
  light chain complementarity determining region 3 for antibody 15164
QQYDSFPYT

SEQ ID NO: 30328 - protein, 17 aa, Homo sapiens
  heavy chain complementarity determining region 3 for antibody 15164
AKEDYSDVDLRAFYFDS

SEQ ID NO: 30329 - protein, 9 aa, Homo sapiens
  light chain complementarity determining region 3 for antibody 15165
QQYDSFPPT

SEQ ID NO: 30330 - protein, 17 aa, Homo sapiens
  heavy chain complementarity determining region 3 for antibody 15165
ARHRTTGSLYYYSGMDV

SEQ ID NO: 30331 - protein, 9 aa, Homo sapiens
  light chain complementarity determining region 3 for antibody 15166
QQYDSFPLT

SEQ ID NO: 30332 - protein, 18 aa, Homo sapiens
  heavy chain complementarity determining region 3 for antibody 15166
ARAPGDYDMLRRGYYFDH

SEQ ID NO: 30333 - protein, 9 aa, Homo sapiens
  light chain complementarity determining region 3 for antibody 15167
QQYDSFPHT

SEQ ID NO: 30334 - protein, 17 aa, Homo sapiens
  heavy chain complementarity determining region 3 for antibody 15167
AREDWSDVDLRAFYFDS

SEQ ID NO: 30335 - protein, 9 aa, Homo sapiens
  light chain complementarity determining region 3 for antibody 15168
QQYDSFLYT

SEQ ID NO: 30336 - protein, 17 aa, Homo sapiens
  heavy chain complementarity determining region 3 for antibody 15168
AREDYSDVDLRAFYFDS

SEQ ID NO: 30337 - protein, 8 aa, Homo sapiens
  light chain complementarity determining region 3 for antibody 15169
QQYDQFPT

SEQ ID NO: 30338 - protein, 20 aa, Homo sapiens
  heavy chain complementarity determining region 3 for antibody 15169
ATERGTYFRSGSYYHYPLDY

SEQ ID NO: 30339 - protein, 8 aa, Homo sapiens
  light chain complementarity determining region 3 for antibody 15170
QQYDQFPT

SEQ ID NO: 30340 - protein, 20 aa, Homo sapiens
  heavy chain complementarity determining region 3 for antibody 15170
ATDRGTYFRSGSYYHYPLDD

SEQ ID NO: 30341 - protein, 9 aa, Homo sapiens
  light chain complementarity determining region 3 for antibody 15171
QQYDNWPWT

SEQ ID NO: 30342 - protein, 17 aa, Homo sapiens
  heavy chain complementarity determining region 3 for antibody 15171
VTHYYHDSGIYHDFSNY

SEQ ID NO: 30343 - protein, 9 aa, Homo sapiens
  light chain complementarity determining region 3 for antibody 15172
QQYDNVPIT

SEQ ID NO: 30344 - protein, 16 aa, Homo sapiens
  heavy chain complementarity determining region 3 for antibody 15172
TTRKYSYADASVSFDH

SEQ ID NO: 30345 - protein, 9 aa, Homo sapiens
  light chain complementarity determining region 3 for antibody 15173
QQYDNLPYT

SEQ ID NO: 30346 - protein, 10 aa, Homo sapiens
  heavy chain complementarity determining region 3 for antibody 15173
ARENSWGPDS

SEQ ID NO: 30347 - protein, 9 aa, Homo sapiens
  light chain complementarity determining region 3 for antibody 15174
QQYDNLPYT

SEQ ID NO: 30348 - protein, 10 aa, Homo sapiens
  heavy chain complementarity determining region 3 for antibody 15174
ARENNCGPDS

SEQ ID NO: 30349 - protein, 9 aa, Homo sapiens
  light chain complementarity determining region 3 for antibody 15175
QQYDNLPYT

SEQ ID NO: 30350 - protein, 17 aa, Homo sapiens
  heavy chain complementarity determining region 3 for antibody 15175
ARDMYNGVWGSRGIFDS

SEQ ID NO: 30351 - protein, 10 aa, Homo sapiens
  light chain complementarity determining region 3 for antibody 15176
QQYDNLPSVT

SEQ ID NO: 30352 - protein, 18 aa, Homo sapiens
  heavy chain complementarity determining region 3 for antibody 15176
ARDTSPGDSSAWYDAFDI

SEQ ID NO: 30353 - protein, 10 aa, Homo sapiens
  light chain complementarity determining region 3 for antibody 15177
QQYDNLPSVT

SEQ ID NO: 30354 - protein, 11 aa, Homo sapiens
  heavy chain complementarity determining region 3 for antibody 15177
AKSGGFWSFDH

SEQ ID NO: 30355 - protein, 10 aa, Homo sapiens
  light chain complementarity determining region 3 for antibody 15178
QQYDNLPSVT

SEQ ID NO: 30356 - protein, 11 aa, Homo sapiens
  heavy chain complementarity determining region 3 for antibody 15178
AKSGGFWSCDY

SEQ ID NO: 30357 - protein, 10 aa, Homo sapiens
  light chain complementarity determining region 3 for antibody 15179
QQYDNLPSVT

SEQ ID NO: 30358 - protein, 11 aa, Homo sapiens
  heavy chain complementarity determining region 3 for antibody 15179
AKSGGFLSFDY

SEQ ID NO: 30359 - protein, 10 aa, Homo sapiens
  light chain complementarity determining region 3 for antibody 15180
QQYDNLPSVT

SEQ ID NO: 30360 - protein, 11 aa, Homo sapiens
  heavy chain complementarity determining region 3 for antibody 15180
AKSGGCWSFDY

SEQ ID NO: 30361 - protein, 10 aa, Homo sapiens
  light chain complementarity determining region 3 for antibody 15181
QQYDNLPSVP

SEQ ID NO: 30362 - protein, 11 aa, Homo sapiens
  heavy chain complementarity determining region 3 for antibody 15181
AKSGGCWSFDY

SEQ ID NO: 30363 - protein, 10 aa, Homo sapiens
  light chain complementarity determining region 3 for antibody 15182
QQYDNLPPVT

SEQ ID NO: 30364 - protein, 11 aa, Homo sapiens
  heavy chain complementarity determining region 3 for antibody 15182
AKSGGFWSFDY

SEQ ID NO: 30365 - protein, 9 aa, Homo sapiens
  light chain complementarity determining region 3 for antibody 15183
QQYDNLPPT

SEQ ID NO: 30366 - protein, 17 aa, Homo sapiens
  heavy chain complementarity determining region 3 for antibody 15183
ARVRDSSNYYVAEYFQY

SEQ ID NO: 30367 - protein, 9 aa, Homo sapiens
  light chain complementarity determining region 3 for antibody 15184
QQYDNLPPT

SEQ ID NO: 30368 - protein, 18 aa, Homo sapiens
  heavy chain complementarity determining region 3 for antibody 15184
ARAPGDYDMLRRGYYFDH

SEQ ID NO: 30369 - protein, 10 aa, Homo sapiens
  light chain complementarity determining region 3 for antibody 15185
QQYDNLPPST

SEQ ID NO: 30370 - protein, 16 aa, Homo sapiens
  heavy chain complementarity determining region 3 for antibody 15185
ARELFKGEYDYYAMDV

SEQ ID NO: 30371 - protein, 10 aa, Homo sapiens
  light chain complementarity determining region 3 for antibody 15186
QQYDNLPPLT

SEQ ID NO: 30372 - protein, 20 aa, Homo sapiens
  heavy chain complementarity determining region 3 for antibody 15186
AKHTDLYFGTERTVGYWCDS

SEQ ID NO: 30373 - protein, 10 aa, Homo sapiens
  light chain complementarity determining region 3 for antibody 15187
QQYDNLPPIT

SEQ ID NO: 30374 - protein, 15 aa, Homo sapiens
  heavy chain complementarity determining region 3 for antibody 15187
AKDTEYTDGFGAMDV

SEQ ID NO: 30375 - protein, 11 aa, Homo sapiens
  light chain complementarity determining region 3 for antibody 15188
QQYDNLPPGNT

SEQ ID NO: 30376 - protein, 21 aa, Homo sapiens
  heavy chain complementarity determining region 3 for antibody 15188
ARSKGPTRSGSHWDYYYGMDV

SEQ ID NO: 30377 - protein, 10 aa, Homo sapiens
  light chain complementarity determining region 3 for antibody 15189
QQYDNLPPFT

SEQ ID NO: 30378 - protein, 16 aa, Homo sapiens
  heavy chain complementarity determining region 3 for antibody 15189
SRELFKGEYDYYAMDV

SEQ ID NO: 30379 - protein, 10 aa, Homo sapiens
  light chain complementarity determining region 3 for antibody 15190
QQYDNLPPFT

SEQ ID NO: 30380 - protein, 16 aa, Homo sapiens
  heavy chain complementarity determining region 3 for antibody 15190
ARELLKGEYDYYAMDV

SEQ ID NO: 30381 - protein, 10 aa, Homo sapiens
  light chain complementarity determining region 3 for antibody 15191
QQYDNLPPFT

SEQ ID NO: 30382 - protein, 16 aa, Homo sapiens
  heavy chain complementarity determining region 3 for antibody 15191
ARELFKGEYGYYAMDV

SEQ ID NO: 30383 - protein, 10 aa, Homo sapiens
  light chain complementarity determining region 3 for antibody 15192
QQYDNLPPFT

SEQ ID NO: 30384 - protein, 16 aa, Homo sapiens
  heavy chain complementarity determining region 3 for antibody 15192
ARELFKGEYDYYARDV

SEQ ID NO: 30385 - protein, 10 aa, Homo sapiens
  light chain complementarity determining region 3 for antibody 15193
QQYDNLPPFT

SEQ ID NO: 30386 - protein, 16 aa, Homo sapiens
  heavy chain complementarity determining region 3 for antibody 15193
ARELFKGEYDYYAMGV

SEQ ID NO: 30387 - protein, 10 aa, Homo sapiens
  light chain complementarity determining region 3 for antibody 15194
QQYDNLPPFT

SEQ ID NO: 30388 - protein, 16 aa, Homo sapiens
  heavy chain complementarity determining region 3 for antibody 15194
ARELFKGEYDYYAIDV

SEQ ID NO: 30389 - protein, 10 aa, Homo sapiens
  light chain complementarity determining region 3 for antibody 15195
QQYDNLPPFT

SEQ ID NO: 30390 - protein, 16 aa, Homo sapiens
  heavy chain complementarity determining region 3 for antibody 15195
ARELFKGEYDYHAMDV

SEQ ID NO: 30391 - protein, 10 aa, Homo sapiens
  light chain complementarity determining region 3 for antibody 15196
QQYDNLPPFT

SEQ ID NO: 30392 - protein, 16 aa, Homo sapiens
  heavy chain complementarity determining region 3 for antibody 15196
ARELFKGEHDYYAMDV

SEQ ID NO: 30393 - protein, 10 aa, Homo sapiens
  light chain complementarity determining region 3 for antibody 15197
QQYDNLPPFA

SEQ ID NO: 30394 - protein, 16 aa, Homo sapiens
  heavy chain complementarity determining region 3 for antibody 15197
ARELFKGEYDYYAMDV

SEQ ID NO: 30395 - protein, 9 aa, Homo sapiens
  light chain complementarity determining region 3 for antibody 15198
QQYDNLPLT

SEQ ID NO: 30396 - protein, 13 aa, Homo sapiens
  heavy chain complementarity determining region 3 for antibody 15198
VREAMFYGDPLDS

SEQ ID NO: 30397 - protein, 9 aa, Homo sapiens
  light chain complementarity determining region 3 for antibody 15199
QQYDNLPLT

SEQ ID NO: 30398 - protein, 17 aa, Homo sapiens
  heavy chain complementarity determining region 3 for antibody 15199
VKGSTTMVRGDYYGMDV

SEQ ID NO: 30399 - protein, 9 aa, Homo sapiens
  light chain complementarity determining region 3 for antibody 15200
QQYDNLPLT

SEQ ID NO: 30400 - protein, 18 aa, Homo sapiens
  heavy chain complementarity determining region 3 for antibody 15200
TRAPGDYDMLRRGYYFDH

SEQ ID NO: 30401 - protein, 9 aa, Homo sapiens
  light chain complementarity determining region 3 for antibody 15201
QQYDNLPLT

SEQ ID NO: 30402 - protein, 18 aa, Homo sapiens
  heavy chain complementarity determining region 3 for antibody 15201
SRAPGDYDMLRRGYYFDH

SEQ ID NO: 30403 - protein, 9 aa, Homo sapiens
  light chain complementarity determining region 3 for antibody 15202
QQYDNLPLT

SEQ ID NO: 30404 - protein, 23 aa, Homo sapiens
  heavy chain complementarity determining region 3 for antibody 15202
ATGRGEGIVAAGRGRYHYYAMDA

SEQ ID NO: 30405 - protein, 9 aa, Homo sapiens
  light chain complementarity determining region 3 for antibody 15203
QQYDNLPLT

SEQ ID NO: 30406 - protein, 22 aa, Homo sapiens
  heavy chain complementarity determining region 3 for antibody 15203
ARLTLSPNPDSSGYYHGRYFDY

SEQ ID NO: 30407 - protein, 9 aa, Homo sapiens
  light chain complementarity determining region 3 for antibody 15204
QQYDNLPLT

SEQ ID NO: 30408 - protein, 22 aa, Homo sapiens
  heavy chain complementarity determining region 3 for antibody 15204
ARHSGYSNTWYMNYYYYYGMDV

SEQ ID NO: 30409 - protein, 9 aa, Homo sapiens
  light chain complementarity determining region 3 for antibody 15205
QQYDNLPLT

SEQ ID NO: 30410 - protein, 14 aa, Homo sapiens
  heavy chain complementarity determining region 3 for antibody 15205
ARDSGWDIHDIPGF

SEQ ID NO: 30411 - protein, 9 aa, Homo sapiens
  light chain complementarity determining region 3 for antibody 15206
QQYDNLPLT

SEQ ID NO: 30412 - protein, 14 aa, Homo sapiens
  heavy chain complementarity determining region 3 for antibody 15206
ARDQATVVRGVLDY

SEQ ID NO: 30413 - protein, 9 aa, Homo sapiens
  light chain complementarity determining region 3 for antibody 15207
QQYDNLPLT

SEQ ID NO: 30414 - protein, 18 aa, Homo sapiens
  heavy chain complementarity determining region 3 for antibody 15207
ARDPGDYDMLRRGYYFDH

SEQ ID NO: 30415 - protein, 9 aa, Homo sapiens
  light chain complementarity determining region 3 for antibody 15208
QQYDNLPLT

SEQ ID NO: 30416 - protein, 18 aa, Homo sapiens
  heavy chain complementarity determining region 3 for antibody 15208
ARAPGDYDVLRRGYYFDH

SEQ ID NO: 30417 - protein, 9 aa, Homo sapiens
  light chain complementarity determining region 3 for antibody 15209
QQYDNLPLT

SEQ ID NO: 30418 - protein, 18 aa, Homo sapiens
  heavy chain complementarity determining region 3 for antibody 15209
ARAPGDYDRLRRGYYFDH

SEQ ID NO: 30419 - protein, 9 aa, Homo sapiens
  light chain complementarity determining region 3 for antibody 15210
QQYDNLPLT

SEQ ID NO: 30420 - protein, 18 aa, Homo sapiens
  heavy chain complementarity determining region 3 for antibody 15210
ARAPGDYDMLRRGYYCDH

SEQ ID NO: 30421 - protein, 9 aa, Homo sapiens
  light chain complementarity determining region 3 for antibody 15211
QQYDNLPLT

SEQ ID NO: 30422 - protein, 18 aa, Homo sapiens
  heavy chain complementarity determining region 3 for antibody 15211
ARAPGDYDMLRRGYDFDH

SEQ ID NO: 30423 - protein, 9 aa, Homo sapiens
  light chain complementarity determining region 3 for antibody 15212
QQYDNLPLT

SEQ ID NO: 30424 - protein, 18 aa, Homo sapiens
  heavy chain complementarity determining region 3 for antibody 15212
ARAPGDYDMLRRGHYFDH

SEQ ID NO: 30425 - protein, 9 aa, Homo sapiens
  light chain complementarity determining region 3 for antibody 15213
QQYDNLPLT

SEQ ID NO: 30426 - protein, 18 aa, Homo sapiens
  heavy chain complementarity determining region 3 for antibody 15213
AGAPGDYDMLRRGYYFDH

SEQ ID NO: 30427 - protein, 9 aa, Homo sapiens
  light chain complementarity determining region 3 for antibody 15214
QQYDNLPLP

SEQ ID NO: 30428 - protein, 18 aa, Homo sapiens
  heavy chain complementarity determining region 3 for antibody 15214
ARAPGDYDMLRRGYYFDH

SEQ ID NO: 30429 - protein, 9 aa, Homo sapiens
  light chain complementarity determining region 3 for antibody 15215
QQYDNLPLN

SEQ ID NO: 30430 - protein, 18 aa, Homo sapiens
  heavy chain complementarity determining region 3 for antibody 15215
ARAPGDYDMLRRGYYFDH

SEQ ID NO: 30431 - protein, 9 aa, Homo sapiens
  light chain complementarity determining region 3 for antibody 15216
QQYDNLPHT

SEQ ID NO: 30432 - protein, 17 aa, Homo sapiens
  heavy chain complementarity determining region 3 for antibody 15216
ARAPPVEYYDSSGYCNY

SEQ ID NO: 30433 - protein, 10 aa, Homo sapiens
  light chain complementarity determining region 3 for antibody 15217
QQYDNLPHFT

SEQ ID NO: 30434 - protein, 16 aa, Homo sapiens
  heavy chain complementarity determining region 3 for antibody 15217
ARELFKGEYDYYAMDV

SEQ ID NO: 30435 - protein, 8 aa, Homo sapiens
  light chain complementarity determining region 3 for antibody 15218
QQYDNLLT

SEQ ID NO: 30436 - protein, 19 aa, Homo sapiens
  heavy chain complementarity determining region 3 for antibody 15218
AKDRSVNAAMDYYYSGMDV

SEQ ID NO: 30437 - protein, 8 aa, Homo sapiens
  light chain complementarity determining region 3 for antibody 15219
QQYDNLLT

SEQ ID NO: 30438 - protein, 20 aa, Homo sapiens
  heavy chain complementarity determining region 3 for antibody 15219
AKDRSVNAAMDYYYDSGMDV

SEQ ID NO: 30439 - protein, 8 aa, Homo sapiens
  light chain complementarity determining region 3 for antibody 15220
QQYDNLLT

SEQ ID NO: 30440 - protein, 20 aa, Homo sapiens
  heavy chain complementarity determining region 3 for antibody 15220
AKDRSVNAAMDHYYYSGMDV

SEQ ID NO: 30441 - protein, 8 aa, Homo sapiens
  light chain complementarity determining region 3 for antibody 15221
QQYDNLLP

SEQ ID NO: 30442 - protein, 20 aa, Homo sapiens
  heavy chain complementarity determining region 3 for antibody 15221
ARDRSVNAAMDYYFYSGMDV

SEQ ID NO: 30443 - protein, 9 aa, Homo sapiens
  light chain complementarity determining region 3 for antibody 15222
QQYDNLLFT

SEQ ID NO: 30444 - protein, 11 aa, Homo sapiens
  heavy chain complementarity determining region 3 for antibody 15222
ARVNYGSGFDH

SEQ ID NO: 30445 - protein, 8 aa, Homo sapiens
  light chain complementarity determining region 3 for antibody 15223
QQYDNLIT

SEQ ID NO: 30446 - protein, 21 aa, Homo sapiens
  heavy chain complementarity determining region 3 for antibody 15223
AKDRSADTTMDGYYYYSAVDV

SEQ ID NO: 30447 - protein, 9 aa, Homo sapiens
  light chain complementarity determining region 3 for antibody 15224
QQYDNLHLT

SEQ ID NO: 30448 - protein, 18 aa, Homo sapiens
  heavy chain complementarity determining region 3 for antibody 15224
ARAPGDYDMLRRGYYFDH

SEQ ID NO: 30449 - protein, 7 aa, Homo sapiens
  light chain complementarity determining region 3 for antibody 15225
QQYDNLF

SEQ ID NO: 30450 - protein, 13 aa, Homo sapiens
  heavy chain complementarity determining region 3 for antibody 15225
ASGRHSGYDYFDY

SEQ ID NO: 30451 - protein, 7 aa, Homo sapiens
  light chain complementarity determining region 3 for antibody 15226
QQYDNLF

SEQ ID NO: 30452 - protein, 13 aa, Homo sapiens
  heavy chain complementarity determining region 3 for antibody 15226
ASGPHSGYDYFDY

SEQ ID NO: 30453 - protein, 7 aa, Homo sapiens
  light chain complementarity determining region 3 for antibody 15227
QQYDNLF

SEQ ID NO: 30454 - protein, 13 aa, Homo sapiens
  heavy chain complementarity determining region 3 for antibody 15227
ASGLHSGYDCFDY

SEQ ID NO: 30455 - protein, 9 aa, Homo sapiens
  light chain complementarity determining region 3 for antibody 15228
QQYDNIPYT

SEQ ID NO: 30456 - protein, 10 aa, Homo sapiens
  heavy chain complementarity determining region 3 for antibody 15228
AREGVPDFDF

SEQ ID NO: 30457 - protein, 10 aa, Homo sapiens
  light chain complementarity determining region 3 for antibody 15229
QQYDNIPSVT

SEQ ID NO: 30458 - protein, 11 aa, Homo sapiens
  heavy chain complementarity determining region 3 for antibody 15229
AKSGGFWSFDY

SEQ ID NO: 30459 - protein, 9 aa, Homo sapiens
  light chain complementarity determining region 3 for antibody 15230
QQYDNIPLT

SEQ ID NO: 30460 - protein, 13 aa, Homo sapiens
  heavy chain complementarity determining region 3 for antibody 15230
VRESMFYGDPLDS

SEQ ID NO: 30461 - protein, 9 aa, Homo sapiens
  light chain complementarity determining region 3 for antibody 15231
QQYDNIPLT

SEQ ID NO: 30462 - protein, 18 aa, Homo sapiens
  heavy chain complementarity determining region 3 for antibody 15231
VRAPGDYDMLRRGYYFDH

SEQ ID NO: 30463 - protein, 8 aa, Homo sapiens
  light chain complementarity determining region 3 for antibody 15232
QQYDNILT

SEQ ID NO: 30464 - protein, 11 aa, Homo sapiens
  heavy chain complementarity determining region 3 for antibody 15232
GRSHTENAFDI

SEQ ID NO: 30465 - protein, 9 aa, Homo sapiens
  light chain complementarity determining region 3 for antibody 15233
QQYDNFPTT

SEQ ID NO: 30466 - protein, 20 aa, Homo sapiens
  heavy chain complementarity determining region 3 for antibody 15233
ARLLGYCSGGSCQAHKLFDF

SEQ ID NO: 30467 - protein, 10 aa, Homo sapiens
  light chain complementarity determining region 3 for antibody 15234
QQYDNFPPYT

SEQ ID NO: 30468 - protein, 11 aa, Homo sapiens
  heavy chain complementarity determining region 3 for antibody 15234
ARERTTVTFDY

SEQ ID NO: 30469 - protein, 9 aa, Homo sapiens
  light chain complementarity determining region 3 for antibody 15235
QQYDNFPPT

SEQ ID NO: 30470 - protein, 20 aa, Homo sapiens
  heavy chain complementarity determining region 3 for antibody 15235
ARLLGYCSGGSCQAHKRFDF

SEQ ID NO: 30471 - protein, 11 aa, Homo sapiens
  light chain complementarity determining region 3 for antibody 15236
QQYDNFPPRFT

SEQ ID NO: 30472 - protein, 9 aa, Homo sapiens
  heavy chain complementarity determining region 3 for antibody 15236
TRRMFGFDY

SEQ ID NO: 30473 - protein, 9 aa, Homo sapiens
  light chain complementarity determining region 3 for antibody 15237
QQYDNFPLT

SEQ ID NO: 30474 - protein, 13 aa, Homo sapiens
  heavy chain complementarity determining region 3 for antibody 15237
TTDPRGTDGRGNW

SEQ ID NO: 30475 - protein, 8 aa, Homo sapiens
  light chain complementarity determining region 3 for antibody 15238
QQYDNFLT

SEQ ID NO: 30476 - protein, 20 aa, Homo sapiens
  heavy chain complementarity determining region 3 for antibody 15238
AKDRSVNAAMDYYYYSGMDV

SEQ ID NO: 30477 - protein, 9 aa, Homo sapiens
  light chain complementarity determining region 3 for antibody 15239
QQYDNFLPT

SEQ ID NO: 30478 - protein, 20 aa, Homo sapiens
  heavy chain complementarity determining region 3 for antibody 15239
ARLLGYCSGGSCQAHKLFDF

SEQ ID NO: 30479 - protein, 9 aa, Homo sapiens
  light chain complementarity determining region 3 for antibody 15240
QQYDNAPIT

SEQ ID NO: 30480 - protein, 16 aa, Homo sapiens
  heavy chain complementarity determining region 3 for antibody 15240
TTRKYSYAYASVSFDH

SEQ ID NO: 30481 - protein, 9 aa, Homo sapiens
  light chain complementarity determining region 3 for antibody 15241
QQYDKVPLT

SEQ ID NO: 30482 - protein, 20 aa, Homo sapiens
  heavy chain complementarity determining region 3 for antibody 15241
AKDRRRDTSMDYCYYSAMGV

SEQ ID NO: 30483 - protein, 9 aa, Homo sapiens
  light chain complementarity determining region 3 for antibody 15242
QQYDKVPLA

SEQ ID NO: 30484 - protein, 20 aa, Homo sapiens
  heavy chain complementarity determining region 3 for antibody 15242
AKDRRRDTSMDYFYYSAMGV

SEQ ID NO: 30485 - protein, 9 aa, Homo sapiens
  light chain complementarity determining region 3 for antibody 15243
QQYDHYAHT

SEQ ID NO: 30486 - protein, 14 aa, Homo sapiens
  heavy chain complementarity determining region 3 for antibody 15243
ARDVHTTGWTLGGY

SEQ ID NO: 30487 - protein, 9 aa, Homo sapiens
  light chain complementarity determining region 3 for antibody 15244
QQYDHFSLT

SEQ ID NO: 30488 - protein, 14 aa, Homo sapiens
  heavy chain complementarity determining region 3 for antibody 15244
VRQVVTAVRWPFEY

SEQ ID NO: 30489 - protein, 8 aa, Homo sapiens
  light chain complementarity determining region 3 for antibody 15245
QQYDHFPT

SEQ ID NO: 30490 - protein, 20 aa, Homo sapiens
  heavy chain complementarity determining region 3 for antibody 15245
ATDRGTYFRSGSYYHYPLDY

SEQ ID NO: 30491 - protein, 11 aa, Homo sapiens
  light chain complementarity determining region 3 for antibody 15246
QQYDGSPPMYT

SEQ ID NO: 30492 - protein, 12 aa, Homo sapiens
  heavy chain complementarity determining region 3 for antibody 15246
AHRPLTRGWFDP

SEQ ID NO: 30493 - protein, 9 aa, Homo sapiens
  light chain complementarity determining region 3 for antibody 15247
QQYDELPLT

SEQ ID NO: 30494 - protein, 21 aa, Homo sapiens
  heavy chain complementarity determining region 3 for antibody 15247
ARDLVHYASSGHYGGSDHFQR

SEQ ID NO: 30495 - protein, 9 aa, Homo sapiens
  light chain complementarity determining region 3 for antibody 15248
QQYDELPIT

SEQ ID NO: 30496 - protein, 21 aa, Homo sapiens
  heavy chain complementarity determining region 3 for antibody 15248
ARDMVHYASSGHYGGSDHFQR

SEQ ID NO: 30497 - protein, 9 aa, Homo sapiens
  light chain complementarity determining region 3 for antibody 15249
QQYDELPIT

SEQ ID NO: 30498 - protein, 21 aa, Homo sapiens
  heavy chain complementarity determining region 3 for antibody 15249
ARDLVHYASSGPYGGSDHFQR

SEQ ID NO: 30499 - protein, 8 aa, Homo sapiens
  light chain complementarity determining region 3 for antibody 15250
QQYDDLRS

SEQ ID NO: 30500 - protein, 18 aa, Homo sapiens
  heavy chain complementarity determining region 3 for antibody 15250
ARESVYFGELSTYCFFDS

SEQ ID NO: 30501 - protein, 10 aa, Homo sapiens
  light chain complementarity determining region 3 for antibody 15251
QQYDDLPPFT

SEQ ID NO: 30502 - protein, 9 aa, Homo sapiens
  heavy chain complementarity determining region 3 for antibody 15251
ARYFGAFEM

SEQ ID NO: 30503 - protein, 9 aa, Homo sapiens
  light chain complementarity determining region 3 for antibody 15252
QQYDDLPLT

SEQ ID NO: 30504 - protein, 21 aa, Homo sapiens
  heavy chain complementarity determining region 3 for antibody 15252
ARALPTEYCSSGDYSLGIFDS

SEQ ID NO: 30505 - protein, 9 aa, Homo sapiens
  light chain complementarity determining region 3 for antibody 15253
QQYDCLPLT

SEQ ID NO: 30506 - protein, 18 aa, Homo sapiens
  heavy chain complementarity determining region 3 for antibody 15253
ARAPGDYDMLRRGYYFDH

SEQ ID NO: 30507 - protein, 9 aa, Homo sapiens
  light chain complementarity determining region 3 for antibody 15254
QQYDAYPLT

SEQ ID NO: 30508 - protein, 19 aa, Homo sapiens
  heavy chain complementarity determining region 3 for antibody 15254
ARDRSDTSMDPGGEGCFDH

SEQ ID NO: 30509 - protein, 9 aa, Homo sapiens
  light chain complementarity determining region 3 for antibody 15255
QQYDAFPYT

SEQ ID NO: 30510 - protein, 17 aa, Homo sapiens
  heavy chain complementarity determining region 3 for antibody 15255
AREDYSDVDLRAFYLDS

SEQ ID NO: 30511 - protein, 9 aa, Homo sapiens
  light chain complementarity determining region 3 for antibody 15256
QQYDAFPYN

SEQ ID NO: 30512 - protein, 17 aa, Homo sapiens
  heavy chain complementarity determining region 3 for antibody 15256
AREDYSDVDLRAFYFDS

SEQ ID NO: 30513 - protein, 9 aa, Homo sapiens
  light chain complementarity determining region 3 for antibody 15257
QQYCSSPYT

SEQ ID NO: 30514 - protein, 12 aa, Homo sapiens
  heavy chain complementarity determining region 3 for antibody 15257
ARRSWDSGYDPS

SEQ ID NO: 30515 - protein, 9 aa, Homo sapiens
  light chain complementarity determining region 3 for antibody 15258
QQYCSSATT

SEQ ID NO: 30516 - protein, 23 aa, Homo sapiens
  heavy chain complementarity determining region 3 for antibody 15258
ARQPRSPSSWGIVAAGTINWFDP

SEQ ID NO: 30517 - protein, 9 aa, Homo sapiens
  light chain complementarity determining region 3 for antibody 15259
QQYATSRGT

SEQ ID NO: 30518 - protein, 21 aa, Homo sapiens
  heavy chain complementarity determining region 3 for antibody 15259
ARDRGGDFHHGSAYYYRPLDY

SEQ ID NO: 30519 - protein, 9 aa, Homo sapiens
  light chain complementarity determining region 3 for antibody 15260
QQYASYPYT

SEQ ID NO: 30520 - protein, 17 aa, Homo sapiens
  heavy chain complementarity determining region 3 for antibody 15260
ARENWNDVDLRQFYFDF

SEQ ID NO: 30521 - protein, 8 aa, Homo sapiens
  light chain complementarity determining region 3 for antibody 15261
QQYASSKT

SEQ ID NO: 30522 - protein, 10 aa, Homo sapiens
  heavy chain complementarity determining region 3 for antibody 15261
AREGAGRFDY

SEQ ID NO: 30523 - protein, 10 aa, Homo sapiens
  light chain complementarity determining region 3 for antibody 15262
QQYASSALYT

SEQ ID NO: 30524 - protein, 16 aa, Homo sapiens
  heavy chain complementarity determining region 3 for antibody 15262
ARELFKGEYDYYAMDV

SEQ ID NO: 30525 - protein, 10 aa, Homo sapiens
  light chain complementarity determining region 3 for antibody 15263
QQYASSALFT

SEQ ID NO: 30526 - protein, 16 aa, Homo sapiens
  heavy chain complementarity determining region 3 for antibody 15263
ARELFKGEYDYYALDV

SEQ ID NO: 30527 - protein, 9 aa, Homo sapiens
  light chain complementarity determining region 3 for antibody 15264
QQYASLPLT

SEQ ID NO: 30528 - protein, 18 aa, Homo sapiens
  heavy chain complementarity determining region 3 for antibody 15264
ARAPGDYDMLRRGYYFDH

SEQ ID NO: 30529 - protein, 11 aa, Homo sapiens
  light chain complementarity determining region 3 for antibody 15265
QQVSPYEQGIT

SEQ ID NO: 30530 - protein, 17 aa, Homo sapiens
  heavy chain complementarity determining region 3 for antibody 15265
ARERQYCYGDRCYGEDL

SEQ ID NO: 30531 - protein, 11 aa, Homo sapiens
  light chain complementarity determining region 3 for antibody 15266
QQVSHYEQGIT

SEQ ID NO: 30532 - protein, 17 aa, Homo sapiens
  heavy chain complementarity determining region 3 for antibody 15266
ARERQYCYGNRCYGEDL

SEQ ID NO: 30533 - protein, 11 aa, Homo sapiens
  light chain complementarity determining region 3 for antibody 15267
QQVSHYEQGIT

SEQ ID NO: 30534 - protein, 17 aa, Homo sapiens
  heavy chain complementarity determining region 3 for antibody 15267
ARERQYCYGDRCYREDL

SEQ ID NO: 30535 - protein, 11 aa, Homo sapiens
  light chain complementarity determining region 3 for antibody 15268
QQVSHYEQGIT

SEQ ID NO: 30536 - protein, 17 aa, Homo sapiens
  heavy chain complementarity determining region 3 for antibody 15268
ARERQYCYGDRCYGGDL

SEQ ID NO: 30537 - protein, 11 aa, Homo sapiens
  light chain complementarity determining region 3 for antibody 15269
QQVSHYEQGFT

SEQ ID NO: 30538 - protein, 17 aa, Homo sapiens
  heavy chain complementarity determining region 3 for antibody 15269
ARERQYCYGDRCYGEDL

SEQ ID NO: 30539 - protein, 9 aa, Homo sapiens
  light chain complementarity determining region 3 for antibody 15270
QQVNTYPLT

SEQ ID NO: 30540 - protein, 18 aa, Homo sapiens
  heavy chain complementarity determining region 3 for antibody 15270
ARYEGYGDSPTVYYGLDV

SEQ ID NO: 30541 - protein, 9 aa, Homo sapiens
  light chain complementarity determining region 3 for antibody 15271
QQVNTYPLT

SEQ ID NO: 30542 - protein, 18 aa, Homo sapiens
  heavy chain complementarity determining region 3 for antibody 15271
ARYEDYGDSPTVYYGLDA

SEQ ID NO: 30543 - protein, 9 aa, Homo sapiens
  light chain complementarity determining region 3 for antibody 15272
QQVNTYPLT

SEQ ID NO: 30544 - protein, 17 aa, Homo sapiens
  heavy chain complementarity determining region 3 for antibody 15272
AKDLSGVHYDIHHGLDV

SEQ ID NO: 30545 - protein, 9 aa, Homo sapiens
  light chain complementarity determining region 3 for antibody 15273
QQVNSYGYT

SEQ ID NO: 30546 - protein, 16 aa, Homo sapiens
  heavy chain complementarity determining region 3 for antibody 15273
ATTTGYSNYYYYGMDV

SEQ ID NO: 30547 - protein, 9 aa, Homo sapiens
  light chain complementarity determining region 3 for antibody 15274
QQVNSYDYT

SEQ ID NO: 30548 - protein, 16 aa, Homo sapiens
  heavy chain complementarity determining region 3 for antibody 15274
ATTTGYSNYYSYGMDV

SEQ ID NO: 30549 - protein, 9 aa, Homo sapiens
  light chain complementarity determining region 3 for antibody 15275
QQVNSYDYT

SEQ ID NO: 30550 - protein, 16 aa, Homo sapiens
  heavy chain complementarity determining region 3 for antibody 15275
ATTTGYSNYYFYGMDV

SEQ ID NO: 30551 - protein, 9 aa, Homo sapiens
  light chain complementarity determining region 3 for antibody 15276
QQVNSYDYT

SEQ ID NO: 30552 - protein, 16 aa, Homo sapiens
  heavy chain complementarity determining region 3 for antibody 15276
ATTAGYSNYYYYGMDV

SEQ ID NO: 30553 - protein, 9 aa, Homo sapiens
  light chain complementarity determining region 3 for antibody 15277
QQVNSYDYT

SEQ ID NO: 30554 - protein, 16 aa, Homo sapiens
  heavy chain complementarity determining region 3 for antibody 15277
ASTTSFSNKYYYGMDV

SEQ ID NO: 30555 - protein, 9 aa, Homo sapiens
  light chain complementarity determining region 3 for antibody 15278
QQVNSYDYT

SEQ ID NO: 30556 - protein, 16 aa, Homo sapiens
  heavy chain complementarity determining region 3 for antibody 15278
ASTTGLSNKYYYGMDV

SEQ ID NO: 30557 - protein, 9 aa, Homo sapiens
  light chain complementarity determining region 3 for antibody 15279
QQVNSYDYT

SEQ ID NO: 30558 - protein, 16 aa, Homo sapiens
  heavy chain complementarity determining region 3 for antibody 15279
ASTTGFTNKYYYGMDV

SEQ ID NO: 30559 - protein, 9 aa, Homo sapiens
  light chain complementarity determining region 3 for antibody 15280
QQVNSYDYT

SEQ ID NO: 30560 - protein, 16 aa, Homo sapiens
  heavy chain complementarity determining region 3 for antibody 15280
ASTTGFSNKYYYGVDV

SEQ ID NO: 30561 - protein, 9 aa, Homo sapiens
  light chain complementarity determining region 3 for antibody 15281
QQVNSYDYT

SEQ ID NO: 30562 - protein, 16 aa, Homo sapiens
  heavy chain complementarity determining region 3 for antibody 15281
AATTGYSNYYYYGMDV

SEQ ID NO: 30563 - protein, 9 aa, Homo sapiens
  light chain complementarity determining region 3 for antibody 15282
QQVNSYDYP

SEQ ID NO: 30564 - protein, 16 aa, Homo sapiens
  heavy chain complementarity determining region 3 for antibody 15282
ATTTGYSNYYYYGMDV

SEQ ID NO: 30565 - protein, 9 aa, Homo sapiens
  light chain complementarity determining region 3 for antibody 15283
QQVNSYDYP

SEQ ID NO: 30566 - protein, 16 aa, Homo sapiens
  heavy chain complementarity determining region 3 for antibody 15283
ASTTGFSNKYYYGMDV

SEQ ID NO: 30567 - protein, 9 aa, Homo sapiens
  light chain complementarity determining region 3 for antibody 15284
QQVNSYAYT

SEQ ID NO: 30568 - protein, 16 aa, Homo sapiens
  heavy chain complementarity determining region 3 for antibody 15284
ASTTGFSNKYYYGMDV

SEQ ID NO: 30569 - protein, 9 aa, Homo sapiens
  light chain complementarity determining region 3 for antibody 15285
QQVNSVPWT

SEQ ID NO: 30570 - protein, 17 aa, Homo sapiens
  heavy chain complementarity determining region 3 for antibody 15285
ARVHDSSNYHVAEYFQY

SEQ ID NO: 30571 - protein, 9 aa, Homo sapiens
  light chain complementarity determining region 3 for antibody 15286
QQVNSSDYT

SEQ ID NO: 30572 - protein, 16 aa, Homo sapiens
  heavy chain complementarity determining region 3 for antibody 15286
ASTTGFSNKYYYGMDV

SEQ ID NO: 30573 - protein, 9 aa, Homo sapiens
  light chain complementarity determining region 3 for antibody 15287
QQVMNFPIT

SEQ ID NO: 30574 - protein, 11 aa, Homo sapiens
  heavy chain complementarity determining region 3 for antibody 15287
ARNYGSSGFDY

SEQ ID NO: 30575 - protein, 9 aa, Homo sapiens
  light chain complementarity determining region 3 for antibody 15288
QQVMNFPIT

SEQ ID NO: 30576 - protein, 12 aa, Homo sapiens
  heavy chain complementarity determining region 3 for antibody 15288
AKGILGRGGMDV

SEQ ID NO: 30577 - protein, 9 aa, Homo sapiens
  light chain complementarity determining region 3 for antibody 15289
QQVDSLPFT

SEQ ID NO: 30578 - protein, 19 aa, Homo sapiens
  heavy chain complementarity determining region 3 for antibody 15289
ARSDYSGDTDRYYDYGMDV

SEQ ID NO: 30579 - protein, 9 aa, Homo sapiens
  light chain complementarity determining region 3 for antibody 15290
QQTYSVPQT

SEQ ID NO: 30580 - protein, 18 aa, Homo sapiens
  heavy chain complementarity determining region 3 for antibody 15290
ARVRGEAYGSGWISVSDY

SEQ ID NO: 30581 - protein, 9 aa, Homo sapiens
  light chain complementarity determining region 3 for antibody 15291
QQTYSVPQT

SEQ ID NO: 30582 - protein, 18 aa, Homo sapiens
  heavy chain complementarity determining region 3 for antibody 15291
ARVRGEAYGSGWISVFGY

SEQ ID NO: 30583 - protein, 9 aa, Homo sapiens
  light chain complementarity determining region 3 for antibody 15292
QQTYSVPQN

SEQ ID NO: 30584 - protein, 18 aa, Homo sapiens
  heavy chain complementarity determining region 3 for antibody 15292
ARVRGEAYGSGWISVFDY

SEQ ID NO: 30585 - protein, 9 aa, Homo sapiens
  light chain complementarity determining region 3 for antibody 15293
QQTYSVPPT

SEQ ID NO: 30586 - protein, 18 aa, Homo sapiens
  heavy chain complementarity determining region 3 for antibody 15293
ARVRGEAYGSGWISVFDY

SEQ ID NO: 30587 - protein, 9 aa, Homo sapiens
  light chain complementarity determining region 3 for antibody 15294
QQTYSTPYT

SEQ ID NO: 30588 - protein, 17 aa, Homo sapiens
  heavy chain complementarity determining region 3 for antibody 15294
ARGTYHNDTSGNGPLDY

SEQ ID NO: 30589 - protein, 9 aa, Homo sapiens
  light chain complementarity determining region 3 for antibody 15295
QQTYSTPYI

SEQ ID NO: 30590 - protein, 17 aa, Homo sapiens
  heavy chain complementarity determining region 3 for antibody 15295
ARGTYYNDTSGNGPLDY

SEQ ID NO: 30591 - protein, 9 aa, Homo sapiens
  light chain complementarity determining region 3 for antibody 15296
QQTYSTPWT

SEQ ID NO: 30592 - protein, 16 aa, Homo sapiens
  heavy chain complementarity determining region 3 for antibody 15296
AYTPPVVDTVKDGFHV

SEQ ID NO: 30593 - protein, 9 aa, Homo sapiens
  light chain complementarity determining region 3 for antibody 15297
QQTYSTPVT

SEQ ID NO: 30594 - protein, 16 aa, Homo sapiens
  heavy chain complementarity determining region 3 for antibody 15297
ATLSAASGWSRGWLDP

SEQ ID NO: 30595 - protein, 9 aa, Homo sapiens
  light chain complementarity determining region 3 for antibody 15298
QQTYSTPVT

SEQ ID NO: 30596 - protein, 11 aa, Homo sapiens
  heavy chain complementarity determining region 3 for antibody 15298
ARLDGHLEFDY

SEQ ID NO: 30597 - protein, 10 aa, Homo sapiens
  light chain complementarity determining region 3 for antibody 15299
QQTYSTPTWT

SEQ ID NO: 30598 - protein, 13 aa, Homo sapiens
  heavy chain complementarity determining region 3 for antibody 15299
ARVGAVAGRAFDV

SEQ ID NO: 30599 - protein, 9 aa, Homo sapiens
  light chain complementarity determining region 3 for antibody 15300
QQTYSTPNT

SEQ ID NO: 30600 - protein, 12 aa, Homo sapiens
  heavy chain complementarity determining region 3 for antibody 15300
ARRVIRRFWFDP

SEQ ID NO: 30601 - protein, 10 aa, Homo sapiens
  light chain complementarity determining region 3 for antibody 15301
QQTYSTPLSI

SEQ ID NO: 30602 - protein, 12 aa, Homo sapiens
  heavy chain complementarity determining region 3 for antibody 15301
ARGPRSGWYLVD

SEQ ID NO: 30603 - protein, 10 aa, Homo sapiens
  light chain complementarity determining region 3 for antibody 15302
QQTYSTHLFI

SEQ ID NO: 30604 - protein, 12 aa, Homo sapiens
  heavy chain complementarity determining region 3 for antibody 15302
ARGPRSGWYLVD

SEQ ID NO: 30605 - protein, 9 aa, Homo sapiens
  light chain complementarity determining region 3 for antibody 15303
QQTYSTALT

SEQ ID NO: 30606 - protein, 13 aa, Homo sapiens
  heavy chain complementarity determining region 3 for antibody 15303
ARGPWDGYNYQDF

SEQ ID NO: 30607 - protein, 10 aa, Homo sapiens
  light chain complementarity determining region 3 for antibody 15304
QQTYSSPTWT

SEQ ID NO: 30608 - protein, 13 aa, Homo sapiens
  heavy chain complementarity determining region 3 for antibody 15304
ARVGAAAGRAFDI

SEQ ID NO: 30609 - protein, 10 aa, Homo sapiens
  light chain complementarity determining region 3 for antibody 15305
QQTYSSPTPT

SEQ ID NO: 30610 - protein, 17 aa, Homo sapiens
  heavy chain complementarity determining region 3 for antibody 15305
ARLTPYTSNWNPFYCDY

SEQ ID NO: 30611 - protein, 10 aa, Homo sapiens
  light chain complementarity determining region 3 for antibody 15306
QQTYSSPPPT

SEQ ID NO: 30612 - protein, 17 aa, Homo sapiens
  heavy chain complementarity determining region 3 for antibody 15306
ERLTPYTSNWNPFYCDY

SEQ ID NO: 30613 - protein, 10 aa, Homo sapiens
  light chain complementarity determining region 3 for antibody 15307
QQTYSSPPPT

SEQ ID NO: 30614 - protein, 17 aa, Homo sapiens
  heavy chain complementarity determining region 3 for antibody 15307
ARLTPYTSNWNPLYCDY

SEQ ID NO: 30615 - protein, 10 aa, Homo sapiens
  light chain complementarity determining region 3 for antibody 15308
QQTYSSPPPT

SEQ ID NO: 30616 - protein, 17 aa, Homo sapiens
  heavy chain complementarity determining region 3 for antibody 15308
ARLTPYTSNWNPFYRDY

SEQ ID NO: 30617 - protein, 10 aa, Homo sapiens
  light chain complementarity determining region 3 for antibody 15309
QQTYSSPPPT

SEQ ID NO: 30618 - protein, 17 aa, Homo sapiens
  heavy chain complementarity determining region 3 for antibody 15309
ARLTPYTSNWNPCYCDY

SEQ ID NO: 30619 - protein, 10 aa, Homo sapiens
  light chain complementarity determining region 3 for antibody 15310
QQTYSSPPPT

SEQ ID NO: 30620 - protein, 17 aa, Homo sapiens
  heavy chain complementarity determining region 3 for antibody 15310
ARLTPYSSNWNPFYCDY

SEQ ID NO: 30621 - protein, 10 aa, Homo sapiens
  light chain complementarity determining region 3 for antibody 15311
QQTYSSPPPT

SEQ ID NO: 30622 - protein, 14 aa, Homo sapiens
  heavy chain complementarity determining region 3 for antibody 15311
ARLNKMTRIRYFDS

SEQ ID NO: 30623 - protein, 10 aa, Homo sapiens
  light chain complementarity determining region 3 for antibody 15312
QQTYSSPPPT

SEQ ID NO: 30624 - protein, 17 aa, Homo sapiens
  heavy chain complementarity determining region 3 for antibody 15312
ARLAPYTSNWNPFYCDY

SEQ ID NO: 30625 - protein, 10 aa, Homo sapiens
  light chain complementarity determining region 3 for antibody 15313
QQTYSSPPPT

SEQ ID NO: 30626 - protein, 22 aa, Homo sapiens
  heavy chain complementarity determining region 3 for antibody 15313
ARHSGYSNTWYMNYYYYYGMDV

SEQ ID NO: 30627 - protein, 10 aa, Homo sapiens
  light chain complementarity determining region 3 for antibody 15314
QQTYSSPPNT

SEQ ID NO: 30628 - protein, 19 aa, Homo sapiens
  heavy chain complementarity determining region 3 for antibody 15314
AKTASSTFYSLQYYYGMDV

SEQ ID NO: 30629 - protein, 10 aa, Homo sapiens
  light chain complementarity determining region 3 for antibody 15315
QQTYSSPHPT

SEQ ID NO: 30630 - protein, 17 aa, Homo sapiens
  heavy chain complementarity determining region 3 for antibody 15315
ARLTPYTSNWNPFYCDY

SEQ ID NO: 30631 - protein, 10 aa, Homo sapiens
  light chain complementarity determining region 3 for antibody 15316
QQTYSSHPPT

SEQ ID NO: 30632 - protein, 17 aa, Homo sapiens
  heavy chain complementarity determining region 3 for antibody 15316
ARLTPYTSNWNPFYCDY

SEQ ID NO: 30633 - protein, 10 aa, Homo sapiens
  light chain complementarity determining region 3 for antibody 15317
QQTYSRPPPT

SEQ ID NO: 30634 - protein, 17 aa, Homo sapiens
  heavy chain complementarity determining region 3 for antibody 15317
ARLTPYTSNWNPFYCDY

SEQ ID NO: 30635 - protein, 9 aa, Homo sapiens
  light chain complementarity determining region 3 for antibody 15318
QQTYSPPVT

SEQ ID NO: 30636 - protein, 11 aa, Homo sapiens
  heavy chain complementarity determining region 3 for antibody 15318
ARLDGHREFDY

SEQ ID NO: 30637 - protein, 10 aa, Homo sapiens
  light chain complementarity determining region 3 for antibody 15319
QQTYSNPTWT

SEQ ID NO: 30638 - protein, 13 aa, Homo sapiens
  heavy chain complementarity determining region 3 for antibody 15319
ARGGAVAGRAFDV

SEQ ID NO: 30639 - protein, 10 aa, Homo sapiens
  light chain complementarity determining region 3 for antibody 15320
QQTYSNPTGT

SEQ ID NO: 30640 - protein, 13 aa, Homo sapiens
  heavy chain complementarity determining region 3 for antibody 15320
ARVGAVAGRAFDV

SEQ ID NO: 30641 - protein, 10 aa, Homo sapiens
  light chain complementarity determining region 3 for antibody 15321
QQTYSIPPPT

SEQ ID NO: 30642 - protein, 17 aa, Homo sapiens
  heavy chain complementarity determining region 3 for antibody 15321
ARLTPYTSNWNPFYCDY

SEQ ID NO: 30643 - protein, 9 aa, Homo sapiens
  light chain complementarity determining region 3 for antibody 15322
QQTYSGLFT

SEQ ID NO: 30644 - protein, 17 aa, Homo sapiens
  heavy chain complementarity determining region 3 for antibody 15322
ARTLELERTYHYFGMDV

SEQ ID NO: 30645 - protein, 9 aa, Homo sapiens
  light chain complementarity determining region 3 for antibody 15323
QQTYSAPYT

SEQ ID NO: 30646 - protein, 18 aa, Homo sapiens
  heavy chain complementarity determining region 3 for antibody 15323
ARDVYCSDGSCYENWFDP

SEQ ID NO: 30647 - protein, 10 aa, Homo sapiens
  light chain complementarity determining region 3 for antibody 15324
QQTYRSPPPT

SEQ ID NO: 30648 - protein, 17 aa, Homo sapiens
  heavy chain complementarity determining region 3 for antibody 15324
ARLTPYTSNWNPFYCDY

SEQ ID NO: 30649 - protein, 9 aa, Homo sapiens
  light chain complementarity determining region 3 for antibody 15325
QQTYNDPLT

SEQ ID NO: 30650 - protein, 16 aa, Homo sapiens
  heavy chain complementarity determining region 3 for antibody 15325
TTLPFMAPNYYYGMDV

SEQ ID NO: 30651 - protein, 8 aa, Homo sapiens
  light chain complementarity determining region 3 for antibody 15326
QQTYNAVT

SEQ ID NO: 30652 - protein, 22 aa, Homo sapiens
  heavy chain complementarity determining region 3 for antibody 15326
ARHSGYSNTWYMNYYYYYGMDV

SEQ ID NO: 30653 - protein, 9 aa, Homo sapiens
  light chain complementarity determining region 3 for antibody 15327
QQTYATQRT

SEQ ID NO: 30654 - protein, 13 aa, Homo sapiens
  heavy chain complementarity determining region 3 for antibody 15327
ARVGAVAGRAFDV

SEQ ID NO: 30655 - protein, 9 aa, Homo sapiens
  light chain complementarity determining region 3 for antibody 15328
QQTNSLPFT

SEQ ID NO: 30656 - protein, 19 aa, Homo sapiens
  heavy chain complementarity determining region 3 for antibody 15328
ARNDYSGDTDRYYDFGMDV

SEQ ID NO: 30657 - protein, 9 aa, Homo sapiens
  light chain complementarity determining region 3 for antibody 15329
QQTNSFPYT

SEQ ID NO: 30658 - protein, 18 aa, Homo sapiens
  heavy chain complementarity determining region 3 for antibody 15329
VRHLWFGRGSAYYYAMDV

SEQ ID NO: 30659 - protein, 9 aa, Homo sapiens
  light chain complementarity determining region 3 for antibody 15330
QQTNSFPLT

SEQ ID NO: 30660 - protein, 19 aa, Homo sapiens
  heavy chain complementarity determining region 3 for antibody 15330
ATSPESGDCYDCYYFGMDV

SEQ ID NO: 30661 - protein, 9 aa, Homo sapiens
  light chain complementarity determining region 3 for antibody 15331
QQTNSFPFT

SEQ ID NO: 30662 - protein, 20 aa, Homo sapiens
  heavy chain complementarity determining region 3 for antibody 15331
VRHNTLRYVDQTVFSYGMDV

SEQ ID NO: 30663 - protein, 9 aa, Homo sapiens
  light chain complementarity determining region 3 for antibody 15332
QQTNSFPFT

SEQ ID NO: 30664 - protein, 20 aa, Homo sapiens
  heavy chain complementarity determining region 3 for antibody 15332
VRHNTLRCFDQTVFSYGMDV

SEQ ID NO: 30665 - protein, 9 aa, Homo sapiens
  light chain complementarity determining region 3 for antibody 15333
QQTKGFPYT

SEQ ID NO: 30666 - protein, 18 aa, Homo sapiens
  heavy chain complementarity determining region 3 for antibody 15333
ARHLWLDRGHFYYHSMDV

SEQ ID NO: 30667 - protein, 9 aa, Homo sapiens
  light chain complementarity determining region 3 for antibody 15334
QQTHTPLYT

SEQ ID NO: 30668 - protein, 18 aa, Homo sapiens
  heavy chain complementarity determining region 3 for antibody 15334
ARRRGYGSRDYFYYAMDV

SEQ ID NO: 30669 - protein, 8 aa, Homo sapiens
  light chain complementarity determining region 3 for antibody 15335
QQTHSFPP

SEQ ID NO: 30670 - protein, 22 aa, Homo sapiens
  heavy chain complementarity determining region 3 for antibody 15335
ARHSGYSSTWYMNYYYYYGMDV

SEQ ID NO: 30671 - protein, 9 aa, Homo sapiens
  light chain complementarity determining region 3 for antibody 15336
QQTFSPPWA

SEQ ID NO: 30672 - protein, 19 aa, Homo sapiens
  heavy chain complementarity determining region 3 for antibody 15336
ATMRYGSGELTYDYYGMDV

SEQ ID NO: 30673 - protein, 7 aa, Homo sapiens
  light chain complementarity determining region 3 for antibody 15337
QQTDTPL

SEQ ID NO: 30674 - protein, 22 aa, Homo sapiens
  heavy chain complementarity determining region 3 for antibody 15337
ARAKTSRFYRGYATSPPYYFDY

SEQ ID NO: 30675 - protein, 9 aa, Homo sapiens
  light chain complementarity determining region 3 for antibody 15338
QQTDSFPLT

SEQ ID NO: 30676 - protein, 13 aa, Homo sapiens
  heavy chain complementarity determining region 3 for antibody 15338
ARGAPGSTWYFGY

SEQ ID NO: 30677 - protein, 9 aa, Homo sapiens
  light chain complementarity determining region 3 for antibody 15339
QQSYVTPRT

SEQ ID NO: 30678 - protein, 15 aa, Homo sapiens
  heavy chain complementarity determining region 3 for antibody 15339
ARVQVTPSYYYGMDV

SEQ ID NO: 30679 - protein, 9 aa, Homo sapiens
  light chain complementarity determining region 3 for antibody 15340
QQSYTTPYS

SEQ ID NO: 30680 - protein, 12 aa, Homo sapiens
  heavy chain complementarity determining region 3 for antibody 15340
ASLSHVEMAIDY

SEQ ID NO: 30681 - protein, 9 aa, Homo sapiens
  light chain complementarity determining region 3 for antibody 15341
QQSYTTPRT

SEQ ID NO: 30682 - protein, 19 aa, Homo sapiens
  heavy chain complementarity determining region 3 for antibody 15341
ARDGPILRFVDDPVYGMDV

SEQ ID NO: 30683 - protein, 9 aa, Homo sapiens
  light chain complementarity determining region 3 for antibody 15342
QQSYTTPRP

SEQ ID NO: 30684 - protein, 19 aa, Homo sapiens
  heavy chain complementarity determining region 3 for antibody 15342
ARDGPILRFFDDPVYGMDV

SEQ ID NO: 30685 - protein, 9 aa, Homo sapiens
  light chain complementarity determining region 3 for antibody 15343
QQSYTTPRA

SEQ ID NO: 30686 - protein, 19 aa, Homo sapiens
  heavy chain complementarity determining region 3 for antibody 15343
ARDGPILRFFDDPVYGMDV

SEQ ID NO: 30687 - protein, 9 aa, Homo sapiens
  light chain complementarity determining region 3 for antibody 15344
QQSYTTPPP

SEQ ID NO: 30688 - protein, 15 aa, Homo sapiens
  heavy chain complementarity determining region 3 for antibody 15344
ARVSGTDRGGDHFDK

SEQ ID NO: 30689 - protein, 9 aa, Homo sapiens
  light chain complementarity determining region 3 for antibody 15345
QQSYTTHGT

SEQ ID NO: 30690 - protein, 13 aa, Homo sapiens
  heavy chain complementarity determining region 3 for antibody 15345
ARIIYGNYYGMDV

SEQ ID NO: 30691 - protein, 9 aa, Homo sapiens
  light chain complementarity determining region 3 for antibody 15346
QQSYTMPRT

SEQ ID NO: 30692 - protein, 18 aa, Homo sapiens
  heavy chain complementarity determining region 3 for antibody 15346
TTVLSQLLAGDWHLYFQH

SEQ ID NO: 30693 - protein, 9 aa, Homo sapiens
  light chain complementarity determining region 3 for antibody 15347
QQSYTFPWT

SEQ ID NO: 30694 - protein, 14 aa, Homo sapiens
  heavy chain complementarity determining region 3 for antibody 15347
ATDPPTGGYNSLDF

SEQ ID NO: 30695 - protein, 9 aa, Homo sapiens
  light chain complementarity determining region 3 for antibody 15348
QQSYTFPWK

SEQ ID NO: 30696 - protein, 14 aa, Homo sapiens
  heavy chain complementarity determining region 3 for antibody 15348
ATDPPTDGYNSLDF

SEQ ID NO: 30697 - protein, 9 aa, Homo sapiens
  light chain complementarity determining region 3 for antibody 15349
QQSYTFPGT

SEQ ID NO: 30698 - protein, 14 aa, Homo sapiens
  heavy chain complementarity determining region 3 for antibody 15349
ATDPPTDGYNSLDF

SEQ ID NO: 30699 - protein, 9 aa, Homo sapiens
  light chain complementarity determining region 3 for antibody 15350
QQSYTALYT

SEQ ID NO: 30700 - protein, 16 aa, Homo sapiens
  heavy chain complementarity determining region 3 for antibody 15350
ARGGYLTSTPYYGMGV

SEQ ID NO: 30701 - protein, 9 aa, Homo sapiens
  light chain complementarity determining region 3 for antibody 15351
QQSYTALYT

SEQ ID NO: 30702 - protein, 16 aa, Homo sapiens
  heavy chain complementarity determining region 3 for antibody 15351
ARGGYLTSTPYYGMDA

SEQ ID NO: 30703 - protein, 9 aa, Homo sapiens
  light chain complementarity determining region 3 for antibody 15352
QQSYSVPFT

SEQ ID NO: 30704 - protein, 14 aa, Homo sapiens
  heavy chain complementarity determining region 3 for antibody 15352
AHSPSYRSGPPFDY

SEQ ID NO: 30705 - protein, 9 aa, Homo sapiens
  light chain complementarity determining region 3 for antibody 15353
QQSYSTVTT

SEQ ID NO: 30706 - protein, 18 aa, Homo sapiens
  heavy chain complementarity determining region 3 for antibody 15353
ARGAGYLYHRKVYSSFDY

SEQ ID NO: 30707 - protein, 9 aa, Homo sapiens
  light chain complementarity determining region 3 for antibody 15354
QQSYSTTFT

SEQ ID NO: 30708 - protein, 14 aa, Homo sapiens
  heavy chain complementarity determining region 3 for antibody 15354
ARLPGRYPRYGMDV

SEQ ID NO: 30709 - protein, 9 aa, Homo sapiens
  light chain complementarity determining region 3 for antibody 15355
QQSYSTSWA

SEQ ID NO: 30710 - protein, 16 aa, Homo sapiens
  heavy chain complementarity determining region 3 for antibody 15355
ARDRGSSWYENNWFDP

SEQ ID NO: 30711 - protein, 9 aa, Homo sapiens
  light chain complementarity determining region 3 for antibody 15356
QQSYSTSLT

SEQ ID NO: 30712 - protein, 19 aa, Homo sapiens
  heavy chain complementarity determining region 3 for antibody 15356
VLSKQPSGAYSVYYYGMDV

SEQ ID NO: 30713 - protein, 7 aa, Homo sapiens
  light chain complementarity determining region 3 for antibody 15357
QQSYSTR

SEQ ID NO: 30714 - protein, 13 aa, Homo sapiens
  heavy chain complementarity determining region 3 for antibody 15357
ATAYSGNFDEFDP

SEQ ID NO: 30715 - protein, 9 aa, Homo sapiens
  light chain complementarity determining region 3 for antibody 15358
QQSYSTQYT

SEQ ID NO: 30716 - protein, 15 aa, Homo sapiens
  heavy chain complementarity determining region 3 for antibody 15358
ARGGAVRPRYYGVDV

SEQ ID NO: 30717 - protein, 9 aa, Homo sapiens
  light chain complementarity determining region 3 for antibody 15359
QQSYSTQFT

SEQ ID NO: 30718 - protein, 13 aa, Homo sapiens
  heavy chain complementarity determining region 3 for antibody 15359
ARSLSATLEYFHH

SEQ ID NO: 30719 - protein, 9 aa, Homo sapiens
  light chain complementarity determining region 3 for antibody 15360
QQSYSTPYT

SEQ ID NO: 30720 - protein, 15 aa, Homo sapiens
  heavy chain complementarity determining region 3 for antibody 15360
VKARGSPWGTYRWDV

SEQ ID NO: 30721 - protein, 9 aa, Homo sapiens
  light chain complementarity determining region 3 for antibody 15361
QQSYSTPYT

SEQ ID NO: 30722 - protein, 15 aa, Homo sapiens
  heavy chain complementarity determining region 3 for antibody 15361
VKARGSAWGTYRWDV

SEQ ID NO: 30723 - protein, 9 aa, Homo sapiens
  light chain complementarity determining region 3 for antibody 15362
QQSYSTPYT

SEQ ID NO: 30724 - protein, 12 aa, Homo sapiens
  heavy chain complementarity determining region 3 for antibody 15362
AVELGYGDVPIA

SEQ ID NO: 30725 - protein, 9 aa, Homo sapiens
  light chain complementarity determining region 3 for antibody 15363
QQSYSTPYT

SEQ ID NO: 30726 - protein, 12 aa, Homo sapiens
  heavy chain complementarity determining region 3 for antibody 15363
AVELGYGDIHIA

SEQ ID NO: 30727 - protein, 9 aa, Homo sapiens
  light chain complementarity determining region 3 for antibody 15364
QQSYSTPYT

SEQ ID NO: 30728 - protein, 12 aa, Homo sapiens
  heavy chain complementarity determining region 3 for antibody 15364
AVELGHGDIPIA

SEQ ID NO: 30729 - protein, 9 aa, Homo sapiens
  light chain complementarity determining region 3 for antibody 15365
QQSYSTPYT

SEQ ID NO: 30730 - protein, 17 aa, Homo sapiens
  heavy chain complementarity determining region 3 for antibody 15365
ARVSYYDVDLITYYFDH

SEQ ID NO: 30731 - protein, 9 aa, Homo sapiens
  light chain complementarity determining region 3 for antibody 15366
QQSYSTPYT

SEQ ID NO: 30732 - protein, 18 aa, Homo sapiens
  heavy chain complementarity determining region 3 for antibody 15366
ARVPALRRAGYWFRWFDP

SEQ ID NO: 30733 - protein, 9 aa, Homo sapiens
  light chain complementarity determining region 3 for antibody 15367
QQSYSTPYT

SEQ ID NO: 30734 - protein, 13 aa, Homo sapiens
  heavy chain complementarity determining region 3 for antibody 15367
ARQFHGAAKHFDF

SEQ ID NO: 30735 - protein, 9 aa, Homo sapiens
  light chain complementarity determining region 3 for antibody 15368
QQSYSTPYT

SEQ ID NO: 30736 - protein, 17 aa, Homo sapiens
  heavy chain complementarity determining region 3 for antibody 15368
ARGSYYDVDLIAYYFDH

SEQ ID NO: 30737 - protein, 9 aa, Homo sapiens
  light chain complementarity determining region 3 for antibody 15369
QQSYSTPYT

SEQ ID NO: 30738 - protein, 16 aa, Homo sapiens
  heavy chain complementarity determining region 3 for antibody 15369
ARGGFGELGLHNAFDI

SEQ ID NO: 30739 - protein, 9 aa, Homo sapiens
  light chain complementarity determining region 3 for antibody 15370
QQSYSTPYT

SEQ ID NO: 30740 - protein, 15 aa, Homo sapiens
  heavy chain complementarity determining region 3 for antibody 15370
ARGGAVRQRYYGVDV

SEQ ID NO: 30741 - protein, 9 aa, Homo sapiens
  light chain complementarity determining region 3 for antibody 15371
QQSYSTPYT

SEQ ID NO: 30742 - protein, 15 aa, Homo sapiens
  heavy chain complementarity determining region 3 for antibody 15371
ARGDCRDEPCYPGAY

SEQ ID NO: 30743 - protein, 9 aa, Homo sapiens
  light chain complementarity determining region 3 for antibody 15372
QQSYSTPYT

SEQ ID NO: 30744 - protein, 15 aa, Homo sapiens
  heavy chain complementarity determining region 3 for antibody 15372
ARGDCRDEACYPGAY

SEQ ID NO: 30745 - protein, 9 aa, Homo sapiens
  light chain complementarity determining region 3 for antibody 15373
QQSYSTPYT

SEQ ID NO: 30746 - protein, 15 aa, Homo sapiens
  heavy chain complementarity determining region 3 for antibody 15373
ARDQRQLLNPRAFDV

SEQ ID NO: 30747 - protein, 9 aa, Homo sapiens
  light chain complementarity determining region 3 for antibody 15374
QQSYSTPYT

SEQ ID NO: 30748 - protein, 17 aa, Homo sapiens
  heavy chain complementarity determining region 3 for antibody 15374
ARDGSYGDRMYHYGMDV

SEQ ID NO: 30749 - protein, 9 aa, Homo sapiens
  light chain complementarity determining region 3 for antibody 15375
QQSYSTPYT

SEQ ID NO: 30750 - protein, 10 aa, Homo sapiens
  heavy chain complementarity determining region 3 for antibody 15375
AGAIAAAGSY

SEQ ID NO: 30751 - protein, 9 aa, Homo sapiens
  light chain complementarity determining region 3 for antibody 15376
QQSYSTPYS

SEQ ID NO: 30752 - protein, 13 aa, Homo sapiens
  heavy chain complementarity determining region 3 for antibody 15376
AKATSDGSGALHY

SEQ ID NO: 30753 - protein, 9 aa, Homo sapiens
  light chain complementarity determining region 3 for antibody 15377
QQSYSTPYP

SEQ ID NO: 30754 - protein, 15 aa, Homo sapiens
  heavy chain complementarity determining region 3 for antibody 15377
AKDNGVGIGVAGLDH

SEQ ID NO: 30755 - protein, 9 aa, Homo sapiens
  light chain complementarity determining region 3 for antibody 15378
QQSYSTPYH

SEQ ID NO: 30756 - protein, 17 aa, Homo sapiens
  heavy chain complementarity determining region 3 for antibody 15378
ARGSYYDVDLNRFYFDY

SEQ ID NO: 30757 - protein, 9 aa, Homo sapiens
  light chain complementarity determining region 3 for antibody 15379
QQSYSTPYA

SEQ ID NO: 30758 - protein, 12 aa, Homo sapiens
  heavy chain complementarity determining region 3 for antibody 15379
AVELGYGDIPIA

SEQ ID NO: 30759 - protein, 9 aa, Homo sapiens
  light chain complementarity determining region 3 for antibody 15380
QQSYSTPWT

SEQ ID NO: 30760 - protein, 14 aa, Homo sapiens
  heavy chain complementarity determining region 3 for antibody 15380
ARVQVDYSNYGCDS

SEQ ID NO: 30761 - protein, 9 aa, Homo sapiens
  light chain complementarity determining region 3 for antibody 15381
QQSYSTPST

SEQ ID NO: 30762 - protein, 17 aa, Homo sapiens
  heavy chain complementarity determining region 3 for antibody 15381
ARGSYYDVDLITYYFDH

SEQ ID NO: 30763 - protein, 10 aa, Homo sapiens
  light chain complementarity determining region 3 for antibody 15382
QQSYSTPSIT

SEQ ID NO: 30764 - protein, 11 aa, Homo sapiens
  heavy chain complementarity determining region 3 for antibody 15382
ARDSGGGDYDY

SEQ ID NO: 30765 - protein, 9 aa, Homo sapiens
  light chain complementarity determining region 3 for antibody 15383
QQSYSTPRT

SEQ ID NO: 30766 - protein, 11 aa, Homo sapiens
  heavy chain complementarity determining region 3 for antibody 15383
VHRVFKLYFDN

SEQ ID NO: 30767 - protein, 9 aa, Homo sapiens
  light chain complementarity determining region 3 for antibody 15384
QQSYSTPRT

SEQ ID NO: 30768 - protein, 17 aa, Homo sapiens
  heavy chain complementarity determining region 3 for antibody 15384
TNDYYGDYMAQYNWFDS

SEQ ID NO: 30769 - protein, 9 aa, Homo sapiens
  light chain complementarity determining region 3 for antibody 15385
QQSYSTPRT

SEQ ID NO: 30770 - protein, 17 aa, Homo sapiens
  heavy chain complementarity determining region 3 for antibody 15385
TKDYYGDYMAQYNWFDP

SEQ ID NO: 30771 - protein, 9 aa, Homo sapiens
  light chain complementarity determining region 3 for antibody 15386
QQSYSTPRT

SEQ ID NO: 30772 - protein, 17 aa, Homo sapiens
  heavy chain complementarity determining region 3 for antibody 15386
TKDYCGDYMAQYNWFDS

SEQ ID NO: 30773 - protein, 9 aa, Homo sapiens
  light chain complementarity determining region 3 for antibody 15387
QQSYSTPRT

SEQ ID NO: 30774 - protein, 14 aa, Homo sapiens
  heavy chain complementarity determining region 3 for antibody 15387
ASVQVDYSNYGCDS

SEQ ID NO: 30775 - protein, 9 aa, Homo sapiens
  light chain complementarity determining region 3 for antibody 15388
QQSYSTPRT

SEQ ID NO: 30776 - protein, 14 aa, Homo sapiens
  heavy chain complementarity determining region 3 for antibody 15388
ARVRVDYSNYGCDS

SEQ ID NO: 30777 - protein, 9 aa, Homo sapiens
  light chain complementarity determining region 3 for antibody 15389
QQSYSTPRT

SEQ ID NO: 30778 - protein, 14 aa, Homo sapiens
  heavy chain complementarity determining region 3 for antibody 15389
ARVQVDYSTYGCDS

SEQ ID NO: 30779 - protein, 9 aa, Homo sapiens
  light chain complementarity determining region 3 for antibody 15390
QQSYSTPRT

SEQ ID NO: 30780 - protein, 14 aa, Homo sapiens
  heavy chain complementarity determining region 3 for antibody 15390
ARVQVDYSNCGCDS

SEQ ID NO: 30781 - protein, 9 aa, Homo sapiens
  light chain complementarity determining region 3 for antibody 15391
QQSYSTPRT

SEQ ID NO: 30782 - protein, 14 aa, Homo sapiens
  heavy chain complementarity determining region 3 for antibody 15391
ARVQVDHSNYGCDS

SEQ ID NO: 30783 - protein, 9 aa, Homo sapiens
  light chain complementarity determining region 3 for antibody 15392
QQSYSTPRT

SEQ ID NO: 30784 - protein, 14 aa, Homo sapiens
  heavy chain complementarity determining region 3 for antibody 15392
ARVPVDYSNYGCDS

SEQ ID NO: 30785 - protein, 9 aa, Homo sapiens
  light chain complementarity determining region 3 for antibody 15393
QQSYSTPRT

SEQ ID NO: 30786 - protein, 16 aa, Homo sapiens
  heavy chain complementarity determining region 3 for antibody 15393
ARTQGTRDYYYYAMDV

SEQ ID NO: 30787 - protein, 9 aa, Homo sapiens
  light chain complementarity determining region 3 for antibody 15394
QQSYSTPRT

SEQ ID NO: 30788 - protein, 16 aa, Homo sapiens
  heavy chain complementarity determining region 3 for antibody 15394
ARGGFGELGLHNAFDV

SEQ ID NO: 30789 - protein, 9 aa, Homo sapiens
  light chain complementarity determining region 3 for antibody 15395
QQSYSTPRT

SEQ ID NO: 30790 - protein, 14 aa, Homo sapiens
  heavy chain complementarity determining region 3 for antibody 15395
ARDQVDYSNYGCDS

SEQ ID NO: 30791 - protein, 9 aa, Homo sapiens
  light chain complementarity determining region 3 for antibody 15396
QQSYSTPRT

SEQ ID NO: 30792 - protein, 17 aa, Homo sapiens
  heavy chain complementarity determining region 3 for antibody 15396
AKDLSGVHYDIHHGLDV

SEQ ID NO: 30793 - protein, 9 aa, Homo sapiens
  light chain complementarity determining region 3 for antibody 15397
QQSYSTPRP

SEQ ID NO: 30794 - protein, 17 aa, Homo sapiens
  heavy chain complementarity determining region 3 for antibody 15397
TKDYYGDYMAQYNWFDS

SEQ ID NO: 30795 - protein, 9 aa, Homo sapiens
  light chain complementarity determining region 3 for antibody 15398
QQSYSTPRP

SEQ ID NO: 30796 - protein, 12 aa, Homo sapiens
  heavy chain complementarity determining region 3 for antibody 15398
ASTYPYAAGYDH

SEQ ID NO: 30797 - protein, 9 aa, Homo sapiens
  light chain complementarity determining region 3 for antibody 15399
QQSYSTPRP

SEQ ID NO: 30798 - protein, 17 aa, Homo sapiens
  heavy chain complementarity determining region 3 for antibody 15399
ARGLTTWRMGSGTLFDY

SEQ ID NO: 30799 - protein, 9 aa, Homo sapiens
  light chain complementarity determining region 3 for antibody 15400
QQSYSTPQT

SEQ ID NO: 30800 - protein, 14 aa, Homo sapiens
  heavy chain complementarity determining region 3 for antibody 15400
ARVQVDYSNYGCDS

SEQ ID NO: 30801 - protein, 9 aa, Homo sapiens
  light chain complementarity determining region 3 for antibody 15401
QQSYSTPQT

SEQ ID NO: 30802 - protein, 19 aa, Homo sapiens
  heavy chain complementarity determining region 3 for antibody 15401
ARISHFGEVSGPWDGWFDP

SEQ ID NO: 30803 - protein, 9 aa, Homo sapiens
  light chain complementarity determining region 3 for antibody 15402
QQSYSTPQT

SEQ ID NO: 30804 - protein, 15 aa, Homo sapiens
  heavy chain complementarity determining region 3 for antibody 15402
ARGGIHYDILTGLDY

SEQ ID NO: 30805 - protein, 9 aa, Homo sapiens
  light chain complementarity determining region 3 for antibody 15403
QQSYSTPQT

SEQ ID NO: 30806 - protein, 18 aa, Homo sapiens
  heavy chain complementarity determining region 3 for antibody 15403
AKVSGQIWGRDYYYGIDV

SEQ ID NO: 30807 - protein, 10 aa, Homo sapiens
  light chain complementarity determining region 3 for antibody 15404
QQSYSTPPYT

SEQ ID NO: 30808 - protein, 16 aa, Homo sapiens
  heavy chain complementarity determining region 3 for antibody 15404
AKAGFGELGLHNALDV

SEQ ID NO: 30809 - protein, 9 aa, Homo sapiens
  light chain complementarity determining region 3 for antibody 15405
QQSYSTPPT

SEQ ID NO: 30810 - protein, 16 aa, Homo sapiens
  heavy chain complementarity determining region 3 for antibody 15405
ARGGFGELGRHNAFDV

SEQ ID NO: 30811 - protein, 10 aa, Homo sapiens
  light chain complementarity determining region 3 for antibody 15406
QQSYSTPPST

SEQ ID NO: 30812 - protein, 16 aa, Homo sapiens
  heavy chain complementarity determining region 3 for antibody 15406
AKAGFGELGLHNAFDV

SEQ ID NO: 30813 - protein, 9 aa, Homo sapiens
  light chain complementarity determining region 3 for antibody 15407
QQSYSTPPM

SEQ ID NO: 30814 - protein, 13 aa, Homo sapiens
  heavy chain complementarity determining region 3 for antibody 15407
ARVDDTNYLTVAY

SEQ ID NO: 30815 - protein, 10 aa, Homo sapiens
  light chain complementarity determining region 3 for antibody 15408
QQSYSTPPLP

SEQ ID NO: 30816 - protein, 25 aa, Homo sapiens
  heavy chain complementarity determining region 3 for antibody 15408
ARVNTYYYGSGSYYPEDPYYYGMDV

SEQ ID NO: 30817 - protein, 9 aa, Homo sapiens
  light chain complementarity determining region 3 for antibody 15409
QQSYSTPLT

SEQ ID NO: 30818 - protein, 13 aa, Homo sapiens
  heavy chain complementarity determining region 3 for antibody 15409
ARVYSSAWYNFDS

SEQ ID NO: 30819 - protein, 9 aa, Homo sapiens
  light chain complementarity determining region 3 for antibody 15410
QQSYSTPLT

SEQ ID NO: 30820 - protein, 14 aa, Homo sapiens
  heavy chain complementarity determining region 3 for antibody 15410
ARLPGIYPRYGMDV

SEQ ID NO: 30821 - protein, 9 aa, Homo sapiens
  light chain complementarity determining region 3 for antibody 15411
QQSYSTPLT

SEQ ID NO: 30822 - protein, 14 aa, Homo sapiens
  heavy chain complementarity determining region 3 for antibody 15411
ARLGKGQWLDSFDY

SEQ ID NO: 30823 - protein, 9 aa, Homo sapiens
  light chain complementarity determining region 3 for antibody 15412
QQSYSTPLT

SEQ ID NO: 30824 - protein, 21 aa, Homo sapiens
  heavy chain complementarity determining region 3 for antibody 15412
ARDPGRGYSLASYFYYYGMDV

SEQ ID NO: 30825 - protein, 9 aa, Homo sapiens
  light chain complementarity determining region 3 for antibody 15413
QQSYSTPLT

SEQ ID NO: 30826 - protein, 13 aa, Homo sapiens
  heavy chain complementarity determining region 3 for antibody 15413
AHRSPEGRSGLDY

SEQ ID NO: 30827 - protein, 9 aa, Homo sapiens
  light chain complementarity determining region 3 for antibody 15414
QQSYSTPLT

SEQ ID NO: 30828 - protein, 18 aa, Homo sapiens
  heavy chain complementarity determining region 3 for antibody 15414
AHLMISSGGLIGTYSFDI

SEQ ID NO: 30829 - protein, 9 aa, Homo sapiens
  light chain complementarity determining region 3 for antibody 15415
QQSYSTPLT

SEQ ID NO: 30830 - protein, 18 aa, Homo sapiens
  heavy chain complementarity determining region 3 for antibody 15415
AHLMISFGGLIGTYSFGI

SEQ ID NO: 30831 - protein, 9 aa, Homo sapiens
  light chain complementarity determining region 3 for antibody 15416
QQSYSTPLT

SEQ ID NO: 30832 - protein, 18 aa, Homo sapiens
  heavy chain complementarity determining region 3 for antibody 15416
AHLMISFGGLIGTYSCDI

SEQ ID NO: 30833 - protein, 9 aa, Homo sapiens
  light chain complementarity determining region 3 for antibody 15417
QQSYSTPLT

SEQ ID NO: 30834 - protein, 18 aa, Homo sapiens
  heavy chain complementarity determining region 3 for antibody 15417
AHLMISFGGLICTYSFDI

SEQ ID NO: 30835 - protein, 9 aa, Homo sapiens
  light chain complementarity determining region 3 for antibody 15418
QQSYSTPLP

SEQ ID NO: 30836 - protein, 19 aa, Homo sapiens
  heavy chain complementarity determining region 3 for antibody 15418
ARGPTAAYTYGMRGGGIDV

SEQ ID NO: 30837 - protein, 10 aa, Homo sapiens
  light chain complementarity determining region 3 for antibody 15419
QQSYSTPLLT

SEQ ID NO: 30838 - protein, 15 aa, Homo sapiens
  heavy chain complementarity determining region 3 for antibody 15419
AVWESMTEWIGPFDY

SEQ ID NO: 30839 - protein, 10 aa, Homo sapiens
  light chain complementarity determining region 3 for antibody 15420
QQSYSTPLLT

SEQ ID NO: 30840 - protein, 15 aa, Homo sapiens
  heavy chain complementarity determining region 3 for antibody 15420
AGWESMTEWLGPFDY

SEQ ID NO: 30841 - protein, 10 aa, Homo sapiens
  light chain complementarity determining region 3 for antibody 15421
QQSYSTPLIT

SEQ ID NO: 30842 - protein, 15 aa, Homo sapiens
  heavy chain complementarity determining region 3 for antibody 15421
AVWESMTEWLGPFDY

SEQ ID NO: 30843 - protein, 10 aa, Homo sapiens
  light chain complementarity determining region 3 for antibody 15422
QQSYSTPLFT

SEQ ID NO: 30844 - protein, 23 aa, Homo sapiens
  heavy chain complementarity determining region 3 for antibody 15422
ARHFPKGGSGVTGTQSLLYYMDV

SEQ ID NO: 30845 - protein, 10 aa, Homo sapiens
  light chain complementarity determining region 3 for antibody 15423
QQSYSTPKVT

SEQ ID NO: 30846 - protein, 15 aa, Homo sapiens
  heavy chain complementarity determining region 3 for antibody 15423
TRDLAVYGDYGIGGY

SEQ ID NO: 30847 - protein, 9 aa, Homo sapiens
  light chain complementarity determining region 3 for antibody 15424
QQSYSTPIT

SEQ ID NO: 30848 - protein, 25 aa, Homo sapiens
  heavy chain complementarity determining region 3 for antibody 15424
AKDRTDPEYSRSLFYGDGYYYGLDV

SEQ ID NO: 30849 - protein, 9 aa, Homo sapiens
  light chain complementarity determining region 3 for antibody 15425
QQSYSTPHT

SEQ ID NO: 30850 - protein, 19 aa, Homo sapiens
  heavy chain complementarity determining region 3 for antibody 15425
ARENGGRGWVSYYYYGMDV

SEQ ID NO: 30851 - protein, 9 aa, Homo sapiens
  light chain complementarity determining region 3 for antibody 15426
QQSYSTPHT

SEQ ID NO: 30852 - protein, 15 aa, Homo sapiens
  heavy chain complementarity determining region 3 for antibody 15426
AKDNGVGIGVAGLDH

SEQ ID NO: 30853 - protein, 8 aa, Homo sapiens
  light chain complementarity determining region 3 for antibody 15427
QQSYSTPH

SEQ ID NO: 30854 - protein, 20 aa, Homo sapiens
  heavy chain complementarity determining region 3 for antibody 15427
AKDDGVYSAYGTSYYYAMDV

SEQ ID NO: 30855 - protein, 9 aa, Homo sapiens
  light chain complementarity determining region 3 for antibody 15428
QQSYSTPGS

SEQ ID NO: 30856 - protein, 13 aa, Homo sapiens
  heavy chain complementarity determining region 3 for antibody 15428
ASGGYSYGDVADY

SEQ ID NO: 30857 - protein, 9 aa, Homo sapiens
  light chain complementarity determining region 3 for antibody 15429
QQSYSTPFT

SEQ ID NO: 30858 - protein, 13 aa, Homo sapiens
  heavy chain complementarity determining region 3 for antibody 15429
TRTYGSGRNWFDP

SEQ ID NO: 30859 - protein, 9 aa, Homo sapiens
  light chain complementarity determining region 3 for antibody 15430
QQSYSTPFT

SEQ ID NO: 30860 - protein, 14 aa, Homo sapiens
  heavy chain complementarity determining region 3 for antibody 15430
ASLPGRYPRHGFDV

SEQ ID NO: 30861 - protein, 9 aa, Homo sapiens
  light chain complementarity determining region 3 for antibody 15431
QQSYSTPFT

SEQ ID NO: 30862 - protein, 14 aa, Homo sapiens
  heavy chain complementarity determining region 3 for antibody 15431
ARPPGRYPRYGMDV

SEQ ID NO: 30863 - protein, 9 aa, Homo sapiens
  light chain complementarity determining region 3 for antibody 15432
QQSYSTPFT

SEQ ID NO: 30864 - protein, 14 aa, Homo sapiens
  heavy chain complementarity determining region 3 for antibody 15432
ARLTGRYPRYGMDV

SEQ ID NO: 30865 - protein, 9 aa, Homo sapiens
  light chain complementarity determining region 3 for antibody 15433
QQSYSTPFT

SEQ ID NO: 30866 - protein, 14 aa, Homo sapiens
  heavy chain complementarity determining region 3 for antibody 15433
ARLPGSYPRYGMDV

SEQ ID NO: 30867 - protein, 9 aa, Homo sapiens
  light chain complementarity determining region 3 for antibody 15434
QQSYSTPFT

SEQ ID NO: 30868 - protein, 14 aa, Homo sapiens
  heavy chain complementarity determining region 3 for antibody 15434
ARLPGRYPRYGMDF

SEQ ID NO: 30869 - protein, 9 aa, Homo sapiens
  light chain complementarity determining region 3 for antibody 15435
QQSYSTPFT

SEQ ID NO: 30870 - protein, 14 aa, Homo sapiens
  heavy chain complementarity determining region 3 for antibody 15435
ARLPGRFPRHGFDV

SEQ ID NO: 30871 - protein, 9 aa, Homo sapiens
  light chain complementarity determining region 3 for antibody 15436
QQSYSTPFT

SEQ ID NO: 30872 - protein, 14 aa, Homo sapiens
  heavy chain complementarity determining region 3 for antibody 15436
ARLPGRCPRYGMDV

SEQ ID NO: 30873 - protein, 9 aa, Homo sapiens
  light chain complementarity determining region 3 for antibody 15437
QQSYSTPFT

SEQ ID NO: 30874 - protein, 14 aa, Homo sapiens
  heavy chain complementarity determining region 3 for antibody 15437
ARLPGGYPRYGMDV

SEQ ID NO: 30875 - protein, 9 aa, Homo sapiens
  light chain complementarity determining region 3 for antibody 15438
QQSYSTPFT

SEQ ID NO: 30876 - protein, 15 aa, Homo sapiens
  heavy chain complementarity determining region 3 for antibody 15438
AKGGDTAMLDWYSDL

SEQ ID NO: 30877 - protein, 9 aa, Homo sapiens
  light chain complementarity determining region 3 for antibody 15439
QQSYSTPFT

SEQ ID NO: 30878 - protein, 14 aa, Homo sapiens
  heavy chain complementarity determining region 3 for antibody 15439
AGLPGRYPRYGMDV

SEQ ID NO: 30879 - protein, 9 aa, Homo sapiens
  light chain complementarity determining region 3 for antibody 15440
QQSYSTPFP

SEQ ID NO: 30880 - protein, 14 aa, Homo sapiens
  heavy chain complementarity determining region 3 for antibody 15440
ARLPGRYPRYGMDV

SEQ ID NO: 30881 - protein, 9 aa, Homo sapiens
  light chain complementarity determining region 3 for antibody 15441
QQSYSTPFN

SEQ ID NO: 30882 - protein, 18 aa, Homo sapiens
  heavy chain complementarity determining region 3 for antibody 15441
ARTRVGMYSGGPPFMFDP

SEQ ID NO: 30883 - protein, 10 aa, Homo sapiens
  light chain complementarity determining region 3 for antibody 15442
QQSYSTPFLT

SEQ ID NO: 30884 - protein, 15 aa, Homo sapiens
  heavy chain complementarity determining region 3 for antibody 15442
AVWESMTEWLGPFDY

SEQ ID NO: 30885 - protein, 9 aa, Homo sapiens
  light chain complementarity determining region 3 for antibody 15443
QQSYSTPFA

SEQ ID NO: 30886 - protein, 14 aa, Homo sapiens
  heavy chain complementarity determining region 3 for antibody 15443
ARLPGRYPRHGFDV

SEQ ID NO: 30887 - protein, 7 aa, Homo sapiens
  light chain complementarity determining region 3 for antibody 15444
QQSYSTP

SEQ ID NO: 30888 - protein, 13 aa, Homo sapiens
  heavy chain complementarity determining region 3 for antibody 15444
ASSFCSGGSRYDY

SEQ ID NO: 30889 - protein, 10 aa, Homo sapiens
  light chain complementarity determining region 3 for antibody 15445
QQSYSTNLFT

SEQ ID NO: 30890 - protein, 14 aa, Homo sapiens
  heavy chain complementarity determining region 3 for antibody 15445
ARMAYGGSDYWFDP

SEQ ID NO: 30891 - protein, 9 aa, Homo sapiens
  light chain complementarity determining region 3 for antibody 15446
QQSYSTLYP

SEQ ID NO: 30892 - protein, 13 aa, Homo sapiens
  heavy chain complementarity determining region 3 for antibody 15446
ARETRLWGDAFDF

SEQ ID NO: 30893 - protein, 9 aa, Homo sapiens
  light chain complementarity determining region 3 for antibody 15447
QQSYSTLWT

SEQ ID NO: 30894 - protein, 15 aa, Homo sapiens
  heavy chain complementarity determining region 3 for antibody 15447
ARAPPIAVAINGMDV

SEQ ID NO: 30895 - protein, 8 aa, Homo sapiens
  light chain complementarity determining region 3 for antibody 15448
QQSYSTLT

SEQ ID NO: 30896 - protein, 11 aa, Homo sapiens
  heavy chain complementarity determining region 3 for antibody 15448
ARHVYYYHLDF

SEQ ID NO: 30897 - protein, 8 aa, Homo sapiens
  light chain complementarity determining region 3 for antibody 15449
QQSYSTLT

SEQ ID NO: 30898 - protein, 10 aa, Homo sapiens
  heavy chain complementarity determining region 3 for antibody 15449
ARHVYYHLDV

SEQ ID NO: 30899 - protein, 8 aa, Homo sapiens
  light chain complementarity determining region 3 for antibody 15450
QQSYSTLT

SEQ ID NO: 30900 - protein, 11 aa, Homo sapiens
  heavy chain complementarity determining region 3 for antibody 15450
ARHVSYYHLDV

SEQ ID NO: 30901 - protein, 8 aa, Homo sapiens
  light chain complementarity determining region 3 for antibody 15451
QQSYSTLT

SEQ ID NO: 30902 - protein, 11 aa, Homo sapiens
  heavy chain complementarity determining region 3 for antibody 15451
ARHGYYYHLDV

SEQ ID NO: 30903 - protein, 10 aa, Homo sapiens
  light chain complementarity determining region 3 for antibody 15452
QQSYSTLSWT

SEQ ID NO: 30904 - protein, 19 aa, Homo sapiens
  heavy chain complementarity determining region 3 for antibody 15452
ARDKVEGDYAQWDCYGMDV

SEQ ID NO: 30905 - protein, 10 aa, Homo sapiens
  light chain complementarity determining region 3 for antibody 15453
QQSYSTLSWT

SEQ ID NO: 30906 - protein, 19 aa, Homo sapiens
  heavy chain complementarity determining region 3 for antibody 15453
ARDKVEGDFAQWDYYGMDV

SEQ ID NO: 30907 - protein, 10 aa, Homo sapiens
  light chain complementarity determining region 3 for antibody 15454
QQSYSTLSWP

SEQ ID NO: 30908 - protein, 19 aa, Homo sapiens
  heavy chain complementarity determining region 3 for antibody 15454
ARDKVEGDYAQWDYYGMDV

SEQ ID NO: 30909 - protein, 10 aa, Homo sapiens
  light chain complementarity determining region 3 for antibody 15455
QQSYSTLSLT

SEQ ID NO: 30910 - protein, 19 aa, Homo sapiens
  heavy chain complementarity determining region 3 for antibody 15455
ARDKVEGDYAQWDYYGMDV

SEQ ID NO: 30911 - protein, 9 aa, Homo sapiens
  light chain complementarity determining region 3 for antibody 15456
QQSYSTLGS

SEQ ID NO: 30912 - protein, 13 aa, Homo sapiens
  heavy chain complementarity determining region 3 for antibody 15456
ASGGYSYGYVADY

SEQ ID NO: 30913 - protein, 9 aa, Homo sapiens
  light chain complementarity determining region 3 for antibody 15457
QQSYSTLGS

SEQ ID NO: 30914 - protein, 19 aa, Homo sapiens
  heavy chain complementarity determining region 3 for antibody 15457
ARSDYSGDTDRYYDYGMDV

SEQ ID NO: 30915 - protein, 9 aa, Homo sapiens
  light chain complementarity determining region 3 for antibody 15458
QQSYSTLFT

SEQ ID NO: 30916 - protein, 18 aa, Homo sapiens
  heavy chain complementarity determining region 3 for antibody 15458
ARARRDWQIYGDYYYFDY

SEQ ID NO: 30917 - protein, 10 aa, Homo sapiens
  light chain complementarity determining region 3 for antibody 15459
QQSYSTHLFT

SEQ ID NO: 30918 - protein, 14 aa, Homo sapiens
  heavy chain complementarity determining region 3 for antibody 15459
ARVAYGGSDYWFDP

SEQ ID NO: 30919 - protein, 10 aa, Homo sapiens
  light chain complementarity determining region 3 for antibody 15460
QQSYSTHLFT

SEQ ID NO: 30920 - protein, 14 aa, Homo sapiens
  heavy chain complementarity determining region 3 for antibody 15460
ARMAYGGSDYWFDS

SEQ ID NO: 30921 - protein, 10 aa, Homo sapiens
  light chain complementarity determining region 3 for antibody 15461
QQSYSTHLFT

SEQ ID NO: 30922 - protein, 14 aa, Homo sapiens
  heavy chain complementarity determining region 3 for antibody 15461
ARMAYGGPDYWFDP

SEQ ID NO: 30923 - protein, 8 aa, Homo sapiens
  light chain complementarity determining region 3 for antibody 15462
QQSYSTFH

SEQ ID NO: 30924 - protein, 20 aa, Homo sapiens
  heavy chain complementarity determining region 3 for antibody 15462
AKDDGAYSVDDTDYYYAMDV

SEQ ID NO: 30925 - protein, 9 aa, Homo sapiens
  light chain complementarity determining region 3 for antibody 15463
QQSYSSTWT

SEQ ID NO: 30926 - protein, 23 aa, Homo sapiens
  heavy chain complementarity determining region 3 for antibody 15463
ARGVTGPYASNWYESDYYYGMDV

SEQ ID NO: 30927 - protein, 9 aa, Homo sapiens
  light chain complementarity determining region 3 for antibody 15464
QQSYSSTWT

SEQ ID NO: 30928 - protein, 23 aa, Homo sapiens
  heavy chain complementarity determining region 3 for antibody 15464
ARGVIGPYASNWYESDYYYGVDV

SEQ ID NO: 30929 - protein, 9 aa, Homo sapiens
  light chain complementarity determining region 3 for antibody 15465
QQSYSSTWT

SEQ ID NO: 30930 - protein, 23 aa, Homo sapiens
  heavy chain complementarity determining region 3 for antibody 15465
ARGVIGPYASNWYESDYYYGMGV

SEQ ID NO: 30931 - protein, 9 aa, Homo sapiens
  light chain complementarity determining region 3 for antibody 15466
QQSYSSTGT

SEQ ID NO: 30932 - protein, 23 aa, Homo sapiens
  heavy chain complementarity determining region 3 for antibody 15466
ARGVIGPYASNWYESDYYYGMDV

SEQ ID NO: 30933 - protein, 10 aa, Homo sapiens
  light chain complementarity determining region 3 for antibody 15467
QQSYSSRLFT

SEQ ID NO: 30934 - protein, 20 aa, Homo sapiens
  heavy chain complementarity determining region 3 for antibody 15467
ARTTQEYSSSWYWGYYGMDV

SEQ ID NO: 30935 - protein, 10 aa, Homo sapiens
  light chain complementarity determining region 3 for antibody 15468
QQSYSSRILT

SEQ ID NO: 30936 - protein, 20 aa, Homo sapiens
  heavy chain complementarity determining region 3 for antibody 15468
ARTTQEYSSSWYWGYYGMDV

SEQ ID NO: 30937 - protein, 11 aa, Homo sapiens
  light chain complementarity determining region 3 for antibody 15469
QQSYSSPSEYT

SEQ ID NO: 30938 - protein, 12 aa, Homo sapiens
  heavy chain complementarity determining region 3 for antibody 15469
ARPDYGDHKIDL

SEQ ID NO: 30939 - protein, 10 aa, Homo sapiens
  light chain complementarity determining region 3 for antibody 15470
QQSYSSPQST

SEQ ID NO: 30940 - protein, 22 aa, Homo sapiens
  heavy chain complementarity determining region 3 for antibody 15470
ARHRCRASCYGGFWTHYNWFDP

SEQ ID NO: 30941 - protein, 11 aa, Homo sapiens
  light chain complementarity determining region 3 for antibody 15471
QQSYSSPPEYT

SEQ ID NO: 30942 - protein, 12 aa, Homo sapiens
  heavy chain complementarity determining region 3 for antibody 15471
ARPDYGDHKIGL

SEQ ID NO: 30943 - protein, 11 aa, Homo sapiens
  light chain complementarity determining region 3 for antibody 15472
QQSYSSPPEYT

SEQ ID NO: 30944 - protein, 12 aa, Homo sapiens
  heavy chain complementarity determining region 3 for antibody 15472
ARPDYGDHKIDP

SEQ ID NO: 30945 - protein, 11 aa, Homo sapiens
  light chain complementarity determining region 3 for antibody 15473
QQSYSSPPEYT

SEQ ID NO: 30946 - protein, 12 aa, Homo sapiens
  heavy chain complementarity determining region 3 for antibody 15473
ARPDSGDHKIDL

SEQ ID NO: 30947 - protein, 9 aa, Homo sapiens
  light chain complementarity determining region 3 for antibody 15474
QQSYSSPPA

SEQ ID NO: 30948 - protein, 14 aa, Homo sapiens
  heavy chain complementarity determining region 3 for antibody 15474
ARIWGSSSVDAFDI

SEQ ID NO: 30949 - protein, 8 aa, Homo sapiens
  light chain complementarity determining region 3 for antibody 15475
QQSYSSLT

SEQ ID NO: 30950 - protein, 19 aa, Homo sapiens
  heavy chain complementarity determining region 3 for antibody 15475
VRDSLSYFDWIRPTNWFDA

SEQ ID NO: 30951 - protein, 8 aa, Homo sapiens
  light chain complementarity determining region 3 for antibody 15476
QQSYSSLT

SEQ ID NO: 30952 - protein, 19 aa, Homo sapiens
  heavy chain complementarity determining region 3 for antibody 15476
VRDALRYFDWIRPTNWFDA

SEQ ID NO: 30953 - protein, 10 aa, Homo sapiens
  light chain complementarity determining region 3 for antibody 15477
QQSYSSHMST

SEQ ID NO: 30954 - protein, 21 aa, Homo sapiens
  heavy chain complementarity determining region 3 for antibody 15477
ARGYLESLYGDYLHYYYAMDV

SEQ ID NO: 30955 - protein, 9 aa, Homo sapiens
  light chain complementarity determining region 3 for antibody 15478
QQSYSSFFT

SEQ ID NO: 30956 - protein, 20 aa, Homo sapiens
  heavy chain complementarity determining region 3 for antibody 15478
ARTVVGRTLFGARFGGVLDY

SEQ ID NO: 30957 - protein, 9 aa, Homo sapiens
  light chain complementarity determining region 3 for antibody 15479
QQSYSPPST

SEQ ID NO: 30958 - protein, 15 aa, Homo sapiens
  heavy chain complementarity determining region 3 for antibody 15479
ARGGAVRPRYRGMDV

SEQ ID NO: 30959 - protein, 8 aa, Homo sapiens
  light chain complementarity determining region 3 for antibody 15480
QQSYSPLT

SEQ ID NO: 30960 - protein, 11 aa, Homo sapiens
  heavy chain complementarity determining region 3 for antibody 15480
ARHVYYYHLDV

SEQ ID NO: 30961 - protein, 9 aa, Homo sapiens
  light chain complementarity determining region 3 for antibody 15481
QQSYSNPLT

SEQ ID NO: 30962 - protein, 22 aa, Homo sapiens
  heavy chain complementarity determining region 3 for antibody 15481
LRDGDTYYYDGDRYYYGPGFDF

SEQ ID NO: 30963 - protein, 9 aa, Homo sapiens
  light chain complementarity determining region 3 for antibody 15482
QQSYSNPLT

SEQ ID NO: 30964 - protein, 15 aa, Homo sapiens
  heavy chain complementarity determining region 3 for antibody 15482
ARDSDDSGGLYRFED

SEQ ID NO: 30965 - protein, 10 aa, Homo sapiens
  light chain complementarity determining region 3 for antibody 15483
QQSYSNLGAT

SEQ ID NO: 30966 - protein, 5 aa, Homo sapiens
  heavy chain complementarity determining region 3 for antibody 15483
YGMDV

SEQ ID NO: 30967 - protein, 9 aa, Homo sapiens
  light chain complementarity determining region 3 for antibody 15484
QQSYSMRLT

SEQ ID NO: 30968 - protein, 12 aa, Homo sapiens
  heavy chain complementarity determining region 3 for antibody 15484
ATMRSYYSGLDV

SEQ ID NO: 30969 - protein, 9 aa, Homo sapiens
  light chain complementarity determining region 3 for antibody 15485
QQSYSMRLT

SEQ ID NO: 30970 - protein, 12 aa, Homo sapiens
  heavy chain complementarity determining region 3 for antibody 15485
ATMRSYDNGLDV

SEQ ID NO: 30971 - protein, 9 aa, Homo sapiens
  light chain complementarity determining region 3 for antibody 15486
QQSYSMRLT

SEQ ID NO: 30972 - protein, 12 aa, Homo sapiens
  heavy chain complementarity determining region 3 for antibody 15486
AAMRSYYNGLDV

SEQ ID NO: 30973 - protein, 9 aa, Homo sapiens
  light chain complementarity determining region 3 for antibody 15487
QQSYSLRLT

SEQ ID NO: 30974 - protein, 12 aa, Homo sapiens
  heavy chain complementarity determining region 3 for antibody 15487
ATMRSYYNGLDV

SEQ ID NO: 30975 - protein, 9 aa, Homo sapiens
  light chain complementarity determining region 3 for antibody 15488
QQSYSLPYT

SEQ ID NO: 30976 - protein, 15 aa, Homo sapiens
  heavy chain complementarity determining region 3 for antibody 15488
ARGGAVRPRCYGMDV

SEQ ID NO: 30977 - protein, 9 aa, Homo sapiens
  light chain complementarity determining region 3 for antibody 15489
QQSYSLPYT

SEQ ID NO: 30978 - protein, 15 aa, Homo sapiens
  heavy chain complementarity determining region 3 for antibody 15489
ARGGAGRPRYYGMDV

SEQ ID NO: 30979 - protein, 9 aa, Homo sapiens
  light chain complementarity determining region 3 for antibody 15490
QQSYSLPYT

SEQ ID NO: 30980 - protein, 15 aa, Homo sapiens
  heavy chain complementarity determining region 3 for antibody 15490
ARGGAARPRYYGMDV

SEQ ID NO: 30981 - protein, 9 aa, Homo sapiens
  light chain complementarity determining region 3 for antibody 15491
QQSYSLPST

SEQ ID NO: 30982 - protein, 15 aa, Homo sapiens
  heavy chain complementarity determining region 3 for antibody 15491
ARGGAVRPRYYGMDV

SEQ ID NO: 30983 - protein, 9 aa, Homo sapiens
  light chain complementarity determining region 3 for antibody 15492
QQSYSLPRT

SEQ ID NO: 30984 - protein, 18 aa, Homo sapiens
  heavy chain complementarity determining region 3 for antibody 15492
ARIHEYDYDSSGGKALDV

SEQ ID NO: 30985 - protein, 10 aa, Homo sapiens
  light chain complementarity determining region 3 for antibody 15493
QQSYSIPPGT

SEQ ID NO: 30986 - protein, 15 aa, Homo sapiens
  heavy chain complementarity determining region 3 for antibody 15493
ARIIVVIWGKYYFDH

SEQ ID NO: 30987 - protein, 9 aa, Homo sapiens
  light chain complementarity determining region 3 for antibody 15494
QQSYSIPFT

SEQ ID NO: 30988 - protein, 16 aa, Homo sapiens
  heavy chain complementarity determining region 3 for antibody 15494
AHITVDCPFRTPYFDY

SEQ ID NO: 30989 - protein, 9 aa, Homo sapiens
  light chain complementarity determining region 3 for antibody 15495
QQSYSIPFT

SEQ ID NO: 30990 - protein, 16 aa, Homo sapiens
  heavy chain complementarity determining region 3 for antibody 15495
AHIAVDYPFRTPYFDY

SEQ ID NO: 30991 - protein, 10 aa, Homo sapiens
  light chain complementarity determining region 3 for antibody 15496
QQSYSIHMYT

SEQ ID NO: 30992 - protein, 21 aa, Homo sapiens
  heavy chain complementarity determining region 3 for antibody 15496
ARGYLESLNGDHQHCHYALDV

SEQ ID NO: 30993 - protein, 10 aa, Homo sapiens
  light chain complementarity determining region 3 for antibody 15497
QQSYSGPPLS

SEQ ID NO: 30994 - protein, 20 aa, Homo sapiens
  heavy chain complementarity determining region 3 for antibody 15497
ARHFRETLGGLAREFAAFDI

SEQ ID NO: 30995 - protein, 9 aa, Homo sapiens
  light chain complementarity determining region 3 for antibody 15498
QQSYSAPYT

SEQ ID NO: 30996 - protein, 15 aa, Homo sapiens
  heavy chain complementarity determining region 3 for antibody 15498
ASGGEPILGTNYLAY

SEQ ID NO: 30997 - protein, 9 aa, Homo sapiens
  light chain complementarity determining region 3 for antibody 15499
QQSYSAPYT

SEQ ID NO: 30998 - protein, 15 aa, Homo sapiens
  heavy chain complementarity determining region 3 for antibody 15499
ARDQRQLLNHRAFDV

SEQ ID NO: 30999 - protein, 9 aa, Homo sapiens
  light chain complementarity determining region 3 for antibody 15500
QQSYSAPRT

SEQ ID NO: 31000 - protein, 20 aa, Homo sapiens
  heavy chain complementarity determining region 3 for antibody 15500
VRDDILTGYYQSDYYHAMDV

SEQ ID NO: 31001 - protein, 9 aa, Homo sapiens
  light chain complementarity determining region 3 for antibody 15501
QQSYSAPRT

SEQ ID NO: 31002 - protein, 17 aa, Homo sapiens
  heavy chain complementarity determining region 3 for antibody 15501
TKDYYGDYMAQYNWFDS

SEQ ID NO: 31003 - protein, 10 aa, Homo sapiens
  light chain complementarity determining region 3 for antibody 15502
QQSYSAPPVT

SEQ ID NO: 31004 - protein, 15 aa, Homo sapiens
  heavy chain complementarity determining region 3 for antibody 15502
AKDMMTTGYYYGMDV

SEQ ID NO: 31005 - protein, 11 aa, Homo sapiens
  light chain complementarity determining region 3 for antibody 15503
QQSYSAPPMPT

SEQ ID NO: 31006 - protein, 22 aa, Homo sapiens
  heavy chain complementarity determining region 3 for antibody 15503
ARVTTYFYDTSGFSAVGYRMDV

SEQ ID NO: 31007 - protein, 11 aa, Homo sapiens
  light chain complementarity determining region 3 for antibody 15504
QQSYSAPPMHT

SEQ ID NO: 31008 - protein, 22 aa, Homo sapiens
  heavy chain complementarity determining region 3 for antibody 15504
ARVTTYSYDTSGFSAVGYRMDV

SEQ ID NO: 31009 - protein, 11 aa, Homo sapiens
  light chain complementarity determining region 3 for antibody 15505
QQSYSAPPMHT

SEQ ID NO: 31010 - protein, 22 aa, Homo sapiens
  heavy chain complementarity determining region 3 for antibody 15505
ARVTTYFYDTSGLSAVGYRMDV

SEQ ID NO: 31011 - protein, 11 aa, Homo sapiens
  light chain complementarity determining region 3 for antibody 15506
QQSYSAPPMHT

SEQ ID NO: 31012 - protein, 22 aa, Homo sapiens
  heavy chain complementarity determining region 3 for antibody 15506
ARVTTYFYDTSGFSAVGYRMDA

SEQ ID NO: 31013 - protein, 11 aa, Homo sapiens
  light chain complementarity determining region 3 for antibody 15507
QQSYSAPPMHT

SEQ ID NO: 31014 - protein, 22 aa, Homo sapiens
  heavy chain complementarity determining region 3 for antibody 15507
ARVTTYFYDTSGCSAVGYRMDV

SEQ ID NO: 31015 - protein, 11 aa, Homo sapiens
  light chain complementarity determining region 3 for antibody 15508
QQSYSAPPMHP

SEQ ID NO: 31016 - protein, 22 aa, Homo sapiens
  heavy chain complementarity determining region 3 for antibody 15508
ARVTTYFYDTSGFSAVGYRMDV

SEQ ID NO: 31017 - protein, 9 aa, Homo sapiens
  light chain complementarity determining region 3 for antibody 15509
QQSYSAPLT

SEQ ID NO: 31018 - protein, 12 aa, Homo sapiens
  heavy chain complementarity determining region 3 for antibody 15509
AKEYLTYGSGDY

SEQ ID NO: 31019 - protein, 9 aa, Homo sapiens
  light chain complementarity determining region 3 for antibody 15510
QQSYSAPLS

SEQ ID NO: 31020 - protein, 21 aa, Homo sapiens
  heavy chain complementarity determining region 3 for antibody 15510
ARGSGIMLGGGMYYYYYGMDV

SEQ ID NO: 31021 - protein, 9 aa, Homo sapiens
  light chain complementarity determining region 3 for antibody 15511
QQSYSAPLS

SEQ ID NO: 31022 - protein, 21 aa, Homo sapiens
  heavy chain complementarity determining region 3 for antibody 15511
ARGSGIMLGGEMYYDYYGMDV

SEQ ID NO: 31023 - protein, 9 aa, Homo sapiens
  light chain complementarity determining region 3 for antibody 15512
QQSYSAPIT

SEQ ID NO: 31024 - protein, 16 aa, Homo sapiens
  heavy chain complementarity determining region 3 for antibody 15512
AREGSGTAIEEGYFDY

SEQ ID NO: 31025 - protein, 8 aa, Homo sapiens
  light chain complementarity determining region 3 for antibody 15513
QQSYSALS

SEQ ID NO: 31026 - protein, 10 aa, Homo sapiens
  heavy chain complementarity determining region 3 for antibody 15513
AHLSRGVNFF

SEQ ID NO: 31027 - protein, 9 aa, Homo sapiens
  light chain complementarity determining region 3 for antibody 15514
QQSYRTPHT

SEQ ID NO: 31028 - protein, 14 aa, Homo sapiens
  heavy chain complementarity determining region 3 for antibody 15514
ARSGHDYGSLGIGS

SEQ ID NO: 31029 - protein, 9 aa, Homo sapiens
  light chain complementarity determining region 3 for antibody 15515
QQSYRPPQA

SEQ ID NO: 31030 - protein, 14 aa, Homo sapiens
  heavy chain complementarity determining region 3 for antibody 15515
ARSKEWFVGAAFDY

SEQ ID NO: 31031 - protein, 9 aa, Homo sapiens
  light chain complementarity determining region 3 for antibody 15516
QQSYRPPQA

SEQ ID NO: 31032 - protein, 14 aa, Homo sapiens
  heavy chain complementarity determining region 3 for antibody 15516
ARSKEWFLGAALDY

SEQ ID NO: 31033 - protein, 9 aa, Homo sapiens
  light chain complementarity determining region 3 for antibody 15517
QQSYRPPQA

SEQ ID NO: 31034 - protein, 14 aa, Homo sapiens
  heavy chain complementarity determining region 3 for antibody 15517
ARSKEWFLGAAFDH

SEQ ID NO: 31035 - protein, 9 aa, Homo sapiens
  light chain complementarity determining region 3 for antibody 15518
QQSYRHPQA

SEQ ID NO: 31036 - protein, 14 aa, Homo sapiens
  heavy chain complementarity determining region 3 for antibody 15518
ARSKEWFLGAAFDY

SEQ ID NO: 31037 - protein, 9 aa, Homo sapiens
  light chain complementarity determining region 3 for antibody 15519
QQSYRFPLS

SEQ ID NO: 31038 - protein, 13 aa, Homo sapiens
  heavy chain complementarity determining region 3 for antibody 15519
TRTYGSGRNWFDP

SEQ ID NO: 31039 - protein, 8 aa, Homo sapiens
  light chain complementarity determining region 3 for antibody 15520
QQSYRAPP

SEQ ID NO: 31040 - protein, 10 aa, Homo sapiens
  heavy chain complementarity determining region 3 for antibody 15520
AHLSRGVNFF

SEQ ID NO: 31041 - protein, 8 aa, Homo sapiens
  light chain complementarity determining region 3 for antibody 15521
QQSYRALS

SEQ ID NO: 31042 - protein, 10 aa, Homo sapiens
  heavy chain complementarity determining region 3 for antibody 15521
AHRSRGVNFF

SEQ ID NO: 31043 - protein, 8 aa, Homo sapiens
  light chain complementarity determining region 3 for antibody 15522
QQSYRALS

SEQ ID NO: 31044 - protein, 10 aa, Homo sapiens
  heavy chain complementarity determining region 3 for antibody 15522
AHLSRGVNCF

SEQ ID NO: 31045 - protein, 8 aa, Homo sapiens
  light chain complementarity determining region 3 for antibody 15523
QQSYRALS

SEQ ID NO: 31046 - protein, 10 aa, Homo sapiens
  heavy chain complementarity determining region 3 for antibody 15523
AHLSRGVDFF

SEQ ID NO: 31047 - protein, 8 aa, Homo sapiens
  light chain complementarity determining region 3 for antibody 15524
QQSYPAPS

SEQ ID NO: 31048 - protein, 10 aa, Homo sapiens
  heavy chain complementarity determining region 3 for antibody 15524
AHLSRGVNFF

SEQ ID NO: 31049 - protein, 8 aa, Homo sapiens
  light chain complementarity determining region 3 for antibody 15525
QQSYPALP

SEQ ID NO: 31050 - protein, 10 aa, Homo sapiens
  heavy chain complementarity determining region 3 for antibody 15525
AHLSRGVNFF

SEQ ID NO: 31051 - protein, 9 aa, Homo sapiens
  light chain complementarity determining region 3 for antibody 15526
QQSYNTQWT

SEQ ID NO: 31052 - protein, 14 aa, Homo sapiens
  heavy chain complementarity determining region 3 for antibody 15526
AAAKVWGYYYGMDV

SEQ ID NO: 31053 - protein, 9 aa, Homo sapiens
  light chain complementarity determining region 3 for antibody 15527
QQSYNTPWT

SEQ ID NO: 31054 - protein, 14 aa, Homo sapiens
  heavy chain complementarity determining region 3 for antibody 15527
AAVKVWGYYYGMDV

SEQ ID NO: 31055 - protein, 9 aa, Homo sapiens
  light chain complementarity determining region 3 for antibody 15528
QQSYNTPWT

SEQ ID NO: 31056 - protein, 14 aa, Homo sapiens
  heavy chain complementarity determining region 3 for antibody 15528
AAAKVWGYYYGMDD

SEQ ID NO: 31057 - protein, 9 aa, Homo sapiens
  light chain complementarity determining region 3 for antibody 15529
QQSYNTPWT

SEQ ID NO: 31058 - protein, 14 aa, Homo sapiens
  heavy chain complementarity determining region 3 for antibody 15529
AAAKVWGYYYCMDV

SEQ ID NO: 31059 - protein, 9 aa, Homo sapiens
  light chain complementarity determining region 3 for antibody 15530
QQSYNTPWT

SEQ ID NO: 31060 - protein, 14 aa, Homo sapiens
  heavy chain complementarity determining region 3 for antibody 15530
AAAKVWGYSYGMDV

SEQ ID NO: 31061 - protein, 9 aa, Homo sapiens
  light chain complementarity determining region 3 for antibody 15531
QQSYNTPWT

SEQ ID NO: 31062 - protein, 14 aa, Homo sapiens
  heavy chain complementarity determining region 3 for antibody 15531
AAAKVWGCYYGMDV

SEQ ID NO: 31063 - protein, 9 aa, Homo sapiens
  light chain complementarity determining region 3 for antibody 15532
QQSYNTPWT

SEQ ID NO: 31064 - protein, 14 aa, Homo sapiens
  heavy chain complementarity determining region 3 for antibody 15532
AAAKGWGYYYGMDV

SEQ ID NO: 31065 - protein, 9 aa, Homo sapiens
  light chain complementarity determining region 3 for antibody 15533
QQSYNTPWT

SEQ ID NO: 31066 - protein, 14 aa, Homo sapiens
  heavy chain complementarity determining region 3 for antibody 15533
AAAEVWGYYYGMDV

SEQ ID NO: 31067 - protein, 9 aa, Homo sapiens
  light chain complementarity determining region 3 for antibody 15534
QQSYNTPWP

SEQ ID NO: 31068 - protein, 14 aa, Homo sapiens
  heavy chain complementarity determining region 3 for antibody 15534
AAAKVWGYYYGMDV

SEQ ID NO: 31069 - protein, 9 aa, Homo sapiens
  light chain complementarity determining region 3 for antibody 15535
QQSYNTPLT

SEQ ID NO: 31070 - protein, 17 aa, Homo sapiens
  heavy chain complementarity determining region 3 for antibody 15535
AKVADNSGYYPYNWFDP

SEQ ID NO: 31071 - protein, 9 aa, Homo sapiens
  light chain complementarity determining region 3 for antibody 15536
QQSYNTPGT

SEQ ID NO: 31072 - protein, 14 aa, Homo sapiens
  heavy chain complementarity determining region 3 for antibody 15536
AAAKVWGYYYGMDV

SEQ ID NO: 31073 - protein, 9 aa, Homo sapiens
  light chain complementarity determining region 3 for antibody 15537
QQSYNTPFT

SEQ ID NO: 31074 - protein, 15 aa, Homo sapiens
  heavy chain complementarity determining region 3 for antibody 15537
VKNGVGLSGRRYSQH

SEQ ID NO: 31075 - protein, 9 aa, Homo sapiens
  light chain complementarity determining region 3 for antibody 15538
QQSYNTPCT

SEQ ID NO: 31076 - protein, 14 aa, Homo sapiens
  heavy chain complementarity determining region 3 for antibody 15538
AAAKVWGYYYGMDV

SEQ ID NO: 31077 - protein, 9 aa, Homo sapiens
  light chain complementarity determining region 3 for antibody 15539
QQSYNPRWT

SEQ ID NO: 31078 - protein, 14 aa, Homo sapiens
  heavy chain complementarity determining region 3 for antibody 15539
ARAGPSGTYSGFDS

SEQ ID NO: 31079 - protein, 9 aa, Homo sapiens
  light chain complementarity determining region 3 for antibody 15540
QQSYNLRWT

SEQ ID NO: 31080 - protein, 14 aa, Homo sapiens
  heavy chain complementarity determining region 3 for antibody 15540
ARAGPSGTYSGSDS

SEQ ID NO: 31081 - protein, 9 aa, Homo sapiens
  light chain complementarity determining region 3 for antibody 15541
QQSYNLRWT

SEQ ID NO: 31082 - protein, 14 aa, Homo sapiens
  heavy chain complementarity determining region 3 for antibody 15541
ARAGPSGTYPGFDS

SEQ ID NO: 31083 - protein, 9 aa, Homo sapiens
  light chain complementarity determining region 3 for antibody 15542
QQSYNLRWT

SEQ ID NO: 31084 - protein, 14 aa, Homo sapiens
  heavy chain complementarity determining region 3 for antibody 15542
ARAGPSGNYSGFDS

SEQ ID NO: 31085 - protein, 9 aa, Homo sapiens
  light chain complementarity determining region 3 for antibody 15543
QQSYNLRWA

SEQ ID NO: 31086 - protein, 14 aa, Homo sapiens
  heavy chain complementarity determining region 3 for antibody 15543
ARAGPSGTYSGFDS

SEQ ID NO: 31087 - protein, 9 aa, Homo sapiens
  light chain complementarity determining region 3 for antibody 15544
QQSYNLPYT

SEQ ID NO: 31088 - protein, 18 aa, Homo sapiens
  heavy chain complementarity determining region 3 for antibody 15544
ARLYGYDSAAYFFTHFDY

SEQ ID NO: 31089 - protein, 9 aa, Homo sapiens
  light chain complementarity determining region 3 for antibody 15545
QQSYNIRWT

SEQ ID NO: 31090 - protein, 14 aa, Homo sapiens
  heavy chain complementarity determining region 3 for antibody 15545
ARAGPSGTYSGFDS

SEQ ID NO: 31091 - protein, 9 aa, Homo sapiens
  light chain complementarity determining region 3 for antibody 15546
QQSYNFRWT

SEQ ID NO: 31092 - protein, 14 aa, Homo sapiens
  heavy chain complementarity determining region 3 for antibody 15546
ARAGPSGTYSGFDS

SEQ ID NO: 31093 - protein, 9 aa, Homo sapiens
  light chain complementarity determining region 3 for antibody 15547
QQSYNAPQT

SEQ ID NO: 31094 - protein, 15 aa, Homo sapiens
  heavy chain complementarity determining region 3 for antibody 15547
ATESVGQTASNAFDL

SEQ ID NO: 31095 - protein, 9 aa, Homo sapiens
  light chain complementarity determining region 3 for antibody 15548
QQSYNAPQT

SEQ ID NO: 31096 - protein, 15 aa, Homo sapiens
  heavy chain complementarity determining region 3 for antibody 15548
ATESVGPTASNAFDH

SEQ ID NO: 31097 - protein, 9 aa, Homo sapiens
  light chain complementarity determining region 3 for antibody 15549
QQSYNAPQK

SEQ ID NO: 31098 - protein, 15 aa, Homo sapiens
  heavy chain complementarity determining region 3 for antibody 15549
ATESVGPSASNAFDL

SEQ ID NO: 31099 - protein, 8 aa, Homo sapiens
  light chain complementarity determining region 3 for antibody 15550
QQSYNAIT

SEQ ID NO: 31100 - protein, 22 aa, Homo sapiens
  heavy chain complementarity determining region 3 for antibody 15550
AKDMAMIVVVVENPDTPDTLDY

SEQ ID NO: 31101 - protein, 8 aa, Homo sapiens
  light chain complementarity determining region 3 for antibody 15551
QQSYNAIT

SEQ ID NO: 31102 - protein, 22 aa, Homo sapiens
  heavy chain complementarity determining region 3 for antibody 15551
AKDIAMIVVVVESPDTPDTLDY

SEQ ID NO: 31103 - protein, 9 aa, Homo sapiens
  light chain complementarity determining region 3 for antibody 15552
QQSYITPRT

SEQ ID NO: 31104 - protein, 14 aa, Homo sapiens
  heavy chain complementarity determining region 3 for antibody 15552
ATESWSGSHLKLDY

SEQ ID NO: 31105 - protein, 9 aa, Homo sapiens
  light chain complementarity determining region 3 for antibody 15553
QQSYITPRP

SEQ ID NO: 31106 - protein, 19 aa, Homo sapiens
  heavy chain complementarity determining region 3 for antibody 15553
ARDGPILRFFDDPVYGMDV

SEQ ID NO: 31107 - protein, 9 aa, Homo sapiens
  light chain complementarity determining region 3 for antibody 15554
QQSYITPQT

SEQ ID NO: 31108 - protein, 19 aa, Homo sapiens
  heavy chain complementarity determining region 3 for antibody 15554
ERDPIPDIMVRGSKDGMDV

SEQ ID NO: 31109 - protein, 9 aa, Homo sapiens
  light chain complementarity determining region 3 for antibody 15555
QQSYITPQT

SEQ ID NO: 31110 - protein, 19 aa, Homo sapiens
  heavy chain complementarity determining region 3 for antibody 15555
ARDPIPDSMVRGSKDGMDV

SEQ ID NO: 31111 - protein, 9 aa, Homo sapiens
  light chain complementarity determining region 3 for antibody 15556
QQSYITPQP

SEQ ID NO: 31112 - protein, 19 aa, Homo sapiens
  heavy chain complementarity determining region 3 for antibody 15556
ARDPIPDIMVRGSKDGMDV

SEQ ID NO: 31113 - protein, 9 aa, Homo sapiens
  light chain complementarity determining region 3 for antibody 15557
QQSYITPLT

SEQ ID NO: 31114 - protein, 17 aa, Homo sapiens
  heavy chain complementarity determining region 3 for antibody 15557
AREGVLLERTRWGSVDV

SEQ ID NO: 31115 - protein, 8 aa, Homo sapiens
  light chain complementarity determining region 3 for antibody 15558
QQSYGYPT

SEQ ID NO: 31116 - protein, 13 aa, Homo sapiens
  heavy chain complementarity determining region 3 for antibody 15558
ARDRPGTYYVFDY

SEQ ID NO: 31117 - protein, 9 aa, Homo sapiens
  light chain complementarity determining region 3 for antibody 15559
QQSYGTPYT

SEQ ID NO: 31118 - protein, 17 aa, Homo sapiens
  heavy chain complementarity determining region 3 for antibody 15559
ARGSYYDVDLITYYFDH

SEQ ID NO: 31119 - protein, 9 aa, Homo sapiens
  light chain complementarity determining region 3 for antibody 15560
QQSYGTPRT

SEQ ID NO: 31120 - protein, 14 aa, Homo sapiens
  heavy chain complementarity determining region 3 for antibody 15560
ARVQVDYSNYGCDS

SEQ ID NO: 31121 - protein, 10 aa, Homo sapiens
  light chain complementarity determining region 3 for antibody 15561
QQSYGTLVLT

SEQ ID NO: 31122 - protein, 20 aa, Homo sapiens
  heavy chain complementarity determining region 3 for antibody 15561
ARDTERGSQIWSYYYYGVDV

SEQ ID NO: 31123 - protein, 10 aa, Homo sapiens
  light chain complementarity determining region 3 for antibody 15562
QQSYGTHLFT

SEQ ID NO: 31124 - protein, 14 aa, Homo sapiens
  heavy chain complementarity determining region 3 for antibody 15562
ARMAYGGSDYWFDP

SEQ ID NO: 31125 - protein, 9 aa, Homo sapiens
  light chain complementarity determining region 3 for antibody 15563
QQSYGSPFT

SEQ ID NO: 31126 - protein, 18 aa, Homo sapiens
  heavy chain complementarity determining region 3 for antibody 15563
ARDGGVYQQRNAVRGLDP

SEQ ID NO: 31127 - protein, 10 aa, Homo sapiens
  light chain complementarity determining region 3 for antibody 15564
QQSYGPPPLT

SEQ ID NO: 31128 - protein, 20 aa, Homo sapiens
  heavy chain complementarity determining region 3 for antibody 15564
TSHFRETLGGLKREFAAFDI

SEQ ID NO: 31129 - protein, 9 aa, Homo sapiens
  light chain complementarity determining region 3 for antibody 15565
QQSYGLPYT

SEQ ID NO: 31130 - protein, 15 aa, Homo sapiens
  heavy chain complementarity determining region 3 for antibody 15565
ARGGAVRTRYYGMDV

SEQ ID NO: 31131 - protein, 9 aa, Homo sapiens
  light chain complementarity determining region 3 for antibody 15566
QQSYGLPST

SEQ ID NO: 31132 - protein, 15 aa, Homo sapiens
  heavy chain complementarity determining region 3 for antibody 15566
ARGGAVRPRYYGMDV

SEQ ID NO: 31133 - protein, 10 aa, Homo sapiens
  light chain complementarity determining region 3 for antibody 15567
QQSYGLPPLT

SEQ ID NO: 31134 - protein, 20 aa, Homo sapiens
  heavy chain complementarity determining region 3 for antibody 15567
TRHFRETLGGLKREFAAFDI

SEQ ID NO: 31135 - protein, 9 aa, Homo sapiens
  light chain complementarity determining region 3 for antibody 15568
QQSYGIPYT

SEQ ID NO: 31136 - protein, 15 aa, Homo sapiens
  heavy chain complementarity determining region 3 for antibody 15568
ARGGAVRPRYYGMDV

SEQ ID NO: 31137 - protein, 9 aa, Homo sapiens
  light chain complementarity determining region 3 for antibody 15569
QQSYGFPYT

SEQ ID NO: 31138 - protein, 15 aa, Homo sapiens
  heavy chain complementarity determining region 3 for antibody 15569
ARGGAVRPRYYGMDV

SEQ ID NO: 31139 - protein, 9 aa, Homo sapiens
  light chain complementarity determining region 3 for antibody 15570
QQSYDVLYT

SEQ ID NO: 31140 - protein, 12 aa, Homo sapiens
  heavy chain complementarity determining region 3 for antibody 15570
AREIDTIFYSDY

SEQ ID NO: 31141 - protein, 9 aa, Homo sapiens
  light chain complementarity determining region 3 for antibody 15571
QQSYDVLDT

SEQ ID NO: 31142 - protein, 12 aa, Homo sapiens
  heavy chain complementarity determining region 3 for antibody 15571
ARGIDTIFYSDY

SEQ ID NO: 31143 - protein, 9 aa, Homo sapiens
  light chain complementarity determining region 3 for antibody 15572
QQSYDTPYT

SEQ ID NO: 31144 - protein, 13 aa, Homo sapiens
  heavy chain complementarity determining region 3 for antibody 15572
ASGLHSGYDYFDY

SEQ ID NO: 31145 - protein, 9 aa, Homo sapiens
  light chain complementarity determining region 3 for antibody 15573
QQSYDTPYT

SEQ ID NO: 31146 - protein, 12 aa, Homo sapiens
  heavy chain complementarity determining region 3 for antibody 15573
ARHYYGNNAAEL

SEQ ID NO: 31147 - protein, 9 aa, Homo sapiens
  light chain complementarity determining region 3 for antibody 15574
QQSYDTPYT

SEQ ID NO: 31148 - protein, 12 aa, Homo sapiens
  heavy chain complementarity determining region 3 for antibody 15574
ARHYYGNNAADF

SEQ ID NO: 31149 - protein, 9 aa, Homo sapiens
  light chain complementarity determining region 3 for antibody 15575
QQSSTSPLP

SEQ ID NO: 31150 - protein, 10 aa, Homo sapiens
  heavy chain complementarity determining region 3 for antibody 15575
ATGGGWLPED

SEQ ID NO: 31151 - protein, 9 aa, Homo sapiens
  light chain complementarity determining region 3 for antibody 15576
QQSSSTPRT

SEQ ID NO: 31152 - protein, 14 aa, Homo sapiens
  heavy chain complementarity determining region 3 for antibody 15576
ARVQVDYSNYGCDS

SEQ ID NO: 31153 - protein, 9 aa, Homo sapiens
  light chain complementarity determining region 3 for antibody 15577
QQSSSTPFT

SEQ ID NO: 31154 - protein, 14 aa, Homo sapiens
  heavy chain complementarity determining region 3 for antibody 15577
ARLPGRYPRYGMDV

SEQ ID NO: 31155 - protein, 9 aa, Homo sapiens
  light chain complementarity determining region 3 for antibody 15578
QQSQDAPST

SEQ ID NO: 31156 - protein, 13 aa, Homo sapiens
  heavy chain complementarity determining region 3 for antibody 15578
TRDLRRFLNWFDP

SEQ ID NO: 31157 - protein, 9 aa, Homo sapiens
  light chain complementarity determining region 3 for antibody 15579
QQSNTFPIT

SEQ ID NO: 31158 - protein, 19 aa, Homo sapiens
  heavy chain complementarity determining region 3 for antibody 15579
ARDRDYTIVDDSGSGVIDF

SEQ ID NO: 31159 - protein, 9 aa, Homo sapiens
  light chain complementarity determining region 3 for antibody 15580
QQSNSYSHT

SEQ ID NO: 31160 - protein, 21 aa, Homo sapiens
  heavy chain complementarity determining region 3 for antibody 15580
AREQSYTVAGINYYYYYAMDV

SEQ ID NO: 31161 - protein, 9 aa, Homo sapiens
  light chain complementarity determining region 3 for antibody 15581
QQSNSTPLT

SEQ ID NO: 31162 - protein, 22 aa, Homo sapiens
  heavy chain complementarity determining region 3 for antibody 15581
ARGSRGGFGEPVVYYYNYGMDV

SEQ ID NO: 31163 - protein, 9 aa, Homo sapiens
  light chain complementarity determining region 3 for antibody 15582
QQSNSSPIT

SEQ ID NO: 31164 - protein, 15 aa, Homo sapiens
  heavy chain complementarity determining region 3 for antibody 15582
ARCVDAACNYYGMDV

SEQ ID NO: 31165 - protein, 9 aa, Homo sapiens
  light chain complementarity determining region 3 for antibody 15583
QQSNSLPWT

SEQ ID NO: 31166 - protein, 16 aa, Homo sapiens
  heavy chain complementarity determining region 3 for antibody 15583
ARGYSGSDHPYNWFDP

SEQ ID NO: 31167 - protein, 9 aa, Homo sapiens
  light chain complementarity determining region 3 for antibody 15584
QQSNSLPIT

SEQ ID NO: 31168 - protein, 19 aa, Homo sapiens
  heavy chain complementarity determining region 3 for antibody 15584
ARDRDYTIVDDYGSGVFDY

SEQ ID NO: 31169 - protein, 9 aa, Homo sapiens
  light chain complementarity determining region 3 for antibody 15585
QQSNSIPWT

SEQ ID NO: 31170 - protein, 16 aa, Homo sapiens
  heavy chain complementarity determining region 3 for antibody 15585
ARGYSGSDQPYNWFDP

SEQ ID NO: 31171 - protein, 9 aa, Homo sapiens
  light chain complementarity determining region 3 for antibody 15586
QQSNSIPWT

SEQ ID NO: 31172 - protein, 16 aa, Homo sapiens
  heavy chain complementarity determining region 3 for antibody 15586
ARGYSGPDHPYNWFDP

SEQ ID NO: 31173 - protein, 9 aa, Homo sapiens
  light chain complementarity determining region 3 for antibody 15587
QQSNNLPYT

SEQ ID NO: 31174 - protein, 13 aa, Homo sapiens
  heavy chain complementarity determining region 3 for antibody 15587
ARAKWDLFGYFDF

SEQ ID NO: 31175 - protein, 9 aa, Homo sapiens
  light chain complementarity determining region 3 for antibody 15588
QQSNIFPLT

SEQ ID NO: 31176 - protein, 14 aa, Homo sapiens
  heavy chain complementarity determining region 3 for antibody 15588
ASFGGAVPGNPFDH

SEQ ID NO: 31177 - protein, 9 aa, Homo sapiens
  light chain complementarity determining region 3 for antibody 15589
QQSNIFPLT

SEQ ID NO: 31178 - protein, 14 aa, Homo sapiens
  heavy chain complementarity determining region 3 for antibody 15589
ASCGGAVPGNPFDR

SEQ ID NO: 31179 - protein, 9 aa, Homo sapiens
  light chain complementarity determining region 3 for antibody 15590
QQSLTAPLT

SEQ ID NO: 31180 - protein, 17 aa, Homo sapiens
  heavy chain complementarity determining region 3 for antibody 15590
TRSIVSGTGWNAGGFDC

SEQ ID NO: 31181 - protein, 9 aa, Homo sapiens
  light chain complementarity determining region 3 for antibody 15591
QQSLTAPLT

SEQ ID NO: 31182 - protein, 17 aa, Homo sapiens
  heavy chain complementarity determining region 3 for antibody 15591
TRSIVSGSGWSAGGFDC

SEQ ID NO: 31183 - protein, 9 aa, Homo sapiens
  light chain complementarity determining region 3 for antibody 15592
QQSLTAPLT

SEQ ID NO: 31184 - protein, 17 aa, Homo sapiens
  heavy chain complementarity determining region 3 for antibody 15592
TRSIVSGSGWNAGGSDC

SEQ ID NO: 31185 - protein, 9 aa, Homo sapiens
  light chain complementarity determining region 3 for antibody 15593
QQSLTAPLT

SEQ ID NO: 31186 - protein, 17 aa, Homo sapiens
  heavy chain complementarity determining region 3 for antibody 15593
TRSIVSGSGWNAGGFDF

SEQ ID NO: 31187 - protein, 9 aa, Homo sapiens
  light chain complementarity determining region 3 for antibody 15594
QQSLTAPLT

SEQ ID NO: 31188 - protein, 17 aa, Homo sapiens
  heavy chain complementarity determining region 3 for antibody 15594
TRPIVSGSGWNAGGFDC

SEQ ID NO: 31189 - protein, 9 aa, Homo sapiens
  light chain complementarity determining region 3 for antibody 15595
QQSLTAPLT

SEQ ID NO: 31190 - protein, 17 aa, Homo sapiens
  heavy chain complementarity determining region 3 for antibody 15595
TRAIVSGSGWNAGGFDC

SEQ ID NO: 31191 - protein, 9 aa, Homo sapiens
  light chain complementarity determining region 3 for antibody 15596
QQSLTAPLA

SEQ ID NO: 31192 - protein, 17 aa, Homo sapiens
  heavy chain complementarity determining region 3 for antibody 15596
TRSIVSGSGWNAGGFDC

SEQ ID NO: 31193 - protein, 9 aa, Homo sapiens
  light chain complementarity determining region 3 for antibody 15597
QQSLTAPFT

SEQ ID NO: 31194 - protein, 17 aa, Homo sapiens
  heavy chain complementarity determining region 3 for antibody 15597
TRSIVSGSGWNAGGFDC

SEQ ID NO: 31195 - protein, 10 aa, Homo sapiens
  light chain complementarity determining region 3 for antibody 15598
QQSLSPPSLT

SEQ ID NO: 31196 - protein, 10 aa, Homo sapiens
  heavy chain complementarity determining region 3 for antibody 15598
ARDWGWGFDP

SEQ ID NO: 31197 - protein, 10 aa, Homo sapiens
  light chain complementarity determining region 3 for antibody 15599
QQSLSPPPFP

SEQ ID NO: 31198 - protein, 18 aa, Homo sapiens
  heavy chain complementarity determining region 3 for antibody 15599
ARLFFEQLAGDHHYALDV

SEQ ID NO: 31199 - protein, 9 aa, Homo sapiens
  light chain complementarity determining region 3 for antibody 15600
QQSKSSPFT

SEQ ID NO: 31200 - protein, 13 aa, Homo sapiens
  heavy chain complementarity determining region 3 for antibody 15600
ARGGEQWVAWFDP

SEQ ID NO: 31201 - protein, 9 aa, Homo sapiens
  light chain complementarity determining region 3 for antibody 15601
QQSHTIRGT

SEQ ID NO: 31202 - protein, 14 aa, Homo sapiens
  heavy chain complementarity determining region 3 for antibody 15601
ARTGPSGTYSGFDS

SEQ ID NO: 31203 - protein, 9 aa, Homo sapiens
  light chain complementarity determining region 3 for antibody 15602
QQSHSVPLP

SEQ ID NO: 31204 - protein, 20 aa, Homo sapiens
  heavy chain complementarity determining region 3 for antibody 15602
AQDVRSPFPSGRTWAHFFDS

SEQ ID NO: 31205 - protein, 9 aa, Homo sapiens
  light chain complementarity determining region 3 for antibody 15603
QQSHSTPYT

SEQ ID NO: 31206 - protein, 21 aa, Homo sapiens
  heavy chain complementarity determining region 3 for antibody 15603
ARPGGQYCSGSNCYYDNWFGS

SEQ ID NO: 31207 - protein, 9 aa, Homo sapiens
  light chain complementarity determining region 3 for antibody 15604
QQSHSTPVT

SEQ ID NO: 31208 - protein, 16 aa, Homo sapiens
  heavy chain complementarity determining region 3 for antibody 15604
ARMDDSNGYYYGYFDL

SEQ ID NO: 31209 - protein, 9 aa, Homo sapiens
  light chain complementarity determining region 3 for antibody 15605
QQSHSTPRT

SEQ ID NO: 31210 - protein, 16 aa, Homo sapiens
  heavy chain complementarity determining region 3 for antibody 15605
AKDRILSFGEPSPFDY

SEQ ID NO: 31211 - protein, 11 aa, Homo sapiens
  light chain complementarity determining region 3 for antibody 15606
QQSHSTPPEYT

SEQ ID NO: 31212 - protein, 18 aa, Homo sapiens
  heavy chain complementarity determining region 3 for antibody 15606
ARAPIYDMNAYSYSWLDP

SEQ ID NO: 31213 - protein, 11 aa, Homo sapiens
  light chain complementarity determining region 3 for antibody 15607
QQSHSTPPEYT

SEQ ID NO: 31214 - protein, 18 aa, Homo sapiens
  heavy chain complementarity determining region 3 for antibody 15607
AGAPIYDTDGYSFTWFDP

SEQ ID NO: 31215 - protein, 11 aa, Homo sapiens
  light chain complementarity determining region 3 for antibody 15608
QQSHSTPPAYT

SEQ ID NO: 31216 - protein, 18 aa, Homo sapiens
  heavy chain complementarity determining region 3 for antibody 15608
ARAPIYDMNAYSYSWFDP

SEQ ID NO: 31217 - protein, 9 aa, Homo sapiens
  light chain complementarity determining region 3 for antibody 15609
QQSHSSTWT

SEQ ID NO: 31218 - protein, 23 aa, Homo sapiens
  heavy chain complementarity determining region 3 for antibody 15609
ARGVIGPYASNWYESDYYYGMDV

SEQ ID NO: 31219 - protein, 9 aa, Homo sapiens
  light chain complementarity determining region 3 for antibody 15610
QQSHSSPRS

SEQ ID NO: 31220 - protein, 15 aa, Homo sapiens
  heavy chain complementarity determining region 3 for antibody 15610
AREDDSSGRPRLFDY

SEQ ID NO: 31221 - protein, 9 aa, Homo sapiens
  light chain complementarity determining region 3 for antibody 15611
QQSHSLPPT

SEQ ID NO: 31222 - protein, 18 aa, Homo sapiens
  heavy chain complementarity determining region 3 for antibody 15611
TRHGPKFGKFPFYYGVAV

SEQ ID NO: 31223 - protein, 8 aa, Homo sapiens
  light chain complementarity determining region 3 for antibody 15612
QQSHSFPP

SEQ ID NO: 31224 - protein, 22 aa, Homo sapiens
  heavy chain complementarity determining region 3 for antibody 15612
ARHAGYSNTWYMNYYYYYGMDV

SEQ ID NO: 31225 - protein, 9 aa, Homo sapiens
  light chain complementarity determining region 3 for antibody 15613
QQSHNAPWT

SEQ ID NO: 31226 - protein, 14 aa, Homo sapiens
  heavy chain complementarity determining region 3 for antibody 15613
ARESCEDGVCKFDY

SEQ ID NO: 31227 - protein, 9 aa, Homo sapiens
  light chain complementarity determining region 3 for antibody 15614
QQSHATPIT

SEQ ID NO: 31228 - protein, 19 aa, Homo sapiens
  heavy chain complementarity determining region 3 for antibody 15614
TKGRIGSRTAYYYYFGMDV

SEQ ID NO: 31229 - protein, 10 aa, Homo sapiens
  light chain complementarity determining region 3 for antibody 15615
QQSGTLPLLT

SEQ ID NO: 31230 - protein, 18 aa, Homo sapiens
  heavy chain complementarity determining region 3 for antibody 15615
ARDVGYDSNANYNWYFDL

SEQ ID NO: 31231 - protein, 9 aa, Homo sapiens
  light chain complementarity determining region 3 for antibody 15616
QQSFTSPPT

SEQ ID NO: 31232 - protein, 20 aa, Homo sapiens
  heavy chain complementarity determining region 3 for antibody 15616
TRGMLYGSNYFNFGYWNFDL

SEQ ID NO: 31233 - protein, 9 aa, Homo sapiens
  light chain complementarity determining region 3 for antibody 15617
QQSFTIQFT

SEQ ID NO: 31234 - protein, 13 aa, Homo sapiens
  heavy chain complementarity determining region 3 for antibody 15617
TTDRCVGFSWADS

SEQ ID NO: 31235 - protein, 9 aa, Homo sapiens
  light chain complementarity determining region 3 for antibody 15618
QQSFTIQFT

SEQ ID NO: 31236 - protein, 13 aa, Homo sapiens
  heavy chain complementarity determining region 3 for antibody 15618
TTDRCVGFACADS

SEQ ID NO: 31237 - protein, 9 aa, Homo sapiens
  light chain complementarity determining region 3 for antibody 15619
QQSFTIQFT

SEQ ID NO: 31238 - protein, 13 aa, Homo sapiens
  heavy chain complementarity determining region 3 for antibody 15619
TADRCVGFSCADS

SEQ ID NO: 31239 - protein, 9 aa, Homo sapiens
  light chain complementarity determining region 3 for antibody 15620
QQSFTFPRT

SEQ ID NO: 31240 - protein, 17 aa, Homo sapiens
  heavy chain complementarity determining region 3 for antibody 15620
AADPEDNSGSYSGAGDY

SEQ ID NO: 31241 - protein, 9 aa, Homo sapiens
  light chain complementarity determining region 3 for antibody 15621
QQSFTFPRP

SEQ ID NO: 31242 - protein, 17 aa, Homo sapiens
  heavy chain complementarity determining region 3 for antibody 15621
ATDPEDNSGSYSGAGDY

SEQ ID NO: 31243 - protein, 9 aa, Homo sapiens
  light chain complementarity determining region 3 for antibody 15622
QQSFTAPLT

SEQ ID NO: 31244 - protein, 17 aa, Homo sapiens
  heavy chain complementarity determining region 3 for antibody 15622
TRSIVSGSGWNAGGFDC

SEQ ID NO: 31245 - protein, 9 aa, Homo sapiens
  light chain complementarity determining region 3 for antibody 15623
QQSFSTPWA

SEQ ID NO: 31246 - protein, 19 aa, Homo sapiens
  heavy chain complementarity determining region 3 for antibody 15623
ATMRYGSGELTYDYYGMDV

SEQ ID NO: 31247 - protein, 9 aa, Homo sapiens
  light chain complementarity determining region 3 for antibody 15624
QQSFSTPSS

SEQ ID NO: 31248 - protein, 12 aa, Homo sapiens
  heavy chain complementarity determining region 3 for antibody 15624
ARGGSGWRSFDS

SEQ ID NO: 31249 - protein, 10 aa, Homo sapiens
  light chain complementarity determining region 3 for antibody 15625
QQSFSTLLIT

SEQ ID NO: 31250 - protein, 21 aa, Homo sapiens
  heavy chain complementarity determining region 3 for antibody 15625
ARRGEKYYGSGTYCGPYGMDV

SEQ ID NO: 31251 - protein, 9 aa, Homo sapiens
  light chain complementarity determining region 3 for antibody 15626
QQSFSPPWV

SEQ ID NO: 31252 - protein, 19 aa, Homo sapiens
  heavy chain complementarity determining region 3 for antibody 15626
ATMRYGSGELTYDYYGMDV

SEQ ID NO: 31253 - protein, 9 aa, Homo sapiens
  light chain complementarity determining region 3 for antibody 15627
QQSFSPPWT

SEQ ID NO: 31254 - protein, 19 aa, Homo sapiens
  heavy chain complementarity determining region 3 for antibody 15627
ATLRYGSGELTYDYYGMDV

SEQ ID NO: 31255 - protein, 9 aa, Homo sapiens
  light chain complementarity determining region 3 for antibody 15628
QQSFSPPWS

SEQ ID NO: 31256 - protein, 19 aa, Homo sapiens
  heavy chain complementarity determining region 3 for antibody 15628
ATMRYGSGELTYDYYGMDV

SEQ ID NO: 31257 - protein, 9 aa, Homo sapiens
  light chain complementarity determining region 3 for antibody 15629
QQSFSPPWP

SEQ ID NO: 31258 - protein, 19 aa, Homo sapiens
  heavy chain complementarity determining region 3 for antibody 15629
ATLRYISGELTYDYYGMDV

SEQ ID NO: 31259 - protein, 9 aa, Homo sapiens
  light chain complementarity determining region 3 for antibody 15630
QQSFSPPWE

SEQ ID NO: 31260 - protein, 19 aa, Homo sapiens
  heavy chain complementarity determining region 3 for antibody 15630
ATMRYGSGELTYDYYGMDV

SEQ ID NO: 31261 - protein, 9 aa, Homo sapiens
  light chain complementarity determining region 3 for antibody 15631
QQSFSPPWA

SEQ ID NO: 31262 - protein, 19 aa, Homo sapiens
  heavy chain complementarity determining region 3 for antibody 15631
STMRYGSGELTYDYYGMDV

SEQ ID NO: 31263 - protein, 9 aa, Homo sapiens
  light chain complementarity determining region 3 for antibody 15632
QQSFSPPWA

SEQ ID NO: 31264 - protein, 19 aa, Homo sapiens
  heavy chain complementarity determining region 3 for antibody 15632
ATMRYGSGGLTYDYYGMDV

SEQ ID NO: 31265 - protein, 9 aa, Homo sapiens
  light chain complementarity determining region 3 for antibody 15633
QQSFSPPWA

SEQ ID NO: 31266 - protein, 19 aa, Homo sapiens
  heavy chain complementarity determining region 3 for antibody 15633
ATMRYGSGELTYNYYGMDV

SEQ ID NO: 31267 - protein, 9 aa, Homo sapiens
  light chain complementarity determining region 3 for antibody 15634
QQSFSPPWA

SEQ ID NO: 31268 - protein, 19 aa, Homo sapiens
  heavy chain complementarity determining region 3 for antibody 15634
ATMRYGSGELTYDYYSMDV

SEQ ID NO: 31269 - protein, 9 aa, Homo sapiens
  light chain complementarity determining region 3 for antibody 15635
QQSFSPPWA

SEQ ID NO: 31270 - protein, 19 aa, Homo sapiens
  heavy chain complementarity determining region 3 for antibody 15635
ATMRYGSGELTHDYYGMDV

SEQ ID NO: 31271 - protein, 9 aa, Homo sapiens
  light chain complementarity determining region 3 for antibody 15636
QQSFSPPWA

SEQ ID NO: 31272 - protein, 19 aa, Homo sapiens
  heavy chain complementarity determining region 3 for antibody 15636
ATMRYGSGELAYDYYGMDV

SEQ ID NO: 31273 - protein, 9 aa, Homo sapiens
  light chain complementarity determining region 3 for antibody 15637
QQSFSPPWA

SEQ ID NO: 31274 - protein, 19 aa, Homo sapiens
  heavy chain complementarity determining region 3 for antibody 15637
ATMRYGAGELTYDYYGMDV

SEQ ID NO: 31275 - protein, 9 aa, Homo sapiens
  light chain complementarity determining region 3 for antibody 15638
QQSFSPPWA

SEQ ID NO: 31276 - protein, 19 aa, Homo sapiens
  heavy chain complementarity determining region 3 for antibody 15638
ATLRYIAGELTYDYYGMDV

SEQ ID NO: 31277 - protein, 10 aa, Homo sapiens
  light chain complementarity determining region 3 for antibody 15639
QQSFSPPSLT

SEQ ID NO: 31278 - protein, 10 aa, Homo sapiens
  heavy chain complementarity determining region 3 for antibody 15639
AGDWGWGFDP

SEQ ID NO: 31279 - protein, 10 aa, Homo sapiens
  light chain complementarity determining region 3 for antibody 15640
QQSFSGPPWT

SEQ ID NO: 31280 - protein, 19 aa, Homo sapiens
  heavy chain complementarity determining region 3 for antibody 15640
AREIHVLVENLPTTTALDL

SEQ ID NO: 31281 - protein, 9 aa, Homo sapiens
  light chain complementarity determining region 3 for antibody 15641
QQSFLPPWP

SEQ ID NO: 31282 - protein, 14 aa, Homo sapiens
  heavy chain complementarity determining region 3 for antibody 15641
VRSYETSGDSWFDP

SEQ ID NO: 31283 - protein, 8 aa, Homo sapiens
  light chain complementarity determining region 3 for antibody 15642
QQSFASPA

SEQ ID NO: 31284 - protein, 16 aa, Homo sapiens
  heavy chain complementarity determining region 3 for antibody 15642
ARVGPTNMSRYYPMDV

SEQ ID NO: 31285 - protein, 9 aa, Homo sapiens
  light chain complementarity determining region 3 for antibody 15643
QQSDSSSLT

SEQ ID NO: 31286 - protein, 21 aa, Homo sapiens
  heavy chain complementarity determining region 3 for antibody 15643
AHTESTTIFGVVLSYYNWFDP

SEQ ID NO: 31287 - protein, 9 aa, Homo sapiens
  light chain complementarity determining region 3 for antibody 15644
QQSDSLPLT

SEQ ID NO: 31288 - protein, 18 aa, Homo sapiens
  heavy chain complementarity determining region 3 for antibody 15644
ARAPGDYDMLRRGYYFDH

SEQ ID NO: 31289 - protein, 10 aa, Homo sapiens
  light chain complementarity determining region 3 for antibody 15645
QQSCSTLSWT

SEQ ID NO: 31290 - protein, 19 aa, Homo sapiens
  heavy chain complementarity determining region 3 for antibody 15645
ARDKVEGDYAQWDYYGMDV

SEQ ID NO: 31291 - protein, 9 aa, Homo sapiens
  light chain complementarity determining region 3 for antibody 15646
QQRYSTPYT

SEQ ID NO: 31292 - protein, 15 aa, Homo sapiens
  heavy chain complementarity determining region 3 for antibody 15646
ARGGAVRPRYYGMDV

SEQ ID NO: 31293 - protein, 9 aa, Homo sapiens
  light chain complementarity determining region 3 for antibody 15647
QQRYSTPRT

SEQ ID NO: 31294 - protein, 18 aa, Homo sapiens
  heavy chain complementarity determining region 3 for antibody 15647
VREKVGDYCTGSCSFYEN

SEQ ID NO: 31295 - protein, 9 aa, Homo sapiens
  light chain complementarity determining region 3 for antibody 15648
QQRYSTPLT

SEQ ID NO: 31296 - protein, 17 aa, Homo sapiens
  heavy chain complementarity determining region 3 for antibody 15648
ARGSGSPGHYYYYGMDV

SEQ ID NO: 31297 - protein, 9 aa, Homo sapiens
  light chain complementarity determining region 3 for antibody 15649
QQRYSTPFT

SEQ ID NO: 31298 - protein, 14 aa, Homo sapiens
  heavy chain complementarity determining region 3 for antibody 15649
ARLPGIYPRYGMDV

SEQ ID NO: 31299 - protein, 9 aa, Homo sapiens
  light chain complementarity determining region 3 for antibody 15650
QQRYSTPFP

SEQ ID NO: 31300 - protein, 14 aa, Homo sapiens
  heavy chain complementarity determining region 3 for antibody 15650
ARLPGRYPRYGMDV

SEQ ID NO: 31301 - protein, 8 aa, Homo sapiens
  light chain complementarity determining region 3 for antibody 15651
QQRYSSLT

SEQ ID NO: 31302 - protein, 19 aa, Homo sapiens
  heavy chain complementarity determining region 3 for antibody 15651
VRDSLRYFDWIRPTNWFDA

SEQ ID NO: 31303 - protein, 9 aa, Homo sapiens
  light chain complementarity determining region 3 for antibody 15652
QQRYSNPYT

SEQ ID NO: 31304 - protein, 17 aa, Homo sapiens
  heavy chain complementarity determining region 3 for antibody 15652
ARGSYYDVDLNRFYFDY

SEQ ID NO: 31305 - protein, 9 aa, Homo sapiens
  light chain complementarity determining region 3 for antibody 15653
QQRYSLPYT

SEQ ID NO: 31306 - protein, 15 aa, Homo sapiens
  heavy chain complementarity determining region 3 for antibody 15653
ARGGAVRPRYYGMDV

SEQ ID NO: 31307 - protein, 9 aa, Homo sapiens
  light chain complementarity determining region 3 for antibody 15654
QQRYNTPWT

SEQ ID NO: 31308 - protein, 14 aa, Homo sapiens
  heavy chain complementarity determining region 3 for antibody 15654
AAAKVWGYYYGMDV

SEQ ID NO: 31309 - protein, 9 aa, Homo sapiens
  light chain complementarity determining region 3 for antibody 15655
QQRYNLRWT

SEQ ID NO: 31310 - protein, 14 aa, Homo sapiens
  heavy chain complementarity determining region 3 for antibody 15655
ARAGPSGTYSGFDS

SEQ ID NO: 31311 - protein, 10 aa, Homo sapiens
  light chain complementarity determining region 3 for antibody 15656
QQRYGPRPWT

SEQ ID NO: 31312 - protein, 15 aa, Homo sapiens
  heavy chain complementarity determining region 3 for antibody 15656
ARVSGPWVMIYYFDY

SEQ ID NO: 31313 - protein, 9 aa, Homo sapiens
  light chain complementarity determining region 3 for antibody 15657
QQRTTWPVT

SEQ ID NO: 31314 - protein, 19 aa, Homo sapiens
  heavy chain complementarity determining region 3 for antibody 15657
VRARQYRSSWYGPSDAFDI

SEQ ID NO: 31315 - protein, 10 aa, Homo sapiens
  light chain complementarity determining region 3 for antibody 15658
QQRTRWPPPT

SEQ ID NO: 31316 - protein, 12 aa, Homo sapiens
  heavy chain complementarity determining region 3 for antibody 15658
TDTHVTGGDWDY

SEQ ID NO: 31317 - protein, 10 aa, Homo sapiens
  light chain complementarity determining region 3 for antibody 15659
QQRTRWPPLT

SEQ ID NO: 31318 - protein, 12 aa, Homo sapiens
  heavy chain complementarity determining region 3 for antibody 15659
TDTRVTGGDWDY

SEQ ID NO: 31319 - protein, 10 aa, Homo sapiens
  light chain complementarity determining region 3 for antibody 15660
QQRTRWPPLT

SEQ ID NO: 31320 - protein, 12 aa, Homo sapiens
  heavy chain complementarity determining region 3 for antibody 15660
TDTPVTGGDWDY

SEQ ID NO: 31321 - protein, 10 aa, Homo sapiens
  light chain complementarity determining region 3 for antibody 15661
QQRTRWPPLT

SEQ ID NO: 31322 - protein, 12 aa, Homo sapiens
  heavy chain complementarity determining region 3 for antibody 15661
TDTHVTEGDWDY

SEQ ID NO: 31323 - protein, 10 aa, Homo sapiens
  light chain complementarity determining region 3 for antibody 15662
QQRTRWPPLT

SEQ ID NO: 31324 - protein, 12 aa, Homo sapiens
  heavy chain complementarity determining region 3 for antibody 15662
ADTHVTGGDWDY

SEQ ID NO: 31325 - protein, 9 aa, Homo sapiens
  light chain complementarity determining region 3 for antibody 15663
QQRTNWPVT

SEQ ID NO: 31326 - protein, 19 aa, Homo sapiens
  heavy chain complementarity determining region 3 for antibody 15663
VRARQYRSSWHGPSDAFDI

SEQ ID NO: 31327 - protein, 11 aa, Homo sapiens
  light chain complementarity determining region 3 for antibody 15664
QQRTNWPPLFT

SEQ ID NO: 31328 - protein, 14 aa, Homo sapiens
  heavy chain complementarity determining region 3 for antibody 15664
ATSGSGYNLYYFDY

SEQ ID NO: 31329 - protein, 11 aa, Homo sapiens
  light chain complementarity determining region 3 for antibody 15665
QQRTNWPPIFP

SEQ ID NO: 31330 - protein, 14 aa, Homo sapiens
  heavy chain complementarity determining region 3 for antibody 15665
ATSGSGYNLYYFDY

SEQ ID NO: 31331 - protein, 10 aa, Homo sapiens
  light chain complementarity determining region 3 for antibody 15666
QQRTNWGALT

SEQ ID NO: 31332 - protein, 11 aa, Homo sapiens
  heavy chain complementarity determining region 3 for antibody 15666
TRDRITLAGDY

SEQ ID NO: 31333 - protein, 10 aa, Homo sapiens
  light chain complementarity determining region 3 for antibody 15667
QQRTNWGALP

SEQ ID NO: 31334 - protein, 11 aa, Homo sapiens
  heavy chain complementarity determining region 3 for antibody 15667
TRDLITLAGDY

SEQ ID NO: 31335 - protein, 9 aa, Homo sapiens
  light chain complementarity determining region 3 for antibody 15668
QQRTDWLLT

SEQ ID NO: 31336 - protein, 25 aa, Homo sapiens
  heavy chain complementarity determining region 3 for antibody 15668
ARGQLRPRINSMVRGREPRPPYLDY

SEQ ID NO: 31337 - protein, 10 aa, Homo sapiens
  light chain complementarity determining region 3 for antibody 15669
QQRSYWPHFT

SEQ ID NO: 31338 - protein, 19 aa, Homo sapiens
  heavy chain complementarity determining region 3 for antibody 15669
ARQANWSPTKTGGNYYLDS

SEQ ID NO: 31339 - protein, 10 aa, Homo sapiens
  light chain complementarity determining region 3 for antibody 15670
QQRSTWPPGG

SEQ ID NO: 31340 - protein, 9 aa, Homo sapiens
  heavy chain complementarity determining region 3 for antibody 15670
ARDRNYFDS

SEQ ID NO: 31341 - protein, 9 aa, Homo sapiens
  light chain complementarity determining region 3 for antibody 15671
QQRSTWPLT

SEQ ID NO: 31342 - protein, 19 aa, Homo sapiens
  heavy chain complementarity determining region 3 for antibody 15671
ARGARDYGDSGFGVYYFDY

SEQ ID NO: 31343 - protein, 9 aa, Homo sapiens
  light chain complementarity determining region 3 for antibody 15672
QQRSSWQLT

SEQ ID NO: 31344 - protein, 11 aa, Homo sapiens
  heavy chain complementarity determining region 3 for antibody 15672
ANRDNKGYFDY

SEQ ID NO: 31345 - protein, 9 aa, Homo sapiens
  light chain complementarity determining region 3 for antibody 15673
QQRSSWPST

SEQ ID NO: 31346 - protein, 12 aa, Homo sapiens
  heavy chain complementarity determining region 3 for antibody 15673
AREPYSPPYFDS

SEQ ID NO: 31347 - protein, 9 aa, Homo sapiens
  light chain complementarity determining region 3 for antibody 15674
QQRSSWPLT

SEQ ID NO: 31348 - protein, 11 aa, Homo sapiens
  heavy chain complementarity determining region 3 for antibody 15674
ANRDNKCYFDY

SEQ ID NO: 31349 - protein, 9 aa, Homo sapiens
  light chain complementarity determining region 3 for antibody 15675
QQRSRWSPS

SEQ ID NO: 31350 - protein, 13 aa, Homo sapiens
  heavy chain complementarity determining region 3 for antibody 15675
ARTYGSGDSLDDY

SEQ ID NO: 31351 - protein, 9 aa, Homo sapiens
  light chain complementarity determining region 3 for antibody 15676
QQRSNWWDT

SEQ ID NO: 31352 - protein, 15 aa, Homo sapiens
  heavy chain complementarity determining region 3 for antibody 15676
ARGRGGEISRAYSDF

SEQ ID NO: 31353 - protein, 11 aa, Homo sapiens
  light chain complementarity determining region 3 for antibody 15677
QQRSNWSPTFT

SEQ ID NO: 31354 - protein, 18 aa, Homo sapiens
  heavy chain complementarity determining region 3 for antibody 15677
ASVLYENSSSGRKYYFDY

SEQ ID NO: 31355 - protein, 9 aa, Homo sapiens
  light chain complementarity determining region 3 for antibody 15678
QQRSNWRDT

SEQ ID NO: 31356 - protein, 15 aa, Homo sapiens
  heavy chain complementarity determining region 3 for antibody 15678
ARGRGGESSRAYSDF

SEQ ID NO: 31357 - protein, 9 aa, Homo sapiens
  light chain complementarity determining region 3 for antibody 15679
QQRSNWRDT

SEQ ID NO: 31358 - protein, 15 aa, Homo sapiens
  heavy chain complementarity determining region 3 for antibody 15679
ARGRGEEISRAYSDF

SEQ ID NO: 31359 - protein, 10 aa, Homo sapiens
  light chain complementarity determining region 3 for antibody 15680
QQRSNWPSTT

SEQ ID NO: 31360 - protein, 8 aa, Homo sapiens
  heavy chain complementarity determining region 3 for antibody 15680
ARDLIITS

SEQ ID NO: 31361 - protein, 11 aa, Homo sapiens
  light chain complementarity determining region 3 for antibody 15681
QQRSNWPQSVT

SEQ ID NO: 31362 - protein, 16 aa, Homo sapiens
  heavy chain complementarity determining region 3 for antibody 15681
ARGALVVLVDLNAFDI

SEQ ID NO: 31363 - protein, 10 aa, Homo sapiens
  light chain complementarity determining region 3 for antibody 15682
QQRSNWPQLT

SEQ ID NO: 31364 - protein, 18 aa, Homo sapiens
  heavy chain complementarity determining region 3 for antibody 15682
AKDVSYYNSGSYVEPRDH

SEQ ID NO: 31365 - protein, 10 aa, Homo sapiens
  light chain complementarity determining region 3 for antibody 15683
QQRSNWPPYT

SEQ ID NO: 31366 - protein, 15 aa, Homo sapiens
  heavy chain complementarity determining region 3 for antibody 15683
ATLVRGLIIMGYFDY

SEQ ID NO: 31367 - protein, 10 aa, Homo sapiens
  light chain complementarity determining region 3 for antibody 15684
QQRSNWPPVT

SEQ ID NO: 31368 - protein, 19 aa, Homo sapiens
  heavy chain complementarity determining region 3 for antibody 15684
ASPIVTNESVADETIRVDY

SEQ ID NO: 31369 - protein, 11 aa, Homo sapiens
  light chain complementarity determining region 3 for antibody 15685
QQRSNWPPVNT

SEQ ID NO: 31370 - protein, 17 aa, Homo sapiens
  heavy chain complementarity determining region 3 for antibody 15685
AREGAGYGGTPDVAFDI

SEQ ID NO: 31371 - protein, 11 aa, Homo sapiens
  light chain complementarity determining region 3 for antibody 15686
QQRSNWPPVLT

SEQ ID NO: 31372 - protein, 16 aa, Homo sapiens
  heavy chain complementarity determining region 3 for antibody 15686
ARRLGETAMALDAFDI

SEQ ID NO: 31373 - protein, 11 aa, Homo sapiens
  light chain complementarity determining region 3 for antibody 15687
QQRSNWPPVHT

SEQ ID NO: 31374 - protein, 17 aa, Homo sapiens
  heavy chain complementarity determining region 3 for antibody 15687
AREGAGYGGTPDVAFDI

SEQ ID NO: 31375 - protein, 11 aa, Homo sapiens
  light chain complementarity determining region 3 for antibody 15688
QQRSNWPPVFT

SEQ ID NO: 31376 - protein, 16 aa, Homo sapiens
  heavy chain complementarity determining region 3 for antibody 15688
VRRLGETAMALDAFDI

SEQ ID NO: 31377 - protein, 11 aa, Homo sapiens
  light chain complementarity determining region 3 for antibody 15689
QQRSNWPPVCT

SEQ ID NO: 31378 - protein, 16 aa, Homo sapiens
  heavy chain complementarity determining region 3 for antibody 15689
ARRLGETAMALDAFDI

SEQ ID NO: 31379 - protein, 9 aa, Homo sapiens
  light chain complementarity determining region 3 for antibody 15690
QQRSNWPPT

SEQ ID NO: 31380 - protein, 11 aa, Homo sapiens
  heavy chain complementarity determining region 3 for antibody 15690
ARMTSLWTFDI

SEQ ID NO: 31381 - protein, 11 aa, Homo sapiens
  light chain complementarity determining region 3 for antibody 15691
QQRSNWPPSVT

SEQ ID NO: 31382 - protein, 16 aa, Homo sapiens
  heavy chain complementarity determining region 3 for antibody 15691
ARGALVVLVDLNALDI

SEQ ID NO: 31383 - protein, 11 aa, Homo sapiens
  light chain complementarity determining region 3 for antibody 15692
QQRSNWPPSVT

SEQ ID NO: 31384 - protein, 16 aa, Homo sapiens
  heavy chain complementarity determining region 3 for antibody 15692
ARGALVGLVDLNAFDI

SEQ ID NO: 31385 - protein, 11 aa, Homo sapiens
  light chain complementarity determining region 3 for antibody 15693
QQRSNWPPSVT

SEQ ID NO: 31386 - protein, 16 aa, Homo sapiens
  heavy chain complementarity determining region 3 for antibody 15693
AGGALVVLVDLNAFDI

SEQ ID NO: 31387 - protein, 11 aa, Homo sapiens
  light chain complementarity determining region 3 for antibody 15694
QQRSNWPPSVP

SEQ ID NO: 31388 - protein, 16 aa, Homo sapiens
  heavy chain complementarity determining region 3 for antibody 15694
ARGALVVLVDLNAFDI

SEQ ID NO: 31389 - protein, 10 aa, Homo sapiens
  light chain complementarity determining region 3 for antibody 15695
QQRSNWPPLP

SEQ ID NO: 31390 - protein, 10 aa, Homo sapiens
  heavy chain complementarity determining region 3 for antibody 15695
AVMGYYAMDV

SEQ ID NO: 31391 - protein, 10 aa, Homo sapiens
  light chain complementarity determining region 3 for antibody 15696
QQRSNWPPLP

SEQ ID NO: 31392 - protein, 16 aa, Homo sapiens
  heavy chain complementarity determining region 3 for antibody 15696
ARETYSSGREPYYCDY

SEQ ID NO: 31393 - protein, 11 aa, Homo sapiens
  light chain complementarity determining region 3 for antibody 15697
QQRSNWPPLLA

SEQ ID NO: 31394 - protein, 11 aa, Homo sapiens
  heavy chain complementarity determining region 3 for antibody 15697
AREQTGYYPHY

SEQ ID NO: 31395 - protein, 10 aa, Homo sapiens
  light chain complementarity determining region 3 for antibody 15698
QQRSNWPPGG

SEQ ID NO: 31396 - protein, 9 aa, Homo sapiens
  heavy chain complementarity determining region 3 for antibody 15698
AGDRNYFDS

SEQ ID NO: 31397 - protein, 11 aa, Homo sapiens
  light chain complementarity determining region 3 for antibody 15699
QQRSNWPPGFT

SEQ ID NO: 31398 - protein, 16 aa, Homo sapiens
  heavy chain complementarity determining region 3 for antibody 15699
AKDLSHGNYLRGDFDY

SEQ ID NO: 31399 - protein, 9 aa, Homo sapiens
  light chain complementarity determining region 3 for antibody 15700
QQRSNWPLT

SEQ ID NO: 31400 - protein, 20 aa, Homo sapiens
  heavy chain complementarity determining region 3 for antibody 15700
TRQDTQGPPRHHAVAEASDI

SEQ ID NO: 31401 - protein, 9 aa, Homo sapiens
  light chain complementarity determining region 3 for antibody 15701
QQRSNWPLT

SEQ ID NO: 31402 - protein, 19 aa, Homo sapiens
  heavy chain complementarity determining region 3 for antibody 15701
ARGARDYGDSGVGVYYFDY

SEQ ID NO: 31403 - protein, 9 aa, Homo sapiens
  light chain complementarity determining region 3 for antibody 15702
QQRSNWPLT

SEQ ID NO: 31404 - protein, 19 aa, Homo sapiens
  heavy chain complementarity determining region 3 for antibody 15702
ARGARDYGDSGLGVYYFDY

SEQ ID NO: 31405 - protein, 9 aa, Homo sapiens
  light chain complementarity determining region 3 for antibody 15703
QQRSNWPLT

SEQ ID NO: 31406 - protein, 16 aa, Homo sapiens
  heavy chain complementarity determining region 3 for antibody 15703
ARELFKGEYDYYAMDV

SEQ ID NO: 31407 - protein, 9 aa, Homo sapiens
  light chain complementarity determining region 3 for antibody 15704
QQRSNWPLT

SEQ ID NO: 31408 - protein, 17 aa, Homo sapiens
  heavy chain complementarity determining region 3 for antibody 15704
AKESSTPSHRGFYYMDV

SEQ ID NO: 31409 - protein, 9 aa, Homo sapiens
  light chain complementarity determining region 3 for antibody 15705
QQRSNWPLT

SEQ ID NO: 31410 - protein, 17 aa, Homo sapiens
  heavy chain complementarity determining region 3 for antibody 15705
AKASSTPSQRGFYYMDV

SEQ ID NO: 31411 - protein, 9 aa, Homo sapiens
  light chain complementarity determining region 3 for antibody 15706
QQRSNWPLT

SEQ ID NO: 31412 - protein, 17 aa, Homo sapiens
  heavy chain complementarity determining region 3 for antibody 15706
AKASSTPSHRGLYYMDV

SEQ ID NO: 31413 - protein, 10 aa, Homo sapiens
  light chain complementarity determining region 3 for antibody 15707
QQRSNWPIYT

SEQ ID NO: 31414 - protein, 14 aa, Homo sapiens
  heavy chain complementarity determining region 3 for antibody 15707
ARLNKMTRIRYFDS

SEQ ID NO: 31415 - protein, 10 aa, Homo sapiens
  light chain complementarity determining region 3 for antibody 15708
QQRSNWPIST

SEQ ID NO: 31416 - protein, 14 aa, Homo sapiens
  heavy chain complementarity determining region 3 for antibody 15708
ARLNKMTRIRYFDS

SEQ ID NO: 31417 - protein, 10 aa, Homo sapiens
  light chain complementarity determining region 3 for antibody 15709
QQRSNWPIFT

SEQ ID NO: 31418 - protein, 14 aa, Homo sapiens
  heavy chain complementarity determining region 3 for antibody 15709
ARLSKMTRIRYFDS

SEQ ID NO: 31419 - protein, 10 aa, Homo sapiens
  light chain complementarity determining region 3 for antibody 15710
QQRSNWPIFT

SEQ ID NO: 31420 - protein, 14 aa, Homo sapiens
  heavy chain complementarity determining region 3 for antibody 15710
ARLNKTTRIRYFDS

SEQ ID NO: 31421 - protein, 10 aa, Homo sapiens
  light chain complementarity determining region 3 for antibody 15711
QQRSNWPIFT

SEQ ID NO: 31422 - protein, 14 aa, Homo sapiens
  heavy chain complementarity determining region 3 for antibody 15711
ARLNKMTRIRYLDS

SEQ ID NO: 31423 - protein, 10 aa, Homo sapiens
  light chain complementarity determining region 3 for antibody 15712
QQRSNWPIFT

SEQ ID NO: 31424 - protein, 14 aa, Homo sapiens
  heavy chain complementarity determining region 3 for antibody 15712
ARLNKMTRIRYFDP

SEQ ID NO: 31425 - protein, 10 aa, Homo sapiens
  light chain complementarity determining region 3 for antibody 15713
QQRSNWPIFT

SEQ ID NO: 31426 - protein, 14 aa, Homo sapiens
  heavy chain complementarity determining region 3 for antibody 15713
ARLKKMTRIRYFDS

SEQ ID NO: 31427 - protein, 10 aa, Homo sapiens
  light chain complementarity determining region 3 for antibody 15714
QQRSNWPIFT

SEQ ID NO: 31428 - protein, 14 aa, Homo sapiens
  heavy chain complementarity determining region 3 for antibody 15714
AILNKMTRIRYFDS

SEQ ID NO: 31429 - protein, 9 aa, Homo sapiens
  light chain complementarity determining region 3 for antibody 15715
QQRSNWPIA

SEQ ID NO: 31430 - protein, 19 aa, Homo sapiens
  heavy chain complementarity determining region 3 for antibody 15715
ARVVTYSGLSRDPENWFDL

SEQ ID NO: 31431 - protein, 10 aa, Homo sapiens
  light chain complementarity determining region 3 for antibody 15716
QQRSNWPHFT

SEQ ID NO: 31432 - protein, 19 aa, Homo sapiens
  heavy chain complementarity determining region 3 for antibody 15716
ARQANWSPTKTGGTYYLDS

SEQ ID NO: 31433 - protein, 8 aa, Homo sapiens
  light chain complementarity determining region 3 for antibody 15717
QQRSNWLT

SEQ ID NO: 31434 - protein, 19 aa, Homo sapiens
  heavy chain complementarity determining region 3 for antibody 15717
ARRFYPDSNGYYGTPLGDP

SEQ ID NO: 31435 - protein, 8 aa, Homo sapiens
  light chain complementarity determining region 3 for antibody 15718
QQRSNWLT

SEQ ID NO: 31436 - protein, 19 aa, Homo sapiens
  heavy chain complementarity determining region 3 for antibody 15718
ARGFYPDSNGYYGTPLDDP

SEQ ID NO: 31437 - protein, 9 aa, Homo sapiens
  light chain complementarity determining region 3 for antibody 15719
QQRSNWLRP

SEQ ID NO: 31438 - protein, 15 aa, Homo sapiens
  heavy chain complementarity determining region 3 for antibody 15719
AAYNRLPAAGQGDEY

SEQ ID NO: 31439 - protein, 9 aa, Homo sapiens
  light chain complementarity determining region 3 for antibody 15720
QQRSNWLLT

SEQ ID NO: 31440 - protein, 17 aa, Homo sapiens
  heavy chain complementarity determining region 3 for antibody 15720
AKASSTPSHRGFYYMDV

SEQ ID NO: 31441 - protein, 11 aa, Homo sapiens
  light chain complementarity determining region 3 for antibody 15721
QQRSNSPPLLA

SEQ ID NO: 31442 - protein, 11 aa, Homo sapiens
  heavy chain complementarity determining region 3 for antibody 15721
AREQTGYYPLY

SEQ ID NO: 31443 - protein, 8 aa, Homo sapiens
  light chain complementarity determining region 3 for antibody 15722
QQRSNSIT

SEQ ID NO: 31444 - protein, 25 aa, Homo sapiens
  heavy chain complementarity determining region 3 for antibody 15722
ARTRIYFYDSTGDPTLDYPHYGMDV

SEQ ID NO: 31445 - protein, 8 aa, Homo sapiens
  light chain complementarity determining region 3 for antibody 15723
QQRSNSIT

SEQ ID NO: 31446 - protein, 25 aa, Homo sapiens
  heavy chain complementarity determining region 3 for antibody 15723
ARTRIYFYDSTGDPTLDYHHYGVDV

SEQ ID NO: 31447 - protein, 8 aa, Homo sapiens
  light chain complementarity determining region 3 for antibody 15724
QQRSNSIT

SEQ ID NO: 31448 - protein, 25 aa, Homo sapiens
  heavy chain complementarity determining region 3 for antibody 15724
ARARIYFYDSTGDPTLDYHHYGMDV

SEQ ID NO: 31449 - protein, 11 aa, Homo sapiens
  light chain complementarity determining region 3 for antibody 15725
QQRSNRPPTFT

SEQ ID NO: 31450 - protein, 18 aa, Homo sapiens
  heavy chain complementarity determining region 3 for antibody 15725
ASVLYENSSSGRKYYFDY

SEQ ID NO: 31451 - protein, 10 aa, Homo sapiens
  light chain complementarity determining region 3 for antibody 15726
QQRSNCPPFT

SEQ ID NO: 31452 - protein, 10 aa, Homo sapiens
  heavy chain complementarity determining region 3 for antibody 15726
AVMGYYAMDV

SEQ ID NO: 31453 - protein, 9 aa, Homo sapiens
  light chain complementarity determining region 3 for antibody 15727
QQRSHWPLT

SEQ ID NO: 31454 - protein, 19 aa, Homo sapiens
  heavy chain complementarity determining region 3 for antibody 15727
ARGARDYGDSGFGVYYFDY

SEQ ID NO: 31455 - protein, 8 aa, Homo sapiens
  light chain complementarity determining region 3 for antibody 15728
QQRSHWLT

SEQ ID NO: 31456 - protein, 16 aa, Homo sapiens
  heavy chain complementarity determining region 3 for antibody 15728
ARATDYTGDRPWYFDL

SEQ ID NO: 31457 - protein, 8 aa, Homo sapiens
  light chain complementarity determining region 3 for antibody 15729
QQRSHWLT

SEQ ID NO: 31458 - protein, 16 aa, Homo sapiens
  heavy chain complementarity determining region 3 for antibody 15729
ARATDYTGDPPWYFDL

SEQ ID NO: 31459 - protein, 8 aa, Homo sapiens
  light chain complementarity determining region 3 for antibody 15730
QQRSHWLT

SEQ ID NO: 31460 - protein, 16 aa, Homo sapiens
  heavy chain complementarity determining region 3 for antibody 15730
ARATDCTGDLPWYFDL

SEQ ID NO: 31461 - protein, 9 aa, Homo sapiens
  light chain complementarity determining region 3 for antibody 15731
QQRSGWPPT

SEQ ID NO: 31462 - protein, 16 aa, Homo sapiens
  heavy chain complementarity determining region 3 for antibody 15731
ARVLYGSGPNANWFDP

SEQ ID NO: 31463 - protein, 9 aa, Homo sapiens
  light chain complementarity determining region 3 for antibody 15732
QQRSGWPPT

SEQ ID NO: 31464 - protein, 16 aa, Homo sapiens
  heavy chain complementarity determining region 3 for antibody 15732
ARVFYGSGPNANWSDP

SEQ ID NO: 31465 - protein, 9 aa, Homo sapiens
  light chain complementarity determining region 3 for antibody 15733
QQRSGWPPT

SEQ ID NO: 31466 - protein, 16 aa, Homo sapiens
  heavy chain complementarity determining region 3 for antibody 15733
ARVFYGSGPNANWLDP

SEQ ID NO: 31467 - protein, 9 aa, Homo sapiens
  light chain complementarity determining region 3 for antibody 15734
QQRSGWPPT

SEQ ID NO: 31468 - protein, 16 aa, Homo sapiens
  heavy chain complementarity determining region 3 for antibody 15734
ARVFYGSGANANWFDP

SEQ ID NO: 31469 - protein, 9 aa, Homo sapiens
  light chain complementarity determining region 3 for antibody 15735
QQRSGWPPT

SEQ ID NO: 31470 - protein, 16 aa, Homo sapiens
  heavy chain complementarity determining region 3 for antibody 15735
ARVCYGSGPNANWFDP

SEQ ID NO: 31471 - protein, 9 aa, Homo sapiens
  light chain complementarity determining region 3 for antibody 15736
QQRSGWPPT

SEQ ID NO: 31472 - protein, 16 aa, Homo sapiens
  heavy chain complementarity determining region 3 for antibody 15736
ARMFYGSGPNANWFDP

SEQ ID NO: 31473 - protein, 9 aa, Homo sapiens
  light chain complementarity determining region 3 for antibody 15737
QQRSGWPPN

SEQ ID NO: 31474 - protein, 16 aa, Homo sapiens
  heavy chain complementarity determining region 3 for antibody 15737
ARVFYGSGPNANWFDP

SEQ ID NO: 31475 - protein, 9 aa, Homo sapiens
  light chain complementarity determining region 3 for antibody 15738
QQRSGWHPT

SEQ ID NO: 31476 - protein, 16 aa, Homo sapiens
  heavy chain complementarity determining region 3 for antibody 15738
ARVFYGSGPNANWFDP

SEQ ID NO: 31477 - protein, 9 aa, Homo sapiens
  light chain complementarity determining region 3 for antibody 15739
QQRSGGPPT

SEQ ID NO: 31478 - protein, 16 aa, Homo sapiens
  heavy chain complementarity determining region 3 for antibody 15739
ARVFYGSGPNANWFDP

SEQ ID NO: 31479 - protein, 10 aa, Homo sapiens
  light chain complementarity determining region 3 for antibody 15740
QQRSDWPPGT

SEQ ID NO: 31480 - protein, 18 aa, Homo sapiens
  heavy chain complementarity determining region 3 for antibody 15740
ASRGGGGGNSLWYYGLDV

SEQ ID NO: 31481 - protein, 8 aa, Homo sapiens
  light chain complementarity determining region 3 for antibody 15741
QQRSDWPP

SEQ ID NO: 31482 - protein, 15 aa, Homo sapiens
  heavy chain complementarity determining region 3 for antibody 15741
ARDGNPAVVRGYCDY

SEQ ID NO: 31483 - protein, 9 aa, Homo sapiens
  light chain complementarity determining region 3 for antibody 15742
QQRSDRPIT

SEQ ID NO: 31484 - protein, 10 aa, Homo sapiens
  heavy chain complementarity determining region 3 for antibody 15742
ARDADRKDDF

SEQ ID NO: 31485 - protein, 11 aa, Homo sapiens
  light chain complementarity determining region 3 for antibody 15743
QQRRNWPPAPT

SEQ ID NO: 31486 - protein, 18 aa, Homo sapiens
  heavy chain complementarity determining region 3 for antibody 15743
AKDADCNGGNCYLFYFDY

SEQ ID NO: 31487 - protein, 9 aa, Homo sapiens
  light chain complementarity determining region 3 for antibody 15744
QQRRNWPLT

SEQ ID NO: 31488 - protein, 14 aa, Homo sapiens
  heavy chain complementarity determining region 3 for antibody 15744
AKEGWQWDGYYFDY

SEQ ID NO: 31489 - protein, 10 aa, Homo sapiens
  light chain complementarity determining region 3 for antibody 15745
QQRPRWPPLT

SEQ ID NO: 31490 - protein, 12 aa, Homo sapiens
  heavy chain complementarity determining region 3 for antibody 15745
TDTHVTGGDWDY

SEQ ID NO: 31491 - protein, 9 aa, Homo sapiens
  light chain complementarity determining region 3 for antibody 15746
QQRPNWPVT

SEQ ID NO: 31492 - protein, 19 aa, Homo sapiens
  heavy chain complementarity determining region 3 for antibody 15746
VRARQYRSSWYGPSDAFDI

SEQ ID NO: 31493 - protein, 9 aa, Homo sapiens
  light chain complementarity determining region 3 for antibody 15747
QQRNTWRLT

SEQ ID NO: 31494 - protein, 22 aa, Homo sapiens
  heavy chain complementarity determining region 3 for antibody 15747
ARHSGYSNTWYMNYYYYYGMDV

SEQ ID NO: 31495 - protein, 9 aa, Homo sapiens
  light chain complementarity determining region 3 for antibody 15748
QQRNNWVLT

SEQ ID NO: 31496 - protein, 22 aa, Homo sapiens
  heavy chain complementarity determining region 3 for antibody 15748
ARHSGYSNTWYMNYYYYYGMDV

SEQ ID NO: 31497 - protein, 10 aa, Homo sapiens
  light chain complementarity determining region 3 for antibody 15749
QQRNNWPLWT

SEQ ID NO: 31498 - protein, 21 aa, Homo sapiens
  heavy chain complementarity determining region 3 for antibody 15749
AEVPIPNDSGWYHADYYGVDV

SEQ ID NO: 31499 - protein, 9 aa, Homo sapiens
  light chain complementarity determining region 3 for antibody 15750
QQRNNWGRT

SEQ ID NO: 31500 - protein, 22 aa, Homo sapiens
  heavy chain complementarity determining region 3 for antibody 15750
ARHSGYSNTWYMNYYYYYGMDV

SEQ ID NO: 31501 - protein, 9 aa, Homo sapiens
  light chain complementarity determining region 3 for antibody 15751
QQRNNWGLT

SEQ ID NO: 31502 - protein, 22 aa, Homo sapiens
  heavy chain complementarity determining region 3 for antibody 15751
ERHSGYSNTWYMNYYYYYGMDV

SEQ ID NO: 31503 - protein, 9 aa, Homo sapiens
  light chain complementarity determining region 3 for antibody 15752
QQRNNWGLT

SEQ ID NO: 31504 - protein, 22 aa, Homo sapiens
  heavy chain complementarity determining region 3 for antibody 15752
ASHSGYSNTWYMNYYYYYGMDV

SEQ ID NO: 31505 - protein, 9 aa, Homo sapiens
  light chain complementarity determining region 3 for antibody 15753
QQRNNWGLT

SEQ ID NO: 31506 - protein, 19 aa, Homo sapiens
  heavy chain complementarity determining region 3 for antibody 15753
ARSDYSGDTDRYYDYGMDV

SEQ ID NO: 31507 - protein, 9 aa, Homo sapiens
  light chain complementarity determining region 3 for antibody 15754
QQRNNWGLT

SEQ ID NO: 31508 - protein, 22 aa, Homo sapiens
  heavy chain complementarity determining region 3 for antibody 15754
ARRSGYSNTWYMNYYYYYGMDV

SEQ ID NO: 31509 - protein, 9 aa, Homo sapiens
  light chain complementarity determining region 3 for antibody 15755
QQRNNWGLT

SEQ ID NO: 31510 - protein, 22 aa, Homo sapiens
  heavy chain complementarity determining region 3 for antibody 15755
ARHSGYSSTWYMNYYYYYGMDV

SEQ ID NO: 31511 - protein, 9 aa, Homo sapiens
  light chain complementarity determining region 3 for antibody 15756
QQRNNWGLT

SEQ ID NO: 31512 - protein, 22 aa, Homo sapiens
  heavy chain complementarity determining region 3 for antibody 15756
ARHSGYSNTWYVNYYYYYGMDV

SEQ ID NO: 31513 - protein, 9 aa, Homo sapiens
  light chain complementarity determining region 3 for antibody 15757
QQRNNWGLT

SEQ ID NO: 31514 - protein, 22 aa, Homo sapiens
  heavy chain complementarity determining region 3 for antibody 15757
ARHSGYSNTWYMNYYYYYGMDA

SEQ ID NO: 31515 - protein, 9 aa, Homo sapiens
  light chain complementarity determining region 3 for antibody 15758
QQRNNWGLT

SEQ ID NO: 31516 - protein, 22 aa, Homo sapiens
  heavy chain complementarity determining region 3 for antibody 15758
ARHSGYSNTWYMNYYYYDGMDV

SEQ ID NO: 31517 - protein, 9 aa, Homo sapiens
  light chain complementarity determining region 3 for antibody 15759
QQRNNWGLT

SEQ ID NO: 31518 - protein, 22 aa, Homo sapiens
  heavy chain complementarity determining region 3 for antibody 15759
ARHSGYSNTWYMNYYYYCGMDV

SEQ ID NO: 31519 - protein, 9 aa, Homo sapiens
  light chain complementarity determining region 3 for antibody 15760
QQRNNWGLT

SEQ ID NO: 31520 - protein, 22 aa, Homo sapiens
  heavy chain complementarity determining region 3 for antibody 15760
ARHSGYSNTWYMNYYCYYGMDV

SEQ ID NO: 31521 - protein, 9 aa, Homo sapiens
  light chain complementarity determining region 3 for antibody 15761
QQRNNWGLT

SEQ ID NO: 31522 - protein, 22 aa, Homo sapiens
  heavy chain complementarity determining region 3 for antibody 15761
ARHSGYSNTWYMNYSYYYGMDV

SEQ ID NO: 31523 - protein, 9 aa, Homo sapiens
  light chain complementarity determining region 3 for antibody 15762
QQRNNWGLT

SEQ ID NO: 31524 - protein, 22 aa, Homo sapiens
  heavy chain complementarity determining region 3 for antibody 15762
ARHSGYSNTWYMNYCYYYGMDV

SEQ ID NO: 31525 - protein, 9 aa, Homo sapiens
  light chain complementarity determining region 3 for antibody 15763
QQRNNWGLT

SEQ ID NO: 31526 - protein, 22 aa, Homo sapiens
  heavy chain complementarity determining region 3 for antibody 15763
ARHSGYSNTWYMKYYYYYGMDV

SEQ ID NO: 31527 - protein, 9 aa, Homo sapiens
  light chain complementarity determining region 3 for antibody 15764
QQRNNWGLT

SEQ ID NO: 31528 - protein, 22 aa, Homo sapiens
  heavy chain complementarity determining region 3 for antibody 15764
ARHSGYSNTWYMDYYYYYGMDV

SEQ ID NO: 31529 - protein, 9 aa, Homo sapiens
  light chain complementarity determining region 3 for antibody 15765
QQRNNWGLT

SEQ ID NO: 31530 - protein, 22 aa, Homo sapiens
  heavy chain complementarity determining region 3 for antibody 15765
ARHSGYSNAWYMNYYYYYGMDV

SEQ ID NO: 31531 - protein, 9 aa, Homo sapiens
  light chain complementarity determining region 3 for antibody 15766
QQRNNWGLT

SEQ ID NO: 31532 - protein, 22 aa, Homo sapiens
  heavy chain complementarity determining region 3 for antibody 15766
ARHSGHSNTWYMNYYYYYGMDV

SEQ ID NO: 31533 - protein, 9 aa, Homo sapiens
  light chain complementarity determining region 3 for antibody 15767
QQRNNWGIT

SEQ ID NO: 31534 - protein, 22 aa, Homo sapiens
  heavy chain complementarity determining region 3 for antibody 15767
ARHSGYSNTWYMNYYYYYGMDV

SEQ ID NO: 31535 - protein, 9 aa, Homo sapiens
  light chain complementarity determining region 3 for antibody 15768
QQRNNWALT

SEQ ID NO: 31536 - protein, 22 aa, Homo sapiens
  heavy chain complementarity determining region 3 for antibody 15768
ARHSGYSNTWYMNYYYYYGMDV

SEQ ID NO: 31537 - protein, 9 aa, Homo sapiens
  light chain complementarity determining region 3 for antibody 15769
QQRNGWPPT

SEQ ID NO: 31538 - protein, 16 aa, Homo sapiens
  heavy chain complementarity determining region 3 for antibody 15769
ARVFYGSGPNANWFDP

SEQ ID NO: 31539 - protein, 9 aa, Homo sapiens
  light chain complementarity determining region 3 for antibody 15770
QQRNDWGLT

SEQ ID NO: 31540 - protein, 22 aa, Homo sapiens
  heavy chain complementarity determining region 3 for antibody 15770
ARHSGYSNTWYMNYYYYYGMDV

SEQ ID NO: 31541 - protein, 9 aa, Homo sapiens
  light chain complementarity determining region 3 for antibody 15771
QQRHSIPLT

SEQ ID NO: 31542 - protein, 14 aa, Homo sapiens
  heavy chain complementarity determining region 3 for antibody 15771
AKDFGQWLVGPFDS

SEQ ID NO: 31543 - protein, 9 aa, Homo sapiens
  light chain complementarity determining region 3 for antibody 15772
QQRHNWGLT

SEQ ID NO: 31544 - protein, 22 aa, Homo sapiens
  heavy chain complementarity determining region 3 for antibody 15772
ARHSGYSNTWYMDYYYYYGMDV

SEQ ID NO: 31545 - protein, 10 aa, Homo sapiens
  light chain complementarity determining region 3 for antibody 15773
QQRGTWPPIT

SEQ ID NO: 31546 - protein, 18 aa, Homo sapiens
  heavy chain complementarity determining region 3 for antibody 15773
AKDLAPSMRVVAQGALDI

SEQ ID NO: 31547 - protein, 10 aa, Homo sapiens
  light chain complementarity determining region 3 for antibody 15774
QQRGTLPRLT

SEQ ID NO: 31548 - protein, 18 aa, Homo sapiens
  heavy chain complementarity determining region 3 for antibody 15774
ARDVGYDSNANYNWYFDL

SEQ ID NO: 31549 - protein, 9 aa, Homo sapiens
  light chain complementarity determining region 3 for antibody 15775
QQRGSWPPT

SEQ ID NO: 31550 - protein, 14 aa, Homo sapiens
  heavy chain complementarity determining region 3 for antibody 15775
AKGMTSWYLMVVDY

SEQ ID NO: 31551 - protein, 10 aa, Homo sapiens
  light chain complementarity determining region 3 for antibody 15776
QQRGNWPIFT

SEQ ID NO: 31552 - protein, 14 aa, Homo sapiens
  heavy chain complementarity determining region 3 for antibody 15776
ARLNKMTRIRYFDS

SEQ ID NO: 31553 - protein, 9 aa, Homo sapiens
  light chain complementarity determining region 3 for antibody 15777
QQRGGWPLT

SEQ ID NO: 31554 - protein, 16 aa, Homo sapiens
  heavy chain complementarity determining region 3 for antibody 15777
AAGVKAYRRAVGYFDY

SEQ ID NO: 31555 - protein, 9 aa, Homo sapiens
  light chain complementarity determining region 3 for antibody 15778
QQRGGRPLT

SEQ ID NO: 31556 - protein, 16 aa, Homo sapiens
  heavy chain complementarity determining region 3 for antibody 15778
AAGVKAYRRAVRYFDY

SEQ ID NO: 31557 - protein, 9 aa, Homo sapiens
  light chain complementarity determining region 3 for antibody 15779
QQRGGRPLA

SEQ ID NO: 31558 - protein, 16 aa, Homo sapiens
  heavy chain complementarity determining region 3 for antibody 15779
AAGVKAYRRAVRYFDY

SEQ ID NO: 31559 - protein, 9 aa, Homo sapiens
  light chain complementarity determining region 3 for antibody 15780
QQRGGGPLH

SEQ ID NO: 31560 - protein, 16 aa, Homo sapiens
  heavy chain complementarity determining region 3 for antibody 15780
AAGVKAYRRAVRYFDY

SEQ ID NO: 31561 - protein, 10 aa, Homo sapiens
  light chain complementarity determining region 3 for antibody 15781
QQRGDWPPLP

SEQ ID NO: 31562 - protein, 12 aa, Homo sapiens
  heavy chain complementarity determining region 3 for antibody 15781
TSTTGIVVVKDY

SEQ ID NO: 31563 - protein, 9 aa, Homo sapiens
  light chain complementarity determining region 3 for antibody 15782
QQRFTIQFT

SEQ ID NO: 31564 - protein, 13 aa, Homo sapiens
  heavy chain complementarity determining region 3 for antibody 15782
TTDRCVGFSCADS

SEQ ID NO: 31565 - protein, 9 aa, Homo sapiens
  light chain complementarity determining region 3 for antibody 15783
QQQFTGRWT

SEQ ID NO: 31566 - protein, 15 aa, Homo sapiens
  heavy chain complementarity determining region 3 for antibody 15783
AKEGRSGGICYGFDV

SEQ ID NO: 31567 - protein, 9 aa, Homo sapiens
  light chain complementarity determining region 3 for antibody 15784
QQQFTGRWT

SEQ ID NO: 31568 - protein, 15 aa, Homo sapiens
  heavy chain complementarity determining region 3 for antibody 15784
AKEGCSGGTCYGFDV

SEQ ID NO: 31569 - protein, 9 aa, Homo sapiens
  light chain complementarity determining region 3 for antibody 15785
QQQFTGRWT

SEQ ID NO: 31570 - protein, 15 aa, Homo sapiens
  heavy chain complementarity determining region 3 for antibody 15785
AKEGCSGGICYGLDV

SEQ ID NO: 31571 - protein, 9 aa, Homo sapiens
  light chain complementarity determining region 3 for antibody 15786
QQQFTGRWK

SEQ ID NO: 31572 - protein, 15 aa, Homo sapiens
  heavy chain complementarity determining region 3 for antibody 15786
AKEGCSGGICYGFDV

SEQ ID NO: 31573 - protein, 9 aa, Homo sapiens
  light chain complementarity determining region 3 for antibody 15787
QQQFTGRWA

SEQ ID NO: 31574 - protein, 15 aa, Homo sapiens
  heavy chain complementarity determining region 3 for antibody 15787
AKEGCSGGICYGFDV

SEQ ID NO: 31575 - protein, 9 aa, Homo sapiens
  light chain complementarity determining region 3 for antibody 15788
QQNYSTPYT

SEQ ID NO: 31576 - protein, 17 aa, Homo sapiens
  heavy chain complementarity determining region 3 for antibody 15788
ARGSYYDVDLNRFYFDY

SEQ ID NO: 31577 - protein, 9 aa, Homo sapiens
  light chain complementarity determining region 3 for antibody 15789
QQNYRTPYT

SEQ ID NO: 31578 - protein, 14 aa, Homo sapiens
  heavy chain complementarity determining region 3 for antibody 15789
VKDIKSNYYYGIDA

SEQ ID NO: 31579 - protein, 9 aa, Homo sapiens
  light chain complementarity determining region 3 for antibody 15790
QQNYRPSPA

SEQ ID NO: 31580 - protein, 11 aa, Homo sapiens
  heavy chain complementarity determining region 3 for antibody 15790
TRDPPGNGMDV

SEQ ID NO: 31581 - protein, 9 aa, Homo sapiens
  light chain complementarity determining region 3 for antibody 15791
QQNYNTPRT

SEQ ID NO: 31582 - protein, 20 aa, Homo sapiens
  heavy chain complementarity determining region 3 for antibody 15791
TTDDTLLVPADPRDDNWVDP

SEQ ID NO: 31583 - protein, 9 aa, Homo sapiens
  light chain complementarity determining region 3 for antibody 15792
QQNYNTPRT

SEQ ID NO: 31584 - protein, 20 aa, Homo sapiens
  heavy chain complementarity determining region 3 for antibody 15792
TTDDIVLVPADPRDDNWVDP

SEQ ID NO: 31585 - protein, 9 aa, Homo sapiens
  light chain complementarity determining region 3 for antibody 15793
QQNYNTPRT

SEQ ID NO: 31586 - protein, 20 aa, Homo sapiens
  heavy chain complementarity determining region 3 for antibody 15793
TTDDILLVPADPRDDNWVGP

SEQ ID NO: 31587 - protein, 9 aa, Homo sapiens
  light chain complementarity determining region 3 for antibody 15794
QQNYNTHRT

SEQ ID NO: 31588 - protein, 20 aa, Homo sapiens
  heavy chain complementarity determining region 3 for antibody 15794
TTDDILLVPADPRDDNWVDP

SEQ ID NO: 31589 - protein, 10 aa, Homo sapiens
  light chain complementarity determining region 3 for antibody 15795
QQNVSSALYT

SEQ ID NO: 31590 - protein, 16 aa, Homo sapiens
  heavy chain complementarity determining region 3 for antibody 15795
ARELFKGEYDYYAMDV

SEQ ID NO: 31591 - protein, 10 aa, Homo sapiens
  light chain complementarity determining region 3 for antibody 15796
QQNVRSDLFT

SEQ ID NO: 31592 - protein, 16 aa, Homo sapiens
  heavy chain complementarity determining region 3 for antibody 15796
ARELFKGQIDYYGIDV

SEQ ID NO: 31593 - protein, 9 aa, Homo sapiens
  light chain complementarity determining region 3 for antibody 15797
QQNSTFPYT

SEQ ID NO: 31594 - protein, 17 aa, Homo sapiens
  heavy chain complementarity determining region 3 for antibody 15797
AREVWNDVDLRQYYFDY

SEQ ID NO: 31595 - protein, 10 aa, Homo sapiens
  light chain complementarity determining region 3 for antibody 15798
QQNSSSPQLT

SEQ ID NO: 31596 - protein, 13 aa, Homo sapiens
  heavy chain complementarity determining region 3 for antibody 15798
ARSAGYYPNWLES

SEQ ID NO: 31597 - protein, 9 aa, Homo sapiens
  light chain complementarity determining region 3 for antibody 15799
QQNSNFPYT

SEQ ID NO: 31598 - protein, 17 aa, Homo sapiens
  heavy chain complementarity determining region 3 for antibody 15799
AREDWNDVDLRQFYFDY

SEQ ID NO: 31599 - protein, 9 aa, Homo sapiens
  light chain complementarity determining region 3 for antibody 15800
QQNNSYSIT

SEQ ID NO: 31600 - protein, 14 aa, Homo sapiens
  heavy chain complementarity determining region 3 for antibody 15800
ARDLAGTVPYYFDY

SEQ ID NO: 31601 - protein, 9 aa, Homo sapiens
  light chain complementarity determining region 3 for antibody 15801
QQNNSYPYT

SEQ ID NO: 31602 - protein, 22 aa, Homo sapiens
  heavy chain complementarity determining region 3 for antibody 15801
ARGRPFPDTHINRNYYYYGMDV

SEQ ID NO: 31603 - protein, 9 aa, Homo sapiens
  light chain complementarity determining region 3 for antibody 15802
QQNNSYPIT

SEQ ID NO: 31604 - protein, 13 aa, Homo sapiens
  heavy chain complementarity determining region 3 for antibody 15802
ASGLHSGYDYFDY

SEQ ID NO: 31605 - protein, 8 aa, Homo sapiens
  light chain complementarity determining region 3 for antibody 15803
QQNNSVWT

SEQ ID NO: 31606 - protein, 17 aa, Homo sapiens
  heavy chain complementarity determining region 3 for antibody 15803
ARGFIVDFWSGYSPFDH

SEQ ID NO: 31607 - protein, 9 aa, Homo sapiens
  light chain complementarity determining region 3 for antibody 15804
QQNNSLPIT

SEQ ID NO: 31608 - protein, 19 aa, Homo sapiens
  heavy chain complementarity determining region 3 for antibody 15804
ARDRDYTIVDDYGSGVFDY

SEQ ID NO: 31609 - protein, 9 aa, Homo sapiens
  light chain complementarity determining region 3 for antibody 15805
QQNNSFPYT

SEQ ID NO: 31610 - protein, 17 aa, Homo sapiens
  heavy chain complementarity determining region 3 for antibody 15805
AREDWSDVDLRLFYIDY

SEQ ID NO: 31611 - protein, 9 aa, Homo sapiens
  light chain complementarity determining region 3 for antibody 15806
QQNHSYPLT

SEQ ID NO: 31612 - protein, 15 aa, Homo sapiens
  heavy chain complementarity determining region 3 for antibody 15806
ARGGIHYDILTGLDY

SEQ ID NO: 31613 - protein, 8 aa, Homo sapiens
  light chain complementarity determining region 3 for antibody 15807
QQNGTSKT

SEQ ID NO: 31614 - protein, 14 aa, Homo sapiens
  heavy chain complementarity determining region 3 for antibody 15807
AREGGFTLTNWFDL

SEQ ID NO: 31615 - protein, 7 aa, Homo sapiens
  light chain complementarity determining region 3 for antibody 15808
QQNGSSR

SEQ ID NO: 31616 - protein, 16 aa, Homo sapiens
  heavy chain complementarity determining region 3 for antibody 15808
TTTYGDYPPYYYAMVV

SEQ ID NO: 31617 - protein, 9 aa, Homo sapiens
  light chain complementarity determining region 3 for antibody 15809
QQNGSSPIT

SEQ ID NO: 31618 - protein, 6 aa, Homo sapiens
  heavy chain complementarity determining region 3 for antibody 15809
AITILG

SEQ ID NO: 31619 - protein, 10 aa, Homo sapiens
  light chain complementarity determining region 3 for antibody 15810
QQNGSSPAGT

SEQ ID NO: 31620 - protein, 17 aa, Homo sapiens
  heavy chain complementarity determining region 3 for antibody 15810
AREDWSDVDLRAFYFDS

SEQ ID NO: 31621 - protein, 8 aa, Homo sapiens
  light chain complementarity determining region 3 for antibody 15811
QQNGSSLT

SEQ ID NO: 31622 - protein, 17 aa, Homo sapiens
  heavy chain complementarity determining region 3 for antibody 15811
AKVYRPHCGSYCFYFDS

SEQ ID NO: 31623 - protein, 9 aa, Homo sapiens
  light chain complementarity determining region 3 for antibody 15812
QQNGSSLLT

SEQ ID NO: 31624 - protein, 19 aa, Homo sapiens
  heavy chain complementarity determining region 3 for antibody 15812
ARVGGGWYYVREPHYYFDY

SEQ ID NO: 31625 - protein, 8 aa, Homo sapiens
  light chain complementarity determining region 3 for antibody 15813
QQNGNLLT

SEQ ID NO: 31626 - protein, 20 aa, Homo sapiens
  heavy chain complementarity determining region 3 for antibody 15813
SKDRSVNAAMDYYYYSAMDV

SEQ ID NO: 31627 - protein, 9 aa, Homo sapiens
  light chain complementarity determining region 3 for antibody 15814
QQNGGLPIT

SEQ ID NO: 31628 - protein, 17 aa, Homo sapiens
  heavy chain complementarity determining region 3 for antibody 15814
ARVDGYILTGYPYHSDY

SEQ ID NO: 31629 - protein, 9 aa, Homo sapiens
  light chain complementarity determining region 3 for antibody 15815
QQNFSPPGA

SEQ ID NO: 31630 - protein, 19 aa, Homo sapiens
  heavy chain complementarity determining region 3 for antibody 15815
ATMRYGSGELTYDYYGMDV

SEQ ID NO: 31631 - protein, 11 aa, Homo sapiens
  light chain complementarity determining region 3 for antibody 15816
QQNDTSSRLFT

SEQ ID NO: 31632 - protein, 18 aa, Homo sapiens
  heavy chain complementarity determining region 3 for antibody 15816
ARAPSYDSSGYGKYPFEI

SEQ ID NO: 31633 - protein, 8 aa, Homo sapiens
  light chain complementarity determining region 3 for antibody 15817
QQNDQFPT

SEQ ID NO: 31634 - protein, 20 aa, Homo sapiens
  heavy chain complementarity determining region 3 for antibody 15817
ATDRGTYFRSGSYYHYPLDY

SEQ ID NO: 31635 - protein, 9 aa, Homo sapiens
  light chain complementarity determining region 3 for antibody 15818
QQNDNLPPT

SEQ ID NO: 31636 - protein, 17 aa, Homo sapiens
  heavy chain complementarity determining region 3 for antibody 15818
ARVHDSSNYYVAEYFQY

SEQ ID NO: 31637 - protein, 9 aa, Homo sapiens
  light chain complementarity determining region 3 for antibody 15819
QQNDNLPHT

SEQ ID NO: 31638 - protein, 17 aa, Homo sapiens
  heavy chain complementarity determining region 3 for antibody 15819
ARAPPVEYYDSSGYYNY

SEQ ID NO: 31639 - protein, 9 aa, Homo sapiens
  light chain complementarity determining region 3 for antibody 15820
QQNCNTPRT

SEQ ID NO: 31640 - protein, 20 aa, Homo sapiens
  heavy chain complementarity determining region 3 for antibody 15820
TTDDILLVPADPRDDNWVDP

SEQ ID NO: 31641 - protein, 10 aa, Homo sapiens
  light chain complementarity determining region 3 for antibody 15821
QQLYSYPVFA

SEQ ID NO: 31642 - protein, 19 aa, Homo sapiens
  heavy chain complementarity determining region 3 for antibody 15821
ARVLKRYFEWSTYYYIMDV

SEQ ID NO: 31643 - protein, 10 aa, Homo sapiens
  light chain complementarity determining region 3 for antibody 15822
QQLYSHPVFA

SEQ ID NO: 31644 - protein, 19 aa, Homo sapiens
  heavy chain complementarity determining region 3 for antibody 15822
ARVLKRYFEWSTYYYLMDV

SEQ ID NO: 31645 - protein, 9 aa, Homo sapiens
  light chain complementarity determining region 3 for antibody 15823
QQLYRYPIT

SEQ ID NO: 31646 - protein, 14 aa, Homo sapiens
  heavy chain complementarity determining region 3 for antibody 15823
GRDTTHDWSDGGIY

SEQ ID NO: 31647 - protein, 9 aa, Homo sapiens
  light chain complementarity determining region 3 for antibody 15824
QQLTSYPLT

SEQ ID NO: 31648 - protein, 18 aa, Homo sapiens
  heavy chain complementarity determining region 3 for antibody 15824
ARYEDYGDSPTVYYGMDA

SEQ ID NO: 31649 - protein, 9 aa, Homo sapiens
  light chain complementarity determining region 3 for antibody 15825
QQLTIYSLA

SEQ ID NO: 31650 - protein, 17 aa, Homo sapiens
  heavy chain complementarity determining region 3 for antibody 15825
ARGGNPSGNHYYYGLDV

SEQ ID NO: 31651 - protein, 8 aa, Homo sapiens
  light chain complementarity determining region 3 for antibody 15826
QQLSSYPA

SEQ ID NO: 31652 - protein, 23 aa, Homo sapiens
  heavy chain complementarity determining region 3 for antibody 15826
SHIPVTSRDVPLGTHYYYYGMDV

SEQ ID NO: 31653 - protein, 8 aa, Homo sapiens
  light chain complementarity determining region 3 for antibody 15827
QQLSSYPA

SEQ ID NO: 31654 - protein, 23 aa, Homo sapiens
  heavy chain complementarity determining region 3 for antibody 15827
PHISVTSRDVPLGTHYYYYGMDV

SEQ ID NO: 31655 - protein, 8 aa, Homo sapiens
  light chain complementarity determining region 3 for antibody 15828
QQLSSYPA

SEQ ID NO: 31656 - protein, 23 aa, Homo sapiens
  heavy chain complementarity determining region 3 for antibody 15828
PHISVTSRDVPLDTHYYYYGMDV

SEQ ID NO: 31657 - protein, 8 aa, Homo sapiens
  light chain complementarity determining region 3 for antibody 15829
QQLSSYPA

SEQ ID NO: 31658 - protein, 23 aa, Homo sapiens
  heavy chain complementarity determining region 3 for antibody 15829
AHISVTSRDVPLGTHYYYYGMDV

SEQ ID NO: 31659 - protein, 8 aa, Homo sapiens
  light chain complementarity determining region 3 for antibody 15830
QQLSSSPA

SEQ ID NO: 31660 - protein, 23 aa, Homo sapiens
  heavy chain complementarity determining region 3 for antibody 15830
SHISVTSRDVPLGTHYYYYGMDV

SEQ ID NO: 31661 - protein, 9 aa, Homo sapiens
  light chain complementarity determining region 3 for antibody 15831
QQLSNYPLT

SEQ ID NO: 31662 - protein, 15 aa, Homo sapiens
  heavy chain complementarity determining region 3 for antibody 15831
GRGWWTDGYDYGMDV

SEQ ID NO: 31663 - protein, 9 aa, Homo sapiens
  light chain complementarity determining region 3 for antibody 15832
QQLPGYPLT

SEQ ID NO: 31664 - protein, 21 aa, Homo sapiens
  heavy chain complementarity determining region 3 for antibody 15832
ARDWAQSNGYPVGHYYYGMDV

SEQ ID NO: 31665 - protein, 10 aa, Homo sapiens
  light chain complementarity determining region 3 for antibody 15833
QQLNTYPPLT

SEQ ID NO: 31666 - protein, 14 aa, Homo sapiens
  heavy chain complementarity determining region 3 for antibody 15833
AGDADTPHRRAFDV

SEQ ID NO: 31667 - protein, 10 aa, Homo sapiens
  light chain complementarity determining region 3 for antibody 15834
QQLNTYPPIT

SEQ ID NO: 31668 - protein, 14 aa, Homo sapiens
  heavy chain complementarity determining region 3 for antibody 15834
AGDADTTHRRAFDV

SEQ ID NO: 31669 - protein, 10 aa, Homo sapiens
  light chain complementarity determining region 3 for antibody 15835
QQLNTYPPIT

SEQ ID NO: 31670 - protein, 14 aa, Homo sapiens
  heavy chain complementarity determining region 3 for antibody 15835
AGDADTPQRRAFDV

SEQ ID NO: 31671 - protein, 10 aa, Homo sapiens
  light chain complementarity determining region 3 for antibody 15836
QQLNTYPPIT

SEQ ID NO: 31672 - protein, 14 aa, Homo sapiens
  heavy chain complementarity determining region 3 for antibody 15836
AGDADTPHRRASDV

SEQ ID NO: 31673 - protein, 10 aa, Homo sapiens
  light chain complementarity determining region 3 for antibody 15837
QQLNTYPPIT

SEQ ID NO: 31674 - protein, 14 aa, Homo sapiens
  heavy chain complementarity determining region 3 for antibody 15837
AGDADAPHRRAFDV

SEQ ID NO: 31675 - protein, 10 aa, Homo sapiens
  light chain complementarity determining region 3 for antibody 15838
QQLNTYPPIT

SEQ ID NO: 31676 - protein, 14 aa, Homo sapiens
  heavy chain complementarity determining region 3 for antibody 15838
AGAADTPHRRAFDV

SEQ ID NO: 31677 - protein, 9 aa, Homo sapiens
  light chain complementarity determining region 3 for antibody 15839
QQLNTYPPD

SEQ ID NO: 31678 - protein, 17 aa, Homo sapiens
  heavy chain complementarity determining region 3 for antibody 15839
ARGSGSPGHYYYYGMDV

SEQ ID NO: 31679 - protein, 9 aa, Homo sapiens
  light chain complementarity determining region 3 for antibody 15840
QQLNTYPPA

SEQ ID NO: 31680 - protein, 17 aa, Homo sapiens
  heavy chain complementarity determining region 3 for antibody 15840
ARGSGSPGHYYYYGMDV

SEQ ID NO: 31681 - protein, 9 aa, Homo sapiens
  light chain complementarity determining region 3 for antibody 15841
QQLNTYPLV

SEQ ID NO: 31682 - protein, 17 aa, Homo sapiens
  heavy chain complementarity determining region 3 for antibody 15841
ARGSGSPGHYYYYGMDV

SEQ ID NO: 31683 - protein, 9 aa, Homo sapiens
  light chain complementarity determining region 3 for antibody 15842
QQLNTYPLT

SEQ ID NO: 31684 - protein, 18 aa, Homo sapiens
  heavy chain complementarity determining region 3 for antibody 15842
VRGSGAPVDLYCYYAMDV

SEQ ID NO: 31685 - protein, 9 aa, Homo sapiens
  light chain complementarity determining region 3 for antibody 15843
QQLNTYPLT

SEQ ID NO: 31686 - protein, 17 aa, Homo sapiens
  heavy chain complementarity determining region 3 for antibody 15843
AKDLSGVHYDIHHGLDV

SEQ ID NO: 31687 - protein, 10 aa, Homo sapiens
  light chain complementarity determining region 3 for antibody 15844
QQLNTSPPIT

SEQ ID NO: 31688 - protein, 14 aa, Homo sapiens
  heavy chain complementarity determining region 3 for antibody 15844
AGDADTPHRRAFDV

SEQ ID NO: 31689 - protein, 10 aa, Homo sapiens
  light chain complementarity determining region 3 for antibody 15845
QQLNTHPPIT

SEQ ID NO: 31690 - protein, 14 aa, Homo sapiens
  heavy chain complementarity determining region 3 for antibody 15845
AGDVDTPHRRAFDV

SEQ ID NO: 31691 - protein, 9 aa, Homo sapiens
  light chain complementarity determining region 3 for antibody 15846
QQLNSYPYT

SEQ ID NO: 31692 - protein, 14 aa, Homo sapiens
  heavy chain complementarity determining region 3 for antibody 15846
ARLNGDSGYDYNDY

SEQ ID NO: 31693 - protein, 9 aa, Homo sapiens
  light chain complementarity determining region 3 for antibody 15847
QQLNSYPWT

SEQ ID NO: 31694 - protein, 11 aa, Homo sapiens
  heavy chain complementarity determining region 3 for antibody 15847
ASVMVRRGIDV

SEQ ID NO: 31695 - protein, 9 aa, Homo sapiens
  light chain complementarity determining region 3 for antibody 15848
QQLNSYPWT

SEQ ID NO: 31696 - protein, 11 aa, Homo sapiens
  heavy chain complementarity determining region 3 for antibody 15848
ASLRVRRGIDV

SEQ ID NO: 31697 - protein, 10 aa, Homo sapiens
  light chain complementarity determining region 3 for antibody 15849
QQLNSYPRFT

SEQ ID NO: 31698 - protein, 16 aa, Homo sapiens
  heavy chain complementarity determining region 3 for antibody 15849
ASTTGFSNKYYYGMDV

SEQ ID NO: 31699 - protein, 10 aa, Homo sapiens
  light chain complementarity determining region 3 for antibody 15850
QQLNSYPRFT

SEQ ID NO: 31700 - protein, 16 aa, Homo sapiens
  heavy chain complementarity determining region 3 for antibody 15850
ARGGTYTAVYYYGMDV

SEQ ID NO: 31701 - protein, 9 aa, Homo sapiens
  light chain complementarity determining region 3 for antibody 15851
QQLNSYPLT

SEQ ID NO: 31702 - protein, 18 aa, Homo sapiens
  heavy chain complementarity determining region 3 for antibody 15851
ARYEGYGDPPTVYYGMDV

SEQ ID NO: 31703 - protein, 9 aa, Homo sapiens
  light chain complementarity determining region 3 for antibody 15852
QQLNSYPLT

SEQ ID NO: 31704 - protein, 18 aa, Homo sapiens
  heavy chain complementarity determining region 3 for antibody 15852
ARYEDYGDTPTVYYGMDV

SEQ ID NO: 31705 - protein, 9 aa, Homo sapiens
  light chain complementarity determining region 3 for antibody 15853
QQLNSYPLT

SEQ ID NO: 31706 - protein, 18 aa, Homo sapiens
  heavy chain complementarity determining region 3 for antibody 15853
ARYEDYGDPPTVYYGIDV

SEQ ID NO: 31707 - protein, 9 aa, Homo sapiens
  light chain complementarity determining region 3 for antibody 15854
QQLNSYPLT

SEQ ID NO: 31708 - protein, 16 aa, Homo sapiens
  heavy chain complementarity determining region 3 for antibody 15854
AGSRREGSNWVWYFDL

SEQ ID NO: 31709 - protein, 9 aa, Homo sapiens
  light chain complementarity determining region 3 for antibody 15855
QQLNSSPLT

SEQ ID NO: 31710 - protein, 18 aa, Homo sapiens
  heavy chain complementarity determining region 3 for antibody 15855
ARYEDYGDSPTVYYGMDA

SEQ ID NO: 31711 - protein, 9 aa, Homo sapiens
  light chain complementarity determining region 3 for antibody 15856
QQLNSFPPN

SEQ ID NO: 31712 - protein, 18 aa, Homo sapiens
  heavy chain complementarity determining region 3 for antibody 15856
ARGSGAPIDDYYYYGLDV

SEQ ID NO: 31713 - protein, 9 aa, Homo sapiens
  light chain complementarity determining region 3 for antibody 15857
QQLNNYPLT

SEQ ID NO: 31714 - protein, 18 aa, Homo sapiens
  heavy chain complementarity determining region 3 for antibody 15857
VRGSGAPVDLYYYYAMDV

SEQ ID NO: 31715 - protein, 9 aa, Homo sapiens
  light chain complementarity determining region 3 for antibody 15858
QQLNNYPLT

SEQ ID NO: 31716 - protein, 15 aa, Homo sapiens
  heavy chain complementarity determining region 3 for antibody 15858
GGGWWTDGYDYGMDV

SEQ ID NO: 31717 - protein, 9 aa, Homo sapiens
  light chain complementarity determining region 3 for antibody 15859
QQLNIYPVT

SEQ ID NO: 31718 - protein, 16 aa, Homo sapiens
  heavy chain complementarity determining region 3 for antibody 15859
ARGDDFGSGSYYNFDY

SEQ ID NO: 31719 - protein, 11 aa, Homo sapiens
  light chain complementarity determining region 3 for antibody 15860
QQLNDFTRGIT

SEQ ID NO: 31720 - protein, 17 aa, Homo sapiens
  heavy chain complementarity determining region 3 for antibody 15860
ARGRQYCSHLSCYGEDY

SEQ ID NO: 31721 - protein, 9 aa, Homo sapiens
  light chain complementarity determining region 3 for antibody 15861
QQLKSSPPN

SEQ ID NO: 31722 - protein, 18 aa, Homo sapiens
  heavy chain complementarity determining region 3 for antibody 15861
ARGSGAPIDDYYYYGLDV

SEQ ID NO: 31723 - protein, 9 aa, Homo sapiens
  light chain complementarity determining region 3 for antibody 15862
QQLKSFPPT

SEQ ID NO: 31724 - protein, 18 aa, Homo sapiens
  heavy chain complementarity determining region 3 for antibody 15862
ARGSGAPIDDYYYYGLDV

SEQ ID NO: 31725 - protein, 9 aa, Homo sapiens
  light chain complementarity determining region 3 for antibody 15863
QQLHGYPPT

SEQ ID NO: 31726 - protein, 21 aa, Homo sapiens
  heavy chain complementarity determining region 3 for antibody 15863
ARDWAQSNGYPVGHYYYGMDV

SEQ ID NO: 31727 - protein, 9 aa, Homo sapiens
  light chain complementarity determining region 3 for antibody 15864
QQLHGYPLT

SEQ ID NO: 31728 - protein, 21 aa, Homo sapiens
  heavy chain complementarity determining region 3 for antibody 15864
AREWAQSNGYPVGHYYYGMDV

SEQ ID NO: 31729 - protein, 9 aa, Homo sapiens
  light chain complementarity determining region 3 for antibody 15865
QQLHGYPLT

SEQ ID NO: 31730 - protein, 21 aa, Homo sapiens
  heavy chain complementarity determining region 3 for antibody 15865
ARDWAQSSGYPVGHYYYGMDV

SEQ ID NO: 31731 - protein, 9 aa, Homo sapiens
  light chain complementarity determining region 3 for antibody 15866
QQLHGYPLT

SEQ ID NO: 31732 - protein, 21 aa, Homo sapiens
  heavy chain complementarity determining region 3 for antibody 15866
ARDWAQSNGYPVSHYYYGMDV

SEQ ID NO: 31733 - protein, 9 aa, Homo sapiens
  light chain complementarity determining region 3 for antibody 15867
QQLHGYPLT

SEQ ID NO: 31734 - protein, 21 aa, Homo sapiens
  heavy chain complementarity determining region 3 for antibody 15867
ARDWAQSNGYPVGHYYYGMGV

SEQ ID NO: 31735 - protein, 9 aa, Homo sapiens
  light chain complementarity determining region 3 for antibody 15868
QQLHGYPLT

SEQ ID NO: 31736 - protein, 21 aa, Homo sapiens
  heavy chain complementarity determining region 3 for antibody 15868
ARDWAQSNGYPVGHYYYGMEV

SEQ ID NO: 31737 - protein, 9 aa, Homo sapiens
  light chain complementarity determining region 3 for antibody 15869
QQLHGYPLT

SEQ ID NO: 31738 - protein, 21 aa, Homo sapiens
  heavy chain complementarity determining region 3 for antibody 15869
ARDWAQSNGYPVGHYYYGMDA

SEQ ID NO: 31739 - protein, 9 aa, Homo sapiens
  light chain complementarity determining region 3 for antibody 15870
QQLHGYPLT

SEQ ID NO: 31740 - protein, 21 aa, Homo sapiens
  heavy chain complementarity determining region 3 for antibody 15870
ARDWAQSNGYPVGHYYSGMDV

SEQ ID NO: 31741 - protein, 9 aa, Homo sapiens
  light chain complementarity determining region 3 for antibody 15871
QQLHGYPLT

SEQ ID NO: 31742 - protein, 21 aa, Homo sapiens
  heavy chain complementarity determining region 3 for antibody 15871
ARDWAQSNGYPVGHYYCGMDV

SEQ ID NO: 31743 - protein, 9 aa, Homo sapiens
  light chain complementarity determining region 3 for antibody 15872
QQLHGYPLT

SEQ ID NO: 31744 - protein, 21 aa, Homo sapiens
  heavy chain complementarity determining region 3 for antibody 15872
ARDWAQSNGYPVGHYHYGMDV

SEQ ID NO: 31745 - protein, 9 aa, Homo sapiens
  light chain complementarity determining region 3 for antibody 15873
QQLHGYPLT

SEQ ID NO: 31746 - protein, 21 aa, Homo sapiens
  heavy chain complementarity determining region 3 for antibody 15873
ARDWAQSNGYPVGHYDYGMDV

SEQ ID NO: 31747 - protein, 9 aa, Homo sapiens
  light chain complementarity determining region 3 for antibody 15874
QQLHGYPLT

SEQ ID NO: 31748 - protein, 21 aa, Homo sapiens
  heavy chain complementarity determining region 3 for antibody 15874
ARDWAQSNGYPVGHSYYGMDV

SEQ ID NO: 31749 - protein, 9 aa, Homo sapiens
  light chain complementarity determining region 3 for antibody 15875
QQLHGYPLT

SEQ ID NO: 31750 - protein, 21 aa, Homo sapiens
  heavy chain complementarity determining region 3 for antibody 15875
ARDWAQSNGYHVGHYYYGMDV

SEQ ID NO: 31751 - protein, 9 aa, Homo sapiens
  light chain complementarity determining region 3 for antibody 15876
QQLHGYPLT

SEQ ID NO: 31752 - protein, 21 aa, Homo sapiens
  heavy chain complementarity determining region 3 for antibody 15876
ARDWAESNGYPVGHYYYGMDV

SEQ ID NO: 31753 - protein, 9 aa, Homo sapiens
  light chain complementarity determining region 3 for antibody 15877
QQLHGYPLT

SEQ ID NO: 31754 - protein, 21 aa, Homo sapiens
  heavy chain complementarity determining region 3 for antibody 15877
ARDRAQSNGYPVGHYYYGMDV

SEQ ID NO: 31755 - protein, 9 aa, Homo sapiens
  light chain complementarity determining region 3 for antibody 15878
QQLHGYPLT

SEQ ID NO: 31756 - protein, 21 aa, Homo sapiens
  heavy chain complementarity determining region 3 for antibody 15878
ARDGAQSNGYPVGHYYYGMDV

SEQ ID NO: 31757 - protein, 9 aa, Homo sapiens
  light chain complementarity determining region 3 for antibody 15879
QQLHGYPLT

SEQ ID NO: 31758 - protein, 20 aa, Homo sapiens
  heavy chain complementarity determining region 3 for antibody 15879
AGTYGSGTYSPDYYYFGMDV

SEQ ID NO: 31759 - protein, 9 aa, Homo sapiens
  light chain complementarity determining region 3 for antibody 15880
QQLHGYPLT

SEQ ID NO: 31760 - protein, 21 aa, Homo sapiens
  heavy chain complementarity determining region 3 for antibody 15880
AGDWAQSNGYPVGHYYYGMDV

SEQ ID NO: 31761 - protein, 9 aa, Homo sapiens
  light chain complementarity determining region 3 for antibody 15881
QQLHGYPLA

SEQ ID NO: 31762 - protein, 21 aa, Homo sapiens
  heavy chain complementarity determining region 3 for antibody 15881
ARDWAQSNGYPVGHYYYGMDV

SEQ ID NO: 31763 - protein, 9 aa, Homo sapiens
  light chain complementarity determining region 3 for antibody 15882
QQLHGCPLT

SEQ ID NO: 31764 - protein, 21 aa, Homo sapiens
  heavy chain complementarity determining region 3 for antibody 15882
ARDWAQSNGYPVGHYYYGMDV

SEQ ID NO: 31765 - protein, 9 aa, Homo sapiens
  light chain complementarity determining region 3 for antibody 15883
QQLGSSPFT

SEQ ID NO: 31766 - protein, 13 aa, Homo sapiens
  heavy chain complementarity determining region 3 for antibody 15883
ARRLYSDLIPFDY

SEQ ID NO: 31767 - protein, 11 aa, Homo sapiens
  light chain complementarity determining region 3 for antibody 15884
QQLASFMRGIT

SEQ ID NO: 31768 - protein, 17 aa, Homo sapiens
  heavy chain complementarity determining region 3 for antibody 15884
ARERQYCDDLSCYGEDS

SEQ ID NO: 31769 - protein, 9 aa, Homo sapiens
  light chain complementarity determining region 3 for antibody 15885
QQINNYPIT

SEQ ID NO: 31770 - protein, 14 aa, Homo sapiens
  heavy chain complementarity determining region 3 for antibody 15885
AKEKGGGGAAGLDD

SEQ ID NO: 31771 - protein, 9 aa, Homo sapiens
  light chain complementarity determining region 3 for antibody 15886
QQIHSYPIT

SEQ ID NO: 31772 - protein, 16 aa, Homo sapiens
  heavy chain complementarity determining region 3 for antibody 15886
ARTQGTRDYYYYAMDV

SEQ ID NO: 31773 - protein, 10 aa, Homo sapiens
  light chain complementarity determining region 3 for antibody 15887
QQHYNWPPDP

SEQ ID NO: 31774 - protein, 11 aa, Homo sapiens
  heavy chain complementarity determining region 3 for antibody 15887
ARWFRGSNYDY

SEQ ID NO: 31775 - protein, 10 aa, Homo sapiens
  light chain complementarity determining region 3 for antibody 15888
QQHVSSELFT

SEQ ID NO: 31776 - protein, 16 aa, Homo sapiens
  heavy chain complementarity determining region 3 for antibody 15888
AREIFKGEIDYYAMDV

SEQ ID NO: 31777 - protein, 10 aa, Homo sapiens
  light chain complementarity determining region 3 for antibody 15889
QQHVSSALYT

SEQ ID NO: 31778 - protein, 16 aa, Homo sapiens
  heavy chain complementarity determining region 3 for antibody 15889
ARELFKGEYDYYAMDV

SEQ ID NO: 31779 - protein, 10 aa, Homo sapiens
  light chain complementarity determining region 3 for antibody 15890
QQHVPSHKYT

SEQ ID NO: 31780 - protein, 22 aa, Homo sapiens
  heavy chain complementarity determining region 3 for antibody 15890
ARHSPFLEMLGERWLQFGAFDI

SEQ ID NO: 31781 - protein, 10 aa, Homo sapiens
  light chain complementarity determining region 3 for antibody 15891
QQHSSSPQLT

SEQ ID NO: 31782 - protein, 13 aa, Homo sapiens
  heavy chain complementarity determining region 3 for antibody 15891
ARSAGYYPNWLES

SEQ ID NO: 31783 - protein, 9 aa, Homo sapiens
  light chain complementarity determining region 3 for antibody 15892
QQHRNVPIT

SEQ ID NO: 31784 - protein, 20 aa, Homo sapiens
  heavy chain complementarity determining region 3 for antibody 15892
AKDRVPDTSMDYFFRHGMDV

SEQ ID NO: 31785 - protein, 9 aa, Homo sapiens
  light chain complementarity determining region 3 for antibody 15893
QQHNTYPYT

SEQ ID NO: 31786 - protein, 19 aa, Homo sapiens
  heavy chain complementarity determining region 3 for antibody 15893
ARDQSSSYGDYYYHYGMDV

SEQ ID NO: 31787 - protein, 10 aa, Homo sapiens
  light chain complementarity determining region 3 for antibody 15894
QQHNSYSQGA

SEQ ID NO: 31788 - protein, 14 aa, Homo sapiens
  heavy chain complementarity determining region 3 for antibody 15894
AKDDTGDYPSYFDH

SEQ ID NO: 31789 - protein, 10 aa, Homo sapiens
  light chain complementarity determining region 3 for antibody 15895
QQHNSYSPVT

SEQ ID NO: 31790 - protein, 13 aa, Homo sapiens
  heavy chain complementarity determining region 3 for antibody 15895
ARSIDWLPYVVDF

SEQ ID NO: 31791 - protein, 9 aa, Homo sapiens
  light chain complementarity determining region 3 for antibody 15896
QQHNSYPYT

SEQ ID NO: 31792 - protein, 16 aa, Homo sapiens
  heavy chain complementarity determining region 3 for antibody 15896
AKDLVHSGSSWWGPDS

SEQ ID NO: 31793 - protein, 9 aa, Homo sapiens
  light chain complementarity determining region 3 for antibody 15897
QQHNSYPRT

SEQ ID NO: 31794 - protein, 11 aa, Homo sapiens
  heavy chain complementarity determining region 3 for antibody 15897
ARDHEGYGYYY

SEQ ID NO: 31795 - protein, 8 aa, Homo sapiens
  light chain complementarity determining region 3 for antibody 15898
QQHNSVWT

SEQ ID NO: 31796 - protein, 17 aa, Homo sapiens
  heavy chain complementarity determining region 3 for antibody 15898
ARGFIVDFWSGYSPFDH

SEQ ID NO: 31797 - protein, 9 aa, Homo sapiens
  light chain complementarity determining region 3 for antibody 15899
QQHNNLPYT

SEQ ID NO: 31798 - protein, 13 aa, Homo sapiens
  heavy chain complementarity determining region 3 for antibody 15899
ARAKWDLFGYFDF

SEQ ID NO: 31799 - protein, 10 aa, Homo sapiens
  light chain complementarity determining region 3 for antibody 15900
QQHKNWPPLT

SEQ ID NO: 31800 - protein, 15 aa, Homo sapiens
  heavy chain complementarity determining region 3 for antibody 15900
ARVVSGWYAPRWFDT

SEQ ID NO: 31801 - protein, 8 aa, Homo sapiens
  light chain complementarity determining region 3 for antibody 15901
QQHHTFST

SEQ ID NO: 31802 - protein, 18 aa, Homo sapiens
  heavy chain complementarity determining region 3 for antibody 15901
ARARRTQHRSDYYDGLDV

SEQ ID NO: 31803 - protein, 8 aa, Homo sapiens
  light chain complementarity determining region 3 for antibody 15902
QQHHSVWT

SEQ ID NO: 31804 - protein, 13 aa, Homo sapiens
  heavy chain complementarity determining region 3 for antibody 15902
AKVRAGDYDSLDY

SEQ ID NO: 31805 - protein, 9 aa, Homo sapiens
  light chain complementarity determining region 3 for antibody 15903
QQHGSVPLT

SEQ ID NO: 31806 - protein, 20 aa, Homo sapiens
  heavy chain complementarity determining region 3 for antibody 15903
AKDRPVDTSMDDYYYHGMDV

SEQ ID NO: 31807 - protein, 8 aa, Homo sapiens
  light chain complementarity determining region 3 for antibody 15904
QQHGSSPT

SEQ ID NO: 31808 - protein, 21 aa, Homo sapiens
  heavy chain complementarity determining region 3 for antibody 15904
ATRTSGKYSSSDDYYYYGMDV

SEQ ID NO: 31809 - protein, 9 aa, Homo sapiens
  light chain complementarity determining region 3 for antibody 15905
QQHGSSPLT

SEQ ID NO: 31810 - protein, 11 aa, Homo sapiens
  heavy chain complementarity determining region 3 for antibody 15905
THYSSGWFFDF

SEQ ID NO: 31811 - protein, 9 aa, Homo sapiens
  light chain complementarity determining region 3 for antibody 15906
QQHGSPPYT

SEQ ID NO: 31812 - protein, 14 aa, Homo sapiens
  heavy chain complementarity determining region 3 for antibody 15906
ARGQNRASSVPHAY

SEQ ID NO: 31813 - protein, 10 aa, Homo sapiens
  light chain complementarity determining region 3 for antibody 15907
QQHGNSPLIT

SEQ ID NO: 31814 - protein, 12 aa, Homo sapiens
  heavy chain complementarity determining region 3 for antibody 15907
ARGPLRGRHFDY

SEQ ID NO: 31815 - protein, 8 aa, Homo sapiens
  light chain complementarity determining region 3 for antibody 15908
QQHGNLLT

SEQ ID NO: 31816 - protein, 20 aa, Homo sapiens
  heavy chain complementarity determining region 3 for antibody 15908
SKDRSVNAAMDYYYYSAMDV

SEQ ID NO: 31817 - protein, 9 aa, Homo sapiens
  light chain complementarity determining region 3 for antibody 15909
QQHESVPLT

SEQ ID NO: 31818 - protein, 20 aa, Homo sapiens
  heavy chain complementarity determining region 3 for antibody 15909
AKERPVDTSMDDYYYHGMDV

SEQ ID NO: 31819 - protein, 9 aa, Homo sapiens
  light chain complementarity determining region 3 for antibody 15910
QQHENWPLT

SEQ ID NO: 31820 - protein, 22 aa, Homo sapiens
  heavy chain complementarity determining region 3 for antibody 15910
AKGLCSITSCYEAHYYYNGMDV

SEQ ID NO: 31821 - protein, 9 aa, Homo sapiens
  light chain complementarity determining region 3 for antibody 15911
QQHDTYSYT

SEQ ID NO: 31822 - protein, 20 aa, Homo sapiens
  heavy chain complementarity determining region 3 for antibody 15911
ARFSYCSGDCYRAHYYGMDV

SEQ ID NO: 31823 - protein, 8 aa, Homo sapiens
  light chain complementarity determining region 3 for antibody 15912
QQHDSYWA

SEQ ID NO: 31824 - protein, 18 aa, Homo sapiens
  heavy chain complementarity determining region 3 for antibody 15912
AREGEITTHQPLGWFFDL

SEQ ID NO: 31825 - protein, 9 aa, Homo sapiens
  light chain complementarity determining region 3 for antibody 15913
QQHDSVPLT

SEQ ID NO: 31826 - protein, 20 aa, Homo sapiens
  heavy chain complementarity determining region 3 for antibody 15913
AKDRPVDTSMDDYYYHGMDV

SEQ ID NO: 31827 - protein, 9 aa, Homo sapiens
  light chain complementarity determining region 3 for antibody 15914
QQHDSDPPL

SEQ ID NO: 31828 - protein, 13 aa, Homo sapiens
  heavy chain complementarity determining region 3 for antibody 15914
ARQFHGAAKHFDF

SEQ ID NO: 31829 - protein, 10 aa, Homo sapiens
  light chain complementarity determining region 3 for antibody 15915
QQHDNLPPLT

SEQ ID NO: 31830 - protein, 20 aa, Homo sapiens
  heavy chain complementarity determining region 3 for antibody 15915
AKHTDLYFGTERTVGYWCDT

SEQ ID NO: 31831 - protein, 10 aa, Homo sapiens
  light chain complementarity determining region 3 for antibody 15916
QQHDNLPPFT

SEQ ID NO: 31832 - protein, 16 aa, Homo sapiens
  heavy chain complementarity determining region 3 for antibody 15916
ARELFKGEYDCYAMDV

SEQ ID NO: 31833 - protein, 9 aa, Homo sapiens
  light chain complementarity determining region 3 for antibody 15917
QQHATSPLP

SEQ ID NO: 31834 - protein, 10 aa, Homo sapiens
  heavy chain complementarity determining region 3 for antibody 15917
AGGTGWHIDH

SEQ ID NO: 31835 - protein, 9 aa, Homo sapiens
  light chain complementarity determining region 3 for antibody 15918
QQHASVPLT

SEQ ID NO: 31836 - protein, 20 aa, Homo sapiens
  heavy chain complementarity determining region 3 for antibody 15918
AKDRPVDTSMDDYYYHGMDV

SEQ ID NO: 31837 - protein, 9 aa, Homo sapiens
  light chain complementarity determining region 3 for antibody 15919
QQGYSVPYT

SEQ ID NO: 31838 - protein, 13 aa, Homo sapiens
  heavy chain complementarity determining region 3 for antibody 15919
ARGSIYGSGKYEY

SEQ ID NO: 31839 - protein, 9 aa, Homo sapiens
  light chain complementarity determining region 3 for antibody 15920
QQGYSTPRT

SEQ ID NO: 31840 - protein, 14 aa, Homo sapiens
  heavy chain complementarity determining region 3 for antibody 15920
ARVQVDYSNYGCDS

SEQ ID NO: 31841 - protein, 11 aa, Homo sapiens
  light chain complementarity determining region 3 for antibody 15921
QQGYSSPPENT

SEQ ID NO: 31842 - protein, 16 aa, Homo sapiens
  heavy chain complementarity determining region 3 for antibody 15921
AREAGEDYYYKDIFDI

SEQ ID NO: 31843 - protein, 10 aa, Homo sapiens
  light chain complementarity determining region 3 for antibody 15922
QQGYSSLGLT

SEQ ID NO: 31844 - protein, 13 aa, Homo sapiens
  heavy chain complementarity determining region 3 for antibody 15922
ARLPSGSYSEFDY

SEQ ID NO: 31845 - protein, 9 aa, Homo sapiens
  light chain complementarity determining region 3 for antibody 15923
QQGYSLPYT

SEQ ID NO: 31846 - protein, 15 aa, Homo sapiens
  heavy chain complementarity determining region 3 for antibody 15923
ARGGAVRPRYYGMDV

SEQ ID NO: 31847 - protein, 9 aa, Homo sapiens
  light chain complementarity determining region 3 for antibody 15924
QQGYRFPFT

SEQ ID NO: 31848 - protein, 19 aa, Homo sapiens
  heavy chain complementarity determining region 3 for antibody 15924
ARSDYSGDTDRYYDHGMDV

SEQ ID NO: 31849 - protein, 9 aa, Homo sapiens
  light chain complementarity determining region 3 for antibody 15925
QQGYNTPWT

SEQ ID NO: 31850 - protein, 14 aa, Homo sapiens
  heavy chain complementarity determining region 3 for antibody 15925
AAAKVWGYYYGMDV

SEQ ID NO: 31851 - protein, 9 aa, Homo sapiens
  light chain complementarity determining region 3 for antibody 15926
QQGYNFPYT

SEQ ID NO: 31852 - protein, 18 aa, Homo sapiens
  heavy chain complementarity determining region 3 for antibody 15926
ARLYGYDSAAYFFTHFDY

SEQ ID NO: 31853 - protein, 9 aa, Homo sapiens
  light chain complementarity determining region 3 for antibody 15927
QQGYIVPQT

SEQ ID NO: 31854 - protein, 18 aa, Homo sapiens
  heavy chain complementarity determining region 3 for antibody 15927
ARPARTGSYSYRYYGMAV

SEQ ID NO: 31855 - protein, 9 aa, Homo sapiens
  light chain complementarity determining region 3 for antibody 15928
QQGYIVPQP

SEQ ID NO: 31856 - protein, 18 aa, Homo sapiens
  heavy chain complementarity determining region 3 for antibody 15928
ARPSRTGSYSYRYYGMAV

SEQ ID NO: 31857 - protein, 9 aa, Homo sapiens
  light chain complementarity determining region 3 for antibody 15929
QQGNSYDYT

SEQ ID NO: 31858 - protein, 16 aa, Homo sapiens
  heavy chain complementarity determining region 3 for antibody 15929
ATTTGYSNYYYYGMDV

SEQ ID NO: 31859 - protein, 9 aa, Homo sapiens
  light chain complementarity determining region 3 for antibody 15930
QQGNSVPWT

SEQ ID NO: 31860 - protein, 17 aa, Homo sapiens
  heavy chain complementarity determining region 3 for antibody 15930
ARVRDSSNYHVAEYFQY

SEQ ID NO: 31861 - protein, 9 aa, Homo sapiens
  light chain complementarity determining region 3 for antibody 15931
QQGNSVPWT

SEQ ID NO: 31862 - protein, 17 aa, Homo sapiens
  heavy chain complementarity determining region 3 for antibody 15931
ARVHGSSNYHVAEYFQY

SEQ ID NO: 31863 - protein, 9 aa, Homo sapiens
  light chain complementarity determining region 3 for antibody 15932
QQGNSVPWT

SEQ ID NO: 31864 - protein, 17 aa, Homo sapiens
  heavy chain complementarity determining region 3 for antibody 15932
ARVHDSSNHHVAEYFQY

SEQ ID NO: 31865 - protein, 9 aa, Homo sapiens
  light chain complementarity determining region 3 for antibody 15933
QQGNSVPWP

SEQ ID NO: 31866 - protein, 17 aa, Homo sapiens
  heavy chain complementarity determining region 3 for antibody 15933
ARVHDSSNYHVAEYFQY

SEQ ID NO: 31867 - protein, 9 aa, Homo sapiens
  light chain complementarity determining region 3 for antibody 15934
QQGNSVPRT

SEQ ID NO: 31868 - protein, 17 aa, Homo sapiens
  heavy chain complementarity determining region 3 for antibody 15934
ARVHDSSNYHVAEYFQY

SEQ ID NO: 31869 - protein, 9 aa, Homo sapiens
  light chain complementarity determining region 3 for antibody 15935
QQGNSVPLT

SEQ ID NO: 31870 - protein, 17 aa, Homo sapiens
  heavy chain complementarity determining region 3 for antibody 15935
ARVHDSSNYHVAEYFQY

SEQ ID NO: 31871 - protein, 9 aa, Homo sapiens
  light chain complementarity determining region 3 for antibody 15936
QQGNSLPFT

SEQ ID NO: 31872 - protein, 19 aa, Homo sapiens
  heavy chain complementarity determining region 3 for antibody 15936
ERTDYSGDTDRYYDYGMDV

SEQ ID NO: 31873 - protein, 9 aa, Homo sapiens
  light chain complementarity determining region 3 for antibody 15937
QQGNSFPWT

SEQ ID NO: 31874 - protein, 17 aa, Homo sapiens
  heavy chain complementarity determining region 3 for antibody 15937
ARVNDSSNYYVAEYFQY

SEQ ID NO: 31875 - protein, 9 aa, Homo sapiens
  light chain complementarity determining region 3 for antibody 15938
QQGNSFPWT

SEQ ID NO: 31876 - protein, 17 aa, Homo sapiens
  heavy chain complementarity determining region 3 for antibody 15938
ARVHDSSKYYVAEYFQY

SEQ ID NO: 31877 - protein, 9 aa, Homo sapiens
  light chain complementarity determining region 3 for antibody 15939
QQGNSFPWT

SEQ ID NO: 31878 - protein, 17 aa, Homo sapiens
  heavy chain complementarity determining region 3 for antibody 15939
ARVHDSSDYYVAEYFQY

SEQ ID NO: 31879 - protein, 9 aa, Homo sapiens
  light chain complementarity determining region 3 for antibody 15940
QQGNSFPWP

SEQ ID NO: 31880 - protein, 17 aa, Homo sapiens
  heavy chain complementarity determining region 3 for antibody 15940
ARVHDSSNYYVAEYFQY

SEQ ID NO: 31881 - protein, 9 aa, Homo sapiens
  light chain complementarity determining region 3 for antibody 15941
QQGNSFPWA

SEQ ID NO: 31882 - protein, 17 aa, Homo sapiens
  heavy chain complementarity determining region 3 for antibody 15941
ARVHDSSNYYVAEYFQY

SEQ ID NO: 31883 - protein, 9 aa, Homo sapiens
  light chain complementarity determining region 3 for antibody 15942
QQGNSFPFT

SEQ ID NO: 31884 - protein, 19 aa, Homo sapiens
  heavy chain complementarity determining region 3 for antibody 15942
ARTDYSGDTDRYYDFGMDV

SEQ ID NO: 31885 - protein, 9 aa, Homo sapiens
  light chain complementarity determining region 3 for antibody 15943
QQGNSFPFT

SEQ ID NO: 31886 - protein, 19 aa, Homo sapiens
  heavy chain complementarity determining region 3 for antibody 15943
ARTDCSGDTDRYYDFGTDV

SEQ ID NO: 31887 - protein, 9 aa, Homo sapiens
  light chain complementarity determining region 3 for antibody 15944
QQGNSFPFT

SEQ ID NO: 31888 - protein, 19 aa, Homo sapiens
  heavy chain complementarity determining region 3 for antibody 15944
ARTDCSGDTDRYYDFGMDA

SEQ ID NO: 31889 - protein, 9 aa, Homo sapiens
  light chain complementarity determining region 3 for antibody 15945
QQGNSFPFT

SEQ ID NO: 31890 - protein, 19 aa, Homo sapiens
  heavy chain complementarity determining region 3 for antibody 15945
ARTDCSGDTDRYYDFGIDV

SEQ ID NO: 31891 - protein, 9 aa, Homo sapiens
  light chain complementarity determining region 3 for antibody 15946
QQGNSFPFT

SEQ ID NO: 31892 - protein, 19 aa, Homo sapiens
  heavy chain complementarity determining region 3 for antibody 15946
ARTDCRGDTDRYYDFGMDV

SEQ ID NO: 31893 - protein, 9 aa, Homo sapiens
  light chain complementarity determining region 3 for antibody 15947
QQGNSFPFT

SEQ ID NO: 31894 - protein, 19 aa, Homo sapiens
  heavy chain complementarity determining region 3 for antibody 15947
ARTDCGGDTDRYYDFGMDV

SEQ ID NO: 31895 - protein, 9 aa, Homo sapiens
  light chain complementarity determining region 3 for antibody 15948
QQGNSFHFT

SEQ ID NO: 31896 - protein, 19 aa, Homo sapiens
  heavy chain complementarity determining region 3 for antibody 15948
ARTDCSGDTDRYYDFGMDV

SEQ ID NO: 31897 - protein, 9 aa, Homo sapiens
  light chain complementarity determining region 3 for antibody 15949
QQGNSCPFT

SEQ ID NO: 31898 - protein, 19 aa, Homo sapiens
  heavy chain complementarity determining region 3 for antibody 15949
ARTDCSGDTDRYYDFGMDV

SEQ ID NO: 31899 - protein, 9 aa, Homo sapiens
  light chain complementarity determining region 3 for antibody 15950
QQGMNFPIT

SEQ ID NO: 31900 - protein, 11 aa, Homo sapiens
  heavy chain complementarity determining region 3 for antibody 15950
ARNYDSSGFDY

SEQ ID NO: 31901 - protein, 9 aa, Homo sapiens
  light chain complementarity determining region 3 for antibody 15951
QQGHSSPFT

SEQ ID NO: 31902 - protein, 19 aa, Homo sapiens
  heavy chain complementarity determining region 3 for antibody 15951
ARSAYSGDTDRYYDYGMDV

SEQ ID NO: 31903 - protein, 9 aa, Homo sapiens
  light chain complementarity determining region 3 for antibody 15952
QQGHSPPFT

SEQ ID NO: 31904 - protein, 19 aa, Homo sapiens
  heavy chain complementarity determining region 3 for antibody 15952
ARSDYSGDTDRYYDYGMDV

SEQ ID NO: 31905 - protein, 9 aa, Homo sapiens
  light chain complementarity determining region 3 for antibody 15953
QQGHSLPFT

SEQ ID NO: 31906 - protein, 19 aa, Homo sapiens
  heavy chain complementarity determining region 3 for antibody 15953
ARSVYSGDTDRYYDYGMDV

SEQ ID NO: 31907 - protein, 9 aa, Homo sapiens
  light chain complementarity determining region 3 for antibody 15954
QQGHSLPFT

SEQ ID NO: 31908 - protein, 19 aa, Homo sapiens
  heavy chain complementarity determining region 3 for antibody 15954
ARSDYSGGTDRYYDYGMDV

SEQ ID NO: 31909 - protein, 9 aa, Homo sapiens
  light chain complementarity determining region 3 for antibody 15955
QQGHSLPFT

SEQ ID NO: 31910 - protein, 19 aa, Homo sapiens
  heavy chain complementarity determining region 3 for antibody 15955
ARSDYSGDTGRYYDYGMDV

SEQ ID NO: 31911 - protein, 9 aa, Homo sapiens
  light chain complementarity determining region 3 for antibody 15956
QQGHSLPFT

SEQ ID NO: 31912 - protein, 19 aa, Homo sapiens
  heavy chain complementarity determining region 3 for antibody 15956
ARSDYSGDTDRYYNYGMDV

SEQ ID NO: 31913 - protein, 9 aa, Homo sapiens
  light chain complementarity determining region 3 for antibody 15957
QQGHSLPFT

SEQ ID NO: 31914 - protein, 19 aa, Homo sapiens
  heavy chain complementarity determining region 3 for antibody 15957
ARSDYSGDTDRYYEYGMDV

SEQ ID NO: 31915 - protein, 9 aa, Homo sapiens
  light chain complementarity determining region 3 for antibody 15958
QQGHSLPFT

SEQ ID NO: 31916 - protein, 19 aa, Homo sapiens
  heavy chain complementarity determining region 3 for antibody 15958
ARSDYSGDTDRYYDYGMDA

SEQ ID NO: 31917 - protein, 9 aa, Homo sapiens
  light chain complementarity determining region 3 for antibody 15959
QQGHSLPFT

SEQ ID NO: 31918 - protein, 19 aa, Homo sapiens
  heavy chain complementarity determining region 3 for antibody 15959
ARSDYSGDTDRYDDYGMDV

SEQ ID NO: 31919 - protein, 9 aa, Homo sapiens
  light chain complementarity determining region 3 for antibody 15960
QQGHSLPFT

SEQ ID NO: 31920 - protein, 19 aa, Homo sapiens
  heavy chain complementarity determining region 3 for antibody 15960
ARSDYSGDTDRCYDYGMDV

SEQ ID NO: 31921 - protein, 9 aa, Homo sapiens
  light chain complementarity determining region 3 for antibody 15961
QQGHSLPFT

SEQ ID NO: 31922 - protein, 19 aa, Homo sapiens
  heavy chain complementarity determining region 3 for antibody 15961
ARSDYSGDSDRYYDYGMDV

SEQ ID NO: 31923 - protein, 9 aa, Homo sapiens
  light chain complementarity determining region 3 for antibody 15962
QQGHSLPFT

SEQ ID NO: 31924 - protein, 19 aa, Homo sapiens
  heavy chain complementarity determining region 3 for antibody 15962
ARSDYRGDTDRYYDYGMDV

SEQ ID NO: 31925 - protein, 9 aa, Homo sapiens
  light chain complementarity determining region 3 for antibody 15963
QQGHSLPFT

SEQ ID NO: 31926 - protein, 19 aa, Homo sapiens
  heavy chain complementarity determining region 3 for antibody 15963
ARSDCSGDTDRYYDYGMDV

SEQ ID NO: 31927 - protein, 9 aa, Homo sapiens
  light chain complementarity determining region 3 for antibody 15964
QQGHSLPFT

SEQ ID NO: 31928 - protein, 19 aa, Homo sapiens
  heavy chain complementarity determining region 3 for antibody 15964
ARSAYSGETDRYYDYGLDV

SEQ ID NO: 31929 - protein, 9 aa, Homo sapiens
  light chain complementarity determining region 3 for antibody 15965
QQGHSLPFT

SEQ ID NO: 31930 - protein, 19 aa, Homo sapiens
  heavy chain complementarity determining region 3 for antibody 15965
ARGDYSGDTDRYYDYGMDV

SEQ ID NO: 31931 - protein, 9 aa, Homo sapiens
  light chain complementarity determining region 3 for antibody 15966
QQGHRLPFT

SEQ ID NO: 31932 - protein, 19 aa, Homo sapiens
  heavy chain complementarity determining region 3 for antibody 15966
ARSDYSGDTDRYYDYGMDV

SEQ ID NO: 31933 - protein, 9 aa, Homo sapiens
  light chain complementarity determining region 3 for antibody 15967
QQGFSFPFT

SEQ ID NO: 31934 - protein, 19 aa, Homo sapiens
  heavy chain complementarity determining region 3 for antibody 15967
ARSDYSGDTDRYYDHGMDV

SEQ ID NO: 31935 - protein, 9 aa, Homo sapiens
  light chain complementarity determining region 3 for antibody 15968
QQGDSPPFT

SEQ ID NO: 31936 - protein, 19 aa, Homo sapiens
  heavy chain complementarity determining region 3 for antibody 15968
ARSDYSGDTDRYYDYGMDV

SEQ ID NO: 31937 - protein, 9 aa, Homo sapiens
  light chain complementarity determining region 3 for antibody 15969
QQGDSLPFT

SEQ ID NO: 31938 - protein, 19 aa, Homo sapiens
  heavy chain complementarity determining region 3 for antibody 15969
ARSDCSGDTDRYYDYGMDV

SEQ ID NO: 31939 - protein, 9 aa, Homo sapiens
  light chain complementarity determining region 3 for antibody 15970
QQFTTYPLT

SEQ ID NO: 31940 - protein, 17 aa, Homo sapiens
  heavy chain complementarity determining region 3 for antibody 15970
AKDLSGVHYDIHHGLDV

SEQ ID NO: 31941 - protein, 9 aa, Homo sapiens
  light chain complementarity determining region 3 for antibody 15971
QQFTSYPLT

SEQ ID NO: 31942 - protein, 6 aa, Homo sapiens
  heavy chain complementarity determining region 3 for antibody 15971
ASRGGF

SEQ ID NO: 31943 - protein, 9 aa, Homo sapiens
  light chain complementarity determining region 3 for antibody 15972
QQFTSYLWT

SEQ ID NO: 31944 - protein, 17 aa, Homo sapiens
  heavy chain complementarity determining region 3 for antibody 15972
ATSYCDNARCFPVGSDY

SEQ ID NO: 31945 - protein, 9 aa, Homo sapiens
  light chain complementarity determining region 3 for antibody 15973
QQFSTYPLT

SEQ ID NO: 31946 - protein, 17 aa, Homo sapiens
  heavy chain complementarity determining region 3 for antibody 15973
AKDLSGVRYDIHHGLDV

SEQ ID NO: 31947 - protein, 9 aa, Homo sapiens
  light chain complementarity determining region 3 for antibody 15974
QQFSTYPLT

SEQ ID NO: 31948 - protein, 17 aa, Homo sapiens
  heavy chain complementarity determining region 3 for antibody 15974
AKDLSGVHYDIHHGLDV

SEQ ID NO: 31949 - protein, 8 aa, Homo sapiens
  light chain complementarity determining region 3 for antibody 15975
QQFSSYPS

SEQ ID NO: 31950 - protein, 16 aa, Homo sapiens
  heavy chain complementarity determining region 3 for antibody 15975
ARVYSSDWYGGGAFDL

SEQ ID NO: 31951 - protein, 9 aa, Homo sapiens
  light chain complementarity determining region 3 for antibody 15976
QQFSSYPLT

SEQ ID NO: 31952 - protein, 8 aa, Homo sapiens
  heavy chain complementarity determining region 3 for antibody 15976
AKRSAFDF

SEQ ID NO: 31953 - protein, 9 aa, Homo sapiens
  light chain complementarity determining region 3 for antibody 15977
QQFSPYSDS

SEQ ID NO: 31954 - protein, 13 aa, Homo sapiens
  heavy chain complementarity determining region 3 for antibody 15977
VRIGAAAGTAFDY

SEQ ID NO: 31955 - protein, 9 aa, Homo sapiens
  light chain complementarity determining region 3 for antibody 15978
QQFSGYPLT

SEQ ID NO: 31956 - protein, 17 aa, Homo sapiens
  heavy chain complementarity determining region 3 for antibody 15978
ARDRLATIRNSYCGMDV

SEQ ID NO: 31957 - protein, 9 aa, Homo sapiens
  light chain complementarity determining region 3 for antibody 15979
QQFRSYPIT

SEQ ID NO: 31958 - protein, 16 aa, Homo sapiens
  heavy chain complementarity determining region 3 for antibody 15979
ARTQGTRDYYYYAMDV

SEQ ID NO: 31959 - protein, 9 aa, Homo sapiens
  light chain complementarity determining region 3 for antibody 15980
QQFNTYPLT

SEQ ID NO: 31960 - protein, 17 aa, Homo sapiens
  heavy chain complementarity determining region 3 for antibody 15980
AKDLSGVHYNIHHGLDV

SEQ ID NO: 31961 - protein, 9 aa, Homo sapiens
  light chain complementarity determining region 3 for antibody 15981
QQFNTYPLT

SEQ ID NO: 31962 - protein, 17 aa, Homo sapiens
  heavy chain complementarity determining region 3 for antibody 15981
AKDLSGVHYGIHHGLDV

SEQ ID NO: 31963 - protein, 9 aa, Homo sapiens
  light chain complementarity determining region 3 for antibody 15982
QQFNTYPLT

SEQ ID NO: 31964 - protein, 17 aa, Homo sapiens
  heavy chain complementarity determining region 3 for antibody 15982
AKDLSGVHYDTHHGLDV

SEQ ID NO: 31965 - protein, 9 aa, Homo sapiens
  light chain complementarity determining region 3 for antibody 15983
QQFNTYPLT

SEQ ID NO: 31966 - protein, 17 aa, Homo sapiens
  heavy chain complementarity determining region 3 for antibody 15983
AKDLSGVHYDLHHGLDV

SEQ ID NO: 31967 - protein, 9 aa, Homo sapiens
  light chain complementarity determining region 3 for antibody 15984
QQFNTYPLT

SEQ ID NO: 31968 - protein, 17 aa, Homo sapiens
  heavy chain complementarity determining region 3 for antibody 15984
AKDLSGVHYDIPHGLDV

SEQ ID NO: 31969 - protein, 9 aa, Homo sapiens
  light chain complementarity determining region 3 for antibody 15985
QQFNTYPLT

SEQ ID NO: 31970 - protein, 17 aa, Homo sapiens
  heavy chain complementarity determining region 3 for antibody 15985
AKDLSGVHYDIHHGLNV

SEQ ID NO: 31971 - protein, 9 aa, Homo sapiens
  light chain complementarity determining region 3 for antibody 15986
QQFNTYPLT

SEQ ID NO: 31972 - protein, 17 aa, Homo sapiens
  heavy chain complementarity determining region 3 for antibody 15986
AKDLSGVHYDIHHGLDD

SEQ ID NO: 31973 - protein, 9 aa, Homo sapiens
  light chain complementarity determining region 3 for antibody 15987
QQFNTYPLT

SEQ ID NO: 31974 - protein, 17 aa, Homo sapiens
  heavy chain complementarity determining region 3 for antibody 15987
AKDLSGVHYDIHHDLDV

SEQ ID NO: 31975 - protein, 9 aa, Homo sapiens
  light chain complementarity determining region 3 for antibody 15988
QQFNTYPLT

SEQ ID NO: 31976 - protein, 17 aa, Homo sapiens
  heavy chain complementarity determining region 3 for antibody 15988
AKDLSGVHYAIHHGLDV

SEQ ID NO: 31977 - protein, 9 aa, Homo sapiens
  light chain complementarity determining region 3 for antibody 15989
QQFNTYPLT

SEQ ID NO: 31978 - protein, 17 aa, Homo sapiens
  heavy chain complementarity determining region 3 for antibody 15989
AKDLSGVHCDIHHGLDV

SEQ ID NO: 31979 - protein, 9 aa, Homo sapiens
  light chain complementarity determining region 3 for antibody 15990
QQFNTYPLT

SEQ ID NO: 31980 - protein, 17 aa, Homo sapiens
  heavy chain complementarity determining region 3 for antibody 15990
AKDLRGVHYDIHHGLDV

SEQ ID NO: 31981 - protein, 9 aa, Homo sapiens
  light chain complementarity determining region 3 for antibody 15991
QQFNTYPLT

SEQ ID NO: 31982 - protein, 17 aa, Homo sapiens
  heavy chain complementarity determining region 3 for antibody 15991
AEDLSGVHYDIHHGLDV

SEQ ID NO: 31983 - protein, 9 aa, Homo sapiens
  light chain complementarity determining region 3 for antibody 15992
QQFNTYLLT

SEQ ID NO: 31984 - protein, 17 aa, Homo sapiens
  heavy chain complementarity determining region 3 for antibody 15992
AKDLSGVHYDIHHGLDV

SEQ ID NO: 31985 - protein, 9 aa, Homo sapiens
  light chain complementarity determining region 3 for antibody 15993
QQFNSYPWT

SEQ ID NO: 31986 - protein, 14 aa, Homo sapiens
  heavy chain complementarity determining region 3 for antibody 15993
ARDYSFYVHNAFDI

SEQ ID NO: 31987 - protein, 9 aa, Homo sapiens
  light chain complementarity determining region 3 for antibody 15994
QQFNSYPLT

SEQ ID NO: 31988 - protein, 11 aa, Homo sapiens
  heavy chain complementarity determining region 3 for antibody 15994
TRGIPRYYFDF

SEQ ID NO: 31989 - protein, 9 aa, Homo sapiens
  light chain complementarity determining region 3 for antibody 15995
QQFNSYPLT

SEQ ID NO: 31990 - protein, 6 aa, Homo sapiens
  heavy chain complementarity determining region 3 for antibody 15995
ASRRGF

SEQ ID NO: 31991 - protein, 9 aa, Homo sapiens
  light chain complementarity determining region 3 for antibody 15996
QQFNSYPIT

SEQ ID NO: 31992 - protein, 14 aa, Homo sapiens
  heavy chain complementarity determining region 3 for antibody 15996
ARDRVSSKWPSFDY

SEQ ID NO: 31993 - protein, 9 aa, Homo sapiens
  light chain complementarity determining region 3 for antibody 15997
QQFNSYPFT

SEQ ID NO: 31994 - protein, 12 aa, Homo sapiens
  heavy chain complementarity determining region 3 for antibody 15997
ARGVHWGRWFDP

SEQ ID NO: 31995 - protein, 9 aa, Homo sapiens
  light chain complementarity determining region 3 for antibody 15998
QQFNSCPLT

SEQ ID NO: 31996 - protein, 14 aa, Homo sapiens
  heavy chain complementarity determining region 3 for antibody 15998
AGLGSSGFFSGFDP

SEQ ID NO: 31997 - protein, 9 aa, Homo sapiens
  light chain complementarity determining region 3 for antibody 15999
QQFNNYPQT

SEQ ID NO: 31998 - protein, 11 aa, Homo sapiens
  heavy chain complementarity determining region 3 for antibody 15999
AREETRGYSQN

SEQ ID NO: 31999 - protein, 9 aa, Homo sapiens
  light chain complementarity determining region 3 for antibody 16000
QQFNNYPQT

SEQ ID NO: 32000 - protein, 11 aa, Homo sapiens
  heavy chain complementarity determining region 3 for antibody 16000
AREATRGYSRN

SEQ ID NO: 32001 - protein, 9 aa, Homo sapiens
  light chain complementarity determining region 3 for antibody 16001
QQFNNYPQT

SEQ ID NO: 32002 - protein, 11 aa, Homo sapiens
  heavy chain complementarity determining region 3 for antibody 16001
AREATRGYIQN

SEQ ID NO: 32003 - protein, 9 aa, Homo sapiens
  light chain complementarity determining region 3 for antibody 16002
QQFNNYPQP

SEQ ID NO: 32004 - protein, 11 aa, Homo sapiens
  heavy chain complementarity determining region 3 for antibody 16002
AREATRGYSQN

SEQ ID NO: 32005 - protein, 9 aa, Homo sapiens
  light chain complementarity determining region 3 for antibody 16003
QQFNNYPPT

SEQ ID NO: 32006 - protein, 11 aa, Homo sapiens
  heavy chain complementarity determining region 3 for antibody 16003
AREATRGYSQN

SEQ ID NO: 32007 - protein, 9 aa, Homo sapiens
  light chain complementarity determining region 3 for antibody 16004
QQFNAYPLT

SEQ ID NO: 32008 - protein, 17 aa, Homo sapiens
  heavy chain complementarity determining region 3 for antibody 16004
AKDLSGVHYDIHHGLDV

SEQ ID NO: 32009 - protein, 9 aa, Homo sapiens
  light chain complementarity determining region 3 for antibody 16005
QQFKTHPHT

SEQ ID NO: 32010 - protein, 15 aa, Homo sapiens
  heavy chain complementarity determining region 3 for antibody 16005
AKGRHNLNYVYGMDV

SEQ ID NO: 32011 - protein, 9 aa, Homo sapiens
  light chain complementarity determining region 3 for antibody 16006
QQFHTYPLT

SEQ ID NO: 32012 - protein, 17 aa, Homo sapiens
  heavy chain complementarity determining region 3 for antibody 16006
AKDLSGVHYDIHHGLDV

SEQ ID NO: 32013 - protein, 9 aa, Homo sapiens
  light chain complementarity determining region 3 for antibody 16007
QQFHSYTIT

SEQ ID NO: 32014 - protein, 16 aa, Homo sapiens
  heavy chain complementarity determining region 3 for antibody 16007
ARTQGTRDYYYYAMDV

SEQ ID NO: 32015 - protein, 9 aa, Homo sapiens
  light chain complementarity determining region 3 for antibody 16008
QQFHSYPIT

SEQ ID NO: 32016 - protein, 16 aa, Homo sapiens
  heavy chain complementarity determining region 3 for antibody 16008
SRTQGTRDYYYYAMDV

SEQ ID NO: 32017 - protein, 9 aa, Homo sapiens
  light chain complementarity determining region 3 for antibody 16009
QQFHSYPIT

SEQ ID NO: 32018 - protein, 16 aa, Homo sapiens
  heavy chain complementarity determining region 3 for antibody 16009
ARTQGTRYYYYYAMDV

SEQ ID NO: 32019 - protein, 9 aa, Homo sapiens
  light chain complementarity determining region 3 for antibody 16010
QQFHSYPIT

SEQ ID NO: 32020 - protein, 16 aa, Homo sapiens
  heavy chain complementarity determining region 3 for antibody 16010
ARTQGTRDYYYYDMDV

SEQ ID NO: 32021 - protein, 9 aa, Homo sapiens
  light chain complementarity determining region 3 for antibody 16011
QQFHSYPIT

SEQ ID NO: 32022 - protein, 16 aa, Homo sapiens
  heavy chain complementarity determining region 3 for antibody 16011
ARTQGTRDYYYYAMDD

SEQ ID NO: 32023 - protein, 9 aa, Homo sapiens
  light chain complementarity determining region 3 for antibody 16012
QQFHSYPIT

SEQ ID NO: 32024 - protein, 16 aa, Homo sapiens
  heavy chain complementarity determining region 3 for antibody 16012
ARTQGTRDYYYHAMDV

SEQ ID NO: 32025 - protein, 9 aa, Homo sapiens
  light chain complementarity determining region 3 for antibody 16013
QQFHSYPIT

SEQ ID NO: 32026 - protein, 16 aa, Homo sapiens
  heavy chain complementarity determining region 3 for antibody 16013
ARTQGTRDSYYYAMDV

SEQ ID NO: 32027 - protein, 9 aa, Homo sapiens
  light chain complementarity determining region 3 for antibody 16014
QQFHSYPIT

SEQ ID NO: 32028 - protein, 16 aa, Homo sapiens
  heavy chain complementarity determining region 3 for antibody 16014
ARTQGTRDCYYYAMDV

SEQ ID NO: 32029 - protein, 9 aa, Homo sapiens
  light chain complementarity determining region 3 for antibody 16015
QQFHSYPIT

SEQ ID NO: 32030 - protein, 16 aa, Homo sapiens
  heavy chain complementarity determining region 3 for antibody 16015
ARTQGRRDYYYYAMDV

SEQ ID NO: 32031 - protein, 9 aa, Homo sapiens
  light chain complementarity determining region 3 for antibody 16016
QQFHSYPIT

SEQ ID NO: 32032 - protein, 16 aa, Homo sapiens
  heavy chain complementarity determining region 3 for antibody 16016
ARTQGPRDYYYYAMDV

SEQ ID NO: 32033 - protein, 9 aa, Homo sapiens
  light chain complementarity determining region 3 for antibody 16017
QQFHSYPIT

SEQ ID NO: 32034 - protein, 16 aa, Homo sapiens
  heavy chain complementarity determining region 3 for antibody 16017
ARTQDTRDYYYYAMDV

SEQ ID NO: 32035 - protein, 9 aa, Homo sapiens
  light chain complementarity determining region 3 for antibody 16018
QQFHSYPIT

SEQ ID NO: 32036 - protein, 16 aa, Homo sapiens
  heavy chain complementarity determining region 3 for antibody 16018
ARTQCTRDYYYYAMDV

SEQ ID NO: 32037 - protein, 9 aa, Homo sapiens
  light chain complementarity determining region 3 for antibody 16019
QQFHSYPIN

SEQ ID NO: 32038 - protein, 16 aa, Homo sapiens
  heavy chain complementarity determining region 3 for antibody 16019
ARTQGTRDYYYYAMDV

SEQ ID NO: 32039 - protein, 9 aa, Homo sapiens
  light chain complementarity determining region 3 for antibody 16020
QQFHSYLIT

SEQ ID NO: 32040 - protein, 16 aa, Homo sapiens
  heavy chain complementarity determining region 3 for antibody 16020
ARTQGTRDYYYYAMDV

SEQ ID NO: 32041 - protein, 9 aa, Homo sapiens
  light chain complementarity determining region 3 for antibody 16021
QQFEYLPPT

SEQ ID NO: 32042 - protein, 19 aa, Homo sapiens
  heavy chain complementarity determining region 3 for antibody 16021
ARHKFRIGQSDYYYYKTDV

SEQ ID NO: 32043 - protein, 9 aa, Homo sapiens
  light chain complementarity determining region 3 for antibody 16022
QQFDTYPLT

SEQ ID NO: 32044 - protein, 17 aa, Homo sapiens
  heavy chain complementarity determining region 3 for antibody 16022
AKDLSGVHYDIHHGLDV

SEQ ID NO: 32045 - protein, 10 aa, Homo sapiens
  light chain complementarity determining region 3 for antibody 16023
QQFDNWPPWT

SEQ ID NO: 32046 - protein, 17 aa, Homo sapiens
  heavy chain complementarity determining region 3 for antibody 16023
ARNRRGFSYGDGGFFDS

SEQ ID NO: 32047 - protein, 10 aa, Homo sapiens
  light chain complementarity determining region 3 for antibody 16024
QQFDNWPPRT

SEQ ID NO: 32048 - protein, 17 aa, Homo sapiens
  heavy chain complementarity determining region 3 for antibody 16024
ARNRRGFSYGYGGFFDS

SEQ ID NO: 32049 - protein, 10 aa, Homo sapiens
  light chain complementarity determining region 3 for antibody 16025
QQFDNPFPST

SEQ ID NO: 32050 - protein, 13 aa, Homo sapiens
  heavy chain complementarity determining region 3 for antibody 16025
ARDSVGDSGYGST

SEQ ID NO: 32051 - protein, 10 aa, Homo sapiens
  light chain complementarity determining region 3 for antibody 16026
QQFDNPFPFT

SEQ ID NO: 32052 - protein, 13 aa, Homo sapiens
  heavy chain complementarity determining region 3 for antibody 16026
ARESVGDSGYGST

SEQ ID NO: 32053 - protein, 10 aa, Homo sapiens
  light chain complementarity determining region 3 for antibody 16027
QQFDNPFPFT

SEQ ID NO: 32054 - protein, 13 aa, Homo sapiens
  heavy chain complementarity determining region 3 for antibody 16027
ARDSVGDSGYGSA

SEQ ID NO: 32055 - protein, 10 aa, Homo sapiens
  light chain complementarity determining region 3 for antibody 16028
QQFDNPFPFT

SEQ ID NO: 32056 - protein, 13 aa, Homo sapiens
  heavy chain complementarity determining region 3 for antibody 16028
ARDSVGDAGYGST

SEQ ID NO: 32057 - protein, 10 aa, Homo sapiens
  light chain complementarity determining region 3 for antibody 16029
QQFDNPFPFP

SEQ ID NO: 32058 - protein, 13 aa, Homo sapiens
  heavy chain complementarity determining region 3 for antibody 16029
ARDSVGDSGYGST

SEQ ID NO: 32059 - protein, 9 aa, Homo sapiens
  light chain complementarity determining region 3 for antibody 16030
QQFDHFSIT

SEQ ID NO: 32060 - protein, 14 aa, Homo sapiens
  heavy chain complementarity determining region 3 for antibody 16030
VRQVVTAVRWPFEY

SEQ ID NO: 32061 - protein, 9 aa, Homo sapiens
  light chain complementarity determining region 3 for antibody 16031
QQFDGSRRT

SEQ ID NO: 32062 - protein, 21 aa, Homo sapiens
  heavy chain complementarity determining region 3 for antibody 16031
VRGGYYHSGNYYYYDYYGMDV

SEQ ID NO: 32063 - protein, 11 aa, Homo sapiens
  light chain complementarity determining region 3 for antibody 16032
QQFDDVLPGFT

SEQ ID NO: 32064 - protein, 20 aa, Homo sapiens
  heavy chain complementarity determining region 3 for antibody 16032
ARGRNGGNADRLPVWNNMAV

SEQ ID NO: 32065 - protein, 8 aa, Homo sapiens
  light chain complementarity determining region 3 for antibody 16033
QQDYNLRT

SEQ ID NO: 32066 - protein, 17 aa, Homo sapiens
  heavy chain complementarity determining region 3 for antibody 16033
TTDAGGRYYDILTGPDY

SEQ ID NO: 32067 - protein, 10 aa, Homo sapiens
  light chain complementarity determining region 3 for antibody 16034
QQDVPSHKYT

SEQ ID NO: 32068 - protein, 22 aa, Homo sapiens
  heavy chain complementarity determining region 3 for antibody 16034
ARHSPFLEMLGERWLQFGAFDI

SEQ ID NO: 32069 - protein, 9 aa, Homo sapiens
  light chain complementarity determining region 3 for antibody 16035
QQDSTFPYT

SEQ ID NO: 32070 - protein, 17 aa, Homo sapiens
  heavy chain complementarity determining region 3 for antibody 16035
AREQYNDVDLRQFFFDY

SEQ ID NO: 32071 - protein, 9 aa, Homo sapiens
  light chain complementarity determining region 3 for antibody 16036
QQDSSIPRT

SEQ ID NO: 32072 - protein, 16 aa, Homo sapiens
  heavy chain complementarity determining region 3 for antibody 16036
TRSPRSDYRDNFEYKY

SEQ ID NO: 32073 - protein, 9 aa, Homo sapiens
  light chain complementarity determining region 3 for antibody 16037
QQDNSYPYT

SEQ ID NO: 32074 - protein, 15 aa, Homo sapiens
  heavy chain complementarity determining region 3 for antibody 16037
ARVNAPSITWPLYDF

SEQ ID NO: 32075 - protein, 9 aa, Homo sapiens
  light chain complementarity determining region 3 for antibody 16038
QQDNSYPYT

SEQ ID NO: 32076 - protein, 19 aa, Homo sapiens
  heavy chain complementarity determining region 3 for antibody 16038
ARDQSSSYGDYYSYYGMDV

SEQ ID NO: 32077 - protein, 9 aa, Homo sapiens
  light chain complementarity determining region 3 for antibody 16039
QQDNSYPRT

SEQ ID NO: 32078 - protein, 19 aa, Homo sapiens
  heavy chain complementarity determining region 3 for antibody 16039
ARDSPSVRKRPTEYYGMDV

SEQ ID NO: 32079 - protein, 9 aa, Homo sapiens
  light chain complementarity determining region 3 for antibody 16040
QQDNSYPIT

SEQ ID NO: 32080 - protein, 16 aa, Homo sapiens
  heavy chain complementarity determining region 3 for antibody 16040
TRRWDYDSSGQRIVDY

SEQ ID NO: 32081 - protein, 9 aa, Homo sapiens
  light chain complementarity determining region 3 for antibody 16041
QQDNSYPIT

SEQ ID NO: 32082 - protein, 10 aa, Homo sapiens
  heavy chain complementarity determining region 3 for antibody 16041
ARTYLRNFDS

SEQ ID NO: 32083 - protein, 9 aa, Homo sapiens
  light chain complementarity determining region 3 for antibody 16042
QQDNSLPIT

SEQ ID NO: 32084 - protein, 19 aa, Homo sapiens
  heavy chain complementarity determining region 3 for antibody 16042
ARDRDYTIVDDYGSGVFDY

SEQ ID NO: 32085 - protein, 9 aa, Homo sapiens
  light chain complementarity determining region 3 for antibody 16043
QQDNSLPHT

SEQ ID NO: 32086 - protein, 14 aa, Homo sapiens
  heavy chain complementarity determining region 3 for antibody 16043
ARDRSVTYGKYFGH

SEQ ID NO: 32087 - protein, 9 aa, Homo sapiens
  light chain complementarity determining region 3 for antibody 16044
QQDNSFPWT

SEQ ID NO: 32088 - protein, 17 aa, Homo sapiens
  heavy chain complementarity determining region 3 for antibody 16044
ARRSGLYYFDAHNYYDF

SEQ ID NO: 32089 - protein, 9 aa, Homo sapiens
  light chain complementarity determining region 3 for antibody 16045
QQDNSFPWT

SEQ ID NO: 32090 - protein, 14 aa, Homo sapiens
  heavy chain complementarity determining region 3 for antibody 16045
ARLNKMTRIRYFDS

SEQ ID NO: 32091 - protein, 8 aa, Homo sapiens
  light chain complementarity determining region 3 for antibody 16046
QQDNNWPS

SEQ ID NO: 32092 - protein, 12 aa, Homo sapiens
  heavy chain complementarity determining region 3 for antibody 16046
VQGNGAGSYSRH

SEQ ID NO: 32093 - protein, 9 aa, Homo sapiens
  light chain complementarity determining region 3 for antibody 16047
QQDNNWPRS

SEQ ID NO: 32094 - protein, 15 aa, Homo sapiens
  heavy chain complementarity determining region 3 for antibody 16047
VKSGTYSSSSGWFDT

SEQ ID NO: 32095 - protein, 9 aa, Homo sapiens
  light chain complementarity determining region 3 for antibody 16048
QQDGSSPYT

SEQ ID NO: 32096 - protein, 13 aa, Homo sapiens
  heavy chain complementarity determining region 3 for antibody 16048
ARGSTYGSGTYTS

SEQ ID NO: 32097 - protein, 9 aa, Homo sapiens
  light chain complementarity determining region 3 for antibody 16049
QQDGSSPRT

SEQ ID NO: 32098 - protein, 16 aa, Homo sapiens
  heavy chain complementarity determining region 3 for antibody 16049
ATTTGYSNYYYYGMDV

SEQ ID NO: 32099 - protein, 9 aa, Homo sapiens
  light chain complementarity determining region 3 for antibody 16050
QQDGSSPPT

SEQ ID NO: 32100 - protein, 12 aa, Homo sapiens
  heavy chain complementarity determining region 3 for antibody 16050
ASGFLEWSLYEY

SEQ ID NO: 32101 - protein, 10 aa, Homo sapiens
  light chain complementarity determining region 3 for antibody 16051
QQDGSSPPIT

SEQ ID NO: 32102 - protein, 12 aa, Homo sapiens
  heavy chain complementarity determining region 3 for antibody 16051
AVELGYGDIPIA

SEQ ID NO: 32103 - protein, 9 aa, Homo sapiens
  light chain complementarity determining region 3 for antibody 16052
QQDGSSPIT

SEQ ID NO: 32104 - protein, 6 aa, Homo sapiens
  heavy chain complementarity determining region 3 for antibody 16052
AITILG

SEQ ID NO: 32105 - protein, 10 aa, Homo sapiens
  light chain complementarity determining region 3 for antibody 16053
QQDGRSPRYI

SEQ ID NO: 32106 - protein, 12 aa, Homo sapiens
  heavy chain complementarity determining region 3 for antibody 16053
TRDLGSRYGMDV

SEQ ID NO: 32107 - protein, 9 aa, Homo sapiens
  light chain complementarity determining region 3 for antibody 16054
QQDGGLPIT

SEQ ID NO: 32108 - protein, 17 aa, Homo sapiens
  heavy chain complementarity determining region 3 for antibody 16054
ARVDGYILTGYPYHSDY

SEQ ID NO: 32109 - protein, 10 aa, Homo sapiens
  light chain complementarity determining region 3 for antibody 16055
QQDFNWPLIT

SEQ ID NO: 32110 - protein, 15 aa, Homo sapiens
  heavy chain complementarity determining region 3 for antibody 16055
ASMFEFDSGTYYSNY

SEQ ID NO: 32111 - protein, 9 aa, Homo sapiens
  light chain complementarity determining region 3 for antibody 16056
QQDDTFPIT

SEQ ID NO: 32112 - protein, 16 aa, Homo sapiens
  heavy chain complementarity determining region 3 for antibody 16056
ARGWRQVASGWLYFDY

SEQ ID NO: 32113 - protein, 9 aa, Homo sapiens
  light chain complementarity determining region 3 for antibody 16057
QQDDSSPWT

SEQ ID NO: 32114 - protein, 17 aa, Homo sapiens
  heavy chain complementarity determining region 3 for antibody 16057
ARGVYGAYLGYYFGMDV

SEQ ID NO: 32115 - protein, 11 aa, Homo sapiens
  light chain complementarity determining region 3 for antibody 16058
QQDDNSSPGYT

SEQ ID NO: 32116 - protein, 16 aa, Homo sapiens
  heavy chain complementarity determining region 3 for antibody 16058
AHRFYYGTNGSVAFDI

SEQ ID NO: 32117 - protein, 10 aa, Homo sapiens
  light chain complementarity determining region 3 for antibody 16059
QQDDNLPSVT

SEQ ID NO: 32118 - protein, 11 aa, Homo sapiens
  heavy chain complementarity determining region 3 for antibody 16059
AKSGGFWSFDY

SEQ ID NO: 32119 - protein, 9 aa, Homo sapiens
  light chain complementarity determining region 3 for antibody 16060
QQCYSTPLT

SEQ ID NO: 32120 - protein, 14 aa, Homo sapiens
  heavy chain complementarity determining region 3 for antibody 16060
AKDRNNNWWGGIDY

SEQ ID NO: 32121 - protein, 11 aa, Homo sapiens
  light chain complementarity determining region 3 for antibody 16061
QQCYSSPPENT

SEQ ID NO: 32122 - protein, 16 aa, Homo sapiens
  heavy chain complementarity determining region 3 for antibody 16061
AREAGEDYYYKGIFDI

SEQ ID NO: 32123 - protein, 11 aa, Homo sapiens
  light chain complementarity determining region 3 for antibody 16062
QQCYSSPPENP

SEQ ID NO: 32124 - protein, 16 aa, Homo sapiens
  heavy chain complementarity determining region 3 for antibody 16062
AREAGEDYYYKDIFDI

SEQ ID NO: 32125 - protein, 9 aa, Homo sapiens
  light chain complementarity determining region 3 for antibody 16063
QQCSYWPPT

SEQ ID NO: 32126 - protein, 15 aa, Homo sapiens
  heavy chain complementarity determining region 3 for antibody 16063
AHYRNGWYSEPIYDY

SEQ ID NO: 32127 - protein, 9 aa, Homo sapiens
  light chain complementarity determining region 3 for antibody 16064
QQCSSLPLT

SEQ ID NO: 32128 - protein, 16 aa, Homo sapiens
  heavy chain complementarity determining region 3 for antibody 16064
ARWGKTPTTMADAFDI

SEQ ID NO: 32129 - protein, 11 aa, Homo sapiens
  light chain complementarity determining region 3 for antibody 16065
QQCSNWPPSVT

SEQ ID NO: 32130 - protein, 16 aa, Homo sapiens
  heavy chain complementarity determining region 3 for antibody 16065
ARGALVVLVDLNAFDI

SEQ ID NO: 32131 - protein, 9 aa, Homo sapiens
  light chain complementarity determining region 3 for antibody 16066
QQCNTYPWT

SEQ ID NO: 32132 - protein, 11 aa, Homo sapiens
  heavy chain complementarity determining region 3 for antibody 16066
PTGVYSSGWLP

SEQ ID NO: 32133 - protein, 11 aa, Homo sapiens
  light chain complementarity determining region 3 for antibody 16067
QQCNNWPPDYT

SEQ ID NO: 32134 - protein, 17 aa, Homo sapiens
  heavy chain complementarity determining region 3 for antibody 16067
AKDPASVVGLPRGYFDY

SEQ ID NO: 32135 - protein, 9 aa, Homo sapiens
  light chain complementarity determining region 3 for antibody 16068
QQCKTYPYT

SEQ ID NO: 32136 - protein, 17 aa, Homo sapiens
  heavy chain complementarity determining region 3 for antibody 16068
AREDWNDVDLREYYFDY

SEQ ID NO: 32137 - protein, 9 aa, Homo sapiens
  light chain complementarity determining region 3 for antibody 16069
QQCGTSPLT

SEQ ID NO: 32138 - protein, 16 aa, Homo sapiens
  heavy chain complementarity determining region 3 for antibody 16069
ARWGAVPESRKNCFDY

SEQ ID NO: 32139 - protein, 9 aa, Homo sapiens
  light chain complementarity determining region 3 for antibody 16070
QQCFSDPLT

SEQ ID NO: 32140 - protein, 13 aa, Homo sapiens
  heavy chain complementarity determining region 3 for antibody 16070
ARGRSDASDALDV

SEQ ID NO: 32141 - protein, 8 aa, Homo sapiens
  light chain complementarity determining region 3 for antibody 16071
QQCENLPP

SEQ ID NO: 32142 - protein, 18 aa, Homo sapiens
  heavy chain complementarity determining region 3 for antibody 16071
ARDNVHMATTWGDDAFDT

SEQ ID NO: 32143 - protein, 9 aa, Homo sapiens
  light chain complementarity determining region 3 for antibody 16072
QQCDSFPYT

SEQ ID NO: 32144 - protein, 17 aa, Homo sapiens
  heavy chain complementarity determining region 3 for antibody 16072
AREDWSDVDLRAFYFDS

SEQ ID NO: 32145 - protein, 9 aa, Homo sapiens
  light chain complementarity determining region 3 for antibody 16073
QQCDHFSIT

SEQ ID NO: 32146 - protein, 15 aa, Homo sapiens
  heavy chain complementarity determining region 3 for antibody 16073
ARDPTAAGFPAHFDY

SEQ ID NO: 32147 - protein, 9 aa, Homo sapiens
  light chain complementarity determining region 3 for antibody 16074
QQAYSFPWT

SEQ ID NO: 32148 - protein, 14 aa, Homo sapiens
  heavy chain complementarity determining region 3 for antibody 16074
ARLNKMTRIRYFDS

SEQ ID NO: 32149 - protein, 9 aa, Homo sapiens
  light chain complementarity determining region 3 for antibody 16075
QQAYSFPHT

SEQ ID NO: 32150 - protein, 17 aa, Homo sapiens
  heavy chain complementarity determining region 3 for antibody 16075
AKDLDTPMEYYFYGMDV

SEQ ID NO: 32151 - protein, 9 aa, Homo sapiens
  light chain complementarity determining region 3 for antibody 16076
QQAYSFPHT

SEQ ID NO: 32152 - protein, 17 aa, Homo sapiens
  heavy chain complementarity determining region 3 for antibody 16076
AKDLDTPMDYYFYGIDV

SEQ ID NO: 32153 - protein, 9 aa, Homo sapiens
  light chain complementarity determining region 3 for antibody 16077
QQAYRIPLT

SEQ ID NO: 32154 - protein, 13 aa, Homo sapiens
  heavy chain complementarity determining region 3 for antibody 16077
VRTYGSGRNWFDP

SEQ ID NO: 32155 - protein, 9 aa, Homo sapiens
  light chain complementarity determining region 3 for antibody 16078
QQAYRFPLT

SEQ ID NO: 32156 - protein, 13 aa, Homo sapiens
  heavy chain complementarity determining region 3 for antibody 16078
VRTYGAGRNWFDT

SEQ ID NO: 32157 - protein, 9 aa, Homo sapiens
  light chain complementarity determining region 3 for antibody 16079
QQAYRFPLT

SEQ ID NO: 32158 - protein, 13 aa, Homo sapiens
  heavy chain complementarity determining region 3 for antibody 16079
VRAYGSGRNWFDP

SEQ ID NO: 32159 - protein, 9 aa, Homo sapiens
  light chain complementarity determining region 3 for antibody 16080
QQAYRFPLT

SEQ ID NO: 32160 - protein, 13 aa, Homo sapiens
  heavy chain complementarity determining region 3 for antibody 16080
ARTYSSGRNWFDL

SEQ ID NO: 32161 - protein, 9 aa, Homo sapiens
  light chain complementarity determining region 3 for antibody 16081
QQAYRFPLS

SEQ ID NO: 32162 - protein, 13 aa, Homo sapiens
  heavy chain complementarity determining region 3 for antibody 16081
TRTYGSRRNWFDP

SEQ ID NO: 32163 - protein, 9 aa, Homo sapiens
  light chain complementarity determining region 3 for antibody 16082
QQAYRFPLS

SEQ ID NO: 32164 - protein, 13 aa, Homo sapiens
  heavy chain complementarity determining region 3 for antibody 16082
TRTYGSGSNWFDP

SEQ ID NO: 32165 - protein, 9 aa, Homo sapiens
  light chain complementarity determining region 3 for antibody 16083
QQAYRFPLS

SEQ ID NO: 32166 - protein, 13 aa, Homo sapiens
  heavy chain complementarity determining region 3 for antibody 16083
TRTYGSGRNWFNP

SEQ ID NO: 32167 - protein, 9 aa, Homo sapiens
  light chain complementarity determining region 3 for antibody 16084
QQAYRFPLS

SEQ ID NO: 32168 - protein, 13 aa, Homo sapiens
  heavy chain complementarity determining region 3 for antibody 16084
TRTYGSGRNWFEP

SEQ ID NO: 32169 - protein, 9 aa, Homo sapiens
  light chain complementarity determining region 3 for antibody 16085
QQAYRFPLS

SEQ ID NO: 32170 - protein, 13 aa, Homo sapiens
  heavy chain complementarity determining region 3 for antibody 16085
TRTYGSGRNWFDT

SEQ ID NO: 32171 - protein, 9 aa, Homo sapiens
  light chain complementarity determining region 3 for antibody 16086
QQAYRFPLS

SEQ ID NO: 32172 - protein, 13 aa, Homo sapiens
  heavy chain complementarity determining region 3 for antibody 16086
TRTYGSGRNWFDA

SEQ ID NO: 32173 - protein, 9 aa, Homo sapiens
  light chain complementarity determining region 3 for antibody 16087
QQAYRFPLS

SEQ ID NO: 32174 - protein, 13 aa, Homo sapiens
  heavy chain complementarity determining region 3 for antibody 16087
TRTYGSGRNWCDP

SEQ ID NO: 32175 - protein, 9 aa, Homo sapiens
  light chain complementarity determining region 3 for antibody 16088
QQAYRFPLS

SEQ ID NO: 32176 - protein, 13 aa, Homo sapiens
  heavy chain complementarity determining region 3 for antibody 16088
TRTYGSGRHWFDP

SEQ ID NO: 32177 - protein, 9 aa, Homo sapiens
  light chain complementarity determining region 3 for antibody 16089
QQAYRFPLS

SEQ ID NO: 32178 - protein, 13 aa, Homo sapiens
  heavy chain complementarity determining region 3 for antibody 16089
TRTHGSGRNWFDP

SEQ ID NO: 32179 - protein, 9 aa, Homo sapiens
  light chain complementarity determining region 3 for antibody 16090
QQAYRFPLS

SEQ ID NO: 32180 - protein, 13 aa, Homo sapiens
  heavy chain complementarity determining region 3 for antibody 16090
TRSYGSGRNWFDP

SEQ ID NO: 32181 - protein, 9 aa, Homo sapiens
  light chain complementarity determining region 3 for antibody 16091
QQAYRFPLS

SEQ ID NO: 32182 - protein, 13 aa, Homo sapiens
  heavy chain complementarity determining region 3 for antibody 16091
TRIYGSGRNWFDP

SEQ ID NO: 32183 - protein, 9 aa, Homo sapiens
  light chain complementarity determining region 3 for antibody 16092
QQAYRFPLS

SEQ ID NO: 32184 - protein, 13 aa, Homo sapiens
  heavy chain complementarity determining region 3 for antibody 16092
TKTYGSGRNWFDP

SEQ ID NO: 32185 - protein, 9 aa, Homo sapiens
  light chain complementarity determining region 3 for antibody 16093
QQAYRFPLS

SEQ ID NO: 32186 - protein, 7 aa, Homo sapiens
  heavy chain complementarity determining region 3 for antibody 16093
GRNWFDP

SEQ ID NO: 32187 - protein, 9 aa, Homo sapiens
  light chain complementarity determining region 3 for antibody 16094
QQAYRFPLS

SEQ ID NO: 32188 - protein, 13 aa, Homo sapiens
  heavy chain complementarity determining region 3 for antibody 16094
ASGLHSGYDYFDY

SEQ ID NO: 32189 - protein, 9 aa, Homo sapiens
  light chain complementarity determining region 3 for antibody 16095
QQAYRFPLS

SEQ ID NO: 32190 - protein, 19 aa, Homo sapiens
  heavy chain complementarity determining region 3 for antibody 16095
ARSDYSGDTDRYYDYGMDV

SEQ ID NO: 32191 - protein, 9 aa, Homo sapiens
  light chain complementarity determining region 3 for antibody 16096
QQAYRFPLS

SEQ ID NO: 32192 - protein, 22 aa, Homo sapiens
  heavy chain complementarity determining region 3 for antibody 16096
ARHSGYSNTWYMNYYYYYGMDV

SEQ ID NO: 32193 - protein, 9 aa, Homo sapiens
  light chain complementarity determining region 3 for antibody 16097
QQAYRFPLS

SEQ ID NO: 32194 - protein, 15 aa, Homo sapiens
  heavy chain complementarity determining region 3 for antibody 16097
ARGGAVRPRYYGMDV

SEQ ID NO: 32195 - protein, 9 aa, Homo sapiens
  light chain complementarity determining region 3 for antibody 16098
QQAYRFPLS

SEQ ID NO: 32196 - protein, 19 aa, Homo sapiens
  heavy chain complementarity determining region 3 for antibody 16098
ARDSPSVRKRPTEYYGMDV

SEQ ID NO: 32197 - protein, 9 aa, Homo sapiens
  light chain complementarity determining region 3 for antibody 16099
QQAYRFPHT

SEQ ID NO: 32198 - protein, 17 aa, Homo sapiens
  heavy chain complementarity determining region 3 for antibody 16099
AKDLDTPMDYYFYGMDV

SEQ ID NO: 32199 - protein, 9 aa, Homo sapiens
  light chain complementarity determining region 3 for antibody 16100
QQATSFPWT

SEQ ID NO: 32200 - protein, 14 aa, Homo sapiens
  heavy chain complementarity determining region 3 for antibody 16100
ARLNKMTRIRYFDS

SEQ ID NO: 32201 - protein, 10 aa, Homo sapiens
  light chain complementarity determining region 3 for antibody 16101
QQATSFPPIP

SEQ ID NO: 32202 - protein, 21 aa, Homo sapiens
  heavy chain complementarity determining region 3 for antibody 16101
ARGLTDEGYKSGYGCYYGLDV

SEQ ID NO: 32203 - protein, 9 aa, Homo sapiens
  light chain complementarity determining region 3 for antibody 16102
QQATSFPLT

SEQ ID NO: 32204 - protein, 25 aa, Homo sapiens
  heavy chain complementarity determining region 3 for antibody 16102
AKDQLGNIVGSTTPFLRYYYYGMDV

SEQ ID NO: 32205 - protein, 9 aa, Homo sapiens
  light chain complementarity determining region 3 for antibody 16103
QQATIFPLT

SEQ ID NO: 32206 - protein, 25 aa, Homo sapiens
  heavy chain complementarity determining region 3 for antibody 16103
ARDHLGNTVGSTTSFLRYYYYGMDV

SEQ ID NO: 32207 - protein, 9 aa, Homo sapiens
  light chain complementarity determining region 3 for antibody 16104
QQASSFPLT

SEQ ID NO: 32208 - protein, 19 aa, Homo sapiens
  heavy chain complementarity determining region 3 for antibody 16104
ATFRLTAFDSYFHYYGIDV

SEQ ID NO: 32209 - protein, 9 aa, Homo sapiens
  light chain complementarity determining region 3 for antibody 16105
QQASNWPLT

SEQ ID NO: 32210 - protein, 17 aa, Homo sapiens
  heavy chain complementarity determining region 3 for antibody 16105
ARYCSSDSCYTNGGVDV

SEQ ID NO: 32211 - protein, 8 aa, Homo sapiens
  light chain complementarity determining region 3 for antibody 16106
QQARSFPP

SEQ ID NO: 32212 - protein, 22 aa, Homo sapiens
  heavy chain complementarity determining region 3 for antibody 16106
ARHSGYSNTWYMNYYYYYGMDV

SEQ ID NO: 32213 - protein, 9 aa, Homo sapiens
  light chain complementarity determining region 3 for antibody 16107
QQANTLPFT

SEQ ID NO: 32214 - protein, 19 aa, Homo sapiens
  heavy chain complementarity determining region 3 for antibody 16107
ARNGYSGDTDRYYDFGMDV

SEQ ID NO: 32215 - protein, 9 aa, Homo sapiens
  light chain complementarity determining region 3 for antibody 16108
QQANTLPFT

SEQ ID NO: 32216 - protein, 19 aa, Homo sapiens
  heavy chain complementarity determining region 3 for antibody 16108
ARNDYSGDTDRYYDVGMDV

SEQ ID NO: 32217 - protein, 9 aa, Homo sapiens
  light chain complementarity determining region 3 for antibody 16109
QQANTFPPT

SEQ ID NO: 32218 - protein, 17 aa, Homo sapiens
  heavy chain complementarity determining region 3 for antibody 16109
AMVRYTCGGDCYYKFDY

SEQ ID NO: 32219 - protein, 9 aa, Homo sapiens
  light chain complementarity determining region 3 for antibody 16110
QQANTFPHT

SEQ ID NO: 32220 - protein, 13 aa, Homo sapiens
  heavy chain complementarity determining region 3 for antibody 16110
ARGRRFENQFFDY

SEQ ID NO: 32221 - protein, 9 aa, Homo sapiens
  light chain complementarity determining region 3 for antibody 16111
QQANSLPST

SEQ ID NO: 32222 - protein, 19 aa, Homo sapiens
  heavy chain complementarity determining region 3 for antibody 16111
ARNDYSGDTDRYYDFGMDV

SEQ ID NO: 32223 - protein, 9 aa, Homo sapiens
  light chain complementarity determining region 3 for antibody 16112
QQANSLPRT

SEQ ID NO: 32224 - protein, 20 aa, Homo sapiens
  heavy chain complementarity determining region 3 for antibody 16112
ARDVVYSSRIEVYYYYGMDV

SEQ ID NO: 32225 - protein, 9 aa, Homo sapiens
  light chain complementarity determining region 3 for antibody 16113
QQANSLPRT

SEQ ID NO: 32226 - protein, 14 aa, Homo sapiens
  heavy chain complementarity determining region 3 for antibody 16113
ARDRSVTYGKYFGH

SEQ ID NO: 32227 - protein, 9 aa, Homo sapiens
  light chain complementarity determining region 3 for antibody 16114
QQANSLPHT

SEQ ID NO: 32228 - protein, 14 aa, Homo sapiens
  heavy chain complementarity determining region 3 for antibody 16114
ARDRSVTYGKYFDH

SEQ ID NO: 32229 - protein, 9 aa, Homo sapiens
  light chain complementarity determining region 3 for antibody 16115
QQANSLPHT

SEQ ID NO: 32230 - protein, 14 aa, Homo sapiens
  heavy chain complementarity determining region 3 for antibody 16115
ARDRSVTYGKHFGH

SEQ ID NO: 32231 - protein, 9 aa, Homo sapiens
  light chain complementarity determining region 3 for antibody 16116
QQANSLPHT

SEQ ID NO: 32232 - protein, 14 aa, Homo sapiens
  heavy chain complementarity determining region 3 for antibody 16116
ARDRSVTYGKDFGH

SEQ ID NO: 32233 - protein, 9 aa, Homo sapiens
  light chain complementarity determining region 3 for antibody 16117
QQANSLPHT

SEQ ID NO: 32234 - protein, 14 aa, Homo sapiens
  heavy chain complementarity determining region 3 for antibody 16117
ARDRSVTYGEYFGH

SEQ ID NO: 32235 - protein, 9 aa, Homo sapiens
  light chain complementarity determining region 3 for antibody 16118
QQANSLPHT

SEQ ID NO: 32236 - protein, 14 aa, Homo sapiens
  heavy chain complementarity determining region 3 for antibody 16118
ARDRSVNYGKYFGH

SEQ ID NO: 32237 - protein, 9 aa, Homo sapiens
  light chain complementarity determining region 3 for antibody 16119
QQANSLPHT

SEQ ID NO: 32238 - protein, 14 aa, Homo sapiens
  heavy chain complementarity determining region 3 for antibody 16119
ARDRAVTYGKYFGH

SEQ ID NO: 32239 - protein, 9 aa, Homo sapiens
  light chain complementarity determining region 3 for antibody 16120
QQANSLPHP

SEQ ID NO: 32240 - protein, 14 aa, Homo sapiens
  heavy chain complementarity determining region 3 for antibody 16120
ARDRSVTYGKYFGH

SEQ ID NO: 32241 - protein, 9 aa, Homo sapiens
  light chain complementarity determining region 3 for antibody 16121
QQANSLPFT

SEQ ID NO: 32242 - protein, 19 aa, Homo sapiens
  heavy chain complementarity determining region 3 for antibody 16121
ARTNYSGDTDRYYDYGMDV

SEQ ID NO: 32243 - protein, 9 aa, Homo sapiens
  light chain complementarity determining region 3 for antibody 16122
QQANSLPFT

SEQ ID NO: 32244 - protein, 19 aa, Homo sapiens
  heavy chain complementarity determining region 3 for antibody 16122
ARTGYSGDTDRYYDYGMDV

SEQ ID NO: 32245 - protein, 9 aa, Homo sapiens
  light chain complementarity determining region 3 for antibody 16123
QQANSLPFT

SEQ ID NO: 32246 - protein, 19 aa, Homo sapiens
  heavy chain complementarity determining region 3 for antibody 16123
ARTDCSGDTDRYYDYGMDV

SEQ ID NO: 32247 - protein, 9 aa, Homo sapiens
  light chain complementarity determining region 3 for antibody 16124
QQANSLPFT

SEQ ID NO: 32248 - protein, 19 aa, Homo sapiens
  heavy chain complementarity determining region 3 for antibody 16124
ARTDCSGDTDRYYDFGMDV

SEQ ID NO: 32249 - protein, 9 aa, Homo sapiens
  light chain complementarity determining region 3 for antibody 16125
QQANSLPFT

SEQ ID NO: 32250 - protein, 19 aa, Homo sapiens
  heavy chain complementarity determining region 3 for antibody 16125
ARNDYSGDTNRYYDFGMDV

SEQ ID NO: 32251 - protein, 9 aa, Homo sapiens
  light chain complementarity determining region 3 for antibody 16126
QQANSLPFT

SEQ ID NO: 32252 - protein, 19 aa, Homo sapiens
  heavy chain complementarity determining region 3 for antibody 16126
ARNDYSGDTDRYYGFGMDV

SEQ ID NO: 32253 - protein, 9 aa, Homo sapiens
  light chain complementarity determining region 3 for antibody 16127
QQANSLPFT

SEQ ID NO: 32254 - protein, 19 aa, Homo sapiens
  heavy chain complementarity determining region 3 for antibody 16127
ARNDYSGDTDRYYDFGMGV

SEQ ID NO: 32255 - protein, 9 aa, Homo sapiens
  light chain complementarity determining region 3 for antibody 16128
QQANSLPFT

SEQ ID NO: 32256 - protein, 19 aa, Homo sapiens
  heavy chain complementarity determining region 3 for antibody 16128
ARNDYSGDTDRYYDFGMDA

SEQ ID NO: 32257 - protein, 9 aa, Homo sapiens
  light chain complementarity determining region 3 for antibody 16129
QQANSLPFT

SEQ ID NO: 32258 - protein, 19 aa, Homo sapiens
  heavy chain complementarity determining region 3 for antibody 16129
ARNDYSGDTDRSYDFGMDV

SEQ ID NO: 32259 - protein, 9 aa, Homo sapiens
  light chain complementarity determining region 3 for antibody 16130
QQANSLPFT

SEQ ID NO: 32260 - protein, 19 aa, Homo sapiens
  heavy chain complementarity determining region 3 for antibody 16130
ARNDYSGDTDHYYDFGMDV

SEQ ID NO: 32261 - protein, 9 aa, Homo sapiens
  light chain complementarity determining region 3 for antibody 16131
QQANSLPFT

SEQ ID NO: 32262 - protein, 19 aa, Homo sapiens
  heavy chain complementarity determining region 3 for antibody 16131
ARNDYSGDPDRYYDFGMDV

SEQ ID NO: 32263 - protein, 9 aa, Homo sapiens
  light chain complementarity determining region 3 for antibody 16132
QQANSLPFT

SEQ ID NO: 32264 - protein, 19 aa, Homo sapiens
  heavy chain complementarity determining region 3 for antibody 16132
ARNDYSGDNDRYYDFGMDV

SEQ ID NO: 32265 - protein, 9 aa, Homo sapiens
  light chain complementarity determining region 3 for antibody 16133
QQANSLPFT

SEQ ID NO: 32266 - protein, 19 aa, Homo sapiens
  heavy chain complementarity determining region 3 for antibody 16133
ARNDYSGDADRYYDFGMDV

SEQ ID NO: 32267 - protein, 9 aa, Homo sapiens
  light chain complementarity determining region 3 for antibody 16134
QQANSLPFT

SEQ ID NO: 32268 - protein, 19 aa, Homo sapiens
  heavy chain complementarity determining region 3 for antibody 16134
ARNAYSGDTDRYYDFGMDV

SEQ ID NO: 32269 - protein, 9 aa, Homo sapiens
  light chain complementarity determining region 3 for antibody 16135
QQANSLPFT

SEQ ID NO: 32270 - protein, 23 aa, Homo sapiens
  heavy chain complementarity determining region 3 for antibody 16135
ARGGYSARDLSPDIPVTYYGVDV

SEQ ID NO: 32271 - protein, 9 aa, Homo sapiens
  light chain complementarity determining region 3 for antibody 16136
QQANSLPFT

SEQ ID NO: 32272 - protein, 17 aa, Homo sapiens
  heavy chain complementarity determining region 3 for antibody 16136
AREDWNDVDLRQFYFDY

SEQ ID NO: 32273 - protein, 9 aa, Homo sapiens
  light chain complementarity determining region 3 for antibody 16137
QQANSLPFT

SEQ ID NO: 32274 - protein, 19 aa, Homo sapiens
  heavy chain complementarity determining region 3 for antibody 16137
ARADYSGGTDRYYDYGMDV

SEQ ID NO: 32275 - protein, 9 aa, Homo sapiens
  light chain complementarity determining region 3 for antibody 16138
QQANSLPFT

SEQ ID NO: 32276 - protein, 19 aa, Homo sapiens
  heavy chain complementarity determining region 3 for antibody 16138
AGNDYSGDTDRYYDFGMDV

SEQ ID NO: 32277 - protein, 9 aa, Homo sapiens
  light chain complementarity determining region 3 for antibody 16139
QQANSLPFP

SEQ ID NO: 32278 - protein, 19 aa, Homo sapiens
  heavy chain complementarity determining region 3 for antibody 16139
ARNDYSGDTDRYYDFGMDV

SEQ ID NO: 32279 - protein, 9 aa, Homo sapiens
  light chain complementarity determining region 3 for antibody 16140
QQANSIPFT

SEQ ID NO: 32280 - protein, 19 aa, Homo sapiens
  heavy chain complementarity determining region 3 for antibody 16140
ARTDYSGDTDRYYDYGMDV

SEQ ID NO: 32281 - protein, 9 aa, Homo sapiens
  light chain complementarity determining region 3 for antibody 16141
QQANSFQWT

SEQ ID NO: 32282 - protein, 14 aa, Homo sapiens
  heavy chain complementarity determining region 3 for antibody 16141
ARLNKMTRIRYFDS

SEQ ID NO: 32283 - protein, 9 aa, Homo sapiens
  light chain complementarity determining region 3 for antibody 16142
QQANSFPYT

SEQ ID NO: 32284 - protein, 13 aa, Homo sapiens
  heavy chain complementarity determining region 3 for antibody 16142
TRTYGSGRNWFDP

SEQ ID NO: 32285 - protein, 9 aa, Homo sapiens
  light chain complementarity determining region 3 for antibody 16143
QQANSFPYT

SEQ ID NO: 32286 - protein, 19 aa, Homo sapiens
  heavy chain complementarity determining region 3 for antibody 16143
ASGYSYSYSGRFNDYGMDV

SEQ ID NO: 32287 - protein, 9 aa, Homo sapiens
  light chain complementarity determining region 3 for antibody 16144
QQANSFPYT

SEQ ID NO: 32288 - protein, 19 aa, Homo sapiens
  heavy chain complementarity determining region 3 for antibody 16144
ASGYSYGYSGRLNDYGMDV

SEQ ID NO: 32289 - protein, 9 aa, Homo sapiens
  light chain complementarity determining region 3 for antibody 16145
QQANSFPYT

SEQ ID NO: 32290 - protein, 19 aa, Homo sapiens
  heavy chain complementarity determining region 3 for antibody 16145
ASGYSYGYSGRFNDCGMDV

SEQ ID NO: 32291 - protein, 9 aa, Homo sapiens
  light chain complementarity determining region 3 for antibody 16146
QQANSFPYT

SEQ ID NO: 32292 - protein, 19 aa, Homo sapiens
  heavy chain complementarity determining region 3 for antibody 16146
ASGYSYGYPGRFNDYGMDV

SEQ ID NO: 32293 - protein, 9 aa, Homo sapiens
  light chain complementarity determining region 3 for antibody 16147
QQANSFPYT

SEQ ID NO: 32294 - protein, 19 aa, Homo sapiens
  heavy chain complementarity determining region 3 for antibody 16147
ASGYSYGDSGRFNDYGMDV

SEQ ID NO: 32295 - protein, 9 aa, Homo sapiens
  light chain complementarity determining region 3 for antibody 16148
QQANSFPYT

SEQ ID NO: 32296 - protein, 22 aa, Homo sapiens
  heavy chain complementarity determining region 3 for antibody 16148
ARDRVGEAAAGTRYYHYYSMDV

SEQ ID NO: 32297 - protein, 9 aa, Homo sapiens
  light chain complementarity determining region 3 for antibody 16149
QQANSFPYT

SEQ ID NO: 32298 - protein, 22 aa, Homo sapiens
  heavy chain complementarity determining region 3 for antibody 16149
ARDRVGEAAAGTRYYHYHGMDV

SEQ ID NO: 32299 - protein, 9 aa, Homo sapiens
  light chain complementarity determining region 3 for antibody 16150
QQANSFPYT

SEQ ID NO: 32300 - protein, 22 aa, Homo sapiens
  heavy chain complementarity determining region 3 for antibody 16150
ARDRVGEAAAGTRYHHYYGMDV

SEQ ID NO: 32301 - protein, 9 aa, Homo sapiens
  light chain complementarity determining region 3 for antibody 16151
QQANSFPYT

SEQ ID NO: 32302 - protein, 22 aa, Homo sapiens
  heavy chain complementarity determining region 3 for antibody 16151
ARDRVGEAAAGTRYCHYYGMDV

SEQ ID NO: 32303 - protein, 9 aa, Homo sapiens
  light chain complementarity determining region 3 for antibody 16152
QQANSFPYT

SEQ ID NO: 32304 - protein, 22 aa, Homo sapiens
  heavy chain complementarity determining region 3 for antibody 16152
ARDRVGEAAAGTRCYHYYGMDV

SEQ ID NO: 32305 - protein, 9 aa, Homo sapiens
  light chain complementarity determining region 3 for antibody 16153
QQANSFPYT

SEQ ID NO: 32306 - protein, 22 aa, Homo sapiens
  heavy chain complementarity determining region 3 for antibody 16153
ARDRVGEAAAGARYYHYYGMDV

SEQ ID NO: 32307 - protein, 9 aa, Homo sapiens
  light chain complementarity determining region 3 for antibody 16154
QQANSFPYN

SEQ ID NO: 32308 - protein, 22 aa, Homo sapiens
  heavy chain complementarity determining region 3 for antibody 16154
ARDRVGEAAAGTRYYHYYGMDV

SEQ ID NO: 32309 - protein, 9 aa, Homo sapiens
  light chain complementarity determining region 3 for antibody 16155
QQANSFPWT

SEQ ID NO: 32310 - protein, 14 aa, Homo sapiens
  heavy chain complementarity determining region 3 for antibody 16155
ARPNKMTRIRYFDS

SEQ ID NO: 32311 - protein, 9 aa, Homo sapiens
  light chain complementarity determining region 3 for antibody 16156
QQANSFPWT

SEQ ID NO: 32312 - protein, 14 aa, Homo sapiens
  heavy chain complementarity determining region 3 for antibody 16156
ARLNKVTRIRYFDS

SEQ ID NO: 32313 - protein, 9 aa, Homo sapiens
  light chain complementarity determining region 3 for antibody 16157
QQANSFPWT

SEQ ID NO: 32314 - protein, 14 aa, Homo sapiens
  heavy chain complementarity determining region 3 for antibody 16157
ARLNKMTRVRYFDS

SEQ ID NO: 32315 - protein, 9 aa, Homo sapiens
  light chain complementarity determining region 3 for antibody 16158
QQANSFPWT

SEQ ID NO: 32316 - protein, 14 aa, Homo sapiens
  heavy chain complementarity determining region 3 for antibody 16158
ARLNKMTRSRYFDS

SEQ ID NO: 32317 - protein, 9 aa, Homo sapiens
  light chain complementarity determining region 3 for antibody 16159
QQANSFPWT

SEQ ID NO: 32318 - protein, 14 aa, Homo sapiens
  heavy chain complementarity determining region 3 for antibody 16159
ARLNKMTRIRYLDS

SEQ ID NO: 32319 - protein, 9 aa, Homo sapiens
  light chain complementarity determining region 3 for antibody 16160
QQANSFPWT

SEQ ID NO: 32320 - protein, 14 aa, Homo sapiens
  heavy chain complementarity determining region 3 for antibody 16160
ARLNKMTRIRYFDY

SEQ ID NO: 32321 - protein, 9 aa, Homo sapiens
  light chain complementarity determining region 3 for antibody 16161
QQANSFPWT

SEQ ID NO: 32322 - protein, 14 aa, Homo sapiens
  heavy chain complementarity determining region 3 for antibody 16161
ARLNKMTRIRYFDA

SEQ ID NO: 32323 - protein, 9 aa, Homo sapiens
  light chain complementarity determining region 3 for antibody 16162
QQANSFPWT

SEQ ID NO: 32324 - protein, 14 aa, Homo sapiens
  heavy chain complementarity determining region 3 for antibody 16162
ARLKKMTRIRYFDS

SEQ ID NO: 32325 - protein, 9 aa, Homo sapiens
  light chain complementarity determining region 3 for antibody 16163
QQANSFPWT

SEQ ID NO: 32326 - protein, 14 aa, Homo sapiens
  heavy chain complementarity determining region 3 for antibody 16163
AKLNKMTRIRYFDS

SEQ ID NO: 32327 - protein, 9 aa, Homo sapiens
  light chain complementarity determining region 3 for antibody 16164
QQANSFPWT

SEQ ID NO: 32328 - protein, 17 aa, Homo sapiens
  heavy chain complementarity determining region 3 for antibody 16164
AKDLSGVHYDIHHGLDV

SEQ ID NO: 32329 - protein, 9 aa, Homo sapiens
  light chain complementarity determining region 3 for antibody 16165
QQANSFPWT

SEQ ID NO: 32330 - protein, 14 aa, Homo sapiens
  heavy chain complementarity determining region 3 for antibody 16165
AGLNKMTRIRYFDS

SEQ ID NO: 32331 - protein, 9 aa, Homo sapiens
  light chain complementarity determining region 3 for antibody 16166
QQANSFPWP

SEQ ID NO: 32332 - protein, 14 aa, Homo sapiens
  heavy chain complementarity determining region 3 for antibody 16166
ARLNKMTRIRYFDS

SEQ ID NO: 32333 - protein, 9 aa, Homo sapiens
  light chain complementarity determining region 3 for antibody 16167
QQANSFPVT

SEQ ID NO: 32334 - protein, 25 aa, Homo sapiens
  heavy chain complementarity determining region 3 for antibody 16167
TTDSLINDDIMPGYPNYYYYYGMDV

SEQ ID NO: 32335 - protein, 9 aa, Homo sapiens
  light chain complementarity determining region 3 for antibody 16168
QQANSFPRT

SEQ ID NO: 32336 - protein, 20 aa, Homo sapiens
  heavy chain complementarity determining region 3 for antibody 16168
ARVVVYSSRIEVYYYYGMDV

SEQ ID NO: 32337 - protein, 9 aa, Homo sapiens
  light chain complementarity determining region 3 for antibody 16169
QQANSFPRT

SEQ ID NO: 32338 - protein, 20 aa, Homo sapiens
  heavy chain complementarity determining region 3 for antibody 16169
ARDVVYSSRIEVYYYYGMDD

SEQ ID NO: 32339 - protein, 9 aa, Homo sapiens
  light chain complementarity determining region 3 for antibody 16170
QQANSFPRT

SEQ ID NO: 32340 - protein, 19 aa, Homo sapiens
  heavy chain complementarity determining region 3 for antibody 16170
ARDVVYSSRIEVYYYGMDV

SEQ ID NO: 32341 - protein, 9 aa, Homo sapiens
  light chain complementarity determining region 3 for antibody 16171
QQANSFPRT

SEQ ID NO: 32342 - protein, 18 aa, Homo sapiens
  heavy chain complementarity determining region 3 for antibody 16171
ARDVGYDSNAHYHWYFDL

SEQ ID NO: 32343 - protein, 8 aa, Homo sapiens
  light chain complementarity determining region 3 for antibody 16172
QQANSFPP

SEQ ID NO: 32344 - protein, 22 aa, Homo sapiens
  heavy chain complementarity determining region 3 for antibody 16172
ARHSGYSNTWYMNYYYYYGMDV

SEQ ID NO: 32345 - protein, 9 aa, Homo sapiens
  light chain complementarity determining region 3 for antibody 16173
QQANSFPLT

SEQ ID NO: 32346 - protein, 7 aa, Homo sapiens
  heavy chain complementarity determining region 3 for antibody 16173
ASYYLDH

SEQ ID NO: 32347 - protein, 9 aa, Homo sapiens
  light chain complementarity determining region 3 for antibody 16174
QQANSFPLT

SEQ ID NO: 32348 - protein, 17 aa, Homo sapiens
  heavy chain complementarity determining region 3 for antibody 16174
AREQLQLPNYYYYGMGV

SEQ ID NO: 32349 - protein, 9 aa, Homo sapiens
  light chain complementarity determining region 3 for antibody 16175
QQANSFPLT

SEQ ID NO: 32350 - protein, 14 aa, Homo sapiens
  heavy chain complementarity determining region 3 for antibody 16175
ARDVWGSRYYGMDV

SEQ ID NO: 32351 - protein, 9 aa, Homo sapiens
  light chain complementarity determining region 3 for antibody 16176
QQANSFPLT

SEQ ID NO: 32352 - protein, 16 aa, Homo sapiens
  heavy chain complementarity determining region 3 for antibody 16176
ARDQLQLPNYYYGMGV

SEQ ID NO: 32353 - protein, 9 aa, Homo sapiens
  light chain complementarity determining region 3 for antibody 16177
QQANSFPLT

SEQ ID NO: 32354 - protein, 17 aa, Homo sapiens
  heavy chain complementarity determining region 3 for antibody 16177
ARDQLQLPNYYSYGMGV

SEQ ID NO: 32355 - protein, 9 aa, Homo sapiens
  light chain complementarity determining region 3 for antibody 16178
QQANSFPLT

SEQ ID NO: 32356 - protein, 17 aa, Homo sapiens
  heavy chain complementarity determining region 3 for antibody 16178
ARDQLQLPNYCYYGMGV

SEQ ID NO: 32357 - protein, 9 aa, Homo sapiens
  light chain complementarity determining region 3 for antibody 16179
QQANSFPLT

SEQ ID NO: 32358 - protein, 19 aa, Homo sapiens
  heavy chain complementarity determining region 3 for antibody 16179
ANFWLTSYDSYYYYYGMDV

SEQ ID NO: 32359 - protein, 9 aa, Homo sapiens
  light chain complementarity determining region 3 for antibody 16180
QQANSFPLT

SEQ ID NO: 32360 - protein, 19 aa, Homo sapiens
  heavy chain complementarity determining region 3 for antibody 16180
ANFRLTSYDSYYYCYGMDV

SEQ ID NO: 32361 - protein, 9 aa, Homo sapiens
  light chain complementarity determining region 3 for antibody 16181
QQANSFPLP

SEQ ID NO: 32362 - protein, 21 aa, Homo sapiens
  heavy chain complementarity determining region 3 for antibody 16181
VRDRSFGSGSYEYYYYYGMDA

SEQ ID NO: 32363 - protein, 9 aa, Homo sapiens
  light chain complementarity determining region 3 for antibody 16182
QQANSFPLP

SEQ ID NO: 32364 - protein, 17 aa, Homo sapiens
  heavy chain complementarity determining region 3 for antibody 16182
ARDQLQLPNYYYYGMGV

SEQ ID NO: 32365 - protein, 9 aa, Homo sapiens
  light chain complementarity determining region 3 for antibody 16183
QQANSFPIT

SEQ ID NO: 32366 - protein, 19 aa, Homo sapiens
  heavy chain complementarity determining region 3 for antibody 16183
ATDRYCSRPNCPQGNWFDP

SEQ ID NO: 32367 - protein, 9 aa, Homo sapiens
  light chain complementarity determining region 3 for antibody 16184
QQANSFPIT

SEQ ID NO: 32368 - protein, 20 aa, Homo sapiens
  heavy chain complementarity determining region 3 for antibody 16184
ARDRSYGSGSYEYYYYGMDV

SEQ ID NO: 32369 - protein, 9 aa, Homo sapiens
  light chain complementarity determining region 3 for antibody 16185
QQANSFPIT

SEQ ID NO: 32370 - protein, 21 aa, Homo sapiens
  heavy chain complementarity determining region 3 for antibody 16185
ARDRSYGSGSYEYYYYCGMDV

SEQ ID NO: 32371 - protein, 9 aa, Homo sapiens
  light chain complementarity determining region 3 for antibody 16186
QQANSFPGT

SEQ ID NO: 32372 - protein, 14 aa, Homo sapiens
  heavy chain complementarity determining region 3 for antibody 16186
ARLNKMTRIRYFDS

SEQ ID NO: 32373 - protein, 9 aa, Homo sapiens
  light chain complementarity determining region 3 for antibody 16187
QQANSFPFT

SEQ ID NO: 32374 - protein, 16 aa, Homo sapiens
  heavy chain complementarity determining region 3 for antibody 16187
ARGGCGELGLQNALDI

SEQ ID NO: 32375 - protein, 9 aa, Homo sapiens
  light chain complementarity determining region 3 for antibody 16188
QQANSFPFT

SEQ ID NO: 32376 - protein, 24 aa, Homo sapiens
  heavy chain complementarity determining region 3 for antibody 16188
AKDHRVGFGDPVGVGYYYYYTMDV

SEQ ID NO: 32377 - protein, 10 aa, Homo sapiens
  light chain complementarity determining region 3 for antibody 16189
QQANSFLSIT

SEQ ID NO: 32378 - protein, 11 aa, Homo sapiens
  heavy chain complementarity determining region 3 for antibody 16189
AREQTGYYPRY

SEQ ID NO: 32379 - protein, 10 aa, Homo sapiens
  light chain complementarity determining region 3 for antibody 16190
QQANSFLSIT

SEQ ID NO: 32380 - protein, 11 aa, Homo sapiens
  heavy chain complementarity determining region 3 for antibody 16190
AREQTGYYHLY

SEQ ID NO: 32381 - protein, 10 aa, Homo sapiens
  light chain complementarity determining region 3 for antibody 16191
QQANSFLSFT

SEQ ID NO: 32382 - protein, 11 aa, Homo sapiens
  heavy chain complementarity determining region 3 for antibody 16191
AREQTGYYPLY

SEQ ID NO: 32383 - protein, 9 aa, Homo sapiens
  light chain complementarity determining region 3 for antibody 16192
QQANILPLT

SEQ ID NO: 32384 - protein, 25 aa, Homo sapiens
  heavy chain complementarity determining region 3 for antibody 16192
ARDHLGNIVGSAPSFLRYYYHGLEV

SEQ ID NO: 32385 - protein, 9 aa, Homo sapiens
  light chain complementarity determining region 3 for antibody 16193
QQANGLPFT

SEQ ID NO: 32386 - protein, 19 aa, Homo sapiens
  heavy chain complementarity determining region 3 for antibody 16193
ARADYSGETDRYYDYGMDV

SEQ ID NO: 32387 - protein, 9 aa, Homo sapiens
  light chain complementarity determining region 3 for antibody 16194
QQAKTFPPT

SEQ ID NO: 32388 - protein, 13 aa, Homo sapiens
  heavy chain complementarity determining region 3 for antibody 16194
ARGRKFENQYFDY

SEQ ID NO: 32389 - protein, 9 aa, Homo sapiens
  light chain complementarity determining region 3 for antibody 16195
QQAKTFPHT

SEQ ID NO: 32390 - protein, 13 aa, Homo sapiens
  heavy chain complementarity determining region 3 for antibody 16195
ARGRRFENQYFDY

SEQ ID NO: 32391 - protein, 9 aa, Homo sapiens
  light chain complementarity determining region 3 for antibody 16196
QQAKSFPLT

SEQ ID NO: 32392 - protein, 19 aa, Homo sapiens
  heavy chain complementarity determining region 3 for antibody 16196
ATDRYCSRPNCPQGNWFDP

SEQ ID NO: 32393 - protein, 9 aa, Homo sapiens
  light chain complementarity determining region 3 for antibody 16197
QQAKSFPIT

SEQ ID NO: 32394 - protein, 19 aa, Homo sapiens
  heavy chain complementarity determining region 3 for antibody 16197
ATDRYCSRPSCPQGNWFDP

SEQ ID NO: 32395 - protein, 9 aa, Homo sapiens
  light chain complementarity determining region 3 for antibody 16198
QQAKSFPIT

SEQ ID NO: 32396 - protein, 19 aa, Homo sapiens
  heavy chain complementarity determining region 3 for antibody 16198
ATDRYCSRPNCPQGNWFDH

SEQ ID NO: 32397 - protein, 9 aa, Homo sapiens
  light chain complementarity determining region 3 for antibody 16199
QQAKSFPIN

SEQ ID NO: 32398 - protein, 19 aa, Homo sapiens
  heavy chain complementarity determining region 3 for antibody 16199
ATDRYCSRPNCPQGNWFDP

SEQ ID NO: 32399 - protein, 8 aa, Homo sapiens
  light chain complementarity determining region 3 for antibody 16200
QQAHSFPP

SEQ ID NO: 32400 - protein, 22 aa, Homo sapiens
  heavy chain complementarity determining region 3 for antibody 16200
TRHSGYSNTWYMNYYYYYGMDV

SEQ ID NO: 32401 - protein, 8 aa, Homo sapiens
  light chain complementarity determining region 3 for antibody 16201
QQAHSFPP

SEQ ID NO: 32402 - protein, 22 aa, Homo sapiens
  heavy chain complementarity determining region 3 for antibody 16201
ARYSGYSNTWYMNYYYYYGMDV

SEQ ID NO: 32403 - protein, 8 aa, Homo sapiens
  light chain complementarity determining region 3 for antibody 16202
QQAHSFPP

SEQ ID NO: 32404 - protein, 22 aa, Homo sapiens
  heavy chain complementarity determining region 3 for antibody 16202
ARRSGYSNTWYMNYYYYYGMDV

SEQ ID NO: 32405 - protein, 8 aa, Homo sapiens
  light chain complementarity determining region 3 for antibody 16203
QQAHSFPP

SEQ ID NO: 32406 - protein, 22 aa, Homo sapiens
  heavy chain complementarity determining region 3 for antibody 16203
ARPSGYSSTWYMNYYYYYGMDV

SEQ ID NO: 32407 - protein, 8 aa, Homo sapiens
  light chain complementarity determining region 3 for antibody 16204
QQAHSFPP

SEQ ID NO: 32408 - protein, 22 aa, Homo sapiens
  heavy chain complementarity determining region 3 for antibody 16204
ARHSGYSNTWYTNYYYYYGMDV

SEQ ID NO: 32409 - protein, 8 aa, Homo sapiens
  light chain complementarity determining region 3 for antibody 16205
QQAHSFPP

SEQ ID NO: 32410 - protein, 22 aa, Homo sapiens
  heavy chain complementarity determining region 3 for antibody 16205
ARHSGYSNTWYMSYYYYYGMDV

SEQ ID NO: 32411 - protein, 8 aa, Homo sapiens
  light chain complementarity determining region 3 for antibody 16206
QQAHSFPP

SEQ ID NO: 32412 - protein, 23 aa, Homo sapiens
  heavy chain complementarity determining region 3 for antibody 16206
ARHSGYSNTWYMNYYYYYYGMDV

SEQ ID NO: 32413 - protein, 8 aa, Homo sapiens
  light chain complementarity determining region 3 for antibody 16207
QQAHSFPP

SEQ ID NO: 32414 - protein, 22 aa, Homo sapiens
  heavy chain complementarity determining region 3 for antibody 16207
ARHSGYSNTWYMNYYYYYCMDV

SEQ ID NO: 32415 - protein, 8 aa, Homo sapiens
  light chain complementarity determining region 3 for antibody 16208
QQAHSFPP

SEQ ID NO: 32416 - protein, 22 aa, Homo sapiens
  heavy chain complementarity determining region 3 for antibody 16208
ARHSGYSNTWYMNYYYFYGMDV

SEQ ID NO: 32417 - protein, 8 aa, Homo sapiens
  light chain complementarity determining region 3 for antibody 16209
QQAHSFPP

SEQ ID NO: 32418 - protein, 22 aa, Homo sapiens
  heavy chain complementarity determining region 3 for antibody 16209
ARHSGYSNTWYMNYYSYYGMDV

SEQ ID NO: 32419 - protein, 8 aa, Homo sapiens
  light chain complementarity determining region 3 for antibody 16210
QQAHSFPP

SEQ ID NO: 32420 - protein, 22 aa, Homo sapiens
  heavy chain complementarity determining region 3 for antibody 16210
ARHSGYSNTWYMNYYCYYGMDV

SEQ ID NO: 32421 - protein, 8 aa, Homo sapiens
  light chain complementarity determining region 3 for antibody 16211
QQAHSFPP

SEQ ID NO: 32422 - protein, 22 aa, Homo sapiens
  heavy chain complementarity determining region 3 for antibody 16211
ARHSGYSNTWYMNYHYYYGMDV

SEQ ID NO: 32423 - protein, 8 aa, Homo sapiens
  light chain complementarity determining region 3 for antibody 16212
QQAHSFPP

SEQ ID NO: 32424 - protein, 22 aa, Homo sapiens
  heavy chain complementarity determining region 3 for antibody 16212
ARHSGYSNTWYMNHYYYYGMDV

SEQ ID NO: 32425 - protein, 8 aa, Homo sapiens
  light chain complementarity determining region 3 for antibody 16213
QQAHSFPP

SEQ ID NO: 32426 - protein, 22 aa, Homo sapiens
  heavy chain complementarity determining region 3 for antibody 16213
ARHSGYSNTCYMNYYYYYGMDV

SEQ ID NO: 32427 - protein, 8 aa, Homo sapiens
  light chain complementarity determining region 3 for antibody 16214
QQAHSFPP

SEQ ID NO: 32428 - protein, 22 aa, Homo sapiens
  heavy chain complementarity determining region 3 for antibody 16214
ARHSGYSNIWYMNYYYYYGMDV

SEQ ID NO: 32429 - protein, 8 aa, Homo sapiens
  light chain complementarity determining region 3 for antibody 16215
QQAHSFPP

SEQ ID NO: 32430 - protein, 22 aa, Homo sapiens
  heavy chain complementarity determining region 3 for antibody 16215
ARHSGYSDTWYMNYYYYYGMDV

SEQ ID NO: 32431 - protein, 8 aa, Homo sapiens
  light chain complementarity determining region 3 for antibody 16216
QQAHSFPP

SEQ ID NO: 32432 - protein, 22 aa, Homo sapiens
  heavy chain complementarity determining region 3 for antibody 16216
ARHSGCSNTWYMNYYYYYGMDV

SEQ ID NO: 32433 - protein, 8 aa, Homo sapiens
  light chain complementarity determining region 3 for antibody 16217
QQAHSFPP

SEQ ID NO: 32434 - protein, 22 aa, Homo sapiens
  heavy chain complementarity determining region 3 for antibody 16217
AGHSGYSNTWYMNYYYYYGMDV

SEQ ID NO: 32435 - protein, 8 aa, Homo sapiens
  light chain complementarity determining region 3 for antibody 16218
QQAHGFPP

SEQ ID NO: 32436 - protein, 22 aa, Homo sapiens
  heavy chain complementarity determining region 3 for antibody 16218
ARHSGYSNTWYMNYYYYYGMDV

SEQ ID NO: 32437 - protein, 9 aa, Homo sapiens
  light chain complementarity determining region 3 for antibody 16219
QQADTFPTT

SEQ ID NO: 32438 - protein, 16 aa, Homo sapiens
  heavy chain complementarity determining region 3 for antibody 16219
ARGWRQVASGWLYFDY

SEQ ID NO: 32439 - protein, 9 aa, Homo sapiens
  light chain complementarity determining region 3 for antibody 16220
QQADTFPIT

SEQ ID NO: 32440 - protein, 16 aa, Homo sapiens
  heavy chain complementarity determining region 3 for antibody 16220
ARGWRRVASGWLYFDY

SEQ ID NO: 32441 - protein, 9 aa, Homo sapiens
  light chain complementarity determining region 3 for antibody 16221
QQADSFPLT

SEQ ID NO: 32442 - protein, 15 aa, Homo sapiens
  heavy chain complementarity determining region 3 for antibody 16221
ARDPGYSSAWNYFDR

SEQ ID NO: 32443 - protein, 9 aa, Homo sapiens
  light chain complementarity determining region 3 for antibody 16222
QQADSFPIT

SEQ ID NO: 32444 - protein, 18 aa, Homo sapiens
  heavy chain complementarity determining region 3 for antibody 16222
AHTSAYYESDDPTHYFNA

SEQ ID NO: 32445 - protein, 9 aa, Homo sapiens
  light chain complementarity determining region 3 for antibody 16223
QQADSFHIT

SEQ ID NO: 32446 - protein, 18 aa, Homo sapiens
  heavy chain complementarity determining region 3 for antibody 16223
AHTSAYYESDDPTHYFNS

SEQ ID NO: 32447 - protein, 9 aa, Homo sapiens
  light chain complementarity determining region 3 for antibody 16224
QPYYTYSET

SEQ ID NO: 32448 - protein, 19 aa, Homo sapiens
  heavy chain complementarity determining region 3 for antibody 16224
ATVKGDQGELDYDYHGVDV

SEQ ID NO: 32449 - protein, 9 aa, Homo sapiens
  light chain complementarity determining region 3 for antibody 16225
QPYYTTPFT

SEQ ID NO: 32450 - protein, 17 aa, Homo sapiens
  heavy chain complementarity determining region 3 for antibody 16225
ARGRYESGDYYNNAFDF

SEQ ID NO: 32451 - protein, 9 aa, Homo sapiens
  light chain complementarity determining region 3 for antibody 16226
QPYYTSPLT

SEQ ID NO: 32452 - protein, 17 aa, Homo sapiens
  heavy chain complementarity determining region 3 for antibody 16226
ARERSVAGAVRFYGMDV

SEQ ID NO: 32453 - protein, 9 aa, Homo sapiens
  light chain complementarity determining region 3 for antibody 16227
QPYYSAPRT

SEQ ID NO: 32454 - protein, 20 aa, Homo sapiens
  heavy chain complementarity determining region 3 for antibody 16227
VRDDILTGYYQSDYYHAMDV

SEQ ID NO: 32455 - protein, 10 aa, Homo sapiens
  light chain complementarity determining region 3 for antibody 16228
QPYVSSELFT

SEQ ID NO: 32456 - protein, 16 aa, Homo sapiens
  heavy chain complementarity determining region 3 for antibody 16228
AREIFKGEIDYYAMDV

SEQ ID NO: 32457 - protein, 10 aa, Homo sapiens
  light chain complementarity determining region 3 for antibody 16229
QPYVSSALYT

SEQ ID NO: 32458 - protein, 16 aa, Homo sapiens
  heavy chain complementarity determining region 3 for antibody 16229
AKELFKGEYDYYAMDV

SEQ ID NO: 32459 - protein, 10 aa, Homo sapiens
  light chain complementarity determining region 3 for antibody 16230
QPYVPSHKYT

SEQ ID NO: 32460 - protein, 22 aa, Homo sapiens
  heavy chain complementarity determining region 3 for antibody 16230
ARHSPFLEMLGERWLQFGAFDI

SEQ ID NO: 32461 - protein, 10 aa, Homo sapiens
  light chain complementarity determining region 3 for antibody 16231
QPYVNSALFT

SEQ ID NO: 32462 - protein, 16 aa, Homo sapiens
  heavy chain complementarity determining region 3 for antibody 16231
AREVFKGEIDYYAMDV

SEQ ID NO: 32463 - protein, 9 aa, Homo sapiens
  light chain complementarity determining region 3 for antibody 16232
QPYSTFPYT

SEQ ID NO: 32464 - protein, 17 aa, Homo sapiens
  heavy chain complementarity determining region 3 for antibody 16232
AREVWNDVDLRQYYFDY

SEQ ID NO: 32465 - protein, 9 aa, Homo sapiens
  light chain complementarity determining region 3 for antibody 16233
QPYSTFPYT

SEQ ID NO: 32466 - protein, 17 aa, Homo sapiens
  heavy chain complementarity determining region 3 for antibody 16233
AREDWNDVDLRQFYFDY

SEQ ID NO: 32467 - protein, 9 aa, Homo sapiens
  light chain complementarity determining region 3 for antibody 16234
QPYSSYPWT

SEQ ID NO: 32468 - protein, 17 aa, Homo sapiens
  heavy chain complementarity determining region 3 for antibody 16234
ARRFGLYYFGASDYYDY

SEQ ID NO: 32469 - protein, 10 aa, Homo sapiens
  light chain complementarity determining region 3 for antibody 16235
QPYSRWPPWT

SEQ ID NO: 32470 - protein, 9 aa, Homo sapiens
  heavy chain complementarity determining region 3 for antibody 16235
ARGYSYGNL

SEQ ID NO: 32471 - protein, 9 aa, Homo sapiens
  light chain complementarity determining region 3 for antibody 16236
QPYNSFPYT

SEQ ID NO: 32472 - protein, 17 aa, Homo sapiens
  heavy chain complementarity determining region 3 for antibody 16236
AREDWSDVDLRLFYLDY

SEQ ID NO: 32473 - protein, 9 aa, Homo sapiens
  light chain complementarity determining region 3 for antibody 16237
QPYNSFPPT

SEQ ID NO: 32474 - protein, 19 aa, Homo sapiens
  heavy chain complementarity determining region 3 for antibody 16237
AKDPHPVVVGELLEPVFDH

SEQ ID NO: 32475 - protein, 9 aa, Homo sapiens
  light chain complementarity determining region 3 for antibody 16238
QPYNGRSLT

SEQ ID NO: 32476 - protein, 11 aa, Homo sapiens
  heavy chain complementarity determining region 3 for antibody 16238
ARIQQLGALAH

SEQ ID NO: 32477 - protein, 9 aa, Homo sapiens
  light chain complementarity determining region 3 for antibody 16239
QPYKTDPWT

SEQ ID NO: 32478 - protein, 10 aa, Homo sapiens
  heavy chain complementarity determining region 3 for antibody 16239
IRHEEYVRPY

SEQ ID NO: 32479 - protein, 8 aa, Homo sapiens
  light chain complementarity determining region 3 for antibody 16240
QPYKNWPL

SEQ ID NO: 32480 - protein, 18 aa, Homo sapiens
  heavy chain complementarity determining region 3 for antibody 16240
AKDAAVDVILGNRGYFDF

SEQ ID NO: 32481 - protein, 9 aa, Homo sapiens
  light chain complementarity determining region 3 for antibody 16241
QPYGTSRYT

SEQ ID NO: 32482 - protein, 23 aa, Homo sapiens
  heavy chain complementarity determining region 3 for antibody 16241
ARVGCSGEKCSSTAGYYYYPLDV

SEQ ID NO: 32483 - protein, 8 aa, Homo sapiens
  light chain complementarity determining region 3 for antibody 16242
QPYGTSGT

SEQ ID NO: 32484 - protein, 19 aa, Homo sapiens
  heavy chain complementarity determining region 3 for antibody 16242
ARSDLLSEELSSEPGAFDF

SEQ ID NO: 32485 - protein, 9 aa, Homo sapiens
  light chain complementarity determining region 3 for antibody 16243
QPYGSSRYT

SEQ ID NO: 32486 - protein, 23 aa, Homo sapiens
  heavy chain complementarity determining region 3 for antibody 16243
ARVGCSGEKCSSTSGYYYYALDV

SEQ ID NO: 32487 - protein, 8 aa, Homo sapiens
  light chain complementarity determining region 3 for antibody 16244
QPYGSSPT

SEQ ID NO: 32488 - protein, 21 aa, Homo sapiens
  heavy chain complementarity determining region 3 for antibody 16244
ATRTSGKYSSSDDYYYYGMDV

SEQ ID NO: 32489 - protein, 9 aa, Homo sapiens
  light chain complementarity determining region 3 for antibody 16245
QPYGSSATT

SEQ ID NO: 32490 - protein, 23 aa, Homo sapiens
  heavy chain complementarity determining region 3 for antibody 16245
ARQPRSPSSWGIVAAGTINWFDP

SEQ ID NO: 32491 - protein, 10 aa, Homo sapiens
  light chain complementarity determining region 3 for antibody 16246
QPYGRSPPLT

SEQ ID NO: 32492 - protein, 16 aa, Homo sapiens
  heavy chain complementarity determining region 3 for antibody 16246
ATSFLYSGSYYGGLDY

SEQ ID NO: 32493 - protein, 9 aa, Homo sapiens
  light chain complementarity determining region 3 for antibody 16247
QPYETSPFT

SEQ ID NO: 32494 - protein, 11 aa, Homo sapiens
  heavy chain complementarity determining region 3 for antibody 16247
GRGSVTPDMGY

SEQ ID NO: 32495 - protein, 9 aa, Homo sapiens
  light chain complementarity determining region 3 for antibody 16248
QPYDSSPWT

SEQ ID NO: 32496 - protein, 17 aa, Homo sapiens
  heavy chain complementarity determining region 3 for antibody 16248
ARGVYGAYLGYYFGMDV

SEQ ID NO: 32497 - protein, 9 aa, Homo sapiens
  light chain complementarity determining region 3 for antibody 16249
QPYDSFPYT

SEQ ID NO: 32498 - protein, 17 aa, Homo sapiens
  heavy chain complementarity determining region 3 for antibody 16249
AREDWSDVDLRAFYFDS

SEQ ID NO: 32499 - protein, 9 aa, Homo sapiens
  light chain complementarity determining region 3 for antibody 16250
QPTYSTLWT

SEQ ID NO: 32500 - protein, 16 aa, Homo sapiens
  heavy chain complementarity determining region 3 for antibody 16250
AYTPPVVDTVKDGFHV

SEQ ID NO: 32501 - protein, 9 aa, Homo sapiens
  light chain complementarity determining region 3 for antibody 16251
QPTNSFPYT

SEQ ID NO: 32502 - protein, 18 aa, Homo sapiens
  heavy chain complementarity determining region 3 for antibody 16251
VRHLWFGRGSSYYYAMDV

SEQ ID NO: 32503 - protein, 9 aa, Homo sapiens
  light chain complementarity determining region 3 for antibody 16252
QPSYSTPYT

SEQ ID NO: 32504 - protein, 17 aa, Homo sapiens
  heavy chain complementarity determining region 3 for antibody 16252
ARGSYYDVDLITYYFDH

SEQ ID NO: 32505 - protein, 9 aa, Homo sapiens
  light chain complementarity determining region 3 for antibody 16253
QPSYSTPYT

SEQ ID NO: 32506 - protein, 15 aa, Homo sapiens
  heavy chain complementarity determining region 3 for antibody 16253
ARGGAVRPRYYGVDV

SEQ ID NO: 32507 - protein, 10 aa, Homo sapiens
  light chain complementarity determining region 3 for antibody 16254
QPSYSTPLLT

SEQ ID NO: 32508 - protein, 15 aa, Homo sapiens
  heavy chain complementarity determining region 3 for antibody 16254
AVWESMTEWLGPFDY

SEQ ID NO: 32509 - protein, 9 aa, Homo sapiens
  light chain complementarity determining region 3 for antibody 16255
QPSYRTPFT

SEQ ID NO: 32510 - protein, 22 aa, Homo sapiens
  heavy chain complementarity determining region 3 for antibody 16255
ARVPGITVAGPLTGYYYYGKDV

SEQ ID NO: 32511 - protein, 8 aa, Homo sapiens
  light chain complementarity determining region 3 for antibody 16256
QPSYRALS

SEQ ID NO: 32512 - protein, 10 aa, Homo sapiens
  heavy chain complementarity determining region 3 for antibody 16256
AHLSRGVNFF

SEQ ID NO: 32513 - protein, 10 aa, Homo sapiens
  light chain complementarity determining region 3 for antibody 16257
QPSYGPRPWT

SEQ ID NO: 32514 - protein, 15 aa, Homo sapiens
  heavy chain complementarity determining region 3 for antibody 16257
ARVSGPWVMIYYFDY

SEQ ID NO: 32515 - protein, 9 aa, Homo sapiens
  light chain complementarity determining region 3 for antibody 16258
QPSFSPPWA

SEQ ID NO: 32516 - protein, 19 aa, Homo sapiens
  heavy chain complementarity determining region 3 for antibody 16258
ATMRYGSGELTYDYYGMDV

SEQ ID NO: 32517 - protein, 9 aa, Homo sapiens
  light chain complementarity determining region 3 for antibody 16259
QPRNNWGLT

SEQ ID NO: 32518 - protein, 22 aa, Homo sapiens
  heavy chain complementarity determining region 3 for antibody 16259
ARHSGYSNTWYMNYYYYYGMDV

SEQ ID NO: 32519 - protein, 9 aa, Homo sapiens
  light chain complementarity determining region 3 for antibody 16260
QPGYSFPFT

SEQ ID NO: 32520 - protein, 19 aa, Homo sapiens
  heavy chain complementarity determining region 3 for antibody 16260
ARSDYSGDTDRYYDHGMDV

SEQ ID NO: 32521 - protein, 9 aa, Homo sapiens
  light chain complementarity determining region 3 for antibody 16261
QPFSPYSYS

SEQ ID NO: 32522 - protein, 13 aa, Homo sapiens
  heavy chain complementarity determining region 3 for antibody 16261
VRIGAAAGTAFDY

SEQ ID NO: 32523 - protein, 10 aa, Homo sapiens
  light chain complementarity determining region 3 for antibody 16262
QPFGNSPRYT

SEQ ID NO: 32524 - protein, 20 aa, Homo sapiens
  heavy chain complementarity determining region 3 for antibody 16262
ARDRGGRSSSFTNYQYNMDV

SEQ ID NO: 32525 - protein, 9 aa, Homo sapiens
  light chain complementarity determining region 3 for antibody 16263
QNYDSSPRI

SEQ ID NO: 32526 - protein, 13 aa, Homo sapiens
  heavy chain complementarity determining region 3 for antibody 16263
TRDEDGNNTPVDY

SEQ ID NO: 32527 - protein, 9 aa, Homo sapiens
  light chain complementarity determining region 3 for antibody 16264
QNYDSSPRF

SEQ ID NO: 32528 - protein, 13 aa, Homo sapiens
  heavy chain complementarity determining region 3 for antibody 16264
TRDEDGNNTPFDY

SEQ ID NO: 32529 - protein, 10 aa, Homo sapiens
  light chain complementarity determining region 3 for antibody 16265
QNHGYSPLYT

SEQ ID NO: 32530 - protein, 12 aa, Homo sapiens
  heavy chain complementarity determining region 3 for antibody 16265
AKGILGRGGMDV

SEQ ID NO: 32531 - protein, 9 aa, Homo sapiens
  light chain complementarity determining region 3 for antibody 16266
QMYGDSPWT

SEQ ID NO: 32532 - protein, 9 aa, Homo sapiens
  heavy chain complementarity determining region 3 for antibody 16266
ARWNQAFDY

SEQ ID NO: 32533 - protein, 10 aa, Homo sapiens
  light chain complementarity determining region 3 for antibody 16267
QLYSSSPQLT

SEQ ID NO: 32534 - protein, 13 aa, Homo sapiens
  heavy chain complementarity determining region 3 for antibody 16267
ARSAGYYPNWLES

SEQ ID NO: 32535 - protein, 10 aa, Homo sapiens
  light chain complementarity determining region 3 for antibody 16268
QLYRDWPGWT

SEQ ID NO: 32536 - protein, 17 aa, Homo sapiens
  heavy chain complementarity determining region 3 for antibody 16268
AKEIWIVNRPGGDAFDM

SEQ ID NO: 32537 - protein, 10 aa, Homo sapiens
  light chain complementarity determining region 3 for antibody 16269
QLYGSSPRYT

SEQ ID NO: 32538 - protein, 20 aa, Homo sapiens
  heavy chain complementarity determining region 3 for antibody 16269
ARDRGGRTSSFTNSQQSMDV

SEQ ID NO: 32539 - protein, 10 aa, Homo sapiens
  light chain complementarity determining region 3 for antibody 16270
QLYGSSPRYT

SEQ ID NO: 32540 - protein, 20 aa, Homo sapiens
  heavy chain complementarity determining region 3 for antibody 16270
ARDRGGRTSSFTNCQQSMDV

SEQ ID NO: 32541 - protein, 11 aa, Homo sapiens
  light chain complementarity determining region 3 for antibody 16271
QLRYNWPPVLT

SEQ ID NO: 32542 - protein, 17 aa, Homo sapiens
  heavy chain complementarity determining region 3 for antibody 16271
ARDKGGGGRLLVAAPDY

SEQ ID NO: 32543 - protein, 11 aa, Homo sapiens
  light chain complementarity determining region 3 for antibody 16272
QLRSNWPPGFT

SEQ ID NO: 32544 - protein, 14 aa, Homo sapiens
  heavy chain complementarity determining region 3 for antibody 16272
ARDPYSYGLNYLDY

SEQ ID NO: 32545 - protein, 9 aa, Homo sapiens
  light chain complementarity determining region 3 for antibody 16273
QLLTNYVLT

SEQ ID NO: 32546 - protein, 11 aa, Homo sapiens
  heavy chain complementarity determining region 3 for antibody 16273
ARVMQGVACDV

SEQ ID NO: 32547 - protein, 11 aa, Homo sapiens
  light chain complementarity determining region 3 for antibody 16274
QLLNSHYGGFT

SEQ ID NO: 32548 - protein, 19 aa, Homo sapiens
  heavy chain complementarity determining region 3 for antibody 16274
ARGGPCSGTTCFSYYGVDV

SEQ ID NO: 32549 - protein, 11 aa, Homo sapiens
  light chain complementarity determining region 3 for antibody 16275
QLLNSHSGWFT

SEQ ID NO: 32550 - protein, 19 aa, Homo sapiens
  heavy chain complementarity determining region 3 for antibody 16275
ARGGPCSGTTCFSYYGVDV

SEQ ID NO: 32551 - protein, 11 aa, Homo sapiens
  light chain complementarity determining region 3 for antibody 16276
QLLNSHSGGFT

SEQ ID NO: 32552 - protein, 19 aa, Homo sapiens
  heavy chain complementarity determining region 3 for antibody 16276
ARGGPCSGTTCFSYYSVDV

SEQ ID NO: 32553 - protein, 11 aa, Homo sapiens
  light chain complementarity determining region 3 for antibody 16277
QLLNSHSGGFT

SEQ ID NO: 32554 - protein, 19 aa, Homo sapiens
  heavy chain complementarity determining region 3 for antibody 16277
ARGGPCSGTACFSYYGVDV

SEQ ID NO: 32555 - protein, 11 aa, Homo sapiens
  light chain complementarity determining region 3 for antibody 16278
QLLNSHSGAFT

SEQ ID NO: 32556 - protein, 19 aa, Homo sapiens
  heavy chain complementarity determining region 3 for antibody 16278
ARGGPCSGTTCFSYYGVDV

SEQ ID NO: 32557 - protein, 11 aa, Homo sapiens
  light chain complementarity determining region 3 for antibody 16279
QLLNSHPGGFT

SEQ ID NO: 32558 - protein, 19 aa, Homo sapiens
  heavy chain complementarity determining region 3 for antibody 16279
ARGGPCSGTTCFSYYGVDV

SEQ ID NO: 32559 - protein, 9 aa, Homo sapiens
  light chain complementarity determining region 3 for antibody 16280
QLGHSLPFT

SEQ ID NO: 32560 - protein, 19 aa, Homo sapiens
  heavy chain complementarity determining region 3 for antibody 16280
ARSDYSGDTDRYYDYGMDV

SEQ ID NO: 32561 - protein, 10 aa, Homo sapiens
  light chain complementarity determining region 3 for antibody 16281
QLFGSSPRYT

SEQ ID NO: 32562 - protein, 20 aa, Homo sapiens
  heavy chain complementarity determining region 3 for antibody 16281
ARDRGGRSSSFTNYQYNMDV

SEQ ID NO: 32563 - protein, 10 aa, Homo sapiens
  light chain complementarity determining region 3 for antibody 16282
QLFGNSPRYT

SEQ ID NO: 32564 - protein, 20 aa, Homo sapiens
  heavy chain complementarity determining region 3 for antibody 16282
ARDRGGRSSSFTNHQYNMDV

SEQ ID NO: 32565 - protein, 10 aa, Homo sapiens
  light chain complementarity determining region 3 for antibody 16283
QLFGNSPRYT

SEQ ID NO: 32566 - protein, 20 aa, Homo sapiens
  heavy chain complementarity determining region 3 for antibody 16283
ARDRGGRSSSCTNYQYNMDV

SEQ ID NO: 32567 - protein, 10 aa, Homo sapiens
  light chain complementarity determining region 3 for antibody 16284
QLFGNSPRYT

SEQ ID NO: 32568 - protein, 20 aa, Homo sapiens
  heavy chain complementarity determining region 3 for antibody 16284
AGDRGGRSSSFTNYQYNMDV

SEQ ID NO: 32569 - protein, 10 aa, Homo sapiens
  light chain complementarity determining region 3 for antibody 16285
QLFGNSPLYT

SEQ ID NO: 32570 - protein, 20 aa, Homo sapiens
  heavy chain complementarity determining region 3 for antibody 16285
ARDRGGRSSSFTNYQYNMDV

SEQ ID NO: 32571 - protein, 10 aa, Homo sapiens
  light chain complementarity determining region 3 for antibody 16286
QKYYSAPPFT

SEQ ID NO: 32572 - protein, 19 aa, Homo sapiens
  heavy chain complementarity determining region 3 for antibody 16286
ARELDFDILTGYLGGLFQH

SEQ ID NO: 32573 - protein, 10 aa, Homo sapiens
  light chain complementarity determining region 3 for antibody 16287
QKYVSSALYT

SEQ ID NO: 32574 - protein, 16 aa, Homo sapiens
  heavy chain complementarity determining region 3 for antibody 16287
ARELFKGEYDYYAMDV

SEQ ID NO: 32575 - protein, 10 aa, Homo sapiens
  light chain complementarity determining region 3 for antibody 16288
QKYVNSGLFT

SEQ ID NO: 32576 - protein, 16 aa, Homo sapiens
  heavy chain complementarity determining region 3 for antibody 16288
AREVFKGQIDYYGMDV

SEQ ID NO: 32577 - protein, 9 aa, Homo sapiens
  light chain complementarity determining region 3 for antibody 16289
QKYSTFPYT

SEQ ID NO: 32578 - protein, 17 aa, Homo sapiens
  heavy chain complementarity determining region 3 for antibody 16289
AREQWNDVDLRQFYFDY

SEQ ID NO: 32579 - protein, 10 aa, Homo sapiens
  light chain complementarity determining region 3 for antibody 16290
QKYSNVPPFT

SEQ ID NO: 32580 - protein, 17 aa, Homo sapiens
  heavy chain complementarity determining region 3 for antibody 16290
ASDPTYGDSYYYSGMDL

SEQ ID NO: 32581 - protein, 9 aa, Homo sapiens
  light chain complementarity determining region 3 for antibody 16291
QKYNSYWYT

SEQ ID NO: 32582 - protein, 20 aa, Homo sapiens
  heavy chain complementarity determining region 3 for antibody 16291
AGTYGSGTYSPDYYYFGMDV

SEQ ID NO: 32583 - protein, 8 aa, Homo sapiens
  light chain complementarity determining region 3 for antibody 16292
QKYNSYSA

SEQ ID NO: 32584 - protein, 15 aa, Homo sapiens
  heavy chain complementarity determining region 3 for antibody 16292
ARAYSSGWYPESFDF

SEQ ID NO: 32585 - protein, 9 aa, Homo sapiens
  light chain complementarity determining region 3 for antibody 16293
QKYNSVPWM

SEQ ID NO: 32586 - protein, 14 aa, Homo sapiens
  heavy chain complementarity determining region 3 for antibody 16293
ARDESRSRVNVLDI

SEQ ID NO: 32587 - protein, 9 aa, Homo sapiens
  light chain complementarity determining region 3 for antibody 16294
QKYNSDPRT

SEQ ID NO: 32588 - protein, 20 aa, Homo sapiens
  heavy chain complementarity determining region 3 for antibody 16294
ARGGKYSSNFPYFYHYGLDV

SEQ ID NO: 32589 - protein, 9 aa, Homo sapiens
  light chain complementarity determining region 3 for antibody 16295
QKYNSDPFT

SEQ ID NO: 32590 - protein, 17 aa, Homo sapiens
  heavy chain complementarity determining region 3 for antibody 16295
ARDRDSSGWDYWGPLPN

SEQ ID NO: 32591 - protein, 9 aa, Homo sapiens
  light chain complementarity determining region 3 for antibody 16296
QKYNSAPRK

SEQ ID NO: 32592 - protein, 16 aa, Homo sapiens
  heavy chain complementarity determining region 3 for antibody 16296
AKDLFRGVLRWDASDI

SEQ ID NO: 32593 - protein, 9 aa, Homo sapiens
  light chain complementarity determining region 3 for antibody 16297
QKYNSAPPT

SEQ ID NO: 32594 - protein, 22 aa, Homo sapiens
  heavy chain complementarity determining region 3 for antibody 16297
ARDRWFRIEEDGFRTIRHPFDY

SEQ ID NO: 32595 - protein, 11 aa, Homo sapiens
  light chain complementarity determining region 3 for antibody 16298
QKYNSAPPLFT

SEQ ID NO: 32596 - protein, 11 aa, Homo sapiens
  heavy chain complementarity determining region 3 for antibody 16298
ARDHEGYGYYY

SEQ ID NO: 32597 - protein, 9 aa, Homo sapiens
  light chain complementarity determining region 3 for antibody 16299
QKYNSAPLT

SEQ ID NO: 32598 - protein, 16 aa, Homo sapiens
  heavy chain complementarity determining region 3 for antibody 16299
TTHFAPRRWLVRGGDH

SEQ ID NO: 32599 - protein, 9 aa, Homo sapiens
  light chain complementarity determining region 3 for antibody 16300
QKYNSAPLT

SEQ ID NO: 32600 - protein, 22 aa, Homo sapiens
  heavy chain complementarity determining region 3 for antibody 16300
ARGGPERDYYDSIDSIYDALDI

SEQ ID NO: 32601 - protein, 9 aa, Homo sapiens
  light chain complementarity determining region 3 for antibody 16301
QKYNSAPLT

SEQ ID NO: 32602 - protein, 22 aa, Homo sapiens
  heavy chain complementarity determining region 3 for antibody 16301
ARGGADRDYYDSIDSIYDAFDI

SEQ ID NO: 32603 - protein, 9 aa, Homo sapiens
  light chain complementarity determining region 3 for antibody 16302
QKYNSAPIT

SEQ ID NO: 32604 - protein, 22 aa, Homo sapiens
  heavy chain complementarity determining region 3 for antibody 16302
ARGLGTINYNDMLTGYFQYFDL

SEQ ID NO: 32605 - protein, 9 aa, Homo sapiens
  light chain complementarity determining region 3 for antibody 16303
QKYNSAPIT

SEQ ID NO: 32606 - protein, 22 aa, Homo sapiens
  heavy chain complementarity determining region 3 for antibody 16303
ARGLGTINYNDILTDYFQYFDL

SEQ ID NO: 32607 - protein, 9 aa, Homo sapiens
  light chain complementarity determining region 3 for antibody 16304
QKYNSAPIT

SEQ ID NO: 32608 - protein, 22 aa, Homo sapiens
  heavy chain complementarity determining region 3 for antibody 16304
ARGLGNINYNDILTGYFQYFDL

SEQ ID NO: 32609 - protein, 9 aa, Homo sapiens
  light chain complementarity determining region 3 for antibody 16305
QKYNSAPIP

SEQ ID NO: 32610 - protein, 22 aa, Homo sapiens
  heavy chain complementarity determining region 3 for antibody 16305
ARGLGTINYNDILTGYFQYFDL

SEQ ID NO: 32611 - protein, 9 aa, Homo sapiens
  light chain complementarity determining region 3 for antibody 16306
QKYNSAPFT

SEQ ID NO: 32612 - protein, 15 aa, Homo sapiens
  heavy chain complementarity determining region 3 for antibody 16306
ARDRTVASPNWYFDL

SEQ ID NO: 32613 - protein, 9 aa, Homo sapiens
  light chain complementarity determining region 3 for antibody 16307
QKYNSAPFT

SEQ ID NO: 32614 - protein, 15 aa, Homo sapiens
  heavy chain complementarity determining region 3 for antibody 16307
ARDRTVAAPNWYVDL

SEQ ID NO: 32615 - protein, 9 aa, Homo sapiens
  light chain complementarity determining region 3 for antibody 16308
QKYNRAPIT

SEQ ID NO: 32616 - protein, 22 aa, Homo sapiens
  heavy chain complementarity determining region 3 for antibody 16308
ARGLGTINYNDILTGYFQYFDL

SEQ ID NO: 32617 - protein, 10 aa, Homo sapiens
  light chain complementarity determining region 3 for antibody 16309
QKYNNVPPFT

SEQ ID NO: 32618 - protein, 17 aa, Homo sapiens
  heavy chain complementarity determining region 3 for antibody 16309
ASYPTYGDSYYYSGMDL

SEQ ID NO: 32619 - protein, 10 aa, Homo sapiens
  light chain complementarity determining region 3 for antibody 16310
QKYNNVPPFT

SEQ ID NO: 32620 - protein, 17 aa, Homo sapiens
  heavy chain complementarity determining region 3 for antibody 16310
ASDPTYGDSYYYSGVDL

SEQ ID NO: 32621 - protein, 10 aa, Homo sapiens
  light chain complementarity determining region 3 for antibody 16311
QKYNNVPPFT

SEQ ID NO: 32622 - protein, 17 aa, Homo sapiens
  heavy chain complementarity determining region 3 for antibody 16311
ASDPTCGDSYYYSGMDL

SEQ ID NO: 32623 - protein, 10 aa, Homo sapiens
  light chain complementarity determining region 3 for antibody 16312
QKYNNVPPFT

SEQ ID NO: 32624 - protein, 17 aa, Homo sapiens
  heavy chain complementarity determining region 3 for antibody 16312
ASDPPYGDSYYYSGMDL

SEQ ID NO: 32625 - protein, 10 aa, Homo sapiens
  light chain complementarity determining region 3 for antibody 16313
QKYNNVPPFN

SEQ ID NO: 32626 - protein, 17 aa, Homo sapiens
  heavy chain complementarity determining region 3 for antibody 16313
ASDPTYGDSYYYSGMDL

SEQ ID NO: 32627 - protein, 10 aa, Homo sapiens
  light chain complementarity determining region 3 for antibody 16314
QKYNNVHPFT

SEQ ID NO: 32628 - protein, 17 aa, Homo sapiens
  heavy chain complementarity determining region 3 for antibody 16314
ASDPTYGDSYYYSGMDL

SEQ ID NO: 32629 - protein, 10 aa, Homo sapiens
  light chain complementarity determining region 3 for antibody 16315
QKYNNAPPFT

SEQ ID NO: 32630 - protein, 17 aa, Homo sapiens
  heavy chain complementarity determining region 3 for antibody 16315
ASDPPYGDSYYYSGMDL

SEQ ID NO: 32631 - protein, 9 aa, Homo sapiens
  light chain complementarity determining region 3 for antibody 16316
QKYNIYSWT

SEQ ID NO: 32632 - protein, 20 aa, Homo sapiens
  heavy chain complementarity determining region 3 for antibody 16316
ARGSGETYYDILTGYCYFDH

SEQ ID NO: 32633 - protein, 9 aa, Homo sapiens
  light chain complementarity determining region 3 for antibody 16317
QKYNIAPLT

SEQ ID NO: 32634 - protein, 22 aa, Homo sapiens
  heavy chain complementarity determining region 3 for antibody 16317
ARGGPERDYYDSIDSIYDAFDI

SEQ ID NO: 32635 - protein, 8 aa, Homo sapiens
  light chain complementarity determining region 3 for antibody 16318
QKYNFDPT

SEQ ID NO: 32636 - protein, 19 aa, Homo sapiens
  heavy chain complementarity determining region 3 for antibody 16318
ARDTWSSGRPNRGYFYFDL

SEQ ID NO: 32637 - protein, 8 aa, Homo sapiens
  light chain complementarity determining region 3 for antibody 16319
QKYGTSPT

SEQ ID NO: 32638 - protein, 12 aa, Homo sapiens
  heavy chain complementarity determining region 3 for antibody 16319
ARGSVGDLSLPY

SEQ ID NO: 32639 - protein, 8 aa, Homo sapiens
  light chain complementarity determining region 3 for antibody 16320
QKYGSSPT

SEQ ID NO: 32640 - protein, 21 aa, Homo sapiens
  heavy chain complementarity determining region 3 for antibody 16320
ATRTSGKYSSSDDYYYYGMDV

SEQ ID NO: 32641 - protein, 10 aa, Homo sapiens
  light chain complementarity determining region 3 for antibody 16321
QKYGDSPLVT

SEQ ID NO: 32642 - protein, 16 aa, Homo sapiens
  heavy chain complementarity determining region 3 for antibody 16321
TRRIVGTWLVPYYFDY

SEQ ID NO: 32643 - protein, 10 aa, Homo sapiens
  light chain complementarity determining region 3 for antibody 16322
QKYFNWPLIT

SEQ ID NO: 32644 - protein, 15 aa, Homo sapiens
  heavy chain complementarity determining region 3 for antibody 16322
ASMFEFDSGTYYSNY

SEQ ID NO: 32645 - protein, 9 aa, Homo sapiens
  light chain complementarity determining region 3 for antibody 16323
QKYDSLPLT

SEQ ID NO: 32646 - protein, 18 aa, Homo sapiens
  heavy chain complementarity determining region 3 for antibody 16323
ARAPGDYDMLRRGYYFDH

SEQ ID NO: 32647 - protein, 9 aa, Homo sapiens
  light chain complementarity determining region 3 for antibody 16324
QKYDSLPLT

SEQ ID NO: 32648 - protein, 18 aa, Homo sapiens
  heavy chain complementarity determining region 3 for antibody 16324
AKALPPGIEVVGTNYFDR

SEQ ID NO: 32649 - protein, 9 aa, Homo sapiens
  light chain complementarity determining region 3 for antibody 16325
QKYDSFPYT

SEQ ID NO: 32650 - protein, 17 aa, Homo sapiens
  heavy chain complementarity determining region 3 for antibody 16325
AREDYSDVDLRAFYFDS

SEQ ID NO: 32651 - protein, 9 aa, Homo sapiens
  light chain complementarity determining region 3 for antibody 16326
QKYDSFPYT

SEQ ID NO: 32652 - protein, 17 aa, Homo sapiens
  heavy chain complementarity determining region 3 for antibody 16326
AREDWSDVDLRAFYFDS

SEQ ID NO: 32653 - protein, 10 aa, Homo sapiens
  light chain complementarity determining region 3 for antibody 16327
QKYDSAPPFT

SEQ ID NO: 32654 - protein, 19 aa, Homo sapiens
  heavy chain complementarity determining region 3 for antibody 16327
ARELDCDILTGYLGGLFQH

SEQ ID NO: 32655 - protein, 9 aa, Homo sapiens
  light chain complementarity determining region 3 for antibody 16328
QKYDSAPHT

SEQ ID NO: 32656 - protein, 19 aa, Homo sapiens
  heavy chain complementarity determining region 3 for antibody 16328
ARQVDYDGGDYYVYDAFDI

SEQ ID NO: 32657 - protein, 9 aa, Homo sapiens
  light chain complementarity determining region 3 for antibody 16329
QKYDSAPHT

SEQ ID NO: 32658 - protein, 19 aa, Homo sapiens
  heavy chain complementarity determining region 3 for antibody 16329
ARQVDYDGGDYYVSDASDI

SEQ ID NO: 32659 - protein, 9 aa, Homo sapiens
  light chain complementarity determining region 3 for antibody 16330
QKVNSYDYT

SEQ ID NO: 32660 - protein, 16 aa, Homo sapiens
  heavy chain complementarity determining region 3 for antibody 16330
ASTTGFSNKYYYGMDV

SEQ ID NO: 32661 - protein, 9 aa, Homo sapiens
  light chain complementarity determining region 3 for antibody 16331
QKVNNYPIT

SEQ ID NO: 32662 - protein, 14 aa, Homo sapiens
  heavy chain complementarity determining region 3 for antibody 16331
AKEKGGGGAAGLDD

SEQ ID NO: 32663 - protein, 9 aa, Homo sapiens
  light chain complementarity determining region 3 for antibody 16332
QKTYSTLWT

SEQ ID NO: 32664 - protein, 16 aa, Homo sapiens
  heavy chain complementarity determining region 3 for antibody 16332
AYTPPVVDTVKDGFHV

SEQ ID NO: 32665 - protein, 9 aa, Homo sapiens
  light chain complementarity determining region 3 for antibody 16333
QKSYSTPRT

SEQ ID NO: 32666 - protein, 14 aa, Homo sapiens
  heavy chain complementarity determining region 3 for antibody 16333
ARVQVDYSNYGCDS

SEQ ID NO: 32667 - protein, 9 aa, Homo sapiens
  light chain complementarity determining region 3 for antibody 16334
QKSYSTPFT

SEQ ID NO: 32668 - protein, 14 aa, Homo sapiens
  heavy chain complementarity determining region 3 for antibody 16334
ARLPGRYPRYGMDV

SEQ ID NO: 32669 - protein, 9 aa, Homo sapiens
  light chain complementarity determining region 3 for antibody 16335
QKSLTAPLT

SEQ ID NO: 32670 - protein, 17 aa, Homo sapiens
  heavy chain complementarity determining region 3 for antibody 16335
TRSIVSGSGWNAGGFDC

SEQ ID NO: 32671 - protein, 9 aa, Homo sapiens
  light chain complementarity determining region 3 for antibody 16336
QKNNSAPRT

SEQ ID NO: 32672 - protein, 20 aa, Homo sapiens
  heavy chain complementarity determining region 3 for antibody 16336
ARGGKYSSNFPYFYHYGLDV

SEQ ID NO: 32673 - protein, 9 aa, Homo sapiens
  light chain complementarity determining region 3 for antibody 16337
QKNNSAPPA

SEQ ID NO: 32674 - protein, 14 aa, Homo sapiens
  heavy chain complementarity determining region 3 for antibody 16337
ARPKSVGTRDAFDI

SEQ ID NO: 32675 - protein, 9 aa, Homo sapiens
  light chain complementarity determining region 3 for antibody 16338
QKNNSAPLT

SEQ ID NO: 32676 - protein, 17 aa, Homo sapiens
  heavy chain complementarity determining region 3 for antibody 16338
ARGSGSPGNYYYYGMDV

SEQ ID NO: 32677 - protein, 9 aa, Homo sapiens
  light chain complementarity determining region 3 for antibody 16339
QKHNSAPRT

SEQ ID NO: 32678 - protein, 20 aa, Homo sapiens
  heavy chain complementarity determining region 3 for antibody 16339
ARGGRYSDNFPYYHHYGMDV

SEQ ID NO: 32679 - protein, 9 aa, Homo sapiens
  light chain complementarity determining region 3 for antibody 16340
QKGNSFPFT

SEQ ID NO: 32680 - protein, 19 aa, Homo sapiens
  heavy chain complementarity determining region 3 for antibody 16340
ARTDCSGDTDRYYDFGMDV

SEQ ID NO: 32681 - protein, 9 aa, Homo sapiens
  light chain complementarity determining region 3 for antibody 16341
QKGHSLPFT

SEQ ID NO: 32682 - protein, 19 aa, Homo sapiens
  heavy chain complementarity determining region 3 for antibody 16341
ARSDYSGDTDRYYDYGMDV

SEQ ID NO: 32683 - protein, 9 aa, Homo sapiens
  light chain complementarity determining region 3 for antibody 16342
QKFSPYSYS

SEQ ID NO: 32684 - protein, 13 aa, Homo sapiens
  heavy chain complementarity determining region 3 for antibody 16342
VRIGAAAGTAFDY

SEQ ID NO: 32685 - protein, 11 aa, Homo sapiens
  light chain complementarity determining region 3 for antibody 16343
QKDNSAPPIFT

SEQ ID NO: 32686 - protein, 11 aa, Homo sapiens
  heavy chain complementarity determining region 3 for antibody 16343
ARDHEGYGYYY

SEQ ID NO: 32687 - protein, 9 aa, Homo sapiens
  light chain complementarity determining region 3 for antibody 16344
QKDNSAPPA

SEQ ID NO: 32688 - protein, 14 aa, Homo sapiens
  heavy chain complementarity determining region 3 for antibody 16344
ARPKSVGTRDAFDI

SEQ ID NO: 32689 - protein, 9 aa, Homo sapiens
  light chain complementarity determining region 3 for antibody 16345
QKDNSAPFT

SEQ ID NO: 32690 - protein, 15 aa, Homo sapiens
  heavy chain complementarity determining region 3 for antibody 16345
ARDRTVAAPNWYFDL

SEQ ID NO: 32691 - protein, 9 aa, Homo sapiens
  light chain complementarity determining region 3 for antibody 16346
QKCDDLPLP

SEQ ID NO: 32692 - protein, 26 aa, Homo sapiens
  heavy chain complementarity determining region 3 for antibody 16346
ARAAFDLSGAHNYYGSGIYYKGGSDS

SEQ ID NO: 32693 - protein, 9 aa, Homo sapiens
  light chain complementarity determining region 3 for antibody 16347
QKAYRFPLS

SEQ ID NO: 32694 - protein, 13 aa, Homo sapiens
  heavy chain complementarity determining region 3 for antibody 16347
TRTYGSGRNWFDP

SEQ ID NO: 32695 - protein, 9 aa, Homo sapiens
  light chain complementarity determining region 3 for antibody 16348
QKANSLPFT

SEQ ID NO: 32696 - protein, 19 aa, Homo sapiens
  heavy chain complementarity determining region 3 for antibody 16348
ARNDYSGDTDRYYDFGMDV

SEQ ID NO: 32697 - protein, 9 aa, Homo sapiens
  light chain complementarity determining region 3 for antibody 16349
QKANSFPRT

SEQ ID NO: 32698 - protein, 18 aa, Homo sapiens
  heavy chain complementarity determining region 3 for antibody 16349
ASARMYCAGDCYSDAFEI

SEQ ID NO: 32699 - protein, 9 aa, Homo sapiens
  light chain complementarity determining region 3 for antibody 16350
QHYYSTPRT

SEQ ID NO: 32700 - protein, 22 aa, Homo sapiens
  heavy chain complementarity determining region 3 for antibody 16350
ARDQIGGEAGDVLTDLHGSFDL

SEQ ID NO: 32701 - protein, 9 aa, Homo sapiens
  light chain complementarity determining region 3 for antibody 16351
QHYYFTPWT

SEQ ID NO: 32702 - protein, 19 aa, Homo sapiens
  heavy chain complementarity determining region 3 for antibody 16351
ARAKREQLVDSYSFHGLDV

SEQ ID NO: 32703 - protein, 9 aa, Homo sapiens
  light chain complementarity determining region 3 for antibody 16352
QHYYDTPRT

SEQ ID NO: 32704 - protein, 23 aa, Homo sapiens
  heavy chain complementarity determining region 3 for antibody 16352
ARGGPYRPAPYFYDISGPQYFQH

SEQ ID NO: 32705 - protein, 9 aa, Homo sapiens
  light chain complementarity determining region 3 for antibody 16353
QHYTSWPIT

SEQ ID NO: 32706 - protein, 15 aa, Homo sapiens
  heavy chain complementarity determining region 3 for antibody 16353
AKDWGVSGWYNWFDP

SEQ ID NO: 32707 - protein, 9 aa, Homo sapiens
  light chain complementarity determining region 3 for antibody 16354
QHYSTSPGT

SEQ ID NO: 32708 - protein, 18 aa, Homo sapiens
  heavy chain complementarity determining region 3 for antibody 16354
ARYLYHDYWGGLLQPFDN

SEQ ID NO: 32709 - protein, 10 aa, Homo sapiens
  light chain complementarity determining region 3 for antibody 16355
QHYSSLSLGT

SEQ ID NO: 32710 - protein, 25 aa, Homo sapiens
  heavy chain complementarity determining region 3 for antibody 16355
ARDIPTAVDVRDVLSGRDYYYGMDV

SEQ ID NO: 32711 - protein, 9 aa, Homo sapiens
  light chain complementarity determining region 3 for antibody 16356
QHYSRYPVT

SEQ ID NO: 32712 - protein, 11 aa, Homo sapiens
  heavy chain complementarity determining region 3 for antibody 16356
AREQTGYYPLY

SEQ ID NO: 32713 - protein, 10 aa, Homo sapiens
  light chain complementarity determining region 3 for antibody 16357
QHYNTYSGSI

SEQ ID NO: 32714 - protein, 19 aa, Homo sapiens
  heavy chain complementarity determining region 3 for antibody 16357
ARVRLLDYGDYVGASHSDF

SEQ ID NO: 32715 - protein, 10 aa, Homo sapiens
  light chain complementarity determining region 3 for antibody 16358
QHYNTYPSGP

SEQ ID NO: 32716 - protein, 17 aa, Homo sapiens
  heavy chain complementarity determining region 3 for antibody 16358
ARDQLQLPNYYYYGMGV

SEQ ID NO: 32717 - protein, 9 aa, Homo sapiens
  light chain complementarity determining region 3 for antibody 16359
QHYNSYPLT

SEQ ID NO: 32718 - protein, 19 aa, Homo sapiens
  heavy chain complementarity determining region 3 for antibody 16359
ARDHSDTTMEPGGEGCFDY

SEQ ID NO: 32719 - protein, 7 aa, Homo sapiens
  light chain complementarity determining region 3 for antibody 16360
QHYNSWP

SEQ ID NO: 32720 - protein, 12 aa, Homo sapiens
  heavy chain complementarity determining region 3 for antibody 16360
AKETASYGHADY

SEQ ID NO: 32721 - protein, 9 aa, Homo sapiens
  light chain complementarity determining region 3 for antibody 16361
QHYNSFPYT

SEQ ID NO: 32722 - protein, 17 aa, Homo sapiens
  heavy chain complementarity determining region 3 for antibody 16361
AREDWNDVDLREFYFDY

SEQ ID NO: 32723 - protein, 9 aa, Homo sapiens
  light chain complementarity determining region 3 for antibody 16362
QHYNSFPYT

SEQ ID NO: 32724 - protein, 17 aa, Homo sapiens
  heavy chain complementarity determining region 3 for antibody 16362
AREDFSDVDLRLFYLDY

SEQ ID NO: 32725 - protein, 9 aa, Homo sapiens
  light chain complementarity determining region 3 for antibody 16363
QHYNGRSLT

SEQ ID NO: 32726 - protein, 11 aa, Homo sapiens
  heavy chain complementarity determining region 3 for antibody 16363
ARIQQLGALAH

SEQ ID NO: 32727 - protein, 9 aa, Homo sapiens
  light chain complementarity determining region 3 for antibody 16364
QHYKTDPWT

SEQ ID NO: 32728 - protein, 10 aa, Homo sapiens
  heavy chain complementarity determining region 3 for antibody 16364
IRHEEYVRPY

SEQ ID NO: 32729 - protein, 8 aa, Homo sapiens
  light chain complementarity determining region 3 for antibody 16365
QHYKNWTL

SEQ ID NO: 32730 - protein, 18 aa, Homo sapiens
  heavy chain complementarity determining region 3 for antibody 16365
AKDAAVDVILGNRGYFDF

SEQ ID NO: 32731 - protein, 8 aa, Homo sapiens
  light chain complementarity determining region 3 for antibody 16366
QHYKDWPL

SEQ ID NO: 32732 - protein, 18 aa, Homo sapiens
  heavy chain complementarity determining region 3 for antibody 16366
AKDAAVDVILGNRGYFDF

SEQ ID NO: 32733 - protein, 10 aa, Homo sapiens
  light chain complementarity determining region 3 for antibody 16367
QHYHTYPSGT

SEQ ID NO: 32734 - protein, 17 aa, Homo sapiens
  heavy chain complementarity determining region 3 for antibody 16367
ARDQLQLPNYYYYGMGV

SEQ ID NO: 32735 - protein, 8 aa, Homo sapiens
  light chain complementarity determining region 3 for antibody 16368
QHYGTSGT

SEQ ID NO: 32736 - protein, 19 aa, Homo sapiens
  heavy chain complementarity determining region 3 for antibody 16368
ARSDSLSEELSSEPGAFDF

SEQ ID NO: 32737 - protein, 8 aa, Homo sapiens
  light chain complementarity determining region 3 for antibody 16369
QHYGTSGT

SEQ ID NO: 32738 - protein, 19 aa, Homo sapiens
  heavy chain complementarity determining region 3 for antibody 16369
ARSDLLSEELSSEPGACDF

SEQ ID NO: 32739 - protein, 8 aa, Homo sapiens
  light chain complementarity determining region 3 for antibody 16370
QHYGTSGT

SEQ ID NO: 32740 - protein, 19 aa, Homo sapiens
  heavy chain complementarity determining region 3 for antibody 16370
AGSDLLSEELSSEPGAFDF

SEQ ID NO: 32741 - protein, 8 aa, Homo sapiens
  light chain complementarity determining region 3 for antibody 16371
QHYGTSGP

SEQ ID NO: 32742 - protein, 19 aa, Homo sapiens
  heavy chain complementarity determining region 3 for antibody 16371
ARSDLLSEELSSEPGAFDF

SEQ ID NO: 32743 - protein, 8 aa, Homo sapiens
  light chain complementarity determining region 3 for antibody 16372
QHYGTSGA

SEQ ID NO: 32744 - protein, 19 aa, Homo sapiens
  heavy chain complementarity determining region 3 for antibody 16372
ARSDLLSEELSSEPGAFDF

SEQ ID NO: 32745 - protein, 9 aa, Homo sapiens
  light chain complementarity determining region 3 for antibody 16373
QHYGSSPWT

SEQ ID NO: 32746 - protein, 14 aa, Homo sapiens
  heavy chain complementarity determining region 3 for antibody 16373
AKDALVIGHDAFDV

SEQ ID NO: 32747 - protein, 9 aa, Homo sapiens
  light chain complementarity determining region 3 for antibody 16374
QHYGSSPGT

SEQ ID NO: 32748 - protein, 12 aa, Homo sapiens
  heavy chain complementarity determining region 3 for antibody 16374
AGGFLEWLLFEY

SEQ ID NO: 32749 - protein, 10 aa, Homo sapiens
  light chain complementarity determining region 3 for antibody 16375
QHYGSLSLGT

SEQ ID NO: 32750 - protein, 25 aa, Homo sapiens
  heavy chain complementarity determining region 3 for antibody 16375
ARDIPPAVDVRDVLSGRDYYYGMDV

SEQ ID NO: 32751 - protein, 8 aa, Homo sapiens
  light chain complementarity determining region 3 for antibody 16376
QHYGGSVT

SEQ ID NO: 32752 - protein, 20 aa, Homo sapiens
  heavy chain complementarity determining region 3 for antibody 16376
VRGQYCGGDCSPGPGHAFDI

SEQ ID NO: 32753 - protein, 10 aa, Homo sapiens
  light chain complementarity determining region 3 for antibody 16377
QHYFSVPPWT

SEQ ID NO: 32754 - protein, 12 aa, Homo sapiens
  heavy chain complementarity determining region 3 for antibody 16377
ARLLRFGDYFDY

SEQ ID NO: 32755 - protein, 9 aa, Homo sapiens
  light chain complementarity determining region 3 for antibody 16378
QHYDNPPLT

SEQ ID NO: 32756 - protein, 17 aa, Homo sapiens
  heavy chain complementarity determining region 3 for antibody 16378
VKGSTTMVRGDYYGMDV

SEQ ID NO: 32757 - protein, 10 aa, Homo sapiens
  light chain complementarity determining region 3 for antibody 16379
QHYDNLPRLP

SEQ ID NO: 32758 - protein, 18 aa, Homo sapiens
  heavy chain complementarity determining region 3 for antibody 16379
AKDPDSQYYYDISGYSDY

SEQ ID NO: 32759 - protein, 9 aa, Homo sapiens
  light chain complementarity determining region 3 for antibody 16380
QHYDNLPLT

SEQ ID NO: 32760 - protein, 17 aa, Homo sapiens
  heavy chain complementarity determining region 3 for antibody 16380
VKGSKTMVRGDYYGMDV

SEQ ID NO: 32761 - protein, 9 aa, Homo sapiens
  light chain complementarity determining region 3 for antibody 16381
QHYDNLPLT

SEQ ID NO: 32762 - protein, 17 aa, Homo sapiens
  heavy chain complementarity determining region 3 for antibody 16381
VKGATTMVRGDYYGMDV

SEQ ID NO: 32763 - protein, 11 aa, Homo sapiens
  light chain complementarity determining region 3 for antibody 16382
QHYDGFPPMYT

SEQ ID NO: 32764 - protein, 9 aa, Homo sapiens
  heavy chain complementarity determining region 3 for antibody 16382
VRFRAGQEA

SEQ ID NO: 32765 - protein, 11 aa, Homo sapiens
  light chain complementarity determining region 3 for antibody 16383
QHYDDLPPMYT

SEQ ID NO: 32766 - protein, 9 aa, Homo sapiens
  heavy chain complementarity determining region 3 for antibody 16383
VRFRAGQEA

SEQ ID NO: 32767 - protein, 9 aa, Homo sapiens
  light chain complementarity determining region 3 for antibody 16384
QHYDDLPFT

SEQ ID NO: 32768 - protein, 18 aa, Homo sapiens
  heavy chain complementarity determining region 3 for antibody 16384
VRLTRRFEELHTFYGMDV

SEQ ID NO: 32769 - protein, 9 aa, Homo sapiens
  light chain complementarity determining region 3 for antibody 16385
QHYDDLLFT

SEQ ID NO: 32770 - protein, 18 aa, Homo sapiens
  heavy chain complementarity determining region 3 for antibody 16385
VRLTRRFEELQTFYGMDV

SEQ ID NO: 32771 - protein, 9 aa, Homo sapiens
  light chain complementarity determining region 3 for antibody 16386
QHYDDLLFT

SEQ ID NO: 32772 - protein, 18 aa, Homo sapiens
  heavy chain complementarity determining region 3 for antibody 16386
VRLTRRFEELHTVYGMDV

SEQ ID NO: 32773 - protein, 9 aa, Homo sapiens
  light chain complementarity determining region 3 for antibody 16387
QHYDDLLFT

SEQ ID NO: 32774 - protein, 18 aa, Homo sapiens
  heavy chain complementarity determining region 3 for antibody 16387
VRLTRRFEELHTFCGMDV

SEQ ID NO: 32775 - protein, 9 aa, Homo sapiens
  light chain complementarity determining region 3 for antibody 16388
QHYDDLLFS

SEQ ID NO: 32776 - protein, 18 aa, Homo sapiens
  heavy chain complementarity determining region 3 for antibody 16388
VRLTRRFEELHTFYGMDV

SEQ ID NO: 32777 - protein, 9 aa, Homo sapiens
  light chain complementarity determining region 3 for antibody 16389
QHYDDILFT

SEQ ID NO: 32778 - protein, 18 aa, Homo sapiens
  heavy chain complementarity determining region 3 for antibody 16389
VRLTRRFEELHTFYGMDV

SEQ ID NO: 32779 - protein, 9 aa, Homo sapiens
  light chain complementarity determining region 3 for antibody 16390
QHYDDFLFT

SEQ ID NO: 32780 - protein, 18 aa, Homo sapiens
  heavy chain complementarity determining region 3 for antibody 16390
VRLTRRFEELHTFYGMDV

SEQ ID NO: 32781 - protein, 9 aa, Homo sapiens
  light chain complementarity determining region 3 for antibody 16391
QHYATSRGP

SEQ ID NO: 32782 - protein, 21 aa, Homo sapiens
  heavy chain complementarity determining region 3 for antibody 16391
ARDRGGDFHHGSAYYYRPLDY

SEQ ID NO: 32783 - protein, 9 aa, Homo sapiens
  light chain complementarity determining region 3 for antibody 16392
QHYADLLFT

SEQ ID NO: 32784 - protein, 18 aa, Homo sapiens
  heavy chain complementarity determining region 3 for antibody 16392
VRLTRRFEELHTFYGMDV

SEQ ID NO: 32785 - protein, 8 aa, Homo sapiens
  light chain complementarity determining region 3 for antibody 16393
QHSYRALS

SEQ ID NO: 32786 - protein, 10 aa, Homo sapiens
  heavy chain complementarity determining region 3 for antibody 16393
AHLSRGVNFF

SEQ ID NO: 32787 - protein, 9 aa, Homo sapiens
  light chain complementarity determining region 3 for antibody 16394
QHSYNTPLT

SEQ ID NO: 32788 - protein, 14 aa, Homo sapiens
  heavy chain complementarity determining region 3 for antibody 16394
ARAPPRGELSPLNH

SEQ ID NO: 32789 - protein, 9 aa, Homo sapiens
  light chain complementarity determining region 3 for antibody 16395
QHSYGTPWT

SEQ ID NO: 32790 - protein, 12 aa, Homo sapiens
  heavy chain complementarity determining region 3 for antibody 16395
ARVQAAGSGIDT

SEQ ID NO: 32791 - protein, 9 aa, Homo sapiens
  light chain complementarity determining region 3 for antibody 16396
QHSYDIPST

SEQ ID NO: 32792 - protein, 15 aa, Homo sapiens
  heavy chain complementarity determining region 3 for antibody 16396
ARDSTNWGSVWYFDL

SEQ ID NO: 32793 - protein, 9 aa, Homo sapiens
  light chain complementarity determining region 3 for antibody 16397
QHSLTAPLT

SEQ ID NO: 32794 - protein, 17 aa, Homo sapiens
  heavy chain complementarity determining region 3 for antibody 16397
TRSIVSGSGWNAGGFDC

SEQ ID NO: 32795 - protein, 9 aa, Homo sapiens
  light chain complementarity determining region 3 for antibody 16398
QHRSNWSGT

SEQ ID NO: 32796 - protein, 11 aa, Homo sapiens
  heavy chain complementarity determining region 3 for antibody 16398
ARGESYGDSDH

SEQ ID NO: 32797 - protein, 9 aa, Homo sapiens
  light chain complementarity determining region 3 for antibody 16399
QHRRNWPRT

SEQ ID NO: 32798 - protein, 13 aa, Homo sapiens
  heavy chain complementarity determining region 3 for antibody 16399
AGSYYPGDNWFDP

SEQ ID NO: 32799 - protein, 9 aa, Homo sapiens
  light chain complementarity determining region 3 for antibody 16400
QHRNNWWLT

SEQ ID NO: 32800 - protein, 22 aa, Homo sapiens
  heavy chain complementarity determining region 3 for antibody 16400
ARHSGYSNTWYMNYYYYYGMDV

SEQ ID NO: 32801 - protein, 9 aa, Homo sapiens
  light chain complementarity determining region 3 for antibody 16401
QHRNNWGRT

SEQ ID NO: 32802 - protein, 22 aa, Homo sapiens
  heavy chain complementarity determining region 3 for antibody 16401
ARHSGYSNTWYMNYYYYYGMDV

SEQ ID NO: 32803 - protein, 9 aa, Homo sapiens
  light chain complementarity determining region 3 for antibody 16402
QHRNNWGPT

SEQ ID NO: 32804 - protein, 22 aa, Homo sapiens
  heavy chain complementarity determining region 3 for antibody 16402
ARHSGYSNTWYMNYYYYYGMDV

SEQ ID NO: 32805 - protein, 9 aa, Homo sapiens
  light chain complementarity determining region 3 for antibody 16403
QHRNNWGLT

SEQ ID NO: 32806 - protein, 22 aa, Homo sapiens
  heavy chain complementarity determining region 3 for antibody 16403
ARYSGYSNTWYMNYYYYYGMDV

SEQ ID NO: 32807 - protein, 9 aa, Homo sapiens
  light chain complementarity determining region 3 for antibody 16404
QHRNNWGLT

SEQ ID NO: 32808 - protein, 22 aa, Homo sapiens
  heavy chain complementarity determining region 3 for antibody 16404
ARRSGYSNTWYMNYYYYYGMDV

SEQ ID NO: 32809 - protein, 9 aa, Homo sapiens
  light chain complementarity determining region 3 for antibody 16405
QHRNNWGLT

SEQ ID NO: 32810 - protein, 22 aa, Homo sapiens
  heavy chain complementarity determining region 3 for antibody 16405
ARHYGYSNTWYMNYYYYYGMDV

SEQ ID NO: 32811 - protein, 9 aa, Homo sapiens
  light chain complementarity determining region 3 for antibody 16406
QHRNNWGLT

SEQ ID NO: 32812 - protein, 22 aa, Homo sapiens
  heavy chain complementarity determining region 3 for antibody 16406
ARHSGYSNTWYMNYYYYYGTDV

SEQ ID NO: 32813 - protein, 9 aa, Homo sapiens
  light chain complementarity determining region 3 for antibody 16407
QHRNNWGLT

SEQ ID NO: 32814 - protein, 22 aa, Homo sapiens
  heavy chain complementarity determining region 3 for antibody 16407
ARHSGYSNTWYMNYYYYYGIDV

SEQ ID NO: 32815 - protein, 9 aa, Homo sapiens
  light chain complementarity determining region 3 for antibody 16408
QHRNNWGLT

SEQ ID NO: 32816 - protein, 21 aa, Homo sapiens
  heavy chain complementarity determining region 3 for antibody 16408
ARHSGYSNTWYMNYYYYGMDV

SEQ ID NO: 32817 - protein, 9 aa, Homo sapiens
  light chain complementarity determining region 3 for antibody 16409
QHRNNWGLT

SEQ ID NO: 32818 - protein, 22 aa, Homo sapiens
  heavy chain complementarity determining region 3 for antibody 16409
ARHSGYSNTWYMNYYYYDGMDV

SEQ ID NO: 32819 - protein, 9 aa, Homo sapiens
  light chain complementarity determining region 3 for antibody 16410
QHRNNWGLT

SEQ ID NO: 32820 - protein, 22 aa, Homo sapiens
  heavy chain complementarity determining region 3 for antibody 16410
ARHSGYSNNWYMNYYYYYGMDV

SEQ ID NO: 32821 - protein, 9 aa, Homo sapiens
  light chain complementarity determining region 3 for antibody 16411
QHRNNWGLT

SEQ ID NO: 32822 - protein, 22 aa, Homo sapiens
  heavy chain complementarity determining region 3 for antibody 16411
ARHSGDSNTWYMNYYYYYGMDV

SEQ ID NO: 32823 - protein, 9 aa, Homo sapiens
  light chain complementarity determining region 3 for antibody 16412
QHRNNWGLT

SEQ ID NO: 32824 - protein, 22 aa, Homo sapiens
  heavy chain complementarity determining region 3 for antibody 16412
ARHAGYSNTWYMNYYYYYGMDV

SEQ ID NO: 32825 - protein, 9 aa, Homo sapiens
  light chain complementarity determining region 3 for antibody 16413
QHRNNWGLP

SEQ ID NO: 32826 - protein, 22 aa, Homo sapiens
  heavy chain complementarity determining region 3 for antibody 16413
ARHSGYSNTWYMNYYYYYGMDV

SEQ ID NO: 32827 - protein, 9 aa, Homo sapiens
  light chain complementarity determining region 3 for antibody 16414
QHRHNWGLT

SEQ ID NO: 32828 - protein, 22 aa, Homo sapiens
  heavy chain complementarity determining region 3 for antibody 16414
ARHSGYSNTWYMNYYYYYGMDV

SEQ ID NO: 32829 - protein, 9 aa, Homo sapiens
  light chain complementarity determining region 3 for antibody 16415
QHRDHFSIT

SEQ ID NO: 32830 - protein, 15 aa, Homo sapiens
  heavy chain complementarity determining region 3 for antibody 16415
ARDPTAAGFPAHFDY

SEQ ID NO: 32831 - protein, 9 aa, Homo sapiens
  light chain complementarity determining region 3 for antibody 16416
QHNYSPPPA

SEQ ID NO: 32832 - protein, 11 aa, Homo sapiens
  heavy chain complementarity determining region 3 for antibody 16416
TRDPPGNGMDV

SEQ ID NO: 32833 - protein, 9 aa, Homo sapiens
  light chain complementarity determining region 3 for antibody 16417
QHNYRPSPA

SEQ ID NO: 32834 - protein, 11 aa, Homo sapiens
  heavy chain complementarity determining region 3 for antibody 16417
TREPPGNGMDV

SEQ ID NO: 32835 - protein, 9 aa, Homo sapiens
  light chain complementarity determining region 3 for antibody 16418
QHNYRPSPA

SEQ ID NO: 32836 - protein, 11 aa, Homo sapiens
  heavy chain complementarity determining region 3 for antibody 16418
TRDPPGNGVDV

SEQ ID NO: 32837 - protein, 9 aa, Homo sapiens
  light chain complementarity determining region 3 for antibody 16419
QHNYRPSPA

SEQ ID NO: 32838 - protein, 11 aa, Homo sapiens
  heavy chain complementarity determining region 3 for antibody 16419
TRDPPGNGMAV

SEQ ID NO: 32839 - protein, 9 aa, Homo sapiens
  light chain complementarity determining region 3 for antibody 16420
QHNYRPSPA

SEQ ID NO: 32840 - protein, 11 aa, Homo sapiens
  heavy chain complementarity determining region 3 for antibody 16420
TRDPPGNGLDV

SEQ ID NO: 32841 - protein, 9 aa, Homo sapiens
  light chain complementarity determining region 3 for antibody 16421
QHNYRPSPA

SEQ ID NO: 32842 - protein, 11 aa, Homo sapiens
  heavy chain complementarity determining region 3 for antibody 16421
TRDPPGNCMDV

SEQ ID NO: 32843 - protein, 9 aa, Homo sapiens
  light chain complementarity determining region 3 for antibody 16422
QHNYRPSPA

SEQ ID NO: 32844 - protein, 11 aa, Homo sapiens
  heavy chain complementarity determining region 3 for antibody 16422
TRDPPGDGMDV

SEQ ID NO: 32845 - protein, 9 aa, Homo sapiens
  light chain complementarity determining region 3 for antibody 16423
QHNYRPSPA

SEQ ID NO: 32846 - protein, 11 aa, Homo sapiens
  heavy chain complementarity determining region 3 for antibody 16423
TRDAPGNGMDV

SEQ ID NO: 32847 - protein, 9 aa, Homo sapiens
  light chain complementarity determining region 3 for antibody 16424
QHNYRPSPA

SEQ ID NO: 32848 - protein, 11 aa, Homo sapiens
  heavy chain complementarity determining region 3 for antibody 16424
TRAPPGNGMDV

SEQ ID NO: 32849 - protein, 9 aa, Homo sapiens
  light chain complementarity determining region 3 for antibody 16425
QHNYRPSAA

SEQ ID NO: 32850 - protein, 11 aa, Homo sapiens
  heavy chain complementarity determining region 3 for antibody 16425
TRDPPGNGMDV

SEQ ID NO: 32851 - protein, 9 aa, Homo sapiens
  light chain complementarity determining region 3 for antibody 16426
QHNYRLSPA

SEQ ID NO: 32852 - protein, 11 aa, Homo sapiens
  heavy chain complementarity determining region 3 for antibody 16426
TRDPPGNGMDV

SEQ ID NO: 32853 - protein, 9 aa, Homo sapiens
  light chain complementarity determining region 3 for antibody 16427
QHNYKPSPA

SEQ ID NO: 32854 - protein, 11 aa, Homo sapiens
  heavy chain complementarity determining region 3 for antibody 16427
TRDPPGNGMDV

SEQ ID NO: 32855 - protein, 9 aa, Homo sapiens
  light chain complementarity determining region 3 for antibody 16428
QHNYIPSPT

SEQ ID NO: 32856 - protein, 11 aa, Homo sapiens
  heavy chain complementarity determining region 3 for antibody 16428
TRDPPGNGMDV

SEQ ID NO: 32857 - protein, 9 aa, Homo sapiens
  light chain complementarity determining region 3 for antibody 16429
QHNYGPSPA

SEQ ID NO: 32858 - protein, 11 aa, Homo sapiens
  heavy chain complementarity determining region 3 for antibody 16429
TRDPPGNGMDV

SEQ ID NO: 32859 - protein, 9 aa, Homo sapiens
  light chain complementarity determining region 3 for antibody 16430
QHNSRPSPA

SEQ ID NO: 32860 - protein, 11 aa, Homo sapiens
  heavy chain complementarity determining region 3 for antibody 16430
TRDPPGNGMDV

SEQ ID NO: 32861 - protein, 11 aa, Homo sapiens
  light chain complementarity determining region 3 for antibody 16431
QHNGSSPPGNT

SEQ ID NO: 32862 - protein, 17 aa, Homo sapiens
  heavy chain complementarity determining region 3 for antibody 16431
ARETYDVLTGSNFGMDV

SEQ ID NO: 32863 - protein, 11 aa, Homo sapiens
  light chain complementarity determining region 3 for antibody 16432
QHNGSSPPEST

SEQ ID NO: 32864 - protein, 17 aa, Homo sapiens
  heavy chain complementarity determining region 3 for antibody 16432
ARENYDVLTGSNYGMDV

SEQ ID NO: 32865 - protein, 11 aa, Homo sapiens
  light chain complementarity determining region 3 for antibody 16433
QHNGSSPPENT

SEQ ID NO: 32866 - protein, 17 aa, Homo sapiens
  heavy chain complementarity determining region 3 for antibody 16433
ARETYDVLTGSNCGMDV

SEQ ID NO: 32867 - protein, 11 aa, Homo sapiens
  light chain complementarity determining region 3 for antibody 16434
QHNGSSPPENT

SEQ ID NO: 32868 - protein, 17 aa, Homo sapiens
  heavy chain complementarity determining region 3 for antibody 16434
ARENYDVLTGPNYGMDV

SEQ ID NO: 32869 - protein, 11 aa, Homo sapiens
  light chain complementarity determining region 3 for antibody 16435
QHNGSSPPENN

SEQ ID NO: 32870 - protein, 17 aa, Homo sapiens
  heavy chain complementarity determining region 3 for antibody 16435
ARETYDVLTGSNFGMDV

SEQ ID NO: 32871 - protein, 11 aa, Homo sapiens
  light chain complementarity determining region 3 for antibody 16436
QHNGSSPPENN

SEQ ID NO: 32872 - protein, 17 aa, Homo sapiens
  heavy chain complementarity determining region 3 for antibody 16436
ARENYDVLTGANYGMDV

SEQ ID NO: 32873 - protein, 11 aa, Homo sapiens
  light chain complementarity determining region 3 for antibody 16437
QHNGSSPPEHT

SEQ ID NO: 32874 - protein, 17 aa, Homo sapiens
  heavy chain complementarity determining region 3 for antibody 16437
ARENYDVLTGSNYGMDV

SEQ ID NO: 32875 - protein, 11 aa, Homo sapiens
  light chain complementarity determining region 3 for antibody 16438
QHNGSSPPANT

SEQ ID NO: 32876 - protein, 17 aa, Homo sapiens
  heavy chain complementarity determining region 3 for antibody 16438
ARENYDVLTGANYGMDV

SEQ ID NO: 32877 - protein, 11 aa, Homo sapiens
  light chain complementarity determining region 3 for antibody 16439
QHNGSPPPENT

SEQ ID NO: 32878 - protein, 17 aa, Homo sapiens
  heavy chain complementarity determining region 3 for antibody 16439
ARENYDVLTGSNYGMDV

SEQ ID NO: 32879 - protein, 11 aa, Homo sapiens
  light chain complementarity determining region 3 for antibody 16440
QHNGRSPPENT

SEQ ID NO: 32880 - protein, 17 aa, Homo sapiens
  heavy chain complementarity determining region 3 for antibody 16440
ARENYDVLTGSNYGMDV

SEQ ID NO: 32881 - protein, 10 aa, Homo sapiens
  light chain complementarity determining region 3 for antibody 16441
QHLSIYPALT

SEQ ID NO: 32882 - protein, 17 aa, Homo sapiens
  heavy chain complementarity determining region 3 for antibody 16441
AKDLGAGAKDYYYGMDV

SEQ ID NO: 32883 - protein, 10 aa, Homo sapiens
  light chain complementarity determining region 3 for antibody 16442
QHLSIYHELT

SEQ ID NO: 32884 - protein, 17 aa, Homo sapiens
  heavy chain complementarity determining region 3 for antibody 16442
AKDLGAGAKDYYYGMDV

SEQ ID NO: 32885 - protein, 9 aa, Homo sapiens
  light chain complementarity determining region 3 for antibody 16443
QHLNTYPLT

SEQ ID NO: 32886 - protein, 17 aa, Homo sapiens
  heavy chain complementarity determining region 3 for antibody 16443
AKDLSGIHYDIHHGLDV

SEQ ID NO: 32887 - protein, 11 aa, Homo sapiens
  light chain complementarity determining region 3 for antibody 16444
QHLNSYSGGLT

SEQ ID NO: 32888 - protein, 19 aa, Homo sapiens
  heavy chain complementarity determining region 3 for antibody 16444
TRGGACSGDNCYSYYGTDV

SEQ ID NO: 32889 - protein, 8 aa, Homo sapiens
  light chain complementarity determining region 3 for antibody 16445
QHLNSHPT

SEQ ID NO: 32890 - protein, 11 aa, Homo sapiens
  heavy chain complementarity determining region 3 for antibody 16445
GRSHTENAFDV

SEQ ID NO: 32891 - protein, 8 aa, Homo sapiens
  light chain complementarity determining region 3 for antibody 16446
QHLNSHPT

SEQ ID NO: 32892 - protein, 11 aa, Homo sapiens
  heavy chain complementarity determining region 3 for antibody 16446
ARSRTENAFDV

SEQ ID NO: 32893 - protein, 8 aa, Homo sapiens
  light chain complementarity determining region 3 for antibody 16447
QHLNSHPT

SEQ ID NO: 32894 - protein, 11 aa, Homo sapiens
  heavy chain complementarity determining region 3 for antibody 16447
ARSHTENTFDV

SEQ ID NO: 32895 - protein, 8 aa, Homo sapiens
  light chain complementarity determining region 3 for antibody 16448
QHLNSHPT

SEQ ID NO: 32896 - protein, 11 aa, Homo sapiens
  heavy chain complementarity determining region 3 for antibody 16448
ARSHSENAFGV

SEQ ID NO: 32897 - protein, 9 aa, Homo sapiens
  light chain complementarity determining region 3 for antibody 16449
QHHSNWPFT

SEQ ID NO: 32898 - protein, 13 aa, Homo sapiens
  heavy chain complementarity determining region 3 for antibody 16449
ARIQIVGAREFEY

SEQ ID NO: 32899 - protein, 9 aa, Homo sapiens
  light chain complementarity determining region 3 for antibody 16450
QHHNNWGLT

SEQ ID NO: 32900 - protein, 22 aa, Homo sapiens
  heavy chain complementarity determining region 3 for antibody 16450
ARHSGYSNTWYMNYYYYYGMDV

SEQ ID NO: 32901 - protein, 11 aa, Homo sapiens
  light chain complementarity determining region 3 for antibody 16451
QHHGSSPPENT

SEQ ID NO: 32902 - protein, 17 aa, Homo sapiens
  heavy chain complementarity determining region 3 for antibody 16451
ARENYDVLTGANYGMDV

SEQ ID NO: 32903 - protein, 9 aa, Homo sapiens
  light chain complementarity determining region 3 for antibody 16452
QHGYSFPFT

SEQ ID NO: 32904 - protein, 19 aa, Homo sapiens
  heavy chain complementarity determining region 3 for antibody 16452
ARSDYSGDTDRYYDHGMDV

SEQ ID NO: 32905 - protein, 9 aa, Homo sapiens
  light chain complementarity determining region 3 for antibody 16453
QHFNTYSLT

SEQ ID NO: 32906 - protein, 17 aa, Homo sapiens
  heavy chain complementarity determining region 3 for antibody 16453
AKDLSGIHYDIHHGLDV

SEQ ID NO: 32907 - protein, 9 aa, Homo sapiens
  light chain complementarity determining region 3 for antibody 16454
QHFNTYPLT

SEQ ID NO: 32908 - protein, 17 aa, Homo sapiens
  heavy chain complementarity determining region 3 for antibody 16454
AKDLSGVHYDIHHGLDV

SEQ ID NO: 32909 - protein, 9 aa, Homo sapiens
  light chain complementarity determining region 3 for antibody 16455
QHFNTYPLT

SEQ ID NO: 32910 - protein, 17 aa, Homo sapiens
  heavy chain complementarity determining region 3 for antibody 16455
AKDLSGIQYDIHHGLDV

SEQ ID NO: 32911 - protein, 9 aa, Homo sapiens
  light chain complementarity determining region 3 for antibody 16456
QHFNTYPLT

SEQ ID NO: 32912 - protein, 17 aa, Homo sapiens
  heavy chain complementarity determining region 3 for antibody 16456
AKDLSGIHYDIHHGLYV

SEQ ID NO: 32913 - protein, 9 aa, Homo sapiens
  light chain complementarity determining region 3 for antibody 16457
QHFNTYPLS

SEQ ID NO: 32914 - protein, 17 aa, Homo sapiens
  heavy chain complementarity determining region 3 for antibody 16457
AKDLSGIHYDIHHGLDV

SEQ ID NO: 32915 - protein, 10 aa, Homo sapiens
  light chain complementarity determining region 3 for antibody 16458
QHFDNPFPFT

SEQ ID NO: 32916 - protein, 13 aa, Homo sapiens
  heavy chain complementarity determining region 3 for antibody 16458
ARDSVGDSGYGST

SEQ ID NO: 32917 - protein, 9 aa, Homo sapiens
  light chain complementarity determining region 3 for antibody 16459
QHFDGSHWT

SEQ ID NO: 32918 - protein, 16 aa, Homo sapiens
  heavy chain complementarity determining region 3 for antibody 16459
ARDHLVPTMGRNWFDP

SEQ ID NO: 32919 - protein, 9 aa, Homo sapiens
  light chain complementarity determining region 3 for antibody 16460
QHCYSTPLT

SEQ ID NO: 32920 - protein, 14 aa, Homo sapiens
  heavy chain complementarity determining region 3 for antibody 16460
ARDRNNNWWGGIDY

SEQ ID NO: 32921 - protein, 9 aa, Homo sapiens
  light chain complementarity determining region 3 for antibody 16461
QHCNNWGLT

SEQ ID NO: 32922 - protein, 22 aa, Homo sapiens
  heavy chain complementarity determining region 3 for antibody 16461
ARHSGYSNTWYMNYYYYYGMDV

SEQ ID NO: 32923 - protein, 9 aa, Homo sapiens
  light chain complementarity determining region 3 for antibody 16462
QHCGHFSIT

SEQ ID NO: 32924 - protein, 15 aa, Homo sapiens
  heavy chain complementarity determining region 3 for antibody 16462
ARDPTAAGFPAHFDY

SEQ ID NO: 32925 - protein, 9 aa, Homo sapiens
  light chain complementarity determining region 3 for antibody 16463
QHCDHFSLT

SEQ ID NO: 32926 - protein, 15 aa, Homo sapiens
  heavy chain complementarity determining region 3 for antibody 16463
ARDPTAAGFPAHFDY

SEQ ID NO: 32927 - protein, 9 aa, Homo sapiens
  light chain complementarity determining region 3 for antibody 16464
QHCDHFSIT

SEQ ID NO: 32928 - protein, 15 aa, Homo sapiens
  heavy chain complementarity determining region 3 for antibody 16464
ARGPTAAGFPAHFDY

SEQ ID NO: 32929 - protein, 9 aa, Homo sapiens
  light chain complementarity determining region 3 for antibody 16465
QHCDHFSIT

SEQ ID NO: 32930 - protein, 15 aa, Homo sapiens
  heavy chain complementarity determining region 3 for antibody 16465
ARDPTEAGFPAHFDY

SEQ ID NO: 32931 - protein, 9 aa, Homo sapiens
  light chain complementarity determining region 3 for antibody 16466
QHCDHFSIT

SEQ ID NO: 32932 - protein, 15 aa, Homo sapiens
  heavy chain complementarity determining region 3 for antibody 16466
ARDPTAAGFPAHFGY

SEQ ID NO: 32933 - protein, 9 aa, Homo sapiens
  light chain complementarity determining region 3 for antibody 16467
QHCDHFSIT

SEQ ID NO: 32934 - protein, 15 aa, Homo sapiens
  heavy chain complementarity determining region 3 for antibody 16467
ARDPAAAGFPAHFDY

SEQ ID NO: 32935 - protein, 9 aa, Homo sapiens
  light chain complementarity determining region 3 for antibody 16468
QHCDHFPIT

SEQ ID NO: 32936 - protein, 15 aa, Homo sapiens
  heavy chain complementarity determining region 3 for antibody 16468
ARDPTAAGFPAHFDY

SEQ ID NO: 32937 - protein, 9 aa, Homo sapiens
  light chain complementarity determining region 3 for antibody 16469
QGYNNDPWT

SEQ ID NO: 32938 - protein, 15 aa, Homo sapiens
  heavy chain complementarity determining region 3 for antibody 16469
GRHRYSSSQGYGMDV

SEQ ID NO: 32939 - protein, 9 aa, Homo sapiens
  light chain complementarity determining region 3 for antibody 16470
QGYNNAPWT

SEQ ID NO: 32940 - protein, 15 aa, Homo sapiens
  heavy chain complementarity determining region 3 for antibody 16470
GRHRYSSSQGYGVDV

SEQ ID NO: 32941 - protein, 9 aa, Homo sapiens
  light chain complementarity determining region 3 for antibody 16471
QGYNNAPWK

SEQ ID NO: 32942 - protein, 15 aa, Homo sapiens
  heavy chain complementarity determining region 3 for antibody 16471
GRHRYSSSQGYGMDV

SEQ ID NO: 32943 - protein, 9 aa, Homo sapiens
  light chain complementarity determining region 3 for antibody 16472
QGYNNAPWA

SEQ ID NO: 32944 - protein, 15 aa, Homo sapiens
  heavy chain complementarity determining region 3 for antibody 16472
GRHRYSSSQGYGMDV

SEQ ID NO: 32945 - protein, 10 aa, Homo sapiens
  light chain complementarity determining region 3 for antibody 16473
QGYGSSPPIT

SEQ ID NO: 32946 - protein, 22 aa, Homo sapiens
  heavy chain complementarity determining region 3 for antibody 16473
ARDGSGDYDAALGDYYYYGMDV

SEQ ID NO: 32947 - protein, 10 aa, Homo sapiens
  light chain complementarity determining region 3 for antibody 16474
QGYGSSPPIP

SEQ ID NO: 32948 - protein, 22 aa, Homo sapiens
  heavy chain complementarity determining region 3 for antibody 16474
ARDGYGDYDAALGDYYYYGMDV

SEQ ID NO: 32949 - protein, 9 aa, Homo sapiens
  light chain complementarity determining region 3 for antibody 16475
QGDNNAPWT

SEQ ID NO: 32950 - protein, 15 aa, Homo sapiens
  heavy chain complementarity determining region 3 for antibody 16475
GRHRYSSAQGYGMDV

SEQ ID NO: 32951 - protein, 9 aa, Homo sapiens
  light chain complementarity determining region 3 for antibody 16476
QEYYSTPYS

SEQ ID NO: 32952 - protein, 13 aa, Homo sapiens
  heavy chain complementarity determining region 3 for antibody 16476
AKATSDGSGALHY

SEQ ID NO: 32953 - protein, 10 aa, Homo sapiens
  light chain complementarity determining region 3 for antibody 16477
QEYYSTPPLT

SEQ ID NO: 32954 - protein, 20 aa, Homo sapiens
  heavy chain complementarity determining region 3 for antibody 16477
ARHFRETLGGQVREFAAFDI

SEQ ID NO: 32955 - protein, 9 aa, Homo sapiens
  light chain complementarity determining region 3 for antibody 16478
QEYNSYSLT

SEQ ID NO: 32956 - protein, 7 aa, Homo sapiens
  heavy chain complementarity determining region 3 for antibody 16478
ARVPGCS

SEQ ID NO: 32957 - protein, 9 aa, Homo sapiens
  light chain complementarity determining region 3 for antibody 16479
QEYDSYSAT

SEQ ID NO: 32958 - protein, 12 aa, Homo sapiens
  heavy chain complementarity determining region 3 for antibody 16479
TTGGAVSLSGAH

SEQ ID NO: 32959 - protein, 11 aa, Homo sapiens
  light chain complementarity determining region 3 for antibody 16480
QEYDRLPPRVT

SEQ ID NO: 32960 - protein, 22 aa, Homo sapiens
  heavy chain complementarity determining region 3 for antibody 16480
AHTQKHSYAAFSGAFYYYALDV

SEQ ID NO: 32961 - protein, 9 aa, Homo sapiens
  light chain complementarity determining region 3 for antibody 16481
QEYDNYSAT

SEQ ID NO: 32962 - protein, 12 aa, Homo sapiens
  heavy chain complementarity determining region 3 for antibody 16481
ATGGAVSLSGAH

SEQ ID NO: 32963 - protein, 11 aa, Homo sapiens
  light chain complementarity determining region 3 for antibody 16482
QESYTTPPRPT

SEQ ID NO: 32964 - protein, 13 aa, Homo sapiens
  heavy chain complementarity determining region 3 for antibody 16482
TRISVTHYYGMDV

SEQ ID NO: 32965 - protein, 11 aa, Homo sapiens
  light chain complementarity determining region 3 for antibody 16483
QESYTTPPRLP

SEQ ID NO: 32966 - protein, 13 aa, Homo sapiens
  heavy chain complementarity determining region 3 for antibody 16483
TRISVTHYYGMDV

SEQ ID NO: 32967 - protein, 10 aa, Homo sapiens
  light chain complementarity determining region 3 for antibody 16484
QESYSTPPLT

SEQ ID NO: 32968 - protein, 27 aa, Homo sapiens
  heavy chain complementarity determining region 3 for antibody 16484
ARPRRVLSLGESFAPPTGLWDYYGMDV

SEQ ID NO: 32969 - protein, 10 aa, Homo sapiens
  light chain complementarity determining region 3 for antibody 16485
QESYSTPPFT

SEQ ID NO: 32970 - protein, 27 aa, Homo sapiens
  heavy chain complementarity determining region 3 for antibody 16485
ARPRRVLSLGESFASPTGLWDYYGLDV

SEQ ID NO: 32971 - protein, 10 aa, Homo sapiens
  light chain complementarity determining region 3 for antibody 16486
QESYSTPPFT

SEQ ID NO: 32972 - protein, 27 aa, Homo sapiens
  heavy chain complementarity determining region 3 for antibody 16486
ARPRRVLSLGESFAPPTGLWGYYGMDV

SEQ ID NO: 32973 - protein, 10 aa, Homo sapiens
  light chain complementarity determining region 3 for antibody 16487
QESYSTPPFT

SEQ ID NO: 32974 - protein, 27 aa, Homo sapiens
  heavy chain complementarity determining region 3 for antibody 16487
ARPRRVLSLGESFAPPTGLWDYYGVDV

SEQ ID NO: 32975 - protein, 10 aa, Homo sapiens
  light chain complementarity determining region 3 for antibody 16488
QESYSTPPFT

SEQ ID NO: 32976 - protein, 27 aa, Homo sapiens
  heavy chain complementarity determining region 3 for antibody 16488
ARPRRVLSLGESFAPPTGLRDYYGMDV

SEQ ID NO: 32977 - protein, 10 aa, Homo sapiens
  light chain complementarity determining region 3 for antibody 16489
QESYSTPPFT

SEQ ID NO: 32978 - protein, 27 aa, Homo sapiens
  heavy chain complementarity determining region 3 for antibody 16489
ARPRRVLSLGESCAPPTGLWDYYGMDV

SEQ ID NO: 32979 - protein, 10 aa, Homo sapiens
  light chain complementarity determining region 3 for antibody 16490
QESYSTPPFT

SEQ ID NO: 32980 - protein, 27 aa, Homo sapiens
  heavy chain complementarity determining region 3 for antibody 16490
ARPRRVLALGESFAPPTGLWDYYGMDV

SEQ ID NO: 32981 - protein, 10 aa, Homo sapiens
  light chain complementarity determining region 3 for antibody 16491
QESYSTPPFT

SEQ ID NO: 32982 - protein, 27 aa, Homo sapiens
  heavy chain complementarity determining region 3 for antibody 16491
ARPRRVLALGESFAPPTGLWDYYGLDV

SEQ ID NO: 32983 - protein, 10 aa, Homo sapiens
  light chain complementarity determining region 3 for antibody 16492
QESYSTPPFT

SEQ ID NO: 32984 - protein, 27 aa, Homo sapiens
  heavy chain complementarity determining region 3 for antibody 16492
ARPRGVLSLGESFAPPTGLWDYYGMDV

SEQ ID NO: 32985 - protein, 10 aa, Homo sapiens
  light chain complementarity determining region 3 for antibody 16493
QESYSTPPFP

SEQ ID NO: 32986 - protein, 27 aa, Homo sapiens
  heavy chain complementarity determining region 3 for antibody 16493
ARPRRVLSLGESFAPPTGLWDYYGMDV

SEQ ID NO: 32987 - protein, 10 aa, Homo sapiens
  light chain complementarity determining region 3 for antibody 16494
QESYSTPPFP

SEQ ID NO: 32988 - protein, 27 aa, Homo sapiens
  heavy chain complementarity determining region 3 for antibody 16494
ARPRRVLSLGESFAPPTGLWDYYGLDV

SEQ ID NO: 32989 - protein, 10 aa, Homo sapiens
  light chain complementarity determining region 3 for antibody 16495
QERYSTPPFT

SEQ ID NO: 32990 - protein, 27 aa, Homo sapiens
  heavy chain complementarity determining region 3 for antibody 16495
ARPRRVLSLGESFAPPTGLWDYYGMDV

SEQ ID NO: 32991 - protein, 10 aa, Homo sapiens
  light chain complementarity determining region 3 for antibody 16496
QEANSFPLLA

SEQ ID NO: 32992 - protein, 15 aa, Homo sapiens
  heavy chain complementarity determining region 3 for antibody 16496
ARADYFGSGNYHPDY

SEQ ID NO: 32993 - protein, 7 aa, Homo sapiens
  light chain complementarity determining region 3 for antibody 16497
QEANSFP

SEQ ID NO: 32994 - protein, 19 aa, Homo sapiens
  heavy chain complementarity determining region 3 for antibody 16497
AKEDVTVCGVPEYYYGMDV

SEQ ID NO: 32995 - protein, 10 aa, Homo sapiens
  light chain complementarity determining region 3 for antibody 16498
QDYNDWPPIT

SEQ ID NO: 32996 - protein, 16 aa, Homo sapiens
  heavy chain complementarity determining region 3 for antibody 16498
ARLKRTSYSTGWFFQY

SEQ ID NO: 32997 - protein, 9 aa, Homo sapiens
  light chain complementarity determining region 3 for antibody 16499
PQYYFTPWT

SEQ ID NO: 32998 - protein, 19 aa, Homo sapiens
  heavy chain complementarity determining region 3 for antibody 16499
ARAKREQLVDSYSFHGLDV

SEQ ID NO: 32999 - protein, 9 aa, Homo sapiens
  light chain complementarity determining region 3 for antibody 16500
PQYSTSPGT

SEQ ID NO: 33000 - protein, 18 aa, Homo sapiens
  heavy chain complementarity determining region 3 for antibody 16500
ARYLYHDYWGGLLQPFDN

SEQ ID NO: 33001 - protein, 9 aa, Homo sapiens
  light chain complementarity determining region 3 for antibody 16501
PQYSTFPYT

SEQ ID NO: 33002 - protein, 17 aa, Homo sapiens
  heavy chain complementarity determining region 3 for antibody 16501
AREVWNDVDLRQYYFDY

SEQ ID NO: 33003 - protein, 9 aa, Homo sapiens
  light chain complementarity determining region 3 for antibody 16502
PQYSSLPYT

SEQ ID NO: 33004 - protein, 17 aa, Homo sapiens
  heavy chain complementarity determining region 3 for antibody 16502
AREQWNDVDLRQFYFDY

SEQ ID NO: 33005 - protein, 9 aa, Homo sapiens
  light chain complementarity determining region 3 for antibody 16503
PQYSSFPYT

SEQ ID NO: 33006 - protein, 17 aa, Homo sapiens
  heavy chain complementarity determining region 3 for antibody 16503
AREDWNDVDLRQWYFDS

SEQ ID NO: 33007 - protein, 8 aa, Homo sapiens
  light chain complementarity determining region 3 for antibody 16504
PQYNSYSA

SEQ ID NO: 33008 - protein, 15 aa, Homo sapiens
  heavy chain complementarity determining region 3 for antibody 16504
ARAYSSGWYPESFDF

SEQ ID NO: 33009 - protein, 9 aa, Homo sapiens
  light chain complementarity determining region 3 for antibody 16505
PQYNSYPYT

SEQ ID NO: 33010 - protein, 19 aa, Homo sapiens
  heavy chain complementarity determining region 3 for antibody 16505
ARDQSSSYGDYYYYYGMDV

SEQ ID NO: 33011 - protein, 9 aa, Homo sapiens
  light chain complementarity determining region 3 for antibody 16506
PQYNSYPGT

SEQ ID NO: 33012 - protein, 17 aa, Homo sapiens
  heavy chain complementarity determining region 3 for antibody 16506
ARQIDIVVEIVSDGLDV

SEQ ID NO: 33013 - protein, 9 aa, Homo sapiens
  light chain complementarity determining region 3 for antibody 16507
PQYNSFPPT

SEQ ID NO: 33014 - protein, 19 aa, Homo sapiens
  heavy chain complementarity determining region 3 for antibody 16507
AKDPHSVVIGELLEPLFDS

SEQ ID NO: 33015 - protein, 9 aa, Homo sapiens
  light chain complementarity determining region 3 for antibody 16508
PQYNNWPRT

SEQ ID NO: 33016 - protein, 16 aa, Homo sapiens
  heavy chain complementarity determining region 3 for antibody 16508
ARDSGIESRGLWYFDL

SEQ ID NO: 33017 - protein, 10 aa, Homo sapiens
  light chain complementarity determining region 3 for antibody 16509
PQYNNWPPWT

SEQ ID NO: 33018 - protein, 19 aa, Homo sapiens
  heavy chain complementarity determining region 3 for antibody 16509
VTDYDFPRHSSSWSPWFDP

SEQ ID NO: 33019 - protein, 9 aa, Homo sapiens
  light chain complementarity determining region 3 for antibody 16510
PQYNIYSWT

SEQ ID NO: 33020 - protein, 20 aa, Homo sapiens
  heavy chain complementarity determining region 3 for antibody 16510
ARGSGETYYDILTGYCYFDH

SEQ ID NO: 33021 - protein, 9 aa, Homo sapiens
  light chain complementarity determining region 3 for antibody 16511
PQYHSYPYT

SEQ ID NO: 33022 - protein, 17 aa, Homo sapiens
  heavy chain complementarity determining region 3 for antibody 16511
AREQFADVDLRQYFFDY

SEQ ID NO: 33023 - protein, 9 aa, Homo sapiens
  light chain complementarity determining region 3 for antibody 16512
PQYGTSRYT

SEQ ID NO: 33024 - protein, 23 aa, Homo sapiens
  heavy chain complementarity determining region 3 for antibody 16512
ARVGCSGEKCSSTAGYYYYPLDV

SEQ ID NO: 33025 - protein, 9 aa, Homo sapiens
  light chain complementarity determining region 3 for antibody 16513
PQYGTSPRT

SEQ ID NO: 33026 - protein, 9 aa, Homo sapiens
  heavy chain complementarity determining region 3 for antibody 16513
AREWSGFDY

SEQ ID NO: 33027 - protein, 10 aa, Homo sapiens
  light chain complementarity determining region 3 for antibody 16514
PQYDSSSLFT

SEQ ID NO: 33028 - protein, 22 aa, Homo sapiens
  heavy chain complementarity determining region 3 for antibody 16514
ARHWYASGSPYGGHYYYFGMDV

SEQ ID NO: 33029 - protein, 9 aa, Homo sapiens
  light chain complementarity determining region 3 for antibody 16515
PQYDAFPYT

SEQ ID NO: 33030 - protein, 17 aa, Homo sapiens
  heavy chain complementarity determining region 3 for antibody 16515
AREDYSDVDLRAFYFDS

SEQ ID NO: 33031 - protein, 9 aa, Homo sapiens
  light chain complementarity determining region 3 for antibody 16516
PQSYSVPYS

SEQ ID NO: 33032 - protein, 13 aa, Homo sapiens
  heavy chain complementarity determining region 3 for antibody 16516
ARGSIYGSGKYEY

SEQ ID NO: 33033 - protein, 9 aa, Homo sapiens
  light chain complementarity determining region 3 for antibody 16517
PQSYSTPRT

SEQ ID NO: 33034 - protein, 14 aa, Homo sapiens
  heavy chain complementarity determining region 3 for antibody 16517
ARVQVDYSNYGCDS

SEQ ID NO: 33035 - protein, 10 aa, Homo sapiens
  light chain complementarity determining region 3 for antibody 16518
PQSYSTHLFT

SEQ ID NO: 33036 - protein, 14 aa, Homo sapiens
  heavy chain complementarity determining region 3 for antibody 16518
ARMAYGGSDYWFDP

SEQ ID NO: 33037 - protein, 8 aa, Homo sapiens
  light chain complementarity determining region 3 for antibody 16519
PQSYRALS

SEQ ID NO: 33038 - protein, 10 aa, Homo sapiens
  heavy chain complementarity determining region 3 for antibody 16519
AHLSRGVNFF

SEQ ID NO: 33039 - protein, 10 aa, Homo sapiens
  light chain complementarity determining region 3 for antibody 16520
PQSSSLPRLT

SEQ ID NO: 33040 - protein, 18 aa, Homo sapiens
  heavy chain complementarity determining region 3 for antibody 16520
ARDVGYDSNAHYHWYFDL

SEQ ID NO: 33041 - protein, 9 aa, Homo sapiens
  light chain complementarity determining region 3 for antibody 16521
PQRTNWPVT

SEQ ID NO: 33042 - protein, 19 aa, Homo sapiens
  heavy chain complementarity determining region 3 for antibody 16521
VRARQYRSSWYGPSDAFDI

SEQ ID NO: 33043 - protein, 8 aa, Homo sapiens
  light chain complementarity determining region 3 for antibody 16522
PQRSHWLT

SEQ ID NO: 33044 - protein, 16 aa, Homo sapiens
  heavy chain complementarity determining region 3 for antibody 16522
ARATDYTGDLPWYFDL

SEQ ID NO: 33045 - protein, 9 aa, Homo sapiens
  light chain complementarity determining region 3 for antibody 16523
PQRSGWPPT

SEQ ID NO: 33046 - protein, 16 aa, Homo sapiens
  heavy chain complementarity determining region 3 for antibody 16523
ARVFYGSGPNANWFDP

SEQ ID NO: 33047 - protein, 9 aa, Homo sapiens
  light chain complementarity determining region 3 for antibody 16524
PQRGNWPPT

SEQ ID NO: 33048 - protein, 13 aa, Homo sapiens
  heavy chain complementarity determining region 3 for antibody 16524
ARDGVWSTSSADL

SEQ ID NO: 33049 - protein, 9 aa, Homo sapiens
  light chain complementarity determining region 3 for antibody 16525
PQGYSFPFP

SEQ ID NO: 33050 - protein, 19 aa, Homo sapiens
  heavy chain complementarity determining region 3 for antibody 16525
ARSDYSGDTDRYYDHGMDV

SEQ ID NO: 33051 - protein, 9 aa, Homo sapiens
  light chain complementarity determining region 3 for antibody 16526
PQGHSLPFT

SEQ ID NO: 33052 - protein, 19 aa, Homo sapiens
  heavy chain complementarity determining region 3 for antibody 16526
ARSDYSGDTDRYYDYGMDV

SEQ ID NO: 33053 - protein, 9 aa, Homo sapiens
  light chain complementarity determining region 3 for antibody 16527
PQFHSYPIT

SEQ ID NO: 33054 - protein, 16 aa, Homo sapiens
  heavy chain complementarity determining region 3 for antibody 16527
ARTQGTRDYYYYAMDV

SEQ ID NO: 33055 - protein, 9 aa, Homo sapiens
  light chain complementarity determining region 3 for antibody 16528
PQAYRFPLS

SEQ ID NO: 33056 - protein, 13 aa, Homo sapiens
  heavy chain complementarity determining region 3 for antibody 16528
TRTYGSGRNWFDP

SEQ ID NO: 33057 - protein, 9 aa, Homo sapiens
  light chain complementarity determining region 3 for antibody 16529
PKYDSAPHT

SEQ ID NO: 33058 - protein, 19 aa, Homo sapiens
  heavy chain complementarity determining region 3 for antibody 16529
ARQVDYDGGDYYVSDAFDI

SEQ ID NO: 33059 - protein, 10 aa, Homo sapiens
  light chain complementarity determining region 3 for antibody 16530
PHYYSVPPWT

SEQ ID NO: 33060 - protein, 12 aa, Homo sapiens
  heavy chain complementarity determining region 3 for antibody 16530
ARLLRFGDYFDY

SEQ ID NO: 33061 - protein, 9 aa, Homo sapiens
  light chain complementarity determining region 3 for antibody 16531
PHYHNWPRT

SEQ ID NO: 33062 - protein, 9 aa, Homo sapiens
  heavy chain complementarity determining region 3 for antibody 16531
ARGASEVDF

SEQ ID NO: 33063 - protein, 9 aa, Homo sapiens
  light chain complementarity determining region 3 for antibody 16532
NQYATSPLT

SEQ ID NO: 33064 - protein, 10 aa, Homo sapiens
  heavy chain complementarity determining region 3 for antibody 16532
GYSNGWLVHY

SEQ ID NO: 33065 - protein, 10 aa, Homo sapiens
  light chain complementarity determining region 3 for antibody 16533
MRYVSSELFT

SEQ ID NO: 33066 - protein, 16 aa, Homo sapiens
  heavy chain complementarity determining region 3 for antibody 16533
ARELFKGEYDYYGMDV

SEQ ID NO: 33067 - protein, 9 aa, Homo sapiens
  light chain complementarity determining region 3 for antibody 16534
MQVLQTPWT

SEQ ID NO: 33068 - protein, 17 aa, Homo sapiens
  heavy chain complementarity determining region 3 for antibody 16534
AREPMVTDRYYYDGLDV

SEQ ID NO: 33069 - protein, 9 aa, Homo sapiens
  light chain complementarity determining region 3 for antibody 16535
MQTQQTRLT

SEQ ID NO: 33070 - protein, 16 aa, Homo sapiens
  heavy chain complementarity determining region 3 for antibody 16535
ARVDSGSSLYFYGMDV

SEQ ID NO: 33071 - protein, 9 aa, Homo sapiens
  light chain complementarity determining region 3 for antibody 16536
MQTLQLPFT

SEQ ID NO: 33072 - protein, 19 aa, Homo sapiens
  heavy chain complementarity determining region 3 for antibody 16536
VRHDRYCSGDRCFSFWFDP

SEQ ID NO: 33073 - protein, 8 aa, Homo sapiens
  light chain complementarity determining region 3 for antibody 16537
MQTLPGPT

SEQ ID NO: 33074 - protein, 20 aa, Homo sapiens
  heavy chain complementarity determining region 3 for antibody 16537
ARNAGYNYGYGYAYYFGLDM

SEQ ID NO: 33075 - protein, 9 aa, Homo sapiens
  light chain complementarity determining region 3 for antibody 16538
MQSTYWPRT

SEQ ID NO: 33076 - protein, 11 aa, Homo sapiens
  heavy chain complementarity determining region 3 for antibody 16538
AREPAFGDLDY

SEQ ID NO: 33077 - protein, 6 aa, Homo sapiens
  light chain complementarity determining region 3 for antibody 16539
MQSTNW

SEQ ID NO: 33078 - protein, 19 aa, Homo sapiens
  heavy chain complementarity determining region 3 for antibody 16539
ARERVRCRSGICYDATFDI

SEQ ID NO: 33079 - protein, 9 aa, Homo sapiens
  light chain complementarity determining region 3 for antibody 16540
MQSLQLPPT

SEQ ID NO: 33080 - protein, 14 aa, Homo sapiens
  heavy chain complementarity determining region 3 for antibody 16540
ARGPENWRSLNFDY

SEQ ID NO: 33081 - protein, 9 aa, Homo sapiens
  light chain complementarity determining region 3 for antibody 16541
MQSLQLPLT

SEQ ID NO: 33082 - protein, 7 aa, Homo sapiens
  heavy chain complementarity determining region 3 for antibody 16541
TKILSSY

SEQ ID NO: 33083 - protein, 9 aa, Homo sapiens
  light chain complementarity determining region 3 for antibody 16542
MQRTHWPPT

SEQ ID NO: 33084 - protein, 8 aa, Homo sapiens
  heavy chain complementarity determining region 3 for antibody 16542
VRAEQFDY

SEQ ID NO: 33085 - protein, 10 aa, Homo sapiens
  light chain complementarity determining region 3 for antibody 16543
MQNTHWRGDI

SEQ ID NO: 33086 - protein, 16 aa, Homo sapiens
  heavy chain complementarity determining region 3 for antibody 16543
TRDMMDDFWNDYTGDY

SEQ ID NO: 33087 - protein, 9 aa, Homo sapiens
  light chain complementarity determining region 3 for antibody 16544
MQLIQFPYT

SEQ ID NO: 33088 - protein, 16 aa, Homo sapiens
  heavy chain complementarity determining region 3 for antibody 16544
ATWLVLTSSRNDVFDV

SEQ ID NO: 33089 - protein, 9 aa, Homo sapiens
  light chain complementarity determining region 3 for antibody 16545
MQHVEFPSP

SEQ ID NO: 33090 - protein, 17 aa, Homo sapiens
  heavy chain complementarity determining region 3 for antibody 16545
ARDEYNGDRRSYYGMDV

SEQ ID NO: 33091 - protein, 9 aa, Homo sapiens
  light chain complementarity determining region 3 for antibody 16546
MQHVEFPSP

SEQ ID NO: 33092 - protein, 17 aa, Homo sapiens
  heavy chain complementarity determining region 3 for antibody 16546
ARDEYHGDRRSYSGMDV

SEQ ID NO: 33093 - protein, 9 aa, Homo sapiens
  light chain complementarity determining region 3 for antibody 16547
MQGTYWPLP

SEQ ID NO: 33094 - protein, 15 aa, Homo sapiens
  heavy chain complementarity determining region 3 for antibody 16547
VRDRLHVLTGSSIDS

SEQ ID NO: 33095 - protein, 10 aa, Homo sapiens
  light chain complementarity determining region 3 for antibody 16548
MQGTYWPLLA

SEQ ID NO: 33096 - protein, 10 aa, Homo sapiens
  heavy chain complementarity determining region 3 for antibody 16548
ARENNWGPDR

SEQ ID NO: 33097 - protein, 8 aa, Homo sapiens
  light chain complementarity determining region 3 for antibody 16549
MQGTYSYT

SEQ ID NO: 33098 - protein, 15 aa, Homo sapiens
  heavy chain complementarity determining region 3 for antibody 16549
AKEGLLWFGGDAFDI

SEQ ID NO: 33099 - protein, 8 aa, Homo sapiens
  light chain complementarity determining region 3 for antibody 16550
MQGTYSDT

SEQ ID NO: 33100 - protein, 15 aa, Homo sapiens
  heavy chain complementarity determining region 3 for antibody 16550
AKEGLLWFGEDAFDI

SEQ ID NO: 33101 - protein, 9 aa, Homo sapiens
  light chain complementarity determining region 3 for antibody 16551
MQGTPWPWT

SEQ ID NO: 33102 - protein, 11 aa, Homo sapiens
  heavy chain complementarity determining region 3 for antibody 16551
ARHVYYYHLDV

SEQ ID NO: 33103 - protein, 8 aa, Homo sapiens
  light chain complementarity determining region 3 for antibody 16552
MQGTPWPT

SEQ ID NO: 33104 - protein, 12 aa, Homo sapiens
  heavy chain complementarity determining region 3 for antibody 16552
THDWDFNYGMDV

SEQ ID NO: 33105 - protein, 10 aa, Homo sapiens
  light chain complementarity determining region 3 for antibody 16553
MQGTPWPPLN

SEQ ID NO: 33106 - protein, 26 aa, Homo sapiens
  heavy chain complementarity determining region 3 for antibody 16553
ARELITSIATPGHEFPNYYYYYGMDV

SEQ ID NO: 33107 - protein, 8 aa, Homo sapiens
  light chain complementarity determining region 3 for antibody 16554
MQGTPWPP

SEQ ID NO: 33108 - protein, 19 aa, Homo sapiens
  heavy chain complementarity determining region 3 for antibody 16554
ATGPRNNWNYNAWVNRFDP

SEQ ID NO: 33109 - protein, 9 aa, Homo sapiens
  light chain complementarity determining region 3 for antibody 16555
MQGTNWPPT

SEQ ID NO: 33110 - protein, 15 aa, Homo sapiens
  heavy chain complementarity determining region 3 for antibody 16555
ARGRRGFREGMGMDV

SEQ ID NO: 33111 - protein, 9 aa, Homo sapiens
  light chain complementarity determining region 3 for antibody 16556
MQGTNWPHT

SEQ ID NO: 33112 - protein, 11 aa, Homo sapiens
  heavy chain complementarity determining region 3 for antibody 16556
ATFGQQWRLAH

SEQ ID NO: 33113 - protein, 9 aa, Homo sapiens
  light chain complementarity determining region 3 for antibody 16557
MQGTHWQWT

SEQ ID NO: 33114 - protein, 11 aa, Homo sapiens
  heavy chain complementarity determining region 3 for antibody 16557
ARHVYYYHLDV

SEQ ID NO: 33115 - protein, 9 aa, Homo sapiens
  light chain complementarity determining region 3 for antibody 16558
MQGTHWQLT

SEQ ID NO: 33116 - protein, 13 aa, Homo sapiens
  heavy chain complementarity determining region 3 for antibody 16558
ARAYSRTFILLGY

SEQ ID NO: 33117 - protein, 9 aa, Homo sapiens
  light chain complementarity determining region 3 for antibody 16559
MQGTHWPWT

SEQ ID NO: 33118 - protein, 12 aa, Homo sapiens
  heavy chain complementarity determining region 3 for antibody 16559
VHVSGWPYHFDQ

SEQ ID NO: 33119 - protein, 9 aa, Homo sapiens
  light chain complementarity determining region 3 for antibody 16560
MQGTHWPWT

SEQ ID NO: 33120 - protein, 11 aa, Homo sapiens
  heavy chain complementarity determining region 3 for antibody 16560
ARRVYYYHLDV

SEQ ID NO: 33121 - protein, 9 aa, Homo sapiens
  light chain complementarity determining region 3 for antibody 16561
MQGTHWPWT

SEQ ID NO: 33122 - protein, 11 aa, Homo sapiens
  heavy chain complementarity determining region 3 for antibody 16561
ARNVYYYHLDV

SEQ ID NO: 33123 - protein, 9 aa, Homo sapiens
  light chain complementarity determining region 3 for antibody 16562
MQGTHWPWT

SEQ ID NO: 33124 - protein, 11 aa, Homo sapiens
  heavy chain complementarity determining region 3 for antibody 16562
ARHVYYYHVDV

SEQ ID NO: 33125 - protein, 9 aa, Homo sapiens
  light chain complementarity determining region 3 for antibody 16563
MQGTHWPWT

SEQ ID NO: 33126 - protein, 11 aa, Homo sapiens
  heavy chain complementarity determining region 3 for antibody 16563
ARHVYYYHFDV

SEQ ID NO: 33127 - protein, 9 aa, Homo sapiens
  light chain complementarity determining region 3 for antibody 16564
MQGTHWPWT

SEQ ID NO: 33128 - protein, 11 aa, Homo sapiens
  heavy chain complementarity determining region 3 for antibody 16564
ARHVYYFHLDV

SEQ ID NO: 33129 - protein, 9 aa, Homo sapiens
  light chain complementarity determining region 3 for antibody 16565
MQGTHWPWT

SEQ ID NO: 33130 - protein, 11 aa, Homo sapiens
  heavy chain complementarity determining region 3 for antibody 16565
ARHVYSSHLDV

SEQ ID NO: 33131 - protein, 9 aa, Homo sapiens
  light chain complementarity determining region 3 for antibody 16566
MQGTHWPWT

SEQ ID NO: 33132 - protein, 11 aa, Homo sapiens
  heavy chain complementarity determining region 3 for antibody 16566
ARHVYCYHLDV

SEQ ID NO: 33133 - protein, 9 aa, Homo sapiens
  light chain complementarity determining region 3 for antibody 16567
MQGTHWPWT

SEQ ID NO: 33134 - protein, 11 aa, Homo sapiens
  heavy chain complementarity determining region 3 for antibody 16567
ARHAYYYHLDV

SEQ ID NO: 33135 - protein, 9 aa, Homo sapiens
  light chain complementarity determining region 3 for antibody 16568
MQGTHWPWP

SEQ ID NO: 33136 - protein, 11 aa, Homo sapiens
  heavy chain complementarity determining region 3 for antibody 16568
ARHVYYYHLDV

SEQ ID NO: 33137 - protein, 9 aa, Homo sapiens
  light chain complementarity determining region 3 for antibody 16569
MQGTHWPWK

SEQ ID NO: 33138 - protein, 11 aa, Homo sapiens
  heavy chain complementarity determining region 3 for antibody 16569
ARHVYYYHLDV

SEQ ID NO: 33139 - protein, 9 aa, Homo sapiens
  light chain complementarity determining region 3 for antibody 16570
MQGTHWPVT

SEQ ID NO: 33140 - protein, 14 aa, Homo sapiens
  heavy chain complementarity determining region 3 for antibody 16570
VKDKNHILTDHLDY

SEQ ID NO: 33141 - protein, 8 aa, Homo sapiens
  light chain complementarity determining region 3 for antibody 16571
MQGTHWPT

SEQ ID NO: 33142 - protein, 12 aa, Homo sapiens
  heavy chain complementarity determining region 3 for antibody 16571
THDWGFNYGMDV

SEQ ID NO: 33143 - protein, 8 aa, Homo sapiens
  light chain complementarity determining region 3 for antibody 16572
MQGTHWPT

SEQ ID NO: 33144 - protein, 12 aa, Homo sapiens
  heavy chain complementarity determining region 3 for antibody 16572
THDWDVNYGMDV

SEQ ID NO: 33145 - protein, 8 aa, Homo sapiens
  light chain complementarity determining region 3 for antibody 16573
MQGTHWPT

SEQ ID NO: 33146 - protein, 12 aa, Homo sapiens
  heavy chain complementarity determining region 3 for antibody 16573
THDWDCNYGMDV

SEQ ID NO: 33147 - protein, 9 aa, Homo sapiens
  light chain complementarity determining region 3 for antibody 16574
MQGTHWPRT

SEQ ID NO: 33148 - protein, 10 aa, Homo sapiens
  heavy chain complementarity determining region 3 for antibody 16574
ARETNWGPDY

SEQ ID NO: 33149 - protein, 9 aa, Homo sapiens
  light chain complementarity determining region 3 for antibody 16575
MQGTHWPQT

SEQ ID NO: 33150 - protein, 11 aa, Homo sapiens
  heavy chain complementarity determining region 3 for antibody 16575
ATFGQQWRLAH

SEQ ID NO: 33151 - protein, 9 aa, Homo sapiens
  light chain complementarity determining region 3 for antibody 16576
MQGTHWPQT

SEQ ID NO: 33152 - protein, 20 aa, Homo sapiens
  heavy chain complementarity determining region 3 for antibody 16576
ARDGGDYDSSGYYYGASPDS

SEQ ID NO: 33153 - protein, 9 aa, Homo sapiens
  light chain complementarity determining region 3 for antibody 16577
MQGTHWPQP

SEQ ID NO: 33154 - protein, 20 aa, Homo sapiens
  heavy chain complementarity determining region 3 for antibody 16577
ARDGGYYDSSGYYYGASPEY

SEQ ID NO: 33155 - protein, 9 aa, Homo sapiens
  light chain complementarity determining region 3 for antibody 16578
MQGTHWPQP

SEQ ID NO: 33156 - protein, 20 aa, Homo sapiens
  heavy chain complementarity determining region 3 for antibody 16578
ARDGGYYDSSGYYYGASPDS

SEQ ID NO: 33157 - protein, 10 aa, Homo sapiens
  light chain complementarity determining region 3 for antibody 16579
MQGTHWPPTT

SEQ ID NO: 33158 - protein, 8 aa, Homo sapiens
  heavy chain complementarity determining region 3 for antibody 16579
VTLFGFDD

SEQ ID NO: 33159 - protein, 9 aa, Homo sapiens
  light chain complementarity determining region 3 for antibody 16580
MQGTHWPPT

SEQ ID NO: 33160 - protein, 15 aa, Homo sapiens
  heavy chain complementarity determining region 3 for antibody 16580
ARGRRGFHEGMGLDV

SEQ ID NO: 33161 - protein, 10 aa, Homo sapiens
  light chain complementarity determining region 3 for antibody 16581
MQGTHWPPST

SEQ ID NO: 33162 - protein, 9 aa, Homo sapiens
  heavy chain complementarity determining region 3 for antibody 16581
LRDNYGADY

SEQ ID NO: 33163 - protein, 10 aa, Homo sapiens
  light chain complementarity determining region 3 for antibody 16582
MQGTHWPPSG

SEQ ID NO: 33164 - protein, 17 aa, Homo sapiens
  heavy chain complementarity determining region 3 for antibody 16582
ARGDYYDNTTHYDAFDI

SEQ ID NO: 33165 - protein, 10 aa, Homo sapiens
  light chain complementarity determining region 3 for antibody 16583
MQGTHWPPPT

SEQ ID NO: 33166 - protein, 14 aa, Homo sapiens
  heavy chain complementarity determining region 3 for antibody 16583
SNGGGPYDDAGFDY

SEQ ID NO: 33167 - protein, 9 aa, Homo sapiens
  light chain complementarity determining region 3 for antibody 16584
MQGTHWPPP

SEQ ID NO: 33168 - protein, 15 aa, Homo sapiens
  heavy chain complementarity determining region 3 for antibody 16584
ARGRRGFQEGMGLDL

SEQ ID NO: 33169 - protein, 10 aa, Homo sapiens
  light chain complementarity determining region 3 for antibody 16585
MQGTHWPPLN

SEQ ID NO: 33170 - protein, 26 aa, Homo sapiens
  heavy chain complementarity determining region 3 for antibody 16585
ARELITSIATPGHEFPNYHYYYGMDV

SEQ ID NO: 33171 - protein, 10 aa, Homo sapiens
  light chain complementarity determining region 3 for antibody 16586
MQGTHWPPLN

SEQ ID NO: 33172 - protein, 26 aa, Homo sapiens
  heavy chain complementarity determining region 3 for antibody 16586
ARELIPSIATPGHEFPNYYYYYGMDV

SEQ ID NO: 33173 - protein, 10 aa, Homo sapiens
  light chain complementarity determining region 3 for antibody 16587
MQGTHWPPLH

SEQ ID NO: 33174 - protein, 26 aa, Homo sapiens
  heavy chain complementarity determining region 3 for antibody 16587
ARELITSIATPGHEFPNYYYYYGMDV

SEQ ID NO: 33175 - protein, 9 aa, Homo sapiens
  light chain complementarity determining region 3 for antibody 16588
MQGTHWPGT

SEQ ID NO: 33176 - protein, 15 aa, Homo sapiens
  heavy chain complementarity determining region 3 for antibody 16588
ARDRPHPLTGRDPDF

SEQ ID NO: 33177 - protein, 9 aa, Homo sapiens
  light chain complementarity determining region 3 for antibody 16589
MQGTHWPGN

SEQ ID NO: 33178 - protein, 27 aa, Homo sapiens
  heavy chain complementarity determining region 3 for antibody 16589
ARDLGPQAVESCGGDCYSPEGVDAFDF

SEQ ID NO: 33179 - protein, 9 aa, Homo sapiens
  light chain complementarity determining region 3 for antibody 16590
MQGTHWPAK

SEQ ID NO: 33180 - protein, 13 aa, Homo sapiens
  heavy chain complementarity determining region 3 for antibody 16590
ARFEIGGFYYAVY

SEQ ID NO: 33181 - protein, 8 aa, Homo sapiens
  light chain complementarity determining region 3 for antibody 16591
MQGTHSYP

SEQ ID NO: 33182 - protein, 10 aa, Homo sapiens
  heavy chain complementarity determining region 3 for antibody 16591
ARDNWNSFDY

SEQ ID NO: 33183 - protein, 8 aa, Homo sapiens
  light chain complementarity determining region 3 for antibody 16592
MQGTHRPT

SEQ ID NO: 33184 - protein, 12 aa, Homo sapiens
  heavy chain complementarity determining region 3 for antibody 16592
THDWDFNYGMDV

SEQ ID NO: 33185 - protein, 8 aa, Homo sapiens
  light chain complementarity determining region 3 for antibody 16593
MQGTHPYT

SEQ ID NO: 33186 - protein, 10 aa, Homo sapiens
  heavy chain complementarity determining region 3 for antibody 16593
ARDNWNSFDY

SEQ ID NO: 33187 - protein, 9 aa, Homo sapiens
  light chain complementarity determining region 3 for antibody 16594
MQGTHLPLT

SEQ ID NO: 33188 - protein, 13 aa, Homo sapiens
  heavy chain complementarity determining region 3 for antibody 16594
ARAYSRTFILLGY

SEQ ID NO: 33189 - protein, 8 aa, Homo sapiens
  light chain complementarity determining region 3 for antibody 16595
MQGTHLGG

SEQ ID NO: 33190 - protein, 13 aa, Homo sapiens
  heavy chain complementarity determining region 3 for antibody 16595
AKTTVTDQYYFDY

SEQ ID NO: 33191 - protein, 9 aa, Homo sapiens
  light chain complementarity determining region 3 for antibody 16596
MQGTHGPPT

SEQ ID NO: 33192 - protein, 15 aa, Homo sapiens
  heavy chain complementarity determining region 3 for antibody 16596
ARGRRGFQEGMGMDV

SEQ ID NO: 33193 - protein, 10 aa, Homo sapiens
  light chain complementarity determining region 3 for antibody 16597
MQGTHGPPLT

SEQ ID NO: 33194 - protein, 26 aa, Homo sapiens
  heavy chain complementarity determining region 3 for antibody 16597
ARELITSIATPGHEFPNYYYYYGMDV

SEQ ID NO: 33195 - protein, 9 aa, Homo sapiens
  light chain complementarity determining region 3 for antibody 16598
MQGTHGPLT

SEQ ID NO: 33196 - protein, 13 aa, Homo sapiens
  heavy chain complementarity determining region 3 for antibody 16598
ARAYSRTFILLGY

SEQ ID NO: 33197 - protein, 10 aa, Homo sapiens
  light chain complementarity determining region 3 for antibody 16599
MQGTHCPPIT

SEQ ID NO: 33198 - protein, 8 aa, Homo sapiens
  heavy chain complementarity determining region 3 for antibody 16599
VTLFGFDD

SEQ ID NO: 33199 - protein, 8 aa, Homo sapiens
  light chain complementarity determining region 3 for antibody 16600
MQGTCSYT

SEQ ID NO: 33200 - protein, 15 aa, Homo sapiens
  heavy chain complementarity determining region 3 for antibody 16600
AKEGLLWFGEDAFDI

SEQ ID NO: 33201 - protein, 9 aa, Homo sapiens
  light chain complementarity determining region 3 for antibody 16601
MQGPHWPPT

SEQ ID NO: 33202 - protein, 15 aa, Homo sapiens
  heavy chain complementarity determining region 3 for antibody 16601
ARGRRGFQEGMGLDL

SEQ ID NO: 33203 - protein, 10 aa, Homo sapiens
  light chain complementarity determining region 3 for antibody 16602
MQGLQTPPIT

SEQ ID NO: 33204 - protein, 21 aa, Homo sapiens
  heavy chain complementarity determining region 3 for antibody 16602
ARGYYYGSGSYYNSFYSGMDV

SEQ ID NO: 33205 - protein, 9 aa, Homo sapiens
  light chain complementarity determining region 3 for antibody 16603
MQGLQTPLT

SEQ ID NO: 33206 - protein, 13 aa, Homo sapiens
  heavy chain complementarity determining region 3 for antibody 16603
ARSAGYYPNWLES

SEQ ID NO: 33207 - protein, 9 aa, Homo sapiens
  light chain complementarity determining region 3 for antibody 16604
MQGLQTPLT

SEQ ID NO: 33208 - protein, 16 aa, Homo sapiens
  heavy chain complementarity determining region 3 for antibody 16604
ARGGVGELGLHNAFDV

SEQ ID NO: 33209 - protein, 9 aa, Homo sapiens
  light chain complementarity determining region 3 for antibody 16605
MQGLQTPLT

SEQ ID NO: 33210 - protein, 16 aa, Homo sapiens
  heavy chain complementarity determining region 3 for antibody 16605
ARGGLGELGLHNAFDV

SEQ ID NO: 33211 - protein, 9 aa, Homo sapiens
  light chain complementarity determining region 3 for antibody 16606
MQGLQTPLT

SEQ ID NO: 33212 - protein, 16 aa, Homo sapiens
  heavy chain complementarity determining region 3 for antibody 16606
ARGGFGGLGLHNAFDV

SEQ ID NO: 33213 - protein, 9 aa, Homo sapiens
  light chain complementarity determining region 3 for antibody 16607
MQGLQTPLT

SEQ ID NO: 33214 - protein, 16 aa, Homo sapiens
  heavy chain complementarity determining region 3 for antibody 16607
ARGGFGELGRHNAFDV

SEQ ID NO: 33215 - protein, 9 aa, Homo sapiens
  light chain complementarity determining region 3 for antibody 16608
MQGLQTPLT

SEQ ID NO: 33216 - protein, 16 aa, Homo sapiens
  heavy chain complementarity determining region 3 for antibody 16608
ARGGFGELGLQNAFDV

SEQ ID NO: 33217 - protein, 9 aa, Homo sapiens
  light chain complementarity determining region 3 for antibody 16609
MQGLQTPLT

SEQ ID NO: 33218 - protein, 16 aa, Homo sapiens
  heavy chain complementarity determining region 3 for antibody 16609
ARGGFGELGLNNAFDV

SEQ ID NO: 33219 - protein, 9 aa, Homo sapiens
  light chain complementarity determining region 3 for antibody 16610
MQGLQTPLT

SEQ ID NO: 33220 - protein, 16 aa, Homo sapiens
  heavy chain complementarity determining region 3 for antibody 16610
ARGGFGELGLHSAFDV

SEQ ID NO: 33221 - protein, 9 aa, Homo sapiens
  light chain complementarity determining region 3 for antibody 16611
MQGLQTPLT

SEQ ID NO: 33222 - protein, 16 aa, Homo sapiens
  heavy chain complementarity determining region 3 for antibody 16611
ARGGFGELGLHNAFGV

SEQ ID NO: 33223 - protein, 9 aa, Homo sapiens
  light chain complementarity determining region 3 for antibody 16612
MQGLQTPLT

SEQ ID NO: 33224 - protein, 16 aa, Homo sapiens
  heavy chain complementarity determining region 3 for antibody 16612
ARGGFGELGIHNAFDV

SEQ ID NO: 33225 - protein, 9 aa, Homo sapiens
  light chain complementarity determining region 3 for antibody 16613
MQGLQTPFT

SEQ ID NO: 33226 - protein, 19 aa, Homo sapiens
  heavy chain complementarity determining region 3 for antibody 16613
ARLDRYCTGSRCYSFWFEP

SEQ ID NO: 33227 - protein, 9 aa, Homo sapiens
  light chain complementarity determining region 3 for antibody 16614
MQGLQSPLT

SEQ ID NO: 33228 - protein, 16 aa, Homo sapiens
  heavy chain complementarity determining region 3 for antibody 16614
ARGGFGELGLHNAFDV

SEQ ID NO: 33229 - protein, 9 aa, Homo sapiens
  light chain complementarity determining region 3 for antibody 16615
MQGLQNPLT

SEQ ID NO: 33230 - protein, 16 aa, Homo sapiens
  heavy chain complementarity determining region 3 for antibody 16615
ARGGFGELGLHNAFDV

SEQ ID NO: 33231 - protein, 9 aa, Homo sapiens
  light chain complementarity determining region 3 for antibody 16616
MQGLQLPFT

SEQ ID NO: 33232 - protein, 19 aa, Homo sapiens
  heavy chain complementarity determining region 3 for antibody 16616
VRHDRYCSGDRCFSFWFDP

SEQ ID NO: 33233 - protein, 7 aa, Homo sapiens
  light chain complementarity determining region 3 for antibody 16617
MQGLQIV

SEQ ID NO: 33234 - protein, 23 aa, Homo sapiens
  heavy chain complementarity determining region 3 for antibody 16617
ARTYDMLTNHFRIGYDYHYNMDV

SEQ ID NO: 33235 - protein, 9 aa, Homo sapiens
  light chain complementarity determining region 3 for antibody 16618
MQGLQFPLT

SEQ ID NO: 33236 - protein, 19 aa, Homo sapiens
  heavy chain complementarity determining region 3 for antibody 16618
ARVAYYYGEEDHYYYAMDV

SEQ ID NO: 33237 - protein, 9 aa, Homo sapiens
  light chain complementarity determining region 3 for antibody 16619
MQGLQFPLT

SEQ ID NO: 33238 - protein, 19 aa, Homo sapiens
  heavy chain complementarity determining region 3 for antibody 16619
ARVAYYYDEEDRYYYAMDV

SEQ ID NO: 33239 - protein, 9 aa, Homo sapiens
  light chain complementarity determining region 3 for antibody 16620
MQGLQFPLT

SEQ ID NO: 33240 - protein, 19 aa, Homo sapiens
  heavy chain complementarity determining region 3 for antibody 16620
ARAAYYYDEEDHYYYAMDV

SEQ ID NO: 33241 - protein, 9 aa, Homo sapiens
  light chain complementarity determining region 3 for antibody 16621
MQGLPTPPA

SEQ ID NO: 33242 - protein, 18 aa, Homo sapiens
  heavy chain complementarity determining region 3 for antibody 16621
ARTRVGVYSGSSPFMFDP

SEQ ID NO: 33243 - protein, 9 aa, Homo sapiens
  light chain complementarity determining region 3 for antibody 16622
MQGLLTTPA

SEQ ID NO: 33244 - protein, 18 aa, Homo sapiens
  heavy chain complementarity determining region 3 for antibody 16622
ARTRVGVYSGSSPFMFDP

SEQ ID NO: 33245 - protein, 9 aa, Homo sapiens
  light chain complementarity determining region 3 for antibody 16623
MQGLLTTPA

SEQ ID NO: 33246 - protein, 18 aa, Homo sapiens
  heavy chain complementarity determining region 3 for antibody 16623
ARTRVGLYSGGSPFMFNP

SEQ ID NO: 33247 - protein, 9 aa, Homo sapiens
  light chain complementarity determining region 3 for antibody 16624
MQGLLTPPP

SEQ ID NO: 33248 - protein, 18 aa, Homo sapiens
  heavy chain complementarity determining region 3 for antibody 16624
ARTRVGMYSGGSPFMFDP

SEQ ID NO: 33249 - protein, 9 aa, Homo sapiens
  light chain complementarity determining region 3 for antibody 16625
MQGLLTPPA

SEQ ID NO: 33250 - protein, 18 aa, Homo sapiens
  heavy chain complementarity determining region 3 for antibody 16625
ARTRVGVYSGSYPFMFDP

SEQ ID NO: 33251 - protein, 9 aa, Homo sapiens
  light chain complementarity determining region 3 for antibody 16626
MQGLLTPPA

SEQ ID NO: 33252 - protein, 18 aa, Homo sapiens
  heavy chain complementarity determining region 3 for antibody 16626
ARTRVGVYSGSSSFMFDP

SEQ ID NO: 33253 - protein, 9 aa, Homo sapiens
  light chain complementarity determining region 3 for antibody 16627
MQGLLTPPA

SEQ ID NO: 33254 - protein, 18 aa, Homo sapiens
  heavy chain complementarity determining region 3 for antibody 16627
ARTRVGVYSGSSPFMLDP

SEQ ID NO: 33255 - protein, 9 aa, Homo sapiens
  light chain complementarity determining region 3 for antibody 16628
MQGLLTPPA

SEQ ID NO: 33256 - protein, 18 aa, Homo sapiens
  heavy chain complementarity determining region 3 for antibody 16628
ARTRVGVYSGSSPFMFAP

SEQ ID NO: 33257 - protein, 9 aa, Homo sapiens
  light chain complementarity determining region 3 for antibody 16629
MQGLLTPPA

SEQ ID NO: 33258 - protein, 18 aa, Homo sapiens
  heavy chain complementarity determining region 3 for antibody 16629
ARTRVGRYSGGSPFMFNP

SEQ ID NO: 33259 - protein, 9 aa, Homo sapiens
  light chain complementarity determining region 3 for antibody 16630
MQGLLTPPA

SEQ ID NO: 33260 - protein, 18 aa, Homo sapiens
  heavy chain complementarity determining region 3 for antibody 16630
ARTRVGLYSGGSPFMSNP

SEQ ID NO: 33261 - protein, 9 aa, Homo sapiens
  light chain complementarity determining region 3 for antibody 16631
MQGLLTPPA

SEQ ID NO: 33262 - protein, 18 aa, Homo sapiens
  heavy chain complementarity determining region 3 for antibody 16631
ARTRAGVYSGSSPFMFDP

SEQ ID NO: 33263 - protein, 9 aa, Homo sapiens
  light chain complementarity determining region 3 for antibody 16632
MQGLLTLPA

SEQ ID NO: 33264 - protein, 18 aa, Homo sapiens
  heavy chain complementarity determining region 3 for antibody 16632
ARTRVGMYSGGSPFMFDP

SEQ ID NO: 33265 - protein, 9 aa, Homo sapiens
  light chain complementarity determining region 3 for antibody 16633
MQGLLSPPA

SEQ ID NO: 33266 - protein, 18 aa, Homo sapiens
  heavy chain complementarity determining region 3 for antibody 16633
ARTRVGMCSGGSPFMFDP

SEQ ID NO: 33267 - protein, 9 aa, Homo sapiens
  light chain complementarity determining region 3 for antibody 16634
MQGLLPPPA

SEQ ID NO: 33268 - protein, 18 aa, Homo sapiens
  heavy chain complementarity determining region 3 for antibody 16634
ARTRVGVYSGSSPFMFDP

SEQ ID NO: 33269 - protein, 9 aa, Homo sapiens
  light chain complementarity determining region 3 for antibody 16635
MQGLLNPPA

SEQ ID NO: 33270 - protein, 18 aa, Homo sapiens
  heavy chain complementarity determining region 3 for antibody 16635
ARTRVGLYSGGSPFMFNP

SEQ ID NO: 33271 - protein, 9 aa, Homo sapiens
  light chain complementarity determining region 3 for antibody 16636
MQGLLIPPA

SEQ ID NO: 33272 - protein, 18 aa, Homo sapiens
  heavy chain complementarity determining region 3 for antibody 16636
ARTRVGVYSGSSPFMFDP

SEQ ID NO: 33273 - protein, 9 aa, Homo sapiens
  light chain complementarity determining region 3 for antibody 16637
MQGLKTPPT

SEQ ID NO: 33274 - protein, 16 aa, Homo sapiens
  heavy chain complementarity determining region 3 for antibody 16637
ARGGFGELGLHNAFDV

SEQ ID NO: 33275 - protein, 9 aa, Homo sapiens
  light chain complementarity determining region 3 for antibody 16638
MQGLKFPLT

SEQ ID NO: 33276 - protein, 19 aa, Homo sapiens
  heavy chain complementarity determining region 3 for antibody 16638
ARVAYYYDEEDHYYYAMDV

SEQ ID NO: 33277 - protein, 9 aa, Homo sapiens
  light chain complementarity determining region 3 for antibody 16639
MQGLHFPLT

SEQ ID NO: 33278 - protein, 19 aa, Homo sapiens
  heavy chain complementarity determining region 3 for antibody 16639
ARVAYYYDEEDHDYYAMDV

SEQ ID NO: 33279 - protein, 9 aa, Homo sapiens
  light chain complementarity determining region 3 for antibody 16640
MQGKHWPWT

SEQ ID NO: 33280 - protein, 12 aa, Homo sapiens
  heavy chain complementarity determining region 3 for antibody 16640
VHVSGWPYYFDQ

SEQ ID NO: 33281 - protein, 8 aa, Homo sapiens
  light chain complementarity determining region 3 for antibody 16641
MQGKHWPT

SEQ ID NO: 33282 - protein, 12 aa, Homo sapiens
  heavy chain complementarity determining region 3 for antibody 16641
THDWDFNYGMDV

SEQ ID NO: 33283 - protein, 9 aa, Homo sapiens
  light chain complementarity determining region 3 for antibody 16642
MQGKHWPPT

SEQ ID NO: 33284 - protein, 15 aa, Homo sapiens
  heavy chain complementarity determining region 3 for antibody 16642
ARGRRGFREGMGMDV

SEQ ID NO: 33285 - protein, 9 aa, Homo sapiens
  light chain complementarity determining region 3 for antibody 16643
MQGKHWPGT

SEQ ID NO: 33286 - protein, 15 aa, Homo sapiens
  heavy chain complementarity determining region 3 for antibody 16643
ARDRPHPLTGQDPDF

SEQ ID NO: 33287 - protein, 9 aa, Homo sapiens
  light chain complementarity determining region 3 for antibody 16644
MQGIQTPLT

SEQ ID NO: 33288 - protein, 16 aa, Homo sapiens
  heavy chain complementarity determining region 3 for antibody 16644
ARGGFGELGLHNAFDV

SEQ ID NO: 33289 - protein, 10 aa, Homo sapiens
  light chain complementarity determining region 3 for antibody 16645
MQGAHWPPLN

SEQ ID NO: 33290 - protein, 26 aa, Homo sapiens
  heavy chain complementarity determining region 3 for antibody 16645
ARELITSIATPGHEFPNYYYYYGMDV

SEQ ID NO: 33291 - protein, 9 aa, Homo sapiens
  light chain complementarity determining region 3 for antibody 16646
MQDLQTPIT

SEQ ID NO: 33292 - protein, 12 aa, Homo sapiens
  heavy chain complementarity determining region 3 for antibody 16646
AKDSTNKWELLD

SEQ ID NO: 33293 - protein, 9 aa, Homo sapiens
  light chain complementarity determining region 3 for antibody 16647
MQDLQTPFT

SEQ ID NO: 33294 - protein, 19 aa, Homo sapiens
  heavy chain complementarity determining region 3 for antibody 16647
ARLDRYCTGSRCYSFWFEP

SEQ ID NO: 33295 - protein, 9 aa, Homo sapiens
  light chain complementarity determining region 3 for antibody 16648
MQAVQTPRT

SEQ ID NO: 33296 - protein, 14 aa, Homo sapiens
  heavy chain complementarity determining region 3 for antibody 16648
AREGQRQLDGDFDC

SEQ ID NO: 33297 - protein, 9 aa, Homo sapiens
  light chain complementarity determining region 3 for antibody 16649
MQAVQTPLT

SEQ ID NO: 33298 - protein, 17 aa, Homo sapiens
  heavy chain complementarity determining region 3 for antibody 16649
TEETDLAVAGYAEYFLH

SEQ ID NO: 33299 - protein, 9 aa, Homo sapiens
  light chain complementarity determining region 3 for antibody 16650
MQAVQTLRT

SEQ ID NO: 33300 - protein, 14 aa, Homo sapiens
  heavy chain complementarity determining region 3 for antibody 16650
AREGQRQLAGDFDC

SEQ ID NO: 33301 - protein, 9 aa, Homo sapiens
  light chain complementarity determining region 3 for antibody 16651
MQAVPTPRT

SEQ ID NO: 33302 - protein, 14 aa, Homo sapiens
  heavy chain complementarity determining region 3 for antibody 16651
AREGQRQLAGDFDC

SEQ ID NO: 33303 - protein, 9 aa, Homo sapiens
  light chain complementarity determining region 3 for antibody 16652
MQATHWPPA

SEQ ID NO: 33304 - protein, 17 aa, Homo sapiens
  heavy chain complementarity determining region 3 for antibody 16652
ARGFLDRGSGWTYYFDH

SEQ ID NO: 33305 - protein, 9 aa, Homo sapiens
  light chain complementarity determining region 3 for antibody 16653
MQATHWPPA

SEQ ID NO: 33306 - protein, 17 aa, Homo sapiens
  heavy chain complementarity determining region 3 for antibody 16653
ARGFLDRGSGWTYYFDD

SEQ ID NO: 33307 - protein, 9 aa, Homo sapiens
  light chain complementarity determining region 3 for antibody 16654
MQATHWPPA

SEQ ID NO: 33308 - protein, 17 aa, Homo sapiens
  heavy chain complementarity determining region 3 for antibody 16654
ARGFLDRGSGWTYCFDY

SEQ ID NO: 33309 - protein, 9 aa, Homo sapiens
  light chain complementarity determining region 3 for antibody 16655
MQATHWPPA

SEQ ID NO: 33310 - protein, 17 aa, Homo sapiens
  heavy chain complementarity determining region 3 for antibody 16655
ARGFLDRGSGWPYYFDY

SEQ ID NO: 33311 - protein, 9 aa, Homo sapiens
  light chain complementarity determining region 3 for antibody 16656
MQATHWPPA

SEQ ID NO: 33312 - protein, 17 aa, Homo sapiens
  heavy chain complementarity determining region 3 for antibody 16656
ARGFLDRGSGWAYYFDY

SEQ ID NO: 33313 - protein, 9 aa, Homo sapiens
  light chain complementarity determining region 3 for antibody 16657
MQAPQTPFT

SEQ ID NO: 33314 - protein, 19 aa, Homo sapiens
  heavy chain complementarity determining region 3 for antibody 16657
ARLDRYCTGSRCYSFWFEP

SEQ ID NO: 33315 - protein, 9 aa, Homo sapiens
  light chain complementarity determining region 3 for antibody 16658
MQALRTPWT

SEQ ID NO: 33316 - protein, 13 aa, Homo sapiens
  heavy chain complementarity determining region 3 for antibody 16658
ATSRDSSSWYSNY

SEQ ID NO: 33317 - protein, 9 aa, Homo sapiens
  light chain complementarity determining region 3 for antibody 16659
MQALQTVFT

SEQ ID NO: 33318 - protein, 18 aa, Homo sapiens
  heavy chain complementarity determining region 3 for antibody 16659
ARHEYYFDSRGPTNWFDP

SEQ ID NO: 33319 - protein, 9 aa, Homo sapiens
  light chain complementarity determining region 3 for antibody 16660
MQALQTSTT

SEQ ID NO: 33320 - protein, 14 aa, Homo sapiens
  heavy chain complementarity determining region 3 for antibody 16660
ARMWWTQQDHGVDA

SEQ ID NO: 33321 - protein, 9 aa, Homo sapiens
  light chain complementarity determining region 3 for antibody 16661
MQALQTSIT

SEQ ID NO: 33322 - protein, 14 aa, Homo sapiens
  heavy chain complementarity determining region 3 for antibody 16661
ARMWWTQWDHGPDV

SEQ ID NO: 33323 - protein, 9 aa, Homo sapiens
  light chain complementarity determining region 3 for antibody 16662
MQALQTSIT

SEQ ID NO: 33324 - protein, 18 aa, Homo sapiens
  heavy chain complementarity determining region 3 for antibody 16662
ARAPGDYDMLRRGYYFDH

SEQ ID NO: 33325 - protein, 9 aa, Homo sapiens
  light chain complementarity determining region 3 for antibody 16663
MQALQTQCT

SEQ ID NO: 33326 - protein, 19 aa, Homo sapiens
  heavy chain complementarity determining region 3 for antibody 16663
VRGLYSTYWSGYVGDGFDM

SEQ ID NO: 33327 - protein, 9 aa, Homo sapiens
  light chain complementarity determining region 3 for antibody 16664
MQALQTPYT

SEQ ID NO: 33328 - protein, 20 aa, Homo sapiens
  heavy chain complementarity determining region 3 for antibody 16664
ARGLGDCWSGYFHYFYGMDV

SEQ ID NO: 33329 - protein, 9 aa, Homo sapiens
  light chain complementarity determining region 3 for antibody 16665
MQALQTPYT

SEQ ID NO: 33330 - protein, 22 aa, Homo sapiens
  heavy chain complementarity determining region 3 for antibody 16665
ARDCCLTAVLLVAVVVAATSGL

SEQ ID NO: 33331 - protein, 9 aa, Homo sapiens
  light chain complementarity determining region 3 for antibody 16666
MQALQTPWT

SEQ ID NO: 33332 - protein, 17 aa, Homo sapiens
  heavy chain complementarity determining region 3 for antibody 16666
AREPMVTDHYYYDGLDV

SEQ ID NO: 33333 - protein, 9 aa, Homo sapiens
  light chain complementarity determining region 3 for antibody 16667
MQALQTPST

SEQ ID NO: 33334 - protein, 19 aa, Homo sapiens
  heavy chain complementarity determining region 3 for antibody 16667
ARDECSGDVCLTFPWCIDL

SEQ ID NO: 33335 - protein, 9 aa, Homo sapiens
  light chain complementarity determining region 3 for antibody 16668
MQALQTPRT

SEQ ID NO: 33336 - protein, 19 aa, Homo sapiens
  heavy chain complementarity determining region 3 for antibody 16668
VRGLYSTYWSGYVGDGFDM

SEQ ID NO: 33337 - protein, 9 aa, Homo sapiens
  light chain complementarity determining region 3 for antibody 16669
MQALQTPRT

SEQ ID NO: 33338 - protein, 19 aa, Homo sapiens
  heavy chain complementarity determining region 3 for antibody 16669
ARVLGRGVIIRDYYYGMDV

SEQ ID NO: 33339 - protein, 9 aa, Homo sapiens
  light chain complementarity determining region 3 for antibody 16670
MQALQTPRT

SEQ ID NO: 33340 - protein, 23 aa, Homo sapiens
  heavy chain complementarity determining region 3 for antibody 16670
ARGGYSANDLSADIPVTYYGVDV

SEQ ID NO: 33341 - protein, 9 aa, Homo sapiens
  light chain complementarity determining region 3 for antibody 16671
MQALQTPRT

SEQ ID NO: 33342 - protein, 23 aa, Homo sapiens
  heavy chain complementarity determining region 3 for antibody 16671
ARGGYSAGDLSPDIPVTYYGVDV

SEQ ID NO: 33343 - protein, 9 aa, Homo sapiens
  light chain complementarity determining region 3 for antibody 16672
MQALQTPRT

SEQ ID NO: 33344 - protein, 23 aa, Homo sapiens
  heavy chain complementarity determining region 3 for antibody 16672
ARGEYSANDLSPDIPATYYGVDV

SEQ ID NO: 33345 - protein, 9 aa, Homo sapiens
  light chain complementarity determining region 3 for antibody 16673
MQALQTPRP

SEQ ID NO: 33346 - protein, 23 aa, Homo sapiens
  heavy chain complementarity determining region 3 for antibody 16673
ARGGYSASDLSPDIPASYYGVDV

SEQ ID NO: 33347 - protein, 9 aa, Homo sapiens
  light chain complementarity determining region 3 for antibody 16674
MQALQTPRN

SEQ ID NO: 33348 - protein, 23 aa, Homo sapiens
  heavy chain complementarity determining region 3 for antibody 16674
ARGGYSANDLSPDIPATYYGVDV

SEQ ID NO: 33349 - protein, 9 aa, Homo sapiens
  light chain complementarity determining region 3 for antibody 16675
MQALQTPRA

SEQ ID NO: 33350 - protein, 23 aa, Homo sapiens
  heavy chain complementarity determining region 3 for antibody 16675
ARGGYSASDLSPDIPATYYGVDV

SEQ ID NO: 33351 - protein, 10 aa, Homo sapiens
  light chain complementarity determining region 3 for antibody 16676
MQALQTPPYP

SEQ ID NO: 33352 - protein, 15 aa, Homo sapiens
  heavy chain complementarity determining region 3 for antibody 16676
ARAGYCGGDCYSQDY

SEQ ID NO: 33353 - protein, 9 aa, Homo sapiens
  light chain complementarity determining region 3 for antibody 16677
MQALQTPPT

SEQ ID NO: 33354 - protein, 23 aa, Homo sapiens
  heavy chain complementarity determining region 3 for antibody 16677
ARGGYSAYEVSPDIPVTYYGVDI

SEQ ID NO: 33355 - protein, 10 aa, Homo sapiens
  light chain complementarity determining region 3 for antibody 16678
MQALQTPPST

SEQ ID NO: 33356 - protein, 15 aa, Homo sapiens
  heavy chain complementarity determining region 3 for antibody 16678
ARAGYCGGDCYSQDY

SEQ ID NO: 33357 - protein, 10 aa, Homo sapiens
  light chain complementarity determining region 3 for antibody 16679
MQALQTPPPT

SEQ ID NO: 33358 - protein, 16 aa, Homo sapiens
  heavy chain complementarity determining region 3 for antibody 16679
ARGGFGELGLHNAFDI

SEQ ID NO: 33359 - protein, 10 aa, Homo sapiens
  light chain complementarity determining region 3 for antibody 16680
MQALQTPPNT

SEQ ID NO: 33360 - protein, 15 aa, Homo sapiens
  heavy chain complementarity determining region 3 for antibody 16680
ARAGYCGGDCYSQDY

SEQ ID NO: 33361 - protein, 10 aa, Homo sapiens
  light chain complementarity determining region 3 for antibody 16681
MQALQTPPLT

SEQ ID NO: 33362 - protein, 16 aa, Homo sapiens
  heavy chain complementarity determining region 3 for antibody 16681
ARGGFGGLGLHNAFDI

SEQ ID NO: 33363 - protein, 10 aa, Homo sapiens
  light chain complementarity determining region 3 for antibody 16682
MQALQTPPLP

SEQ ID NO: 33364 - protein, 16 aa, Homo sapiens
  heavy chain complementarity determining region 3 for antibody 16682
ARGGFGELGLHNAFDI

SEQ ID NO: 33365 - protein, 10 aa, Homo sapiens
  light chain complementarity determining region 3 for antibody 16683
MQALQTPPDT

SEQ ID NO: 33366 - protein, 15 aa, Homo sapiens
  heavy chain complementarity determining region 3 for antibody 16683
ARAGYCGGDCYSQDY

SEQ ID NO: 33367 - protein, 9 aa, Homo sapiens
  light chain complementarity determining region 3 for antibody 16684
MQALQTPLT

SEQ ID NO: 33368 - protein, 16 aa, Homo sapiens
  heavy chain complementarity determining region 3 for antibody 16684
ARGGFGELGLHNAFDV

SEQ ID NO: 33369 - protein, 9 aa, Homo sapiens
  light chain complementarity determining region 3 for antibody 16685
MQALQTPLT

SEQ ID NO: 33370 - protein, 24 aa, Homo sapiens
  heavy chain complementarity determining region 3 for antibody 16685
ARDKGEGSGKFGELRKNYYYGMDV

SEQ ID NO: 33371 - protein, 9 aa, Homo sapiens
  light chain complementarity determining region 3 for antibody 16686
MQALQTPIT

SEQ ID NO: 33372 - protein, 14 aa, Homo sapiens
  heavy chain complementarity determining region 3 for antibody 16686
ARMWWTQLDHGPDV

SEQ ID NO: 33373 - protein, 9 aa, Homo sapiens
  light chain complementarity determining region 3 for antibody 16687
MQALQTPIT

SEQ ID NO: 33374 - protein, 26 aa, Homo sapiens
  heavy chain complementarity determining region 3 for antibody 16687
ARGPGLGYCSLTTCFPDPYYHYGMDV

SEQ ID NO: 33375 - protein, 9 aa, Homo sapiens
  light chain complementarity determining region 3 for antibody 16688
MQALQTPIT

SEQ ID NO: 33376 - protein, 12 aa, Homo sapiens
  heavy chain complementarity determining region 3 for antibody 16688
AKDSTNKWELQD

SEQ ID NO: 33377 - protein, 9 aa, Homo sapiens
  light chain complementarity determining region 3 for antibody 16689
MQALQTPGT

SEQ ID NO: 33378 - protein, 13 aa, Homo sapiens
  heavy chain complementarity determining region 3 for antibody 16689
ATSRDSSSWYSNY

SEQ ID NO: 33379 - protein, 9 aa, Homo sapiens
  light chain complementarity determining region 3 for antibody 16690
MQALQTPGT

SEQ ID NO: 33380 - protein, 15 aa, Homo sapiens
  heavy chain complementarity determining region 3 for antibody 16690
ARGGPHYGDYDPLDH

SEQ ID NO: 33381 - protein, 9 aa, Homo sapiens
  light chain complementarity determining region 3 for antibody 16691
MQALQTPFT

SEQ ID NO: 33382 - protein, 19 aa, Homo sapiens
  heavy chain complementarity determining region 3 for antibody 16691
ARPDRYCTGSRCYSFWFEP

SEQ ID NO: 33383 - protein, 9 aa, Homo sapiens
  light chain complementarity determining region 3 for antibody 16692
MQALQTPFT

SEQ ID NO: 33384 - protein, 19 aa, Homo sapiens
  heavy chain complementarity determining region 3 for antibody 16692
ARLDRYCTSSRCYSFWFEP

SEQ ID NO: 33385 - protein, 9 aa, Homo sapiens
  light chain complementarity determining region 3 for antibody 16693
MQALQTPFT

SEQ ID NO: 33386 - protein, 19 aa, Homo sapiens
  heavy chain complementarity determining region 3 for antibody 16693
ARLDRYCTGSRCYSFWFGP

SEQ ID NO: 33387 - protein, 9 aa, Homo sapiens
  light chain complementarity determining region 3 for antibody 16694
MQALQTPFT

SEQ ID NO: 33388 - protein, 19 aa, Homo sapiens
  heavy chain complementarity determining region 3 for antibody 16694
ARLDRYCTGSRCYSFWFEH

SEQ ID NO: 33389 - protein, 9 aa, Homo sapiens
  light chain complementarity determining region 3 for antibody 16695
MQALQTPFT

SEQ ID NO: 33390 - protein, 19 aa, Homo sapiens
  heavy chain complementarity determining region 3 for antibody 16695
ARLDRYCTGSRCYSFWFDP

SEQ ID NO: 33391 - protein, 9 aa, Homo sapiens
  light chain complementarity determining region 3 for antibody 16696
MQALQTPFT

SEQ ID NO: 33392 - protein, 19 aa, Homo sapiens
  heavy chain complementarity determining region 3 for antibody 16696
ARLDRYCTGSRCHSFWFEP

SEQ ID NO: 33393 - protein, 9 aa, Homo sapiens
  light chain complementarity determining region 3 for antibody 16697
MQALQTPFT

SEQ ID NO: 33394 - protein, 19 aa, Homo sapiens
  heavy chain complementarity determining region 3 for antibody 16697
ARLDRYCTGSRCFSFWFEP

SEQ ID NO: 33395 - protein, 9 aa, Homo sapiens
  light chain complementarity determining region 3 for antibody 16698
MQALQTPFT

SEQ ID NO: 33396 - protein, 19 aa, Homo sapiens
  heavy chain complementarity determining region 3 for antibody 16698
ARLDRYCTGSHCYSFWFEP

SEQ ID NO: 33397 - protein, 9 aa, Homo sapiens
  light chain complementarity determining region 3 for antibody 16699
MQALQTPFT

SEQ ID NO: 33398 - protein, 19 aa, Homo sapiens
  heavy chain complementarity determining region 3 for antibody 16699
ARLDRYCTGGRCYSFWFEP

SEQ ID NO: 33399 - protein, 9 aa, Homo sapiens
  light chain complementarity determining region 3 for antibody 16700
MQALQTPFT

SEQ ID NO: 33400 - protein, 14 aa, Homo sapiens
  heavy chain complementarity determining region 3 for antibody 16700
ARDLLGDSSAYFDH

SEQ ID NO: 33401 - protein, 9 aa, Homo sapiens
  light chain complementarity determining region 3 for antibody 16701
MQALQTPCT

SEQ ID NO: 33402 - protein, 19 aa, Homo sapiens
  heavy chain complementarity determining region 3 for antibody 16701
ARGLYKDYWSGYTGDGFDI

SEQ ID NO: 33403 - protein, 9 aa, Homo sapiens
  light chain complementarity determining region 3 for antibody 16702
MQALQTPCP

SEQ ID NO: 33404 - protein, 19 aa, Homo sapiens
  heavy chain complementarity determining region 3 for antibody 16702
VRGLYSTYWSGYVGDGFDM

SEQ ID NO: 33405 - protein, 9 aa, Homo sapiens
  light chain complementarity determining region 3 for antibody 16703
MQALQTLLT

SEQ ID NO: 33406 - protein, 16 aa, Homo sapiens
  heavy chain complementarity determining region 3 for antibody 16703
ARLSFDVYSTSVGMDV

SEQ ID NO: 33407 - protein, 9 aa, Homo sapiens
  light chain complementarity determining region 3 for antibody 16704
MQALQTLLT

SEQ ID NO: 33408 - protein, 16 aa, Homo sapiens
  heavy chain complementarity determining region 3 for antibody 16704
ARLNVDVYSTSVGMDV

SEQ ID NO: 33409 - protein, 9 aa, Homo sapiens
  light chain complementarity determining region 3 for antibody 16705
MQALQTLLT

SEQ ID NO: 33410 - protein, 16 aa, Homo sapiens
  heavy chain complementarity determining region 3 for antibody 16705
ARLNFDVYSTAVGMDV

SEQ ID NO: 33411 - protein, 9 aa, Homo sapiens
  light chain complementarity determining region 3 for antibody 16706
MQALQTLLT

SEQ ID NO: 33412 - protein, 16 aa, Homo sapiens
  heavy chain complementarity determining region 3 for antibody 16706
ARLNFDVYSSSVGMDV

SEQ ID NO: 33413 - protein, 9 aa, Homo sapiens
  light chain complementarity determining region 3 for antibody 16707
MQALQTLLT

SEQ ID NO: 33414 - protein, 16 aa, Homo sapiens
  heavy chain complementarity determining region 3 for antibody 16707
ARLNFDVYSASVGMDV

SEQ ID NO: 33415 - protein, 9 aa, Homo sapiens
  light chain complementarity determining region 3 for antibody 16708
MQALQTHLT

SEQ ID NO: 33416 - protein, 18 aa, Homo sapiens
  heavy chain complementarity determining region 3 for antibody 16708
GRDGRGGGISVAAPGFDL

SEQ ID NO: 33417 - protein, 8 aa, Homo sapiens
  light chain complementarity determining region 3 for antibody 16709
MQALQTGT

SEQ ID NO: 33418 - protein, 18 aa, Homo sapiens
  heavy chain complementarity determining region 3 for antibody 16709
ARAPYYGDHGDRPNWFDP

SEQ ID NO: 33419 - protein, 8 aa, Homo sapiens
  light chain complementarity determining region 3 for antibody 16710
MQALQSRT

SEQ ID NO: 33420 - protein, 25 aa, Homo sapiens
  heavy chain complementarity determining region 3 for antibody 16710
ARESPFDYCTSATCYQGYYYHVMDV

SEQ ID NO: 33421 - protein, 9 aa, Homo sapiens
  light chain complementarity determining region 3 for antibody 16711
MQALQSPWT

SEQ ID NO: 33422 - protein, 17 aa, Homo sapiens
  heavy chain complementarity determining region 3 for antibody 16711
AREPMVTDRYYYDGLDV

SEQ ID NO: 33423 - protein, 8 aa, Homo sapiens
  light chain complementarity determining region 3 for antibody 16712
MQALQSFT

SEQ ID NO: 33424 - protein, 12 aa, Homo sapiens
  heavy chain complementarity determining region 3 for antibody 16712
ARNGYSYGKFDY

SEQ ID NO: 33425 - protein, 8 aa, Homo sapiens
  light chain complementarity determining region 3 for antibody 16713
MQALQRFN

SEQ ID NO: 33426 - protein, 12 aa, Homo sapiens
  heavy chain complementarity determining region 3 for antibody 16713
ARNGYSYGKFDY

SEQ ID NO: 33427 - protein, 8 aa, Homo sapiens
  light chain complementarity determining region 3 for antibody 16714
MQALQPWT

SEQ ID NO: 33428 - protein, 20 aa, Homo sapiens
  heavy chain complementarity determining region 3 for antibody 16714
AKDSPYYRSGINHYYYALDV

SEQ ID NO: 33429 - protein, 9 aa, Homo sapiens
  light chain complementarity determining region 3 for antibody 16715
MQALQPPVT

SEQ ID NO: 33430 - protein, 15 aa, Homo sapiens
  heavy chain complementarity determining region 3 for antibody 16715
AKGDYGSGIELALDY

SEQ ID NO: 33431 - protein, 9 aa, Homo sapiens
  light chain complementarity determining region 3 for antibody 16716
MQALQLPLT

SEQ ID NO: 33432 - protein, 19 aa, Homo sapiens
  heavy chain complementarity determining region 3 for antibody 16716
VRHDRYCSSDRCFSFWFDP

SEQ ID NO: 33433 - protein, 9 aa, Homo sapiens
  light chain complementarity determining region 3 for antibody 16717
MQALQLPFT

SEQ ID NO: 33434 - protein, 19 aa, Homo sapiens
  heavy chain complementarity determining region 3 for antibody 16717
VRRDRYCSGDRCFSFWFDP

SEQ ID NO: 33435 - protein, 9 aa, Homo sapiens
  light chain complementarity determining region 3 for antibody 16718
MQALQLPFT

SEQ ID NO: 33436 - protein, 19 aa, Homo sapiens
  heavy chain complementarity determining region 3 for antibody 16718
VRHGRYCSGDRCFSFWFDP

SEQ ID NO: 33437 - protein, 9 aa, Homo sapiens
  light chain complementarity determining region 3 for antibody 16719
MQALQLPFT

SEQ ID NO: 33438 - protein, 19 aa, Homo sapiens
  heavy chain complementarity determining region 3 for antibody 16719
VRHDRYCSGDRYFSFWFDP

SEQ ID NO: 33439 - protein, 9 aa, Homo sapiens
  light chain complementarity determining region 3 for antibody 16720
MQALQLPFT

SEQ ID NO: 33440 - protein, 19 aa, Homo sapiens
  heavy chain complementarity determining region 3 for antibody 16720
VRHDRYCSGDRCFSVWFDP

SEQ ID NO: 33441 - protein, 9 aa, Homo sapiens
  light chain complementarity determining region 3 for antibody 16721
MQALQLPFT

SEQ ID NO: 33442 - protein, 19 aa, Homo sapiens
  heavy chain complementarity determining region 3 for antibody 16721
VRHDRYCSGDRCFSFWLDP

SEQ ID NO: 33443 - protein, 9 aa, Homo sapiens
  light chain complementarity determining region 3 for antibody 16722
MQALQLPFT

SEQ ID NO: 33444 - protein, 19 aa, Homo sapiens
  heavy chain complementarity determining region 3 for antibody 16722
VRHDRYCSGDRCFSFRFDP

SEQ ID NO: 33445 - protein, 9 aa, Homo sapiens
  light chain complementarity determining region 3 for antibody 16723
MQALQLPFT

SEQ ID NO: 33446 - protein, 19 aa, Homo sapiens
  heavy chain complementarity determining region 3 for antibody 16723
VRHDRYCSGDRCCSFWFDP

SEQ ID NO: 33447 - protein, 9 aa, Homo sapiens
  light chain complementarity determining region 3 for antibody 16724
MQALQLPFT

SEQ ID NO: 33448 - protein, 19 aa, Homo sapiens
  heavy chain complementarity determining region 3 for antibody 16724
VRHDKYCSGDRCFSFWFDP

SEQ ID NO: 33449 - protein, 9 aa, Homo sapiens
  light chain complementarity determining region 3 for antibody 16725
MQALQILLT

SEQ ID NO: 33450 - protein, 16 aa, Homo sapiens
  heavy chain complementarity determining region 3 for antibody 16725
ARLNFDVYSTSVGMDV

SEQ ID NO: 33451 - protein, 9 aa, Homo sapiens
  light chain complementarity determining region 3 for antibody 16726
MQALQFPFT

SEQ ID NO: 33452 - protein, 19 aa, Homo sapiens
  heavy chain complementarity determining region 3 for antibody 16726
VRHDRYCSGDRCFSFWFDP

SEQ ID NO: 33453 - protein, 9 aa, Homo sapiens
  light chain complementarity determining region 3 for antibody 16727
MQALPTPWT

SEQ ID NO: 33454 - protein, 13 aa, Homo sapiens
  heavy chain complementarity determining region 3 for antibody 16727
ARAGRDFYYGMDV

SEQ ID NO: 33455 - protein, 9 aa, Homo sapiens
  light chain complementarity determining region 3 for antibody 16728
MQALPTPRT

SEQ ID NO: 33456 - protein, 23 aa, Homo sapiens
  heavy chain complementarity determining region 3 for antibody 16728
ARGGYSANDLSPDIPATYYGVDV

SEQ ID NO: 33457 - protein, 9 aa, Homo sapiens
  light chain complementarity determining region 3 for antibody 16729
MQALPTPLT

SEQ ID NO: 33458 - protein, 18 aa, Homo sapiens
  heavy chain complementarity determining region 3 for antibody 16729
GRDGRGGGISVAAPGFDL

SEQ ID NO: 33459 - protein, 9 aa, Homo sapiens
  light chain complementarity determining region 3 for antibody 16730
MQALPTLYT

SEQ ID NO: 33460 - protein, 14 aa, Homo sapiens
  heavy chain complementarity determining region 3 for antibody 16730
ARGWGSGRPYGMDV

SEQ ID NO: 33461 - protein, 8 aa, Homo sapiens
  light chain complementarity determining region 3 for antibody 16731
MQALPTFT

SEQ ID NO: 33462 - protein, 16 aa, Homo sapiens
  heavy chain complementarity determining region 3 for antibody 16731
ARVGVSDTNYYYGMDV

SEQ ID NO: 33463 - protein, 6 aa, Homo sapiens
  light chain complementarity determining region 3 for antibody 16732
MQALPT

SEQ ID NO: 33464 - protein, 15 aa, Homo sapiens
  heavy chain complementarity determining region 3 for antibody 16732
ARGLLDTAMAFSFDY

SEQ ID NO: 33465 - protein, 9 aa, Homo sapiens
  light chain complementarity determining region 3 for antibody 16733
MQALPLPFT

SEQ ID NO: 33466 - protein, 19 aa, Homo sapiens
  heavy chain complementarity determining region 3 for antibody 16733
VRHDRYCSGDRCFSFWFDP

SEQ ID NO: 33467 - protein, 9 aa, Homo sapiens
  light chain complementarity determining region 3 for antibody 16734
MQALLTPPT

SEQ ID NO: 33468 - protein, 19 aa, Homo sapiens
  heavy chain complementarity determining region 3 for antibody 16734
ARAPLTTYYSGGSAYGMDV

SEQ ID NO: 33469 - protein, 9 aa, Homo sapiens
  light chain complementarity determining region 3 for antibody 16735
MQALLTPIP

SEQ ID NO: 33470 - protein, 19 aa, Homo sapiens
  heavy chain complementarity determining region 3 for antibody 16735
ARGDFHYYSGSGGSFGMDV

SEQ ID NO: 33471 - protein, 9 aa, Homo sapiens
  light chain complementarity determining region 3 for antibody 16736
MQALLIPIT

SEQ ID NO: 33472 - protein, 19 aa, Homo sapiens
  heavy chain complementarity determining region 3 for antibody 16736
ARGDFHYYSGSGGSFGMDV

SEQ ID NO: 33473 - protein, 9 aa, Homo sapiens
  light chain complementarity determining region 3 for antibody 16737
MQALKTPWT

SEQ ID NO: 33474 - protein, 17 aa, Homo sapiens
  heavy chain complementarity determining region 3 for antibody 16737
AREPMVTDRYYYDGLDV

SEQ ID NO: 33475 - protein, 9 aa, Homo sapiens
  light chain complementarity determining region 3 for antibody 16738
MQALKTPIT

SEQ ID NO: 33476 - protein, 12 aa, Homo sapiens
  heavy chain complementarity determining region 3 for antibody 16738
AKDSTNKWELLD

SEQ ID NO: 33477 - protein, 9 aa, Homo sapiens
  light chain complementarity determining region 3 for antibody 16739
MQALKLPFT

SEQ ID NO: 33478 - protein, 19 aa, Homo sapiens
  heavy chain complementarity determining region 3 for antibody 16739
VRHDRYCSGDRCFSFWFDP

SEQ ID NO: 33479 - protein, 9 aa, Homo sapiens
  light chain complementarity determining region 3 for antibody 16740
MQALHTSIT

SEQ ID NO: 33480 - protein, 14 aa, Homo sapiens
  heavy chain complementarity determining region 3 for antibody 16740
ARMWWTQLDHGPDV

SEQ ID NO: 33481 - protein, 9 aa, Homo sapiens
  light chain complementarity determining region 3 for antibody 16741
MQALHTPIT

SEQ ID NO: 33482 - protein, 19 aa, Homo sapiens
  heavy chain complementarity determining region 3 for antibody 16741
ARDECSGDVCLTFPWCIDL

SEQ ID NO: 33483 - protein, 9 aa, Homo sapiens
  light chain complementarity determining region 3 for antibody 16742
MQALHTPFT

SEQ ID NO: 33484 - protein, 19 aa, Homo sapiens
  heavy chain complementarity determining region 3 for antibody 16742
ARLDRYCTGSRCYSFWFEP

SEQ ID NO: 33485 - protein, 9 aa, Homo sapiens
  light chain complementarity determining region 3 for antibody 16743
MQALHLPFT

SEQ ID NO: 33486 - protein, 19 aa, Homo sapiens
  heavy chain complementarity determining region 3 for antibody 16743
VRHDRYCSSDRCFSFWFDP

SEQ ID NO: 33487 - protein, 10 aa, Homo sapiens
  light chain complementarity determining region 3 for antibody 16744
MQALETPGLT

SEQ ID NO: 33488 - protein, 19 aa, Homo sapiens
  heavy chain complementarity determining region 3 for antibody 16744
ARGPYSSSWDDFYYYGMDV

SEQ ID NO: 33489 - protein, 9 aa, Homo sapiens
  light chain complementarity determining region 3 for antibody 16745
MQAKHWPPA

SEQ ID NO: 33490 - protein, 17 aa, Homo sapiens
  heavy chain complementarity determining region 3 for antibody 16745
ARGFLDRGSGWTYYFDY

SEQ ID NO: 33491 - protein, 8 aa, Homo sapiens
  light chain complementarity determining region 3 for antibody 16746
MQAIQRFT

SEQ ID NO: 33492 - protein, 12 aa, Homo sapiens
  heavy chain complementarity determining region 3 for antibody 16746
ARNGYSYGKFDY

SEQ ID NO: 33493 - protein, 9 aa, Homo sapiens
  light chain complementarity determining region 3 for antibody 16747
MQAGQTPRT

SEQ ID NO: 33494 - protein, 14 aa, Homo sapiens
  heavy chain complementarity determining region 3 for antibody 16747
AREGQRQLAGDFDC

SEQ ID NO: 33495 - protein, 9 aa, Homo sapiens
  light chain complementarity determining region 3 for antibody 16748
MQAEQTPRT

SEQ ID NO: 33496 - protein, 14 aa, Homo sapiens
  heavy chain complementarity determining region 3 for antibody 16748
AREGQRQLAGDFDC

SEQ ID NO: 33497 - protein, 9 aa, Homo sapiens
  light chain complementarity determining region 3 for antibody 16749
MQAAQTPRT

SEQ ID NO: 33498 - protein, 14 aa, Homo sapiens
  heavy chain complementarity determining region 3 for antibody 16749
AREGQRQLAGDFDC

SEQ ID NO: 33499 - protein, 9 aa, Homo sapiens
  light chain complementarity determining region 3 for antibody 16750
MPGTYWPLT

SEQ ID NO: 33500 - protein, 15 aa, Homo sapiens
  heavy chain complementarity determining region 3 for antibody 16750
VRDRLHVLTGSSIDS

SEQ ID NO: 33501 - protein, 8 aa, Homo sapiens
  light chain complementarity determining region 3 for antibody 16751
MPGTHWPT

SEQ ID NO: 33502 - protein, 12 aa, Homo sapiens
  heavy chain complementarity determining region 3 for antibody 16751
THDWDFNYGMDV

SEQ ID NO: 33503 - protein, 9 aa, Homo sapiens
  light chain complementarity determining region 3 for antibody 16752
MPGTHWPPT

SEQ ID NO: 33504 - protein, 15 aa, Homo sapiens
  heavy chain complementarity determining region 3 for antibody 16752
ARGRRGFREGMGLDV

SEQ ID NO: 33505 - protein, 9 aa, Homo sapiens
  light chain complementarity determining region 3 for antibody 16753
MPGTHWPPT

SEQ ID NO: 33506 - protein, 15 aa, Homo sapiens
  heavy chain complementarity determining region 3 for antibody 16753
ARGRRGFQEGMGLDV

SEQ ID NO: 33507 - protein, 10 aa, Homo sapiens
  light chain complementarity determining region 3 for antibody 16754
MPGTHWPPLN

SEQ ID NO: 33508 - protein, 26 aa, Homo sapiens
  heavy chain complementarity determining region 3 for antibody 16754
ARELITSIATPGHEFPNYYYYYGMDV

SEQ ID NO: 33509 - protein, 10 aa, Homo sapiens
  light chain complementarity determining region 3 for antibody 16755
MPGLQTPPIT

SEQ ID NO: 33510 - protein, 21 aa, Homo sapiens
  heavy chain complementarity determining region 3 for antibody 16755
ARGYYYGSGSYYNSFYYGMDV

SEQ ID NO: 33511 - protein, 9 aa, Homo sapiens
  light chain complementarity determining region 3 for antibody 16756
MPGLQFPLT

SEQ ID NO: 33512 - protein, 19 aa, Homo sapiens
  heavy chain complementarity determining region 3 for antibody 16756
ARVAYYYDEEDHYYYAMDV

SEQ ID NO: 33513 - protein, 9 aa, Homo sapiens
  light chain complementarity determining region 3 for antibody 16757
MPALQTPLT

SEQ ID NO: 33514 - protein, 18 aa, Homo sapiens
  heavy chain complementarity determining region 3 for antibody 16757
GRDGRGGGISVAAPGFDL

SEQ ID NO: 33515 - protein, 9 aa, Homo sapiens
  light chain complementarity determining region 3 for antibody 16758
MPALQTPFT

SEQ ID NO: 33516 - protein, 19 aa, Homo sapiens
  heavy chain complementarity determining region 3 for antibody 16758
ARLDRYCTGSRCYSFWFEP

SEQ ID NO: 33517 - protein, 8 aa, Homo sapiens
  light chain complementarity determining region 3 for antibody 16759
MPALQTFT

SEQ ID NO: 33518 - protein, 16 aa, Homo sapiens
  heavy chain complementarity determining region 3 for antibody 16759
ARVGVSDTNYYYGMDV

SEQ ID NO: 33519 - protein, 9 aa, Homo sapiens
  light chain complementarity determining region 3 for antibody 16760
MKALQLPFT

SEQ ID NO: 33520 - protein, 19 aa, Homo sapiens
  heavy chain complementarity determining region 3 for antibody 16760
VRHDRYCSGDRCFSFWFDP

SEQ ID NO: 33521 - protein, 10 aa, Homo sapiens
  light chain complementarity determining region 3 for antibody 16761
MHGTYWPLLT

SEQ ID NO: 33522 - protein, 10 aa, Homo sapiens
  heavy chain complementarity determining region 3 for antibody 16761
ARENNWGPDR

SEQ ID NO: 33523 - protein, 9 aa, Homo sapiens
  light chain complementarity determining region 3 for antibody 16762
MHGTHWPPT

SEQ ID NO: 33524 - protein, 15 aa, Homo sapiens
  heavy chain complementarity determining region 3 for antibody 16762
ARGRRGFQEGMGLDV

SEQ ID NO: 33525 - protein, 9 aa, Homo sapiens
  light chain complementarity determining region 3 for antibody 16763
MHGSHWPLT

SEQ ID NO: 33526 - protein, 16 aa, Homo sapiens
  heavy chain complementarity determining region 3 for antibody 16763
ARDLRASAAAGANFDY

SEQ ID NO: 33527 - protein, 11 aa, Homo sapiens
  light chain complementarity determining region 3 for antibody 16764
MHATHWPPRYT

SEQ ID NO: 33528 - protein, 18 aa, Homo sapiens
  heavy chain complementarity determining region 3 for antibody 16764
TRLESRGYYHGGLDAFDV

SEQ ID NO: 33529 - protein, 11 aa, Homo sapiens
  light chain complementarity determining region 3 for antibody 16765
MHATHWPPMYT

SEQ ID NO: 33530 - protein, 18 aa, Homo sapiens
  heavy chain complementarity determining region 3 for antibody 16765
TRIESRGYYHGGLDAFDV

SEQ ID NO: 33531 - protein, 11 aa, Homo sapiens
  light chain complementarity determining region 3 for antibody 16766
MHATHWPPMYT

SEQ ID NO: 33532 - protein, 18 aa, Homo sapiens
  heavy chain complementarity determining region 3 for antibody 16766
TGLESRGYYHGGLDAFDV

SEQ ID NO: 33533 - protein, 11 aa, Homo sapiens
  light chain complementarity determining region 3 for antibody 16767
MHATHWPPLYT

SEQ ID NO: 33534 - protein, 18 aa, Homo sapiens
  heavy chain complementarity determining region 3 for antibody 16767
TRLESRGYYHGGLDAFDV

SEQ ID NO: 33535 - protein, 9 aa, Homo sapiens
  light chain complementarity determining region 3 for antibody 16768
MHALQTPFT

SEQ ID NO: 33536 - protein, 19 aa, Homo sapiens
  heavy chain complementarity determining region 3 for antibody 16768
ARLDRYCTGSRCYSFWFEP

SEQ ID NO: 33537 - protein, 9 aa, Homo sapiens
  light chain complementarity determining region 3 for antibody 16769
MHALLTPPT

SEQ ID NO: 33538 - protein, 19 aa, Homo sapiens
  heavy chain complementarity determining region 3 for antibody 16769
ARAHLTTYYSGGSAYGMDV

SEQ ID NO: 33539 - protein, 15 aa, Homo sapiens
  light chain complementarity determining region 3 for antibody 16770
MEALQTLASSTNSFT

SEQ ID NO: 33540 - protein, 17 aa, Homo sapiens
  heavy chain complementarity determining region 3 for antibody 16770
ARDGSYGDRMYYYGMGV

SEQ ID NO: 33541 - protein, 6 aa, Homo sapiens
  light chain complementarity determining region 3 for antibody 16771
MEALQT

SEQ ID NO: 33542 - protein, 17 aa, Homo sapiens
  heavy chain complementarity determining region 3 for antibody 16771
ARDGSYGDRMNYHGMDV

SEQ ID NO: 33543 - protein, 10 aa, Homo sapiens
  light chain complementarity determining region 3 for antibody 16772
LRYVSSELFT

SEQ ID NO: 33544 - protein, 16 aa, Homo sapiens
  heavy chain complementarity determining region 3 for antibody 16772
ARELVKGEYDYYGMDV

SEQ ID NO: 33545 - protein, 10 aa, Homo sapiens
  light chain complementarity determining region 3 for antibody 16773
LRYVSSELFT

SEQ ID NO: 33546 - protein, 16 aa, Homo sapiens
  heavy chain complementarity determining region 3 for antibody 16773
ARELLKGEYDYYGMDV

SEQ ID NO: 33547 - protein, 10 aa, Homo sapiens
  light chain complementarity determining region 3 for antibody 16774
LRYVSSELFT

SEQ ID NO: 33548 - protein, 16 aa, Homo sapiens
  heavy chain complementarity determining region 3 for antibody 16774
ARELFKGGYDYYGMDV

SEQ ID NO: 33549 - protein, 10 aa, Homo sapiens
  light chain complementarity determining region 3 for antibody 16775
LRYVSSELFT

SEQ ID NO: 33550 - protein, 16 aa, Homo sapiens
  heavy chain complementarity determining region 3 for antibody 16775
ARELFKGEYDYCGMDV

SEQ ID NO: 33551 - protein, 10 aa, Homo sapiens
  light chain complementarity determining region 3 for antibody 16776
LRYVSSELFP

SEQ ID NO: 33552 - protein, 16 aa, Homo sapiens
  heavy chain complementarity determining region 3 for antibody 16776
ARELFKGEYDYYGMDV

SEQ ID NO: 33553 - protein, 10 aa, Homo sapiens
  light chain complementarity determining region 3 for antibody 16777
LRYGSSELFT

SEQ ID NO: 33554 - protein, 16 aa, Homo sapiens
  heavy chain complementarity determining region 3 for antibody 16777
ARELFKGEYDYYGMDV

SEQ ID NO: 33555 - protein, 10 aa, Homo sapiens
  light chain complementarity determining region 3 for antibody 16778
LRYASSELFT

SEQ ID NO: 33556 - protein, 16 aa, Homo sapiens
  heavy chain complementarity determining region 3 for antibody 16778
ARELFKGEYDYYGMDV

SEQ ID NO: 33557 - protein, 9 aa, Homo sapiens
  light chain complementarity determining region 3 for antibody 16779
LRHNSYPWT

SEQ ID NO: 33558 - protein, 10 aa, Homo sapiens
  heavy chain complementarity determining region 3 for antibody 16779
ARAYANPSSY

SEQ ID NO: 33559 - protein, 9 aa, Homo sapiens
  light chain complementarity determining region 3 for antibody 16780
LQYYSYPWT

SEQ ID NO: 33560 - protein, 9 aa, Homo sapiens
  heavy chain complementarity determining region 3 for antibody 16780
ARGHYGPDY

SEQ ID NO: 33561 - protein, 9 aa, Homo sapiens
  light chain complementarity determining region 3 for antibody 16781
LQYYNNPHT

SEQ ID NO: 33562 - protein, 14 aa, Homo sapiens
  heavy chain complementarity determining region 3 for antibody 16781
ARASPKDGYNIIDY

SEQ ID NO: 33563 - protein, 9 aa, Homo sapiens
  light chain complementarity determining region 3 for antibody 16782
LQYTNWPRT

SEQ ID NO: 33564 - protein, 16 aa, Homo sapiens
  heavy chain complementarity determining region 3 for antibody 16782
ARDSGIESRGLWYFDL

SEQ ID NO: 33565 - protein, 9 aa, Homo sapiens
  light chain complementarity determining region 3 for antibody 16783
LQYNTWPRT

SEQ ID NO: 33566 - protein, 16 aa, Homo sapiens
  heavy chain complementarity determining region 3 for antibody 16783
ARDSGIESRGLWYFDL

SEQ ID NO: 33567 - protein, 9 aa, Homo sapiens
  light chain complementarity determining region 3 for antibody 16784
LQYNSYWYT

SEQ ID NO: 33568 - protein, 20 aa, Homo sapiens
  heavy chain complementarity determining region 3 for antibody 16784
AGTYGSGTYSPDYYYFGMDV

SEQ ID NO: 33569 - protein, 9 aa, Homo sapiens
  light chain complementarity determining region 3 for antibody 16785
LQYNSLPYT

SEQ ID NO: 33570 - protein, 17 aa, Homo sapiens
  heavy chain complementarity determining region 3 for antibody 16785
AREDWSDVDLRQFYLES

SEQ ID NO: 33571 - protein, 9 aa, Homo sapiens
  light chain complementarity determining region 3 for antibody 16786
LQYNSFPYT

SEQ ID NO: 33572 - protein, 17 aa, Homo sapiens
  heavy chain complementarity determining region 3 for antibody 16786
AREDWSDVDLRNFYLEF

SEQ ID NO: 33573 - protein, 9 aa, Homo sapiens
  light chain complementarity determining region 3 for antibody 16787
LQYNSFPRT

SEQ ID NO: 33574 - protein, 18 aa, Homo sapiens
  heavy chain complementarity determining region 3 for antibody 16787
ASSHYYDSDGSYKEDLDY

SEQ ID NO: 33575 - protein, 9 aa, Homo sapiens
  light chain complementarity determining region 3 for antibody 16788
LQYNNWPRT

SEQ ID NO: 33576 - protein, 16 aa, Homo sapiens
  heavy chain complementarity determining region 3 for antibody 16788
ARGSGIESRGLWYFDL

SEQ ID NO: 33577 - protein, 9 aa, Homo sapiens
  light chain complementarity determining region 3 for antibody 16789
LQYNNWPRT

SEQ ID NO: 33578 - protein, 16 aa, Homo sapiens
  heavy chain complementarity determining region 3 for antibody 16789
ARESGIESRGLWYFDL

SEQ ID NO: 33579 - protein, 9 aa, Homo sapiens
  light chain complementarity determining region 3 for antibody 16790
LQYNNWPRT

SEQ ID NO: 33580 - protein, 16 aa, Homo sapiens
  heavy chain complementarity determining region 3 for antibody 16790
ARDSGSESRGLWYFDL

SEQ ID NO: 33581 - protein, 9 aa, Homo sapiens
  light chain complementarity determining region 3 for antibody 16791
LQYNNWPRT

SEQ ID NO: 33582 - protein, 16 aa, Homo sapiens
  heavy chain complementarity determining region 3 for antibody 16791
ARDSGIESRGLWYFDP

SEQ ID NO: 33583 - protein, 9 aa, Homo sapiens
  light chain complementarity determining region 3 for antibody 16792
LQYNNWPRT

SEQ ID NO: 33584 - protein, 16 aa, Homo sapiens
  heavy chain complementarity determining region 3 for antibody 16792
ARDSGIESRGLWYFDI

SEQ ID NO: 33585 - protein, 9 aa, Homo sapiens
  light chain complementarity determining region 3 for antibody 16793
LQYNNWPRT

SEQ ID NO: 33586 - protein, 16 aa, Homo sapiens
  heavy chain complementarity determining region 3 for antibody 16793
ARDSGIESRGLWYCDL

SEQ ID NO: 33587 - protein, 9 aa, Homo sapiens
  light chain complementarity determining region 3 for antibody 16794
LQYNNWPRT

SEQ ID NO: 33588 - protein, 16 aa, Homo sapiens
  heavy chain complementarity determining region 3 for antibody 16794
ARDSGIESRCLWYFDL

SEQ ID NO: 33589 - protein, 9 aa, Homo sapiens
  light chain complementarity determining region 3 for antibody 16795
LQYNNWPRP

SEQ ID NO: 33590 - protein, 16 aa, Homo sapiens
  heavy chain complementarity determining region 3 for antibody 16795
ARDSGIESRGLWYFDL

SEQ ID NO: 33591 - protein, 9 aa, Homo sapiens
  light chain complementarity determining region 3 for antibody 16796
LQYNNLPRT

SEQ ID NO: 33592 - protein, 16 aa, Homo sapiens
  heavy chain complementarity determining region 3 for antibody 16796
ARDSGIESRGLWYFDL

SEQ ID NO: 33593 - protein, 8 aa, Homo sapiens
  light chain complementarity determining region 3 for antibody 16797
LQYKSYWT

SEQ ID NO: 33594 - protein, 17 aa, Homo sapiens
  heavy chain complementarity determining region 3 for antibody 16797
ARVSAMVRGPFYWYYDL

SEQ ID NO: 33595 - protein, 8 aa, Homo sapiens
  light chain complementarity determining region 3 for antibody 16798
LQYKSYWT

SEQ ID NO: 33596 - protein, 17 aa, Homo sapiens
  heavy chain complementarity determining region 3 for antibody 16798
ARVSAMARGTFYWYYDL

SEQ ID NO: 33597 - protein, 9 aa, Homo sapiens
  light chain complementarity determining region 3 for antibody 16799
LQYHNWPRT

SEQ ID NO: 33598 - protein, 16 aa, Homo sapiens
  heavy chain complementarity determining region 3 for antibody 16799
ARDSGIESRGLWYFDL

SEQ ID NO: 33599 - protein, 9 aa, Homo sapiens
  light chain complementarity determining region 3 for antibody 16800
LQYGSSPYT

SEQ ID NO: 33600 - protein, 13 aa, Homo sapiens
  heavy chain complementarity determining region 3 for antibody 16800
ARGSTYGSGTYTS

SEQ ID NO: 33601 - protein, 9 aa, Homo sapiens
  light chain complementarity determining region 3 for antibody 16801
LQVNTYPLT

SEQ ID NO: 33602 - protein, 19 aa, Homo sapiens
  heavy chain complementarity determining region 3 for antibody 16801
AREEGYYDGSGSFHPESDY

SEQ ID NO: 33603 - protein, 9 aa, Homo sapiens
  light chain complementarity determining region 3 for antibody 16802
LQSNNWPRT

SEQ ID NO: 33604 - protein, 16 aa, Homo sapiens
  heavy chain complementarity determining region 3 for antibody 16802
ARDSGIESRGLWYFDL

SEQ ID NO: 33605 - protein, 9 aa, Homo sapiens
  light chain complementarity determining region 3 for antibody 16803
LQRSRAPFT

SEQ ID NO: 33606 - protein, 11 aa, Homo sapiens
  heavy chain complementarity determining region 3 for antibody 16803
VRDRGLWLLDY

SEQ ID NO: 33607 - protein, 9 aa, Homo sapiens
  light chain complementarity determining region 3 for antibody 16804
LQRSDWPQT

SEQ ID NO: 33608 - protein, 12 aa, Homo sapiens
  heavy chain complementarity determining region 3 for antibody 16804
ARDTGGDWYFDY

SEQ ID NO: 33609 - protein, 9 aa, Homo sapiens
  light chain complementarity determining region 3 for antibody 16805
LQRRAWPQT

SEQ ID NO: 33610 - protein, 12 aa, Homo sapiens
  heavy chain complementarity determining region 3 for antibody 16805
ARDTGGDWYFDY

SEQ ID NO: 33611 - protein, 9 aa, Homo sapiens
  light chain complementarity determining region 3 for antibody 16806
LQNNSYPFT

SEQ ID NO: 33612 - protein, 15 aa, Homo sapiens
  heavy chain complementarity determining region 3 for antibody 16806
ARRYSSGWWALDFDY

SEQ ID NO: 33613 - protein, 9 aa, Homo sapiens
  light chain complementarity determining region 3 for antibody 16807
LQLNSYPFT

SEQ ID NO: 33614 - protein, 15 aa, Homo sapiens
  heavy chain complementarity determining region 3 for antibody 16807
ARRYSSGWWALDFDY

SEQ ID NO: 33615 - protein, 9 aa, Homo sapiens
  light chain complementarity determining region 3 for antibody 16808
LQHTSYPLT

SEQ ID NO: 33616 - protein, 12 aa, Homo sapiens
  heavy chain complementarity determining region 3 for antibody 16808
AGARNGYNLFDY

SEQ ID NO: 33617 - protein, 9 aa, Homo sapiens
  light chain complementarity determining region 3 for antibody 16809
LQHTSFPRT

SEQ ID NO: 33618 - protein, 17 aa, Homo sapiens
  heavy chain complementarity determining region 3 for antibody 16809
AREGYCTTGVCYNWFDP

SEQ ID NO: 33619 - protein, 9 aa, Homo sapiens
  light chain complementarity determining region 3 for antibody 16810
LQHNSYPYT

SEQ ID NO: 33620 - protein, 10 aa, Homo sapiens
  heavy chain complementarity determining region 3 for antibody 16810
ATYAAGYFEY

SEQ ID NO: 33621 - protein, 9 aa, Homo sapiens
  light chain complementarity determining region 3 for antibody 16811
LQHNSYPYT

SEQ ID NO: 33622 - protein, 7 aa, Homo sapiens
  heavy chain complementarity determining region 3 for antibody 16811
ARDGGDY

SEQ ID NO: 33623 - protein, 9 aa, Homo sapiens
  light chain complementarity determining region 3 for antibody 16812
LQHNSYPWT

SEQ ID NO: 33624 - protein, 11 aa, Homo sapiens
  heavy chain complementarity determining region 3 for antibody 16812
ARIPPNLPGDY

SEQ ID NO: 33625 - protein, 9 aa, Homo sapiens
  light chain complementarity determining region 3 for antibody 16813
LQHNSYPWT

SEQ ID NO: 33626 - protein, 19 aa, Homo sapiens
  heavy chain complementarity determining region 3 for antibody 16813
ARGVGSDFSGFYLLGYFDL

SEQ ID NO: 33627 - protein, 9 aa, Homo sapiens
  light chain complementarity determining region 3 for antibody 16814
LQHNSYPVT

SEQ ID NO: 33628 - protein, 20 aa, Homo sapiens
  heavy chain complementarity determining region 3 for antibody 16814
ARDRGKSFGISVGTQYGTDV

SEQ ID NO: 33629 - protein, 9 aa, Homo sapiens
  light chain complementarity determining region 3 for antibody 16815
LQHNSYPRT

SEQ ID NO: 33630 - protein, 19 aa, Homo sapiens
  heavy chain complementarity determining region 3 for antibody 16815
TTDFWLVVTAGFYYHGMDV

SEQ ID NO: 33631 - protein, 9 aa, Homo sapiens
  light chain complementarity determining region 3 for antibody 16816
LQHNSYPRT

SEQ ID NO: 33632 - protein, 19 aa, Homo sapiens
  heavy chain complementarity determining region 3 for antibody 16816
TTDFWLIVTAGFYYRGMDV

SEQ ID NO: 33633 - protein, 9 aa, Homo sapiens
  light chain complementarity determining region 3 for antibody 16817
LQHNSYPRT

SEQ ID NO: 33634 - protein, 19 aa, Homo sapiens
  heavy chain complementarity determining region 3 for antibody 16817
TTDFWLIVTAGFYCHGMDV

SEQ ID NO: 33635 - protein, 9 aa, Homo sapiens
  light chain complementarity determining region 3 for antibody 16818
LQHNSYPPT

SEQ ID NO: 33636 - protein, 12 aa, Homo sapiens
  heavy chain complementarity determining region 3 for antibody 16818
ARNGRFLNGFDP

SEQ ID NO: 33637 - protein, 9 aa, Homo sapiens
  light chain complementarity determining region 3 for antibody 16819
LQHNSYPHT

SEQ ID NO: 33638 - protein, 19 aa, Homo sapiens
  heavy chain complementarity determining region 3 for antibody 16819
ATFASARGRLAPYYYRMDV

SEQ ID NO: 33639 - protein, 9 aa, Homo sapiens
  light chain complementarity determining region 3 for antibody 16820
LQHNSYPFT

SEQ ID NO: 33640 - protein, 15 aa, Homo sapiens
  heavy chain complementarity determining region 3 for antibody 16820
ARRYSSGWWALGFDY

SEQ ID NO: 33641 - protein, 8 aa, Homo sapiens
  light chain complementarity determining region 3 for antibody 16821
LQHNSYLT

SEQ ID NO: 33642 - protein, 12 aa, Homo sapiens
  heavy chain complementarity determining region 3 for antibody 16821
AKGILGRGGMDV

SEQ ID NO: 33643 - protein, 9 aa, Homo sapiens
  light chain complementarity determining region 3 for antibody 16822
LQHNSYLLT

SEQ ID NO: 33644 - protein, 21 aa, Homo sapiens
  heavy chain complementarity determining region 3 for antibody 16822
ARDLLVSSGWSEYYRCHGMDV

SEQ ID NO: 33645 - protein, 9 aa, Homo sapiens
  light chain complementarity determining region 3 for antibody 16823
LQHNSSPLT

SEQ ID NO: 33646 - protein, 18 aa, Homo sapiens
  heavy chain complementarity determining region 3 for antibody 16823
AKIGYYYESSGYYGDQDY

SEQ ID NO: 33647 - protein, 9 aa, Homo sapiens
  light chain complementarity determining region 3 for antibody 16824
LQHNSSPFT

SEQ ID NO: 33648 - protein, 15 aa, Homo sapiens
  heavy chain complementarity determining region 3 for antibody 16824
ARRYSSGWWALDFDY

SEQ ID NO: 33649 - protein, 9 aa, Homo sapiens
  light chain complementarity determining region 3 for antibody 16825
LQHNSSLLT

SEQ ID NO: 33650 - protein, 21 aa, Homo sapiens
  heavy chain complementarity determining region 3 for antibody 16825
ARDLLVSSGWSEYYRSHGMDV

SEQ ID NO: 33651 - protein, 9 aa, Homo sapiens
  light chain complementarity determining region 3 for antibody 16826
LQHNSCPLT

SEQ ID NO: 33652 - protein, 13 aa, Homo sapiens
  heavy chain complementarity determining region 3 for antibody 16826
TRLIAAPGTYFDF

SEQ ID NO: 33653 - protein, 9 aa, Homo sapiens
  light chain complementarity determining region 3 for antibody 16827
LQHNGYPWT

SEQ ID NO: 33654 - protein, 17 aa, Homo sapiens
  heavy chain complementarity determining region 3 for antibody 16827
ARETRGFEFGYVSSFDH

SEQ ID NO: 33655 - protein, 9 aa, Homo sapiens
  light chain complementarity determining region 3 for antibody 16828
LQHNAFPRT

SEQ ID NO: 33656 - protein, 16 aa, Homo sapiens
  heavy chain complementarity determining region 3 for antibody 16828
AKDDREDFYDTDGFYA

SEQ ID NO: 33657 - protein, 10 aa, Homo sapiens
  light chain complementarity determining region 3 for antibody 16829
LQHDNFPLVT

SEQ ID NO: 33658 - protein, 17 aa, Homo sapiens
  heavy chain complementarity determining region 3 for antibody 16829
ERDGEWELRAFYNWFDP

SEQ ID NO: 33659 - protein, 9 aa, Homo sapiens
  light chain complementarity determining region 3 for antibody 16830
LQHDNFPLP

SEQ ID NO: 33660 - protein, 19 aa, Homo sapiens
  heavy chain complementarity determining region 3 for antibody 16830
ARSIAAAGSYYLYYYAMDV

SEQ ID NO: 33661 - protein, 9 aa, Homo sapiens
  light chain complementarity determining region 3 for antibody 16831
LQHDNFPLP

SEQ ID NO: 33662 - protein, 19 aa, Homo sapiens
  heavy chain complementarity determining region 3 for antibody 16831
ARSIAAAGSYYCYYYAMDV

SEQ ID NO: 33663 - protein, 9 aa, Homo sapiens
  light chain complementarity determining region 3 for antibody 16832
LQHDNFHLP

SEQ ID NO: 33664 - protein, 19 aa, Homo sapiens
  heavy chain complementarity determining region 3 for antibody 16832
ARSIAAAGSYYFYYYAMDV

SEQ ID NO: 33665 - protein, 9 aa, Homo sapiens
  light chain complementarity determining region 3 for antibody 16833
LQHAGFPLT

SEQ ID NO: 33666 - protein, 15 aa, Homo sapiens
  heavy chain complementarity determining region 3 for antibody 16833
AHGYSSKWYLFPFDF

SEQ ID NO: 33667 - protein, 9 aa, Homo sapiens
  light chain complementarity determining region 3 for antibody 16834
LQGYGTPYP

SEQ ID NO: 33668 - protein, 17 aa, Homo sapiens
  heavy chain complementarity determining region 3 for antibody 16834
AKEGGGYCSGGTCYPEN

SEQ ID NO: 33669 - protein, 9 aa, Homo sapiens
  light chain complementarity determining region 3 for antibody 16835
LQGTHWPWT

SEQ ID NO: 33670 - protein, 11 aa, Homo sapiens
  heavy chain complementarity determining region 3 for antibody 16835
ARHVYYYHLDV

SEQ ID NO: 33671 - protein, 9 aa, Homo sapiens
  light chain complementarity determining region 3 for antibody 16836
LQGLQFPLT

SEQ ID NO: 33672 - protein, 19 aa, Homo sapiens
  heavy chain complementarity determining region 3 for antibody 16836
ARVAYYYDEEDHYYYAMDV

SEQ ID NO: 33673 - protein, 9 aa, Homo sapiens
  light chain complementarity determining region 3 for antibody 16837
LQGLLTPPA

SEQ ID NO: 33674 - protein, 18 aa, Homo sapiens
  heavy chain complementarity determining region 3 for antibody 16837
ARTRVGVYSGSSPFMFDP

SEQ ID NO: 33675 - protein, 9 aa, Homo sapiens
  light chain complementarity determining region 3 for antibody 16838
LQFNNWPRT

SEQ ID NO: 33676 - protein, 16 aa, Homo sapiens
  heavy chain complementarity determining region 3 for antibody 16838
ARDSGIESRGLWYFDL

SEQ ID NO: 33677 - protein, 9 aa, Homo sapiens
  light chain complementarity determining region 3 for antibody 16839
LQESTYPLT

SEQ ID NO: 33678 - protein, 19 aa, Homo sapiens
  heavy chain complementarity determining region 3 for antibody 16839
AREEGYYDGSGSWHPESNN

SEQ ID NO: 33679 - protein, 9 aa, Homo sapiens
  light chain complementarity determining region 3 for antibody 16840
LQESTYPLT

SEQ ID NO: 33680 - protein, 19 aa, Homo sapiens
  heavy chain complementarity determining region 3 for antibody 16840
AREEGYCDGSGSWHPESDN

SEQ ID NO: 33681 - protein, 9 aa, Homo sapiens
  light chain complementarity determining region 3 for antibody 16841
LQESTYPLT

SEQ ID NO: 33682 - protein, 19 aa, Homo sapiens
  heavy chain complementarity determining region 3 for antibody 16841
AREEGHYAGSGSFLPESDS

SEQ ID NO: 33683 - protein, 9 aa, Homo sapiens
  light chain complementarity determining region 3 for antibody 16842
LQERTYPLT

SEQ ID NO: 33684 - protein, 19 aa, Homo sapiens
  heavy chain complementarity determining region 3 for antibody 16842
AREEGHYSGSGSFLPESDS

SEQ ID NO: 33685 - protein, 9 aa, Homo sapiens
  light chain complementarity determining region 3 for antibody 16843
LQENTYPPT

SEQ ID NO: 33686 - protein, 19 aa, Homo sapiens
  heavy chain complementarity determining region 3 for antibody 16843
AREEGYYDGSGSFHPESDY

SEQ ID NO: 33687 - protein, 9 aa, Homo sapiens
  light chain complementarity determining region 3 for antibody 16844
LQENTYPLT

SEQ ID NO: 33688 - protein, 19 aa, Homo sapiens
  heavy chain complementarity determining region 3 for antibody 16844
AREEGYYDGSGSFHPDSDY

SEQ ID NO: 33689 - protein, 9 aa, Homo sapiens
  light chain complementarity determining region 3 for antibody 16845
LQENTSPLT

SEQ ID NO: 33690 - protein, 19 aa, Homo sapiens
  heavy chain complementarity determining region 3 for antibody 16845
AREEGYYDGSGSFHPESDY

SEQ ID NO: 33691 - protein, 9 aa, Homo sapiens
  light chain complementarity determining region 3 for antibody 16846
LQDYTYPFS

SEQ ID NO: 33692 - protein, 16 aa, Homo sapiens
  heavy chain complementarity determining region 3 for antibody 16846
VKDVGDHRDSYTTLDY

SEQ ID NO: 33693 - protein, 9 aa, Homo sapiens
  light chain complementarity determining region 3 for antibody 16847
LQDYTFPPT

SEQ ID NO: 33694 - protein, 14 aa, Homo sapiens
  heavy chain complementarity determining region 3 for antibody 16847
AKGLVEKTAGRVDS

SEQ ID NO: 33695 - protein, 9 aa, Homo sapiens
  light chain complementarity determining region 3 for antibody 16848
LQDYSYPPT

SEQ ID NO: 33696 - protein, 28 aa, Homo sapiens
  heavy chain complementarity determining region 3 for antibody 16848
TRDQARGDYFRSESFFEGDDTYSYNMDV

SEQ ID NO: 33697 - protein, 9 aa, Homo sapiens
  light chain complementarity determining region 3 for antibody 16849
LQDYRYPRT

SEQ ID NO: 33698 - protein, 18 aa, Homo sapiens
  heavy chain complementarity determining region 3 for antibody 16849
ARDTSPGDSSAWYDAFDI

SEQ ID NO: 33699 - protein, 9 aa, Homo sapiens
  light chain complementarity determining region 3 for antibody 16850
LQDYNYPWT

SEQ ID NO: 33700 - protein, 17 aa, Homo sapiens
  heavy chain complementarity determining region 3 for antibody 16850
VRGVTGTSSTSDYYFDH

SEQ ID NO: 33701 - protein, 9 aa, Homo sapiens
  light chain complementarity determining region 3 for antibody 16851
LQDYKYSRT

SEQ ID NO: 33702 - protein, 18 aa, Homo sapiens
  heavy chain complementarity determining region 3 for antibody 16851
ARDTSPGDSSAWYDAFDI

SEQ ID NO: 33703 - protein, 9 aa, Homo sapiens
  light chain complementarity determining region 3 for antibody 16852
LQDYKYPRT

SEQ ID NO: 33704 - protein, 18 aa, Homo sapiens
  heavy chain complementarity determining region 3 for antibody 16852
VRDTSPGDSSAWYDAFDI

SEQ ID NO: 33705 - protein, 9 aa, Homo sapiens
  light chain complementarity determining region 3 for antibody 16853
LQDYKYPRT

SEQ ID NO: 33706 - protein, 18 aa, Homo sapiens
  heavy chain complementarity determining region 3 for antibody 16853
ASDTSPGDSSAWYDAFDI

SEQ ID NO: 33707 - protein, 9 aa, Homo sapiens
  light chain complementarity determining region 3 for antibody 16854
LQDYKYPRT

SEQ ID NO: 33708 - protein, 18 aa, Homo sapiens
  heavy chain complementarity determining region 3 for antibody 16854
ARDTSRGDSSAWYDAFDI

SEQ ID NO: 33709 - protein, 9 aa, Homo sapiens
  light chain complementarity determining region 3 for antibody 16855
LQDYKYPRT

SEQ ID NO: 33710 - protein, 18 aa, Homo sapiens
  heavy chain complementarity determining region 3 for antibody 16855
ARDTSPGDSSAWYDTFDI

SEQ ID NO: 33711 - protein, 9 aa, Homo sapiens
  light chain complementarity determining region 3 for antibody 16856
LQDYKYPRT

SEQ ID NO: 33712 - protein, 18 aa, Homo sapiens
  heavy chain complementarity determining region 3 for antibody 16856
ARDTSPGDSSAWYDAFGI

SEQ ID NO: 33713 - protein, 9 aa, Homo sapiens
  light chain complementarity determining region 3 for antibody 16857
LQDYKYPRT

SEQ ID NO: 33714 - protein, 18 aa, Homo sapiens
  heavy chain complementarity determining region 3 for antibody 16857
ARDTSPGDSSACYDAFDI

SEQ ID NO: 33715 - protein, 9 aa, Homo sapiens
  light chain complementarity determining region 3 for antibody 16858
LQDYKYPRT

SEQ ID NO: 33716 - protein, 18 aa, Homo sapiens
  heavy chain complementarity determining region 3 for antibody 16858
ARDTSPGDNSAWYDAFDI

SEQ ID NO: 33717 - protein, 9 aa, Homo sapiens
  light chain complementarity determining region 3 for antibody 16859
LQDYKYPRT

SEQ ID NO: 33718 - protein, 18 aa, Homo sapiens
  heavy chain complementarity determining region 3 for antibody 16859
ARDTPPGDSSAWYDAFDI

SEQ ID NO: 33719 - protein, 9 aa, Homo sapiens
  light chain complementarity determining region 3 for antibody 16860
LQDYKYPRT

SEQ ID NO: 33720 - protein, 18 aa, Homo sapiens
  heavy chain complementarity determining region 3 for antibody 16860
ARDTAPGDSSAWYDAFDI

SEQ ID NO: 33721 - protein, 9 aa, Homo sapiens
  light chain complementarity determining region 3 for antibody 16861
LQDYKYPRS

SEQ ID NO: 33722 - protein, 18 aa, Homo sapiens
  heavy chain complementarity determining region 3 for antibody 16861
ARDTSPGDSSAWYDAFDI

SEQ ID NO: 33723 - protein, 9 aa, Homo sapiens
  light chain complementarity determining region 3 for antibody 16862
LQDYKYPRK

SEQ ID NO: 33724 - protein, 18 aa, Homo sapiens
  heavy chain complementarity determining region 3 for antibody 16862
ARDTSPGDSSAWYDAFDI

SEQ ID NO: 33725 - protein, 9 aa, Homo sapiens
  light chain complementarity determining region 3 for antibody 16863
LQDYKYLRT

SEQ ID NO: 33726 - protein, 18 aa, Homo sapiens
  heavy chain complementarity determining region 3 for antibody 16863
ARDTSPGDSSAWYDAFDI

SEQ ID NO: 33727 - protein, 9 aa, Homo sapiens
  light chain complementarity determining region 3 for antibody 16864
LQDHKYPRT

SEQ ID NO: 33728 - protein, 18 aa, Homo sapiens
  heavy chain complementarity determining region 3 for antibody 16864
ARDTSPGDSSAWYDAFDI

SEQ ID NO: 33729 - protein, 9 aa, Homo sapiens
  light chain complementarity determining region 3 for antibody 16865
LQDFYYPYT

SEQ ID NO: 33730 - protein, 18 aa, Homo sapiens
  heavy chain complementarity determining region 3 for antibody 16865
ARDPIHCIGADCFSYFDQ

SEQ ID NO: 33731 - protein, 9 aa, Homo sapiens
  light chain complementarity determining region 3 for antibody 16866
LQATPWPYT

SEQ ID NO: 33732 - protein, 11 aa, Homo sapiens
  heavy chain complementarity determining region 3 for antibody 16866
AKDTQWLPFDC

SEQ ID NO: 33733 - protein, 9 aa, Homo sapiens
  light chain complementarity determining region 3 for antibody 16867
LQATHWPYT

SEQ ID NO: 33734 - protein, 11 aa, Homo sapiens
  heavy chain complementarity determining region 3 for antibody 16867
AKDTQWLHFDC

SEQ ID NO: 33735 - protein, 9 aa, Homo sapiens
  light chain complementarity determining region 3 for antibody 16868
LQATHWPET

SEQ ID NO: 33736 - protein, 11 aa, Homo sapiens
  heavy chain complementarity determining region 3 for antibody 16868
AKDTQWLPFDC

SEQ ID NO: 33737 - protein, 9 aa, Homo sapiens
  light chain complementarity determining region 3 for antibody 16869
LQAPHWPYT

SEQ ID NO: 33738 - protein, 11 aa, Homo sapiens
  heavy chain complementarity determining region 3 for antibody 16869
AKDTQWLPFDC

SEQ ID NO: 33739 - protein, 9 aa, Homo sapiens
  light chain complementarity determining region 3 for antibody 16870
LQALQTPRT

SEQ ID NO: 33740 - protein, 23 aa, Homo sapiens
  heavy chain complementarity determining region 3 for antibody 16870
ARGGYSANDLSPDIPATYYGVDV

SEQ ID NO: 33741 - protein, 9 aa, Homo sapiens
  light chain complementarity determining region 3 for antibody 16871
LQALQLPFT

SEQ ID NO: 33742 - protein, 19 aa, Homo sapiens
  heavy chain complementarity determining region 3 for antibody 16871
VRHDRYCSGDRCFSFWFDP

SEQ ID NO: 33743 - protein, 9 aa, Homo sapiens
  light chain complementarity determining region 3 for antibody 16872
LPYYNTPHT

SEQ ID NO: 33744 - protein, 14 aa, Homo sapiens
  heavy chain complementarity determining region 3 for antibody 16872
ARASPKDGYNIIDY

SEQ ID NO: 33745 - protein, 9 aa, Homo sapiens
  light chain complementarity determining region 3 for antibody 16873
LPDYKYPRT

SEQ ID NO: 33746 - protein, 18 aa, Homo sapiens
  heavy chain complementarity determining region 3 for antibody 16873
ARDTSPGDSSAWYDAFDI

SEQ ID NO: 33747 - protein, 10 aa, Homo sapiens
  light chain complementarity determining region 3 for antibody 16874
LLRGTSPPYT

SEQ ID NO: 33748 - protein, 15 aa, Homo sapiens
  heavy chain complementarity determining region 3 for antibody 16874
ARGSYTKYYFYGLDV

SEQ ID NO: 33749 - protein, 10 aa, Homo sapiens
  light chain complementarity determining region 3 for antibody 16875
LLHGTSPPYP

SEQ ID NO: 33750 - protein, 15 aa, Homo sapiens
  heavy chain complementarity determining region 3 for antibody 16875
ARGSYTKYYFYGLDV

SEQ ID NO: 33751 - protein, 9 aa, Homo sapiens
  light chain complementarity determining region 3 for antibody 16876
LHYYNYPRT

SEQ ID NO: 33752 - protein, 14 aa, Homo sapiens
  heavy chain complementarity determining region 3 for antibody 16876
AREGVRGNFAYFDY

SEQ ID NO: 33753 - protein, 9 aa, Homo sapiens
  light chain complementarity determining region 3 for antibody 16877
LHNYRPSPA

SEQ ID NO: 33754 - protein, 11 aa, Homo sapiens
  heavy chain complementarity determining region 3 for antibody 16877
TRDPPGNGMDV

SEQ ID NO: 33755 - protein, 9 aa, Homo sapiens
  light chain complementarity determining region 3 for antibody 16878
LHDYKYPRT

SEQ ID NO: 33756 - protein, 18 aa, Homo sapiens
  heavy chain complementarity determining region 3 for antibody 16878
ARDTSPGDSSAWYDAFDI

SEQ ID NO: 33757 - protein, 10 aa, Homo sapiens
  light chain complementarity determining region 3 for antibody 16879
KQYVSSELFT

SEQ ID NO: 33758 - protein, 16 aa, Homo sapiens
  heavy chain complementarity determining region 3 for antibody 16879
AREIFKGEIDYYAMDV

SEQ ID NO: 33759 - protein, 9 aa, Homo sapiens
  light chain complementarity determining region 3 for antibody 16880
KQYGSSPYT

SEQ ID NO: 33760 - protein, 13 aa, Homo sapiens
  heavy chain complementarity determining region 3 for antibody 16880
ARGSTYGSGTYTS

SEQ ID NO: 33761 - protein, 9 aa, Homo sapiens
  light chain complementarity determining region 3 for antibody 16881
KQYGSSPWT

SEQ ID NO: 33762 - protein, 14 aa, Homo sapiens
  heavy chain complementarity determining region 3 for antibody 16881
AKDALVIGHDAFDV

SEQ ID NO: 33763 - protein, 9 aa, Homo sapiens
  light chain complementarity determining region 3 for antibody 16882
KQYDTYPLT

SEQ ID NO: 33764 - protein, 19 aa, Homo sapiens
  heavy chain complementarity determining region 3 for antibody 16882
ARDRSDTSMDPGGEGCFDH

SEQ ID NO: 33765 - protein, 9 aa, Homo sapiens
  light chain complementarity determining region 3 for antibody 16883
KQYDSFPYT

SEQ ID NO: 33766 - protein, 17 aa, Homo sapiens
  heavy chain complementarity determining region 3 for antibody 16883
AREDWSDVDLRAFYFDS

SEQ ID NO: 33767 - protein, 10 aa, Homo sapiens
  light chain complementarity determining region 3 for antibody 16884
KQYDNLPPFT

SEQ ID NO: 33768 - protein, 16 aa, Homo sapiens
  heavy chain complementarity determining region 3 for antibody 16884
ARELFKGEYDYYAMDV

SEQ ID NO: 33769 - protein, 9 aa, Homo sapiens
  light chain complementarity determining region 3 for antibody 16885
KQSYTFPWT

SEQ ID NO: 33770 - protein, 14 aa, Homo sapiens
  heavy chain complementarity determining region 3 for antibody 16885
ATDPPTDGYNSLDF

SEQ ID NO: 33771 - protein, 9 aa, Homo sapiens
  light chain complementarity determining region 3 for antibody 16886
KQSYSTLYT

SEQ ID NO: 33772 - protein, 12 aa, Homo sapiens
  heavy chain complementarity determining region 3 for antibody 16886
ARDRSSSEGSDY

SEQ ID NO: 33773 - protein, 8 aa, Homo sapiens
  light chain complementarity determining region 3 for antibody 16887
KQCCIPLP

SEQ ID NO: 33774 - protein, 26 aa, Homo sapiens
  heavy chain complementarity determining region 3 for antibody 16887
ARPNPSLGGYCHGGSCPDYYYYGLDV

SEQ ID NO: 33775 - protein, 9 aa, Homo sapiens
  light chain complementarity determining region 3 for antibody 16888
KQANSFPWT

SEQ ID NO: 33776 - protein, 14 aa, Homo sapiens
  heavy chain complementarity determining region 3 for antibody 16888
ARLNKMTRIRYFDS

SEQ ID NO: 33777 - protein, 6 aa, Homo sapiens
  light chain complementarity determining region 3 for antibody 16889
HYYSNS

SEQ ID NO: 33778 - protein, 18 aa, Homo sapiens
  heavy chain complementarity determining region 3 for antibody 16889
ATRHADYFNGYYYFALDV

SEQ ID NO: 33779 - protein, 6 aa, Homo sapiens
  light chain complementarity determining region 3 for antibody 16890
HYYGTS

SEQ ID NO: 33780 - protein, 18 aa, Homo sapiens
  heavy chain complementarity determining region 3 for antibody 16890
ATRHADYFNGYYYFALDV

SEQ ID NO: 33781 - protein, 6 aa, Homo sapiens
  light chain complementarity determining region 3 for antibody 16891
HYYGSS

SEQ ID NO: 33782 - protein, 18 aa, Homo sapiens
  heavy chain complementarity determining region 3 for antibody 16891
ATRHADYFNGYYYFALDV

SEQ ID NO: 33783 - protein, 6 aa, Homo sapiens
  light chain complementarity determining region 3 for antibody 16892
HYYGNS

SEQ ID NO: 33784 - protein, 18 aa, Homo sapiens
  heavy chain complementarity determining region 3 for antibody 16892
ATRHADYFSGYYYFALDV

SEQ ID NO: 33785 - protein, 9 aa, Homo sapiens
  light chain complementarity determining region 3 for antibody 16893
HRYSVPRGT

SEQ ID NO: 33786 - protein, 21 aa, Homo sapiens
  heavy chain complementarity determining region 3 for antibody 16893
ARDRGGDFHGDSSYYNRPFDY

SEQ ID NO: 33787 - protein, 9 aa, Homo sapiens
  light chain complementarity determining region 3 for antibody 16894
HRYNHLPPH

SEQ ID NO: 33788 - protein, 20 aa, Homo sapiens
  heavy chain complementarity determining region 3 for antibody 16894
ARGTYYDYVWGNYRPNWFDS

SEQ ID NO: 33789 - protein, 9 aa, Homo sapiens
  light chain complementarity determining region 3 for antibody 16895
HRTYDAPRS

SEQ ID NO: 33790 - protein, 14 aa, Homo sapiens
  heavy chain complementarity determining region 3 for antibody 16895
AALREIVVLTSPLQ

SEQ ID NO: 33791 - protein, 9 aa, Homo sapiens
  light chain complementarity determining region 3 for antibody 16896
HQYYSPSPP

SEQ ID NO: 33792 - protein, 13 aa, Homo sapiens
  heavy chain complementarity determining region 3 for antibody 16896
ARGEGSEFYGMDV

SEQ ID NO: 33793 - protein, 8 aa, Homo sapiens
  light chain complementarity determining region 3 for antibody 16897
HQYYSIPT

SEQ ID NO: 33794 - protein, 28 aa, Homo sapiens
  heavy chain complementarity determining region 3 for antibody 16897
ARTRRKAPYYDPLTGYYESVHYYYAMDV

SEQ ID NO: 33795 - protein, 8 aa, Homo sapiens
  light chain complementarity determining region 3 for antibody 16898
HQYYSIPT

SEQ ID NO: 33796 - protein, 28 aa, Homo sapiens
  heavy chain complementarity determining region 3 for antibody 16898
ARTRREAPYYDPLTGYYESAHYYYAMDV

SEQ ID NO: 33797 - protein, 8 aa, Homo sapiens
  light chain complementarity determining region 3 for antibody 16899
HQYYSIPK

SEQ ID NO: 33798 - protein, 28 aa, Homo sapiens
  heavy chain complementarity determining region 3 for antibody 16899
ARTRREAPYYDPLTGYYESVHYYYAMDV

SEQ ID NO: 33799 - protein, 9 aa, Homo sapiens
  light chain complementarity determining region 3 for antibody 16900
HQYYFFPYT

SEQ ID NO: 33800 - protein, 17 aa, Homo sapiens
  heavy chain complementarity determining region 3 for antibody 16900
AREDWNDADLRLFYLDY

SEQ ID NO: 33801 - protein, 9 aa, Homo sapiens
  light chain complementarity determining region 3 for antibody 16901
HQYYDTPNT

SEQ ID NO: 33802 - protein, 8 aa, Homo sapiens
  heavy chain complementarity determining region 3 for antibody 16901
AKSHPPDH

SEQ ID NO: 33803 - protein, 9 aa, Homo sapiens
  light chain complementarity determining region 3 for antibody 16902
HQYYDNPFT

SEQ ID NO: 33804 - protein, 13 aa, Homo sapiens
  heavy chain complementarity determining region 3 for antibody 16902
AREKLEPDYGMDV

SEQ ID NO: 33805 - protein, 9 aa, Homo sapiens
  light chain complementarity determining region 3 for antibody 16903
HQYYDIPFT

SEQ ID NO: 33806 - protein, 13 aa, Homo sapiens
  heavy chain complementarity determining region 3 for antibody 16903
AREYDSSGGGMDV

SEQ ID NO: 33807 - protein, 10 aa, Homo sapiens
  light chain complementarity determining region 3 for antibody 16904
HQYVPSHKYT

SEQ ID NO: 33808 - protein, 22 aa, Homo sapiens
  heavy chain complementarity determining region 3 for antibody 16904
ARHSPFLEMLGERWLQFGAFDI

SEQ ID NO: 33809 - protein, 9 aa, Homo sapiens
  light chain complementarity determining region 3 for antibody 16905
HQYSVSRWT

SEQ ID NO: 33810 - protein, 21 aa, Homo sapiens
  heavy chain complementarity determining region 3 for antibody 16905
ARDRGGDFHGDSSYYNRPFDY

SEQ ID NO: 33811 - protein, 9 aa, Homo sapiens
  light chain complementarity determining region 3 for antibody 16906
HQYSVSRGT

SEQ ID NO: 33812 - protein, 21 aa, Homo sapiens
  heavy chain complementarity determining region 3 for antibody 16906
ARDRGGGFHGDSSYYNRPFDY

SEQ ID NO: 33813 - protein, 9 aa, Homo sapiens
  light chain complementarity determining region 3 for antibody 16907
HQYSVSRGT

SEQ ID NO: 33814 - protein, 21 aa, Homo sapiens
  heavy chain complementarity determining region 3 for antibody 16907
ARDRGGDSHGDSSYYNRPFDY

SEQ ID NO: 33815 - protein, 9 aa, Homo sapiens
  light chain complementarity determining region 3 for antibody 16908
HQYSVSRGT

SEQ ID NO: 33816 - protein, 21 aa, Homo sapiens
  heavy chain complementarity determining region 3 for antibody 16908
ARDRGGDLHGDSSYYNRPFDY

SEQ ID NO: 33817 - protein, 9 aa, Homo sapiens
  light chain complementarity determining region 3 for antibody 16909
HQYSVSRGT

SEQ ID NO: 33818 - protein, 21 aa, Homo sapiens
  heavy chain complementarity determining region 3 for antibody 16909
ARDRGGDFHGGSSYYNRPFDY

SEQ ID NO: 33819 - protein, 9 aa, Homo sapiens
  light chain complementarity determining region 3 for antibody 16910
HQYSVSRGT

SEQ ID NO: 33820 - protein, 21 aa, Homo sapiens
  heavy chain complementarity determining region 3 for antibody 16910
ARDRGGDFHGESSYYNRPFDY

SEQ ID NO: 33821 - protein, 9 aa, Homo sapiens
  light chain complementarity determining region 3 for antibody 16911
HQYSVSRGT

SEQ ID NO: 33822 - protein, 21 aa, Homo sapiens
  heavy chain complementarity determining region 3 for antibody 16911
ARDRGGDFHGDSSYYTRPFDY

SEQ ID NO: 33823 - protein, 9 aa, Homo sapiens
  light chain complementarity determining region 3 for antibody 16912
HQYSVSRGT

SEQ ID NO: 33824 - protein, 21 aa, Homo sapiens
  heavy chain complementarity determining region 3 for antibody 16912
ARDRGGDFHGDSSYYNRPVDY

SEQ ID NO: 33825 - protein, 9 aa, Homo sapiens
  light chain complementarity determining region 3 for antibody 16913
HQYSVSRGT

SEQ ID NO: 33826 - protein, 21 aa, Homo sapiens
  heavy chain complementarity determining region 3 for antibody 16913
ARDRGGDFHGDSSYYNRPSDY

SEQ ID NO: 33827 - protein, 9 aa, Homo sapiens
  light chain complementarity determining region 3 for antibody 16914
HQYSVSRGT

SEQ ID NO: 33828 - protein, 21 aa, Homo sapiens
  heavy chain complementarity determining region 3 for antibody 16914
ARDRGGDFHGDSSYYNRHFDY

SEQ ID NO: 33829 - protein, 9 aa, Homo sapiens
  light chain complementarity determining region 3 for antibody 16915
HQYSVSPGT

SEQ ID NO: 33830 - protein, 21 aa, Homo sapiens
  heavy chain complementarity determining region 3 for antibody 16915
ARDRGGDFHGDSSYYNRPFDY

SEQ ID NO: 33831 - protein, 9 aa, Homo sapiens
  light chain complementarity determining region 3 for antibody 16916
HQYSIVPPT

SEQ ID NO: 33832 - protein, 18 aa, Homo sapiens
  heavy chain complementarity determining region 3 for antibody 16916
ARPRDCSSSSCFYDPFDY

SEQ ID NO: 33833 - protein, 9 aa, Homo sapiens
  light chain complementarity determining region 3 for antibody 16917
HQYSISRGT

SEQ ID NO: 33834 - protein, 21 aa, Homo sapiens
  heavy chain complementarity determining region 3 for antibody 16917
ARDRGGDFHGDSSYYNRPFDY

SEQ ID NO: 33835 - protein, 9 aa, Homo sapiens
  light chain complementarity determining region 3 for antibody 16918
HQYSASRGT

SEQ ID NO: 33836 - protein, 21 aa, Homo sapiens
  heavy chain complementarity determining region 3 for antibody 16918
ARDRGGDFHGDSSYYNRPFDY

SEQ ID NO: 33837 - protein, 8 aa, Homo sapiens
  light chain complementarity determining region 3 for antibody 16919
HQYPSFST

SEQ ID NO: 33838 - protein, 15 aa, Homo sapiens
  heavy chain complementarity determining region 3 for antibody 16919
ARTDMIRGVIGAFDV

SEQ ID NO: 33839 - protein, 9 aa, Homo sapiens
  light chain complementarity determining region 3 for antibody 16920
HQYNSYPYT

SEQ ID NO: 33840 - protein, 19 aa, Homo sapiens
  heavy chain complementarity determining region 3 for antibody 16920
ARDQSSSYGDYYYYYGMDV

SEQ ID NO: 33841 - protein, 8 aa, Homo sapiens
  light chain complementarity determining region 3 for antibody 16921
HQYNNWPS

SEQ ID NO: 33842 - protein, 12 aa, Homo sapiens
  heavy chain complementarity determining region 3 for antibody 16921
VQGNGAGSYSRH

SEQ ID NO: 33843 - protein, 10 aa, Homo sapiens [sequence omitted]

SEQ ID NO: 33844 - protein, 19 aa, Homo sapiens
  heavy chain complementarity determining region 3 for antibody 16922
VTDYDFPRHSSSWSPWFDP

SEQ ID NO: 33845 - protein, 8 aa, Homo sapiens
  light chain complementarity determining region 3 for antibody 16923
HQYLSFST

SEQ ID NO: 33846 - protein, 15 aa, Homo sapiens
  heavy chain complementarity determining region 3 for antibody 16923
ARTDMMRGVIGAFDV

SEQ ID NO: 33847 - protein, 8 aa, Homo sapiens
  light chain complementarity determining region 3 for antibody 16924
HQYLFFST

SEQ ID NO: 33848 - protein, 15 aa, Homo sapiens
  heavy chain complementarity determining region 3 for antibody 16924
ARTDMIRGVIGAFDV

SEQ ID NO: 33849 - protein, 9 aa, Homo sapiens
  light chain complementarity determining region 3 for antibody 16925
HQYGSSWYN

SEQ ID NO: 33850 - protein, 20 aa, Homo sapiens
  heavy chain complementarity determining region 3 for antibody 16925
ARDPHRYGGKDSLYHYGLDV

SEQ ID NO: 33851 - protein, 9 aa, Homo sapiens
  light chain complementarity determining region 3 for antibody 16926
HQYGSSWDT

SEQ ID NO: 33852 - protein, 20 aa, Homo sapiens
  heavy chain complementarity determining region 3 for antibody 16926
ARDPHRYGGKDSLYHYGLDV

SEQ ID NO: 33853 - protein, 9 aa, Homo sapiens
  light chain complementarity determining region 3 for antibody 16927
HQYGSSRGT

SEQ ID NO: 33854 - protein, 21 aa, Homo sapiens
  heavy chain complementarity determining region 3 for antibody 16927
ATDRGGDYYRKSGYYYRPFDY

SEQ ID NO: 33855 - protein, 9 aa, Homo sapiens
  light chain complementarity determining region 3 for antibody 16928
HQYGNLPGT

SEQ ID NO: 33856 - protein, 15 aa, Homo sapiens
  heavy chain complementarity determining region 3 for antibody 16928
VKVIWYYFGLGGFDP

SEQ ID NO: 33857 - protein, 10 aa, Homo sapiens
  light chain complementarity determining region 3 for antibody 16929
HQYGGSPPYT

SEQ ID NO: 33858 - protein, 13 aa, Homo sapiens
  heavy chain complementarity determining region 3 for antibody 16929
VKEGTVVAAPLDV

SEQ ID NO: 33859 - protein, 10 aa, Homo sapiens
  light chain complementarity determining region 3 for antibody 16930
HQYGGPPPYT

SEQ ID NO: 33860 - protein, 13 aa, Homo sapiens
  heavy chain complementarity determining region 3 for antibody 16930
AKEGTVVAAPLDV

SEQ ID NO: 33861 - protein, 8 aa, Homo sapiens
  light chain complementarity determining region 3 for antibody 16931
HQYDTSPP

SEQ ID NO: 33862 - protein, 17 aa, Homo sapiens
  heavy chain complementarity determining region 3 for antibody 16931
ARDGSYGDRMYYYGMGV

SEQ ID NO: 33863 - protein, 9 aa, Homo sapiens
  light chain complementarity determining region 3 for antibody 16932
HQYDSLPLT

SEQ ID NO: 33864 - protein, 18 aa, Homo sapiens
  heavy chain complementarity determining region 3 for antibody 16932
ARAPGDYDMLRRGYYFDH

SEQ ID NO: 33865 - protein, 9 aa, Homo sapiens
  light chain complementarity determining region 3 for antibody 16933
HQYATSQLT

SEQ ID NO: 33866 - protein, 10 aa, Homo sapiens
  heavy chain complementarity determining region 3 for antibody 16933
GYSNGWLVHY

SEQ ID NO: 33867 - protein, 9 aa, Homo sapiens
  light chain complementarity determining region 3 for antibody 16934
HQYATSPLT

SEQ ID NO: 33868 - protein, 10 aa, Homo sapiens
  heavy chain complementarity determining region 3 for antibody 16934
GYSNGGLVHY

SEQ ID NO: 33869 - protein, 8 aa, Homo sapiens
  light chain complementarity determining region 3 for antibody 16935
HQTNSFPP

SEQ ID NO: 33870 - protein, 21 aa, Homo sapiens
  heavy chain complementarity determining region 3 for antibody 16935
ARHSGYSNTWYMNYYYYGMDV

SEQ ID NO: 33871 - protein, 8 aa, Homo sapiens
  light chain complementarity determining region 3 for antibody 16936
HQTNSFPP

SEQ ID NO: 33872 - protein, 22 aa, Homo sapiens
  heavy chain complementarity determining region 3 for antibody 16936
ARHSGYSNTWYMNYYYYDGMDV

SEQ ID NO: 33873 - protein, 8 aa, Homo sapiens
  light chain complementarity determining region 3 for antibody 16937
HQTNSFPP

SEQ ID NO: 33874 - protein, 22 aa, Homo sapiens
  heavy chain complementarity determining region 3 for antibody 16937
ARHSGYSNTWYMNYYHYYGMDV

SEQ ID NO: 33875 - protein, 8 aa, Homo sapiens
  light chain complementarity determining region 3 for antibody 16938
HQTNSFPP

SEQ ID NO: 33876 - protein, 22 aa, Homo sapiens
  heavy chain complementarity determining region 3 for antibody 16938
ARHSGYSNTWYMNYYDYYGMDV

SEQ ID NO: 33877 - protein, 8 aa, Homo sapiens
  light chain complementarity determining region 3 for antibody 16939
HQTNSFPP

SEQ ID NO: 33878 - protein, 22 aa, Homo sapiens
  heavy chain complementarity determining region 3 for antibody 16939
ARHSGYSNTWYMKYYYYYGMDV

SEQ ID NO: 33879 - protein, 8 aa, Homo sapiens
  light chain complementarity determining region 3 for antibody 16940
HQTNSFPP

SEQ ID NO: 33880 - protein, 22 aa, Homo sapiens
  heavy chain complementarity determining region 3 for antibody 16940
ARHSGYGNTWYMNYYYYYGMDV

SEQ ID NO: 33881 - protein, 8 aa, Homo sapiens
  light chain complementarity determining region 3 for antibody 16941
HQSYTNPP

SEQ ID NO: 33882 - protein, 16 aa, Homo sapiens
  heavy chain complementarity determining region 3 for antibody 16941
AATVTTRPYYYYGMDV

SEQ ID NO: 33883 - protein, 9 aa, Homo sapiens
  light chain complementarity determining region 3 for antibody 16942
HQSYTIPYT

SEQ ID NO: 33884 - protein, 11 aa, Homo sapiens
  heavy chain complementarity determining region 3 for antibody 16942
ARVRGSSWIDY

SEQ ID NO: 33885 - protein, 9 aa, Homo sapiens
  light chain complementarity determining region 3 for antibody 16943
HQSYSSPFT

SEQ ID NO: 33886 - protein, 11 aa, Homo sapiens
  heavy chain complementarity determining region 3 for antibody 16943
VHKGDYASWDY

SEQ ID NO: 33887 - protein, 10 aa, Homo sapiens
  light chain complementarity determining region 3 for antibody 16944
HQSTILPRLT

SEQ ID NO: 33888 - protein, 18 aa, Homo sapiens
  heavy chain complementarity determining region 3 for antibody 16944
TRDVGYDRSANYHWYFDV

SEQ ID NO: 33889 - protein, 10 aa, Homo sapiens
  light chain complementarity determining region 3 for antibody 16945
HQSSSLVRLP

SEQ ID NO: 33890 - protein, 18 aa, Homo sapiens
  heavy chain complementarity determining region 3 for antibody 16945
ARDLGYDYNANYHWYFDL

SEQ ID NO: 33891 - protein, 10 aa, Homo sapiens
  light chain complementarity determining region 3 for antibody 16946
HQSSSLPRRT

SEQ ID NO: 33892 - protein, 18 aa, Homo sapiens
  heavy chain complementarity determining region 3 for antibody 16946
ARDVGYDSNAHYHWYFDL

SEQ ID NO: 33893 - protein, 10 aa, Homo sapiens
  light chain complementarity determining region 3 for antibody 16947
HQSSSLPRPT

SEQ ID NO: 33894 - protein, 18 aa, Homo sapiens
  heavy chain complementarity determining region 3 for antibody 16947
ARDVGYDSNAHYHWYFDL

SEQ ID NO: 33895 - protein, 10 aa, Homo sapiens
  light chain complementarity determining region 3 for antibody 16948
HQSSSLPRLT

SEQ ID NO: 33896 - protein, 18 aa, Homo sapiens
  heavy chain complementarity determining region 3 for antibody 16948
VRDVGYDSNAHYHWYFDL

SEQ ID NO: 33897 - protein, 10 aa, Homo sapiens
  light chain complementarity determining region 3 for antibody 16949
HQSSSLPRLT

SEQ ID NO: 33898 - protein, 18 aa, Homo sapiens
  heavy chain complementarity determining region 3 for antibody 16949
ARDVGYGSNAHYHWYFDL

SEQ ID NO: 33899 - protein, 10 aa, Homo sapiens
  light chain complementarity determining region 3 for antibody 16950
HQSSSLPRLT

SEQ ID NO: 33900 - protein, 18 aa, Homo sapiens
  heavy chain complementarity determining region 3 for antibody 16950
ARDVGYDSNAHYQWYFDL

SEQ ID NO: 33901 - protein, 10 aa, Homo sapiens
  light chain complementarity determining region 3 for antibody 16951
HQSSSLPRLT

SEQ ID NO: 33902 - protein, 18 aa, Homo sapiens
  heavy chain complementarity determining region 3 for antibody 16951
ARDVGYDSNAHYHRYFDL

SEQ ID NO: 33903 - protein, 10 aa, Homo sapiens
  light chain complementarity determining region 3 for antibody 16952
HQSSSLPRLT

SEQ ID NO: 33904 - protein, 18 aa, Homo sapiens
  heavy chain complementarity determining region 3 for antibody 16952
ARDVGYDSNAHHHWYFDL

SEQ ID NO: 33905 - protein, 10 aa, Homo sapiens
  light chain complementarity determining region 3 for antibody 16953
HQSSSLPRLT

SEQ ID NO: 33906 - protein, 18 aa, Homo sapiens
  heavy chain complementarity determining region 3 for antibody 16953
ARDVGYDSNAHCHWYFDL

SEQ ID NO: 33907 - protein, 10 aa, Homo sapiens
  light chain complementarity determining region 3 for antibody 16954
HQSSSLPRLT

SEQ ID NO: 33908 - protein, 18 aa, Homo sapiens
  heavy chain complementarity determining region 3 for antibody 16954
ARDLGDDFNAYYHWYFDL

SEQ ID NO: 33909 - protein, 10 aa, Homo sapiens
  light chain complementarity determining region 3 for antibody 16955
HQSSSLPRLT

SEQ ID NO: 33910 - protein, 18 aa, Homo sapiens
  heavy chain complementarity determining region 3 for antibody 16955
AGDVGYDSNAHYHWYFDL

SEQ ID NO: 33911 - protein, 10 aa, Homo sapiens
  light chain complementarity determining region 3 for antibody 16956
HQSSSLPRLN

SEQ ID NO: 33912 - protein, 18 aa, Homo sapiens
  heavy chain complementarity determining region 3 for antibody 16956
ARDVGYDSNAHYHWYFDL

SEQ ID NO: 33913 - protein, 9 aa, Homo sapiens
  light chain complementarity determining region 3 for antibody 16957
HQSSSFPYT

SEQ ID NO: 33914 - protein, 19 aa, Homo sapiens
  heavy chain complementarity determining region 3 for antibody 16957
ARDRDYTIVDDYGSGVIDF

SEQ ID NO: 33915 - protein, 9 aa, Homo sapiens
  light chain complementarity determining region 3 for antibody 16958
HQSSSFPWT

SEQ ID NO: 33916 - protein, 15 aa, Homo sapiens
  heavy chain complementarity determining region 3 for antibody 16958
ATLRVVGITSEWSGS

SEQ ID NO: 33917 - protein, 9 aa, Homo sapiens
  light chain complementarity determining region 3 for antibody 16959
HQSSRLPPT

SEQ ID NO: 33918 - protein, 11 aa, Homo sapiens
  heavy chain complementarity determining region 3 for antibody 16959
ARGDYLDAFHF

SEQ ID NO: 33919 - protein, 10 aa, Homo sapiens
  light chain complementarity determining region 3 for antibody 16960
HQSSGLPRLT

SEQ ID NO: 33920 - protein, 18 aa, Homo sapiens
  heavy chain complementarity determining region 3 for antibody 16960
ARDVGYDSNAHYHWYFDL

SEQ ID NO: 33921 - protein, 10 aa, Homo sapiens
  light chain complementarity determining region 3 for antibody 16961
HQSNSLPRLT

SEQ ID NO: 33922 - protein, 18 aa, Homo sapiens
  heavy chain complementarity determining region 3 for antibody 16961
ARDVGYDSNAHYHWYFDL

SEQ ID NO: 33923 - protein, 10 aa, Homo sapiens
  light chain complementarity determining region 3 for antibody 16962
HQSFSPPSLP

SEQ ID NO: 33924 - protein, 10 aa, Homo sapiens
  heavy chain complementarity determining region 3 for antibody 16962
ARDWGWGFDP

SEQ ID NO: 33925 - protein, 9 aa, Homo sapiens
  light chain complementarity determining region 3 for antibody 16963
HQRTNWPVT

SEQ ID NO: 33926 - protein, 19 aa, Homo sapiens
  heavy chain complementarity determining region 3 for antibody 16963
VRARQYRSSWYGPSDAFDI

SEQ ID NO: 33927 - protein, 10 aa, Homo sapiens
  light chain complementarity determining region 3 for antibody 16964
HQRSNWPPFT

SEQ ID NO: 33928 - protein, 15 aa, Homo sapiens
  heavy chain complementarity determining region 3 for antibody 16964
ARDGCSGASCYSFGH

SEQ ID NO: 33929 - protein, 10 aa, Homo sapiens
  light chain complementarity determining region 3 for antibody 16965
HQRSNWPPFT

SEQ ID NO: 33930 - protein, 15 aa, Homo sapiens
  heavy chain complementarity determining region 3 for antibody 16965
ARDGCSGASCYSFDH

SEQ ID NO: 33931 - protein, 9 aa, Homo sapiens
  light chain complementarity determining region 3 for antibody 16966
HQRSNWPLT

SEQ ID NO: 33932 - protein, 17 aa, Homo sapiens
  heavy chain complementarity determining region 3 for antibody 16966
AKASSTPSHRGFYYMDV

SEQ ID NO: 33933 - protein, 9 aa, Homo sapiens
  light chain complementarity determining region 3 for antibody 16967
HQRGNWPPT

SEQ ID NO: 33934 - protein, 13 aa, Homo sapiens
  heavy chain complementarity determining region 3 for antibody 16967
VRDGVWSTSSADL

SEQ ID NO: 33935 - protein, 9 aa, Homo sapiens
  light chain complementarity determining region 3 for antibody 16968
HQRGNWPPT

SEQ ID NO: 33936 - protein, 13 aa, Homo sapiens
  heavy chain complementarity determining region 3 for antibody 16968
ARDGVWSTSSADP

SEQ ID NO: 33937 - protein, 9 aa, Homo sapiens
  light chain complementarity determining region 3 for antibody 16969
HQRGNWPPT

SEQ ID NO: 33938 - protein, 13 aa, Homo sapiens
  heavy chain complementarity determining region 3 for antibody 16969
ARDGGWSTSSADL

SEQ ID NO: 33939 - protein, 9 aa, Homo sapiens
  light chain complementarity determining region 3 for antibody 16970
HQRGNWPPP

SEQ ID NO: 33940 - protein, 13 aa, Homo sapiens
  heavy chain complementarity determining region 3 for antibody 16970
ARDGVWSTSSADL

SEQ ID NO: 33941 - protein, 10 aa, Homo sapiens
  light chain complementarity determining region 3 for antibody 16971
HQRGNWPPIT

SEQ ID NO: 33942 - protein, 18 aa, Homo sapiens
  heavy chain complementarity determining region 3 for antibody 16971
AKDLAPSMRVVAQGALDI

SEQ ID NO: 33943 - protein, 10 aa, Homo sapiens
  light chain complementarity determining region 3 for antibody 16972
HQRGDWPPYT

SEQ ID NO: 33944 - protein, 22 aa, Homo sapiens
  heavy chain complementarity determining region 3 for antibody 16972
ARDRLAGPPWVGDLLSKRYFDY

SEQ ID NO: 33945 - protein, 9 aa, Homo sapiens
  light chain complementarity determining region 3 for antibody 16973
HQNGTSRGT

SEQ ID NO: 33946 - protein, 21 aa, Homo sapiens
  heavy chain complementarity determining region 3 for antibody 16973
ATDRGGDYYRKSGYYYRPFDY

SEQ ID NO: 33947 - protein, 9 aa, Homo sapiens
  light chain complementarity determining region 3 for antibody 16974
HQLNSYPWT

SEQ ID NO: 33948 - protein, 11 aa, Homo sapiens
  heavy chain complementarity determining region 3 for antibody 16974
ASLMVRRGIDV

SEQ ID NO: 33949 - protein, 9 aa, Homo sapiens
  light chain complementarity determining region 3 for antibody 16975
HQLGSSPFT

SEQ ID NO: 33950 - protein, 13 aa, Homo sapiens
  heavy chain complementarity determining region 3 for antibody 16975
ARHLYSDLIPFDY

SEQ ID NO: 33951 - protein, 9 aa, Homo sapiens
  light chain complementarity determining region 3 for antibody 16976
HQGNSVPWT

SEQ ID NO: 33952 - protein, 17 aa, Homo sapiens
  heavy chain complementarity determining region 3 for antibody 16976
ARVHDSSNYHVAEYFQY

SEQ ID NO: 33953 - protein, 9 aa, Homo sapiens
  light chain complementarity determining region 3 for antibody 16977
HQDGTSRGT

SEQ ID NO: 33954 - protein, 21 aa, Homo sapiens
  heavy chain complementarity determining region 3 for antibody 16977
ATDRGGDYYRKSGYYYRPFDY

SEQ ID NO: 33955 - protein, 10 aa, Homo sapiens
  light chain complementarity determining region 3 for antibody 16978
HQCNNWPPWT

SEQ ID NO: 33956 - protein, 19 aa, Homo sapiens
  heavy chain complementarity determining region 3 for antibody 16978
VTDYDFPRHSSSWSPWFDP

SEQ ID NO: 33957 - protein, 11 aa, Homo sapiens
  light chain complementarity determining region 3 for antibody 16979
HQCNKWPPRDT

SEQ ID NO: 33958 - protein, 14 aa, Homo sapiens
  heavy chain complementarity determining region 3 for antibody 16979
AKDECGDGYYGMDV

SEQ ID NO: 33959 - protein, 8 aa, Homo sapiens
  light chain complementarity determining region 3 for antibody 16980
HQANSSPP

SEQ ID NO: 33960 - protein, 22 aa, Homo sapiens
  heavy chain complementarity determining region 3 for antibody 16980
TRHSGYSNTWYMNYYYYYGMDV

SEQ ID NO: 33961 - protein, 9 aa, Homo sapiens
  light chain complementarity determining region 3 for antibody 16981
HQANSLPHT

SEQ ID NO: 33962 - protein, 14 aa, Homo sapiens
  heavy chain complementarity determining region 3 for antibody 16981
ARDRSVTYGKYFGH

SEQ ID NO: 33963 - protein, 8 aa, Homo sapiens
  light chain complementarity determining region 3 for antibody 16982
HQANSFPP

SEQ ID NO: 33964 - protein, 22 aa, Homo sapiens
  heavy chain complementarity determining region 3 for antibody 16982
TRHSGYSNTWYMNYYYYCGMDV

SEQ ID NO: 33965 - protein, 8 aa, Homo sapiens
  light chain complementarity determining region 3 for antibody 16983
HQANSFPP

SEQ ID NO: 33966 - protein, 22 aa, Homo sapiens
  heavy chain complementarity determining region 3 for antibody 16983
TRHSGYSNTWYMDYYYYYGMDV

SEQ ID NO: 33967 - protein, 9 aa, Homo sapiens
  light chain complementarity determining region 3 for antibody 16984
HQAKSFPIT

SEQ ID NO: 33968 - protein, 19 aa, Homo sapiens
  heavy chain complementarity determining region 3 for antibody 16984
ATDRYCSRPNCPQGNWFDP

SEQ ID NO: 33969 - protein, 10 aa, Homo sapiens
  light chain complementarity determining region 3 for antibody 16985
HPSTILPRLT

SEQ ID NO: 33970 - protein, 18 aa, Homo sapiens
  heavy chain complementarity determining region 3 for antibody 16985
ARDVGYDRSANYHWYFDV

SEQ ID NO: 33971 - protein, 8 aa, Homo sapiens
  light chain complementarity determining region 3 for antibody 16986
HKTNSFPP

SEQ ID NO: 33972 - protein, 22 aa, Homo sapiens
  heavy chain complementarity determining region 3 for antibody 16986
ARHSGYSNTWYMNYYYYYGMDV

SEQ ID NO: 33973 - protein, 10 aa, Homo sapiens
  light chain complementarity determining region 3 for antibody 16987
HKSSSLPRLT

SEQ ID NO: 33974 - protein, 18 aa, Homo sapiens
  heavy chain complementarity determining region 3 for antibody 16987
ARDVGYDSNAHYHWYFDL

SEQ ID NO: 33975 - protein, 9 aa, Homo sapiens
  light chain complementarity determining region 3 for antibody 16988
HHYNNWLYT

SEQ ID NO: 33976 - protein, 13 aa, Homo sapiens
  heavy chain complementarity determining region 3 for antibody 16988
AYSPSTTVTPLDY

SEQ ID NO: 33977 - protein, 9 aa, Homo sapiens
  light chain complementarity determining region 3 for antibody 16989
HHYHSFPYT

SEQ ID NO: 33978 - protein, 17 aa, Homo sapiens
  heavy chain complementarity determining region 3 for antibody 16989
AREDWNDVDTREFYFDY

SEQ ID NO: 33979 - protein, 9 aa, Homo sapiens
  light chain complementarity determining region 3 for antibody 16990
AQGSYGPAT

SEQ ID NO: 33980 - protein, 10 aa, Homo sapiens
  heavy chain complementarity determining region 3 for antibody 16990
CRDRRGFGDV

SEQ ID NO: 33981 - protein, 9 aa, Homo sapiens
  light chain complementarity determining region 3 for antibody 16991
MQALETPFT

SEQ ID NO: 33982 - protein, 15 aa, Homo sapiens
  heavy chain complementarity determining region 3 for antibody 16991
VRHYRETVAGIEGDS

SEQ ID NO: 33983 - protein, 9 aa, Homo sapiens
  light chain complementarity determining region 3 for antibody 16992
MQALETPFT

SEQ ID NO: 33984 - protein, 15 aa, Homo sapiens
  heavy chain complementarity determining region 3 for antibody 16992
VRHYRIITAPLEGDS

SEQ ID NO: 33985 - protein, 9 aa, Homo sapiens
  light chain complementarity determining region 3 for antibody 16993
LQHNSYPLT

SEQ ID NO: 33986 - protein, 13 aa, Homo sapiens
  heavy chain complementarity determining region 3 for antibody 16993
VRHAVVRPMVVDD

SEQ ID NO: 33987 - protein, 9 aa, Homo sapiens
  light chain complementarity determining region 3 for antibody 16994
QQYGSSPRT

SEQ ID NO: 33988 - protein, 25 aa, Homo sapiens
  heavy chain complementarity determining region 3 for antibody 16994
ARLRIDRLRLPGAMRGPLYDCGLNV

SEQ ID NO: 33989 - protein, 10 aa, Homo sapiens
  light chain complementarity determining region 3 for antibody 16995
QQYGSSPMYS

SEQ ID NO: 33990 - protein, 11 aa, Homo sapiens
  heavy chain complementarity determining region 3 for antibody 16995
ARGGQWGSLDY

SEQ ID NO: 33991 - protein, 9 aa, Homo sapiens
  light chain complementarity determining region 3 for antibody 16996
LQGNRFPHT

SEQ ID NO: 33992 - protein, 14 aa, Homo sapiens
  heavy chain complementarity determining region 3 for antibody 16996
ARYCSGNSCYSMDH

SEQ ID NO: 33993 - protein, 10 aa, Homo sapiens
  light chain complementarity determining region 3 for antibody 16997
QQRSKWPPLT

SEQ ID NO: 33994 - protein, 9 aa, Homo sapiens
  heavy chain complementarity determining region 3 for antibody 16997
ARVDGYFDY

SEQ ID NO: 33995 - protein, 9 aa, Homo sapiens
  light chain complementarity determining region 3 for antibody 16998
HQYSSSPYT

SEQ ID NO: 33996 - protein, 13 aa, Homo sapiens
  heavy chain complementarity determining region 3 for antibody 16998
ARGTYSAFAIFGV

SEQ ID NO: 33997 - protein, 10 aa, Homo sapiens
  light chain complementarity determining region 3 for antibody 16999
QQRYNWPPFT

SEQ ID NO: 33998 - protein, 11 aa, Homo sapiens
  heavy chain complementarity determining region 3 for antibody 16999
ARGVGSYPFDS

SEQ ID NO: 33999 - protein, 9 aa, Homo sapiens
  light chain complementarity determining region 3 for antibody 17000
QQYGTSPFT

SEQ ID NO: 34000 - protein, 15 aa, Homo sapiens
  heavy chain complementarity determining region 3 for antibody 17000
ARQNDFLSGPGEFDP

SEQ ID NO: 34001 - protein, 9 aa, Homo sapiens
  light chain complementarity determining region 3 for antibody 17001
QQRSSWPYT

SEQ ID NO: 34002 - protein, 11 aa, Homo sapiens
  heavy chain complementarity determining region 3 for antibody 17001
VKRWGGSSIDY

SEQ ID NO: 34003 - protein, 9 aa, Homo sapiens
  light chain complementarity determining region 3 for antibody 17002
MQALETPFT

SEQ ID NO: 34004 - protein, 15 aa, Homo sapiens
  heavy chain complementarity determining region 3 for antibody 17002
VRHYRELATGIEGDS

SEQ ID NO: 34005 - protein, 9 aa, Homo sapiens
  light chain complementarity determining region 3 for antibody 17003
QQYYTSLRT

SEQ ID NO: 34006 - protein, 12 aa, Homo sapiens
  heavy chain complementarity determining region 3 for antibody 17003
VKDCGLGGSRDS

SEQ ID NO: 34007 - protein, 9 aa, Homo sapiens
  light chain complementarity determining region 3 for antibody 17004
QQYGTPPRT

SEQ ID NO: 34008 - protein, 25 aa, Homo sapiens
  heavy chain complementarity determining region 3 for antibody 17004
ARLRVDRLRLPGAMRGPLYDRGLNV

SEQ ID NO: 34009 - protein, 9 aa, Homo sapiens
  light chain complementarity determining region 3 for antibody 17005
HHTYTFPRT

SEQ ID NO: 34010 - protein, 20 aa, Homo sapiens
  heavy chain complementarity determining region 3 for antibody 17005
ARGRRIAALSTAHYYYGMDV

SEQ ID NO: 34011 - protein, 9 aa, Homo sapiens
  light chain complementarity determining region 3 for antibody 17006
QQYGTSPRT

SEQ ID NO: 34012 - protein, 13 aa, Homo sapiens
  heavy chain complementarity determining region 3 for antibody 17006
PIGFYDRSGYHEY

SEQ ID NO: 34013 - protein, 9 aa, Homo sapiens
  light chain complementarity determining region 3 for antibody 17007
QQYGNLPRT

SEQ ID NO: 34014 - protein, 13 aa, Homo sapiens
  heavy chain complementarity determining region 3 for antibody 17007
AGGDFHSGGYSEF

SEQ ID NO: 34015 - protein, 9 aa, Homo sapiens
  light chain complementarity determining region 3 for antibody 17008
QQYGSIPLT

SEQ ID NO: 34016 - protein, 7 aa, Homo sapiens
  heavy chain complementarity determining region 3 for antibody 17008
HGYELKC

SEQ ID NO: 34017 - protein, 9 aa, Homo sapiens
  light chain complementarity determining region 3 for antibody 17009
HHTSTFPRT

SEQ ID NO: 34018 - protein, 20 aa, Homo sapiens
  heavy chain complementarity determining region 3 for antibody 17009
ARGRRIAALSTAHYYYGMDV

SEQ ID NO: 34019 - protein, 10 aa, Homo sapiens
  light chain complementarity determining region 3 for antibody 17010
QQYNQWPPLT

SEQ ID NO: 34020 - protein, 17 aa, Homo sapiens
  heavy chain complementarity determining region 3 for antibody 17010
ARDLYFSIIQGGGAFDA

SEQ ID NO: 34021 - protein, 9 aa, Homo sapiens
  light chain complementarity determining region 3 for antibody 17011
LQHDNFPYS

SEQ ID NO: 34022 - protein, 12 aa, Homo sapiens
  heavy chain complementarity determining region 3 for antibody 17011
AREWDSGWYPAS

SEQ ID NO: 34023 - protein, 9 aa, Homo sapiens
  light chain complementarity determining region 3 for antibody 17012
QQFYTYPLT

SEQ ID NO: 34024 - protein, 12 aa, Homo sapiens
  heavy chain complementarity determining region 3 for antibody 17012
TRVLSSAIGEWD

SEQ ID NO: 34025 - protein, 9 aa, Homo sapiens
  light chain complementarity determining region 3 for antibody 17013
QQYGSSPRT

SEQ ID NO: 34026 - protein, 18 aa, Homo sapiens
  heavy chain complementarity determining region 3 for antibody 17013
ATAFWVGLGVPPPGFFEY

SEQ ID NO: 34027 - protein, 9 aa, Homo sapiens
  light chain complementarity determining region 3 for antibody 17014
QQYGNIPRT

SEQ ID NO: 34028 - protein, 13 aa, Homo sapiens
  heavy chain complementarity determining region 3 for antibody 17014
AGGLFHSSGYSEF

SEQ ID NO: 34029 - protein, 9 aa, Homo sapiens
  light chain complementarity determining region 3 for antibody 17015
LQYGFAQYS

SEQ ID NO: 34030 - protein, 18 aa, Homo sapiens
  heavy chain complementarity determining region 3 for antibody 17015
TGVHGLTMLRGATKPFDF

SEQ ID NO: 34031 - protein, 8 aa, Homo sapiens
  light chain complementarity determining region 3 for antibody 17016
QQYGTSRM

SEQ ID NO: 34032 - protein, 13 aa, Homo sapiens
  heavy chain complementarity determining region 3 for antibody 17016
ARGQFVGSAYYEN

SEQ ID NO: 34033 - protein, 9 aa, Homo sapiens
  light chain complementarity determining region 3 for antibody 17017
QHYVTSPLT

SEQ ID NO: 34034 - protein, 8 aa, Homo sapiens
  heavy chain complementarity determining region 3 for antibody 17017
VCMIVATN

SEQ ID NO: 34035 - protein, 9 aa, Homo sapiens
  light chain complementarity determining region 3 for antibody 17018
QQYGSIPRT

SEQ ID NO: 34036 - protein, 13 aa, Homo sapiens
  heavy chain complementarity determining region 3 for antibody 17018
AGGGFSSGRYSEY

SEQ ID NO: 34037 - protein, 9 aa, Homo sapiens
  light chain complementarity determining region 3 for antibody 17019
QQGYRPPFI

SEQ ID NO: 34038 - protein, 15 aa, Homo sapiens
  heavy chain complementarity determining region 3 for antibody 17019
TRAQVIWGQLYYFDY

SEQ ID NO: 34039 - protein, 9 aa, Homo sapiens
  light chain complementarity determining region 3 for antibody 17020
QQAHSFPLA

SEQ ID NO: 34040 - protein, 11 aa, Homo sapiens
  heavy chain complementarity determining region 3 for antibody 17020
VHSPAMAEIDY

SEQ ID NO: 34041 - protein, 9 aa, Homo sapiens
  light chain complementarity determining region 3 for antibody 17021
LQNEYWPRT

SEQ ID NO: 34042 - protein, 11 aa, Homo sapiens
  heavy chain complementarity determining region 3 for antibody 17021
VRVGGAGYFDH

SEQ ID NO: 34043 - protein, 9 aa, Homo sapiens
  light chain complementarity determining region 3 for antibody 17022
QQRSNWPPT

SEQ ID NO: 34044 - protein, 8 aa, Homo sapiens
  heavy chain complementarity determining region 3 for antibody 17022
ATLGNDSD

SEQ ID NO: 34045 - protein, 9 aa, Homo sapiens
  light chain complementarity determining region 3 for antibody 17023
QQYGSIPRT

SEQ ID NO: 34046 - protein, 14 aa, Homo sapiens
  heavy chain complementarity determining region 3 for antibody 17023
AGGEFSSGWHYSEN

SEQ ID NO: 34047 - protein, 9 aa, Homo sapiens
  light chain complementarity determining region 3 for antibody 17024
QQYGGSPRT

SEQ ID NO: 34048 - protein, 13 aa, Homo sapiens
  heavy chain complementarity determining region 3 for antibody 17024
ASGYFDSGAYYEF

SEQ ID NO: 34049 - protein, 9 aa, Homo sapiens
  light chain complementarity determining region 3 for antibody 17025
QQYGSSPLT

SEQ ID NO: 34050 - protein, 19 aa, Homo sapiens
  heavy chain complementarity determining region 3 for antibody 17025
ARGSSSSRRRAAVVGYFDL

SEQ ID NO: 34051 - protein, 10 aa, Homo sapiens
  light chain complementarity determining region 3 for antibody 17026
QQYGSSPPVT

SEQ ID NO: 34052 - protein, 15 aa, Homo sapiens
  heavy chain complementarity determining region 3 for antibody 17026
AKGPMVRGVLGPFDY

SEQ ID NO: 34053 - protein, 8 aa, Homo sapiens
  light chain complementarity determining region 3 for antibody 17027
QQYENLVT

SEQ ID NO: 34054 - protein, 18 aa, Homo sapiens
  heavy chain complementarity determining region 3 for antibody 17027
AKGAEGSCSVRKCYPFDY

SEQ ID NO: 34055 - protein, 9 aa, Homo sapiens
  light chain complementarity determining region 3 for antibody 17028
QQRSNWPFT

SEQ ID NO: 34056 - protein, 14 aa, Homo sapiens
  heavy chain complementarity determining region 3 for antibody 17028
ARSLSSAWYDWSDP

SEQ ID NO: 34057 - protein, 9 aa, Homo sapiens
  light chain complementarity determining region 3 for antibody 17029
MGTLQTPPT

SEQ ID NO: 34058 - protein, 15 aa, Homo sapiens
  heavy chain complementarity determining region 3 for antibody 17029
TRDGKKDGHNDAFDI

SEQ ID NO: 34059 - protein, 9 aa, Homo sapiens
  light chain complementarity determining region 3 for antibody 17030
QQYGNLPRT

SEQ ID NO: 34060 - protein, 13 aa, Homo sapiens
  heavy chain complementarity determining region 3 for antibody 17030
AGGQFHSSGYSEF

SEQ ID NO: 34061 - protein, 9 aa, Homo sapiens
  light chain complementarity determining region 3 for antibody 17031
QQYGNLPRT

SEQ ID NO: 34062 - protein, 13 aa, Homo sapiens
  heavy chain complementarity determining region 3 for antibody 17031
AGGQFHTSGYSEF

SEQ ID NO: 34063 - protein, 9 aa, Homo sapiens
  light chain complementarity determining region 3 for antibody 17032
QQYNTWPRT

SEQ ID NO: 34064 - protein, 22 aa, Homo sapiens
  heavy chain complementarity determining region 3 for antibody 17032
AREVRASGYDDFYNYYYYGLDV

SEQ ID NO: 34065 - protein, 9 aa, Homo sapiens
  light chain complementarity determining region 3 for antibody 17033
QQYGSLPLT

SEQ ID NO: 34066 - protein, 15 aa, Homo sapiens
  heavy chain complementarity determining region 3 for antibody 17033
AHRPNYYDKAGAFDI

SEQ ID NO: 34067 - protein, 9 aa, Homo sapiens
  light chain complementarity determining region 3 for antibody 17034
QQYNRSPRT

SEQ ID NO: 34068 - protein, 16 aa, Homo sapiens
  heavy chain complementarity determining region 3 for antibody 17034
VKDFTGECHYGSWVDP

SEQ ID NO: 34069 - protein, 9 aa, Homo sapiens
  light chain complementarity determining region 3 for antibody 17035
HQSGALPWT

SEQ ID NO: 34070 - protein, 14 aa, Homo sapiens
  heavy chain complementarity determining region 3 for antibody 17035
VRDASGNSGWYADS

SEQ ID NO: 34071 - protein, 9 aa, Homo sapiens
  light chain complementarity determining region 3 for antibody 17036
QQYGNLPRT

SEQ ID NO: 34072 - protein, 13 aa, Homo sapiens
  heavy chain complementarity determining region 3 for antibody 17036
AGGNFHSGGYGEY

SEQ ID NO: 34073 - protein, 9 aa, Homo sapiens
  light chain complementarity determining region 3 for antibody 17037
QHYGSLPLT

SEQ ID NO: 34074 - protein, 16 aa, Homo sapiens
  heavy chain complementarity determining region 3 for antibody 17037
ATMLVRGLLYFHAVDV

SEQ ID NO: 34075 - protein, 9 aa, Homo sapiens
  light chain complementarity determining region 3 for antibody 17038
QQSYGLPQT

SEQ ID NO: 34076 - protein, 19 aa, Homo sapiens
  heavy chain complementarity determining region 3 for antibody 17038
ARVGLEIPPAIRRGEWFDP

SEQ ID NO: 34077 - protein, 10 aa, Homo sapiens
  light chain complementarity determining region 3 for antibody 17039
QQYNNWLGWT

SEQ ID NO: 34078 - protein, 13 aa, Homo sapiens
  heavy chain complementarity determining region 3 for antibody 17039
ARHGRRSGWYYTY

SEQ ID NO: 34079 - protein, 9 aa, Homo sapiens
  light chain complementarity determining region 3 for antibody 17040
QQYTNWPLT

SEQ ID NO: 34080 - protein, 16 aa, Homo sapiens
  heavy chain complementarity determining region 3 for antibody 17040
TRYCSSSNCALYGMDV

SEQ ID NO: 34081 - protein, 10 aa, Homo sapiens
  light chain complementarity determining region 3 for antibody 17041
QQRYNWPPYT

SEQ ID NO: 34082 - protein, 11 aa, Homo sapiens
  heavy chain complementarity determining region 3 for antibody 17041
ARGVGSYVFES

SEQ ID NO: 34083 - protein, 9 aa, Homo sapiens
  light chain complementarity determining region 3 for antibody 17042
QYYGRSPWT

SEQ ID NO: 34084 - protein, 17 aa, Homo sapiens
  heavy chain complementarity determining region 3 for antibody 17042
ARTVLYHFTSGRAAFDV

SEQ ID NO: 34085 - protein, 9 aa, Homo sapiens
  light chain complementarity determining region 3 for antibody 17043
MQALETPFT

SEQ ID NO: 34086 - protein, 15 aa, Homo sapiens
  heavy chain complementarity determining region 3 for antibody 17043
VRHYRELTTGIEGDS

SEQ ID NO: 34087 - protein, 9 aa, Homo sapiens
  light chain complementarity determining region 3 for antibody 17044
QQYGSIPRT

SEQ ID NO: 34088 - protein, 13 aa, Homo sapiens
  heavy chain complementarity determining region 3 for antibody 17044
AGGSFSGGNYKED

SEQ ID NO: 34089 - protein, 9 aa, Homo sapiens
  light chain complementarity determining region 3 for antibody 17045
QKYDTAPWT

SEQ ID NO: 34090 - protein, 15 aa, Homo sapiens
  heavy chain complementarity determining region 3 for antibody 17045
LRDIKGPSAGIPYDS

SEQ ID NO: 34091 - protein, 9 aa, Homo sapiens
  light chain complementarity determining region 3 for antibody 17046
QQHNSWPRT

SEQ ID NO: 34092 - protein, 14 aa, Homo sapiens
  heavy chain complementarity determining region 3 for antibody 17046
ARGGDYEYPDVFDI

SEQ ID NO: 34093 - protein, 10 aa, Homo sapiens
  light chain complementarity determining region 3 for antibody 17047
QQYDNWPPWT

SEQ ID NO: 34094 - protein, 12 aa, Homo sapiens
  heavy chain complementarity determining region 3 for antibody 17047
AKTLRERKELDY

SEQ ID NO: 34095 - protein, 9 aa, Homo sapiens
  light chain complementarity determining region 3 for antibody 17048
QQRNKWPRT

SEQ ID NO: 34096 - protein, 13 aa, Homo sapiens
  heavy chain complementarity determining region 3 for antibody 17048
AKDLGSLRYDFDY

SEQ ID NO: 34097 - protein, 9 aa, Homo sapiens
  light chain complementarity determining region 3 for antibody 17049
QQYYTTPRT

SEQ ID NO: 34098 - protein, 8 aa, Homo sapiens
  heavy chain complementarity determining region 3 for antibody 17049
ARDGAFDS

SEQ ID NO: 34099 - protein, 9 aa, Homo sapiens
  light chain complementarity determining region 3 for antibody 17050
QQRTDWPPT

SEQ ID NO: 34100 - protein, 17 aa, Homo sapiens
  heavy chain complementarity determining region 3 for antibody 17050
ARTALCESPAYYRFFDY

SEQ ID NO: 34101 - protein, 9 aa, Homo sapiens
  light chain complementarity determining region 3 for antibody 17051
QQYGGSPRT

SEQ ID NO: 34102 - protein, 13 aa, Homo sapiens
  heavy chain complementarity determining region 3 for antibody 17051
AAGYFSSGTYYEY

SEQ ID NO: 34103 - protein, 9 aa, Homo sapiens
  light chain complementarity determining region 3 for antibody 17052
QQTNSNPPT

SEQ ID NO: 34104 - protein, 14 aa, Homo sapiens
  heavy chain complementarity determining region 3 for antibody 17052
ARGGLGIWGNSSDI

SEQ ID NO: 34105 - protein, 9 aa, Homo sapiens
  light chain complementarity determining region 3 for antibody 17053
HQYYSSPRM

SEQ ID NO: 34106 - protein, 13 aa, Homo sapiens
  heavy chain complementarity determining region 3 for antibody 17053
ARGQSGDPRTYDY

SEQ ID NO: 34107 - protein, 8 aa, Homo sapiens
  light chain complementarity determining region 3 for antibody 17054
QQYGGSPS

SEQ ID NO: 34108 - protein, 16 aa, Homo sapiens
  heavy chain complementarity determining region 3 for antibody 17054
ATDWGSGTQWIRAFDV

SEQ ID NO: 34109 - protein, 9 aa, Homo sapiens
  light chain complementarity determining region 3 for antibody 17055
QQYGTLPQT

SEQ ID NO: 34110 - protein, 18 aa, Homo sapiens
  heavy chain complementarity determining region 3 for antibody 17055
ARDYYGSGREIWVGAFDI

SEQ ID NO: 34111 - protein, 10 aa, Homo sapiens
  light chain complementarity determining region 3 for antibody 17056
QHYHNWPPWT

SEQ ID NO: 34112 - protein, 13 aa, Homo sapiens
  heavy chain complementarity determining region 3 for antibody 17056
AKGRVRELYYFDT

SEQ ID NO: 34113 - protein, 9 aa, Homo sapiens
  light chain complementarity determining region 3 for antibody 17057
QQYRRSPST

SEQ ID NO: 34114 - protein, 17 aa, Homo sapiens
  heavy chain complementarity determining region 3 for antibody 17057
AGLSSRLGDGSPSLFDY

SEQ ID NO: 34115 - protein, 9 aa, Homo sapiens
  light chain complementarity determining region 3 for antibody 17058
QQYHSSPIT

SEQ ID NO: 34116 - protein, 14 aa, Homo sapiens
  heavy chain complementarity determining region 3 for antibody 17058
AKESSVYGVYPYDS

SEQ ID NO: 34117 - protein, 9 aa, Homo sapiens
  light chain complementarity determining region 3 for antibody 17059
HQYAESPRM

SEQ ID NO: 34118 - protein, 17 aa, Homo sapiens
  heavy chain complementarity determining region 3 for antibody 17059
AKSVGVDDAMTTRVYDS

SEQ ID NO: 34119 - protein, 9 aa, Homo sapiens
  light chain complementarity determining region 3 for antibody 17060
LQDYNYPWT

SEQ ID NO: 34120 - protein, 11 aa, Homo sapiens
  heavy chain complementarity determining region 3 for antibody 17060
ARDYAGAFFDY

SEQ ID NO: 34121 - protein, 9 aa, Homo sapiens
  light chain complementarity determining region 3 for antibody 17061
QQYGRIPRT

SEQ ID NO: 34122 - protein, 13 aa, Homo sapiens
  heavy chain complementarity determining region 3 for antibody 17061
AGGLFGSGTYSEF

SEQ ID NO: 34123 - protein, 8 aa, Homo sapiens
  light chain complementarity determining region 3 for antibody 17062
QHYSTALT

SEQ ID NO: 34124 - protein, 12 aa, Homo sapiens
  heavy chain complementarity determining region 3 for antibody 17062
ARGRVVFHTIDS

SEQ ID NO: 34125 - protein, 9 aa, Homo sapiens
  light chain complementarity determining region 3 for antibody 17063
QQSDRKPFT

SEQ ID NO: 34126 - protein, 14 aa, Homo sapiens
  heavy chain complementarity determining region 3 for antibody 17063
ARDNSNNWYEGMDV

SEQ ID NO: 34127 - protein, 11 aa, Homo sapiens
  light chain complementarity determining region 3 for antibody 17064
QHYVSSPPNFT

SEQ ID NO: 34128 - protein, 15 aa, Homo sapiens
  heavy chain complementarity determining region 3 for antibody 17064
ARDPSYIAAAGRGDY

SEQ ID NO: 34129 - protein, 9 aa, Homo sapiens
  light chain complementarity determining region 3 for antibody 17065
LQASYWPRT

SEQ ID NO: 34130 - protein, 9 aa, Homo sapiens
  heavy chain complementarity determining region 3 for antibody 17065
VAGHLTFDH

SEQ ID NO: 34131 - protein, 9 aa, Homo sapiens
  light chain complementarity determining region 3 for antibody 17066
QQYGTIPRT

SEQ ID NO: 34132 - protein, 13 aa, Homo sapiens
  heavy chain complementarity determining region 3 for antibody 17066
AGGNFHRSGYAEY

SEQ ID NO: 34133 - protein, 9 aa, Homo sapiens
  light chain complementarity determining region 3 for antibody 17067
QQYGSSPRT

SEQ ID NO: 34134 - protein, 14 aa, Homo sapiens
  heavy chain complementarity determining region 3 for antibody 17067
AGGRFSSGSSYSEN

SEQ ID NO: 34135 - protein, 9 aa, Homo sapiens
  light chain complementarity determining region 3 for antibody 17068
QQYGRIPRT

SEQ ID NO: 34136 - protein, 13 aa, Homo sapiens
  heavy chain complementarity determining region 3 for antibody 17068
AGGLYDSSGYSEF

SEQ ID NO: 34137 - protein, 9 aa, Homo sapiens
  light chain complementarity determining region 3 for antibody 17069
QQSTTSPRT

SEQ ID NO: 34138 - protein, 13 aa, Homo sapiens
  heavy chain complementarity determining region 3 for antibody 17069
GKGYEYAPRIYDY

SEQ ID NO: 34139 - protein, 9 aa, Homo sapiens
  light chain complementarity determining region 3 for antibody 17070
QQSYSSLLT

SEQ ID NO: 34140 - protein, 16 aa, Homo sapiens
  heavy chain complementarity determining region 3 for antibody 17070
AREGGSTYTTKRAFDS

SEQ ID NO: 34141 - protein, 9 aa, Homo sapiens
  light chain complementarity determining region 3 for antibody 17071
QQYGRSPYT

SEQ ID NO: 34142 - protein, 18 aa, Homo sapiens
  heavy chain complementarity determining region 3 for antibody 17071
ARPMVRALDEYNYYGLDV

SEQ ID NO: 34143 - protein, 8 aa, Homo sapiens
  light chain complementarity determining region 3 for antibody 17072
QQYGNSPF

SEQ ID NO: 34144 - protein, 20 aa, Homo sapiens
  heavy chain complementarity determining region 3 for antibody 17072
ARGPPGYDTSGYYRNWYFDL

SEQ ID NO: 34145 - protein, 8 aa, Homo sapiens
  light chain complementarity determining region 3 for antibody 17073
QHLNSYPR

SEQ ID NO: 34146 - protein, 18 aa, Homo sapiens
  heavy chain complementarity determining region 3 for antibody 17073
ARDRAMTGPRGPSYVFDS

SEQ ID NO: 34147 - protein, 9 aa, Homo sapiens
  light chain complementarity determining region 3 for antibody 17074
QQYNSYPWT

SEQ ID NO: 34148 - protein, 10 aa, Homo sapiens
  heavy chain complementarity determining region 3 for antibody 17074
ARSGGGQWDY

SEQ ID NO: 34149 - protein, 9 aa, Homo sapiens
  light chain complementarity determining region 3 for antibody 17075
MQALETPFT

SEQ ID NO: 34150 - protein, 15 aa, Homo sapiens
  heavy chain complementarity determining region 3 for antibody 17075
VRHYRITVAAVEGDS

SEQ ID NO: 34151 - protein, 9 aa, Homo sapiens
  light chain complementarity determining region 3 for antibody 17076
MQALETPFT

SEQ ID NO: 34152 - protein, 15 aa, Homo sapiens
  heavy chain complementarity determining region 3 for antibody 17076
VRHYRELATGFEGDS

SEQ ID NO: 34153 - protein, 9 aa, Homo sapiens
  light chain complementarity determining region 3 for antibody 17077
QQYGNSPRT

SEQ ID NO: 34154 - protein, 13 aa, Homo sapiens
  heavy chain complementarity determining region 3 for antibody 17077
AGGHYDSGDYREY

SEQ ID NO: 34155 - protein, 11 aa, Homo sapiens
  light chain complementarity determining region 3 for antibody 17078
QQYRASPPGFT

SEQ ID NO: 34156 - protein, 14 aa, Homo sapiens
  heavy chain complementarity determining region 3 for antibody 17078
ARSPSNSRNRSFDQ

SEQ ID NO: 34157 - protein, 9 aa, Homo sapiens
  light chain complementarity determining region 3 for antibody 17079
QQYNSYLYT

SEQ ID NO: 34158 - protein, 16 aa, Homo sapiens
  heavy chain complementarity determining region 3 for antibody 17079
AREGDSRGWYGGSMDV

SEQ ID NO: 34159 - protein, 6 aa, Homo sapiens
  light chain complementarity determining region 3 for antibody 17080
QQYGTT

SEQ ID NO: 34160 - protein, 12 aa, Homo sapiens
  heavy chain complementarity determining region 3 for antibody 17080
ARDADAGYAQDC

SEQ ID NO: 34161 - protein, 11 aa, Homo sapiens
  light chain complementarity determining region 3 for antibody 17081
QQRTNWPPIYT

SEQ ID NO: 34162 - protein, 14 aa, Homo sapiens
  heavy chain complementarity determining region 3 for antibody 17081
ARGGLGIWGNSSDI

SEQ ID NO: 34163 - protein, 9 aa, Homo sapiens
  light chain complementarity determining region 3 for antibody 17082
QQLNSYPHT

SEQ ID NO: 34164 - protein, 12 aa, Homo sapiens
  heavy chain complementarity determining region 3 for antibody 17082
ARTSLSHDYGYY

SEQ ID NO: 34165 - protein, 9 aa, Homo sapiens
  light chain complementarity determining region 3 for antibody 17083
QQSYTSPIT

SEQ ID NO: 34166 - protein, 16 aa, Homo sapiens
  heavy chain complementarity determining region 3 for antibody 17083
ARESGGGSPRHNYFDP

SEQ ID NO: 34167 - protein, 9 aa, Homo sapiens
  light chain complementarity determining region 3 for antibody 17084
QQYGTSPRT

SEQ ID NO: 34168 - protein, 14 aa, Homo sapiens
  heavy chain complementarity determining region 3 for antibody 17084
AGGDFCGRDCYSEY

SEQ ID NO: 34169 - protein, 9 aa, Homo sapiens
  light chain complementarity determining region 3 for antibody 17085
LQHNTYPWT

SEQ ID NO: 34170 - protein, 18 aa, Homo sapiens
  heavy chain complementarity determining region 3 for antibody 17085
ARDGVDYAPRDYYYGLDV

SEQ ID NO: 34171 - protein, 9 aa, Homo sapiens
  light chain complementarity determining region 3 for antibody 17086
QQYVTTPLT

SEQ ID NO: 34172 - protein, 8 aa, Homo sapiens
  heavy chain complementarity determining region 3 for antibody 17086
VRMSDYIL

SEQ ID NO: 34173 - protein, 10 aa, Homo sapiens
  light chain complementarity determining region 3 for antibody 17087
QHYSRSPPIT

SEQ ID NO: 34174 - protein, 20 aa, Homo sapiens
  heavy chain complementarity determining region 3 for antibody 17087
ARDAADVEIVPAARLFAMDV

SEQ ID NO: 34175 - protein, 9 aa, Homo sapiens
  light chain complementarity determining region 3 for antibody 17088
MQALETPFT

SEQ ID NO: 34176 - protein, 15 aa, Homo sapiens
  heavy chain complementarity determining region 3 for antibody 17088
VRHYRLTVAGIEGDS

SEQ ID NO: 34177 - protein, 9 aa, Homo sapiens
  light chain complementarity determining region 3 for antibody 17089
VQYNRYPRT

SEQ ID NO: 34178 - protein, 6 aa, Homo sapiens
  heavy chain complementarity determining region 3 for antibody 17089
TRALDY

SEQ ID NO: 34179 - protein, 11 aa, Homo sapiens
  light chain complementarity determining region 3 for antibody 17090
QQYDTSPPGYT

SEQ ID NO: 34180 - protein, 14 aa, Homo sapiens
  heavy chain complementarity determining region 3 for antibody 17090
ARETSNSRKRSFDQ

SEQ ID NO: 34181 - protein, 9 aa, Homo sapiens
  light chain complementarity determining region 3 for antibody 17091
QQHSNWPLT

SEQ ID NO: 34182 - protein, 14 aa, Homo sapiens
  heavy chain complementarity determining region 3 for antibody 17091
AKHRYDSSGYYFDY

SEQ ID NO: 34183 - protein, 9 aa, Homo sapiens
  light chain complementarity determining region 3 for antibody 17092
QQSHSVPLT

SEQ ID NO: 34184 - protein, 16 aa, Homo sapiens
  heavy chain complementarity determining region 3 for antibody 17092
ARVYATVTSQALGVDY

SEQ ID NO: 34185 - protein, 8 aa, Homo sapiens
  light chain complementarity determining region 3 for antibody 17093
QQRNFRLT

SEQ ID NO: 34186 - protein, 13 aa, Homo sapiens
  heavy chain complementarity determining region 3 for antibody 17093
TTDAAFVPYYFTY

SEQ ID NO: 34187 - protein, 9 aa, Homo sapiens
  light chain complementarity determining region 3 for antibody 17094
QQYGSSPRT

SEQ ID NO: 34188 - protein, 17 aa, Homo sapiens
  heavy chain complementarity determining region 3 for antibody 17094
TTDPQWLEPPPFLTNDY

SEQ ID NO: 34189 - protein, 9 aa, Homo sapiens
  light chain complementarity determining region 3 for antibody 17095
LQYKSYPRT

SEQ ID NO: 34190 - protein, 6 aa, Homo sapiens
  heavy chain complementarity determining region 3 for antibody 17095
SRALDY

SEQ ID NO: 34191 - protein, 9 aa, Homo sapiens
  light chain complementarity determining region 3 for antibody 17096
QQYGTIPRT

SEQ ID NO: 34192 - protein, 14 aa, Homo sapiens
  heavy chain complementarity determining region 3 for antibody 17096
AGGEFCGGDCYSEY

SEQ ID NO: 34193 - protein, 9 aa, Homo sapiens
  light chain complementarity determining region 3 for antibody 17097
QQYGTTPRT

SEQ ID NO: 34194 - protein, 13 aa, Homo sapiens
  heavy chain complementarity determining region 3 for antibody 17097
ACGYYEGGRYYEY

SEQ ID NO: 34195 - protein, 9 aa, Homo sapiens
  light chain complementarity determining region 3 for antibody 17098
QQYGSSPRT

SEQ ID NO: 34196 - protein, 15 aa, Homo sapiens
  heavy chain complementarity determining region 3 for antibody 17098
AKTYDFWSGDDAFEI

SEQ ID NO: 34197 - protein, 11 aa, Homo sapiens
  light chain complementarity determining region 3 for antibody 17099
QQYGDSPPMYT

SEQ ID NO: 34198 - protein, 12 aa, Homo sapiens
  heavy chain complementarity determining region 3 for antibody 17099
AGQGDRSYSYSY

SEQ ID NO: 34199 - protein, 9 aa, Homo sapiens
  light chain complementarity determining region 3 for antibody 17100
QQYYTSVRT

SEQ ID NO: 34200 - protein, 12 aa, Homo sapiens
  heavy chain complementarity determining region 3 for antibody 17100
VKDCGLGGSRDF

SEQ ID NO: 34201 - protein, 9 aa, Homo sapiens
  light chain complementarity determining region 3 for antibody 17101
QQYGNLPRT

SEQ ID NO: 34202 - protein, 13 aa, Homo sapiens
  heavy chain complementarity determining region 3 for antibody 17101
ARGQYERSGYKEN

SEQ ID NO: 34203 - protein, 8 aa, Homo sapiens
  light chain complementarity determining region 3 for antibody 17102
QQYNTWLS

SEQ ID NO: 34204 - protein, 12 aa, Homo sapiens
  heavy chain complementarity determining region 3 for antibody 17102
ARLLWDSYYFDS

SEQ ID NO: 34205 - protein, 11 aa, Homo sapiens
  light chain complementarity determining region 3 for antibody 17103
QLYETSPPGYT

SEQ ID NO: 34206 - protein, 14 aa, Homo sapiens
  heavy chain complementarity determining region 3 for antibody 17103
ARENSISRKRSFDQ

SEQ ID NO: 34207 - protein, 8 aa, Homo sapiens
  light chain complementarity determining region 3 for antibody 17104
MQGTHWPT

SEQ ID NO: 34208 - protein, 21 aa, Homo sapiens
  heavy chain complementarity determining region 3 for antibody 17104
AKDRPNYYESNGQYYTPKGDL

SEQ ID NO: 34209 - protein, 10 aa, Homo sapiens
  light chain complementarity determining region 3 for antibody 17105
QQYATSPPWT

SEQ ID NO: 34210 - protein, 16 aa, Homo sapiens
  heavy chain complementarity determining region 3 for antibody 17105
ARVQWVRGLTKEGLDF

SEQ ID NO: 34211 - protein, 10 aa, Homo sapiens
  light chain complementarity determining region 3 for antibody 17106
QQSNNWPPWT

SEQ ID NO: 34212 - protein, 11 aa, Homo sapiens
  heavy chain complementarity determining region 3 for antibody 17106
AASGSHYKFDY

SEQ ID NO: 34213 - protein, 9 aa, Homo sapiens
  light chain complementarity determining region 3 for antibody 17107
LQHNSYPLT

SEQ ID NO: 34214 - protein, 13 aa, Homo sapiens
  heavy chain complementarity determining region 3 for antibody 17107
VRHTVVRPIVVDD

SEQ ID NO: 34215 - protein, 9 aa, Homo sapiens
  light chain complementarity determining region 3 for antibody 17108
QQYGSSPVT

SEQ ID NO: 34216 - protein, 20 aa, Homo sapiens
  heavy chain complementarity determining region 3 for antibody 17108
ARRPVVSGWYRTGISSWFDP

SEQ ID NO: 34217 - protein, 9 aa, Homo sapiens
  light chain complementarity determining region 3 for antibody 17109
QQYGNLPRT

SEQ ID NO: 34218 - protein, 14 aa, Homo sapiens
  heavy chain complementarity determining region 3 for antibody 17109
AGGDFHRGGGYSEF

SEQ ID NO: 34219 - protein, 9 aa, Homo sapiens
  light chain complementarity determining region 3 for antibody 17110
QQSYSTPWT

SEQ ID NO: 34220 - protein, 13 aa, Homo sapiens
  heavy chain complementarity determining region 3 for antibody 17110
VNVSQWLDDAFDF

SEQ ID NO: 34221 - protein, 9 aa, Homo sapiens
  light chain complementarity determining region 3 for antibody 17111
LQGNRFPHT

SEQ ID NO: 34222 - protein, 14 aa, Homo sapiens
  heavy chain complementarity determining region 3 for antibody 17111
ARYCSGTSCYSMDY

SEQ ID NO: 34223 - protein, 9 aa, Homo sapiens
  light chain complementarity determining region 3 for antibody 17112
QQYGTIPRT

SEQ ID NO: 34224 - protein, 13 aa, Homo sapiens
  heavy chain complementarity determining region 3 for antibody 17112
AGGLFDSSGYSEF

SEQ ID NO: 34225 - protein, 9 aa, Homo sapiens
  light chain complementarity determining region 3 for antibody 17113
QQYGNIPRS

SEQ ID NO: 34226 - protein, 13 aa, Homo sapiens
  heavy chain complementarity determining region 3 for antibody 17113
AGGTWHSGTYYES

SEQ ID NO: 34227 - protein, 10 aa, Homo sapiens
  light chain complementarity determining region 3 for antibody 17114
QQRYNWPPWT

SEQ ID NO: 34228 - protein, 20 aa, Homo sapiens
  heavy chain complementarity determining region 3 for antibody 17114
ARHRQVTVADSFEVFWYFDL

SEQ ID NO: 34229 - protein, 10 aa, Homo sapiens
  light chain complementarity determining region 3 for antibody 17115
QQYVTSLKWT

SEQ ID NO: 34230 - protein, 15 aa, Homo sapiens
  heavy chain complementarity determining region 3 for antibody 17115
GRLLSPYSHRTPFDP

SEQ ID NO: 34231 - protein, 9 aa, Homo sapiens
  light chain complementarity determining region 3 for antibody 17116
QQYGTSPRT

SEQ ID NO: 34232 - protein, 13 aa, Homo sapiens
  heavy chain complementarity determining region 3 for antibody 17116
AGGSGSGTYYKEH

SEQ ID NO: 34233 - protein, 9 aa, Homo sapiens
  light chain complementarity determining region 3 for antibody 17117
QQTYTSPPT

SEQ ID NO: 34234 - protein, 13 aa, Homo sapiens
  heavy chain complementarity determining region 3 for antibody 17117
ARRYYDSSDYFDI

SEQ ID NO: 34235 - protein, 9 aa, Homo sapiens
  light chain complementarity determining region 3 for antibody 17118
QQYRSYPPT

SEQ ID NO: 34236 - protein, 17 aa, Homo sapiens
  heavy chain complementarity determining region 3 for antibody 17118
ARVPYCSTTTCYFPFDF

SEQ ID NO: 34237 - protein, 9 aa, Homo sapiens
  light chain complementarity determining region 3 for antibody 17119
QQYGSSPLT

SEQ ID NO: 34238 - protein, 13 aa, Homo sapiens
  heavy chain complementarity determining region 3 for antibody 17119
AHSQWLVLDVFDF

SEQ ID NO: 34239 - protein, 9 aa, Homo sapiens
  light chain complementarity determining region 3 for antibody 17120
QQYGNSPRT

SEQ ID NO: 34240 - protein, 14 aa, Homo sapiens
  heavy chain complementarity determining region 3 for antibody 17120
ASDPVVGAPGYFDY

SEQ ID NO: 34241 - protein, 9 aa, Homo sapiens
  light chain complementarity determining region 3 for antibody 17121
QQYGNSPLT

SEQ ID NO: 34242 - protein, 13 aa, Homo sapiens
  heavy chain complementarity determining region 3 for antibody 17121
ASKTSVRTYSSDL

SEQ ID NO: 34243 - protein, 9 aa, Homo sapiens
  light chain complementarity determining region 3 for antibody 17122
QQYERSPQT

SEQ ID NO: 34244 - protein, 15 aa, Homo sapiens
  heavy chain complementarity determining region 3 for antibody 17122
ARDPTVASHHYGVDV

SEQ ID NO: 34245 - protein, 9 aa, Homo sapiens
  light chain complementarity determining region 3 for antibody 17123
HQSSSLPLT

SEQ ID NO: 34246 - protein, 15 aa, Homo sapiens
  heavy chain complementarity determining region 3 for antibody 17123
AKSGGGGSYRLPVDY

SEQ ID NO: 34247 - protein, 9 aa, Homo sapiens
  light chain complementarity determining region 3 for antibody 17124
QYYGASPCT

SEQ ID NO: 34248 - protein, 11 aa, Homo sapiens
  heavy chain complementarity determining region 3 for antibody 17124
ARGEVGYAFDI

SEQ ID NO: 34249 - protein, 9 aa, Homo sapiens
  light chain complementarity determining region 3 for antibody 17125
QQYGSIPRT

SEQ ID NO: 34250 - protein, 13 aa, Homo sapiens
  heavy chain complementarity determining region 3 for antibody 17125
ALGHYHTTGYSEF

SEQ ID NO: 34251 - protein, 9 aa, Homo sapiens
  light chain complementarity determining region 3 for antibody 17126
QQYYSYPRT

SEQ ID NO: 34252 - protein, 11 aa, Homo sapiens
  heavy chain complementarity determining region 3 for antibody 17126
ARDFSNGPFTH

SEQ ID NO: 34253 - protein, 9 aa, Homo sapiens
  light chain complementarity determining region 3 for antibody 17127
QQYGNSPRT

SEQ ID NO: 34254 - protein, 13 aa, Homo sapiens
  heavy chain complementarity determining region 3 for antibody 17127
AIGYYDRGTYYEY

SEQ ID NO: 34255 - protein, 10 aa, Homo sapiens
  light chain complementarity determining region 3 for antibody 17128
QQSFSSSPIT

SEQ ID NO: 34256 - protein, 16 aa, Homo sapiens
  heavy chain complementarity determining region 3 for antibody 17128
ARQGPWTTVVTPHFDH

SEQ ID NO: 34257 - protein, 10 aa, Homo sapiens
  light chain complementarity determining region 3 for antibody 17129
QLYGSSPTWT

SEQ ID NO: 34258 - protein, 9 aa, Homo sapiens
  heavy chain complementarity determining region 3 for antibody 17129
ATGGELLGY

SEQ ID NO: 34259 - protein, 9 aa, Homo sapiens
  light chain complementarity determining region 3 for antibody 17130
MQVLQVPHT

SEQ ID NO: 34260 - protein, 14 aa, Homo sapiens
  heavy chain complementarity determining region 3 for antibody 17130
TSGLVRRGARVFDI

SEQ ID NO: 34261 - protein, 9 aa, Homo sapiens
  light chain complementarity determining region 3 for antibody 17131
MQGLRTPRT

SEQ ID NO: 34262 - protein, 23 aa, Homo sapiens
  heavy chain complementarity determining region 3 for antibody 17131
ARERAYASGPYYSPLYYYYGVDT

SEQ ID NO: 34263 - protein, 9 aa, Homo sapiens
  light chain complementarity determining region 3 for antibody 17132
LQDYNYPYT

SEQ ID NO: 34264 - protein, 15 aa, Homo sapiens
  heavy chain complementarity determining region 3 for antibody 17132
ARGHVYAIRYWFFDI

SEQ ID NO: 34265 - protein, 9 aa, Homo sapiens
  light chain complementarity determining region 3 for antibody 17133
QQYSSSLFA

SEQ ID NO: 34266 - protein, 15 aa, Homo sapiens
  heavy chain complementarity determining region 3 for antibody 17133
ARGGKSSSWLSYFDS

SEQ ID NO: 34267 - protein, 9 aa, Homo sapiens
  light chain complementarity determining region 3 for antibody 17134
QQYQNWPYT

SEQ ID NO: 34268 - protein, 11 aa, Homo sapiens
  heavy chain complementarity determining region 3 for antibody 17134
GGFYHGGPCGY

SEQ ID NO: 34269 - protein, 9 aa, Homo sapiens
  light chain complementarity determining region 3 for antibody 17135
QQYGSSLYT

SEQ ID NO: 34270 - protein, 16 aa, Homo sapiens
  heavy chain complementarity determining region 3 for antibody 17135
ARAKHYGDYYYYGMDA

SEQ ID NO: 34271 - protein, 9 aa, Homo sapiens
  light chain complementarity determining region 3 for antibody 17136
QQSGTSPRT

SEQ ID NO: 34272 - protein, 13 aa, Homo sapiens
  heavy chain complementarity determining region 3 for antibody 17136
GKGYEYAPRIYDY

SEQ ID NO: 34273 - protein, 9 aa, Homo sapiens
  light chain complementarity determining region 3 for antibody 17137
HQGYRTPFT

SEQ ID NO: 34274 - protein, 15 aa, Homo sapiens
  heavy chain complementarity determining region 3 for antibody 17137
AKAQVIWGQLYYFES

SEQ ID NO: 34275 - protein, 9 aa, Homo sapiens
  light chain complementarity determining region 3 for antibody 17138
QQYDSSPQT

SEQ ID NO: 34276 - protein, 14 aa, Homo sapiens
  heavy chain complementarity determining region 3 for antibody 17138
ARDNPHRLERYFDL

SEQ ID NO: 34277 - protein, 9 aa, Homo sapiens
  light chain complementarity determining region 3 for antibody 17139
QQGNRFPHT

SEQ ID NO: 34278 - protein, 14 aa, Homo sapiens
  heavy chain complementarity determining region 3 for antibody 17139
ARYCSGTRCYSMDY

SEQ ID NO: 34279 - protein, 9 aa, Homo sapiens
  light chain complementarity determining region 3 for antibody 17140
LQHNSFPWT

SEQ ID NO: 34280 - protein, 11 aa, Homo sapiens
  heavy chain complementarity determining region 3 for antibody 17140
VRDVPTAHFDY

SEQ ID NO: 34281 - protein, 9 aa, Homo sapiens
  light chain complementarity determining region 3 for antibody 17141
QQYGGSPRT

SEQ ID NO: 34282 - protein, 15 aa, Homo sapiens
  heavy chain complementarity determining region 3 for antibody 17141
AKDGPYCGSDCFFDS

SEQ ID NO: 34283 - protein, 8 aa, Homo sapiens
  light chain complementarity determining region 3 for antibody 17142
QDYGSSRT

SEQ ID NO: 34284 - protein, 15 aa, Homo sapiens
  heavy chain complementarity determining region 3 for antibody 17142
ASGSFDTLTGSYSEV

SEQ ID NO: 34285 - protein, 9 aa, Homo sapiens
  light chain complementarity determining region 3 for antibody 17143
LQHNTYPRT

SEQ ID NO: 34286 - protein, 7 aa, Homo sapiens
  heavy chain complementarity determining region 3 for antibody 17143
SNAHFDY

SEQ ID NO: 34287 - protein, 9 aa, Homo sapiens
  light chain complementarity determining region 3 for antibody 17144
HQSYTAPFT

SEQ ID NO: 34288 - protein, 12 aa, Homo sapiens
  heavy chain complementarity determining region 3 for antibody 17144
ARNYFDSSGPDY

SEQ ID NO: 34289 - protein, 9 aa, Homo sapiens
  light chain complementarity determining region 3 for antibody 17145
QQYGSSPPT

SEQ ID NO: 34290 - protein, 16 aa, Homo sapiens
  heavy chain complementarity determining region 3 for antibody 17145
ARGRTFRGNIYADLLY

SEQ ID NO: 34291 - protein, 9 aa, Homo sapiens
  light chain complementarity determining region 3 for antibody 17146
QQYGSSPDT

SEQ ID NO: 34292 - protein, 15 aa, Homo sapiens
  heavy chain complementarity determining region 3 for antibody 17146
AREGGYCGGDCSFDY

SEQ ID NO: 34293 - protein, 9 aa, Homo sapiens
  light chain complementarity determining region 3 for antibody 17147
QQYGNLPRT

SEQ ID NO: 34294 - protein, 13 aa, Homo sapiens
  heavy chain complementarity determining region 3 for antibody 17147
AGGNYDTGRYEEY

SEQ ID NO: 34295 - protein, 9 aa, Homo sapiens
  light chain complementarity determining region 3 for antibody 17148
QQYGFSPYI

SEQ ID NO: 34296 - protein, 11 aa, Homo sapiens
  heavy chain complementarity determining region 3 for antibody 17148
TRGYIEVIGDW

SEQ ID NO: 34297 - protein, 8 aa, Homo sapiens
  light chain complementarity determining region 3 for antibody 17149
QQRSNWLT

SEQ ID NO: 34298 - protein, 16 aa, Homo sapiens
  heavy chain complementarity determining region 3 for antibody 17149
AKDIVLMGSSGGSFDY

SEQ ID NO: 34299 - protein, 9 aa, Homo sapiens
  light chain complementarity determining region 3 for antibody 17150
QLYNTYPWT

SEQ ID NO: 34300 - protein, 10 aa, Homo sapiens
  heavy chain complementarity determining region 3 for antibody 17150
VKMNWELAGV

SEQ ID NO: 34301 - protein, 9 aa, Homo sapiens
  light chain complementarity determining region 3 for antibody 17151
QHRRTWLYS

SEQ ID NO: 34302 - protein, 20 aa, Homo sapiens
  heavy chain complementarity determining region 3 for antibody 17151
ARDGSAGMAARGTPYYGLDV

SEQ ID NO: 34303 - protein, 10 aa, Homo sapiens
  light chain complementarity determining region 3 for antibody 17152
HQSGILPPWT

SEQ ID NO: 34304 - protein, 13 aa, Homo sapiens
  heavy chain complementarity determining region 3 for antibody 17152
ARVSQAYYNGMDV

SEQ ID NO: 34305 - protein, 8 aa, Homo sapiens
  light chain complementarity determining region 3 for antibody 17153
QYYGYSPT

SEQ ID NO: 34306 - protein, 9 aa, Homo sapiens
  heavy chain complementarity determining region 3 for antibody 17153
ARGYDAFDI

SEQ ID NO: 34307 - protein, 8 aa, Homo sapiens
  light chain complementarity determining region 3 for antibody 17154
QQYGTSLT

SEQ ID NO: 34308 - protein, 14 aa, Homo sapiens
  heavy chain complementarity determining region 3 for antibody 17154
ARAGSYYADWYFDL

SEQ ID NO: 34309 - protein, 9 aa, Homo sapiens
  light chain complementarity determining region 3 for antibody 17155
QQYGSTVGT

SEQ ID NO: 34310 - protein, 9 aa, Homo sapiens
  heavy chain complementarity determining region 3 for antibody 17155
ARMYSGLDY

SEQ ID NO: 34311 - protein, 9 aa, Homo sapiens
  light chain complementarity determining region 3 for antibody 17156
QQSYSIPIT

SEQ ID NO: 34312 - protein, 14 aa, Homo sapiens
  heavy chain complementarity determining region 3 for antibody 17156
ARDRRNYYYYGMDV

SEQ ID NO: 34313 - protein, 9 aa, Homo sapiens
  light chain complementarity determining region 3 for antibody 17157
QQYGYSARP

SEQ ID NO: 34314 - protein, 13 aa, Homo sapiens
  heavy chain complementarity determining region 3 for antibody 17157
ARGYFYSDGYIED

SEQ ID NO: 34315 - protein, 8 aa, Homo sapiens
  light chain complementarity determining region 3 for antibody 17158
LQRSDGYT

SEQ ID NO: 34316 - protein, 13 aa, Homo sapiens
  heavy chain complementarity determining region 3 for antibody 17158
ATNSGSYPNYLDP

SEQ ID NO: 34317 - protein, 9 aa, Homo sapiens
  light chain complementarity determining region 3 for antibody 17159
HQYGSSPQT

SEQ ID NO: 34318 - protein, 9 aa, Homo sapiens
  heavy chain complementarity determining region 3 for antibody 17159
SRGYDISGC

SEQ ID NO: 34319 - protein, 10 aa, Homo sapiens
  light chain complementarity determining region 3 for antibody 17160
QQYNNWPPLT

SEQ ID NO: 34320 - protein, 17 aa, Homo sapiens
  heavy chain complementarity determining region 3 for antibody 17160
AKDLRPFYDIFAGYLDM

SEQ ID NO: 34321 - protein, 10 aa, Homo sapiens
  light chain complementarity determining region 3 for antibody 17161
QQYDSLRLYT

SEQ ID NO: 34322 - protein, 28 aa, Homo sapiens
  heavy chain complementarity determining region 3 for antibody 17161
ARRSLTTKYYDYVWGNYRSLDPTDAFDV

SEQ ID NO: 34323 - protein, 9 aa, Homo sapiens
  light chain complementarity determining region 3 for antibody 17162
MQALQTPPT

SEQ ID NO: 34324 - protein, 15 aa, Homo sapiens
  heavy chain complementarity determining region 3 for antibody 17162
ARDGLRDGFSDAFDI

SEQ ID NO: 34325 - protein, 8 aa, Homo sapiens
  light chain complementarity determining region 3 for antibody 17163
QQYGRSLT

SEQ ID NO: 34326 - protein, 17 aa, Homo sapiens
  heavy chain complementarity determining region 3 for antibody 17163
ASIYDSTGYYYGGYFQH

SEQ ID NO: 34327 - protein, 10 aa, Homo sapiens
  light chain complementarity determining region 3 for antibody 17164
QQRSNWPPIT

SEQ ID NO: 34328 - protein, 11 aa, Homo sapiens
  heavy chain complementarity determining region 3 for antibody 17164
ASQKSYDYFDF

SEQ ID NO: 34329 - protein, 9 aa, Homo sapiens
  light chain complementarity determining region 3 for antibody 17165
QQRSNWPLT

SEQ ID NO: 34330 - protein, 9 aa, Homo sapiens
  heavy chain complementarity determining region 3 for antibody 17165
ANYGDWVDY

SEQ ID NO: 34331 - protein, 9 aa, Homo sapiens
  light chain complementarity determining region 3 for antibody 17166
QQFNDWPRT

SEQ ID NO: 34332 - protein, 15 aa, Homo sapiens
  heavy chain complementarity determining region 3 for antibody 17166
TTDTVSGYYTYYFDS

SEQ ID NO: 34333 - protein, 9 aa, Homo sapiens
  light chain complementarity determining region 3 for antibody 17167
QAYNNFFRT

SEQ ID NO: 34334 - protein, 11 aa, Homo sapiens
  heavy chain complementarity determining region 3 for antibody 17167
ARDRRAYGMDV

SEQ ID NO: 34335 - protein, 9 aa, Homo sapiens
  light chain complementarity determining region 3 for antibody 17168
LQYGGTPLT

SEQ ID NO: 34336 - protein, 8 aa, Homo sapiens
  heavy chain complementarity determining region 3 for antibody 17168
VRIMDPGY

SEQ ID NO: 34337 - protein, 8 aa, Homo sapiens
  light chain complementarity determining region 3 for antibody 17169
QRYGSSPL

SEQ ID NO: 34338 - protein, 15 aa, Homo sapiens
  heavy chain complementarity determining region 3 for antibody 17169
ARDRASIGYYYLFDY

SEQ ID NO: 34339 - protein, 8 aa, Homo sapiens
  light chain complementarity determining region 3 for antibody 17170
QQRHTRLS

SEQ ID NO: 34340 - protein, 11 aa, Homo sapiens
  heavy chain complementarity determining region 3 for antibody 17170
ASGSMGWVFDH

SEQ ID NO: 34341 - protein, 9 aa, Homo sapiens
  light chain complementarity determining region 3 for antibody 17171
QQGNSLPIT

SEQ ID NO: 34342 - protein, 12 aa, Homo sapiens
  heavy chain complementarity determining region 3 for antibody 17171
ARVVLGGRGFDY

SEQ ID NO: 34343 - protein, 9 aa, Homo sapiens
  light chain complementarity determining region 3 for antibody 17172
QHYGSSLWT

SEQ ID NO: 34344 - protein, 13 aa, Homo sapiens
  heavy chain complementarity determining region 3 for antibody 17172
ARKFLGYDHVLDV

SEQ ID NO: 34345 - protein, 9 aa, Homo sapiens
  light chain complementarity determining region 3 for antibody 17173
HQSGVLPWT

SEQ ID NO: 34346 - protein, 14 aa, Homo sapiens
  heavy chain complementarity determining region 3 for antibody 17173
VRDASGNSGWYAAS

SEQ ID NO: 34347 - protein, 10 aa, Homo sapiens
  light chain complementarity determining region 3 for antibody 17174
QQYNNWPPLT

SEQ ID NO: 34348 - protein, 12 aa, Homo sapiens
  heavy chain complementarity determining region 3 for antibody 17174
ARYGDYFLGWVY

SEQ ID NO: 34349 - protein, 9 aa, Homo sapiens
  light chain complementarity determining region 3 for antibody 17175
QQYGSPPRT

SEQ ID NO: 34350 - protein, 14 aa, Homo sapiens
  heavy chain complementarity determining region 3 for antibody 17175
AGGNFCGYDCYSEY

SEQ ID NO: 34351 - protein, 9 aa, Homo sapiens
  light chain complementarity determining region 3 for antibody 17176
QQTYVSSYT

SEQ ID NO: 34352 - protein, 19 aa, Homo sapiens
  heavy chain complementarity determining region 3 for antibody 17176
ARDGPGGYGSASYGDDFDY

SEQ ID NO: 34353 - protein, 10 aa, Homo sapiens
  light chain complementarity determining region 3 for antibody 17177
QQFNNWPPWT

SEQ ID NO: 34354 - protein, 12 aa, Homo sapiens
  heavy chain complementarity determining region 3 for antibody 17177
AKTVRERKELDH

SEQ ID NO: 34355 - protein, 9 aa, Homo sapiens
  light chain complementarity determining region 3 for antibody 17178
MQGLQTPYT

SEQ ID NO: 34356 - protein, 18 aa, Homo sapiens
  heavy chain complementarity determining region 3 for antibody 17178
ARQRRGGYSYGYHYGMDV

SEQ ID NO: 34357 - protein, 9 aa, Homo sapiens
  light chain complementarity determining region 3 for antibody 17179
QQYATSPLT

SEQ ID NO: 34358 - protein, 10 aa, Homo sapiens
  heavy chain complementarity determining region 3 for antibody 17179
VAGAGWLPDY

SEQ ID NO: 34359 - protein, 9 aa, Homo sapiens
  light chain complementarity determining region 3 for antibody 17180
QQGYSTPLI

SEQ ID NO: 34360 - protein, 10 aa, Homo sapiens
  heavy chain complementarity determining region 3 for antibody 17180
VREMVGARDY

SEQ ID NO: 34361 - protein, 9 aa, Homo sapiens
  light chain complementarity determining region 3 for antibody 17181
QQYGSSPRT

SEQ ID NO: 34362 - protein, 13 aa, Homo sapiens
  heavy chain complementarity determining region 3 for antibody 17181
ATGYYASGTYLEY

SEQ ID NO: 34363 - protein, 9 aa, Homo sapiens
  light chain complementarity determining region 3 for antibody 17182
QQYGSSHYT

SEQ ID NO: 34364 - protein, 11 aa, Homo sapiens
  heavy chain complementarity determining region 3 for antibody 17182
AKGGLRWPLDY

SEQ ID NO: 34365 - protein, 9 aa, Homo sapiens
  light chain complementarity determining region 3 for antibody 17183
QQYGSIPRT

SEQ ID NO: 34366 - protein, 13 aa, Homo sapiens
  heavy chain complementarity determining region 3 for antibody 17183
AGGIFDSSGYGEY

SEQ ID NO: 34367 - protein, 8 aa, Homo sapiens
  light chain complementarity determining region 3 for antibody 17184
QQSFRPAT

SEQ ID NO: 34368 - protein, 18 aa, Homo sapiens
  heavy chain complementarity determining region 3 for antibody 17184
ARGSGITIFGGVIRYFDY

SEQ ID NO: 34369 - protein, 9 aa, Homo sapiens
  light chain complementarity determining region 3 for antibody 17185
QQYDTLPLT

SEQ ID NO: 34370 - protein, 10 aa, Homo sapiens
  heavy chain complementarity determining region 3 for antibody 17185
VHGQSMLVAY

SEQ ID NO: 34371 - protein, 9 aa, Homo sapiens
  light chain complementarity determining region 3 for antibody 17186
LQGNRFPHT

SEQ ID NO: 34372 - protein, 14 aa, Homo sapiens
  heavy chain complementarity determining region 3 for antibody 17186
ARYCSGSSCYSMDY

SEQ ID NO: 34373 - protein, 10 aa, Homo sapiens
  light chain complementarity determining region 3 for antibody 17187
QQYNTWPPDT

SEQ ID NO: 34374 - protein, 13 aa, Homo sapiens
  heavy chain complementarity determining region 3 for antibody 17187
ARGIIPVAGLLDY

SEQ ID NO: 34375 - protein, 9 aa, Homo sapiens
  light chain complementarity determining region 3 for antibody 17188
QQYGSSSIT

SEQ ID NO: 34376 - protein, 13 aa, Homo sapiens
  heavy chain complementarity determining region 3 for antibody 17188
VKNFFMAFDAFHM

SEQ ID NO: 34377 - protein, 8 aa, Homo sapiens
  light chain complementarity determining region 3 for antibody 17189
QQSYSTAT

SEQ ID NO: 34378 - protein, 14 aa, Homo sapiens
  heavy chain complementarity determining region 3 for antibody 17189
ASHGTSDRRGAFDI

SEQ ID NO: 34379 - protein, 9 aa, Homo sapiens
  light chain complementarity determining region 3 for antibody 17190
QKYGTPPRP

SEQ ID NO: 34380 - protein, 13 aa, Homo sapiens
  heavy chain complementarity determining region 3 for antibody 17190
AGGLYDNTGYSEF

SEQ ID NO: 34381 - protein, 9 aa, Homo sapiens
  light chain complementarity determining region 3 for antibody 17191
LQYNSYPFT

SEQ ID NO: 34382 - protein, 7 aa, Homo sapiens
  heavy chain complementarity determining region 3 for antibody 17191
ALYRLDY

SEQ ID NO: 34383 - protein, 9 aa, Homo sapiens
  light chain complementarity determining region 3 for antibody 17192
QQYGSSPRT

SEQ ID NO: 34384 - protein, 14 aa, Homo sapiens
  heavy chain complementarity determining region 3 for antibody 17192
AKGLMYHYDSALDL

SEQ ID NO: 34385 - protein, 9 aa, Homo sapiens
  light chain complementarity determining region 3 for antibody 17193
QQYGDSPVT

SEQ ID NO: 34386 - protein, 18 aa, Homo sapiens
  heavy chain complementarity determining region 3 for antibody 17193
AKIADAAFSASHRGYFDD

SEQ ID NO: 34387 - protein, 9 aa, Homo sapiens
  light chain complementarity determining region 3 for antibody 17194
QQSYSTRRT

SEQ ID NO: 34388 - protein, 12 aa, Homo sapiens
  heavy chain complementarity determining region 3 for antibody 17194
ARPREDGDAFDI

SEQ ID NO: 34389 - protein, 9 aa, Homo sapiens
  light chain complementarity determining region 3 for antibody 17195
QQYGRIPRS

SEQ ID NO: 34390 - protein, 13 aa, Homo sapiens
  heavy chain complementarity determining region 3 for antibody 17195
AGGTWHSSAYYES

SEQ ID NO: 34391 - protein, 10 aa, Homo sapiens
  light chain complementarity determining region 3 for antibody 17196
QHNDDLRQLS

SEQ ID NO: 34392 - protein, 13 aa, Homo sapiens
  heavy chain complementarity determining region 3 for antibody 17196
ARDQDGDYGYFHN

SEQ ID NO: 34393 - protein, 9 aa, Homo sapiens
  light chain complementarity determining region 3 for antibody 17197
QQYNTYSRT

SEQ ID NO: 34394 - protein, 15 aa, Homo sapiens
  heavy chain complementarity determining region 3 for antibody 17197
ARERNRGSFGSAFDV

SEQ ID NO: 34395 - protein, 9 aa, Homo sapiens
  light chain complementarity determining region 3 for antibody 17198
QQYGNSPRT

SEQ ID NO: 34396 - protein, 15 aa, Homo sapiens
  heavy chain complementarity determining region 3 for antibody 17198
AGGWFNYYSSGYYET

SEQ ID NO: 34397 - protein, 9 aa, Homo sapiens
  light chain complementarity determining region 3 for antibody 17199
QQYDAQSWT

SEQ ID NO: 34398 - protein, 11 aa, Homo sapiens
  heavy chain complementarity determining region 3 for antibody 17199
ARGWRDNSFDY

SEQ ID NO: 34399 - protein, 10 aa, Homo sapiens
  light chain complementarity determining region 3 for antibody 17200
QQRGIWPPIT

SEQ ID NO: 34400 - protein, 13 aa, Homo sapiens
  heavy chain complementarity determining region 3 for antibody 17200
VRELHAGAYYYDY

SEQ ID NO: 34401 - protein, 9 aa, Homo sapiens
  light chain complementarity determining region 3 for antibody 17201
QQYSTFPLT

SEQ ID NO: 34402 - protein, 13 aa, Homo sapiens
  heavy chain complementarity determining region 3 for antibody 17201
ARDMVAAPGTFDY

SEQ ID NO: 34403 - protein, 9 aa, Homo sapiens
  light chain complementarity determining region 3 for antibody 17202
QQYGSIPRT

SEQ ID NO: 34404 - protein, 13 aa, Homo sapiens
  heavy chain complementarity determining region 3 for antibody 17202
AGGLFHSSGYSEF

SEQ ID NO: 34405 - protein, 10 aa, Homo sapiens
  light chain complementarity determining region 3 for antibody 17203
QQYDDWPPWT

SEQ ID NO: 34406 - protein, 16 aa, Homo sapiens
  heavy chain complementarity determining region 3 for antibody 17203
GGSRTSSQQLVAPIHY

SEQ ID NO: 34407 - protein, 9 aa, Homo sapiens
  light chain complementarity determining region 3 for antibody 17204
QQSHTTPYT

SEQ ID NO: 34408 - protein, 14 aa, Homo sapiens
  heavy chain complementarity determining region 3 for antibody 17204
ARLVKIVINGEDDY

SEQ ID NO: 34409 - protein, 10 aa, Homo sapiens
  light chain complementarity determining region 3 for antibody 17205
QQRSDWPPLT

SEQ ID NO: 34410 - protein, 10 aa, Homo sapiens
  heavy chain complementarity determining region 3 for antibody 17205
ARDYTMTFDY

SEQ ID NO: 34411 - protein, 9 aa, Homo sapiens
  light chain complementarity determining region 3 for antibody 17206
QQLNTYPIT

SEQ ID NO: 34412 - protein, 13 aa, Homo sapiens
  heavy chain complementarity determining region 3 for antibody 17206
AKTLTMVTTYGDY

SEQ ID NO: 34413 - protein, 9 aa, Homo sapiens
  light chain complementarity determining region 3 for antibody 17207
MQGSHWPPT

SEQ ID NO: 34414 - protein, 13 aa, Homo sapiens
  heavy chain complementarity determining region 3 for antibody 17207
VRDLGDGYNSIDY

SEQ ID NO: 34415 - protein, 9 aa, Homo sapiens
  light chain complementarity determining region 3 for antibody 17208
QQYNLNSET

SEQ ID NO: 34416 - protein, 8 aa, Homo sapiens
  heavy chain complementarity determining region 3 for antibody 17208
VTSPSRNY

SEQ ID NO: 34417 - protein, 9 aa, Homo sapiens
  light chain complementarity determining region 3 for antibody 17209
QQTYFLPRT

SEQ ID NO: 34418 - protein, 12 aa, Homo sapiens
  heavy chain complementarity determining region 3 for antibody 17209
ARQGPYQQPFDL

SEQ ID NO: 34419 - protein, 10 aa, Homo sapiens
  light chain complementarity determining region 3 for antibody 17210
QQLNSYPLLT

SEQ ID NO: 34420 - protein, 19 aa, Homo sapiens
  heavy chain complementarity determining region 3 for antibody 17210
AHRRDSSGWYFPPQSAFDI

SEQ ID NO: 34421 - protein, 9 aa, Homo sapiens
  light chain complementarity determining region 3 for antibody 17211
MQATYWPWT

SEQ ID NO: 34422 - protein, 11 aa, Homo sapiens
  heavy chain complementarity determining region 3 for antibody 17211
LSAVRGSSFDI

SEQ ID NO: 34423 - protein, 9 aa, Homo sapiens
  light chain complementarity determining region 3 for antibody 17212
HHYGSSPWP

SEQ ID NO: 34424 - protein, 13 aa, Homo sapiens
  heavy chain complementarity determining region 3 for antibody 17212
ARAQTWSGRLFDY

SEQ ID NO: 34425 - protein, 8 aa, Homo sapiens
  light chain complementarity determining region 3 for antibody 17213
QQYSFFST

SEQ ID NO: 34426 - protein, 12 aa, Homo sapiens
  heavy chain complementarity determining region 3 for antibody 17213
ARDRGHGGDFDY

SEQ ID NO: 34427 - protein, 9 aa, Homo sapiens
  light chain complementarity determining region 3 for antibody 17214
QQYAGSPWT

SEQ ID NO: 34428 - protein, 12 aa, Homo sapiens
  heavy chain complementarity determining region 3 for antibody 17214
VRSHYNTGRVDY

SEQ ID NO: 34429 - protein, 9 aa, Homo sapiens
  light chain complementarity determining region 3 for antibody 17215
QQSYSTPHT

SEQ ID NO: 34430 - protein, 17 aa, Homo sapiens
  heavy chain complementarity determining region 3 for antibody 17215
ASLSYTWNYTPGAYFDY

SEQ ID NO: 34431 - protein, 9 aa, Homo sapiens
  light chain complementarity determining region 3 for antibody 17216
QHRNNWPLT

SEQ ID NO: 34432 - protein, 13 aa, Homo sapiens
  heavy chain complementarity determining region 3 for antibody 17216
ARGNIAAPGRLEC

SEQ ID NO: 34433 - protein, 10 aa, Homo sapiens
  light chain complementarity determining region 3 for antibody 17217
QQYSSSPPWT

SEQ ID NO: 34434 - protein, 16 aa, Homo sapiens
  heavy chain complementarity determining region 3 for antibody 17217
ARRQWVRGLFRGGLDS

SEQ ID NO: 34435 - protein, 10 aa, Homo sapiens
  light chain complementarity determining region 3 for antibody 17218
QQYGTSPTWT

SEQ ID NO: 34436 - protein, 18 aa, Homo sapiens
  heavy chain complementarity determining region 3 for antibody 17218
ARAPRDTMIVVRYYGMDV

SEQ ID NO: 34437 - protein, 9 aa, Homo sapiens
  light chain complementarity determining region 3 for antibody 17219
MQTLQIPYT

SEQ ID NO: 34438 - protein, 14 aa, Homo sapiens
  heavy chain complementarity determining region 3 for antibody 17219
ARDHYHDRSVILDY

SEQ ID NO: 34439 - protein, 8 aa, Homo sapiens
  light chain complementarity determining region 3 for antibody 17220
MQGTDWPT

SEQ ID NO: 34440 - protein, 21 aa, Homo sapiens
  heavy chain complementarity determining region 3 for antibody 17220
AKDRPNYYGSDGQYYTPKGDL

SEQ ID NO: 34441 - protein, 9 aa, Homo sapiens
  light chain complementarity determining region 3 for antibody 17221
QQYNSYPLT

SEQ ID NO: 34442 - protein, 13 aa, Homo sapiens
  heavy chain complementarity determining region 3 for antibody 17221
AHVSNGYYYYYDF

SEQ ID NO: 34443 - protein, 9 aa, Homo sapiens
  light chain complementarity determining region 3 for antibody 17222
QQYGNLPRT

SEQ ID NO: 34444 - protein, 13 aa, Homo sapiens
  heavy chain complementarity determining region 3 for antibody 17222
AGGDFHRGGYSEY

SEQ ID NO: 34445 - protein, 10 aa, Homo sapiens
  light chain complementarity determining region 3 for antibody 17223
QQYGDSPAYS

SEQ ID NO: 34446 - protein, 10 aa, Homo sapiens
  heavy chain complementarity determining region 3 for antibody 17223
VNSAGSYFEY

SEQ ID NO: 34447 - protein, 9 aa, Homo sapiens
  light chain complementarity determining region 3 for antibody 17224
QQYFTSPPT

SEQ ID NO: 34448 - protein, 15 aa, Homo sapiens
  heavy chain complementarity determining region 3 for antibody 17224
VKVLMSGTQIALFDQ

SEQ ID NO: 34449 - protein, 9 aa, Homo sapiens
  light chain complementarity determining region 3 for antibody 17225
QHYNIYSET

SEQ ID NO: 34450 - protein, 8 aa, Homo sapiens
  heavy chain complementarity determining region 3 for antibody 17225
ATSPQRGS

SEQ ID NO: 34451 - protein, 8 aa, Homo sapiens
  light chain complementarity determining region 3 for antibody 17226
QQYGSSWT

SEQ ID NO: 34452 - protein, 12 aa, Homo sapiens
  heavy chain complementarity determining region 3 for antibody 17226
ARLAVAVGAFDI

SEQ ID NO: 34453 - protein, 9 aa, Homo sapiens
  light chain complementarity determining region 3 for antibody 17227
QHRSGWPLT

SEQ ID NO: 34454 - protein, 18 aa, Homo sapiens
  heavy chain complementarity determining region 3 for antibody 17227
ARDLPPGATGNCYYGLED

SEQ ID NO: 34455 - protein, 9 aa, Homo sapiens
  light chain complementarity determining region 3 for antibody 17228
QQYVTPPLT

SEQ ID NO: 34456 - protein, 18 aa, Homo sapiens
  heavy chain complementarity determining region 3 for antibody 17228
ARCVAAAAKWGVYWYFDL

SEQ ID NO: 34457 - protein, 9 aa, Homo sapiens
  light chain complementarity determining region 3 for antibody 17229
QQSYSTQWT

SEQ ID NO: 34458 - protein, 23 aa, Homo sapiens
  heavy chain complementarity determining region 3 for antibody 17229
ARLSRDPVAIRAAPLDYYFAMDV

SEQ ID NO: 34459 - protein, 10 aa, Homo sapiens
  light chain complementarity determining region 3 for antibody 17230
QQRYKWPPYT

SEQ ID NO: 34460 - protein, 11 aa, Homo sapiens
  heavy chain complementarity determining region 3 for antibody 17230
ARGVGSYVFES

SEQ ID NO: 34461 - protein, 9 aa, Homo sapiens
  light chain complementarity determining region 3 for antibody 17231
QQLNTYPIT

SEQ ID NO: 34462 - protein, 19 aa, Homo sapiens
  heavy chain complementarity determining region 3 for antibody 17231
ARDVIRNCGSDCYFWYFDL

SEQ ID NO: 34463 - protein, 10 aa, Homo sapiens
  light chain complementarity determining region 3 for antibody 17232
QHYGRSPPYS

SEQ ID NO: 34464 - protein, 23 aa, Homo sapiens
  heavy chain complementarity determining region 3 for antibody 17232
ARGLRSSDWSKIMEMDSYYGLDV

SEQ ID NO: 34465 - protein, 9 aa, Homo sapiens
  light chain complementarity determining region 3 for antibody 17233
MQGLQTPYT

SEQ ID NO: 34466 - protein, 10 aa, Homo sapiens
  heavy chain complementarity determining region 3 for antibody 17233
GSDLTGARDH

SEQ ID NO: 34467 - protein, 9 aa, Homo sapiens
  light chain complementarity determining region 3 for antibody 17234
QQYGSFPYT

SEQ ID NO: 34468 - protein, 14 aa, Homo sapiens
  heavy chain complementarity determining region 3 for antibody 17234
ARGGFIVAWGLFDY

SEQ ID NO: 34469 - protein, 9 aa, Homo sapiens
  light chain complementarity determining region 3 for antibody 17235
QQRSNWPPT

SEQ ID NO: 34470 - protein, 13 aa, Homo sapiens
  heavy chain complementarity determining region 3 for antibody 17235
ARGLIFKQWVVDY

SEQ ID NO: 34471 - protein, 9 aa, Homo sapiens
  light chain complementarity determining region 3 for antibody 17236
QQRRDWPIT

SEQ ID NO: 34472 - protein, 17 aa, Homo sapiens
  heavy chain complementarity determining region 3 for antibody 17236
AKGTADTHSGWPYYIDS

SEQ ID NO: 34473 - protein, 6 aa, Homo sapiens
  light chain complementarity determining region 3 for antibody 17237
QKYGSF

SEQ ID NO: 34474 - protein, 11 aa, Homo sapiens
  heavy chain complementarity determining region 3 for antibody 17237
ARAGISYALDV

SEQ ID NO: 34475 - protein, 10 aa, Homo sapiens
  light chain complementarity determining region 3 for antibody 17238
QQRGNSPPWT

SEQ ID NO: 34476 - protein, 12 aa, Homo sapiens
  heavy chain complementarity determining region 3 for antibody 17238
ARDHYARVAFDI

SEQ ID NO: 34477 - protein, 9 aa, Homo sapiens
  light chain complementarity determining region 3 for antibody 17239
QQGYSTPLT

SEQ ID NO: 34478 - protein, 14 aa, Homo sapiens
  heavy chain complementarity determining region 3 for antibody 17239
ARDRFGDSRISFDY

SEQ ID NO: 34479 - protein, 9 aa, Homo sapiens
  light chain complementarity determining region 3 for antibody 17240
MQALETPFT

SEQ ID NO: 34480 - protein, 15 aa, Homo sapiens
  heavy chain complementarity determining region 3 for antibody 17240
VRHYRETVAGIEGDC

SEQ ID NO: 34481 - protein, 9 aa, Homo sapiens
  light chain complementarity determining region 3 for antibody 17241
QQYGTSPRT

SEQ ID NO: 34482 - protein, 13 aa, Homo sapiens
  heavy chain complementarity determining region 3 for antibody 17241
AGGYFDRSGYYEY

SEQ ID NO: 34483 - protein, 9 aa, Homo sapiens
  light chain complementarity determining region 3 for antibody 17242
QQYGSFPYT

SEQ ID NO: 34484 - protein, 14 aa, Homo sapiens
  heavy chain complementarity determining region 3 for antibody 17242
TRGGFIVAWGLFDY

SEQ ID NO: 34485 - protein, 9 aa, Homo sapiens
  light chain complementarity determining region 3 for antibody 17243
QQSYTTPPT

SEQ ID NO: 34486 - protein, 11 aa, Homo sapiens
  heavy chain complementarity determining region 3 for antibody 17243
ARGGNWQYFDY

SEQ ID NO: 34487 - protein, 9 aa, Homo sapiens
  light chain complementarity determining region 3 for antibody 17244
LQSHSSPFT

SEQ ID NO: 34488 - protein, 17 aa, Homo sapiens
  heavy chain complementarity determining region 3 for antibody 17244
AKDHFPFAAGRRGGVDY

SEQ ID NO: 34489 - protein, 10 aa, Homo sapiens
  light chain complementarity determining region 3 for antibody 17245
QQYVSSPPWT

SEQ ID NO: 34490 - protein, 11 aa, Homo sapiens
  heavy chain complementarity determining region 3 for antibody 17245
AREGSYHYFDF

SEQ ID NO: 34491 - protein, 9 aa, Homo sapiens
  light chain complementarity determining region 3 for antibody 17246
QQYGSIPRT

SEQ ID NO: 34492 - protein, 14 aa, Homo sapiens
  heavy chain complementarity determining region 3 for antibody 17246
AGGDFCGSDCYSEY

SEQ ID NO: 34493 - protein, 10 aa, Homo sapiens
  light chain complementarity determining region 3 for antibody 17247
QQFDNSPKWT

SEQ ID NO: 34494 - protein, 13 aa, Homo sapiens
  heavy chain complementarity determining region 3 for antibody 17247
ARAPKFGAVYFDY

SEQ ID NO: 34495 - protein, 9 aa, Homo sapiens
  light chain complementarity determining region 3 for antibody 17248
MQTLQTPTT

SEQ ID NO: 34496 - protein, 16 aa, Homo sapiens
  heavy chain complementarity determining region 3 for antibody 17248
TMDLFALGLSSGCHDY

SEQ ID NO: 34497 - protein, 9 aa, Homo sapiens
  light chain complementarity determining region 3 for antibody 17249
LQYKIYPRT

SEQ ID NO: 34498 - protein, 6 aa, Homo sapiens
  heavy chain complementarity determining region 3 for antibody 17249
SRALDY

SEQ ID NO: 34499 - protein, 9 aa, Homo sapiens
  light chain complementarity determining region 3 for antibody 17250
LQHNSFPWT

SEQ ID NO: 34500 - protein, 11 aa, Homo sapiens
  heavy chain complementarity determining region 3 for antibody 17250
VRDVLTAHFDY

SEQ ID NO: 34501 - protein, 8 aa, Homo sapiens
  light chain complementarity determining region 3 for antibody 17251
HQRGHGYT

SEQ ID NO: 34502 - protein, 21 aa, Homo sapiens
  heavy chain complementarity determining region 3 for antibody 17251
AHRGGCSRGSCYGATYNWFDP

SEQ ID NO: 34503 - protein, 10 aa, Homo sapiens
  light chain complementarity determining region 3 for antibody 17252
QQSNNWPPWT

SEQ ID NO: 34504 - protein, 18 aa, Homo sapiens
  heavy chain complementarity determining region 3 for antibody 17252
ARGVPRFWAPGGTGPFDY

SEQ ID NO: 34505 - protein, 9 aa, Homo sapiens
  light chain complementarity determining region 3 for antibody 17253
QQYGTSPYT

SEQ ID NO: 34506 - protein, 14 aa, Homo sapiens
  heavy chain complementarity determining region 3 for antibody 17253
AKEPPRWLQPFSGY

SEQ ID NO: 34507 - protein, 9 aa, Homo sapiens
  light chain complementarity determining region 3 for antibody 17254
QQYDNLQST

SEQ ID NO: 34508 - protein, 17 aa, Homo sapiens
  heavy chain complementarity determining region 3 for antibody 17254
AKERFIRWLRLGGVFDS

SEQ ID NO: 34509 - protein, 9 aa, Homo sapiens
  light chain complementarity determining region 3 for antibody 17255
QQLNSYPPT

SEQ ID NO: 34510 - protein, 14 aa, Homo sapiens
  heavy chain complementarity determining region 3 for antibody 17255
ATVGYTIGSGVFDI

SEQ ID NO: 34511 - protein, 9 aa, Homo sapiens
  light chain complementarity determining region 3 for antibody 17256
HQYATLPET

SEQ ID NO: 34512 - protein, 13 aa, Homo sapiens
  heavy chain complementarity determining region 3 for antibody 17256
VRRGYGDFVREDF

SEQ ID NO: 34513 - protein, 8 aa, Homo sapiens
  light chain complementarity determining region 3 for antibody 17257
QQHGYSWT

SEQ ID NO: 34514 - protein, 9 aa, Homo sapiens
  heavy chain complementarity determining region 3 for antibody 17257
ARWVEGLDV

SEQ ID NO: 34515 - protein, 10 aa, Homo sapiens
  light chain complementarity determining region 3 for antibody 17258
HQYGGSPVWT

SEQ ID NO: 34516 - protein, 10 aa, Homo sapiens
  heavy chain complementarity determining region 3 for antibody 17258
AGDNRLDQAT

SEQ ID NO: 34517 - protein, 8 aa, Homo sapiens
  light chain complementarity determining region 3 for antibody 17259
QQYYSYWT

SEQ ID NO: 34518 - protein, 18 aa, Homo sapiens
  heavy chain complementarity determining region 3 for antibody 17259
TREGFGANKNVINWYFDL

SEQ ID NO: 34519 - protein, 9 aa, Homo sapiens
  light chain complementarity determining region 3 for antibody 17260
QQSVGPPIT

SEQ ID NO: 34520 - protein, 11 aa, Homo sapiens
  heavy chain complementarity determining region 3 for antibody 17260
ARFFVVGANAA

SEQ ID NO: 34521 - protein, 11 aa, Homo sapiens
  light chain complementarity determining region 3 for antibody 17261
QQRINWPPSFS

SEQ ID NO: 34522 - protein, 15 aa, Homo sapiens
  heavy chain complementarity determining region 3 for antibody 17261
ARDRSGSYSVHAFDI

SEQ ID NO: 34523 - protein, 9 aa, Homo sapiens
  light chain complementarity determining region 3 for antibody 17262
QQYYTSVRT

SEQ ID NO: 34524 - protein, 12 aa, Homo sapiens
  heavy chain complementarity determining region 3 for antibody 17262
VKDCGLGGSRDS

SEQ ID NO: 34525 - protein, 10 aa, Homo sapiens
  light chain complementarity determining region 3 for antibody 17263
QQYNNWPPYT

SEQ ID NO: 34526 - protein, 17 aa, Homo sapiens
  heavy chain complementarity determining region 3 for antibody 17263
AGGGDTAQQFMYPPNNY

SEQ ID NO: 34527 - protein, 9 aa, Homo sapiens
  light chain complementarity determining region 3 for antibody 17264
QQYGSSPRT

SEQ ID NO: 34528 - protein, 13 aa, Homo sapiens
  heavy chain complementarity determining region 3 for antibody 17264
ASGYFDRSGYYEY

SEQ ID NO: 34529 - protein, 9 aa, Homo sapiens
  light chain complementarity determining region 3 for antibody 17265
QQSYITLLT

SEQ ID NO: 34530 - protein, 16 aa, Homo sapiens
  heavy chain complementarity determining region 3 for antibody 17265
ARDVSFGELLSGTPDY

SEQ ID NO: 34531 - protein, 9 aa, Homo sapiens
  light chain complementarity determining region 3 for antibody 17266
QQSDSIPYT

SEQ ID NO: 34532 - protein, 12 aa, Homo sapiens
  heavy chain complementarity determining region 3 for antibody 17266
ARGNPIVTGFDY

SEQ ID NO: 34533 - protein, 10 aa, Homo sapiens
  light chain complementarity determining region 3 for antibody 17267
QQSYHVPALT

SEQ ID NO: 34534 - protein, 17 aa, Homo sapiens
  heavy chain complementarity determining region 3 for antibody 17267
AKDQIAVAGKAPCGMDV

SEQ ID NO: 34535 - protein, 9 aa, Homo sapiens
  light chain complementarity determining region 3 for antibody 17268
MQALQAPWT

SEQ ID NO: 34536 - protein, 11 aa, Homo sapiens
  heavy chain complementarity determining region 3 for antibody 17268
ARQPDPTTPTP

SEQ ID NO: 34537 - protein, 9 aa, Homo sapiens
  light chain complementarity determining region 3 for antibody 17269
LQDYSYPRT

SEQ ID NO: 34538 - protein, 18 aa, Homo sapiens
  heavy chain complementarity determining region 3 for antibody 17269
ARDANPSSGDLYFDAFDI

SEQ ID NO: 34539 - protein, 9 aa, Homo sapiens
  light chain complementarity determining region 3 for antibody 17270
QQYGTIPRT

SEQ ID NO: 34540 - protein, 13 aa, Homo sapiens
  heavy chain complementarity determining region 3 for antibody 17270
AGGIFHSRGYGEY

SEQ ID NO: 34541 - protein, 9 aa, Homo sapiens
  light chain complementarity determining region 3 for antibody 17271
QQYGSLPRT

SEQ ID NO: 34542 - protein, 14 aa, Homo sapiens
  heavy chain complementarity determining region 3 for antibody 17271
AGGDFCGGDCYSEY

SEQ ID NO: 34543 - protein, 9 aa, Homo sapiens
  light chain complementarity determining region 3 for antibody 17272
QQYGATPRT

SEQ ID NO: 34544 - protein, 13 aa, Homo sapiens
  heavy chain complementarity determining region 3 for antibody 17272
ASGYGSGASYREN

SEQ ID NO: 34545 - protein, 9 aa, Homo sapiens
  light chain complementarity determining region 3 for antibody 17273
QQYATSPRT

SEQ ID NO: 34546 - protein, 15 aa, Homo sapiens
  heavy chain complementarity determining region 3 for antibody 17273
ARDGNVLATGYPLDY

SEQ ID NO: 34547 - protein, 11 aa, Homo sapiens
  light chain complementarity determining region 3 for antibody 17274
QYRHNWPAEYT

SEQ ID NO: 34548 - protein, 15 aa, Homo sapiens
  heavy chain complementarity determining region 3 for antibody 17274
AREGVDRLTISAFDI

SEQ ID NO: 34549 - protein, 10 aa, Homo sapiens
  light chain complementarity determining region 3 for antibody 17275
QQYNNWPPVT

SEQ ID NO: 34550 - protein, 16 aa, Homo sapiens
  heavy chain complementarity determining region 3 for antibody 17275
TSERSTTWYVVEPFDI

SEQ ID NO: 34551 - protein, 9 aa, Homo sapiens
  light chain complementarity determining region 3 for antibody 17276
QQYDDLPPA

SEQ ID NO: 34552 - protein, 16 aa, Homo sapiens
  heavy chain complementarity determining region 3 for antibody 17276
ARGSWPGSSGWGPLGS

SEQ ID NO: 34553 - protein, 8 aa, Homo sapiens
  light chain complementarity determining region 3 for antibody 17277
QQRSNSIT

SEQ ID NO: 34554 - protein, 15 aa, Homo sapiens
  heavy chain complementarity determining region 3 for antibody 17277
ASRGEIAVAGPYFDY

SEQ ID NO: 34555 - protein, 8 aa, Homo sapiens
  light chain complementarity determining region 3 for antibody 17278
MQALQTPT

SEQ ID NO: 34556 - protein, 15 aa, Homo sapiens
  heavy chain complementarity determining region 3 for antibody 17278
ARRDYYDSSGYRLDY

SEQ ID NO: 34557 - protein, 7 aa, Homo sapiens
  light chain complementarity determining region 3 for antibody 17279
HQYGGGT

SEQ ID NO: 34558 - protein, 15 aa, Homo sapiens
  heavy chain complementarity determining region 3 for antibody 17279
TAIVFFAGSVHIEQY

SEQ ID NO: 34559 - protein, 9 aa, Homo sapiens
  light chain complementarity determining region 3 for antibody 17280
HQGYRTPFT

SEQ ID NO: 34560 - protein, 12 aa, Homo sapiens
  heavy chain complementarity determining region 3 for antibody 17280
ARPLDGDHGFDV

SEQ ID NO: 34561 - protein, 8 aa, Homo sapiens
  light chain complementarity determining region 3 for antibody 17281
QQYNSYWT

SEQ ID NO: 34562 - protein, 17 aa, Homo sapiens
  heavy chain complementarity determining region 3 for antibody 17281
AGDPTYYDSSGADAFAI

SEQ ID NO: 34563 - protein, 9 aa, Homo sapiens
  light chain complementarity determining region 3 for antibody 17282
QQYGRSPQT

SEQ ID NO: 34564 - protein, 11 aa, Homo sapiens
  heavy chain complementarity determining region 3 for antibody 17282
ARGWIELWGDF

SEQ ID NO: 34565 - protein, 9 aa, Homo sapiens
  light chain complementarity determining region 3 for antibody 17283
QQGYSSPFT

SEQ ID NO: 34566 - protein, 15 aa, Homo sapiens
  heavy chain complementarity determining region 3 for antibody 17283
AKAQVIWGQLYYFES

SEQ ID NO: 34567 - protein, 9 aa, Homo sapiens
  light chain complementarity determining region 3 for antibody 17284
QQDNSFPFT

SEQ ID NO: 34568 - protein, 13 aa, Homo sapiens
  heavy chain complementarity determining region 3 for antibody 17284
AKDISQMVTILDY

SEQ ID NO: 34569 - protein, 9 aa, Homo sapiens
  light chain complementarity determining region 3 for antibody 17285
MQGTHWPRT

SEQ ID NO: 34570 - protein, 12 aa, Homo sapiens
  heavy chain complementarity determining region 3 for antibody 17285
ATLSMANAKFDH

SEQ ID NO: 34571 - protein, 9 aa, Homo sapiens
  light chain complementarity determining region 3 for antibody 17286
QQSYSSLLT

SEQ ID NO: 34572 - protein, 16 aa, Homo sapiens
  heavy chain complementarity determining region 3 for antibody 17286
AREGGSTYTSKRAFDS

SEQ ID NO: 34573 - protein, 9 aa, Homo sapiens
  light chain complementarity determining region 3 for antibody 17287
QQRRNWPLT

SEQ ID NO: 34574 - protein, 15 aa, Homo sapiens
  heavy chain complementarity determining region 3 for antibody 17287
AKGTSIAARPDCFDL

SEQ ID NO: 34575 - protein, 9 aa, Homo sapiens
  light chain complementarity determining region 3 for antibody 17288
QQFKSFPIT

SEQ ID NO: 34576 - protein, 11 aa, Homo sapiens
  heavy chain complementarity determining region 3 for antibody 17288
VNDGGHWDFDF

SEQ ID NO: 34577 - protein, 9 aa, Homo sapiens
  light chain complementarity determining region 3 for antibody 17289
QQFDNLPLT

SEQ ID NO: 34578 - protein, 17 aa, Homo sapiens
  heavy chain complementarity determining region 3 for antibody 17289
TTQGITIFGVVIDAFDI

SEQ ID NO: 34579 - protein, 9 aa, Homo sapiens
  light chain complementarity determining region 3 for antibody 17290
LQFQNVPLT

SEQ ID NO: 34580 - protein, 18 aa, Homo sapiens
  heavy chain complementarity determining region 3 for antibody 17290
VRGGRDSQGPLGYYGLGV

SEQ ID NO: 34581 - protein, 9 aa, Homo sapiens
  light chain complementarity determining region 3 for antibody 17291
QQYGNIPRT

SEQ ID NO: 34582 - protein, 14 aa, Homo sapiens
  heavy chain complementarity determining region 3 for antibody 17291
AGGTFDSSGYYYEY

SEQ ID NO: 34583 - protein, 9 aa, Homo sapiens
  light chain complementarity determining region 3 for antibody 17292
QQSYSTPRT

SEQ ID NO: 34584 - protein, 11 aa, Homo sapiens
  heavy chain complementarity determining region 3 for antibody 17292
ARDNTFGWFDP

SEQ ID NO: 34585 - protein, 9 aa, Homo sapiens
  light chain complementarity determining region 3 for antibody 17293
QQYGTSPRT

SEQ ID NO: 34586 - protein, 13 aa, Homo sapiens
  heavy chain complementarity determining region 3 for antibody 17293
ACGYYQSGRYYEY

SEQ ID NO: 34587 - protein, 10 aa, Homo sapiens
  light chain complementarity determining region 3 for antibody 17294
QQYGSSPGYT

SEQ ID NO: 34588 - protein, 14 aa, Homo sapiens
  heavy chain complementarity determining region 3 for antibody 17294
ARGPAAAGPWYFDF

SEQ ID NO: 34589 - protein, 9 aa, Homo sapiens
  light chain complementarity determining region 3 for antibody 17295
QQSNLWPLT

SEQ ID NO: 34590 - protein, 13 aa, Homo sapiens
  heavy chain complementarity determining region 3 for antibody 17295
ARHGGTCYRYFDY

SEQ ID NO: 34591 - protein, 9 aa, Homo sapiens
  light chain complementarity determining region 3 for antibody 17296
QQRNSWPTT

SEQ ID NO: 34592 - protein, 14 aa, Homo sapiens
  heavy chain complementarity determining region 3 for antibody 17296
ARDPFSGSGVGFDF

SEQ ID NO: 34593 - protein, 9 aa, Homo sapiens
  light chain complementarity determining region 3 for antibody 17297
QQYGSIPRT

SEQ ID NO: 34594 - protein, 14 aa, Homo sapiens
  heavy chain complementarity determining region 3 for antibody 17297
AGGEYCGGNCYSEY

SEQ ID NO: 34595 - protein, 9 aa, Homo sapiens
  light chain complementarity determining region 3 for antibody 17298
QQGYSIPFT

SEQ ID NO: 34596 - protein, 13 aa, Homo sapiens
  heavy chain complementarity determining region 3 for antibody 17298
AKEGDSSGDYFDY

SEQ ID NO: 34597 - protein, 9 aa, Homo sapiens
  light chain complementarity determining region 3 for antibody 17299
QQFNIYPPT

SEQ ID NO: 34598 - protein, 15 aa, Homo sapiens
  heavy chain complementarity determining region 3 for antibody 17299
VRDSGIRVRQDYFDY

SEQ ID NO: 34599 - protein, 9 aa, Homo sapiens
  light chain complementarity determining region 3 for antibody 17300
QKYGTSPRP

SEQ ID NO: 34600 - protein, 13 aa, Homo sapiens
  heavy chain complementarity determining region 3 for antibody 17300
AGGHYHSSGYSEF

SEQ ID NO: 34601 - protein, 8 aa, Homo sapiens
  light chain complementarity determining region 3 for antibody 17301
QQYYSYRT

SEQ ID NO: 34602 - protein, 14 aa, Homo sapiens
  heavy chain complementarity determining region 3 for antibody 17301
VTDQDVYWSGYFRT

SEQ ID NO: 34603 - protein, 9 aa, Homo sapiens
  light chain complementarity determining region 3 for antibody 17302
QQSYITPWT

SEQ ID NO: 34604 - protein, 10 aa, Homo sapiens
  heavy chain complementarity determining region 3 for antibody 17302
ARAPTHAFDI

SEQ ID NO: 34605 - protein, 10 aa, Homo sapiens
  light chain complementarity determining region 3 for antibody 17303
QQRYSWPPLT

SEQ ID NO: 34606 - protein, 14 aa, Homo sapiens
  heavy chain complementarity determining region 3 for antibody 17303
AKGANLHHPYYFDY

SEQ ID NO: 34607 - protein, 9 aa, Homo sapiens
  light chain complementarity determining region 3 for antibody 17304
QQGYSLPWT

SEQ ID NO: 34608 - protein, 13 aa, Homo sapiens
  heavy chain complementarity determining region 3 for antibody 17304
ASNRMSYPHYFDY

SEQ ID NO: 34609 - protein, 9 aa, Homo sapiens
  light chain complementarity determining region 3 for antibody 17305
HQIHTFPLT

SEQ ID NO: 34610 - protein, 11 aa, Homo sapiens
  heavy chain complementarity determining region 3 for antibody 17305
TSDNGKWAFDA

SEQ ID NO: 34611 - protein, 9 aa, Homo sapiens
  light chain complementarity determining region 3 for antibody 17306
EQRLDWPLT

SEQ ID NO: 34612 - protein, 11 aa, Homo sapiens
  heavy chain complementarity determining region 3 for antibody 17306
ARNILGGHTDF

SEQ ID NO: 34613 - protein, 9 aa, Homo sapiens
  light chain complementarity determining region 3 for antibody 17307
QQYNVWPYT

SEQ ID NO: 34614 - protein, 13 aa, Homo sapiens
  heavy chain complementarity determining region 3 for antibody 17307
ARVMAAAGYGMDV

SEQ ID NO: 34615 - protein, 9 aa, Homo sapiens
  light chain complementarity determining region 3 for antibody 17308
QQYGSWPWT

SEQ ID NO: 34616 - protein, 11 aa, Homo sapiens
  heavy chain complementarity determining region 3 for antibody 17308
ARDRYLGRVGY

SEQ ID NO: 34617 - protein, 10 aa, Homo sapiens
  light chain complementarity determining region 3 for antibody 17309
QQLNSYPRVT

SEQ ID NO: 34618 - protein, 19 aa, Homo sapiens
  heavy chain complementarity determining region 3 for antibody 17309
ARDRVEVPGTQVPYWYFDL

SEQ ID NO: 34619 - protein, 9 aa, Homo sapiens
  light chain complementarity determining region 3 for antibody 17310
QQLGTLPYT

SEQ ID NO: 34620 - protein, 16 aa, Homo sapiens
  heavy chain complementarity determining region 3 for antibody 17310
TTERHIAEFEEASFDI

SEQ ID NO: 34621 - protein, 9 aa, Homo sapiens
  light chain complementarity determining region 3 for antibody 17311
MQGTHWPLT

SEQ ID NO: 34622 - protein, 11 aa, Homo sapiens
  heavy chain complementarity determining region 3 for antibody 17311
ARGVLDPAFAV

SEQ ID NO: 34623 - protein, 9 aa, Homo sapiens
  light chain complementarity determining region 3 for antibody 17312
MGTLQTPPP

SEQ ID NO: 34624 - protein, 15 aa, Homo sapiens
  heavy chain complementarity determining region 3 for antibody 17312
TRDGKKDGHNDAFDI

SEQ ID NO: 34625 - protein, 9 aa, Homo sapiens
  light chain complementarity determining region 3 for antibody 17313
QQYKSYLYT

SEQ ID NO: 34626 - protein, 12 aa, Homo sapiens
  heavy chain complementarity determining region 3 for antibody 17313
ARALGWRAWFDP

SEQ ID NO: 34627 - protein, 9 aa, Homo sapiens
  light chain complementarity determining region 3 for antibody 17314
QQYGTIPRT

SEQ ID NO: 34628 - protein, 13 aa, Homo sapiens
  heavy chain complementarity determining region 3 for antibody 17314
AGGSFSGRNYKED

SEQ ID NO: 34629 - protein, 9 aa, Homo sapiens
  light chain complementarity determining region 3 for antibody 17315
QQYGGLEKT

SEQ ID NO: 34630 - protein, 12 aa, Homo sapiens
  heavy chain complementarity determining region 3 for antibody 17315
ARGGIWTGGFDY

SEQ ID NO: 34631 - protein, 9 aa, Homo sapiens
  light chain complementarity determining region 3 for antibody 17316
QQTHTAPYT

SEQ ID NO: 34632 - protein, 13 aa, Homo sapiens
  heavy chain complementarity determining region 3 for antibody 17316
ARARNYDRISLDF

SEQ ID NO: 34633 - protein, 9 aa, Homo sapiens
  light chain complementarity determining region 3 for antibody 17317
MQALETPLT

SEQ ID NO: 34634 - protein, 15 aa, Homo sapiens
  heavy chain complementarity determining region 3 for antibody 17317
VRHYRIITAPLEGDS

SEQ ID NO: 34635 - protein, 9 aa, Homo sapiens
  light chain complementarity determining region 3 for antibody 17318
MQALETPFT

SEQ ID NO: 34636 - protein, 15 aa, Homo sapiens
  heavy chain complementarity determining region 3 for antibody 17318
VRHYRVLATGIEGDS

SEQ ID NO: 34637 - protein, 11 aa, Homo sapiens
  light chain complementarity determining region 3 for antibody 17319
QQYVTSPPSYT

SEQ ID NO: 34638 - protein, 11 aa, Homo sapiens
  heavy chain complementarity determining region 3 for antibody 17319
AYSPGWWRIDC

SEQ ID NO: 34639 - protein, 9 aa, Homo sapiens
  light chain complementarity determining region 3 for antibody 17320
QQYHGLPLT

SEQ ID NO: 34640 - protein, 13 aa, Homo sapiens
  heavy chain complementarity determining region 3 for antibody 17320
ARDGVPGKFNRAL

SEQ ID NO: 34641 - protein, 8 aa, Homo sapiens
  light chain complementarity determining region 3 for antibody 17321
QQRAKSVT

SEQ ID NO: 34642 - protein, 11 aa, Homo sapiens
  heavy chain complementarity determining region 3 for antibody 17321
GRGTSTWTDDF

SEQ ID NO: 34643 - protein, 9 aa, Homo sapiens
  light chain complementarity determining region 3 for antibody 17322
QQANSYPWT

SEQ ID NO: 34644 - protein, 13 aa, Homo sapiens
  heavy chain complementarity determining region 3 for antibody 17322
ARESDSGQGQFDY

SEQ ID NO: 34645 - protein, 11 aa, Homo sapiens
  light chain complementarity determining region 3 for antibody 17323
QHYGSSPPRWT

SEQ ID NO: 34646 - protein, 14 aa, Homo sapiens
  heavy chain complementarity determining region 3 for antibody 17323
ASFLLSRRGSYVDY

SEQ ID NO: 34647 - protein, 9 aa, Homo sapiens
  light chain complementarity determining region 3 for antibody 17324
QHYDSHSRT

SEQ ID NO: 34648 - protein, 22 aa, Homo sapiens
  heavy chain complementarity determining region 3 for antibody 17324
AREGYYHGSGTYQPPSYYGMAV

SEQ ID NO: 34649 - protein, 9 aa, Homo sapiens
  light chain complementarity determining region 3 for antibody 17325
QHPKSYPFT

SEQ ID NO: 34650 - protein, 15 aa, Homo sapiens
  heavy chain complementarity determining region 3 for antibody 17325
ARLGIVVAERGYFDH

SEQ ID NO: 34651 - protein, 9 aa, Homo sapiens
  light chain complementarity determining region 3 for antibody 17326
MQALETPFT

SEQ ID NO: 34652 - protein, 15 aa, Homo sapiens
  heavy chain complementarity determining region 3 for antibody 17326
VRHYRITVAAIEEDS

SEQ ID NO: 34653 - protein, 9 aa, Homo sapiens
  light chain complementarity determining region 3 for antibody 17327
QQYNNWPRT

SEQ ID NO: 34654 - protein, 14 aa, Homo sapiens
  heavy chain complementarity determining region 3 for antibody 17327
ATAPGYYSSSPFDY

SEQ ID NO: 34655 - protein, 9 aa, Homo sapiens
  light chain complementarity determining region 3 for antibody 17328
QQYGGSPHT

SEQ ID NO: 34656 - protein, 15 aa, Homo sapiens
  heavy chain complementarity determining region 3 for antibody 17328
ARESPIRGPWGYFDF

SEQ ID NO: 34657 - protein, 9 aa, Homo sapiens
  light chain complementarity determining region 3 for antibody 17329
QQGNRFPHT

SEQ ID NO: 34658 - protein, 14 aa, Homo sapiens
  heavy chain complementarity determining region 3 for antibody 17329
ARYCSGTKCYSMDY

SEQ ID NO: 34659 - protein, 9 aa, Homo sapiens
  light chain complementarity determining region 3 for antibody 17330
QKYNSGPLT

SEQ ID NO: 34660 - protein, 17 aa, Homo sapiens
  heavy chain complementarity determining region 3 for antibody 17330
ARERFYYGSGNYHPSDS

SEQ ID NO: 34661 - protein, 9 aa, Homo sapiens
  light chain complementarity determining region 3 for antibody 17331
MQSRRWPHT

SEQ ID NO: 34662 - protein, 8 aa, Homo sapiens
  heavy chain complementarity determining region 3 for antibody 17331
TAWGSSQH

SEQ ID NO: 34663 - protein, 9 aa, Homo sapiens
  light chain complementarity determining region 3 for antibody 17332
MQGTHWPWT

SEQ ID NO: 34664 - protein, 10 aa, Homo sapiens
  heavy chain complementarity determining region 3 for antibody 17332
ARETHWGPDY

SEQ ID NO: 34665 - protein, 9 aa, Homo sapiens
  light chain complementarity determining region 3 for antibody 17333
MQALQPPWT

SEQ ID NO: 34666 - protein, 13 aa, Homo sapiens
  heavy chain complementarity determining region 3 for antibody 17333
ARHSGSYYYPGDY

SEQ ID NO: 34667 - protein, 9 aa, Homo sapiens
  light chain complementarity determining region 3 for antibody 17334
LQYNNWPRT

SEQ ID NO: 34668 - protein, 12 aa, Homo sapiens
  heavy chain complementarity determining region 3 for antibody 17334
ARDHWLGYYFDF

SEQ ID NO: 34669 - protein, 9 aa, Homo sapiens
  light chain complementarity determining region 3 for antibody 17335
HQSSSFPWT

SEQ ID NO: 34670 - protein, 19 aa, Homo sapiens
  heavy chain complementarity determining region 3 for antibody 17335
ARTGYDILSDSPFVDAFDI

SEQ ID NO: 34671 - protein, 9 aa, Homo sapiens
  light chain complementarity determining region 3 for antibody 17336
LHNKNFPYA

SEQ ID NO: 34672 - protein, 14 aa, Homo sapiens
  heavy chain complementarity determining region 3 for antibody 17336
TRTEWSSGWRLFDY

SEQ ID NO: 34673 - protein, 9 aa, Homo sapiens
  light chain complementarity determining region 3 for antibody 17337
QQYSSHVYT

SEQ ID NO: 34674 - protein, 18 aa, Homo sapiens
  heavy chain complementarity determining region 3 for antibody 17337
AQERDGYCDSHACYGLDV

SEQ ID NO: 34675 - protein, 9 aa, Homo sapiens
  light chain complementarity determining region 3 for antibody 17338
QQYRSSPPT

SEQ ID NO: 34676 - protein, 10 aa, Homo sapiens
  heavy chain complementarity determining region 3 for antibody 17338
VRGIHNAFDI

SEQ ID NO: 34677 - protein, 9 aa, Homo sapiens
  light chain complementarity determining region 3 for antibody 17339
QQYQNWPYT

SEQ ID NO: 34678 - protein, 11 aa, Homo sapiens
  heavy chain complementarity determining region 3 for antibody 17339
GAYYHGGPCGY

SEQ ID NO: 34679 - protein, 9 aa, Homo sapiens
  light chain complementarity determining region 3 for antibody 17340
QQYNSYSRT

SEQ ID NO: 34680 - protein, 15 aa, Homo sapiens
  heavy chain complementarity determining region 3 for antibody 17340
VRHYRIITAPLEGDS

SEQ ID NO: 34681 - protein, 8 aa, Homo sapiens
  light chain complementarity determining region 3 for antibody 17341
QQYNNWVR

SEQ ID NO: 34682 - protein, 12 aa, Homo sapiens
  heavy chain complementarity determining region 3 for antibody 17341
ARRVSDWWFFDL

SEQ ID NO: 34683 - protein, 9 aa, Homo sapiens
  light chain complementarity determining region 3 for antibody 17342
QQYGTSPYT

SEQ ID NO: 34684 - protein, 20 aa, Homo sapiens
  heavy chain complementarity determining region 3 for antibody 17342
ARGGQKGYFDWLFELDGMDV

SEQ ID NO: 34685 - protein, 9 aa, Homo sapiens
  light chain complementarity determining region 3 for antibody 17343
QQTYIPPRT

SEQ ID NO: 34686 - protein, 21 aa, Homo sapiens
  heavy chain complementarity determining region 3 for antibody 17343
ARVTVRVPSTTGFGQYYGLDV

SEQ ID NO: 34687 - protein, 9 aa, Homo sapiens
  light chain complementarity determining region 3 for antibody 17344
QQSYSSPYT

SEQ ID NO: 34688 - protein, 14 aa, Homo sapiens
  heavy chain complementarity determining region 3 for antibody 17344
AREGGDSRRYAYDI

SEQ ID NO: 34689 - protein, 9 aa, Homo sapiens
  light chain complementarity determining region 3 for antibody 17345
QQSSTYPLT

SEQ ID NO: 34690 - protein, 8 aa, Homo sapiens
  heavy chain complementarity determining region 3 for antibody 17345
IIYVNSWY

SEQ ID NO: 34691 - protein, 10 aa, Homo sapiens
  light chain complementarity determining region 3 for antibody 17346
QQRYNLPPFT

SEQ ID NO: 34692 - protein, 11 aa, Homo sapiens
  heavy chain complementarity determining region 3 for antibody 17346
ARGVGSYPFDS

SEQ ID NO: 34693 - protein, 9 aa, Homo sapiens
  light chain complementarity determining region 3 for antibody 17347
LQHNSYPLT

SEQ ID NO: 34694 - protein, 22 aa, Homo sapiens
  heavy chain complementarity determining region 3 for antibody 17347
ARDQASTVVVVSRPWEVSDLTF

SEQ ID NO: 34695 - protein, 9 aa, Homo sapiens
  light chain complementarity determining region 3 for antibody 17348
LQGNRFPHT

SEQ ID NO: 34696 - protein, 14 aa, Homo sapiens
  heavy chain complementarity determining region 3 for antibody 17348
ARYCSGKSCYSMDH

SEQ ID NO: 34697 - protein, 9 aa, Homo sapiens
  light chain complementarity determining region 3 for antibody 17349
HQSSSLPYT

SEQ ID NO: 34698 - protein, 14 aa, Homo sapiens
  heavy chain complementarity determining region 3 for antibody 17349
ATSPKGTSLYYFDF

SEQ ID NO: 34699 - protein, 9 aa, Homo sapiens
  light chain complementarity determining region 3 for antibody 17350
QQYGTSPFT

SEQ ID NO: 34700 - protein, 18 aa, Homo sapiens
  heavy chain complementarity determining region 3 for antibody 17350
ARFEKWELRRGYYYGMDV

SEQ ID NO: 34701 - protein, 9 aa, Homo sapiens
  light chain complementarity determining region 3 for antibody 17351
QQYGSSPRT

SEQ ID NO: 34702 - protein, 13 aa, Homo sapiens
  heavy chain complementarity determining region 3 for antibody 17351
ARGSGIFGGFFDY

SEQ ID NO: 34703 - protein, 9 aa, Homo sapiens
  light chain complementarity determining region 3 for antibody 17352
QQYDSLPLT

SEQ ID NO: 34704 - protein, 20 aa, Homo sapiens
  heavy chain complementarity determining region 3 for antibody 17352
VRGLHIVVATSFPGNYGVDV

SEQ ID NO: 34705 - protein, 8 aa, Homo sapiens
  light chain complementarity determining region 3 for antibody 17353
QQYDNLPV

SEQ ID NO: 34706 - protein, 15 aa, Homo sapiens
  heavy chain complementarity determining region 3 for antibody 17353
ARQITSAWNEHAFDY

SEQ ID NO: 34707 - protein, 9 aa, Homo sapiens
  light chain complementarity determining region 3 for antibody 17354
MQTTLWPYT

SEQ ID NO: 34708 - protein, 15 aa, Homo sapiens
  heavy chain complementarity determining region 3 for antibody 17354
ARGPLRFAGNEGLDY

SEQ ID NO: 34709 - protein, 9 aa, Homo sapiens
  light chain complementarity determining region 3 for antibody 17355
QQYTNWPLT

SEQ ID NO: 34710 - protein, 16 aa, Homo sapiens
  heavy chain complementarity determining region 3 for antibody 17355
AKEGYHYETGGGGMDV

SEQ ID NO: 34711 - protein, 9 aa, Homo sapiens
  light chain complementarity determining region 3 for antibody 17356
QQYDTSPGT

SEQ ID NO: 34712 - protein, 16 aa, Homo sapiens
  heavy chain complementarity determining region 3 for antibody 17356
ARLSGDWGSAPHFFDT

SEQ ID NO: 34713 - protein, 8 aa, Homo sapiens
  light chain complementarity determining region 3 for antibody 17357
QQSYSNWT

SEQ ID NO: 34714 - protein, 11 aa, Homo sapiens
  heavy chain complementarity determining region 3 for antibody 17357
ARGPMVRALDY

SEQ ID NO: 34715 - protein, 9 aa, Homo sapiens
  light chain complementarity determining region 3 for antibody 17358
QQFAGTPHT

SEQ ID NO: 34716 - protein, 9 aa, Homo sapiens
  heavy chain complementarity determining region 3 for antibody 17358
VRGDWGSGY

SEQ ID NO: 34717 - protein, 9 aa, Homo sapiens
  light chain complementarity determining region 3 for antibody 17359
QKYDSAPQT

SEQ ID NO: 34718 - protein, 13 aa, Homo sapiens
  heavy chain complementarity determining region 3 for antibody 17359
ASSSLGYVDAFDL

SEQ ID NO: 34719 - protein, 8 aa, Homo sapiens
  light chain complementarity determining region 3 for antibody 17360
QHYGSTYT

SEQ ID NO: 34720 - protein, 17 aa, Homo sapiens
  heavy chain complementarity determining region 3 for antibody 17360
ARDHGGVQSRKSGALDV

SEQ ID NO: 34721 - protein, 9 aa, Homo sapiens
  light chain complementarity determining region 3 for antibody 17361
MQALQAPGT

SEQ ID NO: 34722 - protein, 22 aa, Homo sapiens
  heavy chain complementarity determining region 3 for antibody 17361
ARLTGVVKQQVGYYYYYYGMDV

SEQ ID NO: 34723 - protein, 9 aa, Homo sapiens
  light chain complementarity determining region 3 for antibody 17362
LQDYNYPRT

SEQ ID NO: 34724 - protein, 15 aa, Homo sapiens
  heavy chain complementarity determining region 3 for antibody 17362
ARSPRYSSSWGRFDP

SEQ ID NO: 34725 - protein, 9 aa, Homo sapiens
  light chain complementarity determining region 3 for antibody 17363
LQDYNYPMT

SEQ ID NO: 34726 - protein, 18 aa, Homo sapiens
  heavy chain complementarity determining region 3 for antibody 17363
ARALGHCWGGHCYTAFDI

SEQ ID NO: 34727 - protein, 9 aa, Homo sapiens
  light chain complementarity determining region 3 for antibody 17364
QQYGSSPRT

SEQ ID NO: 34728 - protein, 19 aa, Homo sapiens
  heavy chain complementarity determining region 3 for antibody 17364
ARPQGYDFRSGYSEHYFDY

SEQ ID NO: 34729 - protein, 9 aa, Homo sapiens
  light chain complementarity determining region 3 for antibody 17365
QQADSFPFT

SEQ ID NO: 34730 - protein, 12 aa, Homo sapiens
  heavy chain complementarity determining region 3 for antibody 17365
AKGGSLWLSFDP

SEQ ID NO: 34731 - protein, 9 aa, Homo sapiens
  light chain complementarity determining region 3 for antibody 17366
LQHNSFPRT

SEQ ID NO: 34732 - protein, 11 aa, Homo sapiens
  heavy chain complementarity determining region 3 for antibody 17366
ARLIETWSGDY

SEQ ID NO: 34733 - protein, 9 aa, Homo sapiens
  light chain complementarity determining region 3 for antibody 17367
LQHNSFPLT

SEQ ID NO: 34734 - protein, 10 aa, Homo sapiens
  heavy chain complementarity determining region 3 for antibody 17367
ARDDLWSFDY

SEQ ID NO: 34735 - protein, 9 aa, Homo sapiens
  light chain complementarity determining region 3 for antibody 17368
QQYGSPIFT

SEQ ID NO: 34736 - protein, 13 aa, Homo sapiens
  heavy chain complementarity determining region 3 for antibody 17368
VMASRGYYSSFDY

SEQ ID NO: 34737 - protein, 9 aa, Homo sapiens
  light chain complementarity determining region 3 for antibody 17369
QQRDNWPPL

SEQ ID NO: 34738 - protein, 16 aa, Homo sapiens
  heavy chain complementarity determining region 3 for antibody 17369
ARLLDPDGYNFWYFDY

SEQ ID NO: 34739 - protein, 10 aa, Homo sapiens
  light chain complementarity determining region 3 for antibody 17370
QQHVSSPPWT

SEQ ID NO: 34740 - protein, 14 aa, Homo sapiens
  heavy chain complementarity determining region 3 for antibody 17370
ARSPRTTMPPPWDY

SEQ ID NO: 34741 - protein, 9 aa, Homo sapiens
  light chain complementarity determining region 3 for antibody 17371
QQANSYPIT

SEQ ID NO: 34742 - protein, 13 aa, Homo sapiens
  heavy chain complementarity determining region 3 for antibody 17371
ARDRFTYGNWYDP

SEQ ID NO: 34743 - protein, 9 aa, Homo sapiens
  light chain complementarity determining region 3 for antibody 17372
QQAHSFPRT

SEQ ID NO: 34744 - protein, 13 aa, Homo sapiens
  heavy chain complementarity determining region 3 for antibody 17372
ATSHDYGDSALDS

SEQ ID NO: 34745 - protein, 9 aa, Homo sapiens
  light chain complementarity determining region 3 for antibody 17373
QHSHSRPFT

SEQ ID NO: 34746 - protein, 20 aa, Homo sapiens
  heavy chain complementarity determining region 3 for antibody 17373
AKGISVAALRTVYYYYGMDV

SEQ ID NO: 34747 - protein, 9 aa, Homo sapiens
  light chain complementarity determining region 3 for antibody 17374
QQYNTYRYT

SEQ ID NO: 34748 - protein, 18 aa, Homo sapiens
  heavy chain complementarity determining region 3 for antibody 17374
AKVRDFHAAGTPGNGLDV

SEQ ID NO: 34749 - protein, 9 aa, Homo sapiens
  light chain complementarity determining region 3 for antibody 17375
QQYGSLPHT

SEQ ID NO: 34750 - protein, 14 aa, Homo sapiens
  heavy chain complementarity determining region 3 for antibody 17375
ARGGGSDWYGLLYY

SEQ ID NO: 34751 - protein, 9 aa, Homo sapiens
  light chain complementarity determining region 3 for antibody 17376
QQYGSIPRT

SEQ ID NO: 34752 - protein, 14 aa, Homo sapiens
  heavy chain complementarity determining region 3 for antibody 17376
AGGDFCGRDCYSEY

SEQ ID NO: 34753 - protein, 9 aa, Homo sapiens
  light chain complementarity determining region 3 for antibody 17377
QQYGSIPRS

SEQ ID NO: 34754 - protein, 13 aa, Homo sapiens
  heavy chain complementarity determining region 3 for antibody 17377
AGGTWHSGIYYES

SEQ ID NO: 34755 - protein, 9 aa, Homo sapiens
  light chain complementarity determining region 3 for antibody 17378
QQSYDNART

SEQ ID NO: 34756 - protein, 13 aa, Homo sapiens
  heavy chain complementarity determining region 3 for antibody 17378
ARRDAYNYSGLDY

SEQ ID NO: 34757 - protein, 9 aa, Homo sapiens
  light chain complementarity determining region 3 for antibody 17379
QQAHTFPFT

SEQ ID NO: 34758 - protein, 15 aa, Homo sapiens
  heavy chain complementarity determining region 3 for antibody 17379
ARCFSGGKSCGWFDP

SEQ ID NO: 34759 - protein, 9 aa, Homo sapiens
  light chain complementarity determining region 3 for antibody 17380
QQYGDSPYT

SEQ ID NO: 34760 - protein, 22 aa, Homo sapiens
  heavy chain complementarity determining region 3 for antibody 17380
TRRRPTGRTSFRRGGRQGAFDI

SEQ ID NO: 34761 - protein, 9 aa, Homo sapiens
  light chain complementarity determining region 3 for antibody 17381
QQSHTTPPT

SEQ ID NO: 34762 - protein, 18 aa, Homo sapiens
  heavy chain complementarity determining region 3 for antibody 17381
VQLLGYCRDHGYCPPFAY

SEQ ID NO: 34763 - protein, 9 aa, Homo sapiens
  light chain complementarity determining region 3 for antibody 17382
QQRSNWPYT

SEQ ID NO: 34764 - protein, 13 aa, Homo sapiens
  heavy chain complementarity determining region 3 for antibody 17382
ARYSSKSPDRDDY

SEQ ID NO: 34765 - protein, 8 aa, Homo sapiens
  light chain complementarity determining region 3 for antibody 17383
QQICTTRT

SEQ ID NO: 34766 - protein, 18 aa, Homo sapiens
  heavy chain complementarity determining region 3 for antibody 17383
ARERGYCSGGSCYPRPLN

SEQ ID NO: 34767 - protein, 9 aa, Homo sapiens
  light chain complementarity determining region 3 for antibody 17384
QQFDRYPLT

SEQ ID NO: 34768 - protein, 19 aa, Homo sapiens
  heavy chain complementarity determining region 3 for antibody 17384
ARDSRRMVRGLIVYNWFDP

SEQ ID NO: 34769 - protein, 9 aa, Homo sapiens
  light chain complementarity determining region 3 for antibody 17385
QKYNSVPLT

SEQ ID NO: 34770 - protein, 10 aa, Homo sapiens
  heavy chain complementarity determining region 3 for antibody 17385
AREFYYGIDV

SEQ ID NO: 34771 - protein, 10 aa, Homo sapiens
  light chain complementarity determining region 3 for antibody 17386
QYYDDSPGYT

SEQ ID NO: 34772 - protein, 12 aa, Homo sapiens
  heavy chain complementarity determining region 3 for antibody 17386
ARETTNIGELDY

SEQ ID NO: 34773 - protein, 9 aa, Homo sapiens
  light chain complementarity determining region 3 for antibody 17387
QQYGSSFLT

SEQ ID NO: 34774 - protein, 19 aa, Homo sapiens
  heavy chain complementarity determining region 3 for antibody 17387
ARYCASGGSCYSPKYGMDV

SEQ ID NO: 34775 - protein, 10 aa, Homo sapiens
  light chain complementarity determining region 3 for antibody 17388
QQYGNSPTWT

SEQ ID NO: 34776 - protein, 19 aa, Homo sapiens
  heavy chain complementarity determining region 3 for antibody 17388
ARAEYYYDSGGYRPYYFDY

SEQ ID NO: 34777 - protein, 9 aa, Homo sapiens
  light chain complementarity determining region 3 for antibody 17389
QQLKSYPLT

SEQ ID NO: 34778 - protein, 13 aa, Homo sapiens
  heavy chain complementarity determining region 3 for antibody 17389
VPVMEVTLGAFAF

SEQ ID NO: 34779 - protein, 9 aa, Homo sapiens
  light chain complementarity determining region 3 for antibody 17390
QNYDTAPVT

SEQ ID NO: 34780 - protein, 9 aa, Homo sapiens
  heavy chain complementarity determining region 3 for antibody 17390
AAVGGWLAS

SEQ ID NO: 34781 - protein, 9 aa, Homo sapiens
  light chain complementarity determining region 3 for antibody 17391
QHYNGYWWP

SEQ ID NO: 34782 - protein, 12 aa, Homo sapiens
  heavy chain complementarity determining region 3 for antibody 17391
VTYLVGHGGVGF

SEQ ID NO: 34783 - protein, 12 aa, Homo sapiens
  light chain complementarity determining region 3 for antibody 17392
QHYNDWPPGRGT

SEQ ID NO: 34784 - protein, 14 aa, Homo sapiens
  heavy chain complementarity determining region 3 for antibody 17392
ARDLSSTSSWYFDY

SEQ ID NO: 34785 - protein, 10 aa, Homo sapiens
  light chain complementarity determining region 3 for antibody 17393
QHFGSSPEIT

SEQ ID NO: 34786 - protein, 13 aa, Homo sapiens
  heavy chain complementarity determining region 3 for antibody 17393
VRGARRGRYDFDY

SEQ ID NO: 34787 - protein, 8 aa, Homo sapiens
  light chain complementarity determining region 3 for antibody 17394
MQGVQPYP

SEQ ID NO: 34788 - protein, 7 aa, Homo sapiens
  heavy chain complementarity determining region 3 for antibody 17394
ATKMGDY

SEQ ID NO: 34789 - protein, 9 aa, Homo sapiens
  light chain complementarity determining region 3 for antibody 17395
MQALETPFT

SEQ ID NO: 34790 - protein, 15 aa, Homo sapiens
  heavy chain complementarity determining region 3 for antibody 17395
LRHYRSLVTGTEADS

SEQ ID NO: 34791 - protein, 9 aa, Homo sapiens
  light chain complementarity determining region 3 for antibody 17396
HQYGRSPYT

SEQ ID NO: 34792 - protein, 11 aa, Homo sapiens
  heavy chain complementarity determining region 3 for antibody 17396
ATWAFYHGVDV

SEQ ID NO: 34793 - protein, 9 aa, Homo sapiens
  light chain complementarity determining region 3 for antibody 17397
HHYHNAPWG

SEQ ID NO: 34794 - protein, 15 aa, Homo sapiens
  heavy chain complementarity determining region 3 for antibody 17397
AATSYGSRKVRPALS

SEQ ID NO: 34795 - protein, 9 aa, Homo sapiens
  light chain complementarity determining region 3 for antibody 17398
RQALETPFT

SEQ ID NO: 34796 - protein, 15 aa, Homo sapiens
  heavy chain complementarity determining region 3 for antibody 17398
VRHYRETVAGIEGDS

SEQ ID NO: 34797 - protein, 8 aa, Homo sapiens
  light chain complementarity determining region 3 for antibody 17399
QQYTYWWT

SEQ ID NO: 34798 - protein, 12 aa, Homo sapiens
  heavy chain complementarity determining region 3 for antibody 17399
ARIRDGSNYFAY

SEQ ID NO: 34799 - protein, 9 aa, Homo sapiens
  light chain complementarity determining region 3 for antibody 17400
QQYSDSPGT

SEQ ID NO: 34800 - protein, 22 aa, Homo sapiens
  heavy chain complementarity determining region 3 for antibody 17400
ARPKTQGGYYESSGYERAAFDL

SEQ ID NO: 34801 - protein, 9 aa, Homo sapiens
  light chain complementarity determining region 3 for antibody 17401
QQYNNWPYT

SEQ ID NO: 34802 - protein, 14 aa, Homo sapiens
  heavy chain complementarity determining region 3 for antibody 17401
AREDYGGNWDAFDI

SEQ ID NO: 34803 - protein, 10 aa, Homo sapiens
  light chain complementarity determining region 3 for antibody 17402
QQYNNWPRYT

SEQ ID NO: 34804 - protein, 14 aa, Homo sapiens
  heavy chain complementarity determining region 3 for antibody 17402
ARLGEGYSYGPSDC

SEQ ID NO: 34805 - protein, 9 aa, Homo sapiens
  light chain complementarity determining region 3 for antibody 17403
QQSYINPRT

SEQ ID NO: 34806 - protein, 15 aa, Homo sapiens
  heavy chain complementarity determining region 3 for antibody 17403
ARLSSTVTRFDAFDI

SEQ ID NO: 34807 - protein, 9 aa, Homo sapiens
  light chain complementarity determining region 3 for antibody 17404
QQSYGTPAT

SEQ ID NO: 34808 - protein, 16 aa, Homo sapiens
  heavy chain complementarity determining region 3 for antibody 17404
AKDVLDTAMINYWFDP

SEQ ID NO: 34809 - protein, 10 aa, Homo sapiens
  light chain complementarity determining region 3 for antibody 17405
QQRINWPLFT

SEQ ID NO: 34810 - protein, 13 aa, Homo sapiens
  heavy chain complementarity determining region 3 for antibody 17405
ARPGGSSLMFFDF

SEQ ID NO: 34811 - protein, 9 aa, Homo sapiens
  light chain complementarity determining region 3 for antibody 17406
QQFYNNPFT

SEQ ID NO: 34812 - protein, 14 aa, Homo sapiens
  heavy chain complementarity determining region 3 for antibody 17406
LGQDCSGVGCDYPR

SEQ ID NO: 34813 - protein, 9 aa, Homo sapiens
  light chain complementarity determining region 3 for antibody 17407
QKYNSAPRT

SEQ ID NO: 34814 - protein, 8 aa, Homo sapiens
  heavy chain complementarity determining region 3 for antibody 17407
AAGGSCDY

SEQ ID NO: 34815 - protein, 9 aa, Homo sapiens
  light chain complementarity determining region 3 for antibody 17408
MQATYWPGT

SEQ ID NO: 34816 - protein, 11 aa, Homo sapiens
  heavy chain complementarity determining region 3 for antibody 17408
LSAVRGSSFDI

SEQ ID NO: 34817 - protein, 9 aa, Homo sapiens
  light chain complementarity determining region 3 for antibody 17409
MQALETPFP

SEQ ID NO: 34818 - protein, 15 aa, Homo sapiens
  heavy chain complementarity determining region 3 for antibody 17409
VRHYRIITAPLEGDS

SEQ ID NO: 34819 - protein, 9 aa, Homo sapiens
  light chain complementarity determining region 3 for antibody 17410
LQALETPFT

SEQ ID NO: 34820 - protein, 15 aa, Homo sapiens
  heavy chain complementarity determining region 3 for antibody 17410
VRHYRETVAGIEGDS

SEQ ID NO: 34821 - protein, 9 aa, Homo sapiens
  light chain complementarity determining region 3 for antibody 17411
HQYKAYPLT

SEQ ID NO: 34822 - protein, 11 aa, Homo sapiens
  heavy chain complementarity determining region 3 for antibody 17411
ARSRNHWLEES

SEQ ID NO: 34823 - protein, 9 aa, Homo sapiens
  light chain complementarity determining region 3 for antibody 17412
QQYSTSPVT

SEQ ID NO: 34824 - protein, 16 aa, Homo sapiens
  heavy chain complementarity determining region 3 for antibody 17412
ATDWGSGSHYIRAYDL

SEQ ID NO: 34825 - protein, 9 aa, Homo sapiens
  light chain complementarity determining region 3 for antibody 17413
QQYHSTPLT

SEQ ID NO: 34826 - protein, 20 aa, Homo sapiens
  heavy chain complementarity determining region 3 for antibody 17413
ARARSKTTVVTPTRQFASDI

SEQ ID NO: 34827 - protein, 10 aa, Homo sapiens
  light chain complementarity determining region 3 for antibody 17414
QQYDNVPRFT

SEQ ID NO: 34828 - protein, 23 aa, Homo sapiens
  heavy chain complementarity determining region 3 for antibody 17414
ARAPLRSLESTDYDLLSGGYFDH

SEQ ID NO: 34829 - protein, 9 aa, Homo sapiens
  light chain complementarity determining region 3 for antibody 17415
QQYDNLPYT

SEQ ID NO: 34830 - protein, 13 aa, Homo sapiens
  heavy chain complementarity determining region 3 for antibody 17415
ARSRQLAAGAGDY

SEQ ID NO: 34831 - protein, 10 aa, Homo sapiens
  light chain complementarity determining region 3 for antibody 17416
QQSYITPPYT

SEQ ID NO: 34832 - protein, 19 aa, Homo sapiens
  heavy chain complementarity determining region 3 for antibody 17416
ARTPLVVTASTSSGNWFDP

SEQ ID NO: 34833 - protein, 9 aa, Homo sapiens
  light chain complementarity determining region 3 for antibody 17417
QQRSNWPLT

SEQ ID NO: 34834 - protein, 14 aa, Homo sapiens
  heavy chain complementarity determining region 3 for antibody 17417
ARGPEEAAGGEFDS

SEQ ID NO: 34835 - protein, 10 aa, Homo sapiens
  light chain complementarity determining region 3 for antibody 17418
QKYGGSPLVT

SEQ ID NO: 34836 - protein, 14 aa, Homo sapiens
  heavy chain complementarity determining region 3 for antibody 17418
ARDPISGSPDYFDY

SEQ ID NO: 34837 - protein, 9 aa, Homo sapiens
  light chain complementarity determining region 3 for antibody 17419
MQASQFPYT

SEQ ID NO: 34838 - protein, 12 aa, Homo sapiens
  heavy chain complementarity determining region 3 for antibody 17419
TRGLFGVSGVDY

SEQ ID NO: 34839 - protein, 8 aa, Homo sapiens
  light chain complementarity determining region 3 for antibody 17420
MQALQALT

SEQ ID NO: 34840 - protein, 16 aa, Homo sapiens
  heavy chain complementarity determining region 3 for antibody 17420
AKAGWLVGYDLSRGCA

SEQ ID NO: 34841 - protein, 9 aa, Homo sapiens
  light chain complementarity determining region 3 for antibody 17421
MQALETPLT

SEQ ID NO: 34842 - protein, 15 aa, Homo sapiens
  heavy chain complementarity determining region 3 for antibody 17421
VRHYRETVAGIEGDS

SEQ ID NO: 34843 - protein, 8 aa, Homo sapiens
  light chain complementarity determining region 3 for antibody 17422
QQYNSYLT

SEQ ID NO: 34844 - protein, 14 aa, Homo sapiens
  heavy chain complementarity determining region 3 for antibody 17422
ARNSEGSGWFPCDY

SEQ ID NO: 34845 - protein, 9 aa, Homo sapiens
  light chain complementarity determining region 3 for antibody 17423
QQYNEWPLT

SEQ ID NO: 34846 - protein, 17 aa, Homo sapiens
  heavy chain complementarity determining region 3 for antibody 17423
AIAEGWDNYKGVDAFDI

SEQ ID NO: 34847 - protein, 9 aa, Homo sapiens
  light chain complementarity determining region 3 for antibody 17424
QQYGTTPRT

SEQ ID NO: 34848 - protein, 13 aa, Homo sapiens
  heavy chain complementarity determining region 3 for antibody 17424
AGGLFDRRGYSEF

SEQ ID NO: 34849 - protein, 10 aa, Homo sapiens
  light chain complementarity determining region 3 for antibody 17425
QQYDIWPPWT

SEQ ID NO: 34850 - protein, 14 aa, Homo sapiens
  heavy chain complementarity determining region 3 for antibody 17425
TAAQPVGWGYYFVY

SEQ ID NO: 34851 - protein, 9 aa, Homo sapiens
  light chain complementarity determining region 3 for antibody 17426
QQGYNTPWT

SEQ ID NO: 34852 - protein, 12 aa, Homo sapiens
  heavy chain complementarity determining region 3 for antibody 17426
ARVQQRGDSFDI

SEQ ID NO: 34853 - protein, 11 aa, Homo sapiens
  light chain complementarity determining region 3 for antibody 17427
QHYNNWPLMYT

SEQ ID NO: 34854 - protein, 14 aa, Homo sapiens
  heavy chain complementarity determining region 3 for antibody 17427
LLRHRRADWPGVDY

SEQ ID NO: 34855 - protein, 9 aa, Homo sapiens
  light chain complementarity determining region 3 for antibody 17428
MQALETPFP

SEQ ID NO: 34856 - protein, 15 aa, Homo sapiens
  heavy chain complementarity determining region 3 for antibody 17428
VRHYRETVAGIEGDS

SEQ ID NO: 34857 - protein, 9 aa, Homo sapiens
  light chain complementarity determining region 3 for antibody 17429
LQDFTYPFT

SEQ ID NO: 34858 - protein, 10 aa, Homo sapiens
  heavy chain complementarity determining region 3 for antibody 17429
AKERAGEPDY

SEQ ID NO: 34859 - protein, 11 aa, Homo sapiens
  light chain complementarity determining region 3 for antibody 17430
QQYSSWPPNLT

SEQ ID NO: 34860 - protein, 13 aa, Homo sapiens
  heavy chain complementarity determining region 3 for antibody 17430
ARGGQNSGLYLGY

SEQ ID NO: 34861 - protein, 10 aa, Homo sapiens
  light chain complementarity determining region 3 for antibody 17431
QQYHEWPPGS

SEQ ID NO: 34862 - protein, 14 aa, Homo sapiens
  heavy chain complementarity determining region 3 for antibody 17431
AKGRGTFYSGMFDS

SEQ ID NO: 34863 - protein, 10 aa, Homo sapiens
  light chain complementarity determining region 3 for antibody 17432
QQYGSSVPWT

SEQ ID NO: 34864 - protein, 13 aa, Homo sapiens
  heavy chain complementarity determining region 3 for antibody 17432
AHGRRSSWDSFDY

SEQ ID NO: 34865 - protein, 9 aa, Homo sapiens
  light chain complementarity determining region 3 for antibody 17433
QQYGSSPRT

SEQ ID NO: 34866 - protein, 17 aa, Homo sapiens
  heavy chain complementarity determining region 3 for antibody 17433
ARAQGVVVVAARGAFDI

SEQ ID NO: 34867 - protein, 8 aa, Homo sapiens
  light chain complementarity determining region 3 for antibody 17434
QQYDYLWT

SEQ ID NO: 34868 - protein, 10 aa, Homo sapiens
  heavy chain complementarity determining region 3 for antibody 17434
ATRPIASFPL

SEQ ID NO: 34869 - protein, 10 aa, Homo sapiens
  light chain complementarity determining region 3 for antibody 17435
QQYDNWPPLT

SEQ ID NO: 34870 - protein, 15 aa, Homo sapiens
  heavy chain complementarity determining region 3 for antibody 17435
AKEPDCGRNCLFFES

SEQ ID NO: 34871 - protein, 9 aa, Homo sapiens
  light chain complementarity determining region 3 for antibody 17436
QQVISYPFT

SEQ ID NO: 34872 - protein, 12 aa, Homo sapiens
  heavy chain complementarity determining region 3 for antibody 17436
ARPLDGDHGFDP

SEQ ID NO: 34873 - protein, 9 aa, Homo sapiens
  light chain complementarity determining region 3 for antibody 17437
QQTHSFPLS

SEQ ID NO: 34874 - protein, 11 aa, Homo sapiens
  heavy chain complementarity determining region 3 for antibody 17437
VHSPAMAEIDY

SEQ ID NO: 34875 - protein, 9 aa, Homo sapiens
  light chain complementarity determining region 3 for antibody 17438
QQRANWPLT

SEQ ID NO: 34876 - protein, 18 aa, Homo sapiens
  heavy chain complementarity determining region 3 for antibody 17438
ARSPPADIFFGEFFLFDY

SEQ ID NO: 34877 - protein, 9 aa, Homo sapiens
  light chain complementarity determining region 3 for antibody 17439
QQFNSFPWT

SEQ ID NO: 34878 - protein, 20 aa, Homo sapiens
  heavy chain complementarity determining region 3 for antibody 17439
MSHFCIGGNCYSGARGPFDP

SEQ ID NO: 34879 - protein, 9 aa, Homo sapiens
  light chain complementarity determining region 3 for antibody 17440
MQGTHWPIT

SEQ ID NO: 34880 - protein, 18 aa, Homo sapiens
  heavy chain complementarity determining region 3 for antibody 17440
TRDFRDSCSGGGCYYFDL

SEQ ID NO: 34881 - protein, 9 aa, Homo sapiens
  light chain complementarity determining region 3 for antibody 17441
MQALETPFT

SEQ ID NO: 34882 - protein, 15 aa, Homo sapiens
  heavy chain complementarity determining region 3 for antibody 17441
VRHYRVPVAGIEGDS

SEQ ID NO: 34883 - protein, 9 aa, Homo sapiens
  light chain complementarity determining region 3 for antibody 17442
LHDYDYPRT

SEQ ID NO: 34884 - protein, 22 aa, Homo sapiens
  heavy chain complementarity determining region 3 for antibody 17442
ARDSSPRYYYGGRDYYVDVLDL

SEQ ID NO: 34885 - protein, 6 aa, Homo sapiens
  light chain complementarity determining region 3 for antibody 17443
QRHGGS

SEQ ID NO: 34886 - protein, 11 aa, Homo sapiens
  heavy chain complementarity determining region 3 for antibody 17443
ARAGYRAAFDI

SEQ ID NO: 34887 - protein, 9 aa, Homo sapiens
  light chain complementarity determining region 3 for antibody 17444
QQYYTTPRT

SEQ ID NO: 34888 - protein, 11 aa, Homo sapiens
  heavy chain complementarity determining region 3 for antibody 17444
TRGQDRSKQGY

SEQ ID NO: 34889 - protein, 9 aa, Homo sapiens
  light chain complementarity determining region 3 for antibody 17445
QQYYSTPRA

SEQ ID NO: 34890 - protein, 13 aa, Homo sapiens
  heavy chain complementarity determining region 3 for antibody 17445
AAVDPYYYYGMDV

SEQ ID NO: 34891 - protein, 10 aa, Homo sapiens
  light chain complementarity determining region 3 for antibody 17446
QQSYSTPLYT

SEQ ID NO: 34892 - protein, 12 aa, Homo sapiens
  heavy chain complementarity determining region 3 for antibody 17446
TRLDWGRSGSDY

SEQ ID NO: 34893 - protein, 9 aa, Homo sapiens
  light chain complementarity determining region 3 for antibody 17447
QQNGDFPIT

SEQ ID NO: 34894 - protein, 13 aa, Homo sapiens
  heavy chain complementarity determining region 3 for antibody 17447
AISVGVTTGWFDP

SEQ ID NO: 34895 - protein, 9 aa, Homo sapiens
  light chain complementarity determining region 3 for antibody 17448
QQHYGYPLT

SEQ ID NO: 34896 - protein, 18 aa, Homo sapiens
  heavy chain complementarity determining region 3 for antibody 17448
ARSRSGGIRDPQYNGLDV

SEQ ID NO: 34897 - protein, 9 aa, Homo sapiens
  light chain complementarity determining region 3 for antibody 17449
QQANSFPLT

SEQ ID NO: 34898 - protein, 15 aa, Homo sapiens
  heavy chain complementarity determining region 3 for antibody 17449
ARVALSVAGNNWFDP

SEQ ID NO: 34899 - protein, 9 aa, Homo sapiens
  light chain complementarity determining region 3 for antibody 17450
QKFDGAPYT

SEQ ID NO: 34900 - protein, 14 aa, Homo sapiens
  heavy chain complementarity determining region 3 for antibody 17450
AKPQLTRHNGGFDR

SEQ ID NO: 34901 - protein, 11 aa, Homo sapiens
  light chain complementarity determining region 3 for antibody 17451
QGYGASPPMYT

SEQ ID NO: 34902 - protein, 12 aa, Homo sapiens
  heavy chain complementarity determining region 3 for antibody 17451
AKDLHGSGSFDH

SEQ ID NO: 34903 - protein, 10 aa, Homo sapiens
  light chain complementarity determining region 3 for antibody 17452
QQYHNWPPWT

SEQ ID NO: 34904 - protein, 21 aa, Homo sapiens
  heavy chain complementarity determining region 3 for antibody 17452
ARAGRGDDYGDYRTDPGWFEA

SEQ ID NO: 34905 - protein, 10 aa, Homo sapiens
  light chain complementarity determining region 3 for antibody 17453
QQYHDWPPLT

SEQ ID NO: 34906 - protein, 17 aa, Homo sapiens
  heavy chain complementarity determining region 3 for antibody 17453
ARDSRIKMFGVVVMFQH

SEQ ID NO: 34907 - protein, 8 aa, Homo sapiens
  light chain complementarity determining region 3 for antibody 17454
QQYGSSPT

SEQ ID NO: 34908 - protein, 14 aa, Homo sapiens
  heavy chain complementarity determining region 3 for antibody 17454
ARLGGPDRGEKGGY

SEQ ID NO: 34909 - protein, 9 aa, Homo sapiens
  light chain complementarity determining region 3 for antibody 17455
QQYGNLPRT

SEQ ID NO: 34910 - protein, 12 aa, Homo sapiens
  heavy chain complementarity determining region 3 for antibody 17455
AREFPETCYFPN

SEQ ID NO: 34911 - protein, 9 aa, Homo sapiens
  light chain complementarity determining region 3 for antibody 17456
QEYNSAPWT

SEQ ID NO: 34912 - protein, 15 aa, Homo sapiens
  heavy chain complementarity determining region 3 for antibody 17456
TTRGYDSSDHYYFDY

SEQ ID NO: 34913 - protein, 9 aa, Homo sapiens
  light chain complementarity determining region 3 for antibody 17457
MQGTHWPKT

SEQ ID NO: 34914 - protein, 11 aa, Homo sapiens
  heavy chain complementarity determining region 3 for antibody 17457
SRGNSSSWYDY

SEQ ID NO: 34915 - protein, 8 aa, Homo sapiens
  light chain complementarity determining region 3 for antibody 17458
LHYGPSYT

SEQ ID NO: 34916 - protein, 18 aa, Homo sapiens
  heavy chain complementarity determining region 3 for antibody 17458
TRRASGGYCSANNCFVDF

SEQ ID NO: 34917 - protein, 9 aa, Homo sapiens
  light chain complementarity determining region 3 for antibody 17459
HQYATSPLT

SEQ ID NO: 34918 - protein, 10 aa, Homo sapiens
  heavy chain complementarity determining region 3 for antibody 17459
TTGGGWLVHY

SEQ ID NO: 34919 - protein, 9 aa, Homo sapiens
  light chain complementarity determining region 3 for antibody 17460
QQYYRYPVT

SEQ ID NO: 34920 - protein, 15 aa, Homo sapiens
  heavy chain complementarity determining region 3 for antibody 17460
AHGQHTTTVTSYFNF

SEQ ID NO: 34921 - protein, 11 aa, Homo sapiens
  light chain complementarity determining region 3 for antibody 17461
QQYRASPPGFP

SEQ ID NO: 34922 - protein, 14 aa, Homo sapiens
  heavy chain complementarity determining region 3 for antibody 17461
ARSPSNSRNRSFDQ

SEQ ID NO: 34923 - protein, 9 aa, Homo sapiens
  light chain complementarity determining region 3 for antibody 17462
QQYNKWPRT

SEQ ID NO: 34924 - protein, 15 aa, Homo sapiens
  heavy chain complementarity determining region 3 for antibody 17462
AKDGGSGWIPIYFDF

SEQ ID NO: 34925 - protein, 9 aa, Homo sapiens
  light chain complementarity determining region 3 for antibody 17463
QQSYTIPYT

SEQ ID NO: 34926 - protein, 21 aa, Homo sapiens
  heavy chain complementarity determining region 3 for antibody 17463
AKDVLHIDGGRWFQRGGSFNI

SEQ ID NO: 34927 - protein, 9 aa, Homo sapiens
  light chain complementarity determining region 3 for antibody 17464
QQHGGSPVT

SEQ ID NO: 34928 - protein, 6 aa, Homo sapiens
  heavy chain complementarity determining region 3 for antibody 17464
AAIPTF

SEQ ID NO: 34929 - protein, 9 aa, Homo sapiens
  light chain complementarity determining region 3 for antibody 17465
QQGYSTPLI

SEQ ID NO: 34930 - protein, 15 aa, Homo sapiens
  heavy chain complementarity determining region 3 for antibody 17465
ARAQVIWGQLYYFDY

SEQ ID NO: 34931 - protein, 11 aa, Homo sapiens
  light chain complementarity determining region 3 for antibody 17466
QHYGSSPPRGT

SEQ ID NO: 34932 - protein, 14 aa, Homo sapiens
  heavy chain complementarity determining region 3 for antibody 17466
ASFLLSRRGSYVDY

SEQ ID NO: 34933 - protein, 9 aa, Homo sapiens
  light chain complementarity determining region 3 for antibody 17467
MQVLQTPLT

SEQ ID NO: 34934 - protein, 19 aa, Homo sapiens
  heavy chain complementarity determining region 3 for antibody 17467
AFLLPDMYYSDGSASLLPY

SEQ ID NO: 34935 - protein, 9 aa, Homo sapiens
  light chain complementarity determining region 3 for antibody 17468
MQALQTPWT

SEQ ID NO: 34936 - protein, 12 aa, Homo sapiens
  heavy chain complementarity determining region 3 for antibody 17468
ALELIATGGFDY

SEQ ID NO: 34937 - protein, 9 aa, Homo sapiens
  light chain complementarity determining region 3 for antibody 17469
MQALEIPFT

SEQ ID NO: 34938 - protein, 15 aa, Homo sapiens
  heavy chain complementarity determining region 3 for antibody 17469
VRHYRIITAPLEGDS

SEQ ID NO: 34939 - protein, 9 aa, Homo sapiens
  light chain complementarity determining region 3 for antibody 17470
MQALEIPFT

SEQ ID NO: 34940 - protein, 15 aa, Homo sapiens
  heavy chain complementarity determining region 3 for antibody 17470
VRHYRETVAGIEGDS

SEQ ID NO: 34941 - protein, 9 aa, Homo sapiens
  light chain complementarity determining region 3 for antibody 17471
HQVISYPFT

SEQ ID NO: 34942 - protein, 12 aa, Homo sapiens
  heavy chain complementarity determining region 3 for antibody 17471
ARPLDGDHGFDV

SEQ ID NO: 34943 - protein, 9 aa, Homo sapiens
  light chain complementarity determining region 3 for antibody 17472
VQFQNVPLT

SEQ ID NO: 34944 - protein, 18 aa, Homo sapiens
  heavy chain complementarity determining region 3 for antibody 17472
VRGGRDSQGPLGYYNLGV

SEQ ID NO: 34945 - protein, 9 aa, Homo sapiens
  light chain complementarity determining region 3 for antibody 17473
QQYYSSPIT

SEQ ID NO: 34946 - protein, 21 aa, Homo sapiens
  heavy chain complementarity determining region 3 for antibody 17473
AKDAGLSIFRYFDGLFDAFHI

SEQ ID NO: 34947 - protein, 10 aa, Homo sapiens
  light chain complementarity determining region 3 for antibody 17474
QQYHSYSPAT

SEQ ID NO: 34948 - protein, 19 aa, Homo sapiens
  heavy chain complementarity determining region 3 for antibody 17474
ARESEYYFDKSGYLRPFDF

SEQ ID NO: 34949 - protein, 9 aa, Homo sapiens
  light chain complementarity determining region 3 for antibody 17475
QQYGTSRVT

SEQ ID NO: 34950 - protein, 17 aa, Homo sapiens
  heavy chain complementarity determining region 3 for antibody 17475
TKDRWLRVYDSSGCYDS

SEQ ID NO: 34951 - protein, 9 aa, Homo sapiens
  light chain complementarity determining region 3 for antibody 17476
QQYGSSPFS

SEQ ID NO: 34952 - protein, 13 aa, Homo sapiens
  heavy chain complementarity determining region 3 for antibody 17476
ARGQQYSGRIFDY

SEQ ID NO: 34953 - protein, 9 aa, Homo sapiens
  light chain complementarity determining region 3 for antibody 17477
QQYGSSLYT

SEQ ID NO: 34954 - protein, 24 aa, Homo sapiens
  heavy chain complementarity determining region 3 for antibody 17477
ARDRGVLLWFGELSPTAEDDAFDI

SEQ ID NO: 34955 - protein, 8 aa, Homo sapiens
  light chain complementarity determining region 3 for antibody 17478
QQYGSSIT

SEQ ID NO: 34956 - protein, 12 aa, Homo sapiens
  heavy chain complementarity determining region 3 for antibody 17478
VKDCGLGGSRDF

SEQ ID NO: 34957 - protein, 10 aa, Homo sapiens
  light chain complementarity determining region 3 for antibody 17479
QQYDNLPPFT

SEQ ID NO: 34958 - protein, 21 aa, Homo sapiens
  heavy chain complementarity determining region 3 for antibody 17479
AKASGSIAVSTSRYYYYAMDV

SEQ ID NO: 34959 - protein, 9 aa, Homo sapiens
  light chain complementarity determining region 3 for antibody 17480
QQYDLLPPS

SEQ ID NO: 34960 - protein, 21 aa, Homo sapiens
  heavy chain complementarity determining region 3 for antibody 17480
ARGLHIVVVTSILRGFWYFGL

SEQ ID NO: 34961 - protein, 9 aa, Homo sapiens
  light chain complementarity determining region 3 for antibody 17481
QQYAELPVT

SEQ ID NO: 34962 - protein, 13 aa, Homo sapiens
  heavy chain complementarity determining region 3 for antibody 17481
ATTYYWVVWYFDL

SEQ ID NO: 34963 - protein, 9 aa, Homo sapiens
  light chain complementarity determining region 3 for antibody 17482
QQSYGTLCT

SEQ ID NO: 34964 - protein, 19 aa, Homo sapiens
  heavy chain complementarity determining region 3 for antibody 17482
AREAYFYDSSGSKIGYFDY

SEQ ID NO: 34965 - protein, 9 aa, Homo sapiens
  light chain complementarity determining region 3 for antibody 17483
QQSHTYSWT

SEQ ID NO: 34966 - protein, 12 aa, Homo sapiens
  heavy chain complementarity determining region 3 for antibody 17483
ARMGYSYGHFDN

SEQ ID NO: 34967 - protein, 9 aa, Homo sapiens
  light chain complementarity determining region 3 for antibody 17484
QEYDSLPFT

SEQ ID NO: 34968 - protein, 22 aa, Homo sapiens
  heavy chain complementarity determining region 3 for antibody 17484
ARDDRISFDYPNSGYSGGTFDL

SEQ ID NO: 34969 - protein, 9 aa, Homo sapiens
  light chain complementarity determining region 3 for antibody 17485
LQHNSYPLT

SEQ ID NO: 34970 - protein, 13 aa, Homo sapiens
  heavy chain complementarity determining region 3 for antibody 17485
ARHLVRGGLVVDD

SEQ ID NO: 34971 - protein, 10 aa, Homo sapiens
  light chain complementarity determining region 3 for antibody 17486
QQYNNWPPYT

SEQ ID NO: 34972 - protein, 17 aa, Homo sapiens
  heavy chain complementarity determining region 3 for antibody 17486
ARDVPSYFSVVRGVIDY

SEQ ID NO: 34973 - protein, 9 aa, Homo sapiens
  light chain complementarity determining region 3 for antibody 17487
QQYGSSPRT

SEQ ID NO: 34974 - protein, 21 aa, Homo sapiens
  heavy chain complementarity determining region 3 for antibody 17487
AKDTAPYSTSWHTKKFYYFDY

SEQ ID NO: 34975 - protein, 9 aa, Homo sapiens
  light chain complementarity determining region 3 for antibody 17488
QQYDNLPYT

SEQ ID NO: 34976 - protein, 12 aa, Homo sapiens
  heavy chain complementarity determining region 3 for antibody 17488
ARDRVASGGFDP

SEQ ID NO: 34977 - protein, 9 aa, Homo sapiens
  light chain complementarity determining region 3 for antibody 17489
QQYDDLPYT

SEQ ID NO: 34978 - protein, 11 aa, Homo sapiens
  heavy chain complementarity determining region 3 for antibody 17489
AAQSVGFGELP

SEQ ID NO: 34979 - protein, 10 aa, Homo sapiens
  light chain complementarity determining region 3 for antibody 17490
QQNDNFLAYT

SEQ ID NO: 34980 - protein, 20 aa, Homo sapiens
  heavy chain complementarity determining region 3 for antibody 17490
ARDFFPFPRGPDSFDDVFDL

SEQ ID NO: 34981 - protein, 10 aa, Homo sapiens
  light chain complementarity determining region 3 for antibody 17491
MQGTHWPPYT

SEQ ID NO: 34982 - protein, 13 aa, Homo sapiens
  heavy chain complementarity determining region 3 for antibody 17491
VRDWAIWHQEFDL

SEQ ID NO: 34983 - protein, 9 aa, Homo sapiens
  light chain complementarity determining region 3 for antibody 17492
LQYYSTPWT

SEQ ID NO: 34984 - protein, 15 aa, Homo sapiens
  heavy chain complementarity determining region 3 for antibody 17492
IRQSKVDNYYNYPDF

SEQ ID NO: 34985 - protein, 9 aa, Homo sapiens
  light chain complementarity determining region 3 for antibody 17493
LQDYTYPRT

SEQ ID NO: 34986 - protein, 18 aa, Homo sapiens
  heavy chain complementarity determining region 3 for antibody 17493
ARDSSPSPAGVGYDAFDI

SEQ ID NO: 34987 - protein, 9 aa, Homo sapiens
  light chain complementarity determining region 3 for antibody 17494
HQYGHSLET

SEQ ID NO: 34988 - protein, 11 aa, Homo sapiens
  heavy chain complementarity determining region 3 for antibody 17494
ARHVYGVGKDH

SEQ ID NO: 34989 - protein, 9 aa, Homo sapiens
  light chain complementarity determining region 3 for antibody 17495
HQFDKRPYS

SEQ ID NO: 34990 - protein, 20 aa, Homo sapiens
  heavy chain complementarity determining region 3 for antibody 17495
ARDRRRRYAILALRSYGMDV

SEQ ID NO: 34991 - protein, 9 aa, Homo sapiens
  light chain complementarity determining region 3 for antibody 17496
QQYNSYPFT

SEQ ID NO: 34992 - protein, 20 aa, Homo sapiens
  heavy chain complementarity determining region 3 for antibody 17496
VRAEHYHDSSGNYCGPHFDN

SEQ ID NO: 34993 - protein, 10 aa, Homo sapiens [sequence omitted]

SEQ ID NO: 34994 - protein, 19 aa, Homo sapiens
  heavy chain complementarity determining region 3 for antibody 17497
ARDLGFGELPEGQYNWFDP

SEQ ID NO: 34995 - protein, 10 aa, Homo sapiens
  light chain complementarity determining region 3 for antibody 17498
QQYGTSSMYT

SEQ ID NO: 34996 - protein, 9 aa, Homo sapiens
  heavy chain complementarity determining region 3 for antibody 17498
ARGAAGFDY

SEQ ID NO: 34997 - protein, 9 aa, Homo sapiens
  light chain complementarity determining region 3 for antibody 17499
QQTYSPPRT

SEQ ID NO: 34998 - protein, 12 aa, Homo sapiens
  heavy chain complementarity determining region 3 for antibody 17499
ARNGAGAYGMDV

SEQ ID NO: 34999 - protein, 9 aa, Homo sapiens
  light chain complementarity determining region 3 for antibody 17500
QQSYIAPYT

SEQ ID NO: 35000 - protein, 17 aa, Homo sapiens
  heavy chain complementarity determining region 3 for antibody 17500
ARLTLRKSLEHIGGLDP

SEQ ID NO: 35001 - protein, 9 aa, Homo sapiens
  light chain complementarity determining region 3 for antibody 17501
QQSSTTPRT

SEQ ID NO: 35002 - protein, 22 aa, Homo sapiens
  heavy chain complementarity determining region 3 for antibody 17501
AREGLCTSTSCYEVNHYNGMDV

SEQ ID NO: 35003 - protein, 9 aa, Homo sapiens
  light chain complementarity determining region 3 for antibody 17502
HHYSSSPYT

SEQ ID NO: 35004 - protein, 13 aa, Homo sapiens
  heavy chain complementarity determining region 3 for antibody 17502
ARGTYSAFAIFGV

SEQ ID NO: 35005 - protein, 9 aa, Homo sapiens
  light chain complementarity determining region 3 for antibody 17503
QRTYNAPYT

SEQ ID NO: 35006 - protein, 17 aa, Homo sapiens
  heavy chain complementarity determining region 3 for antibody 17503
TKDRWLRVYDSSGCYDS

SEQ ID NO: 35007 - protein, 11 aa, Homo sapiens
  light chain complementarity determining region 3 for antibody 17504
QQYTNWPPLFT

SEQ ID NO: 35008 - protein, 14 aa, Homo sapiens
  heavy chain complementarity determining region 3 for antibody 17504
ARLNGIFGLYAFDV

SEQ ID NO: 35009 - protein, 8 aa, Homo sapiens
  light chain complementarity determining region 3 for antibody 17505
QQYNRFWT

SEQ ID NO: 35010 - protein, 19 aa, Homo sapiens
  heavy chain complementarity determining region 3 for antibody 17505
ARGGRDTYHRSGYYSTCDF

SEQ ID NO: 35011 - protein, 9 aa, Homo sapiens
  light chain complementarity determining region 3 for antibody 17506
QQYGTSPRT

SEQ ID NO: 35012 - protein, 13 aa, Homo sapiens
  heavy chain complementarity determining region 3 for antibody 17506
AGGSGSGTYYKDH

SEQ ID NO: 35013 - protein, 9 aa, Homo sapiens
  light chain complementarity determining region 3 for antibody 17507
QQSYSTPPT

SEQ ID NO: 35014 - protein, 16 aa, Homo sapiens
  heavy chain complementarity determining region 3 for antibody 17507
SKDILRQWLKLRTFED

SEQ ID NO: 35015 - protein, 9 aa, Homo sapiens
  light chain complementarity determining region 3 for antibody 17508
QQLNSFPFT

SEQ ID NO: 35016 - protein, 15 aa, Homo sapiens
  heavy chain complementarity determining region 3 for antibody 17508
ARLPLGSTFLYGMDV

SEQ ID NO: 35017 - protein, 10 aa, Homo sapiens
  light chain complementarity determining region 3 for antibody 17509
QQAYNTPPFT

SEQ ID NO: 35018 - protein, 17 aa, Homo sapiens
  heavy chain complementarity determining region 3 for antibody 17509
ARPAYSGQRPERYGMDV

SEQ ID NO: 35019 - protein, 9 aa, Homo sapiens
  light chain complementarity determining region 3 for antibody 17510
QKYTTAPFT

SEQ ID NO: 35020 - protein, 15 aa, Homo sapiens
  heavy chain complementarity determining region 3 for antibody 17510
ARVDPLTLVRDTDDY

SEQ ID NO: 35021 - protein, 9 aa, Homo sapiens
  light chain complementarity determining region 3 for antibody 17511
MQVLQTPLT

SEQ ID NO: 35022 - protein, 12 aa, Homo sapiens
  heavy chain complementarity determining region 3 for antibody 17511
VKDGETNWGSWH

SEQ ID NO: 35023 - protein, 9 aa, Homo sapiens
  light chain complementarity determining region 3 for antibody 17512
HQYNSYPWT

SEQ ID NO: 35024 - protein, 15 aa, Homo sapiens
  heavy chain complementarity determining region 3 for antibody 17512
TADLYRSSGWYSPDY

SEQ ID NO: 35025 - protein, 8 aa, Homo sapiens
  light chain complementarity determining region 3 for antibody 17513
QYYGSSPT

SEQ ID NO: 35026 - protein, 9 aa, Homo sapiens
  heavy chain complementarity determining region 3 for antibody 17513
ARGYDAFDF

SEQ ID NO: 35027 - protein, 9 aa, Homo sapiens
  light chain complementarity determining region 3 for antibody 17514
QQSNSVPRT

SEQ ID NO: 35028 - protein, 15 aa, Homo sapiens
  heavy chain complementarity determining region 3 for antibody 17514
ASMPYNSYRNPPFDN

SEQ ID NO: 35029 - protein, 9 aa, Homo sapiens
  light chain complementarity determining region 3 for antibody 17515
QQSLVSPST

SEQ ID NO: 35030 - protein, 15 aa, Homo sapiens
  heavy chain complementarity determining region 3 for antibody 17515
AREKKGSKAVRAFDI

SEQ ID NO: 35031 - protein, 10 aa, Homo sapiens
  light chain complementarity determining region 3 for antibody 17516
QQSHHWPPWT

SEQ ID NO: 35032 - protein, 18 aa, Homo sapiens
  heavy chain complementarity determining region 3 for antibody 17516
ARGVPPFWAPGGVGPFDF

SEQ ID NO: 35033 - protein, 10 aa, Homo sapiens
  light chain complementarity determining region 3 for antibody 17517
MQGTHWPPRT

SEQ ID NO: 35034 - protein, 11 aa, Homo sapiens
  heavy chain complementarity determining region 3 for antibody 17517
ARDDGTAGEDF

SEQ ID NO: 35035 - protein, 9 aa, Homo sapiens
  light chain complementarity determining region 3 for antibody 17518
MQGTHWPLE

SEQ ID NO: 35036 - protein, 18 aa, Homo sapiens
  heavy chain complementarity determining region 3 for antibody 17518
ARDERDTCTTDLCYYFDY

SEQ ID NO: 35037 - protein, 9 aa, Homo sapiens
  light chain complementarity determining region 3 for antibody 17519
MQDLETPFT

SEQ ID NO: 35038 - protein, 15 aa, Homo sapiens
  heavy chain complementarity determining region 3 for antibody 17519
VRHYRIITAPLEGDS

SEQ ID NO: 35039 - protein, 9 aa, Homo sapiens
  light chain complementarity determining region 3 for antibody 17520
LQHNSYPLT

SEQ ID NO: 35040 - protein, 18 aa, Homo sapiens
  heavy chain complementarity determining region 3 for antibody 17520
GRISVMTVGGKDYYGMDV

SEQ ID NO: 35041 - protein, 9 aa, Homo sapiens
  light chain complementarity determining region 3 for antibody 17521
LQHDDLPYT

SEQ ID NO: 35042 - protein, 8 aa, Homo sapiens
  heavy chain complementarity determining region 3 for antibody 17521
ADVGAHGF

SEQ ID NO: 35043 - protein, 9 aa, Homo sapiens
  light chain complementarity determining region 3 for antibody 17522
LQGNRFPHT

SEQ ID NO: 35044 - protein, 14 aa, Homo sapiens
  heavy chain complementarity determining region 3 for antibody 17522
ARYCGGNSCYSMDH

SEQ ID NO: 35045 - protein, 9 aa, Homo sapiens
  light chain complementarity determining region 3 for antibody 17523
HQSGGFPRT

SEQ ID NO: 35046 - protein, 11 aa, Homo sapiens
  heavy chain complementarity determining region 3 for antibody 17523
AREVYGGTFDS

SEQ ID NO: 35047 - protein, 9 aa, Homo sapiens
  light chain complementarity determining region 3 for antibody 17524
RQALETPFT

SEQ ID NO: 35048 - protein, 15 aa, Homo sapiens
  heavy chain complementarity determining region 3 for antibody 17524
VRHYRIITAPLEGDS

SEQ ID NO: 35049 - protein, 8 aa, Homo sapiens
  light chain complementarity determining region 3 for antibody 17525
QQYNSYWT

SEQ ID NO: 35050 - protein, 18 aa, Homo sapiens
  heavy chain complementarity determining region 3 for antibody 17525
AGSGYDYVWGSYQNAMDV

SEQ ID NO: 35051 - protein, 8 aa, Homo sapiens
  light chain complementarity determining region 3 for antibody 17526
QQYLTYWT

SEQ ID NO: 35052 - protein, 19 aa, Homo sapiens
  heavy chain complementarity determining region 3 for antibody 17526
AKEGLYYDIHDSKRGYFDS

SEQ ID NO: 35053 - protein, 9 aa, Homo sapiens
  light chain complementarity determining region 3 for antibody 17527
QQYGSSPRT

SEQ ID NO: 35054 - protein, 16 aa, Homo sapiens
  heavy chain complementarity determining region 3 for antibody 17527
ARESHSSGWYDWYFDY

SEQ ID NO: 35055 - protein, 8 aa, Homo sapiens
  light chain complementarity determining region 3 for antibody 17528
QQYGPSRT

SEQ ID NO: 35056 - protein, 15 aa, Homo sapiens
  heavy chain complementarity determining region 3 for antibody 17528
ARGEYYYDSSGYRED

SEQ ID NO: 35057 - protein, 11 aa, Homo sapiens
  light chain complementarity determining region 3 for antibody 17529
QQYDRSPPGYT

SEQ ID NO: 35058 - protein, 14 aa, Homo sapiens
  heavy chain complementarity determining region 3 for antibody 17529
ARDTHNSRKRSFDQ

SEQ ID NO: 35059 - protein, 9 aa, Homo sapiens
  light chain complementarity determining region 3 for antibody 17530
QQSYSIPFT

SEQ ID NO: 35060 - protein, 13 aa, Homo sapiens
  heavy chain complementarity determining region 3 for antibody 17530
ARSGYRGSDEFDY

SEQ ID NO: 35061 - protein, 9 aa, Homo sapiens
  light chain complementarity determining region 3 for antibody 17531
QQSYSFPWT

SEQ ID NO: 35062 - protein, 16 aa, Homo sapiens
  heavy chain complementarity determining region 3 for antibody 17531
ARDPGLGPTTVYGMDV

SEQ ID NO: 35063 - protein, 10 aa, Homo sapiens
  light chain complementarity determining region 3 for antibody 17532
QQSYSAPLFT

SEQ ID NO: 35064 - protein, 14 aa, Homo sapiens
  heavy chain complementarity determining region 3 for antibody 17532
ARVIIWGSNPKFDF

SEQ ID NO: 35065 - protein, 9 aa, Homo sapiens
  light chain complementarity determining region 3 for antibody 17533
QQSYNTPWT

SEQ ID NO: 35066 - protein, 14 aa, Homo sapiens
  heavy chain complementarity determining region 3 for antibody 17533
ARRALRGNWDVFDY

SEQ ID NO: 35067 - protein, 11 aa, Homo sapiens
  light chain complementarity determining region 3 for antibody 17534
QQRSNWPPRLT

SEQ ID NO: 35068 - protein, 17 aa, Homo sapiens
  heavy chain complementarity determining region 3 for antibody 17534
ARDGSLDPLYGSGSYGY

SEQ ID NO: 35069 - protein, 11 aa, Homo sapiens
  light chain complementarity determining region 3 for antibody 17535
QQRSNWPPIFT

SEQ ID NO: 35070 - protein, 18 aa, Homo sapiens
  heavy chain complementarity determining region 3 for antibody 17535
ARIPPYDSSGYYYYVLDY

SEQ ID NO: 35071 - protein, 9 aa, Homo sapiens
  light chain complementarity determining region 3 for antibody 17536
MQSTHWPYT

SEQ ID NO: 35072 - protein, 12 aa, Homo sapiens
  heavy chain complementarity determining region 3 for antibody 17536
ARDKSNHNPLVY

SEQ ID NO: 35073 - protein, 9 aa, Homo sapiens
  light chain complementarity determining region 3 for antibody 17537
MQSLQTPLA

SEQ ID NO: 35074 - protein, 18 aa, Homo sapiens
  heavy chain complementarity determining region 3 for antibody 17537
AIGYYGSGSYYTCYGFDP

SEQ ID NO: 35075 - protein, 11 aa, Homo sapiens
  light chain complementarity determining region 3 for antibody 17538
MQGTHLVPPFT

SEQ ID NO: 35076 - protein, 16 aa, Homo sapiens
  heavy chain complementarity determining region 3 for antibody 17538
ARENSILYNYYSGVDV

SEQ ID NO: 35077 - protein, 9 aa, Homo sapiens
  light chain complementarity determining region 3 for antibody 17539
MQALQTPWT

SEQ ID NO: 35078 - protein, 18 aa, Homo sapiens
  heavy chain complementarity determining region 3 for antibody 17539
AKSEDHLWFGELGDAFDV

SEQ ID NO: 35079 - protein, 9 aa, Homo sapiens
  light chain complementarity determining region 3 for antibody 17540
MQALDTPFT

SEQ ID NO: 35080 - protein, 15 aa, Homo sapiens
  heavy chain complementarity determining region 3 for antibody 17540
VRHYRETVAGIEGDS

SEQ ID NO: 35081 - protein, 9 aa, Homo sapiens
  light chain complementarity determining region 3 for antibody 17541
MHSINWPWT

SEQ ID NO: 35082 - protein, 7 aa, Homo sapiens
  heavy chain complementarity determining region 3 for antibody 17541
ATARGAD

SEQ ID NO: 35083 - protein, 9 aa, Homo sapiens
  light chain complementarity determining region 3 for antibody 17542
LQDYDYPRT

SEQ ID NO: 35084 - protein, 19 aa, Homo sapiens
  heavy chain complementarity determining region 3 for antibody 17542
ARDEEYYDGGSGYYDVFDV

SEQ ID NO: 35085 - protein, 9 aa, Homo sapiens
  light chain complementarity determining region 3 for antibody 17543
HQSSGLPHT

SEQ ID NO: 35086 - protein, 12 aa, Homo sapiens
  heavy chain complementarity determining region 3 for antibody 17543
SPHTWSNIVVDY

SEQ ID NO: 35087 - protein, 9 aa, Homo sapiens
  light chain complementarity determining region 3 for antibody 17544
QYYGASPYT

SEQ ID NO: 35088 - protein, 14 aa, Homo sapiens
  heavy chain complementarity determining region 3 for antibody 17544
ARVGVFASGQVFDL

SEQ ID NO: 35089 - protein, 9 aa, Homo sapiens
  light chain complementarity determining region 3 for antibody 17545
QQYKSWPRT

SEQ ID NO: 35090 - protein, 15 aa, Homo sapiens
  heavy chain complementarity determining region 3 for antibody 17545
ARWGSIYGGNSPIDQ

SEQ ID NO: 35091 - protein, 11 aa, Homo sapiens
  light chain complementarity determining region 3 for antibody 17546
QQYGTSPPKVT

SEQ ID NO: 35092 - protein, 11 aa, Homo sapiens
  heavy chain complementarity determining region 3 for antibody 17546
AKPSAGTTGDY

SEQ ID NO: 35093 - protein, 9 aa, Homo sapiens
  light chain complementarity determining region 3 for antibody 17547
QQYESSPWT

SEQ ID NO: 35094 - protein, 18 aa, Homo sapiens
  heavy chain complementarity determining region 3 for antibody 17547
ARQIDYGDYASYHGYCDV

SEQ ID NO: 35095 - protein, 9 aa, Homo sapiens
  light chain complementarity determining region 3 for antibody 17548
QQYDVSTLT

SEQ ID NO: 35096 - protein, 22 aa, Homo sapiens
  heavy chain complementarity determining region 3 for antibody 17548
ARGSRPYGIYAYPLIPYSFFDD

SEQ ID NO: 35097 - protein, 11 aa, Homo sapiens
  light chain complementarity determining region 3 for antibody 17549
QQYDTSPPGYP

SEQ ID NO: 35098 - protein, 14 aa, Homo sapiens
  heavy chain complementarity determining region 3 for antibody 17549
ARETSNSRKRSFDQ

SEQ ID NO: 35099 - protein, 9 aa, Homo sapiens
  light chain complementarity determining region 3 for antibody 17550
QQSYSTPYT

SEQ ID NO: 35100 - protein, 17 aa, Homo sapiens
  heavy chain complementarity determining region 3 for antibody 17550
AKGRRDAAMVRGLWFDP

SEQ ID NO: 35101 - protein, 9 aa, Homo sapiens
  light chain complementarity determining region 3 for antibody 17551
QQRSNWPRT

SEQ ID NO: 35102 - protein, 18 aa, Homo sapiens
  heavy chain complementarity determining region 3 for antibody 17551
ARDPVEWELTPLYYGMDV

SEQ ID NO: 35103 - protein, 11 aa, Homo sapiens
  light chain complementarity determining region 3 for antibody 17552
QQRGSWPPGLT

SEQ ID NO: 35104 - protein, 23 aa, Homo sapiens
  heavy chain complementarity determining region 3 for antibody 17552
AARNVSHDSSGYPLADYFYGMDV

SEQ ID NO: 35105 - protein, 9 aa, Homo sapiens
  light chain complementarity determining region 3 for antibody 17553
QQPHSFPLT

SEQ ID NO: 35106 - protein, 15 aa, Homo sapiens
  heavy chain complementarity determining region 3 for antibody 17553
AKDPSCDSIWNYFDY

SEQ ID NO: 35107 - protein, 9 aa, Homo sapiens
  light chain complementarity determining region 3 for antibody 17554
QQASGFPYT

SEQ ID NO: 35108 - protein, 19 aa, Homo sapiens
  heavy chain complementarity determining region 3 for antibody 17554
ARDDFGDYEGGTGINWFDP

SEQ ID NO: 35109 - protein, 9 aa, Homo sapiens
  light chain complementarity determining region 3 for antibody 17555
QHTHTFPRT

SEQ ID NO: 35110 - protein, 20 aa, Homo sapiens
  heavy chain complementarity determining region 3 for antibody 17555
GRGRRIAALSTAHYYYGMDV

SEQ ID NO: 35111 - protein, 11 aa, Homo sapiens
  light chain complementarity determining region 3 for antibody 17556
QELNSYPRSGT

SEQ ID NO: 35112 - protein, 24 aa, Homo sapiens
  heavy chain complementarity determining region 3 for antibody 17556
ARDRDGDYYGSGSLLYYYYYGMDV

SEQ ID NO: 35113 - protein, 9 aa, Homo sapiens
  light chain complementarity determining region 3 for antibody 17557
MQGLETPFT

SEQ ID NO: 35114 - protein, 15 aa, Homo sapiens
  heavy chain complementarity determining region 3 for antibody 17557
VRHYRETVAGIEGDS

SEQ ID NO: 35115 - protein, 9 aa, Homo sapiens
  light chain complementarity determining region 3 for antibody 17558
MQALEPPFT

SEQ ID NO: 35116 - protein, 15 aa, Homo sapiens
  heavy chain complementarity determining region 3 for antibody 17558
VRHYRETVAGIEGDS

SEQ ID NO: 35117 - protein, 9 aa, Homo sapiens
  light chain complementarity determining region 3 for antibody 17559
LQHNSYPLT

SEQ ID NO: 35118 - protein, 11 aa, Homo sapiens
  heavy chain complementarity determining region 3 for antibody 17559
ATSFEDNWFDN

SEQ ID NO: 35119 - protein, 9 aa, Homo sapiens
  light chain complementarity determining region 3 for antibody 17560
LQHNSYPLT

SEQ ID NO: 35120 - protein, 13 aa, Homo sapiens
  heavy chain complementarity determining region 3 for antibody 17560
ARHMVRGGMVVDD

SEQ ID NO: 35121 - protein, 9 aa, Homo sapiens
  light chain complementarity determining region 3 for antibody 17561
HQYGDTPRT

SEQ ID NO: 35122 - protein, 16 aa, Homo sapiens
  heavy chain complementarity determining region 3 for antibody 17561
AGLSASGHLAPNTFDV

SEQ ID NO: 35123 - protein, 8 aa, Homo sapiens
  light chain complementarity determining region 3 for antibody 17562
QQYSYWQT

SEQ ID NO: 35124 - protein, 13 aa, Homo sapiens
  heavy chain complementarity determining region 3 for antibody 17562
ARANDYGDYYLEY

SEQ ID NO: 35125 - protein, 9 aa, Homo sapiens
  light chain complementarity determining region 3 for antibody 17563
QQYNSYPWT

SEQ ID NO: 35126 - protein, 13 aa, Homo sapiens
  heavy chain complementarity determining region 3 for antibody 17563
ARGHGNKYGLFDY

SEQ ID NO: 35127 - protein, 9 aa, Homo sapiens
  light chain complementarity determining region 3 for antibody 17564
QQYGSSPLT

SEQ ID NO: 35128 - protein, 20 aa, Homo sapiens
  heavy chain complementarity determining region 3 for antibody 17564
ARGDFLITSYSGTRKDALDI

SEQ ID NO: 35129 - protein, 9 aa, Homo sapiens
  light chain complementarity determining region 3 for antibody 17565
QQVHIYPPT

SEQ ID NO: 35130 - protein, 12 aa, Homo sapiens
  heavy chain complementarity determining region 3 for antibody 17565
ARDTDGSFGLDV

SEQ ID NO: 35131 - protein, 9 aa, Homo sapiens
  light chain complementarity determining region 3 for antibody 17566
QQTSTYPWT

SEQ ID NO: 35132 - protein, 19 aa, Homo sapiens
  heavy chain complementarity determining region 3 for antibody 17566
ARVQFQMTTRTTRAPYFDY

SEQ ID NO: 35133 - protein, 9 aa, Homo sapiens
  light chain complementarity determining region 3 for antibody 17567
QQSYSTPWT

SEQ ID NO: 35134 - protein, 15 aa, Homo sapiens
  heavy chain complementarity determining region 3 for antibody 17567
ASRYSSGWYYYGMDV

SEQ ID NO: 35135 - protein, 9 aa, Homo sapiens
  light chain complementarity determining region 3 for antibody 17568
QQSYSDPPT

SEQ ID NO: 35136 - protein, 16 aa, Homo sapiens
  heavy chain complementarity determining region 3 for antibody 17568
ARHLQIHSTSSGVFGI

SEQ ID NO: 35137 - protein, 9 aa, Homo sapiens
  light chain complementarity determining region 3 for antibody 17569
QQFASYPIT

SEQ ID NO: 35138 - protein, 13 aa, Homo sapiens
  heavy chain complementarity determining region 3 for antibody 17569
TSRSLSAGAPIDF

SEQ ID NO: 35139 - protein, 9 aa, Homo sapiens
  light chain complementarity determining region 3 for antibody 17570
QKYNSAPIT

SEQ ID NO: 35140 - protein, 19 aa, Homo sapiens
  heavy chain complementarity determining region 3 for antibody 17570
ASLLHLRGSLDYLLPYFDY

SEQ ID NO: 35141 - protein, 9 aa, Homo sapiens
  light chain complementarity determining region 3 for antibody 17571
QHYDSAVQT

SEQ ID NO: 35142 - protein, 19 aa, Homo sapiens
  heavy chain complementarity determining region 3 for antibody 17571
AKEAAAFCGDYCRGSHCDF

SEQ ID NO: 35143 - protein, 9 aa, Homo sapiens
  light chain complementarity determining region 3 for antibody 17572
QHYDNLLFT

SEQ ID NO: 35144 - protein, 23 aa, Homo sapiens
  heavy chain complementarity determining region 3 for antibody 17572
ARTSRTYSSGWYAKTFYYYVMDV

SEQ ID NO: 35145 - protein, 9 aa, Homo sapiens
  light chain complementarity determining region 3 for antibody 17573
MPALETPFT

SEQ ID NO: 35146 - protein, 15 aa, Homo sapiens
  heavy chain complementarity determining region 3 for antibody 17573
VRHYRETVAGIEGDS

SEQ ID NO: 35147 - protein, 9 aa, Homo sapiens
  light chain complementarity determining region 3 for antibody 17574
LQHNTYPRT

SEQ ID NO: 35148 - protein, 19 aa, Homo sapiens
  heavy chain complementarity determining region 3 for antibody 17574
AREPYSSGYPYYYYYGVDV

SEQ ID NO: 35149 - protein, 9 aa, Homo sapiens
  light chain complementarity determining region 3 for antibody 17575
QQYYSTPGT

SEQ ID NO: 35150 - protein, 15 aa, Homo sapiens
  heavy chain complementarity determining region 3 for antibody 17575
ARGSESSGFYWYFDL

SEQ ID NO: 35151 - protein, 9 aa, Homo sapiens
  light chain complementarity determining region 3 for antibody 17576
QQYYNNPPV

SEQ ID NO: 35152 - protein, 15 aa, Homo sapiens
  heavy chain complementarity determining region 3 for antibody 17576
ARAGRCGGDCFSLDY

SEQ ID NO: 35153 - protein, 10 aa, Homo sapiens
  light chain complementarity determining region 3 for antibody 17577
QQYNNWPPYT

SEQ ID NO: 35154 - protein, 19 aa, Homo sapiens
  heavy chain complementarity determining region 3 for antibody 17577
ARDTYYYGSGSYLYYGMDV

SEQ ID NO: 35155 - protein, 9 aa, Homo sapiens
  light chain complementarity determining region 3 for antibody 17578
QQYNNFSGT

SEQ ID NO: 35156 - protein, 15 aa, Homo sapiens
  heavy chain complementarity determining region 3 for antibody 17578
ARGGYTFGGIVVLDK

SEQ ID NO: 35157 - protein, 9 aa, Homo sapiens
  light chain complementarity determining region 3 for antibody 17579
QQYGNLPRT

SEQ ID NO: 35158 - protein, 13 aa, Homo sapiens
  heavy chain complementarity determining region 3 for antibody 17579
AGGDFHSGGYSDF

SEQ ID NO: 35159 - protein, 9 aa, Homo sapiens
  light chain complementarity determining region 3 for antibody 17580
QQYGISPRT

SEQ ID NO: 35160 - protein, 9 aa, Homo sapiens
  heavy chain complementarity determining region 3 for antibody 17580
VREYSAFDI

SEQ ID NO: 35161 - protein, 9 aa, Homo sapiens
  light chain complementarity determining region 3 for antibody 17581
QQTYTFPQT

SEQ ID NO: 35162 - protein, 24 aa, Homo sapiens
  heavy chain complementarity determining region 3 for antibody 17581
ARGSLEYYYDGSGYYYATGDAYDI

SEQ ID NO: 35163 - protein, 9 aa, Homo sapiens
  light chain complementarity determining region 3 for antibody 17582
QQSYITSIT

SEQ ID NO: 35164 - protein, 16 aa, Homo sapiens
  heavy chain complementarity determining region 3 for antibody 17582
ARVSTSGWNTNYGLDV

SEQ ID NO: 35165 - protein, 9 aa, Homo sapiens
  light chain complementarity determining region 3 for antibody 17583
QKYVSTPRP

SEQ ID NO: 35166 - protein, 18 aa, Homo sapiens
  heavy chain complementarity determining region 3 for antibody 17583
AHERWEKNRSYKYYGMDL

SEQ ID NO: 35167 - protein, 9 aa, Homo sapiens
  light chain complementarity determining region 3 for antibody 17584
MQGTQWPWT

SEQ ID NO: 35168 - protein, 15 aa, Homo sapiens
  heavy chain complementarity determining region 3 for antibody 17584
VRFPPDLDIVGMIDH

SEQ ID NO: 35169 - protein, 9 aa, Homo sapiens
  light chain complementarity determining region 3 for antibody 17585
LQDFGYPRT

SEQ ID NO: 35170 - protein, 18 aa, Homo sapiens
  heavy chain complementarity determining region 3 for antibody 17585
TRDLSPSYDRLYYDAFDI

SEQ ID NO: 35171 - protein, 10 aa, Homo sapiens
  light chain complementarity determining region 3 for antibody 17586
HQYGRSAPWT

SEQ ID NO: 35172 - protein, 11 aa, Homo sapiens
  heavy chain complementarity determining region 3 for antibody 17586
VKDRGAVMGDY

SEQ ID NO: 35173 - protein, 9 aa, Homo sapiens
  light chain complementarity determining region 3 for antibody 17587
QQYYTYPLT

SEQ ID NO: 35174 - protein, 15 aa, Homo sapiens
  heavy chain complementarity determining region 3 for antibody 17587
AHGVWVRGVTSRFDY

SEQ ID NO: 35175 - protein, 9 aa, Homo sapiens
  light chain complementarity determining region 3 for antibody 17588
QQYGRSPWT

SEQ ID NO: 35176 - protein, 13 aa, Homo sapiens
  heavy chain complementarity determining region 3 for antibody 17588
ARDSVDYGDPLDL

SEQ ID NO: 35177 - protein, 9 aa, Homo sapiens
  light chain complementarity determining region 3 for antibody 17589
QQYDNWPWT

SEQ ID NO: 35178 - protein, 13 aa, Homo sapiens
  heavy chain complementarity determining region 3 for antibody 17589
ASGGVFYHNFFDT

SEQ ID NO: 35179 - protein, 9 aa, Homo sapiens
  light chain complementarity determining region 3 for antibody 17590
QQTYSALWT

SEQ ID NO: 35180 - protein, 14 aa, Homo sapiens
  heavy chain complementarity determining region 3 for antibody 17590
ARVIPDVGRPYFDH

SEQ ID NO: 35181 - protein, 8 aa, Homo sapiens
  light chain complementarity determining region 3 for antibody 17591
QQRSDGYT

SEQ ID NO: 35182 - protein, 13 aa, Homo sapiens
  heavy chain complementarity determining region 3 for antibody 17591
ATNSGSYPNYLDP

SEQ ID NO: 35183 - protein, 11 aa, Homo sapiens
  light chain complementarity determining region 3 for antibody 17592
QQLNSYPRAIT

SEQ ID NO: 35184 - protein, 13 aa, Homo sapiens
  heavy chain complementarity determining region 3 for antibody 17592
ARVVRGYSGHFDY

SEQ ID NO: 35185 - protein, 9 aa, Homo sapiens
  light chain complementarity determining region 3 for antibody 17593
QQGYSSPFT

SEQ ID NO: 35186 - protein, 15 aa, Homo sapiens
  heavy chain complementarity determining region 3 for antibody 17593
VKAQVIWGQLYYFES

SEQ ID NO: 35187 - protein, 9 aa, Homo sapiens
  light chain complementarity determining region 3 for antibody 17594
QKYYSALLT

SEQ ID NO: 35188 - protein, 17 aa, Homo sapiens
  heavy chain complementarity determining region 3 for antibody 17594
ARDRHYYGSGNYYPFDY

SEQ ID NO: 35189 - protein, 9 aa, Homo sapiens
  light chain complementarity determining region 3 for antibody 17595
MQGLETPFT

SEQ ID NO: 35190 - protein, 15 aa, Homo sapiens
  heavy chain complementarity determining region 3 for antibody 17595
VRHYRIITAPLEGDS

SEQ ID NO: 35191 - protein, 9 aa, Homo sapiens
  light chain complementarity determining region 3 for antibody 17596
MQAVQTPRT

SEQ ID NO: 35192 - protein, 14 aa, Homo sapiens
  heavy chain complementarity determining region 3 for antibody 17596
ARGHRGGKYKGIDA

SEQ ID NO: 35193 - protein, 9 aa, Homo sapiens
  light chain complementarity determining region 3 for antibody 17597
HQYGSSSRT

SEQ ID NO: 35194 - protein, 17 aa, Homo sapiens
  heavy chain complementarity determining region 3 for antibody 17597
TTDTQRLLPPPFVTNDY

SEQ ID NO: 35195 - protein, 9 aa, Homo sapiens
  light chain complementarity determining region 3 for antibody 17598
HQRSNWPPL

SEQ ID NO: 35196 - protein, 12 aa, Homo sapiens
  heavy chain complementarity determining region 3 for antibody 17598
ARSLKRWGNFDY

SEQ ID NO: 35197 - protein, 9 aa, Homo sapiens
  light chain complementarity determining region 3 for antibody 17599
QQYYGTPPT

SEQ ID NO: 35198 - protein, 11 aa, Homo sapiens
  heavy chain complementarity determining region 3 for antibody 17599
ARSTSAYYSEY

SEQ ID NO: 35199 - protein, 9 aa, Homo sapiens
  light chain complementarity determining region 3 for antibody 17600
QQYNNWPET

SEQ ID NO: 35200 - protein, 16 aa, Homo sapiens
  heavy chain complementarity determining region 3 for antibody 17600
ARELGRYSYGHDAFDI

SEQ ID NO: 35201 - protein, 9 aa, Homo sapiens
  light chain complementarity determining region 3 for antibody 17601
QQYDNVQST

SEQ ID NO: 35202 - protein, 17 aa, Homo sapiens
  heavy chain complementarity determining region 3 for antibody 17601
AKERFIRWLRLGGVFDS

SEQ ID NO: 35203 - protein, 9 aa, Homo sapiens
  light chain complementarity determining region 3 for antibody 17602
QQYDNLPYT

SEQ ID NO: 35204 - protein, 16 aa, Homo sapiens
  heavy chain complementarity determining region 3 for antibody 17602
ARSSGGYSSSWYYFDY

SEQ ID NO: 35205 - protein, 9 aa, Homo sapiens
  light chain complementarity determining region 3 for antibody 17603
QQRSNWPRT

SEQ ID NO: 35206 - protein, 17 aa, Homo sapiens
  heavy chain complementarity determining region 3 for antibody 17603
ARDYNYESGGSSGAFDI

SEQ ID NO: 35207 - protein, 9 aa, Homo sapiens
  light chain complementarity determining region 3 for antibody 17604
QQLNSYPWT

SEQ ID NO: 35208 - protein, 14 aa, Homo sapiens
  heavy chain complementarity determining region 3 for antibody 17604
ARVEGAPVPDAFDI

SEQ ID NO: 35209 - protein, 9 aa, Homo sapiens
  light chain complementarity determining region 3 for antibody 17605
QQANSLPHT

SEQ ID NO: 35210 - protein, 16 aa, Homo sapiens
  heavy chain complementarity determining region 3 for antibody 17605
ARDPGSSSSGWYYFDY

SEQ ID NO: 35211 - protein, 9 aa, Homo sapiens
  light chain complementarity determining region 3 for antibody 17606
QQAKSSPLS

SEQ ID NO: 35212 - protein, 16 aa, Homo sapiens
  heavy chain complementarity determining region 3 for antibody 17606
ARALVVPATAWSWFDP

SEQ ID NO: 35213 - protein, 9 aa, Homo sapiens
  light chain complementarity determining region 3 for antibody 17607
QHSHSRPFT

SEQ ID NO: 35214 - protein, 20 aa, Homo sapiens
  heavy chain complementarity determining region 3 for antibody 17607
AKGIAVAALRTVYYYYGMDV

SEQ ID NO: 35215 - protein, 9 aa, Homo sapiens
  light chain complementarity determining region 3 for antibody 17608
MQPLQFPIT

SEQ ID NO: 35216 - protein, 12 aa, Homo sapiens
  heavy chain complementarity determining region 3 for antibody 17608
VKMGDSPRLFDQ

SEQ ID NO: 35217 - protein, 11 aa, Homo sapiens
  light chain complementarity determining region 3 for antibody 17609
MQGTHWPPMYT

SEQ ID NO: 35218 - protein, 17 aa, Homo sapiens
  heavy chain complementarity determining region 3 for antibody 17609
ARGGSGYYQEGDDTFGF

SEQ ID NO: 35219 - protein, 9 aa, Homo sapiens
  light chain complementarity determining region 3 for antibody 17610
MQALQTPLT

SEQ ID NO: 35220 - protein, 12 aa, Homo sapiens
  heavy chain complementarity determining region 3 for antibody 17610
AKSTYGDYLHDS

SEQ ID NO: 35221 - protein, 9 aa, Homo sapiens
  light chain complementarity determining region 3 for antibody 17611
MQALETPFT

SEQ ID NO: 35222 - protein, 15 aa, Homo sapiens
  heavy chain complementarity determining region 3 for antibody 17611
IRHYRITVAGIEGDS

SEQ ID NO: 35223 - protein, 9 aa, Homo sapiens
  light chain complementarity determining region 3 for antibody 17612
LQGNSFPHT

SEQ ID NO: 35224 - protein, 14 aa, Homo sapiens
  heavy chain complementarity determining region 3 for antibody 17612
ARYCSGNSCYSMDH

SEQ ID NO: 35225 - protein, 9 aa, Homo sapiens
  light chain complementarity determining region 3 for antibody 17613
QQYNSLPFT

SEQ ID NO: 35226 - protein, 18 aa, Homo sapiens
  heavy chain complementarity determining region 3 for antibody 17613
ARDLGGCSDDGCYSRFDY

SEQ ID NO: 35227 - protein, 9 aa, Homo sapiens
  light chain complementarity determining region 3 for antibody 17614
QQYGSSRVT

SEQ ID NO: 35228 - protein, 17 aa, Homo sapiens
  heavy chain complementarity determining region 3 for antibody 17614
AKPPLPWVGELSSAFDM

SEQ ID NO: 35229 - protein, 10 aa, Homo sapiens
  light chain complementarity determining region 3 for antibody 17615
QQYGSSLGIT

SEQ ID NO: 35230 - protein, 18 aa, Homo sapiens
  heavy chain complementarity determining region 3 for antibody 17615
AKDWGTGWYGRRPYYFDY

SEQ ID NO: 35231 - protein, 9 aa, Homo sapiens
  light chain complementarity determining region 3 for antibody 17616
QQYGRSPFT

SEQ ID NO: 35232 - protein, 19 aa, Homo sapiens
  heavy chain complementarity determining region 3 for antibody 17616
ARDGPRGRVTGVTWKPLDY

SEQ ID NO: 35233 - protein, 10 aa, Homo sapiens
  light chain complementarity determining region 3 for antibody 17617
QQYGDPPLYT

SEQ ID NO: 35234 - protein, 10 aa, Homo sapiens
  heavy chain complementarity determining region 3 for antibody 17617
VRAGYYCLDY

SEQ ID NO: 35235 - protein, 10 aa, Homo sapiens
  light chain complementarity determining region 3 for antibody 17618
QQSYTTPIFT

SEQ ID NO: 35236 - protein, 17 aa, Homo sapiens
  heavy chain complementarity determining region 3 for antibody 17618
AVYTSTDGIFNKDAFDI

SEQ ID NO: 35237 - protein, 10 aa, Homo sapiens
  light chain complementarity determining region 3 for antibody 17619
QQSYFTPPLT

SEQ ID NO: 35238 - protein, 20 aa, Homo sapiens
  heavy chain complementarity determining region 3 for antibody 17619
ARNTGTSSWSPLSYYYGMDV

SEQ ID NO: 35239 - protein, 9 aa, Homo sapiens
  light chain complementarity determining region 3 for antibody 17620
QQGYSRLPT

SEQ ID NO: 35240 - protein, 18 aa, Homo sapiens
  heavy chain complementarity determining region 3 for antibody 17620
ARGYGSGSYFNYYYGMDV

SEQ ID NO: 35241 - protein, 9 aa, Homo sapiens
  light chain complementarity determining region 3 for antibody 17621
QQFDNSGYT

SEQ ID NO: 35242 - protein, 13 aa, Homo sapiens
  heavy chain complementarity determining region 3 for antibody 17621
VRERHPGAFYFDF

SEQ ID NO: 35243 - protein, 9 aa, Homo sapiens
  light chain complementarity determining region 3 for antibody 17622
QKYNSAPWP

SEQ ID NO: 35244 - protein, 14 aa, Homo sapiens
  heavy chain complementarity determining region 3 for antibody 17622
ARARGPASDWYFDY

SEQ ID NO: 35245 - protein, 9 aa, Homo sapiens
  light chain complementarity determining region 3 for antibody 17623
QHTHTFPRT

SEQ ID NO: 35246 - protein, 20 aa, Homo sapiens
  heavy chain complementarity determining region 3 for antibody 17623
ARGRRIAALSTAHYYYGMDV

SEQ ID NO: 35247 - protein, 9 aa, Homo sapiens
  light chain complementarity determining region 3 for antibody 17624
MQSRRWPHT

SEQ ID NO: 35248 - protein, 8 aa, Homo sapiens
  heavy chain complementarity determining region 3 for antibody 17624
TAWGSSHH

SEQ ID NO: 35249 - protein, 9 aa, Homo sapiens
  light chain complementarity determining region 3 for antibody 17625
MQALETPFT

SEQ ID NO: 35250 - protein, 15 aa, Homo sapiens
  heavy chain complementarity determining region 3 for antibody 17625
IRHYRITVAAIEGDS

SEQ ID NO: 35251 - protein, 9 aa, Homo sapiens
  light chain complementarity determining region 3 for antibody 17626
LQGTHWPPT

SEQ ID NO: 35252 - protein, 12 aa, Homo sapiens
  heavy chain complementarity determining region 3 for antibody 17626
ATDYGPVVTLAH

SEQ ID NO: 35253 - protein, 9 aa, Homo sapiens
  light chain complementarity determining region 3 for antibody 17627
HQYGESPRM

SEQ ID NO: 35254 - protein, 16 aa, Homo sapiens
  heavy chain complementarity determining region 3 for antibody 17627
AKSLGVDAMTTRVYDS

SEQ ID NO: 35255 - protein, 9 aa, Homo sapiens
  light chain complementarity determining region 3 for antibody 17628
HQSYSTPRT

SEQ ID NO: 35256 - protein, 11 aa, Homo sapiens
  heavy chain complementarity determining region 3 for antibody 17628
ARARSSGGFDI

SEQ ID NO: 35257 - protein, 9 aa, Homo sapiens
  light chain complementarity determining region 3 for antibody 17629
HQRGALPWT

SEQ ID NO: 35258 - protein, 14 aa, Homo sapiens
  heavy chain complementarity determining region 3 for antibody 17629
VRDASGNSGWYADS

SEQ ID NO: 35259 - protein, 9 aa, Homo sapiens
  light chain complementarity determining region 3 for antibody 17630
QQYSSYPWT

SEQ ID NO: 35260 - protein, 17 aa, Homo sapiens
  heavy chain complementarity determining region 3 for antibody 17630
VKGTNPVLDWISIPFDY

SEQ ID NO: 35261 - protein, 9 aa, Homo sapiens
  light chain complementarity determining region 3 for antibody 17631
QQYSGSPRT

SEQ ID NO: 35262 - protein, 14 aa, Homo sapiens
  heavy chain complementarity determining region 3 for antibody 17631
ATGWYDTSGHYLEY

SEQ ID NO: 35263 - protein, 9 aa, Homo sapiens
  light chain complementarity determining region 3 for antibody 17632
QQYNSYPWT

SEQ ID NO: 35264 - protein, 20 aa, Homo sapiens
  heavy chain complementarity determining region 3 for antibody 17632
ARVKHYHDSSDYYYYYGVDV

SEQ ID NO: 35265 - protein, 9 aa, Homo sapiens
  light chain complementarity determining region 3 for antibody 17633
QQYNSYPLT

SEQ ID NO: 35266 - protein, 15 aa, Homo sapiens
  heavy chain complementarity determining region 3 for antibody 17633
VRHYRITVAAVEGDS

SEQ ID NO: 35267 - protein, 10 aa, Homo sapiens
  light chain complementarity determining region 3 for antibody 17634
QQYNNWPPIT

SEQ ID NO: 35268 - protein, 16 aa, Homo sapiens
  heavy chain complementarity determining region 3 for antibody 17634
ARAGSSGWNKAGGYDI

SEQ ID NO: 35269 - protein, 9 aa, Homo sapiens
  light chain complementarity determining region 3 for antibody 17635
QQYHSTPPT

SEQ ID NO: 35270 - protein, 20 aa, Homo sapiens
  heavy chain complementarity determining region 3 for antibody 17635
ARARSKTTVVTPTRQFASDI

SEQ ID NO: 35271 - protein, 9 aa, Homo sapiens
  light chain complementarity determining region 3 for antibody 17636
QQYHSDPLT

SEQ ID NO: 35272 - protein, 10 aa, Homo sapiens
  heavy chain complementarity determining region 3 for antibody 17636
AGGTGWILDT

SEQ ID NO: 35273 - protein, 8 aa, Homo sapiens
  light chain complementarity determining region 3 for antibody 17637
QQYGTSRT

SEQ ID NO: 35274 - protein, 15 aa, Homo sapiens
  heavy chain complementarity determining region 3 for antibody 17637
ARGEFYRDSRGYRED

SEQ ID NO: 35275 - protein, 8 aa, Homo sapiens
  light chain complementarity determining region 3 for antibody 17638
QQYGPSRT

SEQ ID NO: 35276 - protein, 15 aa, Homo sapiens
  heavy chain complementarity determining region 3 for antibody 17638
ARGEFYYDGSGYRED

SEQ ID NO: 35277 - protein, 9 aa, Homo sapiens
  light chain complementarity determining region 3 for antibody 17639
QQYDSSPYT

SEQ ID NO: 35278 - protein, 19 aa, Homo sapiens
  heavy chain complementarity determining region 3 for antibody 17639
ARHYGIVSAAPKALNWFDP

SEQ ID NO: 35279 - protein, 9 aa, Homo sapiens
  light chain complementarity determining region 3 for antibody 17640
QQYDSFPWT

SEQ ID NO: 35280 - protein, 26 aa, Homo sapiens
  heavy chain complementarity determining region 3 for antibody 17640
ARDKNDLYTSVLRGTLFTNYYYGMNV

SEQ ID NO: 35281 - protein, 9 aa, Homo sapiens
  light chain complementarity determining region 3 for antibody 17641
QQYDDLPYS

SEQ ID NO: 35282 - protein, 16 aa, Homo sapiens
  heavy chain complementarity determining region 3 for antibody 17641
ARDLARWNPVTGAFDI

SEQ ID NO: 35283 - protein, 10 aa, Homo sapiens
  light chain complementarity determining region 3 for antibody 17642
QQYAHLLPLT

SEQ ID NO: 35284 - protein, 11 aa, Homo sapiens
  heavy chain complementarity determining region 3 for antibody 17642
ARVRMGGGFDY

SEQ ID NO: 35285 - protein, 9 aa, Homo sapiens
  light chain complementarity determining region 3 for antibody 17643
QQTYSPPFT

SEQ ID NO: 35286 - protein, 14 aa, Homo sapiens
  heavy chain complementarity determining region 3 for antibody 17643
ARGRDTSGYSGLDY

SEQ ID NO: 35287 - protein, 9 aa, Homo sapiens
  light chain complementarity determining region 3 for antibody 17644
QQSYNTPRT

SEQ ID NO: 35288 - protein, 24 aa, Homo sapiens
  heavy chain complementarity determining region 3 for antibody 17644
ARESVVHSDIWRSPAPRYYYAMDV

SEQ ID NO: 35289 - protein, 10 aa, Homo sapiens
  light chain complementarity determining region 3 for antibody 17645
QQRYNWPPFP

SEQ ID NO: 35290 - protein, 11 aa, Homo sapiens
  heavy chain complementarity determining region 3 for antibody 17645
ARGVGSYPFDS

SEQ ID NO: 35291 - protein, 10 aa, Homo sapiens
  light chain complementarity determining region 3 for antibody 17646
QQRSKWPPLP

SEQ ID NO: 35292 - protein, 9 aa, Homo sapiens
  heavy chain complementarity determining region 3 for antibody 17646
ARVDGYFDY

SEQ ID NO: 35293 - protein, 9 aa, Homo sapiens
  light chain complementarity determining region 3 for antibody 17647
QQHHDWPQT

SEQ ID NO: 35294 - protein, 23 aa, Homo sapiens
  heavy chain complementarity determining region 3 for antibody 17647
ALQINKDLGLIRGVTQWTTYFDY

SEQ ID NO: 35295 - protein, 9 aa, Homo sapiens
  light chain complementarity determining region 3 for antibody 17648
QQGFSTPLT

SEQ ID NO: 35296 - protein, 21 aa, Homo sapiens
  heavy chain complementarity determining region 3 for antibody 17648
TREEGDIVAVASATYPHGMDV

SEQ ID NO: 35297 - protein, 10 aa, Homo sapiens
  light chain complementarity determining region 3 for antibody 17649
QLRSNWPRIT

SEQ ID NO: 35298 - protein, 21 aa, Homo sapiens
  heavy chain complementarity determining region 3 for antibody 17649
AHSPFSTIFGVVVKGSTYFDQ

SEQ ID NO: 35299 - protein, 9 aa, Homo sapiens
  light chain complementarity determining region 3 for antibody 17650
QHSHSRPFT

SEQ ID NO: 35300 - protein, 20 aa, Homo sapiens
  heavy chain complementarity determining region 3 for antibody 17650
AKGVSVAALRTVYYYYGLDV

SEQ ID NO: 35301 - protein, 9 aa, Homo sapiens
  light chain complementarity determining region 3 for antibody 17651
MQALETPFT

SEQ ID NO: 35302 - protein, 14 aa, Homo sapiens
  heavy chain complementarity determining region 3 for antibody 17651
VKDHLMNTVTTAGY

SEQ ID NO: 35303 - protein, 10 aa, Homo sapiens
  light chain complementarity determining region 3 for antibody 17652
LQHNSYPSLT

SEQ ID NO: 35304 - protein, 15 aa, Homo sapiens
  heavy chain complementarity determining region 3 for antibody 17652
VFSGAAVGRFFVGDY

SEQ ID NO: 35305 - protein, 10 aa, Homo sapiens
  light chain complementarity determining region 3 for antibody 17653
QRYGGSPLYT

SEQ ID NO: 35306 - protein, 11 aa, Homo sapiens
  heavy chain complementarity determining region 3 for antibody 17653
ARKGGLHYFDD

SEQ ID NO: 35307 - protein, 9 aa, Homo sapiens
  light chain complementarity determining region 3 for antibody 17654
QQYYDFPHT

SEQ ID NO: 35308 - protein, 18 aa, Homo sapiens
  heavy chain complementarity determining region 3 for antibody 17654
ARAPNYYGSGRRPFYFDY

SEQ ID NO: 35309 - protein, 9 aa, Homo sapiens
  light chain complementarity determining region 3 for antibody 17655
QQYGSSPRT

SEQ ID NO: 35310 - protein, 17 aa, Homo sapiens
  heavy chain complementarity determining region 3 for antibody 17655
ARVRSFYYDTSGHYYLF

SEQ ID NO: 35311 - protein, 9 aa, Homo sapiens
  light chain complementarity determining region 3 for antibody 17656
QQYGNSPWT

SEQ ID NO: 35312 - protein, 16 aa, Homo sapiens
  heavy chain complementarity determining region 3 for antibody 17656
AKFRRERYWALETFDH

SEQ ID NO: 35313 - protein, 9 aa, Homo sapiens
  light chain complementarity determining region 3 for antibody 17657
QQSYSTPPT

SEQ ID NO: 35314 - protein, 16 aa, Homo sapiens
  heavy chain complementarity determining region 3 for antibody 17657
AGISQFWSGFTSGMDV

SEQ ID NO: 35315 - protein, 9 aa, Homo sapiens
  light chain complementarity determining region 3 for antibody 17658
QQHAAYPLT

SEQ ID NO: 35316 - protein, 18 aa, Homo sapiens
  heavy chain complementarity determining region 3 for antibody 17658
TRDDGWFGKLTYGTSMDV

SEQ ID NO: 35317 - protein, 9 aa, Homo sapiens
  light chain complementarity determining region 3 for antibody 17659
QQFYGSPWT

SEQ ID NO: 35318 - protein, 16 aa, Homo sapiens
  heavy chain complementarity determining region 3 for antibody 17659
IRQDYYDTSGFSYPAT

SEQ ID NO: 35319 - protein, 9 aa, Homo sapiens
  light chain complementarity determining region 3 for antibody 17660
QQCNSYSRT

SEQ ID NO: 35320 - protein, 11 aa, Homo sapiens
  heavy chain complementarity determining region 3 for antibody 17660
ARNILGGHTDF

SEQ ID NO: 35321 - protein, 9 aa, Homo sapiens
  light chain complementarity determining region 3 for antibody 17661
MQSVLLPQT

SEQ ID NO: 35322 - protein, 10 aa, Homo sapiens
  heavy chain complementarity determining region 3 for antibody 17661
AREVRHYFET

SEQ ID NO: 35323 - protein, 9 aa, Homo sapiens
  light chain complementarity determining region 3 for antibody 17662
MQGTHWPAN

SEQ ID NO: 35324 - protein, 14 aa, Homo sapiens
  heavy chain complementarity determining region 3 for antibody 17662
AKSPLKTGVTDFDY

SEQ ID NO: 35325 - protein, 9 aa, Homo sapiens
  light chain complementarity determining region 3 for antibody 17663
MQALSSPPT

SEQ ID NO: 35326 - protein, 12 aa, Homo sapiens
  heavy chain complementarity determining region 3 for antibody 17663
AKDLVGGARGGS

SEQ ID NO: 35327 - protein, 9 aa, Homo sapiens
  light chain complementarity determining region 3 for antibody 17664
MQALGTPFT

SEQ ID NO: 35328 - protein, 15 aa, Homo sapiens
  heavy chain complementarity determining region 3 for antibody 17664
VRHYRIITAPLEGDS

SEQ ID NO: 35329 - protein, 9 aa, Homo sapiens
  light chain complementarity determining region 3 for antibody 17665
LQGTLWPWT

SEQ ID NO: 35330 - protein, 12 aa, Homo sapiens
  heavy chain complementarity determining region 3 for antibody 17665
VTGDSARHYFGF

SEQ ID NO: 35331 - protein, 9 aa, Homo sapiens
  light chain complementarity determining region 3 for antibody 17666
HQSGALPWT

SEQ ID NO: 35332 - protein, 10 aa, Homo sapiens
  heavy chain complementarity determining region 3 for antibody 17666
ARDFGGPFDY

SEQ ID NO: 35333 - protein, 9 aa, Homo sapiens
  light chain complementarity determining region 3 for antibody 17667
QQYNSYPYT

SEQ ID NO: 35334 - protein, 12 aa, Homo sapiens
  heavy chain complementarity determining region 3 for antibody 17667
AREGLRFHPFDV

SEQ ID NO: 35335 - protein, 11 aa, Homo sapiens
  light chain complementarity determining region 3 for antibody 17668
QQYNNWPPRRT

SEQ ID NO: 35336 - protein, 16 aa, Homo sapiens
  heavy chain complementarity determining region 3 for antibody 17668
AKEAAGTVTYFGYFDY

SEQ ID NO: 35337 - protein, 9 aa, Homo sapiens
  light chain complementarity determining region 3 for antibody 17669
QQYGTSPWT

SEQ ID NO: 35338 - protein, 13 aa, Homo sapiens
  heavy chain complementarity determining region 3 for antibody 17669
ARAQSWSGRLFDY

SEQ ID NO: 35339 - protein, 8 aa, Homo sapiens
  light chain complementarity determining region 3 for antibody 17670
QQYGGSLT

SEQ ID NO: 35340 - protein, 13 aa, Homo sapiens
  heavy chain complementarity determining region 3 for antibody 17670
AKDKGAWIQLFDY

SEQ ID NO: 35341 - protein, 8 aa, Homo sapiens
  light chain complementarity determining region 3 for antibody 17671
QQYENLIT

SEQ ID NO: 35342 - protein, 18 aa, Homo sapiens
  heavy chain complementarity determining region 3 for antibody 17671
AKGAEGSCSVRKCYPFDY

SEQ ID NO: 35343 - protein, 8 aa, Homo sapiens
  light chain complementarity determining region 3 for antibody 17672
QQYDSYST

SEQ ID NO: 35344 - protein, 16 aa, Homo sapiens
  heavy chain complementarity determining region 3 for antibody 17672
AKDALALTSKPYYFDF

SEQ ID NO: 35345 - protein, 9 aa, Homo sapiens
  light chain complementarity determining region 3 for antibody 17673
QQYDNLPLT

SEQ ID NO: 35346 - protein, 20 aa, Homo sapiens
  heavy chain complementarity determining region 3 for antibody 17673
ARDQAYYYGSGSSGVDWFDP

SEQ ID NO: 35347 - protein, 9 aa, Homo sapiens
  light chain complementarity determining region 3 for antibody 17674
QQSYTTPYT

SEQ ID NO: 35348 - protein, 13 aa, Homo sapiens
  heavy chain complementarity determining region 3 for antibody 17674
ARISSTWPPLFDY

SEQ ID NO: 35349 - protein, 9 aa, Homo sapiens
  light chain complementarity determining region 3 for antibody 17675
QQSYSTPYT

SEQ ID NO: 35350 - protein, 21 aa, Homo sapiens
  heavy chain complementarity determining region 3 for antibody 17675
ARDLSTVTTKTNTYYYCALDV

SEQ ID NO: 35351 - protein, 9 aa, Homo sapiens
  light chain complementarity determining region 3 for antibody 17676
QQSYSTPWT

SEQ ID NO: 35352 - protein, 14 aa, Homo sapiens
  heavy chain complementarity determining region 3 for antibody 17676
ARAPLGFAGVPFDN

SEQ ID NO: 35353 - protein, 9 aa, Homo sapiens
  light chain complementarity determining region 3 for antibody 17677
QQSYGSPFN

SEQ ID NO: 35354 - protein, 15 aa, Homo sapiens
  heavy chain complementarity determining region 3 for antibody 17677
ARVSIQLWQKTWFDP

SEQ ID NO: 35355 - protein, 9 aa, Homo sapiens
  light chain complementarity determining region 3 for antibody 17678
QQLNTYPRA

SEQ ID NO: 35356 - protein, 19 aa, Homo sapiens
  heavy chain complementarity determining region 3 for antibody 17678
AKDGGPGWDLLRSGNALDI

SEQ ID NO: 35357 - protein, 9 aa, Homo sapiens
  light chain complementarity determining region 3 for antibody 17679
QQLGSSPTT

SEQ ID NO: 35358 - protein, 13 aa, Homo sapiens
  heavy chain complementarity determining region 3 for antibody 17679
ATQTGSYYDGFDI

SEQ ID NO: 35359 - protein, 10 aa, Homo sapiens
  light chain complementarity determining region 3 for antibody 17680
QQDGSSPMYS

SEQ ID NO: 35360 - protein, 11 aa, Homo sapiens
  heavy chain complementarity determining region 3 for antibody 17680
ARGGQWGSLDY

SEQ ID NO: 35361 - protein, 10 aa, Homo sapiens
  light chain complementarity determining region 3 for antibody 17681
QQCFSTPGYT

SEQ ID NO: 35362 - protein, 11 aa, Homo sapiens
  heavy chain complementarity determining region 3 for antibody 17681
AKTYNSGWFDY

SEQ ID NO: 35363 - protein, 9 aa, Homo sapiens
  light chain complementarity determining region 3 for antibody 17682
QKYNSAPRT

SEQ ID NO: 35364 - protein, 17 aa, Homo sapiens
  heavy chain complementarity determining region 3 for antibody 17682
ARDRWYYGSGNYYPFDI

SEQ ID NO: 35365 - protein, 9 aa, Homo sapiens
  light chain complementarity determining region 3 for antibody 17683
QHYKSYPLT

SEQ ID NO: 35366 - protein, 12 aa, Homo sapiens
  heavy chain complementarity determining region 3 for antibody 17683
TRTQNNGWTFDY

SEQ ID NO: 35367 - protein, 9 aa, Homo sapiens
  light chain complementarity determining region 3 for antibody 17684
QHYGRSPRT

SEQ ID NO: 35368 - protein, 13 aa, Homo sapiens
  heavy chain complementarity determining region 3 for antibody 17684
ARGKFERSGYVET

SEQ ID NO: 35369 - protein, 10 aa, Homo sapiens
  light chain complementarity determining region 3 for antibody 17685
QHYGNSPPIT

SEQ ID NO: 35370 - protein, 11 aa, Homo sapiens
  heavy chain complementarity determining region 3 for antibody 17685
ARCFNTCYFDQ

SEQ ID NO: 35371 - protein, 10 aa, Homo sapiens
  light chain complementarity determining region 3 for antibody 17686
QHYDYSPKLT

SEQ ID NO: 35372 - protein, 18 aa, Homo sapiens
  heavy chain complementarity determining region 3 for antibody 17686
ATGHPLRLHDYYYFVMDV

SEQ ID NO: 35373 - protein, 9 aa, Homo sapiens
  light chain complementarity determining region 3 for antibody 17687
QHHQTYWPT

SEQ ID NO: 35374 - protein, 12 aa, Homo sapiens
  heavy chain complementarity determining region 3 for antibody 17687
AGDPSGNSYFDY

SEQ ID NO: 35375 - protein, 9 aa, Homo sapiens
  light chain complementarity determining region 3 for antibody 17688
QHFGNSPLT

SEQ ID NO: 35376 - protein, 11 aa, Homo sapiens
  heavy chain complementarity determining region 3 for antibody 17688
ARKPMGTPFDY

SEQ ID NO: 35377 - protein, 9 aa, Homo sapiens
  light chain complementarity determining region 3 for antibody 17689
MYTLQTQLS

SEQ ID NO: 35378 - protein, 24 aa, Homo sapiens
  heavy chain complementarity determining region 3 for antibody 17689
ARAVGCDGTNCHAAWGFYYYALDV

SEQ ID NO: 35379 - protein, 9 aa, Homo sapiens
  light chain complementarity determining region 3 for antibody 17690
MQPLLTPWT

SEQ ID NO: 35380 - protein, 11 aa, Homo sapiens
  heavy chain complementarity determining region 3 for antibody 17690
ARDRDYSALDV

SEQ ID NO: 35381 - protein, 9 aa, Homo sapiens
  light chain complementarity determining region 3 for antibody 17691
MQALEPPFT

SEQ ID NO: 35382 - protein, 15 aa, Homo sapiens
  heavy chain complementarity determining region 3 for antibody 17691
VRHYRIITAPLEGDS

SEQ ID NO: 35383 - protein, 9 aa, Homo sapiens
  light chain complementarity determining region 3 for antibody 17692
MGTLQTPPT

SEQ ID NO: 35384 - protein, 15 aa, Homo sapiens
  heavy chain complementarity determining region 3 for antibody 17692
TRDGKRDGHNDAFDI

SEQ ID NO: 35385 - protein, 9 aa, Homo sapiens
  light chain complementarity determining region 3 for antibody 17693
LQNDYWPRT

SEQ ID NO: 35386 - protein, 11 aa, Homo sapiens
  heavy chain complementarity determining region 3 for antibody 17693
VRVGGAGYFDH

SEQ ID NO: 35387 - protein, 11 aa, Homo sapiens
  light chain complementarity determining region 3 for antibody 17694
QVFDTSPPMYT

SEQ ID NO: 35388 - protein, 23 aa, Homo sapiens
  heavy chain complementarity determining region 3 for antibody 17694
ARANRRYRRSDSRMDFLYFGMDV

SEQ ID NO: 35389 - protein, 9 aa, Homo sapiens
  light chain complementarity determining region 3 for antibody 17695
QQYNSYPWT

SEQ ID NO: 35390 - protein, 23 aa, Homo sapiens
  heavy chain complementarity determining region 3 for antibody 17695
AGGRITGATWQRPTNYYYYAMNV

SEQ ID NO: 35391 - protein, 9 aa, Homo sapiens
  light chain complementarity determining region 3 for antibody 17696
QQYNSWPRT

SEQ ID NO: 35392 - protein, 19 aa, Homo sapiens
  heavy chain complementarity determining region 3 for antibody 17696
ATVALATINMKIVGEYFHH

SEQ ID NO: 35393 - protein, 9 aa, Homo sapiens
  light chain complementarity determining region 3 for antibody 17697
QQYNGYSYT

SEQ ID NO: 35394 - protein, 20 aa, Homo sapiens
  heavy chain complementarity determining region 3 for antibody 17697
TKVRQAIVVVPAASLAYFDY

SEQ ID NO: 35395 - protein, 9 aa, Homo sapiens
  light chain complementarity determining region 3 for antibody 17698
QQYNAFPLT

SEQ ID NO: 35396 - protein, 17 aa, Homo sapiens
  heavy chain complementarity determining region 3 for antibody 17698
ARAPFRDVYNYRVPIDY

SEQ ID NO: 35397 - protein, 9 aa, Homo sapiens
  light chain complementarity determining region 3 for antibody 17699
QQYGTSPRT

SEQ ID NO: 35398 - protein, 13 aa, Homo sapiens
  heavy chain complementarity determining region 3 for antibody 17699
PIGFYDRSGYHDY

SEQ ID NO: 35399 - protein, 9 aa, Homo sapiens
  light chain complementarity determining region 3 for antibody 17700
QQYGTPPRT

SEQ ID NO: 35400 - protein, 25 aa, Homo sapiens
  heavy chain complementarity determining region 3 for antibody 17700
ASLRVDRLRLPGAMRGPLYDRGLNV

SEQ ID NO: 35401 - protein, 10 aa, Homo sapiens
  light chain complementarity determining region 3 for antibody 17701
QQYGSSPPST

SEQ ID NO: 35402 - protein, 17 aa, Homo sapiens
  heavy chain complementarity determining region 3 for antibody 17701
ARTYDTTGYYYGGYFDY

SEQ ID NO: 35403 - protein, 9 aa, Homo sapiens
  light chain complementarity determining region 3 for antibody 17702
QQYGSLPRT

SEQ ID NO: 35404 - protein, 13 aa, Homo sapiens
  heavy chain complementarity determining region 3 for antibody 17702
ARGQFERSGYKEN

SEQ ID NO: 35405 - protein, 9 aa, Homo sapiens
  light chain complementarity determining region 3 for antibody 17703
QQSYDTPWT

SEQ ID NO: 35406 - protein, 20 aa, Homo sapiens
  heavy chain complementarity determining region 3 for antibody 17703
ARLSHVFFDSTGTGYYAMDV

SEQ ID NO: 35407 - protein, 9 aa, Homo sapiens
  light chain complementarity determining region 3 for antibody 17704
QQGYSNPLT

SEQ ID NO: 35408 - protein, 15 aa, Homo sapiens
  heavy chain complementarity determining region 3 for antibody 17704
ARAQVIWGQLYYFDS

SEQ ID NO: 35409 - protein, 9 aa, Homo sapiens
  light chain complementarity determining region 3 for antibody 17705
QQAGGAPYT

SEQ ID NO: 35410 - protein, 13 aa, Homo sapiens
  heavy chain complementarity determining region 3 for antibody 17705
ARDWYNSNWSMDV

SEQ ID NO: 35411 - protein, 9 aa, Homo sapiens
  light chain complementarity determining region 3 for antibody 17706
QATQNFPYA

SEQ ID NO: 35412 - protein, 14 aa, Homo sapiens
  heavy chain complementarity determining region 3 for antibody 17706
TRTSWSDGWRFFQD

SEQ ID NO: 35413 - protein, 9 aa, Homo sapiens
  light chain complementarity determining region 3 for antibody 17707
MQDLETPFT

SEQ ID NO: 35414 - protein, 15 aa, Homo sapiens
  heavy chain complementarity determining region 3 for antibody 17707
VRHYRETVAGIEGDS

SEQ ID NO: 35415 - protein, 9 aa, Homo sapiens
  light chain complementarity determining region 3 for antibody 17708
MHALETPFT

SEQ ID NO: 35416 - protein, 15 aa, Homo sapiens
  heavy chain complementarity determining region 3 for antibody 17708
VRHYRETVAGIEGDS

SEQ ID NO: 35417 - protein, 9 aa, Homo sapiens
  light chain complementarity determining region 3 for antibody 17709
LQHNSYPLT

SEQ ID NO: 35418 - protein, 18 aa, Homo sapiens
  heavy chain complementarity determining region 3 for antibody 17709
ARGDVSAGRYSSSPPPTH

SEQ ID NO: 35419 - protein, 11 aa, Homo sapiens
  light chain complementarity determining region 3 for antibody 17710
QRWSTSGSRYI

SEQ ID NO: 35420 - protein, 14 aa, Homo sapiens
  heavy chain complementarity determining region 3 for antibody 17710
ARHTEVTGLRGFDR

SEQ ID NO: 35421 - protein, 9 aa, Homo sapiens
  light chain complementarity determining region 3 for antibody 17711
QQYGSSPRT

SEQ ID NO: 35422 - protein, 14 aa, Homo sapiens
  heavy chain complementarity determining region 3 for antibody 17711
ATGFFDRSRHYLEY

SEQ ID NO: 35423 - protein, 9 aa, Homo sapiens
  light chain complementarity determining region 3 for antibody 17712
QQYGSIPRT

SEQ ID NO: 35424 - protein, 13 aa, Homo sapiens
  heavy chain complementarity determining region 3 for antibody 17712
AGGGFSSGRYSDY

SEQ ID NO: 35425 - protein, 8 aa, Homo sapiens
  light chain complementarity determining region 3 for antibody 17713
QQYDKLYT

SEQ ID NO: 35426 - protein, 13 aa, Homo sapiens
  heavy chain complementarity determining region 3 for antibody 17713
VTGGIYTTGPLDF

SEQ ID NO: 35427 - protein, 9 aa, Homo sapiens
  light chain complementarity determining region 3 for antibody 17714
QQSHTGPWT

SEQ ID NO: 35428 - protein, 12 aa, Homo sapiens
  heavy chain complementarity determining region 3 for antibody 17714
VRGRNYEVTFDY

SEQ ID NO: 35429 - protein, 9 aa, Homo sapiens
  light chain complementarity determining region 3 for antibody 17715
QQGDTFPLT

SEQ ID NO: 35430 - protein, 16 aa, Homo sapiens
  heavy chain complementarity determining region 3 for antibody 17715
ARGQSIWDAGYLGLDV

SEQ ID NO: 35431 - protein, 9 aa, Homo sapiens
  light chain complementarity determining region 3 for antibody 17716
QQFGSLPHT

SEQ ID NO: 35432 - protein, 14 aa, Homo sapiens
  heavy chain complementarity determining region 3 for antibody 17716
ARGGGSDWYGLLYD

SEQ ID NO: 35433 - protein, 9 aa, Homo sapiens
  light chain complementarity determining region 3 for antibody 17717
QHGYRTPFT

SEQ ID NO: 35434 - protein, 15 aa, Homo sapiens
  heavy chain complementarity determining region 3 for antibody 17717
AKAQVIWGQLYYFES

SEQ ID NO: 35435 - protein, 9 aa, Homo sapiens
  light chain complementarity determining region 3 for antibody 17718
MQALGTPFT

SEQ ID NO: 35436 - protein, 15 aa, Homo sapiens
  heavy chain complementarity determining region 3 for antibody 17718
VRHYRETVAGIEGDS

SEQ ID NO: 35437 - protein, 9 aa, Homo sapiens
  light chain complementarity determining region 3 for antibody 17719
MQALETPFT

SEQ ID NO: 35438 - protein, 15 aa, Homo sapiens
  heavy chain complementarity determining region 3 for antibody 17719
VRQYRETVAGIEGDS

SEQ ID NO: 35439 - protein, 9 aa, Homo sapiens
  light chain complementarity determining region 3 for antibody 17720
LQDNNYPPT

SEQ ID NO: 35440 - protein, 12 aa, Homo sapiens
  heavy chain complementarity determining region 3 for antibody 17720
ATVGLEGLGRLI

SEQ ID NO: 35441 - protein, 9 aa, Homo sapiens
  light chain complementarity determining region 3 for antibody 17721
QQYYSVPRT

SEQ ID NO: 35442 - protein, 17 aa, Homo sapiens
  heavy chain complementarity determining region 3 for antibody 17721
ARGNSGGGCNSCEYFPL

SEQ ID NO: 35443 - protein, 10 aa, Homo sapiens
  light chain complementarity determining region 3 for antibody 17722
QQYYSTPPYT

SEQ ID NO: 35444 - protein, 16 aa, Homo sapiens
  heavy chain complementarity determining region 3 for antibody 17722
VGDISLAMSSRRGFVY

SEQ ID NO: 35445 - protein, 9 aa, Homo sapiens
  light chain complementarity determining region 3 for antibody 17723
QQYYSSPWT

SEQ ID NO: 35446 - protein, 15 aa, Homo sapiens
  heavy chain complementarity determining region 3 for antibody 17723
AREGTPVTPSDAFDI

SEQ ID NO: 35447 - protein, 9 aa, Homo sapiens
  light chain complementarity determining region 3 for antibody 17724
QQYYSHPRT

SEQ ID NO: 35448 - protein, 10 aa, Homo sapiens
  heavy chain complementarity determining region 3 for antibody 17724
ARDLQGPFDY

SEQ ID NO: 35449 - protein, 9 aa, Homo sapiens
  light chain complementarity determining region 3 for antibody 17725
QQYNSYPLT

SEQ ID NO: 35450 - protein, 20 aa, Homo sapiens
  heavy chain complementarity determining region 3 for antibody 17725
AHRLAVGCRGGRCYGYHFDY

SEQ ID NO: 35451 - protein, 11 aa, Homo sapiens
  light chain complementarity determining region 3 for antibody 17726
QQYNNWPLPLT

SEQ ID NO: 35452 - protein, 17 aa, Homo sapiens
  heavy chain complementarity determining region 3 for antibody 17726
AREGMVRGVTYPPYFDY

SEQ ID NO: 35453 - protein, 11 aa, Homo sapiens
  light chain complementarity determining region 3 for antibody 17727
QQYGTSPRMDT

SEQ ID NO: 35454 - protein, 23 aa, Homo sapiens
  heavy chain complementarity determining region 3 for antibody 17727
ARMRSGYSRDKNVLQFYYYGLDV

SEQ ID NO: 35455 - protein, 9 aa, Homo sapiens
  light chain complementarity determining region 3 for antibody 17728
QQYGGSPRT

SEQ ID NO: 35456 - protein, 13 aa, Homo sapiens
  heavy chain complementarity determining region 3 for antibody 17728
ASGYFDSGAYYDF

SEQ ID NO: 35457 - protein, 10 aa, Homo sapiens
  light chain complementarity determining region 3 for antibody 17729
QQRSQWPPLT

SEQ ID NO: 35458 - protein, 11 aa, Homo sapiens
  heavy chain complementarity determining region 3 for antibody 17729
ASPVLLPWFDS

SEQ ID NO: 35459 - protein, 9 aa, Homo sapiens
  light chain complementarity determining region 3 for antibody 17730
QQGSGHPYT

SEQ ID NO: 35460 - protein, 15 aa, Homo sapiens
  heavy chain complementarity determining region 3 for antibody 17730
ARDGWLQETKSFFDH

SEQ ID NO: 35461 - protein, 9 aa, Homo sapiens
  light chain complementarity determining region 3 for antibody 17731
MQVLQTPYT

SEQ ID NO: 35462 - protein, 10 aa, Homo sapiens
  heavy chain complementarity determining region 3 for antibody 17731
TPGRSAWYDK

SEQ ID NO: 35463 - protein, 8 aa, Homo sapiens
  light chain complementarity determining region 3 for antibody 17732
MQALQTPG

SEQ ID NO: 35464 - protein, 19 aa, Homo sapiens
  heavy chain complementarity determining region 3 for antibody 17732
ANFGSGNFYNVRYYYGMDV

SEQ ID NO: 35465 - protein, 9 aa, Homo sapiens
  light chain complementarity determining region 3 for antibody 17733
LQGNRFPHT

SEQ ID NO: 35466 - protein, 14 aa, Homo sapiens
  heavy chain complementarity determining region 3 for antibody 17733
ARYCSGNSCYSMDL

SEQ ID NO: 35467 - protein, 9 aa, Homo sapiens
  light chain complementarity determining region 3 for antibody 17734
LQDEHYPWT

SEQ ID NO: 35468 - protein, 17 aa, Homo sapiens
  heavy chain complementarity determining region 3 for antibody 17734
ARVKWLELQDFYYGMDV

SEQ ID NO: 35469 - protein, 9 aa, Homo sapiens
  light chain complementarity determining region 3 for antibody 17735
QQYYTSLRP

SEQ ID NO: 35470 - protein, 12 aa, Homo sapiens
  heavy chain complementarity determining region 3 for antibody 17735
VKDCGLGGSRDS

SEQ ID NO: 35471 - protein, 9 aa, Homo sapiens
  light chain complementarity determining region 3 for antibody 17736
QQYYTIPLT

SEQ ID NO: 35472 - protein, 11 aa, Homo sapiens
  heavy chain complementarity determining region 3 for antibody 17736
ARSDKVNWFDT

SEQ ID NO: 35473 - protein, 9 aa, Homo sapiens
  light chain complementarity determining region 3 for antibody 17737
QQYNTYPLT

SEQ ID NO: 35474 - protein, 12 aa, Homo sapiens
  heavy chain complementarity determining region 3 for antibody 17737
GRVAPVEYYLDF

SEQ ID NO: 35475 - protein, 9 aa, Homo sapiens
  light chain complementarity determining region 3 for antibody 17738
QQYLRDPYT

SEQ ID NO: 35476 - protein, 18 aa, Homo sapiens
  heavy chain complementarity determining region 3 for antibody 17738
ARGAYGSTIYYNLHYFDF

SEQ ID NO: 35477 - protein, 10 aa, Homo sapiens
  light chain complementarity determining region 3 for antibody 17739
QQYKSYSGFT

SEQ ID NO: 35478 - protein, 18 aa, Homo sapiens
  heavy chain complementarity determining region 3 for antibody 17739
ARSALITAAAEYFYGMDV

SEQ ID NO: 35479 - protein, 10 aa, Homo sapiens
  light chain complementarity determining region 3 for antibody 17740
QQYGSSPPYT

SEQ ID NO: 35480 - protein, 18 aa, Homo sapiens
  heavy chain complementarity determining region 3 for antibody 17740
AMGKWFGDFNFYYYAMDV

SEQ ID NO: 35481 - protein, 11 aa, Homo sapiens
  light chain complementarity determining region 3 for antibody 17741
QQYGDSPPMYP

SEQ ID NO: 35482 - protein, 12 aa, Homo sapiens
  heavy chain complementarity determining region 3 for antibody 17741
AGQGDRSYSYSY

SEQ ID NO: 35483 - protein, 12 aa, Homo sapiens
  light chain complementarity determining region 3 for antibody 17742
QQYDNLPRTLLA

SEQ ID NO: 35484 - protein, 12 aa, Homo sapiens
  heavy chain complementarity determining region 3 for antibody 17742
EMTPRGGYLFDY

SEQ ID NO: 35485 - protein, 8 aa, Homo sapiens
  light chain complementarity determining region 3 for antibody 17743
QQSYNTRT

SEQ ID NO: 35486 - protein, 16 aa, Homo sapiens
  heavy chain complementarity determining region 3 for antibody 17743
ARETDPISSGPNGFQH

SEQ ID NO: 35487 - protein, 9 aa, Homo sapiens
  light chain complementarity determining region 3 for antibody 17744
QQSYITPRT

SEQ ID NO: 35488 - protein, 16 aa, Homo sapiens
  heavy chain complementarity determining region 3 for antibody 17744
ARDAELVIAVGTTFDT

SEQ ID NO: 35489 - protein, 9 aa, Homo sapiens
  light chain complementarity determining region 3 for antibody 17745
QQRTNWRFT

SEQ ID NO: 35490 - protein, 16 aa, Homo sapiens
  heavy chain complementarity determining region 3 for antibody 17745
ARDQGYCLGTNCYLLH

SEQ ID NO: 35491 - protein, 8 aa, Homo sapiens
  light chain complementarity determining region 3 for antibody 17746
QQRSSWLT

SEQ ID NO: 35492 - protein, 23 aa, Homo sapiens
  heavy chain complementarity determining region 3 for antibody 17746
ARDHPPTTISGWGRTNFYQGLDV

SEQ ID NO: 35493 - protein, 9 aa, Homo sapiens
  light chain complementarity determining region 3 for antibody 17747
QQNSNTPRT

SEQ ID NO: 35494 - protein, 21 aa, Homo sapiens
  heavy chain complementarity determining region 3 for antibody 17747
ARTDEPLTSMEYYYSYYAMDV

SEQ ID NO: 35495 - protein, 9 aa, Homo sapiens
  light chain complementarity determining region 3 for antibody 17748
QQLNSYPLT

SEQ ID NO: 35496 - protein, 20 aa, Homo sapiens
  heavy chain complementarity determining region 3 for antibody 17748
ATSKVVVVSEGLYYYYGLDV

SEQ ID NO: 35497 - protein, 9 aa, Homo sapiens
  light chain complementarity determining region 3 for antibody 17749
QQADSFPPT

SEQ ID NO: 35498 - protein, 20 aa, Homo sapiens
  heavy chain complementarity determining region 3 for antibody 17749
ARDPSNCISTSCRGGSTVDY

SEQ ID NO: 35499 - protein, 11 aa, Homo sapiens
  light chain complementarity determining region 3 for antibody 17750
QHYARSPPMYT

SEQ ID NO: 35500 - protein, 24 aa, Homo sapiens
  heavy chain complementarity determining region 3 for antibody 17750
ARLAVYCSGSSCYPPQYHYYGMDV

SEQ ID NO: 35501 - protein, 9 aa, Homo sapiens
  light chain complementarity determining region 3 for antibody 17751
QEYNLAPLT

SEQ ID NO: 35502 - protein, 6 aa, Homo sapiens
  heavy chain complementarity determining region 3 for antibody 17751
ARDLDS

SEQ ID NO: 35503 - protein, 9 aa, Homo sapiens
  light chain complementarity determining region 3 for antibody 17752
MQTLQTPLT

SEQ ID NO: 35504 - protein, 18 aa, Homo sapiens
  heavy chain complementarity determining region 3 for antibody 17752
AKGFTIFGVIAGFDAFDT

SEQ ID NO: 35505 - protein, 10 aa, Homo sapiens
  light chain complementarity determining region 3 for antibody 17753
MQSVQFPRWT

SEQ ID NO: 35506 - protein, 8 aa, Homo sapiens
  heavy chain complementarity determining region 3 for antibody 17753
AKGYGFDS

SEQ ID NO: 35507 - protein, 8 aa, Homo sapiens
  light chain complementarity determining region 3 for antibody 17754
MQSTQWPT

SEQ ID NO: 35508 - protein, 21 aa, Homo sapiens
  heavy chain complementarity determining region 3 for antibody 17754
AKDRPNYYGSNAGYYTPGGDL

SEQ ID NO: 35509 - protein, 9 aa, Homo sapiens
  light chain complementarity determining region 3 for antibody 17755
LQHYTYPLT

SEQ ID NO: 35510 - protein, 25 aa, Homo sapiens
  heavy chain complementarity determining region 3 for antibody 17755
SRQREFYDGRGSPYYYYQYNQGMDV

SEQ ID NO: 35511 - protein, 9 aa, Homo sapiens
  light chain complementarity determining region 3 for antibody 17756
LQDYNYPRT

SEQ ID NO: 35512 - protein, 16 aa, Homo sapiens
  heavy chain complementarity determining region 3 for antibody 17756
ASSVVVVAYGHDAFDI

SEQ ID NO: 35513 - protein, 9 aa, Homo sapiens
  light chain complementarity determining region 3 for antibody 17757
LQALETPFT

SEQ ID NO: 35514 - protein, 15 aa, Homo sapiens
  heavy chain complementarity determining region 3 for antibody 17757
VRHYRIITAPLEGDS

SEQ ID NO: 35515 - protein, 9 aa, Homo sapiens
  light chain complementarity determining region 3 for antibody 17758
HQYYSAPLT

SEQ ID NO: 35516 - protein, 21 aa, Homo sapiens
  heavy chain complementarity determining region 3 for antibody 17758
AKDEGLSVFRSFDGLFDAFDI

SEQ ID NO: 35517 - protein, 9 aa, Homo sapiens
  light chain complementarity determining region 3 for antibody 17759
QQYTNWPPT

SEQ ID NO: 35518 - protein, 16 aa, Homo sapiens
  heavy chain complementarity determining region 3 for antibody 17759
AKEGYHYETGGGGMDV

SEQ ID NO: 35519 - protein, 8 aa, Homo sapiens
  light chain complementarity determining region 3 for antibody 17760
QQYRDSLT

SEQ ID NO: 35520 - protein, 13 aa, Homo sapiens
  heavy chain complementarity determining region 3 for antibody 17760
ARLYRWPTMSFDS

SEQ ID NO: 35521 - protein, 9 aa, Homo sapiens
  light chain complementarity determining region 3 for antibody 17761
QQYNSYPVA

SEQ ID NO: 35522 - protein, 17 aa, Homo sapiens
  heavy chain complementarity determining region 3 for antibody 17761
ARGPHSGNYSKTRNFDY

SEQ ID NO: 35523 - protein, 9 aa, Homo sapiens
  light chain complementarity determining region 3 for antibody 17762
QQYGSSPRT

SEQ ID NO: 35524 - protein, 18 aa, Homo sapiens
  heavy chain complementarity determining region 3 for antibody 17762
ATAFWVGLGVPPPGFFDY

SEQ ID NO: 35525 - protein, 11 aa, Homo sapiens
  light chain complementarity determining region 3 for antibody 17763
QQYGRSPPGYT

SEQ ID NO: 35526 - protein, 12 aa, Homo sapiens
  heavy chain complementarity determining region 3 for antibody 17763
AREWPETCYFDY

SEQ ID NO: 35527 - protein, 9 aa, Homo sapiens
  light chain complementarity determining region 3 for antibody 17764
QQYDASSLT

SEQ ID NO: 35528 - protein, 14 aa, Homo sapiens
  heavy chain complementarity determining region 3 for antibody 17764
ARRAPYGNSWTFDY

SEQ ID NO: 35529 - protein, 10 aa, Homo sapiens
  light chain complementarity determining region 3 for antibody 17765
QQNYGAPPYS

SEQ ID NO: 35530 - protein, 16 aa, Homo sapiens
  heavy chain complementarity determining region 3 for antibody 17765
ARTSYDTSGYYYPFEY

SEQ ID NO: 35531 - protein, 10 aa, Homo sapiens
  light chain complementarity determining region 3 for antibody 17766
QQLNTSPPLT

SEQ ID NO: 35532 - protein, 20 aa, Homo sapiens
  heavy chain complementarity determining region 3 for antibody 17766
ARHSYSKNWGENYYYYGLDV

SEQ ID NO: 35533 - protein, 9 aa, Homo sapiens
  light chain complementarity determining region 3 for antibody 17767
QQFYTYPLT

SEQ ID NO: 35534 - protein, 12 aa, Homo sapiens
  heavy chain complementarity determining region 3 for antibody 17767
TRVLSSAIGECD

SEQ ID NO: 35535 - protein, 9 aa, Homo sapiens
  light chain complementarity determining region 3 for antibody 17768
QHYDEISFT

SEQ ID NO: 35536 - protein, 18 aa, Homo sapiens
  heavy chain complementarity determining region 3 for antibody 17768
ATTRSYYYITTYRSSFDI

SEQ ID NO: 35537 - protein, 9 aa, Homo sapiens
  light chain complementarity determining region 3 for antibody 17769
QHSYLVPYT

SEQ ID NO: 35538 - protein, 16 aa, Homo sapiens
  heavy chain complementarity determining region 3 for antibody 17769
ARVGEGVAATLWYFDL

SEQ ID NO: 35539 - protein, 10 aa, Homo sapiens
  light chain complementarity determining region 3 for antibody 17770
QHLYNWPPLT

SEQ ID NO: 35540 - protein, 22 aa, Homo sapiens
  heavy chain complementarity determining region 3 for antibody 17770
ARVDCSSTNCYVGYYYYFGLDV

SEQ ID NO: 35541 - protein, 9 aa, Homo sapiens
  light chain complementarity determining region 3 for antibody 17771
QEIYFTPYT

SEQ ID NO: 35542 - protein, 17 aa, Homo sapiens
  heavy chain complementarity determining region 3 for antibody 17771
ANDHSINGSSVGPGFDY

SEQ ID NO: 35543 - protein, 9 aa, Homo sapiens
  light chain complementarity determining region 3 for antibody 17772
MRALETPFT

SEQ ID NO: 35544 - protein, 15 aa, Homo sapiens
  heavy chain complementarity determining region 3 for antibody 17772
VRHYRELATGIEGDS

SEQ ID NO: 35545 - protein, 9 aa, Homo sapiens
  light chain complementarity determining region 3 for antibody 17773
MQVLETPFT

SEQ ID NO: 35546 - protein, 15 aa, Homo sapiens
  heavy chain complementarity determining region 3 for antibody 17773
VRHYRETVAGIEGDS

SEQ ID NO: 35547 - protein, 9 aa, Homo sapiens
  light chain complementarity determining region 3 for antibody 17774
MQGTHWPLT

SEQ ID NO: 35548 - protein, 28 aa, Homo sapiens
  heavy chain complementarity determining region 3 for antibody 17774
MRFPDEPDEMDYEGDYYDSIDFAGDFQH

SEQ ID NO: 35549 - protein, 10 aa, Homo sapiens
  light chain complementarity determining region 3 for antibody 17775
MHGTLWPPET

SEQ ID NO: 35550 - protein, 23 aa, Homo sapiens
  heavy chain complementarity determining region 3 for antibody 17775
ATGGRSSSWSRGLPPKYYYGMDV

SEQ ID NO: 35551 - protein, 9 aa, Homo sapiens
  light chain complementarity determining region 3 for antibody 17776
LQVVSFPRT

SEQ ID NO: 35552 - protein, 8 aa, Homo sapiens
  heavy chain complementarity determining region 3 for antibody 17776
ARNSGWYD

SEQ ID NO: 35553 - protein, 9 aa, Homo sapiens
  light chain complementarity determining region 3 for antibody 17777
LQHNTYPLT

SEQ ID NO: 35554 - protein, 16 aa, Homo sapiens
  heavy chain complementarity determining region 3 for antibody 17777
ARDTSIFGVVQNWLDA

SEQ ID NO: 35555 - protein, 9 aa, Homo sapiens
  light chain complementarity determining region 3 for antibody 17778
LQGTHWPPT

SEQ ID NO: 35556 - protein, 11 aa, Homo sapiens
  heavy chain complementarity determining region 3 for antibody 17778
ATGPQVTMPQD

SEQ ID NO: 35557 - protein, 8 aa, Homo sapiens
  light chain complementarity determining region 3 for antibody 17779
QQYYTTRS

SEQ ID NO: 35558 - protein, 9 aa, Homo sapiens
  heavy chain complementarity determining region 3 for antibody 17779
SIDNLGMGY

SEQ ID NO: 35559 - protein, 9 aa, Homo sapiens
  light chain complementarity determining region 3 for antibody 17780
QQYYTTPRP

SEQ ID NO: 35560 - protein, 8 aa, Homo sapiens
  heavy chain complementarity determining region 3 for antibody 17780
ARDGAFDS

SEQ ID NO: 35561 - protein, 9 aa, Homo sapiens
  light chain complementarity determining region 3 for antibody 17781
QQYYSTPPT

SEQ ID NO: 35562 - protein, 14 aa, Homo sapiens
  heavy chain complementarity determining region 3 for antibody 17781
ARSLSSAWYDWSDP

SEQ ID NO: 35563 - protein, 8 aa, Homo sapiens
  light chain complementarity determining region 3 for antibody 17782
QQYNTWIT

SEQ ID NO: 35564 - protein, 17 aa, Homo sapiens
  heavy chain complementarity determining region 3 for antibody 17782
ALLWGSVDYWGRGSVDY

SEQ ID NO: 35565 - protein, 9 aa, Homo sapiens
  light chain complementarity determining region 3 for antibody 17783
QQYGSSPLT

SEQ ID NO: 35566 - protein, 22 aa, Homo sapiens
  heavy chain complementarity determining region 3 for antibody 17783
ASQTEGYCTTTDCYGAHRPFDI

SEQ ID NO: 35567 - protein, 9 aa, Homo sapiens
  light chain complementarity determining region 3 for antibody 17784
QQTYSLPYT

SEQ ID NO: 35568 - protein, 19 aa, Homo sapiens
  heavy chain complementarity determining region 3 for antibody 17784
VTPADWRGNSYGWAGSFAS

SEQ ID NO: 35569 - protein, 11 aa, Homo sapiens
  light chain complementarity determining region 3 for antibody 17785
QHYVSSPPNFP

SEQ ID NO: 35570 - protein, 15 aa, Homo sapiens
  heavy chain complementarity determining region 3 for antibody 17785
ARDPSYIAAAGRGDY

SEQ ID NO: 35571 - protein, 10 aa, Homo sapiens
  light chain complementarity determining region 3 for antibody 17786
MQALQTAPFT

SEQ ID NO: 35572 - protein, 12 aa, Homo sapiens
  heavy chain complementarity determining region 3 for antibody 17786
ARGRAGFGRFDP

SEQ ID NO: 35573 - protein, 9 aa, Homo sapiens
  light chain complementarity determining region 3 for antibody 17787
LQYTNFPFT

SEQ ID NO: 35574 - protein, 6 aa, Homo sapiens
  heavy chain complementarity determining region 3 for antibody 17787
LADLDH

SEQ ID NO: 35575 - protein, 9 aa, Homo sapiens
  light chain complementarity determining region 3 for antibody 17788
LQSIHWPWT

SEQ ID NO: 35576 - protein, 11 aa, Homo sapiens
  heavy chain complementarity determining region 3 for antibody 17788
GRHIRRSPEDY

SEQ ID NO: 35577 - protein, 9 aa, Homo sapiens
  light chain complementarity determining region 3 for antibody 17789
LQHNSYPLT

SEQ ID NO: 35578 - protein, 13 aa, Homo sapiens
  heavy chain complementarity determining region 3 for antibody 17789
VRHAVVRPIVVDD

SEQ ID NO: 35579 - protein, 8 aa, Homo sapiens
  light chain complementarity determining region 3 for antibody 17790
HQYYNIPT

SEQ ID NO: 35580 - protein, 15 aa, Homo sapiens
  heavy chain complementarity determining region 3 for antibody 17790
AKTRPFRGAALPSDH

SEQ ID NO: 35581 - protein, 9 aa, Homo sapiens
  light chain complementarity determining region 3 for antibody 17791
HHTYTFPRP

SEQ ID NO: 35582 - protein, 20 aa, Homo sapiens
  heavy chain complementarity determining region 3 for antibody 17791
ARGRRIAALSTAHYYYGMDV

SEQ ID NO: 35583 - protein, 9 aa, Homo sapiens
  light chain complementarity determining region 3 for antibody 17792
QQYNTYPLT

SEQ ID NO: 35584 - protein, 12 aa, Homo sapiens
  heavy chain complementarity determining region 3 for antibody 17792
AKSEGRWLQLDY

SEQ ID NO: 35585 - protein, 8 aa, Homo sapiens
  light chain complementarity determining region 3 for antibody 17793
QQYNSYWT

SEQ ID NO: 35586 - protein, 14 aa, Homo sapiens
  heavy chain complementarity determining region 3 for antibody 17793
AKDRQWIPDGPLDY

SEQ ID NO: 35587 - protein, 9 aa, Homo sapiens
  light chain complementarity determining region 3 for antibody 17794
QQYNSYPYT

SEQ ID NO: 35588 - protein, 16 aa, Homo sapiens
  heavy chain complementarity determining region 3 for antibody 17794
IREGNDYIWGSYRYDY

SEQ ID NO: 35589 - protein, 9 aa, Homo sapiens
  light chain complementarity determining region 3 for antibody 17795
QQYNSYPWT

SEQ ID NO: 35590 - protein, 17 aa, Homo sapiens
  heavy chain complementarity determining region 3 for antibody 17795
ARGRFFDWLLTPSGMDV

SEQ ID NO: 35591 - protein, 8 aa, Homo sapiens
  light chain complementarity determining region 3 for antibody 17796
QQYGTSRM

SEQ ID NO: 35592 - protein, 13 aa, Homo sapiens
  heavy chain complementarity determining region 3 for antibody 17796
ARGQFVGSAYYDN

SEQ ID NO: 35593 - protein, 9 aa, Homo sapiens
  light chain complementarity determining region 3 for antibody 17797
QQYGTSPRP

SEQ ID NO: 35594 - protein, 13 aa, Homo sapiens
  heavy chain complementarity determining region 3 for antibody 17797
PIGFYDRSGYHEY

SEQ ID NO: 35595 - protein, 9 aa, Homo sapiens
  light chain complementarity determining region 3 for antibody 17798
QQYGSSPRP

SEQ ID NO: 35596 - protein, 25 aa, Homo sapiens
  heavy chain complementarity determining region 3 for antibody 17798
ARLRIDRLRLPGAMRGPLYDCGLNV

SEQ ID NO: 35597 - protein, 9 aa, Homo sapiens
  light chain complementarity determining region 3 for antibody 17799
QQYGSSPNT

SEQ ID NO: 35598 - protein, 29 aa, Homo sapiens
  heavy chain complementarity determining region 3 for antibody 17799
AKSGRLRDLWFGDFRRPNYFDNTGYYLDY

SEQ ID NO: 35599 - protein, 9 aa, Homo sapiens
  light chain complementarity determining region 3 for antibody 17800
QQYGDSRWT

SEQ ID NO: 35600 - protein, 13 aa, Homo sapiens
  heavy chain complementarity determining region 3 for antibody 17800
LQWLVLGPSTFDI

SEQ ID NO: 35601 - protein, 9 aa, Homo sapiens
  light chain complementarity determining region 3 for antibody 17801
QQRRDWPRT

SEQ ID NO: 35602 - protein, 17 aa, Homo sapiens
  heavy chain complementarity determining region 3 for antibody 17801
AQGGGYCGGDCFFYYDH

SEQ ID NO: 35603 - protein, 9 aa, Homo sapiens
  light chain complementarity determining region 3 for antibody 17802
QQGYSNPLI

SEQ ID NO: 35604 - protein, 15 aa, Homo sapiens
  heavy chain complementarity determining region 3 for antibody 17802
ARAQVIWGQLYYFDF

SEQ ID NO: 35605 - protein, 9 aa, Homo sapiens
  light chain complementarity determining region 3 for antibody 17803
QQFDDVHRS

SEQ ID NO: 35606 - protein, 16 aa, Homo sapiens
  heavy chain complementarity determining region 3 for antibody 17803
ARESADTIQGKGTFEI

SEQ ID NO: 35607 - protein, 9 aa, Homo sapiens
  light chain complementarity determining region 3 for antibody 17804
QHYGSIPLT

SEQ ID NO: 35608 - protein, 7 aa, Homo sapiens
  heavy chain complementarity determining region 3 for antibody 17804
HGYELKC

SEQ ID NO: 35609 - protein, 9 aa, Homo sapiens
  light chain complementarity determining region 3 for antibody 17805
MQGTHWPPT

SEQ ID NO: 35610 - protein, 16 aa, Homo sapiens
  heavy chain complementarity determining region 3 for antibody 17805
VRAALPTGVTVGGVDY

SEQ ID NO: 35611 - protein, 9 aa, Homo sapiens
  light chain complementarity determining region 3 for antibody 17806
MQALETPST

SEQ ID NO: 35612 - protein, 15 aa, Homo sapiens
  heavy chain complementarity determining region 3 for antibody 17806
VRHYRIITAPLEGDS

SEQ ID NO: 35613 - protein, 9 aa, Homo sapiens
  light chain complementarity determining region 3 for antibody 17807
MGTLQTPPA

SEQ ID NO: 35614 - protein, 15 aa, Homo sapiens
  heavy chain complementarity determining region 3 for antibody 17807
TRDGKKDGHNDAFDI

SEQ ID NO: 35615 - protein, 9 aa, Homo sapiens
  light chain complementarity determining region 3 for antibody 17808
MEVVQSPWT

SEQ ID NO: 35616 - protein, 18 aa, Homo sapiens
  heavy chain complementarity determining region 3 for antibody 17808
IRGGRMYCSGEPCYSGSL

SEQ ID NO: 35617 - protein, 9 aa, Homo sapiens
  light chain complementarity determining region 3 for antibody 17809
LQHNTYPLT

SEQ ID NO: 35618 - protein, 20 aa, Homo sapiens
  heavy chain complementarity determining region 3 for antibody 17809
ARGEHVVVVTSFHGTQGINS

SEQ ID NO: 35619 - protein, 9 aa, Homo sapiens
  light chain complementarity determining region 3 for antibody 17810
LQHNSYPFT

SEQ ID NO: 35620 - protein, 17 aa, Homo sapiens
  heavy chain complementarity determining region 3 for antibody 17810
VRDRRGRVFFGDDAFDV

SEQ ID NO: 35621 - protein, 10 aa, Homo sapiens
  light chain complementarity determining region 3 for antibody 17811
HHYNNWPRSA

SEQ ID NO: 35622 - protein, 18 aa, Homo sapiens
  heavy chain complementarity determining region 3 for antibody 17811
ARGGRSSGWHVQNDGFDI

SEQ ID NO: 35623 - protein, 9 aa, Homo sapiens
  light chain complementarity determining region 3 for antibody 17812
QQYYTSFRT

SEQ ID NO: 35624 - protein, 12 aa, Homo sapiens
  heavy chain complementarity determining region 3 for antibody 17812
VKDCGLGGSRDS

SEQ ID NO: 35625 - protein, 11 aa, Homo sapiens
  light chain complementarity determining region 3 for antibody 17813
QQYVTSPPSYP

SEQ ID NO: 35626 - protein, 11 aa, Homo sapiens
  heavy chain complementarity determining region 3 for antibody 17813
AYSPGWWRIDC

SEQ ID NO: 35627 - protein, 9 aa, Homo sapiens
  light chain complementarity determining region 3 for antibody 17814
QQYGSSPRT

SEQ ID NO: 35628 - protein, 14 aa, Homo sapiens
  heavy chain complementarity determining region 3 for antibody 17814
AGGTFSSGSSYSEN

SEQ ID NO: 35629 - protein, 9 aa, Homo sapiens
  light chain complementarity determining region 3 for antibody 17815
QQYGSIPRT

SEQ ID NO: 35630 - protein, 14 aa, Homo sapiens
  heavy chain complementarity determining region 3 for antibody 17815
AGGEFSSGWHYSDN

SEQ ID NO: 35631 - protein, 9 aa, Homo sapiens
  light chain complementarity determining region 3 for antibody 17816
QQYFSTPRT

SEQ ID NO: 35632 - protein, 20 aa, Homo sapiens
  heavy chain complementarity determining region 3 for antibody 17816
ARGVYDSDWGTYHYEGWFDP

SEQ ID NO: 35633 - protein, 11 aa, Homo sapiens
  light chain complementarity determining region 3 for antibody 17817
QQRFNWPPTIT

SEQ ID NO: 35634 - protein, 12 aa, Homo sapiens
  heavy chain complementarity determining region 3 for antibody 17817
ALSFGGVEYFDY

SEQ ID NO: 35635 - protein, 9 aa, Homo sapiens
  light chain complementarity determining region 3 for antibody 17818
QQAHSFPYT

SEQ ID NO: 35636 - protein, 20 aa, Homo sapiens
  heavy chain complementarity determining region 3 for antibody 17818
ARTTYYYDRSGLSLFYKSDY

SEQ ID NO: 35637 - protein, 10 aa, Homo sapiens
  light chain complementarity determining region 3 for antibody 17819
MQSIQPPRWT

SEQ ID NO: 35638 - protein, 8 aa, Homo sapiens
  heavy chain complementarity determining region 3 for antibody 17819
AKGYGFDC

SEQ ID NO: 35639 - protein, 10 aa, Homo sapiens
  light chain complementarity determining region 3 for antibody 17820
MQGTYWPPWT

SEQ ID NO: 35640 - protein, 13 aa, Homo sapiens
  heavy chain complementarity determining region 3 for antibody 17820
VRDGDSTTWPLDF

SEQ ID NO: 35641 - protein, 9 aa, Homo sapiens
  light chain complementarity determining region 3 for antibody 17821
MQATHWPIT

SEQ ID NO: 35642 - protein, 16 aa, Homo sapiens
  heavy chain complementarity determining region 3 for antibody 17821
ARGSAVEDRAGSAFDN

SEQ ID NO: 35643 - protein, 8 aa, Homo sapiens
  light chain complementarity determining region 3 for antibody 17822
MQAQHTRT

SEQ ID NO: 35644 - protein, 21 aa, Homo sapiens
  heavy chain complementarity determining region 3 for antibody 17822
AREKHYAYCSDGVCYTGAFDI

SEQ ID NO: 35645 - protein, 9 aa, Homo sapiens
  light chain complementarity determining region 3 for antibody 17823
MQALETPFT

SEQ ID NO: 35646 - protein, 15 aa, Homo sapiens
  heavy chain complementarity determining region 3 for antibody 17823
VRHYRIITAPLEVDS

SEQ ID NO: 35647 - protein, 9 aa, Homo sapiens
  light chain complementarity determining region 3 for antibody 17824
MQALATPFT

SEQ ID NO: 35648 - protein, 15 aa, Homo sapiens
  heavy chain complementarity determining region 3 for antibody 17824
VRHYRETVAGIEGDS

SEQ ID NO: 35649 - protein, 9 aa, Homo sapiens
  light chain complementarity determining region 3 for antibody 17825
MHALETPFT

SEQ ID NO: 35650 - protein, 15 aa, Homo sapiens
  heavy chain complementarity determining region 3 for antibody 17825
VRHYRIITAPLEGDS

SEQ ID NO: 35651 - protein, 9 aa, Homo sapiens
  light chain complementarity determining region 3 for antibody 17826
MGTLQSPPT

SEQ ID NO: 35652 - protein, 15 aa, Homo sapiens
  heavy chain complementarity determining region 3 for antibody 17826
TRDGKRDGHNDAFDI

SEQ ID NO: 35653 - protein, 10 aa, Homo sapiens
  light chain complementarity determining region 3 for antibody 17827
LQRVNWPPYS

SEQ ID NO: 35654 - protein, 20 aa, Homo sapiens
  heavy chain complementarity determining region 3 for antibody 17827
AREPLDQGDYPSPGYWYFDL

SEQ ID NO: 35655 - protein, 9 aa, Homo sapiens
  light chain complementarity determining region 3 for antibody 17828
QQYYSTPWT

SEQ ID NO: 35656 - protein, 15 aa, Homo sapiens
  heavy chain complementarity determining region 3 for antibody 17828
IRQSKMNNNWDYPDS

SEQ ID NO: 35657 - protein, 10 aa, Homo sapiens
  light chain complementarity determining region 3 for antibody 17829
QQYYSTPSIT

SEQ ID NO: 35658 - protein, 15 aa, Homo sapiens
  heavy chain complementarity determining region 3 for antibody 17829
AAVIYYDGDYYGMDV

SEQ ID NO: 35659 - protein, 9 aa, Homo sapiens
  light chain complementarity determining region 3 for antibody 17830
QQYGTIPRT

SEQ ID NO: 35660 - protein, 10 aa, Homo sapiens
  heavy chain complementarity determining region 3 for antibody 17830
ASLNRRTSRR

SEQ ID NO: 35661 - protein, 9 aa, Homo sapiens
  light chain complementarity determining region 3 for antibody 17831
QQYGSSPYT

SEQ ID NO: 35662 - protein, 22 aa, Homo sapiens
  heavy chain complementarity determining region 3 for antibody 17831
ARRRPTDITKFRQRGRQGPFEI

SEQ ID NO: 35663 - protein, 9 aa, Homo sapiens
  light chain complementarity determining region 3 for antibody 17832
QQYGSSPYT

SEQ ID NO: 35664 - protein, 19 aa, Homo sapiens
  heavy chain complementarity determining region 3 for antibody 17832
ARGLAGYDSSGYLLYYFDY

SEQ ID NO: 35665 - protein, 10 aa, Homo sapiens
  light chain complementarity determining region 3 for antibody 17833
QQYGSSPMYR

SEQ ID NO: 35666 - protein, 11 aa, Homo sapiens
  heavy chain complementarity determining region 3 for antibody 17833
ARGGQWGSLDY

SEQ ID NO: 35667 - protein, 9 aa, Homo sapiens
  light chain complementarity determining region 3 for antibody 17834
QQSYASPPT

SEQ ID NO: 35668 - protein, 13 aa, Homo sapiens
  heavy chain complementarity determining region 3 for antibody 17834
AHITLRYRTTFDF

SEQ ID NO: 35669 - protein, 9 aa, Homo sapiens
  light chain complementarity determining region 3 for antibody 17835
QQRSNWPWT

SEQ ID NO: 35670 - protein, 19 aa, Homo sapiens
  heavy chain complementarity determining region 3 for antibody 17835
ARGWSGAATYGYYYYGMDV

SEQ ID NO: 35671 - protein, 10 aa, Homo sapiens
  light chain complementarity determining region 3 for antibody 17836
QQRQFWPPIT

SEQ ID NO: 35672 - protein, 12 aa, Homo sapiens
  heavy chain complementarity determining region 3 for antibody 17836
ARAPTHVAMFEY

SEQ ID NO: 35673 - protein, 9 aa, Homo sapiens
  light chain complementarity determining region 3 for antibody 17837
QQLNSYPYT

SEQ ID NO: 35674 - protein, 12 aa, Homo sapiens
  heavy chain complementarity determining region 3 for antibody 17837
AIWAGAKGGLPY

SEQ ID NO: 35675 - protein, 9 aa, Homo sapiens
  light chain complementarity determining region 3 for antibody 17838
QQCNIYPYT

SEQ ID NO: 35676 - protein, 12 aa, Homo sapiens
  heavy chain complementarity determining region 3 for antibody 17838
VREARQGDVKFQ

SEQ ID NO: 35677 - protein, 9 aa, Homo sapiens
  light chain complementarity determining region 3 for antibody 17839
QQANSVPLT

SEQ ID NO: 35678 - protein, 21 aa, Homo sapiens
  heavy chain complementarity determining region 3 for antibody 17839
AKGNIPSGRYSRHRAKDGFDA

SEQ ID NO: 35679 - protein, 9 aa, Homo sapiens
  light chain complementarity determining region 3 for antibody 17840
QHYGSPPRT

SEQ ID NO: 35680 - protein, 14 aa, Homo sapiens
  heavy chain complementarity determining region 3 for antibody 17840
AGGVFSSDWNYSEY

SEQ ID NO: 35681 - protein, 9 aa, Homo sapiens
  light chain complementarity determining region 3 for antibody 17841
QEADRHPLT

SEQ ID NO: 35682 - protein, 16 aa, Homo sapiens
  heavy chain complementarity determining region 3 for antibody 17841
ARDPSADSNGWYYFDY

SEQ ID NO: 35683 - protein, 9 aa, Homo sapiens
  light chain complementarity determining region 3 for antibody 17842
MQPLQIPRT

SEQ ID NO: 35684 - protein, 16 aa, Homo sapiens
  heavy chain complementarity determining region 3 for antibody 17842
ARIPTFYYVSGRNPDY

SEQ ID NO: 35685 - protein, 9 aa, Homo sapiens
  light chain complementarity determining region 3 for antibody 17843
MQALQTVHT

SEQ ID NO: 35686 - protein, 17 aa, Homo sapiens
  heavy chain complementarity determining region 3 for antibody 17843
ARDVGRHCSGSGCHHDY

SEQ ID NO: 35687 - protein, 9 aa, Homo sapiens
  light chain complementarity determining region 3 for antibody 17844
MQALETQFT

SEQ ID NO: 35688 - protein, 15 aa, Homo sapiens
  heavy chain complementarity determining region 3 for antibody 17844
VRHYRIITAPLEGDS

SEQ ID NO: 35689 - protein, 9 aa, Homo sapiens
  light chain complementarity determining region 3 for antibody 17845
LQHNSYPPT

SEQ ID NO: 35690 - protein, 13 aa, Homo sapiens
  heavy chain complementarity determining region 3 for antibody 17845
VRHAVVRPMVVDD

SEQ ID NO: 35691 - protein, 9 aa, Homo sapiens
  light chain complementarity determining region 3 for antibody 17846
LQDYTYPRT

SEQ ID NO: 35692 - protein, 22 aa, Homo sapiens
  heavy chain complementarity determining region 3 for antibody 17846
ARDSTPKLLVAGTMRYYDAFDI

SEQ ID NO: 35693 - protein, 9 aa, Homo sapiens
  light chain complementarity determining region 3 for antibody 17847
YQRSNWPRT

SEQ ID NO: 35694 - protein, 17 aa, Homo sapiens
  heavy chain complementarity determining region 3 for antibody 17847
AQGGGYCGGDCYYYLDN

SEQ ID NO: 35695 - protein, 9 aa, Homo sapiens
  light chain complementarity determining region 3 for antibody 17848
QQYGTPPRT

SEQ ID NO: 35696 - protein, 25 aa, Homo sapiens
  heavy chain complementarity determining region 3 for antibody 17848
ARLRVARLRLPGAMRGPLYDRGLNV

SEQ ID NO: 35697 - protein, 9 aa, Homo sapiens
  light chain complementarity determining region 3 for antibody 17849
QQYGSSPYT

SEQ ID NO: 35698 - protein, 16 aa, Homo sapiens
  heavy chain complementarity determining region 3 for antibody 17849
ARECPRLFGDHCPYDY

SEQ ID NO: 35699 - protein, 9 aa, Homo sapiens
  light chain complementarity determining region 3 for antibody 17850
QQYDSYPIT

SEQ ID NO: 35700 - protein, 12 aa, Homo sapiens
  heavy chain complementarity determining region 3 for antibody 17850
ARERASVVTFDS

SEQ ID NO: 35701 - protein, 11 aa, Homo sapiens
  light chain complementarity determining region 3 for antibody 17851
QQYADLPLGIT

SEQ ID NO: 35702 - protein, 14 aa, Homo sapiens
  heavy chain complementarity determining region 3 for antibody 17851
ARILSSGWYGGFDY

SEQ ID NO: 35703 - protein, 10 aa, Homo sapiens
  light chain complementarity determining region 3 for antibody 17852
QQRSDWPPLP

SEQ ID NO: 35704 - protein, 10 aa, Homo sapiens
  heavy chain complementarity determining region 3 for antibody 17852
ARDYTMTFDY

SEQ ID NO: 35705 - protein, 10 aa, Homo sapiens
  light chain complementarity determining region 3 for antibody 17853
QQLYSDPLFT

SEQ ID NO: 35706 - protein, 19 aa, Homo sapiens
  heavy chain complementarity determining region 3 for antibody 17853
ARLNTAMAEDYYYYYGLDV

SEQ ID NO: 35707 - protein, 9 aa, Homo sapiens
  light chain complementarity determining region 3 for antibody 17854
QQLNSYPFT

SEQ ID NO: 35708 - protein, 19 aa, Homo sapiens
  heavy chain complementarity determining region 3 for antibody 17854
ARSSLLWFDKLSVPYYFDY

SEQ ID NO: 35709 - protein, 9 aa, Homo sapiens
  light chain complementarity determining region 3 for antibody 17855
QQAHSFPRT

SEQ ID NO: 35710 - protein, 13 aa, Homo sapiens
  heavy chain complementarity determining region 3 for antibody 17855
ARDLRVGRNGLDV

SEQ ID NO: 35711 - protein, 11 aa, Homo sapiens
  light chain complementarity determining region 3 for antibody 17856
QLYETSPPGYP

SEQ ID NO: 35712 - protein, 14 aa, Homo sapiens
  heavy chain complementarity determining region 3 for antibody 17856
ARENSISRKRSFDQ

SEQ ID NO: 35713 - protein, 10 aa, Homo sapiens
  light chain complementarity determining region 3 for antibody 17857
MQGTHWPPLT

SEQ ID NO: 35714 - protein, 18 aa, Homo sapiens
  heavy chain complementarity determining region 3 for antibody 17857
ARKSSGWYSLSAYWYFDL

SEQ ID NO: 35715 - protein, 9 aa, Homo sapiens
  light chain complementarity determining region 3 for antibody 17858
MQGTHRPFT

SEQ ID NO: 35716 - protein, 21 aa, Homo sapiens
  heavy chain complementarity determining region 3 for antibody 17858
ARGGDYGDYWVRYYYYYGMDV

SEQ ID NO: 35717 - protein, 9 aa, Homo sapiens
  light chain complementarity determining region 3 for antibody 17859
MQALRTRLT

SEQ ID NO: 35718 - protein, 23 aa, Homo sapiens
  heavy chain complementarity determining region 3 for antibody 17859
ARVSQNLGEWSGSSRYGINAFAP

SEQ ID NO: 35719 - protein, 10 aa, Homo sapiens
  light chain complementarity determining region 3 for antibody 17860
MQALQTPVYT

SEQ ID NO: 35720 - protein, 15 aa, Homo sapiens
  heavy chain complementarity determining region 3 for antibody 17860
ARQPLEVSHYHGMDV

SEQ ID NO: 35721 - protein, 9 aa, Homo sapiens
  light chain complementarity determining region 3 for antibody 17861
MQALETPST

SEQ ID NO: 35722 - protein, 15 aa, Homo sapiens
  heavy chain complementarity determining region 3 for antibody 17861
VRHYRETVAGIEGDS

SEQ ID NO: 35723 - protein, 9 aa, Homo sapiens
  light chain complementarity determining region 3 for antibody 17862
MQALETPFT

SEQ ID NO: 35724 - protein, 15 aa, Homo sapiens
  heavy chain complementarity determining region 3 for antibody 17862
VSHYRETVAGIEGDS

SEQ ID NO: 35725 - protein, 9 aa, Homo sapiens
  light chain complementarity determining region 3 for antibody 17863
MQALDTPFT

SEQ ID NO: 35726 - protein, 15 aa, Homo sapiens
  heavy chain complementarity determining region 3 for antibody 17863
VRHYRIITAPLEGDS

SEQ ID NO: 35727 - protein, 9 aa, Homo sapiens
  light chain complementarity determining region 3 for antibody 17864
LQHNSFPLT

SEQ ID NO: 35728 - protein, 19 aa, Homo sapiens
  heavy chain complementarity determining region 3 for antibody 17864
ASLRYSSSWSRRLVDVFEI

SEQ ID NO: 35729 - protein, 9 aa, Homo sapiens
  light chain complementarity determining region 3 for antibody 17865
LQHNSFPLT

SEQ ID NO: 35730 - protein, 16 aa, Homo sapiens
  heavy chain complementarity determining region 3 for antibody 17865
ARYSGSYYWGFYPFDP

SEQ ID NO: 35731 - protein, 9 aa, Homo sapiens
  light chain complementarity determining region 3 for antibody 17866
LQGNRFPHT

SEQ ID NO: 35732 - protein, 14 aa, Homo sapiens
  heavy chain complementarity determining region 3 for antibody 17866
SRYCSGSSCYSMDH

SEQ ID NO: 35733 - protein, 9 aa, Homo sapiens
  light chain complementarity determining region 3 for antibody 17867
LQGNRFPHT

SEQ ID NO: 35734 - protein, 14 aa, Homo sapiens
  heavy chain complementarity determining region 3 for antibody 17867
ARYCSGSSCYSMDH

SEQ ID NO: 35735 - protein, 9 aa, Homo sapiens
  light chain complementarity determining region 3 for antibody 17868
QQYNNWPYT

SEQ ID NO: 35736 - protein, 11 aa, Homo sapiens
  heavy chain complementarity determining region 3 for antibody 17868
GSFYHGGPCGF

SEQ ID NO: 35737 - protein, 9 aa, Homo sapiens
  light chain complementarity determining region 3 for antibody 17869
QQYGSTTLT

SEQ ID NO: 35738 - protein, 15 aa, Homo sapiens
  heavy chain complementarity determining region 3 for antibody 17869
ARGPHPPYYGGFFHR

SEQ ID NO: 35739 - protein, 9 aa, Homo sapiens
  light chain complementarity determining region 3 for antibody 17870
QQYGSSPRT

SEQ ID NO: 35740 - protein, 11 aa, Homo sapiens
  heavy chain complementarity determining region 3 for antibody 17870
ARRTALVGLDY

SEQ ID NO: 35741 - protein, 10 aa, Homo sapiens
  light chain complementarity determining region 3 for antibody 17871
QQYGSSLVYT

SEQ ID NO: 35742 - protein, 15 aa, Homo sapiens
  heavy chain complementarity determining region 3 for antibody 17871
AREPLVAGSFGWFDP

SEQ ID NO: 35743 - protein, 9 aa, Homo sapiens
  light chain complementarity determining region 3 for antibody 17872
QQYGRLPRT

SEQ ID NO: 35744 - protein, 13 aa, Homo sapiens
  heavy chain complementarity determining region 3 for antibody 17872
AGGLFGSGTYSEF

SEQ ID NO: 35745 - protein, 9 aa, Homo sapiens
  light chain complementarity determining region 3 for antibody 17873
QQYGNSPRT

SEQ ID NO: 35746 - protein, 13 aa, Homo sapiens
  heavy chain complementarity determining region 3 for antibody 17873
AIGYYDRGTYYDY

SEQ ID NO: 35747 - protein, 9 aa, Homo sapiens
  light chain complementarity determining region 3 for antibody 17874
QQYDSYPWT

SEQ ID NO: 35748 - protein, 20 aa, Homo sapiens
  heavy chain complementarity determining region 3 for antibody 17874
ARVAPFLYYGSGHRRAYLDR

SEQ ID NO: 35749 - protein, 9 aa, Homo sapiens
  light chain complementarity determining region 3 for antibody 17875
QQSYTFPRT

SEQ ID NO: 35750 - protein, 13 aa, Homo sapiens
  heavy chain complementarity determining region 3 for antibody 17875
ARDLENWVNCFDY

SEQ ID NO: 35751 - protein, 9 aa, Homo sapiens
  light chain complementarity determining region 3 for antibody 17876
QQSFFVPIT

SEQ ID NO: 35752 - protein, 15 aa, Homo sapiens
  heavy chain complementarity determining region 3 for antibody 17876
ARGSCTGPSCYVFDF

SEQ ID NO: 35753 - protein, 9 aa, Homo sapiens
  light chain complementarity determining region 3 for antibody 17877
QQSDSTPIT

SEQ ID NO: 35754 - protein, 16 aa, Homo sapiens
  heavy chain complementarity determining region 3 for antibody 17877
SRGAYYSSSWYGWFDP

SEQ ID NO: 35755 - protein, 10 aa, Homo sapiens
  light chain complementarity determining region 3 for antibody 17878
QQRYNWPPYT

SEQ ID NO: 35756 - protein, 11 aa, Homo sapiens
  heavy chain complementarity determining region 3 for antibody 17878
TRGVGSYPFDQ

SEQ ID NO: 35757 - protein, 10 aa, Homo sapiens
  light chain complementarity determining region 3 for antibody 17879
QQRSKWPPPT

SEQ ID NO: 35758 - protein, 9 aa, Homo sapiens
  heavy chain complementarity determining region 3 for antibody 17879
ARVDGYFDY

SEQ ID NO: 35759 - protein, 10 aa, Homo sapiens
  light chain complementarity determining region 3 for antibody 17880
QQRSKGPPLT

SEQ ID NO: 35760 - protein, 9 aa, Homo sapiens
  heavy chain complementarity determining region 3 for antibody 17880
ARVDGYFDY

SEQ ID NO: 35761 - protein, 9 aa, Homo sapiens
  light chain complementarity determining region 3 for antibody 17881
QQHNDYPWT

SEQ ID NO: 35762 - protein, 10 aa, Homo sapiens
  heavy chain complementarity determining region 3 for antibody 17881
ARDYEAALDY

SEQ ID NO: 35763 - protein, 9 aa, Homo sapiens
  light chain complementarity determining region 3 for antibody 17882
QQGYSPPFI

SEQ ID NO: 35764 - protein, 15 aa, Homo sapiens
  heavy chain complementarity determining region 3 for antibody 17882
TRAQVIWGQLYYFDY

SEQ ID NO: 35765 - protein, 9 aa, Homo sapiens
  light chain complementarity determining region 3 for antibody 17883
QQCHRTPNT

SEQ ID NO: 35766 - protein, 14 aa, Homo sapiens
  heavy chain complementarity determining region 3 for antibody 17883
ATVSDSTWLRSFDV

SEQ ID NO: 35767 - protein, 11 aa, Homo sapiens
  light chain complementarity determining region 3 for antibody 17884
QHYGSSPPRYT

SEQ ID NO: 35768 - protein, 17 aa, Homo sapiens
  heavy chain complementarity determining region 3 for antibody 17884
ARLWSSQHLHHQDVFDV

SEQ ID NO: 35769 - protein, 9 aa, Homo sapiens
  light chain complementarity determining region 3 for antibody 17885
QHRYDWLIS

SEQ ID NO: 35770 - protein, 15 aa, Homo sapiens
  heavy chain complementarity determining region 3 for antibody 17885
ARGRRYGRFGGNLDV

SEQ ID NO: 35771 - protein, 9 aa, Homo sapiens
  light chain complementarity determining region 3 for antibody 17886
MQVLETPFT

SEQ ID NO: 35772 - protein, 15 aa, Homo sapiens
  heavy chain complementarity determining region 3 for antibody 17886
VRHYRIITAPLEGDS

SEQ ID NO: 35773 - protein, 9 aa, Homo sapiens
  light chain complementarity determining region 3 for antibody 17887
MQALQGPYT

SEQ ID NO: 35774 - protein, 17 aa, Homo sapiens
  heavy chain complementarity determining region 3 for antibody 17887
ATHYPVATPQYYYGLDV

SEQ ID NO: 35775 - protein, 9 aa, Homo sapiens
  light chain complementarity determining region 3 for antibody 17888
MQALETPFT

SEQ ID NO: 35776 - protein, 15 aa, Homo sapiens
  heavy chain complementarity determining region 3 for antibody 17888
VRHYRRITAPLEGDS

SEQ ID NO: 35777 - protein, 9 aa, Homo sapiens
  light chain complementarity determining region 3 for antibody 17889
MQALETPFT

SEQ ID NO: 35778 - protein, 15 aa, Homo sapiens
  heavy chain complementarity determining region 3 for antibody 17889
VRHYRIITAPLDGDS

SEQ ID NO: 35779 - protein, 9 aa, Homo sapiens
  light chain complementarity determining region 3 for antibody 17890
HQYSSSPST

SEQ ID NO: 35780 - protein, 13 aa, Homo sapiens
  heavy chain complementarity determining region 3 for antibody 17890
ARGTYSAFAIFGV

SEQ ID NO: 35781 - protein, 9 aa, Homo sapiens
  light chain complementarity determining region 3 for antibody 17891
HQGYRTPFT

SEQ ID NO: 35782 - protein, 15 aa, Homo sapiens
  heavy chain complementarity determining region 3 for antibody 17891
AKAQVIWGQLYYFDS

SEQ ID NO: 35783 - protein, 9 aa, Homo sapiens
  light chain complementarity determining region 3 for antibody 17892
HQCSYSPLT

SEQ ID NO: 35784 - protein, 10 aa, Homo sapiens
  heavy chain complementarity determining region 3 for antibody 17892
AWGIGWTSNY

SEQ ID NO: 35785 - protein, 9 aa, Homo sapiens
  light chain complementarity determining region 3 for antibody 17893
QQYYSTPWT

SEQ ID NO: 35786 - protein, 15 aa, Homo sapiens
  heavy chain complementarity determining region 3 for antibody 17893
IRQSKVDNNYNYPDF

SEQ ID NO: 35787 - protein, 9 aa, Homo sapiens
  light chain complementarity determining region 3 for antibody 17894
QQYYSTPHT

SEQ ID NO: 35788 - protein, 13 aa, Homo sapiens
  heavy chain complementarity determining region 3 for antibody 17894
ARHSSGYPTPFDY

SEQ ID NO: 35789 - protein, 10 aa, Homo sapiens
  light chain complementarity determining region 3 for antibody 17895
QQYVTSLKWT

SEQ ID NO: 35790 - protein, 6 aa, Homo sapiens
  heavy chain complementarity determining region 3 for antibody 17895
RTPFDP

SEQ ID NO: 35791 - protein, 9 aa, Homo sapiens
  light chain complementarity determining region 3 for antibody 17896
QQYGSYPQT

SEQ ID NO: 35792 - protein, 14 aa, Homo sapiens
  heavy chain complementarity determining region 3 for antibody 17896
ARGSYGDYSDAYDL

SEQ ID NO: 35793 - protein, 9 aa, Homo sapiens
  light chain complementarity determining region 3 for antibody 17897
QQYGSIPLP

SEQ ID NO: 35794 - protein, 7 aa, Homo sapiens
  heavy chain complementarity determining region 3 for antibody 17897
HGYELKC

SEQ ID NO: 35795 - protein, 9 aa, Homo sapiens
  light chain complementarity determining region 3 for antibody 17898
QQYGNLPRT

SEQ ID NO: 35796 - protein, 13 aa, Homo sapiens
  heavy chain complementarity determining region 3 for antibody 17898
AGGNFHSGGYGDY

SEQ ID NO: 35797 - protein, 9 aa, Homo sapiens
  light chain complementarity determining region 3 for antibody 17899
QQRSSWPYP

SEQ ID NO: 35798 - protein, 11 aa, Homo sapiens
  heavy chain complementarity determining region 3 for antibody 17899
VKRWGGSSIDY

SEQ ID NO: 35799 - protein, 9 aa, Homo sapiens
  light chain complementarity determining region 3 for antibody 17900
QHYYSSPYT

SEQ ID NO: 35800 - protein, 10 aa, Homo sapiens
  heavy chain complementarity determining region 3 for antibody 17900
ARDGGDYADY

SEQ ID NO: 35801 - protein, 10 aa, Homo sapiens
  light chain complementarity determining region 3 for antibody 17901
QHYDNLPTLT

SEQ ID NO: 35802 - protein, 18 aa, Homo sapiens
  heavy chain complementarity determining region 3 for antibody 17901
VSTTVLLVHLTSEDSSDI

SEQ ID NO: 35803 - protein, 9 aa, Homo sapiens
  light chain complementarity determining region 3 for antibody 17902
MKALETPFT

SEQ ID NO: 35804 - protein, 15 aa, Homo sapiens
  heavy chain complementarity determining region 3 for antibody 17902
VRHYRETVAGIEGDS

SEQ ID NO: 35805 - protein, 9 aa, Homo sapiens
  light chain complementarity determining region 3 for antibody 17903
MHSINWPGT

SEQ ID NO: 35806 - protein, 7 aa, Homo sapiens
  heavy chain complementarity determining region 3 for antibody 17903
ATARGAD

SEQ ID NO: 35807 - protein, 9 aa, Homo sapiens
  light chain complementarity determining region 3 for antibody 17904
LQHNSYPPT

SEQ ID NO: 35808 - protein, 13 aa, Homo sapiens
  heavy chain complementarity determining region 3 for antibody 17904
ARSTTGLSGFFES

SEQ ID NO: 35809 - protein, 9 aa, Homo sapiens
  light chain complementarity determining region 3 for antibody 17905
RQYGGLEKT

SEQ ID NO: 35810 - protein, 12 aa, Homo sapiens
  heavy chain complementarity determining region 3 for antibody 17905
ARGGIWTGGFDY

SEQ ID NO: 35811 - protein, 9 aa, Homo sapiens
  light chain complementarity determining region 3 for antibody 17906
QQYYTSPLT

SEQ ID NO: 35812 - protein, 20 aa, Homo sapiens
  heavy chain complementarity determining region 3 for antibody 17906
ARDQAYYYGSGSSGVDWFDP

SEQ ID NO: 35813 - protein, 8 aa, Homo sapiens
  light chain complementarity determining region 3 for antibody 17907
QQYSNYAM

SEQ ID NO: 35814 - protein, 15 aa, Homo sapiens
  heavy chain complementarity determining region 3 for antibody 17907
ARQRPNNDSLYYFDY

SEQ ID NO: 35815 - protein, 9 aa, Homo sapiens
  light chain complementarity determining region 3 for antibody 17908
QQYNTYPRT

SEQ ID NO: 35816 - protein, 10 aa, Homo sapiens
  heavy chain complementarity determining region 3 for antibody 17908
ARGPGGYPDS

SEQ ID NO: 35817 - protein, 9 aa, Homo sapiens
  light chain complementarity determining region 3 for antibody 17909
QQYGTSPFT

SEQ ID NO: 35818 - protein, 15 aa, Homo sapiens
  heavy chain complementarity determining region 3 for antibody 17909
ARQNDFLSGPGEFGP

SEQ ID NO: 35819 - protein, 9 aa, Homo sapiens
  light chain complementarity determining region 3 for antibody 17910
QQYGSSPRT

SEQ ID NO: 35820 - protein, 13 aa, Homo sapiens
  heavy chain complementarity determining region 3 for antibody 17910
AKALHGAPRCYDS

SEQ ID NO: 35821 - protein, 9 aa, Homo sapiens
  light chain complementarity determining region 3 for antibody 17911
QQYGRIPRT

SEQ ID NO: 35822 - protein, 13 aa, Homo sapiens
  heavy chain complementarity determining region 3 for antibody 17911
AGGGFSSGRYSEY

SEQ ID NO: 35823 - protein, 9 aa, Homo sapiens
  light chain complementarity determining region 3 for antibody 17912
QQYGNSPRT

SEQ ID NO: 35824 - protein, 15 aa, Homo sapiens
  heavy chain complementarity determining region 3 for antibody 17912
AGGWFNYYSSGYYEP

SEQ ID NO: 35825 - protein, 9 aa, Homo sapiens
  light chain complementarity determining region 3 for antibody 17913
QQYGGSPRT

SEQ ID NO: 35826 - protein, 12 aa, Homo sapiens
  heavy chain complementarity determining region 3 for antibody 17913
AAGYCSGTYYEY

SEQ ID NO: 35827 - protein, 9 aa, Homo sapiens
  light chain complementarity determining region 3 for antibody 17914
QQYGASTMT

SEQ ID NO: 35828 - protein, 14 aa, Homo sapiens
  heavy chain complementarity determining region 3 for antibody 17914
VRQDEKRPYRVVDY

SEQ ID NO: 35829 - protein, 9 aa, Homo sapiens
  light chain complementarity determining region 3 for antibody 17915
QQYENLPFT

SEQ ID NO: 35830 - protein, 13 aa, Homo sapiens
  heavy chain complementarity determining region 3 for antibody 17915
ARGGYVLLSVFEM

SEQ ID NO: 35831 - protein, 9 aa, Homo sapiens
  light chain complementarity determining region 3 for antibody 17916
QQYDTYPLT

SEQ ID NO: 35832 - protein, 19 aa, Homo sapiens
  heavy chain complementarity determining region 3 for antibody 17916
ARESERLAWGKVTYNHFDP

SEQ ID NO: 35833 - protein, 9 aa, Homo sapiens
  light chain complementarity determining region 3 for antibody 17917
QQVNSYPRT

SEQ ID NO: 35834 - protein, 23 aa, Homo sapiens
  heavy chain complementarity determining region 3 for antibody 17917
ARASMVRGVYITSPYSYSSHMDV

SEQ ID NO: 35835 - protein, 10 aa, Homo sapiens
  light chain complementarity determining region 3 for antibody 17918
QQSYSTLGIT

SEQ ID NO: 35836 - protein, 14 aa, Homo sapiens
  heavy chain complementarity determining region 3 for antibody 17918
ARDQWVAGLKYFDY

SEQ ID NO: 35837 - protein, 9 aa, Homo sapiens
  light chain complementarity determining region 3 for antibody 17919
QQSYSSPLT

SEQ ID NO: 35838 - protein, 14 aa, Homo sapiens
  heavy chain complementarity determining region 3 for antibody 17919
ARYGAYYGYDNFDN

SEQ ID NO: 35839 - protein, 9 aa, Homo sapiens
  light chain complementarity determining region 3 for antibody 17920
QQSNSYPRT

SEQ ID NO: 35840 - protein, 9 aa, Homo sapiens
  heavy chain complementarity determining region 3 for antibody 17920
ARGAKEFEY

SEQ ID NO: 35841 - protein, 9 aa, Homo sapiens
  light chain complementarity determining region 3 for antibody 17921
QPYYTSLRT

SEQ ID NO: 35842 - protein, 12 aa, Homo sapiens
  heavy chain complementarity determining region 3 for antibody 17921
VKDCGLGGSRDS

SEQ ID NO: 35843 - protein, 9 aa, Homo sapiens
  light chain complementarity determining region 3 for antibody 17922
QKYNSAPLT

SEQ ID NO: 35844 - protein, 19 aa, Homo sapiens
  heavy chain complementarity determining region 3 for antibody 17922
ARHQPRGLGISFLTSPFDN

SEQ ID NO: 35845 - protein, 8 aa, Homo sapiens
  light chain complementarity determining region 3 for antibody 17923
MQALQTPL

SEQ ID NO: 35846 - protein, 15 aa, Homo sapiens
  heavy chain complementarity determining region 3 for antibody 17923
AKDYGGNSYYYGMDV

SEQ ID NO: 35847 - protein, 9 aa, Homo sapiens
  light chain complementarity determining region 3 for antibody 17924
MQALETPFT

SEQ ID NO: 35848 - protein, 15 aa, Homo sapiens
  heavy chain complementarity determining region 3 for antibody 17924
VRHYRIIMAPLEGDS

SEQ ID NO: 35849 - protein, 9 aa, Homo sapiens
  light chain complementarity determining region 3 for antibody 17925
LQCHSYPWT

SEQ ID NO: 35850 - protein, 16 aa, Homo sapiens
  heavy chain complementarity determining region 3 for antibody 17925
ARDSRLANYYYHGMDV

SEQ ID NO: 35851 - protein, 9 aa, Homo sapiens
  light chain complementarity determining region 3 for antibody 17926
LHHYAFPRT

SEQ ID NO: 35852 - protein, 8 aa, Homo sapiens
  heavy chain complementarity determining region 3 for antibody 17926
ADIGAGIS

SEQ ID NO: 35853 - protein, 9 aa, Homo sapiens
  light chain complementarity determining region 3 for antibody 17927
QQYYTSPRT

SEQ ID NO: 35854 - protein, 12 aa, Homo sapiens
  heavy chain complementarity determining region 3 for antibody 17927
VKDCGLGGSRDS

SEQ ID NO: 35855 - protein, 9 aa, Homo sapiens
  light chain complementarity determining region 3 for antibody 17928
QQYYSTPGL

SEQ ID NO: 35856 - protein, 16 aa, Homo sapiens
  heavy chain complementarity determining region 3 for antibody 17928
ARSSGGYSSSWYYFDY

SEQ ID NO: 35857 - protein, 9 aa, Homo sapiens
  light chain complementarity determining region 3 for antibody 17929
QQYYNTPWT

SEQ ID NO: 35858 - protein, 17 aa, Homo sapiens
  heavy chain complementarity determining region 3 for antibody 17929
SRQAHFYGTSAYDYPDS

SEQ ID NO: 35859 - protein, 9 aa, Homo sapiens
  light chain complementarity determining region 3 for antibody 17930
QQYYDLPFT

SEQ ID NO: 35860 - protein, 12 aa, Homo sapiens
  heavy chain complementarity determining region 3 for antibody 17930
VRSGHSYSHFDY

SEQ ID NO: 35861 - protein, 9 aa, Homo sapiens
  light chain complementarity determining region 3 for antibody 17931
QQYNSYPYT

SEQ ID NO: 35862 - protein, 13 aa, Homo sapiens
  heavy chain complementarity determining region 3 for antibody 17931
AAEHIVGHISFDY

SEQ ID NO: 35863 - protein, 9 aa, Homo sapiens
  light chain complementarity determining region 3 for antibody 17932
QQYGTPPRP

SEQ ID NO: 35864 - protein, 25 aa, Homo sapiens
  heavy chain complementarity determining region 3 for antibody 17932
ARLRVDRLRLPGAMRGPLYDRGLNV

SEQ ID NO: 35865 - protein, 9 aa, Homo sapiens
  light chain complementarity determining region 3 for antibody 17933
QQYGTIPRT

SEQ ID NO: 35866 - protein, 13 aa, Homo sapiens
  heavy chain complementarity determining region 3 for antibody 17933
AGGNFHRSGYADY

SEQ ID NO: 35867 - protein, 10 aa, Homo sapiens
  light chain complementarity determining region 3 for antibody 17934
QQYGSSSIFT

SEQ ID NO: 35868 - protein, 14 aa, Homo sapiens
  heavy chain complementarity determining region 3 for antibody 17934
TTCVPAASQNTEDY

SEQ ID NO: 35869 - protein, 10 aa, Homo sapiens
  light chain complementarity determining region 3 for antibody 17935
QQYGSSPMDS

SEQ ID NO: 35870 - protein, 11 aa, Homo sapiens
  heavy chain complementarity determining region 3 for antibody 17935
ARGGQWGSLDY

SEQ ID NO: 35871 - protein, 9 aa, Homo sapiens
  light chain complementarity determining region 3 for antibody 17936
QQYGNSPRT

SEQ ID NO: 35872 - protein, 13 aa, Homo sapiens
  heavy chain complementarity determining region 3 for antibody 17936
AGGHYDSGDYRDY

SEQ ID NO: 35873 - protein, 9 aa, Homo sapiens
  light chain complementarity determining region 3 for antibody 17937
QQSYTTPWT

SEQ ID NO: 35874 - protein, 19 aa, Homo sapiens
  heavy chain complementarity determining region 3 for antibody 17937
ACITRGLREVGEWELLSPY

SEQ ID NO: 35875 - protein, 9 aa, Homo sapiens
  light chain complementarity determining region 3 for antibody 17938
QQSDIAPLT

SEQ ID NO: 35876 - protein, 10 aa, Homo sapiens
  heavy chain complementarity determining region 3 for antibody 17938
ASGLGWESGY

SEQ ID NO: 35877 - protein, 10 aa, Homo sapiens
  light chain complementarity determining region 3 for antibody 17939
QQRYNWPPLT

SEQ ID NO: 35878 - protein, 11 aa, Homo sapiens
  heavy chain complementarity determining region 3 for antibody 17939
ARGVGSYPFDS

SEQ ID NO: 35879 - protein, 9 aa, Homo sapiens
  light chain complementarity determining region 3 for antibody 17940
QQRSNWPPT

SEQ ID NO: 35880 - protein, 17 aa, Homo sapiens
  heavy chain complementarity determining region 3 for antibody 17940
ARGKGSSGSYYPYYFDY

SEQ ID NO: 35881 - protein, 10 aa, Homo sapiens
  light chain complementarity determining region 3 for antibody 17941
QQFGGSPSYT

SEQ ID NO: 35882 - protein, 16 aa, Homo sapiens
  heavy chain complementarity determining region 3 for antibody 17941
ARGPVMLTAVRSWFDP

SEQ ID NO: 35883 - protein, 9 aa, Homo sapiens
  light chain complementarity determining region 3 for antibody 17942
QNYDGPPLT

SEQ ID NO: 35884 - protein, 21 aa, Homo sapiens
  heavy chain complementarity determining region 3 for antibody 17942
AKDLYHLNTVRPSDQAGGLDF

SEQ ID NO: 35885 - protein, 9 aa, Homo sapiens
  light chain complementarity determining region 3 for antibody 17943
QKYDSAPLT

SEQ ID NO: 35886 - protein, 19 aa, Homo sapiens
  heavy chain complementarity determining region 3 for antibody 17943
AREQGDDVVTAAPRGGFDY

SEQ ID NO: 35887 - protein, 12 aa, Homo sapiens
  light chain complementarity determining region 3 for antibody 17944
QHYNDWPPGRGP

SEQ ID NO: 35888 - protein, 14 aa, Homo sapiens
  heavy chain complementarity determining region 3 for antibody 17944
ARDLSSTSSWYFDY

SEQ ID NO: 35889 - protein, 8 aa, Homo sapiens
  light chain complementarity determining region 3 for antibody 17945
MQSTQWPT

SEQ ID NO: 35890 - protein, 21 aa, Homo sapiens
  heavy chain complementarity determining region 3 for antibody 17945
AKDRPNYYGSNAGYYTPGGDR

SEQ ID NO: 35891 - protein, 8 aa, Homo sapiens
  light chain complementarity determining region 3 for antibody 17946
MQGTHWPT

SEQ ID NO: 35892 - protein, 21 aa, Homo sapiens
  heavy chain complementarity determining region 3 for antibody 17946
AKDRPNYYENNGHYYTPKGDL

SEQ ID NO: 35893 - protein, 8 aa, Homo sapiens
  light chain complementarity determining region 3 for antibody 17947
MQGTDWPT

SEQ ID NO: 35894 - protein, 21 aa, Homo sapiens
  heavy chain complementarity determining region 3 for antibody 17947
AKDRPNYYGSNGQYYTPKGDL

SEQ ID NO: 35895 - protein, 9 aa, Homo sapiens
  light chain complementarity determining region 3 for antibody 17948
MQALQTPST

SEQ ID NO: 35896 - protein, 20 aa, Homo sapiens
  heavy chain complementarity determining region 3 for antibody 17948
ARLYCGSTTCYENYYYGLDV

SEQ ID NO: 35897 - protein, 9 aa, Homo sapiens
  light chain complementarity determining region 3 for antibody 17949
MQALETPFT

SEQ ID NO: 35898 - protein, 15 aa, Homo sapiens
  heavy chain complementarity determining region 3 for antibody 17949
VSHYRIITAPLEGDS

SEQ ID NO: 35899 - protein, 9 aa, Homo sapiens
  light chain complementarity determining region 3 for antibody 17950
MQALETPFS

SEQ ID NO: 35900 - protein, 15 aa, Homo sapiens
  heavy chain complementarity determining region 3 for antibody 17950
VRHYRETVAGIEGDC

SEQ ID NO: 35901 - protein, 9 aa, Homo sapiens
  light chain complementarity determining region 3 for antibody 17951
MPALETPFT

SEQ ID NO: 35902 - protein, 15 aa, Homo sapiens
  heavy chain complementarity determining region 3 for antibody 17951
VRHYRIITAPLEGDS

SEQ ID NO: 35903 - protein, 11 aa, Homo sapiens
  light chain complementarity determining region 3 for antibody 17952
QQYYTSLLGFT

SEQ ID NO: 35904 - protein, 12 aa, Homo sapiens
  heavy chain complementarity determining region 3 for antibody 17952
ATSPSPYYHLDF

SEQ ID NO: 35905 - protein, 9 aa, Homo sapiens
  light chain complementarity determining region 3 for antibody 17953
QQYNSYSYT

SEQ ID NO: 35906 - protein, 14 aa, Homo sapiens
  heavy chain complementarity determining region 3 for antibody 17953
AKAHSMVRRYYFDY

SEQ ID NO: 35907 - protein, 10 aa, Homo sapiens
  light chain complementarity determining region 3 for antibody 17954
QQYGTSVLVS

SEQ ID NO: 35908 - protein, 14 aa, Homo sapiens
  heavy chain complementarity determining region 3 for antibody 17954
ARDPIAAHPDYFDY

SEQ ID NO: 35909 - protein, 9 aa, Homo sapiens
  light chain complementarity determining region 3 for antibody 17955
QQYGTPPRT

SEQ ID NO: 35910 - protein, 13 aa, Homo sapiens
  heavy chain complementarity determining region 3 for antibody 17955
ACGYYEGGRYYEY

SEQ ID NO: 35911 - protein, 10 aa, Homo sapiens
  light chain complementarity determining region 3 for antibody 17956
QQYGSSPPGT

SEQ ID NO: 35912 - protein, 15 aa, Homo sapiens
  heavy chain complementarity determining region 3 for antibody 17956
AKGPMVRGVLGPFDY

SEQ ID NO: 35913 - protein, 9 aa, Homo sapiens
  light chain complementarity determining region 3 for antibody 17957
QQYGNLPRT

SEQ ID NO: 35914 - protein, 13 aa, Homo sapiens
  heavy chain complementarity determining region 3 for antibody 17957
AGGLFHSSGYSEF

SEQ ID NO: 35915 - protein, 9 aa, Homo sapiens
  light chain complementarity determining region 3 for antibody 17958
QQYGNLPRT

SEQ ID NO: 35916 - protein, 13 aa, Homo sapiens
  heavy chain complementarity determining region 3 for antibody 17958
AGGEFHRGGYSEF

SEQ ID NO: 35917 - protein, 9 aa, Homo sapiens
  light chain complementarity determining region 3 for antibody 17959
QQTYIPPRT

SEQ ID NO: 35918 - protein, 21 aa, Homo sapiens
  heavy chain complementarity determining region 3 for antibody 17959
SRVTVRVPSTTGFGQYYGLDV

SEQ ID NO: 35919 - protein, 9 aa, Homo sapiens
  light chain complementarity determining region 3 for antibody 17960
QQSYSTPRT

SEQ ID NO: 35920 - protein, 14 aa, Homo sapiens
  heavy chain complementarity determining region 3 for antibody 17960
ARDSIRGGEYYFDY

SEQ ID NO: 35921 - protein, 9 aa, Homo sapiens
  light chain complementarity determining region 3 for antibody 17961
QQSYSSPFT

SEQ ID NO: 35922 - protein, 13 aa, Homo sapiens
  heavy chain complementarity determining region 3 for antibody 17961
ARKGDYYYYGMDV

SEQ ID NO: 35923 - protein, 9 aa, Homo sapiens
  light chain complementarity determining region 3 for antibody 17962
QQSYRTAFT

SEQ ID NO: 35924 - protein, 12 aa, Homo sapiens
  heavy chain complementarity determining region 3 for antibody 17962
VKDCGLGGSRDS

SEQ ID NO: 35925 - protein, 10 aa, Homo sapiens
  light chain complementarity determining region 3 for antibody 17963
QQRSTWFPYT

SEQ ID NO: 35926 - protein, 16 aa, Homo sapiens
  heavy chain complementarity determining region 3 for antibody 17963
ARGSSDYDNPGSWLDP

SEQ ID NO: 35927 - protein, 9 aa, Homo sapiens
  light chain complementarity determining region 3 for antibody 17964
QQLDSYPIT

SEQ ID NO: 35928 - protein, 10 aa, Homo sapiens
  heavy chain complementarity determining region 3 for antibody 17964
STEVAADDDY

SEQ ID NO: 35929 - protein, 9 aa, Homo sapiens
  light chain complementarity determining region 3 for antibody 17965
QQDGTSPRT

SEQ ID NO: 35930 - protein, 13 aa, Homo sapiens
  heavy chain complementarity determining region 3 for antibody 17965
PIGFYDRSGYHEY

SEQ ID NO: 35931 - protein, 9 aa, Homo sapiens
  light chain complementarity determining region 3 for antibody 17966
QQANSFPVT

SEQ ID NO: 35932 - protein, 20 aa, Homo sapiens
  heavy chain complementarity determining region 3 for antibody 17966
VKDTIPYDSRGYYRRHFFDY

SEQ ID NO: 35933 - protein, 9 aa, Homo sapiens
  light chain complementarity determining region 3 for antibody 17967
QQAHSFPYT

SEQ ID NO: 35934 - protein, 20 aa, Homo sapiens
  heavy chain complementarity determining region 3 for antibody 17967
ARTTYYYDRSGLSLFYKFDY

SEQ ID NO: 35935 - protein, 11 aa, Homo sapiens
  light chain complementarity determining region 3 for antibody 17968
QLYETSPPGNT

SEQ ID NO: 35936 - protein, 14 aa, Homo sapiens
  heavy chain complementarity determining region 3 for antibody 17968
ARENSISRKRSFDQ

SEQ ID NO: 35937 - protein, 9 aa, Homo sapiens
  light chain complementarity determining region 3 for antibody 17969
QHYAFSPYV

SEQ ID NO: 35938 - protein, 15 aa, Homo sapiens
  heavy chain complementarity determining region 3 for antibody 17969
ARESRSQVGEVLVDY

SEQ ID NO: 35939 - protein, 8 aa, Homo sapiens
  light chain complementarity determining region 3 for antibody 17970
QHFGISVS

SEQ ID NO: 35940 - protein, 20 aa, Homo sapiens
  heavy chain complementarity determining region 3 for antibody 17970
ARQRAGDWWELLNGVEAFDL

SEQ ID NO: 35941 - protein, 9 aa, Homo sapiens
  light chain complementarity determining region 3 for antibody 17971
MQGTHWPLG

SEQ ID NO: 35942 - protein, 18 aa, Homo sapiens
  heavy chain complementarity determining region 3 for antibody 17971
ARDERDTCTTDLCYYFDY

SEQ ID NO: 35943 - protein, 9 aa, Homo sapiens
  light chain complementarity determining region 3 for antibody 17972
MQGLQTPYT

SEQ ID NO: 35944 - protein, 10 aa, Homo sapiens
  heavy chain complementarity determining region 3 for antibody 17972
VGELVGSRDS

SEQ ID NO: 35945 - protein, 9 aa, Homo sapiens
  light chain complementarity determining region 3 for antibody 17973
MQALETPFT

SEQ ID NO: 35946 - protein, 15 aa, Homo sapiens
  heavy chain complementarity determining region 3 for antibody 17973
VRHYRISTAPLEGDS

SEQ ID NO: 35947 - protein, 9 aa, Homo sapiens
  light chain complementarity determining region 3 for antibody 17974
LQHNTYPWT

SEQ ID NO: 35948 - protein, 23 aa, Homo sapiens
  heavy chain complementarity determining region 3 for antibody 17974
ARDRRTLIAARTRHDFNYYVMDV

SEQ ID NO: 35949 - protein, 9 aa, Homo sapiens
  light chain complementarity determining region 3 for antibody 17975
HQYYSTPPT

SEQ ID NO: 35950 - protein, 16 aa, Homo sapiens
  heavy chain complementarity determining region 3 for antibody 17975
ARSLTTSPAGEKWFDS

SEQ ID NO: 35951 - protein, 9 aa, Homo sapiens
  light chain complementarity determining region 3 for antibody 17976
RQYGSFPYT

SEQ ID NO: 35952 - protein, 14 aa, Homo sapiens
  heavy chain complementarity determining region 3 for antibody 17976
ARGGFIVAWGLFDY

SEQ ID NO: 35953 - protein, 8 aa, Homo sapiens
  light chain complementarity determining region 3 for antibody 17977
QQYYSTPT

SEQ ID NO: 35954 - protein, 16 aa, Homo sapiens
  heavy chain complementarity determining region 3 for antibody 17977
ARSIAAGPAANGWFDP

SEQ ID NO: 35955 - protein, 9 aa, Homo sapiens
  light chain complementarity determining region 3 for antibody 17978
QQYYRYPVT

SEQ ID NO: 35956 - protein, 15 aa, Homo sapiens
  heavy chain complementarity determining region 3 for antibody 17978
AHGQHTTTVTSYFNY

SEQ ID NO: 35957 - protein, 8 aa, Homo sapiens
  light chain complementarity determining region 3 for antibody 17979
QQYTDFFS

SEQ ID NO: 35958 - protein, 12 aa, Homo sapiens
  heavy chain complementarity determining region 3 for antibody 17979
ARILWHRAAFDI

SEQ ID NO: 35959 - protein, 10 aa, Homo sapiens
  light chain complementarity determining region 3 for antibody 17980
QQYNQWPPLP

SEQ ID NO: 35960 - protein, 17 aa, Homo sapiens
  heavy chain complementarity determining region 3 for antibody 17980
ARDLYFSIIQGGGAFDA

SEQ ID NO: 35961 - protein, 9 aa, Homo sapiens
  light chain complementarity determining region 3 for antibody 17981
QQYGSSPLP

SEQ ID NO: 35962 - protein, 19 aa, Homo sapiens
  heavy chain complementarity determining region 3 for antibody 17981
ARGSSSSRRRAAVVGYFDL

SEQ ID NO: 35963 - protein, 9 aa, Homo sapiens
  light chain complementarity determining region 3 for antibody 17982
QQYGSLPRT

SEQ ID NO: 35964 - protein, 13 aa, Homo sapiens
  heavy chain complementarity determining region 3 for antibody 17982
AGGGFSSGRYSEY

SEQ ID NO: 35965 - protein, 9 aa, Homo sapiens
  light chain complementarity determining region 3 for antibody 17983
QQYGSLPLT

SEQ ID NO: 35966 - protein, 7 aa, Homo sapiens
  heavy chain complementarity determining region 3 for antibody 17983
HGYELKC

SEQ ID NO: 35967 - protein, 9 aa, Homo sapiens
  light chain complementarity determining region 3 for antibody 17984
QQYGSIPRT

SEQ ID NO: 35968 - protein, 13 aa, Homo sapiens
  heavy chain complementarity determining region 3 for antibody 17984
AGGLFHAMGYSEY

SEQ ID NO: 35969 - protein, 9 aa, Homo sapiens
  light chain complementarity determining region 3 for antibody 17985
QQYGRIPRT

SEQ ID NO: 35970 - protein, 14 aa, Homo sapiens
  heavy chain complementarity determining region 3 for antibody 17985
AGGEFSSGWHYSEN

SEQ ID NO: 35971 - protein, 9 aa, Homo sapiens
  light chain complementarity determining region 3 for antibody 17986
QQYCSIPWT

SEQ ID NO: 35972 - protein, 14 aa, Homo sapiens
  heavy chain complementarity determining region 3 for antibody 17986
AKCASNYGNDAFDI

SEQ ID NO: 35973 - protein, 9 aa, Homo sapiens
  light chain complementarity determining region 3 for antibody 17987
QQTYSTPLT

SEQ ID NO: 35974 - protein, 16 aa, Homo sapiens
  heavy chain complementarity determining region 3 for antibody 17987
ARVRATVTTQALGVDS

SEQ ID NO: 35975 - protein, 10 aa, Homo sapiens
  light chain complementarity determining region 3 for antibody 17988
QQRYNWPPYT

SEQ ID NO: 35976 - protein, 11 aa, Homo sapiens
  heavy chain complementarity determining region 3 for antibody 17988
ARGVGSYVFDS

SEQ ID NO: 35977 - protein, 10 aa, Homo sapiens
  light chain complementarity determining region 3 for antibody 17989
QQRYNWPPYP

SEQ ID NO: 35978 - protein, 11 aa, Homo sapiens
  heavy chain complementarity determining region 3 for antibody 17989
ARGVGSYVFES

SEQ ID NO: 35979 - protein, 11 aa, Homo sapiens
  light chain complementarity determining region 3 for antibody 17990
QQFTNWPPLFT

SEQ ID NO: 35980 - protein, 14 aa, Homo sapiens
  heavy chain complementarity determining region 3 for antibody 17990
ARLNGIVGYYAFDM

SEQ ID NO: 35981 - protein, 9 aa, Homo sapiens
  light chain complementarity determining region 3 for antibody 17991
QQDGSSPRT

SEQ ID NO: 35982 - protein, 25 aa, Homo sapiens
  heavy chain complementarity determining region 3 for antibody 17991
ARLRIDRLRLPGAMRGPLYDCGLNV

SEQ ID NO: 35983 - protein, 9 aa, Homo sapiens
  light chain complementarity determining region 3 for antibody 17992
QKYNSALLT

SEQ ID NO: 35984 - protein, 17 aa, Homo sapiens
  heavy chain complementarity determining region 3 for antibody 17992
ARHRHYYGSGNYHPFDY

SEQ ID NO: 35985 - protein, 9 aa, Homo sapiens
  light chain complementarity determining region 3 for antibody 17993
QKYGTSPRP

SEQ ID NO: 35986 - protein, 13 aa, Homo sapiens
  heavy chain complementarity determining region 3 for antibody 17993
AGGHYHSSSYSEF

SEQ ID NO: 35987 - protein, 10 aa, Homo sapiens
  light chain complementarity determining region 3 for antibody 17994
QHYHNWPPWT

SEQ ID NO: 35988 - protein, 13 aa, Homo sapiens
  heavy chain complementarity determining region 3 for antibody 17994
AKGRVRELYYFET

SEQ ID NO: 35989 - protein, 9 aa, Homo sapiens
  light chain complementarity determining region 3 for antibody 17995
MQGLRTPGT

SEQ ID NO: 35990 - protein, 23 aa, Homo sapiens
  heavy chain complementarity determining region 3 for antibody 17995
ARERAYASGPYYSPLYYYYGVDT

SEQ ID NO: 35991 - protein, 9 aa, Homo sapiens
  light chain complementarity determining region 3 for antibody 17996
MQALQTGHT

SEQ ID NO: 35992 - protein, 17 aa, Homo sapiens
  heavy chain complementarity determining region 3 for antibody 17996
ARDVGRHCSGSGCHHDY

SEQ ID NO: 35993 - protein, 9 aa, Homo sapiens
  light chain complementarity determining region 3 for antibody 17997
MQALETPFK

SEQ ID NO: 35994 - protein, 15 aa, Homo sapiens
  heavy chain complementarity determining region 3 for antibody 17997
VRHYRETVAGIEGDS

SEQ ID NO: 35995 - protein, 9 aa, Homo sapiens
  light chain complementarity determining region 3 for antibody 17998
MQALENPFT

SEQ ID NO: 35996 - protein, 15 aa, Homo sapiens
  heavy chain complementarity determining region 3 for antibody 17998
VRHYRIITAPLEGDS

SEQ ID NO: 35997 - protein, 9 aa, Homo sapiens
  light chain complementarity determining region 3 for antibody 17999
LQYYATPWT

SEQ ID NO: 35998 - protein, 15 aa, Homo sapiens
  heavy chain complementarity determining region 3 for antibody 17999
VRQSKVDNNYNYPDF

SEQ ID NO: 35999 - protein, 9 aa, Homo sapiens
  light chain complementarity determining region 3 for antibody 18000
LQHNSYPLT

SEQ ID NO: 36000 - protein, 14 aa, Homo sapiens
  heavy chain complementarity determining region 3 for antibody 18000
AGCGGNSGKYYFDY

SEQ ID NO: 36001 - protein, 9 aa, Homo sapiens
  light chain complementarity determining region 3 for antibody 18001
LQHNSYPLP

SEQ ID NO: 36002 - protein, 13 aa, Homo sapiens
  heavy chain complementarity determining region 3 for antibody 18001
VRHAVVRPMVVDD

SEQ ID NO: 36003 - protein, 9 aa, Homo sapiens
  light chain complementarity determining region 3 for antibody 18002
HQYGSSPRT

SEQ ID NO: 36004 - protein, 17 aa, Homo sapiens
  heavy chain complementarity determining region 3 for antibody 18002
TTDPQWLTPPPFVTNDY

SEQ ID NO: 36005 - protein, 9 aa, Homo sapiens
  light chain complementarity determining region 3 for antibody 18003
HHTSTFPRP

SEQ ID NO: 36006 - protein, 20 aa, Homo sapiens
  heavy chain complementarity determining region 3 for antibody 18003
ARGRRIAALSTAHYYYGMDV

SEQ ID NO: 36007 - protein, 8 aa, Homo sapiens
  light chain complementarity determining region 3 for antibody 18004
QQYYTSWT

SEQ ID NO: 36008 - protein, 15 aa, Homo sapiens
  heavy chain complementarity determining region 3 for antibody 18004
ARAMTPKWELAFYDY

SEQ ID NO: 36009 - protein, 9 aa, Homo sapiens
  light chain complementarity determining region 3 for antibody 18005
QQYYSIPWT

SEQ ID NO: 36010 - protein, 14 aa, Homo sapiens
  heavy chain complementarity determining region 3 for antibody 18005
AKCGYSYGNDAFDI

SEQ ID NO: 36011 - protein, 10 aa, Homo sapiens
  light chain complementarity determining region 3 for antibody 18006
QQYYGTPPYS

SEQ ID NO: 36012 - protein, 17 aa, Homo sapiens
  heavy chain complementarity determining region 3 for antibody 18006
AKGVSFDNGWTDWYFDL

SEQ ID NO: 36013 - protein, 9 aa, Homo sapiens
  light chain complementarity determining region 3 for antibody 18007
QQYNSYPWT

SEQ ID NO: 36014 - protein, 10 aa, Homo sapiens
  heavy chain complementarity determining region 3 for antibody 18007
AMSGGGQWDY

SEQ ID NO: 36015 - protein, 8 aa, Homo sapiens
  light chain complementarity determining region 3 for antibody 18008
QQYHSLLT

SEQ ID NO: 36016 - protein, 24 aa, Homo sapiens
  heavy chain complementarity determining region 3 for antibody 18008
ARQSVGNGGHSNSWYHTSLYLMDV

SEQ ID NO: 36017 - protein, 9 aa, Homo sapiens
  light chain complementarity determining region 3 for antibody 18009
QQYGSSPRT

SEQ ID NO: 36018 - protein, 25 aa, Homo sapiens
  heavy chain complementarity determining region 3 for antibody 18009
ASLRIDRLRLPGAMRGPLYDCGLNV

SEQ ID NO: 36019 - protein, 9 aa, Homo sapiens
  light chain complementarity determining region 3 for antibody 18010
QQYGSSPPT

SEQ ID NO: 36020 - protein, 16 aa, Homo sapiens
  heavy chain complementarity determining region 3 for antibody 18010
ARDFHPMAASDTAYDS

SEQ ID NO: 36021 - protein, 10 aa, Homo sapiens
  light chain complementarity determining region 3 for antibody 18011
QQYGSSPMSS

SEQ ID NO: 36022 - protein, 11 aa, Homo sapiens
  heavy chain complementarity determining region 3 for antibody 18011
ARGGQWGSLDY

SEQ ID NO: 36023 - protein, 9 aa, Homo sapiens
  light chain complementarity determining region 3 for antibody 18012
QQYGNLPRT

SEQ ID NO: 36024 - protein, 13 aa, Homo sapiens
  heavy chain complementarity determining region 3 for antibody 18012
AGGQFHTSGYSDF

SEQ ID NO: 36025 - protein, 9 aa, Homo sapiens
  light chain complementarity determining region 3 for antibody 18013
QQYGNLPRT

SEQ ID NO: 36026 - protein, 14 aa, Homo sapiens
  heavy chain complementarity determining region 3 for antibody 18013
AGGDFHRGGGYSDF

SEQ ID NO: 36027 - protein, 9 aa, Homo sapiens
  light chain complementarity determining region 3 for antibody 18014
QQYFTSLRT

SEQ ID NO: 36028 - protein, 12 aa, Homo sapiens
  heavy chain complementarity determining region 3 for antibody 18014
VKDCGLGGSRDS

SEQ ID NO: 36029 - protein, 8 aa, Homo sapiens
  light chain complementarity determining region 3 for antibody 18015
QQYDYLPA

SEQ ID NO: 36030 - protein, 12 aa, Homo sapiens
  heavy chain complementarity determining region 3 for antibody 18015
ARSNWNIIAFDL

SEQ ID NO: 36031 - protein, 9 aa, Homo sapiens
  light chain complementarity determining region 3 for antibody 18016
QQVDTYPYT

SEQ ID NO: 36032 - protein, 7 aa, Homo sapiens
  heavy chain complementarity determining region 3 for antibody 18016
ARGLWGP

SEQ ID NO: 36033 - protein, 8 aa, Homo sapiens
  light chain complementarity determining region 3 for antibody 18017
QQSHTTLT

SEQ ID NO: 36034 - protein, 12 aa, Homo sapiens
  heavy chain complementarity determining region 3 for antibody 18017
ARRGGFGRTFDF

SEQ ID NO: 36035 - protein, 9 aa, Homo sapiens
  light chain complementarity determining region 3 for antibody 18018
QQSFDTPYT

SEQ ID NO: 36036 - protein, 14 aa, Homo sapiens
  heavy chain complementarity determining region 3 for antibody 18018
ARGTSGTHSDYLDH

SEQ ID NO: 36037 - protein, 10 aa, Homo sapiens
  light chain complementarity determining region 3 for antibody 18019
QQRYNWPPVT

SEQ ID NO: 36038 - protein, 11 aa, Homo sapiens
  heavy chain complementarity determining region 3 for antibody 18019
ARGVGSYPFDS

SEQ ID NO: 36039 - protein, 10 aa, Homo sapiens
  light chain complementarity determining region 3 for antibody 18020
QQRSNWLPIT

SEQ ID NO: 36040 - protein, 17 aa, Homo sapiens
  heavy chain complementarity determining region 3 for antibody 18020
TTGTEDSGWYSFRYFAL

SEQ ID NO: 36041 - protein, 10 aa, Homo sapiens
  light chain complementarity determining region 3 for antibody 18021
QQRSKRPPLT

SEQ ID NO: 36042 - protein, 9 aa, Homo sapiens
  heavy chain complementarity determining region 3 for antibody 18021
ARVDGYFDY

SEQ ID NO: 36043 - protein, 9 aa, Homo sapiens
  light chain complementarity determining region 3 for antibody 18022
QQRNNWPRT

SEQ ID NO: 36044 - protein, 13 aa, Homo sapiens
  heavy chain complementarity determining region 3 for antibody 18022
AKDLGSLRYDFDY

SEQ ID NO: 36045 - protein, 9 aa, Homo sapiens
  light chain complementarity determining region 3 for antibody 18023
QQLNSNPLT

SEQ ID NO: 36046 - protein, 18 aa, Homo sapiens
  heavy chain complementarity determining region 3 for antibody 18023
AKHFYGSGNARKFYSLDV

SEQ ID NO: 36047 - protein, 11 aa, Homo sapiens
  light chain complementarity determining region 3 for antibody 18024
QLYETSPPGDT

SEQ ID NO: 36048 - protein, 14 aa, Homo sapiens
  heavy chain complementarity determining region 3 for antibody 18024
ARENSISRKRSFDQ

SEQ ID NO: 36049 - protein, 10 aa, Homo sapiens
  light chain complementarity determining region 3 for antibody 18025
QLRDKWPPVI

SEQ ID NO: 36050 - protein, 12 aa, Homo sapiens
  heavy chain complementarity determining region 3 for antibody 18025
VRDGRSGWHFDS

SEQ ID NO: 36051 - protein, 9 aa, Homo sapiens
  light chain complementarity determining region 3 for antibody 18026
QHYGTSPFT

SEQ ID NO: 36052 - protein, 15 aa, Homo sapiens
  heavy chain complementarity determining region 3 for antibody 18026
ARQNDFLSGPGEFDP

SEQ ID NO: 36053 - protein, 9 aa, Homo sapiens
  light chain complementarity determining region 3 for antibody 18027
MQVLQAPLS

SEQ ID NO: 36054 - protein, 18 aa, Homo sapiens
  heavy chain complementarity determining region 3 for antibody 18027
ARPKVGATDYHYYFGIDV

SEQ ID NO: 36055 - protein, 9 aa, Homo sapiens
  light chain complementarity determining region 3 for antibody 18028
MQSTQSPLT

SEQ ID NO: 36056 - protein, 9 aa, Homo sapiens
  heavy chain complementarity determining region 3 for antibody 18028
ARGSRILHY

SEQ ID NO: 36057 - protein, 9 aa, Homo sapiens
  light chain complementarity determining region 3 for antibody 18029
MQSTHWPYT

SEQ ID NO: 36058 - protein, 10 aa, Homo sapiens
  heavy chain complementarity determining region 3 for antibody 18029
ARYSSDWESY

SEQ ID NO: 36059 - protein, 9 aa, Homo sapiens
  light chain complementarity determining region 3 for antibody 18030
MQPLHTPIT

SEQ ID NO: 36060 - protein, 18 aa, Homo sapiens
  heavy chain complementarity determining region 3 for antibody 18030
ARPFYDSYTYHYYYGLDV

SEQ ID NO: 36061 - protein, 9 aa, Homo sapiens
  light chain complementarity determining region 3 for antibody 18031
MQGTNWPWT

SEQ ID NO: 36062 - protein, 12 aa, Homo sapiens
  heavy chain complementarity determining region 3 for antibody 18031
ATSFTLFGVDDS

SEQ ID NO: 36063 - protein, 9 aa, Homo sapiens
  light chain complementarity determining region 3 for antibody 18032
MQGIHWPGT

SEQ ID NO: 36064 - protein, 7 aa, Homo sapiens
  heavy chain complementarity determining region 3 for antibody 18032
ARGWGAY

SEQ ID NO: 36065 - protein, 8 aa, Homo sapiens
  light chain complementarity determining region 3 for antibody 18033
MQALQTRV

SEQ ID NO: 36066 - protein, 20 aa, Homo sapiens
  heavy chain complementarity determining region 3 for antibody 18033
ARERGRHSSGPLHYYNGLDV

SEQ ID NO: 36067 - protein, 9 aa, Homo sapiens
  light chain complementarity determining region 3 for antibody 18034
MQALQTPIT

SEQ ID NO: 36068 - protein, 24 aa, Homo sapiens
  heavy chain complementarity determining region 3 for antibody 18034
VTAPPYYYDSAGDSPIGRDWYFDL

SEQ ID NO: 36069 - protein, 9 aa, Homo sapiens
  light chain complementarity determining region 3 for antibody 18035
MQALETQFT

SEQ ID NO: 36070 - protein, 15 aa, Homo sapiens
  heavy chain complementarity determining region 3 for antibody 18035
VRHYRETVAGIEGDS

SEQ ID NO: 36071 - protein, 9 aa, Homo sapiens
  light chain complementarity determining region 3 for antibody 18036
MQALETPLP

SEQ ID NO: 36072 - protein, 15 aa, Homo sapiens
  heavy chain complementarity determining region 3 for antibody 18036
VRHYRETVAGIEGDS

SEQ ID NO: 36073 - protein, 9 aa, Homo sapiens
  light chain complementarity determining region 3 for antibody 18037
MQALETPFT

SEQ ID NO: 36074 - protein, 15 aa, Homo sapiens
  heavy chain complementarity determining region 3 for antibody 18037
VRHYRETVAGREGDS

SEQ ID NO: 36075 - protein, 9 aa, Homo sapiens
  light chain complementarity determining region 3 for antibody 18038
MQALETPFT

SEQ ID NO: 36076 - protein, 15 aa, Homo sapiens
  heavy chain complementarity determining region 3 for antibody 18038
VRHDRETVAGIEGDS

SEQ ID NO: 36077 - protein, 9 aa, Homo sapiens
  light chain complementarity determining region 3 for antibody 18039
MQALESPFT

SEQ ID NO: 36078 - protein, 15 aa, Homo sapiens
  heavy chain complementarity determining region 3 for antibody 18039
VRHYRETVAGIEGDS

SEQ ID NO: 36079 - protein, 9 aa, Homo sapiens
  light chain complementarity determining region 3 for antibody 18040
MQALATPFT

SEQ ID NO: 36080 - protein, 15 aa, Homo sapiens
  heavy chain complementarity determining region 3 for antibody 18040
VRHYRIITAPLEGDS

SEQ ID NO: 36081 - protein, 9 aa, Homo sapiens
  light chain complementarity determining region 3 for antibody 18041
LQYGFAQYR

SEQ ID NO: 36082 - protein, 18 aa, Homo sapiens
  heavy chain complementarity determining region 3 for antibody 18041
TGVHGLTMLRGATKPFDF

SEQ ID NO: 36083 - protein, 9 aa, Homo sapiens
  light chain complementarity determining region 3 for antibody 18042
QQYYTSVRT

SEQ ID NO: 36084 - protein, 12 aa, Homo sapiens
  heavy chain complementarity determining region 3 for antibody 18042
VKDCGLGGPRDY

SEQ ID NO: 36085 - protein, 9 aa, Homo sapiens
  light chain complementarity determining region 3 for antibody 18043
QQYYNAPWT

SEQ ID NO: 36086 - protein, 12 aa, Homo sapiens
  heavy chain complementarity determining region 3 for antibody 18043
ARLFHRGNFFDH

SEQ ID NO: 36087 - protein, 8 aa, Homo sapiens
  light chain complementarity determining region 3 for antibody 18044
QQYSNYRT

SEQ ID NO: 36088 - protein, 12 aa, Homo sapiens
  heavy chain complementarity determining region 3 for antibody 18044
ATSSQLVYYFDY

SEQ ID NO: 36089 - protein, 10 aa, Homo sapiens
  light chain complementarity determining region 3 for antibody 18045
QQYNNWLGGT

SEQ ID NO: 36090 - protein, 13 aa, Homo sapiens
  heavy chain complementarity determining region 3 for antibody 18045
ARHGRRSGWYYTY

SEQ ID NO: 36091 - protein, 9 aa, Homo sapiens
  light chain complementarity determining region 3 for antibody 18046
QQYNNWFYT

SEQ ID NO: 36092 - protein, 14 aa, Homo sapiens
  heavy chain complementarity determining region 3 for antibody 18046
ARDWRRDGRPDIDY

SEQ ID NO: 36093 - protein, 8 aa, Homo sapiens
  light chain complementarity determining region 3 for antibody 18047
QQYNIYWT

SEQ ID NO: 36094 - protein, 14 aa, Homo sapiens
  heavy chain complementarity determining region 3 for antibody 18047
AVLGSNWQVYNFDY

SEQ ID NO: 36095 - protein, 9 aa, Homo sapiens
  light chain complementarity determining region 3 for antibody 18048
QQYGSSPRT

SEQ ID NO: 36096 - protein, 14 aa, Homo sapiens
  heavy chain complementarity determining region 3 for antibody 18048
AGGRFSSGSSYSDN

SEQ ID NO: 36097 - protein, 10 aa, Homo sapiens
  light chain complementarity determining region 3 for antibody 18049
QQYGSSPPVP

SEQ ID NO: 36098 - protein, 15 aa, Homo sapiens
  heavy chain complementarity determining region 3 for antibody 18049
AKGPMVRGVLGPFDY

SEQ ID NO: 36099 - protein, 10 aa, Homo sapiens
  light chain complementarity determining region 3 for antibody 18050
QQYGSSPLYS

SEQ ID NO: 36100 - protein, 11 aa, Homo sapiens
  heavy chain complementarity determining region 3 for antibody 18050
ARGGQWGSLDY

SEQ ID NO: 36101 - protein, 9 aa, Homo sapiens
  light chain complementarity determining region 3 for antibody 18051
QQYGSLPRT

SEQ ID NO: 36102 - protein, 13 aa, Homo sapiens
  heavy chain complementarity determining region 3 for antibody 18051
AGGSFSGGNYKED

SEQ ID NO: 36103 - protein, 9 aa, Homo sapiens
  light chain complementarity determining region 3 for antibody 18052
QQYGSFPLT

SEQ ID NO: 36104 - protein, 7 aa, Homo sapiens
  heavy chain complementarity determining region 3 for antibody 18052
HGYELKC

SEQ ID NO: 36105 - protein, 9 aa, Homo sapiens
  light chain complementarity determining region 3 for antibody 18053
QQYGNSLWT

SEQ ID NO: 36106 - protein, 25 aa, Homo sapiens
  heavy chain complementarity determining region 3 for antibody 18053
ARRGPRIGSGWYSQDRDGINWFFDL

SEQ ID NO: 36107 - protein, 9 aa, Homo sapiens
  light chain complementarity determining region 3 for antibody 18054
QQYGNLPRT

SEQ ID NO: 36108 - protein, 13 aa, Homo sapiens
  heavy chain complementarity determining region 3 for antibody 18054
AGGQFHSSGYSDF

SEQ ID NO: 36109 - protein, 8 aa, Homo sapiens
  light chain complementarity determining region 3 for antibody 18055
QQYGGSPR

SEQ ID NO: 36110 - protein, 16 aa, Homo sapiens
  heavy chain complementarity determining region 3 for antibody 18055
ATDWGSGTQWIRAFDV

SEQ ID NO: 36111 - protein, 11 aa, Homo sapiens
  light chain complementarity determining region 3 for antibody 18056
QQYDTSPPGDT

SEQ ID NO: 36112 - protein, 14 aa, Homo sapiens
  heavy chain complementarity determining region 3 for antibody 18056
ARETSNSRKRSFDQ

SEQ ID NO: 36113 - protein, 8 aa, Homo sapiens
  light chain complementarity determining region 3 for antibody 18057
QQYDSYST

SEQ ID NO: 36114 - protein, 17 aa, Homo sapiens
  heavy chain complementarity determining region 3 for antibody 18057
ARRYGVSVDYPWSPFIS

SEQ ID NO: 36115 - protein, 10 aa, Homo sapiens
  light chain complementarity determining region 3 for antibody 18058
QQYDNWPPWT

SEQ ID NO: 36116 - protein, 12 aa, Homo sapiens
  heavy chain complementarity determining region 3 for antibody 18058
AKALRERKELDY

SEQ ID NO: 36117 - protein, 9 aa, Homo sapiens
  light chain complementarity determining region 3 for antibody 18059
QQTFNTPHT

SEQ ID NO: 36118 - protein, 19 aa, Homo sapiens
  heavy chain complementarity determining region 3 for antibody 18059
ATYMRSWPELGGGRYSLDV

SEQ ID NO: 36119 - protein, 10 aa, Homo sapiens
  light chain complementarity determining region 3 for antibody 18060
QQRSNWPPYT

SEQ ID NO: 36120 - protein, 16 aa, Homo sapiens
  heavy chain complementarity determining region 3 for antibody 18060
ARDRRDSWPGGHYFDS

SEQ ID NO: 36121 - protein, 10 aa, Homo sapiens
  light chain complementarity determining region 3 for antibody 18061
QQRSNWPPVT

SEQ ID NO: 36122 - protein, 14 aa, Homo sapiens
  heavy chain complementarity determining region 3 for antibody 18061
ARDLSGVLIGAWSH

SEQ ID NO: 36123 - protein, 9 aa, Homo sapiens
  light chain complementarity determining region 3 for antibody 18062
QQGYSTPFT

SEQ ID NO: 36124 - protein, 15 aa, Homo sapiens
  heavy chain complementarity determining region 3 for antibody 18062
ARAQVIWGQLYYFDL

SEQ ID NO: 36125 - protein, 9 aa, Homo sapiens
  light chain complementarity determining region 3 for antibody 18063
QQGYRPPFI

SEQ ID NO: 36126 - protein, 15 aa, Homo sapiens
  heavy chain complementarity determining region 3 for antibody 18063
TGAQVIWGQLYYFDY

SEQ ID NO: 36127 - protein, 9 aa, Homo sapiens
  light chain complementarity determining region 3 for antibody 18064
QQFYNNPLT

SEQ ID NO: 36128 - protein, 14 aa, Homo sapiens
  heavy chain complementarity determining region 3 for antibody 18064
VGQDCIGGACDYPR

SEQ ID NO: 36129 - protein, 9 aa, Homo sapiens
  light chain complementarity determining region 3 for antibody 18065
QQDGNLPRT

SEQ ID NO: 36130 - protein, 13 aa, Homo sapiens
  heavy chain complementarity determining region 3 for antibody 18065
AGGDFHSGGYSEF

SEQ ID NO: 36131 - protein, 10 aa, Homo sapiens
  light chain complementarity determining region 3 for antibody 18066
QKDNCGPPGT

SEQ ID NO: 36132 - protein, 14 aa, Homo sapiens
  heavy chain complementarity determining region 3 for antibody 18066
ARGLLWFGERDFDN

SEQ ID NO: 36133 - protein, 10 aa, Homo sapiens
  light chain complementarity determining region 3 for antibody 18067
MQGTHWPPPT

SEQ ID NO: 36134 - protein, 18 aa, Homo sapiens
  heavy chain complementarity determining region 3 for antibody 18067
ARKSSGWYSLSAYWYFDL

SEQ ID NO: 36135 - protein, 9 aa, Homo sapiens
  light chain complementarity determining region 3 for antibody 18068
MQALETPFT

SEQ ID NO: 36136 - protein, 15 aa, Homo sapiens
  heavy chain complementarity determining region 3 for antibody 18068
VRHYRETVAGLEGDS

SEQ ID NO: 36137 - protein, 9 aa, Homo sapiens
  light chain complementarity determining region 3 for antibody 18069
MQALETPFN

SEQ ID NO: 36138 - protein, 15 aa, Homo sapiens
  heavy chain complementarity determining region 3 for antibody 18069
VRHYRETVAGIEGDS

SEQ ID NO: 36139 - protein, 9 aa, Homo sapiens
  light chain complementarity determining region 3 for antibody 18070
MQAIETPFT

SEQ ID NO: 36140 - protein, 15 aa, Homo sapiens
  heavy chain complementarity determining region 3 for antibody 18070
VRHYRIITAPLEGDS

SEQ ID NO: 36141 - protein, 10 aa, Homo sapiens
  light chain complementarity determining region 3 for antibody 18071
MHGTLWPPGT

SEQ ID NO: 36142 - protein, 23 aa, Homo sapiens
  heavy chain complementarity determining region 3 for antibody 18071
ATGGRSSSWSRGLPPKYYYGMDV

SEQ ID NO: 36143 - protein, 9 aa, Homo sapiens
  light chain complementarity determining region 3 for antibody 18072
LQYGFSQYS

SEQ ID NO: 36144 - protein, 18 aa, Homo sapiens
  heavy chain complementarity determining region 3 for antibody 18072
TGVHGLTMLRGATKPFDF

SEQ ID NO: 36145 - protein, 9 aa, Homo sapiens
  light chain complementarity determining region 3 for antibody 18073
LQYGFAQYS

SEQ ID NO: 36146 - protein, 18 aa, Homo sapiens
  heavy chain complementarity determining region 3 for antibody 18073
TGVHGLTMLRGATNPFDF

SEQ ID NO: 36147 - protein, 9 aa, Homo sapiens
  light chain complementarity determining region 3 for antibody 18074
LQSIHWPGT

SEQ ID NO: 36148 - protein, 11 aa, Homo sapiens
  heavy chain complementarity determining region 3 for antibody 18074
GRHIRRSPEDY

SEQ ID NO: 36149 - protein, 9 aa, Homo sapiens
  light chain complementarity determining region 3 for antibody 18075
LQHDNFLVH

SEQ ID NO: 36150 - protein, 14 aa, Homo sapiens
  heavy chain complementarity determining region 3 for antibody 18075
AREDYGGNWDAFDI

SEQ ID NO: 36151 - protein, 9 aa, Homo sapiens
  light chain complementarity determining region 3 for antibody 18076
LQDNGYPRT

SEQ ID NO: 36152 - protein, 18 aa, Homo sapiens
  heavy chain complementarity determining region 3 for antibody 18076
ARDSNPTYGTNYLDAFDI

SEQ ID NO: 36153 - protein, 9 aa, Homo sapiens
  light chain complementarity determining region 3 for antibody 18077
QQYYTIPPT

SEQ ID NO: 36154 - protein, 11 aa, Homo sapiens
  heavy chain complementarity determining region 3 for antibody 18077
ARSDKVNWFDT

SEQ ID NO: 36155 - protein, 9 aa, Homo sapiens
  light chain complementarity determining region 3 for antibody 18078
QQYYSTPLT

SEQ ID NO: 36156 - protein, 20 aa, Homo sapiens
  heavy chain complementarity determining region 3 for antibody 18078
ARDQAYYLASGSSGVDWFDP

SEQ ID NO: 36157 - protein, 9 aa, Homo sapiens
  light chain complementarity determining region 3 for antibody 18079
QQYYRSPPT

SEQ ID NO: 36158 - protein, 19 aa, Homo sapiens
  heavy chain complementarity determining region 3 for antibody 18079
VKGRRGLCSGGNCPHYYDS

SEQ ID NO: 36159 - protein, 11 aa, Homo sapiens
  light chain complementarity determining region 3 for antibody 18080
QQYYNWPPKYT

SEQ ID NO: 36160 - protein, 14 aa, Homo sapiens
  heavy chain complementarity determining region 3 for antibody 18080
ANSQLQLGHDAFDI

SEQ ID NO: 36161 - protein, 11 aa, Homo sapiens
  light chain complementarity determining region 3 for antibody 18081
QQYVTSPPSST

SEQ ID NO: 36162 - protein, 11 aa, Homo sapiens
  heavy chain complementarity determining region 3 for antibody 18081
AYSPGWWRIDC

SEQ ID NO: 36163 - protein, 9 aa, Homo sapiens
  light chain complementarity determining region 3 for antibody 18082
QQYSATPFT

SEQ ID NO: 36164 - protein, 18 aa, Homo sapiens
  heavy chain complementarity determining region 3 for antibody 18082
ARGRCEGDCYAWYYALDV

SEQ ID NO: 36165 - protein, 10 aa, Homo sapiens
  light chain complementarity determining region 3 for antibody 18083
QQYNHWPPVT

SEQ ID NO: 36166 - protein, 12 aa, Homo sapiens
  heavy chain complementarity determining region 3 for antibody 18083
VKPAYSSGWYDF

SEQ ID NO: 36167 - protein, 8 aa, Homo sapiens
  light chain complementarity determining region 3 for antibody 18084
QQYNDGWT

SEQ ID NO: 36168 - protein, 10 aa, Homo sapiens
  heavy chain complementarity determining region 3 for antibody 18084
ARDKQVVLDS

SEQ ID NO: 36169 - protein, 9 aa, Homo sapiens
  light chain complementarity determining region 3 for antibody 18085
QQYKSYPLT

SEQ ID NO: 36170 - protein, 17 aa, Homo sapiens
  heavy chain complementarity determining region 3 for antibody 18085
ARVRYCTPGNCYQTWDS

SEQ ID NO: 36171 - protein, 9 aa, Homo sapiens
  light chain complementarity determining region 3 for antibody 18086
QQYGTSPRT

SEQ ID NO: 36172 - protein, 13 aa, Homo sapiens
  heavy chain complementarity determining region 3 for antibody 18086
ACGYYQSGRYYGY

SEQ ID NO: 36173 - protein, 9 aa, Homo sapiens
  light chain complementarity determining region 3 for antibody 18087
QQYGTPPRT

SEQ ID NO: 36174 - protein, 25 aa, Homo sapiens
  heavy chain complementarity determining region 3 for antibody 18087
ARRRVDRLRLPGAMRGPLYDRGLNV

SEQ ID NO: 36175 - protein, 9 aa, Homo sapiens
  light chain complementarity determining region 3 for antibody 18088
QQYGTPPRT

SEQ ID NO: 36176 - protein, 25 aa, Homo sapiens
  heavy chain complementarity determining region 3 for antibody 18088
ARLGVDRLRLPGAMRGPLYDRGLNV

SEQ ID NO: 36177 - protein, 9 aa, Homo sapiens
  light chain complementarity determining region 3 for antibody 18089
QQYGSTGGT

SEQ ID NO: 36178 - protein, 9 aa, Homo sapiens
  heavy chain complementarity determining region 3 for antibody 18089
ARMYSGLDY

SEQ ID NO: 36179 - protein, 9 aa, Homo sapiens
  light chain complementarity determining region 3 for antibody 18090
QQYGSSPRT

SEQ ID NO: 36180 - protein, 14 aa, Homo sapiens
  heavy chain complementarity determining region 3 for antibody 18090
ARRGYYSASGQFDY

SEQ ID NO: 36181 - protein, 9 aa, Homo sapiens
  light chain complementarity determining region 3 for antibody 18091
QQYGSSPRT

SEQ ID NO: 36182 - protein, 13 aa, Homo sapiens
  heavy chain complementarity determining region 3 for antibody 18091
AGGYFDSNGYYEY

SEQ ID NO: 36183 - protein, 10 aa, Homo sapiens
  light chain complementarity determining region 3 for antibody 18092
QQYGSSPPYT

SEQ ID NO: 36184 - protein, 18 aa, Homo sapiens
  heavy chain complementarity determining region 3 for antibody 18092
ATGKWFGDFNFYYYAMDV

SEQ ID NO: 36185 - protein, 9 aa, Homo sapiens
  light chain complementarity determining region 3 for antibody 18093
QQYGRIPRT

SEQ ID NO: 36186 - protein, 13 aa, Homo sapiens
  heavy chain complementarity determining region 3 for antibody 18093
AGGLYDSSGYSDF

SEQ ID NO: 36187 - protein, 10 aa, Homo sapiens
  light chain complementarity determining region 3 for antibody 18094
QQSYSTPRLT

SEQ ID NO: 36188 - protein, 15 aa, Homo sapiens
  heavy chain complementarity determining region 3 for antibody 18094
ARRDSSGWLEYYFDY

SEQ ID NO: 36189 - protein, 9 aa, Homo sapiens
  light chain complementarity determining region 3 for antibody 18095
QQSSDFPYT

SEQ ID NO: 36190 - protein, 13 aa, Homo sapiens
  heavy chain complementarity determining region 3 for antibody 18095
ARIPDISGWPFDL

SEQ ID NO: 36191 - protein, 10 aa, Homo sapiens
  light chain complementarity determining region 3 for antibody 18096
QQRYKWPPYT

SEQ ID NO: 36192 - protein, 11 aa, Homo sapiens
  heavy chain complementarity determining region 3 for antibody 18096
ARGVGSYVFDS

SEQ ID NO: 36193 - protein, 9 aa, Homo sapiens
  light chain complementarity determining region 3 for antibody 18097
QQRSNWPPT

SEQ ID NO: 36194 - protein, 8 aa, Homo sapiens
  heavy chain complementarity determining region 3 for antibody 18097
ATLGNDAD

SEQ ID NO: 36195 - protein, 9 aa, Homo sapiens
  light chain complementarity determining region 3 for antibody 18098
QQRSNWPFT

SEQ ID NO: 36196 - protein, 17 aa, Homo sapiens
  heavy chain complementarity determining region 3 for antibody 18098
ARGPPPRFTTIWYYFEY

SEQ ID NO: 36197 - protein, 9 aa, Homo sapiens
  light chain complementarity determining region 3 for antibody 18099
QQFGSLPHT

SEQ ID NO: 36198 - protein, 14 aa, Homo sapiens
  heavy chain complementarity determining region 3 for antibody 18099
ARGGGSDWYGFLYD

SEQ ID NO: 36199 - protein, 9 aa, Homo sapiens
  light chain complementarity determining region 3 for antibody 18100
QQADSFPIT

SEQ ID NO: 36200 - protein, 17 aa, Homo sapiens
  heavy chain complementarity determining region 3 for antibody 18100
AKGPAPYNWTYGPFFDY

SEQ ID NO: 36201 - protein, 9 aa, Homo sapiens
  light chain complementarity determining region 3 for antibody 18101
QHYYTSLRT

SEQ ID NO: 36202 - protein, 12 aa, Homo sapiens
  heavy chain complementarity determining region 3 for antibody 18101
VKDCGLGGSRDS

SEQ ID NO: 36203 - protein, 8 aa, Homo sapiens
  light chain complementarity determining region 3 for antibody 18102
QGNRFPHT

SEQ ID NO: 36204 - protein, 14 aa, Homo sapiens
  heavy chain complementarity determining region 3 for antibody 18102
ARYCSGNSCYSMDL

SEQ ID NO: 36205 - protein, 9 aa, Homo sapiens
  light chain complementarity determining region 3 for antibody 18103
MQGTQWPRT

SEQ ID NO: 36206 - protein, 13 aa, Homo sapiens
  heavy chain complementarity determining region 3 for antibody 18103
TRDPGVFYGGMDV

SEQ ID NO: 36207 - protein, 9 aa, Homo sapiens
  light chain complementarity determining region 3 for antibody 18104
MQAQQSPYT

SEQ ID NO: 36208 - protein, 18 aa, Homo sapiens
  heavy chain complementarity determining region 3 for antibody 18104
ARGVPPFWAPGGVGPFDF

SEQ ID NO: 36209 - protein, 9 aa, Homo sapiens
  light chain complementarity determining region 3 for antibody 18105
MQALRTRLT

SEQ ID NO: 36210 - protein, 23 aa, Homo sapiens
  heavy chain complementarity determining region 3 for antibody 18105
ARVSQNLGEWSGTSRYGINAFDP

SEQ ID NO: 36211 - protein, 8 aa, Homo sapiens
  light chain complementarity determining region 3 for antibody 18106
MQALQTPP

SEQ ID NO: 36212 - protein, 15 aa, Homo sapiens
  heavy chain complementarity determining region 3 for antibody 18106
ARRDYYDSSGYRLDY

SEQ ID NO: 36213 - protein, 9 aa, Homo sapiens
  light chain complementarity determining region 3 for antibody 18107
MQALETPLT

SEQ ID NO: 36214 - protein, 15 aa, Homo sapiens
  heavy chain complementarity determining region 3 for antibody 18107
VRHYRELATGIEGDS

SEQ ID NO: 36215 - protein, 9 aa, Homo sapiens
  light chain complementarity determining region 3 for antibody 18108
MQALETPLP

SEQ ID NO: 36216 - protein, 15 aa, Homo sapiens
  heavy chain complementarity determining region 3 for antibody 18108
VRHYRIITAPLEGDS

SEQ ID NO: 36217 - protein, 9 aa, Homo sapiens
  light chain complementarity determining region 3 for antibody 18109
MQALETPFT

SEQ ID NO: 36218 - protein, 15 aa, Homo sapiens
  heavy chain complementarity determining region 3 for antibody 18109
VRRYRIITAPLEGDS

SEQ ID NO: 36219 - protein, 9 aa, Homo sapiens
  light chain complementarity determining region 3 for antibody 18110
MQALETPFT

SEQ ID NO: 36220 - protein, 15 aa, Homo sapiens
  heavy chain complementarity determining region 3 for antibody 18110
VRHYRETVAGIEVDS

SEQ ID NO: 36221 - protein, 9 aa, Homo sapiens
  light chain complementarity determining region 3 for antibody 18111
LQTLQTPWT

SEQ ID NO: 36222 - protein, 13 aa, Homo sapiens
  heavy chain complementarity determining region 3 for antibody 18111
AKVVSYGSGGLQY

SEQ ID NO: 36223 - protein, 9 aa, Homo sapiens
  light chain complementarity determining region 3 for antibody 18112
LQPNSYPLT

SEQ ID NO: 36224 - protein, 13 aa, Homo sapiens
  heavy chain complementarity determining region 3 for antibody 18112
VRHAVVRPMVVDD

SEQ ID NO: 36225 - protein, 9 aa, Homo sapiens
  light chain complementarity determining region 3 for antibody 18113
HQYRTTPHT

SEQ ID NO: 36226 - protein, 12 aa, Homo sapiens
  heavy chain complementarity determining region 3 for antibody 18113
AKYPDNSFWYES

SEQ ID NO: 36227 - protein, 9 aa, Homo sapiens
  light chain complementarity determining region 3 for antibody 18114
HQALSFPIT

SEQ ID NO: 36228 - protein, 11 aa, Homo sapiens
  heavy chain complementarity determining region 3 for antibody 18114
ATYYSGGWFDP

SEQ ID NO: 36229 - protein, 9 aa, Homo sapiens
  light chain complementarity determining region 3 for antibody 18115
TQALETPFT

SEQ ID NO: 36230 - protein, 15 aa, Homo sapiens
  heavy chain complementarity determining region 3 for antibody 18115
VRHYRETVAGIEGDS

SEQ ID NO: 36231 - protein, 9 aa, Homo sapiens
  light chain complementarity determining region 3 for antibody 18116
RQSYTFPRT

SEQ ID NO: 36232 - protein, 13 aa, Homo sapiens
  heavy chain complementarity determining region 3 for antibody 18116
ARDLENWVNCFDY

SEQ ID NO: 36233 - protein, 9 aa, Homo sapiens
  light chain complementarity determining region 3 for antibody 18117
QQYYTTPLS

SEQ ID NO: 36234 - protein, 15 aa, Homo sapiens
  heavy chain complementarity determining region 3 for antibody 18117
ARGMSEGEMATTSEY

SEQ ID NO: 36235 - protein, 9 aa, Homo sapiens
  light chain complementarity determining region 3 for antibody 18118
QQYYSTPLT

SEQ ID NO: 36236 - protein, 20 aa, Homo sapiens
  heavy chain complementarity determining region 3 for antibody 18118
ARDQAYYSGSGSSGVDWFDP

SEQ ID NO: 36237 - protein, 9 aa, Homo sapiens
  light chain complementarity determining region 3 for antibody 18119
QQYYSSEYT

SEQ ID NO: 36238 - protein, 18 aa, Homo sapiens
  heavy chain complementarity determining region 3 for antibody 18119
GREREGYCHRSSCYAIED

SEQ ID NO: 36239 - protein, 9 aa, Homo sapiens
  light chain complementarity determining region 3 for antibody 18120
QQYYSIPPT

SEQ ID NO: 36240 - protein, 11 aa, Homo sapiens
  heavy chain complementarity determining region 3 for antibody 18120
ARVGFLVPFDC

SEQ ID NO: 36241 - protein, 9 aa, Homo sapiens
  light chain complementarity determining region 3 for antibody 18121
QQYYGPPPT

SEQ ID NO: 36242 - protein, 21 aa, Homo sapiens
  heavy chain complementarity determining region 3 for antibody 18121
ARKAQTSDCSGGICYAYYLDF

SEQ ID NO: 36243 - protein, 9 aa, Homo sapiens
  light chain complementarity determining region 3 for antibody 18122
QQYSTYLFT

SEQ ID NO: 36244 - protein, 16 aa, Homo sapiens
  heavy chain complementarity determining region 3 for antibody 18122
AKAGRVCSGGSCYVDS

SEQ ID NO: 36245 - protein, 9 aa, Homo sapiens
  light chain complementarity determining region 3 for antibody 18123
QQYSNWPLT

SEQ ID NO: 36246 - protein, 16 aa, Homo sapiens
  heavy chain complementarity determining region 3 for antibody 18123
AKGRDNGDSHYWYFEI

SEQ ID NO: 36247 - protein, 10 aa, Homo sapiens
  light chain complementarity determining region 3 for antibody 18124
QQYNSRPPLT

SEQ ID NO: 36248 - protein, 21 aa, Homo sapiens
  heavy chain complementarity determining region 3 for antibody 18124
ARDRNVLLWFGQSMKYYGMDV

SEQ ID NO: 36249 - protein, 9 aa, Homo sapiens
  light chain complementarity determining region 3 for antibody 18125
QQYNSFPLT

SEQ ID NO: 36250 - protein, 13 aa, Homo sapiens
  heavy chain complementarity determining region 3 for antibody 18125
ARRSSDYSGHFDY

SEQ ID NO: 36251 - protein, 10 aa, Homo sapiens
  light chain complementarity determining region 3 for antibody 18126
QQYNQWPPLT

SEQ ID NO: 36252 - protein, 17 aa, Homo sapiens
  heavy chain complementarity determining region 3 for antibody 18126
ARDRYFSIIQGGGAFDA

SEQ ID NO: 36253 - protein, 9 aa, Homo sapiens
  light chain complementarity determining region 3 for antibody 18127
QQYNNWPRT

SEQ ID NO: 36254 - protein, 21 aa, Homo sapiens
  heavy chain complementarity determining region 3 for antibody 18127
VRDYDYVWGSYRSFRGYSFDS

SEQ ID NO: 36255 - protein, 9 aa, Homo sapiens
  light chain complementarity determining region 3 for antibody 18128
QQYGTTPRT

SEQ ID NO: 36256 - protein, 12 aa, Homo sapiens
  heavy chain complementarity determining region 3 for antibody 18128
AGGLFDRRGYSE

SEQ ID NO: 36257 - protein, 8 aa, Homo sapiens
  light chain complementarity determining region 3 for antibody 18129
QQYGTSYT

SEQ ID NO: 36258 - protein, 21 aa, Homo sapiens
  heavy chain complementarity determining region 3 for antibody 18129
AKASGSIAVSTSRYYYYAMDV

SEQ ID NO: 36259 - protein, 9 aa, Homo sapiens
  light chain complementarity determining region 3 for antibody 18130
QQYGTSPYT

SEQ ID NO: 36260 - protein, 14 aa, Homo sapiens
  heavy chain complementarity determining region 3 for antibody 18130
AKEPPRWLHPFSGY

SEQ ID NO: 36261 - protein, 9 aa, Homo sapiens
  light chain complementarity determining region 3 for antibody 18131
QQYGTSPRT

SEQ ID NO: 36262 - protein, 13 aa, Homo sapiens
  heavy chain complementarity determining region 3 for antibody 18131
AGGYFDRSGYYDY

SEQ ID NO: 36263 - protein, 9 aa, Homo sapiens
  light chain complementarity determining region 3 for antibody 18132
QQYGTSPFP

SEQ ID NO: 36264 - protein, 15 aa, Homo sapiens
  heavy chain complementarity determining region 3 for antibody 18132
ARQNDFLSGPGEFDP

SEQ ID NO: 36265 - protein, 9 aa, Homo sapiens
  light chain complementarity determining region 3 for antibody 18133
QQYGTLPRT

SEQ ID NO: 36266 - protein, 13 aa, Homo sapiens
  heavy chain complementarity determining region 3 for antibody 18133
AGGNFHRSGYAEY

SEQ ID NO: 36267 - protein, 9 aa, Homo sapiens
  light chain complementarity determining region 3 for antibody 18134
QQYGSSPWT

SEQ ID NO: 36268 - protein, 11 aa, Homo sapiens
  heavy chain complementarity determining region 3 for antibody 18134
ARGGSSYAFDS

SEQ ID NO: 36269 - protein, 9 aa, Homo sapiens
  light chain complementarity determining region 3 for antibody 18135
QQYGSSPRT

SEQ ID NO: 36270 - protein, 25 aa, Homo sapiens
  heavy chain complementarity determining region 3 for antibody 18135
ARLRSDRLRLPGAMRGPLYDCGLNV

SEQ ID NO: 36271 - protein, 9 aa, Homo sapiens
  light chain complementarity determining region 3 for antibody 18136
QQYGSSPRT

SEQ ID NO: 36272 - protein, 25 aa, Homo sapiens
  heavy chain complementarity determining region 3 for antibody 18136
ARLRIDRLRLPGAMRGPLYDCGLDV

SEQ ID NO: 36273 - protein, 9 aa, Homo sapiens
  light chain complementarity determining region 3 for antibody 18137
QQYGNLPRT

SEQ ID NO: 36274 - protein, 13 aa, Homo sapiens
  heavy chain complementarity determining region 3 for antibody 18137
AGGNYDTGRYEDY

SEQ ID NO: 36275 - protein, 9 aa, Homo sapiens
  light chain complementarity determining region 3 for antibody 18138
QQYFTTPIT

SEQ ID NO: 36276 - protein, 10 aa, Homo sapiens
  heavy chain complementarity determining region 3 for antibody 18138
ARSGGYGWDS

SEQ ID NO: 36277 - protein, 11 aa, Homo sapiens
  light chain complementarity determining region 3 for antibody 18139
QQYDTSPPGNT

SEQ ID NO: 36278 - protein, 14 aa, Homo sapiens
  heavy chain complementarity determining region 3 for antibody 18139
ARETSNSRKRSFDQ

SEQ ID NO: 36279 - protein, 9 aa, Homo sapiens
  light chain complementarity determining region 3 for antibody 18140
QQTYTPPHT

SEQ ID NO: 36280 - protein, 14 aa, Homo sapiens
  heavy chain complementarity determining region 3 for antibody 18140
ATSLAPPADEHLDS

SEQ ID NO: 36281 - protein, 10 aa, Homo sapiens
  light chain complementarity determining region 3 for antibody 18141
QQRGIWPEMS

SEQ ID NO: 36282 - protein, 14 aa, Homo sapiens
  heavy chain complementarity determining region 3 for antibody 18141
AKDHDSNISGFGEL

SEQ ID NO: 36283 - protein, 9 aa, Homo sapiens
  light chain complementarity determining region 3 for antibody 18142
QQLSNYPHT

SEQ ID NO: 36284 - protein, 26 aa, Homo sapiens
  heavy chain complementarity determining region 3 for antibody 18142
ARGSRGYKDENSSLRRLQYYQYGMDV

SEQ ID NO: 36285 - protein, 11 aa, Homo sapiens
  light chain complementarity determining region 3 for antibody 18143
QQFGTSPPGYT

SEQ ID NO: 36286 - protein, 14 aa, Homo sapiens
  heavy chain complementarity determining region 3 for antibody 18143
ARDSGTSRKRSFDQ

SEQ ID NO: 36287 - protein, 10 aa, Homo sapiens
  light chain complementarity determining region 3 for antibody 18144
QQDNQWPPLT

SEQ ID NO: 36288 - protein, 17 aa, Homo sapiens
  heavy chain complementarity determining region 3 for antibody 18144
ARDLYFSIIQGGGAFDA

SEQ ID NO: 36289 - protein, 9 aa, Homo sapiens
  light chain complementarity determining region 3 for antibody 18145
QQDHSSPIT

SEQ ID NO: 36290 - protein, 14 aa, Homo sapiens
  heavy chain complementarity determining region 3 for antibody 18145
AKESSVYGVYPYDS

SEQ ID NO: 36291 - protein, 9 aa, Homo sapiens
  light chain complementarity determining region 3 for antibody 18146
QQDGSSPRT

SEQ ID NO: 36292 - protein, 18 aa, Homo sapiens
  heavy chain complementarity determining region 3 for antibody 18146
ATAFWVGLGVPPPGFFEY

SEQ ID NO: 36293 - protein, 9 aa, Homo sapiens
  light chain complementarity determining region 3 for antibody 18147
QQANTFPWT

SEQ ID NO: 36294 - protein, 16 aa, Homo sapiens
  heavy chain complementarity determining region 3 for antibody 18147
ARDKWASSTWGRWLDP

SEQ ID NO: 36295 - protein, 10 aa, Homo sapiens
  light chain complementarity determining region 3 for antibody 18148
QKYNSAPPWT

SEQ ID NO: 36296 - protein, 22 aa, Homo sapiens
  heavy chain complementarity determining region 3 for antibody 18148
ARGHRLYCSGGSCYVIPGAFDI

SEQ ID NO: 36297 - protein, 9 aa, Homo sapiens
  light chain complementarity determining region 3 for antibody 18149
QKYGTPPRP

SEQ ID NO: 36298 - protein, 13 aa, Homo sapiens
  heavy chain complementarity determining region 3 for antibody 18149
AGGLYDNTGYSDF

SEQ ID NO: 36299 - protein, 8 aa, Homo sapiens
  light chain complementarity determining region 3 for antibody 18150
QHRGNWVT

SEQ ID NO: 36300 - protein, 12 aa, Homo sapiens
  heavy chain complementarity determining region 3 for antibody 18150
VTEYGSASLADN

SEQ ID NO: 36301 - protein, 9 aa, Homo sapiens
  light chain complementarity determining region 3 for antibody 18151
MQTLQTPPT

SEQ ID NO: 36302 - protein, 16 aa, Homo sapiens
  heavy chain complementarity determining region 3 for antibody 18151
TMDLFALGLSSGCHDY

SEQ ID NO: 36303 - protein, 8 aa, Homo sapiens
  light chain complementarity determining region 3 for antibody 18152
MQSTQWPT

SEQ ID NO: 36304 - protein, 21 aa, Homo sapiens
  heavy chain complementarity determining region 3 for antibody 18152
AKDRPNYYGTNAGYYTPGGDL

SEQ ID NO: 36305 - protein, 10 aa, Homo sapiens
  light chain complementarity determining region 3 for antibody 18153
MQSTHWPPYT

SEQ ID NO: 36306 - protein, 12 aa, Homo sapiens
  heavy chain complementarity determining region 3 for antibody 18153
ARGRWHVLWGDN

SEQ ID NO: 36307 - protein, 7 aa, Homo sapiens
  light chain complementarity determining region 3 for antibody 18154
MQALRPL

SEQ ID NO: 36308 - protein, 20 aa, Homo sapiens
  heavy chain complementarity determining region 3 for antibody 18154
AGPRVEHYFDTTAYFYAFEY

SEQ ID NO: 36309 - protein, 9 aa, Homo sapiens
  light chain complementarity determining region 3 for antibody 18155
MQALQTPWT

SEQ ID NO: 36310 - protein, 19 aa, Homo sapiens
  heavy chain complementarity determining region 3 for antibody 18155
ARDIVFGSGSSSYYYGMDV

SEQ ID NO: 36311 - protein, 9 aa, Homo sapiens
  light chain complementarity determining region 3 for antibody 18156
MQALQTPGT

SEQ ID NO: 36312 - protein, 18 aa, Homo sapiens
  heavy chain complementarity determining region 3 for antibody 18156
AKSEDHLWFGELGDAFDV

SEQ ID NO: 36313 - protein, 9 aa, Homo sapiens
  light chain complementarity determining region 3 for antibody 18157
MQALETPFT

SEQ ID NO: 36314 - protein, 15 aa, Homo sapiens
  heavy chain complementarity determining region 3 for antibody 18157
VRHYRIITAPVEGDS

SEQ ID NO: 36315 - protein, 9 aa, Homo sapiens
  light chain complementarity determining region 3 for antibody 18158
MQALETPFT

SEQ ID NO: 36316 - protein, 15 aa, Homo sapiens
  heavy chain complementarity determining region 3 for antibody 18158
VRHYRIITAPLEGDP

SEQ ID NO: 36317 - protein, 9 aa, Homo sapiens
  light chain complementarity determining region 3 for antibody 18159
MQALETPFT

SEQ ID NO: 36318 - protein, 15 aa, Homo sapiens
  heavy chain complementarity determining region 3 for antibody 18159
VRHYRIIPAPLEGDS

SEQ ID NO: 36319 - protein, 9 aa, Homo sapiens
  light chain complementarity determining region 3 for antibody 18160
MQALETPFT

SEQ ID NO: 36320 - protein, 15 aa, Homo sapiens
  heavy chain complementarity determining region 3 for antibody 18160
VRHYRETVAGIDGDS

SEQ ID NO: 36321 - protein, 9 aa, Homo sapiens
  light chain complementarity determining region 3 for antibody 18161
MQALETPFT

SEQ ID NO: 36322 - protein, 11 aa, Homo sapiens
  heavy chain complementarity determining region 3 for antibody 18161
ARAGTRTLSGD

SEQ ID NO: 36323 - protein, 9 aa, Homo sapiens
  light chain complementarity determining region 3 for antibody 18162
MQALETPFI

SEQ ID NO: 36324 - protein, 15 aa, Homo sapiens
  heavy chain complementarity determining region 3 for antibody 18162
VRHYRETVAGIEGDS

SEQ ID NO: 36325 - protein, 9 aa, Homo sapiens
  light chain complementarity determining region 3 for antibody 18163
LQHHSYPLT

SEQ ID NO: 36326 - protein, 13 aa, Homo sapiens
  heavy chain complementarity determining region 3 for antibody 18163
VRHAVVRPMVVDD

SEQ ID NO: 36327 - protein, 9 aa, Homo sapiens
  light chain complementarity determining region 3 for antibody 18164
LQGNRFPPT

SEQ ID NO: 36328 - protein, 14 aa, Homo sapiens
  heavy chain complementarity determining region 3 for antibody 18164
ARYCSGNSCYSMDH

SEQ ID NO: 36329 - protein, 9 aa, Homo sapiens
  light chain complementarity determining region 3 for antibody 18165
HQHAAAPLT

SEQ ID NO: 36330 - protein, 10 aa, Homo sapiens
  heavy chain complementarity determining region 3 for antibody 18165
AHGAGWVSDY

SEQ ID NO: 36331 - protein, 10 aa, Homo sapiens
  light chain complementarity determining region 3 for antibody 18166
QRYGDPPLYT

SEQ ID NO: 36332 - protein, 10 aa, Homo sapiens
  heavy chain complementarity determining region 3 for antibody 18166
VRAGYYCLDY

SEQ ID NO: 36333 - protein, 9 aa, Homo sapiens
  light chain complementarity determining region 3 for antibody 18167
QQYYTTPRT

SEQ ID NO: 36334 - protein, 15 aa, Homo sapiens
  heavy chain complementarity determining region 3 for antibody 18167
ASLSPAWYDSSGYSA

SEQ ID NO: 36335 - protein, 9 aa, Homo sapiens
  light chain complementarity determining region 3 for antibody 18168
QQYYTFLRT

SEQ ID NO: 36336 - protein, 12 aa, Homo sapiens
  heavy chain complementarity determining region 3 for antibody 18168
VKDCGLGGSRDS

SEQ ID NO: 36337 - protein, 9 aa, Homo sapiens
  light chain complementarity determining region 3 for antibody 18169
QQYVTPPLT

SEQ ID NO: 36338 - protein, 8 aa, Homo sapiens
  heavy chain complementarity determining region 3 for antibody 18169
VRMSDYIL

SEQ ID NO: 36339 - protein, 9 aa, Homo sapiens
  light chain complementarity determining region 3 for antibody 18170
QQYNSYPWT

SEQ ID NO: 36340 - protein, 17 aa, Homo sapiens
  heavy chain complementarity determining region 3 for antibody 18170
VKGTNPVLDWISIPFDY

SEQ ID NO: 36341 - protein, 9 aa, Homo sapiens
  light chain complementarity determining region 3 for antibody 18171
QQYGTPPRT

SEQ ID NO: 36342 - protein, 25 aa, Homo sapiens
  heavy chain complementarity determining region 3 for antibody 18171
AGLRVDRLRLPGAMRGPLYDRGLNV

SEQ ID NO: 36343 - protein, 10 aa, Homo sapiens
  light chain complementarity determining region 3 for antibody 18172
QQYGSSRALT

SEQ ID NO: 36344 - protein, 16 aa, Homo sapiens
  heavy chain complementarity determining region 3 for antibody 18172
ARNPTDSNGHYTYFDS

SEQ ID NO: 36345 - protein, 9 aa, Homo sapiens
  light chain complementarity determining region 3 for antibody 18173
QQYGSSPPP

SEQ ID NO: 36346 - protein, 16 aa, Homo sapiens
  heavy chain complementarity determining region 3 for antibody 18173
ARGRTFRGNIYADLLY

SEQ ID NO: 36347 - protein, 9 aa, Homo sapiens
  light chain complementarity determining region 3 for antibody 18174
QQYGSPPRT

SEQ ID NO: 36348 - protein, 14 aa, Homo sapiens
  heavy chain complementarity determining region 3 for antibody 18174
AGGNFCGYDCYSDY

SEQ ID NO: 36349 - protein, 9 aa, Homo sapiens
  light chain complementarity determining region 3 for antibody 18175
QQYGSIPRT

SEQ ID NO: 36350 - protein, 13 aa, Homo sapiens
  heavy chain complementarity determining region 3 for antibody 18175
AGGKFDSSGYGEY

SEQ ID NO: 36351 - protein, 9 aa, Homo sapiens
  light chain complementarity determining region 3 for antibody 18176
QQYGPSSET

SEQ ID NO: 36352 - protein, 25 aa, Homo sapiens
  heavy chain complementarity determining region 3 for antibody 18176
ARGLRARRDLRYFDRLLIPHDALDI

SEQ ID NO: 36353 - protein, 9 aa, Homo sapiens
  light chain complementarity determining region 3 for antibody 18177
QQYFTTPRT

SEQ ID NO: 36354 - protein, 8 aa, Homo sapiens
  heavy chain complementarity determining region 3 for antibody 18177
ARDGAFDS

SEQ ID NO: 36355 - protein, 11 aa, Homo sapiens
  light chain complementarity determining region 3 for antibody 18178
QQYDPLSWTWT

SEQ ID NO: 36356 - protein, 11 aa, Homo sapiens
  heavy chain complementarity determining region 3 for antibody 18178
ARGWLDNSFDF

SEQ ID NO: 36357 - protein, 10 aa, Homo sapiens
  light chain complementarity determining region 3 for antibody 18179
QQYDGYWGYS

SEQ ID NO: 36358 - protein, 13 aa, Homo sapiens
  heavy chain complementarity determining region 3 for antibody 18179
AKVPYDSTGEFDF

SEQ ID NO: 36359 - protein, 9 aa, Homo sapiens
  light chain complementarity determining region 3 for antibody 18180
QQSYSSLLT

SEQ ID NO: 36360 - protein, 16 aa, Homo sapiens
  heavy chain complementarity determining region 3 for antibody 18180
AREEGGTYTSRRAFDS

SEQ ID NO: 36361 - protein, 9 aa, Homo sapiens
  light chain complementarity determining region 3 for antibody 18181
QQSYLTPLT

SEQ ID NO: 36362 - protein, 15 aa, Homo sapiens
  heavy chain complementarity determining region 3 for antibody 18181
ARAGPIPTSLEGIEY

SEQ ID NO: 36363 - protein, 11 aa, Homo sapiens
  light chain complementarity determining region 3 for antibody 18182
QQRTNWPPIYP

SEQ ID NO: 36364 - protein, 14 aa, Homo sapiens
  heavy chain complementarity determining region 3 for antibody 18182
ARGGLGIWGNSSDI

SEQ ID NO: 36365 - protein, 9 aa, Homo sapiens
  light chain complementarity determining region 3 for antibody 18183
QQRTDWPPP

SEQ ID NO: 36366 - protein, 17 aa, Homo sapiens
  heavy chain complementarity determining region 3 for antibody 18183
ARTALCESPAYYRFFDY

SEQ ID NO: 36367 - protein, 9 aa, Homo sapiens
  light chain complementarity determining region 3 for antibody 18184
QQRSSWPYT

SEQ ID NO: 36368 - protein, 11 aa, Homo sapiens
  heavy chain complementarity determining region 3 for antibody 18184
VNRWGGSSIDY

SEQ ID NO: 36369 - protein, 9 aa, Homo sapiens
  light chain complementarity determining region 3 for antibody 18185
QQRSSWPST

SEQ ID NO: 36370 - protein, 11 aa, Homo sapiens
  heavy chain complementarity determining region 3 for antibody 18185
VKRWGGSSIDY

SEQ ID NO: 36371 - protein, 10 aa, Homo sapiens
  light chain complementarity determining region 3 for antibody 18186
QQRSDWPPPT

SEQ ID NO: 36372 - protein, 10 aa, Homo sapiens
  heavy chain complementarity determining region 3 for antibody 18186
ARDYTMTFDY

SEQ ID NO: 36373 - protein, 9 aa, Homo sapiens
  light chain complementarity determining region 3 for antibody 18187
QQRHDWPIT

SEQ ID NO: 36374 - protein, 12 aa, Homo sapiens
  heavy chain complementarity determining region 3 for antibody 18187
AKGGSLWSVYES

SEQ ID NO: 36375 - protein, 9 aa, Homo sapiens
  light chain complementarity determining region 3 for antibody 18188
QQRFNWPRT

SEQ ID NO: 36376 - protein, 16 aa, Homo sapiens
  heavy chain complementarity determining region 3 for antibody 18188
VRVGKDYASALLYFDS

SEQ ID NO: 36377 - protein, 9 aa, Homo sapiens
  light chain complementarity determining region 3 for antibody 18189
QQFYTYPLT

SEQ ID NO: 36378 - protein, 12 aa, Homo sapiens
  heavy chain complementarity determining region 3 for antibody 18189
TRVLSSAIGDWD

SEQ ID NO: 36379 - protein, 9 aa, Homo sapiens
  light chain complementarity determining region 3 for antibody 18190
QQDGNLPRT

SEQ ID NO: 36380 - protein, 13 aa, Homo sapiens
  heavy chain complementarity determining region 3 for antibody 18190
AGGNFHSGGYGEY

SEQ ID NO: 36381 - protein, 9 aa, Homo sapiens
  light chain complementarity determining region 3 for antibody 18191
QQADRIPLT

SEQ ID NO: 36382 - protein, 16 aa, Homo sapiens
  heavy chain complementarity determining region 3 for antibody 18191
ARDASSFSDGWFYFDF

SEQ ID NO: 36383 - protein, 11 aa, Homo sapiens
  light chain complementarity determining region 3 for antibody 18192
QLWSTSGSRYT

SEQ ID NO: 36384 - protein, 14 aa, Homo sapiens
  heavy chain complementarity determining region 3 for antibody 18192
ARHTAESGLRGFDQ

SEQ ID NO: 36385 - protein, 9 aa, Homo sapiens
  light chain complementarity determining region 3 for antibody 18193
QKFDSLPLT

SEQ ID NO: 36386 - protein, 15 aa, Homo sapiens
  heavy chain complementarity determining region 3 for antibody 18193
ATYGYLNSWFQAFDT

SEQ ID NO: 36387 - protein, 9 aa, Homo sapiens
  light chain complementarity determining region 3 for antibody 18194
QHYYSTPAF

SEQ ID NO: 36388 - protein, 11 aa, Homo sapiens
  heavy chain complementarity determining region 3 for antibody 18194
VKRWGGSSIDY

SEQ ID NO: 36389 - protein, 11 aa, Homo sapiens
  light chain complementarity determining region 3 for antibody 18195
QELNSYPRRGT

SEQ ID NO: 36390 - protein, 24 aa, Homo sapiens
  heavy chain complementarity determining region 3 for antibody 18195
ARDRDGDYYGSGSLLYYYYYGMDV

SEQ ID NO: 36391 - protein, 9 aa, Homo sapiens
  light chain complementarity determining region 3 for antibody 18196
PQYGSSPRT

SEQ ID NO: 36392 - protein, 25 aa, Homo sapiens
  heavy chain complementarity determining region 3 for antibody 18196
ARLRIDRLRLPGAMRGPLYDCGLNV

SEQ ID NO: 36393 - protein, 9 aa, Homo sapiens
  light chain complementarity determining region 3 for antibody 18197
MQSRRGPHT

SEQ ID NO: 36394 - protein, 8 aa, Homo sapiens
  heavy chain complementarity determining region 3 for antibody 18197
TAWGSSQH

SEQ ID NO: 36395 - protein, 9 aa, Homo sapiens
  light chain complementarity determining region 3 for antibody 18198
MQPLLTPGT

SEQ ID NO: 36396 - protein, 11 aa, Homo sapiens
  heavy chain complementarity determining region 3 for antibody 18198
ARDRDYSALDV

SEQ ID NO: 36397 - protein, 9 aa, Homo sapiens
  light chain complementarity determining region 3 for antibody 18199
MQGTHWPPT

SEQ ID NO: 36398 - protein, 15 aa, Homo sapiens
  heavy chain complementarity determining region 3 for antibody 18199
AKSSGRKIAVAGFDS

SEQ ID NO: 36399 - protein, 9 aa, Homo sapiens
  light chain complementarity determining region 3 for antibody 18200
MQGLQTPRT

SEQ ID NO: 36400 - protein, 30 aa, Homo sapiens
  heavy chain complementarity determining region 3 for antibody 18200
ARGPVTKRSRRTQRYDFWNNFSLEYHGMDV

SEQ ID NO: 36401 - protein, 9 aa, Homo sapiens
  light chain complementarity determining region 3 for antibody 18201
MQDTHWPLT

SEQ ID NO: 36402 - protein, 8 aa, Homo sapiens
  heavy chain complementarity determining region 3 for antibody 18201
ARTRTFDI

SEQ ID NO: 36403 - protein, 9 aa, Homo sapiens
  light chain complementarity determining region 3 for antibody 18202
MQATQIPWT

SEQ ID NO: 36404 - protein, 7 aa, Homo sapiens
  heavy chain complementarity determining region 3 for antibody 18202
LGGGVDY

SEQ ID NO: 36405 - protein, 9 aa, Homo sapiens
  light chain complementarity determining region 3 for antibody 18203
MQALVTPFT

SEQ ID NO: 36406 - protein, 15 aa, Homo sapiens
  heavy chain complementarity determining region 3 for antibody 18203
VRHYRIITAPLEGDS

SEQ ID NO: 36407 - protein, 9 aa, Homo sapiens
  light chain complementarity determining region 3 for antibody 18204
MQALETPFT

SEQ ID NO: 36408 - protein, 15 aa, Homo sapiens
  heavy chain complementarity determining region 3 for antibody 18204
VRPYRIITAPLEGDS

SEQ ID NO: 36409 - protein, 9 aa, Homo sapiens
  light chain complementarity determining region 3 for antibody 18205
MQALETPFT

SEQ ID NO: 36410 - protein, 15 aa, Homo sapiens
  heavy chain complementarity determining region 3 for antibody 18205
VRHYRIITAHLEGDS

SEQ ID NO: 36411 - protein, 9 aa, Homo sapiens
  light chain complementarity determining region 3 for antibody 18206
MQALETPFT

SEQ ID NO: 36412 - protein, 15 aa, Homo sapiens
  heavy chain complementarity determining region 3 for antibody 18206
VRHSRIITAPLEGDS

SEQ ID NO: 36413 - protein, 9 aa, Homo sapiens
  light chain complementarity determining region 3 for antibody 18207
MQALETPFT

SEQ ID NO: 36414 - protein, 15 aa, Homo sapiens
  heavy chain complementarity determining region 3 for antibody 18207
LRHYRSLVTATEVDS

SEQ ID NO: 36415 - protein, 9 aa, Homo sapiens
  light chain complementarity determining region 3 for antibody 18208
MQALETPFN

SEQ ID NO: 36416 - protein, 15 aa, Homo sapiens
  heavy chain complementarity determining region 3 for antibody 18208
VRHYRIITAPLEGDS

SEQ ID NO: 36417 - protein, 9 aa, Homo sapiens
  light chain complementarity determining region 3 for antibody 18209
MQALESPFT

SEQ ID NO: 36418 - protein, 15 aa, Homo sapiens
  heavy chain complementarity determining region 3 for antibody 18209
VRHYRIITAPLEGDS

SEQ ID NO: 36419 - protein, 9 aa, Homo sapiens
  light chain complementarity determining region 3 for antibody 18210
MQAIETPFT

SEQ ID NO: 36420 - protein, 15 aa, Homo sapiens
  heavy chain complementarity determining region 3 for antibody 18210
VRHYRETVAGIEGDS

SEQ ID NO: 36421 - protein, 9 aa, Homo sapiens
  light chain complementarity determining region 3 for antibody 18211
LQYGFAPYS

SEQ ID NO: 36422 - protein, 18 aa, Homo sapiens
  heavy chain complementarity determining region 3 for antibody 18211
TGVHGLTMLRGATKPFDF

SEQ ID NO: 36423 - protein, 9 aa, Homo sapiens
  light chain complementarity determining region 3 for antibody 18212
LQGTLWPGT

SEQ ID NO: 36424 - protein, 12 aa, Homo sapiens
  heavy chain complementarity determining region 3 for antibody 18212
VTGDSARHYFGF

SEQ ID NO: 36425 - protein, 9 aa, Homo sapiens
  light chain complementarity determining region 3 for antibody 18213
LQGNRFPLT

SEQ ID NO: 36426 - protein, 14 aa, Homo sapiens
  heavy chain complementarity determining region 3 for antibody 18213
ARYCSGNSCYSMDH

SEQ ID NO: 36427 - protein, 9 aa, Homo sapiens
  light chain complementarity determining region 3 for antibody 18214
HSYHSDRFS

SEQ ID NO: 36428 - protein, 15 aa, Homo sapiens
  heavy chain complementarity determining region 3 for antibody 18214
ARGPLRFAGNEGLDY

SEQ ID NO: 36429 - protein, 9 aa, Homo sapiens
  light chain complementarity determining region 3 for antibody 18215
HQYSRSPYT

SEQ ID NO: 36430 - protein, 13 aa, Homo sapiens
  heavy chain complementarity determining region 3 for antibody 18215
ARGTYSAFAIFGV

SEQ ID NO: 36431 - protein, 9 aa, Homo sapiens
  light chain complementarity determining region 3 for antibody 18216
HHYYSSPRM

SEQ ID NO: 36432 - protein, 13 aa, Homo sapiens
  heavy chain complementarity determining region 3 for antibody 18216
ARGQSGDPRTYDY

SEQ ID NO: 36433 - protein, 11 aa, Homo sapiens
  light chain complementarity determining region 3 for antibody 18217
QQYYTTPPMYT

SEQ ID NO: 36434 - protein, 16 aa, Homo sapiens
  heavy chain complementarity determining region 3 for antibody 18217
ARDPDTSGWYLHAFDI

SEQ ID NO: 36435 - protein, 9 aa, Homo sapiens
  light chain complementarity determining region 3 for antibody 18218
QQYYTIPLT

SEQ ID NO: 36436 - protein, 10 aa, Homo sapiens
  heavy chain complementarity determining region 3 for antibody 18218
TGFVVSTIPY

SEQ ID NO: 36437 - protein, 11 aa, Homo sapiens
  light chain complementarity determining region 3 for antibody 18219
QQYYFSPPVLT

SEQ ID NO: 36438 - protein, 15 aa, Homo sapiens
  heavy chain complementarity determining region 3 for antibody 18219
ARGLTWQLPNLYFDS

SEQ ID NO: 36439 - protein, 9 aa, Homo sapiens
  light chain complementarity determining region 3 for antibody 18220
QQYWSIPLT

SEQ ID NO: 36440 - protein, 7 aa, Homo sapiens
  heavy chain complementarity determining region 3 for antibody 18220
HGYELKC

SEQ ID NO: 36441 - protein, 9 aa, Homo sapiens
  light chain complementarity determining region 3 for antibody 18221
QQYVTSPFT

SEQ ID NO: 36442 - protein, 18 aa, Homo sapiens
  heavy chain complementarity determining region 3 for antibody 18221
ARGLPHLFSVNYRGPFDD

SEQ ID NO: 36443 - protein, 9 aa, Homo sapiens
  light chain complementarity determining region 3 for antibody 18222
QQYNSWLWT

SEQ ID NO: 36444 - protein, 14 aa, Homo sapiens
  heavy chain complementarity determining region 3 for antibody 18222
ARLSSTGSKWYFDL

SEQ ID NO: 36445 - protein, 10 aa, Homo sapiens
  light chain complementarity determining region 3 for antibody 18223
QQYNNWPAPS

SEQ ID NO: 36446 - protein, 14 aa, Homo sapiens
  heavy chain complementarity determining region 3 for antibody 18223
AHSPIRSLGELFDS

SEQ ID NO: 36447 - protein, 9 aa, Homo sapiens
  light chain complementarity determining region 3 for antibody 18224
QQYLSIPHT

SEQ ID NO: 36448 - protein, 13 aa, Homo sapiens
  heavy chain complementarity determining region 3 for antibody 18224
VRPSPLGISAFDI

SEQ ID NO: 36449 - protein, 9 aa, Homo sapiens
  light chain complementarity determining region 3 for antibody 18225
QQYHSDPPT

SEQ ID NO: 36450 - protein, 10 aa, Homo sapiens
  heavy chain complementarity determining region 3 for antibody 18225
AGGTGWILDT

SEQ ID NO: 36451 - protein, 9 aa, Homo sapiens
  light chain complementarity determining region 3 for antibody 18226
QQYGTSPRT

SEQ ID NO: 36452 - protein, 13 aa, Homo sapiens
  heavy chain complementarity determining region 3 for antibody 18226
PIGVYDRSGYHEY

SEQ ID NO: 36453 - protein, 9 aa, Homo sapiens
  light chain complementarity determining region 3 for antibody 18227
QQYGTSPRT

SEQ ID NO: 36454 - protein, 13 aa, Homo sapiens
  heavy chain complementarity determining region 3 for antibody 18227
ACGYYQSGRYYDY

SEQ ID NO: 36455 - protein, 9 aa, Homo sapiens
  light chain complementarity determining region 3 for antibody 18228
QQYGTSPFT

SEQ ID NO: 36456 - protein, 15 aa, Homo sapiens
  heavy chain complementarity determining region 3 for antibody 18228
ARQNDCLSGPGEFDP

SEQ ID NO: 36457 - protein, 9 aa, Homo sapiens
  light chain complementarity determining region 3 for antibody 18229
QQYGTIPRT

SEQ ID NO: 36458 - protein, 13 aa, Homo sapiens
  heavy chain complementarity determining region 3 for antibody 18229
AGGLFDSSGYSDF

SEQ ID NO: 36459 - protein, 9 aa, Homo sapiens
  light chain complementarity determining region 3 for antibody 18230
QQYGTIPRT

SEQ ID NO: 36460 - protein, 13 aa, Homo sapiens
  heavy chain complementarity determining region 3 for antibody 18230
AGGIFHSRGYGDY

SEQ ID NO: 36461 - protein, 9 aa, Homo sapiens
  light chain complementarity determining region 3 for antibody 18231
QQYGSSPRT

SEQ ID NO: 36462 - protein, 14 aa, Homo sapiens
  heavy chain complementarity determining region 3 for antibody 18231
AGGRFSSGSSYSEH

SEQ ID NO: 36463 - protein, 9 aa, Homo sapiens
  light chain complementarity determining region 3 for antibody 18232
QQYGSSPRK

SEQ ID NO: 36464 - protein, 18 aa, Homo sapiens
  heavy chain complementarity determining region 3 for antibody 18232
ATAFWVGLGVPPPGFFEY

SEQ ID NO: 36465 - protein, 10 aa, Homo sapiens
  light chain complementarity determining region 3 for antibody 18233
QQYGSSPMYG

SEQ ID NO: 36466 - protein, 11 aa, Homo sapiens
  heavy chain complementarity determining region 3 for antibody 18233
ARGGQWGSLDY

SEQ ID NO: 36467 - protein, 10 aa, Homo sapiens
  light chain complementarity determining region 3 for antibody 18234
QQYGSSPMNS

SEQ ID NO: 36468 - protein, 11 aa, Homo sapiens
  heavy chain complementarity determining region 3 for antibody 18234
ARGGQWGSLDY

SEQ ID NO: 36469 - protein, 9 aa, Homo sapiens
  light chain complementarity determining region 3 for antibody 18235
QQYGSLPRT

SEQ ID NO: 36470 - protein, 13 aa, Homo sapiens
  heavy chain complementarity determining region 3 for antibody 18235
ALGHYHTTGYSEF

SEQ ID NO: 36471 - protein, 9 aa, Homo sapiens
  light chain complementarity determining region 3 for antibody 18236
QQYGSLPRT

SEQ ID NO: 36472 - protein, 14 aa, Homo sapiens
  heavy chain complementarity determining region 3 for antibody 18236
AGGEFSSGWHYSEN

SEQ ID NO: 36473 - protein, 9 aa, Homo sapiens
  light chain complementarity determining region 3 for antibody 18237
QQYGSIPRT

SEQ ID NO: 36474 - protein, 13 aa, Homo sapiens
  heavy chain complementarity determining region 3 for antibody 18237
AGGIFDSSGYGDY

SEQ ID NO: 36475 - protein, 9 aa, Homo sapiens
  light chain complementarity determining region 3 for antibody 18238
QQYGSIPRP

SEQ ID NO: 36476 - protein, 13 aa, Homo sapiens
  heavy chain complementarity determining region 3 for antibody 18238
AGGGFSSGRYSEY

SEQ ID NO: 36477 - protein, 8 aa, Homo sapiens
  light chain complementarity determining region 3 for antibody 18239
QQYGPSRT

SEQ ID NO: 36478 - protein, 15 aa, Homo sapiens
  heavy chain complementarity determining region 3 for antibody 18239
ARGEYYYDSSGYRDD

SEQ ID NO: 36479 - protein, 9 aa, Homo sapiens
  light chain complementarity determining region 3 for antibody 18240
QQYGNSPRP

SEQ ID NO: 36480 - protein, 13 aa, Homo sapiens
  heavy chain complementarity determining region 3 for antibody 18240
AGGHYDSGDYREY

SEQ ID NO: 36481 - protein, 9 aa, Homo sapiens
  light chain complementarity determining region 3 for antibody 18241
QQYGGIPLT

SEQ ID NO: 36482 - protein, 7 aa, Homo sapiens
  heavy chain complementarity determining region 3 for antibody 18241
HGYELKC

SEQ ID NO: 36483 - protein, 9 aa, Homo sapiens
  light chain complementarity determining region 3 for antibody 18242
QQYDDLPYT

SEQ ID NO: 36484 - protein, 11 aa, Homo sapiens
  heavy chain complementarity determining region 3 for antibody 18242
AAQSVGFGEFP

SEQ ID NO: 36485 - protein, 9 aa, Homo sapiens
  light chain complementarity determining region 3 for antibody 18243
QQSYSAPFT

SEQ ID NO: 36486 - protein, 18 aa, Homo sapiens
  heavy chain complementarity determining region 3 for antibody 18243
ARDEPVCSGGRCPHPWSY

SEQ ID NO: 36487 - protein, 9 aa, Homo sapiens
  light chain complementarity determining region 3 for antibody 18244
QQSYDKPWT

SEQ ID NO: 36488 - protein, 12 aa, Homo sapiens
  heavy chain complementarity determining region 3 for antibody 18244
ARIRVAAADFDF

SEQ ID NO: 36489 - protein, 10 aa, Homo sapiens
  light chain complementarity determining region 3 for antibody 18245
QQNNNWLGWT

SEQ ID NO: 36490 - protein, 13 aa, Homo sapiens
  heavy chain complementarity determining region 3 for antibody 18245
ARHGRRSGWYYTY

SEQ ID NO: 36491 - protein, 8 aa, Homo sapiens
  light chain complementarity determining region 3 for antibody 18246
QQHNSYST

SEQ ID NO: 36492 - protein, 18 aa, Homo sapiens
  heavy chain complementarity determining region 3 for antibody 18246
AKDHSPPFGVVIGYYFDY

SEQ ID NO: 36493 - protein, 9 aa, Homo sapiens
  light chain complementarity determining region 3 for antibody 18247
QQGYSTPLT

SEQ ID NO: 36494 - protein, 15 aa, Homo sapiens
  heavy chain complementarity determining region 3 for antibody 18247
ARAQVIWGQLYYFDF

SEQ ID NO: 36495 - protein, 9 aa, Homo sapiens
  light chain complementarity determining region 3 for antibody 18248
QQDGTPPRT

SEQ ID NO: 36496 - protein, 25 aa, Homo sapiens
  heavy chain complementarity determining region 3 for antibody 18248
ARLRVDRLRLPGAMRGPLYDRGLNV

SEQ ID NO: 36497 - protein, 9 aa, Homo sapiens
  light chain complementarity determining region 3 for antibody 18249
QQDGNSPRT

SEQ ID NO: 36498 - protein, 14 aa, Homo sapiens
  heavy chain complementarity determining region 3 for antibody 18249
ASDPVVGAPGYFDY

SEQ ID NO: 36499 - protein, 10 aa, Homo sapiens
  light chain complementarity determining region 3 for antibody 18250
QKYGGSPLGT

SEQ ID NO: 36500 - protein, 14 aa, Homo sapiens
  heavy chain complementarity determining region 3 for antibody 18250
ARDPISGSPDYFDY

SEQ ID NO: 36501 - protein, 9 aa, Homo sapiens
  light chain complementarity determining region 3 for antibody 18251
QHYVTSPLP

SEQ ID NO: 36502 - protein, 8 aa, Homo sapiens
  heavy chain complementarity determining region 3 for antibody 18251
VCMIVATN

SEQ ID NO: 36503 - protein, 9 aa, Homo sapiens
  light chain complementarity determining region 3 for antibody 18252
QHYNRSPRT

SEQ ID NO: 36504 - protein, 16 aa, Homo sapiens
  heavy chain complementarity determining region 3 for antibody 18252
VKDFTGECHYGSWVDP

SEQ ID NO: 36505 - protein, 10 aa, Homo sapiens
  light chain complementarity determining region 3 for antibody 18253
QHYHNWPPRT

SEQ ID NO: 36506 - protein, 13 aa, Homo sapiens
  heavy chain complementarity determining region 3 for antibody 18253
AKGRVRELYYFDT

SEQ ID NO: 36507 - protein, 8 aa, Homo sapiens
  light chain complementarity determining region 3 for antibody 18254
QHYGTSRM

SEQ ID NO: 36508 - protein, 13 aa, Homo sapiens
  heavy chain complementarity determining region 3 for antibody 18254
ARGQFVGSAYYEN

SEQ ID NO: 36509 - protein, 9 aa, Homo sapiens
  light chain complementarity determining region 3 for antibody 18255
QHYGSLPLP

SEQ ID NO: 36510 - protein, 16 aa, Homo sapiens
  heavy chain complementarity determining region 3 for antibody 18255
ATMLVRGLLYFHAVDV

SEQ ID NO: 36511 - protein, 9 aa, Homo sapiens
  light chain complementarity determining region 3 for antibody 18256
QHYGGSPRT

SEQ ID NO: 36512 - protein, 13 aa, Homo sapiens
  heavy chain complementarity determining region 3 for antibody 18256
AAGYFSSGTYYEY

SEQ ID NO: 36513 - protein, 9 aa, Homo sapiens
  light chain complementarity determining region 3 for antibody 18257
QHTFTGTWT

SEQ ID NO: 36514 - protein, 19 aa, Homo sapiens
  heavy chain complementarity determining region 3 for antibody 18257
VRVSDLGEKDGYNYDSFDL

SEQ ID NO: 36515 - protein, 10 aa, Homo sapiens
  light chain complementarity determining region 3 for antibody 18258
MQSIQPPRGT

SEQ ID NO: 36516 - protein, 8 aa, Homo sapiens
  heavy chain complementarity determining region 3 for antibody 18258
AKGYGFDC

SEQ ID NO: 36517 - protein, 9 aa, Homo sapiens
  light chain complementarity determining region 3 for antibody 18259
MQGIHWPWT

SEQ ID NO: 36518 - protein, 7 aa, Homo sapiens
  heavy chain complementarity determining region 3 for antibody 18259
ARGWGAY

SEQ ID NO: 36519 - protein, 10 aa, Homo sapiens
  light chain complementarity determining region 3 for antibody 18260
MQATKFPPGT

SEQ ID NO: 36520 - protein, 14 aa, Homo sapiens
  heavy chain complementarity determining region 3 for antibody 18260
ARMETTVSFRAFDY

SEQ ID NO: 36521 - protein, 9 aa, Homo sapiens
  light chain complementarity determining region 3 for antibody 18261
MQALQTPGT

SEQ ID NO: 36522 - protein, 12 aa, Homo sapiens
  heavy chain complementarity determining region 3 for antibody 18261
ALELIATGGFDY

SEQ ID NO: 36523 - protein, 8 aa, Homo sapiens
  light chain complementarity determining region 3 for antibody 18262
MQALQALP

SEQ ID NO: 36524 - protein, 16 aa, Homo sapiens
  heavy chain complementarity determining region 3 for antibody 18262
AKAGWLVGYDLSRGCA

SEQ ID NO: 36525 - protein, 9 aa, Homo sapiens
  light chain complementarity determining region 3 for antibody 18263
MQALETPFT

SEQ ID NO: 36526 - protein, 15 aa, Homo sapiens
  heavy chain complementarity determining region 3 for antibody 18263
VRHDRIITAPLEGDS

SEQ ID NO: 36527 - protein, 9 aa, Homo sapiens
  light chain complementarity determining region 3 for antibody 18264
MQALETPFT

SEQ ID NO: 36528 - protein, 15 aa, Homo sapiens
  heavy chain complementarity determining region 3 for antibody 18264
GRHYRIITAPLEGDS

SEQ ID NO: 36529 - protein, 9 aa, Homo sapiens
  light chain complementarity determining region 3 for antibody 18265
MQALEPPFT

SEQ ID NO: 36530 - protein, 15 aa, Homo sapiens
  heavy chain complementarity determining region 3 for antibody 18265
VRHYRELATGIEGDS

SEQ ID NO: 36531 - protein, 9 aa, Homo sapiens
  light chain complementarity determining region 3 for antibody 18266
MQALENPFT

SEQ ID NO: 36532 - protein, 15 aa, Homo sapiens
  heavy chain complementarity determining region 3 for antibody 18266
VRHYRETVAGIEGDS

SEQ ID NO: 36533 - protein, 9 aa, Homo sapiens
  light chain complementarity determining region 3 for antibody 18267
MKALETPFT

SEQ ID NO: 36534 - protein, 15 aa, Homo sapiens
  heavy chain complementarity determining region 3 for antibody 18267
VRHYRIITAPLEGDS

SEQ ID NO: 36535 - protein, 9 aa, Homo sapiens
  light chain complementarity determining region 3 for antibody 18268
MGTLQTPPT

SEQ ID NO: 36536 - protein, 15 aa, Homo sapiens
  heavy chain complementarity determining region 3 for antibody 18268
TRDGKKDGHNDAFDF

SEQ ID NO: 36537 - protein, 10 aa, Homo sapiens
  light chain complementarity determining region 3 for antibody 18269
LQYNNWPPYT

SEQ ID NO: 36538 - protein, 18 aa, Homo sapiens
  heavy chain complementarity determining region 3 for antibody 18269
ARAPTYDYGSRAYYLFDY

SEQ ID NO: 36539 - protein, 9 aa, Homo sapiens
  light chain complementarity determining region 3 for antibody 18270
LQHNTYPPT

SEQ ID NO: 36540 - protein, 15 aa, Homo sapiens
  heavy chain complementarity determining region 3 for antibody 18270
AKVWRGNSLWYDSDY

SEQ ID NO: 36541 - protein, 8 aa, Homo sapiens
  light chain complementarity determining region 3 for antibody 18271
LQHNSYLS

SEQ ID NO: 36542 - protein, 11 aa, Homo sapiens
  heavy chain complementarity determining region 3 for antibody 18271
ARDYAGAFFDY

SEQ ID NO: 36543 - protein, 9 aa, Homo sapiens
  light chain complementarity determining region 3 for antibody 18272
HQYYSSPRM

SEQ ID NO: 36544 - protein, 13 aa, Homo sapiens
  heavy chain complementarity determining region 3 for antibody 18272
ARGQSGDPRPYDY

SEQ ID NO: 36545 - protein, 9 aa, Homo sapiens
  light chain complementarity determining region 3 for antibody 18273
HQYSSSPYT

SEQ ID NO: 36546 - protein, 13 aa, Homo sapiens
  heavy chain complementarity determining region 3 for antibody 18273
ARGTYSAFAISGV

SEQ ID NO: 36547 - protein, 9 aa, Homo sapiens
  light chain complementarity determining region 3 for antibody 18274
HQYSSLPYT

SEQ ID NO: 36548 - protein, 13 aa, Homo sapiens
  heavy chain complementarity determining region 3 for antibody 18274
ARGTYSAFAIFGV

SEQ ID NO: 36549 - protein, 11 aa, Homo sapiens
  light chain complementarity determining region 3 for antibody 18275
HQYNNWPPRVS

SEQ ID NO: 36550 - protein, 13 aa, Homo sapiens
  heavy chain complementarity determining region 3 for antibody 18275
AKDRLGIIDAFDI

SEQ ID NO: 36551 - protein, 9 aa, Homo sapiens
  light chain complementarity determining region 3 for antibody 18276
HQYGSSPRT

SEQ ID NO: 36552 - protein, 14 aa, Homo sapiens
  heavy chain complementarity determining region 3 for antibody 18276
STDRIVGGGWMGDY

SEQ ID NO: 36553 - protein, 9 aa, Homo sapiens
  light chain complementarity determining region 3 for antibody 18277
HQYAESPRR

SEQ ID NO: 36554 - protein, 17 aa, Homo sapiens
  heavy chain complementarity determining region 3 for antibody 18277
AKSVGVDDAMTTRVYDS

SEQ ID NO: 36555 - protein, 9 aa, Homo sapiens
  light chain complementarity determining region 3 for antibody 18278
HQSYTAPFT

SEQ ID NO: 36556 - protein, 12 aa, Homo sapiens
  heavy chain complementarity determining region 3 for antibody 18278
ARNYFDSSGPGY

SEQ ID NO: 36557 - protein, 10 aa, Homo sapiens
  light chain complementarity determining region 3 for antibody 18279
HQSGILPPGT

SEQ ID NO: 36558 - protein, 13 aa, Homo sapiens
  heavy chain complementarity determining region 3 for antibody 18279
ARVSQAYYNGMDV

SEQ ID NO: 36559 - protein, 9 aa, Homo sapiens
  light chain complementarity determining region 3 for antibody 18280
VQSRTRPWT

SEQ ID NO: 36560 - protein, 12 aa, Homo sapiens
  heavy chain complementarity determining region 3 for antibody 18280
ARGRDEHKLGNY

SEQ ID NO: 36561 - protein, 11 aa, Homo sapiens
  light chain complementarity determining region 3 for antibody 18281
QRYDTSPPRYS

SEQ ID NO: 36562 - protein, 14 aa, Homo sapiens
  heavy chain complementarity determining region 3 for antibody 18281
ARHKQESGTRGFDF

SEQ ID NO: 36563 - protein, 9 aa, Homo sapiens
  light chain complementarity determining region 3 for antibody 18282
QQYYTSPLT

SEQ ID NO: 36564 - protein, 13 aa, Homo sapiens
  heavy chain complementarity determining region 3 for antibody 18282
VRGARRGRYEFDY

SEQ ID NO: 36565 - protein, 9 aa, Homo sapiens
  light chain complementarity determining region 3 for antibody 18283
QQYYTPPRT

SEQ ID NO: 36566 - protein, 8 aa, Homo sapiens
  heavy chain complementarity determining region 3 for antibody 18283
ARDGAFDS

SEQ ID NO: 36567 - protein, 9 aa, Homo sapiens
  light chain complementarity determining region 3 for antibody 18284
QQYYSTPWA

SEQ ID NO: 36568 - protein, 24 aa, Homo sapiens
  heavy chain complementarity determining region 3 for antibody 18284
ARGRPPSGWYRLKDRTYYYYGLDV

SEQ ID NO: 36569 - protein, 9 aa, Homo sapiens
  light chain complementarity determining region 3 for antibody 18285
QQYYSTPPT

SEQ ID NO: 36570 - protein, 12 aa, Homo sapiens
  heavy chain complementarity determining region 3 for antibody 18285
ARDRQQLVLFDY

SEQ ID NO: 36571 - protein, 9 aa, Homo sapiens
  light chain complementarity determining region 3 for antibody 18286
QQYYPSLRT

SEQ ID NO: 36572 - protein, 12 aa, Homo sapiens
  heavy chain complementarity determining region 3 for antibody 18286
VKDCGLGGSRDS

SEQ ID NO: 36573 - protein, 9 aa, Homo sapiens
  light chain complementarity determining region 3 for antibody 18287
QQYVTTPLT

SEQ ID NO: 36574 - protein, 8 aa, Homo sapiens
  heavy chain complementarity determining region 3 for antibody 18287
VRMSDYSL

SEQ ID NO: 36575 - protein, 11 aa, Homo sapiens
  light chain complementarity determining region 3 for antibody 18288
QQYVTSPPSSP

SEQ ID NO: 36576 - protein, 11 aa, Homo sapiens
  heavy chain complementarity determining region 3 for antibody 18288
AYSPGWWRIDC

SEQ ID NO: 36577 - protein, 9 aa, Homo sapiens
  light chain complementarity determining region 3 for antibody 18289
QQYNSFPWT

SEQ ID NO: 36578 - protein, 18 aa, Homo sapiens
  heavy chain complementarity determining region 3 for antibody 18289
AKGSGTHWERTSEAHCDL

SEQ ID NO: 36579 - protein, 10 aa, Homo sapiens
  light chain complementarity determining region 3 for antibody 18290
QQYNNWPPVT

SEQ ID NO: 36580 - protein, 12 aa, Homo sapiens
  heavy chain complementarity determining region 3 for antibody 18290
VKPAYSSGWYDY

SEQ ID NO: 36581 - protein, 10 aa, Homo sapiens
  light chain complementarity determining region 3 for antibody 18291
QQYNKWPPLT

SEQ ID NO: 36582 - protein, 17 aa, Homo sapiens
  heavy chain complementarity determining region 3 for antibody 18291
ARDLYFSIIQGGGAFDA

SEQ ID NO: 36583 - protein, 10 aa, Homo sapiens
  light chain complementarity determining region 3 for antibody 18292
QQYNHWPPLT

SEQ ID NO: 36584 - protein, 17 aa, Homo sapiens
  heavy chain complementarity determining region 3 for antibody 18292
ARDLYFSIIQGGGAFDA

SEQ ID NO: 36585 - protein, 10 aa, Homo sapiens
  light chain complementarity determining region 3 for antibody 18293
QQYHDWPPLT

SEQ ID NO: 36586 - protein, 17 aa, Homo sapiens
  heavy chain complementarity determining region 3 for antibody 18293
ARDSRIKMFGVVVMFHH

SEQ ID NO: 36587 - protein, 9 aa, Homo sapiens
  light chain complementarity determining region 3 for antibody 18294
QQYGTTPRT

SEQ ID NO: 36588 - protein, 13 aa, Homo sapiens
  heavy chain complementarity determining region 3 for antibody 18294
ACGYYEGGRYYDY

SEQ ID NO: 36589 - protein, 11 aa, Homo sapiens
  light chain complementarity determining region 3 for antibody 18295
QQYGTSPPKVP

SEQ ID NO: 36590 - protein, 11 aa, Homo sapiens
  heavy chain complementarity determining region 3 for antibody 18295
AKPSAGTTGDY

SEQ ID NO: 36591 - protein, 9 aa, Homo sapiens
  light chain complementarity determining region 3 for antibody 18296
QQYGTSPLT

SEQ ID NO: 36592 - protein, 15 aa, Homo sapiens
  heavy chain complementarity determining region 3 for antibody 18296
ARQNDFLSGPGEFDP

SEQ ID NO: 36593 - protein, 9 aa, Homo sapiens
  light chain complementarity determining region 3 for antibody 18297
QQYGTLPRT

SEQ ID NO: 36594 - protein, 13 aa, Homo sapiens
  heavy chain complementarity determining region 3 for antibody 18297
AGGIFHSRGYGEY

SEQ ID NO: 36595 - protein, 9 aa, Homo sapiens
  light chain complementarity determining region 3 for antibody 18298
QQYGSSPRT

SEQ ID NO: 36596 - protein, 13 aa, Homo sapiens
  heavy chain complementarity determining region 3 for antibody 18298
ASGYFDRSGYYDY

SEQ ID NO: 36597 - protein, 9 aa, Homo sapiens
  light chain complementarity determining region 3 for antibody 18299
QQYGSSPRT

SEQ ID NO: 36598 - protein, 25 aa, Homo sapiens
  heavy chain complementarity determining region 3 for antibody 18299
ARLRIDRLRLPGAMRGPLYDCGLSV

SEQ ID NO: 36599 - protein, 10 aa, Homo sapiens
  light chain complementarity determining region 3 for antibody 18300
QQYGSSPGDT

SEQ ID NO: 36600 - protein, 14 aa, Homo sapiens
  heavy chain complementarity determining region 3 for antibody 18300
ARGPAAAGPWYFDF

SEQ ID NO: 36601 - protein, 9 aa, Homo sapiens
  light chain complementarity determining region 3 for antibody 18301
QQYGSLPLP

SEQ ID NO: 36602 - protein, 15 aa, Homo sapiens
  heavy chain complementarity determining region 3 for antibody 18301
AHRPNYYDKAGAFDI

SEQ ID NO: 36603 - protein, 10 aa, Homo sapiens
  light chain complementarity determining region 3 for antibody 18302
QQYGRSPMYS

SEQ ID NO: 36604 - protein, 11 aa, Homo sapiens
  heavy chain complementarity determining region 3 for antibody 18302
ARGGQWGSLDY

SEQ ID NO: 36605 - protein, 9 aa, Homo sapiens
  light chain complementarity determining region 3 for antibody 18303
QQYGNSPRT

SEQ ID NO: 36606 - protein, 15 aa, Homo sapiens
  heavy chain complementarity determining region 3 for antibody 18303
AGGWFNYYSSGYYDT

SEQ ID NO: 36607 - protein, 9 aa, Homo sapiens
  light chain complementarity determining region 3 for antibody 18304
QQYGHLPRT

SEQ ID NO: 36608 - protein, 13 aa, Homo sapiens
  heavy chain complementarity determining region 3 for antibody 18304
AGGDFHRGGYSEY

SEQ ID NO: 36609 - protein, 9 aa, Homo sapiens
  light chain complementarity determining region 3 for antibody 18305
QQYFSTPYT

SEQ ID NO: 36610 - protein, 16 aa, Homo sapiens
  heavy chain complementarity determining region 3 for antibody 18305
ARAKWDRGLAVAGFDY

SEQ ID NO: 36611 - protein, 8 aa, Homo sapiens
  light chain complementarity determining region 3 for antibody 18306
QQYENLGT

SEQ ID NO: 36612 - protein, 18 aa, Homo sapiens
  heavy chain complementarity determining region 3 for antibody 18306
AKGAEGSCSVRKCYPFDY

SEQ ID NO: 36613 - protein, 9 aa, Homo sapiens
  light chain complementarity determining region 3 for antibody 18307
QQYDTAPWT

SEQ ID NO: 36614 - protein, 15 aa, Homo sapiens
  heavy chain complementarity determining region 3 for antibody 18307
LRDIKGPSAGIPYDS

SEQ ID NO: 36615 - protein, 9 aa, Homo sapiens
  light chain complementarity determining region 3 for antibody 18308
QQYDSYPLT

SEQ ID NO: 36616 - protein, 15 aa, Homo sapiens
  heavy chain complementarity determining region 3 for antibody 18308
ARGGYDSGHYYVGHY

SEQ ID NO: 36617 - protein, 9 aa, Homo sapiens
  light chain complementarity determining region 3 for antibody 18309
QQSYTTPWT

SEQ ID NO: 36618 - protein, 18 aa, Homo sapiens
  heavy chain complementarity determining region 3 for antibody 18309
ARMRRAVLNFWSVGIIDS

SEQ ID NO: 36619 - protein, 8 aa, Homo sapiens
  light chain complementarity determining region 3 for antibody 18310
QQSYSISF

SEQ ID NO: 36620 - protein, 14 aa, Homo sapiens
  heavy chain complementarity determining region 3 for antibody 18310
ARGLAIDSTGCVGY

SEQ ID NO: 36621 - protein, 9 aa, Homo sapiens
  light chain complementarity determining region 3 for antibody 18311
QQSYRTAFT

SEQ ID NO: 36622 - protein, 15 aa, Homo sapiens
  heavy chain complementarity determining region 3 for antibody 18311
AVLPMVLVSNGHLEY

SEQ ID NO: 36623 - protein, 9 aa, Homo sapiens
  light chain complementarity determining region 3 for antibody 18312
QQSHITPIT

SEQ ID NO: 36624 - protein, 10 aa, Homo sapiens
  heavy chain complementarity determining region 3 for antibody 18312
TRSEGYGMDV

SEQ ID NO: 36625 - protein, 9 aa, Homo sapiens
  light chain complementarity determining region 3 for antibody 18313
QQSHDFPYT

SEQ ID NO: 36626 - protein, 13 aa, Homo sapiens
  heavy chain complementarity determining region 3 for antibody 18313
VRLNDIHGWPFDS

SEQ ID NO: 36627 - protein, 10 aa, Homo sapiens
  light chain complementarity determining region 3 for antibody 18314
QQSFSSSPIT

SEQ ID NO: 36628 - protein, 16 aa, Homo sapiens
  heavy chain complementarity determining region 3 for antibody 18314
ARQGPWTTVVPPHFDH

SEQ ID NO: 36629 - protein, 11 aa, Homo sapiens
  light chain complementarity determining region 3 for antibody 18315
QQRTNWPPIST

SEQ ID NO: 36630 - protein, 14 aa, Homo sapiens
  heavy chain complementarity determining region 3 for antibody 18315
ARGGLGIWGNSSDI

SEQ ID NO: 36631 - protein, 10 aa, Homo sapiens
  light chain complementarity determining region 3 for antibody 18316
QQRSNWPPWT

SEQ ID NO: 36632 - protein, 14 aa, Homo sapiens
  heavy chain complementarity determining region 3 for antibody 18316
ARFYGSSAVDAFDI

SEQ ID NO: 36633 - protein, 9 aa, Homo sapiens
  light chain complementarity determining region 3 for antibody 18317
QQRKNWPFT

SEQ ID NO: 36634 - protein, 18 aa, Homo sapiens
  heavy chain complementarity determining region 3 for antibody 18317
ARDPWKYDSSGHGGTFDY

SEQ ID NO: 36635 - protein, 9 aa, Homo sapiens
  light chain complementarity determining region 3 for antibody 18318
QQRDNWPYT

SEQ ID NO: 36636 - protein, 16 aa, Homo sapiens
  heavy chain complementarity determining region 3 for antibody 18318
ARDGGSCRSRADYFDY

SEQ ID NO: 36637 - protein, 9 aa, Homo sapiens
  light chain complementarity determining region 3 for antibody 18319
QQNGTSPRT

SEQ ID NO: 36638 - protein, 13 aa, Homo sapiens
  heavy chain complementarity determining region 3 for antibody 18319
PIGFYDRSGYHEY

SEQ ID NO: 36639 - protein, 9 aa, Homo sapiens
  light chain complementarity determining region 3 for antibody 18320
QQNGSSPRT

SEQ ID NO: 36640 - protein, 25 aa, Homo sapiens
  heavy chain complementarity determining region 3 for antibody 18320
ARLRIDRLRLPGAMRGPLYDCGLNV

SEQ ID NO: 36641 - protein, 9 aa, Homo sapiens
  light chain complementarity determining region 3 for antibody 18321
QQLNTYPIT

SEQ ID NO: 36642 - protein, 13 aa, Homo sapiens
  heavy chain complementarity determining region 3 for antibody 18321
AKTLTMVATYGDY

SEQ ID NO: 36643 - protein, 9 aa, Homo sapiens
  light chain complementarity determining region 3 for antibody 18322
QQGYRPPFI

SEQ ID NO: 36644 - protein, 15 aa, Homo sapiens
  heavy chain complementarity determining region 3 for antibody 18322
TRAQVVWGQLYYFDY

SEQ ID NO: 36645 - protein, 9 aa, Homo sapiens
  light chain complementarity determining region 3 for antibody 18323
QQFNIYPPP

SEQ ID NO: 36646 - protein, 15 aa, Homo sapiens
  heavy chain complementarity determining region 3 for antibody 18323
VRDSGIRVRQDYFDY

SEQ ID NO: 36647 - protein, 9 aa, Homo sapiens
  light chain complementarity determining region 3 for antibody 18324
QQDVTTPLT

SEQ ID NO: 36648 - protein, 8 aa, Homo sapiens
  heavy chain complementarity determining region 3 for antibody 18324
VRMSDYIL

SEQ ID NO: 36649 - protein, 9 aa, Homo sapiens
  light chain complementarity determining region 3 for antibody 18325
QQDGSSPRT

SEQ ID NO: 36650 - protein, 17 aa, Homo sapiens
  heavy chain complementarity determining region 3 for antibody 18325
TTDPQWLEPPPFLTNDY

SEQ ID NO: 36651 - protein, 9 aa, Homo sapiens
  light chain complementarity determining region 3 for antibody 18326
QQDGSSPLT

SEQ ID NO: 36652 - protein, 19 aa, Homo sapiens
  heavy chain complementarity determining region 3 for antibody 18326
ARGSSSSRRRAAVVGYFDL

SEQ ID NO: 36653 - protein, 9 aa, Homo sapiens
  light chain complementarity determining region 3 for antibody 18327
QQDGSIPRT

SEQ ID NO: 36654 - protein, 13 aa, Homo sapiens
  heavy chain complementarity determining region 3 for antibody 18327
AGGGFSSGRYSEY

SEQ ID NO: 36655 - protein, 9 aa, Homo sapiens
  light chain complementarity determining region 3 for antibody 18328
QQDGRSPYT

SEQ ID NO: 36656 - protein, 18 aa, Homo sapiens
  heavy chain complementarity determining region 3 for antibody 18328
ARPMVRALDEYNYYGLDV

SEQ ID NO: 36657 - protein, 9 aa, Homo sapiens
  light chain complementarity determining region 3 for antibody 18329
QQDGNLPRT

SEQ ID NO: 36658 - protein, 13 aa, Homo sapiens
  heavy chain complementarity determining region 3 for antibody 18329
AGGQFHSSGYSEF

SEQ ID NO: 36659 - protein, 9 aa, Homo sapiens
  light chain complementarity determining region 3 for antibody 18330
QQANSFPLT

SEQ ID NO: 36660 - protein, 18 aa, Homo sapiens
  heavy chain complementarity determining region 3 for antibody 18330
VLMGHYYNSGSPNWYFDL

SEQ ID NO: 36661 - protein, 9 aa, Homo sapiens
  light chain complementarity determining region 3 for antibody 18331
QNYYNPPTS

SEQ ID NO: 36662 - protein, 14 aa, Homo sapiens
  heavy chain complementarity determining region 3 for antibody 18331
TRDPPGIAAAGGGG

SEQ ID NO: 36663 - protein, 9 aa, Homo sapiens
  light chain complementarity determining region 3 for antibody 18332
QHYVTSPLT

SEQ ID NO: 36664 - protein, 8 aa, Homo sapiens
  heavy chain complementarity determining region 3 for antibody 18332
VCMIVATH

SEQ ID NO: 36665 - protein, 9 aa, Homo sapiens
  light chain complementarity determining region 3 for antibody 18333
QHRSGWPPT

SEQ ID NO: 36666 - protein, 18 aa, Homo sapiens
  heavy chain complementarity determining region 3 for antibody 18333
ARDLPPGATGNCYYGLED

SEQ ID NO: 36667 - protein, 9 aa, Homo sapiens
  light chain complementarity determining region 3 for antibody 18334
QHRRTWLDS

SEQ ID NO: 36668 - protein, 20 aa, Homo sapiens
  heavy chain complementarity determining region 3 for antibody 18334
ARDGSAGMAARGTPYYGLDV

SEQ ID NO: 36669 - protein, 11 aa, Homo sapiens
  light chain complementarity determining region 3 for antibody 18335
QGYGASPPMYP

SEQ ID NO: 36670 - protein, 12 aa, Homo sapiens
  heavy chain complementarity determining region 3 for antibody 18335
AKDLHGSGSFDH

SEQ ID NO: 36671 - protein, 9 aa, Homo sapiens
  light chain complementarity determining region 3 for antibody 18336
PQYYTSLRT

SEQ ID NO: 36672 - protein, 12 aa, Homo sapiens
  heavy chain complementarity determining region 3 for antibody 18336
VKDCGLGGSRDS

SEQ ID NO: 36673 - protein, 10 aa, Homo sapiens
  light chain complementarity determining region 3 for antibody 18337
MQSIQPPRWT

SEQ ID NO: 36674 - protein, 8 aa, Homo sapiens
  heavy chain complementarity determining region 3 for antibody 18337
AKGYGFDS

SEQ ID NO: 36675 - protein, 10 aa, Homo sapiens
  light chain complementarity determining region 3 for antibody 18338
MQRVQFPRWT

SEQ ID NO: 36676 - protein, 8 aa, Homo sapiens
  heavy chain complementarity determining region 3 for antibody 18338
AKGYGFDS

SEQ ID NO: 36677 - protein, 9 aa, Homo sapiens
  light chain complementarity determining region 3 for antibody 18339
MQGTQWPRT

SEQ ID NO: 36678 - protein, 13 aa, Homo sapiens
  heavy chain complementarity determining region 3 for antibody 18339
TRDPGVFYGGMDA

SEQ ID NO: 36679 - protein, 9 aa, Homo sapiens
  light chain complementarity determining region 3 for antibody 18340
MQGTQGPWT

SEQ ID NO: 36680 - protein, 15 aa, Homo sapiens
  heavy chain complementarity determining region 3 for antibody 18340
VRFPPDLDIVGMIDH

SEQ ID NO: 36681 - protein, 8 aa, Homo sapiens
  light chain complementarity determining region 3 for antibody 18341
MQGTDWRT

SEQ ID NO: 36682 - protein, 10 aa, Homo sapiens
  heavy chain complementarity determining region 3 for antibody 18341
ARDTPGDLDY

SEQ ID NO: 36683 - protein, 9 aa, Homo sapiens
  light chain complementarity determining region 3 for antibody 18342
MQGLQVPHT

SEQ ID NO: 36684 - protein, 14 aa, Homo sapiens
  heavy chain complementarity determining region 3 for antibody 18342
TSGLVRRGARVFDI

SEQ ID NO: 36685 - protein, 9 aa, Homo sapiens
  light chain complementarity determining region 3 for antibody 18343
MQGLQTLFT

SEQ ID NO: 36686 - protein, 23 aa, Homo sapiens
  heavy chain complementarity determining region 3 for antibody 18343
AKVSGLIGFGEPNNYYYYYGMDV

SEQ ID NO: 36687 - protein, 9 aa, Homo sapiens
  light chain complementarity determining region 3 for antibody 18344
MQATQYPYT

SEQ ID NO: 36688 - protein, 13 aa, Homo sapiens
  heavy chain complementarity determining region 3 for antibody 18344
ARLPARGGWHFQP

SEQ ID NO: 36689 - protein, 9 aa, Homo sapiens
  light chain complementarity determining region 3 for antibody 18345
MQALVTPFT

SEQ ID NO: 36690 - protein, 15 aa, Homo sapiens
  heavy chain complementarity determining region 3 for antibody 18345
VRHYRETVAGIEGDS

SEQ ID NO: 36691 - protein, 9 aa, Homo sapiens
  light chain complementarity determining region 3 for antibody 18346
MQALKTPFT

SEQ ID NO: 36692 - protein, 15 aa, Homo sapiens
  heavy chain complementarity determining region 3 for antibody 18346
VRHYRETVAGIEGDS

SEQ ID NO: 36693 - protein, 9 aa, Homo sapiens
  light chain complementarity determining region 3 for antibody 18347
MQALETPFT

SEQ ID NO: 36694 - protein, 15 aa, Homo sapiens
  heavy chain complementarity determining region 3 for antibody 18347
VRHYRIIAAPLEGDS

SEQ ID NO: 36695 - protein, 9 aa, Homo sapiens
  light chain complementarity determining region 3 for antibody 18348
MQALETPFT

SEQ ID NO: 36696 - protein, 15 aa, Homo sapiens
  heavy chain complementarity determining region 3 for antibody 18348
VRHYRGTVAGIEGDS

SEQ ID NO: 36697 - protein, 9 aa, Homo sapiens
  light chain complementarity determining region 3 for antibody 18349
MQALETPFT

SEQ ID NO: 36698 - protein, 15 aa, Homo sapiens
  heavy chain complementarity determining region 3 for antibody 18349
VRHYREAVAGIEGDS

SEQ ID NO: 36699 - protein, 9 aa, Homo sapiens
  light chain complementarity determining region 3 for antibody 18350
MQALETPFT

SEQ ID NO: 36700 - protein, 15 aa, Homo sapiens
  heavy chain complementarity determining region 3 for antibody 18350
LRHYRSLVTATEADS

SEQ ID NO: 36701 - protein, 9 aa, Homo sapiens
  light chain complementarity determining region 3 for antibody 18351
MQALETPFP

SEQ ID NO: 36702 - protein, 15 aa, Homo sapiens
  heavy chain complementarity determining region 3 for antibody 18351
VRHYRITVAAVEGDS

SEQ ID NO: 36703 - protein, 9 aa, Homo sapiens
  light chain complementarity determining region 3 for antibody 18352
MQALETPFI

SEQ ID NO: 36704 - protein, 15 aa, Homo sapiens
  heavy chain complementarity determining region 3 for antibody 18352
VRHYRIITAPLEGDS

SEQ ID NO: 36705 - protein, 9 aa, Homo sapiens
  light chain complementarity determining region 3 for antibody 18353
MHRINWPWT

SEQ ID NO: 36706 - protein, 7 aa, Homo sapiens
  heavy chain complementarity determining region 3 for antibody 18353
ATARGAD

SEQ ID NO: 36707 - protein, 9 aa, Homo sapiens
  light chain complementarity determining region 3 for antibody 18354
MGTLQTPPR

SEQ ID NO: 36708 - protein, 15 aa, Homo sapiens
  heavy chain complementarity determining region 3 for antibody 18354
TRDGKKDGHNDAFDI

SEQ ID NO: 36709 - protein, 9 aa, Homo sapiens
  light chain complementarity determining region 3 for antibody 18355
LQYGGPPLT

SEQ ID NO: 36710 - protein, 8 aa, Homo sapiens
  heavy chain complementarity determining region 3 for antibody 18355
VRIMDPGY

SEQ ID NO: 36711 - protein, 9 aa, Homo sapiens
  light chain complementarity determining region 3 for antibody 18356
LQHNSYPFT

SEQ ID NO: 36712 - protein, 13 aa, Homo sapiens
  heavy chain complementarity determining region 3 for antibody 18356
VRHAVVRPMVVDD

SEQ ID NO: 36713 - protein, 9 aa, Homo sapiens
  light chain complementarity determining region 3 for antibody 18357
LQGNRFPHT

SEQ ID NO: 36714 - protein, 14 aa, Homo sapiens
  heavy chain complementarity determining region 3 for antibody 18357
ARYCSGNSCSSMDH

SEQ ID NO: 36715 - protein, 9 aa, Homo sapiens
  light chain complementarity determining region 3 for antibody 18358
LQGNRFPHT

SEQ ID NO: 36716 - protein, 14 aa, Homo sapiens
  heavy chain complementarity determining region 3 for antibody 18358
ARYCSGNSCCSMDH

SEQ ID NO: 36717 - protein, 9 aa, Homo sapiens
  light chain complementarity determining region 3 for antibody 18359
HQYRSSPYT

SEQ ID NO: 36718 - protein, 13 aa, Homo sapiens
  heavy chain complementarity determining region 3 for antibody 18359
ARGTYSAFAIFGV

SEQ ID NO: 36719 - protein, 9 aa, Homo sapiens
  light chain complementarity determining region 3 for antibody 18360
EQHLDWPLT

SEQ ID NO: 36720 - protein, 11 aa, Homo sapiens
  heavy chain complementarity determining region 3 for antibody 18360
ARNILGGHTDF

SEQ ID NO: 36721 - protein, 10 aa, Homo sapiens
  light chain complementarity determining region 3 for antibody 18361
SQSTYWPPYT

SEQ ID NO: 36722 - protein, 16 aa, Homo sapiens
  heavy chain complementarity determining region 3 for antibody 18361
VRLSRTGGALLDAFDV

SEQ ID NO: 36723 - protein, 9 aa, Homo sapiens
  light chain complementarity determining region 3 for antibody 18362
RQALETPFT

SEQ ID NO: 36724 - protein, 15 aa, Homo sapiens
  heavy chain complementarity determining region 3 for antibody 18362
VRHYRELTTGIEGDS

SEQ ID NO: 36725 - protein, 9 aa, Homo sapiens
  light chain complementarity determining region 3 for antibody 18363
QYYGRSPWP

SEQ ID NO: 36726 - protein, 17 aa, Homo sapiens
  heavy chain complementarity determining region 3 for antibody 18363
ARTVLYHFTSGRAAFDV

SEQ ID NO: 36727 - protein, 9 aa, Homo sapiens
  light chain complementarity determining region 3 for antibody 18364
QRYNVWPYT

SEQ ID NO: 36728 - protein, 13 aa, Homo sapiens
  heavy chain complementarity determining region 3 for antibody 18364
ARVMAAAGYGMDV

SEQ ID NO: 36729 - protein, 8 aa, Homo sapiens
  light chain complementarity determining region 3 for antibody 18365
QRDGSSPL

SEQ ID NO: 36730 - protein, 15 aa, Homo sapiens
  heavy chain complementarity determining region 3 for antibody 18365
ARDRASIGYYYLFDY

SEQ ID NO: 36731 - protein, 9 aa, Homo sapiens
  light chain complementarity determining region 3 for antibody 18366
QQYYTTPWT

SEQ ID NO: 36732 - protein, 14 aa, Homo sapiens
  heavy chain complementarity determining region 3 for antibody 18366
ARPAQIYSSSWVDY

SEQ ID NO: 36733 - protein, 9 aa, Homo sapiens
  light chain complementarity determining region 3 for antibody 18367
QQYYRSPPT

SEQ ID NO: 36734 - protein, 19 aa, Homo sapiens
  heavy chain complementarity determining region 3 for antibody 18367
AKGRRGQCSGGNCPHYYDS

SEQ ID NO: 36735 - protein, 9 aa, Homo sapiens
  light chain complementarity determining region 3 for antibody 18368
QQYYISLRT

SEQ ID NO: 36736 - protein, 12 aa, Homo sapiens
  heavy chain complementarity determining region 3 for antibody 18368
VKDCGLGGSRDS

SEQ ID NO: 36737 - protein, 9 aa, Homo sapiens
  light chain complementarity determining region 3 for antibody 18369
QQYYDSPPT

SEQ ID NO: 36738 - protein, 20 aa, Homo sapiens
  heavy chain complementarity determining region 3 for antibody 18369
ARVDSQWLGELLRPNWYFDL

SEQ ID NO: 36739 - protein, 10 aa, Homo sapiens
  light chain complementarity determining region 3 for antibody 18370
QQYSSSPPGT

SEQ ID NO: 36740 - protein, 16 aa, Homo sapiens
  heavy chain complementarity determining region 3 for antibody 18370
ARRQWVRGLFRGGLDS

SEQ ID NO: 36741 - protein, 8 aa, Homo sapiens
  light chain complementarity determining region 3 for antibody 18371
QQYNRYWT

SEQ ID NO: 36742 - protein, 13 aa, Homo sapiens
  heavy chain complementarity determining region 3 for antibody 18371
ARVSHAFGGVNDY

SEQ ID NO: 36743 - protein, 10 aa, Homo sapiens
  light chain complementarity determining region 3 for antibody 18372
QQYNNWPPLP

SEQ ID NO: 36744 - protein, 17 aa, Homo sapiens
  heavy chain complementarity determining region 3 for antibody 18372
AKDLRPFYDIFAGYLDM

SEQ ID NO: 36745 - protein, 10 aa, Homo sapiens
  light chain complementarity determining region 3 for antibody 18373
QQYNNWLGWT

SEQ ID NO: 36746 - protein, 13 aa, Homo sapiens
  heavy chain complementarity determining region 3 for antibody 18373
ARHGRRSGWYYAY

SEQ ID NO: 36747 - protein, 9 aa, Homo sapiens
  light chain complementarity determining region 3 for antibody 18374
QQYGYSARP

SEQ ID NO: 36748 - protein, 13 aa, Homo sapiens
  heavy chain complementarity determining region 3 for antibody 18374
ARGYFYSDGYIDD

SEQ ID NO: 36749 - protein, 8 aa, Homo sapiens
  light chain complementarity determining region 3 for antibody 18375
QQYGTSRL

SEQ ID NO: 36750 - protein, 13 aa, Homo sapiens
  heavy chain complementarity determining region 3 for antibody 18375
ARGQFVGSAYYEN

SEQ ID NO: 36751 - protein, 9 aa, Homo sapiens
  light chain complementarity determining region 3 for antibody 18376
QQYGTSPFT

SEQ ID NO: 36752 - protein, 15 aa, Homo sapiens
  heavy chain complementarity determining region 3 for antibody 18376
ARQNDVLSGPGEFDP

SEQ ID NO: 36753 - protein, 9 aa, Homo sapiens
  light chain complementarity determining region 3 for antibody 18377
QQYGTLPRT

SEQ ID NO: 36754 - protein, 13 aa, Homo sapiens
  heavy chain complementarity determining region 3 for antibody 18377
AGGLFDSSGYSEF

SEQ ID NO: 36755 - protein, 9 aa, Homo sapiens
  light chain complementarity determining region 3 for antibody 18378
QQYGSYPRT

SEQ ID NO: 36756 - protein, 25 aa, Homo sapiens
  heavy chain complementarity determining region 3 for antibody 18378
ARLRIDRLRLPGAMRGPLYDCGLNV

SEQ ID NO: 36757 - protein, 9 aa, Homo sapiens
  light chain complementarity determining region 3 for antibody 18379
QQYGSSPRT

SEQ ID NO: 36758 - protein, 25 aa, Homo sapiens
  heavy chain complementarity determining region 3 for antibody 18379
ARLRIARLRLPGAMRGPLYDCGLNV

SEQ ID NO: 36759 - protein, 9 aa, Homo sapiens
  light chain complementarity determining region 3 for antibody 18380
QQYGSSPRT

SEQ ID NO: 36760 - protein, 15 aa, Homo sapiens
  heavy chain complementarity determining region 3 for antibody 18380
AKTYDCWSGDDAFEI

SEQ ID NO: 36761 - protein, 9 aa, Homo sapiens
  light chain complementarity determining region 3 for antibody 18381
QQYGSSPRP

SEQ ID NO: 36762 - protein, 15 aa, Homo sapiens
  heavy chain complementarity determining region 3 for antibody 18381
AKTYDFWSGDDAFEI

SEQ ID NO: 36763 - protein, 9 aa, Homo sapiens
  light chain complementarity determining region 3 for antibody 18382
QQYGSSPPT

SEQ ID NO: 36764 - protein, 19 aa, Homo sapiens
  heavy chain complementarity determining region 3 for antibody 18382
ARGSSSSRRRAAVVGYFDL

SEQ ID NO: 36765 - protein, 10 aa, Homo sapiens
  light chain complementarity determining region 3 for antibody 18383
QQYGSSPPAT

SEQ ID NO: 36766 - protein, 15 aa, Homo sapiens
  heavy chain complementarity determining region 3 for antibody 18383
AKGPMVRGVLGPFDY

SEQ ID NO: 36767 - protein, 9 aa, Homo sapiens
  light chain complementarity determining region 3 for antibody 18384
QQYGSLPRT

SEQ ID NO: 36768 - protein, 13 aa, Homo sapiens
  heavy chain complementarity determining region 3 for antibody 18384
AGGLFHSSGYSEF

SEQ ID NO: 36769 - protein, 9 aa, Homo sapiens
  light chain complementarity determining region 3 for antibody 18385
QQYGSIPRT

SEQ ID NO: 36770 - protein, 13 aa, Homo sapiens
  heavy chain complementarity determining region 3 for antibody 18385
AGGLFHSSGYSDF

SEQ ID NO: 36771 - protein, 9 aa, Homo sapiens
  light chain complementarity determining region 3 for antibody 18386
QQYGSIPPT

SEQ ID NO: 36772 - protein, 7 aa, Homo sapiens
  heavy chain complementarity determining region 3 for antibody 18386
HGYELKC

SEQ ID NO: 36773 - protein, 11 aa, Homo sapiens
  light chain complementarity determining region 3 for antibody 18387
QQYGRSPPGYP

SEQ ID NO: 36774 - protein, 12 aa, Homo sapiens
  heavy chain complementarity determining region 3 for antibody 18387
AREWPETCYFDY

SEQ ID NO: 36775 - protein, 9 aa, Homo sapiens
  light chain complementarity determining region 3 for antibody 18388
QQYGRLPLT

SEQ ID NO: 36776 - protein, 15 aa, Homo sapiens
  heavy chain complementarity determining region 3 for antibody 18388
AHRPNYYDKAGAFDI

SEQ ID NO: 36777 - protein, 9 aa, Homo sapiens
  light chain complementarity determining region 3 for antibody 18389
QQYGNLPRS

SEQ ID NO: 36778 - protein, 13 aa, Homo sapiens
  heavy chain complementarity determining region 3 for antibody 18389
AGGTWHSGTYYES

SEQ ID NO: 36779 - protein, 9 aa, Homo sapiens
  light chain complementarity determining region 3 for antibody 18390
QQYGNIPRT

SEQ ID NO: 36780 - protein, 13 aa, Homo sapiens
  heavy chain complementarity determining region 3 for antibody 18390
AGGLFHSSGYSDF

SEQ ID NO: 36781 - protein, 11 aa, Homo sapiens
  light chain complementarity determining region 3 for antibody 18391
QQYGGSPPGYT

SEQ ID NO: 36782 - protein, 12 aa, Homo sapiens
  heavy chain complementarity determining region 3 for antibody 18391
AREWPETCYFDY

SEQ ID NO: 36783 - protein, 9 aa, Homo sapiens
  light chain complementarity determining region 3 for antibody 18392
QQYGGLGKT

SEQ ID NO: 36784 - protein, 12 aa, Homo sapiens
  heavy chain complementarity determining region 3 for antibody 18392
ARGGIWTGGFDY

SEQ ID NO: 36785 - protein, 11 aa, Homo sapiens
  light chain complementarity determining region 3 for antibody 18393
QQYGDSPPMST

SEQ ID NO: 36786 - protein, 12 aa, Homo sapiens
  heavy chain complementarity determining region 3 for antibody 18393
AGQGDRSYSYSY

SEQ ID NO: 36787 - protein, 9 aa, Homo sapiens
  light chain complementarity determining region 3 for antibody 18394
QQYFTSPPT

SEQ ID NO: 36788 - protein, 15 aa, Homo sapiens
  heavy chain complementarity determining region 3 for antibody 18394
VKVLMSGTQIALFDH

SEQ ID NO: 36789 - protein, 9 aa, Homo sapiens
  light chain complementarity determining region 3 for antibody 18395
QQYERPPQT

SEQ ID NO: 36790 - protein, 15 aa, Homo sapiens
  heavy chain complementarity determining region 3 for antibody 18395
ARDPTVASHHYGVDV

SEQ ID NO: 36791 - protein, 11 aa, Homo sapiens
  light chain complementarity determining region 3 for antibody 18396
QQYDTSPPGST

SEQ ID NO: 36792 - protein, 14 aa, Homo sapiens
  heavy chain complementarity determining region 3 for antibody 18396
ARETSNSRKRSFDQ

SEQ ID NO: 36793 - protein, 11 aa, Homo sapiens
  light chain complementarity determining region 3 for antibody 18397
QQYDTSPPGDP

SEQ ID NO: 36794 - protein, 14 aa, Homo sapiens
  heavy chain complementarity determining region 3 for antibody 18397
ARETSNSRKRSFDQ

SEQ ID NO: 36795 - protein, 9 aa, Homo sapiens
  light chain complementarity determining region 3 for antibody 18398
QQTNSNPPT

SEQ ID NO: 36796 - protein, 12 aa, Homo sapiens
  heavy chain complementarity determining region 3 for antibody 18398
ARGGLGIWGNSF

SEQ ID NO: 36797 - protein, 9 aa, Homo sapiens
  light chain complementarity determining region 3 for antibody 18399
QQSYSAPFT

SEQ ID NO: 36798 - protein, 18 aa, Homo sapiens
  heavy chain complementarity determining region 3 for antibody 18399
ARDEPGCSGGRCPHPWSY

SEQ ID NO: 36799 - protein, 10 aa, Homo sapiens
  light chain complementarity determining region 3 for antibody 18400
QQSGSSPMYS

SEQ ID NO: 36800 - protein, 11 aa, Homo sapiens
  heavy chain complementarity determining region 3 for antibody 18400
ARGGQWGSLDY

SEQ ID NO: 36801 - protein, 10 aa, Homo sapiens
  light chain complementarity determining region 3 for antibody 18401
QQRYSWPPLP

SEQ ID NO: 36802 - protein, 14 aa, Homo sapiens
  heavy chain complementarity determining region 3 for antibody 18401
AKGANLHHPYYFDY

SEQ ID NO: 36803 - protein, 8 aa, Homo sapiens
  light chain complementarity determining region 3 for antibody 18402
QQRTGWLS

SEQ ID NO: 36804 - protein, 19 aa, Homo sapiens
  heavy chain complementarity determining region 3 for antibody 18402
ARVYCSGFSCYSGGWYFDL

SEQ ID NO: 36805 - protein, 10 aa, Homo sapiens
  light chain complementarity determining region 3 for antibody 18403
QQRSNWPPLT

SEQ ID NO: 36806 - protein, 9 aa, Homo sapiens
  heavy chain complementarity determining region 3 for antibody 18403
ARVDGYFDY

SEQ ID NO: 36807 - protein, 10 aa, Homo sapiens
  light chain complementarity determining region 3 for antibody 18404
QQRGIWPPIP

SEQ ID NO: 36808 - protein, 13 aa, Homo sapiens
  heavy chain complementarity determining region 3 for antibody 18404
VRELHAGAYYYDY

SEQ ID NO: 36809 - protein, 9 aa, Homo sapiens
  light chain complementarity determining region 3 for antibody 18405
QQHGSSPRT

SEQ ID NO: 36810 - protein, 25 aa, Homo sapiens
  heavy chain complementarity determining region 3 for antibody 18405
ARLRIDRLRLPGAMRGPLYDCGLNV

SEQ ID NO: 36811 - protein, 9 aa, Homo sapiens
  light chain complementarity determining region 3 for antibody 18406
QQGYSSPLI

SEQ ID NO: 36812 - protein, 15 aa, Homo sapiens
  heavy chain complementarity determining region 3 for antibody 18406
ARAQVIWGQLYYFDY

SEQ ID NO: 36813 - protein, 9 aa, Homo sapiens
  light chain complementarity determining region 3 for antibody 18407
QQFYTYPLT

SEQ ID NO: 36814 - protein, 12 aa, Homo sapiens
  heavy chain complementarity determining region 3 for antibody 18407
TRVLSSAIGEGD

SEQ ID NO: 36815 - protein, 9 aa, Homo sapiens
  light chain complementarity determining region 3 for antibody 18408
QQDGTIPRT

SEQ ID NO: 36816 - protein, 13 aa, Homo sapiens
  heavy chain complementarity determining region 3 for antibody 18408
AGGNFHRSGYAEY

SEQ ID NO: 36817 - protein, 9 aa, Homo sapiens
  light chain complementarity determining region 3 for antibody 18409
QQDGSIPRT

SEQ ID NO: 36818 - protein, 13 aa, Homo sapiens
  heavy chain complementarity determining region 3 for antibody 18409
AGGSFSGGNYKED

SEQ ID NO: 36819 - protein, 9 aa, Homo sapiens
  light chain complementarity determining region 3 for antibody 18410
QQDGNIPRT

SEQ ID NO: 36820 - protein, 13 aa, Homo sapiens
  heavy chain complementarity determining region 3 for antibody 18410
AGGLFHSSGYSEF

SEQ ID NO: 36821 - protein, 9 aa, Homo sapiens
  light chain complementarity determining region 3 for antibody 18411
QQDGGSPRT

SEQ ID NO: 36822 - protein, 13 aa, Homo sapiens
  heavy chain complementarity determining region 3 for antibody 18411
ASGYFDSGAYYEF

SEQ ID NO: 36823 - protein, 9 aa, Homo sapiens
  light chain complementarity determining region 3 for antibody 18412
QQDGFSPYI

SEQ ID NO: 36824 - protein, 11 aa, Homo sapiens
  heavy chain complementarity determining region 3 for antibody 18412
TRGYIEVIGDW

SEQ ID NO: 36825 - protein, 8 aa, Homo sapiens
  light chain complementarity determining region 3 for antibody 18413
QQDENLVT

SEQ ID NO: 36826 - protein, 18 aa, Homo sapiens
  heavy chain complementarity determining region 3 for antibody 18413
AKGAEGSCSVRKCYPFDY

SEQ ID NO: 36827 - protein, 9 aa, Homo sapiens
  light chain complementarity determining region 3 for antibody 18414
QQCNSYSRT

SEQ ID NO: 36828 - protein, 11 aa, Homo sapiens
  heavy chain complementarity determining region 3 for antibody 18414
ARNILGGRTDF

SEQ ID NO: 36829 - protein, 9 aa, Homo sapiens
  light chain complementarity determining region 3 for antibody 18415
QQAHSFPPA

SEQ ID NO: 36830 - protein, 11 aa, Homo sapiens
  heavy chain complementarity determining region 3 for antibody 18415
VHSPAMAEIDY

SEQ ID NO: 36831 - protein, 10 aa, Homo sapiens
  light chain complementarity determining region 3 for antibody 18416
QLYGSSPTGT

SEQ ID NO: 36832 - protein, 9 aa, Homo sapiens
  heavy chain complementarity determining region 3 for antibody 18416
ATGGELLGY

SEQ ID NO: 36833 - protein, 11 aa, Homo sapiens
  light chain complementarity determining region 3 for antibody 18417
QLYETSPPGTT

SEQ ID NO: 36834 - protein, 14 aa, Homo sapiens
  heavy chain complementarity determining region 3 for antibody 18417
ARENSISRKRSFDQ

SEQ ID NO: 36835 - protein, 11 aa, Homo sapiens
  light chain complementarity determining region 3 for antibody 18418
QLYETSPPGST

SEQ ID NO: 36836 - protein, 14 aa, Homo sapiens
  heavy chain complementarity determining region 3 for antibody 18418
ARENSISRKRSFDQ

SEQ ID NO: 36837 - protein, 9 aa, Homo sapiens
  light chain complementarity determining region 3 for antibody 18419
QHYGTSPLT

SEQ ID NO: 36838 - protein, 8 aa, Homo sapiens
  heavy chain complementarity determining region 3 for antibody 18419
VCMIVATN

SEQ ID NO: 36839 - protein, 11 aa, Homo sapiens
  light chain complementarity determining region 3 for antibody 18420
QHYGSSPPRWP

SEQ ID NO: 36840 - protein, 14 aa, Homo sapiens
  heavy chain complementarity determining region 3 for antibody 18420
ASFLLSRRGSYVDY

SEQ ID NO: 36841 - protein, 11 aa, Homo sapiens
  light chain complementarity determining region 3 for antibody 18421
QHYGSSPPNFT

SEQ ID NO: 36842 - protein, 15 aa, Homo sapiens
  heavy chain complementarity determining region 3 for antibody 18421
ARDPSYIAAAGRGDY

SEQ ID NO: 36843 - protein, 10 aa, Homo sapiens
  light chain complementarity determining region 3 for antibody 18422
QHYDTSSPIS

SEQ ID NO: 36844 - protein, 11 aa, Homo sapiens
  heavy chain complementarity determining region 3 for antibody 18422
ARAIRAHYFDH

SEQ ID NO: 36845 - protein, 10 aa, Homo sapiens
  light chain complementarity determining region 3 for antibody 18423
QHFGSSPEIT

SEQ ID NO: 36846 - protein, 13 aa, Homo sapiens
  heavy chain complementarity determining region 3 for antibody 18423
VRWARRGRYDFDY

SEQ ID NO: 36847 - protein, 10 aa, Homo sapiens
  light chain complementarity determining region 3 for antibody 18424
PQRSKWPPLT

SEQ ID NO: 36848 - protein, 9 aa, Homo sapiens
  heavy chain complementarity determining region 3 for antibody 18424
ARVDGYFDY

SEQ ID NO: 36849 - protein, 10 aa, Homo sapiens
  light chain complementarity determining region 3 for antibody 18425
MQSVKSPRWT

SEQ ID NO: 36850 - protein, 8 aa, Homo sapiens
  heavy chain complementarity determining region 3 for antibody 18425
AKGYGLDS

SEQ ID NO: 36851 - protein, 9 aa, Homo sapiens
  light chain complementarity determining region 3 for antibody 18426
MQSRRGPHT

SEQ ID NO: 36852 - protein, 8 aa, Homo sapiens
  heavy chain complementarity determining region 3 for antibody 18426
TAWGSSHH

SEQ ID NO: 36853 - protein, 9 aa, Homo sapiens
  light chain complementarity determining region 3 for antibody 18427
MQPLHTPYT

SEQ ID NO: 36854 - protein, 12 aa, Homo sapiens
  heavy chain complementarity determining region 3 for antibody 18427
ARTSGYDIGGDY

SEQ ID NO: 36855 - protein, 10 aa, Homo sapiens
  light chain complementarity determining region 3 for antibody 18428
MQGTYWPPGT

SEQ ID NO: 36856 - protein, 13 aa, Homo sapiens
  heavy chain complementarity determining region 3 for antibody 18428
VRDGDSTTWPLDF

SEQ ID NO: 36857 - protein, 8 aa, Homo sapiens
  light chain complementarity determining region 3 for antibody 18429
MQGTHGPT

SEQ ID NO: 36858 - protein, 21 aa, Homo sapiens
  heavy chain complementarity determining region 3 for antibody 18429
AKDRPNYYESNGQYYTPKGDL

SEQ ID NO: 36859 - protein, 9 aa, Homo sapiens
  light chain complementarity determining region 3 for antibody 18430
MQGTHGPLT

SEQ ID NO: 36860 - protein, 11 aa, Homo sapiens
  heavy chain complementarity determining region 3 for antibody 18430
ARGVLDPAFAV

SEQ ID NO: 36861 - protein, 9 aa, Homo sapiens
  light chain complementarity determining region 3 for antibody 18431
MQATQIPGT

SEQ ID NO: 36862 - protein, 7 aa, Homo sapiens
  heavy chain complementarity determining region 3 for antibody 18431
LGGGVDY

SEQ ID NO: 36863 - protein, 9 aa, Homo sapiens
  light chain complementarity determining region 3 for antibody 18432
MQAPETPFT

SEQ ID NO: 36864 - protein, 15 aa, Homo sapiens
  heavy chain complementarity determining region 3 for antibody 18432
VRHYRETVAGIEGDS

SEQ ID NO: 36865 - protein, 10 aa, Homo sapiens
  light chain complementarity determining region 3 for antibody 18433
MQALQTPPNT

SEQ ID NO: 36866 - protein, 22 aa, Homo sapiens
  heavy chain complementarity determining region 3 for antibody 18433
ASLYYYGSGSYMRFRDYYGMDV

SEQ ID NO: 36867 - protein, 9 aa, Homo sapiens
  light chain complementarity determining region 3 for antibody 18434
MQALQAPGT

SEQ ID NO: 36868 - protein, 11 aa, Homo sapiens
  heavy chain complementarity determining region 3 for antibody 18434
ARQPDPTTPTP

SEQ ID NO: 36869 - protein, 9 aa, Homo sapiens
  light chain complementarity determining region 3 for antibody 18435
MQALETPFT

SEQ ID NO: 36870 - protein, 15 aa, Homo sapiens
  heavy chain complementarity determining region 3 for antibody 18435
VRHYRETAAGIEGDS

SEQ ID NO: 36871 - protein, 9 aa, Homo sapiens
  light chain complementarity determining region 3 for antibody 18436
MQALEIPFT

SEQ ID NO: 36872 - protein, 15 aa, Homo sapiens
  heavy chain complementarity determining region 3 for antibody 18436
VRHYRLTVAGIEGDS

SEQ ID NO: 36873 - protein, 9 aa, Homo sapiens
  light chain complementarity determining region 3 for antibody 18437
MQALEAPFT

SEQ ID NO: 36874 - protein, 15 aa, Homo sapiens
  heavy chain complementarity determining region 3 for antibody 18437
VRHYRETVAGIEGDS

SEQ ID NO: 36875 - protein, 9 aa, Homo sapiens
  light chain complementarity determining region 3 for antibody 18438
MGPLQTPPT

SEQ ID NO: 36876 - protein, 15 aa, Homo sapiens
  heavy chain complementarity determining region 3 for antibody 18438
TRDGKKDGHNDAFDI

SEQ ID NO: 36877 - protein, 9 aa, Homo sapiens
  light chain complementarity determining region 3 for antibody 18439
LQHNRFPLT

SEQ ID NO: 36878 - protein, 19 aa, Homo sapiens
  heavy chain complementarity determining region 3 for antibody 18439
ASLRYSSSWSRRLVDVFEI

SEQ ID NO: 36879 - protein, 9 aa, Homo sapiens
  light chain complementarity determining region 3 for antibody 18440
LQGTRFPHT

SEQ ID NO: 36880 - protein, 14 aa, Homo sapiens
  heavy chain complementarity determining region 3 for antibody 18440
ARYCSGNSCYSMDH

SEQ ID NO: 36881 - protein, 9 aa, Homo sapiens
  light chain complementarity determining region 3 for antibody 18441
LQDYNYPRT

SEQ ID NO: 36882 - protein, 11 aa, Homo sapiens
  heavy chain complementarity determining region 3 for antibody 18441
ATDQGLHGMDV

SEQ ID NO: 36883 - protein, 9 aa, Homo sapiens
  light chain complementarity determining region 3 for antibody 18442
LQDYNYPMT

SEQ ID NO: 36884 - protein, 18 aa, Homo sapiens
  heavy chain complementarity determining region 3 for antibody 18442
ARALGHCWGGHCYSAFDI

SEQ ID NO: 36885 - protein, 9 aa, Homo sapiens
  light chain complementarity determining region 3 for antibody 18443
LQALETPFT

SEQ ID NO: 36886 - protein, 15 aa, Homo sapiens
  heavy chain complementarity determining region 3 for antibody 18443
VRHYRELTTGIEGDS

SEQ ID NO: 36887 - protein, 9 aa, Homo sapiens
  light chain complementarity determining region 3 for antibody 18444
LPGNRFPHT

SEQ ID NO: 36888 - protein, 14 aa, Homo sapiens
  heavy chain complementarity determining region 3 for antibody 18444
ARYCSGNSCYSMDH

SEQ ID NO: 36889 - protein, 9 aa, Homo sapiens
  light chain complementarity determining region 3 for antibody 18445
HQYSSSPYT

SEQ ID NO: 36890 - protein, 13 aa, Homo sapiens
  heavy chain complementarity determining region 3 for antibody 18445
ARGAYSAFAIFGV

SEQ ID NO: 36891 - protein, 7 aa, Homo sapiens
  light chain complementarity determining region 3 for antibody 18446
HQYGGGT

SEQ ID NO: 36892 - protein, 15 aa, Homo sapiens
  heavy chain complementarity determining region 3 for antibody 18446
TAIVFFAGSVHIDQY

SEQ ID NO: 36893 - protein, 9 aa, Homo sapiens
  light chain complementarity determining region 3 for antibody 18447
HQYAGSPRM

SEQ ID NO: 36894 - protein, 17 aa, Homo sapiens
  heavy chain complementarity determining region 3 for antibody 18447
AKSVGVDDAMTTRVYDS

SEQ ID NO: 36895 - protein, 10 aa, Homo sapiens
  light chain complementarity determining region 3 for antibody 18448
HQSGILPPWP

SEQ ID NO: 36896 - protein, 13 aa, Homo sapiens
  heavy chain complementarity determining region 3 for antibody 18448
ARVSQAYYNGMDV

SEQ ID NO: 36897 - protein, 9 aa, Homo sapiens
  light chain complementarity determining region 3 for antibody 18449
HQSGAFPWT

SEQ ID NO: 36898 - protein, 14 aa, Homo sapiens
  heavy chain complementarity determining region 3 for antibody 18449
VRDASGNSGWYADS

SEQ ID NO: 36899 - protein, 9 aa, Homo sapiens
  light chain complementarity determining region 3 for antibody 18450
HHTYTFPRT

SEQ ID NO: 36900 - protein, 20 aa, Homo sapiens
  heavy chain complementarity determining region 3 for antibody 18450
ARGRRIAALSTAHCYYGMDV

SEQ ID NO: 36901 - protein, 9 aa, Homo sapiens
  light chain complementarity determining region 3 for antibody 18451
HHTSTFPRT

SEQ ID NO: 36902 - protein, 20 aa, Homo sapiens
  heavy chain complementarity determining region 3 for antibody 18451
ARGRRIAALSTAHDYYGMDV

SEQ ID NO: 36903 - protein, 9 aa, Homo sapiens
  light chain complementarity determining region 3 for antibody 18452
HHTSPFPRT

SEQ ID NO: 36904 - protein, 20 aa, Homo sapiens
  heavy chain complementarity determining region 3 for antibody 18452
ARGRRIAALSTAHYYYGMDV

SEQ ID NO: 36905 - protein, 9 aa, Homo sapiens
  light chain complementarity determining region 3 for antibody 18453
VQALETPFT

SEQ ID NO: 36906 - protein, 15 aa, Homo sapiens
  heavy chain complementarity determining region 3 for antibody 18453
VRHYRITVAAVEGDS

SEQ ID NO: 36907 - protein, 9 aa, Homo sapiens
  light chain complementarity determining region 3 for antibody 18454
VQALETPFT

SEQ ID NO: 36908 - protein, 15 aa, Homo sapiens
  heavy chain complementarity determining region 3 for antibody 18454
VRHYRIITAPLEGDS

SEQ ID NO: 36909 - protein, 9 aa, Homo sapiens
  light chain complementarity determining region 3 for antibody 18455
RQALETPFT

SEQ ID NO: 36910 - protein, 15 aa, Homo sapiens
  heavy chain complementarity determining region 3 for antibody 18455
VRHYRELATGIEGDS

SEQ ID NO: 36911 - protein, 9 aa, Homo sapiens
  light chain complementarity determining region 3 for antibody 18456
QRRSSWPRT

SEQ ID NO: 36912 - protein, 15 aa, Homo sapiens
  heavy chain complementarity determining region 3 for antibody 18456
AKDDSGWSGSGYFDY

SEQ ID NO: 36913 - protein, 9 aa, Homo sapiens
  light chain complementarity determining region 3 for antibody 18457
QQYYTTPPS

SEQ ID NO: 36914 - protein, 15 aa, Homo sapiens
  heavy chain complementarity determining region 3 for antibody 18457
ARGMSEGEMATTSEY

SEQ ID NO: 36915 - protein, 10 aa, Homo sapiens
  light chain complementarity determining region 3 for antibody 18458
QQYYTTPLYA

SEQ ID NO: 36916 - protein, 14 aa, Homo sapiens
  heavy chain complementarity determining region 3 for antibody 18458
AVCYYTSGTFVFDI

SEQ ID NO: 36917 - protein, 9 aa, Homo sapiens
  light chain complementarity determining region 3 for antibody 18459
QQYYTSLRT

SEQ ID NO: 36918 - protein, 12 aa, Homo sapiens
  heavy chain complementarity determining region 3 for antibody 18459
VKDCGLGGPRDY

SEQ ID NO: 36919 - protein, 9 aa, Homo sapiens
  light chain complementarity determining region 3 for antibody 18460
QQYYSSPLT

SEQ ID NO: 36920 - protein, 14 aa, Homo sapiens
  heavy chain complementarity determining region 3 for antibody 18460
VRDQHSGSFYPFDL

SEQ ID NO: 36921 - protein, 10 aa, Homo sapiens
  light chain complementarity determining region 3 for antibody 18461
QQYYGTPPYT

SEQ ID NO: 36922 - protein, 17 aa, Homo sapiens
  heavy chain complementarity determining region 3 for antibody 18461
ARGVSFDNGWTDWYFGL

SEQ ID NO: 36923 - protein, 8 aa, Homo sapiens
  light chain complementarity determining region 3 for antibody 18462
QQYSNYWA

SEQ ID NO: 36924 - protein, 11 aa, Homo sapiens
  heavy chain complementarity determining region 3 for antibody 18462
ARGAWGVGIPS

SEQ ID NO: 36925 - protein, 9 aa, Homo sapiens
  light chain complementarity determining region 3 for antibody 18463
QQYNTWPRT

SEQ ID NO: 36926 - protein, 22 aa, Homo sapiens
  heavy chain complementarity determining region 3 for antibody 18463
AREVRASGYDDFYNYYHYGLDV

SEQ ID NO: 36927 - protein, 9 aa, Homo sapiens
  light chain complementarity determining region 3 for antibody 18464
QQYNRPPRT

SEQ ID NO: 36928 - protein, 16 aa, Homo sapiens
  heavy chain complementarity determining region 3 for antibody 18464
VKDFTGECHYGSWVDP

SEQ ID NO: 36929 - protein, 9 aa, Homo sapiens
  light chain complementarity determining region 3 for antibody 18465
QQYNNWPLT

SEQ ID NO: 36930 - protein, 16 aa, Homo sapiens
  heavy chain complementarity determining region 3 for antibody 18465
ARDRGWRDGYNSIFES

SEQ ID NO: 36931 - protein, 10 aa, Homo sapiens
  light chain complementarity determining region 3 for antibody 18466
QQYNNWLGRT

SEQ ID NO: 36932 - protein, 13 aa, Homo sapiens
  heavy chain complementarity determining region 3 for antibody 18466
ARHGRRSGWYYTY

SEQ ID NO: 36933 - protein, 10 aa, Homo sapiens
  light chain complementarity determining region 3 for antibody 18467
QQYNNWFGWT

SEQ ID NO: 36934 - protein, 13 aa, Homo sapiens
  heavy chain complementarity determining region 3 for antibody 18467
ARHGRRSGWYYTY

SEQ ID NO: 36935 - protein, 9 aa, Homo sapiens
  light chain complementarity determining region 3 for antibody 18468
QQYGVSPFF

SEQ ID NO: 36936 - protein, 12 aa, Homo sapiens
  heavy chain complementarity determining region 3 for antibody 18468
ARGWNELDYFDY

SEQ ID NO: 36937 - protein, 9 aa, Homo sapiens
  light chain complementarity determining region 3 for antibody 18469
QQYGTSPFT

SEQ ID NO: 36938 - protein, 15 aa, Homo sapiens
  heavy chain complementarity determining region 3 for antibody 18469
ARQNDFLRGPGEFDP

SEQ ID NO: 36939 - protein, 9 aa, Homo sapiens
  light chain complementarity determining region 3 for antibody 18470
QQYGTPPRT

SEQ ID NO: 36940 - protein, 25 aa, Homo sapiens
  heavy chain complementarity determining region 3 for antibody 18470
ARLSVDRLRLPGAMRGPLYDRGLNV

SEQ ID NO: 36941 - protein, 9 aa, Homo sapiens
  light chain complementarity determining region 3 for antibody 18471
QQYGTPPRT

SEQ ID NO: 36942 - protein, 25 aa, Homo sapiens
  heavy chain complementarity determining region 3 for antibody 18471
AILRVDRLRLPGAMRGPLYDRGLNV

SEQ ID NO: 36943 - protein, 9 aa, Homo sapiens
  light chain complementarity determining region 3 for antibody 18472
QQYGTLPQK

SEQ ID NO: 36944 - protein, 18 aa, Homo sapiens
  heavy chain complementarity determining region 3 for antibody 18472
ARDYYGSGREIWVGAFDI

SEQ ID NO: 36945 - protein, 9 aa, Homo sapiens
  light chain complementarity determining region 3 for antibody 18473
QQYGTLPPT

SEQ ID NO: 36946 - protein, 18 aa, Homo sapiens
  heavy chain complementarity determining region 3 for antibody 18473
ARDYYGSGREIWVGAFDI

SEQ ID NO: 36947 - protein, 10 aa, Homo sapiens
  light chain complementarity determining region 3 for antibody 18474
QQYGSSTMYS

SEQ ID NO: 36948 - protein, 11 aa, Homo sapiens
  heavy chain complementarity determining region 3 for antibody 18474
ARGGQWGSLDY

SEQ ID NO: 36949 - protein, 10 aa, Homo sapiens
  light chain complementarity determining region 3 for antibody 18475
QQYGSSPRYS

SEQ ID NO: 36950 - protein, 11 aa, Homo sapiens
  heavy chain complementarity determining region 3 for antibody 18475
ARGGQWGSLDY

SEQ ID NO: 36951 - protein, 9 aa, Homo sapiens
  light chain complementarity determining region 3 for antibody 18476
QQYGSSPRP

SEQ ID NO: 36952 - protein, 14 aa, Homo sapiens
  heavy chain complementarity determining region 3 for antibody 18476
AGGRFSSGSSYSEN

SEQ ID NO: 36953 - protein, 10 aa, Homo sapiens
  light chain complementarity determining region 3 for antibody 18477
QQYGSSPMHS

SEQ ID NO: 36954 - protein, 11 aa, Homo sapiens
  heavy chain complementarity determining region 3 for antibody 18477
ARGGQWGSLDY

SEQ ID NO: 36955 - protein, 10 aa, Homo sapiens
  light chain complementarity determining region 3 for antibody 18478
QQYGSSPMFS

SEQ ID NO: 36956 - protein, 11 aa, Homo sapiens
  heavy chain complementarity determining region 3 for antibody 18478
ARGGQWGSLDY

SEQ ID NO: 36957 - protein, 8 aa, Homo sapiens
  light chain complementarity determining region 3 for antibody 18479
QQYGSSGT

SEQ ID NO: 36958 - protein, 12 aa, Homo sapiens
  heavy chain complementarity determining region 3 for antibody 18479
ARLAVAVGAFDI

SEQ ID NO: 36959 - protein, 9 aa, Homo sapiens
  light chain complementarity determining region 3 for antibody 18480
QQYGSPVGT

SEQ ID NO: 36960 - protein, 9 aa, Homo sapiens
  heavy chain complementarity determining region 3 for antibody 18480
ARMYSGLDY

SEQ ID NO: 36961 - protein, 9 aa, Homo sapiens
  light chain complementarity determining region 3 for antibody 18481
QQYGSPPRT

SEQ ID NO: 36962 - protein, 18 aa, Homo sapiens
  heavy chain complementarity determining region 3 for antibody 18481
ATAFWVGLGVPPPGFFEY

SEQ ID NO: 36963 - protein, 10 aa, Homo sapiens
  light chain complementarity determining region 3 for antibody 18482
QQYGSPPMYS

SEQ ID NO: 36964 - protein, 11 aa, Homo sapiens
  heavy chain complementarity determining region 3 for antibody 18482
ARGGQWGSLDY

SEQ ID NO: 36965 - protein, 9 aa, Homo sapiens
  light chain complementarity determining region 3 for antibody 18483
QQYGSLPRT

SEQ ID NO: 36966 - protein, 13 aa, Homo sapiens
  heavy chain complementarity determining region 3 for antibody 18483
AGGIFDSSGYGEY

SEQ ID NO: 36967 - protein, 9 aa, Homo sapiens
  light chain complementarity determining region 3 for antibody 18484
QQYGSLPLT

SEQ ID NO: 36968 - protein, 15 aa, Homo sapiens
  heavy chain complementarity determining region 3 for antibody 18484
AHRPNCYDKAGAFDI

SEQ ID NO: 36969 - protein, 9 aa, Homo sapiens
  light chain complementarity determining region 3 for antibody 18485
QQYGSIPRT

SEQ ID NO: 36970 - protein, 13 aa, Homo sapiens
  heavy chain complementarity determining region 3 for antibody 18485
AGGGCSSGRYSEY

SEQ ID NO: 36971 - protein, 9 aa, Homo sapiens
  light chain complementarity determining region 3 for antibody 18486
QQYGRIPRT

SEQ ID NO: 36972 - protein, 14 aa, Homo sapiens
  heavy chain complementarity determining region 3 for antibody 18486
AGGDFCGSDCYSEY

SEQ ID NO: 36973 - protein, 9 aa, Homo sapiens
  light chain complementarity determining region 3 for antibody 18487
QQYGRIPRP

SEQ ID NO: 36974 - protein, 13 aa, Homo sapiens
  heavy chain complementarity determining region 3 for antibody 18487
AGGTWHSSAYYES

SEQ ID NO: 36975 - protein, 9 aa, Homo sapiens
  light chain complementarity determining region 3 for antibody 18488
QQYGNIPRS

SEQ ID NO: 36976 - protein, 13 aa, Homo sapiens
  heavy chain complementarity determining region 3 for antibody 18488
AGGAWHSGTYYES

SEQ ID NO: 36977 - protein, 9 aa, Homo sapiens
  light chain complementarity determining region 3 for antibody 18489
QQYGNIPRA

SEQ ID NO: 36978 - protein, 13 aa, Homo sapiens
  heavy chain complementarity determining region 3 for antibody 18489
AGGTWHSGTYYES

SEQ ID NO: 36979 - protein, 9 aa, Homo sapiens
  light chain complementarity determining region 3 for antibody 18490
QQYGGSPRT

SEQ ID NO: 36980 - protein, 13 aa, Homo sapiens
  heavy chain complementarity determining region 3 for antibody 18490
ASGYFDSGAYFEF

SEQ ID NO: 36981 - protein, 11 aa, Homo sapiens
  light chain complementarity determining region 3 for antibody 18491
QQYETSPPGYT

SEQ ID NO: 36982 - protein, 14 aa, Homo sapiens
  heavy chain complementarity determining region 3 for antibody 18491
ARENRISRKRSFDQ

SEQ ID NO: 36983 - protein, 11 aa, Homo sapiens
  light chain complementarity determining region 3 for antibody 18492
QQYDTSPPGNP

SEQ ID NO: 36984 - protein, 14 aa, Homo sapiens
  heavy chain complementarity determining region 3 for antibody 18492
ARETSNSRKRSFDQ

SEQ ID NO: 36985 - protein, 9 aa, Homo sapiens
  light chain complementarity determining region 3 for antibody 18493
QQYDSSPQP

SEQ ID NO: 36986 - protein, 14 aa, Homo sapiens
  heavy chain complementarity determining region 3 for antibody 18493
ARDNPHRLERYFDL

SEQ ID NO: 36987 - protein, 10 aa, Homo sapiens
  light chain complementarity determining region 3 for antibody 18494
QQYATSPPRT

SEQ ID NO: 36988 - protein, 16 aa, Homo sapiens
  heavy chain complementarity determining region 3 for antibody 18494
ARVQWVRGLTKEGLDF

SEQ ID NO: 36989 - protein, 9 aa, Homo sapiens
  light chain complementarity determining region 3 for antibody 18495
QQSYTSPLT

SEQ ID NO: 36990 - protein, 16 aa, Homo sapiens
  heavy chain complementarity determining region 3 for antibody 18495
ARESGGGSPRHNYFDP

SEQ ID NO: 36991 - protein, 9 aa, Homo sapiens
  light chain complementarity determining region 3 for antibody 18496
QQSYRTPRT

SEQ ID NO: 36992 - protein, 14 aa, Homo sapiens
  heavy chain complementarity determining region 3 for antibody 18496
AREWELAGGAGFDY

SEQ ID NO: 36993 - protein, 9 aa, Homo sapiens
  light chain complementarity determining region 3 for antibody 18497
QQSSTYPLT

SEQ ID NO: 36994 - protein, 8 aa, Homo sapiens
  heavy chain complementarity determining region 3 for antibody 18497
IIYVNSCY

SEQ ID NO: 36995 - protein, 10 aa, Homo sapiens
  light chain complementarity determining region 3 for antibody 18498
QQSNQWPPLT

SEQ ID NO: 36996 - protein, 17 aa, Homo sapiens
  heavy chain complementarity determining region 3 for antibody 18498
ARDLYFSIIQGGGAFDA

SEQ ID NO: 36997 - protein, 9 aa, Homo sapiens
  light chain complementarity determining region 3 for antibody 18499
QQSHTTPPT

SEQ ID NO: 36998 - protein, 14 aa, Homo sapiens
  heavy chain complementarity determining region 3 for antibody 18499
ARDVSSRTMWYFDP

SEQ ID NO: 36999 - protein, 8 aa, Homo sapiens
  light chain complementarity determining region 3 for antibody 18500
QQSFRPPT

SEQ ID NO: 37000 - protein, 18 aa, Homo sapiens
  heavy chain complementarity determining region 3 for antibody 18500
ARGSGITIFGGVIRYFDY

SEQ ID NO: 37001 - protein, 10 aa, Homo sapiens
  light chain complementarity determining region 3 for antibody 18501
QQRYNRPPFT

SEQ ID NO: 37002 - protein, 11 aa, Homo sapiens
  heavy chain complementarity determining region 3 for antibody 18501
ARGVGSYPFDS

SEQ ID NO: 37003 - protein, 10 aa, Homo sapiens
  light chain complementarity determining region 3 for antibody 18502
QQRYKWPPYP

SEQ ID NO: 37004 - protein, 11 aa, Homo sapiens
  heavy chain complementarity determining region 3 for antibody 18502
ARGVGSYVFES

SEQ ID NO: 37005 - protein, 10 aa, Homo sapiens
  light chain complementarity determining region 3 for antibody 18503
QQRSNWPPWT

SEQ ID NO: 37006 - protein, 20 aa, Homo sapiens
  heavy chain complementarity determining region 3 for antibody 18503
AREKGYCSSTSCPGGYYFDY

SEQ ID NO: 37007 - protein, 11 aa, Homo sapiens
  light chain complementarity determining region 3 for antibody 18504
QQRSNWPPGLT

SEQ ID NO: 37008 - protein, 15 aa, Homo sapiens
  heavy chain complementarity determining region 3 for antibody 18504
AREYYDSSGYYYADY

SEQ ID NO: 37009 - protein, 9 aa, Homo sapiens
  light chain complementarity determining region 3 for antibody 18505
QQRSNWPFP

SEQ ID NO: 37010 - protein, 14 aa, Homo sapiens
  heavy chain complementarity determining region 3 for antibody 18505
ARSLSSAWYDWSDP

SEQ ID NO: 37011 - protein, 10 aa, Homo sapiens
  light chain complementarity determining region 3 for antibody 18506
QQRSKWPPIT

SEQ ID NO: 37012 - protein, 9 aa, Homo sapiens
  heavy chain complementarity determining region 3 for antibody 18506
ARVDGYFDY

SEQ ID NO: 37013 - protein, 8 aa, Homo sapiens
  light chain complementarity determining region 3 for antibody 18507
QQRNFRLT

SEQ ID NO: 37014 - protein, 13 aa, Homo sapiens
  heavy chain complementarity determining region 3 for antibody 18507
TTDAAFVPYYFAY

SEQ ID NO: 37015 - protein, 9 aa, Homo sapiens
  light chain complementarity determining region 3 for antibody 18508
QQNGTPPRT

SEQ ID NO: 37016 - protein, 25 aa, Homo sapiens
  heavy chain complementarity determining region 3 for antibody 18508
ARLRVDRLRLPGAMRGPLYDRGLNV

SEQ ID NO: 37017 - protein, 9 aa, Homo sapiens
  light chain complementarity determining region 3 for antibody 18509
QQNGSSPRT

SEQ ID NO: 37018 - protein, 18 aa, Homo sapiens
  heavy chain complementarity determining region 3 for antibody 18509
ATAFWVGLGVPPPGFFEY

SEQ ID NO: 37019 - protein, 10 aa, Homo sapiens
  light chain complementarity determining region 3 for antibody 18510
QQNGSSPMYS

SEQ ID NO: 37020 - protein, 11 aa, Homo sapiens
  heavy chain complementarity determining region 3 for antibody 18510
ARGGQWGSLDY

SEQ ID NO: 37021 - protein, 9 aa, Homo sapiens
  light chain complementarity determining region 3 for antibody 18511
QQLNSYPPT

SEQ ID NO: 37022 - protein, 14 aa, Homo sapiens
  heavy chain complementarity determining region 3 for antibody 18511
ARENSVAGTRSYDY

SEQ ID NO: 37023 - protein, 9 aa, Homo sapiens
  light chain complementarity determining region 3 for antibody 18512
QQHYSYPRT

SEQ ID NO: 37024 - protein, 11 aa, Homo sapiens
  heavy chain complementarity determining region 3 for antibody 18512
ARDFSNGPFTH

SEQ ID NO: 37025 - protein, 10 aa, Homo sapiens
  light chain complementarity determining region 3 for antibody 18513
QQHVSSPPGT

SEQ ID NO: 37026 - protein, 14 aa, Homo sapiens
  heavy chain complementarity determining region 3 for antibody 18513
ARSPRTTMPPPWDY

SEQ ID NO: 37027 - protein, 9 aa, Homo sapiens
  light chain complementarity determining region 3 for antibody 18514
QQHGNLPRT

SEQ ID NO: 37028 - protein, 13 aa, Homo sapiens
  heavy chain complementarity determining region 3 for antibody 18514
AGGNFHSGGYGEY

SEQ ID NO: 37029 - protein, 9 aa, Homo sapiens
  light chain complementarity determining region 3 for antibody 18515
QQGYRPPFL

SEQ ID NO: 37030 - protein, 15 aa, Homo sapiens
  heavy chain complementarity determining region 3 for antibody 18515
TRAQVIWGQLYYFDY

SEQ ID NO: 37031 - protein, 9 aa, Homo sapiens
  light chain complementarity determining region 3 for antibody 18516
QQFYNNPFT

SEQ ID NO: 37032 - protein, 14 aa, Homo sapiens
  heavy chain complementarity determining region 3 for antibody 18516
LGQDCSGVGCDYPS

SEQ ID NO: 37033 - protein, 9 aa, Homo sapiens
  light chain complementarity determining region 3 for antibody 18517
QQFGSSPHT

SEQ ID NO: 37034 - protein, 12 aa, Homo sapiens
  heavy chain complementarity determining region 3 for antibody 18517
AGSGLRDIVAIY

SEQ ID NO: 37035 - protein, 9 aa, Homo sapiens
  light chain complementarity determining region 3 for antibody 18518
QQDGSSPRT

SEQ ID NO: 37036 - protein, 14 aa, Homo sapiens
  heavy chain complementarity determining region 3 for antibody 18518
AGGRFSSGSSYSEN

SEQ ID NO: 37037 - protein, 9 aa, Homo sapiens
  light chain complementarity determining region 3 for antibody 18519
QQDGSSPDT

SEQ ID NO: 37038 - protein, 15 aa, Homo sapiens
  heavy chain complementarity determining region 3 for antibody 18519
AREGGYCGGDCSFDY

SEQ ID NO: 37039 - protein, 9 aa, Homo sapiens
  light chain complementarity determining region 3 for antibody 18520
QQDGSLPLT

SEQ ID NO: 37040 - protein, 15 aa, Homo sapiens
  heavy chain complementarity determining region 3 for antibody 18520
AHRPNYYDKAGAFDI

SEQ ID NO: 37041 - protein, 9 aa, Homo sapiens
  light chain complementarity determining region 3 for antibody 18521
QQAHSSPRT

SEQ ID NO: 37042 - protein, 13 aa, Homo sapiens
  heavy chain complementarity determining region 3 for antibody 18521
ARDLRVGRNGLDV

SEQ ID NO: 37043 - protein, 9 aa, Homo sapiens
  light chain complementarity determining region 3 for antibody 18522
QPYGSSPRT

SEQ ID NO: 37044 - protein, 25 aa, Homo sapiens
  heavy chain complementarity determining region 3 for antibody 18522
ARLRIDRLRLPGAMRGPLYDCGLNV

SEQ ID NO: 37045 - protein, 9 aa, Homo sapiens
  light chain complementarity determining region 3 for antibody 18523
QKYGTSPRP

SEQ ID NO: 37046 - protein, 13 aa, Homo sapiens
  heavy chain complementarity determining region 3 for antibody 18523
AGGHYHSSGYSDF

SEQ ID NO: 37047 - protein, 6 aa, Homo sapiens
  light chain complementarity determining region 3 for antibody 18524
QKDGSF

SEQ ID NO: 37048 - protein, 11 aa, Homo sapiens
  heavy chain complementarity determining region 3 for antibody 18524
ARAGISYALDV

SEQ ID NO: 37049 - protein, 9 aa, Homo sapiens
  light chain complementarity determining region 3 for antibody 18525
QHYYRTPYT

SEQ ID NO: 37050 - protein, 15 aa, Homo sapiens
  heavy chain complementarity determining region 3 for antibody 18525
VHMAGSAMAWGWFDS

SEQ ID NO: 37051 - protein, 10 aa, Homo sapiens
  light chain complementarity determining region 3 for antibody 18526
QHYSRSPPIP

SEQ ID NO: 37052 - protein, 20 aa, Homo sapiens
  heavy chain complementarity determining region 3 for antibody 18526
ARDAADVEIVPAARLFAMDV

SEQ ID NO: 37053 - protein, 9 aa, Homo sapiens
  light chain complementarity determining region 3 for antibody 18527
QHYNGYWGP

SEQ ID NO: 37054 - protein, 12 aa, Homo sapiens
  heavy chain complementarity determining region 3 for antibody 18527
VTYLVGHGGVGF

SEQ ID NO: 37055 - protein, 10 aa, Homo sapiens
  light chain complementarity determining region 3 for antibody 18528
QHYHNWPPWT

SEQ ID NO: 37056 - protein, 13 aa, Homo sapiens
  heavy chain complementarity determining region 3 for antibody 18528
AKGRVRELYYFEP

SEQ ID NO: 37057 - protein, 9 aa, Homo sapiens
  light chain complementarity determining region 3 for antibody 18529
QHYGSLPLT

SEQ ID NO: 37058 - protein, 16 aa, Homo sapiens
  heavy chain complementarity determining region 3 for antibody 18529
AAMLVRGLLYFHAVDV

SEQ ID NO: 37059 - protein, 9 aa, Homo sapiens
  light chain complementarity determining region 3 for antibody 18530
QHYGRSPWT

SEQ ID NO: 37060 - protein, 17 aa, Homo sapiens
  heavy chain complementarity determining region 3 for antibody 18530
ARTVLYHFTSGRAAFDV

SEQ ID NO: 37061 - protein, 10 aa, Homo sapiens
  light chain complementarity determining region 3 for antibody 18531
QHYDYSPKLP

SEQ ID NO: 37062 - protein, 18 aa, Homo sapiens
  heavy chain complementarity determining region 3 for antibody 18531
ATGHPLRLHDYYYFVMDV

SEQ ID NO: 37063 - protein, 7 aa, Homo sapiens
  light chain complementarity determining region 3 for antibody 18532
QHHKNWA

SEQ ID NO: 37064 - protein, 12 aa, Homo sapiens
  heavy chain complementarity determining region 3 for antibody 18532
AREGDVTGYADQ

SEQ ID NO: 37065 - protein, 8 aa, Homo sapiens
  light chain complementarity determining region 3 for antibody 18533
QDYGSSRP

SEQ ID NO: 37066 - protein, 15 aa, Homo sapiens
  heavy chain complementarity determining region 3 for antibody 18533
ASGSFDTLTGSYSEV

SEQ ID NO: 37067 - protein, 9 aa, Homo sapiens
  light chain complementarity determining region 3 for antibody 18534
PQYYTTPRT

SEQ ID NO: 37068 - protein, 8 aa, Homo sapiens
  heavy chain complementarity determining region 3 for antibody 18534
ARDGAFDS

SEQ ID NO: 37069 - protein, 10 aa, Homo sapiens
  light chain complementarity determining region 3 for antibody 18535
PQRYNWPPFT

SEQ ID NO: 37070 - protein, 11 aa, Homo sapiens
  heavy chain complementarity determining region 3 for antibody 18535
ARGVGSYPFDS

SEQ ID NO: 37071 - protein, 9 aa, Homo sapiens
  light chain complementarity determining region 3 for antibody 18536
PQRSNWPFT

SEQ ID NO: 37072 - protein, 14 aa, Homo sapiens
  heavy chain complementarity determining region 3 for antibody 18536
ARSLSSAWYDWSDP

SEQ ID NO: 37073 - protein, 9 aa, Homo sapiens
  light chain complementarity determining region 3 for antibody 18537
PHTSTFPRT

SEQ ID NO: 37074 - protein, 20 aa, Homo sapiens
  heavy chain complementarity determining region 3 for antibody 18537
ARGRRIAALSTAHYYYGMDV

SEQ ID NO: 37075 - protein, 9 aa, Homo sapiens
  light chain complementarity determining region 3 for antibody 18538
MQRRRWPHT

SEQ ID NO: 37076 - protein, 8 aa, Homo sapiens
  heavy chain complementarity determining region 3 for antibody 18538
TAWGSSQH

SEQ ID NO: 37077 - protein, 9 aa, Homo sapiens
  light chain complementarity determining region 3 for antibody 18539
MQRLQTPLA

SEQ ID NO: 37078 - protein, 18 aa, Homo sapiens
  heavy chain complementarity determining region 3 for antibody 18539
AIGYYGSGSYYTCYGFDP

SEQ ID NO: 37079 - protein, 9 aa, Homo sapiens
  light chain complementarity determining region 3 for antibody 18540
MQPLQFPFT

SEQ ID NO: 37080 - protein, 12 aa, Homo sapiens
  heavy chain complementarity determining region 3 for antibody 18540
VKMGDSPRLFDQ

SEQ ID NO: 37081 - protein, 8 aa, Homo sapiens
  light chain complementarity determining region 3 for antibody 18541
MQGTHWPR

SEQ ID NO: 37082 - protein, 21 aa, Homo sapiens
  heavy chain complementarity determining region 3 for antibody 18541
AKDRPNYYESNGQYYTPKGDL

SEQ ID NO: 37083 - protein, 9 aa, Homo sapiens
  light chain complementarity determining region 3 for antibody 18542
MQGTHWPFT

SEQ ID NO: 37084 - protein, 18 aa, Homo sapiens
  heavy chain complementarity determining region 3 for antibody 18542
TRDFRDSCSGGGCYYFDL

SEQ ID NO: 37085 - protein, 8 aa, Homo sapiens
  light chain complementarity determining region 3 for antibody 18543
MQGTDGPT

SEQ ID NO: 37086 - protein, 21 aa, Homo sapiens
  heavy chain complementarity determining region 3 for antibody 18543
AKDRPNYYGSDGQYYTPKGDL

SEQ ID NO: 37087 - protein, 9 aa, Homo sapiens
  light chain complementarity determining region 3 for antibody 18544
MQGSHGPPT

SEQ ID NO: 37088 - protein, 13 aa, Homo sapiens
  heavy chain complementarity determining region 3 for antibody 18544
VRDLGDGYNSIDY

SEQ ID NO: 37089 - protein, 9 aa, Homo sapiens
  light chain complementarity determining region 3 for antibody 18545
MQGLQTPNT

SEQ ID NO: 37090 - protein, 18 aa, Homo sapiens
  heavy chain complementarity determining region 3 for antibody 18545
ARQRRGGYSYGYHYGMDV

SEQ ID NO: 37091 - protein, 9 aa, Homo sapiens
  light chain complementarity determining region 3 for antibody 18546
MQGLQTPDT

SEQ ID NO: 37092 - protein, 18 aa, Homo sapiens
  heavy chain complementarity determining region 3 for antibody 18546
ARQRRGGYSYGYHYGMDV

SEQ ID NO: 37093 - protein, 8 aa, Homo sapiens
  light chain complementarity determining region 3 for antibody 18547
MQALQTRT

SEQ ID NO: 37094 - protein, 19 aa, Homo sapiens
  heavy chain complementarity determining region 3 for antibody 18547
VRGRYYDAAGGGRYKGMDV

SEQ ID NO: 37095 - protein, 9 aa, Homo sapiens
  light chain complementarity determining region 3 for antibody 18548
MQALQTPYT

SEQ ID NO: 37096 - protein, 19 aa, Homo sapiens
  heavy chain complementarity determining region 3 for antibody 18548
AREGRHCGGGICYNNCFDP

SEQ ID NO: 37097 - protein, 9 aa, Homo sapiens
  light chain complementarity determining region 3 for antibody 18549
MQALQTPGT

SEQ ID NO: 37098 - protein, 19 aa, Homo sapiens
  heavy chain complementarity determining region 3 for antibody 18549
ARDIVFGSGSSSYYYGMDV

SEQ ID NO: 37099 - protein, 9 aa, Homo sapiens
  light chain complementarity determining region 3 for antibody 18550
MQALETPLT

SEQ ID NO: 37100 - protein, 15 aa, Homo sapiens
  heavy chain complementarity determining region 3 for antibody 18550
VRHYRVLATGIEGDS

SEQ ID NO: 37101 - protein, 9 aa, Homo sapiens
  light chain complementarity determining region 3 for antibody 18551
MQALETPFT

SEQ ID NO: 37102 - protein, 15 aa, Homo sapiens
  heavy chain complementarity determining region 3 for antibody 18551
VRRYRETVAGIEGDS

SEQ ID NO: 37103 - protein, 9 aa, Homo sapiens
  light chain complementarity determining region 3 for antibody 18552
MQALETPFT

SEQ ID NO: 37104 - protein, 15 aa, Homo sapiens
  heavy chain complementarity determining region 3 for antibody 18552
VRHYRIVTAPLEGDS

SEQ ID NO: 37105 - protein, 9 aa, Homo sapiens
  light chain complementarity determining region 3 for antibody 18553
MQALETPFT

SEQ ID NO: 37106 - protein, 15 aa, Homo sapiens
  heavy chain complementarity determining region 3 for antibody 18553
VRHYRIITATLEGDS

SEQ ID NO: 37107 - protein, 9 aa, Homo sapiens
  light chain complementarity determining region 3 for antibody 18554
MQALETPFT

SEQ ID NO: 37108 - protein, 15 aa, Homo sapiens
  heavy chain complementarity determining region 3 for antibody 18554
VRHYRIITAPLEGDA

SEQ ID NO: 37109 - protein, 9 aa, Homo sapiens
  light chain complementarity determining region 3 for antibody 18555
MQALETPFT

SEQ ID NO: 37110 - protein, 15 aa, Homo sapiens
  heavy chain complementarity determining region 3 for antibody 18555
VRHYRETVAGIEWDS

SEQ ID NO: 37111 - protein, 9 aa, Homo sapiens
  light chain complementarity determining region 3 for antibody 18556
MQALETPFN

SEQ ID NO: 37112 - protein, 15 aa, Homo sapiens
  heavy chain complementarity determining region 3 for antibody 18556
VRHYRELATGIEGDS

SEQ ID NO: 37113 - protein, 9 aa, Homo sapiens
  light chain complementarity determining region 3 for antibody 18557
MQALETPCT

SEQ ID NO: 37114 - protein, 15 aa, Homo sapiens
  heavy chain complementarity determining region 3 for antibody 18557
VRHYRETVAGIEGDS

SEQ ID NO: 37115 - protein, 9 aa, Homo sapiens
  light chain complementarity determining region 3 for antibody 18558
MQALEIPFT

SEQ ID NO: 37116 - protein, 15 aa, Homo sapiens
  heavy chain complementarity determining region 3 for antibody 18558
VRHYRELTTGIEGDS

SEQ ID NO: 37117 - protein, 9 aa, Homo sapiens
  light chain complementarity determining region 3 for antibody 18559
MGTLQTPPP

SEQ ID NO: 37118 - protein, 15 aa, Homo sapiens
  heavy chain complementarity determining region 3 for antibody 18559
TRDGKRDGHNDAFDI

SEQ ID NO: 37119 - protein, 9 aa, Homo sapiens
  light chain complementarity determining region 3 for antibody 18560
LQHNTYPGT

SEQ ID NO: 37120 - protein, 18 aa, Homo sapiens
  heavy chain complementarity determining region 3 for antibody 18560
ARDGVDYAPRDYYYGLDV

SEQ ID NO: 37121 - protein, 9 aa, Homo sapiens
  light chain complementarity determining region 3 for antibody 18561
LQHNSYPLT

SEQ ID NO: 37122 - protein, 13 aa, Homo sapiens
  heavy chain complementarity determining region 3 for antibody 18561
VRHAVVSPMVVDD

SEQ ID NO: 37123 - protein, 9 aa, Homo sapiens
  light chain complementarity determining region 3 for antibody 18562
LQHDNFPYS

SEQ ID NO: 37124 - protein, 12 aa, Homo sapiens
  heavy chain complementarity determining region 3 for antibody 18562
AREWDSGWYPDS

SEQ ID NO: 37125 - protein, 9 aa, Homo sapiens
  light chain complementarity determining region 3 for antibody 18563
LQGNSFPHT

SEQ ID NO: 37126 - protein, 14 aa, Homo sapiens
  heavy chain complementarity determining region 3 for antibody 18563
ARYCSGSSCYSMDY

SEQ ID NO: 37127 - protein, 9 aa, Homo sapiens
  light chain complementarity determining region 3 for antibody 18564
LQGNRFPHP

SEQ ID NO: 37128 - protein, 14 aa, Homo sapiens
  heavy chain complementarity determining region 3 for antibody 18564
ARYCSGNSCYSMDH

SEQ ID NO: 37129 - protein, 9 aa, Homo sapiens
  light chain complementarity determining region 3 for antibody 18565
LQALETPFT

SEQ ID NO: 37130 - protein, 15 aa, Homo sapiens
  heavy chain complementarity determining region 3 for antibody 18565
VRHYRELATGIEGDS

SEQ ID NO: 37131 - protein, 9 aa, Homo sapiens
  light chain complementarity determining region 3 for antibody 18566
HQYSSSPYP

SEQ ID NO: 37132 - protein, 13 aa, Homo sapiens
  heavy chain complementarity determining region 3 for antibody 18566
ARGTYSAFAIFGV

SEQ ID NO: 37133 - protein, 9 aa, Homo sapiens
  light chain complementarity determining region 3 for antibody 18567
HQYSSSPDT

SEQ ID NO: 37134 - protein, 13 aa, Homo sapiens
  heavy chain complementarity determining region 3 for antibody 18567
ARGTYSAFAIFGV

SEQ ID NO: 37135 - protein, 10 aa, Homo sapiens
  light chain complementarity determining region 3 for antibody 18568
HQSGILPPWR

SEQ ID NO: 37136 - protein, 13 aa, Homo sapiens
  heavy chain complementarity determining region 3 for antibody 18568
ARVSQAYYNGMDV

SEQ ID NO: 37137 - protein, 9 aa, Homo sapiens
  light chain complementarity determining region 3 for antibody 18569
HQRGGFPRT

SEQ ID NO: 37138 - protein, 11 aa, Homo sapiens
  heavy chain complementarity determining region 3 for antibody 18569
AREVYGGTFDS

SEQ ID NO: 37139 - protein, 9 aa, Homo sapiens
  light chain complementarity determining region 3 for antibody 18570
HQGGALPWT

SEQ ID NO: 37140 - protein, 14 aa, Homo sapiens
  heavy chain complementarity determining region 3 for antibody 18570
VRDASGNSGWYADS

SEQ ID NO: 37141 - protein, 9 aa, Homo sapiens
  light chain complementarity determining region 3 for antibody 18571
HPYSSSPYT

SEQ ID NO: 37142 - protein, 13 aa, Homo sapiens
  heavy chain complementarity determining region 3 for antibody 18571
ARGTYSAFAIFGV

SEQ ID NO: 37143 - protein, 9 aa, Homo sapiens
  light chain complementarity determining region 3 for antibody 18572
HPTYTFPRT

SEQ ID NO: 37144 - protein, 20 aa, Homo sapiens
  heavy chain complementarity determining region 3 for antibody 18572
ARGRRIAALSTAHYYYGMDV

SEQ ID NO: 37145 - protein, 9 aa, Homo sapiens
  light chain complementarity determining region 3 for antibody 18573
HPTSTFPRT

SEQ ID NO: 37146 - protein, 20 aa, Homo sapiens
  heavy chain complementarity determining region 3 for antibody 18573
ARGRRIAALSTAHYYYGMDV

SEQ ID NO: 37147 - protein, 9 aa, Homo sapiens
  light chain complementarity determining region 3 for antibody 18574
HKYDTAPWT

SEQ ID NO: 37148 - protein, 15 aa, Homo sapiens
  heavy chain complementarity determining region 3 for antibody 18574
LRDIKGPSAGIPYDS

SEQ ID NO: 37149 - protein, 9 aa, Homo sapiens
  light chain complementarity determining region 3 for antibody 18575
HHTYTFPRS

SEQ ID NO: 37150 - protein, 20 aa, Homo sapiens
  heavy chain complementarity determining region 3 for antibody 18575
ARGRRIAALSTAHYYYGMDV

SEQ ID NO: 37151 - protein, 9 aa, Homo sapiens
  light chain complementarity determining region 3 for antibody 18576
HHTSTFPRT

SEQ ID NO: 37152 - protein, 20 aa, Homo sapiens
  heavy chain complementarity determining region 3 for antibody 18576
ARGRRIAARSTAHYYYGMDV

SEQ ID NO: 37153 - protein, 9 aa, Homo sapiens
  light chain complementarity determining region 3 for antibody 18577
GQYNRYPRT

SEQ ID NO: 37154 - protein, 6 aa, Homo sapiens
  heavy chain complementarity determining region 3 for antibody 18577
TRALDY

SEQ ID NO: 37155 - protein, 9 aa, Homo sapiens
  light chain complementarity determining region 3 for antibody 18578
RQALETPST

SEQ ID NO: 37156 - protein, 15 aa, Homo sapiens
  heavy chain complementarity determining region 3 for antibody 18578
VRHYRETVAGIEGDS

SEQ ID NO: 37157 - protein, 9 aa, Homo sapiens
  light chain complementarity determining region 3 for antibody 18579
QYYGRSPWT

SEQ ID NO: 37158 - protein, 17 aa, Homo sapiens
  heavy chain complementarity determining region 3 for antibody 18579
ARTVLYHFTSVRAAFDV

SEQ ID NO: 37159 - protein, 10 aa, Homo sapiens
  light chain complementarity determining region 3 for antibody 18580
QYYDDSPGYP

SEQ ID NO: 37160 - protein, 12 aa, Homo sapiens
  heavy chain complementarity determining region 3 for antibody 18580
ARETTNIGELDY

SEQ ID NO: 37161 - protein, 11 aa, Homo sapiens
  light chain complementarity determining region 3 for antibody 18581
QYRHNWPAGYT

SEQ ID NO: 37162 - protein, 15 aa, Homo sapiens
  heavy chain complementarity determining region 3 for antibody 18581
AREGVDRLTISAFDI

SEQ ID NO: 37163 - protein, 9 aa, Homo sapiens
  light chain complementarity determining region 3 for antibody 18582
QQYYTSVRP

SEQ ID NO: 37164 - protein, 12 aa, Homo sapiens
  heavy chain complementarity determining region 3 for antibody 18582
VKDCGLGGSRDS

SEQ ID NO: 37165 - protein, 9 aa, Homo sapiens
  light chain complementarity determining region 3 for antibody 18583
QQYYTSVRP

SEQ ID NO: 37166 - protein, 12 aa, Homo sapiens
  heavy chain complementarity determining region 3 for antibody 18583
VKDCGLGGSRDF

SEQ ID NO: 37167 - protein, 8 aa, Homo sapiens
  light chain complementarity determining region 3 for antibody 18584
QQYYSYRT

SEQ ID NO: 37168 - protein, 14 aa, Homo sapiens
  heavy chain complementarity determining region 3 for antibody 18584
VTDQDVYWSGYFST

SEQ ID NO: 37169 - protein, 9 aa, Homo sapiens
  light chain complementarity determining region 3 for antibody 18585
QQYYNTPWT

SEQ ID NO: 37170 - protein, 17 aa, Homo sapiens
  heavy chain complementarity determining region 3 for antibody 18585
ARLWSSQHLHHQDVFDV

SEQ ID NO: 37171 - protein, 9 aa, Homo sapiens
  light chain complementarity determining region 3 for antibody 18586
QQYRDSPGT

SEQ ID NO: 37172 - protein, 22 aa, Homo sapiens
  heavy chain complementarity determining region 3 for antibody 18586
ARPKTQGGYYESSGYERAAFDL

SEQ ID NO: 37173 - protein, 11 aa, Homo sapiens
  light chain complementarity determining region 3 for antibody 18587
QQYRASPPGVT

SEQ ID NO: 37174 - protein, 14 aa, Homo sapiens
  heavy chain complementarity determining region 3 for antibody 18587
ARSPSNSRNRSFDQ

SEQ ID NO: 37175 - protein, 11 aa, Homo sapiens
  light chain complementarity determining region 3 for antibody 18588
QQYRALPPGFT

SEQ ID NO: 37176 - protein, 14 aa, Homo sapiens
  heavy chain complementarity determining region 3 for antibody 18588
ARSPSNSRNRSFDQ

SEQ ID NO: 37177 - protein, 9 aa, Homo sapiens
  light chain complementarity determining region 3 for antibody 18589
QQYNVWPYT

SEQ ID NO: 37178 - protein, 13 aa, Homo sapiens
  heavy chain complementarity determining region 3 for antibody 18589
ARVMAAVGYGMDV

SEQ ID NO: 37179 - protein, 9 aa, Homo sapiens
  light chain complementarity determining region 3 for antibody 18590
QQYNTWPRT

SEQ ID NO: 37180 - protein, 22 aa, Homo sapiens
  heavy chain complementarity determining region 3 for antibody 18590
AREVRASGYGDFYNYYYYGLDV

SEQ ID NO: 37181 - protein, 9 aa, Homo sapiens
  light chain complementarity determining region 3 for antibody 18591
QQYNTWPRT

SEQ ID NO: 37182 - protein, 22 aa, Homo sapiens
  heavy chain complementarity determining region 3 for antibody 18591
AREVRASGCDDFYNYYYYGLDV

SEQ ID NO: 37183 - protein, 9 aa, Homo sapiens
  light chain complementarity determining region 3 for antibody 18592
QQYNSYPYT

SEQ ID NO: 37184 - protein, 21 aa, Homo sapiens
  heavy chain complementarity determining region 3 for antibody 18592
ARDSSAWVTVRDYYHNSGMDV

SEQ ID NO: 37185 - protein, 10 aa, Homo sapiens
  light chain complementarity determining region 3 for antibody 18593
QQYNQWPPPT

SEQ ID NO: 37186 - protein, 17 aa, Homo sapiens
  heavy chain complementarity determining region 3 for antibody 18593
ARDLYFSIIQGGGAFDA

SEQ ID NO: 37187 - protein, 10 aa, Homo sapiens
  light chain complementarity determining region 3 for antibody 18594
QQYNQWPPLT

SEQ ID NO: 37188 - protein, 17 aa, Homo sapiens
  heavy chain complementarity determining region 3 for antibody 18594
ARDLYFSSIQGGGAFDA

SEQ ID NO: 37189 - protein, 10 aa, Homo sapiens
  light chain complementarity determining region 3 for antibody 18595
QQYNQWPPLT

SEQ ID NO: 37190 - protein, 17 aa, Homo sapiens
  heavy chain complementarity determining region 3 for antibody 18595
ARDLYFSIIHGGGAFDA

SEQ ID NO: 37191 - protein, 10 aa, Homo sapiens
  light chain complementarity determining region 3 for antibody 18596
QQYNQWPPLT

SEQ ID NO: 37192 - protein, 17 aa, Homo sapiens
  heavy chain complementarity determining region 3 for antibody 18596
ARDLYCSIIQGGGAFDA

SEQ ID NO: 37193 - protein, 10 aa, Homo sapiens
  light chain complementarity determining region 3 for antibody 18597
QQYNQRPPLT

SEQ ID NO: 37194 - protein, 17 aa, Homo sapiens
  heavy chain complementarity determining region 3 for antibody 18597
ARDLYFSIIQGGGAFDA

SEQ ID NO: 37195 - protein, 8 aa, Homo sapiens
  light chain complementarity determining region 3 for antibody 18598
QQYNNWPT

SEQ ID NO: 37196 - protein, 18 aa, Homo sapiens
  heavy chain complementarity determining region 3 for antibody 18598
ARGPPRMFSVTWYGAFDV

SEQ ID NO: 37197 - protein, 9 aa, Homo sapiens
  light chain complementarity determining region 3 for antibody 18599
QQYNNWPRT

SEQ ID NO: 37198 - protein, 15 aa, Homo sapiens
  heavy chain complementarity determining region 3 for antibody 18599
AKDGGSGWIPIYFDF

SEQ ID NO: 37199 - protein, 9 aa, Homo sapiens
  light chain complementarity determining region 3 for antibody 18600
QQYHSSPIT

SEQ ID NO: 37200 - protein, 9 aa, Homo sapiens
  heavy chain complementarity determining region 3 for antibody 18600
AKESSVYDS

SEQ ID NO: 37201 - protein, 6 aa, Homo sapiens
  light chain complementarity determining region 3 for antibody 18601
QQYGTT

SEQ ID NO: 37202 - protein, 12 aa, Homo sapiens
  heavy chain complementarity determining region 3 for antibody 18601
ARDADAGYALDC

SEQ ID NO: 37203 - protein, 8 aa, Homo sapiens
  light chain complementarity determining region 3 for antibody 18602
QQYGTSRM

SEQ ID NO: 37204 - protein, 13 aa, Homo sapiens
  heavy chain complementarity determining region 3 for antibody 18602
ARGQFVGSAYSEN

SEQ ID NO: 37205 - protein, 9 aa, Homo sapiens
  light chain complementarity determining region 3 for antibody 18603
QQYGTSPVT

SEQ ID NO: 37206 - protein, 15 aa, Homo sapiens
  heavy chain complementarity determining region 3 for antibody 18603
ARQNDFLSGPGEFDP

SEQ ID NO: 37207 - protein, 9 aa, Homo sapiens
  light chain complementarity determining region 3 for antibody 18604
QQYGTSPRT

SEQ ID NO: 37208 - protein, 13 aa, Homo sapiens
  heavy chain complementarity determining region 3 for antibody 18604
PIGCYDRSGYHEY

SEQ ID NO: 37209 - protein, 10 aa, Homo sapiens
  light chain complementarity determining region 3 for antibody 18605
QQYGTSLPWT

SEQ ID NO: 37210 - protein, 14 aa, Homo sapiens
  heavy chain complementarity determining region 3 for antibody 18605
ARGGSSGYDSQLDF

SEQ ID NO: 37211 - protein, 9 aa, Homo sapiens
  light chain complementarity determining region 3 for antibody 18606
QQYGTPPRT

SEQ ID NO: 37212 - protein, 25 aa, Homo sapiens
  heavy chain complementarity determining region 3 for antibody 18606
ARLRVDRLRLPGAMRGPLYDRGLSV

SEQ ID NO: 37213 - protein, 9 aa, Homo sapiens
  light chain complementarity determining region 3 for antibody 18607
QQYGSVPHT

SEQ ID NO: 37214 - protein, 14 aa, Homo sapiens
  heavy chain complementarity determining region 3 for antibody 18607
ARGGGSDWYGLLYY

SEQ ID NO: 37215 - protein, 9 aa, Homo sapiens
  light chain complementarity determining region 3 for antibody 18608
QQYGSSPRT

SEQ ID NO: 37216 - protein, 17 aa, Homo sapiens
  heavy chain complementarity determining region 3 for antibody 18608
ATDPQWLEPPPFLTNDY

SEQ ID NO: 37217 - protein, 9 aa, Homo sapiens
  light chain complementarity determining region 3 for antibody 18609
QQYGSSPRT

SEQ ID NO: 37218 - protein, 19 aa, Homo sapiens
  heavy chain complementarity determining region 3 for antibody 18609
ARPQGYDCRSGYSEHYFDY

SEQ ID NO: 37219 - protein, 9 aa, Homo sapiens
  light chain complementarity determining region 3 for antibody 18610
QQYGSSPRT

SEQ ID NO: 37220 - protein, 25 aa, Homo sapiens
  heavy chain complementarity determining region 3 for antibody 18610
ARLRIDRLRLPGARRGPLYDCGLNV

SEQ ID NO: 37221 - protein, 9 aa, Homo sapiens
  light chain complementarity determining region 3 for antibody 18611
QQYGSSPRT

SEQ ID NO: 37222 - protein, 25 aa, Homo sapiens
  heavy chain complementarity determining region 3 for antibody 18611
ARLRIDRLRLPGAMRGPLYDCGLTV

SEQ ID NO: 37223 - protein, 9 aa, Homo sapiens
  light chain complementarity determining region 3 for antibody 18612
QQYGSSPRT

SEQ ID NO: 37224 - protein, 25 aa, Homo sapiens
  heavy chain complementarity determining region 3 for antibody 18612
ARLRIDRLRLPGAMRGPLYACGLNV

SEQ ID NO: 37225 - protein, 9 aa, Homo sapiens
  light chain complementarity determining region 3 for antibody 18613
QQYGSSPRR

SEQ ID NO: 37226 - protein, 25 aa, Homo sapiens
  heavy chain complementarity determining region 3 for antibody 18613
ARLRIDRLRLPGAMRGPLYDCGLNV

SEQ ID NO: 37227 - protein, 9 aa, Homo sapiens
  light chain complementarity determining region 3 for antibody 18614
QQYGSSPPT

SEQ ID NO: 37228 - protein, 16 aa, Homo sapiens
  heavy chain complementarity determining region 3 for antibody 18614
ARGRTFRGNIYADLVY

SEQ ID NO: 37229 - protein, 10 aa, Homo sapiens
  light chain complementarity determining region 3 for antibody 18615
QQYGSSPIYS

SEQ ID NO: 37230 - protein, 11 aa, Homo sapiens
  heavy chain complementarity determining region 3 for antibody 18615
ARGGQWGSLDY

SEQ ID NO: 37231 - protein, 9 aa, Homo sapiens
  light chain complementarity determining region 3 for antibody 18616
QQYGSSLLT

SEQ ID NO: 37232 - protein, 20 aa, Homo sapiens
  heavy chain complementarity determining region 3 for antibody 18616
ARGGYYYNSGNYRQASTFDS

SEQ ID NO: 37233 - protein, 9 aa, Homo sapiens
  light chain complementarity determining region 3 for antibody 18617
QQYGSLPRT

SEQ ID NO: 37234 - protein, 25 aa, Homo sapiens
  heavy chain complementarity determining region 3 for antibody 18617
ARLRIDRLRLPGAMRGPLYDCGLNV

SEQ ID NO: 37235 - protein, 9 aa, Homo sapiens
  light chain complementarity determining region 3 for antibody 18618
QQYGSLPRT

SEQ ID NO: 37236 - protein, 14 aa, Homo sapiens
  heavy chain complementarity determining region 3 for antibody 18618
AGGDFCGRDCYSEY

SEQ ID NO: 37237 - protein, 9 aa, Homo sapiens
  light chain complementarity determining region 3 for antibody 18619
QQYGSLPNT

SEQ ID NO: 37238 - protein, 29 aa, Homo sapiens
  heavy chain complementarity determining region 3 for antibody 18619
AKSGRLRDLWFGDFRRPNYFDNTGYYLDY

SEQ ID NO: 37239 - protein, 10 aa, Homo sapiens
  light chain complementarity determining region 3 for antibody 18620
QQYGSLPMYS

SEQ ID NO: 37240 - protein, 11 aa, Homo sapiens
  heavy chain complementarity determining region 3 for antibody 18620
ARGGQWGSLDY

SEQ ID NO: 37241 - protein, 9 aa, Homo sapiens
  light chain complementarity determining region 3 for antibody 18621
QQYGSLPHT

SEQ ID NO: 37242 - protein, 14 aa, Homo sapiens
  heavy chain complementarity determining region 3 for antibody 18621
ARGGGSDWYGFLYY

SEQ ID NO: 37243 - protein, 9 aa, Homo sapiens
  light chain complementarity determining region 3 for antibody 18622
QQYGSIPRT

SEQ ID NO: 37244 - protein, 13 aa, Homo sapiens
  heavy chain complementarity determining region 3 for antibody 18622
ALGHYHTTGYSDF

SEQ ID NO: 37245 - protein, 9 aa, Homo sapiens
  light chain complementarity determining region 3 for antibody 18623
QQYGSIPRT

SEQ ID NO: 37246 - protein, 13 aa, Homo sapiens
  heavy chain complementarity determining region 3 for antibody 18623
AGGSFSGGNYKDD

SEQ ID NO: 37247 - protein, 9 aa, Homo sapiens
  light chain complementarity determining region 3 for antibody 18624
QQYGSIPRT

SEQ ID NO: 37248 - protein, 14 aa, Homo sapiens
  heavy chain complementarity determining region 3 for antibody 18624
AGGECSSGWHYSEN

SEQ ID NO: 37249 - protein, 9 aa, Homo sapiens
  light chain complementarity determining region 3 for antibody 18625
QQYGSIPLT

SEQ ID NO: 37250 - protein, 7 aa, Homo sapiens
  heavy chain complementarity determining region 3 for antibody 18625
HGYELKF

SEQ ID NO: 37251 - protein, 9 aa, Homo sapiens
  light chain complementarity determining region 3 for antibody 18626
QQYGSAPRT

SEQ ID NO: 37252 - protein, 25 aa, Homo sapiens
  heavy chain complementarity determining region 3 for antibody 18626
ARLRIDRLRLPGAMRGPLYDCGLNV

SEQ ID NO: 37253 - protein, 9 aa, Homo sapiens
  light chain complementarity determining region 3 for antibody 18627
QQYGRSPRT

SEQ ID NO: 37254 - protein, 25 aa, Homo sapiens
  heavy chain complementarity determining region 3 for antibody 18627
ARLRIDRLRLPGAMRGPLYDCGLNV

SEQ ID NO: 37255 - protein, 8 aa, Homo sapiens
  light chain complementarity determining region 3 for antibody 18628
QQYGRSLT

SEQ ID NO: 37256 - protein, 16 aa, Homo sapiens
  heavy chain complementarity determining region 3 for antibody 18628
ASIYDSTDYYGGYFQH

SEQ ID NO: 37257 - protein, 9 aa, Homo sapiens
  light chain complementarity determining region 3 for antibody 18629
QQYGRLPRT

SEQ ID NO: 37258 - protein, 13 aa, Homo sapiens
  heavy chain complementarity determining region 3 for antibody 18629
AGGLYDSSGYSEF

SEQ ID NO: 37259 - protein, 9 aa, Homo sapiens
  light chain complementarity determining region 3 for antibody 18630
QQYGRIPRA

SEQ ID NO: 37260 - protein, 13 aa, Homo sapiens
  heavy chain complementarity determining region 3 for antibody 18630
AGGTWHSSAYYES

SEQ ID NO: 37261 - protein, 9 aa, Homo sapiens
  light chain complementarity determining region 3 for antibody 18631
QQYGNSPRT

SEQ ID NO: 37262 - protein, 16 aa, Homo sapiens
  heavy chain complementarity determining region 3 for antibody 18631
ARGTFYQGSSDNYHEN

SEQ ID NO: 37263 - protein, 9 aa, Homo sapiens
  light chain complementarity determining region 3 for antibody 18632
QQYGNSPRT

SEQ ID NO: 37264 - protein, 15 aa, Homo sapiens
  heavy chain complementarity determining region 3 for antibody 18632
AGGWFNYYSSGYYES

SEQ ID NO: 37265 - protein, 9 aa, Homo sapiens
  light chain complementarity determining region 3 for antibody 18633
QQYGNLPRT

SEQ ID NO: 37266 - protein, 13 aa, Homo sapiens
  heavy chain complementarity determining region 3 for antibody 18633
AGGSFHSGGYGEY

SEQ ID NO: 37267 - protein, 9 aa, Homo sapiens
  light chain complementarity determining region 3 for antibody 18634
QQYGNIPRS

SEQ ID NO: 37268 - protein, 13 aa, Homo sapiens
  heavy chain complementarity determining region 3 for antibody 18634
AGGTWHSGTYFES

SEQ ID NO: 37269 - protein, 9 aa, Homo sapiens
  light chain complementarity determining region 3 for antibody 18635
QQYGNIPRP

SEQ ID NO: 37270 - protein, 13 aa, Homo sapiens
  heavy chain complementarity determining region 3 for antibody 18635
AGGLFHSSGYSEF

SEQ ID NO: 37271 - protein, 9 aa, Homo sapiens
  light chain complementarity determining region 3 for antibody 18636
QQYGNIPRK

SEQ ID NO: 37272 - protein, 13 aa, Homo sapiens
  heavy chain complementarity determining region 3 for antibody 18636
AGGLFHSSGYSEF

SEQ ID NO: 37273 - protein, 9 aa, Homo sapiens
  light chain complementarity determining region 3 for antibody 18637
QQYGGSPRT

SEQ ID NO: 37274 - protein, 13 aa, Homo sapiens
  heavy chain complementarity determining region 3 for antibody 18637
ASGYFDSGAYSEF

SEQ ID NO: 37275 - protein, 9 aa, Homo sapiens
  light chain complementarity determining region 3 for antibody 18638
QQYGGSPRP

SEQ ID NO: 37276 - protein, 13 aa, Homo sapiens
  heavy chain complementarity determining region 3 for antibody 18638
AAGYFSSGTYYEY

SEQ ID NO: 37277 - protein, 9 aa, Homo sapiens
  light chain complementarity determining region 3 for antibody 18639
QQYGGLPRT

SEQ ID NO: 37278 - protein, 13 aa, Homo sapiens
  heavy chain complementarity determining region 3 for antibody 18639
ASGYFDSGAYYEF

SEQ ID NO: 37279 - protein, 9 aa, Homo sapiens
  light chain complementarity determining region 3 for antibody 18640
QQYGGLPRT

SEQ ID NO: 37280 - protein, 13 aa, Homo sapiens
  heavy chain complementarity determining region 3 for antibody 18640
AAGYFSSGTYYEY

SEQ ID NO: 37281 - protein, 10 aa, Homo sapiens
  light chain complementarity determining region 3 for antibody 18641
QQYGDSPAYG

SEQ ID NO: 37282 - protein, 10 aa, Homo sapiens
  heavy chain complementarity determining region 3 for antibody 18641
VNSAGSYFEY

SEQ ID NO: 37283 - protein, 9 aa, Homo sapiens
  light chain complementarity determining region 3 for antibody 18642
QQYGAPPRT

SEQ ID NO: 37284 - protein, 13 aa, Homo sapiens
  heavy chain complementarity determining region 3 for antibody 18642
ASGYGSGASYREN

SEQ ID NO: 37285 - protein, 9 aa, Homo sapiens
  light chain complementarity determining region 3 for antibody 18643
QQYFTSPPP

SEQ ID NO: 37286 - protein, 15 aa, Homo sapiens
  heavy chain complementarity determining region 3 for antibody 18643
VKVLMSGTQIALFDQ

SEQ ID NO: 37287 - protein, 9 aa, Homo sapiens
  light chain complementarity determining region 3 for antibody 18644
QQYFTRPPT

SEQ ID NO: 37288 - protein, 15 aa, Homo sapiens
  heavy chain complementarity determining region 3 for antibody 18644
VKVLMSGTQIALFDQ

SEQ ID NO: 37289 - protein, 8 aa, Homo sapiens
  light chain complementarity determining region 3 for antibody 18645
QQYFATLT

SEQ ID NO: 37290 - protein, 18 aa, Homo sapiens
  heavy chain complementarity determining region 3 for antibody 18645
AKDKTGRRSSSWSYFFDF

SEQ ID NO: 37291 - protein, 8 aa, Homo sapiens
  light chain complementarity determining region 3 for antibody 18646
QQYETLVT

SEQ ID NO: 37292 - protein, 18 aa, Homo sapiens
  heavy chain complementarity determining region 3 for antibody 18646
AKGAEGSCSVRKCYPFDY

SEQ ID NO: 37293 - protein, 9 aa, Homo sapiens
  light chain complementarity determining region 3 for antibody 18647
QQYDTSPGT

SEQ ID NO: 37294 - protein, 16 aa, Homo sapiens
  heavy chain complementarity determining region 3 for antibody 18647
ARLSGDWGSAPHFFGT

SEQ ID NO: 37295 - protein, 9 aa, Homo sapiens
  light chain complementarity determining region 3 for antibody 18648
QQYDTSPGT

SEQ ID NO: 37296 - protein, 16 aa, Homo sapiens
  heavy chain complementarity determining region 3 for antibody 18648
ARLSGDWGSAPHFFDP

SEQ ID NO: 37297 - protein, 9 aa, Homo sapiens
  light chain complementarity determining region 3 for antibody 18649
QQYDSSPPT

SEQ ID NO: 37298 - protein, 14 aa, Homo sapiens
  heavy chain complementarity determining region 3 for antibody 18649
ARDNPHRLERYFDL

SEQ ID NO: 37299 - protein, 9 aa, Homo sapiens
  light chain complementarity determining region 3 for antibody 18650
QQYDRSPQT

SEQ ID NO: 37300 - protein, 15 aa, Homo sapiens
  heavy chain complementarity determining region 3 for antibody 18650
ARDPTVASHHYGVDV

SEQ ID NO: 37301 - protein, 11 aa, Homo sapiens
  light chain complementarity determining region 3 for antibody 18651
QQYDRSPPGYP

SEQ ID NO: 37302 - protein, 14 aa, Homo sapiens
  heavy chain complementarity determining region 3 for antibody 18651
ARDTHNSRKRSFDQ

SEQ ID NO: 37303 - protein, 10 aa, Homo sapiens
  light chain complementarity determining region 3 for antibody 18652
QQYDNWPPWT

SEQ ID NO: 37304 - protein, 12 aa, Homo sapiens
  heavy chain complementarity determining region 3 for antibody 18652
AKTLRERKELDC

SEQ ID NO: 37305 - protein, 10 aa, Homo sapiens
  light chain complementarity determining region 3 for antibody 18653
QQYDNWPPGT

SEQ ID NO: 37306 - protein, 12 aa, Homo sapiens
  heavy chain complementarity determining region 3 for antibody 18653
AKTLRERKELDY

SEQ ID NO: 37307 - protein, 10 aa, Homo sapiens
  light chain complementarity determining region 3 for antibody 18654
QQYATSPPWP

SEQ ID NO: 37308 - protein, 16 aa, Homo sapiens
  heavy chain complementarity determining region 3 for antibody 18654
ARVQWVRGLTKEGLDF

SEQ ID NO: 37309 - protein, 9 aa, Homo sapiens
  light chain complementarity determining region 3 for antibody 18655
QQTNSNPPT

SEQ ID NO: 37310 - protein, 14 aa, Homo sapiens
  heavy chain complementarity determining region 3 for antibody 18655
ARGGLGIWGNSSDL

SEQ ID NO: 37311 - protein, 9 aa, Homo sapiens
  light chain complementarity determining region 3 for antibody 18656
QQTNSNPPT

SEQ ID NO: 37312 - protein, 14 aa, Homo sapiens
  heavy chain complementarity determining region 3 for antibody 18656
ARGGLGIGGNSSDI

SEQ ID NO: 37313 - protein, 10 aa, Homo sapiens
  light chain complementarity determining region 3 for antibody 18657
QQSYHVPALT

SEQ ID NO: 37314 - protein, 17 aa, Homo sapiens
  heavy chain complementarity determining region 3 for antibody 18657
AKDQMAVAGKAPCGMDV

SEQ ID NO: 37315 - protein, 9 aa, Homo sapiens
  light chain complementarity determining region 3 for antibody 18658
QQSFSTPYT

SEQ ID NO: 37316 - protein, 18 aa, Homo sapiens
  heavy chain complementarity determining region 3 for antibody 18658
ARDIFWRGTAAMRYYFDY

SEQ ID NO: 37317 - protein, 10 aa, Homo sapiens
  light chain complementarity determining region 3 for antibody 18659
QQRYNWPPFN

SEQ ID NO: 37318 - protein, 11 aa, Homo sapiens
  heavy chain complementarity determining region 3 for antibody 18659
ARGVGSYPFDS

SEQ ID NO: 37319 - protein, 11 aa, Homo sapiens
  light chain complementarity determining region 3 for antibody 18660
QQRTNWPPIYT

SEQ ID NO: 37320 - protein, 14 aa, Homo sapiens
  heavy chain complementarity determining region 3 for antibody 18660
ARGGLGIGGNSSDI

SEQ ID NO: 37321 - protein, 9 aa, Homo sapiens
  light chain complementarity determining region 3 for antibody 18661
QQRSSWPYT

SEQ ID NO: 37322 - protein, 11 aa, Homo sapiens
  heavy chain complementarity determining region 3 for antibody 18661
VKRWGGSRIDY

SEQ ID NO: 37323 - protein, 9 aa, Homo sapiens
  light chain complementarity determining region 3 for antibody 18662
QQRSSWPYT

SEQ ID NO: 37324 - protein, 11 aa, Homo sapiens
  heavy chain complementarity determining region 3 for antibody 18662
VKGWGGSSIDY

SEQ ID NO: 37325 - protein, 9 aa, Homo sapiens
  light chain complementarity determining region 3 for antibody 18663
QQRSSCPYT

SEQ ID NO: 37326 - protein, 11 aa, Homo sapiens
  heavy chain complementarity determining region 3 for antibody 18663
VKRWGGSSIDY

SEQ ID NO: 37327 - protein, 9 aa, Homo sapiens
  light chain complementarity determining region 3 for antibody 18664
QQRSNGQFT

SEQ ID NO: 37328 - protein, 16 aa, Homo sapiens
  heavy chain complementarity determining region 3 for antibody 18664
ARDWGSTNAATGRFDY

SEQ ID NO: 37329 - protein, 10 aa, Homo sapiens
  light chain complementarity determining region 3 for antibody 18665
QQRSKWPPRT

SEQ ID NO: 37330 - protein, 9 aa, Homo sapiens
  heavy chain complementarity determining region 3 for antibody 18665
ARVDGYFDY

SEQ ID NO: 37331 - protein, 10 aa, Homo sapiens
  light chain complementarity determining region 3 for antibody 18666
QQRSGWPPLT

SEQ ID NO: 37332 - protein, 10 aa, Homo sapiens
  heavy chain complementarity determining region 3 for antibody 18666
ARDYTMTFDY

SEQ ID NO: 37333 - protein, 8 aa, Homo sapiens
  light chain complementarity determining region 3 for antibody 18667
QQRNFRPT

SEQ ID NO: 37334 - protein, 13 aa, Homo sapiens
  heavy chain complementarity determining region 3 for antibody 18667
TTDAAFVPYYFTY

SEQ ID NO: 37335 - protein, 8 aa, Homo sapiens
  light chain complementarity determining region 3 for antibody 18668
QQRNFRLP

SEQ ID NO: 37336 - protein, 13 aa, Homo sapiens
  heavy chain complementarity determining region 3 for antibody 18668
TTDAAFVPYYFTY

SEQ ID NO: 37337 - protein, 10 aa, Homo sapiens
  light chain complementarity determining region 3 for antibody 18669
QQRGNSPPWP

SEQ ID NO: 37338 - protein, 12 aa, Homo sapiens
  heavy chain complementarity determining region 3 for antibody 18669
ARDHYARVAFDI

SEQ ID NO: 37339 - protein, 9 aa, Homo sapiens
  light chain complementarity determining region 3 for antibody 18670
QQPNSWPRT

SEQ ID NO: 37340 - protein, 14 aa, Homo sapiens
  heavy chain complementarity determining region 3 for antibody 18670
ARGGDYEYPDVFDI

SEQ ID NO: 37341 - protein, 9 aa, Homo sapiens
  light chain complementarity determining region 3 for antibody 18671
QQNGSSLYT

SEQ ID NO: 37342 - protein, 16 aa, Homo sapiens
  heavy chain complementarity determining region 3 for antibody 18671
ARAKHYGDYYYYGMDA

SEQ ID NO: 37343 - protein, 9 aa, Homo sapiens
  light chain complementarity determining region 3 for antibody 18672
QQNGNLPRT

SEQ ID NO: 37344 - protein, 13 aa, Homo sapiens
  heavy chain complementarity determining region 3 for antibody 18672
AGGDFHSGGYSEF

SEQ ID NO: 37345 - protein, 9 aa, Homo sapiens
  light chain complementarity determining region 3 for antibody 18673
QQNGNIPRT

SEQ ID NO: 37346 - protein, 13 aa, Homo sapiens
  heavy chain complementarity determining region 3 for antibody 18673
AGGLFHSSGYSEF

SEQ ID NO: 37347 - protein, 8 aa, Homo sapiens
  light chain complementarity determining region 3 for antibody 18674
QQNGGSPS

SEQ ID NO: 37348 - protein, 16 aa, Homo sapiens
  heavy chain complementarity determining region 3 for antibody 18674
ATDWGSGTQWIRAFDV

SEQ ID NO: 37349 - protein, 9 aa, Homo sapiens
  light chain complementarity determining region 3 for antibody 18675
QQNGGSPRT

SEQ ID NO: 37350 - protein, 13 aa, Homo sapiens
  heavy chain complementarity determining region 3 for antibody 18675
ASGYFDSGAYYEF

SEQ ID NO: 37351 - protein, 9 aa, Homo sapiens
  light chain complementarity determining region 3 for antibody 18676
QQLNSYPLT

SEQ ID NO: 37352 - protein, 14 aa, Homo sapiens
  heavy chain complementarity determining region 3 for antibody 18676
ARGKGQWLDWYFDL

SEQ ID NO: 37353 - protein, 9 aa, Homo sapiens
  light chain complementarity determining region 3 for antibody 18677
QQLGTLPYT

SEQ ID NO: 37354 - protein, 16 aa, Homo sapiens
  heavy chain complementarity determining region 3 for antibody 18677
TTERHIAVFEEASFDI

SEQ ID NO: 37355 - protein, 9 aa, Homo sapiens
  light chain complementarity determining region 3 for antibody 18678
QQLDSSPLT

SEQ ID NO: 37356 - protein, 15 aa, Homo sapiens
  heavy chain complementarity determining region 3 for antibody 18678
AKDKGPGVRVYFCDS

SEQ ID NO: 37357 - protein, 8 aa, Homo sapiens
  light chain complementarity determining region 3 for antibody 18679
QQICTTRT

SEQ ID NO: 37358 - protein, 8 aa, Homo sapiens
  heavy chain complementarity determining region 3 for antibody 18679
AKGYGFDS

SEQ ID NO: 37359 - protein, 8 aa, Homo sapiens
  light chain complementarity determining region 3 for antibody 18680
QQHGYSGT

SEQ ID NO: 37360 - protein, 9 aa, Homo sapiens
  heavy chain complementarity determining region 3 for antibody 18680
ARWVEGLDV

SEQ ID NO: 37361 - protein, 9 aa, Homo sapiens
  light chain complementarity determining region 3 for antibody 18681
QQHGTPPRT

SEQ ID NO: 37362 - protein, 25 aa, Homo sapiens
  heavy chain complementarity determining region 3 for antibody 18681
ARLRVDRLRLPGAMRGPLYDRGLNV

SEQ ID NO: 37363 - protein, 9 aa, Homo sapiens
  light chain complementarity determining region 3 for antibody 18682
QQGYRTPFI

SEQ ID NO: 37364 - protein, 15 aa, Homo sapiens
  heavy chain complementarity determining region 3 for antibody 18682
TRAQVIWGQLYYFDY

SEQ ID NO: 37365 - protein, 9 aa, Homo sapiens
  light chain complementarity determining region 3 for antibody 18683
QQGYRPPFI

SEQ ID NO: 37366 - protein, 15 aa, Homo sapiens
  heavy chain complementarity determining region 3 for antibody 18683
TRAQVIWGQLYSFDY

SEQ ID NO: 37367 - protein, 9 aa, Homo sapiens
  light chain complementarity determining region 3 for antibody 18684
QQGNSFPHT

SEQ ID NO: 37368 - protein, 14 aa, Homo sapiens
  heavy chain complementarity determining region 3 for antibody 18684
ARYCSGTRCYSMDY

SEQ ID NO: 37369 - protein, 9 aa, Homo sapiens
  light chain complementarity determining region 3 for antibody 18685
QQGNSFPHT

SEQ ID NO: 37370 - protein, 14 aa, Homo sapiens
  heavy chain complementarity determining region 3 for antibody 18685
ARYCSGTKCYSMDY

SEQ ID NO: 37371 - protein, 9 aa, Homo sapiens
  light chain complementarity determining region 3 for antibody 18686
QQFYGSPWT

SEQ ID NO: 37372 - protein, 16 aa, Homo sapiens
  heavy chain complementarity determining region 3 for antibody 18686
IRQDYYDTSGFSYPAP

SEQ ID NO: 37373 - protein, 9 aa, Homo sapiens
  light chain complementarity determining region 3 for antibody 18687
QQDRRSPST

SEQ ID NO: 37374 - protein, 17 aa, Homo sapiens
  heavy chain complementarity determining region 3 for antibody 18687
AGLSSRLGDGSPSLFDY

SEQ ID NO: 37375 - protein, 9 aa, Homo sapiens
  light chain complementarity determining region 3 for antibody 18688
QQDHSFPLA

SEQ ID NO: 37376 - protein, 11 aa, Homo sapiens
  heavy chain complementarity determining region 3 for antibody 18688
VHSPAMAEIDY

SEQ ID NO: 37377 - protein, 9 aa, Homo sapiens
  light chain complementarity determining region 3 for antibody 18689
QQDGTSPRT

SEQ ID NO: 37378 - protein, 14 aa, Homo sapiens
  heavy chain complementarity determining region 3 for antibody 18689
AGGDFCGRDCYSEY

SEQ ID NO: 37379 - protein, 9 aa, Homo sapiens
  light chain complementarity determining region 3 for antibody 18690
QQDGTLPQT

SEQ ID NO: 37380 - protein, 18 aa, Homo sapiens
  heavy chain complementarity determining region 3 for antibody 18690
ARDYYGSGREIWVGAFDI

SEQ ID NO: 37381 - protein, 9 aa, Homo sapiens
  light chain complementarity determining region 3 for antibody 18691
QQDGSSPRT

SEQ ID NO: 37382 - protein, 15 aa, Homo sapiens
  heavy chain complementarity determining region 3 for antibody 18691
AKTYDFWSGDDAFEI

SEQ ID NO: 37383 - protein, 9 aa, Homo sapiens
  light chain complementarity determining region 3 for antibody 18692
QQDGSIPRT

SEQ ID NO: 37384 - protein, 14 aa, Homo sapiens
  heavy chain complementarity determining region 3 for antibody 18692
AGGEFSSGWHYSEN

SEQ ID NO: 37385 - protein, 9 aa, Homo sapiens
  light chain complementarity determining region 3 for antibody 18693
QQDGNLPRT

SEQ ID NO: 37386 - protein, 13 aa, Homo sapiens
  heavy chain complementarity determining region 3 for antibody 18693
AGGNYDTGRYEEY

SEQ ID NO: 37387 - protein, 9 aa, Homo sapiens
  light chain complementarity determining region 3 for antibody 18694
QQDGNLPRT

SEQ ID NO: 37388 - protein, 14 aa, Homo sapiens
  heavy chain complementarity determining region 3 for antibody 18694
AGGDFHRGGGYSEF

SEQ ID NO: 37389 - protein, 9 aa, Homo sapiens
  light chain complementarity determining region 3 for antibody 18695
QQDGNIPRS

SEQ ID NO: 37390 - protein, 13 aa, Homo sapiens
  heavy chain complementarity determining region 3 for antibody 18695
AGGTWHSGTYYES

SEQ ID NO: 37391 - protein, 9 aa, Homo sapiens
  light chain complementarity determining region 3 for antibody 18696
QQADRKPFT

SEQ ID NO: 37392 - protein, 14 aa, Homo sapiens
  heavy chain complementarity determining region 3 for antibody 18696
ARDNSNNWYEGMDV

SEQ ID NO: 37393 - protein, 10 aa, Homo sapiens
  light chain complementarity determining region 3 for antibody 18697
QPYGSSPMYS

SEQ ID NO: 37394 - protein, 11 aa, Homo sapiens
  heavy chain complementarity determining region 3 for antibody 18697
ARGGQWGSLDY

SEQ ID NO: 37395 - protein, 11 aa, Homo sapiens
  light chain complementarity determining region 3 for antibody 18698
QLYETSPPGSP

SEQ ID NO: 37396 - protein, 14 aa, Homo sapiens
  heavy chain complementarity determining region 3 for antibody 18698
ARENSISRKRSFDQ

SEQ ID NO: 37397 - protein, 9 aa, Homo sapiens
  light chain complementarity determining region 3 for antibody 18699
QKNDTAPWT

SEQ ID NO: 37398 - protein, 15 aa, Homo sapiens
  heavy chain complementarity determining region 3 for antibody 18699
LRDIKGPSAGIPYDS

SEQ ID NO: 37399 - protein, 9 aa, Homo sapiens
  light chain complementarity determining region 3 for antibody 18700
QHYVTSPLT

SEQ ID NO: 37400 - protein, 8 aa, Homo sapiens
  heavy chain complementarity determining region 3 for antibody 18700
VCMRVATN

SEQ ID NO: 37401 - protein, 9 aa, Homo sapiens
  light chain complementarity determining region 3 for antibody 18701
QHYVTSPLT

SEQ ID NO: 37402 - protein, 8 aa, Homo sapiens
  heavy chain complementarity determining region 3 for antibody 18701
VCMIAATN

SEQ ID NO: 37403 - protein, 9 aa, Homo sapiens
  light chain complementarity determining region 3 for antibody 18702
QHYGSSPRT

SEQ ID NO: 37404 - protein, 13 aa, Homo sapiens
  heavy chain complementarity determining region 3 for antibody 18702
ARGKFERSGYVET

SEQ ID NO: 37405 - protein, 9 aa, Homo sapiens
  light chain complementarity determining region 3 for antibody 18703
QHYGSLPIT

SEQ ID NO: 37406 - protein, 16 aa, Homo sapiens
  heavy chain complementarity determining region 3 for antibody 18703
ATMLVRGLLYFHAVDV

SEQ ID NO: 37407 - protein, 9 aa, Homo sapiens
  light chain complementarity determining region 3 for antibody 18704
QHYGRSPRT

SEQ ID NO: 37408 - protein, 13 aa, Homo sapiens
  heavy chain complementarity determining region 3 for antibody 18704
ARGKFERSGYVEP

SEQ ID NO: 37409 - protein, 9 aa, Homo sapiens
  light chain complementarity determining region 3 for antibody 18705
QHYGRLPLT

SEQ ID NO: 37410 - protein, 16 aa, Homo sapiens
  heavy chain complementarity determining region 3 for antibody 18705
ATMLVRGLLYFHAVDV

SEQ ID NO: 37411 - protein, 10 aa, Homo sapiens
  light chain complementarity determining region 3 for antibody 18706
QHYGNSPPIT

SEQ ID NO: 37412 - protein, 11 aa, Homo sapiens
  heavy chain complementarity determining region 3 for antibody 18706
ARCFNTCYFDH

SEQ ID NO: 37413 - protein, 9 aa, Homo sapiens
  light chain complementarity determining region 3 for antibody 18707
QHYGNSPLT

SEQ ID NO: 37414 - protein, 13 aa, Homo sapiens
  heavy chain complementarity determining region 3 for antibody 18707
ASKTSVRTYSSDL

SEQ ID NO: 37415 - protein, 9 aa, Homo sapiens
  light chain complementarity determining region 3 for antibody 18708
QHYGGSPRT

SEQ ID NO: 37416 - protein, 15 aa, Homo sapiens
  heavy chain complementarity determining region 3 for antibody 18708
AKDGPYCGSDCFFDS

SEQ ID NO: 37417 - protein, 9 aa, Homo sapiens
  light chain complementarity determining region 3 for antibody 18709
QHYFTSPPT

SEQ ID NO: 37418 - protein, 15 aa, Homo sapiens
  heavy chain complementarity determining region 3 for antibody 18709
VKVLMSGTQIALFDQ

SEQ ID NO: 37419 - protein, 11 aa, Homo sapiens
  light chain complementarity determining region 3 for antibody 18710
QDRHNWPAEYT

SEQ ID NO: 37420 - protein, 15 aa, Homo sapiens
  heavy chain complementarity determining region 3 for antibody 18710
AREGVDRLTISAFDI

SEQ ID NO: 37421 - protein, 9 aa, Homo sapiens
  light chain complementarity determining region 3 for antibody 18711
PYYGASPCT

SEQ ID NO: 37422 - protein, 11 aa, Homo sapiens
  heavy chain complementarity determining region 3 for antibody 18711
ARGEVGYAFDI

SEQ ID NO: 37423 - protein, 9 aa, Homo sapiens
  light chain complementarity determining region 3 for antibody 18712
MQVLQTPLT

SEQ ID NO: 37424 - protein, 12 aa, Homo sapiens
  heavy chain complementarity determining region 3 for antibody 18712
VKDGETNWGSCH

SEQ ID NO: 37425 - protein, 9 aa, Homo sapiens
  light chain complementarity determining region 3 for antibody 18713
MQTTLWPST

SEQ ID NO: 37426 - protein, 15 aa, Homo sapiens
  heavy chain complementarity determining region 3 for antibody 18713
ARGPLRFAGNEGLDY

SEQ ID NO: 37427 - protein, 9 aa, Homo sapiens
  light chain complementarity determining region 3 for antibody 18714
MQSLETPFT

SEQ ID NO: 37428 - protein, 15 aa, Homo sapiens
  heavy chain complementarity determining region 3 for antibody 18714
VRHYRETVAGIEGDS

SEQ ID NO: 37429 - protein, 9 aa, Homo sapiens
  light chain complementarity determining region 3 for antibody 18715
MQGTQWPWT

SEQ ID NO: 37430 - protein, 15 aa, Homo sapiens
  heavy chain complementarity determining region 3 for antibody 18715
VRVPPDLDIVGMIDH

SEQ ID NO: 37431 - protein, 8 aa, Homo sapiens
  light chain complementarity determining region 3 for antibody 18716
MQGTDWRA

SEQ ID NO: 37432 - protein, 10 aa, Homo sapiens
  heavy chain complementarity determining region 3 for antibody 18716
ARDTPGDLDY

SEQ ID NO: 37433 - protein, 10 aa, Homo sapiens
  light chain complementarity determining region 3 for antibody 18717
MQALQTPGYT

SEQ ID NO: 37434 - protein, 15 aa, Homo sapiens
  heavy chain complementarity determining region 3 for antibody 18717
ARQPLEVSHYHGMDV

SEQ ID NO: 37435 - protein, 9 aa, Homo sapiens
  light chain complementarity determining region 3 for antibody 18718
MQALQAPWP

SEQ ID NO: 37436 - protein, 11 aa, Homo sapiens
  heavy chain complementarity determining region 3 for antibody 18718
ARQPDPTTPTP

SEQ ID NO: 37437 - protein, 9 aa, Homo sapiens
  light chain complementarity determining region 3 for antibody 18719
MQALGTPFT

SEQ ID NO: 37438 - protein, 15 aa, Homo sapiens
  heavy chain complementarity determining region 3 for antibody 18719
VRHYRITVAAVEGDS

SEQ ID NO: 37439 - protein, 9 aa, Homo sapiens
  light chain complementarity determining region 3 for antibody 18720
MQALETPST

SEQ ID NO: 37440 - protein, 15 aa, Homo sapiens
  heavy chain complementarity determining region 3 for antibody 18720
VRHYRELATGIEGDS

SEQ ID NO: 37441 - protein, 9 aa, Homo sapiens
  light chain complementarity determining region 3 for antibody 18721
MQALETPFT

SEQ ID NO: 37442 - protein, 15 aa, Homo sapiens
  heavy chain complementarity determining region 3 for antibody 18721
VRQYRELATGIEGDS

SEQ ID NO: 37443 - protein, 9 aa, Homo sapiens
  light chain complementarity determining region 3 for antibody 18722
MQALETPFT

SEQ ID NO: 37444 - protein, 15 aa, Homo sapiens
  heavy chain complementarity determining region 3 for antibody 18722
VRHYRVITAPLEGDS

SEQ ID NO: 37445 - protein, 9 aa, Homo sapiens
  light chain complementarity determining region 3 for antibody 18723
MQALETPFT

SEQ ID NO: 37446 - protein, 15 aa, Homo sapiens
  heavy chain complementarity determining region 3 for antibody 18723
VRHYRIITSPLEGDS

SEQ ID NO: 37447 - protein, 9 aa, Homo sapiens
  light chain complementarity determining region 3 for antibody 18724
MQALETPFT

SEQ ID NO: 37448 - protein, 15 aa, Homo sapiens
  heavy chain complementarity determining region 3 for antibody 18724
VRHYRIITPPLEGDS

SEQ ID NO: 37449 - protein, 9 aa, Homo sapiens
  light chain complementarity determining region 3 for antibody 18725
MQALETPFT

SEQ ID NO: 37450 - protein, 15 aa, Homo sapiens
  heavy chain complementarity determining region 3 for antibody 18725
VRHYRIITGPLEGDS

SEQ ID NO: 37451 - protein, 9 aa, Homo sapiens
  light chain complementarity determining region 3 for antibody 18726
MQALETPFT

SEQ ID NO: 37452 - protein, 15 aa, Homo sapiens
  heavy chain complementarity determining region 3 for antibody 18726
VRHYRETVAGSEGDS

SEQ ID NO: 37453 - protein, 9 aa, Homo sapiens
  light chain complementarity determining region 3 for antibody 18727
MQALETPFT

SEQ ID NO: 37454 - protein, 15 aa, Homo sapiens
  heavy chain complementarity determining region 3 for antibody 18727
VRHYRETVAGIEGGS

SEQ ID NO: 37455 - protein, 9 aa, Homo sapiens
  light chain complementarity determining region 3 for antibody 18728
MQALETPFT

SEQ ID NO: 37456 - protein, 15 aa, Homo sapiens
  heavy chain complementarity determining region 3 for antibody 18728
VRHYRETVAGIEGDA

SEQ ID NO: 37457 - protein, 9 aa, Homo sapiens
  light chain complementarity determining region 3 for antibody 18729
MQALETPFT

SEQ ID NO: 37458 - protein, 15 aa, Homo sapiens
  heavy chain complementarity determining region 3 for antibody 18729
VRHCRIITAPLEGDS

SEQ ID NO: 37459 - protein, 9 aa, Homo sapiens
  light chain complementarity determining region 3 for antibody 18730
MQALETPFT

SEQ ID NO: 37460 - protein, 15 aa, Homo sapiens
  heavy chain complementarity determining region 3 for antibody 18730
GRHYRETVAGIEGDS

SEQ ID NO: 37461 - protein, 9 aa, Homo sapiens
  light chain complementarity determining region 3 for antibody 18731
MQALETPFP

SEQ ID NO: 37462 - protein, 15 aa, Homo sapiens
  heavy chain complementarity determining region 3 for antibody 18731
VRHYRELATGIEGDS

SEQ ID NO: 37463 - protein, 9 aa, Homo sapiens
  light chain complementarity determining region 3 for antibody 18732
MQALETPCT

SEQ ID NO: 37464 - protein, 15 aa, Homo sapiens
  heavy chain complementarity determining region 3 for antibody 18732
VRHYRIITAPLEGDS

SEQ ID NO: 37465 - protein, 9 aa, Homo sapiens
  light chain complementarity determining region 3 for antibody 18733
MQALETHFT

SEQ ID NO: 37466 - protein, 15 aa, Homo sapiens
  heavy chain complementarity determining region 3 for antibody 18733
VRHYRIITAPLEGDS

SEQ ID NO: 37467 - protein, 9 aa, Homo sapiens
  light chain complementarity determining region 3 for antibody 18734
MQALEIPFT

SEQ ID NO: 37468 - protein, 15 aa, Homo sapiens
  heavy chain complementarity determining region 3 for antibody 18734
VRHYRELATGIEGDS

SEQ ID NO: 37469 - protein, 9 aa, Homo sapiens
  light chain complementarity determining region 3 for antibody 18735
MLALETPFT

SEQ ID NO: 37470 - protein, 15 aa, Homo sapiens
  heavy chain complementarity determining region 3 for antibody 18735
VRHYRETVAGIEGDS

SEQ ID NO: 37471 - protein, 9 aa, Homo sapiens
  light chain complementarity determining region 3 for antibody 18736
MGTLQTPPT

SEQ ID NO: 37472 - protein, 15 aa, Homo sapiens
  heavy chain complementarity determining region 3 for antibody 18736
TRDGKKDGHNDAFDV

SEQ ID NO: 37473 - protein, 9 aa, Homo sapiens
  light chain complementarity determining region 3 for antibody 18737
MGNLQTPPT

SEQ ID NO: 37474 - protein, 15 aa, Homo sapiens
  heavy chain complementarity determining region 3 for antibody 18737
TRDGKKDGHNDAFDI

SEQ ID NO: 37475 - protein, 9 aa, Homo sapiens
  light chain complementarity determining region 3 for antibody 18738
LQYGFAQDS

SEQ ID NO: 37476 - protein, 18 aa, Homo sapiens
  heavy chain complementarity determining region 3 for antibody 18738
TGVHGLTMLRGATKPFDF

SEQ ID NO: 37477 - protein, 8 aa, Homo sapiens
  light chain complementarity determining region 3 for antibody 18739
LQRSAGYT

SEQ ID NO: 37478 - protein, 13 aa, Homo sapiens
  heavy chain complementarity determining region 3 for antibody 18739
ATNSGSYPNYLDP

SEQ ID NO: 37479 - protein, 9 aa, Homo sapiens
  light chain complementarity determining region 3 for antibody 18740
LQNGYWPRT

SEQ ID NO: 37480 - protein, 11 aa, Homo sapiens
  heavy chain complementarity determining region 3 for antibody 18740
VRVGGAGYFDH

SEQ ID NO: 37481 - protein, 9 aa, Homo sapiens
  light chain complementarity determining region 3 for antibody 18741
LQNEYWPRT

SEQ ID NO: 37482 - protein, 11 aa, Homo sapiens
  heavy chain complementarity determining region 3 for antibody 18741
VRVGGAGYFDP

SEQ ID NO: 37483 - protein, 9 aa, Homo sapiens
  light chain complementarity determining region 3 for antibody 18742
LQNEYWPRT

SEQ ID NO: 37484 - protein, 11 aa, Homo sapiens
  heavy chain complementarity determining region 3 for antibody 18742
VRVGGAGCFDH

SEQ ID NO: 37485 - protein, 9 aa, Homo sapiens
  light chain complementarity determining region 3 for antibody 18743
LQNEYLPRT

SEQ ID NO: 37486 - protein, 11 aa, Homo sapiens
  heavy chain complementarity determining region 3 for antibody 18743
VRVGGAGYFDH

SEQ ID NO: 37487 - protein, 9 aa, Homo sapiens
  light chain complementarity determining region 3 for antibody 18744
LQHNSSPLT

SEQ ID NO: 37488 - protein, 13 aa, Homo sapiens
  heavy chain complementarity determining region 3 for antibody 18744
VRHAVVRPMVVDD

SEQ ID NO: 37489 - protein, 9 aa, Homo sapiens
  light chain complementarity determining region 3 for antibody 18745
LQHNRYPLT

SEQ ID NO: 37490 - protein, 13 aa, Homo sapiens
  heavy chain complementarity determining region 3 for antibody 18745
VRHAVVRPMVVDD

SEQ ID NO: 37491 - protein, 9 aa, Homo sapiens
  light chain complementarity determining region 3 for antibody 18746
LQHDNFPYS

SEQ ID NO: 37492 - protein, 12 aa, Homo sapiens
  heavy chain complementarity determining region 3 for antibody 18746
AREWGSGWYPAS

SEQ ID NO: 37493 - protein, 9 aa, Homo sapiens
  light chain complementarity determining region 3 for antibody 18747
LQHDNFPYS

SEQ ID NO: 37494 - protein, 12 aa, Homo sapiens
  heavy chain complementarity determining region 3 for antibody 18747
AREWESGWYPAS

SEQ ID NO: 37495 - protein, 9 aa, Homo sapiens
  light chain complementarity determining region 3 for antibody 18748
LQHDNFPSS

SEQ ID NO: 37496 - protein, 12 aa, Homo sapiens
  heavy chain complementarity determining region 3 for antibody 18748
AREWDSGWYPAS

SEQ ID NO: 37497 - protein, 9 aa, Homo sapiens
  light chain complementarity determining region 3 for antibody 18749
LQGNRFPHT

SEQ ID NO: 37498 - protein, 14 aa, Homo sapiens
  heavy chain complementarity determining region 3 for antibody 18749
ARYCSGNSCYSMAH

SEQ ID NO: 37499 - protein, 9 aa, Homo sapiens
  light chain complementarity determining region 3 for antibody 18750
LQDGGTPLT

SEQ ID NO: 37500 - protein, 8 aa, Homo sapiens
  heavy chain complementarity determining region 3 for antibody 18750
VRIMDPGY

SEQ ID NO: 37501 - protein, 9 aa, Homo sapiens
  light chain complementarity determining region 3 for antibody 18751
LQCNRFPHT

SEQ ID NO: 37502 - protein, 14 aa, Homo sapiens
  heavy chain complementarity determining region 3 for antibody 18751
ARYCSGNSCYSMDH

SEQ ID NO: 37503 - protein, 9 aa, Homo sapiens
  light chain complementarity determining region 3 for antibody 18752
LQASYWPRT

SEQ ID NO: 37504 - protein, 9 aa, Homo sapiens
  heavy chain complementarity determining region 3 for antibody 18752
VAGHLPFDH

SEQ ID NO: 37505 - protein, 9 aa, Homo sapiens
  light chain complementarity determining region 3 for antibody 18753
LQASYWPRR

SEQ ID NO: 37506 - protein, 9 aa, Homo sapiens
  heavy chain complementarity determining region 3 for antibody 18753
VAGHLTFDH

SEQ ID NO: 37507 - protein, 9 aa, Homo sapiens
  light chain complementarity determining region 3 for antibody 18754
LQASYWPGT

SEQ ID NO: 37508 - protein, 9 aa, Homo sapiens
  heavy chain complementarity determining region 3 for antibody 18754
VAGHLTFDH

SEQ ID NO: 37509 - protein, 9 aa, Homo sapiens
  light chain complementarity determining region 3 for antibody 18755
LQASYGPRT

SEQ ID NO: 37510 - protein, 9 aa, Homo sapiens
  heavy chain complementarity determining region 3 for antibody 18755
VAGHLTFDH

SEQ ID NO: 37511 - protein, 9 aa, Homo sapiens
  light chain complementarity determining region 3 for antibody 18756
LHDYNYPRT

SEQ ID NO: 37512 - protein, 18 aa, Homo sapiens
  heavy chain complementarity determining region 3 for antibody 18756
VRDDEVVEEGVVFDRYDS

SEQ ID NO: 37513 - protein, 9 aa, Homo sapiens
  light chain complementarity determining region 3 for antibody 18757
IQALETPFT

SEQ ID NO: 37514 - protein, 15 aa, Homo sapiens
  heavy chain complementarity determining region 3 for antibody 18757
VRHYRIITAPLEGDS

SEQ ID NO: 37515 - protein, 10 aa, Homo sapiens
  light chain complementarity determining region 3 for antibody 18758
HQYYRSPPHT

SEQ ID NO: 37516 - protein, 9 aa, Homo sapiens
  heavy chain complementarity determining region 3 for antibody 18758
AVYSGGWWG

SEQ ID NO: 37517 - protein, 10 aa, Homo sapiens
  light chain complementarity determining region 3 for antibody 18759
HQYYPSLPET

SEQ ID NO: 37518 - protein, 11 aa, Homo sapiens
  heavy chain complementarity determining region 3 for antibody 18759
VLRSKNSAYDS

SEQ ID NO: 37519 - protein, 9 aa, Homo sapiens
  light chain complementarity determining region 3 for antibody 18760
HQYSSSPYN

SEQ ID NO: 37520 - protein, 13 aa, Homo sapiens
  heavy chain complementarity determining region 3 for antibody 18760
ARGTYSAFAIFGV

SEQ ID NO: 37521 - protein, 11 aa, Homo sapiens
  light chain complementarity determining region 3 for antibody 18761
HQYNNWPPRGS

SEQ ID NO: 37522 - protein, 13 aa, Homo sapiens
  heavy chain complementarity determining region 3 for antibody 18761
AKDRLGIIDAFDI

SEQ ID NO: 37523 - protein, 9 aa, Homo sapiens
  light chain complementarity determining region 3 for antibody 18762
HQYATLPGT

SEQ ID NO: 37524 - protein, 13 aa, Homo sapiens
  heavy chain complementarity determining region 3 for antibody 18762
VRRGYGDFVREDF

SEQ ID NO: 37525 - protein, 9 aa, Homo sapiens
  light chain complementarity determining region 3 for antibody 18763
HQTYTFPRT

SEQ ID NO: 37526 - protein, 20 aa, Homo sapiens
  heavy chain complementarity determining region 3 for antibody 18763
ARGRRIAALSTAHYYYGMDV

SEQ ID NO: 37527 - protein, 9 aa, Homo sapiens
  light chain complementarity determining region 3 for antibody 18764
HQTSTFPRT

SEQ ID NO: 37528 - protein, 20 aa, Homo sapiens
  heavy chain complementarity determining region 3 for antibody 18764
ARGRRIAALSTAHYYYGMDV

SEQ ID NO: 37529 - protein, 9 aa, Homo sapiens
  light chain complementarity determining region 3 for antibody 18765
HQSSSFPLT

SEQ ID NO: 37530 - protein, 15 aa, Homo sapiens
  heavy chain complementarity determining region 3 for antibody 18765
AKSGGGGSYRLPVDY

SEQ ID NO: 37531 - protein, 9 aa, Homo sapiens
  light chain complementarity determining region 3 for antibody 18766
HQSGALPWT

SEQ ID NO: 37532 - protein, 14 aa, Homo sapiens
  heavy chain complementarity determining region 3 for antibody 18766
VRDASGNSGLYADS

SEQ ID NO: 37533 - protein, 9 aa, Homo sapiens
  light chain complementarity determining region 3 for antibody 18767
HQRGVLPWT

SEQ ID NO: 37534 - protein, 14 aa, Homo sapiens
  heavy chain complementarity determining region 3 for antibody 18767
VRDASGNSGWYAAS

SEQ ID NO: 37535 - protein, 9 aa, Homo sapiens
  light chain complementarity determining region 3 for antibody 18768
HHTYTFPWT

SEQ ID NO: 37536 - protein, 20 aa, Homo sapiens
  heavy chain complementarity determining region 3 for antibody 18768
ARGRRIAALSTAHYYYGMDV

SEQ ID NO: 37537 - protein, 9 aa, Homo sapiens
  light chain complementarity determining region 3 for antibody 18769
HHTYTFPRT

SEQ ID NO: 37538 - protein, 20 aa, Homo sapiens
  heavy chain complementarity determining region 3 for antibody 18769
ARGRRIAALSTAHYYDGMDV

SEQ ID NO: 37539 - protein, 9 aa, Homo sapiens
  light chain complementarity determining region 3 for antibody 18770
TQALETPFT

SEQ ID NO: 37540 - protein, 15 aa, Homo sapiens
  heavy chain complementarity determining region 3 for antibody 18770
VRHYRIITAPLEGDS

SEQ ID NO: 37541 - protein, 9 aa, Homo sapiens
  light chain complementarity determining region 3 for antibody 18771
RQYGSSPRT

SEQ ID NO: 37542 - protein, 25 aa, Homo sapiens
  heavy chain complementarity determining region 3 for antibody 18771
ARLRIDRLRLPGAMRGPLYDCGLNV

SEQ ID NO: 37543 - protein, 10 aa, Homo sapiens
  light chain complementarity determining region 3 for antibody 18772
RQYDNWPPWT

SEQ ID NO: 37544 - protein, 12 aa, Homo sapiens
  heavy chain complementarity determining region 3 for antibody 18772
AKTLRERKELDY

SEQ ID NO: 37545 - protein, 10 aa, Homo sapiens
  light chain complementarity determining region 3 for antibody 18773
RQRYNWPPFT

SEQ ID NO: 37546 - protein, 11 aa, Homo sapiens
  heavy chain complementarity determining region 3 for antibody 18773
ARGVGSYPFDS

SEQ ID NO: 37547 - protein, 9 aa, Homo sapiens
  light chain complementarity determining region 3 for antibody 18774
RQALETPLT

SEQ ID NO: 37548 - protein, 15 aa, Homo sapiens
  heavy chain complementarity determining region 3 for antibody 18774
VRHYRIITAPLEGDS

SEQ ID NO: 37549 - protein, 9 aa, Homo sapiens
  light chain complementarity determining region 3 for antibody 18775
RQALETPFT

SEQ ID NO: 37550 - protein, 15 aa, Homo sapiens
  heavy chain complementarity determining region 3 for antibody 18775
VRHYRLTVAGIEGDS

SEQ ID NO: 37551 - protein, 9 aa, Homo sapiens
  light chain complementarity determining region 3 for antibody 18776
RQALETPFT

SEQ ID NO: 37552 - protein, 15 aa, Homo sapiens
  heavy chain complementarity determining region 3 for antibody 18776
VRHYRITVAAVEGDS

SEQ ID NO: 37553 - protein, 9 aa, Homo sapiens
  light chain complementarity determining region 3 for antibody 18777
RQALETPFP

SEQ ID NO: 37554 - protein, 15 aa, Homo sapiens
  heavy chain complementarity determining region 3 for antibody 18777
VRHYRETVAGIEGDS

SEQ ID NO: 37555 - protein, 9 aa, Homo sapiens
  light chain complementarity determining region 3 for antibody 18778
QYYGRSPWT

SEQ ID NO: 37556 - protein, 17 aa, Homo sapiens
  heavy chain complementarity determining region 3 for antibody 18778
ARTVLYHFTAGRAAFDV

SEQ ID NO: 37557 - protein, 8 aa, Homo sapiens
  light chain complementarity determining region 3 for antibody 18779
QRNGSSPL

SEQ ID NO: 37558 - protein, 15 aa, Homo sapiens
  heavy chain complementarity determining region 3 for antibody 18779
ARDRASIGYYYLFDY

SEQ ID NO: 37559 - protein, 9 aa, Homo sapiens
  light chain complementarity determining region 3 for antibody 18780
QQYYTYPLT

SEQ ID NO: 37560 - protein, 15 aa, Homo sapiens
  heavy chain complementarity determining region 3 for antibody 18780
AHGVWVRGVPSRFDY

SEQ ID NO: 37561 - protein, 9 aa, Homo sapiens
  light chain complementarity determining region 3 for antibody 18781
QQYYTTLRT

SEQ ID NO: 37562 - protein, 8 aa, Homo sapiens
  heavy chain complementarity determining region 3 for antibody 18781
ARDGAFDS

SEQ ID NO: 37563 - protein, 9 aa, Homo sapiens
  light chain complementarity determining region 3 for antibody 18782
QQYYTSPLT

SEQ ID NO: 37564 - protein, 20 aa, Homo sapiens
  heavy chain complementarity determining region 3 for antibody 18782
ARDPAYYYGSGSSGVDWFDP

SEQ ID NO: 37565 - protein, 9 aa, Homo sapiens
  light chain complementarity determining region 3 for antibody 18783
QQYYTSFRT

SEQ ID NO: 37566 - protein, 12 aa, Homo sapiens
  heavy chain complementarity determining region 3 for antibody 18783
VKDCGLGGSRDF

SEQ ID NO: 37567 - protein, 9 aa, Homo sapiens
  light chain complementarity determining region 3 for antibody 18784
QQYYTNPRT

SEQ ID NO: 37568 - protein, 8 aa, Homo sapiens
  heavy chain complementarity determining region 3 for antibody 18784
ARDGAFDS

SEQ ID NO: 37569 - protein, 8 aa, Homo sapiens
  light chain complementarity determining region 3 for antibody 18785
QQYYSYRT

SEQ ID NO: 37570 - protein, 14 aa, Homo sapiens
  heavy chain complementarity determining region 3 for antibody 18785
VTDQDVYWSGYFRP

SEQ ID NO: 37571 - protein, 9 aa, Homo sapiens
  light chain complementarity determining region 3 for antibody 18786
QQYYSTPLT

SEQ ID NO: 37572 - protein, 20 aa, Homo sapiens
  heavy chain complementarity determining region 3 for antibody 18786
ARDQAYYYGSGSSGVDWFDP

SEQ ID NO: 37573 - protein, 8 aa, Homo sapiens
  light chain complementarity determining region 3 for antibody 18787
QQYYSTLT

SEQ ID NO: 37574 - protein, 15 aa, Homo sapiens
  heavy chain complementarity determining region 3 for antibody 18787
ANGTLRLGATHYFDY

SEQ ID NO: 37575 - protein, 9 aa, Homo sapiens
  light chain complementarity determining region 3 for antibody 18788
QQYYSSPWT

SEQ ID NO: 37576 - protein, 15 aa, Homo sapiens
  heavy chain complementarity determining region 3 for antibody 18788
ARHRTEMATITYFDY

SEQ ID NO: 37577 - protein, 9 aa, Homo sapiens
  light chain complementarity determining region 3 for antibody 18789
QQYYSNPGL

SEQ ID NO: 37578 - protein, 16 aa, Homo sapiens
  heavy chain complementarity determining region 3 for antibody 18789
ARSSGGYSSSWYYFDY

SEQ ID NO: 37579 - protein, 9 aa, Homo sapiens
  light chain complementarity determining region 3 for antibody 18790
QQYYNAPGT

SEQ ID NO: 37580 - protein, 12 aa, Homo sapiens
  heavy chain complementarity determining region 3 for antibody 18790
ARLFHRGNFFDH

SEQ ID NO: 37581 - protein, 10 aa, Homo sapiens
  light chain complementarity determining region 3 for antibody 18791
QQYVTSLKRT

SEQ ID NO: 37582 - protein, 15 aa, Homo sapiens
  heavy chain complementarity determining region 3 for antibody 18791
GRLLSPYSHRTPFDP

SEQ ID NO: 37583 - protein, 9 aa, Homo sapiens
  light chain complementarity determining region 3 for antibody 18792
QQYTNWPLP

SEQ ID NO: 37584 - protein, 16 aa, Homo sapiens
  heavy chain complementarity determining region 3 for antibody 18792
TRYCSSSNCALYGMDV

SEQ ID NO: 37585 - protein, 10 aa, Homo sapiens
  light chain complementarity determining region 3 for antibody 18793
QQYSSTPMFT

SEQ ID NO: 37586 - protein, 16 aa, Homo sapiens
  heavy chain complementarity determining region 3 for antibody 18793
ASPFSIDGLAVRAFDI

SEQ ID NO: 37587 - protein, 10 aa, Homo sapiens
  light chain complementarity determining region 3 for antibody 18794
QQYSDYSGGT

SEQ ID NO: 37588 - protein, 17 aa, Homo sapiens
  heavy chain complementarity determining region 3 for antibody 18794
GFSPSMIRGLIPGAFHF

SEQ ID NO: 37589 - protein, 9 aa, Homo sapiens
  light chain complementarity determining region 3 for antibody 18795
QQYRRSPSP

SEQ ID NO: 37590 - protein, 17 aa, Homo sapiens
  heavy chain complementarity determining region 3 for antibody 18795
AGLSSRLGDGSPSLFDY

SEQ ID NO: 37591 - protein, 9 aa, Homo sapiens
  light chain complementarity determining region 3 for antibody 18796
QQYRRSPRT

SEQ ID NO: 37592 - protein, 17 aa, Homo sapiens
  heavy chain complementarity determining region 3 for antibody 18796
AGLSSRLGDGSPSLFDY

SEQ ID NO: 37593 - protein, 9 aa, Homo sapiens
  light chain complementarity determining region 3 for antibody 18797
QQYNTWPRT

SEQ ID NO: 37594 - protein, 22 aa, Homo sapiens
  heavy chain complementarity determining region 3 for antibody 18797
AREVRASGYDGFYNYYYYGLDV

SEQ ID NO: 37595 - protein, 9 aa, Homo sapiens
  light chain complementarity determining region 3 for antibody 18798
QQYNTWPRT

SEQ ID NO: 37596 - protein, 22 aa, Homo sapiens
  heavy chain complementarity determining region 3 for antibody 18798
AREVRASGYDDCYNYYYYGLDV

SEQ ID NO: 37597 - protein, 9 aa, Homo sapiens
  light chain complementarity determining region 3 for antibody 18799
QQYNTWPRT

SEQ ID NO: 37598 - protein, 22 aa, Homo sapiens
  heavy chain complementarity determining region 3 for antibody 18799
AREVRARGYDDFYNYYYYGLDV

SEQ ID NO: 37599 - protein, 9 aa, Homo sapiens
  light chain complementarity determining region 3 for antibody 18800
QQYNSYLYT

SEQ ID NO: 37600 - protein, 16 aa, Homo sapiens
  heavy chain complementarity determining region 3 for antibody 18800
AREGESRGWYGGSMDV

SEQ ID NO: 37601 - protein, 10 aa, Homo sapiens
  light chain complementarity determining region 3 for antibody 18801
QQYNQWPPLT

SEQ ID NO: 37602 - protein, 17 aa, Homo sapiens
  heavy chain complementarity determining region 3 for antibody 18801
ARDLYFSMIQGGGAFDA

SEQ ID NO: 37603 - protein, 10 aa, Homo sapiens
  light chain complementarity determining region 3 for antibody 18802
QQYNQWPPIT

SEQ ID NO: 37604 - protein, 17 aa, Homo sapiens
  heavy chain complementarity determining region 3 for antibody 18802
ARDLYFSIIQGGGAFDA

SEQ ID NO: 37605 - protein, 10 aa, Homo sapiens
  light chain complementarity determining region 3 for antibody 18803
QQYNQGPPLT

SEQ ID NO: 37606 - protein, 17 aa, Homo sapiens
  heavy chain complementarity determining region 3 for antibody 18803
ARDLYFSIIQGGGAFDA

SEQ ID NO: 37607 - protein, 10 aa, Homo sapiens
  light chain complementarity determining region 3 for antibody 18804
QQYNNWPPVP

SEQ ID NO: 37608 - protein, 16 aa, Homo sapiens
  heavy chain complementarity determining region 3 for antibody 18804
TSERSTTWYVVEPFDI

SEQ ID NO: 37609 - protein, 10 aa, Homo sapiens
  light chain complementarity determining region 3 for antibody 18805
QQYNNWPPGT

SEQ ID NO: 37610 - protein, 16 aa, Homo sapiens
  heavy chain complementarity determining region 3 for antibody 18805
TSERSTTWYVVEPFDI

SEQ ID NO: 37611 - protein, 10 aa, Homo sapiens
  light chain complementarity determining region 3 for antibody 18806
QQYNNWLPVT

SEQ ID NO: 37612 - protein, 16 aa, Homo sapiens
  heavy chain complementarity determining region 3 for antibody 18806
TSERSTTWYVVEPFDI

SEQ ID NO: 37613 - protein, 10 aa, Homo sapiens
  light chain complementarity determining region 3 for antibody 18807
QQYNNWLGWT

SEQ ID NO: 37614 - protein, 13 aa, Homo sapiens
  heavy chain complementarity determining region 3 for antibody 18807
ARHGRRSGWYFTY

SEQ ID NO: 37615 - protein, 12 aa, Homo sapiens
  light chain complementarity determining region 3 for antibody 18808
QQYNKWPPEKLT

SEQ ID NO: 37616 - protein, 11 aa, Homo sapiens
  heavy chain complementarity determining region 3 for antibody 18808
ATFYEHYGMDV

SEQ ID NO: 37617 - protein, 9 aa, Homo sapiens
  light chain complementarity determining region 3 for antibody 18809
QQYKSWPRT

SEQ ID NO: 37618 - protein, 15 aa, Homo sapiens
  heavy chain complementarity determining region 3 for antibody 18809
ARWGSIYGGNSPIDH

SEQ ID NO: 37619 - protein, 10 aa, Homo sapiens
  light chain complementarity determining region 3 for antibody 18810
QQYHSYSPAT

SEQ ID NO: 37620 - protein, 19 aa, Homo sapiens
  heavy chain complementarity determining region 3 for antibody 18810
ARESEYYCDKSGYLRPFDF

SEQ ID NO: 37621 - protein, 9 aa, Homo sapiens
  light chain complementarity determining region 3 for antibody 18811
QQYHSTPLP

SEQ ID NO: 37622 - protein, 20 aa, Homo sapiens
  heavy chain complementarity determining region 3 for antibody 18811
ARARSKTTVVTPTRQFASDI

SEQ ID NO: 37623 - protein, 9 aa, Homo sapiens
  light chain complementarity determining region 3 for antibody 18812
QQYHGLPLT

SEQ ID NO: 37624 - protein, 13 aa, Homo sapiens
  heavy chain complementarity determining region 3 for antibody 18812
ARDGVPGKCNRAL

SEQ ID NO: 37625 - protein, 9 aa, Homo sapiens
  light chain complementarity determining region 3 for antibody 18813
QQYGVLPWT

SEQ ID NO: 37626 - protein, 14 aa, Homo sapiens
  heavy chain complementarity determining region 3 for antibody 18813
AHRRNWYDNSGLED

SEQ ID NO: 37627 - protein, 9 aa, Homo sapiens
  light chain complementarity determining region 3 for antibody 18814
QQYGTSPYP

SEQ ID NO: 37628 - protein, 20 aa, Homo sapiens
  heavy chain complementarity determining region 3 for antibody 18814
ARGGQKGYFDWLFELDGMDV

SEQ ID NO: 37629 - protein, 9 aa, Homo sapiens
  light chain complementarity determining region 3 for antibody 18815
QQYGTSPST

SEQ ID NO: 37630 - protein, 13 aa, Homo sapiens
  heavy chain complementarity determining region 3 for antibody 18815
PIGFYDRSGYHEY

SEQ ID NO: 37631 - protein, 9 aa, Homo sapiens
  light chain complementarity determining region 3 for antibody 18816
QQYGTSPST

SEQ ID NO: 37632 - protein, 20 aa, Homo sapiens
  heavy chain complementarity determining region 3 for antibody 18816
ARGGQKGYFDWLFELDGMDV

SEQ ID NO: 37633 - protein, 9 aa, Homo sapiens
  light chain complementarity determining region 3 for antibody 18817
QQYGTSPRT

SEQ ID NO: 37634 - protein, 13 aa, Homo sapiens
  heavy chain complementarity determining region 3 for antibody 18817
AGGRGSGTYYKEH

SEQ ID NO: 37635 - protein, 9 aa, Homo sapiens
  light chain complementarity determining region 3 for antibody 18818
QQYGTSPFT

SEQ ID NO: 37636 - protein, 15 aa, Homo sapiens
  heavy chain complementarity determining region 3 for antibody 18818
ASQNDFLSGPGEFDP

SEQ ID NO: 37637 - protein, 9 aa, Homo sapiens
  light chain complementarity determining region 3 for antibody 18819
QQYGTSPFT

SEQ ID NO: 37638 - protein, 15 aa, Homo sapiens
  heavy chain complementarity determining region 3 for antibody 18819
ARQTDFLSGPGEFDP

SEQ ID NO: 37639 - protein, 8 aa, Homo sapiens
  light chain complementarity determining region 3 for antibody 18820
QQYGTSLP

SEQ ID NO: 37640 - protein, 14 aa, Homo sapiens
  heavy chain complementarity determining region 3 for antibody 18820
ARAGSYYADWYFDL

SEQ ID NO: 37641 - protein, 10 aa, Homo sapiens
  light chain complementarity determining region 3 for antibody 18821
QQYGTSLKWT

SEQ ID NO: 37642 - protein, 15 aa, Homo sapiens
  heavy chain complementarity determining region 3 for antibody 18821
GRLLSPYSHRTPFDP

SEQ ID NO: 37643 - protein, 9 aa, Homo sapiens
  light chain complementarity determining region 3 for antibody 18822
QQYGTPPRT

SEQ ID NO: 37644 - protein, 13 aa, Homo sapiens
  heavy chain complementarity determining region 3 for antibody 18822
PIGFYDRSGYHEY

SEQ ID NO: 37645 - protein, 9 aa, Homo sapiens
  light chain complementarity determining region 3 for antibody 18823
QQYGTPPRT

SEQ ID NO: 37646 - protein, 25 aa, Homo sapiens
  heavy chain complementarity determining region 3 for antibody 18823
ARLRVGRLRLPGAMRGPLYDRGLNV

SEQ ID NO: 37647 - protein, 9 aa, Homo sapiens
  light chain complementarity determining region 3 for antibody 18824
QQYGTPPRT

SEQ ID NO: 37648 - protein, 25 aa, Homo sapiens
  heavy chain complementarity determining region 3 for antibody 18824
ARLRGDRLRLPGAMRGPLYDRGLNV

SEQ ID NO: 37649 - protein, 9 aa, Homo sapiens
  light chain complementarity determining region 3 for antibody 18825
QQYGTLPRT

SEQ ID NO: 37650 - protein, 13 aa, Homo sapiens
  heavy chain complementarity determining region 3 for antibody 18825
AGGSFSGRNYKED

SEQ ID NO: 37651 - protein, 9 aa, Homo sapiens
  light chain complementarity determining region 3 for antibody 18826
QQYGTLPRT

SEQ ID NO: 37652 - protein, 14 aa, Homo sapiens
  heavy chain complementarity determining region 3 for antibody 18826
AGGEFCGGDCYSEY

SEQ ID NO: 37653 - protein, 8 aa, Homo sapiens
  light chain complementarity determining region 3 for antibody 18827
QQYGSSWK

SEQ ID NO: 37654 - protein, 12 aa, Homo sapiens
  heavy chain complementarity determining region 3 for antibody 18827
ARLAVAVGAFDI

SEQ ID NO: 37655 - protein, 9 aa, Homo sapiens
  light chain complementarity determining region 3 for antibody 18828
QQYGSSSIT

SEQ ID NO: 37656 - protein, 13 aa, Homo sapiens
  heavy chain complementarity determining region 3 for antibody 18828
VKNFFMAFDAFHI

SEQ ID NO: 37657 - protein, 9 aa, Homo sapiens
  light chain complementarity determining region 3 for antibody 18829
QQYGSSRWT

SEQ ID NO: 37658 - protein, 17 aa, Homo sapiens
  heavy chain complementarity determining region 3 for antibody 18829
AREKGWSYRHYYYGMDV

SEQ ID NO: 37659 - protein, 9 aa, Homo sapiens
  light chain complementarity determining region 3 for antibody 18830
QQYGSSRVT

SEQ ID NO: 37660 - protein, 17 aa, Homo sapiens
  heavy chain complementarity determining region 3 for antibody 18830
ANPPLPWVGELSSAFDM

SEQ ID NO: 37661 - protein, 9 aa, Homo sapiens
  light chain complementarity determining region 3 for antibody 18831
QQYGSSRVP

SEQ ID NO: 37662 - protein, 17 aa, Homo sapiens
  heavy chain complementarity determining region 3 for antibody 18831
AKPPLPWVGELSSAFDM

SEQ ID NO: 37663 - protein, 9 aa, Homo sapiens
  light chain complementarity determining region 3 for antibody 18832
QQYGSSPRT

SEQ ID NO: 37664 - protein, 17 aa, Homo sapiens
  heavy chain complementarity determining region 3 for antibody 18832
TTDPQWLEPPPFRTNDY

SEQ ID NO: 37665 - protein, 9 aa, Homo sapiens
  light chain complementarity determining region 3 for antibody 18833
QQYGSSPRT

SEQ ID NO: 37666 - protein, 17 aa, Homo sapiens
  heavy chain complementarity determining region 3 for antibody 18833
TTDPQWLEPPPFLSNDY

SEQ ID NO: 37667 - protein, 9 aa, Homo sapiens
  light chain complementarity determining region 3 for antibody 18834
QQYGSSPRT

SEQ ID NO: 37668 - protein, 17 aa, Homo sapiens
  heavy chain complementarity determining region 3 for antibody 18834
TTDPQWLEPPPFLANDY

SEQ ID NO: 37669 - protein, 9 aa, Homo sapiens
  light chain complementarity determining region 3 for antibody 18835
QQYGSSPRT

SEQ ID NO: 37670 - protein, 17 aa, Homo sapiens
  heavy chain complementarity determining region 3 for antibody 18835
TTDPQWLDPPPFLTNDY

SEQ ID NO: 37671 - protein, 9 aa, Homo sapiens
  light chain complementarity determining region 3 for antibody 18836
QQYGSSPRT

SEQ ID NO: 37672 - protein, 25 aa, Homo sapiens
  heavy chain complementarity determining region 3 for antibody 18836
ARLSIDRLRLPGAMRGPLYDCGLNV

SEQ ID NO: 37673 - protein, 9 aa, Homo sapiens
  light chain complementarity determining region 3 for antibody 18837
QQYGSSPRT

SEQ ID NO: 37674 - protein, 25 aa, Homo sapiens
  heavy chain complementarity determining region 3 for antibody 18837
ARLRIDRLRRPGAMRGPLYDCGLNV

SEQ ID NO: 37675 - protein, 9 aa, Homo sapiens
  light chain complementarity determining region 3 for antibody 18838
QQYGSSPRT

SEQ ID NO: 37676 - protein, 14 aa, Homo sapiens
  heavy chain complementarity determining region 3 for antibody 18838
AKGLMYPYDSALDL

SEQ ID NO: 37677 - protein, 9 aa, Homo sapiens
  light chain complementarity determining region 3 for antibody 18839
QQYGSSPRT

SEQ ID NO: 37678 - protein, 14 aa, Homo sapiens
  heavy chain complementarity determining region 3 for antibody 18839
AGGRLSSGSSYSEN

SEQ ID NO: 37679 - protein, 9 aa, Homo sapiens
  light chain complementarity determining region 3 for antibody 18840
QQYGSSPRP

SEQ ID NO: 37680 - protein, 18 aa, Homo sapiens
  heavy chain complementarity determining region 3 for antibody 18840
ATAFWVGLGVPPPGFFEY

SEQ ID NO: 37681 - protein, 10 aa, Homo sapiens
  light chain complementarity determining region 3 for antibody 18841
QQYGSSPPVT

SEQ ID NO: 37682 - protein, 15 aa, Homo sapiens
  heavy chain complementarity determining region 3 for antibody 18841
AKGPRVRGVLGPFDY

SEQ ID NO: 37683 - protein, 9 aa, Homo sapiens
  light chain complementarity determining region 3 for antibody 18842
QQYGSSPLT

SEQ ID NO: 37684 - protein, 25 aa, Homo sapiens
  heavy chain complementarity determining region 3 for antibody 18842
ARLRIDRLRLPGAMRGPLYDCGLNV

SEQ ID NO: 37685 - protein, 9 aa, Homo sapiens
  light chain complementarity determining region 3 for antibody 18843
QQYGSSPLT

SEQ ID NO: 37686 - protein, 19 aa, Homo sapiens
  heavy chain complementarity determining region 3 for antibody 18843
ARGSSASRRRAAVVGYFDL

SEQ ID NO: 37687 - protein, 9 aa, Homo sapiens
  light chain complementarity determining region 3 for antibody 18844
QQYGSSPLP

SEQ ID NO: 37688 - protein, 20 aa, Homo sapiens
  heavy chain complementarity determining region 3 for antibody 18844
ARGDFLITSYSGTRKDALDI

SEQ ID NO: 37689 - protein, 9 aa, Homo sapiens
  light chain complementarity determining region 3 for antibody 18845
QQYGSPPRT

SEQ ID NO: 37690 - protein, 25 aa, Homo sapiens
  heavy chain complementarity determining region 3 for antibody 18845
ARLRVDRLRLPGAMRGPLYDRGLNV

SEQ ID NO: 37691 - protein, 9 aa, Homo sapiens
  light chain complementarity determining region 3 for antibody 18846
QQYGSLPRT

SEQ ID NO: 37692 - protein, 14 aa, Homo sapiens
  heavy chain complementarity determining region 3 for antibody 18846
AGGEYCGGNCYSEY

SEQ ID NO: 37693 - protein, 9 aa, Homo sapiens
  light chain complementarity determining region 3 for antibody 18847
QQYGSLPHT

SEQ ID NO: 37694 - protein, 14 aa, Homo sapiens
  heavy chain complementarity determining region 3 for antibody 18847
ARGGGSDWYGLLDY

SEQ ID NO: 37695 - protein, 9 aa, Homo sapiens
  light chain complementarity determining region 3 for antibody 18848
QQYGSIPRT

SEQ ID NO: 37696 - protein, 13 aa, Homo sapiens
  heavy chain complementarity determining region 3 for antibody 18848
AGGSLSGGNYKED

SEQ ID NO: 37697 - protein, 9 aa, Homo sapiens
  light chain complementarity determining region 3 for antibody 18849
QQYGSIPRT

SEQ ID NO: 37698 - protein, 14 aa, Homo sapiens
  heavy chain complementarity determining region 3 for antibody 18849
AGGEYCGGNCYSDY

SEQ ID NO: 37699 - protein, 9 aa, Homo sapiens
  light chain complementarity determining region 3 for antibody 18850
QQYGSIPRT

SEQ ID NO: 37700 - protein, 14 aa, Homo sapiens
  heavy chain complementarity determining region 3 for antibody 18850
AGGEFSSGWRYSEN

SEQ ID NO: 37701 - protein, 9 aa, Homo sapiens
  light chain complementarity determining region 3 for antibody 18851
QQYGSIPRP

SEQ ID NO: 37702 - protein, 13 aa, Homo sapiens
  heavy chain complementarity determining region 3 for antibody 18851
ALGHYHTTGYSEF

SEQ ID NO: 37703 - protein, 9 aa, Homo sapiens
  light chain complementarity determining region 3 for antibody 18852
QQYGSIPRP

SEQ ID NO: 37704 - protein, 13 aa, Homo sapiens
  heavy chain complementarity determining region 3 for antibody 18852
AGGLFHSSGYSEF

SEQ ID NO: 37705 - protein, 9 aa, Homo sapiens
  light chain complementarity determining region 3 for antibody 18853
QQYGSIPRP

SEQ ID NO: 37706 - protein, 14 aa, Homo sapiens
  heavy chain complementarity determining region 3 for antibody 18853
AGGEFSSGWHYSEN

SEQ ID NO: 37707 - protein, 9 aa, Homo sapiens
  light chain complementarity determining region 3 for antibody 18854
QQYGSFPST

SEQ ID NO: 37708 - protein, 14 aa, Homo sapiens
  heavy chain complementarity determining region 3 for antibody 18854
ARGGFIVAWGLFDY

SEQ ID NO: 37709 - protein, 9 aa, Homo sapiens
  light chain complementarity determining region 3 for antibody 18855
QQYGRSPYT

SEQ ID NO: 37710 - protein, 18 aa, Homo sapiens
  heavy chain complementarity determining region 3 for antibody 18855
ARPMVRALDEYSYYGLDV

SEQ ID NO: 37711 - protein, 9 aa, Homo sapiens
  light chain complementarity determining region 3 for antibody 18856
QQYGRSPYP

SEQ ID NO: 37712 - protein, 18 aa, Homo sapiens
  heavy chain complementarity determining region 3 for antibody 18856
ARPMVRALDEYNYYGLDV

SEQ ID NO: 37713 - protein, 9 aa, Homo sapiens
  light chain complementarity determining region 3 for antibody 18857
QQYGRSPST

SEQ ID NO: 37714 - protein, 18 aa, Homo sapiens
  heavy chain complementarity determining region 3 for antibody 18857
ARPMVRALDEYNYYGLDV

SEQ ID NO: 37715 - protein, 9 aa, Homo sapiens
  light chain complementarity determining region 3 for antibody 18858
QQYGRSPRT

SEQ ID NO: 37716 - protein, 18 aa, Homo sapiens
  heavy chain complementarity determining region 3 for antibody 18858
ATAFWVGLGVPPPGFFEY

SEQ ID NO: 37717 - protein, 11 aa, Homo sapiens
  light chain complementarity determining region 3 for antibody 18859
QQYGRSPPGYT

SEQ ID NO: 37718 - protein, 12 aa, Homo sapiens
  heavy chain complementarity determining region 3 for antibody 18859
AREWPETCYLDY

SEQ ID NO: 37719 - protein, 9 aa, Homo sapiens
  light chain complementarity determining region 3 for antibody 18860
QQYGRSPLT

SEQ ID NO: 37720 - protein, 19 aa, Homo sapiens
  heavy chain complementarity determining region 3 for antibody 18860
ARGSSSSRRRAAVVGYFDL

SEQ ID NO: 37721 - protein, 8 aa, Homo sapiens
  light chain complementarity determining region 3 for antibody 18861
QQYGRSLT

SEQ ID NO: 37722 - protein, 17 aa, Homo sapiens
  heavy chain complementarity determining region 3 for antibody 18861
ASIYDSTGYSYGGYFQH

SEQ ID NO: 37723 - protein, 9 aa, Homo sapiens
  light chain complementarity determining region 3 for antibody 18862
QQYGRIPRT

SEQ ID NO: 37724 - protein, 14 aa, Homo sapiens
  heavy chain complementarity determining region 3 for antibody 18862
AGGEYCGGNCYSEY

SEQ ID NO: 37725 - protein, 9 aa, Homo sapiens
  light chain complementarity determining region 3 for antibody 18863
QQYGRIPLT

SEQ ID NO: 37726 - protein, 7 aa, Homo sapiens
  heavy chain complementarity determining region 3 for antibody 18863
HGYELKC

SEQ ID NO: 37727 - protein, 10 aa, Homo sapiens
  light chain complementarity determining region 3 for antibody 18864
QQYGNSPTWR

SEQ ID NO: 37728 - protein, 19 aa, Homo sapiens
  heavy chain complementarity determining region 3 for antibody 18864
ARAEYYYDSGGYRPYYFDY

SEQ ID NO: 37729 - protein, 9 aa, Homo sapiens
  light chain complementarity determining region 3 for antibody 18865
QQYGNSPRT

SEQ ID NO: 37730 - protein, 13 aa, Homo sapiens
  heavy chain complementarity determining region 3 for antibody 18865
AIGYYDRGTYHEY

SEQ ID NO: 37731 - protein, 9 aa, Homo sapiens
  light chain complementarity determining region 3 for antibody 18866
QQYGNSPRP

SEQ ID NO: 37732 - protein, 13 aa, Homo sapiens
  heavy chain complementarity determining region 3 for antibody 18866
AIGYYDRGTYYEY

SEQ ID NO: 37733 - protein, 8 aa, Homo sapiens
  light chain complementarity determining region 3 for antibody 18867
QQYGNLVT

SEQ ID NO: 37734 - protein, 18 aa, Homo sapiens
  heavy chain complementarity determining region 3 for antibody 18867
AKGAEGSCSVRKCYPFDY

SEQ ID NO: 37735 - protein, 9 aa, Homo sapiens
  light chain complementarity determining region 3 for antibody 18868
QQYGNLPRT

SEQ ID NO: 37736 - protein, 14 aa, Homo sapiens
  heavy chain complementarity determining region 3 for antibody 18868
AGGTFDSSGYYYEY

SEQ ID NO: 37737 - protein, 9 aa, Homo sapiens
  light chain complementarity determining region 3 for antibody 18869
QQYGNLPRT

SEQ ID NO: 37738 - protein, 13 aa, Homo sapiens
  heavy chain complementarity determining region 3 for antibody 18869
AGGDFHRGGYSDY

SEQ ID NO: 37739 - protein, 9 aa, Homo sapiens
  light chain complementarity determining region 3 for antibody 18870
QQYGNLPRP

SEQ ID NO: 37740 - protein, 14 aa, Homo sapiens
  heavy chain complementarity determining region 3 for antibody 18870
AGGDFHRGGGYSEF

SEQ ID NO: 37741 - protein, 9 aa, Homo sapiens
  light chain complementarity determining region 3 for antibody 18871
QQYGNFPRT

SEQ ID NO: 37742 - protein, 13 aa, Homo sapiens
  heavy chain complementarity determining region 3 for antibody 18871
AGGDFHSGGYSEF

SEQ ID NO: 37743 - protein, 9 aa, Homo sapiens
  light chain complementarity determining region 3 for antibody 18872
QQYGGSPRT

SEQ ID NO: 37744 - protein, 13 aa, Homo sapiens
  heavy chain complementarity determining region 3 for antibody 18872
ASGDFDSGAYYEF

SEQ ID NO: 37745 - protein, 9 aa, Homo sapiens
  light chain complementarity determining region 3 for antibody 18873
QQYGGSPRT

SEQ ID NO: 37746 - protein, 13 aa, Homo sapiens
  heavy chain complementarity determining region 3 for antibody 18873
ASGCFDSGAYYEF

SEQ ID NO: 37747 - protein, 9 aa, Homo sapiens
  light chain complementarity determining region 3 for antibody 18874
QQYGGSPRP

SEQ ID NO: 37748 - protein, 13 aa, Homo sapiens
  heavy chain complementarity determining region 3 for antibody 18874
ASGYFDSGAYYEF

SEQ ID NO: 37749 - protein, 9 aa, Homo sapiens
  light chain complementarity determining region 3 for antibody 18875
QQYGGLEKK

SEQ ID NO: 37750 - protein, 12 aa, Homo sapiens
  heavy chain complementarity determining region 3 for antibody 18875
ARGGIWTGGFDY

SEQ ID NO: 37751 - protein, 11 aa, Homo sapiens
  light chain complementarity determining region 3 for antibody 18876
QQYGDSPPMDT

SEQ ID NO: 37752 - protein, 12 aa, Homo sapiens
  heavy chain complementarity determining region 3 for antibody 18876
AGQGDRSYSYSY

SEQ ID NO: 37753 - protein, 11 aa, Homo sapiens
  light chain complementarity determining region 3 for antibody 18877
QQYDTSPPGYT

SEQ ID NO: 37754 - protein, 14 aa, Homo sapiens
  heavy chain complementarity determining region 3 for antibody 18877
ARETSNSRKRSFDH

SEQ ID NO: 37755 - protein, 11 aa, Homo sapiens
  light chain complementarity determining region 3 for antibody 18878
QQYDRSPPGST

SEQ ID NO: 37756 - protein, 14 aa, Homo sapiens
  heavy chain complementarity determining region 3 for antibody 18878
ARDTHNSRKRSFDQ

SEQ ID NO: 37757 - protein, 11 aa, Homo sapiens
  light chain complementarity determining region 3 for antibody 18879
QQYDRSPPGDT

SEQ ID NO: 37758 - protein, 14 aa, Homo sapiens
  heavy chain complementarity determining region 3 for antibody 18879
ARDTHNSRKRSFDQ

SEQ ID NO: 37759 - protein, 10 aa, Homo sapiens
  light chain complementarity determining region 3 for antibody 18880
QQYDNWPPWP

SEQ ID NO: 37760 - protein, 12 aa, Homo sapiens
  heavy chain complementarity determining region 3 for antibody 18880
AKTLRERKELDY

SEQ ID NO: 37761 - protein, 10 aa, Homo sapiens
  light chain complementarity determining region 3 for antibody 18881
QQYDNWPPLP

SEQ ID NO: 37762 - protein, 15 aa, Homo sapiens
  heavy chain complementarity determining region 3 for antibody 18881
AKEPDCGRNCLFFES

SEQ ID NO: 37763 - protein, 10 aa, Homo sapiens
  light chain complementarity determining region 3 for antibody 18882
QQYCSSPMYS

SEQ ID NO: 37764 - protein, 11 aa, Homo sapiens
  heavy chain complementarity determining region 3 for antibody 18882
ARGGQWGSLDY

SEQ ID NO: 37765 - protein, 9 aa, Homo sapiens
  light chain complementarity determining region 3 for antibody 18883
QQYATSPLP

SEQ ID NO: 37766 - protein, 10 aa, Homo sapiens
  heavy chain complementarity determining region 3 for antibody 18883
VAGAGWLPDY

SEQ ID NO: 37767 - protein, 9 aa, Homo sapiens
  light chain complementarity determining region 3 for antibody 18884
QQYASSPLT

SEQ ID NO: 37768 - protein, 10 aa, Homo sapiens
  heavy chain complementarity determining region 3 for antibody 18884
AGGSGWLIDY

SEQ ID NO: 37769 - protein, 9 aa, Homo sapiens
  light chain complementarity determining region 3 for antibody 18885
QQSYTSVRT

SEQ ID NO: 37770 - protein, 12 aa, Homo sapiens
  heavy chain complementarity determining region 3 for antibody 18885
VKDCGLGGSRDF

SEQ ID NO: 37771 - protein, 9 aa, Homo sapiens
  light chain complementarity determining region 3 for antibody 18886
QQSYTSPIT

SEQ ID NO: 37772 - protein, 16 aa, Homo sapiens
  heavy chain complementarity determining region 3 for antibody 18886
AGESGGGSPRHNYFDP

SEQ ID NO: 37773 - protein, 9 aa, Homo sapiens
  light chain complementarity determining region 3 for antibody 18887
QQSYSTRRP

SEQ ID NO: 37774 - protein, 12 aa, Homo sapiens
  heavy chain complementarity determining region 3 for antibody 18887
ARPREDGDAFDI

SEQ ID NO: 37775 - protein, 9 aa, Homo sapiens
  light chain complementarity determining region 3 for antibody 18888
QQSYSTPPT

SEQ ID NO: 37776 - protein, 16 aa, Homo sapiens
  heavy chain complementarity determining region 3 for antibody 18888
SKDMLRQWLKLRTFED

SEQ ID NO: 37777 - protein, 9 aa, Homo sapiens
  light chain complementarity determining region 3 for antibody 18889
QQSYSTPPT

SEQ ID NO: 37778 - protein, 16 aa, Homo sapiens
  heavy chain complementarity determining region 3 for antibody 18889
SKDILRQWLKLRPFED

SEQ ID NO: 37779 - protein, 9 aa, Homo sapiens
  light chain complementarity determining region 3 for antibody 18890
QQSYSTPPT

SEQ ID NO: 37780 - protein, 17 aa, Homo sapiens
  heavy chain complementarity determining region 3 for antibody 18890
ASLSYTWNYTPGAYFDY

SEQ ID NO: 37781 - protein, 9 aa, Homo sapiens
  light chain complementarity determining region 3 for antibody 18891
QQSYDNPRT

SEQ ID NO: 37782 - protein, 13 aa, Homo sapiens
  heavy chain complementarity determining region 3 for antibody 18891
ARRDAYNYSGLDY

SEQ ID NO: 37783 - protein, 9 aa, Homo sapiens
  light chain complementarity determining region 3 for antibody 18892
QQSSVTPYT

SEQ ID NO: 37784 - protein, 17 aa, Homo sapiens
  heavy chain complementarity determining region 3 for antibody 18892
VTDLGSGNYLSHDAFDV

SEQ ID NO: 37785 - protein, 9 aa, Homo sapiens
  light chain complementarity determining region 3 for antibody 18893
QQSNSVPLT

SEQ ID NO: 37786 - protein, 16 aa, Homo sapiens
  heavy chain complementarity determining region 3 for antibody 18893
ARVYATVTSQALGVDY

SEQ ID NO: 37787 - protein, 9 aa, Homo sapiens
  light chain complementarity determining region 3 for antibody 18894
QQSHRVPLT

SEQ ID NO: 37788 - protein, 16 aa, Homo sapiens
  heavy chain complementarity determining region 3 for antibody 18894
ARVYATVTSQALGVDY

SEQ ID NO: 37789 - protein, 9 aa, Homo sapiens
  light chain complementarity determining region 3 for antibody 18895
QQSGSSPRT

SEQ ID NO: 37790 - protein, 25 aa, Homo sapiens
  heavy chain complementarity determining region 3 for antibody 18895
ARLRIDRLRLPGAMRGPLYDCGLNV

SEQ ID NO: 37791 - protein, 9 aa, Homo sapiens
  light chain complementarity determining region 3 for antibody 18896
QQSGGPPIT

SEQ ID NO: 37792 - protein, 11 aa, Homo sapiens
  heavy chain complementarity determining region 3 for antibody 18896
ARFFVVGANAA

SEQ ID NO: 37793 - protein, 9 aa, Homo sapiens
  light chain complementarity determining region 3 for antibody 18897
QQSDSKPFT

SEQ ID NO: 37794 - protein, 14 aa, Homo sapiens
  heavy chain complementarity determining region 3 for antibody 18897
ARDNSNNWYEGMDV

SEQ ID NO: 37795 - protein, 10 aa, Homo sapiens
  light chain complementarity determining region 3 for antibody 18898
QQRYNGPPFT

SEQ ID NO: 37796 - protein, 11 aa, Homo sapiens
  heavy chain complementarity determining region 3 for antibody 18898
ARGVGSYPFDS

SEQ ID NO: 37797 - protein, 10 aa, Homo sapiens
  light chain complementarity determining region 3 for antibody 18899
QQRTSWPPLT

SEQ ID NO: 37798 - protein, 11 aa, Homo sapiens
  heavy chain complementarity determining region 3 for antibody 18899
ADWAYDSYWNY

SEQ ID NO: 37799 - protein, 9 aa, Homo sapiens
  light chain complementarity determining region 3 for antibody 18900
QQRTAWPPT

SEQ ID NO: 37800 - protein, 17 aa, Homo sapiens
  heavy chain complementarity determining region 3 for antibody 18900
ARTALCESPAYYRFFDY

SEQ ID NO: 37801 - protein, 9 aa, Homo sapiens
  light chain complementarity determining region 3 for antibody 18901
QQRSSWPYT

SEQ ID NO: 37802 - protein, 11 aa, Homo sapiens
  heavy chain complementarity determining region 3 for antibody 18901
VKRWGGSSMDY

SEQ ID NO: 37803 - protein, 9 aa, Homo sapiens
  light chain complementarity determining region 3 for antibody 18902
QQRSSWPYT

SEQ ID NO: 37804 - protein, 11 aa, Homo sapiens
  heavy chain complementarity determining region 3 for antibody 18902
VKRWGGRSIDY

SEQ ID NO: 37805 - protein, 8 aa, Homo sapiens
  light chain complementarity determining region 3 for antibody 18903
QQRSSWPT

SEQ ID NO: 37806 - protein, 26 aa, Homo sapiens
  heavy chain complementarity determining region 3 for antibody 18903
ARGVGARNYDLTASNPASRVYWFFDV

SEQ ID NO: 37807 - protein, 9 aa, Homo sapiens
  light chain complementarity determining region 3 for antibody 18904
QQRSSGPYT

SEQ ID NO: 37808 - protein, 11 aa, Homo sapiens
  heavy chain complementarity determining region 3 for antibody 18904
VKRWGGSSIDY

SEQ ID NO: 37809 - protein, 9 aa, Homo sapiens
  light chain complementarity determining region 3 for antibody 18905
QQRSNWPPP

SEQ ID NO: 37810 - protein, 8 aa, Homo sapiens
  heavy chain complementarity determining region 3 for antibody 18905
ATLGNDSD

SEQ ID NO: 37811 - protein, 9 aa, Homo sapiens
  light chain complementarity determining region 3 for antibody 18906
QQRSNRPPT

SEQ ID NO: 37812 - protein, 8 aa, Homo sapiens
  heavy chain complementarity determining region 3 for antibody 18906
ATLGNDSD

SEQ ID NO: 37813 - protein, 9 aa, Homo sapiens
  light chain complementarity determining region 3 for antibody 18907
QQRSNRPFT

SEQ ID NO: 37814 - protein, 14 aa, Homo sapiens
  heavy chain complementarity determining region 3 for antibody 18907
ARSLSSAWYDWSDP

SEQ ID NO: 37815 - protein, 10 aa, Homo sapiens
  light chain complementarity determining region 3 for antibody 18908
QQRSDWPPLT

SEQ ID NO: 37816 - protein, 10 aa, Homo sapiens
  heavy chain complementarity determining region 3 for antibody 18908
ARDYTMPFDY

SEQ ID NO: 37817 - protein, 10 aa, Homo sapiens
  light chain complementarity determining region 3 for antibody 18909
QQRGIWPPTT

SEQ ID NO: 37818 - protein, 13 aa, Homo sapiens
  heavy chain complementarity determining region 3 for antibody 18909
VRELHAGAYYYDY

SEQ ID NO: 37819 - protein, 10 aa, Homo sapiens
  light chain complementarity determining region 3 for antibody 18910
QQNVTSLKWT

SEQ ID NO: 37820 - protein, 15 aa, Homo sapiens
  heavy chain complementarity determining region 3 for antibody 18910
GRLLSPYSHRTPFDP

SEQ ID NO: 37821 - protein, 8 aa, Homo sapiens
  light chain complementarity determining region 3 for antibody 18911
QQNNSYWT

SEQ ID NO: 37822 - protein, 18 aa, Homo sapiens
  heavy chain complementarity determining region 3 for antibody 18911
AGSGYDYVWGSYQNAMDV

SEQ ID NO: 37823 - protein, 9 aa, Homo sapiens
  light chain complementarity determining region 3 for antibody 18912
QQNGTIPRT

SEQ ID NO: 37824 - protein, 13 aa, Homo sapiens
  heavy chain complementarity determining region 3 for antibody 18912
AGGNFHRSGYAEY

SEQ ID NO: 37825 - protein, 10 aa, Homo sapiens
  light chain complementarity determining region 3 for antibody 18913
QQNGSSPPVT

SEQ ID NO: 37826 - protein, 15 aa, Homo sapiens
  heavy chain complementarity determining region 3 for antibody 18913
AKGPMVRGVLGPFDY

SEQ ID NO: 37827 - protein, 9 aa, Homo sapiens
  light chain complementarity determining region 3 for antibody 18914
QQLNTYPIT

SEQ ID NO: 37828 - protein, 13 aa, Homo sapiens
  heavy chain complementarity determining region 3 for antibody 18914
AKPLTMVTTYGDY

SEQ ID NO: 37829 - protein, 9 aa, Homo sapiens
  light chain complementarity determining region 3 for antibody 18915
QQLNSYPPP

SEQ ID NO: 37830 - protein, 14 aa, Homo sapiens
  heavy chain complementarity determining region 3 for antibody 18915
ATVGYTIGSGVFDI

SEQ ID NO: 37831 - protein, 9 aa, Homo sapiens
  light chain complementarity determining region 3 for antibody 18916
QQHSNWPLT

SEQ ID NO: 37832 - protein, 14 aa, Homo sapiens
  heavy chain complementarity determining region 3 for antibody 18916
AKHRYDSSGYSFDY

SEQ ID NO: 37833 - protein, 9 aa, Homo sapiens
  light chain complementarity determining region 3 for antibody 18917
QQHNSWPRP

SEQ ID NO: 37834 - protein, 14 aa, Homo sapiens
  heavy chain complementarity determining region 3 for antibody 18917
ARGGDYEYPDVFDI

SEQ ID NO: 37835 - protein, 9 aa, Homo sapiens
  light chain complementarity determining region 3 for antibody 18918
QQGSRPPFI

SEQ ID NO: 37836 - protein, 15 aa, Homo sapiens
  heavy chain complementarity determining region 3 for antibody 18918
TRAQVIWGQLYYFDY

SEQ ID NO: 37837 - protein, 9 aa, Homo sapiens
  light chain complementarity determining region 3 for antibody 18919
QQFYTSLRT

SEQ ID NO: 37838 - protein, 12 aa, Homo sapiens
  heavy chain complementarity determining region 3 for antibody 18919
VKDCGLGGSRDS

SEQ ID NO: 37839 - protein, 9 aa, Homo sapiens
  light chain complementarity determining region 3 for antibody 18920
QQFYINPFT

SEQ ID NO: 37840 - protein, 14 aa, Homo sapiens
  heavy chain complementarity determining region 3 for antibody 18920
LGQDCSGVGCDYPR

SEQ ID NO: 37841 - protein, 9 aa, Homo sapiens
  light chain complementarity determining region 3 for antibody 18921
QQFKIYPFT

SEQ ID NO: 37842 - protein, 14 aa, Homo sapiens
  heavy chain complementarity determining region 3 for antibody 18921
AKAKDSSGYHSLDY

SEQ ID NO: 37843 - protein, 9 aa, Homo sapiens
  light chain complementarity determining region 3 for antibody 18922
QQFDDVHRS

SEQ ID NO: 37844 - protein, 16 aa, Homo sapiens
  heavy chain complementarity determining region 3 for antibody 18922
ARESADTIQGKGTFDI

SEQ ID NO: 37845 - protein, 9 aa, Homo sapiens
  light chain complementarity determining region 3 for antibody 18923
QQFAGPPHT

SEQ ID NO: 37846 - protein, 9 aa, Homo sapiens
  heavy chain complementarity determining region 3 for antibody 18923
VRGDWGSGY

SEQ ID NO: 37847 - protein, 9 aa, Homo sapiens
  light chain complementarity determining region 3 for antibody 18924
QQDNTWPRT

SEQ ID NO: 37848 - protein, 22 aa, Homo sapiens
  heavy chain complementarity determining region 3 for antibody 18924
AREVRASGYDDFYNYYYYGLDV

SEQ ID NO: 37849 - protein, 9 aa, Homo sapiens
  light chain complementarity determining region 3 for antibody 18925
QQDGTSPRT

SEQ ID NO: 37850 - protein, 13 aa, Homo sapiens
  heavy chain complementarity determining region 3 for antibody 18925
AGGSGSGTYYKEH

SEQ ID NO: 37851 - protein, 9 aa, Homo sapiens
  light chain complementarity determining region 3 for antibody 18926
QQDGSSPPT

SEQ ID NO: 37852 - protein, 16 aa, Homo sapiens
  heavy chain complementarity determining region 3 for antibody 18926
ARGRTFRGNIYADLLY

SEQ ID NO: 37853 - protein, 9 aa, Homo sapiens
  light chain complementarity determining region 3 for antibody 18927
QQDGNSPRT

SEQ ID NO: 37854 - protein, 13 aa, Homo sapiens
  heavy chain complementarity determining region 3 for antibody 18927
AGGHYDSGDYREY

SEQ ID NO: 37855 - protein, 9 aa, Homo sapiens
  light chain complementarity determining region 3 for antibody 18928
QQDGNLPRT

SEQ ID NO: 37856 - protein, 13 aa, Homo sapiens
  heavy chain complementarity determining region 3 for antibody 18928
AGGNFHSGGYGDY

SEQ ID NO: 37857 - protein, 9 aa, Homo sapiens
  light chain complementarity determining region 3 for antibody 18929
QQAHSFPLA

SEQ ID NO: 37858 - protein, 11 aa, Homo sapiens
  heavy chain complementarity determining region 3 for antibody 18929
VRSPAMAEIDY

SEQ ID NO: 37859 - protein, 9 aa, Homo sapiens
  light chain complementarity determining region 3 for antibody 18930
QPYGSSPNT

SEQ ID NO: 37860 - protein, 29 aa, Homo sapiens
  heavy chain complementarity determining region 3 for antibody 18930
AKSGRLRDLWFGDFRRPNYFDNTGYYLDY

SEQ ID NO: 37861 - protein, 10 aa, Homo sapiens
  light chain complementarity determining region 3 for antibody 18931
QLYGSSPTWP

SEQ ID NO: 37862 - protein, 9 aa, Homo sapiens
  heavy chain complementarity determining region 3 for antibody 18931
ATGGELLGY

SEQ ID NO: 37863 - protein, 11 aa, Homo sapiens
  light chain complementarity determining region 3 for antibody 18932
QLYETSPPGDP

SEQ ID NO: 37864 - protein, 14 aa, Homo sapiens
  heavy chain complementarity determining region 3 for antibody 18932
ARENSISRKRSFDQ

SEQ ID NO: 37865 - protein, 11 aa, Homo sapiens
  light chain complementarity determining region 3 for antibody 18933
QLDETSPPGYT

SEQ ID NO: 37866 - protein, 14 aa, Homo sapiens
  heavy chain complementarity determining region 3 for antibody 18933
ARENSISRKRSFDQ

SEQ ID NO: 37867 - protein, 9 aa, Homo sapiens
  light chain complementarity determining region 3 for antibody 18934
QKYDSAPPT

SEQ ID NO: 37868 - protein, 13 aa, Homo sapiens
  heavy chain complementarity determining region 3 for antibody 18934
ASSSLGYVDAFDL

SEQ ID NO: 37869 - protein, 9 aa, Homo sapiens
  light chain complementarity determining region 3 for antibody 18935
QKNDSAPQT

SEQ ID NO: 37870 - protein, 13 aa, Homo sapiens
  heavy chain complementarity determining region 3 for antibody 18935
ASSSLGYVDAFDL

SEQ ID NO: 37871 - protein, 9 aa, Homo sapiens
  light chain complementarity determining region 3 for antibody 18936
QKHDTAPWT

SEQ ID NO: 37872 - protein, 15 aa, Homo sapiens
  heavy chain complementarity determining region 3 for antibody 18936
LRDIKGPSAGIPYDS

SEQ ID NO: 37873 - protein, 9 aa, Homo sapiens
  light chain complementarity determining region 3 for antibody 18937
QHYYSTPGT

SEQ ID NO: 37874 - protein, 15 aa, Homo sapiens
  heavy chain complementarity determining region 3 for antibody 18937
ARGSESSGFYWYFDL

SEQ ID NO: 37875 - protein, 9 aa, Homo sapiens
  light chain complementarity determining region 3 for antibody 18938
QHYYNNPPV

SEQ ID NO: 37876 - protein, 15 aa, Homo sapiens
  heavy chain complementarity determining region 3 for antibody 18938
ARAGRCGGDCFSLDY

SEQ ID NO: 37877 - protein, 10 aa, Homo sapiens
  light chain complementarity determining region 3 for antibody 18939
QHYHNWPPWP

SEQ ID NO: 37878 - protein, 13 aa, Homo sapiens
  heavy chain complementarity determining region 3 for antibody 18939
AKGRVRELYYFDT

SEQ ID NO: 37879 - protein, 10 aa, Homo sapiens
  light chain complementarity determining region 3 for antibody 18940
QHYHNWPPGT

SEQ ID NO: 37880 - protein, 13 aa, Homo sapiens
  heavy chain complementarity determining region 3 for antibody 18940
AKGRVRELYYFET

SEQ ID NO: 37881 - protein, 10 aa, Homo sapiens
  light chain complementarity determining region 3 for antibody 18941
QHYHNLPPWT

SEQ ID NO: 37882 - protein, 13 aa, Homo sapiens
  heavy chain complementarity determining region 3 for antibody 18941
AKGRVRELYYFET

SEQ ID NO: 37883 - protein, 11 aa, Homo sapiens
  light chain complementarity determining region 3 for antibody 18942
QHYGSSPPRGP

SEQ ID NO: 37884 - protein, 14 aa, Homo sapiens
  heavy chain complementarity determining region 3 for antibody 18942
ASFLLSRRGSYVDY

SEQ ID NO: 37885 - protein, 9 aa, Homo sapiens
  light chain complementarity determining region 3 for antibody 18943
QHYGSLPLT

SEQ ID NO: 37886 - protein, 16 aa, Homo sapiens
  heavy chain complementarity determining region 3 for antibody 18943
ATMLVRGLLYFRAVDV

SEQ ID NO: 37887 - protein, 10 aa, Homo sapiens
  light chain complementarity determining region 3 for antibody 18944
QHYDYSPKLT

SEQ ID NO: 37888 - protein, 18 aa, Homo sapiens
  heavy chain complementarity determining region 3 for antibody 18944
ATGHPLRLHDYYYCVMDV

SEQ ID NO: 37889 - protein, 11 aa, Homo sapiens
  light chain complementarity determining region 3 for antibody 18945
QHYARSPPMYP

SEQ ID NO: 37890 - protein, 24 aa, Homo sapiens
  heavy chain complementarity determining region 3 for antibody 18945
ARLAVYCSGSSCYPPQYHYYGMDV

SEQ ID NO: 37891 - protein, 9 aa, Homo sapiens
  light chain complementarity determining region 3 for antibody 18946
QHRRTWLSS

SEQ ID NO: 37892 - protein, 20 aa, Homo sapiens
  heavy chain complementarity determining region 3 for antibody 18946
ARDGSAGMAARGTPYYGLDV

SEQ ID NO: 37893 - protein, 9 aa, Homo sapiens
  light chain complementarity determining region 3 for antibody 18947
QHRNNWPLP

SEQ ID NO: 37894 - protein, 13 aa, Homo sapiens
  heavy chain complementarity determining region 3 for antibody 18947
ARGNIAAPGRLEC

SEQ ID NO: 37895 - protein, 9 aa, Homo sapiens
  light chain complementarity determining region 3 for antibody 18948
QHPNSYPFT

SEQ ID NO: 37896 - protein, 15 aa, Homo sapiens
  heavy chain complementarity determining region 3 for antibody 18948
ARLGIVVAERGYFDH

SEQ ID NO: 37897 - protein, 10 aa, Homo sapiens
  light chain complementarity determining region 3 for antibody 18949
QHFGSSPEIP

SEQ ID NO: 37898 - protein, 13 aa, Homo sapiens
  heavy chain complementarity determining region 3 for antibody 18949
VRGARRGRYDFDY

SEQ ID NO: 37899 - protein, 9 aa, Homo sapiens
  light chain complementarity determining region 3 for antibody 18950
QEYDSLPFT

SEQ ID NO: 37900 - protein, 22 aa, Homo sapiens
  heavy chain complementarity determining region 3 for antibody 18950
ARDDRISFDYPNSGYSGGPFDL

SEQ ID NO: 37901 - protein, 8 aa, Homo sapiens
  light chain complementarity determining region 3 for antibody 18951
QDYGSSRT

SEQ ID NO: 37902 - protein, 15 aa, Homo sapiens
  heavy chain complementarity determining region 3 for antibody 18951
ASGSFDALTGSYSEV

SEQ ID NO: 37903 - protein, 9 aa, Homo sapiens
  light chain complementarity determining region 3 for antibody 18952
QAYNDFFRT

SEQ ID NO: 37904 - protein, 11 aa, Homo sapiens
  heavy chain complementarity determining region 3 for antibody 18952
ARDRRAYGMDV

SEQ ID NO: 37905 - protein, 10 aa, Homo sapiens
  light chain complementarity determining region 3 for antibody 18953
PQYNQWPPLT

SEQ ID NO: 37906 - protein, 17 aa, Homo sapiens
  heavy chain complementarity determining region 3 for antibody 18953
ARDLYFSIIQGGGAFDA

SEQ ID NO: 37907 - protein, 9 aa, Homo sapiens
  light chain complementarity determining region 3 for antibody 18954
PQYGSIPLT

SEQ ID NO: 37908 - protein, 7 aa, Homo sapiens
  heavy chain complementarity determining region 3 for antibody 18954
HGYELKC

SEQ ID NO: 37909 - protein, 9 aa, Homo sapiens
  light chain complementarity determining region 3 for antibody 18955
PQYGGSPRT

SEQ ID NO: 37910 - protein, 13 aa, Homo sapiens
  heavy chain complementarity determining region 3 for antibody 18955
AAGYFSSGTYYEY

SEQ ID NO: 37911 - protein, 9 aa, Homo sapiens
  light chain complementarity determining region 3 for antibody 18956
PQYFTSPPT

SEQ ID NO: 37912 - protein, 15 aa, Homo sapiens
  heavy chain complementarity determining region 3 for antibody 18956
VKVLMSGTQIALFDQ

SEQ ID NO: 37913 - protein, 9 aa, Homo sapiens
  light chain complementarity determining region 3 for antibody 18957
PHTYTFPRT

SEQ ID NO: 37914 - protein, 20 aa, Homo sapiens
  heavy chain complementarity determining region 3 for antibody 18957
ARGRRIAALSTAHYYYGMDV

SEQ ID NO: 37915 - protein, 10 aa, Homo sapiens
  light chain complementarity determining region 3 for antibody 18958
MQSVQFPRGT

SEQ ID NO: 37916 - protein, 8 aa, Homo sapiens
  heavy chain complementarity determining region 3 for antibody 18958
AKGYGFDS

SEQ ID NO: 37917 - protein, 8 aa, Homo sapiens
  light chain complementarity determining region 3 for antibody 18959
MQSTQGPT

SEQ ID NO: 37918 - protein, 21 aa, Homo sapiens
  heavy chain complementarity determining region 3 for antibody 18959
AKDRPNYYGSNAGYYTPGGDR

SEQ ID NO: 37919 - protein, 8 aa, Homo sapiens
  light chain complementarity determining region 3 for antibody 18960
MQSTQGPT

SEQ ID NO: 37920 - protein, 21 aa, Homo sapiens
  heavy chain complementarity determining region 3 for antibody 18960
AKDRPNYYGSNAGYYTPGGDL

SEQ ID NO: 37921 - protein, 9 aa, Homo sapiens
  light chain complementarity determining region 3 for antibody 18961
MQSRRWPPT

SEQ ID NO: 37922 - protein, 8 aa, Homo sapiens
  heavy chain complementarity determining region 3 for antibody 18961
TAWGSSQH

SEQ ID NO: 37923 - protein, 9 aa, Homo sapiens
  light chain complementarity determining region 3 for antibody 18962
MQRVLLPQT

SEQ ID NO: 37924 - protein, 10 aa, Homo sapiens
  heavy chain complementarity determining region 3 for antibody 18962
AREVRHYFET

SEQ ID NO: 37925 - protein, 9 aa, Homo sapiens
  light chain complementarity determining region 3 for antibody 18963
MQRRRWPHT

SEQ ID NO: 37926 - protein, 8 aa, Homo sapiens
  heavy chain complementarity determining region 3 for antibody 18963
TAWGSSHH

SEQ ID NO: 37927 - protein, 9 aa, Homo sapiens
  light chain complementarity determining region 3 for antibody 18964
MQPLQFPLT

SEQ ID NO: 37928 - protein, 12 aa, Homo sapiens
  heavy chain complementarity determining region 3 for antibody 18964
VKMGDSPRLFDQ

SEQ ID NO: 37929 - protein, 9 aa, Homo sapiens
  light chain complementarity determining region 3 for antibody 18965
MQGTPWPWT

SEQ ID NO: 37930 - protein, 10 aa, Homo sapiens
  heavy chain complementarity determining region 3 for antibody 18965
ARETHWGPDY

SEQ ID NO: 37931 - protein, 9 aa, Homo sapiens
  light chain complementarity determining region 3 for antibody 18966
MQGTPWPLE

SEQ ID NO: 37932 - protein, 18 aa, Homo sapiens
  heavy chain complementarity determining region 3 for antibody 18966
ARDERDTCTTDLCYYFDY

SEQ ID NO: 37933 - protein, 9 aa, Homo sapiens
  light chain complementarity determining region 3 for antibody 18967
MQGTHWPWR

SEQ ID NO: 37934 - protein, 10 aa, Homo sapiens
  heavy chain complementarity determining region 3 for antibody 18967
ARETHWGPDY

SEQ ID NO: 37935 - protein, 9 aa, Homo sapiens
  light chain complementarity determining region 3 for antibody 18968
MQGTHWPPT

SEQ ID NO: 37936 - protein, 11 aa, Homo sapiens
  heavy chain complementarity determining region 3 for antibody 18968
ARGVLDPAFAV

SEQ ID NO: 37937 - protein, 8 aa, Homo sapiens
  light chain complementarity determining region 3 for antibody 18969
MQGTHWPP

SEQ ID NO: 37938 - protein, 21 aa, Homo sapiens
  heavy chain complementarity determining region 3 for antibody 18969
AKDRPNYYESNGQYYTPKGDL

SEQ ID NO: 37939 - protein, 9 aa, Homo sapiens
  light chain complementarity determining region 3 for antibody 18970
MQGTHGPWT

SEQ ID NO: 37940 - protein, 10 aa, Homo sapiens
  heavy chain complementarity determining region 3 for antibody 18970
ARETHWGPDY

SEQ ID NO: 37941 - protein, 9 aa, Homo sapiens
  light chain complementarity determining region 3 for antibody 18971
MQGTHGPKT

SEQ ID NO: 37942 - protein, 11 aa, Homo sapiens
  heavy chain complementarity determining region 3 for antibody 18971
SRGNSSSWYDY

SEQ ID NO: 37943 - protein, 8 aa, Homo sapiens
  light chain complementarity determining region 3 for antibody 18972
MQGTDWPR

SEQ ID NO: 37944 - protein, 21 aa, Homo sapiens
  heavy chain complementarity determining region 3 for antibody 18972
AKDRPNYYGSDGQYYTPKGDL

SEQ ID NO: 37945 - protein, 8 aa, Homo sapiens
  light chain complementarity determining region 3 for antibody 18973
MQGTDCPT

SEQ ID NO: 37946 - protein, 21 aa, Homo sapiens
  heavy chain complementarity determining region 3 for antibody 18973
AKDRPNYYGSDGQYYTPKGDL

SEQ ID NO: 37947 - protein, 9 aa, Homo sapiens
  light chain complementarity determining region 3 for antibody 18974
MQGLQTPYT

SEQ ID NO: 37948 - protein, 10 aa, Homo sapiens
  heavy chain complementarity determining region 3 for antibody 18974
GRDLSGARDY

SEQ ID NO: 37949 - protein, 9 aa, Homo sapiens
  light chain complementarity determining region 3 for antibody 18975
MQGINWPGT

SEQ ID NO: 37950 - protein, 7 aa, Homo sapiens
  heavy chain complementarity determining region 3 for antibody 18975
ARGWGAY

SEQ ID NO: 37951 - protein, 9 aa, Homo sapiens
  light chain complementarity determining region 3 for antibody 18976
MQATYWPGR

SEQ ID NO: 37952 - protein, 11 aa, Homo sapiens
  heavy chain complementarity determining region 3 for antibody 18976
LSAVRGSSFDI

SEQ ID NO: 37953 - protein, 9 aa, Homo sapiens
  light chain complementarity determining region 3 for antibody 18977
MQATHWPYT

SEQ ID NO: 37954 - protein, 12 aa, Homo sapiens
  heavy chain complementarity determining region 3 for antibody 18977
ARGPLKTAAGMW

SEQ ID NO: 37955 - protein, 9 aa, Homo sapiens
  light chain complementarity determining region 3 for antibody 18978
MQAQQTPLT

SEQ ID NO: 37956 - protein, 13 aa, Homo sapiens
  heavy chain complementarity determining region 3 for antibody 18978
ASANYDFWSGLST

SEQ ID NO: 37957 - protein, 9 aa, Homo sapiens
  light chain complementarity determining region 3 for antibody 18979
MQAPETPFT

SEQ ID NO: 37958 - protein, 15 aa, Homo sapiens
  heavy chain complementarity determining region 3 for antibody 18979
VRHYRIITAPLEGDS

SEQ ID NO: 37959 - protein, 8 aa, Homo sapiens
  light chain complementarity determining region 3 for antibody 18980
MQALQTPT

SEQ ID NO: 37960 - protein, 15 aa, Homo sapiens
  heavy chain complementarity determining region 3 for antibody 18980
ARRDYYDSSGYSLDY

SEQ ID NO: 37961 - protein, 9 aa, Homo sapiens
  light chain complementarity determining region 3 for antibody 18981
MQALQTPPP

SEQ ID NO: 37962 - protein, 15 aa, Homo sapiens
  heavy chain complementarity determining region 3 for antibody 18981
ARDGLRDGFSDAFDI

SEQ ID NO: 37963 - protein, 9 aa, Homo sapiens
  light chain complementarity determining region 3 for antibody 18982
MQALKTPFT

SEQ ID NO: 37964 - protein, 15 aa, Homo sapiens
  heavy chain complementarity determining region 3 for antibody 18982
VRHYRIITAPLEGDS

SEQ ID NO: 37965 - protein, 9 aa, Homo sapiens
  light chain complementarity determining region 3 for antibody 18983
MQALGTPFT

SEQ ID NO: 37966 - protein, 15 aa, Homo sapiens
  heavy chain complementarity determining region 3 for antibody 18983
VRHYRELATGIEGDS

SEQ ID NO: 37967 - protein, 9 aa, Homo sapiens
  light chain complementarity determining region 3 for antibody 18984
MQALETPFT

SEQ ID NO: 37968 - protein, 15 aa, Homo sapiens
  heavy chain complementarity determining region 3 for antibody 18984
VRQYRIITAPLEGDS

SEQ ID NO: 37969 - protein, 9 aa, Homo sapiens
  light chain complementarity determining region 3 for antibody 18985
MQALETPFT

SEQ ID NO: 37970 - protein, 15 aa, Homo sapiens
  heavy chain complementarity determining region 3 for antibody 18985
VRHYRKTVAGIEGDS

SEQ ID NO: 37971 - protein, 9 aa, Homo sapiens
  light chain complementarity determining region 3 for antibody 18986
MQALETPFT

SEQ ID NO: 37972 - protein, 15 aa, Homo sapiens
  heavy chain complementarity determining region 3 for antibody 18986
VRHYRIITDPLEGDS

SEQ ID NO: 37973 - protein, 9 aa, Homo sapiens
  light chain complementarity determining region 3 for antibody 18987
MQALETPFT

SEQ ID NO: 37974 - protein, 15 aa, Homo sapiens
  heavy chain complementarity determining region 3 for antibody 18987
VRHYRIITAPLEGGS

SEQ ID NO: 37975 - protein, 9 aa, Homo sapiens
  light chain complementarity determining region 3 for antibody 18988
MQALETPFT

SEQ ID NO: 37976 - protein, 15 aa, Homo sapiens
  heavy chain complementarity determining region 3 for antibody 18988
VRHYRIITAALEGDS

SEQ ID NO: 37977 - protein, 9 aa, Homo sapiens
  light chain complementarity determining region 3 for antibody 18989
MQALETPFT

SEQ ID NO: 37978 - protein, 15 aa, Homo sapiens
  heavy chain complementarity determining region 3 for antibody 18989
VRHYRETVAGVEGDS

SEQ ID NO: 37979 - protein, 9 aa, Homo sapiens
  light chain complementarity determining region 3 for antibody 18990
MQALETPFT

SEQ ID NO: 37980 - protein, 15 aa, Homo sapiens
  heavy chain complementarity determining region 3 for antibody 18990
VRHYRETVAGIERDS

SEQ ID NO: 37981 - protein, 9 aa, Homo sapiens
  light chain complementarity determining region 3 for antibody 18991
MQALETPFT

SEQ ID NO: 37982 - protein, 15 aa, Homo sapiens
  heavy chain complementarity determining region 3 for antibody 18991
VRHYRETGAGIEGDS

SEQ ID NO: 37983 - protein, 9 aa, Homo sapiens
  light chain complementarity determining region 3 for antibody 18992
MQALETPFT

SEQ ID NO: 37984 - protein, 15 aa, Homo sapiens
  heavy chain complementarity determining region 3 for antibody 18992
VRHYRELATGIDGDS

SEQ ID NO: 37985 - protein, 9 aa, Homo sapiens
  light chain complementarity determining region 3 for antibody 18993
MQALETPFT

SEQ ID NO: 37986 - protein, 15 aa, Homo sapiens
  heavy chain complementarity determining region 3 for antibody 18993
VRHYRELAAGIEGDS

SEQ ID NO: 37987 - protein, 9 aa, Homo sapiens
  light chain complementarity determining region 3 for antibody 18994
MQALETPFT

SEQ ID NO: 37988 - protein, 15 aa, Homo sapiens
  heavy chain complementarity determining region 3 for antibody 18994
VRHHRETVAGIEGDS

SEQ ID NO: 37989 - protein, 9 aa, Homo sapiens
  light chain complementarity determining region 3 for antibody 18995
MQALETPFT

SEQ ID NO: 37990 - protein, 15 aa, Homo sapiens
  heavy chain complementarity determining region 3 for antibody 18995
VRHCRETVAGIEGDS

SEQ ID NO: 37991 - protein, 9 aa, Homo sapiens
  light chain complementarity determining region 3 for antibody 18996
MQALETPFT

SEQ ID NO: 37992 - protein, 15 aa, Homo sapiens
  heavy chain complementarity determining region 3 for antibody 18996
VGHYRETVAGIEGDS

SEQ ID NO: 37993 - protein, 9 aa, Homo sapiens
  light chain complementarity determining region 3 for antibody 18997
MQALETPFT

SEQ ID NO: 37994 - protein, 14 aa, Homo sapiens
  heavy chain complementarity determining region 3 for antibody 18997
RHYRIITAPLEGDS

SEQ ID NO: 37995 - protein, 9 aa, Homo sapiens
  light chain complementarity determining region 3 for antibody 18998
MQALETPFP

SEQ ID NO: 37996 - protein, 15 aa, Homo sapiens
  heavy chain complementarity determining region 3 for antibody 18998
VRHYRELTTGIEGDS

SEQ ID NO: 37997 - protein, 9 aa, Homo sapiens
  light chain complementarity determining region 3 for antibody 18999
MQALEAPFT

SEQ ID NO: 37998 - protein, 15 aa, Homo sapiens
  heavy chain complementarity determining region 3 for antibody 18999
VRHYRIITAPLEGDS

SEQ ID NO: 37999 - protein, 9 aa, Homo sapiens
  light chain complementarity determining region 3 for antibody 19000
MQALDTPFT

SEQ ID NO: 38000 - protein, 15 aa, Homo sapiens
  heavy chain complementarity determining region 3 for antibody 19000
VRHYRELATGIEGDS

SEQ ID NO: 38001 - protein, 9 aa, Homo sapiens
  light chain complementarity determining region 3 for antibody 19001
MGTLQTPRT

SEQ ID NO: 38002 - protein, 15 aa, Homo sapiens
  heavy chain complementarity determining region 3 for antibody 19001
TRDGKKDGHNDAFDI

SEQ ID NO: 38003 - protein, 9 aa, Homo sapiens
  light chain complementarity determining region 3 for antibody 19002
MGTLQSPPT

SEQ ID NO: 38004 - protein, 14 aa, Homo sapiens
  heavy chain complementarity determining region 3 for antibody 19002
TRDGKRDGHNDAYI

SEQ ID NO: 38005 - protein, 9 aa, Homo sapiens
  light chain complementarity determining region 3 for antibody 19003
LQYYSTPGT

SEQ ID NO: 38006 - protein, 15 aa, Homo sapiens
  heavy chain complementarity determining region 3 for antibody 19003
IRQSKVDNYYNYPDF

SEQ ID NO: 38007 - protein, 9 aa, Homo sapiens
  light chain complementarity determining region 3 for antibody 19004
LQYRSYPPT

SEQ ID NO: 38008 - protein, 17 aa, Homo sapiens
  heavy chain complementarity determining region 3 for antibody 19004
ARVPYCSTTTCYFPFDF

SEQ ID NO: 38009 - protein, 9 aa, Homo sapiens
  light chain complementarity determining region 3 for antibody 19005
LQYNSYPRT

SEQ ID NO: 38010 - protein, 6 aa, Homo sapiens
  heavy chain complementarity determining region 3 for antibody 19005
SRALDY

SEQ ID NO: 38011 - protein, 9 aa, Homo sapiens
  light chain complementarity determining region 3 for antibody 19006
LQYNIYPRT

SEQ ID NO: 38012 - protein, 6 aa, Homo sapiens
  heavy chain complementarity determining region 3 for antibody 19006
SRALDY

SEQ ID NO: 38013 - protein, 9 aa, Homo sapiens
  light chain complementarity determining region 3 for antibody 19007
LQYGFAQSS

SEQ ID NO: 38014 - protein, 18 aa, Homo sapiens
  heavy chain complementarity determining region 3 for antibody 19007
TGVHGLTMLRGATKPFDF

SEQ ID NO: 38015 - protein, 9 aa, Homo sapiens
  light chain complementarity determining region 3 for antibody 19008
LQTYSPPRT

SEQ ID NO: 38016 - protein, 12 aa, Homo sapiens
  heavy chain complementarity determining region 3 for antibody 19008
ARNGAGAYGMDV

SEQ ID NO: 38017 - protein, 9 aa, Homo sapiens
  light chain complementarity determining region 3 for antibody 19009
LQTTQLPHT

SEQ ID NO: 38018 - protein, 12 aa, Homo sapiens
  heavy chain complementarity determining region 3 for antibody 19009
TRHAWTPYSMDV

SEQ ID NO: 38019 - protein, 9 aa, Homo sapiens
  light chain complementarity determining region 3 for antibody 19010
LQTLQTPGT

SEQ ID NO: 38020 - protein, 13 aa, Homo sapiens
  heavy chain complementarity determining region 3 for antibody 19010
AKVVSYGSGGLQY

SEQ ID NO: 38021 - protein, 9 aa, Homo sapiens
  light chain complementarity determining region 3 for antibody 19011
LQQNSYPLT

SEQ ID NO: 38022 - protein, 13 aa, Homo sapiens
  heavy chain complementarity determining region 3 for antibody 19011
VRHAVVRPMVVDD

SEQ ID NO: 38023 - protein, 9 aa, Homo sapiens
  light chain complementarity determining region 3 for antibody 19012
LQNEYCPRT

SEQ ID NO: 38024 - protein, 11 aa, Homo sapiens
  heavy chain complementarity determining region 3 for antibody 19012
VRVGGAGYFDH

SEQ ID NO: 38025 - protein, 9 aa, Homo sapiens
  light chain complementarity determining region 3 for antibody 19013
LQHTSYPLT

SEQ ID NO: 38026 - protein, 13 aa, Homo sapiens
  heavy chain complementarity determining region 3 for antibody 19013
VRHAVVRPMVVDD

SEQ ID NO: 38027 - protein, 9 aa, Homo sapiens
  light chain complementarity determining region 3 for antibody 19014
LQHNSFPLT

SEQ ID NO: 38028 - protein, 13 aa, Homo sapiens
  heavy chain complementarity determining region 3 for antibody 19014
VRHAVVRPMVVDD

SEQ ID NO: 38029 - protein, 9 aa, Homo sapiens
  light chain complementarity determining region 3 for antibody 19015
LQGTHGPPT

SEQ ID NO: 38030 - protein, 12 aa, Homo sapiens
  heavy chain complementarity determining region 3 for antibody 19015
ATDYGPVVTLAH

SEQ ID NO: 38031 - protein, 9 aa, Homo sapiens
  light chain complementarity determining region 3 for antibody 19016
LQGNRFPNT

SEQ ID NO: 38032 - protein, 14 aa, Homo sapiens
  heavy chain complementarity determining region 3 for antibody 19016
ARYCSGNSCYSMDH

SEQ ID NO: 38033 - protein, 9 aa, Homo sapiens
  light chain complementarity determining region 3 for antibody 19017
LQGNRFPHT

SEQ ID NO: 38034 - protein, 14 aa, Homo sapiens
  heavy chain complementarity determining region 3 for antibody 19017
ARYWSGNSCYSMDH

SEQ ID NO: 38035 - protein, 9 aa, Homo sapiens
  light chain complementarity determining region 3 for antibody 19018
LQDYNYPGT

SEQ ID NO: 38036 - protein, 11 aa, Homo sapiens
  heavy chain complementarity determining region 3 for antibody 19018
ARDYAGAFFDY

SEQ ID NO: 38037 - protein, 9 aa, Homo sapiens
  light chain complementarity determining region 3 for antibody 19019
LQDGFAQYS

SEQ ID NO: 38038 - protein, 18 aa, Homo sapiens
  heavy chain complementarity determining region 3 for antibody 19019
TGVHGLTMLRGATKPFDF

SEQ ID NO: 38039 - protein, 9 aa, Homo sapiens
  light chain complementarity determining region 3 for antibody 19020
LQALETPFP

SEQ ID NO: 38040 - protein, 15 aa, Homo sapiens
  heavy chain complementarity determining region 3 for antibody 19020
VRHYRIITAPLEGDS

SEQ ID NO: 38041 - protein, 9 aa, Homo sapiens
  light chain complementarity determining region 3 for antibody 19021
LPNEYWPRT

SEQ ID NO: 38042 - protein, 11 aa, Homo sapiens
  heavy chain complementarity determining region 3 for antibody 19021
VRVGGAGYFDH

SEQ ID NO: 38043 - protein, 9 aa, Homo sapiens
  light chain complementarity determining region 3 for antibody 19022
LPHNSYPLT

SEQ ID NO: 38044 - protein, 13 aa, Homo sapiens
  heavy chain complementarity determining region 3 for antibody 19022
VRHAVVRPMVVDD

SEQ ID NO: 38045 - protein, 9 aa, Homo sapiens
  light chain complementarity determining region 3 for antibody 19023
LKHNSYPLT

SEQ ID NO: 38046 - protein, 13 aa, Homo sapiens
  heavy chain complementarity determining region 3 for antibody 19023
VRHAVVRPMVVDD

SEQ ID NO: 38047 - protein, 8 aa, Homo sapiens
  light chain complementarity determining region 3 for antibody 19024
LHYGPSYP

SEQ ID NO: 38048 - protein, 18 aa, Homo sapiens
  heavy chain complementarity determining region 3 for antibody 19024
TRRASGGYCSANNCFVDF

SEQ ID NO: 38049 - protein, 9 aa, Homo sapiens
  light chain complementarity determining region 3 for antibody 19025
KQGTHGPHT

SEQ ID NO: 38050 - protein, 11 aa, Homo sapiens
  heavy chain complementarity determining region 3 for antibody 19025
ARDPGWGALDY

SEQ ID NO: 38051 - protein, 9 aa, Homo sapiens
  light chain complementarity determining region 3 for antibody 19026
KQALETPFT

SEQ ID NO: 38052 - protein, 15 aa, Homo sapiens
  heavy chain complementarity determining region 3 for antibody 19026
VRHYRIITAPLEGDS

SEQ ID NO: 38053 - protein, 9 aa, Homo sapiens
  light chain complementarity determining region 3 for antibody 19027
HQYSSSPYT

SEQ ID NO: 38054 - protein, 13 aa, Homo sapiens
  heavy chain complementarity determining region 3 for antibody 19027
ARGTYSAFAIFDV

SEQ ID NO: 38055 - protein, 9 aa, Homo sapiens
  light chain complementarity determining region 3 for antibody 19028
HQYGTSPFT

SEQ ID NO: 38056 - protein, 15 aa, Homo sapiens
  heavy chain complementarity determining region 3 for antibody 19028
ARQNDFLSGPGEFDP

SEQ ID NO: 38057 - protein, 10 aa, Homo sapiens
  light chain complementarity determining region 3 for antibody 19029
HQYGRSAPGT

SEQ ID NO: 38058 - protein, 11 aa, Homo sapiens
  heavy chain complementarity determining region 3 for antibody 19029
VKDRGAVMGDY

SEQ ID NO: 38059 - protein, 7 aa, Homo sapiens
  light chain complementarity determining region 3 for antibody 19030
HQYGGGT

SEQ ID NO: 38060 - protein, 15 aa, Homo sapiens
  heavy chain complementarity determining region 3 for antibody 19030
TAIVFFAGSVHIEHY

SEQ ID NO: 38061 - protein, 9 aa, Homo sapiens
  light chain complementarity determining region 3 for antibody 19031
HQYATLPAT

SEQ ID NO: 38062 - protein, 13 aa, Homo sapiens
  heavy chain complementarity determining region 3 for antibody 19031
VRRGYGDFVREDF

SEQ ID NO: 38063 - protein, 9 aa, Homo sapiens
  light chain complementarity determining region 3 for antibody 19032
HQYAESPRL

SEQ ID NO: 38064 - protein, 17 aa, Homo sapiens
  heavy chain complementarity determining region 3 for antibody 19032
AKSVGVDDAMTTRVYDS

SEQ ID NO: 38065 - protein, 9 aa, Homo sapiens
  light chain complementarity determining region 3 for antibody 19033
HQYAASPRM

SEQ ID NO: 38066 - protein, 17 aa, Homo sapiens
  heavy chain complementarity determining region 3 for antibody 19033
AKSVGVDDAMTTRVYDS

SEQ ID NO: 38067 - protein, 9 aa, Homo sapiens
  light chain complementarity determining region 3 for antibody 19034
HQSGVFPWT

SEQ ID NO: 38068 - protein, 14 aa, Homo sapiens
  heavy chain complementarity determining region 3 for antibody 19034
VRDASGNSGWYAAS

SEQ ID NO: 38069 - protein, 9 aa, Homo sapiens
  light chain complementarity determining region 3 for antibody 19035
HQSGALPGT

SEQ ID NO: 38070 - protein, 14 aa, Homo sapiens
  heavy chain complementarity determining region 3 for antibody 19035
VRDASGNSGWYADS

SEQ ID NO: 38071 - protein, 9 aa, Homo sapiens
  light chain complementarity determining region 3 for antibody 19036
HQRYTAPFT

SEQ ID NO: 38072 - protein, 12 aa, Homo sapiens
  heavy chain complementarity determining region 3 for antibody 19036
ARNYFDSSGPDY

SEQ ID NO: 38073 - protein, 10 aa, Homo sapiens
  light chain complementarity determining region 3 for antibody 19037
HQRSKWPPLT

SEQ ID NO: 38074 - protein, 9 aa, Homo sapiens
  heavy chain complementarity determining region 3 for antibody 19037
ARVDGYFDY

SEQ ID NO: 38075 - protein, 9 aa, Homo sapiens
  light chain complementarity determining region 3 for antibody 19038
HQIGALPWT

SEQ ID NO: 38076 - protein, 14 aa, Homo sapiens
  heavy chain complementarity determining region 3 for antibody 19038
VRDASGNSGWYADS

SEQ ID NO: 38077 - protein, 9 aa, Homo sapiens
  light chain complementarity determining region 3 for antibody 19039
HQGYTAPFT

SEQ ID NO: 38078 - protein, 12 aa, Homo sapiens
  heavy chain complementarity determining region 3 for antibody 19039
ARNYFDSSGPDY

SEQ ID NO: 38079 - protein, 9 aa, Homo sapiens
  light chain complementarity determining region 3 for antibody 19040
HHTSTFPRT

SEQ ID NO: 38080 - protein, 20 aa, Homo sapiens
  heavy chain complementarity determining region 3 for antibody 19040
ARGRRIAALSTAHYDYGMDV

SEQ ID NO: 38081 - protein, 9 aa, Homo sapiens
  light chain complementarity determining region 3 for antibody 19041
HHTFTFPRT

SEQ ID NO: 38082 - protein, 20 aa, Homo sapiens
  heavy chain complementarity determining region 3 for antibody 19041
ARGRRIAALSTAHYYYGMDV

SEQ ID NO: 38083 - protein, 9 aa, Homo sapiens
  light chain complementarity determining region 3 for antibody 19042
HHPYTFPRT

SEQ ID NO: 38084 - protein, 20 aa, Homo sapiens
  heavy chain complementarity determining region 3 for antibody 19042
ARGRRIAALSTAHYYYGMDV

SEQ ID NO: 38085 - protein, 9 aa, Homo sapiens
  light chain complementarity determining region 3 for antibody 19043
VQYNSYPRT

SEQ ID NO: 38086 - protein, 6 aa, Homo sapiens
  heavy chain complementarity determining region 3 for antibody 19043
TRALDY

SEQ ID NO: 38087 - protein, 9 aa, Homo sapiens
  light chain complementarity determining region 3 for antibody 19044
VQSNRYPRT

SEQ ID NO: 38088 - protein, 6 aa, Homo sapiens
  heavy chain complementarity determining region 3 for antibody 19044
TRALDY

SEQ ID NO: 38089 - protein, 9 aa, Homo sapiens
  light chain complementarity determining region 3 for antibody 19045
VQALETPFT

SEQ ID NO: 38090 - protein, 15 aa, Homo sapiens
  heavy chain complementarity determining region 3 for antibody 19045
VRHYRETVAGIEGDS

SEQ ID NO: 38091 - protein, 9 aa, Homo sapiens
  light chain complementarity determining region 3 for antibody 19046
RQYGTSPFT

SEQ ID NO: 38092 - protein, 15 aa, Homo sapiens
  heavy chain complementarity determining region 3 for antibody 19046
ARQNDFLSGPGEFDP

SEQ ID NO: 38093 - protein, 9 aa, Homo sapiens
  light chain complementarity determining region 3 for antibody 19047
RQTTLWPYT

SEQ ID NO: 38094 - protein, 15 aa, Homo sapiens
  heavy chain complementarity determining region 3 for antibody 19047
ARGPLRFAGNEGLDY

SEQ ID NO: 38095 - protein, 9 aa, Homo sapiens
  light chain complementarity determining region 3 for antibody 19048
RQGYSSPFT

SEQ ID NO: 38096 - protein, 15 aa, Homo sapiens
  heavy chain complementarity determining region 3 for antibody 19048
VKAQVIWGQLYYFES

SEQ ID NO: 38097 - protein, 9 aa, Homo sapiens
  light chain complementarity determining region 3 for antibody 19049
RQGLQTPYT

SEQ ID NO: 38098 - protein, 18 aa, Homo sapiens
  heavy chain complementarity determining region 3 for antibody 19049
ARQRRGGYSYGYHYGMDV

SEQ ID NO: 38099 - protein, 9 aa, Homo sapiens
  light chain complementarity determining region 3 for antibody 19050
RQALETPFT

SEQ ID NO: 38100 - protein, 15 aa, Homo sapiens
  heavy chain complementarity determining region 3 for antibody 19050
VRHYRELATGFEGDS

SEQ ID NO: 38101 - protein, 9 aa, Homo sapiens
  light chain complementarity determining region 3 for antibody 19051
RQALETPFP

SEQ ID NO: 38102 - protein, 15 aa, Homo sapiens
  heavy chain complementarity determining region 3 for antibody 19051
VRHYRIITAPLEGDS

SEQ ID NO: 38103 - protein, 9 aa, Homo sapiens
  light chain complementarity determining region 3 for antibody 19052
RHTSTFPRT

SEQ ID NO: 38104 - protein, 20 aa, Homo sapiens
  heavy chain complementarity determining region 3 for antibody 19052
ARGRRIAALSTAHYYYGMDV

SEQ ID NO: 38105 - protein, 9 aa, Homo sapiens
  light chain complementarity determining region 3 for antibody 19053
QYYGRSPWT

SEQ ID NO: 38106 - protein, 17 aa, Homo sapiens
  heavy chain complementarity determining region 3 for antibody 19053
ARTVLYPFTSGRAAFDV

SEQ ID NO: 38107 - protein, 9 aa, Homo sapiens
  light chain complementarity determining region 3 for antibody 19054
QYYGRSPWT

SEQ ID NO: 38108 - protein, 17 aa, Homo sapiens
  heavy chain complementarity determining region 3 for antibody 19054
ARTVLYHVTSGRAAFDV

SEQ ID NO: 38109 - protein, 9 aa, Homo sapiens
  light chain complementarity determining region 3 for antibody 19055
QYYGRSPWT

SEQ ID NO: 38110 - protein, 17 aa, Homo sapiens
  heavy chain complementarity determining region 3 for antibody 19055
ARTVLYHCTSGRAAFDV

SEQ ID NO: 38111 - protein, 9 aa, Homo sapiens
  light chain complementarity determining region 3 for antibody 19056
QYYGASPCP

SEQ ID NO: 38112 - protein, 11 aa, Homo sapiens
  heavy chain complementarity determining region 3 for antibody 19056
ARGEVGYAFDI

SEQ ID NO: 38113 - protein, 11 aa, Homo sapiens
  light chain complementarity determining region 3 for antibody 19057
QYRHNWPAEYT

SEQ ID NO: 38114 - protein, 15 aa, Homo sapiens
  heavy chain complementarity determining region 3 for antibody 19057
AREGVDRLAISAFDI

SEQ ID NO: 38115 - protein, 11 aa, Homo sapiens
  light chain complementarity determining region 3 for antibody 19058
QYRHNWPAEST

SEQ ID NO: 38116 - protein, 15 aa, Homo sapiens
  heavy chain complementarity determining region 3 for antibody 19058
AREGVDRLTISAFDI

SEQ ID NO: 38117 - protein, 11 aa, Homo sapiens
  light chain complementarity determining region 3 for antibody 19059
QYRHNWPAAYT

SEQ ID NO: 38118 - protein, 15 aa, Homo sapiens
  heavy chain complementarity determining region 3 for antibody 19059
AREGVDRLTISAFDI

SEQ ID NO: 38119 - protein, 9 aa, Homo sapiens
  light chain complementarity determining region 3 for antibody 19060
QRYGTSPRT

SEQ ID NO: 38120 - protein, 13 aa, Homo sapiens
  heavy chain complementarity determining region 3 for antibody 19060
PIGFYDRSGYHEY

SEQ ID NO: 38121 - protein, 8 aa, Homo sapiens
  light chain complementarity determining region 3 for antibody 19061
QRYGSSPL

SEQ ID NO: 38122 - protein, 15 aa, Homo sapiens
  heavy chain complementarity determining region 3 for antibody 19061
ARERASIGYYYLFDY

SEQ ID NO: 38123 - protein, 11 aa, Homo sapiens
  light chain complementarity determining region 3 for antibody 19062
QRYDTSPPRYG

SEQ ID NO: 38124 - protein, 14 aa, Homo sapiens
  heavy chain complementarity determining region 3 for antibody 19062
ARHKQESGTRGFDF

SEQ ID NO: 38125 - protein, 9 aa, Homo sapiens
  light chain complementarity determining region 3 for antibody 19063
QQYYTPPLS

SEQ ID NO: 38126 - protein, 15 aa, Homo sapiens
  heavy chain complementarity determining region 3 for antibody 19063
ARGMSEGEMATTSEY

SEQ ID NO: 38127 - protein, 9 aa, Homo sapiens
  light chain complementarity determining region 3 for antibody 19064
QQYYTNPRT

SEQ ID NO: 38128 - protein, 11 aa, Homo sapiens
  heavy chain complementarity determining region 3 for antibody 19064
TRGQDRSKQGY

SEQ ID NO: 38129 - protein, 9 aa, Homo sapiens
  light chain complementarity determining region 3 for antibody 19065
QQYYSTPGT

SEQ ID NO: 38130 - protein, 15 aa, Homo sapiens
  heavy chain complementarity determining region 3 for antibody 19065
IRQSKVDNNYNYPDF

SEQ ID NO: 38131 - protein, 9 aa, Homo sapiens
  light chain complementarity determining region 3 for antibody 19066
QQYYSSPWT

SEQ ID NO: 38132 - protein, 16 aa, Homo sapiens
  heavy chain complementarity determining region 3 for antibody 19066
ARGSMVRDPRENWFDP

SEQ ID NO: 38133 - protein, 9 aa, Homo sapiens
  light chain complementarity determining region 3 for antibody 19067
QQYYSSLRT

SEQ ID NO: 38134 - protein, 12 aa, Homo sapiens
  heavy chain complementarity determining region 3 for antibody 19067
VKDCGLGGSRDS

SEQ ID NO: 38135 - protein, 9 aa, Homo sapiens
  light chain complementarity determining region 3 for antibody 19068
QQYYSSEYT

SEQ ID NO: 38136 - protein, 18 aa, Homo sapiens
  heavy chain complementarity determining region 3 for antibody 19068
GREREGYCHRSSCYAIDD

SEQ ID NO: 38137 - protein, 9 aa, Homo sapiens
  light chain complementarity determining region 3 for antibody 19069
QQYYSGPRT

SEQ ID NO: 38138 - protein, 17 aa, Homo sapiens
  heavy chain complementarity determining region 3 for antibody 19069
ARGNSGGGCNSCEYFPL

SEQ ID NO: 38139 - protein, 9 aa, Homo sapiens
  light chain complementarity determining region 3 for antibody 19070
QQYYISPLT

SEQ ID NO: 38140 - protein, 9 aa, Homo sapiens
  heavy chain complementarity determining region 3 for antibody 19070
LRIGGEKPY

SEQ ID NO: 38141 - protein, 9 aa, Homo sapiens
  light chain complementarity determining region 3 for antibody 19071
QQYYCYPVT

SEQ ID NO: 38142 - protein, 15 aa, Homo sapiens
  heavy chain complementarity determining region 3 for antibody 19071
AHGQHTTTVTSYFNF

SEQ ID NO: 38143 - protein, 11 aa, Homo sapiens
  light chain complementarity determining region 3 for antibody 19072
QQYVTSPPSDT

SEQ ID NO: 38144 - protein, 11 aa, Homo sapiens
  heavy chain complementarity determining region 3 for antibody 19072
AYSPGWWRIDC

SEQ ID NO: 38145 - protein, 9 aa, Homo sapiens
  light chain complementarity determining region 3 for antibody 19073
QQYVTSPFT

SEQ ID NO: 38146 - protein, 18 aa, Homo sapiens
  heavy chain complementarity determining region 3 for antibody 19073
ARGPPHLFSVNYRGPFDD

SEQ ID NO: 38147 - protein, 9 aa, Homo sapiens
  light chain complementarity determining region 3 for antibody 19074
QQYSSYPPT

SEQ ID NO: 38148 - protein, 17 aa, Homo sapiens
  heavy chain complementarity determining region 3 for antibody 19074
ARVPYCSTTTCYFPFDF

SEQ ID NO: 38149 - protein, 10 aa, Homo sapiens
  light chain complementarity determining region 3 for antibody 19075
QQYSSSPPWR

SEQ ID NO: 38150 - protein, 16 aa, Homo sapiens
  heavy chain complementarity determining region 3 for antibody 19075
ARRQWVRGLFRGGLDS

SEQ ID NO: 38151 - protein, 9 aa, Homo sapiens
  light chain complementarity determining region 3 for antibody 19076
QQYSSSLVA

SEQ ID NO: 38152 - protein, 15 aa, Homo sapiens
  heavy chain complementarity determining region 3 for antibody 19076
ARGGKSSSWLSYFDS

SEQ ID NO: 38153 - protein, 9 aa, Homo sapiens
  light chain complementarity determining region 3 for antibody 19077
QQYRRSPST

SEQ ID NO: 38154 - protein, 17 aa, Homo sapiens
  heavy chain complementarity determining region 3 for antibody 19077
AGLSSRLGDGSLSLFDY

SEQ ID NO: 38155 - protein, 9 aa, Homo sapiens
  light chain complementarity determining region 3 for antibody 19078
QQYRRSPST

SEQ ID NO: 38156 - protein, 17 aa, Homo sapiens
  heavy chain complementarity determining region 3 for antibody 19078
AGLSSRLGDGAPSLFDY

SEQ ID NO: 38157 - protein, 9 aa, Homo sapiens
  light chain complementarity determining region 3 for antibody 19079
QQYQNWPYT

SEQ ID NO: 38158 - protein, 11 aa, Homo sapiens
  heavy chain complementarity determining region 3 for antibody 19079
GGLYHGGPCGY

SEQ ID NO: 38159 - protein, 9 aa, Homo sapiens
  light chain complementarity determining region 3 for antibody 19080
QQYQGYPIT

SEQ ID NO: 38160 - protein, 14 aa, Homo sapiens
  heavy chain complementarity determining region 3 for antibody 19080
ARNSEGSGWFPCDY

SEQ ID NO: 38161 - protein, 9 aa, Homo sapiens
  light chain complementarity determining region 3 for antibody 19081
QQYNTWPRT

SEQ ID NO: 38162 - protein, 22 aa, Homo sapiens
  heavy chain complementarity determining region 3 for antibody 19081
AREVRASGYDAFYNYYYYGLDV

SEQ ID NO: 38163 - protein, 10 aa, Homo sapiens
  light chain complementarity determining region 3 for antibody 19082
QQYNTWPPDP

SEQ ID NO: 38164 - protein, 13 aa, Homo sapiens
  heavy chain complementarity determining region 3 for antibody 19082
ARGIIPVAGLLDY

SEQ ID NO: 38165 - protein, 8 aa, Homo sapiens
  light chain complementarity determining region 3 for antibody 19083
QQYNTWLR

SEQ ID NO: 38166 - protein, 12 aa, Homo sapiens
  heavy chain complementarity determining region 3 for antibody 19083
ARLLWDSYYFDS

SEQ ID NO: 38167 - protein, 9 aa, Homo sapiens
  light chain complementarity determining region 3 for antibody 19084
QQYNSYLYT

SEQ ID NO: 38168 - protein, 12 aa, Homo sapiens
  heavy chain complementarity determining region 3 for antibody 19084
ARALGWRAWFDP

SEQ ID NO: 38169 - protein, 9 aa, Homo sapiens
  light chain complementarity determining region 3 for antibody 19085
QQYNRSPRT

SEQ ID NO: 38170 - protein, 16 aa, Homo sapiens
  heavy chain complementarity determining region 3 for antibody 19085
VKDFTGECHYGSWVGP

SEQ ID NO: 38171 - protein, 10 aa, Homo sapiens
  light chain complementarity determining region 3 for antibody 19086
QQYNQWPPLT

SEQ ID NO: 38172 - protein, 17 aa, Homo sapiens
  heavy chain complementarity determining region 3 for antibody 19086
ARDLYLSIIQGGGAFDA

SEQ ID NO: 38173 - protein, 9 aa, Homo sapiens
  light chain complementarity determining region 3 for antibody 19087
QQYNNWPRP

SEQ ID NO: 38174 - protein, 14 aa, Homo sapiens
  heavy chain complementarity determining region 3 for antibody 19087
ATAPGYYSSSPFDY

SEQ ID NO: 38175 - protein, 10 aa, Homo sapiens
  light chain complementarity determining region 3 for antibody 19088
QQYNNWPPST

SEQ ID NO: 38176 - protein, 17 aa, Homo sapiens
  heavy chain complementarity determining region 3 for antibody 19088
ARDVPSYFSVVRGVIDY

SEQ ID NO: 38177 - protein, 11 aa, Homo sapiens
  light chain complementarity determining region 3 for antibody 19089
QQYNNWPLPLP

SEQ ID NO: 38178 - protein, 17 aa, Homo sapiens
  heavy chain complementarity determining region 3 for antibody 19089
AREGMVRGVTYPPYFDY

SEQ ID NO: 38179 - protein, 10 aa, Homo sapiens
  light chain complementarity determining region 3 for antibody 19090
QQYNKWPPWT

SEQ ID NO: 38180 - protein, 15 aa, Homo sapiens
  heavy chain complementarity determining region 3 for antibody 19090
AKDFWAAAGNTAFDH

SEQ ID NO: 38181 - protein, 9 aa, Homo sapiens
  light chain complementarity determining region 3 for antibody 19091
QQYLNWPYT

SEQ ID NO: 38182 - protein, 11 aa, Homo sapiens
  heavy chain complementarity determining region 3 for antibody 19091
GAYYHGGPCGY

SEQ ID NO: 38183 - protein, 8 aa, Homo sapiens
  light chain complementarity determining region 3 for antibody 19092
QQYIDWWT

SEQ ID NO: 38184 - protein, 16 aa, Homo sapiens
  heavy chain complementarity determining region 3 for antibody 19092
ARHGYHGWGYRGWFDP

SEQ ID NO: 38185 - protein, 9 aa, Homo sapiens
  light chain complementarity determining region 3 for antibody 19093
QQYHSSPTT

SEQ ID NO: 38186 - protein, 14 aa, Homo sapiens
  heavy chain complementarity determining region 3 for antibody 19093
AKESSVYGVYPYDS

SEQ ID NO: 38187 - protein, 9 aa, Homo sapiens
  light chain complementarity determining region 3 for antibody 19094
QQYHSNPPT

SEQ ID NO: 38188 - protein, 20 aa, Homo sapiens
  heavy chain complementarity determining region 3 for antibody 19094
ARARSKTTVVTPTRQFASDI

SEQ ID NO: 38189 - protein, 9 aa, Homo sapiens
  light chain complementarity determining region 3 for antibody 19095
QQYHRDPLT

SEQ ID NO: 38190 - protein, 10 aa, Homo sapiens
  heavy chain complementarity determining region 3 for antibody 19095
AGGTGWILDT

SEQ ID NO: 38191 - protein, 10 aa, Homo sapiens
  light chain complementarity determining region 3 for antibody 19096
QQYHNWSPWT

SEQ ID NO: 38192 - protein, 21 aa, Homo sapiens
  heavy chain complementarity determining region 3 for antibody 19096
ARAGRGDDYGDYRTDPGWFEA

SEQ ID NO: 38193 - protein, 9 aa, Homo sapiens
  light chain complementarity determining region 3 for antibody 19097
QQYGYSARP

SEQ ID NO: 38194 - protein, 13 aa, Homo sapiens
  heavy chain complementarity determining region 3 for antibody 19097
ARGCFYSDGYIED

SEQ ID NO: 38195 - protein, 9 aa, Homo sapiens
  light chain complementarity determining region 3 for antibody 19098
QQYGTTPRT

SEQ ID NO: 38196 - protein, 13 aa, Homo sapiens
  heavy chain complementarity determining region 3 for antibody 19098
AGGLFDRRGYSDF

SEQ ID NO: 38197 - protein, 8 aa, Homo sapiens
  light chain complementarity determining region 3 for antibody 19099
QQYGTSRM

SEQ ID NO: 38198 - protein, 13 aa, Homo sapiens
  heavy chain complementarity determining region 3 for antibody 19099
ARGQFGGSAYYEN

SEQ ID NO: 38199 - protein, 10 aa, Homo sapiens
  light chain complementarity determining region 3 for antibody 19100
QQYGTSPTRT

SEQ ID NO: 38200 - protein, 18 aa, Homo sapiens
  heavy chain complementarity determining region 3 for antibody 19100
ARAPRDTMIVVRYYGMDV

SEQ ID NO: 38201 - protein, 10 aa, Homo sapiens
  light chain complementarity determining region 3 for antibody 19101
QQYGTSPTGT

SEQ ID NO: 38202 - protein, 18 aa, Homo sapiens
  heavy chain complementarity determining region 3 for antibody 19101
ARAPRDTMIVVRYYGMDV

SEQ ID NO: 38203 - protein, 9 aa, Homo sapiens
  light chain complementarity determining region 3 for antibody 19102
QQYGTSPRT

SEQ ID NO: 38204 - protein, 14 aa, Homo sapiens
  heavy chain complementarity determining region 3 for antibody 19102
AGGDLCGRDCYSEY

SEQ ID NO: 38205 - protein, 9 aa, Homo sapiens
  light chain complementarity determining region 3 for antibody 19103
QQYGTSPRT

SEQ ID NO: 38206 - protein, 14 aa, Homo sapiens
  heavy chain complementarity determining region 3 for antibody 19103
AGGDFCGRDCYSDY

SEQ ID NO: 38207 - protein, 9 aa, Homo sapiens
  light chain complementarity determining region 3 for antibody 19104
QQYGTSPRT

SEQ ID NO: 38208 - protein, 14 aa, Homo sapiens
  heavy chain complementarity determining region 3 for antibody 19104
AGGDCCGRDCYSEY

SEQ ID NO: 38209 - protein, 9 aa, Homo sapiens
  light chain complementarity determining region 3 for antibody 19105
QQYGTSPRP

SEQ ID NO: 38210 - protein, 13 aa, Homo sapiens
  heavy chain complementarity determining region 3 for antibody 19105
AGGYFDRSGYYEY

SEQ ID NO: 38211 - protein, 11 aa, Homo sapiens
  light chain complementarity determining region 3 for antibody 19106
QQYGTSPPKAT

SEQ ID NO: 38212 - protein, 11 aa, Homo sapiens
  heavy chain complementarity determining region 3 for antibody 19106
AKPSAGTTGDY

SEQ ID NO: 38213 - protein, 9 aa, Homo sapiens
  light chain complementarity determining region 3 for antibody 19107
QQYGTSPFT

SEQ ID NO: 38214 - protein, 15 aa, Homo sapiens
  heavy chain complementarity determining region 3 for antibody 19107
ARQSDFLSGPGEFDP

SEQ ID NO: 38215 - protein, 9 aa, Homo sapiens
  light chain complementarity determining region 3 for antibody 19108
QQYGTSPFT

SEQ ID NO: 38216 - protein, 15 aa, Homo sapiens
  heavy chain complementarity determining region 3 for antibody 19108
ARQNDFVSGPGEFDP

SEQ ID NO: 38217 - protein, 9 aa, Homo sapiens
  light chain complementarity determining region 3 for antibody 19109
QQYGTSPFT

SEQ ID NO: 38218 - protein, 15 aa, Homo sapiens
  heavy chain complementarity determining region 3 for antibody 19109
ARQNAFLSGPGEFDP

SEQ ID NO: 38219 - protein, 9 aa, Homo sapiens
  light chain complementarity determining region 3 for antibody 19110
QQYGTSPFP

SEQ ID NO: 38220 - protein, 18 aa, Homo sapiens
  heavy chain complementarity determining region 3 for antibody 19110
ARFEKWELRRGYYYGMDV

SEQ ID NO: 38221 - protein, 9 aa, Homo sapiens
  light chain complementarity determining region 3 for antibody 19111
QQYGTSPFN

SEQ ID NO: 38222 - protein, 15 aa, Homo sapiens
  heavy chain complementarity determining region 3 for antibody 19111
ARQNDFLSGPGEFDP

SEQ ID NO: 38223 - protein, 8 aa, Homo sapiens
  light chain complementarity determining region 3 for antibody 19112
QQYGTSLT

SEQ ID NO: 38224 - protein, 14 aa, Homo sapiens
  heavy chain complementarity determining region 3 for antibody 19112
ARAGSYYADWSFDL

SEQ ID NO: 38225 - protein, 9 aa, Homo sapiens
  light chain complementarity determining region 3 for antibody 19113
QQYGTPPRK

SEQ ID NO: 38226 - protein, 25 aa, Homo sapiens
  heavy chain complementarity determining region 3 for antibody 19113
ARLRVDRLRLPGAMRGPLYDRGLNV

SEQ ID NO: 38227 - protein, 9 aa, Homo sapiens
  light chain complementarity determining region 3 for antibody 19114
QQYGTPPLT

SEQ ID NO: 38228 - protein, 18 aa, Homo sapiens
  heavy chain complementarity determining region 3 for antibody 19114
ARCVAAAAKWGVYWYFDL

SEQ ID NO: 38229 - protein, 6 aa, Homo sapiens
  light chain complementarity determining region 3 for antibody 19115
QQYGTP

SEQ ID NO: 38230 - protein, 12 aa, Homo sapiens
  heavy chain complementarity determining region 3 for antibody 19115
ARDADAGYAQDC

SEQ ID NO: 38231 - protein, 9 aa, Homo sapiens
  light chain complementarity determining region 3 for antibody 19116
QQYGTLPRT

SEQ ID NO: 38232 - protein, 25 aa, Homo sapiens
  heavy chain complementarity determining region 3 for antibody 19116
ARLRVDRLRLPGAMRGPLYDRGLNV

SEQ ID NO: 38233 - protein, 9 aa, Homo sapiens
  light chain complementarity determining region 3 for antibody 19117
QQYGTLPRT

SEQ ID NO: 38234 - protein, 13 aa, Homo sapiens
  heavy chain complementarity determining region 3 for antibody 19117
AGGNFHSGGYGEY

SEQ ID NO: 38235 - protein, 9 aa, Homo sapiens
  light chain complementarity determining region 3 for antibody 19118
QQYGTKPRT

SEQ ID NO: 38236 - protein, 13 aa, Homo sapiens
  heavy chain complementarity determining region 3 for antibody 19118
AGGLFDSSGYSEF

SEQ ID NO: 38237 - protein, 9 aa, Homo sapiens
  light chain complementarity determining region 3 for antibody 19119
QQYGTIPRT

SEQ ID NO: 38238 - protein, 13 aa, Homo sapiens
  heavy chain complementarity determining region 3 for antibody 19119
AGGLFHSSGYSEF

SEQ ID NO: 38239 - protein, 9 aa, Homo sapiens
  light chain complementarity determining region 3 for antibody 19120
QQYGTIPRT

SEQ ID NO: 38240 - protein, 13 aa, Homo sapiens
  heavy chain complementarity determining region 3 for antibody 19120
AGGAFSGRNYKED

SEQ ID NO: 38241 - protein, 9 aa, Homo sapiens
  light chain complementarity determining region 3 for antibody 19121
QQYGTHPRT

SEQ ID NO: 38242 - protein, 25 aa, Homo sapiens
  heavy chain complementarity determining region 3 for antibody 19121
ARLRVDRLRLPGAMRGPLYDRGLNV

SEQ ID NO: 38243 - protein, 9 aa, Homo sapiens
  light chain complementarity determining region 3 for antibody 19122
QQYGTFPRT

SEQ ID NO: 38244 - protein, 14 aa, Homo sapiens
  heavy chain complementarity determining region 3 for antibody 19122
AGGEFCGGDCYSEY

SEQ ID NO: 38245 - protein, 9 aa, Homo sapiens
  light chain complementarity determining region 3 for antibody 19123
QQYGSTVGP

SEQ ID NO: 38246 - protein, 9 aa, Homo sapiens
  heavy chain complementarity determining region 3 for antibody 19123
ARMYSGLDY

SEQ ID NO: 38247 - protein, 10 aa, Homo sapiens
  light chain complementarity determining region 3 for antibody 19124
QQYGSSVPWT

SEQ ID NO: 38248 - protein, 13 aa, Homo sapiens
  heavy chain complementarity determining region 3 for antibody 19124
AHGRRRSWDSFDY

SEQ ID NO: 38249 - protein, 10 aa, Homo sapiens
  light chain complementarity determining region 3 for antibody 19125
QQYGSSVPGT

SEQ ID NO: 38250 - protein, 13 aa, Homo sapiens
  heavy chain complementarity determining region 3 for antibody 19125
AHGRRSSWDSFDY

SEQ ID NO: 38251 - protein, 9 aa, Homo sapiens
  light chain complementarity determining region 3 for antibody 19126
QQYGSSPYT

SEQ ID NO: 38252 - protein, 15 aa, Homo sapiens
  heavy chain complementarity determining region 3 for antibody 19126
AREGGYCGGDCSFDY

SEQ ID NO: 38253 - protein, 10 aa, Homo sapiens
  light chain complementarity determining region 3 for antibody 19127
QQYGSSPTYS

SEQ ID NO: 38254 - protein, 11 aa, Homo sapiens
  heavy chain complementarity determining region 3 for antibody 19127
ARGGQWGSLDY

SEQ ID NO: 38255 - protein, 9 aa, Homo sapiens
  light chain complementarity determining region 3 for antibody 19128
QQYGSSPRT

SEQ ID NO: 38256 - protein, 17 aa, Homo sapiens
  heavy chain complementarity determining region 3 for antibody 19128
TTDPQWLEPPPCLTNDY

SEQ ID NO: 38257 - protein, 9 aa, Homo sapiens
  light chain complementarity determining region 3 for antibody 19129
QQYGSSPRT

SEQ ID NO: 38258 - protein, 17 aa, Homo sapiens
  heavy chain complementarity determining region 3 for antibody 19129
ARVRSFYYDTSGHYYVF

SEQ ID NO: 38259 - protein, 9 aa, Homo sapiens
  light chain complementarity determining region 3 for antibody 19130
QQYGSSPRT

SEQ ID NO: 38260 - protein, 25 aa, Homo sapiens
  heavy chain complementarity determining region 3 for antibody 19130
ARRRIDRLRLPGAMRGPLYDCGLNV

SEQ ID NO: 38261 - protein, 9 aa, Homo sapiens
  light chain complementarity determining region 3 for antibody 19131
QQYGSSPPT

SEQ ID NO: 38262 - protein, 16 aa, Homo sapiens
  heavy chain complementarity determining region 3 for antibody 19131
ARDFHPRAASDTAYDS

SEQ ID NO: 38263 - protein, 10 aa, Homo sapiens
  light chain complementarity determining region 3 for antibody 19132
QQYGSSPMYS

SEQ ID NO: 38264 - protein, 11 aa, Homo sapiens
  heavy chain complementarity determining region 3 for antibody 19132
ARGGHWGSLDY

SEQ ID NO: 38265 - protein, 9 aa, Homo sapiens
  light chain complementarity determining region 3 for antibody 19133
QQYGSSPLT

SEQ ID NO: 38266 - protein, 13 aa, Homo sapiens
  heavy chain complementarity determining region 3 for antibody 19133
ASGYFDRSGYYEY

SEQ ID NO: 38267 - protein, 9 aa, Homo sapiens
  light chain complementarity determining region 3 for antibody 19134
QQYGSSLYP

SEQ ID NO: 38268 - protein, 16 aa, Homo sapiens
  heavy chain complementarity determining region 3 for antibody 19134
ARAKHYGDYYYYGMDA

SEQ ID NO: 38269 - protein, 9 aa, Homo sapiens
  light chain complementarity determining region 3 for antibody 19135
QQYGSPPRT

SEQ ID NO: 38270 - protein, 25 aa, Homo sapiens
  heavy chain complementarity determining region 3 for antibody 19135
ARLRIDRLRLPGAMRGPLYDCGLNV

SEQ ID NO: 38271 - protein, 9 aa, Homo sapiens
  light chain complementarity determining region 3 for antibody 19136
QQYGSPPRT

SEQ ID NO: 38272 - protein, 15 aa, Homo sapiens
  heavy chain complementarity determining region 3 for antibody 19136
AKTYDFWSGDDAFEI

SEQ ID NO: 38273 - protein, 9 aa, Homo sapiens
  light chain complementarity determining region 3 for antibody 19137
QQYGSPPRP

SEQ ID NO: 38274 - protein, 14 aa, Homo sapiens
  heavy chain complementarity determining region 3 for antibody 19137
AGGNFCGYDCYSEY

SEQ ID NO: 38275 - protein, 9 aa, Homo sapiens
  light chain complementarity determining region 3 for antibody 19138
QQYGSLPRT

SEQ ID NO: 38276 - protein, 18 aa, Homo sapiens
  heavy chain complementarity determining region 3 for antibody 19138
ATAFWVGLGVPPPGFFEY

SEQ ID NO: 38277 - protein, 9 aa, Homo sapiens
  light chain complementarity determining region 3 for antibody 19139
QQYGSLPRT

SEQ ID NO: 38278 - protein, 15 aa, Homo sapiens
  heavy chain complementarity determining region 3 for antibody 19139
AHRPNYYDKAGAFDI

SEQ ID NO: 38279 - protein, 9 aa, Homo sapiens
  light chain complementarity determining region 3 for antibody 19140
QQYGSLPRT

SEQ ID NO: 38280 - protein, 13 aa, Homo sapiens
  heavy chain complementarity determining region 3 for antibody 19140
AGGGFSSGRYSDY

SEQ ID NO: 38281 - protein, 9 aa, Homo sapiens
  light chain complementarity determining region 3 for antibody 19141
QQYGSLPRT

SEQ ID NO: 38282 - protein, 14 aa, Homo sapiens
  heavy chain complementarity determining region 3 for antibody 19141
AGGDCCGGDCYSEY

SEQ ID NO: 38283 - protein, 9 aa, Homo sapiens
  light chain complementarity determining region 3 for antibody 19142
QQYGSLPLT

SEQ ID NO: 38284 - protein, 15 aa, Homo sapiens
  heavy chain complementarity determining region 3 for antibody 19142
AHRPNYYDKAGAFDL

SEQ ID NO: 38285 - protein, 9 aa, Homo sapiens
  light chain complementarity determining region 3 for antibody 19143
QQYGSLPLT

SEQ ID NO: 38286 - protein, 15 aa, Homo sapiens
  heavy chain complementarity determining region 3 for antibody 19143
AHRPNDYDKAGAFDI

SEQ ID NO: 38287 - protein, 9 aa, Homo sapiens
  light chain complementarity determining region 3 for antibody 19144
QQYGSLPIT

SEQ ID NO: 38288 - protein, 15 aa, Homo sapiens
  heavy chain complementarity determining region 3 for antibody 19144
AHRPNYYDKAGAFDI

SEQ ID NO: 38289 - protein, 9 aa, Homo sapiens
  light chain complementarity determining region 3 for antibody 19145
QQYGSLLLT

SEQ ID NO: 38290 - protein, 15 aa, Homo sapiens
  heavy chain complementarity determining region 3 for antibody 19145
AHRPNYYDKAGAFDI

SEQ ID NO: 38291 - protein, 9 aa, Homo sapiens
  light chain complementarity determining region 3 for antibody 19146
QQYGSIPRT

SEQ ID NO: 38292 - protein, 13 aa, Homo sapiens
  heavy chain complementarity determining region 3 for antibody 19146
AGVGFSSGRYSEY

SEQ ID NO: 38293 - protein, 9 aa, Homo sapiens
  light chain complementarity determining region 3 for antibody 19147
QQYGSIPRT

SEQ ID NO: 38294 - protein, 13 aa, Homo sapiens
  heavy chain complementarity determining region 3 for antibody 19147
AGGSVSGGNYKED

SEQ ID NO: 38295 - protein, 9 aa, Homo sapiens
  light chain complementarity determining region 3 for antibody 19148
QQYGSIPRT

SEQ ID NO: 38296 - protein, 13 aa, Homo sapiens
  heavy chain complementarity determining region 3 for antibody 19148
AGGSFSGGTYKED

SEQ ID NO: 38297 - protein, 9 aa, Homo sapiens
  light chain complementarity determining region 3 for antibody 19149
QQYGSIPRT

SEQ ID NO: 38298 - protein, 13 aa, Homo sapiens
  heavy chain complementarity determining region 3 for antibody 19149
AGGSFASGRYSED

SEQ ID NO: 38299 - protein, 9 aa, Homo sapiens
  light chain complementarity determining region 3 for antibody 19150
QQYGSIPRT

SEQ ID NO: 38300 - protein, 13 aa, Homo sapiens
  heavy chain complementarity determining region 3 for antibody 19150
AGGLYDSSGYSEF

SEQ ID NO: 38301 - protein, 9 aa, Homo sapiens
  light chain complementarity determining region 3 for antibody 19151
QQYGSIPRT

SEQ ID NO: 38302 - protein, 14 aa, Homo sapiens
  heavy chain complementarity determining region 3 for antibody 19151
AGGDCCGSDCYSEY

SEQ ID NO: 38303 - protein, 9 aa, Homo sapiens
  light chain complementarity determining region 3 for antibody 19152
QQYGSIPRP

SEQ ID NO: 38304 - protein, 13 aa, Homo sapiens
  heavy chain complementarity determining region 3 for antibody 19152
AGGTWHSGIYYES

SEQ ID NO: 38305 - protein, 9 aa, Homo sapiens
  light chain complementarity determining region 3 for antibody 19153
QQYGSIPLT

SEQ ID NO: 38306 - protein, 7 aa, Homo sapiens
  heavy chain complementarity determining region 3 for antibody 19153
HGYELNC

SEQ ID NO: 38307 - protein, 9 aa, Homo sapiens
  light chain complementarity determining region 3 for antibody 19154
QQYGSIPLT

SEQ ID NO: 38308 - protein, 7 aa, Homo sapiens
  heavy chain complementarity determining region 3 for antibody 19154
HGYELKY

SEQ ID NO: 38309 - protein, 9 aa, Homo sapiens
  light chain complementarity determining region 3 for antibody 19155
QQYGSIPLT

SEQ ID NO: 38310 - protein, 7 aa, Homo sapiens
  heavy chain complementarity determining region 3 for antibody 19155
HGYELEC

SEQ ID NO: 38311 - protein, 9 aa, Homo sapiens
  light chain complementarity determining region 3 for antibody 19156
QQYGSIPIT

SEQ ID NO: 38312 - protein, 7 aa, Homo sapiens
  heavy chain complementarity determining region 3 for antibody 19156
HGYELKC

SEQ ID NO: 38313 - protein, 9 aa, Homo sapiens
  light chain complementarity determining region 3 for antibody 19157
QQYGSIPHT

SEQ ID NO: 38314 - protein, 14 aa, Homo sapiens
  heavy chain complementarity determining region 3 for antibody 19157
AGGEFSSGWHYSEN

SEQ ID NO: 38315 - protein, 9 aa, Homo sapiens
  light chain complementarity determining region 3 for antibody 19158
QQYGSIPFT

SEQ ID NO: 38316 - protein, 7 aa, Homo sapiens
  heavy chain complementarity determining region 3 for antibody 19158
HGYELKC

SEQ ID NO: 38317 - protein, 9 aa, Homo sapiens
  light chain complementarity determining region 3 for antibody 19159
QQYGSFPHT

SEQ ID NO: 38318 - protein, 14 aa, Homo sapiens
  heavy chain complementarity determining region 3 for antibody 19159
ARGGGSDWYGLLYY

SEQ ID NO: 38319 - protein, 9 aa, Homo sapiens
  light chain complementarity determining region 3 for antibody 19160
QQYGRSLYT

SEQ ID NO: 38320 - protein, 16 aa, Homo sapiens
  heavy chain complementarity determining region 3 for antibody 19160
ARAKHYGDYYYYGMDA

SEQ ID NO: 38321 - protein, 9 aa, Homo sapiens
  light chain complementarity determining region 3 for antibody 19161
QQYGRLPRT

SEQ ID NO: 38322 - protein, 13 aa, Homo sapiens
  heavy chain complementarity determining region 3 for antibody 19161
AGGGFSSGRYSEY

SEQ ID NO: 38323 - protein, 9 aa, Homo sapiens
  light chain complementarity determining region 3 for antibody 19162
QQYGRKPRT

SEQ ID NO: 38324 - protein, 13 aa, Homo sapiens
  heavy chain complementarity determining region 3 for antibody 19162
AGGLFGSGTYSEF

SEQ ID NO: 38325 - protein, 9 aa, Homo sapiens
  light chain complementarity determining region 3 for antibody 19163
QQYGRIPRS

SEQ ID NO: 38326 - protein, 13 aa, Homo sapiens
  heavy chain complementarity determining region 3 for antibody 19163
AGGTWHSSAYYDS

SEQ ID NO: 38327 - protein, 9 aa, Homo sapiens
  light chain complementarity determining region 3 for antibody 19164
QQYGRIPRS

SEQ ID NO: 38328 - protein, 13 aa, Homo sapiens
  heavy chain complementarity determining region 3 for antibody 19164
AGGTWHSGIYYES

SEQ ID NO: 38329 - protein, 9 aa, Homo sapiens
  light chain complementarity determining region 3 for antibody 19165
QQYGRIPRK

SEQ ID NO: 38330 - protein, 13 aa, Homo sapiens
  heavy chain complementarity determining region 3 for antibody 19165
AGGLFGSGTYSEF

SEQ ID NO: 38331 - protein, 10 aa, Homo sapiens
  light chain complementarity determining region 3 for antibody 19166
QQYGNSPTGT

SEQ ID NO: 38332 - protein, 19 aa, Homo sapiens
  heavy chain complementarity determining region 3 for antibody 19166
ARAEYYYDSGGYRPYYFDY

SEQ ID NO: 38333 - protein, 9 aa, Homo sapiens
  light chain complementarity determining region 3 for antibody 19167
QQYGNSPRT

SEQ ID NO: 38334 - protein, 15 aa, Homo sapiens
  heavy chain complementarity determining region 3 for antibody 19167
AGGWFNYYSSGYYEA

SEQ ID NO: 38335 - protein, 9 aa, Homo sapiens
  light chain complementarity determining region 3 for antibody 19168
QQYGNSPLT

SEQ ID NO: 38336 - protein, 13 aa, Homo sapiens
  heavy chain complementarity determining region 3 for antibody 19168
ASKTSVRTCSSDL

SEQ ID NO: 38337 - protein, 8 aa, Homo sapiens
  light chain complementarity determining region 3 for antibody 19169
QQYGNSPF

SEQ ID NO: 38338 - protein, 20 aa, Homo sapiens
  heavy chain complementarity determining region 3 for antibody 19169
ARGPPGYDTSGYSRNWYFDL

SEQ ID NO: 38339 - protein, 9 aa, Homo sapiens
  light chain complementarity determining region 3 for antibody 19170
QQYGNPPRT

SEQ ID NO: 38340 - protein, 25 aa, Homo sapiens
  heavy chain complementarity determining region 3 for antibody 19170
ARLRVDRLRLPGAMRGPLYDRGLNV

SEQ ID NO: 38341 - protein, 9 aa, Homo sapiens
  light chain complementarity determining region 3 for antibody 19171
QQYGNLPWT

SEQ ID NO: 38342 - protein, 13 aa, Homo sapiens
  heavy chain complementarity determining region 3 for antibody 19171
AGGNFHSGGYGEY

SEQ ID NO: 38343 - protein, 9 aa, Homo sapiens
  light chain complementarity determining region 3 for antibody 19172
QQYGNLPRT

SEQ ID NO: 38344 - protein, 13 aa, Homo sapiens
  heavy chain complementarity determining region 3 for antibody 19172
ASGYGSGTYYREN

SEQ ID NO: 38345 - protein, 9 aa, Homo sapiens
  light chain complementarity determining region 3 for antibody 19173
QQYGNLPRT

SEQ ID NO: 38346 - protein, 13 aa, Homo sapiens
  heavy chain complementarity determining region 3 for antibody 19173
ARGQYERSGYKDN

SEQ ID NO: 38347 - protein, 9 aa, Homo sapiens
  light chain complementarity determining region 3 for antibody 19174
QQYGNLPRT

SEQ ID NO: 38348 - protein, 13 aa, Homo sapiens
  heavy chain complementarity determining region 3 for antibody 19174
AGGQFHSSGSSEF

SEQ ID NO: 38349 - protein, 9 aa, Homo sapiens
  light chain complementarity determining region 3 for antibody 19175
QQYGNLPRT

SEQ ID NO: 38350 - protein, 13 aa, Homo sapiens
  heavy chain complementarity determining region 3 for antibody 19175
AGGDVHSGGYSEF

SEQ ID NO: 38351 - protein, 9 aa, Homo sapiens
  light chain complementarity determining region 3 for antibody 19176
QQYGNLPRP

SEQ ID NO: 38352 - protein, 13 aa, Homo sapiens
  heavy chain complementarity determining region 3 for antibody 19176
AGGQFHSSGYSEF

SEQ ID NO: 38353 - protein, 9 aa, Homo sapiens
  light chain complementarity determining region 3 for antibody 19177
QQYGNLPRP

SEQ ID NO: 38354 - protein, 13 aa, Homo sapiens
  heavy chain complementarity determining region 3 for antibody 19177
AGGNFHSGGYGEY

SEQ ID NO: 38355 - protein, 9 aa, Homo sapiens
  light chain complementarity determining region 3 for antibody 19178
QQYGNLPRK

SEQ ID NO: 38356 - protein, 13 aa, Homo sapiens
  heavy chain complementarity determining region 3 for antibody 19178
AGGNFHSGGYGEY

SEQ ID NO: 38357 - protein, 9 aa, Homo sapiens
  light chain complementarity determining region 3 for antibody 19179
QQYGNIPRS

SEQ ID NO: 38358 - protein, 13 aa, Homo sapiens
  heavy chain complementarity determining region 3 for antibody 19179
AGGTWHSGTYCES

SEQ ID NO: 38359 - protein, 9 aa, Homo sapiens
  light chain complementarity determining region 3 for antibody 19180
QQYGNIPRS

SEQ ID NO: 38360 - protein, 13 aa, Homo sapiens
  heavy chain complementarity determining region 3 for antibody 19180
AGGTWHSGTCYES

SEQ ID NO: 38361 - protein, 9 aa, Homo sapiens
  light chain complementarity determining region 3 for antibody 19181
QQYGNIPRP

SEQ ID NO: 38362 - protein, 14 aa, Homo sapiens
  heavy chain complementarity determining region 3 for antibody 19181
AGGTFDSSGYYYEY

SEQ ID NO: 38363 - protein, 9 aa, Homo sapiens
  light chain complementarity determining region 3 for antibody 19182
QQYGHLPRT

SEQ ID NO: 38364 - protein, 13 aa, Homo sapiens
  heavy chain complementarity determining region 3 for antibody 19182
AGGDFHSGGYSEF

SEQ ID NO: 38365 - protein, 9 aa, Homo sapiens
  light chain complementarity determining region 3 for antibody 19183
QQYGGSPRT

SEQ ID NO: 38366 - protein, 13 aa, Homo sapiens
  heavy chain complementarity determining region 3 for antibody 19183
ASGYFDSGAYCEF

SEQ ID NO: 38367 - protein, 9 aa, Homo sapiens
  light chain complementarity determining region 3 for antibody 19184
QQYGGSPRT

SEQ ID NO: 38368 - protein, 13 aa, Homo sapiens
  heavy chain complementarity determining region 3 for antibody 19184
ASGCFDSGAYYDF

SEQ ID NO: 38369 - protein, 9 aa, Homo sapiens
  light chain complementarity determining region 3 for antibody 19185
QQYGGSPRA

SEQ ID NO: 38370 - protein, 13 aa, Homo sapiens
  heavy chain complementarity determining region 3 for antibody 19185
AAGYFSSGTYYEY

SEQ ID NO: 38371 - protein, 10 aa, Homo sapiens
  light chain complementarity determining region 3 for antibody 19186
QQYGGSPMYT

SEQ ID NO: 38372 - protein, 18 aa, Homo sapiens
  heavy chain complementarity determining region 3 for antibody 19186
ARERGYCSGGSCYPRPLN

SEQ ID NO: 38373 - protein, 9 aa, Homo sapiens
  light chain complementarity determining region 3 for antibody 19187
QQYGGPPRT

SEQ ID NO: 38374 - protein, 13 aa, Homo sapiens
  heavy chain complementarity determining region 3 for antibody 19187
AAGYFSSGTYYEY

SEQ ID NO: 38375 - protein, 9 aa, Homo sapiens
  light chain complementarity determining region 3 for antibody 19188
QQYGFSPYI

SEQ ID NO: 38376 - protein, 11 aa, Homo sapiens
  heavy chain complementarity determining region 3 for antibody 19188
TRGYIEVIGDC

SEQ ID NO: 38377 - protein, 9 aa, Homo sapiens
  light chain complementarity determining region 3 for antibody 19189
QQYGDSPYT

SEQ ID NO: 38378 - protein, 22 aa, Homo sapiens
  heavy chain complementarity determining region 3 for antibody 19189
TGRRPTGRTSFRRGGRQGAFDI

SEQ ID NO: 38379 - protein, 9 aa, Homo sapiens
  light chain complementarity determining region 3 for antibody 19190
QQYGDSPVT

SEQ ID NO: 38380 - protein, 18 aa, Homo sapiens
  heavy chain complementarity determining region 3 for antibody 19190
AKIADAAFAASHRGYFDD

SEQ ID NO: 38381 - protein, 11 aa, Homo sapiens
  light chain complementarity determining region 3 for antibody 19191
QQYGDSPPMSP

SEQ ID NO: 38382 - protein, 12 aa, Homo sapiens
  heavy chain complementarity determining region 3 for antibody 19191
AGQGDRSYSYSY

SEQ ID NO: 38383 - protein, 9 aa, Homo sapiens
  light chain complementarity determining region 3 for antibody 19192
QQYGCSPRT

SEQ ID NO: 38384 - protein, 13 aa, Homo sapiens
  heavy chain complementarity determining region 3 for antibody 19192
AAGYFSSGTYYEY

SEQ ID NO: 38385 - protein, 9 aa, Homo sapiens
  light chain complementarity determining region 3 for antibody 19193
QQYGCIPLT

SEQ ID NO: 38386 - protein, 7 aa, Homo sapiens
  heavy chain complementarity determining region 3 for antibody 19193
HGYELKC

SEQ ID NO: 38387 - protein, 11 aa, Homo sapiens
  light chain complementarity determining region 3 for antibody 19194
QQYGASPPMYT

SEQ ID NO: 38388 - protein, 12 aa, Homo sapiens
  heavy chain complementarity determining region 3 for antibody 19194
AGQGDRSYSYSY

SEQ ID NO: 38389 - protein, 9 aa, Homo sapiens
  light chain complementarity determining region 3 for antibody 19195
QQYFISPPT

SEQ ID NO: 38390 - protein, 15 aa, Homo sapiens
  heavy chain complementarity determining region 3 for antibody 19195
VKVLMSGTQIALFDQ

SEQ ID NO: 38391 - protein, 9 aa, Homo sapiens
  light chain complementarity determining region 3 for antibody 19196
QQYERSPQP

SEQ ID NO: 38392 - protein, 15 aa, Homo sapiens
  heavy chain complementarity determining region 3 for antibody 19196
ARDPTVASHHYGVDV

SEQ ID NO: 38393 - protein, 9 aa, Homo sapiens
  light chain complementarity determining region 3 for antibody 19197
QQYERSPPT

SEQ ID NO: 38394 - protein, 15 aa, Homo sapiens
  heavy chain complementarity determining region 3 for antibody 19197
ARDPTVASHHYGVDV

SEQ ID NO: 38395 - protein, 8 aa, Homo sapiens
  light chain complementarity determining region 3 for antibody 19198
QQYENLVT

SEQ ID NO: 38396 - protein, 18 aa, Homo sapiens
  heavy chain complementarity determining region 3 for antibody 19198
AKGAEGSCSVRKCYPFDS

SEQ ID NO: 38397 - protein, 8 aa, Homo sapiens
  light chain complementarity determining region 3 for antibody 19199
QQYENLVP

SEQ ID NO: 38398 - protein, 18 aa, Homo sapiens
  heavy chain complementarity determining region 3 for antibody 19199
AKGAEGSCSVRKCYPFDY

SEQ ID NO: 38399 - protein, 11 aa, Homo sapiens
  light chain complementarity determining region 3 for antibody 19200
QQYDTSPPGSP

SEQ ID NO: 38400 - protein, 14 aa, Homo sapiens
  heavy chain complementarity determining region 3 for antibody 19200
ARETSNSRKRSFDQ

SEQ ID NO: 38401 - protein, 10 aa, Homo sapiens
  light chain complementarity determining region 3 for antibody 19201
QQYDSLRLNT

SEQ ID NO: 38402 - protein, 28 aa, Homo sapiens
  heavy chain complementarity determining region 3 for antibody 19201
ARRSLTTKYYDYVWGNYRSLDPTDAFDV

SEQ ID NO: 38403 - protein, 10 aa, Homo sapiens
  light chain complementarity determining region 3 for antibody 19202
QQYDSLPLYT

SEQ ID NO: 38404 - protein, 28 aa, Homo sapiens
  heavy chain complementarity determining region 3 for antibody 19202
ARRSLTTKYYDYVWGNYRSLDPTDAFDV

SEQ ID NO: 38405 - protein, 11 aa, Homo sapiens
  light chain complementarity determining region 3 for antibody 19203
QQYDPLSWTWP

SEQ ID NO: 38406 - protein, 11 aa, Homo sapiens
  heavy chain complementarity determining region 3 for antibody 19203
ARGWLDNSFDF

SEQ ID NO: 38407 - protein, 10 aa, Homo sapiens
  light chain complementarity determining region 3 for antibody 19204
QQYDNWPPWR

SEQ ID NO: 38408 - protein, 12 aa, Homo sapiens
  heavy chain complementarity determining region 3 for antibody 19204
AKTLRERKELDY

SEQ ID NO: 38409 - protein, 8 aa, Homo sapiens
  light chain complementarity determining region 3 for antibody 19205
QQYDNLVT

SEQ ID NO: 38410 - protein, 18 aa, Homo sapiens
  heavy chain complementarity determining region 3 for antibody 19205
AKGAEGSCSVRKCYPFDY

SEQ ID NO: 38411 - protein, 9 aa, Homo sapiens
  light chain complementarity determining region 3 for antibody 19206
QQYDNLPST

SEQ ID NO: 38412 - protein, 17 aa, Homo sapiens
  heavy chain complementarity determining region 3 for antibody 19206
AKERFIRWLRLGGVFDS

SEQ ID NO: 38413 - protein, 9 aa, Homo sapiens
  light chain complementarity determining region 3 for antibody 19207
QQYDLLPPR

SEQ ID NO: 38414 - protein, 21 aa, Homo sapiens
  heavy chain complementarity determining region 3 for antibody 19207
ARGLHIVVVTSILRGFWYFGL

SEQ ID NO: 38415 - protein, 9 aa, Homo sapiens
  light chain complementarity determining region 3 for antibody 19208
QQYDFLPPS

SEQ ID NO: 38416 - protein, 21 aa, Homo sapiens
  heavy chain complementarity determining region 3 for antibody 19208
ARGLHIVVVTSILRGFWYFGL

SEQ ID NO: 38417 - protein, 10 aa, Homo sapiens
  light chain complementarity determining region 3 for antibody 19209
QQYDDWPPWP

SEQ ID NO: 38418 - protein, 16 aa, Homo sapiens
  heavy chain complementarity determining region 3 for antibody 19209
GGSRTSSQQLVAPIHY

SEQ ID NO: 38419 - protein, 9 aa, Homo sapiens
  light chain complementarity determining region 3 for antibody 19210
QQYDAQSRT

SEQ ID NO: 38420 - protein, 11 aa, Homo sapiens
  heavy chain complementarity determining region 3 for antibody 19210
ARGWRDNSFDY

SEQ ID NO: 38421 - protein, 9 aa, Homo sapiens
  light chain complementarity determining region 3 for antibody 19211
QQYDAQSGT

SEQ ID NO: 38422 - protein, 11 aa, Homo sapiens
  heavy chain complementarity determining region 3 for antibody 19211
ARGWRDNSFDY

SEQ ID NO: 38423 - protein, 9 aa, Homo sapiens
  light chain complementarity determining region 3 for antibody 19212
QQYATSPRP

SEQ ID NO: 38424 - protein, 15 aa, Homo sapiens
  heavy chain complementarity determining region 3 for antibody 19212
ARDGNVLATGYPLDY

SEQ ID NO: 38425 - protein, 9 aa, Homo sapiens
  light chain complementarity determining region 3 for antibody 19213
QQYANLPWT

SEQ ID NO: 38426 - protein, 11 aa, Homo sapiens
  heavy chain complementarity determining region 3 for antibody 19213
ATWAFRHGVDV

SEQ ID NO: 38427 - protein, 10 aa, Homo sapiens
  light chain complementarity determining region 3 for antibody 19214
QQVDNSPKWT

SEQ ID NO: 38428 - protein, 13 aa, Homo sapiens
  heavy chain complementarity determining region 3 for antibody 19214
ARAPKFGAVYFDY

SEQ ID NO: 38429 - protein, 9 aa, Homo sapiens
  light chain complementarity determining region 3 for antibody 19215
QQTHTAPYP

SEQ ID NO: 38430 - protein, 13 aa, Homo sapiens
  heavy chain complementarity determining region 3 for antibody 19215
ARARNYDRISLDF

SEQ ID NO: 38431 - protein, 9 aa, Homo sapiens
  light chain complementarity determining region 3 for antibody 19216
QQSYTSPIT

SEQ ID NO: 38432 - protein, 16 aa, Homo sapiens
  heavy chain complementarity determining region 3 for antibody 19216
ARESGGGSPRHNYFGP

SEQ ID NO: 38433 - protein, 9 aa, Homo sapiens
  light chain complementarity determining region 3 for antibody 19217
QQSYTSLRT

SEQ ID NO: 38434 - protein, 12 aa, Homo sapiens
  heavy chain complementarity determining region 3 for antibody 19217
VKDCGLGGSRDS

SEQ ID NO: 38435 - protein, 10 aa, Homo sapiens
  light chain complementarity determining region 3 for antibody 19218
QQSYSTPLYT

SEQ ID NO: 38436 - protein, 15 aa, Homo sapiens
  heavy chain complementarity determining region 3 for antibody 19218
ARDNLVGGTTAAFDY

SEQ ID NO: 38437 - protein, 9 aa, Homo sapiens
  light chain complementarity determining region 3 for antibody 19219
QQSYSSLPT

SEQ ID NO: 38438 - protein, 16 aa, Homo sapiens
  heavy chain complementarity determining region 3 for antibody 19219
AREGGSTYTSKRAFDS

SEQ ID NO: 38439 - protein, 9 aa, Homo sapiens
  light chain complementarity determining region 3 for antibody 19220
QQSYSSLLT

SEQ ID NO: 38440 - protein, 16 aa, Homo sapiens
  heavy chain complementarity determining region 3 for antibody 19220
AREGGSTYPTKRAFDS

SEQ ID NO: 38441 - protein, 9 aa, Homo sapiens
  light chain complementarity determining region 3 for antibody 19221
QQSYSSLLA

SEQ ID NO: 38442 - protein, 16 aa, Homo sapiens
  heavy chain complementarity determining region 3 for antibody 19221
AREGGSTYTTKRAFDS

SEQ ID NO: 38443 - protein, 9 aa, Homo sapiens
  light chain complementarity determining region 3 for antibody 19222
QQSYSPPPT

SEQ ID NO: 38444 - protein, 14 aa, Homo sapiens
  heavy chain complementarity determining region 3 for antibody 19222
ARVGQQLFFSRFDP

SEQ ID NO: 38445 - protein, 9 aa, Homo sapiens
  light chain complementarity determining region 3 for antibody 19223
QQSYKSPYT

SEQ ID NO: 38446 - protein, 15 aa, Homo sapiens
  heavy chain complementarity determining region 3 for antibody 19223
VKDLYGSSWYGGFHY

SEQ ID NO: 38447 - protein, 9 aa, Homo sapiens
  light chain complementarity determining region 3 for antibody 19224
QQSYGSPQT

SEQ ID NO: 38448 - protein, 19 aa, Homo sapiens
  heavy chain complementarity determining region 3 for antibody 19224
ARVGLEIPPAIRRGEWFDP

SEQ ID NO: 38449 - protein, 9 aa, Homo sapiens
  light chain complementarity determining region 3 for antibody 19225
QQSYGLPQT

SEQ ID NO: 38450 - protein, 19 aa, Homo sapiens
  heavy chain complementarity determining region 3 for antibody 19225
ARVGLEIPPAIRRGEGFDP

SEQ ID NO: 38451 - protein, 9 aa, Homo sapiens
  light chain complementarity determining region 3 for antibody 19226
QQSTNWPLT

SEQ ID NO: 38452 - protein, 16 aa, Homo sapiens
  heavy chain complementarity determining region 3 for antibody 19226
TRYCSSSNCALYGMDV

SEQ ID NO: 38453 - protein, 10 aa, Homo sapiens
  light chain complementarity determining region 3 for antibody 19227
QQSNNWPPWT

SEQ ID NO: 38454 - protein, 18 aa, Homo sapiens
  heavy chain complementarity determining region 3 for antibody 19227
ARGVPRVWAPGGTGPFDY

SEQ ID NO: 38455 - protein, 10 aa, Homo sapiens
  light chain complementarity determining region 3 for antibody 19228
QQSNNWPPWP

SEQ ID NO: 38456 - protein, 11 aa, Homo sapiens
  heavy chain complementarity determining region 3 for antibody 19228
AASGSHYKFDY

SEQ ID NO: 38457 - protein, 9 aa, Homo sapiens
  light chain complementarity determining region 3 for antibody 19229
QQSHTYSWT

SEQ ID NO: 38458 - protein, 12 aa, Homo sapiens
  heavy chain complementarity determining region 3 for antibody 19229
ARMGYNYGHFDN

SEQ ID NO: 38459 - protein, 9 aa, Homo sapiens
  light chain complementarity determining region 3 for antibody 19230
QQSHSVPLT

SEQ ID NO: 38460 - protein, 16 aa, Homo sapiens
  heavy chain complementarity determining region 3 for antibody 19230
ARVYATVTSQARGVDY

SEQ ID NO: 38461 - protein, 9 aa, Homo sapiens
  light chain complementarity determining region 3 for antibody 19231
QQSGRKPFT

SEQ ID NO: 38462 - protein, 14 aa, Homo sapiens
  heavy chain complementarity determining region 3 for antibody 19231
ARDNSNNWYEGMDV

SEQ ID NO: 38463 - protein, 9 aa, Homo sapiens
  light chain complementarity determining region 3 for antibody 19232
QQSFSTLVT

SEQ ID NO: 38464 - protein, 11 aa, Homo sapiens
  heavy chain complementarity determining region 3 for antibody 19232
ARGGNWNYFDY

SEQ ID NO: 38465 - protein, 10 aa, Homo sapiens
  light chain complementarity determining region 3 for antibody 19233
QQRYTWPPYT

SEQ ID NO: 38466 - protein, 11 aa, Homo sapiens
  heavy chain complementarity determining region 3 for antibody 19233
ARGVGSYVFES

SEQ ID NO: 38467 - protein, 10 aa, Homo sapiens
  light chain complementarity determining region 3 for antibody 19234
QQRYSWPPLT

SEQ ID NO: 38468 - protein, 14 aa, Homo sapiens
  heavy chain complementarity determining region 3 for antibody 19234
AKGANLPHPYYFDY

SEQ ID NO: 38469 - protein, 8 aa, Homo sapiens
  light chain complementarity determining region 3 for antibody 19235
QQRYSTAT

SEQ ID NO: 38470 - protein, 14 aa, Homo sapiens
  heavy chain complementarity determining region 3 for antibody 19235
ASHGTSDRRGAFDI

SEQ ID NO: 38471 - protein, 10 aa, Homo sapiens
  light chain complementarity determining region 3 for antibody 19236
QQRYNWPPWP

SEQ ID NO: 38472 - protein, 20 aa, Homo sapiens
  heavy chain complementarity determining region 3 for antibody 19236
ARHRQVTVADSFEVFWYFDL

SEQ ID NO: 38473 - protein, 10 aa, Homo sapiens
  light chain complementarity determining region 3 for antibody 19237
QQRYNWPPST

SEQ ID NO: 38474 - protein, 11 aa, Homo sapiens
  heavy chain complementarity determining region 3 for antibody 19237
ARGVGSYVFES

SEQ ID NO: 38475 - protein, 10 aa, Homo sapiens
  light chain complementarity determining region 3 for antibody 19238
QQRYNWPPST

SEQ ID NO: 38476 - protein, 11 aa, Homo sapiens
  heavy chain complementarity determining region 3 for antibody 19238
ARGVGSYPFDS

SEQ ID NO: 38477 - protein, 10 aa, Homo sapiens
  light chain complementarity determining region 3 for antibody 19239
QQRYNWPPHT

SEQ ID NO: 38478 - protein, 11 aa, Homo sapiens
  heavy chain complementarity determining region 3 for antibody 19239
ARGVGSYVFES

SEQ ID NO: 38479 - protein, 10 aa, Homo sapiens
  light chain complementarity determining region 3 for antibody 19240
QQRYNWPPFT

SEQ ID NO: 38480 - protein, 11 aa, Homo sapiens
  heavy chain complementarity determining region 3 for antibody 19240
ARGVGSYVFES

SEQ ID NO: 38481 - protein, 10 aa, Homo sapiens
  light chain complementarity determining region 3 for antibody 19241
QQRYNWPPFT

SEQ ID NO: 38482 - protein, 11 aa, Homo sapiens
  heavy chain complementarity determining region 3 for antibody 19241
ARGVGSDPFDS

SEQ ID NO: 38483 - protein, 10 aa, Homo sapiens
  light chain complementarity determining region 3 for antibody 19242
QQRYNWPPFT

SEQ ID NO: 38484 - protein, 11 aa, Homo sapiens
  heavy chain complementarity determining region 3 for antibody 19242
ARGVGRYPFDS

SEQ ID NO: 38485 - protein, 10 aa, Homo sapiens
  light chain complementarity determining region 3 for antibody 19243
QQRYNWPPDT

SEQ ID NO: 38486 - protein, 11 aa, Homo sapiens
  heavy chain complementarity determining region 3 for antibody 19243
ARGVGSYVFES

SEQ ID NO: 38487 - protein, 9 aa, Homo sapiens
  light chain complementarity determining region 3 for antibody 19244
QQRYGLPQT

SEQ ID NO: 38488 - protein, 19 aa, Homo sapiens
  heavy chain complementarity determining region 3 for antibody 19244
ARVGLEIPPAIRRGEWFDP

SEQ ID NO: 38489 - protein, 9 aa, Homo sapiens
  light chain complementarity determining region 3 for antibody 19245
QQRTDWPPT

SEQ ID NO: 38490 - protein, 17 aa, Homo sapiens
  heavy chain complementarity determining region 3 for antibody 19245
ARAALCESPAYYRFFDY

SEQ ID NO: 38491 - protein, 9 aa, Homo sapiens
  light chain complementarity determining region 3 for antibody 19246
QQRSSWPYT

SEQ ID NO: 38492 - protein, 11 aa, Homo sapiens
  heavy chain complementarity determining region 3 for antibody 19246
VKRWGGSSIDF

SEQ ID NO: 38493 - protein, 9 aa, Homo sapiens
  light chain complementarity determining region 3 for antibody 19247
QQRSSWPYT

SEQ ID NO: 38494 - protein, 11 aa, Homo sapiens
  heavy chain complementarity determining region 3 for antibody 19247
VKRWGGSGIDY

SEQ ID NO: 38495 - protein, 9 aa, Homo sapiens
  light chain complementarity determining region 3 for antibody 19248
QQRSSWPYA

SEQ ID NO: 38496 - protein, 11 aa, Homo sapiens
  heavy chain complementarity determining region 3 for antibody 19248
VKRWGGSSIDY

SEQ ID NO: 38497 - protein, 10 aa, Homo sapiens
  light chain complementarity determining region 3 for antibody 19249
QQRSNWPPHT

SEQ ID NO: 38498 - protein, 16 aa, Homo sapiens
  heavy chain complementarity determining region 3 for antibody 19249
ARDRRDSWPGGHYFDS

SEQ ID NO: 38499 - protein, 10 aa, Homo sapiens
  light chain complementarity determining region 3 for antibody 19250
QQRSNWPPFT

SEQ ID NO: 38500 - protein, 11 aa, Homo sapiens
  heavy chain complementarity determining region 3 for antibody 19250
ARGVGSYPFDS

SEQ ID NO: 38501 - protein, 9 aa, Homo sapiens
  light chain complementarity determining region 3 for antibody 19251
QQRSNWPLT

SEQ ID NO: 38502 - protein, 9 aa, Homo sapiens
  heavy chain complementarity determining region 3 for antibody 19251
ANYGDCVDY

SEQ ID NO: 38503 - protein, 8 aa, Homo sapiens
  light chain complementarity determining region 3 for antibody 19252
QQRSNWLP

SEQ ID NO: 38504 - protein, 16 aa, Homo sapiens
  heavy chain complementarity determining region 3 for antibody 19252
AKDIVLMGSSGGSFDY

SEQ ID NO: 38505 - protein, 8 aa, Homo sapiens
  light chain complementarity determining region 3 for antibody 19253
QQRSNSFT

SEQ ID NO: 38506 - protein, 15 aa, Homo sapiens
  heavy chain complementarity determining region 3 for antibody 19253
ASRGEIAVAGPYFDY

SEQ ID NO: 38507 - protein, 9 aa, Homo sapiens
  light chain complementarity determining region 3 for antibody 19254
QQRSNLPPT

SEQ ID NO: 38508 - protein, 8 aa, Homo sapiens
  heavy chain complementarity determining region 3 for antibody 19254
ATLGNDSD

SEQ ID NO: 38509 - protein, 10 aa, Homo sapiens
  light chain complementarity determining region 3 for antibody 19255
QQRSKWPPFT

SEQ ID NO: 38510 - protein, 9 aa, Homo sapiens
  heavy chain complementarity determining region 3 for antibody 19255
ARVDGYFDY

SEQ ID NO: 38511 - protein, 9 aa, Homo sapiens
  light chain complementarity determining region 3 for antibody 19256
QQRNSWPTT

SEQ ID NO: 38512 - protein, 14 aa, Homo sapiens
  heavy chain complementarity determining region 3 for antibody 19256
ARDPVSGSGVGFDF

SEQ ID NO: 38513 - protein, 9 aa, Homo sapiens
  light chain complementarity determining region 3 for antibody 19257
QQRNKLPRT

SEQ ID NO: 38514 - protein, 13 aa, Homo sapiens
  heavy chain complementarity determining region 3 for antibody 19257
AKDLGSLRYDFDY

SEQ ID NO: 38515 - protein, 11 aa, Homo sapiens
  light chain complementarity determining region 3 for antibody 19258
QQRITWPPSFS

SEQ ID NO: 38516 - protein, 15 aa, Homo sapiens
  heavy chain complementarity determining region 3 for antibody 19258
ARDRSGSYSVHAFDI

SEQ ID NO: 38517 - protein, 10 aa, Homo sapiens
  light chain complementarity determining region 3 for antibody 19259
QQRINWPLFP

SEQ ID NO: 38518 - protein, 13 aa, Homo sapiens
  heavy chain complementarity determining region 3 for antibody 19259
ARPGGSSLMFFDF

SEQ ID NO: 38519 - protein, 9 aa, Homo sapiens
  light chain complementarity determining region 3 for antibody 19260
QQRHTTPYT

SEQ ID NO: 38520 - protein, 14 aa, Homo sapiens
  heavy chain complementarity determining region 3 for antibody 19260
ARLVKIVINGEDDY

SEQ ID NO: 38521 - protein, 9 aa, Homo sapiens
  light chain complementarity determining region 3 for antibody 19261
QQRHSVPLT

SEQ ID NO: 38522 - protein, 16 aa, Homo sapiens
  heavy chain complementarity determining region 3 for antibody 19261
ARVYATVTSQALGVDY

SEQ ID NO: 38523 - protein, 10 aa, Homo sapiens
  light chain complementarity determining region 3 for antibody 19262
QQRGNWPPIT

SEQ ID NO: 38524 - protein, 13 aa, Homo sapiens
  heavy chain complementarity determining region 3 for antibody 19262
VRELHAGAYYYDY

SEQ ID NO: 38525 - protein, 10 aa, Homo sapiens
  light chain complementarity determining region 3 for antibody 19263
QQRGNSPPGT

SEQ ID NO: 38526 - protein, 12 aa, Homo sapiens
  heavy chain complementarity determining region 3 for antibody 19263
ARDHYARVAFDI

SEQ ID NO: 38527 - protein, 10 aa, Homo sapiens
  light chain complementarity determining region 3 for antibody 19264
QQRGIWPEMS

SEQ ID NO: 38528 - protein, 14 aa, Homo sapiens
  heavy chain complementarity determining region 3 for antibody 19264
AKDHDSNISGFGDL

SEQ ID NO: 38529 - protein, 10 aa, Homo sapiens
  light chain complementarity determining region 3 for antibody 19265
QQRGIRPPIT

SEQ ID NO: 38530 - protein, 13 aa, Homo sapiens
  heavy chain complementarity determining region 3 for antibody 19265
VRELHAGAYYYDY

SEQ ID NO: 38531 - protein, 9 aa, Homo sapiens
  light chain complementarity determining region 3 for antibody 19266
QQRCNWPPT

SEQ ID NO: 38532 - protein, 8 aa, Homo sapiens
  heavy chain complementarity determining region 3 for antibody 19266
ATLGNDSD

SEQ ID NO: 38533 - protein, 9 aa, Homo sapiens
  light chain complementarity determining region 3 for antibody 19267
QQNYTSLRT

SEQ ID NO: 38534 - protein, 12 aa, Homo sapiens
  heavy chain complementarity determining region 3 for antibody 19267
VKDCGLGGSRDS

SEQ ID NO: 38535 - protein, 9 aa, Homo sapiens
  light chain complementarity determining region 3 for antibody 19268
QQNYSYPRT

SEQ ID NO: 38536 - protein, 11 aa, Homo sapiens
  heavy chain complementarity determining region 3 for antibody 19268
ARDFSNGPFTH

SEQ ID NO: 38537 - protein, 10 aa, Homo sapiens
  light chain complementarity determining region 3 for antibody 19269
QQNNQWPPLT

SEQ ID NO: 38538 - protein, 17 aa, Homo sapiens
  heavy chain complementarity determining region 3 for antibody 19269
ARDLYFSIIQGGGAFDA

SEQ ID NO: 38539 - protein, 9 aa, Homo sapiens
  light chain complementarity determining region 3 for antibody 19270
QQNGTTPRT

SEQ ID NO: 38540 - protein, 13 aa, Homo sapiens
  heavy chain complementarity determining region 3 for antibody 19270
ACGYYEGGRYYEY

SEQ ID NO: 38541 - protein, 9 aa, Homo sapiens
  light chain complementarity determining region 3 for antibody 19271
QQNGTLPQT

SEQ ID NO: 38542 - protein, 18 aa, Homo sapiens
  heavy chain complementarity determining region 3 for antibody 19271
ARDYYGSGREIWVGAFDI

SEQ ID NO: 38543 - protein, 8 aa, Homo sapiens
  light chain complementarity determining region 3 for antibody 19272
QQNGNSPF

SEQ ID NO: 38544 - protein, 20 aa, Homo sapiens
  heavy chain complementarity determining region 3 for antibody 19272
ARGPPGYDTSGYYRNWYFDL

SEQ ID NO: 38545 - protein, 9 aa, Homo sapiens
  light chain complementarity determining region 3 for antibody 19273
QQLYTYPLT

SEQ ID NO: 38546 - protein, 12 aa, Homo sapiens
  heavy chain complementarity determining region 3 for antibody 19273
TRVLSSAIGEWD

SEQ ID NO: 38547 - protein, 9 aa, Homo sapiens
  light chain complementarity determining region 3 for antibody 19274
QQLNTYPIT

SEQ ID NO: 38548 - protein, 13 aa, Homo sapiens
  heavy chain complementarity determining region 3 for antibody 19274
AKALTMVTTYGDY

SEQ ID NO: 38549 - protein, 9 aa, Homo sapiens
  light chain complementarity determining region 3 for antibody 19275
QQLNSYPHT

SEQ ID NO: 38550 - protein, 12 aa, Homo sapiens
  heavy chain complementarity determining region 3 for antibody 19275
ARTSLAHDYGYY

SEQ ID NO: 38551 - protein, 9 aa, Homo sapiens
  light chain complementarity determining region 3 for antibody 19276
QQLGTLPST

SEQ ID NO: 38552 - protein, 16 aa, Homo sapiens
  heavy chain complementarity determining region 3 for antibody 19276
TTERHIAEFEEASFDI

SEQ ID NO: 38553 - protein, 9 aa, Homo sapiens
  light chain complementarity determining region 3 for antibody 19277
QQIYTYPLT

SEQ ID NO: 38554 - protein, 12 aa, Homo sapiens
  heavy chain complementarity determining region 3 for antibody 19277
TRVLSSAIGEWD

SEQ ID NO: 38555 - protein, 9 aa, Homo sapiens
  light chain complementarity determining region 3 for antibody 19278
QQHYTSLRT

SEQ ID NO: 38556 - protein, 12 aa, Homo sapiens
  heavy chain complementarity determining region 3 for antibody 19278
VKDCGLGGSRDS

SEQ ID NO: 38557 - protein, 10 aa, Homo sapiens
  light chain complementarity determining region 3 for antibody 19279
QQHVSSPPWR

SEQ ID NO: 38558 - protein, 14 aa, Homo sapiens
  heavy chain complementarity determining region 3 for antibody 19279
ARSPRTTMPPPWDY

SEQ ID NO: 38559 - protein, 9 aa, Homo sapiens
  light chain complementarity determining region 3 for antibody 19280
QQHSNWPPT

SEQ ID NO: 38560 - protein, 14 aa, Homo sapiens
  heavy chain complementarity determining region 3 for antibody 19280
AKHRYDSSGYYFDY

SEQ ID NO: 38561 - protein, 9 aa, Homo sapiens
  light chain complementarity determining region 3 for antibody 19281
QQHNTWPRT

SEQ ID NO: 38562 - protein, 22 aa, Homo sapiens
  heavy chain complementarity determining region 3 for antibody 19281
AREVRASGYDDFYNYYYYGLDV

SEQ ID NO: 38563 - protein, 9 aa, Homo sapiens
  light chain complementarity determining region 3 for antibody 19282
QQHNDYPWT

SEQ ID NO: 38564 - protein, 10 aa, Homo sapiens
  heavy chain complementarity determining region 3 for antibody 19282
ARDYDAALDY

SEQ ID NO: 38565 - protein, 9 aa, Homo sapiens
  light chain complementarity determining region 3 for antibody 19283
QQHHDWPPT

SEQ ID NO: 38566 - protein, 23 aa, Homo sapiens
  heavy chain complementarity determining region 3 for antibody 19283
ALQINKDLGLIRGVTQWTTYFDY

SEQ ID NO: 38567 - protein, 9 aa, Homo sapiens
  light chain complementarity determining region 3 for antibody 19284
QQHGSSPRT

SEQ ID NO: 38568 - protein, 18 aa, Homo sapiens
  heavy chain complementarity determining region 3 for antibody 19284
ATAFWVGLGVPPPGFFEY

SEQ ID NO: 38569 - protein, 10 aa, Homo sapiens
  light chain complementarity determining region 3 for antibody 19285
QQHGSSPPWT

SEQ ID NO: 38570 - protein, 14 aa, Homo sapiens
  heavy chain complementarity determining region 3 for antibody 19285
ARSPRTTMPPPWDY

SEQ ID NO: 38571 - protein, 10 aa, Homo sapiens
  light chain complementarity determining region 3 for antibody 19286
QQHGSSPMYS

SEQ ID NO: 38572 - protein, 11 aa, Homo sapiens
  heavy chain complementarity determining region 3 for antibody 19286
ARGGQWGSLDY

SEQ ID NO: 38573 - protein, 9 aa, Homo sapiens
  light chain complementarity determining region 3 for antibody 19287
QQGYSSPLI

SEQ ID NO: 38574 - protein, 14 aa, Homo sapiens
  heavy chain complementarity determining region 3 for antibody 19287
ARAQVIWGQFYFDY

SEQ ID NO: 38575 - protein, 9 aa, Homo sapiens
  light chain complementarity determining region 3 for antibody 19288
QQGYSSPFT

SEQ ID NO: 38576 - protein, 15 aa, Homo sapiens
  heavy chain complementarity determining region 3 for antibody 19288
AKAQVIWGQLYYFDS

SEQ ID NO: 38577 - protein, 9 aa, Homo sapiens
  light chain complementarity determining region 3 for antibody 19289
QQGYRPPFI

SEQ ID NO: 38578 - protein, 15 aa, Homo sapiens
  heavy chain complementarity determining region 3 for antibody 19289
TRAQVIWGHLYYFDY

SEQ ID NO: 38579 - protein, 7 aa, Homo sapiens
  light chain complementarity determining region 3 for antibody 19290
QQGRNWL

SEQ ID NO: 38580 - protein, 13 aa, Homo sapiens
  heavy chain complementarity determining region 3 for antibody 19290
ARDFSSGSYYFDF

SEQ ID NO: 38581 - protein, 9 aa, Homo sapiens
  light chain complementarity determining region 3 for antibody 19291
QQFYTYPLT

SEQ ID NO: 38582 - protein, 12 aa, Homo sapiens
  heavy chain complementarity determining region 3 for antibody 19291
TRVLSSARGEWD

SEQ ID NO: 38583 - protein, 9 aa, Homo sapiens
  light chain complementarity determining region 3 for antibody 19292
QQFYTYPLT

SEQ ID NO: 38584 - protein, 12 aa, Homo sapiens
  heavy chain complementarity determining region 3 for antibody 19292
TRVLSSAIGDCD

SEQ ID NO: 38585 - protein, 9 aa, Homo sapiens
  light chain complementarity determining region 3 for antibody 19293
QQFYTYPLP

SEQ ID NO: 38586 - protein, 12 aa, Homo sapiens
  heavy chain complementarity determining region 3 for antibody 19293
TRVLSSAIGEWD

SEQ ID NO: 38587 - protein, 9 aa, Homo sapiens
  light chain complementarity determining region 3 for antibody 19294
QQFYNNPPT

SEQ ID NO: 38588 - protein, 14 aa, Homo sapiens
  heavy chain complementarity determining region 3 for antibody 19294
VGQDCIGGACDYPR

SEQ ID NO: 38589 - protein, 9 aa, Homo sapiens
  light chain complementarity determining region 3 for antibody 19295
QQFFNNPFT

SEQ ID NO: 38590 - protein, 14 aa, Homo sapiens
  heavy chain complementarity determining region 3 for antibody 19295
LGQDCSGVGCDYPR

SEQ ID NO: 38591 - protein, 10 aa, Homo sapiens
  light chain complementarity determining region 3 for antibody 19296
QQFDNPPKWT

SEQ ID NO: 38592 - protein, 13 aa, Homo sapiens
  heavy chain complementarity determining region 3 for antibody 19296
ARAPKFGAVYFDY

SEQ ID NO: 38593 - protein, 9 aa, Homo sapiens
  light chain complementarity determining region 3 for antibody 19297
QQDSSSLFA

SEQ ID NO: 38594 - protein, 15 aa, Homo sapiens
  heavy chain complementarity determining region 3 for antibody 19297
ARGGKSSSWLSYFDS

SEQ ID NO: 38595 - protein, 9 aa, Homo sapiens
  light chain complementarity determining region 3 for antibody 19298
QQDNSFPLT

SEQ ID NO: 38596 - protein, 13 aa, Homo sapiens
  heavy chain complementarity determining region 3 for antibody 19298
AKDISQMVTILDY

SEQ ID NO: 38597 - protein, 9 aa, Homo sapiens
  light chain complementarity determining region 3 for antibody 19299
QQDGTTPRT

SEQ ID NO: 38598 - protein, 13 aa, Homo sapiens
  heavy chain complementarity determining region 3 for antibody 19299
AGGLFDRRGYSEF

SEQ ID NO: 38599 - protein, 9 aa, Homo sapiens
  light chain complementarity determining region 3 for antibody 19300
QQDGTTPRT

SEQ ID NO: 38600 - protein, 13 aa, Homo sapiens
  heavy chain complementarity determining region 3 for antibody 19300
ACGYYEGGRYYEY

SEQ ID NO: 38601 - protein, 9 aa, Homo sapiens
  light chain complementarity determining region 3 for antibody 19301
QQDGTIPRT

SEQ ID NO: 38602 - protein, 13 aa, Homo sapiens
  heavy chain complementarity determining region 3 for antibody 19301
AGGLFDSSGYSEF

SEQ ID NO: 38603 - protein, 9 aa, Homo sapiens
  light chain complementarity determining region 3 for antibody 19302
QQDGSSPRT

SEQ ID NO: 38604 - protein, 16 aa, Homo sapiens
  heavy chain complementarity determining region 3 for antibody 19302
ARESHSSGWYDWYFDY

SEQ ID NO: 38605 - protein, 9 aa, Homo sapiens
  light chain complementarity determining region 3 for antibody 19303
QQDGSSPLT

SEQ ID NO: 38606 - protein, 13 aa, Homo sapiens
  heavy chain complementarity determining region 3 for antibody 19303
AHSQWLVLDVFDF

SEQ ID NO: 38607 - protein, 9 aa, Homo sapiens
  light chain complementarity determining region 3 for antibody 19304
QQDGSPPRT

SEQ ID NO: 38608 - protein, 14 aa, Homo sapiens
  heavy chain complementarity determining region 3 for antibody 19304
AGGNFCGYDCYSEY

SEQ ID NO: 38609 - protein, 9 aa, Homo sapiens
  light chain complementarity determining region 3 for antibody 19305
QQDGSIPRT

SEQ ID NO: 38610 - protein, 13 aa, Homo sapiens
  heavy chain complementarity determining region 3 for antibody 19305
AGGIFDSSGYGEY

SEQ ID NO: 38611 - protein, 9 aa, Homo sapiens
  light chain complementarity determining region 3 for antibody 19306
QQDGSIPRT

SEQ ID NO: 38612 - protein, 14 aa, Homo sapiens
  heavy chain complementarity determining region 3 for antibody 19306
AGGEYCGGNCYSEY

SEQ ID NO: 38613 - protein, 9 aa, Homo sapiens
  light chain complementarity determining region 3 for antibody 19307
QQDGSFPYT

SEQ ID NO: 38614 - protein, 14 aa, Homo sapiens
  heavy chain complementarity determining region 3 for antibody 19307
TRGGFIVAWGLFDY

SEQ ID NO: 38615 - protein, 9 aa, Homo sapiens
  light chain complementarity determining region 3 for antibody 19308
QQDGRSPWT

SEQ ID NO: 38616 - protein, 13 aa, Homo sapiens
  heavy chain complementarity determining region 3 for antibody 19308
ARDSVDYGDPLDL

SEQ ID NO: 38617 - protein, 8 aa, Homo sapiens
  light chain complementarity determining region 3 for antibody 19309
QQDGNSPF

SEQ ID NO: 38618 - protein, 20 aa, Homo sapiens
  heavy chain complementarity determining region 3 for antibody 19309
ARGPPGYDTSGYYRNWYFDL

SEQ ID NO: 38619 - protein, 9 aa, Homo sapiens
  light chain complementarity determining region 3 for antibody 19310
QQDGNLPRT

SEQ ID NO: 38620 - protein, 13 aa, Homo sapiens
  heavy chain complementarity determining region 3 for antibody 19310
AGGQFHTSGYSEF

SEQ ID NO: 38621 - protein, 11 aa, Homo sapiens
  light chain complementarity determining region 3 for antibody 19311
QQDGDSPPMYT

SEQ ID NO: 38622 - protein, 12 aa, Homo sapiens
  heavy chain complementarity determining region 3 for antibody 19311
AGQGDRSYSYSY

SEQ ID NO: 38623 - protein, 10 aa, Homo sapiens
  light chain complementarity determining region 3 for antibody 19312
QQDDNWPPWT

SEQ ID NO: 38624 - protein, 12 aa, Homo sapiens
  heavy chain complementarity determining region 3 for antibody 19312
AKTLRERKELDY

SEQ ID NO: 38625 - protein, 9 aa, Homo sapiens
  light chain complementarity determining region 3 for antibody 19313
QQDDAQSWT

SEQ ID NO: 38626 - protein, 11 aa, Homo sapiens
  heavy chain complementarity determining region 3 for antibody 19313
ARGWRDNSFDY

SEQ ID NO: 38627 - protein, 11 aa, Homo sapiens
  light chain complementarity determining region 3 for antibody 19314
QQCTNWPPLFT

SEQ ID NO: 38628 - protein, 14 aa, Homo sapiens
  heavy chain complementarity determining region 3 for antibody 19314
ARLNGIFGLYAFDV

SEQ ID NO: 38629 - protein, 9 aa, Homo sapiens
  light chain complementarity determining region 3 for antibody 19315
QQANSFPGT

SEQ ID NO: 38630 - protein, 20 aa, Homo sapiens
  heavy chain complementarity determining region 3 for antibody 19315
VKDTIPYDSRGYYRRHFFDY

SEQ ID NO: 38631 - protein, 9 aa, Homo sapiens
  light chain complementarity determining region 3 for antibody 19316
QPYGTSPFT

SEQ ID NO: 38632 - protein, 15 aa, Homo sapiens
  heavy chain complementarity determining region 3 for antibody 19316
ARQNDFLSGPGEFDP

SEQ ID NO: 38633 - protein, 9 aa, Homo sapiens
  light chain complementarity determining region 3 for antibody 19317
QPYGTPPRT

SEQ ID NO: 38634 - protein, 25 aa, Homo sapiens
  heavy chain complementarity determining region 3 for antibody 19317
ARLRVDRLRLPGAMRGPLYDRGLNV

SEQ ID NO: 38635 - protein, 9 aa, Homo sapiens
  light chain complementarity determining region 3 for antibody 19318
QPYGSSPRT

SEQ ID NO: 38636 - protein, 15 aa, Homo sapiens
  heavy chain complementarity determining region 3 for antibody 19318
AKTYDFWSGDDAFEI

SEQ ID NO: 38637 - protein, 9 aa, Homo sapiens
  light chain complementarity determining region 3 for antibody 19319
QPYGNSPRT

SEQ ID NO: 38638 - protein, 14 aa, Homo sapiens
  heavy chain complementarity determining region 3 for antibody 19319
ASDPVVGAPGYFDY

SEQ ID NO: 38639 - protein, 9 aa, Homo sapiens
  light chain complementarity determining region 3 for antibody 19320
QKYNTAPFT

SEQ ID NO: 38640 - protein, 15 aa, Homo sapiens
  heavy chain complementarity determining region 3 for antibody 19320
ARVDPLTLVRDTDDY

SEQ ID NO: 38641 - protein, 9 aa, Homo sapiens
  light chain complementarity determining region 3 for antibody 19321
QKYNSGPLP

SEQ ID NO: 38642 - protein, 17 aa, Homo sapiens
  heavy chain complementarity determining region 3 for antibody 19321
ARERFYYGSGNYHPSDS

SEQ ID NO: 38643 - protein, 9 aa, Homo sapiens
  light chain complementarity determining region 3 for antibody 19322
QKYGTSPRP

SEQ ID NO: 38644 - protein, 13 aa, Homo sapiens
  heavy chain complementarity determining region 3 for antibody 19322
AGGHYHSSGSSEF

SEQ ID NO: 38645 - protein, 9 aa, Homo sapiens
  light chain complementarity determining region 3 for antibody 19323
QKYGNLPRT

SEQ ID NO: 38646 - protein, 13 aa, Homo sapiens
  heavy chain complementarity determining region 3 for antibody 19323
AGGDFHSGGYSEF

SEQ ID NO: 38647 - protein, 10 aa, Homo sapiens
  light chain complementarity determining region 3 for antibody 19324
QKYGGSPLVP

SEQ ID NO: 38648 - protein, 14 aa, Homo sapiens
  heavy chain complementarity determining region 3 for antibody 19324
ARDPISGSPDYFDY

SEQ ID NO: 38649 - protein, 9 aa, Homo sapiens
  light chain complementarity determining region 3 for antibody 19325
QKYDTAPWT

SEQ ID NO: 38650 - protein, 15 aa, Homo sapiens
  heavy chain complementarity determining region 3 for antibody 19325
LRDIKGPSAGSPYDS

SEQ ID NO: 38651 - protein, 9 aa, Homo sapiens
  light chain complementarity determining region 3 for antibody 19326
QKSDSAPFT

SEQ ID NO: 38652 - protein, 15 aa, Homo sapiens
  heavy chain complementarity determining region 3 for antibody 19326
AKVWRGNSLWYDSDY

SEQ ID NO: 38653 - protein, 10 aa, Homo sapiens
  light chain complementarity determining region 3 for antibody 19327
QKRYNWPPFT

SEQ ID NO: 38654 - protein, 11 aa, Homo sapiens
  heavy chain complementarity determining region 3 for antibody 19327
ARGVGSYPFDS

SEQ ID NO: 38655 - protein, 9 aa, Homo sapiens
  light chain complementarity determining region 3 for antibody 19328
QKNGTSPRP

SEQ ID NO: 38656 - protein, 13 aa, Homo sapiens
  heavy chain complementarity determining region 3 for antibody 19328
AGGHYHSSGYSEF

SEQ ID NO: 38657 - protein, 9 aa, Homo sapiens
  light chain complementarity determining region 3 for antibody 19329
QKNGTPPRP

SEQ ID NO: 38658 - protein, 13 aa, Homo sapiens
  heavy chain complementarity determining region 3 for antibody 19329
AGGLYDNTGYSEF

SEQ ID NO: 38659 - protein, 6 aa, Homo sapiens
  light chain complementarity determining region 3 for antibody 19330
QKNGSF

SEQ ID NO: 38660 - protein, 11 aa, Homo sapiens
  heavy chain complementarity determining region 3 for antibody 19330
ARAGISYALDV

SEQ ID NO: 38661 - protein, 9 aa, Homo sapiens
  light chain complementarity determining region 3 for antibody 19331
QKFDGAPST

SEQ ID NO: 38662 - protein, 14 aa, Homo sapiens
  heavy chain complementarity determining region 3 for antibody 19331
AKPQLTRHNGGFDR

SEQ ID NO: 38663 - protein, 9 aa, Homo sapiens
  light chain complementarity determining region 3 for antibody 19332
QKDGTPPRP

SEQ ID NO: 38664 - protein, 13 aa, Homo sapiens
  heavy chain complementarity determining region 3 for antibody 19332
AGGLYDNTGYSEF

SEQ ID NO: 38665 - protein, 9 aa, Homo sapiens
  light chain complementarity determining region 3 for antibody 19333
QHYVTSPLT

SEQ ID NO: 38666 - protein, 8 aa, Homo sapiens
  heavy chain complementarity determining region 3 for antibody 19333
VCMIVAAN

SEQ ID NO: 38667 - protein, 9 aa, Homo sapiens
  light chain complementarity determining region 3 for antibody 19334
QHYVTLPLT

SEQ ID NO: 38668 - protein, 8 aa, Homo sapiens
  heavy chain complementarity determining region 3 for antibody 19334
VCMIVATN

SEQ ID NO: 38669 - protein, 8 aa, Homo sapiens
  light chain complementarity determining region 3 for antibody 19335
QHYSTPLT

SEQ ID NO: 38670 - protein, 12 aa, Homo sapiens
  heavy chain complementarity determining region 3 for antibody 19335
ARGRVVFHTIDS

SEQ ID NO: 38671 - protein, 8 aa, Homo sapiens
  light chain complementarity determining region 3 for antibody 19336
QHYSTALT

SEQ ID NO: 38672 - protein, 12 aa, Homo sapiens
  heavy chain complementarity determining region 3 for antibody 19336
ARGRVVFHAIDS

SEQ ID NO: 38673 - protein, 8 aa, Homo sapiens
  light chain complementarity determining region 3 for antibody 19337
QHYSTALP

SEQ ID NO: 38674 - protein, 12 aa, Homo sapiens
  heavy chain complementarity determining region 3 for antibody 19337
ARGRVVFHTIDS

SEQ ID NO: 38675 - protein, 10 aa, Homo sapiens
  light chain complementarity determining region 3 for antibody 19338
QHYSRSPPTT

SEQ ID NO: 38676 - protein, 20 aa, Homo sapiens
  heavy chain complementarity determining region 3 for antibody 19338
ARDAADVEIVPAARLFAMDV

SEQ ID NO: 38677 - protein, 10 aa, Homo sapiens
  light chain complementarity determining region 3 for antibody 19339
QHYNNWPPLT

SEQ ID NO: 38678 - protein, 17 aa, Homo sapiens
  heavy chain complementarity determining region 3 for antibody 19339
AKDLRPFYDIFAGYLDM

SEQ ID NO: 38679 - protein, 9 aa, Homo sapiens
  light chain complementarity determining region 3 for antibody 19340
QHYNGYCWP

SEQ ID NO: 38680 - protein, 12 aa, Homo sapiens
  heavy chain complementarity determining region 3 for antibody 19340
VTYLVGHGGVGF

SEQ ID NO: 38681 - protein, 10 aa, Homo sapiens
  light chain complementarity determining region 3 for antibody 19341
QHYHNWPPWT

SEQ ID NO: 38682 - protein, 13 aa, Homo sapiens
  heavy chain complementarity determining region 3 for antibody 19341
AKGRVRELYYFEA

SEQ ID NO: 38683 - protein, 10 aa, Homo sapiens
  light chain complementarity determining region 3 for antibody 19342
QHYHNWPPWT

SEQ ID NO: 38684 - protein, 13 aa, Homo sapiens
  heavy chain complementarity determining region 3 for antibody 19342
AKGRVRELYYFDS

SEQ ID NO: 38685 - protein, 10 aa, Homo sapiens
  light chain complementarity determining region 3 for antibody 19343
QHYHNRPPWT

SEQ ID NO: 38686 - protein, 13 aa, Homo sapiens
  heavy chain complementarity determining region 3 for antibody 19343
AKGRVRELYYFET

SEQ ID NO: 38687 - protein, 9 aa, Homo sapiens
  light chain complementarity determining region 3 for antibody 19344
QHYGSSPRT

SEQ ID NO: 38688 - protein, 14 aa, Homo sapiens
  heavy chain complementarity determining region 3 for antibody 19344
AKGLMYHYDSALDL

SEQ ID NO: 38689 - protein, 11 aa, Homo sapiens
  light chain complementarity determining region 3 for antibody 19345
QHYGSSPPRWA

SEQ ID NO: 38690 - protein, 14 aa, Homo sapiens
  heavy chain complementarity determining region 3 for antibody 19345
ASFLLSRRGSYVDY

SEQ ID NO: 38691 - protein, 8 aa, Homo sapiens
  light chain complementarity determining region 3 for antibody 19346
QHYGSPYT

SEQ ID NO: 38692 - protein, 17 aa, Homo sapiens
  heavy chain complementarity determining region 3 for antibody 19346
ARDHGGVQSRKSGALDV

SEQ ID NO: 38693 - protein, 9 aa, Homo sapiens
  light chain complementarity determining region 3 for antibody 19347
QHYGSPPRT

SEQ ID NO: 38694 - protein, 14 aa, Homo sapiens
  heavy chain complementarity determining region 3 for antibody 19347
AGGVFSSDWNYSDY

SEQ ID NO: 38695 - protein, 9 aa, Homo sapiens
  light chain complementarity determining region 3 for antibody 19348
QHYGRSLWT

SEQ ID NO: 38696 - protein, 13 aa, Homo sapiens
  heavy chain complementarity determining region 3 for antibody 19348
ARKFLGYDHVLDV

SEQ ID NO: 38697 - protein, 9 aa, Homo sapiens
  light chain complementarity determining region 3 for antibody 19349
QHYGNSPRT

SEQ ID NO: 38698 - protein, 13 aa, Homo sapiens
  heavy chain complementarity determining region 3 for antibody 19349
AIGYYDRGTYYEY

SEQ ID NO: 38699 - protein, 10 aa, Homo sapiens
  light chain complementarity determining region 3 for antibody 19350
QHYGNSPPIT

SEQ ID NO: 38700 - protein, 11 aa, Homo sapiens
  heavy chain complementarity determining region 3 for antibody 19350
ARCFNPCYFDQ

SEQ ID NO: 38701 - protein, 9 aa, Homo sapiens
  light chain complementarity determining region 3 for antibody 19351
QHYDSNSRT

SEQ ID NO: 38702 - protein, 22 aa, Homo sapiens
  heavy chain complementarity determining region 3 for antibody 19351
AREGYYHGSGTYQPPSYYGMAV

SEQ ID NO: 38703 - protein, 9 aa, Homo sapiens
  light chain complementarity determining region 3 for antibody 19352
QHYDRAVQT

SEQ ID NO: 38704 - protein, 19 aa, Homo sapiens
  heavy chain complementarity determining region 3 for antibody 19352
AKEAAAFCGDYCRGSHCDF

SEQ ID NO: 38705 - protein, 10 aa, Homo sapiens
  light chain complementarity determining region 3 for antibody 19353
QHRYNWPPFT

SEQ ID NO: 38706 - protein, 11 aa, Homo sapiens
  heavy chain complementarity determining region 3 for antibody 19353
ARGVGSYPFDS

SEQ ID NO: 38707 - protein, 9 aa, Homo sapiens
  light chain complementarity determining region 3 for antibody 19354
QHRRTWPYS

SEQ ID NO: 38708 - protein, 20 aa, Homo sapiens
  heavy chain complementarity determining region 3 for antibody 19354
ARDGSAGMAARGTPYYGLDV

SEQ ID NO: 38709 - protein, 9 aa, Homo sapiens
  light chain complementarity determining region 3 for antibody 19355
QHRNNWPLT

SEQ ID NO: 38710 - protein, 13 aa, Homo sapiens
  heavy chain complementarity determining region 3 for antibody 19355
ARGNIAAPGRLDC

SEQ ID NO: 38711 - protein, 10 aa, Homo sapiens
  light chain complementarity determining region 3 for antibody 19356
QHNDDLRKLS

SEQ ID NO: 38712 - protein, 13 aa, Homo sapiens
  heavy chain complementarity determining region 3 for antibody 19356
ARDQDGDYGYFHN

SEQ ID NO: 38713 - protein, 8 aa, Homo sapiens
  light chain complementarity determining region 3 for antibody 19357
QHLNRYPR

SEQ ID NO: 38714 - protein, 18 aa, Homo sapiens
  heavy chain complementarity determining region 3 for antibody 19357
ARDRAMTGPRGPSYVFDS

SEQ ID NO: 38715 - protein, 8 aa, Homo sapiens
  light chain complementarity determining region 3 for antibody 19358
QHHGYSWT

SEQ ID NO: 38716 - protein, 9 aa, Homo sapiens
  heavy chain complementarity determining region 3 for antibody 19358
ARWVEGLDV

SEQ ID NO: 38717 - protein, 9 aa, Homo sapiens
  light chain complementarity determining region 3 for antibody 19359
QEYNSAPGT

SEQ ID NO: 38718 - protein, 15 aa, Homo sapiens
  heavy chain complementarity determining region 3 for antibody 19359
TTRGYDSSDHYYFDY

SEQ ID NO: 38719 - protein, 9 aa, Homo sapiens
  light chain complementarity determining region 3 for antibody 19360
PQYGTPPRT

SEQ ID NO: 38720 - protein, 25 aa, Homo sapiens
  heavy chain complementarity determining region 3 for antibody 19360
ARLRVDRLRLPGAMRGPLYDRGLNV

SEQ ID NO: 38721 - protein, 9 aa, Homo sapiens
  light chain complementarity determining region 3 for antibody 19361
PQYGSSPRT

SEQ ID NO: 38722 - protein, 18 aa, Homo sapiens
  heavy chain complementarity determining region 3 for antibody 19361
ATAFWVGLGVPPPGFFEY

SEQ ID NO: 38723 - protein, 9 aa, Homo sapiens
  light chain complementarity determining region 3 for antibody 19362
PQYGSSPRT

SEQ ID NO: 38724 - protein, 15 aa, Homo sapiens
  heavy chain complementarity determining region 3 for antibody 19362
AKTYDFWSGDDAFEI

SEQ ID NO: 38725 - protein, 9 aa, Homo sapiens
  light chain complementarity determining region 3 for antibody 19363
PQRTDWPPT

SEQ ID NO: 38726 - protein, 17 aa, Homo sapiens
  heavy chain complementarity determining region 3 for antibody 19363
ARTALCESPAYYRFFDY

SEQ ID NO: 38727 - protein, 9 aa, Homo sapiens
  light chain complementarity determining region 3 for antibody 19364
PHYGSLPLT

SEQ ID NO: 38728 - protein, 16 aa, Homo sapiens
  heavy chain complementarity determining region 3 for antibody 19364
ATMLVRGLLYFHAVDV

SEQ ID NO: 38729 - protein, 9 aa, Homo sapiens
  light chain complementarity determining region 3 for antibody 19365
MYTLQIQLS

SEQ ID NO: 38730 - protein, 24 aa, Homo sapiens
  heavy chain complementarity determining region 3 for antibody 19365
ARAVGCDGTNCHAAWGFYYYALDV

SEQ ID NO: 38731 - protein, 9 aa, Homo sapiens
  light chain complementarity determining region 3 for antibody 19366
MQVLQVQHT

SEQ ID NO: 38732 - protein, 14 aa, Homo sapiens
  heavy chain complementarity determining region 3 for antibody 19366
TSGLVRRGARVFDI

SEQ ID NO: 38733 - protein, 9 aa, Homo sapiens
  light chain complementarity determining region 3 for antibody 19367
MQVLQVPQT

SEQ ID NO: 38734 - protein, 14 aa, Homo sapiens
  heavy chain complementarity determining region 3 for antibody 19367
TSGLVRRGARVFDI

SEQ ID NO: 38735 - protein, 9 aa, Homo sapiens
  light chain complementarity determining region 3 for antibody 19368
MQVLQVPHP

SEQ ID NO: 38736 - protein, 14 aa, Homo sapiens
  heavy chain complementarity determining region 3 for antibody 19368
TSGLVRRGARVFDI

SEQ ID NO: 38737 - protein, 9 aa, Homo sapiens
  light chain complementarity determining region 3 for antibody 19369
MQVLEIPFT

SEQ ID NO: 38738 - protein, 15 aa, Homo sapiens
  heavy chain complementarity determining region 3 for antibody 19369
VRHYRETVAGIEGDS

SEQ ID NO: 38739 - protein, 9 aa, Homo sapiens
  light chain complementarity determining region 3 for antibody 19370
MQTLQTPTT

SEQ ID NO: 38740 - protein, 16 aa, Homo sapiens
  heavy chain complementarity determining region 3 for antibody 19370
TMDLCALGLSSGCHDY

SEQ ID NO: 38741 - protein, 9 aa, Homo sapiens
  light chain complementarity determining region 3 for antibody 19371
MQTIQLPRT

SEQ ID NO: 38742 - protein, 10 aa, Homo sapiens
  heavy chain complementarity determining region 3 for antibody 19371
TTLDFWLLDY

SEQ ID NO: 38743 - protein, 10 aa, Homo sapiens
  light chain complementarity determining region 3 for antibody 19372
MQSVKSPRGT

SEQ ID NO: 38744 - protein, 8 aa, Homo sapiens
  heavy chain complementarity determining region 3 for antibody 19372
AKGYGLDS

SEQ ID NO: 38745 - protein, 9 aa, Homo sapiens
  light chain complementarity determining region 3 for antibody 19373
MQSLETPFT

SEQ ID NO: 38746 - protein, 15 aa, Homo sapiens
  heavy chain complementarity determining region 3 for antibody 19373
VRHYRIITAPLEGDS

SEQ ID NO: 38747 - protein, 9 aa, Homo sapiens
  light chain complementarity determining region 3 for antibody 19374
MQPLQTPRT

SEQ ID NO: 38748 - protein, 30 aa, Homo sapiens
  heavy chain complementarity determining region 3 for antibody 19374
ARGVPRRLRFMDAFGSGTNLPQPPVDWFDP

SEQ ID NO: 38749 - protein, 8 aa, Homo sapiens
  light chain complementarity determining region 3 for antibody 19375
MQGVQRYP

SEQ ID NO: 38750 - protein, 7 aa, Homo sapiens
  heavy chain complementarity determining region 3 for antibody 19375
ATKMGDY

SEQ ID NO: 38751 - protein, 8 aa, Homo sapiens
  light chain complementarity determining region 3 for antibody 19376
MQGVQPDP

SEQ ID NO: 38752 - protein, 7 aa, Homo sapiens
  heavy chain complementarity determining region 3 for antibody 19376
ATKMGDY

SEQ ID NO: 38753 - protein, 9 aa, Homo sapiens
  light chain complementarity determining region 3 for antibody 19377
MQGTLWPFA

SEQ ID NO: 38754 - protein, 9 aa, Homo sapiens
  heavy chain complementarity determining region 3 for antibody 19377
GPEARGMSH

SEQ ID NO: 38755 - protein, 9 aa, Homo sapiens
  light chain complementarity determining region 3 for antibody 19378
MQGTHWPVT

SEQ ID NO: 38756 - protein, 18 aa, Homo sapiens
  heavy chain complementarity determining region 3 for antibody 19378
TRDFRDSCSGGGCYYFDL

SEQ ID NO: 38757 - protein, 8 aa, Homo sapiens
  light chain complementarity determining region 3 for antibody 19379
MQGTHWPT

SEQ ID NO: 38758 - protein, 21 aa, Homo sapiens
  heavy chain complementarity determining region 3 for antibody 19379
AKDRTNYYESNGQYYTPKGDL

SEQ ID NO: 38759 - protein, 11 aa, Homo sapiens
  light chain complementarity determining region 3 for antibody 19380
MQGTHWPPRYT

SEQ ID NO: 38760 - protein, 17 aa, Homo sapiens
  heavy chain complementarity determining region 3 for antibody 19380
ARGGSGYYQEGDDTFGF

SEQ ID NO: 38761 - protein, 9 aa, Homo sapiens
  light chain complementarity determining region 3 for antibody 19381
MQGTHWPGT

SEQ ID NO: 38762 - protein, 10 aa, Homo sapiens
  heavy chain complementarity determining region 3 for antibody 19381
ARETHWGPDY

SEQ ID NO: 38763 - protein, 8 aa, Homo sapiens
  light chain complementarity determining region 3 for antibody 19382
MQGTHWPA

SEQ ID NO: 38764 - protein, 21 aa, Homo sapiens
  heavy chain complementarity determining region 3 for antibody 19382
AKDRPNYYESNGQYYTPKGDL

SEQ ID NO: 38765 - protein, 8 aa, Homo sapiens
  light chain complementarity determining region 3 for antibody 19383
MQGTDWPP

SEQ ID NO: 38766 - protein, 21 aa, Homo sapiens
  heavy chain complementarity determining region 3 for antibody 19383
AKDRPNYYGSDGQYYTPKGDL

SEQ ID NO: 38767 - protein, 8 aa, Homo sapiens
  light chain complementarity determining region 3 for antibody 19384
MQGTDWPA

SEQ ID NO: 38768 - protein, 21 aa, Homo sapiens
  heavy chain complementarity determining region 3 for antibody 19384
AKDRPNYYGSDGQYYTPKGDL

SEQ ID NO: 38769 - protein, 8 aa, Homo sapiens
  light chain complementarity determining region 3 for antibody 19385
MQGTAWPT

SEQ ID NO: 38770 - protein, 21 aa, Homo sapiens
  heavy chain complementarity determining region 3 for antibody 19385
AKDRPNYYGSDGQYYTPKGDL

SEQ ID NO: 38771 - protein, 9 aa, Homo sapiens
  light chain complementarity determining region 3 for antibody 19386
MQGSPWPPT

SEQ ID NO: 38772 - protein, 13 aa, Homo sapiens
  heavy chain complementarity determining region 3 for antibody 19386
VRDLGDGYNSIDY

SEQ ID NO: 38773 - protein, 9 aa, Homo sapiens
  light chain complementarity determining region 3 for antibody 19387
MQGSHWPPP

SEQ ID NO: 38774 - protein, 13 aa, Homo sapiens
  heavy chain complementarity determining region 3 for antibody 19387
VRDLGDGYNSIDY

SEQ ID NO: 38775 - protein, 9 aa, Homo sapiens
  light chain complementarity determining region 3 for antibody 19388
MQGLQTPYT

SEQ ID NO: 38776 - protein, 10 aa, Homo sapiens
  heavy chain complementarity determining region 3 for antibody 19388
GSDLTGASDH

SEQ ID NO: 38777 - protein, 9 aa, Homo sapiens
  light chain complementarity determining region 3 for antibody 19389
MQGLQTPRT

SEQ ID NO: 38778 - protein, 30 aa, Homo sapiens
  heavy chain complementarity determining region 3 for antibody 19389
TSGPVSKRSRGFQRYDFWNNFSLDYHGMDV

SEQ ID NO: 38779 - protein, 9 aa, Homo sapiens
  light chain complementarity determining region 3 for antibody 19390
MQGLQTPLT

SEQ ID NO: 38780 - protein, 19 aa, Homo sapiens
  heavy chain complementarity determining region 3 for antibody 19390
AFLLPDMYYSDGSASLLPY

SEQ ID NO: 38781 - protein, 9 aa, Homo sapiens
  light chain complementarity determining region 3 for antibody 19391
MQGLQPPYT

SEQ ID NO: 38782 - protein, 10 aa, Homo sapiens
  heavy chain complementarity determining region 3 for antibody 19391
GSDLTGARDH

SEQ ID NO: 38783 - protein, 9 aa, Homo sapiens
  light chain complementarity determining region 3 for antibody 19392
MQGLQAPGT

SEQ ID NO: 38784 - protein, 22 aa, Homo sapiens
  heavy chain complementarity determining region 3 for antibody 19392
ARLTGVVKQQVGYYYYYYGMDV

SEQ ID NO: 38785 - protein, 9 aa, Homo sapiens
  light chain complementarity determining region 3 for antibody 19393
MQGLPTPYT

SEQ ID NO: 38786 - protein, 10 aa, Homo sapiens
  heavy chain complementarity determining region 3 for antibody 19393
GSDLTGARDH

SEQ ID NO: 38787 - protein, 9 aa, Homo sapiens
  light chain complementarity determining region 3 for antibody 19394
MQGLETPLT

SEQ ID NO: 38788 - protein, 15 aa, Homo sapiens
  heavy chain complementarity determining region 3 for antibody 19394
VRHYRETVAGIEGDS

SEQ ID NO: 38789 - protein, 9 aa, Homo sapiens
  light chain complementarity determining region 3 for antibody 19395
MQDLETPFT

SEQ ID NO: 38790 - protein, 15 aa, Homo sapiens
  heavy chain complementarity determining region 3 for antibody 19395
VRHYRELATGIEGDS

SEQ ID NO: 38791 - protein, 9 aa, Homo sapiens
  light chain complementarity determining region 3 for antibody 19396
MQATYWPWP

SEQ ID NO: 38792 - protein, 11 aa, Homo sapiens
  heavy chain complementarity determining region 3 for antibody 19396
LSAVRGSSFDI

SEQ ID NO: 38793 - protein, 9 aa, Homo sapiens
  light chain complementarity determining region 3 for antibody 19397
MQALQTPFT

SEQ ID NO: 38794 - protein, 24 aa, Homo sapiens
  heavy chain complementarity determining region 3 for antibody 19397
VTAPPYYYDSAGDSPIGRDWYFDL

SEQ ID NO: 38795 - protein, 8 aa, Homo sapiens
  light chain complementarity determining region 3 for antibody 19398
MQALQTPA

SEQ ID NO: 38796 - protein, 15 aa, Homo sapiens
  heavy chain complementarity determining region 3 for antibody 19398
ARRDYYDSSGYRLDY

SEQ ID NO: 38797 - protein, 8 aa, Homo sapiens
  light chain complementarity determining region 3 for antibody 19399
MQALPTPT

SEQ ID NO: 38798 - protein, 15 aa, Homo sapiens
  heavy chain complementarity determining region 3 for antibody 19399
ARRDYYDSSGYRLDY

SEQ ID NO: 38799 - protein, 9 aa, Homo sapiens
  light chain complementarity determining region 3 for antibody 19400
MQALETQFT

SEQ ID NO: 38800 - protein, 15 aa, Homo sapiens
  heavy chain complementarity determining region 3 for antibody 19400
VRHYRELATGIEGDS

SEQ ID NO: 38801 - protein, 9 aa, Homo sapiens
  light chain complementarity determining region 3 for antibody 19401
MQALETPFT

SEQ ID NO: 38802 - protein, 15 aa, Homo sapiens
  heavy chain complementarity determining region 3 for antibody 19401
VRPYRETVAGIEGDS

SEQ ID NO: 38803 - protein, 9 aa, Homo sapiens
  light chain complementarity determining region 3 for antibody 19402
MQALETPFT

SEQ ID NO: 38804 - protein, 15 aa, Homo sapiens
  heavy chain complementarity determining region 3 for antibody 19402
VRHYRIITAPSEGDS

SEQ ID NO: 38805 - protein, 9 aa, Homo sapiens
  light chain complementarity determining region 3 for antibody 19403
MQALETPFT

SEQ ID NO: 38806 - protein, 15 aa, Homo sapiens
  heavy chain complementarity determining region 3 for antibody 19403
VRHYRIITAPLGGDS

SEQ ID NO: 38807 - protein, 9 aa, Homo sapiens
  light chain complementarity determining region 3 for antibody 19404
MQALETPFT

SEQ ID NO: 38808 - protein, 15 aa, Homo sapiens
  heavy chain complementarity determining region 3 for antibody 19404
VRHYRIITAPLEGYS

SEQ ID NO: 38809 - protein, 9 aa, Homo sapiens
  light chain complementarity determining region 3 for antibody 19405
MQALETPFT

SEQ ID NO: 38810 - protein, 15 aa, Homo sapiens
  heavy chain complementarity determining region 3 for antibody 19405
VRHYRIISAPLEGDS

SEQ ID NO: 38811 - protein, 9 aa, Homo sapiens
  light chain complementarity determining region 3 for antibody 19406
MQALETPFT

SEQ ID NO: 38812 - protein, 15 aa, Homo sapiens
  heavy chain complementarity determining region 3 for antibody 19406
VRHYRETVVGIEGDS

SEQ ID NO: 38813 - protein, 9 aa, Homo sapiens
  light chain complementarity determining region 3 for antibody 19407
MQALETPFT

SEQ ID NO: 38814 - protein, 15 aa, Homo sapiens
  heavy chain complementarity determining region 3 for antibody 19407
VRHYRETVAGTEGDS

SEQ ID NO: 38815 - protein, 9 aa, Homo sapiens
  light chain complementarity determining region 3 for antibody 19408
MQALETPFT

SEQ ID NO: 38816 - protein, 15 aa, Homo sapiens
  heavy chain complementarity determining region 3 for antibody 19408
VRHYRETVAGIGGDS

SEQ ID NO: 38817 - protein, 9 aa, Homo sapiens
  light chain complementarity determining region 3 for antibody 19409
MQALETPFT

SEQ ID NO: 38818 - protein, 15 aa, Homo sapiens
  heavy chain complementarity determining region 3 for antibody 19409
VRHYRELATGSEGDS

SEQ ID NO: 38819 - protein, 9 aa, Homo sapiens
  light chain complementarity determining region 3 for antibody 19410
MQALETPFT

SEQ ID NO: 38820 - protein, 15 aa, Homo sapiens
  heavy chain complementarity determining region 3 for antibody 19410
VRHYRELATGIEVDS

SEQ ID NO: 38821 - protein, 9 aa, Homo sapiens
  light chain complementarity determining region 3 for antibody 19411
MQALETPFT

SEQ ID NO: 38822 - protein, 15 aa, Homo sapiens
  heavy chain complementarity determining region 3 for antibody 19411
VRHYRDTVAGIEGDS

SEQ ID NO: 38823 - protein, 9 aa, Homo sapiens
  light chain complementarity determining region 3 for antibody 19412
MQALETPFT

SEQ ID NO: 38824 - protein, 15 aa, Homo sapiens
  heavy chain complementarity determining region 3 for antibody 19412
LRHYRSLVTTTEADY

SEQ ID NO: 38825 - protein, 9 aa, Homo sapiens
  light chain complementarity determining region 3 for antibody 19413
MQALETPFP

SEQ ID NO: 38826 - protein, 15 aa, Homo sapiens
  heavy chain complementarity determining region 3 for antibody 19413
VRHYRLTVAGIEGDS

SEQ ID NO: 38827 - protein, 9 aa, Homo sapiens
  light chain complementarity determining region 3 for antibody 19414
MQALETPFP

SEQ ID NO: 38828 - protein, 15 aa, Homo sapiens
  heavy chain complementarity determining region 3 for antibody 19414
VRHYRETVAGIEGDC

SEQ ID NO: 38829 - protein, 9 aa, Homo sapiens
  light chain complementarity determining region 3 for antibody 19415
MQALETPFA

SEQ ID NO: 38830 - protein, 15 aa, Homo sapiens
  heavy chain complementarity determining region 3 for antibody 19415
VRHYRETVAGIEGDS

SEQ ID NO: 38831 - protein, 9 aa, Homo sapiens
  light chain complementarity determining region 3 for antibody 19416
MQALESPFT

SEQ ID NO: 38832 - protein, 15 aa, Homo sapiens
  heavy chain complementarity determining region 3 for antibody 19416
VRHYRELATGFEGDS

SEQ ID NO: 38833 - protein, 9 aa, Homo sapiens
  light chain complementarity determining region 3 for antibody 19417
MQALEIPFT

SEQ ID NO: 38834 - protein, 15 aa, Homo sapiens
  heavy chain complementarity determining region 3 for antibody 19417
VRHYRELATGFEGDS

SEQ ID NO: 38835 - protein, 9 aa, Homo sapiens
  light chain complementarity determining region 3 for antibody 19418
MQALEIPFT

SEQ ID NO: 38836 - protein, 15 aa, Homo sapiens
  heavy chain complementarity determining region 3 for antibody 19418
IRHYRITVAGIEGDS

SEQ ID NO: 38837 - protein, 9 aa, Homo sapiens
  light chain complementarity determining region 3 for antibody 19419
MQALDTPFT

SEQ ID NO: 38838 - protein, 15 aa, Homo sapiens
  heavy chain complementarity determining region 3 for antibody 19419
LRHYRSLLTTTEGDS

SEQ ID NO: 38839 - protein, 9 aa, Homo sapiens
  light chain complementarity determining region 3 for antibody 19420
MQALDIPFT

SEQ ID NO: 38840 - protein, 15 aa, Homo sapiens
  heavy chain complementarity determining region 3 for antibody 19420
VRHYRETVAGIEGDS

SEQ ID NO: 38841 - protein, 9 aa, Homo sapiens
  light chain complementarity determining region 3 for antibody 19421
MQAIEPPFT

SEQ ID NO: 38842 - protein, 15 aa, Homo sapiens
  heavy chain complementarity determining region 3 for antibody 19421
VRHYRETVAGIEGDS

SEQ ID NO: 38843 - protein, 9 aa, Homo sapiens
  light chain complementarity determining region 3 for antibody 19422
MHALETPFT

SEQ ID NO: 38844 - protein, 15 aa, Homo sapiens
  heavy chain complementarity determining region 3 for antibody 19422
VRHYRELATGIEGDS

SEQ ID NO: 38845 - protein, 9 aa, Homo sapiens
  light chain complementarity determining region 3 for antibody 19423
MGTLQTPPT

SEQ ID NO: 38846 - protein, 15 aa, Homo sapiens
  heavy chain complementarity determining region 3 for antibody 19423
TRDGKKDGHNDAFDL

SEQ ID NO: 38847 - protein, 9 aa, Homo sapiens
  light chain complementarity determining region 3 for antibody 19424
MGTLQSPPP

SEQ ID NO: 38848 - protein, 15 aa, Homo sapiens
  heavy chain complementarity determining region 3 for antibody 19424
TRDGKRDGHNDAFDI

SEQ ID NO: 38849 - protein, 9 aa, Homo sapiens
  light chain complementarity determining region 3 for antibody 19425
MGTLQNPPT

SEQ ID NO: 38850 - protein, 15 aa, Homo sapiens
  heavy chain complementarity determining region 3 for antibody 19425
TRDGKKDGHNDAFDI

SEQ ID NO: 38851 - protein, 9 aa, Homo sapiens
  light chain complementarity determining region 3 for antibody 19426
MEVVQSPGT

SEQ ID NO: 38852 - protein, 18 aa, Homo sapiens
  heavy chain complementarity determining region 3 for antibody 19426
IRGGRMYCSGEPCYSGSL

SEQ ID NO: 38853 - protein, 9 aa, Homo sapiens
  light chain complementarity determining region 3 for antibody 19427
MEGVQSPWT

SEQ ID NO: 38854 - protein, 18 aa, Homo sapiens
  heavy chain complementarity determining region 3 for antibody 19427
IRGGRMYCSGEPCYSGSL

SEQ ID NO: 38855 - protein, 9 aa, Homo sapiens
  light chain complementarity determining region 3 for antibody 19428
LQYYSTPRT

SEQ ID NO: 38856 - protein, 15 aa, Homo sapiens
  heavy chain complementarity determining region 3 for antibody 19428
IRQSKVDNYYNYPDF

SEQ ID NO: 38857 - protein, 9 aa, Homo sapiens
  light chain complementarity determining region 3 for antibody 19429
LQYYSPPWT

SEQ ID NO: 38858 - protein, 15 aa, Homo sapiens
  heavy chain complementarity determining region 3 for antibody 19429
IRQSKVDNYYNYPDF

SEQ ID NO: 38859 - protein, 9 aa, Homo sapiens
  light chain complementarity determining region 3 for antibody 19430
LQYYFTPWT

SEQ ID NO: 38860 - protein, 15 aa, Homo sapiens
  heavy chain complementarity determining region 3 for antibody 19430
IRQSKVDNYYNYPDF

SEQ ID NO: 38861 - protein, 9 aa, Homo sapiens
  light chain complementarity determining region 3 for antibody 19431
LQYYATPGT

SEQ ID NO: 38862 - protein, 15 aa, Homo sapiens
  heavy chain complementarity determining region 3 for antibody 19431
VRQSKVDNNYNYPDF

SEQ ID NO: 38863 - protein, 8 aa, Homo sapiens
  light chain complementarity determining region 3 for antibody 19432
LQYNSYLT

SEQ ID NO: 38864 - protein, 14 aa, Homo sapiens
  heavy chain complementarity determining region 3 for antibody 19432
ARNSEGSGWFPCDY

SEQ ID NO: 38865 - protein, 9 aa, Homo sapiens
  light chain complementarity determining region 3 for antibody 19433
LQYGLAQYS

SEQ ID NO: 38866 - protein, 18 aa, Homo sapiens
  heavy chain complementarity determining region 3 for antibody 19433
TGVHGLTMLRGATKPFDF

SEQ ID NO: 38867 - protein, 9 aa, Homo sapiens
  light chain complementarity determining region 3 for antibody 19434
LQYGGKPLT

SEQ ID NO: 38868 - protein, 8 aa, Homo sapiens
  heavy chain complementarity determining region 3 for antibody 19434
VRIMDPGY

SEQ ID NO: 38869 - protein, 9 aa, Homo sapiens
  light chain complementarity determining region 3 for antibody 19435
LQYGFPQYS

SEQ ID NO: 38870 - protein, 18 aa, Homo sapiens
  heavy chain complementarity determining region 3 for antibody 19435
TGVHGLTMLRGATKPFDF

SEQ ID NO: 38871 - protein, 9 aa, Homo sapiens
  light chain complementarity determining region 3 for antibody 19436
LQYGFAQYS

SEQ ID NO: 38872 - protein, 18 aa, Homo sapiens
  heavy chain complementarity determining region 3 for antibody 19436
TGVHGRTMLRGATKPFDF

SEQ ID NO: 38873 - protein, 9 aa, Homo sapiens
  light chain complementarity determining region 3 for antibody 19437
LQYGFAQYS

SEQ ID NO: 38874 - protein, 18 aa, Homo sapiens
  heavy chain complementarity determining region 3 for antibody 19437
TGVHGLTMRRGATKPFDF

SEQ ID NO: 38875 - protein, 9 aa, Homo sapiens
  light chain complementarity determining region 3 for antibody 19438
LQYGFAQYS

SEQ ID NO: 38876 - protein, 18 aa, Homo sapiens
  heavy chain complementarity determining region 3 for antibody 19438
TGVHGLTMPRGATKPFDF

SEQ ID NO: 38877 - protein, 9 aa, Homo sapiens
  light chain complementarity determining region 3 for antibody 19439
LQYGCAQYS

SEQ ID NO: 38878 - protein, 18 aa, Homo sapiens
  heavy chain complementarity determining region 3 for antibody 19439
TGVHGLTMLRGATKPFDF

SEQ ID NO: 38879 - protein, 9 aa, Homo sapiens
  light chain complementarity determining region 3 for antibody 19440
LQVNRFPHT

SEQ ID NO: 38880 - protein, 14 aa, Homo sapiens
  heavy chain complementarity determining region 3 for antibody 19440
ARYCSGNSCYSMDH

SEQ ID NO: 38881 - protein, 9 aa, Homo sapiens
  light chain complementarity determining region 3 for antibody 19441
LQSHSSPLT

SEQ ID NO: 38882 - protein, 17 aa, Homo sapiens
  heavy chain complementarity determining region 3 for antibody 19441
AKDHFPFAAGRRGGVDY

SEQ ID NO: 38883 - protein, 9 aa, Homo sapiens
  light chain complementarity determining region 3 for antibody 19442
LQNEYWPRT

SEQ ID NO: 38884 - protein, 11 aa, Homo sapiens
  heavy chain complementarity determining region 3 for antibody 19442
GRVGGAGYFDH

SEQ ID NO: 38885 - protein, 9 aa, Homo sapiens
  light chain complementarity determining region 3 for antibody 19443
LQNEYWPGT

SEQ ID NO: 38886 - protein, 11 aa, Homo sapiens
  heavy chain complementarity determining region 3 for antibody 19443
VRVGGAGYFDH

SEQ ID NO: 38887 - protein, 9 aa, Homo sapiens
  light chain complementarity determining region 3 for antibody 19444
LQNENWPRT

SEQ ID NO: 38888 - protein, 11 aa, Homo sapiens
  heavy chain complementarity determining region 3 for antibody 19444
VRVGGAGYFDH

SEQ ID NO: 38889 - protein, 9 aa, Homo sapiens
  light chain complementarity determining region 3 for antibody 19445
LQHNSYPWT

SEQ ID NO: 38890 - protein, 16 aa, Homo sapiens
  heavy chain complementarity determining region 3 for antibody 19445
ARVGISVIAAGGSPDN

SEQ ID NO: 38891 - protein, 9 aa, Homo sapiens
  light chain complementarity determining region 3 for antibody 19446
LQHNSYPRT

SEQ ID NO: 38892 - protein, 13 aa, Homo sapiens
  heavy chain complementarity determining region 3 for antibody 19446
VRHAVVRPMVVDD

SEQ ID NO: 38893 - protein, 9 aa, Homo sapiens
  light chain complementarity determining region 3 for antibody 19447
LQHNSYPLT

SEQ ID NO: 38894 - protein, 13 aa, Homo sapiens
  heavy chain complementarity determining region 3 for antibody 19447
VSHAVVRPMVVDD

SEQ ID NO: 38895 - protein, 9 aa, Homo sapiens
  light chain complementarity determining region 3 for antibody 19448
LQHNSYPLT

SEQ ID NO: 38896 - protein, 13 aa, Homo sapiens
  heavy chain complementarity determining region 3 for antibody 19448
VRHAVVRPMVVGD

SEQ ID NO: 38897 - protein, 9 aa, Homo sapiens
  light chain complementarity determining region 3 for antibody 19449
LQHNSYPLT

SEQ ID NO: 38898 - protein, 13 aa, Homo sapiens
  heavy chain complementarity determining region 3 for antibody 19449
VRHAVLRPMVVDD

SEQ ID NO: 38899 - protein, 9 aa, Homo sapiens
  light chain complementarity determining region 3 for antibody 19450
LQHNSYPLT

SEQ ID NO: 38900 - protein, 22 aa, Homo sapiens
  heavy chain complementarity determining region 3 for antibody 19450
ARDQASTVVVVSRPWEVSDLPF

SEQ ID NO: 38901 - protein, 9 aa, Homo sapiens
  light chain complementarity determining region 3 for antibody 19451
LQHNSYPLN

SEQ ID NO: 38902 - protein, 13 aa, Homo sapiens
  heavy chain complementarity determining region 3 for antibody 19451
VRHAVVRPMVVDD

SEQ ID NO: 38903 - protein, 9 aa, Homo sapiens
  light chain complementarity determining region 3 for antibody 19452
LQHNGYPLT

SEQ ID NO: 38904 - protein, 13 aa, Homo sapiens
  heavy chain complementarity determining region 3 for antibody 19452
VRHAVVRPMVVDD

SEQ ID NO: 38905 - protein, 9 aa, Homo sapiens
  light chain complementarity determining region 3 for antibody 19453
LQHNCYPLT

SEQ ID NO: 38906 - protein, 13 aa, Homo sapiens
  heavy chain complementarity determining region 3 for antibody 19453
VRHAVVRPMVVDD

SEQ ID NO: 38907 - protein, 9 aa, Homo sapiens
  light chain complementarity determining region 3 for antibody 19454
LQHEYWPRT

SEQ ID NO: 38908 - protein, 11 aa, Homo sapiens
  heavy chain complementarity determining region 3 for antibody 19454
VRVGGAGYFDH

SEQ ID NO: 38909 - protein, 9 aa, Homo sapiens
  light chain complementarity determining region 3 for antibody 19455
LQGTLWPGP

SEQ ID NO: 38910 - protein, 12 aa, Homo sapiens
  heavy chain complementarity determining region 3 for antibody 19455
VTGDSARHYFGF

SEQ ID NO: 38911 - protein, 9 aa, Homo sapiens
  light chain complementarity determining region 3 for antibody 19456
LQGTLGPWT

SEQ ID NO: 38912 - protein, 12 aa, Homo sapiens
  heavy chain complementarity determining region 3 for antibody 19456
VTGDSARHYFGF

SEQ ID NO: 38913 - protein, 9 aa, Homo sapiens
  light chain complementarity determining region 3 for antibody 19457
LQGNRFPYT

SEQ ID NO: 38914 - protein, 14 aa, Homo sapiens
  heavy chain complementarity determining region 3 for antibody 19457
ARYCSGNSCYSMDH

SEQ ID NO: 38915 - protein, 9 aa, Homo sapiens
  light chain complementarity determining region 3 for antibody 19458
LQGNRFPPT

SEQ ID NO: 38916 - protein, 14 aa, Homo sapiens
  heavy chain complementarity determining region 3 for antibody 19458
ARYCSGSSCYSMDY

SEQ ID NO: 38917 - protein, 9 aa, Homo sapiens
  light chain complementarity determining region 3 for antibody 19459
LQGNRFPHT

SEQ ID NO: 38918 - protein, 14 aa, Homo sapiens
  heavy chain complementarity determining region 3 for antibody 19459
ARYCSGNSCYSMGH

SEQ ID NO: 38919 - protein, 9 aa, Homo sapiens
  light chain complementarity determining region 3 for antibody 19460
LQDYNYPRT

SEQ ID NO: 38920 - protein, 15 aa, Homo sapiens
  heavy chain complementarity determining region 3 for antibody 19460
ARSPRYSSSRGRFDP

SEQ ID NO: 38921 - protein, 9 aa, Homo sapiens
  light chain complementarity determining region 3 for antibody 19461
LQASYCPRT

SEQ ID NO: 38922 - protein, 9 aa, Homo sapiens
  heavy chain complementarity determining region 3 for antibody 19461
VAGHLTFDH

SEQ ID NO: 38923 - protein, 9 aa, Homo sapiens
  light chain complementarity determining region 3 for antibody 19462
LKHDNFPYS

SEQ ID NO: 38924 - protein, 12 aa, Homo sapiens
  heavy chain complementarity determining region 3 for antibody 19462
AREWDSGWYPAS

SEQ ID NO: 38925 - protein, 8 aa, Homo sapiens
  light chain complementarity determining region 3 for antibody 19463
HQYYSTHT

SEQ ID NO: 38926 - protein, 10 aa, Homo sapiens
  heavy chain complementarity determining region 3 for antibody 19463
ASLNRRTARR

SEQ ID NO: 38927 - protein, 9 aa, Homo sapiens
  light chain complementarity determining region 3 for antibody 19464
HQYYSSPRR

SEQ ID NO: 38928 - protein, 13 aa, Homo sapiens
  heavy chain complementarity determining region 3 for antibody 19464
ARGQSGDPRTYDY

SEQ ID NO: 38929 - protein, 9 aa, Homo sapiens
  light chain complementarity determining region 3 for antibody 19465
HQYYSPPRM

SEQ ID NO: 38930 - protein, 13 aa, Homo sapiens
  heavy chain complementarity determining region 3 for antibody 19465
ARGQSGDPRTYDY

SEQ ID NO: 38931 - protein, 9 aa, Homo sapiens
  light chain complementarity determining region 3 for antibody 19466
HQYSSSPNT

SEQ ID NO: 38932 - protein, 13 aa, Homo sapiens
  heavy chain complementarity determining region 3 for antibody 19466
ARGTYSAFAIFGV

SEQ ID NO: 38933 - protein, 9 aa, Homo sapiens
  light chain complementarity determining region 3 for antibody 19467
HQYRTTPPT

SEQ ID NO: 38934 - protein, 12 aa, Homo sapiens
  heavy chain complementarity determining region 3 for antibody 19467
AKYPDNSFWYES

SEQ ID NO: 38935 - protein, 9 aa, Homo sapiens
  light chain complementarity determining region 3 for antibody 19468
HQYGTPPRT

SEQ ID NO: 38936 - protein, 25 aa, Homo sapiens
  heavy chain complementarity determining region 3 for antibody 19468
ARLRVDRLRLPGAMRGPLYDRGLNV

SEQ ID NO: 38937 - protein, 9 aa, Homo sapiens
  light chain complementarity determining region 3 for antibody 19469
HQYAESPRM

SEQ ID NO: 38938 - protein, 17 aa, Homo sapiens
  heavy chain complementarity determining region 3 for antibody 19469
AKSVGVGDAMTTRVYDS

SEQ ID NO: 38939 - protein, 9 aa, Homo sapiens
  light chain complementarity determining region 3 for antibody 19470
HQSSSFPGT

SEQ ID NO: 38940 - protein, 19 aa, Homo sapiens
  heavy chain complementarity determining region 3 for antibody 19470
ARTGYDILSDSPFVDAFDI

SEQ ID NO: 38941 - protein, 9 aa, Homo sapiens
  light chain complementarity determining region 3 for antibody 19471
HQRSSWPYT

SEQ ID NO: 38942 - protein, 11 aa, Homo sapiens
  heavy chain complementarity determining region 3 for antibody 19471
VKRWGGSSIDY

SEQ ID NO: 38943 - protein, 9 aa, Homo sapiens
  light chain complementarity determining region 3 for antibody 19472
HQRSNWPPL

SEQ ID NO: 38944 - protein, 12 aa, Homo sapiens
  heavy chain complementarity determining region 3 for antibody 19472
ARSLKSWGNFDY

SEQ ID NO: 38945 - protein, 9 aa, Homo sapiens
  light chain complementarity determining region 3 for antibody 19473
HQIHTFPIT

SEQ ID NO: 38946 - protein, 11 aa, Homo sapiens
  heavy chain complementarity determining region 3 for antibody 19473
TSDNGKWAFDA

SEQ ID NO: 38947 - protein, 9 aa, Homo sapiens
  light chain complementarity determining region 3 for antibody 19474
HQGGVLPWT

SEQ ID NO: 38948 - protein, 14 aa, Homo sapiens
  heavy chain complementarity determining region 3 for antibody 19474
VRDASGNSGWYAAS

SEQ ID NO: 38949 - protein, 9 aa, Homo sapiens
  light chain complementarity determining region 3 for antibody 19475
HQCSYSPLP

SEQ ID NO: 38950 - protein, 10 aa, Homo sapiens
  heavy chain complementarity determining region 3 for antibody 19475
AWGIGWTSNY

SEQ ID NO: 38951 - protein, 9 aa, Homo sapiens
  light chain complementarity determining region 3 for antibody 19476
HPSGALPWT

SEQ ID NO: 38952 - protein, 14 aa, Homo sapiens
  heavy chain complementarity determining region 3 for antibody 19476
VRDASGNSGWYADS

SEQ ID NO: 38953 - protein, 9 aa, Homo sapiens
  light chain complementarity determining region 3 for antibody 19477
HHTYTFPRT

SEQ ID NO: 38954 - protein, 4 aa, Homo sapiens
  heavy chain complementarity determining region 3 for antibody 19477
GMDV

SEQ ID NO: 38955 - protein, 9 aa, Homo sapiens
  light chain complementarity determining region 3 for antibody 19478
HHTYTFPRT

SEQ ID NO: 38956 - protein, 20 aa, Homo sapiens
  heavy chain complementarity determining region 3 for antibody 19478
ARVRRIAALSTAHYYYGMDV

SEQ ID NO: 38957 - protein, 9 aa, Homo sapiens
  light chain complementarity determining region 3 for antibody 19479
HHTYTFPRT

SEQ ID NO: 38958 - protein, 20 aa, Homo sapiens
  heavy chain complementarity determining region 3 for antibody 19479
ARGRRRAALSTAHYYYGMDV

SEQ ID NO: 38959 - protein, 9 aa, Homo sapiens
  light chain complementarity determining region 3 for antibody 19480
HHTYTFPRT

SEQ ID NO: 38960 - protein, 20 aa, Homo sapiens
  heavy chain complementarity determining region 3 for antibody 19480
ARGRRIAALSTAHDYYGMDV

SEQ ID NO: 38961 - protein, 9 aa, Homo sapiens
  light chain complementarity determining region 3 for antibody 19481
HHTYNFPRT

SEQ ID NO: 38962 - protein, 20 aa, Homo sapiens
  heavy chain complementarity determining region 3 for antibody 19481
ARGRRIAALSTAHYYYGMDV

SEQ ID NO: 38963 - protein, 9 aa, Homo sapiens
  light chain complementarity determining region 3 for antibody 19482
HHTSTFPRT

SEQ ID NO: 38964 - protein, 20 aa, Homo sapiens
  heavy chain complementarity determining region 3 for antibody 19482
SRGRRIAALSTAHYYYGMDV

SEQ ID NO: 38965 - protein, 9 aa, Homo sapiens
  light chain complementarity determining region 3 for antibody 19483
HHTSTFPRT

SEQ ID NO: 38966 - protein, 20 aa, Homo sapiens
  heavy chain complementarity determining region 3 for antibody 19483
ARGRRRAALSTAHYYYGMDV

SEQ ID NO: 38967 - protein, 9 aa, Homo sapiens
  light chain complementarity determining region 3 for antibody 19484
HHTSTFPRT

SEQ ID NO: 38968 - protein, 20 aa, Homo sapiens
  heavy chain complementarity determining region 3 for antibody 19484
ARCRRIAALSTAHYYYGMDV

SEQ ID NO: 38969 - protein, 9 aa, Homo sapiens
  light chain complementarity determining region 3 for antibody 19485
HHTSTFPRS

SEQ ID NO: 38970 - protein, 20 aa, Homo sapiens
  heavy chain complementarity determining region 3 for antibody 19485
ARGRRIAALSTAHYYYGMDV

SEQ ID NO: 38971 - protein, 9 aa, Homo sapiens
  light chain complementarity determining region 3 for antibody 19486
HHTSTFLRT

SEQ ID NO: 38972 - protein, 20 aa, Homo sapiens
  heavy chain complementarity determining region 3 for antibody 19486
ARGRRIAALSTAHYYYGMDV

SEQ ID NO: 38973 - protein, 10 aa, Homo sapiens
  light chain complementarity determining region 3 for antibody 19487
HEYNNGPNHS

SEQ ID NO: 38974 - protein, 16 aa, Homo sapiens
  heavy chain complementarity determining region 3 for antibody 19487
ARLGRMDYSGSAPFPY

SEQ ID NO: 38975 - protein, 9 aa, Homo sapiens
  light chain complementarity determining region 3 for antibody 19488
EQRLDWPLP

SEQ ID NO: 38976 - protein, 11 aa, Homo sapiens
  heavy chain complementarity determining region 3 for antibody 19488
ARNILGGHTDF

SEQ ID NO: 38977 - protein, 9 aa, Homo sapiens
  light chain complementarity determining region 3 for antibody 19489
YQYGRSPWT

SEQ ID NO: 38978 - protein, 11 aa, Homo sapiens
  heavy chain complementarity determining region 3 for antibody 19489
ATWAFYHGVDV

SEQ ID NO: 38979 - protein, 9 aa, Homo sapiens
  light chain complementarity determining region 3 for antibody 19490
YHTSTFPRT

SEQ ID NO: 38980 - protein, 20 aa, Homo sapiens
  heavy chain complementarity determining region 3 for antibody 19490
ARGRRIAALSTAHYYYGMDV

SEQ ID NO: 38981 - protein, 9 aa, Homo sapiens
  light chain complementarity determining region 3 for antibody 19491
VQYNRDPRT

SEQ ID NO: 38982 - protein, 6 aa, Homo sapiens
  heavy chain complementarity determining region 3 for antibody 19491
TRALDY

SEQ ID NO: 38983 - protein, 9 aa, Homo sapiens
  light chain complementarity determining region 3 for antibody 19492
RQYGGLGKT

SEQ ID NO: 38984 - protein, 12 aa, Homo sapiens
  heavy chain complementarity determining region 3 for antibody 19492
ARGGIWTGGFDY

SEQ ID NO: 38985 - protein, 9 aa, Homo sapiens
  light chain complementarity determining region 3 for antibody 19493
RQTNSNPPT

SEQ ID NO: 38986 - protein, 14 aa, Homo sapiens
  heavy chain complementarity determining region 3 for antibody 19493
ARGGLGIWGNSSDI

SEQ ID NO: 38987 - protein, 10 aa, Homo sapiens
  light chain complementarity determining region 3 for antibody 19494
RQSFSSSPIT

SEQ ID NO: 38988 - protein, 16 aa, Homo sapiens
  heavy chain complementarity determining region 3 for antibody 19494
ARQGPWTTVVTPHFDH

SEQ ID NO: 38989 - protein, 9 aa, Homo sapiens
  light chain complementarity determining region 3 for antibody 19495
RQRSNWPPT

SEQ ID NO: 38990 - protein, 8 aa, Homo sapiens
  heavy chain complementarity determining region 3 for antibody 19495
ATLGNDSD

SEQ ID NO: 38991 - protein, 10 aa, Homo sapiens
  light chain complementarity determining region 3 for antibody 19496
RQRSKWPPLT

SEQ ID NO: 38992 - protein, 9 aa, Homo sapiens
  heavy chain complementarity determining region 3 for antibody 19496
ARVDGYFDY

SEQ ID NO: 38993 - protein, 10 aa, Homo sapiens
  light chain complementarity determining region 3 for antibody 19497
RQGTYWPPGT

SEQ ID NO: 38994 - protein, 13 aa, Homo sapiens
  heavy chain complementarity determining region 3 for antibody 19497
VRDGDSTTWPLDF

SEQ ID NO: 38995 - protein, 9 aa, Homo sapiens
  light chain complementarity determining region 3 for antibody 19498
RQALETPST

SEQ ID NO: 38996 - protein, 15 aa, Homo sapiens
  heavy chain complementarity determining region 3 for antibody 19498
VRHYRIITAPLEGDS

SEQ ID NO: 38997 - protein, 9 aa, Homo sapiens
  light chain complementarity determining region 3 for antibody 19499
RQALETPFN

SEQ ID NO: 38998 - protein, 15 aa, Homo sapiens
  heavy chain complementarity determining region 3 for antibody 19499
VRHYRIITAPLEGDS

SEQ ID NO: 38999 - protein, 9 aa, Homo sapiens
  light chain complementarity determining region 3 for antibody 19500
RGTLQTPPT

SEQ ID NO: 39000 - protein, 15 aa, Homo sapiens
  heavy chain complementarity determining region 3 for antibody 19500
TRDGKKDGHNDAFDI

SEQ ID NO: 39001 - protein, 8 aa, Homo sapiens
  light chain complementarity determining region 3 for antibody 19501
QYYGYSPT

SEQ ID NO: 39002 - protein, 9 aa, Homo sapiens
  heavy chain complementarity determining region 3 for antibody 19501
ARGYDACDI

SEQ ID NO: 39003 - protein, 9 aa, Homo sapiens
  light chain complementarity determining region 3 for antibody 19502
QYYGAPPCT

SEQ ID NO: 39004 - protein, 11 aa, Homo sapiens
  heavy chain complementarity determining region 3 for antibody 19502
ARGEVGYAFDI

SEQ ID NO: 39005 - protein, 10 aa, Homo sapiens
  light chain complementarity determining region 3 for antibody 19503
QYYDDSPGYT

SEQ ID NO: 39006 - protein, 12 aa, Homo sapiens
  heavy chain complementarity determining region 3 for antibody 19503
ARETTNIGEFDY

SEQ ID NO: 39007 - protein, 11 aa, Homo sapiens
  light chain complementarity determining region 3 for antibody 19504
QYRHNWPAVYT

SEQ ID NO: 39008 - protein, 15 aa, Homo sapiens
  heavy chain complementarity determining region 3 for antibody 19504
AREGVDRLTISAFDI

SEQ ID NO: 39009 - protein, 11 aa, Homo sapiens
  light chain complementarity determining region 3 for antibody 19505
QVFDTSPPMYT

SEQ ID NO: 39010 - protein, 23 aa, Homo sapiens
  heavy chain complementarity determining region 3 for antibody 19505
ARATRRYRRSDSRMDFLYFGMDV

SEQ ID NO: 39011 - protein, 9 aa, Homo sapiens
  light chain complementarity determining region 3 for antibody 19506
QRYNNYPWT

SEQ ID NO: 39012 - protein, 16 aa, Homo sapiens
  heavy chain complementarity determining region 3 for antibody 19506
AKDRGEVAILIDAFDI

SEQ ID NO: 39013 - protein, 9 aa, Homo sapiens
  light chain complementarity determining region 3 for antibody 19507
QRYIRAPWT

SEQ ID NO: 39014 - protein, 12 aa, Homo sapiens
  heavy chain complementarity determining region 3 for antibody 19507
ARGRTGILPADY

SEQ ID NO: 39015 - protein, 10 aa, Homo sapiens
  light chain complementarity determining region 3 for antibody 19508
QRYGSSPMYS

SEQ ID NO: 39016 - protein, 11 aa, Homo sapiens
  heavy chain complementarity determining region 3 for antibody 19508
ARGGQWGSLDY

SEQ ID NO: 39017 - protein, 9 aa, Homo sapiens
  light chain complementarity determining region 3 for antibody 19509
QRYGSSPLT

SEQ ID NO: 39018 - protein, 13 aa, Homo sapiens
  heavy chain complementarity determining region 3 for antibody 19509
AHSQWLVLDVFDF

SEQ ID NO: 39019 - protein, 9 aa, Homo sapiens
  light chain complementarity determining region 3 for antibody 19510
QQYYVLPFT

SEQ ID NO: 39020 - protein, 12 aa, Homo sapiens
  heavy chain complementarity determining region 3 for antibody 19510
VRSGHSYSHFDY

SEQ ID NO: 39021 - protein, 9 aa, Homo sapiens
  light chain complementarity determining region 3 for antibody 19511
QQYYTTPWT

SEQ ID NO: 39022 - protein, 17 aa, Homo sapiens
  heavy chain complementarity determining region 3 for antibody 19511
SRQAHFYGTSAYDYPDS

SEQ ID NO: 39023 - protein, 9 aa, Homo sapiens
  light chain complementarity determining region 3 for antibody 19512
QQYYTTPRP

SEQ ID NO: 39024 - protein, 11 aa, Homo sapiens
  heavy chain complementarity determining region 3 for antibody 19512
TRGQDRSKQGY

SEQ ID NO: 39025 - protein, 9 aa, Homo sapiens
  light chain complementarity determining region 3 for antibody 19513
QQYYTTPRI

SEQ ID NO: 39026 - protein, 8 aa, Homo sapiens
  heavy chain complementarity determining region 3 for antibody 19513
ARDGAFDS

SEQ ID NO: 39027 - protein, 9 aa, Homo sapiens
  light chain complementarity determining region 3 for antibody 19514
QQYYTSPRT

SEQ ID NO: 39028 - protein, 8 aa, Homo sapiens
  heavy chain complementarity determining region 3 for antibody 19514
ARDGAFDS

SEQ ID NO: 39029 - protein, 9 aa, Homo sapiens
  light chain complementarity determining region 3 for antibody 19515
QQYYTSLRT

SEQ ID NO: 39030 - protein, 12 aa, Homo sapiens
  heavy chain complementarity determining region 3 for antibody 19515
VKECGLGGSRDS

SEQ ID NO: 39031 - protein, 9 aa, Homo sapiens
  light chain complementarity determining region 3 for antibody 19516
QQYYTSLRT

SEQ ID NO: 39032 - protein, 12 aa, Homo sapiens
  heavy chain complementarity determining region 3 for antibody 19516
VKDCGLGGSRDA

SEQ ID NO: 39033 - protein, 9 aa, Homo sapiens
  light chain complementarity determining region 3 for antibody 19517
QQYYTSLRS

SEQ ID NO: 39034 - protein, 12 aa, Homo sapiens
  heavy chain complementarity determining region 3 for antibody 19517
VKDCGLGGSRDS

SEQ ID NO: 39035 - protein, 9 aa, Homo sapiens
  light chain complementarity determining region 3 for antibody 19518
QQYYTSLRA

SEQ ID NO: 39036 - protein, 12 aa, Homo sapiens
  heavy chain complementarity determining region 3 for antibody 19518
VKDCGLGGSRDS

SEQ ID NO: 39037 - protein, 9 aa, Homo sapiens
  light chain complementarity determining region 3 for antibody 19519
QQYYTSLPT

SEQ ID NO: 39038 - protein, 12 aa, Homo sapiens
  heavy chain complementarity determining region 3 for antibody 19519
VKDCGLGGSRDS

SEQ ID NO: 39039 - protein, 11 aa, Homo sapiens
  light chain complementarity determining region 3 for antibody 19520
QQYYTSLLGFI

SEQ ID NO: 39040 - protein, 12 aa, Homo sapiens
  heavy chain complementarity determining region 3 for antibody 19520
ATSPSPYYHLDF

SEQ ID NO: 39041 - protein, 9 aa, Homo sapiens
  light chain complementarity determining region 3 for antibody 19521
QQYYTSART

SEQ ID NO: 39042 - protein, 12 aa, Homo sapiens
  heavy chain complementarity determining region 3 for antibody 19521
VKDCGLGGSRDS

SEQ ID NO: 39043 - protein, 9 aa, Homo sapiens
  light chain complementarity determining region 3 for antibody 19522
QQYYTPVRT

SEQ ID NO: 39044 - protein, 12 aa, Homo sapiens
  heavy chain complementarity determining region 3 for antibody 19522
VKDCGLGGSRDF

SEQ ID NO: 39045 - protein, 9 aa, Homo sapiens
  light chain complementarity determining region 3 for antibody 19523
QQYYTFVRT

SEQ ID NO: 39046 - protein, 12 aa, Homo sapiens
  heavy chain complementarity determining region 3 for antibody 19523
VKDCGLGGSRDF

SEQ ID NO: 39047 - protein, 9 aa, Homo sapiens
  light chain complementarity determining region 3 for antibody 19524
QQYYTFPRT

SEQ ID NO: 39048 - protein, 12 aa, Homo sapiens
  heavy chain complementarity determining region 3 for antibody 19524
VKDCGLGGSRDS

SEQ ID NO: 39049 - protein, 8 aa, Homo sapiens
  light chain complementarity determining region 3 for antibody 19525
QQYYSYWT

SEQ ID NO: 39050 - protein, 18 aa, Homo sapiens
  heavy chain complementarity determining region 3 for antibody 19525
TREGCGANKNVINWYFDL

SEQ ID NO: 39051 - protein, 9 aa, Homo sapiens
  light chain complementarity determining region 3 for antibody 19526
QQYYSYPRT

SEQ ID NO: 39052 - protein, 11 aa, Homo sapiens
  heavy chain complementarity determining region 3 for antibody 19526
ARDFSNGPFAH

SEQ ID NO: 39053 - protein, 9 aa, Homo sapiens
  light chain complementarity determining region 3 for antibody 19527
QQYYSVPWT

SEQ ID NO: 39054 - protein, 14 aa, Homo sapiens
  heavy chain complementarity determining region 3 for antibody 19527
AKDGGRGGGSAFDY

SEQ ID NO: 39055 - protein, 9 aa, Homo sapiens
  light chain complementarity determining region 3 for antibody 19528
QQYYSTPWT

SEQ ID NO: 39056 - protein, 15 aa, Homo sapiens
  heavy chain complementarity determining region 3 for antibody 19528
IRQSKVDGNYNYPDF

SEQ ID NO: 39057 - protein, 10 aa, Homo sapiens
  light chain complementarity determining region 3 for antibody 19529
QQYYSTPSIP

SEQ ID NO: 39058 - protein, 15 aa, Homo sapiens
  heavy chain complementarity determining region 3 for antibody 19529
AAVIYYDGDYYGMDV

SEQ ID NO: 39059 - protein, 10 aa, Homo sapiens
  light chain complementarity determining region 3 for antibody 19530
QQYYSTPPIT

SEQ ID NO: 39060 - protein, 15 aa, Homo sapiens
  heavy chain complementarity determining region 3 for antibody 19530
AAVIYYDGDYYGMDV

SEQ ID NO: 39061 - protein, 9 aa, Homo sapiens
  light chain complementarity determining region 3 for antibody 19531
QQYYSTPHT

SEQ ID NO: 39062 - protein, 9 aa, Homo sapiens
  heavy chain complementarity determining region 3 for antibody 19531
ARRLAALDY

SEQ ID NO: 39063 - protein, 9 aa, Homo sapiens
  light chain complementarity determining region 3 for antibody 19532
QQYYSNPGT

SEQ ID NO: 39064 - protein, 15 aa, Homo sapiens
  heavy chain complementarity determining region 3 for antibody 19532
ARGSESSGFYWYFDL

SEQ ID NO: 39065 - protein, 9 aa, Homo sapiens
  light chain complementarity determining region 3 for antibody 19533
QQYYSFPPT

SEQ ID NO: 39066 - protein, 11 aa, Homo sapiens
  heavy chain complementarity determining region 3 for antibody 19533
ARVGFLVPFDC

SEQ ID NO: 39067 - protein, 9 aa, Homo sapiens
  light chain complementarity determining region 3 for antibody 19534
QQYYPSVRT

SEQ ID NO: 39068 - protein, 12 aa, Homo sapiens
  heavy chain complementarity determining region 3 for antibody 19534
VKDCGLGGSRDS

SEQ ID NO: 39069 - protein, 9 aa, Homo sapiens
  light chain complementarity determining region 3 for antibody 19535
QQYYNTPRT

SEQ ID NO: 39070 - protein, 18 aa, Homo sapiens
  heavy chain complementarity determining region 3 for antibody 19535
ARESGTPDSSGFDWYFDL

SEQ ID NO: 39071 - protein, 9 aa, Homo sapiens
  light chain complementarity determining region 3 for antibody 19536
QQYYNTPGT

SEQ ID NO: 39072 - protein, 17 aa, Homo sapiens
  heavy chain complementarity determining region 3 for antibody 19536
SRQAHFYGTSAYDYPDS

SEQ ID NO: 39073 - protein, 9 aa, Homo sapiens
  light chain complementarity determining region 3 for antibody 19537
QQYYITPRT

SEQ ID NO: 39074 - protein, 8 aa, Homo sapiens
  heavy chain complementarity determining region 3 for antibody 19537
ARDGAFDS

SEQ ID NO: 39075 - protein, 9 aa, Homo sapiens
  light chain complementarity determining region 3 for antibody 19538
QQYYISLRR

SEQ ID NO: 39076 - protein, 12 aa, Homo sapiens
  heavy chain complementarity determining region 3 for antibody 19538
VKDCGLGGSRDS

SEQ ID NO: 39077 - protein, 9 aa, Homo sapiens
  light chain complementarity determining region 3 for antibody 19539
QQYYGTPPP

SEQ ID NO: 39078 - protein, 11 aa, Homo sapiens
  heavy chain complementarity determining region 3 for antibody 19539
ARSTSAYYSEY

SEQ ID NO: 39079 - protein, 9 aa, Homo sapiens
  light chain complementarity determining region 3 for antibody 19540
QQYYGPPPT

SEQ ID NO: 39080 - protein, 11 aa, Homo sapiens
  heavy chain complementarity determining region 3 for antibody 19540
ARSTSAYYSEY

SEQ ID NO: 39081 - protein, 9 aa, Homo sapiens
  light chain complementarity determining region 3 for antibody 19541
QQYYGNPPT

SEQ ID NO: 39082 - protein, 11 aa, Homo sapiens
  heavy chain complementarity determining region 3 for antibody 19541
ARSTSAYYSEY

SEQ ID NO: 39083 - protein, 9 aa, Homo sapiens
  light chain complementarity determining region 3 for antibody 19542
QQYVTTPLP

SEQ ID NO: 39084 - protein, 8 aa, Homo sapiens
  heavy chain complementarity determining region 3 for antibody 19542
VRMSDYIL

SEQ ID NO: 39085 - protein, 11 aa, Homo sapiens
  light chain complementarity determining region 3 for antibody 19543
QQYVTSPPSNT

SEQ ID NO: 39086 - protein, 11 aa, Homo sapiens
  heavy chain complementarity determining region 3 for antibody 19543
AYSPGWWRIDC

SEQ ID NO: 39087 - protein, 11 aa, Homo sapiens
  light chain complementarity determining region 3 for antibody 19544
QQYVTSPPPST

SEQ ID NO: 39088 - protein, 11 aa, Homo sapiens
  heavy chain complementarity determining region 3 for antibody 19544
AYSPGWWRIDC

SEQ ID NO: 39089 - protein, 9 aa, Homo sapiens
  light chain complementarity determining region 3 for antibody 19545
QQYVTSPLT

SEQ ID NO: 39090 - protein, 8 aa, Homo sapiens
  heavy chain complementarity determining region 3 for antibody 19545
VRMSDYIL

SEQ ID NO: 39091 - protein, 10 aa, Homo sapiens
  light chain complementarity determining region 3 for antibody 19546
QQYVTSLKWT

SEQ ID NO: 39092 - protein, 15 aa, Homo sapiens
  heavy chain complementarity determining region 3 for antibody 19546
GRLLSPYSHRPPFDP

SEQ ID NO: 39093 - protein, 10 aa, Homo sapiens
  light chain complementarity determining region 3 for antibody 19547
QQYVTSLKGT

SEQ ID NO: 39094 - protein, 15 aa, Homo sapiens
  heavy chain complementarity determining region 3 for antibody 19547
GRLLSPYSHRTPFDP

SEQ ID NO: 39095 - protein, 9 aa, Homo sapiens
  light chain complementarity determining region 3 for antibody 19548
QQYVTPPLK

SEQ ID NO: 39096 - protein, 18 aa, Homo sapiens
  heavy chain complementarity determining region 3 for antibody 19548
ARCVAAAAKWGVYWYFDL

SEQ ID NO: 39097 - protein, 9 aa, Homo sapiens
  light chain complementarity determining region 3 for antibody 19549
QQYVSTPRP

SEQ ID NO: 39098 - protein, 18 aa, Homo sapiens
  heavy chain complementarity determining region 3 for antibody 19549
AHERWEKNRSYKYYGMDL

SEQ ID NO: 39099 - protein, 10 aa, Homo sapiens
  light chain complementarity determining region 3 for antibody 19550
QQYVSSPPWP

SEQ ID NO: 39100 - protein, 11 aa, Homo sapiens
  heavy chain complementarity determining region 3 for antibody 19550
AREGSYHYFDF

SEQ ID NO: 39101 - protein, 11 aa, Homo sapiens
  light chain complementarity determining region 3 for antibody 19551
QQYTNWPPLFP

SEQ ID NO: 39102 - protein, 14 aa, Homo sapiens
  heavy chain complementarity determining region 3 for antibody 19551
ARLNGIFGLYAFDV

SEQ ID NO: 39103 - protein, 9 aa, Homo sapiens
  light chain complementarity determining region 3 for antibody 19552
QQYTNCPLT

SEQ ID NO: 39104 - protein, 16 aa, Homo sapiens
  heavy chain complementarity determining region 3 for antibody 19552
AKEGYHYETGGGGMDV

SEQ ID NO: 39105 - protein, 9 aa, Homo sapiens
  light chain complementarity determining region 3 for antibody 19553
QQYSTTPLT

SEQ ID NO: 39106 - protein, 20 aa, Homo sapiens
  heavy chain complementarity determining region 3 for antibody 19553
ARGERRYLSGWYRPAGFFDL

SEQ ID NO: 39107 - protein, 9 aa, Homo sapiens
  light chain complementarity determining region 3 for antibody 19554
QQYSTSPGT

SEQ ID NO: 39108 - protein, 16 aa, Homo sapiens
  heavy chain complementarity determining region 3 for antibody 19554
ATDWGSGSHYIRAYDL

SEQ ID NO: 39109 - protein, 9 aa, Homo sapiens
  light chain complementarity determining region 3 for antibody 19555
QQYSSYPWP

SEQ ID NO: 39110 - protein, 17 aa, Homo sapiens
  heavy chain complementarity determining region 3 for antibody 19555
VKGTNPVLDWISIPFDY

SEQ ID NO: 39111 - protein, 11 aa, Homo sapiens
  light chain complementarity determining region 3 for antibody 19556
QQYSSWPPNLP

SEQ ID NO: 39112 - protein, 13 aa, Homo sapiens
  heavy chain complementarity determining region 3 for antibody 19556
ARGGQNSGLYLGY

SEQ ID NO: 39113 - protein, 10 aa, Homo sapiens
  light chain complementarity determining region 3 for antibody 19557
QQYSSSTPWT

SEQ ID NO: 39114 - protein, 16 aa, Homo sapiens
  heavy chain complementarity determining region 3 for antibody 19557
ARRQWVRGLFRGGLDS

SEQ ID NO: 39115 - protein, 10 aa, Homo sapiens
  light chain complementarity determining region 3 for antibody 19558
QQYSSSPPRT

SEQ ID NO: 39116 - protein, 16 aa, Homo sapiens
  heavy chain complementarity determining region 3 for antibody 19558
ARRQWVRGLFRGGLDS

SEQ ID NO: 39117 - protein, 9 aa, Homo sapiens
  light chain complementarity determining region 3 for antibody 19559
QQYSSPPWT

SEQ ID NO: 39118 - protein, 19 aa, Homo sapiens
  heavy chain complementarity determining region 3 for antibody 19559
ARGSSLVEHFGGAYYFFDY

SEQ ID NO: 39119 - protein, 9 aa, Homo sapiens
  light chain complementarity determining region 3 for antibody 19560
QQYSSPLFA

SEQ ID NO: 39120 - protein, 15 aa, Homo sapiens
  heavy chain complementarity determining region 3 for antibody 19560
ARGGKSSSWLSYFDS

SEQ ID NO: 39121 - protein, 11 aa, Homo sapiens
  light chain complementarity determining region 3 for antibody 19561
QQYSSGPPNLT

SEQ ID NO: 39122 - protein, 13 aa, Homo sapiens
  heavy chain complementarity determining region 3 for antibody 19561
ARGGQNSGLYLGY

SEQ ID NO: 39123 - protein, 9 aa, Homo sapiens
  light chain complementarity determining region 3 for antibody 19562
QQYSGSPRT

SEQ ID NO: 39124 - protein, 14 aa, Homo sapiens
  heavy chain complementarity determining region 3 for antibody 19562
ATGWYDTSGHYLDY

SEQ ID NO: 39125 - protein, 8 aa, Homo sapiens
  light chain complementarity determining region 3 for antibody 19563
QQYSFFSP

SEQ ID NO: 39126 - protein, 12 aa, Homo sapiens
  heavy chain complementarity determining region 3 for antibody 19563
ARDRGHGGDFDY

SEQ ID NO: 39127 - protein, 9 aa, Homo sapiens
  light chain complementarity determining region 3 for antibody 19564
QQYRSSPPT

SEQ ID NO: 39128 - protein, 17 aa, Homo sapiens
  heavy chain complementarity determining region 3 for antibody 19564
ARVPYCSTTTCYFPFDF

SEQ ID NO: 39129 - protein, 9 aa, Homo sapiens
  light chain complementarity determining region 3 for antibody 19565
QQYRNSPLT

SEQ ID NO: 39130 - protein, 13 aa, Homo sapiens
  heavy chain complementarity determining region 3 for antibody 19565
ASKTSVRTYSSDL

SEQ ID NO: 39131 - protein, 9 aa, Homo sapiens
  light chain complementarity determining region 3 for antibody 19566
QQYRAYSGT

SEQ ID NO: 39132 - protein, 15 aa, Homo sapiens
  heavy chain complementarity determining region 3 for antibody 19566
AKDIMGGTGWYYFEY

SEQ ID NO: 39133 - protein, 11 aa, Homo sapiens
  light chain complementarity determining region 3 for antibody 19567
QQYRASPPGFT

SEQ ID NO: 39134 - protein, 14 aa, Homo sapiens
  heavy chain complementarity determining region 3 for antibody 19567
ARSPSNSRNRSFDH

SEQ ID NO: 39135 - protein, 9 aa, Homo sapiens
  light chain complementarity determining region 3 for antibody 19568
QQYQNWPYT

SEQ ID NO: 39136 - protein, 11 aa, Homo sapiens
  heavy chain complementarity determining region 3 for antibody 19568
GGVYHGGPCGY

SEQ ID NO: 39137 - protein, 9 aa, Homo sapiens
  light chain complementarity determining region 3 for antibody 19569
QQYQNWPYT

SEQ ID NO: 39138 - protein, 11 aa, Homo sapiens
  heavy chain complementarity determining region 3 for antibody 19569
GAYYRGGPCGY

SEQ ID NO: 39139 - protein, 9 aa, Homo sapiens
  light chain complementarity determining region 3 for antibody 19570
QQYQNWPYP

SEQ ID NO: 39140 - protein, 11 aa, Homo sapiens
  heavy chain complementarity determining region 3 for antibody 19570
GAYYHGGPCGY

SEQ ID NO: 39141 - protein, 9 aa, Homo sapiens
  light chain complementarity determining region 3 for antibody 19571
QQYPSTPLT

SEQ ID NO: 39142 - protein, 20 aa, Homo sapiens
  heavy chain complementarity determining region 3 for antibody 19571
ARARSKTTVVTPTRQFASDI

SEQ ID NO: 39143 - protein, 8 aa, Homo sapiens
  light chain complementarity determining region 3 for antibody 19572
QQYNYWWT

SEQ ID NO: 39144 - protein, 12 aa, Homo sapiens
  heavy chain complementarity determining region 3 for antibody 19572
ARIRDGSNYFAY

SEQ ID NO: 39145 - protein, 9 aa, Homo sapiens
  light chain complementarity determining region 3 for antibody 19573
QQYNVYPLT

SEQ ID NO: 39146 - protein, 21 aa, Homo sapiens
  heavy chain complementarity determining region 3 for antibody 19573
ATEGGILRFLDRSQAAYPINW

SEQ ID NO: 39147 - protein, 9 aa, Homo sapiens
  light chain complementarity determining region 3 for antibody 19574
QQYNTYSRT

SEQ ID NO: 39148 - protein, 15 aa, Homo sapiens
  heavy chain complementarity determining region 3 for antibody 19574
ARERNRGSFGGAFDV

SEQ ID NO: 39149 - protein, 9 aa, Homo sapiens
  light chain complementarity determining region 3 for antibody 19575
QQYNTYSCT

SEQ ID NO: 39150 - protein, 15 aa, Homo sapiens
  heavy chain complementarity determining region 3 for antibody 19575
ARERNRGSFGSAFDV

SEQ ID NO: 39151 - protein, 9 aa, Homo sapiens
  light chain complementarity determining region 3 for antibody 19576
QQYNTYRYT

SEQ ID NO: 39152 - protein, 18 aa, Homo sapiens
  heavy chain complementarity determining region 3 for antibody 19576
AKVRDFHAAGPPGNGLDV

SEQ ID NO: 39153 - protein, 8 aa, Homo sapiens
  light chain complementarity determining region 3 for antibody 19577
QQYNTWPS

SEQ ID NO: 39154 - protein, 12 aa, Homo sapiens
  heavy chain complementarity determining region 3 for antibody 19577
ARLLWDSYYFDS

SEQ ID NO: 39155 - protein, 9 aa, Homo sapiens
  light chain complementarity determining region 3 for antibody 19578
QQYNTWPRT

SEQ ID NO: 39156 - protein, 22 aa, Homo sapiens
  heavy chain complementarity determining region 3 for antibody 19578
ASEVRASGYDDFYNYYYYGLDV

SEQ ID NO: 39157 - protein, 9 aa, Homo sapiens
  light chain complementarity determining region 3 for antibody 19579
QQYNTWPRT

SEQ ID NO: 39158 - protein, 22 aa, Homo sapiens
  heavy chain complementarity determining region 3 for antibody 19579
AREVRASGYDDFYNYYYDGLDV

SEQ ID NO: 39159 - protein, 9 aa, Homo sapiens
  light chain complementarity determining region 3 for antibody 19580
QQYNTWPRT

SEQ ID NO: 39160 - protein, 22 aa, Homo sapiens
  heavy chain complementarity determining region 3 for antibody 19580
AREVRASGDDDFYNYYYYGLDV

SEQ ID NO: 39161 - protein, 10 aa, Homo sapiens
  light chain complementarity determining region 3 for antibody 19581
QQYNTWPPLT

SEQ ID NO: 39162 - protein, 17 aa, Homo sapiens
  heavy chain complementarity determining region 3 for antibody 19581
AKDLRPFYDIFAGYLDM

SEQ ID NO: 39163 - protein, 10 aa, Homo sapiens
  light chain complementarity determining region 3 for antibody 19582
QQYNTWPPAT

SEQ ID NO: 39164 - protein, 13 aa, Homo sapiens
  heavy chain complementarity determining region 3 for antibody 19582
ARGIIPVAGLLDY

SEQ ID NO: 39165 - protein, 9 aa, Homo sapiens
  light chain complementarity determining region 3 for antibody 19583
QQYNTWPGT

SEQ ID NO: 39166 - protein, 22 aa, Homo sapiens
  heavy chain complementarity determining region 3 for antibody 19583
AREVRASGYDDFYNYYYYGLDV

SEQ ID NO: 39167 - protein, 9 aa, Homo sapiens
  light chain complementarity determining region 3 for antibody 19584
QQYNTSLRT

SEQ ID NO: 39168 - protein, 12 aa, Homo sapiens
  heavy chain complementarity determining region 3 for antibody 19584
VKDCGLGGSRDS

SEQ ID NO: 39169 - protein, 9 aa, Homo sapiens
  light chain complementarity determining region 3 for antibody 19585
QQYNTRPRT

SEQ ID NO: 39170 - protein, 22 aa, Homo sapiens
  heavy chain complementarity determining region 3 for antibody 19585
AREVRASGYDDFYNYYYYGLDV

SEQ ID NO: 39171 - protein, 8 aa, Homo sapiens
  light chain complementarity determining region 3 for antibody 19586
QQYNTRLS

SEQ ID NO: 39172 - protein, 12 aa, Homo sapiens
  heavy chain complementarity determining region 3 for antibody 19586
ARLLWDSYYFDS

SEQ ID NO: 39173 - protein, 10 aa, Homo sapiens
  light chain complementarity determining region 3 for antibody 19587
QQYNSYSGFT

SEQ ID NO: 39174 - protein, 18 aa, Homo sapiens
  heavy chain complementarity determining region 3 for antibody 19587
ARSALITAAAEYFYGMDV

SEQ ID NO: 39175 - protein, 9 aa, Homo sapiens
  light chain complementarity determining region 3 for antibody 19588
QQYNSYPYT

SEQ ID NO: 39176 - protein, 12 aa, Homo sapiens
  heavy chain complementarity determining region 3 for antibody 19588
AREGLRFRPFDV

SEQ ID NO: 39177 - protein, 9 aa, Homo sapiens
  light chain complementarity determining region 3 for antibody 19589
QQYNSYPWT

SEQ ID NO: 39178 - protein, 10 aa, Homo sapiens
  heavy chain complementarity determining region 3 for antibody 19589
AGSGGGQWDY

SEQ ID NO: 39179 - protein, 9 aa, Homo sapiens
  light chain complementarity determining region 3 for antibody 19590
QQYNSYPWT

SEQ ID NO: 39180 - protein, 23 aa, Homo sapiens
  heavy chain complementarity determining region 3 for antibody 19590
AGGRITGATWQRPTNYYYYAMDV

SEQ ID NO: 39181 - protein, 9 aa, Homo sapiens
  light chain complementarity determining region 3 for antibody 19591
QQYNSYLYT

SEQ ID NO: 39182 - protein, 16 aa, Homo sapiens
  heavy chain complementarity determining region 3 for antibody 19591
AREGDSRGWYGGSVDV

SEQ ID NO: 39183 - protein, 9 aa, Homo sapiens
  light chain complementarity determining region 3 for antibody 19592
QQYNSYLYT

SEQ ID NO: 39184 - protein, 16 aa, Homo sapiens
  heavy chain complementarity determining region 3 for antibody 19592
AREGDSRGWSGGSMDV

SEQ ID NO: 39185 - protein, 8 aa, Homo sapiens
  light chain complementarity determining region 3 for antibody 19593
QQYNSYLP

SEQ ID NO: 39186 - protein, 14 aa, Homo sapiens
  heavy chain complementarity determining region 3 for antibody 19593
ARNSEGSGWFPCDY

SEQ ID NO: 39187 - protein, 9 aa, Homo sapiens
  light chain complementarity determining region 3 for antibody 19594
QQYNSFPLS

SEQ ID NO: 39188 - protein, 13 aa, Homo sapiens
  heavy chain complementarity determining region 3 for antibody 19594
ARRSSDYSGHFDY

SEQ ID NO: 39189 - protein, 9 aa, Homo sapiens
  light chain complementarity determining region 3 for antibody 19595
QQYNRSPRT

SEQ ID NO: 39190 - protein, 16 aa, Homo sapiens
  heavy chain complementarity determining region 3 for antibody 19595
VKDFTGECPYGSWVDP

SEQ ID NO: 39191 - protein, 8 aa, Homo sapiens
  light chain complementarity determining region 3 for antibody 19596
QQYNRFWT

SEQ ID NO: 39192 - protein, 19 aa, Homo sapiens
  heavy chain complementarity determining region 3 for antibody 19596
ARGGRDTYHRSGYYSPCDF

SEQ ID NO: 39193 - protein, 10 aa, Homo sapiens
  light chain complementarity determining region 3 for antibody 19597
QQYNQWPPLT

SEQ ID NO: 39194 - protein, 17 aa, Homo sapiens
  heavy chain complementarity determining region 3 for antibody 19597
ARDLYVSIIQGGGAFDA

SEQ ID NO: 39195 - protein, 10 aa, Homo sapiens
  light chain complementarity determining region 3 for antibody 19598
QQYNQWPPFT

SEQ ID NO: 39196 - protein, 17 aa, Homo sapiens
  heavy chain complementarity determining region 3 for antibody 19598
ARDLYFSIIQGGGAFDA

SEQ ID NO: 39197 - protein, 10 aa, Homo sapiens
  light chain complementarity determining region 3 for antibody 19599
QQYNQWHPLT

SEQ ID NO: 39198 - protein, 17 aa, Homo sapiens
  heavy chain complementarity determining region 3 for antibody 19599
ARDLYFSIIQGGGAFDA

SEQ ID NO: 39199 - protein, 10 aa, Homo sapiens
  light chain complementarity determining region 3 for antibody 19600
QQYNPWPPLT

SEQ ID NO: 39200 - protein, 17 aa, Homo sapiens
  heavy chain complementarity determining region 3 for antibody 19600
ARDLYFSIIQGGGAFDA

SEQ ID NO: 39201 - protein, 9 aa, Homo sapiens
  light chain complementarity determining region 3 for antibody 19601
QQYNNWPRT

SEQ ID NO: 39202 - protein, 14 aa, Homo sapiens
  heavy chain complementarity determining region 3 for antibody 19601
ATAPGYCSSSPFDY

SEQ ID NO: 39203 - protein, 10 aa, Homo sapiens
  light chain complementarity determining region 3 for antibody 19602
QQYNNWPPYT

SEQ ID NO: 39204 - protein, 17 aa, Homo sapiens
  heavy chain complementarity determining region 3 for antibody 19602
AGGGDSAQQFMYPPNNY

SEQ ID NO: 39205 - protein, 10 aa, Homo sapiens
  light chain complementarity determining region 3 for antibody 19603
QQYNNWPPYP

SEQ ID NO: 39206 - protein, 19 aa, Homo sapiens
  heavy chain complementarity determining region 3 for antibody 19603
ARDTYYYGSGSYLYYGMDV

SEQ ID NO: 39207 - protein, 10 aa, Homo sapiens
  light chain complementarity determining region 3 for antibody 19604
QQYNNWPPLT

SEQ ID NO: 39208 - protein, 17 aa, Homo sapiens
  heavy chain complementarity determining region 3 for antibody 19604
AKDLRPFYDVFAGYLDM

SEQ ID NO: 39209 - protein, 10 aa, Homo sapiens
  light chain complementarity determining region 3 for antibody 19605
QQYNNWPPFT

SEQ ID NO: 39210 - protein, 12 aa, Homo sapiens
  heavy chain complementarity determining region 3 for antibody 19605
ARYGDYFLGWVY

SEQ ID NO: 39211 - protein, 9 aa, Homo sapiens
  light chain complementarity determining region 3 for antibody 19606
QQYNNWPGT

SEQ ID NO: 39212 - protein, 16 aa, Homo sapiens
  heavy chain complementarity determining region 3 for antibody 19606
ARELGRYSYGHDAFDI

SEQ ID NO: 39213 - protein, 9 aa, Homo sapiens
  light chain complementarity determining region 3 for antibody 19607
QQYNEGPLT

SEQ ID NO: 39214 - protein, 17 aa, Homo sapiens
  heavy chain complementarity determining region 3 for antibody 19607
AIAEGWDNYKGVDAFDI

SEQ ID NO: 39215 - protein, 9 aa, Homo sapiens
  light chain complementarity determining region 3 for antibody 19608
QQYLRAPYT

SEQ ID NO: 39216 - protein, 18 aa, Homo sapiens
  heavy chain complementarity determining region 3 for antibody 19608
ARGAYGSTIYYNLHYFDF

SEQ ID NO: 39217 - protein, 9 aa, Homo sapiens
  light chain complementarity determining region 3 for antibody 19609
QQYKSNLYT

SEQ ID NO: 39218 - protein, 12 aa, Homo sapiens
  heavy chain complementarity determining region 3 for antibody 19609
ARALGWRAWFDP

SEQ ID NO: 39219 - protein, 9 aa, Homo sapiens
  light chain complementarity determining region 3 for antibody 19610
QQYKKWPLT

SEQ ID NO: 39220 - protein, 18 aa, Homo sapiens
  heavy chain complementarity determining region 3 for antibody 19610
AKDLSVYQTIPTRTIFDY

SEQ ID NO: 39221 - protein, 9 aa, Homo sapiens
  light chain complementarity determining region 3 for antibody 19611
QQYISSPYT

SEQ ID NO: 39222 - protein, 15 aa, Homo sapiens
  heavy chain complementarity determining region 3 for antibody 19611
GKDWGSGYGRGTVDY

SEQ ID NO: 39223 - protein, 11 aa, Homo sapiens
  light chain complementarity determining region 3 for antibody 19612
QQYIKWPPEIT

SEQ ID NO: 39224 - protein, 14 aa, Homo sapiens
  heavy chain complementarity determining region 3 for antibody 19612
ARHDRPMDLFFLEP

SEQ ID NO: 39225 - protein, 10 aa, Homo sapiens
  light chain complementarity determining region 3 for antibody 19613
QQYHSYSPPT

SEQ ID NO: 39226 - protein, 19 aa, Homo sapiens
  heavy chain complementarity determining region 3 for antibody 19613
ARESEYYFDKSGYLRPFDF

SEQ ID NO: 39227 - protein, 9 aa, Homo sapiens
  light chain complementarity determining region 3 for antibody 19614
QQYHSSPNT

SEQ ID NO: 39228 - protein, 14 aa, Homo sapiens
  heavy chain complementarity determining region 3 for antibody 19614
AKESSVYGVYPYDS

SEQ ID NO: 39229 - protein, 9 aa, Homo sapiens
  light chain complementarity determining region 3 for antibody 19615
QQYHSSPIT

SEQ ID NO: 39230 - protein, 14 aa, Homo sapiens
  heavy chain complementarity determining region 3 for antibody 19615
AKESAVYGVYPYDS

SEQ ID NO: 39231 - protein, 9 aa, Homo sapiens
  light chain complementarity determining region 3 for antibody 19616
QQYHSSPFT

SEQ ID NO: 39232 - protein, 14 aa, Homo sapiens
  heavy chain complementarity determining region 3 for antibody 19616
AKESSVYGVYPYDS

SEQ ID NO: 39233 - protein, 9 aa, Homo sapiens
  light chain complementarity determining region 3 for antibody 19617
QQYGYSAWP

SEQ ID NO: 39234 - protein, 13 aa, Homo sapiens
  heavy chain complementarity determining region 3 for antibody 19617
ARGYFYSDGYIED

SEQ ID NO: 39235 - protein, 9 aa, Homo sapiens
  light chain complementarity determining region 3 for antibody 19618
QQYGTTPLT

SEQ ID NO: 39236 - protein, 8 aa, Homo sapiens
  heavy chain complementarity determining region 3 for antibody 19618
VRMSDYIL

SEQ ID NO: 39237 - protein, 6 aa, Homo sapiens
  light chain complementarity determining region 3 for antibody 19619
QQYGTT

SEQ ID NO: 39238 - protein, 12 aa, Homo sapiens
  heavy chain complementarity determining region 3 for antibody 19619
ARDADAGYAQDF

SEQ ID NO: 39239 - protein, 8 aa, Homo sapiens
  light chain complementarity determining region 3 for antibody 19620
QQYGTSRT

SEQ ID NO: 39240 - protein, 15 aa, Homo sapiens
  heavy chain complementarity determining region 3 for antibody 19620
ARGEFYRDSRGYRDD

SEQ ID NO: 39241 - protein, 8 aa, Homo sapiens
  light chain complementarity determining region 3 for antibody 19621
QQYGTSRM

SEQ ID NO: 39242 - protein, 13 aa, Homo sapiens
  heavy chain complementarity determining region 3 for antibody 19621
ARGQFVGSAYYEH

SEQ ID NO: 39243 - protein, 8 aa, Homo sapiens
  light chain complementarity determining region 3 for antibody 19622
QQYGTSRM

SEQ ID NO: 39244 - protein, 13 aa, Homo sapiens
  heavy chain complementarity determining region 3 for antibody 19622
ARGQFVGSASYEN

SEQ ID NO: 39245 - protein, 9 aa, Homo sapiens
  light chain complementarity determining region 3 for antibody 19623
QQYGTSPYT

SEQ ID NO: 39246 - protein, 20 aa, Homo sapiens
  heavy chain complementarity determining region 3 for antibody 19623
ARGGQEGYFDWLFELDGMDV

SEQ ID NO: 39247 - protein, 9 aa, Homo sapiens
  light chain complementarity determining region 3 for antibody 19624
QQYGTSPYT

SEQ ID NO: 39248 - protein, 14 aa, Homo sapiens
  heavy chain complementarity determining region 3 for antibody 19624
AKEPPRWLLPFSGY

SEQ ID NO: 39249 - protein, 10 aa, Homo sapiens
  light chain complementarity determining region 3 for antibody 19625
QQYGTSPTWR

SEQ ID NO: 39250 - protein, 18 aa, Homo sapiens
  heavy chain complementarity determining region 3 for antibody 19625
ARAPRDTMIVVRYYGMDV

SEQ ID NO: 39251 - protein, 9 aa, Homo sapiens
  light chain complementarity determining region 3 for antibody 19626
QQYGTSPST

SEQ ID NO: 39252 - protein, 15 aa, Homo sapiens
  heavy chain complementarity determining region 3 for antibody 19626
ARQNDFLSGPGEFDP

SEQ ID NO: 39253 - protein, 9 aa, Homo sapiens
  light chain complementarity determining region 3 for antibody 19627
QQYGTSPRT

SEQ ID NO: 39254 - protein, 13 aa, Homo sapiens
  heavy chain complementarity determining region 3 for antibody 19627
PRGFYDRSGYHEY

SEQ ID NO: 39255 - protein, 9 aa, Homo sapiens
  light chain complementarity determining region 3 for antibody 19628
QQYGTSPRT

SEQ ID NO: 39256 - protein, 13 aa, Homo sapiens
  heavy chain complementarity determining region 3 for antibody 19628
AGGSGSGTYYNEH

SEQ ID NO: 39257 - protein, 9 aa, Homo sapiens
  light chain complementarity determining region 3 for antibody 19629
QQYGTSPRT

SEQ ID NO: 39258 - protein, 14 aa, Homo sapiens
  heavy chain complementarity determining region 3 for antibody 19629
AGGDVCGRDCYSEY

SEQ ID NO: 39259 - protein, 9 aa, Homo sapiens
  light chain complementarity determining region 3 for antibody 19630
QQYGTSPRP

SEQ ID NO: 39260 - protein, 14 aa, Homo sapiens
  heavy chain complementarity determining region 3 for antibody 19630
AGGDFCGRDCYSEY

SEQ ID NO: 39261 - protein, 11 aa, Homo sapiens
  light chain complementarity determining region 3 for antibody 19631
QQYGTSPRMAT

SEQ ID NO: 39262 - protein, 23 aa, Homo sapiens
  heavy chain complementarity determining region 3 for antibody 19631
ARMRSGYSRDKNVLQFYYYGLDV

SEQ ID NO: 39263 - protein, 9 aa, Homo sapiens
  light chain complementarity determining region 3 for antibody 19632
QQYGTSPRK

SEQ ID NO: 39264 - protein, 13 aa, Homo sapiens
  heavy chain complementarity determining region 3 for antibody 19632
AGGSGSGTYYKDH

SEQ ID NO: 39265 - protein, 11 aa, Homo sapiens
  light chain complementarity determining region 3 for antibody 19633
QQYGTSPPKVT

SEQ ID NO: 39266 - protein, 11 aa, Homo sapiens
  heavy chain complementarity determining region 3 for antibody 19633
ANPSAGTTGDY

SEQ ID NO: 39267 - protein, 9 aa, Homo sapiens
  light chain complementarity determining region 3 for antibody 19634
QQYGTSPLT

SEQ ID NO: 39268 - protein, 14 aa, Homo sapiens
  heavy chain complementarity determining region 3 for antibody 19634
AGGDFCGRDCYSEY

SEQ ID NO: 39269 - protein, 9 aa, Homo sapiens
  light chain complementarity determining region 3 for antibody 19635
QQYGTSPLP

SEQ ID NO: 39270 - protein, 15 aa, Homo sapiens
  heavy chain complementarity determining region 3 for antibody 19635
ARQNDFLSGPGEFDP

SEQ ID NO: 39271 - protein, 9 aa, Homo sapiens
  light chain complementarity determining region 3 for antibody 19636
QQYGTSPFT

SEQ ID NO: 39272 - protein, 15 aa, Homo sapiens
  heavy chain complementarity determining region 3 for antibody 19636
VRQNDFLSGPGEFDP

SEQ ID NO: 39273 - protein, 9 aa, Homo sapiens
  light chain complementarity determining region 3 for antibody 19637
QQYGTSPFT

SEQ ID NO: 39274 - protein, 15 aa, Homo sapiens
  heavy chain complementarity determining region 3 for antibody 19637
ARQNVFLSGPGEFDP

SEQ ID NO: 39275 - protein, 9 aa, Homo sapiens
  light chain complementarity determining region 3 for antibody 19638
QQYGTSPFT

SEQ ID NO: 39276 - protein, 15 aa, Homo sapiens
  heavy chain complementarity determining region 3 for antibody 19638
ARQNGFLSGPGEFDP

SEQ ID NO: 39277 - protein, 9 aa, Homo sapiens
  light chain complementarity determining region 3 for antibody 19639
QQYGTSPFT

SEQ ID NO: 39278 - protein, 15 aa, Homo sapiens
  heavy chain complementarity determining region 3 for antibody 19639
ARQNDLLSGPGEFDP

SEQ ID NO: 39279 - protein, 9 aa, Homo sapiens
  light chain complementarity determining region 3 for antibody 19640
QQYGTSPCT

SEQ ID NO: 39280 - protein, 13 aa, Homo sapiens
  heavy chain complementarity determining region 3 for antibody 19640
PIGFYDRSGYHEY

SEQ ID NO: 39281 - protein, 8 aa, Homo sapiens
  light chain complementarity determining region 3 for antibody 19641
QQYGTSFT

SEQ ID NO: 39282 - protein, 14 aa, Homo sapiens
  heavy chain complementarity determining region 3 for antibody 19641
ARAGSYYADWYFDL

SEQ ID NO: 39283 - protein, 9 aa, Homo sapiens
  light chain complementarity determining region 3 for antibody 19642
QQYGTPPRT

SEQ ID NO: 39284 - protein, 25 aa, Homo sapiens
  heavy chain complementarity determining region 3 for antibody 19642
ARLRVDRLRLPGAMRGPLYDRGLDV

SEQ ID NO: 39285 - protein, 9 aa, Homo sapiens
  light chain complementarity determining region 3 for antibody 19643
QQYGTPPRT

SEQ ID NO: 39286 - protein, 25 aa, Homo sapiens
  heavy chain complementarity determining region 3 for antibody 19643
ARLRADRLRLPGAMRGPLYDRGLNV

SEQ ID NO: 39287 - protein, 9 aa, Homo sapiens
  light chain complementarity determining region 3 for antibody 19644
QQYGTPPRT

SEQ ID NO: 39288 - protein, 13 aa, Homo sapiens
  heavy chain complementarity determining region 3 for antibody 19644
AGGLFDRRGYSEF

SEQ ID NO: 39289 - protein, 9 aa, Homo sapiens
  light chain complementarity determining region 3 for antibody 19645
QQYGTPPRT

SEQ ID NO: 39290 - protein, 13 aa, Homo sapiens
  heavy chain complementarity determining region 3 for antibody 19645
ACGYYEGGRYYDY

SEQ ID NO: 39291 - protein, 9 aa, Homo sapiens
  light chain complementarity determining region 3 for antibody 19646
QQYGTIPWT

SEQ ID NO: 39292 - protein, 13 aa, Homo sapiens
  heavy chain complementarity determining region 3 for antibody 19646
AGGNFHRSGYAEY

SEQ ID NO: 39293 - protein, 9 aa, Homo sapiens
  light chain complementarity determining region 3 for antibody 19647
QQYGTIPRT

SEQ ID NO: 39294 - protein, 13 aa, Homo sapiens
  heavy chain complementarity determining region 3 for antibody 19647
AGGSFSGRNYKDD

SEQ ID NO: 39295 - protein, 9 aa, Homo sapiens
  light chain complementarity determining region 3 for antibody 19648
QQYGTIPRT

SEQ ID NO: 39296 - protein, 13 aa, Homo sapiens
  heavy chain complementarity determining region 3 for antibody 19648
AGGSFHRSGYAEY

SEQ ID NO: 39297 - protein, 9 aa, Homo sapiens
  light chain complementarity determining region 3 for antibody 19649
QQYGTIPRT

SEQ ID NO: 39298 - protein, 13 aa, Homo sapiens
  heavy chain complementarity determining region 3 for antibody 19649
AGGILHSRGYGEY

SEQ ID NO: 39299 - protein, 9 aa, Homo sapiens
  light chain complementarity determining region 3 for antibody 19650
QQYGTIPRT

SEQ ID NO: 39300 - protein, 14 aa, Homo sapiens
  heavy chain complementarity determining region 3 for antibody 19650
AGGEFCGGDCYSDY

SEQ ID NO: 39301 - protein, 9 aa, Homo sapiens
  light chain complementarity determining region 3 for antibody 19651
QQYGTIPRP

SEQ ID NO: 39302 - protein, 13 aa, Homo sapiens
  heavy chain complementarity determining region 3 for antibody 19651
AGGLFDSSGYSEF

SEQ ID NO: 39303 - protein, 9 aa, Homo sapiens
  light chain complementarity determining region 3 for antibody 19652
QQYGTFPQT

SEQ ID NO: 39304 - protein, 18 aa, Homo sapiens
  heavy chain complementarity determining region 3 for antibody 19652
ARDYYGSGREIWVGAFDI

SEQ ID NO: 39305 - protein, 10 aa, Homo sapiens
  light chain complementarity determining region 3 for antibody 19653
QQYGSSVPWR

SEQ ID NO: 39306 - protein, 13 aa, Homo sapiens
  heavy chain complementarity determining region 3 for antibody 19653
AHGRRSSWDSFDY

SEQ ID NO: 39307 - protein, 9 aa, Homo sapiens
  light chain complementarity determining region 3 for antibody 19654
QQYGSSTRT

SEQ ID NO: 39308 - protein, 15 aa, Homo sapiens
  heavy chain complementarity determining region 3 for antibody 19654
AKTYDFWSGDDAFEI

SEQ ID NO: 39309 - protein, 10 aa, Homo sapiens
  light chain complementarity determining region 3 for antibody 19655
QQYGSSSIFT

SEQ ID NO: 39310 - protein, 14 aa, Homo sapiens
  heavy chain complementarity determining region 3 for antibody 19655
TTCVPAAAQNTEDY

SEQ ID NO: 39311 - protein, 10 aa, Homo sapiens
  light chain complementarity determining region 3 for antibody 19656
QQYGSSSIFP

SEQ ID NO: 39312 - protein, 14 aa, Homo sapiens
  heavy chain complementarity determining region 3 for antibody 19656
TTCVPAASQNTEDY

SEQ ID NO: 39313 - protein, 9 aa, Homo sapiens
  light chain complementarity determining region 3 for antibody 19657
QQYGSSPYT

SEQ ID NO: 39314 - protein, 11 aa, Homo sapiens
  heavy chain complementarity determining region 3 for antibody 19657
AKGGLRWPLDY

SEQ ID NO: 39315 - protein, 9 aa, Homo sapiens
  light chain complementarity determining region 3 for antibody 19658
QQYGSSPWT

SEQ ID NO: 39316 - protein, 15 aa, Homo sapiens
  heavy chain complementarity determining region 3 for antibody 19658
AKTYDFWSGDDAFEI

SEQ ID NO: 39317 - protein, 9 aa, Homo sapiens
  light chain complementarity determining region 3 for antibody 19659
QQYGSSPVT

SEQ ID NO: 39318 - protein, 15 aa, Homo sapiens
  heavy chain complementarity determining region 3 for antibody 19659
AREGGYCGGDCSFDY

SEQ ID NO: 39319 - protein, 9 aa, Homo sapiens
  light chain complementarity determining region 3 for antibody 19660
QQYGSSPVP

SEQ ID NO: 39320 - protein, 20 aa, Homo sapiens
  heavy chain complementarity determining region 3 for antibody 19660
ARRPVVSGWYRTGISSWFDP

SEQ ID NO: 39321 - protein, 8 aa, Homo sapiens
  light chain complementarity determining region 3 for antibody 19661
QQYGSSPT

SEQ ID NO: 39322 - protein, 14 aa, Homo sapiens
  heavy chain complementarity determining region 3 for antibody 19661
ARRGGPDRGEKGGY

SEQ ID NO: 39323 - protein, 9 aa, Homo sapiens
  light chain complementarity determining region 3 for antibody 19662
QQYGSSPRT

SEQ ID NO: 39324 - protein, 17 aa, Homo sapiens
  heavy chain complementarity determining region 3 for antibody 19662
TTDPQWLEPPPVLTNDY

SEQ ID NO: 39325 - protein, 9 aa, Homo sapiens
  light chain complementarity determining region 3 for antibody 19663
QQYGSSPRT

SEQ ID NO: 39326 - protein, 13 aa, Homo sapiens
  heavy chain complementarity determining region 3 for antibody 19663
PIGFYDRSGYHDY

SEQ ID NO: 39327 - protein, 9 aa, Homo sapiens
  light chain complementarity determining region 3 for antibody 19664
QQYGSSPRT

SEQ ID NO: 39328 - protein, 13 aa, Homo sapiens
  heavy chain complementarity determining region 3 for antibody 19664
ATGYYASGSYLEY

SEQ ID NO: 39329 - protein, 9 aa, Homo sapiens
  light chain complementarity determining region 3 for antibody 19665
QQYGSSPRT

SEQ ID NO: 39330 - protein, 13 aa, Homo sapiens
  heavy chain complementarity determining region 3 for antibody 19665
ATGYDASGTYLEY

SEQ ID NO: 39331 - protein, 9 aa, Homo sapiens
  light chain complementarity determining region 3 for antibody 19666
QQYGSSPRT

SEQ ID NO: 39332 - protein, 18 aa, Homo sapiens
  heavy chain complementarity determining region 3 for antibody 19666
ATAFWVGLGVPPPGFLEY

SEQ ID NO: 39333 - protein, 9 aa, Homo sapiens
  light chain complementarity determining region 3 for antibody 19667
QQYGSSPRT

SEQ ID NO: 39334 - protein, 18 aa, Homo sapiens
  heavy chain complementarity determining region 3 for antibody 19667
ATACWVGLGVPPPGFFEY

SEQ ID NO: 39335 - protein, 9 aa, Homo sapiens
  light chain complementarity determining region 3 for antibody 19668
QQYGSSPRT

SEQ ID NO: 39336 - protein, 19 aa, Homo sapiens
  heavy chain complementarity determining region 3 for antibody 19668
ARPQGYDLRSGYSEHYFDY

SEQ ID NO: 39337 - protein, 9 aa, Homo sapiens
  light chain complementarity determining region 3 for antibody 19669
QQYGSSPRT

SEQ ID NO: 39338 - protein, 25 aa, Homo sapiens
  heavy chain complementarity determining region 3 for antibody 19669
ARLRIYRLRLPGAMRGPLYDCGLNV

SEQ ID NO: 39339 - protein, 9 aa, Homo sapiens
  light chain complementarity determining region 3 for antibody 19670
QQYGSSPRT

SEQ ID NO: 39340 - protein, 25 aa, Homo sapiens
  heavy chain complementarity determining region 3 for antibody 19670
ARLRIDRLRLPGAMRGPVYDCGLNV

SEQ ID NO: 39341 - protein, 9 aa, Homo sapiens
  light chain complementarity determining region 3 for antibody 19671
QQYGSSPRT

SEQ ID NO: 39342 - protein, 25 aa, Homo sapiens
  heavy chain complementarity determining region 3 for antibody 19671
ARLRIDRLRLPGAMRGPLYVCGLNV

SEQ ID NO: 39343 - protein, 9 aa, Homo sapiens
  light chain complementarity determining region 3 for antibody 19672
QQYGSSPRT

SEQ ID NO: 39344 - protein, 25 aa, Homo sapiens
  heavy chain complementarity determining region 3 for antibody 19672
ARLRIDRLRLPGAMRGPLYDCGLHV

SEQ ID NO: 39345 - protein, 9 aa, Homo sapiens
  light chain complementarity determining region 3 for antibody 19673
QQYGSSPRT

SEQ ID NO: 39346 - protein, 25 aa, Homo sapiens
  heavy chain complementarity determining region 3 for antibody 19673
ARLRIDRLRLAGAMRGPLYDCGLNV

SEQ ID NO: 39347 - protein, 9 aa, Homo sapiens
  light chain complementarity determining region 3 for antibody 19674
QQYGSSPRT

SEQ ID NO: 39348 - protein, 13 aa, Homo sapiens
  heavy chain complementarity determining region 3 for antibody 19674
ARGSGIFGGFFGY

SEQ ID NO: 39349 - protein, 9 aa, Homo sapiens
  light chain complementarity determining region 3 for antibody 19675
QQYGSSPRT

SEQ ID NO: 39350 - protein, 16 aa, Homo sapiens
  heavy chain complementarity determining region 3 for antibody 19675
ARESHSSGWYDWYIDY

SEQ ID NO: 39351 - protein, 9 aa, Homo sapiens
  light chain complementarity determining region 3 for antibody 19676
QQYGSSPRT

SEQ ID NO: 39352 - protein, 15 aa, Homo sapiens
  heavy chain complementarity determining region 3 for antibody 19676
AKTYDVWSGDDAFEI

SEQ ID NO: 39353 - protein, 9 aa, Homo sapiens
  light chain complementarity determining region 3 for antibody 19677
QQYGSSPRT

SEQ ID NO: 39354 - protein, 14 aa, Homo sapiens
  heavy chain complementarity determining region 3 for antibody 19677
AGGTFSSGSSYSDN

SEQ ID NO: 39355 - protein, 9 aa, Homo sapiens
  light chain complementarity determining region 3 for antibody 19678
QQYGSSPRT

SEQ ID NO: 39356 - protein, 13 aa, Homo sapiens
  heavy chain complementarity determining region 3 for antibody 19678
AGGSGSGTYYKEH

SEQ ID NO: 39357 - protein, 9 aa, Homo sapiens
  light chain complementarity determining region 3 for antibody 19679
QQYGSSPRT

SEQ ID NO: 39358 - protein, 14 aa, Homo sapiens
  heavy chain complementarity determining region 3 for antibody 19679
AGGRVSSGSSYSEN

SEQ ID NO: 39359 - protein, 9 aa, Homo sapiens
  light chain complementarity determining region 3 for antibody 19680
QQYGSSPRT

SEQ ID NO: 39360 - protein, 14 aa, Homo sapiens
  heavy chain complementarity determining region 3 for antibody 19680
AGGRCSSGSSYSEN

SEQ ID NO: 39361 - protein, 9 aa, Homo sapiens
  light chain complementarity determining region 3 for antibody 19681
QQYGSSPRS

SEQ ID NO: 39362 - protein, 25 aa, Homo sapiens
  heavy chain complementarity determining region 3 for antibody 19681
ARLRIDRLRLPGAMRGPLYDCGLNV

SEQ ID NO: 39363 - protein, 9 aa, Homo sapiens
  light chain complementarity determining region 3 for antibody 19682
QQYGSSPRP

SEQ ID NO: 39364 - protein, 13 aa, Homo sapiens
  heavy chain complementarity determining region 3 for antibody 19682
ASGYFDRSGYYEY

SEQ ID NO: 39365 - protein, 9 aa, Homo sapiens
  light chain complementarity determining region 3 for antibody 19683
QQYGSSPRP

SEQ ID NO: 39366 - protein, 14 aa, Homo sapiens
  heavy chain complementarity determining region 3 for antibody 19683
ARRGYYSASGQFDY

SEQ ID NO: 39367 - protein, 9 aa, Homo sapiens
  light chain complementarity determining region 3 for antibody 19684
QQYGSSPRP

SEQ ID NO: 39368 - protein, 14 aa, Homo sapiens
  heavy chain complementarity determining region 3 for antibody 19684
AKGLMYHYDSALDL

SEQ ID NO: 39369 - protein, 9 aa, Homo sapiens
  light chain complementarity determining region 3 for antibody 19685
QQYGSSPRK

SEQ ID NO: 39370 - protein, 25 aa, Homo sapiens
  heavy chain complementarity determining region 3 for antibody 19685
ARLRIDRLRLPGAMRGPLYDCGLNV

SEQ ID NO: 39371 - protein, 9 aa, Homo sapiens
  light chain complementarity determining region 3 for antibody 19686
QQYGSSPRA

SEQ ID NO: 39372 - protein, 17 aa, Homo sapiens
  heavy chain complementarity determining region 3 for antibody 19686
TTDPQWLEPPPFLTNDY

SEQ ID NO: 39373 - protein, 9 aa, Homo sapiens
  light chain complementarity determining region 3 for antibody 19687
QQYGSSPQT

SEQ ID NO: 39374 - protein, 14 aa, Homo sapiens
  heavy chain complementarity determining region 3 for antibody 19687
ARDNPHRLERYFDL

SEQ ID NO: 39375 - protein, 10 aa, Homo sapiens
  light chain complementarity determining region 3 for antibody 19688
QQYGSSPPYP

SEQ ID NO: 39376 - protein, 18 aa, Homo sapiens
  heavy chain complementarity determining region 3 for antibody 19688
AMGKWFGDFNFYYYAMDV

SEQ ID NO: 39377 - protein, 10 aa, Homo sapiens
  light chain complementarity determining region 3 for antibody 19689
QQYGSSPPVT

SEQ ID NO: 39378 - protein, 15 aa, Homo sapiens
  heavy chain complementarity determining region 3 for antibody 19689
AKGPMVRGVLGPCDY

SEQ ID NO: 39379 - protein, 9 aa, Homo sapiens
  light chain complementarity determining region 3 for antibody 19690
QQYGSSPPT

SEQ ID NO: 39380 - protein, 16 aa, Homo sapiens
  heavy chain complementarity determining region 3 for antibody 19690
ARVFHPMAASDTAYDS

SEQ ID NO: 39381 - protein, 10 aa, Homo sapiens
  light chain complementarity determining region 3 for antibody 19691
QQYGSSPMYS

SEQ ID NO: 39382 - protein, 11 aa, Homo sapiens
  heavy chain complementarity determining region 3 for antibody 19691
ARGGQWGPLDY

SEQ ID NO: 39383 - protein, 10 aa, Homo sapiens
  light chain complementarity determining region 3 for antibody 19692
QQYGSSPMYI

SEQ ID NO: 39384 - protein, 11 aa, Homo sapiens
  heavy chain complementarity determining region 3 for antibody 19692
ARGGQWGSLDY

SEQ ID NO: 39385 - protein, 10 aa, Homo sapiens
  light chain complementarity determining region 3 for antibody 19693
QQYGSSPMTS

SEQ ID NO: 39386 - protein, 11 aa, Homo sapiens
  heavy chain complementarity determining region 3 for antibody 19693
ARGGQWGSLDY

SEQ ID NO: 39387 - protein, 9 aa, Homo sapiens
  light chain complementarity determining region 3 for antibody 19694
QQYGSSPKT

SEQ ID NO: 39388 - protein, 29 aa, Homo sapiens
  heavy chain complementarity determining region 3 for antibody 19694
AKSGRLRDLWFGDFRRPNYFDNTGYYLDY

SEQ ID NO: 39389 - protein, 10 aa, Homo sapiens
  light chain complementarity determining region 3 for antibody 19695
QQYGSSPGYP

SEQ ID NO: 39390 - protein, 14 aa, Homo sapiens
  heavy chain complementarity determining region 3 for antibody 19695
ARGPAAAGPWYFDF

SEQ ID NO: 39391 - protein, 9 aa, Homo sapiens
  light chain complementarity determining region 3 for antibody 19696
QQYGSSPGT

SEQ ID NO: 39392 - protein, 20 aa, Homo sapiens
  heavy chain complementarity determining region 3 for antibody 19696
ARRPVVSGWYRTGISSWFDP

SEQ ID NO: 39393 - protein, 9 aa, Homo sapiens
  light chain complementarity determining region 3 for antibody 19697
QQYGSSPFS

SEQ ID NO: 39394 - protein, 13 aa, Homo sapiens
  heavy chain complementarity determining region 3 for antibody 19697
ARGQQYSGRLFDY

SEQ ID NO: 39395 - protein, 9 aa, Homo sapiens
  light chain complementarity determining region 3 for antibody 19698
QQYGSSPDT

SEQ ID NO: 39396 - protein, 15 aa, Homo sapiens
  heavy chain complementarity determining region 3 for antibody 19698
AREGGYCGGDCSLDY

SEQ ID NO: 39397 - protein, 9 aa, Homo sapiens
  light chain complementarity determining region 3 for antibody 19699
QQYGSSLYT

SEQ ID NO: 39398 - protein, 16 aa, Homo sapiens
  heavy chain complementarity determining region 3 for antibody 19699
ARAKHSGDYYYYGMDA

SEQ ID NO: 39399 - protein, 9 aa, Homo sapiens
  light chain complementarity determining region 3 for antibody 19700
QQYGSSLYA

SEQ ID NO: 39400 - protein, 16 aa, Homo sapiens
  heavy chain complementarity determining region 3 for antibody 19700
ARAKHYGDYYYYGMDA

SEQ ID NO: 39401 - protein, 9 aa, Homo sapiens
  light chain complementarity determining region 3 for antibody 19701
QQYGSSLST

SEQ ID NO: 39402 - protein, 16 aa, Homo sapiens
  heavy chain complementarity determining region 3 for antibody 19701
ARAKHYGDYYYYGMDA

SEQ ID NO: 39403 - protein, 9 aa, Homo sapiens
  light chain complementarity determining region 3 for antibody 19702
QQYGSSHYT

SEQ ID NO: 39404 - protein, 11 aa, Homo sapiens
  heavy chain complementarity determining region 3 for antibody 19702
AEGGLRWPLDY

SEQ ID NO: 39405 - protein, 9 aa, Homo sapiens
  light chain complementarity determining region 3 for antibody 19703
QQYGSSHYP

SEQ ID NO: 39406 - protein, 11 aa, Homo sapiens
  heavy chain complementarity determining region 3 for antibody 19703
AKGGLRWPLDY

SEQ ID NO: 39407 - protein, 9 aa, Homo sapiens
  light chain complementarity determining region 3 for antibody 19704
QQYGSSHPT

SEQ ID NO: 39408 - protein, 16 aa, Homo sapiens
  heavy chain complementarity determining region 3 for antibody 19704
ARGRTFRGNIYADLLY

SEQ ID NO: 39409 - protein, 9 aa, Homo sapiens
  light chain complementarity determining region 3 for antibody 19705
QQYGSSFFT

SEQ ID NO: 39410 - protein, 19 aa, Homo sapiens
  heavy chain complementarity determining region 3 for antibody 19705
ARYCASGGSCYSPKYGMDV

SEQ ID NO: 39411 - protein, 9 aa, Homo sapiens
  light chain complementarity determining region 3 for antibody 19706
QQYGSPPRT

SEQ ID NO: 39412 - protein, 17 aa, Homo sapiens
  heavy chain complementarity determining region 3 for antibody 19706
ARVRSFYYDTSGHYYLF

SEQ ID NO: 39413 - protein, 9 aa, Homo sapiens
  light chain complementarity determining region 3 for antibody 19707
QQYGSPPRT

SEQ ID NO: 39414 - protein, 14 aa, Homo sapiens
  heavy chain complementarity determining region 3 for antibody 19707
AKGLMYHYDSALDL

SEQ ID NO: 39415 - protein, 10 aa, Homo sapiens
  light chain complementarity determining region 3 for antibody 19708
QQYGSPPPVT

SEQ ID NO: 39416 - protein, 15 aa, Homo sapiens
  heavy chain complementarity determining region 3 for antibody 19708
AKGPMVRGVLGPFDY

SEQ ID NO: 39417 - protein, 9 aa, Homo sapiens
  light chain complementarity determining region 3 for antibody 19709
QQYGSLPYT

SEQ ID NO: 39418 - protein, 14 aa, Homo sapiens
  heavy chain complementarity determining region 3 for antibody 19709
ARGGFIVAWGLFDY

SEQ ID NO: 39419 - protein, 9 aa, Homo sapiens
  light chain complementarity determining region 3 for antibody 19710
QQYGSLPRT

SEQ ID NO: 39420 - protein, 13 aa, Homo sapiens
  heavy chain complementarity determining region 3 for antibody 19710
ARGQFERSGYKDN

SEQ ID NO: 39421 - protein, 9 aa, Homo sapiens
  light chain complementarity determining region 3 for antibody 19711
QQYGSLPRT

SEQ ID NO: 39422 - protein, 13 aa, Homo sapiens
  heavy chain complementarity determining region 3 for antibody 19711
AGGQFHSSGYSEF

SEQ ID NO: 39423 - protein, 9 aa, Homo sapiens
  light chain complementarity determining region 3 for antibody 19712
QQYGSLPRP

SEQ ID NO: 39424 - protein, 14 aa, Homo sapiens
  heavy chain complementarity determining region 3 for antibody 19712
AGGDFCGGDCYSEY

SEQ ID NO: 39425 - protein, 9 aa, Homo sapiens
  light chain complementarity determining region 3 for antibody 19713
QQYGSLFLT

SEQ ID NO: 39426 - protein, 19 aa, Homo sapiens
  heavy chain complementarity determining region 3 for antibody 19713
ARYCASGGSCYSPKYGMDV

SEQ ID NO: 39427 - protein, 9 aa, Homo sapiens
  light chain complementarity determining region 3 for antibody 19714
QQYGSIPRT

SEQ ID NO: 39428 - protein, 7 aa, Homo sapiens
  heavy chain complementarity determining region 3 for antibody 19714
HGYELKC

SEQ ID NO: 39429 - protein, 9 aa, Homo sapiens
  light chain complementarity determining region 3 for antibody 19715
QQYGSIPRT

SEQ ID NO: 39430 - protein, 13 aa, Homo sapiens
  heavy chain complementarity determining region 3 for antibody 19715
AGGSFGGGNYKED

SEQ ID NO: 39431 - protein, 9 aa, Homo sapiens
  light chain complementarity determining region 3 for antibody 19716
QQYGSIPRT

SEQ ID NO: 39432 - protein, 13 aa, Homo sapiens
  heavy chain complementarity determining region 3 for antibody 19716
AGGGFSSGRYSES

SEQ ID NO: 39433 - protein, 9 aa, Homo sapiens
  light chain complementarity determining region 3 for antibody 19717
QQYGSIPRT

SEQ ID NO: 39434 - protein, 13 aa, Homo sapiens
  heavy chain complementarity determining region 3 for antibody 19717
AGGGFSSGRYAEY

SEQ ID NO: 39435 - protein, 9 aa, Homo sapiens
  light chain complementarity determining region 3 for antibody 19718
QQYGSIPRT

SEQ ID NO: 39436 - protein, 13 aa, Homo sapiens
  heavy chain complementarity determining region 3 for antibody 19718
AGGGFSSGRCSEY

SEQ ID NO: 39437 - protein, 9 aa, Homo sapiens
  light chain complementarity determining region 3 for antibody 19719
QQYGSIPRT

SEQ ID NO: 39438 - protein, 14 aa, Homo sapiens
  heavy chain complementarity determining region 3 for antibody 19719
AGGEVSSGWHYSEN

SEQ ID NO: 39439 - protein, 9 aa, Homo sapiens
  light chain complementarity determining region 3 for antibody 19720
QQYGSIPRT

SEQ ID NO: 39440 - protein, 14 aa, Homo sapiens
  heavy chain complementarity determining region 3 for antibody 19720
AGGESSSGWHYSEN

SEQ ID NO: 39441 - protein, 9 aa, Homo sapiens
  light chain complementarity determining region 3 for antibody 19721
QQYGSIPRT

SEQ ID NO: 39442 - protein, 13 aa, Homo sapiens
  heavy chain complementarity determining region 3 for antibody 19721
AGGAFSGGNYKED

SEQ ID NO: 39443 - protein, 9 aa, Homo sapiens
  light chain complementarity determining region 3 for antibody 19722
QQYGSIPRS

SEQ ID NO: 39444 - protein, 13 aa, Homo sapiens
  heavy chain complementarity determining region 3 for antibody 19722
AGGSWHSGIYYES

SEQ ID NO: 39445 - protein, 9 aa, Homo sapiens
  light chain complementarity determining region 3 for antibody 19723
QQYGSIPRP

SEQ ID NO: 39446 - protein, 13 aa, Homo sapiens
  heavy chain complementarity determining region 3 for antibody 19723
AGGSFSGGNYKED

SEQ ID NO: 39447 - protein, 9 aa, Homo sapiens
  light chain complementarity determining region 3 for antibody 19724
QQYGSIPRN

SEQ ID NO: 39448 - protein, 13 aa, Homo sapiens
  heavy chain complementarity determining region 3 for antibody 19724
AGGGFSSGRYSEY

SEQ ID NO: 39449 - protein, 9 aa, Homo sapiens
  light chain complementarity determining region 3 for antibody 19725
QQYGSIPRK

SEQ ID NO: 39450 - protein, 13 aa, Homo sapiens
  heavy chain complementarity determining region 3 for antibody 19725
AGGSFSGGNYKED

SEQ ID NO: 39451 - protein, 9 aa, Homo sapiens
  light chain complementarity determining region 3 for antibody 19726
QQYGSIPLT

SEQ ID NO: 39452 - protein, 7 aa, Homo sapiens
  heavy chain complementarity determining region 3 for antibody 19726
HGYELQC

SEQ ID NO: 39453 - protein, 9 aa, Homo sapiens
  light chain complementarity determining region 3 for antibody 19727
QQYGSIPLT

SEQ ID NO: 39454 - protein, 13 aa, Homo sapiens
  heavy chain complementarity determining region 3 for antibody 19727
AGGLFHSSGYSEF

SEQ ID NO: 39455 - protein, 9 aa, Homo sapiens
  light chain complementarity determining region 3 for antibody 19728
QQYGSIPLN

SEQ ID NO: 39456 - protein, 7 aa, Homo sapiens
  heavy chain complementarity determining region 3 for antibody 19728
HGYELKC

SEQ ID NO: 39457 - protein, 9 aa, Homo sapiens
  light chain complementarity determining region 3 for antibody 19729
QQYGSFPYT

SEQ ID NO: 39458 - protein, 14 aa, Homo sapiens
  heavy chain complementarity determining region 3 for antibody 19729
TRGGVIVAWGLFDY

SEQ ID NO: 39459 - protein, 9 aa, Homo sapiens
  light chain complementarity determining region 3 for antibody 19730
QQYGSFPYT

SEQ ID NO: 39460 - protein, 14 aa, Homo sapiens
  heavy chain complementarity determining region 3 for antibody 19730
TRGGFIVAWCLFDY

SEQ ID NO: 39461 - protein, 9 aa, Homo sapiens
  light chain complementarity determining region 3 for antibody 19731
QQYGSFPYT

SEQ ID NO: 39462 - protein, 14 aa, Homo sapiens
  heavy chain complementarity determining region 3 for antibody 19731
TRGGCIVAWGLFDY

SEQ ID NO: 39463 - protein, 9 aa, Homo sapiens
  light chain complementarity determining region 3 for antibody 19732
QQYGSFPYT

SEQ ID NO: 39464 - protein, 14 aa, Homo sapiens
  heavy chain complementarity determining region 3 for antibody 19732
ARGGCIVAWGLFDY

SEQ ID NO: 39465 - protein, 9 aa, Homo sapiens
  light chain complementarity determining region 3 for antibody 19733
QQYGSFPST

SEQ ID NO: 39466 - protein, 14 aa, Homo sapiens
  heavy chain complementarity determining region 3 for antibody 19733
TRGGFIVAWGLFDY

SEQ ID NO: 39467 - protein, 9 aa, Homo sapiens
  light chain complementarity determining region 3 for antibody 19734
QQYGSFPRS

SEQ ID NO: 39468 - protein, 13 aa, Homo sapiens
  heavy chain complementarity determining region 3 for antibody 19734
AGGTWHSGIYYES

SEQ ID NO: 39469 - protein, 9 aa, Homo sapiens
  light chain complementarity determining region 3 for antibody 19735
QQYGSFPDT

SEQ ID NO: 39470 - protein, 14 aa, Homo sapiens
  heavy chain complementarity determining region 3 for antibody 19735
ARGGFIVAWGLFDY

SEQ ID NO: 39471 - protein, 10 aa, Homo sapiens
  light chain complementarity determining region 3 for antibody 19736
QQYGRSVPWT

SEQ ID NO: 39472 - protein, 13 aa, Homo sapiens
  heavy chain complementarity determining region 3 for antibody 19736
AHGRRSSWDSFDY

SEQ ID NO: 39473 - protein, 9 aa, Homo sapiens
  light chain complementarity determining region 3 for antibody 19737
QQYGRSPYT

SEQ ID NO: 39474 - protein, 18 aa, Homo sapiens
  heavy chain complementarity determining region 3 for antibody 19737
ARPMVRALEEYNYYGLDV

SEQ ID NO: 39475 - protein, 9 aa, Homo sapiens
  light chain complementarity determining region 3 for antibody 19738
QQYGRSPYT

SEQ ID NO: 39476 - protein, 18 aa, Homo sapiens
  heavy chain complementarity determining region 3 for antibody 19738
ARPMVRALDEYTYYGLDV

SEQ ID NO: 39477 - protein, 9 aa, Homo sapiens
  light chain complementarity determining region 3 for antibody 19739
QQYGRSPYT

SEQ ID NO: 39478 - protein, 18 aa, Homo sapiens
  heavy chain complementarity determining region 3 for antibody 19739
ARPMVRALDEYNYCGLDV

SEQ ID NO: 39479 - protein, 9 aa, Homo sapiens
  light chain complementarity determining region 3 for antibody 19740
QQYGRSPRT

SEQ ID NO: 39480 - protein, 15 aa, Homo sapiens
  heavy chain complementarity determining region 3 for antibody 19740
AKTYDFWSGDDAFEI

SEQ ID NO: 39481 - protein, 9 aa, Homo sapiens
  light chain complementarity determining region 3 for antibody 19741
QQYGRSPQT

SEQ ID NO: 39482 - protein, 11 aa, Homo sapiens
  heavy chain complementarity determining region 3 for antibody 19741
ARGWIERWGDF

SEQ ID NO: 39483 - protein, 9 aa, Homo sapiens
  light chain complementarity determining region 3 for antibody 19742
QQYGRSPQT

SEQ ID NO: 39484 - protein, 11 aa, Homo sapiens
  heavy chain complementarity determining region 3 for antibody 19742
ARGWIDLWGDF

SEQ ID NO: 39485 - protein, 10 aa, Homo sapiens
  light chain complementarity determining region 3 for antibody 19743
QQYGRSPPVT

SEQ ID NO: 39486 - protein, 15 aa, Homo sapiens
  heavy chain complementarity determining region 3 for antibody 19743
AKGPMVRGVLGPFDY

SEQ ID NO: 39487 - protein, 11 aa, Homo sapiens
  light chain complementarity determining region 3 for antibody 19744
QQYGRSPPGNT

SEQ ID NO: 39488 - protein, 12 aa, Homo sapiens
  heavy chain complementarity determining region 3 for antibody 19744
AREWPETCYFDY

SEQ ID NO: 39489 - protein, 9 aa, Homo sapiens
  light chain complementarity determining region 3 for antibody 19745
QQYGRSPGT

SEQ ID NO: 39490 - protein, 13 aa, Homo sapiens
  heavy chain complementarity determining region 3 for antibody 19745
ARDSVDYGDPLDL

SEQ ID NO: 39491 - protein, 9 aa, Homo sapiens
  light chain complementarity determining region 3 for antibody 19746
QQYGRLPYT

SEQ ID NO: 39492 - protein, 18 aa, Homo sapiens
  heavy chain complementarity determining region 3 for antibody 19746
ARPMVRALDEYNYYGLDV

SEQ ID NO: 39493 - protein, 9 aa, Homo sapiens
  light chain complementarity determining region 3 for antibody 19747
QQYGRLPRS

SEQ ID NO: 39494 - protein, 13 aa, Homo sapiens
  heavy chain complementarity determining region 3 for antibody 19747
AGGTWHSSAYYES

SEQ ID NO: 39495 - protein, 9 aa, Homo sapiens
  light chain complementarity determining region 3 for antibody 19748
QQYGRITRT

SEQ ID NO: 39496 - protein, 13 aa, Homo sapiens
  heavy chain complementarity determining region 3 for antibody 19748
AGGLYDSSGYSEF

SEQ ID NO: 39497 - protein, 9 aa, Homo sapiens
  light chain complementarity determining region 3 for antibody 19749
QQYGRIPRT

SEQ ID NO: 39498 - protein, 13 aa, Homo sapiens
  heavy chain complementarity determining region 3 for antibody 19749
AGGRYDSSGYSEF

SEQ ID NO: 39499 - protein, 9 aa, Homo sapiens
  light chain complementarity determining region 3 for antibody 19750
QQYGRIPRT

SEQ ID NO: 39500 - protein, 13 aa, Homo sapiens
  heavy chain complementarity determining region 3 for antibody 19750
AGGLFGSGPYSEF

SEQ ID NO: 39501 - protein, 9 aa, Homo sapiens
  light chain complementarity determining region 3 for antibody 19751
QQYGRIPRT

SEQ ID NO: 39502 - protein, 14 aa, Homo sapiens
  heavy chain complementarity determining region 3 for antibody 19751
AGGEFSSGWHYSDN

SEQ ID NO: 39503 - protein, 9 aa, Homo sapiens
  light chain complementarity determining region 3 for antibody 19752
QQYGRFPYT

SEQ ID NO: 39504 - protein, 14 aa, Homo sapiens
  heavy chain complementarity determining region 3 for antibody 19752
ARGGFIVAWGLFDY

SEQ ID NO: 39505 - protein, 9 aa, Homo sapiens
  light chain complementarity determining region 3 for antibody 19753
QQYGRFPRS

SEQ ID NO: 39506 - protein, 13 aa, Homo sapiens
  heavy chain complementarity determining region 3 for antibody 19753
AGGTWHSSAYYES

SEQ ID NO: 39507 - protein, 8 aa, Homo sapiens
  light chain complementarity determining region 3 for antibody 19754
QQYGPSRT

SEQ ID NO: 39508 - protein, 15 aa, Homo sapiens
  heavy chain complementarity determining region 3 for antibody 19754
ARGEFYYDGSGYRDD

SEQ ID NO: 39509 - protein, 9 aa, Homo sapiens
  light chain complementarity determining region 3 for antibody 19755
QQYGPSPRT

SEQ ID NO: 39510 - protein, 13 aa, Homo sapiens
  heavy chain complementarity determining region 3 for antibody 19755
PIGFYDRSGYHEY

SEQ ID NO: 39511 - protein, 9 aa, Homo sapiens
  light chain complementarity determining region 3 for antibody 19756
QQYGPIPRT

SEQ ID NO: 39512 - protein, 13 aa, Homo sapiens
  heavy chain complementarity determining region 3 for antibody 19756
AGGNFHRSGYAEY

SEQ ID NO: 39513 - protein, 9 aa, Homo sapiens
  light chain complementarity determining region 3 for antibody 19757
QQYGPIPRT

SEQ ID NO: 39514 - protein, 13 aa, Homo sapiens
  heavy chain complementarity determining region 3 for antibody 19757
AGGIFHSRGYGEY

SEQ ID NO: 39515 - protein, 9 aa, Homo sapiens
  light chain complementarity determining region 3 for antibody 19758
QQYGNTPRT

SEQ ID NO: 39516 - protein, 13 aa, Homo sapiens
  heavy chain complementarity determining region 3 for antibody 19758
AGGLFHSSGYSEF

SEQ ID NO: 39517 - protein, 9 aa, Homo sapiens
  light chain complementarity determining region 3 for antibody 19759
QQYGNSPRT

SEQ ID NO: 39518 - protein, 15 aa, Homo sapiens
  heavy chain complementarity determining region 3 for antibody 19759
AGGWFNYYSSGYSET

SEQ ID NO: 39519 - protein, 9 aa, Homo sapiens
  light chain complementarity determining region 3 for antibody 19760
QQYGNSPRT

SEQ ID NO: 39520 - protein, 13 aa, Homo sapiens
  heavy chain complementarity determining region 3 for antibody 19760
AGGQYDSGDYREY

SEQ ID NO: 39521 - protein, 9 aa, Homo sapiens
  light chain complementarity determining region 3 for antibody 19761
QQYGNSPRP

SEQ ID NO: 39522 - protein, 14 aa, Homo sapiens
  heavy chain complementarity determining region 3 for antibody 19761
ASDPVVGAPGYFDY

SEQ ID NO: 39523 - protein, 9 aa, Homo sapiens
  light chain complementarity determining region 3 for antibody 19762
QQYGNSPRK

SEQ ID NO: 39524 - protein, 14 aa, Homo sapiens
  heavy chain complementarity determining region 3 for antibody 19762
ASDPVVGAPGYFDY

SEQ ID NO: 39525 - protein, 8 aa, Homo sapiens
  light chain complementarity determining region 3 for antibody 19763
QQYGNSPF

SEQ ID NO: 39526 - protein, 20 aa, Homo sapiens
  heavy chain complementarity determining region 3 for antibody 19763
ARGPPGYDPSGYYRNWYFDL

SEQ ID NO: 39527 - protein, 8 aa, Homo sapiens
  light chain complementarity determining region 3 for antibody 19764
QQYGNSPF

SEQ ID NO: 39528 - protein, 20 aa, Homo sapiens
  heavy chain complementarity determining region 3 for antibody 19764
ARGPPGYDASGYYRNWYFDL

SEQ ID NO: 39529 - protein, 9 aa, Homo sapiens
  light chain complementarity determining region 3 for antibody 19765
QQYGNLPWT

SEQ ID NO: 39530 - protein, 13 aa, Homo sapiens
  heavy chain complementarity determining region 3 for antibody 19765
AGGDFHSGGYSEF

SEQ ID NO: 39531 - protein, 9 aa, Homo sapiens
  light chain complementarity determining region 3 for antibody 19766
QQYGNLPRT

SEQ ID NO: 39532 - protein, 13 aa, Homo sapiens
  heavy chain complementarity determining region 3 for antibody 19766
AGGQFHSSGCSEF

SEQ ID NO: 39533 - protein, 9 aa, Homo sapiens
  light chain complementarity determining region 3 for antibody 19767
QQYGNLPRT

SEQ ID NO: 39534 - protein, 13 aa, Homo sapiens
  heavy chain complementarity determining region 3 for antibody 19767
AGGQFHPSGYSEF

SEQ ID NO: 39535 - protein, 9 aa, Homo sapiens
  light chain complementarity determining region 3 for antibody 19768
QQYGNLPRT

SEQ ID NO: 39536 - protein, 13 aa, Homo sapiens
  heavy chain complementarity determining region 3 for antibody 19768
AGGNYDAGRYEEY

SEQ ID NO: 39537 - protein, 9 aa, Homo sapiens
  light chain complementarity determining region 3 for antibody 19769
QQYGNLPRT

SEQ ID NO: 39538 - protein, 13 aa, Homo sapiens
  heavy chain complementarity determining region 3 for antibody 19769
AGGNCHSGGYGEY

SEQ ID NO: 39539 - protein, 9 aa, Homo sapiens
  light chain complementarity determining region 3 for antibody 19770
QQYGNLPRT

SEQ ID NO: 39540 - protein, 13 aa, Homo sapiens
  heavy chain complementarity determining region 3 for antibody 19770
AGGGFHSGGYSEF

SEQ ID NO: 39541 - protein, 9 aa, Homo sapiens
  light chain complementarity determining region 3 for antibody 19771
QQYGNLPRT

SEQ ID NO: 39542 - protein, 14 aa, Homo sapiens
  heavy chain complementarity determining region 3 for antibody 19771
AGGDLHRGGGYSEF

SEQ ID NO: 39543 - protein, 9 aa, Homo sapiens
  light chain complementarity determining region 3 for antibody 19772
QQYGNLPRT

SEQ ID NO: 39544 - protein, 13 aa, Homo sapiens
  heavy chain complementarity determining region 3 for antibody 19772
AGGDCHSGGYSEF

SEQ ID NO: 39545 - protein, 9 aa, Homo sapiens
  light chain complementarity determining region 3 for antibody 19773
QQYGNLPRP

SEQ ID NO: 39546 - protein, 13 aa, Homo sapiens
  heavy chain complementarity determining region 3 for antibody 19773
ARGQYERSGYKEN

SEQ ID NO: 39547 - protein, 9 aa, Homo sapiens
  light chain complementarity determining region 3 for antibody 19774
QQYGNLPRK

SEQ ID NO: 39548 - protein, 13 aa, Homo sapiens
  heavy chain complementarity determining region 3 for antibody 19774
AGGQFHSSGYSEF

SEQ ID NO: 39549 - protein, 9 aa, Homo sapiens
  light chain complementarity determining region 3 for antibody 19775
QQYGNLPRK

SEQ ID NO: 39550 - protein, 13 aa, Homo sapiens
  heavy chain complementarity determining region 3 for antibody 19775
AGGDFHSGGYSEF

SEQ ID NO: 39551 - protein, 9 aa, Homo sapiens
  light chain complementarity determining region 3 for antibody 19776
QQYGNLPLT

SEQ ID NO: 39552 - protein, 13 aa, Homo sapiens
  heavy chain complementarity determining region 3 for antibody 19776
AGGDFHSGGYSEF

SEQ ID NO: 39553 - protein, 9 aa, Homo sapiens
  light chain complementarity determining region 3 for antibody 19777
QQYGNLLRT

SEQ ID NO: 39554 - protein, 13 aa, Homo sapiens
  heavy chain complementarity determining region 3 for antibody 19777
AGGQFHSSGYSEF

SEQ ID NO: 39555 - protein, 9 aa, Homo sapiens
  light chain complementarity determining region 3 for antibody 19778
QQYGNLLRT

SEQ ID NO: 39556 - protein, 13 aa, Homo sapiens
  heavy chain complementarity determining region 3 for antibody 19778
AGGDFHRGGYSEY

SEQ ID NO: 39557 - protein, 9 aa, Homo sapiens
  light chain complementarity determining region 3 for antibody 19779
QQYGNLHRT

SEQ ID NO: 39558 - protein, 13 aa, Homo sapiens
  heavy chain complementarity determining region 3 for antibody 19779
AGGDFHSGGYSEF

SEQ ID NO: 39559 - protein, 9 aa, Homo sapiens
  light chain complementarity determining region 3 for antibody 19780
QQYGNKPRT

SEQ ID NO: 39560 - protein, 13 aa, Homo sapiens
  heavy chain complementarity determining region 3 for antibody 19780
AGGLFHSSGYSEF

SEQ ID NO: 39561 - protein, 9 aa, Homo sapiens
  light chain complementarity determining region 3 for antibody 19781
QQYGNIPRT

SEQ ID NO: 39562 - protein, 13 aa, Homo sapiens
  heavy chain complementarity determining region 3 for antibody 19781
AGGLLHSSGYSEF

SEQ ID NO: 39563 - protein, 9 aa, Homo sapiens
  light chain complementarity determining region 3 for antibody 19782
QQYGNIPRS

SEQ ID NO: 39564 - protein, 13 aa, Homo sapiens
  heavy chain complementarity determining region 3 for antibody 19782
AGGTWHSGTYYDS

SEQ ID NO: 39565 - protein, 9 aa, Homo sapiens
  light chain complementarity determining region 3 for antibody 19783
QQYGNIPRP

SEQ ID NO: 39566 - protein, 13 aa, Homo sapiens
  heavy chain complementarity determining region 3 for antibody 19783
AGGTWHSGTYYES

SEQ ID NO: 39567 - protein, 9 aa, Homo sapiens
  light chain complementarity determining region 3 for antibody 19784
QQYGNILRT

SEQ ID NO: 39568 - protein, 13 aa, Homo sapiens
  heavy chain complementarity determining region 3 for antibody 19784
AGGLFHSSGYSEF

SEQ ID NO: 39569 - protein, 9 aa, Homo sapiens
  light chain complementarity determining region 3 for antibody 19785
QQYGNIHRT

SEQ ID NO: 39570 - protein, 13 aa, Homo sapiens
  heavy chain complementarity determining region 3 for antibody 19785
AGGLFHSSGYSEF

SEQ ID NO: 39571 - protein, 9 aa, Homo sapiens
  light chain complementarity determining region 3 for antibody 19786
QQYGKLPRT

SEQ ID NO: 39572 - protein, 13 aa, Homo sapiens
  heavy chain complementarity determining region 3 for antibody 19786
AGGQFHTSGYSEF

SEQ ID NO: 39573 - protein, 9 aa, Homo sapiens
  light chain complementarity determining region 3 for antibody 19787
QQYGKLPRT

SEQ ID NO: 39574 - protein, 13 aa, Homo sapiens
  heavy chain complementarity determining region 3 for antibody 19787
AGGDFHSGGYSEF

SEQ ID NO: 39575 - protein, 9 aa, Homo sapiens
  light chain complementarity determining region 3 for antibody 19788
QQYGHIPRT

SEQ ID NO: 39576 - protein, 13 aa, Homo sapiens
  heavy chain complementarity determining region 3 for antibody 19788
AGGLFHSSGYSEF

SEQ ID NO: 39577 - protein, 9 aa, Homo sapiens
  light chain complementarity determining region 3 for antibody 19789
QQYGGSPWT

SEQ ID NO: 39578 - protein, 13 aa, Homo sapiens
  heavy chain complementarity determining region 3 for antibody 19789
AAGYFSSGTYYEY

SEQ ID NO: 39579 - protein, 8 aa, Homo sapiens
  light chain complementarity determining region 3 for antibody 19790
QQYGGSPS

SEQ ID NO: 39580 - protein, 16 aa, Homo sapiens
  heavy chain complementarity determining region 3 for antibody 19790
ATDWGSGTHWIRAFDV

SEQ ID NO: 39581 - protein, 9 aa, Homo sapiens
  light chain complementarity determining region 3 for antibody 19791
QQYGGSPRT

SEQ ID NO: 39582 - protein, 18 aa, Homo sapiens
  heavy chain complementarity determining region 3 for antibody 19791
ATAFWVGLGVPPPGFFEY

SEQ ID NO: 39583 - protein, 9 aa, Homo sapiens
  light chain complementarity determining region 3 for antibody 19792
QQYGGSPRT

SEQ ID NO: 39584 - protein, 13 aa, Homo sapiens
  heavy chain complementarity determining region 3 for antibody 19792
ASGYVDSGAYYEF

SEQ ID NO: 39585 - protein, 9 aa, Homo sapiens
  light chain complementarity determining region 3 for antibody 19793
QQYGGSPRT

SEQ ID NO: 39586 - protein, 13 aa, Homo sapiens
  heavy chain complementarity determining region 3 for antibody 19793
ASGYFDSGAYYEL

SEQ ID NO: 39587 - protein, 9 aa, Homo sapiens
  light chain complementarity determining region 3 for antibody 19794
QQYGGSPRT

SEQ ID NO: 39588 - protein, 13 aa, Homo sapiens
  heavy chain complementarity determining region 3 for antibody 19794
ASGYFDRGAYYEF

SEQ ID NO: 39589 - protein, 9 aa, Homo sapiens
  light chain complementarity determining region 3 for antibody 19795
QQYGGSPRT

SEQ ID NO: 39590 - protein, 15 aa, Homo sapiens
  heavy chain complementarity determining region 3 for antibody 19795
AKDGPYCGSDCVFDS

SEQ ID NO: 39591 - protein, 9 aa, Homo sapiens
  light chain complementarity determining region 3 for antibody 19796
QQYGGSPRT

SEQ ID NO: 39592 - protein, 15 aa, Homo sapiens
  heavy chain complementarity determining region 3 for antibody 19796
AKDGPYCGADCFFDS

SEQ ID NO: 39593 - protein, 9 aa, Homo sapiens
  light chain complementarity determining region 3 for antibody 19797
QQYGGSPRT

SEQ ID NO: 39594 - protein, 13 aa, Homo sapiens
  heavy chain complementarity determining region 3 for antibody 19797
AAGYFSSGTYYDY

SEQ ID NO: 39595 - protein, 9 aa, Homo sapiens
  light chain complementarity determining region 3 for antibody 19798
QQYGGSPRT

SEQ ID NO: 39596 - protein, 13 aa, Homo sapiens
  heavy chain complementarity determining region 3 for antibody 19798
AAGYFSSGTYFEY

SEQ ID NO: 39597 - protein, 9 aa, Homo sapiens
  light chain complementarity determining region 3 for antibody 19799
QQYGGSPRT

SEQ ID NO: 39598 - protein, 13 aa, Homo sapiens
  heavy chain complementarity determining region 3 for antibody 19799
AAGYFSSGPYYEY

SEQ ID NO: 39599 - protein, 9 aa, Homo sapiens
  light chain complementarity determining region 3 for antibody 19800
QQYGGSPRA

SEQ ID NO: 39600 - protein, 15 aa, Homo sapiens
  heavy chain complementarity determining region 3 for antibody 19800
AKDGPYCGSDCFFDS

SEQ ID NO: 39601 - protein, 9 aa, Homo sapiens
  light chain complementarity determining region 3 for antibody 19801
QQYGGSPPT

SEQ ID NO: 39602 - protein, 15 aa, Homo sapiens
  heavy chain complementarity determining region 3 for antibody 19801
ARESPIRGPWGYFDF

SEQ ID NO: 39603 - protein, 9 aa, Homo sapiens
  light chain complementarity determining region 3 for antibody 19802
QQYGGSGIT

SEQ ID NO: 39604 - protein, 11 aa, Homo sapiens
  heavy chain complementarity determining region 3 for antibody 19802
ARRAHVGWFDP

SEQ ID NO: 39605 - protein, 9 aa, Homo sapiens
  light chain complementarity determining region 3 for antibody 19803
QQYGGPPRT

SEQ ID NO: 39606 - protein, 15 aa, Homo sapiens
  heavy chain complementarity determining region 3 for antibody 19803
AKDGPYCGSDCFFDS

SEQ ID NO: 39607 - protein, 9 aa, Homo sapiens
  light chain complementarity determining region 3 for antibody 19804
QQYGGPIFT

SEQ ID NO: 39608 - protein, 13 aa, Homo sapiens
  heavy chain complementarity determining region 3 for antibody 19804
VMASRGYYSSFDY

SEQ ID NO: 39609 - protein, 9 aa, Homo sapiens
  light chain complementarity determining region 3 for antibody 19805
QQYGGLVKT

SEQ ID NO: 39610 - protein, 12 aa, Homo sapiens
  heavy chain complementarity determining region 3 for antibody 19805
ARGGIWTGGFDY

SEQ ID NO: 39611 - protein, 8 aa, Homo sapiens
  light chain complementarity determining region 3 for antibody 19806
QQYGGLPS

SEQ ID NO: 39612 - protein, 16 aa, Homo sapiens
  heavy chain complementarity determining region 3 for antibody 19806
ATDWGSGTQWIRAFDV

SEQ ID NO: 39613 - protein, 9 aa, Homo sapiens
  light chain complementarity determining region 3 for antibody 19807
QQYGFSPYI

SEQ ID NO: 39614 - protein, 11 aa, Homo sapiens
  heavy chain complementarity determining region 3 for antibody 19807
TRGYIEGIGDW

SEQ ID NO: 39615 - protein, 9 aa, Homo sapiens
  light chain complementarity determining region 3 for antibody 19808
QQYGFSPSI

SEQ ID NO: 39616 - protein, 11 aa, Homo sapiens
  heavy chain complementarity determining region 3 for antibody 19808
TRGYIEVIGDW

SEQ ID NO: 39617 - protein, 9 aa, Homo sapiens
  light chain complementarity determining region 3 for antibody 19809
QQYGDSPVT

SEQ ID NO: 39618 - protein, 18 aa, Homo sapiens
  heavy chain complementarity determining region 3 for antibody 19809
AKIADAALSASHRGYFDD

SEQ ID NO: 39619 - protein, 9 aa, Homo sapiens
  light chain complementarity determining region 3 for antibody 19810
QQYGDSPVP

SEQ ID NO: 39620 - protein, 18 aa, Homo sapiens
  heavy chain complementarity determining region 3 for antibody 19810
AKIADAAFSASHRGYFDD

SEQ ID NO: 39621 - protein, 10 aa, Homo sapiens
  light chain complementarity determining region 3 for antibody 19811
QQYGDSPSYS

SEQ ID NO: 39622 - protein, 10 aa, Homo sapiens
  heavy chain complementarity determining region 3 for antibody 19811
VNSAGSYFEY

SEQ ID NO: 39623 - protein, 8 aa, Homo sapiens
  light chain complementarity determining region 3 for antibody 19812
QQYGCSPS

SEQ ID NO: 39624 - protein, 16 aa, Homo sapiens
  heavy chain complementarity determining region 3 for antibody 19812
ATDWGSGTQWIRAFDV

SEQ ID NO: 39625 - protein, 9 aa, Homo sapiens
  light chain complementarity determining region 3 for antibody 19813
QQYGAKPRT

SEQ ID NO: 39626 - protein, 13 aa, Homo sapiens
  heavy chain complementarity determining region 3 for antibody 19813
ASGYGSGASYREN

SEQ ID NO: 39627 - protein, 9 aa, Homo sapiens
  light chain complementarity determining region 3 for antibody 19814
QQYFTTPTT

SEQ ID NO: 39628 - protein, 10 aa, Homo sapiens
  heavy chain complementarity determining region 3 for antibody 19814
ARSGGYGWDS

SEQ ID NO: 39629 - protein, 9 aa, Homo sapiens
  light chain complementarity determining region 3 for antibody 19815
QQYFTTPRT

SEQ ID NO: 39630 - protein, 11 aa, Homo sapiens
  heavy chain complementarity determining region 3 for antibody 19815
TRGQDRSKQGY

SEQ ID NO: 39631 - protein, 9 aa, Homo sapiens
  light chain complementarity determining region 3 for antibody 19816
QQYFSTPYP

SEQ ID NO: 39632 - protein, 16 aa, Homo sapiens
  heavy chain complementarity determining region 3 for antibody 19816
ARAKWDRGLAVAGFDY

SEQ ID NO: 39633 - protein, 9 aa, Homo sapiens
  light chain complementarity determining region 3 for antibody 19817
QQYFNTPWT

SEQ ID NO: 39634 - protein, 17 aa, Homo sapiens
  heavy chain complementarity determining region 3 for antibody 19817
SRQAHFYGTSAYDYPDS

SEQ ID NO: 39635 - protein, 9 aa, Homo sapiens
  light chain complementarity determining region 3 for antibody 19818
QQYESLPWT

SEQ ID NO: 39636 - protein, 18 aa, Homo sapiens
  heavy chain complementarity determining region 3 for antibody 19818
ARQIDYGDYASYHGYCDV

SEQ ID NO: 39637 - protein, 8 aa, Homo sapiens
  light chain complementarity determining region 3 for antibody 19819
QQYENLVT

SEQ ID NO: 39638 - protein, 18 aa, Homo sapiens
  heavy chain complementarity determining region 3 for antibody 19819
AKGAEGACSVRKCYPFDY

SEQ ID NO: 39639 - protein, 8 aa, Homo sapiens
  light chain complementarity determining region 3 for antibody 19820
QQYENLAT

SEQ ID NO: 39640 - protein, 18 aa, Homo sapiens
  heavy chain complementarity determining region 3 for antibody 19820
AKGAEGSCSVRKCYPFDY

SEQ ID NO: 39641 - protein, 9 aa, Homo sapiens
  light chain complementarity determining region 3 for antibody 19821
QQYDVSNLT

SEQ ID NO: 39642 - protein, 22 aa, Homo sapiens
  heavy chain complementarity determining region 3 for antibody 19821
ARGSRPYGIYAYPLIPYSFFDD

SEQ ID NO: 39643 - protein, 11 aa, Homo sapiens
  light chain complementarity determining region 3 for antibody 19822
QQYDTSPPGTT

SEQ ID NO: 39644 - protein, 14 aa, Homo sapiens
  heavy chain complementarity determining region 3 for antibody 19822
ARETSNSRKRSFDQ

SEQ ID NO: 39645 - protein, 11 aa, Homo sapiens
  light chain complementarity determining region 3 for antibody 19823
QQYDTSPPGAP

SEQ ID NO: 39646 - protein, 14 aa, Homo sapiens
  heavy chain complementarity determining region 3 for antibody 19823
ARETSNSRKRSFDQ

SEQ ID NO: 39647 - protein, 11 aa, Homo sapiens
  light chain complementarity determining region 3 for antibody 19824
QQYDTPPPGYT

SEQ ID NO: 39648 - protein, 14 aa, Homo sapiens
  heavy chain complementarity determining region 3 for antibody 19824
ARETSNSRKRSFDQ

SEQ ID NO: 39649 - protein, 9 aa, Homo sapiens
  light chain complementarity determining region 3 for antibody 19825
QQYDSSPYP

SEQ ID NO: 39650 - protein, 19 aa, Homo sapiens
  heavy chain complementarity determining region 3 for antibody 19825
ARHYGIVSAAPKALNWFDP

SEQ ID NO: 39651 - protein, 9 aa, Homo sapiens
  light chain complementarity determining region 3 for antibody 19826
QQYDSSPQT

SEQ ID NO: 39652 - protein, 14 aa, Homo sapiens
  heavy chain complementarity determining region 3 for antibody 19826
ARDNPHRSERYFDL

SEQ ID NO: 39653 - protein, 9 aa, Homo sapiens
  light chain complementarity determining region 3 for antibody 19827
QQYDSSPQT

SEQ ID NO: 39654 - protein, 14 aa, Homo sapiens
  heavy chain complementarity determining region 3 for antibody 19827
ARDKPHRLERYFDL

SEQ ID NO: 39655 - protein, 10 aa, Homo sapiens
  light chain complementarity determining region 3 for antibody 19828
QQYDSLRLHT

SEQ ID NO: 39656 - protein, 28 aa, Homo sapiens
  heavy chain complementarity determining region 3 for antibody 19828
ARRSLTTKYYDYVWGNYRSLDPTDAFDV

SEQ ID NO: 39657 - protein, 9 aa, Homo sapiens
  light chain complementarity determining region 3 for antibody 19829
QQYDSLPLT

SEQ ID NO: 39658 - protein, 20 aa, Homo sapiens
  heavy chain complementarity determining region 3 for antibody 19829
VSGLHIVVATSFPGNYGVDV

SEQ ID NO: 39659 - protein, 9 aa, Homo sapiens
  light chain complementarity determining region 3 for antibody 19830
QQYDSLPLP

SEQ ID NO: 39660 - protein, 20 aa, Homo sapiens
  heavy chain complementarity determining region 3 for antibody 19830
VRGLHIVVATSFPGNYGVDV

SEQ ID NO: 39661 - protein, 9 aa, Homo sapiens
  light chain complementarity determining region 3 for antibody 19831
QQYDRSPQT

SEQ ID NO: 39662 - protein, 14 aa, Homo sapiens
  heavy chain complementarity determining region 3 for antibody 19831
ARDNPHRLERYFDL

SEQ ID NO: 39663 - protein, 11 aa, Homo sapiens
  light chain complementarity determining region 3 for antibody 19832
QQYDPLSWTGT

SEQ ID NO: 39664 - protein, 11 aa, Homo sapiens
  heavy chain complementarity determining region 3 for antibody 19832
ARGWLDNSFDF

SEQ ID NO: 39665 - protein, 9 aa, Homo sapiens
  light chain complementarity determining region 3 for antibody 19833
QQYDNWPWT

SEQ ID NO: 39666 - protein, 13 aa, Homo sapiens
  heavy chain complementarity determining region 3 for antibody 19833
ASGGVFYHNFFDP

SEQ ID NO: 39667 - protein, 10 aa, Homo sapiens
  light chain complementarity determining region 3 for antibody 19834
QQYDNWPPWT

SEQ ID NO: 39668 - protein, 12 aa, Homo sapiens
  heavy chain complementarity determining region 3 for antibody 19834
AKTLRERKDLDY

SEQ ID NO: 39669 - protein, 10 aa, Homo sapiens
  light chain complementarity determining region 3 for antibody 19835
QQYDNWPPWT

SEQ ID NO: 39670 - protein, 12 aa, Homo sapiens
  heavy chain complementarity determining region 3 for antibody 19835
AETLRERKELDY

SEQ ID NO: 39671 - protein, 10 aa, Homo sapiens
  light chain complementarity determining region 3 for antibody 19836
QQYDNWPPRT

SEQ ID NO: 39672 - protein, 12 aa, Homo sapiens
  heavy chain complementarity determining region 3 for antibody 19836
AKTLRERKELDY

SEQ ID NO: 39673 - protein, 10 aa, Homo sapiens
  light chain complementarity determining region 3 for antibody 19837
QQYDNWPPLT

SEQ ID NO: 39674 - protein, 15 aa, Homo sapiens
  heavy chain complementarity determining region 3 for antibody 19837
AKEPDCGRNCLFFDS

SEQ ID NO: 39675 - protein, 10 aa, Homo sapiens
  light chain complementarity determining region 3 for antibody 19838
QQYDNWLPWT

SEQ ID NO: 39676 - protein, 12 aa, Homo sapiens
  heavy chain complementarity determining region 3 for antibody 19838
AKTLRERKELDY

SEQ ID NO: 39677 - protein, 8 aa, Homo sapiens
  light chain complementarity determining region 3 for antibody 19839
QQYDNLPV

SEQ ID NO: 39678 - protein, 15 aa, Homo sapiens
  heavy chain complementarity determining region 3 for antibody 19839
ARQITSAWNEHAFDH

SEQ ID NO: 39679 - protein, 9 aa, Homo sapiens
  light chain complementarity determining region 3 for antibody 19840
QQYDNLPRT

SEQ ID NO: 39680 - protein, 13 aa, Homo sapiens
  heavy chain complementarity determining region 3 for antibody 19840
AGGEFHRGGYSEF

SEQ ID NO: 39681 - protein, 10 aa, Homo sapiens
  light chain complementarity determining region 3 for antibody 19841
QQYDDWPPGT

SEQ ID NO: 39682 - protein, 16 aa, Homo sapiens
  heavy chain complementarity determining region 3 for antibody 19841
GGSRTSSQQLVAPIHY

SEQ ID NO: 39683 - protein, 9 aa, Homo sapiens
  light chain complementarity determining region 3 for antibody 19842
QQYCSIPGT

SEQ ID NO: 39684 - protein, 14 aa, Homo sapiens
  heavy chain complementarity determining region 3 for antibody 19842
AKCASNYGNDAFDI

SEQ ID NO: 39685 - protein, 9 aa, Homo sapiens
  light chain complementarity determining region 3 for antibody 19843
QQYATSPRT

SEQ ID NO: 39686 - protein, 15 aa, Homo sapiens
  heavy chain complementarity determining region 3 for antibody 19843
ARDGSVLATGYPLDY

SEQ ID NO: 39687 - protein, 10 aa, Homo sapiens
  light chain complementarity determining region 3 for antibody 19844
QQYATSPPWT

SEQ ID NO: 39688 - protein, 16 aa, Homo sapiens
  heavy chain complementarity determining region 3 for antibody 19844
ARVQWVRGLTKEGFDF

SEQ ID NO: 39689 - protein, 10 aa, Homo sapiens
  light chain complementarity determining region 3 for antibody 19845
QQYATSPPWT

SEQ ID NO: 39690 - protein, 16 aa, Homo sapiens
  heavy chain complementarity determining region 3 for antibody 19845
ARVQWVRGLAKEGLDF

SEQ ID NO: 39691 - protein, 9 aa, Homo sapiens
  light chain complementarity determining region 3 for antibody 19846
QQYATSPPT

SEQ ID NO: 39692 - protein, 10 aa, Homo sapiens
  heavy chain complementarity determining region 3 for antibody 19846
VAGAGWLPDY

SEQ ID NO: 39693 - protein, 10 aa, Homo sapiens
  light chain complementarity determining region 3 for antibody 19847
QQYATSPPGT

SEQ ID NO: 39694 - protein, 16 aa, Homo sapiens
  heavy chain complementarity determining region 3 for antibody 19847
ARVQWVRGLTKEGLDF

SEQ ID NO: 39695 - protein, 10 aa, Homo sapiens
  light chain complementarity determining region 3 for antibody 19848
QQYATPPPWT

SEQ ID NO: 39696 - protein, 16 aa, Homo sapiens
  heavy chain complementarity determining region 3 for antibody 19848
ARVQWVRGLTKEGLDF

SEQ ID NO: 39697 - protein, 8 aa, Homo sapiens
  light chain complementarity determining region 3 for antibody 19849
QQYANLVT

SEQ ID NO: 39698 - protein, 18 aa, Homo sapiens
  heavy chain complementarity determining region 3 for antibody 19849
AKGAEGSCSVRKCYPFDY

SEQ ID NO: 39699 - protein, 9 aa, Homo sapiens
  light chain complementarity determining region 3 for antibody 19850
QQYAGSPWT

SEQ ID NO: 39700 - protein, 12 aa, Homo sapiens
  heavy chain complementarity determining region 3 for antibody 19850
VRSHSNTGRVDY

SEQ ID NO: 39701 - protein, 9 aa, Homo sapiens
  light chain complementarity determining region 3 for antibody 19851
QQYAGSPWP

SEQ ID NO: 39702 - protein, 12 aa, Homo sapiens
  heavy chain complementarity determining region 3 for antibody 19851
VRSHYNTGRVDY

SEQ ID NO: 39703 - protein, 9 aa, Homo sapiens
  light chain complementarity determining region 3 for antibody 19852
QQYAGPPWT

SEQ ID NO: 39704 - protein, 12 aa, Homo sapiens
  heavy chain complementarity determining region 3 for antibody 19852
VRSHYNTGRVDY

SEQ ID NO: 39705 - protein, 10 aa, Homo sapiens
  light chain complementarity determining region 3 for antibody 19853
QQYAASPPWT

SEQ ID NO: 39706 - protein, 16 aa, Homo sapiens
  heavy chain complementarity determining region 3 for antibody 19853
ARVQWVRGLTKEGLDF

SEQ ID NO: 39707 - protein, 9 aa, Homo sapiens
  light chain complementarity determining region 3 for antibody 19854
QQVHIYPPP

SEQ ID NO: 39708 - protein, 12 aa, Homo sapiens
  heavy chain complementarity determining region 3 for antibody 19854
ARDTDGSFGLDV

SEQ ID NO: 39709 - protein, 9 aa, Homo sapiens
  light chain complementarity determining region 3 for antibody 19855
QQTYTSPPT

SEQ ID NO: 39710 - protein, 13 aa, Homo sapiens
  heavy chain complementarity determining region 3 for antibody 19855
ARRYYDSSDCFDI

SEQ ID NO: 39711 - protein, 9 aa, Homo sapiens
  light chain complementarity determining region 3 for antibody 19856
QQTYTSPPT

SEQ ID NO: 39712 - protein, 13 aa, Homo sapiens
  heavy chain complementarity determining region 3 for antibody 19856
ARRCYDSSDYFDI

SEQ ID NO: 39713 - protein, 9 aa, Homo sapiens
  light chain complementarity determining region 3 for antibody 19857
QQTYSLPYT

SEQ ID NO: 39714 - protein, 19 aa, Homo sapiens
  heavy chain complementarity determining region 3 for antibody 19857
VAPADWRGNSYGWAGSFAS

SEQ ID NO: 39715 - protein, 9 aa, Homo sapiens
  light chain complementarity determining region 3 for antibody 19858
QQTYIPPRT

SEQ ID NO: 39716 - protein, 21 aa, Homo sapiens
  heavy chain complementarity determining region 3 for antibody 19858
ARVTVRVPSTTGFGQYYGVDV

SEQ ID NO: 39717 - protein, 9 aa, Homo sapiens
  light chain complementarity determining region 3 for antibody 19859
QQTYGSSYT

SEQ ID NO: 39718 - protein, 19 aa, Homo sapiens
  heavy chain complementarity determining region 3 for antibody 19859
ARDGPGGYGSASYGDDFDY

SEQ ID NO: 39719 - protein, 9 aa, Homo sapiens
  light chain complementarity determining region 3 for antibody 19860
QQTNSNPPT

SEQ ID NO: 39720 - protein, 14 aa, Homo sapiens
  heavy chain complementarity determining region 3 for antibody 19860
ARGGLGSWGNSSDI

SEQ ID NO: 39721 - protein, 9 aa, Homo sapiens
  light chain complementarity determining region 3 for antibody 19861
QQTNSNPPP

SEQ ID NO: 39722 - protein, 14 aa, Homo sapiens
  heavy chain complementarity determining region 3 for antibody 19861
ARGGLGIWGNSSDI

SEQ ID NO: 39723 - protein, 9 aa, Homo sapiens
  light chain complementarity determining region 3 for antibody 19862
QQTNSFPLS

SEQ ID NO: 39724 - protein, 11 aa, Homo sapiens
  heavy chain complementarity determining region 3 for antibody 19862
VHSPAMAEIDY

SEQ ID NO: 39725 - protein, 9 aa, Homo sapiens
  light chain complementarity determining region 3 for antibody 19863
QQSYTTPPP

SEQ ID NO: 39726 - protein, 11 aa, Homo sapiens
  heavy chain complementarity determining region 3 for antibody 19863
ARGGNWQYFDY

SEQ ID NO: 39727 - protein, 9 aa, Homo sapiens
  light chain complementarity determining region 3 for antibody 19864
QQSYTSPIN

SEQ ID NO: 39728 - protein, 16 aa, Homo sapiens
  heavy chain complementarity determining region 3 for antibody 19864
ARESGGGSPRHNYFDP

SEQ ID NO: 39729 - protein, 9 aa, Homo sapiens
  light chain complementarity determining region 3 for antibody 19865
QQSYSVPLT

SEQ ID NO: 39730 - protein, 16 aa, Homo sapiens
  heavy chain complementarity determining region 3 for antibody 19865
ARVYATVTSQALGVDY

SEQ ID NO: 39731 - protein, 9 aa, Homo sapiens
  light chain complementarity determining region 3 for antibody 19866
QQSYSTQWT

SEQ ID NO: 39732 - protein, 23 aa, Homo sapiens
  heavy chain complementarity determining region 3 for antibody 19866
ARLSRDPVAIRAAPLDYYCAMDV

SEQ ID NO: 39733 - protein, 9 aa, Homo sapiens
  light chain complementarity determining region 3 for antibody 19867
QQSYSTPYT

SEQ ID NO: 39734 - protein, 20 aa, Homo sapiens
  heavy chain complementarity determining region 3 for antibody 19867
AKPRSSHRTTVVIRDEAFDI

SEQ ID NO: 39735 - protein, 9 aa, Homo sapiens
  light chain complementarity determining region 3 for antibody 19868
QQSYSTPWT

SEQ ID NO: 39736 - protein, 13 aa, Homo sapiens
  heavy chain complementarity determining region 3 for antibody 19868
VNVSQWLDDASDF

SEQ ID NO: 39737 - protein, 9 aa, Homo sapiens
  light chain complementarity determining region 3 for antibody 19869
QQSYSTPWT

SEQ ID NO: 39738 - protein, 15 aa, Homo sapiens
  heavy chain complementarity determining region 3 for antibody 19869
GSRYSSGWYYYGMDV

SEQ ID NO: 39739 - protein, 9 aa, Homo sapiens
  light chain complementarity determining region 3 for antibody 19870
QQSYSTPPT

SEQ ID NO: 39740 - protein, 16 aa, Homo sapiens
  heavy chain complementarity determining region 3 for antibody 19870
SKDILRQWLKLRTFDD

SEQ ID NO: 39741 - protein, 9 aa, Homo sapiens
  light chain complementarity determining region 3 for antibody 19871
QQSYSTPGT

SEQ ID NO: 39742 - protein, 13 aa, Homo sapiens
  heavy chain complementarity determining region 3 for antibody 19871
VNVSQWLDDAFDF

SEQ ID NO: 39743 - protein, 9 aa, Homo sapiens
  light chain complementarity determining region 3 for antibody 19872
QQSYSSLLT

SEQ ID NO: 39744 - protein, 16 aa, Homo sapiens
  heavy chain complementarity determining region 3 for antibody 19872
AREGGSTYTAKRAFDS

SEQ ID NO: 39745 - protein, 9 aa, Homo sapiens
  light chain complementarity determining region 3 for antibody 19873
QQSYSSLLP

SEQ ID NO: 39746 - protein, 16 aa, Homo sapiens
  heavy chain complementarity determining region 3 for antibody 19873
AREGGSTYTSKRAFDS

SEQ ID NO: 39747 - protein, 9 aa, Homo sapiens
  light chain complementarity determining region 3 for antibody 19874
QQSYSIPIT

SEQ ID NO: 39748 - protein, 14 aa, Homo sapiens
  heavy chain complementarity determining region 3 for antibody 19874
ARDRRNYCYYGMDV

SEQ ID NO: 39749 - protein, 9 aa, Homo sapiens
  light chain complementarity determining region 3 for antibody 19875
QQSYITPYS

SEQ ID NO: 39750 - protein, 18 aa, Homo sapiens
  heavy chain complementarity determining region 3 for antibody 19875
ATGDATVTTGLEFDAFDI

SEQ ID NO: 39751 - protein, 9 aa, Homo sapiens
  light chain complementarity determining region 3 for antibody 19876
QQSYITPRT

SEQ ID NO: 39752 - protein, 10 aa, Homo sapiens
  heavy chain complementarity determining region 3 for antibody 19876
ARAPTHAFDI

SEQ ID NO: 39753 - protein, 9 aa, Homo sapiens
  light chain complementarity determining region 3 for antibody 19877
QQSYIAPYP

SEQ ID NO: 39754 - protein, 17 aa, Homo sapiens
  heavy chain complementarity determining region 3 for antibody 19877
ARLTLRKSLEHIGGLDP

SEQ ID NO: 39755 - protein, 9 aa, Homo sapiens
  light chain complementarity determining region 3 for antibody 19878
QQSYGWPQT

SEQ ID NO: 39756 - protein, 19 aa, Homo sapiens
  heavy chain complementarity determining region 3 for antibody 19878
ARVGLEIPPAIRRGEWFDP

SEQ ID NO: 39757 - protein, 9 aa, Homo sapiens
  light chain complementarity determining region 3 for antibody 19879
QQSYGLPQT

SEQ ID NO: 39758 - protein, 19 aa, Homo sapiens
  heavy chain complementarity determining region 3 for antibody 19879
ARVGLEMPPAIRRGEWFDP

SEQ ID NO: 39759 - protein, 9 aa, Homo sapiens
  light chain complementarity determining region 3 for antibody 19880
QQSYGLPQP

SEQ ID NO: 39760 - protein, 19 aa, Homo sapiens
  heavy chain complementarity determining region 3 for antibody 19880
ARVGLEIPPAIRRGEWFDP

SEQ ID NO: 39761 - protein, 9 aa, Homo sapiens
  light chain complementarity determining region 3 for antibody 19881
QQSYGFPQT

SEQ ID NO: 39762 - protein, 19 aa, Homo sapiens
  heavy chain complementarity determining region 3 for antibody 19881
ARVGLEIPPAIRRGEWFDP

SEQ ID NO: 39763 - protein, 10 aa, Homo sapiens
  light chain complementarity determining region 3 for antibody 19882
QQSYFTPPLP

SEQ ID NO: 39764 - protein, 20 aa, Homo sapiens
  heavy chain complementarity determining region 3 for antibody 19882
ARNTGTSSWSPLSYYYGMDV

SEQ ID NO: 39765 - protein, 9 aa, Homo sapiens
  light chain complementarity determining region 3 for antibody 19883
QQSYDTPWT

SEQ ID NO: 39766 - protein, 20 aa, Homo sapiens
  heavy chain complementarity determining region 3 for antibody 19883
ASLSHVFFDSTGTGYYAMDV

SEQ ID NO: 39767 - protein, 9 aa, Homo sapiens
  light chain complementarity determining region 3 for antibody 19884
QQSYDTPWT

SEQ ID NO: 39768 - protein, 20 aa, Homo sapiens
  heavy chain complementarity determining region 3 for antibody 19884
ARLSHVFFDSTGTGYYALDV

SEQ ID NO: 39769 - protein, 9 aa, Homo sapiens
  light chain complementarity determining region 3 for antibody 19885
QQSVGPPST

SEQ ID NO: 39770 - protein, 11 aa, Homo sapiens
  heavy chain complementarity determining region 3 for antibody 19885
ARFFVVGANAA

SEQ ID NO: 39771 - protein, 9 aa, Homo sapiens
  light chain complementarity determining region 3 for antibody 19886
QQSVGPPIP

SEQ ID NO: 39772 - protein, 11 aa, Homo sapiens
  heavy chain complementarity determining region 3 for antibody 19886
ARFFVVGANAA

SEQ ID NO: 39773 - protein, 9 aa, Homo sapiens
  light chain complementarity determining region 3 for antibody 19887
QQSSSWPYT

SEQ ID NO: 39774 - protein, 11 aa, Homo sapiens
  heavy chain complementarity determining region 3 for antibody 19887
VKRWGGSSIDY

SEQ ID NO: 39775 - protein, 9 aa, Homo sapiens
  light chain complementarity determining region 3 for antibody 19888
QQSNSYLYT

SEQ ID NO: 39776 - protein, 16 aa, Homo sapiens
  heavy chain complementarity determining region 3 for antibody 19888
AREGDSRGWYGGSMDV

SEQ ID NO: 39777 - protein, 9 aa, Homo sapiens
  light chain complementarity determining region 3 for antibody 19889
QQSNRVPRT

SEQ ID NO: 39778 - protein, 15 aa, Homo sapiens
  heavy chain complementarity determining region 3 for antibody 19889
ASMPYNSYRNPPFDN

SEQ ID NO: 39779 - protein, 10 aa, Homo sapiens
  light chain complementarity determining region 3 for antibody 19890
QQSNNWPPWT

SEQ ID NO: 39780 - protein, 11 aa, Homo sapiens
  heavy chain complementarity determining region 3 for antibody 19890
AASGSRYKFDY

SEQ ID NO: 39781 - protein, 10 aa, Homo sapiens
  light chain complementarity determining region 3 for antibody 19891
QQSNNWPPWT

SEQ ID NO: 39782 - protein, 11 aa, Homo sapiens
  heavy chain complementarity determining region 3 for antibody 19891
AASGSHYKVDY

SEQ ID NO: 39783 - protein, 10 aa, Homo sapiens
  light chain complementarity determining region 3 for antibody 19892
QQSNNWPPRT

SEQ ID NO: 39784 - protein, 11 aa, Homo sapiens
  heavy chain complementarity determining region 3 for antibody 19892
AASGSHYKFDY

SEQ ID NO: 39785 - protein, 9 aa, Homo sapiens
  light chain complementarity determining region 3 for antibody 19893
QQSNFYPRT

SEQ ID NO: 39786 - protein, 9 aa, Homo sapiens
  heavy chain complementarity determining region 3 for antibody 19893
ARGAKEFEY

SEQ ID NO: 39787 - protein, 9 aa, Homo sapiens
  light chain complementarity determining region 3 for antibody 19894
QQSNFWPLT

SEQ ID NO: 39788 - protein, 13 aa, Homo sapiens
  heavy chain complementarity determining region 3 for antibody 19894
ARHGGTCYRYFDY

SEQ ID NO: 39789 - protein, 9 aa, Homo sapiens
  light chain complementarity determining region 3 for antibody 19895
QQSHTTPYT

SEQ ID NO: 39790 - protein, 14 aa, Homo sapiens
  heavy chain complementarity determining region 3 for antibody 19895
VRLVKVVINGEDDY

SEQ ID NO: 39791 - protein, 9 aa, Homo sapiens
  light chain complementarity determining region 3 for antibody 19896
QQSHTTPYT

SEQ ID NO: 39792 - protein, 14 aa, Homo sapiens
  heavy chain complementarity determining region 3 for antibody 19896
ARLVKIVINGEVDY

SEQ ID NO: 39793 - protein, 8 aa, Homo sapiens
  light chain complementarity determining region 3 for antibody 19897
QQSHTTLS

SEQ ID NO: 39794 - protein, 12 aa, Homo sapiens
  heavy chain complementarity determining region 3 for antibody 19897
ARRGGFGRTFDF

SEQ ID NO: 39795 - protein, 9 aa, Homo sapiens
  light chain complementarity determining region 3 for antibody 19898
QQSHSVPLT

SEQ ID NO: 39796 - protein, 16 aa, Homo sapiens
  heavy chain complementarity determining region 3 for antibody 19898
ARVYAPVTSQALGVDY

SEQ ID NO: 39797 - protein, 10 aa, Homo sapiens
  light chain complementarity determining region 3 for antibody 19899
QQSHHWPPWT

SEQ ID NO: 39798 - protein, 18 aa, Homo sapiens
  heavy chain complementarity determining region 3 for antibody 19899
ARGVPPCWAPGGVGPFDF

SEQ ID NO: 39799 - protein, 9 aa, Homo sapiens
  light chain complementarity determining region 3 for antibody 19900
QQSGTLPQT

SEQ ID NO: 39800 - protein, 18 aa, Homo sapiens
  heavy chain complementarity determining region 3 for antibody 19900
ARDYYGSGREIWVGAFDI

SEQ ID NO: 39801 - protein, 10 aa, Homo sapiens
  light chain complementarity determining region 3 for antibody 19901
QQSFSSSPIT

SEQ ID NO: 39802 - protein, 16 aa, Homo sapiens
  heavy chain complementarity determining region 3 for antibody 19901
ARQGPGTTVVTPHFDH

SEQ ID NO: 39803 - protein, 10 aa, Homo sapiens
  light chain complementarity determining region 3 for antibody 19902
QQSFSSSPFT

SEQ ID NO: 39804 - protein, 16 aa, Homo sapiens
  heavy chain complementarity determining region 3 for antibody 19902
ARQGPWTTVVTPHFDH

SEQ ID NO: 39805 - protein, 8 aa, Homo sapiens
  light chain complementarity determining region 3 for antibody 19903
QQSFRPAT

SEQ ID NO: 39806 - protein, 18 aa, Homo sapiens
  heavy chain complementarity determining region 3 for antibody 19903
ARGSGITIFGGVIRCFDY

SEQ ID NO: 39807 - protein, 8 aa, Homo sapiens
  light chain complementarity determining region 3 for antibody 19904
QQSFRPAP

SEQ ID NO: 39808 - protein, 18 aa, Homo sapiens
  heavy chain complementarity determining region 3 for antibody 19904
ARGSGITIFGGVIRYFDY

SEQ ID NO: 39809 - protein, 9 aa, Homo sapiens
  light chain complementarity determining region 3 for antibody 19905
QQSDRQPFT

SEQ ID NO: 39810 - protein, 14 aa, Homo sapiens
  heavy chain complementarity determining region 3 for antibody 19905
ARDNSNNWYEGMDV

SEQ ID NO: 39811 - protein, 9 aa, Homo sapiens
  light chain complementarity determining region 3 for antibody 19906
QQSDRKPFP

SEQ ID NO: 39812 - protein, 14 aa, Homo sapiens
  heavy chain complementarity determining region 3 for antibody 19906
ARDNSNNWYEGMDV

SEQ ID NO: 39813 - protein, 9 aa, Homo sapiens
  light chain complementarity determining region 3 for antibody 19907
QQSDGKPFT

SEQ ID NO: 39814 - protein, 14 aa, Homo sapiens
  heavy chain complementarity determining region 3 for antibody 19907
ARDNSNNWYEGMDV

SEQ ID NO: 39815 - protein, 10 aa, Homo sapiens
  light chain complementarity determining region 3 for antibody 19908
QQRYSWPPRT

SEQ ID NO: 39816 - protein, 14 aa, Homo sapiens
  heavy chain complementarity determining region 3 for antibody 19908
AKGANLHHPYYFDY

SEQ ID NO: 39817 - protein, 10 aa, Homo sapiens
  light chain complementarity determining region 3 for antibody 19909
QQRYSWPPLT

SEQ ID NO: 39818 - protein, 14 aa, Homo sapiens
  heavy chain complementarity determining region 3 for antibody 19909
AKGANLHHPYSFDY

SEQ ID NO: 39819 - protein, 9 aa, Homo sapiens
  light chain complementarity determining region 3 for antibody 19910
QQRYSTRRT

SEQ ID NO: 39820 - protein, 12 aa, Homo sapiens
  heavy chain complementarity determining region 3 for antibody 19910
ARPREDGDAFDI

SEQ ID NO: 39821 - protein, 9 aa, Homo sapiens
  light chain complementarity determining region 3 for antibody 19911
QQRYSTPPT

SEQ ID NO: 39822 - protein, 16 aa, Homo sapiens
  heavy chain complementarity determining region 3 for antibody 19911
SKDILRQWLKLRTFED

SEQ ID NO: 39823 - protein, 9 aa, Homo sapiens
  light chain complementarity determining region 3 for antibody 19912
QQRYSSLLT

SEQ ID NO: 39824 - protein, 16 aa, Homo sapiens
  heavy chain complementarity determining region 3 for antibody 19912
AREGGSTYTTKRAFDS

SEQ ID NO: 39825 - protein, 10 aa, Homo sapiens
  light chain complementarity determining region 3 for antibody 19913
QQRYNWPPRT

SEQ ID NO: 39826 - protein, 20 aa, Homo sapiens
  heavy chain complementarity determining region 3 for antibody 19913
ARHRQVTVADSFEVFWYFDL

SEQ ID NO: 39827 - protein, 10 aa, Homo sapiens
  light chain complementarity determining region 3 for antibody 19914
QQRYNWPPIT

SEQ ID NO: 39828 - protein, 11 aa, Homo sapiens
  heavy chain complementarity determining region 3 for antibody 19914
ARGVGSYPFDS

SEQ ID NO: 39829 - protein, 10 aa, Homo sapiens
  light chain complementarity determining region 3 for antibody 19915
QQRYNWPPFT

SEQ ID NO: 39830 - protein, 11 aa, Homo sapiens
  heavy chain complementarity determining region 3 for antibody 19915
TRGVGSYPFDS

SEQ ID NO: 39831 - protein, 10 aa, Homo sapiens
  light chain complementarity determining region 3 for antibody 19916
QQRYNWPPFT

SEQ ID NO: 39832 - protein, 11 aa, Homo sapiens
  heavy chain complementarity determining region 3 for antibody 19916
ARGVGSYPVDS

SEQ ID NO: 39833 - protein, 10 aa, Homo sapiens
  light chain complementarity determining region 3 for antibody 19917
QQRYNWPPFT

SEQ ID NO: 39834 - protein, 11 aa, Homo sapiens
  heavy chain complementarity determining region 3 for antibody 19917
ARGVGSCPFDS

SEQ ID NO: 39835 - protein, 10 aa, Homo sapiens
  light chain complementarity determining region 3 for antibody 19918
QQRYNWHPYT

SEQ ID NO: 39836 - protein, 11 aa, Homo sapiens
  heavy chain complementarity determining region 3 for antibody 19918
ARGVGSYVFES

SEQ ID NO: 39837 - protein, 10 aa, Homo sapiens
  light chain complementarity determining region 3 for antibody 19919
QQRYNLPPFP

SEQ ID NO: 39838 - protein, 11 aa, Homo sapiens
  heavy chain complementarity determining region 3 for antibody 19919
ARGVGSYPFDS

SEQ ID NO: 39839 - protein, 10 aa, Homo sapiens
  light chain complementarity determining region 3 for antibody 19920
QQRYKWPPST

SEQ ID NO: 39840 - protein, 11 aa, Homo sapiens
  heavy chain complementarity determining region 3 for antibody 19920
ARGVGSYVFES

SEQ ID NO: 39841 - protein, 9 aa, Homo sapiens
  light chain complementarity determining region 3 for antibody 19921
QQRYGTPAT

SEQ ID NO: 39842 - protein, 16 aa, Homo sapiens
  heavy chain complementarity determining region 3 for antibody 19921
AKDVLDTAMINYWFDP

SEQ ID NO: 39843 - protein, 9 aa, Homo sapiens
  light chain complementarity determining region 3 for antibody 19922
QQRYDNART

SEQ ID NO: 39844 - protein, 13 aa, Homo sapiens
  heavy chain complementarity determining region 3 for antibody 19922
ARRDAYNYSGLDY

SEQ ID NO: 39845 - protein, 9 aa, Homo sapiens
  light chain complementarity determining region 3 for antibody 19923
QQRTNWRFT

SEQ ID NO: 39846 - protein, 16 aa, Homo sapiens
  heavy chain complementarity determining region 3 for antibody 19923
ARDQGYCLGTNCYFLH

SEQ ID NO: 39847 - protein, 11 aa, Homo sapiens
  light chain complementarity determining region 3 for antibody 19924
QQRTNWPPIYT

SEQ ID NO: 39848 - protein, 14 aa, Homo sapiens
  heavy chain complementarity determining region 3 for antibody 19924
ARGGRGIWGNSSDI

SEQ ID NO: 39849 - protein, 11 aa, Homo sapiens
  light chain complementarity determining region 3 for antibody 19925
QQRTNWPPIYT

SEQ ID NO: 39850 - protein, 12 aa, Homo sapiens
  heavy chain complementarity determining region 3 for antibody 19925
ARGGLGIWGNSF

SEQ ID NO: 39851 - protein, 9 aa, Homo sapiens
  light chain complementarity determining region 3 for antibody 19926
QQRSTWPYT

SEQ ID NO: 39852 - protein, 11 aa, Homo sapiens
  heavy chain complementarity determining region 3 for antibody 19926
VKRWGGSSIDY

SEQ ID NO: 39853 - protein, 10 aa, Homo sapiens
  light chain complementarity determining region 3 for antibody 19927
QQRSTWFPST

SEQ ID NO: 39854 - protein, 16 aa, Homo sapiens
  heavy chain complementarity determining region 3 for antibody 19927
ARGSSDYDNPGSWLDP

SEQ ID NO: 39855 - protein, 10 aa, Homo sapiens
  light chain complementarity determining region 3 for antibody 19928
QQRSTGPPLT

SEQ ID NO: 39856 - protein, 9 aa, Homo sapiens
  heavy chain complementarity determining region 3 for antibody 19928
ARVDGYFDY

SEQ ID NO: 39857 - protein, 9 aa, Homo sapiens
  light chain complementarity determining region 3 for antibody 19929
QQRSSWPYT

SEQ ID NO: 39858 - protein, 11 aa, Homo sapiens
  heavy chain complementarity determining region 3 for antibody 19929
VERWGGSSIDY

SEQ ID NO: 39859 - protein, 9 aa, Homo sapiens
  light chain complementarity determining region 3 for antibody 19930
QQRSSWPYT

SEQ ID NO: 39860 - protein, 11 aa, Homo sapiens
  heavy chain complementarity determining region 3 for antibody 19930
MKRWGGSSIDY

SEQ ID NO: 39861 - protein, 9 aa, Homo sapiens
  light chain complementarity determining region 3 for antibody 19931
QQRSSWPYT

SEQ ID NO: 39862 - protein, 11 aa, Homo sapiens
  heavy chain complementarity determining region 3 for antibody 19931
AKRWGGSSIDY

SEQ ID NO: 39863 - protein, 9 aa, Homo sapiens
  light chain complementarity determining region 3 for antibody 19932
QQRSSWPYN

SEQ ID NO: 39864 - protein, 11 aa, Homo sapiens
  heavy chain complementarity determining region 3 for antibody 19932
VKRWGGSSIDY

SEQ ID NO: 39865 - protein, 9 aa, Homo sapiens
  light chain complementarity determining region 3 for antibody 19933
QQRSSWPFT

SEQ ID NO: 39866 - protein, 11 aa, Homo sapiens
  heavy chain complementarity determining region 3 for antibody 19933
VKRWGGSSIDY

SEQ ID NO: 39867 - protein, 9 aa, Homo sapiens
  light chain complementarity determining region 3 for antibody 19934
QQRSSWPDT

SEQ ID NO: 39868 - protein, 11 aa, Homo sapiens
  heavy chain complementarity determining region 3 for antibody 19934
VKRWGGSSIDY

SEQ ID NO: 39869 - protein, 9 aa, Homo sapiens
  light chain complementarity determining region 3 for antibody 19935
QQRSSLPYT

SEQ ID NO: 39870 - protein, 11 aa, Homo sapiens
  heavy chain complementarity determining region 3 for antibody 19935
VKRWGGSSIDY

SEQ ID NO: 39871 - protein, 9 aa, Homo sapiens
  light chain complementarity determining region 3 for antibody 19936
QQRSRWPYT

SEQ ID NO: 39872 - protein, 11 aa, Homo sapiens
  heavy chain complementarity determining region 3 for antibody 19936
VKRWGGSSIDY

SEQ ID NO: 39873 - protein, 9 aa, Homo sapiens
  light chain complementarity determining region 3 for antibody 19937
QQRSNWPYT

SEQ ID NO: 39874 - protein, 11 aa, Homo sapiens
  heavy chain complementarity determining region 3 for antibody 19937
VKRWGGSSIDY

SEQ ID NO: 39875 - protein, 9 aa, Homo sapiens
  light chain complementarity determining region 3 for antibody 19938
QQRSNWPYT

SEQ ID NO: 39876 - protein, 13 aa, Homo sapiens
  heavy chain complementarity determining region 3 for antibody 19938
ARYSSKSPDRVDY

SEQ ID NO: 39877 - protein, 8 aa, Homo sapiens
  light chain complementarity determining region 3 for antibody 19939
QQRSNWPT

SEQ ID NO: 39878 - protein, 16 aa, Homo sapiens
  heavy chain complementarity determining region 3 for antibody 19939
AKDIVLMGSSGGSFDY

SEQ ID NO: 39879 - protein, 9 aa, Homo sapiens
  light chain complementarity determining region 3 for antibody 19940
QQRSNWPPT

SEQ ID NO: 39880 - protein, 9 aa, Homo sapiens
  heavy chain complementarity determining region 3 for antibody 19940
ANYGDWVDY

SEQ ID NO: 39881 - protein, 11 aa, Homo sapiens
  light chain complementarity determining region 3 for antibody 19941
QQRSNWPPRLP

SEQ ID NO: 39882 - protein, 17 aa, Homo sapiens
  heavy chain complementarity determining region 3 for antibody 19941
ARDGSLDPLYGSGSYGY

SEQ ID NO: 39883 - protein, 10 aa, Homo sapiens
  light chain complementarity determining region 3 for antibody 19942
QQRSNWPPLT

SEQ ID NO: 39884 - protein, 11 aa, Homo sapiens
  heavy chain complementarity determining region 3 for antibody 19942
ASQKSYDYFDF

SEQ ID NO: 39885 - protein, 11 aa, Homo sapiens
  light chain complementarity determining region 3 for antibody 19943
QQRSNWPPIFP

SEQ ID NO: 39886 - protein, 18 aa, Homo sapiens
  heavy chain complementarity determining region 3 for antibody 19943
ARIPPYDSSGYYYYVLDY

SEQ ID NO: 39887 - protein, 11 aa, Homo sapiens
  light chain complementarity determining region 3 for antibody 19944
QQRSNWPPGPT

SEQ ID NO: 39888 - protein, 15 aa, Homo sapiens
  heavy chain complementarity determining region 3 for antibody 19944
AREYYDSSGYYYADY

SEQ ID NO: 39889 - protein, 9 aa, Homo sapiens
  light chain complementarity determining region 3 for antibody 19945
QQRSNWPLT

SEQ ID NO: 39890 - protein, 14 aa, Homo sapiens
  heavy chain complementarity determining region 3 for antibody 19945
ARSLSSAWYDWSDP

SEQ ID NO: 39891 - protein, 9 aa, Homo sapiens
  light chain complementarity determining region 3 for antibody 19946
QQRSNWPLT

SEQ ID NO: 39892 - protein, 9 aa, Homo sapiens
  heavy chain complementarity determining region 3 for antibody 19946
ANDGDWVDY

SEQ ID NO: 39893 - protein, 9 aa, Homo sapiens
  light chain complementarity determining region 3 for antibody 19947
QQRSNWPLP

SEQ ID NO: 39894 - protein, 9 aa, Homo sapiens
  heavy chain complementarity determining region 3 for antibody 19947
ANYGDWVDY

SEQ ID NO: 39895 - protein, 9 aa, Homo sapiens
  light chain complementarity determining region 3 for antibody 19948
QQRSNWPFT

SEQ ID NO: 39896 - protein, 14 aa, Homo sapiens
  heavy chain complementarity determining region 3 for antibody 19948
AREADTGYGYYCDL

SEQ ID NO: 39897 - protein, 10 aa, Homo sapiens
  light chain complementarity determining region 3 for antibody 19949
QQRSNLPPIT

SEQ ID NO: 39898 - protein, 11 aa, Homo sapiens
  heavy chain complementarity determining region 3 for antibody 19949
ASQKSYDYFDF

SEQ ID NO: 39899 - protein, 9 aa, Homo sapiens
  light chain complementarity determining region 3 for antibody 19950
QQRSNCPPT

SEQ ID NO: 39900 - protein, 8 aa, Homo sapiens
  heavy chain complementarity determining region 3 for antibody 19950
ATLGNDSD

SEQ ID NO: 39901 - protein, 10 aa, Homo sapiens
  light chain complementarity determining region 3 for antibody 19951
QQRSKWPPPP

SEQ ID NO: 39902 - protein, 9 aa, Homo sapiens
  heavy chain complementarity determining region 3 for antibody 19951
ARVDGYFDY

SEQ ID NO: 39903 - protein, 10 aa, Homo sapiens
  light chain complementarity determining region 3 for antibody 19952
QQRSKWPPLT

SEQ ID NO: 39904 - protein, 9 aa, Homo sapiens
  heavy chain complementarity determining region 3 for antibody 19952
ARVDGYLDY

SEQ ID NO: 39905 - protein, 9 aa, Homo sapiens
  light chain complementarity determining region 3 for antibody 19953
QQRSIWPLT

SEQ ID NO: 39906 - protein, 18 aa, Homo sapiens
  heavy chain complementarity determining region 3 for antibody 19953
ARAFQSSAWFEQANWFDP

SEQ ID NO: 39907 - protein, 10 aa, Homo sapiens
  light chain complementarity determining region 3 for antibody 19954
QQRSDWPPPP

SEQ ID NO: 39908 - protein, 10 aa, Homo sapiens
  heavy chain complementarity determining region 3 for antibody 19954
ARDYTMTFDY

SEQ ID NO: 39909 - protein, 10 aa, Homo sapiens
  light chain complementarity determining region 3 for antibody 19955
QQRSDWPPLP

SEQ ID NO: 39910 - protein, 10 aa, Homo sapiens
  heavy chain complementarity determining region 3 for antibody 19955
ARDYTMPFDY

SEQ ID NO: 39911 - protein, 10 aa, Homo sapiens
  light chain complementarity determining region 3 for antibody 19956
QQRSDLPPLT

SEQ ID NO: 39912 - protein, 10 aa, Homo sapiens
  heavy chain complementarity determining region 3 for antibody 19956
ARDYTMTFDY

SEQ ID NO: 39913 - protein, 10 aa, Homo sapiens
  light chain complementarity determining region 3 for antibody 19957
QQRSAWPPLT

SEQ ID NO: 39914 - protein, 10 aa, Homo sapiens
  heavy chain complementarity determining region 3 for antibody 19957
ARDYTMTFDY

SEQ ID NO: 39915 - protein, 8 aa, Homo sapiens
  light chain complementarity determining region 3 for antibody 19958
QQRPTRLS

SEQ ID NO: 39916 - protein, 11 aa, Homo sapiens
  heavy chain complementarity determining region 3 for antibody 19958
ASGSMGWVFDH

SEQ ID NO: 39917 - protein, 8 aa, Homo sapiens
  light chain complementarity determining region 3 for antibody 19959
QQRNTRLS

SEQ ID NO: 39918 - protein, 11 aa, Homo sapiens
  heavy chain complementarity determining region 3 for antibody 19959
ASGSMGWVFDH

SEQ ID NO: 39919 - protein, 9 aa, Homo sapiens
  light chain complementarity determining region 3 for antibody 19960
QQRNKWPRT

SEQ ID NO: 39920 - protein, 13 aa, Homo sapiens
  heavy chain complementarity determining region 3 for antibody 19960
AKDLGSLRYAFDY

SEQ ID NO: 39921 - protein, 9 aa, Homo sapiens
  light chain complementarity determining region 3 for antibody 19961
QQRNKWPRN

SEQ ID NO: 39922 - protein, 13 aa, Homo sapiens
  heavy chain complementarity determining region 3 for antibody 19961
AKDLGSLRYDFDY

SEQ ID NO: 39923 - protein, 9 aa, Homo sapiens
  light chain complementarity determining region 3 for antibody 19962
QQRNDWPPT

SEQ ID NO: 39924 - protein, 17 aa, Homo sapiens
  heavy chain complementarity determining region 3 for antibody 19962
ARTALCESPAYYRFFDY

SEQ ID NO: 39925 - protein, 11 aa, Homo sapiens
  light chain complementarity determining region 3 for antibody 19963
QQRINWPPSFP

SEQ ID NO: 39926 - protein, 15 aa, Homo sapiens
  heavy chain complementarity determining region 3 for antibody 19963
ARDRSGSYSVHAFDI

SEQ ID NO: 39927 - protein, 10 aa, Homo sapiens
  light chain complementarity determining region 3 for antibody 19964
QQRIDWPPLT

SEQ ID NO: 39928 - protein, 10 aa, Homo sapiens
  heavy chain complementarity determining region 3 for antibody 19964
ARDYTMTFDY

SEQ ID NO: 39929 - protein, 8 aa, Homo sapiens
  light chain complementarity determining region 3 for antibody 19965
QQRHNRLS

SEQ ID NO: 39930 - protein, 11 aa, Homo sapiens
  heavy chain complementarity determining region 3 for antibody 19965
ASGSMGWVFDH

SEQ ID NO: 39931 - protein, 9 aa, Homo sapiens
  light chain complementarity determining region 3 for antibody 19966
QQRGTLPYT

SEQ ID NO: 39932 - protein, 16 aa, Homo sapiens
  heavy chain complementarity determining region 3 for antibody 19966
TTERHIAEFEEASFDI

SEQ ID NO: 39933 - protein, 10 aa, Homo sapiens
  light chain complementarity determining region 3 for antibody 19967
QQRGSWPPIT

SEQ ID NO: 39934 - protein, 13 aa, Homo sapiens
  heavy chain complementarity determining region 3 for antibody 19967
VRELHAGAYYYDY

SEQ ID NO: 39935 - protein, 11 aa, Homo sapiens
  light chain complementarity determining region 3 for antibody 19968
QQRGSWPPGLP

SEQ ID NO: 39936 - protein, 23 aa, Homo sapiens
  heavy chain complementarity determining region 3 for antibody 19968
AARNVSHDSSGYPLADYFYGMDV

SEQ ID NO: 39937 - protein, 9 aa, Homo sapiens
  light chain complementarity determining region 3 for antibody 19969
QQRGNWPFT

SEQ ID NO: 39938 - protein, 14 aa, Homo sapiens
  heavy chain complementarity determining region 3 for antibody 19969
ARSLSSAWYDWSDP

SEQ ID NO: 39939 - protein, 10 aa, Homo sapiens
  light chain complementarity determining region 3 for antibody 19970
QQRGIWPLIT

SEQ ID NO: 39940 - protein, 13 aa, Homo sapiens
  heavy chain complementarity determining region 3 for antibody 19970
VRELHAGAYYYDY

SEQ ID NO: 39941 - protein, 9 aa, Homo sapiens
  light chain complementarity determining region 3 for antibody 19971
QQRCNWPFT

SEQ ID NO: 39942 - protein, 14 aa, Homo sapiens
  heavy chain complementarity determining region 3 for antibody 19971
ARSLSSAWYDWSDP

SEQ ID NO: 39943 - protein, 9 aa, Homo sapiens
  light chain complementarity determining region 3 for antibody 19972
QQRANWPPL

SEQ ID NO: 39944 - protein, 16 aa, Homo sapiens
  heavy chain complementarity determining region 3 for antibody 19972
ARLLDPDGYNFWYFDY

SEQ ID NO: 39945 - protein, 8 aa, Homo sapiens
  light chain complementarity determining region 3 for antibody 19973
QQRAKSGT

SEQ ID NO: 39946 - protein, 11 aa, Homo sapiens
  heavy chain complementarity determining region 3 for antibody 19973
GRGTSTWTDDF

SEQ ID NO: 39947 - protein, 9 aa, Homo sapiens
  light chain complementarity determining region 3 for antibody 19974
QQPYVSSYT

SEQ ID NO: 39948 - protein, 19 aa, Homo sapiens
  heavy chain complementarity determining region 3 for antibody 19974
ARDGPGGYGSASYGDDFDY

SEQ ID NO: 39949 - protein, 9 aa, Homo sapiens
  light chain complementarity determining region 3 for antibody 19975
QQPYTSPPT

SEQ ID NO: 39950 - protein, 13 aa, Homo sapiens
  heavy chain complementarity determining region 3 for antibody 19975
ARRYYDSSDYFDI

SEQ ID NO: 39951 - protein, 10 aa, Homo sapiens
  light chain complementarity determining region 3 for antibody 19976
QQPNNWPPWT

SEQ ID NO: 39952 - protein, 11 aa, Homo sapiens
  heavy chain complementarity determining region 3 for antibody 19976
AASGSHYKFDY

SEQ ID NO: 39953 - protein, 9 aa, Homo sapiens
  light chain complementarity determining region 3 for antibody 19977
QQNVTTPLT

SEQ ID NO: 39954 - protein, 8 aa, Homo sapiens
  heavy chain complementarity determining region 3 for antibody 19977
VRMSDYIL

SEQ ID NO: 39955 - protein, 9 aa, Homo sapiens
  light chain complementarity determining region 3 for antibody 19978
QQNSTAPLT

SEQ ID NO: 39956 - protein, 16 aa, Homo sapiens
  heavy chain complementarity determining region 3 for antibody 19978
ARSKSRAIEVEATFDI

SEQ ID NO: 39957 - protein, 9 aa, Homo sapiens
  light chain complementarity determining region 3 for antibody 19979
QQNSSSLFA

SEQ ID NO: 39958 - protein, 15 aa, Homo sapiens
  heavy chain complementarity determining region 3 for antibody 19979
ARGGKSSSWLSYFDS

SEQ ID NO: 39959 - protein, 9 aa, Homo sapiens
  light chain complementarity determining region 3 for antibody 19980
QQNSNWPLT

SEQ ID NO: 39960 - protein, 14 aa, Homo sapiens
  heavy chain complementarity determining region 3 for antibody 19980
AKHRYDSSGYYFDY

SEQ ID NO: 39961 - protein, 9 aa, Homo sapiens
  light chain complementarity determining region 3 for antibody 19981
QQNSNTPRT

SEQ ID NO: 39962 - protein, 21 aa, Homo sapiens
  heavy chain complementarity determining region 3 for antibody 19981
ARTDEPLASMEYYYSYYAMDV

SEQ ID NO: 39963 - protein, 9 aa, Homo sapiens
  light chain complementarity determining region 3 for antibody 19982
QQNSNTPRT

SEQ ID NO: 39964 - protein, 21 aa, Homo sapiens
  heavy chain complementarity determining region 3 for antibody 19982
ARTDDPLTSMEYYYSYYAMDV

SEQ ID NO: 39965 - protein, 9 aa, Homo sapiens
  light chain complementarity determining region 3 for antibody 19983
QQNNTYSRT

SEQ ID NO: 39966 - protein, 15 aa, Homo sapiens
  heavy chain complementarity determining region 3 for antibody 19983
ARERNRGSFGSAFDV

SEQ ID NO: 39967 - protein, 9 aa, Homo sapiens
  light chain complementarity determining region 3 for antibody 19984
QQNNTWPRT

SEQ ID NO: 39968 - protein, 22 aa, Homo sapiens
  heavy chain complementarity determining region 3 for antibody 19984
AREVRASGYDDFYNYYYYGLDV

SEQ ID NO: 39969 - protein, 8 aa, Homo sapiens
  light chain complementarity determining region 3 for antibody 19985
QQNNRFWT

SEQ ID NO: 39970 - protein, 19 aa, Homo sapiens
  heavy chain complementarity determining region 3 for antibody 19985
ARGGRDTYHRSGYYSTCDF

SEQ ID NO: 39971 - protein, 9 aa, Homo sapiens
  light chain complementarity determining region 3 for antibody 19986
QQNGTSPRT

SEQ ID NO: 39972 - protein, 13 aa, Homo sapiens
  heavy chain complementarity determining region 3 for antibody 19986
AGGSGSGTYYKEH

SEQ ID NO: 39973 - protein, 9 aa, Homo sapiens
  light chain complementarity determining region 3 for antibody 19987
QQNGSSPRT

SEQ ID NO: 39974 - protein, 17 aa, Homo sapiens
  heavy chain complementarity determining region 3 for antibody 19987
TTDPQWLEPPPFLTNDY

SEQ ID NO: 39975 - protein, 9 aa, Homo sapiens
  light chain complementarity determining region 3 for antibody 19988
QQNGSSPLT

SEQ ID NO: 39976 - protein, 19 aa, Homo sapiens
  heavy chain complementarity determining region 3 for antibody 19988
ARGSSSSRRRAAVVGYFDL

SEQ ID NO: 39977 - protein, 9 aa, Homo sapiens
  light chain complementarity determining region 3 for antibody 19989
QQNGSSHYT

SEQ ID NO: 39978 - protein, 11 aa, Homo sapiens
  heavy chain complementarity determining region 3 for antibody 19989
AKGGLRWPLDY

SEQ ID NO: 39979 - protein, 9 aa, Homo sapiens
  light chain complementarity determining region 3 for antibody 19990
QQNGSPPRT

SEQ ID NO: 39980 - protein, 14 aa, Homo sapiens
  heavy chain complementarity determining region 3 for antibody 19990
AGGNFCGYDCYSEY

SEQ ID NO: 39981 - protein, 9 aa, Homo sapiens
  light chain complementarity determining region 3 for antibody 19991
QQNGSLPLT

SEQ ID NO: 39982 - protein, 15 aa, Homo sapiens
  heavy chain complementarity determining region 3 for antibody 19991
AHRPNYYDKAGAFDI

SEQ ID NO: 39983 - protein, 9 aa, Homo sapiens
  light chain complementarity determining region 3 for antibody 19992
QQNGSIPRT

SEQ ID NO: 39984 - protein, 13 aa, Homo sapiens
  heavy chain complementarity determining region 3 for antibody 19992
AGGSFSGGNYKED

SEQ ID NO: 39985 - protein, 9 aa, Homo sapiens
  light chain complementarity determining region 3 for antibody 19993
QQNGSIPRT

SEQ ID NO: 39986 - protein, 14 aa, Homo sapiens
  heavy chain complementarity determining region 3 for antibody 19993
AGGEFSSGWHYSEN

SEQ ID NO: 39987 - protein, 9 aa, Homo sapiens
  light chain complementarity determining region 3 for antibody 19994
QQNGRSPYT

SEQ ID NO: 39988 - protein, 18 aa, Homo sapiens
  heavy chain complementarity determining region 3 for antibody 19994
ARPMVRALDEYNYYGLDV

SEQ ID NO: 39989 - protein, 9 aa, Homo sapiens
  light chain complementarity determining region 3 for antibody 19995
QQNGRIPRT

SEQ ID NO: 39990 - protein, 13 aa, Homo sapiens
  heavy chain complementarity determining region 3 for antibody 19995
AGGLFGSGTYSEF

SEQ ID NO: 39991 - protein, 9 aa, Homo sapiens
  light chain complementarity determining region 3 for antibody 19996
QQNGRIPRS

SEQ ID NO: 39992 - protein, 13 aa, Homo sapiens
  heavy chain complementarity determining region 3 for antibody 19996
AGGTWHSSAYYES

SEQ ID NO: 39993 - protein, 9 aa, Homo sapiens
  light chain complementarity determining region 3 for antibody 19997
QQNGNSPRT

SEQ ID NO: 39994 - protein, 14 aa, Homo sapiens
  heavy chain complementarity determining region 3 for antibody 19997
ASDPVVGAPGYFDY

SEQ ID NO: 39995 - protein, 9 aa, Homo sapiens
  light chain complementarity determining region 3 for antibody 19998
QQNGNSPRT

SEQ ID NO: 39996 - protein, 15 aa, Homo sapiens
  heavy chain complementarity determining region 3 for antibody 19998
AGGWFNYYSSGYYET

SEQ ID NO: 39997 - protein, 9 aa, Homo sapiens
  light chain complementarity determining region 3 for antibody 19999
QQNGNLPRT

SEQ ID NO: 39998 - protein, 13 aa, Homo sapiens
  heavy chain complementarity determining region 3 for antibody 19999
AGGQFHSSGYSEF

SEQ ID NO: 39999 - protein, 8 aa, Homo sapiens
  light chain complementarity determining region 3 for antibody 20000
QQNENLVT

SEQ ID NO: 40000 - protein, 18 aa, Homo sapiens
  heavy chain complementarity determining region 3 for antibody 20000
AKGAEGSCSVRKCYPFDY

SEQ ID NO: 40001 - protein, 9 aa, Homo sapiens
  light chain complementarity determining region 3 for antibody 20001
QQNDTLPLT

SEQ ID NO: 40002 - protein, 10 aa, Homo sapiens
  heavy chain complementarity determining region 3 for antibody 20001
VHGQSMLVAY

SEQ ID NO: 40003 - protein, 10 aa, Homo sapiens
  light chain complementarity determining region 3 for antibody 20002
QQNDNLPPFT

SEQ ID NO: 40004 - protein, 21 aa, Homo sapiens
  heavy chain complementarity determining region 3 for antibody 20002
AKASGSIAVSTSRYYYYAMDV

SEQ ID NO: 40005 - protein, 10 aa, Homo sapiens
  light chain complementarity determining region 3 for antibody 20003
QQNDNFLAYT

SEQ ID NO: 40006 - protein, 20 aa, Homo sapiens
  heavy chain complementarity determining region 3 for antibody 20003
ARAFFPFPRGPDSFDDVFDL

SEQ ID NO: 40007 - protein, 10 aa, Homo sapiens
  light chain complementarity determining region 3 for antibody 20004
QQNDHFLAYT

SEQ ID NO: 40008 - protein, 20 aa, Homo sapiens
  heavy chain complementarity determining region 3 for antibody 20004
ARDFFPFPRGPDSFDDVFDL

SEQ ID NO: 40009 - protein, 10 aa, Homo sapiens
  light chain complementarity determining region 3 for antibody 20005
QQLYSYPLLT

SEQ ID NO: 40010 - protein, 19 aa, Homo sapiens
  heavy chain complementarity determining region 3 for antibody 20005
AHRRDSSGWYFPPQSAFDI

SEQ ID NO: 40011 - protein, 9 aa, Homo sapiens
  light chain complementarity determining region 3 for antibody 20006
QQLSNWPPT

SEQ ID NO: 40012 - protein, 8 aa, Homo sapiens
  heavy chain complementarity determining region 3 for antibody 20006
ATLGNDSD

SEQ ID NO: 40013 - protein, 10 aa, Homo sapiens
  light chain complementarity determining region 3 for antibody 20007
QQLSKWPPLT

SEQ ID NO: 40014 - protein, 9 aa, Homo sapiens
  heavy chain complementarity determining region 3 for antibody 20007
ARVDGYFDY

SEQ ID NO: 40015 - protein, 9 aa, Homo sapiens
  light chain complementarity determining region 3 for antibody 20008
QQLNTYPIT

SEQ ID NO: 40016 - protein, 13 aa, Homo sapiens
  heavy chain complementarity determining region 3 for antibody 20008
AKTLTMVTPYGDY

SEQ ID NO: 40017 - protein, 9 aa, Homo sapiens
  light chain complementarity determining region 3 for antibody 20009
QQLNSYPYT

SEQ ID NO: 40018 - protein, 12 aa, Homo sapiens
  heavy chain complementarity determining region 3 for antibody 20009
AIWAGAKGGLHY

SEQ ID NO: 40019 - protein, 9 aa, Homo sapiens
  light chain complementarity determining region 3 for antibody 20010
QQLNSYPRT

SEQ ID NO: 40020 - protein, 14 aa, Homo sapiens
  heavy chain complementarity determining region 3 for antibody 20010
ARVEGAPVPDAFDI

SEQ ID NO: 40021 - protein, 10 aa, Homo sapiens
  light chain complementarity determining region 3 for antibody 20011
QQLNSYPLLT

SEQ ID NO: 40022 - protein, 19 aa, Homo sapiens
  heavy chain complementarity determining region 3 for antibody 20011
ARRRDSSGWYFPPQSAFDI

SEQ ID NO: 40023 - protein, 10 aa, Homo sapiens
  light chain complementarity determining region 3 for antibody 20012
QQLNSYPLLT

SEQ ID NO: 40024 - protein, 19 aa, Homo sapiens
  heavy chain complementarity determining region 3 for antibody 20012
AHRRDSSGWYFHPQSAFDI

SEQ ID NO: 40025 - protein, 9 aa, Homo sapiens
  light chain complementarity determining region 3 for antibody 20013
QQLNSYPHT

SEQ ID NO: 40026 - protein, 12 aa, Homo sapiens
  heavy chain complementarity determining region 3 for antibody 20013
ARTSLSHDYGDY

SEQ ID NO: 40027 - protein, 9 aa, Homo sapiens
  light chain complementarity determining region 3 for antibody 20014
QQLNSYPHT

SEQ ID NO: 40028 - protein, 12 aa, Homo sapiens
  heavy chain complementarity determining region 3 for antibody 20014
ARASLSHDYGYY

SEQ ID NO: 40029 - protein, 9 aa, Homo sapiens
  light chain complementarity determining region 3 for antibody 20015
QQLGTLPYT

SEQ ID NO: 40030 - protein, 16 aa, Homo sapiens
  heavy chain complementarity determining region 3 for antibody 20015
TTERHIAEFEEASCDI

SEQ ID NO: 40031 - protein, 9 aa, Homo sapiens
  light chain complementarity determining region 3 for antibody 20016
QQLGTLPYT

SEQ ID NO: 40032 - protein, 16 aa, Homo sapiens
  heavy chain complementarity determining region 3 for antibody 20016
STERHIAEFEEASFDI

SEQ ID NO: 40033 - protein, 9 aa, Homo sapiens
  light chain complementarity determining region 3 for antibody 20017
QQHYRYPVT

SEQ ID NO: 40034 - protein, 15 aa, Homo sapiens
  heavy chain complementarity determining region 3 for antibody 20017
AHGQHTTTVTSYFNF

SEQ ID NO: 40035 - protein, 9 aa, Homo sapiens
  light chain complementarity determining region 3 for antibody 20018
QQHYGYPLT

SEQ ID NO: 40036 - protein, 18 aa, Homo sapiens
  heavy chain complementarity determining region 3 for antibody 20018
ARSRSGGSRDPQYNGLDV

SEQ ID NO: 40037 - protein, 10 aa, Homo sapiens
  light chain complementarity determining region 3 for antibody 20019
QQHVSSPPRT

SEQ ID NO: 40038 - protein, 14 aa, Homo sapiens
  heavy chain complementarity determining region 3 for antibody 20019
ARSPRTTMPPPWDY

SEQ ID NO: 40039 - protein, 10 aa, Homo sapiens
  light chain complementarity determining region 3 for antibody 20020
QQHVSLPPWT

SEQ ID NO: 40040 - protein, 14 aa, Homo sapiens
  heavy chain complementarity determining region 3 for antibody 20020
ARSPRTTMPPPWDY

SEQ ID NO: 40041 - protein, 9 aa, Homo sapiens
  light chain complementarity determining region 3 for antibody 20021
QQHSTWPLT

SEQ ID NO: 40042 - protein, 14 aa, Homo sapiens
  heavy chain complementarity determining region 3 for antibody 20021
AKHRYDSSGYYFDY

SEQ ID NO: 40043 - protein, 9 aa, Homo sapiens
  light chain complementarity determining region 3 for antibody 20022
QQHNSYLYT

SEQ ID NO: 40044 - protein, 16 aa, Homo sapiens
  heavy chain complementarity determining region 3 for antibody 20022
AREGDSRGWYGGSMDV

SEQ ID NO: 40045 - protein, 10 aa, Homo sapiens
  light chain complementarity determining region 3 for antibody 20023
QQHNQWPPLT

SEQ ID NO: 40046 - protein, 17 aa, Homo sapiens
  heavy chain complementarity determining region 3 for antibody 20023
ARDLYFSIIQGGGAFDA

SEQ ID NO: 40047 - protein, 10 aa, Homo sapiens
  light chain complementarity determining region 3 for antibody 20024
QQHNNWPPYT

SEQ ID NO: 40048 - protein, 17 aa, Homo sapiens
  heavy chain complementarity determining region 3 for antibody 20024
AGGGDTAQQFMYPPNNY

SEQ ID NO: 40049 - protein, 10 aa, Homo sapiens
  light chain complementarity determining region 3 for antibody 20025
QQHNNWPPLT

SEQ ID NO: 40050 - protein, 12 aa, Homo sapiens
  heavy chain complementarity determining region 3 for antibody 20025
ARYGDYFLGWVY

SEQ ID NO: 40051 - protein, 8 aa, Homo sapiens
  light chain complementarity determining region 3 for antibody 20026
QQHGYSWT

SEQ ID NO: 40052 - protein, 9 aa, Homo sapiens
  heavy chain complementarity determining region 3 for antibody 20026
ARWVECLDV

SEQ ID NO: 40053 - protein, 8 aa, Homo sapiens
  light chain complementarity determining region 3 for antibody 20027
QQHGYSWP

SEQ ID NO: 40054 - protein, 9 aa, Homo sapiens
  heavy chain complementarity determining region 3 for antibody 20027
ARWVEGLDV

SEQ ID NO: 40055 - protein, 9 aa, Homo sapiens
  light chain complementarity determining region 3 for antibody 20028
QQHGYSARP

SEQ ID NO: 40056 - protein, 13 aa, Homo sapiens
  heavy chain complementarity determining region 3 for antibody 20028
ARGYFYSDGYIED

SEQ ID NO: 40057 - protein, 9 aa, Homo sapiens
  light chain complementarity determining region 3 for antibody 20029
QQHGTSRVT

SEQ ID NO: 40058 - protein, 17 aa, Homo sapiens
  heavy chain complementarity determining region 3 for antibody 20029
TKDRWLRVYDSSGCYDS

SEQ ID NO: 40059 - protein, 8 aa, Homo sapiens
  light chain complementarity determining region 3 for antibody 20030
QQHGSSWT

SEQ ID NO: 40060 - protein, 9 aa, Homo sapiens
  heavy chain complementarity determining region 3 for antibody 20030
ARWVEGLDV

SEQ ID NO: 40061 - protein, 9 aa, Homo sapiens
  light chain complementarity determining region 3 for antibody 20031
QQHGSLPHT

SEQ ID NO: 40062 - protein, 14 aa, Homo sapiens
  heavy chain complementarity determining region 3 for antibody 20031
ARGGGSDWYGLLYY

SEQ ID NO: 40063 - protein, 9 aa, Homo sapiens
  light chain complementarity determining region 3 for antibody 20032
QQHGSIPRT

SEQ ID NO: 40064 - protein, 13 aa, Homo sapiens
  heavy chain complementarity determining region 3 for antibody 20032
AGGIFDSSGYGEY

SEQ ID NO: 40065 - protein, 9 aa, Homo sapiens
  light chain complementarity determining region 3 for antibody 20033
QQHGSIPRT

SEQ ID NO: 40066 - protein, 13 aa, Homo sapiens
  heavy chain complementarity determining region 3 for antibody 20033
AGGGFSSGRYSEY

SEQ ID NO: 40067 - protein, 9 aa, Homo sapiens
  light chain complementarity determining region 3 for antibody 20034
QQHGRIPRT

SEQ ID NO: 40068 - protein, 13 aa, Homo sapiens
  heavy chain complementarity determining region 3 for antibody 20034
AGGLYDSSGYSEF

SEQ ID NO: 40069 - protein, 8 aa, Homo sapiens
  light chain complementarity determining region 3 for antibody 20035
QQHGNSPF

SEQ ID NO: 40070 - protein, 20 aa, Homo sapiens
  heavy chain complementarity determining region 3 for antibody 20035
ARGPPGYDTSGYYRNWYFDL

SEQ ID NO: 40071 - protein, 9 aa, Homo sapiens
  light chain complementarity determining region 3 for antibody 20036
QQHGNIPRT

SEQ ID NO: 40072 - protein, 13 aa, Homo sapiens
  heavy chain complementarity determining region 3 for antibody 20036
AGGLFHSSGYSEF

SEQ ID NO: 40073 - protein, 8 aa, Homo sapiens
  light chain complementarity determining region 3 for antibody 20037
QQHENLVT

SEQ ID NO: 40074 - protein, 18 aa, Homo sapiens
  heavy chain complementarity determining region 3 for antibody 20037
AKGAEGSCSVRKCYPFDY

SEQ ID NO: 40075 - protein, 9 aa, Homo sapiens
  light chain complementarity determining region 3 for antibody 20038
QQGYSTPLP

SEQ ID NO: 40076 - protein, 14 aa, Homo sapiens
  heavy chain complementarity determining region 3 for antibody 20038
ARDRFGDSRISFDY

SEQ ID NO: 40077 - protein, 9 aa, Homo sapiens
  light chain complementarity determining region 3 for antibody 20039
QQGYSTPFT

SEQ ID NO: 40078 - protein, 15 aa, Homo sapiens
  heavy chain complementarity determining region 3 for antibody 20039
ARAQVIWGQLYYFDF

SEQ ID NO: 40079 - protein, 9 aa, Homo sapiens
  light chain complementarity determining region 3 for antibody 20040
QQGYSTPFI

SEQ ID NO: 40080 - protein, 15 aa, Homo sapiens
  heavy chain complementarity determining region 3 for antibody 20040
TRAQVIWGQLYYFDY

SEQ ID NO: 40081 - protein, 9 aa, Homo sapiens
  light chain complementarity determining region 3 for antibody 20041
QQGYRPPFI

SEQ ID NO: 40082 - protein, 15 aa, Homo sapiens
  heavy chain complementarity determining region 3 for antibody 20041
TRAQVMWGQLYYFDY

SEQ ID NO: 40083 - protein, 9 aa, Homo sapiens
  light chain complementarity determining region 3 for antibody 20042
QQGYRPPFI

SEQ ID NO: 40084 - protein, 15 aa, Homo sapiens
  heavy chain complementarity determining region 3 for antibody 20042
TRAQVIWGQLSYFDY

SEQ ID NO: 40085 - protein, 9 aa, Homo sapiens
  light chain complementarity determining region 3 for antibody 20043
QQGYNTPWT

SEQ ID NO: 40086 - protein, 12 aa, Homo sapiens
  heavy chain complementarity determining region 3 for antibody 20043
ARGQQRGDSFDI

SEQ ID NO: 40087 - protein, 9 aa, Homo sapiens
  light chain complementarity determining region 3 for antibody 20044
QQGYNTPGT

SEQ ID NO: 40088 - protein, 12 aa, Homo sapiens
  heavy chain complementarity determining region 3 for antibody 20044
ARVQQRGDSFDI

SEQ ID NO: 40089 - protein, 9 aa, Homo sapiens
  light chain complementarity determining region 3 for antibody 20045
QQGTSLPIT

SEQ ID NO: 40090 - protein, 12 aa, Homo sapiens
  heavy chain complementarity determining region 3 for antibody 20045
ARVVLGGRGFDY

SEQ ID NO: 40091 - protein, 9 aa, Homo sapiens
  light chain complementarity determining region 3 for antibody 20046
QQGNSFPIT

SEQ ID NO: 40092 - protein, 12 aa, Homo sapiens
  heavy chain complementarity determining region 3 for antibody 20046
ARVVLGGRGFDY

SEQ ID NO: 40093 - protein, 9 aa, Homo sapiens
  light chain complementarity determining region 3 for antibody 20047
QQGNRFPHT

SEQ ID NO: 40094 - protein, 14 aa, Homo sapiens
  heavy chain complementarity determining region 3 for antibody 20047
ARYWSGTRCYSMDY

SEQ ID NO: 40095 - protein, 9 aa, Homo sapiens
  light chain complementarity determining region 3 for antibody 20048
QQGISYPFT

SEQ ID NO: 40096 - protein, 12 aa, Homo sapiens
  heavy chain complementarity determining region 3 for antibody 20048
ARPLDGDHGFDP

SEQ ID NO: 40097 - protein, 9 aa, Homo sapiens
  light chain complementarity determining region 3 for antibody 20049
QQFYTYPPT

SEQ ID NO: 40098 - protein, 12 aa, Homo sapiens
  heavy chain complementarity determining region 3 for antibody 20049
TRVLSSAIGEWD

SEQ ID NO: 40099 - protein, 9 aa, Homo sapiens
  light chain complementarity determining region 3 for antibody 20050
QQFYTYPLT

SEQ ID NO: 40100 - protein, 12 aa, Homo sapiens
  heavy chain complementarity determining region 3 for antibody 20050
TRVRSSAIGEWD

SEQ ID NO: 40101 - protein, 9 aa, Homo sapiens
  light chain complementarity determining region 3 for antibody 20051
QQFYTYPLT

SEQ ID NO: 40102 - protein, 12 aa, Homo sapiens
  heavy chain complementarity determining region 3 for antibody 20051
TRVLSSAIGEWH

SEQ ID NO: 40103 - protein, 9 aa, Homo sapiens
  light chain complementarity determining region 3 for antibody 20052
QQFYTSVRT

SEQ ID NO: 40104 - protein, 12 aa, Homo sapiens
  heavy chain complementarity determining region 3 for antibody 20052
VKDCGLGGSRDF

SEQ ID NO: 40105 - protein, 9 aa, Homo sapiens
  light chain complementarity determining region 3 for antibody 20053
QQFYNNPFT

SEQ ID NO: 40106 - protein, 14 aa, Homo sapiens
  heavy chain complementarity determining region 3 for antibody 20053
LGQDCSGVGCDFPR

SEQ ID NO: 40107 - protein, 9 aa, Homo sapiens
  light chain complementarity determining region 3 for antibody 20054
QQFYNNPFT

SEQ ID NO: 40108 - protein, 14 aa, Homo sapiens
  heavy chain complementarity determining region 3 for antibody 20054
LGQDCSGVGCDCPR

SEQ ID NO: 40109 - protein, 9 aa, Homo sapiens
  light chain complementarity determining region 3 for antibody 20055
QQFYGSPWP

SEQ ID NO: 40110 - protein, 16 aa, Homo sapiens
  heavy chain complementarity determining region 3 for antibody 20055
IRQDYYDTSGFSYPAT

SEQ ID NO: 40111 - protein, 9 aa, Homo sapiens
  light chain complementarity determining region 3 for antibody 20056
QQFNSFPIT

SEQ ID NO: 40112 - protein, 11 aa, Homo sapiens
  heavy chain complementarity determining region 3 for antibody 20056
VNDGGHWDFDF

SEQ ID NO: 40113 - protein, 10 aa, Homo sapiens
  light chain complementarity determining region 3 for antibody 20057
QQFNNWPPGT

SEQ ID NO: 40114 - protein, 12 aa, Homo sapiens
  heavy chain complementarity determining region 3 for antibody 20057
AKTVRERKELDH

SEQ ID NO: 40115 - protein, 10 aa, Homo sapiens
  light chain complementarity determining region 3 for antibody 20058
QQFNNWLGWT

SEQ ID NO: 40116 - protein, 13 aa, Homo sapiens
  heavy chain complementarity determining region 3 for antibody 20058
ARHGRRSGWYYTY

SEQ ID NO: 40117 - protein, 9 aa, Homo sapiens
  light chain complementarity determining region 3 for antibody 20059
QQFNDWPRP

SEQ ID NO: 40118 - protein, 15 aa, Homo sapiens
  heavy chain complementarity determining region 3 for antibody 20059
TTDTVSGYYTYYFDS

SEQ ID NO: 40119 - protein, 9 aa, Homo sapiens
  light chain complementarity determining region 3 for antibody 20060
QQFNDCPRT

SEQ ID NO: 40120 - protein, 15 aa, Homo sapiens
  heavy chain complementarity determining region 3 for antibody 20060
TTDTVSGYYTYYFDS

SEQ ID NO: 40121 - protein, 11 aa, Homo sapiens
  light chain complementarity determining region 3 for antibody 20061
QQFGTSPPGYP

SEQ ID NO: 40122 - protein, 14 aa, Homo sapiens
  heavy chain complementarity determining region 3 for antibody 20061
ARDSGTSRKRSFDQ

SEQ ID NO: 40123 - protein, 9 aa, Homo sapiens
  light chain complementarity determining region 3 for antibody 20062
QQFGSLPHT

SEQ ID NO: 40124 - protein, 14 aa, Homo sapiens
  heavy chain complementarity determining region 3 for antibody 20062
ARGGGSDWSGLLYD

SEQ ID NO: 40125 - protein, 10 aa, Homo sapiens
  light chain complementarity determining region 3 for antibody 20063
QQFGNSPKWT

SEQ ID NO: 40126 - protein, 13 aa, Homo sapiens
  heavy chain complementarity determining region 3 for antibody 20063
ARAPKFGAVYFDY

SEQ ID NO: 40127 - protein, 9 aa, Homo sapiens
  light chain complementarity determining region 3 for antibody 20064
QQFDSYPLT

SEQ ID NO: 40128 - protein, 19 aa, Homo sapiens
  heavy chain complementarity determining region 3 for antibody 20064
ARDSRRMVRGLIVYNWFDP

SEQ ID NO: 40129 - protein, 10 aa, Homo sapiens
  light chain complementarity determining region 3 for antibody 20065
QQFDNSPKWT

SEQ ID NO: 40130 - protein, 13 aa, Homo sapiens
  heavy chain complementarity determining region 3 for antibody 20065
ARAPKVGAVYFDY

SEQ ID NO: 40131 - protein, 10 aa, Homo sapiens
  light chain complementarity determining region 3 for antibody 20066
QQFDNSPKWR

SEQ ID NO: 40132 - protein, 13 aa, Homo sapiens
  heavy chain complementarity determining region 3 for antibody 20066
ARAPKFGAVYFDY

SEQ ID NO: 40133 - protein, 9 aa, Homo sapiens
  light chain complementarity determining region 3 for antibody 20067
QQFDNLPLT

SEQ ID NO: 40134 - protein, 17 aa, Homo sapiens
  heavy chain complementarity determining region 3 for antibody 20067
ATQGITIFGVVIDAFDI

SEQ ID NO: 40135 - protein, 9 aa, Homo sapiens
  light chain complementarity determining region 3 for antibody 20068
QQFAGTPPT

SEQ ID NO: 40136 - protein, 9 aa, Homo sapiens
  heavy chain complementarity determining region 3 for antibody 20068
VRGDWGSGY

SEQ ID NO: 40137 - protein, 9 aa, Homo sapiens
  light chain complementarity determining region 3 for antibody 20069
QQDYTSLRT

SEQ ID NO: 40138 - protein, 12 aa, Homo sapiens
  heavy chain complementarity determining region 3 for antibody 20069
VKDCGLGGSRDS

SEQ ID NO: 40139 - protein, 9 aa, Homo sapiens
  light chain complementarity determining region 3 for antibody 20070
QQDYSIPWT

SEQ ID NO: 40140 - protein, 14 aa, Homo sapiens
  heavy chain complementarity determining region 3 for antibody 20070
AKCGYSYGNDAFDI

SEQ ID NO: 40141 - protein, 9 aa, Homo sapiens
  light chain complementarity determining region 3 for antibody 20071
QQDVTPPLT

SEQ ID NO: 40142 - protein, 18 aa, Homo sapiens
  heavy chain complementarity determining region 3 for antibody 20071
ARCVAAAAKWGVYWYFDL

SEQ ID NO: 40143 - protein, 10 aa, Homo sapiens
  light chain complementarity determining region 3 for antibody 20072
QQDVSSPPWT

SEQ ID NO: 40144 - protein, 11 aa, Homo sapiens
  heavy chain complementarity determining region 3 for antibody 20072
AREGSYHYFDF

SEQ ID NO: 40145 - protein, 9 aa, Homo sapiens
  light chain complementarity determining region 3 for antibody 20073
QQDTNWPPT

SEQ ID NO: 40146 - protein, 16 aa, Homo sapiens
  heavy chain complementarity determining region 3 for antibody 20073
AKEGYHYETGGGGMDV

SEQ ID NO: 40147 - protein, 9 aa, Homo sapiens
  light chain complementarity determining region 3 for antibody 20074
QQDSDSPGT

SEQ ID NO: 40148 - protein, 22 aa, Homo sapiens
  heavy chain complementarity determining region 3 for antibody 20074
ARPKTQGGYYESSGYERAAFDL

SEQ ID NO: 40149 - protein, 11 aa, Homo sapiens
  light chain complementarity determining region 3 for antibody 20075
QQDRASPPGFT

SEQ ID NO: 40150 - protein, 14 aa, Homo sapiens
  heavy chain complementarity determining region 3 for antibody 20075
ARSPSNSRNRSFDQ

SEQ ID NO: 40151 - protein, 9 aa, Homo sapiens
  light chain complementarity determining region 3 for antibody 20076
QQDNSFPLT

SEQ ID NO: 40152 - protein, 13 aa, Homo sapiens
  heavy chain complementarity determining region 3 for antibody 20076
ARRSSDYSGHFDY

SEQ ID NO: 40153 - protein, 9 aa, Homo sapiens
  light chain complementarity determining region 3 for antibody 20077
QQDGTSPYT

SEQ ID NO: 40154 - protein, 20 aa, Homo sapiens
  heavy chain complementarity determining region 3 for antibody 20077
ARGGQKGYFDWLFELDGMDV

SEQ ID NO: 40155 - protein, 10 aa, Homo sapiens
  light chain complementarity determining region 3 for antibody 20078
QQDGTSPTWT

SEQ ID NO: 40156 - protein, 18 aa, Homo sapiens
  heavy chain complementarity determining region 3 for antibody 20078
ARAPRDTMIVVRYYGMDV

SEQ ID NO: 40157 - protein, 9 aa, Homo sapiens
  light chain complementarity determining region 3 for antibody 20079
QQDGTSPRT

SEQ ID NO: 40158 - protein, 13 aa, Homo sapiens
  heavy chain complementarity determining region 3 for antibody 20079
ACGYYQSGRYYEY

SEQ ID NO: 40159 - protein, 9 aa, Homo sapiens
  light chain complementarity determining region 3 for antibody 20080
QQDGTSPFT

SEQ ID NO: 40160 - protein, 18 aa, Homo sapiens
  heavy chain complementarity determining region 3 for antibody 20080
ARFEKWELRRGYYYGMDV

SEQ ID NO: 40161 - protein, 9 aa, Homo sapiens
  light chain complementarity determining region 3 for antibody 20081
QQDGTIPRT

SEQ ID NO: 40162 - protein, 14 aa, Homo sapiens
  heavy chain complementarity determining region 3 for antibody 20081
AGGEFCGGDCYSEY

SEQ ID NO: 40163 - protein, 8 aa, Homo sapiens
  light chain complementarity determining region 3 for antibody 20082
QQDGSSWT

SEQ ID NO: 40164 - protein, 12 aa, Homo sapiens
  heavy chain complementarity determining region 3 for antibody 20082
ARLAVAVGAFDI

SEQ ID NO: 40165 - protein, 9 aa, Homo sapiens
  light chain complementarity determining region 3 for antibody 20083
QQDGSSRVT

SEQ ID NO: 40166 - protein, 17 aa, Homo sapiens
  heavy chain complementarity determining region 3 for antibody 20083
AKPPLPWVGELSSAFDM

SEQ ID NO: 40167 - protein, 9 aa, Homo sapiens
  light chain complementarity determining region 3 for antibody 20084
QQDGSSPVT

SEQ ID NO: 40168 - protein, 20 aa, Homo sapiens
  heavy chain complementarity determining region 3 for antibody 20084
ARRPVVSGWYRTGISSWFDP

SEQ ID NO: 40169 - protein, 8 aa, Homo sapiens
  light chain complementarity determining region 3 for antibody 20085
QQDGSSPT

SEQ ID NO: 40170 - protein, 14 aa, Homo sapiens
  heavy chain complementarity determining region 3 for antibody 20085
ARLGGPDRGEKGGY

SEQ ID NO: 40171 - protein, 9 aa, Homo sapiens
  light chain complementarity determining region 3 for antibody 20086
QQDGSSPRT

SEQ ID NO: 40172 - protein, 13 aa, Homo sapiens
  heavy chain complementarity determining region 3 for antibody 20086
ATGYYASGTYLEY

SEQ ID NO: 40173 - protein, 9 aa, Homo sapiens
  light chain complementarity determining region 3 for antibody 20087
QQDGSSPRT

SEQ ID NO: 40174 - protein, 17 aa, Homo sapiens
  heavy chain complementarity determining region 3 for antibody 20087
ARAQGVVVVAARGAFDI

SEQ ID NO: 40175 - protein, 9 aa, Homo sapiens
  light chain complementarity determining region 3 for antibody 20088
QQDGSSPRT

SEQ ID NO: 40176 - protein, 21 aa, Homo sapiens
  heavy chain complementarity determining region 3 for antibody 20088
AKDTAPYSTSWHTKKFYYFDY

SEQ ID NO: 40177 - protein, 10 aa, Homo sapiens
  light chain complementarity determining region 3 for antibody 20089
QQDGSSPPVT

SEQ ID NO: 40178 - protein, 15 aa, Homo sapiens
  heavy chain complementarity determining region 3 for antibody 20089
AKGPMVRGVLGPFDY

SEQ ID NO: 40179 - protein, 9 aa, Homo sapiens
  light chain complementarity determining region 3 for antibody 20090
QQDGSSLYT

SEQ ID NO: 40180 - protein, 16 aa, Homo sapiens
  heavy chain complementarity determining region 3 for antibody 20090
ARAKHYGDYYYYGMDA

SEQ ID NO: 40181 - protein, 9 aa, Homo sapiens
  light chain complementarity determining region 3 for antibody 20091
QQDGSSFLT

SEQ ID NO: 40182 - protein, 19 aa, Homo sapiens
  heavy chain complementarity determining region 3 for antibody 20091
ARYCASGGSCYSPKYGMDV

SEQ ID NO: 40183 - protein, 9 aa, Homo sapiens
  light chain complementarity determining region 3 for antibody 20092
QQDGSLPRT

SEQ ID NO: 40184 - protein, 14 aa, Homo sapiens
  heavy chain complementarity determining region 3 for antibody 20092
AGGDFCGRDCYSEY

SEQ ID NO: 40185 - protein, 9 aa, Homo sapiens
  light chain complementarity determining region 3 for antibody 20093
QQDGSFPYT

SEQ ID NO: 40186 - protein, 14 aa, Homo sapiens
  heavy chain complementarity determining region 3 for antibody 20093
ARGGFIVAWGLFDY

SEQ ID NO: 40187 - protein, 9 aa, Homo sapiens
  light chain complementarity determining region 3 for antibody 20094
QQDGRIPRT

SEQ ID NO: 40188 - protein, 13 aa, Homo sapiens
  heavy chain complementarity determining region 3 for antibody 20094
AGGLYDSSGYSEF

SEQ ID NO: 40189 - protein, 9 aa, Homo sapiens
  light chain complementarity determining region 3 for antibody 20095
QQDGRIPRT

SEQ ID NO: 40190 - protein, 13 aa, Homo sapiens
  heavy chain complementarity determining region 3 for antibody 20095
AGGLFGSGTYSEF

SEQ ID NO: 40191 - protein, 8 aa, Homo sapiens
  light chain complementarity determining region 3 for antibody 20096
QQDGPSRT

SEQ ID NO: 40192 - protein, 15 aa, Homo sapiens
  heavy chain complementarity determining region 3 for antibody 20096
ARGEYYYDSSGYRED

SEQ ID NO: 40193 - protein, 8 aa, Homo sapiens
  light chain complementarity determining region 3 for antibody 20097
QQDGPSRT

SEQ ID NO: 40194 - protein, 15 aa, Homo sapiens
  heavy chain complementarity determining region 3 for antibody 20097
ARGEFYYDGSGYRED

SEQ ID NO: 40195 - protein, 8 aa, Homo sapiens
  light chain complementarity determining region 3 for antibody 20098
QQDGNLVT

SEQ ID NO: 40196 - protein, 18 aa, Homo sapiens
  heavy chain complementarity determining region 3 for antibody 20098
AKGAEGSCSVRKCYPFDY

SEQ ID NO: 40197 - protein, 9 aa, Homo sapiens
  light chain complementarity determining region 3 for antibody 20099
QQDGNLPRT

SEQ ID NO: 40198 - protein, 14 aa, Homo sapiens
  heavy chain complementarity determining region 3 for antibody 20099
AGGDFHRGGGYSDF

SEQ ID NO: 40199 - protein, 9 aa, Homo sapiens
  light chain complementarity determining region 3 for antibody 20100
QQDGGSPRT

SEQ ID NO: 40200 - protein, 13 aa, Homo sapiens
  heavy chain complementarity determining region 3 for antibody 20100
ASGYFDSGAYYDF

SEQ ID NO: 40201 - protein, 9 aa, Homo sapiens
  light chain complementarity determining region 3 for antibody 20101
QQDGDSPVT

SEQ ID NO: 40202 - protein, 18 aa, Homo sapiens
  heavy chain complementarity determining region 3 for antibody 20101
AKIADAAFSASHRGYFDD

SEQ ID NO: 40203 - protein, 11 aa, Homo sapiens
  light chain complementarity determining region 3 for antibody 20102
QQDDTSPPGYT

SEQ ID NO: 40204 - protein, 14 aa, Homo sapiens
  heavy chain complementarity determining region 3 for antibody 20102
ARETSNSRKRSFDQ

SEQ ID NO: 40205 - protein, 9 aa, Homo sapiens
  light chain complementarity determining region 3 for antibody 20103
QQDDSSPPT

SEQ ID NO: 40206 - protein, 14 aa, Homo sapiens
  heavy chain complementarity determining region 3 for antibody 20103
ARDNPHRLERYFDL

SEQ ID NO: 40207 - protein, 8 aa, Homo sapiens
  light chain complementarity determining region 3 for antibody 20104
QQCFGTAT

SEQ ID NO: 40208 - protein, 13 aa, Homo sapiens
  heavy chain complementarity determining region 3 for antibody 20104
ARATMTAPNWFDP

SEQ ID NO: 40209 - protein, 10 aa, Homo sapiens
  light chain complementarity determining region 3 for antibody 20105
QQAYNTPPFP

SEQ ID NO: 40210 - protein, 17 aa, Homo sapiens
  heavy chain complementarity determining region 3 for antibody 20105
ARPAYSGQRPERYGMDV

SEQ ID NO: 40211 - protein, 9 aa, Homo sapiens
  light chain complementarity determining region 3 for antibody 20106
QQANSYPIT

SEQ ID NO: 40212 - protein, 13 aa, Homo sapiens
  heavy chain complementarity determining region 3 for antibody 20106
ARDRFAYGNWYDP

SEQ ID NO: 40213 - protein, 9 aa, Homo sapiens
  light chain complementarity determining region 3 for antibody 20107
QQANSFPVT

SEQ ID NO: 40214 - protein, 20 aa, Homo sapiens
  heavy chain complementarity determining region 3 for antibody 20107
VKDSIPYDSRGYYRRHFFDY

SEQ ID NO: 40215 - protein, 9 aa, Homo sapiens
  light chain complementarity determining region 3 for antibody 20108
QQANSFPAT

SEQ ID NO: 40216 - protein, 21 aa, Homo sapiens
  heavy chain complementarity determining region 3 for antibody 20108
ARDLVGYYYDSSGYPRNYFDY

SEQ ID NO: 40217 - protein, 9 aa, Homo sapiens
  light chain complementarity determining region 3 for antibody 20109
QQAKSSPLS

SEQ ID NO: 40218 - protein, 16 aa, Homo sapiens
  heavy chain complementarity determining region 3 for antibody 20109
ARALVGPATAWSWFDP

SEQ ID NO: 40219 - protein, 8 aa, Homo sapiens
  light chain complementarity determining region 3 for antibody 20110
QPYYTTRS

SEQ ID NO: 40220 - protein, 9 aa, Homo sapiens
  heavy chain complementarity determining region 3 for antibody 20110
SIDNLGMGY

SEQ ID NO: 40221 - protein, 9 aa, Homo sapiens
  light chain complementarity determining region 3 for antibody 20111
QPYYTSPRT

SEQ ID NO: 40222 - protein, 12 aa, Homo sapiens
  heavy chain complementarity determining region 3 for antibody 20111
VKDCGLGGSRDS

SEQ ID NO: 40223 - protein, 8 aa, Homo sapiens
  light chain complementarity determining region 3 for antibody 20112
QPYYSTPT

SEQ ID NO: 40224 - protein, 16 aa, Homo sapiens
  heavy chain complementarity determining region 3 for antibody 20112
ARSIAAGPAANGWFDP

SEQ ID NO: 40225 - protein, 9 aa, Homo sapiens
  light chain complementarity determining region 3 for antibody 20113
QPYYNAPWT

SEQ ID NO: 40226 - protein, 12 aa, Homo sapiens
  heavy chain complementarity determining region 3 for antibody 20113
ARLFHRGNFFDH

SEQ ID NO: 40227 - protein, 9 aa, Homo sapiens
  light chain complementarity determining region 3 for antibody 20114
QPYNTWPRT

SEQ ID NO: 40228 - protein, 22 aa, Homo sapiens
  heavy chain complementarity determining region 3 for antibody 20114
AREVRASGYDDFYNYYYYGLDV

SEQ ID NO: 40229 - protein, 9 aa, Homo sapiens
  light chain complementarity determining region 3 for antibody 20115
QPYNRSPRT

SEQ ID NO: 40230 - protein, 16 aa, Homo sapiens
  heavy chain complementarity determining region 3 for antibody 20115
VKDFTGECHYGSWVDP

SEQ ID NO: 40231 - protein, 9 aa, Homo sapiens
  light chain complementarity determining region 3 for antibody 20116
QPYHSTPLT

SEQ ID NO: 40232 - protein, 20 aa, Homo sapiens
  heavy chain complementarity determining region 3 for antibody 20116
ARARSKTTVVTPTRQFASDI

SEQ ID NO: 40233 - protein, 9 aa, Homo sapiens
  light chain complementarity determining region 3 for antibody 20117
QPYGYSARP

SEQ ID NO: 40234 - protein, 13 aa, Homo sapiens
  heavy chain complementarity determining region 3 for antibody 20117
ARGYFYSDGYIED

SEQ ID NO: 40235 - protein, 9 aa, Homo sapiens
  light chain complementarity determining region 3 for antibody 20118
QPYGTSPRT

SEQ ID NO: 40236 - protein, 13 aa, Homo sapiens
  heavy chain complementarity determining region 3 for antibody 20118
PIGFYDRSGYHEY

SEQ ID NO: 40237 - protein, 9 aa, Homo sapiens
  light chain complementarity determining region 3 for antibody 20119
QPYGSSRVT

SEQ ID NO: 40238 - protein, 17 aa, Homo sapiens
  heavy chain complementarity determining region 3 for antibody 20119
AKPPLPWVGELSSAFDM

SEQ ID NO: 40239 - protein, 9 aa, Homo sapiens
  light chain complementarity determining region 3 for antibody 20120
QPYGSIPLT

SEQ ID NO: 40240 - protein, 7 aa, Homo sapiens
  heavy chain complementarity determining region 3 for antibody 20120
HGYELKC

SEQ ID NO: 40241 - protein, 9 aa, Homo sapiens
  light chain complementarity determining region 3 for antibody 20121
QPYGGSPRT

SEQ ID NO: 40242 - protein, 13 aa, Homo sapiens
  heavy chain complementarity determining region 3 for antibody 20121
ASGYFDSGAYYEF

SEQ ID NO: 40243 - protein, 9 aa, Homo sapiens
  light chain complementarity determining region 3 for antibody 20122
QPYGGSPRT

SEQ ID NO: 40244 - protein, 13 aa, Homo sapiens
  heavy chain complementarity determining region 3 for antibody 20122
AAGYFSSGTYYEY

SEQ ID NO: 40245 - protein, 9 aa, Homo sapiens
  light chain complementarity determining region 3 for antibody 20123
QPYERSPQT

SEQ ID NO: 40246 - protein, 15 aa, Homo sapiens
  heavy chain complementarity determining region 3 for antibody 20123
ARDPTVASHHYGVDV

SEQ ID NO: 40247 - protein, 10 aa, Homo sapiens
  light chain complementarity determining region 3 for antibody 20124
QPRSKWPPLT

SEQ ID NO: 40248 - protein, 9 aa, Homo sapiens
  heavy chain complementarity determining region 3 for antibody 20124
ARVDGYFDY

SEQ ID NO: 40249 - protein, 9 aa, Homo sapiens
  light chain complementarity determining region 3 for antibody 20125
QPRNKWPRT

SEQ ID NO: 40250 - protein, 13 aa, Homo sapiens
  heavy chain complementarity determining region 3 for antibody 20125
AKDLGSLRYDFDY

SEQ ID NO: 40251 - protein, 11 aa, Homo sapiens
  light chain complementarity determining region 3 for antibody 20126
QNYVSSPPNFT

SEQ ID NO: 40252 - protein, 15 aa, Homo sapiens
  heavy chain complementarity determining region 3 for antibody 20126
ARDPSYIAAAGRGDY

SEQ ID NO: 40253 - protein, 9 aa, Homo sapiens
  light chain complementarity determining region 3 for antibody 20127
QNYDGPPLT

SEQ ID NO: 40254 - protein, 21 aa, Homo sapiens
  heavy chain complementarity determining region 3 for antibody 20127
AKGLYHLNTVRPSDQAGGLDF

SEQ ID NO: 40255 - protein, 9 aa, Homo sapiens
  light chain complementarity determining region 3 for antibody 20128
QLYNTYPWP

SEQ ID NO: 40256 - protein, 10 aa, Homo sapiens
  heavy chain complementarity determining region 3 for antibody 20128
VKMNWELAGV

SEQ ID NO: 40257 - protein, 9 aa, Homo sapiens
  light chain complementarity determining region 3 for antibody 20129
QLYITYPWT

SEQ ID NO: 40258 - protein, 10 aa, Homo sapiens
  heavy chain complementarity determining region 3 for antibody 20129
VKMNWELAGV

SEQ ID NO: 40259 - protein, 10 aa, Homo sapiens
  light chain complementarity determining region 3 for antibody 20130
QLYGSSPTWT

SEQ ID NO: 40260 - protein, 9 aa, Homo sapiens
  heavy chain complementarity determining region 3 for antibody 20130
APGGELLGY

SEQ ID NO: 40261 - protein, 10 aa, Homo sapiens
  light chain complementarity determining region 3 for antibody 20131
QLYGSSPTGR

SEQ ID NO: 40262 - protein, 9 aa, Homo sapiens
  heavy chain complementarity determining region 3 for antibody 20131
ATGGELLGY

SEQ ID NO: 40263 - protein, 11 aa, Homo sapiens
  light chain complementarity determining region 3 for antibody 20132
QLYETSPPGNP

SEQ ID NO: 40264 - protein, 14 aa, Homo sapiens
  heavy chain complementarity determining region 3 for antibody 20132
ARENSISRKRSFDQ

SEQ ID NO: 40265 - protein, 11 aa, Homo sapiens
  light chain complementarity determining region 3 for antibody 20133
QLWSTSGSRYT

SEQ ID NO: 40266 - protein, 14 aa, Homo sapiens
  heavy chain complementarity determining region 3 for antibody 20133
ARHTAESGLRGFDH

SEQ ID NO: 40267 - protein, 10 aa, Homo sapiens
  light chain complementarity determining region 3 for antibody 20134
QLRSNWPRIT

SEQ ID NO: 40268 - protein, 21 aa, Homo sapiens
  heavy chain complementarity determining region 3 for antibody 20134
AHSPFSTSFGVVVKGSTYFDQ

SEQ ID NO: 40269 - protein, 9 aa, Homo sapiens
  light chain complementarity determining region 3 for antibody 20135
QLNNTYPWT

SEQ ID NO: 40270 - protein, 10 aa, Homo sapiens
  heavy chain complementarity determining region 3 for antibody 20135
VKMNWELAGV

SEQ ID NO: 40271 - protein, 9 aa, Homo sapiens
  light chain complementarity determining region 3 for antibody 20136
QKYYTAPWT

SEQ ID NO: 40272 - protein, 15 aa, Homo sapiens
  heavy chain complementarity determining region 3 for antibody 20136
LRDIKGPSAGIPYDS

SEQ ID NO: 40273 - protein, 9 aa, Homo sapiens
  light chain complementarity determining region 3 for antibody 20137
QKYVSTPRP

SEQ ID NO: 40274 - protein, 18 aa, Homo sapiens
  heavy chain complementarity determining region 3 for antibody 20137
AHERWEKNRSYKCYGMDL

SEQ ID NO: 40275 - protein, 9 aa, Homo sapiens
  light chain complementarity determining region 3 for antibody 20138
QKYNSGPLT

SEQ ID NO: 40276 - protein, 17 aa, Homo sapiens
  heavy chain complementarity determining region 3 for antibody 20138
ARERSYYGSGNYHPSDS

SEQ ID NO: 40277 - protein, 9 aa, Homo sapiens
  light chain complementarity determining region 3 for antibody 20139
QKYNSAPLT

SEQ ID NO: 40278 - protein, 19 aa, Homo sapiens
  heavy chain complementarity determining region 3 for antibody 20139
ASHQPRGLGISFLTSPFDN

SEQ ID NO: 40279 - protein, 9 aa, Homo sapiens
  light chain complementarity determining region 3 for antibody 20140
QKYNSAPLT

SEQ ID NO: 40280 - protein, 19 aa, Homo sapiens
  heavy chain complementarity determining region 3 for antibody 20140
ARHQPRGLGISFLPSPFDN

SEQ ID NO: 40281 - protein, 9 aa, Homo sapiens
  light chain complementarity determining region 3 for antibody 20141
QKYNSAPIT

SEQ ID NO: 40282 - protein, 19 aa, Homo sapiens
  heavy chain complementarity determining region 3 for antibody 20141
ASLLHVRGSLDYLLPYFDY

SEQ ID NO: 40283 - protein, 9 aa, Homo sapiens
  light chain complementarity determining region 3 for antibody 20142
QKYGTSPLP

SEQ ID NO: 40284 - protein, 13 aa, Homo sapiens
  heavy chain complementarity determining region 3 for antibody 20142
AGGHYHSSGYSEF

SEQ ID NO: 40285 - protein, 9 aa, Homo sapiens
  light chain complementarity determining region 3 for antibody 20143
QKYGTPPRP

SEQ ID NO: 40286 - protein, 13 aa, Homo sapiens
  heavy chain complementarity determining region 3 for antibody 20143
AGGHYHSSGYSEF

SEQ ID NO: 40287 - protein, 9 aa, Homo sapiens
  light chain complementarity determining region 3 for antibody 20144
QKYGRSPYT

SEQ ID NO: 40288 - protein, 18 aa, Homo sapiens
  heavy chain complementarity determining region 3 for antibody 20144
ARPMVRALDEYNYYGLDV

SEQ ID NO: 40289 - protein, 9 aa, Homo sapiens
  light chain complementarity determining region 3 for antibody 20145
QKYGNLPRT

SEQ ID NO: 40290 - protein, 13 aa, Homo sapiens
  heavy chain complementarity determining region 3 for antibody 20145
AGGQFHSSGYSEF

SEQ ID NO: 40291 - protein, 9 aa, Homo sapiens
  light chain complementarity determining region 3 for antibody 20146
QKRSSWPYT

SEQ ID NO: 40292 - protein, 11 aa, Homo sapiens
  heavy chain complementarity determining region 3 for antibody 20146
VKRWGGSSIDY

SEQ ID NO: 40293 - protein, 9 aa, Homo sapiens
  light chain complementarity determining region 3 for antibody 20147
QKNNSGPLT

SEQ ID NO: 40294 - protein, 17 aa, Homo sapiens
  heavy chain complementarity determining region 3 for antibody 20147
ARERFYYGSGNYHPSDS

SEQ ID NO: 40295 - protein, 9 aa, Homo sapiens
  light chain complementarity determining region 3 for antibody 20148
QKHNSGPLT

SEQ ID NO: 40296 - protein, 17 aa, Homo sapiens
  heavy chain complementarity determining region 3 for antibody 20148
ARERFYYGSGNYHPSDS

SEQ ID NO: 40297 - protein, 9 aa, Homo sapiens
  light chain complementarity determining region 3 for antibody 20149
QKHNSAPRT

SEQ ID NO: 40298 - protein, 17 aa, Homo sapiens
  heavy chain complementarity determining region 3 for antibody 20149
ARDRWYYGSGNYYPFDI

SEQ ID NO: 40299 - protein, 9 aa, Homo sapiens
  light chain complementarity determining region 3 for antibody 20150
QHYYTIPLT

SEQ ID NO: 40300 - protein, 11 aa, Homo sapiens
  heavy chain complementarity determining region 3 for antibody 20150
ARSDKVNWFDT

SEQ ID NO: 40301 - protein, 11 aa, Homo sapiens
  light chain complementarity determining region 3 for antibody 20151
QHYVSSPPNFT

SEQ ID NO: 40302 - protein, 15 aa, Homo sapiens
  heavy chain complementarity determining region 3 for antibody 20151
ARDPSYIAAAGGGDY

SEQ ID NO: 40303 - protein, 11 aa, Homo sapiens
  light chain complementarity determining region 3 for antibody 20152
QHYVSSPPNFT

SEQ ID NO: 40304 - protein, 15 aa, Homo sapiens
  heavy chain complementarity determining region 3 for antibody 20152
ARDPSDIAAAGRGDY

SEQ ID NO: 40305 - protein, 11 aa, Homo sapiens
  light chain complementarity determining region 3 for antibody 20153
QHYVSSPPNFT

SEQ ID NO: 40306 - protein, 15 aa, Homo sapiens
  heavy chain complementarity determining region 3 for antibody 20153
AGDPSYIAAAGRGDY

SEQ ID NO: 40307 - protein, 11 aa, Homo sapiens
  light chain complementarity determining region 3 for antibody 20154
QHYVSSPPNFS

SEQ ID NO: 40308 - protein, 15 aa, Homo sapiens
  heavy chain complementarity determining region 3 for antibody 20154
ARDPSYIAAAGRGDY

SEQ ID NO: 40309 - protein, 11 aa, Homo sapiens
  light chain complementarity determining region 3 for antibody 20155
QHYVRSPPNFT

SEQ ID NO: 40310 - protein, 15 aa, Homo sapiens
  heavy chain complementarity determining region 3 for antibody 20155
ARDPSYIAAAGRGDY

SEQ ID NO: 40311 - protein, 9 aa, Homo sapiens
  light chain complementarity determining region 3 for antibody 20156
QHYVPSPLT

SEQ ID NO: 40312 - protein, 8 aa, Homo sapiens
  heavy chain complementarity determining region 3 for antibody 20156
VCMIVATN

SEQ ID NO: 40313 - protein, 10 aa, Homo sapiens
  light chain complementarity determining region 3 for antibody 20157
QHYSWSPPIT

SEQ ID NO: 40314 - protein, 20 aa, Homo sapiens
  heavy chain complementarity determining region 3 for antibody 20157
ARDAADVEIVPAARLFAMDV

SEQ ID NO: 40315 - protein, 8 aa, Homo sapiens
  light chain complementarity determining region 3 for antibody 20158
QHYSTALT

SEQ ID NO: 40316 - protein, 12 aa, Homo sapiens
  heavy chain complementarity determining region 3 for antibody 20158
ARGRVVFHPIDS

SEQ ID NO: 40317 - protein, 8 aa, Homo sapiens
  light chain complementarity determining region 3 for antibody 20159
QHYSTALT

SEQ ID NO: 40318 - protein, 12 aa, Homo sapiens
  heavy chain complementarity determining region 3 for antibody 20159
ARGRVVCHTIDS

SEQ ID NO: 40319 - protein, 10 aa, Homo sapiens
  light chain complementarity determining region 3 for antibody 20160
QHYSSSPPWT

SEQ ID NO: 40320 - protein, 16 aa, Homo sapiens
  heavy chain complementarity determining region 3 for antibody 20160
ARRQWVRGLFRGGLDS

SEQ ID NO: 40321 - protein, 10 aa, Homo sapiens
  light chain complementarity determining region 3 for antibody 20161
QHYSRSPPIT

SEQ ID NO: 40322 - protein, 20 aa, Homo sapiens
  heavy chain complementarity determining region 3 for antibody 20161
ARDAADVEIVPAARLCAMDV

SEQ ID NO: 40323 - protein, 10 aa, Homo sapiens
  light chain complementarity determining region 3 for antibody 20162
QHYSRSPPIT

SEQ ID NO: 40324 - protein, 20 aa, Homo sapiens
  heavy chain complementarity determining region 3 for antibody 20162
ARDAADGEIVPAARLFAMDV

SEQ ID NO: 40325 - protein, 10 aa, Homo sapiens
  light chain complementarity determining region 3 for antibody 20163
QHYPNWPPWT

SEQ ID NO: 40326 - protein, 13 aa, Homo sapiens
  heavy chain complementarity determining region 3 for antibody 20163
AKGRVRELYYFDT

SEQ ID NO: 40327 - protein, 11 aa, Homo sapiens
  light chain complementarity determining region 3 for antibody 20164
QHYNNCPLMYT

SEQ ID NO: 40328 - protein, 14 aa, Homo sapiens
  heavy chain complementarity determining region 3 for antibody 20164
LLRHRRADWPGVDY

SEQ ID NO: 40329 - protein, 9 aa, Homo sapiens
  light chain complementarity determining region 3 for antibody 20165
QHYNGYWWP

SEQ ID NO: 40330 - protein, 12 aa, Homo sapiens
  heavy chain complementarity determining region 3 for antibody 20165
VAYLVGHGGVGF

SEQ ID NO: 40331 - protein, 10 aa, Homo sapiens
  light chain complementarity determining region 3 for antibody 20166
QHYHNWPPWT

SEQ ID NO: 40332 - protein, 13 aa, Homo sapiens
  heavy chain complementarity determining region 3 for antibody 20166
AKGRVRELYYLDT

SEQ ID NO: 40333 - protein, 10 aa, Homo sapiens
  light chain complementarity determining region 3 for antibody 20167
QHYHNWPPWT

SEQ ID NO: 40334 - protein, 13 aa, Homo sapiens
  heavy chain complementarity determining region 3 for antibody 20167
AKGRVRELYYFDP

SEQ ID NO: 40335 - protein, 10 aa, Homo sapiens
  light chain complementarity determining region 3 for antibody 20168
QHYHNCPPWT

SEQ ID NO: 40336 - protein, 13 aa, Homo sapiens
  heavy chain complementarity determining region 3 for antibody 20168
AKGRVRELYYFDT

SEQ ID NO: 40337 - protein, 9 aa, Homo sapiens
  light chain complementarity determining region 3 for antibody 20169
QHYGSSSIT

SEQ ID NO: 40338 - protein, 13 aa, Homo sapiens
  heavy chain complementarity determining region 3 for antibody 20169
VKNFFMAFDAFHM

SEQ ID NO: 40339 - protein, 11 aa, Homo sapiens
  light chain complementarity determining region 3 for antibody 20170
QHYGSSPPRGA

SEQ ID NO: 40340 - protein, 14 aa, Homo sapiens
  heavy chain complementarity determining region 3 for antibody 20170
ASFLLSRRGSYVDY

SEQ ID NO: 40341 - protein, 11 aa, Homo sapiens
  light chain complementarity determining region 3 for antibody 20171
QHYGSSPPNFP

SEQ ID NO: 40342 - protein, 15 aa, Homo sapiens
  heavy chain complementarity determining region 3 for antibody 20171
ARDPSYIAAAGRGDY

SEQ ID NO: 40343 - protein, 11 aa, Homo sapiens
  light chain complementarity determining region 3 for antibody 20172
QHYGSSPPGGT

SEQ ID NO: 40344 - protein, 14 aa, Homo sapiens
  heavy chain complementarity determining region 3 for antibody 20172
ASFLLSRRGSYVDY

SEQ ID NO: 40345 - protein, 9 aa, Homo sapiens
  light chain complementarity determining region 3 for antibody 20173
QHYGSPPRP

SEQ ID NO: 40346 - protein, 14 aa, Homo sapiens
  heavy chain complementarity determining region 3 for antibody 20173
AGGVFSSDWNYSEY

SEQ ID NO: 40347 - protein, 9 aa, Homo sapiens
  light chain complementarity determining region 3 for antibody 20174
QHYGSLPLT

SEQ ID NO: 40348 - protein, 7 aa, Homo sapiens
  heavy chain complementarity determining region 3 for antibody 20174
HGYELKC

SEQ ID NO: 40349 - protein, 9 aa, Homo sapiens
  light chain complementarity determining region 3 for antibody 20175
QHYGSLLWT

SEQ ID NO: 40350 - protein, 13 aa, Homo sapiens
  heavy chain complementarity determining region 3 for antibody 20175
ARKFLGYDHVLDV

SEQ ID NO: 40351 - protein, 9 aa, Homo sapiens
  light chain complementarity determining region 3 for antibody 20176
QHYGSIPLP

SEQ ID NO: 40352 - protein, 7 aa, Homo sapiens
  heavy chain complementarity determining region 3 for antibody 20176
HGYELKC

SEQ ID NO: 40353 - protein, 9 aa, Homo sapiens
  light chain complementarity determining region 3 for antibody 20177
QHYGRSPRT

SEQ ID NO: 40354 - protein, 13 aa, Homo sapiens
  heavy chain complementarity determining region 3 for antibody 20177
ARGKCERSGYVET

SEQ ID NO: 40355 - protein, 10 aa, Homo sapiens
  light chain complementarity determining region 3 for antibody 20178
QHYGRSPPSS

SEQ ID NO: 40356 - protein, 23 aa, Homo sapiens
  heavy chain complementarity determining region 3 for antibody 20178
ARGLRSSDWSKIMEMDSYYGLDV

SEQ ID NO: 40357 - protein, 10 aa, Homo sapiens
  light chain complementarity determining region 3 for antibody 20179
QHYGRSPPDS

SEQ ID NO: 40358 - protein, 23 aa, Homo sapiens
  heavy chain complementarity determining region 3 for antibody 20179
ARGLRSSDWSKIMEMDSYYGLDV

SEQ ID NO: 40359 - protein, 9 aa, Homo sapiens
  light chain complementarity determining region 3 for antibody 20180
QHYGNLPRT

SEQ ID NO: 40360 - protein, 13 aa, Homo sapiens
  heavy chain complementarity determining region 3 for antibody 20180
ARGQYERSGYKEN

SEQ ID NO: 40361 - protein, 9 aa, Homo sapiens
  light chain complementarity determining region 3 for antibody 20181
QHYGNIPRS

SEQ ID NO: 40362 - protein, 13 aa, Homo sapiens
  heavy chain complementarity determining region 3 for antibody 20181
AGGTWHSGTYYES

SEQ ID NO: 40363 - protein, 9 aa, Homo sapiens
  light chain complementarity determining region 3 for antibody 20182
QHYGASPCT

SEQ ID NO: 40364 - protein, 11 aa, Homo sapiens
  heavy chain complementarity determining region 3 for antibody 20182
ARGEVGYAFDI

SEQ ID NO: 40365 - protein, 9 aa, Homo sapiens
  light chain complementarity determining region 3 for antibody 20183
QHYDSPVQT

SEQ ID NO: 40366 - protein, 19 aa, Homo sapiens
  heavy chain complementarity determining region 3 for antibody 20183
AKEAAAFCGDYCRGSHCDF

SEQ ID NO: 40367 - protein, 9 aa, Homo sapiens
  light chain complementarity determining region 3 for antibody 20184
QHYDNLLLT

SEQ ID NO: 40368 - protein, 23 aa, Homo sapiens
  heavy chain complementarity determining region 3 for antibody 20184
ARTSRTYSSGWYAKTFYYYVMDV

SEQ ID NO: 40369 - protein, 11 aa, Homo sapiens
  light chain complementarity determining region 3 for antibody 20185
QHYASSPPMYT

SEQ ID NO: 40370 - protein, 24 aa, Homo sapiens
  heavy chain complementarity determining region 3 for antibody 20185
ARLAVYCSGSSCYPPQYHYYGMDV

SEQ ID NO: 40371 - protein, 9 aa, Homo sapiens
  light chain complementarity determining region 3 for antibody 20186
QHTHTFPRP

SEQ ID NO: 40372 - protein, 20 aa, Homo sapiens
  heavy chain complementarity determining region 3 for antibody 20186
ARGRRIAALSTAHYYYGMDV

SEQ ID NO: 40373 - protein, 9 aa, Homo sapiens
  light chain complementarity determining region 3 for antibody 20187
QHSHSRPFT

SEQ ID NO: 40374 - protein, 20 aa, Homo sapiens
  heavy chain complementarity determining region 3 for antibody 20187
AKGISVAALRTVYYYCGMDV

SEQ ID NO: 40375 - protein, 10 aa, Homo sapiens
  light chain complementarity determining region 3 for antibody 20188
QHRSKWPPLT

SEQ ID NO: 40376 - protein, 9 aa, Homo sapiens
  heavy chain complementarity determining region 3 for antibody 20188
ARVDGYFDY

SEQ ID NO: 40377 - protein, 9 aa, Homo sapiens
  light chain complementarity determining region 3 for antibody 20189
QHRSGWPLT

SEQ ID NO: 40378 - protein, 18 aa, Homo sapiens
  heavy chain complementarity determining region 3 for antibody 20189
ARDLPPGATGNCYYGLDD

SEQ ID NO: 40379 - protein, 9 aa, Homo sapiens
  light chain complementarity determining region 3 for antibody 20190
QHRNNWPLT

SEQ ID NO: 40380 - protein, 13 aa, Homo sapiens
  heavy chain complementarity determining region 3 for antibody 20190
ARGNIAAPGRLGC

SEQ ID NO: 40381 - protein, 9 aa, Homo sapiens
  light chain complementarity determining region 3 for antibody 20191
QHRNNWPLT

SEQ ID NO: 40382 - protein, 13 aa, Homo sapiens
  heavy chain complementarity determining region 3 for antibody 20191
ARGNIAAPGRLEF

SEQ ID NO: 40383 - protein, 9 aa, Homo sapiens
  light chain complementarity determining region 3 for antibody 20192
QHRNKWPRT

SEQ ID NO: 40384 - protein, 13 aa, Homo sapiens
  heavy chain complementarity determining region 3 for antibody 20192
AKDLGSLRYDFDY

SEQ ID NO: 40385 - protein, 9 aa, Homo sapiens
  light chain complementarity determining region 3 for antibody 20193
QHPKSYPFT

SEQ ID NO: 40386 - protein, 15 aa, Homo sapiens
  heavy chain complementarity determining region 3 for antibody 20193
ARLGIVVAERGCFDH

SEQ ID NO: 40387 - protein, 10 aa, Homo sapiens
  light chain complementarity determining region 3 for antibody 20194
QHNDDLRQIS

SEQ ID NO: 40388 - protein, 13 aa, Homo sapiens
  heavy chain complementarity determining region 3 for antibody 20194
ARDQDGDYGYFHN

SEQ ID NO: 40389 - protein, 10 aa, Homo sapiens
  light chain complementarity determining region 3 for antibody 20195
QHNDDLRPLS

SEQ ID NO: 40390 - protein, 13 aa, Homo sapiens
  heavy chain complementarity determining region 3 for antibody 20195
ARDQDGDYGYFHN

SEQ ID NO: 40391 - protein, 8 aa, Homo sapiens
  light chain complementarity determining region 3 for antibody 20196
QHLNSYPR

SEQ ID NO: 40392 - protein, 18 aa, Homo sapiens
  heavy chain complementarity determining region 3 for antibody 20196
ARDRAVTGPRGPSYVFDS

SEQ ID NO: 40393 - protein, 8 aa, Homo sapiens
  light chain complementarity determining region 3 for antibody 20197
QHLNSYPR

SEQ ID NO: 40394 - protein, 18 aa, Homo sapiens
  heavy chain complementarity determining region 3 for antibody 20197
ARDRAMTGPRGTSYVFDS

SEQ ID NO: 40395 - protein, 9 aa, Homo sapiens
  light chain complementarity determining region 3 for antibody 20198
QHHGSLPLT

SEQ ID NO: 40396 - protein, 16 aa, Homo sapiens
  heavy chain complementarity determining region 3 for antibody 20198
ATMLVRGLLYFHAVDV

SEQ ID NO: 40397 - protein, 10 aa, Homo sapiens
  light chain complementarity determining region 3 for antibody 20199
QHFGSSPAIT

SEQ ID NO: 40398 - protein, 13 aa, Homo sapiens
  heavy chain complementarity determining region 3 for antibody 20199
VRGARRGRYDFDY

SEQ ID NO: 40399 - protein, 9 aa, Homo sapiens
  light chain complementarity determining region 3 for antibody 20200
QHAHTFPRT

SEQ ID NO: 40400 - protein, 20 aa, Homo sapiens
  heavy chain complementarity determining region 3 for antibody 20200
GRGRRIAALSTAHYYYGMDV

SEQ ID NO: 40401 - protein, 11 aa, Homo sapiens
  light chain complementarity determining region 3 for antibody 20201
QGYGASPPMYA

SEQ ID NO: 40402 - protein, 12 aa, Homo sapiens
  heavy chain complementarity determining region 3 for antibody 20201
AKDLHGSGSFDH

SEQ ID NO: 40403 - protein, 11 aa, Homo sapiens
  light chain complementarity determining region 3 for antibody 20202
QGYGASPPMST

SEQ ID NO: 40404 - protein, 12 aa, Homo sapiens
  heavy chain complementarity determining region 3 for antibody 20202
AKDLHGSGSFDH

SEQ ID NO: 40405 - protein, 11 aa, Homo sapiens
  light chain complementarity determining region 3 for antibody 20203
QGYGASPPLYT

SEQ ID NO: 40406 - protein, 12 aa, Homo sapiens
  heavy chain complementarity determining region 3 for antibody 20203
AKDLHGSGSFDH

SEQ ID NO: 40407 - protein, 9 aa, Homo sapiens
  light chain complementarity determining region 3 for antibody 20204
QEYNTWPPA

SEQ ID NO: 40408 - protein, 15 aa, Homo sapiens
  heavy chain complementarity determining region 3 for antibody 20204
AFYSSGPGSAYFYDQ

SEQ ID NO: 40409 - protein, 9 aa, Homo sapiens
  light chain complementarity determining region 3 for antibody 20205
QEYDSLPFT

SEQ ID NO: 40410 - protein, 22 aa, Homo sapiens
  heavy chain complementarity determining region 3 for antibody 20205
ARDDRISFDYPNSGYSGGSFDL

SEQ ID NO: 40411 - protein, 8 aa, Homo sapiens
  light chain complementarity determining region 3 for antibody 20206
QDYGSSRR

SEQ ID NO: 40412 - protein, 15 aa, Homo sapiens
  heavy chain complementarity determining region 3 for antibody 20206
ASGSFDTLTGSYSEV

SEQ ID NO: 40413 - protein, 8 aa, Homo sapiens
  light chain complementarity determining region 3 for antibody 20207
QDYGSPRT

SEQ ID NO: 40414 - protein, 15 aa, Homo sapiens
  heavy chain complementarity determining region 3 for antibody 20207
ASGSFDTLTGSYSEV

SEQ ID NO: 40415 - protein, 8 aa, Homo sapiens
  light chain complementarity determining region 3 for antibody 20208
QDYGSLRT

SEQ ID NO: 40416 - protein, 15 aa, Homo sapiens
  heavy chain complementarity determining region 3 for antibody 20208
ASGSFDTLTGSYSEV

SEQ ID NO: 40417 - protein, 9 aa, Homo sapiens
  light chain complementarity determining region 3 for antibody 20209
QAYNNFFRP

SEQ ID NO: 40418 - protein, 11 aa, Homo sapiens
  heavy chain complementarity determining region 3 for antibody 20209
ARDRRAYGMDV

SEQ ID NO: 40419 - protein, 6 aa, Homo sapiens
  light chain complementarity determining region 3 for antibody 20210
PRHGGS

SEQ ID NO: 40420 - protein, 11 aa, Homo sapiens
  heavy chain complementarity determining region 3 for antibody 20210
ARAGYRAAFDI

SEQ ID NO: 40421 - protein, 9 aa, Homo sapiens
  light chain complementarity determining region 3 for antibody 20211
PQYYTPPRT

SEQ ID NO: 40422 - protein, 8 aa, Homo sapiens
  heavy chain complementarity determining region 3 for antibody 20211
ARDGAFDS

SEQ ID NO: 40423 - protein, 9 aa, Homo sapiens
  light chain complementarity determining region 3 for antibody 20212
PQYGTSPFT

SEQ ID NO: 40424 - protein, 15 aa, Homo sapiens
  heavy chain complementarity determining region 3 for antibody 20212
ARQNDFLSGPGEFDP

SEQ ID NO: 40425 - protein, 9 aa, Homo sapiens
  light chain complementarity determining region 3 for antibody 20213
PQYGSSPRP

SEQ ID NO: 40426 - protein, 25 aa, Homo sapiens
  heavy chain complementarity determining region 3 for antibody 20213
ARLRIDRLRLPGAMRGPLYDCGLNV

SEQ ID NO: 40427 - protein, 10 aa, Homo sapiens
  light chain complementarity determining region 3 for antibody 20214
PQYGSSPMYS

SEQ ID NO: 40428 - protein, 11 aa, Homo sapiens
  heavy chain complementarity determining region 3 for antibody 20214
ARGGQWGSLDY

SEQ ID NO: 40429 - protein, 9 aa, Homo sapiens
  light chain complementarity determining region 3 for antibody 20215
PQYGNLPRT

SEQ ID NO: 40430 - protein, 13 aa, Homo sapiens
  heavy chain complementarity determining region 3 for antibody 20215
AGGDFHSGGYSEF

SEQ ID NO: 40431 - protein, 9 aa, Homo sapiens
  light chain complementarity determining region 3 for antibody 20216
PQRSSWPYT

SEQ ID NO: 40432 - protein, 11 aa, Homo sapiens
  heavy chain complementarity determining region 3 for antibody 20216
VKRWGGSSIDY

SEQ ID NO: 40433 - protein, 9 aa, Homo sapiens
  light chain complementarity determining region 3 for antibody 20217
PQRSNWPPT

SEQ ID NO: 40434 - protein, 8 aa, Homo sapiens
  heavy chain complementarity determining region 3 for antibody 20217
ATLGNDSD

SEQ ID NO: 40435 - protein, 8 aa, Homo sapiens
  light chain complementarity determining region 3 for antibody 20218
PQRNFRLT

SEQ ID NO: 40436 - protein, 13 aa, Homo sapiens
  heavy chain complementarity determining region 3 for antibody 20218
TTDAAFVPYYFTY

SEQ ID NO: 40437 - protein, 10 aa, Homo sapiens
  light chain complementarity determining region 3 for antibody 20219
PQRGIWPPIT

SEQ ID NO: 40438 - protein, 13 aa, Homo sapiens
  heavy chain complementarity determining region 3 for antibody 20219
VRELHAGAYYYDY

SEQ ID NO: 40439 - protein, 8 aa, Homo sapiens
  light chain complementarity determining region 3 for antibody 20220
PQRGHGYT

SEQ ID NO: 40440 - protein, 21 aa, Homo sapiens
  heavy chain complementarity determining region 3 for antibody 20220
AHRGGCSRGSCYGATYNWFDP

SEQ ID NO: 40441 - protein, 9 aa, Homo sapiens
  light chain complementarity determining region 3 for antibody 20221
PQHSNWPLT

SEQ ID NO: 40442 - protein, 14 aa, Homo sapiens
  heavy chain complementarity determining region 3 for antibody 20221
AKHRYDSSGYYFDY

SEQ ID NO: 40443 - protein, 9 aa, Homo sapiens
  light chain complementarity determining region 3 for antibody 20222
MQVLQVPNT

SEQ ID NO: 40444 - protein, 14 aa, Homo sapiens
  heavy chain complementarity determining region 3 for antibody 20222
TSGLVRRGARVFDI

SEQ ID NO: 40445 - protein, 9 aa, Homo sapiens
  light chain complementarity determining region 3 for antibody 20223
MQVLQVPLT

SEQ ID NO: 40446 - protein, 14 aa, Homo sapiens
  heavy chain complementarity determining region 3 for antibody 20223
TSGLVRRGARVFDI

SEQ ID NO: 40447 - protein, 9 aa, Homo sapiens
  light chain complementarity determining region 3 for antibody 20224
MQVLQVPHT

SEQ ID NO: 40448 - protein, 14 aa, Homo sapiens
  heavy chain complementarity determining region 3 for antibody 20224
TSGLVRRGARVFDL

SEQ ID NO: 40449 - protein, 9 aa, Homo sapiens
  light chain complementarity determining region 3 for antibody 20225
MQVLQTPPT

SEQ ID NO: 40450 - protein, 19 aa, Homo sapiens
  heavy chain complementarity determining region 3 for antibody 20225
AFLLPDMYYSDGSASLLPY

SEQ ID NO: 40451 - protein, 9 aa, Homo sapiens
  light chain complementarity determining region 3 for antibody 20226
MQVLQTPNT

SEQ ID NO: 40452 - protein, 10 aa, Homo sapiens
  heavy chain complementarity determining region 3 for antibody 20226
TPGRSAWYDK

SEQ ID NO: 40453 - protein, 9 aa, Homo sapiens
  light chain complementarity determining region 3 for antibody 20227
MQVLQTPLT

SEQ ID NO: 40454 - protein, 12 aa, Homo sapiens
  heavy chain complementarity determining region 3 for antibody 20227
VKDGETNWGSGH

SEQ ID NO: 40455 - protein, 9 aa, Homo sapiens
  light chain complementarity determining region 3 for antibody 20228
MQTLQTPTT

SEQ ID NO: 40456 - protein, 16 aa, Homo sapiens
  heavy chain complementarity determining region 3 for antibody 20228
TMDVFALGLSSGCHDY

SEQ ID NO: 40457 - protein, 9 aa, Homo sapiens
  light chain complementarity determining region 3 for antibody 20229
MQTLQTPTT

SEQ ID NO: 40458 - protein, 16 aa, Homo sapiens
  heavy chain complementarity determining region 3 for antibody 20229
TMDLFALGLSSGCPDY

SEQ ID NO: 40459 - protein, 9 aa, Homo sapiens
  light chain complementarity determining region 3 for antibody 20230
MQTLKTPLT

SEQ ID NO: 40460 - protein, 18 aa, Homo sapiens
  heavy chain complementarity determining region 3 for antibody 20230
AKGFTIFGVIAGFDAFDT

SEQ ID NO: 40461 - protein, 9 aa, Homo sapiens
  light chain complementarity determining region 3 for antibody 20231
MQSVLLPQT

SEQ ID NO: 40462 - protein, 10 aa, Homo sapiens
  heavy chain complementarity determining region 3 for antibody 20231
AREVRHYFEP

SEQ ID NO: 40463 - protein, 9 aa, Homo sapiens
  light chain complementarity determining region 3 for antibody 20232
MQSVLLPQT

SEQ ID NO: 40464 - protein, 10 aa, Homo sapiens
  heavy chain complementarity determining region 3 for antibody 20232
AGEVRHYFET

SEQ ID NO: 40465 - protein, 9 aa, Homo sapiens
  light chain complementarity determining region 3 for antibody 20233
MQSTQSPPT

SEQ ID NO: 40466 - protein, 9 aa, Homo sapiens
  heavy chain complementarity determining region 3 for antibody 20233
ARGSRILHY

SEQ ID NO: 40467 - protein, 9 aa, Homo sapiens
  light chain complementarity determining region 3 for antibody 20234
MQSTHGPYT

SEQ ID NO: 40468 - protein, 10 aa, Homo sapiens
  heavy chain complementarity determining region 3 for antibody 20234
ARYSSDWESY

SEQ ID NO: 40469 - protein, 9 aa, Homo sapiens
  light chain complementarity determining region 3 for antibody 20235
MQSRGWPHT

SEQ ID NO: 40470 - protein, 8 aa, Homo sapiens
  heavy chain complementarity determining region 3 for antibody 20235
TAWGSSQH

SEQ ID NO: 40471 - protein, 9 aa, Homo sapiens
  light chain complementarity determining region 3 for antibody 20236
MQSLQTPRA

SEQ ID NO: 40472 - protein, 18 aa, Homo sapiens
  heavy chain complementarity determining region 3 for antibody 20236
AIGYYGSGSYYTCYGFDP

SEQ ID NO: 40473 - protein, 9 aa, Homo sapiens
  light chain complementarity determining region 3 for antibody 20237
MQSLQTPLT

SEQ ID NO: 40474 - protein, 10 aa, Homo sapiens
  heavy chain complementarity determining region 3 for antibody 20237
ARDVGYRPNY

SEQ ID NO: 40475 - protein, 9 aa, Homo sapiens
  light chain complementarity determining region 3 for antibody 20238
MQSGLLPQT

SEQ ID NO: 40476 - protein, 10 aa, Homo sapiens
  heavy chain complementarity determining region 3 for antibody 20238
AREVRHYFET

SEQ ID NO: 40477 - protein, 9 aa, Homo sapiens
  light chain complementarity determining region 3 for antibody 20239
MQPLQTPRT

SEQ ID NO: 40478 - protein, 30 aa, Homo sapiens
  heavy chain complementarity determining region 3 for antibody 20239
ARGVPRRLRFMDAFGSGTNLPQPPVEWFDP

SEQ ID NO: 40479 - protein, 9 aa, Homo sapiens
  light chain complementarity determining region 3 for antibody 20240
MQPLQTPLT

SEQ ID NO: 40480 - protein, 23 aa, Homo sapiens
  heavy chain complementarity determining region 3 for antibody 20240
ATGGRSSSWSRGLPPKYYYGMDV

SEQ ID NO: 40481 - protein, 9 aa, Homo sapiens
  light chain complementarity determining region 3 for antibody 20241
MQPLQFPLT

SEQ ID NO: 40482 - protein, 12 aa, Homo sapiens
  heavy chain complementarity determining region 3 for antibody 20241
VKMGDSPRLFDH

SEQ ID NO: 40483 - protein, 9 aa, Homo sapiens
  light chain complementarity determining region 3 for antibody 20242
MQPLQFPIT

SEQ ID NO: 40484 - protein, 12 aa, Homo sapiens
  heavy chain complementarity determining region 3 for antibody 20242
VKMGDSPRLFDH

SEQ ID NO: 40485 - protein, 8 aa, Homo sapiens
  light chain complementarity determining region 3 for antibody 20243
MQGTPWPT

SEQ ID NO: 40486 - protein, 21 aa, Homo sapiens
  heavy chain complementarity determining region 3 for antibody 20243
AKDRPNYYESNGQYYTPKGDL

SEQ ID NO: 40487 - protein, 8 aa, Homo sapiens
  light chain complementarity determining region 3 for antibody 20244
MQGTNWPT

SEQ ID NO: 40488 - protein, 21 aa, Homo sapiens
  heavy chain complementarity determining region 3 for antibody 20244
AKDRPNYYESNGQYYTPKGDL

SEQ ID NO: 40489 - protein, 10 aa, Homo sapiens
  light chain complementarity determining region 3 for antibody 20245
MQGTNWPPYT

SEQ ID NO: 40490 - protein, 13 aa, Homo sapiens
  heavy chain complementarity determining region 3 for antibody 20245
VRDWAIWHQEFDL

SEQ ID NO: 40491 - protein, 9 aa, Homo sapiens
  light chain complementarity determining region 3 for antibody 20246
MQGTNWPLE

SEQ ID NO: 40492 - protein, 18 aa, Homo sapiens
  heavy chain complementarity determining region 3 for antibody 20246
ARDERDTCTTDLCYYFDY

SEQ ID NO: 40493 - protein, 8 aa, Homo sapiens
  light chain complementarity determining region 3 for antibody 20247
MQGTHWPT

SEQ ID NO: 40494 - protein, 21 aa, Homo sapiens
  heavy chain complementarity determining region 3 for antibody 20247
AKDRPNYYESNGQYYPPKGDL

SEQ ID NO: 40495 - protein, 8 aa, Homo sapiens
  light chain complementarity determining region 3 for antibody 20248
MQGTHWPT

SEQ ID NO: 40496 - protein, 21 aa, Homo sapiens
  heavy chain complementarity determining region 3 for antibody 20248
AKDRPNYYESNGQSYTPKGDL

SEQ ID NO: 40497 - protein, 9 aa, Homo sapiens
  light chain complementarity determining region 3 for antibody 20249
MQGTHWPRT

SEQ ID NO: 40498 - protein, 11 aa, Homo sapiens
  heavy chain complementarity determining region 3 for antibody 20249
SRGNSSSWYDY

SEQ ID NO: 40499 - protein, 9 aa, Homo sapiens
  light chain complementarity determining region 3 for antibody 20250
MQGTHWPRT

SEQ ID NO: 40500 - protein, 15 aa, Homo sapiens
  heavy chain complementarity determining region 3 for antibody 20250
ASTSFPRAHSWYFDY

SEQ ID NO: 40501 - protein, 11 aa, Homo sapiens
  light chain complementarity determining region 3 for antibody 20251
MQGTHWPPMYT

SEQ ID NO: 40502 - protein, 17 aa, Homo sapiens
  heavy chain complementarity determining region 3 for antibody 20251
ARGGSGYYQEGDDPFGF

SEQ ID NO: 40503 - protein, 11 aa, Homo sapiens
  light chain complementarity determining region 3 for antibody 20252
MQGTHWPPMHT

SEQ ID NO: 40504 - protein, 17 aa, Homo sapiens
  heavy chain complementarity determining region 3 for antibody 20252
ARGGSGYYQEGDDTFGF

SEQ ID NO: 40505 - protein, 9 aa, Homo sapiens
  light chain complementarity determining region 3 for antibody 20253
MQGTHWPLT

SEQ ID NO: 40506 - protein, 28 aa, Homo sapiens
  heavy chain complementarity determining region 3 for antibody 20253
MRFPDEPDEMDYEVDYYDSIDFAGDFQH

SEQ ID NO: 40507 - protein, 9 aa, Homo sapiens
  light chain complementarity determining region 3 for antibody 20254
MQGTHWPKR

SEQ ID NO: 40508 - protein, 11 aa, Homo sapiens
  heavy chain complementarity determining region 3 for antibody 20254
SRGNSSSWYDY

SEQ ID NO: 40509 - protein, 11 aa, Homo sapiens
  light chain complementarity determining region 3 for antibody 20255
MQGTHLVPPFP

SEQ ID NO: 40510 - protein, 16 aa, Homo sapiens
  heavy chain complementarity determining region 3 for antibody 20255
ARENSILYNYYSGVDV

SEQ ID NO: 40511 - protein, 9 aa, Homo sapiens
  light chain complementarity determining region 3 for antibody 20256
MQGTHGPPT

SEQ ID NO: 40512 - protein, 15 aa, Homo sapiens
  heavy chain complementarity determining region 3 for antibody 20256
AKSSGRKIAVAGFDS

SEQ ID NO: 40513 - protein, 11 aa, Homo sapiens
  light chain complementarity determining region 3 for antibody 20257
MQGTHGPPMYT

SEQ ID NO: 40514 - protein, 17 aa, Homo sapiens
  heavy chain complementarity determining region 3 for antibody 20257
ARGGSGYYQEGDDTFGF

SEQ ID NO: 40515 - protein, 9 aa, Homo sapiens
  light chain complementarity determining region 3 for antibody 20258
MQGTHGPLE

SEQ ID NO: 40516 - protein, 18 aa, Homo sapiens
  heavy chain complementarity determining region 3 for antibody 20258
ARDERDTCTTDLCYYFDY

SEQ ID NO: 40517 - protein, 8 aa, Homo sapiens
  light chain complementarity determining region 3 for antibody 20259
MQGTDWRP

SEQ ID NO: 40518 - protein, 10 aa, Homo sapiens
  heavy chain complementarity determining region 3 for antibody 20259
ARDTPGDLDY

SEQ ID NO: 40519 - protein, 8 aa, Homo sapiens
  light chain complementarity determining region 3 for antibody 20260
MQGTDWPT

SEQ ID NO: 40520 - protein, 21 aa, Homo sapiens
  heavy chain complementarity determining region 3 for antibody 20260
AKDRPSYYGSDGQYYTPKGDL

SEQ ID NO: 40521 - protein, 8 aa, Homo sapiens
  light chain complementarity determining region 3 for antibody 20261
MQGTDWPT

SEQ ID NO: 40522 - protein, 21 aa, Homo sapiens
  heavy chain complementarity determining region 3 for antibody 20261
AKDRPNYYGSDGQYCTPKGDL

SEQ ID NO: 40523 - protein, 8 aa, Homo sapiens
  light chain complementarity determining region 3 for antibody 20262
MQGTDWPT

SEQ ID NO: 40524 - protein, 21 aa, Homo sapiens
  heavy chain complementarity determining region 3 for antibody 20262
AKDRPNYYGSDCQYYTPKGDL

SEQ ID NO: 40525 - protein, 9 aa, Homo sapiens
  light chain complementarity determining region 3 for antibody 20263
MQGSNWPPT

SEQ ID NO: 40526 - protein, 13 aa, Homo sapiens
  heavy chain complementarity determining region 3 for antibody 20263
VRDLGDGYNSIDY

SEQ ID NO: 40527 - protein, 9 aa, Homo sapiens
  light chain complementarity determining region 3 for antibody 20264
MQGLRTPWT

SEQ ID NO: 40528 - protein, 23 aa, Homo sapiens
  heavy chain complementarity determining region 3 for antibody 20264
ARERAYASGPYYSPLYYYYGVDT

SEQ ID NO: 40529 - protein, 9 aa, Homo sapiens
  light chain complementarity determining region 3 for antibody 20265
MQGLRTPRT

SEQ ID NO: 40530 - protein, 23 aa, Homo sapiens
  heavy chain complementarity determining region 3 for antibody 20265
ARERAYASGPYYSPLSYYYGVDT

SEQ ID NO: 40531 - protein, 9 aa, Homo sapiens
  light chain complementarity determining region 3 for antibody 20266
MQGLQTPDT

SEQ ID NO: 40532 - protein, 10 aa, Homo sapiens
  heavy chain complementarity determining region 3 for antibody 20266
GSDLTGARDH

SEQ ID NO: 40533 - protein, 9 aa, Homo sapiens
  light chain complementarity determining region 3 for antibody 20267
MQGLETPFT

SEQ ID NO: 40534 - protein, 15 aa, Homo sapiens
  heavy chain complementarity determining region 3 for antibody 20267
VRHYRVPVAGIEGDS

SEQ ID NO: 40535 - protein, 9 aa, Homo sapiens
  light chain complementarity determining region 3 for antibody 20268
MQGLETPFT

SEQ ID NO: 40536 - protein, 15 aa, Homo sapiens
  heavy chain complementarity determining region 3 for antibody 20268
VRHYRITVAAVEGDS

SEQ ID NO: 40537 - protein, 9 aa, Homo sapiens
  light chain complementarity determining region 3 for antibody 20269
MQGLETPFT

SEQ ID NO: 40538 - protein, 15 aa, Homo sapiens
  heavy chain complementarity determining region 3 for antibody 20269
VRHYRELATGIEGDS

SEQ ID NO: 40539 - protein, 8 aa, Homo sapiens
  light chain complementarity determining region 3 for antibody 20270
MQGKHWPT

SEQ ID NO: 40540 - protein, 21 aa, Homo sapiens
  heavy chain complementarity determining region 3 for antibody 20270
AKDRPNYYESNGQYYTPKGDL

SEQ ID NO: 40541 - protein, 9 aa, Homo sapiens
  light chain complementarity determining region 3 for antibody 20271
MQGINWPWT

SEQ ID NO: 40542 - protein, 7 aa, Homo sapiens
  heavy chain complementarity determining region 3 for antibody 20271
ARGWGAY

SEQ ID NO: 40543 - protein, 9 aa, Homo sapiens
  light chain complementarity determining region 3 for antibody 20272
MQDLETPFT

SEQ ID NO: 40544 - protein, 15 aa, Homo sapiens
  heavy chain complementarity determining region 3 for antibody 20272
VRHYRLTVAGIEGDS

SEQ ID NO: 40545 - protein, 9 aa, Homo sapiens
  light chain complementarity determining region 3 for antibody 20273
MQAVETPFT

SEQ ID NO: 40546 - protein, 15 aa, Homo sapiens
  heavy chain complementarity determining region 3 for antibody 20273
VRHYRIITAPLEGDS

SEQ ID NO: 40547 - protein, 9 aa, Homo sapiens
  light chain complementarity determining region 3 for antibody 20274
MQATYWPWR

SEQ ID NO: 40548 - protein, 11 aa, Homo sapiens
  heavy chain complementarity determining region 3 for antibody 20274
LSAVRGSSFDI

SEQ ID NO: 40549 - protein, 9 aa, Homo sapiens
  light chain complementarity determining region 3 for antibody 20275
MQATYGPGT

SEQ ID NO: 40550 - protein, 11 aa, Homo sapiens
  heavy chain complementarity determining region 3 for antibody 20275
LSAVRGSSFDI

SEQ ID NO: 40551 - protein, 9 aa, Homo sapiens
  light chain complementarity determining region 3 for antibody 20276
MQATQIPGR

SEQ ID NO: 40552 - protein, 7 aa, Homo sapiens
  heavy chain complementarity determining region 3 for antibody 20276
LGGGVDY

SEQ ID NO: 40553 - protein, 9 aa, Homo sapiens
  light chain complementarity determining region 3 for antibody 20277
MQATPIPGT

SEQ ID NO: 40554 - protein, 7 aa, Homo sapiens
  heavy chain complementarity determining region 3 for antibody 20277
LGGGVDY

SEQ ID NO: 40555 - protein, 9 aa, Homo sapiens
  light chain complementarity determining region 3 for antibody 20278
MQATNWPIT

SEQ ID NO: 40556 - protein, 16 aa, Homo sapiens
  heavy chain complementarity determining region 3 for antibody 20278
ARGSAVEDRAGSAFDN

SEQ ID NO: 40557 - protein, 9 aa, Homo sapiens
  light chain complementarity determining region 3 for antibody 20279
MQASQFPYP

SEQ ID NO: 40558 - protein, 12 aa, Homo sapiens
  heavy chain complementarity determining region 3 for antibody 20279
TRGLFGVSGVDY

SEQ ID NO: 40559 - protein, 9 aa, Homo sapiens
  light chain complementarity determining region 3 for antibody 20280
MQASKFPYT

SEQ ID NO: 40560 - protein, 12 aa, Homo sapiens
  heavy chain complementarity determining region 3 for antibody 20280
TRGLFGVSGVDY

SEQ ID NO: 40561 - protein, 9 aa, Homo sapiens
  light chain complementarity determining region 3 for antibody 20281
MQARETPFT

SEQ ID NO: 40562 - protein, 15 aa, Homo sapiens
  heavy chain complementarity determining region 3 for antibody 20281
VRHYRIITAPLEGDS

SEQ ID NO: 40563 - protein, 9 aa, Homo sapiens
  light chain complementarity determining region 3 for antibody 20282
MQALQTVHP

SEQ ID NO: 40564 - protein, 17 aa, Homo sapiens
  heavy chain complementarity determining region 3 for antibody 20282
ARDVGRHCSGSGCHHDY

SEQ ID NO: 40565 - protein, 8 aa, Homo sapiens
  light chain complementarity determining region 3 for antibody 20283
MQALQTPS

SEQ ID NO: 40566 - protein, 15 aa, Homo sapiens
  heavy chain complementarity determining region 3 for antibody 20283
ARRDYYDSSGYRLDY

SEQ ID NO: 40567 - protein, 8 aa, Homo sapiens
  light chain complementarity determining region 3 for antibody 20284
MQALQTPF

SEQ ID NO: 40568 - protein, 15 aa, Homo sapiens
  heavy chain complementarity determining region 3 for antibody 20284
AKDYGGNSYYYGMDV

SEQ ID NO: 40569 - protein, 9 aa, Homo sapiens
  light chain complementarity determining region 3 for antibody 20285
MQALQTGPT

SEQ ID NO: 40570 - protein, 17 aa, Homo sapiens
  heavy chain complementarity determining region 3 for antibody 20285
ARDVGRHCSGSGCHHDY

SEQ ID NO: 40571 - protein, 9 aa, Homo sapiens
  light chain complementarity determining region 3 for antibody 20286
MQALQPPST

SEQ ID NO: 40572 - protein, 20 aa, Homo sapiens
  heavy chain complementarity determining region 3 for antibody 20286
ARLYCGSTTCYENYYYGLDV

SEQ ID NO: 40573 - protein, 9 aa, Homo sapiens
  light chain complementarity determining region 3 for antibody 20287
MQALQAPWT

SEQ ID NO: 40574 - protein, 11 aa, Homo sapiens
  heavy chain complementarity determining region 3 for antibody 20287
ARQPDPPTPTP

SEQ ID NO: 40575 - protein, 9 aa, Homo sapiens
  light chain complementarity determining region 3 for antibody 20288
MQALKTPFT

SEQ ID NO: 40576 - protein, 15 aa, Homo sapiens
  heavy chain complementarity determining region 3 for antibody 20288
VRHYRELATGIEGDS

SEQ ID NO: 40577 - protein, 8 aa, Homo sapiens
  light chain complementarity determining region 3 for antibody 20289
MQALHTPT

SEQ ID NO: 40578 - protein, 15 aa, Homo sapiens
  heavy chain complementarity determining region 3 for antibody 20289
ARRDYYDSSGYRLDY

SEQ ID NO: 40579 - protein, 9 aa, Homo sapiens
  light chain complementarity determining region 3 for antibody 20290
MQALHAPGT

SEQ ID NO: 40580 - protein, 22 aa, Homo sapiens
  heavy chain complementarity determining region 3 for antibody 20290
ARLTGVVKQQVGYYYYYYGMDV

SEQ ID NO: 40581 - protein, 9 aa, Homo sapiens
  light chain complementarity determining region 3 for antibody 20291
MQALGTPFT

SEQ ID NO: 40582 - protein, 15 aa, Homo sapiens
  heavy chain complementarity determining region 3 for antibody 20291
VRHYRVPVAGIEGDS

SEQ ID NO: 40583 - protein, 9 aa, Homo sapiens
  light chain complementarity determining region 3 for antibody 20292
MQALGTPFT

SEQ ID NO: 40584 - protein, 15 aa, Homo sapiens
  heavy chain complementarity determining region 3 for antibody 20292
VRHYRELATGFEGDS

SEQ ID NO: 40585 - protein, 9 aa, Homo sapiens
  light chain complementarity determining region 3 for antibody 20293
MQALGTPFT

SEQ ID NO: 40586 - protein, 15 aa, Homo sapiens
  heavy chain complementarity determining region 3 for antibody 20293
LRHYRSLVTGTEADS

SEQ ID NO: 40587 - protein, 9 aa, Homo sapiens
  light chain complementarity determining region 3 for antibody 20294
MQALETQLT

SEQ ID NO: 40588 - protein, 15 aa, Homo sapiens
  heavy chain complementarity determining region 3 for antibody 20294
VRHYRETVAGIEGDS

SEQ ID NO: 40589 - protein, 9 aa, Homo sapiens
  light chain complementarity determining region 3 for antibody 20295
MQALETQFT

SEQ ID NO: 40590 - protein, 15 aa, Homo sapiens
  heavy chain complementarity determining region 3 for antibody 20295
VRHYRLTVAGIEGDS

SEQ ID NO: 40591 - protein, 9 aa, Homo sapiens
  light chain complementarity determining region 3 for antibody 20296
MQALETPLT

SEQ ID NO: 40592 - protein, 15 aa, Homo sapiens
  heavy chain complementarity determining region 3 for antibody 20296
VRHYRLTVAGIEGDS

SEQ ID NO: 40593 - protein, 9 aa, Homo sapiens
  light chain complementarity determining region 3 for antibody 20297
MQALETPLP

SEQ ID NO: 40594 - protein, 15 aa, Homo sapiens
  heavy chain complementarity determining region 3 for antibody 20297
VRHYRITVAAVEGDS

SEQ ID NO: 40595 - protein, 9 aa, Homo sapiens
  light chain complementarity determining region 3 for antibody 20298
MQALETPLN

SEQ ID NO: 40596 - protein, 15 aa, Homo sapiens
  heavy chain complementarity determining region 3 for antibody 20298
VRHYRETVAGIEGDS

SEQ ID NO: 40597 - protein, 9 aa, Homo sapiens
  light chain complementarity determining region 3 for antibody 20299
MQALETPFT

SEQ ID NO: 40598 - protein, 15 aa, Homo sapiens
  heavy chain complementarity determining region 3 for antibody 20299
VSHYRLTVAGIEGDS

SEQ ID NO: 40599 - protein, 9 aa, Homo sapiens
  light chain complementarity determining region 3 for antibody 20300
MQALETPFT

SEQ ID NO: 40600 - protein, 15 aa, Homo sapiens
  heavy chain complementarity determining region 3 for antibody 20300
VRQYRLTVAGIEGDS

SEQ ID NO: 40601 - protein, 9 aa, Homo sapiens
  light chain complementarity determining region 3 for antibody 20301
MQALETPFT

SEQ ID NO: 40602 - protein, 15 aa, Homo sapiens
  heavy chain complementarity determining region 3 for antibody 20301
VRNYRETVAGIEGDS

SEQ ID NO: 40603 - protein, 9 aa, Homo sapiens
  light chain complementarity determining region 3 for antibody 20302
MQALETPFT

SEQ ID NO: 40604 - protein, 15 aa, Homo sapiens
  heavy chain complementarity determining region 3 for antibody 20302
VRLYRIITAPLEGDS

SEQ ID NO: 40605 - protein, 9 aa, Homo sapiens
  light chain complementarity determining region 3 for antibody 20303
MQALETPFT

SEQ ID NO: 40606 - protein, 15 aa, Homo sapiens
  heavy chain complementarity determining region 3 for antibody 20303
VRHYRRTVAAVEGDS

SEQ ID NO: 40607 - protein, 9 aa, Homo sapiens
  light chain complementarity determining region 3 for antibody 20304
MQALETPFT

SEQ ID NO: 40608 - protein, 15 aa, Homo sapiens
  heavy chain complementarity determining region 3 for antibody 20304
VRHYRIMTAPLEGDS

SEQ ID NO: 40609 - protein, 9 aa, Homo sapiens
  light chain complementarity determining region 3 for antibody 20305
MQALETPFT

SEQ ID NO: 40610 - protein, 15 aa, Homo sapiens
  heavy chain complementarity determining region 3 for antibody 20305
VRHYRILTAPLEGDS

SEQ ID NO: 40611 - protein, 9 aa, Homo sapiens
  light chain complementarity determining region 3 for antibody 20306
MQALETPFT

SEQ ID NO: 40612 - protein, 15 aa, Homo sapiens
  heavy chain complementarity determining region 3 for antibody 20306
VRHYRIITAPLEWDS

SEQ ID NO: 40613 - protein, 9 aa, Homo sapiens
  light chain complementarity determining region 3 for antibody 20307
MQALETPFT

SEQ ID NO: 40614 - protein, 15 aa, Homo sapiens
  heavy chain complementarity determining region 3 for antibody 20307
VRHYRIITAPLEGDY

SEQ ID NO: 40615 - protein, 9 aa, Homo sapiens
  light chain complementarity determining region 3 for antibody 20308
MQALETPFT

SEQ ID NO: 40616 - protein, 15 aa, Homo sapiens
  heavy chain complementarity determining region 3 for antibody 20308
VRHYRETVDGIEGDS

SEQ ID NO: 40617 - protein, 9 aa, Homo sapiens
  light chain complementarity determining region 3 for antibody 20309
MQALETPFT

SEQ ID NO: 40618 - protein, 15 aa, Homo sapiens
  heavy chain complementarity determining region 3 for antibody 20309
VRHYRETVAGIEGDY

SEQ ID NO: 40619 - protein, 9 aa, Homo sapiens
  light chain complementarity determining region 3 for antibody 20310
MQALETPFT

SEQ ID NO: 40620 - protein, 15 aa, Homo sapiens
  heavy chain complementarity determining region 3 for antibody 20310
VRHYRETVAGIEGDP

SEQ ID NO: 40621 - protein, 9 aa, Homo sapiens
  light chain complementarity determining region 3 for antibody 20311
MQALETPFT

SEQ ID NO: 40622 - protein, 15 aa, Homo sapiens
  heavy chain complementarity determining region 3 for antibody 20311
VRHYRETVAGIECDS

SEQ ID NO: 40623 - protein, 9 aa, Homo sapiens
  light chain complementarity determining region 3 for antibody 20312
MQALETPFT

SEQ ID NO: 40624 - protein, 15 aa, Homo sapiens
  heavy chain complementarity determining region 3 for antibody 20312
VRHYRELTTGSEGDS

SEQ ID NO: 40625 - protein, 9 aa, Homo sapiens
  light chain complementarity determining region 3 for antibody 20313
MQALETPFT

SEQ ID NO: 40626 - protein, 15 aa, Homo sapiens
  heavy chain complementarity determining region 3 for antibody 20313
VRHYRELTTGIGGDS

SEQ ID NO: 40627 - protein, 9 aa, Homo sapiens
  light chain complementarity determining region 3 for antibody 20314
MQALETPFT

SEQ ID NO: 40628 - protein, 15 aa, Homo sapiens
  heavy chain complementarity determining region 3 for antibody 20314
VRHYRELATGCEGDS

SEQ ID NO: 40629 - protein, 9 aa, Homo sapiens
  light chain complementarity determining region 3 for antibody 20315
MQALETPFT

SEQ ID NO: 40630 - protein, 15 aa, Homo sapiens
  heavy chain complementarity determining region 3 for antibody 20315
VRHYMETVAGIEGDS

SEQ ID NO: 40631 - protein, 9 aa, Homo sapiens
  light chain complementarity determining region 3 for antibody 20316
MQALETPFT

SEQ ID NO: 40632 - protein, 15 aa, Homo sapiens
  heavy chain complementarity determining region 3 for antibody 20316
VRHYGIITAPLEGDS

SEQ ID NO: 40633 - protein, 9 aa, Homo sapiens
  light chain complementarity determining region 3 for antibody 20317
MQALETPFT

SEQ ID NO: 40634 - protein, 15 aa, Homo sapiens
  heavy chain complementarity determining region 3 for antibody 20317
VRHSRETVAGIEGDS

SEQ ID NO: 40635 - protein, 9 aa, Homo sapiens
  light chain complementarity determining region 3 for antibody 20318
MQALETPFT

SEQ ID NO: 40636 - protein, 14 aa, Homo sapiens
  heavy chain complementarity determining region 3 for antibody 20318
VKDHVMNTVTTAGY

SEQ ID NO: 40637 - protein, 9 aa, Homo sapiens
  light chain complementarity determining region 3 for antibody 20319
MQALETPFT

SEQ ID NO: 40638 - protein, 14 aa, Homo sapiens
  heavy chain complementarity determining region 3 for antibody 20319
VKDHLMNPVTTAGY

SEQ ID NO: 40639 - protein, 9 aa, Homo sapiens
  light chain complementarity determining region 3 for antibody 20320
MQALETPFT

SEQ ID NO: 40640 - protein, 15 aa, Homo sapiens
  heavy chain complementarity determining region 3 for antibody 20320
VGHYRIITAPLEGDS

SEQ ID NO: 40641 - protein, 9 aa, Homo sapiens
  light chain complementarity determining region 3 for antibody 20321
MQALETPFT

SEQ ID NO: 40642 - protein, 15 aa, Homo sapiens
  heavy chain complementarity determining region 3 for antibody 20321
DRHYRETVAGIEGDS

SEQ ID NO: 40643 - protein, 9 aa, Homo sapiens
  light chain complementarity determining region 3 for antibody 20322
MQALETPFT

SEQ ID NO: 40644 - protein, 15 aa, Homo sapiens
  heavy chain complementarity determining region 3 for antibody 20322
ARHYRIITAPLEGDS

SEQ ID NO: 40645 - protein, 9 aa, Homo sapiens
  light chain complementarity determining region 3 for antibody 20323
MQALETPFS

SEQ ID NO: 40646 - protein, 15 aa, Homo sapiens
  heavy chain complementarity determining region 3 for antibody 20323
VRHYRIITAPLEGDS

SEQ ID NO: 40647 - protein, 9 aa, Homo sapiens
  light chain complementarity determining region 3 for antibody 20324
MQALETPFA

SEQ ID NO: 40648 - protein, 15 aa, Homo sapiens
  heavy chain complementarity determining region 3 for antibody 20324
VRHYRIITAPLEGDS

SEQ ID NO: 40649 - protein, 9 aa, Homo sapiens
  light chain complementarity determining region 3 for antibody 20325
MQALETPCT

SEQ ID NO: 40650 - protein, 15 aa, Homo sapiens
  heavy chain complementarity determining region 3 for antibody 20325
VRHYRELATGIEGDS

SEQ ID NO: 40651 - protein, 9 aa, Homo sapiens
  light chain complementarity determining region 3 for antibody 20326
MQALEPPST

SEQ ID NO: 40652 - protein, 15 aa, Homo sapiens
  heavy chain complementarity determining region 3 for antibody 20326
VRHYRIITAPLEGDS

SEQ ID NO: 40653 - protein, 9 aa, Homo sapiens
  light chain complementarity determining region 3 for antibody 20327
MQALELPFT

SEQ ID NO: 40654 - protein, 15 aa, Homo sapiens
  heavy chain complementarity determining region 3 for antibody 20327
VRHYRIITAPLEGDS

SEQ ID NO: 40655 - protein, 9 aa, Homo sapiens
  light chain complementarity determining region 3 for antibody 20328
MQALELPFT

SEQ ID NO: 40656 - protein, 15 aa, Homo sapiens
  heavy chain complementarity determining region 3 for antibody 20328
VRHYRETVAGIEGDS

SEQ ID NO: 40657 - protein, 9 aa, Homo sapiens
  light chain complementarity determining region 3 for antibody 20329
MQALEIPFT

SEQ ID NO: 40658 - protein, 15 aa, Homo sapiens
  heavy chain complementarity determining region 3 for antibody 20329
VRHYRITVAAVEGDS

SEQ ID NO: 40659 - protein, 9 aa, Homo sapiens
  light chain complementarity determining region 3 for antibody 20330
MQALDTPFT

SEQ ID NO: 40660 - protein, 15 aa, Homo sapiens
  heavy chain complementarity determining region 3 for antibody 20330
VRHYRITVAAVEGDS

SEQ ID NO: 40661 - protein, 9 aa, Homo sapiens
  light chain complementarity determining region 3 for antibody 20331
MQALDTPFT

SEQ ID NO: 40662 - protein, 15 aa, Homo sapiens
  heavy chain complementarity determining region 3 for antibody 20331
VRHYRELTTGIEGDS

SEQ ID NO: 40663 - protein, 9 aa, Homo sapiens
  light chain complementarity determining region 3 for antibody 20332
MQALATPFT

SEQ ID NO: 40664 - protein, 15 aa, Homo sapiens
  heavy chain complementarity determining region 3 for antibody 20332
VRHYRELATGFEGDS

SEQ ID NO: 40665 - protein, 9 aa, Homo sapiens
  light chain complementarity determining region 3 for antibody 20333
MQAIETPFT

SEQ ID NO: 40666 - protein, 15 aa, Homo sapiens
  heavy chain complementarity determining region 3 for antibody 20333
VRHYRELATGIEGDS

SEQ ID NO: 40667 - protein, 9 aa, Homo sapiens
  light chain complementarity determining region 3 for antibody 20334
MPALQAPWT

SEQ ID NO: 40668 - protein, 11 aa, Homo sapiens
  heavy chain complementarity determining region 3 for antibody 20334
ARQPDPTTPTP

SEQ ID NO: 40669 - protein, 9 aa, Homo sapiens
  light chain complementarity determining region 3 for antibody 20335
MPALETPLT

SEQ ID NO: 40670 - protein, 15 aa, Homo sapiens
  heavy chain complementarity determining region 3 for antibody 20335
VRHYRIITAPLEGDS

SEQ ID NO: 40671 - protein, 9 aa, Homo sapiens
  light chain complementarity determining region 3 for antibody 20336
MPALETPFT

SEQ ID NO: 40672 - protein, 15 aa, Homo sapiens
  heavy chain complementarity determining region 3 for antibody 20336
VSHYRETVAGIEGDS

SEQ ID NO: 40673 - protein, 9 aa, Homo sapiens
  light chain complementarity determining region 3 for antibody 20337
MPALETPFT

SEQ ID NO: 40674 - protein, 15 aa, Homo sapiens
  heavy chain complementarity determining region 3 for antibody 20337
LRHYRSLVTGTEADS

SEQ ID NO: 40675 - protein, 9 aa, Homo sapiens
  light chain complementarity determining region 3 for antibody 20338
MKVLQVPHT

SEQ ID NO: 40676 - protein, 14 aa, Homo sapiens
  heavy chain complementarity determining region 3 for antibody 20338
TSGLVRRGARVFDI

SEQ ID NO: 40677 - protein, 9 aa, Homo sapiens
  light chain complementarity determining region 3 for antibody 20339
MHSRRWPHT

SEQ ID NO: 40678 - protein, 8 aa, Homo sapiens
  heavy chain complementarity determining region 3 for antibody 20339
TAWGSSQH

SEQ ID NO: 40679 - protein, 9 aa, Homo sapiens
  light chain complementarity determining region 3 for antibody 20340
MHGTHWPLT

SEQ ID NO: 40680 - protein, 11 aa, Homo sapiens
  heavy chain complementarity determining region 3 for antibody 20340
ARGVLDPAFAV

SEQ ID NO: 40681 - protein, 9 aa, Homo sapiens
  light chain complementarity determining region 3 for antibody 20341
MHGLQTPYT

SEQ ID NO: 40682 - protein, 18 aa, Homo sapiens
  heavy chain complementarity determining region 3 for antibody 20341
ARQRRGGYSYGYHYGMDV

SEQ ID NO: 40683 - protein, 9 aa, Homo sapiens
  light chain complementarity determining region 3 for antibody 20342
MHALETPFT

SEQ ID NO: 40684 - protein, 15 aa, Homo sapiens
  heavy chain complementarity determining region 3 for antibody 20342
VRHYRITVAAVEGDS

SEQ ID NO: 40685 - protein, 9 aa, Homo sapiens
  light chain complementarity determining region 3 for antibody 20343
MGTLQTPPT

SEQ ID NO: 40686 - protein, 15 aa, Homo sapiens
  heavy chain complementarity determining region 3 for antibody 20343
TRDGKRDGHNDACDI

SEQ ID NO: 40687 - protein, 9 aa, Homo sapiens
  light chain complementarity determining region 3 for antibody 20344
MGTLQTPPS

SEQ ID NO: 40688 - protein, 15 aa, Homo sapiens
  heavy chain complementarity determining region 3 for antibody 20344
TRDGKKDGHNDAFDI

SEQ ID NO: 40689 - protein, 9 aa, Homo sapiens
  light chain complementarity determining region 3 for antibody 20345
MGTLQTPPA

SEQ ID NO: 40690 - protein, 15 aa, Homo sapiens
  heavy chain complementarity determining region 3 for antibody 20345
TRDGKKDGHNDAFDF

SEQ ID NO: 40691 - protein, 9 aa, Homo sapiens
  light chain complementarity determining region 3 for antibody 20346
MGSLQTPPP

SEQ ID NO: 40692 - protein, 15 aa, Homo sapiens
  heavy chain complementarity determining region 3 for antibody 20346
TRDGKKDGHNDAFDI

SEQ ID NO: 40693 - protein, 9 aa, Homo sapiens
  light chain complementarity determining region 3 for antibody 20347
MEVVQSPWR

SEQ ID NO: 40694 - protein, 18 aa, Homo sapiens
  heavy chain complementarity determining region 3 for antibody 20347
IRGGRMYCSGEPCYSGSL

SEQ ID NO: 40695 - protein, 9 aa, Homo sapiens
  light chain complementarity determining region 3 for antibody 20348
MEVVKSPWT

SEQ ID NO: 40696 - protein, 18 aa, Homo sapiens
  heavy chain complementarity determining region 3 for antibody 20348
IRGGRMYCSGEPCYSGSL

SEQ ID NO: 40697 - protein, 9 aa, Homo sapiens
  light chain complementarity determining region 3 for antibody 20349
LQYYSTPWT

SEQ ID NO: 40698 - protein, 15 aa, Homo sapiens
  heavy chain complementarity determining region 3 for antibody 20349
IRQAKVDNYYNYPDF

SEQ ID NO: 40699 - protein, 9 aa, Homo sapiens
  light chain complementarity determining region 3 for antibody 20350
LQYKSYPRT

SEQ ID NO: 40700 - protein, 6 aa, Homo sapiens
  heavy chain complementarity determining region 3 for antibody 20350
SRAFDY

SEQ ID NO: 40701 - protein, 9 aa, Homo sapiens
  light chain complementarity determining region 3 for antibody 20351
LQYKIYPRT

SEQ ID NO: 40702 - protein, 6 aa, Homo sapiens
  heavy chain complementarity determining region 3 for antibody 20351
SRAFDY

SEQ ID NO: 40703 - protein, 9 aa, Homo sapiens
  light chain complementarity determining region 3 for antibody 20352
LQYGGTPLK

SEQ ID NO: 40704 - protein, 8 aa, Homo sapiens
  heavy chain complementarity determining region 3 for antibody 20352
VRIMDPGY

SEQ ID NO: 40705 - protein, 9 aa, Homo sapiens
  light chain complementarity determining region 3 for antibody 20353
LQYGFEQYS

SEQ ID NO: 40706 - protein, 18 aa, Homo sapiens
  heavy chain complementarity determining region 3 for antibody 20353
TGVHGLTMLRGATKPFDF

SEQ ID NO: 40707 - protein, 9 aa, Homo sapiens
  light chain complementarity determining region 3 for antibody 20354
LQYGFAQYS

SEQ ID NO: 40708 - protein, 18 aa, Homo sapiens
  heavy chain complementarity determining region 3 for antibody 20354
TGVHGLTMLRGATKPFDL

SEQ ID NO: 40709 - protein, 9 aa, Homo sapiens
  light chain complementarity determining region 3 for antibody 20355
LQVLQVPHT

SEQ ID NO: 40710 - protein, 14 aa, Homo sapiens
  heavy chain complementarity determining region 3 for antibody 20355
TSGLVRRGARVFDI

SEQ ID NO: 40711 - protein, 9 aa, Homo sapiens
  light chain complementarity determining region 3 for antibody 20356
LQSRRWPHT

SEQ ID NO: 40712 - protein, 8 aa, Homo sapiens
  heavy chain complementarity determining region 3 for antibody 20356
TAWGSSQH

SEQ ID NO: 40713 - protein, 9 aa, Homo sapiens
  light chain complementarity determining region 3 for antibody 20357
LQSIHGPGT

SEQ ID NO: 40714 - protein, 11 aa, Homo sapiens
  heavy chain complementarity determining region 3 for antibody 20357
GRHIRRSPEDY

SEQ ID NO: 40715 - protein, 9 aa, Homo sapiens
  light chain complementarity determining region 3 for antibody 20358
LQSHSRPFT

SEQ ID NO: 40716 - protein, 17 aa, Homo sapiens
  heavy chain complementarity determining region 3 for antibody 20358
AKDHFPFAAGRRGGVDY

SEQ ID NO: 40717 - protein, 8 aa, Homo sapiens
  light chain complementarity determining region 3 for antibody 20359
LQRSDGYP

SEQ ID NO: 40718 - protein, 13 aa, Homo sapiens
  heavy chain complementarity determining region 3 for antibody 20359
ATNSGSYPNYLDP

SEQ ID NO: 40719 - protein, 9 aa, Homo sapiens
  light chain complementarity determining region 3 for antibody 20360
LQRIHWPGT

SEQ ID NO: 40720 - protein, 11 aa, Homo sapiens
  heavy chain complementarity determining region 3 for antibody 20360
GRHIRRSPEDY

SEQ ID NO: 40721 - protein, 9 aa, Homo sapiens
  light chain complementarity determining region 3 for antibody 20361
LQPNSYPLT

SEQ ID NO: 40722 - protein, 13 aa, Homo sapiens
  heavy chain complementarity determining region 3 for antibody 20361
VRHTVVRPIVVDD

SEQ ID NO: 40723 - protein, 9 aa, Homo sapiens
  light chain complementarity determining region 3 for antibody 20362
LQNNTYPWT

SEQ ID NO: 40724 - protein, 18 aa, Homo sapiens
  heavy chain complementarity determining region 3 for antibody 20362
ARDGVDYAPRDYYYGLDV

SEQ ID NO: 40725 - protein, 9 aa, Homo sapiens
  light chain complementarity determining region 3 for antibody 20363
LQNNSYPLT

SEQ ID NO: 40726 - protein, 13 aa, Homo sapiens
  heavy chain complementarity determining region 3 for antibody 20363
VRHAVVRPMVVDD

SEQ ID NO: 40727 - protein, 9 aa, Homo sapiens
  light chain complementarity determining region 3 for antibody 20364
LQNNSYPLT

SEQ ID NO: 40728 - protein, 22 aa, Homo sapiens
  heavy chain complementarity determining region 3 for antibody 20364
ARDQASTVVVVSRPWEVSDLTF

SEQ ID NO: 40729 - protein, 9 aa, Homo sapiens
  light chain complementarity determining region 3 for antibody 20365
LQNEYWPRT

SEQ ID NO: 40730 - protein, 11 aa, Homo sapiens
  heavy chain complementarity determining region 3 for antibody 20365
VRVGGAGSFDH

SEQ ID NO: 40731 - protein, 9 aa, Homo sapiens
  light chain complementarity determining region 3 for antibody 20366
LQNESWPRT

SEQ ID NO: 40732 - protein, 11 aa, Homo sapiens
  heavy chain complementarity determining region 3 for antibody 20366
VRVGGAGYFDH

SEQ ID NO: 40733 - protein, 9 aa, Homo sapiens
  light chain complementarity determining region 3 for antibody 20367
LQNDNFPYS

SEQ ID NO: 40734 - protein, 12 aa, Homo sapiens
  heavy chain complementarity determining region 3 for antibody 20367
AREWDSGWYPAS

SEQ ID NO: 40735 - protein, 9 aa, Homo sapiens
  light chain complementarity determining region 3 for antibody 20368
LQHNTYPWT

SEQ ID NO: 40736 - protein, 18 aa, Homo sapiens
  heavy chain complementarity determining region 3 for antibody 20368
ARGGVDYAPRDYYYGLDV

SEQ ID NO: 40737 - protein, 9 aa, Homo sapiens
  light chain complementarity determining region 3 for antibody 20369
LQHNTYPWT

SEQ ID NO: 40738 - protein, 18 aa, Homo sapiens
  heavy chain complementarity determining region 3 for antibody 20369
ARDGVDYAPRDYYSGLDV

SEQ ID NO: 40739 - protein, 9 aa, Homo sapiens
  light chain complementarity determining region 3 for antibody 20370
LQHNTYPLT

SEQ ID NO: 40740 - protein, 7 aa, Homo sapiens
  heavy chain complementarity determining region 3 for antibody 20370
SNAHFDY

SEQ ID NO: 40741 - protein, 9 aa, Homo sapiens
  light chain complementarity determining region 3 for antibody 20371
LQHNSYPRT

SEQ ID NO: 40742 - protein, 17 aa, Homo sapiens
  heavy chain complementarity determining region 3 for antibody 20371
AKDAGGGYRYSYGAPDY

SEQ ID NO: 40743 - protein, 9 aa, Homo sapiens
  light chain complementarity determining region 3 for antibody 20372
LQHNSYPLT

SEQ ID NO: 40744 - protein, 13 aa, Homo sapiens
  heavy chain complementarity determining region 3 for antibody 20372
VRHAVVRPLVVDD

SEQ ID NO: 40745 - protein, 9 aa, Homo sapiens
  light chain complementarity determining region 3 for antibody 20373
LQHNSYPLT

SEQ ID NO: 40746 - protein, 11 aa, Homo sapiens
  heavy chain complementarity determining region 3 for antibody 20373
ATSFGDNWFDN

SEQ ID NO: 40747 - protein, 9 aa, Homo sapiens
  light chain complementarity determining region 3 for antibody 20374
LQHNSYPLT

SEQ ID NO: 40748 - protein, 22 aa, Homo sapiens
  heavy chain complementarity determining region 3 for antibody 20374
ARDQASTVVVVARPWEVSDLTF

SEQ ID NO: 40749 - protein, 9 aa, Homo sapiens
  light chain complementarity determining region 3 for antibody 20375
LQHNSYPLT

SEQ ID NO: 40750 - protein, 22 aa, Homo sapiens
  heavy chain complementarity determining region 3 for antibody 20375
ARDQASAVVVVSRPWEVSDLTF

SEQ ID NO: 40751 - protein, 9 aa, Homo sapiens
  light chain complementarity determining region 3 for antibody 20376
LQHNSYPIT

SEQ ID NO: 40752 - protein, 13 aa, Homo sapiens
  heavy chain complementarity determining region 3 for antibody 20376
VRHAVVRPMVVDD

SEQ ID NO: 40753 - protein, 9 aa, Homo sapiens
  light chain complementarity determining region 3 for antibody 20377
LQHNSYPFT

SEQ ID NO: 40754 - protein, 13 aa, Homo sapiens
  heavy chain complementarity determining region 3 for antibody 20377
VRHTVVRPIVVDD

SEQ ID NO: 40755 - protein, 9 aa, Homo sapiens
  light chain complementarity determining region 3 for antibody 20378
LQHNSYLLT

SEQ ID NO: 40756 - protein, 13 aa, Homo sapiens
  heavy chain complementarity determining region 3 for antibody 20378
VRHAVVRPMVVDD

SEQ ID NO: 40757 - protein, 9 aa, Homo sapiens
  light chain complementarity determining region 3 for antibody 20379
LQHNSFPPT

SEQ ID NO: 40758 - protein, 19 aa, Homo sapiens
  heavy chain complementarity determining region 3 for antibody 20379
ASLRYSSSWSRRLVDVFEI

SEQ ID NO: 40759 - protein, 9 aa, Homo sapiens
  light chain complementarity determining region 3 for antibody 20380
LQHNRYPFT

SEQ ID NO: 40760 - protein, 17 aa, Homo sapiens
  heavy chain complementarity determining region 3 for antibody 20380
VRDRRGRVFFGDDAFDV

SEQ ID NO: 40761 - protein, 9 aa, Homo sapiens
  light chain complementarity determining region 3 for antibody 20381
LQHNNYPPT

SEQ ID NO: 40762 - protein, 15 aa, Homo sapiens
  heavy chain complementarity determining region 3 for antibody 20381
AKVWRGNSLWYDSDY

SEQ ID NO: 40763 - protein, 9 aa, Homo sapiens
  light chain complementarity determining region 3 for antibody 20382
LQHKTYPRM

SEQ ID NO: 40764 - protein, 11 aa, Homo sapiens
  heavy chain complementarity determining region 3 for antibody 20382
TTGLSSAGVNY

SEQ ID NO: 40765 - protein, 9 aa, Homo sapiens
  light chain complementarity determining region 3 for antibody 20383
LQHDNFPYR

SEQ ID NO: 40766 - protein, 12 aa, Homo sapiens
  heavy chain complementarity determining region 3 for antibody 20383
AREWDSGWYPAS

SEQ ID NO: 40767 - protein, 9 aa, Homo sapiens
  light chain complementarity determining region 3 for antibody 20384
LQHDNFPHS

SEQ ID NO: 40768 - protein, 12 aa, Homo sapiens
  heavy chain complementarity determining region 3 for antibody 20384
AREWDSGWYPAS

SEQ ID NO: 40769 - protein, 9 aa, Homo sapiens
  light chain complementarity determining region 3 for antibody 20385
LQHDNFLVT

SEQ ID NO: 40770 - protein, 14 aa, Homo sapiens
  heavy chain complementarity determining region 3 for antibody 20385
AREDYGGNWDAFDI

SEQ ID NO: 40771 - protein, 9 aa, Homo sapiens
  light chain complementarity determining region 3 for antibody 20386
LQGTHWPPP

SEQ ID NO: 40772 - protein, 11 aa, Homo sapiens
  heavy chain complementarity determining region 3 for antibody 20386
ATGPQVTMPQD

SEQ ID NO: 40773 - protein, 9 aa, Homo sapiens
  light chain complementarity determining region 3 for antibody 20387
LQGTHGPPT

SEQ ID NO: 40774 - protein, 11 aa, Homo sapiens
  heavy chain complementarity determining region 3 for antibody 20387
ATGPQVTMPQD

SEQ ID NO: 40775 - protein, 9 aa, Homo sapiens
  light chain complementarity determining region 3 for antibody 20388
LQGNSFPPT

SEQ ID NO: 40776 - protein, 14 aa, Homo sapiens
  heavy chain complementarity determining region 3 for antibody 20388
ARYCSGNSCYSMDH

SEQ ID NO: 40777 - protein, 9 aa, Homo sapiens
  light chain complementarity determining region 3 for antibody 20389
LQGNRFPNT

SEQ ID NO: 40778 - protein, 14 aa, Homo sapiens
  heavy chain complementarity determining region 3 for antibody 20389
ARYCSGTSCYSMDY

SEQ ID NO: 40779 - protein, 9 aa, Homo sapiens
  light chain complementarity determining region 3 for antibody 20390
LQGNRFPHT

SEQ ID NO: 40780 - protein, 14 aa, Homo sapiens
  heavy chain complementarity determining region 3 for antibody 20390
ARYCSGNSCYSIDH

SEQ ID NO: 40781 - protein, 9 aa, Homo sapiens
  light chain complementarity determining region 3 for antibody 20391
LQGNRFPHT

SEQ ID NO: 40782 - protein, 14 aa, Homo sapiens
  heavy chain complementarity determining region 3 for antibody 20391
ARYCSGNSCYAMDH

SEQ ID NO: 40783 - protein, 9 aa, Homo sapiens
  light chain complementarity determining region 3 for antibody 20392
LQGNRFPHT

SEQ ID NO: 40784 - protein, 14 aa, Homo sapiens
  heavy chain complementarity determining region 3 for antibody 20392
ARYCSGNGCYSMDH

SEQ ID NO: 40785 - protein, 9 aa, Homo sapiens
  light chain complementarity determining region 3 for antibody 20393
LQGNRFPHT

SEQ ID NO: 40786 - protein, 14 aa, Homo sapiens
  heavy chain complementarity determining region 3 for antibody 20393
ARHCSGNSCYSMDH

SEQ ID NO: 40787 - protein, 9 aa, Homo sapiens
  light chain complementarity determining region 3 for antibody 20394
LQGNRFPHT

SEQ ID NO: 40788 - protein, 14 aa, Homo sapiens
  heavy chain complementarity determining region 3 for antibody 20394
ARDCSGNSCYSMDH

SEQ ID NO: 40789 - protein, 9 aa, Homo sapiens
  light chain complementarity determining region 3 for antibody 20395
LQGNRFPHT

SEQ ID NO: 40790 - protein, 14 aa, Homo sapiens
  heavy chain complementarity determining region 3 for antibody 20395
ARCCSGNSCYSMDH

SEQ ID NO: 40791 - protein, 9 aa, Homo sapiens
  light chain complementarity determining region 3 for antibody 20396
LQGNRFPHP

SEQ ID NO: 40792 - protein, 14 aa, Homo sapiens
  heavy chain complementarity determining region 3 for antibody 20396
ARYCSGSSCYSMDY

SEQ ID NO: 40793 - protein, 9 aa, Homo sapiens
  light chain complementarity determining region 3 for antibody 20397
LQGNRFPHM

SEQ ID NO: 40794 - protein, 14 aa, Homo sapiens
  heavy chain complementarity determining region 3 for antibody 20397
ARYCSGNSCYSMDH

SEQ ID NO: 40795 - protein, 9 aa, Homo sapiens
  light chain complementarity determining region 3 for antibody 20398
LQGNRFHHT

SEQ ID NO: 40796 - protein, 14 aa, Homo sapiens
  heavy chain complementarity determining region 3 for antibody 20398
ARYCSGKSCYSMDH

SEQ ID NO: 40797 - protein, 9 aa, Homo sapiens
  light chain complementarity determining region 3 for antibody 20399
LQGLQTPYT

SEQ ID NO: 40798 - protein, 18 aa, Homo sapiens
  heavy chain complementarity determining region 3 for antibody 20399
ARQRRGGYSYGYHYGMDV

SEQ ID NO: 40799 - protein, 9 aa, Homo sapiens
  light chain complementarity determining region 3 for antibody 20400
LQFQNGPLT

SEQ ID NO: 40800 - protein, 18 aa, Homo sapiens
  heavy chain complementarity determining region 3 for antibody 20400
VRGGRDSQGPLGYYGLGV

SEQ ID NO: 40801 - protein, 9 aa, Homo sapiens
  light chain complementarity determining region 3 for antibody 20401
LQFHNVPLT

SEQ ID NO: 40802 - protein, 18 aa, Homo sapiens
  heavy chain complementarity determining region 3 for antibody 20401
VRGGRDSQGPLGYYGLGV

SEQ ID NO: 40803 - protein, 9 aa, Homo sapiens
  light chain complementarity determining region 3 for antibody 20402
LQDYSYPRT

SEQ ID NO: 40804 - protein, 18 aa, Homo sapiens
  heavy chain complementarity determining region 3 for antibody 20402
ARDASPSSGDLYFDAFDI

SEQ ID NO: 40805 - protein, 9 aa, Homo sapiens
  light chain complementarity determining region 3 for antibody 20403
LQDYNYPWT

SEQ ID NO: 40806 - protein, 11 aa, Homo sapiens
  heavy chain complementarity determining region 3 for antibody 20403
ARDSAGAFFDY

SEQ ID NO: 40807 - protein, 9 aa, Homo sapiens
  light chain complementarity determining region 3 for antibody 20404
LQDYNYPMT

SEQ ID NO: 40808 - protein, 18 aa, Homo sapiens
  heavy chain complementarity determining region 3 for antibody 20404
ARALGHCWGGHCYAAFDI

SEQ ID NO: 40809 - protein, 9 aa, Homo sapiens
  light chain complementarity determining region 3 for antibody 20405
LQDYNYPHT

SEQ ID NO: 40810 - protein, 10 aa, Homo sapiens
  heavy chain complementarity determining region 3 for antibody 20405
ARRGLYFGES

SEQ ID NO: 40811 - protein, 9 aa, Homo sapiens
  light chain complementarity determining region 3 for antibody 20406
LQDNSYPFT

SEQ ID NO: 40812 - protein, 7 aa, Homo sapiens
  heavy chain complementarity determining region 3 for antibody 20406
ALYRLDY

SEQ ID NO: 40813 - protein, 9 aa, Homo sapiens
  light chain complementarity determining region 3 for antibody 20407
LQCNRFPHT

SEQ ID NO: 40814 - protein, 14 aa, Homo sapiens
  heavy chain complementarity determining region 3 for antibody 20407
ARYCSGTSCYSMDY

SEQ ID NO: 40815 - protein, 9 aa, Homo sapiens
  light chain complementarity determining region 3 for antibody 20408
LQASSWPRT

SEQ ID NO: 40816 - protein, 9 aa, Homo sapiens
  heavy chain complementarity determining region 3 for antibody 20408
VAGHLTFDH

SEQ ID NO: 40817 - protein, 9 aa, Homo sapiens
  light chain complementarity determining region 3 for antibody 20409
LQASFWPRT

SEQ ID NO: 40818 - protein, 9 aa, Homo sapiens
  heavy chain complementarity determining region 3 for antibody 20409
VAGHLTFDH

SEQ ID NO: 40819 - protein, 9 aa, Homo sapiens
  light chain complementarity determining region 3 for antibody 20410
LQALETPFT

SEQ ID NO: 40820 - protein, 15 aa, Homo sapiens
  heavy chain complementarity determining region 3 for antibody 20410
VRHYRVLATGIEGDS

SEQ ID NO: 40821 - protein, 9 aa, Homo sapiens
  light chain complementarity determining region 3 for antibody 20411
LQALETPFT

SEQ ID NO: 40822 - protein, 15 aa, Homo sapiens
  heavy chain complementarity determining region 3 for antibody 20411
VRHYRLTVAGIEGDS

SEQ ID NO: 40823 - protein, 9 aa, Homo sapiens
  light chain complementarity determining region 3 for antibody 20412
LQALETPFT

SEQ ID NO: 40824 - protein, 15 aa, Homo sapiens
  heavy chain complementarity determining region 3 for antibody 20412
VRHCRIITAPLEGDS

SEQ ID NO: 40825 - protein, 9 aa, Homo sapiens
  light chain complementarity determining region 3 for antibody 20413
LQALEIPFT

SEQ ID NO: 40826 - protein, 15 aa, Homo sapiens
  heavy chain complementarity determining region 3 for antibody 20413
VRHYRETVAGIEGDS

SEQ ID NO: 40827 - protein, 9 aa, Homo sapiens
  light chain complementarity determining region 3 for antibody 20414
LHYYSTPWT

SEQ ID NO: 40828 - protein, 15 aa, Homo sapiens
  heavy chain complementarity determining region 3 for antibody 20414
IRQSKVDNYYNYPDF

SEQ ID NO: 40829 - protein, 8 aa, Homo sapiens
  light chain complementarity determining region 3 for antibody 20415
LHYGPSDT

SEQ ID NO: 40830 - protein, 18 aa, Homo sapiens
  heavy chain complementarity determining region 3 for antibody 20415
TRRASGGYCSANNCFVDF

SEQ ID NO: 40831 - protein, 9 aa, Homo sapiens
  light chain complementarity determining region 3 for antibody 20416
LHTYTFPRT

SEQ ID NO: 40832 - protein, 20 aa, Homo sapiens
  heavy chain complementarity determining region 3 for antibody 20416
ARGRRIAALSTAHYYYGMDV

SEQ ID NO: 40833 - protein, 9 aa, Homo sapiens
  light chain complementarity determining region 3 for antibody 20417
LHNNNFPYA

SEQ ID NO: 40834 - protein, 14 aa, Homo sapiens
  heavy chain complementarity determining region 3 for antibody 20417
TRTEWSSGWRLFDY

SEQ ID NO: 40835 - protein, 9 aa, Homo sapiens
  light chain complementarity determining region 3 for antibody 20418
LHHYAFPRT

SEQ ID NO: 40836 - protein, 8 aa, Homo sapiens
  heavy chain complementarity determining region 3 for antibody 20418
ADIGAGSS

SEQ ID NO: 40837 - protein, 9 aa, Homo sapiens
  light chain complementarity determining region 3 for antibody 20419
LHDYDYPRT

SEQ ID NO: 40838 - protein, 22 aa, Homo sapiens
  heavy chain complementarity determining region 3 for antibody 20419
ARDSSPRYYYGGRDYYVDVFDL

SEQ ID NO: 40839 - protein, 9 aa, Homo sapiens
  light chain complementarity determining region 3 for antibody 20420
LGTLQTPPT

SEQ ID NO: 40840 - protein, 15 aa, Homo sapiens
  heavy chain complementarity determining region 3 for antibody 20420
TRDGKKDGHNDAFDI

SEQ ID NO: 40841 - protein, 9 aa, Homo sapiens
  light chain complementarity determining region 3 for antibody 20421
KQHNSWPRT

SEQ ID NO: 40842 - protein, 14 aa, Homo sapiens
  heavy chain complementarity determining region 3 for antibody 20421
ARGGDYEYPDVFDI

SEQ ID NO: 40843 - protein, 9 aa, Homo sapiens
  light chain complementarity determining region 3 for antibody 20422
IQALETPFT

SEQ ID NO: 40844 - protein, 15 aa, Homo sapiens
  heavy chain complementarity determining region 3 for antibody 20422
VRHYRETVAGIEGDS

SEQ ID NO: 40845 - protein, 9 aa, Homo sapiens
  light chain complementarity determining region 3 for antibody 20423
IGTLQTPPT

SEQ ID NO: 40846 - protein, 15 aa, Homo sapiens
  heavy chain complementarity determining region 3 for antibody 20423
TRDGKKDGHNDAFDI

SEQ ID NO: 40847 - protein, 9 aa, Homo sapiens
  light chain complementarity determining region 3 for antibody 20424
HQYYSSPRL

SEQ ID NO: 40848 - protein, 13 aa, Homo sapiens
  heavy chain complementarity determining region 3 for antibody 20424
ARGQSGDPRTYDY

SEQ ID NO: 40849 - protein, 9 aa, Homo sapiens
  light chain complementarity determining region 3 for antibody 20425
HQYSSSPHT

SEQ ID NO: 40850 - protein, 13 aa, Homo sapiens
  heavy chain complementarity determining region 3 for antibody 20425
ARGTYSAFAIFGV

SEQ ID NO: 40851 - protein, 9 aa, Homo sapiens
  light chain complementarity determining region 3 for antibody 20426
HQYSSSPFT

SEQ ID NO: 40852 - protein, 13 aa, Homo sapiens
  heavy chain complementarity determining region 3 for antibody 20426
ARGTYSAFAIFGV

SEQ ID NO: 40853 - protein, 9 aa, Homo sapiens
  light chain complementarity determining region 3 for antibody 20427
HQYRTPPHT

SEQ ID NO: 40854 - protein, 12 aa, Homo sapiens
  heavy chain complementarity determining region 3 for antibody 20427
AKYPDNSFWYES

SEQ ID NO: 40855 - protein, 10 aa, Homo sapiens
  light chain complementarity determining region 3 for antibody 20428
HQYGTSVAHT

SEQ ID NO: 40856 - protein, 14 aa, Homo sapiens
  heavy chain complementarity determining region 3 for antibody 20428
VKDGGIYPVNWFDS

SEQ ID NO: 40857 - protein, 9 aa, Homo sapiens
  light chain complementarity determining region 3 for antibody 20429
HQYGSSSRT

SEQ ID NO: 40858 - protein, 17 aa, Homo sapiens
  heavy chain complementarity determining region 3 for antibody 20429
TTDTQRLLPPPFVPNDY

SEQ ID NO: 40859 - protein, 9 aa, Homo sapiens
  light chain complementarity determining region 3 for antibody 20430
HQYGSSPRT

SEQ ID NO: 40860 - protein, 17 aa, Homo sapiens
  heavy chain complementarity determining region 3 for antibody 20430
TTDPQWLTPPPFVPNDY

SEQ ID NO: 40861 - protein, 9 aa, Homo sapiens
  light chain complementarity determining region 3 for antibody 20431
HQYGRSPYT

SEQ ID NO: 40862 - protein, 11 aa, Homo sapiens
  heavy chain complementarity determining region 3 for antibody 20431
ATWAVYHGVDV

SEQ ID NO: 40863 - protein, 9 aa, Homo sapiens
  light chain complementarity determining region 3 for antibody 20432
HQYGNIPRT

SEQ ID NO: 40864 - protein, 13 aa, Homo sapiens
  heavy chain complementarity determining region 3 for antibody 20432
AGGLFHSSGYSEF

SEQ ID NO: 40865 - protein, 10 aa, Homo sapiens
  light chain complementarity determining region 3 for antibody 20433
HQYGGSPLWT

SEQ ID NO: 40866 - protein, 10 aa, Homo sapiens
  heavy chain complementarity determining region 3 for antibody 20433
AGDNRLDQAT

SEQ ID NO: 40867 - protein, 9 aa, Homo sapiens
  light chain complementarity determining region 3 for antibody 20434
HQYGDTPRT

SEQ ID NO: 40868 - protein, 16 aa, Homo sapiens
  heavy chain complementarity determining region 3 for antibody 20434
AGLSASGHLAPNPFDV

SEQ ID NO: 40869 - protein, 9 aa, Homo sapiens
  light chain complementarity determining region 3 for antibody 20435
HQYGDTPRP

SEQ ID NO: 40870 - protein, 16 aa, Homo sapiens
  heavy chain complementarity determining region 3 for antibody 20435
AGLSASGHLAPNTFDV

SEQ ID NO: 40871 - protein, 9 aa, Homo sapiens
  light chain complementarity determining region 3 for antibody 20436
HQYAVSPRM

SEQ ID NO: 40872 - protein, 17 aa, Homo sapiens
  heavy chain complementarity determining region 3 for antibody 20436
AKSVGVDDAMTTRVYDS

SEQ ID NO: 40873 - protein, 9 aa, Homo sapiens
  light chain complementarity determining region 3 for antibody 20437
HQYATLPET

SEQ ID NO: 40874 - protein, 13 aa, Homo sapiens
  heavy chain complementarity determining region 3 for antibody 20437
VRRGYGAFVREDF

SEQ ID NO: 40875 - protein, 9 aa, Homo sapiens
  light chain complementarity determining region 3 for antibody 20438
HQYAESPRT

SEQ ID NO: 40876 - protein, 17 aa, Homo sapiens
  heavy chain complementarity determining region 3 for antibody 20438
AKSVGVDDAMTTRVYDS

SEQ ID NO: 40877 - protein, 9 aa, Homo sapiens
  light chain complementarity determining region 3 for antibody 20439
HQYAESPRM

SEQ ID NO: 40878 - protein, 17 aa, Homo sapiens
  heavy chain complementarity determining region 3 for antibody 20439
AKSVGVDDAMTPRVYDS

SEQ ID NO: 40879 - protein, 9 aa, Homo sapiens
  light chain complementarity determining region 3 for antibody 20440
HQYAESPRK

SEQ ID NO: 40880 - protein, 17 aa, Homo sapiens
  heavy chain complementarity determining region 3 for antibody 20440
AKSVGVDDAMTTRVYDS

SEQ ID NO: 40881 - protein, 9 aa, Homo sapiens
  light chain complementarity determining region 3 for antibody 20441
HQSYTAPST

SEQ ID NO: 40882 - protein, 12 aa, Homo sapiens
  heavy chain complementarity determining region 3 for antibody 20441
ARNYFDSSGPDY

SEQ ID NO: 40883 - protein, 9 aa, Homo sapiens
  light chain complementarity determining region 3 for antibody 20442
HQSSSFPYT

SEQ ID NO: 40884 - protein, 14 aa, Homo sapiens
  heavy chain complementarity determining region 3 for antibody 20442
ATSPKGTSLYYFDF

SEQ ID NO: 40885 - protein, 10 aa, Homo sapiens
  light chain complementarity determining region 3 for antibody 20443
HQSGILPPWT

SEQ ID NO: 40886 - protein, 13 aa, Homo sapiens
  heavy chain complementarity determining region 3 for antibody 20443
ARVSQASYNGMDV

SEQ ID NO: 40887 - protein, 10 aa, Homo sapiens
  light chain complementarity determining region 3 for antibody 20444
HQSGILPPWS

SEQ ID NO: 40888 - protein, 13 aa, Homo sapiens
  heavy chain complementarity determining region 3 for antibody 20444
ARVSQAYYNGMDV

SEQ ID NO: 40889 - protein, 10 aa, Homo sapiens
  light chain complementarity determining region 3 for antibody 20445
HQSGILPPGR

SEQ ID NO: 40890 - protein, 13 aa, Homo sapiens
  heavy chain complementarity determining region 3 for antibody 20445
ARVSQAYYNGMDV

SEQ ID NO: 40891 - protein, 9 aa, Homo sapiens
  light chain complementarity determining region 3 for antibody 20446
HQSGGLPWT

SEQ ID NO: 40892 - protein, 14 aa, Homo sapiens
  heavy chain complementarity determining region 3 for antibody 20446
VRDASGNSGWYAAS

SEQ ID NO: 40893 - protein, 9 aa, Homo sapiens
  light chain complementarity determining region 3 for antibody 20447
HQSGDLPWT

SEQ ID NO: 40894 - protein, 14 aa, Homo sapiens
  heavy chain complementarity determining region 3 for antibody 20447
VRDASGNSGWYADS

SEQ ID NO: 40895 - protein, 9 aa, Homo sapiens
  light chain complementarity determining region 3 for antibody 20448
HQSGALPWA

SEQ ID NO: 40896 - protein, 14 aa, Homo sapiens
  heavy chain complementarity determining region 3 for antibody 20448
VRDASGNSGWYADS

SEQ ID NO: 40897 - protein, 10 aa, Homo sapiens
  light chain complementarity determining region 3 for antibody 20449
HQRYNWPPFT

SEQ ID NO: 40898 - protein, 11 aa, Homo sapiens
  heavy chain complementarity determining region 3 for antibody 20449
ARGVGSYPFDS

SEQ ID NO: 40899 - protein, 9 aa, Homo sapiens
  light chain complementarity determining region 3 for antibody 20450
HQRSSLPLT

SEQ ID NO: 40900 - protein, 15 aa, Homo sapiens
  heavy chain complementarity determining region 3 for antibody 20450
AKSGGGGSYRLPVDY

SEQ ID NO: 40901 - protein, 8 aa, Homo sapiens
  light chain complementarity determining region 3 for antibody 20451
HQRGYGYT

SEQ ID NO: 40902 - protein, 21 aa, Homo sapiens
  heavy chain complementarity determining region 3 for antibody 20451
AHRGGCSRGSCYGATYNWFDP

SEQ ID NO: 40903 - protein, 8 aa, Homo sapiens
  light chain complementarity determining region 3 for antibody 20452
HQRGNGYT

SEQ ID NO: 40904 - protein, 21 aa, Homo sapiens
  heavy chain complementarity determining region 3 for antibody 20452
AHRGGCSRGSCYGATYNWFDP

SEQ ID NO: 40905 - protein, 8 aa, Homo sapiens
  light chain complementarity determining region 3 for antibody 20453
HQRGHGYT

SEQ ID NO: 40906 - protein, 21 aa, Homo sapiens
  heavy chain complementarity determining region 3 for antibody 20453
AHRGGCSRGSSYGATYNWFDP

SEQ ID NO: 40907 - protein, 8 aa, Homo sapiens
  light chain complementarity determining region 3 for antibody 20454
HQRGHGYT

SEQ ID NO: 40908 - protein, 21 aa, Homo sapiens
  heavy chain complementarity determining region 3 for antibody 20454
AHRGGCSRGSCYGVTYNWFDP

SEQ ID NO: 40909 - protein, 8 aa, Homo sapiens
  light chain complementarity determining region 3 for antibody 20455
HQRGHGYT

SEQ ID NO: 40910 - protein, 21 aa, Homo sapiens
  heavy chain complementarity determining region 3 for antibody 20455
AHRGGCSRGSCYGATYSWFDP

SEQ ID NO: 40911 - protein, 9 aa, Homo sapiens
  light chain complementarity determining region 3 for antibody 20456
HQLGTLPYT

SEQ ID NO: 40912 - protein, 16 aa, Homo sapiens
  heavy chain complementarity determining region 3 for antibody 20456
TTERHIAEFEEASFDI

SEQ ID NO: 40913 - protein, 9 aa, Homo sapiens
  light chain complementarity determining region 3 for antibody 20457
HQIHTFPLP

SEQ ID NO: 40914 - protein, 11 aa, Homo sapiens
  heavy chain complementarity determining region 3 for antibody 20457
TSDNGKWAFDA

SEQ ID NO: 40915 - protein, 10 aa, Homo sapiens
  light chain complementarity determining region 3 for antibody 20458
HQHGGSPVWT

SEQ ID NO: 40916 - protein, 10 aa, Homo sapiens
  heavy chain complementarity determining region 3 for antibody 20458
AGDNRLDQAT

SEQ ID NO: 40917 - protein, 9 aa, Homo sapiens
  light chain complementarity determining region 3 for antibody 20459
HQGYRTPFT

SEQ ID NO: 40918 - protein, 15 aa, Homo sapiens
  heavy chain complementarity determining region 3 for antibody 20459
AKAQVIWGQLYSFES

SEQ ID NO: 40919 - protein, 9 aa, Homo sapiens
  light chain complementarity determining region 3 for antibody 20460
HQGSYSPLT

SEQ ID NO: 40920 - protein, 10 aa, Homo sapiens
  heavy chain complementarity determining region 3 for antibody 20460
AWGIGWTSNY

SEQ ID NO: 40921 - protein, 9 aa, Homo sapiens
  light chain complementarity determining region 3 for antibody 20461
HQDGSSPQT

SEQ ID NO: 40922 - protein, 9 aa, Homo sapiens
  heavy chain complementarity determining region 3 for antibody 20461
SRGYDISGC

SEQ ID NO: 40923 - protein, 9 aa, Homo sapiens
  light chain complementarity determining region 3 for antibody 20462
HQDATLPET

SEQ ID NO: 40924 - protein, 13 aa, Homo sapiens
  heavy chain complementarity determining region 3 for antibody 20462
VRRGYGDFVREDF

SEQ ID NO: 40925 - protein, 9 aa, Homo sapiens
  light chain complementarity determining region 3 for antibody 20463
HPSSSLPLT

SEQ ID NO: 40926 - protein, 15 aa, Homo sapiens
  heavy chain complementarity determining region 3 for antibody 20463
AKSGGGGSYRLPVDY

SEQ ID NO: 40927 - protein, 10 aa, Homo sapiens
  light chain complementarity determining region 3 for antibody 20464
HHYHNWPPWT

SEQ ID NO: 40928 - protein, 13 aa, Homo sapiens
  heavy chain complementarity determining region 3 for antibody 20464
AKGRVRELYYFET

SEQ ID NO: 40929 - protein, 9 aa, Homo sapiens
  light chain complementarity determining region 3 for antibody 20465
HHYHNAPWG

SEQ ID NO: 40930 - protein, 15 aa, Homo sapiens
  heavy chain complementarity determining region 3 for antibody 20465
AAASYGSRKVRPALS

SEQ ID NO: 40931 - protein, 9 aa, Homo sapiens
  light chain complementarity determining region 3 for antibody 20466
HHYGSSPWP

SEQ ID NO: 40932 - protein, 13 aa, Homo sapiens
  heavy chain complementarity determining region 3 for antibody 20466
ARAQTWSGSLFDY

SEQ ID NO: 40933 - protein, 9 aa, Homo sapiens
  light chain complementarity determining region 3 for antibody 20467
HHYGRSPWP

SEQ ID NO: 40934 - protein, 13 aa, Homo sapiens
  heavy chain complementarity determining region 3 for antibody 20467
ARAQTWSGRLFDY

SEQ ID NO: 40935 - protein, 9 aa, Homo sapiens
  light chain complementarity determining region 3 for antibody 20468
HHTYTFPRT

SEQ ID NO: 40936 - protein, 20 aa, Homo sapiens
  heavy chain complementarity determining region 3 for antibody 20468
ARGRSIAALSTAHYYYGMDV

SEQ ID NO: 40937 - protein, 9 aa, Homo sapiens
  light chain complementarity determining region 3 for antibody 20469
HHTYTFPRT

SEQ ID NO: 40938 - protein, 20 aa, Homo sapiens
  heavy chain complementarity determining region 3 for antibody 20469
ARGRRVAALSTAHYYYGMDV

SEQ ID NO: 40939 - protein, 9 aa, Homo sapiens
  light chain complementarity determining region 3 for antibody 20470
HHTYTFPRT

SEQ ID NO: 40940 - protein, 20 aa, Homo sapiens
  heavy chain complementarity determining region 3 for antibody 20470
ARGRRIAARSTAHYYYGMDV

SEQ ID NO: 40941 - protein, 9 aa, Homo sapiens
  light chain complementarity determining region 3 for antibody 20471
HHTYTFPRT

SEQ ID NO: 40942 - protein, 20 aa, Homo sapiens
  heavy chain complementarity determining region 3 for antibody 20471
ARGRRIAALSTAHYYSGMDV

SEQ ID NO: 40943 - protein, 9 aa, Homo sapiens
  light chain complementarity determining region 3 for antibody 20472
HHTYTFPRT

SEQ ID NO: 40944 - protein, 20 aa, Homo sapiens
  heavy chain complementarity determining region 3 for antibody 20472
ARGRRIAALSTAHYYCGMDV

SEQ ID NO: 40945 - protein, 9 aa, Homo sapiens
  light chain complementarity determining region 3 for antibody 20473
HHTYTFPRT

SEQ ID NO: 40946 - protein, 20 aa, Homo sapiens
  heavy chain complementarity determining region 3 for antibody 20473
ARGGRIAALSTAHYYYGMDV

SEQ ID NO: 40947 - protein, 9 aa, Homo sapiens
  light chain complementarity determining region 3 for antibody 20474
HHTYTFPRT

SEQ ID NO: 40948 - protein, 20 aa, Homo sapiens
  heavy chain complementarity determining region 3 for antibody 20474
ARARRIAALSTAHYYYGMDV

SEQ ID NO: 40949 - protein, 9 aa, Homo sapiens
  light chain complementarity determining region 3 for antibody 20475
HHTYTFPRT

SEQ ID NO: 40950 - protein, 20 aa, Homo sapiens
  heavy chain complementarity determining region 3 for antibody 20475
AGGRRIAALSTAHYYYGMDV

SEQ ID NO: 40951 - protein, 9 aa, Homo sapiens
  light chain complementarity determining region 3 for antibody 20476
HHTYTFPRI

SEQ ID NO: 40952 - protein, 20 aa, Homo sapiens
  heavy chain complementarity determining region 3 for antibody 20476
ARGRRIAALSTAHYYYGMDV

SEQ ID NO: 40953 - protein, 9 aa, Homo sapiens
  light chain complementarity determining region 3 for antibody 20477
HHTYPFPRT

SEQ ID NO: 40954 - protein, 20 aa, Homo sapiens
  heavy chain complementarity determining region 3 for antibody 20477
ARGRRIAALSTAHYYYGMDV

SEQ ID NO: 40955 - protein, 9 aa, Homo sapiens
  light chain complementarity determining region 3 for antibody 20478
HHTSTLPRT

SEQ ID NO: 40956 - protein, 20 aa, Homo sapiens
  heavy chain complementarity determining region 3 for antibody 20478
ARGRRIAALSTAHYYYGMDV

SEQ ID NO: 40957 - protein, 9 aa, Homo sapiens
  light chain complementarity determining region 3 for antibody 20479
HHTSTFPRT

SEQ ID NO: 40958 - protein, 20 aa, Homo sapiens
  heavy chain complementarity determining region 3 for antibody 20479
ARGRRIAALSTAPYYYGMDV

SEQ ID NO: 40959 - protein, 9 aa, Homo sapiens
  light chain complementarity determining region 3 for antibody 20480
HHPSTFPRT

SEQ ID NO: 40960 - protein, 20 aa, Homo sapiens
  heavy chain complementarity determining region 3 for antibody 20480
ARGRRIAALSTAHYYYGMDV

SEQ ID NO: 40961 - protein, 9 aa, Homo sapiens
  light chain complementarity determining region 3 for antibody 20481
HHNSTFPRT

SEQ ID NO: 40962 - protein, 20 aa, Homo sapiens
  heavy chain complementarity determining region 3 for antibody 20481
ARGRRIAALSTAHYYYGMDV

SEQ ID NO: 40963 - protein, 9 aa, Homo sapiens
  light chain complementarity determining region 3 for antibody 20482
FQHNSFPLT

SEQ ID NO: 40964 - protein, 19 aa, Homo sapiens
  heavy chain complementarity determining region 3 for antibody 20482
ASLRYSSSWSRRLVDVFEI

SEQ ID NO: 40965 - protein, 9 aa, Homo sapiens
  light chain complementarity determining region 3 for antibody 20483
EQHYSNPRT

SEQ ID NO: 40966 - protein, 12 aa, Homo sapiens
  heavy chain complementarity determining region 3 for antibody 20483
ARGLSVWAPLNY

SEQ ID NO: 40967 - protein, 9 aa, Homo sapiens
  light chain complementarity determining region 3 for antibody 20484
YHTYTFPRT

SEQ ID NO: 40968 - protein, 20 aa, Homo sapiens
  heavy chain complementarity determining region 3 for antibody 20484
ARGRRIAALSTAHYYYGMDV

SEQ ID NO: 40969 - protein, 9 aa, Homo sapiens
  light chain complementarity determining region 3 for antibody 20485
WQALETPFT

SEQ ID NO: 40970 - protein, 15 aa, Homo sapiens
  heavy chain complementarity determining region 3 for antibody 20485
VRHYRIITAPLEGDS

SEQ ID NO: 40971 - protein, 9 aa, Homo sapiens
  light chain complementarity determining region 3 for antibody 20486
WQALETPFT

SEQ ID NO: 40972 - protein, 15 aa, Homo sapiens
  heavy chain complementarity determining region 3 for antibody 20486
VRHYRETVAGIEGDS

SEQ ID NO: 40973 - protein, 9 aa, Homo sapiens
  light chain complementarity determining region 3 for antibody 20487
VQYNRNPRT

SEQ ID NO: 40974 - protein, 6 aa, Homo sapiens
  heavy chain complementarity determining region 3 for antibody 20487
TRALDY

SEQ ID NO: 40975 - protein, 9 aa, Homo sapiens
  light chain complementarity determining region 3 for antibody 20488
VQSRTRPRT

SEQ ID NO: 40976 - protein, 12 aa, Homo sapiens
  heavy chain complementarity determining region 3 for antibody 20488
ARGRDEHKLGNY

SEQ ID NO: 40977 - protein, 9 aa, Homo sapiens
  light chain complementarity determining region 3 for antibody 20489
VQSQNVPLT

SEQ ID NO: 40978 - protein, 18 aa, Homo sapiens
  heavy chain complementarity determining region 3 for antibody 20489
VRGGRDSQGPLGYYNLGV

SEQ ID NO: 40979 - protein, 9 aa, Homo sapiens
  light chain complementarity determining region 3 for antibody 20490
VQFNRYPRT

SEQ ID NO: 40980 - protein, 6 aa, Homo sapiens
  heavy chain complementarity determining region 3 for antibody 20490
TRALDY

SEQ ID NO: 40981 - protein, 9 aa, Homo sapiens
  light chain complementarity determining region 3 for antibody 20491
TGTLQTPPT

SEQ ID NO: 40982 - protein, 15 aa, Homo sapiens
  heavy chain complementarity determining region 3 for antibody 20491
TRDGKRDGHNDAFDI

SEQ ID NO: 40983 - protein, 10 aa, Homo sapiens
  light chain complementarity determining region 3 for antibody 20492
SQSTYWPPHT

SEQ ID NO: 40984 - protein, 16 aa, Homo sapiens
  heavy chain complementarity determining region 3 for antibody 20492
VRLSRTGGALLDAFDV

SEQ ID NO: 40985 - protein, 10 aa, Homo sapiens
  light chain complementarity determining region 3 for antibody 20493
SQSTYGPPYT

SEQ ID NO: 40986 - protein, 16 aa, Homo sapiens
  heavy chain complementarity determining region 3 for antibody 20493
VRLSRTGGALLDAFDV

SEQ ID NO: 40987 - protein, 9 aa, Homo sapiens
  light chain complementarity determining region 3 for antibody 20494
SQRSNWPRT

SEQ ID NO: 40988 - protein, 17 aa, Homo sapiens
  heavy chain complementarity determining region 3 for antibody 20494
AQGGGYCGGDCYYYLDN

SEQ ID NO: 40989 - protein, 9 aa, Homo sapiens
  light chain complementarity determining region 3 for antibody 20495
RQYTNWPLT

SEQ ID NO: 40990 - protein, 16 aa, Homo sapiens
  heavy chain complementarity determining region 3 for antibody 20495
TRYCSSSNCALYGMDV

SEQ ID NO: 40991 - protein, 10 aa, Homo sapiens
  light chain complementarity determining region 3 for antibody 20496
RQYNQWPPLT

SEQ ID NO: 40992 - protein, 17 aa, Homo sapiens
  heavy chain complementarity determining region 3 for antibody 20496
ARDLYFSIIQGGGAFDA

SEQ ID NO: 40993 - protein, 10 aa, Homo sapiens
  light chain complementarity determining region 3 for antibody 20497
RQYNNWPPLT

SEQ ID NO: 40994 - protein, 17 aa, Homo sapiens
  heavy chain complementarity determining region 3 for antibody 20497
AKDLRPFYDIFAGYLDM

SEQ ID NO: 40995 - protein, 8 aa, Homo sapiens
  light chain complementarity determining region 3 for antibody 20498
RQYNDGWT

SEQ ID NO: 40996 - protein, 10 aa, Homo sapiens
  heavy chain complementarity determining region 3 for antibody 20498
ARDKQVVLDS

SEQ ID NO: 40997 - protein, 9 aa, Homo sapiens
  light chain complementarity determining region 3 for antibody 20499
RQYGTSPLT

SEQ ID NO: 40998 - protein, 15 aa, Homo sapiens
  heavy chain complementarity determining region 3 for antibody 20499
ARQNDFLSGPGEFDP

SEQ ID NO: 40999 - protein, 9 aa, Homo sapiens
  light chain complementarity determining region 3 for antibody 20500
RQYGTPPRT

SEQ ID NO: 41000 - protein, 25 aa, Homo sapiens
  heavy chain complementarity determining region 3 for antibody 20500
ARRRVDRLRLPGAMRGPLYDRGLNV

SEQ ID NO: 41001 - protein, 9 aa, Homo sapiens
  light chain complementarity determining region 3 for antibody 20501
RQYGTPPRT

SEQ ID NO: 41002 - protein, 25 aa, Homo sapiens
  heavy chain complementarity determining region 3 for antibody 20501
ARLRVDRLRLPGAMRGPLYDRGLNV

SEQ ID NO: 41003 - protein, 9 aa, Homo sapiens
  light chain complementarity determining region 3 for antibody 20502
RQYGSIPRT

SEQ ID NO: 41004 - protein, 14 aa, Homo sapiens
  heavy chain complementarity determining region 3 for antibody 20502
AGGEYCGGNCYSEY

SEQ ID NO: 41005 - protein, 9 aa, Homo sapiens
  light chain complementarity determining region 3 for antibody 20503
RQYGSIPRT

SEQ ID NO: 41006 - protein, 14 aa, Homo sapiens
  heavy chain complementarity determining region 3 for antibody 20503
AGGEFSSGWHYSEN

SEQ ID NO: 41007 - protein, 9 aa, Homo sapiens
  light chain complementarity determining region 3 for antibody 20504
RQVLETPFT

SEQ ID NO: 41008 - protein, 15 aa, Homo sapiens
  heavy chain complementarity determining region 3 for antibody 20504
VRHYRIITAPLEGDS

SEQ ID NO: 41009 - protein, 9 aa, Homo sapiens
  light chain complementarity determining region 3 for antibody 20505
RQTLQTPTT

SEQ ID NO: 41010 - protein, 16 aa, Homo sapiens
  heavy chain complementarity determining region 3 for antibody 20505
TMDLFALGLSSGCHDY

SEQ ID NO: 41011 - protein, 10 aa, Homo sapiens
  light chain complementarity determining region 3 for antibody 20506
RQSVQFPRWT

SEQ ID NO: 41012 - protein, 8 aa, Homo sapiens
  heavy chain complementarity determining region 3 for antibody 20506
AKGYGFDS

SEQ ID NO: 41013 - protein, 9 aa, Homo sapiens
  light chain complementarity determining region 3 for antibody 20507
RQRTDWPPT

SEQ ID NO: 41014 - protein, 17 aa, Homo sapiens
  heavy chain complementarity determining region 3 for antibody 20507
ARTALCESPAYYRFFDY

SEQ ID NO: 41015 - protein, 9 aa, Homo sapiens
  light chain complementarity determining region 3 for antibody 20508
RQRNKWPRT

SEQ ID NO: 41016 - protein, 13 aa, Homo sapiens
  heavy chain complementarity determining region 3 for antibody 20508
AKDLGSLRYDFDY

SEQ ID NO: 41017 - protein, 8 aa, Homo sapiens
  light chain complementarity determining region 3 for antibody 20509
RQRNFRLT

SEQ ID NO: 41018 - protein, 13 aa, Homo sapiens
  heavy chain complementarity determining region 3 for antibody 20509
TTDAAFVPYYFTY

SEQ ID NO: 41019 - protein, 9 aa, Homo sapiens
  light chain complementarity determining region 3 for antibody 20510
RQPLLTPWT

SEQ ID NO: 41020 - protein, 11 aa, Homo sapiens
  heavy chain complementarity determining region 3 for antibody 20510
ARDRDYSALDV

SEQ ID NO: 41021 - protein, 9 aa, Homo sapiens
  light chain complementarity determining region 3 for antibody 20511
RQLNSYPHT

SEQ ID NO: 41022 - protein, 12 aa, Homo sapiens
  heavy chain complementarity determining region 3 for antibody 20511
ARTSLSHDYGYY

SEQ ID NO: 41023 - protein, 9 aa, Homo sapiens
  light chain complementarity determining region 3 for antibody 20512
RQHNSYPLT

SEQ ID NO: 41024 - protein, 13 aa, Homo sapiens
  heavy chain complementarity determining region 3 for antibody 20512
VRHAVVRPMVVDD

SEQ ID NO: 41025 - protein, 9 aa, Homo sapiens
  light chain complementarity determining region 3 for antibody 20513
RQGTHWPWT

SEQ ID NO: 41026 - protein, 10 aa, Homo sapiens
  heavy chain complementarity determining region 3 for antibody 20513
ARETHWGPDY

SEQ ID NO: 41027 - protein, 8 aa, Homo sapiens
  light chain complementarity determining region 3 for antibody 20514
RQGTHWPT

SEQ ID NO: 41028 - protein, 21 aa, Homo sapiens
  heavy chain complementarity determining region 3 for antibody 20514
AKDRPNYYESNGQYYTPKGDL

SEQ ID NO: 41029 - protein, 9 aa, Homo sapiens
  light chain complementarity determining region 3 for antibody 20515
RQGTHWPLT

SEQ ID NO: 41030 - protein, 28 aa, Homo sapiens
  heavy chain complementarity determining region 3 for antibody 20515
MRFPDEPDEMDYEGDYYDSIDFAGDFQH

SEQ ID NO: 41031 - protein, 9 aa, Homo sapiens
  light chain complementarity determining region 3 for antibody 20516
RQGTHWPLE

SEQ ID NO: 41032 - protein, 18 aa, Homo sapiens
  heavy chain complementarity determining region 3 for antibody 20516
ARDERDTCTTDLCYYFDY

SEQ ID NO: 41033 - protein, 8 aa, Homo sapiens
  light chain complementarity determining region 3 for antibody 20517
RQGTDWPT

SEQ ID NO: 41034 - protein, 21 aa, Homo sapiens
  heavy chain complementarity determining region 3 for antibody 20517
AKDRPNYYGSDGQYYTPKGDL

SEQ ID NO: 41035 - protein, 9 aa, Homo sapiens
  light chain complementarity determining region 3 for antibody 20518
RQGSHWPPT

SEQ ID NO: 41036 - protein, 13 aa, Homo sapiens
  heavy chain complementarity determining region 3 for antibody 20518
VRDLGDGYNSIDY

SEQ ID NO: 41037 - protein, 9 aa, Homo sapiens
  light chain complementarity determining region 3 for antibody 20519
RQGNRFPHT

SEQ ID NO: 41038 - protein, 14 aa, Homo sapiens
  heavy chain complementarity determining region 3 for antibody 20519
ARYCSGNSCYSMDH

SEQ ID NO: 41039 - protein, 9 aa, Homo sapiens
  light chain complementarity determining region 3 for antibody 20520
RQGLETPFT

SEQ ID NO: 41040 - protein, 15 aa, Homo sapiens
  heavy chain complementarity determining region 3 for antibody 20520
VRHYRIITAPLEGDS

SEQ ID NO: 41041 - protein, 9 aa, Homo sapiens
  light chain complementarity determining region 3 for antibody 20521
RQGLETPFT

SEQ ID NO: 41042 - protein, 15 aa, Homo sapiens
  heavy chain complementarity determining region 3 for antibody 20521
VRHYRETVAGIEGDS

SEQ ID NO: 41043 - protein, 9 aa, Homo sapiens
  light chain complementarity determining region 3 for antibody 20522
RQGDTFPLT

SEQ ID NO: 41044 - protein, 16 aa, Homo sapiens
  heavy chain complementarity determining region 3 for antibody 20522
ARGQSIWDAGYLGLDV

SEQ ID NO: 41045 - protein, 9 aa, Homo sapiens
  light chain complementarity determining region 3 for antibody 20523
RQDLETPFT

SEQ ID NO: 41046 - protein, 15 aa, Homo sapiens
  heavy chain complementarity determining region 3 for antibody 20523
VRHYRIITAPLEGDS

SEQ ID NO: 41047 - protein, 9 aa, Homo sapiens
  light chain complementarity determining region 3 for antibody 20524
RQDGGLGKT

SEQ ID NO: 41048 - protein, 12 aa, Homo sapiens
  heavy chain complementarity determining region 3 for antibody 20524
ARGGIWTGGFDY

SEQ ID NO: 41049 - protein, 9 aa, Homo sapiens
  light chain complementarity determining region 3 for antibody 20525
RQDGGLEKT

SEQ ID NO: 41050 - protein, 12 aa, Homo sapiens
  heavy chain complementarity determining region 3 for antibody 20525
ARGGIWTGGFDY

SEQ ID NO: 41051 - protein, 9 aa, Homo sapiens
  light chain complementarity determining region 3 for antibody 20526
RQASYWPRT

SEQ ID NO: 41052 - protein, 9 aa, Homo sapiens
  heavy chain complementarity determining region 3 for antibody 20526
VAGHLTFDH

SEQ ID NO: 41053 - protein, 9 aa, Homo sapiens
  light chain complementarity determining region 3 for antibody 20527
RQALQTPPT

SEQ ID NO: 41054 - protein, 15 aa, Homo sapiens
  heavy chain complementarity determining region 3 for antibody 20527
ARDGLRDGFSDAFDI

SEQ ID NO: 41055 - protein, 8 aa, Homo sapiens
  light chain complementarity determining region 3 for antibody 20528
RQALQALT

SEQ ID NO: 41056 - protein, 16 aa, Homo sapiens
  heavy chain complementarity determining region 3 for antibody 20528
AKAGWLVGYDLSRGCA

SEQ ID NO: 41057 - protein, 9 aa, Homo sapiens
  light chain complementarity determining region 3 for antibody 20529
RQALHGPYT

SEQ ID NO: 41058 - protein, 17 aa, Homo sapiens
  heavy chain complementarity determining region 3 for antibody 20529
ATHYPVATPQYYYGLDV

SEQ ID NO: 41059 - protein, 9 aa, Homo sapiens
  light chain complementarity determining region 3 for antibody 20530
RQALETQFT

SEQ ID NO: 41060 - protein, 15 aa, Homo sapiens
  heavy chain complementarity determining region 3 for antibody 20530
VRHYRITVAAVEGDS

SEQ ID NO: 41061 - protein, 9 aa, Homo sapiens
  light chain complementarity determining region 3 for antibody 20531
RQALETPFT

SEQ ID NO: 41062 - protein, 15 aa, Homo sapiens
  heavy chain complementarity determining region 3 for antibody 20531
VRHYRVPVAGIEGDS

SEQ ID NO: 41063 - protein, 9 aa, Homo sapiens
  light chain complementarity determining region 3 for antibody 20532
RQALETPFT

SEQ ID NO: 41064 - protein, 15 aa, Homo sapiens
  heavy chain complementarity determining region 3 for antibody 20532
IRHYRITVAAIEGDS

SEQ ID NO: 41065 - protein, 9 aa, Homo sapiens
  light chain complementarity determining region 3 for antibody 20533
RQALEPPFT

SEQ ID NO: 41066 - protein, 15 aa, Homo sapiens
  heavy chain complementarity determining region 3 for antibody 20533
VRHYRIITAPLEGDS

SEQ ID NO: 41067 - protein, 9 aa, Homo sapiens
  light chain complementarity determining region 3 for antibody 20534
RQALDTPFT

SEQ ID NO: 41068 - protein, 15 aa, Homo sapiens
  heavy chain complementarity determining region 3 for antibody 20534
VRHYRETVAGIEGDS

SEQ ID NO: 41069 - protein, 9 aa, Homo sapiens
  light chain complementarity determining region 3 for antibody 20535
RHSINWPGT

SEQ ID NO: 41070 - protein, 7 aa, Homo sapiens
  heavy chain complementarity determining region 3 for antibody 20535
ATARGAD

SEQ ID NO: 41071 - protein, 9 aa, Homo sapiens
  light chain complementarity determining region 3 for antibody 20536
RHRNNWPLT

SEQ ID NO: 41072 - protein, 13 aa, Homo sapiens
  heavy chain complementarity determining region 3 for antibody 20536
ARGNIAAPGRLEC

SEQ ID NO: 41073 - protein, 9 aa, Homo sapiens
  light chain complementarity determining region 3 for antibody 20537
QYYVTSPLT

SEQ ID NO: 41074 - protein, 8 aa, Homo sapiens
  heavy chain complementarity determining region 3 for antibody 20537
VCMIVATN

SEQ ID NO: 41075 - protein, 8 aa, Homo sapiens
  light chain complementarity determining region 3 for antibody 20538
QYYGYSPT

SEQ ID NO: 41076 - protein, 9 aa, Homo sapiens
  heavy chain complementarity determining region 3 for antibody 20538
ARGYGAFDI

SEQ ID NO: 41077 - protein, 8 aa, Homo sapiens
  light chain complementarity determining region 3 for antibody 20539
QYYGSSPP

SEQ ID NO: 41078 - protein, 9 aa, Homo sapiens
  heavy chain complementarity determining region 3 for antibody 20539
ARGYDAFDF

SEQ ID NO: 41079 - protein, 9 aa, Homo sapiens
  light chain complementarity determining region 3 for antibody 20540
QYYGRSTWT

SEQ ID NO: 41080 - protein, 17 aa, Homo sapiens
  heavy chain complementarity determining region 3 for antibody 20540
ARTVLYHFTSGRAAFDV

SEQ ID NO: 41081 - protein, 9 aa, Homo sapiens
  light chain complementarity determining region 3 for antibody 20541
QYYGRSPWT

SEQ ID NO: 41082 - protein, 17 aa, Homo sapiens
  heavy chain complementarity determining region 3 for antibody 20541
ARTVLYHITSGRAAFDV

SEQ ID NO: 41083 - protein, 9 aa, Homo sapiens
  light chain complementarity determining region 3 for antibody 20542
QYYGRSPWT

SEQ ID NO: 41084 - protein, 17 aa, Homo sapiens
  heavy chain complementarity determining region 3 for antibody 20542
ARTVLYHFTSGRAACDV

SEQ ID NO: 41085 - protein, 9 aa, Homo sapiens
  light chain complementarity determining region 3 for antibody 20543
QYYGRSPWT

SEQ ID NO: 41086 - protein, 17 aa, Homo sapiens
  heavy chain complementarity determining region 3 for antibody 20543
ARTVLYHFPSGRAAFDV

SEQ ID NO: 41087 - protein, 9 aa, Homo sapiens
  light chain complementarity determining region 3 for antibody 20544
QYYGRSPWT

SEQ ID NO: 41088 - protein, 17 aa, Homo sapiens
  heavy chain complementarity determining region 3 for antibody 20544
ARTVLYHFASGRAAFDV

SEQ ID NO: 41089 - protein, 8 aa, Homo sapiens
  light chain complementarity determining region 3 for antibody 20545
QYYGRSPT

SEQ ID NO: 41090 - protein, 9 aa, Homo sapiens
  heavy chain complementarity determining region 3 for antibody 20545
ARGYDAFDF

SEQ ID NO: 41091 - protein, 9 aa, Homo sapiens
  light chain complementarity determining region 3 for antibody 20546
QYYGMSPWT

SEQ ID NO: 41092 - protein, 17 aa, Homo sapiens
  heavy chain complementarity determining region 3 for antibody 20546
ARTVLYHFTSGRAAFDV

SEQ ID NO: 41093 - protein, 9 aa, Homo sapiens
  light chain complementarity determining region 3 for antibody 20547
QYYGASPYP

SEQ ID NO: 41094 - protein, 14 aa, Homo sapiens
  heavy chain complementarity determining region 3 for antibody 20547
ARVGVFASGQVFDL

SEQ ID NO: 41095 - protein, 9 aa, Homo sapiens
  light chain complementarity determining region 3 for antibody 20548
QYYGASPGT

SEQ ID NO: 41096 - protein, 11 aa, Homo sapiens
  heavy chain complementarity determining region 3 for antibody 20548
ARGEVGYAFDI

SEQ ID NO: 41097 - protein, 9 aa, Homo sapiens
  light chain complementarity determining region 3 for antibody 20549
QYYGASPFT

SEQ ID NO: 41098 - protein, 11 aa, Homo sapiens
  heavy chain complementarity determining region 3 for antibody 20549
ARGEVGYAFDI

SEQ ID NO: 41099 - protein, 10 aa, Homo sapiens
  light chain complementarity determining region 3 for antibody 20550
QYYDDSPGYT

SEQ ID NO: 41100 - protein, 12 aa, Homo sapiens
  heavy chain complementarity determining region 3 for antibody 20550
AREATNIGELDY

SEQ ID NO: 41101 - protein, 10 aa, Homo sapiens
  light chain complementarity determining region 3 for antibody 20551
QYYDDSPGYI

SEQ ID NO: 41102 - protein, 12 aa, Homo sapiens
  heavy chain complementarity determining region 3 for antibody 20551
ARETTNIGELDY

SEQ ID NO: 41103 - protein, 9 aa, Homo sapiens
  light chain complementarity determining region 3 for antibody 20552
QYYCASPCT

SEQ ID NO: 41104 - protein, 11 aa, Homo sapiens
  heavy chain complementarity determining region 3 for antibody 20552
ARGEVGYAFDI

SEQ ID NO: 41105 - protein, 11 aa, Homo sapiens
  light chain complementarity determining region 3 for antibody 20553
QYRNNWPAEYT

SEQ ID NO: 41106 - protein, 15 aa, Homo sapiens
  heavy chain complementarity determining region 3 for antibody 20553
AREGVDRLTISAFDI

SEQ ID NO: 41107 - protein, 11 aa, Homo sapiens
  light chain complementarity determining region 3 for antibody 20554
QYRHNWPAEYP

SEQ ID NO: 41108 - protein, 15 aa, Homo sapiens
  heavy chain complementarity determining region 3 for antibody 20554
AREGVDRLTISAFDI

SEQ ID NO: 41109 - protein, 11 aa, Homo sapiens
  light chain complementarity determining region 3 for antibody 20555
QYRHNWPAEHT

SEQ ID NO: 41110 - protein, 15 aa, Homo sapiens
  heavy chain complementarity determining region 3 for antibody 20555
AREGVDRLTISAFDI

SEQ ID NO: 41111 - protein, 11 aa, Homo sapiens
  light chain complementarity determining region 3 for antibody 20556
QYRHNWPAEDT

SEQ ID NO: 41112 - protein, 15 aa, Homo sapiens
  heavy chain complementarity determining region 3 for antibody 20556
AREGVDRLTISAFDI

SEQ ID NO: 41113 - protein, 8 aa, Homo sapiens
  light chain complementarity determining region 3 for antibody 20557
QYGNLPRT

SEQ ID NO: 41114 - protein, 13 aa, Homo sapiens
  heavy chain complementarity determining region 3 for antibody 20557
AGGDFHSGGYSEF

SEQ ID NO: 41115 - protein, 11 aa, Homo sapiens
  light chain complementarity determining region 3 for antibody 20558
QVFDTSPPTYT

SEQ ID NO: 41116 - protein, 23 aa, Homo sapiens
  heavy chain complementarity determining region 3 for antibody 20558
ARANRRYRRSDSRMDFLYFGMDV

SEQ ID NO: 41117 - protein, 11 aa, Homo sapiens
  light chain complementarity determining region 3 for antibody 20559
QVFDTSPPMYP

SEQ ID NO: 41118 - protein, 23 aa, Homo sapiens
  heavy chain complementarity determining region 3 for antibody 20559
ARANRRYRRSDSRMDFLYFGMDV

SEQ ID NO: 41119 - protein, 11 aa, Homo sapiens
  light chain complementarity determining region 3 for antibody 20560
QVFDTSPPMST

SEQ ID NO: 41120 - protein, 23 aa, Homo sapiens
  heavy chain complementarity determining region 3 for antibody 20560
ARANRRYRRSDSRMDFLYFGMDV

SEQ ID NO: 41121 - protein, 11 aa, Homo sapiens
  light chain complementarity determining region 3 for antibody 20561
QVFDTSPPLST

SEQ ID NO: 41122 - protein, 23 aa, Homo sapiens
  heavy chain complementarity determining region 3 for antibody 20561
ARANRRYRRSDSRMDFLYFGMDV

SEQ ID NO: 41123 - protein, 9 aa, Homo sapiens
  light chain complementarity determining region 3 for antibody 20562
QTYGGSPRT

SEQ ID NO: 41124 - protein, 13 aa, Homo sapiens
  heavy chain complementarity determining region 3 for antibody 20562
AAGYFSSGTYYEY

SEQ ID NO: 41125 - protein, 10 aa, Homo sapiens
  light chain complementarity determining region 3 for antibody 20563
QTYGGSPLVT

SEQ ID NO: 41126 - protein, 14 aa, Homo sapiens
  heavy chain complementarity determining region 3 for antibody 20563
ARDPISGSPDYFDY

SEQ ID NO: 41127 - protein, 9 aa, Homo sapiens
  light chain complementarity determining region 3 for antibody 20564
QSYGRSPWT

SEQ ID NO: 41128 - protein, 17 aa, Homo sapiens
  heavy chain complementarity determining region 3 for antibody 20564
ARTVLYHFTSGRAAFDV

SEQ ID NO: 41129 - protein, 9 aa, Homo sapiens
  light chain complementarity determining region 3 for antibody 20565
QSYGASPYT

SEQ ID NO: 41130 - protein, 14 aa, Homo sapiens
  heavy chain complementarity determining region 3 for antibody 20565
ARVGVFASGQVFDL

SEQ ID NO: 41131 - protein, 9 aa, Homo sapiens
  light chain complementarity determining region 3 for antibody 20566
QRYYTSVRT

SEQ ID NO: 41132 - protein, 12 aa, Homo sapiens
  heavy chain complementarity determining region 3 for antibody 20566
VKDCGLGGSRDF

SEQ ID NO: 41133 - protein, 9 aa, Homo sapiens
  light chain complementarity determining region 3 for antibody 20567
QRYRRSPST

SEQ ID NO: 41134 - protein, 17 aa, Homo sapiens
  heavy chain complementarity determining region 3 for antibody 20567
AGLSSRLGDGSPSLFDY

SEQ ID NO: 41135 - protein, 8 aa, Homo sapiens
  light chain complementarity determining region 3 for antibody 20568
QRYNSYLT

SEQ ID NO: 41136 - protein, 14 aa, Homo sapiens
  heavy chain complementarity determining region 3 for antibody 20568
ARNSEGSGWFPCDY

SEQ ID NO: 41137 - protein, 9 aa, Homo sapiens
  light chain complementarity determining region 3 for antibody 20569
QRYGSSRVT

SEQ ID NO: 41138 - protein, 17 aa, Homo sapiens
  heavy chain complementarity determining region 3 for antibody 20569
AKPPLPWVGELSSAFDM

SEQ ID NO: 41139 - protein, 10 aa, Homo sapiens
  light chain complementarity determining region 3 for antibody 20570
QRYGSSPPVT

SEQ ID NO: 41140 - protein, 15 aa, Homo sapiens
  heavy chain complementarity determining region 3 for antibody 20570
AKGPMVRGVLGPFDY

SEQ ID NO: 41141 - protein, 9 aa, Homo sapiens
  light chain complementarity determining region 3 for antibody 20571
QRYGSSPDT

SEQ ID NO: 41142 - protein, 15 aa, Homo sapiens
  heavy chain complementarity determining region 3 for antibody 20571
AREGGYCGGDCSFDY

SEQ ID NO: 41143 - protein, 9 aa, Homo sapiens
  light chain complementarity determining region 3 for antibody 20572
QRYGRIPRT

SEQ ID NO: 41144 - protein, 13 aa, Homo sapiens
  heavy chain complementarity determining region 3 for antibody 20572
AGGLFGSGTYSEF

SEQ ID NO: 41145 - protein, 9 aa, Homo sapiens
  light chain complementarity determining region 3 for antibody 20573
QRYGNIPRT

SEQ ID NO: 41146 - protein, 13 aa, Homo sapiens
  heavy chain complementarity determining region 3 for antibody 20573
AGGLFHSSGYSEF

SEQ ID NO: 41147 - protein, 10 aa, Homo sapiens
  light chain complementarity determining region 3 for antibody 20574
QRYGGSPLYT

SEQ ID NO: 41148 - protein, 11 aa, Homo sapiens
  heavy chain complementarity determining region 3 for antibody 20574
ARKGGLRYFDD

SEQ ID NO: 41149 - protein, 9 aa, Homo sapiens
  light chain complementarity determining region 3 for antibody 20575
QRYERSPQT

SEQ ID NO: 41150 - protein, 15 aa, Homo sapiens
  heavy chain complementarity determining region 3 for antibody 20575
ARDPTVASHHYGVDV

SEQ ID NO: 41151 - protein, 8 aa, Homo sapiens
  light chain complementarity determining region 3 for antibody 20576
QRYENLVT

SEQ ID NO: 41152 - protein, 18 aa, Homo sapiens
  heavy chain complementarity determining region 3 for antibody 20576
AKGAEGSCSVRKCYPFDY

SEQ ID NO: 41153 - protein, 11 aa, Homo sapiens
  light chain complementarity determining region 3 for antibody 20577
QRYDTSPPRYR

SEQ ID NO: 41154 - protein, 14 aa, Homo sapiens
  heavy chain complementarity determining region 3 for antibody 20577
ARHKQESGTRGFDF

SEQ ID NO: 41155 - protein, 11 aa, Homo sapiens
  light chain complementarity determining region 3 for antibody 20578
QRWSTSGSSYL

SEQ ID NO: 41156 - protein, 14 aa, Homo sapiens
  heavy chain complementarity determining region 3 for antibody 20578
ARHTEVTGLRGFDR

SEQ ID NO: 41157 - protein, 11 aa, Homo sapiens
  light chain complementarity determining region 3 for antibody 20579
QRWSTSGSSYI

SEQ ID NO: 41158 - protein, 14 aa, Homo sapiens
  heavy chain complementarity determining region 3 for antibody 20579
ARHTEVTGLRGFDR

SEQ ID NO: 41159 - protein, 11 aa, Homo sapiens
  light chain complementarity determining region 3 for antibody 20580
QRWSTSGSRYL

SEQ ID NO: 41160 - protein, 14 aa, Homo sapiens
  heavy chain complementarity determining region 3 for antibody 20580
ARHTEVTGLRGFDR

SEQ ID NO: 41161 - protein, 11 aa, Homo sapiens
  light chain complementarity determining region 3 for antibody 20581
QRWSTSGSRYI

SEQ ID NO: 41162 - protein, 14 aa, Homo sapiens
  heavy chain complementarity determining region 3 for antibody 20581
ARHTEVTGLRGFDP

SEQ ID NO: 41163 - protein, 11 aa, Homo sapiens
  light chain complementarity determining region 3 for antibody 20582
QRWSTSGSRSI

SEQ ID NO: 41164 - protein, 14 aa, Homo sapiens
  heavy chain complementarity determining region 3 for antibody 20582
ARHTEVTGLRGFDR

SEQ ID NO: 41165 - protein, 9 aa, Homo sapiens
  light chain complementarity determining region 3 for antibody 20583
QRTYNAPYT

SEQ ID NO: 41166 - protein, 17 aa, Homo sapiens
  heavy chain complementarity determining region 3 for antibody 20583
TKDRWLRVYDSSGCFDS

SEQ ID NO: 41167 - protein, 9 aa, Homo sapiens
  light chain complementarity determining region 3 for antibody 20584
QRSYNTPRT

SEQ ID NO: 41168 - protein, 24 aa, Homo sapiens
  heavy chain complementarity determining region 3 for antibody 20584
ARESVVHSDIWRSPAPRYYYAMDV

SEQ ID NO: 41169 - protein, 8 aa, Homo sapiens
  light chain complementarity determining region 3 for antibody 20585
QRSNWPPT

SEQ ID NO: 41170 - protein, 8 aa, Homo sapiens
  heavy chain complementarity determining region 3 for antibody 20585
ATLGNDSD

SEQ ID NO: 41171 - protein, 9 aa, Homo sapiens
  light chain complementarity determining region 3 for antibody 20586
QRNYNAPYT

SEQ ID NO: 41172 - protein, 17 aa, Homo sapiens
  heavy chain complementarity determining region 3 for antibody 20586
TKDRWLRVYDSSGCYDS

SEQ ID NO: 41173 - protein, 9 aa, Homo sapiens
  light chain complementarity determining region 3 for antibody 20587
QRLYNAPYT

SEQ ID NO: 41174 - protein, 17 aa, Homo sapiens
  heavy chain complementarity determining region 3 for antibody 20587
TKDRWLRVYDSSGCYDS

SEQ ID NO: 41175 - protein, 9 aa, Homo sapiens
  light chain complementarity determining region 3 for antibody 20588
QRLNSYPHT

SEQ ID NO: 41176 - protein, 12 aa, Homo sapiens
  heavy chain complementarity determining region 3 for antibody 20588
ARTSLSHDYGYY

SEQ ID NO: 41177 - protein, 8 aa, Homo sapiens
  light chain complementarity determining region 3 for antibody 20589
QRHGSSPL

SEQ ID NO: 41178 - protein, 15 aa, Homo sapiens
  heavy chain complementarity determining region 3 for antibody 20589
ARDRASIGYYYLFDY

SEQ ID NO: 41179 - protein, 11 aa, Homo sapiens
  light chain complementarity determining region 3 for antibody 20590
QRGSTSGSRYI

SEQ ID NO: 41180 - protein, 14 aa, Homo sapiens
  heavy chain complementarity determining region 3 for antibody 20590
ARHTEVTGLRGFDR

SEQ ID NO: 41181 - protein, 9 aa, Homo sapiens
  light chain complementarity determining region 3 for antibody 20591
QQYYTTTRP

SEQ ID NO: 41182 - protein, 8 aa, Homo sapiens
  heavy chain complementarity determining region 3 for antibody 20591
ARDGAFDS

SEQ ID NO: 41183 - protein, 8 aa, Homo sapiens
  light chain complementarity determining region 3 for antibody 20592
QQYYTTRP

SEQ ID NO: 41184 - protein, 9 aa, Homo sapiens
  heavy chain complementarity determining region 3 for antibody 20592
SIDNLGMGY

SEQ ID NO: 41185 - protein, 9 aa, Homo sapiens
  light chain complementarity determining region 3 for antibody 20593
QQYYTTPYT

SEQ ID NO: 41186 - protein, 24 aa, Homo sapiens
  heavy chain complementarity determining region 3 for antibody 20593
ARDGGTNILRILQWLAPHHFGLDV

SEQ ID NO: 41187 - protein, 9 aa, Homo sapiens
  light chain complementarity determining region 3 for antibody 20594
QQYYTTPRT

SEQ ID NO: 41188 - protein, 15 aa, Homo sapiens
  heavy chain complementarity determining region 3 for antibody 20594
SSLSPAWYDSSGYSA

SEQ ID NO: 41189 - protein, 9 aa, Homo sapiens
  light chain complementarity determining region 3 for antibody 20595
QQYYTTPRS

SEQ ID NO: 41190 - protein, 8 aa, Homo sapiens
  heavy chain complementarity determining region 3 for antibody 20595
ARDGAFDS

SEQ ID NO: 41191 - protein, 9 aa, Homo sapiens
  light chain complementarity determining region 3 for antibody 20596
QQYYTTPRA

SEQ ID NO: 41192 - protein, 8 aa, Homo sapiens
  heavy chain complementarity determining region 3 for antibody 20596
ARDGAFDS

SEQ ID NO: 41193 - protein, 9 aa, Homo sapiens
  light chain complementarity determining region 3 for antibody 20597
QQYYTTPPT

SEQ ID NO: 41194 - protein, 11 aa, Homo sapiens
  heavy chain complementarity determining region 3 for antibody 20597
ARLTGDWFFDL

SEQ ID NO: 41195 - protein, 11 aa, Homo sapiens
  light chain complementarity determining region 3 for antibody 20598
QQYYTTPPMYL

SEQ ID NO: 41196 - protein, 16 aa, Homo sapiens
  heavy chain complementarity determining region 3 for antibody 20598
ARDPDTSGWYLHAFDI

SEQ ID NO: 41197 - protein, 11 aa, Homo sapiens
  light chain complementarity determining region 3 for antibody 20599
QQYYTTPPMNT

SEQ ID NO: 41198 - protein, 16 aa, Homo sapiens
  heavy chain complementarity determining region 3 for antibody 20599
ARDPDTSGWYLHAFDI

SEQ ID NO: 41199 - protein, 9 aa, Homo sapiens
  light chain complementarity determining region 3 for antibody 20600
QQYYTSVRK

SEQ ID NO: 41200 - protein, 12 aa, Homo sapiens
  heavy chain complementarity determining region 3 for antibody 20600
VKDCGLGGSRDS

SEQ ID NO: 41201 - protein, 9 aa, Homo sapiens
  light chain complementarity determining region 3 for antibody 20601
QQYYTSSRT

SEQ ID NO: 41202 - protein, 12 aa, Homo sapiens
  heavy chain complementarity determining region 3 for antibody 20601
VKDCGLGGSRDS

SEQ ID NO: 41203 - protein, 9 aa, Homo sapiens
  light chain complementarity determining region 3 for antibody 20602
QQYYTSRRT

SEQ ID NO: 41204 - protein, 12 aa, Homo sapiens
  heavy chain complementarity determining region 3 for antibody 20602
VKDCGLGGSRDS

SEQ ID NO: 41205 - protein, 9 aa, Homo sapiens
  light chain complementarity determining region 3 for antibody 20603
QQYYTSPLP

SEQ ID NO: 41206 - protein, 20 aa, Homo sapiens
  heavy chain complementarity determining region 3 for antibody 20603
ARDQAYYYGSGSSGVDWFDP

SEQ ID NO: 41207 - protein, 9 aa, Homo sapiens
  light chain complementarity determining region 3 for antibody 20604
QQYYTSLRT

SEQ ID NO: 41208 - protein, 12 aa, Homo sapiens
  heavy chain complementarity determining region 3 for antibody 20604
VKGCGLGGSRDS

SEQ ID NO: 41209 - protein, 9 aa, Homo sapiens
  light chain complementarity determining region 3 for antibody 20605
QQYYTSLRT

SEQ ID NO: 41210 - protein, 12 aa, Homo sapiens
  heavy chain complementarity determining region 3 for antibody 20605
VKDGGLGGSRDS

SEQ ID NO: 41211 - protein, 9 aa, Homo sapiens
  light chain complementarity determining region 3 for antibody 20606
QQYYTSLRT

SEQ ID NO: 41212 - protein, 12 aa, Homo sapiens
  heavy chain complementarity determining region 3 for antibody 20606
VKDCGRGGSRDS

SEQ ID NO: 41213 - protein, 9 aa, Homo sapiens
  light chain complementarity determining region 3 for antibody 20607
QQYYTSLRT

SEQ ID NO: 41214 - protein, 12 aa, Homo sapiens
  heavy chain complementarity determining region 3 for antibody 20607
VKDCGLGGSRGS

SEQ ID NO: 41215 - protein, 9 aa, Homo sapiens
  light chain complementarity determining region 3 for antibody 20608
QQYYTSLRT

SEQ ID NO: 41216 - protein, 12 aa, Homo sapiens
  heavy chain complementarity determining region 3 for antibody 20608
VEDCGLGGSRDS

SEQ ID NO: 41217 - protein, 9 aa, Homo sapiens
  light chain complementarity determining region 3 for antibody 20609
QQYYTSLRR

SEQ ID NO: 41218 - protein, 12 aa, Homo sapiens
  heavy chain complementarity determining region 3 for antibody 20609
VKDCGLGGSRDS

SEQ ID NO: 41219 - protein, 9 aa, Homo sapiens
  light chain complementarity determining region 3 for antibody 20610
QQYYTSLRQ

SEQ ID NO: 41220 - protein, 12 aa, Homo sapiens
  heavy chain complementarity determining region 3 for antibody 20610
VKDCGLGGSRDS

SEQ ID NO: 41221 - protein, 11 aa, Homo sapiens
  light chain complementarity determining region 3 for antibody 20611
QQYYTSLLGLT

SEQ ID NO: 41222 - protein, 12 aa, Homo sapiens
  heavy chain complementarity determining region 3 for antibody 20611
ATSPSPYYHLDF

SEQ ID NO: 41223 - protein, 11 aa, Homo sapiens
  light chain complementarity determining region 3 for antibody 20612
QQYYTSLLGFP

SEQ ID NO: 41224 - protein, 12 aa, Homo sapiens
  heavy chain complementarity determining region 3 for antibody 20612
ATSPSPYYHLDF

SEQ ID NO: 41225 - protein, 9 aa, Homo sapiens
  light chain complementarity determining region 3 for antibody 20613
QQYYTSLGT

SEQ ID NO: 41226 - protein, 12 aa, Homo sapiens
  heavy chain complementarity determining region 3 for antibody 20613
VKDCGLGGSRDS

SEQ ID NO: 41227 - protein, 9 aa, Homo sapiens
  light chain complementarity determining region 3 for antibody 20614
QQYYTSFRT

SEQ ID NO: 41228 - protein, 12 aa, Homo sapiens
  heavy chain complementarity determining region 3 for antibody 20614
VKECGLGGSRDF

SEQ ID NO: 41229 - protein, 9 aa, Homo sapiens
  light chain complementarity determining region 3 for antibody 20615
QQYYTSFRP

SEQ ID NO: 41230 - protein, 12 aa, Homo sapiens
  heavy chain complementarity determining region 3 for antibody 20615
VKDCGLGGSRDS

SEQ ID NO: 41231 - protein, 9 aa, Homo sapiens
  light chain complementarity determining region 3 for antibody 20616
QQYYTSFRP

SEQ ID NO: 41232 - protein, 12 aa, Homo sapiens
  heavy chain complementarity determining region 3 for antibody 20616
VKDCGLGGSRDF

SEQ ID NO: 41233 - protein, 9 aa, Homo sapiens
  light chain complementarity determining region 3 for antibody 20617
QQYYTSFGT

SEQ ID NO: 41234 - protein, 12 aa, Homo sapiens
  heavy chain complementarity determining region 3 for antibody 20617
VKDCGLGGSRDS

SEQ ID NO: 41235 - protein, 9 aa, Homo sapiens
  light chain complementarity determining region 3 for antibody 20618
QQYYTSART

SEQ ID NO: 41236 - protein, 12 aa, Homo sapiens
  heavy chain complementarity determining region 3 for antibody 20618
VKDCGLGGSRDF

SEQ ID NO: 41237 - protein, 8 aa, Homo sapiens
  light chain complementarity determining region 3 for antibody 20619
QQYYTPRS

SEQ ID NO: 41238 - protein, 9 aa, Homo sapiens
  heavy chain complementarity determining region 3 for antibody 20619
SIDNLGMGY

SEQ ID NO: 41239 - protein, 9 aa, Homo sapiens
  light chain complementarity determining region 3 for antibody 20620
QQYYTPPRT

SEQ ID NO: 41240 - protein, 11 aa, Homo sapiens
  heavy chain complementarity determining region 3 for antibody 20620
TRGQDRSKQGY

SEQ ID NO: 41241 - protein, 9 aa, Homo sapiens
  light chain complementarity determining region 3 for antibody 20621
QQYYTIPPP

SEQ ID NO: 41242 - protein, 10 aa, Homo sapiens
  heavy chain complementarity determining region 3 for antibody 20621
TGFVVSTIPY

SEQ ID NO: 41243 - protein, 9 aa, Homo sapiens
  light chain complementarity determining region 3 for antibody 20622
QQYYTIPLP

SEQ ID NO: 41244 - protein, 11 aa, Homo sapiens
  heavy chain complementarity determining region 3 for antibody 20622
ARSDKVNWFDT

SEQ ID NO: 41245 - protein, 9 aa, Homo sapiens
  light chain complementarity determining region 3 for antibody 20623
QQYYTHPRT

SEQ ID NO: 41246 - protein, 8 aa, Homo sapiens
  heavy chain complementarity determining region 3 for antibody 20623
ARDGAFDS

SEQ ID NO: 41247 - protein, 9 aa, Homo sapiens
  light chain complementarity determining region 3 for antibody 20624
QQYYTFVRT

SEQ ID NO: 41248 - protein, 12 aa, Homo sapiens
  heavy chain complementarity determining region 3 for antibody 20624
VKDCGLGGSRDS

SEQ ID NO: 41249 - protein, 11 aa, Homo sapiens
  light chain complementarity determining region 3 for antibody 20625
QQYYTFLLGFT

SEQ ID NO: 41250 - protein, 12 aa, Homo sapiens
  heavy chain complementarity determining region 3 for antibody 20625
ATSPSPYYHLDF

SEQ ID NO: 41251 - protein, 9 aa, Homo sapiens
  light chain complementarity determining region 3 for antibody 20626
QQYYTFFRT

SEQ ID NO: 41252 - protein, 12 aa, Homo sapiens
  heavy chain complementarity determining region 3 for antibody 20626
VKDCGLGGSRDS

SEQ ID NO: 41253 - protein, 9 aa, Homo sapiens
  light chain complementarity determining region 3 for antibody 20627
QQYYTFFRK

SEQ ID NO: 41254 - protein, 12 aa, Homo sapiens
  heavy chain complementarity determining region 3 for antibody 20627
VKDCGLGGSRDS

SEQ ID NO: 41255 - protein, 8 aa, Homo sapiens
  light chain complementarity determining region 3 for antibody 20628
QQYYSYRT

SEQ ID NO: 41256 - protein, 14 aa, Homo sapiens
  heavy chain complementarity determining region 3 for antibody 20628
VADQDVYWSGYFRT

SEQ ID NO: 41257 - protein, 8 aa, Homo sapiens
  light chain complementarity determining region 3 for antibody 20629
QQYYSYRT

SEQ ID NO: 41258 - protein, 14 aa, Homo sapiens
  heavy chain complementarity determining region 3 for antibody 20629
GTDQDVYWSGYFRT

SEQ ID NO: 41259 - protein, 9 aa, Homo sapiens
  light chain complementarity determining region 3 for antibody 20630
QQYYSYPLT

SEQ ID NO: 41260 - protein, 17 aa, Homo sapiens
  heavy chain complementarity determining region 3 for antibody 20630
ARALDIVVVVDAIWFDP

SEQ ID NO: 41261 - protein, 9 aa, Homo sapiens
  light chain complementarity determining region 3 for antibody 20631
QQYYSVPGR

SEQ ID NO: 41262 - protein, 14 aa, Homo sapiens
  heavy chain complementarity determining region 3 for antibody 20631
AKDGGRGGGSAFDY

SEQ ID NO: 41263 - protein, 9 aa, Homo sapiens
  light chain complementarity determining region 3 for antibody 20632
QQYYSTPRT

SEQ ID NO: 41264 - protein, 8 aa, Homo sapiens
  heavy chain complementarity determining region 3 for antibody 20632
ARDGAFDS

SEQ ID NO: 41265 - protein, 9 aa, Homo sapiens
  light chain complementarity determining region 3 for antibody 20633
QQYYSTPRA

SEQ ID NO: 41266 - protein, 13 aa, Homo sapiens
  heavy chain complementarity determining region 3 for antibody 20633
AAVEPYYYYGMDV

SEQ ID NO: 41267 - protein, 9 aa, Homo sapiens
  light chain complementarity determining region 3 for antibody 20634
QQYYSTPQT

SEQ ID NO: 41268 - protein, 13 aa, Homo sapiens
  heavy chain complementarity determining region 3 for antibody 20634
ATGDTDMVRAFDI

SEQ ID NO: 41269 - protein, 9 aa, Homo sapiens
  light chain complementarity determining region 3 for antibody 20635
QQYYSTPPT

SEQ ID NO: 41270 - protein, 13 aa, Homo sapiens
  heavy chain complementarity determining region 3 for antibody 20635
ATGDTDMVRAFDI

SEQ ID NO: 41271 - protein, 9 aa, Homo sapiens
  light chain complementarity determining region 3 for antibody 20636
QQYYSTPPT

SEQ ID NO: 41272 - protein, 20 aa, Homo sapiens
  heavy chain complementarity determining region 3 for antibody 20636
ARDQAYYYGSGSSGVDWFDP

SEQ ID NO: 41273 - protein, 10 aa, Homo sapiens
  light chain complementarity determining region 3 for antibody 20637
QQYYSTPPNT

SEQ ID NO: 41274 - protein, 16 aa, Homo sapiens
  heavy chain complementarity determining region 3 for antibody 20637
VGDISLAMSSRRGFVY

SEQ ID NO: 41275 - protein, 10 aa, Homo sapiens
  light chain complementarity determining region 3 for antibody 20638
QQYYSTPPIT

SEQ ID NO: 41276 - protein, 8 aa, Homo sapiens
  heavy chain complementarity determining region 3 for antibody 20638
GDYYGMDV

SEQ ID NO: 41277 - protein, 9 aa, Homo sapiens
  light chain complementarity determining region 3 for antibody 20639
QQYYSTPLT

SEQ ID NO: 41278 - protein, 20 aa, Homo sapiens
  heavy chain complementarity determining region 3 for antibody 20639
ARDQAYYYSSGSSGVDWFDP

SEQ ID NO: 41279 - protein, 9 aa, Homo sapiens
  light chain complementarity determining region 3 for antibody 20640
QQYYSTPLT

SEQ ID NO: 41280 - protein, 20 aa, Homo sapiens
  heavy chain complementarity determining region 3 for antibody 20640
ARDQAYYSGSGSSGVDWFGP

SEQ ID NO: 41281 - protein, 9 aa, Homo sapiens
  light chain complementarity determining region 3 for antibody 20641
QQYYSTPLT

SEQ ID NO: 41282 - protein, 16 aa, Homo sapiens
  heavy chain complementarity determining region 3 for antibody 20641
AKDTYYYDIRGYPGDY

SEQ ID NO: 41283 - protein, 9 aa, Homo sapiens
  light chain complementarity determining region 3 for antibody 20642
QQYYSSPWT

SEQ ID NO: 41284 - protein, 15 aa, Homo sapiens
  heavy chain complementarity determining region 3 for antibody 20642
ARHRTEMATITYSDY

SEQ ID NO: 41285 - protein, 8 aa, Homo sapiens
  light chain complementarity determining region 3 for antibody 20643
QQYYSSPT

SEQ ID NO: 41286 - protein, 16 aa, Homo sapiens
  heavy chain complementarity determining region 3 for antibody 20643
ARSIAAGPAANGWFDP

SEQ ID NO: 41287 - protein, 9 aa, Homo sapiens
  light chain complementarity determining region 3 for antibody 20644
QQYYSSPLT

SEQ ID NO: 41288 - protein, 14 aa, Homo sapiens
  heavy chain complementarity determining region 3 for antibody 20644
SAADRSDTSAYYSN

SEQ ID NO: 41289 - protein, 9 aa, Homo sapiens
  light chain complementarity determining region 3 for antibody 20645
QQYYSSPIT

SEQ ID NO: 41290 - protein, 21 aa, Homo sapiens
  heavy chain complementarity determining region 3 for antibody 20645
AKDAGLSIFRYCDGLFDAFHI

SEQ ID NO: 41291 - protein, 9 aa, Homo sapiens
  light chain complementarity determining region 3 for antibody 20646
QQYYSSPGT

SEQ ID NO: 41292 - protein, 16 aa, Homo sapiens
  heavy chain complementarity determining region 3 for antibody 20646
ARGSMVRDPRENWFDP

SEQ ID NO: 41293 - protein, 9 aa, Homo sapiens
  light chain complementarity determining region 3 for antibody 20647
QQYYSPPYT

SEQ ID NO: 41294 - protein, 13 aa, Homo sapiens
  heavy chain complementarity determining region 3 for antibody 20647
ASSSDSSDYYLRY

SEQ ID NO: 41295 - protein, 9 aa, Homo sapiens
  light chain complementarity determining region 3 for antibody 20648
QQYYSPPWT

SEQ ID NO: 41296 - protein, 15 aa, Homo sapiens
  heavy chain complementarity determining region 3 for antibody 20648
IRQSKVDGNYNYPDF

SEQ ID NO: 41297 - protein, 10 aa, Homo sapiens
  light chain complementarity determining region 3 for antibody 20649
QQYYSPPSIT

SEQ ID NO: 41298 - protein, 15 aa, Homo sapiens
  heavy chain complementarity determining region 3 for antibody 20649
AAVIYYDGDYYGMDV

SEQ ID NO: 41299 - protein, 9 aa, Homo sapiens
  light chain complementarity determining region 3 for antibody 20650
QQYYSIPGT

SEQ ID NO: 41300 - protein, 14 aa, Homo sapiens
  heavy chain complementarity determining region 3 for antibody 20650
AKCGYSYGNDAFDI

SEQ ID NO: 41301 - protein, 9 aa, Homo sapiens
  light chain complementarity determining region 3 for antibody 20651
QQYYSGPWT

SEQ ID NO: 41302 - protein, 14 aa, Homo sapiens
  heavy chain complementarity determining region 3 for antibody 20651
AKDGGRGGGSAFDY

SEQ ID NO: 41303 - protein, 9 aa, Homo sapiens
  light chain complementarity determining region 3 for antibody 20652
QQYYSGPIT

SEQ ID NO: 41304 - protein, 21 aa, Homo sapiens
  heavy chain complementarity determining region 3 for antibody 20652
AKDAGLSIFRYFDGLFDAFHI

SEQ ID NO: 41305 - protein, 9 aa, Homo sapiens
  light chain complementarity determining region 3 for antibody 20653
QQYYRYPVT

SEQ ID NO: 41306 - protein, 15 aa, Homo sapiens
  heavy chain complementarity determining region 3 for antibody 20653
AHGQHTTTVTAYFNF

SEQ ID NO: 41307 - protein, 9 aa, Homo sapiens
  light chain complementarity determining region 3 for antibody 20654
QQYYRYPGT

SEQ ID NO: 41308 - protein, 15 aa, Homo sapiens
  heavy chain complementarity determining region 3 for antibody 20654
AHGQHTTTVTSYFNF

SEQ ID NO: 41309 - protein, 10 aa, Homo sapiens
  light chain complementarity determining region 3 for antibody 20655
QQYYRTPSIT

SEQ ID NO: 41310 - protein, 15 aa, Homo sapiens
  heavy chain complementarity determining region 3 for antibody 20655
AAVIYYDGDYYGMDV

SEQ ID NO: 41311 - protein, 10 aa, Homo sapiens
  light chain complementarity determining region 3 for antibody 20656
QQYYRTPPYT

SEQ ID NO: 41312 - protein, 16 aa, Homo sapiens
  heavy chain complementarity determining region 3 for antibody 20656
VGDISLAMSSRRGFVY

SEQ ID NO: 41313 - protein, 9 aa, Homo sapiens
  light chain complementarity determining region 3 for antibody 20657
QQYYRRPPT

SEQ ID NO: 41314 - protein, 19 aa, Homo sapiens
  heavy chain complementarity determining region 3 for antibody 20657
VKGRRGLCSGGNCPHYYDS

SEQ ID NO: 41315 - protein, 9 aa, Homo sapiens
  light chain complementarity determining region 3 for antibody 20658
QQYYRGPPT

SEQ ID NO: 41316 - protein, 19 aa, Homo sapiens
  heavy chain complementarity determining region 3 for antibody 20658
AKGRRGQCSGGNCPHYYDS

SEQ ID NO: 41317 - protein, 9 aa, Homo sapiens
  light chain complementarity determining region 3 for antibody 20659
QQYYPTPRT

SEQ ID NO: 41318 - protein, 8 aa, Homo sapiens
  heavy chain complementarity determining region 3 for antibody 20659
ARDGAFDS

SEQ ID NO: 41319 - protein, 9 aa, Homo sapiens
  light chain complementarity determining region 3 for antibody 20660
QQYYPSVRT

SEQ ID NO: 41320 - protein, 12 aa, Homo sapiens
  heavy chain complementarity determining region 3 for antibody 20660
VKDCGLGGSRDF

SEQ ID NO: 41321 - protein, 9 aa, Homo sapiens
  light chain complementarity determining region 3 for antibody 20661
QQYYNWPRT

SEQ ID NO: 41322 - protein, 17 aa, Homo sapiens
  heavy chain complementarity determining region 3 for antibody 20661
ARDGVESYYESSGYLRH

SEQ ID NO: 41323 - protein, 9 aa, Homo sapiens
  light chain complementarity determining region 3 for antibody 20662
QQYYNTPWT

SEQ ID NO: 41324 - protein, 17 aa, Homo sapiens
  heavy chain complementarity determining region 3 for antibody 20662
SRQESVSETGGYDYPDY

SEQ ID NO: 41325 - protein, 9 aa, Homo sapiens
  light chain complementarity determining region 3 for antibody 20663
QQYYNSPWT

SEQ ID NO: 41326 - protein, 17 aa, Homo sapiens
  heavy chain complementarity determining region 3 for antibody 20663
SRQAHFYGTSAYDYPDS

SEQ ID NO: 41327 - protein, 9 aa, Homo sapiens
  light chain complementarity determining region 3 for antibody 20664
QQYYNNPVT

SEQ ID NO: 41328 - protein, 11 aa, Homo sapiens
  heavy chain complementarity determining region 3 for antibody 20664
AGAEAEGWFDP

SEQ ID NO: 41329 - protein, 9 aa, Homo sapiens
  light chain complementarity determining region 3 for antibody 20665
QQYYNLPLT

SEQ ID NO: 41330 - protein, 16 aa, Homo sapiens
  heavy chain complementarity determining region 3 for antibody 20665
VRDRTASGAPWDSYDL

SEQ ID NO: 41331 - protein, 9 aa, Homo sapiens
  light chain complementarity determining region 3 for antibody 20666
QQYYNLPLT

SEQ ID NO: 41332 - protein, 16 aa, Homo sapiens
  heavy chain complementarity determining region 3 for antibody 20666
VRDGTASGAPWDSYDL

SEQ ID NO: 41333 - protein, 9 aa, Homo sapiens
  light chain complementarity determining region 3 for antibody 20667
QQYYITPWT

SEQ ID NO: 41334 - protein, 17 aa, Homo sapiens
  heavy chain complementarity determining region 3 for antibody 20667
SRQAHFYGTSAYDYPDS

SEQ ID NO: 41335 - protein, 9 aa, Homo sapiens
  light chain complementarity determining region 3 for antibody 20668
QQYYITPRT

SEQ ID NO: 41336 - protein, 11 aa, Homo sapiens
  heavy chain complementarity determining region 3 for antibody 20668
TRGQDRSKQGY

SEQ ID NO: 41337 - protein, 9 aa, Homo sapiens
  light chain complementarity determining region 3 for antibody 20669
QQYYISVRT

SEQ ID NO: 41338 - protein, 12 aa, Homo sapiens
  heavy chain complementarity determining region 3 for antibody 20669
VKDCGLGGSRDS

SEQ ID NO: 41339 - protein, 9 aa, Homo sapiens
  light chain complementarity determining region 3 for antibody 20670
QQYYISVRT

SEQ ID NO: 41340 - protein, 12 aa, Homo sapiens
  heavy chain complementarity determining region 3 for antibody 20670
VKDCGLGGSRDF

SEQ ID NO: 41341 - protein, 9 aa, Homo sapiens
  light chain complementarity determining region 3 for antibody 20671
QQYYISPPT

SEQ ID NO: 41342 - protein, 13 aa, Homo sapiens
  heavy chain complementarity determining region 3 for antibody 20671
ARQAYGSGSYYNA

SEQ ID NO: 41343 - protein, 9 aa, Homo sapiens
  light chain complementarity determining region 3 for antibody 20672
QQYYISFRT

SEQ ID NO: 41344 - protein, 12 aa, Homo sapiens
  heavy chain complementarity determining region 3 for antibody 20672
VKDCGLGGSRDS

SEQ ID NO: 41345 - protein, 9 aa, Homo sapiens
  light chain complementarity determining region 3 for antibody 20673
QQYYIFLRT

SEQ ID NO: 41346 - protein, 12 aa, Homo sapiens
  heavy chain complementarity determining region 3 for antibody 20673
VKDCGLGGSRDS

SEQ ID NO: 41347 - protein, 10 aa, Homo sapiens
  light chain complementarity determining region 3 for antibody 20674
QQYYGTPPHS

SEQ ID NO: 41348 - protein, 17 aa, Homo sapiens
  heavy chain complementarity determining region 3 for antibody 20674
AKGVSFDNGWTDWYFDL

SEQ ID NO: 41349 - protein, 9 aa, Homo sapiens
  light chain complementarity determining region 3 for antibody 20675
QQYYDFPHT

SEQ ID NO: 41350 - protein, 18 aa, Homo sapiens
  heavy chain complementarity determining region 3 for antibody 20675
ARAPNYYGAGRRPFYFDY

SEQ ID NO: 41351 - protein, 9 aa, Homo sapiens
  light chain complementarity determining region 3 for antibody 20676
QQYYDFPHT

SEQ ID NO: 41352 - protein, 18 aa, Homo sapiens
  heavy chain complementarity determining region 3 for antibody 20676
ARAPNCYGSGRRPFYFDY

SEQ ID NO: 41353 - protein, 9 aa, Homo sapiens
  light chain complementarity determining region 3 for antibody 20677
QQYWSSPRT

SEQ ID NO: 41354 - protein, 14 aa, Homo sapiens
  heavy chain complementarity determining region 3 for antibody 20677
AGGRFSSGSSYSEN

SEQ ID NO: 41355 - protein, 9 aa, Homo sapiens
  light chain complementarity determining region 3 for antibody 20678
QQYWSIPRT

SEQ ID NO: 41356 - protein, 14 aa, Homo sapiens
  heavy chain complementarity determining region 3 for antibody 20678
AGGEYCGGNCYSEY

SEQ ID NO: 41357 - protein, 9 aa, Homo sapiens
  light chain complementarity determining region 3 for antibody 20679
QQYVTTPPT

SEQ ID NO: 41358 - protein, 8 aa, Homo sapiens
  heavy chain complementarity determining region 3 for antibody 20679
VRMSDYIL

SEQ ID NO: 41359 - protein, 9 aa, Homo sapiens
  light chain complementarity determining region 3 for antibody 20680
QQYVTTPIT

SEQ ID NO: 41360 - protein, 8 aa, Homo sapiens
  heavy chain complementarity determining region 3 for antibody 20680
VRMSDYIL

SEQ ID NO: 41361 - protein, 11 aa, Homo sapiens
  light chain complementarity determining region 3 for antibody 20681
QQYVTSPPSYN

SEQ ID NO: 41362 - protein, 11 aa, Homo sapiens
  heavy chain complementarity determining region 3 for antibody 20681
AYSPGWWRIDC

SEQ ID NO: 41363 - protein, 11 aa, Homo sapiens
  light chain complementarity determining region 3 for antibody 20682
QQYVTSPPPSP

SEQ ID NO: 41364 - protein, 11 aa, Homo sapiens
  heavy chain complementarity determining region 3 for antibody 20682
AYSPGWWRIDC

SEQ ID NO: 41365 - protein, 11 aa, Homo sapiens
  light chain complementarity determining region 3 for antibody 20683
QQYVTSPPAYT

SEQ ID NO: 41366 - protein, 11 aa, Homo sapiens
  heavy chain complementarity determining region 3 for antibody 20683
AYSPGWWRIDC

SEQ ID NO: 41367 - protein, 10 aa, Homo sapiens
  light chain complementarity determining region 3 for antibody 20684
QQYVTSLKWT

SEQ ID NO: 41368 - protein, 15 aa, Homo sapiens
  heavy chain complementarity determining region 3 for antibody 20684
GRLLSPYSHRTPFAP

SEQ ID NO: 41369 - protein, 10 aa, Homo sapiens
  light chain complementarity determining region 3 for antibody 20685
QQYVTSLKWT

SEQ ID NO: 41370 - protein, 15 aa, Homo sapiens
  heavy chain complementarity determining region 3 for antibody 20685
GRLLSPYAHRTPFDP

SEQ ID NO: 41371 - protein, 10 aa, Homo sapiens
  light chain complementarity determining region 3 for antibody 20686
QQYVTSLKWT

SEQ ID NO: 41372 - protein, 15 aa, Homo sapiens
  heavy chain complementarity determining region 3 for antibody 20686
GRLLSPSSHRTPFDP

SEQ ID NO: 41373 - protein, 10 aa, Homo sapiens
  light chain complementarity determining region 3 for antibody 20687
QQYVTSLKWP

SEQ ID NO: 41374 - protein, 15 aa, Homo sapiens
  heavy chain complementarity determining region 3 for antibody 20687
GRLLSPYSHRTPFDP

SEQ ID NO: 41375 - protein, 9 aa, Homo sapiens
  light chain complementarity determining region 3 for antibody 20688
QQYVTQPLT

SEQ ID NO: 41376 - protein, 18 aa, Homo sapiens
  heavy chain complementarity determining region 3 for antibody 20688
ARCVAAAAKWGVYWYFDL

SEQ ID NO: 41377 - protein, 9 aa, Homo sapiens
  light chain complementarity determining region 3 for antibody 20689
QQYVTPPLT

SEQ ID NO: 41378 - protein, 18 aa, Homo sapiens
  heavy chain complementarity determining region 3 for antibody 20689
ARCVAAAAKWGVYWFFDL

SEQ ID NO: 41379 - protein, 9 aa, Homo sapiens
  light chain complementarity determining region 3 for antibody 20690
QQYVTPPLP

SEQ ID NO: 41380 - protein, 8 aa, Homo sapiens
  heavy chain complementarity determining region 3 for antibody 20690
VRMSDYIL

SEQ ID NO: 41381 - protein, 9 aa, Homo sapiens
  light chain complementarity determining region 3 for antibody 20691
QQYVTKPLT

SEQ ID NO: 41382 - protein, 8 aa, Homo sapiens
  heavy chain complementarity determining region 3 for antibody 20691
VRMSDYIL

SEQ ID NO: 41383 - protein, 10 aa, Homo sapiens
  light chain complementarity determining region 3 for antibody 20692
QQYVSSPPWT

SEQ ID NO: 41384 - protein, 11 aa, Homo sapiens
  heavy chain complementarity determining region 3 for antibody 20692
AREGSYHYFDL

SEQ ID NO: 41385 - protein, 9 aa, Homo sapiens
  light chain complementarity determining region 3 for antibody 20693
QQYVGSPRT

SEQ ID NO: 41386 - protein, 13 aa, Homo sapiens
  heavy chain complementarity determining region 3 for antibody 20693
AAGYFSSGTYYEY

SEQ ID NO: 41387 - protein, 9 aa, Homo sapiens
  light chain complementarity determining region 3 for antibody 20694
QQYTYWPLT

SEQ ID NO: 41388 - protein, 16 aa, Homo sapiens
  heavy chain complementarity determining region 3 for antibody 20694
TRYCSSSNCALYGMDV

SEQ ID NO: 41389 - protein, 8 aa, Homo sapiens
  light chain complementarity determining region 3 for antibody 20695
QQYTYWGT

SEQ ID NO: 41390 - protein, 12 aa, Homo sapiens
  heavy chain complementarity determining region 3 for antibody 20695
ARIRDGSNYFAY

SEQ ID NO: 41391 - protein, 9 aa, Homo sapiens
  light chain complementarity determining region 3 for antibody 20696
QQYTSYPLT

SEQ ID NO: 41392 - protein, 13 aa, Homo sapiens
  heavy chain complementarity determining region 3 for antibody 20696
AHVSNGYYYYYDF

SEQ ID NO: 41393 - protein, 9 aa, Homo sapiens
  light chain complementarity determining region 3 for antibody 20697
QQYTNWPLT

SEQ ID NO: 41394 - protein, 16 aa, Homo sapiens
  heavy chain complementarity determining region 3 for antibody 20697
TRYRSSSNCALYGMDV

SEQ ID NO: 41395 - protein, 9 aa, Homo sapiens
  light chain complementarity determining region 3 for antibody 20698
QQYTNWPLP

SEQ ID NO: 41396 - protein, 16 aa, Homo sapiens
  heavy chain complementarity determining region 3 for antibody 20698
AKEGYHYETGGGGMDV

SEQ ID NO: 41397 - protein, 9 aa, Homo sapiens
  light chain complementarity determining region 3 for antibody 20699
QQYSVSPGT

SEQ ID NO: 41398 - protein, 22 aa, Homo sapiens
  heavy chain complementarity determining region 3 for antibody 20699
ARPKTQGGYYESSGYERAAFDL

SEQ ID NO: 41399 - protein, 9 aa, Homo sapiens
  light chain complementarity determining region 3 for antibody 20700
QQYSTYPLT

SEQ ID NO: 41400 - protein, 8 aa, Homo sapiens
  heavy chain complementarity determining region 3 for antibody 20700
IIYVNSWY

SEQ ID NO: 41401 - protein, 9 aa, Homo sapiens
  light chain complementarity determining region 3 for antibody 20701
QQYSTWPRT

SEQ ID NO: 41402 - protein, 22 aa, Homo sapiens
  heavy chain complementarity determining region 3 for antibody 20701
AREVRASGYDDFYNYYYYGLDV

SEQ ID NO: 41403 - protein, 9 aa, Homo sapiens
  light chain complementarity determining region 3 for antibody 20702
QQYSTTPRT

SEQ ID NO: 41404 - protein, 11 aa, Homo sapiens
  heavy chain complementarity determining region 3 for antibody 20702
TRGQDRSKQGY

SEQ ID NO: 41405 - protein, 9 aa, Homo sapiens
  light chain complementarity determining region 3 for antibody 20703
QQYSTSPVT

SEQ ID NO: 41406 - protein, 16 aa, Homo sapiens
  heavy chain complementarity determining region 3 for antibody 20703
ATDWGSGSHYMRAYDL

SEQ ID NO: 41407 - protein, 9 aa, Homo sapiens
  light chain complementarity determining region 3 for antibody 20704
QQYSTIPRT

SEQ ID NO: 41408 - protein, 13 aa, Homo sapiens
  heavy chain complementarity determining region 3 for antibody 20704
AGGLFDSSGYSEF

SEQ ID NO: 41409 - protein, 9 aa, Homo sapiens
  light chain complementarity determining region 3 for antibody 20705
QQYSSYPWT

SEQ ID NO: 41410 - protein, 17 aa, Homo sapiens
  heavy chain complementarity determining region 3 for antibody 20705
LKGTNPVLDWISIPFDY

SEQ ID NO: 41411 - protein, 11 aa, Homo sapiens
  light chain complementarity determining region 3 for antibody 20706
QQYSSWPPNLT

SEQ ID NO: 41412 - protein, 13 aa, Homo sapiens
  heavy chain complementarity determining region 3 for antibody 20706
ARGGQNSGLSLGY

SEQ ID NO: 41413 - protein, 9 aa, Homo sapiens
  light chain complementarity determining region 3 for antibody 20707
QQYSSTPYT

SEQ ID NO: 41414 - protein, 19 aa, Homo sapiens
  heavy chain complementarity determining region 3 for antibody 20707
ARGECTRSSDCSYNDAFHM

SEQ ID NO: 41415 - protein, 10 aa, Homo sapiens
  light chain complementarity determining region 3 for antibody 20708
QQYSSSPSWT

SEQ ID NO: 41416 - protein, 16 aa, Homo sapiens
  heavy chain complementarity determining region 3 for antibody 20708
ARRQWVRGLFRGGLDS

SEQ ID NO: 41417 - protein, 10 aa, Homo sapiens
  light chain complementarity determining region 3 for antibody 20709
QQYSSSPPWT

SEQ ID NO: 41418 - protein, 16 aa, Homo sapiens
  heavy chain complementarity determining region 3 for antibody 20709
ARRQWVRGLVRGGLDS

SEQ ID NO: 41419 - protein, 10 aa, Homo sapiens
  light chain complementarity determining region 3 for antibody 20710
QQYSSSPPWT

SEQ ID NO: 41420 - protein, 16 aa, Homo sapiens
  heavy chain complementarity determining region 3 for antibody 20710
AGRQWVRGLFRGGLDS

SEQ ID NO: 41421 - protein, 10 aa, Homo sapiens
  light chain complementarity determining region 3 for antibody 20711
QQYSSSPPWR

SEQ ID NO: 41422 - protein, 16 aa, Homo sapiens
  heavy chain complementarity determining region 3 for antibody 20711
ARRQWVRGLFRWGLDS

SEQ ID NO: 41423 - protein, 9 aa, Homo sapiens
  light chain complementarity determining region 3 for antibody 20712
QQYSSSPPT

SEQ ID NO: 41424 - protein, 10 aa, Homo sapiens
  heavy chain complementarity determining region 3 for antibody 20712
VRGIHNAFDI

SEQ ID NO: 41425 - protein, 9 aa, Homo sapiens
  light chain complementarity determining region 3 for antibody 20713
QQYSSSLFP

SEQ ID NO: 41426 - protein, 15 aa, Homo sapiens
  heavy chain complementarity determining region 3 for antibody 20713
ARGGKSSSWLSYFDS

SEQ ID NO: 41427 - protein, 10 aa, Homo sapiens
  light chain complementarity determining region 3 for antibody 20714
QQYSSPPPWT

SEQ ID NO: 41428 - protein, 16 aa, Homo sapiens
  heavy chain complementarity determining region 3 for antibody 20714
ARRQWVRGLFRGGLDS

SEQ ID NO: 41429 - protein, 9 aa, Homo sapiens
  light chain complementarity determining region 3 for antibody 20715
QQYSSHVDT

SEQ ID NO: 41430 - protein, 18 aa, Homo sapiens
  heavy chain complementarity determining region 3 for antibody 20715
AQERDGYCDSHACYGLDV

SEQ ID NO: 41431 - protein, 9 aa, Homo sapiens
  light chain complementarity determining region 3 for antibody 20716
QQYSSHMYT

SEQ ID NO: 41432 - protein, 18 aa, Homo sapiens
  heavy chain complementarity determining region 3 for antibody 20716
AQERDGYCDSHACYGLDV

SEQ ID NO: 41433 - protein, 9 aa, Homo sapiens
  light chain complementarity determining region 3 for antibody 20717
QQYSRSPST

SEQ ID NO: 41434 - protein, 17 aa, Homo sapiens
  heavy chain complementarity determining region 3 for antibody 20717
AGLSSRLGDGSPSLFDY

SEQ ID NO: 41435 - protein, 9 aa, Homo sapiens
  light chain complementarity determining region 3 for antibody 20718
QQYSGTPPT

SEQ ID NO: 41436 - protein, 11 aa, Homo sapiens
  heavy chain complementarity determining region 3 for antibody 20718
ARSTSAYYSEY

SEQ ID NO: 41437 - protein, 9 aa, Homo sapiens
  light chain complementarity determining region 3 for antibody 20719
QQYSDSPGT

SEQ ID NO: 41438 - protein, 22 aa, Homo sapiens
  heavy chain complementarity determining region 3 for antibody 20719
ARTKTQGGYYESSGYERAAFDL

SEQ ID NO: 41439 - protein, 9 aa, Homo sapiens
  light chain complementarity determining region 3 for antibody 20720
QQYSDSPGT

SEQ ID NO: 41440 - protein, 22 aa, Homo sapiens
  heavy chain complementarity determining region 3 for antibody 20720
ARSKTQGGYYESSGYERAAFDL

SEQ ID NO: 41441 - protein, 9 aa, Homo sapiens
  light chain complementarity determining region 3 for antibody 20721
QQYSDSPGT

SEQ ID NO: 41442 - protein, 22 aa, Homo sapiens
  heavy chain complementarity determining region 3 for antibody 20721
ARQKTQGGYYESSGYERAAFDL

SEQ ID NO: 41443 - protein, 9 aa, Homo sapiens
  light chain complementarity determining region 3 for antibody 20722
QQYSDSPGT

SEQ ID NO: 41444 - protein, 22 aa, Homo sapiens
  heavy chain complementarity determining region 3 for antibody 20722
ARPKTQGGYYGSSGYERAAFDL

SEQ ID NO: 41445 - protein, 9 aa, Homo sapiens
  light chain complementarity determining region 3 for antibody 20723
QQYSDSPGT

SEQ ID NO: 41446 - protein, 22 aa, Homo sapiens
  heavy chain complementarity determining region 3 for antibody 20723
ARAKTQGGYYESSGYERAAFDL

SEQ ID NO: 41447 - protein, 9 aa, Homo sapiens
  light chain complementarity determining region 3 for antibody 20724
QQYSDSPGP

SEQ ID NO: 41448 - protein, 22 aa, Homo sapiens
  heavy chain complementarity determining region 3 for antibody 20724
ARPKTQGGYYESSGYERAAFDL

SEQ ID NO: 41449 - protein, 9 aa, Homo sapiens
  light chain complementarity determining region 3 for antibody 20725
QQYSAPPFT

SEQ ID NO: 41450 - protein, 18 aa, Homo sapiens
  heavy chain complementarity determining region 3 for antibody 20725
ARGRCEGDCYAWYYALDV

SEQ ID NO: 41451 - protein, 8 aa, Homo sapiens
  light chain complementarity determining region 3 for antibody 20726
QQYRYWQT

SEQ ID NO: 41452 - protein, 13 aa, Homo sapiens
  heavy chain complementarity determining region 3 for antibody 20726
ARANDYGDYYLEY

SEQ ID NO: 41453 - protein, 9 aa, Homo sapiens
  light chain complementarity determining region 3 for antibody 20727
QQYRTSPVT

SEQ ID NO: 41454 - protein, 16 aa, Homo sapiens
  heavy chain complementarity determining region 3 for antibody 20727
ATDWGSGSHYIRAYDL

SEQ ID NO: 41455 - protein, 9 aa, Homo sapiens
  light chain complementarity determining region 3 for antibody 20728
QQYRSYSPT

SEQ ID NO: 41456 - protein, 17 aa, Homo sapiens
  heavy chain complementarity determining region 3 for antibody 20728
ARVPYCSTTTCYFPFDF

SEQ ID NO: 41457 - protein, 9 aa, Homo sapiens
  light chain complementarity determining region 3 for antibody 20729
QQYRSYPPT

SEQ ID NO: 41458 - protein, 17 aa, Homo sapiens
  heavy chain complementarity determining region 3 for antibody 20729
ARVPYCSTTTCYVPFDF

SEQ ID NO: 41459 - protein, 9 aa, Homo sapiens
  light chain complementarity determining region 3 for antibody 20730
QQYRSYPPT

SEQ ID NO: 41460 - protein, 17 aa, Homo sapiens
  heavy chain complementarity determining region 3 for antibody 20730
ARVPYCSTTTCYCPFDF

SEQ ID NO: 41461 - protein, 9 aa, Homo sapiens
  light chain complementarity determining region 3 for antibody 20731
QQYRSYPPP

SEQ ID NO: 41462 - protein, 17 aa, Homo sapiens
  heavy chain complementarity determining region 3 for antibody 20731
ARVPYCSTTTCYFPFDF

SEQ ID NO: 41463 - protein, 9 aa, Homo sapiens
  light chain complementarity determining region 3 for antibody 20732
QQYRRSPST

SEQ ID NO: 41464 - protein, 17 aa, Homo sapiens
  heavy chain complementarity determining region 3 for antibody 20732
AGLSSRLGDGSPSRFDY

SEQ ID NO: 41465 - protein, 9 aa, Homo sapiens
  light chain complementarity determining region 3 for antibody 20733
QQYRRSPSK

SEQ ID NO: 41466 - protein, 17 aa, Homo sapiens
  heavy chain complementarity determining region 3 for antibody 20733
AGLSSRLGDGSPSLFDY

SEQ ID NO: 41467 - protein, 9 aa, Homo sapiens
  light chain complementarity determining region 3 for antibody 20734
QQYRRSPCT

SEQ ID NO: 41468 - protein, 17 aa, Homo sapiens
  heavy chain complementarity determining region 3 for antibody 20734
AGLSSRLGDGSPSLFDY

SEQ ID NO: 41469 - protein, 9 aa, Homo sapiens
  light chain complementarity determining region 3 for antibody 20735
QQYRGSPST

SEQ ID NO: 41470 - protein, 17 aa, Homo sapiens
  heavy chain complementarity determining region 3 for antibody 20735
AGLSSRLGDGSPSLFDY

SEQ ID NO: 41471 - protein, 11 aa, Homo sapiens
  light chain complementarity determining region 3 for antibody 20736
QQYRASPPGST

SEQ ID NO: 41472 - protein, 14 aa, Homo sapiens
  heavy chain complementarity determining region 3 for antibody 20736
ARSPSNSRNRSFDQ

SEQ ID NO: 41473 - protein, 11 aa, Homo sapiens
  light chain complementarity determining region 3 for antibody 20737
QQYRASPPGSP

SEQ ID NO: 41474 - protein, 14 aa, Homo sapiens
  heavy chain complementarity determining region 3 for antibody 20737
ARSPSNSRNRSFDQ

SEQ ID NO: 41475 - protein, 11 aa, Homo sapiens
  light chain complementarity determining region 3 for antibody 20738
QQYRASPPGFT

SEQ ID NO: 41476 - protein, 14 aa, Homo sapiens
  heavy chain complementarity determining region 3 for antibody 20738
ARSPSNSRNRSLDQ

SEQ ID NO: 41477 - protein, 11 aa, Homo sapiens
  light chain complementarity determining region 3 for antibody 20739
QQYRASPPGFS

SEQ ID NO: 41478 - protein, 14 aa, Homo sapiens
  heavy chain complementarity determining region 3 for antibody 20739
ARSPSNSRNRSFDQ

SEQ ID NO: 41479 - protein, 11 aa, Homo sapiens
  light chain complementarity determining region 3 for antibody 20740
QQYRAPPPGFP

SEQ ID NO: 41480 - protein, 14 aa, Homo sapiens
  heavy chain complementarity determining region 3 for antibody 20740
ARSPSNSRNRSFDQ

SEQ ID NO: 41481 - protein, 9 aa, Homo sapiens
  light chain complementarity determining region 3 for antibody 20741
QQYQNWPYT

SEQ ID NO: 41482 - protein, 11 aa, Homo sapiens
  heavy chain complementarity determining region 3 for antibody 20741
GGFSHGGPCGY

SEQ ID NO: 41483 - protein, 9 aa, Homo sapiens
  light chain complementarity determining region 3 for antibody 20742
QQYQNWPYT

SEQ ID NO: 41484 - protein, 11 aa, Homo sapiens
  heavy chain complementarity determining region 3 for antibody 20742
GGCYHGGPCGY

SEQ ID NO: 41485 - protein, 9 aa, Homo sapiens
  light chain complementarity determining region 3 for antibody 20743
QQYQNWPYT

SEQ ID NO: 41486 - protein, 11 aa, Homo sapiens
  heavy chain complementarity determining region 3 for antibody 20743
GAYYPGGPCGY

SEQ ID NO: 41487 - protein, 9 aa, Homo sapiens
  light chain complementarity determining region 3 for antibody 20744
QQYQNWPYT

SEQ ID NO: 41488 - protein, 11 aa, Homo sapiens
  heavy chain complementarity determining region 3 for antibody 20744
GAYSHGGPCGY

SEQ ID NO: 41489 - protein, 9 aa, Homo sapiens
  light chain complementarity determining region 3 for antibody 20745
QQYQNWPYT

SEQ ID NO: 41490 - protein, 11 aa, Homo sapiens
  heavy chain complementarity determining region 3 for antibody 20745
GAYDHGGPCGY

SEQ ID NO: 41491 - protein, 9 aa, Homo sapiens
  light chain complementarity determining region 3 for antibody 20746
QQYQNWPYP

SEQ ID NO: 41492 - protein, 11 aa, Homo sapiens
  heavy chain complementarity determining region 3 for antibody 20746
GGFYHGGPCGY

SEQ ID NO: 41493 - protein, 9 aa, Homo sapiens
  light chain complementarity determining region 3 for antibody 20747
QQYQNWPNT

SEQ ID NO: 41494 - protein, 11 aa, Homo sapiens
  heavy chain complementarity determining region 3 for antibody 20747
GGFYHGGPCGY

SEQ ID NO: 41495 - protein, 9 aa, Homo sapiens
  light chain complementarity determining region 3 for antibody 20748
QQYPSSPIT

SEQ ID NO: 41496 - protein, 14 aa, Homo sapiens
  heavy chain complementarity determining region 3 for antibody 20748
AKESSVYGVYPYDS

SEQ ID NO: 41497 - protein, 11 aa, Homo sapiens
  light chain complementarity determining region 3 for antibody 20749
QQYPNWPPLFT

SEQ ID NO: 41498 - protein, 14 aa, Homo sapiens
  heavy chain complementarity determining region 3 for antibody 20749
ARLNGIFGLYAFDV

SEQ ID NO: 41499 - protein, 9 aa, Homo sapiens
  light chain complementarity determining region 3 for antibody 20750
QQYNVWPYP

SEQ ID NO: 41500 - protein, 13 aa, Homo sapiens
  heavy chain complementarity determining region 3 for antibody 20750
ARVMAAAGYGMDV

SEQ ID NO: 41501 - protein, 9 aa, Homo sapiens
  light chain complementarity determining region 3 for antibody 20751
QQYNTYSPT

SEQ ID NO: 41502 - protein, 15 aa, Homo sapiens
  heavy chain complementarity determining region 3 for antibody 20751
ARERNRGSFGSAFDV

SEQ ID NO: 41503 - protein, 9 aa, Homo sapiens
  light chain complementarity determining region 3 for antibody 20752
QQYNTYSLT

SEQ ID NO: 41504 - protein, 15 aa, Homo sapiens
  heavy chain complementarity determining region 3 for antibody 20752
ARERNRGSFGSAFDV

SEQ ID NO: 41505 - protein, 9 aa, Homo sapiens
  light chain complementarity determining region 3 for antibody 20753
QQYNTYRYT

SEQ ID NO: 41506 - protein, 18 aa, Homo sapiens
  heavy chain complementarity determining region 3 for antibody 20753
ANVRDFHAAGTPGNGLDV

SEQ ID NO: 41507 - protein, 9 aa, Homo sapiens
  light chain complementarity determining region 3 for antibody 20754
QQYNTYRST

SEQ ID NO: 41508 - protein, 18 aa, Homo sapiens
  heavy chain complementarity determining region 3 for antibody 20754
AKVRDFHAAGTPGNGLDV

SEQ ID NO: 41509 - protein, 9 aa, Homo sapiens
  light chain complementarity determining region 3 for antibody 20755
QQYNTYPYT

SEQ ID NO: 41510 - protein, 18 aa, Homo sapiens
  heavy chain complementarity determining region 3 for antibody 20755
AKVRDFHAAGTPGNGLDV

SEQ ID NO: 41511 - protein, 9 aa, Homo sapiens
  light chain complementarity determining region 3 for antibody 20756
QQYNTYPLT

SEQ ID NO: 41512 - protein, 12 aa, Homo sapiens
  heavy chain complementarity determining region 3 for antibody 20756
AKSEGRWLHLDY

SEQ ID NO: 41513 - protein, 9 aa, Homo sapiens
  light chain complementarity determining region 3 for antibody 20757
QQYNTYFRT

SEQ ID NO: 41514 - protein, 15 aa, Homo sapiens
  heavy chain complementarity determining region 3 for antibody 20757
ARERNRGSFGSAFDV

SEQ ID NO: 41515 - protein, 9 aa, Homo sapiens
  light chain complementarity determining region 3 for antibody 20758
QQYNTWPWT

SEQ ID NO: 41516 - protein, 22 aa, Homo sapiens
  heavy chain complementarity determining region 3 for antibody 20758
AREVRASGYDDFYNYYYYGLDV

SEQ ID NO: 41517 - protein, 9 aa, Homo sapiens
  light chain complementarity determining region 3 for antibody 20759
QQYNTWPRT

SEQ ID NO: 41518 - protein, 22 aa, Homo sapiens
  heavy chain complementarity determining region 3 for antibody 20759
EREVRASGYDDFYNYYYYGLDV

SEQ ID NO: 41519 - protein, 9 aa, Homo sapiens
  light chain complementarity determining region 3 for antibody 20760
QQYNTWPRT

SEQ ID NO: 41520 - protein, 22 aa, Homo sapiens
  heavy chain complementarity determining region 3 for antibody 20760
AREVSASGYDDFYNYYYYGLDV

SEQ ID NO: 41521 - protein, 9 aa, Homo sapiens
  light chain complementarity determining region 3 for antibody 20761
QQYNTWPRT

SEQ ID NO: 41522 - protein, 22 aa, Homo sapiens
  heavy chain complementarity determining region 3 for antibody 20761
AREVRASGYDDFYNYYYYGVDV

SEQ ID NO: 41523 - protein, 9 aa, Homo sapiens
  light chain complementarity determining region 3 for antibody 20762
QQYNTWPRT

SEQ ID NO: 41524 - protein, 22 aa, Homo sapiens
  heavy chain complementarity determining region 3 for antibody 20762
AREVRASGYDDFYNYYYYGFDV

SEQ ID NO: 41525 - protein, 9 aa, Homo sapiens
  light chain complementarity determining region 3 for antibody 20763
QQYNTWPRT

SEQ ID NO: 41526 - protein, 22 aa, Homo sapiens
  heavy chain complementarity determining region 3 for antibody 20763
AREVRASGYDDFYNYYSYGLDV

SEQ ID NO: 41527 - protein, 9 aa, Homo sapiens
  light chain complementarity determining region 3 for antibody 20764
QQYNTWPRT

SEQ ID NO: 41528 - protein, 22 aa, Homo sapiens
  heavy chain complementarity determining region 3 for antibody 20764
AREVRASGYDDFYNYSYYGLDV

SEQ ID NO: 41529 - protein, 9 aa, Homo sapiens
  light chain complementarity determining region 3 for antibody 20765
QQYNTWPRT

SEQ ID NO: 41530 - protein, 22 aa, Homo sapiens
  heavy chain complementarity determining region 3 for antibody 20765
AREVRASGYDDFYNSYYYGLDV

SEQ ID NO: 41531 - protein, 9 aa, Homo sapiens
  light chain complementarity determining region 3 for antibody 20766
QQYNTWPRT

SEQ ID NO: 41532 - protein, 22 aa, Homo sapiens
  heavy chain complementarity determining region 3 for antibody 20766
AREVRASGYDDFYNDYYYGLDV

SEQ ID NO: 41533 - protein, 9 aa, Homo sapiens
  light chain complementarity determining region 3 for antibody 20767
QQYNTWPRT

SEQ ID NO: 41534 - protein, 22 aa, Homo sapiens
  heavy chain complementarity determining region 3 for antibody 20767
AREVRASGYDDFHNYYYYGLDV

SEQ ID NO: 41535 - protein, 9 aa, Homo sapiens
  light chain complementarity determining region 3 for antibody 20768
QQYNTWPRT

SEQ ID NO: 41536 - protein, 22 aa, Homo sapiens
  heavy chain complementarity determining region 3 for antibody 20768
AREVRASGYDDFDNYYYYGLDV

SEQ ID NO: 41537 - protein, 9 aa, Homo sapiens
  light chain complementarity determining region 3 for antibody 20769
QQYNTWPRT

SEQ ID NO: 41538 - protein, 22 aa, Homo sapiens
  heavy chain complementarity determining region 3 for antibody 20769
AREVRAGGYDDFYNYYYYGLDV

SEQ ID NO: 41539 - protein, 9 aa, Homo sapiens
  light chain complementarity determining region 3 for antibody 20770
QQYNTWPRT

SEQ ID NO: 41540 - protein, 22 aa, Homo sapiens
  heavy chain complementarity determining region 3 for antibody 20770
AREVRACGYDDFYNYYYYGLDV

SEQ ID NO: 41541 - protein, 9 aa, Homo sapiens
  light chain complementarity determining region 3 for antibody 20771
QQYNTWPRT

SEQ ID NO: 41542 - protein, 22 aa, Homo sapiens
  heavy chain complementarity determining region 3 for antibody 20771
ARAVRASGYDDFYNYYYYGLDV

SEQ ID NO: 41543 - protein, 9 aa, Homo sapiens
  light chain complementarity determining region 3 for antibody 20772
QQYNTWPRT

SEQ ID NO: 41544 - protein, 22 aa, Homo sapiens
  heavy chain complementarity determining region 3 for antibody 20772
AIEVRASGYDDFYNYYSYGLDV

SEQ ID NO: 41545 - protein, 10 aa, Homo sapiens
  light chain complementarity determining region 3 for antibody 20773
QQYNTWPPDT

SEQ ID NO: 41546 - protein, 13 aa, Homo sapiens
  heavy chain complementarity determining region 3 for antibody 20773
ARGSIPVAGLLDY

SEQ ID NO: 41547 - protein, 9 aa, Homo sapiens
  light chain complementarity determining region 3 for antibody 20774
QQYNTWLRT

SEQ ID NO: 41548 - protein, 22 aa, Homo sapiens
  heavy chain complementarity determining region 3 for antibody 20774
AREVRASGYDDFYNYYYYGLDV

SEQ ID NO: 41549 - protein, 8 aa, Homo sapiens
  light chain complementarity determining region 3 for antibody 20775
QQYNTWFT

SEQ ID NO: 41550 - protein, 17 aa, Homo sapiens
  heavy chain complementarity determining region 3 for antibody 20775
ALLWGSVDYWGRGSVDY

SEQ ID NO: 41551 - protein, 8 aa, Homo sapiens
  light chain complementarity determining region 3 for antibody 20776
QQYNTWFS

SEQ ID NO: 41552 - protein, 12 aa, Homo sapiens
  heavy chain complementarity determining region 3 for antibody 20776
ARLLWDSYYFDS

SEQ ID NO: 41553 - protein, 10 aa, Homo sapiens
  light chain complementarity determining region 3 for antibody 20777
QQYNTGPPDT

SEQ ID NO: 41554 - protein, 13 aa, Homo sapiens
  heavy chain complementarity determining region 3 for antibody 20777
ARGIIPVAGLLDY

SEQ ID NO: 41555 - protein, 9 aa, Homo sapiens
  light chain complementarity determining region 3 for antibody 20778
QQYNTFRYT

SEQ ID NO: 41556 - protein, 18 aa, Homo sapiens
  heavy chain complementarity determining region 3 for antibody 20778
AKVRDFHAAGTPGNGLDV

SEQ ID NO: 41557 - protein, 10 aa, Homo sapiens
  light chain complementarity determining region 3 for antibody 20779
QQYNTCPPDT

SEQ ID NO: 41558 - protein, 13 aa, Homo sapiens
  heavy chain complementarity determining region 3 for antibody 20779
ARGIIPVAGLLDY

SEQ ID NO: 41559 - protein, 8 aa, Homo sapiens
  light chain complementarity determining region 3 for antibody 20780
QQYNTCIT

SEQ ID NO: 41560 - protein, 17 aa, Homo sapiens
  heavy chain complementarity determining region 3 for antibody 20780
ALLWGSVDYWGRGSVDY

SEQ ID NO: 41561 - protein, 8 aa, Homo sapiens
  light chain complementarity determining region 3 for antibody 20781
QQYNSYWT

SEQ ID NO: 41562 - protein, 18 aa, Homo sapiens
  heavy chain complementarity determining region 3 for antibody 20781
AGSGYEYVWGSYQNAMDV

SEQ ID NO: 41563 - protein, 8 aa, Homo sapiens
  light chain complementarity determining region 3 for antibody 20782
QQYNSYWT

SEQ ID NO: 41564 - protein, 17 aa, Homo sapiens
  heavy chain complementarity determining region 3 for antibody 20782
AGDPTYYDSSGAYAFAI

SEQ ID NO: 41565 - protein, 8 aa, Homo sapiens
  light chain complementarity determining region 3 for antibody 20783
QQYNSYWT

SEQ ID NO: 41566 - protein, 17 aa, Homo sapiens
  heavy chain complementarity determining region 3 for antibody 20783
AGDHTYYDSSGADAFAI

SEQ ID NO: 41567 - protein, 8 aa, Homo sapiens
  light chain complementarity determining region 3 for antibody 20784
QQYNSYWR

SEQ ID NO: 41568 - protein, 18 aa, Homo sapiens
  heavy chain complementarity determining region 3 for antibody 20784
AGSGYDYVWGSYQNAMDV

SEQ ID NO: 41569 - protein, 8 aa, Homo sapiens
  light chain complementarity determining region 3 for antibody 20785
QQYNSYWP

SEQ ID NO: 41570 - protein, 17 aa, Homo sapiens
  heavy chain complementarity determining region 3 for antibody 20785
AGDPTYYDSSGADAFAI

SEQ ID NO: 41571 - protein, 9 aa, Homo sapiens
  light chain complementarity determining region 3 for antibody 20786
QQYNSYSRT

SEQ ID NO: 41572 - protein, 15 aa, Homo sapiens
  heavy chain complementarity determining region 3 for antibody 20786
VRPYRIITAPLEGDS

SEQ ID NO: 41573 - protein, 9 aa, Homo sapiens
  light chain complementarity determining region 3 for antibody 20787
QQYNSYSRT

SEQ ID NO: 41574 - protein, 15 aa, Homo sapiens
  heavy chain complementarity determining region 3 for antibody 20787
VRHYRIIPAPLEGDS

SEQ ID NO: 41575 - protein, 9 aa, Homo sapiens
  light chain complementarity determining region 3 for antibody 20788
QQYNSYPYT

SEQ ID NO: 41576 - protein, 16 aa, Homo sapiens
  heavy chain complementarity determining region 3 for antibody 20788
IRGGNDYIWGSYRYDY

SEQ ID NO: 41577 - protein, 9 aa, Homo sapiens
  light chain complementarity determining region 3 for antibody 20789
QQYNSYPYT

SEQ ID NO: 41578 - protein, 16 aa, Homo sapiens
  heavy chain complementarity determining region 3 for antibody 20789
AREGDSRGWYGGSMDV

SEQ ID NO: 41579 - protein, 9 aa, Homo sapiens
  light chain complementarity determining region 3 for antibody 20790
QQYNSYPWT

SEQ ID NO: 41580 - protein, 20 aa, Homo sapiens
  heavy chain complementarity determining region 3 for antibody 20790
ARVKHCHDSSDYYYYYGVDV

SEQ ID NO: 41581 - protein, 9 aa, Homo sapiens
  light chain complementarity determining region 3 for antibody 20791
QQYNSYPWT

SEQ ID NO: 41582 - protein, 17 aa, Homo sapiens
  heavy chain complementarity determining region 3 for antibody 20791
ARGRFFDWLLAPSGMDV

SEQ ID NO: 41583 - protein, 9 aa, Homo sapiens
  light chain complementarity determining region 3 for antibody 20792
QQYNSYPWT

SEQ ID NO: 41584 - protein, 13 aa, Homo sapiens
  heavy chain complementarity determining region 3 for antibody 20792
ARGHGNKYGVFDY

SEQ ID NO: 41585 - protein, 9 aa, Homo sapiens
  light chain complementarity determining region 3 for antibody 20793
QQYNSYPWT

SEQ ID NO: 41586 - protein, 13 aa, Homo sapiens
  heavy chain complementarity determining region 3 for antibody 20793
ARGHGNKYGLFDD

SEQ ID NO: 41587 - protein, 9 aa, Homo sapiens
  light chain complementarity determining region 3 for antibody 20794
QQYNSYPWT

SEQ ID NO: 41588 - protein, 13 aa, Homo sapiens
  heavy chain complementarity determining region 3 for antibody 20794
ARGHGNKYDLFDY

SEQ ID NO: 41589 - protein, 9 aa, Homo sapiens
  light chain complementarity determining region 3 for antibody 20795
QQYNSYPWT

SEQ ID NO: 41590 - protein, 4 aa, Homo sapiens
  heavy chain complementarity determining region 3 for antibody 20795
AMNV

SEQ ID NO: 41591 - protein, 9 aa, Homo sapiens
  light chain complementarity determining region 3 for antibody 20796
QQYNSYPWT

SEQ ID NO: 41592 - protein, 17 aa, Homo sapiens
  heavy chain complementarity determining region 3 for antibody 20796
AGGRFFDWLLTPSGMDV

SEQ ID NO: 41593 - protein, 9 aa, Homo sapiens
  light chain complementarity determining region 3 for antibody 20797
QQYNSYPLT

SEQ ID NO: 41594 - protein, 13 aa, Homo sapiens
  heavy chain complementarity determining region 3 for antibody 20797
ARVSNGYYYYYDF

SEQ ID NO: 41595 - protein, 9 aa, Homo sapiens
  light chain complementarity determining region 3 for antibody 20798
QQYNSYPLT

SEQ ID NO: 41596 - protein, 20 aa, Homo sapiens
  heavy chain complementarity determining region 3 for antibody 20798
AHSLAVGCRGGRCYGYHFDY

SEQ ID NO: 41597 - protein, 9 aa, Homo sapiens
  light chain complementarity determining region 3 for antibody 20799
QQYNSYPGT

SEQ ID NO: 41598 - protein, 13 aa, Homo sapiens
  heavy chain complementarity determining region 3 for antibody 20799
ARGHGNKYGLFDY

SEQ ID NO: 41599 - protein, 9 aa, Homo sapiens
  light chain complementarity determining region 3 for antibody 20800
QQYNSYPGA

SEQ ID NO: 41600 - protein, 17 aa, Homo sapiens
  heavy chain complementarity determining region 3 for antibody 20800
ARGPHSGNYSKTRNFDY

SEQ ID NO: 41601 - protein, 9 aa, Homo sapiens
  light chain complementarity determining region 3 for antibody 20801
QQYNSYPCT

SEQ ID NO: 41602 - protein, 23 aa, Homo sapiens
  heavy chain complementarity determining region 3 for antibody 20801
AGGRITGATWQRPTNYYYYAMNV

SEQ ID NO: 41603 - protein, 9 aa, Homo sapiens
  light chain complementarity determining region 3 for antibody 20802
QQYNSYLYT

SEQ ID NO: 41604 - protein, 16 aa, Homo sapiens
  heavy chain complementarity determining region 3 for antibody 20802
AREGYSRGWYGGSMDV

SEQ ID NO: 41605 - protein, 9 aa, Homo sapiens
  light chain complementarity determining region 3 for antibody 20803
QQYNSYLYT

SEQ ID NO: 41606 - protein, 16 aa, Homo sapiens
  heavy chain complementarity determining region 3 for antibody 20803
AREGDSRGGYGGSMDV

SEQ ID NO: 41607 - protein, 9 aa, Homo sapiens
  light chain complementarity determining region 3 for antibody 20804
QQYNSYLYN

SEQ ID NO: 41608 - protein, 16 aa, Homo sapiens
  heavy chain complementarity determining region 3 for antibody 20804
AREGDSRGWYGGSMDV

SEQ ID NO: 41609 - protein, 8 aa, Homo sapiens
  light chain complementarity determining region 3 for antibody 20805
QQYNSYLT

SEQ ID NO: 41610 - protein, 17 aa, Homo sapiens
  heavy chain complementarity determining region 3 for antibody 20805
AGDPTYYDSSGADAFAI

SEQ ID NO: 41611 - protein, 9 aa, Homo sapiens
  light chain complementarity determining region 3 for antibody 20806
QQYNSYLNT

SEQ ID NO: 41612 - protein, 16 aa, Homo sapiens
  heavy chain complementarity determining region 3 for antibody 20806
AREGDSRGWYGGSMDV

SEQ ID NO: 41613 - protein, 9 aa, Homo sapiens
  light chain complementarity determining region 3 for antibody 20807
QQYNSWPRT

SEQ ID NO: 41614 - protein, 19 aa, Homo sapiens
  heavy chain complementarity determining region 3 for antibody 20807
ATVALATINMKIVGEYFRH

SEQ ID NO: 41615 - protein, 9 aa, Homo sapiens
  light chain complementarity determining region 3 for antibody 20808
QQYNSWPRT

SEQ ID NO: 41616 - protein, 15 aa, Homo sapiens
  heavy chain complementarity determining region 3 for antibody 20808
AKDTEVVVLRGAFDI

SEQ ID NO: 41617 - protein, 9 aa, Homo sapiens
  light chain complementarity determining region 3 for antibody 20809
QQYNSWLWT

SEQ ID NO: 41618 - protein, 14 aa, Homo sapiens
  heavy chain complementarity determining region 3 for antibody 20809
ARRSSTGSKWYFDL

SEQ ID NO: 41619 - protein, 9 aa, Homo sapiens
  light chain complementarity determining region 3 for antibody 20810
QQYNSTPPT

SEQ ID NO: 41620 - protein, 20 aa, Homo sapiens
  heavy chain complementarity determining region 3 for antibody 20810
ARARSKTTVVTPTRQFASDI

SEQ ID NO: 41621 - protein, 9 aa, Homo sapiens
  light chain complementarity determining region 3 for antibody 20811
QQYNSTPLT

SEQ ID NO: 41622 - protein, 20 aa, Homo sapiens
  heavy chain complementarity determining region 3 for antibody 20811
ARARSKTTVVTPTRQFASDI

SEQ ID NO: 41623 - protein, 9 aa, Homo sapiens
  light chain complementarity determining region 3 for antibody 20812
QQYNSSPIT

SEQ ID NO: 41624 - protein, 14 aa, Homo sapiens
  heavy chain complementarity determining region 3 for antibody 20812
AKESSVYGVYPYDS

SEQ ID NO: 41625 - protein, 10 aa, Homo sapiens
  light chain complementarity determining region 3 for antibody 20813
QQYNSRPPLP

SEQ ID NO: 41626 - protein, 21 aa, Homo sapiens
  heavy chain complementarity determining region 3 for antibody 20813
ARDRNVLLWFGQSMKYYGMDV

SEQ ID NO: 41627 - protein, 10 aa, Homo sapiens
  light chain complementarity determining region 3 for antibody 20814
QQYNSRPPLN

SEQ ID NO: 41628 - protein, 21 aa, Homo sapiens
  heavy chain complementarity determining region 3 for antibody 20814
ARDRNVLLWFGQSMKYYGMDV

SEQ ID NO: 41629 - protein, 9 aa, Homo sapiens
  light chain complementarity determining region 3 for antibody 20815
QQYNSFPWT

SEQ ID NO: 41630 - protein, 17 aa, Homo sapiens
  heavy chain complementarity determining region 3 for antibody 20815
VKGTNPVLDWISIPFDY

SEQ ID NO: 41631 - protein, 9 aa, Homo sapiens
  light chain complementarity determining region 3 for antibody 20816
QQYNSFPPT

SEQ ID NO: 41632 - protein, 13 aa, Homo sapiens
  heavy chain complementarity determining region 3 for antibody 20816
ARRSSDYSGHFDY

SEQ ID NO: 41633 - protein, 9 aa, Homo sapiens
  light chain complementarity determining region 3 for antibody 20817
QQYNSAPWP

SEQ ID NO: 41634 - protein, 14 aa, Homo sapiens
  heavy chain complementarity determining region 3 for antibody 20817
ARARGPASDWYFDY

SEQ ID NO: 41635 - protein, 9 aa, Homo sapiens
  light chain complementarity determining region 3 for antibody 20818
QQYNSAPIT

SEQ ID NO: 41636 - protein, 19 aa, Homo sapiens
  heavy chain complementarity determining region 3 for antibody 20818
ASLLHLRGSLDYLLPYFDY

SEQ ID NO: 41637 - protein, 8 aa, Homo sapiens
  light chain complementarity determining region 3 for antibody 20819
QQYNRVWT

SEQ ID NO: 41638 - protein, 19 aa, Homo sapiens
  heavy chain complementarity determining region 3 for antibody 20819
ARGGRDTYHRSGYYSTCDF

SEQ ID NO: 41639 - protein, 9 aa, Homo sapiens
  light chain complementarity determining region 3 for antibody 20820
QQYNRSPRT

SEQ ID NO: 41640 - protein, 16 aa, Homo sapiens
  heavy chain complementarity determining region 3 for antibody 20820
VKDVTGECHYGSWVDP

SEQ ID NO: 41641 - protein, 9 aa, Homo sapiens
  light chain complementarity determining region 3 for antibody 20821
QQYNRSPRT

SEQ ID NO: 41642 - protein, 16 aa, Homo sapiens
  heavy chain complementarity determining region 3 for antibody 20821
VKDSTGECHYGSWVDP

SEQ ID NO: 41643 - protein, 9 aa, Homo sapiens
  light chain complementarity determining region 3 for antibody 20822
QQYNRSPRT

SEQ ID NO: 41644 - protein, 16 aa, Homo sapiens
  heavy chain complementarity determining region 3 for antibody 20822
VKDFTGECHYGSWLDP

SEQ ID NO: 41645 - protein, 9 aa, Homo sapiens
  light chain complementarity determining region 3 for antibody 20823
QQYNRSPRT

SEQ ID NO: 41646 - protein, 16 aa, Homo sapiens
  heavy chain complementarity determining region 3 for antibody 20823
VKDFTGECHYGSCVDP

SEQ ID NO: 41647 - protein, 9 aa, Homo sapiens
  light chain complementarity determining region 3 for antibody 20824
QQYNRSPRS

SEQ ID NO: 41648 - protein, 16 aa, Homo sapiens
  heavy chain complementarity determining region 3 for antibody 20824
VKDFTGECHYGSWVDP

SEQ ID NO: 41649 - protein, 9 aa, Homo sapiens
  light chain complementarity determining region 3 for antibody 20825
QQYNRSPRP

SEQ ID NO: 41650 - protein, 16 aa, Homo sapiens
  heavy chain complementarity determining region 3 for antibody 20825
VKDFTGECHYGSWVDP

SEQ ID NO: 41651 - protein, 10 aa, Homo sapiens
  light chain complementarity determining region 3 for antibody 20826
QQYNQWPSLT

SEQ ID NO: 41652 - protein, 17 aa, Homo sapiens
  heavy chain complementarity determining region 3 for antibody 20826
ARDLYFSIIQGGGAFDA

SEQ ID NO: 41653 - protein, 10 aa, Homo sapiens
  light chain complementarity determining region 3 for antibody 20827
QQYNQWPPRT

SEQ ID NO: 41654 - protein, 17 aa, Homo sapiens
  heavy chain complementarity determining region 3 for antibody 20827
ARDLYFSIIQGGGAFDA

SEQ ID NO: 41655 - protein, 10 aa, Homo sapiens
  light chain complementarity determining region 3 for antibody 20828
QQYNQWPPPT

SEQ ID NO: 41656 - protein, 17 aa, Homo sapiens
  heavy chain complementarity determining region 3 for antibody 20828
ARDLYFSSIQGGGAFDA

SEQ ID NO: 41657 - protein, 10 aa, Homo sapiens
  light chain complementarity determining region 3 for antibody 20829
QQYNQWPPLT

SEQ ID NO: 41658 - protein, 17 aa, Homo sapiens
  heavy chain complementarity determining region 3 for antibody 20829
ARDLYVSSIQGGGAFDA

SEQ ID NO: 41659 - protein, 10 aa, Homo sapiens
  light chain complementarity determining region 3 for antibody 20830
QQYNQWPPLT

SEQ ID NO: 41660 - protein, 17 aa, Homo sapiens
  heavy chain complementarity determining region 3 for antibody 20830
ARDLYSSIIQGGGAFDA

SEQ ID NO: 41661 - protein, 10 aa, Homo sapiens
  light chain complementarity determining region 3 for antibody 20831
QQYNQWPPLT

SEQ ID NO: 41662 - protein, 17 aa, Homo sapiens
  heavy chain complementarity determining region 3 for antibody 20831
ARDLYFSTIQGGGAFDA

SEQ ID NO: 41663 - protein, 10 aa, Homo sapiens
  light chain complementarity determining region 3 for antibody 20832
QQYNQWPPLT

SEQ ID NO: 41664 - protein, 17 aa, Homo sapiens
  heavy chain complementarity determining region 3 for antibody 20832
ARDLYFSISQGGGAFDA

SEQ ID NO: 41665 - protein, 10 aa, Homo sapiens
  light chain complementarity determining region 3 for antibody 20833
QQYNQWPPLT

SEQ ID NO: 41666 - protein, 17 aa, Homo sapiens
  heavy chain complementarity determining region 3 for antibody 20833
ARDLYFSIIRGGGAFDA

SEQ ID NO: 41667 - protein, 10 aa, Homo sapiens
  light chain complementarity determining region 3 for antibody 20834
QQYNQWPPLT

SEQ ID NO: 41668 - protein, 17 aa, Homo sapiens
  heavy chain complementarity determining region 3 for antibody 20834
ARDLDFSIIQGGGAFDA

SEQ ID NO: 41669 - protein, 10 aa, Homo sapiens
  light chain complementarity determining region 3 for antibody 20835
QQYNQWPPLT

SEQ ID NO: 41670 - protein, 17 aa, Homo sapiens
  heavy chain complementarity determining region 3 for antibody 20835
ARDLCFSIIQGGGAFDA

SEQ ID NO: 41671 - protein, 10 aa, Homo sapiens
  light chain complementarity determining region 3 for antibody 20836
QQYNQWPPLA

SEQ ID NO: 41672 - protein, 17 aa, Homo sapiens
  heavy chain complementarity determining region 3 for antibody 20836
ARDLYFSIIQGGGAFDA

SEQ ID NO: 41673 - protein, 10 aa, Homo sapiens
  light chain complementarity determining region 3 for antibody 20837
QQYNQCPPLT

SEQ ID NO: 41674 - protein, 17 aa, Homo sapiens
  heavy chain complementarity determining region 3 for antibody 20837
ARDLYFSIIQGGGAFDA

SEQ ID NO: 41675 - protein, 8 aa, Homo sapiens
  light chain complementarity determining region 3 for antibody 20838
QQYNNWVR

SEQ ID NO: 41676 - protein, 12 aa, Homo sapiens
  heavy chain complementarity determining region 3 for antibody 20838
ASRVSDWWFFDL

SEQ ID NO: 41677 - protein, 8 aa, Homo sapiens
  light chain complementarity determining region 3 for antibody 20839
QQYNNWVR

SEQ ID NO: 41678 - protein, 12 aa, Homo sapiens
  heavy chain complementarity determining region 3 for antibody 20839
ARRVSDWWFLDL

SEQ ID NO: 41679 - protein, 9 aa, Homo sapiens
  light chain complementarity determining region 3 for antibody 20840
QQYNNWPYP

SEQ ID NO: 41680 - protein, 14 aa, Homo sapiens
  heavy chain complementarity determining region 3 for antibody 20840
AREDYGGNWDAFDI

SEQ ID NO: 41681 - protein, 9 aa, Homo sapiens
  light chain complementarity determining region 3 for antibody 20841
QQYNNWPRT

SEQ ID NO: 41682 - protein, 14 aa, Homo sapiens
  heavy chain complementarity determining region 3 for antibody 20841
ATAPGSYSSSPFDY

SEQ ID NO: 41683 - protein, 9 aa, Homo sapiens
  light chain complementarity determining region 3 for antibody 20842
QQYNNWPRT

SEQ ID NO: 41684 - protein, 22 aa, Homo sapiens
  heavy chain complementarity determining region 3 for antibody 20842
AREVRASGYDDFYNYYYYGLDV

SEQ ID NO: 41685 - protein, 9 aa, Homo sapiens
  light chain complementarity determining region 3 for antibody 20843
QQYNNWPRT

SEQ ID NO: 41686 - protein, 14 aa, Homo sapiens
  heavy chain complementarity determining region 3 for antibody 20843
AAAPGYYSSSPFDY

SEQ ID NO: 41687 - protein, 10 aa, Homo sapiens
  light chain complementarity determining region 3 for antibody 20844
QQYNNWPQLT

SEQ ID NO: 41688 - protein, 17 aa, Homo sapiens
  heavy chain complementarity determining region 3 for antibody 20844
AKDLRPFYDIFAGYLDM

SEQ ID NO: 41689 - protein, 10 aa, Homo sapiens
  light chain complementarity determining region 3 for antibody 20845
QQYNNWPPYT

SEQ ID NO: 41690 - protein, 15 aa, Homo sapiens
  heavy chain complementarity determining region 3 for antibody 20845
ARGLTWQLPNLYFDS

SEQ ID NO: 41691 - protein, 10 aa, Homo sapiens
  light chain complementarity determining region 3 for antibody 20846
QQYNNWPPYT

SEQ ID NO: 41692 - protein, 17 aa, Homo sapiens
  heavy chain complementarity determining region 3 for antibody 20846
ARDVPAYFSVVRGVIDY

SEQ ID NO: 41693 - protein, 10 aa, Homo sapiens
  light chain complementarity determining region 3 for antibody 20847
QQYNNWPPYT

SEQ ID NO: 41694 - protein, 19 aa, Homo sapiens
  heavy chain complementarity determining region 3 for antibody 20847
ARDTYCYGSGSYLYYGMDV

SEQ ID NO: 41695 - protein, 10 aa, Homo sapiens
  light chain complementarity determining region 3 for antibody 20848
QQYNNWPPYP

SEQ ID NO: 41696 - protein, 17 aa, Homo sapiens
  heavy chain complementarity determining region 3 for antibody 20848
ARDVPSYFSVVRGVIDY

SEQ ID NO: 41697 - protein, 10 aa, Homo sapiens
  light chain complementarity determining region 3 for antibody 20849
QQYNNWPPYP

SEQ ID NO: 41698 - protein, 17 aa, Homo sapiens
  heavy chain complementarity determining region 3 for antibody 20849
AGGGDTAQQFMYPPNNY

SEQ ID NO: 41699 - protein, 10 aa, Homo sapiens [sequence omitted]

SEQ ID NO: 41700 - protein, 11 aa, Homo sapiens
  heavy chain complementarity determining region 3 for antibody 20850
AASGSHYKFDY

SEQ ID NO: 41701 - protein, 10 aa, Homo sapiens
  light chain complementarity determining region 3 for antibody 20851
QQYNNWPPVT

SEQ ID NO: 41702 - protein, 16 aa, Homo sapiens
  heavy chain complementarity determining region 3 for antibody 20851
ARAGSSGWNKAGGYDI

SEQ ID NO: 41703 - protein, 10 aa, Homo sapiens
  light chain complementarity determining region 3 for antibody 20852
QQYNNWPPST

SEQ ID NO: 41704 - protein, 19 aa, Homo sapiens
  heavy chain complementarity determining region 3 for antibody 20852
ARDTYYYGSGSYLYYGMDV

SEQ ID NO: 41705 - protein, 10 aa, Homo sapiens
  light chain complementarity determining region 3 for antibody 20853
QQYNNWPPST

SEQ ID NO: 41706 - protein, 17 aa, Homo sapiens
  heavy chain complementarity determining region 3 for antibody 20853
AGGGDTAQQFMYPPNNY

SEQ ID NO: 41707 - protein, 11 aa, Homo sapiens
  light chain complementarity determining region 3 for antibody 20854
QQYNNWPPRRT

SEQ ID NO: 41708 - protein, 16 aa, Homo sapiens
  heavy chain complementarity determining region 3 for antibody 20854
AKEAAGTVTYFGYFNY

SEQ ID NO: 41709 - protein, 11 aa, Homo sapiens
  light chain complementarity determining region 3 for antibody 20855
QQYNNWPPRRR

SEQ ID NO: 41710 - protein, 16 aa, Homo sapiens
  heavy chain complementarity determining region 3 for antibody 20855
AKEAAGTVTYFGYFDY

SEQ ID NO: 41711 - protein, 11 aa, Homo sapiens
  light chain complementarity determining region 3 for antibody 20856
QQYNNWPPRRP

SEQ ID NO: 41712 - protein, 16 aa, Homo sapiens
  heavy chain complementarity determining region 3 for antibody 20856
AKEAAGTVTYFGYFDY

SEQ ID NO: 41713 - protein, 10 aa, Homo sapiens
  light chain complementarity determining region 3 for antibody 20857
QQYNNWPPPT

SEQ ID NO: 41714 - protein, 12 aa, Homo sapiens
  heavy chain complementarity determining region 3 for antibody 20857
ARYGDYFLGWVY

SEQ ID NO: 41715 - protein, 10 aa, Homo sapiens
  light chain complementarity determining region 3 for antibody 20858
QQYNNWPPPT

SEQ ID NO: 41716 - protein, 17 aa, Homo sapiens
  heavy chain complementarity determining region 3 for antibody 20858
AKDLRPFYDIFAGYLDM

SEQ ID NO: 41717 - protein, 11 aa, Homo sapiens
  light chain complementarity determining region 3 for antibody 20859
QQYNNWPPMRT

SEQ ID NO: 41718 - protein, 16 aa, Homo sapiens
  heavy chain complementarity determining region 3 for antibody 20859
AKEAAGTVTYFGYFDY

SEQ ID NO: 41719 - protein, 10 aa, Homo sapiens
  light chain complementarity determining region 3 for antibody 20860
QQYNNWPPLT

SEQ ID NO: 41720 - protein, 12 aa, Homo sapiens
  heavy chain complementarity determining region 3 for antibody 20860
ARYGDYLLGWVY

SEQ ID NO: 41721 - protein, 10 aa, Homo sapiens
  light chain complementarity determining region 3 for antibody 20861
QQYNNWPPLT

SEQ ID NO: 41722 - protein, 12 aa, Homo sapiens
  heavy chain complementarity determining region 3 for antibody 20861
ARYGDDFLGWVY

SEQ ID NO: 41723 - protein, 10 aa, Homo sapiens
  light chain complementarity determining region 3 for antibody 20862
QQYNNWPPLT

SEQ ID NO: 41724 - protein, 12 aa, Homo sapiens
  heavy chain complementarity determining region 3 for antibody 20862
ARYGDCFLGWVY

SEQ ID NO: 41725 - protein, 10 aa, Homo sapiens
  light chain complementarity determining region 3 for antibody 20863
QQYNNWPPLT

SEQ ID NO: 41726 - protein, 12 aa, Homo sapiens
  heavy chain complementarity determining region 3 for antibody 20863
ARCGDYFLGWVY

SEQ ID NO: 41727 - protein, 10 aa, Homo sapiens
  light chain complementarity determining region 3 for antibody 20864
QQYNNWPPLT

SEQ ID NO: 41728 - protein, 17 aa, Homo sapiens
  heavy chain complementarity determining region 3 for antibody 20864
AKDLRPFYDIVAGYLDM

SEQ ID NO: 41729 - protein, 10 aa, Homo sapiens
  light chain complementarity determining region 3 for antibody 20865
QQYNNWPPLT

SEQ ID NO: 41730 - protein, 17 aa, Homo sapiens
  heavy chain complementarity determining region 3 for antibody 20865
AKDLRPFYDIFAGYLDI

SEQ ID NO: 41731 - protein, 10 aa, Homo sapiens
  light chain complementarity determining region 3 for antibody 20866
QQYNNWPPLS

SEQ ID NO: 41732 - protein, 12 aa, Homo sapiens
  heavy chain complementarity determining region 3 for antibody 20866
ARYGDYFLGWVY

SEQ ID NO: 41733 - protein, 10 aa, Homo sapiens
  light chain complementarity determining region 3 for antibody 20867
QQYNNWPPIT

SEQ ID NO: 41734 - protein, 16 aa, Homo sapiens
  heavy chain complementarity determining region 3 for antibody 20867
ARAGSSGWNEAGGYDI

SEQ ID NO: 41735 - protein, 10 aa, Homo sapiens
  light chain complementarity determining region 3 for antibody 20868
QQYNNWPPFT

SEQ ID NO: 41736 - protein, 17 aa, Homo sapiens
  heavy chain complementarity determining region 3 for antibody 20868
AKDLRPFYDIFAGYLDM

SEQ ID NO: 41737 - protein, 10 aa, Homo sapiens
  light chain complementarity determining region 3 for antibody 20869
QQYNNWPLYT

SEQ ID NO: 41738 - protein, 17 aa, Homo sapiens
  heavy chain complementarity determining region 3 for antibody 20869
AGGGDTAQQFMYPPNNY

SEQ ID NO: 41739 - protein, 11 aa, Homo sapiens
  light chain complementarity determining region 3 for antibody 20870
QQYNNWPLPLT

SEQ ID NO: 41740 - protein, 17 aa, Homo sapiens
  heavy chain complementarity determining region 3 for antibody 20870
AREGMVRGVPYPPYFDY

SEQ ID NO: 41741 - protein, 9 aa, Homo sapiens
  light chain complementarity determining region 3 for antibody 20871
QQYNNWPET

SEQ ID NO: 41742 - protein, 16 aa, Homo sapiens
  heavy chain complementarity determining region 3 for antibody 20871
ARDLGRYSYGHDAFDI

SEQ ID NO: 41743 - protein, 9 aa, Homo sapiens
  light chain complementarity determining region 3 for antibody 20872
QQYNNWPDT

SEQ ID NO: 41744 - protein, 14 aa, Homo sapiens
  heavy chain complementarity determining region 3 for antibody 20872
AREDYGGNWDAFDI

SEQ ID NO: 41745 - protein, 10 aa, Homo sapiens
  light chain complementarity determining region 3 for antibody 20873
QQYNNWLGWT

SEQ ID NO: 41746 - protein, 13 aa, Homo sapiens
  heavy chain complementarity determining region 3 for antibody 20873
ARHGRRSSWYYTY

SEQ ID NO: 41747 - protein, 10 aa, Homo sapiens
  light chain complementarity determining region 3 for antibody 20874
QQYNNWLGWT

SEQ ID NO: 41748 - protein, 13 aa, Homo sapiens
  heavy chain complementarity determining region 3 for antibody 20874
ARHGRRSGWYSTY

SEQ ID NO: 41749 - protein, 10 aa, Homo sapiens
  light chain complementarity determining region 3 for antibody 20875
QQYNNWLGWT

SEQ ID NO: 41750 - protein, 13 aa, Homo sapiens
  heavy chain complementarity determining region 3 for antibody 20875
ARHGRRSGWYCAY

SEQ ID NO: 41751 - protein, 10 aa, Homo sapiens
  light chain complementarity determining region 3 for antibody 20876
QQYNNWLGWT

SEQ ID NO: 41752 - protein, 13 aa, Homo sapiens
  heavy chain complementarity determining region 3 for antibody 20876
ARHGRRRGWYYTY

SEQ ID NO: 41753 - protein, 10 aa, Homo sapiens
  light chain complementarity determining region 3 for antibody 20877
QQYNNWLGWR

SEQ ID NO: 41754 - protein, 13 aa, Homo sapiens
  heavy chain complementarity determining region 3 for antibody 20877
ARHGRRSGWYYTY

SEQ ID NO: 41755 - protein, 10 aa, Homo sapiens
  light chain complementarity determining region 3 for antibody 20878
QQYNNWLGWP

SEQ ID NO: 41756 - protein, 13 aa, Homo sapiens
  heavy chain complementarity determining region 3 for antibody 20878
ARHGRRSGWYYTY

SEQ ID NO: 41757 - protein, 8 aa, Homo sapiens
  light chain complementarity determining region 3 for antibody 20879
QQYNNWGR

SEQ ID NO: 41758 - protein, 12 aa, Homo sapiens
  heavy chain complementarity determining region 3 for antibody 20879
ARRVSDWWFFDL

SEQ ID NO: 41759 - protein, 10 aa, Homo sapiens
  light chain complementarity determining region 3 for antibody 20880
QQYNNLPRYT

SEQ ID NO: 41760 - protein, 14 aa, Homo sapiens
  heavy chain complementarity determining region 3 for antibody 20880
ARLGEGYSYGPSDC

SEQ ID NO: 41761 - protein, 10 aa, Homo sapiens
  light chain complementarity determining region 3 for antibody 20881
QQYNNLPPIT

SEQ ID NO: 41762 - protein, 16 aa, Homo sapiens
  heavy chain complementarity determining region 3 for antibody 20881
ARAGSSGWNKAGGYDI

SEQ ID NO: 41763 - protein, 9 aa, Homo sapiens
  light chain complementarity determining region 3 for antibody 20882
QQYNNFSGT

SEQ ID NO: 41764 - protein, 15 aa, Homo sapiens
  heavy chain complementarity determining region 3 for antibody 20882
ARGGYTFGGIVVLDN

SEQ ID NO: 41765 - protein, 10 aa, Homo sapiens
  light chain complementarity determining region 3 for antibody 20883
QQYNNCPPYT

SEQ ID NO: 41766 - protein, 17 aa, Homo sapiens
  heavy chain complementarity determining region 3 for antibody 20883
AGGGDTAQQFMYPPNNY

SEQ ID NO: 41767 - protein, 9 aa, Homo sapiens
  light chain complementarity determining region 3 for antibody 20884
QQYNLNSET

SEQ ID NO: 41768 - protein, 8 aa, Homo sapiens
  heavy chain complementarity determining region 3 for antibody 20884
VASPSRNY

SEQ ID NO: 41769 - protein, 9 aa, Homo sapiens
  light chain complementarity determining region 3 for antibody 20885
QQYNKWPRT

SEQ ID NO: 41770 - protein, 15 aa, Homo sapiens
  heavy chain complementarity determining region 3 for antibody 20885
AKDGGSGCIPIYFDF

SEQ ID NO: 41771 - protein, 10 aa, Homo sapiens
  light chain complementarity determining region 3 for antibody 20886
QQYNKWPPPT

SEQ ID NO: 41772 - protein, 17 aa, Homo sapiens
  heavy chain complementarity determining region 3 for antibody 20886
ARDLYFSIIQGGGAFDA

SEQ ID NO: 41773 - protein, 10 aa, Homo sapiens
  light chain complementarity determining region 3 for antibody 20887
QQYNHWPPLP

SEQ ID NO: 41774 - protein, 17 aa, Homo sapiens
  heavy chain complementarity determining region 3 for antibody 20887
ARDLYFSIIQGGGAFDA

SEQ ID NO: 41775 - protein, 9 aa, Homo sapiens
  light chain complementarity determining region 3 for antibody 20888
QQYNGYSYP

SEQ ID NO: 41776 - protein, 20 aa, Homo sapiens
  heavy chain complementarity determining region 3 for antibody 20888
TKVRQAIVVVPAASLAYFDY

SEQ ID NO: 41777 - protein, 9 aa, Homo sapiens
  light chain complementarity determining region 3 for antibody 20889
QQYNGYLYT

SEQ ID NO: 41778 - protein, 20 aa, Homo sapiens
  heavy chain complementarity determining region 3 for antibody 20889
TKVRQAIVVVPAASLAYFDY

SEQ ID NO: 41779 - protein, 10 aa, Homo sapiens
  light chain complementarity determining region 3 for antibody 20890
QQYNEWPPGS

SEQ ID NO: 41780 - protein, 14 aa, Homo sapiens
  heavy chain complementarity determining region 3 for antibody 20890
AKGRGTFYSGMFDS

SEQ ID NO: 41781 - protein, 9 aa, Homo sapiens
  light chain complementarity determining region 3 for antibody 20891
QQYNEWPLT

SEQ ID NO: 41782 - protein, 17 aa, Homo sapiens
  heavy chain complementarity determining region 3 for antibody 20891
ASAEGWDNYKGVDAFDI

SEQ ID NO: 41783 - protein, 9 aa, Homo sapiens
  light chain complementarity determining region 3 for antibody 20892
QQYLSFPHT

SEQ ID NO: 41784 - protein, 13 aa, Homo sapiens
  heavy chain complementarity determining region 3 for antibody 20892
VRPSPLGISAFDI

SEQ ID NO: 41785 - protein, 9 aa, Homo sapiens
  light chain complementarity determining region 3 for antibody 20893
QQYLRDPYT

SEQ ID NO: 41786 - protein, 18 aa, Homo sapiens
  heavy chain complementarity determining region 3 for antibody 20893
ARGAYGSTIYYTLHYFDF

SEQ ID NO: 41787 - protein, 9 aa, Homo sapiens
  light chain complementarity determining region 3 for antibody 20894
QQYKSYPLT

SEQ ID NO: 41788 - protein, 17 aa, Homo sapiens
  heavy chain complementarity determining region 3 for antibody 20894
ARVRYCTPGNCYQSWDS

SEQ ID NO: 41789 - protein, 9 aa, Homo sapiens
  light chain complementarity determining region 3 for antibody 20895
QQYKSYLYT

SEQ ID NO: 41790 - protein, 12 aa, Homo sapiens
  heavy chain complementarity determining region 3 for antibody 20895
ARALGGRAWFDP

SEQ ID NO: 41791 - protein, 9 aa, Homo sapiens
  light chain complementarity determining region 3 for antibody 20896
QQYKSWPRM

SEQ ID NO: 41792 - protein, 15 aa, Homo sapiens
  heavy chain complementarity determining region 3 for antibody 20896
ARWGSIYGGNSPIDQ

SEQ ID NO: 41793 - protein, 9 aa, Homo sapiens
  light chain complementarity determining region 3 for antibody 20897
QQYKSWPRK

SEQ ID NO: 41794 - protein, 15 aa, Homo sapiens
  heavy chain complementarity determining region 3 for antibody 20897
ARWGSIYGGNSPIDQ

SEQ ID NO: 41795 - protein, 9 aa, Homo sapiens
  light chain complementarity determining region 3 for antibody 20898
QQYKSSLYT

SEQ ID NO: 41796 - protein, 12 aa, Homo sapiens
  heavy chain complementarity determining region 3 for antibody 20898
ARALGWRAWFDP

SEQ ID NO: 41797 - protein, 9 aa, Homo sapiens
  light chain complementarity determining region 3 for antibody 20899
QQYKNWPYT

SEQ ID NO: 41798 - protein, 11 aa, Homo sapiens
  heavy chain complementarity determining region 3 for antibody 20899
GGFYHGGPCGY

SEQ ID NO: 41799 - protein, 11 aa, Homo sapiens
  light chain complementarity determining region 3 for antibody 20900
QQYITSPPGYT

SEQ ID NO: 41800 - protein, 21 aa, Homo sapiens
  heavy chain complementarity determining region 3 for antibody 20900
VKEGPDYYDGGDYFWDDAFDV

SEQ ID NO: 41801 - protein, 11 aa, Homo sapiens
  light chain complementarity determining region 3 for antibody 20901
QQYITSPPGYP

SEQ ID NO: 41802 - protein, 21 aa, Homo sapiens
  heavy chain complementarity determining region 3 for antibody 20901
VKEGPDYYDGGDYFWDDAFDV

SEQ ID NO: 41803 - protein, 9 aa, Homo sapiens
  light chain complementarity determining region 3 for antibody 20902
QQYISYPWT

SEQ ID NO: 41804 - protein, 23 aa, Homo sapiens
  heavy chain complementarity determining region 3 for antibody 20902
AGGRITGATWQRPTNYYYYAMNV

SEQ ID NO: 41805 - protein, 10 aa, Homo sapiens
  light chain complementarity determining region 3 for antibody 20903
QQYINWPPLT

SEQ ID NO: 41806 - protein, 17 aa, Homo sapiens
  heavy chain complementarity determining region 3 for antibody 20903
AKDLRPFYDIFAGYLDM

SEQ ID NO: 41807 - protein, 10 aa, Homo sapiens
  light chain complementarity determining region 3 for antibody 20904
QQYHSYSPAT

SEQ ID NO: 41808 - protein, 19 aa, Homo sapiens
  heavy chain complementarity determining region 3 for antibody 20904
ARESEYCFDKSGYLRPFDF

SEQ ID NO: 41809 - protein, 9 aa, Homo sapiens
  light chain complementarity determining region 3 for antibody 20905
QQYHSTPRT

SEQ ID NO: 41810 - protein, 20 aa, Homo sapiens
  heavy chain complementarity determining region 3 for antibody 20905
ARARSKTTVVTPTRQFASDI

SEQ ID NO: 41811 - protein, 9 aa, Homo sapiens
  light chain complementarity determining region 3 for antibody 20906
QQYHSTPPT

SEQ ID NO: 41812 - protein, 14 aa, Homo sapiens
  heavy chain complementarity determining region 3 for antibody 20906
ARDRKAMGFFGMDV

SEQ ID NO: 41813 - protein, 9 aa, Homo sapiens
  light chain complementarity determining region 3 for antibody 20907
QQYHSTPLT

SEQ ID NO: 41814 - protein, 14 aa, Homo sapiens
  heavy chain complementarity determining region 3 for antibody 20907
ARDRKAMGFFGMDV

SEQ ID NO: 41815 - protein, 9 aa, Homo sapiens
  light chain complementarity determining region 3 for antibody 20908
QQYHSTPLT

SEQ ID NO: 41816 - protein, 20 aa, Homo sapiens
  heavy chain complementarity determining region 3 for antibody 20908
ARARSKTTVVTPTRHFASDI

SEQ ID NO: 41817 - protein, 9 aa, Homo sapiens
  light chain complementarity determining region 3 for antibody 20909
QQYHSTPLT

SEQ ID NO: 41818 - protein, 20 aa, Homo sapiens
  heavy chain complementarity determining region 3 for antibody 20909
ARARSKTTVATPTRQFASDI

SEQ ID NO: 41819 - protein, 9 aa, Homo sapiens
  light chain complementarity determining region 3 for antibody 20910
QQYHSSPVT

SEQ ID NO: 41820 - protein, 14 aa, Homo sapiens
  heavy chain complementarity determining region 3 for antibody 20910
AKESSVYGVYPYDS

SEQ ID NO: 41821 - protein, 9 aa, Homo sapiens
  light chain complementarity determining region 3 for antibody 20911
QQYHSSPIT

SEQ ID NO: 41822 - protein, 14 aa, Homo sapiens
  heavy chain complementarity determining region 3 for antibody 20911
AKESSVYGVYPFDS

SEQ ID NO: 41823 - protein, 9 aa, Homo sapiens
  light chain complementarity determining region 3 for antibody 20912
QQYHSPPLT

SEQ ID NO: 41824 - protein, 20 aa, Homo sapiens
  heavy chain complementarity determining region 3 for antibody 20912
ARARSKTTVVTPTRQFASDI

SEQ ID NO: 41825 - protein, 9 aa, Homo sapiens
  light chain complementarity determining region 3 for antibody 20913
QQYHSNPLT

SEQ ID NO: 41826 - protein, 20 aa, Homo sapiens
  heavy chain complementarity determining region 3 for antibody 20913
ARARSKTTVVTPTRQFASDI

SEQ ID NO: 41827 - protein, 9 aa, Homo sapiens
  light chain complementarity determining region 3 for antibody 20914
QQYHSLPLT

SEQ ID NO: 41828 - protein, 19 aa, Homo sapiens
  heavy chain complementarity determining region 3 for antibody 20914
ARVRSVLIAPAGLWFRPEY

SEQ ID NO: 41829 - protein, 10 aa, Homo sapiens
  light chain complementarity determining region 3 for antibody 20915
QQYHRYSPAT

SEQ ID NO: 41830 - protein, 19 aa, Homo sapiens
  heavy chain complementarity determining region 3 for antibody 20915
ARESEYYFDKSGYLRPFDF

SEQ ID NO: 41831 - protein, 9 aa, Homo sapiens
  light chain complementarity determining region 3 for antibody 20916
QQYHRTPPT

SEQ ID NO: 41832 - protein, 20 aa, Homo sapiens
  heavy chain complementarity determining region 3 for antibody 20916
ARARSKTTVVTPTRQFASDI

SEQ ID NO: 41833 - protein, 9 aa, Homo sapiens
  light chain complementarity determining region 3 for antibody 20917
QQYHRTPLT

SEQ ID NO: 41834 - protein, 20 aa, Homo sapiens
  heavy chain complementarity determining region 3 for antibody 20917
ARARSKTTVVTPTRQFASDI

SEQ ID NO: 41835 - protein, 10 aa, Homo sapiens
  light chain complementarity determining region 3 for antibody 20918
QQYHNWPPWT

SEQ ID NO: 41836 - protein, 13 aa, Homo sapiens
  heavy chain complementarity determining region 3 for antibody 20918
AKGRVRELYYFDT

SEQ ID NO: 41837 - protein, 9 aa, Homo sapiens
  light chain complementarity determining region 3 for antibody 20919
QQYHINPLT

SEQ ID NO: 41838 - protein, 20 aa, Homo sapiens
  heavy chain complementarity determining region 3 for antibody 20919
ARARSKTTVVTPTRQFASDI

SEQ ID NO: 41839 - protein, 10 aa, Homo sapiens
  light chain complementarity determining region 3 for antibody 20920
QQYHEWPPGS

SEQ ID NO: 41840 - protein, 14 aa, Homo sapiens
  heavy chain complementarity determining region 3 for antibody 20920
AKGRGTFYSGMFDA

SEQ ID NO: 41841 - protein, 10 aa, Homo sapiens
  light chain complementarity determining region 3 for antibody 20921
QQYHEWPPGS

SEQ ID NO: 41842 - protein, 14 aa, Homo sapiens
  heavy chain complementarity determining region 3 for antibody 20921
AKGRGPFYSGMFDS

SEQ ID NO: 41843 - protein, 10 aa, Homo sapiens
  light chain complementarity determining region 3 for antibody 20922
QQYHEWPPGG

SEQ ID NO: 41844 - protein, 14 aa, Homo sapiens
  heavy chain complementarity determining region 3 for antibody 20922
AKGRGTFYSGMFDS

SEQ ID NO: 41845 - protein, 10 aa, Homo sapiens
  light chain complementarity determining region 3 for antibody 20923
QQYHEWPLGS

SEQ ID NO: 41846 - protein, 14 aa, Homo sapiens
  heavy chain complementarity determining region 3 for antibody 20923
AKGRGTFYSGMFDS

SEQ ID NO: 41847 - protein, 10 aa, Homo sapiens
  light chain complementarity determining region 3 for antibody 20924
QQYHEGPPGS

SEQ ID NO: 41848 - protein, 14 aa, Homo sapiens
  heavy chain complementarity determining region 3 for antibody 20924
AKGRGTFYSGMFDS

SEQ ID NO: 41849 - protein, 10 aa, Homo sapiens
  light chain complementarity determining region 3 for antibody 20925
QQYHDWPSLT

SEQ ID NO: 41850 - protein, 17 aa, Homo sapiens
  heavy chain complementarity determining region 3 for antibody 20925
ARDSRIKMFGVVVMFQH

SEQ ID NO: 41851 - protein, 10 aa, Homo sapiens
  light chain complementarity determining region 3 for antibody 20926
QQYHDWPPPT

SEQ ID NO: 41852 - protein, 17 aa, Homo sapiens
  heavy chain complementarity determining region 3 for antibody 20926
ARDSRIKMFGVVVMFQH

SEQ ID NO: 41853 - protein, 10 aa, Homo sapiens
  light chain complementarity determining region 3 for antibody 20927
QQYHDWPPLS

SEQ ID NO: 41854 - protein, 17 aa, Homo sapiens
  heavy chain complementarity determining region 3 for antibody 20927
ARDSRIKMFGVVVMFQH

SEQ ID NO: 41855 - protein, 10 aa, Homo sapiens
  light chain complementarity determining region 3 for antibody 20928
QQYHDWPPGS

SEQ ID NO: 41856 - protein, 14 aa, Homo sapiens
  heavy chain complementarity determining region 3 for antibody 20928
AKGRGTFYSGMFDS

SEQ ID NO: 41857 - protein, 9 aa, Homo sapiens
  light chain complementarity determining region 3 for antibody 20929
QQYGYSARP

SEQ ID NO: 41858 - protein, 13 aa, Homo sapiens
  heavy chain complementarity determining region 3 for antibody 20929
ARGYFYSDGYTED

SEQ ID NO: 41859 - protein, 9 aa, Homo sapiens
  light chain complementarity determining region 3 for antibody 20930
QQYGYLPRT

SEQ ID NO: 41860 - protein, 13 aa, Homo sapiens
  heavy chain complementarity determining region 3 for antibody 20930
AGGNFHSGGYGEY

SEQ ID NO: 41861 - protein, 9 aa, Homo sapiens
  light chain complementarity determining region 3 for antibody 20931
QQYGYLARP

SEQ ID NO: 41862 - protein, 13 aa, Homo sapiens
  heavy chain complementarity determining region 3 for antibody 20931
ARGYFYSDGYIED

SEQ ID NO: 41863 - protein, 9 aa, Homo sapiens
  light chain complementarity determining region 3 for antibody 20932
QQYGTTPRT

SEQ ID NO: 41864 - protein, 13 aa, Homo sapiens
  heavy chain complementarity determining region 3 for antibody 20932
AGGRFDRRGYSEF

SEQ ID NO: 41865 - protein, 9 aa, Homo sapiens
  light chain complementarity determining region 3 for antibody 20933
QQYGTTPRT

SEQ ID NO: 41866 - protein, 13 aa, Homo sapiens
  heavy chain complementarity determining region 3 for antibody 20933
AGGLVDRRGYSEF

SEQ ID NO: 41867 - protein, 9 aa, Homo sapiens
  light chain complementarity determining region 3 for antibody 20934
QQYGTTPRT

SEQ ID NO: 41868 - protein, 13 aa, Homo sapiens
  heavy chain complementarity determining region 3 for antibody 20934
ACGYYEGGRYSEY

SEQ ID NO: 41869 - protein, 9 aa, Homo sapiens
  light chain complementarity determining region 3 for antibody 20935
QQYGTTPRT

SEQ ID NO: 41870 - protein, 13 aa, Homo sapiens
  heavy chain complementarity determining region 3 for antibody 20935
ACGYYEGGRYFEY

SEQ ID NO: 41871 - protein, 9 aa, Homo sapiens
  light chain complementarity determining region 3 for antibody 20936
QQYGTTPRP

SEQ ID NO: 41872 - protein, 13 aa, Homo sapiens
  heavy chain complementarity determining region 3 for antibody 20936
AGGLFDRRGYSEF

SEQ ID NO: 41873 - protein, 9 aa, Homo sapiens
  light chain complementarity determining region 3 for antibody 20937
QQYGTTPRK

SEQ ID NO: 41874 - protein, 13 aa, Homo sapiens
  heavy chain complementarity determining region 3 for antibody 20937
AGGLFDRRGYSEF

SEQ ID NO: 41875 - protein, 9 aa, Homo sapiens
  light chain complementarity determining region 3 for antibody 20938
QQYGTTPRA

SEQ ID NO: 41876 - protein, 13 aa, Homo sapiens
  heavy chain complementarity determining region 3 for antibody 20938
ACGYYEGGRYYEY

SEQ ID NO: 41877 - protein, 10 aa, Homo sapiens
  light chain complementarity determining region 3 for antibody 20939
QQYGTSVLVS

SEQ ID NO: 41878 - protein, 14 aa, Homo sapiens
  heavy chain complementarity determining region 3 for antibody 20939
ARDPRAAHPDYFDY

SEQ ID NO: 41879 - protein, 9 aa, Homo sapiens
  light chain complementarity determining region 3 for antibody 20940
QQYGTSTFT

SEQ ID NO: 41880 - protein, 15 aa, Homo sapiens
  heavy chain complementarity determining region 3 for antibody 20940
ARQNDFLSGPGEFDP

SEQ ID NO: 41881 - protein, 9 aa, Homo sapiens
  light chain complementarity determining region 3 for antibody 20941
QQYGTSSRT

SEQ ID NO: 41882 - protein, 13 aa, Homo sapiens
  heavy chain complementarity determining region 3 for antibody 20941
PIGFYDRSGYHEY

SEQ ID NO: 41883 - protein, 8 aa, Homo sapiens
  light chain complementarity determining region 3 for antibody 20942
QQYGTSRT

SEQ ID NO: 41884 - protein, 15 aa, Homo sapiens
  heavy chain complementarity determining region 3 for antibody 20942
ARGEFCRDSRGYRED

SEQ ID NO: 41885 - protein, 8 aa, Homo sapiens
  light chain complementarity determining region 3 for antibody 20943
QQYGTSRM

SEQ ID NO: 41886 - protein, 13 aa, Homo sapiens
  heavy chain complementarity determining region 3 for antibody 20943
ARGQFVGSAYYEY

SEQ ID NO: 41887 - protein, 8 aa, Homo sapiens
  light chain complementarity determining region 3 for antibody 20944
QQYGTSRM

SEQ ID NO: 41888 - protein, 13 aa, Homo sapiens
  heavy chain complementarity determining region 3 for antibody 20944
ARGQFVGSAYFEN

SEQ ID NO: 41889 - protein, 8 aa, Homo sapiens
  light chain complementarity determining region 3 for antibody 20945
QQYGTSRM

SEQ ID NO: 41890 - protein, 13 aa, Homo sapiens
  heavy chain complementarity determining region 3 for antibody 20945
ARGQFVGSAYCEN

SEQ ID NO: 41891 - protein, 8 aa, Homo sapiens
  light chain complementarity determining region 3 for antibody 20946
QQYGTSRM

SEQ ID NO: 41892 - protein, 13 aa, Homo sapiens
  heavy chain complementarity determining region 3 for antibody 20946
ARGQFGGSAYYDN

SEQ ID NO: 41893 - protein, 8 aa, Homo sapiens
  light chain complementarity determining region 3 for antibody 20947
QQYGTSRI

SEQ ID NO: 41894 - protein, 13 aa, Homo sapiens
  heavy chain complementarity determining region 3 for antibody 20947
ARGQFVGSAYYEN

SEQ ID NO: 41895 - protein, 9 aa, Homo sapiens
  light chain complementarity determining region 3 for antibody 20948
QQYGTSRGT

SEQ ID NO: 41896 - protein, 17 aa, Homo sapiens
  heavy chain complementarity determining region 3 for antibody 20948
TKDRWLRVYDSSGCYDS

SEQ ID NO: 41897 - protein, 9 aa, Homo sapiens
  light chain complementarity determining region 3 for antibody 20949
QQYGTSPYT

SEQ ID NO: 41898 - protein, 20 aa, Homo sapiens
  heavy chain complementarity determining region 3 for antibody 20949
ARGGQKGYVDWLFELDGMDV

SEQ ID NO: 41899 - protein, 9 aa, Homo sapiens
  light chain complementarity determining region 3 for antibody 20950
QQYGTSPYT

SEQ ID NO: 41900 - protein, 20 aa, Homo sapiens
  heavy chain complementarity determining region 3 for antibody 20950
ARGGQKGYCDWLFELDGMDV

SEQ ID NO: 41901 - protein, 9 aa, Homo sapiens
  light chain complementarity determining region 3 for antibody 20951
QQYGTSPYT

SEQ ID NO: 41902 - protein, 20 aa, Homo sapiens
  heavy chain complementarity determining region 3 for antibody 20951
ARGGQKGCFDWLFELDGMDV

SEQ ID NO: 41903 - protein, 9 aa, Homo sapiens
  light chain complementarity determining region 3 for antibody 20952
QQYGTSPWT

SEQ ID NO: 41904 - protein, 14 aa, Homo sapiens
  heavy chain complementarity determining region 3 for antibody 20952
AGGDFCGRDCYSEY

SEQ ID NO: 41905 - protein, 10 aa, Homo sapiens
  light chain complementarity determining region 3 for antibody 20953
QQYGTSPTWT

SEQ ID NO: 41906 - protein, 18 aa, Homo sapiens
  heavy chain complementarity determining region 3 for antibody 20953
ARAPRDTMIVVRYCGMDV

SEQ ID NO: 41907 - protein, 10 aa, Homo sapiens
  light chain complementarity determining region 3 for antibody 20954
QQYGTSPTWT

SEQ ID NO: 41908 - protein, 18 aa, Homo sapiens
  heavy chain complementarity determining region 3 for antibody 20954
ARAPRDAMIVVRYYGMDV

SEQ ID NO: 41909 - protein, 10 aa, Homo sapiens
  light chain complementarity determining region 3 for antibody 20955
QQYGTSPTWT

SEQ ID NO: 41910 - protein, 18 aa, Homo sapiens
  heavy chain complementarity determining region 3 for antibody 20955
ARAARDTMIVVRYYGMDV

SEQ ID NO: 41911 - protein, 9 aa, Homo sapiens
  light chain complementarity determining region 3 for antibody 20956
QQYGTSPST

SEQ ID NO: 41912 - protein, 14 aa, Homo sapiens
  heavy chain complementarity determining region 3 for antibody 20956
AKEPPRWLQPFSGY

SEQ ID NO: 41913 - protein, 9 aa, Homo sapiens
  light chain complementarity determining region 3 for antibody 20957
QQYGTSPRT

SEQ ID NO: 41914 - protein, 13 aa, Homo sapiens
  heavy chain complementarity determining region 3 for antibody 20957
PIGYYDRSGYHDY

SEQ ID NO: 41915 - protein, 9 aa, Homo sapiens
  light chain complementarity determining region 3 for antibody 20958
QQYGTSPRT

SEQ ID NO: 41916 - protein, 13 aa, Homo sapiens
  heavy chain complementarity determining region 3 for antibody 20958
PIGFYDRSGDHEY

SEQ ID NO: 41917 - protein, 9 aa, Homo sapiens
  light chain complementarity determining region 3 for antibody 20959
QQYGTSPRT

SEQ ID NO: 41918 - protein, 14 aa, Homo sapiens
  heavy chain complementarity determining region 3 for antibody 20959
ASDPVVGAPGYFDY

SEQ ID NO: 41919 - protein, 9 aa, Homo sapiens
  light chain complementarity determining region 3 for antibody 20960
QQYGTSPRT

SEQ ID NO: 41920 - protein, 25 aa, Homo sapiens
  heavy chain complementarity determining region 3 for antibody 20960
ARLRIDRLRLPGAMRGPLYDCGLNV

SEQ ID NO: 41921 - protein, 9 aa, Homo sapiens
  light chain complementarity determining region 3 for antibody 20961
QQYGTSPRT

SEQ ID NO: 41922 - protein, 14 aa, Homo sapiens
  heavy chain complementarity determining region 3 for antibody 20961
AGWDFCGRDCYSEY

SEQ ID NO: 41923 - protein, 9 aa, Homo sapiens
  light chain complementarity determining region 3 for antibody 20962
QQYGTSPRT

SEQ ID NO: 41924 - protein, 13 aa, Homo sapiens
  heavy chain complementarity determining region 3 for antibody 20962
AGGSGSGTYYKEL

SEQ ID NO: 41925 - protein, 9 aa, Homo sapiens
  light chain complementarity determining region 3 for antibody 20963
QQYGTSPRT

SEQ ID NO: 41926 - protein, 13 aa, Homo sapiens
  heavy chain complementarity determining region 3 for antibody 20963
AGGSGSGTYYKDL

SEQ ID NO: 41927 - protein, 9 aa, Homo sapiens
  light chain complementarity determining region 3 for antibody 20964
QQYGTSPRT

SEQ ID NO: 41928 - protein, 13 aa, Homo sapiens
  heavy chain complementarity determining region 3 for antibody 20964
AGGSGSGTDYKDH

SEQ ID NO: 41929 - protein, 9 aa, Homo sapiens
  light chain complementarity determining region 3 for antibody 20965
QQYGTSPRT

SEQ ID NO: 41930 - protein, 13 aa, Homo sapiens
  heavy chain complementarity determining region 3 for antibody 20965
AGGSGSGPYYKEH

SEQ ID NO: 41931 - protein, 9 aa, Homo sapiens
  light chain complementarity determining region 3 for antibody 20966
QQYGTSPRT

SEQ ID NO: 41932 - protein, 13 aa, Homo sapiens
  heavy chain complementarity determining region 3 for antibody 20966
AGGSGSGPYYKDH

SEQ ID NO: 41933 - protein, 9 aa, Homo sapiens
  light chain complementarity determining region 3 for antibody 20967
QQYGTSPRT

SEQ ID NO: 41934 - protein, 13 aa, Homo sapiens
  heavy chain complementarity determining region 3 for antibody 20967
AGGSGSGPYYIEH

SEQ ID NO: 41935 - protein, 9 aa, Homo sapiens
  light chain complementarity determining region 3 for antibody 20968
QQYGTSPRT

SEQ ID NO: 41936 - protein, 13 aa, Homo sapiens
  heavy chain complementarity determining region 3 for antibody 20968
AGGSGAGTYYKEH

SEQ ID NO: 41937 - protein, 9 aa, Homo sapiens
  light chain complementarity determining region 3 for antibody 20969
QQYGTSPRT

SEQ ID NO: 41938 - protein, 14 aa, Homo sapiens
  heavy chain complementarity determining region 3 for antibody 20969
AGGDFCGRDCYSES

SEQ ID NO: 41939 - protein, 9 aa, Homo sapiens
  light chain complementarity determining region 3 for antibody 20970
QQYGTSPRT

SEQ ID NO: 41940 - protein, 13 aa, Homo sapiens
  heavy chain complementarity determining region 3 for antibody 20970
ACGYYQSGRYCEY

SEQ ID NO: 41941 - protein, 9 aa, Homo sapiens
  light chain complementarity determining region 3 for antibody 20971
QQYGTSPRT

SEQ ID NO: 41942 - protein, 13 aa, Homo sapiens
  heavy chain complementarity determining region 3 for antibody 20971
ACGYYQSGRSYEY

SEQ ID NO: 41943 - protein, 9 aa, Homo sapiens
  light chain complementarity determining region 3 for antibody 20972
QQYGTSPRS

SEQ ID NO: 41944 - protein, 13 aa, Homo sapiens
  heavy chain complementarity determining region 3 for antibody 20972
AGGYFDRSGYYEY

SEQ ID NO: 41945 - protein, 9 aa, Homo sapiens
  light chain complementarity determining region 3 for antibody 20973
QQYGTSPRP

SEQ ID NO: 41946 - protein, 13 aa, Homo sapiens
  heavy chain complementarity determining region 3 for antibody 20973
PIGVYDRSGYHEY

SEQ ID NO: 41947 - protein, 9 aa, Homo sapiens
  light chain complementarity determining region 3 for antibody 20974
QQYGTSPRP

SEQ ID NO: 41948 - protein, 13 aa, Homo sapiens
  heavy chain complementarity determining region 3 for antibody 20974
PIGFYDRSGYHDY

SEQ ID NO: 41949 - protein, 9 aa, Homo sapiens
  light chain complementarity determining region 3 for antibody 20975
QQYGTSPRN

SEQ ID NO: 41950 - protein, 13 aa, Homo sapiens
  heavy chain complementarity determining region 3 for antibody 20975
PIGFYDRSGYHEY

SEQ ID NO: 41951 - protein, 9 aa, Homo sapiens
  light chain complementarity determining region 3 for antibody 20976
QQYGTSPRK

SEQ ID NO: 41952 - protein, 13 aa, Homo sapiens
  heavy chain complementarity determining region 3 for antibody 20976
AGGSGSGTYYKEH

SEQ ID NO: 41953 - protein, 10 aa, Homo sapiens
  light chain complementarity determining region 3 for antibody 20977
QQYGTSPPWT

SEQ ID NO: 41954 - protein, 18 aa, Homo sapiens
  heavy chain complementarity determining region 3 for antibody 20977
ARAPRDTMIVVRYYGMDV

SEQ ID NO: 41955 - protein, 11 aa, Homo sapiens
  light chain complementarity determining region 3 for antibody 20978
QQYGTSPPSYT

SEQ ID NO: 41956 - protein, 11 aa, Homo sapiens
  heavy chain complementarity determining region 3 for antibody 20978
AYSPGWWRIDC

SEQ ID NO: 41957 - protein, 11 aa, Homo sapiens
  light chain complementarity determining region 3 for antibody 20979
QQYGTSPPSYP

SEQ ID NO: 41958 - protein, 11 aa, Homo sapiens
  heavy chain complementarity determining region 3 for antibody 20979
AYSPGWWRIDC

SEQ ID NO: 41959 - protein, 11 aa, Homo sapiens
  light chain complementarity determining region 3 for antibody 20980
QQYGTSPPKVT

SEQ ID NO: 41960 - protein, 11 aa, Homo sapiens
  heavy chain complementarity determining region 3 for antibody 20980
AKPSAGTPGDY

SEQ ID NO: 41961 - protein, 11 aa, Homo sapiens
  light chain complementarity determining region 3 for antibody 20981
QQYGTSPPKVT

SEQ ID NO: 41962 - protein, 11 aa, Homo sapiens
  heavy chain complementarity determining region 3 for antibody 20981
AKPSAGTAGDY

SEQ ID NO: 41963 - protein, 11 aa, Homo sapiens
  light chain complementarity determining region 3 for antibody 20982
QQYGTSPPKGT

SEQ ID NO: 41964 - protein, 11 aa, Homo sapiens
  heavy chain complementarity determining region 3 for antibody 20982
ANPSAGTTGDY

SEQ ID NO: 41965 - protein, 11 aa, Homo sapiens
  light chain complementarity determining region 3 for antibody 20983
QQYGTSPPKGT

SEQ ID NO: 41966 - protein, 11 aa, Homo sapiens
  heavy chain complementarity determining region 3 for antibody 20983
AKPSAGTTGDY

SEQ ID NO: 41967 - protein, 10 aa, Homo sapiens
  light chain complementarity determining region 3 for antibody 20984
QQYGTSPMYS

SEQ ID NO: 41968 - protein, 11 aa, Homo sapiens
  heavy chain complementarity determining region 3 for antibody 20984
ARGGQWGSLDY

SEQ ID NO: 41969 - protein, 9 aa, Homo sapiens
  light chain complementarity determining region 3 for antibody 20985
QQYGTSPLT

SEQ ID NO: 41970 - protein, 10 aa, Homo sapiens
  heavy chain complementarity determining region 3 for antibody 20985
VAGAGWLPDY

SEQ ID NO: 41971 - protein, 9 aa, Homo sapiens
  light chain complementarity determining region 3 for antibody 20986
QQYGTSPLT

SEQ ID NO: 41972 - protein, 13 aa, Homo sapiens
  heavy chain complementarity determining region 3 for antibody 20986
ACGYYQSGRYYEY

SEQ ID NO: 41973 - protein, 9 aa, Homo sapiens
  light chain complementarity determining region 3 for antibody 20987
QQYGTSPGT

SEQ ID NO: 41974 - protein, 13 aa, Homo sapiens
  heavy chain complementarity determining region 3 for antibody 20987
PIGFYDRSGYHEY

SEQ ID NO: 41975 - protein, 9 aa, Homo sapiens
  light chain complementarity determining region 3 for antibody 20988
QQYGTSPFT

SEQ ID NO: 41976 - protein, 15 aa, Homo sapiens
  heavy chain complementarity determining region 3 for antibody 20988
ARQSDCLSGPGEFDP

SEQ ID NO: 41977 - protein, 9 aa, Homo sapiens
  light chain complementarity determining region 3 for antibody 20989
QQYGTSPFT

SEQ ID NO: 41978 - protein, 15 aa, Homo sapiens
  heavy chain complementarity determining region 3 for antibody 20989
ARQNDFWSGPGEFDP

SEQ ID NO: 41979 - protein, 9 aa, Homo sapiens
  light chain complementarity determining region 3 for antibody 20990
QQYGTSPFT

SEQ ID NO: 41980 - protein, 15 aa, Homo sapiens
  heavy chain complementarity determining region 3 for antibody 20990
ARQNDFLSSPGEFDP

SEQ ID NO: 41981 - protein, 9 aa, Homo sapiens
  light chain complementarity determining region 3 for antibody 20991
QQYGTSPFT

SEQ ID NO: 41982 - protein, 15 aa, Homo sapiens
  heavy chain complementarity determining region 3 for antibody 20991
ARQNDFLSGPGESDP

SEQ ID NO: 41983 - protein, 9 aa, Homo sapiens
  light chain complementarity determining region 3 for antibody 20992
QQYGTSPFT

SEQ ID NO: 41984 - protein, 15 aa, Homo sapiens
  heavy chain complementarity determining region 3 for antibody 20992
ARQNDFLSGPGELDP

SEQ ID NO: 41985 - protein, 9 aa, Homo sapiens
  light chain complementarity determining region 3 for antibody 20993
QQYGTSPFT

SEQ ID NO: 41986 - protein, 15 aa, Homo sapiens
  heavy chain complementarity determining region 3 for antibody 20993
ARQNDFLSGPGEFAP

SEQ ID NO: 41987 - protein, 9 aa, Homo sapiens
  light chain complementarity determining region 3 for antibody 20994
QQYGTSPFT

SEQ ID NO: 41988 - protein, 15 aa, Homo sapiens
  heavy chain complementarity determining region 3 for antibody 20994
ARQHDFLSGPGEFDP

SEQ ID NO: 41989 - protein, 9 aa, Homo sapiens
  light chain complementarity determining region 3 for antibody 20995
QQYGTSPFT

SEQ ID NO: 41990 - protein, 15 aa, Homo sapiens
  heavy chain complementarity determining region 3 for antibody 20995
ARHNDFLSGPGEFDP

SEQ ID NO: 41991 - protein, 9 aa, Homo sapiens
  light chain complementarity determining region 3 for antibody 20996
QQYGTSPFT

SEQ ID NO: 41992 - protein, 18 aa, Homo sapiens
  heavy chain complementarity determining region 3 for antibody 20996
ARFEKWERRRGYYYGMDV

SEQ ID NO: 41993 - protein, 9 aa, Homo sapiens
  light chain complementarity determining region 3 for antibody 20997
QQYGTSPFT

SEQ ID NO: 41994 - protein, 18 aa, Homo sapiens
  heavy chain complementarity determining region 3 for antibody 20997
ARFEKWELRRGYYYGMGV

SEQ ID NO: 41995 - protein, 9 aa, Homo sapiens
  light chain complementarity determining region 3 for antibody 20998
QQYGTSPDT

SEQ ID NO: 41996 - protein, 14 aa, Homo sapiens
  heavy chain complementarity determining region 3 for antibody 20998
AKEPPRWLQPFSGY

SEQ ID NO: 41997 - protein, 9 aa, Homo sapiens
  light chain complementarity determining region 3 for antibody 20999
QQYGTSLRT

SEQ ID NO: 41998 - protein, 13 aa, Homo sapiens
  heavy chain complementarity determining region 3 for antibody 20999
PIGFYDRSGYHEY

SEQ ID NO: 41999 - protein, 10 aa, Homo sapiens
  light chain complementarity determining region 3 for antibody 21000
QQYGTSLPGT

SEQ ID NO: 42000 - protein, 14 aa, Homo sapiens
  heavy chain complementarity determining region 3 for antibody 21000
ARGGSSGYDSQLDF

SEQ ID NO: 42001 - protein, 11 aa, Homo sapiens
  light chain complementarity determining region 3 for antibody 21001
QQYGTSHRMDT

SEQ ID NO: 42002 - protein, 23 aa, Homo sapiens
  heavy chain complementarity determining region 3 for antibody 21001
ARMRSGYSRDKNVLQFYYYGLDV

SEQ ID NO: 42003 - protein, 9 aa, Homo sapiens
  light chain complementarity determining region 3 for antibody 21002
QQYGTPSRT

SEQ ID NO: 42004 - protein, 25 aa, Homo sapiens
  heavy chain complementarity determining region 3 for antibody 21002
ARLRVDRLRLPGAMRGPLYDRGLNV

SEQ ID NO: 42005 - protein, 10 aa, Homo sapiens
  light chain complementarity determining region 3 for antibody 21003
QQYGTPPTWT

SEQ ID NO: 42006 - protein, 18 aa, Homo sapiens
  heavy chain complementarity determining region 3 for antibody 21003
ARAPRDTMIVVRYYGMDV

SEQ ID NO: 42007 - protein, 9 aa, Homo sapiens
  light chain complementarity determining region 3 for antibody 21004
QQYGTPPRT

SEQ ID NO: 42008 - protein, 25 aa, Homo sapiens
  heavy chain complementarity determining region 3 for antibody 21004
SRLRVDRLRLPGAMRGPLYDRGLNV

SEQ ID NO: 42009 - protein, 9 aa, Homo sapiens
  light chain complementarity determining region 3 for antibody 21005
QQYGTPPRT

SEQ ID NO: 42010 - protein, 25 aa, Homo sapiens
  heavy chain complementarity determining region 3 for antibody 21005
PRLRVDRLRLPGAMRGPLYDRGLNV

SEQ ID NO: 42011 - protein, 9 aa, Homo sapiens
  light chain complementarity determining region 3 for antibody 21006
QQYGTPPRT

SEQ ID NO: 42012 - protein, 25 aa, Homo sapiens
  heavy chain complementarity determining region 3 for antibody 21006
ERLRVDRLRLPGAMRGPLYDRGLNV

SEQ ID NO: 42013 - protein, 9 aa, Homo sapiens
  light chain complementarity determining region 3 for antibody 21007
QQYGTPPRT

SEQ ID NO: 42014 - protein, 25 aa, Homo sapiens
  heavy chain complementarity determining region 3 for antibody 21007
ASLRVARLRLPGAMRGPLYDRGLNV

SEQ ID NO: 42015 - protein, 9 aa, Homo sapiens
  light chain complementarity determining region 3 for antibody 21008
QQYGTPPRT

SEQ ID NO: 42016 - protein, 25 aa, Homo sapiens
  heavy chain complementarity determining region 3 for antibody 21008
ASLGVDRLRLPGAMRGPLYDRGLNV

SEQ ID NO: 42017 - protein, 9 aa, Homo sapiens
  light chain complementarity determining region 3 for antibody 21009
QQYGTPPRT

SEQ ID NO: 42018 - protein, 25 aa, Homo sapiens
  heavy chain complementarity determining region 3 for antibody 21009
ARLRVDRRRLPGAMRGPLYDRGLNV

SEQ ID NO: 42019 - protein, 9 aa, Homo sapiens
  light chain complementarity determining region 3 for antibody 21010
QQYGTPPRT

SEQ ID NO: 42020 - protein, 25 aa, Homo sapiens
  heavy chain complementarity determining region 3 for antibody 21010
ARLRVDRLRRPGAMRGPLYDRGLNV

SEQ ID NO: 42021 - protein, 9 aa, Homo sapiens
  light chain complementarity determining region 3 for antibody 21011
QQYGTPPRT

SEQ ID NO: 42022 - protein, 25 aa, Homo sapiens
  heavy chain complementarity determining region 3 for antibody 21011
ARLRVDRLRLPGAVRGPLYDRGLNV

SEQ ID NO: 42023 - protein, 9 aa, Homo sapiens
  light chain complementarity determining region 3 for antibody 21012
QQYGTPPRT

SEQ ID NO: 42024 - protein, 25 aa, Homo sapiens
  heavy chain complementarity determining region 3 for antibody 21012
ARLRVDRLRLPGAMRGPLYGRGLNV

SEQ ID NO: 42025 - protein, 9 aa, Homo sapiens
  light chain complementarity determining region 3 for antibody 21013
QQYGTPPRT

SEQ ID NO: 42026 - protein, 25 aa, Homo sapiens
  heavy chain complementarity determining region 3 for antibody 21013
ARLRVDRLRLPGAMRGPLYDRGPNV

SEQ ID NO: 42027 - protein, 9 aa, Homo sapiens
  light chain complementarity determining region 3 for antibody 21014
QQYGTPPRT

SEQ ID NO: 42028 - protein, 25 aa, Homo sapiens
  heavy chain complementarity determining region 3 for antibody 21014
ARLRVDRLRLPGAMRGPLYDRGLNA

SEQ ID NO: 42029 - protein, 9 aa, Homo sapiens
  light chain complementarity determining region 3 for antibody 21015
QQYGTPPRT

SEQ ID NO: 42030 - protein, 25 aa, Homo sapiens
  heavy chain complementarity determining region 3 for antibody 21015
ARLRVDRLRLPGAMRGPLYARGLNV

SEQ ID NO: 42031 - protein, 9 aa, Homo sapiens
  light chain complementarity determining region 3 for antibody 21016
QQYGTPPRT

SEQ ID NO: 42032 - protein, 25 aa, Homo sapiens
  heavy chain complementarity determining region 3 for antibody 21016
ARLRVDRLRLPGAMRGPLCDRGLNV

SEQ ID NO: 42033 - protein, 9 aa, Homo sapiens
  light chain complementarity determining region 3 for antibody 21017
QQYGTPPRT

SEQ ID NO: 42034 - protein, 25 aa, Homo sapiens
  heavy chain complementarity determining region 3 for antibody 21017
ARLRVDRLRLHGAMRGPLYDRGLNV

SEQ ID NO: 42035 - protein, 9 aa, Homo sapiens
  light chain complementarity determining region 3 for antibody 21018
QQYGTPPRT

SEQ ID NO: 42036 - protein, 25 aa, Homo sapiens
  heavy chain complementarity determining region 3 for antibody 21018
ARLGVDRLRLPGAMRGPLYDRGLDV

SEQ ID NO: 42037 - protein, 9 aa, Homo sapiens
  light chain complementarity determining region 3 for antibody 21019
QQYGTPPRT

SEQ ID NO: 42038 - protein, 13 aa, Homo sapiens
  heavy chain complementarity determining region 3 for antibody 21019
AGGYFDRSGYYEY

SEQ ID NO: 42039 - protein, 9 aa, Homo sapiens
  light chain complementarity determining region 3 for antibody 21020
QQYGTPPRT

SEQ ID NO: 42040 - protein, 12 aa, Homo sapiens
  heavy chain complementarity determining region 3 for antibody 21020
AGGLFDRRGYSE

SEQ ID NO: 42041 - protein, 9 aa, Homo sapiens
  light chain complementarity determining region 3 for antibody 21021
QQYGTPPRQ

SEQ ID NO: 42042 - protein, 25 aa, Homo sapiens
  heavy chain complementarity determining region 3 for antibody 21021
ARLRVDRLRLPGAMRGPLYDRGLNV

SEQ ID NO: 42043 - protein, 9 aa, Homo sapiens
  light chain complementarity determining region 3 for antibody 21022
QQYGTPPRP

SEQ ID NO: 42044 - protein, 13 aa, Homo sapiens
  heavy chain complementarity determining region 3 for antibody 21022
PIGFYDRSGYHEY

SEQ ID NO: 42045 - protein, 9 aa, Homo sapiens
  light chain complementarity determining region 3 for antibody 21023
QQYGTPPFT

SEQ ID NO: 42046 - protein, 15 aa, Homo sapiens
  heavy chain complementarity determining region 3 for antibody 21023
ARQNDFLSGPGEFDP

SEQ ID NO: 42047 - protein, 9 aa, Homo sapiens
  light chain complementarity determining region 3 for antibody 21024
QQYGTLPRT

SEQ ID NO: 42048 - protein, 10 aa, Homo sapiens
  heavy chain complementarity determining region 3 for antibody 21024
ASLNRRTSRR

SEQ ID NO: 42049 - protein, 9 aa, Homo sapiens
  light chain complementarity determining region 3 for antibody 21025
QQYGTLPRT

SEQ ID NO: 42050 - protein, 13 aa, Homo sapiens
  heavy chain complementarity determining region 3 for antibody 21025
ARGQYERSGYKEN

SEQ ID NO: 42051 - protein, 9 aa, Homo sapiens
  light chain complementarity determining region 3 for antibody 21026
QQYGTLPRT

SEQ ID NO: 42052 - protein, 13 aa, Homo sapiens
  heavy chain complementarity determining region 3 for antibody 21026
AGGQFHTSGYSEF

SEQ ID NO: 42053 - protein, 9 aa, Homo sapiens
  light chain complementarity determining region 3 for antibody 21027
QQYGTLPRT

SEQ ID NO: 42054 - protein, 13 aa, Homo sapiens
  heavy chain complementarity determining region 3 for antibody 21027
AGGQFHSSGYSEF

SEQ ID NO: 42055 - protein, 9 aa, Homo sapiens
  light chain complementarity determining region 3 for antibody 21028
QQYGTLPRR

SEQ ID NO: 42056 - protein, 13 aa, Homo sapiens
  heavy chain complementarity determining region 3 for antibody 21028
AGGDFHSGGYSEF

SEQ ID NO: 42057 - protein, 9 aa, Homo sapiens
  light chain complementarity determining region 3 for antibody 21029
QQYGTLPQT

SEQ ID NO: 42058 - protein, 18 aa, Homo sapiens
  heavy chain complementarity determining region 3 for antibody 21029
ARDYYGAGREIWVGAFDI

SEQ ID NO: 42059 - protein, 9 aa, Homo sapiens
  light chain complementarity determining region 3 for antibody 21030
QQYGTLPQP

SEQ ID NO: 42060 - protein, 18 aa, Homo sapiens
  heavy chain complementarity determining region 3 for antibody 21030
ARDYYGSGREIWVGAFDI

SEQ ID NO: 42061 - protein, 9 aa, Homo sapiens
  light chain complementarity determining region 3 for antibody 21031
QQYGTLPFP

SEQ ID NO: 42062 - protein, 15 aa, Homo sapiens
  heavy chain complementarity determining region 3 for antibody 21031
ARQNDFLSGPGEFDP

SEQ ID NO: 42063 - protein, 9 aa, Homo sapiens
  light chain complementarity determining region 3 for antibody 21032
QQYGTKPRT

SEQ ID NO: 42064 - protein, 10 aa, Homo sapiens
  heavy chain complementarity determining region 3 for antibody 21032
ASLNRRTSRR

SEQ ID NO: 42065 - protein, 9 aa, Homo sapiens
  light chain complementarity determining region 3 for antibody 21033
QQYGTKPRT

SEQ ID NO: 42066 - protein, 13 aa, Homo sapiens
  heavy chain complementarity determining region 3 for antibody 21033
AGGNFHRSGYAEY

SEQ ID NO: 42067 - protein, 9 aa, Homo sapiens
  light chain complementarity determining region 3 for antibody 21034
QQYGTKPRT

SEQ ID NO: 42068 - protein, 13 aa, Homo sapiens
  heavy chain complementarity determining region 3 for antibody 21034
ACGYYEGGRYYEY

SEQ ID NO: 42069 - protein, 9 aa, Homo sapiens
  light chain complementarity determining region 3 for antibody 21035
QQYGTISRT

SEQ ID NO: 42070 - protein, 14 aa, Homo sapiens
  heavy chain complementarity determining region 3 for antibody 21035
AGGEFCGGDCYSEY

SEQ ID NO: 42071 - protein, 9 aa, Homo sapiens
  light chain complementarity determining region 3 for antibody 21036
QQYGTIPRT

SEQ ID NO: 42072 - protein, 13 aa, Homo sapiens
  heavy chain complementarity determining region 3 for antibody 21036
TGGNFHRSGYAEY

SEQ ID NO: 42073 - protein, 9 aa, Homo sapiens
  light chain complementarity determining region 3 for antibody 21037
QQYGTIPRT

SEQ ID NO: 42074 - protein, 10 aa, Homo sapiens
  heavy chain complementarity determining region 3 for antibody 21037
ASLSRRTSRR

SEQ ID NO: 42075 - protein, 9 aa, Homo sapiens
  light chain complementarity determining region 3 for antibody 21038
QQYGTIPRT

SEQ ID NO: 42076 - protein, 10 aa, Homo sapiens
  heavy chain complementarity determining region 3 for antibody 21038
ASLNRRTSSR

SEQ ID NO: 42077 - protein, 9 aa, Homo sapiens
  light chain complementarity determining region 3 for antibody 21039
QQYGTIPRT

SEQ ID NO: 42078 - protein, 13 aa, Homo sapiens
  heavy chain complementarity determining region 3 for antibody 21039
AGGSFHSRGYGEY

SEQ ID NO: 42079 - protein, 9 aa, Homo sapiens
  light chain complementarity determining region 3 for antibody 21040
QQYGTIPRT

SEQ ID NO: 42080 - protein, 13 aa, Homo sapiens
  heavy chain complementarity determining region 3 for antibody 21040
AGGSFGGRNYKED

SEQ ID NO: 42081 - protein, 9 aa, Homo sapiens
  light chain complementarity determining region 3 for antibody 21041
QQYGTIPRT

SEQ ID NO: 42082 - protein, 13 aa, Homo sapiens
  heavy chain complementarity determining region 3 for antibody 21041
AGGNVHRSGYAEY

SEQ ID NO: 42083 - protein, 9 aa, Homo sapiens
  light chain complementarity determining region 3 for antibody 21042
QQYGTIPRT

SEQ ID NO: 42084 - protein, 13 aa, Homo sapiens
  heavy chain complementarity determining region 3 for antibody 21042
AGGNFHRSGYVEY

SEQ ID NO: 42085 - protein, 9 aa, Homo sapiens
  light chain complementarity determining region 3 for antibody 21043
QQYGTIPRT

SEQ ID NO: 42086 - protein, 13 aa, Homo sapiens
  heavy chain complementarity determining region 3 for antibody 21043
AGGLLDSSGYSEF

SEQ ID NO: 42087 - protein, 9 aa, Homo sapiens
  light chain complementarity determining region 3 for antibody 21044
QQYGTIPRT

SEQ ID NO: 42088 - protein, 13 aa, Homo sapiens
  heavy chain complementarity determining region 3 for antibody 21044
AGGLFDGSGYSEF

SEQ ID NO: 42089 - protein, 9 aa, Homo sapiens
  light chain complementarity determining region 3 for antibody 21045
QQYGTIPRT

SEQ ID NO: 42090 - protein, 14 aa, Homo sapiens
  heavy chain complementarity determining region 3 for antibody 21045
AGGEVCGGDCYSEY

SEQ ID NO: 42091 - protein, 9 aa, Homo sapiens
  light chain complementarity determining region 3 for antibody 21046
QQYGTIPRR

SEQ ID NO: 42092 - protein, 13 aa, Homo sapiens
  heavy chain complementarity determining region 3 for antibody 21046
AGGNFHRSGYAEY

SEQ ID NO: 42093 - protein, 9 aa, Homo sapiens
  light chain complementarity determining region 3 for antibody 21047
QQYGTIPRP

SEQ ID NO: 42094 - protein, 10 aa, Homo sapiens
  heavy chain complementarity determining region 3 for antibody 21047
ASLNRRTSRR

SEQ ID NO: 42095 - protein, 9 aa, Homo sapiens
  light chain complementarity determining region 3 for antibody 21048
QQYGTIPRP

SEQ ID NO: 42096 - protein, 13 aa, Homo sapiens
  heavy chain complementarity determining region 3 for antibody 21048
AGGIFHSRGYGEY

SEQ ID NO: 42097 - protein, 9 aa, Homo sapiens
  light chain complementarity determining region 3 for antibody 21049
QQYGTIPRK

SEQ ID NO: 42098 - protein, 14 aa, Homo sapiens
  heavy chain complementarity determining region 3 for antibody 21049
AGGEFCGGDCYSEY

SEQ ID NO: 42099 - protein, 9 aa, Homo sapiens
  light chain complementarity determining region 3 for antibody 21050
QQYGTIPRK

SEQ ID NO: 42100 - protein, 14 aa, Homo sapiens
  heavy chain complementarity determining region 3 for antibody 21050
AGGEFCGGDCYPEY

SEQ ID NO: 42101 - protein, 9 aa, Homo sapiens
  light chain complementarity determining region 3 for antibody 21051
QQYGSWPWT

SEQ ID NO: 42102 - protein, 11 aa, Homo sapiens
  heavy chain complementarity determining region 3 for antibody 21051
ARDRYLCRVGY

SEQ ID NO: 42103 - protein, 9 aa, Homo sapiens
  light chain complementarity determining region 3 for antibody 21052
QQYGSTVGA

SEQ ID NO: 42104 - protein, 9 aa, Homo sapiens
  heavy chain complementarity determining region 3 for antibody 21052
ARMYSGLDY

SEQ ID NO: 42105 - protein, 10 aa, Homo sapiens
  light chain complementarity determining region 3 for antibody 21053
QQYGSSVPWP

SEQ ID NO: 42106 - protein, 13 aa, Homo sapiens
  heavy chain complementarity determining region 3 for antibody 21053
AHGRRSSWDSFDY

SEQ ID NO: 42107 - protein, 10 aa, Homo sapiens
  light chain complementarity determining region 3 for antibody 21054
QQYGSSSMYS

SEQ ID NO: 42108 - protein, 11 aa, Homo sapiens
  heavy chain complementarity determining region 3 for antibody 21054
ARGGQWGSLDY

SEQ ID NO: 42109 - protein, 9 aa, Homo sapiens
  light chain complementarity determining region 3 for antibody 21055
QQYGSSSLT

SEQ ID NO: 42110 - protein, 13 aa, Homo sapiens
  heavy chain complementarity determining region 3 for antibody 21055
VKNFFMAFDAFHM

SEQ ID NO: 42111 - protein, 9 aa, Homo sapiens
  light chain complementarity determining region 3 for antibody 21056
QQYGSSSIT

SEQ ID NO: 42112 - protein, 13 aa, Homo sapiens
  heavy chain complementarity determining region 3 for antibody 21056
VKNFVMAFDAFHI

SEQ ID NO: 42113 - protein, 9 aa, Homo sapiens
  light chain complementarity determining region 3 for antibody 21057
QQYGSSSIT

SEQ ID NO: 42114 - protein, 13 aa, Homo sapiens
  heavy chain complementarity determining region 3 for antibody 21057
VKNFLMAFDAFHM

SEQ ID NO: 42115 - protein, 9 aa, Homo sapiens
  light chain complementarity determining region 3 for antibody 21058
QQYGSSSIT

SEQ ID NO: 42116 - protein, 13 aa, Homo sapiens
  heavy chain complementarity determining region 3 for antibody 21058
VKNFFLPFDAFHM

SEQ ID NO: 42117 - protein, 9 aa, Homo sapiens
  light chain complementarity determining region 3 for antibody 21059
QQYGSSSIN

SEQ ID NO: 42118 - protein, 13 aa, Homo sapiens
  heavy chain complementarity determining region 3 for antibody 21059
VKNFFMAFDAFHM

SEQ ID NO: 42119 - protein, 9 aa, Homo sapiens
  light chain complementarity determining region 3 for antibody 21060
QQYGSSRVT

SEQ ID NO: 42120 - protein, 17 aa, Homo sapiens
  heavy chain complementarity determining region 3 for antibody 21060
ANPPLPWVGELSSAFDI

SEQ ID NO: 42121 - protein, 9 aa, Homo sapiens
  light chain complementarity determining region 3 for antibody 21061
QQYGSSQRT

SEQ ID NO: 42122 - protein, 18 aa, Homo sapiens
  heavy chain complementarity determining region 3 for antibody 21061
ATAFWVGLGVPPPGFFEY

SEQ ID NO: 42123 - protein, 9 aa, Homo sapiens
  light chain complementarity determining region 3 for antibody 21062
QQYGSSPYT

SEQ ID NO: 42124 - protein, 19 aa, Homo sapiens
  heavy chain complementarity determining region 3 for antibody 21062
ARGLAGYDSSGYLPYYFDY

SEQ ID NO: 42125 - protein, 9 aa, Homo sapiens
  light chain complementarity determining region 3 for antibody 21063
QQYGSSPYT

SEQ ID NO: 42126 - protein, 16 aa, Homo sapiens
  heavy chain complementarity determining region 3 for antibody 21063
ARECPRRFGDHCPYDY

SEQ ID NO: 42127 - protein, 9 aa, Homo sapiens
  light chain complementarity determining region 3 for antibody 21064
QQYGSSPYP

SEQ ID NO: 42128 - protein, 22 aa, Homo sapiens
  heavy chain complementarity determining region 3 for antibody 21064
ARRRPTDITKFRQRGRQGPFEI

SEQ ID NO: 42129 - protein, 10 aa, Homo sapiens
  light chain complementarity determining region 3 for antibody 21065
QQYGSSPWYS

SEQ ID NO: 42130 - protein, 11 aa, Homo sapiens
  heavy chain complementarity determining region 3 for antibody 21065
ARGGQWGSLDY

SEQ ID NO: 42131 - protein, 9 aa, Homo sapiens
  light chain complementarity determining region 3 for antibody 21066
QQYGSSPWT

SEQ ID NO: 42132 - protein, 25 aa, Homo sapiens
  heavy chain complementarity determining region 3 for antibody 21066
ARLRIDRLRLPGAMRGPLYDCGLNV

SEQ ID NO: 42133 - protein, 9 aa, Homo sapiens
  light chain complementarity determining region 3 for antibody 21067
QQYGSSPWT

SEQ ID NO: 42134 - protein, 14 aa, Homo sapiens
  heavy chain complementarity determining region 3 for antibody 21067
AKGLMYHYDSALDL

SEQ ID NO: 42135 - protein, 9 aa, Homo sapiens
  light chain complementarity determining region 3 for antibody 21068
QQYGSSPVT

SEQ ID NO: 42136 - protein, 20 aa, Homo sapiens
  heavy chain complementarity determining region 3 for antibody 21068
ERRPVVSGWYRTGISSWFDP

SEQ ID NO: 42137 - protein, 9 aa, Homo sapiens
  light chain complementarity determining region 3 for antibody 21069
QQYGSSPVT

SEQ ID NO: 42138 - protein, 20 aa, Homo sapiens
  heavy chain complementarity determining region 3 for antibody 21069
ARRPVVSGWYRTCISSWFDP

SEQ ID NO: 42139 - protein, 10 aa, Homo sapiens
  light chain complementarity determining region 3 for antibody 21070
QQYGSSPTGT

SEQ ID NO: 42140 - protein, 15 aa, Homo sapiens
  heavy chain complementarity determining region 3 for antibody 21070
AKGPMVRGVLGPFDY

SEQ ID NO: 42141 - protein, 10 aa, Homo sapiens
  light chain complementarity determining region 3 for antibody 21071
QQYGSSPSVT

SEQ ID NO: 42142 - protein, 15 aa, Homo sapiens
  heavy chain complementarity determining region 3 for antibody 21071
AKGPMVRGVLGPFDY

SEQ ID NO: 42143 - protein, 9 aa, Homo sapiens
  light chain complementarity determining region 3 for antibody 21072
QQYGSSPST

SEQ ID NO: 42144 - protein, 19 aa, Homo sapiens
  heavy chain complementarity determining region 3 for antibody 21072
ARGLAGYDSSGYLLYYFDY

SEQ ID NO: 42145 - protein, 9 aa, Homo sapiens
  light chain complementarity determining region 3 for antibody 21073
QQYGSSPRT

SEQ ID NO: 42146 - protein, 17 aa, Homo sapiens
  heavy chain complementarity determining region 3 for antibody 21073
TTDPQWLEPPPYLTNDY

SEQ ID NO: 42147 - protein, 9 aa, Homo sapiens
  light chain complementarity determining region 3 for antibody 21074
QQYGSSPRT

SEQ ID NO: 42148 - protein, 17 aa, Homo sapiens
  heavy chain complementarity determining region 3 for antibody 21074
TTDPQWLEPPPFLTNDD

SEQ ID NO: 42149 - protein, 9 aa, Homo sapiens
  light chain complementarity determining region 3 for antibody 21075
QQYGSSPRT

SEQ ID NO: 42150 - protein, 17 aa, Homo sapiens
  heavy chain complementarity determining region 3 for antibody 21075
TTDPQWLEPPPFLTNAY

SEQ ID NO: 42151 - protein, 9 aa, Homo sapiens
  light chain complementarity determining region 3 for antibody 21076
QQYGSSPRT

SEQ ID NO: 42152 - protein, 17 aa, Homo sapiens
  heavy chain complementarity determining region 3 for antibody 21076
TTDPQWLEPPPFLPNDY

SEQ ID NO: 42153 - protein, 9 aa, Homo sapiens
  light chain complementarity determining region 3 for antibody 21077
QQYGSSPRT

SEQ ID NO: 42154 - protein, 17 aa, Homo sapiens
  heavy chain complementarity determining region 3 for antibody 21077
TTDHQWLEPPPFLTNDY

SEQ ID NO: 42155 - protein, 9 aa, Homo sapiens
  light chain complementarity determining region 3 for antibody 21078
QQYGSSPRT

SEQ ID NO: 42156 - protein, 17 aa, Homo sapiens
  heavy chain complementarity determining region 3 for antibody 21078
TTAPQWLEPPPFLTNDY

SEQ ID NO: 42157 - protein, 9 aa, Homo sapiens
  light chain complementarity determining region 3 for antibody 21079
QQYGSSPRT

SEQ ID NO: 42158 - protein, 25 aa, Homo sapiens
  heavy chain complementarity determining region 3 for antibody 21079
TRLRIDRLRLPGAMRGPLYDCGLNV

SEQ ID NO: 42159 - protein, 9 aa, Homo sapiens
  light chain complementarity determining region 3 for antibody 21080
QQYGSSPRT

SEQ ID NO: 42160 - protein, 17 aa, Homo sapiens
  heavy chain complementarity determining region 3 for antibody 21080
TADPQWLEPPPFLTNDY

SEQ ID NO: 42161 - protein, 9 aa, Homo sapiens
  light chain complementarity determining region 3 for antibody 21081
QQYGSSPRT

SEQ ID NO: 42162 - protein, 17 aa, Homo sapiens
  heavy chain complementarity determining region 3 for antibody 21081
AWAQGVVVVAARGAFDI

SEQ ID NO: 42163 - protein, 9 aa, Homo sapiens
  light chain complementarity determining region 3 for antibody 21082
QQYGSSPRT

SEQ ID NO: 42164 - protein, 25 aa, Homo sapiens
  heavy chain complementarity determining region 3 for antibody 21082
ATLRIDRLRLPGAMRGPLYDCGLNV

SEQ ID NO: 42165 - protein, 9 aa, Homo sapiens
  light chain complementarity determining region 3 for antibody 21083
QQYGSSPRT

SEQ ID NO: 42166 - protein, 13 aa, Homo sapiens
  heavy chain complementarity determining region 3 for antibody 21083
ATGYYASGTYLDY

SEQ ID NO: 42167 - protein, 9 aa, Homo sapiens
  light chain complementarity determining region 3 for antibody 21084
QQYGSSPRT

SEQ ID NO: 42168 - protein, 13 aa, Homo sapiens
  heavy chain complementarity determining region 3 for antibody 21084
ATGYYASGPYLEY

SEQ ID NO: 42169 - protein, 9 aa, Homo sapiens
  light chain complementarity determining region 3 for antibody 21085
QQYGSSPRT

SEQ ID NO: 42170 - protein, 14 aa, Homo sapiens
  heavy chain complementarity determining region 3 for antibody 21085
ATGFFDRSRHYLDY

SEQ ID NO: 42171 - protein, 9 aa, Homo sapiens
  light chain complementarity determining region 3 for antibody 21086
QQYGSSPRT

SEQ ID NO: 42172 - protein, 13 aa, Homo sapiens
  heavy chain complementarity determining region 3 for antibody 21086
ATGCYASGTYLEY

SEQ ID NO: 42173 - protein, 9 aa, Homo sapiens
  light chain complementarity determining region 3 for antibody 21087
QQYGSSPRT

SEQ ID NO: 42174 - protein, 13 aa, Homo sapiens
  heavy chain complementarity determining region 3 for antibody 21087
ATGCYASGTYLDY

SEQ ID NO: 42175 - protein, 9 aa, Homo sapiens
  light chain complementarity determining region 3 for antibody 21088
QQYGSSPRT

SEQ ID NO: 42176 - protein, 18 aa, Homo sapiens
  heavy chain complementarity determining region 3 for antibody 21088
ATASWVGLGVPPPGFFEY

SEQ ID NO: 42177 - protein, 9 aa, Homo sapiens
  light chain complementarity determining region 3 for antibody 21089
QQYGSSPRT

SEQ ID NO: 42178 - protein, 18 aa, Homo sapiens
  heavy chain complementarity determining region 3 for antibody 21089
ATALWVGLGVPPPGFFEY

SEQ ID NO: 42179 - protein, 9 aa, Homo sapiens
  light chain complementarity determining region 3 for antibody 21090
QQYGSSPRT

SEQ ID NO: 42180 - protein, 18 aa, Homo sapiens
  heavy chain complementarity determining region 3 for antibody 21090
ATAFWVGVGVPPPGFFEY

SEQ ID NO: 42181 - protein, 9 aa, Homo sapiens
  light chain complementarity determining region 3 for antibody 21091
QQYGSSPRT

SEQ ID NO: 42182 - protein, 18 aa, Homo sapiens
  heavy chain complementarity determining region 3 for antibody 21091
ATAFWVGLGVPPPGVFEY

SEQ ID NO: 42183 - protein, 9 aa, Homo sapiens
  light chain complementarity determining region 3 for antibody 21092
QQYGSSPRT

SEQ ID NO: 42184 - protein, 18 aa, Homo sapiens
  heavy chain complementarity determining region 3 for antibody 21092
ATAFWVGLGVPHPGFFEY

SEQ ID NO: 42185 - protein, 9 aa, Homo sapiens
  light chain complementarity determining region 3 for antibody 21093
QQYGSSPRT

SEQ ID NO: 42186 - protein, 18 aa, Homo sapiens
  heavy chain complementarity determining region 3 for antibody 21093
ATAFWVGLGVAPPGFFEY

SEQ ID NO: 42187 - protein, 9 aa, Homo sapiens
  light chain complementarity determining region 3 for antibody 21094
QQYGSSPRT

SEQ ID NO: 42188 - protein, 18 aa, Homo sapiens
  heavy chain complementarity determining region 3 for antibody 21094
ATAFWGGLGVPPPGFFEY

SEQ ID NO: 42189 - protein, 9 aa, Homo sapiens
  light chain complementarity determining region 3 for antibody 21095
QQYGSSPRT

SEQ ID NO: 42190 - protein, 18 aa, Homo sapiens
  heavy chain complementarity determining region 3 for antibody 21095
ATAFGVGLGVPPPGFFEY

SEQ ID NO: 42191 - protein, 9 aa, Homo sapiens
  light chain complementarity determining region 3 for antibody 21096
QQYGSSPRT

SEQ ID NO: 42192 - protein, 19 aa, Homo sapiens
  heavy chain complementarity determining region 3 for antibody 21096
ASPQGYDFRSGYSEHYFDY

SEQ ID NO: 42193 - protein, 9 aa, Homo sapiens
  light chain complementarity determining region 3 for antibody 21097
QQYGSSPRT

SEQ ID NO: 42194 - protein, 13 aa, Homo sapiens
  heavy chain complementarity determining region 3 for antibody 21097
ASGCFDRSGYYEY

SEQ ID NO: 42195 - protein, 9 aa, Homo sapiens
  light chain complementarity determining region 3 for antibody 21098
QQYGSSPRT

SEQ ID NO: 42196 - protein, 17 aa, Homo sapiens
  heavy chain complementarity determining region 3 for antibody 21098
ARVRSFYDDTSGHYYLF

SEQ ID NO: 42197 - protein, 9 aa, Homo sapiens
  light chain complementarity determining region 3 for antibody 21099
QQYGSSPRT

SEQ ID NO: 42198 - protein, 19 aa, Homo sapiens
  heavy chain complementarity determining region 3 for antibody 21099
ARTQGYDFRSGYSEHYFDY

SEQ ID NO: 42199 - protein, 9 aa, Homo sapiens
  light chain complementarity determining region 3 for antibody 21100
QQYGSSPRT

SEQ ID NO: 42200 - protein, 16 aa, Homo sapiens
  heavy chain complementarity determining region 3 for antibody 21100
ARSRGSSGYQWGAFDL

SEQ ID NO: 42201 - protein, 9 aa, Homo sapiens
  light chain complementarity determining region 3 for antibody 21101
QQYGSSPRT

SEQ ID NO: 42202 - protein, 11 aa, Homo sapiens
  heavy chain complementarity determining region 3 for antibody 21101
ARRTALGGLDY

SEQ ID NO: 42203 - protein, 9 aa, Homo sapiens
  light chain complementarity determining region 3 for antibody 21102
QQYGSSPRT

SEQ ID NO: 42204 - protein, 25 aa, Homo sapiens
  heavy chain complementarity determining region 3 for antibody 21102
ARPRIDRLRLPGAMRGPLYDCGLNV

SEQ ID NO: 42205 - protein, 9 aa, Homo sapiens
  light chain complementarity determining region 3 for antibody 21103
QQYGSSPRT

SEQ ID NO: 42206 - protein, 25 aa, Homo sapiens
  heavy chain complementarity determining region 3 for antibody 21103
ARLRVDRLRLPGAMRGPLYDCGLNV

SEQ ID NO: 42207 - protein, 9 aa, Homo sapiens
  light chain complementarity determining region 3 for antibody 21104
QQYGSSPRT

SEQ ID NO: 42208 - protein, 25 aa, Homo sapiens
  heavy chain complementarity determining region 3 for antibody 21104
ARLRTDRLRLPGAMRGPLYDCGLNV

SEQ ID NO: 42209 - protein, 9 aa, Homo sapiens
  light chain complementarity determining region 3 for antibody 21105
QQYGSSPRT

SEQ ID NO: 42210 - protein, 25 aa, Homo sapiens
  heavy chain complementarity determining region 3 for antibody 21105
ARLRMDRLRLPGAMRGPLYDCGLNV

SEQ ID NO: 42211 - protein, 9 aa, Homo sapiens
  light chain complementarity determining region 3 for antibody 21106
QQYGSSPRT

SEQ ID NO: 42212 - protein, 25 aa, Homo sapiens
  heavy chain complementarity determining region 3 for antibody 21106
ARLRINRLRLPGAMRGPLYDCGLNV

SEQ ID NO: 42213 - protein, 9 aa, Homo sapiens
  light chain complementarity determining region 3 for antibody 21107
QQYGSSPRT

SEQ ID NO: 42214 - protein, 25 aa, Homo sapiens
  heavy chain complementarity determining region 3 for antibody 21107
ARLRIGRLRLPGAMRGPLYDCGLNV

SEQ ID NO: 42215 - protein, 9 aa, Homo sapiens
  light chain complementarity determining region 3 for antibody 21108
QQYGSSPRT

SEQ ID NO: 42216 - protein, 25 aa, Homo sapiens
  heavy chain complementarity determining region 3 for antibody 21108
ARLRIDRRRLPGAMRGPLYDCGLNV

SEQ ID NO: 42217 - protein, 9 aa, Homo sapiens
  light chain complementarity determining region 3 for antibody 21109
QQYGSSPRT

SEQ ID NO: 42218 - protein, 25 aa, Homo sapiens
  heavy chain complementarity determining region 3 for antibody 21109
ARLRIDRLRVPGAMRGPLYDCGLNV

SEQ ID NO: 42219 - protein, 9 aa, Homo sapiens
  light chain complementarity determining region 3 for antibody 21110
QQYGSSPRT

SEQ ID NO: 42220 - protein, 25 aa, Homo sapiens
  heavy chain complementarity determining region 3 for antibody 21110
ARLRIDRLRLTGAMRGPLYDCGLNV

SEQ ID NO: 42221 - protein, 9 aa, Homo sapiens
  light chain complementarity determining region 3 for antibody 21111
QQYGSSPRT

SEQ ID NO: 42222 - protein, 25 aa, Homo sapiens
  heavy chain complementarity determining region 3 for antibody 21111
ARLRIDRLRLPGSMRGPLYDCGLNV

SEQ ID NO: 42223 - protein, 9 aa, Homo sapiens
  light chain complementarity determining region 3 for antibody 21112
QQYGSSPRT

SEQ ID NO: 42224 - protein, 25 aa, Homo sapiens
  heavy chain complementarity determining region 3 for antibody 21112
ARLRIDRLRLPGAMSGPLYDCGLNV

SEQ ID NO: 42225 - protein, 9 aa, Homo sapiens
  light chain complementarity determining region 3 for antibody 21113
QQYGSSPRT

SEQ ID NO: 42226 - protein, 25 aa, Homo sapiens
  heavy chain complementarity determining region 3 for antibody 21113
ARLRIDRLRLPGAMRGPLYDCGVNV

SEQ ID NO: 42227 - protein, 9 aa, Homo sapiens
  light chain complementarity determining region 3 for antibody 21114
QQYGSSPRT

SEQ ID NO: 42228 - protein, 25 aa, Homo sapiens
  heavy chain complementarity determining region 3 for antibody 21114
ARLRIDRLRLPGAMRGPLYDCGSNV

SEQ ID NO: 42229 - protein, 9 aa, Homo sapiens
  light chain complementarity determining region 3 for antibody 21115
QQYGSSPRT

SEQ ID NO: 42230 - protein, 25 aa, Homo sapiens
  heavy chain complementarity determining region 3 for antibody 21115
ARLRIDRLRLPGAMRGPLDDCGLNV

SEQ ID NO: 42231 - protein, 9 aa, Homo sapiens
  light chain complementarity determining region 3 for antibody 21116
QQYGSSPRT

SEQ ID NO: 42232 - protein, 25 aa, Homo sapiens
  heavy chain complementarity determining region 3 for antibody 21116
ARLRIDRLRLPGAMRGPLCDCGLNV

SEQ ID NO: 42233 - protein, 9 aa, Homo sapiens
  light chain complementarity determining region 3 for antibody 21117
QQYGSSPRT

SEQ ID NO: 42234 - protein, 25 aa, Homo sapiens
  heavy chain complementarity determining region 3 for antibody 21117
ARLRIDRLRLPGAMRGLLYDCGLNV

SEQ ID NO: 42235 - protein, 9 aa, Homo sapiens
  light chain complementarity determining region 3 for antibody 21118
QQYGSSPRT

SEQ ID NO: 42236 - protein, 25 aa, Homo sapiens
  heavy chain complementarity determining region 3 for antibody 21118
ARLRIDRLRLPGAMHGPLYDCGLNV

SEQ ID NO: 42237 - protein, 9 aa, Homo sapiens
  light chain complementarity determining region 3 for antibody 21119
QQYGSSPRT

SEQ ID NO: 42238 - protein, 25 aa, Homo sapiens
  heavy chain complementarity determining region 3 for antibody 21119
ARLRIDRLRIPGAMRGPLYDCGLNV

SEQ ID NO: 42239 - protein, 9 aa, Homo sapiens
  light chain complementarity determining region 3 for antibody 21120
QQYGSSPRT

SEQ ID NO: 42240 - protein, 19 aa, Homo sapiens
  heavy chain complementarity determining region 3 for antibody 21120
ARGSSSSRRRAAVVGYFDL

SEQ ID NO: 42241 - protein, 9 aa, Homo sapiens
  light chain complementarity determining region 3 for antibody 21121
QQYGSSPRT

SEQ ID NO: 42242 - protein, 13 aa, Homo sapiens
  heavy chain complementarity determining region 3 for antibody 21121
ARGSGIFGGCFDY

SEQ ID NO: 42243 - protein, 9 aa, Homo sapiens
  light chain complementarity determining region 3 for antibody 21122
QQYGSSPRT

SEQ ID NO: 42244 - protein, 13 aa, Homo sapiens
  heavy chain complementarity determining region 3 for antibody 21122
ARGSGICGGFFDY

SEQ ID NO: 42245 - protein, 9 aa, Homo sapiens
  light chain complementarity determining region 3 for antibody 21123
QQYGSSPRT

SEQ ID NO: 42246 - protein, 17 aa, Homo sapiens
  heavy chain complementarity determining region 3 for antibody 21123
ARAQGVVVVAARGAFDL

SEQ ID NO: 42247 - protein, 9 aa, Homo sapiens
  light chain complementarity determining region 3 for antibody 21124
QQYGSSPRT

SEQ ID NO: 42248 - protein, 15 aa, Homo sapiens
  heavy chain complementarity determining region 3 for antibody 21124
AKTYEFWSGDDAFEI

SEQ ID NO: 42249 - protein, 9 aa, Homo sapiens
  light chain complementarity determining region 3 for antibody 21125
QQYGSSPRT

SEQ ID NO: 42250 - protein, 15 aa, Homo sapiens
  heavy chain complementarity determining region 3 for antibody 21125
AKTYDLWSGDDAFEI

SEQ ID NO: 42251 - protein, 9 aa, Homo sapiens
  light chain complementarity determining region 3 for antibody 21126
QQYGSSPRT

SEQ ID NO: 42252 - protein, 15 aa, Homo sapiens
  heavy chain complementarity determining region 3 for antibody 21126
AKTYDFWSGDDALEI

SEQ ID NO: 42253 - protein, 9 aa, Homo sapiens
  light chain complementarity determining region 3 for antibody 21127
QQYGSSPRT

SEQ ID NO: 42254 - protein, 15 aa, Homo sapiens
  heavy chain complementarity determining region 3 for antibody 21127
AKTYDFWSGDDAFDI

SEQ ID NO: 42255 - protein, 9 aa, Homo sapiens
  light chain complementarity determining region 3 for antibody 21128
QQYGSSPRT

SEQ ID NO: 42256 - protein, 15 aa, Homo sapiens
  heavy chain complementarity determining region 3 for antibody 21128
AKAYDFWSGDDAFEI

SEQ ID NO: 42257 - protein, 9 aa, Homo sapiens
  light chain complementarity determining region 3 for antibody 21129
QQYGSSPRT

SEQ ID NO: 42258 - protein, 25 aa, Homo sapiens
  heavy chain complementarity determining region 3 for antibody 21129
AILRIDRLRLPGAMRGPLYDCGLNV

SEQ ID NO: 42259 - protein, 9 aa, Homo sapiens
  light chain complementarity determining region 3 for antibody 21130
QQYGSSPRT

SEQ ID NO: 42260 - protein, 25 aa, Homo sapiens
  heavy chain complementarity determining region 3 for antibody 21130
AGLRIDRLRLPGAMRGPLYDCGLNV

SEQ ID NO: 42261 - protein, 9 aa, Homo sapiens
  light chain complementarity determining region 3 for antibody 21131
QQYGSSPRT

SEQ ID NO: 42262 - protein, 14 aa, Homo sapiens
  heavy chain complementarity determining region 3 for antibody 21131
AGGTCSSGSSYSEN

SEQ ID NO: 42263 - protein, 9 aa, Homo sapiens
  light chain complementarity determining region 3 for antibody 21132
QQYGSSPRT

SEQ ID NO: 42264 - protein, 14 aa, Homo sapiens
  heavy chain complementarity determining region 3 for antibody 21132
AGGRFSSGSSYSEY

SEQ ID NO: 42265 - protein, 9 aa, Homo sapiens
  light chain complementarity determining region 3 for antibody 21133
QQYGSSPRT

SEQ ID NO: 42266 - protein, 14 aa, Homo sapiens
  heavy chain complementarity determining region 3 for antibody 21133
AGGRFSSGSSYSEI

SEQ ID NO: 42267 - protein, 9 aa, Homo sapiens
  light chain complementarity determining region 3 for antibody 21134
QQYGSSPRT

SEQ ID NO: 42268 - protein, 14 aa, Homo sapiens
  heavy chain complementarity determining region 3 for antibody 21134
AGGRFSRGSSYSEN

SEQ ID NO: 42269 - protein, 9 aa, Homo sapiens
  light chain complementarity determining region 3 for antibody 21135
QQYGSSPRR

SEQ ID NO: 42270 - protein, 25 aa, Homo sapiens
  heavy chain complementarity determining region 3 for antibody 21135
ARLRIARLRLPGAMRGPLYDCGLNV

SEQ ID NO: 42271 - protein, 9 aa, Homo sapiens
  light chain complementarity determining region 3 for antibody 21136
QQYGSSPRP

SEQ ID NO: 42272 - protein, 11 aa, Homo sapiens
  heavy chain complementarity determining region 3 for antibody 21136
ARRTALVGLDY

SEQ ID NO: 42273 - protein, 9 aa, Homo sapiens
  light chain complementarity determining region 3 for antibody 21137
QQYGSSPRP

SEQ ID NO: 42274 - protein, 21 aa, Homo sapiens
  heavy chain complementarity determining region 3 for antibody 21137
AKDTAPYSTSWHTKKFYYFDY

SEQ ID NO: 42275 - protein, 9 aa, Homo sapiens
  light chain complementarity determining region 3 for antibody 21138
QQYGSSPRN

SEQ ID NO: 42276 - protein, 15 aa, Homo sapiens
  heavy chain complementarity determining region 3 for antibody 21138
AKTYDFWSGDDAFEI

SEQ ID NO: 42277 - protein, 9 aa, Homo sapiens
  light chain complementarity determining region 3 for antibody 21139
QQYGSSPRN

SEQ ID NO: 42278 - protein, 14 aa, Homo sapiens
  heavy chain complementarity determining region 3 for antibody 21139
AKGLMYHYDSALDL

SEQ ID NO: 42279 - protein, 9 aa, Homo sapiens
  light chain complementarity determining region 3 for antibody 21140
QQYGSSPRM

SEQ ID NO: 42280 - protein, 25 aa, Homo sapiens
  heavy chain complementarity determining region 3 for antibody 21140
ARLRIDRLRLPGAMRGPLYDCGLNV

SEQ ID NO: 42281 - protein, 9 aa, Homo sapiens
  light chain complementarity determining region 3 for antibody 21141
QQYGSSPRK

SEQ ID NO: 42282 - protein, 17 aa, Homo sapiens
  heavy chain complementarity determining region 3 for antibody 21141
TTDPQWLEPPPFLTNDY

SEQ ID NO: 42283 - protein, 9 aa, Homo sapiens
  light chain complementarity determining region 3 for antibody 21142
QQYGSSPRK

SEQ ID NO: 42284 - protein, 13 aa, Homo sapiens
  heavy chain complementarity determining region 3 for antibody 21142
ATGYYASGTYLEY

SEQ ID NO: 42285 - protein, 9 aa, Homo sapiens
  light chain complementarity determining region 3 for antibody 21143
QQYGSSPRK

SEQ ID NO: 42286 - protein, 19 aa, Homo sapiens
  heavy chain complementarity determining region 3 for antibody 21143
ARPQGYDFRSGYSEHYFDY

SEQ ID NO: 42287 - protein, 10 aa, Homo sapiens
  light chain complementarity determining region 3 for antibody 21144
QQYGSSPPVT

SEQ ID NO: 42288 - protein, 15 aa, Homo sapiens
  heavy chain complementarity determining region 3 for antibody 21144
AKGPMVRGVLGPVDY

SEQ ID NO: 42289 - protein, 10 aa, Homo sapiens
  light chain complementarity determining region 3 for antibody 21145
QQYGSSPPVT

SEQ ID NO: 42290 - protein, 15 aa, Homo sapiens
  heavy chain complementarity determining region 3 for antibody 21145
AKGPMVRGGLGPFDY

SEQ ID NO: 42291 - protein, 10 aa, Homo sapiens
  light chain complementarity determining region 3 for antibody 21146
QQYGSSPPVT

SEQ ID NO: 42292 - protein, 15 aa, Homo sapiens
  heavy chain complementarity determining region 3 for antibody 21146
AKGAMVRGVLGPFDY

SEQ ID NO: 42293 - protein, 9 aa, Homo sapiens
  light chain complementarity determining region 3 for antibody 21147
QQYGSSPPT

SEQ ID NO: 42294 - protein, 16 aa, Homo sapiens
  heavy chain complementarity determining region 3 for antibody 21147
ARGRTFRGNIYADLFY

SEQ ID NO: 42295 - protein, 9 aa, Homo sapiens
  light chain complementarity determining region 3 for antibody 21148
QQYGSSPPT

SEQ ID NO: 42296 - protein, 16 aa, Homo sapiens
  heavy chain complementarity determining region 3 for antibody 21148
ARGRTFRGHIYADLLY

SEQ ID NO: 42297 - protein, 9 aa, Homo sapiens
  light chain complementarity determining region 3 for antibody 21149
QQYGSSPPT

SEQ ID NO: 42298 - protein, 16 aa, Homo sapiens
  heavy chain complementarity determining region 3 for antibody 21149
ARGRTCRGNIYADLLY

SEQ ID NO: 42299 - protein, 10 aa, Homo sapiens
  light chain complementarity determining region 3 for antibody 21150
QQYGSSPPST

SEQ ID NO: 42300 - protein, 17 aa, Homo sapiens
  heavy chain complementarity determining region 3 for antibody 21150
ARTYDTTGYCYGGYFDY

SEQ ID NO: 42301 - protein, 9 aa, Homo sapiens
  light chain complementarity determining region 3 for antibody 21151
QQYGSSPPP

SEQ ID NO: 42302 - protein, 16 aa, Homo sapiens
  heavy chain complementarity determining region 3 for antibody 21151
ARDFHPMAASDTAYDS

SEQ ID NO: 42303 - protein, 10 aa, Homo sapiens
  light chain complementarity determining region 3 for antibody 21152
QQYGSSPPFT

SEQ ID NO: 42304 - protein, 15 aa, Homo sapiens
  heavy chain complementarity determining region 3 for antibody 21152
AKGPMVRGVLGPFDY

SEQ ID NO: 42305 - protein, 8 aa, Homo sapiens
  light chain complementarity determining region 3 for antibody 21153
QQYGSSPP

SEQ ID NO: 42306 - protein, 14 aa, Homo sapiens
  heavy chain complementarity determining region 3 for antibody 21153
ARLGGPDRGEKGGY

SEQ ID NO: 42307 - protein, 9 aa, Homo sapiens
  light chain complementarity determining region 3 for antibody 21154
QQYGSSPNT

SEQ ID NO: 42308 - protein, 29 aa, Homo sapiens
  heavy chain complementarity determining region 3 for antibody 21154
AKSGRLRDLWFGDFRRPNYVDNTGYYLDY

SEQ ID NO: 42309 - protein, 9 aa, Homo sapiens
  light chain complementarity determining region 3 for antibody 21155
QQYGSSPNP

SEQ ID NO: 42310 - protein, 29 aa, Homo sapiens
  heavy chain complementarity determining region 3 for antibody 21155
AKSGRLRDLWFGDFRRPNYFDNTGYYLDY

SEQ ID NO: 42311 - protein, 10 aa, Homo sapiens
  light chain complementarity determining region 3 for antibody 21156
QQYGSSPMYS

SEQ ID NO: 42312 - protein, 11 aa, Homo sapiens
  heavy chain complementarity determining region 3 for antibody 21156
VRGGQWGSLDY

SEQ ID NO: 42313 - protein, 10 aa, Homo sapiens
  light chain complementarity determining region 3 for antibody 21157
QQYGSSPMYS

SEQ ID NO: 42314 - protein, 11 aa, Homo sapiens
  heavy chain complementarity determining region 3 for antibody 21157
ARGVQWGSLDY

SEQ ID NO: 42315 - protein, 10 aa, Homo sapiens
  light chain complementarity determining region 3 for antibody 21158
QQYGSSPMYS

SEQ ID NO: 42316 - protein, 11 aa, Homo sapiens
  heavy chain complementarity determining region 3 for antibody 21158
ARGGQWGSRDY

SEQ ID NO: 42317 - protein, 10 aa, Homo sapiens
  light chain complementarity determining region 3 for antibody 21159
QQYGSSPMYS

SEQ ID NO: 42318 - protein, 11 aa, Homo sapiens
  heavy chain complementarity determining region 3 for antibody 21159
ARGGQWGALDY

SEQ ID NO: 42319 - protein, 10 aa, Homo sapiens
  light chain complementarity determining region 3 for antibody 21160
QQYGSSPMYS

SEQ ID NO: 42320 - protein, 11 aa, Homo sapiens
  heavy chain complementarity determining region 3 for antibody 21160
ARGGQRGSLDY

SEQ ID NO: 42321 - protein, 10 aa, Homo sapiens
  light chain complementarity determining region 3 for antibody 21161
QQYGSSPMYS

SEQ ID NO: 42322 - protein, 11 aa, Homo sapiens
  heavy chain complementarity determining region 3 for antibody 21161
ARGGQGGSLDY

SEQ ID NO: 42323 - protein, 10 aa, Homo sapiens
  light chain complementarity determining region 3 for antibody 21162
QQYGSSPMYS

SEQ ID NO: 42324 - protein, 11 aa, Homo sapiens
  heavy chain complementarity determining region 3 for antibody 21162
ARGGPWGSLDY

SEQ ID NO: 42325 - protein, 10 aa, Homo sapiens
  light chain complementarity determining region 3 for antibody 21163
QQYGSSPMYS

SEQ ID NO: 42326 - protein, 11 aa, Homo sapiens
  heavy chain complementarity determining region 3 for antibody 21163
ARGGKWGSLDY

SEQ ID NO: 42327 - protein, 10 aa, Homo sapiens
  light chain complementarity determining region 3 for antibody 21164
QQYGSSPMYN

SEQ ID NO: 42328 - protein, 11 aa, Homo sapiens
  heavy chain complementarity determining region 3 for antibody 21164
ARGGQWGSLDY

SEQ ID NO: 42329 - protein, 10 aa, Homo sapiens
  light chain complementarity determining region 3 for antibody 21165
QQYGSSPMSG

SEQ ID NO: 42330 - protein, 11 aa, Homo sapiens
  heavy chain complementarity determining region 3 for antibody 21165
ARGGQWGSLDY

SEQ ID NO: 42331 - protein, 10 aa, Homo sapiens
  light chain complementarity determining region 3 for antibody 21166
QQYGSSPMDR

SEQ ID NO: 42332 - protein, 11 aa, Homo sapiens
  heavy chain complementarity determining region 3 for antibody 21166
ARGGQWGSLDY

SEQ ID NO: 42333 - protein, 9 aa, Homo sapiens
  light chain complementarity determining region 3 for antibody 21167
QQYGSSPLT

SEQ ID NO: 42334 - protein, 22 aa, Homo sapiens
  heavy chain complementarity determining region 3 for antibody 21167
ASQTEGYCTTTDCDGAHRPFDI

SEQ ID NO: 42335 - protein, 9 aa, Homo sapiens
  light chain complementarity determining region 3 for antibody 21168
QQYGSSPLT

SEQ ID NO: 42336 - protein, 22 aa, Homo sapiens
  heavy chain complementarity determining region 3 for antibody 21168
ASQTEGYCTTADCYGAHRPFDI

SEQ ID NO: 42337 - protein, 9 aa, Homo sapiens
  light chain complementarity determining region 3 for antibody 21169
QQYGSSPLT

SEQ ID NO: 42338 - protein, 13 aa, Homo sapiens
  heavy chain complementarity determining region 3 for antibody 21169
ARSQGLPEDVFND

SEQ ID NO: 42339 - protein, 9 aa, Homo sapiens
  light chain complementarity determining region 3 for antibody 21170
QQYGSSPLT

SEQ ID NO: 42340 - protein, 19 aa, Homo sapiens
  heavy chain complementarity determining region 3 for antibody 21170
ARGSSSSRRRAAVVWYFDL

SEQ ID NO: 42341 - protein, 9 aa, Homo sapiens
  light chain complementarity determining region 3 for antibody 21171
QQYGSSPLT

SEQ ID NO: 42342 - protein, 19 aa, Homo sapiens
  heavy chain complementarity determining region 3 for antibody 21171
ARGSSSSRRRAAVVGSFDL

SEQ ID NO: 42343 - protein, 9 aa, Homo sapiens
  light chain complementarity determining region 3 for antibody 21172
QQYGSSPLT

SEQ ID NO: 42344 - protein, 19 aa, Homo sapiens
  heavy chain complementarity determining region 3 for antibody 21172
ARGSSSSRRRAAVVGHFDL

SEQ ID NO: 42345 - protein, 9 aa, Homo sapiens
  light chain complementarity determining region 3 for antibody 21173
QQYGSSPLT

SEQ ID NO: 42346 - protein, 19 aa, Homo sapiens
  heavy chain complementarity determining region 3 for antibody 21173
ARGSSSSRRRAAVVGCFDL

SEQ ID NO: 42347 - protein, 9 aa, Homo sapiens
  light chain complementarity determining region 3 for antibody 21174
QQYGSSPLT

SEQ ID NO: 42348 - protein, 19 aa, Homo sapiens
  heavy chain complementarity determining region 3 for antibody 21174
ARGSSSSRRRAAGVGYFDL

SEQ ID NO: 42349 - protein, 9 aa, Homo sapiens
  light chain complementarity determining region 3 for antibody 21175
QQYGSSPLT

SEQ ID NO: 42350 - protein, 19 aa, Homo sapiens
  heavy chain complementarity determining region 3 for antibody 21175
ARGSSSSRRRAAAVGYFDL

SEQ ID NO: 42351 - protein, 9 aa, Homo sapiens
  light chain complementarity determining region 3 for antibody 21176
QQYGSSPLT

SEQ ID NO: 42352 - protein, 19 aa, Homo sapiens
  heavy chain complementarity determining region 3 for antibody 21176
ARGSGSSRRRAAVVGYFDL

SEQ ID NO: 42353 - protein, 9 aa, Homo sapiens
  light chain complementarity determining region 3 for antibody 21177
QQYGSSPLT

SEQ ID NO: 42354 - protein, 13 aa, Homo sapiens
  heavy chain complementarity determining region 3 for antibody 21177
AHSQWLVLDVLDF

SEQ ID NO: 42355 - protein, 9 aa, Homo sapiens
  light chain complementarity determining region 3 for antibody 21178
QQYGSSPLT

SEQ ID NO: 42356 - protein, 19 aa, Homo sapiens
  heavy chain complementarity determining region 3 for antibody 21178
AGGSSSSRRRAAVVGYFDL

SEQ ID NO: 42357 - protein, 10 aa, Homo sapiens
  light chain complementarity determining region 3 for antibody 21179
QQYGSSPKYS

SEQ ID NO: 42358 - protein, 11 aa, Homo sapiens
  heavy chain complementarity determining region 3 for antibody 21179
ARGGQWGSLDY

SEQ ID NO: 42359 - protein, 10 aa, Homo sapiens
  light chain complementarity determining region 3 for antibody 21180
QQYGSSPIYR

SEQ ID NO: 42360 - protein, 11 aa, Homo sapiens
  heavy chain complementarity determining region 3 for antibody 21180
ARGGQWGSLDY

SEQ ID NO: 42361 - protein, 9 aa, Homo sapiens
  light chain complementarity determining region 3 for antibody 21181
QQYGSSPIT

SEQ ID NO: 42362 - protein, 19 aa, Homo sapiens
  heavy chain complementarity determining region 3 for antibody 21181
ARGSSSSRRRAAVVGYFDL

SEQ ID NO: 42363 - protein, 10 aa, Homo sapiens
  light chain complementarity determining region 3 for antibody 21182
QQYGSSPISS

SEQ ID NO: 42364 - protein, 11 aa, Homo sapiens
  heavy chain complementarity determining region 3 for antibody 21182
ARGGQWGSLDY

SEQ ID NO: 42365 - protein, 9 aa, Homo sapiens
  light chain complementarity determining region 3 for antibody 21183
QQYGSSPGT

SEQ ID NO: 42366 - protein, 11 aa, Homo sapiens
  heavy chain complementarity determining region 3 for antibody 21183
ARGGSSYAFDS

SEQ ID NO: 42367 - protein, 9 aa, Homo sapiens
  light chain complementarity determining region 3 for antibody 21184
QQYGSSPGT

SEQ ID NO: 42368 - protein, 15 aa, Homo sapiens
  heavy chain complementarity determining region 3 for antibody 21184
AREGGYCGGDCSFDY

SEQ ID NO: 42369 - protein, 9 aa, Homo sapiens
  light chain complementarity determining region 3 for antibody 21185
QQYGSSPGT

SEQ ID NO: 42370 - protein, 15 aa, Homo sapiens
  heavy chain complementarity determining region 3 for antibody 21185
AKTYDFWSGDDAFEI

SEQ ID NO: 42371 - protein, 9 aa, Homo sapiens
  light chain complementarity determining region 3 for antibody 21186
QQYGSSPDT

SEQ ID NO: 42372 - protein, 19 aa, Homo sapiens
  heavy chain complementarity determining region 3 for antibody 21186
ARGLAGYDSSGYLLYYFDY

SEQ ID NO: 42373 - protein, 9 aa, Homo sapiens
  light chain complementarity determining region 3 for antibody 21187
QQYGSSPAT

SEQ ID NO: 42374 - protein, 15 aa, Homo sapiens
  heavy chain complementarity determining region 3 for antibody 21187
AREGGYCGGDCSFDY

SEQ ID NO: 42375 - protein, 9 aa, Homo sapiens
  light chain complementarity determining region 3 for antibody 21188
QQYGSSLYT

SEQ ID NO: 42376 - protein, 24 aa, Homo sapiens
  heavy chain complementarity determining region 3 for antibody 21188
ERDRGVLLWFGELSPTAEDDAFDI

SEQ ID NO: 42377 - protein, 9 aa, Homo sapiens
  light chain complementarity determining region 3 for antibody 21189
QQYGSSLYT

SEQ ID NO: 42378 - protein, 24 aa, Homo sapiens
  heavy chain complementarity determining region 3 for antibody 21189
ARDRGVLLWFGELSPTAEDDAFDL

SEQ ID NO: 42379 - protein, 9 aa, Homo sapiens
  light chain complementarity determining region 3 for antibody 21190
QQYGSSLYT

SEQ ID NO: 42380 - protein, 16 aa, Homo sapiens
  heavy chain complementarity determining region 3 for antibody 21190
ARAKHYGNYYYYGMDA

SEQ ID NO: 42381 - protein, 9 aa, Homo sapiens
  light chain complementarity determining region 3 for antibody 21191
QQYGSSLYT

SEQ ID NO: 42382 - protein, 16 aa, Homo sapiens
  heavy chain complementarity determining region 3 for antibody 21191
ARAKHYGDYYYSGMDA

SEQ ID NO: 42383 - protein, 9 aa, Homo sapiens
  light chain complementarity determining region 3 for antibody 21192
QQYGSSLYT

SEQ ID NO: 42384 - protein, 15 aa, Homo sapiens
  heavy chain complementarity determining region 3 for antibody 21192
ARAKHYGDYYYGMDA

SEQ ID NO: 42385 - protein, 9 aa, Homo sapiens
  light chain complementarity determining region 3 for antibody 21193
QQYGSSLYT

SEQ ID NO: 42386 - protein, 16 aa, Homo sapiens
  heavy chain complementarity determining region 3 for antibody 21193
ARAKHYGDYDYYGMDA

SEQ ID NO: 42387 - protein, 9 aa, Homo sapiens
  light chain complementarity determining region 3 for antibody 21194
QQYGSSLYT

SEQ ID NO: 42388 - protein, 16 aa, Homo sapiens
  heavy chain complementarity determining region 3 for antibody 21194
ARAKHYGAYYYYGMDA

SEQ ID NO: 42389 - protein, 9 aa, Homo sapiens
  light chain complementarity determining region 3 for antibody 21195
QQYGSSLYT

SEQ ID NO: 42390 - protein, 16 aa, Homo sapiens
  heavy chain complementarity determining region 3 for antibody 21195
ARAKHCGDYYYYGMDA

SEQ ID NO: 42391 - protein, 10 aa, Homo sapiens
  light chain complementarity determining region 3 for antibody 21196
QQYGSSLVNT

SEQ ID NO: 42392 - protein, 15 aa, Homo sapiens
  heavy chain complementarity determining region 3 for antibody 21196
AREPLVAGSFGWFDP

SEQ ID NO: 42393 - protein, 8 aa, Homo sapiens
  light chain complementarity determining region 3 for antibody 21197
QQYGSSLT

SEQ ID NO: 42394 - protein, 12 aa, Homo sapiens
  heavy chain complementarity determining region 3 for antibody 21197
VKDCGLGGSRDF

SEQ ID NO: 42395 - protein, 9 aa, Homo sapiens
  light chain complementarity determining region 3 for antibody 21198
QQYGSSLST

SEQ ID NO: 42396 - protein, 24 aa, Homo sapiens
  heavy chain complementarity determining region 3 for antibody 21198
ARDRGVLLWFGELSPTAEDDAFDI

SEQ ID NO: 42397 - protein, 9 aa, Homo sapiens
  light chain complementarity determining region 3 for antibody 21199
QQYGSSLRT

SEQ ID NO: 42398 - protein, 25 aa, Homo sapiens
  heavy chain complementarity determining region 3 for antibody 21199
ARLRIDRLRLPGAMRGPLYDCGLNV

SEQ ID NO: 42399 - protein, 10 aa, Homo sapiens
  light chain complementarity determining region 3 for antibody 21200
QQYGSSLPVT

SEQ ID NO: 42400 - protein, 15 aa, Homo sapiens
  heavy chain complementarity determining region 3 for antibody 21200
AKGPMVRGVLGPFDY

SEQ ID NO: 42401 - protein, 9 aa, Homo sapiens
  light chain complementarity determining region 3 for antibody 21201
QQYGSSLNT

SEQ ID NO: 42402 - protein, 24 aa, Homo sapiens
  heavy chain complementarity determining region 3 for antibody 21201
ARDRGVLLWFGELSPTAEDDAFDI

SEQ ID NO: 42403 - protein, 10 aa, Homo sapiens
  light chain complementarity determining region 3 for antibody 21202
QQYGSSLGYT

SEQ ID NO: 42404 - protein, 15 aa, Homo sapiens
  heavy chain complementarity determining region 3 for antibody 21202
AREPLVAGSFGWFDP

SEQ ID NO: 42405 - protein, 10 aa, Homo sapiens
  light chain complementarity determining region 3 for antibody 21203
QQYGSSLGIT

SEQ ID NO: 42406 - protein, 18 aa, Homo sapiens
  heavy chain complementarity determining region 3 for antibody 21203
AKDWGAGWYGRRPYYFDY

SEQ ID NO: 42407 - protein, 9 aa, Homo sapiens
  light chain complementarity determining region 3 for antibody 21204
QQYGSSHFT

SEQ ID NO: 42408 - protein, 11 aa, Homo sapiens
  heavy chain complementarity determining region 3 for antibody 21204
AKGGLRWPLDY

SEQ ID NO: 42409 - protein, 9 aa, Homo sapiens
  light chain complementarity determining region 3 for antibody 21205
QQYGSSARP

SEQ ID NO: 42410 - protein, 13 aa, Homo sapiens
  heavy chain complementarity determining region 3 for antibody 21205
ARGYFYSDGYIED

SEQ ID NO: 42411 - protein, 10 aa, Homo sapiens
  light chain complementarity determining region 3 for antibody 21206
QQYGSSAMYS

SEQ ID NO: 42412 - protein, 11 aa, Homo sapiens
  heavy chain complementarity determining region 3 for antibody 21206
ARGGQWGSLDY

SEQ ID NO: 42413 - protein, 9 aa, Homo sapiens
  light chain complementarity determining region 3 for antibody 21207
QQYGSPSIT

SEQ ID NO: 42414 - protein, 13 aa, Homo sapiens
  heavy chain complementarity determining region 3 for antibody 21207
VKNFFMAFDAFHM

SEQ ID NO: 42415 - protein, 8 aa, Homo sapiens
  light chain complementarity determining region 3 for antibody 21208
QQYGSPPT

SEQ ID NO: 42416 - protein, 14 aa, Homo sapiens
  heavy chain complementarity determining region 3 for antibody 21208
ARLGGPDRGEKGGY

SEQ ID NO: 42417 - protein, 9 aa, Homo sapiens
  light chain complementarity determining region 3 for antibody 21209
QQYGSPPRK

SEQ ID NO: 42418 - protein, 14 aa, Homo sapiens
  heavy chain complementarity determining region 3 for antibody 21209
AGGNFCGYDCYSEY

SEQ ID NO: 42419 - protein, 9 aa, Homo sapiens
  light chain complementarity determining region 3 for antibody 21210
QQYGSPPPT

SEQ ID NO: 42420 - protein, 16 aa, Homo sapiens
  heavy chain complementarity determining region 3 for antibody 21210
ARGRTFRGNIYADLLY

SEQ ID NO: 42421 - protein, 9 aa, Homo sapiens
  light chain complementarity determining region 3 for antibody 21211
QQYGSPPLT

SEQ ID NO: 42422 - protein, 19 aa, Homo sapiens
  heavy chain complementarity determining region 3 for antibody 21211
ARGSSSSRRRAAVVGYFDL

SEQ ID NO: 42423 - protein, 9 aa, Homo sapiens
  light chain complementarity determining region 3 for antibody 21212
QQYGSPLYT

SEQ ID NO: 42424 - protein, 16 aa, Homo sapiens
  heavy chain complementarity determining region 3 for antibody 21212
ARAKHYGDYYYYGMDA

SEQ ID NO: 42425 - protein, 9 aa, Homo sapiens
  light chain complementarity determining region 3 for antibody 21213
QQYGSPLFT

SEQ ID NO: 42426 - protein, 13 aa, Homo sapiens
  heavy chain complementarity determining region 3 for antibody 21213
VMASRGYYSSFDY

SEQ ID NO: 42427 - protein, 8 aa, Homo sapiens
  light chain complementarity determining region 3 for antibody 21214
QQYGSPIT

SEQ ID NO: 42428 - protein, 12 aa, Homo sapiens
  heavy chain complementarity determining region 3 for antibody 21214
VKDCGLGGSRDF

SEQ ID NO: 42429 - protein, 9 aa, Homo sapiens
  light chain complementarity determining region 3 for antibody 21215
QQYGSPIFT

SEQ ID NO: 42430 - protein, 13 aa, Homo sapiens
  heavy chain complementarity determining region 3 for antibody 21215
VMASRGYSSSFDY

SEQ ID NO: 42431 - protein, 9 aa, Homo sapiens
  light chain complementarity determining region 3 for antibody 21216
QQYGSPIFT

SEQ ID NO: 42432 - protein, 13 aa, Homo sapiens
  heavy chain complementarity determining region 3 for antibody 21216
VMARRGYYSSFDY

SEQ ID NO: 42433 - protein, 9 aa, Homo sapiens
  light chain complementarity determining region 3 for antibody 21217
QQYGSPIFP

SEQ ID NO: 42434 - protein, 13 aa, Homo sapiens
  heavy chain complementarity determining region 3 for antibody 21217
VMASRGYYSSFDY

SEQ ID NO: 42435 - protein, 9 aa, Homo sapiens
  light chain complementarity determining region 3 for antibody 21218
QQYGSLPRT

SEQ ID NO: 42436 - protein, 13 aa, Homo sapiens
  heavy chain complementarity determining region 3 for antibody 21218
AGGIFDSSGYGDY

SEQ ID NO: 42437 - protein, 9 aa, Homo sapiens
  light chain complementarity determining region 3 for antibody 21219
QQYGSLPRT

SEQ ID NO: 42438 - protein, 14 aa, Homo sapiens
  heavy chain complementarity determining region 3 for antibody 21219
AGGEFSSGWHYSEH

SEQ ID NO: 42439 - protein, 9 aa, Homo sapiens
  light chain complementarity determining region 3 for antibody 21220
QQYGSLPRP

SEQ ID NO: 42440 - protein, 13 aa, Homo sapiens
  heavy chain complementarity determining region 3 for antibody 21220
ARGQFERSGYKEN

SEQ ID NO: 42441 - protein, 9 aa, Homo sapiens
  light chain complementarity determining region 3 for antibody 21221
QQYGSLPRP

SEQ ID NO: 42442 - protein, 13 aa, Homo sapiens
  heavy chain complementarity determining region 3 for antibody 21221
AGGGFSSGRYSEY

SEQ ID NO: 42443 - protein, 9 aa, Homo sapiens
  light chain complementarity determining region 3 for antibody 21222
QQYGSLPRP

SEQ ID NO: 42444 - protein, 14 aa, Homo sapiens
  heavy chain complementarity determining region 3 for antibody 21222
AGGEFSSGWHYSEN

SEQ ID NO: 42445 - protein, 10 aa, Homo sapiens
  light chain complementarity determining region 3 for antibody 21223
QQYGSLPPVT

SEQ ID NO: 42446 - protein, 15 aa, Homo sapiens
  heavy chain complementarity determining region 3 for antibody 21223
AKGPMVRGVLGPFDY

SEQ ID NO: 42447 - protein, 9 aa, Homo sapiens
  light chain complementarity determining region 3 for antibody 21224
QQYGSLPPT

SEQ ID NO: 42448 - protein, 15 aa, Homo sapiens
  heavy chain complementarity determining region 3 for antibody 21224
AHRPNYYDKAGAFDI

SEQ ID NO: 42449 - protein, 9 aa, Homo sapiens
  light chain complementarity determining region 3 for antibody 21225
QQYGSLPLT

SEQ ID NO: 42450 - protein, 15 aa, Homo sapiens
  heavy chain complementarity determining region 3 for antibody 21225
ARRPNYYDKAGAFDI

SEQ ID NO: 42451 - protein, 9 aa, Homo sapiens
  light chain complementarity determining region 3 for antibody 21226
QQYGSLPLP

SEQ ID NO: 42452 - protein, 7 aa, Homo sapiens
  heavy chain complementarity determining region 3 for antibody 21226
HGYELKC

SEQ ID NO: 42453 - protein, 9 aa, Homo sapiens
  light chain complementarity determining region 3 for antibody 21227
QQYGSLPHT

SEQ ID NO: 42454 - protein, 14 aa, Homo sapiens
  heavy chain complementarity determining region 3 for antibody 21227
ARGGGSDGYGLLYY

SEQ ID NO: 42455 - protein, 9 aa, Homo sapiens
  light chain complementarity determining region 3 for antibody 21228
QQYGSLPHP

SEQ ID NO: 42456 - protein, 14 aa, Homo sapiens
  heavy chain complementarity determining region 3 for antibody 21228
ARGGGSDWYGLLYY

SEQ ID NO: 42457 - protein, 9 aa, Homo sapiens
  light chain complementarity determining region 3 for antibody 21229
QQYGSLPDT

SEQ ID NO: 42458 - protein, 15 aa, Homo sapiens
  heavy chain complementarity determining region 3 for antibody 21229
AREGGYCGGDCSFDY

SEQ ID NO: 42459 - protein, 9 aa, Homo sapiens
  light chain complementarity determining region 3 for antibody 21230
QQYGSLPDT

SEQ ID NO: 42460 - protein, 29 aa, Homo sapiens
  heavy chain complementarity determining region 3 for antibody 21230
AKSGRLRDLWFGDFRRPNYFDNTGYYLDY

SEQ ID NO: 42461 - protein, 9 aa, Homo sapiens
  light chain complementarity determining region 3 for antibody 21231
QQYGSKPRT

SEQ ID NO: 42462 - protein, 13 aa, Homo sapiens
  heavy chain complementarity determining region 3 for antibody 21231
AGGSFSGGNYKED

SEQ ID NO: 42463 - protein, 9 aa, Homo sapiens
  light chain complementarity determining region 3 for antibody 21232
QQYGSKPRT

SEQ ID NO: 42464 - protein, 13 aa, Homo sapiens
  heavy chain complementarity determining region 3 for antibody 21232
AGGGFSSGRYSEY

SEQ ID NO: 42465 - protein, 9 aa, Homo sapiens
  light chain complementarity determining region 3 for antibody 21233
QQYGSKPRT

SEQ ID NO: 42466 - protein, 14 aa, Homo sapiens
  heavy chain complementarity determining region 3 for antibody 21233
AGGEFSSGWHYSEN

SEQ ID NO: 42467 - protein, 9 aa, Homo sapiens
  light chain complementarity determining region 3 for antibody 21234
QQYGSKPRP

SEQ ID NO: 42468 - protein, 13 aa, Homo sapiens
  heavy chain complementarity determining region 3 for antibody 21234
AGGGFSSGRYSEY

SEQ ID NO: 42469 - protein, 9 aa, Homo sapiens
  light chain complementarity determining region 3 for antibody 21235
QQYGSITRT

SEQ ID NO: 42470 - protein, 13 aa, Homo sapiens
  heavy chain complementarity determining region 3 for antibody 21235
ALGHYHTTGYSEF

SEQ ID NO: 42471 - protein, 9 aa, Homo sapiens
  light chain complementarity determining region 3 for antibody 21236
QQYGSIPWT

SEQ ID NO: 42472 - protein, 13 aa, Homo sapiens
  heavy chain complementarity determining region 3 for antibody 21236
AGGIFDSSGYGEY

SEQ ID NO: 42473 - protein, 9 aa, Homo sapiens
  light chain complementarity determining region 3 for antibody 21237
QQYGSIPST

SEQ ID NO: 42474 - protein, 7 aa, Homo sapiens
  heavy chain complementarity determining region 3 for antibody 21237
HGYELKC

SEQ ID NO: 42475 - protein, 9 aa, Homo sapiens
  light chain complementarity determining region 3 for antibody 21238
QQYGSIPST

SEQ ID NO: 42476 - protein, 14 aa, Homo sapiens
  heavy chain complementarity determining region 3 for antibody 21238
AGGEFSSGWHYSDN

SEQ ID NO: 42477 - protein, 9 aa, Homo sapiens
  light chain complementarity determining region 3 for antibody 21239
QQYGSIPRT

SEQ ID NO: 42478 - protein, 14 aa, Homo sapiens
  heavy chain complementarity determining region 3 for antibody 21239
VRDASGNSGWYADS

SEQ ID NO: 42479 - protein, 9 aa, Homo sapiens
  light chain complementarity determining region 3 for antibody 21240
QQYGSIPRT

SEQ ID NO: 42480 - protein, 13 aa, Homo sapiens
  heavy chain complementarity determining region 3 for antibody 21240
ALGRYHTTGYSEF

SEQ ID NO: 42481 - protein, 9 aa, Homo sapiens
  light chain complementarity determining region 3 for antibody 21241
QQYGSIPRT

SEQ ID NO: 42482 - protein, 13 aa, Homo sapiens
  heavy chain complementarity determining region 3 for antibody 21241
ALGHYHTTGSSEF

SEQ ID NO: 42483 - protein, 9 aa, Homo sapiens
  light chain complementarity determining region 3 for antibody 21242
QQYGSIPRT

SEQ ID NO: 42484 - protein, 13 aa, Homo sapiens
  heavy chain complementarity determining region 3 for antibody 21242
AGGSFSGRNYKED

SEQ ID NO: 42485 - protein, 9 aa, Homo sapiens
  light chain complementarity determining region 3 for antibody 21243
QQYGSIPRT

SEQ ID NO: 42486 - protein, 13 aa, Homo sapiens
  heavy chain complementarity determining region 3 for antibody 21243
AGGSFSGGNYKEH

SEQ ID NO: 42487 - protein, 9 aa, Homo sapiens
  light chain complementarity determining region 3 for antibody 21244
QQYGSIPRT

SEQ ID NO: 42488 - protein, 13 aa, Homo sapiens
  heavy chain complementarity determining region 3 for antibody 21244
AGGSFSGGHYKED

SEQ ID NO: 42489 - protein, 9 aa, Homo sapiens
  light chain complementarity determining region 3 for antibody 21245
QQYGSIPRT

SEQ ID NO: 42490 - protein, 13 aa, Homo sapiens
  heavy chain complementarity determining region 3 for antibody 21245
AGGSFRGGNYKED

SEQ ID NO: 42491 - protein, 9 aa, Homo sapiens
  light chain complementarity determining region 3 for antibody 21246
QQYGSIPRT

SEQ ID NO: 42492 - protein, 13 aa, Homo sapiens
  heavy chain complementarity determining region 3 for antibody 21246
AGGSCSGGNYKED

SEQ ID NO: 42493 - protein, 9 aa, Homo sapiens
  light chain complementarity determining region 3 for antibody 21247
QQYGSIPRT

SEQ ID NO: 42494 - protein, 13 aa, Homo sapiens
  heavy chain complementarity determining region 3 for antibody 21247
AGGRFHSSGYSEF

SEQ ID NO: 42495 - protein, 9 aa, Homo sapiens
  light chain complementarity determining region 3 for antibody 21248
QQYGSIPRT

SEQ ID NO: 42496 - protein, 13 aa, Homo sapiens
  heavy chain complementarity determining region 3 for antibody 21248
AGGLFHSSGCSEF

SEQ ID NO: 42497 - protein, 9 aa, Homo sapiens
  light chain complementarity determining region 3 for antibody 21249
QQYGSIPRT

SEQ ID NO: 42498 - protein, 13 aa, Homo sapiens
  heavy chain complementarity determining region 3 for antibody 21249
AGGLFHAMGYSDY

SEQ ID NO: 42499 - protein, 9 aa, Homo sapiens
  light chain complementarity determining region 3 for antibody 21250
QQYGSIPRT

SEQ ID NO: 42500 - protein, 13 aa, Homo sapiens
  heavy chain complementarity determining region 3 for antibody 21250
AGGLFDSSGYSEF

SEQ ID NO: 42501 - protein, 9 aa, Homo sapiens
  light chain complementarity determining region 3 for antibody 21251
QQYGSIPRT

SEQ ID NO: 42502 - protein, 13 aa, Homo sapiens
  heavy chain complementarity determining region 3 for antibody 21251
AGGIVDSSGYGEY

SEQ ID NO: 42503 - protein, 9 aa, Homo sapiens
  light chain complementarity determining region 3 for antibody 21252
QQYGSIPRT

SEQ ID NO: 42504 - protein, 13 aa, Homo sapiens
  heavy chain complementarity determining region 3 for antibody 21252
AGGGVSSGRYSEY

SEQ ID NO: 42505 - protein, 9 aa, Homo sapiens
  light chain complementarity determining region 3 for antibody 21253
QQYGSIPRT

SEQ ID NO: 42506 - protein, 13 aa, Homo sapiens
  heavy chain complementarity determining region 3 for antibody 21253
AGGGFSSGRSSEY

SEQ ID NO: 42507 - protein, 9 aa, Homo sapiens
  light chain complementarity determining region 3 for antibody 21254
QQYGSIPRT

SEQ ID NO: 42508 - protein, 13 aa, Homo sapiens
  heavy chain complementarity determining region 3 for antibody 21254
AGGGFSRGRYSEY

SEQ ID NO: 42509 - protein, 9 aa, Homo sapiens
  light chain complementarity determining region 3 for antibody 21255
QQYGSIPRT

SEQ ID NO: 42510 - protein, 13 aa, Homo sapiens
  heavy chain complementarity determining region 3 for antibody 21255
AGGGFRSGRYSEY

SEQ ID NO: 42511 - protein, 9 aa, Homo sapiens
  light chain complementarity determining region 3 for antibody 21256
QQYGSIPRT

SEQ ID NO: 42512 - protein, 14 aa, Homo sapiens
  heavy chain complementarity determining region 3 for antibody 21256
AGGEVSSGWRYSEN

SEQ ID NO: 42513 - protein, 9 aa, Homo sapiens
  light chain complementarity determining region 3 for antibody 21257
QQYGSIPRT

SEQ ID NO: 42514 - protein, 14 aa, Homo sapiens
  heavy chain complementarity determining region 3 for antibody 21257
AGGELSSGWHYSEN

SEQ ID NO: 42515 - protein, 9 aa, Homo sapiens
  light chain complementarity determining region 3 for antibody 21258
QQYGSIPRT

SEQ ID NO: 42516 - protein, 14 aa, Homo sapiens
  heavy chain complementarity determining region 3 for antibody 21258
AGGEFSSGWHYAEN

SEQ ID NO: 42517 - protein, 9 aa, Homo sapiens
  light chain complementarity determining region 3 for antibody 21259
QQYGSIPRT

SEQ ID NO: 42518 - protein, 14 aa, Homo sapiens
  heavy chain complementarity determining region 3 for antibody 21259
AGGDLCGSDCYSEY

SEQ ID NO: 42519 - protein, 9 aa, Homo sapiens
  light chain complementarity determining region 3 for antibody 21260
QQYGSIPRT

SEQ ID NO: 42520 - protein, 14 aa, Homo sapiens
  heavy chain complementarity determining region 3 for antibody 21260
AGGDLCGRDCYSEY

SEQ ID NO: 42521 - protein, 9 aa, Homo sapiens
  light chain complementarity determining region 3 for antibody 21261
QQYGSIPRT

SEQ ID NO: 42522 - protein, 14 aa, Homo sapiens
  heavy chain complementarity determining region 3 for antibody 21261
AGGDFCGSDCYSDY

SEQ ID NO: 42523 - protein, 9 aa, Homo sapiens
  light chain complementarity determining region 3 for antibody 21262
QQYGSIPRT

SEQ ID NO: 42524 - protein, 14 aa, Homo sapiens
  heavy chain complementarity determining region 3 for antibody 21262
AGGDFCGRDCYSDY

SEQ ID NO: 42525 - protein, 9 aa, Homo sapiens
  light chain complementarity determining region 3 for antibody 21263
QQYGSIPRT

SEQ ID NO: 42526 - protein, 13 aa, Homo sapiens
  heavy chain complementarity determining region 3 for antibody 21263
AGCSFSGGNYKED

SEQ ID NO: 42527 - protein, 9 aa, Homo sapiens
  light chain complementarity determining region 3 for antibody 21264
QQYGSIPRS

SEQ ID NO: 42528 - protein, 13 aa, Homo sapiens
  heavy chain complementarity determining region 3 for antibody 21264
AGGAWHSGIYYES

SEQ ID NO: 42529 - protein, 9 aa, Homo sapiens
  light chain complementarity determining region 3 for antibody 21265
QQYGSIPRR

SEQ ID NO: 42530 - protein, 13 aa, Homo sapiens
  heavy chain complementarity determining region 3 for antibody 21265
AGGSFSGGNYKED

SEQ ID NO: 42531 - protein, 9 aa, Homo sapiens
  light chain complementarity determining region 3 for antibody 21266
QQYGSIPRP

SEQ ID NO: 42532 - protein, 14 aa, Homo sapiens
  heavy chain complementarity determining region 3 for antibody 21266
AGGEYCGGNCYSEY

SEQ ID NO: 42533 - protein, 9 aa, Homo sapiens
  light chain complementarity determining region 3 for antibody 21267
QQYGSIPRP

SEQ ID NO: 42534 - protein, 14 aa, Homo sapiens
  heavy chain complementarity determining region 3 for antibody 21267
AGGDFCGRDCYSEY

SEQ ID NO: 42535 - protein, 9 aa, Homo sapiens
  light chain complementarity determining region 3 for antibody 21268
QQYGSIPRA

SEQ ID NO: 42536 - protein, 13 aa, Homo sapiens
  heavy chain complementarity determining region 3 for antibody 21268
AGGTWHSGIYYES

SEQ ID NO: 42537 - protein, 9 aa, Homo sapiens
  light chain complementarity determining region 3 for antibody 21269
QQYGSIPPT

SEQ ID NO: 42538 - protein, 7 aa, Homo sapiens
  heavy chain complementarity determining region 3 for antibody 21269
HGYELNC

SEQ ID NO: 42539 - protein, 9 aa, Homo sapiens
  light chain complementarity determining region 3 for antibody 21270
QQYGSIPMT

SEQ ID NO: 42540 - protein, 13 aa, Homo sapiens
  heavy chain complementarity determining region 3 for antibody 21270
AGGIFDSSGYGEY

SEQ ID NO: 42541 - protein, 9 aa, Homo sapiens
  light chain complementarity determining region 3 for antibody 21271
QQYGSIPLT

SEQ ID NO: 42542 - protein, 7 aa, Homo sapiens
  heavy chain complementarity determining region 3 for antibody 21271
HGYELKS

SEQ ID NO: 42543 - protein, 9 aa, Homo sapiens
  light chain complementarity determining region 3 for antibody 21272
QQYGSIPLT

SEQ ID NO: 42544 - protein, 7 aa, Homo sapiens
  heavy chain complementarity determining region 3 for antibody 21272
HGYALKC

SEQ ID NO: 42545 - protein, 9 aa, Homo sapiens
  light chain complementarity determining region 3 for antibody 21273
QQYGSIPLT

SEQ ID NO: 42546 - protein, 13 aa, Homo sapiens
  heavy chain complementarity determining region 3 for antibody 21273
AGGGFSSGRYSEY

SEQ ID NO: 42547 - protein, 9 aa, Homo sapiens
  light chain complementarity determining region 3 for antibody 21274
QQYGSIPHT

SEQ ID NO: 42548 - protein, 13 aa, Homo sapiens
  heavy chain complementarity determining region 3 for antibody 21274
AGGGFSSGRYSEY

SEQ ID NO: 42549 - protein, 9 aa, Homo sapiens
  light chain complementarity determining region 3 for antibody 21275
QQYGSIPGT

SEQ ID NO: 42550 - protein, 14 aa, Homo sapiens
  heavy chain complementarity determining region 3 for antibody 21275
AGGEFSSGWHYSEN

SEQ ID NO: 42551 - protein, 9 aa, Homo sapiens
  light chain complementarity determining region 3 for antibody 21276
QQYGSILRT

SEQ ID NO: 42552 - protein, 13 aa, Homo sapiens
  heavy chain complementarity determining region 3 for antibody 21276
AGGGFSSGRYSEY

SEQ ID NO: 42553 - protein, 9 aa, Homo sapiens
  light chain complementarity determining region 3 for antibody 21277
QQYGSILRT

SEQ ID NO: 42554 - protein, 14 aa, Homo sapiens
  heavy chain complementarity determining region 3 for antibody 21277
AGGEFSSGWHYSEN

SEQ ID NO: 42555 - protein, 9 aa, Homo sapiens
  light chain complementarity determining region 3 for antibody 21278
QQYGSFPYT

SEQ ID NO: 42556 - protein, 14 aa, Homo sapiens
  heavy chain complementarity determining region 3 for antibody 21278
ARGGVIVAWGLFDY

SEQ ID NO: 42557 - protein, 9 aa, Homo sapiens
  light chain complementarity determining region 3 for antibody 21279
QQYGSFPYT

SEQ ID NO: 42558 - protein, 14 aa, Homo sapiens
  heavy chain complementarity determining region 3 for antibody 21279
ARGGFIVAWCLFDY

SEQ ID NO: 42559 - protein, 9 aa, Homo sapiens
  light chain complementarity determining region 3 for antibody 21280
QQYGSFPYP

SEQ ID NO: 42560 - protein, 14 aa, Homo sapiens
  heavy chain complementarity determining region 3 for antibody 21280
TRGGFIVAWGLFDY

SEQ ID NO: 42561 - protein, 9 aa, Homo sapiens
  light chain complementarity determining region 3 for antibody 21281
QQYGSFPDT

SEQ ID NO: 42562 - protein, 14 aa, Homo sapiens
  heavy chain complementarity determining region 3 for antibody 21281
TRGGFIVAWGLFDY

SEQ ID NO: 42563 - protein, 9 aa, Homo sapiens
  light chain complementarity determining region 3 for antibody 21282
QQYGSAPDT

SEQ ID NO: 42564 - protein, 15 aa, Homo sapiens
  heavy chain complementarity determining region 3 for antibody 21282
AREGGYCGGDCSFDY

SEQ ID NO: 42565 - protein, 9 aa, Homo sapiens
  light chain complementarity determining region 3 for antibody 21283
QQYGRWPWT

SEQ ID NO: 42566 - protein, 11 aa, Homo sapiens
  heavy chain complementarity determining region 3 for antibody 21283
ARDRYLGRVGY

SEQ ID NO: 42567 - protein, 9 aa, Homo sapiens
  light chain complementarity determining region 3 for antibody 21284
QQYGRSSIT

SEQ ID NO: 42568 - protein, 13 aa, Homo sapiens
  heavy chain complementarity determining region 3 for antibody 21284
VKNFFMAFDAFHM

SEQ ID NO: 42569 - protein, 9 aa, Homo sapiens
  light chain complementarity determining region 3 for antibody 21285
QQYGRSPYT

SEQ ID NO: 42570 - protein, 18 aa, Homo sapiens
  heavy chain complementarity determining region 3 for antibody 21285
ARPMVRSLDEYNYYGLDV

SEQ ID NO: 42571 - protein, 9 aa, Homo sapiens
  light chain complementarity determining region 3 for antibody 21286
QQYGRSPYT

SEQ ID NO: 42572 - protein, 18 aa, Homo sapiens
  heavy chain complementarity determining region 3 for antibody 21286
ARPMVRAMDEYNYYGLDV

SEQ ID NO: 42573 - protein, 9 aa, Homo sapiens
  light chain complementarity determining region 3 for antibody 21287
QQYGRSPYT

SEQ ID NO: 42574 - protein, 18 aa, Homo sapiens
  heavy chain complementarity determining region 3 for antibody 21287
ARPMVRALDEYNYSGLDV

SEQ ID NO: 42575 - protein, 9 aa, Homo sapiens
  light chain complementarity determining region 3 for antibody 21288
QQYGRSPYT

SEQ ID NO: 42576 - protein, 18 aa, Homo sapiens
  heavy chain complementarity determining region 3 for antibody 21288
ARPMVRALDEYNDYGLDV

SEQ ID NO: 42577 - protein, 9 aa, Homo sapiens
  light chain complementarity determining region 3 for antibody 21289
QQYGRSPYT

SEQ ID NO: 42578 - protein, 18 aa, Homo sapiens
  heavy chain complementarity determining region 3 for antibody 21289
ARPMVRALDEYHYYGLDV

SEQ ID NO: 42579 - protein, 9 aa, Homo sapiens
  light chain complementarity determining region 3 for antibody 21290
QQYGRSPYT

SEQ ID NO: 42580 - protein, 18 aa, Homo sapiens
  heavy chain complementarity determining region 3 for antibody 21290
ARPIVRALDEYNYYGLDV

SEQ ID NO: 42581 - protein, 9 aa, Homo sapiens
  light chain complementarity determining region 3 for antibody 21291
QQYGRSPYT

SEQ ID NO: 42582 - protein, 18 aa, Homo sapiens
  heavy chain complementarity determining region 3 for antibody 21291
ARHMVRALDEYNYYGLDV

SEQ ID NO: 42583 - protein, 9 aa, Homo sapiens
  light chain complementarity determining region 3 for antibody 21292
QQYGRSPYT

SEQ ID NO: 42584 - protein, 18 aa, Homo sapiens
  heavy chain complementarity determining region 3 for antibody 21292
AGPMVRALDEYNYYGLDV

SEQ ID NO: 42585 - protein, 9 aa, Homo sapiens
  light chain complementarity determining region 3 for antibody 21293
QQYGRSPYI

SEQ ID NO: 42586 - protein, 18 aa, Homo sapiens
  heavy chain complementarity determining region 3 for antibody 21293
ARPMVRALDEYNYYGLDV

SEQ ID NO: 42587 - protein, 8 aa, Homo sapiens
  light chain complementarity determining region 3 for antibody 21294
QQYGRSPT

SEQ ID NO: 42588 - protein, 17 aa, Homo sapiens
  heavy chain complementarity determining region 3 for antibody 21294
ASIYDSTGYYYGGYFQH

SEQ ID NO: 42589 - protein, 9 aa, Homo sapiens
  light chain complementarity determining region 3 for antibody 21295
QQYGRSPQT

SEQ ID NO: 42590 - protein, 11 aa, Homo sapiens
  heavy chain complementarity determining region 3 for antibody 21295
ARGWIERCGDF

SEQ ID NO: 42591 - protein, 9 aa, Homo sapiens
  light chain complementarity determining region 3 for antibody 21296
QQYGRSPQK

SEQ ID NO: 42592 - protein, 11 aa, Homo sapiens
  heavy chain complementarity determining region 3 for antibody 21296
ARGWIELWGDF

SEQ ID NO: 42593 - protein, 11 aa, Homo sapiens
  light chain complementarity determining region 3 for antibody 21297
QQYGRSPPGYN

SEQ ID NO: 42594 - protein, 12 aa, Homo sapiens
  heavy chain complementarity determining region 3 for antibody 21297
AREWPETCYFDY

SEQ ID NO: 42595 - protein, 11 aa, Homo sapiens
  light chain complementarity determining region 3 for antibody 21298
QQYGRSPPGST

SEQ ID NO: 42596 - protein, 12 aa, Homo sapiens
  heavy chain complementarity determining region 3 for antibody 21298
AREWPETCYFDY

SEQ ID NO: 42597 - protein, 11 aa, Homo sapiens
  light chain complementarity determining region 3 for antibody 21299
QQYGRSPPGDT

SEQ ID NO: 42598 - protein, 12 aa, Homo sapiens
  heavy chain complementarity determining region 3 for antibody 21299
AREWPETCYFDY

SEQ ID NO: 42599 - protein, 9 aa, Homo sapiens
  light chain complementarity determining region 3 for antibody 21300
QQYGRSPNT

SEQ ID NO: 42600 - protein, 18 aa, Homo sapiens
  heavy chain complementarity determining region 3 for antibody 21300
ARPMVRALDEYNYYGLDV

SEQ ID NO: 42601 - protein, 9 aa, Homo sapiens
  light chain complementarity determining region 3 for antibody 21301
QQYGRSPNT

SEQ ID NO: 42602 - protein, 29 aa, Homo sapiens
  heavy chain complementarity determining region 3 for antibody 21301
AKSGRLRDLWFGDFRRPNYFDNTGYYLDY

SEQ ID NO: 42603 - protein, 10 aa, Homo sapiens
  light chain complementarity determining region 3 for antibody 21302
QQYGRSPMDS

SEQ ID NO: 42604 - protein, 11 aa, Homo sapiens
  heavy chain complementarity determining region 3 for antibody 21302
ARGGQWGSLDY

SEQ ID NO: 42605 - protein, 9 aa, Homo sapiens
  light chain complementarity determining region 3 for antibody 21303
QQYGRSPFT

SEQ ID NO: 42606 - protein, 19 aa, Homo sapiens
  heavy chain complementarity determining region 3 for antibody 21303
ARDGPRGRVTGVTWNPLDY

SEQ ID NO: 42607 - protein, 9 aa, Homo sapiens
  light chain complementarity determining region 3 for antibody 21304
QQYGRSPFS

SEQ ID NO: 42608 - protein, 13 aa, Homo sapiens
  heavy chain complementarity determining region 3 for antibody 21304
ARGQQYSGRIFDY

SEQ ID NO: 42609 - protein, 8 aa, Homo sapiens
  light chain complementarity determining region 3 for antibody 21305
QQYGRSLT

SEQ ID NO: 42610 - protein, 17 aa, Homo sapiens
  heavy chain complementarity determining region 3 for antibody 21305
ASIYDSTGYYYGGYFHH

SEQ ID NO: 42611 - protein, 8 aa, Homo sapiens
  light chain complementarity determining region 3 for antibody 21306
QQYGRSLT

SEQ ID NO: 42612 - protein, 17 aa, Homo sapiens
  heavy chain complementarity determining region 3 for antibody 21306
ASIYDSTGYYYGGSFQH

SEQ ID NO: 42613 - protein, 8 aa, Homo sapiens
  light chain complementarity determining region 3 for antibody 21307
QQYGRSLT

SEQ ID NO: 42614 - protein, 17 aa, Homo sapiens
  heavy chain complementarity determining region 3 for antibody 21307
ASISDSTGYYYCGYFQH

SEQ ID NO: 42615 - protein, 8 aa, Homo sapiens
  light chain complementarity determining region 3 for antibody 21308
QQYGRSFT

SEQ ID NO: 42616 - protein, 17 aa, Homo sapiens
  heavy chain complementarity determining region 3 for antibody 21308
ASIYDSTGYYYGGYFQH

SEQ ID NO: 42617 - protein, 9 aa, Homo sapiens
  light chain complementarity determining region 3 for antibody 21309
QQYGRRPRT

SEQ ID NO: 42618 - protein, 13 aa, Homo sapiens
  heavy chain complementarity determining region 3 for antibody 21309
AGGLFGSGTYSEF

SEQ ID NO: 42619 - protein, 9 aa, Homo sapiens
  light chain complementarity determining region 3 for antibody 21310
QQYGRPPYT

SEQ ID NO: 42620 - protein, 18 aa, Homo sapiens
  heavy chain complementarity determining region 3 for antibody 21310
ARPMVRALDEYNYYGLDV

SEQ ID NO: 42621 - protein, 9 aa, Homo sapiens
  light chain complementarity determining region 3 for antibody 21311
QQYGRMPRS

SEQ ID NO: 42622 - protein, 13 aa, Homo sapiens
  heavy chain complementarity determining region 3 for antibody 21311
AGGTWHSSAYYES

SEQ ID NO: 42623 - protein, 9 aa, Homo sapiens
  light chain complementarity determining region 3 for antibody 21312
QQYGRLPRT

SEQ ID NO: 42624 - protein, 13 aa, Homo sapiens
  heavy chain complementarity determining region 3 for antibody 21312
AGGLYDSSGYSDF

SEQ ID NO: 42625 - protein, 9 aa, Homo sapiens
  light chain complementarity determining region 3 for antibody 21313
QQYGRLPRT

SEQ ID NO: 42626 - protein, 14 aa, Homo sapiens
  heavy chain complementarity determining region 3 for antibody 21313
AGGEYCGGNCYSEY

SEQ ID NO: 42627 - protein, 9 aa, Homo sapiens
  light chain complementarity determining region 3 for antibody 21314
QQYGRKPRT

SEQ ID NO: 42628 - protein, 13 aa, Homo sapiens
  heavy chain complementarity determining region 3 for antibody 21314
AGGLYDSSGYSEF

SEQ ID NO: 42629 - protein, 9 aa, Homo sapiens
  light chain complementarity determining region 3 for antibody 21315
QQYGRITRT

SEQ ID NO: 42630 - protein, 13 aa, Homo sapiens
  heavy chain complementarity determining region 3 for antibody 21315
AGGLFGSGTYSEF

SEQ ID NO: 42631 - protein, 9 aa, Homo sapiens
  light chain complementarity determining region 3 for antibody 21316
QQYGRIPWT

SEQ ID NO: 42632 - protein, 13 aa, Homo sapiens
  heavy chain complementarity determining region 3 for antibody 21316
AGGLYDSSGYSEF

SEQ ID NO: 42633 - protein, 9 aa, Homo sapiens
  light chain complementarity determining region 3 for antibody 21317
QQYGRIPRT

SEQ ID NO: 42634 - protein, 13 aa, Homo sapiens
  heavy chain complementarity determining region 3 for antibody 21317
AGGLVGSGTYSEF

SEQ ID NO: 42635 - protein, 9 aa, Homo sapiens
  light chain complementarity determining region 3 for antibody 21318
QQYGRIPRT

SEQ ID NO: 42636 - protein, 13 aa, Homo sapiens
  heavy chain complementarity determining region 3 for antibody 21318
AGGLSGSGTYSVF

SEQ ID NO: 42637 - protein, 9 aa, Homo sapiens
  light chain complementarity determining region 3 for antibody 21319
QQYGRIPRT

SEQ ID NO: 42638 - protein, 13 aa, Homo sapiens
  heavy chain complementarity determining region 3 for antibody 21319
AGGLFGSGSYSEF

SEQ ID NO: 42639 - protein, 9 aa, Homo sapiens
  light chain complementarity determining region 3 for antibody 21320
QQYGRIPRT

SEQ ID NO: 42640 - protein, 13 aa, Homo sapiens
  heavy chain complementarity determining region 3 for antibody 21320
AGGLFGAGTYSEF

SEQ ID NO: 42641 - protein, 9 aa, Homo sapiens
  light chain complementarity determining region 3 for antibody 21321
QQYGRIPRT

SEQ ID NO: 42642 - protein, 13 aa, Homo sapiens
  heavy chain complementarity determining region 3 for antibody 21321
AGGGFSSGRYSDY

SEQ ID NO: 42643 - protein, 9 aa, Homo sapiens
  light chain complementarity determining region 3 for antibody 21322
QQYGRIPRT

SEQ ID NO: 42644 - protein, 14 aa, Homo sapiens
  heavy chain complementarity determining region 3 for antibody 21322
AGGEFSSGWHYSEH

SEQ ID NO: 42645 - protein, 9 aa, Homo sapiens
  light chain complementarity determining region 3 for antibody 21323
QQYGRIPRT

SEQ ID NO: 42646 - protein, 14 aa, Homo sapiens
  heavy chain complementarity determining region 3 for antibody 21323
AGGEFCGGDCYSEY

SEQ ID NO: 42647 - protein, 9 aa, Homo sapiens
  light chain complementarity determining region 3 for antibody 21324
QQYGRIPRR

SEQ ID NO: 42648 - protein, 13 aa, Homo sapiens
  heavy chain complementarity determining region 3 for antibody 21324
AGGLFGSGTYSEF

SEQ ID NO: 42649 - protein, 9 aa, Homo sapiens
  light chain complementarity determining region 3 for antibody 21325
QQYGRIPRP

SEQ ID NO: 42650 - protein, 13 aa, Homo sapiens
  heavy chain complementarity determining region 3 for antibody 21325
AGGLFGSGTYSEF

SEQ ID NO: 42651 - protein, 9 aa, Homo sapiens
  light chain complementarity determining region 3 for antibody 21326
QQYGRIPRP

SEQ ID NO: 42652 - protein, 13 aa, Homo sapiens
  heavy chain complementarity determining region 3 for antibody 21326
AGGGFSSGRYSEY

SEQ ID NO: 42653 - protein, 9 aa, Homo sapiens
  light chain complementarity determining region 3 for antibody 21327
QQYGRIPRK

SEQ ID NO: 42654 - protein, 13 aa, Homo sapiens
  heavy chain complementarity determining region 3 for antibody 21327
AGGLYDSSGYSEF

SEQ ID NO: 42655 - protein, 9 aa, Homo sapiens
  light chain complementarity determining region 3 for antibody 21328
QQYGRIPRA

SEQ ID NO: 42656 - protein, 13 aa, Homo sapiens
  heavy chain complementarity determining region 3 for antibody 21328
AGGTWHSSAYYDS

SEQ ID NO: 42657 - protein, 9 aa, Homo sapiens
  light chain complementarity determining region 3 for antibody 21329
QQYGRIHRT

SEQ ID NO: 42658 - protein, 13 aa, Homo sapiens
  heavy chain complementarity determining region 3 for antibody 21329
AGGLYDSSGYSEF

SEQ ID NO: 42659 - protein, 9 aa, Homo sapiens
  light chain complementarity determining region 3 for antibody 21330
QQYGPSSVT

SEQ ID NO: 42660 - protein, 25 aa, Homo sapiens
  heavy chain complementarity determining region 3 for antibody 21330
ARGLRARRDLRYFDRLLIPHDALDI

SEQ ID NO: 42661 - protein, 8 aa, Homo sapiens
  light chain complementarity determining region 3 for antibody 21331
QQYGPSRT

SEQ ID NO: 42662 - protein, 15 aa, Homo sapiens
  heavy chain complementarity determining region 3 for antibody 21331
ARVEYYYDSSGYRDD

SEQ ID NO: 42663 - protein, 8 aa, Homo sapiens
  light chain complementarity determining region 3 for antibody 21332
QQYGPSRT

SEQ ID NO: 42664 - protein, 15 aa, Homo sapiens
  heavy chain complementarity determining region 3 for antibody 21332
ARGEFFYDGSGYRED

SEQ ID NO: 42665 - protein, 9 aa, Homo sapiens
  light chain complementarity determining region 3 for antibody 21333
QQYGPIPRT

SEQ ID NO: 42666 - protein, 13 aa, Homo sapiens
  heavy chain complementarity determining region 3 for antibody 21333
AGGLFDSSGYSEF

SEQ ID NO: 42667 - protein, 9 aa, Homo sapiens
  light chain complementarity determining region 3 for antibody 21334
QQYGNYPRT

SEQ ID NO: 42668 - protein, 14 aa, Homo sapiens
  heavy chain complementarity determining region 3 for antibody 21334
ASDPVVGAPGYFDY

SEQ ID NO: 42669 - protein, 9 aa, Homo sapiens
  light chain complementarity determining region 3 for antibody 21335
QQYGNSTRT

SEQ ID NO: 42670 - protein, 14 aa, Homo sapiens
  heavy chain complementarity determining region 3 for antibody 21335
ASDPVVGAPGYFDY

SEQ ID NO: 42671 - protein, 9 aa, Homo sapiens
  light chain complementarity determining region 3 for antibody 21336
QQYGNSPRT

SEQ ID NO: 42672 - protein, 13 aa, Homo sapiens
  heavy chain complementarity determining region 3 for antibody 21336
PIGFYDRSGYHEY

SEQ ID NO: 42673 - protein, 9 aa, Homo sapiens
  light chain complementarity determining region 3 for antibody 21337
QQYGNSPRT

SEQ ID NO: 42674 - protein, 18 aa, Homo sapiens
  heavy chain complementarity determining region 3 for antibody 21337
ATAFWVGLGVPPPGFFEY

SEQ ID NO: 42675 - protein, 9 aa, Homo sapiens
  light chain complementarity determining region 3 for antibody 21338
QQYGNSPRT

SEQ ID NO: 42676 - protein, 14 aa, Homo sapiens
  heavy chain complementarity determining region 3 for antibody 21338
ASDPVVGAPGYFVY

SEQ ID NO: 42677 - protein, 9 aa, Homo sapiens
  light chain complementarity determining region 3 for antibody 21339
QQYGNSPRT

SEQ ID NO: 42678 - protein, 14 aa, Homo sapiens
  heavy chain complementarity determining region 3 for antibody 21339
ASDPVVGAPGSFDY

SEQ ID NO: 42679 - protein, 9 aa, Homo sapiens
  light chain complementarity determining region 3 for antibody 21340
QQYGNSPRT

SEQ ID NO: 42680 - protein, 13 aa, Homo sapiens
  heavy chain complementarity determining region 3 for antibody 21340
AIGYYDRGTYYES

SEQ ID NO: 42681 - protein, 9 aa, Homo sapiens
  light chain complementarity determining region 3 for antibody 21341
QQYGNSPRT

SEQ ID NO: 42682 - protein, 13 aa, Homo sapiens
  heavy chain complementarity determining region 3 for antibody 21341
AIGYYDRGAYYEY

SEQ ID NO: 42683 - protein, 9 aa, Homo sapiens
  light chain complementarity determining region 3 for antibody 21342
QQYGNSPRT

SEQ ID NO: 42684 - protein, 15 aa, Homo sapiens
  heavy chain complementarity determining region 3 for antibody 21342
AGGWFNYYSSGYYDS

SEQ ID NO: 42685 - protein, 9 aa, Homo sapiens
  light chain complementarity determining region 3 for antibody 21343
QQYGNSPRT

SEQ ID NO: 42686 - protein, 15 aa, Homo sapiens
  heavy chain complementarity determining region 3 for antibody 21343
AGGWFNYYSSGYYDP

SEQ ID NO: 42687 - protein, 9 aa, Homo sapiens
  light chain complementarity determining region 3 for antibody 21344
QQYGNSPRT

SEQ ID NO: 42688 - protein, 13 aa, Homo sapiens
  heavy chain complementarity determining region 3 for antibody 21344
AGGHYDSGEYREY

SEQ ID NO: 42689 - protein, 9 aa, Homo sapiens
  light chain complementarity determining region 3 for antibody 21345
QQYGNSPRT

SEQ ID NO: 42690 - protein, 13 aa, Homo sapiens
  heavy chain complementarity determining region 3 for antibody 21345
AGGHYDSGDYRGY

SEQ ID NO: 42691 - protein, 9 aa, Homo sapiens
  light chain complementarity determining region 3 for antibody 21346
QQYGNSPRT

SEQ ID NO: 42692 - protein, 13 aa, Homo sapiens
  heavy chain complementarity determining region 3 for antibody 21346
AGGHYDSGDDREY

SEQ ID NO: 42693 - protein, 9 aa, Homo sapiens
  light chain complementarity determining region 3 for antibody 21347
QQYGNSPRT

SEQ ID NO: 42694 - protein, 13 aa, Homo sapiens
  heavy chain complementarity determining region 3 for antibody 21347
AGGDFHSGGYSEF

SEQ ID NO: 42695 - protein, 9 aa, Homo sapiens
  light chain complementarity determining region 3 for antibody 21348
QQYGNSPRP

SEQ ID NO: 42696 - protein, 15 aa, Homo sapiens
  heavy chain complementarity determining region 3 for antibody 21348
AGGWFNYYSSGYYET

SEQ ID NO: 42697 - protein, 9 aa, Homo sapiens
  light chain complementarity determining region 3 for antibody 21349
QQYGNSPRA

SEQ ID NO: 42698 - protein, 14 aa, Homo sapiens
  heavy chain complementarity determining region 3 for antibody 21349
ASDPVVGAPGYFDY

SEQ ID NO: 42699 - protein, 9 aa, Homo sapiens
  light chain complementarity determining region 3 for antibody 21350
QQYGNSPPT

SEQ ID NO: 42700 - protein, 13 aa, Homo sapiens
  heavy chain complementarity determining region 3 for antibody 21350
ASKTSVRTYSSDL

SEQ ID NO: 42701 - protein, 10 aa, Homo sapiens
  light chain complementarity determining region 3 for antibody 21351
QQYGNSPMYS

SEQ ID NO: 42702 - protein, 11 aa, Homo sapiens
  heavy chain complementarity determining region 3 for antibody 21351
ARGGQWGSLDY

SEQ ID NO: 42703 - protein, 9 aa, Homo sapiens
  light chain complementarity determining region 3 for antibody 21352
QQYGNSPLT

SEQ ID NO: 42704 - protein, 13 aa, Homo sapiens
  heavy chain complementarity determining region 3 for antibody 21352
ASKTSVRTYSADL

SEQ ID NO: 42705 - protein, 9 aa, Homo sapiens
  light chain complementarity determining region 3 for antibody 21353
QQYGNSPLT

SEQ ID NO: 42706 - protein, 14 aa, Homo sapiens
  heavy chain complementarity determining region 3 for antibody 21353
ASDPVVGAPGYFDY

SEQ ID NO: 42707 - protein, 10 aa, Homo sapiens
  light chain complementarity determining region 3 for antibody 21354
QQYGNSPKGT

SEQ ID NO: 42708 - protein, 19 aa, Homo sapiens
  heavy chain complementarity determining region 3 for antibody 21354
ARAEYYYDSGGYRPYYFDY

SEQ ID NO: 42709 - protein, 9 aa, Homo sapiens
  light chain complementarity determining region 3 for antibody 21355
QQYGNSPFT

SEQ ID NO: 42710 - protein, 15 aa, Homo sapiens
  heavy chain complementarity determining region 3 for antibody 21355
ARQNDFLSGPGEFDP

SEQ ID NO: 42711 - protein, 8 aa, Homo sapiens
  light chain complementarity determining region 3 for antibody 21356
QQYGNSPF

SEQ ID NO: 42712 - protein, 20 aa, Homo sapiens
  heavy chain complementarity determining region 3 for antibody 21356
ARGPTGYDTSGYYRNWYFDL

SEQ ID NO: 42713 - protein, 8 aa, Homo sapiens
  light chain complementarity determining region 3 for antibody 21357
QQYGNSPF

SEQ ID NO: 42714 - protein, 20 aa, Homo sapiens
  heavy chain complementarity determining region 3 for antibody 21357
ARGPPGYDTSGYYRNWYSDL

SEQ ID NO: 42715 - protein, 8 aa, Homo sapiens
  light chain complementarity determining region 3 for antibody 21358
QQYGNSPF

SEQ ID NO: 42716 - protein, 20 aa, Homo sapiens
  heavy chain complementarity determining region 3 for antibody 21358
ARGPPGYDTSGYYRNWYFDP

SEQ ID NO: 42717 - protein, 8 aa, Homo sapiens
  light chain complementarity determining region 3 for antibody 21359
QQYGNSPF

SEQ ID NO: 42718 - protein, 20 aa, Homo sapiens
  heavy chain complementarity determining region 3 for antibody 21359
ARGPPGYDTSGYYRHWYFDL

SEQ ID NO: 42719 - protein, 8 aa, Homo sapiens
  light chain complementarity determining region 3 for antibody 21360
QQYGNSPF

SEQ ID NO: 42720 - protein, 20 aa, Homo sapiens
  heavy chain complementarity determining region 3 for antibody 21360
ARGPPGYDTSGYYRDWYFDL

SEQ ID NO: 42721 - protein, 8 aa, Homo sapiens
  light chain complementarity determining region 3 for antibody 21361
QQYGNSPF

SEQ ID NO: 42722 - protein, 20 aa, Homo sapiens
  heavy chain complementarity determining region 3 for antibody 21361
ARGPPGYDTRGYYRNWYFDL

SEQ ID NO: 42723 - protein, 8 aa, Homo sapiens
  light chain complementarity determining region 3 for antibody 21362
QQYGNSPF

SEQ ID NO: 42724 - protein, 20 aa, Homo sapiens
  heavy chain complementarity determining region 3 for antibody 21362
ARGAPGYDTSGYYRNWYFDL

SEQ ID NO: 42725 - protein, 8 aa, Homo sapiens
  light chain complementarity determining region 3 for antibody 21363
QQYGNSPF

SEQ ID NO: 42726 - protein, 20 aa, Homo sapiens
  heavy chain complementarity determining region 3 for antibody 21363
AIGPPGYDTSGYYRNWYFDL

SEQ ID NO: 42727 - protein, 9 aa, Homo sapiens
  light chain complementarity determining region 3 for antibody 21364
QQYGNSLRT

SEQ ID NO: 42728 - protein, 13 aa, Homo sapiens
  heavy chain complementarity determining region 3 for antibody 21364
AIGYYDRGTYYEY

SEQ ID NO: 42729 - protein, 9 aa, Homo sapiens
  light chain complementarity determining region 3 for antibody 21365
QQYGNSHRT

SEQ ID NO: 42730 - protein, 14 aa, Homo sapiens
  heavy chain complementarity determining region 3 for antibody 21365
ASDPVVGAPGYFDY

SEQ ID NO: 42731 - protein, 9 aa, Homo sapiens
  light chain complementarity determining region 3 for antibody 21366
QQYGNPPRT

SEQ ID NO: 42732 - protein, 25 aa, Homo sapiens
  heavy chain complementarity determining region 3 for antibody 21366
ARLRVARLRLPGAMRGPLYDRGLNV

SEQ ID NO: 42733 - protein, 9 aa, Homo sapiens
  light chain complementarity determining region 3 for antibody 21367
QQYGNPPRT

SEQ ID NO: 42734 - protein, 25 aa, Homo sapiens
  heavy chain complementarity determining region 3 for antibody 21367
ARLGVDRLRLPGAMRGPLYDRGLNV

SEQ ID NO: 42735 - protein, 9 aa, Homo sapiens
  light chain complementarity determining region 3 for antibody 21368
QQYGNLTRT

SEQ ID NO: 42736 - protein, 13 aa, Homo sapiens
  heavy chain complementarity determining region 3 for antibody 21368
AGGNYDTGRYEEY

SEQ ID NO: 42737 - protein, 9 aa, Homo sapiens
  light chain complementarity determining region 3 for antibody 21369
QQYGNLPWT

SEQ ID NO: 42738 - protein, 13 aa, Homo sapiens
  heavy chain complementarity determining region 3 for antibody 21369
AGGNYDTGRYEEY

SEQ ID NO: 42739 - protein, 9 aa, Homo sapiens
  light chain complementarity determining region 3 for antibody 21370
QQYGNLPRT

SEQ ID NO: 42740 - protein, 12 aa, Homo sapiens
  heavy chain complementarity determining region 3 for antibody 21370
AREFPETCYFHN

SEQ ID NO: 42741 - protein, 9 aa, Homo sapiens
  light chain complementarity determining region 3 for antibody 21371
QQYGNLPRT

SEQ ID NO: 42742 - protein, 13 aa, Homo sapiens
  heavy chain complementarity determining region 3 for antibody 21371
AIGYYDRGTYYEY

SEQ ID NO: 42743 - protein, 9 aa, Homo sapiens
  light chain complementarity determining region 3 for antibody 21372
QQYGNLPRT

SEQ ID NO: 42744 - protein, 13 aa, Homo sapiens
  heavy chain complementarity determining region 3 for antibody 21372
AGGRFHSSGYSEF

SEQ ID NO: 42745 - protein, 9 aa, Homo sapiens
  light chain complementarity determining region 3 for antibody 21373
QQYGNLPRT

SEQ ID NO: 42746 - protein, 13 aa, Homo sapiens
  heavy chain complementarity determining region 3 for antibody 21373
AGGQLHTSGYSEF

SEQ ID NO: 42747 - protein, 9 aa, Homo sapiens
  light chain complementarity determining region 3 for antibody 21374
QQYGNLPRT

SEQ ID NO: 42748 - protein, 13 aa, Homo sapiens
  heavy chain complementarity determining region 3 for antibody 21374
AGGQFHASGYSEF

SEQ ID NO: 42749 - protein, 9 aa, Homo sapiens
  light chain complementarity determining region 3 for antibody 21375
QQYGNLPRT

SEQ ID NO: 42750 - protein, 13 aa, Homo sapiens
  heavy chain complementarity determining region 3 for antibody 21375
AGGQFHASGYSDF

SEQ ID NO: 42751 - protein, 9 aa, Homo sapiens
  light chain complementarity determining region 3 for antibody 21376
QQYGNLPRT

SEQ ID NO: 42752 - protein, 13 aa, Homo sapiens
  heavy chain complementarity determining region 3 for antibody 21376
AGGNYDTGRYDEY

SEQ ID NO: 42753 - protein, 9 aa, Homo sapiens
  light chain complementarity determining region 3 for antibody 21377
QQYGNLPRT

SEQ ID NO: 42754 - protein, 13 aa, Homo sapiens
  heavy chain complementarity determining region 3 for antibody 21377
AGGNYDPGRYEDY

SEQ ID NO: 42755 - protein, 9 aa, Homo sapiens
  light chain complementarity determining region 3 for antibody 21378
QQYGNLPRT

SEQ ID NO: 42756 - protein, 13 aa, Homo sapiens
  heavy chain complementarity determining region 3 for antibody 21378
AGGNLHSGGYGEY

SEQ ID NO: 42757 - protein, 9 aa, Homo sapiens
  light chain complementarity determining region 3 for antibody 21379
QQYGNLPRT

SEQ ID NO: 42758 - protein, 13 aa, Homo sapiens
  heavy chain complementarity determining region 3 for antibody 21379
AGGNFPSGGYGEY

SEQ ID NO: 42759 - protein, 9 aa, Homo sapiens
  light chain complementarity determining region 3 for antibody 21380
QQYGNLPRT

SEQ ID NO: 42760 - protein, 13 aa, Homo sapiens
  heavy chain complementarity determining region 3 for antibody 21380
AGGNFHSGGYGES

SEQ ID NO: 42761 - protein, 9 aa, Homo sapiens
  light chain complementarity determining region 3 for antibody 21381
QQYGNLPRT

SEQ ID NO: 42762 - protein, 13 aa, Homo sapiens
  heavy chain complementarity determining region 3 for antibody 21381
AGGNDDTGRYEEY

SEQ ID NO: 42763 - protein, 9 aa, Homo sapiens
  light chain complementarity determining region 3 for antibody 21382
QQYGNLPRT

SEQ ID NO: 42764 - protein, 14 aa, Homo sapiens
  heavy chain complementarity determining region 3 for antibody 21382
AGGDVHRGGGYSEF

SEQ ID NO: 42765 - protein, 9 aa, Homo sapiens
  light chain complementarity determining region 3 for antibody 21383
QQYGNLPRT

SEQ ID NO: 42766 - protein, 13 aa, Homo sapiens
  heavy chain complementarity determining region 3 for antibody 21383
AGGDLHSGGYSEF

SEQ ID NO: 42767 - protein, 9 aa, Homo sapiens
  light chain complementarity determining region 3 for antibody 21384
QQYGNLPRT

SEQ ID NO: 42768 - protein, 13 aa, Homo sapiens
  heavy chain complementarity determining region 3 for antibody 21384
AGGDFHSSGYSEF

SEQ ID NO: 42769 - protein, 9 aa, Homo sapiens
  light chain complementarity determining region 3 for antibody 21385
QQYGNLPRT

SEQ ID NO: 42770 - protein, 13 aa, Homo sapiens
  heavy chain complementarity determining region 3 for antibody 21385
AGGDFHSGGYSGF

SEQ ID NO: 42771 - protein, 9 aa, Homo sapiens
  light chain complementarity determining region 3 for antibody 21386
QQYGNLPRT

SEQ ID NO: 42772 - protein, 13 aa, Homo sapiens
  heavy chain complementarity determining region 3 for antibody 21386
AGGDFHSGGYSEV

SEQ ID NO: 42773 - protein, 9 aa, Homo sapiens
  light chain complementarity determining region 3 for antibody 21387
QQYGNLPRT

SEQ ID NO: 42774 - protein, 13 aa, Homo sapiens
  heavy chain complementarity determining region 3 for antibody 21387
AGGDFHSGGCSEF

SEQ ID NO: 42775 - protein, 9 aa, Homo sapiens
  light chain complementarity determining region 3 for antibody 21388
QQYGNLPRT

SEQ ID NO: 42776 - protein, 13 aa, Homo sapiens
  heavy chain complementarity determining region 3 for antibody 21388
AGGAFHSGGYSEF

SEQ ID NO: 42777 - protein, 9 aa, Homo sapiens
  light chain complementarity determining region 3 for antibody 21389
QQYGNLPRT

SEQ ID NO: 42778 - protein, 13 aa, Homo sapiens
  heavy chain complementarity determining region 3 for antibody 21389
ACGNFHSGGYGEY

SEQ ID NO: 42779 - protein, 9 aa, Homo sapiens
  light chain complementarity determining region 3 for antibody 21390
QQYGNLPRS

SEQ ID NO: 42780 - protein, 13 aa, Homo sapiens
  heavy chain complementarity determining region 3 for antibody 21390
AGGTWHSGTYFES

SEQ ID NO: 42781 - protein, 9 aa, Homo sapiens
  light chain complementarity determining region 3 for antibody 21391
QQYGNLPRR

SEQ ID NO: 42782 - protein, 13 aa, Homo sapiens
  heavy chain complementarity determining region 3 for antibody 21391
AGGQFHSSGYSEF

SEQ ID NO: 42783 - protein, 9 aa, Homo sapiens
  light chain complementarity determining region 3 for antibody 21392
QQYGNLPRR

SEQ ID NO: 42784 - protein, 13 aa, Homo sapiens
  heavy chain complementarity determining region 3 for antibody 21392
AGGNFHSGGYGEY

SEQ ID NO: 42785 - protein, 9 aa, Homo sapiens
  light chain complementarity determining region 3 for antibody 21393
QQYGNLPRR

SEQ ID NO: 42786 - protein, 13 aa, Homo sapiens
  heavy chain complementarity determining region 3 for antibody 21393
AGGDFHSGGYSEF

SEQ ID NO: 42787 - protein, 9 aa, Homo sapiens
  light chain complementarity determining region 3 for antibody 21394
QQYGNLPRP

SEQ ID NO: 42788 - protein, 13 aa, Homo sapiens
  heavy chain complementarity determining region 3 for antibody 21394
AGGNYDTGRYEEY

SEQ ID NO: 42789 - protein, 9 aa, Homo sapiens
  light chain complementarity determining region 3 for antibody 21395
QQYGNLPRP

SEQ ID NO: 42790 - protein, 13 aa, Homo sapiens
  heavy chain complementarity determining region 3 for antibody 21395
AGGEFHRGGYSEF

SEQ ID NO: 42791 - protein, 9 aa, Homo sapiens
  light chain complementarity determining region 3 for antibody 21396
QQYGNLPRP

SEQ ID NO: 42792 - protein, 13 aa, Homo sapiens
  heavy chain complementarity determining region 3 for antibody 21396
AGGDFHSGGYSEF

SEQ ID NO: 42793 - protein, 9 aa, Homo sapiens
  light chain complementarity determining region 3 for antibody 21397
QQYGNLPRK

SEQ ID NO: 42794 - protein, 13 aa, Homo sapiens
  heavy chain complementarity determining region 3 for antibody 21397
ARGQYERSGYKEN

SEQ ID NO: 42795 - protein, 9 aa, Homo sapiens
  light chain complementarity determining region 3 for antibody 21398
QQYGNLPRK

SEQ ID NO: 42796 - protein, 13 aa, Homo sapiens
  heavy chain complementarity determining region 3 for antibody 21398
AGGQFHTSGYSEF

SEQ ID NO: 42797 - protein, 9 aa, Homo sapiens
  light chain complementarity determining region 3 for antibody 21399
QQYGNLPRK

SEQ ID NO: 42798 - protein, 13 aa, Homo sapiens
  heavy chain complementarity determining region 3 for antibody 21399
AGGNFHSGGYGDY

SEQ ID NO: 42799 - protein, 9 aa, Homo sapiens
  light chain complementarity determining region 3 for antibody 21400
QQYGNLPRK

SEQ ID NO: 42800 - protein, 13 aa, Homo sapiens
  heavy chain complementarity determining region 3 for antibody 21400
AGGDFHRGGYSEY

SEQ ID NO: 42801 - protein, 9 aa, Homo sapiens
  light chain complementarity determining region 3 for antibody 21401
QQYGNLPLT

SEQ ID NO: 42802 - protein, 13 aa, Homo sapiens
  heavy chain complementarity determining region 3 for antibody 21401
AGGQFHTSGYSEF

SEQ ID NO: 42803 - protein, 9 aa, Homo sapiens
  light chain complementarity determining region 3 for antibody 21402
QQYGNLPLT

SEQ ID NO: 42804 - protein, 13 aa, Homo sapiens
  heavy chain complementarity determining region 3 for antibody 21402
AGGQFHSSGYSEF

SEQ ID NO: 42805 - protein, 9 aa, Homo sapiens
  light chain complementarity determining region 3 for antibody 21403
QQYGNLPGT

SEQ ID NO: 42806 - protein, 13 aa, Homo sapiens
  heavy chain complementarity determining region 3 for antibody 21403
AGGNFHSGGYGEY

SEQ ID NO: 42807 - protein, 8 aa, Homo sapiens
  light chain complementarity determining region 3 for antibody 21404
QQYGNLIT

SEQ ID NO: 42808 - protein, 18 aa, Homo sapiens
  heavy chain complementarity determining region 3 for antibody 21404
AKGAEGSCSVRKCYPFDY

SEQ ID NO: 42809 - protein, 9 aa, Homo sapiens
  light chain complementarity determining region 3 for antibody 21405
QQYGNLHRT

SEQ ID NO: 42810 - protein, 13 aa, Homo sapiens
  heavy chain complementarity determining region 3 for antibody 21405
AGGQFHTSGYSEF

SEQ ID NO: 42811 - protein, 9 aa, Homo sapiens
  light chain complementarity determining region 3 for antibody 21406
QQYGNIPRT

SEQ ID NO: 42812 - protein, 13 aa, Homo sapiens
  heavy chain complementarity determining region 3 for antibody 21406
AGGTWHSGTYYES

SEQ ID NO: 42813 - protein, 9 aa, Homo sapiens
  light chain complementarity determining region 3 for antibody 21407
QQYGNIPRT

SEQ ID NO: 42814 - protein, 14 aa, Homo sapiens
  heavy chain complementarity determining region 3 for antibody 21407
AGGTVDSSGYYYEY

SEQ ID NO: 42815 - protein, 9 aa, Homo sapiens
  light chain complementarity determining region 3 for antibody 21408
QQYGNIPRT

SEQ ID NO: 42816 - protein, 14 aa, Homo sapiens
  heavy chain complementarity determining region 3 for antibody 21408
AGGTFDSSGYYYDY

SEQ ID NO: 42817 - protein, 9 aa, Homo sapiens
  light chain complementarity determining region 3 for antibody 21409
QQYGNIPRT

SEQ ID NO: 42818 - protein, 14 aa, Homo sapiens
  heavy chain complementarity determining region 3 for antibody 21409
AGGTFDSSGYYFDY

SEQ ID NO: 42819 - protein, 9 aa, Homo sapiens
  light chain complementarity determining region 3 for antibody 21410
QQYGNIPRT

SEQ ID NO: 42820 - protein, 13 aa, Homo sapiens
  heavy chain complementarity determining region 3 for antibody 21410
AGGLFHSSGYSGF

SEQ ID NO: 42821 - protein, 9 aa, Homo sapiens
  light chain complementarity determining region 3 for antibody 21411
QQYGNIPRT

SEQ ID NO: 42822 - protein, 13 aa, Homo sapiens
  heavy chain complementarity determining region 3 for antibody 21411
AGGLFHSSGSSEF

SEQ ID NO: 42823 - protein, 9 aa, Homo sapiens
  light chain complementarity determining region 3 for antibody 21412
QQYGNIPRT

SEQ ID NO: 42824 - protein, 13 aa, Homo sapiens
  heavy chain complementarity determining region 3 for antibody 21412
AGGLFDSSGYSEF

SEQ ID NO: 42825 - protein, 9 aa, Homo sapiens
  light chain complementarity determining region 3 for antibody 21413
QQYGNIPLT

SEQ ID NO: 42826 - protein, 13 aa, Homo sapiens
  heavy chain complementarity determining region 3 for antibody 21413
AGGLFHSSGYSEF

SEQ ID NO: 42827 - protein, 9 aa, Homo sapiens
  light chain complementarity determining region 3 for antibody 21414
QQYGNIHRT

SEQ ID NO: 42828 - protein, 13 aa, Homo sapiens
  heavy chain complementarity determining region 3 for antibody 21414
AGGLFHSSGYSDF

SEQ ID NO: 42829 - protein, 9 aa, Homo sapiens
  light chain complementarity determining region 3 for antibody 21415
QQYGNFPRT

SEQ ID NO: 42830 - protein, 13 aa, Homo sapiens
  heavy chain complementarity determining region 3 for antibody 21415
ARGQYERSGYKEN

SEQ ID NO: 42831 - protein, 9 aa, Homo sapiens
  light chain complementarity determining region 3 for antibody 21416
QQYGNFPRT

SEQ ID NO: 42832 - protein, 13 aa, Homo sapiens
  heavy chain complementarity determining region 3 for antibody 21416
AGGNFHSGGYGEY

SEQ ID NO: 42833 - protein, 9 aa, Homo sapiens
  light chain complementarity determining region 3 for antibody 21417
QQYGNFPRT

SEQ ID NO: 42834 - protein, 14 aa, Homo sapiens
  heavy chain complementarity determining region 3 for antibody 21417
AGGDFHRGGGYSEF

SEQ ID NO: 42835 - protein, 9 aa, Homo sapiens
  light chain complementarity determining region 3 for antibody 21418
QQYGKSPRT

SEQ ID NO: 42836 - protein, 14 aa, Homo sapiens
  heavy chain complementarity determining region 3 for antibody 21418
ASDPVVGAPGYFDY

SEQ ID NO: 42837 - protein, 9 aa, Homo sapiens
  light chain complementarity determining region 3 for antibody 21419
QQYGKIPRT

SEQ ID NO: 42838 - protein, 13 aa, Homo sapiens
  heavy chain complementarity determining region 3 for antibody 21419
AGGLYDSSGYSEF

SEQ ID NO: 42839 - protein, 9 aa, Homo sapiens
  light chain complementarity determining region 3 for antibody 21420
QQYGKIPRT

SEQ ID NO: 42840 - protein, 13 aa, Homo sapiens
  heavy chain complementarity determining region 3 for antibody 21420
AGGLFHSSGYSEF

SEQ ID NO: 42841 - protein, 9 aa, Homo sapiens
  light chain complementarity determining region 3 for antibody 21421
QQYGISPRT

SEQ ID NO: 42842 - protein, 17 aa, Homo sapiens
  heavy chain complementarity determining region 3 for antibody 21421
TTDPQWLEPPPFLTNDY

SEQ ID NO: 42843 - protein, 9 aa, Homo sapiens
  light chain complementarity determining region 3 for antibody 21422
QQYGISPRT

SEQ ID NO: 42844 - protein, 13 aa, Homo sapiens
  heavy chain complementarity determining region 3 for antibody 21422
PIGFYDRSGYHEY

SEQ ID NO: 42845 - protein, 9 aa, Homo sapiens
  light chain complementarity determining region 3 for antibody 21423
QQYGISPRT

SEQ ID NO: 42846 - protein, 14 aa, Homo sapiens
  heavy chain complementarity determining region 3 for antibody 21423
AKGLMYHYDSALDL

SEQ ID NO: 42847 - protein, 9 aa, Homo sapiens
  light chain complementarity determining region 3 for antibody 21424
QQYGISPRP

SEQ ID NO: 42848 - protein, 9 aa, Homo sapiens
  heavy chain complementarity determining region 3 for antibody 21424
VREYSAFDI

SEQ ID NO: 42849 - protein, 9 aa, Homo sapiens
  light chain complementarity determining region 3 for antibody 21425
QQYGISLYT

SEQ ID NO: 42850 - protein, 16 aa, Homo sapiens
  heavy chain complementarity determining region 3 for antibody 21425
ARAKHYGDYYYYGMDA

SEQ ID NO: 42851 - protein, 9 aa, Homo sapiens
  light chain complementarity determining region 3 for antibody 21426
QQYGILPRT

SEQ ID NO: 42852 - protein, 13 aa, Homo sapiens
  heavy chain complementarity determining region 3 for antibody 21426
ARGQFERSGYKEN

SEQ ID NO: 42853 - protein, 9 aa, Homo sapiens
  light chain complementarity determining region 3 for antibody 21427
QQYGHSPRT

SEQ ID NO: 42854 - protein, 13 aa, Homo sapiens
  heavy chain complementarity determining region 3 for antibody 21427
AIGYYDRGTYYEY

SEQ ID NO: 42855 - protein, 9 aa, Homo sapiens
  light chain complementarity determining region 3 for antibody 21428
QQYGHLPRT

SEQ ID NO: 42856 - protein, 12 aa, Homo sapiens
  heavy chain complementarity determining region 3 for antibody 21428
AREFPETCYFPN

SEQ ID NO: 42857 - protein, 9 aa, Homo sapiens
  light chain complementarity determining region 3 for antibody 21429
QQYGHLPRT

SEQ ID NO: 42858 - protein, 13 aa, Homo sapiens
  heavy chain complementarity determining region 3 for antibody 21429
AGGQFHSSGYSEF

SEQ ID NO: 42859 - protein, 9 aa, Homo sapiens
  light chain complementarity determining region 3 for antibody 21430
QQYGHLPRT

SEQ ID NO: 42860 - protein, 13 aa, Homo sapiens
  heavy chain complementarity determining region 3 for antibody 21430
AGGDFHRGGYSDY

SEQ ID NO: 42861 - protein, 9 aa, Homo sapiens
  light chain complementarity determining region 3 for antibody 21431
QQYGGSTRT

SEQ ID NO: 42862 - protein, 13 aa, Homo sapiens
  heavy chain complementarity determining region 3 for antibody 21431
AAGYFSSGTYYEY

SEQ ID NO: 42863 - protein, 9 aa, Homo sapiens
  light chain complementarity determining region 3 for antibody 21432
QQYGGSRRT

SEQ ID NO: 42864 - protein, 13 aa, Homo sapiens
  heavy chain complementarity determining region 3 for antibody 21432
ASGYFDSGAYYDF

SEQ ID NO: 42865 - protein, 9 aa, Homo sapiens
  light chain complementarity determining region 3 for antibody 21433
QQYGGSPWT

SEQ ID NO: 42866 - protein, 13 aa, Homo sapiens
  heavy chain complementarity determining region 3 for antibody 21433
ASGYFDSGAYYEF

SEQ ID NO: 42867 - protein, 8 aa, Homo sapiens
  light chain complementarity determining region 3 for antibody 21434
QQYGGSPS

SEQ ID NO: 42868 - protein, 16 aa, Homo sapiens
  heavy chain complementarity determining region 3 for antibody 21434
ATGWGSGTQWIRAFDV

SEQ ID NO: 42869 - protein, 8 aa, Homo sapiens
  light chain complementarity determining region 3 for antibody 21435
QQYGGSPS

SEQ ID NO: 42870 - protein, 16 aa, Homo sapiens
  heavy chain complementarity determining region 3 for antibody 21435
ATDWGSGAQWIRAFDV

SEQ ID NO: 42871 - protein, 8 aa, Homo sapiens
  light chain complementarity determining region 3 for antibody 21436
QQYGGSPS

SEQ ID NO: 42872 - protein, 16 aa, Homo sapiens
  heavy chain complementarity determining region 3 for antibody 21436
AADWGSGTQWIRAFDV

SEQ ID NO: 42873 - protein, 9 aa, Homo sapiens
  light chain complementarity determining region 3 for antibody 21437
QQYGGSPRT

SEQ ID NO: 42874 - protein, 25 aa, Homo sapiens
  heavy chain complementarity determining region 3 for antibody 21437
ASLRIDRLRLPGAMRGPLYDCGLNV

SEQ ID NO: 42875 - protein, 9 aa, Homo sapiens
  light chain complementarity determining region 3 for antibody 21438
QQYGGSPRT

SEQ ID NO: 42876 - protein, 13 aa, Homo sapiens
  heavy chain complementarity determining region 3 for antibody 21438
ASGYLDSGAYYEF

SEQ ID NO: 42877 - protein, 9 aa, Homo sapiens
  light chain complementarity determining region 3 for antibody 21439
QQYGGSPRT

SEQ ID NO: 42878 - protein, 13 aa, Homo sapiens
  heavy chain complementarity determining region 3 for antibody 21439
ASGYFESGAYYEF

SEQ ID NO: 42879 - protein, 9 aa, Homo sapiens
  light chain complementarity determining region 3 for antibody 21440
QQYGGSPRT

SEQ ID NO: 42880 - protein, 13 aa, Homo sapiens
  heavy chain complementarity determining region 3 for antibody 21440
ASGYFDSGAYFDF

SEQ ID NO: 42881 - protein, 9 aa, Homo sapiens
  light chain complementarity determining region 3 for antibody 21441
QQYGGSPRT

SEQ ID NO: 42882 - protein, 13 aa, Homo sapiens
  heavy chain complementarity determining region 3 for antibody 21441
ASGYFDGGAYYEF

SEQ ID NO: 42883 - protein, 9 aa, Homo sapiens
  light chain complementarity determining region 3 for antibody 21442
QQYGGSPRT

SEQ ID NO: 42884 - protein, 13 aa, Homo sapiens
  heavy chain complementarity determining region 3 for antibody 21442
ASGYCDSGAYYEF

SEQ ID NO: 42885 - protein, 9 aa, Homo sapiens
  light chain complementarity determining region 3 for antibody 21443
QQYGGSPRT

SEQ ID NO: 42886 - protein, 13 aa, Homo sapiens
  heavy chain complementarity determining region 3 for antibody 21443
ASGYCDSGAYYDF

SEQ ID NO: 42887 - protein, 9 aa, Homo sapiens
  light chain complementarity determining region 3 for antibody 21444
QQYGGSPRT

SEQ ID NO: 42888 - protein, 13 aa, Homo sapiens
  heavy chain complementarity determining region 3 for antibody 21444
ASGSFDSGAYYEF

SEQ ID NO: 42889 - protein, 9 aa, Homo sapiens
  light chain complementarity determining region 3 for antibody 21445
QQYGGSPRT

SEQ ID NO: 42890 - protein, 25 aa, Homo sapiens
  heavy chain complementarity determining region 3 for antibody 21445
ARLRIDRLRLPGAMRGPLYDCGLNV

SEQ ID NO: 42891 - protein, 9 aa, Homo sapiens
  light chain complementarity determining region 3 for antibody 21446
QQYGGSPRT

SEQ ID NO: 42892 - protein, 14 aa, Homo sapiens
  heavy chain complementarity determining region 3 for antibody 21446
AGGRFSSGSSYSEN

SEQ ID NO: 42893 - protein, 9 aa, Homo sapiens
  light chain complementarity determining region 3 for antibody 21447
QQYGGSPRT

SEQ ID NO: 42894 - protein, 13 aa, Homo sapiens
  heavy chain complementarity determining region 3 for antibody 21447
AAGYFSSGTYSEY

SEQ ID NO: 42895 - protein, 9 aa, Homo sapiens
  light chain complementarity determining region 3 for antibody 21448
QQYGGSPRR

SEQ ID NO: 42896 - protein, 13 aa, Homo sapiens
  heavy chain complementarity determining region 3 for antibody 21448
ASGYFDSGAYYEF

SEQ ID NO: 42897 - protein, 9 aa, Homo sapiens
  light chain complementarity determining region 3 for antibody 21449
QQYGGSPRR

SEQ ID NO: 42898 - protein, 13 aa, Homo sapiens
  heavy chain complementarity determining region 3 for antibody 21449
AAGYFSSGTYYEY

SEQ ID NO: 42899 - protein, 9 aa, Homo sapiens
  light chain complementarity determining region 3 for antibody 21450
QQYGGSPRP

SEQ ID NO: 42900 - protein, 13 aa, Homo sapiens
  heavy chain complementarity determining region 3 for antibody 21450
ASGYFDSGAYYDF

SEQ ID NO: 42901 - protein, 9 aa, Homo sapiens
  light chain complementarity determining region 3 for antibody 21451
QQYGGSPRP

SEQ ID NO: 42902 - protein, 15 aa, Homo sapiens
  heavy chain complementarity determining region 3 for antibody 21451
AKDGPYCGSDCFFDS

SEQ ID NO: 42903 - protein, 9 aa, Homo sapiens
  light chain complementarity determining region 3 for antibody 21452
QQYGGSPRK

SEQ ID NO: 42904 - protein, 13 aa, Homo sapiens
  heavy chain complementarity determining region 3 for antibody 21452
AAGYFSSGTYYEY

SEQ ID NO: 42905 - protein, 11 aa, Homo sapiens
  light chain complementarity determining region 3 for antibody 21453
QQYGGSPPMYT

SEQ ID NO: 42906 - protein, 19 aa, Homo sapiens
  heavy chain complementarity determining region 3 for antibody 21453
ARGTSFFPNSLYYLPFFDS

SEQ ID NO: 42907 - protein, 11 aa, Homo sapiens
  light chain complementarity determining region 3 for antibody 21454
QQYGGSPPGYP

SEQ ID NO: 42908 - protein, 12 aa, Homo sapiens
  heavy chain complementarity determining region 3 for antibody 21454
AREWPETCYFDY

SEQ ID NO: 42909 - protein, 10 aa, Homo sapiens
  light chain complementarity determining region 3 for antibody 21455
QQYGGSPMYS

SEQ ID NO: 42910 - protein, 11 aa, Homo sapiens
  heavy chain complementarity determining region 3 for antibody 21455
ARGGQWGSLDY

SEQ ID NO: 42911 - protein, 9 aa, Homo sapiens
  light chain complementarity determining region 3 for antibody 21456
QQYGGSPHT

SEQ ID NO: 42912 - protein, 15 aa, Homo sapiens
  heavy chain complementarity determining region 3 for antibody 21456
ARESPMRGPWGYFDF

SEQ ID NO: 42913 - protein, 9 aa, Homo sapiens
  light chain complementarity determining region 3 for antibody 21457
QQYGGSPHT

SEQ ID NO: 42914 - protein, 15 aa, Homo sapiens
  heavy chain complementarity determining region 3 for antibody 21457
ARESPIRGPWCYFDF

SEQ ID NO: 42915 - protein, 9 aa, Homo sapiens
  light chain complementarity determining region 3 for antibody 21458
QQYGGSPHP

SEQ ID NO: 42916 - protein, 15 aa, Homo sapiens
  heavy chain complementarity determining region 3 for antibody 21458
ARESPIRGPWGYFDF

SEQ ID NO: 42917 - protein, 8 aa, Homo sapiens
  light chain complementarity determining region 3 for antibody 21459
QQYGGSPC

SEQ ID NO: 42918 - protein, 16 aa, Homo sapiens
  heavy chain complementarity determining region 3 for antibody 21459
ATDWGSGTQWIRAFDV

SEQ ID NO: 42919 - protein, 9 aa, Homo sapiens
  light chain complementarity determining region 3 for antibody 21460
QQYGGSAIS

SEQ ID NO: 42920 - protein, 9 aa, Homo sapiens
  heavy chain complementarity determining region 3 for antibody 21460
GFLSGGRDY

SEQ ID NO: 42921 - protein, 8 aa, Homo sapiens
  light chain complementarity determining region 3 for antibody 21461
QQYGGPPS

SEQ ID NO: 42922 - protein, 16 aa, Homo sapiens
  heavy chain complementarity determining region 3 for antibody 21461
ATDWGSGTQWIRAFDV

SEQ ID NO: 42923 - protein, 9 aa, Homo sapiens
  light chain complementarity determining region 3 for antibody 21462
QQYGGPPRT

SEQ ID NO: 42924 - protein, 13 aa, Homo sapiens
  heavy chain complementarity determining region 3 for antibody 21462
ASGYFDSGAYYEF

SEQ ID NO: 42925 - protein, 9 aa, Homo sapiens
  light chain complementarity determining region 3 for antibody 21463
QQYGGIPRT

SEQ ID NO: 42926 - protein, 13 aa, Homo sapiens
  heavy chain complementarity determining region 3 for antibody 21463
AGGSFSGGNYKED

SEQ ID NO: 42927 - protein, 9 aa, Homo sapiens
  light chain complementarity determining region 3 for antibody 21464
QQYGFSPHI

SEQ ID NO: 42928 - protein, 11 aa, Homo sapiens
  heavy chain complementarity determining region 3 for antibody 21464
TRGYIEVIGDW

SEQ ID NO: 42929 - protein, 9 aa, Homo sapiens
  light chain complementarity determining region 3 for antibody 21465
QQYGDSPVT

SEQ ID NO: 42930 - protein, 18 aa, Homo sapiens
  heavy chain complementarity determining region 3 for antibody 21465
AKIADAAFSASRRGYFDD

SEQ ID NO: 42931 - protein, 9 aa, Homo sapiens
  light chain complementarity determining region 3 for antibody 21466
QQYGDSPST

SEQ ID NO: 42932 - protein, 22 aa, Homo sapiens
  heavy chain complementarity determining region 3 for antibody 21466
TRRRPTGRTSFRRGGRQGAFDI

SEQ ID NO: 42933 - protein, 11 aa, Homo sapiens
  light chain complementarity determining region 3 for antibody 21467
QQYGDSPPMYT

SEQ ID NO: 42934 - protein, 12 aa, Homo sapiens
  heavy chain complementarity determining region 3 for antibody 21467
AWQGDRSYSYSY

SEQ ID NO: 42935 - protein, 11 aa, Homo sapiens
  light chain complementarity determining region 3 for antibody 21468
QQYGDSPPMYT

SEQ ID NO: 42936 - protein, 12 aa, Homo sapiens
  heavy chain complementarity determining region 3 for antibody 21468
AGQGDRAYSYSY

SEQ ID NO: 42937 - protein, 11 aa, Homo sapiens
  light chain complementarity determining region 3 for antibody 21469
QQYGDSPPMYT

SEQ ID NO: 42938 - protein, 12 aa, Homo sapiens
  heavy chain complementarity determining region 3 for antibody 21469
AGQGARSYSYSY

SEQ ID NO: 42939 - protein, 11 aa, Homo sapiens
  light chain complementarity determining region 3 for antibody 21470
QQYGDSPPMNT

SEQ ID NO: 42940 - protein, 12 aa, Homo sapiens
  heavy chain complementarity determining region 3 for antibody 21470
AGQGDRSYSYSY

SEQ ID NO: 42941 - protein, 11 aa, Homo sapiens
  light chain complementarity determining region 3 for antibody 21471
QQYGDSPPLYT

SEQ ID NO: 42942 - protein, 12 aa, Homo sapiens
  heavy chain complementarity determining region 3 for antibody 21471
AGQGDRSYSYSY

SEQ ID NO: 42943 - protein, 11 aa, Homo sapiens
  light chain complementarity determining region 3 for antibody 21472
QQYGDSPPLDT

SEQ ID NO: 42944 - protein, 12 aa, Homo sapiens
  heavy chain complementarity determining region 3 for antibody 21472
AGQGDRSYSYSY

SEQ ID NO: 42945 - protein, 9 aa, Homo sapiens
  light chain complementarity determining region 3 for antibody 21473
QQYGDSPNT

SEQ ID NO: 42946 - protein, 22 aa, Homo sapiens
  heavy chain complementarity determining region 3 for antibody 21473
TRRRPTGRTSFRRGGRQGAFDI

SEQ ID NO: 42947 - protein, 9 aa, Homo sapiens
  light chain complementarity determining region 3 for antibody 21474
QQYGDSPGT

SEQ ID NO: 42948 - protein, 18 aa, Homo sapiens
  heavy chain complementarity determining region 3 for antibody 21474
AKIADAAFSASHRGYFDD

SEQ ID NO: 42949 - protein, 9 aa, Homo sapiens
  light chain complementarity determining region 3 for antibody 21475
QQYGDSPDT

SEQ ID NO: 42950 - protein, 22 aa, Homo sapiens
  heavy chain complementarity determining region 3 for antibody 21475
TRRRPTGRTSFRRGGRQGAFDI

SEQ ID NO: 42951 - protein, 10 aa, Homo sapiens
  light chain complementarity determining region 3 for antibody 21476
QQYGDSPAYS

SEQ ID NO: 42952 - protein, 10 aa, Homo sapiens
  heavy chain complementarity determining region 3 for antibody 21476
VNSAGSYSEY

SEQ ID NO: 42953 - protein, 10 aa, Homo sapiens
  light chain complementarity determining region 3 for antibody 21477
QQYGDSPAYR

SEQ ID NO: 42954 - protein, 10 aa, Homo sapiens
  heavy chain complementarity determining region 3 for antibody 21477
VNSAGSYFEY

SEQ ID NO: 42955 - protein, 10 aa, Homo sapiens
  light chain complementarity determining region 3 for antibody 21478
QQYGDSPAYG

SEQ ID NO: 42956 - protein, 10 aa, Homo sapiens
  heavy chain complementarity determining region 3 for antibody 21478
VNSAGSYFDY

SEQ ID NO: 42957 - protein, 10 aa, Homo sapiens
  light chain complementarity determining region 3 for antibody 21479
QQYGDSPASS

SEQ ID NO: 42958 - protein, 10 aa, Homo sapiens
  heavy chain complementarity determining region 3 for antibody 21479
VNSAGSYFEY

SEQ ID NO: 42959 - protein, 10 aa, Homo sapiens
  light chain complementarity determining region 3 for antibody 21480
QQYGDSPAHS

SEQ ID NO: 42960 - protein, 10 aa, Homo sapiens
  heavy chain complementarity determining region 3 for antibody 21480
VNSAGSYFEY

SEQ ID NO: 42961 - protein, 9 aa, Homo sapiens
  light chain complementarity determining region 3 for antibody 21481
QQYGDPPVT

SEQ ID NO: 42962 - protein, 18 aa, Homo sapiens
  heavy chain complementarity determining region 3 for antibody 21481
AKIADAAFSASHRGYFDD

SEQ ID NO: 42963 - protein, 10 aa, Homo sapiens
  light chain complementarity determining region 3 for antibody 21482
QQYGDPPLST

SEQ ID NO: 42964 - protein, 10 aa, Homo sapiens
  heavy chain complementarity determining region 3 for antibody 21482
VRAGYYCLDY

SEQ ID NO: 42965 - protein, 9 aa, Homo sapiens
  light chain complementarity determining region 3 for antibody 21483
QQYGCSPRT

SEQ ID NO: 42966 - protein, 25 aa, Homo sapiens
  heavy chain complementarity determining region 3 for antibody 21483
ARLRIDRLRLPGAMRGPLYDCGLNV

SEQ ID NO: 42967 - protein, 9 aa, Homo sapiens
  light chain complementarity determining region 3 for antibody 21484
QQYGCIPRT

SEQ ID NO: 42968 - protein, 13 aa, Homo sapiens
  heavy chain complementarity determining region 3 for antibody 21484
AGGSFSGGNYKED

SEQ ID NO: 42969 - protein, 9 aa, Homo sapiens
  light chain complementarity determining region 3 for antibody 21485
QQYGATPRT

SEQ ID NO: 42970 - protein, 13 aa, Homo sapiens
  heavy chain complementarity determining region 3 for antibody 21485
ASGYGSGASYRDN

SEQ ID NO: 42971 - protein, 9 aa, Homo sapiens
  light chain complementarity determining region 3 for antibody 21486
QQYFTTPRP

SEQ ID NO: 42972 - protein, 8 aa, Homo sapiens
  heavy chain complementarity determining region 3 for antibody 21486
ARDGAFDS

SEQ ID NO: 42973 - protein, 9 aa, Homo sapiens
  light chain complementarity determining region 3 for antibody 21487
QQYFTTPIT

SEQ ID NO: 42974 - protein, 10 aa, Homo sapiens
  heavy chain complementarity determining region 3 for antibody 21487
ARSGGSGWDS

SEQ ID NO: 42975 - protein, 9 aa, Homo sapiens
  light chain complementarity determining region 3 for antibody 21488
QQYFTSVRT

SEQ ID NO: 42976 - protein, 12 aa, Homo sapiens
  heavy chain complementarity determining region 3 for antibody 21488
VKDCGLGGSRDS

SEQ ID NO: 42977 - protein, 9 aa, Homo sapiens
  light chain complementarity determining region 3 for antibody 21489
QQYFTSVRT

SEQ ID NO: 42978 - protein, 12 aa, Homo sapiens
  heavy chain complementarity determining region 3 for antibody 21489
VKDCGLGGSRDF

SEQ ID NO: 42979 - protein, 9 aa, Homo sapiens
  light chain complementarity determining region 3 for antibody 21490
QQYFTSVRK

SEQ ID NO: 42980 - protein, 12 aa, Homo sapiens
  heavy chain complementarity determining region 3 for antibody 21490
VKDCGLGGSRDS

SEQ ID NO: 42981 - protein, 9 aa, Homo sapiens
  light chain complementarity determining region 3 for antibody 21491
QQYFTSPPT

SEQ ID NO: 42982 - protein, 15 aa, Homo sapiens
  heavy chain complementarity determining region 3 for antibody 21491
VKVLMSGAQIALFDQ

SEQ ID NO: 42983 - protein, 9 aa, Homo sapiens
  light chain complementarity determining region 3 for antibody 21492
QQYFTSPPI

SEQ ID NO: 42984 - protein, 15 aa, Homo sapiens
  heavy chain complementarity determining region 3 for antibody 21492
VKVLMSGTQIALFDQ

SEQ ID NO: 42985 - protein, 9 aa, Homo sapiens
  light chain complementarity determining region 3 for antibody 21493
QQYFTIPPT

SEQ ID NO: 42986 - protein, 15 aa, Homo sapiens
  heavy chain complementarity determining region 3 for antibody 21493
VKVLMSGTQIALFDQ

SEQ ID NO: 42987 - protein, 9 aa, Homo sapiens
  light chain complementarity determining region 3 for antibody 21494
QQYFTGPPT

SEQ ID NO: 42988 - protein, 15 aa, Homo sapiens
  heavy chain complementarity determining region 3 for antibody 21494
VKVLMSGTQIALFDQ

SEQ ID NO: 42989 - protein, 9 aa, Homo sapiens
  light chain complementarity determining region 3 for antibody 21495
QQYFTCPPT

SEQ ID NO: 42990 - protein, 15 aa, Homo sapiens
  heavy chain complementarity determining region 3 for antibody 21495
VKVLMSGTQIALFDQ

SEQ ID NO: 42991 - protein, 9 aa, Homo sapiens
  light chain complementarity determining region 3 for antibody 21496
QQYFTCPPP

SEQ ID NO: 42992 - protein, 15 aa, Homo sapiens
  heavy chain complementarity determining region 3 for antibody 21496
VKVLMSGTQIALFDQ

SEQ ID NO: 42993 - protein, 9 aa, Homo sapiens
  light chain complementarity determining region 3 for antibody 21497
QQYFSSPPT

SEQ ID NO: 42994 - protein, 15 aa, Homo sapiens
  heavy chain complementarity determining region 3 for antibody 21497
VKVLMSGTQIALFDQ

SEQ ID NO: 42995 - protein, 9 aa, Homo sapiens
  light chain complementarity determining region 3 for antibody 21498
QQYFSPPRT

SEQ ID NO: 42996 - protein, 20 aa, Homo sapiens
  heavy chain complementarity determining region 3 for antibody 21498
ARGVYDSDWGTYHYEGWFDP

SEQ ID NO: 42997 - protein, 10 aa, Homo sapiens
  light chain complementarity determining region 3 for antibody 21499
QQYFRTPPYT

SEQ ID NO: 42998 - protein, 16 aa, Homo sapiens
  heavy chain complementarity determining region 3 for antibody 21499
VGDISLAMSSRRGFVY

SEQ ID NO: 42999 - protein, 9 aa, Homo sapiens
  light chain complementarity determining region 3 for antibody 21500
QQYFITPRT

SEQ ID NO: 43000 - protein, 20 aa, Homo sapiens
  heavy chain complementarity determining region 3 for antibody 21500
ARGVYDSDWGTYHYEGWFDP

SEQ ID NO: 43001 - protein, 9 aa, Homo sapiens
  light chain complementarity determining region 3 for antibody 21501
QQYFISLRT

SEQ ID NO: 43002 - protein, 12 aa, Homo sapiens
  heavy chain complementarity determining region 3 for antibody 21501
VKDCGLGGSRDS

SEQ ID NO: 43003 - protein, 9 aa, Homo sapiens
  light chain complementarity determining region 3 for antibody 21502
QQYFGTPLT

SEQ ID NO: 43004 - protein, 16 aa, Homo sapiens
  heavy chain complementarity determining region 3 for antibody 21502
VKAPGYTNGYDFFFHH

SEQ ID NO: 43005 - protein, 11 aa, Homo sapiens
  light chain complementarity determining region 3 for antibody 21503
QQYETSPPGYP

SEQ ID NO: 43006 - protein, 14 aa, Homo sapiens
  heavy chain complementarity determining region 3 for antibody 21503
ARETSNSRKRSFDQ

SEQ ID NO: 43007 - protein, 9 aa, Homo sapiens
  light chain complementarity determining region 3 for antibody 21504
QQYESSPWT

SEQ ID NO: 43008 - protein, 18 aa, Homo sapiens
  heavy chain complementarity determining region 3 for antibody 21504
ARQIDYGDYASYHGYFDV

SEQ ID NO: 43009 - protein, 9 aa, Homo sapiens
  light chain complementarity determining region 3 for antibody 21505
QQYESSPWP

SEQ ID NO: 43010 - protein, 18 aa, Homo sapiens
  heavy chain complementarity determining region 3 for antibody 21505
ARQIDYGDYASYHGYCDV

SEQ ID NO: 43011 - protein, 9 aa, Homo sapiens
  light chain complementarity determining region 3 for antibody 21506
QQYERSPQN

SEQ ID NO: 43012 - protein, 15 aa, Homo sapiens
  heavy chain complementarity determining region 3 for antibody 21506
ARDPTVASHHYGVDV

SEQ ID NO: 43013 - protein, 9 aa, Homo sapiens
  light chain complementarity determining region 3 for antibody 21507
QQYERSPKT

SEQ ID NO: 43014 - protein, 15 aa, Homo sapiens
  heavy chain complementarity determining region 3 for antibody 21507
ARDPTVASHHYGVDV

SEQ ID NO: 43015 - protein, 9 aa, Homo sapiens
  light chain complementarity determining region 3 for antibody 21508
QQYERPPPT

SEQ ID NO: 43016 - protein, 15 aa, Homo sapiens
  heavy chain complementarity determining region 3 for antibody 21508
ARDPTVASHHYGVDV

SEQ ID NO: 43017 - protein, 9 aa, Homo sapiens
  light chain complementarity determining region 3 for antibody 21509
QQYERLPYT

SEQ ID NO: 43018 - protein, 22 aa, Homo sapiens
  heavy chain complementarity determining region 3 for antibody 21509
ARDEGYFDNSWGHYRHKGIFDS

SEQ ID NO: 43019 - protein, 9 aa, Homo sapiens
  light chain complementarity determining region 3 for antibody 21510
QQYERAPQT

SEQ ID NO: 43020 - protein, 15 aa, Homo sapiens
  heavy chain complementarity determining region 3 for antibody 21510
ARDPTVASHHYGVDV

SEQ ID NO: 43021 - protein, 8 aa, Homo sapiens
  light chain complementarity determining region 3 for antibody 21511
QQYENLVT

SEQ ID NO: 43022 - protein, 18 aa, Homo sapiens
  heavy chain complementarity determining region 3 for antibody 21511
ARGAEGSCSVRKCYPFDY

SEQ ID NO: 43023 - protein, 8 aa, Homo sapiens
  light chain complementarity determining region 3 for antibody 21512
QQYENLVT

SEQ ID NO: 43024 - protein, 18 aa, Homo sapiens
  heavy chain complementarity determining region 3 for antibody 21512
AKGSEGSCSVRKCYPFDY

SEQ ID NO: 43025 - protein, 8 aa, Homo sapiens
  light chain complementarity determining region 3 for antibody 21513
QQYENLVT

SEQ ID NO: 43026 - protein, 18 aa, Homo sapiens
  heavy chain complementarity determining region 3 for antibody 21513
AKGAEGSCSVRKRYPFDY

SEQ ID NO: 43027 - protein, 8 aa, Homo sapiens
  light chain complementarity determining region 3 for antibody 21514
QQYENLVT

SEQ ID NO: 43028 - protein, 18 aa, Homo sapiens
  heavy chain complementarity determining region 3 for antibody 21514
AKGAEGSCSVRKCYPVDY

SEQ ID NO: 43029 - protein, 8 aa, Homo sapiens
  light chain complementarity determining region 3 for antibody 21515
QQYENLVT

SEQ ID NO: 43030 - protein, 18 aa, Homo sapiens
  heavy chain complementarity determining region 3 for antibody 21515
AKGAEGSCSVRKCYPFDD

SEQ ID NO: 43031 - protein, 8 aa, Homo sapiens
  light chain complementarity determining region 3 for antibody 21516
QQYENLVN

SEQ ID NO: 43032 - protein, 18 aa, Homo sapiens
  heavy chain complementarity determining region 3 for antibody 21516
AKGAEGSCSVRKCYPFDY

SEQ ID NO: 43033 - protein, 8 aa, Homo sapiens
  light chain complementarity determining region 3 for antibody 21517
QQYEKLVT

SEQ ID NO: 43034 - protein, 18 aa, Homo sapiens
  heavy chain complementarity determining region 3 for antibody 21517
AKGAEGSCSVRKCYPFDY

SEQ ID NO: 43035 - protein, 8 aa, Homo sapiens
  light chain complementarity determining region 3 for antibody 21518
QQYEHLVT

SEQ ID NO: 43036 - protein, 18 aa, Homo sapiens
  heavy chain complementarity determining region 3 for antibody 21518
AKGAEGSCSVRKCYPFDY

SEQ ID NO: 43037 - protein, 9 aa, Homo sapiens
  light chain complementarity determining region 3 for antibody 21519
QQYDVSPLT

SEQ ID NO: 43038 - protein, 22 aa, Homo sapiens
  heavy chain complementarity determining region 3 for antibody 21519
ARGSRPYGIYAYPLIPYSFFDD

SEQ ID NO: 43039 - protein, 9 aa, Homo sapiens
  light chain complementarity determining region 3 for antibody 21520
QQYDTYPPT

SEQ ID NO: 43040 - protein, 19 aa, Homo sapiens
  heavy chain complementarity determining region 3 for antibody 21520
ARESERLAWGKVTYNHFDP

SEQ ID NO: 43041 - protein, 9 aa, Homo sapiens
  light chain complementarity determining region 3 for antibody 21521
QQYDTSPWT

SEQ ID NO: 43042 - protein, 16 aa, Homo sapiens
  heavy chain complementarity determining region 3 for antibody 21521
ARLSGDWGSAPHFFDT

SEQ ID NO: 43043 - protein, 11 aa, Homo sapiens
  light chain complementarity determining region 3 for antibody 21522
QQYDTSPTGYT

SEQ ID NO: 43044 - protein, 14 aa, Homo sapiens
  heavy chain complementarity determining region 3 for antibody 21522
ARETSNSRKRSFDQ

SEQ ID NO: 43045 - protein, 11 aa, Homo sapiens
  light chain complementarity determining region 3 for antibody 21523
QQYDTSPSGYT

SEQ ID NO: 43046 - protein, 14 aa, Homo sapiens
  heavy chain complementarity determining region 3 for antibody 21523
ARETSNSRKRSFDQ

SEQ ID NO: 43047 - protein, 11 aa, Homo sapiens
  light chain complementarity determining region 3 for antibody 21524
QQYDTSPPGYT

SEQ ID NO: 43048 - protein, 14 aa, Homo sapiens
  heavy chain complementarity determining region 3 for antibody 21524
ARETSNSRKRSCDQ

SEQ ID NO: 43049 - protein, 11 aa, Homo sapiens
  light chain complementarity determining region 3 for antibody 21525
QQYDTSPPGYT

SEQ ID NO: 43050 - protein, 14 aa, Homo sapiens
  heavy chain complementarity determining region 3 for antibody 21525
ARETSNPRKRSFDQ

SEQ ID NO: 43051 - protein, 11 aa, Homo sapiens
  light chain complementarity determining region 3 for antibody 21526
QQYDTSPPGYT

SEQ ID NO: 43052 - protein, 14 aa, Homo sapiens
  heavy chain complementarity determining region 3 for antibody 21526
AREPSNSRKRSFDQ

SEQ ID NO: 43053 - protein, 11 aa, Homo sapiens
  light chain complementarity determining region 3 for antibody 21527
QQYDTSPPGYA

SEQ ID NO: 43054 - protein, 14 aa, Homo sapiens
  heavy chain complementarity determining region 3 for antibody 21527
ARETSNSRKRSFDQ

SEQ ID NO: 43055 - protein, 11 aa, Homo sapiens
  light chain complementarity determining region 3 for antibody 21528
QQYDTSPPGHT

SEQ ID NO: 43056 - protein, 14 aa, Homo sapiens
  heavy chain complementarity determining region 3 for antibody 21528
ARETSNSRKRSFDQ

SEQ ID NO: 43057 - protein, 11 aa, Homo sapiens
  light chain complementarity determining region 3 for antibody 21529
QQYDTSPPGFT

SEQ ID NO: 43058 - protein, 14 aa, Homo sapiens
  heavy chain complementarity determining region 3 for antibody 21529
ARETSNSRKRSFDQ

SEQ ID NO: 43059 - protein, 11 aa, Homo sapiens
  light chain complementarity determining region 3 for antibody 21530
QQYDTSPPGCP

SEQ ID NO: 43060 - protein, 14 aa, Homo sapiens
  heavy chain complementarity determining region 3 for antibody 21530
ARETSNSRKRSFDQ

SEQ ID NO: 43061 - protein, 10 aa, Homo sapiens
  light chain complementarity determining region 3 for antibody 21531
QQYDTSLKWT

SEQ ID NO: 43062 - protein, 15 aa, Homo sapiens
  heavy chain complementarity determining region 3 for antibody 21531
GRLLSPYSHRTPFDP

SEQ ID NO: 43063 - protein, 11 aa, Homo sapiens
  light chain complementarity determining region 3 for antibody 21532
QQYDTPPPGYP

SEQ ID NO: 43064 - protein, 14 aa, Homo sapiens
  heavy chain complementarity determining region 3 for antibody 21532
ARETSNSRKRSFDQ

SEQ ID NO: 43065 - protein, 8 aa, Homo sapiens
  light chain complementarity determining region 3 for antibody 21533
QQYDTLPV

SEQ ID NO: 43066 - protein, 15 aa, Homo sapiens
  heavy chain complementarity determining region 3 for antibody 21533
ARQITSAWNEHAFDY

SEQ ID NO: 43067 - protein, 9 aa, Homo sapiens
  light chain complementarity determining region 3 for antibody 21534
QQYDTFPLT

SEQ ID NO: 43068 - protein, 10 aa, Homo sapiens
  heavy chain complementarity determining region 3 for antibody 21534
VHGQSMLVAY

SEQ ID NO: 43069 - protein, 9 aa, Homo sapiens
  light chain complementarity determining region 3 for antibody 21535
QQYDSYPWT

SEQ ID NO: 43070 - protein, 20 aa, Homo sapiens
  heavy chain complementarity determining region 3 for antibody 21535
ARVAPFLYYGAGHRRAYLDR

SEQ ID NO: 43071 - protein, 9 aa, Homo sapiens
  light chain complementarity determining region 3 for antibody 21536
QQYDSYPIT

SEQ ID NO: 43072 - protein, 12 aa, Homo sapiens
  heavy chain complementarity determining region 3 for antibody 21536
ARERASVVPFDS

SEQ ID NO: 43073 - protein, 9 aa, Homo sapiens
  light chain complementarity determining region 3 for antibody 21537
QQYDSSPVT

SEQ ID NO: 43074 - protein, 20 aa, Homo sapiens
  heavy chain complementarity determining region 3 for antibody 21537
ARRPVVSGWYRTGISSWFDP

SEQ ID NO: 43075 - protein, 9 aa, Homo sapiens
  light chain complementarity determining region 3 for antibody 21538
QQYDSSPRT

SEQ ID NO: 43076 - protein, 25 aa, Homo sapiens
  heavy chain complementarity determining region 3 for antibody 21538
ARLRIDRLRLPGAMRGPLYDCGLNV

SEQ ID NO: 43077 - protein, 9 aa, Homo sapiens
  light chain complementarity determining region 3 for antibody 21539
QQYDSSPQT

SEQ ID NO: 43078 - protein, 14 aa, Homo sapiens
  heavy chain complementarity determining region 3 for antibody 21539
ARDSPHRLERYFDL

SEQ ID NO: 43079 - protein, 9 aa, Homo sapiens
  light chain complementarity determining region 3 for antibody 21540
QQYDSSPLT

SEQ ID NO: 43080 - protein, 19 aa, Homo sapiens
  heavy chain complementarity determining region 3 for antibody 21540
ARGSSSSRRRAAVVGYFDL

SEQ ID NO: 43081 - protein, 9 aa, Homo sapiens
  light chain complementarity determining region 3 for antibody 21541
QQYDSSPLT

SEQ ID NO: 43082 - protein, 14 aa, Homo sapiens
  heavy chain complementarity determining region 3 for antibody 21541
ARDNPHRLERYFDL

SEQ ID NO: 43083 - protein, 10 aa, Homo sapiens
  light chain complementarity determining region 3 for antibody 21542
QQYDSLRLYT

SEQ ID NO: 43084 - protein, 28 aa, Homo sapiens
  heavy chain complementarity determining region 3 for antibody 21542
VRRSLTTKYYDYVWGNYRSLDPTDAFDV

SEQ ID NO: 43085 - protein, 10 aa, Homo sapiens
  light chain complementarity determining region 3 for antibody 21543
QQYDSLRLYT

SEQ ID NO: 43086 - protein, 28 aa, Homo sapiens
  heavy chain complementarity determining region 3 for antibody 21543
ARRSRTTKYYDYVWGNYRSLDPTDAFDV

SEQ ID NO: 43087 - protein, 10 aa, Homo sapiens
  light chain complementarity determining region 3 for antibody 21544
QQYDSLRLYT

SEQ ID NO: 43088 - protein, 28 aa, Homo sapiens
  heavy chain complementarity determining region 3 for antibody 21544
ARRSLTTKYYDYVWGNYRSLDPTYAFDV

SEQ ID NO: 43089 - protein, 10 aa, Homo sapiens
  light chain complementarity determining region 3 for antibody 21545
QQYDSLRLYT

SEQ ID NO: 43090 - protein, 28 aa, Homo sapiens
  heavy chain complementarity determining region 3 for antibody 21545
ARRSLTTKYYDYVWGNYRSLDPPDAFDV

SEQ ID NO: 43091 - protein, 10 aa, Homo sapiens
  light chain complementarity determining region 3 for antibody 21546
QQYDSLRLYT

SEQ ID NO: 43092 - protein, 28 aa, Homo sapiens
  heavy chain complementarity determining region 3 for antibody 21546
ARRSLTTKYYDYVWGNYRALDPTDAFDV

SEQ ID NO: 43093 - protein, 10 aa, Homo sapiens
  light chain complementarity determining region 3 for antibody 21547
QQYDSLRLYT

SEQ ID NO: 43094 - protein, 28 aa, Homo sapiens
  heavy chain complementarity determining region 3 for antibody 21547
ARRSLTAKYYDYVWGNYRSLDPTDAFDV

SEQ ID NO: 43095 - protein, 10 aa, Homo sapiens
  light chain complementarity determining region 3 for antibody 21548
QQYDSLRLYT

SEQ ID NO: 43096 - protein, 28 aa, Homo sapiens
  heavy chain complementarity determining region 3 for antibody 21548
AGRSLTTKYYDYVWGNYRSLDPTDAFDV

SEQ ID NO: 43097 - protein, 10 aa, Homo sapiens
  light chain complementarity determining region 3 for antibody 21549
QQYDSLRLYP

SEQ ID NO: 43098 - protein, 28 aa, Homo sapiens
  heavy chain complementarity determining region 3 for antibody 21549
ARRSLTTKYYDYVWGNYRSLDPTDAFDV

SEQ ID NO: 43099 - protein, 10 aa, Homo sapiens
  light chain complementarity determining region 3 for antibody 21550
QQYDSLRLST

SEQ ID NO: 43100 - protein, 28 aa, Homo sapiens
  heavy chain complementarity determining region 3 for antibody 21550
ARRSLTTKYYDYVWGNYRSLDPTDAFDV

SEQ ID NO: 43101 - protein, 9 aa, Homo sapiens
  light chain complementarity determining region 3 for antibody 21551
QQYDSLPQT

SEQ ID NO: 43102 - protein, 14 aa, Homo sapiens
  heavy chain complementarity determining region 3 for antibody 21551
ARDNPHRLERYFDL

SEQ ID NO: 43103 - protein, 9 aa, Homo sapiens
  light chain complementarity determining region 3 for antibody 21552
QQYDSLPLT

SEQ ID NO: 43104 - protein, 20 aa, Homo sapiens
  heavy chain complementarity determining region 3 for antibody 21552
VRGLHIVVSTSFPGNYGVDV

SEQ ID NO: 43105 - protein, 9 aa, Homo sapiens
  light chain complementarity determining region 3 for antibody 21553
QQYDSLPLT

SEQ ID NO: 43106 - protein, 20 aa, Homo sapiens
  heavy chain complementarity determining region 3 for antibody 21553
VRGLHIVVATSFPGNHGVDV

SEQ ID NO: 43107 - protein, 9 aa, Homo sapiens
  light chain complementarity determining region 3 for antibody 21554
QQYDSLPLT

SEQ ID NO: 43108 - protein, 20 aa, Homo sapiens
  heavy chain complementarity determining region 3 for antibody 21554
VRGLHIVVATSFPGNCGVDV

SEQ ID NO: 43109 - protein, 10 aa, Homo sapiens
  light chain complementarity determining region 3 for antibody 21555
QQYDSLCLYT

SEQ ID NO: 43110 - protein, 28 aa, Homo sapiens
  heavy chain complementarity determining region 3 for antibody 21555
ARRSLTTKYYDYVWGNYRSLDPTDAFDV

SEQ ID NO: 43111 - protein, 9 aa, Homo sapiens
  light chain complementarity determining region 3 for antibody 21556
QQYDSFPWP

SEQ ID NO: 43112 - protein, 26 aa, Homo sapiens
  heavy chain complementarity determining region 3 for antibody 21556
ARDKNDLYTSVLRGTLFTNYYYGMNV

SEQ ID NO: 43113 - protein, 9 aa, Homo sapiens
  light chain complementarity determining region 3 for antibody 21557
QQYDSFPRT

SEQ ID NO: 43114 - protein, 26 aa, Homo sapiens
  heavy chain complementarity determining region 3 for antibody 21557
ARDKNDLYTSVLRGTLFTNYYYGMNV

SEQ ID NO: 43115 - protein, 11 aa, Homo sapiens
  light chain complementarity determining region 3 for antibody 21558
QQYDRSPPGSP

SEQ ID NO: 43116 - protein, 14 aa, Homo sapiens
  heavy chain complementarity determining region 3 for antibody 21558
ARDTHNSRKRSFDQ

SEQ ID NO: 43117 - protein, 11 aa, Homo sapiens
  light chain complementarity determining region 3 for antibody 21559
QQYDRSPPGNT

SEQ ID NO: 43118 - protein, 14 aa, Homo sapiens
  heavy chain complementarity determining region 3 for antibody 21559
ARDTHNSRKRSFDQ

SEQ ID NO: 43119 - protein, 11 aa, Homo sapiens
  light chain complementarity determining region 3 for antibody 21560
QQYDRSPPGHT

SEQ ID NO: 43120 - protein, 14 aa, Homo sapiens
  heavy chain complementarity determining region 3 for antibody 21560
ARDTHNSRKRSFDQ

SEQ ID NO: 43121 - protein, 9 aa, Homo sapiens
  light chain complementarity determining region 3 for antibody 21561
QQYDRKPFT

SEQ ID NO: 43122 - protein, 14 aa, Homo sapiens
  heavy chain complementarity determining region 3 for antibody 21561
ARDNSNNWYEGMDV

SEQ ID NO: 43123 - protein, 9 aa, Homo sapiens
  light chain complementarity determining region 3 for antibody 21562
QQYDRKPFT

SEQ ID NO: 43124 - protein, 14 aa, Homo sapiens
  heavy chain complementarity determining region 3 for antibody 21562
ARDNSHNWYEGMDV

SEQ ID NO: 43125 - protein, 10 aa, Homo sapiens
  light chain complementarity determining region 3 for antibody 21563
QQYDQWPPLT

SEQ ID NO: 43126 - protein, 17 aa, Homo sapiens
  heavy chain complementarity determining region 3 for antibody 21563
ARDLYFSIIQGGGAFDA

SEQ ID NO: 43127 - protein, 9 aa, Homo sapiens
  light chain complementarity determining region 3 for antibody 21564
QQYDNWPYT

SEQ ID NO: 43128 - protein, 13 aa, Homo sapiens
  heavy chain complementarity determining region 3 for antibody 21564
GRGNGGSDGSDWL

SEQ ID NO: 43129 - protein, 9 aa, Homo sapiens
  light chain complementarity determining region 3 for antibody 21565
QQYDNWPWT

SEQ ID NO: 43130 - protein, 13 aa, Homo sapiens
  heavy chain complementarity determining region 3 for antibody 21565
ASGGVFYHNVFDT

SEQ ID NO: 43131 - protein, 9 aa, Homo sapiens
  light chain complementarity determining region 3 for antibody 21566
QQYDNWPWT

SEQ ID NO: 43132 - protein, 13 aa, Homo sapiens
  heavy chain complementarity determining region 3 for antibody 21566
ASGGVFYHNFFDS

SEQ ID NO: 43133 - protein, 9 aa, Homo sapiens
  light chain complementarity determining region 3 for antibody 21567
QQYDNWPRT

SEQ ID NO: 43134 - protein, 20 aa, Homo sapiens
  heavy chain complementarity determining region 3 for antibody 21567
ARIPHFFYDSSDYYHPVFDY

SEQ ID NO: 43135 - protein, 10 aa, Homo sapiens
  light chain complementarity determining region 3 for antibody 21568
QQYDNWPPWT

SEQ ID NO: 43136 - protein, 12 aa, Homo sapiens
  heavy chain complementarity determining region 3 for antibody 21568
AKTLREREELDY

SEQ ID NO: 43137 - protein, 10 aa, Homo sapiens
  light chain complementarity determining region 3 for antibody 21569
QQYDNWPPWT

SEQ ID NO: 43138 - protein, 12 aa, Homo sapiens
  heavy chain complementarity determining region 3 for antibody 21569
AKSLRERKELDY

SEQ ID NO: 43139 - protein, 10 aa, Homo sapiens
  light chain complementarity determining region 3 for antibody 21570
QQYDNWPPWT

SEQ ID NO: 43140 - protein, 12 aa, Homo sapiens
  heavy chain complementarity determining region 3 for antibody 21570
AKPLRERKDLDY

SEQ ID NO: 43141 - protein, 10 aa, Homo sapiens
  light chain complementarity determining region 3 for antibody 21571
QQYDNWPPWK

SEQ ID NO: 43142 - protein, 12 aa, Homo sapiens
  heavy chain complementarity determining region 3 for antibody 21571
AKTLRERKELDY

SEQ ID NO: 43143 - protein, 10 aa, Homo sapiens
  light chain complementarity determining region 3 for antibody 21572
QQYDNWPPLT

SEQ ID NO: 43144 - protein, 15 aa, Homo sapiens
  heavy chain complementarity determining region 3 for antibody 21572
AKEPDGGRNCLFFES

SEQ ID NO: 43145 - protein, 9 aa, Homo sapiens
  light chain complementarity determining region 3 for antibody 21573
QQYDNVQST

SEQ ID NO: 43146 - protein, 17 aa, Homo sapiens
  heavy chain complementarity determining region 3 for antibody 21573
AKERFIRGLRLGGVFDS

SEQ ID NO: 43147 - protein, 9 aa, Homo sapiens
  light chain complementarity determining region 3 for antibody 21574
QQYDNVQSN

SEQ ID NO: 43148 - protein, 17 aa, Homo sapiens
  heavy chain complementarity determining region 3 for antibody 21574
AKERFIRWLRLGGVFDS

SEQ ID NO: 43149 - protein, 10 aa, Homo sapiens
  light chain complementarity determining region 3 for antibody 21575
QQYDNVPRFT

SEQ ID NO: 43150 - protein, 23 aa, Homo sapiens
  heavy chain complementarity determining region 3 for antibody 21575
ARSPLRSLESTDYDLLSGGYFDH

SEQ ID NO: 43151 - protein, 10 aa, Homo sapiens
  light chain complementarity determining region 3 for antibody 21576
QQYDNVPRFT

SEQ ID NO: 43152 - protein, 23 aa, Homo sapiens
  heavy chain complementarity determining region 3 for antibody 21576
ARAPLRSLESTDYDLVSGGYFDH

SEQ ID NO: 43153 - protein, 10 aa, Homo sapiens
  light chain complementarity determining region 3 for antibody 21577
QQYDNVPRFT

SEQ ID NO: 43154 - protein, 23 aa, Homo sapiens
  heavy chain complementarity determining region 3 for antibody 21577
ARAALRSLESTDYDLLSGGYFDH

SEQ ID NO: 43155 - protein, 9 aa, Homo sapiens
  light chain complementarity determining region 3 for antibody 21578
QQYDNLQST

SEQ ID NO: 43156 - protein, 17 aa, Homo sapiens
  heavy chain complementarity determining region 3 for antibody 21578
AKERFIRWLRVGGVFDS

SEQ ID NO: 43157 - protein, 9 aa, Homo sapiens
  light chain complementarity determining region 3 for antibody 21579
QQYDNLQST

SEQ ID NO: 43158 - protein, 17 aa, Homo sapiens
  heavy chain complementarity determining region 3 for antibody 21579
AKERFIRWLRLGGVVDS

SEQ ID NO: 43159 - protein, 9 aa, Homo sapiens
  light chain complementarity determining region 3 for antibody 21580
QQYDNLQST

SEQ ID NO: 43160 - protein, 17 aa, Homo sapiens
  heavy chain complementarity determining region 3 for antibody 21580
AKERFIRWLRLGGVFGS

SEQ ID NO: 43161 - protein, 9 aa, Homo sapiens
  light chain complementarity determining region 3 for antibody 21581
QQYDNLQSP

SEQ ID NO: 43162 - protein, 17 aa, Homo sapiens
  heavy chain complementarity determining region 3 for antibody 21581
AKERFIRWLRLGGVFDS

SEQ ID NO: 43163 - protein, 9 aa, Homo sapiens
  light chain complementarity determining region 3 for antibody 21582
QQYDNLQFT

SEQ ID NO: 43164 - protein, 17 aa, Homo sapiens
  heavy chain complementarity determining region 3 for antibody 21582
AKERFIRWLRLGGVFDS

SEQ ID NO: 43165 - protein, 9 aa, Homo sapiens
  light chain complementarity determining region 3 for antibody 21583
QQYDNLPYT

SEQ ID NO: 43166 - protein, 13 aa, Homo sapiens
  heavy chain complementarity determining region 3 for antibody 21583
ARSRHLAAGAGDY

SEQ ID NO: 43167 - protein, 8 aa, Homo sapiens
  light chain complementarity determining region 3 for antibody 21584
QQYDNLPV

SEQ ID NO: 43168 - protein, 15 aa, Homo sapiens
  heavy chain complementarity determining region 3 for antibody 21584
ARQIASAWNEHAFDY

SEQ ID NO: 43169 - protein, 9 aa, Homo sapiens
  light chain complementarity determining region 3 for antibody 21585
QQYDNLPNT

SEQ ID NO: 43170 - protein, 12 aa, Homo sapiens
  heavy chain complementarity determining region 3 for antibody 21585
ARDRVASGGFDP

SEQ ID NO: 43171 - protein, 9 aa, Homo sapiens
  light chain complementarity determining region 3 for antibody 21586
QQYDNLPLT

SEQ ID NO: 43172 - protein, 10 aa, Homo sapiens
  heavy chain complementarity determining region 3 for antibody 21586
VHGQSMLVAY

SEQ ID NO: 43173 - protein, 9 aa, Homo sapiens
  light chain complementarity determining region 3 for antibody 21587
QQYDNFQST

SEQ ID NO: 43174 - protein, 17 aa, Homo sapiens
  heavy chain complementarity determining region 3 for antibody 21587
AKERFIRWLRLGGVFDS

SEQ ID NO: 43175 - protein, 10 aa, Homo sapiens
  light chain complementarity determining region 3 for antibody 21588
QQYDNFPPFT

SEQ ID NO: 43176 - protein, 21 aa, Homo sapiens
  heavy chain complementarity determining region 3 for antibody 21588
AKASGSIAVSTSRYYYYAMDV

SEQ ID NO: 43177 - protein, 9 aa, Homo sapiens
  light chain complementarity determining region 3 for antibody 21589
QQYDLIPPS

SEQ ID NO: 43178 - protein, 21 aa, Homo sapiens
  heavy chain complementarity determining region 3 for antibody 21589
ARGLHIVVVTSILRGFWYFGL

SEQ ID NO: 43179 - protein, 10 aa, Homo sapiens
  light chain complementarity determining region 3 for antibody 21590
QQYDIWPPWT

SEQ ID NO: 43180 - protein, 14 aa, Homo sapiens
  heavy chain complementarity determining region 3 for antibody 21590
TAAQPVGWGYYFVS

SEQ ID NO: 43181 - protein, 10 aa, Homo sapiens
  light chain complementarity determining region 3 for antibody 21591
QQYDIWPPWT

SEQ ID NO: 43182 - protein, 14 aa, Homo sapiens
  heavy chain complementarity determining region 3 for antibody 21591
TAAQPVGWGYYFGY

SEQ ID NO: 43183 - protein, 10 aa, Homo sapiens
  light chain complementarity determining region 3 for antibody 21592
QQYDIWPPWT

SEQ ID NO: 43184 - protein, 14 aa, Homo sapiens
  heavy chain complementarity determining region 3 for antibody 21592
TAAQPVGWGYYFDY

SEQ ID NO: 43185 - protein, 10 aa, Homo sapiens
  light chain complementarity determining region 3 for antibody 21593
QQYDIWPPGT

SEQ ID NO: 43186 - protein, 14 aa, Homo sapiens
  heavy chain complementarity determining region 3 for antibody 21593
TAAQPVGWGYYFVY

SEQ ID NO: 43187 - protein, 10 aa, Homo sapiens
  light chain complementarity determining region 3 for antibody 21594
QQYDDWPPWT

SEQ ID NO: 43188 - protein, 16 aa, Homo sapiens
  heavy chain complementarity determining region 3 for antibody 21594
GGSRTSAQQLVAPIHY

SEQ ID NO: 43189 - protein, 9 aa, Homo sapiens
  light chain complementarity determining region 3 for antibody 21595
QQYDDLPYT

SEQ ID NO: 43190 - protein, 11 aa, Homo sapiens
  heavy chain complementarity determining region 3 for antibody 21595
AAQSVGFGEVP

SEQ ID NO: 43191 - protein, 9 aa, Homo sapiens
  light chain complementarity determining region 3 for antibody 21596
QQYDDLPYS

SEQ ID NO: 43192 - protein, 16 aa, Homo sapiens
  heavy chain complementarity determining region 3 for antibody 21596
ARDLARWNPVPGAFDI

SEQ ID NO: 43193 - protein, 9 aa, Homo sapiens
  light chain complementarity determining region 3 for antibody 21597
QQYDDLPSS

SEQ ID NO: 43194 - protein, 16 aa, Homo sapiens
  heavy chain complementarity determining region 3 for antibody 21597
ARDLARWNPVTGAFDI

SEQ ID NO: 43195 - protein, 9 aa, Homo sapiens
  light chain complementarity determining region 3 for antibody 21598
QQYDDLPPA

SEQ ID NO: 43196 - protein, 16 aa, Homo sapiens
  heavy chain complementarity determining region 3 for antibody 21598
ARGSCPGSSGWGPLGS

SEQ ID NO: 43197 - protein, 9 aa, Homo sapiens
  light chain complementarity determining region 3 for antibody 21599
QQYDDLPNS

SEQ ID NO: 43198 - protein, 16 aa, Homo sapiens
  heavy chain complementarity determining region 3 for antibody 21599
ARDLARWNPVTGAFDI

SEQ ID NO: 43199 - protein, 9 aa, Homo sapiens
  light chain complementarity determining region 3 for antibody 21600
QQYDDLPHT

SEQ ID NO: 43200 - protein, 11 aa, Homo sapiens
  heavy chain complementarity determining region 3 for antibody 21600
AAQSVGFGELP

SEQ ID NO: 43201 - protein, 9 aa, Homo sapiens
  light chain complementarity determining region 3 for antibody 21601
QQYDAQSWR

SEQ ID NO: 43202 - protein, 11 aa, Homo sapiens
  heavy chain complementarity determining region 3 for antibody 21601
ARGWRDNSFDY

SEQ ID NO: 43203 - protein, 9 aa, Homo sapiens
  light chain complementarity determining region 3 for antibody 21602
QQYDAQSWP

SEQ ID NO: 43204 - protein, 11 aa, Homo sapiens
  heavy chain complementarity determining region 3 for antibody 21602
ARGWRDNSFDY

SEQ ID NO: 43205 - protein, 6 aa, Homo sapiens
  light chain complementarity determining region 3 for antibody 21603
QQYCTT

SEQ ID NO: 43206 - protein, 12 aa, Homo sapiens
  heavy chain complementarity determining region 3 for antibody 21603
ARDADAGYAQDC

SEQ ID NO: 43207 - protein, 10 aa, Homo sapiens
  light chain complementarity determining region 3 for antibody 21604
QQYCTSPTWT

SEQ ID NO: 43208 - protein, 18 aa, Homo sapiens
  heavy chain complementarity determining region 3 for antibody 21604
ARAPRDTMIVVRYYGMDV

SEQ ID NO: 43209 - protein, 9 aa, Homo sapiens
  light chain complementarity determining region 3 for antibody 21605
QQYCSSPRT

SEQ ID NO: 43210 - protein, 25 aa, Homo sapiens
  heavy chain complementarity determining region 3 for antibody 21605
ARLRIDRLRLPGAMRGPLYDCGLNV

SEQ ID NO: 43211 - protein, 9 aa, Homo sapiens
  light chain complementarity determining region 3 for antibody 21606
QQYCSSLFA

SEQ ID NO: 43212 - protein, 15 aa, Homo sapiens
  heavy chain complementarity determining region 3 for antibody 21606
ARGGKSSSWLSYFDS

SEQ ID NO: 43213 - protein, 9 aa, Homo sapiens
  light chain complementarity determining region 3 for antibody 21607
QQYCRSPST

SEQ ID NO: 43214 - protein, 17 aa, Homo sapiens
  heavy chain complementarity determining region 3 for antibody 21607
AGLSSRLGDGSPSLFDY

SEQ ID NO: 43215 - protein, 9 aa, Homo sapiens
  light chain complementarity determining region 3 for antibody 21608
QQYCRIPRT

SEQ ID NO: 43216 - protein, 13 aa, Homo sapiens
  heavy chain complementarity determining region 3 for antibody 21608
AGGLYDSSGYSEF

SEQ ID NO: 43217 - protein, 9 aa, Homo sapiens
  light chain complementarity determining region 3 for antibody 21609
QQYCGSPRT

SEQ ID NO: 43218 - protein, 13 aa, Homo sapiens
  heavy chain complementarity determining region 3 for antibody 21609
ASGYFDSGAYYEF

SEQ ID NO: 43219 - protein, 11 aa, Homo sapiens
  light chain complementarity determining region 3 for antibody 21610
QQYCASPPGFT

SEQ ID NO: 43220 - protein, 14 aa, Homo sapiens
  heavy chain complementarity determining region 3 for antibody 21610
ARSPSNSRNRSFDQ

SEQ ID NO: 43221 - protein, 11 aa, Homo sapiens
  light chain complementarity determining region 3 for antibody 21611
QQYCASPPGFP

SEQ ID NO: 43222 - protein, 14 aa, Homo sapiens
  heavy chain complementarity determining region 3 for antibody 21611
ARSPSNSRNRSFDQ

SEQ ID NO: 43223 - protein, 9 aa, Homo sapiens
  light chain complementarity determining region 3 for antibody 21612
QQYATSPRA

SEQ ID NO: 43224 - protein, 15 aa, Homo sapiens
  heavy chain complementarity determining region 3 for antibody 21612
ARDGNVLATGYPLDY

SEQ ID NO: 43225 - protein, 10 aa, Homo sapiens
  light chain complementarity determining region 3 for antibody 21613
QQYATSPPWT

SEQ ID NO: 43226 - protein, 16 aa, Homo sapiens
  heavy chain complementarity determining region 3 for antibody 21613
ARVQWVRRLTKEGLDF

SEQ ID NO: 43227 - protein, 9 aa, Homo sapiens
  light chain complementarity determining region 3 for antibody 21614
QQYATSPLT

SEQ ID NO: 43228 - protein, 15 aa, Homo sapiens
  heavy chain complementarity determining region 3 for antibody 21614
ARDGNVLATGYPLDY

SEQ ID NO: 43229 - protein, 9 aa, Homo sapiens
  light chain complementarity determining region 3 for antibody 21615
QQYATSPFT

SEQ ID NO: 43230 - protein, 10 aa, Homo sapiens
  heavy chain complementarity determining region 3 for antibody 21615
VAGAGWLPDY

SEQ ID NO: 43231 - protein, 9 aa, Homo sapiens
  light chain complementarity determining region 3 for antibody 21616
QQYASSPWT

SEQ ID NO: 43232 - protein, 16 aa, Homo sapiens
  heavy chain complementarity determining region 3 for antibody 21616
ARSRGSSGYQWGAFDL

SEQ ID NO: 43233 - protein, 9 aa, Homo sapiens
  light chain complementarity determining region 3 for antibody 21617
QQYAGSPWT

SEQ ID NO: 43234 - protein, 12 aa, Homo sapiens
  heavy chain complementarity determining region 3 for antibody 21617
VRSHYNPGRVDY

SEQ ID NO: 43235 - protein, 9 aa, Homo sapiens
  light chain complementarity determining region 3 for antibody 21618
QQYAGSPWT

SEQ ID NO: 43236 - protein, 12 aa, Homo sapiens
  heavy chain complementarity determining region 3 for antibody 21618
VRAHYNTGRVDY

SEQ ID NO: 43237 - protein, 9 aa, Homo sapiens
  light chain complementarity determining region 3 for antibody 21619
QQYAGSPLT

SEQ ID NO: 43238 - protein, 12 aa, Homo sapiens
  heavy chain complementarity determining region 3 for antibody 21619
VRSHYNTGRVDY

SEQ ID NO: 43239 - protein, 9 aa, Homo sapiens
  light chain complementarity determining region 3 for antibody 21620
QQYAELPGT

SEQ ID NO: 43240 - protein, 13 aa, Homo sapiens
  heavy chain complementarity determining region 3 for antibody 21620
ATTYYWVVWYFDL

SEQ ID NO: 43241 - protein, 9 aa, Homo sapiens
  light chain complementarity determining region 3 for antibody 21621
QQVYTYPLT

SEQ ID NO: 43242 - protein, 12 aa, Homo sapiens
  heavy chain complementarity determining region 3 for antibody 21621
TRVLSSAIGEWD

SEQ ID NO: 43243 - protein, 9 aa, Homo sapiens
  light chain complementarity determining region 3 for antibody 21622
QQVISYPLT

SEQ ID NO: 43244 - protein, 12 aa, Homo sapiens
  heavy chain complementarity determining region 3 for antibody 21622
ARPLDGDHGFDP

SEQ ID NO: 43245 - protein, 9 aa, Homo sapiens
  light chain complementarity determining region 3 for antibody 21623
QQVISYPFT

SEQ ID NO: 43246 - protein, 12 aa, Homo sapiens
  heavy chain complementarity determining region 3 for antibody 21623
ARPLDGVHGFDP

SEQ ID NO: 43247 - protein, 9 aa, Homo sapiens
  light chain complementarity determining region 3 for antibody 21624
QQVISYPFT

SEQ ID NO: 43248 - protein, 12 aa, Homo sapiens
  heavy chain complementarity determining region 3 for antibody 21624
ARPLDGAHGFDP

SEQ ID NO: 43249 - protein, 9 aa, Homo sapiens
  light chain complementarity determining region 3 for antibody 21625
QQVHIYPPT

SEQ ID NO: 43250 - protein, 12 aa, Homo sapiens
  heavy chain complementarity determining region 3 for antibody 21625
ARDTDGSCGLDV

SEQ ID NO: 43251 - protein, 10 aa, Homo sapiens
  light chain complementarity determining region 3 for antibody 21626
QQVGGSPSYT

SEQ ID NO: 43252 - protein, 16 aa, Homo sapiens
  heavy chain complementarity determining region 3 for antibody 21626
ARGPVMLTAVRSWFDP

SEQ ID NO: 43253 - protein, 9 aa, Homo sapiens
  light chain complementarity determining region 3 for antibody 21627
QQVAGTPHT

SEQ ID NO: 43254 - protein, 9 aa, Homo sapiens
  heavy chain complementarity determining region 3 for antibody 21627
VRGDWGSGY

SEQ ID NO: 43255 - protein, 9 aa, Homo sapiens
  light chain complementarity determining region 3 for antibody 21628
QQTYVSSYT

SEQ ID NO: 43256 - protein, 19 aa, Homo sapiens
  heavy chain complementarity determining region 3 for antibody 21628
ARDGSGGYGSASYGDDFDY

SEQ ID NO: 43257 - protein, 9 aa, Homo sapiens
  light chain complementarity determining region 3 for antibody 21629
QQTYVSSYP

SEQ ID NO: 43258 - protein, 19 aa, Homo sapiens
  heavy chain complementarity determining region 3 for antibody 21629
ARDGPGGYGSASYGDDFDY

SEQ ID NO: 43259 - protein, 9 aa, Homo sapiens
  light chain complementarity determining region 3 for antibody 21630
QQTYVSSHT

SEQ ID NO: 43260 - protein, 19 aa, Homo sapiens
  heavy chain complementarity determining region 3 for antibody 21630
ARDGPGGYGSASYGDDFDY

SEQ ID NO: 43261 - protein, 9 aa, Homo sapiens
  light chain complementarity determining region 3 for antibody 21631
QQTYTSPPT

SEQ ID NO: 43262 - protein, 13 aa, Homo sapiens
  heavy chain complementarity determining region 3 for antibody 21631
ARRYYDSSDYCDI

SEQ ID NO: 43263 - protein, 9 aa, Homo sapiens
  light chain complementarity determining region 3 for antibody 21632
QQTYTFPQT

SEQ ID NO: 43264 - protein, 24 aa, Homo sapiens
  heavy chain complementarity determining region 3 for antibody 21632
ARGSLEYYYDGSGYYYDTGDAYDI

SEQ ID NO: 43265 - protein, 9 aa, Homo sapiens
  light chain complementarity determining region 3 for antibody 21633
QQTYSSPRT

SEQ ID NO: 43266 - protein, 12 aa, Homo sapiens
  heavy chain complementarity determining region 3 for antibody 21633
ARNGAGAYGMDV

SEQ ID NO: 43267 - protein, 9 aa, Homo sapiens
  light chain complementarity determining region 3 for antibody 21634
QQTYSPPFP

SEQ ID NO: 43268 - protein, 14 aa, Homo sapiens
  heavy chain complementarity determining region 3 for antibody 21634
ARGRDTSGYSGLDY

SEQ ID NO: 43269 - protein, 9 aa, Homo sapiens
  light chain complementarity determining region 3 for antibody 21635
QQTYSLPST

SEQ ID NO: 43270 - protein, 19 aa, Homo sapiens
  heavy chain complementarity determining region 3 for antibody 21635
VTPADWRGNSYGWAGSFAS

SEQ ID NO: 43271 - protein, 9 aa, Homo sapiens
  light chain complementarity determining region 3 for antibody 21636
QQTYIPPRT

SEQ ID NO: 43272 - protein, 21 aa, Homo sapiens
  heavy chain complementarity determining region 3 for antibody 21636
ARVTVRVPSTTGFGQYCGLDV

SEQ ID NO: 43273 - protein, 9 aa, Homo sapiens
  light chain complementarity determining region 3 for antibody 21637
QQTYIPPRT

SEQ ID NO: 43274 - protein, 21 aa, Homo sapiens
  heavy chain complementarity determining region 3 for antibody 21637
ARVTVRVPSSTGFGQYYGLDV

SEQ ID NO: 43275 - protein, 9 aa, Homo sapiens
  light chain complementarity determining region 3 for antibody 21638
QQTYIPPLT

SEQ ID NO: 43276 - protein, 21 aa, Homo sapiens
  heavy chain complementarity determining region 3 for antibody 21638
ARVTVRVPSTTGFGQYYGLDV

SEQ ID NO: 43277 - protein, 9 aa, Homo sapiens
  light chain complementarity determining region 3 for antibody 21639
QQTYIALWT

SEQ ID NO: 43278 - protein, 14 aa, Homo sapiens
  heavy chain complementarity determining region 3 for antibody 21639
ARVIPDVGRPYFDH

SEQ ID NO: 43279 - protein, 9 aa, Homo sapiens
  light chain complementarity determining region 3 for antibody 21640
QQTYFLPRT

SEQ ID NO: 43280 - protein, 12 aa, Homo sapiens
  heavy chain complementarity determining region 3 for antibody 21640
ARQGPYQQPVDL

SEQ ID NO: 43281 - protein, 9 aa, Homo sapiens
  light chain complementarity determining region 3 for antibody 21641
QQTYFLPRT

SEQ ID NO: 43282 - protein, 12 aa, Homo sapiens
  heavy chain complementarity determining region 3 for antibody 21641
ARQGPYQQPCDL

SEQ ID NO: 43283 - protein, 9 aa, Homo sapiens
  light chain complementarity determining region 3 for antibody 21642
QQTYFLPRT

SEQ ID NO: 43284 - protein, 12 aa, Homo sapiens
  heavy chain complementarity determining region 3 for antibody 21642
ARQGPYQHPFDL

SEQ ID NO: 43285 - protein, 9 aa, Homo sapiens
  light chain complementarity determining region 3 for antibody 21643
QQTYDSSYT

SEQ ID NO: 43286 - protein, 19 aa, Homo sapiens
  heavy chain complementarity determining region 3 for antibody 21643
ARDGPGGYGSASYGDDFDY

SEQ ID NO: 43287 - protein, 9 aa, Homo sapiens
  light chain complementarity determining region 3 for antibody 21644
QQTYASSYT

SEQ ID NO: 43288 - protein, 19 aa, Homo sapiens
  heavy chain complementarity determining region 3 for antibody 21644
ARDGPGGYGSASYGDDFDY

SEQ ID NO: 43289 - protein, 9 aa, Homo sapiens
  light chain complementarity determining region 3 for antibody 21645
QQTSIPPRT

SEQ ID NO: 43290 - protein, 21 aa, Homo sapiens
  heavy chain complementarity determining region 3 for antibody 21645
ARVTVRVPSTTGFGQYYGLDV

SEQ ID NO: 43291 - protein, 9 aa, Homo sapiens
  light chain complementarity determining region 3 for antibody 21646
QQTNSNPPT

SEQ ID NO: 43292 - protein, 14 aa, Homo sapiens
  heavy chain complementarity determining region 3 for antibody 21646
SRGGLGIWGNSSDI

SEQ ID NO: 43293 - protein, 9 aa, Homo sapiens
  light chain complementarity determining region 3 for antibody 21647
QQTNSNPPT

SEQ ID NO: 43294 - protein, 14 aa, Homo sapiens
  heavy chain complementarity determining region 3 for antibody 21647
ERGGLGIWGNSSDI

SEQ ID NO: 43295 - protein, 9 aa, Homo sapiens
  light chain complementarity determining region 3 for antibody 21648
QQTNSNPPT

SEQ ID NO: 43296 - protein, 14 aa, Homo sapiens
  heavy chain complementarity determining region 3 for antibody 21648
ARGGLVIWGNSSDI

SEQ ID NO: 43297 - protein, 9 aa, Homo sapiens
  light chain complementarity determining region 3 for antibody 21649
QQTNSNPPT

SEQ ID NO: 43298 - protein, 14 aa, Homo sapiens
  heavy chain complementarity determining region 3 for antibody 21649
ARGGLGIWGNPSDI

SEQ ID NO: 43299 - protein, 9 aa, Homo sapiens
  light chain complementarity determining region 3 for antibody 21650
QQTNSNPPT

SEQ ID NO: 43300 - protein, 14 aa, Homo sapiens
  heavy chain complementarity determining region 3 for antibody 21650
ARGGLGIWGNASDI

SEQ ID NO: 43301 - protein, 9 aa, Homo sapiens
  light chain complementarity determining region 3 for antibody 21651
QQTNSNHPT

SEQ ID NO: 43302 - protein, 14 aa, Homo sapiens
  heavy chain complementarity determining region 3 for antibody 21651
ARGGLGIWGNSSDI

SEQ ID NO: 43303 - protein, 9 aa, Homo sapiens
  light chain complementarity determining region 3 for antibody 21652
QQTNRNPPT

SEQ ID NO: 43304 - protein, 14 aa, Homo sapiens
  heavy chain complementarity determining region 3 for antibody 21652
ARGGLGIWGNSSDI

SEQ ID NO: 43305 - protein, 9 aa, Homo sapiens
  light chain complementarity determining region 3 for antibody 21653
QQTHTVPYT

SEQ ID NO: 43306 - protein, 13 aa, Homo sapiens
  heavy chain complementarity determining region 3 for antibody 21653
ARARNYDRISLDF

SEQ ID NO: 43307 - protein, 9 aa, Homo sapiens
  light chain complementarity determining region 3 for antibody 21654
QQTHSFPPS

SEQ ID NO: 43308 - protein, 11 aa, Homo sapiens
  heavy chain complementarity determining region 3 for antibody 21654
VHSPAMAEIDY

SEQ ID NO: 43309 - protein, 9 aa, Homo sapiens
  light chain complementarity determining region 3 for antibody 21655
QQTDRKPFT

SEQ ID NO: 43310 - protein, 14 aa, Homo sapiens
  heavy chain complementarity determining region 3 for antibody 21655
ARDNSNNWYEGMDV

SEQ ID NO: 43311 - protein, 9 aa, Homo sapiens
  light chain complementarity determining region 3 for antibody 21656
QQSYTTPPT

SEQ ID NO: 43312 - protein, 11 aa, Homo sapiens
  heavy chain complementarity determining region 3 for antibody 21656
ARGGNWQSFDY

SEQ ID NO: 43313 - protein, 10 aa, Homo sapiens
  light chain complementarity determining region 3 for antibody 21657
QQSYTTPLFT

SEQ ID NO: 43314 - protein, 17 aa, Homo sapiens
  heavy chain complementarity determining region 3 for antibody 21657
AVYTSTDGIFNKDAFDI

SEQ ID NO: 43315 - protein, 10 aa, Homo sapiens
  light chain complementarity determining region 3 for antibody 21658
QQSYTTPIFT

SEQ ID NO: 43316 - protein, 17 aa, Homo sapiens
  heavy chain complementarity determining region 3 for antibody 21658
AVYASTDGIFNKDAFDI

SEQ ID NO: 43317 - protein, 9 aa, Homo sapiens
  light chain complementarity determining region 3 for antibody 21659
QQSYTTPHT

SEQ ID NO: 43318 - protein, 13 aa, Homo sapiens
  heavy chain complementarity determining region 3 for antibody 21659
ARISSTWPPLFDY

SEQ ID NO: 43319 - protein, 9 aa, Homo sapiens
  light chain complementarity determining region 3 for antibody 21660
QQSYTTLPT

SEQ ID NO: 43320 - protein, 11 aa, Homo sapiens
  heavy chain complementarity determining region 3 for antibody 21660
ARGGNWQYFDY

SEQ ID NO: 43321 - protein, 9 aa, Homo sapiens
  light chain complementarity determining region 3 for antibody 21661
QQSYTSPIT

SEQ ID NO: 43322 - protein, 16 aa, Homo sapiens
  heavy chain complementarity determining region 3 for antibody 21661
ARESGGGSPRHNCFDP

SEQ ID NO: 43323 - protein, 9 aa, Homo sapiens
  light chain complementarity determining region 3 for antibody 21662
QQSYTSFRT

SEQ ID NO: 43324 - protein, 12 aa, Homo sapiens
  heavy chain complementarity determining region 3 for antibody 21662
VKDCGLGGSRDS

SEQ ID NO: 43325 - protein, 9 aa, Homo sapiens
  light chain complementarity determining region 3 for antibody 21663
QQSYTNPPT

SEQ ID NO: 43326 - protein, 11 aa, Homo sapiens
  heavy chain complementarity determining region 3 for antibody 21663
ARGGNWQYFDY

SEQ ID NO: 43327 - protein, 9 aa, Homo sapiens
  light chain complementarity determining region 3 for antibody 21664
QQSYTIPYT

SEQ ID NO: 43328 - protein, 21 aa, Homo sapiens
  heavy chain complementarity determining region 3 for antibody 21664
AKDVLHIDGGRWFQRGGSFNL

SEQ ID NO: 43329 - protein, 9 aa, Homo sapiens
  light chain complementarity determining region 3 for antibody 21665
QQSYSTRRT

SEQ ID NO: 43330 - protein, 12 aa, Homo sapiens
  heavy chain complementarity determining region 3 for antibody 21665
ARPREDGDAFDL

SEQ ID NO: 43331 - protein, 9 aa, Homo sapiens
  light chain complementarity determining region 3 for antibody 21666
QQSYSTRRT

SEQ ID NO: 43332 - protein, 12 aa, Homo sapiens
  heavy chain complementarity determining region 3 for antibody 21666
ARHREDGDAFDI

SEQ ID NO: 43333 - protein, 9 aa, Homo sapiens
  light chain complementarity determining region 3 for antibody 21667
QQSYSTRRR

SEQ ID NO: 43334 - protein, 12 aa, Homo sapiens
  heavy chain complementarity determining region 3 for antibody 21667
ARPREDGDAFDI

SEQ ID NO: 43335 - protein, 9 aa, Homo sapiens
  light chain complementarity determining region 3 for antibody 21668
QQSYSTQWT

SEQ ID NO: 43336 - protein, 23 aa, Homo sapiens
  heavy chain complementarity determining region 3 for antibody 21668
ASLSRDPVAIRAAPLDYYFAMDV

SEQ ID NO: 43337 - protein, 9 aa, Homo sapiens
  light chain complementarity determining region 3 for antibody 21669
QQSYSTQWT

SEQ ID NO: 43338 - protein, 23 aa, Homo sapiens
  heavy chain complementarity determining region 3 for antibody 21669
ARPSRDPVAIRAAPLDYYFAMDV

SEQ ID NO: 43339 - protein, 9 aa, Homo sapiens
  light chain complementarity determining region 3 for antibody 21670
QQSYSTQWT

SEQ ID NO: 43340 - protein, 23 aa, Homo sapiens
  heavy chain complementarity determining region 3 for antibody 21670
ARLSRDPVAIRAAPLDYYFAMGV

SEQ ID NO: 43341 - protein, 9 aa, Homo sapiens
  light chain complementarity determining region 3 for antibody 21671
QQSYSTQWP

SEQ ID NO: 43342 - protein, 23 aa, Homo sapiens
  heavy chain complementarity determining region 3 for antibody 21671
ARLSRDPVAIRAAPLDYYFAMDV

SEQ ID NO: 43343 - protein, 9 aa, Homo sapiens
  light chain complementarity determining region 3 for antibody 21672
QQSYSTQWK

SEQ ID NO: 43344 - protein, 23 aa, Homo sapiens
  heavy chain complementarity determining region 3 for antibody 21672
ARLSRDPVAIRAAPLDYYFAMDV

SEQ ID NO: 43345 - protein, 9 aa, Homo sapiens
  light chain complementarity determining region 3 for antibody 21673
QQSYSTPYT

SEQ ID NO: 43346 - protein, 17 aa, Homo sapiens
  heavy chain complementarity determining region 3 for antibody 21673
AKGRRDAAMVRGRWFDP

SEQ ID NO: 43347 - protein, 9 aa, Homo sapiens
  light chain complementarity determining region 3 for antibody 21674
QQSYSTPWT

SEQ ID NO: 43348 - protein, 13 aa, Homo sapiens
  heavy chain complementarity determining region 3 for antibody 21674
VSVSQWLDDAFDF

SEQ ID NO: 43349 - protein, 9 aa, Homo sapiens
  light chain complementarity determining region 3 for antibody 21675
QQSYSTPWT

SEQ ID NO: 43350 - protein, 13 aa, Homo sapiens
  heavy chain complementarity determining region 3 for antibody 21675
VNVAQWLDDAFDF

SEQ ID NO: 43351 - protein, 9 aa, Homo sapiens
  light chain complementarity determining region 3 for antibody 21676
QQSYSTPWP

SEQ ID NO: 43352 - protein, 13 aa, Homo sapiens
  heavy chain complementarity determining region 3 for antibody 21676
VNVSQWLDDAFDF

SEQ ID NO: 43353 - protein, 10 aa, Homo sapiens
  light chain complementarity determining region 3 for antibody 21677
QQSYSTPSIT

SEQ ID NO: 43354 - protein, 15 aa, Homo sapiens
  heavy chain complementarity determining region 3 for antibody 21677
AAVIYYDGDYYGMDV

SEQ ID NO: 43355 - protein, 9 aa, Homo sapiens
  light chain complementarity determining region 3 for antibody 21678
QQSYSTPRT

SEQ ID NO: 43356 - protein, 11 aa, Homo sapiens
  heavy chain complementarity determining region 3 for antibody 21678
ARDNTFGWFAP

SEQ ID NO: 43357 - protein, 10 aa, Homo sapiens
  light chain complementarity determining region 3 for antibody 21679
QQSYSTPRPT

SEQ ID NO: 43358 - protein, 15 aa, Homo sapiens
  heavy chain complementarity determining region 3 for antibody 21679
ARRDSSGWLEYYFDY

SEQ ID NO: 43359 - protein, 10 aa, Homo sapiens
  light chain complementarity determining region 3 for antibody 21680
QQSYSTPRLT

SEQ ID NO: 43360 - protein, 15 aa, Homo sapiens
  heavy chain complementarity determining region 3 for antibody 21680
ARRDSSGWLEYCFDY

SEQ ID NO: 43361 - protein, 9 aa, Homo sapiens
  light chain complementarity determining region 3 for antibody 21681
QQSYSTPQP

SEQ ID NO: 43362 - protein, 17 aa, Homo sapiens
  heavy chain complementarity determining region 3 for antibody 21681
ASLSYTWNYTPGAYFDY

SEQ ID NO: 43363 - protein, 9 aa, Homo sapiens
  light chain complementarity determining region 3 for antibody 21682
QQSYSTPPT

SEQ ID NO: 43364 - protein, 16 aa, Homo sapiens
  heavy chain complementarity determining region 3 for antibody 21682
SRDNQLHSGSSGVFAY

SEQ ID NO: 43365 - protein, 9 aa, Homo sapiens
  light chain complementarity determining region 3 for antibody 21683
QQSYSTPPT

SEQ ID NO: 43366 - protein, 16 aa, Homo sapiens
  heavy chain complementarity determining region 3 for antibody 21683
SKDILRQWLKLRAFED

SEQ ID NO: 43367 - protein, 9 aa, Homo sapiens
  light chain complementarity determining region 3 for antibody 21684
QQSYSTPPT

SEQ ID NO: 43368 - protein, 16 aa, Homo sapiens
  heavy chain complementarity determining region 3 for antibody 21684
AGISQFWSGFTPGMDV

SEQ ID NO: 43369 - protein, 9 aa, Homo sapiens
  light chain complementarity determining region 3 for antibody 21685
QQSYSTPNT

SEQ ID NO: 43370 - protein, 17 aa, Homo sapiens
  heavy chain complementarity determining region 3 for antibody 21685
ASLSYTWNYTPGAYFDY

SEQ ID NO: 43371 - protein, 10 aa, Homo sapiens
  light chain complementarity determining region 3 for antibody 21686
QQSYSTPLYT

SEQ ID NO: 43372 - protein, 12 aa, Homo sapiens
  heavy chain complementarity determining region 3 for antibody 21686
TSLDWGRSGSDY

SEQ ID NO: 43373 - protein, 10 aa, Homo sapiens
  light chain complementarity determining region 3 for antibody 21687
QQSYSTPLYT

SEQ ID NO: 43374 - protein, 12 aa, Homo sapiens
  heavy chain complementarity determining region 3 for antibody 21687
TRLDWGRSGIDY

SEQ ID NO: 43375 - protein, 10 aa, Homo sapiens
  light chain complementarity determining region 3 for antibody 21688
QQSYSTPLYT

SEQ ID NO: 43376 - protein, 12 aa, Homo sapiens
  heavy chain complementarity determining region 3 for antibody 21688
ARLDWGRSGSDY

SEQ ID NO: 43377 - protein, 10 aa, Homo sapiens
  light chain complementarity determining region 3 for antibody 21689
QQSYSTPLST

SEQ ID NO: 43378 - protein, 12 aa, Homo sapiens
  heavy chain complementarity determining region 3 for antibody 21689
TRLDWGRSGSDY

SEQ ID NO: 43379 - protein, 9 aa, Homo sapiens
  light chain complementarity determining region 3 for antibody 21690
QQSYSTPHT

SEQ ID NO: 43380 - protein, 17 aa, Homo sapiens
  heavy chain complementarity determining region 3 for antibody 21690
ARLSYTWNYTPGAYFDY

SEQ ID NO: 43381 - protein, 9 aa, Homo sapiens
  light chain complementarity determining region 3 for antibody 21691
QQSYSTHWT

SEQ ID NO: 43382 - protein, 23 aa, Homo sapiens
  heavy chain complementarity determining region 3 for antibody 21691
ARLSRDPVAIRAAPLDYYFAMDV

SEQ ID NO: 43383 - protein, 9 aa, Homo sapiens
  light chain complementarity determining region 3 for antibody 21692
QQSYSTHWT

SEQ ID NO: 43384 - protein, 23 aa, Homo sapiens
  heavy chain complementarity determining region 3 for antibody 21692
ARLSRDPVAIRAAPLDYYCAMDV

SEQ ID NO: 43385 - protein, 8 aa, Homo sapiens
  light chain complementarity determining region 3 for antibody 21693
QQSYSTAT

SEQ ID NO: 43386 - protein, 14 aa, Homo sapiens
  heavy chain complementarity determining region 3 for antibody 21693
ASHGTSARRGAFDI

SEQ ID NO: 43387 - protein, 9 aa, Homo sapiens
  light chain complementarity determining region 3 for antibody 21694
QQSYSSPYP

SEQ ID NO: 43388 - protein, 14 aa, Homo sapiens
  heavy chain complementarity determining region 3 for antibody 21694
AREGGDSRRYAYDI

SEQ ID NO: 43389 - protein, 10 aa, Homo sapiens
  light chain complementarity determining region 3 for antibody 21695
QQSYSSPLFT

SEQ ID NO: 43390 - protein, 14 aa, Homo sapiens
  heavy chain complementarity determining region 3 for antibody 21695
ARVIIWGSNPKFDF

SEQ ID NO: 43391 - protein, 9 aa, Homo sapiens
  light chain complementarity determining region 3 for antibody 21696
QQSYSSPFT

SEQ ID NO: 43392 - protein, 13 aa, Homo sapiens
  heavy chain complementarity determining region 3 for antibody 21696
ARKGDYYDYGMDV

SEQ ID NO: 43393 - protein, 9 aa, Homo sapiens
  light chain complementarity determining region 3 for antibody 21697
QQSYSSPFT

SEQ ID NO: 43394 - protein, 13 aa, Homo sapiens
  heavy chain complementarity determining region 3 for antibody 21697
ARKGDYCYYGMDV

SEQ ID NO: 43395 - protein, 9 aa, Homo sapiens
  light chain complementarity determining region 3 for antibody 21698
QQSYSSLLT

SEQ ID NO: 43396 - protein, 16 aa, Homo sapiens
  heavy chain complementarity determining region 3 for antibody 21698
AREGGSTYTTKRALDS

SEQ ID NO: 43397 - protein, 9 aa, Homo sapiens
  light chain complementarity determining region 3 for antibody 21699
QQSYSSLLT

SEQ ID NO: 43398 - protein, 16 aa, Homo sapiens
  heavy chain complementarity determining region 3 for antibody 21699
AREGGSTYTPKRAFDS

SEQ ID NO: 43399 - protein, 9 aa, Homo sapiens
  light chain complementarity determining region 3 for antibody 21700
QQSYSSLLT

SEQ ID NO: 43400 - protein, 16 aa, Homo sapiens
  heavy chain complementarity determining region 3 for antibody 21700
AREGGSTYPSKRAFDS

SEQ ID NO: 43401 - protein, 9 aa, Homo sapiens
  light chain complementarity determining region 3 for antibody 21701
QQSYSSLFT

SEQ ID NO: 43402 - protein, 16 aa, Homo sapiens
  heavy chain complementarity determining region 3 for antibody 21701
AREGGSTYTTKRAFDS

SEQ ID NO: 43403 - protein, 8 aa, Homo sapiens
  light chain complementarity determining region 3 for antibody 21702
QQSYSNWP

SEQ ID NO: 43404 - protein, 11 aa, Homo sapiens
  heavy chain complementarity determining region 3 for antibody 21702
ARGPMVRALDY

SEQ ID NO: 43405 - protein, 9 aa, Homo sapiens
  light chain complementarity determining region 3 for antibody 21703
QQSYSMPRT

SEQ ID NO: 43406 - protein, 11 aa, Homo sapiens
  heavy chain complementarity determining region 3 for antibody 21703
ARDNTFGWFDP

SEQ ID NO: 43407 - protein, 9 aa, Homo sapiens
  light chain complementarity determining region 3 for antibody 21704
QQSYSIRRT

SEQ ID NO: 43408 - protein, 12 aa, Homo sapiens
  heavy chain complementarity determining region 3 for antibody 21704
ARPREDGDAFDI

SEQ ID NO: 43409 - protein, 9 aa, Homo sapiens
  light chain complementarity determining region 3 for antibody 21705
QQSYSIPVT

SEQ ID NO: 43410 - protein, 13 aa, Homo sapiens
  heavy chain complementarity determining region 3 for antibody 21705
ARSGYRGSDEFDY

SEQ ID NO: 43411 - protein, 9 aa, Homo sapiens
  light chain complementarity determining region 3 for antibody 21706
QQSYSIPLT

SEQ ID NO: 43412 - protein, 13 aa, Homo sapiens
  heavy chain complementarity determining region 3 for antibody 21706
ARSGYRGSDEFDY

SEQ ID NO: 43413 - protein, 9 aa, Homo sapiens
  light chain complementarity determining region 3 for antibody 21707
QQSYSIPIT

SEQ ID NO: 43414 - protein, 14 aa, Homo sapiens
  heavy chain complementarity determining region 3 for antibody 21707
ARERRNYYYYGMDV

SEQ ID NO: 43415 - protein, 9 aa, Homo sapiens
  light chain complementarity determining region 3 for antibody 21708
QQSYSIPIT

SEQ ID NO: 43416 - protein, 14 aa, Homo sapiens
  heavy chain complementarity determining region 3 for antibody 21708
ARDRRNYYYYGIDV

SEQ ID NO: 43417 - protein, 9 aa, Homo sapiens
  light chain complementarity determining region 3 for antibody 21709
QQSYSIPIT

SEQ ID NO: 43418 - protein, 14 aa, Homo sapiens
  heavy chain complementarity determining region 3 for antibody 21709
ARDRRNYYYCGMDV

SEQ ID NO: 43419 - protein, 9 aa, Homo sapiens
  light chain complementarity determining region 3 for antibody 21710
QQSYSIPIT

SEQ ID NO: 43420 - protein, 14 aa, Homo sapiens
  heavy chain complementarity determining region 3 for antibody 21710
ARDRRNYYSYGMDV

SEQ ID NO: 43421 - protein, 9 aa, Homo sapiens
  light chain complementarity determining region 3 for antibody 21711
QQSYSIPIT

SEQ ID NO: 43422 - protein, 14 aa, Homo sapiens
  heavy chain complementarity determining region 3 for antibody 21711
AGDRRNYYYYGMDV

SEQ ID NO: 43423 - protein, 9 aa, Homo sapiens
  light chain complementarity determining region 3 for antibody 21712
QQSYSIPFT

SEQ ID NO: 43424 - protein, 14 aa, Homo sapiens
  heavy chain complementarity determining region 3 for antibody 21712
ARDRRNYYYYGMDV

SEQ ID NO: 43425 - protein, 9 aa, Homo sapiens
  light chain complementarity determining region 3 for antibody 21713
QQSYSFPWT

SEQ ID NO: 43426 - protein, 16 aa, Homo sapiens
  heavy chain complementarity determining region 3 for antibody 21713
ARDPGLGPTTVYGMAV

SEQ ID NO: 43427 - protein, 9 aa, Homo sapiens
  light chain complementarity determining region 3 for antibody 21714
QQSYSFPWT

SEQ ID NO: 43428 - protein, 16 aa, Homo sapiens
  heavy chain complementarity determining region 3 for antibody 21714
AGDPGLGPTTVYGMDV

SEQ ID NO: 43429 - protein, 9 aa, Homo sapiens
  light chain complementarity determining region 3 for antibody 21715
QQSYSFPWK

SEQ ID NO: 43430 - protein, 16 aa, Homo sapiens
  heavy chain complementarity determining region 3 for antibody 21715
ARDPGLGPTTVYGMDV

SEQ ID NO: 43431 - protein, 9 aa, Homo sapiens
  light chain complementarity determining region 3 for antibody 21716
QQSYSDPPT

SEQ ID NO: 43432 - protein, 16 aa, Homo sapiens
  heavy chain complementarity determining region 3 for antibody 21716
ARHLQMHSTSSGVFGI

SEQ ID NO: 43433 - protein, 9 aa, Homo sapiens
  light chain complementarity determining region 3 for antibody 21717
QQSYSDPPT

SEQ ID NO: 43434 - protein, 16 aa, Homo sapiens
  heavy chain complementarity determining region 3 for antibody 21717
ARHLQIHSPSSGVFGI

SEQ ID NO: 43435 - protein, 10 aa, Homo sapiens
  light chain complementarity determining region 3 for antibody 21718
QQSYSAPLST

SEQ ID NO: 43436 - protein, 14 aa, Homo sapiens
  heavy chain complementarity determining region 3 for antibody 21718
ARVIIWGSNPKFDF

SEQ ID NO: 43437 - protein, 10 aa, Homo sapiens
  light chain complementarity determining region 3 for antibody 21719
QQSYSAPLFP

SEQ ID NO: 43438 - protein, 14 aa, Homo sapiens
  heavy chain complementarity determining region 3 for antibody 21719
ARVIIWGSNPKFDF

SEQ ID NO: 43439 - protein, 9 aa, Homo sapiens
  light chain complementarity determining region 3 for antibody 21720
QQSYRTPWT

SEQ ID NO: 43440 - protein, 13 aa, Homo sapiens
  heavy chain complementarity determining region 3 for antibody 21720
VNVSQWLDDAFDF

SEQ ID NO: 43441 - protein, 9 aa, Homo sapiens
  light chain complementarity determining region 3 for antibody 21721
QQSYNTPWT

SEQ ID NO: 43442 - protein, 14 aa, Homo sapiens
  heavy chain complementarity determining region 3 for antibody 21721
ARRALRGNWDVFDF

SEQ ID NO: 43443 - protein, 9 aa, Homo sapiens
  light chain complementarity determining region 3 for antibody 21722
QQSYNTPLT

SEQ ID NO: 43444 - protein, 24 aa, Homo sapiens
  heavy chain complementarity determining region 3 for antibody 21722
ARVRDHNSSGWYRQSYYYYYGMDV

SEQ ID NO: 43445 - protein, 9 aa, Homo sapiens
  light chain complementarity determining region 3 for antibody 21723
QQSYNSPIT

SEQ ID NO: 43446 - protein, 16 aa, Homo sapiens
  heavy chain complementarity determining region 3 for antibody 21723
ARESGGGSPRHNYFDP

SEQ ID NO: 43447 - protein, 9 aa, Homo sapiens
  light chain complementarity determining region 3 for antibody 21724
QQSYLMPLT

SEQ ID NO: 43448 - protein, 15 aa, Homo sapiens
  heavy chain complementarity determining region 3 for antibody 21724
ARAGPIPTSLEGIEY

SEQ ID NO: 43449 - protein, 9 aa, Homo sapiens
  light chain complementarity determining region 3 for antibody 21725
QQSYITSLT

SEQ ID NO: 43450 - protein, 16 aa, Homo sapiens
  heavy chain complementarity determining region 3 for antibody 21725
ARVSTSGWNTNYGLDV

SEQ ID NO: 43451 - protein, 9 aa, Homo sapiens
  light chain complementarity determining region 3 for antibody 21726
QQSYITPWT

SEQ ID NO: 43452 - protein, 13 aa, Homo sapiens
  heavy chain complementarity determining region 3 for antibody 21726
VNVSQWLDDAFDF

SEQ ID NO: 43453 - protein, 9 aa, Homo sapiens
  light chain complementarity determining region 3 for antibody 21727
QQSYITPWP

SEQ ID NO: 43454 - protein, 10 aa, Homo sapiens
  heavy chain complementarity determining region 3 for antibody 21727
ARAPTHAFDI

SEQ ID NO: 43455 - protein, 9 aa, Homo sapiens
  light chain complementarity determining region 3 for antibody 21728
QQSYITPRT

SEQ ID NO: 43456 - protein, 16 aa, Homo sapiens
  heavy chain complementarity determining region 3 for antibody 21728
ARDAELVIAVGTTFDP

SEQ ID NO: 43457 - protein, 9 aa, Homo sapiens
  light chain complementarity determining region 3 for antibody 21729
QQSYITPRT

SEQ ID NO: 43458 - protein, 16 aa, Homo sapiens
  heavy chain complementarity determining region 3 for antibody 21729
ARDAELVIAVGPTFDT

SEQ ID NO: 43459 - protein, 10 aa, Homo sapiens
  light chain complementarity determining region 3 for antibody 21730
QQSYITPPYT

SEQ ID NO: 43460 - protein, 19 aa, Homo sapiens
  heavy chain complementarity determining region 3 for antibody 21730
ARTPLVVTASTSSGNWLDP

SEQ ID NO: 43461 - protein, 9 aa, Homo sapiens
  light chain complementarity determining region 3 for antibody 21731
QQSYITPGT

SEQ ID NO: 43462 - protein, 10 aa, Homo sapiens
  heavy chain complementarity determining region 3 for antibody 21731
ARAPTHAFDI

SEQ ID NO: 43463 - protein, 9 aa, Homo sapiens
  light chain complementarity determining region 3 for antibody 21732
QQSYITLLT

SEQ ID NO: 43464 - protein, 15 aa, Homo sapiens
  heavy chain complementarity determining region 3 for antibody 21732
ARDVSFGELSGTPDY

SEQ ID NO: 43465 - protein, 9 aa, Homo sapiens
  light chain complementarity determining region 3 for antibody 21733
QQSYITLLT

SEQ ID NO: 43466 - protein, 16 aa, Homo sapiens
  heavy chain complementarity determining region 3 for antibody 21733
ARDVSFGELLSGPPDY

SEQ ID NO: 43467 - protein, 9 aa, Homo sapiens
  light chain complementarity determining region 3 for antibody 21734
QQSYITLLT

SEQ ID NO: 43468 - protein, 16 aa, Homo sapiens
  heavy chain complementarity determining region 3 for antibody 21734
ARDVAFGELLSGTPDY

SEQ ID NO: 43469 - protein, 9 aa, Homo sapiens
  light chain complementarity determining region 3 for antibody 21735
QQSYITLLP

SEQ ID NO: 43470 - protein, 16 aa, Homo sapiens
  heavy chain complementarity determining region 3 for antibody 21735
ARDVSFGELLSGTPDY

SEQ ID NO: 43471 - protein, 9 aa, Homo sapiens
  light chain complementarity determining region 3 for antibody 21736
QQSYIMPRT

SEQ ID NO: 43472 - protein, 17 aa, Homo sapiens
  heavy chain complementarity determining region 3 for antibody 21736
AREYTDQTWNSLFHFDS

SEQ ID NO: 43473 - protein, 9 aa, Homo sapiens
  light chain complementarity determining region 3 for antibody 21737
QQSYIAPYT

SEQ ID NO: 43474 - protein, 17 aa, Homo sapiens
  heavy chain complementarity determining region 3 for antibody 21737
ARLTLRKALEHIGGLDP

SEQ ID NO: 43475 - protein, 9 aa, Homo sapiens
  light chain complementarity determining region 3 for antibody 21738
QQSYIAPYT

SEQ ID NO: 43476 - protein, 17 aa, Homo sapiens
  heavy chain complementarity determining region 3 for antibody 21738
ARLSLRKSLEHIGGLDP

SEQ ID NO: 43477 - protein, 10 aa, Homo sapiens
  light chain complementarity determining region 3 for antibody 21739
QQSYHVPALT

SEQ ID NO: 43478 - protein, 17 aa, Homo sapiens
  heavy chain complementarity determining region 3 for antibody 21739
AKGQIAVAGKAPCGMDV

SEQ ID NO: 43479 - protein, 10 aa, Homo sapiens
  light chain complementarity determining region 3 for antibody 21740
QQSYHVPALT

SEQ ID NO: 43480 - protein, 17 aa, Homo sapiens
  heavy chain complementarity determining region 3 for antibody 21740
AKEQIAVAGKAPCGMDV

SEQ ID NO: 43481 - protein, 10 aa, Homo sapiens
  light chain complementarity determining region 3 for antibody 21741
QQSYHVPALT

SEQ ID NO: 43482 - protein, 17 aa, Homo sapiens
  heavy chain complementarity determining region 3 for antibody 21741
AKDQIAVAGRAPCGMDV

SEQ ID NO: 43483 - protein, 10 aa, Homo sapiens
  light chain complementarity determining region 3 for antibody 21742
QQSYHVPALT

SEQ ID NO: 43484 - protein, 17 aa, Homo sapiens
  heavy chain complementarity determining region 3 for antibody 21742
AKDQIAVAGNAPCGMDV

SEQ ID NO: 43485 - protein, 10 aa, Homo sapiens
  light chain complementarity determining region 3 for antibody 21743
QQSYHVPALT

SEQ ID NO: 43486 - protein, 17 aa, Homo sapiens
  heavy chain complementarity determining region 3 for antibody 21743
AKDQIAVAGKAPCRMDV

SEQ ID NO: 43487 - protein, 10 aa, Homo sapiens
  light chain complementarity determining region 3 for antibody 21744
QQSYHVPALP

SEQ ID NO: 43488 - protein, 17 aa, Homo sapiens
  heavy chain complementarity determining region 3 for antibody 21744
AKDQIAVAGKAPCGMDV

SEQ ID NO: 43489 - protein, 9 aa, Homo sapiens
  light chain complementarity determining region 3 for antibody 21745
QQSYGTPAT

SEQ ID NO: 43490 - protein, 16 aa, Homo sapiens
  heavy chain complementarity determining region 3 for antibody 21745
AKDVWDTAMINYWFDP

SEQ ID NO: 43491 - protein, 9 aa, Homo sapiens
  light chain complementarity determining region 3 for antibody 21746
QQSYGTLCK

SEQ ID NO: 43492 - protein, 19 aa, Homo sapiens
  heavy chain complementarity determining region 3 for antibody 21746
AREAYFYDSSGSKIGYFDY

SEQ ID NO: 43493 - protein, 9 aa, Homo sapiens
  light chain complementarity determining region 3 for antibody 21747
QQSYGSPFD

SEQ ID NO: 43494 - protein, 15 aa, Homo sapiens
  heavy chain complementarity determining region 3 for antibody 21747
ARVSIQLWQKTWFDP

SEQ ID NO: 43495 - protein, 9 aa, Homo sapiens
  light chain complementarity determining region 3 for antibody 21748
QQSYGLPQT

SEQ ID NO: 43496 - protein, 19 aa, Homo sapiens
  heavy chain complementarity determining region 3 for antibody 21748
ARVGLEIPPAMRRGEWFDP

SEQ ID NO: 43497 - protein, 9 aa, Homo sapiens
  light chain complementarity determining region 3 for antibody 21749
QQSYGLPQT

SEQ ID NO: 43498 - protein, 19 aa, Homo sapiens
  heavy chain complementarity determining region 3 for antibody 21749
ARVGLEIPAAIRRGEWFDP

SEQ ID NO: 43499 - protein, 9 aa, Homo sapiens
  light chain complementarity determining region 3 for antibody 21750
QQSYGLLQT

SEQ ID NO: 43500 - protein, 19 aa, Homo sapiens
  heavy chain complementarity determining region 3 for antibody 21750
ARVGLEIPPAIRRGEWFDP

SEQ ID NO: 43501 - protein, 9 aa, Homo sapiens
  light chain complementarity determining region 3 for antibody 21751
QQSYDTPWT

SEQ ID NO: 43502 - protein, 20 aa, Homo sapiens
  heavy chain complementarity determining region 3 for antibody 21751
ARLSHVVFDSTGTGYYAMDV

SEQ ID NO: 43503 - protein, 9 aa, Homo sapiens
  light chain complementarity determining region 3 for antibody 21752
QQSYDTPWT

SEQ ID NO: 43504 - protein, 20 aa, Homo sapiens
  heavy chain complementarity determining region 3 for antibody 21752
ARLSHVFFDSTGTGYYAMDA

SEQ ID NO: 43505 - protein, 9 aa, Homo sapiens
  light chain complementarity determining region 3 for antibody 21753
QQSYDTPWP

SEQ ID NO: 43506 - protein, 20 aa, Homo sapiens
  heavy chain complementarity determining region 3 for antibody 21753
ARLSHVFFDSTGTGYYAMDV

SEQ ID NO: 43507 - protein, 9 aa, Homo sapiens
  light chain complementarity determining region 3 for antibody 21754
QQSYDNSRT

SEQ ID NO: 43508 - protein, 13 aa, Homo sapiens
  heavy chain complementarity determining region 3 for antibody 21754
ARRDAYNYSGLDY

SEQ ID NO: 43509 - protein, 9 aa, Homo sapiens
  light chain complementarity determining region 3 for antibody 21755
QQSYASPPT

SEQ ID NO: 43510 - protein, 13 aa, Homo sapiens
  heavy chain complementarity determining region 3 for antibody 21755
AHITLRYRTSFDF

SEQ ID NO: 43511 - protein, 8 aa, Homo sapiens
  light chain complementarity determining region 3 for antibody 21756
QQSVGTRT

SEQ ID NO: 43512 - protein, 14 aa, Homo sapiens
  heavy chain complementarity determining region 3 for antibody 21756
AREADTGYGYYCDL

SEQ ID NO: 43513 - protein, 9 aa, Homo sapiens
  light chain complementarity determining region 3 for antibody 21757
QQSVGPPNT

SEQ ID NO: 43514 - protein, 11 aa, Homo sapiens
  heavy chain complementarity determining region 3 for antibody 21757
ARFFVVGANAA

SEQ ID NO: 43515 - protein, 9 aa, Homo sapiens
  light chain complementarity determining region 3 for antibody 21758
QQSVGPPLT

SEQ ID NO: 43516 - protein, 11 aa, Homo sapiens
  heavy chain complementarity determining region 3 for antibody 21758
ARFFVVGANAA

SEQ ID NO: 43517 - protein, 9 aa, Homo sapiens
  light chain complementarity determining region 3 for antibody 21759
QQSVGPPIT

SEQ ID NO: 43518 - protein, 11 aa, Homo sapiens
  heavy chain complementarity determining region 3 for antibody 21759
ARLFVVGANAA

SEQ ID NO: 43519 - protein, 9 aa, Homo sapiens
  light chain complementarity determining region 3 for antibody 21760
QQSVGPPFT

SEQ ID NO: 43520 - protein, 11 aa, Homo sapiens
  heavy chain complementarity determining region 3 for antibody 21760
ARFFVVGANAA

SEQ ID NO: 43521 - protein, 9 aa, Homo sapiens
  light chain complementarity determining region 3 for antibody 21761
QQSTTSPRT

SEQ ID NO: 43522 - protein, 13 aa, Homo sapiens
  heavy chain complementarity determining region 3 for antibody 21761
GEGYEYAPRIYDY

SEQ ID NO: 43523 - protein, 9 aa, Homo sapiens
  light chain complementarity determining region 3 for antibody 21762
QQSTTSPRK

SEQ ID NO: 43524 - protein, 13 aa, Homo sapiens
  heavy chain complementarity determining region 3 for antibody 21762
GKGYEYAPRIYDY

SEQ ID NO: 43525 - protein, 9 aa, Homo sapiens
  light chain complementarity determining region 3 for antibody 21763
QQSTTSPGT

SEQ ID NO: 43526 - protein, 13 aa, Homo sapiens
  heavy chain complementarity determining region 3 for antibody 21763
GKGYEYAPRIYDY

SEQ ID NO: 43527 - protein, 9 aa, Homo sapiens
  light chain complementarity determining region 3 for antibody 21764
QQSTTPPRT

SEQ ID NO: 43528 - protein, 13 aa, Homo sapiens
  heavy chain complementarity determining region 3 for antibody 21764
GKGYEYAPRIYDY

SEQ ID NO: 43529 - protein, 9 aa, Homo sapiens
  light chain complementarity determining region 3 for antibody 21765
QQSTPSPRT

SEQ ID NO: 43530 - protein, 13 aa, Homo sapiens
  heavy chain complementarity determining region 3 for antibody 21765
GKGYEYAPRIYDY

SEQ ID NO: 43531 - protein, 8 aa, Homo sapiens
  light chain complementarity determining region 3 for antibody 21766
QQSSSNWT

SEQ ID NO: 43532 - protein, 11 aa, Homo sapiens
  heavy chain complementarity determining region 3 for antibody 21766
ARGPMVRALDY

SEQ ID NO: 43533 - protein, 9 aa, Homo sapiens
  light chain complementarity determining region 3 for antibody 21767
QQSNTWPRT

SEQ ID NO: 43534 - protein, 22 aa, Homo sapiens
  heavy chain complementarity determining region 3 for antibody 21767
AREVRASGYDDFYNYYYYGLDV

SEQ ID NO: 43535 - protein, 9 aa, Homo sapiens
  light chain complementarity determining region 3 for antibody 21768
QQSNSYPWT

SEQ ID NO: 43536 - protein, 23 aa, Homo sapiens
  heavy chain complementarity determining region 3 for antibody 21768
AGGRITGATWQRPTNYYYYAMNV

SEQ ID NO: 43537 - protein, 9 aa, Homo sapiens
  light chain complementarity determining region 3 for antibody 21769
QQSNSFPLT

SEQ ID NO: 43538 - protein, 13 aa, Homo sapiens
  heavy chain complementarity determining region 3 for antibody 21769
ARRSSDYSGHFDY

SEQ ID NO: 43539 - protein, 10 aa, Homo sapiens
  light chain complementarity determining region 3 for antibody 21770
QQSNNWPPWT

SEQ ID NO: 43540 - protein, 18 aa, Homo sapiens
  heavy chain complementarity determining region 3 for antibody 21770
ARGVPRLWAPGGTGPFDY

SEQ ID NO: 43541 - protein, 10 aa, Homo sapiens
  light chain complementarity determining region 3 for antibody 21771
QQSNNWPPWT

SEQ ID NO: 43542 - protein, 18 aa, Homo sapiens
  heavy chain complementarity determining region 3 for antibody 21771
AGGVPRFWAPGGTGPFDY

SEQ ID NO: 43543 - protein, 10 aa, Homo sapiens
  light chain complementarity determining region 3 for antibody 21772
QQSNNWPPWT

SEQ ID NO: 43544 - protein, 11 aa, Homo sapiens
  heavy chain complementarity determining region 3 for antibody 21772
AASGSYYKFDY

SEQ ID NO: 43545 - protein, 10 aa, Homo sapiens
  light chain complementarity determining region 3 for antibody 21773
QQSNNWPPLT

SEQ ID NO: 43546 - protein, 12 aa, Homo sapiens
  heavy chain complementarity determining region 3 for antibody 21773
ARYGDYFLGWVY

SEQ ID NO: 43547 - protein, 10 aa, Homo sapiens
  light chain complementarity determining region 3 for antibody 21774
QQSNNWPPGT

SEQ ID NO: 43548 - protein, 18 aa, Homo sapiens
  heavy chain complementarity determining region 3 for antibody 21774
ARGVPRFWAPGGTGPFDY

SEQ ID NO: 43549 - protein, 9 aa, Homo sapiens
  light chain complementarity determining region 3 for antibody 21775
QQSNLWPLT

SEQ ID NO: 43550 - protein, 13 aa, Homo sapiens
  heavy chain complementarity determining region 3 for antibody 21775
ARHGGPCYRYFDY

SEQ ID NO: 43551 - protein, 9 aa, Homo sapiens
  light chain complementarity determining region 3 for antibody 21776
QQSNLWPLP

SEQ ID NO: 43552 - protein, 13 aa, Homo sapiens
  heavy chain complementarity determining region 3 for antibody 21776
ARHGGTCYRYFDY

SEQ ID NO: 43553 - protein, 9 aa, Homo sapiens
  light chain complementarity determining region 3 for antibody 21777
QQSNIWPLT

SEQ ID NO: 43554 - protein, 13 aa, Homo sapiens
  heavy chain complementarity determining region 3 for antibody 21777
ARHGGTCYRYFDY

SEQ ID NO: 43555 - protein, 9 aa, Homo sapiens
  light chain complementarity determining region 3 for antibody 21778
QQSHTYSWP

SEQ ID NO: 43556 - protein, 12 aa, Homo sapiens
  heavy chain complementarity determining region 3 for antibody 21778
ARMGYSYGHFDN

SEQ ID NO: 43557 - protein, 9 aa, Homo sapiens
  light chain complementarity determining region 3 for antibody 21779
QQSHTTPYP

SEQ ID NO: 43558 - protein, 14 aa, Homo sapiens
  heavy chain complementarity determining region 3 for antibody 21779
ARLVKIVINGEDDY

SEQ ID NO: 43559 - protein, 9 aa, Homo sapiens
  light chain complementarity determining region 3 for antibody 21780
QQSHTTPST

SEQ ID NO: 43560 - protein, 14 aa, Homo sapiens
  heavy chain complementarity determining region 3 for antibody 21780
ARLVKIVINGEDDY

SEQ ID NO: 43561 - protein, 9 aa, Homo sapiens
  light chain complementarity determining region 3 for antibody 21781
QQSHTTPNT

SEQ ID NO: 43562 - protein, 14 aa, Homo sapiens
  heavy chain complementarity determining region 3 for antibody 21781
ARLVKIVINGEDDY

SEQ ID NO: 43563 - protein, 8 aa, Homo sapiens
  light chain complementarity determining region 3 for antibody 21782
QQSHTTLP

SEQ ID NO: 43564 - protein, 12 aa, Homo sapiens
  heavy chain complementarity determining region 3 for antibody 21782
ARRGGFGRTFDF

SEQ ID NO: 43565 - protein, 8 aa, Homo sapiens
  light chain complementarity determining region 3 for antibody 21783
QQSHTRLS

SEQ ID NO: 43566 - protein, 11 aa, Homo sapiens
  heavy chain complementarity determining region 3 for antibody 21783
ASGSMGWVFDH

SEQ ID NO: 43567 - protein, 9 aa, Homo sapiens
  light chain complementarity determining region 3 for antibody 21784
QQSHTGPWT

SEQ ID NO: 43568 - protein, 12 aa, Homo sapiens
  heavy chain complementarity determining region 3 for antibody 21784
VRGRNYEVPFDY

SEQ ID NO: 43569 - protein, 9 aa, Homo sapiens
  light chain complementarity determining region 3 for antibody 21785
QQSHSVPLT

SEQ ID NO: 43570 - protein, 16 aa, Homo sapiens
  heavy chain complementarity determining region 3 for antibody 21785
ARVYATVTSQALGADY

SEQ ID NO: 43571 - protein, 9 aa, Homo sapiens
  light chain complementarity determining region 3 for antibody 21786
QQSHSVPLT

SEQ ID NO: 43572 - protein, 16 aa, Homo sapiens
  heavy chain complementarity determining region 3 for antibody 21786
ARVYATVTPQALGVDY

SEQ ID NO: 43573 - protein, 9 aa, Homo sapiens
  light chain complementarity determining region 3 for antibody 21787
QQSHSVPLT

SEQ ID NO: 43574 - protein, 16 aa, Homo sapiens
  heavy chain complementarity determining region 3 for antibody 21787
ARVYATVTAQALGVDY

SEQ ID NO: 43575 - protein, 9 aa, Homo sapiens
  light chain complementarity determining region 3 for antibody 21788
QQSHSVPLT

SEQ ID NO: 43576 - protein, 16 aa, Homo sapiens
  heavy chain complementarity determining region 3 for antibody 21788
ARVYATVPSQALGVDY

SEQ ID NO: 43577 - protein, 9 aa, Homo sapiens
  light chain complementarity determining region 3 for antibody 21789
QQSHSVPLT

SEQ ID NO: 43578 - protein, 16 aa, Homo sapiens
  heavy chain complementarity determining region 3 for antibody 21789
ARVEATVTSQALGVDY

SEQ ID NO: 43579 - protein, 9 aa, Homo sapiens
  light chain complementarity determining region 3 for antibody 21790
QQSHSVPLT

SEQ ID NO: 43580 - protein, 16 aa, Homo sapiens
  heavy chain complementarity determining region 3 for antibody 21790
ARGYATVTSQALGVDY

SEQ ID NO: 43581 - protein, 9 aa, Homo sapiens
  light chain complementarity determining region 3 for antibody 21791
QQSHSVPLT

SEQ ID NO: 43582 - protein, 16 aa, Homo sapiens
  heavy chain complementarity determining region 3 for antibody 21791
ARGDATVTSQALGVDY

SEQ ID NO: 43583 - protein, 9 aa, Homo sapiens
  light chain complementarity determining region 3 for antibody 21792
QQSHSVPLP

SEQ ID NO: 43584 - protein, 16 aa, Homo sapiens
  heavy chain complementarity determining region 3 for antibody 21792
ARVYATVTSQALGVDY

SEQ ID NO: 43585 - protein, 9 aa, Homo sapiens
  light chain complementarity determining region 3 for antibody 21793
QQSHSSLLT

SEQ ID NO: 43586 - protein, 16 aa, Homo sapiens
  heavy chain complementarity determining region 3 for antibody 21793
AREGGSTYTSKRAFDS

SEQ ID NO: 43587 - protein, 9 aa, Homo sapiens
  light chain complementarity determining region 3 for antibody 21794
QQSHSGPLT

SEQ ID NO: 43588 - protein, 16 aa, Homo sapiens
  heavy chain complementarity determining region 3 for antibody 21794
ARVYATVTSQALGVDY

SEQ ID NO: 43589 - protein, 9 aa, Homo sapiens
  light chain complementarity determining region 3 for antibody 21795
QQSHSFPRT

SEQ ID NO: 43590 - protein, 13 aa, Homo sapiens
  heavy chain complementarity determining region 3 for antibody 21795
ATSHDYGDSALDS

SEQ ID NO: 43591 - protein, 9 aa, Homo sapiens
  light chain complementarity determining region 3 for antibody 21796
QQSHSFPLA

SEQ ID NO: 43592 - protein, 11 aa, Homo sapiens
  heavy chain complementarity determining region 3 for antibody 21796
VHSPAMAEIDY

SEQ ID NO: 43593 - protein, 9 aa, Homo sapiens
  light chain complementarity determining region 3 for antibody 21797
QQSHSDPLT

SEQ ID NO: 43594 - protein, 16 aa, Homo sapiens
  heavy chain complementarity determining region 3 for antibody 21797
ARVYATVTSQALGVDY

SEQ ID NO: 43595 - protein, 9 aa, Homo sapiens
  light chain complementarity determining region 3 for antibody 21798
QQSHSAPLT

SEQ ID NO: 43596 - protein, 16 aa, Homo sapiens
  heavy chain complementarity determining region 3 for antibody 21798
ARVYATVTSQALGVDY

SEQ ID NO: 43597 - protein, 10 aa, Homo sapiens
  light chain complementarity determining region 3 for antibody 21799
QQSHNWPPWT

SEQ ID NO: 43598 - protein, 18 aa, Homo sapiens
  heavy chain complementarity determining region 3 for antibody 21799
ARGVPPFWAPGGVGPFDF

SEQ ID NO: 43599 - protein, 10 aa, Homo sapiens
  light chain complementarity determining region 3 for antibody 21800
QQSHHWPPWP

SEQ ID NO: 43600 - protein, 18 aa, Homo sapiens
  heavy chain complementarity determining region 3 for antibody 21800
ARGVPPFWAPGGVGPFDF

SEQ ID NO: 43601 - protein, 9 aa, Homo sapiens
  light chain complementarity determining region 3 for antibody 21801
QQSGTSPRT

SEQ ID NO: 43602 - protein, 13 aa, Homo sapiens
  heavy chain complementarity determining region 3 for antibody 21801
GKGYEYAPRSYDY

SEQ ID NO: 43603 - protein, 9 aa, Homo sapiens
  light chain complementarity determining region 3 for antibody 21802
QQSGTSPRT

SEQ ID NO: 43604 - protein, 13 aa, Homo sapiens
  heavy chain complementarity determining region 3 for antibody 21802
GKGYEYAPGIYDY

SEQ ID NO: 43605 - protein, 9 aa, Homo sapiens
  light chain complementarity determining region 3 for antibody 21803
QQSGTSPRT

SEQ ID NO: 43606 - protein, 14 aa, Homo sapiens
  heavy chain complementarity determining region 3 for antibody 21803
AGGDFCGRDCYSEY

SEQ ID NO: 43607 - protein, 9 aa, Homo sapiens
  light chain complementarity determining region 3 for antibody 21804
QQSGTSPPT

SEQ ID NO: 43608 - protein, 13 aa, Homo sapiens
  heavy chain complementarity determining region 3 for antibody 21804
GKGYEYAPRIYDY

SEQ ID NO: 43609 - protein, 9 aa, Homo sapiens
  light chain complementarity determining region 3 for antibody 21805
QQSGTSLRT

SEQ ID NO: 43610 - protein, 13 aa, Homo sapiens
  heavy chain complementarity determining region 3 for antibody 21805
GKGYEYAPRIYDY

SEQ ID NO: 43611 - protein, 9 aa, Homo sapiens
  light chain complementarity determining region 3 for antibody 21806
QQSGSSPRT

SEQ ID NO: 43612 - protein, 18 aa, Homo sapiens
  heavy chain complementarity determining region 3 for antibody 21806
ATAFWVGLGVPPPGFFEY

SEQ ID NO: 43613 - protein, 9 aa, Homo sapiens
  light chain complementarity determining region 3 for antibody 21807
QQSGSSPRT

SEQ ID NO: 43614 - protein, 13 aa, Homo sapiens
  heavy chain complementarity determining region 3 for antibody 21807
ARGSGIFGGFFDY

SEQ ID NO: 43615 - protein, 9 aa, Homo sapiens
  light chain complementarity determining region 3 for antibody 21808
QQSGSSPRT

SEQ ID NO: 43616 - protein, 15 aa, Homo sapiens
  heavy chain complementarity determining region 3 for antibody 21808
AKTYDFWSGDDAFEI

SEQ ID NO: 43617 - protein, 9 aa, Homo sapiens
  light chain complementarity determining region 3 for antibody 21809
QQSGRKPLT

SEQ ID NO: 43618 - protein, 14 aa, Homo sapiens
  heavy chain complementarity determining region 3 for antibody 21809
ARDNSNNWYEGMDV

SEQ ID NO: 43619 - protein, 9 aa, Homo sapiens
  light chain complementarity determining region 3 for antibody 21810
QQSGRKPLN

SEQ ID NO: 43620 - protein, 14 aa, Homo sapiens
  heavy chain complementarity determining region 3 for antibody 21810
ARDNSNNWYEGMDV

SEQ ID NO: 43621 - protein, 9 aa, Homo sapiens
  light chain complementarity determining region 3 for antibody 21811
QQSGNSPRT

SEQ ID NO: 43622 - protein, 14 aa, Homo sapiens
  heavy chain complementarity determining region 3 for antibody 21811
ASDPVVGAPGYFDY

SEQ ID NO: 43623 - protein, 10 aa, Homo sapiens
  light chain complementarity determining region 3 for antibody 21812
QQSGIWPPIT

SEQ ID NO: 43624 - protein, 13 aa, Homo sapiens
  heavy chain complementarity determining region 3 for antibody 21812
VRELHAGAYYYDY

SEQ ID NO: 43625 - protein, 9 aa, Homo sapiens
  light chain complementarity determining region 3 for antibody 21813
QQSFTTPRT

SEQ ID NO: 43626 - protein, 8 aa, Homo sapiens
  heavy chain complementarity determining region 3 for antibody 21813
ARDGAFDS

SEQ ID NO: 43627 - protein, 10 aa, Homo sapiens
  light chain complementarity determining region 3 for antibody 21814
QQSFSSSPIT

SEQ ID NO: 43628 - protein, 16 aa, Homo sapiens
  heavy chain complementarity determining region 3 for antibody 21814
ARQGRWTTVVTPHFDH

SEQ ID NO: 43629 - protein, 10 aa, Homo sapiens
  light chain complementarity determining region 3 for antibody 21815
QQSFSSSPIT

SEQ ID NO: 43630 - protein, 16 aa, Homo sapiens
  heavy chain complementarity determining region 3 for antibody 21815
ARQGPWTTVVTTHFDH

SEQ ID NO: 43631 - protein, 10 aa, Homo sapiens
  light chain complementarity determining region 3 for antibody 21816
QQSFSSSPIT

SEQ ID NO: 43632 - protein, 16 aa, Homo sapiens
  heavy chain complementarity determining region 3 for antibody 21816
ARQGPWTTVVAPHFDH

SEQ ID NO: 43633 - protein, 10 aa, Homo sapiens
  light chain complementarity determining region 3 for antibody 21817
QQSFSPSPIT

SEQ ID NO: 43634 - protein, 16 aa, Homo sapiens
  heavy chain complementarity determining region 3 for antibody 21817
ARQGPWTTVVTPHFDH

SEQ ID NO: 43635 - protein, 8 aa, Homo sapiens
  light chain complementarity determining region 3 for antibody 21818
QQSFRPST

SEQ ID NO: 43636 - protein, 18 aa, Homo sapiens
  heavy chain complementarity determining region 3 for antibody 21818
ARGSGITIFGGVIRYFDY

SEQ ID NO: 43637 - protein, 8 aa, Homo sapiens
  light chain complementarity determining region 3 for antibody 21819
QQSFRPET

SEQ ID NO: 43638 - protein, 18 aa, Homo sapiens
  heavy chain complementarity determining region 3 for antibody 21819
ARGSGITIFGGVIRYFDY

SEQ ID NO: 43639 - protein, 8 aa, Homo sapiens
  light chain complementarity determining region 3 for antibody 21820
QQSFRPAT

SEQ ID NO: 43640 - protein, 18 aa, Homo sapiens
  heavy chain complementarity determining region 3 for antibody 21820
ARGSGTTIFGGVIRYFDY

SEQ ID NO: 43641 - protein, 8 aa, Homo sapiens
  light chain complementarity determining region 3 for antibody 21821
QQSFRPAT

SEQ ID NO: 43642 - protein, 18 aa, Homo sapiens
  heavy chain complementarity determining region 3 for antibody 21821
ARGSGLTIFGGVIRYFDY

SEQ ID NO: 43643 - protein, 8 aa, Homo sapiens
  light chain complementarity determining region 3 for antibody 21822
QQSFRPAT

SEQ ID NO: 43644 - protein, 18 aa, Homo sapiens
  heavy chain complementarity determining region 3 for antibody 21822
ARGSGITIFGGVIRYFAY

SEQ ID NO: 43645 - protein, 8 aa, Homo sapiens
  light chain complementarity determining region 3 for antibody 21823
QQSENLVT

SEQ ID NO: 43646 - protein, 18 aa, Homo sapiens
  heavy chain complementarity determining region 3 for antibody 21823
AKGAEGSCSVRKCYPFDY

SEQ ID NO: 43647 - protein, 9 aa, Homo sapiens
  light chain complementarity determining region 3 for antibody 21824
QQSDSIPYT

SEQ ID NO: 43648 - protein, 12 aa, Homo sapiens
  heavy chain complementarity determining region 3 for antibody 21824
ARGSPIVTGFDY

SEQ ID NO: 43649 - protein, 9 aa, Homo sapiens
  light chain complementarity determining region 3 for antibody 21825
QQSDRKPST

SEQ ID NO: 43650 - protein, 14 aa, Homo sapiens
  heavy chain complementarity determining region 3 for antibody 21825
ARDNSNNWYEGMDV

SEQ ID NO: 43651 - protein, 9 aa, Homo sapiens
  light chain complementarity determining region 3 for antibody 21826
QQSDRKPFT

SEQ ID NO: 43652 - protein, 14 aa, Homo sapiens
  heavy chain complementarity determining region 3 for antibody 21826
ARDSSNNWYEGMDV

SEQ ID NO: 43653 - protein, 9 aa, Homo sapiens
  light chain complementarity determining region 3 for antibody 21827
QQSDRKPFT

SEQ ID NO: 43654 - protein, 14 aa, Homo sapiens
  heavy chain complementarity determining region 3 for antibody 21827
ARDNSNSWYEGMDV

SEQ ID NO: 43655 - protein, 9 aa, Homo sapiens
  light chain complementarity determining region 3 for antibody 21828
QQSDRKPFT

SEQ ID NO: 43656 - protein, 14 aa, Homo sapiens
  heavy chain complementarity determining region 3 for antibody 21828
ARDNSNNWYEGLDV

SEQ ID NO: 43657 - protein, 9 aa, Homo sapiens
  light chain complementarity determining region 3 for antibody 21829
QQSDRKPFN

SEQ ID NO: 43658 - protein, 14 aa, Homo sapiens
  heavy chain complementarity determining region 3 for antibody 21829
ARDNSNNWYEGMDV

SEQ ID NO: 43659 - protein, 9 aa, Homo sapiens
  light chain complementarity determining region 3 for antibody 21830
QQSDRIPYT

SEQ ID NO: 43660 - protein, 12 aa, Homo sapiens
  heavy chain complementarity determining region 3 for antibody 21830
ARGNPIVTGFDY

SEQ ID NO: 43661 - protein, 10 aa, Homo sapiens
  light chain complementarity determining region 3 for antibody 21831
QQSDNWPPWT

SEQ ID NO: 43662 - protein, 12 aa, Homo sapiens
  heavy chain complementarity determining region 3 for antibody 21831
AKTLRERKELDY

SEQ ID NO: 43663 - protein, 9 aa, Homo sapiens
  light chain complementarity determining region 3 for antibody 21832
QQSARKPFT

SEQ ID NO: 43664 - protein, 14 aa, Homo sapiens
  heavy chain complementarity determining region 3 for antibody 21832
ARDNSNNWYEGMDV

SEQ ID NO: 43665 - protein, 10 aa, Homo sapiens
  light chain complementarity determining region 3 for antibody 21833
QQRYTWPPFT

SEQ ID NO: 43666 - protein, 11 aa, Homo sapiens
  heavy chain complementarity determining region 3 for antibody 21833
ARGVGSYPFDS

SEQ ID NO: 43667 - protein, 9 aa, Homo sapiens
  light chain complementarity determining region 3 for antibody 21834
QQRYTWPLT

SEQ ID NO: 43668 - protein, 22 aa, Homo sapiens
  heavy chain complementarity determining region 3 for antibody 21834
ARAPLVIGPPPLERVRQIHFDY

SEQ ID NO: 43669 - protein, 9 aa, Homo sapiens
  light chain complementarity determining region 3 for antibody 21835
QQRYTTPYT

SEQ ID NO: 43670 - protein, 13 aa, Homo sapiens
  heavy chain complementarity determining region 3 for antibody 21835
ARISSTWPPLFDY

SEQ ID NO: 43671 - protein, 10 aa, Homo sapiens
  light chain complementarity determining region 3 for antibody 21836
QQRYSWPPPP

SEQ ID NO: 43672 - protein, 14 aa, Homo sapiens
  heavy chain complementarity determining region 3 for antibody 21836
AKGANLHHPYYFDY

SEQ ID NO: 43673 - protein, 10 aa, Homo sapiens
  light chain complementarity determining region 3 for antibody 21837
QQRYSWPPLT

SEQ ID NO: 43674 - protein, 14 aa, Homo sapiens
  heavy chain complementarity determining region 3 for antibody 21837
AKGANLRHPYYFDY

SEQ ID NO: 43675 - protein, 10 aa, Homo sapiens
  light chain complementarity determining region 3 for antibody 21838
QQRYSWPPIT

SEQ ID NO: 43676 - protein, 14 aa, Homo sapiens
  heavy chain complementarity determining region 3 for antibody 21838
AKGANLHHPYYFDY

SEQ ID NO: 43677 - protein, 9 aa, Homo sapiens
  light chain complementarity determining region 3 for antibody 21839
QQRYSTPWT

SEQ ID NO: 43678 - protein, 13 aa, Homo sapiens
  heavy chain complementarity determining region 3 for antibody 21839
VNVSQWLDDAFDF

SEQ ID NO: 43679 - protein, 9 aa, Homo sapiens
  light chain complementarity determining region 3 for antibody 21840
QQRYSTPRT

SEQ ID NO: 43680 - protein, 11 aa, Homo sapiens
  heavy chain complementarity determining region 3 for antibody 21840
ARDNTFGWFDP

SEQ ID NO: 43681 - protein, 9 aa, Homo sapiens
  light chain complementarity determining region 3 for antibody 21841
QQRYSTPPT

SEQ ID NO: 43682 - protein, 16 aa, Homo sapiens
  heavy chain complementarity determining region 3 for antibody 21841
AGISQFWSGFTSGMDV

SEQ ID NO: 43683 - protein, 9 aa, Homo sapiens
  light chain complementarity determining region 3 for antibody 21842
QQRYSTPHT

SEQ ID NO: 43684 - protein, 17 aa, Homo sapiens
  heavy chain complementarity determining region 3 for antibody 21842
ASLSYTWNYTPGAYFDY

SEQ ID NO: 43685 - protein, 10 aa, Homo sapiens
  light chain complementarity determining region 3 for antibody 21843
QQRYNWSPFT

SEQ ID NO: 43686 - protein, 11 aa, Homo sapiens
  heavy chain complementarity determining region 3 for antibody 21843
ARGVGSYPFDS

SEQ ID NO: 43687 - protein, 10 aa, Homo sapiens
  light chain complementarity determining region 3 for antibody 21844
QQRYNWPQYT

SEQ ID NO: 43688 - protein, 11 aa, Homo sapiens
  heavy chain complementarity determining region 3 for antibody 21844
ARGVGSYVFES

SEQ ID NO: 43689 - protein, 10 aa, Homo sapiens
  light chain complementarity determining region 3 for antibody 21845
QQRYNWPPYT

SEQ ID NO: 43690 - protein, 11 aa, Homo sapiens
  heavy chain complementarity determining region 3 for antibody 21845
ARGVGSYVLES

SEQ ID NO: 43691 - protein, 10 aa, Homo sapiens
  light chain complementarity determining region 3 for antibody 21846
QQRYNWPPYT

SEQ ID NO: 43692 - protein, 11 aa, Homo sapiens
  heavy chain complementarity determining region 3 for antibody 21846
ARGVGSYVFEP

SEQ ID NO: 43693 - protein, 10 aa, Homo sapiens
  light chain complementarity determining region 3 for antibody 21847
QQRYNWPPYT

SEQ ID NO: 43694 - protein, 11 aa, Homo sapiens
  heavy chain complementarity determining region 3 for antibody 21847
ARGVGSYGFES

SEQ ID NO: 43695 - protein, 10 aa, Homo sapiens
  light chain complementarity determining region 3 for antibody 21848
QQRYNWPPYT

SEQ ID NO: 43696 - protein, 11 aa, Homo sapiens
  heavy chain complementarity determining region 3 for antibody 21848
ARGMGSYVFES

SEQ ID NO: 43697 - protein, 10 aa, Homo sapiens
  light chain complementarity determining region 3 for antibody 21849
QQRYNWPPYT

SEQ ID NO: 43698 - protein, 11 aa, Homo sapiens
  heavy chain complementarity determining region 3 for antibody 21849
ARGLGSYVFES

SEQ ID NO: 43699 - protein, 10 aa, Homo sapiens
  light chain complementarity determining region 3 for antibody 21850
QQRYNWPPWT

SEQ ID NO: 43700 - protein, 20 aa, Homo sapiens
  heavy chain complementarity determining region 3 for antibody 21850
ARHRQVTVAYSFEVFWYFDL

SEQ ID NO: 43701 - protein, 10 aa, Homo sapiens
  light chain complementarity determining region 3 for antibody 21851
QQRYNWPPWT

SEQ ID NO: 43702 - protein, 20 aa, Homo sapiens
  heavy chain complementarity determining region 3 for antibody 21851
ARHRQVTVADSSEVFWYFDL

SEQ ID NO: 43703 - protein, 10 aa, Homo sapiens
  light chain complementarity determining region 3 for antibody 21852
QQRYNWPPWT

SEQ ID NO: 43704 - protein, 20 aa, Homo sapiens
  heavy chain complementarity determining region 3 for antibody 21852
ARHRQVTVADSFEVFWSFDL

SEQ ID NO: 43705 - protein, 10 aa, Homo sapiens
  light chain complementarity determining region 3 for antibody 21853
QQRYNWPPWT

SEQ ID NO: 43706 - protein, 20 aa, Homo sapiens
  heavy chain complementarity determining region 3 for antibody 21853
ARHRQVTVAASFEVFWYFDL

SEQ ID NO: 43707 - protein, 10 aa, Homo sapiens
  light chain complementarity determining region 3 for antibody 21854
QQRYNWPPST

SEQ ID NO: 43708 - protein, 11 aa, Homo sapiens
  heavy chain complementarity determining region 3 for antibody 21854
ARGVGSYVFDS

SEQ ID NO: 43709 - protein, 10 aa, Homo sapiens
  light chain complementarity determining region 3 for antibody 21855
QQRYNWPPSP

SEQ ID NO: 43710 - protein, 11 aa, Homo sapiens
  heavy chain complementarity determining region 3 for antibody 21855
ARGVGSYPFDS

SEQ ID NO: 43711 - protein, 10 aa, Homo sapiens
  light chain complementarity determining region 3 for antibody 21856
QQRYNWPPFT

SEQ ID NO: 43712 - protein, 11 aa, Homo sapiens
  heavy chain complementarity determining region 3 for antibody 21856
ARGVGSYPSDS

SEQ ID NO: 43713 - protein, 10 aa, Homo sapiens
  light chain complementarity determining region 3 for antibody 21857
QQRYNWPPFT

SEQ ID NO: 43714 - protein, 11 aa, Homo sapiens
  heavy chain complementarity determining region 3 for antibody 21857
ARGVGSYPLDS

SEQ ID NO: 43715 - protein, 10 aa, Homo sapiens
  light chain complementarity determining region 3 for antibody 21858
QQRYNWPPFT

SEQ ID NO: 43716 - protein, 11 aa, Homo sapiens
  heavy chain complementarity determining region 3 for antibody 21858
ARGVGSYPFDA

SEQ ID NO: 43717 - protein, 10 aa, Homo sapiens
  light chain complementarity determining region 3 for antibody 21859
QQRYNWPPFT

SEQ ID NO: 43718 - protein, 11 aa, Homo sapiens
  heavy chain complementarity determining region 3 for antibody 21859
AKGVGSYPFDS

SEQ ID NO: 43719 - protein, 10 aa, Homo sapiens
  light chain complementarity determining region 3 for antibody 21860
QQRYNWPPFT

SEQ ID NO: 43720 - protein, 11 aa, Homo sapiens
  heavy chain complementarity determining region 3 for antibody 21860
AGGVGSYPFDS

SEQ ID NO: 43721 - protein, 10 aa, Homo sapiens
  light chain complementarity determining region 3 for antibody 21861
QQRYNWPPFI

SEQ ID NO: 43722 - protein, 11 aa, Homo sapiens
  heavy chain complementarity determining region 3 for antibody 21861
ARGVGSYPFDS

SEQ ID NO: 43723 - protein, 10 aa, Homo sapiens
  light chain complementarity determining region 3 for antibody 21862
QQRYNWPPCT

SEQ ID NO: 43724 - protein, 11 aa, Homo sapiens
  heavy chain complementarity determining region 3 for antibody 21862
ARGVGSYPFDS

SEQ ID NO: 43725 - protein, 10 aa, Homo sapiens
  light chain complementarity determining region 3 for antibody 21863
QQRYNRPPYT

SEQ ID NO: 43726 - protein, 11 aa, Homo sapiens
  heavy chain complementarity determining region 3 for antibody 21863
TRGVGSYPFDQ

SEQ ID NO: 43727 - protein, 10 aa, Homo sapiens
  light chain complementarity determining region 3 for antibody 21864
QQRYNRPPYT

SEQ ID NO: 43728 - protein, 11 aa, Homo sapiens
  heavy chain complementarity determining region 3 for antibody 21864
ARGVGSYVFDS

SEQ ID NO: 43729 - protein, 10 aa, Homo sapiens
  light chain complementarity determining region 3 for antibody 21865
QQRYNLPPYT

SEQ ID NO: 43730 - protein, 11 aa, Homo sapiens
  heavy chain complementarity determining region 3 for antibody 21865
ARGVGSYVFES

SEQ ID NO: 43731 - protein, 10 aa, Homo sapiens
  light chain complementarity determining region 3 for antibody 21866
QQRYNLPPVT

SEQ ID NO: 43732 - protein, 11 aa, Homo sapiens
  heavy chain complementarity determining region 3 for antibody 21866
ARGVGSYPFDS

SEQ ID NO: 43733 - protein, 10 aa, Homo sapiens
  light chain complementarity determining region 3 for antibody 21867
QQRYNGPPYT

SEQ ID NO: 43734 - protein, 11 aa, Homo sapiens
  heavy chain complementarity determining region 3 for antibody 21867
ARGVGSYVFES

SEQ ID NO: 43735 - protein, 10 aa, Homo sapiens
  light chain complementarity determining region 3 for antibody 21868
QQRYNCPPYT

SEQ ID NO: 43736 - protein, 11 aa, Homo sapiens
  heavy chain complementarity determining region 3 for antibody 21868
ARGVGSYVFES

SEQ ID NO: 43737 - protein, 10 aa, Homo sapiens
  light chain complementarity determining region 3 for antibody 21869
QQRYNCPPWT

SEQ ID NO: 43738 - protein, 20 aa, Homo sapiens
  heavy chain complementarity determining region 3 for antibody 21869
ARHRQVTVADSFEVFWYFDL

SEQ ID NO: 43739 - protein, 10 aa, Homo sapiens
  light chain complementarity determining region 3 for antibody 21870
QQRYNCPPFT

SEQ ID NO: 43740 - protein, 11 aa, Homo sapiens
  heavy chain complementarity determining region 3 for antibody 21870
ARGVGSYPFDS

SEQ ID NO: 43741 - protein, 10 aa, Homo sapiens
  light chain complementarity determining region 3 for antibody 21871
QQRYKWPPYT

SEQ ID NO: 43742 - protein, 11 aa, Homo sapiens
  heavy chain complementarity determining region 3 for antibody 21871
ARGVGSYVFDP

SEQ ID NO: 43743 - protein, 10 aa, Homo sapiens
  light chain complementarity determining region 3 for antibody 21872
QQRYKWPPHT

SEQ ID NO: 43744 - protein, 11 aa, Homo sapiens
  heavy chain complementarity determining region 3 for antibody 21872
ARGVGSYVFES

SEQ ID NO: 43745 - protein, 10 aa, Homo sapiens
  light chain complementarity determining region 3 for antibody 21873
QQRYKWPPFT

SEQ ID NO: 43746 - protein, 11 aa, Homo sapiens
  heavy chain complementarity determining region 3 for antibody 21873
ARGVGSYPFDS

SEQ ID NO: 43747 - protein, 10 aa, Homo sapiens
  light chain complementarity determining region 3 for antibody 21874
QQRYKRPPYT

SEQ ID NO: 43748 - protein, 11 aa, Homo sapiens
  heavy chain complementarity determining region 3 for antibody 21874
ARGVGSYVFDS

SEQ ID NO: 43749 - protein, 10 aa, Homo sapiens
  light chain complementarity determining region 3 for antibody 21875
QQRYKLPPYT

SEQ ID NO: 43750 - protein, 11 aa, Homo sapiens
  heavy chain complementarity determining region 3 for antibody 21875
ARGVGSYVFDS

SEQ ID NO: 43751 - protein, 9 aa, Homo sapiens
  light chain complementarity determining region 3 for antibody 21876
QQRYITLLT

SEQ ID NO: 43752 - protein, 16 aa, Homo sapiens
  heavy chain complementarity determining region 3 for antibody 21876
ARDVSFGELLSGTPDY

SEQ ID NO: 43753 - protein, 10 aa, Homo sapiens
  light chain complementarity determining region 3 for antibody 21877
QQRYHWPPFT

SEQ ID NO: 43754 - protein, 11 aa, Homo sapiens
  heavy chain complementarity determining region 3 for antibody 21877
ARGVGSYPFDS

SEQ ID NO: 43755 - protein, 10 aa, Homo sapiens
  light chain complementarity determining region 3 for antibody 21878
QQRYFTPPLT

SEQ ID NO: 43756 - protein, 20 aa, Homo sapiens
  heavy chain complementarity determining region 3 for antibody 21878
ARNTGTSSWSPLSYYYGMDV

SEQ ID NO: 43757 - protein, 9 aa, Homo sapiens
  light chain complementarity determining region 3 for antibody 21879
QQRTNWRFT

SEQ ID NO: 43758 - protein, 16 aa, Homo sapiens
  heavy chain complementarity determining region 3 for antibody 21879
ARDQGYCLGTNCYSLH

SEQ ID NO: 43759 - protein, 11 aa, Homo sapiens
  light chain complementarity determining region 3 for antibody 21880
QQRTNWPPLYT

SEQ ID NO: 43760 - protein, 14 aa, Homo sapiens
  heavy chain complementarity determining region 3 for antibody 21880
ARGGLGIWGNSSDI

SEQ ID NO: 43761 - protein, 11 aa, Homo sapiens
  light chain complementarity determining region 3 for antibody 21881
QQRTNWPPIYT

SEQ ID NO: 43762 - protein, 14 aa, Homo sapiens
  heavy chain complementarity determining region 3 for antibody 21881
ARGGLGVWGNSSDI

SEQ ID NO: 43763 - protein, 11 aa, Homo sapiens
  light chain complementarity determining region 3 for antibody 21882
QQRTNWPPIYT

SEQ ID NO: 43764 - protein, 14 aa, Homo sapiens
  heavy chain complementarity determining region 3 for antibody 21882
ARGGLGIWGNASDI

SEQ ID NO: 43765 - protein, 11 aa, Homo sapiens
  light chain complementarity determining region 3 for antibody 21883
QQRTNWPPINT

SEQ ID NO: 43766 - protein, 14 aa, Homo sapiens
  heavy chain complementarity determining region 3 for antibody 21883
ARGGLGIWGNSSDI

SEQ ID NO: 43767 - protein, 11 aa, Homo sapiens
  light chain complementarity determining region 3 for antibody 21884
QQRTNWPPIHT

SEQ ID NO: 43768 - protein, 14 aa, Homo sapiens
  heavy chain complementarity determining region 3 for antibody 21884
ARGGLGIWGNSSDI

SEQ ID NO: 43769 - protein, 9 aa, Homo sapiens
  light chain complementarity determining region 3 for antibody 21885
QQRTNRRFT

SEQ ID NO: 43770 - protein, 16 aa, Homo sapiens
  heavy chain complementarity determining region 3 for antibody 21885
ARDQGYCLGTNCYLLH

SEQ ID NO: 43771 - protein, 8 aa, Homo sapiens
  light chain complementarity determining region 3 for antibody 21886
QQRTKSVT

SEQ ID NO: 43772 - protein, 11 aa, Homo sapiens
  heavy chain complementarity determining region 3 for antibody 21886
GRGTSTWTDDF

SEQ ID NO: 43773 - protein, 9 aa, Homo sapiens
  light chain complementarity determining region 3 for antibody 21887
QQRTDWPPT

SEQ ID NO: 43774 - protein, 17 aa, Homo sapiens
  heavy chain complementarity determining region 3 for antibody 21887
AGTALCESPAYYRFFDY

SEQ ID NO: 43775 - protein, 9 aa, Homo sapiens
  light chain complementarity determining region 3 for antibody 21888
QQRTDWPPA

SEQ ID NO: 43776 - protein, 17 aa, Homo sapiens
  heavy chain complementarity determining region 3 for antibody 21888
ARTALCESPAYYRFFDY

SEQ ID NO: 43777 - protein, 10 aa, Homo sapiens
  light chain complementarity determining region 3 for antibody 21889
QQRSTWPPLT

SEQ ID NO: 43778 - protein, 9 aa, Homo sapiens
  heavy chain complementarity determining region 3 for antibody 21889
ARVDGYFDY

SEQ ID NO: 43779 - protein, 9 aa, Homo sapiens
  light chain complementarity determining region 3 for antibody 21890
QQRSSWSYT

SEQ ID NO: 43780 - protein, 11 aa, Homo sapiens
  heavy chain complementarity determining region 3 for antibody 21890
VKRWGGSSIDY

SEQ ID NO: 43781 - protein, 9 aa, Homo sapiens
  light chain complementarity determining region 3 for antibody 21891
QQRSSWPYT

SEQ ID NO: 43782 - protein, 11 aa, Homo sapiens
  heavy chain complementarity determining region 3 for antibody 21891
VKRWGGSSVDY

SEQ ID NO: 43783 - protein, 9 aa, Homo sapiens
  light chain complementarity determining region 3 for antibody 21892
QQRSSWPYT

SEQ ID NO: 43784 - protein, 11 aa, Homo sapiens
  heavy chain complementarity determining region 3 for antibody 21892
VKRWGGSSSDY

SEQ ID NO: 43785 - protein, 9 aa, Homo sapiens
  light chain complementarity determining region 3 for antibody 21893
QQRSSWPYT

SEQ ID NO: 43786 - protein, 11 aa, Homo sapiens
  heavy chain complementarity determining region 3 for antibody 21893
VKRWGGSSIDS

SEQ ID NO: 43787 - protein, 9 aa, Homo sapiens
  light chain complementarity determining region 3 for antibody 21894
QQRSSWPYT

SEQ ID NO: 43788 - protein, 11 aa, Homo sapiens
  heavy chain complementarity determining region 3 for antibody 21894
VKRWGGSSIDD

SEQ ID NO: 43789 - protein, 9 aa, Homo sapiens
  light chain complementarity determining region 3 for antibody 21895
QQRSSWPYT

SEQ ID NO: 43790 - protein, 11 aa, Homo sapiens
  heavy chain complementarity determining region 3 for antibody 21895
VKRWGGGSIDY

SEQ ID NO: 43791 - protein, 9 aa, Homo sapiens
  light chain complementarity determining region 3 for antibody 21896
QQRSSWPYT

SEQ ID NO: 43792 - protein, 11 aa, Homo sapiens
  heavy chain complementarity determining region 3 for antibody 21896
VKRWCGSSIDY

SEQ ID NO: 43793 - protein, 9 aa, Homo sapiens
  light chain complementarity determining region 3 for antibody 21897
QQRSSWPYS

SEQ ID NO: 43794 - protein, 11 aa, Homo sapiens
  heavy chain complementarity determining region 3 for antibody 21897
VKRWGGSSIDY

SEQ ID NO: 43795 - protein, 9 aa, Homo sapiens
  light chain complementarity determining region 3 for antibody 21898
QQRSSWPRT

SEQ ID NO: 43796 - protein, 17 aa, Homo sapiens
  heavy chain complementarity determining region 3 for antibody 21898
ARDYNYESGGSSGAFDI

SEQ ID NO: 43797 - protein, 10 aa, Homo sapiens
  light chain complementarity determining region 3 for antibody 21899
QQRSQWPPLT

SEQ ID NO: 43798 - protein, 9 aa, Homo sapiens
  heavy chain complementarity determining region 3 for antibody 21899
ARVDGYFDY

SEQ ID NO: 43799 - protein, 10 aa, Homo sapiens
  light chain complementarity determining region 3 for antibody 21900
QQRSQGPPLT

SEQ ID NO: 43800 - protein, 11 aa, Homo sapiens
  heavy chain complementarity determining region 3 for antibody 21900
ASPVLLPWFDS

SEQ ID NO: 43801 - protein, 9 aa, Homo sapiens
  light chain complementarity determining region 3 for antibody 21901
QQRSNWPYT

SEQ ID NO: 43802 - protein, 13 aa, Homo sapiens
  heavy chain complementarity determining region 3 for antibody 21901
ARYSSKSPDRGDY

SEQ ID NO: 43803 - protein, 9 aa, Homo sapiens
  light chain complementarity determining region 3 for antibody 21902
QQRSNWPWT

SEQ ID NO: 43804 - protein, 19 aa, Homo sapiens
  heavy chain complementarity determining region 3 for antibody 21902
ARGWSGAATYGYYYCGMDV

SEQ ID NO: 43805 - protein, 9 aa, Homo sapiens
  light chain complementarity determining region 3 for antibody 21903
QQRSNWPST

SEQ ID NO: 43806 - protein, 8 aa, Homo sapiens
  heavy chain complementarity determining region 3 for antibody 21903
ATLGNDSD

SEQ ID NO: 43807 - protein, 9 aa, Homo sapiens
  light chain complementarity determining region 3 for antibody 21904
QQRSNWPRT

SEQ ID NO: 43808 - protein, 17 aa, Homo sapiens
  heavy chain complementarity determining region 3 for antibody 21904
ARDYDYESGGSSGAFDI

SEQ ID NO: 43809 - protein, 9 aa, Homo sapiens
  light chain complementarity determining region 3 for antibody 21905
QQRSNWPQT

SEQ ID NO: 43810 - protein, 16 aa, Homo sapiens
  heavy chain complementarity determining region 3 for antibody 21905
ARDGANNWFFKHGLDV

SEQ ID NO: 43811 - protein, 10 aa, Homo sapiens
  light chain complementarity determining region 3 for antibody 21906
QQRSNWPPWT

SEQ ID NO: 43812 - protein, 20 aa, Homo sapiens
  heavy chain complementarity determining region 3 for antibody 21906
AREKGYCSSTSCPGGYYSDY

SEQ ID NO: 43813 - protein, 10 aa, Homo sapiens
  light chain complementarity determining region 3 for antibody 21907
QQRSNWPPTT

SEQ ID NO: 43814 - protein, 11 aa, Homo sapiens
  heavy chain complementarity determining region 3 for antibody 21907
ASQKSYDYFDF

SEQ ID NO: 43815 - protein, 9 aa, Homo sapiens
  light chain complementarity determining region 3 for antibody 21908
QQRSNWPPT

SEQ ID NO: 43816 - protein, 8 aa, Homo sapiens
  heavy chain complementarity determining region 3 for antibody 21908
ATLGNESD

SEQ ID NO: 43817 - protein, 9 aa, Homo sapiens
  light chain complementarity determining region 3 for antibody 21909
QQRSNWPPT

SEQ ID NO: 43818 - protein, 8 aa, Homo sapiens
  heavy chain complementarity determining region 3 for antibody 21909
ATLGHDSD

SEQ ID NO: 43819 - protein, 9 aa, Homo sapiens
  light chain complementarity determining region 3 for antibody 21910
QQRSNWPPT

SEQ ID NO: 43820 - protein, 8 aa, Homo sapiens
  heavy chain complementarity determining region 3 for antibody 21910
ATLGDDSD

SEQ ID NO: 43821 - protein, 11 aa, Homo sapiens
  light chain complementarity determining region 3 for antibody 21911
QQRSNWPPRPP

SEQ ID NO: 43822 - protein, 17 aa, Homo sapiens
  heavy chain complementarity determining region 3 for antibody 21911
ARDGSLDPLYGSGSYGY

SEQ ID NO: 43823 - protein, 9 aa, Homo sapiens
  light chain complementarity determining region 3 for antibody 21912
QQRSNWPPN

SEQ ID NO: 43824 - protein, 8 aa, Homo sapiens
  heavy chain complementarity determining region 3 for antibody 21912
ATLGNDSD

SEQ ID NO: 43825 - protein, 10 aa, Homo sapiens
  light chain complementarity determining region 3 for antibody 21913
QQRSNWPPLP

SEQ ID NO: 43826 - protein, 9 aa, Homo sapiens
  heavy chain complementarity determining region 3 for antibody 21913
ARVDGYFDY

SEQ ID NO: 43827 - protein, 11 aa, Homo sapiens
  light chain complementarity determining region 3 for antibody 21914
QQRSNWPPIYT

SEQ ID NO: 43828 - protein, 14 aa, Homo sapiens
  heavy chain complementarity determining region 3 for antibody 21914
ARGGLGIWGNSSDI

SEQ ID NO: 43829 - protein, 10 aa, Homo sapiens
  light chain complementarity determining region 3 for antibody 21915
QQRSNWPPIT

SEQ ID NO: 43830 - protein, 11 aa, Homo sapiens
  heavy chain complementarity determining region 3 for antibody 21915
ASRKSYDYFDF

SEQ ID NO: 43831 - protein, 10 aa, Homo sapiens
  light chain complementarity determining region 3 for antibody 21916
QQRSNWPPIT

SEQ ID NO: 43832 - protein, 11 aa, Homo sapiens
  heavy chain complementarity determining region 3 for antibody 21916
ASQKSYDYFDL

SEQ ID NO: 43833 - protein, 10 aa, Homo sapiens
  light chain complementarity determining region 3 for antibody 21917
QQRSNWPPIP

SEQ ID NO: 43834 - protein, 11 aa, Homo sapiens
  heavy chain complementarity determining region 3 for antibody 21917
ASQKSYDYFDF

SEQ ID NO: 43835 - protein, 9 aa, Homo sapiens
  light chain complementarity determining region 3 for antibody 21918
QQRSNWPPH

SEQ ID NO: 43836 - protein, 8 aa, Homo sapiens
  heavy chain complementarity determining region 3 for antibody 21918
ATLGNDSD

SEQ ID NO: 43837 - protein, 11 aa, Homo sapiens
  light chain complementarity determining region 3 for antibody 21919
QQRSNWPPGLT

SEQ ID NO: 43838 - protein, 15 aa, Homo sapiens
  heavy chain complementarity determining region 3 for antibody 21919
AREYYDSSGYYYADD

SEQ ID NO: 43839 - protein, 9 aa, Homo sapiens
  light chain complementarity determining region 3 for antibody 21920
QQRSNWPPA

SEQ ID NO: 43840 - protein, 8 aa, Homo sapiens
  heavy chain complementarity determining region 3 for antibody 21920
ATLGNDSD

SEQ ID NO: 43841 - protein, 9 aa, Homo sapiens
  light chain complementarity determining region 3 for antibody 21921
QQRSNWPLT

SEQ ID NO: 43842 - protein, 9 aa, Homo sapiens
  heavy chain complementarity determining region 3 for antibody 21921
ASYGDWVDY

SEQ ID NO: 43843 - protein, 9 aa, Homo sapiens
  light chain complementarity determining region 3 for antibody 21922
QQRSNWPLT

SEQ ID NO: 43844 - protein, 9 aa, Homo sapiens
  heavy chain complementarity determining region 3 for antibody 21922
ANCGDWVDY

SEQ ID NO: 43845 - protein, 9 aa, Homo sapiens
  light chain complementarity determining region 3 for antibody 21923
QQRSNWPLT

SEQ ID NO: 43846 - protein, 15 aa, Homo sapiens
  heavy chain complementarity determining region 3 for antibody 21923
AKGTSIAARPDCFDL

SEQ ID NO: 43847 - protein, 9 aa, Homo sapiens
  light chain complementarity determining region 3 for antibody 21924
QQRSNWPLT

SEQ ID NO: 43848 - protein, 9 aa, Homo sapiens
  heavy chain complementarity determining region 3 for antibody 21924
AHYGDWVDY

SEQ ID NO: 43849 - protein, 9 aa, Homo sapiens
  light chain complementarity determining region 3 for antibody 21925
QQRSNWPLP

SEQ ID NO: 43850 - protein, 14 aa, Homo sapiens
  heavy chain complementarity determining region 3 for antibody 21925
ARSLSSAWYDWSDP

SEQ ID NO: 43851 - protein, 9 aa, Homo sapiens
  light chain complementarity determining region 3 for antibody 21926
QQRSNWPLP

SEQ ID NO: 43852 - protein, 14 aa, Homo sapiens
  heavy chain complementarity determining region 3 for antibody 21926
ARGPEEAAGGEFDS

SEQ ID NO: 43853 - protein, 9 aa, Homo sapiens
  light chain complementarity determining region 3 for antibody 21927
QQRSNWPFT

SEQ ID NO: 43854 - protein, 14 aa, Homo sapiens
  heavy chain complementarity determining region 3 for antibody 21927
ARSLSSAWYDWLDP

SEQ ID NO: 43855 - protein, 8 aa, Homo sapiens
  light chain complementarity determining region 3 for antibody 21928
QQRSNWLT

SEQ ID NO: 43856 - protein, 16 aa, Homo sapiens
  heavy chain complementarity determining region 3 for antibody 21928
AKDRVLMGSSGGSFDY

SEQ ID NO: 43857 - protein, 8 aa, Homo sapiens
  light chain complementarity determining region 3 for antibody 21929
QQRSNWLT

SEQ ID NO: 43858 - protein, 16 aa, Homo sapiens
  heavy chain complementarity determining region 3 for antibody 21929
AKDIVLMGSSGGSLDY

SEQ ID NO: 43859 - protein, 8 aa, Homo sapiens
  light chain complementarity determining region 3 for antibody 21930
QQRSNWLT

SEQ ID NO: 43860 - protein, 16 aa, Homo sapiens
  heavy chain complementarity determining region 3 for antibody 21930
AKDIGLMGSSGGSFDY

SEQ ID NO: 43861 - protein, 8 aa, Homo sapiens
  light chain complementarity determining region 3 for antibody 21931
QQRSNPIT

SEQ ID NO: 43862 - protein, 15 aa, Homo sapiens
  heavy chain complementarity determining region 3 for antibody 21931
ASRGEIAVAGPYFDY

SEQ ID NO: 43863 - protein, 9 aa, Homo sapiens
  light chain complementarity determining region 3 for antibody 21932
QQRSNGPPT

SEQ ID NO: 43864 - protein, 8 aa, Homo sapiens
  heavy chain complementarity determining region 3 for antibody 21932
ATLGNDSD

SEQ ID NO: 43865 - protein, 9 aa, Homo sapiens
  light chain complementarity determining region 3 for antibody 21933
QQRSNFLFT

SEQ ID NO: 43866 - protein, 17 aa, Homo sapiens
  heavy chain complementarity determining region 3 for antibody 21933
ASTLNRYYYDSSGRIDY

SEQ ID NO: 43867 - protein, 10 aa, Homo sapiens
  light chain complementarity determining region 3 for antibody 21934
QQRSKWPQLT

SEQ ID NO: 43868 - protein, 9 aa, Homo sapiens
  heavy chain complementarity determining region 3 for antibody 21934
ARVDGYFDY

SEQ ID NO: 43869 - protein, 10 aa, Homo sapiens
  light chain complementarity determining region 3 for antibody 21935
QQRSKWPPLT

SEQ ID NO: 43870 - protein, 9 aa, Homo sapiens
  heavy chain complementarity determining region 3 for antibody 21935
ARVDGYFDS

SEQ ID NO: 43871 - protein, 10 aa, Homo sapiens
  light chain complementarity determining region 3 for antibody 21936
QQRSKWPPLT

SEQ ID NO: 43872 - protein, 9 aa, Homo sapiens
  heavy chain complementarity determining region 3 for antibody 21936
ARVDGCFDY

SEQ ID NO: 43873 - protein, 10 aa, Homo sapiens
  light chain complementarity determining region 3 for antibody 21937
QQRSKWPPLN

SEQ ID NO: 43874 - protein, 9 aa, Homo sapiens
  heavy chain complementarity determining region 3 for antibody 21937
ARVDGYFDY

SEQ ID NO: 43875 - protein, 10 aa, Homo sapiens
  light chain complementarity determining region 3 for antibody 21938
QQRSKWPPLH

SEQ ID NO: 43876 - protein, 9 aa, Homo sapiens
  heavy chain complementarity determining region 3 for antibody 21938
ARVDGYFDY

SEQ ID NO: 43877 - protein, 8 aa, Homo sapiens
  light chain complementarity determining region 3 for antibody 21939
QQRSHWLT

SEQ ID NO: 43878 - protein, 16 aa, Homo sapiens
  heavy chain complementarity determining region 3 for antibody 21939
AKDIVLMGSSGGSFDY

SEQ ID NO: 43879 - protein, 10 aa, Homo sapiens
  light chain complementarity determining region 3 for antibody 21940
QQRSEWPPLT

SEQ ID NO: 43880 - protein, 9 aa, Homo sapiens
  heavy chain complementarity determining region 3 for antibody 21940
ARVDGYFDY

SEQ ID NO: 43881 - protein, 10 aa, Homo sapiens
  light chain complementarity determining region 3 for antibody 21941
QQRSDWPPLT

SEQ ID NO: 43882 - protein, 10 aa, Homo sapiens
  heavy chain complementarity determining region 3 for antibody 21941
ASDYTMTFDY

SEQ ID NO: 43883 - protein, 10 aa, Homo sapiens
  light chain complementarity determining region 3 for antibody 21942
QQRSDWPPLT

SEQ ID NO: 43884 - protein, 10 aa, Homo sapiens
  heavy chain complementarity determining region 3 for antibody 21942
ARDYAMTFDY

SEQ ID NO: 43885 - protein, 8 aa, Homo sapiens
  light chain complementarity determining region 3 for antibody 21943
QQRSDGHT

SEQ ID NO: 43886 - protein, 13 aa, Homo sapiens
  heavy chain complementarity determining region 3 for antibody 21943
ATNSGSYPNYLDP

SEQ ID NO: 43887 - protein, 9 aa, Homo sapiens
  light chain complementarity determining region 3 for antibody 21944
QQRRSWPYT

SEQ ID NO: 43888 - protein, 11 aa, Homo sapiens
  heavy chain complementarity determining region 3 for antibody 21944
VKRWGGSSIDY

SEQ ID NO: 43889 - protein, 9 aa, Homo sapiens
  light chain complementarity determining region 3 for antibody 21945
QQRRNWPPT

SEQ ID NO: 43890 - protein, 17 aa, Homo sapiens
  heavy chain complementarity determining region 3 for antibody 21945
ARGKGSSGSYYPYYFDY

SEQ ID NO: 43891 - protein, 9 aa, Homo sapiens
  light chain complementarity determining region 3 for antibody 21946
QQRRNWPPT

SEQ ID NO: 43892 - protein, 15 aa, Homo sapiens
  heavy chain complementarity determining region 3 for antibody 21946
AKGTSIAARPDCFDL

SEQ ID NO: 43893 - protein, 9 aa, Homo sapiens
  light chain complementarity determining region 3 for antibody 21947
QQRRNWPLT

SEQ ID NO: 43894 - protein, 15 aa, Homo sapiens
  heavy chain complementarity determining region 3 for antibody 21947
AKGTSIAARSDCFDL

SEQ ID NO: 43895 - protein, 9 aa, Homo sapiens
  light chain complementarity determining region 3 for antibody 21948
QQRRNWPLP

SEQ ID NO: 43896 - protein, 15 aa, Homo sapiens
  heavy chain complementarity determining region 3 for antibody 21948
AKGTSIAARPDCFDL

SEQ ID NO: 43897 - protein, 9 aa, Homo sapiens
  light chain complementarity determining region 3 for antibody 21949
QQRRNWPFT

SEQ ID NO: 43898 - protein, 14 aa, Homo sapiens
  heavy chain complementarity determining region 3 for antibody 21949
ARSLSSAWYDWSDP

SEQ ID NO: 43899 - protein, 10 aa, Homo sapiens
  light chain complementarity determining region 3 for antibody 21950
QQRRKWPPLT

SEQ ID NO: 43900 - protein, 9 aa, Homo sapiens
  heavy chain complementarity determining region 3 for antibody 21950
ARVDGYFDY

SEQ ID NO: 43901 - protein, 9 aa, Homo sapiens
  light chain complementarity determining region 3 for antibody 21951
QQRRGWPIT

SEQ ID NO: 43902 - protein, 17 aa, Homo sapiens
  heavy chain complementarity determining region 3 for antibody 21951
AKGTADTHSGWPYYIDS

SEQ ID NO: 43903 - protein, 9 aa, Homo sapiens
  light chain complementarity determining region 3 for antibody 21952
QQRRDWPRT

SEQ ID NO: 43904 - protein, 17 aa, Homo sapiens
  heavy chain complementarity determining region 3 for antibody 21952
AQGGGYCGGDCFFSYDH

SEQ ID NO: 43905 - protein, 9 aa, Homo sapiens
  light chain complementarity determining region 3 for antibody 21953
QQRRDWPIT

SEQ ID NO: 43906 - protein, 17 aa, Homo sapiens
  heavy chain complementarity determining region 3 for antibody 21953
AKGTADTHSGCPYYIDS

SEQ ID NO: 43907 - protein, 9 aa, Homo sapiens
  light chain complementarity determining region 3 for antibody 21954
QQRRDLPIT

SEQ ID NO: 43908 - protein, 17 aa, Homo sapiens
  heavy chain complementarity determining region 3 for antibody 21954
AKGTADTHSGWPYYIDS

SEQ ID NO: 43909 - protein, 9 aa, Homo sapiens
  light chain complementarity determining region 3 for antibody 21955
QQRRAWPRT

SEQ ID NO: 43910 - protein, 17 aa, Homo sapiens
  heavy chain complementarity determining region 3 for antibody 21955
AQGGGYCGGDCFFYYDH

SEQ ID NO: 43911 - protein, 10 aa, Homo sapiens
  light chain complementarity determining region 3 for antibody 21956
QQRQVWPPIT

SEQ ID NO: 43912 - protein, 12 aa, Homo sapiens
  heavy chain complementarity determining region 3 for antibody 21956
ARAPTHVAMFDY

SEQ ID NO: 43913 - protein, 10 aa, Homo sapiens
  light chain complementarity determining region 3 for antibody 21957
QQRQFWPPIT

SEQ ID NO: 43914 - protein, 12 aa, Homo sapiens
  heavy chain complementarity determining region 3 for antibody 21957
ARAPTHVAMFDY

SEQ ID NO: 43915 - protein, 10 aa, Homo sapiens
  light chain complementarity determining region 3 for antibody 21958
QQRQFWPPFT

SEQ ID NO: 43916 - protein, 12 aa, Homo sapiens
  heavy chain complementarity determining region 3 for antibody 21958
ARAPTHVAMFEY

SEQ ID NO: 43917 - protein, 11 aa, Homo sapiens
  light chain complementarity determining region 3 for antibody 21959
QQRPNWPPIYT

SEQ ID NO: 43918 - protein, 14 aa, Homo sapiens
  heavy chain complementarity determining region 3 for antibody 21959
ARGGLGIWGNSSDI

SEQ ID NO: 43919 - protein, 9 aa, Homo sapiens
  light chain complementarity determining region 3 for antibody 21960
QQRPDWPPP

SEQ ID NO: 43920 - protein, 17 aa, Homo sapiens
  heavy chain complementarity determining region 3 for antibody 21960
ARTALCESPAYYRFFDY

SEQ ID NO: 43921 - protein, 9 aa, Homo sapiens
  light chain complementarity determining region 3 for antibody 21961
QQRNSWPTT

SEQ ID NO: 43922 - protein, 14 aa, Homo sapiens
  heavy chain complementarity determining region 3 for antibody 21961
ARDPFAGSGVGFDF

SEQ ID NO: 43923 - protein, 9 aa, Homo sapiens
  light chain complementarity determining region 3 for antibody 21962
QQRNSVPRT

SEQ ID NO: 43924 - protein, 15 aa, Homo sapiens
  heavy chain complementarity determining region 3 for antibody 21962
ASMPYNSYRNPPFDN

SEQ ID NO: 43925 - protein, 9 aa, Homo sapiens
  light chain complementarity determining region 3 for antibody 21963
QQRNSRPTT

SEQ ID NO: 43926 - protein, 14 aa, Homo sapiens
  heavy chain complementarity determining region 3 for antibody 21963
ARDPFSGSGVGFDF

SEQ ID NO: 43927 - protein, 9 aa, Homo sapiens
  light chain complementarity determining region 3 for antibody 21964
QQRNSLPTT

SEQ ID NO: 43928 - protein, 14 aa, Homo sapiens
  heavy chain complementarity determining region 3 for antibody 21964
ARDPFSGSGVGFDF

SEQ ID NO: 43929 - protein, 9 aa, Homo sapiens
  light chain complementarity determining region 3 for antibody 21965
QQRNPWPTT

SEQ ID NO: 43930 - protein, 14 aa, Homo sapiens
  heavy chain complementarity determining region 3 for antibody 21965
ARDPFSGSGVGFDF

SEQ ID NO: 43931 - protein, 8 aa, Homo sapiens
  light chain complementarity determining region 3 for antibody 21966
QQRNLRLT

SEQ ID NO: 43932 - protein, 13 aa, Homo sapiens
  heavy chain complementarity determining region 3 for antibody 21966
TTDAAFVPYYFAY

SEQ ID NO: 43933 - protein, 9 aa, Homo sapiens
  light chain complementarity determining region 3 for antibody 21967
QQRNKWPRT

SEQ ID NO: 43934 - protein, 13 aa, Homo sapiens
  heavy chain complementarity determining region 3 for antibody 21967
AKELGSLRYDFDY

SEQ ID NO: 43935 - protein, 9 aa, Homo sapiens
  light chain complementarity determining region 3 for antibody 21968
QQRNKWPRT

SEQ ID NO: 43936 - protein, 13 aa, Homo sapiens
  heavy chain complementarity determining region 3 for antibody 21968
AKDLGSLRYDVDY

SEQ ID NO: 43937 - protein, 9 aa, Homo sapiens
  light chain complementarity determining region 3 for antibody 21969
QQRNKWPRT

SEQ ID NO: 43938 - protein, 13 aa, Homo sapiens
  heavy chain complementarity determining region 3 for antibody 21969
AKDLGSLRYDFGY

SEQ ID NO: 43939 - protein, 9 aa, Homo sapiens
  light chain complementarity determining region 3 for antibody 21970
QQRNKWPRP

SEQ ID NO: 43940 - protein, 13 aa, Homo sapiens
  heavy chain complementarity determining region 3 for antibody 21970
AKDLGSLRYDFDY

SEQ ID NO: 43941 - protein, 9 aa, Homo sapiens
  light chain complementarity determining region 3 for antibody 21971
QQRNKWHRT

SEQ ID NO: 43942 - protein, 13 aa, Homo sapiens
  heavy chain complementarity determining region 3 for antibody 21971
AKDLGSLRYDFDY

SEQ ID NO: 43943 - protein, 8 aa, Homo sapiens
  light chain complementarity determining region 3 for antibody 21972
QQRNFRPP

SEQ ID NO: 43944 - protein, 13 aa, Homo sapiens
  heavy chain complementarity determining region 3 for antibody 21972
TTDAAFVPYYFTY

SEQ ID NO: 43945 - protein, 8 aa, Homo sapiens
  light chain complementarity determining region 3 for antibody 21973
QQRNFRLT

SEQ ID NO: 43946 - protein, 13 aa, Homo sapiens
  heavy chain complementarity determining region 3 for antibody 21973
TTDTAFVPYYFTY

SEQ ID NO: 43947 - protein, 8 aa, Homo sapiens
  light chain complementarity determining region 3 for antibody 21974
QQRNFRLT

SEQ ID NO: 43948 - protein, 13 aa, Homo sapiens
  heavy chain complementarity determining region 3 for antibody 21974
TTDAAFVPYYFTD

SEQ ID NO: 43949 - protein, 8 aa, Homo sapiens
  light chain complementarity determining region 3 for antibody 21975
QQRNFRLT

SEQ ID NO: 43950 - protein, 13 aa, Homo sapiens
  heavy chain complementarity determining region 3 for antibody 21975
TTDAAFVPYDFTY

SEQ ID NO: 43951 - protein, 8 aa, Homo sapiens
  light chain complementarity determining region 3 for antibody 21976
QQRNFRLT

SEQ ID NO: 43952 - protein, 13 aa, Homo sapiens
  heavy chain complementarity determining region 3 for antibody 21976
TTDAAFVPSYFTY

SEQ ID NO: 43953 - protein, 8 aa, Homo sapiens
  light chain complementarity determining region 3 for antibody 21977
QQRNFRLT

SEQ ID NO: 43954 - protein, 13 aa, Homo sapiens
  heavy chain complementarity determining region 3 for antibody 21977
TTDAAFVPCYFTY

SEQ ID NO: 43955 - protein, 8 aa, Homo sapiens
  light chain complementarity determining region 3 for antibody 21978
QQRNFRLT

SEQ ID NO: 43956 - protein, 13 aa, Homo sapiens
  heavy chain complementarity determining region 3 for antibody 21978
TTDAACVPYYFTY

SEQ ID NO: 43957 - protein, 8 aa, Homo sapiens
  light chain complementarity determining region 3 for antibody 21979
QQRNFRLT

SEQ ID NO: 43958 - protein, 13 aa, Homo sapiens
  heavy chain complementarity determining region 3 for antibody 21979
TADAAFVPYYFTY

SEQ ID NO: 43959 - protein, 8 aa, Homo sapiens
  light chain complementarity determining region 3 for antibody 21980
QQRNFRLT

SEQ ID NO: 43960 - protein, 13 aa, Homo sapiens
  heavy chain complementarity determining region 3 for antibody 21980
ATDAAFVPYYFTY

SEQ ID NO: 43961 - protein, 8 aa, Homo sapiens
  light chain complementarity determining region 3 for antibody 21981
QQRNFRLS

SEQ ID NO: 43962 - protein, 13 aa, Homo sapiens
  heavy chain complementarity determining region 3 for antibody 21981
TTDAAFVPYYFTY

SEQ ID NO: 43963 - protein, 8 aa, Homo sapiens
  light chain complementarity determining region 3 for antibody 21982
QQRNFRLA

SEQ ID NO: 43964 - protein, 13 aa, Homo sapiens
  heavy chain complementarity determining region 3 for antibody 21982
TTDAAFVPYYFTY

SEQ ID NO: 43965 - protein, 8 aa, Homo sapiens
  light chain complementarity determining region 3 for antibody 21983
QQRHTRPS

SEQ ID NO: 43966 - protein, 11 aa, Homo sapiens
  heavy chain complementarity determining region 3 for antibody 21983
ASGSMGWVFDH

SEQ ID NO: 43967 - protein, 8 aa, Homo sapiens
  light chain complementarity determining region 3 for antibody 21984
QQRHTRLS

SEQ ID NO: 43968 - protein, 11 aa, Homo sapiens
  heavy chain complementarity determining region 3 for antibody 21984
ASGSMGGVFDH

SEQ ID NO: 43969 - protein, 8 aa, Homo sapiens
  light chain complementarity determining region 3 for antibody 21985
QQRHTRLP

SEQ ID NO: 43970 - protein, 11 aa, Homo sapiens
  heavy chain complementarity determining region 3 for antibody 21985
ASGSMGWVFDH

SEQ ID NO: 43971 - protein, 9 aa, Homo sapiens
  light chain complementarity determining region 3 for antibody 21986
QQRHDWPIT

SEQ ID NO: 43972 - protein, 12 aa, Homo sapiens
  heavy chain complementarity determining region 3 for antibody 21986
AKGGSLWSVYDS

SEQ ID NO: 43973 - protein, 9 aa, Homo sapiens
  light chain complementarity determining region 3 for antibody 21987
QQRGSWPYT

SEQ ID NO: 43974 - protein, 11 aa, Homo sapiens
  heavy chain complementarity determining region 3 for antibody 21987
VKRWGGSSIDY

SEQ ID NO: 43975 - protein, 10 aa, Homo sapiens
  light chain complementarity determining region 3 for antibody 21988
QQRGSWPPIP

SEQ ID NO: 43976 - protein, 13 aa, Homo sapiens
  heavy chain complementarity determining region 3 for antibody 21988
VRELHAGAYYYDY

SEQ ID NO: 43977 - protein, 11 aa, Homo sapiens
  light chain complementarity determining region 3 for antibody 21989
QQRGSWPPGPT

SEQ ID NO: 43978 - protein, 23 aa, Homo sapiens
  heavy chain complementarity determining region 3 for antibody 21989
AARNVSHDSSGYPLADYFYGMDV

SEQ ID NO: 43979 - protein, 11 aa, Homo sapiens
  light chain complementarity determining region 3 for antibody 21990
QQRGSWPPGLP

SEQ ID NO: 43980 - protein, 23 aa, Homo sapiens
  heavy chain complementarity determining region 3 for antibody 21990
AARNVSHDSSGYPLADCFYGMDV

SEQ ID NO: 43981 - protein, 10 aa, Homo sapiens
  light chain complementarity determining region 3 for antibody 21991
QQRGNWPPWT

SEQ ID NO: 43982 - protein, 12 aa, Homo sapiens
  heavy chain complementarity determining region 3 for antibody 21991
ARDHYARVAFDI

SEQ ID NO: 43983 - protein, 10 aa, Homo sapiens
  light chain complementarity determining region 3 for antibody 21992
QQRGNSPPWT

SEQ ID NO: 43984 - protein, 12 aa, Homo sapiens
  heavy chain complementarity determining region 3 for antibody 21992
ARDHYARVSFDI

SEQ ID NO: 43985 - protein, 10 aa, Homo sapiens
  light chain complementarity determining region 3 for antibody 21993
QQRGNSPPWT

SEQ ID NO: 43986 - protein, 12 aa, Homo sapiens
  heavy chain complementarity determining region 3 for antibody 21993
ARDHCARVAFDI

SEQ ID NO: 43987 - protein, 10 aa, Homo sapiens
  light chain complementarity determining region 3 for antibody 21994
QQRGNSPPWR

SEQ ID NO: 43988 - protein, 12 aa, Homo sapiens
  heavy chain complementarity determining region 3 for antibody 21994
ARDHYARVAFDI

SEQ ID NO: 43989 - protein, 10 aa, Homo sapiens
  light chain complementarity determining region 3 for antibody 21995
QQRGNSPPRT

SEQ ID NO: 43990 - protein, 12 aa, Homo sapiens
  heavy chain complementarity determining region 3 for antibody 21995
ARDHYARVAFDI

SEQ ID NO: 43991 - protein, 10 aa, Homo sapiens
  light chain complementarity determining region 3 for antibody 21996
QQRGIWPPLT

SEQ ID NO: 43992 - protein, 13 aa, Homo sapiens
  heavy chain complementarity determining region 3 for antibody 21996
VRELHAGAYYYDY

SEQ ID NO: 43993 - protein, 10 aa, Homo sapiens
  light chain complementarity determining region 3 for antibody 21997
QQRGIWPPIT

SEQ ID NO: 43994 - protein, 13 aa, Homo sapiens
  heavy chain complementarity determining region 3 for antibody 21997
VRERHAGAYYYDY

SEQ ID NO: 43995 - protein, 10 aa, Homo sapiens
  light chain complementarity determining region 3 for antibody 21998
QQRGIWPPIT

SEQ ID NO: 43996 - protein, 10 aa, Homo sapiens
  heavy chain complementarity determining region 3 for antibody 21998
VRELHAGAYY

SEQ ID NO: 43997 - protein, 10 aa, Homo sapiens
  light chain complementarity determining region 3 for antibody 21999
QQRGIGPPIT

SEQ ID NO: 43998 - protein, 13 aa, Homo sapiens
  heavy chain complementarity determining region 3 for antibody 21999
VRELHAGAYYYDY

SEQ ID NO: 43999 - protein, 10 aa, Homo sapiens
  light chain complementarity determining region 3 for antibody 22000
QQRFSSSPIT

SEQ ID NO: 44000 - protein, 16 aa, Homo sapiens
  heavy chain complementarity determining region 3 for antibody 22000
ARQGPWTTVVTPHFDH

SEQ ID NO: 44001 - protein, 8 aa, Homo sapiens
  light chain complementarity determining region 3 for antibody 22001
QQRFRPAT

SEQ ID NO: 44002 - protein, 18 aa, Homo sapiens
  heavy chain complementarity determining region 3 for antibody 22001
ARGSGITIFGGVIRYFDY

SEQ ID NO: 44003 - protein, 11 aa, Homo sapiens
  light chain complementarity determining region 3 for antibody 22002
QQRFNWPPTIT

SEQ ID NO: 44004 - protein, 12 aa, Homo sapiens
  heavy chain complementarity determining region 3 for antibody 22002
ALAFGGVEYFDY

SEQ ID NO: 44005 - protein, 11 aa, Homo sapiens
  light chain complementarity determining region 3 for antibody 22003
QQRFNWPPTIP

SEQ ID NO: 44006 - protein, 12 aa, Homo sapiens
  heavy chain complementarity determining region 3 for antibody 22003
ALSFGGVEYFDY

SEQ ID NO: 44007 - protein, 10 aa, Homo sapiens
  light chain complementarity determining region 3 for antibody 22004
QQRDNWPPFT

SEQ ID NO: 44008 - protein, 11 aa, Homo sapiens
  heavy chain complementarity determining region 3 for antibody 22004
ARGVGSYPFDS

SEQ ID NO: 44009 - protein, 9 aa, Homo sapiens
  light chain complementarity determining region 3 for antibody 22005
QQRDNRPPL

SEQ ID NO: 44010 - protein, 16 aa, Homo sapiens
  heavy chain complementarity determining region 3 for antibody 22005
ARLLDPDGYNFWYFDY

SEQ ID NO: 44011 - protein, 9 aa, Homo sapiens
  light chain complementarity determining region 3 for antibody 22006
QQRDIAPLT

SEQ ID NO: 44012 - protein, 10 aa, Homo sapiens
  heavy chain complementarity determining region 3 for antibody 22006
ASGLGWESGY

SEQ ID NO: 44013 - protein, 9 aa, Homo sapiens
  light chain complementarity determining region 3 for antibody 22007
QQRCSWPYT

SEQ ID NO: 44014 - protein, 11 aa, Homo sapiens
  heavy chain complementarity determining region 3 for antibody 22007
VKRWGGSSIDY

SEQ ID NO: 44015 - protein, 10 aa, Homo sapiens
  light chain complementarity determining region 3 for antibody 22008
QQRCKWPPLT

SEQ ID NO: 44016 - protein, 9 aa, Homo sapiens
  heavy chain complementarity determining region 3 for antibody 22008
ARVDGYFDY

SEQ ID NO: 44017 - protein, 9 aa, Homo sapiens
  light chain complementarity determining region 3 for antibody 22009
QQRANWPLT

SEQ ID NO: 44018 - protein, 18 aa, Homo sapiens
  heavy chain complementarity determining region 3 for antibody 22009
ARSPPADIFFGEFCLFDY

SEQ ID NO: 44019 - protein, 9 aa, Homo sapiens
  light chain complementarity determining region 3 for antibody 22010
QQPYTFPQT

SEQ ID NO: 44020 - protein, 24 aa, Homo sapiens
  heavy chain complementarity determining region 3 for antibody 22010
ARGSLEYYYDGSGYYYATGDAYDI

SEQ ID NO: 44021 - protein, 9 aa, Homo sapiens
  light chain complementarity determining region 3 for antibody 22011
QQPYSLPYT

SEQ ID NO: 44022 - protein, 19 aa, Homo sapiens
  heavy chain complementarity determining region 3 for antibody 22011
VTPADWRGNSYGWAGSFAS

SEQ ID NO: 44023 - protein, 9 aa, Homo sapiens
  light chain complementarity determining region 3 for antibody 22012
QQPVGPPIT

SEQ ID NO: 44024 - protein, 11 aa, Homo sapiens
  heavy chain complementarity determining region 3 for antibody 22012
ARFFVVGANAA

SEQ ID NO: 44025 - protein, 9 aa, Homo sapiens
  light chain complementarity determining region 3 for antibody 22013
QQPTTSPRT

SEQ ID NO: 44026 - protein, 13 aa, Homo sapiens
  heavy chain complementarity determining region 3 for antibody 22013
GKGYEYAPRIYDY

SEQ ID NO: 44027 - protein, 9 aa, Homo sapiens
  light chain complementarity determining region 3 for antibody 22014
QQPSTYPWT

SEQ ID NO: 44028 - protein, 19 aa, Homo sapiens
  heavy chain complementarity determining region 3 for antibody 22014
ARVQFQMTTRTTRAPYFDY

SEQ ID NO: 44029 - protein, 8 aa, Homo sapiens
  light chain complementarity determining region 3 for antibody 22015
QQNYSYWT

SEQ ID NO: 44030 - protein, 18 aa, Homo sapiens
  heavy chain complementarity determining region 3 for antibody 22015
TREGFGANKNVINWYFDL

SEQ ID NO: 44031 - protein, 8 aa, Homo sapiens
  light chain complementarity determining region 3 for antibody 22016
QQNYSYRT

SEQ ID NO: 44032 - protein, 14 aa, Homo sapiens
  heavy chain complementarity determining region 3 for antibody 22016
VTDQDVYWSGYFRT

SEQ ID NO: 44033 - protein, 9 aa, Homo sapiens
  light chain complementarity determining region 3 for antibody 22017
QQNYRYPVT

SEQ ID NO: 44034 - protein, 15 aa, Homo sapiens
  heavy chain complementarity determining region 3 for antibody 22017
AHGQHTTTVTSYFNF

SEQ ID NO: 44035 - protein, 9 aa, Homo sapiens
  light chain complementarity determining region 3 for antibody 22018
QQNYNTPWT

SEQ ID NO: 44036 - protein, 17 aa, Homo sapiens
  heavy chain complementarity determining region 3 for antibody 22018
SRQAHFYGTSAYDYPDS

SEQ ID NO: 44037 - protein, 9 aa, Homo sapiens
  light chain complementarity determining region 3 for antibody 22019
QQNYGYPLT

SEQ ID NO: 44038 - protein, 18 aa, Homo sapiens
  heavy chain complementarity determining region 3 for antibody 22019
ARSRSGGIRDPQYNGLDV

SEQ ID NO: 44039 - protein, 10 aa, Homo sapiens
  light chain complementarity determining region 3 for antibody 22020
QQNYGAPPYS

SEQ ID NO: 44040 - protein, 16 aa, Homo sapiens
  heavy chain complementarity determining region 3 for antibody 22020
ARTSYDTSGYYYPFDY

SEQ ID NO: 44041 - protein, 9 aa, Homo sapiens
  light chain complementarity determining region 3 for antibody 22021
QQNVTPPLT

SEQ ID NO: 44042 - protein, 18 aa, Homo sapiens
  heavy chain complementarity determining region 3 for antibody 22021
ARCVAAAAKWGVYWYFDL

SEQ ID NO: 44043 - protein, 9 aa, Homo sapiens
  light chain complementarity determining region 3 for antibody 22022
QQNTNWPLT

SEQ ID NO: 44044 - protein, 16 aa, Homo sapiens
  heavy chain complementarity determining region 3 for antibody 22022
TRYCSSSNCALYGMDV

SEQ ID NO: 44045 - protein, 9 aa, Homo sapiens
  light chain complementarity determining region 3 for antibody 22023
QQNSNTPRT

SEQ ID NO: 44046 - protein, 21 aa, Homo sapiens
  heavy chain complementarity determining region 3 for antibody 22023
ARTDEPLTAMEYYYSYYAMDV

SEQ ID NO: 44047 - protein, 11 aa, Homo sapiens
  light chain complementarity determining region 3 for antibody 22024
QQNRASPPGFT

SEQ ID NO: 44048 - protein, 14 aa, Homo sapiens
  heavy chain complementarity determining region 3 for antibody 22024
ARSPSNSRNRSFDQ

SEQ ID NO: 44049 - protein, 9 aa, Homo sapiens
  light chain complementarity determining region 3 for antibody 22025
QQNQNWPYT

SEQ ID NO: 44050 - protein, 11 aa, Homo sapiens
  heavy chain complementarity determining region 3 for antibody 22025
GGFYHGGPCGY

SEQ ID NO: 44051 - protein, 9 aa, Homo sapiens
  light chain complementarity determining region 3 for antibody 22026
QQNNVWPYT

SEQ ID NO: 44052 - protein, 13 aa, Homo sapiens
  heavy chain complementarity determining region 3 for antibody 22026
ARVMAAAGYGMDV

SEQ ID NO: 44053 - protein, 8 aa, Homo sapiens
  light chain complementarity determining region 3 for antibody 22027
QQNNSYWT

SEQ ID NO: 44054 - protein, 14 aa, Homo sapiens
  heavy chain complementarity determining region 3 for antibody 22027
AKDRQWIPDGPLDY

SEQ ID NO: 44055 - protein, 9 aa, Homo sapiens
  light chain complementarity determining region 3 for antibody 22028
QQNNSWPRT

SEQ ID NO: 44056 - protein, 19 aa, Homo sapiens
  heavy chain complementarity determining region 3 for antibody 22028
ATVALATINMKIVGEYFHH

SEQ ID NO: 44057 - protein, 9 aa, Homo sapiens
  light chain complementarity determining region 3 for antibody 22029
QQNNSWPRT

SEQ ID NO: 44058 - protein, 14 aa, Homo sapiens
  heavy chain complementarity determining region 3 for antibody 22029
ARGGDYEYPDVFDI

SEQ ID NO: 44059 - protein, 9 aa, Homo sapiens
  light chain complementarity determining region 3 for antibody 22030
QQNHTAPYT

SEQ ID NO: 44060 - protein, 13 aa, Homo sapiens
  heavy chain complementarity determining region 3 for antibody 22030
ARARNYDRISLDF

SEQ ID NO: 44061 - protein, 9 aa, Homo sapiens
  light chain complementarity determining region 3 for antibody 22031
QQNHSSPIT

SEQ ID NO: 44062 - protein, 14 aa, Homo sapiens
  heavy chain complementarity determining region 3 for antibody 22031
AKESSVYGVYPYDS

SEQ ID NO: 44063 - protein, 9 aa, Homo sapiens
  light chain complementarity determining region 3 for antibody 22032
QQNHSFPLS

SEQ ID NO: 44064 - protein, 11 aa, Homo sapiens
  heavy chain complementarity determining region 3 for antibody 22032
VHSPAMAEIDY

SEQ ID NO: 44065 - protein, 8 aa, Homo sapiens
  light chain complementarity determining region 3 for antibody 22033
QQNGYSWT

SEQ ID NO: 44066 - protein, 9 aa, Homo sapiens
  heavy chain complementarity determining region 3 for antibody 22033
ARWVEGLDV

SEQ ID NO: 44067 - protein, 10 aa, Homo sapiens
  light chain complementarity determining region 3 for antibody 22034
QQNGTSPTWT

SEQ ID NO: 44068 - protein, 18 aa, Homo sapiens
  heavy chain complementarity determining region 3 for antibody 22034
ARAPRDTMIVVRYYGMDV

SEQ ID NO: 44069 - protein, 9 aa, Homo sapiens
  light chain complementarity determining region 3 for antibody 22035
QQNGTSPRT

SEQ ID NO: 44070 - protein, 13 aa, Homo sapiens
  heavy chain complementarity determining region 3 for antibody 22035
PIGFYDRSGYHDY

SEQ ID NO: 44071 - protein, 9 aa, Homo sapiens
  light chain complementarity determining region 3 for antibody 22036
QQNGTSPRT

SEQ ID NO: 44072 - protein, 13 aa, Homo sapiens
  heavy chain complementarity determining region 3 for antibody 22036
AGGYFDRSGYYEY

SEQ ID NO: 44073 - protein, 9 aa, Homo sapiens
  light chain complementarity determining region 3 for antibody 22037
QQNGTSPRT

SEQ ID NO: 44074 - protein, 13 aa, Homo sapiens
  heavy chain complementarity determining region 3 for antibody 22037
ACGYYQSGRYYEY

SEQ ID NO: 44075 - protein, 9 aa, Homo sapiens
  light chain complementarity determining region 3 for antibody 22038
QQNGTSPFT

SEQ ID NO: 44076 - protein, 15 aa, Homo sapiens
  heavy chain complementarity determining region 3 for antibody 22038
ARQNDFLSGPGEFDP

SEQ ID NO: 44077 - protein, 9 aa, Homo sapiens
  light chain complementarity determining region 3 for antibody 22039
QQNGTPPRT

SEQ ID NO: 44078 - protein, 25 aa, Homo sapiens
  heavy chain complementarity determining region 3 for antibody 22039
ASLRVDRLRLPGAMRGPLYDRGLNV

SEQ ID NO: 44079 - protein, 9 aa, Homo sapiens
  light chain complementarity determining region 3 for antibody 22040
QQNGTIPRT

SEQ ID NO: 44080 - protein, 13 aa, Homo sapiens
  heavy chain complementarity determining region 3 for antibody 22040
AGGLFDSSGYSEF

SEQ ID NO: 44081 - protein, 9 aa, Homo sapiens
  light chain complementarity determining region 3 for antibody 22041
QQNGTIPRT

SEQ ID NO: 44082 - protein, 14 aa, Homo sapiens
  heavy chain complementarity determining region 3 for antibody 22041
AGGEFCGGDCYSEY

SEQ ID NO: 44083 - protein, 9 aa, Homo sapiens
  light chain complementarity determining region 3 for antibody 22042
QQNGSTVGT

SEQ ID NO: 44084 - protein, 9 aa, Homo sapiens
  heavy chain complementarity determining region 3 for antibody 22042
ARMYSGLDY

SEQ ID NO: 44085 - protein, 9 aa, Homo sapiens
  light chain complementarity determining region 3 for antibody 22043
QQNGSSPRT

SEQ ID NO: 44086 - protein, 17 aa, Homo sapiens
  heavy chain complementarity determining region 3 for antibody 22043
TTDPQWLEPPPFLANDY

SEQ ID NO: 44087 - protein, 9 aa, Homo sapiens
  light chain complementarity determining region 3 for antibody 22044
QQNGSSPRT

SEQ ID NO: 44088 - protein, 14 aa, Homo sapiens
  heavy chain complementarity determining region 3 for antibody 22044
ATGFFDRSRHYLEY

SEQ ID NO: 44089 - protein, 9 aa, Homo sapiens
  light chain complementarity determining region 3 for antibody 22045
QQNGSSPRT

SEQ ID NO: 44090 - protein, 17 aa, Homo sapiens
  heavy chain complementarity determining region 3 for antibody 22045
ARAQGVVVVAARGAFDI

SEQ ID NO: 44091 - protein, 9 aa, Homo sapiens
  light chain complementarity determining region 3 for antibody 22046
QQNGSSPRT

SEQ ID NO: 44092 - protein, 15 aa, Homo sapiens
  heavy chain complementarity determining region 3 for antibody 22046
AKTYDFWSGDDAFEI

SEQ ID NO: 44093 - protein, 9 aa, Homo sapiens
  light chain complementarity determining region 3 for antibody 22047
QQNGSSPRT

SEQ ID NO: 44094 - protein, 14 aa, Homo sapiens
  heavy chain complementarity determining region 3 for antibody 22047
AGGTFSSGSSYSEN

SEQ ID NO: 44095 - protein, 9 aa, Homo sapiens
  light chain complementarity determining region 3 for antibody 22048
QQNGSSPRT

SEQ ID NO: 44096 - protein, 14 aa, Homo sapiens
  heavy chain complementarity determining region 3 for antibody 22048
AGGRFSSGSSYSEN

SEQ ID NO: 44097 - protein, 10 aa, Homo sapiens
  light chain complementarity determining region 3 for antibody 22049
QQNGSSPPYT

SEQ ID NO: 44098 - protein, 18 aa, Homo sapiens
  heavy chain complementarity determining region 3 for antibody 22049
ATGKWFGDFNFYYYAMDV

SEQ ID NO: 44099 - protein, 10 aa, Homo sapiens
  light chain complementarity determining region 3 for antibody 22050
QQNGSSPMYG

SEQ ID NO: 44100 - protein, 11 aa, Homo sapiens
  heavy chain complementarity determining region 3 for antibody 22050
ARGGQWGSLDY

SEQ ID NO: 44101 - protein, 9 aa, Homo sapiens
  light chain complementarity determining region 3 for antibody 22051
QQNGSPPRT

SEQ ID NO: 44102 - protein, 15 aa, Homo sapiens
  heavy chain complementarity determining region 3 for antibody 22051
AKTYDFWSGDDAFEI

SEQ ID NO: 44103 - protein, 9 aa, Homo sapiens
  light chain complementarity determining region 3 for antibody 22052
QQNGSIPRT

SEQ ID NO: 44104 - protein, 13 aa, Homo sapiens
  heavy chain complementarity determining region 3 for antibody 22052
AGGIFDSSGYGEY

SEQ ID NO: 44105 - protein, 9 aa, Homo sapiens
  light chain complementarity determining region 3 for antibody 22053
QQNGSIPRT

SEQ ID NO: 44106 - protein, 14 aa, Homo sapiens
  heavy chain complementarity determining region 3 for antibody 22053
AGGDFCGSDCYSEY

SEQ ID NO: 44107 - protein, 9 aa, Homo sapiens
  light chain complementarity determining region 3 for antibody 22054
QQNGNLPRT

SEQ ID NO: 44108 - protein, 13 aa, Homo sapiens
  heavy chain complementarity determining region 3 for antibody 22054
AGGQFHTSGYSEF

SEQ ID NO: 44109 - protein, 9 aa, Homo sapiens
  light chain complementarity determining region 3 for antibody 22055
QQNGNLPRT

SEQ ID NO: 44110 - protein, 13 aa, Homo sapiens
  heavy chain complementarity determining region 3 for antibody 22055
AGGQFHSSGYSDF

SEQ ID NO: 44111 - protein, 9 aa, Homo sapiens
  light chain complementarity determining region 3 for antibody 22056
QQNGNLPRT

SEQ ID NO: 44112 - protein, 13 aa, Homo sapiens
  heavy chain complementarity determining region 3 for antibody 22056
AGGQFHASGYSEF

SEQ ID NO: 44113 - protein, 9 aa, Homo sapiens
  light chain complementarity determining region 3 for antibody 22057
QQNGNLPRT

SEQ ID NO: 44114 - protein, 13 aa, Homo sapiens
  heavy chain complementarity determining region 3 for antibody 22057
AGGNYDTGRYEEY

SEQ ID NO: 44115 - protein, 9 aa, Homo sapiens
  light chain complementarity determining region 3 for antibody 22058
QQNGNLPRT

SEQ ID NO: 44116 - protein, 13 aa, Homo sapiens
  heavy chain complementarity determining region 3 for antibody 22058
AGGNFHSGGYGEY

SEQ ID NO: 44117 - protein, 9 aa, Homo sapiens
  light chain complementarity determining region 3 for antibody 22059
QQNGNLPRT

SEQ ID NO: 44118 - protein, 13 aa, Homo sapiens
  heavy chain complementarity determining region 3 for antibody 22059
AGGDFHRGGYSEY

SEQ ID NO: 44119 - protein, 9 aa, Homo sapiens
  light chain complementarity determining region 3 for antibody 22060
QQNGNIPRT

SEQ ID NO: 44120 - protein, 14 aa, Homo sapiens
  heavy chain complementarity determining region 3 for antibody 22060
AGGTFDSSGYYYEY

SEQ ID NO: 44121 - protein, 9 aa, Homo sapiens
  light chain complementarity determining region 3 for antibody 22061
QQNGNIPRS

SEQ ID NO: 44122 - protein, 13 aa, Homo sapiens
  heavy chain complementarity determining region 3 for antibody 22061
AGGTWHSGTYYES

SEQ ID NO: 44123 - protein, 9 aa, Homo sapiens
  light chain complementarity determining region 3 for antibody 22062
QQNGGLEKT

SEQ ID NO: 44124 - protein, 12 aa, Homo sapiens
  heavy chain complementarity determining region 3 for antibody 22062
ARGGIWTGGFDY

SEQ ID NO: 44125 - protein, 9 aa, Homo sapiens
  light chain complementarity determining region 3 for antibody 22063
QQNGATPRT

SEQ ID NO: 44126 - protein, 13 aa, Homo sapiens
  heavy chain complementarity determining region 3 for antibody 22063
ASGYGSGASYREN

SEQ ID NO: 44127 - protein, 8 aa, Homo sapiens
  light chain complementarity determining region 3 for antibody 22064
QQNENLVT

SEQ ID NO: 44128 - protein, 18 aa, Homo sapiens
  heavy chain complementarity determining region 3 for antibody 22064
AKGAEGSGSVRKCYPFDY

SEQ ID NO: 44129 - protein, 9 aa, Homo sapiens
  light chain complementarity determining region 3 for antibody 22065
QQNDSYPIT

SEQ ID NO: 44130 - protein, 12 aa, Homo sapiens
  heavy chain complementarity determining region 3 for antibody 22065
ARERASVVTFDS

SEQ ID NO: 44131 - protein, 9 aa, Homo sapiens
  light chain complementarity determining region 3 for antibody 22066
QQNDSSPYT

SEQ ID NO: 44132 - protein, 19 aa, Homo sapiens
  heavy chain complementarity determining region 3 for antibody 22066
ARHYGIVSAAPKALNWFDP

SEQ ID NO: 44133 - protein, 10 aa, Homo sapiens
  light chain complementarity determining region 3 for antibody 22067
QQNDNWPPWT

SEQ ID NO: 44134 - protein, 12 aa, Homo sapiens
  heavy chain complementarity determining region 3 for antibody 22067
AKTLRERKELDY

SEQ ID NO: 44135 - protein, 9 aa, Homo sapiens
  light chain complementarity determining region 3 for antibody 22068
QQNDNLPYT

SEQ ID NO: 44136 - protein, 16 aa, Homo sapiens
  heavy chain complementarity determining region 3 for antibody 22068
ARSSGGYSSSWYYFDY

SEQ ID NO: 44137 - protein, 9 aa, Homo sapiens
  light chain complementarity determining region 3 for antibody 22069
QQNDNLPYT

SEQ ID NO: 44138 - protein, 13 aa, Homo sapiens
  heavy chain complementarity determining region 3 for antibody 22069
ARSRQLAAGAGDY

SEQ ID NO: 44139 - protein, 8 aa, Homo sapiens
  light chain complementarity determining region 3 for antibody 22070
QQNDNLPV

SEQ ID NO: 44140 - protein, 15 aa, Homo sapiens
  heavy chain complementarity determining region 3 for antibody 22070
ARQITSAWNEHAFDY

SEQ ID NO: 44141 - protein, 10 aa, Homo sapiens
  light chain complementarity determining region 3 for antibody 22071
QQNDNFLAYT

SEQ ID NO: 44142 - protein, 20 aa, Homo sapiens
  heavy chain complementarity determining region 3 for antibody 22071
ARDFFPFPRGPDSVDDVFDL

SEQ ID NO: 44143 - protein, 10 aa, Homo sapiens
  light chain complementarity determining region 3 for antibody 22072
QQNDNFLAYP

SEQ ID NO: 44144 - protein, 20 aa, Homo sapiens
  heavy chain complementarity determining region 3 for antibody 22072
ARDFFPFPRGPDSFDDVFDL

SEQ ID NO: 44145 - protein, 10 aa, Homo sapiens
  light chain complementarity determining region 3 for antibody 22073
QQLYSDPLFT

SEQ ID NO: 44146 - protein, 19 aa, Homo sapiens
  heavy chain complementarity determining region 3 for antibody 22073
ARLNTAMAEEYYYYYGLDV

SEQ ID NO: 44147 - protein, 10 aa, Homo sapiens
  light chain complementarity determining region 3 for antibody 22074
QQLYRDPLFT

SEQ ID NO: 44148 - protein, 19 aa, Homo sapiens
  heavy chain complementarity determining region 3 for antibody 22074
ARLNTAMAEDYYYYYGLDV

SEQ ID NO: 44149 - protein, 10 aa, Homo sapiens
  light chain complementarity determining region 3 for antibody 22075
QQLYNWPPFT

SEQ ID NO: 44150 - protein, 11 aa, Homo sapiens
  heavy chain complementarity determining region 3 for antibody 22075
ARGVGSYPFDS

SEQ ID NO: 44151 - protein, 9 aa, Homo sapiens
  light chain complementarity determining region 3 for antibody 22076
QQLTTYPIT

SEQ ID NO: 44152 - protein, 19 aa, Homo sapiens
  heavy chain complementarity determining region 3 for antibody 22076
ARDVIRNCGSDCYFWYFDL

SEQ ID NO: 44153 - protein, 9 aa, Homo sapiens
  light chain complementarity determining region 3 for antibody 22077
QQLSNYPHT

SEQ ID NO: 44154 - protein, 26 aa, Homo sapiens
  heavy chain complementarity determining region 3 for antibody 22077
ARGSRGYKDENSSLRRLQYYQCGMDV

SEQ ID NO: 44155 - protein, 9 aa, Homo sapiens
  light chain complementarity determining region 3 for antibody 22078
QQLNTYPLT

SEQ ID NO: 44156 - protein, 13 aa, Homo sapiens
  heavy chain complementarity determining region 3 for antibody 22078
AKTLTMVTTYGDY

SEQ ID NO: 44157 - protein, 9 aa, Homo sapiens
  light chain complementarity determining region 3 for antibody 22079
QQLNTYPIT

SEQ ID NO: 44158 - protein, 19 aa, Homo sapiens
  heavy chain complementarity determining region 3 for antibody 22079
ARDVVRNCGSDCYFWYFDL

SEQ ID NO: 44159 - protein, 9 aa, Homo sapiens
  light chain complementarity determining region 3 for antibody 22080
QQLNTYPIT

SEQ ID NO: 44160 - protein, 19 aa, Homo sapiens
  heavy chain complementarity determining region 3 for antibody 22080
ARDVIRNCGSYCYFWYFDL

SEQ ID NO: 44161 - protein, 9 aa, Homo sapiens
  light chain complementarity determining region 3 for antibody 22081
QQLNTYPIT

SEQ ID NO: 44162 - protein, 19 aa, Homo sapiens
  heavy chain complementarity determining region 3 for antibody 22081
ARDVIRNCGSDCYLWYFDL

SEQ ID NO: 44163 - protein, 9 aa, Homo sapiens
  light chain complementarity determining region 3 for antibody 22082
QQLNTYPIT

SEQ ID NO: 44164 - protein, 19 aa, Homo sapiens
  heavy chain complementarity determining region 3 for antibody 22082
ARDVIRKCGSDCYFWYFDL

SEQ ID NO: 44165 - protein, 9 aa, Homo sapiens
  light chain complementarity determining region 3 for antibody 22083
QQLNTYPIT

SEQ ID NO: 44166 - protein, 13 aa, Homo sapiens
  heavy chain complementarity determining region 3 for antibody 22083
AKTLTMVTTSGDY

SEQ ID NO: 44167 - protein, 9 aa, Homo sapiens
  light chain complementarity determining region 3 for antibody 22084
QQLNTYPIT

SEQ ID NO: 44168 - protein, 13 aa, Homo sapiens
  heavy chain complementarity determining region 3 for antibody 22084
AKTLTMGTTYGDY

SEQ ID NO: 44169 - protein, 9 aa, Homo sapiens
  light chain complementarity determining region 3 for antibody 22085
QQLNTYPIS

SEQ ID NO: 44170 - protein, 19 aa, Homo sapiens
  heavy chain complementarity determining region 3 for antibody 22085
ARDVIRNCGSDCYFWYFDL

SEQ ID NO: 44171 - protein, 9 aa, Homo sapiens
  light chain complementarity determining region 3 for antibody 22086
QQLNSYPTT

SEQ ID NO: 44172 - protein, 12 aa, Homo sapiens
  heavy chain complementarity determining region 3 for antibody 22086
ARTSLSHDYGYY

SEQ ID NO: 44173 - protein, 10 aa, Homo sapiens
  light chain complementarity determining region 3 for antibody 22087
QQLNSYPRVT

SEQ ID NO: 44174 - protein, 19 aa, Homo sapiens
  heavy chain complementarity determining region 3 for antibody 22087
ARDRVEVPRTQVPYWYFDL

SEQ ID NO: 44175 - protein, 10 aa, Homo sapiens
  light chain complementarity determining region 3 for antibody 22088
QQLNSYPRFT

SEQ ID NO: 44176 - protein, 19 aa, Homo sapiens
  heavy chain complementarity determining region 3 for antibody 22088
ARDRVEVPGTQVPYWYFDL

SEQ ID NO: 44177 - protein, 9 aa, Homo sapiens
  light chain complementarity determining region 3 for antibody 22089
QQLNSYPPP

SEQ ID NO: 44178 - protein, 12 aa, Homo sapiens
  heavy chain complementarity determining region 3 for antibody 22089
ARTSLSHDYGYY

SEQ ID NO: 44179 - protein, 9 aa, Homo sapiens
  light chain complementarity determining region 3 for antibody 22090
QQLNSYPLT

SEQ ID NO: 44180 - protein, 13 aa, Homo sapiens
  heavy chain complementarity determining region 3 for antibody 22090
VPVMEVTLGAFAF

SEQ ID NO: 44181 - protein, 9 aa, Homo sapiens
  light chain complementarity determining region 3 for antibody 22091
QQLNSYPLP

SEQ ID NO: 44182 - protein, 20 aa, Homo sapiens
  heavy chain complementarity determining region 3 for antibody 22091
ATSKVVVVSEGLYYYYGLDV

SEQ ID NO: 44183 - protein, 10 aa, Homo sapiens
  light chain complementarity determining region 3 for antibody 22092
QQLNSYPLLT

SEQ ID NO: 44184 - protein, 19 aa, Homo sapiens
  heavy chain complementarity determining region 3 for antibody 22092
ALRRDSSGWYFPPQSAFDI

SEQ ID NO: 44185 - protein, 10 aa, Homo sapiens
  light chain complementarity determining region 3 for antibody 22093
QQLNSYPLLT

SEQ ID NO: 44186 - protein, 19 aa, Homo sapiens
  heavy chain complementarity determining region 3 for antibody 22093
AHRRDSSGWYFPPQSAFAI

SEQ ID NO: 44187 - protein, 10 aa, Homo sapiens
  light chain complementarity determining region 3 for antibody 22094
QQLNSYPLLT

SEQ ID NO: 44188 - protein, 19 aa, Homo sapiens
  heavy chain complementarity determining region 3 for antibody 22094
AHRRDSSGWYFPPQAAFDI

SEQ ID NO: 44189 - protein, 10 aa, Homo sapiens
  light chain complementarity determining region 3 for antibody 22095
QQLNSYPLLT

SEQ ID NO: 44190 - protein, 19 aa, Homo sapiens
  heavy chain complementarity determining region 3 for antibody 22095
AHRRDSSGWYFPPHSAFDI

SEQ ID NO: 44191 - protein, 10 aa, Homo sapiens
  light chain complementarity determining region 3 for antibody 22096
QQLNSYPLLT

SEQ ID NO: 44192 - protein, 19 aa, Homo sapiens
  heavy chain complementarity determining region 3 for antibody 22096
AHRRDRSGWYFPPQSAFDI

SEQ ID NO: 44193 - protein, 10 aa, Homo sapiens
  light chain complementarity determining region 3 for antibody 22097
QQLNSYPLLP

SEQ ID NO: 44194 - protein, 19 aa, Homo sapiens
  heavy chain complementarity determining region 3 for antibody 22097
AHRRDSSGWYFPPQSAFDI

SEQ ID NO: 44195 - protein, 9 aa, Homo sapiens
  light chain complementarity determining region 3 for antibody 22098
QQLNFYPLG

SEQ ID NO: 44196 - protein, 18 aa, Homo sapiens
  heavy chain complementarity determining region 3 for antibody 22098
ARDNDHSGYSYYYYGMDV

SEQ ID NO: 44197 - protein, 9 aa, Homo sapiens
  light chain complementarity determining region 3 for antibody 22099
QQLKSYPLT

SEQ ID NO: 44198 - protein, 13 aa, Homo sapiens
  heavy chain complementarity determining region 3 for antibody 22099
VPVMEVALGAFAF

SEQ ID NO: 44199 - protein, 9 aa, Homo sapiens
  light chain complementarity determining region 3 for antibody 22100
QQLKSFPIT

SEQ ID NO: 44200 - protein, 11 aa, Homo sapiens
  heavy chain complementarity determining region 3 for antibody 22100
VNDGGHWDFDF

SEQ ID NO: 44201 - protein, 9 aa, Homo sapiens
  light chain complementarity determining region 3 for antibody 22101
QQLGTLPFT

SEQ ID NO: 44202 - protein, 16 aa, Homo sapiens
  heavy chain complementarity determining region 3 for antibody 22101
TTERHIAEFEEASFDI

SEQ ID NO: 44203 - protein, 10 aa, Homo sapiens
  light chain complementarity determining region 3 for antibody 22102
QQLGIWPPIT

SEQ ID NO: 44204 - protein, 13 aa, Homo sapiens
  heavy chain complementarity determining region 3 for antibody 22102
VRELHAGAYYYDY

SEQ ID NO: 44205 - protein, 9 aa, Homo sapiens
  light chain complementarity determining region 3 for antibody 22103
QQLDSSPLP

SEQ ID NO: 44206 - protein, 15 aa, Homo sapiens
  heavy chain complementarity determining region 3 for antibody 22103
AKDKGPGVRVYFCDS

SEQ ID NO: 44207 - protein, 9 aa, Homo sapiens
  light chain complementarity determining region 3 for antibody 22104
QQIYFLPRT

SEQ ID NO: 44208 - protein, 12 aa, Homo sapiens
  heavy chain complementarity determining region 3 for antibody 22104
ARQGPYQQPFDL

SEQ ID NO: 44209 - protein, 9 aa, Homo sapiens
  light chain complementarity determining region 3 for antibody 22105
QQINTWPRT

SEQ ID NO: 44210 - protein, 22 aa, Homo sapiens
  heavy chain complementarity determining region 3 for antibody 22105
AREVRASGYDDFYNYYYYGLDV

SEQ ID NO: 44211 - protein, 10 aa, Homo sapiens
  light chain complementarity determining region 3 for antibody 22106
QQINSYPRVT

SEQ ID NO: 44212 - protein, 19 aa, Homo sapiens
  heavy chain complementarity determining region 3 for antibody 22106
ARDRVEVPGTQVPYWYFDL

SEQ ID NO: 44213 - protein, 9 aa, Homo sapiens
  light chain complementarity determining region 3 for antibody 22107
QQIDSIPYT

SEQ ID NO: 44214 - protein, 12 aa, Homo sapiens
  heavy chain complementarity determining region 3 for antibody 22107
ARGNPIVTGFDY

SEQ ID NO: 44215 - protein, 8 aa, Homo sapiens
  light chain complementarity determining region 3 for antibody 22108
QQICTTRT

SEQ ID NO: 44216 - protein, 18 aa, Homo sapiens
  heavy chain complementarity determining region 3 for antibody 22108
ARERGYCSGGSCYPRPRN

SEQ ID NO: 44217 - protein, 8 aa, Homo sapiens
  light chain complementarity determining region 3 for antibody 22109
QQICTTRT

SEQ ID NO: 44218 - protein, 18 aa, Homo sapiens
  heavy chain complementarity determining region 3 for antibody 22109
ARERGYCSGGSCYPRPHN

SEQ ID NO: 44219 - protein, 8 aa, Homo sapiens
  light chain complementarity determining region 3 for antibody 22110
QQHYSYWT

SEQ ID NO: 44220 - protein, 18 aa, Homo sapiens
  heavy chain complementarity determining region 3 for antibody 22110
TREGFGANKNVINWYFDL

SEQ ID NO: 44221 - protein, 8 aa, Homo sapiens
  light chain complementarity determining region 3 for antibody 22111
QQHYSYRT

SEQ ID NO: 44222 - protein, 14 aa, Homo sapiens
  heavy chain complementarity determining region 3 for antibody 22111
VTDQDVYWSGYFRT

SEQ ID NO: 44223 - protein, 9 aa, Homo sapiens
  light chain complementarity determining region 3 for antibody 22112
QQHYRYPGT

SEQ ID NO: 44224 - protein, 15 aa, Homo sapiens
  heavy chain complementarity determining region 3 for antibody 22112
AHGQHTTTVTSYFNF

SEQ ID NO: 44225 - protein, 9 aa, Homo sapiens
  light chain complementarity determining region 3 for antibody 22113
QQHYGYPPT

SEQ ID NO: 44226 - protein, 18 aa, Homo sapiens
  heavy chain complementarity determining region 3 for antibody 22113
ARSRSGGIRDPQYNGLDV

SEQ ID NO: 44227 - protein, 9 aa, Homo sapiens
  light chain complementarity determining region 3 for antibody 22114
QQHYGYPLT

SEQ ID NO: 44228 - protein, 18 aa, Homo sapiens
  heavy chain complementarity determining region 3 for antibody 22114
ARSRSGGIRDPQYTGLDV

SEQ ID NO: 44229 - protein, 9 aa, Homo sapiens
  light chain complementarity determining region 3 for antibody 22115
QQHVTTPLT

SEQ ID NO: 44230 - protein, 8 aa, Homo sapiens
  heavy chain complementarity determining region 3 for antibody 22115
VRMSDYIL

SEQ ID NO: 44231 - protein, 9 aa, Homo sapiens
  light chain complementarity determining region 3 for antibody 22116
QQHVTPPLT

SEQ ID NO: 44232 - protein, 18 aa, Homo sapiens
  heavy chain complementarity determining region 3 for antibody 22116
ARCVAAAAKWGVYWYFDL

SEQ ID NO: 44233 - protein, 10 aa, Homo sapiens
  light chain complementarity determining region 3 for antibody 22117
QQHVSSPPWT

SEQ ID NO: 44234 - protein, 14 aa, Homo sapiens
  heavy chain complementarity determining region 3 for antibody 22117
ARSPRTTVPPPWDY

SEQ ID NO: 44235 - protein, 10 aa, Homo sapiens
  light chain complementarity determining region 3 for antibody 22118
QQHVSSPPWP

SEQ ID NO: 44236 - protein, 14 aa, Homo sapiens
  heavy chain complementarity determining region 3 for antibody 22118
ARSPRTTMPPPWDY

SEQ ID NO: 44237 - protein, 9 aa, Homo sapiens
  light chain complementarity determining region 3 for antibody 22119
QQHTSWPRT

SEQ ID NO: 44238 - protein, 14 aa, Homo sapiens
  heavy chain complementarity determining region 3 for antibody 22119
ARGGDYEYPDVFDI

SEQ ID NO: 44239 - protein, 9 aa, Homo sapiens
  light chain complementarity determining region 3 for antibody 22120
QQHTNWPLT

SEQ ID NO: 44240 - protein, 16 aa, Homo sapiens
  heavy chain complementarity determining region 3 for antibody 22120
AKEGYHYETGGGGMDV

SEQ ID NO: 44241 - protein, 9 aa, Homo sapiens
  light chain complementarity determining region 3 for antibody 22121
QQHSSSLFA

SEQ ID NO: 44242 - protein, 15 aa, Homo sapiens
  heavy chain complementarity determining region 3 for antibody 22121
ARGGKSSSWLSYFDS

SEQ ID NO: 44243 - protein, 9 aa, Homo sapiens
  light chain complementarity determining region 3 for antibody 22122
QQHSNWPLT

SEQ ID NO: 44244 - protein, 14 aa, Homo sapiens
  heavy chain complementarity determining region 3 for antibody 22122
AKRRYDSSGYYFDY

SEQ ID NO: 44245 - protein, 9 aa, Homo sapiens
  light chain complementarity determining region 3 for antibody 22123
QQHSNWPLT

SEQ ID NO: 44246 - protein, 14 aa, Homo sapiens
  heavy chain complementarity determining region 3 for antibody 22123
AKHRYDSRGYYFDY

SEQ ID NO: 44247 - protein, 9 aa, Homo sapiens
  light chain complementarity determining region 3 for antibody 22124
QQHSNWPLP

SEQ ID NO: 44248 - protein, 14 aa, Homo sapiens
  heavy chain complementarity determining region 3 for antibody 22124
AKHRYDSSGYYFDY

SEQ ID NO: 44249 - protein, 9 aa, Homo sapiens
  light chain complementarity determining region 3 for antibody 22125
QQHSNRPLT

SEQ ID NO: 44250 - protein, 14 aa, Homo sapiens
  heavy chain complementarity determining region 3 for antibody 22125
AKHRYDSSGYYFDY

SEQ ID NO: 44251 - protein, 9 aa, Homo sapiens
  light chain complementarity determining region 3 for antibody 22126
QQHSNGPLT

SEQ ID NO: 44252 - protein, 14 aa, Homo sapiens
  heavy chain complementarity determining region 3 for antibody 22126
AKHRYDSSGYYFDY

SEQ ID NO: 44253 - protein, 9 aa, Homo sapiens
  light chain complementarity determining region 3 for antibody 22127
QQHSHWPLT

SEQ ID NO: 44254 - protein, 14 aa, Homo sapiens
  heavy chain complementarity determining region 3 for antibody 22127
AKHRYDSSGYYFDY

SEQ ID NO: 44255 - protein, 9 aa, Homo sapiens
  light chain complementarity determining region 3 for antibody 22128
QQHSDSPGT

SEQ ID NO: 44256 - protein, 22 aa, Homo sapiens
  heavy chain complementarity determining region 3 for antibody 22128
ARPKTQGGYYESSGYERAAFDL

SEQ ID NO: 44257 - protein, 9 aa, Homo sapiens
  light chain complementarity determining region 3 for antibody 22129
QQHRSYPPT

SEQ ID NO: 44258 - protein, 17 aa, Homo sapiens
  heavy chain complementarity determining region 3 for antibody 22129
ARVPYCSTTTCYFPFDF

SEQ ID NO: 44259 - protein, 8 aa, Homo sapiens
  light chain complementarity determining region 3 for antibody 22130
QQHNTWLS

SEQ ID NO: 44260 - protein, 12 aa, Homo sapiens
  heavy chain complementarity determining region 3 for antibody 22130
ARLLWDSYYFDS

SEQ ID NO: 44261 - protein, 9 aa, Homo sapiens
  light chain complementarity determining region 3 for antibody 22131
QQHNSWPRT

SEQ ID NO: 44262 - protein, 14 aa, Homo sapiens
  heavy chain complementarity determining region 3 for antibody 22131
ARGGGYEYPDVFDI

SEQ ID NO: 44263 - protein, 9 aa, Homo sapiens
  light chain complementarity determining region 3 for antibody 22132
QQHNSWPRK

SEQ ID NO: 44264 - protein, 14 aa, Homo sapiens
  heavy chain complementarity determining region 3 for antibody 22132
ARGGDYEYPDVFDI

SEQ ID NO: 44265 - protein, 9 aa, Homo sapiens
  light chain complementarity determining region 3 for antibody 22133
QQHNSWLRT

SEQ ID NO: 44266 - protein, 14 aa, Homo sapiens
  heavy chain complementarity determining region 3 for antibody 22133
ARGGDYEYPDVFDI

SEQ ID NO: 44267 - protein, 9 aa, Homo sapiens
  light chain complementarity determining region 3 for antibody 22134
QQHNSRPRT

SEQ ID NO: 44268 - protein, 14 aa, Homo sapiens
  heavy chain complementarity determining region 3 for antibody 22134
ARGGDYEYPDVFDI

SEQ ID NO: 44269 - protein, 9 aa, Homo sapiens
  light chain complementarity determining region 3 for antibody 22135
QQHNSGPRT

SEQ ID NO: 44270 - protein, 14 aa, Homo sapiens
  heavy chain complementarity determining region 3 for antibody 22135
ARGGDYEYPDVFDI

SEQ ID NO: 44271 - protein, 9 aa, Homo sapiens
  light chain complementarity determining region 3 for antibody 22136
QQHNSCPRT

SEQ ID NO: 44272 - protein, 14 aa, Homo sapiens
  heavy chain complementarity determining region 3 for antibody 22136
ARGGDYEYPDVFDI

SEQ ID NO: 44273 - protein, 8 aa, Homo sapiens
  light chain complementarity determining region 3 for antibody 22137
QQHNNWVR

SEQ ID NO: 44274 - protein, 12 aa, Homo sapiens
  heavy chain complementarity determining region 3 for antibody 22137
ARRVSDWWFFDL

SEQ ID NO: 44275 - protein, 10 aa, Homo sapiens
  light chain complementarity determining region 3 for antibody 22138
QQHNNWPRYT

SEQ ID NO: 44276 - protein, 14 aa, Homo sapiens
  heavy chain complementarity determining region 3 for antibody 22138
ARLGEGYSYGPSDC

SEQ ID NO: 44277 - protein, 9 aa, Homo sapiens
  light chain complementarity determining region 3 for antibody 22139
QQHNCWPRT

SEQ ID NO: 44278 - protein, 14 aa, Homo sapiens
  heavy chain complementarity determining region 3 for antibody 22139
ARGGDYEYPDVFDI

SEQ ID NO: 44279 - protein, 9 aa, Homo sapiens
  light chain complementarity determining region 3 for antibody 22140
QQHHDWPQT

SEQ ID NO: 44280 - protein, 23 aa, Homo sapiens
  heavy chain complementarity determining region 3 for antibody 22140
ALQINKDLGLVRGVTQWTTYFDY

SEQ ID NO: 44281 - protein, 8 aa, Homo sapiens
  light chain complementarity determining region 3 for antibody 22141
QQHGYSWK

SEQ ID NO: 44282 - protein, 9 aa, Homo sapiens
  heavy chain complementarity determining region 3 for antibody 22141
ARWVEGLDV

SEQ ID NO: 44283 - protein, 6 aa, Homo sapiens
  light chain complementarity determining region 3 for antibody 22142
QQHGTT

SEQ ID NO: 44284 - protein, 12 aa, Homo sapiens
  heavy chain complementarity determining region 3 for antibody 22142
ARDADAGYAQDC

SEQ ID NO: 44285 - protein, 10 aa, Homo sapiens
  light chain complementarity determining region 3 for antibody 22143
QQHGTSPTWT

SEQ ID NO: 44286 - protein, 18 aa, Homo sapiens
  heavy chain complementarity determining region 3 for antibody 22143
ARAPRDTMIVVRYYGMDV

SEQ ID NO: 44287 - protein, 11 aa, Homo sapiens
  light chain complementarity determining region 3 for antibody 22144
QQHGTSPPKVP

SEQ ID NO: 44288 - protein, 11 aa, Homo sapiens
  heavy chain complementarity determining region 3 for antibody 22144
AKPSAGTTGDY

SEQ ID NO: 44289 - protein, 8 aa, Homo sapiens
  light chain complementarity determining region 3 for antibody 22145
QQHGTSLT

SEQ ID NO: 44290 - protein, 14 aa, Homo sapiens
  heavy chain complementarity determining region 3 for antibody 22145
ARAGSYYADWYFDL

SEQ ID NO: 44291 - protein, 9 aa, Homo sapiens
  light chain complementarity determining region 3 for antibody 22146
QQHGTLPQT

SEQ ID NO: 44292 - protein, 18 aa, Homo sapiens
  heavy chain complementarity determining region 3 for antibody 22146
ARDYYGSGREIWVGAFDI

SEQ ID NO: 44293 - protein, 9 aa, Homo sapiens
  light chain complementarity determining region 3 for antibody 22147
QQHGSSPRT

SEQ ID NO: 44294 - protein, 17 aa, Homo sapiens
  heavy chain complementarity determining region 3 for antibody 22147
TTDPQWLEPPPFLTNDY

SEQ ID NO: 44295 - protein, 9 aa, Homo sapiens
  light chain complementarity determining region 3 for antibody 22148
QQHGSSPRS

SEQ ID NO: 44296 - protein, 25 aa, Homo sapiens
  heavy chain complementarity determining region 3 for antibody 22148
ARLRIDRLRLPGAMRGPLYDCGLNV

SEQ ID NO: 44297 - protein, 10 aa, Homo sapiens
  light chain complementarity determining region 3 for antibody 22149
QQHGSSPPVT

SEQ ID NO: 44298 - protein, 15 aa, Homo sapiens
  heavy chain complementarity determining region 3 for antibody 22149
AKGPMVRGVLGPFDY

SEQ ID NO: 44299 - protein, 9 aa, Homo sapiens
  light chain complementarity determining region 3 for antibody 22150
QQHGSIPRT

SEQ ID NO: 44300 - protein, 14 aa, Homo sapiens
  heavy chain complementarity determining region 3 for antibody 22150
AGGEFSSGWHYSEN

SEQ ID NO: 44301 - protein, 9 aa, Homo sapiens
  light chain complementarity determining region 3 for antibody 22151
QQHGSIPLT

SEQ ID NO: 44302 - protein, 7 aa, Homo sapiens
  heavy chain complementarity determining region 3 for antibody 22151
HGYELKC

SEQ ID NO: 44303 - protein, 9 aa, Homo sapiens
  light chain complementarity determining region 3 for antibody 22152
QQHGNSPRT

SEQ ID NO: 44304 - protein, 13 aa, Homo sapiens
  heavy chain complementarity determining region 3 for antibody 22152
AGGHYDSGDYREY

SEQ ID NO: 44305 - protein, 9 aa, Homo sapiens
  light chain complementarity determining region 3 for antibody 22153
QQHGNLPRT

SEQ ID NO: 44306 - protein, 13 aa, Homo sapiens
  heavy chain complementarity determining region 3 for antibody 22153
AGGQFHSSGYSEF

SEQ ID NO: 44307 - protein, 9 aa, Homo sapiens
  light chain complementarity determining region 3 for antibody 22154
QQHGNLPRT

SEQ ID NO: 44308 - protein, 14 aa, Homo sapiens
  heavy chain complementarity determining region 3 for antibody 22154
AGGDFHRGGGYSEF

SEQ ID NO: 44309 - protein, 9 aa, Homo sapiens
  light chain complementarity determining region 3 for antibody 22155
QQHGNIPRS

SEQ ID NO: 44310 - protein, 13 aa, Homo sapiens
  heavy chain complementarity determining region 3 for antibody 22155
AGGTWHSGTYYES

SEQ ID NO: 44311 - protein, 9 aa, Homo sapiens
  light chain complementarity determining region 3 for antibody 22156
QQHGGSPVT

SEQ ID NO: 44312 - protein, 6 aa, Homo sapiens
  heavy chain complementarity determining region 3 for antibody 22156
AAIPAF

SEQ ID NO: 44313 - protein, 9 aa, Homo sapiens
  light chain complementarity determining region 3 for antibody 22157
QQHGGSPGT

SEQ ID NO: 44314 - protein, 6 aa, Homo sapiens
  heavy chain complementarity determining region 3 for antibody 22157
AAIPTF

SEQ ID NO: 44315 - protein, 8 aa, Homo sapiens
  light chain complementarity determining region 3 for antibody 22158
QQHDSYST

SEQ ID NO: 44316 - protein, 16 aa, Homo sapiens
  heavy chain complementarity determining region 3 for antibody 22158
AKDALALTSKPYYFDF

SEQ ID NO: 44317 - protein, 9 aa, Homo sapiens
  light chain complementarity determining region 3 for antibody 22159
QQHDSFPWT

SEQ ID NO: 44318 - protein, 26 aa, Homo sapiens
  heavy chain complementarity determining region 3 for antibody 22159
ARDKNDLYTSVLRGTLFTNYYYGMNV

SEQ ID NO: 44319 - protein, 10 aa, Homo sapiens
  light chain complementarity determining region 3 for antibody 22160
QQHDNWPPWT

SEQ ID NO: 44320 - protein, 12 aa, Homo sapiens
  heavy chain complementarity determining region 3 for antibody 22160
AKTLRERKELDY

SEQ ID NO: 44321 - protein, 9 aa, Homo sapiens
  light chain complementarity determining region 3 for antibody 22161
QQHDNLPYT

SEQ ID NO: 44322 - protein, 13 aa, Homo sapiens
  heavy chain complementarity determining region 3 for antibody 22161
ARSRQLAAGAGDY

SEQ ID NO: 44323 - protein, 9 aa, Homo sapiens
  light chain complementarity determining region 3 for antibody 22162
QQGYSTQLT

SEQ ID NO: 44324 - protein, 14 aa, Homo sapiens
  heavy chain complementarity determining region 3 for antibody 22162
ARDRFGDSRISFDY

SEQ ID NO: 44325 - protein, 9 aa, Homo sapiens
  light chain complementarity determining region 3 for antibody 22163
QQGYSTPLT

SEQ ID NO: 44326 - protein, 15 aa, Homo sapiens
  heavy chain complementarity determining region 3 for antibody 22163
VRAQVIWGQLYYFDF

SEQ ID NO: 44327 - protein, 9 aa, Homo sapiens
  light chain complementarity determining region 3 for antibody 22164
QQGYSTPLT

SEQ ID NO: 44328 - protein, 14 aa, Homo sapiens
  heavy chain complementarity determining region 3 for antibody 22164
ARDRFGDARISFDY

SEQ ID NO: 44329 - protein, 9 aa, Homo sapiens
  light chain complementarity determining region 3 for antibody 22165
QQGYSTPLL

SEQ ID NO: 44330 - protein, 10 aa, Homo sapiens
  heavy chain complementarity determining region 3 for antibody 22165
VREMVGARDY

SEQ ID NO: 44331 - protein, 9 aa, Homo sapiens
  light chain complementarity determining region 3 for antibody 22166
QQGYSTPLI

SEQ ID NO: 44332 - protein, 10 aa, Homo sapiens
  heavy chain complementarity determining region 3 for antibody 22166
VREMVGALDY

SEQ ID NO: 44333 - protein, 9 aa, Homo sapiens
  light chain complementarity determining region 3 for antibody 22167
QQGYSTPLI

SEQ ID NO: 44334 - protein, 15 aa, Homo sapiens
  heavy chain complementarity determining region 3 for antibody 22167
ARAQVSWGQLYYFDY

SEQ ID NO: 44335 - protein, 9 aa, Homo sapiens
  light chain complementarity determining region 3 for antibody 22168
QQGYSTPLI

SEQ ID NO: 44336 - protein, 15 aa, Homo sapiens
  heavy chain complementarity determining region 3 for antibody 22168
ARAQVIWGQLYYLDY

SEQ ID NO: 44337 - protein, 9 aa, Homo sapiens
  light chain complementarity determining region 3 for antibody 22169
QQGYSTPLI

SEQ ID NO: 44338 - protein, 15 aa, Homo sapiens
  heavy chain complementarity determining region 3 for antibody 22169
ARAQVIWGQLYYFAY

SEQ ID NO: 44339 - protein, 9 aa, Homo sapiens
  light chain complementarity determining region 3 for antibody 22170
QQGYSSPFT

SEQ ID NO: 44340 - protein, 15 aa, Homo sapiens
  heavy chain complementarity determining region 3 for antibody 22170
VKAQVIWGQLYYFDS

SEQ ID NO: 44341 - protein, 9 aa, Homo sapiens
  light chain complementarity determining region 3 for antibody 22171
QQGYSSPFT

SEQ ID NO: 44342 - protein, 15 aa, Homo sapiens
  heavy chain complementarity determining region 3 for antibody 22171
VKAQVIWGHLYYFES

SEQ ID NO: 44343 - protein, 9 aa, Homo sapiens
  light chain complementarity determining region 3 for antibody 22172
QQGYSSPFP

SEQ ID NO: 44344 - protein, 15 aa, Homo sapiens
  heavy chain complementarity determining region 3 for antibody 22172
AKAQVIWGQLYYFES

SEQ ID NO: 44345 - protein, 9 aa, Homo sapiens
  light chain complementarity determining region 3 for antibody 22173
QQGYSRLPT

SEQ ID NO: 44346 - protein, 18 aa, Homo sapiens
  heavy chain complementarity determining region 3 for antibody 22173
ARGYGSGSYFNCYYGMDV

SEQ ID NO: 44347 - protein, 9 aa, Homo sapiens
  light chain complementarity determining region 3 for antibody 22174
QQGYSRLPP

SEQ ID NO: 44348 - protein, 18 aa, Homo sapiens
  heavy chain complementarity determining region 3 for antibody 22174
ARGYGSGSYFNYYYGMDV

SEQ ID NO: 44349 - protein, 9 aa, Homo sapiens
  light chain complementarity determining region 3 for antibody 22175
QQGYSNPLT

SEQ ID NO: 44350 - protein, 15 aa, Homo sapiens
  heavy chain complementarity determining region 3 for antibody 22175
ARAQVVWGQLYYFDS

SEQ ID NO: 44351 - protein, 9 aa, Homo sapiens
  light chain complementarity determining region 3 for antibody 22176
QQGYSIPST

SEQ ID NO: 44352 - protein, 13 aa, Homo sapiens
  heavy chain complementarity determining region 3 for antibody 22176
AKEGDSSGDYFDY

SEQ ID NO: 44353 - protein, 9 aa, Homo sapiens
  light chain complementarity determining region 3 for antibody 22177
QQGYSIPFT

SEQ ID NO: 44354 - protein, 13 aa, Homo sapiens
  heavy chain complementarity determining region 3 for antibody 22177
AKEGDSSGDYLDY

SEQ ID NO: 44355 - protein, 9 aa, Homo sapiens
  light chain complementarity determining region 3 for antibody 22178
QQGYSIPFT

SEQ ID NO: 44356 - protein, 13 aa, Homo sapiens
  heavy chain complementarity determining region 3 for antibody 22178
AKEGDSSGDYFDS

SEQ ID NO: 44357 - protein, 9 aa, Homo sapiens
  light chain complementarity determining region 3 for antibody 22179
QQGYSIPFT

SEQ ID NO: 44358 - protein, 13 aa, Homo sapiens
  heavy chain complementarity determining region 3 for antibody 22179
AKEGDSGGDYFDY

SEQ ID NO: 44359 - protein, 9 aa, Homo sapiens
  light chain complementarity determining region 3 for antibody 22180
QQGYSIPFP

SEQ ID NO: 44360 - protein, 13 aa, Homo sapiens
  heavy chain complementarity determining region 3 for antibody 22180
AKEGDSSGDYFDY

SEQ ID NO: 44361 - protein, 9 aa, Homo sapiens
  light chain complementarity determining region 3 for antibody 22181
QQGYRSPFI

SEQ ID NO: 44362 - protein, 15 aa, Homo sapiens
  heavy chain complementarity determining region 3 for antibody 22181
TRAQVIWGQLYYFDY

SEQ ID NO: 44363 - protein, 9 aa, Homo sapiens
  light chain complementarity determining region 3 for antibody 22182
QQGYRPPSI

SEQ ID NO: 44364 - protein, 15 aa, Homo sapiens
  heavy chain complementarity determining region 3 for antibody 22182
TRAQVIWGQLYYFDY

SEQ ID NO: 44365 - protein, 9 aa, Homo sapiens
  light chain complementarity determining region 3 for antibody 22183
QQGYRPPFI

SEQ ID NO: 44366 - protein, 15 aa, Homo sapiens
  heavy chain complementarity determining region 3 for antibody 22183
TRSQVIWGQLYYFDY

SEQ ID NO: 44367 - protein, 9 aa, Homo sapiens
  light chain complementarity determining region 3 for antibody 22184
QQGYRPPFI

SEQ ID NO: 44368 - protein, 15 aa, Homo sapiens
  heavy chain complementarity determining region 3 for antibody 22184
TRAQVSWGQLYYFDY

SEQ ID NO: 44369 - protein, 9 aa, Homo sapiens
  light chain complementarity determining region 3 for antibody 22185
QQGYRPPFI

SEQ ID NO: 44370 - protein, 15 aa, Homo sapiens
  heavy chain complementarity determining region 3 for antibody 22185
TRAQVIWGRLYYFDY

SEQ ID NO: 44371 - protein, 9 aa, Homo sapiens
  light chain complementarity determining region 3 for antibody 22186
QQGYRPPFI

SEQ ID NO: 44372 - protein, 15 aa, Homo sapiens
  heavy chain complementarity determining region 3 for antibody 22186
TRAQVIWGQLCYFDY

SEQ ID NO: 44373 - protein, 9 aa, Homo sapiens
  light chain complementarity determining region 3 for antibody 22187
QQGYRPPFF

SEQ ID NO: 44374 - protein, 15 aa, Homo sapiens
  heavy chain complementarity determining region 3 for antibody 22187
TRAQVIWGQLYYFDY

SEQ ID NO: 44375 - protein, 9 aa, Homo sapiens
  light chain complementarity determining region 3 for antibody 22188
QQGYNTPWT

SEQ ID NO: 44376 - protein, 12 aa, Homo sapiens
  heavy chain complementarity determining region 3 for antibody 22188
ARVQQRGDSFDL

SEQ ID NO: 44377 - protein, 9 aa, Homo sapiens
  light chain complementarity determining region 3 for antibody 22189
QQGYNTPWT

SEQ ID NO: 44378 - protein, 12 aa, Homo sapiens
  heavy chain complementarity determining region 3 for antibody 22189
ARVHQRGDSFDI

SEQ ID NO: 44379 - protein, 9 aa, Homo sapiens
  light chain complementarity determining region 3 for antibody 22190
QQGYNTPCT

SEQ ID NO: 44380 - protein, 12 aa, Homo sapiens
  heavy chain complementarity determining region 3 for antibody 22190
ARVQQRGDSFDI

SEQ ID NO: 44381 - protein, 9 aa, Homo sapiens
  light chain complementarity determining region 3 for antibody 22191
QQGYASPPT

SEQ ID NO: 44382 - protein, 13 aa, Homo sapiens
  heavy chain complementarity determining region 3 for antibody 22191
AHITLRYRTTFDF

SEQ ID NO: 44383 - protein, 9 aa, Homo sapiens
  light chain complementarity determining region 3 for antibody 22192
QQGSGNPYT

SEQ ID NO: 44384 - protein, 15 aa, Homo sapiens
  heavy chain complementarity determining region 3 for antibody 22192
ARDGWLQETKSFFDH

SEQ ID NO: 44385 - protein, 9 aa, Homo sapiens
  light chain complementarity determining region 3 for antibody 22193
QQGSGHPST

SEQ ID NO: 44386 - protein, 15 aa, Homo sapiens
  heavy chain complementarity determining region 3 for antibody 22193
ARDGWLQETKSFFDH

SEQ ID NO: 44387 - protein, 9 aa, Homo sapiens
  light chain complementarity determining region 3 for antibody 22194
QQGNSYSRT

SEQ ID NO: 44388 - protein, 11 aa, Homo sapiens
  heavy chain complementarity determining region 3 for antibody 22194
ARNILGGHTDF

SEQ ID NO: 44389 - protein, 9 aa, Homo sapiens
  light chain complementarity determining region 3 for antibody 22195
QQGNSLPWT

SEQ ID NO: 44390 - protein, 13 aa, Homo sapiens
  heavy chain complementarity determining region 3 for antibody 22195
ASNRMSYPHYFDY

SEQ ID NO: 44391 - protein, 9 aa, Homo sapiens
  light chain complementarity determining region 3 for antibody 22196
QQGNSLPLT

SEQ ID NO: 44392 - protein, 12 aa, Homo sapiens
  heavy chain complementarity determining region 3 for antibody 22196
ARVVLGGRGFDY

SEQ ID NO: 44393 - protein, 9 aa, Homo sapiens
  light chain complementarity determining region 3 for antibody 22197
QQGNSLPFT

SEQ ID NO: 44394 - protein, 12 aa, Homo sapiens
  heavy chain complementarity determining region 3 for antibody 22197
ARVVLGGRGFDY

SEQ ID NO: 44395 - protein, 9 aa, Homo sapiens
  light chain complementarity determining region 3 for antibody 22198
QQGHIYPPT

SEQ ID NO: 44396 - protein, 12 aa, Homo sapiens
  heavy chain complementarity determining region 3 for antibody 22198
ARDTDGSFGLDV

SEQ ID NO: 44397 - protein, 9 aa, Homo sapiens
  light chain complementarity determining region 3 for antibody 22199
QQGDTFPLT

SEQ ID NO: 44398 - protein, 16 aa, Homo sapiens
  heavy chain complementarity determining region 3 for antibody 22199
ARGQSIWDAGYLGLGV

SEQ ID NO: 44399 - protein, 9 aa, Homo sapiens
  light chain complementarity determining region 3 for antibody 22200
QQGDTFPLT

SEQ ID NO: 44400 - protein, 16 aa, Homo sapiens
  heavy chain complementarity determining region 3 for antibody 22200
ARGQAIWDAGYLGLDV

SEQ ID NO: 44401 - protein, 9 aa, Homo sapiens
  light chain complementarity determining region 3 for antibody 22201
QQGDTFPLT

SEQ ID NO: 44402 - protein, 16 aa, Homo sapiens
  heavy chain complementarity determining region 3 for antibody 22201
AGGQSIWDAGYLGLDV

SEQ ID NO: 44403 - protein, 9 aa, Homo sapiens
  light chain complementarity determining region 3 for antibody 22202
QQFYTYPLT

SEQ ID NO: 44404 - protein, 12 aa, Homo sapiens
  heavy chain complementarity determining region 3 for antibody 22202
TRVLSSARGECD

SEQ ID NO: 44405 - protein, 9 aa, Homo sapiens
  light chain complementarity determining region 3 for antibody 22203
QQFYTYPLT

SEQ ID NO: 44406 - protein, 12 aa, Homo sapiens
  heavy chain complementarity determining region 3 for antibody 22203
TRVLSSAIGVWD

SEQ ID NO: 44407 - protein, 9 aa, Homo sapiens
  light chain complementarity determining region 3 for antibody 22204
QQFYTYPLT

SEQ ID NO: 44408 - protein, 12 aa, Homo sapiens
  heavy chain complementarity determining region 3 for antibody 22204
TRVLSSAIGQCD

SEQ ID NO: 44409 - protein, 9 aa, Homo sapiens
  light chain complementarity determining region 3 for antibody 22205
QQFYTYPLT

SEQ ID NO: 44410 - protein, 12 aa, Homo sapiens
  heavy chain complementarity determining region 3 for antibody 22205
TRGLSSAIGEWD

SEQ ID NO: 44411 - protein, 9 aa, Homo sapiens
  light chain complementarity determining region 3 for antibody 22206
QQFYTYPLT

SEQ ID NO: 44412 - protein, 12 aa, Homo sapiens
  heavy chain complementarity determining region 3 for antibody 22206
ARVLSSAIGEWD

SEQ ID NO: 44413 - protein, 9 aa, Homo sapiens
  light chain complementarity determining region 3 for antibody 22207
QQFYTYPLN

SEQ ID NO: 44414 - protein, 12 aa, Homo sapiens
  heavy chain complementarity determining region 3 for antibody 22207
TRVLSSAIGEWD

SEQ ID NO: 44415 - protein, 9 aa, Homo sapiens
  light chain complementarity determining region 3 for antibody 22208
QQFYTTPRT

SEQ ID NO: 44416 - protein, 8 aa, Homo sapiens
  heavy chain complementarity determining region 3 for antibody 22208
ARDGAFDS

SEQ ID NO: 44417 - protein, 9 aa, Homo sapiens
  light chain complementarity determining region 3 for antibody 22209
QQFYNNPLT

SEQ ID NO: 44418 - protein, 14 aa, Homo sapiens
  heavy chain complementarity determining region 3 for antibody 22209
VGQDCIGGACDSPR

SEQ ID NO: 44419 - protein, 9 aa, Homo sapiens
  light chain complementarity determining region 3 for antibody 22210
QQFYNNPFT

SEQ ID NO: 44420 - protein, 14 aa, Homo sapiens
  heavy chain complementarity determining region 3 for antibody 22210
LGQDCSGVGCDSPR

SEQ ID NO: 44421 - protein, 9 aa, Homo sapiens
  light chain complementarity determining region 3 for antibody 22211
QQFYNNPFT

SEQ ID NO: 44422 - protein, 14 aa, Homo sapiens
  heavy chain complementarity determining region 3 for antibody 22211
LGQDCSGVGCDFPS

SEQ ID NO: 44423 - protein, 9 aa, Homo sapiens
  light chain complementarity determining region 3 for antibody 22212
QQFYNNPFP

SEQ ID NO: 44424 - protein, 14 aa, Homo sapiens
  heavy chain complementarity determining region 3 for antibody 22212
LGQDCSGVGCDYPR

SEQ ID NO: 44425 - protein, 9 aa, Homo sapiens
  light chain complementarity determining region 3 for antibody 22213
QQFYGSPWT

SEQ ID NO: 44426 - protein, 16 aa, Homo sapiens
  heavy chain complementarity determining region 3 for antibody 22213
IRQDYYDTSGFSYPAA

SEQ ID NO: 44427 - protein, 9 aa, Homo sapiens
  light chain complementarity determining region 3 for antibody 22214
QQFYGFPWT

SEQ ID NO: 44428 - protein, 16 aa, Homo sapiens
  heavy chain complementarity determining region 3 for antibody 22214
IRQDYYDTSGFSYPAT

SEQ ID NO: 44429 - protein, 9 aa, Homo sapiens
  light chain complementarity determining region 3 for antibody 22215
QQFYDWPRT

SEQ ID NO: 44430 - protein, 15 aa, Homo sapiens
  heavy chain complementarity determining region 3 for antibody 22215
TTDTVSGYYTYYFDS

SEQ ID NO: 44431 - protein, 11 aa, Homo sapiens
  light chain complementarity determining region 3 for antibody 22216
QQFTNWPPLFT

SEQ ID NO: 44432 - protein, 14 aa, Homo sapiens
  heavy chain complementarity determining region 3 for antibody 22216
ARLSGIVGYYAFDM

SEQ ID NO: 44433 - protein, 11 aa, Homo sapiens
  light chain complementarity determining region 3 for antibody 22217
QQFTNWPPLFT

SEQ ID NO: 44434 - protein, 14 aa, Homo sapiens
  heavy chain complementarity determining region 3 for antibody 22217
ARLNGIVGYYAFDI

SEQ ID NO: 44435 - protein, 9 aa, Homo sapiens
  light chain complementarity determining region 3 for antibody 22218
QQFNSFPWT

SEQ ID NO: 44436 - protein, 20 aa, Homo sapiens
  heavy chain complementarity determining region 3 for antibody 22218
MSRFCIGGNCYSGARGPFDP

SEQ ID NO: 44437 - protein, 10 aa, Homo sapiens
  light chain complementarity determining region 3 for antibody 22219
QQFNNWPTWT

SEQ ID NO: 44438 - protein, 12 aa, Homo sapiens
  heavy chain complementarity determining region 3 for antibody 22219
AKTVRERKELDH

SEQ ID NO: 44439 - protein, 10 aa, Homo sapiens
  light chain complementarity determining region 3 for antibody 22220
QQFNNWPPWT

SEQ ID NO: 44440 - protein, 12 aa, Homo sapiens
  heavy chain complementarity determining region 3 for antibody 22220
AKAVRERKELDH

SEQ ID NO: 44441 - protein, 10 aa, Homo sapiens
  light chain complementarity determining region 3 for antibody 22221
QQFNNWPPWP

SEQ ID NO: 44442 - protein, 12 aa, Homo sapiens
  heavy chain complementarity determining region 3 for antibody 22221
AKTVRERKELDH

SEQ ID NO: 44443 - protein, 10 aa, Homo sapiens
  light chain complementarity determining region 3 for antibody 22222
QQFNNWPPWK

SEQ ID NO: 44444 - protein, 12 aa, Homo sapiens
  heavy chain complementarity determining region 3 for antibody 22222
AKTVRERKELDH

SEQ ID NO: 44445 - protein, 10 aa, Homo sapiens
  light chain complementarity determining region 3 for antibody 22223
QQFNNWPPRT

SEQ ID NO: 44446 - protein, 12 aa, Homo sapiens
  heavy chain complementarity determining region 3 for antibody 22223
AKTVRERKELDH

SEQ ID NO: 44447 - protein, 10 aa, Homo sapiens
  light chain complementarity determining region 3 for antibody 22224
QQFNNWPPLT

SEQ ID NO: 44448 - protein, 12 aa, Homo sapiens
  heavy chain complementarity determining region 3 for antibody 22224
AKTVRERKELDH

SEQ ID NO: 44449 - protein, 10 aa, Homo sapiens
  light chain complementarity determining region 3 for antibody 22225
QQFNNWPPLT

SEQ ID NO: 44450 - protein, 17 aa, Homo sapiens
  heavy chain complementarity determining region 3 for antibody 22225
AKDLRPFYDIFAGYLDM

SEQ ID NO: 44451 - protein, 9 aa, Homo sapiens
  light chain complementarity determining region 3 for antibody 22226
QQFNIYPPT

SEQ ID NO: 44452 - protein, 15 aa, Homo sapiens
  heavy chain complementarity determining region 3 for antibody 22226
VRDSGSRVRQDYFDY

SEQ ID NO: 44453 - protein, 9 aa, Homo sapiens
  light chain complementarity determining region 3 for antibody 22227
QQFNIYPPT

SEQ ID NO: 44454 - protein, 15 aa, Homo sapiens
  heavy chain complementarity determining region 3 for antibody 22227
VRDSGIRVRQGYFDY

SEQ ID NO: 44455 - protein, 9 aa, Homo sapiens
  light chain complementarity determining region 3 for antibody 22228
QQFNIYPPT

SEQ ID NO: 44456 - protein, 15 aa, Homo sapiens
  heavy chain complementarity determining region 3 for antibody 22228
VRDSGIRVRQDSFDY

SEQ ID NO: 44457 - protein, 9 aa, Homo sapiens
  light chain complementarity determining region 3 for antibody 22229
QQFNIYPPT

SEQ ID NO: 44458 - protein, 15 aa, Homo sapiens
  heavy chain complementarity determining region 3 for antibody 22229
VRDSGIRFRQDYFDY

SEQ ID NO: 44459 - protein, 9 aa, Homo sapiens
  light chain complementarity determining region 3 for antibody 22230
QQFNIYPPT

SEQ ID NO: 44460 - protein, 15 aa, Homo sapiens
  heavy chain complementarity determining region 3 for antibody 22230
VRDPGIRVRQDYFDY

SEQ ID NO: 44461 - protein, 9 aa, Homo sapiens
  light chain complementarity determining region 3 for antibody 22231
QQFNIYPPS

SEQ ID NO: 44462 - protein, 15 aa, Homo sapiens
  heavy chain complementarity determining region 3 for antibody 22231
VRDSGIRVRQDYFDY

SEQ ID NO: 44463 - protein, 9 aa, Homo sapiens
  light chain complementarity determining region 3 for antibody 22232
QQFNIFPPT

SEQ ID NO: 44464 - protein, 15 aa, Homo sapiens
  heavy chain complementarity determining region 3 for antibody 22232
VRDSGIRVRQDYFDY

SEQ ID NO: 44465 - protein, 9 aa, Homo sapiens
  light chain complementarity determining region 3 for antibody 22233
QQFNAWPRT

SEQ ID NO: 44466 - protein, 15 aa, Homo sapiens
  heavy chain complementarity determining region 3 for antibody 22233
TTDTVSGYYTYYFDS

SEQ ID NO: 44467 - protein, 11 aa, Homo sapiens
  light chain complementarity determining region 3 for antibody 22234
QQFGTSPPGDT

SEQ ID NO: 44468 - protein, 14 aa, Homo sapiens
  heavy chain complementarity determining region 3 for antibody 22234
ARDSGTSRKRSFDQ

SEQ ID NO: 44469 - protein, 9 aa, Homo sapiens
  light chain complementarity determining region 3 for antibody 22235
QQFGTIPRT

SEQ ID NO: 44470 - protein, 13 aa, Homo sapiens
  heavy chain complementarity determining region 3 for antibody 22235
AGGLFDSSGYSEF

SEQ ID NO: 44471 - protein, 9 aa, Homo sapiens
  light chain complementarity determining region 3 for antibody 22236
QQFGSLPHT

SEQ ID NO: 44472 - protein, 14 aa, Homo sapiens
  heavy chain complementarity determining region 3 for antibody 22236
ASGGGSDWYGLLYD

SEQ ID NO: 44473 - protein, 9 aa, Homo sapiens
  light chain complementarity determining region 3 for antibody 22237
QQFGSLPHT

SEQ ID NO: 44474 - protein, 14 aa, Homo sapiens
  heavy chain complementarity determining region 3 for antibody 22237
ARGGGSDWYGLLDD

SEQ ID NO: 44475 - protein, 9 aa, Homo sapiens
  light chain complementarity determining region 3 for antibody 22238
QQFGSLPHT

SEQ ID NO: 44476 - protein, 14 aa, Homo sapiens
  heavy chain complementarity determining region 3 for antibody 22238
ARGGGRDWYGLLYD

SEQ ID NO: 44477 - protein, 9 aa, Homo sapiens
  light chain complementarity determining region 3 for antibody 22239
QQFGRLPHT

SEQ ID NO: 44478 - protein, 14 aa, Homo sapiens
  heavy chain complementarity determining region 3 for antibody 22239
ARGGGSDWYGLLYD

SEQ ID NO: 44479 - protein, 9 aa, Homo sapiens
  light chain complementarity determining region 3 for antibody 22240
QQFGRLPHT

SEQ ID NO: 44480 - protein, 14 aa, Homo sapiens
  heavy chain complementarity determining region 3 for antibody 22240
ARGGGSDWYGFLYD

SEQ ID NO: 44481 - protein, 10 aa, Homo sapiens
  light chain complementarity determining region 3 for antibody 22241
QQFGGPPSYT

SEQ ID NO: 44482 - protein, 16 aa, Homo sapiens
  heavy chain complementarity determining region 3 for antibody 22241
ARGPVMLTAVRSWFDP

SEQ ID NO: 44483 - protein, 9 aa, Homo sapiens
  light chain complementarity determining region 3 for antibody 22242
QQFFNTPYT

SEQ ID NO: 44484 - protein, 15 aa, Homo sapiens
  heavy chain complementarity determining region 3 for antibody 22242
TRERYYDLWSGYLDY

SEQ ID NO: 44485 - protein, 9 aa, Homo sapiens
  light chain complementarity determining region 3 for antibody 22243
QQFDRKPFT

SEQ ID NO: 44486 - protein, 14 aa, Homo sapiens
  heavy chain complementarity determining region 3 for antibody 22243
ARDNSNNWYEGMDV

SEQ ID NO: 44487 - protein, 10 aa, Homo sapiens
  light chain complementarity determining region 3 for antibody 22244
QQFDNSPTWT

SEQ ID NO: 44488 - protein, 13 aa, Homo sapiens
  heavy chain complementarity determining region 3 for antibody 22244
ARAPKFGAVYFDY

SEQ ID NO: 44489 - protein, 10 aa, Homo sapiens
  light chain complementarity determining region 3 for antibody 22245
QQFDNSPKLT

SEQ ID NO: 44490 - protein, 13 aa, Homo sapiens
  heavy chain complementarity determining region 3 for antibody 22245
ARAPKFGAVYFDY

SEQ ID NO: 44491 - protein, 9 aa, Homo sapiens
  light chain complementarity determining region 3 for antibody 22246
QQFDNLPLT

SEQ ID NO: 44492 - protein, 17 aa, Homo sapiens
  heavy chain complementarity determining region 3 for antibody 22246
TTQGITSFGVVIDAFDI

SEQ ID NO: 44493 - protein, 9 aa, Homo sapiens
  light chain complementarity determining region 3 for antibody 22247
QQFDNLPLT

SEQ ID NO: 44494 - protein, 17 aa, Homo sapiens
  heavy chain complementarity determining region 3 for antibody 22247
TTQGITISGVVIDAFDI

SEQ ID NO: 44495 - protein, 9 aa, Homo sapiens
  light chain complementarity determining region 3 for antibody 22248
QQFDNLPLT

SEQ ID NO: 44496 - protein, 17 aa, Homo sapiens
  heavy chain complementarity determining region 3 for antibody 22248
TSQGITIFGVVIDAFDI

SEQ ID NO: 44497 - protein, 9 aa, Homo sapiens
  light chain complementarity determining region 3 for antibody 22249
QQFDNLPLT

SEQ ID NO: 44498 - protein, 17 aa, Homo sapiens
  heavy chain complementarity determining region 3 for antibody 22249
TPQGITIFGVVIDAFDI

SEQ ID NO: 44499 - protein, 9 aa, Homo sapiens
  light chain complementarity determining region 3 for antibody 22250
QQFDNFPLT

SEQ ID NO: 44500 - protein, 17 aa, Homo sapiens
  heavy chain complementarity determining region 3 for antibody 22250
TTQGITIFGVVIDAFDI

SEQ ID NO: 44501 - protein, 9 aa, Homo sapiens
  light chain complementarity determining region 3 for antibody 22251
QQFDGAPYT

SEQ ID NO: 44502 - protein, 14 aa, Homo sapiens
  heavy chain complementarity determining region 3 for antibody 22251
AKPQLTRHNGGFDR

SEQ ID NO: 44503 - protein, 10 aa, Homo sapiens
  light chain complementarity determining region 3 for antibody 22252
QQFANSPKWT

SEQ ID NO: 44504 - protein, 13 aa, Homo sapiens
  heavy chain complementarity determining region 3 for antibody 22252
ARAPKFGAVYFDY

SEQ ID NO: 44505 - protein, 9 aa, Homo sapiens
  light chain complementarity determining region 3 for antibody 22253
QQFAGPPPT

SEQ ID NO: 44506 - protein, 9 aa, Homo sapiens
  heavy chain complementarity determining region 3 for antibody 22253
VRGDWGSGY

SEQ ID NO: 44507 - protein, 8 aa, Homo sapiens
  light chain complementarity determining region 3 for antibody 22254
QQDYSYRT

SEQ ID NO: 44508 - protein, 14 aa, Homo sapiens
  heavy chain complementarity determining region 3 for antibody 22254
VTDQDVYWSGYFRT

SEQ ID NO: 44509 - protein, 9 aa, Homo sapiens
  light chain complementarity determining region 3 for antibody 22255
QQDYSYPRT

SEQ ID NO: 44510 - protein, 18 aa, Homo sapiens
  heavy chain complementarity determining region 3 for antibody 22255
ARDANPSSGDLYFDAFDI

SEQ ID NO: 44511 - protein, 9 aa, Homo sapiens
  light chain complementarity determining region 3 for antibody 22256
QQDYRPPFI

SEQ ID NO: 44512 - protein, 15 aa, Homo sapiens
  heavy chain complementarity determining region 3 for antibody 22256
TRAQVIWGQLYYFDY

SEQ ID NO: 44513 - protein, 11 aa, Homo sapiens
  light chain complementarity determining region 3 for antibody 22257
QQDVTSPPSYT

SEQ ID NO: 44514 - protein, 11 aa, Homo sapiens
  heavy chain complementarity determining region 3 for antibody 22257
AYSPGWWRIDC

SEQ ID NO: 44515 - protein, 9 aa, Homo sapiens
  light chain complementarity determining region 3 for antibody 22258
QQDSNWPLT

SEQ ID NO: 44516 - protein, 16 aa, Homo sapiens
  heavy chain complementarity determining region 3 for antibody 22258
AKGRDNGDSHYWYFEI

SEQ ID NO: 44517 - protein, 8 aa, Homo sapiens
  light chain complementarity determining region 3 for antibody 22259
QQDNSYWT

SEQ ID NO: 44518 - protein, 14 aa, Homo sapiens
  heavy chain complementarity determining region 3 for antibody 22259
AKDRQWIPDGPLDY

SEQ ID NO: 44519 - protein, 9 aa, Homo sapiens
  light chain complementarity determining region 3 for antibody 22260
QQDNSYPYT

SEQ ID NO: 44520 - protein, 12 aa, Homo sapiens
  heavy chain complementarity determining region 3 for antibody 22260
AREGLRFHPFDV

SEQ ID NO: 44521 - protein, 9 aa, Homo sapiens
  light chain complementarity determining region 3 for antibody 22261
QQDNSYPLT

SEQ ID NO: 44522 - protein, 15 aa, Homo sapiens
  heavy chain complementarity determining region 3 for antibody 22261
VRHYRITVAAVEGDS

SEQ ID NO: 44523 - protein, 9 aa, Homo sapiens
  light chain complementarity determining region 3 for antibody 22262
QQDNSWPRT

SEQ ID NO: 44524 - protein, 19 aa, Homo sapiens
  heavy chain complementarity determining region 3 for antibody 22262
ATVALATINMKIVGEYFHH

SEQ ID NO: 44525 - protein, 9 aa, Homo sapiens
  light chain complementarity determining region 3 for antibody 22263
QQDNSFPFT

SEQ ID NO: 44526 - protein, 13 aa, Homo sapiens
  heavy chain complementarity determining region 3 for antibody 22263
AKDTSQMVTILDY

SEQ ID NO: 44527 - protein, 9 aa, Homo sapiens
  light chain complementarity determining region 3 for antibody 22264
QQDNSFPFT

SEQ ID NO: 44528 - protein, 13 aa, Homo sapiens
  heavy chain complementarity determining region 3 for antibody 22264
AKDSSQMVTILDY

SEQ ID NO: 44529 - protein, 9 aa, Homo sapiens
  light chain complementarity determining region 3 for antibody 22265
QQDNSFPFT

SEQ ID NO: 44530 - protein, 13 aa, Homo sapiens
  heavy chain complementarity determining region 3 for antibody 22265
AKDMSQMVTILDY

SEQ ID NO: 44531 - protein, 9 aa, Homo sapiens
  light chain complementarity determining region 3 for antibody 22266
QQDNRFPFT

SEQ ID NO: 44532 - protein, 13 aa, Homo sapiens
  heavy chain complementarity determining region 3 for antibody 22266
AKDISQMVTILDY

SEQ ID NO: 44533 - protein, 10 aa, Homo sapiens
  light chain complementarity determining region 3 for antibody 22267
QQDNNWPSWT

SEQ ID NO: 44534 - protein, 19 aa, Homo sapiens
  heavy chain complementarity determining region 3 for antibody 22267
ARDLGFGELPEGQYNWFDP

SEQ ID NO: 44535 - protein, 10 aa, Homo sapiens
  light chain complementarity determining region 3 for antibody 22268
QQDNNWPPVT

SEQ ID NO: 44536 - protein, 16 aa, Homo sapiens
  heavy chain complementarity determining region 3 for antibody 22268
TSERSTTWYVVEPFDI

SEQ ID NO: 44537 - protein, 10 aa, Homo sapiens
  light chain complementarity determining region 3 for antibody 22269
QQDNNWPPLT

SEQ ID NO: 44538 - protein, 12 aa, Homo sapiens
  heavy chain complementarity determining region 3 for antibody 22269
ARYGDYFLGWVY

SEQ ID NO: 44539 - protein, 10 aa, Homo sapiens
  light chain complementarity determining region 3 for antibody 22270
QQDNNWPAPS

SEQ ID NO: 44540 - protein, 14 aa, Homo sapiens
  heavy chain complementarity determining region 3 for antibody 22270
AHSPIRSLGELFDS

SEQ ID NO: 44541 - protein, 10 aa, Homo sapiens
  light chain complementarity determining region 3 for antibody 22271
QQDNNWLGWT

SEQ ID NO: 44542 - protein, 13 aa, Homo sapiens
  heavy chain complementarity determining region 3 for antibody 22271
ARHGRRSGWYYTY

SEQ ID NO: 44543 - protein, 9 aa, Homo sapiens
  light chain complementarity determining region 3 for antibody 22272
QQDHTFPFT

SEQ ID NO: 44544 - protein, 15 aa, Homo sapiens
  heavy chain complementarity determining region 3 for antibody 22272
ARCFSGGKSCGWFDP

SEQ ID NO: 44545 - protein, 9 aa, Homo sapiens
  light chain complementarity determining region 3 for antibody 22273
QQDHSFPPA

SEQ ID NO: 44546 - protein, 11 aa, Homo sapiens
  heavy chain complementarity determining region 3 for antibody 22273
VHSPAMAEIDY

SEQ ID NO: 44547 - protein, 10 aa, Homo sapiens
  light chain complementarity determining region 3 for antibody 22274
QQDHNWPPWT

SEQ ID NO: 44548 - protein, 21 aa, Homo sapiens
  heavy chain complementarity determining region 3 for antibody 22274
ARAGRGDDYGDYRTDPGWFEA

SEQ ID NO: 44549 - protein, 9 aa, Homo sapiens
  light chain complementarity determining region 3 for antibody 22275
QQDGYSARP

SEQ ID NO: 44550 - protein, 13 aa, Homo sapiens
  heavy chain complementarity determining region 3 for antibody 22275
ARGYFYSDGYIED

SEQ ID NO: 44551 - protein, 6 aa, Homo sapiens
  light chain complementarity determining region 3 for antibody 22276
QQDGTT

SEQ ID NO: 44552 - protein, 12 aa, Homo sapiens
  heavy chain complementarity determining region 3 for antibody 22276
ARDADAGYAQDC

SEQ ID NO: 44553 - protein, 10 aa, Homo sapiens
  light chain complementarity determining region 3 for antibody 22277
QQDGTSSMYT

SEQ ID NO: 44554 - protein, 9 aa, Homo sapiens
  heavy chain complementarity determining region 3 for antibody 22277
ARGAAGFDY

SEQ ID NO: 44555 - protein, 9 aa, Homo sapiens
  light chain complementarity determining region 3 for antibody 22278
QQDGTSPRT

SEQ ID NO: 44556 - protein, 13 aa, Homo sapiens
  heavy chain complementarity determining region 3 for antibody 22278
AGGYFDRSGYYDY

SEQ ID NO: 44557 - protein, 8 aa, Homo sapiens
  light chain complementarity determining region 3 for antibody 22279
QQDGTSLT

SEQ ID NO: 44558 - protein, 14 aa, Homo sapiens
  heavy chain complementarity determining region 3 for antibody 22279
ARAGSYYADWYFDL

SEQ ID NO: 44559 - protein, 9 aa, Homo sapiens
  light chain complementarity determining region 3 for antibody 22280
QQDGTPPRT

SEQ ID NO: 44560 - protein, 25 aa, Homo sapiens
  heavy chain complementarity determining region 3 for antibody 22280
ARRRVDRLRLPGAMRGPLYDRGLNV

SEQ ID NO: 44561 - protein, 9 aa, Homo sapiens
  light chain complementarity determining region 3 for antibody 22281
QQDGTPPRT

SEQ ID NO: 44562 - protein, 25 aa, Homo sapiens
  heavy chain complementarity determining region 3 for antibody 22281
ARLGVDRLRLPGAMRGPLYDRGLNV

SEQ ID NO: 44563 - protein, 9 aa, Homo sapiens
  light chain complementarity determining region 3 for antibody 22282
QQDGTKPRT

SEQ ID NO: 44564 - protein, 13 aa, Homo sapiens
  heavy chain complementarity determining region 3 for antibody 22282
AGGNFHRSGYAEY

SEQ ID NO: 44565 - protein, 9 aa, Homo sapiens
  light chain complementarity determining region 3 for antibody 22283
QQDGTIPRT

SEQ ID NO: 44566 - protein, 13 aa, Homo sapiens
  heavy chain complementarity determining region 3 for antibody 22283
AGGSFSGRNYKED

SEQ ID NO: 44567 - protein, 9 aa, Homo sapiens
  light chain complementarity determining region 3 for antibody 22284
QQDGTIPRT

SEQ ID NO: 44568 - protein, 13 aa, Homo sapiens
  heavy chain complementarity determining region 3 for antibody 22284
AGGNFHRSGYADY

SEQ ID NO: 44569 - protein, 9 aa, Homo sapiens
  light chain complementarity determining region 3 for antibody 22285
QQDGTIPRT

SEQ ID NO: 44570 - protein, 13 aa, Homo sapiens
  heavy chain complementarity determining region 3 for antibody 22285
AGGIFHSRGYGEY

SEQ ID NO: 44571 - protein, 9 aa, Homo sapiens
  light chain complementarity determining region 3 for antibody 22286
QQDGSVPHT

SEQ ID NO: 44572 - protein, 14 aa, Homo sapiens
  heavy chain complementarity determining region 3 for antibody 22286
ARGGGSDWYGLLYY

SEQ ID NO: 44573 - protein, 9 aa, Homo sapiens
  light chain complementarity determining region 3 for antibody 22287
QQDGSSPRT

SEQ ID NO: 44574 - protein, 18 aa, Homo sapiens
  heavy chain complementarity determining region 3 for antibody 22287
ATAFWVGLGVPPPGFFDY

SEQ ID NO: 44575 - protein, 9 aa, Homo sapiens
  light chain complementarity determining region 3 for antibody 22288
QQDGSSPRT

SEQ ID NO: 44576 - protein, 13 aa, Homo sapiens
  heavy chain complementarity determining region 3 for antibody 22288
ASGYFDRSGYYEY

SEQ ID NO: 44577 - protein, 9 aa, Homo sapiens
  light chain complementarity determining region 3 for antibody 22289
QQDGSSPRT

SEQ ID NO: 44578 - protein, 19 aa, Homo sapiens
  heavy chain complementarity determining region 3 for antibody 22289
ARPQGYDFRSGYSEHYFDY

SEQ ID NO: 44579 - protein, 9 aa, Homo sapiens
  light chain complementarity determining region 3 for antibody 22290
QQDGSSPRT

SEQ ID NO: 44580 - protein, 25 aa, Homo sapiens
  heavy chain complementarity determining region 3 for antibody 22290
ARLRIDRLRLPGAMRGPLYDCGLSV

SEQ ID NO: 44581 - protein, 9 aa, Homo sapiens
  light chain complementarity determining region 3 for antibody 22291
QQDGSSPRT

SEQ ID NO: 44582 - protein, 13 aa, Homo sapiens
  heavy chain complementarity determining region 3 for antibody 22291
ARGSGIFGGFFDY

SEQ ID NO: 44583 - protein, 9 aa, Homo sapiens
  light chain complementarity determining region 3 for antibody 22292
QQDGSSPRT

SEQ ID NO: 44584 - protein, 14 aa, Homo sapiens
  heavy chain complementarity determining region 3 for antibody 22292
AGGRFSSGSSYSDN

SEQ ID NO: 44585 - protein, 9 aa, Homo sapiens
  light chain complementarity determining region 3 for antibody 22293
QQDGSSPQT

SEQ ID NO: 44586 - protein, 14 aa, Homo sapiens
  heavy chain complementarity determining region 3 for antibody 22293
ARDNPHRLERYFDL

SEQ ID NO: 44587 - protein, 10 aa, Homo sapiens
  light chain complementarity determining region 3 for antibody 22294
QQDGSSPPYT

SEQ ID NO: 44588 - protein, 18 aa, Homo sapiens
  heavy chain complementarity determining region 3 for antibody 22294
ATGKWFGDFNFYYYAMDV

SEQ ID NO: 44589 - protein, 10 aa, Homo sapiens
  light chain complementarity determining region 3 for antibody 22295
QQDGSSPPVP

SEQ ID NO: 44590 - protein, 15 aa, Homo sapiens
  heavy chain complementarity determining region 3 for antibody 22295
AKGPMVRGVLGPFDY

SEQ ID NO: 44591 - protein, 9 aa, Homo sapiens
  light chain complementarity determining region 3 for antibody 22296
QQDGSSPLT

SEQ ID NO: 44592 - protein, 22 aa, Homo sapiens
  heavy chain complementarity determining region 3 for antibody 22296
ASQTEGYCTTTDCYGAHRPFDI

SEQ ID NO: 44593 - protein, 10 aa, Homo sapiens
  light chain complementarity determining region 3 for antibody 22297
QQDGSSPGYT

SEQ ID NO: 44594 - protein, 14 aa, Homo sapiens
  heavy chain complementarity determining region 3 for antibody 22297
ARGPAAAGPWYFDF

SEQ ID NO: 44595 - protein, 10 aa, Homo sapiens
  light chain complementarity determining region 3 for antibody 22298
QQDGSSPGDT

SEQ ID NO: 44596 - protein, 14 aa, Homo sapiens
  heavy chain complementarity determining region 3 for antibody 22298
ARGPAAAGPWYFDF

SEQ ID NO: 44597 - protein, 9 aa, Homo sapiens
  light chain complementarity determining region 3 for antibody 22299
QQDGSSLYT

SEQ ID NO: 44598 - protein, 24 aa, Homo sapiens
  heavy chain complementarity determining region 3 for antibody 22299
ARDRGVLLWFGELSPTAEDDAFDI

SEQ ID NO: 44599 - protein, 10 aa, Homo sapiens
  light chain complementarity determining region 3 for antibody 22300
QQDGSSLGIT

SEQ ID NO: 44600 - protein, 18 aa, Homo sapiens
  heavy chain complementarity determining region 3 for antibody 22300
AKDWGTGWYGRRPYYFDY

SEQ ID NO: 44601 - protein, 9 aa, Homo sapiens
  light chain complementarity determining region 3 for antibody 22301
QQDGSSHYT

SEQ ID NO: 44602 - protein, 11 aa, Homo sapiens
  heavy chain complementarity determining region 3 for antibody 22301
AKGGLRWPLDY

SEQ ID NO: 44603 - protein, 9 aa, Homo sapiens
  light chain complementarity determining region 3 for antibody 22302
QQDGSLPRT

SEQ ID NO: 44604 - protein, 14 aa, Homo sapiens
  heavy chain complementarity determining region 3 for antibody 22302
AGGDFCGGDCYSEY

SEQ ID NO: 44605 - protein, 9 aa, Homo sapiens
  light chain complementarity determining region 3 for antibody 22303
QQDGSIPRT

SEQ ID NO: 44606 - protein, 13 aa, Homo sapiens
  heavy chain complementarity determining region 3 for antibody 22303
AGGLFHSSGYSEF

SEQ ID NO: 44607 - protein, 9 aa, Homo sapiens
  light chain complementarity determining region 3 for antibody 22304
QQDGSIPRT

SEQ ID NO: 44608 - protein, 13 aa, Homo sapiens
  heavy chain complementarity determining region 3 for antibody 22304
AGGGFSSGRYSDY

SEQ ID NO: 44609 - protein, 9 aa, Homo sapiens
  light chain complementarity determining region 3 for antibody 22305
QQDGRSPQT

SEQ ID NO: 44610 - protein, 11 aa, Homo sapiens
  heavy chain complementarity determining region 3 for antibody 22305
ARGWIELWGDF

SEQ ID NO: 44611 - protein, 9 aa, Homo sapiens
  light chain complementarity determining region 3 for antibody 22306
QQDGRIPRS

SEQ ID NO: 44612 - protein, 13 aa, Homo sapiens
  heavy chain complementarity determining region 3 for antibody 22306
AGGTWHSSAYYES

SEQ ID NO: 44613 - protein, 9 aa, Homo sapiens
  light chain complementarity determining region 3 for antibody 22307
QQDGRIPRS

SEQ ID NO: 44614 - protein, 13 aa, Homo sapiens
  heavy chain complementarity determining region 3 for antibody 22307
AGGTWHSGIYYES

SEQ ID NO: 44615 - protein, 9 aa, Homo sapiens
  light chain complementarity determining region 3 for antibody 22308
QQDGNLPRT

SEQ ID NO: 44616 - protein, 12 aa, Homo sapiens
  heavy chain complementarity determining region 3 for antibody 22308
AREFPETCYFPN

SEQ ID NO: 44617 - protein, 9 aa, Homo sapiens
  light chain complementarity determining region 3 for antibody 22309
QQDGNLPRT

SEQ ID NO: 44618 - protein, 13 aa, Homo sapiens
  heavy chain complementarity determining region 3 for antibody 22309
AGGDFHRGGYSEY

SEQ ID NO: 44619 - protein, 9 aa, Homo sapiens
  light chain complementarity determining region 3 for antibody 22310
QQDGNLPRP

SEQ ID NO: 44620 - protein, 13 aa, Homo sapiens
  heavy chain complementarity determining region 3 for antibody 22310
AGGDFHSGGYSEF

SEQ ID NO: 44621 - protein, 8 aa, Homo sapiens
  light chain complementarity determining region 3 for antibody 22311
QQDGGSPS

SEQ ID NO: 44622 - protein, 16 aa, Homo sapiens
  heavy chain complementarity determining region 3 for antibody 22311
ATDWGSGTQWIRAFDV

SEQ ID NO: 44623 - protein, 9 aa, Homo sapiens
  light chain complementarity determining region 3 for antibody 22312
QQDGGSPHT

SEQ ID NO: 44624 - protein, 15 aa, Homo sapiens
  heavy chain complementarity determining region 3 for antibody 22312
ARESPIRGPWGYFDF

SEQ ID NO: 44625 - protein, 10 aa, Homo sapiens
  light chain complementarity determining region 3 for antibody 22313
QQDGDSPAYS

SEQ ID NO: 44626 - protein, 10 aa, Homo sapiens
  heavy chain complementarity determining region 3 for antibody 22313
VNSAGSYFEY

SEQ ID NO: 44627 - protein, 9 aa, Homo sapiens
  light chain complementarity determining region 3 for antibody 22314
QQDGATPRT

SEQ ID NO: 44628 - protein, 13 aa, Homo sapiens
  heavy chain complementarity determining region 3 for antibody 22314
ASGYGSGASYREN

SEQ ID NO: 44629 - protein, 8 aa, Homo sapiens
  light chain complementarity determining region 3 for antibody 22315
QQDENLGT

SEQ ID NO: 44630 - protein, 18 aa, Homo sapiens
  heavy chain complementarity determining region 3 for antibody 22315
AKGAEGSCSVRKCYPFDY

SEQ ID NO: 44631 - protein, 11 aa, Homo sapiens
  light chain complementarity determining region 3 for antibody 22316
QQDDTSPPGYT

SEQ ID NO: 44632 - protein, 14 aa, Homo sapiens
  heavy chain complementarity determining region 3 for antibody 22316
ARETSNSRKRSFDH

SEQ ID NO: 44633 - protein, 9 aa, Homo sapiens
  light chain complementarity determining region 3 for antibody 22317
QQDDSSPYT

SEQ ID NO: 44634 - protein, 19 aa, Homo sapiens
  heavy chain complementarity determining region 3 for antibody 22317
ARHYGIVSAAPKALNWFDP

SEQ ID NO: 44635 - protein, 9 aa, Homo sapiens
  light chain complementarity determining region 3 for antibody 22318
QQDDSSPQT

SEQ ID NO: 44636 - protein, 14 aa, Homo sapiens
  heavy chain complementarity determining region 3 for antibody 22318
ARDNPHRLERYFDL

SEQ ID NO: 44637 - protein, 9 aa, Homo sapiens
  light chain complementarity determining region 3 for antibody 22319
QQDDNLPYT

SEQ ID NO: 44638 - protein, 16 aa, Homo sapiens
  heavy chain complementarity determining region 3 for antibody 22319
ARSSGGYSSSWYYFDY

SEQ ID NO: 44639 - protein, 9 aa, Homo sapiens
  light chain complementarity determining region 3 for antibody 22320
QQDATSPRT

SEQ ID NO: 44640 - protein, 15 aa, Homo sapiens
  heavy chain complementarity determining region 3 for antibody 22320
ARDGNVLATGYPLDY

SEQ ID NO: 44641 - protein, 9 aa, Homo sapiens
  light chain complementarity determining region 3 for antibody 22321
QQCYTYPLT

SEQ ID NO: 44642 - protein, 12 aa, Homo sapiens
  heavy chain complementarity determining region 3 for antibody 22321
TRVLSSAIGEWD

SEQ ID NO: 44643 - protein, 9 aa, Homo sapiens
  light chain complementarity determining region 3 for antibody 22322
QQCYTTPRT

SEQ ID NO: 44644 - protein, 8 aa, Homo sapiens
  heavy chain complementarity determining region 3 for antibody 22322
ARDGAFDS

SEQ ID NO: 44645 - protein, 8 aa, Homo sapiens
  light chain complementarity determining region 3 for antibody 22323
QQCYSSPA

SEQ ID NO: 44646 - protein, 16 aa, Homo sapiens
  heavy chain complementarity determining region 3 for antibody 22323
ARAIYSSSRPERYFDY

SEQ ID NO: 44647 - protein, 9 aa, Homo sapiens
  light chain complementarity determining region 3 for antibody 22324
QQCYSRLPT

SEQ ID NO: 44648 - protein, 18 aa, Homo sapiens
  heavy chain complementarity determining region 3 for antibody 22324
ARGYGSGSYFNYYYGMDV

SEQ ID NO: 44649 - protein, 9 aa, Homo sapiens
  light chain complementarity determining region 3 for antibody 22325
QQCYINPRT

SEQ ID NO: 44650 - protein, 15 aa, Homo sapiens
  heavy chain complementarity determining region 3 for antibody 22325
ARLSSTVTRFDAFDI

SEQ ID NO: 44651 - protein, 9 aa, Homo sapiens
  light chain complementarity determining region 3 for antibody 22326
QQCSSSLFA

SEQ ID NO: 44652 - protein, 15 aa, Homo sapiens
  heavy chain complementarity determining region 3 for antibody 22326
ARGGKSSSWLSYFDS

SEQ ID NO: 44653 - protein, 9 aa, Homo sapiens
  light chain complementarity determining region 3 for antibody 22327
QQCNSYSRT

SEQ ID NO: 44654 - protein, 11 aa, Homo sapiens
  heavy chain complementarity determining region 3 for antibody 22327
ARNIRGGHTDF

SEQ ID NO: 44655 - protein, 9 aa, Homo sapiens
  light chain complementarity determining region 3 for antibody 22328
QQCNSYSGT

SEQ ID NO: 44656 - protein, 11 aa, Homo sapiens
  heavy chain complementarity determining region 3 for antibody 22328
ARNILGGHTDF

SEQ ID NO: 44657 - protein, 9 aa, Homo sapiens
  light chain complementarity determining region 3 for antibody 22329
QQCNIYPYT

SEQ ID NO: 44658 - protein, 12 aa, Homo sapiens
  heavy chain complementarity determining region 3 for antibody 22329
VREARQGDVKCH

SEQ ID NO: 44659 - protein, 9 aa, Homo sapiens
  light chain complementarity determining region 3 for antibody 22330
QQCLVSPST

SEQ ID NO: 44660 - protein, 15 aa, Homo sapiens
  heavy chain complementarity determining region 3 for antibody 22330
AREKKGSKAVRAFDI

SEQ ID NO: 44661 - protein, 9 aa, Homo sapiens
  light chain complementarity determining region 3 for antibody 22331
QQCHRTPNT

SEQ ID NO: 44662 - protein, 14 aa, Homo sapiens
  heavy chain complementarity determining region 3 for antibody 22331
ATVSGSTWLRSFDV

SEQ ID NO: 44663 - protein, 9 aa, Homo sapiens
  light chain complementarity determining region 3 for antibody 22332
QQCGTLPQT

SEQ ID NO: 44664 - protein, 18 aa, Homo sapiens
  heavy chain complementarity determining region 3 for antibody 22332
ARDYYGSGREIWVGAFDI

SEQ ID NO: 44665 - protein, 9 aa, Homo sapiens
  light chain complementarity determining region 3 for antibody 22333
QQCGSSLYT

SEQ ID NO: 44666 - protein, 16 aa, Homo sapiens
  heavy chain complementarity determining region 3 for antibody 22333
ARAKHYGDYYYYGMDA

SEQ ID NO: 44667 - protein, 9 aa, Homo sapiens
  light chain complementarity determining region 3 for antibody 22334
QQCGGSPRT

SEQ ID NO: 44668 - protein, 13 aa, Homo sapiens
  heavy chain complementarity determining region 3 for antibody 22334
ASGYFDSGAYYEF

SEQ ID NO: 44669 - protein, 10 aa, Homo sapiens
  light chain complementarity determining region 3 for antibody 22335
QQCFSTPGDT

SEQ ID NO: 44670 - protein, 11 aa, Homo sapiens
  heavy chain complementarity determining region 3 for antibody 22335
AKTYNSGWFDY

SEQ ID NO: 44671 - protein, 10 aa, Homo sapiens
  light chain complementarity determining region 3 for antibody 22336
QQCFSPPGYT

SEQ ID NO: 44672 - protein, 11 aa, Homo sapiens
  heavy chain complementarity determining region 3 for antibody 22336
AKTYNSGWFDY

SEQ ID NO: 44673 - protein, 8 aa, Homo sapiens
  light chain complementarity determining region 3 for antibody 22337
QQCENLGT

SEQ ID NO: 44674 - protein, 18 aa, Homo sapiens
  heavy chain complementarity determining region 3 for antibody 22337
AKGAEGSCSVRKCYPFDY

SEQ ID NO: 44675 - protein, 9 aa, Homo sapiens
  light chain complementarity determining region 3 for antibody 22338
QQAYVSSYT

SEQ ID NO: 44676 - protein, 19 aa, Homo sapiens
  heavy chain complementarity determining region 3 for antibody 22338
ARDGPGGYGSASYGDDFDY

SEQ ID NO: 44677 - protein, 9 aa, Homo sapiens
  light chain complementarity determining region 3 for antibody 22339
QQAVGPPIT

SEQ ID NO: 44678 - protein, 11 aa, Homo sapiens
  heavy chain complementarity determining region 3 for antibody 22339
ARFFVVGANAA

SEQ ID NO: 44679 - protein, 9 aa, Homo sapiens
  light chain complementarity determining region 3 for antibody 22340
QQATTSPRT

SEQ ID NO: 44680 - protein, 13 aa, Homo sapiens
  heavy chain complementarity determining region 3 for antibody 22340
GKGYEYAPRIYDY

SEQ ID NO: 44681 - protein, 9 aa, Homo sapiens
  light chain complementarity determining region 3 for antibody 22341
QQASSFPVT

SEQ ID NO: 44682 - protein, 20 aa, Homo sapiens
  heavy chain complementarity determining region 3 for antibody 22341
VKDTIPYDSRGYYRRHFFDY

SEQ ID NO: 44683 - protein, 9 aa, Homo sapiens
  light chain complementarity determining region 3 for antibody 22342
QQAPTFPFT

SEQ ID NO: 44684 - protein, 15 aa, Homo sapiens
  heavy chain complementarity determining region 3 for antibody 22342
ARCFSGGKSCGWFDP

SEQ ID NO: 44685 - protein, 9 aa, Homo sapiens
  light chain complementarity determining region 3 for antibody 22343
QQANSYPWT

SEQ ID NO: 44686 - protein, 13 aa, Homo sapiens
  heavy chain complementarity determining region 3 for antibody 22343
ARESGSGQGQFDY

SEQ ID NO: 44687 - protein, 9 aa, Homo sapiens
  light chain complementarity determining region 3 for antibody 22344
QQANSYPWT

SEQ ID NO: 44688 - protein, 13 aa, Homo sapiens
  heavy chain complementarity determining region 3 for antibody 22344
ARESDSGQGHFDY

SEQ ID NO: 44689 - protein, 9 aa, Homo sapiens
  light chain complementarity determining region 3 for antibody 22345
QQANSYPIT

SEQ ID NO: 44690 - protein, 13 aa, Homo sapiens
  heavy chain complementarity determining region 3 for antibody 22345
ARDRFPYGNWYDP

SEQ ID NO: 44691 - protein, 9 aa, Homo sapiens
  light chain complementarity determining region 3 for antibody 22346
QQANSYPIT

SEQ ID NO: 44692 - protein, 13 aa, Homo sapiens
  heavy chain complementarity determining region 3 for antibody 22346
AGDRFTYGNWYDP

SEQ ID NO: 44693 - protein, 9 aa, Homo sapiens
  light chain complementarity determining region 3 for antibody 22347
QQANSVLLT

SEQ ID NO: 44694 - protein, 21 aa, Homo sapiens
  heavy chain complementarity determining region 3 for antibody 22347
AKGNIPSGRYSRHRAKDGFDA

SEQ ID NO: 44695 - protein, 9 aa, Homo sapiens
  light chain complementarity determining region 3 for antibody 22348
QQANSFPVT

SEQ ID NO: 44696 - protein, 20 aa, Homo sapiens
  heavy chain complementarity determining region 3 for antibody 22348
VKDTIPYDSRGYSRRHFFDY

SEQ ID NO: 44697 - protein, 9 aa, Homo sapiens
  light chain complementarity determining region 3 for antibody 22349
QQANSFPVT

SEQ ID NO: 44698 - protein, 20 aa, Homo sapiens
  heavy chain complementarity determining region 3 for antibody 22349
VKATIPYDSRGYYRRHFFDY

SEQ ID NO: 44699 - protein, 9 aa, Homo sapiens
  light chain complementarity determining region 3 for antibody 22350
QQANSFPLT

SEQ ID NO: 44700 - protein, 15 aa, Homo sapiens
  heavy chain complementarity determining region 3 for antibody 22350
ARVALAVAGNNWFDP

SEQ ID NO: 44701 - protein, 10 aa, Homo sapiens
  light chain complementarity determining region 3 for antibody 22351
QQANNWPPWT

SEQ ID NO: 44702 - protein, 11 aa, Homo sapiens
  heavy chain complementarity determining region 3 for antibody 22351
AASGSHYKFDY

SEQ ID NO: 44703 - protein, 9 aa, Homo sapiens
  light chain complementarity determining region 3 for antibody 22352
QQAHTFPFT

SEQ ID NO: 44704 - protein, 15 aa, Homo sapiens
  heavy chain complementarity determining region 3 for antibody 22352
ARCFAGGKSCGWFDP

SEQ ID NO: 44705 - protein, 9 aa, Homo sapiens
  light chain complementarity determining region 3 for antibody 22353
QQAHSFPYT

SEQ ID NO: 44706 - protein, 20 aa, Homo sapiens
  heavy chain complementarity determining region 3 for antibody 22353
ARTTYYYDRSGLSLFYKCDY

SEQ ID NO: 44707 - protein, 9 aa, Homo sapiens
  light chain complementarity determining region 3 for antibody 22354
QQAHSFPLS

SEQ ID NO: 44708 - protein, 11 aa, Homo sapiens
  heavy chain complementarity determining region 3 for antibody 22354
VHSPAMAEIDY

SEQ ID NO: 44709 - protein, 9 aa, Homo sapiens
  light chain complementarity determining region 3 for antibody 22355
QQAHSFPLA

SEQ ID NO: 44710 - protein, 11 aa, Homo sapiens
  heavy chain complementarity determining region 3 for antibody 22355
VPSPAMAEIDY

SEQ ID NO: 44711 - protein, 9 aa, Homo sapiens
  light chain complementarity determining region 3 for antibody 22356
QQAHSFPLA

SEQ ID NO: 44712 - protein, 11 aa, Homo sapiens
  heavy chain complementarity determining region 3 for antibody 22356
VHSPAMAEIDF

SEQ ID NO: 44713 - protein, 9 aa, Homo sapiens
  light chain complementarity determining region 3 for antibody 22357
QQAHSFPLA

SEQ ID NO: 44714 - protein, 11 aa, Homo sapiens
  heavy chain complementarity determining region 3 for antibody 22357
VHSLAMAEIDH

SEQ ID NO: 44715 - protein, 9 aa, Homo sapiens
  light chain complementarity determining region 3 for antibody 22358
QQAGGAPST

SEQ ID NO: 44716 - protein, 13 aa, Homo sapiens
  heavy chain complementarity determining region 3 for antibody 22358
ARDWYNSNWSMDV

SEQ ID NO: 44717 - protein, 9 aa, Homo sapiens
  light chain complementarity determining region 3 for antibody 22359
QQADSKPFT

SEQ ID NO: 44718 - protein, 14 aa, Homo sapiens
  heavy chain complementarity determining region 3 for antibody 22359
ARDNSNNWYEGMDV

SEQ ID NO: 44719 - protein, 9 aa, Homo sapiens
  light chain complementarity determining region 3 for antibody 22360
QQADSFPPT

SEQ ID NO: 44720 - protein, 20 aa, Homo sapiens
  heavy chain complementarity determining region 3 for antibody 22360
ARDPSNCISPSCRGGSTVDY

SEQ ID NO: 44721 - protein, 9 aa, Homo sapiens
  light chain complementarity determining region 3 for antibody 22361
QQADSFPPP

SEQ ID NO: 44722 - protein, 20 aa, Homo sapiens
  heavy chain complementarity determining region 3 for antibody 22361
ARDPSNCISTSCRGGSTVDY

SEQ ID NO: 44723 - protein, 9 aa, Homo sapiens
  light chain complementarity determining region 3 for antibody 22362
QQADSFPFT

SEQ ID NO: 44724 - protein, 12 aa, Homo sapiens
  heavy chain complementarity determining region 3 for antibody 22362
AKGGRLWLSFDP

SEQ ID NO: 44725 - protein, 9 aa, Homo sapiens
  light chain complementarity determining region 3 for antibody 22363
QQADSCPFT

SEQ ID NO: 44726 - protein, 12 aa, Homo sapiens
  heavy chain complementarity determining region 3 for antibody 22363
AKGGSLWLSFDP

SEQ ID NO: 44727 - protein, 9 aa, Homo sapiens
  light chain complementarity determining region 3 for antibody 22364
QPYYTTPWT

SEQ ID NO: 44728 - protein, 14 aa, Homo sapiens
  heavy chain complementarity determining region 3 for antibody 22364
ARPAQIYSSSWVDY

SEQ ID NO: 44729 - protein, 8 aa, Homo sapiens
  light chain complementarity determining region 3 for antibody 22365
QPYYTSWT

SEQ ID NO: 44730 - protein, 15 aa, Homo sapiens
  heavy chain complementarity determining region 3 for antibody 22365
ARAMTPKWELAFYDY

SEQ ID NO: 44731 - protein, 9 aa, Homo sapiens
  light chain complementarity determining region 3 for antibody 22366
QPYYSTPRA

SEQ ID NO: 44732 - protein, 13 aa, Homo sapiens
  heavy chain complementarity determining region 3 for antibody 22366
AAVDPYYYYGMDV

SEQ ID NO: 44733 - protein, 10 aa, Homo sapiens
  light chain complementarity determining region 3 for antibody 22367
QPYYSTPPYT

SEQ ID NO: 44734 - protein, 16 aa, Homo sapiens
  heavy chain complementarity determining region 3 for antibody 22367
VGDISLAMSSRRGFVY

SEQ ID NO: 44735 - protein, 9 aa, Homo sapiens
  light chain complementarity determining region 3 for antibody 22368
QPYYNNPPV

SEQ ID NO: 44736 - protein, 15 aa, Homo sapiens
  heavy chain complementarity determining region 3 for antibody 22368
ARAGRCGGDCFSLDY

SEQ ID NO: 44737 - protein, 10 aa, Homo sapiens
  light chain complementarity determining region 3 for antibody 22369
QPYTNWPPLT

SEQ ID NO: 44738 - protein, 17 aa, Homo sapiens
  heavy chain complementarity determining region 3 for antibody 22369
AKDLRPFYDIFAGYLDM

SEQ ID NO: 44739 - protein, 10 aa, Homo sapiens
  light chain complementarity determining region 3 for antibody 22370
QPYSRSPPIT

SEQ ID NO: 44740 - protein, 20 aa, Homo sapiens
  heavy chain complementarity determining region 3 for antibody 22370
ARDAADVEIVPAARLFAMDV

SEQ ID NO: 44741 - protein, 10 aa, Homo sapiens
  light chain complementarity determining region 3 for antibody 22371
QPYNNWLGWT

SEQ ID NO: 44742 - protein, 13 aa, Homo sapiens
  heavy chain complementarity determining region 3 for antibody 22371
ARHGRRSGWYYTY

SEQ ID NO: 44743 - protein, 9 aa, Homo sapiens
  light chain complementarity determining region 3 for antibody 22372
QPYNLNSET

SEQ ID NO: 44744 - protein, 8 aa, Homo sapiens
  heavy chain complementarity determining region 3 for antibody 22372
VTSPSRNY

SEQ ID NO: 44745 - protein, 10 aa, Homo sapiens
  light chain complementarity determining region 3 for antibody 22373
QPYHSYSPAT

SEQ ID NO: 44746 - protein, 19 aa, Homo sapiens
  heavy chain complementarity determining region 3 for antibody 22373
ARESEYYFDKSGYLRPFDF

SEQ ID NO: 44747 - protein, 9 aa, Homo sapiens
  light chain complementarity determining region 3 for antibody 22374
QPYHSTPPT

SEQ ID NO: 44748 - protein, 20 aa, Homo sapiens
  heavy chain complementarity determining region 3 for antibody 22374
ARARSKTTVVTPTRQFASDI

SEQ ID NO: 44749 - protein, 10 aa, Homo sapiens
  light chain complementarity determining region 3 for antibody 22375
QPYHNWPPWT

SEQ ID NO: 44750 - protein, 13 aa, Homo sapiens
  heavy chain complementarity determining region 3 for antibody 22375
AKGRVRELYYFDT

SEQ ID NO: 44751 - protein, 9 aa, Homo sapiens
  light chain complementarity determining region 3 for antibody 22376
QPYGSSPRT

SEQ ID NO: 44752 - protein, 17 aa, Homo sapiens
  heavy chain complementarity determining region 3 for antibody 22376
TTDPQWLEPPPFLTNDY

SEQ ID NO: 44753 - protein, 9 aa, Homo sapiens
  light chain complementarity determining region 3 for antibody 22377
QPYGSSPRT

SEQ ID NO: 44754 - protein, 14 aa, Homo sapiens
  heavy chain complementarity determining region 3 for antibody 22377
AGGRFSSGSSYSEN

SEQ ID NO: 44755 - protein, 10 aa, Homo sapiens
  light chain complementarity determining region 3 for antibody 22378
QPYGSSPPYT

SEQ ID NO: 44756 - protein, 18 aa, Homo sapiens
  heavy chain complementarity determining region 3 for antibody 22378
ATGKWFGDFNFYYYAMDV

SEQ ID NO: 44757 - protein, 10 aa, Homo sapiens
  light chain complementarity determining region 3 for antibody 22379
QPYGSSPPVT

SEQ ID NO: 44758 - protein, 15 aa, Homo sapiens
  heavy chain complementarity determining region 3 for antibody 22379
AKGPMVRGVLGPFDY

SEQ ID NO: 44759 - protein, 9 aa, Homo sapiens
  light chain complementarity determining region 3 for antibody 22380
QPYGSSLWT

SEQ ID NO: 44760 - protein, 13 aa, Homo sapiens
  heavy chain complementarity determining region 3 for antibody 22380
ARKFLGYDHVLDV

SEQ ID NO: 44761 - protein, 9 aa, Homo sapiens
  light chain complementarity determining region 3 for antibody 22381
QPYGSLPRT

SEQ ID NO: 44762 - protein, 25 aa, Homo sapiens
  heavy chain complementarity determining region 3 for antibody 22381
ARLRIDRLRLPGAMRGPLYDCGLNV

SEQ ID NO: 44763 - protein, 9 aa, Homo sapiens
  light chain complementarity determining region 3 for antibody 22382
QPYGSIPRT

SEQ ID NO: 44764 - protein, 13 aa, Homo sapiens
  heavy chain complementarity determining region 3 for antibody 22382
AGGSFSGGNYKED

SEQ ID NO: 44765 - protein, 9 aa, Homo sapiens
  light chain complementarity determining region 3 for antibody 22383
QPYGSIPRT

SEQ ID NO: 44766 - protein, 13 aa, Homo sapiens
  heavy chain complementarity determining region 3 for antibody 22383
AGGGFSSGRYSEY

SEQ ID NO: 44767 - protein, 9 aa, Homo sapiens
  light chain complementarity determining region 3 for antibody 22384
QPYGRIPLT

SEQ ID NO: 44768 - protein, 7 aa, Homo sapiens
  heavy chain complementarity determining region 3 for antibody 22384
HGYELKC

SEQ ID NO: 44769 - protein, 9 aa, Homo sapiens
  light chain complementarity determining region 3 for antibody 22385
QPYGNSPRT

SEQ ID NO: 44770 - protein, 13 aa, Homo sapiens
  heavy chain complementarity determining region 3 for antibody 22385
AGGHYDSGDYREY

SEQ ID NO: 44771 - protein, 9 aa, Homo sapiens
  light chain complementarity determining region 3 for antibody 22386
QPYGNLPRT

SEQ ID NO: 44772 - protein, 13 aa, Homo sapiens
  heavy chain complementarity determining region 3 for antibody 22386
ARGQYERSGYKEN

SEQ ID NO: 44773 - protein, 8 aa, Homo sapiens
  light chain complementarity determining region 3 for antibody 22387
QPYENLVT

SEQ ID NO: 44774 - protein, 18 aa, Homo sapiens
  heavy chain complementarity determining region 3 for antibody 22387
AKGAEGSCSVRKCYPFDY

SEQ ID NO: 44775 - protein, 9 aa, Homo sapiens
  light chain complementarity determining region 3 for antibody 22388
QPYDVSTLT

SEQ ID NO: 44776 - protein, 22 aa, Homo sapiens
  heavy chain complementarity determining region 3 for antibody 22388
ARGSRPYGIYAYPLIPYSFFDD

SEQ ID NO: 44777 - protein, 9 aa, Homo sapiens
  light chain complementarity determining region 3 for antibody 22389
QPYAGSPWT

SEQ ID NO: 44778 - protein, 12 aa, Homo sapiens
  heavy chain complementarity determining region 3 for antibody 22389
VRSHYNTGRVDY

SEQ ID NO: 44779 - protein, 9 aa, Homo sapiens
  light chain complementarity determining region 3 for antibody 22390
QPVHIYPPT

SEQ ID NO: 44780 - protein, 12 aa, Homo sapiens
  heavy chain complementarity determining region 3 for antibody 22390
ARDTDGSFGLDV

SEQ ID NO: 44781 - protein, 9 aa, Homo sapiens
  light chain complementarity determining region 3 for antibody 22391
QPTYTSPPT

SEQ ID NO: 44782 - protein, 13 aa, Homo sapiens
  heavy chain complementarity determining region 3 for antibody 22391
ARRYYDSSDYFDI

SEQ ID NO: 44783 - protein, 9 aa, Homo sapiens
  light chain complementarity determining region 3 for antibody 22392
QPTHTFPRT

SEQ ID NO: 44784 - protein, 20 aa, Homo sapiens
  heavy chain complementarity determining region 3 for antibody 22392
ARGRRIAALSTAHYYYGMDV

SEQ ID NO: 44785 - protein, 9 aa, Homo sapiens
  light chain complementarity determining region 3 for antibody 22393
QPSYTSPIT

SEQ ID NO: 44786 - protein, 16 aa, Homo sapiens
  heavy chain complementarity determining region 3 for antibody 22393
ARESGGGSPRHNYFDP

SEQ ID NO: 44787 - protein, 9 aa, Homo sapiens
  light chain complementarity determining region 3 for antibody 22394
QPSYSTPYT

SEQ ID NO: 44788 - protein, 17 aa, Homo sapiens
  heavy chain complementarity determining region 3 for antibody 22394
AKGRRDAAMVRGLWFDP

SEQ ID NO: 44789 - protein, 9 aa, Homo sapiens
  light chain complementarity determining region 3 for antibody 22395
QPSYSTPHT

SEQ ID NO: 44790 - protein, 17 aa, Homo sapiens
  heavy chain complementarity determining region 3 for antibody 22395
ASLSYTWNYTPGAYFDY

SEQ ID NO: 44791 - protein, 9 aa, Homo sapiens
  light chain complementarity determining region 3 for antibody 22396
QPSYSSLLT

SEQ ID NO: 44792 - protein, 16 aa, Homo sapiens
  heavy chain complementarity determining region 3 for antibody 22396
AREGGSTYTSKRAFDS

SEQ ID NO: 44793 - protein, 9 aa, Homo sapiens
  light chain complementarity determining region 3 for antibody 22397
QPSHSRPFT

SEQ ID NO: 44794 - protein, 20 aa, Homo sapiens
  heavy chain complementarity determining region 3 for antibody 22397
AKGVSVAALRTVYYYYGLDV

SEQ ID NO: 44795 - protein, 9 aa, Homo sapiens
  light chain complementarity determining region 3 for antibody 22398
QPSGSIPRS

SEQ ID NO: 44796 - protein, 13 aa, Homo sapiens
  heavy chain complementarity determining region 3 for antibody 22398
AGGTWHSGIYYES

SEQ ID NO: 44797 - protein, 9 aa, Homo sapiens
  light chain complementarity determining region 3 for antibody 22399
QPRTNWRFT

SEQ ID NO: 44798 - protein, 16 aa, Homo sapiens
  heavy chain complementarity determining region 3 for antibody 22399
ARDQGYCLGTNCYLLH

SEQ ID NO: 44799 - protein, 9 aa, Homo sapiens
  light chain complementarity determining region 3 for antibody 22400
QPRSSWPYT

SEQ ID NO: 44800 - protein, 11 aa, Homo sapiens
  heavy chain complementarity determining region 3 for antibody 22400
VKRWGGSSIDY

SEQ ID NO: 44801 - protein, 9 aa, Homo sapiens
  light chain complementarity determining region 3 for antibody 22401
QPRSNWPFT

SEQ ID NO: 44802 - protein, 14 aa, Homo sapiens
  heavy chain complementarity determining region 3 for antibody 22401
ARSLSSAWYDWSDP

SEQ ID NO: 44803 - protein, 10 aa, Homo sapiens
  light chain complementarity determining region 3 for antibody 22402
QPRSDWPPLT

SEQ ID NO: 44804 - protein, 10 aa, Homo sapiens
  heavy chain complementarity determining region 3 for antibody 22402
ARDYTMTFDY

SEQ ID NO: 44805 - protein, 9 aa, Homo sapiens
  light chain complementarity determining region 3 for antibody 22403
QPLNTYPIT

SEQ ID NO: 44806 - protein, 13 aa, Homo sapiens
  heavy chain complementarity determining region 3 for antibody 22403
AKTLTMVTTYGDY

SEQ ID NO: 44807 - protein, 8 aa, Homo sapiens
  light chain complementarity determining region 3 for antibody 22404
QPICTTRT

SEQ ID NO: 44808 - protein, 18 aa, Homo sapiens
  heavy chain complementarity determining region 3 for antibody 22404
ARERGYCSGGSCYPRPLN

SEQ ID NO: 44809 - protein, 9 aa, Homo sapiens
  light chain complementarity determining region 3 for antibody 22405
QPHNSWPRT

SEQ ID NO: 44810 - protein, 14 aa, Homo sapiens
  heavy chain complementarity determining region 3 for antibody 22405
ARGGDYEYPDVFDI

SEQ ID NO: 44811 - protein, 9 aa, Homo sapiens
  light chain complementarity determining region 3 for antibody 22406
QPFYTYPLT

SEQ ID NO: 44812 - protein, 12 aa, Homo sapiens
  heavy chain complementarity determining region 3 for antibody 22406
TRVLSSAIGEWD

SEQ ID NO: 44813 - protein, 9 aa, Homo sapiens
  light chain complementarity determining region 3 for antibody 22407
QPFNDWPRT

SEQ ID NO: 44814 - protein, 15 aa, Homo sapiens
  heavy chain complementarity determining region 3 for antibody 22407
TTDTVSGYYTYYFDS

SEQ ID NO: 44815 - protein, 10 aa, Homo sapiens
  light chain complementarity determining region 3 for antibody 22408
QPFGSSPEIT

SEQ ID NO: 44816 - protein, 13 aa, Homo sapiens
  heavy chain complementarity determining region 3 for antibody 22408
VRGARRGRYDFDY

SEQ ID NO: 44817 - protein, 9 aa, Homo sapiens
  light chain complementarity determining region 3 for antibody 22409
QPFDNSGYT

SEQ ID NO: 44818 - protein, 13 aa, Homo sapiens
  heavy chain complementarity determining region 3 for antibody 22409
VRERHPGAFYFDF

SEQ ID NO: 44819 - protein, 10 aa, Homo sapiens
  light chain complementarity determining region 3 for antibody 22410
QPDNQWPPLT

SEQ ID NO: 44820 - protein, 17 aa, Homo sapiens
  heavy chain complementarity determining region 3 for antibody 22410
ARDLYFSIIQGGGAFDA

SEQ ID NO: 44821 - protein, 9 aa, Homo sapiens
  light chain complementarity determining region 3 for antibody 22411
QPASGFPYT

SEQ ID NO: 44822 - protein, 19 aa, Homo sapiens
  heavy chain complementarity determining region 3 for antibody 22411
ARDDFGDYEGGTGINWFDP

SEQ ID NO: 44823 - protein, 8 aa, Homo sapiens
  light chain complementarity determining region 3 for antibody 22412
QNYSTALT

SEQ ID NO: 44824 - protein, 12 aa, Homo sapiens
  heavy chain complementarity determining region 3 for antibody 22412
ARGRVVFHTIDS

SEQ ID NO: 44825 - protein, 8 aa, Homo sapiens
  light chain complementarity determining region 3 for antibody 22413
QNYGYSPT

SEQ ID NO: 44826 - protein, 9 aa, Homo sapiens
  heavy chain complementarity determining region 3 for antibody 22413
ARGYDAFDI

SEQ ID NO: 44827 - protein, 9 aa, Homo sapiens
  light chain complementarity determining region 3 for antibody 22414
QNYDTAPVT

SEQ ID NO: 44828 - protein, 9 aa, Homo sapiens
  heavy chain complementarity determining region 3 for antibody 22414
AAFGGWLAS

SEQ ID NO: 44829 - protein, 9 aa, Homo sapiens
  light chain complementarity determining region 3 for antibody 22415
QNYDGPPLT

SEQ ID NO: 44830 - protein, 21 aa, Homo sapiens
  heavy chain complementarity determining region 3 for antibody 22415
AKDLYHLNAVRPSDQAGGLDF

SEQ ID NO: 44831 - protein, 9 aa, Homo sapiens
  light chain complementarity determining region 3 for antibody 22416
QNYDGPPLT

SEQ ID NO: 44832 - protein, 21 aa, Homo sapiens
  heavy chain complementarity determining region 3 for antibody 22416
AKDLCHLNTVRPSDQAGGLDF

SEQ ID NO: 44833 - protein, 9 aa, Homo sapiens
  light chain complementarity determining region 3 for antibody 22417
QNYDGPPFT

SEQ ID NO: 44834 - protein, 21 aa, Homo sapiens
  heavy chain complementarity determining region 3 for antibody 22417
AKDLYHLNTVRPSDQAGGLDF

SEQ ID NO: 44835 - protein, 9 aa, Homo sapiens
  light chain complementarity determining region 3 for antibody 22418
QLYNTYPWT

SEQ ID NO: 44836 - protein, 10 aa, Homo sapiens
  heavy chain complementarity determining region 3 for antibody 22418
VRMNWELAGV

SEQ ID NO: 44837 - protein, 9 aa, Homo sapiens
  light chain complementarity determining region 3 for antibody 22419
QLYNTYPWT

SEQ ID NO: 44838 - protein, 10 aa, Homo sapiens
  heavy chain complementarity determining region 3 for antibody 22419
VNMNWELAGV

SEQ ID NO: 44839 - protein, 9 aa, Homo sapiens
  light chain complementarity determining region 3 for antibody 22420
QLYNTYPWT

SEQ ID NO: 44840 - protein, 10 aa, Homo sapiens
  heavy chain complementarity determining region 3 for antibody 22420
VKMNWEFAGV

SEQ ID NO: 44841 - protein, 9 aa, Homo sapiens
  light chain complementarity determining region 3 for antibody 22421
QLYNTYPWK

SEQ ID NO: 44842 - protein, 10 aa, Homo sapiens
  heavy chain complementarity determining region 3 for antibody 22421
VKMNWELAGV

SEQ ID NO: 44843 - protein, 10 aa, Homo sapiens
  light chain complementarity determining region 3 for antibody 22422
QLYNNWPPLT

SEQ ID NO: 44844 - protein, 12 aa, Homo sapiens
  heavy chain complementarity determining region 3 for antibody 22422
ARYGDYFLGWVY

SEQ ID NO: 44845 - protein, 9 aa, Homo sapiens
  light chain complementarity determining region 3 for antibody 22423
QLYGTPPRT

SEQ ID NO: 44846 - protein, 25 aa, Homo sapiens
  heavy chain complementarity determining region 3 for antibody 22423
ARLRVDRLRLPGAMRGPLYDRGLNV

SEQ ID NO: 44847 - protein, 10 aa, Homo sapiens
  light chain complementarity determining region 3 for antibody 22424
QLYGSSPTWR

SEQ ID NO: 44848 - protein, 9 aa, Homo sapiens
  heavy chain complementarity determining region 3 for antibody 22424
ATGGELLGY

SEQ ID NO: 44849 - protein, 10 aa, Homo sapiens
  light chain complementarity determining region 3 for antibody 22425
QLYGSSPTCT

SEQ ID NO: 44850 - protein, 9 aa, Homo sapiens
  heavy chain complementarity determining region 3 for antibody 22425
ATGGELLGY

SEQ ID NO: 44851 - protein, 10 aa, Homo sapiens
  light chain complementarity determining region 3 for antibody 22426
QLYGSSPSWT

SEQ ID NO: 44852 - protein, 9 aa, Homo sapiens
  heavy chain complementarity determining region 3 for antibody 22426
ATGGELLGY

SEQ ID NO: 44853 - protein, 10 aa, Homo sapiens
  light chain complementarity determining region 3 for antibody 22427
QLYGSSPPWT

SEQ ID NO: 44854 - protein, 9 aa, Homo sapiens
  heavy chain complementarity determining region 3 for antibody 22427
ATGGELLGY

SEQ ID NO: 44855 - protein, 10 aa, Homo sapiens
  light chain complementarity determining region 3 for antibody 22428
QLYGSSPPWR

SEQ ID NO: 44856 - protein, 9 aa, Homo sapiens
  heavy chain complementarity determining region 3 for antibody 22428
ATGGELLGY

SEQ ID NO: 44857 - protein, 10 aa, Homo sapiens
  light chain complementarity determining region 3 for antibody 22429
QLYGSSPPVT

SEQ ID NO: 44858 - protein, 15 aa, Homo sapiens
  heavy chain complementarity determining region 3 for antibody 22429
AKGPMVRGVLGPFDY

SEQ ID NO: 44859 - protein, 10 aa, Homo sapiens
  light chain complementarity determining region 3 for antibody 22430
QLYGDSPAYS

SEQ ID NO: 44860 - protein, 10 aa, Homo sapiens
  heavy chain complementarity determining region 3 for antibody 22430
VNSAGSYFEY

SEQ ID NO: 44861 - protein, 11 aa, Homo sapiens
  light chain complementarity determining region 3 for antibody 22431
QLYETSPPVYT

SEQ ID NO: 44862 - protein, 14 aa, Homo sapiens
  heavy chain complementarity determining region 3 for antibody 22431
ARENSISRKRSFDQ

SEQ ID NO: 44863 - protein, 11 aa, Homo sapiens
  light chain complementarity determining region 3 for antibody 22432
QLYETSPPGYT

SEQ ID NO: 44864 - protein, 14 aa, Homo sapiens
  heavy chain complementarity determining region 3 for antibody 22432
ARESSISRKRSFDQ

SEQ ID NO: 44865 - protein, 11 aa, Homo sapiens
  light chain complementarity determining region 3 for antibody 22433
QLYETSPPGYA

SEQ ID NO: 44866 - protein, 14 aa, Homo sapiens
  heavy chain complementarity determining region 3 for antibody 22433
ARENSISRKRSFDQ

SEQ ID NO: 44867 - protein, 11 aa, Homo sapiens
  light chain complementarity determining region 3 for antibody 22434
QLYETSPPGTP

SEQ ID NO: 44868 - protein, 14 aa, Homo sapiens
  heavy chain complementarity determining region 3 for antibody 22434
ARENSISRKRSFDQ

SEQ ID NO: 44869 - protein, 11 aa, Homo sapiens
  light chain complementarity determining region 3 for antibody 22435
QLYETSPPGHT

SEQ ID NO: 44870 - protein, 14 aa, Homo sapiens
  heavy chain complementarity determining region 3 for antibody 22435
ARENSISRKRSFDQ

SEQ ID NO: 44871 - protein, 11 aa, Homo sapiens
  light chain complementarity determining region 3 for antibody 22436
QLYETSPPGGT

SEQ ID NO: 44872 - protein, 14 aa, Homo sapiens
  heavy chain complementarity determining region 3 for antibody 22436
ARENSISRKRSFDQ

SEQ ID NO: 44873 - protein, 11 aa, Homo sapiens
  light chain complementarity determining region 3 for antibody 22437
QLYETSPPGAT

SEQ ID NO: 44874 - protein, 14 aa, Homo sapiens
  heavy chain complementarity determining region 3 for antibody 22437
ARENSISRKRSFDQ

SEQ ID NO: 44875 - protein, 11 aa, Homo sapiens
  light chain complementarity determining region 3 for antibody 22438
QLYDTSPPGYT

SEQ ID NO: 44876 - protein, 14 aa, Homo sapiens
  heavy chain complementarity determining region 3 for antibody 22438
ARENSISRKRSFDQ

SEQ ID NO: 44877 - protein, 11 aa, Homo sapiens
  light chain complementarity determining region 3 for antibody 22439
QLYATSPPGYT

SEQ ID NO: 44878 - protein, 14 aa, Homo sapiens
  heavy chain complementarity determining region 3 for antibody 22439
ARENSISRKRSFDQ

SEQ ID NO: 44879 - protein, 11 aa, Homo sapiens
  light chain complementarity determining region 3 for antibody 22440
QLWSTSGSSYT

SEQ ID NO: 44880 - protein, 14 aa, Homo sapiens
  heavy chain complementarity determining region 3 for antibody 22440
ARHTAESGLRGFDQ

SEQ ID NO: 44881 - protein, 11 aa, Homo sapiens
  light chain complementarity determining region 3 for antibody 22441
QLWSTSGSRYP

SEQ ID NO: 44882 - protein, 14 aa, Homo sapiens
  heavy chain complementarity determining region 3 for antibody 22441
ARHTAESGLRGFDQ

SEQ ID NO: 44883 - protein, 11 aa, Homo sapiens
  light chain complementarity determining region 3 for antibody 22442
QLWSTSGSRST

SEQ ID NO: 44884 - protein, 14 aa, Homo sapiens
  heavy chain complementarity determining region 3 for antibody 22442
ARHTAESGLRGFDQ

SEQ ID NO: 44885 - protein, 9 aa, Homo sapiens
  light chain complementarity determining region 3 for antibody 22443
QLTYVSSYT

SEQ ID NO: 44886 - protein, 19 aa, Homo sapiens
  heavy chain complementarity determining region 3 for antibody 22443
ARDGPGGYGSASYGDDFDY

SEQ ID NO: 44887 - protein, 11 aa, Homo sapiens
  light chain complementarity determining region 3 for antibody 22444
QLSETSPPGYT

SEQ ID NO: 44888 - protein, 14 aa, Homo sapiens
  heavy chain complementarity determining region 3 for antibody 22444
ARENSISRKRSFDQ

SEQ ID NO: 44889 - protein, 9 aa, Homo sapiens
  light chain complementarity determining region 3 for antibody 22445
QLGYSTPLI

SEQ ID NO: 44890 - protein, 15 aa, Homo sapiens
  heavy chain complementarity determining region 3 for antibody 22445
ARAQVIWGQLYYFDY

SEQ ID NO: 44891 - protein, 11 aa, Homo sapiens
  light chain complementarity determining region 3 for antibody 22446
QLDETSPPGYP

SEQ ID NO: 44892 - protein, 14 aa, Homo sapiens
  heavy chain complementarity determining region 3 for antibody 22446
ARENSISRKRSFDQ

SEQ ID NO: 44893 - protein, 9 aa, Homo sapiens
  light chain complementarity determining region 3 for antibody 22447
QKYYSAPQT

SEQ ID NO: 44894 - protein, 13 aa, Homo sapiens
  heavy chain complementarity determining region 3 for antibody 22447
ASSSLGYVDAFDL

SEQ ID NO: 44895 - protein, 9 aa, Homo sapiens
  light chain complementarity determining region 3 for antibody 22448
QKYYSALLT

SEQ ID NO: 44896 - protein, 17 aa, Homo sapiens
  heavy chain complementarity determining region 3 for antibody 22448
ARGRHYYGSGNYYPFDY

SEQ ID NO: 44897 - protein, 9 aa, Homo sapiens
  light chain complementarity determining region 3 for antibody 22449
QKYYSALLT

SEQ ID NO: 44898 - protein, 17 aa, Homo sapiens
  heavy chain complementarity determining region 3 for antibody 22449
ARDRHDYGSGNYYPFDY

SEQ ID NO: 44899 - protein, 9 aa, Homo sapiens
  light chain complementarity determining region 3 for antibody 22450
QKYYSALLT

SEQ ID NO: 44900 - protein, 17 aa, Homo sapiens
  heavy chain complementarity determining region 3 for antibody 22450
ARARHYYGSGNYYPFDY

SEQ ID NO: 44901 - protein, 9 aa, Homo sapiens
  light chain complementarity determining region 3 for antibody 22451
QKYYSALLT

SEQ ID NO: 44902 - protein, 17 aa, Homo sapiens
  heavy chain complementarity determining region 3 for antibody 22451
AGDRHYYGSGNYYPFDY

SEQ ID NO: 44903 - protein, 9 aa, Homo sapiens
  light chain complementarity determining region 3 for antibody 22452
QKYVTTPLT

SEQ ID NO: 44904 - protein, 8 aa, Homo sapiens
  heavy chain complementarity determining region 3 for antibody 22452
VRMSDYIL

SEQ ID NO: 44905 - protein, 9 aa, Homo sapiens
  light chain complementarity determining region 3 for antibody 22453
QKYTTAPFT

SEQ ID NO: 44906 - protein, 15 aa, Homo sapiens
  heavy chain complementarity determining region 3 for antibody 22453
ARVAPLTLVRDTDDY

SEQ ID NO: 44907 - protein, 9 aa, Homo sapiens
  light chain complementarity determining region 3 for antibody 22454
QKYTTAPFT

SEQ ID NO: 44908 - protein, 15 aa, Homo sapiens
  heavy chain complementarity determining region 3 for antibody 22454
AGVDPLTLVRDTDDY

SEQ ID NO: 44909 - protein, 9 aa, Homo sapiens
  light chain complementarity determining region 3 for antibody 22455
QKYTSAPIT

SEQ ID NO: 44910 - protein, 19 aa, Homo sapiens
  heavy chain complementarity determining region 3 for antibody 22455
ASLLHLRGSLDYLLPYFDY

SEQ ID NO: 44911 - protein, 9 aa, Homo sapiens
  light chain complementarity determining region 3 for antibody 22456
QKYNSGPRT

SEQ ID NO: 44912 - protein, 17 aa, Homo sapiens
  heavy chain complementarity determining region 3 for antibody 22456
ARERFYYGSGNYHPSDS

SEQ ID NO: 44913 - protein, 9 aa, Homo sapiens
  light chain complementarity determining region 3 for antibody 22457
QKYNSAPIT

SEQ ID NO: 44914 - protein, 19 aa, Homo sapiens
  heavy chain complementarity determining region 3 for antibody 22457
ASLLHLRGSLDYLLPSFDY

SEQ ID NO: 44915 - protein, 9 aa, Homo sapiens
  light chain complementarity determining region 3 for antibody 22458
QKYNSAPIT

SEQ ID NO: 44916 - protein, 19 aa, Homo sapiens
  heavy chain complementarity determining region 3 for antibody 22458
ASLLHLRGALDYLLPYFDY

SEQ ID NO: 44917 - protein, 9 aa, Homo sapiens
  light chain complementarity determining region 3 for antibody 22459
QKYNSAPFT

SEQ ID NO: 44918 - protein, 19 aa, Homo sapiens
  heavy chain complementarity determining region 3 for antibody 22459
ASLLHLRGSLDYLLPYFDY

SEQ ID NO: 44919 - protein, 9 aa, Homo sapiens
  light chain complementarity determining region 3 for antibody 22460
QKYNSALLT

SEQ ID NO: 44920 - protein, 17 aa, Homo sapiens
  heavy chain complementarity determining region 3 for antibody 22460
ASHRHYYGSGNYHPFDY

SEQ ID NO: 44921 - protein, 9 aa, Homo sapiens
  light chain complementarity determining region 3 for antibody 22461
QKYNSALLT

SEQ ID NO: 44922 - protein, 17 aa, Homo sapiens
  heavy chain complementarity determining region 3 for antibody 22461
AGHRHYYGSGNYHPFDY

SEQ ID NO: 44923 - protein, 9 aa, Homo sapiens
  light chain complementarity determining region 3 for antibody 22462
QKYNRVPLT

SEQ ID NO: 44924 - protein, 10 aa, Homo sapiens
  heavy chain complementarity determining region 3 for antibody 22462
AREFYYGIDV

SEQ ID NO: 44925 - protein, 10 aa, Homo sapiens
  light chain complementarity determining region 3 for antibody 22463
QKYNNWLGWT

SEQ ID NO: 44926 - protein, 13 aa, Homo sapiens
  heavy chain complementarity determining region 3 for antibody 22463
ARHGRRSGWYYTY

SEQ ID NO: 44927 - protein, 9 aa, Homo sapiens
  light chain complementarity determining region 3 for antibody 22464
QKYHSSPIT

SEQ ID NO: 44928 - protein, 14 aa, Homo sapiens
  heavy chain complementarity determining region 3 for antibody 22464
AKESSVYGVYPYDS

SEQ ID NO: 44929 - protein, 9 aa, Homo sapiens
  light chain complementarity determining region 3 for antibody 22465
QKYGTSPRP

SEQ ID NO: 44930 - protein, 13 aa, Homo sapiens
  heavy chain complementarity determining region 3 for antibody 22465
AGGHYHSSSYSDF

SEQ ID NO: 44931 - protein, 9 aa, Homo sapiens
  light chain complementarity determining region 3 for antibody 22466
QKYGTPPRP

SEQ ID NO: 44932 - protein, 13 aa, Homo sapiens
  heavy chain complementarity determining region 3 for antibody 22466
AGGLYDNTGSSEF

SEQ ID NO: 44933 - protein, 9 aa, Homo sapiens
  light chain complementarity determining region 3 for antibody 22467
QKYGTPPRP

SEQ ID NO: 44934 - protein, 13 aa, Homo sapiens
  heavy chain complementarity determining region 3 for antibody 22467
AGGLDDNTGYSEF

SEQ ID NO: 44935 - protein, 9 aa, Homo sapiens
  light chain complementarity determining region 3 for antibody 22468
QKYGTPPLP

SEQ ID NO: 44936 - protein, 13 aa, Homo sapiens
  heavy chain complementarity determining region 3 for antibody 22468
AGGLYDNTGYSEF

SEQ ID NO: 44937 - protein, 9 aa, Homo sapiens
  light chain complementarity determining region 3 for antibody 22469
QKYGTLPQT

SEQ ID NO: 44938 - protein, 18 aa, Homo sapiens
  heavy chain complementarity determining region 3 for antibody 22469
ARDYYGSGREIWVGAFDI

SEQ ID NO: 44939 - protein, 9 aa, Homo sapiens
  light chain complementarity determining region 3 for antibody 22470
QKYGTIPRT

SEQ ID NO: 44940 - protein, 13 aa, Homo sapiens
  heavy chain complementarity determining region 3 for antibody 22470
AGGSFSGRNYKED

SEQ ID NO: 44941 - protein, 9 aa, Homo sapiens
  light chain complementarity determining region 3 for antibody 22471
QKYGSSPRT

SEQ ID NO: 44942 - protein, 18 aa, Homo sapiens
  heavy chain complementarity determining region 3 for antibody 22471
ATAFWVGLGVPPPGFFEY

SEQ ID NO: 44943 - protein, 9 aa, Homo sapiens
  light chain complementarity determining region 3 for antibody 22472
QKYGSSPRT

SEQ ID NO: 44944 - protein, 14 aa, Homo sapiens
  heavy chain complementarity determining region 3 for antibody 22472
AGGRFSSGSSYSEN

SEQ ID NO: 44945 - protein, 9 aa, Homo sapiens
  light chain complementarity determining region 3 for antibody 22473
QKYGSSPLP

SEQ ID NO: 44946 - protein, 19 aa, Homo sapiens
  heavy chain complementarity determining region 3 for antibody 22473
ARGSSSSRRRAAVVGYFDL

SEQ ID NO: 44947 - protein, 9 aa, Homo sapiens
  light chain complementarity determining region 3 for antibody 22474
QKYGSIPRT

SEQ ID NO: 44948 - protein, 14 aa, Homo sapiens
  heavy chain complementarity determining region 3 for antibody 22474
AGGEFSSGWHYSEN

SEQ ID NO: 44949 - protein, 6 aa, Homo sapiens
  light chain complementarity determining region 3 for antibody 22475
QKYGSF

SEQ ID NO: 44950 - protein, 11 aa, Homo sapiens
  heavy chain complementarity determining region 3 for antibody 22475
ARAGISDALDV

SEQ ID NO: 44951 - protein, 9 aa, Homo sapiens
  light chain complementarity determining region 3 for antibody 22476
QKYGISPRP

SEQ ID NO: 44952 - protein, 13 aa, Homo sapiens
  heavy chain complementarity determining region 3 for antibody 22476
AGGHYHSSGYSEF

SEQ ID NO: 44953 - protein, 9 aa, Homo sapiens
  light chain complementarity determining region 3 for antibody 22477
QKYGGSPRT

SEQ ID NO: 44954 - protein, 13 aa, Homo sapiens
  heavy chain complementarity determining region 3 for antibody 22477
ASGYFDSGAYYEF

SEQ ID NO: 44955 - protein, 9 aa, Homo sapiens
  light chain complementarity determining region 3 for antibody 22478
QKYESAPQT

SEQ ID NO: 44956 - protein, 13 aa, Homo sapiens
  heavy chain complementarity determining region 3 for antibody 22478
ASSSLGYVDAFDL

SEQ ID NO: 44957 - protein, 9 aa, Homo sapiens
  light chain complementarity determining region 3 for antibody 22479
QKYERSPQT

SEQ ID NO: 44958 - protein, 15 aa, Homo sapiens
  heavy chain complementarity determining region 3 for antibody 22479
ARDPTVASHHYGVDV

SEQ ID NO: 44959 - protein, 9 aa, Homo sapiens
  light chain complementarity determining region 3 for antibody 22480
QKYDTAPLT

SEQ ID NO: 44960 - protein, 15 aa, Homo sapiens
  heavy chain complementarity determining region 3 for antibody 22480
LRDIKGPSAGIPYDS

SEQ ID NO: 44961 - protein, 9 aa, Homo sapiens
  light chain complementarity determining region 3 for antibody 22481
QKYDTAPCT

SEQ ID NO: 44962 - protein, 15 aa, Homo sapiens
  heavy chain complementarity determining region 3 for antibody 22481
LRDIKGPSAGIPYDS

SEQ ID NO: 44963 - protein, 9 aa, Homo sapiens
  light chain complementarity determining region 3 for antibody 22482
QKYDSAPQT

SEQ ID NO: 44964 - protein, 13 aa, Homo sapiens
  heavy chain complementarity determining region 3 for antibody 22482
ASSSVGYVDAFDL

SEQ ID NO: 44965 - protein, 9 aa, Homo sapiens
  light chain complementarity determining region 3 for antibody 22483
QKYDSAPQT

SEQ ID NO: 44966 - protein, 13 aa, Homo sapiens
  heavy chain complementarity determining region 3 for antibody 22483
AGSSLGYVDAFDL

SEQ ID NO: 44967 - protein, 9 aa, Homo sapiens
  light chain complementarity determining region 3 for antibody 22484
QKYDRAPQT

SEQ ID NO: 44968 - protein, 13 aa, Homo sapiens
  heavy chain complementarity determining region 3 for antibody 22484
ASSSLGYVDAFDL

SEQ ID NO: 44969 - protein, 10 aa, Homo sapiens
  light chain complementarity determining region 3 for antibody 22485
QKYDNWPPWT

SEQ ID NO: 44970 - protein, 12 aa, Homo sapiens
  heavy chain complementarity determining region 3 for antibody 22485
AKTLRERKELDY

SEQ ID NO: 44971 - protein, 9 aa, Homo sapiens
  light chain complementarity determining region 3 for antibody 22486
QKSYSTPWT

SEQ ID NO: 44972 - protein, 13 aa, Homo sapiens
  heavy chain complementarity determining region 3 for antibody 22486
VNVSQWLDDAFDF

SEQ ID NO: 44973 - protein, 9 aa, Homo sapiens
  light chain complementarity determining region 3 for antibody 22487
QKSDRKPFT

SEQ ID NO: 44974 - protein, 14 aa, Homo sapiens
  heavy chain complementarity determining region 3 for antibody 22487
ARDNSNNWYEGMDV

SEQ ID NO: 44975 - protein, 10 aa, Homo sapiens
  light chain complementarity determining region 3 for antibody 22488
QKRSDWPPLT

SEQ ID NO: 44976 - protein, 10 aa, Homo sapiens
  heavy chain complementarity determining region 3 for antibody 22488
ARDYTMTFDY

SEQ ID NO: 44977 - protein, 9 aa, Homo sapiens
  light chain complementarity determining region 3 for antibody 22489
QKNTTAPFT

SEQ ID NO: 44978 - protein, 15 aa, Homo sapiens
  heavy chain complementarity determining region 3 for antibody 22489
ARVDPLTLVRDTDDY

SEQ ID NO: 44979 - protein, 9 aa, Homo sapiens
  light chain complementarity determining region 3 for antibody 22490
QKNNSVPLT

SEQ ID NO: 44980 - protein, 10 aa, Homo sapiens
  heavy chain complementarity determining region 3 for antibody 22490
AREFYYGIDV

SEQ ID NO: 44981 - protein, 9 aa, Homo sapiens
  light chain complementarity determining region 3 for antibody 22491
QKNNSAPWP

SEQ ID NO: 44982 - protein, 14 aa, Homo sapiens
  heavy chain complementarity determining region 3 for antibody 22491
ARARGPASDWYFDY

SEQ ID NO: 44983 - protein, 9 aa, Homo sapiens
  light chain complementarity determining region 3 for antibody 22492
QKNNSAPRT

SEQ ID NO: 44984 - protein, 8 aa, Homo sapiens
  heavy chain complementarity determining region 3 for antibody 22492
AAGGSCDY

SEQ ID NO: 44985 - protein, 10 aa, Homo sapiens
  light chain complementarity determining region 3 for antibody 22493
QKNGGSPLVT

SEQ ID NO: 44986 - protein, 14 aa, Homo sapiens
  heavy chain complementarity determining region 3 for antibody 22493
ARDPISGSPDYFDY

SEQ ID NO: 44987 - protein, 9 aa, Homo sapiens
  light chain complementarity determining region 3 for antibody 22494
QKHNSVPLT

SEQ ID NO: 44988 - protein, 10 aa, Homo sapiens
  heavy chain complementarity determining region 3 for antibody 22494
AREFYYGIDV

SEQ ID NO: 44989 - protein, 6 aa, Homo sapiens
  light chain complementarity determining region 3 for antibody 22495
QKHGSF

SEQ ID NO: 44990 - protein, 11 aa, Homo sapiens
  heavy chain complementarity determining region 3 for antibody 22495
ARAGISYALDV

SEQ ID NO: 44991 - protein, 10 aa, Homo sapiens
  light chain complementarity determining region 3 for antibody 22496
QKFNNWPPWT

SEQ ID NO: 44992 - protein, 12 aa, Homo sapiens
  heavy chain complementarity determining region 3 for antibody 22496
AKTVRERKELDH

SEQ ID NO: 44993 - protein, 9 aa, Homo sapiens
  light chain complementarity determining region 3 for antibody 22497
QKFDGAPYT

SEQ ID NO: 44994 - protein, 14 aa, Homo sapiens
  heavy chain complementarity determining region 3 for antibody 22497
AKPQLTRHNGGFDH

SEQ ID NO: 44995 - protein, 9 aa, Homo sapiens
  light chain complementarity determining region 3 for antibody 22498
QKFAGAPYT

SEQ ID NO: 44996 - protein, 14 aa, Homo sapiens
  heavy chain complementarity determining region 3 for antibody 22498
AKPQLTRHNGGFDR

SEQ ID NO: 44997 - protein, 9 aa, Homo sapiens
  light chain complementarity determining region 3 for antibody 22499
QKDNSGPLT

SEQ ID NO: 44998 - protein, 17 aa, Homo sapiens
  heavy chain complementarity determining region 3 for antibody 22499
ARERFYYGSGNYHPSDS

SEQ ID NO: 44999 - protein, 9 aa, Homo sapiens
  light chain complementarity determining region 3 for antibody 22500
QKDGTPPRP

SEQ ID NO: 45000 - protein, 13 aa, Homo sapiens
  heavy chain complementarity determining region 3 for antibody 22500
AGGLYDNTGYSDF

SEQ ID NO: 45001 - protein, 10 aa, Homo sapiens
  light chain complementarity determining region 3 for antibody 22501
QKDGGSPLVT

SEQ ID NO: 45002 - protein, 14 aa, Homo sapiens
  heavy chain complementarity determining region 3 for antibody 22501
ARDPISGSPDYFDY

SEQ ID NO: 45003 - protein, 9 aa, Homo sapiens
  light chain complementarity determining region 3 for antibody 22502
QHYYTTPRT

SEQ ID NO: 45004 - protein, 11 aa, Homo sapiens
  heavy chain complementarity determining region 3 for antibody 22502
TRGQDRSKQGY

SEQ ID NO: 45005 - protein, 9 aa, Homo sapiens
  light chain complementarity determining region 3 for antibody 22503
QHYYTTPRP

SEQ ID NO: 45006 - protein, 8 aa, Homo sapiens
  heavy chain complementarity determining region 3 for antibody 22503
ARDGAFDS

SEQ ID NO: 45007 - protein, 9 aa, Homo sapiens
  light chain complementarity determining region 3 for antibody 22504
QHYYTSVRT

SEQ ID NO: 45008 - protein, 12 aa, Homo sapiens
  heavy chain complementarity determining region 3 for antibody 22504
VKDCGLGGSRDS

SEQ ID NO: 45009 - protein, 9 aa, Homo sapiens
  light chain complementarity determining region 3 for antibody 22505
QHYYTSLRR

SEQ ID NO: 45010 - protein, 12 aa, Homo sapiens
  heavy chain complementarity determining region 3 for antibody 22505
VKDCGLGGSRDS

SEQ ID NO: 45011 - protein, 11 aa, Homo sapiens
  light chain complementarity determining region 3 for antibody 22506
QHYYTSLLGFP

SEQ ID NO: 45012 - protein, 12 aa, Homo sapiens
  heavy chain complementarity determining region 3 for antibody 22506
ATSPSPYYHLDF

SEQ ID NO: 45013 - protein, 9 aa, Homo sapiens
  light chain complementarity determining region 3 for antibody 22507
QHYYSVPRT

SEQ ID NO: 45014 - protein, 17 aa, Homo sapiens
  heavy chain complementarity determining region 3 for antibody 22507
ARGNSGGGCNSCEYFPL

SEQ ID NO: 45015 - protein, 9 aa, Homo sapiens
  light chain complementarity determining region 3 for antibody 22508
QHYYSTPWT

SEQ ID NO: 45016 - protein, 15 aa, Homo sapiens
  heavy chain complementarity determining region 3 for antibody 22508
IRQSKVDNNYNYPDF

SEQ ID NO: 45017 - protein, 9 aa, Homo sapiens
  light chain complementarity determining region 3 for antibody 22509
QHYYRPPYT

SEQ ID NO: 45018 - protein, 15 aa, Homo sapiens
  heavy chain complementarity determining region 3 for antibody 22509
VHMAGSAMAWGWFDS

SEQ ID NO: 45019 - protein, 9 aa, Homo sapiens
  light chain complementarity determining region 3 for antibody 22510
QHYVTSPPT

SEQ ID NO: 45020 - protein, 8 aa, Homo sapiens
  heavy chain complementarity determining region 3 for antibody 22510
VCMIVATN

SEQ ID NO: 45021 - protein, 9 aa, Homo sapiens
  light chain complementarity determining region 3 for antibody 22511
QHYVTSPLT

SEQ ID NO: 45022 - protein, 8 aa, Homo sapiens
  heavy chain complementarity determining region 3 for antibody 22511
VRMIVATN

SEQ ID NO: 45023 - protein, 9 aa, Homo sapiens
  light chain complementarity determining region 3 for antibody 22512
QHYVTSPLT

SEQ ID NO: 45024 - protein, 8 aa, Homo sapiens
  heavy chain complementarity determining region 3 for antibody 22512
VCMLVATN

SEQ ID NO: 45025 - protein, 9 aa, Homo sapiens
  light chain complementarity determining region 3 for antibody 22513
QHYVTSPLT

SEQ ID NO: 45026 - protein, 8 aa, Homo sapiens
  heavy chain complementarity determining region 3 for antibody 22513
VCMIVATI

SEQ ID NO: 45027 - protein, 9 aa, Homo sapiens
  light chain complementarity determining region 3 for antibody 22514
QHYVTSPLT

SEQ ID NO: 45028 - protein, 8 aa, Homo sapiens
  heavy chain complementarity determining region 3 for antibody 22514
GCMIVATN

SEQ ID NO: 45029 - protein, 9 aa, Homo sapiens
  light chain complementarity determining region 3 for antibody 22515
QHYVTSPLS

SEQ ID NO: 45030 - protein, 8 aa, Homo sapiens
  heavy chain complementarity determining region 3 for antibody 22515
VCMIVATN

SEQ ID NO: 45031 - protein, 9 aa, Homo sapiens
  light chain complementarity determining region 3 for antibody 22516
QHYVTSPLP

SEQ ID NO: 45032 - protein, 8 aa, Homo sapiens
  heavy chain complementarity determining region 3 for antibody 22516
VCMRVATN

SEQ ID NO: 45033 - protein, 9 aa, Homo sapiens
  light chain complementarity determining region 3 for antibody 22517
QHYVTSPFT

SEQ ID NO: 45034 - protein, 8 aa, Homo sapiens
  heavy chain complementarity determining region 3 for antibody 22517
VCMIVATN

SEQ ID NO: 45035 - protein, 11 aa, Homo sapiens
  light chain complementarity determining region 3 for antibody 22518
QHYVSSPPNFT

SEQ ID NO: 45036 - protein, 15 aa, Homo sapiens
  heavy chain complementarity determining region 3 for antibody 22518
ARDPSYMAAAGRGDY

SEQ ID NO: 45037 - protein, 11 aa, Homo sapiens
  light chain complementarity determining region 3 for antibody 22519
QHYVSSPPNFT

SEQ ID NO: 45038 - protein, 15 aa, Homo sapiens
  heavy chain complementarity determining region 3 for antibody 22519
ARDPRYIAAAGRGDY

SEQ ID NO: 45039 - protein, 11 aa, Homo sapiens
  light chain complementarity determining region 3 for antibody 22520
QHYVSSPPNFT

SEQ ID NO: 45040 - protein, 15 aa, Homo sapiens
  heavy chain complementarity determining region 3 for antibody 22520
ARAPSYIAAAGRGDY

SEQ ID NO: 45041 - protein, 11 aa, Homo sapiens
  light chain complementarity determining region 3 for antibody 22521
QHYVSSPPNFN

SEQ ID NO: 45042 - protein, 15 aa, Homo sapiens
  heavy chain complementarity determining region 3 for antibody 22521
ARDPSYIAAAGRGDY

SEQ ID NO: 45043 - protein, 9 aa, Homo sapiens
  light chain complementarity determining region 3 for antibody 22522
QHYVSSPLT

SEQ ID NO: 45044 - protein, 8 aa, Homo sapiens
  heavy chain complementarity determining region 3 for antibody 22522
VCMIVATN

SEQ ID NO: 45045 - protein, 11 aa, Homo sapiens
  light chain complementarity determining region 3 for antibody 22523
QHYVSSHPNFT

SEQ ID NO: 45046 - protein, 15 aa, Homo sapiens
  heavy chain complementarity determining region 3 for antibody 22523
ARDPSYIAAAGRGDY

SEQ ID NO: 45047 - protein, 9 aa, Homo sapiens
  light chain complementarity determining region 3 for antibody 22524
QHYVNSPLT

SEQ ID NO: 45048 - protein, 8 aa, Homo sapiens
  heavy chain complementarity determining region 3 for antibody 22524
VCMIVATN

SEQ ID NO: 45049 - protein, 9 aa, Homo sapiens
  light chain complementarity determining region 3 for antibody 22525
QHYVISPLT

SEQ ID NO: 45050 - protein, 8 aa, Homo sapiens
  heavy chain complementarity determining region 3 for antibody 22525
VCMIVATN

SEQ ID NO: 45051 - protein, 8 aa, Homo sapiens
  light chain complementarity determining region 3 for antibody 22526
QHYSTSLT

SEQ ID NO: 45052 - protein, 12 aa, Homo sapiens
  heavy chain complementarity determining region 3 for antibody 22526
ARGRVVFHTIDS

SEQ ID NO: 45053 - protein, 8 aa, Homo sapiens
  light chain complementarity determining region 3 for antibody 22527
QHYSTALT

SEQ ID NO: 45054 - protein, 12 aa, Homo sapiens
  heavy chain complementarity determining region 3 for antibody 22527
ARGRVVFHSIDS

SEQ ID NO: 45055 - protein, 9 aa, Homo sapiens
  light chain complementarity determining region 3 for antibody 22528
QHYSSHVYT

SEQ ID NO: 45056 - protein, 18 aa, Homo sapiens
  heavy chain complementarity determining region 3 for antibody 22528
AQERDGYCDSHACYGLDV

SEQ ID NO: 45057 - protein, 10 aa, Homo sapiens
  light chain complementarity determining region 3 for antibody 22529
QHYSRSPPST

SEQ ID NO: 45058 - protein, 20 aa, Homo sapiens
  heavy chain complementarity determining region 3 for antibody 22529
ARDAADVEIVPAARLFAMDV

SEQ ID NO: 45059 - protein, 10 aa, Homo sapiens
  light chain complementarity determining region 3 for antibody 22530
QHYSRSPPLT

SEQ ID NO: 45060 - protein, 20 aa, Homo sapiens
  heavy chain complementarity determining region 3 for antibody 22530
ARDAADVEIVPAARLFAMDV

SEQ ID NO: 45061 - protein, 10 aa, Homo sapiens
  light chain complementarity determining region 3 for antibody 22531
QHYSRSPPIT

SEQ ID NO: 45062 - protein, 20 aa, Homo sapiens
  heavy chain complementarity determining region 3 for antibody 22531
ARDAADVETVPAARLFAMDV

SEQ ID NO: 45063 - protein, 10 aa, Homo sapiens
  light chain complementarity determining region 3 for antibody 22532
QHYSRSPPIT

SEQ ID NO: 45064 - protein, 20 aa, Homo sapiens
  heavy chain complementarity determining region 3 for antibody 22532
ARDAADVEIVPAARLFAMDA

SEQ ID NO: 45065 - protein, 10 aa, Homo sapiens
  light chain complementarity determining region 3 for antibody 22533
QHYSRSPPFT

SEQ ID NO: 45066 - protein, 20 aa, Homo sapiens
  heavy chain complementarity determining region 3 for antibody 22533
ARDAADVEIVPAARLFAMDV

SEQ ID NO: 45067 - protein, 8 aa, Homo sapiens
  light chain complementarity determining region 3 for antibody 22534
QHYRTALT

SEQ ID NO: 45068 - protein, 12 aa, Homo sapiens
  heavy chain complementarity determining region 3 for antibody 22534
ARGRVVFHTIDS

SEQ ID NO: 45069 - protein, 10 aa, Homo sapiens
  light chain complementarity determining region 3 for antibody 22535
QHYNTWPPDT

SEQ ID NO: 45070 - protein, 13 aa, Homo sapiens
  heavy chain complementarity determining region 3 for antibody 22535
ARGIIPVAGLLDY

SEQ ID NO: 45071 - protein, 9 aa, Homo sapiens
  light chain complementarity determining region 3 for antibody 22536
QHYNRSPRT

SEQ ID NO: 45072 - protein, 16 aa, Homo sapiens
  heavy chain complementarity determining region 3 for antibody 22536
VKDFTGECHYGSWFDP

SEQ ID NO: 45073 - protein, 10 aa, Homo sapiens
  light chain complementarity determining region 3 for antibody 22537
QHYNNWPPGT

SEQ ID NO: 45074 - protein, 13 aa, Homo sapiens
  heavy chain complementarity determining region 3 for antibody 22537
AKGRVRELYYFDT

SEQ ID NO: 45075 - protein, 11 aa, Homo sapiens
  light chain complementarity determining region 3 for antibody 22538
QHYNNWPLMYI

SEQ ID NO: 45076 - protein, 14 aa, Homo sapiens
  heavy chain complementarity determining region 3 for antibody 22538
LLRHRRADWPGVDY

SEQ ID NO: 45077 - protein, 11 aa, Homo sapiens
  light chain complementarity determining region 3 for antibody 22539
QHYNNWPLMST

SEQ ID NO: 45078 - protein, 14 aa, Homo sapiens
  heavy chain complementarity determining region 3 for antibody 22539
LLRHRRADWPGVDY

SEQ ID NO: 45079 - protein, 11 aa, Homo sapiens
  light chain complementarity determining region 3 for antibody 22540
QHYNNWPLMFT

SEQ ID NO: 45080 - protein, 14 aa, Homo sapiens
  heavy chain complementarity determining region 3 for antibody 22540
LLRHRRADWPGVDY

SEQ ID NO: 45081 - protein, 11 aa, Homo sapiens
  light chain complementarity determining region 3 for antibody 22541
QHYNNWPLMDT

SEQ ID NO: 45082 - protein, 14 aa, Homo sapiens
  heavy chain complementarity determining region 3 for antibody 22541
LLRHRRADWPGVDY

SEQ ID NO: 45083 - protein, 9 aa, Homo sapiens
  light chain complementarity determining region 3 for antibody 22542
QHYNIFSET

SEQ ID NO: 45084 - protein, 8 aa, Homo sapiens
  heavy chain complementarity determining region 3 for antibody 22542
ATSPQRGS

SEQ ID NO: 45085 - protein, 9 aa, Homo sapiens
  light chain complementarity determining region 3 for antibody 22543
QHYNGYWWP

SEQ ID NO: 45086 - protein, 12 aa, Homo sapiens
  heavy chain complementarity determining region 3 for antibody 22543
VTDLVGHGGVGF

SEQ ID NO: 45087 - protein, 9 aa, Homo sapiens
  light chain complementarity determining region 3 for antibody 22544
QHYNGNWWP

SEQ ID NO: 45088 - protein, 12 aa, Homo sapiens
  heavy chain complementarity determining region 3 for antibody 22544
VTYLVGHGGVGF

SEQ ID NO: 45089 - protein, 12 aa, Homo sapiens
  light chain complementarity determining region 3 for antibody 22545
QHYNDWPPGRGT

SEQ ID NO: 45090 - protein, 14 aa, Homo sapiens
  heavy chain complementarity determining region 3 for antibody 22545
ARDLSSPSSWYFDY

SEQ ID NO: 45091 - protein, 12 aa, Homo sapiens
  light chain complementarity determining region 3 for antibody 22546
QHYNDWPPGRGK

SEQ ID NO: 45092 - protein, 14 aa, Homo sapiens
  heavy chain complementarity determining region 3 for antibody 22546
ARDLSSTSSWYFDY

SEQ ID NO: 45093 - protein, 12 aa, Homo sapiens
  light chain complementarity determining region 3 for antibody 22547
QHYNDWPPCRGT

SEQ ID NO: 45094 - protein, 14 aa, Homo sapiens
  heavy chain complementarity determining region 3 for antibody 22547
ARDLSSTSSWYFDY

SEQ ID NO: 45095 - protein, 10 aa, Homo sapiens
  light chain complementarity determining region 3 for antibody 22548
QHYLNWPPWT

SEQ ID NO: 45096 - protein, 13 aa, Homo sapiens
  heavy chain complementarity determining region 3 for antibody 22548
AKGRVRELYYFDT

SEQ ID NO: 45097 - protein, 9 aa, Homo sapiens
  light chain complementarity determining region 3 for antibody 22549
QHYKSYPLT

SEQ ID NO: 45098 - protein, 12 aa, Homo sapiens
  heavy chain complementarity determining region 3 for antibody 22549
TRTQNNGWPFDY

SEQ ID NO: 45099 - protein, 9 aa, Homo sapiens
  light chain complementarity determining region 3 for antibody 22550
QHYHSTPLT

SEQ ID NO: 45100 - protein, 20 aa, Homo sapiens
  heavy chain complementarity determining region 3 for antibody 22550
ARARSKTTVVTPTRQFASDI

SEQ ID NO: 45101 - protein, 10 aa, Homo sapiens
  light chain complementarity determining region 3 for antibody 22551
QHYHNWPPWT

SEQ ID NO: 45102 - protein, 13 aa, Homo sapiens
  heavy chain complementarity determining region 3 for antibody 22551
AKGRVRELCYFDT

SEQ ID NO: 45103 - protein, 10 aa, Homo sapiens
  light chain complementarity determining region 3 for antibody 22552
QHYHNWPPWR

SEQ ID NO: 45104 - protein, 13 aa, Homo sapiens
  heavy chain complementarity determining region 3 for antibody 22552
AKGRVRELYYFDT

SEQ ID NO: 45105 - protein, 10 aa, Homo sapiens
  light chain complementarity determining region 3 for antibody 22553
QHYHNWPPWK

SEQ ID NO: 45106 - protein, 13 aa, Homo sapiens
  heavy chain complementarity determining region 3 for antibody 22553
AKGRVRELYYFET

SEQ ID NO: 45107 - protein, 10 aa, Homo sapiens
  light chain complementarity determining region 3 for antibody 22554
QHYHNWPPWK

SEQ ID NO: 45108 - protein, 13 aa, Homo sapiens
  heavy chain complementarity determining region 3 for antibody 22554
AKGRVRELYYFDT

SEQ ID NO: 45109 - protein, 10 aa, Homo sapiens
  light chain complementarity determining region 3 for antibody 22555
QHYHNWPPWA

SEQ ID NO: 45110 - protein, 13 aa, Homo sapiens
  heavy chain complementarity determining region 3 for antibody 22555
AKGRVRELYYFET

SEQ ID NO: 45111 - protein, 10 aa, Homo sapiens
  light chain complementarity determining region 3 for antibody 22556
QHYHKWPPWT

SEQ ID NO: 45112 - protein, 13 aa, Homo sapiens
  heavy chain complementarity determining region 3 for antibody 22556
AKGRVRELYYFET

SEQ ID NO: 45113 - protein, 8 aa, Homo sapiens
  light chain complementarity determining region 3 for antibody 22557
QHYGYSPT

SEQ ID NO: 45114 - protein, 9 aa, Homo sapiens
  heavy chain complementarity determining region 3 for antibody 22557
ARGYDAFDI

SEQ ID NO: 45115 - protein, 9 aa, Homo sapiens
  light chain complementarity determining region 3 for antibody 22558
QHYGTTPRT

SEQ ID NO: 45116 - protein, 13 aa, Homo sapiens
  heavy chain complementarity determining region 3 for antibody 22558
ACGYYEGGRYYEY

SEQ ID NO: 45117 - protein, 9 aa, Homo sapiens
  light chain complementarity determining region 3 for antibody 22559
QHYGTLPQT

SEQ ID NO: 45118 - protein, 18 aa, Homo sapiens
  heavy chain complementarity determining region 3 for antibody 22559
ARDYYGSGREIWVGAFDI

SEQ ID NO: 45119 - protein, 9 aa, Homo sapiens
  light chain complementarity determining region 3 for antibody 22560
QHYGTIPRT

SEQ ID NO: 45120 - protein, 13 aa, Homo sapiens
  heavy chain complementarity determining region 3 for antibody 22560
AGGIFHSRGYGEY

SEQ ID NO: 45121 - protein, 8 aa, Homo sapiens
  light chain complementarity determining region 3 for antibody 22561
QHYGSTYT

SEQ ID NO: 45122 - protein, 17 aa, Homo sapiens
  heavy chain complementarity determining region 3 for antibody 22561
ARDRGGVQSRKSGALDV

SEQ ID NO: 45123 - protein, 8 aa, Homo sapiens
  light chain complementarity determining region 3 for antibody 22562
QHYGSTST

SEQ ID NO: 45124 - protein, 17 aa, Homo sapiens
  heavy chain complementarity determining region 3 for antibody 22562
ARDHGGVQSRKSGALDV

SEQ ID NO: 45125 - protein, 8 aa, Homo sapiens
  light chain complementarity determining region 3 for antibody 22563
QHYGSSYT

SEQ ID NO: 45126 - protein, 17 aa, Homo sapiens
  heavy chain complementarity determining region 3 for antibody 22563
ARDHGGVQSRKSGALDV

SEQ ID NO: 45127 - protein, 9 aa, Homo sapiens
  light chain complementarity determining region 3 for antibody 22564
QHYGSSPRT

SEQ ID NO: 45128 - protein, 25 aa, Homo sapiens
  heavy chain complementarity determining region 3 for antibody 22564
ARLRIDRLRLPGAMRGPLYDCGLNV

SEQ ID NO: 45129 - protein, 11 aa, Homo sapiens
  light chain complementarity determining region 3 for antibody 22565
QHYGSSPPRYP

SEQ ID NO: 45130 - protein, 17 aa, Homo sapiens
  heavy chain complementarity determining region 3 for antibody 22565
ARLWSSQHLHHQDVFDV

SEQ ID NO: 45131 - protein, 11 aa, Homo sapiens
  light chain complementarity determining region 3 for antibody 22566
QHYGSSPPRWT

SEQ ID NO: 45132 - protein, 14 aa, Homo sapiens
  heavy chain complementarity determining region 3 for antibody 22566
ASFLLSRRGSYVNY

SEQ ID NO: 45133 - protein, 11 aa, Homo sapiens
  light chain complementarity determining region 3 for antibody 22567
QHYGSSPPRWE

SEQ ID NO: 45134 - protein, 14 aa, Homo sapiens
  heavy chain complementarity determining region 3 for antibody 22567
ASFLLSRRGSYVDY

SEQ ID NO: 45135 - protein, 11 aa, Homo sapiens
  light chain complementarity determining region 3 for antibody 22568
QHYGSSPPRST

SEQ ID NO: 45136 - protein, 17 aa, Homo sapiens
  heavy chain complementarity determining region 3 for antibody 22568
ARLWSSQHLHHQDVFDV

SEQ ID NO: 45137 - protein, 11 aa, Homo sapiens
  light chain complementarity determining region 3 for antibody 22569
QHYGSSPPRGR

SEQ ID NO: 45138 - protein, 14 aa, Homo sapiens
  heavy chain complementarity determining region 3 for antibody 22569
ASFLLSRRGSYVDY

SEQ ID NO: 45139 - protein, 9 aa, Homo sapiens
  light chain complementarity determining region 3 for antibody 22570
QHYGSSLWT

SEQ ID NO: 45140 - protein, 13 aa, Homo sapiens
  heavy chain complementarity determining region 3 for antibody 22570
ARKFLGYGHVLDV

SEQ ID NO: 45141 - protein, 9 aa, Homo sapiens
  light chain complementarity determining region 3 for antibody 22571
QHYGSSLGT

SEQ ID NO: 45142 - protein, 13 aa, Homo sapiens
  heavy chain complementarity determining region 3 for antibody 22571
ARKFLGYDHVLDV

SEQ ID NO: 45143 - protein, 9 aa, Homo sapiens
  light chain complementarity determining region 3 for antibody 22572
QHYGSLPLT

SEQ ID NO: 45144 - protein, 16 aa, Homo sapiens
  heavy chain complementarity determining region 3 for antibody 22572
ATMWVRGLLYFHAVDV

SEQ ID NO: 45145 - protein, 9 aa, Homo sapiens
  light chain complementarity determining region 3 for antibody 22573
QHYGSLPLT

SEQ ID NO: 45146 - protein, 16 aa, Homo sapiens
  heavy chain complementarity determining region 3 for antibody 22573
ATMLVRGLRYFHAVDV

SEQ ID NO: 45147 - protein, 9 aa, Homo sapiens
  light chain complementarity determining region 3 for antibody 22574
QHYGSLPLT

SEQ ID NO: 45148 - protein, 16 aa, Homo sapiens
  heavy chain complementarity determining region 3 for antibody 22574
ATMLVRGLLYFHDVDV

SEQ ID NO: 45149 - protein, 9 aa, Homo sapiens
  light chain complementarity determining region 3 for antibody 22575
QHYGSLPFT

SEQ ID NO: 45150 - protein, 16 aa, Homo sapiens
  heavy chain complementarity determining region 3 for antibody 22575
ATMLVRGLLYFHAVDV

SEQ ID NO: 45151 - protein, 9 aa, Homo sapiens
  light chain complementarity determining region 3 for antibody 22576
QHYGSFLWT

SEQ ID NO: 45152 - protein, 13 aa, Homo sapiens
  heavy chain complementarity determining region 3 for antibody 22576
ARKFLGYDHVLDV

SEQ ID NO: 45153 - protein, 10 aa, Homo sapiens
  light chain complementarity determining region 3 for antibody 22577
QHYGRYPPYS

SEQ ID NO: 45154 - protein, 23 aa, Homo sapiens
  heavy chain complementarity determining region 3 for antibody 22577
ARGLRSSDWSKIMEMDSYYGLDV

SEQ ID NO: 45155 - protein, 9 aa, Homo sapiens
  light chain complementarity determining region 3 for antibody 22578
QHYGRSTRT

SEQ ID NO: 45156 - protein, 13 aa, Homo sapiens
  heavy chain complementarity determining region 3 for antibody 22578
ARGKFERSGYVET

SEQ ID NO: 45157 - protein, 9 aa, Homo sapiens
  light chain complementarity determining region 3 for antibody 22579
QHYGRSPRT

SEQ ID NO: 45158 - protein, 13 aa, Homo sapiens
  heavy chain complementarity determining region 3 for antibody 22579
ARRKFERSGYVET

SEQ ID NO: 45159 - protein, 9 aa, Homo sapiens
  light chain complementarity determining region 3 for antibody 22580
QHYGRSPRT

SEQ ID NO: 45160 - protein, 13 aa, Homo sapiens
  heavy chain complementarity determining region 3 for antibody 22580
ARGKFERSGYVDT

SEQ ID NO: 45161 - protein, 9 aa, Homo sapiens
  light chain complementarity determining region 3 for antibody 22581
QHYGRSPRK

SEQ ID NO: 45162 - protein, 13 aa, Homo sapiens
  heavy chain complementarity determining region 3 for antibody 22581
ARGKFERSGYVET

SEQ ID NO: 45163 - protein, 10 aa, Homo sapiens
  light chain complementarity determining region 3 for antibody 22582
QHYGRSPPYS

SEQ ID NO: 45164 - protein, 23 aa, Homo sapiens
  heavy chain complementarity determining region 3 for antibody 22582
ARGLRSSDWSKSMEMDSYYGLDV

SEQ ID NO: 45165 - protein, 10 aa, Homo sapiens
  light chain complementarity determining region 3 for antibody 22583
QHYGRSPPYS

SEQ ID NO: 45166 - protein, 23 aa, Homo sapiens
  heavy chain complementarity determining region 3 for antibody 22583
ARGLRSSDWSKIMEMDSYCGLDV

SEQ ID NO: 45167 - protein, 10 aa, Homo sapiens
  light chain complementarity determining region 3 for antibody 22584
QHYGRSPPYS

SEQ ID NO: 45168 - protein, 23 aa, Homo sapiens
  heavy chain complementarity determining region 3 for antibody 22584
ARGLRSSDWSKIMEMDAYYGLDV

SEQ ID NO: 45169 - protein, 10 aa, Homo sapiens
  light chain complementarity determining region 3 for antibody 22585
QHYGRSPPYS

SEQ ID NO: 45170 - protein, 23 aa, Homo sapiens
  heavy chain complementarity determining region 3 for antibody 22585
ARGLRSSDWAKIMEMDSYYGLDV

SEQ ID NO: 45171 - protein, 10 aa, Homo sapiens
  light chain complementarity determining region 3 for antibody 22586
QHYGRSPPYS

SEQ ID NO: 45172 - protein, 23 aa, Homo sapiens
  heavy chain complementarity determining region 3 for antibody 22586
ARGLRSSAWSKIMEMDSYYGLDV

SEQ ID NO: 45173 - protein, 10 aa, Homo sapiens
  light chain complementarity determining region 3 for antibody 22587
QHYGRSPPYP

SEQ ID NO: 45174 - protein, 23 aa, Homo sapiens
  heavy chain complementarity determining region 3 for antibody 22587
ARGLRSSDWSKIMEMDSYYGLDV

SEQ ID NO: 45175 - protein, 10 aa, Homo sapiens
  light chain complementarity determining region 3 for antibody 22588
QHYGRSPPYF

SEQ ID NO: 45176 - protein, 23 aa, Homo sapiens
  heavy chain complementarity determining region 3 for antibody 22588
ARGLRSSDWSKIMEMDSYYGLDV

SEQ ID NO: 45177 - protein, 9 aa, Homo sapiens
  light chain complementarity determining region 3 for antibody 22589
QHYGRSPFT

SEQ ID NO: 45178 - protein, 19 aa, Homo sapiens
  heavy chain complementarity determining region 3 for antibody 22589
ARDGPRGRVTGVTWKPLDY

SEQ ID NO: 45179 - protein, 10 aa, Homo sapiens
  light chain complementarity determining region 3 for antibody 22590
QHYGRFPPYS

SEQ ID NO: 45180 - protein, 23 aa, Homo sapiens
  heavy chain complementarity determining region 3 for antibody 22590
ARGLRSSDWSKIMEMDSYYGLDV

SEQ ID NO: 45181 - protein, 10 aa, Homo sapiens
  light chain complementarity determining region 3 for antibody 22591
QHYGNSPPIT

SEQ ID NO: 45182 - protein, 11 aa, Homo sapiens
  heavy chain complementarity determining region 3 for antibody 22591
ARCVNTCYFDQ

SEQ ID NO: 45183 - protein, 10 aa, Homo sapiens
  light chain complementarity determining region 3 for antibody 22592
QHYGNSPPIP

SEQ ID NO: 45184 - protein, 11 aa, Homo sapiens
  heavy chain complementarity determining region 3 for antibody 22592
ARCFNTCYFDQ

SEQ ID NO: 45185 - protein, 9 aa, Homo sapiens
  light chain complementarity determining region 3 for antibody 22593
QHYGGSPRP

SEQ ID NO: 45186 - protein, 13 aa, Homo sapiens
  heavy chain complementarity determining region 3 for antibody 22593
AAGYFSSGTYYEY

SEQ ID NO: 45187 - protein, 9 aa, Homo sapiens
  light chain complementarity determining region 3 for antibody 22594
QHYFSTPHT

SEQ ID NO: 45188 - protein, 13 aa, Homo sapiens
  heavy chain complementarity determining region 3 for antibody 22594
ARHSSGYPTPFDY

SEQ ID NO: 45189 - protein, 9 aa, Homo sapiens
  light chain complementarity determining region 3 for antibody 22595
QHYDTSPLT

SEQ ID NO: 45190 - protein, 8 aa, Homo sapiens
  heavy chain complementarity determining region 3 for antibody 22595
VCMIVATN

SEQ ID NO: 45191 - protein, 10 aa, Homo sapiens
  light chain complementarity determining region 3 for antibody 22596
QHYDTPSPIS

SEQ ID NO: 45192 - protein, 11 aa, Homo sapiens
  heavy chain complementarity determining region 3 for antibody 22596
ARAIRAHYFDH

SEQ ID NO: 45193 - protein, 9 aa, Homo sapiens
  light chain complementarity determining region 3 for antibody 22597
QHYDSHSRT

SEQ ID NO: 45194 - protein, 22 aa, Homo sapiens
  heavy chain complementarity determining region 3 for antibody 22597
AREGYYQGSGTYQPPSYYGMAV

SEQ ID NO: 45195 - protein, 9 aa, Homo sapiens
  light chain complementarity determining region 3 for antibody 22598
QHYDSHSRT

SEQ ID NO: 45196 - protein, 22 aa, Homo sapiens
  heavy chain complementarity determining region 3 for antibody 22598
AREGYYHGSGTYQPPSYYGMDV

SEQ ID NO: 45197 - protein, 9 aa, Homo sapiens
  light chain complementarity determining region 3 for antibody 22599
QHYDSHSRT

SEQ ID NO: 45198 - protein, 22 aa, Homo sapiens
  heavy chain complementarity determining region 3 for antibody 22599
AREGYYHGSGTYQPPGYYGMAV

SEQ ID NO: 45199 - protein, 9 aa, Homo sapiens
  light chain complementarity determining region 3 for antibody 22600
QHYAFSPYG

SEQ ID NO: 45200 - protein, 15 aa, Homo sapiens
  heavy chain complementarity determining region 3 for antibody 22600
ARESRSQVGEVLVDY

SEQ ID NO: 45201 - protein, 9 aa, Homo sapiens
  light chain complementarity determining region 3 for antibody 22601
QHTSTFPRT

SEQ ID NO: 45202 - protein, 20 aa, Homo sapiens
  heavy chain complementarity determining region 3 for antibody 22601
ARGRRIAALSTAHYYYGMDV

SEQ ID NO: 45203 - protein, 9 aa, Homo sapiens
  light chain complementarity determining region 3 for antibody 22602
QHTHTFPRT

SEQ ID NO: 45204 - protein, 20 aa, Homo sapiens
  heavy chain complementarity determining region 3 for antibody 22602
GRGRRRAALSTAHYYYGMDV

SEQ ID NO: 45205 - protein, 9 aa, Homo sapiens
  light chain complementarity determining region 3 for antibody 22603
QHTHTFPRT

SEQ ID NO: 45206 - protein, 20 aa, Homo sapiens
  heavy chain complementarity determining region 3 for antibody 22603
GRGRRIAALSTARYYYGMDV

SEQ ID NO: 45207 - protein, 9 aa, Homo sapiens
  light chain complementarity determining region 3 for antibody 22604
QHTHTFPRT

SEQ ID NO: 45208 - protein, 20 aa, Homo sapiens
  heavy chain complementarity determining region 3 for antibody 22604
ARGRRIAALSTAHCYYGMDV

SEQ ID NO: 45209 - protein, 9 aa, Homo sapiens
  light chain complementarity determining region 3 for antibody 22605
QHTHTFLRT

SEQ ID NO: 45210 - protein, 20 aa, Homo sapiens
  heavy chain complementarity determining region 3 for antibody 22605
GRGRRIAALSTAHYYYGMDV

SEQ ID NO: 45211 - protein, 9 aa, Homo sapiens
  light chain complementarity determining region 3 for antibody 22606
QHSYTSLRT

SEQ ID NO: 45212 - protein, 12 aa, Homo sapiens
  heavy chain complementarity determining region 3 for antibody 22606
VKDCGLGGSRDS

SEQ ID NO: 45213 - protein, 11 aa, Homo sapiens
  light chain complementarity determining region 3 for antibody 22607
QHSVSSPPNFT

SEQ ID NO: 45214 - protein, 15 aa, Homo sapiens
  heavy chain complementarity determining region 3 for antibody 22607
ARDPSYIAAAGRGDY

SEQ ID NO: 45215 - protein, 9 aa, Homo sapiens
  light chain complementarity determining region 3 for antibody 22608
QHSNSRPFT

SEQ ID NO: 45216 - protein, 20 aa, Homo sapiens
  heavy chain complementarity determining region 3 for antibody 22608
AKGVSVAALRTVYYYYGLDV

SEQ ID NO: 45217 - protein, 9 aa, Homo sapiens
  light chain complementarity determining region 3 for antibody 22609
QHSHSRPFT

SEQ ID NO: 45218 - protein, 20 aa, Homo sapiens
  heavy chain complementarity determining region 3 for antibody 22609
AKGVSVAALRTVYCYYGLDV

SEQ ID NO: 45219 - protein, 10 aa, Homo sapiens
  light chain complementarity determining region 3 for antibody 22610
QHSHNWPPWT

SEQ ID NO: 45220 - protein, 13 aa, Homo sapiens
  heavy chain complementarity determining region 3 for antibody 22610
AKGRVRELYYFES

SEQ ID NO: 45221 - protein, 9 aa, Homo sapiens
  light chain complementarity determining region 3 for antibody 22611
QHSHIRPFT

SEQ ID NO: 45222 - protein, 20 aa, Homo sapiens
  heavy chain complementarity determining region 3 for antibody 22611
AKGISVAALRTVYYYYGMDV

SEQ ID NO: 45223 - protein, 9 aa, Homo sapiens
  light chain complementarity determining region 3 for antibody 22612
QHSGTSPRT

SEQ ID NO: 45224 - protein, 13 aa, Homo sapiens
  heavy chain complementarity determining region 3 for antibody 22612
GKGYEYAPRIYDY

SEQ ID NO: 45225 - protein, 9 aa, Homo sapiens
  light chain complementarity determining region 3 for antibody 22613
QHSDSIPYT

SEQ ID NO: 45226 - protein, 12 aa, Homo sapiens
  heavy chain complementarity determining region 3 for antibody 22613
ARGNPIVTGFDY

SEQ ID NO: 45227 - protein, 9 aa, Homo sapiens
  light chain complementarity determining region 3 for antibody 22614
QHSDSIPNT

SEQ ID NO: 45228 - protein, 12 aa, Homo sapiens
  heavy chain complementarity determining region 3 for antibody 22614
ARGNPIVTGFDY

SEQ ID NO: 45229 - protein, 10 aa, Homo sapiens
  light chain complementarity determining region 3 for antibody 22615
QHRYNLPPFT

SEQ ID NO: 45230 - protein, 11 aa, Homo sapiens
  heavy chain complementarity determining region 3 for antibody 22615
ARGVGSYPFDS

SEQ ID NO: 45231 - protein, 11 aa, Homo sapiens
  light chain complementarity determining region 3 for antibody 22616
QHRTNWPPIYT

SEQ ID NO: 45232 - protein, 14 aa, Homo sapiens
  heavy chain complementarity determining region 3 for antibody 22616
ARGGLGIWGNSSDI

SEQ ID NO: 45233 - protein, 9 aa, Homo sapiens
  light chain complementarity determining region 3 for antibody 22617
QHRSSWPYT

SEQ ID NO: 45234 - protein, 11 aa, Homo sapiens
  heavy chain complementarity determining region 3 for antibody 22617
VKRWGGSSIDY

SEQ ID NO: 45235 - protein, 9 aa, Homo sapiens
  light chain complementarity determining region 3 for antibody 22618
QHRSNWPPT

SEQ ID NO: 45236 - protein, 13 aa, Homo sapiens
  heavy chain complementarity determining region 3 for antibody 22618
ARGLIFKQWVVDY

SEQ ID NO: 45237 - protein, 11 aa, Homo sapiens
  light chain complementarity determining region 3 for antibody 22619
QHRSNWPPIFT

SEQ ID NO: 45238 - protein, 18 aa, Homo sapiens
  heavy chain complementarity determining region 3 for antibody 22619
ARIPPYDSSGYYYYVLDY

SEQ ID NO: 45239 - protein, 9 aa, Homo sapiens
  light chain complementarity determining region 3 for antibody 22620
QHRSNWPGT

SEQ ID NO: 45240 - protein, 15 aa, Homo sapiens
  heavy chain complementarity determining region 3 for antibody 22620
ARDRRAVGGHNAMDV

SEQ ID NO: 45241 - protein, 9 aa, Homo sapiens
  light chain complementarity determining region 3 for antibody 22621
QHRSNRPGT

SEQ ID NO: 45242 - protein, 15 aa, Homo sapiens
  heavy chain complementarity determining region 3 for antibody 22621
ARDRRAVGGHNAMDV

SEQ ID NO: 45243 - protein, 9 aa, Homo sapiens
  light chain complementarity determining region 3 for antibody 22622
QHRSGWPLT

SEQ ID NO: 45244 - protein, 18 aa, Homo sapiens
  heavy chain complementarity determining region 3 for antibody 22622
ARDLPPGATGNCYSGLED

SEQ ID NO: 45245 - protein, 10 aa, Homo sapiens
  light chain complementarity determining region 3 for antibody 22623
QHRSDWPPLT

SEQ ID NO: 45246 - protein, 10 aa, Homo sapiens
  heavy chain complementarity determining region 3 for antibody 22623
ARDYTMTFDY

SEQ ID NO: 45247 - protein, 9 aa, Homo sapiens
  light chain complementarity determining region 3 for antibody 22624
QHRRTWRYS

SEQ ID NO: 45248 - protein, 20 aa, Homo sapiens
  heavy chain complementarity determining region 3 for antibody 22624
ARDGSAGMAARGTPYYGLDV

SEQ ID NO: 45249 - protein, 9 aa, Homo sapiens
  light chain complementarity determining region 3 for antibody 22625
QHRRTWLYS

SEQ ID NO: 45250 - protein, 20 aa, Homo sapiens
  heavy chain complementarity determining region 3 for antibody 22625
TRDGSAGMAARGTPYYGLDV

SEQ ID NO: 45251 - protein, 9 aa, Homo sapiens
  light chain complementarity determining region 3 for antibody 22626
QHRRTWLYS

SEQ ID NO: 45252 - protein, 20 aa, Homo sapiens
  heavy chain complementarity determining region 3 for antibody 22626
AREGSAGMAARGTPYYGLDV

SEQ ID NO: 45253 - protein, 9 aa, Homo sapiens
  light chain complementarity determining region 3 for antibody 22627
QHRRTWLYS

SEQ ID NO: 45254 - protein, 20 aa, Homo sapiens
  heavy chain complementarity determining region 3 for antibody 22627
ARDGSAGMAARGTTYYGLDV

SEQ ID NO: 45255 - protein, 9 aa, Homo sapiens
  light chain complementarity determining region 3 for antibody 22628
QHRRTWLYS

SEQ ID NO: 45256 - protein, 20 aa, Homo sapiens
  heavy chain complementarity determining region 3 for antibody 22628
ARDGSAGMAARGPPYYGLDV

SEQ ID NO: 45257 - protein, 9 aa, Homo sapiens
  light chain complementarity determining region 3 for antibody 22629
QHRRTWLYR

SEQ ID NO: 45258 - protein, 20 aa, Homo sapiens
  heavy chain complementarity determining region 3 for antibody 22629
ARDGSAGMAARGTPYYGLDV

SEQ ID NO: 45259 - protein, 9 aa, Homo sapiens
  light chain complementarity determining region 3 for antibody 22630
QHRRTWLSR

SEQ ID NO: 45260 - protein, 20 aa, Homo sapiens
  heavy chain complementarity determining region 3 for antibody 22630
ARDGSAGMAARGTPYYGLDV

SEQ ID NO: 45261 - protein, 9 aa, Homo sapiens
  light chain complementarity determining region 3 for antibody 22631
QHRRTGLYS

SEQ ID NO: 45262 - protein, 20 aa, Homo sapiens
  heavy chain complementarity determining region 3 for antibody 22631
ARDGSAGMAARGTPYYGLDV

SEQ ID NO: 45263 - protein, 9 aa, Homo sapiens
  light chain complementarity determining region 3 for antibody 22632
QHRRPWLYS

SEQ ID NO: 45264 - protein, 20 aa, Homo sapiens
  heavy chain complementarity determining region 3 for antibody 22632
ARDGSAGMAARGTPYYGLDV

SEQ ID NO: 45265 - protein, 9 aa, Homo sapiens
  light chain complementarity determining region 3 for antibody 22633
QHRNNWPPT

SEQ ID NO: 45266 - protein, 13 aa, Homo sapiens
  heavy chain complementarity determining region 3 for antibody 22633
ARGNIAAPGRLEC

SEQ ID NO: 45267 - protein, 9 aa, Homo sapiens
  light chain complementarity determining region 3 for antibody 22634
QHRNNWPLT

SEQ ID NO: 45268 - protein, 13 aa, Homo sapiens
  heavy chain complementarity determining region 3 for antibody 22634
ARGNIAAPGRLEY

SEQ ID NO: 45269 - protein, 9 aa, Homo sapiens
  light chain complementarity determining region 3 for antibody 22635
QHRNNWPLT

SEQ ID NO: 45270 - protein, 13 aa, Homo sapiens
  heavy chain complementarity determining region 3 for antibody 22635
ARGKIAAPGRLEC

SEQ ID NO: 45271 - protein, 9 aa, Homo sapiens
  light chain complementarity determining region 3 for antibody 22636
QHRNNLPLT

SEQ ID NO: 45272 - protein, 13 aa, Homo sapiens
  heavy chain complementarity determining region 3 for antibody 22636
ARGNIAAPGRLEC

SEQ ID NO: 45273 - protein, 9 aa, Homo sapiens
  light chain complementarity determining region 3 for antibody 22637
QHPKSYPLT

SEQ ID NO: 45274 - protein, 15 aa, Homo sapiens
  heavy chain complementarity determining region 3 for antibody 22637
ARLGIVVAERGYFDH

SEQ ID NO: 45275 - protein, 9 aa, Homo sapiens
  light chain complementarity determining region 3 for antibody 22638
QHPKSYPFT

SEQ ID NO: 45276 - protein, 15 aa, Homo sapiens
  heavy chain complementarity determining region 3 for antibody 22638
ARLGIVGAERGYFDH

SEQ ID NO: 45277 - protein, 9 aa, Homo sapiens
  light chain complementarity determining region 3 for antibody 22639
QHPKRYPFT

SEQ ID NO: 45278 - protein, 15 aa, Homo sapiens
  heavy chain complementarity determining region 3 for antibody 22639
ARLGIVVAERGYFDH

SEQ ID NO: 45279 - protein, 10 aa, Homo sapiens
  light chain complementarity determining region 3 for antibody 22640
QHNDDLRQPS

SEQ ID NO: 45280 - protein, 13 aa, Homo sapiens
  heavy chain complementarity determining region 3 for antibody 22640
ARDQDGDYGYFHN

SEQ ID NO: 45281 - protein, 10 aa, Homo sapiens
  light chain complementarity determining region 3 for antibody 22641
QHNDDLRQLP

SEQ ID NO: 45282 - protein, 13 aa, Homo sapiens
  heavy chain complementarity determining region 3 for antibody 22641
ARDQDGDYGYFHN

SEQ ID NO: 45283 - protein, 10 aa, Homo sapiens
  light chain complementarity determining region 3 for antibody 22642
QHNDDIRQLS

SEQ ID NO: 45284 - protein, 13 aa, Homo sapiens
  heavy chain complementarity determining region 3 for antibody 22642
ARDQDGDYGYFHN

SEQ ID NO: 45285 - protein, 10 aa, Homo sapiens
  light chain complementarity determining region 3 for antibody 22643
QHNDDFRQLS

SEQ ID NO: 45286 - protein, 13 aa, Homo sapiens
  heavy chain complementarity determining region 3 for antibody 22643
ARDQDGDYGYFHN

SEQ ID NO: 45287 - protein, 10 aa, Homo sapiens
  light chain complementarity determining region 3 for antibody 22644
QHLYNWPPLT

SEQ ID NO: 45288 - protein, 22 aa, Homo sapiens
  heavy chain complementarity determining region 3 for antibody 22644
ARVDCSSTTCYVGYYYYFGLDV

SEQ ID NO: 45289 - protein, 10 aa, Homo sapiens
  light chain complementarity determining region 3 for antibody 22645
QHLYNWPPLT

SEQ ID NO: 45290 - protein, 22 aa, Homo sapiens
  heavy chain complementarity determining region 3 for antibody 22645
ARVDCSSTNGYVGYYYYFGLDV

SEQ ID NO: 45291 - protein, 10 aa, Homo sapiens
  light chain complementarity determining region 3 for antibody 22646
QHLYNWPPLT

SEQ ID NO: 45292 - protein, 22 aa, Homo sapiens
  heavy chain complementarity determining region 3 for antibody 22646
ARVDCSSTNCYVGYSYYFGLDV

SEQ ID NO: 45293 - protein, 8 aa, Homo sapiens
  light chain complementarity determining region 3 for antibody 22647
QHLNSYPR

SEQ ID NO: 45294 - protein, 18 aa, Homo sapiens
  heavy chain complementarity determining region 3 for antibody 22647
ARGRAMTGPRGPSYVFDS

SEQ ID NO: 45295 - protein, 8 aa, Homo sapiens
  light chain complementarity determining region 3 for antibody 22648
QHLNSYPR

SEQ ID NO: 45296 - protein, 18 aa, Homo sapiens
  heavy chain complementarity determining region 3 for antibody 22648
ARDRAMTGPRGPSYVLDS

SEQ ID NO: 45297 - protein, 8 aa, Homo sapiens
  light chain complementarity determining region 3 for antibody 22649
QHLNSYPR

SEQ ID NO: 45298 - protein, 18 aa, Homo sapiens
  heavy chain complementarity determining region 3 for antibody 22649
ARDRAMTGPRGPRYVFDS

SEQ ID NO: 45299 - protein, 8 aa, Homo sapiens
  light chain complementarity determining region 3 for antibody 22650
QHLNSYPR

SEQ ID NO: 45300 - protein, 18 aa, Homo sapiens
  heavy chain complementarity determining region 3 for antibody 22650
ARDRAMAGPRGPSYVFDS

SEQ ID NO: 45301 - protein, 9 aa, Homo sapiens
  light chain complementarity determining region 3 for antibody 22651
QHLGTLPYT

SEQ ID NO: 45302 - protein, 16 aa, Homo sapiens
  heavy chain complementarity determining region 3 for antibody 22651
TTERHIAEFEEASFDI

SEQ ID NO: 45303 - protein, 9 aa, Homo sapiens
  light chain complementarity determining region 3 for antibody 22652
QHHNSWPRT

SEQ ID NO: 45304 - protein, 14 aa, Homo sapiens
  heavy chain complementarity determining region 3 for antibody 22652
ARGGDYEYPDVFDI

SEQ ID NO: 45305 - protein, 10 aa, Homo sapiens
  light chain complementarity determining region 3 for antibody 22653
QHHHNWPPWT

SEQ ID NO: 45306 - protein, 13 aa, Homo sapiens
  heavy chain complementarity determining region 3 for antibody 22653
AKGRVRELYYFET

SEQ ID NO: 45307 - protein, 9 aa, Homo sapiens
  light chain complementarity determining region 3 for antibody 22654
QHGYSSPFT

SEQ ID NO: 45308 - protein, 15 aa, Homo sapiens
  heavy chain complementarity determining region 3 for antibody 22654
VKAQVIWGQLYYFES

SEQ ID NO: 45309 - protein, 9 aa, Homo sapiens
  light chain complementarity determining region 3 for antibody 22655
QHGYRTQFT

SEQ ID NO: 45310 - protein, 15 aa, Homo sapiens
  heavy chain complementarity determining region 3 for antibody 22655
AKAQVIWGQLYYFES

SEQ ID NO: 45311 - protein, 9 aa, Homo sapiens
  light chain complementarity determining region 3 for antibody 22656
QHGYRPPFI

SEQ ID NO: 45312 - protein, 15 aa, Homo sapiens
  heavy chain complementarity determining region 3 for antibody 22656
TRAQVIWGQLYYFDY

SEQ ID NO: 45313 - protein, 10 aa, Homo sapiens
  light chain complementarity determining region 3 for antibody 22657
QHFGSSPELT

SEQ ID NO: 45314 - protein, 13 aa, Homo sapiens
  heavy chain complementarity determining region 3 for antibody 22657
VRGARRGRYDFDY

SEQ ID NO: 45315 - protein, 9 aa, Homo sapiens
  light chain complementarity determining region 3 for antibody 22658
QHFGNSPLK

SEQ ID NO: 45316 - protein, 11 aa, Homo sapiens
  heavy chain complementarity determining region 3 for antibody 22658
ARKPMGTPFDY

SEQ ID NO: 45317 - protein, 9 aa, Homo sapiens
  light chain complementarity determining region 3 for antibody 22659
QHFGNAPLT

SEQ ID NO: 45318 - protein, 11 aa, Homo sapiens
  heavy chain complementarity determining region 3 for antibody 22659
ARKPMGTPFDY

SEQ ID NO: 45319 - protein, 9 aa, Homo sapiens
  light chain complementarity determining region 3 for antibody 22660
QHDYTSVRT

SEQ ID NO: 45320 - protein, 12 aa, Homo sapiens
  heavy chain complementarity determining region 3 for antibody 22660
VKDCGLGGSRDS

SEQ ID NO: 45321 - protein, 11 aa, Homo sapiens
  light chain complementarity determining region 3 for antibody 22661
QGYGASPPRYT

SEQ ID NO: 45322 - protein, 12 aa, Homo sapiens
  heavy chain complementarity determining region 3 for antibody 22661
AKDLHGSGSFDH

SEQ ID NO: 45323 - protein, 11 aa, Homo sapiens
  light chain complementarity determining region 3 for antibody 22662
QGYGASPPMSP

SEQ ID NO: 45324 - protein, 12 aa, Homo sapiens
  heavy chain complementarity determining region 3 for antibody 22662
AKDLHGSGSFDH

SEQ ID NO: 45325 - protein, 11 aa, Homo sapiens
  light chain complementarity determining region 3 for antibody 22663
QGYGASPPMNT

SEQ ID NO: 45326 - protein, 12 aa, Homo sapiens
  heavy chain complementarity determining region 3 for antibody 22663
AKDLHGSGSFDH

SEQ ID NO: 45327 - protein, 11 aa, Homo sapiens
  light chain complementarity determining region 3 for antibody 22664
QGYGASPPMNP

SEQ ID NO: 45328 - protein, 12 aa, Homo sapiens
  heavy chain complementarity determining region 3 for antibody 22664
AKDLHGSGSFDH

SEQ ID NO: 45329 - protein, 11 aa, Homo sapiens
  light chain complementarity determining region 3 for antibody 22665
QGFDTSPPMYT

SEQ ID NO: 45330 - protein, 23 aa, Homo sapiens
  heavy chain complementarity determining region 3 for antibody 22665
ARANRRYRRSDSRMDFLYFGMDV

SEQ ID NO: 45331 - protein, 9 aa, Homo sapiens
  light chain complementarity determining region 3 for antibody 22666
QEYNSVPWT

SEQ ID NO: 45332 - protein, 15 aa, Homo sapiens
  heavy chain complementarity determining region 3 for antibody 22666
TTRGYDSSDHYYFDY

SEQ ID NO: 45333 - protein, 9 aa, Homo sapiens
  light chain complementarity determining region 3 for antibody 22667
QEYNIAPLT

SEQ ID NO: 45334 - protein, 6 aa, Homo sapiens
  heavy chain complementarity determining region 3 for antibody 22667
ARDLDS

SEQ ID NO: 45335 - protein, 6 aa, Homo sapiens
  light chain complementarity determining region 3 for antibody 22668
QEYGSF

SEQ ID NO: 45336 - protein, 11 aa, Homo sapiens
  heavy chain complementarity determining region 3 for antibody 22668
ARAGISYALDV

SEQ ID NO: 45337 - protein, 9 aa, Homo sapiens
  light chain complementarity determining region 3 for antibody 22669
QEYDSLPFT

SEQ ID NO: 45338 - protein, 22 aa, Homo sapiens
  heavy chain complementarity determining region 3 for antibody 22669
ARDDRISFDYPNSGYSGGAFDL

SEQ ID NO: 45339 - protein, 9 aa, Homo sapiens
  light chain complementarity determining region 3 for antibody 22670
QEYDSLPFT

SEQ ID NO: 45340 - protein, 22 aa, Homo sapiens
  heavy chain complementarity determining region 3 for antibody 22670
ARDDRISFAYPNSGYSGGTFDL

SEQ ID NO: 45341 - protein, 9 aa, Homo sapiens
  light chain complementarity determining region 3 for antibody 22671
QEYDSIPFT

SEQ ID NO: 45342 - protein, 22 aa, Homo sapiens
  heavy chain complementarity determining region 3 for antibody 22671
ARDDRISFDYPNSGYSGGTFDL

SEQ ID NO: 45343 - protein, 9 aa, Homo sapiens
  light chain complementarity determining region 3 for antibody 22672
QEIYFTPST

SEQ ID NO: 45344 - protein, 17 aa, Homo sapiens
  heavy chain complementarity determining region 3 for antibody 22672
ANDHSINGSSVGPGFDY

SEQ ID NO: 45345 - protein, 8 aa, Homo sapiens
  light chain complementarity determining region 3 for antibody 22673
QDYGSSRT

SEQ ID NO: 45346 - protein, 15 aa, Homo sapiens
  heavy chain complementarity determining region 3 for antibody 22673
ASGSFETLTGSYSEV

SEQ ID NO: 45347 - protein, 8 aa, Homo sapiens
  light chain complementarity determining region 3 for antibody 22674
QDYGSSRT

SEQ ID NO: 45348 - protein, 15 aa, Homo sapiens
  heavy chain complementarity determining region 3 for antibody 22674
ASGSFDTLTGSYSDV

SEQ ID NO: 45349 - protein, 8 aa, Homo sapiens
  light chain complementarity determining region 3 for antibody 22675
QDYGSSRT

SEQ ID NO: 45350 - protein, 15 aa, Homo sapiens
  heavy chain complementarity determining region 3 for antibody 22675
ASGSFDTLTGSCSEV

SEQ ID NO: 45351 - protein, 8 aa, Homo sapiens
  light chain complementarity determining region 3 for antibody 22676
QDYGSSRT

SEQ ID NO: 45352 - protein, 15 aa, Homo sapiens
  heavy chain complementarity determining region 3 for antibody 22676
ASGSFDTLAGSYSEV

SEQ ID NO: 45353 - protein, 9 aa, Homo sapiens
  light chain complementarity determining region 3 for antibody 22677
QAYNNFFRT

SEQ ID NO: 45354 - protein, 11 aa, Homo sapiens
  heavy chain complementarity determining region 3 for antibody 22677
ARDRRAYGIDV

SEQ ID NO: 45355 - protein, 9 aa, Homo sapiens
  light chain complementarity determining region 3 for antibody 22678
QAYNIFFRT

SEQ ID NO: 45356 - protein, 11 aa, Homo sapiens
  heavy chain complementarity determining region 3 for antibody 22678
ARDRRAYGMDV

SEQ ID NO: 45357 - protein, 9 aa, Homo sapiens
  light chain complementarity determining region 3 for antibody 22679
QATQNFPYA

SEQ ID NO: 45358 - protein, 14 aa, Homo sapiens
  heavy chain complementarity determining region 3 for antibody 22679
TRTSWSDGWRFFHD

SEQ ID NO: 45359 - protein, 8 aa, Homo sapiens
  light chain complementarity determining region 3 for antibody 22680
PYYGSSPT

SEQ ID NO: 45360 - protein, 9 aa, Homo sapiens
  heavy chain complementarity determining region 3 for antibody 22680
ARGYDAFDF

SEQ ID NO: 45361 - protein, 9 aa, Homo sapiens
  light chain complementarity determining region 3 for antibody 22681
PYYGRSPWT

SEQ ID NO: 45362 - protein, 17 aa, Homo sapiens
  heavy chain complementarity determining region 3 for antibody 22681
ARTVLYHFTSGRAAFDV

SEQ ID NO: 45363 - protein, 8 aa, Homo sapiens
  light chain complementarity determining region 3 for antibody 22682
PQYYTTRS

SEQ ID NO: 45364 - protein, 9 aa, Homo sapiens
  heavy chain complementarity determining region 3 for antibody 22682
SIDNLGMGY

SEQ ID NO: 45365 - protein, 9 aa, Homo sapiens
  light chain complementarity determining region 3 for antibody 22683
PQYYTSVRT

SEQ ID NO: 45366 - protein, 12 aa, Homo sapiens
  heavy chain complementarity determining region 3 for antibody 22683
VKDCGLGGSRDS

SEQ ID NO: 45367 - protein, 9 aa, Homo sapiens
  light chain complementarity determining region 3 for antibody 22684
PQYYSTPRA

SEQ ID NO: 45368 - protein, 13 aa, Homo sapiens
  heavy chain complementarity determining region 3 for antibody 22684
AAVDPYYYYGMDV

SEQ ID NO: 45369 - protein, 9 aa, Homo sapiens
  light chain complementarity determining region 3 for antibody 22685
PQYYSSPRM

SEQ ID NO: 45370 - protein, 13 aa, Homo sapiens
  heavy chain complementarity determining region 3 for antibody 22685
ARGQSGDPRTYDY

SEQ ID NO: 45371 - protein, 9 aa, Homo sapiens
  light chain complementarity determining region 3 for antibody 22686
PQYYNNPPV

SEQ ID NO: 45372 - protein, 15 aa, Homo sapiens
  heavy chain complementarity determining region 3 for antibody 22686
ARAGRCGGDCFSLDY

SEQ ID NO: 45373 - protein, 10 aa, Homo sapiens
  light chain complementarity determining region 3 for antibody 22687
PQYYGTPPYT

SEQ ID NO: 45374 - protein, 17 aa, Homo sapiens
  heavy chain complementarity determining region 3 for antibody 22687
ARGVSFDNGWTDWYFGL

SEQ ID NO: 45375 - protein, 9 aa, Homo sapiens
  light chain complementarity determining region 3 for antibody 22688
PQYTNWPLT

SEQ ID NO: 45376 - protein, 16 aa, Homo sapiens
  heavy chain complementarity determining region 3 for antibody 22688
TRYCSSSNCALYGMDV

SEQ ID NO: 45377 - protein, 9 aa, Homo sapiens
  light chain complementarity determining region 3 for antibody 22689
PQYSSSPYT

SEQ ID NO: 45378 - protein, 13 aa, Homo sapiens
  heavy chain complementarity determining region 3 for antibody 22689
ARGTYSAFAIFGV

SEQ ID NO: 45379 - protein, 10 aa, Homo sapiens
  light chain complementarity determining region 3 for antibody 22690
PQYSSSPPWT

SEQ ID NO: 45380 - protein, 16 aa, Homo sapiens
  heavy chain complementarity determining region 3 for antibody 22690
ARRQWVRGLFRGGLDS

SEQ ID NO: 45381 - protein, 9 aa, Homo sapiens
  light chain complementarity determining region 3 for antibody 22691
PQYSSSLFA

SEQ ID NO: 45382 - protein, 15 aa, Homo sapiens
  heavy chain complementarity determining region 3 for antibody 22691
ARGGKSSSWLSYFDS

SEQ ID NO: 45383 - protein, 9 aa, Homo sapiens
  light chain complementarity determining region 3 for antibody 22692
PQYNRSPRT

SEQ ID NO: 45384 - protein, 16 aa, Homo sapiens
  heavy chain complementarity determining region 3 for antibody 22692
VKDFTGECHYGSWVDP

SEQ ID NO: 45385 - protein, 9 aa, Homo sapiens
  light chain complementarity determining region 3 for antibody 22693
PQYHSTPPT

SEQ ID NO: 45386 - protein, 20 aa, Homo sapiens
  heavy chain complementarity determining region 3 for antibody 22693
ARARSKTTVVTPTRQFASDI

SEQ ID NO: 45387 - protein, 9 aa, Homo sapiens
  light chain complementarity determining region 3 for antibody 22694
PQYGTSPRT

SEQ ID NO: 45388 - protein, 13 aa, Homo sapiens
  heavy chain complementarity determining region 3 for antibody 22694
PIGFYDRSGYHEY

SEQ ID NO: 45389 - protein, 9 aa, Homo sapiens
  light chain complementarity determining region 3 for antibody 22695
PQYGSWPWT

SEQ ID NO: 45390 - protein, 11 aa, Homo sapiens
  heavy chain complementarity determining region 3 for antibody 22695
ARDRYLGRVGY

SEQ ID NO: 45391 - protein, 9 aa, Homo sapiens
  light chain complementarity determining region 3 for antibody 22696
PQYGRIPRT

SEQ ID NO: 45392 - protein, 13 aa, Homo sapiens
  heavy chain complementarity determining region 3 for antibody 22696
AGGLFGSGTYSEF

SEQ ID NO: 45393 - protein, 9 aa, Homo sapiens
  light chain complementarity determining region 3 for antibody 22697
PQYGNSPRT

SEQ ID NO: 45394 - protein, 14 aa, Homo sapiens
  heavy chain complementarity determining region 3 for antibody 22697
ASDPVVGAPGYFDY

SEQ ID NO: 45395 - protein, 9 aa, Homo sapiens
  light chain complementarity determining region 3 for antibody 22698
PQYGNLPRT

SEQ ID NO: 45396 - protein, 13 aa, Homo sapiens
  heavy chain complementarity determining region 3 for antibody 22698
AGGQFHTSGYSEF

SEQ ID NO: 45397 - protein, 7 aa, Homo sapiens
  light chain complementarity determining region 3 for antibody 22699
PQYGGGT

SEQ ID NO: 45398 - protein, 15 aa, Homo sapiens
  heavy chain complementarity determining region 3 for antibody 22699
TAIVFFAGSVHIEQY

SEQ ID NO: 45399 - protein, 9 aa, Homo sapiens
  light chain complementarity determining region 3 for antibody 22700
PQYGDTPRT

SEQ ID NO: 45400 - protein, 16 aa, Homo sapiens
  heavy chain complementarity determining region 3 for antibody 22700
AGLSASGHLAPNTFDV

SEQ ID NO: 45401 - protein, 9 aa, Homo sapiens
  light chain complementarity determining region 3 for antibody 22701
PQYERSPQT

SEQ ID NO: 45402 - protein, 15 aa, Homo sapiens
  heavy chain complementarity determining region 3 for antibody 22701
ARDPTVASHHYGVDV

SEQ ID NO: 45403 - protein, 10 aa, Homo sapiens
  light chain complementarity determining region 3 for antibody 22702
PQYDNWPPWT

SEQ ID NO: 45404 - protein, 12 aa, Homo sapiens
  heavy chain complementarity determining region 3 for antibody 22702
AKTLRERKELDY

SEQ ID NO: 45405 - protein, 9 aa, Homo sapiens
  light chain complementarity determining region 3 for antibody 22703
PQSNSYPRT

SEQ ID NO: 45406 - protein, 9 aa, Homo sapiens
  heavy chain complementarity determining region 3 for antibody 22703
ARGAKEFEY

SEQ ID NO: 45407 - protein, 10 aa, Homo sapiens
  light chain complementarity determining region 3 for antibody 22704
PQRYNWPPYT

SEQ ID NO: 45408 - protein, 11 aa, Homo sapiens
  heavy chain complementarity determining region 3 for antibody 22704
ARGVGSYVFES

SEQ ID NO: 45409 - protein, 11 aa, Homo sapiens
  light chain complementarity determining region 3 for antibody 22705
PQRTNWPPIYT

SEQ ID NO: 45410 - protein, 14 aa, Homo sapiens
  heavy chain complementarity determining region 3 for antibody 22705
ARGGLGIWGNSSDI

SEQ ID NO: 45411 - protein, 10 aa, Homo sapiens
  light chain complementarity determining region 3 for antibody 22706
PQLNSYPRVT

SEQ ID NO: 45412 - protein, 19 aa, Homo sapiens
  heavy chain complementarity determining region 3 for antibody 22706
ARDRVEVPGTQVPYWYFDL

SEQ ID NO: 45413 - protein, 9 aa, Homo sapiens
  light chain complementarity determining region 3 for antibody 22707
PQHNSWPRT

SEQ ID NO: 45414 - protein, 14 aa, Homo sapiens
  heavy chain complementarity determining region 3 for antibody 22707
ARGGDYEYPDVFDI

SEQ ID NO: 45415 - protein, 9 aa, Homo sapiens
  light chain complementarity determining region 3 for antibody 22708
PQHGTSPRT

SEQ ID NO: 45416 - protein, 13 aa, Homo sapiens
  heavy chain complementarity determining region 3 for antibody 22708
PIGFYDRSGYHEY

SEQ ID NO: 45417 - protein, 9 aa, Homo sapiens
  light chain complementarity determining region 3 for antibody 22709
PQGYRTPFT

SEQ ID NO: 45418 - protein, 15 aa, Homo sapiens
  heavy chain complementarity determining region 3 for antibody 22709
AKAQVIWGQLYYFES

SEQ ID NO: 45419 - protein, 9 aa, Homo sapiens
  light chain complementarity determining region 3 for antibody 22710
PQGNRFPHT

SEQ ID NO: 45420 - protein, 14 aa, Homo sapiens
  heavy chain complementarity determining region 3 for antibody 22710
ARYCSGNSCYSMDH

SEQ ID NO: 45421 - protein, 9 aa, Homo sapiens
  light chain complementarity determining region 3 for antibody 22711
PQFYGSPWT

SEQ ID NO: 45422 - protein, 16 aa, Homo sapiens
  heavy chain complementarity determining region 3 for antibody 22711
IRQDYYDTSGFSYPAT

SEQ ID NO: 45423 - protein, 11 aa, Homo sapiens
  light chain complementarity determining region 3 for antibody 22712
PLYETSPPGDT

SEQ ID NO: 45424 - protein, 14 aa, Homo sapiens
  heavy chain complementarity determining region 3 for antibody 22712
ARENSISRKRSFDQ

SEQ ID NO: 45425 - protein, 9 aa, Homo sapiens
  light chain complementarity determining region 3 for antibody 22713
PKYNSVPLT

SEQ ID NO: 45426 - protein, 10 aa, Homo sapiens
  heavy chain complementarity determining region 3 for antibody 22713
AREFYYGIDV

SEQ ID NO: 45427 - protein, 9 aa, Homo sapiens
  light chain complementarity determining region 3 for antibody 22714
PHYSSSPYT

SEQ ID NO: 45428 - protein, 13 aa, Homo sapiens
  heavy chain complementarity determining region 3 for antibody 22714
ARGTYSAFAIFGV

SEQ ID NO: 45429 - protein, 10 aa, Homo sapiens
  light chain complementarity determining region 3 for antibody 22715
PHYHNWPPWT

SEQ ID NO: 45430 - protein, 13 aa, Homo sapiens
  heavy chain complementarity determining region 3 for antibody 22715
AKGRVRELYYFDT

SEQ ID NO: 45431 - protein, 10 aa, Homo sapiens
  light chain complementarity determining region 3 for antibody 22716
PHYHNLPPWT

SEQ ID NO: 45432 - protein, 13 aa, Homo sapiens
  heavy chain complementarity determining region 3 for antibody 22716
AKGRVRELYYFET

SEQ ID NO: 45433 - protein, 9 aa, Homo sapiens
  light chain complementarity determining region 3 for antibody 22717
PHRRTWLYS

SEQ ID NO: 45434 - protein, 20 aa, Homo sapiens
  heavy chain complementarity determining region 3 for antibody 22717
ARDGSAGMAARGTPYYGLDV

SEQ ID NO: 45435 - protein, 8 aa, Homo sapiens
  light chain complementarity determining region 3 for antibody 22718
PHLNSYPR

SEQ ID NO: 45436 - protein, 18 aa, Homo sapiens
  heavy chain complementarity determining region 3 for antibody 22718
ARDRAMTGPRGPSYVFDS

SEQ ID NO: 45437 - protein, 9 aa, Homo sapiens
  light chain complementarity determining region 3 for antibody 22719
NQYSSSPYT

SEQ ID NO: 45438 - protein, 13 aa, Homo sapiens
  heavy chain complementarity determining region 3 for antibody 22719
ARGTYSAFAIFGV

SEQ ID NO: 45439 - protein, 9 aa, Homo sapiens
  light chain complementarity determining region 3 for antibody 22720
NQYGSSPQT

SEQ ID NO: 45440 - protein, 9 aa, Homo sapiens
  heavy chain complementarity determining region 3 for antibody 22720
SRGYDISGC

SEQ ID NO: 45441 - protein, 9 aa, Homo sapiens
  light chain complementarity determining region 3 for antibody 22721
MYTLQTQLT

SEQ ID NO: 45442 - protein, 24 aa, Homo sapiens
  heavy chain complementarity determining region 3 for antibody 22721
ARAVGCDGTNCHAAWGFYYYALDV

SEQ ID NO: 45443 - protein, 9 aa, Homo sapiens
  light chain complementarity determining region 3 for antibody 22722
MYTLQTQLA

SEQ ID NO: 45444 - protein, 24 aa, Homo sapiens
  heavy chain complementarity determining region 3 for antibody 22722
ARAVGCDGTNCHAAWGFYYYALDV

SEQ ID NO: 45445 - protein, 9 aa, Homo sapiens
  light chain complementarity determining region 3 for antibody 22723
MRALETPFT

SEQ ID NO: 45446 - protein, 15 aa, Homo sapiens
  heavy chain complementarity determining region 3 for antibody 22723
VRHYRETVAGIEGDS

SEQ ID NO: 45447 - protein, 9 aa, Homo sapiens
  light chain complementarity determining region 3 for antibody 22724
MRALETPFP

SEQ ID NO: 45448 - protein, 15 aa, Homo sapiens
  heavy chain complementarity determining region 3 for antibody 22724
VRHYRELATGIEGDS

SEQ ID NO: 45449 - protein, 9 aa, Homo sapiens
  light chain complementarity determining region 3 for antibody 22725
MQVLQVPHT

SEQ ID NO: 45450 - protein, 14 aa, Homo sapiens
  heavy chain complementarity determining region 3 for antibody 22725
TSGLVRRGARVLDI

SEQ ID NO: 45451 - protein, 9 aa, Homo sapiens
  light chain complementarity determining region 3 for antibody 22726
MQVLQVPHT

SEQ ID NO: 45452 - protein, 14 aa, Homo sapiens
  heavy chain complementarity determining region 3 for antibody 22726
SSGLVRRGARVFDI

SEQ ID NO: 45453 - protein, 9 aa, Homo sapiens
  light chain complementarity determining region 3 for antibody 22727
MQVLQVPHT

SEQ ID NO: 45454 - protein, 14 aa, Homo sapiens
  heavy chain complementarity determining region 3 for antibody 22727
PSGLVRRGARVFDI

SEQ ID NO: 45455 - protein, 9 aa, Homo sapiens
  light chain complementarity determining region 3 for antibody 22728
MQVLQVPHT

SEQ ID NO: 45456 - protein, 14 aa, Homo sapiens
  heavy chain complementarity determining region 3 for antibody 22728
ASGLVRRGARVFDI

SEQ ID NO: 45457 - protein, 9 aa, Homo sapiens
  light chain complementarity determining region 3 for antibody 22729
MQVLQVPHA

SEQ ID NO: 45458 - protein, 14 aa, Homo sapiens
  heavy chain complementarity determining region 3 for antibody 22729
TSGLVRRGARVFDI

SEQ ID NO: 45459 - protein, 9 aa, Homo sapiens
  light chain complementarity determining region 3 for antibody 22730
MQVLQTPYN

SEQ ID NO: 45460 - protein, 10 aa, Homo sapiens
  heavy chain complementarity determining region 3 for antibody 22730
TPGRSAWYDK

SEQ ID NO: 45461 - protein, 8 aa, Homo sapiens
  light chain complementarity determining region 3 for antibody 22731
MQVLQTPT

SEQ ID NO: 45462 - protein, 15 aa, Homo sapiens
  heavy chain complementarity determining region 3 for antibody 22731
ARRDYYDSSGYRLDY

SEQ ID NO: 45463 - protein, 9 aa, Homo sapiens
  light chain complementarity determining region 3 for antibody 22732
MQVLQTPPT

SEQ ID NO: 45464 - protein, 15 aa, Homo sapiens
  heavy chain complementarity determining region 3 for antibody 22732
ARDGLRDGFSDAFDI

SEQ ID NO: 45465 - protein, 9 aa, Homo sapiens
  light chain complementarity determining region 3 for antibody 22733
MQVLQIPLT

SEQ ID NO: 45466 - protein, 12 aa, Homo sapiens
  heavy chain complementarity determining region 3 for antibody 22733
VKDGETNWGSWH

SEQ ID NO: 45467 - protein, 9 aa, Homo sapiens
  light chain complementarity determining region 3 for antibody 22734
MQVLQAPLT

SEQ ID NO: 45468 - protein, 19 aa, Homo sapiens
  heavy chain complementarity determining region 3 for antibody 22734
AFLLPDMYYSDGSASLLPY

SEQ ID NO: 45469 - protein, 9 aa, Homo sapiens
  light chain complementarity determining region 3 for antibody 22735
MQVLQAPLS

SEQ ID NO: 45470 - protein, 18 aa, Homo sapiens
  heavy chain complementarity determining region 3 for antibody 22735
ARPKVGATDYHYYCGIDV

SEQ ID NO: 45471 - protein, 9 aa, Homo sapiens
  light chain complementarity determining region 3 for antibody 22736
MQVLQAPFS

SEQ ID NO: 45472 - protein, 18 aa, Homo sapiens
  heavy chain complementarity determining region 3 for antibody 22736
ARPKVGATDYHYYFGIDV

SEQ ID NO: 45473 - protein, 9 aa, Homo sapiens
  light chain complementarity determining region 3 for antibody 22737
MQVLPVPHT

SEQ ID NO: 45474 - protein, 14 aa, Homo sapiens
  heavy chain complementarity determining region 3 for antibody 22737
TSGLVRRGARVFDI

SEQ ID NO: 45475 - protein, 9 aa, Homo sapiens
  light chain complementarity determining region 3 for antibody 22738
MQVLPTPLT

SEQ ID NO: 45476 - protein, 19 aa, Homo sapiens
  heavy chain complementarity determining region 3 for antibody 22738
AFLLPDMYYSDGSASLLPY

SEQ ID NO: 45477 - protein, 9 aa, Homo sapiens
  light chain complementarity determining region 3 for antibody 22739
MQVLHVPHT

SEQ ID NO: 45478 - protein, 14 aa, Homo sapiens
  heavy chain complementarity determining region 3 for antibody 22739
TSGLVRRGARVFDI

SEQ ID NO: 45479 - protein, 9 aa, Homo sapiens
  light chain complementarity determining region 3 for antibody 22740
MQVLHTPLT

SEQ ID NO: 45480 - protein, 19 aa, Homo sapiens
  heavy chain complementarity determining region 3 for antibody 22740
AFLLPDMYYSDGSASLLPY

SEQ ID NO: 45481 - protein, 9 aa, Homo sapiens
  light chain complementarity determining region 3 for antibody 22741
MQVLETPLT

SEQ ID NO: 45482 - protein, 15 aa, Homo sapiens
  heavy chain complementarity determining region 3 for antibody 22741
VRHYRETVAGIEGDS

SEQ ID NO: 45483 - protein, 9 aa, Homo sapiens
  light chain complementarity determining region 3 for antibody 22742
MQVLETPFT

SEQ ID NO: 45484 - protein, 15 aa, Homo sapiens
  heavy chain complementarity determining region 3 for antibody 22742
VRHYRELTTGIEGDS

SEQ ID NO: 45485 - protein, 9 aa, Homo sapiens
  light chain complementarity determining region 3 for antibody 22743
MQVLETPFP

SEQ ID NO: 45486 - protein, 15 aa, Homo sapiens
  heavy chain complementarity determining region 3 for antibody 22743
VRHYRIITAPLEGDS

SEQ ID NO: 45487 - protein, 9 aa, Homo sapiens
  light chain complementarity determining region 3 for antibody 22744
MQVLEPPFT

SEQ ID NO: 45488 - protein, 15 aa, Homo sapiens
  heavy chain complementarity determining region 3 for antibody 22744
VRHYRELATGIEGDS

SEQ ID NO: 45489 - protein, 9 aa, Homo sapiens
  light chain complementarity determining region 3 for antibody 22745
MQVLEIPFT

SEQ ID NO: 45490 - protein, 15 aa, Homo sapiens
  heavy chain complementarity determining region 3 for antibody 22745
VRHYRIITAPLEGDS

SEQ ID NO: 45491 - protein, 9 aa, Homo sapiens
  light chain complementarity determining region 3 for antibody 22746
MQVIETPFT

SEQ ID NO: 45492 - protein, 15 aa, Homo sapiens
  heavy chain complementarity determining region 3 for antibody 22746
VRHYRETVAGIEGDS

SEQ ID NO: 45493 - protein, 9 aa, Homo sapiens
  light chain complementarity determining region 3 for antibody 22747
MQTTPWPYT

SEQ ID NO: 45494 - protein, 15 aa, Homo sapiens
  heavy chain complementarity determining region 3 for antibody 22747
ARGPLRFAGNEGLDY

SEQ ID NO: 45495 - protein, 9 aa, Homo sapiens
  light chain complementarity determining region 3 for antibody 22748
MQTTLWPYP

SEQ ID NO: 45496 - protein, 15 aa, Homo sapiens
  heavy chain complementarity determining region 3 for antibody 22748
ARGPLRFAGNEGLDY

SEQ ID NO: 45497 - protein, 9 aa, Homo sapiens
  light chain complementarity determining region 3 for antibody 22749
MQTTLWPNT

SEQ ID NO: 45498 - protein, 15 aa, Homo sapiens
  heavy chain complementarity determining region 3 for antibody 22749
ARGPLRFAGNEGLDY

SEQ ID NO: 45499 - protein, 9 aa, Homo sapiens
  light chain complementarity determining region 3 for antibody 22750
MQTTLGPYT

SEQ ID NO: 45500 - protein, 15 aa, Homo sapiens
  heavy chain complementarity determining region 3 for antibody 22750
ARGPLRFAGNDGLDY

SEQ ID NO: 45501 - protein, 9 aa, Homo sapiens
  light chain complementarity determining region 3 for antibody 22751
MQTTLCPYT

SEQ ID NO: 45502 - protein, 15 aa, Homo sapiens
  heavy chain complementarity determining region 3 for antibody 22751
ARGPLRFAGNEGLDY

SEQ ID NO: 45503 - protein, 9 aa, Homo sapiens
  light chain complementarity determining region 3 for antibody 22752
MQTLQTPTT

SEQ ID NO: 45504 - protein, 16 aa, Homo sapiens
  heavy chain complementarity determining region 3 for antibody 22752
TMDLFALGLSSGCLDY

SEQ ID NO: 45505 - protein, 9 aa, Homo sapiens
  light chain complementarity determining region 3 for antibody 22753
MQTLQTPTT

SEQ ID NO: 45506 - protein, 16 aa, Homo sapiens
  heavy chain complementarity determining region 3 for antibody 22753
PMDLFALGLSSGCHDY

SEQ ID NO: 45507 - protein, 9 aa, Homo sapiens
  light chain complementarity determining region 3 for antibody 22754
MQTLQTPLT

SEQ ID NO: 45508 - protein, 18 aa, Homo sapiens
  heavy chain complementarity determining region 3 for antibody 22754
AKGFTIFGVIAGFDAFDP

SEQ ID NO: 45509 - protein, 9 aa, Homo sapiens
  light chain complementarity determining region 3 for antibody 22755
MQTLQTPHT

SEQ ID NO: 45510 - protein, 16 aa, Homo sapiens
  heavy chain complementarity determining region 3 for antibody 22755
TMDLFALGLSSGCHDY

SEQ ID NO: 45511 - protein, 9 aa, Homo sapiens
  light chain complementarity determining region 3 for antibody 22756
MQTLQIPYT

SEQ ID NO: 45512 - protein, 14 aa, Homo sapiens
  heavy chain complementarity determining region 3 for antibody 22756
ARDHYHDRSVFLDY

SEQ ID NO: 45513 - protein, 9 aa, Homo sapiens
  light chain complementarity determining region 3 for antibody 22757
MQTLQIPST

SEQ ID NO: 45514 - protein, 14 aa, Homo sapiens
  heavy chain complementarity determining region 3 for antibody 22757
ARDHYHDRSVILDY

SEQ ID NO: 45515 - protein, 9 aa, Homo sapiens
  light chain complementarity determining region 3 for antibody 22758
MQTLHTPPT

SEQ ID NO: 45516 - protein, 16 aa, Homo sapiens
  heavy chain complementarity determining region 3 for antibody 22758
TMDLFALGLSSGCHDY

SEQ ID NO: 45517 - protein, 9 aa, Homo sapiens
  light chain complementarity determining region 3 for antibody 22759
MQTLHIPYT

SEQ ID NO: 45518 - protein, 14 aa, Homo sapiens
  heavy chain complementarity determining region 3 for antibody 22759
ARDHYHDRSVILDY

SEQ ID NO: 45519 - protein, 9 aa, Homo sapiens
  light chain complementarity determining region 3 for antibody 22760
MQTLETPFT

SEQ ID NO: 45520 - protein, 15 aa, Homo sapiens
  heavy chain complementarity determining region 3 for antibody 22760
VRHYRIITAPLEGDS

SEQ ID NO: 45521 - protein, 9 aa, Homo sapiens
  light chain complementarity determining region 3 for antibody 22761
MQTIQLPRT

SEQ ID NO: 45522 - protein, 10 aa, Homo sapiens
  heavy chain complementarity determining region 3 for antibody 22761
TTLDVWLLDY

SEQ ID NO: 45523 - protein, 9 aa, Homo sapiens
  light chain complementarity determining region 3 for antibody 22762
MQTIQIPYT

SEQ ID NO: 45524 - protein, 14 aa, Homo sapiens
  heavy chain complementarity determining region 3 for antibody 22762
ARDHYHDRSVILDY

SEQ ID NO: 45525 - protein, 10 aa, Homo sapiens
  light chain complementarity determining region 3 for antibody 22763
MQSVQFPRWP

SEQ ID NO: 45526 - protein, 8 aa, Homo sapiens
  heavy chain complementarity determining region 3 for antibody 22763
AKGYGFDS

SEQ ID NO: 45527 - protein, 9 aa, Homo sapiens
  light chain complementarity determining region 3 for antibody 22764
MQSVLLPQP

SEQ ID NO: 45528 - protein, 10 aa, Homo sapiens
  heavy chain complementarity determining region 3 for antibody 22764
AREVRHYFET

SEQ ID NO: 45529 - protein, 8 aa, Homo sapiens
  light chain complementarity determining region 3 for antibody 22765
MQSTQWPR

SEQ ID NO: 45530 - protein, 21 aa, Homo sapiens
  heavy chain complementarity determining region 3 for antibody 22765
AKDRPNYYGSNAGYYTPGGDR

SEQ ID NO: 45531 - protein, 8 aa, Homo sapiens
  light chain complementarity determining region 3 for antibody 22766
MQSTQWPP

SEQ ID NO: 45532 - protein, 21 aa, Homo sapiens
  heavy chain complementarity determining region 3 for antibody 22766
AKDRPNYYGTNAGYYTPGGDL

SEQ ID NO: 45533 - protein, 8 aa, Homo sapiens
  light chain complementarity determining region 3 for antibody 22767
MQSTQGPT

SEQ ID NO: 45534 - protein, 21 aa, Homo sapiens
  heavy chain complementarity determining region 3 for antibody 22767
AKDRPNYYGTNAGYYTPGGDL

SEQ ID NO: 45535 - protein, 8 aa, Homo sapiens
  light chain complementarity determining region 3 for antibody 22768
MQSTQGPP

SEQ ID NO: 45536 - protein, 21 aa, Homo sapiens
  heavy chain complementarity determining region 3 for antibody 22768
AKDRPNYYGSNAGYYTPGGDR

SEQ ID NO: 45537 - protein, 8 aa, Homo sapiens
  light chain complementarity determining region 3 for antibody 22769
MQSTQGPP

SEQ ID NO: 45538 - protein, 21 aa, Homo sapiens
  heavy chain complementarity determining region 3 for antibody 22769
AKDRPNYYGSNAGYYTPGGDL

SEQ ID NO: 45539 - protein, 9 aa, Homo sapiens
  light chain complementarity determining region 3 for antibody 22770
MQSTNWRYT

SEQ ID NO: 45540 - protein, 12 aa, Homo sapiens
  heavy chain complementarity determining region 3 for antibody 22770
ARDKSNHNPLVY

SEQ ID NO: 45541 - protein, 9 aa, Homo sapiens
  light chain complementarity determining region 3 for antibody 22771
MQSTHWRYT

SEQ ID NO: 45542 - protein, 12 aa, Homo sapiens
  heavy chain complementarity determining region 3 for antibody 22771
ARDKSNHNPLVY

SEQ ID NO: 45543 - protein, 9 aa, Homo sapiens
  light chain complementarity determining region 3 for antibody 22772
MQSTHWPST

SEQ ID NO: 45544 - protein, 10 aa, Homo sapiens
  heavy chain complementarity determining region 3 for antibody 22772
ARYSSDWESY

SEQ ID NO: 45545 - protein, 9 aa, Homo sapiens
  light chain complementarity determining region 3 for antibody 22773
MQSSRWPHT

SEQ ID NO: 45546 - protein, 8 aa, Homo sapiens
  heavy chain complementarity determining region 3 for antibody 22773
TAWGSSQH

SEQ ID NO: 45547 - protein, 9 aa, Homo sapiens
  light chain complementarity determining region 3 for antibody 22774
MQSRRWPQT

SEQ ID NO: 45548 - protein, 8 aa, Homo sapiens
  heavy chain complementarity determining region 3 for antibody 22774
TAWGSSQH

SEQ ID NO: 45549 - protein, 9 aa, Homo sapiens
  light chain complementarity determining region 3 for antibody 22775
MQSRRWPPT

SEQ ID NO: 45550 - protein, 8 aa, Homo sapiens
  heavy chain complementarity determining region 3 for antibody 22775
TAWGSSHH

SEQ ID NO: 45551 - protein, 9 aa, Homo sapiens
  light chain complementarity determining region 3 for antibody 22776
MQSRRGPHP

SEQ ID NO: 45552 - protein, 8 aa, Homo sapiens
  heavy chain complementarity determining region 3 for antibody 22776
TAWGSSHH

SEQ ID NO: 45553 - protein, 10 aa, Homo sapiens
  light chain complementarity determining region 3 for antibody 22777
MQSLQFPRWT

SEQ ID NO: 45554 - protein, 8 aa, Homo sapiens
  heavy chain complementarity determining region 3 for antibody 22777
AKGYGFDS

SEQ ID NO: 45555 - protein, 9 aa, Homo sapiens
  light chain complementarity determining region 3 for antibody 22778
MQSLKTPLA

SEQ ID NO: 45556 - protein, 18 aa, Homo sapiens
  heavy chain complementarity determining region 3 for antibody 22778
AIGYYGSGSYYTCYGFDP

SEQ ID NO: 45557 - protein, 10 aa, Homo sapiens
  light chain complementarity determining region 3 for antibody 22779
MQSIQPPRRT

SEQ ID NO: 45558 - protein, 8 aa, Homo sapiens
  heavy chain complementarity determining region 3 for antibody 22779
AKGYGFDC

SEQ ID NO: 45559 - protein, 10 aa, Homo sapiens
  light chain complementarity determining region 3 for antibody 22780
MQSIQPPGWR

SEQ ID NO: 45560 - protein, 8 aa, Homo sapiens
  heavy chain complementarity determining region 3 for antibody 22780
AKGYGFDC

SEQ ID NO: 45561 - protein, 10 aa, Homo sapiens
  light chain complementarity determining region 3 for antibody 22781
MQSGKSPRWT

SEQ ID NO: 45562 - protein, 8 aa, Homo sapiens
  heavy chain complementarity determining region 3 for antibody 22781
AKGYGLDS

SEQ ID NO: 45563 - protein, 10 aa, Homo sapiens
  light chain complementarity determining region 3 for antibody 22782
MQRVQFPRGT

SEQ ID NO: 45564 - protein, 8 aa, Homo sapiens
  heavy chain complementarity determining region 3 for antibody 22782
AKGYGFDS

SEQ ID NO: 45565 - protein, 8 aa, Homo sapiens
  light chain complementarity determining region 3 for antibody 22783
MQRTQGPT

SEQ ID NO: 45566 - protein, 21 aa, Homo sapiens
  heavy chain complementarity determining region 3 for antibody 22783
AKDRPNYYGTNAGYYTPGGDL

SEQ ID NO: 45567 - protein, 8 aa, Homo sapiens
  light chain complementarity determining region 3 for antibody 22784
MQRTKWPT

SEQ ID NO: 45568 - protein, 21 aa, Homo sapiens
  heavy chain complementarity determining region 3 for antibody 22784
AKDRPNYYGSNAGYYTPGGDL

SEQ ID NO: 45569 - protein, 10 aa, Homo sapiens
  light chain complementarity determining region 3 for antibody 22785
MQRIQPPRWT

SEQ ID NO: 45570 - protein, 8 aa, Homo sapiens
  heavy chain complementarity determining region 3 for antibody 22785
AKGYGFDC

SEQ ID NO: 45571 - protein, 9 aa, Homo sapiens
  light chain complementarity determining region 3 for antibody 22786
MQPLQTPTT

SEQ ID NO: 45572 - protein, 16 aa, Homo sapiens
  heavy chain complementarity determining region 3 for antibody 22786
TMDLFALGLSSGCHDY

SEQ ID NO: 45573 - protein, 9 aa, Homo sapiens
  light chain complementarity determining region 3 for antibody 22787
MQPLKIPPT

SEQ ID NO: 45574 - protein, 16 aa, Homo sapiens
  heavy chain complementarity determining region 3 for antibody 22787
ARIPTFYYVSGRNPDY

SEQ ID NO: 45575 - protein, 9 aa, Homo sapiens
  light chain complementarity determining region 3 for antibody 22788
MQPLHTPFT

SEQ ID NO: 45576 - protein, 18 aa, Homo sapiens
  heavy chain complementarity determining region 3 for antibody 22788
ARPFYDSYTYHYYYGLDV

SEQ ID NO: 45577 - protein, 9 aa, Homo sapiens
  light chain complementarity determining region 3 for antibody 22789
MQPLETPFT

SEQ ID NO: 45578 - protein, 15 aa, Homo sapiens
  heavy chain complementarity determining region 3 for antibody 22789
VRHYRIITAPLEGDS

SEQ ID NO: 45579 - protein, 9 aa, Homo sapiens
  light chain complementarity determining region 3 for antibody 22790
MQPLEIPFT

SEQ ID NO: 45580 - protein, 15 aa, Homo sapiens
  heavy chain complementarity determining region 3 for antibody 22790
VRHYRIITAPLEGDS

SEQ ID NO: 45581 - protein, 9 aa, Homo sapiens
  light chain complementarity determining region 3 for antibody 22791
MQHLQTLPT

SEQ ID NO: 45582 - protein, 11 aa, Homo sapiens
  heavy chain complementarity determining region 3 for antibody 22791
AKAGTEGTTDR

SEQ ID NO: 45583 - protein, 8 aa, Homo sapiens
  light chain complementarity determining region 3 for antibody 22792
MQGVQPYP

SEQ ID NO: 45584 - protein, 7 aa, Homo sapiens
  heavy chain complementarity determining region 3 for antibody 22792
AAKMGDY

SEQ ID NO: 45585 - protein, 10 aa, Homo sapiens
  light chain complementarity determining region 3 for antibody 22793
MQGTYWPPWT

SEQ ID NO: 45586 - protein, 13 aa, Homo sapiens
  heavy chain complementarity determining region 3 for antibody 22793
VRDGDSTTWPLDV

SEQ ID NO: 45587 - protein, 10 aa, Homo sapiens
  light chain complementarity determining region 3 for antibody 22794
MQGTYWPPRT

SEQ ID NO: 45588 - protein, 13 aa, Homo sapiens
  heavy chain complementarity determining region 3 for antibody 22794
VRDGDSTTWPLDF

SEQ ID NO: 45589 - protein, 9 aa, Homo sapiens
  light chain complementarity determining region 3 for antibody 22795
MQGTQWPWP

SEQ ID NO: 45590 - protein, 15 aa, Homo sapiens
  heavy chain complementarity determining region 3 for antibody 22795
VRFPPDLDIVGMIDH

SEQ ID NO: 45591 - protein, 11 aa, Homo sapiens
  light chain complementarity determining region 3 for antibody 22796
MQGTQLVPPFT

SEQ ID NO: 45592 - protein, 16 aa, Homo sapiens
  heavy chain complementarity determining region 3 for antibody 22796
ARENSILYNYYSGVDV

SEQ ID NO: 45593 - protein, 9 aa, Homo sapiens
  light chain complementarity determining region 3 for antibody 22797
MQGTQGPWP

SEQ ID NO: 45594 - protein, 15 aa, Homo sapiens
  heavy chain complementarity determining region 3 for antibody 22797
VRFPPDLDIVGMIDH

SEQ ID NO: 45595 - protein, 8 aa, Homo sapiens
  light chain complementarity determining region 3 for antibody 22798
MQGTQGPT

SEQ ID NO: 45596 - protein, 21 aa, Homo sapiens
  heavy chain complementarity determining region 3 for antibody 22798
AKDRPNYYGSNAGYYTPGGDL

SEQ ID NO: 45597 - protein, 9 aa, Homo sapiens
  light chain complementarity determining region 3 for antibody 22799
MQGTQGPRT

SEQ ID NO: 45598 - protein, 13 aa, Homo sapiens
  heavy chain complementarity determining region 3 for antibody 22799
TRDPGVFYGGMDV

SEQ ID NO: 45599 - protein, 11 aa, Homo sapiens
  light chain complementarity determining region 3 for antibody 22800
MQGTQGPPMYT

SEQ ID NO: 45600 - protein, 17 aa, Homo sapiens
  heavy chain complementarity determining region 3 for antibody 22800
ARGGSGYYQEGDDTFGF

SEQ ID NO: 45601 - protein, 9 aa, Homo sapiens
  light chain complementarity determining region 3 for antibody 22801
MQGTQGPGT

SEQ ID NO: 45602 - protein, 15 aa, Homo sapiens
  heavy chain complementarity determining region 3 for antibody 22801
VRFPPDLDIVGMIDH

SEQ ID NO: 45603 - protein, 9 aa, Homo sapiens
  light chain complementarity determining region 3 for antibody 22802
MQGTPWPWT

SEQ ID NO: 45604 - protein, 15 aa, Homo sapiens
  heavy chain complementarity determining region 3 for antibody 22802
VRFPPDLDIVGMIDH

SEQ ID NO: 45605 - protein, 10 aa, Homo sapiens
  light chain complementarity determining region 3 for antibody 22803
MQGTPWPPYT

SEQ ID NO: 45606 - protein, 13 aa, Homo sapiens
  heavy chain complementarity determining region 3 for antibody 22803
VRDWAIWHQEFDL

SEQ ID NO: 45607 - protein, 10 aa, Homo sapiens
  light chain complementarity determining region 3 for antibody 22804
MQGTPWPPRT

SEQ ID NO: 45608 - protein, 11 aa, Homo sapiens
  heavy chain complementarity determining region 3 for antibody 22804
ARDDGTAGEDF

SEQ ID NO: 45609 - protein, 9 aa, Homo sapiens
  light chain complementarity determining region 3 for antibody 22805
MQGTPWPLT

SEQ ID NO: 45610 - protein, 11 aa, Homo sapiens
  heavy chain complementarity determining region 3 for antibody 22805
ARGVLDPAFAV

SEQ ID NO: 45611 - protein, 9 aa, Homo sapiens
  light chain complementarity determining region 3 for antibody 22806
MQGTNWPWT

SEQ ID NO: 45612 - protein, 10 aa, Homo sapiens
  heavy chain complementarity determining region 3 for antibody 22806
ARETHWGPDY

SEQ ID NO: 45613 - protein, 9 aa, Homo sapiens
  light chain complementarity determining region 3 for antibody 22807
MQGTNWPWT

SEQ ID NO: 45614 - protein, 12 aa, Homo sapiens
  heavy chain complementarity determining region 3 for antibody 22807
APSFTLFGVDDS

SEQ ID NO: 45615 - protein, 9 aa, Homo sapiens
  light chain complementarity determining region 3 for antibody 22808
MQGTNWPLT

SEQ ID NO: 45616 - protein, 11 aa, Homo sapiens
  heavy chain complementarity determining region 3 for antibody 22808
ARGVLDPAFAV

SEQ ID NO: 45617 - protein, 9 aa, Homo sapiens
  light chain complementarity determining region 3 for antibody 22809
MQGTNWPKT

SEQ ID NO: 45618 - protein, 11 aa, Homo sapiens
  heavy chain complementarity determining region 3 for antibody 22809
SRGNSSSWYDY

SEQ ID NO: 45619 - protein, 9 aa, Homo sapiens
  light chain complementarity determining region 3 for antibody 22810
MQGTNWPAN

SEQ ID NO: 45620 - protein, 14 aa, Homo sapiens
  heavy chain complementarity determining region 3 for antibody 22810
AKSPLKTGVTDFDY

SEQ ID NO: 45621 - protein, 11 aa, Homo sapiens
  light chain complementarity determining region 3 for antibody 22811
MQGTNLVPPFT

SEQ ID NO: 45622 - protein, 16 aa, Homo sapiens
  heavy chain complementarity determining region 3 for antibody 22811
ARENSILYNYYSGVDV

SEQ ID NO: 45623 - protein, 9 aa, Homo sapiens
  light chain complementarity determining region 3 for antibody 22812
MQGTNGPKR

SEQ ID NO: 45624 - protein, 11 aa, Homo sapiens
  heavy chain complementarity determining region 3 for antibody 22812
SRGNSSSWYDY

SEQ ID NO: 45625 - protein, 9 aa, Homo sapiens
  light chain complementarity determining region 3 for antibody 22813
MQGTNCPWT

SEQ ID NO: 45626 - protein, 12 aa, Homo sapiens
  heavy chain complementarity determining region 3 for antibody 22813
ATSFTLFGVDDS

SEQ ID NO: 45627 - protein, 9 aa, Homo sapiens
  light chain complementarity determining region 3 for antibody 22814
MQGTHWRVT

SEQ ID NO: 45628 - protein, 11 aa, Homo sapiens
  heavy chain complementarity determining region 3 for antibody 22814
ARGVLDPAFAV

SEQ ID NO: 45629 - protein, 8 aa, Homo sapiens
  light chain complementarity determining region 3 for antibody 22815
MQGTHWRT

SEQ ID NO: 45630 - protein, 21 aa, Homo sapiens
  heavy chain complementarity determining region 3 for antibody 22815
AKDRPNYYESNGQYYTPKGDL

SEQ ID NO: 45631 - protein, 9 aa, Homo sapiens
  light chain complementarity determining region 3 for antibody 22816
MQGTHWPWT

SEQ ID NO: 45632 - protein, 10 aa, Homo sapiens
  heavy chain complementarity determining region 3 for antibody 22816
AREAHWGPDY

SEQ ID NO: 45633 - protein, 9 aa, Homo sapiens
  light chain complementarity determining region 3 for antibody 22817
MQGTHWPWP

SEQ ID NO: 45634 - protein, 10 aa, Homo sapiens
  heavy chain complementarity determining region 3 for antibody 22817
ARETHWGPDY

SEQ ID NO: 45635 - protein, 8 aa, Homo sapiens
  light chain complementarity determining region 3 for antibody 22818
MQGTHWPT

SEQ ID NO: 45636 - protein, 21 aa, Homo sapiens
  heavy chain complementarity determining region 3 for antibody 22818
AKDRPNYYESNSQYYTPKGDL

SEQ ID NO: 45637 - protein, 8 aa, Homo sapiens
  light chain complementarity determining region 3 for antibody 22819
MQGTHWPT

SEQ ID NO: 45638 - protein, 21 aa, Homo sapiens
  heavy chain complementarity determining region 3 for antibody 22819
AKDRPNYYESNGQYYAPKGDL

SEQ ID NO: 45639 - protein, 8 aa, Homo sapiens
  light chain complementarity determining region 3 for antibody 22820
MQGTHWPT

SEQ ID NO: 45640 - protein, 21 aa, Homo sapiens
  heavy chain complementarity determining region 3 for antibody 22820
AKDRPNDYESNGQYYTPKGDL

SEQ ID NO: 45641 - protein, 9 aa, Homo sapiens
  light chain complementarity determining region 3 for antibody 22821
MQGTHWPRT

SEQ ID NO: 45642 - protein, 19 aa, Homo sapiens
  heavy chain complementarity determining region 3 for antibody 22821
ARDLAYGYVWGSTRYSFDY

SEQ ID NO: 45643 - protein, 9 aa, Homo sapiens
  light chain complementarity determining region 3 for antibody 22822
MQGTHWPRP

SEQ ID NO: 45644 - protein, 12 aa, Homo sapiens
  heavy chain complementarity determining region 3 for antibody 22822
ATLSMANAKFDH

SEQ ID NO: 45645 - protein, 9 aa, Homo sapiens
  light chain complementarity determining region 3 for antibody 22823
MQGTHWPRG

SEQ ID NO: 45646 - protein, 18 aa, Homo sapiens
  heavy chain complementarity determining region 3 for antibody 22823
ARDERDTCTTDLCYYFDY

SEQ ID NO: 45647 - protein, 9 aa, Homo sapiens
  light chain complementarity determining region 3 for antibody 22824
MQGTHWPRE

SEQ ID NO: 45648 - protein, 18 aa, Homo sapiens
  heavy chain complementarity determining region 3 for antibody 22824
ARDERDTCTTDLCYYFDY

SEQ ID NO: 45649 - protein, 9 aa, Homo sapiens
  light chain complementarity determining region 3 for antibody 22825
MQGTHWPPT

SEQ ID NO: 45650 - protein, 16 aa, Homo sapiens
  heavy chain complementarity determining region 3 for antibody 22825
GRAALPTGVTVGGVDY

SEQ ID NO: 45651 - protein, 10 aa, Homo sapiens
  light chain complementarity determining region 3 for antibody 22826
MQGTHWPPST

SEQ ID NO: 45652 - protein, 13 aa, Homo sapiens
  heavy chain complementarity determining region 3 for antibody 22826
VRDWAIWHQEFDL

SEQ ID NO: 45653 - protein, 10 aa, Homo sapiens
  light chain complementarity determining region 3 for antibody 22827
MQGTHWPPRP

SEQ ID NO: 45654 - protein, 11 aa, Homo sapiens
  heavy chain complementarity determining region 3 for antibody 22827
ARDDGTAGEDF

SEQ ID NO: 45655 - protein, 10 aa, Homo sapiens
  light chain complementarity determining region 3 for antibody 22828
MQGTHWPPNT

SEQ ID NO: 45656 - protein, 13 aa, Homo sapiens
  heavy chain complementarity determining region 3 for antibody 22828
VRDWAIWHQEFDL

SEQ ID NO: 45657 - protein, 11 aa, Homo sapiens
  light chain complementarity determining region 3 for antibody 22829
MQGTHWPPMYN

SEQ ID NO: 45658 - protein, 17 aa, Homo sapiens
  heavy chain complementarity determining region 3 for antibody 22829
ARGGSGYYQEGDDTFGF

SEQ ID NO: 45659 - protein, 8 aa, Homo sapiens
  light chain complementarity determining region 3 for antibody 22830
MQGTHWPP

SEQ ID NO: 45660 - protein, 21 aa, Homo sapiens
  heavy chain complementarity determining region 3 for antibody 22830
AKDRPNYYENNGHYYTPKGDL

SEQ ID NO: 45661 - protein, 9 aa, Homo sapiens
  light chain complementarity determining region 3 for antibody 22831
MQGTHWPLT

SEQ ID NO: 45662 - protein, 28 aa, Homo sapiens
  heavy chain complementarity determining region 3 for antibody 22831
LRFPDEPDEMDYEVDYYDSIDFAGDFQH

SEQ ID NO: 45663 - protein, 9 aa, Homo sapiens
  light chain complementarity determining region 3 for antibody 22832
MQGTHWPLT

SEQ ID NO: 45664 - protein, 12 aa, Homo sapiens
  heavy chain complementarity determining region 3 for antibody 22832
ATLSMANAKFDH

SEQ ID NO: 45665 - protein, 9 aa, Homo sapiens
  light chain complementarity determining region 3 for antibody 22833
MQGTHWPLT

SEQ ID NO: 45666 - protein, 11 aa, Homo sapiens
  heavy chain complementarity determining region 3 for antibody 22833
ARGVLAPAFAV

SEQ ID NO: 45667 - protein, 9 aa, Homo sapiens
  light chain complementarity determining region 3 for antibody 22834
MQGTHWPKT

SEQ ID NO: 45668 - protein, 11 aa, Homo sapiens
  heavy chain complementarity determining region 3 for antibody 22834
SRGNSSSWSDY

SEQ ID NO: 45669 - protein, 9 aa, Homo sapiens
  light chain complementarity determining region 3 for antibody 22835
MQGTHWPGT

SEQ ID NO: 45670 - protein, 12 aa, Homo sapiens
  heavy chain complementarity determining region 3 for antibody 22835
ATLSMANAKFDH

SEQ ID NO: 45671 - protein, 9 aa, Homo sapiens
  light chain complementarity determining region 3 for antibody 22836
MQGTHWPAN

SEQ ID NO: 45672 - protein, 14 aa, Homo sapiens
  heavy chain complementarity determining region 3 for antibody 22836
AKSPLKTGVPDFDY

SEQ ID NO: 45673 - protein, 9 aa, Homo sapiens
  light chain complementarity determining region 3 for antibody 22837
MQGTHWHKT

SEQ ID NO: 45674 - protein, 11 aa, Homo sapiens
  heavy chain complementarity determining region 3 for antibody 22837
SRGNSSSWYDY

SEQ ID NO: 45675 - protein, 11 aa, Homo sapiens
  light chain complementarity determining region 3 for antibody 22838
MQGTHLVPPFT

SEQ ID NO: 45676 - protein, 16 aa, Homo sapiens
  heavy chain complementarity determining region 3 for antibody 22838
ARENSILYNHYSGVDV

SEQ ID NO: 45677 - protein, 9 aa, Homo sapiens
  light chain complementarity determining region 3 for antibody 22839
MQGTHGPRT

SEQ ID NO: 45678 - protein, 12 aa, Homo sapiens
  heavy chain complementarity determining region 3 for antibody 22839
ATLSMANAKFDH

SEQ ID NO: 45679 - protein, 10 aa, Homo sapiens
  light chain complementarity determining region 3 for antibody 22840
MQGTHGPPYT

SEQ ID NO: 45680 - protein, 13 aa, Homo sapiens
  heavy chain complementarity determining region 3 for antibody 22840
VRDWAIWHQEFDL

SEQ ID NO: 45681 - protein, 9 aa, Homo sapiens
  light chain complementarity determining region 3 for antibody 22841
MQGTHGPPT

SEQ ID NO: 45682 - protein, 16 aa, Homo sapiens
  heavy chain complementarity determining region 3 for antibody 22841
VRAALPTGVTVGGVDY

SEQ ID NO: 45683 - protein, 10 aa, Homo sapiens
  light chain complementarity determining region 3 for antibody 22842
MQGTHGPPRT

SEQ ID NO: 45684 - protein, 11 aa, Homo sapiens
  heavy chain complementarity determining region 3 for antibody 22842
ARDDGTAGEDF

SEQ ID NO: 45685 - protein, 9 aa, Homo sapiens
  light chain complementarity determining region 3 for antibody 22843
MQGTHGPLT

SEQ ID NO: 45686 - protein, 28 aa, Homo sapiens
  heavy chain complementarity determining region 3 for antibody 22843
MRFPDEPDEMDYEVDYYDSIDFAGDFQH

SEQ ID NO: 45687 - protein, 9 aa, Homo sapiens
  light chain complementarity determining region 3 for antibody 22844
MQGTHGPAN

SEQ ID NO: 45688 - protein, 14 aa, Homo sapiens
  heavy chain complementarity determining region 3 for antibody 22844
AKSPLKTGVTDFDY

SEQ ID NO: 45689 - protein, 8 aa, Homo sapiens
  light chain complementarity determining region 3 for antibody 22845
MQGTHCPT

SEQ ID NO: 45690 - protein, 21 aa, Homo sapiens
  heavy chain complementarity determining region 3 for antibody 22845
AKDRPNYYESNGQYYTPKGDL

SEQ ID NO: 45691 - protein, 9 aa, Homo sapiens
  light chain complementarity determining region 3 for antibody 22846
MQGTHCPIT

SEQ ID NO: 45692 - protein, 18 aa, Homo sapiens
  heavy chain complementarity determining region 3 for antibody 22846
TRDFRDSCSGGGCYYFDL

SEQ ID NO: 45693 - protein, 8 aa, Homo sapiens
  light chain complementarity determining region 3 for antibody 22847
MQGTDWRR

SEQ ID NO: 45694 - protein, 10 aa, Homo sapiens
  heavy chain complementarity determining region 3 for antibody 22847
ARDTPGDLDY

SEQ ID NO: 45695 - protein, 8 aa, Homo sapiens
  light chain complementarity determining region 3 for antibody 22848
MQGTDWPT

SEQ ID NO: 45696 - protein, 21 aa, Homo sapiens
  heavy chain complementarity determining region 3 for antibody 22848
AKDRPNYYGSDGQYYTPKVDL

SEQ ID NO: 45697 - protein, 8 aa, Homo sapiens
  light chain complementarity determining region 3 for antibody 22849
MQGTDWPT

SEQ ID NO: 45698 - protein, 21 aa, Homo sapiens
  heavy chain complementarity determining region 3 for antibody 22849
AKDRPKYYGSNGQYYTPKGDL

SEQ ID NO: 45699 - protein, 8 aa, Homo sapiens
  light chain complementarity determining region 3 for antibody 22850
MQGTDWPT

SEQ ID NO: 45700 - protein, 21 aa, Homo sapiens
  heavy chain complementarity determining region 3 for antibody 22850
AKARPNYYGSDGQYYTPKGDL

SEQ ID NO: 45701 - protein, 8 aa, Homo sapiens
  light chain complementarity determining region 3 for antibody 22851
MQGTDWPR

SEQ ID NO: 45702 - protein, 21 aa, Homo sapiens
  heavy chain complementarity determining region 3 for antibody 22851
AKDRPNYYGSNGQYYTPKGDL

SEQ ID NO: 45703 - protein, 8 aa, Homo sapiens
  light chain complementarity determining region 3 for antibody 22852
MQGTDWGT

SEQ ID NO: 45704 - protein, 10 aa, Homo sapiens
  heavy chain complementarity determining region 3 for antibody 22852
ARDTPGDLDY

SEQ ID NO: 45705 - protein, 8 aa, Homo sapiens
  light chain complementarity determining region 3 for antibody 22853
MQGTDGRT

SEQ ID NO: 45706 - protein, 21 aa, Homo sapiens
  heavy chain complementarity determining region 3 for antibody 22853
AKDRPNYYGSDGQYYTPKGDL

SEQ ID NO: 45707 - protein, 9 aa, Homo sapiens
  light chain complementarity determining region 3 for antibody 22854
MQGSHWPRT

SEQ ID NO: 45708 - protein, 13 aa, Homo sapiens
  heavy chain complementarity determining region 3 for antibody 22854
VRDLGDGYNSIDY

SEQ ID NO: 45709 - protein, 9 aa, Homo sapiens
  light chain complementarity determining region 3 for antibody 22855
MQGSHWPPT

SEQ ID NO: 45710 - protein, 13 aa, Homo sapiens
  heavy chain complementarity determining region 3 for antibody 22855
VRDWGDGYNSIDY

SEQ ID NO: 45711 - protein, 9 aa, Homo sapiens
  light chain complementarity determining region 3 for antibody 22856
MQGSHWPPT

SEQ ID NO: 45712 - protein, 13 aa, Homo sapiens
  heavy chain complementarity determining region 3 for antibody 22856
VRDVGDGYNSIDY

SEQ ID NO: 45713 - protein, 9 aa, Homo sapiens
  light chain complementarity determining region 3 for antibody 22857
MQGSHWPPR

SEQ ID NO: 45714 - protein, 13 aa, Homo sapiens
  heavy chain complementarity determining region 3 for antibody 22857
VRDLGDGYNSIDY

SEQ ID NO: 45715 - protein, 9 aa, Homo sapiens
  light chain complementarity determining region 3 for antibody 22858
MQGPHWPRT

SEQ ID NO: 45716 - protein, 12 aa, Homo sapiens
  heavy chain complementarity determining region 3 for antibody 22858
ATLSMANAKFDH

SEQ ID NO: 45717 - protein, 9 aa, Homo sapiens
  light chain complementarity determining region 3 for antibody 22859
MQGPHWPKT

SEQ ID NO: 45718 - protein, 11 aa, Homo sapiens
  heavy chain complementarity determining region 3 for antibody 22859
SRGNSSSWYDY

SEQ ID NO: 45719 - protein, 8 aa, Homo sapiens
  light chain complementarity determining region 3 for antibody 22860
MQGPDWPT

SEQ ID NO: 45720 - protein, 21 aa, Homo sapiens
  heavy chain complementarity determining region 3 for antibody 22860
AKDRPNYYGSDGQYYTPKGDL

SEQ ID NO: 45721 - protein, 9 aa, Homo sapiens
  light chain complementarity determining region 3 for antibody 22861
MQGLRTPYT

SEQ ID NO: 45722 - protein, 10 aa, Homo sapiens
  heavy chain complementarity determining region 3 for antibody 22861
GRDLSGARDY

SEQ ID NO: 45723 - protein, 9 aa, Homo sapiens
  light chain complementarity determining region 3 for antibody 22862
MQGLRTPRT

SEQ ID NO: 45724 - protein, 23 aa, Homo sapiens
  heavy chain complementarity determining region 3 for antibody 22862
ARERAYASGPYYSPLYYYCGVDT

SEQ ID NO: 45725 - protein, 9 aa, Homo sapiens
  light chain complementarity determining region 3 for antibody 22863
MQGLRTPRT

SEQ ID NO: 45726 - protein, 23 aa, Homo sapiens
  heavy chain complementarity determining region 3 for antibody 22863
ARERAYAAGPYYSPLYYYYGVDT

SEQ ID NO: 45727 - protein, 9 aa, Homo sapiens
  light chain complementarity determining region 3 for antibody 22864
MQGLRTPRT

SEQ ID NO: 45728 - protein, 23 aa, Homo sapiens
  heavy chain complementarity determining region 3 for antibody 22864
AREMAYASGPYYSPLYYYYGVDT

SEQ ID NO: 45729 - protein, 9 aa, Homo sapiens
  light chain complementarity determining region 3 for antibody 22865
MQGLRIPRT

SEQ ID NO: 45730 - protein, 23 aa, Homo sapiens
  heavy chain complementarity determining region 3 for antibody 22865
ARERAYASGPYYSPLYYYYGVDT

SEQ ID NO: 45731 - protein, 9 aa, Homo sapiens
  light chain complementarity determining region 3 for antibody 22866
MQGLQTPYT

SEQ ID NO: 45732 - protein, 10 aa, Homo sapiens
  heavy chain complementarity determining region 3 for antibody 22866
GRDLSGASDY

SEQ ID NO: 45733 - protein, 9 aa, Homo sapiens
  light chain complementarity determining region 3 for antibody 22867
MQGLQTPYT

SEQ ID NO: 45734 - protein, 18 aa, Homo sapiens
  heavy chain complementarity determining region 3 for antibody 22867
ARQRRGGYSYGYHCGMDV

SEQ ID NO: 45735 - protein, 9 aa, Homo sapiens
  light chain complementarity determining region 3 for antibody 22868
MQGLQTPYP

SEQ ID NO: 45736 - protein, 18 aa, Homo sapiens
  heavy chain complementarity determining region 3 for antibody 22868
ARQRRGGYSYGYHYGMDV

SEQ ID NO: 45737 - protein, 9 aa, Homo sapiens
  light chain complementarity determining region 3 for antibody 22869
MQGLQTPYN

SEQ ID NO: 45738 - protein, 10 aa, Homo sapiens
  heavy chain complementarity determining region 3 for antibody 22869
GSDLTGARDH

SEQ ID NO: 45739 - protein, 9 aa, Homo sapiens
  light chain complementarity determining region 3 for antibody 22870
MQGLQTPST

SEQ ID NO: 45740 - protein, 18 aa, Homo sapiens
  heavy chain complementarity determining region 3 for antibody 22870
ARQRRGGYSYGYHYGMDV

SEQ ID NO: 45741 - protein, 9 aa, Homo sapiens
  light chain complementarity determining region 3 for antibody 22871
MQGLQTPLA

SEQ ID NO: 45742 - protein, 18 aa, Homo sapiens
  heavy chain complementarity determining region 3 for antibody 22871
AIGYYGSGSYYTCYGFDP

SEQ ID NO: 45743 - protein, 9 aa, Homo sapiens
  light chain complementarity determining region 3 for antibody 22872
MQGLQTPGT

SEQ ID NO: 45744 - protein, 30 aa, Homo sapiens; identical to SEQ ID NO: 36400
  heavy chain complementarity determining region 3 for antibody 22872

SEQ ID NO: 45745 - protein, 9 aa, Homo sapiens
  light chain complementarity determining region 3 for antibody 22873
MQGLQTPFT

SEQ ID NO: 45746 - protein, 18 aa, Homo sapiens
  heavy chain complementarity determining region 3 for antibody 22873
ARQRRGGYSYGYHYGMDV

SEQ ID NO: 45747 - protein, 9 aa, Homo sapiens
  light chain complementarity determining region 3 for antibody 22874
MQGLQTPET

SEQ ID NO: 45748 - protein, 18 aa, Homo sapiens
  heavy chain complementarity determining region 3 for antibody 22874
ARQRRGGYSYGYHYGMDV

SEQ ID NO: 45749 - protein, 9 aa, Homo sapiens
  light chain complementarity determining region 3 for antibody 22875
MQGLQTGHT

SEQ ID NO: 45750 - protein, 17 aa, Homo sapiens
  heavy chain complementarity determining region 3 for antibody 22875
ARDVGRHCSGSGCHHDY

SEQ ID NO: 45751 - protein, 9 aa, Homo sapiens
  light chain complementarity determining region 3 for antibody 22876
MQGLQIPYT

SEQ ID NO: 45752 - protein, 18 aa, Homo sapiens
  heavy chain complementarity determining region 3 for antibody 22876
ARQRRGGYSYGYHYGMDV

SEQ ID NO: 45753 - protein, 9 aa, Homo sapiens
  light chain complementarity determining region 3 for antibody 22877
MQGLQAPWT

SEQ ID NO: 45754 - protein, 11 aa, Homo sapiens
  heavy chain complementarity determining region 3 for antibody 22877
ARQPDPTTPTP

SEQ ID NO: 45755 - protein, 9 aa, Homo sapiens
  light chain complementarity determining region 3 for antibody 22878
MQGLQAPLS

SEQ ID NO: 45756 - protein, 18 aa, Homo sapiens
  heavy chain complementarity determining region 3 for antibody 22878
ARPKVGATDYHYYFGIDV

SEQ ID NO: 45757 - protein, 9 aa, Homo sapiens
  light chain complementarity determining region 3 for antibody 22879
MQGLHTPYT

SEQ ID NO: 45758 - protein, 18 aa, Homo sapiens
  heavy chain complementarity determining region 3 for antibody 22879
ARQRRGGYSYGYHYGMDV

SEQ ID NO: 45759 - protein, 9 aa, Homo sapiens
  light chain complementarity determining region 3 for antibody 22880
MQGLETPFT

SEQ ID NO: 45760 - protein, 15 aa, Homo sapiens
  heavy chain complementarity determining region 3 for antibody 22880
VRHYRVLATGIEGDS

SEQ ID NO: 45761 - protein, 9 aa, Homo sapiens
  light chain complementarity determining region 3 for antibody 22881
MQGLETPFT

SEQ ID NO: 45762 - protein, 15 aa, Homo sapiens
  heavy chain complementarity determining region 3 for antibody 22881
VRHYRLTVAGIEGDS

SEQ ID NO: 45763 - protein, 9 aa, Homo sapiens
  light chain complementarity determining region 3 for antibody 22882
MQGLETPFT

SEQ ID NO: 45764 - protein, 15 aa, Homo sapiens
  heavy chain complementarity determining region 3 for antibody 22882
VRHYRIITDPLEGDS

SEQ ID NO: 45765 - protein, 9 aa, Homo sapiens
  light chain complementarity determining region 3 for antibody 22883
MQGLETPFT

SEQ ID NO: 45766 - protein, 15 aa, Homo sapiens
  heavy chain complementarity determining region 3 for antibody 22883
VRHYRIITAPLDGDS

SEQ ID NO: 45767 - protein, 9 aa, Homo sapiens
  light chain complementarity determining region 3 for antibody 22884
MQGLETPFT

SEQ ID NO: 45768 - protein, 15 aa, Homo sapiens
  heavy chain complementarity determining region 3 for antibody 22884
VRHYRETVAGIEGDC

SEQ ID NO: 45769 - protein, 9 aa, Homo sapiens
  light chain complementarity determining region 3 for antibody 22885
MQGLETPFP

SEQ ID NO: 45770 - protein, 15 aa, Homo sapiens
  heavy chain complementarity determining region 3 for antibody 22885
VRHYRIITAPLEGDS

SEQ ID NO: 45771 - protein, 9 aa, Homo sapiens
  light chain complementarity determining region 3 for antibody 22886
MQGLETPFP

SEQ ID NO: 45772 - protein, 15 aa, Homo sapiens
  heavy chain complementarity determining region 3 for antibody 22886
VRHYRETVAGIEGDS

SEQ ID NO: 45773 - protein, 9 aa, Homo sapiens
  light chain complementarity determining region 3 for antibody 22887
MQGLETPFN

SEQ ID NO: 45774 - protein, 15 aa, Homo sapiens
  heavy chain complementarity determining region 3 for antibody 22887
VRHYRIITAPLEGDS

SEQ ID NO: 45775 - protein, 9 aa, Homo sapiens
  light chain complementarity determining region 3 for antibody 22888
MQGLESPFT

SEQ ID NO: 45776 - protein, 15 aa, Homo sapiens
  heavy chain complementarity determining region 3 for antibody 22888
VRHYRIITAPLEGDS

SEQ ID NO: 45777 - protein, 9 aa, Homo sapiens
  light chain complementarity determining region 3 for antibody 22889
MQGLDTPFT

SEQ ID NO: 45778 - protein, 15 aa, Homo sapiens
  heavy chain complementarity determining region 3 for antibody 22889
VRHYRIITAPLEGDS

SEQ ID NO: 45779 - protein, 9 aa, Homo sapiens
  light chain complementarity determining region 3 for antibody 22890
MQGKHWPWT

SEQ ID NO: 45780 - protein, 10 aa, Homo sapiens
  heavy chain complementarity determining region 3 for antibody 22890
ARETHWGPDY

SEQ ID NO: 45781 - protein, 9 aa, Homo sapiens
  light chain complementarity determining region 3 for antibody 22891
MQGKHWPGR

SEQ ID NO: 45782 - protein, 7 aa, Homo sapiens
  heavy chain complementarity determining region 3 for antibody 22891
ARGWGAY

SEQ ID NO: 45783 - protein, 9 aa, Homo sapiens
  light chain complementarity determining region 3 for antibody 22892
MQGIRTPRT

SEQ ID NO: 45784 - protein, 23 aa, Homo sapiens
  heavy chain complementarity determining region 3 for antibody 22892
ARERAYASGPYYSPLYYYYGVDT

SEQ ID NO: 45785 - protein, 9 aa, Homo sapiens
  light chain complementarity determining region 3 for antibody 22893
MQGIHWPWR

SEQ ID NO: 45786 - protein, 7 aa, Homo sapiens
  heavy chain complementarity determining region 3 for antibody 22893
ARGWGAY

SEQ ID NO: 45787 - protein, 9 aa, Homo sapiens
  light chain complementarity determining region 3 for antibody 22894
MQGIHWPGR

SEQ ID NO: 45788 - protein, 7 aa, Homo sapiens
  heavy chain complementarity determining region 3 for antibody 22894
ARGWGAY

SEQ ID NO: 45789 - protein, 9 aa, Homo sapiens
  light chain complementarity determining region 3 for antibody 22895
MQDTHWPLT

SEQ ID NO: 45790 - protein, 8 aa, Homo sapiens
  heavy chain complementarity determining region 3 for antibody 22895
ARPRTFDI

SEQ ID NO: 45791 - protein, 8 aa, Homo sapiens
  light chain complementarity determining region 3 for antibody 22896
MQDLQTPT

SEQ ID NO: 45792 - protein, 15 aa, Homo sapiens
  heavy chain complementarity determining region 3 for antibody 22896
ARRDYYDSSGYRLDY

SEQ ID NO: 45793 - protein, 9 aa, Homo sapiens
  light chain complementarity determining region 3 for antibody 22897
MQDLQTPPT

SEQ ID NO: 45794 - protein, 15 aa, Homo sapiens
  heavy chain complementarity determining region 3 for antibody 22897
ARDGLRDGFSDAFDI

SEQ ID NO: 45795 - protein, 9 aa, Homo sapiens
  light chain complementarity determining region 3 for antibody 22898
MQDLETPLT

SEQ ID NO: 45796 - protein, 15 aa, Homo sapiens
  heavy chain complementarity determining region 3 for antibody 22898
VRHYRIITAPLEGDS

SEQ ID NO: 45797 - protein, 9 aa, Homo sapiens
  light chain complementarity determining region 3 for antibody 22899
MQDLETPFT

SEQ ID NO: 45798 - protein, 15 aa, Homo sapiens
  heavy chain complementarity determining region 3 for antibody 22899
VRHYRVLATGIEGDS

SEQ ID NO: 45799 - protein, 9 aa, Homo sapiens
  light chain complementarity determining region 3 for antibody 22900
MQDLETPFT

SEQ ID NO: 45800 - protein, 15 aa, Homo sapiens
  heavy chain complementarity determining region 3 for antibody 22900
VRHYRITVAAVEGDS

SEQ ID NO: 45801 - protein, 9 aa, Homo sapiens
  light chain complementarity determining region 3 for antibody 22901
MQDLETPFT

SEQ ID NO: 45802 - protein, 15 aa, Homo sapiens
  heavy chain complementarity determining region 3 for antibody 22901
VRHYRELTTGIEGDS

SEQ ID NO: 45803 - protein, 9 aa, Homo sapiens
  light chain complementarity determining region 3 for antibody 22902
MQDLETPFT

SEQ ID NO: 45804 - protein, 15 aa, Homo sapiens
  heavy chain complementarity determining region 3 for antibody 22902
VRHYRELATGFEGDS

SEQ ID NO: 45805 - protein, 9 aa, Homo sapiens
  light chain complementarity determining region 3 for antibody 22903
MQDLDTPFT

SEQ ID NO: 45806 - protein, 15 aa, Homo sapiens
  heavy chain complementarity determining region 3 for antibody 22903
VRHYRETVAGIEGDS

SEQ ID NO: 45807 - protein, 9 aa, Homo sapiens
  light chain complementarity determining region 3 for antibody 22904
MQAVQTPGT

SEQ ID NO: 45808 - protein, 14 aa, Homo sapiens
  heavy chain complementarity determining region 3 for antibody 22904
ARGHRGGKYKGIDA

SEQ ID NO: 45809 - protein, 9 aa, Homo sapiens
  light chain complementarity determining region 3 for antibody 22905
MQAVETPFT

SEQ ID NO: 45810 - protein, 15 aa, Homo sapiens
  heavy chain complementarity determining region 3 for antibody 22905
VRHYRITVAAVEGDS

SEQ ID NO: 45811 - protein, 9 aa, Homo sapiens
  light chain complementarity determining region 3 for antibody 22906
MQAVETPFT

SEQ ID NO: 45812 - protein, 15 aa, Homo sapiens
  heavy chain complementarity determining region 3 for antibody 22906
VRHYRETVAGIEGDS

SEQ ID NO: 45813 - protein, 9 aa, Homo sapiens
  light chain complementarity determining region 3 for antibody 22907
MQATYGPWT

SEQ ID NO: 45814 - protein, 11 aa, Homo sapiens
  heavy chain complementarity determining region 3 for antibody 22907
LSAVRGSSFDI

SEQ ID NO: 45815 - protein, 9 aa, Homo sapiens
  light chain complementarity determining region 3 for antibody 22908
MQATYGPGR

SEQ ID NO: 45816 - protein, 11 aa, Homo sapiens
  heavy chain complementarity determining region 3 for antibody 22908
LSAVRGSSFDI

SEQ ID NO: 45817 - protein, 9 aa, Homo sapiens
  light chain complementarity determining region 3 for antibody 22909
MQATKIPGT

SEQ ID NO: 45818 - protein, 7 aa, Homo sapiens
  heavy chain complementarity determining region 3 for antibody 22909
LGGGVDY

SEQ ID NO: 45819 - protein, 9 aa, Homo sapiens
  light chain complementarity determining region 3 for antibody 22910
MQATHWPIT

SEQ ID NO: 45820 - protein, 16 aa, Homo sapiens
  heavy chain complementarity determining region 3 for antibody 22910
ARRSAVEDRAGSAFDN

SEQ ID NO: 45821 - protein, 9 aa, Homo sapiens
  light chain complementarity determining region 3 for antibody 22911
MQATHWPIN

SEQ ID NO: 45822 - protein, 16 aa, Homo sapiens
  heavy chain complementarity determining region 3 for antibody 22911
ARGSAVEDRAGSAFDN

SEQ ID NO: 45823 - protein, 9 aa, Homo sapiens
  light chain complementarity determining region 3 for antibody 22912
MQATHGPIT

SEQ ID NO: 45824 - protein, 16 aa, Homo sapiens
  heavy chain complementarity determining region 3 for antibody 22912
ARGSAVEDRAGSAFDN

SEQ ID NO: 45825 - protein, 9 aa, Homo sapiens
  light chain complementarity determining region 3 for antibody 22913
MQASQFPST

SEQ ID NO: 45826 - protein, 12 aa, Homo sapiens
  heavy chain complementarity determining region 3 for antibody 22913
TRGLFGVSGVDY

SEQ ID NO: 45827 - protein, 9 aa, Homo sapiens
  light chain complementarity determining region 3 for antibody 22914
MQASQFPDT

SEQ ID NO: 45828 - protein, 12 aa, Homo sapiens
  heavy chain complementarity determining region 3 for antibody 22914
TRGLFGVSGVDY

SEQ ID NO: 45829 - protein, 9 aa, Homo sapiens
  light chain complementarity determining region 3 for antibody 22915
MQARETPFT

SEQ ID NO: 45830 - protein, 15 aa, Homo sapiens
  heavy chain complementarity determining region 3 for antibody 22915
VRHYRETVAGIEGDS

SEQ ID NO: 45831 - protein, 8 aa, Homo sapiens
  light chain complementarity determining region 3 for antibody 22916
MQAQHTRT

SEQ ID NO: 45832 - protein, 21 aa, Homo sapiens
  heavy chain complementarity determining region 3 for antibody 22916
AREKHYAYCSDGVCYTGAFDL

SEQ ID NO: 45833 - protein, 9 aa, Homo sapiens
  light chain complementarity determining region 3 for antibody 22917
MQAPYWPGT

SEQ ID NO: 45834 - protein, 11 aa, Homo sapiens
  heavy chain complementarity determining region 3 for antibody 22917
LSAVRGSSFDI

SEQ ID NO: 45835 - protein, 9 aa, Homo sapiens
  light chain complementarity determining region 3 for antibody 22918
MQAPETPFT

SEQ ID NO: 45836 - protein, 15 aa, Homo sapiens
  heavy chain complementarity determining region 3 for antibody 22918
VRHYRELATGIEGDS

SEQ ID NO: 45837 - protein, 9 aa, Homo sapiens
  light chain complementarity determining region 3 for antibody 22919
MQAMETPFT

SEQ ID NO: 45838 - protein, 15 aa, Homo sapiens
  heavy chain complementarity determining region 3 for antibody 22919
VRHYRETVAGIEGDS

SEQ ID NO: 45839 - protein, 9 aa, Homo sapiens
  light chain complementarity determining region 3 for antibody 22920
MQALVTPFT

SEQ ID NO: 45840 - protein, 15 aa, Homo sapiens
  heavy chain complementarity determining region 3 for antibody 22920
VRHYRELTTGIEGDS

SEQ ID NO: 45841 - protein, 9 aa, Homo sapiens
  light chain complementarity determining region 3 for antibody 22921
MQALSSSPT

SEQ ID NO: 45842 - protein, 12 aa, Homo sapiens
  heavy chain complementarity determining region 3 for antibody 22921
AKDLVGGARGGS

SEQ ID NO: 45843 - protein, 9 aa, Homo sapiens
  light chain complementarity determining region 3 for antibody 22922
MQALSSPPP

SEQ ID NO: 45844 - protein, 12 aa, Homo sapiens
  heavy chain complementarity determining region 3 for antibody 22922
AKDLVGGARGGS

SEQ ID NO: 45845 - protein, 9 aa, Homo sapiens
  light chain complementarity determining region 3 for antibody 22923
MQALRTRPT

SEQ ID NO: 45846 - protein, 23 aa, Homo sapiens
  heavy chain complementarity determining region 3 for antibody 22923
ARVSQNLGEWSGSSRYGINAFAP

SEQ ID NO: 45847 - protein, 7 aa, Homo sapiens
  light chain complementarity determining region 3 for antibody 22924
MQALRPR

SEQ ID NO: 45848 - protein, 20 aa, Homo sapiens
  heavy chain complementarity determining region 3 for antibody 22924
AGPRVEHYFDTTAYFYAFEY

SEQ ID NO: 45849 - protein, 7 aa, Homo sapiens
  light chain complementarity determining region 3 for antibody 22925
MQALRPL

SEQ ID NO: 45850 - protein, 20 aa, Homo sapiens
  heavy chain complementarity determining region 3 for antibody 22925
AGPRVEHYFDTTAYFYAFDY

SEQ ID NO: 45851 - protein, 8 aa, Homo sapiens
  light chain complementarity determining region 3 for antibody 22926
MQALQTRA

SEQ ID NO: 45852 - protein, 20 aa, Homo sapiens
  heavy chain complementarity determining region 3 for antibody 22926
ARERGRHSSGPLHYYNGLDV

SEQ ID NO: 45853 - protein, 9 aa, Homo sapiens
  light chain complementarity determining region 3 for antibody 22927
MQALQTPYT

SEQ ID NO: 45854 - protein, 11 aa, Homo sapiens
  heavy chain complementarity determining region 3 for antibody 22927
ARDLAVRPSDF

SEQ ID NO: 45855 - protein, 9 aa, Homo sapiens
  light chain complementarity determining region 3 for antibody 22928
MQALQTPWT

SEQ ID NO: 45856 - protein, 12 aa, Homo sapiens
  heavy chain complementarity determining region 3 for antibody 22928
ALELIAAGGFDY

SEQ ID NO: 45857 - protein, 9 aa, Homo sapiens
  light chain complementarity determining region 3 for antibody 22929
MQALQTPWT

SEQ ID NO: 45858 - protein, 18 aa, Homo sapiens
  heavy chain complementarity determining region 3 for antibody 22929
AKSEDHLWFGELGDAVDV

SEQ ID NO: 45859 - protein, 10 aa, Homo sapiens
  light chain complementarity determining region 3 for antibody 22930
MQALQTPVYT

SEQ ID NO: 45860 - protein, 15 aa, Homo sapiens
  heavy chain complementarity determining region 3 for antibody 22930
ARQPLGVSHYHGMDV

SEQ ID NO: 45861 - protein, 9 aa, Homo sapiens
  light chain complementarity determining region 3 for antibody 22931
MQALQTPVT

SEQ ID NO: 45862 - protein, 24 aa, Homo sapiens
  heavy chain complementarity determining region 3 for antibody 22931
VTAPPYYYDSAGDSPIGRDWYFDL

SEQ ID NO: 45863 - protein, 9 aa, Homo sapiens
  light chain complementarity determining region 3 for antibody 22932
MQALQTPTT

SEQ ID NO: 45864 - protein, 16 aa, Homo sapiens
  heavy chain complementarity determining region 3 for antibody 22932
TMDLFALGLSSGCHDY

SEQ ID NO: 45865 - protein, 9 aa, Homo sapiens
  light chain complementarity determining region 3 for antibody 22933
MQALQTPRT

SEQ ID NO: 45866 - protein, 15 aa, Homo sapiens
  heavy chain complementarity determining region 3 for antibody 22933
ARDGLRDGFSDAFDI

SEQ ID NO: 45867 - protein, 9 aa, Homo sapiens
  light chain complementarity determining region 3 for antibody 22934
MQALQTPPT

SEQ ID NO: 45868 - protein, 14 aa, Homo sapiens
  heavy chain complementarity determining region 3 for antibody 22934
ARYCSGTRCYSMDY

SEQ ID NO: 45869 - protein, 9 aa, Homo sapiens
  light chain complementarity determining region 3 for antibody 22935
MQALQTPPT

SEQ ID NO: 45870 - protein, 15 aa, Homo sapiens
  heavy chain complementarity determining region 3 for antibody 22935
ARDGLRDGFSDAFGI

SEQ ID NO: 45871 - protein, 9 aa, Homo sapiens
  light chain complementarity determining region 3 for antibody 22936
MQALQTPLT

SEQ ID NO: 45872 - protein, 15 aa, Homo sapiens
  heavy chain complementarity determining region 3 for antibody 22936
ARDGLRDGFSDAFDI

SEQ ID NO: 45873 - protein, 9 aa, Homo sapiens
  light chain complementarity determining region 3 for antibody 22937
MQALQTPLP

SEQ ID NO: 45874 - protein, 12 aa, Homo sapiens
  heavy chain complementarity determining region 3 for antibody 22937
AKSTYGDYLHDS

SEQ ID NO: 45875 - protein, 8 aa, Homo sapiens
  light chain complementarity determining region 3 for antibody 22938
MQALQTPI

SEQ ID NO: 45876 - protein, 15 aa, Homo sapiens
  heavy chain complementarity determining region 3 for antibody 22938
ARRDYYDSSGYRLDY

SEQ ID NO: 45877 - protein, 9 aa, Homo sapiens
  light chain complementarity determining region 3 for antibody 22939
MQALQTPFT

SEQ ID NO: 45878 - protein, 15 aa, Homo sapiens
  heavy chain complementarity determining region 3 for antibody 22939
VRHYRETVAGIEGDS

SEQ ID NO: 45879 - protein, 8 aa, Homo sapiens
  light chain complementarity determining region 3 for antibody 22940
MQALQTLT

SEQ ID NO: 45880 - protein, 15 aa, Homo sapiens
  heavy chain complementarity determining region 3 for antibody 22940
ARRDYYDSSGYRLDY

SEQ ID NO: 45881 - protein, 10 aa, Homo sapiens
  light chain complementarity determining region 3 for antibody 22941
MQALQTAPFP

SEQ ID NO: 45882 - protein, 12 aa, Homo sapiens
  heavy chain complementarity determining region 3 for antibody 22941
ARGRAGFGRFDP

SEQ ID NO: 45883 - protein, 8 aa, Homo sapiens
  light chain complementarity determining region 3 for antibody 22942
MQALQPRT

SEQ ID NO: 45884 - protein, 19 aa, Homo sapiens
  heavy chain complementarity determining region 3 for antibody 22942
VRGRYYDAAGGGRYKGMDV

SEQ ID NO: 45885 - protein, 9 aa, Homo sapiens
  light chain complementarity determining region 3 for antibody 22943
MQALQPPGT

SEQ ID NO: 45886 - protein, 13 aa, Homo sapiens
  heavy chain complementarity determining region 3 for antibody 22943
ARHSGSYYYPGDY

SEQ ID NO: 45887 - protein, 9 aa, Homo sapiens
  light chain complementarity determining region 3 for antibody 22944
MQALQPGHT

SEQ ID NO: 45888 - protein, 17 aa, Homo sapiens
  heavy chain complementarity determining region 3 for antibody 22944
ARDVGRHCSGSGCHHDY

SEQ ID NO: 45889 - protein, 8 aa, Homo sapiens
  light chain complementarity determining region 3 for antibody 22945
MQALQNPG

SEQ ID NO: 45890 - protein, 19 aa, Homo sapiens
  heavy chain complementarity determining region 3 for antibody 22945
ANFGSGNFYNVRYYYGMDV

SEQ ID NO: 45891 - protein, 9 aa, Homo sapiens
  light chain complementarity determining region 3 for antibody 22946
MQALQGPNT

SEQ ID NO: 45892 - protein, 17 aa, Homo sapiens
  heavy chain complementarity determining region 3 for antibody 22946
ATHYPVATPQYYYGLDV

SEQ ID NO: 45893 - protein, 9 aa, Homo sapiens
  light chain complementarity determining region 3 for antibody 22947
MQALQFPYT

SEQ ID NO: 45894 - protein, 12 aa, Homo sapiens
  heavy chain complementarity determining region 3 for antibody 22947
TRGLFGVSGVDY

SEQ ID NO: 45895 - protein, 9 aa, Homo sapiens
  light chain complementarity determining region 3 for antibody 22948
MQALQAPWT

SEQ ID NO: 45896 - protein, 11 aa, Homo sapiens
  heavy chain complementarity determining region 3 for antibody 22948
ARQPVPTTPTP

SEQ ID NO: 45897 - protein, 9 aa, Homo sapiens
  light chain complementarity determining region 3 for antibody 22949
MQALQAPWT

SEQ ID NO: 45898 - protein, 11 aa, Homo sapiens
  heavy chain complementarity determining region 3 for antibody 22949
ARQPDPATPTP

SEQ ID NO: 45899 - protein, 10 aa, Homo sapiens
  light chain complementarity determining region 3 for antibody 22950
MQALQAPVYT

SEQ ID NO: 45900 - protein, 15 aa, Homo sapiens
  heavy chain complementarity determining region 3 for antibody 22950
ARQPLEVSHYHGMDV

SEQ ID NO: 45901 - protein, 9 aa, Homo sapiens
  light chain complementarity determining region 3 for antibody 22951
MQALQAPGT

SEQ ID NO: 45902 - protein, 22 aa, Homo sapiens
  heavy chain complementarity determining region 3 for antibody 22951
ARLTGVVKQQVGYYYYYCGMDV

SEQ ID NO: 45903 - protein, 8 aa, Homo sapiens
  light chain complementarity determining region 3 for antibody 22952
MQALQALT

SEQ ID NO: 45904 - protein, 16 aa, Homo sapiens
  heavy chain complementarity determining region 3 for antibody 22952
AKAGWLVGYDLSRGGA

SEQ ID NO: 45905 - protein, 8 aa, Homo sapiens
  light chain complementarity determining region 3 for antibody 22953
MQALQALA

SEQ ID NO: 45906 - protein, 16 aa, Homo sapiens
  heavy chain complementarity determining region 3 for antibody 22953
AKAGWLVGYDLSRGCA

SEQ ID NO: 45907 - protein, 9 aa, Homo sapiens
  light chain complementarity determining region 3 for antibody 22954
MQALLTPRT

SEQ ID NO: 45908 - protein, 16 aa, Homo sapiens
  heavy chain complementarity determining region 3 for antibody 22954
ARGRSSDWHDAVHFDY

SEQ ID NO: 45909 - protein, 9 aa, Homo sapiens
  light chain complementarity determining region 3 for antibody 22955
MQALKTPTT

SEQ ID NO: 45910 - protein, 16 aa, Homo sapiens
  heavy chain complementarity determining region 3 for antibody 22955
TMDLFALGLSSGCHDY

SEQ ID NO: 45911 - protein, 9 aa, Homo sapiens
  light chain complementarity determining region 3 for antibody 22956
MQALKTPST

SEQ ID NO: 45912 - protein, 15 aa, Homo sapiens
  heavy chain complementarity determining region 3 for antibody 22956
VRHYRETVAGIEGDS

SEQ ID NO: 45913 - protein, 9 aa, Homo sapiens
  light chain complementarity determining region 3 for antibody 22957
MQALKTPST

SEQ ID NO: 45914 - protein, 20 aa, Homo sapiens
  heavy chain complementarity determining region 3 for antibody 22957
ARLYCGSTTCYENYYYGLDV

SEQ ID NO: 45915 - protein, 9 aa, Homo sapiens
  light chain complementarity determining region 3 for antibody 22958
MQALKTPPT

SEQ ID NO: 45916 - protein, 15 aa, Homo sapiens
  heavy chain complementarity determining region 3 for antibody 22958
ARDGLRDGFSDAFDI

SEQ ID NO: 45917 - protein, 10 aa, Homo sapiens
  light chain complementarity determining region 3 for antibody 22959
MQALKTAPFT

SEQ ID NO: 45918 - protein, 12 aa, Homo sapiens
  heavy chain complementarity determining region 3 for antibody 22959
ARGRAGFGRFDP

SEQ ID NO: 45919 - protein, 9 aa, Homo sapiens
  light chain complementarity determining region 3 for antibody 22960
MQALKPPWT

SEQ ID NO: 45920 - protein, 13 aa, Homo sapiens
  heavy chain complementarity determining region 3 for antibody 22960
ARHSGSYYYPGDY

SEQ ID NO: 45921 - protein, 9 aa, Homo sapiens
  light chain complementarity determining region 3 for antibody 22961
MQALKAPGT

SEQ ID NO: 45922 - protein, 22 aa, Homo sapiens
  heavy chain complementarity determining region 3 for antibody 22961
ARLTGVVKQQVGYYYYYYGMDV

SEQ ID NO: 45923 - protein, 10 aa, Homo sapiens
  light chain complementarity determining region 3 for antibody 22962
MQALHTPVYT

SEQ ID NO: 45924 - protein, 15 aa, Homo sapiens
  heavy chain complementarity determining region 3 for antibody 22962
ARQPLEVSHYHGMDV

SEQ ID NO: 45925 - protein, 9 aa, Homo sapiens
  light chain complementarity determining region 3 for antibody 22963
MQALHTPIT

SEQ ID NO: 45926 - protein, 24 aa, Homo sapiens
  heavy chain complementarity determining region 3 for antibody 22963
VTAPPYYYDSAGDSPIGRDWYFDL

SEQ ID NO: 45927 - protein, 9 aa, Homo sapiens
  light chain complementarity determining region 3 for antibody 22964
MQALGTPLT

SEQ ID NO: 45928 - protein, 15 aa, Homo sapiens
  heavy chain complementarity determining region 3 for antibody 22964
VRHYRETVAGIEGDS

SEQ ID NO: 45929 - protein, 9 aa, Homo sapiens
  light chain complementarity determining region 3 for antibody 22965
MQALGTPFT

SEQ ID NO: 45930 - protein, 15 aa, Homo sapiens
  heavy chain complementarity determining region 3 for antibody 22965
VRHYRLTVAGIEGDS

SEQ ID NO: 45931 - protein, 9 aa, Homo sapiens
  light chain complementarity determining region 3 for antibody 22966
MQALGTPFT

SEQ ID NO: 45932 - protein, 11 aa, Homo sapiens
  heavy chain complementarity determining region 3 for antibody 22966
ARAGTRTLSGD

SEQ ID NO: 45933 - protein, 9 aa, Homo sapiens
  light chain complementarity determining region 3 for antibody 22967
MQALGTPFP

SEQ ID NO: 45934 - protein, 15 aa, Homo sapiens
  heavy chain complementarity determining region 3 for antibody 22967
VRHYRETVAGIEGDS

SEQ ID NO: 45935 - protein, 9 aa, Homo sapiens
  light chain complementarity determining region 3 for antibody 22968
MQALGTPFN

SEQ ID NO: 45936 - protein, 15 aa, Homo sapiens
  heavy chain complementarity determining region 3 for antibody 22968
VRHYRIITAPLEGDS

SEQ ID NO: 45937 - protein, 9 aa, Homo sapiens
  light chain complementarity determining region 3 for antibody 22969
MQALETSFT

SEQ ID NO: 45938 - protein, 15 aa, Homo sapiens
  heavy chain complementarity determining region 3 for antibody 22969
VRHYRIITAPLEGDS

SEQ ID NO: 45939 - protein, 9 aa, Homo sapiens
  light chain complementarity determining region 3 for antibody 22970
MQALETRFT

SEQ ID NO: 45940 - protein, 15 aa, Homo sapiens
  heavy chain complementarity determining region 3 for antibody 22970
VRHYRETVAGIEGDS

SEQ ID NO: 45941 - protein, 9 aa, Homo sapiens
  light chain complementarity determining region 3 for antibody 22971
MQALETQFI

SEQ ID NO: 45942 - protein, 15 aa, Homo sapiens
  heavy chain complementarity determining region 3 for antibody 22971
VRHYRETVAGIEGDS

SEQ ID NO: 45943 - protein, 9 aa, Homo sapiens
  light chain complementarity determining region 3 for antibody 22972
MQALETPYT

SEQ ID NO: 45944 - protein, 15 aa, Homo sapiens
  heavy chain complementarity determining region 3 for antibody 22972
VRHYRIITAPLEGDS

SEQ ID NO: 45945 - protein, 9 aa, Homo sapiens
  light chain complementarity determining region 3 for antibody 22973
MQALETPVT

SEQ ID NO: 45946 - protein, 15 aa, Homo sapiens
  heavy chain complementarity determining region 3 for antibody 22973
VRHYRIITAPLEGDS

SEQ ID NO: 45947 - protein, 9 aa, Homo sapiens
  light chain complementarity determining region 3 for antibody 22974
MQALETPST

SEQ ID NO: 45948 - protein, 15 aa, Homo sapiens
  heavy chain complementarity determining region 3 for antibody 22974
VRHYRLTVAGIEGDS

SEQ ID NO: 45949 - protein, 9 aa, Homo sapiens
  light chain complementarity determining region 3 for antibody 22975
MQALETPST

SEQ ID NO: 45950 - protein, 15 aa, Homo sapiens
  heavy chain complementarity determining region 3 for antibody 22975
VRHYRITVAAVEGDS

SEQ ID NO: 45951 - protein, 9 aa, Homo sapiens
  light chain complementarity determining region 3 for antibody 22976
MQALETPST

SEQ ID NO: 45952 - protein, 15 aa, Homo sapiens
  heavy chain complementarity determining region 3 for antibody 22976
VRHYRETVAGIEGDC

SEQ ID NO: 45953 - protein, 9 aa, Homo sapiens
  light chain complementarity determining region 3 for antibody 22977
MQALETPSP

SEQ ID NO: 45954 - protein, 15 aa, Homo sapiens
  heavy chain complementarity determining region 3 for antibody 22977
VRHYRETVAGIEGDS

SEQ ID NO: 45955 - protein, 9 aa, Homo sapiens
  light chain complementarity determining region 3 for antibody 22978
MQALETPLT

SEQ ID NO: 45956 - protein, 15 aa, Homo sapiens
  heavy chain complementarity determining region 3 for antibody 22978
VSHYRIITAPLEGDS

SEQ ID NO: 45957 - protein, 9 aa, Homo sapiens
  light chain complementarity determining region 3 for antibody 22979
MQALETPLT

SEQ ID NO: 45958 - protein, 15 aa, Homo sapiens
  heavy chain complementarity determining region 3 for antibody 22979
VRQYRETVAGIEGDS

SEQ ID NO: 45959 - protein, 9 aa, Homo sapiens
  light chain complementarity determining region 3 for antibody 22980
MQALETPLT

SEQ ID NO: 45960 - protein, 15 aa, Homo sapiens
  heavy chain complementarity determining region 3 for antibody 22980
VRHYRIITAPLDGDS

SEQ ID NO: 45961 - protein, 9 aa, Homo sapiens
  light chain complementarity determining region 3 for antibody 22981
MQALETPLT

SEQ ID NO: 45962 - protein, 15 aa, Homo sapiens
  heavy chain complementarity determining region 3 for antibody 22981
VRHYRETVAGIEGDC

SEQ ID NO: 45963 - protein, 9 aa, Homo sapiens
  light chain complementarity determining region 3 for antibody 22982
MQALETPLT

SEQ ID NO: 45964 - protein, 15 aa, Homo sapiens
  heavy chain complementarity determining region 3 for antibody 22982
VRHYRELTTGIEGDS

SEQ ID NO: 45965 - protein, 9 aa, Homo sapiens
  light chain complementarity determining region 3 for antibody 22983
MQALETPLT

SEQ ID NO: 45966 - protein, 15 aa, Homo sapiens
  heavy chain complementarity determining region 3 for antibody 22983
VRHYRELATGFEGDS

SEQ ID NO: 45967 - protein, 9 aa, Homo sapiens
  light chain complementarity determining region 3 for antibody 22984
MQALETPLT

SEQ ID NO: 45968 - protein, 15 aa, Homo sapiens
  heavy chain complementarity determining region 3 for antibody 22984
VRHHRIITAPLEGDS

SEQ ID NO: 45969 - protein, 9 aa, Homo sapiens
  light chain complementarity determining region 3 for antibody 22985
MQALETPLP

SEQ ID NO: 45970 - protein, 15 aa, Homo sapiens
  heavy chain complementarity determining region 3 for antibody 22985
VRHYRELATGIEGDS

SEQ ID NO: 45971 - protein, 9 aa, Homo sapiens
  light chain complementarity determining region 3 for antibody 22986
MQALETPLP

SEQ ID NO: 45972 - protein, 15 aa, Homo sapiens
  heavy chain complementarity determining region 3 for antibody 22986
VRHYRELATGFEGDS

SEQ ID NO: 45973 - protein, 9 aa, Homo sapiens
  light chain complementarity determining region 3 for antibody 22987
MQALETPFT

SEQ ID NO: 45974 - protein, 15 aa, Homo sapiens
  heavy chain complementarity determining region 3 for antibody 22987
VSQYRETVAGIEGDS

SEQ ID NO: 45975 - protein, 9 aa, Homo sapiens
  light chain complementarity determining region 3 for antibody 22988
MQALETPFT

SEQ ID NO: 45976 - protein, 15 aa, Homo sapiens
  heavy chain complementarity determining region 3 for antibody 22988
VSHYRELTTGIEGDS

SEQ ID NO: 45977 - protein, 9 aa, Homo sapiens
  light chain complementarity determining region 3 for antibody 22989
MQALETPFT

SEQ ID NO: 45978 - protein, 15 aa, Homo sapiens
  heavy chain complementarity determining region 3 for antibody 22989
VSHYRELATGIEGDS

SEQ ID NO: 45979 - protein, 9 aa, Homo sapiens
  light chain complementarity determining region 3 for antibody 22990
MQALETPFT

SEQ ID NO: 45980 - protein, 15 aa, Homo sapiens
  heavy chain complementarity determining region 3 for antibody 22990
VSHYRELATGFEGDS

SEQ ID NO: 45981 - protein, 9 aa, Homo sapiens
  light chain complementarity determining region 3 for antibody 22991
MQALETPFT

SEQ ID NO: 45982 - protein, 15 aa, Homo sapiens
  heavy chain complementarity determining region 3 for antibody 22991
VRYYRETVAGIEGDS

SEQ ID NO: 45983 - protein, 9 aa, Homo sapiens
  light chain complementarity determining region 3 for antibody 22992
MQALETPFT

SEQ ID NO: 45984 - protein, 15 aa, Homo sapiens
  heavy chain complementarity determining region 3 for antibody 22992
VRRYRELATGIEGDS

SEQ ID NO: 45985 - protein, 9 aa, Homo sapiens
  light chain complementarity determining region 3 for antibody 22993
MQALETPFT

SEQ ID NO: 45986 - protein, 15 aa, Homo sapiens
  heavy chain complementarity determining region 3 for antibody 22993
VRQYRETVAGIEGDC

SEQ ID NO: 45987 - protein, 9 aa, Homo sapiens
  light chain complementarity determining region 3 for antibody 22994
MQALETPFT

SEQ ID NO: 45988 - protein, 15 aa, Homo sapiens
  heavy chain complementarity determining region 3 for antibody 22994
VRQYRELTTGIEGDS

SEQ ID NO: 45989 - protein, 9 aa, Homo sapiens
  light chain complementarity determining region 3 for antibody 22995
MQALETPFT

SEQ ID NO: 45990 - protein, 15 aa, Homo sapiens
  heavy chain complementarity determining region 3 for antibody 22995
VRHYSIITAPLEGDS

SEQ ID NO: 45991 - protein, 9 aa, Homo sapiens
  light chain complementarity determining region 3 for antibody 22996
MQALETPFT

SEQ ID NO: 45992 - protein, 15 aa, Homo sapiens
  heavy chain complementarity determining region 3 for antibody 22996
VRHYRVTVAGIEGDS

SEQ ID NO: 45993 - protein, 9 aa, Homo sapiens
  light chain complementarity determining region 3 for antibody 22997
MQALETPFT

SEQ ID NO: 45994 - protein, 15 aa, Homo sapiens
  heavy chain complementarity determining region 3 for antibody 22997
VRHYRVPVAGIEVDS

SEQ ID NO: 45995 - protein, 9 aa, Homo sapiens
  light chain complementarity determining region 3 for antibody 22998
MQALETPFT

SEQ ID NO: 45996 - protein, 15 aa, Homo sapiens
  heavy chain complementarity determining region 3 for antibody 22998
VRHYRVLAAGIEGDS

SEQ ID NO: 45997 - protein, 9 aa, Homo sapiens
  light chain complementarity determining region 3 for antibody 22999
MQALETPFT

SEQ ID NO: 45998 - protein, 15 aa, Homo sapiens
  heavy chain complementarity determining region 3 for antibody 22999
VRHYRRSTAPLEGDS

SEQ ID NO: 45999 - protein, 9 aa, Homo sapiens
  light chain complementarity determining region 3 for antibody 23000
MQALETPFT

SEQ ID NO: 46000 - protein, 15 aa, Homo sapiens
  heavy chain complementarity determining region 3 for antibody 23000
VRHYRKLATGIEGDS

SEQ ID NO: 46001 - protein, 9 aa, Homo sapiens
  light chain complementarity determining region 3 for antibody 23001
MQALETPFT

SEQ ID NO: 46002 - protein, 15 aa, Homo sapiens
  heavy chain complementarity determining region 3 for antibody 23001
VRHYRITVAAVEVDS

SEQ ID NO: 46003 - protein, 9 aa, Homo sapiens
  light chain complementarity determining region 3 for antibody 23002
MQALETPFT

SEQ ID NO: 46004 - protein, 15 aa, Homo sapiens
  heavy chain complementarity determining region 3 for antibody 23002
VRHYRITTAPLEGDS

SEQ ID NO: 46005 - protein, 9 aa, Homo sapiens
  light chain complementarity determining region 3 for antibody 23003
MQALETPFT

SEQ ID NO: 46006 - protein, 15 aa, Homo sapiens
  heavy chain complementarity determining region 3 for antibody 23003
VRHYRIITVPLEGDS

SEQ ID NO: 46007 - protein, 9 aa, Homo sapiens
  light chain complementarity determining region 3 for antibody 23004
MQALETPFT

SEQ ID NO: 46008 - protein, 15 aa, Homo sapiens
  heavy chain complementarity determining region 3 for antibody 23004
VRHYRIITAPLERDS

SEQ ID NO: 46009 - protein, 9 aa, Homo sapiens
  light chain complementarity determining region 3 for antibody 23005
MQALETPFT

SEQ ID NO: 46010 - protein, 15 aa, Homo sapiens
  heavy chain complementarity determining region 3 for antibody 23005
VRHYRIITAPLEGAS

SEQ ID NO: 46011 - protein, 9 aa, Homo sapiens
  light chain complementarity determining region 3 for antibody 23006
MQALETPFT

SEQ ID NO: 46012 - protein, 15 aa, Homo sapiens
  heavy chain complementarity determining region 3 for antibody 23006
VRHYRIITAPLDVDS

SEQ ID NO: 46013 - protein, 9 aa, Homo sapiens
  light chain complementarity determining region 3 for antibody 23007
MQALETPFT

SEQ ID NO: 46014 - protein, 15 aa, Homo sapiens
  heavy chain complementarity determining region 3 for antibody 23007
VRHYRIITAPLAGDS

SEQ ID NO: 46015 - protein, 9 aa, Homo sapiens
  light chain complementarity determining region 3 for antibody 23008
MQALETPFT

SEQ ID NO: 46016 - protein, 15 aa, Homo sapiens
  heavy chain complementarity determining region 3 for antibody 23008
VRHYRIIPDPLEGDS

SEQ ID NO: 46017 - protein, 9 aa, Homo sapiens
  light chain complementarity determining region 3 for antibody 23009
MQALETPFT

SEQ ID NO: 46018 - protein, 15 aa, Homo sapiens
  heavy chain complementarity determining region 3 for antibody 23009
VRHYRETVAVIEGDS

SEQ ID NO: 46019 - protein, 9 aa, Homo sapiens
  light chain complementarity determining region 3 for antibody 23010
MQALETPFT

SEQ ID NO: 46020 - protein, 15 aa, Homo sapiens
  heavy chain complementarity determining region 3 for antibody 23010
VRHYRETVASIEGDS

SEQ ID NO: 46021 - protein, 9 aa, Homo sapiens
  light chain complementarity determining region 3 for antibody 23011
MQALETPFT

SEQ ID NO: 46022 - protein, 15 aa, Homo sapiens
  heavy chain complementarity determining region 3 for antibody 23011
VRHYRETVAGIEGDF

SEQ ID NO: 46023 - protein, 9 aa, Homo sapiens
  light chain complementarity determining region 3 for antibody 23012
MQALETPFT

SEQ ID NO: 46024 - protein, 11 aa, Homo sapiens
  heavy chain complementarity determining region 3 for antibody 23012
VRHYRETEGDS

SEQ ID NO: 46025 - protein, 9 aa, Homo sapiens
  light chain complementarity determining region 3 for antibody 23013
MQALETPFT

SEQ ID NO: 46026 - protein, 15 aa, Homo sapiens
  heavy chain complementarity determining region 3 for antibody 23013
VRHYREPVAGIEGDS

SEQ ID NO: 46027 - protein, 9 aa, Homo sapiens
  light chain complementarity determining region 3 for antibody 23014
MQALETPFT

SEQ ID NO: 46028 - protein, 15 aa, Homo sapiens
  heavy chain complementarity determining region 3 for antibody 23014
VRHYRELTPGIEGDS

SEQ ID NO: 46029 - protein, 9 aa, Homo sapiens
  light chain complementarity determining region 3 for antibody 23015
MQALETPFT

SEQ ID NO: 46030 - protein, 15 aa, Homo sapiens
  heavy chain complementarity determining region 3 for antibody 23015
VRHYREKVAGIEGDS

SEQ ID NO: 46031 - protein, 9 aa, Homo sapiens
  light chain complementarity determining region 3 for antibody 23016
MQALETPFT

SEQ ID NO: 46032 - protein, 15 aa, Homo sapiens
  heavy chain complementarity determining region 3 for antibody 23016
VRHYRATVAGIEGDS

SEQ ID NO: 46033 - protein, 9 aa, Homo sapiens
  light chain complementarity determining region 3 for antibody 23017
MQALETPFT

SEQ ID NO: 46034 - protein, 15 aa, Homo sapiens
  heavy chain complementarity determining region 3 for antibody 23017
VRHYRALATGIEGDS

SEQ ID NO: 46035 - protein, 9 aa, Homo sapiens
  light chain complementarity determining region 3 for antibody 23018
MQALETPFT

SEQ ID NO: 46036 - protein, 15 aa, Homo sapiens
  heavy chain complementarity determining region 3 for antibody 23018
VRHYGETVAGIEGDS

SEQ ID NO: 46037 - protein, 9 aa, Homo sapiens
  light chain complementarity determining region 3 for antibody 23019
MQALETPFT

SEQ ID NO: 46038 - protein, 15 aa, Homo sapiens
  heavy chain complementarity determining region 3 for antibody 23019
VRHHRIITAPLEGDS

SEQ ID NO: 46039 - protein, 9 aa, Homo sapiens
  light chain complementarity determining region 3 for antibody 23020
MQALETPFT

SEQ ID NO: 46040 - protein, 15 aa, Homo sapiens
  heavy chain complementarity determining region 3 for antibody 23020
VRHFRIITAPLEGDS

SEQ ID NO: 46041 - protein, 9 aa, Homo sapiens
  light chain complementarity determining region 3 for antibody 23021
MQALETPFT

SEQ ID NO: 46042 - protein, 15 aa, Homo sapiens
  heavy chain complementarity determining region 3 for antibody 23021
VRHDRITVAAVEGDS

SEQ ID NO: 46043 - protein, 9 aa, Homo sapiens
  light chain complementarity determining region 3 for antibody 23022
MQALETPFT

SEQ ID NO: 46044 - protein, 15 aa, Homo sapiens
  heavy chain complementarity determining region 3 for antibody 23022
VRHDRETVAGIEGDC

SEQ ID NO: 46045 - protein, 9 aa, Homo sapiens
  light chain complementarity determining region 3 for antibody 23023
MQALETPFT

SEQ ID NO: 46046 - protein, 15 aa, Homo sapiens
  heavy chain complementarity determining region 3 for antibody 23023
VRHDRELATGIEGDS

SEQ ID NO: 46047 - protein, 9 aa, Homo sapiens
  light chain complementarity determining region 3 for antibody 23024
MQALETPFT

SEQ ID NO: 46048 - protein, 15 aa, Homo sapiens
  heavy chain complementarity determining region 3 for antibody 23024
VRDYRIITAPLEGDS

SEQ ID NO: 46049 - protein, 9 aa, Homo sapiens
  light chain complementarity determining region 3 for antibody 23025
MQALETPFT

SEQ ID NO: 46050 - protein, 15 aa, Homo sapiens
  heavy chain complementarity determining region 3 for antibody 23025
VRDYRETVAGIEGDS

SEQ ID NO: 46051 - protein, 9 aa, Homo sapiens
  light chain complementarity determining region 3 for antibody 23026
MQALETPFT

SEQ ID NO: 46052 - protein, 15 aa, Homo sapiens
  heavy chain complementarity determining region 3 for antibody 23026
VKHYRETVAGIEGDS

SEQ ID NO: 46053 - protein, 9 aa, Homo sapiens
  light chain complementarity determining region 3 for antibody 23027
MQALETPFT

SEQ ID NO: 46054 - protein, 14 aa, Homo sapiens
  heavy chain complementarity determining region 3 for antibody 23027
VKDHLMNTVTPAGY

SEQ ID NO: 46055 - protein, 9 aa, Homo sapiens
  light chain complementarity determining region 3 for antibody 23028
MQALETPFT

SEQ ID NO: 46056 - protein, 14 aa, Homo sapiens
  heavy chain complementarity determining region 3 for antibody 23028
VKDHLMKTVTTAGY

SEQ ID NO: 46057 - protein, 9 aa, Homo sapiens
  light chain complementarity determining region 3 for antibody 23029
MQALETPFT

SEQ ID NO: 46058 - protein, 15 aa, Homo sapiens
  heavy chain complementarity determining region 3 for antibody 23029
VIHYRIITAPLEGDS

SEQ ID NO: 46059 - protein, 9 aa, Homo sapiens
  light chain complementarity determining region 3 for antibody 23030
MQALETPFT

SEQ ID NO: 46060 - protein, 15 aa, Homo sapiens
  heavy chain complementarity determining region 3 for antibody 23030
VIHYRETVAGIEGDS

SEQ ID NO: 46061 - protein, 9 aa, Homo sapiens
  light chain complementarity determining region 3 for antibody 23031
MQALETPFT

SEQ ID NO: 46062 - protein, 15 aa, Homo sapiens
  heavy chain complementarity determining region 3 for antibody 23031
GRHYRIITAPLDGDS

SEQ ID NO: 46063 - protein, 9 aa, Homo sapiens
  light chain complementarity determining region 3 for antibody 23032
MQALETPFT

SEQ ID NO: 46064 - protein, 15 aa, Homo sapiens
  heavy chain complementarity determining region 3 for antibody 23032
GRHYRETVAGIEGDC

SEQ ID NO: 46065 - protein, 9 aa, Homo sapiens
  light chain complementarity determining region 3 for antibody 23033
MQALETPFT

SEQ ID NO: 46066 - protein, 15 aa, Homo sapiens
  heavy chain complementarity determining region 3 for antibody 23033
FRHYRLTVAGIEGDS

SEQ ID NO: 46067 - protein, 9 aa, Homo sapiens
  light chain complementarity determining region 3 for antibody 23034
MQALETPFT

SEQ ID NO: 46068 - protein, 15 aa, Homo sapiens
  heavy chain complementarity determining region 3 for antibody 23034
DRHYRIITAPLEGDS

SEQ ID NO: 46069 - protein, 9 aa, Homo sapiens
  light chain complementarity determining region 3 for antibody 23035
MQALETPFS

SEQ ID NO: 46070 - protein, 15 aa, Homo sapiens
  heavy chain complementarity determining region 3 for antibody 23035
VRHYRETVAGSEGDC

SEQ ID NO: 46071 - protein, 9 aa, Homo sapiens
  light chain complementarity determining region 3 for antibody 23036
MQALETPFP

SEQ ID NO: 46072 - protein, 15 aa, Homo sapiens
  heavy chain complementarity determining region 3 for antibody 23036
VRHYRVLATGIEGDS

SEQ ID NO: 46073 - protein, 9 aa, Homo sapiens
  light chain complementarity determining region 3 for antibody 23037
MQALETPFP

SEQ ID NO: 46074 - protein, 15 aa, Homo sapiens
  heavy chain complementarity determining region 3 for antibody 23037
LRHYRSLVTGTEADS

SEQ ID NO: 46075 - protein, 9 aa, Homo sapiens
  light chain complementarity determining region 3 for antibody 23038
MQALETPFN

SEQ ID NO: 46076 - protein, 15 aa, Homo sapiens
  heavy chain complementarity determining region 3 for antibody 23038
VRHYRIIPAPLEGDS

SEQ ID NO: 46077 - protein, 9 aa, Homo sapiens
  light chain complementarity determining region 3 for antibody 23039
MQALETPFN

SEQ ID NO: 46078 - protein, 15 aa, Homo sapiens
  heavy chain complementarity determining region 3 for antibody 23039
VRHYRELTTGIEGDS

SEQ ID NO: 46079 - protein, 9 aa, Homo sapiens
  light chain complementarity determining region 3 for antibody 23040
MQALETPFN

SEQ ID NO: 46080 - protein, 15 aa, Homo sapiens
  heavy chain complementarity determining region 3 for antibody 23040
VRHYRELATGFEGDS

SEQ ID NO: 46081 - protein, 9 aa, Homo sapiens
  light chain complementarity determining region 3 for antibody 23041
MQALETPFI

SEQ ID NO: 46082 - protein, 15 aa, Homo sapiens
  heavy chain complementarity determining region 3 for antibody 23041
VRHYRELATGFEGDS

SEQ ID NO: 46083 - protein, 9 aa, Homo sapiens
  light chain complementarity determining region 3 for antibody 23042
MQALETPFH

SEQ ID NO: 46084 - protein, 15 aa, Homo sapiens
  heavy chain complementarity determining region 3 for antibody 23042
VRHYRETVAGIEGDS

SEQ ID NO: 46085 - protein, 9 aa, Homo sapiens
  light chain complementarity determining region 3 for antibody 23043
MQALETPFA

SEQ ID NO: 46086 - protein, 15 aa, Homo sapiens
  heavy chain complementarity determining region 3 for antibody 23043
VRHYRELATGIEGDS

SEQ ID NO: 46087 - protein, 9 aa, Homo sapiens
  light chain complementarity determining region 3 for antibody 23044
MQALETLFT

SEQ ID NO: 46088 - protein, 15 aa, Homo sapiens
  heavy chain complementarity determining region 3 for antibody 23044
VRHYRETVAGIEGDS

SEQ ID NO: 46089 - protein, 9 aa, Homo sapiens
  light chain complementarity determining region 3 for antibody 23045
MQALETHFT

SEQ ID NO: 46090 - protein, 15 aa, Homo sapiens
  heavy chain complementarity determining region 3 for antibody 23045
VRHYRETVAGIEGDS

SEQ ID NO: 46091 - protein, 9 aa, Homo sapiens
  light chain complementarity determining region 3 for antibody 23046
MQALESPFT

SEQ ID NO: 46092 - protein, 15 aa, Homo sapiens
  heavy chain complementarity determining region 3 for antibody 23046
VRHYRITVAAVEGDS

SEQ ID NO: 46093 - protein, 9 aa, Homo sapiens
  light chain complementarity determining region 3 for antibody 23047
MQALESPFT

SEQ ID NO: 46094 - protein, 15 aa, Homo sapiens
  heavy chain complementarity determining region 3 for antibody 23047
VRHYRELATGIEGDS

SEQ ID NO: 46095 - protein, 9 aa, Homo sapiens
  light chain complementarity determining region 3 for antibody 23048
MQALESPFI

SEQ ID NO: 46096 - protein, 15 aa, Homo sapiens
  heavy chain complementarity determining region 3 for antibody 23048
VRHYRETVAGIEGDS

SEQ ID NO: 46097 - protein, 9 aa, Homo sapiens
  light chain complementarity determining region 3 for antibody 23049
MQALERPFT

SEQ ID NO: 46098 - protein, 15 aa, Homo sapiens
  heavy chain complementarity determining region 3 for antibody 23049
VRHYRETVAGIEGDS

SEQ ID NO: 46099 - protein, 9 aa, Homo sapiens
  light chain complementarity determining region 3 for antibody 23050
MQALEPQFT

SEQ ID NO: 46100 - protein, 15 aa, Homo sapiens
  heavy chain complementarity determining region 3 for antibody 23050
VRHYRIITAPLEGDS

SEQ ID NO: 46101 - protein, 9 aa, Homo sapiens
  light chain complementarity determining region 3 for antibody 23051
MQALEPPST

SEQ ID NO: 46102 - protein, 15 aa, Homo sapiens
  heavy chain complementarity determining region 3 for antibody 23051
VRHYRETVAGIEGDS

SEQ ID NO: 46103 - protein, 9 aa, Homo sapiens
  light chain complementarity determining region 3 for antibody 23052
MQALEPPLT

SEQ ID NO: 46104 - protein, 15 aa, Homo sapiens
  heavy chain complementarity determining region 3 for antibody 23052
VRHYRIITAPLEGDS

SEQ ID NO: 46105 - protein, 9 aa, Homo sapiens
  light chain complementarity determining region 3 for antibody 23053
MQALEPPFT

SEQ ID NO: 46106 - protein, 15 aa, Homo sapiens
  heavy chain complementarity determining region 3 for antibody 23053
VRHYRELATGFEGDS

SEQ ID NO: 46107 - protein, 9 aa, Homo sapiens
  light chain complementarity determining region 3 for antibody 23054
MQALEPPFP

SEQ ID NO: 46108 - protein, 15 aa, Homo sapiens
  heavy chain complementarity determining region 3 for antibody 23054
VRHYRETVAGIEGDS

SEQ ID NO: 46109 - protein, 9 aa, Homo sapiens
  light chain complementarity determining region 3 for antibody 23055
MQALENPFN

SEQ ID NO: 46110 - protein, 15 aa, Homo sapiens
  heavy chain complementarity determining region 3 for antibody 23055
VRHYRIITAPLEGDS

SEQ ID NO: 46111 - protein, 9 aa, Homo sapiens
  light chain complementarity determining region 3 for antibody 23056
MQALEMPFT

SEQ ID NO: 46112 - protein, 15 aa, Homo sapiens
  heavy chain complementarity determining region 3 for antibody 23056
VRHYRIITAPLEGDS

SEQ ID NO: 46113 - protein, 9 aa, Homo sapiens
  light chain complementarity determining region 3 for antibody 23057
MQALEIQFT

SEQ ID NO: 46114 - protein, 15 aa, Homo sapiens
  heavy chain complementarity determining region 3 for antibody 23057
VRHYRIITAPLEGDS

SEQ ID NO: 46115 - protein, 9 aa, Homo sapiens
  light chain complementarity determining region 3 for antibody 23058
MQALEIQFT

SEQ ID NO: 46116 - protein, 15 aa, Homo sapiens
  heavy chain complementarity determining region 3 for antibody 23058
VRHYRETVAGIEGDS

SEQ ID NO: 46117 - protein, 9 aa, Homo sapiens
  light chain complementarity determining region 3 for antibody 23059
MQALEIPLT

SEQ ID NO: 46118 - protein, 15 aa, Homo sapiens
  heavy chain complementarity determining region 3 for antibody 23059
VRHYRIITAPLEGDS

SEQ ID NO: 46119 - protein, 9 aa, Homo sapiens
  light chain complementarity determining region 3 for antibody 23060
MQALEIPLT

SEQ ID NO: 46120 - protein, 15 aa, Homo sapiens
  heavy chain complementarity determining region 3 for antibody 23060
VRHYRETVAGIEGDS

SEQ ID NO: 46121 - protein, 9 aa, Homo sapiens
  light chain complementarity determining region 3 for antibody 23061
MQALEIPLP

SEQ ID NO: 46122 - protein, 15 aa, Homo sapiens
  heavy chain complementarity determining region 3 for antibody 23061
VRHYRELATGIEGDS

SEQ ID NO: 46123 - protein, 9 aa, Homo sapiens
  light chain complementarity determining region 3 for antibody 23062
MQALEIPFT

SEQ ID NO: 46124 - protein, 15 aa, Homo sapiens
  heavy chain complementarity determining region 3 for antibody 23062
VSHYRETVAGIEGDS

SEQ ID NO: 46125 - protein, 9 aa, Homo sapiens
  light chain complementarity determining region 3 for antibody 23063
MQALEIPFT

SEQ ID NO: 46126 - protein, 15 aa, Homo sapiens
  heavy chain complementarity determining region 3 for antibody 23063
VRHYRETVAGSEGDS

SEQ ID NO: 46127 - protein, 9 aa, Homo sapiens
  light chain complementarity determining region 3 for antibody 23064
MQALEIPFT

SEQ ID NO: 46128 - protein, 15 aa, Homo sapiens
  heavy chain complementarity determining region 3 for antibody 23064
VRHSRIITAPLEGDS

SEQ ID NO: 46129 - protein, 9 aa, Homo sapiens
  light chain complementarity determining region 3 for antibody 23065
MQALEIPFP

SEQ ID NO: 46130 - protein, 15 aa, Homo sapiens
  heavy chain complementarity determining region 3 for antibody 23065
VRHYRETVAGIEGDS

SEQ ID NO: 46131 - protein, 9 aa, Homo sapiens
  light chain complementarity determining region 3 for antibody 23066
MQALEIPFN

SEQ ID NO: 46132 - protein, 15 aa, Homo sapiens
  heavy chain complementarity determining region 3 for antibody 23066
VRHYRETVAGIEGDS

SEQ ID NO: 46133 - protein, 9 aa, Homo sapiens
  light chain complementarity determining region 3 for antibody 23067
MQALEIPFI

SEQ ID NO: 46134 - protein, 15 aa, Homo sapiens
  heavy chain complementarity determining region 3 for antibody 23067
VRHYRETVAGIEGDS

SEQ ID NO: 46135 - protein, 9 aa, Homo sapiens
  light chain complementarity determining region 3 for antibody 23068
MQALEHPFT

SEQ ID NO: 46136 - protein, 15 aa, Homo sapiens
  heavy chain complementarity determining region 3 for antibody 23068
VRHYRELATGIEGDS

SEQ ID NO: 46137 - protein, 9 aa, Homo sapiens
  light chain complementarity determining region 3 for antibody 23069
MQALDTPST

SEQ ID NO: 46138 - protein, 15 aa, Homo sapiens
  heavy chain complementarity determining region 3 for antibody 23069
VRHYRETVAGIEGDS

SEQ ID NO: 46139 - protein, 9 aa, Homo sapiens
  light chain complementarity determining region 3 for antibody 23070
MQALDTPFT

SEQ ID NO: 46140 - protein, 15 aa, Homo sapiens
  heavy chain complementarity determining region 3 for antibody 23070
VRHYRVLATGIEGDS

SEQ ID NO: 46141 - protein, 9 aa, Homo sapiens
  light chain complementarity determining region 3 for antibody 23071
MQALDTPFT

SEQ ID NO: 46142 - protein, 15 aa, Homo sapiens
  heavy chain complementarity determining region 3 for antibody 23071
VRHYRLTVAGIEGDS

SEQ ID NO: 46143 - protein, 9 aa, Homo sapiens
  light chain complementarity determining region 3 for antibody 23072
MQALDTPFT

SEQ ID NO: 46144 - protein, 15 aa, Homo sapiens
  heavy chain complementarity determining region 3 for antibody 23072
VRHYRIITAPLDGDS

SEQ ID NO: 46145 - protein, 9 aa, Homo sapiens
  light chain complementarity determining region 3 for antibody 23073
MQALDTPFT

SEQ ID NO: 46146 - protein, 15 aa, Homo sapiens
  heavy chain complementarity determining region 3 for antibody 23073
VRHYRETVAGIEVDS

SEQ ID NO: 46147 - protein, 9 aa, Homo sapiens
  light chain complementarity determining region 3 for antibody 23074
MQALDTPFT

SEQ ID NO: 46148 - protein, 15 aa, Homo sapiens
  heavy chain complementarity determining region 3 for antibody 23074
LRHYRSLVTGTEADS

SEQ ID NO: 46149 - protein, 9 aa, Homo sapiens
  light chain complementarity determining region 3 for antibody 23075
MQALATPFT

SEQ ID NO: 46150 - protein, 15 aa, Homo sapiens
  heavy chain complementarity determining region 3 for antibody 23075
VRDYRETVAGIEGDS

SEQ ID NO: 46151 - protein, 9 aa, Homo sapiens
  light chain complementarity determining region 3 for antibody 23076
MQALATPFT

SEQ ID NO: 46152 - protein, 15 aa, Homo sapiens
  heavy chain complementarity determining region 3 for antibody 23076
IRHYRITVAAIEGDS

SEQ ID NO: 46153 - protein, 9 aa, Homo sapiens
  light chain complementarity determining region 3 for antibody 23077
MQAIETPFP

SEQ ID NO: 46154 - protein, 15 aa, Homo sapiens
  heavy chain complementarity determining region 3 for antibody 23077
VRHYRIITAPLEGDS

SEQ ID NO: 46155 - protein, 9 aa, Homo sapiens
  light chain complementarity determining region 3 for antibody 23078
MQAGQTPRT

SEQ ID NO: 46156 - protein, 14 aa, Homo sapiens
  heavy chain complementarity determining region 3 for antibody 23078
ARGHRGGKYKGIDA

SEQ ID NO: 46157 - protein, 9 aa, Homo sapiens
  light chain complementarity determining region 3 for antibody 23079
MPVLETPFT

SEQ ID NO: 46158 - protein, 15 aa, Homo sapiens
  heavy chain complementarity determining region 3 for antibody 23079
VRHYRIITAPLEGDS

SEQ ID NO: 46159 - protein, 9 aa, Homo sapiens
  light chain complementarity determining region 3 for antibody 23080
MPTLQTPTT

SEQ ID NO: 46160 - protein, 16 aa, Homo sapiens
  heavy chain complementarity determining region 3 for antibody 23080
TMDLFALGLSSGCHDY

SEQ ID NO: 46161 - protein, 9 aa, Homo sapiens
  light chain complementarity determining region 3 for antibody 23081
MPSINWPGT

SEQ ID NO: 46162 - protein, 7 aa, Homo sapiens
  heavy chain complementarity determining region 3 for antibody 23081
ATARGAD

SEQ ID NO: 46163 - protein, 9 aa, Homo sapiens
  light chain complementarity determining region 3 for antibody 23082
MPGTHWPLT

SEQ ID NO: 46164 - protein, 11 aa, Homo sapiens
  heavy chain complementarity determining region 3 for antibody 23082
ARGVLDPAFAV

SEQ ID NO: 46165 - protein, 9 aa, Homo sapiens
  light chain complementarity determining region 3 for antibody 23083
MPGLETPFT

SEQ ID NO: 46166 - protein, 15 aa, Homo sapiens
  heavy chain complementarity determining region 3 for antibody 23083
VRHYRETVAGIEGDS

SEQ ID NO: 46167 - protein, 9 aa, Homo sapiens
  light chain complementarity determining region 3 for antibody 23084
MPALGTPFT

SEQ ID NO: 46168 - protein, 15 aa, Homo sapiens
  heavy chain complementarity determining region 3 for antibody 23084
VRHYRIITAPLEGDS

SEQ ID NO: 46169 - protein, 9 aa, Homo sapiens
  light chain complementarity determining region 3 for antibody 23085
MPALETPST

SEQ ID NO: 46170 - protein, 15 aa, Homo sapiens
  heavy chain complementarity determining region 3 for antibody 23085
VRHYRIITAPLEGDS

SEQ ID NO: 46171 - protein, 9 aa, Homo sapiens
  light chain complementarity determining region 3 for antibody 23086
MPALETPFP

SEQ ID NO: 46172 - protein, 15 aa, Homo sapiens
  heavy chain complementarity determining region 3 for antibody 23086
VRHYRETVAGIEGDS

SEQ ID NO: 46173 - protein, 9 aa, Homo sapiens
  light chain complementarity determining region 3 for antibody 23087
MPALESPFT

SEQ ID NO: 46174 - protein, 15 aa, Homo sapiens
  heavy chain complementarity determining region 3 for antibody 23087
VRHYRIITAPLEGDS

SEQ ID NO: 46175 - protein, 9 aa, Homo sapiens
  light chain complementarity determining region 3 for antibody 23088
MPALATPFT

SEQ ID NO: 46176 - protein, 15 aa, Homo sapiens
  heavy chain complementarity determining region 3 for antibody 23088
VRHYRIITAPLEGDS

SEQ ID NO: 46177 - protein, 9 aa, Homo sapiens
  light chain complementarity determining region 3 for antibody 23089
MPALATPFT

SEQ ID NO: 46178 - protein, 15 aa, Homo sapiens
  heavy chain complementarity determining region 3 for antibody 23089
VRHYRETVAGIEGDS

SEQ ID NO: 46179 - protein, 9 aa, Homo sapiens
  light chain complementarity determining region 3 for antibody 23090
MLALETPFT

SEQ ID NO: 46180 - protein, 15 aa, Homo sapiens
  heavy chain complementarity determining region 3 for antibody 23090
VRHYRIMTAPLEGDS

SEQ ID NO: 46181 - protein, 9 aa, Homo sapiens
  light chain complementarity determining region 3 for antibody 23091
MKVLETPFT

SEQ ID NO: 46182 - protein, 15 aa, Homo sapiens
  heavy chain complementarity determining region 3 for antibody 23091
VRHYRETVAGIEGDS

SEQ ID NO: 46183 - protein, 9 aa, Homo sapiens
  light chain complementarity determining region 3 for antibody 23092
MKGLQTPYT

SEQ ID NO: 46184 - protein, 10 aa, Homo sapiens
  heavy chain complementarity determining region 3 for antibody 23092
GSDLTGARDH

SEQ ID NO: 46185 - protein, 9 aa, Homo sapiens
  light chain complementarity determining region 3 for antibody 23093
MKALETPFT

SEQ ID NO: 46186 - protein, 15 aa, Homo sapiens
  heavy chain complementarity determining region 3 for antibody 23093
VRHYRVLATGIEGDS

SEQ ID NO: 46187 - protein, 9 aa, Homo sapiens
  light chain complementarity determining region 3 for antibody 23094
MKALETPFT

SEQ ID NO: 46188 - protein, 15 aa, Homo sapiens
  heavy chain complementarity determining region 3 for antibody 23094
VRHYRELATGIEGDS

SEQ ID NO: 46189 - protein, 9 aa, Homo sapiens
  light chain complementarity determining region 3 for antibody 23095
MKALEIPFT

SEQ ID NO: 46190 - protein, 15 aa, Homo sapiens
  heavy chain complementarity determining region 3 for antibody 23095
VRHYRETVAGIEGDS

SEQ ID NO: 46191 - protein, 10 aa, Homo sapiens
  light chain complementarity determining region 3 for antibody 23096
MHSIQPPRWT

SEQ ID NO: 46192 - protein, 8 aa, Homo sapiens
  heavy chain complementarity determining region 3 for antibody 23096
AKGYGFDC

SEQ ID NO: 46193 - protein, 9 aa, Homo sapiens
  light chain complementarity determining region 3 for antibody 23097
MHRINWPGT

SEQ ID NO: 46194 - protein, 7 aa, Homo sapiens
  heavy chain complementarity determining region 3 for antibody 23097
ATARGAD

SEQ ID NO: 46195 - protein, 8 aa, Homo sapiens
  light chain complementarity determining region 3 for antibody 23098
MHGVQPYP

SEQ ID NO: 46196 - protein, 7 aa, Homo sapiens
  heavy chain complementarity determining region 3 for antibody 23098
ATKMGDY

SEQ ID NO: 46197 - protein, 10 aa, Homo sapiens
  light chain complementarity determining region 3 for antibody 23099
MHGTLWPRET

SEQ ID NO: 46198 - protein, 23 aa, Homo sapiens
  heavy chain complementarity determining region 3 for antibody 23099
ATGGRSSSWSRGLPPKYYYGMDV

SEQ ID NO: 46199 - protein, 10 aa, Homo sapiens
  light chain complementarity determining region 3 for antibody 23100
MHGTLWPPGA

SEQ ID NO: 46200 - protein, 23 aa, Homo sapiens
  heavy chain complementarity determining region 3 for antibody 23100
ATGGRSSSWSRGLPPKYYYGMDV

SEQ ID NO: 46201 - protein, 10 aa, Homo sapiens
  light chain complementarity determining region 3 for antibody 23101
MHGTLGPPGT

SEQ ID NO: 46202 - protein, 23 aa, Homo sapiens
  heavy chain complementarity determining region 3 for antibody 23101
ATGGRSSSWSRGLPPKYYYGMDV

SEQ ID NO: 46203 - protein, 9 aa, Homo sapiens
  light chain complementarity determining region 3 for antibody 23102
MHGTHWPRT

SEQ ID NO: 46204 - protein, 12 aa, Homo sapiens
  heavy chain complementarity determining region 3 for antibody 23102
ATLSMANAKFDH

SEQ ID NO: 46205 - protein, 9 aa, Homo sapiens
  light chain complementarity determining region 3 for antibody 23103
MHALGTPFT

SEQ ID NO: 46206 - protein, 15 aa, Homo sapiens
  heavy chain complementarity determining region 3 for antibody 23103
VRHYRIITAPLEGDS

SEQ ID NO: 46207 - protein, 9 aa, Homo sapiens
  light chain complementarity determining region 3 for antibody 23104
MHALETQFT

SEQ ID NO: 46208 - protein, 15 aa, Homo sapiens
  heavy chain complementarity determining region 3 for antibody 23104
VRHYRIITAPLEGDS

SEQ ID NO: 46209 - protein, 9 aa, Homo sapiens
  light chain complementarity determining region 3 for antibody 23105
MHALETPFT

SEQ ID NO: 46210 - protein, 15 aa, Homo sapiens
  heavy chain complementarity determining region 3 for antibody 23105
VRQYRETVAGIEGDS

SEQ ID NO: 46211 - protein, 9 aa, Homo sapiens
  light chain complementarity determining region 3 for antibody 23106
MHALETPFT

SEQ ID NO: 46212 - protein, 15 aa, Homo sapiens
  heavy chain complementarity determining region 3 for antibody 23106
VRHYRVPVAGIEGDS

SEQ ID NO: 46213 - protein, 9 aa, Homo sapiens
  light chain complementarity determining region 3 for antibody 23107
MHALETPFT

SEQ ID NO: 46214 - protein, 14 aa, Homo sapiens
  heavy chain complementarity determining region 3 for antibody 23107
VKDHLMNTVTTAGY

SEQ ID NO: 46215 - protein, 9 aa, Homo sapiens
  light chain complementarity determining region 3 for antibody 23108
MHALETPFT

SEQ ID NO: 46216 - protein, 15 aa, Homo sapiens
  heavy chain complementarity determining region 3 for antibody 23108
IRHYRITVAAIEGDS

SEQ ID NO: 46217 - protein, 9 aa, Homo sapiens
  light chain complementarity determining region 3 for antibody 23109
MHALEPPFT

SEQ ID NO: 46218 - protein, 15 aa, Homo sapiens
  heavy chain complementarity determining region 3 for antibody 23109
VRHYRIITAPLEGDS

SEQ ID NO: 46219 - protein, 9 aa, Homo sapiens
  light chain complementarity determining region 3 for antibody 23110
MHALATPFT

SEQ ID NO: 46220 - protein, 15 aa, Homo sapiens
  heavy chain complementarity determining region 3 for antibody 23110
VRHYRETVAGIEGDS

SEQ ID NO: 46221 - protein, 9 aa, Homo sapiens
  light chain complementarity determining region 3 for antibody 23111
MGTLQTPPT

SEQ ID NO: 46222 - protein, 15 aa, Homo sapiens
  heavy chain complementarity determining region 3 for antibody 23111
TRDGKKEGHNDAFDI

SEQ ID NO: 46223 - protein, 9 aa, Homo sapiens
  light chain complementarity determining region 3 for antibody 23112
MGTLQTPPT

SEQ ID NO: 46224 - protein, 15 aa, Homo sapiens
  heavy chain complementarity determining region 3 for antibody 23112
TRDGKKDGRNDAFDI

SEQ ID NO: 46225 - protein, 9 aa, Homo sapiens
  light chain complementarity determining region 3 for antibody 23113
MGTLQTPPT

SEQ ID NO: 46226 - protein, 15 aa, Homo sapiens
  heavy chain complementarity determining region 3 for antibody 23113
TRDGKKDGPNDAFDI

SEQ ID NO: 46227 - protein, 9 aa, Homo sapiens
  light chain complementarity determining region 3 for antibody 23114
MGTLQTPPT

SEQ ID NO: 46228 - protein, 15 aa, Homo sapiens
  heavy chain complementarity determining region 3 for antibody 23114
TRDGKKDGHNDAFNI

SEQ ID NO: 46229 - protein, 9 aa, Homo sapiens
  light chain complementarity determining region 3 for antibody 23115
MGTLQTPPT

SEQ ID NO: 46230 - protein, 15 aa, Homo sapiens
  heavy chain complementarity determining region 3 for antibody 23115
TRDGKKDGHDDAFDI

SEQ ID NO: 46231 - protein, 9 aa, Homo sapiens
  light chain complementarity determining region 3 for antibody 23116
MGTLQTPPP

SEQ ID NO: 46232 - protein, 15 aa, Homo sapiens
  heavy chain complementarity determining region 3 for antibody 23116
TRDGKKDGHNDAFDV

SEQ ID NO: 46233 - protein, 9 aa, Homo sapiens
  light chain complementarity determining region 3 for antibody 23117
MGTLQTPPP

SEQ ID NO: 46234 - protein, 15 aa, Homo sapiens
  heavy chain complementarity determining region 3 for antibody 23117
TRAGKKDGHNDAFDI

SEQ ID NO: 46235 - protein, 9 aa, Homo sapiens
  light chain complementarity determining region 3 for antibody 23118
MGTLQSPPR

SEQ ID NO: 46236 - protein, 15 aa, Homo sapiens
  heavy chain complementarity determining region 3 for antibody 23118
TRDGKRDGHNDAFDI

SEQ ID NO: 46237 - protein, 9 aa, Homo sapiens
  light chain complementarity determining region 3 for antibody 23119
MGTLQRPPT

SEQ ID NO: 46238 - protein, 15 aa, Homo sapiens
  heavy chain complementarity determining region 3 for antibody 23119
TRDGKRDGHNDAFDI

SEQ ID NO: 46239 - protein, 9 aa, Homo sapiens
  light chain complementarity determining region 3 for antibody 23120
MGTLQNPPP

SEQ ID NO: 46240 - protein, 15 aa, Homo sapiens
  heavy chain complementarity determining region 3 for antibody 23120
TRDGKRDGHNDAFDI

SEQ ID NO: 46241 - protein, 9 aa, Homo sapiens
  light chain complementarity determining region 3 for antibody 23121
MGTLQIPPT

SEQ ID NO: 46242 - protein, 15 aa, Homo sapiens
  heavy chain complementarity determining region 3 for antibody 23121
TRDGKKDGHNDAFDI

SEQ ID NO: 46243 - protein, 9 aa, Homo sapiens
  light chain complementarity determining region 3 for antibody 23122
MGTLPTPPP

SEQ ID NO: 46244 - protein, 15 aa, Homo sapiens
  heavy chain complementarity determining region 3 for antibody 23122
TRDGKKDGHNDAFDI

SEQ ID NO: 46245 - protein, 9 aa, Homo sapiens
  light chain complementarity determining region 3 for antibody 23123
MGTLKTPPT

SEQ ID NO: 46246 - protein, 15 aa, Homo sapiens
  heavy chain complementarity determining region 3 for antibody 23123
TRDGKKDGHNDAFDV

SEQ ID NO: 46247 - protein, 9 aa, Homo sapiens
  light chain complementarity determining region 3 for antibody 23124
MGTLKTPPT

SEQ ID NO: 46248 - protein, 15 aa, Homo sapiens
  heavy chain complementarity determining region 3 for antibody 23124
TRDGKKDGHNDAFDI

SEQ ID NO: 46249 - protein, 9 aa, Homo sapiens
  light chain complementarity determining region 3 for antibody 23125
MGSLQTPPT

SEQ ID NO: 46250 - protein, 15 aa, Homo sapiens
  heavy chain complementarity determining region 3 for antibody 23125
TRDGKRDGHNDAFDI

SEQ ID NO: 46251 - protein, 9 aa, Homo sapiens
  light chain complementarity determining region 3 for antibody 23126
MGPLQTPPT

SEQ ID NO: 46252 - protein, 15 aa, Homo sapiens
  heavy chain complementarity determining region 3 for antibody 23126
TRDGKKDGHNDAFDV

SEQ ID NO: 46253 - protein, 9 aa, Homo sapiens
  light chain complementarity determining region 3 for antibody 23127
MGILQTPPT

SEQ ID NO: 46254 - protein, 15 aa, Homo sapiens
  heavy chain complementarity determining region 3 for antibody 23127
TRDGKKDGHNDAFDI

SEQ ID NO: 46255 - protein, 9 aa, Homo sapiens
  light chain complementarity determining region 3 for antibody 23128
MEVGQSPWT

SEQ ID NO: 46256 - protein, 18 aa, Homo sapiens
  heavy chain complementarity determining region 3 for antibody 23128
IRGGRMYCSGEPCYSGSL

SEQ ID NO: 46257 - protein, 9 aa, Homo sapiens
  light chain complementarity determining region 3 for antibody 23129
MEALETPFT

SEQ ID NO: 46258 - protein, 15 aa, Homo sapiens
  heavy chain complementarity determining region 3 for antibody 23129
VRHYRETVAGIEGDS

SEQ ID NO: 46259 - protein, 9 aa, Homo sapiens
  light chain complementarity determining region 3 for antibody 23130
LRYGFAQYS

SEQ ID NO: 46260 - protein, 18 aa, Homo sapiens
  heavy chain complementarity determining region 3 for antibody 23130
TGVHGLTMLRGATKPFDF

SEQ ID NO: 46261 - protein, 9 aa, Homo sapiens
  light chain complementarity determining region 3 for antibody 23131
LQYYSTPWT

SEQ ID NO: 46262 - protein, 15 aa, Homo sapiens
  heavy chain complementarity determining region 3 for antibody 23131
IRQSKVDNSYNYPDF

SEQ ID NO: 46263 - protein, 9 aa, Homo sapiens
  light chain complementarity determining region 3 for antibody 23132
LQYYSTPWP

SEQ ID NO: 46264 - protein, 15 aa, Homo sapiens
  heavy chain complementarity determining region 3 for antibody 23132
IRQSKVDNYYNYPDF

SEQ ID NO: 46265 - protein, 9 aa, Homo sapiens
  light chain complementarity determining region 3 for antibody 23133
LQYYATPWP

SEQ ID NO: 46266 - protein, 15 aa, Homo sapiens
  heavy chain complementarity determining region 3 for antibody 23133
VRQSKVDNNYNYPDF

SEQ ID NO: 46267 - protein, 9 aa, Homo sapiens
  light chain complementarity determining region 3 for antibody 23134
LQYTNFPFT

SEQ ID NO: 46268 - protein, 6 aa, Homo sapiens
  heavy chain complementarity determining region 3 for antibody 23134
LAALDH

SEQ ID NO: 46269 - protein, 9 aa, Homo sapiens
  light chain complementarity determining region 3 for antibody 23135
LQYNVWPYT

SEQ ID NO: 46270 - protein, 13 aa, Homo sapiens
  heavy chain complementarity determining region 3 for antibody 23135
ARVMAAAGYGMDV

SEQ ID NO: 46271 - protein, 9 aa, Homo sapiens
  light chain complementarity determining region 3 for antibody 23136
LQYNSFPFT

SEQ ID NO: 46272 - protein, 7 aa, Homo sapiens
  heavy chain complementarity determining region 3 for antibody 23136
ALYRLDY

SEQ ID NO: 46273 - protein, 9 aa, Homo sapiens
  light chain complementarity determining region 3 for antibody 23137
LQYNRYPRT

SEQ ID NO: 46274 - protein, 6 aa, Homo sapiens
  heavy chain complementarity determining region 3 for antibody 23137
TRALDY

SEQ ID NO: 46275 - protein, 10 aa, Homo sapiens
  light chain complementarity determining region 3 for antibody 23138
LQYNNWPPWT

SEQ ID NO: 46276 - protein, 13 aa, Homo sapiens
  heavy chain complementarity determining region 3 for antibody 23138
SRGFQPLPDGLDV

SEQ ID NO: 46277 - protein, 9 aa, Homo sapiens
  light chain complementarity determining region 3 for antibody 23139
LQYKSYPRP

SEQ ID NO: 46278 - protein, 6 aa, Homo sapiens
  heavy chain complementarity determining region 3 for antibody 23139
SRALDY

SEQ ID NO: 46279 - protein, 9 aa, Homo sapiens
  light chain complementarity determining region 3 for antibody 23140
LQYKIYPRT

SEQ ID NO: 46280 - protein, 6 aa, Homo sapiens
  heavy chain complementarity determining region 3 for antibody 23140
ARALDY

SEQ ID NO: 46281 - protein, 9 aa, Homo sapiens
  light chain complementarity determining region 3 for antibody 23141
LQYKIYPRK

SEQ ID NO: 46282 - protein, 6 aa, Homo sapiens
  heavy chain complementarity determining region 3 for antibody 23141
SRALDY

SEQ ID NO: 46283 - protein, 9 aa, Homo sapiens
  light chain complementarity determining region 3 for antibody 23142
LQYKISPRT

SEQ ID NO: 46284 - protein, 6 aa, Homo sapiens
  heavy chain complementarity determining region 3 for antibody 23142
SRALDY

SEQ ID NO: 46285 - protein, 9 aa, Homo sapiens
  light chain complementarity determining region 3 for antibody 23143
LQYKGYPRT

SEQ ID NO: 46286 - protein, 6 aa, Homo sapiens
  heavy chain complementarity determining region 3 for antibody 23143
SRALDY

SEQ ID NO: 46287 - protein, 9 aa, Homo sapiens
  light chain complementarity determining region 3 for antibody 23144
LQYINFPFT

SEQ ID NO: 46288 - protein, 6 aa, Homo sapiens
  heavy chain complementarity determining region 3 for antibody 23144
LADLDH

SEQ ID NO: 46289 - protein, 9 aa, Homo sapiens
  light chain complementarity determining region 3 for antibody 23145
LQYGTSPRT

SEQ ID NO: 46290 - protein, 13 aa, Homo sapiens
  heavy chain complementarity determining region 3 for antibody 23145
PIGFYDRSGYHEY

SEQ ID NO: 46291 - protein, 9 aa, Homo sapiens
  light chain complementarity determining region 3 for antibody 23146
LQYGTSPRT

SEQ ID NO: 46292 - protein, 13 aa, Homo sapiens
  heavy chain complementarity determining region 3 for antibody 23146
AGGSGSGTYYKEH

SEQ ID NO: 46293 - protein, 9 aa, Homo sapiens
  light chain complementarity determining region 3 for antibody 23147
LQYGTSPFT

SEQ ID NO: 46294 - protein, 15 aa, Homo sapiens
  heavy chain complementarity determining region 3 for antibody 23147
ARQNDFLSGPGEFDP

SEQ ID NO: 46295 - protein, 9 aa, Homo sapiens
  light chain complementarity determining region 3 for antibody 23148
LQYGSSPRT

SEQ ID NO: 46296 - protein, 25 aa, Homo sapiens
  heavy chain complementarity determining region 3 for antibody 23148
ARLRIDRLRLPGAMRGPLYDCGLNV

SEQ ID NO: 46297 - protein, 10 aa, Homo sapiens
  light chain complementarity determining region 3 for antibody 23149
LQYGSSPMYS

SEQ ID NO: 46298 - protein, 11 aa, Homo sapiens
  heavy chain complementarity determining region 3 for antibody 23149
ARGGQWGSLDY

SEQ ID NO: 46299 - protein, 9 aa, Homo sapiens
  light chain complementarity determining region 3 for antibody 23150
LQYGGTPLT

SEQ ID NO: 46300 - protein, 8 aa, Homo sapiens
  heavy chain complementarity determining region 3 for antibody 23150
VRIMDHGY

SEQ ID NO: 46301 - protein, 9 aa, Homo sapiens
  light chain complementarity determining region 3 for antibody 23151
LQYGGTPLT

SEQ ID NO: 46302 - protein, 8 aa, Homo sapiens
  heavy chain complementarity determining region 3 for antibody 23151
VRIMAPGY

SEQ ID NO: 46303 - protein, 9 aa, Homo sapiens
  light chain complementarity determining region 3 for antibody 23152
LQYGFVQYS

SEQ ID NO: 46304 - protein, 18 aa, Homo sapiens
  heavy chain complementarity determining region 3 for antibody 23152
TGVHGLTMLRGATKPFDF

SEQ ID NO: 46305 - protein, 9 aa, Homo sapiens
  light chain complementarity determining region 3 for antibody 23153
LQYGFSQYS

SEQ ID NO: 46306 - protein, 18 aa, Homo sapiens
  heavy chain complementarity determining region 3 for antibody 23153
TGVHGLTMLRGATNPFDF

SEQ ID NO: 46307 - protein, 9 aa, Homo sapiens
  light chain complementarity determining region 3 for antibody 23154
LQYGFSQFS

SEQ ID NO: 46308 - protein, 18 aa, Homo sapiens
  heavy chain complementarity determining region 3 for antibody 23154
TGVHGLTMLRGATKPFDF

SEQ ID NO: 46309 - protein, 9 aa, Homo sapiens
  light chain complementarity determining region 3 for antibody 23155
LQYGFDQYS

SEQ ID NO: 46310 - protein, 18 aa, Homo sapiens
  heavy chain complementarity determining region 3 for antibody 23155
TGVHGLTMLRGATKPFDF

SEQ ID NO: 46311 - protein, 9 aa, Homo sapiens
  light chain complementarity determining region 3 for antibody 23156
LQYGFAQYS

SEQ ID NO: 46312 - protein, 18 aa, Homo sapiens
  heavy chain complementarity determining region 3 for antibody 23156
TVVHGLTMLRGATNPFDF

SEQ ID NO: 46313 - protein, 9 aa, Homo sapiens
  light chain complementarity determining region 3 for antibody 23157
LQYGFAQYS

SEQ ID NO: 46314 - protein, 18 aa, Homo sapiens
  heavy chain complementarity determining region 3 for antibody 23157
TGVHGPTMLRGATKPFDF

SEQ ID NO: 46315 - protein, 9 aa, Homo sapiens
  light chain complementarity determining region 3 for antibody 23158
LQYGFAQYS

SEQ ID NO: 46316 - protein, 18 aa, Homo sapiens
  heavy chain complementarity determining region 3 for antibody 23158
TGVHGLTRLRGATKPFDF

SEQ ID NO: 46317 - protein, 9 aa, Homo sapiens
  light chain complementarity determining region 3 for antibody 23159
LQYGFAQYS

SEQ ID NO: 46318 - protein, 18 aa, Homo sapiens
  heavy chain complementarity determining region 3 for antibody 23159
TGVHGLTMLRGAAKPFDF

SEQ ID NO: 46319 - protein, 9 aa, Homo sapiens
  light chain complementarity determining region 3 for antibody 23160
LQYGFAQYS

SEQ ID NO: 46320 - protein, 18 aa, Homo sapiens
  heavy chain complementarity determining region 3 for antibody 23160
SGVHGLTMLRGATKPFDF

SEQ ID NO: 46321 - protein, 9 aa, Homo sapiens
  light chain complementarity determining region 3 for antibody 23161
LQYGFAQYS

SEQ ID NO: 46322 - protein, 18 aa, Homo sapiens
  heavy chain complementarity determining region 3 for antibody 23161
AGVHGLTMLRGATKPFDF

SEQ ID NO: 46323 - protein, 9 aa, Homo sapiens
  light chain complementarity determining region 3 for antibody 23162
LQYGFAQYR

SEQ ID NO: 46324 - protein, 18 aa, Homo sapiens
  heavy chain complementarity determining region 3 for antibody 23162
TGVHGLTMLRGATNPFDF

SEQ ID NO: 46325 - protein, 9 aa, Homo sapiens
  light chain complementarity determining region 3 for antibody 23163
LQYGFAQVS

SEQ ID NO: 46326 - protein, 18 aa, Homo sapiens
  heavy chain complementarity determining region 3 for antibody 23163
TGVHGLTMLRGATKPFDF

SEQ ID NO: 46327 - protein, 9 aa, Homo sapiens
  light chain complementarity determining region 3 for antibody 23164
LQYGFAQNS

SEQ ID NO: 46328 - protein, 18 aa, Homo sapiens
  heavy chain complementarity determining region 3 for antibody 23164
TGVHGLTMLRGATKPFDF

SEQ ID NO: 46329 - protein, 9 aa, Homo sapiens
  light chain complementarity determining region 3 for antibody 23165
LQYGFAQHS

SEQ ID NO: 46330 - protein, 18 aa, Homo sapiens
  heavy chain complementarity determining region 3 for antibody 23165
TGVHGLTMLRGATNPFDF

SEQ ID NO: 46331 - protein, 9 aa, Homo sapiens
  light chain complementarity determining region 3 for antibody 23166
LQYGFAQFS

SEQ ID NO: 46332 - protein, 18 aa, Homo sapiens
  heavy chain complementarity determining region 3 for antibody 23166
TGVHGLTMLRGATKPFDF

SEQ ID NO: 46333 - protein, 9 aa, Homo sapiens
  light chain complementarity determining region 3 for antibody 23167
LQYGFAKYS

SEQ ID NO: 46334 - protein, 18 aa, Homo sapiens
  heavy chain complementarity determining region 3 for antibody 23167
TGVHGLTMLRGATKPFDF

SEQ ID NO: 46335 - protein, 9 aa, Homo sapiens
  light chain complementarity determining region 3 for antibody 23168
LQYGFAHYS

SEQ ID NO: 46336 - protein, 18 aa, Homo sapiens
  heavy chain complementarity determining region 3 for antibody 23168
TGVHGLTMLRGATKPFDF

SEQ ID NO: 46337 - protein, 9 aa, Homo sapiens
  light chain complementarity determining region 3 for antibody 23169
LQTLQTPWT

SEQ ID NO: 46338 - protein, 13 aa, Homo sapiens
  heavy chain complementarity determining region 3 for antibody 23169
AKVVSYGSGGLHY

SEQ ID NO: 46339 - protein, 9 aa, Homo sapiens
  light chain complementarity determining region 3 for antibody 23170
LQTEYWPRT

SEQ ID NO: 46340 - protein, 11 aa, Homo sapiens
  heavy chain complementarity determining region 3 for antibody 23170
VRVGGAGYFDH

SEQ ID NO: 46341 - protein, 9 aa, Homo sapiens
  light chain complementarity determining region 3 for antibody 23171
LQSVLLPQT

SEQ ID NO: 46342 - protein, 10 aa, Homo sapiens
  heavy chain complementarity determining region 3 for antibody 23171
AREVRHYFET

SEQ ID NO: 46343 - protein, 9 aa, Homo sapiens
  light chain complementarity determining region 3 for antibody 23172
LQSLHWPGT

SEQ ID NO: 46344 - protein, 11 aa, Homo sapiens
  heavy chain complementarity determining region 3 for antibody 23172
GRHIRRSPEDY

SEQ ID NO: 46345 - protein, 9 aa, Homo sapiens
  light chain complementarity determining region 3 for antibody 23173
LQSINWPWT

SEQ ID NO: 46346 - protein, 11 aa, Homo sapiens
  heavy chain complementarity determining region 3 for antibody 23173
GRHIRRSPEDY

SEQ ID NO: 46347 - protein, 9 aa, Homo sapiens
  light chain complementarity determining region 3 for antibody 23174
LQSHSSPFT

SEQ ID NO: 46348 - protein, 17 aa, Homo sapiens
  heavy chain complementarity determining region 3 for antibody 23174
AKDHFPFAAGLRGGVDY

SEQ ID NO: 46349 - protein, 9 aa, Homo sapiens
  light chain complementarity determining region 3 for antibody 23175
LQSHSSPFT

SEQ ID NO: 46350 - protein, 17 aa, Homo sapiens
  heavy chain complementarity determining region 3 for antibody 23175
AKDHFPCAAGRRGGVDY

SEQ ID NO: 46351 - protein, 9 aa, Homo sapiens
  light chain complementarity determining region 3 for antibody 23176
LQSHSSPFT

SEQ ID NO: 46352 - protein, 17 aa, Homo sapiens
  heavy chain complementarity determining region 3 for antibody 23176
AKDHCPFAAGRRGGVDY

SEQ ID NO: 46353 - protein, 9 aa, Homo sapiens
  light chain complementarity determining region 3 for antibody 23177
LQSHSSPFT

SEQ ID NO: 46354 - protein, 17 aa, Homo sapiens
  heavy chain complementarity determining region 3 for antibody 23177
AEDHFPFAAGRRGGVDY

SEQ ID NO: 46355 - protein, 9 aa, Homo sapiens
  light chain complementarity determining region 3 for antibody 23178
LQSHSSPFP

SEQ ID NO: 46356 - protein, 17 aa, Homo sapiens
  heavy chain complementarity determining region 3 for antibody 23178
AKDHFPFAAGRRGGVDY

SEQ ID NO: 46357 - protein, 10 aa, Homo sapiens
  light chain complementarity determining region 3 for antibody 23179
LQRVNWPPSS

SEQ ID NO: 46358 - protein, 20 aa, Homo sapiens
  heavy chain complementarity determining region 3 for antibody 23179
AREPLDQGDYPSPGYWYFDL

SEQ ID NO: 46359 - protein, 9 aa, Homo sapiens
  light chain complementarity determining region 3 for antibody 23180
LQRSNWPPL

SEQ ID NO: 46360 - protein, 12 aa, Homo sapiens
  heavy chain complementarity determining region 3 for antibody 23180
ARSLKRWGNFDY

SEQ ID NO: 46361 - protein, 9 aa, Homo sapiens
  light chain complementarity determining region 3 for antibody 23181
LQRSNWPFT

SEQ ID NO: 46362 - protein, 14 aa, Homo sapiens
  heavy chain complementarity determining region 3 for antibody 23181
ARSLSSAWYDWSDP

SEQ ID NO: 46363 - protein, 8 aa, Homo sapiens
  light chain complementarity determining region 3 for antibody 23182
LQRSDGYT

SEQ ID NO: 46364 - protein, 13 aa, Homo sapiens
  heavy chain complementarity determining region 3 for antibody 23182
VTNSGSYPNYLDP

SEQ ID NO: 46365 - protein, 8 aa, Homo sapiens
  light chain complementarity determining region 3 for antibody 23183
LQRSDGYT

SEQ ID NO: 46366 - protein, 13 aa, Homo sapiens
  heavy chain complementarity determining region 3 for antibody 23183
ATDSGSYPNYLDP

SEQ ID NO: 46367 - protein, 8 aa, Homo sapiens
  light chain complementarity determining region 3 for antibody 23184
LQRSDGHT

SEQ ID NO: 46368 - protein, 13 aa, Homo sapiens
  heavy chain complementarity determining region 3 for antibody 23184
VTNSGSYPNYLDP

SEQ ID NO: 46369 - protein, 9 aa, Homo sapiens
  light chain complementarity determining region 3 for antibody 23185
LQPNSYPLT

SEQ ID NO: 46370 - protein, 18 aa, Homo sapiens
  heavy chain complementarity determining region 3 for antibody 23185
GRISVMTVGGKDYYGMDV

SEQ ID NO: 46371 - protein, 9 aa, Homo sapiens
  light chain complementarity determining region 3 for antibody 23186
LQNGNLPRT

SEQ ID NO: 46372 - protein, 13 aa, Homo sapiens
  heavy chain complementarity determining region 3 for antibody 23186
AGGQFHSSGYSEF

SEQ ID NO: 46373 - protein, 9 aa, Homo sapiens
  light chain complementarity determining region 3 for antibody 23187
LQNGGTPLT

SEQ ID NO: 46374 - protein, 8 aa, Homo sapiens
  heavy chain complementarity determining region 3 for antibody 23187
VRIMDPGY

SEQ ID NO: 46375 - protein, 9 aa, Homo sapiens
  light chain complementarity determining region 3 for antibody 23188
LQNGFSQYS

SEQ ID NO: 46376 - protein, 18 aa, Homo sapiens
  heavy chain complementarity determining region 3 for antibody 23188
TGVHGLTMLRGATKPFDF

SEQ ID NO: 46377 - protein, 9 aa, Homo sapiens
  light chain complementarity determining region 3 for antibody 23189
LQNGFAQYS

SEQ ID NO: 46378 - protein, 18 aa, Homo sapiens
  heavy chain complementarity determining region 3 for antibody 23189
TGVHGLTMLRGATKPFDF

SEQ ID NO: 46379 - protein, 9 aa, Homo sapiens
  light chain complementarity determining region 3 for antibody 23190
LQNEYWPRT

SEQ ID NO: 46380 - protein, 11 aa, Homo sapiens
  heavy chain complementarity determining region 3 for antibody 23190
VSVGGAGYFDH

SEQ ID NO: 46381 - protein, 9 aa, Homo sapiens
  light chain complementarity determining region 3 for antibody 23191
LQNEYWPRT

SEQ ID NO: 46382 - protein, 11 aa, Homo sapiens
  heavy chain complementarity determining region 3 for antibody 23191
VRVGGAGYFGH

SEQ ID NO: 46383 - protein, 9 aa, Homo sapiens
  light chain complementarity determining region 3 for antibody 23192
LQNEYWPRT

SEQ ID NO: 46384 - protein, 11 aa, Homo sapiens
  heavy chain complementarity determining region 3 for antibody 23192
VRVGGAGYFDL

SEQ ID NO: 46385 - protein, 9 aa, Homo sapiens
  light chain complementarity determining region 3 for antibody 23193
LQNEYWPRT

SEQ ID NO: 46386 - protein, 11 aa, Homo sapiens
  heavy chain complementarity determining region 3 for antibody 23193
VRVGGAGFFDH

SEQ ID NO: 46387 - protein, 9 aa, Homo sapiens
  light chain complementarity determining region 3 for antibody 23194
LQNEYWPRP

SEQ ID NO: 46388 - protein, 11 aa, Homo sapiens
  heavy chain complementarity determining region 3 for antibody 23194
VRVGGAGYFDH

SEQ ID NO: 46389 - protein, 9 aa, Homo sapiens
  light chain complementarity determining region 3 for antibody 23195
LQNEYWLRT

SEQ ID NO: 46390 - protein, 11 aa, Homo sapiens
  heavy chain complementarity determining region 3 for antibody 23195
VRVGGAGYFDH

SEQ ID NO: 46391 - protein, 9 aa, Homo sapiens
  light chain complementarity determining region 3 for antibody 23196
LQNEYWHRT

SEQ ID NO: 46392 - protein, 11 aa, Homo sapiens
  heavy chain complementarity determining region 3 for antibody 23196
VRVGGAGYFDH

SEQ ID NO: 46393 - protein, 9 aa, Homo sapiens
  light chain complementarity determining region 3 for antibody 23197
LQNEYRPRT

SEQ ID NO: 46394 - protein, 11 aa, Homo sapiens
  heavy chain complementarity determining region 3 for antibody 23197
VRVGGAGYFDH

SEQ ID NO: 46395 - protein, 9 aa, Homo sapiens
  light chain complementarity determining region 3 for antibody 23198
LQNDNWPRT

SEQ ID NO: 46396 - protein, 11 aa, Homo sapiens
  heavy chain complementarity determining region 3 for antibody 23198
VRVGGAGYFDH

SEQ ID NO: 46397 - protein, 9 aa, Homo sapiens
  light chain complementarity determining region 3 for antibody 23199
LQNAYWPRT

SEQ ID NO: 46398 - protein, 11 aa, Homo sapiens
  heavy chain complementarity determining region 3 for antibody 23199
VRVGGAGYFDH

SEQ ID NO: 46399 - protein, 9 aa, Homo sapiens
  light chain complementarity determining region 3 for antibody 23200
LQLNSYPLT

SEQ ID NO: 46400 - protein, 13 aa, Homo sapiens
  heavy chain complementarity determining region 3 for antibody 23200
VRHAVVRPMVVDD

SEQ ID NO: 46401 - protein, 9 aa, Homo sapiens
  light chain complementarity determining region 3 for antibody 23201
LQLNSYPLT

SEQ ID NO: 46402 - protein, 22 aa, Homo sapiens
  heavy chain complementarity determining region 3 for antibody 23201
ARDQASTVVVVSRPWEVSDLTF

SEQ ID NO: 46403 - protein, 9 aa, Homo sapiens
  light chain complementarity determining region 3 for antibody 23202
LQHTTYPRT

SEQ ID NO: 46404 - protein, 7 aa, Homo sapiens
  heavy chain complementarity determining region 3 for antibody 23202
SNAHFDY

SEQ ID NO: 46405 - protein, 9 aa, Homo sapiens
  light chain complementarity determining region 3 for antibody 23203
LQHTSFPLT

SEQ ID NO: 46406 - protein, 10 aa, Homo sapiens
  heavy chain complementarity determining region 3 for antibody 23203
ARDDLWSFDY

SEQ ID NO: 46407 - protein, 9 aa, Homo sapiens
  light chain complementarity determining region 3 for antibody 23204
LQHSSYPLT

SEQ ID NO: 46408 - protein, 22 aa, Homo sapiens
  heavy chain complementarity determining region 3 for antibody 23204
ARDQASTVVVVSRPWEVSDLTF

SEQ ID NO: 46409 - protein, 9 aa, Homo sapiens
  light chain complementarity determining region 3 for antibody 23205
LQHNTYPWT

SEQ ID NO: 46410 - protein, 18 aa, Homo sapiens
  heavy chain complementarity determining region 3 for antibody 23205
ARDGVDYAPRDYSYGLDV

SEQ ID NO: 46411 - protein, 9 aa, Homo sapiens
  light chain complementarity determining region 3 for antibody 23206
LQHNTYPRT

SEQ ID NO: 46412 - protein, 7 aa, Homo sapiens
  heavy chain complementarity determining region 3 for antibody 23206
SNAPFDY

SEQ ID NO: 46413 - protein, 9 aa, Homo sapiens
  light chain complementarity determining region 3 for antibody 23207
LQHNTYPRT

SEQ ID NO: 46414 - protein, 7 aa, Homo sapiens
  heavy chain complementarity determining region 3 for antibody 23207
SNALFDY

SEQ ID NO: 46415 - protein, 9 aa, Homo sapiens
  light chain complementarity determining region 3 for antibody 23208
LQHNTYPLT

SEQ ID NO: 46416 - protein, 20 aa, Homo sapiens
  heavy chain complementarity determining region 3 for antibody 23208
ARGDHVVVVTSFHGTQGINS

SEQ ID NO: 46417 - protein, 9 aa, Homo sapiens
  light chain complementarity determining region 3 for antibody 23209
LQHNTYPCT

SEQ ID NO: 46418 - protein, 18 aa, Homo sapiens
  heavy chain complementarity determining region 3 for antibody 23209
ARDGVDYAPRDYYYGLDV

SEQ ID NO: 46419 - protein, 9 aa, Homo sapiens
  light chain complementarity determining region 3 for antibody 23210
LQHNSYSLT

SEQ ID NO: 46420 - protein, 13 aa, Homo sapiens
  heavy chain complementarity determining region 3 for antibody 23210
VRHAVVRPMVVDD

SEQ ID NO: 46421 - protein, 9 aa, Homo sapiens
  light chain complementarity determining region 3 for antibody 23211
LQHNSYPYT

SEQ ID NO: 46422 - protein, 17 aa, Homo sapiens
  heavy chain complementarity determining region 3 for antibody 23211
VRDRRGRVFFGDDAFDV

SEQ ID NO: 46423 - protein, 10 aa, Homo sapiens
  light chain complementarity determining region 3 for antibody 23212
LQHNSYPSLT

SEQ ID NO: 46424 - protein, 15 aa, Homo sapiens
  heavy chain complementarity determining region 3 for antibody 23212
VFSGAAVGRFFVGNY

SEQ ID NO: 46425 - protein, 10 aa, Homo sapiens
  light chain complementarity determining region 3 for antibody 23213
LQHNSYPSLT

SEQ ID NO: 46426 - protein, 15 aa, Homo sapiens
  heavy chain complementarity determining region 3 for antibody 23213
VFSGAAVGRFCVGDY

SEQ ID NO: 46427 - protein, 9 aa, Homo sapiens
  light chain complementarity determining region 3 for antibody 23214
LQHNSYPPT

SEQ ID NO: 46428 - protein, 13 aa, Homo sapiens
  heavy chain complementarity determining region 3 for antibody 23214
ARSTTGLSGFFDS

SEQ ID NO: 46429 - protein, 9 aa, Homo sapiens
  light chain complementarity determining region 3 for antibody 23215
LQHNSYPLT

SEQ ID NO: 46430 - protein, 13 aa, Homo sapiens
  heavy chain complementarity determining region 3 for antibody 23215
VRRAVVRPMVVDD

SEQ ID NO: 46431 - protein, 9 aa, Homo sapiens
  light chain complementarity determining region 3 for antibody 23216
LQHNSYPLT

SEQ ID NO: 46432 - protein, 13 aa, Homo sapiens
  heavy chain complementarity determining region 3 for antibody 23216
VRPAVVRPMVVDD

SEQ ID NO: 46433 - protein, 9 aa, Homo sapiens
  light chain complementarity determining region 3 for antibody 23217
LQHNSYPLT

SEQ ID NO: 46434 - protein, 13 aa, Homo sapiens
  heavy chain complementarity determining region 3 for antibody 23217
VRHTVVSPIVVDD

SEQ ID NO: 46435 - protein, 9 aa, Homo sapiens
  light chain complementarity determining region 3 for antibody 23218
LQHNSYPLT

SEQ ID NO: 46436 - protein, 13 aa, Homo sapiens
  heavy chain complementarity determining region 3 for antibody 23218
VRHTVVRPSVVDD

SEQ ID NO: 46437 - protein, 9 aa, Homo sapiens
  light chain complementarity determining region 3 for antibody 23219
LQHNSYPLT

SEQ ID NO: 46438 - protein, 13 aa, Homo sapiens
  heavy chain complementarity determining region 3 for antibody 23219
VRHLVRGGLVVDD

SEQ ID NO: 46439 - protein, 9 aa, Homo sapiens
  light chain complementarity determining region 3 for antibody 23220
LQHNSYPLT

SEQ ID NO: 46440 - protein, 13 aa, Homo sapiens
  heavy chain complementarity determining region 3 for antibody 23220
VRHAVVRPVVVDD

SEQ ID NO: 46441 - protein, 9 aa, Homo sapiens
  light chain complementarity determining region 3 for antibody 23221
LQHNSYPLT

SEQ ID NO: 46442 - protein, 13 aa, Homo sapiens
  heavy chain complementarity determining region 3 for antibody 23221
VRHAVVRPMVVDY

SEQ ID NO: 46443 - protein, 9 aa, Homo sapiens
  light chain complementarity determining region 3 for antibody 23222
LQHNSYPLT

SEQ ID NO: 46444 - protein, 13 aa, Homo sapiens
  heavy chain complementarity determining region 3 for antibody 23222
VRHAVVRPMVVDV

SEQ ID NO: 46445 - protein, 9 aa, Homo sapiens
  light chain complementarity determining region 3 for antibody 23223
LQHNSYPLT

SEQ ID NO: 46446 - protein, 13 aa, Homo sapiens
  heavy chain complementarity determining region 3 for antibody 23223
VRHAVVRPMVFDD

SEQ ID NO: 46447 - protein, 9 aa, Homo sapiens
  light chain complementarity determining region 3 for antibody 23224
LQHNSYPLT

SEQ ID NO: 46448 - protein, 13 aa, Homo sapiens
  heavy chain complementarity determining region 3 for antibody 23224
VRHAVVRPMVADD

SEQ ID NO: 46449 - protein, 9 aa, Homo sapiens
  light chain complementarity determining region 3 for antibody 23225
LQHNSYPLT

SEQ ID NO: 46450 - protein, 13 aa, Homo sapiens
  heavy chain complementarity determining region 3 for antibody 23225
VRHAVVRPMFVDD

SEQ ID NO: 46451 - protein, 9 aa, Homo sapiens
  light chain complementarity determining region 3 for antibody 23226
LQHNSYPLT

SEQ ID NO: 46452 - protein, 13 aa, Homo sapiens
  heavy chain complementarity determining region 3 for antibody 23226
VRHAVVGPMVVDD

SEQ ID NO: 46453 - protein, 9 aa, Homo sapiens
  light chain complementarity determining region 3 for antibody 23227
LQHNSYPLT

SEQ ID NO: 46454 - protein, 13 aa, Homo sapiens
  heavy chain complementarity determining region 3 for antibody 23227
VRHAVLRPMVVDG

SEQ ID NO: 46455 - protein, 9 aa, Homo sapiens
  light chain complementarity determining region 3 for antibody 23228
LQHNSYPLT

SEQ ID NO: 46456 - protein, 13 aa, Homo sapiens
  heavy chain complementarity determining region 3 for antibody 23228
VRHAVARPMVVDD

SEQ ID NO: 46457 - protein, 9 aa, Homo sapiens
  light chain complementarity determining region 3 for antibody 23229
LQHNSYPLT

SEQ ID NO: 46458 - protein, 13 aa, Homo sapiens
  heavy chain complementarity determining region 3 for antibody 23229
VGHAVVRPMVVDD

SEQ ID NO: 46459 - protein, 9 aa, Homo sapiens
  light chain complementarity determining region 3 for antibody 23230
LQHNSYPLT

SEQ ID NO: 46460 - protein, 11 aa, Homo sapiens
  heavy chain complementarity determining region 3 for antibody 23230
HAVVRPMVVDD

SEQ ID NO: 46461 - protein, 9 aa, Homo sapiens
  light chain complementarity determining region 3 for antibody 23231
LQHNSYPLT

SEQ ID NO: 46462 - protein, 13 aa, Homo sapiens
  heavy chain complementarity determining region 3 for antibody 23231
ARHAVVRPMVVDD

SEQ ID NO: 46463 - protein, 9 aa, Homo sapiens
  light chain complementarity determining region 3 for antibody 23232
LQHNSYPLT

SEQ ID NO: 46464 - protein, 18 aa, Homo sapiens
  heavy chain complementarity determining region 3 for antibody 23232
ARGDVSAGRYSSSPPPAH

SEQ ID NO: 46465 - protein, 9 aa, Homo sapiens
  light chain complementarity determining region 3 for antibody 23233
LQHNSYPLT

SEQ ID NO: 46466 - protein, 22 aa, Homo sapiens
  heavy chain complementarity determining region 3 for antibody 23233
ARDQASTVVVVSRPWEVSDLAF

SEQ ID NO: 46467 - protein, 9 aa, Homo sapiens
  light chain complementarity determining region 3 for antibody 23234
LQHNSYPLT

SEQ ID NO: 46468 - protein, 22 aa, Homo sapiens
  heavy chain complementarity determining region 3 for antibody 23234
ARDQAATVVVVSRPWEVSDLTF

SEQ ID NO: 46469 - protein, 9 aa, Homo sapiens
  light chain complementarity determining region 3 for antibody 23235
LQHNSYPLP

SEQ ID NO: 46470 - protein, 13 aa, Homo sapiens
  heavy chain complementarity determining region 3 for antibody 23235
VRHTVVRPIVVDD

SEQ ID NO: 46471 - protein, 9 aa, Homo sapiens
  light chain complementarity determining region 3 for antibody 23236
LQHNSYPLN

SEQ ID NO: 46472 - protein, 13 aa, Homo sapiens
  heavy chain complementarity determining region 3 for antibody 23236
VRHTVVRPIVVDD

SEQ ID NO: 46473 - protein, 9 aa, Homo sapiens
  light chain complementarity determining region 3 for antibody 23237
LQHNSYPLI

SEQ ID NO: 46474 - protein, 13 aa, Homo sapiens
  heavy chain complementarity determining region 3 for antibody 23237
VRHAVVRPMVVDD

SEQ ID NO: 46475 - protein, 9 aa, Homo sapiens
  light chain complementarity determining region 3 for antibody 23238
LQHNSYPFT

SEQ ID NO: 46476 - protein, 22 aa, Homo sapiens
  heavy chain complementarity determining region 3 for antibody 23238
ARDQASTVVVVSRPWEVSDLTF

SEQ ID NO: 46477 - protein, 9 aa, Homo sapiens
  light chain complementarity determining region 3 for antibody 23239
LQHNSYPFT

SEQ ID NO: 46478 - protein, 7 aa, Homo sapiens
  heavy chain complementarity determining region 3 for antibody 23239
ALYRLDY

SEQ ID NO: 46479 - protein, 9 aa, Homo sapiens
  light chain complementarity determining region 3 for antibody 23240
LQHNSYPFT

SEQ ID NO: 46480 - protein, 14 aa, Homo sapiens
  heavy chain complementarity determining region 3 for antibody 23240
AGCGGNSGKYYFDY

SEQ ID NO: 46481 - protein, 9 aa, Homo sapiens
  light chain complementarity determining region 3 for antibody 23241
LQHNSFPWT

SEQ ID NO: 46482 - protein, 11 aa, Homo sapiens
  heavy chain complementarity determining region 3 for antibody 23241
VRDVRTAHFDY

SEQ ID NO: 46483 - protein, 9 aa, Homo sapiens
  light chain complementarity determining region 3 for antibody 23242
LQHNSFPWT

SEQ ID NO: 46484 - protein, 11 aa, Homo sapiens
  heavy chain complementarity determining region 3 for antibody 23242
VRDVPTAHFDS

SEQ ID NO: 46485 - protein, 9 aa, Homo sapiens
  light chain complementarity determining region 3 for antibody 23243
LQHNSFPWT

SEQ ID NO: 46486 - protein, 11 aa, Homo sapiens
  heavy chain complementarity determining region 3 for antibody 23243
VRDVPPAHFDY

SEQ ID NO: 46487 - protein, 9 aa, Homo sapiens
  light chain complementarity determining region 3 for antibody 23244
LQHNSFPWT

SEQ ID NO: 46488 - protein, 11 aa, Homo sapiens
  heavy chain complementarity determining region 3 for antibody 23244
VRDVLTAPFDY

SEQ ID NO: 46489 - protein, 9 aa, Homo sapiens
  light chain complementarity determining region 3 for antibody 23245
LQHNSFPRT

SEQ ID NO: 46490 - protein, 11 aa, Homo sapiens
  heavy chain complementarity determining region 3 for antibody 23245
ARLIEPWSGDY

SEQ ID NO: 46491 - protein, 9 aa, Homo sapiens
  light chain complementarity determining region 3 for antibody 23246
LQHNSFPPP

SEQ ID NO: 46492 - protein, 19 aa, Homo sapiens
  heavy chain complementarity determining region 3 for antibody 23246
ASLRYSSSWSRRLVDVFEI

SEQ ID NO: 46493 - protein, 9 aa, Homo sapiens
  light chain complementarity determining region 3 for antibody 23247
LQHNSFPLT

SEQ ID NO: 46494 - protein, 10 aa, Homo sapiens
  heavy chain complementarity determining region 3 for antibody 23247
ARDGLWSFDY

SEQ ID NO: 46495 - protein, 9 aa, Homo sapiens
  light chain complementarity determining region 3 for antibody 23248
LQHNSFPLP

SEQ ID NO: 46496 - protein, 19 aa, Homo sapiens
  heavy chain complementarity determining region 3 for antibody 23248
ASLRYSSSWSRRLVDVFEI

SEQ ID NO: 46497 - protein, 9 aa, Homo sapiens
  light chain complementarity determining region 3 for antibody 23249
LQHNSDPLT

SEQ ID NO: 46498 - protein, 13 aa, Homo sapiens
  heavy chain complementarity determining region 3 for antibody 23249
VRHAVVRPMVVDD

SEQ ID NO: 46499 - protein, 9 aa, Homo sapiens
  light chain complementarity determining region 3 for antibody 23250
LQHNNYPWT

SEQ ID NO: 46500 - protein, 18 aa, Homo sapiens
  heavy chain complementarity determining region 3 for antibody 23250
ARDGVDYAPRDYYYGLDV

SEQ ID NO: 46501 - protein, 9 aa, Homo sapiens
  light chain complementarity determining region 3 for antibody 23251
LQHNNWPRT

SEQ ID NO: 46502 - protein, 12 aa, Homo sapiens
  heavy chain complementarity determining region 3 for antibody 23251
ARDHWLGYYFDF

SEQ ID NO: 46503 - protein, 9 aa, Homo sapiens
  light chain complementarity determining region 3 for antibody 23252
LQHGGTPLT

SEQ ID NO: 46504 - protein, 8 aa, Homo sapiens
  heavy chain complementarity determining region 3 for antibody 23252
VRIMDPGY

SEQ ID NO: 46505 - protein, 9 aa, Homo sapiens
  light chain complementarity determining region 3 for antibody 23253
LQHEGLPYT

SEQ ID NO: 46506 - protein, 8 aa, Homo sapiens
  heavy chain complementarity determining region 3 for antibody 23253
ADVGAPGF

SEQ ID NO: 46507 - protein, 9 aa, Homo sapiens
  light chain complementarity determining region 3 for antibody 23254
LQHDYWPRT

SEQ ID NO: 46508 - protein, 11 aa, Homo sapiens
  heavy chain complementarity determining region 3 for antibody 23254
VRVGGAGYFDH

SEQ ID NO: 46509 - protein, 9 aa, Homo sapiens
  light chain complementarity determining region 3 for antibody 23255
LQHDTFPYS

SEQ ID NO: 46510 - protein, 12 aa, Homo sapiens
  heavy chain complementarity determining region 3 for antibody 23255
AREWDSGWYPAS

SEQ ID NO: 46511 - protein, 9 aa, Homo sapiens
  light chain complementarity determining region 3 for antibody 23256
LQHDNFPYS

SEQ ID NO: 46512 - protein, 12 aa, Homo sapiens
  heavy chain complementarity determining region 3 for antibody 23256
ARGWDSGWYPAS

SEQ ID NO: 46513 - protein, 9 aa, Homo sapiens
  light chain complementarity determining region 3 for antibody 23257
LQHDNFPYS

SEQ ID NO: 46514 - protein, 12 aa, Homo sapiens
  heavy chain complementarity determining region 3 for antibody 23257
AREWDSGWYPAA

SEQ ID NO: 46515 - protein, 9 aa, Homo sapiens
  light chain complementarity determining region 3 for antibody 23258
LQHDNFPYS

SEQ ID NO: 46516 - protein, 12 aa, Homo sapiens
  heavy chain complementarity determining region 3 for antibody 23258
AREWDSGWDPAS

SEQ ID NO: 46517 - protein, 9 aa, Homo sapiens
  light chain complementarity determining region 3 for antibody 23259
LQHDNFPYS

SEQ ID NO: 46518 - protein, 12 aa, Homo sapiens
  heavy chain complementarity determining region 3 for antibody 23259
AREWDAGWYPAS

SEQ ID NO: 46519 - protein, 9 aa, Homo sapiens
  light chain complementarity determining region 3 for antibody 23260
LQHDNFPYS

SEQ ID NO: 46520 - protein, 12 aa, Homo sapiens
  heavy chain complementarity determining region 3 for antibody 23260
ARECDSGWYPAS

SEQ ID NO: 46521 - protein, 9 aa, Homo sapiens
  light chain complementarity determining region 3 for antibody 23261
LQHDNFPNS

SEQ ID NO: 46522 - protein, 12 aa, Homo sapiens
  heavy chain complementarity determining region 3 for antibody 23261
AREWDSGWYPAS

SEQ ID NO: 46523 - protein, 9 aa, Homo sapiens
  light chain complementarity determining region 3 for antibody 23262
LQHDDLPYT

SEQ ID NO: 46524 - protein, 8 aa, Homo sapiens
  heavy chain complementarity determining region 3 for antibody 23262
ADVGAHGL

SEQ ID NO: 46525 - protein, 9 aa, Homo sapiens
  light chain complementarity determining region 3 for antibody 23263
LQHDDLPST

SEQ ID NO: 46526 - protein, 8 aa, Homo sapiens
  heavy chain complementarity determining region 3 for antibody 23263
ADVGAHGF

SEQ ID NO: 46527 - protein, 9 aa, Homo sapiens
  light chain complementarity determining region 3 for antibody 23264
LQGYRFPHT

SEQ ID NO: 46528 - protein, 14 aa, Homo sapiens
  heavy chain complementarity determining region 3 for antibody 23264
ARYCSGTSCYSMDY

SEQ ID NO: 46529 - protein, 9 aa, Homo sapiens
  light chain complementarity determining region 3 for antibody 23265
LQGTSFPHT

SEQ ID NO: 46530 - protein, 14 aa, Homo sapiens
  heavy chain complementarity determining region 3 for antibody 23265
ARYCSGNSCYSMDH

SEQ ID NO: 46531 - protein, 9 aa, Homo sapiens
  light chain complementarity determining region 3 for antibody 23266
LQGTRFPHT

SEQ ID NO: 46532 - protein, 14 aa, Homo sapiens
  heavy chain complementarity determining region 3 for antibody 23266
ARYCSGSSCYSMDY

SEQ ID NO: 46533 - protein, 9 aa, Homo sapiens
  light chain complementarity determining region 3 for antibody 23267
LQGTQWPWT

SEQ ID NO: 46534 - protein, 15 aa, Homo sapiens
  heavy chain complementarity determining region 3 for antibody 23267
VRFPPDLDIVGMIDH

SEQ ID NO: 46535 - protein, 9 aa, Homo sapiens
  light chain complementarity determining region 3 for antibody 23268
LQGTQGPWT

SEQ ID NO: 46536 - protein, 15 aa, Homo sapiens
  heavy chain complementarity determining region 3 for antibody 23268
VRFPPDLDIVGMIDH

SEQ ID NO: 46537 - protein, 9 aa, Homo sapiens
  light chain complementarity determining region 3 for antibody 23269
LQGTLWRWT

SEQ ID NO: 46538 - protein, 12 aa, Homo sapiens
  heavy chain complementarity determining region 3 for antibody 23269
VTGDSARHYFGF

SEQ ID NO: 46539 - protein, 9 aa, Homo sapiens
  light chain complementarity determining region 3 for antibody 23270
LQGTLWPGT

SEQ ID NO: 46540 - protein, 12 aa, Homo sapiens
  heavy chain complementarity determining region 3 for antibody 23270
VTGDSARHYFGL

SEQ ID NO: 46541 - protein, 9 aa, Homo sapiens
  light chain complementarity determining region 3 for antibody 23271
LQGTHWPWT

SEQ ID NO: 46542 - protein, 10 aa, Homo sapiens
  heavy chain complementarity determining region 3 for antibody 23271
ARETHWGPDY

SEQ ID NO: 46543 - protein, 9 aa, Homo sapiens
  light chain complementarity determining region 3 for antibody 23272
LQGTHWPPT

SEQ ID NO: 46544 - protein, 11 aa, Homo sapiens
  heavy chain complementarity determining region 3 for antibody 23272
ATGPQVPMPQD

SEQ ID NO: 46545 - protein, 9 aa, Homo sapiens
  light chain complementarity determining region 3 for antibody 23273
LQGTHWPPP

SEQ ID NO: 46546 - protein, 12 aa, Homo sapiens
  heavy chain complementarity determining region 3 for antibody 23273
ATDYGPVVTLAH

SEQ ID NO: 46547 - protein, 9 aa, Homo sapiens
  light chain complementarity determining region 3 for antibody 23274
LQGTHWPAN

SEQ ID NO: 46548 - protein, 14 aa, Homo sapiens
  heavy chain complementarity determining region 3 for antibody 23274
AKSPLKTGVTDFDY

SEQ ID NO: 46549 - protein, 10 aa, Homo sapiens
  light chain complementarity determining region 3 for antibody 23275
LQGTHRPYYN

SEQ ID NO: 46550 - protein, 12 aa, Homo sapiens
  heavy chain complementarity determining region 3 for antibody 23275
ARDPPGDQGLDF

SEQ ID NO: 46551 - protein, 9 aa, Homo sapiens
  light chain complementarity determining region 3 for antibody 23276
LQGTHGPPP

SEQ ID NO: 46552 - protein, 11 aa, Homo sapiens
  heavy chain complementarity determining region 3 for antibody 23276
ATGPQVTMPQD

SEQ ID NO: 46553 - protein, 9 aa, Homo sapiens
  light chain complementarity determining region 3 for antibody 23277
LQGSRFPHT

SEQ ID NO: 46554 - protein, 14 aa, Homo sapiens
  heavy chain complementarity determining region 3 for antibody 23277
ARYCSGNSCYSMDH

SEQ ID NO: 46555 - protein, 9 aa, Homo sapiens
  light chain complementarity determining region 3 for antibody 23278
LQGNRSPHT

SEQ ID NO: 46556 - protein, 14 aa, Homo sapiens
  heavy chain complementarity determining region 3 for antibody 23278
ARYCSGNSCYSMDH

SEQ ID NO: 46557 - protein, 9 aa, Homo sapiens
  light chain complementarity determining region 3 for antibody 23279
LQGNRFTHT

SEQ ID NO: 46558 - protein, 14 aa, Homo sapiens
  heavy chain complementarity determining region 3 for antibody 23279
ARYCSGNSCYSMDH

SEQ ID NO: 46559 - protein, 9 aa, Homo sapiens
  light chain complementarity determining region 3 for antibody 23280
LQGNRFSHT

SEQ ID NO: 46560 - protein, 14 aa, Homo sapiens
  heavy chain complementarity determining region 3 for antibody 23280
ARYCSGNSCYSMDH

SEQ ID NO: 46561 - protein, 9 aa, Homo sapiens
  light chain complementarity determining region 3 for antibody 23281
LQGNRFPQT

SEQ ID NO: 46562 - protein, 14 aa, Homo sapiens
  heavy chain complementarity determining region 3 for antibody 23281
ARYCSGNSCYSMDH

SEQ ID NO: 46563 - protein, 9 aa, Homo sapiens
  light chain complementarity determining region 3 for antibody 23282
LQGNRFPPT

SEQ ID NO: 46564 - protein, 14 aa, Homo sapiens
  heavy chain complementarity determining region 3 for antibody 23282
ARYCSGKSCYSMDH

SEQ ID NO: 46565 - protein, 9 aa, Homo sapiens
  light chain complementarity determining region 3 for antibody 23283
LQGNRFPHT

SEQ ID NO: 46566 - protein, 14 aa, Homo sapiens
  heavy chain complementarity determining region 3 for antibody 23283
ARYCSVNSCYSMDH

SEQ ID NO: 46567 - protein, 9 aa, Homo sapiens
  light chain complementarity determining region 3 for antibody 23284
LQGNRFPHT

SEQ ID NO: 46568 - protein, 14 aa, Homo sapiens
  heavy chain complementarity determining region 3 for antibody 23284
ARYCSGSSCSSMDY

SEQ ID NO: 46569 - protein, 9 aa, Homo sapiens
  light chain complementarity determining region 3 for antibody 23285
LQGNRFPHT

SEQ ID NO: 46570 - protein, 14 aa, Homo sapiens
  heavy chain complementarity determining region 3 for antibody 23285
ARYCSGSSCCSMDY

SEQ ID NO: 46571 - protein, 9 aa, Homo sapiens
  light chain complementarity determining region 3 for antibody 23286
LQGNRFPHT

SEQ ID NO: 46572 - protein, 14 aa, Homo sapiens
  heavy chain complementarity determining region 3 for antibody 23286
ARYCSGPSCYSMDY

SEQ ID NO: 46573 - protein, 9 aa, Homo sapiens
  light chain complementarity determining region 3 for antibody 23287
LQGNRFPHT

SEQ ID NO: 46574 - protein, 14 aa, Homo sapiens
  heavy chain complementarity determining region 3 for antibody 23287
ARYCSGNSRYSMDH

SEQ ID NO: 46575 - protein, 9 aa, Homo sapiens
  light chain complementarity determining region 3 for antibody 23288
LQGNRFPHT

SEQ ID NO: 46576 - protein, 14 aa, Homo sapiens
  heavy chain complementarity determining region 3 for antibody 23288
ARYCSGNSCYSMDP

SEQ ID NO: 46577 - protein, 9 aa, Homo sapiens
  light chain complementarity determining region 3 for antibody 23289
LQGNRFPHT

SEQ ID NO: 46578 - protein, 14 aa, Homo sapiens
  heavy chain complementarity determining region 3 for antibody 23289
ARYCSGNSCDSMDH

SEQ ID NO: 46579 - protein, 9 aa, Homo sapiens
  light chain complementarity determining region 3 for antibody 23290
LQGNRFPHT

SEQ ID NO: 46580 - protein, 14 aa, Homo sapiens
  heavy chain complementarity determining region 3 for antibody 23290
ARYCSGNRCYSMDH

SEQ ID NO: 46581 - protein, 9 aa, Homo sapiens
  light chain complementarity determining region 3 for antibody 23291
LQGNRFPHT

SEQ ID NO: 46582 - protein, 14 aa, Homo sapiens
  heavy chain complementarity determining region 3 for antibody 23291
ARYCRGNSCYSMDH

SEQ ID NO: 46583 - protein, 9 aa, Homo sapiens
  light chain complementarity determining region 3 for antibody 23292
LQGNRFPHT

SEQ ID NO: 46584 - protein, 14 aa, Homo sapiens
  heavy chain complementarity determining region 3 for antibody 23292
AGYCSGNSCYSMDH

SEQ ID NO: 46585 - protein, 9 aa, Homo sapiens
  light chain complementarity determining region 3 for antibody 23293
LQGNRFPHM

SEQ ID NO: 46586 - protein, 14 aa, Homo sapiens
  heavy chain complementarity determining region 3 for antibody 23293
ARYCSGTSCYSMDY

SEQ ID NO: 46587 - protein, 9 aa, Homo sapiens
  light chain complementarity determining region 3 for antibody 23294
LQGNRFHHT

SEQ ID NO: 46588 - protein, 14 aa, Homo sapiens
  heavy chain complementarity determining region 3 for antibody 23294
ARYCSGNSCYSMDH

SEQ ID NO: 46589 - protein, 9 aa, Homo sapiens
  light chain complementarity determining region 3 for antibody 23295
LQGNRCPHT

SEQ ID NO: 46590 - protein, 14 aa, Homo sapiens
  heavy chain complementarity determining region 3 for antibody 23295
ARYCSGNSCYSMDH

SEQ ID NO: 46591 - protein, 9 aa, Homo sapiens
  light chain complementarity determining region 3 for antibody 23296
LQGNGFPHT

SEQ ID NO: 46592 - protein, 14 aa, Homo sapiens
  heavy chain complementarity determining region 3 for antibody 23296
ARYCSGTSCYSMDY

SEQ ID NO: 46593 - protein, 9 aa, Homo sapiens
  light chain complementarity determining region 3 for antibody 23297
LQGLETPFT

SEQ ID NO: 46594 - protein, 15 aa, Homo sapiens
  heavy chain complementarity determining region 3 for antibody 23297
VRHYRETVAGIEGDS

SEQ ID NO: 46595 - protein, 9 aa, Homo sapiens
  light chain complementarity determining region 3 for antibody 23298
LQGKRFPHT

SEQ ID NO: 46596 - protein, 14 aa, Homo sapiens
  heavy chain complementarity determining region 3 for antibody 23298
ARYCSGNSCYSMDH

SEQ ID NO: 46597 - protein, 9 aa, Homo sapiens
  light chain complementarity determining region 3 for antibody 23299
LQGKHWPPT

SEQ ID NO: 46598 - protein, 12 aa, Homo sapiens
  heavy chain complementarity determining region 3 for antibody 23299
ATDYGPVVTLAH

SEQ ID NO: 46599 - protein, 9 aa, Homo sapiens
  light chain complementarity determining region 3 for antibody 23300
LQFQNVPLT

SEQ ID NO: 46600 - protein, 18 aa, Homo sapiens
  heavy chain complementarity determining region 3 for antibody 23300
VRGGRDSQGPFGYYGLGV

SEQ ID NO: 46601 - protein, 9 aa, Homo sapiens
  light chain complementarity determining region 3 for antibody 23301
LQDYTYPRP

SEQ ID NO: 46602 - protein, 22 aa, Homo sapiens
  heavy chain complementarity determining region 3 for antibody 23301
ARDSTPKLLVAGTMRYYDAFDI

SEQ ID NO: 46603 - protein, 9 aa, Homo sapiens
  light chain complementarity determining region 3 for antibody 23302
LQDYTYPRP

SEQ ID NO: 46604 - protein, 18 aa, Homo sapiens
  heavy chain complementarity determining region 3 for antibody 23302
ARDSSPSPAGVGYDAFDI

SEQ ID NO: 46605 - protein, 9 aa, Homo sapiens
  light chain complementarity determining region 3 for antibody 23303
LQDYNYPYT

SEQ ID NO: 46606 - protein, 15 aa, Homo sapiens
  heavy chain complementarity determining region 3 for antibody 23303
ARGRVYAIRYWFFDI

SEQ ID NO: 46607 - protein, 9 aa, Homo sapiens
  light chain complementarity determining region 3 for antibody 23304
LQDYNYPYT

SEQ ID NO: 46608 - protein, 15 aa, Homo sapiens
  heavy chain complementarity determining region 3 for antibody 23304
ARGHVYAIRYWCFDI

SEQ ID NO: 46609 - protein, 9 aa, Homo sapiens
  light chain complementarity determining region 3 for antibody 23305
LQDYNYPYP

SEQ ID NO: 46610 - protein, 15 aa, Homo sapiens
  heavy chain complementarity determining region 3 for antibody 23305
ARGHVYAIRYWFFDI

SEQ ID NO: 46611 - protein, 9 aa, Homo sapiens
  light chain complementarity determining region 3 for antibody 23306
LQDYNYPWT

SEQ ID NO: 46612 - protein, 11 aa, Homo sapiens
  heavy chain complementarity determining region 3 for antibody 23306
ARDYAGGFFDY

SEQ ID NO: 46613 - protein, 9 aa, Homo sapiens
  light chain complementarity determining region 3 for antibody 23307
LQDYNYPWT

SEQ ID NO: 46614 - protein, 11 aa, Homo sapiens
  heavy chain complementarity determining region 3 for antibody 23307
ARDYAGAVFDY

SEQ ID NO: 46615 - protein, 9 aa, Homo sapiens
  light chain complementarity determining region 3 for antibody 23308
LQDYNYPWT

SEQ ID NO: 46616 - protein, 11 aa, Homo sapiens
  heavy chain complementarity determining region 3 for antibody 23308
ARDYAGAFVDY

SEQ ID NO: 46617 - protein, 9 aa, Homo sapiens
  light chain complementarity determining region 3 for antibody 23309
LQDYNYPWT

SEQ ID NO: 46618 - protein, 11 aa, Homo sapiens
  heavy chain complementarity determining region 3 for antibody 23309
ARDYAGACFDY

SEQ ID NO: 46619 - protein, 9 aa, Homo sapiens
  light chain complementarity determining region 3 for antibody 23310
LQDYNYPWP

SEQ ID NO: 46620 - protein, 11 aa, Homo sapiens
  heavy chain complementarity determining region 3 for antibody 23310
ARDYAGAFFDY

SEQ ID NO: 46621 - protein, 9 aa, Homo sapiens
  light chain complementarity determining region 3 for antibody 23311
LQDYNYPRT

SEQ ID NO: 46622 - protein, 15 aa, Homo sapiens
  heavy chain complementarity determining region 3 for antibody 23311
ARSPRYSSSWGRFGP

SEQ ID NO: 46623 - protein, 9 aa, Homo sapiens
  light chain complementarity determining region 3 for antibody 23312
LQDYNYPRT

SEQ ID NO: 46624 - protein, 15 aa, Homo sapiens
  heavy chain complementarity determining region 3 for antibody 23312
ARSPRHSSSWGRFDP

SEQ ID NO: 46625 - protein, 9 aa, Homo sapiens
  light chain complementarity determining region 3 for antibody 23313
LQDYNYPRT

SEQ ID NO: 46626 - protein, 15 aa, Homo sapiens
  heavy chain complementarity determining region 3 for antibody 23313
ARRPRYSSSWGRFDP

SEQ ID NO: 46627 - protein, 9 aa, Homo sapiens
  light chain complementarity determining region 3 for antibody 23314
LQDYNYPRT

SEQ ID NO: 46628 - protein, 21 aa, Homo sapiens
  heavy chain complementarity determining region 3 for antibody 23314
ARDYNPTLYNGGKRSYDAFDI

SEQ ID NO: 46629 - protein, 9 aa, Homo sapiens
  light chain complementarity determining region 3 for antibody 23315
LQDYNYPNT

SEQ ID NO: 46630 - protein, 15 aa, Homo sapiens
  heavy chain complementarity determining region 3 for antibody 23315
ARGHVYAIRYWFFDI

SEQ ID NO: 46631 - protein, 9 aa, Homo sapiens
  light chain complementarity determining region 3 for antibody 23316
LQDYNYPMT

SEQ ID NO: 46632 - protein, 18 aa, Homo sapiens
  heavy chain complementarity determining region 3 for antibody 23316
ARALGQCWGGHCYTAFDI

SEQ ID NO: 46633 - protein, 9 aa, Homo sapiens
  light chain complementarity determining region 3 for antibody 23317
LQDYNYPLT

SEQ ID NO: 46634 - protein, 11 aa, Homo sapiens
  heavy chain complementarity determining region 3 for antibody 23317
ARDYAGAFFDY

SEQ ID NO: 46635 - protein, 9 aa, Homo sapiens
  light chain complementarity determining region 3 for antibody 23318
LQDYNYPLT

SEQ ID NO: 46636 - protein, 18 aa, Homo sapiens
  heavy chain complementarity determining region 3 for antibody 23318
ARALGHCWGGHCYTAFDI

SEQ ID NO: 46637 - protein, 9 aa, Homo sapiens
  light chain complementarity determining region 3 for antibody 23319
LQDYNYPHT

SEQ ID NO: 46638 - protein, 15 aa, Homo sapiens
  heavy chain complementarity determining region 3 for antibody 23319
ARGHVYAIRYWFFDI

SEQ ID NO: 46639 - protein, 9 aa, Homo sapiens
  light chain complementarity determining region 3 for antibody 23320
LQDYNYPDT

SEQ ID NO: 46640 - protein, 15 aa, Homo sapiens
  heavy chain complementarity determining region 3 for antibody 23320
ARGHVYAIRYWFFDI

SEQ ID NO: 46641 - protein, 9 aa, Homo sapiens
  light chain complementarity determining region 3 for antibody 23321
LQDYNYPCT

SEQ ID NO: 46642 - protein, 11 aa, Homo sapiens
  heavy chain complementarity determining region 3 for antibody 23321
ARDYAGAFFDY

SEQ ID NO: 46643 - protein, 9 aa, Homo sapiens
  light chain complementarity determining region 3 for antibody 23322
LQDYNSPWT

SEQ ID NO: 46644 - protein, 11 aa, Homo sapiens
  heavy chain complementarity determining region 3 for antibody 23322
ARDYAGAFFDY

SEQ ID NO: 46645 - protein, 9 aa, Homo sapiens
  light chain complementarity determining region 3 for antibody 23323
LQDYNSPMT

SEQ ID NO: 46646 - protein, 18 aa, Homo sapiens
  heavy chain complementarity determining region 3 for antibody 23323
ARALGHCWGGHCYTAFDI

SEQ ID NO: 46647 - protein, 9 aa, Homo sapiens
  light chain complementarity determining region 3 for antibody 23324
LQDYDYPRT

SEQ ID NO: 46648 - protein, 22 aa, Homo sapiens
  heavy chain complementarity determining region 3 for antibody 23324
ARDSSPRYMYEGRDYYTDVFDM

SEQ ID NO: 46649 - protein, 9 aa, Homo sapiens
  light chain complementarity determining region 3 for antibody 23325
LQDYDYPRT

SEQ ID NO: 46650 - protein, 19 aa, Homo sapiens
  heavy chain complementarity determining region 3 for antibody 23325
ARDEEYFDGGSGYYDVFDV

SEQ ID NO: 46651 - protein, 9 aa, Homo sapiens
  light chain complementarity determining region 3 for antibody 23326
LQDNNYPPT

SEQ ID NO: 46652 - protein, 12 aa, Homo sapiens
  heavy chain complementarity determining region 3 for antibody 23326
ATVGLEGLGSLI

SEQ ID NO: 46653 - protein, 9 aa, Homo sapiens
  light chain complementarity determining region 3 for antibody 23327
LQDGFSQYS

SEQ ID NO: 46654 - protein, 18 aa, Homo sapiens
  heavy chain complementarity determining region 3 for antibody 23327
TGVHGLTMLRGATKPFDF

SEQ ID NO: 46655 - protein, 9 aa, Homo sapiens
  light chain complementarity determining region 3 for antibody 23328
LQDFGYPRT

SEQ ID NO: 46656 - protein, 18 aa, Homo sapiens
  heavy chain complementarity determining region 3 for antibody 23328
TRDLSPSYDRRYYDAFDI

SEQ ID NO: 46657 - protein, 9 aa, Homo sapiens
  light chain complementarity determining region 3 for antibody 23329
LQDEHYPWT

SEQ ID NO: 46658 - protein, 17 aa, Homo sapiens
  heavy chain complementarity determining region 3 for antibody 23329
ARVKWLELQDFYYGLDV

SEQ ID NO: 46659 - protein, 9 aa, Homo sapiens
  light chain complementarity determining region 3 for antibody 23330
LQDEHYPWP

SEQ ID NO: 46660 - protein, 17 aa, Homo sapiens
  heavy chain complementarity determining region 3 for antibody 23330
ARVKWLELQDFYYGMDV

SEQ ID NO: 46661 - protein, 9 aa, Homo sapiens
  light chain complementarity determining region 3 for antibody 23331
LQCNSYPWT

SEQ ID NO: 46662 - protein, 16 aa, Homo sapiens
  heavy chain complementarity determining region 3 for antibody 23331
ARDSRLANYYYHGMDV

SEQ ID NO: 46663 - protein, 9 aa, Homo sapiens
  light chain complementarity determining region 3 for antibody 23332
LQAYNYPWT

SEQ ID NO: 46664 - protein, 11 aa, Homo sapiens
  heavy chain complementarity determining region 3 for antibody 23332
ARDYAGAFFDY

SEQ ID NO: 46665 - protein, 9 aa, Homo sapiens
  light chain complementarity determining region 3 for antibody 23333
LQASYWPRT

SEQ ID NO: 46666 - protein, 9 aa, Homo sapiens
  heavy chain complementarity determining region 3 for antibody 23333
VAWHLTFDH

SEQ ID NO: 46667 - protein, 9 aa, Homo sapiens
  light chain complementarity determining region 3 for antibody 23334
LQASYWPRT

SEQ ID NO: 46668 - protein, 9 aa, Homo sapiens
  heavy chain complementarity determining region 3 for antibody 23334
VAGHRTFDH

SEQ ID NO: 46669 - protein, 9 aa, Homo sapiens
  light chain complementarity determining region 3 for antibody 23335
LQASYWPRT

SEQ ID NO: 46670 - protein, 9 aa, Homo sapiens
  heavy chain complementarity determining region 3 for antibody 23335
VAGHLSFDH

SEQ ID NO: 46671 - protein, 9 aa, Homo sapiens
  light chain complementarity determining region 3 for antibody 23336
LQASYWPRT

SEQ ID NO: 46672 - protein, 9 aa, Homo sapiens
  heavy chain complementarity determining region 3 for antibody 23336
VAGHLAFDH

SEQ ID NO: 46673 - protein, 9 aa, Homo sapiens
  light chain complementarity determining region 3 for antibody 23337
LQASYWPRP

SEQ ID NO: 46674 - protein, 9 aa, Homo sapiens
  heavy chain complementarity determining region 3 for antibody 23337
VAGHLTFDH

SEQ ID NO: 46675 - protein, 9 aa, Homo sapiens
  light chain complementarity determining region 3 for antibody 23338
LQALQTPPT

SEQ ID NO: 46676 - protein, 15 aa, Homo sapiens
  heavy chain complementarity determining region 3 for antibody 23338
ARDGLRDGFSDAFDI

SEQ ID NO: 46677 - protein, 9 aa, Homo sapiens
  light chain complementarity determining region 3 for antibody 23339
LQALETPFT

SEQ ID NO: 46678 - protein, 15 aa, Homo sapiens
  heavy chain complementarity determining region 3 for antibody 23339
VRHYRRITAPLEGDS

SEQ ID NO: 46679 - protein, 9 aa, Homo sapiens
  light chain complementarity determining region 3 for antibody 23340
LQALETPFT

SEQ ID NO: 46680 - protein, 15 aa, Homo sapiens
  heavy chain complementarity determining region 3 for antibody 23340
VRHYRITVAAVEGDS

SEQ ID NO: 46681 - protein, 9 aa, Homo sapiens
  light chain complementarity determining region 3 for antibody 23341
LQALETPFT

SEQ ID NO: 46682 - protein, 15 aa, Homo sapiens
  heavy chain complementarity determining region 3 for antibody 23341
GRHYRIITAPLEGDS

SEQ ID NO: 46683 - protein, 9 aa, Homo sapiens
  light chain complementarity determining region 3 for antibody 23342
LQALETPFN

SEQ ID NO: 46684 - protein, 15 aa, Homo sapiens
  heavy chain complementarity determining region 3 for antibody 23342
VRHYRETVAGIEGDS

SEQ ID NO: 46685 - protein, 9 aa, Homo sapiens
  light chain complementarity determining region 3 for antibody 23343
LQALEPPFT

SEQ ID NO: 46686 - protein, 15 aa, Homo sapiens
  heavy chain complementarity determining region 3 for antibody 23343
VRHYRIITAPLEGDS

SEQ ID NO: 46687 - protein, 9 aa, Homo sapiens
  light chain complementarity determining region 3 for antibody 23344
LPYNSYPFT

SEQ ID NO: 46688 - protein, 7 aa, Homo sapiens
  heavy chain complementarity determining region 3 for antibody 23344
ALYRLDY

SEQ ID NO: 46689 - protein, 9 aa, Homo sapiens
  light chain complementarity determining region 3 for antibody 23345
LPASYWPRT

SEQ ID NO: 46690 - protein, 9 aa, Homo sapiens
  heavy chain complementarity determining region 3 for antibody 23345
VAGHLTFDH

SEQ ID NO: 46691 - protein, 6 aa, Homo sapiens
  light chain complementarity determining region 3 for antibody 23346
LKYGSF

SEQ ID NO: 46692 - protein, 11 aa, Homo sapiens
  heavy chain complementarity determining region 3 for antibody 23346
ARAGISYALDV

SEQ ID NO: 46693 - protein, 9 aa, Homo sapiens
  light chain complementarity determining region 3 for antibody 23347
LKYGFAQYS

SEQ ID NO: 46694 - protein, 18 aa, Homo sapiens
  heavy chain complementarity determining region 3 for antibody 23347
TGVHGLTMLRGATKPFDF

SEQ ID NO: 46695 - protein, 9 aa, Homo sapiens
  light chain complementarity determining region 3 for antibody 23348
LKYDTAPWT

SEQ ID NO: 46696 - protein, 15 aa, Homo sapiens
  heavy chain complementarity determining region 3 for antibody 23348
LRDIKGPSAGIPYDS

SEQ ID NO: 46697 - protein, 9 aa, Homo sapiens
  light chain complementarity determining region 3 for antibody 23349
LKHNSYPLP

SEQ ID NO: 46698 - protein, 13 aa, Homo sapiens
  heavy chain complementarity determining region 3 for antibody 23349
VRHAVVRPMVVDD

SEQ ID NO: 46699 - protein, 10 aa, Homo sapiens
  light chain complementarity determining region 3 for antibody 23350
LHYSRSPPIT

SEQ ID NO: 46700 - protein, 20 aa, Homo sapiens
  heavy chain complementarity determining region 3 for antibody 23350
ARDAADVEIVPAARLFAMDV

SEQ ID NO: 46701 - protein, 8 aa, Homo sapiens
  light chain complementarity determining region 3 for antibody 23351
LHYGTSYT

SEQ ID NO: 46702 - protein, 18 aa, Homo sapiens
  heavy chain complementarity determining region 3 for antibody 23351
TRRASGGYCSANNCFVDF

SEQ ID NO: 46703 - protein, 8 aa, Homo sapiens
  light chain complementarity determining region 3 for antibody 23352
LHYGPSYT

SEQ ID NO: 46704 - protein, 18 aa, Homo sapiens
  heavy chain complementarity determining region 3 for antibody 23352
TSRASGGYCSANNCFVDF

SEQ ID NO: 46705 - protein, 8 aa, Homo sapiens
  light chain complementarity determining region 3 for antibody 23353
LHYGPSYT

SEQ ID NO: 46706 - protein, 18 aa, Homo sapiens
  heavy chain complementarity determining region 3 for antibody 23353
TRRASGGYCSANNCFVDL

SEQ ID NO: 46707 - protein, 9 aa, Homo sapiens
  light chain complementarity determining region 3 for antibody 23354
LHTSTFPRT

SEQ ID NO: 46708 - protein, 20 aa, Homo sapiens
  heavy chain complementarity determining region 3 for antibody 23354
ARGRRIAALSTAHYYYGMDV

SEQ ID NO: 46709 - protein, 9 aa, Homo sapiens
  light chain complementarity determining region 3 for antibody 23355
LHNKNFPYP

SEQ ID NO: 46710 - protein, 14 aa, Homo sapiens
  heavy chain complementarity determining region 3 for antibody 23355
TRTEWSSGWRLFDY

SEQ ID NO: 46711 - protein, 9 aa, Homo sapiens
  light chain complementarity determining region 3 for antibody 23356
LHGNRFPHT

SEQ ID NO: 46712 - protein, 14 aa, Homo sapiens
  heavy chain complementarity determining region 3 for antibody 23356
SRYCSGSSCYSMDH

SEQ ID NO: 46713 - protein, 9 aa, Homo sapiens
  light chain complementarity determining region 3 for antibody 23357
LHDYNYPMT

SEQ ID NO: 46714 - protein, 18 aa, Homo sapiens
  heavy chain complementarity determining region 3 for antibody 23357
ARALGHCWGGHCYTAFDI

SEQ ID NO: 46715 - protein, 9 aa, Homo sapiens
  light chain complementarity determining region 3 for antibody 23358
LHDFGYPRT

SEQ ID NO: 46716 - protein, 18 aa, Homo sapiens
  heavy chain complementarity determining region 3 for antibody 23358
TRDLSPSYDRLYYDAFDI

SEQ ID NO: 46717 - protein, 9 aa, Homo sapiens
  light chain complementarity determining region 3 for antibody 23359
KQYYTTPRT

SEQ ID NO: 46718 - protein, 8 aa, Homo sapiens
  heavy chain complementarity determining region 3 for antibody 23359
ARDGAFDS

SEQ ID NO: 46719 - protein, 9 aa, Homo sapiens
  light chain complementarity determining region 3 for antibody 23360
KQYGSSPRT

SEQ ID NO: 46720 - protein, 18 aa, Homo sapiens
  heavy chain complementarity determining region 3 for antibody 23360
ATAFWVGLGVPPPGFFEY

SEQ ID NO: 46721 - protein, 9 aa, Homo sapiens
  light chain complementarity determining region 3 for antibody 23361
KQSYTSPIT

SEQ ID NO: 46722 - protein, 16 aa, Homo sapiens
  heavy chain complementarity determining region 3 for antibody 23361
ARESGGGSPRHNYFDP

SEQ ID NO: 46723 - protein, 9 aa, Homo sapiens
  light chain complementarity determining region 3 for antibody 23362
KQSYGLPQT

SEQ ID NO: 46724 - protein, 19 aa, Homo sapiens
  heavy chain complementarity determining region 3 for antibody 23362
ARVGLEIPPAIRRGEWFDP

SEQ ID NO: 46725 - protein, 10 aa, Homo sapiens
  light chain complementarity determining region 3 for antibody 23363
KQRYNWPPFT

SEQ ID NO: 46726 - protein, 11 aa, Homo sapiens
  heavy chain complementarity determining region 3 for antibody 23363
ARGVGSYPFDS

SEQ ID NO: 46727 - protein, 10 aa, Homo sapiens
  light chain complementarity determining region 3 for antibody 23364
KQLNSYPRVT

SEQ ID NO: 46728 - protein, 19 aa, Homo sapiens
  heavy chain complementarity determining region 3 for antibody 23364
ARDRVEVPGTQVPYWYFDL

SEQ ID NO: 46729 - protein, 9 aa, Homo sapiens
  light chain complementarity determining region 3 for antibody 23365
KQGTPGPHT

SEQ ID NO: 46730 - protein, 11 aa, Homo sapiens
  heavy chain complementarity determining region 3 for antibody 23365
ARDPGWGALDY

SEQ ID NO: 46731 - protein, 9 aa, Homo sapiens
  light chain complementarity determining region 3 for antibody 23366
KQALETPFT

SEQ ID NO: 46732 - protein, 15 aa, Homo sapiens
  heavy chain complementarity determining region 3 for antibody 23366
VRHYRETVAGIEGDS

SEQ ID NO: 46733 - protein, 9 aa, Homo sapiens
  light chain complementarity determining region 3 for antibody 23367
KHRNNWPLT

SEQ ID NO: 46734 - protein, 13 aa, Homo sapiens
  heavy chain complementarity determining region 3 for antibody 23367
ARGNIAAPGRLEC

SEQ ID NO: 46735 - protein, 9 aa, Homo sapiens
  light chain complementarity determining region 3 for antibody 23368
HYYGRSPWT

SEQ ID NO: 46736 - protein, 17 aa, Homo sapiens
  heavy chain complementarity determining region 3 for antibody 23368
ARTVLYHFTSGRAAFDV

SEQ ID NO: 46737 - protein, 9 aa, Homo sapiens
  light chain complementarity determining region 3 for antibody 23369
HRYGSSPQT

SEQ ID NO: 46738 - protein, 9 aa, Homo sapiens
  heavy chain complementarity determining region 3 for antibody 23369
SRGYDISGC

SEQ ID NO: 46739 - protein, 9 aa, Homo sapiens
  light chain complementarity determining region 3 for antibody 23370
HQYYSYPRT

SEQ ID NO: 46740 - protein, 11 aa, Homo sapiens
  heavy chain complementarity determining region 3 for antibody 23370
ARDFSNGPFTH

SEQ ID NO: 46741 - protein, 9 aa, Homo sapiens
  light chain complementarity determining region 3 for antibody 23371
HQYYSTPPT

SEQ ID NO: 46742 - protein, 15 aa, Homo sapiens
  heavy chain complementarity determining region 3 for antibody 23371
GSLTTSPAGEKWFDS

SEQ ID NO: 46743 - protein, 9 aa, Homo sapiens
  light chain complementarity determining region 3 for antibody 23372
HQYYSSPRM

SEQ ID NO: 46744 - protein, 13 aa, Homo sapiens
  heavy chain complementarity determining region 3 for antibody 23372
ARGQSGDPRAYDY

SEQ ID NO: 46745 - protein, 9 aa, Homo sapiens
  light chain complementarity determining region 3 for antibody 23373
HQYYSAPLT

SEQ ID NO: 46746 - protein, 21 aa, Homo sapiens
  heavy chain complementarity determining region 3 for antibody 23373
AKDEGLSVFRSVDGLFDAFDI

SEQ ID NO: 46747 - protein, 9 aa, Homo sapiens
  light chain complementarity determining region 3 for antibody 23374
HQYYSAPLT

SEQ ID NO: 46748 - protein, 21 aa, Homo sapiens
  heavy chain complementarity determining region 3 for antibody 23374
AKDEGLAVFRSFDGLFDAFDI

SEQ ID NO: 46749 - protein, 9 aa, Homo sapiens
  light chain complementarity determining region 3 for antibody 23375
HQYYSAPLP

SEQ ID NO: 46750 - protein, 21 aa, Homo sapiens
  heavy chain complementarity determining region 3 for antibody 23375
AKDEGLSVFRSFDGLFDAFDI

SEQ ID NO: 46751 - protein, 9 aa, Homo sapiens
  light chain complementarity determining region 3 for antibody 23376
HQYYRSPRM

SEQ ID NO: 46752 - protein, 13 aa, Homo sapiens
  heavy chain complementarity determining region 3 for antibody 23376
ARGQSGDPRTYDY

SEQ ID NO: 46753 - protein, 10 aa, Homo sapiens
  light chain complementarity determining region 3 for antibody 23377
HQYYRSPPHP

SEQ ID NO: 46754 - protein, 9 aa, Homo sapiens
  heavy chain complementarity determining region 3 for antibody 23377
AVYSGGWWG

SEQ ID NO: 46755 - protein, 9 aa, Homo sapiens
  light chain complementarity determining region 3 for antibody 23378
HQYYRAPLT

SEQ ID NO: 46756 - protein, 21 aa, Homo sapiens
  heavy chain complementarity determining region 3 for antibody 23378
AKDEGLSVFRSFDGLFDAFDI

SEQ ID NO: 46757 - protein, 10 aa, Homo sapiens
  light chain complementarity determining region 3 for antibody 23379
HQYYPSFPET

SEQ ID NO: 46758 - protein, 11 aa, Homo sapiens
  heavy chain complementarity determining region 3 for antibody 23379
VLRSKNSAYDS

SEQ ID NO: 46759 - protein, 8 aa, Homo sapiens
  light chain complementarity determining region 3 for antibody 23380
HQYYNIPT

SEQ ID NO: 46760 - protein, 15 aa, Homo sapiens
  heavy chain complementarity determining region 3 for antibody 23380
AKTRPLRGAALPSDH

SEQ ID NO: 46761 - protein, 8 aa, Homo sapiens
  light chain complementarity determining region 3 for antibody 23381
HQYYNIPT

SEQ ID NO: 46762 - protein, 15 aa, Homo sapiens
  heavy chain complementarity determining region 3 for antibody 23381
AKTRPFRGAARPSDH

SEQ ID NO: 46763 - protein, 8 aa, Homo sapiens
  light chain complementarity determining region 3 for antibody 23382
HQYYNIPT

SEQ ID NO: 46764 - protein, 15 aa, Homo sapiens
  heavy chain complementarity determining region 3 for antibody 23382
AKTRPCRGAALPSDH

SEQ ID NO: 46765 - protein, 8 aa, Homo sapiens
  light chain complementarity determining region 3 for antibody 23383
HQYYNIPT

SEQ ID NO: 46766 - protein, 15 aa, Homo sapiens
  heavy chain complementarity determining region 3 for antibody 23383
AKPRPFRGAALPSDH

SEQ ID NO: 46767 - protein, 8 aa, Homo sapiens
  light chain complementarity determining region 3 for antibody 23384
HQYYNIPP

SEQ ID NO: 46768 - protein, 15 aa, Homo sapiens
  heavy chain complementarity determining region 3 for antibody 23384
AKTRPFRGAALPSDH

SEQ ID NO: 46769 - protein, 9 aa, Homo sapiens
  light chain complementarity determining region 3 for antibody 23385
HQYTESPRM

SEQ ID NO: 46770 - protein, 17 aa, Homo sapiens
  heavy chain complementarity determining region 3 for antibody 23385
AKSVGVDDAMTTRVYDS

SEQ ID NO: 46771 - protein, 9 aa, Homo sapiens
  light chain complementarity determining region 3 for antibody 23386
HQYSSSTYT

SEQ ID NO: 46772 - protein, 13 aa, Homo sapiens
  heavy chain complementarity determining region 3 for antibody 23386
ARGTYSAFAIFGV

SEQ ID NO: 46773 - protein, 9 aa, Homo sapiens
  light chain complementarity determining region 3 for antibody 23387
HQYSSSQYT

SEQ ID NO: 46774 - protein, 13 aa, Homo sapiens
  heavy chain complementarity determining region 3 for antibody 23387
ARGTYSAFAIFGV

SEQ ID NO: 46775 - protein, 9 aa, Homo sapiens
  light chain complementarity determining region 3 for antibody 23388
HQYSSSPYT

SEQ ID NO: 46776 - protein, 13 aa, Homo sapiens
  heavy chain complementarity determining region 3 for antibody 23388
ARRTYSAFAIFGV

SEQ ID NO: 46777 - protein, 9 aa, Homo sapiens
  light chain complementarity determining region 3 for antibody 23389
HQYSSSPYT

SEQ ID NO: 46778 - protein, 13 aa, Homo sapiens
  heavy chain complementarity determining region 3 for antibody 23389
ARGTYSAVAIFGV

SEQ ID NO: 46779 - protein, 9 aa, Homo sapiens
  light chain complementarity determining region 3 for antibody 23390
HQYSSSPYT

SEQ ID NO: 46780 - protein, 13 aa, Homo sapiens
  heavy chain complementarity determining region 3 for antibody 23390
ARGTYSAFATFGV

SEQ ID NO: 46781 - protein, 9 aa, Homo sapiens
  light chain complementarity determining region 3 for antibody 23391
HQYSSSPYT

SEQ ID NO: 46782 - protein, 13 aa, Homo sapiens
  heavy chain complementarity determining region 3 for antibody 23391
ARGTYSAFASFGV

SEQ ID NO: 46783 - protein, 9 aa, Homo sapiens
  light chain complementarity determining region 3 for antibody 23392
HQYSSSPYT

SEQ ID NO: 46784 - protein, 13 aa, Homo sapiens
  heavy chain complementarity determining region 3 for antibody 23392
ARGTYSAFAIVGV

SEQ ID NO: 46785 - protein, 9 aa, Homo sapiens
  light chain complementarity determining region 3 for antibody 23393
HQYSSSPYT

SEQ ID NO: 46786 - protein, 13 aa, Homo sapiens
  heavy chain complementarity determining region 3 for antibody 23393
ARGTYSAFAILGV

SEQ ID NO: 46787 - protein, 9 aa, Homo sapiens
  light chain complementarity determining region 3 for antibody 23394
HQYSSPPYT

SEQ ID NO: 46788 - protein, 13 aa, Homo sapiens
  heavy chain complementarity determining region 3 for antibody 23394
ARGTYSAFAIFGV

SEQ ID NO: 46789 - protein, 9 aa, Homo sapiens
  light chain complementarity determining region 3 for antibody 23395
HQYSGSPYT

SEQ ID NO: 46790 - protein, 13 aa, Homo sapiens
  heavy chain complementarity determining region 3 for antibody 23395
ARGTYSAFAIFGV

SEQ ID NO: 46791 - protein, 9 aa, Homo sapiens
  light chain complementarity determining region 3 for antibody 23396
HQYSCSPYT

SEQ ID NO: 46792 - protein, 13 aa, Homo sapiens
  heavy chain complementarity determining region 3 for antibody 23396
ARGTYSAFAIFGV

SEQ ID NO: 46793 - protein, 9 aa, Homo sapiens
  light chain complementarity determining region 3 for antibody 23397
HQYRTTPNT

SEQ ID NO: 46794 - protein, 12 aa, Homo sapiens
  heavy chain complementarity determining region 3 for antibody 23397
AKYPDNSFWYES

SEQ ID NO: 46795 - protein, 9 aa, Homo sapiens
  light chain complementarity determining region 3 for antibody 23398
HQYRTKPPT

SEQ ID NO: 46796 - protein, 12 aa, Homo sapiens
  heavy chain complementarity determining region 3 for antibody 23398
AKYPDNSFWYES

SEQ ID NO: 46797 - protein, 9 aa, Homo sapiens
  light chain complementarity determining region 3 for antibody 23399
HQYNTWPRT

SEQ ID NO: 46798 - protein, 22 aa, Homo sapiens
  heavy chain complementarity determining region 3 for antibody 23399
AREVRASGYDDFYNYYYYGLDV

SEQ ID NO: 46799 - protein, 9 aa, Homo sapiens
  light chain complementarity determining region 3 for antibody 23400
HQYNSYPLT

SEQ ID NO: 46800 - protein, 15 aa, Homo sapiens
  heavy chain complementarity determining region 3 for antibody 23400
TADLYRSSGWYSPDY

SEQ ID NO: 46801 - protein, 9 aa, Homo sapiens
  light chain complementarity determining region 3 for antibody 23401
HQYNSYPGT

SEQ ID NO: 46802 - protein, 15 aa, Homo sapiens
  heavy chain complementarity determining region 3 for antibody 23401
TADLYRSSGWYSPDY

SEQ ID NO: 46803 - protein, 9 aa, Homo sapiens
  light chain complementarity determining region 3 for antibody 23402
HQYNSSPYT

SEQ ID NO: 46804 - protein, 13 aa, Homo sapiens
  heavy chain complementarity determining region 3 for antibody 23402
ARGTYSAFAIFGV

SEQ ID NO: 46805 - protein, 11 aa, Homo sapiens
  light chain complementarity determining region 3 for antibody 23403
HQYNNWPPRVW

SEQ ID NO: 46806 - protein, 13 aa, Homo sapiens
  heavy chain complementarity determining region 3 for antibody 23403
AKDRLGIIDAFDI

SEQ ID NO: 46807 - protein, 10 aa, Homo sapiens
  light chain complementarity determining region 3 for antibody 23404
HQYNNWLGWT

SEQ ID NO: 46808 - protein, 13 aa, Homo sapiens
  heavy chain complementarity determining region 3 for antibody 23404
ARHGRRSGWYYTY

SEQ ID NO: 46809 - protein, 9 aa, Homo sapiens
  light chain complementarity determining region 3 for antibody 23405
HQYKSYPLT

SEQ ID NO: 46810 - protein, 11 aa, Homo sapiens
  heavy chain complementarity determining region 3 for antibody 23405
ARSRNHWLEES

SEQ ID NO: 46811 - protein, 9 aa, Homo sapiens
  light chain complementarity determining region 3 for antibody 23406
HQYKAYPLT

SEQ ID NO: 46812 - protein, 13 aa, Homo sapiens
  heavy chain complementarity determining region 3 for antibody 23406
VRDQATTINWFDP

SEQ ID NO: 46813 - protein, 9 aa, Homo sapiens
  light chain complementarity determining region 3 for antibody 23407
HQYKAYPLT

SEQ ID NO: 46814 - protein, 11 aa, Homo sapiens
  heavy chain complementarity determining region 3 for antibody 23407
ARSRTHWLEES

SEQ ID NO: 46815 - protein, 9 aa, Homo sapiens
  light chain complementarity determining region 3 for antibody 23408
HQYKAYPLT

SEQ ID NO: 46816 - protein, 11 aa, Homo sapiens
  heavy chain complementarity determining region 3 for antibody 23408
ARSRNHWLEDS

SEQ ID NO: 46817 - protein, 9 aa, Homo sapiens
  light chain complementarity determining region 3 for antibody 23409
HQYKAYPLP

SEQ ID NO: 46818 - protein, 11 aa, Homo sapiens
  heavy chain complementarity determining region 3 for antibody 23409
ARSRNHWLEES

SEQ ID NO: 46819 - protein, 9 aa, Homo sapiens
  light chain complementarity determining region 3 for antibody 23410
HQYKAYPFT

SEQ ID NO: 46820 - protein, 11 aa, Homo sapiens
  heavy chain complementarity determining region 3 for antibody 23410
ARSRNHWLEES

SEQ ID NO: 46821 - protein, 8 aa, Homo sapiens
  light chain complementarity determining region 3 for antibody 23411
HQYGTSRM

SEQ ID NO: 46822 - protein, 13 aa, Homo sapiens
  heavy chain complementarity determining region 3 for antibody 23411
ARGQFVGSAYYEN

SEQ ID NO: 46823 - protein, 9 aa, Homo sapiens
  light chain complementarity determining region 3 for antibody 23412
HQYGTSPRT

SEQ ID NO: 46824 - protein, 13 aa, Homo sapiens
  heavy chain complementarity determining region 3 for antibody 23412
PIGFYDRSGYHEY

SEQ ID NO: 46825 - protein, 9 aa, Homo sapiens
  light chain complementarity determining region 3 for antibody 23413
HQYGTSPRT

SEQ ID NO: 46826 - protein, 13 aa, Homo sapiens
  heavy chain complementarity determining region 3 for antibody 23413
AGGSGSGTYYKEH

SEQ ID NO: 46827 - protein, 9 aa, Homo sapiens
  light chain complementarity determining region 3 for antibody 23414
HQYGSSPQT

SEQ ID NO: 46828 - protein, 9 aa, Homo sapiens
  heavy chain complementarity determining region 3 for antibody 23414
SRGYDISGS

SEQ ID NO: 46829 - protein, 9 aa, Homo sapiens
  light chain complementarity determining region 3 for antibody 23415
HQYGSSPPT

SEQ ID NO: 46830 - protein, 9 aa, Homo sapiens
  heavy chain complementarity determining region 3 for antibody 23415
SRGYDISGC

SEQ ID NO: 46831 - protein, 10 aa, Homo sapiens
  light chain complementarity determining region 3 for antibody 23416
HQYGSSPMYS

SEQ ID NO: 46832 - protein, 11 aa, Homo sapiens
  heavy chain complementarity determining region 3 for antibody 23416
ARGGQWGSLDY

SEQ ID NO: 46833 - protein, 9 aa, Homo sapiens
  light chain complementarity determining region 3 for antibody 23417
HQYGSPPQT

SEQ ID NO: 46834 - protein, 9 aa, Homo sapiens
  heavy chain complementarity determining region 3 for antibody 23417
SRGYDISGC

SEQ ID NO: 46835 - protein, 9 aa, Homo sapiens
  light chain complementarity determining region 3 for antibody 23418
HQYGRSQYT

SEQ ID NO: 46836 - protein, 11 aa, Homo sapiens
  heavy chain complementarity determining region 3 for antibody 23418
ATWAFYHGVDV

SEQ ID NO: 46837 - protein, 9 aa, Homo sapiens
  light chain complementarity determining region 3 for antibody 23419
HQYGRSPYT

SEQ ID NO: 46838 - protein, 11 aa, Homo sapiens
  heavy chain complementarity determining region 3 for antibody 23419
ATWACYHGVDV

SEQ ID NO: 46839 - protein, 9 aa, Homo sapiens
  light chain complementarity determining region 3 for antibody 23420
HQYGRSPDT

SEQ ID NO: 46840 - protein, 11 aa, Homo sapiens
  heavy chain complementarity determining region 3 for antibody 23420
ATWAFYHGVDV

SEQ ID NO: 46841 - protein, 10 aa, Homo sapiens
  light chain complementarity determining region 3 for antibody 23421
HQYGRSAPWT

SEQ ID NO: 46842 - protein, 11 aa, Homo sapiens
  heavy chain complementarity determining region 3 for antibody 23421
VKDRGAVMVDY

SEQ ID NO: 46843 - protein, 9 aa, Homo sapiens
  light chain complementarity determining region 3 for antibody 23422
HQYGNLPRT

SEQ ID NO: 46844 - protein, 13 aa, Homo sapiens
  heavy chain complementarity determining region 3 for antibody 23422
ARGQYERSGYKEN

SEQ ID NO: 46845 - protein, 9 aa, Homo sapiens
  light chain complementarity determining region 3 for antibody 23423
HQYGNLPRT

SEQ ID NO: 46846 - protein, 14 aa, Homo sapiens
  heavy chain complementarity determining region 3 for antibody 23423
AGGTFDSSGYYYEY

SEQ ID NO: 46847 - protein, 9 aa, Homo sapiens
  light chain complementarity determining region 3 for antibody 23424
HQYGNLPRT

SEQ ID NO: 46848 - protein, 13 aa, Homo sapiens
  heavy chain complementarity determining region 3 for antibody 23424
AGGQFHTSGYSEF

SEQ ID NO: 46849 - protein, 10 aa, Homo sapiens
  light chain complementarity determining region 3 for antibody 23425
HQYGILPPWT

SEQ ID NO: 46850 - protein, 13 aa, Homo sapiens
  heavy chain complementarity determining region 3 for antibody 23425
ARVSQAYYNGMDV

SEQ ID NO: 46851 - protein, 10 aa, Homo sapiens
  light chain complementarity determining region 3 for antibody 23426
HQYGGSPVRT

SEQ ID NO: 46852 - protein, 10 aa, Homo sapiens
  heavy chain complementarity determining region 3 for antibody 23426
AGDNRLDQAT

SEQ ID NO: 46853 - protein, 9 aa, Homo sapiens
  light chain complementarity determining region 3 for antibody 23427
HQYGGSPRT

SEQ ID NO: 46854 - protein, 13 aa, Homo sapiens
  heavy chain complementarity determining region 3 for antibody 23427
AAGYFSSGTYYEY

SEQ ID NO: 46855 - protein, 10 aa, Homo sapiens
  light chain complementarity determining region 3 for antibody 23428
HQYGGSPGWT

SEQ ID NO: 46856 - protein, 10 aa, Homo sapiens
  heavy chain complementarity determining region 3 for antibody 23428
AGDNRLDQAT

SEQ ID NO: 46857 - protein, 7 aa, Homo sapiens
  light chain complementarity determining region 3 for antibody 23429
HQYGGGT

SEQ ID NO: 46858 - protein, 15 aa, Homo sapiens
  heavy chain complementarity determining region 3 for antibody 23429
TAIVFFAGSAHIEQY

SEQ ID NO: 46859 - protein, 9 aa, Homo sapiens
  light chain complementarity determining region 3 for antibody 23430
HQYGESPGM

SEQ ID NO: 46860 - protein, 16 aa, Homo sapiens
  heavy chain complementarity determining region 3 for antibody 23430
AKSLGVDAMTTRVYDS

SEQ ID NO: 46861 - protein, 9 aa, Homo sapiens
  light chain complementarity determining region 3 for antibody 23431
HQYGDPPRT

SEQ ID NO: 46862 - protein, 16 aa, Homo sapiens
  heavy chain complementarity determining region 3 for antibody 23431
AGLSASGHLAPNPFDV

SEQ ID NO: 46863 - protein, 9 aa, Homo sapiens
  light chain complementarity determining region 3 for antibody 23432
HQYDDLPPA

SEQ ID NO: 46864 - protein, 16 aa, Homo sapiens
  heavy chain complementarity determining region 3 for antibody 23432
ARGSWPGSSGWGPLGS

SEQ ID NO: 46865 - protein, 9 aa, Homo sapiens
  light chain complementarity determining region 3 for antibody 23433
HQYATSPLT

SEQ ID NO: 46866 - protein, 10 aa, Homo sapiens
  heavy chain complementarity determining region 3 for antibody 23433
STGGGWLVHY

SEQ ID NO: 46867 - protein, 9 aa, Homo sapiens
  light chain complementarity determining region 3 for antibody 23434
HQYATSPLT

SEQ ID NO: 46868 - protein, 10 aa, Homo sapiens
  heavy chain complementarity determining region 3 for antibody 23434
PTGGGWLVHY

SEQ ID NO: 46869 - protein, 9 aa, Homo sapiens
  light chain complementarity determining region 3 for antibody 23435
HQYATSPLT

SEQ ID NO: 46870 - protein, 10 aa, Homo sapiens
  heavy chain complementarity determining region 3 for antibody 23435
ATGGGWLVHY

SEQ ID NO: 46871 - protein, 9 aa, Homo sapiens
  light chain complementarity determining region 3 for antibody 23436
HQYATLPET

SEQ ID NO: 46872 - protein, 13 aa, Homo sapiens
  heavy chain complementarity determining region 3 for antibody 23436
VRRGYGGFVREDF

SEQ ID NO: 46873 - protein, 9 aa, Homo sapiens
  light chain complementarity determining region 3 for antibody 23437
HQYATLPET

SEQ ID NO: 46874 - protein, 13 aa, Homo sapiens
  heavy chain complementarity determining region 3 for antibody 23437
VRRGYGDFVRDDF

SEQ ID NO: 46875 - protein, 9 aa, Homo sapiens
  light chain complementarity determining region 3 for antibody 23438
HQYATLPEP

SEQ ID NO: 46876 - protein, 13 aa, Homo sapiens
  heavy chain complementarity determining region 3 for antibody 23438
VRRGYGDFVREDF

SEQ ID NO: 46877 - protein, 9 aa, Homo sapiens
  light chain complementarity determining region 3 for antibody 23439
HQYAESPWM

SEQ ID NO: 46878 - protein, 17 aa, Homo sapiens
  heavy chain complementarity determining region 3 for antibody 23439
AKSVGVDDAMTTRVYDS

SEQ ID NO: 46879 - protein, 9 aa, Homo sapiens
  light chain complementarity determining region 3 for antibody 23440
HQYAESPRM

SEQ ID NO: 46880 - protein, 17 aa, Homo sapiens
  heavy chain complementarity determining region 3 for antibody 23440
AKSGGVDDAMTTRVYDS

SEQ ID NO: 46881 - protein, 9 aa, Homo sapiens
  light chain complementarity determining region 3 for antibody 23441
HQWSYSPLT

SEQ ID NO: 46882 - protein, 10 aa, Homo sapiens
  heavy chain complementarity determining region 3 for antibody 23441
AWGIGWTSNY

SEQ ID NO: 46883 - protein, 9 aa, Homo sapiens
  light chain complementarity determining region 3 for antibody 23442
HQVISYPFT

SEQ ID NO: 46884 - protein, 12 aa, Homo sapiens
  heavy chain complementarity determining region 3 for antibody 23442
ARPLDGAHGFDV

SEQ ID NO: 46885 - protein, 9 aa, Homo sapiens
  light chain complementarity determining region 3 for antibody 23443
HQVISYPFP

SEQ ID NO: 46886 - protein, 12 aa, Homo sapiens
  heavy chain complementarity determining region 3 for antibody 23443
ARPLDGDHGFDV

SEQ ID NO: 46887 - protein, 9 aa, Homo sapiens
  light chain complementarity determining region 3 for antibody 23444
HQTSTFPRT

SEQ ID NO: 46888 - protein, 20 aa, Homo sapiens
  heavy chain complementarity determining region 3 for antibody 23444
ARGRRRAALSTAHYYYGMDV

SEQ ID NO: 46889 - protein, 9 aa, Homo sapiens
  light chain complementarity determining region 3 for antibody 23445
HQSYTSPFT

SEQ ID NO: 46890 - protein, 12 aa, Homo sapiens
  heavy chain complementarity determining region 3 for antibody 23445
ARNYFDSSGPDY

SEQ ID NO: 46891 - protein, 9 aa, Homo sapiens
  light chain complementarity determining region 3 for antibody 23446
HQSYTAPFT

SEQ ID NO: 46892 - protein, 12 aa, Homo sapiens
  heavy chain complementarity determining region 3 for antibody 23446
ARNYSDSSGPDY

SEQ ID NO: 46893 - protein, 9 aa, Homo sapiens
  light chain complementarity determining region 3 for antibody 23447
HQSYTAPFT

SEQ ID NO: 46894 - protein, 12 aa, Homo sapiens
  heavy chain complementarity determining region 3 for antibody 23447
ARNYFNSSGPDY

SEQ ID NO: 46895 - protein, 9 aa, Homo sapiens
  light chain complementarity determining region 3 for antibody 23448
HQSYTAPFT

SEQ ID NO: 46896 - protein, 12 aa, Homo sapiens
  heavy chain complementarity determining region 3 for antibody 23448
ARNYFDSSSPDY

SEQ ID NO: 46897 - protein, 9 aa, Homo sapiens
  light chain complementarity determining region 3 for antibody 23449
HQSYSTPRT

SEQ ID NO: 46898 - protein, 11 aa, Homo sapiens
  heavy chain complementarity determining region 3 for antibody 23449
ARARSSGCFDI

SEQ ID NO: 46899 - protein, 9 aa, Homo sapiens
  light chain complementarity determining region 3 for antibody 23450
HQSYSSPLT

SEQ ID NO: 46900 - protein, 14 aa, Homo sapiens
  heavy chain complementarity determining region 3 for antibody 23450
ARYGAYYGYDNFDN

SEQ ID NO: 46901 - protein, 9 aa, Homo sapiens
  light chain complementarity determining region 3 for antibody 23451
HQSYNAPFT

SEQ ID NO: 46902 - protein, 12 aa, Homo sapiens
  heavy chain complementarity determining region 3 for antibody 23451
ARNYFDSSGPDY

SEQ ID NO: 46903 - protein, 10 aa, Homo sapiens
  light chain complementarity determining region 3 for antibody 23452
HQSYHVPALT

SEQ ID NO: 46904 - protein, 17 aa, Homo sapiens
  heavy chain complementarity determining region 3 for antibody 23452
AKDQIAVAGKAPCGMDV

SEQ ID NO: 46905 - protein, 9 aa, Homo sapiens
  light chain complementarity determining region 3 for antibody 23453
HQSSSTPRT

SEQ ID NO: 46906 - protein, 11 aa, Homo sapiens
  heavy chain complementarity determining region 3 for antibody 23453
ARARSSGGFDI

SEQ ID NO: 46907 - protein, 9 aa, Homo sapiens
  light chain complementarity determining region 3 for antibody 23454
HQSSSLQYT

SEQ ID NO: 46908 - protein, 14 aa, Homo sapiens
  heavy chain complementarity determining region 3 for antibody 23454
ATSPKGTSLYYFDF

SEQ ID NO: 46909 - protein, 9 aa, Homo sapiens
  light chain complementarity determining region 3 for antibody 23455
HQSSSLPYT

SEQ ID NO: 46910 - protein, 14 aa, Homo sapiens
  heavy chain complementarity determining region 3 for antibody 23455
ATSPKGTSLYYLDF

SEQ ID NO: 46911 - protein, 9 aa, Homo sapiens
  light chain complementarity determining region 3 for antibody 23456
HQSSSLPYT

SEQ ID NO: 46912 - protein, 14 aa, Homo sapiens
  heavy chain complementarity determining region 3 for antibody 23456
ATSPKGPSLYYFDF

SEQ ID NO: 46913 - protein, 9 aa, Homo sapiens
  light chain complementarity determining region 3 for antibody 23457
HQSSSLPPT

SEQ ID NO: 46914 - protein, 15 aa, Homo sapiens
  heavy chain complementarity determining region 3 for antibody 23457
AKSGGGGSYRLPVDY

SEQ ID NO: 46915 - protein, 9 aa, Homo sapiens
  light chain complementarity determining region 3 for antibody 23458
HQSSSLPLT

SEQ ID NO: 46916 - protein, 15 aa, Homo sapiens
  heavy chain complementarity determining region 3 for antibody 23458
AKSGGGGSYRRPVDY

SEQ ID NO: 46917 - protein, 9 aa, Homo sapiens
  light chain complementarity determining region 3 for antibody 23459
HQSSSLPLT

SEQ ID NO: 46918 - protein, 15 aa, Homo sapiens
  heavy chain complementarity determining region 3 for antibody 23459
AKSGGGGSDRLPVDY

SEQ ID NO: 46919 - protein, 9 aa, Homo sapiens
  light chain complementarity determining region 3 for antibody 23460
HQSSSLPLT

SEQ ID NO: 46920 - protein, 15 aa, Homo sapiens
  heavy chain complementarity determining region 3 for antibody 23460
AKSGGGGRYRLPVDY

SEQ ID NO: 46921 - protein, 9 aa, Homo sapiens
  light chain complementarity determining region 3 for antibody 23461
HQSSSLPFT

SEQ ID NO: 46922 - protein, 15 aa, Homo sapiens
  heavy chain complementarity determining region 3 for antibody 23461
AKSGGGGSYRLPVDY

SEQ ID NO: 46923 - protein, 9 aa, Homo sapiens
  light chain complementarity determining region 3 for antibody 23462
HQSSSFPWT

SEQ ID NO: 46924 - protein, 19 aa, Homo sapiens
  heavy chain complementarity determining region 3 for antibody 23462
ARTGYDILSDSPCVDAFDI

SEQ ID NO: 46925 - protein, 9 aa, Homo sapiens
  light chain complementarity determining region 3 for antibody 23463
HQSSRFPWT

SEQ ID NO: 46926 - protein, 19 aa, Homo sapiens
  heavy chain complementarity determining region 3 for antibody 23463
ARTGYDILSDSPFVDAFDI

SEQ ID NO: 46927 - protein, 9 aa, Homo sapiens
  light chain complementarity determining region 3 for antibody 23464
HQSSGLPHT

SEQ ID NO: 46928 - protein, 12 aa, Homo sapiens
  heavy chain complementarity determining region 3 for antibody 23464
SPHPWSNIVVDY

SEQ ID NO: 46929 - protein, 9 aa, Homo sapiens
  light chain complementarity determining region 3 for antibody 23465
HQSSGLPHT

SEQ ID NO: 46930 - protein, 12 aa, Homo sapiens
  heavy chain complementarity determining region 3 for antibody 23465
APHTWSNIVVDY

SEQ ID NO: 46931 - protein, 9 aa, Homo sapiens
  light chain complementarity determining region 3 for antibody 23466
HQSSGFPHT

SEQ ID NO: 46932 - protein, 12 aa, Homo sapiens
  heavy chain complementarity determining region 3 for antibody 23466
SPHTWSNIVVDY

SEQ ID NO: 46933 - protein, 9 aa, Homo sapiens
  light chain complementarity determining region 3 for antibody 23467
HQSRSLPLT

SEQ ID NO: 46934 - protein, 15 aa, Homo sapiens
  heavy chain complementarity determining region 3 for antibody 23467
AKSGGGGSYRLPVDY

SEQ ID NO: 46935 - protein, 9 aa, Homo sapiens
  light chain complementarity determining region 3 for antibody 23468
HQSGVLTWT

SEQ ID NO: 46936 - protein, 14 aa, Homo sapiens
  heavy chain complementarity determining region 3 for antibody 23468
VRDASGNSGWYAAS

SEQ ID NO: 46937 - protein, 10 aa, Homo sapiens
  light chain complementarity determining region 3 for antibody 23469
HQSGILPPWT

SEQ ID NO: 46938 - protein, 13 aa, Homo sapiens
  heavy chain complementarity determining region 3 for antibody 23469
ARVSQACYNGMDV

SEQ ID NO: 46939 - protein, 10 aa, Homo sapiens
  light chain complementarity determining region 3 for antibody 23470
HQSGILPPCT

SEQ ID NO: 46940 - protein, 13 aa, Homo sapiens
  heavy chain complementarity determining region 3 for antibody 23470
ARVSQAYYNGMDV

SEQ ID NO: 46941 - protein, 10 aa, Homo sapiens
  light chain complementarity determining region 3 for antibody 23471
HQSGIFPPGT

SEQ ID NO: 46942 - protein, 13 aa, Homo sapiens
  heavy chain complementarity determining region 3 for antibody 23471
ARVSQAYYNGMDV

SEQ ID NO: 46943 - protein, 9 aa, Homo sapiens
  light chain complementarity determining region 3 for antibody 23472
HQSGGFPRT

SEQ ID NO: 46944 - protein, 11 aa, Homo sapiens
  heavy chain complementarity determining region 3 for antibody 23472
AREVYGGSFDS

SEQ ID NO: 46945 - protein, 9 aa, Homo sapiens
  light chain complementarity determining region 3 for antibody 23473
HQSGGFPRT

SEQ ID NO: 46946 - protein, 11 aa, Homo sapiens
  heavy chain complementarity determining region 3 for antibody 23473
AREVYGGPFDS

SEQ ID NO: 46947 - protein, 9 aa, Homo sapiens
  light chain complementarity determining region 3 for antibody 23474
HQSGGFPRP

SEQ ID NO: 46948 - protein, 11 aa, Homo sapiens
  heavy chain complementarity determining region 3 for antibody 23474
AREVYGGTFDS

SEQ ID NO: 46949 - protein, 9 aa, Homo sapiens
  light chain complementarity determining region 3 for antibody 23475
HQSGALPWT

SEQ ID NO: 46950 - protein, 14 aa, Homo sapiens
  heavy chain complementarity determining region 3 for antibody 23475
VREASGNSGWYADS

SEQ ID NO: 46951 - protein, 9 aa, Homo sapiens
  light chain complementarity determining region 3 for antibody 23476
HQSGALPWT

SEQ ID NO: 46952 - protein, 14 aa, Homo sapiens
  heavy chain complementarity determining region 3 for antibody 23476
VRDASGNSGWYADY

SEQ ID NO: 46953 - protein, 9 aa, Homo sapiens
  light chain complementarity determining region 3 for antibody 23477
HQSGALPWT

SEQ ID NO: 46954 - protein, 14 aa, Homo sapiens
  heavy chain complementarity determining region 3 for antibody 23477
VGDASGNSGWYADS

SEQ ID NO: 46955 - protein, 9 aa, Homo sapiens
  light chain complementarity determining region 3 for antibody 23478
HQSGALPWP

SEQ ID NO: 46956 - protein, 14 aa, Homo sapiens
  heavy chain complementarity determining region 3 for antibody 23478
VRDASGNSGWYADS

SEQ ID NO: 46957 - protein, 9 aa, Homo sapiens
  light chain complementarity determining region 3 for antibody 23479
HQSGALPRT

SEQ ID NO: 46958 - protein, 14 aa, Homo sapiens
  heavy chain complementarity determining region 3 for antibody 23479
VRDASGNSGWYADS

SEQ ID NO: 46959 - protein, 9 aa, Homo sapiens
  light chain complementarity determining region 3 for antibody 23480
HQSGALPLT

SEQ ID NO: 46960 - protein, 14 aa, Homo sapiens
  heavy chain complementarity determining region 3 for antibody 23480
VRDASGNSGWYADS

SEQ ID NO: 46961 - protein, 9 aa, Homo sapiens
  light chain complementarity determining region 3 for antibody 23481
HQRYSTPRT

SEQ ID NO: 46962 - protein, 11 aa, Homo sapiens
  heavy chain complementarity determining region 3 for antibody 23481
ARARSSGGFDI

SEQ ID NO: 46963 - protein, 9 aa, Homo sapiens
  light chain complementarity determining region 3 for antibody 23482
HQRSNWPPT

SEQ ID NO: 46964 - protein, 13 aa, Homo sapiens
  heavy chain complementarity determining region 3 for antibody 23482
ARGLIFKQWVVDY

SEQ ID NO: 46965 - protein, 9 aa, Homo sapiens
  light chain complementarity determining region 3 for antibody 23483
HQRSNWPPL

SEQ ID NO: 46966 - protein, 12 aa, Homo sapiens
  heavy chain complementarity determining region 3 for antibody 23483
ARSLKRWGTFDY

SEQ ID NO: 46967 - protein, 8 aa, Homo sapiens
  light chain complementarity determining region 3 for antibody 23484
HQRGPGYT

SEQ ID NO: 46968 - protein, 21 aa, Homo sapiens
  heavy chain complementarity determining region 3 for antibody 23484
AHRGGCSRGSCYGATYNWFDP

SEQ ID NO: 46969 - protein, 8 aa, Homo sapiens
  light chain complementarity determining region 3 for antibody 23485
HQRGPGST

SEQ ID NO: 46970 - protein, 21 aa, Homo sapiens
  heavy chain complementarity determining region 3 for antibody 23485
AHRGGCSRGSCYGATYNWFDP

SEQ ID NO: 46971 - protein, 8 aa, Homo sapiens
  light chain complementarity determining region 3 for antibody 23486
HQRGHGYP

SEQ ID NO: 46972 - protein, 21 aa, Homo sapiens
  heavy chain complementarity determining region 3 for antibody 23486
AHRGGCSRGSCYGATYNWFDP

SEQ ID NO: 46973 - protein, 8 aa, Homo sapiens
  light chain complementarity determining region 3 for antibody 23487
HQRGHGDT

SEQ ID NO: 46974 - protein, 21 aa, Homo sapiens
  heavy chain complementarity determining region 3 for antibody 23487
AHRGGCSRGSCYGATYNWFDP

SEQ ID NO: 46975 - protein, 9 aa, Homo sapiens
  light chain complementarity determining region 3 for antibody 23488
HQRGALTWT

SEQ ID NO: 46976 - protein, 14 aa, Homo sapiens
  heavy chain complementarity determining region 3 for antibody 23488
VRDASGNSGWYADS

SEQ ID NO: 46977 - protein, 9 aa, Homo sapiens
  light chain complementarity determining region 3 for antibody 23489
HQRGAFPWT

SEQ ID NO: 46978 - protein, 14 aa, Homo sapiens
  heavy chain complementarity determining region 3 for antibody 23489
VRDASGNSGWYADS

SEQ ID NO: 46979 - protein, 9 aa, Homo sapiens
  light chain complementarity determining region 3 for antibody 23490
HQPSTFPRT

SEQ ID NO: 46980 - protein, 20 aa, Homo sapiens
  heavy chain complementarity determining region 3 for antibody 23490
ARGRRIAALSTAHYYYGMDV

SEQ ID NO: 46981 - protein, 9 aa, Homo sapiens
  light chain complementarity determining region 3 for antibody 23491
HQNYSAPLT

SEQ ID NO: 46982 - protein, 21 aa, Homo sapiens
  heavy chain complementarity determining region 3 for antibody 23491
AKDEGLSVFRSFDGLFDAFDI

SEQ ID NO: 46983 - protein, 9 aa, Homo sapiens
  light chain complementarity determining region 3 for antibody 23492
HQNSSSPYT

SEQ ID NO: 46984 - protein, 13 aa, Homo sapiens
  heavy chain complementarity determining region 3 for antibody 23492
ARGTYSAFAIFGV

SEQ ID NO: 46985 - protein, 9 aa, Homo sapiens
  light chain complementarity determining region 3 for antibody 23493
HQNGSSPRT

SEQ ID NO: 46986 - protein, 17 aa, Homo sapiens
  heavy chain complementarity determining region 3 for antibody 23493
TTDPQWLTPPPFVTNDY

SEQ ID NO: 46987 - protein, 10 aa, Homo sapiens
  light chain complementarity determining region 3 for antibody 23494
HQNGGSPVWT

SEQ ID NO: 46988 - protein, 10 aa, Homo sapiens
  heavy chain complementarity determining region 3 for antibody 23494
AGDNRLDQAT

SEQ ID NO: 46989 - protein, 9 aa, Homo sapiens
  light chain complementarity determining region 3 for antibody 23495
HQNATLPET

SEQ ID NO: 46990 - protein, 13 aa, Homo sapiens
  heavy chain complementarity determining region 3 for antibody 23495
VRRGYGDFVREDF

SEQ ID NO: 46991 - protein, 9 aa, Homo sapiens
  light chain complementarity determining region 3 for antibody 23496
HQNAESPRM

SEQ ID NO: 46992 - protein, 17 aa, Homo sapiens
  heavy chain complementarity determining region 3 for antibody 23496
AKSVGVDDAMTTRVYDS

SEQ ID NO: 46993 - protein, 9 aa, Homo sapiens
  light chain complementarity determining region 3 for antibody 23497
HQLSNWPPL

SEQ ID NO: 46994 - protein, 12 aa, Homo sapiens
  heavy chain complementarity determining region 3 for antibody 23497
ARSLKRWGNFDY

SEQ ID NO: 46995 - protein, 9 aa, Homo sapiens
  light chain complementarity determining region 3 for antibody 23498
HQIISYPFT

SEQ ID NO: 46996 - protein, 12 aa, Homo sapiens
  heavy chain complementarity determining region 3 for antibody 23498
ARPLDGDHGFDV

SEQ ID NO: 46997 - protein, 9 aa, Homo sapiens
  light chain complementarity determining region 3 for antibody 23499
HQIHTFPPT

SEQ ID NO: 46998 - protein, 11 aa, Homo sapiens
  heavy chain complementarity determining region 3 for antibody 23499
TSDNGKWAFDA

SEQ ID NO: 46999 - protein, 9 aa, Homo sapiens
  light chain complementarity determining region 3 for antibody 23500
HQIHTFPFT

SEQ ID NO: 47000 - protein, 11 aa, Homo sapiens
  heavy chain complementarity determining region 3 for antibody 23500
TSDNGKWAFDA

SEQ ID NO: 47001 - protein, 8 aa, Homo sapiens
  light chain complementarity determining region 3 for antibody 23501
HQHGYSWT

SEQ ID NO: 47002 - protein, 9 aa, Homo sapiens
  heavy chain complementarity determining region 3 for antibody 23501
ARWVEGLDV

SEQ ID NO: 47003 - protein, 9 aa, Homo sapiens
  light chain complementarity determining region 3 for antibody 23502
HQHAAAPLP

SEQ ID NO: 47004 - protein, 10 aa, Homo sapiens
  heavy chain complementarity determining region 3 for antibody 23502
AHGAGWVSDY

SEQ ID NO: 47005 - protein, 9 aa, Homo sapiens
  light chain complementarity determining region 3 for antibody 23503
HQGYRTPLT

SEQ ID NO: 47006 - protein, 12 aa, Homo sapiens
  heavy chain complementarity determining region 3 for antibody 23503
ARPLDGDHGFDV

SEQ ID NO: 47007 - protein, 9 aa, Homo sapiens
  light chain complementarity determining region 3 for antibody 23504
HQGYRTPFT

SEQ ID NO: 47008 - protein, 15 aa, Homo sapiens
  heavy chain complementarity determining region 3 for antibody 23504
SKAQVIWGQLYYFES

SEQ ID NO: 47009 - protein, 9 aa, Homo sapiens
  light chain complementarity determining region 3 for antibody 23505
HQGYRTPFT

SEQ ID NO: 47010 - protein, 12 aa, Homo sapiens
  heavy chain complementarity determining region 3 for antibody 23505
ARPLGGDHGFDV

SEQ ID NO: 47011 - protein, 9 aa, Homo sapiens
  light chain complementarity determining region 3 for antibody 23506
HQGYRTPFT

SEQ ID NO: 47012 - protein, 15 aa, Homo sapiens
  heavy chain complementarity determining region 3 for antibody 23506
AKAQVIWGQFYYFES

SEQ ID NO: 47013 - protein, 9 aa, Homo sapiens
  light chain complementarity determining region 3 for antibody 23507
HQGYRPPFT

SEQ ID NO: 47014 - protein, 15 aa, Homo sapiens
  heavy chain complementarity determining region 3 for antibody 23507
AKAQVIWGQLYYFES

SEQ ID NO: 47015 - protein, 9 aa, Homo sapiens
  light chain complementarity determining region 3 for antibody 23508
HQGSSLPLT

SEQ ID NO: 47016 - protein, 15 aa, Homo sapiens
  heavy chain complementarity determining region 3 for antibody 23508
AKSGGGGSYRLPVDY

SEQ ID NO: 47017 - protein, 9 aa, Homo sapiens
  light chain complementarity determining region 3 for antibody 23509
HQGISYPFT

SEQ ID NO: 47018 - protein, 12 aa, Homo sapiens
  heavy chain complementarity determining region 3 for antibody 23509
ARPLDGDHGFDV

SEQ ID NO: 47019 - protein, 9 aa, Homo sapiens
  light chain complementarity determining region 3 for antibody 23510
HQFSSSPYT

SEQ ID NO: 47020 - protein, 13 aa, Homo sapiens
  heavy chain complementarity determining region 3 for antibody 23510
ARGTYSAFAIFGV

SEQ ID NO: 47021 - protein, 10 aa, Homo sapiens
  light chain complementarity determining region 3 for antibody 23511
HQFGILPPWT

SEQ ID NO: 47022 - protein, 13 aa, Homo sapiens
  heavy chain complementarity determining region 3 for antibody 23511
ARVSQAYYNGMDV

SEQ ID NO: 47023 - protein, 9 aa, Homo sapiens
  light chain complementarity determining region 3 for antibody 23512
HQFDKSPYS

SEQ ID NO: 47024 - protein, 20 aa, Homo sapiens
  heavy chain complementarity determining region 3 for antibody 23512
ARDRRRRYAILALRSYGMDV

SEQ ID NO: 47025 - protein, 9 aa, Homo sapiens
  light chain complementarity determining region 3 for antibody 23513
HQFDKRPYS

SEQ ID NO: 47026 - protein, 20 aa, Homo sapiens
  heavy chain complementarity determining region 3 for antibody 23513
ARDRRRRYAIVALRSYGMDV

SEQ ID NO: 47027 - protein, 9 aa, Homo sapiens
  light chain complementarity determining region 3 for antibody 23514
HQDYSAPLT

SEQ ID NO: 47028 - protein, 21 aa, Homo sapiens
  heavy chain complementarity determining region 3 for antibody 23514
AKDEGLSVFRSFDGLFDAFDI

SEQ ID NO: 47029 - protein, 10 aa, Homo sapiens
  light chain complementarity determining region 3 for antibody 23515
HQDGRSAPGT

SEQ ID NO: 47030 - protein, 11 aa, Homo sapiens
  heavy chain complementarity determining region 3 for antibody 23515
VKDRGAVMGDY

SEQ ID NO: 47031 - protein, 9 aa, Homo sapiens
  light chain complementarity determining region 3 for antibody 23516
HQDAESPRM

SEQ ID NO: 47032 - protein, 17 aa, Homo sapiens
  heavy chain complementarity determining region 3 for antibody 23516
AKSVGVDDAMTTRVYDS

SEQ ID NO: 47033 - protein, 9 aa, Homo sapiens
  light chain complementarity determining region 3 for antibody 23517
HQCSSSPLT

SEQ ID NO: 47034 - protein, 10 aa, Homo sapiens
  heavy chain complementarity determining region 3 for antibody 23517
AWGIGWTSNY

SEQ ID NO: 47035 - protein, 10 aa, Homo sapiens
  light chain complementarity determining region 3 for antibody 23518
HQAGILPPWT

SEQ ID NO: 47036 - protein, 13 aa, Homo sapiens
  heavy chain complementarity determining region 3 for antibody 23518
ARVSQAYYNGMDV

SEQ ID NO: 47037 - protein, 9 aa, Homo sapiens
  light chain complementarity determining region 3 for antibody 23519
HPYYSSPRM

SEQ ID NO: 47038 - protein, 13 aa, Homo sapiens
  heavy chain complementarity determining region 3 for antibody 23519
ARGQSGDPRTYDY

SEQ ID NO: 47039 - protein, 9 aa, Homo sapiens
  light chain complementarity determining region 3 for antibody 23520
HPYYSAPLT

SEQ ID NO: 47040 - protein, 21 aa, Homo sapiens
  heavy chain complementarity determining region 3 for antibody 23520
AKDEGLSVFRSFDGLFDAFDI

SEQ ID NO: 47041 - protein, 9 aa, Homo sapiens
  light chain complementarity determining region 3 for antibody 23521
HPYHNAPWG

SEQ ID NO: 47042 - protein, 15 aa, Homo sapiens
  heavy chain complementarity determining region 3 for antibody 23521
AATSYGSRKVRPALS

SEQ ID NO: 47043 - protein, 10 aa, Homo sapiens
  light chain complementarity determining region 3 for antibody 23522
HPYGGSPVWT

SEQ ID NO: 47044 - protein, 10 aa, Homo sapiens
  heavy chain complementarity determining region 3 for antibody 23522
AGDNRLDQAT

SEQ ID NO: 47045 - protein, 9 aa, Homo sapiens
  light chain complementarity determining region 3 for antibody 23523
HPYAESPRM

SEQ ID NO: 47046 - protein, 17 aa, Homo sapiens
  heavy chain complementarity determining region 3 for antibody 23523
AKSVGVDDAMTTRVYDS

SEQ ID NO: 47047 - protein, 9 aa, Homo sapiens
  light chain complementarity determining region 3 for antibody 23524
HPTYTFPRP

SEQ ID NO: 47048 - protein, 20 aa, Homo sapiens
  heavy chain complementarity determining region 3 for antibody 23524
ARGRRIAALSTAHYYYGMDV

SEQ ID NO: 47049 - protein, 9 aa, Homo sapiens
  light chain complementarity determining region 3 for antibody 23525
HPTSTFPRP

SEQ ID NO: 47050 - protein, 20 aa, Homo sapiens
  heavy chain complementarity determining region 3 for antibody 23525
ARGRRIAALSTAHYYYGMDV

SEQ ID NO: 47051 - protein, 9 aa, Homo sapiens
  light chain complementarity determining region 3 for antibody 23526
HPSGVFPWT

SEQ ID NO: 47052 - protein, 14 aa, Homo sapiens
  heavy chain complementarity determining region 3 for antibody 23526
VRDASGNSGWYAAS

SEQ ID NO: 47053 - protein, 9 aa, Homo sapiens
  light chain complementarity determining region 3 for antibody 23527
HPPYTFPRT

SEQ ID NO: 47054 - protein, 20 aa, Homo sapiens
  heavy chain complementarity determining region 3 for antibody 23527
ARGRRIAALSTAHYYYGMDV

SEQ ID NO: 47055 - protein, 9 aa, Homo sapiens
  light chain complementarity determining region 3 for antibody 23528
HKYGTPPRP

SEQ ID NO: 47056 - protein, 13 aa, Homo sapiens
  heavy chain complementarity determining region 3 for antibody 23528
AGGLYDNTGYSEF

SEQ ID NO: 47057 - protein, 9 aa, Homo sapiens
  light chain complementarity determining region 3 for antibody 23529
HKIHNFPLT

SEQ ID NO: 47058 - protein, 11 aa, Homo sapiens
  heavy chain complementarity determining region 3 for antibody 23529
TSDNGKWAFDA

SEQ ID NO: 47059 - protein, 9 aa, Homo sapiens
  light chain complementarity determining region 3 for antibody 23530
HHYYSSPRL

SEQ ID NO: 47060 - protein, 13 aa, Homo sapiens
  heavy chain complementarity determining region 3 for antibody 23530
ARGQSGDPRTYDY

SEQ ID NO: 47061 - protein, 9 aa, Homo sapiens
  light chain complementarity determining region 3 for antibody 23531
HHYSSSPYT

SEQ ID NO: 47062 - protein, 13 aa, Homo sapiens
  heavy chain complementarity determining region 3 for antibody 23531
ARGAYSAFAIFGV

SEQ ID NO: 47063 - protein, 9 aa, Homo sapiens
  light chain complementarity determining region 3 for antibody 23532
HHYSSSPST

SEQ ID NO: 47064 - protein, 13 aa, Homo sapiens
  heavy chain complementarity determining region 3 for antibody 23532
ARGTYSAFAIFGV

SEQ ID NO: 47065 - protein, 10 aa, Homo sapiens
  light chain complementarity determining region 3 for antibody 23533
HHYNNWPRPA

SEQ ID NO: 47066 - protein, 18 aa, Homo sapiens
  heavy chain complementarity determining region 3 for antibody 23533
ARGGRSSGWHVQNDGFDI

SEQ ID NO: 47067 - protein, 9 aa, Homo sapiens
  light chain complementarity determining region 3 for antibody 23534
HHYHNAPWG

SEQ ID NO: 47068 - protein, 15 aa, Homo sapiens
  heavy chain complementarity determining region 3 for antibody 23534
AATSDGSRKVRPALS

SEQ ID NO: 47069 - protein, 9 aa, Homo sapiens
  light chain complementarity determining region 3 for antibody 23535
HHYHNAPRG

SEQ ID NO: 47070 - protein, 15 aa, Homo sapiens
  heavy chain complementarity determining region 3 for antibody 23535
AATSYGSRKVRPALS

SEQ ID NO: 47071 - protein, 9 aa, Homo sapiens
  light chain complementarity determining region 3 for antibody 23536
HHYHNAPLG

SEQ ID NO: 47072 - protein, 15 aa, Homo sapiens
  heavy chain complementarity determining region 3 for antibody 23536
AATSYGSRKVRPALS

SEQ ID NO: 47073 - protein, 9 aa, Homo sapiens
  light chain complementarity determining region 3 for antibody 23537
HHYGSSPWP

SEQ ID NO: 47074 - protein, 13 aa, Homo sapiens
  heavy chain complementarity determining region 3 for antibody 23537
ARAQTWSGRRFDY

SEQ ID NO: 47075 - protein, 9 aa, Homo sapiens
  light chain complementarity determining region 3 for antibody 23538
HHYGSSPRP

SEQ ID NO: 47076 - protein, 13 aa, Homo sapiens
  heavy chain complementarity determining region 3 for antibody 23538
ARAQTWSGRLFDY

SEQ ID NO: 47077 - protein, 9 aa, Homo sapiens
  light chain complementarity determining region 3 for antibody 23539
HHYGSSPLP

SEQ ID NO: 47078 - protein, 13 aa, Homo sapiens
  heavy chain complementarity determining region 3 for antibody 23539
ARAQTWSGRLFDY

SEQ ID NO: 47079 - protein, 9 aa, Homo sapiens
  light chain complementarity determining region 3 for antibody 23540
HHYGSLPLT

SEQ ID NO: 47080 - protein, 16 aa, Homo sapiens
  heavy chain complementarity determining region 3 for antibody 23540
ATMLVRGLLYFHAVDV

SEQ ID NO: 47081 - protein, 9 aa, Homo sapiens
  light chain complementarity determining region 3 for antibody 23541
HHTYTLPRT

SEQ ID NO: 47082 - protein, 20 aa, Homo sapiens
  heavy chain complementarity determining region 3 for antibody 23541
ARGRRIAALSTAHYYYGMDV

SEQ ID NO: 47083 - protein, 9 aa, Homo sapiens
  light chain complementarity determining region 3 for antibody 23542
HHTYTFSRP

SEQ ID NO: 47084 - protein, 20 aa, Homo sapiens
  heavy chain complementarity determining region 3 for antibody 23542
ARGRRIAALSTAHYYYGMDV

SEQ ID NO: 47085 - protein, 9 aa, Homo sapiens
  light chain complementarity determining region 3 for antibody 23543
HHTYTFPRT

SEQ ID NO: 47086 - protein, 20 aa, Homo sapiens
  heavy chain complementarity determining region 3 for antibody 23543
ARGRRSAALSTAHYYYGMDV

SEQ ID NO: 47087 - protein, 9 aa, Homo sapiens
  light chain complementarity determining region 3 for antibody 23544
HHTYTFPRT

SEQ ID NO: 47088 - protein, 20 aa, Homo sapiens
  heavy chain complementarity determining region 3 for antibody 23544
ARGRRIAALSTAPYYYGMDV

SEQ ID NO: 47089 - protein, 9 aa, Homo sapiens
  light chain complementarity determining region 3 for antibody 23545
HHTYTFPRT

SEQ ID NO: 47090 - protein, 20 aa, Homo sapiens
  heavy chain complementarity determining region 3 for antibody 23545
ARGRRIAALSTAHYYYGLDV

SEQ ID NO: 47091 - protein, 9 aa, Homo sapiens
  light chain complementarity determining region 3 for antibody 23546
HHTYTFPRT

SEQ ID NO: 47092 - protein, 20 aa, Homo sapiens
  heavy chain complementarity determining region 3 for antibody 23546
ARGRRIAALSTAHSYYGMDV

SEQ ID NO: 47093 - protein, 9 aa, Homo sapiens
  light chain complementarity determining region 3 for antibody 23547
HHTYTFPRT

SEQ ID NO: 47094 - protein, 20 aa, Homo sapiens
  heavy chain complementarity determining region 3 for antibody 23547
ARGRRIAALPTAHYYYGMDV

SEQ ID NO: 47095 - protein, 9 aa, Homo sapiens
  light chain complementarity determining region 3 for antibody 23548
HHTYTFPRT

SEQ ID NO: 47096 - protein, 20 aa, Homo sapiens
  heavy chain complementarity determining region 3 for antibody 23548
ARGRCIAALSTAHYYYGMDV

SEQ ID NO: 47097 - protein, 9 aa, Homo sapiens
  light chain complementarity determining region 3 for antibody 23549
HHTYTFPRT

SEQ ID NO: 47098 - protein, 20 aa, Homo sapiens
  heavy chain complementarity determining region 3 for antibody 23549
ARCRRIAALSTAHYYYGMDV

SEQ ID NO: 47099 - protein, 9 aa, Homo sapiens
  light chain complementarity determining region 3 for antibody 23550
HHTYTFPRT

SEQ ID NO: 47100 - protein, 20 aa, Homo sapiens
  heavy chain complementarity determining region 3 for antibody 23550
ALGRRIAALSTAHYYYGMDV

SEQ ID NO: 47101 - protein, 9 aa, Homo sapiens
  light chain complementarity determining region 3 for antibody 23551
HHTYTFLRT

SEQ ID NO: 47102 - protein, 20 aa, Homo sapiens
  heavy chain complementarity determining region 3 for antibody 23551
ARGRRIAALSTAHYYYGMDV

SEQ ID NO: 47103 - protein, 9 aa, Homo sapiens
  light chain complementarity determining region 3 for antibody 23552
HHTYTFHRT

SEQ ID NO: 47104 - protein, 20 aa, Homo sapiens
  heavy chain complementarity determining region 3 for antibody 23552
ARGRRIAALSTAHYYYGMDV

SEQ ID NO: 47105 - protein, 9 aa, Homo sapiens
  light chain complementarity determining region 3 for antibody 23553
HHTYPFPRP

SEQ ID NO: 47106 - protein, 20 aa, Homo sapiens
  heavy chain complementarity determining region 3 for antibody 23553
ARGRRIAALSTAHYYYGMDV

SEQ ID NO: 47107 - protein, 9 aa, Homo sapiens
  light chain complementarity determining region 3 for antibody 23554
HHTSTFPRT

SEQ ID NO: 47108 - protein, 4 aa, Homo sapiens
  heavy chain complementarity determining region 3 for antibody 23554
GMDV

SEQ ID NO: 47109 - protein, 9 aa, Homo sapiens
  light chain complementarity determining region 3 for antibody 23555
HHTSTFPRT

SEQ ID NO: 47110 - protein, 20 aa, Homo sapiens
  heavy chain complementarity determining region 3 for antibody 23555
ARGSRIAALSTAHYYYGMDV

SEQ ID NO: 47111 - protein, 9 aa, Homo sapiens
  light chain complementarity determining region 3 for antibody 23556
HHTSTFPRT

SEQ ID NO: 47112 - protein, 20 aa, Homo sapiens
  heavy chain complementarity determining region 3 for antibody 23556
ARGRRISALSTAHYYYGMDV

SEQ ID NO: 47113 - protein, 9 aa, Homo sapiens
  light chain complementarity determining region 3 for antibody 23557
HHTSTFPRT

SEQ ID NO: 47114 - protein, 20 aa, Homo sapiens
  heavy chain complementarity determining region 3 for antibody 23557
ARGRRIAALSTARYYYGMDV

SEQ ID NO: 47115 - protein, 9 aa, Homo sapiens
  light chain complementarity determining region 3 for antibody 23558
HHTSTFPRT

SEQ ID NO: 47116 - protein, 20 aa, Homo sapiens
  heavy chain complementarity determining region 3 for antibody 23558
ARGRRIAALSTAQYYYGMDV

SEQ ID NO: 47117 - protein, 9 aa, Homo sapiens
  light chain complementarity determining region 3 for antibody 23559
HHTSTFPRT

SEQ ID NO: 47118 - protein, 20 aa, Homo sapiens
  heavy chain complementarity determining region 3 for antibody 23559
ARGRRIAALSTAHYYDGMDV

SEQ ID NO: 47119 - protein, 9 aa, Homo sapiens
  light chain complementarity determining region 3 for antibody 23560
HHTSTFPRT

SEQ ID NO: 47120 - protein, 20 aa, Homo sapiens
  heavy chain complementarity determining region 3 for antibody 23560
ARGRRIAALSTAHCYYGMDV

SEQ ID NO: 47121 - protein, 9 aa, Homo sapiens
  light chain complementarity determining region 3 for antibody 23561
HHTSTFPRT

SEQ ID NO: 47122 - protein, 20 aa, Homo sapiens
  heavy chain complementarity determining region 3 for antibody 23561
ARGRRIAALSPAHYYYGMDV

SEQ ID NO: 47123 - protein, 9 aa, Homo sapiens
  light chain complementarity determining region 3 for antibody 23562
HHTSTFPRT

SEQ ID NO: 47124 - protein, 20 aa, Homo sapiens
  heavy chain complementarity determining region 3 for antibody 23562
ARGRRIAALPTAHYYYGMDV

SEQ ID NO: 47125 - protein, 9 aa, Homo sapiens
  light chain complementarity determining region 3 for antibody 23563
HHTSTFPRT

SEQ ID NO: 47126 - protein, 20 aa, Homo sapiens
  heavy chain complementarity determining region 3 for antibody 23563
ARGRRIAALATAHYYYGMDV

SEQ ID NO: 47127 - protein, 9 aa, Homo sapiens
  light chain complementarity determining region 3 for antibody 23564
HHTSTFPRT

SEQ ID NO: 47128 - protein, 20 aa, Homo sapiens
  heavy chain complementarity determining region 3 for antibody 23564
ARGRCIAALSTAHYYYGMDV

SEQ ID NO: 47129 - protein, 9 aa, Homo sapiens
  light chain complementarity determining region 3 for antibody 23565
HHTSTFPRT

SEQ ID NO: 47130 - protein, 20 aa, Homo sapiens
  heavy chain complementarity determining region 3 for antibody 23565
ARGGRIAALSTAHYYYGMDV

SEQ ID NO: 47131 - protein, 9 aa, Homo sapiens
  light chain complementarity determining region 3 for antibody 23566
HHTSTFPRT

SEQ ID NO: 47132 - protein, 20 aa, Homo sapiens
  heavy chain complementarity determining region 3 for antibody 23566
ALGRRIAALSTAHYYYGMDV

SEQ ID NO: 47133 - protein, 9 aa, Homo sapiens
  light chain complementarity determining region 3 for antibody 23567
HHTSTFPRN

SEQ ID NO: 47134 - protein, 20 aa, Homo sapiens
  heavy chain complementarity determining region 3 for antibody 23567
ARGRRIAALSTAHYYYGMDV

SEQ ID NO: 47135 - protein, 9 aa, Homo sapiens
  light chain complementarity determining region 3 for antibody 23568
HHTSTFPRI

SEQ ID NO: 47136 - protein, 20 aa, Homo sapiens
  heavy chain complementarity determining region 3 for antibody 23568
ARGRRIAALSTAHYYYGMDV

SEQ ID NO: 47137 - protein, 9 aa, Homo sapiens
  light chain complementarity determining region 3 for antibody 23569
HHTSTFPGT

SEQ ID NO: 47138 - protein, 20 aa, Homo sapiens
  heavy chain complementarity determining region 3 for antibody 23569
ARGRRIAALSTAHYYYGMDV

SEQ ID NO: 47139 - protein, 9 aa, Homo sapiens
  light chain complementarity determining region 3 for antibody 23570
HHTSTFHRT

SEQ ID NO: 47140 - protein, 20 aa, Homo sapiens
  heavy chain complementarity determining region 3 for antibody 23570
ARGRRRAALSTAHYYYGMDV

SEQ ID NO: 47141 - protein, 9 aa, Homo sapiens
  light chain complementarity determining region 3 for antibody 23571
HHTSPFPRP

SEQ ID NO: 47142 - protein, 20 aa, Homo sapiens
  heavy chain complementarity determining region 3 for antibody 23571
ARGRRIAALSTAHYYYGMDV

SEQ ID NO: 47143 - protein, 9 aa, Homo sapiens
  light chain complementarity determining region 3 for antibody 23572
HHRYDWLIS

SEQ ID NO: 47144 - protein, 15 aa, Homo sapiens
  heavy chain complementarity determining region 3 for antibody 23572
ARGRRYGRFGGNLDV

SEQ ID NO: 47145 - protein, 9 aa, Homo sapiens
  light chain complementarity determining region 3 for antibody 23573
HHRRTWLYS

SEQ ID NO: 47146 - protein, 20 aa, Homo sapiens
  heavy chain complementarity determining region 3 for antibody 23573
ARDGSAGMAARGTPYYGLDV

SEQ ID NO: 47147 - protein, 9 aa, Homo sapiens
  light chain complementarity determining region 3 for antibody 23574
HHPYTFPRP

SEQ ID NO: 47148 - protein, 20 aa, Homo sapiens
  heavy chain complementarity determining region 3 for antibody 23574
ARGRRIAALSTAHYYYGMDV

SEQ ID NO: 47149 - protein, 9 aa, Homo sapiens
  light chain complementarity determining region 3 for antibody 23575
HHPYPFPRT

SEQ ID NO: 47150 - protein, 20 aa, Homo sapiens
  heavy chain complementarity determining region 3 for antibody 23575
ARGRRIAALSTAHYYYGMDV

SEQ ID NO: 47151 - protein, 9 aa, Homo sapiens
  light chain complementarity determining region 3 for antibody 23576
HHNSSSPYT

SEQ ID NO: 47152 - protein, 13 aa, Homo sapiens
  heavy chain complementarity determining region 3 for antibody 23576
ARGTYSAFAIFGV

SEQ ID NO: 47153 - protein, 9 aa, Homo sapiens
  light chain complementarity determining region 3 for antibody 23577
HHISTFPRT

SEQ ID NO: 47154 - protein, 20 aa, Homo sapiens
  heavy chain complementarity determining region 3 for antibody 23577
ARGRRIAALSTAHYYYGMDV

SEQ ID NO: 47155 - protein, 9 aa, Homo sapiens
  light chain complementarity determining region 3 for antibody 23578
HHHGSSPWP

SEQ ID NO: 47156 - protein, 13 aa, Homo sapiens
  heavy chain complementarity determining region 3 for antibody 23578
ARAQTWSGRLFDY

SEQ ID NO: 47157 - protein, 9 aa, Homo sapiens
  light chain complementarity determining region 3 for antibody 23579
HAYNNFFRT

SEQ ID NO: 47158 - protein, 11 aa, Homo sapiens
  heavy chain complementarity determining region 3 for antibody 23579
ARDRRAYGMDV

SEQ ID NO: 47159 - protein, 9 aa, Homo sapiens
  light chain complementarity determining region 3 for antibody 23580
FQHNSFPLP

SEQ ID NO: 47160 - protein, 19 aa, Homo sapiens
  heavy chain complementarity determining region 3 for antibody 23580
ASLRYSSSWSRRLVDVFEI

SEQ ID NO: 47161 - protein, 9 aa, Homo sapiens
  light chain complementarity determining region 3 for antibody 23581
FQHNRFPLT

SEQ ID NO: 47162 - protein, 19 aa, Homo sapiens
  heavy chain complementarity determining region 3 for antibody 23581
ASLRYSSSWSRRLVDVFEI

SEQ ID NO: 47163 - protein, 9 aa, Homo sapiens
  light chain complementarity determining region 3 for antibody 23582
EQRLGWPLT

SEQ ID NO: 47164 - protein, 11 aa, Homo sapiens
  heavy chain complementarity determining region 3 for antibody 23582
ARNILGGHTDF

SEQ ID NO: 47165 - protein, 9 aa, Homo sapiens
  light chain complementarity determining region 3 for antibody 23583
EQRLDWPFT

SEQ ID NO: 47166 - protein, 11 aa, Homo sapiens
  heavy chain complementarity determining region 3 for antibody 23583
ARNILGGHTDF

SEQ ID NO: 47167 - protein, 9 aa, Homo sapiens
  light chain complementarity determining region 3 for antibody 23584
EQRLDRPLT

SEQ ID NO: 47168 - protein, 11 aa, Homo sapiens
  heavy chain complementarity determining region 3 for antibody 23584
ARNILGGHTDF

SEQ ID NO: 47169 - protein, 9 aa, Homo sapiens
  light chain complementarity determining region 3 for antibody 23585
EQRLDCPLT

SEQ ID NO: 47170 - protein, 11 aa, Homo sapiens
  heavy chain complementarity determining region 3 for antibody 23585
ARNILGGHTDF

SEQ ID NO: 47171 - protein, 9 aa, Homo sapiens
  light chain complementarity determining region 3 for antibody 23586
EQRLAWPLT

SEQ ID NO: 47172 - protein, 11 aa, Homo sapiens
  heavy chain complementarity determining region 3 for antibody 23586
ARNILGGHTDF

SEQ ID NO: 47173 - protein, 9 aa, Homo sapiens
  light chain complementarity determining region 3 for antibody 23587
EHYGSSLWT

SEQ ID NO: 47174 - protein, 13 aa, Homo sapiens
  heavy chain complementarity determining region 3 for antibody 23587
ARKFLGYDHVLDV

SEQ ID NO: 47175 - protein, 9 aa, Homo sapiens
  light chain complementarity determining region 3 for antibody 23588
QQYGSSPRT

SEQ ID NO: 47176 - protein, 25 aa, Homo sapiens
  heavy chain complementarity determining region 3 for antibody 23588
ARLRIDRLRLPGAMRGPLYDCGLNV

SEQ ID NO: 47177 - protein, 9 aa, Homo sapiens
  light chain complementarity determining region 3 for antibody 23589
QQYGSLPLT

SEQ ID NO: 47178 - protein, 15 aa, Homo sapiens
  heavy chain complementarity determining region 3 for antibody 23589
AHRPNYYDKAGAFDI

SEQ ID NO: 47179 - protein, 9 aa, Homo sapiens
  light chain complementarity determining region 3 for antibody 23590
QQYGSTWWT

SEQ ID NO: 47180 - protein, 15 aa, Homo sapiens
  heavy chain complementarity determining region 3 for antibody 23590
ARHMARDSIGYYHDF

SEQ ID NO: 47181 - protein, 10 aa, Homo sapiens
  light chain complementarity determining region 3 for antibody 23591
QQYGSSPMYS

SEQ ID NO: 47182 - protein, 11 aa, Homo sapiens
  heavy chain complementarity determining region 3 for antibody 23591
ARGGQWGSLDY

SEQ ID NO: 47183 - protein, 9 aa, Homo sapiens
  light chain complementarity determining region 3 for antibody 23592
VQYNRYPRT

SEQ ID NO: 47184 - protein, 6 aa, Homo sapiens
  heavy chain complementarity determining region 3 for antibody 23592
TRALDY

SEQ ID NO: 47185 - protein, 9 aa, Homo sapiens
  light chain complementarity determining region 3 for antibody 23593
QQRSSWPYT

SEQ ID NO: 47186 - protein, 11 aa, Homo sapiens
  heavy chain complementarity determining region 3 for antibody 23593
VKRWGGSSIDY

SEQ ID NO: 47187 - protein, 9 aa, Homo sapiens
  light chain complementarity determining region 3 for antibody 23594
QQYGSSLYT

SEQ ID NO: 47188 - protein, 9 aa, Homo sapiens
  heavy chain complementarity determining region 3 for antibody 23594
IYEINAFDI

SEQ ID NO: 47189 - protein, 9 aa, Homo sapiens
  light chain complementarity determining region 3 for antibody 23595
QQYGNLPRT

SEQ ID NO: 47190 - protein, 13 aa, Homo sapiens
  heavy chain complementarity determining region 3 for antibody 23595
AGGNFHSGGYGEY

SEQ ID NO: 47191 - protein, 10 aa, Homo sapiens
  light chain complementarity determining region 3 for antibody 23596
QEYKSWPAFT

SEQ ID NO: 47192 - protein, 11 aa, Homo sapiens
  heavy chain complementarity determining region 3 for antibody 23596
ARRWGSAPFDH

SEQ ID NO: 47193 - protein, 9 aa, Homo sapiens
  light chain complementarity determining region 3 for antibody 23597
QQYGNSPLT

SEQ ID NO: 47194 - protein, 13 aa, Homo sapiens
  heavy chain complementarity determining region 3 for antibody 23597
ASKTSVRTYSSDL

SEQ ID NO: 47195 - protein, 9 aa, Homo sapiens
  light chain complementarity determining region 3 for antibody 23598
MQALETPFT

SEQ ID NO: 47196 - protein, 15 aa, Homo sapiens
  heavy chain complementarity determining region 3 for antibody 23598
VRHYRETVAGIEGDS

SEQ ID NO: 47197 - protein, 9 aa, Homo sapiens
  light chain complementarity determining region 3 for antibody 23599
QQYISYPWT

SEQ ID NO: 47198 - protein, 19 aa, Homo sapiens
  heavy chain complementarity determining region 3 for antibody 23599
ARVSARRILTAPRYPLIDS

SEQ ID NO: 47199 - protein, 9 aa, Homo sapiens
  light chain complementarity determining region 3 for antibody 23600
QQYYTSLRT

SEQ ID NO: 47200 - protein, 12 aa, Homo sapiens
  heavy chain complementarity determining region 3 for antibody 23600
VKDCGLGGSRDS

SEQ ID NO: 47201 - protein, 9 aa, Homo sapiens
  light chain complementarity determining region 3 for antibody 23601
LQNEYWPRT

SEQ ID NO: 47202 - protein, 11 aa, Homo sapiens
  heavy chain complementarity determining region 3 for antibody 23601
VRVGGAGYFDH

SEQ ID NO: 47203 - protein, 9 aa, Homo sapiens
  light chain complementarity determining region 3 for antibody 23602
MQSRRWPHT

SEQ ID NO: 47204 - protein, 8 aa, Homo sapiens
  heavy chain complementarity determining region 3 for antibody 23602
TAWGSSQH

SEQ ID NO: 47205 - protein, 9 aa, Homo sapiens
  light chain complementarity determining region 3 for antibody 23603
QQYGGSSYT

SEQ ID NO: 47206 - protein, 16 aa, Homo sapiens
  heavy chain complementarity determining region 3 for antibody 23603
ANWFGSVGDFLGPFDY

SEQ ID NO: 47207 - protein, 9 aa, Homo sapiens
  light chain complementarity determining region 3 for antibody 23604
QQYYTTPRT

SEQ ID NO: 47208 - protein, 8 aa, Homo sapiens
  heavy chain complementarity determining region 3 for antibody 23604
ARDGAFDS

SEQ ID NO: 47209 - protein, 9 aa, Homo sapiens
  light chain complementarity determining region 3 for antibody 23605
QQYAYSPIT

SEQ ID NO: 47210 - protein, 10 aa, Homo sapiens
  heavy chain complementarity determining region 3 for antibody 23605
ATGAGWLVDY

SEQ ID NO: 47211 - protein, 9 aa, Homo sapiens
  light chain complementarity determining region 3 for antibody 23606
QQYSSSPWT

SEQ ID NO: 47212 - protein, 13 aa, Homo sapiens
  heavy chain complementarity determining region 3 for antibody 23606
ARGSTNWRNWFDP

SEQ ID NO: 47213 - protein, 7 aa, Homo sapiens
  light chain complementarity determining region 3 for antibody 23607
QQYGSWA

SEQ ID NO: 47214 - protein, 11 aa, Homo sapiens
  heavy chain complementarity determining region 3 for antibody 23607
AVVDTTLAMPK

SEQ ID NO: 47215 - protein, 9 aa, Homo sapiens
  light chain complementarity determining region 3 for antibody 23608
QQSNRTPYT

SEQ ID NO: 47216 - protein, 14 aa, Homo sapiens
  heavy chain complementarity determining region 3 for antibody 23608
ATEGPSRMGKFFDS

SEQ ID NO: 47217 - protein, 9 aa, Homo sapiens
  light chain complementarity determining region 3 for antibody 23609
QQYGSSPPT

SEQ ID NO: 47218 - protein, 12 aa, Homo sapiens
  heavy chain complementarity determining region 3 for antibody 23609
ARGPQLWFYFDY

SEQ ID NO: 47219 - protein, 9 aa, Homo sapiens
  light chain complementarity determining region 3 for antibody 23610
VQYHATPVT

SEQ ID NO: 47220 - protein, 9 aa, Homo sapiens
  heavy chain complementarity determining region 3 for antibody 23610
ATGVDADYG

SEQ ID NO: 47221 - protein, 9 aa, Homo sapiens
  light chain complementarity determining region 3 for antibody 23611
QQYYTSVRT

SEQ ID NO: 47222 - protein, 12 aa, Homo sapiens
  heavy chain complementarity determining region 3 for antibody 23611
VKDCGLGGSRDS

SEQ ID NO: 47223 - protein, 6 aa, Homo sapiens
  light chain complementarity determining region 3 for antibody 23612
QQYGET

SEQ ID NO: 47224 - protein, 12 aa, Homo sapiens
  heavy chain complementarity determining region 3 for antibody 23612
ARDHSSGWSLSN

SEQ ID NO: 47225 - protein, 6 aa, Homo sapiens
  light chain complementarity determining region 3 for antibody 23613
QQNGRT

SEQ ID NO: 47226 - protein, 12 aa, Homo sapiens
  heavy chain complementarity determining region 3 for antibody 23613
AKLVNSWYPYDY

SEQ ID NO: 47227 - protein, 9 aa, Homo sapiens
  light chain complementarity determining region 3 for antibody 23614
QQYRRSPST

SEQ ID NO: 47228 - protein, 17 aa, Homo sapiens
  heavy chain complementarity determining region 3 for antibody 23614
AGLSSRLGDGSPSLFDY

SEQ ID NO: 47229 - protein, 10 aa, Homo sapiens
  light chain complementarity determining region 3 for antibody 23615
QQRSDWPPLT

SEQ ID NO: 47230 - protein, 10 aa, Homo sapiens
  heavy chain complementarity determining region 3 for antibody 23615
ARDYTMTFDY

SEQ ID NO: 47231 - protein, 10 aa, Homo sapiens
  light chain complementarity determining region 3 for antibody 23616
QQRSNWPPYT

SEQ ID NO: 47232 - protein, 13 aa, Homo sapiens
  heavy chain complementarity determining region 3 for antibody 23616
ARVGQQRLRGFDI

SEQ ID NO: 47233 - protein, 10 aa, Homo sapiens
  light chain complementarity determining region 3 for antibody 23617
QLYSRSPTWT

SEQ ID NO: 47234 - protein, 19 aa, Homo sapiens
  heavy chain complementarity determining region 3 for antibody 23617
ARESYYPDIGGYTPRAFDI

SEQ ID NO: 47235 - protein, 10 aa, Homo sapiens
  light chain complementarity determining region 3 for antibody 23618
QHYGISPRFT

SEQ ID NO: 47236 - protein, 12 aa, Homo sapiens
  heavy chain complementarity determining region 3 for antibody 23618
ARDVVGATASDF

SEQ ID NO: 47237 - protein, 9 aa, Homo sapiens
  light chain complementarity determining region 3 for antibody 23619
QQYGSSPQT

SEQ ID NO: 47238 - protein, 11 aa, Homo sapiens
  heavy chain complementarity determining region 3 for antibody 23619
ARGDLWSAFDI

SEQ ID NO: 47239 - protein, 9 aa, Homo sapiens
  light chain complementarity determining region 3 for antibody 23620
HQRSDWPET

SEQ ID NO: 47240 - protein, 9 aa, Homo sapiens
  heavy chain complementarity determining region 3 for antibody 23620
ASGDYAFDL

SEQ ID NO: 47241 - protein, 9 aa, Homo sapiens
  light chain complementarity determining region 3 for antibody 23621
QQYGLSPET

SEQ ID NO: 47242 - protein, 15 aa, Homo sapiens
  heavy chain complementarity determining region 3 for antibody 23621
AFRGIQVVNGVRFDY

SEQ ID NO: 47243 - protein, 9 aa, Homo sapiens
  light chain complementarity determining region 3 for antibody 23622
QQYYTSVRT

SEQ ID NO: 47244 - protein, 12 aa, Homo sapiens
  heavy chain complementarity determining region 3 for antibody 23622
VKDCGLGGSRDF

SEQ ID NO: 47245 - protein, 10 aa, Homo sapiens
  light chain complementarity determining region 3 for antibody 23623
QQYNNWPPYT

SEQ ID NO: 47246 - protein, 14 aa, Homo sapiens
  heavy chain complementarity determining region 3 for antibody 23623
ARGGRLRLFSFSDY

SEQ ID NO: 47247 - protein, 8 aa, Homo sapiens
  light chain complementarity determining region 3 for antibody 23624
QQYMSPFT

SEQ ID NO: 47248 - protein, 12 aa, Homo sapiens
  heavy chain complementarity determining region 3 for antibody 23624
ARALSASWYAFY

SEQ ID NO: 47249 - protein, 9 aa, Homo sapiens
  light chain complementarity determining region 3 for antibody 23625
LQYNDWPFI

SEQ ID NO: 47250 - protein, 9 aa, Homo sapiens
  heavy chain complementarity determining region 3 for antibody 23625
AGWFGEFYL

SEQ ID NO: 47251 - protein, 7 aa, Homo sapiens
  light chain complementarity determining region 3 for antibody 23626
LQHDNVP

SEQ ID NO: 47252 - protein, 15 aa, Homo sapiens
  heavy chain complementarity determining region 3 for antibody 23626
ARESWDGSDRSAFDI

SEQ ID NO: 47253 - protein, 9 aa, Homo sapiens
  light chain complementarity determining region 3 for antibody 23627
QQYAGAPRT

SEQ ID NO: 47254 - protein, 14 aa, Homo sapiens
  heavy chain complementarity determining region 3 for antibody 23627
TRDGDNFLWGNYHY

SEQ ID NO: 47255 - protein, 9 aa, Homo sapiens
  light chain complementarity determining region 3 for antibody 23628
QQYATSPLT

SEQ ID NO: 47256 - protein, 10 aa, Homo sapiens
  heavy chain complementarity determining region 3 for antibody 23628
TTGGGWLVDY

SEQ ID NO: 47257 - protein, 9 aa, Homo sapiens
  light chain complementarity determining region 3 for antibody 23629
LQHDNFPGT

SEQ ID NO: 47258 - protein, 20 aa, Homo sapiens
  heavy chain complementarity determining region 3 for antibody 23629
AREVYYDRSGYYYNHKWFDP

SEQ ID NO: 47259 - protein, 8 aa, Homo sapiens
  light chain complementarity determining region 3 for antibody 23630
QYYSNRPT

SEQ ID NO: 47260 - protein, 15 aa, Homo sapiens
  heavy chain complementarity determining region 3 for antibody 23630
AKEVLTRSSDWYWLD

SEQ ID NO: 47261 - protein, 9 aa, Homo sapiens
  light chain complementarity determining region 3 for antibody 23631
QQVHIYPFT

SEQ ID NO: 47262 - protein, 12 aa, Homo sapiens
  heavy chain complementarity determining region 3 for antibody 23631
ARPLDGDFGFDP

SEQ ID NO: 47263 - protein, 9 aa, Homo sapiens
  light chain complementarity determining region 3 for antibody 23632
QQYGSSPFT

SEQ ID NO: 47264 - protein, 21 aa, Homo sapiens
  heavy chain complementarity determining region 3 for antibody 23632
ARVGVERNRYGRTLPVWYFDY

SEQ ID NO: 47265 - protein, 9 aa, Homo sapiens
  light chain complementarity determining region 3 for antibody 23633
QQYGNIPRT

SEQ ID NO: 47266 - protein, 14 aa, Homo sapiens
  heavy chain complementarity determining region 3 for antibody 23633
AGGTFDSSGYYYEY

SEQ ID NO: 47267 - protein, 10 aa, Homo sapiens
  light chain complementarity determining region 3 for antibody 23634
QQRTDRPPYP

SEQ ID NO: 47268 - protein, 15 aa, Homo sapiens
  heavy chain complementarity determining region 3 for antibody 23634
ARLMGDWELPRGTDY

SEQ ID NO: 47269 - protein, 9 aa, Homo sapiens
  light chain complementarity determining region 3 for antibody 23635
LQVVSFPRT

SEQ ID NO: 47270 - protein, 8 aa, Homo sapiens
  heavy chain complementarity determining region 3 for antibody 23635
ARNSGWYD

SEQ ID NO: 47271 - protein, 9 aa, Homo sapiens
  light chain complementarity determining region 3 for antibody 23636
LQYNNYPYT

SEQ ID NO: 47272 - protein, 9 aa, Homo sapiens
  heavy chain complementarity determining region 3 for antibody 23636
GRGVRSFNP

SEQ ID NO: 47273 - protein, 8 aa, Homo sapiens
  light chain complementarity determining region 3 for antibody 23637
LQHDNFPF

SEQ ID NO: 47274 - protein, 16 aa, Homo sapiens
  heavy chain complementarity determining region 3 for antibody 23637
ARHSLGLEWEFQWGAY

SEQ ID NO: 47275 - protein, 9 aa, Homo sapiens
  light chain complementarity determining region 3 for antibody 23638
HQSGALPWT

SEQ ID NO: 47276 - protein, 14 aa, Homo sapiens
  heavy chain complementarity determining region 3 for antibody 23638
VRDASGNSGWYADS

SEQ ID NO: 47277 - protein, 9 aa, Homo sapiens
  light chain complementarity determining region 3 for antibody 23639
QQYESSLWT

SEQ ID NO: 47278 - protein, 12 aa, Homo sapiens
  heavy chain complementarity determining region 3 for antibody 23639
ARDFGLYQEPDS

SEQ ID NO: 47279 - protein, 8 aa, Homo sapiens
  light chain complementarity determining region 3 for antibody 23640
QQYNTYAT

SEQ ID NO: 47280 - protein, 17 aa, Homo sapiens
  heavy chain complementarity determining region 3 for antibody 23640
AHRLDHNGMWNEGIFDH

SEQ ID NO: 47281 - protein, 9 aa, Homo sapiens
  light chain complementarity determining region 3 for antibody 23641
QQRHNWPWT

SEQ ID NO: 47282 - protein, 17 aa, Homo sapiens
  heavy chain complementarity determining region 3 for antibody 23641
VVPQFSRTDWPTEPSDY

SEQ ID NO: 47283 - protein, 9 aa, Homo sapiens
  light chain complementarity determining region 3 for antibody 23642
QQYGSSPYT

SEQ ID NO: 47284 - protein, 9 aa, Homo sapiens
  heavy chain complementarity determining region 3 for antibody 23642
ARETEGFDI

SEQ ID NO: 47285 - protein, 9 aa, Homo sapiens
  light chain complementarity determining region 3 for antibody 23643
QQYNTWPRT

SEQ ID NO: 47286 - protein, 22 aa, Homo sapiens
  heavy chain complementarity determining region 3 for antibody 23643
AREVRASGYDDFYNYYYYGLDV

SEQ ID NO: 47287 - protein, 9 aa, Homo sapiens
  light chain complementarity determining region 3 for antibody 23644
QQYNDYRYT

SEQ ID NO: 47288 - protein, 14 aa, Homo sapiens
  heavy chain complementarity determining region 3 for antibody 23644
TRLFSSASRRVFDP

SEQ ID NO: 47289 - protein, 9 aa, Homo sapiens
  light chain complementarity determining region 3 for antibody 23645
QQYGSSPRT

SEQ ID NO: 47290 - protein, 15 aa, Homo sapiens
  heavy chain complementarity determining region 3 for antibody 23645
ARANGVIITTGVLRY

SEQ ID NO: 47291 - protein, 9 aa, Homo sapiens
  light chain complementarity determining region 3 for antibody 23646
QQYVKSPWT

SEQ ID NO: 47292 - protein, 11 aa, Homo sapiens
  heavy chain complementarity determining region 3 for antibody 23646
AREDWPDGFDI

SEQ ID NO: 47293 - protein, 9 aa, Homo sapiens
  light chain complementarity determining region 3 for antibody 23647
QQYGSSPPT

SEQ ID NO: 47294 - protein, 17 aa, Homo sapiens
  heavy chain complementarity determining region 3 for antibody 23647
ARPYFGPVRAGTNGYDM

SEQ ID NO: 47295 - protein, 9 aa, Homo sapiens
  light chain complementarity determining region 3 for antibody 23648
LQRTHWPPG

SEQ ID NO: 47296 - protein, 18 aa, Homo sapiens
  heavy chain complementarity determining region 3 for antibody 23648
ARDRYSCDSGGCFHWFDP

SEQ ID NO: 47297 - protein, 8 aa, Homo sapiens
  light chain complementarity determining region 3 for antibody 23649
MQALQTPT

SEQ ID NO: 47298 - protein, 9 aa, Homo sapiens
  heavy chain complementarity determining region 3 for antibody 23649
ARDSSAFGP

SEQ ID NO: 47299 - protein, 9 aa, Homo sapiens
  light chain complementarity determining region 3 for antibody 23650
QQYVTYPIT

SEQ ID NO: 47300 - protein, 13 aa, Homo sapiens
  heavy chain complementarity determining region 3 for antibody 23650
GRGGYTSSWYWVY

SEQ ID NO: 47301 - protein, 10 aa, Homo sapiens
  light chain complementarity determining region 3 for antibody 23651
QQYGDSPDVT

SEQ ID NO: 47302 - protein, 16 aa, Homo sapiens
  heavy chain complementarity determining region 3 for antibody 23651
ARDATFWFGEFTFFDH

SEQ ID NO: 47303 - protein, 9 aa, Homo sapiens
  light chain complementarity determining region 3 for antibody 23652
QHYISYSYT

SEQ ID NO: 47304 - protein, 18 aa, Homo sapiens
  heavy chain complementarity determining region 3 for antibody 23652
ARDRYSCDSGGCFHWFDP

SEQ ID NO: 47305 - protein, 9 aa, Homo sapiens
  light chain complementarity determining region 3 for antibody 23653
QQYGSSPYT

SEQ ID NO: 47306 - protein, 17 aa, Homo sapiens
  heavy chain complementarity determining region 3 for antibody 23653
ARGTGYNYGYGGVHFDY

SEQ ID NO: 47307 - protein, 10 aa, Homo sapiens
  light chain complementarity determining region 3 for antibody 23654
QQRYNWPPYT

SEQ ID NO: 47308 - protein, 15 aa, Homo sapiens
  heavy chain complementarity determining region 3 for antibody 23654
AREGSGYPAATGFDI

SEQ ID NO: 47309 - protein, 9 aa, Homo sapiens
  light chain complementarity determining region 3 for antibody 23655
QQYYRTPYT

SEQ ID NO: 47310 - protein, 15 aa, Homo sapiens
  heavy chain complementarity determining region 3 for antibody 23655
ARVGVDPNYYYGLDV

SEQ ID NO: 47311 - protein, 10 aa, Homo sapiens
  light chain complementarity determining region 3 for antibody 23656
QQYNNWLGWT

SEQ ID NO: 47312 - protein, 13 aa, Homo sapiens
  heavy chain complementarity determining region 3 for antibody 23656
ARHGRRSGWYYTY

SEQ ID NO: 47313 - protein, 9 aa, Homo sapiens
  light chain complementarity determining region 3 for antibody 23657
QQYGSIPRT

SEQ ID NO: 47314 - protein, 14 aa, Homo sapiens
  heavy chain complementarity determining region 3 for antibody 23657
AGGKFCGGDCYREY

SEQ ID NO: 47315 - protein, 8 aa, Homo sapiens
  light chain complementarity determining region 3 for antibody 23658
QQYDYLPA

SEQ ID NO: 47316 - protein, 12 aa, Homo sapiens
  heavy chain complementarity determining region 3 for antibody 23658
ARSNWNIIAFDL

SEQ ID NO: 47317 - protein, 9 aa, Homo sapiens
  light chain complementarity determining region 3 for antibody 23659
QQYDNSPPT

SEQ ID NO: 47318 - protein, 19 aa, Homo sapiens
  heavy chain complementarity determining region 3 for antibody 23659
ARDHFPLARGVVSYFYYNY

SEQ ID NO: 47319 - protein, 9 aa, Homo sapiens
  light chain complementarity determining region 3 for antibody 23660
LQYDISPRT

SEQ ID NO: 47320 - protein, 12 aa, Homo sapiens
  heavy chain complementarity determining region 3 for antibody 23660
TTMYGFLHSIDY

SEQ ID NO: 47321 - protein, 9 aa, Homo sapiens
  light chain complementarity determining region 3 for antibody 23661
MQVLQTPLT

SEQ ID NO: 47322 - protein, 12 aa, Homo sapiens
  heavy chain complementarity determining region 3 for antibody 23661
VKDSDKKWELLD

SEQ ID NO: 47323 - protein, 8 aa, Homo sapiens
  light chain complementarity determining region 3 for antibody 23662
HQYGTSIT

SEQ ID NO: 47324 - protein, 16 aa, Homo sapiens
  heavy chain complementarity determining region 3 for antibody 23662
AHSRYGSNIYPVPFDN

SEQ ID NO: 47325 - protein, 9 aa, Homo sapiens
  light chain complementarity determining region 3 for antibody 23663
QQRSNWPWT

SEQ ID NO: 47326 - protein, 14 aa, Homo sapiens
  heavy chain complementarity determining region 3 for antibody 23663
AVTHYYDSSTIGDY

SEQ ID NO: 47327 - protein, 9 aa, Homo sapiens
  light chain complementarity determining region 3 for antibody 23664
HQSRTFPVT

SEQ ID NO: 47328 - protein, 14 aa, Homo sapiens
  heavy chain complementarity determining region 3 for antibody 23664
IRQSKSDNWNYPDY

SEQ ID NO: 47329 - protein, 9 aa, Homo sapiens
  light chain complementarity determining region 3 for antibody 23665
QQYGNLPRT

SEQ ID NO: 47330 - protein, 13 aa, Homo sapiens
  heavy chain complementarity determining region 3 for antibody 23665
AGGNYETGRYEEY

SEQ ID NO: 47331 - protein, 9 aa, Homo sapiens
  light chain complementarity determining region 3 for antibody 23666
QQVNRFPLT

SEQ ID NO: 47332 - protein, 14 aa, Homo sapiens
  heavy chain complementarity determining region 3 for antibody 23666
TTDSPLRRYNYFVY

SEQ ID NO: 47333 - protein, 9 aa, Homo sapiens
  light chain complementarity determining region 3 for antibody 23667
QQSHSPPLT

SEQ ID NO: 47334 - protein, 14 aa, Homo sapiens
  heavy chain complementarity determining region 3 for antibody 23667
ARDSQWLVQYGMDV

SEQ ID NO: 47335 - protein, 9 aa, Homo sapiens
  light chain complementarity determining region 3 for antibody 23668
QQYDLFRET

SEQ ID NO: 47336 - protein, 16 aa, Homo sapiens
  heavy chain complementarity determining region 3 for antibody 23668
ARWGVECSGGYCYFEY

SEQ ID NO: 47337 - protein, 9 aa, Homo sapiens
  light chain complementarity determining region 3 for antibody 23669
QQYDAQSWT

SEQ ID NO: 47338 - protein, 11 aa, Homo sapiens
  heavy chain complementarity determining region 3 for antibody 23669
ARGWRDNSFDY

SEQ ID NO: 47339 - protein, 9 aa, Homo sapiens
  light chain complementarity determining region 3 for antibody 23670
QQSYSTPFT

SEQ ID NO: 47340 - protein, 15 aa, Homo sapiens
  heavy chain complementarity determining region 3 for antibody 23670
SRDADYGDYVGFLDY

SEQ ID NO: 47341 - protein, 9 aa, Homo sapiens
  light chain complementarity determining region 3 for antibody 23671
QKYNSVPLT

SEQ ID NO: 47342 - protein, 14 aa, Homo sapiens
  heavy chain complementarity determining region 3 for antibody 23671
ARPQTWDLLYAFDM

SEQ ID NO: 47343 - protein, 9 aa, Homo sapiens
  light chain complementarity determining region 3 for antibody 23672
QQYDSSPFT

SEQ ID NO: 47344 - protein, 17 aa, Homo sapiens
  heavy chain complementarity determining region 3 for antibody 23672
ARDRGSSWYSGAEHFQY

SEQ ID NO: 47345 - protein, 9 aa, Homo sapiens
  light chain complementarity determining region 3 for antibody 23673
QQLNTYPIT

SEQ ID NO: 47346 - protein, 19 aa, Homo sapiens
  heavy chain complementarity determining region 3 for antibody 23673
ARDVIRNCGSDCYFWYFDL

SEQ ID NO: 47347 - protein, 9 aa, Homo sapiens
  light chain complementarity determining region 3 for antibody 23674
QQYGDSPLT

SEQ ID NO: 47348 - protein, 15 aa, Homo sapiens
  heavy chain complementarity determining region 3 for antibody 23674
AKGRRGSYSHDAFDV

SEQ ID NO: 47349 - protein, 9 aa, Homo sapiens
  light chain complementarity determining region 3 for antibody 23675
QQYDNLPPT

SEQ ID NO: 47350 - protein, 17 aa, Homo sapiens
  heavy chain complementarity determining region 3 for antibody 23675
GYSYGSRESYYYYGMDV

SEQ ID NO: 47351 - protein, 9 aa, Homo sapiens
  light chain complementarity determining region 3 for antibody 23676
QQYGNSPWT

SEQ ID NO: 47352 - protein, 17 aa, Homo sapiens
  heavy chain complementarity determining region 3 for antibody 23676
ALASVAAPGRIQWYFDL

SEQ ID NO: 47353 - protein, 9 aa, Homo sapiens
  light chain complementarity determining region 3 for antibody 23677
QQRSSWPLT

SEQ ID NO: 47354 - protein, 17 aa, Homo sapiens
  heavy chain complementarity determining region 3 for antibody 23677
ARAGEYHDFWSAYYFDF

SEQ ID NO: 47355 - protein, 6 aa, Homo sapiens
  light chain complementarity determining region 3 for antibody 23678
QQLNSL

SEQ ID NO: 47356 - protein, 9 aa, Homo sapiens
  heavy chain complementarity determining region 3 for antibody 23678
DADGGDRVY

SEQ ID NO: 47357 - protein, 10 aa, Homo sapiens
  light chain complementarity determining region 3 for antibody 23679
QQRSNWPPWT

SEQ ID NO: 47358 - protein, 13 aa, Homo sapiens
  heavy chain complementarity determining region 3 for antibody 23679
AREAFPPGGGLDY

SEQ ID NO: 47359 - protein, 9 aa, Homo sapiens
  light chain complementarity determining region 3 for antibody 23680
HQYATSPWT

SEQ ID NO: 47360 - protein, 14 aa, Homo sapiens
  heavy chain complementarity determining region 3 for antibody 23680
ARFGWLDYYYGMDV

SEQ ID NO: 47361 - protein, 9 aa, Homo sapiens
  light chain complementarity determining region 3 for antibody 23681
QQGSTYPLT

SEQ ID NO: 47362 - protein, 20 aa, Homo sapiens
  heavy chain complementarity determining region 3 for antibody 23681
ARYPRREHNPGTTGYYSFDY

SEQ ID NO: 47363 - protein, 9 aa, Homo sapiens
  light chain complementarity determining region 3 for antibody 23682
MQVLQTPLT

SEQ ID NO: 47364 - protein, 12 aa, Homo sapiens
  heavy chain complementarity determining region 3 for antibody 23682
AKDSEQKWELHD

SEQ ID NO: 47365 - protein, 8 aa, Homo sapiens
  light chain complementarity determining region 3 for antibody 23683
HQYGSSFT

SEQ ID NO: 47366 - protein, 16 aa, Homo sapiens
  heavy chain complementarity determining region 3 for antibody 23683
AHSRYSSNIYPVPFDN

SEQ ID NO: 47367 - protein, 9 aa, Homo sapiens
  light chain complementarity determining region 3 for antibody 23684
QQYGSSPTT

SEQ ID NO: 47368 - protein, 17 aa, Homo sapiens
  heavy chain complementarity determining region 3 for antibody 23684
ARLGGSGWNRGHNWFDP

SEQ ID NO: 47369 - protein, 9 aa, Homo sapiens
  light chain complementarity determining region 3 for antibody 23685
QQYDSSSYT

SEQ ID NO: 47370 - protein, 11 aa, Homo sapiens
  heavy chain complementarity determining region 3 for antibody 23685
ARGGFYGSFDF

SEQ ID NO: 47371 - protein, 6 aa, Homo sapiens
  light chain complementarity determining region 3 for antibody 23686
QQYGMT

SEQ ID NO: 47372 - protein, 12 aa, Homo sapiens
  heavy chain complementarity determining region 3 for antibody 23686
ARFANSWYPYDF

SEQ ID NO: 47373 - protein, 9 aa, Homo sapiens
  light chain complementarity determining region 3 for antibody 23687
QQAYSFPFT

SEQ ID NO: 47374 - protein, 15 aa, Homo sapiens
  heavy chain complementarity determining region 3 for antibody 23687
ARVLLEGQLGRALDY

SEQ ID NO: 47375 - protein, 9 aa, Homo sapiens
  light chain complementarity determining region 3 for antibody 23688
QHFGGSPLT

SEQ ID NO: 47376 - protein, 11 aa, Homo sapiens
  heavy chain complementarity determining region 3 for antibody 23688
ARKGTGAPFDY

SEQ ID NO: 47377 - protein, 11 aa, Homo sapiens
  light chain complementarity determining region 3 for antibody 23689
QQRTSWPPKYT

SEQ ID NO: 47378 - protein, 14 aa, Homo sapiens
  heavy chain complementarity determining region 3 for antibody 23689
ARTVLDTAADAFDF

SEQ ID NO: 47379 - protein, 9 aa, Homo sapiens
  light chain complementarity determining region 3 for antibody 23690
QQLNSYPYT

SEQ ID NO: 47380 - protein, 12 aa, Homo sapiens
  heavy chain complementarity determining region 3 for antibody 23690
AIWGGAKGGLPY

SEQ ID NO: 47381 - protein, 8 aa, Homo sapiens
  light chain complementarity determining region 3 for antibody 23691
QQFGSSLT

SEQ ID NO: 47382 - protein, 15 aa, Homo sapiens
  heavy chain complementarity determining region 3 for antibody 23691
ARLRDTTLGRWYFDS

SEQ ID NO: 47383 - protein, 7 aa, Homo sapiens
  light chain complementarity determining region 3 for antibody 23692
QHYQTWT

SEQ ID NO: 47384 - protein, 17 aa, Homo sapiens
  heavy chain complementarity determining region 3 for antibody 23692
ARAFLHDSSDRSGYIDY

SEQ ID NO: 47385 - protein, 9 aa, Homo sapiens
  light chain complementarity determining region 3 for antibody 23693
MQALETPFT

SEQ ID NO: 47386 - protein, 15 aa, Homo sapiens
  heavy chain complementarity determining region 3 for antibody 23693
VRHYRELATGIEGDS

SEQ ID NO: 47387 - protein, 9 aa, Homo sapiens
  light chain complementarity determining region 3 for antibody 23694
QQYGRSPRT

SEQ ID NO: 47388 - protein, 15 aa, Homo sapiens
  heavy chain complementarity determining region 3 for antibody 23694
AKDGEFCGSNCYFGS

SEQ ID NO: 47389 - protein, 9 aa, Homo sapiens
  light chain complementarity determining region 3 for antibody 23695
QQYDLLPPT

SEQ ID NO: 47390 - protein, 21 aa, Homo sapiens
  heavy chain complementarity determining region 3 for antibody 23695
ARGLHVVVVTSILRGFWYFGL

SEQ ID NO: 47391 - protein, 9 aa, Homo sapiens
  light chain complementarity determining region 3 for antibody 23696
QQVKDYPIT

SEQ ID NO: 47392 - protein, 16 aa, Homo sapiens
  heavy chain complementarity determining region 3 for antibody 23696
ARVVHKSLLTQPPNDY

SEQ ID NO: 47393 - protein, 9 aa, Homo sapiens
  light chain complementarity determining region 3 for antibody 23697
QQTYSTPLT

SEQ ID NO: 47394 - protein, 18 aa, Homo sapiens
  heavy chain complementarity determining region 3 for antibody 23697
ARSGRRDSSGFLVNWFDY

SEQ ID NO: 47395 - protein, 9 aa, Homo sapiens
  light chain complementarity determining region 3 for antibody 23698
QQYGNSPFT

SEQ ID NO: 47396 - protein, 15 aa, Homo sapiens
  heavy chain complementarity determining region 3 for antibody 23698
ARQKGQRASAGYFDS

SEQ ID NO: 47397 - protein, 9 aa, Homo sapiens
  light chain complementarity determining region 3 for antibody 23699
HHYGSSPRP

SEQ ID NO: 47398 - protein, 18 aa, Homo sapiens
  heavy chain complementarity determining region 3 for antibody 23699
AREVPDKRGSNSNPYADV

SEQ ID NO: 47399 - protein, 9 aa, Homo sapiens
  light chain complementarity determining region 3 for antibody 23700
HHTSTFPRT

SEQ ID NO: 47400 - protein, 20 aa, Homo sapiens
  heavy chain complementarity determining region 3 for antibody 23700
ARGRRIAALSTAHYYYGMDV

SEQ ID NO: 47401 - protein, 9 aa, Homo sapiens
  light chain complementarity determining region 3 for antibody 23701
QQRFKWPPT

SEQ ID NO: 47402 - protein, 19 aa, Homo sapiens
  heavy chain complementarity determining region 3 for antibody 23701
AREVSSADHYGVGKNWFDP

SEQ ID NO: 47403 - protein, 9 aa, Homo sapiens
  light chain complementarity determining region 3 for antibody 23702
LQHNSFPWT

SEQ ID NO: 47404 - protein, 11 aa, Homo sapiens
  heavy chain complementarity determining region 3 for antibody 23702
VRDVPTAHLDY

SEQ ID NO: 47405 - protein, 9 aa, Homo sapiens
  light chain complementarity determining region 3 for antibody 23703
QQYGGSTGT

SEQ ID NO: 47406 - protein, 15 aa, Homo sapiens
  heavy chain complementarity determining region 3 for antibody 23703
ARGGRGPGMAHCFDL

SEQ ID NO: 47407 - protein, 10 aa, Homo sapiens
  light chain complementarity determining region 3 for antibody 23704
QHYDGYSPWT

SEQ ID NO: 47408 - protein, 12 aa, Homo sapiens
  heavy chain complementarity determining region 3 for antibody 23704
AKVYSSSWYFDY

SEQ ID NO: 47409 - protein, 10 aa, Homo sapiens
  light chain complementarity determining region 3 for antibody 23705
QESYSTLSTT

SEQ ID NO: 47410 - protein, 16 aa, Homo sapiens
  heavy chain complementarity determining region 3 for antibody 23705
AKAKNSVTFGGVIIDH

SEQ ID NO: 47411 - protein, 9 aa, Homo sapiens
  light chain complementarity determining region 3 for antibody 23706
QQGDSIPYT

SEQ ID NO: 47412 - protein, 14 aa, Homo sapiens
  heavy chain complementarity determining region 3 for antibody 23706
GTDPAPDKPDYIDY

SEQ ID NO: 47413 - protein, 9 aa, Homo sapiens
  light chain complementarity determining region 3 for antibody 23707
QQLNSYPYT

SEQ ID NO: 47414 - protein, 12 aa, Homo sapiens
  heavy chain complementarity determining region 3 for antibody 23707
AIWAGAKGGLPY

SEQ ID NO: 47415 - protein, 9 aa, Homo sapiens
  light chain complementarity determining region 3 for antibody 23708
LQHNSYPLT

SEQ ID NO: 47416 - protein, 13 aa, Homo sapiens
  heavy chain complementarity determining region 3 for antibody 23708
VRHAVVRPMVVDD

SEQ ID NO: 47417 - protein, 10 aa, Homo sapiens
  light chain complementarity determining region 3 for antibody 23709
QQYGNPTQIT

SEQ ID NO: 47418 - protein, 16 aa, Homo sapiens
  heavy chain complementarity determining region 3 for antibody 23709
TREIRGVIKPEEDFDY

SEQ ID NO: 47419 - protein, 8 aa, Homo sapiens
  light chain complementarity determining region 3 for antibody 23710
QQSYSTPT

SEQ ID NO: 47420 - protein, 17 aa, Homo sapiens
  heavy chain complementarity determining region 3 for antibody 23710
ARDSRGYNYSPGYAFDI

SEQ ID NO: 47421 - protein, 11 aa, Homo sapiens
  light chain complementarity determining region 3 for antibody 23711
QQRTNWPPIYT

SEQ ID NO: 47422 - protein, 14 aa, Homo sapiens
  heavy chain complementarity determining region 3 for antibody 23711
ARGGLGIWGNSSDI

SEQ ID NO: 47423 - protein, 8 aa, Homo sapiens
  light chain complementarity determining region 3 for antibody 23712
QHYDITWT

SEQ ID NO: 47424 - protein, 10 aa, Homo sapiens
  heavy chain complementarity determining region 3 for antibody 23712
AKTTDWYGHY

SEQ ID NO: 47425 - protein, 9 aa, Homo sapiens
  light chain complementarity determining region 3 for antibody 23713
QQYGDFPLT

SEQ ID NO: 47426 - protein, 13 aa, Homo sapiens
  heavy chain complementarity determining region 3 for antibody 23713
ARDANWFGSGIPD

SEQ ID NO: 47427 - protein, 10 aa, Homo sapiens
  light chain complementarity determining region 3 for antibody 23714
QHFDNLPMFT

SEQ ID NO: 47428 - protein, 16 aa, Homo sapiens
  heavy chain complementarity determining region 3 for antibody 23714
ARVPRGSYASGTLFDY

SEQ ID NO: 47429 - protein, 9 aa, Homo sapiens
  light chain complementarity determining region 3 for antibody 23715
LQHNSFPRT

SEQ ID NO: 47430 - protein, 16 aa, Homo sapiens
  heavy chain complementarity determining region 3 for antibody 23715
ARPGLPSSYGSSSYRH

SEQ ID NO: 47431 - protein, 9 aa, Homo sapiens
  light chain complementarity determining region 3 for antibody 23716
QQYGTAPVT

SEQ ID NO: 47432 - protein, 14 aa, Homo sapiens
  heavy chain complementarity determining region 3 for antibody 23716
ARDLFRGIPDYLDY

SEQ ID NO: 47433 - protein, 9 aa, Homo sapiens
  light chain complementarity determining region 3 for antibody 23717
QQYGSSPRT

SEQ ID NO: 47434 - protein, 14 aa, Homo sapiens
  heavy chain complementarity determining region 3 for antibody 23717
ATGFFDSSRYYLEY

SEQ ID NO: 47435 - protein, 9 aa, Homo sapiens
  light chain complementarity determining region 3 for antibody 23718
QQLNSYPLT

SEQ ID NO: 47436 - protein, 15 aa, Homo sapiens
  heavy chain complementarity determining region 3 for antibody 23718
AREFYGSGSYYLIDY

SEQ ID NO: 47437 - protein, 9 aa, Homo sapiens
  light chain complementarity determining region 3 for antibody 23719
QQFKDYPLT

SEQ ID NO: 47438 - protein, 10 aa, Homo sapiens
  heavy chain complementarity determining region 3 for antibody 23719
ARDPYGRGGY

SEQ ID NO: 47439 - protein, 9 aa, Homo sapiens
  light chain complementarity determining region 3 for antibody 23720
QQSFNNPPT

SEQ ID NO: 47440 - protein, 18 aa, Homo sapiens
  heavy chain complementarity determining region 3 for antibody 23720
VREMDVAVHRVMFNIFDS

SEQ ID NO: 47441 - protein, 9 aa, Homo sapiens
  light chain complementarity determining region 3 for antibody 23721
QQANSFPQT

SEQ ID NO: 47442 - protein, 15 aa, Homo sapiens
  heavy chain complementarity determining region 3 for antibody 23721
ARGGYGGSLYWYFDL

SEQ ID NO: 47443 - protein, 9 aa, Homo sapiens
  light chain complementarity determining region 3 for antibody 23722
QQYGRSPLT

SEQ ID NO: 47444 - protein, 11 aa, Homo sapiens
  heavy chain complementarity determining region 3 for antibody 23722
AREGNYKPHDY

SEQ ID NO: 47445 - protein, 9 aa, Homo sapiens
  light chain complementarity determining region 3 for antibody 23723
QQTFSSPPT

SEQ ID NO: 47446 - protein, 16 aa, Homo sapiens
  heavy chain complementarity determining region 3 for antibody 23723
VTYRDTVTASGYGLDD

SEQ ID NO: 47447 - protein, 9 aa, Homo sapiens
  light chain complementarity determining region 3 for antibody 23724
QQGNRFPHT

SEQ ID NO: 47448 - protein, 14 aa, Homo sapiens
  heavy chain complementarity determining region 3 for antibody 23724
ARYCSGTRCYSMDY

SEQ ID NO: 47449 - protein, 10 aa, Homo sapiens
  light chain complementarity determining region 3 for antibody 23725
MQGSYWPPWT

SEQ ID NO: 47450 - protein, 11 aa, Homo sapiens
  heavy chain complementarity determining region 3 for antibody 23725
ARDTPGIGIDY

SEQ ID NO: 47451 - protein, 9 aa, Homo sapiens
  light chain complementarity determining region 3 for antibody 23726
QQSAGPPLT

SEQ ID NO: 47452 - protein, 14 aa, Homo sapiens
  heavy chain complementarity determining region 3 for antibody 23726
ARDSQWLVQYGMDV

SEQ ID NO: 47453 - protein, 10 aa, Homo sapiens
  light chain complementarity determining region 3 for antibody 23727
QQRSNWPPIT

SEQ ID NO: 47454 - protein, 17 aa, Homo sapiens
  heavy chain complementarity determining region 3 for antibody 23727
AAGYHSGSLSADDVFDM

SEQ ID NO: 47455 - protein, 8 aa, Homo sapiens
  light chain complementarity determining region 3 for antibody 23728
QQRHTRLS

SEQ ID NO: 47456 - protein, 11 aa, Homo sapiens
  heavy chain complementarity determining region 3 for antibody 23728
ASGSMGWVFDH

SEQ ID NO: 47457 - protein, 9 aa, Homo sapiens
  light chain complementarity determining region 3 for antibody 23729
QQYSDWPPF

SEQ ID NO: 47458 - protein, 20 aa, Homo sapiens
  heavy chain complementarity determining region 3 for antibody 23729
AREGGQGPTANGWFGGGADY

SEQ ID NO: 47459 - protein, 9 aa, Homo sapiens
  light chain complementarity determining region 3 for antibody 23730
QQYNNWPPT

SEQ ID NO: 47460 - protein, 12 aa, Homo sapiens
  heavy chain complementarity determining region 3 for antibody 23730
ARTLVQALIWDY

SEQ ID NO: 47461 - protein, 9 aa, Homo sapiens
  light chain complementarity determining region 3 for antibody 23731
MQGTPWPHT

SEQ ID NO: 47462 - protein, 11 aa, Homo sapiens
  heavy chain complementarity determining region 3 for antibody 23731
ARDPGWGARDY

SEQ ID NO: 47463 - protein, 8 aa, Homo sapiens
  light chain complementarity determining region 3 for antibody 23732
QQYGTSRT

SEQ ID NO: 47464 - protein, 15 aa, Homo sapiens
  heavy chain complementarity determining region 3 for antibody 23732
ARGEFYRDSRGYRED

SEQ ID NO: 47465 - protein, 9 aa, Homo sapiens
  light chain complementarity determining region 3 for antibody 23733
QQYGSSWWT

SEQ ID NO: 47466 - protein, 15 aa, Homo sapiens
  heavy chain complementarity determining region 3 for antibody 23733
ARHVARDDIGYYHDL

SEQ ID NO: 47467 - protein, 10 aa, Homo sapiens
  light chain complementarity determining region 3 for antibody 23734
QQSYTTPLKT

SEQ ID NO: 47468 - protein, 14 aa, Homo sapiens
  heavy chain complementarity determining region 3 for antibody 23734
ARDRKTRLGDNLDI

SEQ ID NO: 47469 - protein, 9 aa, Homo sapiens
  light chain complementarity determining region 3 for antibody 23735
QQSYSFPRT

SEQ ID NO: 47470 - protein, 22 aa, Homo sapiens
  heavy chain complementarity determining region 3 for antibody 23735
AREMIKLRVAADGSQRDYIMDV

SEQ ID NO: 47471 - protein, 10 aa, Homo sapiens
  light chain complementarity determining region 3 for antibody 23736
QQTYSTPPYT

SEQ ID NO: 47472 - protein, 19 aa, Homo sapiens
  heavy chain complementarity determining region 3 for antibody 23736
AKDRDSSGWDNYYYYGMDV

SEQ ID NO: 47473 - protein, 9 aa, Homo sapiens
  light chain complementarity determining region 3 for antibody 23737
QHYASSPRT

SEQ ID NO: 47474 - protein, 12 aa, Homo sapiens
  heavy chain complementarity determining region 3 for antibody 23737
TTKRGYIYGAEY

SEQ ID NO: 47475 - protein, 9 aa, Homo sapiens
  light chain complementarity determining region 3 for antibody 23738
MQSRRWPHT

SEQ ID NO: 47476 - protein, 8 aa, Homo sapiens
  heavy chain complementarity determining region 3 for antibody 23738
TAWGSSHH

SEQ ID NO: 47477 - protein, 9 aa, Homo sapiens
  light chain complementarity determining region 3 for antibody 23739
HQYGDTPRT

SEQ ID NO: 47478 - protein, 16 aa, Homo sapiens
  heavy chain complementarity determining region 3 for antibody 23739
AGLSASGHLAPNTFDV

SEQ ID NO: 47479 - protein, 9 aa, Homo sapiens
  light chain complementarity determining region 3 for antibody 23740
QQYNNWPYT

SEQ ID NO: 47480 - protein, 12 aa, Homo sapiens
  heavy chain complementarity determining region 3 for antibody 23740
PQIPVGRDAFDI

SEQ ID NO: 47481 - protein, 9 aa, Homo sapiens
  light chain complementarity determining region 3 for antibody 23741
QQYGSSPRT

SEQ ID NO: 47482 - protein, 13 aa, Homo sapiens
  heavy chain complementarity determining region 3 for antibody 23741
ARGKYESSGYKEN

SEQ ID NO: 47483 - protein, 8 aa, Homo sapiens
  light chain complementarity determining region 3 for antibody 23742
QQYGGSPS

SEQ ID NO: 47484 - protein, 16 aa, Homo sapiens
  heavy chain complementarity determining region 3 for antibody 23742
ATDWGSGTQWIRAFDV

SEQ ID NO: 47485 - protein, 9 aa, Homo sapiens
  light chain complementarity determining region 3 for antibody 23743
QQYFSHVYT

SEQ ID NO: 47486 - protein, 18 aa, Homo sapiens
  heavy chain complementarity determining region 3 for antibody 23743
AQERDGYCDSHACYGLDV

SEQ ID NO: 47487 - protein, 8 aa, Homo sapiens
  light chain complementarity determining region 3 for antibody 23744
QQVNSYPR

SEQ ID NO: 47488 - protein, 20 aa, Homo sapiens
  heavy chain complementarity determining region 3 for antibody 23744
ARDGAVIAPRTRGPGFYFDS

SEQ ID NO: 47489 - protein, 9 aa, Homo sapiens
  light chain complementarity determining region 3 for antibody 23745
QNCGSYPLT

SEQ ID NO: 47490 - protein, 11 aa, Homo sapiens
  heavy chain complementarity determining region 3 for antibody 23745
ARRGSNLHADY

SEQ ID NO: 47491 - protein, 8 aa, Homo sapiens
  light chain complementarity determining region 3 for antibody 23746
QKYGSSPL

SEQ ID NO: 47492 - protein, 14 aa, Homo sapiens
  heavy chain complementarity determining region 3 for antibody 23746
ARDMWDVGDTPPSY

SEQ ID NO: 47493 - protein, 9 aa, Homo sapiens
  light chain complementarity determining region 3 for antibody 23747
QHRSYWPWT

SEQ ID NO: 47494 - protein, 17 aa, Homo sapiens
  heavy chain complementarity determining region 3 for antibody 23747
GREYYDARSGSGNWFDP

SEQ ID NO: 47495 - protein, 9 aa, Homo sapiens
  light chain complementarity determining region 3 for antibody 23748
LQDYNYPWT

SEQ ID NO: 47496 - protein, 14 aa, Homo sapiens
  heavy chain complementarity determining region 3 for antibody 23748
ARVGGFHGSWSLDY

SEQ ID NO: 47497 - protein, 8 aa, Homo sapiens
  light chain complementarity determining region 3 for antibody 23749
QQYTDLFT

SEQ ID NO: 47498 - protein, 12 aa, Homo sapiens
  heavy chain complementarity determining region 3 for antibody 23749
ARYVSHWGKFDH

SEQ ID NO: 47499 - protein, 9 aa, Homo sapiens
  light chain complementarity determining region 3 for antibody 23750
QQRSNWPLT

SEQ ID NO: 47500 - protein, 19 aa, Homo sapiens
  heavy chain complementarity determining region 3 for antibody 23750
AKTVSTTQADTAIIRGGDY

SEQ ID NO: 47501 - protein, 9 aa, Homo sapiens
  light chain complementarity determining region 3 for antibody 23751
QQAHSFPRT

SEQ ID NO: 47502 - protein, 13 aa, Homo sapiens
  heavy chain complementarity determining region 3 for antibody 23751
ARDLRVGRNGLDV

SEQ ID NO: 47503 - protein, 9 aa, Homo sapiens
  light chain complementarity determining region 3 for antibody 23752
QQYGSSPRT

SEQ ID NO: 47504 - protein, 15 aa, Homo sapiens
  heavy chain complementarity determining region 3 for antibody 23752
AKDGPYCGSDCYFEF

SEQ ID NO: 47505 - protein, 9 aa, Homo sapiens
  light chain complementarity determining region 3 for antibody 23753
QQYGRLPIT

SEQ ID NO: 47506 - protein, 11 aa, Homo sapiens
  heavy chain complementarity determining region 3 for antibody 23753
AHRFRTYYFDF

SEQ ID NO: 47507 - protein, 9 aa, Homo sapiens
  light chain complementarity determining region 3 for antibody 23754
QKYNSAPRT

SEQ ID NO: 47508 - protein, 10 aa, Homo sapiens
  heavy chain complementarity determining region 3 for antibody 23754
ARDRLGAFDI

SEQ ID NO: 47509 - protein, 9 aa, Homo sapiens
  light chain complementarity determining region 3 for antibody 23755
QQYSSSLIT

SEQ ID NO: 47510 - protein, 12 aa, Homo sapiens
  heavy chain complementarity determining region 3 for antibody 23755
ARDYVAGDAFDV

SEQ ID NO: 47511 - protein, 9 aa, Homo sapiens
  light chain complementarity determining region 3 for antibody 23756
QQSYSSVLT

SEQ ID NO: 47512 - protein, 16 aa, Homo sapiens
  heavy chain complementarity determining region 3 for antibody 23756
AREGGGTYTSSRAFDF

SEQ ID NO: 47513 - protein, 9 aa, Homo sapiens
  light chain complementarity determining region 3 for antibody 23757
HQYGSSPET

SEQ ID NO: 47514 - protein, 20 aa, Homo sapiens
  heavy chain complementarity determining region 3 for antibody 23757
ARRTPNPAPGMRYYYYGMDV

SEQ ID NO: 47515 - protein, 9 aa, Homo sapiens
  light chain complementarity determining region 3 for antibody 23758
QQHGGFPVT

SEQ ID NO: 47516 - protein, 18 aa, Homo sapiens
  heavy chain complementarity determining region 3 for antibody 23758
ARVTYCPSGTCFSGEIHY

SEQ ID NO: 47517 - protein, 8 aa, Homo sapiens
  light chain complementarity determining region 3 for antibody 23759
QQYGTSPT

SEQ ID NO: 47518 - protein, 22 aa, Homo sapiens
  heavy chain complementarity determining region 3 for antibody 23759
ARGRGTVIRGATTKSYFNVMDV

SEQ ID NO: 47519 - protein, 11 aa, Homo sapiens
  light chain complementarity determining region 3 for antibody 23760
QQYGISPPHWA

SEQ ID NO: 47520 - protein, 12 aa, Homo sapiens
  heavy chain complementarity determining region 3 for antibody 23760
VKEKGGVRVFDF

SEQ ID NO: 47521 - protein, 8 aa, Homo sapiens
  light chain complementarity determining region 3 for antibody 23761
QQYGDSMT

SEQ ID NO: 47522 - protein, 16 aa, Homo sapiens
  heavy chain complementarity determining region 3 for antibody 23761
ARGLSIIRGVMSPFDL

SEQ ID NO: 47523 - protein, 10 aa, Homo sapiens
  light chain complementarity determining region 3 for antibody 23762
QHYVSPPAYT

SEQ ID NO: 47524 - protein, 12 aa, Homo sapiens
  heavy chain complementarity determining region 3 for antibody 23762
ARETTRFGELDY

SEQ ID NO: 47525 - protein, 10 aa, Homo sapiens
  light chain complementarity determining region 3 for antibody 23763
QQYGSSPPFT

SEQ ID NO: 47526 - protein, 14 aa, Homo sapiens
  heavy chain complementarity determining region 3 for antibody 23763
ARDLRWLVLGRLDY

SEQ ID NO: 47527 - protein, 9 aa, Homo sapiens
  light chain complementarity determining region 3 for antibody 23764
QQYGISPRT

SEQ ID NO: 47528 - protein, 13 aa, Homo sapiens
  heavy chain complementarity determining region 3 for antibody 23764
ARDVAGWPFVNNY

SEQ ID NO: 47529 - protein, 9 aa, Homo sapiens
  light chain complementarity determining region 3 for antibody 23765
MQGTHWPYT

SEQ ID NO: 47530 - protein, 10 aa, Homo sapiens
  heavy chain complementarity determining region 3 for antibody 23765
ARDGDFVLDY

SEQ ID NO: 47531 - protein, 9 aa, Homo sapiens
  light chain complementarity determining region 3 for antibody 23766
HQYYSSPRM

SEQ ID NO: 47532 - protein, 13 aa, Homo sapiens
  heavy chain complementarity determining region 3 for antibody 23766
ARGQSGDPRTYDY

SEQ ID NO: 47533 - protein, 9 aa, Homo sapiens
  light chain complementarity determining region 3 for antibody 23767
HQYASSPLT

SEQ ID NO: 47534 - protein, 10 aa, Homo sapiens
  heavy chain complementarity determining region 3 for antibody 23767
AKGGGWLTDY

SEQ ID NO: 47535 - protein, 9 aa, Homo sapiens
  light chain complementarity determining region 3 for antibody 23768
QQYGSSPYA

SEQ ID NO: 47536 - protein, 13 aa, Homo sapiens
  heavy chain complementarity determining region 3 for antibody 23768
ARALQYSGRIFDY

SEQ ID NO: 47537 - protein, 9 aa, Homo sapiens
  light chain complementarity determining region 3 for antibody 23769
QQYGSSPRT

SEQ ID NO: 47538 - protein, 25 aa, Homo sapiens
  heavy chain complementarity determining region 3 for antibody 23769
ARLRIDQLRLPGAMRGALYHCGMDV

SEQ ID NO: 47539 - protein, 10 aa, Homo sapiens
  light chain complementarity determining region 3 for antibody 23770
MQGSYWPPWT

SEQ ID NO: 47540 - protein, 11 aa, Homo sapiens
  heavy chain complementarity determining region 3 for antibody 23770
ARDTPGVGIDY

SEQ ID NO: 47541 - protein, 9 aa, Homo sapiens
  light chain complementarity determining region 3 for antibody 23771
QQSYSTPPT

SEQ ID NO: 47542 - protein, 18 aa, Homo sapiens
  heavy chain complementarity determining region 3 for antibody 23771
ARVVDSSSWYFYFYGMDV

SEQ ID NO: 47543 - protein, 10 aa, Homo sapiens
  light chain complementarity determining region 3 for antibody 23772
QQSYSSFSIT

SEQ ID NO: 47544 - protein, 14 aa, Homo sapiens
  heavy chain complementarity determining region 3 for antibody 23772
ARDFVRGLWRSFDI

SEQ ID NO: 47545 - protein, 10 aa, Homo sapiens
  light chain complementarity determining region 3 for antibody 23773
QQRNKWPPVI

SEQ ID NO: 47546 - protein, 12 aa, Homo sapiens
  heavy chain complementarity determining region 3 for antibody 23773
VRDGSSGWHFDY

SEQ ID NO: 47547 - protein, 9 aa, Homo sapiens
  light chain complementarity determining region 3 for antibody 23774
MQGAHWPYT

SEQ ID NO: 47548 - protein, 11 aa, Homo sapiens
  heavy chain complementarity determining region 3 for antibody 23774
ATVRLVGAVDY

SEQ ID NO: 47549 - protein, 9 aa, Homo sapiens
  light chain complementarity determining region 3 for antibody 23775
LQYYATPWT

SEQ ID NO: 47550 - protein, 15 aa, Homo sapiens
  heavy chain complementarity determining region 3 for antibody 23775
VRQSKVDNNYNYPDF

SEQ ID NO: 47551 - protein, 9 aa, Homo sapiens
  light chain complementarity determining region 3 for antibody 23776
LQHYSYPLT

SEQ ID NO: 47552 - protein, 22 aa, Homo sapiens
  heavy chain complementarity determining region 3 for antibody 23776
AKDQASTVVVVSRPWEVSDLTF

SEQ ID NO: 47553 - protein, 8 aa, Homo sapiens
  light chain complementarity determining region 3 for antibody 23777
QQYVRSLT

SEQ ID NO: 47554 - protein, 15 aa, Homo sapiens
  heavy chain complementarity determining region 3 for antibody 23777
ARGGLPLRRNGYFDS

SEQ ID NO: 47555 - protein, 8 aa, Homo sapiens
  light chain complementarity determining region 3 for antibody 23778
QQYNSYRS

SEQ ID NO: 47556 - protein, 18 aa, Homo sapiens
  heavy chain complementarity determining region 3 for antibody 23778
IVDQDDSYVSGWFGYLRH

SEQ ID NO: 47557 - protein, 10 aa, Homo sapiens
  light chain complementarity determining region 3 for antibody 23779
QQYGYSPKLT

SEQ ID NO: 47558 - protein, 18 aa, Homo sapiens
  heavy chain complementarity determining region 3 for antibody 23779
ATGHPLRLHDYYYFVMDV

SEQ ID NO: 47559 - protein, 9 aa, Homo sapiens
  light chain complementarity determining region 3 for antibody 23780
QQYGSSPLT

SEQ ID NO: 47560 - protein, 17 aa, Homo sapiens
  heavy chain complementarity determining region 3 for antibody 23780
ARAPAPYRSDWRDPFDI

SEQ ID NO: 47561 - protein, 9 aa, Homo sapiens
  light chain complementarity determining region 3 for antibody 23781
QQRHNWPLT

SEQ ID NO: 47562 - protein, 14 aa, Homo sapiens
  heavy chain complementarity determining region 3 for antibody 23781
AKGDSYGIFSVFDF

SEQ ID NO: 47563 - protein, 9 aa, Homo sapiens
  light chain complementarity determining region 3 for antibody 23782
QQNHDRPWT

SEQ ID NO: 47564 - protein, 18 aa, Homo sapiens
  heavy chain complementarity determining region 3 for antibody 23782
ARGSSSFSDSVGYYFFDR

SEQ ID NO: 47565 - protein, 9 aa, Homo sapiens
  light chain complementarity determining region 3 for antibody 23783
QQANSFPPT

SEQ ID NO: 47566 - protein, 17 aa, Homo sapiens
  heavy chain complementarity determining region 3 for antibody 23783
ARDPIVGASIPFYGMDV

SEQ ID NO: 47567 - protein, 9 aa, Homo sapiens
  light chain complementarity determining region 3 for antibody 23784
QQLKSYPLT

SEQ ID NO: 47568 - protein, 13 aa, Homo sapiens
  heavy chain complementarity determining region 3 for antibody 23784
VPVMEVTLGAFAF

SEQ ID NO: 47569 - protein, 9 aa, Homo sapiens
  light chain complementarity determining region 3 for antibody 23785
QQGYRPPFI

SEQ ID NO: 47570 - protein, 15 aa, Homo sapiens
  heavy chain complementarity determining region 3 for antibody 23785
TRAQVIWGQLYYFDY

SEQ ID NO: 47571 - protein, 9 aa, Homo sapiens
  light chain complementarity determining region 3 for antibody 23786
QQGNSLPTT

SEQ ID NO: 47572 - protein, 20 aa, Homo sapiens
  heavy chain complementarity determining region 3 for antibody 23786
ARDPTGYGDYVPLYFYGMDV

SEQ ID NO: 47573 - protein, 9 aa, Homo sapiens
  light chain complementarity determining region 3 for antibody 23787
MQGTHRPPT

SEQ ID NO: 47574 - protein, 15 aa, Homo sapiens
  heavy chain complementarity determining region 3 for antibody 23787
AKSSGPSIAVTGFDY

SEQ ID NO: 47575 - protein, 9 aa, Homo sapiens
  light chain complementarity determining region 3 for antibody 23788
MQALQTRFT

SEQ ID NO: 47576 - protein, 12 aa, Homo sapiens
  heavy chain complementarity determining region 3 for antibody 23788
SKMVGWTYGMDV

SEQ ID NO: 47577 - protein, 9 aa, Homo sapiens
  light chain complementarity determining region 3 for antibody 23789
QQYSTYPWT

SEQ ID NO: 47578 - protein, 16 aa, Homo sapiens
  heavy chain complementarity determining region 3 for antibody 23789
ARVRYPISADNRVVDH

SEQ ID NO: 47579 - protein, 9 aa, Homo sapiens
  light chain complementarity determining region 3 for antibody 23790
QQYGTIPRT

SEQ ID NO: 47580 - protein, 13 aa, Homo sapiens
  heavy chain complementarity determining region 3 for antibody 23790
AGGLFDSSGYSEF

SEQ ID NO: 47581 - protein, 9 aa, Homo sapiens
  light chain complementarity determining region 3 for antibody 23791
QQYGGSGYT

SEQ ID NO: 47582 - protein, 17 aa, Homo sapiens
  heavy chain complementarity determining region 3 for antibody 23791
ARPAVTEFRGINDALDI

SEQ ID NO: 47583 - protein, 9 aa, Homo sapiens
  light chain complementarity determining region 3 for antibody 23792
LQGNRFPHT

SEQ ID NO: 47584 - protein, 14 aa, Homo sapiens
  heavy chain complementarity determining region 3 for antibody 23792
ARYCSGNSCYSMDH

SEQ ID NO: 47585 - protein, 10 aa, Homo sapiens
  light chain complementarity determining region 3 for antibody 23793
QQYYNYPPYT

SEQ ID NO: 47586 - protein, 16 aa, Homo sapiens
  heavy chain complementarity determining region 3 for antibody 23793
ARDTAYDYVWGSPIDY

SEQ ID NO: 47587 - protein, 10 aa, Homo sapiens
  light chain complementarity determining region 3 for antibody 23794
QQYNSWPPIT

SEQ ID NO: 47588 - protein, 9 aa, Homo sapiens
  heavy chain complementarity determining region 3 for antibody 23794
ARGHYGMDV

SEQ ID NO: 47589 - protein, 8 aa, Homo sapiens
  light chain complementarity determining region 3 for antibody 23795
QQYNSPWT

SEQ ID NO: 47590 - protein, 17 aa, Homo sapiens
  heavy chain complementarity determining region 3 for antibody 23795
AREKMWELRPGPDAFDI

SEQ ID NO: 47591 - protein, 10 aa, Homo sapiens
  light chain complementarity determining region 3 for antibody 23796
QQGYGTPMYT

SEQ ID NO: 47592 - protein, 15 aa, Homo sapiens
  heavy chain complementarity determining region 3 for antibody 23796
ARFAESSRYYRPFDY

SEQ ID NO: 47593 - protein, 9 aa, Homo sapiens
  light chain complementarity determining region 3 for antibody 23797
LQYGYFPYT

SEQ ID NO: 47594 - protein, 12 aa, Homo sapiens
  heavy chain complementarity determining region 3 for antibody 23797
VRLLDSSGSLGY

SEQ ID NO: 47595 - protein, 9 aa, Homo sapiens
  light chain complementarity determining region 3 for antibody 23798
QQTYSPPFT

SEQ ID NO: 47596 - protein, 14 aa, Homo sapiens
  heavy chain complementarity determining region 3 for antibody 23798
ARARDTSGYSGLDY

SEQ ID NO: 47597 - protein, 11 aa, Homo sapiens
  light chain complementarity determining region 3 for antibody 23799
QQYSDWPTSFT

SEQ ID NO: 47598 - protein, 14 aa, Homo sapiens
  heavy chain complementarity determining region 3 for antibody 23799
ARASGSNVKMPFDF

SEQ ID NO: 47599 - protein, 9 aa, Homo sapiens
  light chain complementarity determining region 3 for antibody 23800
QQYGSSPRT

SEQ ID NO: 47600 - protein, 11 aa, Homo sapiens
  heavy chain complementarity determining region 3 for antibody 23800
TLSGYLAAFDI

SEQ ID NO: 47601 - protein, 9 aa, Homo sapiens
  light chain complementarity determining region 3 for antibody 23801
QQSYSPPLA

SEQ ID NO: 47602 - protein, 12 aa, Homo sapiens
  heavy chain complementarity determining region 3 for antibody 23801
AHLTGARRYFDY

SEQ ID NO: 47603 - protein, 9 aa, Homo sapiens
  light chain complementarity determining region 3 for antibody 23802
QQFHSYPIT

SEQ ID NO: 47604 - protein, 17 aa, Homo sapiens
  heavy chain complementarity determining region 3 for antibody 23802
ARSGPYHSSGYYYYLDS

SEQ ID NO: 47605 - protein, 9 aa, Homo sapiens
  light chain complementarity determining region 3 for antibody 23803
QQYGSSPLT

SEQ ID NO: 47606 - protein, 19 aa, Homo sapiens
  heavy chain complementarity determining region 3 for antibody 23803
ARGSSSSRRRAAVVGYFDL

SEQ ID NO: 47607 - protein, 9 aa, Homo sapiens
  light chain complementarity determining region 3 for antibody 23804
QQYGGALFK

SEQ ID NO: 47608 - protein, 10 aa, Homo sapiens
  heavy chain complementarity determining region 3 for antibody 23804
TGGEGSKFDY

SEQ ID NO: 47609 - protein, 8 aa, Homo sapiens
  light chain complementarity determining region 3 for antibody 23805
QQYDKLYT

SEQ ID NO: 47610 - protein, 13 aa, Homo sapiens
  heavy chain complementarity determining region 3 for antibody 23805
VTGGIYTTGPLDF

SEQ ID NO: 47611 - protein, 9 aa, Homo sapiens
  light chain complementarity determining region 3 for antibody 23806
QQTYSPPRT

SEQ ID NO: 47612 - protein, 21 aa, Homo sapiens
  heavy chain complementarity determining region 3 for antibody 23806
AKVAVGVPSTTGFGEYYGLDV

SEQ ID NO: 47613 - protein, 9 aa, Homo sapiens
  light chain complementarity determining region 3 for antibody 23807
QQRIDWPWT

SEQ ID NO: 47614 - protein, 12 aa, Homo sapiens
  heavy chain complementarity determining region 3 for antibody 23807
GREDYRTGYVDS

SEQ ID NO: 47615 - protein, 9 aa, Homo sapiens
  light chain complementarity determining region 3 for antibody 23808
QHYAGSPWT

SEQ ID NO: 47616 - protein, 9 aa, Homo sapiens
  heavy chain complementarity determining region 3 for antibody 23808
ARAARGLDV

SEQ ID NO: 47617 - protein, 9 aa, Homo sapiens
  light chain complementarity determining region 3 for antibody 23809
LHNKNFPYA

SEQ ID NO: 47618 - protein, 14 aa, Homo sapiens
  heavy chain complementarity determining region 3 for antibody 23809
TRTEWSSGWRLFDY

SEQ ID NO: 47619 - protein, 9 aa, Homo sapiens
  light chain complementarity determining region 3 for antibody 23810
QQYGSSPGT

SEQ ID NO: 47620 - protein, 16 aa, Homo sapiens
  heavy chain complementarity determining region 3 for antibody 23810
ARAVWGASWSVGWFDS

SEQ ID NO: 47621 - protein, 9 aa, Homo sapiens
  light chain complementarity determining region 3 for antibody 23811
QHTHTFPRT

SEQ ID NO: 47622 - protein, 20 aa, Homo sapiens
  heavy chain complementarity determining region 3 for antibody 23811
GRGRRIAALSTAHYYYGMDV

SEQ ID NO: 47623 - protein, 9 aa, Homo sapiens
  light chain complementarity determining region 3 for antibody 23812
LQHHSYPRT

SEQ ID NO: 47624 - protein, 19 aa, Homo sapiens
  heavy chain complementarity determining region 3 for antibody 23812
ATGGLLGILTQYDYNGMDA

SEQ ID NO: 47625 - protein, 9 aa, Homo sapiens
  light chain complementarity determining region 3 for antibody 23813
LQDDTYPWT

SEQ ID NO: 47626 - protein, 17 aa, Homo sapiens
  heavy chain complementarity determining region 3 for antibody 23813
ARVKWLQLQDFYYGMDV

SEQ ID NO: 47627 - protein, 8 aa, Homo sapiens
  light chain complementarity determining region 3 for antibody 23814
LHYLSSWT

SEQ ID NO: 47628 - protein, 15 aa, Homo sapiens
  heavy chain complementarity determining region 3 for antibody 23814
ARESFDISGNNWFAP

SEQ ID NO: 47629 - protein, 9 aa, Homo sapiens
  light chain complementarity determining region 3 for antibody 23815
LHLHSFPLT

SEQ ID NO: 47630 - protein, 15 aa, Homo sapiens
  heavy chain complementarity determining region 3 for antibody 23815
ARAGAYSGGRYYFDY

SEQ ID NO: 47631 - protein, 9 aa, Homo sapiens
  light chain complementarity determining region 3 for antibody 23816
KQYDNSPWT

SEQ ID NO: 47632 - protein, 16 aa, Homo sapiens
  heavy chain complementarity determining region 3 for antibody 23816
ARDKFYDSSGYHPFDY

SEQ ID NO: 47633 - protein, 9 aa, Homo sapiens
  light chain complementarity determining region 3 for antibody 23817
HQSSASPRT

SEQ ID NO: 47634 - protein, 7 aa, Homo sapiens
  heavy chain complementarity determining region 3 for antibody 23817
GGRDLDY

SEQ ID NO: 47635 - protein, 7 aa, Homo sapiens
  light chain complementarity determining region 3 for antibody 23818
QQRSNWR

SEQ ID NO: 47636 - protein, 19 aa, Homo sapiens
  heavy chain complementarity determining region 3 for antibody 23818
ARGVYCSGGSCYGRNWFDP

SEQ ID NO: 47637 - protein, 9 aa, Homo sapiens
  light chain complementarity determining region 3 for antibody 23819
QQRGNWPLT

SEQ ID NO: 47638 - protein, 26 aa, Homo sapiens
  heavy chain complementarity determining region 3 for antibody 23819
ARDLGLRSLEWKSRNTNTNYYYGMDV

SEQ ID NO: 47639 - protein, 9 aa, Homo sapiens
  light chain complementarity determining region 3 for antibody 23820
QQLNSYPHT

SEQ ID NO: 47640 - protein, 12 aa, Homo sapiens
  heavy chain complementarity determining region 3 for antibody 23820
ARTSLSHDYGYY

SEQ ID NO: 47641 - protein, 11 aa, Homo sapiens
  light chain complementarity determining region 3 for antibody 23821
QQYDNSALEFT

SEQ ID NO: 47642 - protein, 15 aa, Homo sapiens
  heavy chain complementarity determining region 3 for antibody 23821
VREVVTMIEPGGFDV

SEQ ID NO: 47643 - protein, 10 aa, Homo sapiens
  light chain complementarity determining region 3 for antibody 23822
QQRSNWPPVT

SEQ ID NO: 47644 - protein, 14 aa, Homo sapiens
  heavy chain complementarity determining region 3 for antibody 23822
ARDLSGVLIGAWSH

SEQ ID NO: 47645 - protein, 11 aa, Homo sapiens
  light chain complementarity determining region 3 for antibody 23823
QQRSNWPPALT

SEQ ID NO: 47646 - protein, 14 aa, Homo sapiens
  heavy chain complementarity determining region 3 for antibody 23823
AREGTAMVKDAFEI

SEQ ID NO: 47647 - protein, 9 aa, Homo sapiens
  light chain complementarity determining region 3 for antibody 23824
QQYNSYSGT

SEQ ID NO: 47648 - protein, 13 aa, Homo sapiens
  heavy chain complementarity determining region 3 for antibody 23824
ARCVSGWFAPYDY

SEQ ID NO: 47649 - protein, 9 aa, Homo sapiens
  light chain complementarity determining region 3 for antibody 23825
QQYETYPWT

SEQ ID NO: 47650 - protein, 17 aa, Homo sapiens
  heavy chain complementarity determining region 3 for antibody 23825
VRRGGGLPDDRDYGLDV

SEQ ID NO: 47651 - protein, 9 aa, Homo sapiens
  light chain complementarity determining region 3 for antibody 23826
QQRSDWPIT

SEQ ID NO: 47652 - protein, 20 aa, Homo sapiens
  heavy chain complementarity determining region 3 for antibody 23826
ARGGHIVVVTSIGDQAAFNV

SEQ ID NO: 47653 - protein, 9 aa, Homo sapiens
  light chain complementarity determining region 3 for antibody 23827
QQYNTWPPT

SEQ ID NO: 47654 - protein, 13 aa, Homo sapiens
  heavy chain complementarity determining region 3 for antibody 23827
ARVVSSQSGYGDS

SEQ ID NO: 47655 - protein, 8 aa, Homo sapiens
  light chain complementarity determining region 3 for antibody 23828
QQYNTWLS

SEQ ID NO: 47656 - protein, 12 aa, Homo sapiens
  heavy chain complementarity determining region 3 for antibody 23828
ARLLWDSYYFDS

SEQ ID NO: 47657 - protein, 9 aa, Homo sapiens
  light chain complementarity determining region 3 for antibody 23829
QQYGTSPRT

SEQ ID NO: 47658 - protein, 13 aa, Homo sapiens
  heavy chain complementarity determining region 3 for antibody 23829
PIGFYDRSGYHEY

SEQ ID NO: 47659 - protein, 9 aa, Homo sapiens
  light chain complementarity determining region 3 for antibody 23830
QQHSRWPIT

SEQ ID NO: 47660 - protein, 15 aa, Homo sapiens
  heavy chain complementarity determining region 3 for antibody 23830
ARDWGSSGWYNWFDP

SEQ ID NO: 47661 - protein, 9 aa, Homo sapiens
  light chain complementarity determining region 3 for antibody 23831
QQYGSSPYT

SEQ ID NO: 47662 - protein, 16 aa, Homo sapiens
  heavy chain complementarity determining region 3 for antibody 23831
ATPGQHNSGWDYRFDY

SEQ ID NO: 47663 - protein, 9 aa, Homo sapiens
  light chain complementarity determining region 3 for antibody 23832
QQYGSSPPT

SEQ ID NO: 47664 - protein, 23 aa, Homo sapiens
  heavy chain complementarity determining region 3 for antibody 23832
ARDGAHDYIHRLRKKHRIDAFDI

SEQ ID NO: 47665 - protein, 9 aa, Homo sapiens
  light chain complementarity determining region 3 for antibody 23833
QQRGKWPLT

SEQ ID NO: 47666 - protein, 15 aa, Homo sapiens
  heavy chain complementarity determining region 3 for antibody 23833
ARIGGYYDSGTISDY

SEQ ID NO: 47667 - protein, 9 aa, Homo sapiens
  light chain complementarity determining region 3 for antibody 23834
QQYDNWPQA

SEQ ID NO: 47668 - protein, 16 aa, Homo sapiens
  heavy chain complementarity determining region 3 for antibody 23834
ASLPRGGTYWKNVLDV

SEQ ID NO: 47669 - protein, 9 aa, Homo sapiens
  light chain complementarity determining region 3 for antibody 23835
QQFGGAPRT

SEQ ID NO: 47670 - protein, 16 aa, Homo sapiens
  heavy chain complementarity determining region 3 for antibody 23835
ARDPRGGVAVPADFNY

SEQ ID NO: 47671 - protein, 9 aa, Homo sapiens
  light chain complementarity determining region 3 for antibody 23836
LQEYTYPVS

SEQ ID NO: 47672 - protein, 15 aa, Homo sapiens
  heavy chain complementarity determining region 3 for antibody 23836
ARIRRYGSTWETLDH

SEQ ID NO: 47673 - protein, 8 aa, Homo sapiens
  light chain complementarity determining region 3 for antibody 23837
QQYNNWPV

SEQ ID NO: 47674 - protein, 14 aa, Homo sapiens
  heavy chain complementarity determining region 3 for antibody 23837
AGKGYSASGNYYAN

SEQ ID NO: 47675 - protein, 9 aa, Homo sapiens
  light chain complementarity determining region 3 for antibody 23838
QQSHSVPYT

SEQ ID NO: 47676 - protein, 17 aa, Homo sapiens
  heavy chain complementarity determining region 3 for antibody 23838
ARLILRRSLEHIGGLDP

SEQ ID NO: 47677 - protein, 10 aa, Homo sapiens
  light chain complementarity determining region 3 for antibody 23839
MQGTHWPPRT

SEQ ID NO: 47678 - protein, 12 aa, Homo sapiens
  heavy chain complementarity determining region 3 for antibody 23839
VRDPQIGDVSDY

SEQ ID NO: 47679 - protein, 9 aa, Homo sapiens
  light chain complementarity determining region 3 for antibody 23840
QQYATSPLT

SEQ ID NO: 47680 - protein, 10 aa, Homo sapiens
  heavy chain complementarity determining region 3 for antibody 23840
VAGAGWLPDY

SEQ ID NO: 47681 - protein, 9 aa, Homo sapiens
  light chain complementarity determining region 3 for antibody 23841
QQSYSSPRT

SEQ ID NO: 47682 - protein, 17 aa, Homo sapiens
  heavy chain complementarity determining region 3 for antibody 23841
VRVVGLAPVYSRNWYDP

SEQ ID NO: 47683 - protein, 9 aa, Homo sapiens
  light chain complementarity determining region 3 for antibody 23842
QQSFIAPFT

SEQ ID NO: 47684 - protein, 13 aa, Homo sapiens
  heavy chain complementarity determining region 3 for antibody 23842
ARRRSDLSWQFDY

SEQ ID NO: 47685 - protein, 8 aa, Homo sapiens
  light chain complementarity determining region 3 for antibody 23843
QQRSNRLS

SEQ ID NO: 47686 - protein, 11 aa, Homo sapiens
  heavy chain complementarity determining region 3 for antibody 23843
ASGSIGWVFDY

SEQ ID NO: 47687 - protein, 10 aa, Homo sapiens
  light chain complementarity determining region 3 for antibody 23844
QQRGNWPEIT

SEQ ID NO: 47688 - protein, 14 aa, Homo sapiens
  heavy chain complementarity determining region 3 for antibody 23844
AKDHDSFVSGFGDL

SEQ ID NO: 47689 - protein, 9 aa, Homo sapiens
  light chain complementarity determining region 3 for antibody 23845
MQGLQTPYT

SEQ ID NO: 47690 - protein, 10 aa, Homo sapiens
  heavy chain complementarity determining region 3 for antibody 23845
GRDLSGARDY

SEQ ID NO: 47691 - protein, 10 aa, Homo sapiens
  light chain complementarity determining region 3 for antibody 23846
QQYHNWPPWT

SEQ ID NO: 47692 - protein, 21 aa, Homo sapiens
  heavy chain complementarity determining region 3 for antibody 23846
ARTGAEPNSWSSAPEDSWFDP

SEQ ID NO: 47693 - protein, 9 aa, Homo sapiens
  light chain complementarity determining region 3 for antibody 23847
QQYGSSPLT

SEQ ID NO: 47694 - protein, 12 aa, Homo sapiens
  heavy chain complementarity determining region 3 for antibody 23847
ARASWFLSVFDS

SEQ ID NO: 47695 - protein, 9 aa, Homo sapiens
  light chain complementarity determining region 3 for antibody 23848
QQRSNWPST

SEQ ID NO: 47696 - protein, 13 aa, Homo sapiens
  heavy chain complementarity determining region 3 for antibody 23848
TTGEAYSGYDGDY

SEQ ID NO: 47697 - protein, 9 aa, Homo sapiens
  light chain complementarity determining region 3 for antibody 23849
QKYNSAPLT

SEQ ID NO: 47698 - protein, 17 aa, Homo sapiens
  heavy chain complementarity determining region 3 for antibody 23849
ARSDILTGFTTPGLRDV

SEQ ID NO: 47699 - protein, 9 aa, Homo sapiens
  light chain complementarity determining region 3 for antibody 23850
LQHYTYPWT

SEQ ID NO: 47700 - protein, 16 aa, Homo sapiens
  heavy chain complementarity determining region 3 for antibody 23850
NTDFYYPSSGYSYVDF

SEQ ID NO: 47701 - protein, 9 aa, Homo sapiens
  light chain complementarity determining region 3 for antibody 23851
HQYGLSPRT

SEQ ID NO: 47702 - protein, 13 aa, Homo sapiens
  heavy chain complementarity determining region 3 for antibody 23851
ARTGRVAGVEGAS

SEQ ID NO: 47703 - protein, 9 aa, Homo sapiens
  light chain complementarity determining region 3 for antibody 23852
HQYDNLPRT

SEQ ID NO: 47704 - protein, 18 aa, Homo sapiens
  heavy chain complementarity determining region 3 for antibody 23852
VTLPPQYCSGVNCYDVDY

SEQ ID NO: 47705 - protein, 10 aa, Homo sapiens
  light chain complementarity determining region 3 for antibody 23853
HQYASSPPTT

SEQ ID NO: 47706 - protein, 18 aa, Homo sapiens
  heavy chain complementarity determining region 3 for antibody 23853
AKEGYYYNSGSYYNPLDY

SEQ ID NO: 47707 - protein, 9 aa, Homo sapiens
  light chain complementarity determining region 3 for antibody 23854
HHYGTSSGT

SEQ ID NO: 47708 - protein, 12 aa, Homo sapiens
  heavy chain complementarity determining region 3 for antibody 23854
ARDHILLGGFDL

SEQ ID NO: 47709 - protein, 9 aa, Homo sapiens
  light chain complementarity determining region 3 for antibody 23855
QQYGTSPFT

SEQ ID NO: 47710 - protein, 13 aa, Homo sapiens
  heavy chain complementarity determining region 3 for antibody 23855
STPPRSSSSAGGY

SEQ ID NO: 47711 - protein, 9 aa, Homo sapiens
  light chain complementarity determining region 3 for antibody 23856
QQYGSSPPT

SEQ ID NO: 47712 - protein, 13 aa, Homo sapiens
  heavy chain complementarity determining region 3 for antibody 23856
AKPMWRKLYYFDY

SEQ ID NO: 47713 - protein, 10 aa, Homo sapiens
  light chain complementarity determining region 3 for antibody 23857
QQYGSSPLFT

SEQ ID NO: 47714 - protein, 15 aa, Homo sapiens
  heavy chain complementarity determining region 3 for antibody 23857
TTAGYSYGYRFFFDY

SEQ ID NO: 47715 - protein, 9 aa, Homo sapiens
  light chain complementarity determining region 3 for antibody 23858
QQYGRSPWT

SEQ ID NO: 47716 - protein, 18 aa, Homo sapiens
  heavy chain complementarity determining region 3 for antibody 23858
ATNPSIAEPGNIYWYFDL

SEQ ID NO: 47717 - protein, 9 aa, Homo sapiens
  light chain complementarity determining region 3 for antibody 23859
QQRSHWPPT

SEQ ID NO: 47718 - protein, 15 aa, Homo sapiens
  heavy chain complementarity determining region 3 for antibody 23859
ARTERRGNGWYLYDF

SEQ ID NO: 47719 - protein, 9 aa, Homo sapiens
  light chain complementarity determining region 3 for antibody 23860
QHSHSRPFT

SEQ ID NO: 47720 - protein, 20 aa, Homo sapiens
  heavy chain complementarity determining region 3 for antibody 23860
AKGISVAALRTVYYYYGMDV

SEQ ID NO: 47721 - protein, 10 aa, Homo sapiens
  light chain complementarity determining region 3 for antibody 23861
HQYGSSPPYT

SEQ ID NO: 47722 - protein, 14 aa, Homo sapiens
  heavy chain complementarity determining region 3 for antibody 23861
ARRGQWLVREAIDY

SEQ ID NO: 47723 - protein, 9 aa, Homo sapiens
  light chain complementarity determining region 3 for antibody 23862
LQHNSYPLT

SEQ ID NO: 47724 - protein, 21 aa, Homo sapiens
  heavy chain complementarity determining region 3 for antibody 23862
TTDQVLTGYCSGGSCLEYFQH

SEQ ID NO: 47725 - protein, 9 aa, Homo sapiens
  light chain complementarity determining region 3 for antibody 23863
QQYRSSPWT

SEQ ID NO: 47726 - protein, 22 aa, Homo sapiens
  heavy chain complementarity determining region 3 for antibody 23863
ARAVSTNRWGRSTGDWGGAYDI

SEQ ID NO: 47727 - protein, 9 aa, Homo sapiens
  light chain complementarity determining region 3 for antibody 23864
QQYNSYYLT

SEQ ID NO: 47728 - protein, 14 aa, Homo sapiens
  heavy chain complementarity determining region 3 for antibody 23864
ARRPTSRGLGTFDY

SEQ ID NO: 47729 - protein, 9 aa, Homo sapiens
  light chain complementarity determining region 3 for antibody 23865
QQYNNLPWT

SEQ ID NO: 47730 - protein, 12 aa, Homo sapiens
  heavy chain complementarity determining region 3 for antibody 23865
ARGLSSGWGLDY

SEQ ID NO: 47731 - protein, 8 aa, Homo sapiens
  light chain complementarity determining region 3 for antibody 23866
QQHGSSIT

SEQ ID NO: 47732 - protein, 14 aa, Homo sapiens
  heavy chain complementarity determining region 3 for antibody 23866
TRDPVEGPPDYFDY

SEQ ID NO: 47733 - protein, 9 aa, Homo sapiens
  light chain complementarity determining region 3 for antibody 23867
LHDYNYPWT

SEQ ID NO: 47734 - protein, 12 aa, Homo sapiens
  heavy chain complementarity determining region 3 for antibody 23867
ARFGGDGGYLDY

SEQ ID NO: 47735 - protein, 10 aa, Homo sapiens
  light chain complementarity determining region 3 for antibody 23868
QQRYNWPPYT

SEQ ID NO: 47736 - protein, 11 aa, Homo sapiens
  heavy chain complementarity determining region 3 for antibody 23868
ARGVGSYVFES

SEQ ID NO: 47737 - protein, 9 aa, Homo sapiens
  light chain complementarity determining region 3 for antibody 23869
QQRSNWPLT

SEQ ID NO: 47738 - protein, 17 aa, Homo sapiens
  heavy chain complementarity determining region 3 for antibody 23869
AKDFSPYGDYKSDYFDH

SEQ ID NO: 47739 - protein, 9 aa, Homo sapiens
  light chain complementarity determining region 3 for antibody 23870
QQLHSYPLT

SEQ ID NO: 47740 - protein, 15 aa, Homo sapiens
  heavy chain complementarity determining region 3 for antibody 23870
AREFYASGSHYLLDS

SEQ ID NO: 47741 - protein, 9 aa, Homo sapiens
  light chain complementarity determining region 3 for antibody 23871
QHYGTSLWT

SEQ ID NO: 47742 - protein, 16 aa, Homo sapiens
  heavy chain complementarity determining region 3 for antibody 23871
ARLLPAGSLTPQMIPV

SEQ ID NO: 47743 - protein, 7 aa, Homo sapiens
  light chain complementarity determining region 3 for antibody 23872
QQYNSYT

SEQ ID NO: 47744 - protein, 13 aa, Homo sapiens
  heavy chain complementarity determining region 3 for antibody 23872
THNSDGYLGYFQH

SEQ ID NO: 47745 - protein, 9 aa, Homo sapiens
  light chain complementarity determining region 3 for antibody 23873
QQYDNSRLT

SEQ ID NO: 47746 - protein, 23 aa, Homo sapiens
  heavy chain complementarity determining region 3 for antibody 23873
ARGPAGAAYGTTFARPRGGYFGV

SEQ ID NO: 47747 - protein, 10 aa, Homo sapiens
  light chain complementarity determining region 3 for antibody 23874
QQTHSFPPLT

SEQ ID NO: 47748 - protein, 15 aa, Homo sapiens
  heavy chain complementarity determining region 3 for antibody 23874
ARTPWFGDFLHTNDY

SEQ ID NO: 47749 - protein, 11 aa, Homo sapiens
  light chain complementarity determining region 3 for antibody 23875
QQCETSPPMYT

SEQ ID NO: 47750 - protein, 23 aa, Homo sapiens
  heavy chain complementarity determining region 3 for antibody 23875
ARASRGYRRSDSRMEFFFYGLDV

SEQ ID NO: 47751 - protein, 9 aa, Homo sapiens
  light chain complementarity determining region 3 for antibody 23876
HQSGSLPET

SEQ ID NO: 47752 - protein, 8 aa, Homo sapiens
  heavy chain complementarity determining region 3 for antibody 23876
AVYSSLDY

SEQ ID NO: 47753 - protein, 9 aa, Homo sapiens
  light chain complementarity determining region 3 for antibody 23877
HQGYRTPFT

SEQ ID NO: 47754 - protein, 15 aa, Homo sapiens
  heavy chain complementarity determining region 3 for antibody 23877
AKAQVIWGQLYYFES

SEQ ID NO: 47755 - protein, 10 aa, Homo sapiens
  light chain complementarity determining region 3 for antibody 23878
QVYDSSSLWT

SEQ ID NO: 47756 - protein, 19 aa, Homo sapiens
  heavy chain complementarity determining region 3 for antibody 23878
ARESFVRKVGGQRPYYFDI

SEQ ID NO: 47757 - protein, 9 aa, Homo sapiens
  light chain complementarity determining region 3 for antibody 23879
QQYYTYPYT

SEQ ID NO: 47758 - protein, 15 aa, Homo sapiens
  heavy chain complementarity determining region 3 for antibody 23879
ARGQGSGTYNPYFAF

SEQ ID NO: 47759 - protein, 8 aa, Homo sapiens
  light chain complementarity determining region 3 for antibody 23880
QQYNSYGS

SEQ ID NO: 47760 - protein, 12 aa, Homo sapiens
  heavy chain complementarity determining region 3 for antibody 23880
ARNRIWFGDLHF

SEQ ID NO: 47761 - protein, 9 aa, Homo sapiens
  light chain complementarity determining region 3 for antibody 23881
QQYGTYPWT

SEQ ID NO: 47762 - protein, 11 aa, Homo sapiens
  heavy chain complementarity determining region 3 for antibody 23881
THRLVWEGVGH

SEQ ID NO: 47763 - protein, 11 aa, Homo sapiens
  light chain complementarity determining region 3 for antibody 23882
QLRGNWPPTYT

SEQ ID NO: 47764 - protein, 22 aa, Homo sapiens
  heavy chain complementarity determining region 3 for antibody 23882
ATLRPRDVGFCSGGSCPYYFDY

SEQ ID NO: 47765 - protein, 9 aa, Homo sapiens
  light chain complementarity determining region 3 for antibody 23883
QKYDSAPLT

SEQ ID NO: 47766 - protein, 15 aa, Homo sapiens
  heavy chain complementarity determining region 3 for antibody 23883
ARDGGPYQVLLPFSD

SEQ ID NO: 47767 - protein, 9 aa, Homo sapiens
  light chain complementarity determining region 3 for antibody 23884
QHYGAYSGT

SEQ ID NO: 47768 - protein, 10 aa, Homo sapiens
  heavy chain complementarity determining region 3 for antibody 23884
ARDVYDGWDR

SEQ ID NO: 47769 - protein, 10 aa, Homo sapiens
  light chain complementarity determining region 3 for antibody 23885
LQHDNFPPGT

SEQ ID NO: 47770 - protein, 21 aa, Homo sapiens
  heavy chain complementarity determining region 3 for antibody 23885
AKEKGILRFLDRNFYNYPMDV

SEQ ID NO: 47771 - protein, 9 aa, Homo sapiens
  light chain complementarity determining region 3 for antibody 23886
QQYDSLPYT

SEQ ID NO: 47772 - protein, 17 aa, Homo sapiens
  heavy chain complementarity determining region 3 for antibody 23886
ARGKSQLLSFGAKAFDL

SEQ ID NO: 47773 - protein, 9 aa, Homo sapiens
  light chain complementarity determining region 3 for antibody 23887
QQSYSTPPT

SEQ ID NO: 47774 - protein, 12 aa, Homo sapiens
  heavy chain complementarity determining region 3 for antibody 23887
ARETYGVPRFDS

SEQ ID NO: 47775 - protein, 10 aa, Homo sapiens
  light chain complementarity determining region 3 for antibody 23888
QQRSKWPPLT

SEQ ID NO: 47776 - protein, 9 aa, Homo sapiens
  heavy chain complementarity determining region 3 for antibody 23888
ARVDGYFDY

SEQ ID NO: 47777 - protein, 8 aa, Homo sapiens
  light chain complementarity determining region 3 for antibody 23889
QQHRNPFT

SEQ ID NO: 47778 - protein, 15 aa, Homo sapiens
  heavy chain complementarity determining region 3 for antibody 23889
ARAWGAATTSYICDN

SEQ ID NO: 47779 - protein, 9 aa, Homo sapiens
  light chain complementarity determining region 3 for antibody 23890
MQVLRTPYI

SEQ ID NO: 47780 - protein, 17 aa, Homo sapiens
  heavy chain complementarity determining region 3 for antibody 23890
ARWYYYDSSGYYSHFDY

SEQ ID NO: 47781 - protein, 9 aa, Homo sapiens
  light chain complementarity determining region 3 for antibody 23891
MQALETPFT

SEQ ID NO: 47782 - protein, 15 aa, Homo sapiens
  heavy chain complementarity determining region 3 for antibody 23891
VRHYRELTTGIEGDS

SEQ ID NO: 47783 - protein, 9 aa, Homo sapiens
  light chain complementarity determining region 3 for antibody 23892
LQDYNSPWT

SEQ ID NO: 47784 - protein, 14 aa, Homo sapiens
  heavy chain complementarity determining region 3 for antibody 23892
ARVIVAGWTNAFDI

SEQ ID NO: 47785 - protein, 9 aa, Homo sapiens
  light chain complementarity determining region 3 for antibody 23893
LQDNSYPFT

SEQ ID NO: 47786 - protein, 13 aa, Homo sapiens
  heavy chain complementarity determining region 3 for antibody 23893
AHRQLADAGHFDY

SEQ ID NO: 47787 - protein, 10 aa, Homo sapiens
  light chain complementarity determining region 3 for antibody 23894
QQYNSYSSYT

SEQ ID NO: 47788 - protein, 15 aa, Homo sapiens
  heavy chain complementarity determining region 3 for antibody 23894
ARTKLERRRDHYFDY

SEQ ID NO: 47789 - protein, 10 aa, Homo sapiens
  light chain complementarity determining region 3 for antibody 23895
QQYNNWPPIT

SEQ ID NO: 47790 - protein, 18 aa, Homo sapiens
  heavy chain complementarity determining region 3 for antibody 23895
ARGPPDFWSGYYKYYFDY

SEQ ID NO: 47791 - protein, 9 aa, Homo sapiens
  light chain complementarity determining region 3 for antibody 23896
QQYGSFPYT

SEQ ID NO: 47792 - protein, 14 aa, Homo sapiens
  heavy chain complementarity determining region 3 for antibody 23896
ARGGFIVAWGLFDY

SEQ ID NO: 47793 - protein, 9 aa, Homo sapiens
  light chain complementarity determining region 3 for antibody 23897
QQYGNSPWA

SEQ ID NO: 47794 - protein, 11 aa, Homo sapiens
  heavy chain complementarity determining region 3 for antibody 23897
ARKGLYAPLDV

SEQ ID NO: 47795 - protein, 10 aa, Homo sapiens
  light chain complementarity determining region 3 for antibody 23898
QQYGGSAGWT

SEQ ID NO: 47796 - protein, 14 aa, Homo sapiens
  heavy chain complementarity determining region 3 for antibody 23898
AREFCRGGNCCFDS

SEQ ID NO: 47797 - protein, 9 aa, Homo sapiens
  light chain complementarity determining region 3 for antibody 23899
QQSYNNSPT

SEQ ID NO: 47798 - protein, 21 aa, Homo sapiens
  heavy chain complementarity determining region 3 for antibody 23899
AKRTDHHYHSTGYQYRSVFDM

SEQ ID NO: 47799 - protein, 8 aa, Homo sapiens
  light chain complementarity determining region 3 for antibody 23900
QQRGNWPT

SEQ ID NO: 47800 - protein, 15 aa, Homo sapiens
  heavy chain complementarity determining region 3 for antibody 23900
ARVGSSWYTAGWFDP

SEQ ID NO: 47801 - protein, 9 aa, Homo sapiens
  light chain complementarity determining region 3 for antibody 23901
QQYGSSPPT

SEQ ID NO: 47802 - protein, 16 aa, Homo sapiens
  heavy chain complementarity determining region 3 for antibody 23901
AKDISGGFDGWWFFDY

SEQ ID NO: 47803 - protein, 9 aa, Homo sapiens
  light chain complementarity determining region 3 for antibody 23902
QQYGSSLYT

SEQ ID NO: 47804 - protein, 16 aa, Homo sapiens
  heavy chain complementarity determining region 3 for antibody 23902
ARAKHYGDYYYYGMDA

SEQ ID NO: 47805 - protein, 9 aa, Homo sapiens
  light chain complementarity determining region 3 for antibody 23903
QQYDNVPYS

SEQ ID NO: 47806 - protein, 12 aa, Homo sapiens
  heavy chain complementarity determining region 3 for antibody 23903
VREGRPSLALDI

SEQ ID NO: 47807 - protein, 8 aa, Homo sapiens
  light chain complementarity determining region 3 for antibody 23904
MQGTHWPT

SEQ ID NO: 47808 - protein, 21 aa, Homo sapiens
  heavy chain complementarity determining region 3 for antibody 23904
AKDRPNYYESNGQYYTPKGDL

SEQ ID NO: 47809 - protein, 9 aa, Homo sapiens
  light chain complementarity determining region 3 for antibody 23905
HQYGSTPYT

SEQ ID NO: 47810 - protein, 18 aa, Homo sapiens
  heavy chain complementarity determining region 3 for antibody 23905
ARTGVWFGDFIVPDAFDI

SEQ ID NO: 47811 - protein, 9 aa, Homo sapiens
  light chain complementarity determining region 3 for antibody 23906
QQYGTPPRT

SEQ ID NO: 47812 - protein, 25 aa, Homo sapiens
  heavy chain complementarity determining region 3 for antibody 23906
ARLRVDRLRLPGAMRGPLYDRGLNV

SEQ ID NO: 47813 - protein, 8 aa, Homo sapiens
  light chain complementarity determining region 3 for antibody 23907
QQYDNVPT

SEQ ID NO: 47814 - protein, 15 aa, Homo sapiens
  heavy chain complementarity determining region 3 for antibody 23907
ARTSTIFGMVIAFDY

SEQ ID NO: 47815 - protein, 8 aa, Homo sapiens
  light chain complementarity determining region 3 for antibody 23908
QQYKTDST

SEQ ID NO: 47816 - protein, 16 aa, Homo sapiens
  heavy chain complementarity determining region 3 for antibody 23908
ARDGLPVTSKPYYFDY

SEQ ID NO: 47817 - protein, 9 aa, Homo sapiens
  light chain complementarity determining region 3 for antibody 23909
QQYGTSWYT

SEQ ID NO: 47818 - protein, 12 aa, Homo sapiens
  heavy chain complementarity determining region 3 for antibody 23909
ARESEDDDAFDI

SEQ ID NO: 47819 - protein, 9 aa, Homo sapiens
  light chain complementarity determining region 3 for antibody 23910
LQDYTYPRT

SEQ ID NO: 47820 - protein, 20 aa, Homo sapiens
  heavy chain complementarity determining region 3 for antibody 23910
ARDLNHENLGGGYYYDVFDL

SEQ ID NO: 47821 - protein, 9 aa, Homo sapiens
  light chain complementarity determining region 3 for antibody 23911
LQDYNYPYT

SEQ ID NO: 47822 - protein, 17 aa, Homo sapiens
  heavy chain complementarity determining region 3 for antibody 23911
ASLAGIAAAGKKYYFDY

SEQ ID NO: 47823 - protein, 9 aa, Homo sapiens
  light chain complementarity determining region 3 for antibody 23912
HHTYTFPRT

SEQ ID NO: 47824 - protein, 20 aa, Homo sapiens
  heavy chain complementarity determining region 3 for antibody 23912
ARGRRIAALSTAHYYYGMDV

SEQ ID NO: 47825 - protein, 9 aa, Homo sapiens
  light chain complementarity determining region 3 for antibody 23913
QQYGSSPRT

SEQ ID NO: 47826 - protein, 13 aa, Homo sapiens
  heavy chain complementarity determining region 3 for antibody 23913
GKGYPNIYKVYDY

SEQ ID NO: 47827 - protein, 9 aa, Homo sapiens
  light chain complementarity determining region 3 for antibody 23914
QQYGSSPLT

SEQ ID NO: 47828 - protein, 17 aa, Homo sapiens
  heavy chain complementarity determining region 3 for antibody 23914
ARVLTSVTSGIYYGFDV

SEQ ID NO: 47829 - protein, 9 aa, Homo sapiens
  light chain complementarity determining region 3 for antibody 23915
QQGYSSPLS

SEQ ID NO: 47830 - protein, 15 aa, Homo sapiens
  heavy chain complementarity determining region 3 for antibody 23915
ARAQVIWGQLYYFDS

SEQ ID NO: 47831 - protein, 9 aa, Homo sapiens
  light chain complementarity determining region 3 for antibody 23916
MQGTHWPRT

SEQ ID NO: 47832 - protein, 12 aa, Homo sapiens
  heavy chain complementarity determining region 3 for antibody 23916
ATLSMANAKFDH

SEQ ID NO: 47833 - protein, 9 aa, Homo sapiens
  light chain complementarity determining region 3 for antibody 23917
QQYQTYPYT

SEQ ID NO: 47834 - protein, 13 aa, Homo sapiens
  heavy chain complementarity determining region 3 for antibody 23917
AHIAYGGYAYFDH

SEQ ID NO: 47835 - protein, 9 aa, Homo sapiens
  light chain complementarity determining region 3 for antibody 23918
QQYNNWPLT

SEQ ID NO: 47836 - protein, 19 aa, Homo sapiens
  heavy chain complementarity determining region 3 for antibody 23918
AHRRGTRGIQVDGTYGVDV

SEQ ID NO: 47837 - protein, 9 aa, Homo sapiens
  light chain complementarity determining region 3 for antibody 23919
QQYHRYPWS

SEQ ID NO: 47838 - protein, 19 aa, Homo sapiens
  heavy chain complementarity determining region 3 for antibody 23919
AKDQDEHFCGADRVCFFDS

SEQ ID NO: 47839 - protein, 8 aa, Homo sapiens
  light chain complementarity determining region 3 for antibody 23920
QQYGSSIT

SEQ ID NO: 47840 - protein, 15 aa, Homo sapiens
  heavy chain complementarity determining region 3 for antibody 23920
VRNFGSGTYHDAFHI

SEQ ID NO: 47841 - protein, 9 aa, Homo sapiens
  light chain complementarity determining region 3 for antibody 23921
QQYGSSHIT

SEQ ID NO: 47842 - protein, 23 aa, Homo sapiens
  heavy chain complementarity determining region 3 for antibody 23921
AKDGLESYYDSSGTNLAYWYFDL

SEQ ID NO: 47843 - protein, 9 aa, Homo sapiens
  light chain complementarity determining region 3 for antibody 23922
QQYGNIPRT

SEQ ID NO: 47844 - protein, 13 aa, Homo sapiens
  heavy chain complementarity determining region 3 for antibody 23922
AGGLFHSSGYSEF

SEQ ID NO: 47845 - protein, 10 aa, Homo sapiens
  light chain complementarity determining region 3 for antibody 23923
QQSYNIPPFT

SEQ ID NO: 47846 - protein, 14 aa, Homo sapiens
  heavy chain complementarity determining region 3 for antibody 23923
AKSVGSSWGQRFDS

SEQ ID NO: 47847 - protein, 10 aa, Homo sapiens
  light chain complementarity determining region 3 for antibody 23924
QQFDNRPSLT

SEQ ID NO: 47848 - protein, 11 aa, Homo sapiens
  heavy chain complementarity determining region 3 for antibody 23924
ARAAGGENFDS

SEQ ID NO: 47849 - protein, 9 aa, Homo sapiens
  light chain complementarity determining region 3 for antibody 23925
QQCVSFPIT

SEQ ID NO: 47850 - protein, 12 aa, Homo sapiens
  heavy chain complementarity determining region 3 for antibody 23925
TRHRSSERKFDP

SEQ ID NO: 47851 - protein, 9 aa, Homo sapiens
  light chain complementarity determining region 3 for antibody 23926
MQPLHTPIT

SEQ ID NO: 47852 - protein, 18 aa, Homo sapiens
  heavy chain complementarity determining region 3 for antibody 23926
ARPFYDSYTYHYYYGLDV

SEQ ID NO: 47853 - protein, 9 aa, Homo sapiens
  light chain complementarity determining region 3 for antibody 23927
MQGTYWPHI

SEQ ID NO: 47854 - protein, 11 aa, Homo sapiens
  heavy chain complementarity determining region 3 for antibody 23927
ARDPFFGALDC

SEQ ID NO: 47855 - protein, 9 aa, Homo sapiens
  light chain complementarity determining region 3 for antibody 23928
MQGTHWPLE

SEQ ID NO: 47856 - protein, 18 aa, Homo sapiens
  heavy chain complementarity determining region 3 for antibody 23928
ARDERDTCTNGLCYYFDY

SEQ ID NO: 47857 - protein, 9 aa, Homo sapiens
  light chain complementarity determining region 3 for antibody 23929
MQALETPFT

SEQ ID NO: 47858 - protein, 15 aa, Homo sapiens
  heavy chain complementarity determining region 3 for antibody 23929
VRHYRIITAPLEGDS

SEQ ID NO: 47859 - protein, 9 aa, Homo sapiens
  light chain complementarity determining region 3 for antibody 23930
LQSLQSPFT

SEQ ID NO: 47860 - protein, 13 aa, Homo sapiens
  heavy chain complementarity determining region 3 for antibody 23930
ATSDVWLGELFDF

SEQ ID NO: 47861 - protein, 9 aa, Homo sapiens
  light chain complementarity determining region 3 for antibody 23931
HQYSTSPRT

SEQ ID NO: 47862 - protein, 17 aa, Homo sapiens
  heavy chain complementarity determining region 3 for antibody 23931
VKPREIYSSGWVDAFDM

SEQ ID NO: 47863 - protein, 8 aa, Homo sapiens
  light chain complementarity determining region 3 for antibody 23932
QQYSNWYT

SEQ ID NO: 47864 - protein, 17 aa, Homo sapiens
  heavy chain complementarity determining region 3 for antibody 23932
ASQLIPFGGVIIEGFDY

SEQ ID NO: 47865 - protein, 8 aa, Homo sapiens
  light chain complementarity determining region 3 for antibody 23933
QQYNYFWT

SEQ ID NO: 47866 - protein, 20 aa, Homo sapiens
  heavy chain complementarity determining region 3 for antibody 23933
ARDYGAFCISNSCPLGCFQH

SEQ ID NO: 47867 - protein, 9 aa, Homo sapiens
  light chain complementarity determining region 3 for antibody 23934
QQYGSSRWT

SEQ ID NO: 47868 - protein, 18 aa, Homo sapiens
  heavy chain complementarity determining region 3 for antibody 23934
ARGPDHGSSDRVNYFFDL

SEQ ID NO: 47869 - protein, 9 aa, Homo sapiens
  light chain complementarity determining region 3 for antibody 23935
QQYGSPWWT

SEQ ID NO: 47870 - protein, 15 aa, Homo sapiens
  heavy chain complementarity determining region 3 for antibody 23935
ARHMARDSIGYYHDF

SEQ ID NO: 47871 - protein, 9 aa, Homo sapiens
  light chain complementarity determining region 3 for antibody 23936
QQSTSFPYT

SEQ ID NO: 47872 - protein, 8 aa, Homo sapiens
  heavy chain complementarity determining region 3 for antibody 23936
LSGDSRPD

SEQ ID NO: 47873 - protein, 9 aa, Homo sapiens
  light chain complementarity determining region 3 for antibody 23937
QQRENWPPT

SEQ ID NO: 47874 - protein, 13 aa, Homo sapiens
  heavy chain complementarity determining region 3 for antibody 23937
ARDMDDSGDLFDY

SEQ ID NO: 47875 - protein, 9 aa, Homo sapiens
  light chain complementarity determining region 3 for antibody 23938
QDLNGFPFT

SEQ ID NO: 47876 - protein, 12 aa, Homo sapiens
  heavy chain complementarity determining region 3 for antibody 23938
AIWGGAQGGVEF

SEQ ID NO: 47877 - protein, 9 aa, Homo sapiens
  light chain complementarity determining region 3 for antibody 23939
QQSYSTPVT

SEQ ID NO: 47878 - protein, 21 aa, Homo sapiens
  heavy chain complementarity determining region 3 for antibody 23939
ARGAYQYYYDSSGYSNDAFDI

SEQ ID NO: 47879 - protein, 8 aa, Homo sapiens
  light chain complementarity determining region 3 for antibody 23940
QQRSNWPT

SEQ ID NO: 47880 - protein, 17 aa, Homo sapiens
  heavy chain complementarity determining region 3 for antibody 23940
AKDHGPYSSSPTFSFDY

SEQ ID NO: 47881 - protein, 9 aa, Homo sapiens
  light chain complementarity determining region 3 for antibody 23941
QQHDNLPFT

SEQ ID NO: 47882 - protein, 17 aa, Homo sapiens
  heavy chain complementarity determining region 3 for antibody 23941
AKSRSPGSGGYYNPFDY

SEQ ID NO: 47883 - protein, 9 aa, Homo sapiens
  light chain complementarity determining region 3 for antibody 23942
MQGTHWPYT

SEQ ID NO: 47884 - protein, 11 aa, Homo sapiens
  heavy chain complementarity determining region 3 for antibody 23942
IKDMSPGGADV

SEQ ID NO: 47885 - protein, 9 aa, Homo sapiens
  light chain complementarity determining region 3 for antibody 23943
QQYGSSPWT

SEQ ID NO: 47886 - protein, 12 aa, Homo sapiens
  heavy chain complementarity determining region 3 for antibody 23943
ARGLRLGWGLDY

SEQ ID NO: 47887 - protein, 9 aa, Homo sapiens
  light chain complementarity determining region 3 for antibody 23944
QQSYTTPRT

SEQ ID NO: 47888 - protein, 20 aa, Homo sapiens
  heavy chain complementarity determining region 3 for antibody 23944
ARESGVFPIFDWLPYTWFDP

SEQ ID NO: 47889 - protein, 10 aa, Homo sapiens
  light chain complementarity determining region 3 for antibody 23945
MQSIQPPRWT

SEQ ID NO: 47890 - protein, 8 aa, Homo sapiens
  heavy chain complementarity determining region 3 for antibody 23945
AKGYGFDC

SEQ ID NO: 47891 - protein, 10 aa, Homo sapiens
  light chain complementarity determining region 3 for antibody 23946
MQGTHWPPWT

SEQ ID NO: 47892 - protein, 17 aa, Homo sapiens
  heavy chain complementarity determining region 3 for antibody 23946
VRDGYTASGRRNAPGAN

SEQ ID NO: 47893 - protein, 9 aa, Homo sapiens
  light chain complementarity determining region 3 for antibody 23947
MQALETPLT

SEQ ID NO: 47894 - protein, 19 aa, Homo sapiens
  heavy chain complementarity determining region 3 for antibody 23947
ARATSYSSPWVVFYYGVDL

SEQ ID NO: 47895 - protein, 8 aa, Homo sapiens
  light chain complementarity determining region 3 for antibody 23948
LQYGGSPT

SEQ ID NO: 47896 - protein, 11 aa, Homo sapiens
  heavy chain complementarity determining region 3 for antibody 23948
SMGGGIGVSHR

SEQ ID NO: 47897 - protein, 8 aa, Homo sapiens
  light chain complementarity determining region 3 for antibody 23949
HQSNNFPL

SEQ ID NO: 47898 - protein, 10 aa, Homo sapiens
  heavy chain complementarity determining region 3 for antibody 23949
ARDHSGPLDF

SEQ ID NO: 47899 - protein, 10 aa, Homo sapiens
  light chain complementarity determining region 3 for antibody 23950
QQYNNYPPIT

SEQ ID NO: 47900 - protein, 18 aa, Homo sapiens
  heavy chain complementarity determining region 3 for antibody 23950
AGQYYYDSSGYFLAPLDY

SEQ ID NO: 47901 - protein, 8 aa, Homo sapiens
  light chain complementarity determining region 3 for antibody 23951
QQYNIYPT

SEQ ID NO: 47902 - protein, 13 aa, Homo sapiens
  heavy chain complementarity determining region 3 for antibody 23951
ARSRAGFGEFFGY

SEQ ID NO: 47903 - protein, 9 aa, Homo sapiens
  light chain complementarity determining region 3 for antibody 23952
QQYHALPLT

SEQ ID NO: 47904 - protein, 13 aa, Homo sapiens
  heavy chain complementarity determining region 3 for antibody 23952
ARDGVPGKFNRAH

SEQ ID NO: 47905 - protein, 9 aa, Homo sapiens
  light chain complementarity determining region 3 for antibody 23953
QQYGSTTLT

SEQ ID NO: 47906 - protein, 15 aa, Homo sapiens
  heavy chain complementarity determining region 3 for antibody 23953
ARGPHPPYYGGFFHR

SEQ ID NO: 47907 - protein, 9 aa, Homo sapiens
  light chain complementarity determining region 3 for antibody 23954
QQYDSLPWT

SEQ ID NO: 47908 - protein, 19 aa, Homo sapiens
  heavy chain complementarity determining region 3 for antibody 23954
ARTAIGKRYWASSGDQFDY

SEQ ID NO: 47909 - protein, 9 aa, Homo sapiens
  light chain complementarity determining region 3 for antibody 23955
QQSYSNVWT

SEQ ID NO: 47910 - protein, 12 aa, Homo sapiens
  heavy chain complementarity determining region 3 for antibody 23955
ARAPALRSGLNY

SEQ ID NO: 47911 - protein, 9 aa, Homo sapiens
  light chain complementarity determining region 3 for antibody 23956
QQSYFTPYT

SEQ ID NO: 47912 - protein, 15 aa, Homo sapiens
  heavy chain complementarity determining region 3 for antibody 23956
VRDSKIRGLTDWFDP

SEQ ID NO: 47913 - protein, 9 aa, Homo sapiens
  light chain complementarity determining region 3 for antibody 23957
QQSYEIPWT

SEQ ID NO: 47914 - protein, 18 aa, Homo sapiens
  heavy chain complementarity determining region 3 for antibody 23957
ARQEGYCSGGSCYSGSDF

SEQ ID NO: 47915 - protein, 9 aa, Homo sapiens
  light chain complementarity determining region 3 for antibody 23958
QQSYDNART

SEQ ID NO: 47916 - protein, 13 aa, Homo sapiens
  heavy chain complementarity determining region 3 for antibody 23958
ARRDAYNFSGLDY

SEQ ID NO: 47917 - protein, 9 aa, Homo sapiens
  light chain complementarity determining region 3 for antibody 23959
QQLNSYPIT

SEQ ID NO: 47918 - protein, 22 aa, Homo sapiens
  heavy chain complementarity determining region 3 for antibody 23959
AREPHSSSSQTQHYYYYYGMDV

SEQ ID NO: 47919 - protein, 9 aa, Homo sapiens
  light chain complementarity determining region 3 for antibody 23960
QQFNSYPLT

SEQ ID NO: 47920 - protein, 19 aa, Homo sapiens
  heavy chain complementarity determining region 3 for antibody 23960
ARDGRRAARGIIIYNWVDP

SEQ ID NO: 47921 - protein, 9 aa, Homo sapiens
  light chain complementarity determining region 3 for antibody 23961
HQYGESPRM

SEQ ID NO: 47922 - protein, 16 aa, Homo sapiens
  heavy chain complementarity determining region 3 for antibody 23961
AKSLGVDAMTTRVYDS

SEQ ID NO: 47923 - protein, 10 aa, Homo sapiens
  light chain complementarity determining region 3 for antibody 23962
QQYNIRPPDT

SEQ ID NO: 47924 - protein, 14 aa, Homo sapiens
  heavy chain complementarity determining region 3 for antibody 23962
ARDPPGIALAGNSG

SEQ ID NO: 47925 - protein, 9 aa, Homo sapiens
  light chain complementarity determining region 3 for antibody 23963
QHYYSYPWT

SEQ ID NO: 47926 - protein, 17 aa, Homo sapiens
  heavy chain complementarity determining region 3 for antibody 23963
ANFIYDGLTGHPRPWDY

SEQ ID NO: 47927 - protein, 10 aa, Homo sapiens
  light chain complementarity determining region 3 for antibody 23964
QHYKNWPRGT

SEQ ID NO: 47928 - protein, 15 aa, Homo sapiens
  heavy chain complementarity determining region 3 for antibody 23964
ARLGGRLLRSAPFDY

SEQ ID NO: 47929 - protein, 9 aa, Homo sapiens
  light chain complementarity determining region 3 for antibody 23965
QHHQTYWPT

SEQ ID NO: 47930 - protein, 12 aa, Homo sapiens
  heavy chain complementarity determining region 3 for antibody 23965
AGDPSGNSYFDY

SEQ ID NO: 47931 - protein, 10 aa, Homo sapiens
  light chain complementarity determining region 3 for antibody 23966
QHFDTSPPYI

SEQ ID NO: 47932 - protein, 13 aa, Homo sapiens
  heavy chain complementarity determining region 3 for antibody 23966
VRERSGAYPAHDY

SEQ ID NO: 47933 - protein, 9 aa, Homo sapiens
  light chain complementarity determining region 3 for antibody 23967
QQYVTSPWT

SEQ ID NO: 47934 - protein, 12 aa, Homo sapiens
  heavy chain complementarity determining region 3 for antibody 23967
SRGLRSGWGLDY

SEQ ID NO: 47935 - protein, 10 aa, Homo sapiens
  light chain complementarity determining region 3 for antibody 23968
QQYNVYSGLT

SEQ ID NO: 47936 - protein, 7 aa, Homo sapiens
  heavy chain complementarity determining region 3 for antibody 23968
ARGLGFD

SEQ ID NO: 47937 - protein, 9 aa, Homo sapiens
  light chain complementarity determining region 3 for antibody 23969
QQYGSSPWT

SEQ ID NO: 47938 - protein, 20 aa, Homo sapiens
  heavy chain complementarity determining region 3 for antibody 23969
ARLKAASAGLPSYYYAGMDV

SEQ ID NO: 47939 - protein, 10 aa, Homo sapiens
  light chain complementarity determining region 3 for antibody 23970
QQYDSSSYFT

SEQ ID NO: 47940 - protein, 14 aa, Homo sapiens
  heavy chain complementarity determining region 3 for antibody 23970
ASVKRGGGRPRFDN

SEQ ID NO: 47941 - protein, 9 aa, Homo sapiens
  light chain complementarity determining region 3 for antibody 23971
QQYDSLPYT

SEQ ID NO: 47942 - protein, 17 aa, Homo sapiens
  heavy chain complementarity determining region 3 for antibody 23971
ARSRGYSRGWYSGQFDN

SEQ ID NO: 47943 - protein, 9 aa, Homo sapiens
  light chain complementarity determining region 3 for antibody 23972
QQGNTFPLT

SEQ ID NO: 47944 - protein, 16 aa, Homo sapiens
  heavy chain complementarity determining region 3 for antibody 23972
ARGQSIWDDGYLGLDV

SEQ ID NO: 47945 - protein, 9 aa, Homo sapiens
  light chain complementarity determining region 3 for antibody 23973
QHSFNTPYT

SEQ ID NO: 47946 - protein, 14 aa, Homo sapiens
  heavy chain complementarity determining region 3 for antibody 23973
ARLGTMASRHPLDY

SEQ ID NO: 47947 - protein, 9 aa, Homo sapiens
  light chain complementarity determining region 3 for antibody 23974
QHLFSYPPT

SEQ ID NO: 47948 - protein, 14 aa, Homo sapiens
  heavy chain complementarity determining region 3 for antibody 23974
ARENSVTGTRAYDF

SEQ ID NO: 47949 - protein, 9 aa, Homo sapiens
  light chain complementarity determining region 3 for antibody 23975
LQYGFAQYS

SEQ ID NO: 47950 - protein, 18 aa, Homo sapiens
  heavy chain complementarity determining region 3 for antibody 23975
TGVHGLTMLRGATKPFDF

SEQ ID NO: 47951 - protein, 9 aa, Homo sapiens
  light chain complementarity determining region 3 for antibody 23976
QQYKADPWT

SEQ ID NO: 47952 - protein, 13 aa, Homo sapiens
  heavy chain complementarity determining region 3 for antibody 23976
IRWQEYSVSSGPD

SEQ ID NO: 47953 - protein, 9 aa, Homo sapiens
  light chain complementarity determining region 3 for antibody 23977
QQYHNSRWT

SEQ ID NO: 47954 - protein, 11 aa, Homo sapiens
  heavy chain complementarity determining region 3 for antibody 23977
AQSPSANIADV

SEQ ID NO: 47955 - protein, 9 aa, Homo sapiens
  light chain complementarity determining region 3 for antibody 23978
QQYDTFPLT

SEQ ID NO: 47956 - protein, 17 aa, Homo sapiens
  heavy chain complementarity determining region 3 for antibody 23978
ATAGSLSYSGGTMYLDN

SEQ ID NO: 47957 - protein, 8 aa, Homo sapiens
  light chain complementarity determining region 3 for antibody 23979
QQYDNLPT

SEQ ID NO: 47958 - protein, 14 aa, Homo sapiens
  heavy chain complementarity determining region 3 for antibody 23979
AKDWDSSGSNCFDP

SEQ ID NO: 47959 - protein, 9 aa, Homo sapiens
  light chain complementarity determining region 3 for antibody 23980
QQVHSFPPT

SEQ ID NO: 47960 - protein, 12 aa, Homo sapiens
  heavy chain complementarity determining region 3 for antibody 23980
ARDTDGSFGLDV

SEQ ID NO: 47961 - protein, 9 aa, Homo sapiens
  light chain complementarity determining region 3 for antibody 23981
QQSYITPIT

SEQ ID NO: 47962 - protein, 16 aa, Homo sapiens
  heavy chain complementarity determining region 3 for antibody 23981
ARDVGGSYATWDYFDN

SEQ ID NO: 47963 - protein, 10 aa, Homo sapiens
  light chain complementarity determining region 3 for antibody 23982
QQFGNSPPWT

SEQ ID NO: 47964 - protein, 12 aa, Homo sapiens
  heavy chain complementarity determining region 3 for antibody 23982
AKEGLIGGYFDL

SEQ ID NO: 47965 - protein, 11 aa, Homo sapiens
  light chain complementarity determining region 3 for antibody 23983
QQFDTLPPRLT

SEQ ID NO: 47966 - protein, 13 aa, Homo sapiens
  heavy chain complementarity determining region 3 for antibody 23983
ATSRTAAAFVDLP

SEQ ID NO: 47967 - protein, 9 aa, Homo sapiens
  light chain complementarity determining region 3 for antibody 23984
MQALQTPRT

SEQ ID NO: 47968 - protein, 18 aa, Homo sapiens
  heavy chain complementarity determining region 3 for antibody 23984
ATSGCRSTSCYADYGMDV

SEQ ID NO: 47969 - protein, 8 aa, Homo sapiens
  light chain complementarity determining region 3 for antibody 23985
MKGTQGRP

SEQ ID NO: 47970 - protein, 15 aa, Homo sapiens
  heavy chain complementarity determining region 3 for antibody 23985
ATDWSFQMIEGNFHH

SEQ ID NO: 47971 - protein, 9 aa, Homo sapiens
  light chain complementarity determining region 3 for antibody 23986
LQYKSYPRT

SEQ ID NO: 47972 - protein, 6 aa, Homo sapiens
  heavy chain complementarity determining region 3 for antibody 23986
TRALDY

SEQ ID NO: 47973 - protein, 9 aa, Homo sapiens
  light chain complementarity determining region 3 for antibody 23987
LQYHSFPLT

SEQ ID NO: 47974 - protein, 5 aa, Homo sapiens
  heavy chain complementarity determining region 3 for antibody 23987
ARGDY

SEQ ID NO: 47975 - protein, 9 aa, Homo sapiens
  light chain complementarity determining region 3 for antibody 23988
QQYNNWPRT

SEQ ID NO: 47976 - protein, 15 aa, Homo sapiens
  heavy chain complementarity determining region 3 for antibody 23988
ARAPTYSSSSGYLDN

SEQ ID NO: 47977 - protein, 9 aa, Homo sapiens
  light chain complementarity determining region 3 for antibody 23989
QQYNNWPNT

SEQ ID NO: 47978 - protein, 16 aa, Homo sapiens
  heavy chain complementarity determining region 3 for antibody 23989
ARGLSSLASKPGACDF

SEQ ID NO: 47979 - protein, 9 aa, Homo sapiens
  light chain complementarity determining region 3 for antibody 23990
QQYGSSPWT

SEQ ID NO: 47980 - protein, 14 aa, Homo sapiens
  heavy chain complementarity determining region 3 for antibody 23990
ARGQSGSLYDTFDM

SEQ ID NO: 47981 - protein, 9 aa, Homo sapiens
  light chain complementarity determining region 3 for antibody 23991
QQSFLAPLT

SEQ ID NO: 47982 - protein, 12 aa, Homo sapiens
  heavy chain complementarity determining region 3 for antibody 23991
ARFVSGYEAFDV

SEQ ID NO: 47983 - protein, 10 aa, Homo sapiens
  light chain complementarity determining region 3 for antibody 23992
QQRSNWPPIT

SEQ ID NO: 47984 - protein, 12 aa, Homo sapiens
  heavy chain complementarity determining region 3 for antibody 23992
VKDWGAVAGHDY

SEQ ID NO: 47985 - protein, 9 aa, Homo sapiens
  light chain complementarity determining region 3 for antibody 23993
QQLNTYPIT

SEQ ID NO: 47986 - protein, 19 aa, Homo sapiens
  heavy chain complementarity determining region 3 for antibody 23993
TRDVIRKCGSDCYFWYFDL

SEQ ID NO: 47987 - protein, 9 aa, Homo sapiens
  light chain complementarity determining region 3 for antibody 23994
QQFDNYPLT

SEQ ID NO: 47988 - protein, 20 aa, Homo sapiens
  heavy chain complementarity determining region 3 for antibody 23994
ARDLGRSGSIGIIRNDAFNV

SEQ ID NO: 47989 - protein, 9 aa, Homo sapiens
  light chain complementarity determining region 3 for antibody 23995
LQYNSYPRT

SEQ ID NO: 47990 - protein, 9 aa, Homo sapiens
  heavy chain complementarity determining region 3 for antibody 23995
ARGGWATDY

SEQ ID NO: 47991 - protein, 10 aa, Homo sapiens
  light chain complementarity determining region 3 for antibody 23996
LQFNTWPPLT

SEQ ID NO: 47992 - protein, 14 aa, Homo sapiens
  heavy chain complementarity determining region 3 for antibody 23996
ARSKWEAPGTPPDY

SEQ ID NO: 47993 - protein, 9 aa, Homo sapiens
  light chain complementarity determining region 3 for antibody 23997
QQYHTSPRT

SEQ ID NO: 47994 - protein, 14 aa, Homo sapiens
  heavy chain complementarity determining region 3 for antibody 23997
AREGDLDFHYGMDV

SEQ ID NO: 47995 - protein, 10 aa, Homo sapiens
  light chain complementarity determining region 3 for antibody 23998
QQYGSSTPFT

SEQ ID NO: 47996 - protein, 13 aa, Homo sapiens
  heavy chain complementarity determining region 3 for antibody 23998
ARVVVPGRGYFQH

SEQ ID NO: 47997 - protein, 11 aa, Homo sapiens
  light chain complementarity determining region 3 for antibody 23999
QQYETSPPGYT

SEQ ID NO: 47998 - protein, 14 aa, Homo sapiens
  heavy chain complementarity determining region 3 for antibody 23999
ARENSISRKRSFDQ

SEQ ID NO: 47999 - protein, 9 aa, Homo sapiens
  light chain complementarity determining region 3 for antibody 24000
QQSYSTPKT

SEQ ID NO: 48000 - protein, 15 aa, Homo sapiens
  heavy chain complementarity determining region 3 for antibody 24000
ARDRGQLWSEDAFDI

SEQ ID NO: 48001 - protein, 9 aa, Homo sapiens
  light chain complementarity determining region 3 for antibody 24001
QQSYSTPIT

SEQ ID NO: 48002 - protein, 16 aa, Homo sapiens
  heavy chain complementarity determining region 3 for antibody 24001
ARDVGGSYATWDYFDY

SEQ ID NO: 48003 - protein, 9 aa, Homo sapiens
  light chain complementarity determining region 3 for antibody 24002
QQSYSTPFT

SEQ ID NO: 48004 - protein, 12 aa, Homo sapiens
  heavy chain complementarity determining region 3 for antibody 24002
ARGGSYYGVWVD

SEQ ID NO: 48005 - protein, 10 aa, Homo sapiens
  light chain complementarity determining region 3 for antibody 24003
QQSYSTLLLT

SEQ ID NO: 48006 - protein, 20 aa, Homo sapiens
  heavy chain complementarity determining region 3 for antibody 24003
AREVYYDRSGYYYNHKWFDP

SEQ ID NO: 48007 - protein, 9 aa, Homo sapiens
  light chain complementarity determining region 3 for antibody 24004
QQSSQTPTT

SEQ ID NO: 48008 - protein, 15 aa, Homo sapiens
  heavy chain complementarity determining region 3 for antibody 24004
ARDQSDHYPVFNFDN

SEQ ID NO: 48009 - protein, 9 aa, Homo sapiens
  light chain complementarity determining region 3 for antibody 24005
QQRSNWPWT

SEQ ID NO: 48010 - protein, 11 aa, Homo sapiens
  heavy chain complementarity determining region 3 for antibody 24005
VHMFTDYYFES

SEQ ID NO: 48011 - protein, 11 aa, Homo sapiens
  light chain complementarity determining region 3 for antibody 24006
QQRSNWPPMVT

SEQ ID NO: 48012 - protein, 13 aa, Homo sapiens
  heavy chain complementarity determining region 3 for antibody 24006
ATDRAAGKYYFSF

SEQ ID NO: 48013 - protein, 12 aa, Homo sapiens
  light chain complementarity determining region 3 for antibody 24007
QQLNNYSPFRVS

SEQ ID NO: 48014 - protein, 15 aa, Homo sapiens
  heavy chain complementarity determining region 3 for antibody 24007
ARGITLGRGSWSFDY

SEQ ID NO: 48015 - protein, 10 aa, Homo sapiens
  light chain complementarity determining region 3 for antibody 24008
QQFGNSPLYT

SEQ ID NO: 48016 - protein, 23 aa, Homo sapiens
  heavy chain complementarity determining region 3 for antibody 24008
ARGRREYFWGSYRNAPYYYGMEI

SEQ ID NO: 48017 - protein, 11 aa, Homo sapiens
  light chain complementarity determining region 3 for antibody 24009
QQANSFLGGFT

SEQ ID NO: 48018 - protein, 17 aa, Homo sapiens
  heavy chain complementarity determining region 3 for antibody 24009
TRDRIRAVAYYYYGMDV

SEQ ID NO: 48019 - protein, 9 aa, Homo sapiens
  light chain complementarity determining region 3 for antibody 24010
MQGTRWPYT

SEQ ID NO: 48020 - protein, 10 aa, Homo sapiens
  heavy chain complementarity determining region 3 for antibody 24010
ARNSGWSVDC

SEQ ID NO: 48021 - protein, 9 aa, Homo sapiens
  light chain complementarity determining region 3 for antibody 24011
LQDSTFPPT

SEQ ID NO: 48022 - protein, 16 aa, Homo sapiens
  heavy chain complementarity determining region 3 for antibody 24011
ARSGFEVDVGSTVIDY

SEQ ID NO: 48023 - protein, 8 aa, Homo sapiens
  light chain complementarity determining region 3 for antibody 24012
QQYSRSRT

SEQ ID NO: 48024 - protein, 19 aa, Homo sapiens
  heavy chain complementarity determining region 3 for antibody 24012
ARDGVTCSGGSCIETAVDS

SEQ ID NO: 48025 - protein, 10 aa, Homo sapiens
  light chain complementarity determining region 3 for antibody 24013
QQYNNWPPLT

SEQ ID NO: 48026 - protein, 17 aa, Homo sapiens
  heavy chain complementarity determining region 3 for antibody 24013
ARDRLLLRASGGGGFDF

SEQ ID NO: 48027 - protein, 9 aa, Homo sapiens
  light chain complementarity determining region 3 for antibody 24014
QQYGTSPLT

SEQ ID NO: 48028 - protein, 14 aa, Homo sapiens
  heavy chain complementarity determining region 3 for antibody 24014
ARRARGWGSNYFDY

SEQ ID NO: 48029 - protein, 9 aa, Homo sapiens
  light chain complementarity determining region 3 for antibody 24015
QQYGSTRGT

SEQ ID NO: 48030 - protein, 16 aa, Homo sapiens
  heavy chain complementarity determining region 3 for antibody 24015
ARVVWGASWYVGYFDL

SEQ ID NO: 48031 - protein, 9 aa, Homo sapiens
  light chain complementarity determining region 3 for antibody 24016
QQYDNLPPT

SEQ ID NO: 48032 - protein, 17 aa, Homo sapiens
  heavy chain complementarity determining region 3 for antibody 24016
ATSTTAREGYNVALFDY

SEQ ID NO: 48033 - protein, 9 aa, Homo sapiens
  light chain complementarity determining region 3 for antibody 24017
QQYDGYSVS

SEQ ID NO: 48034 - protein, 11 aa, Homo sapiens
  heavy chain complementarity determining region 3 for antibody 24017
ARGNSGYHIEY

SEQ ID NO: 48035 - protein, 9 aa, Homo sapiens
  light chain complementarity determining region 3 for antibody 24018
QQSYSMPLT

SEQ ID NO: 48036 - protein, 15 aa, Homo sapiens
  heavy chain complementarity determining region 3 for antibody 24018
ARDQTMIVLDWKFDL

SEQ ID NO: 48037 - protein, 9 aa, Homo sapiens
  light chain complementarity determining region 3 for antibody 24019
QQSYNTPWT

SEQ ID NO: 48038 - protein, 16 aa, Homo sapiens
  heavy chain complementarity determining region 3 for antibody 24019
TTDSLTMVRGEGVFDY

SEQ ID NO: 48039 - protein, 8 aa, Homo sapiens
  light chain complementarity determining region 3 for antibody 24020
QQRSSRLS

SEQ ID NO: 48040 - protein, 11 aa, Homo sapiens
  heavy chain complementarity determining region 3 for antibody 24020
ASGSMGWVFDY

SEQ ID NO: 48041 - protein, 8 aa, Homo sapiens
  light chain complementarity determining region 3 for antibody 24021
QQRHSWPT

SEQ ID NO: 48042 - protein, 11 aa, Homo sapiens
  heavy chain complementarity determining region 3 for antibody 24021
ARDDRRELPEL

SEQ ID NO: 48043 - protein, 9 aa, Homo sapiens
  light chain complementarity determining region 3 for antibody 24022
QQGLTTPRT

SEQ ID NO: 48044 - protein, 13 aa, Homo sapiens
  heavy chain complementarity determining region 3 for antibody 24022
TTDHHLKPNAFDF

SEQ ID NO: 48045 - protein, 11 aa, Homo sapiens
  light chain complementarity determining region 3 for antibody 24023
QLYERSLPMYS

SEQ ID NO: 48046 - protein, 14 aa, Homo sapiens
  heavy chain complementarity determining region 3 for antibody 24023
ASHIVINGKRGFDH

SEQ ID NO: 48047 - protein, 6 aa, Homo sapiens
  light chain complementarity determining region 3 for antibody 24024
QHRGRS

SEQ ID NO: 48048 - protein, 17 aa, Homo sapiens
  heavy chain complementarity determining region 3 for antibody 24024
ATFSRQVVTGYYWYFDL

SEQ ID NO: 48049 - protein, 9 aa, Homo sapiens
  light chain complementarity determining region 3 for antibody 24025
MQVLQSPLS

SEQ ID NO: 48050 - protein, 12 aa, Homo sapiens
  heavy chain complementarity determining region 3 for antibody 24025
TRDPDSHYGMEV

SEQ ID NO: 48051 - protein, 8 aa, Homo sapiens
  light chain complementarity determining region 3 for antibody 24026
MQALQTLT

SEQ ID NO: 48052 - protein, 16 aa, Homo sapiens
  heavy chain complementarity determining region 3 for antibody 24026
AKAGWLVGYDLSRGCA

SEQ ID NO: 48053 - protein, 9 aa, Homo sapiens
  light chain complementarity determining region 3 for antibody 24027
LQYGGTPLT

SEQ ID NO: 48054 - protein, 8 aa, Homo sapiens
  heavy chain complementarity determining region 3 for antibody 24027
VRIMDPGY

SEQ ID NO: 48055 - protein, 9 aa, Homo sapiens
  light chain complementarity determining region 3 for antibody 24028
LQHNAFPYT

SEQ ID NO: 48056 - protein, 16 aa, Homo sapiens
  heavy chain complementarity determining region 3 for antibody 24028
TFFYSCSPTGICARNY

SEQ ID NO: 48057 - protein, 9 aa, Homo sapiens
  light chain complementarity determining region 3 for antibody 24029
HQYHSSPRT

SEQ ID NO: 48058 - protein, 13 aa, Homo sapiens
  heavy chain complementarity determining region 3 for antibody 24029
ARTGRISGVEGAT

SEQ ID NO: 48059 - protein, 9 aa, Homo sapiens
  light chain complementarity determining region 3 for antibody 24030
QQYSRSPVT

SEQ ID NO: 48060 - protein, 15 aa, Homo sapiens
  heavy chain complementarity determining region 3 for antibody 24030
AREPNSYGLEYYFTY

SEQ ID NO: 48061 - protein, 9 aa, Homo sapiens
  light chain complementarity determining region 3 for antibody 24031
QQYNSYSWT

SEQ ID NO: 48062 - protein, 20 aa, Homo sapiens
  heavy chain complementarity determining region 3 for antibody 24031
VRVKHYHDSSGYYYYYGMDV

SEQ ID NO: 48063 - protein, 8 aa, Homo sapiens
  light chain complementarity determining region 3 for antibody 24032
QQYNSYFT

SEQ ID NO: 48064 - protein, 17 aa, Homo sapiens
  heavy chain complementarity determining region 3 for antibody 24032
ARDVLLWFGERSGVFDI

SEQ ID NO: 48065 - protein, 9 aa, Homo sapiens
  light chain complementarity determining region 3 for antibody 24033
QQYNNFPWT

SEQ ID NO: 48066 - protein, 23 aa, Homo sapiens
  heavy chain complementarity determining region 3 for antibody 24033
TRGKFRFLQWVETSYSYYYDMDV

SEQ ID NO: 48067 - protein, 9 aa, Homo sapiens
  light chain complementarity determining region 3 for antibody 24034
QQYNGFPLT

SEQ ID NO: 48068 - protein, 16 aa, Homo sapiens
  heavy chain complementarity determining region 3 for antibody 24034
ARALSGTYPGSRVFDY

SEQ ID NO: 48069 - protein, 9 aa, Homo sapiens
  light chain complementarity determining region 3 for antibody 24035
QQYGSSPQT

SEQ ID NO: 48070 - protein, 11 aa, Homo sapiens
  heavy chain complementarity determining region 3 for antibody 24035
AKDNSNYLFDY

SEQ ID NO: 48071 - protein, 9 aa, Homo sapiens
  light chain complementarity determining region 3 for antibody 24036
QQYGSSPGT

SEQ ID NO: 48072 - protein, 20 aa, Homo sapiens
  heavy chain complementarity determining region 3 for antibody 24036
ARVYKLSAFRGGGWYGAFDI

SEQ ID NO: 48073 - protein, 9 aa, Homo sapiens
  light chain complementarity determining region 3 for antibody 24037
QQYGSSLIT

SEQ ID NO: 48074 - protein, 13 aa, Homo sapiens
  heavy chain complementarity determining region 3 for antibody 24037
ARGSGSHQDECDY

SEQ ID NO: 48075 - protein, 9 aa, Homo sapiens
  light chain complementarity determining region 3 for antibody 24038
QQYGNLPRT

SEQ ID NO: 48076 - protein, 13 aa, Homo sapiens
  heavy chain complementarity determining region 3 for antibody 24038
AGGDFHRGGYSEY

SEQ ID NO: 48077 - protein, 10 aa, Homo sapiens
  light chain complementarity determining region 3 for antibody 24039
QQYGGSPGWT

SEQ ID NO: 48078 - protein, 14 aa, Homo sapiens
  heavy chain complementarity determining region 3 for antibody 24039
ARHGGWRLLEPLDY

SEQ ID NO: 48079 - protein, 10 aa, Homo sapiens
  light chain complementarity determining region 3 for antibody 24040
QQRSNWPPLT

SEQ ID NO: 48080 - protein, 15 aa, Homo sapiens
  heavy chain complementarity determining region 3 for antibody 24040
ARLAMVTGRGTDFDY

SEQ ID NO: 48081 - protein, 8 aa, Homo sapiens
  light chain complementarity determining region 3 for antibody 24041
QQRSDLIT

SEQ ID NO: 48082 - protein, 18 aa, Homo sapiens
  heavy chain complementarity determining region 3 for antibody 24041
AKGSVRSCSSRNCYYFDS

SEQ ID NO: 48083 - protein, 9 aa, Homo sapiens
  light chain complementarity determining region 3 for antibody 24042
QHRNSWPYT

SEQ ID NO: 48084 - protein, 15 aa, Homo sapiens
  heavy chain complementarity determining region 3 for antibody 24042
AKEGYYVDGSGYCPN

SEQ ID NO: 48085 - protein, 8 aa, Homo sapiens
  light chain complementarity determining region 3 for antibody 24043
MQALQTPT

SEQ ID NO: 48086 - protein, 15 aa, Homo sapiens
  heavy chain complementarity determining region 3 for antibody 24043
ARRDYYDSSGYRLDY

SEQ ID NO: 48087 - protein, 9 aa, Homo sapiens
  light chain complementarity determining region 3 for antibody 24044
VQDATPPYT

SEQ ID NO: 48088 - protein, 15 aa, Homo sapiens
  heavy chain complementarity determining region 3 for antibody 24044
ARDGYDYGGYVAFDV

SEQ ID NO: 48089 - protein, 9 aa, Homo sapiens
  light chain complementarity determining region 3 for antibody 24045
QQYGSSWVT

SEQ ID NO: 48090 - protein, 20 aa, Homo sapiens
  heavy chain complementarity determining region 3 for antibody 24045
AREGGHRQWLEIYDPGYFHH

SEQ ID NO: 48091 - protein, 9 aa, Homo sapiens
  light chain complementarity determining region 3 for antibody 24046
QQYGSSPRT

SEQ ID NO: 48092 - protein, 13 aa, Homo sapiens
  heavy chain complementarity determining region 3 for antibody 24046
ASSGYGDYDDLPY

SEQ ID NO: 48093 - protein, 9 aa, Homo sapiens
  light chain complementarity determining region 3 for antibody 24047
QQYGSSPQT

SEQ ID NO: 48094 - protein, 8 aa, Homo sapiens
  heavy chain complementarity determining region 3 for antibody 24047
TRGGDFDY

SEQ ID NO: 48095 - protein, 9 aa, Homo sapiens
  light chain complementarity determining region 3 for antibody 24048
QQYDTYPYT

SEQ ID NO: 48096 - protein, 6 aa, Homo sapiens
  heavy chain complementarity determining region 3 for antibody 24048
MTMGAT

SEQ ID NO: 48097 - protein, 9 aa, Homo sapiens
  light chain complementarity determining region 3 for antibody 24049
QQYDTYPPT

SEQ ID NO: 48098 - protein, 16 aa, Homo sapiens
  heavy chain complementarity determining region 3 for antibody 24049
ARRSSPGSLGIRWFDP

SEQ ID NO: 48099 - protein, 10 aa, Homo sapiens
  light chain complementarity determining region 3 for antibody 24050
QQSHNNTPYT

SEQ ID NO: 48100 - protein, 21 aa, Homo sapiens
  heavy chain complementarity determining region 3 for antibody 24050
ARTGRHYSDSTVYYYRPRIDY

SEQ ID NO: 48101 - protein, 8 aa, Homo sapiens
  light chain complementarity determining region 3 for antibody 24051
QQSDSTPT

SEQ ID NO: 48102 - protein, 13 aa, Homo sapiens
  heavy chain complementarity determining region 3 for antibody 24051
ARPTSDYNWNFGY

SEQ ID NO: 48103 - protein, 9 aa, Homo sapiens
  light chain complementarity determining region 3 for antibody 24052
QQSDSTPLT

SEQ ID NO: 48104 - protein, 14 aa, Homo sapiens
  heavy chain complementarity determining region 3 for antibody 24052
AKAIAPSGWYYFDY

SEQ ID NO: 48105 - protein, 9 aa, Homo sapiens
  light chain complementarity determining region 3 for antibody 24053
QQLNGNSPT

SEQ ID NO: 48106 - protein, 17 aa, Homo sapiens
  heavy chain complementarity determining region 3 for antibody 24053
ARVVLSTSGWDMIGFDI

SEQ ID NO: 48107 - protein, 9 aa, Homo sapiens
  light chain complementarity determining region 3 for antibody 24054
QQANTFPLT

SEQ ID NO: 48108 - protein, 20 aa, Homo sapiens
  heavy chain complementarity determining region 3 for antibody 24054
ARDSNTPTLSDYDYHYGMDV

SEQ ID NO: 48109 - protein, 9 aa, Homo sapiens
  light chain complementarity determining region 3 for antibody 24055
MQALQTPYT

SEQ ID NO: 48110 - protein, 9 aa, Homo sapiens
  heavy chain complementarity determining region 3 for antibody 24055
ARGDGAMDV

SEQ ID NO: 48111 - protein, 7 aa, Homo sapiens
  light chain complementarity determining region 3 for antibody 24056
MQALQTL

SEQ ID NO: 48112 - protein, 15 aa, Homo sapiens
  heavy chain complementarity determining region 3 for antibody 24056
ARGGYGGSLYWYFDL

SEQ ID NO: 48113 - protein, 10 aa, Homo sapiens
  light chain complementarity determining region 3 for antibody 24057
LQYNNWPPYT

SEQ ID NO: 48114 - protein, 19 aa, Homo sapiens
  heavy chain complementarity determining region 3 for antibody 24057
ATVSPHHDGGGYAPNWLDP

SEQ ID NO: 48115 - protein, 10 aa, Homo sapiens
  light chain complementarity determining region 3 for antibody 24058
LQQSYFPLRT

SEQ ID NO: 48116 - protein, 14 aa, Homo sapiens
  heavy chain complementarity determining region 3 for antibody 24058
ATISGRDFYNWFDP

SEQ ID NO: 48117 - protein, 9 aa, Homo sapiens
  light chain complementarity determining region 3 for antibody 24059
LQNDYWPRT

SEQ ID NO: 48118 - protein, 11 aa, Homo sapiens
  heavy chain complementarity determining region 3 for antibody 24059
VRVGGAGYFDH

SEQ ID NO: 48119 - protein, 10 aa, Homo sapiens
  light chain complementarity determining region 3 for antibody 24060
QQYSISPKWT

SEQ ID NO: 48120 - protein, 17 aa, Homo sapiens
  heavy chain complementarity determining region 3 for antibody 24060
ARDPCKKATDVVCAWDS

SEQ ID NO: 48121 - protein, 9 aa, Homo sapiens
  light chain complementarity determining region 3 for antibody 24061
QQYNSYSRT

SEQ ID NO: 48122 - protein, 16 aa, Homo sapiens
  heavy chain complementarity determining region 3 for antibody 24061
AAGVGMGRGISTTFDY

SEQ ID NO: 48123 - protein, 9 aa, Homo sapiens
  light chain complementarity determining region 3 for antibody 24062
QQYGSSPFT

SEQ ID NO: 48124 - protein, 6 aa, Homo sapiens
  heavy chain complementarity determining region 3 for antibody 24062
VSLMFA

SEQ ID NO: 48125 - protein, 9 aa, Homo sapiens
  light chain complementarity determining region 3 for antibody 24063
QQYGNVPYT

SEQ ID NO: 48126 - protein, 15 aa, Homo sapiens
  heavy chain complementarity determining region 3 for antibody 24063
VRDHSNTYYVDYYDL

SEQ ID NO: 48127 - protein, 9 aa, Homo sapiens
  light chain complementarity determining region 3 for antibody 24064
QQYESSPWT

SEQ ID NO: 48128 - protein, 18 aa, Homo sapiens
  heavy chain complementarity determining region 3 for antibody 24064
ARQIDYGDYASYHGYCDV

SEQ ID NO: 48129 - protein, 9 aa, Homo sapiens
  light chain complementarity determining region 3 for antibody 24065
QQSYSPPWT

SEQ ID NO: 48130 - protein, 13 aa, Homo sapiens
  heavy chain complementarity determining region 3 for antibody 24065
ARGGEFLGRWFDP

SEQ ID NO: 48131 - protein, 9 aa, Homo sapiens
  light chain complementarity determining region 3 for antibody 24066
QQSHDFPYT

SEQ ID NO: 48132 - protein, 13 aa, Homo sapiens
  heavy chain complementarity determining region 3 for antibody 24066
VRLWDIGGWPFDY

SEQ ID NO: 48133 - protein, 9 aa, Homo sapiens
  light chain complementarity determining region 3 for antibody 24067
QQRSNWPST

SEQ ID NO: 48134 - protein, 14 aa, Homo sapiens
  heavy chain complementarity determining region 3 for antibody 24067
ASPYEDGSGWYFDP

SEQ ID NO: 48135 - protein, 10 aa, Homo sapiens
  light chain complementarity determining region 3 for antibody 24068
QQRSNWPPIT

SEQ ID NO: 48136 - protein, 17 aa, Homo sapiens
  heavy chain complementarity determining region 3 for antibody 24068
AAGYHSESLSADDVFDM

SEQ ID NO: 48137 - protein, 9 aa, Homo sapiens
  light chain complementarity determining region 3 for antibody 24069
QQLNSYPPT

SEQ ID NO: 48138 - protein, 14 aa, Homo sapiens
  heavy chain complementarity determining region 3 for antibody 24069
ARENSVAGARAYDY

SEQ ID NO: 48139 - protein, 9 aa, Homo sapiens
  light chain complementarity determining region 3 for antibody 24070
QQGYSIPLL

SEQ ID NO: 48140 - protein, 15 aa, Homo sapiens
  heavy chain complementarity determining region 3 for antibody 24070
ARAQVIWGQLYYFDC

SEQ ID NO: 48141 - protein, 9 aa, Homo sapiens
  light chain complementarity determining region 3 for antibody 24071
QKYNSAPWT

SEQ ID NO: 48142 - protein, 14 aa, Homo sapiens
  heavy chain complementarity determining region 3 for antibody 24071
AKSSGTTVTTSFDY

SEQ ID NO: 48143 - protein, 9 aa, Homo sapiens
  light chain complementarity determining region 3 for antibody 24072
MQGLQTPYT

SEQ ID NO: 48144 - protein, 15 aa, Homo sapiens
  heavy chain complementarity determining region 3 for antibody 24072
ARDVMTTLTRGWLDP

SEQ ID NO: 48145 - protein, 10 aa, Homo sapiens
  light chain complementarity determining region 3 for antibody 24073
LQHDNFPLYT

SEQ ID NO: 48146 - protein, 17 aa, Homo sapiens
  heavy chain complementarity determining region 3 for antibody 24073
ARNFWSSAAMGGIYFDL

SEQ ID NO: 48147 - protein, 9 aa, Homo sapiens
  light chain complementarity determining region 3 for antibody 24074
KQDYNYPIT

SEQ ID NO: 48148 - protein, 15 aa, Homo sapiens
  heavy chain complementarity determining region 3 for antibody 24074
ARDNREDTARRSFDI

SEQ ID NO: 48149 - protein, 9 aa, Homo sapiens
  light chain complementarity determining region 3 for antibody 24075
QQYHTYPLT

SEQ ID NO: 48150 - protein, 16 aa, Homo sapiens
  heavy chain complementarity determining region 3 for antibody 24075
ARGHYGSGNFPCDPDF

SEQ ID NO: 48151 - protein, 9 aa, Homo sapiens
  light chain complementarity determining region 3 for antibody 24076
QQYGSIPRT

SEQ ID NO: 48152 - protein, 14 aa, Homo sapiens
  heavy chain complementarity determining region 3 for antibody 24076
AGGDFCGGDCYSEY

SEQ ID NO: 48153 - protein, 8 aa, Homo sapiens
  light chain complementarity determining region 3 for antibody 24077
QQYGSFFT

SEQ ID NO: 48154 - protein, 14 aa, Homo sapiens
  heavy chain complementarity determining region 3 for antibody 24077
ARHGPGSPWSYFDN

SEQ ID NO: 48155 - protein, 10 aa, Homo sapiens
  light chain complementarity determining region 3 for antibody 24078
QQYGGSPQYT

SEQ ID NO: 48156 - protein, 15 aa, Homo sapiens
  heavy chain complementarity determining region 3 for antibody 24078
ARDDRFATRFHSLDT

SEQ ID NO: 48157 - protein, 9 aa, Homo sapiens
  light chain complementarity determining region 3 for antibody 24079
QQSYSTLAA

SEQ ID NO: 48158 - protein, 14 aa, Homo sapiens
  heavy chain complementarity determining region 3 for antibody 24079
ARESFHNSGYALDY

SEQ ID NO: 48159 - protein, 9 aa, Homo sapiens
  light chain complementarity determining region 3 for antibody 24080
QQSYNTPYT

SEQ ID NO: 48160 - protein, 11 aa, Homo sapiens
  heavy chain complementarity determining region 3 for antibody 24080
ARGSATANFDF

SEQ ID NO: 48161 - protein, 9 aa, Homo sapiens
  light chain complementarity determining region 3 for antibody 24081
QQDDSLPIT

SEQ ID NO: 48162 - protein, 20 aa, Homo sapiens
  heavy chain complementarity determining region 3 for antibody 24081
ARGPHIVVLTSIPWRWSFGL

SEQ ID NO: 48163 - protein, 10 aa, Homo sapiens
  light chain complementarity determining region 3 for antibody 24082
QQANSFPPFT

SEQ ID NO: 48164 - protein, 14 aa, Homo sapiens
  heavy chain complementarity determining region 3 for antibody 24082
ARDRGSGWYIAFDF

SEQ ID NO: 48165 - protein, 9 aa, Homo sapiens
  light chain complementarity determining region 3 for antibody 24083
QKYNSAPFT

SEQ ID NO: 48166 - protein, 16 aa, Homo sapiens
  heavy chain complementarity determining region 3 for antibody 24083
AKGVAADGLKSYYFDY

SEQ ID NO: 48167 - protein, 10 aa, Homo sapiens
  light chain complementarity determining region 3 for antibody 24084
QHYGPSSPRT

SEQ ID NO: 48168 - protein, 12 aa, Homo sapiens
  heavy chain complementarity determining region 3 for antibody 24084
TTAFGWELRRDF

SEQ ID NO: 48169 - protein, 10 aa, Homo sapiens
  light chain complementarity determining region 3 for antibody 24085
MQGTHWPLWT

SEQ ID NO: 48170 - protein, 12 aa, Homo sapiens
  heavy chain complementarity determining region 3 for antibody 24085
TTGLNWGWEPDY

SEQ ID NO: 48171 - protein, 9 aa, Homo sapiens
  light chain complementarity determining region 3 for antibody 24086
QQYYSFLLT

SEQ ID NO: 48172 - protein, 14 aa, Homo sapiens
  heavy chain complementarity determining region 3 for antibody 24086
ARSGSTSYQWYFDY

SEQ ID NO: 48173 - protein, 9 aa, Homo sapiens
  light chain complementarity determining region 3 for antibody 24087
QQYYRYSHT

SEQ ID NO: 48174 - protein, 19 aa, Homo sapiens
  heavy chain complementarity determining region 3 for antibody 24087
ARDPGIGGMAAGASLAFDI

SEQ ID NO: 48175 - protein, 9 aa, Homo sapiens
  light chain complementarity determining region 3 for antibody 24088
QQYSNWLWT

SEQ ID NO: 48176 - protein, 20 aa, Homo sapiens
  heavy chain complementarity determining region 3 for antibody 24088
AHRRVRDTARGNYYSDGMDV

SEQ ID NO: 48177 - protein, 9 aa, Homo sapiens
  light chain complementarity determining region 3 for antibody 24089
QQYNSYSWT

SEQ ID NO: 48178 - protein, 12 aa, Homo sapiens
  heavy chain complementarity determining region 3 for antibody 24089
ARYPVAGVYFQR

SEQ ID NO: 48179 - protein, 9 aa, Homo sapiens
  light chain complementarity determining region 3 for antibody 24090
QQYGRSPWT

SEQ ID NO: 48180 - protein, 18 aa, Homo sapiens
  heavy chain complementarity determining region 3 for antibody 24090
ATMPSLAEPGRIYWYFDL

SEQ ID NO: 48181 - protein, 9 aa, Homo sapiens
  light chain complementarity determining region 3 for antibody 24091
QQTYSIPQT

SEQ ID NO: 48182 - protein, 14 aa, Homo sapiens
  heavy chain complementarity determining region 3 for antibody 24091
ARVGTLWWIDTFDR

SEQ ID NO: 48183 - protein, 10 aa, Homo sapiens
  light chain complementarity determining region 3 for antibody 24092
QQSYSTHPLT

SEQ ID NO: 48184 - protein, 16 aa, Homo sapiens
  heavy chain complementarity determining region 3 for antibody 24092
AKDWGETYNYGSNFDC

SEQ ID NO: 48185 - protein, 8 aa, Homo sapiens
  light chain complementarity determining region 3 for antibody 24093
QQSSNWLT

SEQ ID NO: 48186 - protein, 18 aa, Homo sapiens
  heavy chain complementarity determining region 3 for antibody 24093
ARVGHYDGGGYSLDDFDI

SEQ ID NO: 48187 - protein, 9 aa, Homo sapiens
  light chain complementarity determining region 3 for antibody 24094
QQRSAWPLT

SEQ ID NO: 48188 - protein, 7 aa, Homo sapiens
  heavy chain complementarity determining region 3 for antibody 24094
VRDEWWP

SEQ ID NO: 48189 - protein, 9 aa, Homo sapiens
  light chain complementarity determining region 3 for antibody 24095
QQCLSLPYT

SEQ ID NO: 48190 - protein, 15 aa, Homo sapiens
  heavy chain complementarity determining region 3 for antibody 24095
SRLKGSAGWYHKIDF

SEQ ID NO: 48191 - protein, 9 aa, Homo sapiens
  light chain complementarity determining region 3 for antibody 24096
QHDYRPPWT

SEQ ID NO: 48192 - protein, 15 aa, Homo sapiens
  heavy chain complementarity determining region 3 for antibody 24096
TKEGGHNPLGAGLDQ

SEQ ID NO: 48193 - protein, 9 aa, Homo sapiens
  light chain complementarity determining region 3 for antibody 24097
MQGTHWPYT

SEQ ID NO: 48194 - protein, 11 aa, Homo sapiens
  heavy chain complementarity determining region 3 for antibody 24097
GKDLLPGGLDV

SEQ ID NO: 48195 - protein, 9 aa, Homo sapiens
  light chain complementarity determining region 3 for antibody 24098
MQALQTPLT

SEQ ID NO: 48196 - protein, 12 aa, Homo sapiens
  heavy chain complementarity determining region 3 for antibody 24098
AKDSEQKWELRD

SEQ ID NO: 48197 - protein, 9 aa, Homo sapiens
  light chain complementarity determining region 3 for antibody 24099
MQALQTPIT

SEQ ID NO: 48198 - protein, 17 aa, Homo sapiens
  heavy chain complementarity determining region 3 for antibody 24099
TRGYCTTTSCQLNWFDP

SEQ ID NO: 48199 - protein, 9 aa, Homo sapiens
  light chain complementarity determining region 3 for antibody 24100
MQALQTAIT

SEQ ID NO: 48200 - protein, 12 aa, Homo sapiens
  heavy chain complementarity determining region 3 for antibody 24100
ARDLYDSSRGDF

SEQ ID NO: 48201 - protein, 9 aa, Homo sapiens
  light chain complementarity determining region 3 for antibody 24101
MQALQNPRT

SEQ ID NO: 48202 - protein, 13 aa, Homo sapiens
  heavy chain complementarity determining region 3 for antibody 24101
AKHSGLAGYPLDY

SEQ ID NO: 48203 - protein, 8 aa, Homo sapiens
  light chain complementarity determining region 3 for antibody 24102
MHALQTPG

SEQ ID NO: 48204 - protein, 19 aa, Homo sapiens
  heavy chain complementarity determining region 3 for antibody 24102
ANFGSGNFYNVRYYYGMDV

SEQ ID NO: 48205 - protein, 9 aa, Homo sapiens
  light chain complementarity determining region 3 for antibody 24103
HQYGSSPLT

SEQ ID NO: 48206 - protein, 16 aa, Homo sapiens
  heavy chain complementarity determining region 3 for antibody 24103
TTDHDGSGHYYVAFFS

SEQ ID NO: 48207 - protein, 8 aa, Homo sapiens
  light chain complementarity determining region 3 for antibody 24104
QQYGSYRT

SEQ ID NO: 48208 - protein, 15 aa, Homo sapiens
  heavy chain complementarity determining region 3 for antibody 24104
AKVHSPWSSGYYFDY

SEQ ID NO: 48209 - protein, 9 aa, Homo sapiens
  light chain complementarity determining region 3 for antibody 24105
QQYGSSPRT

SEQ ID NO: 48210 - protein, 14 aa, Homo sapiens
  heavy chain complementarity determining region 3 for antibody 24105
ARDRGSSWYPPFQH

SEQ ID NO: 48211 - protein, 9 aa, Homo sapiens
  light chain complementarity determining region 3 for antibody 24106
QQYGGSPST

SEQ ID NO: 48212 - protein, 11 aa, Homo sapiens
  heavy chain complementarity determining region 3 for antibody 24106
ARKPTGMAFDC

SEQ ID NO: 48213 - protein, 11 aa, Homo sapiens
  light chain complementarity determining region 3 for antibody 24107
QQYDRSPPGFT

SEQ ID NO: 48214 - protein, 14 aa, Homo sapiens
  heavy chain complementarity determining region 3 for antibody 24107
ARETHNSRKRSFDQ

SEQ ID NO: 48215 - protein, 10 aa, Homo sapiens
  light chain complementarity determining region 3 for antibody 24108
QQYDNLPPYT

SEQ ID NO: 48216 - protein, 13 aa, Homo sapiens
  heavy chain complementarity determining region 3 for antibody 24108
ARENGAVAGTLDY

SEQ ID NO: 48217 - protein, 9 aa, Homo sapiens
  light chain complementarity determining region 3 for antibody 24109
QQYDNLPFT

SEQ ID NO: 48218 - protein, 9 aa, Homo sapiens
  heavy chain complementarity determining region 3 for antibody 24109
AKGHRAMYN

SEQ ID NO: 48219 - protein, 9 aa, Homo sapiens
  light chain complementarity determining region 3 for antibody 24110
QQSYSTPYT

SEQ ID NO: 48220 - protein, 11 aa, Homo sapiens
  heavy chain complementarity determining region 3 for antibody 24110
ARGSATANFDF

SEQ ID NO: 48221 - protein, 10 aa, Homo sapiens
  light chain complementarity determining region 3 for antibody 24111
QQRVNWPPWT

SEQ ID NO: 48222 - protein, 15 aa, Homo sapiens
  heavy chain complementarity determining region 3 for antibody 24111
TRQRDDTGDTWYFDF

SEQ ID NO: 48223 - protein, 9 aa, Homo sapiens
  light chain complementarity determining region 3 for antibody 24112
QQRSNWHKT

SEQ ID NO: 48224 - protein, 17 aa, Homo sapiens
  heavy chain complementarity determining region 3 for antibody 24112
AREGDFWSGYQSDAFDI

SEQ ID NO: 48225 - protein, 9 aa, Homo sapiens
  light chain complementarity determining region 3 for antibody 24113
QQANSFPIT

SEQ ID NO: 48226 - protein, 15 aa, Homo sapiens
  heavy chain complementarity determining region 3 for antibody 24113
AREGDCLSTTCYYDY

SEQ ID NO: 48227 - protein, 9 aa, Homo sapiens
  light chain complementarity determining region 3 for antibody 24114
QKYGSSPRP

SEQ ID NO: 48228 - protein, 13 aa, Homo sapiens
  heavy chain complementarity determining region 3 for antibody 24114
ARGEYVSGNYEEN

SEQ ID NO: 48229 - protein, 9 aa, Homo sapiens
  light chain complementarity determining region 3 for antibody 24115
QHTNNLPVS

SEQ ID NO: 48230 - protein, 25 aa, Homo sapiens
  heavy chain complementarity determining region 3 for antibody 24115
ARERHDFSSGSYTGGREYYYYGLDV

SEQ ID NO: 48231 - protein, 9 aa, Homo sapiens
  light chain complementarity determining region 3 for antibody 24116
MQALRSPLT

SEQ ID NO: 48232 - protein, 19 aa, Homo sapiens
  heavy chain complementarity determining region 3 for antibody 24116
ARRGATVAGISGWGYGMDV

SEQ ID NO: 48233 - protein, 9 aa, Homo sapiens
  light chain complementarity determining region 3 for antibody 24117
MQALQTPRT

SEQ ID NO: 48234 - protein, 25 aa, Homo sapiens
  heavy chain complementarity determining region 3 for antibody 24117
ARGAGRDGVVVADARSWAYYYGMDV

SEQ ID NO: 48235 - protein, 9 aa, Homo sapiens
  light chain complementarity determining region 3 for antibody 24118
MQALQSPLT

SEQ ID NO: 48236 - protein, 14 aa, Homo sapiens
  heavy chain complementarity determining region 3 for antibody 24118
ASGYSHDRAGAFNI

SEQ ID NO: 48237 - protein, 9 aa, Homo sapiens
  light chain complementarity determining region 3 for antibody 24119
QQYYTSLRT

SEQ ID NO: 48238 - protein, 12 aa, Homo sapiens
  heavy chain complementarity determining region 3 for antibody 24119
VKDCGLGGSRDF

SEQ ID NO: 48239 - protein, 10 aa, Homo sapiens
  light chain complementarity determining region 3 for antibody 24120
QQYNSYSSYT

SEQ ID NO: 48240 - protein, 15 aa, Homo sapiens
  heavy chain complementarity determining region 3 for antibody 24120
ASRRVSVNYYYGMDV

SEQ ID NO: 48241 - protein, 9 aa, Homo sapiens
  light chain complementarity determining region 3 for antibody 24121
QQYNSYPLT

SEQ ID NO: 48242 - protein, 12 aa, Homo sapiens
  heavy chain complementarity determining region 3 for antibody 24121
AKLVNSWYPYDY

SEQ ID NO: 48243 - protein, 11 aa, Homo sapiens
  light chain complementarity determining region 3 for antibody 24122
QQYKNWPPRLT

SEQ ID NO: 48244 - protein, 19 aa, Homo sapiens
  heavy chain complementarity determining region 3 for antibody 24122
ARLSGLAYAFGGGWGAFDL

SEQ ID NO: 48245 - protein, 10 aa, Homo sapiens
  light chain complementarity determining region 3 for antibody 24123
QQYHNWPPLT

SEQ ID NO: 48246 - protein, 10 aa, Homo sapiens
  heavy chain complementarity determining region 3 for antibody 24123
ARLVHGDFDV

SEQ ID NO: 48247 - protein, 10 aa, Homo sapiens
  light chain complementarity determining region 3 for antibody 24124
QQYGDSPPGT

SEQ ID NO: 48248 - protein, 19 aa, Homo sapiens
  heavy chain complementarity determining region 3 for antibody 24124
ARQIWIAVAGTVRLAYFDY

SEQ ID NO: 48249 - protein, 9 aa, Homo sapiens
  light chain complementarity determining region 3 for antibody 24125
QQYDSSPQT

SEQ ID NO: 48250 - protein, 14 aa, Homo sapiens
  heavy chain complementarity determining region 3 for antibody 24125
ARDNPHRLERYFDL

SEQ ID NO: 48251 - protein, 9 aa, Homo sapiens
  light chain complementarity determining region 3 for antibody 24126
QQTYTSPFN

SEQ ID NO: 48252 - protein, 18 aa, Homo sapiens
  heavy chain complementarity determining region 3 for antibody 24126
AKDLIPDVSVLRGGSPES

SEQ ID NO: 48253 - protein, 8 aa, Homo sapiens
  light chain complementarity determining region 3 for antibody 24127
QQSYSTPS

SEQ ID NO: 48254 - protein, 15 aa, Homo sapiens
  heavy chain complementarity determining region 3 for antibody 24127
ARAQTGGYSYGTEDY

SEQ ID NO: 48255 - protein, 9 aa, Homo sapiens
  light chain complementarity determining region 3 for antibody 24128
QQRSNWPLT

SEQ ID NO: 48256 - protein, 14 aa, Homo sapiens
  heavy chain complementarity determining region 3 for antibody 24128
AKSRGYNTDDAFEI

SEQ ID NO: 48257 - protein, 9 aa, Homo sapiens
  light chain complementarity determining region 3 for antibody 24129
QQRSNWPLT

SEQ ID NO: 48258 - protein, 11 aa, Homo sapiens
  heavy chain complementarity determining region 3 for antibody 24129
AKDSSVAPFDH

SEQ ID NO: 48259 - protein, 9 aa, Homo sapiens
  light chain complementarity determining region 3 for antibody 24130
QQHSNWLWT

SEQ ID NO: 48260 - protein, 20 aa, Homo sapiens
  heavy chain complementarity determining region 3 for antibody 24130
VYRRGYEYVGASYRYTMSDY

SEQ ID NO: 48261 - protein, 9 aa, Homo sapiens
  light chain complementarity determining region 3 for antibody 24131
QQGYSAPFH

SEQ ID NO: 48262 - protein, 16 aa, Homo sapiens
  heavy chain complementarity determining region 3 for antibody 24131
ARGLVHDSSSWYGIDF

SEQ ID NO: 48263 - protein, 9 aa, Homo sapiens
  light chain complementarity determining region 3 for antibody 24132
QQFYSSPLA

SEQ ID NO: 48264 - protein, 11 aa, Homo sapiens
  heavy chain complementarity determining region 3 for antibody 24132
GRVYSWGAVDI

SEQ ID NO: 48265 - protein, 9 aa, Homo sapiens
  light chain complementarity determining region 3 for antibody 24133
QQFDNSPYT

SEQ ID NO: 48266 - protein, 13 aa, Homo sapiens
  heavy chain complementarity determining region 3 for antibody 24133
VKKYTSGWLYFDF

SEQ ID NO: 48267 - protein, 9 aa, Homo sapiens
  light chain complementarity determining region 3 for antibody 24134
QHYYTYSYT

SEQ ID NO: 48268 - protein, 16 aa, Homo sapiens
  heavy chain complementarity determining region 3 for antibody 24134
ARHGARCSGGNCYFDS

SEQ ID NO: 48269 - protein, 9 aa, Homo sapiens
  light chain complementarity determining region 3 for antibody 24135
QHYDDSPWS

SEQ ID NO: 48270 - protein, 16 aa, Homo sapiens
  heavy chain complementarity determining region 3 for antibody 24135
AKAFTFGGVGGHLYDY

SEQ ID NO: 48271 - protein, 8 aa, Homo sapiens
  light chain complementarity determining region 3 for antibody 24136
MRGVEPYP

SEQ ID NO: 48272 - protein, 7 aa, Homo sapiens
  heavy chain complementarity determining region 3 for antibody 24136
ATKMGDY

SEQ ID NO: 48273 - protein, 9 aa, Homo sapiens
  light chain complementarity determining region 3 for antibody 24137
MQGTHWPFT

SEQ ID NO: 48274 - protein, 9 aa, Homo sapiens
  heavy chain complementarity determining region 3 for antibody 24137
SRDPRPLDY

SEQ ID NO: 48275 - protein, 9 aa, Homo sapiens
  light chain complementarity determining region 3 for antibody 24138
MQGRHWPWT

SEQ ID NO: 48276 - protein, 10 aa, Homo sapiens
  heavy chain complementarity determining region 3 for antibody 24138
TTEIVDLFDH

SEQ ID NO: 48277 - protein, 9 aa, Homo sapiens
  light chain complementarity determining region 3 for antibody 24139
MQALQPPWT

SEQ ID NO: 48278 - protein, 17 aa, Homo sapiens
  heavy chain complementarity determining region 3 for antibody 24139
ARPEYYFAGSGYHAFDI

SEQ ID NO: 48279 - protein, 9 aa, Homo sapiens
  light chain complementarity determining region 3 for antibody 24140
LQHNSYPWT

SEQ ID NO: 48280 - protein, 6 aa, Homo sapiens
  heavy chain complementarity determining region 3 for antibody 24140
SRDGTY

SEQ ID NO: 48281 - protein, 9 aa, Homo sapiens
  light chain complementarity determining region 3 for antibody 24141
LQHNSYPLT

SEQ ID NO: 48282 - protein, 13 aa, Homo sapiens
  heavy chain complementarity determining region 3 for antibody 24141
ARHLVRGGMVVDD

SEQ ID NO: 48283 - protein, 9 aa, Homo sapiens
  light chain complementarity determining region 3 for antibody 24142
QRSDRKPFT

SEQ ID NO: 48284 - protein, 14 aa, Homo sapiens
  heavy chain complementarity determining region 3 for antibody 24142
ARDNSNNWYEGMDV

SEQ ID NO: 48285 - protein, 9 aa, Homo sapiens
  light chain complementarity determining region 3 for antibody 24143
QQYGTSPIT

SEQ ID NO: 48286 - protein, 13 aa, Homo sapiens
  heavy chain complementarity determining region 3 for antibody 24143
AKSQHLSIDIFDI

SEQ ID NO: 48287 - protein, 10 aa, Homo sapiens
  light chain complementarity determining region 3 for antibody 24144
QQYGSSPQWT

SEQ ID NO: 48288 - protein, 11 aa, Homo sapiens
  heavy chain complementarity determining region 3 for antibody 24144
TREKVGGYFDY

SEQ ID NO: 48289 - protein, 9 aa, Homo sapiens
  light chain complementarity determining region 3 for antibody 24145
QQSYSSPWT

SEQ ID NO: 48290 - protein, 11 aa, Homo sapiens
  heavy chain complementarity determining region 3 for antibody 24145
ARMRGGWYVDY

SEQ ID NO: 48291 - protein, 9 aa, Homo sapiens
  light chain complementarity determining region 3 for antibody 24146
QQSFNTLYT

SEQ ID NO: 48292 - protein, 14 aa, Homo sapiens
  heavy chain complementarity determining region 3 for antibody 24146
ARDVLHYGHRLFDS

SEQ ID NO: 48293 - protein, 9 aa, Homo sapiens
  light chain complementarity determining region 3 for antibody 24147
QQRSNWPRT

SEQ ID NO: 48294 - protein, 21 aa, Homo sapiens
  heavy chain complementarity determining region 3 for antibody 24147
ATDSTKPRYTYGFYYYYGIDV

SEQ ID NO: 48295 - protein, 8 aa, Homo sapiens
  light chain complementarity determining region 3 for antibody 24148
QQRSNLIT

SEQ ID NO: 48296 - protein, 20 aa, Homo sapiens
  heavy chain complementarity determining region 3 for antibody 24148
ARGRIRRDRLVHYYYYGMDV

SEQ ID NO: 48297 - protein, 9 aa, Homo sapiens
  light chain complementarity determining region 3 for antibody 24149
QQGFSTQWT

SEQ ID NO: 48298 - protein, 12 aa, Homo sapiens
  heavy chain complementarity determining region 3 for antibody 24149
AREAYSEWFPDH

SEQ ID NO: 48299 - protein, 9 aa, Homo sapiens
  light chain complementarity determining region 3 for antibody 24150
QQFNSFPWT

SEQ ID NO: 48300 - protein, 20 aa, Homo sapiens
  heavy chain complementarity determining region 3 for antibody 24150
MSHFCIGGNCYSGARGPFDP

SEQ ID NO: 48301 - protein, 8 aa, Homo sapiens
  light chain complementarity determining region 3 for antibody 24151
QQFHNLPS

SEQ ID NO: 48302 - protein, 9 aa, Homo sapiens
  heavy chain complementarity determining region 3 for antibody 24151
ARGRYRLDL

SEQ ID NO: 48303 - protein, 9 aa, Homo sapiens
  light chain complementarity determining region 3 for antibody 24152
QQFDELPIT

SEQ ID NO: 48304 - protein, 9 aa, Homo sapiens
  heavy chain complementarity determining region 3 for antibody 24152
ARSTHPRGP

SEQ ID NO: 48305 - protein, 8 aa, Homo sapiens
  light chain complementarity determining region 3 for antibody 24153
QHYNYYYT

SEQ ID NO: 48306 - protein, 12 aa, Homo sapiens
  heavy chain complementarity determining region 3 for antibody 24153
VREQGPHKSFDY

SEQ ID NO: 48307 - protein, 9 aa, Homo sapiens
  light chain complementarity determining region 3 for antibody 24154
MQALQTPRT

SEQ ID NO: 48308 - protein, 13 aa, Homo sapiens
  heavy chain complementarity determining region 3 for antibody 24154
ARASGGDYGLPAY

SEQ ID NO: 48309 - protein, 9 aa, Homo sapiens
  light chain complementarity determining region 3 for antibody 24155
LQLHSYPLT

SEQ ID NO: 48310 - protein, 16 aa, Homo sapiens
  heavy chain complementarity determining region 3 for antibody 24155
ARLFYNSDWYVGYFDH

SEQ ID NO: 48311 - protein, 9 aa, Homo sapiens
  light chain complementarity determining region 3 for antibody 24156
QQYVSSPRT

SEQ ID NO: 48312 - protein, 14 aa, Homo sapiens
  heavy chain complementarity determining region 3 for antibody 24156
ARERIGGGHWYFDL

SEQ ID NO: 48313 - protein, 8 aa, Homo sapiens
  light chain complementarity determining region 3 for antibody 24157
QQYNTYWT

SEQ ID NO: 48314 - protein, 14 aa, Homo sapiens
  heavy chain complementarity determining region 3 for antibody 24157
AVLGSNWQVYNFDY

SEQ ID NO: 48315 - protein, 8 aa, Homo sapiens
  light chain complementarity determining region 3 for antibody 24158
QQYNNWWT

SEQ ID NO: 48316 - protein, 15 aa, Homo sapiens
  heavy chain complementarity determining region 3 for antibody 24158
ARDFPDSDSSSFLDL

SEQ ID NO: 48317 - protein, 9 aa, Homo sapiens
  light chain complementarity determining region 3 for antibody 24159
QQYGSTPST

SEQ ID NO: 48318 - protein, 14 aa, Homo sapiens
  heavy chain complementarity determining region 3 for antibody 24159
AREWVSTIRGWFDP

SEQ ID NO: 48319 - protein, 9 aa, Homo sapiens
  light chain complementarity determining region 3 for antibody 24160
QQYGSSPYT

SEQ ID NO: 48320 - protein, 17 aa, Homo sapiens
  heavy chain complementarity determining region 3 for antibody 24160
ARERTEVPGPMPADLDY

SEQ ID NO: 48321 - protein, 9 aa, Homo sapiens
  light chain complementarity determining region 3 for antibody 24161
QQYGSLPRT

SEQ ID NO: 48322 - protein, 14 aa, Homo sapiens
  heavy chain complementarity determining region 3 for antibody 24161
AGGDFCGSDCYSEY

SEQ ID NO: 48323 - protein, 9 aa, Homo sapiens
  light chain complementarity determining region 3 for antibody 24162
QQYDTLPLT

SEQ ID NO: 48324 - protein, 16 aa, Homo sapiens
  heavy chain complementarity determining region 3 for antibody 24162
ARLIRSVVRAPYGMDV

SEQ ID NO: 48325 - protein, 10 aa, Homo sapiens
  light chain complementarity determining region 3 for antibody 24163
QQSYTTLMYT

SEQ ID NO: 48326 - protein, 13 aa, Homo sapiens
  heavy chain complementarity determining region 3 for antibody 24163
ARAPGSGSWTVDY

SEQ ID NO: 48327 - protein, 9 aa, Homo sapiens
  light chain complementarity determining region 3 for antibody 24164
HQYGSSPRT

SEQ ID NO: 48328 - protein, 22 aa, Homo sapiens
  heavy chain complementarity determining region 3 for antibody 24164
ARLKQDVIRSWLKSTVQTGLDY

SEQ ID NO: 48329 - protein, 9 aa, Homo sapiens
  light chain complementarity determining region 3 for antibody 24165
QQYTTPMYT

SEQ ID NO: 48330 - protein, 12 aa, Homo sapiens
  heavy chain complementarity determining region 3 for antibody 24165
AREPPETCYFDY

SEQ ID NO: 48331 - protein, 10 aa, Homo sapiens
  light chain complementarity determining region 3 for antibody 24166
QQYQNWPPWT

SEQ ID NO: 48332 - protein, 12 aa, Homo sapiens
  heavy chain complementarity determining region 3 for antibody 24166
AASEWSGATFNY

SEQ ID NO: 48333 - protein, 9 aa, Homo sapiens
  light chain complementarity determining region 3 for antibody 24167
QQYNTYSRT

SEQ ID NO: 48334 - protein, 12 aa, Homo sapiens
  heavy chain complementarity determining region 3 for antibody 24167
AGSFDSSGYFDY

SEQ ID NO: 48335 - protein, 7 aa, Homo sapiens
  light chain complementarity determining region 3 for antibody 24168
QQYNSYS

SEQ ID NO: 48336 - protein, 9 aa, Homo sapiens
  heavy chain complementarity determining region 3 for antibody 24168
ATHGDGFDY

SEQ ID NO: 48337 - protein, 8 aa, Homo sapiens
  light chain complementarity determining region 3 for antibody 24169
QQYIYWQT

SEQ ID NO: 48338 - protein, 13 aa, Homo sapiens
  heavy chain complementarity determining region 3 for antibody 24169
ARKGGGDFYYLPY

SEQ ID NO: 48339 - protein, 10 aa, Homo sapiens
  light chain complementarity determining region 3 for antibody 24170
QQYGYPPPYT

SEQ ID NO: 48340 - protein, 11 aa, Homo sapiens
  heavy chain complementarity determining region 3 for antibody 24170
TRWRSDGHFDY

SEQ ID NO: 48341 - protein, 9 aa, Homo sapiens
  light chain complementarity determining region 3 for antibody 24171
QQYGSSLYT

SEQ ID NO: 48342 - protein, 15 aa, Homo sapiens
  heavy chain complementarity determining region 3 for antibody 24171
ARLPEYSSSWYYFDF

SEQ ID NO: 48343 - protein, 10 aa, Homo sapiens
  light chain complementarity determining region 3 for antibody 24172
QQYGHSPMYS

SEQ ID NO: 48344 - protein, 13 aa, Homo sapiens
  heavy chain complementarity determining region 3 for antibody 24172
AYIARSSNMDLMS

SEQ ID NO: 48345 - protein, 9 aa, Homo sapiens
  light chain complementarity determining region 3 for antibody 24173
QQSDRKPFT

SEQ ID NO: 48346 - protein, 14 aa, Homo sapiens
  heavy chain complementarity determining region 3 for antibody 24173
ARDNSNNWYEGMDV

SEQ ID NO: 48347 - protein, 10 aa, Homo sapiens
  light chain complementarity determining region 3 for antibody 24174
QQRSNWPPYT

SEQ ID NO: 48348 - protein, 12 aa, Homo sapiens
  heavy chain complementarity determining region 3 for antibody 24174
VRGDPGSPRFDY

SEQ ID NO: 48349 - protein, 9 aa, Homo sapiens
  light chain complementarity determining region 3 for antibody 24175
QKYNSAQLT

SEQ ID NO: 48350 - protein, 15 aa, Homo sapiens
  heavy chain complementarity determining region 3 for antibody 24175
ARRSNDFWSGYHPDY

SEQ ID NO: 48351 - protein, 10 aa, Homo sapiens
  light chain complementarity determining region 3 for antibody 24176
QKYNSAPPWT

SEQ ID NO: 48352 - protein, 14 aa, Homo sapiens
  heavy chain complementarity determining region 3 for antibody 24176
AKGEKWLSSGAFDI

SEQ ID NO: 48353 - protein, 10 aa, Homo sapiens
  light chain complementarity determining region 3 for antibody 24177
QHYNSYSHST

SEQ ID NO: 48354 - protein, 18 aa, Homo sapiens
  heavy chain complementarity determining region 3 for antibody 24177
ARGAGTGYSSNWKIPAGW

SEQ ID NO: 48355 - protein, 9 aa, Homo sapiens
  light chain complementarity determining region 3 for antibody 24178
QHYGSSPLT

SEQ ID NO: 48356 - protein, 13 aa, Homo sapiens
  heavy chain complementarity determining region 3 for antibody 24178
ARGSRVTVRAFDY

SEQ ID NO: 48357 - protein, 9 aa, Homo sapiens
  light chain complementarity determining region 3 for antibody 24179
QHNYNPPFT

SEQ ID NO: 48358 - protein, 13 aa, Homo sapiens
  heavy chain complementarity determining region 3 for antibody 24179
VRGRNYDRDGFDP

SEQ ID NO: 48359 - protein, 9 aa, Homo sapiens
  light chain complementarity determining region 3 for antibody 24180
HQYDASPYT

SEQ ID NO: 48360 - protein, 17 aa, Homo sapiens
  heavy chain complementarity determining region 3 for antibody 24180
ASLLVVPGAIYYYGMDV

SEQ ID NO: 48361 - protein, 8 aa, Homo sapiens
  light chain complementarity determining region 3 for antibody 24181
QQYHSPIT

SEQ ID NO: 48362 - protein, 10 aa, Homo sapiens
  heavy chain complementarity determining region 3 for antibody 24181
VRGRGWTLDH

SEQ ID NO: 48363 - protein, 8 aa, Homo sapiens
  light chain complementarity determining region 3 for antibody 24182
QQYHIFWT

SEQ ID NO: 48364 - protein, 10 aa, Homo sapiens
  heavy chain complementarity determining region 3 for antibody 24182
ATDRRSLLVY

SEQ ID NO: 48365 - protein, 9 aa, Homo sapiens
  light chain complementarity determining region 3 for antibody 24183
QQYGSSPRT

SEQ ID NO: 48366 - protein, 12 aa, Homo sapiens
  heavy chain complementarity determining region 3 for antibody 24183
ARVRGSGSYPDY

SEQ ID NO: 48367 - protein, 9 aa, Homo sapiens
  light chain complementarity determining region 3 for antibody 24184
QQYGSSPRT

SEQ ID NO: 48368 - protein, 14 aa, Homo sapiens
  heavy chain complementarity determining region 3 for antibody 24184
ARVMYYYGSGSFDY

SEQ ID NO: 48369 - protein, 10 aa, Homo sapiens
  light chain complementarity determining region 3 for antibody 24185
QQYGSSPPWT

SEQ ID NO: 48370 - protein, 14 aa, Homo sapiens
  heavy chain complementarity determining region 3 for antibody 24185
ARGGIRGVIIPLLS

SEQ ID NO: 48371 - protein, 10 aa, Homo sapiens
  light chain complementarity determining region 3 for antibody 24186
QQYGSSLSLT

SEQ ID NO: 48372 - protein, 14 aa, Homo sapiens
  heavy chain complementarity determining region 3 for antibody 24186
ARLGLLPYYYGMDV

SEQ ID NO: 48373 - protein, 9 aa, Homo sapiens
  light chain complementarity determining region 3 for antibody 24187
QQYGRSPLT

SEQ ID NO: 48374 - protein, 19 aa, Homo sapiens
  heavy chain complementarity determining region 3 for antibody 24187
ARTNTYYDSTGYYFLDFDY

SEQ ID NO: 48375 - protein, 8 aa, Homo sapiens
  light chain complementarity determining region 3 for antibody 24188
QQYDGSST

SEQ ID NO: 48376 - protein, 15 aa, Homo sapiens
  heavy chain complementarity determining region 3 for antibody 24188
ARVPAPVVTAMYLDY

SEQ ID NO: 48377 - protein, 8 aa, Homo sapiens
  light chain complementarity determining region 3 for antibody 24189
QQRSKSVT

SEQ ID NO: 48378 - protein, 11 aa, Homo sapiens
  heavy chain complementarity determining region 3 for antibody 24189
GRGTSTWTDDY

SEQ ID NO: 48379 - protein, 8 aa, Homo sapiens
  light chain complementarity determining region 3 for antibody 24190
QQRAHWVT

SEQ ID NO: 48380 - protein, 17 aa, Homo sapiens
  heavy chain complementarity determining region 3 for antibody 24190
TTDYCSGGSCYSDWFDP

SEQ ID NO: 48381 - protein, 9 aa, Homo sapiens
  light chain complementarity determining region 3 for antibody 24191
QQNNNIPRT

SEQ ID NO: 48382 - protein, 10 aa, Homo sapiens
  heavy chain complementarity determining region 3 for antibody 24191
ATSVGFGFDY

SEQ ID NO: 48383 - protein, 10 aa, Homo sapiens
  light chain complementarity determining region 3 for antibody 24192
QQLDSSPPWT

SEQ ID NO: 48384 - protein, 13 aa, Homo sapiens
  heavy chain complementarity determining region 3 for antibody 24192
ARLIYVDYVFLDY

SEQ ID NO: 48385 - protein, 9 aa, Homo sapiens
  light chain complementarity determining region 3 for antibody 24193
MQALQTPFT

SEQ ID NO: 48386 - protein, 20 aa, Homo sapiens
  heavy chain complementarity determining region 3 for antibody 24193
ARPRSPVSRRYLYYHYGMDV

SEQ ID NO: 48387 - protein, 9 aa, Homo sapiens
  light chain complementarity determining region 3 for antibody 24194
HQSSSLPYT

SEQ ID NO: 48388 - protein, 15 aa, Homo sapiens
  heavy chain complementarity determining region 3 for antibody 24194
ARDRNNDFWSGYRVY

SEQ ID NO: 48389 - protein, 9 aa, Homo sapiens
  light chain complementarity determining region 3 for antibody 24195
QQYNSYPRT

SEQ ID NO: 48390 - protein, 10 aa, Homo sapiens
  heavy chain complementarity determining region 3 for antibody 24195
ARGPGNYPDF

SEQ ID NO: 48391 - protein, 9 aa, Homo sapiens
  light chain complementarity determining region 3 for antibody 24196
QQYDYLPVT

SEQ ID NO: 48392 - protein, 15 aa, Homo sapiens
  heavy chain complementarity determining region 3 for antibody 24196
ARPPHAFTGENYFTF

SEQ ID NO: 48393 - protein, 8 aa, Homo sapiens
  light chain complementarity determining region 3 for antibody 24197
QQYDTSRT

SEQ ID NO: 48394 - protein, 15 aa, Homo sapiens
  heavy chain complementarity determining region 3 for antibody 24197
AREVTNNDSYSGMDV

SEQ ID NO: 48395 - protein, 9 aa, Homo sapiens
  light chain complementarity determining region 3 for antibody 24198
QQTYVTSYT

SEQ ID NO: 48396 - protein, 14 aa, Homo sapiens
  heavy chain complementarity determining region 3 for antibody 24198
TRTPYHGDYEVYDF

SEQ ID NO: 48397 - protein, 9 aa, Homo sapiens
  light chain complementarity determining region 3 for antibody 24199
QQTSSSPPT

SEQ ID NO: 48398 - protein, 16 aa, Homo sapiens
  heavy chain complementarity determining region 3 for antibody 24199
GRDHELYGRSSGVTDY

SEQ ID NO: 48399 - protein, 10 aa, Homo sapiens
  light chain complementarity determining region 3 for antibody 24200
QQTFSPLALT

SEQ ID NO: 48400 - protein, 23 aa, Homo sapiens
  heavy chain complementarity determining region 3 for antibody 24200
ARTPPFGDFSSVTFYQFFYGMDV

SEQ ID NO: 48401 - protein, 9 aa, Homo sapiens
  light chain complementarity determining region 3 for antibody 24201
QQSYSTPIT

SEQ ID NO: 48402 - protein, 15 aa, Homo sapiens
  heavy chain complementarity determining region 3 for antibody 24201
VRFPPDLDIVGMIDS

SEQ ID NO: 48403 - protein, 9 aa, Homo sapiens
  light chain complementarity determining region 3 for antibody 24202
QQSYSTAYT

SEQ ID NO: 48404 - protein, 15 aa, Homo sapiens
  heavy chain complementarity determining region 3 for antibody 24202
ARGPGGWLQFRPGDF

SEQ ID NO: 48405 - protein, 9 aa, Homo sapiens
  light chain complementarity determining region 3 for antibody 24203
QQHGSSPRT

SEQ ID NO: 48406 - protein, 19 aa, Homo sapiens
  heavy chain complementarity determining region 3 for antibody 24203
AKERLTMFRGITIDDAFDI

SEQ ID NO: 48407 - protein, 9 aa, Homo sapiens
  light chain complementarity determining region 3 for antibody 24204
QQGSTTPRT

SEQ ID NO: 48408 - protein, 22 aa, Homo sapiens
  heavy chain complementarity determining region 3 for antibody 24204
AREGLCTSSRCDVVDHYNGMDV

SEQ ID NO: 48409 - protein, 8 aa, Homo sapiens
  light chain complementarity determining region 3 for antibody 24205
QQFDILIT

SEQ ID NO: 48410 - protein, 14 aa, Homo sapiens
  heavy chain complementarity determining region 3 for antibody 24205
AREDFSDGNGYFDP

SEQ ID NO: 48411 - protein, 9 aa, Homo sapiens
  light chain complementarity determining region 3 for antibody 24206
QQANSFLIT

SEQ ID NO: 48412 - protein, 16 aa, Homo sapiens
  heavy chain complementarity determining region 3 for antibody 24206
ARISRLDAIYYYGMDV

SEQ ID NO: 48413 - protein, 11 aa, Homo sapiens
  light chain complementarity determining region 3 for antibody 24207
QGYGASPPMYT

SEQ ID NO: 48414 - protein, 12 aa, Homo sapiens
  heavy chain complementarity determining region 3 for antibody 24207
AKDLHGSGSFDH

SEQ ID NO: 48415 - protein, 8 aa, Homo sapiens
  light chain complementarity determining region 3 for antibody 24208
MQSLQALS

SEQ ID NO: 48416 - protein, 8 aa, Homo sapiens
  heavy chain complementarity determining region 3 for antibody 24208
VGHLRSPY

SEQ ID NO: 48417 - protein, 9 aa, Homo sapiens
  light chain complementarity determining region 3 for antibody 24209
MQALQTPQT

SEQ ID NO: 48418 - protein, 19 aa, Homo sapiens
  heavy chain complementarity determining region 3 for antibody 24209
VRGFNFIRSGRIPPDAFDI

SEQ ID NO: 48419 - protein, 10 aa, Homo sapiens
  light chain complementarity determining region 3 for antibody 24210
MQALQPHRYT

SEQ ID NO: 48420 - protein, 20 aa, Homo sapiens
  heavy chain complementarity determining region 3 for antibody 24210
ARLKAASAGLPSYYYAGMDV

SEQ ID NO: 48421 - protein, 9 aa, Homo sapiens
  light chain complementarity determining region 3 for antibody 24211
LQHNSHPFT

SEQ ID NO: 48422 - protein, 10 aa, Homo sapiens
  heavy chain complementarity determining region 3 for antibody 24211
GRIGDSSRGY

SEQ ID NO: 48423 - protein, 9 aa, Homo sapiens
  light chain complementarity determining region 3 for antibody 24212
HQYYSSPRL

SEQ ID NO: 48424 - protein, 13 aa, Homo sapiens
  heavy chain complementarity determining region 3 for antibody 24212
ARGQSGDPRTYDY

SEQ ID NO: 48425 - protein, 9 aa, Homo sapiens
  light chain complementarity determining region 3 for antibody 24213
HQALSFPIT

SEQ ID NO: 48426 - protein, 11 aa, Homo sapiens
  heavy chain complementarity determining region 3 for antibody 24213
ATYYSGGWFDP

SEQ ID NO: 48427 - protein, 10 aa, Homo sapiens
  light chain complementarity determining region 3 for antibody 24214
HHSGPSALIT

SEQ ID NO: 48428 - protein, 16 aa, Homo sapiens
  heavy chain complementarity determining region 3 for antibody 24214
ITIGTVSPWVYYALDV

SEQ ID NO: 48429 - protein, 10 aa, Homo sapiens
  light chain complementarity determining region 3 for antibody 24215
QYYGRSPPYS

SEQ ID NO: 48430 - protein, 23 aa, Homo sapiens
  heavy chain complementarity determining region 3 for antibody 24215
ARGLRSSDWSKIMDMDSYYGLDV

SEQ ID NO: 48431 - protein, 10 aa, Homo sapiens
  light chain complementarity determining region 3 for antibody 24216
QRTCIAPLYT

SEQ ID NO: 48432 - protein, 14 aa, Homo sapiens
  heavy chain complementarity determining region 3 for antibody 24216
TKGSPHGGSTLRTS

SEQ ID NO: 48433 - protein, 9 aa, Homo sapiens
  light chain complementarity determining region 3 for antibody 24217
QQYNSYPYT

SEQ ID NO: 48434 - protein, 8 aa, Homo sapiens
  heavy chain complementarity determining region 3 for antibody 24217
ARDPYYDY

SEQ ID NO: 48435 - protein, 9 aa, Homo sapiens
  light chain complementarity determining region 3 for antibody 24218
QQYNSYPLT

SEQ ID NO: 48436 - protein, 10 aa, Homo sapiens
  heavy chain complementarity determining region 3 for antibody 24218
AKDKIGYFDF

SEQ ID NO: 48437 - protein, 9 aa, Homo sapiens
  light chain complementarity determining region 3 for antibody 24219
QQYNSYPFT

SEQ ID NO: 48438 - protein, 13 aa, Homo sapiens
  heavy chain complementarity determining region 3 for antibody 24219
TRLPLRGSWHFQP

SEQ ID NO: 48439 - protein, 9 aa, Homo sapiens
  light chain complementarity determining region 3 for antibody 24220
QQYDNLPPT

SEQ ID NO: 48440 - protein, 12 aa, Homo sapiens
  heavy chain complementarity determining region 3 for antibody 24220
ARLFSSTWYKDF

SEQ ID NO: 48441 - protein, 9 aa, Homo sapiens
  light chain complementarity determining region 3 for antibody 24221
QQYDDLPYT

SEQ ID NO: 48442 - protein, 16 aa, Homo sapiens
  heavy chain complementarity determining region 3 for antibody 24221
ARDRRPMFGAYFGMDV

SEQ ID NO: 48443 - protein, 9 aa, Homo sapiens
  light chain complementarity determining region 3 for antibody 24222
QQYCTTPIT

SEQ ID NO: 48444 - protein, 8 aa, Homo sapiens
  heavy chain complementarity determining region 3 for antibody 24222
VKLSDGIK

SEQ ID NO: 48445 - protein, 9 aa, Homo sapiens
  light chain complementarity determining region 3 for antibody 24223
QQSYSTPRT

SEQ ID NO: 48446 - protein, 14 aa, Homo sapiens
  heavy chain complementarity determining region 3 for antibody 24223
ARGIEGRGQYYFDY

SEQ ID NO: 48447 - protein, 10 aa, Homo sapiens
  light chain complementarity determining region 3 for antibody 24224
QQSYSTPQYT

SEQ ID NO: 48448 - protein, 15 aa, Homo sapiens
  heavy chain complementarity determining region 3 for antibody 24224
ARQHDYGNYWRAFDI

SEQ ID NO: 48449 - protein, 8 aa, Homo sapiens
  light chain complementarity determining region 3 for antibody 24225
QQSYSTNT

SEQ ID NO: 48450 - protein, 15 aa, Homo sapiens
  heavy chain complementarity determining region 3 for antibody 24225
AREGRRPSSGSYFDY

SEQ ID NO: 48451 - protein, 10 aa, Homo sapiens
  light chain complementarity determining region 3 for antibody 24226
QQRSNWPPIT

SEQ ID NO: 48452 - protein, 16 aa, Homo sapiens
  heavy chain complementarity determining region 3 for antibody 24226
ARASGIVRRTPYFFKH

SEQ ID NO: 48453 - protein, 11 aa, Homo sapiens
  light chain complementarity determining region 3 for antibody 24227
QQRNNWPPEGT

SEQ ID NO: 48454 - protein, 16 aa, Homo sapiens
  heavy chain complementarity determining region 3 for antibody 24227
ATWSYLPQRHYWYFDL

SEQ ID NO: 48455 - protein, 9 aa, Homo sapiens
  light chain complementarity determining region 3 for antibody 24228
QQLHKSPWT

SEQ ID NO: 48456 - protein, 14 aa, Homo sapiens
  heavy chain complementarity determining region 3 for antibody 24228
ARAAPEYEWLVPDY

SEQ ID NO: 48457 - protein, 9 aa, Homo sapiens
  light chain complementarity determining region 3 for antibody 24229
QQFDDSGYT

SEQ ID NO: 48458 - protein, 13 aa, Homo sapiens
  heavy chain complementarity determining region 3 for antibody 24229
VRERHPGAFYFDF

SEQ ID NO: 48459 - protein, 9 aa, Homo sapiens
  light chain complementarity determining region 3 for antibody 24230
QQANSFVFT

SEQ ID NO: 48460 - protein, 16 aa, Homo sapiens
  heavy chain complementarity determining region 3 for antibody 24230
ARDGIVVVTATPGFDY

SEQ ID NO: 48461 - protein, 10 aa, Homo sapiens
  light chain complementarity determining region 3 for antibody 24231
QPYNRYYPWT

SEQ ID NO: 48462 - protein, 13 aa, Homo sapiens
  heavy chain complementarity determining region 3 for antibody 24231
AADSYVSLADFDY

SEQ ID NO: 48463 - protein, 11 aa, Homo sapiens
  light chain complementarity determining region 3 for antibody 24232
QHYGTSPAMYT

SEQ ID NO: 48464 - protein, 16 aa, Homo sapiens
  heavy chain complementarity determining region 3 for antibody 24232
ATPYLAVSGPLDAFDI

SEQ ID NO: 48465 - protein, 9 aa, Homo sapiens
  light chain complementarity determining region 3 for antibody 24233
QHYDSYPYT

SEQ ID NO: 48466 - protein, 23 aa, Homo sapiens
  heavy chain complementarity determining region 3 for antibody 24233
ARPGYSNSWHIGGPDYVNYGTDV

SEQ ID NO: 48467 - protein, 9 aa, Homo sapiens
  light chain complementarity determining region 3 for antibody 24234
MQSRRGPHT

SEQ ID NO: 48468 - protein, 8 aa, Homo sapiens
  heavy chain complementarity determining region 3 for antibody 24234
TAWGSSQH

SEQ ID NO: 48469 - protein, 9 aa, Homo sapiens
  light chain complementarity determining region 3 for antibody 24235
MQQTHFPHT

SEQ ID NO: 48470 - protein, 14 aa, Homo sapiens
  heavy chain complementarity determining region 3 for antibody 24235
AREGGYSGYEHFDY

SEQ ID NO: 48471 - protein, 9 aa, Homo sapiens
  light chain complementarity determining region 3 for antibody 24236
MQILQTPIT

SEQ ID NO: 48472 - protein, 12 aa, Homo sapiens
  heavy chain complementarity determining region 3 for antibody 24236
ARDGGSSWSEFT

SEQ ID NO: 48473 - protein, 9 aa, Homo sapiens
  light chain complementarity determining region 3 for antibody 24237
LQHNSYPPT

SEQ ID NO: 48474 - protein, 18 aa, Homo sapiens
  heavy chain complementarity determining region 3 for antibody 24237
AKDFHDSSGYYYGANFDY

SEQ ID NO: 48475 - protein, 10 aa, Homo sapiens
  light chain complementarity determining region 3 for antibody 24238
HQYGTSSMYI

SEQ ID NO: 48476 - protein, 9 aa, Homo sapiens
  heavy chain complementarity determining region 3 for antibody 24238
ARGGGGFDY

SEQ ID NO: 48477 - protein, 9 aa, Homo sapiens
  light chain complementarity determining region 3 for antibody 24239
QQYNSYPVT

SEQ ID NO: 48478 - protein, 12 aa, Homo sapiens
  heavy chain complementarity determining region 3 for antibody 24239
ARKRPGTTHFDY

SEQ ID NO: 48479 - protein, 9 aa, Homo sapiens
  light chain complementarity determining region 3 for antibody 24240
QQYNSFPLT

SEQ ID NO: 48480 - protein, 10 aa, Homo sapiens
  heavy chain complementarity determining region 3 for antibody 24240
SRYSDRSAPD

SEQ ID NO: 48481 - protein, 9 aa, Homo sapiens
  light chain complementarity determining region 3 for antibody 24241
QQYNGYSRT

SEQ ID NO: 48482 - protein, 18 aa, Homo sapiens
  heavy chain complementarity determining region 3 for antibody 24241
ARDFGGRAYTKVENAFDI

SEQ ID NO: 48483 - protein, 9 aa, Homo sapiens
  light chain complementarity determining region 3 for antibody 24242
QQYGSSSST

SEQ ID NO: 48484 - protein, 15 aa, Homo sapiens
  heavy chain complementarity determining region 3 for antibody 24242
ARRISPYNNAWYLDY

SEQ ID NO: 48485 - protein, 9 aa, Homo sapiens
  light chain complementarity determining region 3 for antibody 24243
QQYGSSPVT

SEQ ID NO: 48486 - protein, 21 aa, Homo sapiens
  heavy chain complementarity determining region 3 for antibody 24243
ARVPPRYDSSGYPTPGGYMDV

SEQ ID NO: 48487 - protein, 6 aa, Homo sapiens
  light chain complementarity determining region 3 for antibody 24244
QQYGRT

SEQ ID NO: 48488 - protein, 9 aa, Homo sapiens
  heavy chain complementarity determining region 3 for antibody 24244
ARGGHWFDP

SEQ ID NO: 48489 - protein, 9 aa, Homo sapiens
  light chain complementarity determining region 3 for antibody 24245
QQYGASPRT

SEQ ID NO: 48490 - protein, 16 aa, Homo sapiens
  heavy chain complementarity determining region 3 for antibody 24245
AKSLGWDTMTTRVYDS

SEQ ID NO: 48491 - protein, 11 aa, Homo sapiens
  light chain complementarity determining region 3 for antibody 24246
QQWSTSGSRYS

SEQ ID NO: 48492 - protein, 14 aa, Homo sapiens
  heavy chain complementarity determining region 3 for antibody 24246
ARHTEMTGLRGFDR

SEQ ID NO: 48493 - protein, 8 aa, Homo sapiens
  light chain complementarity determining region 3 for antibody 24247
QQSYTSPS

SEQ ID NO: 48494 - protein, 13 aa, Homo sapiens
  heavy chain complementarity determining region 3 for antibody 24247
ARVSSGWARESDY

SEQ ID NO: 48495 - protein, 9 aa, Homo sapiens
  light chain complementarity determining region 3 for antibody 24248
QQLNSYPLT

SEQ ID NO: 48496 - protein, 26 aa, Homo sapiens
  heavy chain complementarity determining region 3 for antibody 24248
ARDPEGGYYYDSSGYYGNYYYYGMDV

SEQ ID NO: 48497 - protein, 9 aa, Homo sapiens
  light chain complementarity determining region 3 for antibody 24249
QQLNSYPHT

SEQ ID NO: 48498 - protein, 12 aa, Homo sapiens
  heavy chain complementarity determining region 3 for antibody 24249
ARGGASSRYFDL

SEQ ID NO: 48499 - protein, 9 aa, Homo sapiens
  light chain complementarity determining region 3 for antibody 24250
QQFHAYPFT

SEQ ID NO: 48500 - protein, 12 aa, Homo sapiens
  heavy chain complementarity determining region 3 for antibody 24250
ARPLDGDYGFDP

SEQ ID NO: 48501 - protein, 9 aa, Homo sapiens
  light chain complementarity determining region 3 for antibody 24251
QQCVDSPWT

SEQ ID NO: 48502 - protein, 15 aa, Homo sapiens
  heavy chain complementarity determining region 3 for antibody 24251
ASPPVGDYPKGVLDI

SEQ ID NO: 48503 - protein, 10 aa, Homo sapiens
  light chain complementarity determining region 3 for antibody 24252
QQCHATPPYT

SEQ ID NO: 48504 - protein, 14 aa, Homo sapiens
  heavy chain complementarity determining region 3 for antibody 24252
TTDAGLIHRPIFDY

SEQ ID NO: 48505 - protein, 9 aa, Homo sapiens
  light chain complementarity determining region 3 for antibody 24253
QQANSFPPT

SEQ ID NO: 48506 - protein, 11 aa, Homo sapiens
  heavy chain complementarity determining region 3 for antibody 24253
ASGAWGRYFYF

SEQ ID NO: 48507 - protein, 10 aa, Homo sapiens
  light chain complementarity determining region 3 for antibody 24254
MQSIQPPRGT

SEQ ID NO: 48508 - protein, 8 aa, Homo sapiens
  heavy chain complementarity determining region 3 for antibody 24254
AKGYGFDC

SEQ ID NO: 48509 - protein, 8 aa, Homo sapiens
  light chain complementarity determining region 3 for antibody 24255
MQALQPLT

SEQ ID NO: 48510 - protein, 16 aa, Homo sapiens
  heavy chain complementarity determining region 3 for antibody 24255
AKAGWVVGYDLSRGCA

SEQ ID NO: 48511 - protein, 10 aa, Homo sapiens
  light chain complementarity determining region 3 for antibody 24256
QQYSHWPPET

SEQ ID NO: 48512 - protein, 16 aa, Homo sapiens
  heavy chain complementarity determining region 3 for antibody 24256
ATYYSNWPYFYYGFDV

SEQ ID NO: 48513 - protein, 9 aa, Homo sapiens
  light chain complementarity determining region 3 for antibody 24257
QQYNTYPRT

SEQ ID NO: 48514 - protein, 18 aa, Homo sapiens
  heavy chain complementarity determining region 3 for antibody 24257
ARTRRIVFGGGPRVPLDY

SEQ ID NO: 48515 - protein, 9 aa, Homo sapiens
  light chain complementarity determining region 3 for antibody 24258
QQYNSYPYT

SEQ ID NO: 48516 - protein, 14 aa, Homo sapiens
  heavy chain complementarity determining region 3 for antibody 24258
AKEQHSSGWSAIDY

SEQ ID NO: 48517 - protein, 9 aa, Homo sapiens
  light chain complementarity determining region 3 for antibody 24259
QQYNSYPLT

SEQ ID NO: 48518 - protein, 14 aa, Homo sapiens
  heavy chain complementarity determining region 3 for antibody 24259
ARGNLGESRNWFDP

SEQ ID NO: 48519 - protein, 9 aa, Homo sapiens
  light chain complementarity determining region 3 for antibody 24260
QQYNRYSET

SEQ ID NO: 48520 - protein, 9 aa, Homo sapiens
  heavy chain complementarity determining region 3 for antibody 24260
ARILGTNDY

SEQ ID NO: 48521 - protein, 9 aa, Homo sapiens
  light chain complementarity determining region 3 for antibody 24261
QQYNNWPWT

SEQ ID NO: 48522 - protein, 20 aa, Homo sapiens
  heavy chain complementarity determining region 3 for antibody 24261
ARDFFPFPRGPDSFDDVFDL

SEQ ID NO: 48523 - protein, 10 aa, Homo sapiens
  light chain complementarity determining region 3 for antibody 24262
QQYNNWPPIT

SEQ ID NO: 48524 - protein, 13 aa, Homo sapiens
  heavy chain complementarity determining region 3 for antibody 24262
VSDHYYDSSGYYW

SEQ ID NO: 48525 - protein, 11 aa, Homo sapiens
  light chain complementarity determining region 3 for antibody 24263
QQYGTSSPHWA

SEQ ID NO: 48526 - protein, 12 aa, Homo sapiens
  heavy chain complementarity determining region 3 for antibody 24263
VKEKRGVRVFDL

SEQ ID NO: 48527 - protein, 8 aa, Homo sapiens
  light chain complementarity determining region 3 for antibody 24264
QQYGSSVT

SEQ ID NO: 48528 - protein, 21 aa, Homo sapiens
  heavy chain complementarity determining region 3 for antibody 24264
ARGSFEHCSGGSCYFYYGMDV

SEQ ID NO: 48529 - protein, 9 aa, Homo sapiens
  light chain complementarity determining region 3 for antibody 24265
QQYGSSPRT

SEQ ID NO: 48530 - protein, 13 aa, Homo sapiens
  heavy chain complementarity determining region 3 for antibody 24265
AKDMDTKVTGSDH

SEQ ID NO: 48531 - protein, 10 aa, Homo sapiens
  light chain complementarity determining region 3 for antibody 24266
QQYGSSPPIT

SEQ ID NO: 48532 - protein, 15 aa, Homo sapiens
  heavy chain complementarity determining region 3 for antibody 24266
ASRPPDGHTILVFNY

SEQ ID NO: 48533 - protein, 10 aa, Homo sapiens
  light chain complementarity determining region 3 for antibody 24267
QQYGSSLGYT

SEQ ID NO: 48534 - protein, 13 aa, Homo sapiens
  heavy chain complementarity determining region 3 for antibody 24267
AHSGYQVYYGMDV

SEQ ID NO: 48535 - protein, 9 aa, Homo sapiens
  light chain complementarity determining region 3 for antibody 24268
QQYGNSPLT

SEQ ID NO: 48536 - protein, 15 aa, Homo sapiens
  heavy chain complementarity determining region 3 for antibody 24268
AKSDSQYYYYYAMDV

SEQ ID NO: 48537 - protein, 10 aa, Homo sapiens
  light chain complementarity determining region 3 for antibody 24269
QQYANQPPIT

SEQ ID NO: 48538 - protein, 12 aa, Homo sapiens
  heavy chain complementarity determining region 3 for antibody 24269
ARVLDSLSPAFH

SEQ ID NO: 48539 - protein, 9 aa, Homo sapiens
  light chain complementarity determining region 3 for antibody 24270
QQSYSTPRT

SEQ ID NO: 48540 - protein, 15 aa, Homo sapiens
  heavy chain complementarity determining region 3 for antibody 24270
VRHYRETVAGIEGDS

SEQ ID NO: 48541 - protein, 10 aa, Homo sapiens
  light chain complementarity determining region 3 for antibody 24271
QQSYSTPPYT

SEQ ID NO: 48542 - protein, 12 aa, Homo sapiens
  heavy chain complementarity determining region 3 for antibody 24271
ARESSGWSFFDL

SEQ ID NO: 48543 - protein, 9 aa, Homo sapiens
  light chain complementarity determining region 3 for antibody 24272
QQSFTSPIT

SEQ ID NO: 48544 - protein, 17 aa, Homo sapiens
  heavy chain complementarity determining region 3 for antibody 24272
ARGTRPLTSAEQNWLDP

SEQ ID NO: 48545 - protein, 8 aa, Homo sapiens
  light chain complementarity determining region 3 for antibody 24273
QQRWNSGA

SEQ ID NO: 48546 - protein, 14 aa, Homo sapiens
  heavy chain complementarity determining region 3 for antibody 24273
ATGIPAAFRYYFEY

SEQ ID NO: 48547 - protein, 9 aa, Homo sapiens
  light chain complementarity determining region 3 for antibody 24274
QQCNSYPLT

SEQ ID NO: 48548 - protein, 12 aa, Homo sapiens
  heavy chain complementarity determining region 3 for antibody 24274
TRGGGPNSPFHY

SEQ ID NO: 48549 - protein, 9 aa, Homo sapiens
  light chain complementarity determining region 3 for antibody 24275
QQANSFPRT

SEQ ID NO: 48550 - protein, 12 aa, Homo sapiens
  heavy chain complementarity determining region 3 for antibody 24275
VREDFWDRMFDH

SEQ ID NO: 48551 - protein, 10 aa, Homo sapiens
  light chain complementarity determining region 3 for antibody 24276
QLYNSYSLWT

SEQ ID NO: 48552 - protein, 13 aa, Homo sapiens
  heavy chain complementarity determining region 3 for antibody 24276
ARQGQWLIGGLDY

SEQ ID NO: 48553 - protein, 9 aa, Homo sapiens
  light chain complementarity determining region 3 for antibody 24277
MQGSHWPPT

SEQ ID NO: 48554 - protein, 7 aa, Homo sapiens
  heavy chain complementarity determining region 3 for antibody 24277
ATNADYL

SEQ ID NO: 48555 - protein, 9 aa, Homo sapiens
  light chain complementarity determining region 3 for antibody 24278
MQGLQSPPT

SEQ ID NO: 48556 - protein, 18 aa, Homo sapiens
  heavy chain complementarity determining region 3 for antibody 24278
THRAVSFHGYYSAWSFDY

SEQ ID NO: 48557 - protein, 9 aa, Homo sapiens
  light chain complementarity determining region 3 for antibody 24279
LQHNSYLPT

SEQ ID NO: 48558 - protein, 19 aa, Homo sapiens
  heavy chain complementarity determining region 3 for antibody 24279
ARRGATVAGISGWGYGMDV

SEQ ID NO: 48559 - protein, 9 aa, Homo sapiens
  light chain complementarity determining region 3 for antibody 24280
LQDFNYPRT

SEQ ID NO: 48560 - protein, 20 aa, Homo sapiens
  heavy chain complementarity determining region 3 for antibody 24280
ARVDGSLRPDNSGREEYFDY

SEQ ID NO: 48561 - protein, 10 aa, Homo sapiens
  light chain complementarity determining region 3 for antibody 24281
KQYKNWPPFT

SEQ ID NO: 48562 - protein, 13 aa, Homo sapiens
  heavy chain complementarity determining region 3 for antibody 24281
ARDDILADNGFDY

SEQ ID NO: 48563 - protein, 9 aa, Homo sapiens
  light chain complementarity determining region 3 for antibody 24282
HQYNIYSGT

SEQ ID NO: 48564 - protein, 13 aa, Homo sapiens
  heavy chain complementarity determining region 3 for antibody 24282
AKRSGAVAGTLDY

SEQ ID NO: 48565 - protein, 9 aa, Homo sapiens
  light chain complementarity determining region 3 for antibody 24283
HQYDHSPRT

SEQ ID NO: 48566 - protein, 22 aa, Homo sapiens
  heavy chain complementarity determining region 3 for antibody 24283
VRDWERQAYCDGGGCQQDAFDI

SEQ ID NO: 48567 - protein, 9 aa, Homo sapiens
  light chain complementarity determining region 3 for antibody 24284
HQSYSTPFS

SEQ ID NO: 48568 - protein, 14 aa, Homo sapiens
  heavy chain complementarity determining region 3 for antibody 24284
ATSADTSGYSNFDY

SEQ ID NO: 48569 - protein, 9 aa, Homo sapiens
  light chain complementarity determining region 3 for antibody 24285
HQSNSFPWT

SEQ ID NO: 48570 - protein, 13 aa, Homo sapiens
  heavy chain complementarity determining region 3 for antibody 24285
ARVIAQTATPFDS

SEQ ID NO: 48571 - protein, 9 aa, Homo sapiens
  light chain complementarity determining region 3 for antibody 24286
HHYGTPHRP

SEQ ID NO: 48572 - protein, 13 aa, Homo sapiens
  heavy chain complementarity determining region 3 for antibody 24286
VRDYVWGSQHPDY

SEQ ID NO: 48573 - protein, 8 aa, Homo sapiens
  light chain complementarity determining region 3 for antibody 24287
QQYNSLLT

SEQ ID NO: 48574 - protein, 17 aa, Homo sapiens
  heavy chain complementarity determining region 3 for antibody 24287
VKDGAGYSSSWWSYFDY

SEQ ID NO: 48575 - protein, 10 aa, Homo sapiens
  light chain complementarity determining region 3 for antibody 24288
QQYNHWARLS

SEQ ID NO: 48576 - protein, 12 aa, Homo sapiens
  heavy chain complementarity determining region 3 for antibody 24288
AKAYYFDTSGSF

SEQ ID NO: 48577 - protein, 9 aa, Homo sapiens
  light chain complementarity determining region 3 for antibody 24289
QQYGTSPLT

SEQ ID NO: 48578 - protein, 12 aa, Homo sapiens
  heavy chain complementarity determining region 3 for antibody 24289
ARVNWGLNAFDI

SEQ ID NO: 48579 - protein, 9 aa, Homo sapiens
  light chain complementarity determining region 3 for antibody 24290
QQYGSSPYT

SEQ ID NO: 48580 - protein, 16 aa, Homo sapiens
  heavy chain complementarity determining region 3 for antibody 24290
ARNTPIVVVTSHVFDI

SEQ ID NO: 48581 - protein, 9 aa, Homo sapiens
  light chain complementarity determining region 3 for antibody 24291
QQYGSSPPT

SEQ ID NO: 48582 - protein, 12 aa, Homo sapiens
  heavy chain complementarity determining region 3 for antibody 24291
VVGYSSGWYEVD

SEQ ID NO: 48583 - protein, 10 aa, Homo sapiens
  light chain complementarity determining region 3 for antibody 24292
QQYGSSPPLT

SEQ ID NO: 48584 - protein, 20 aa, Homo sapiens
  heavy chain complementarity determining region 3 for antibody 24292
ARLRKQLVLSNVYYYYGMDV

SEQ ID NO: 48585 - protein, 9 aa, Homo sapiens
  light chain complementarity determining region 3 for antibody 24293
QQYGSLPIT

SEQ ID NO: 48586 - protein, 11 aa, Homo sapiens
  heavy chain complementarity determining region 3 for antibody 24293
AHRFRTYYFDY

SEQ ID NO: 48587 - protein, 11 aa, Homo sapiens
  light chain complementarity determining region 3 for antibody 24294
QQYGPSPPLYT

SEQ ID NO: 48588 - protein, 10 aa, Homo sapiens
  heavy chain complementarity determining region 3 for antibody 24294
ARNDVYRIDH

SEQ ID NO: 48589 - protein, 10 aa, Homo sapiens
  light chain complementarity determining region 3 for antibody 24295
QQYGGSPPWT

SEQ ID NO: 48590 - protein, 14 aa, Homo sapiens
  heavy chain complementarity determining region 3 for antibody 24295
ARGGKSTYIPHFDY

SEQ ID NO: 48591 - protein, 9 aa, Homo sapiens
  light chain complementarity determining region 3 for antibody 24296
QQYGASPST

SEQ ID NO: 48592 - protein, 16 aa, Homo sapiens
  heavy chain complementarity determining region 3 for antibody 24296
ARDCRFGNYDDLPFDY

SEQ ID NO: 48593 - protein, 9 aa, Homo sapiens
  light chain complementarity determining region 3 for antibody 24297
QQYDYLPVT

SEQ ID NO: 48594 - protein, 15 aa, Homo sapiens
  heavy chain complementarity determining region 3 for antibody 24297
ARPPHAFTGENYFNF

SEQ ID NO: 48595 - protein, 9 aa, Homo sapiens
  light chain complementarity determining region 3 for antibody 24298
QQYDRSPRT

SEQ ID NO: 48596 - protein, 11 aa, Homo sapiens
  heavy chain complementarity determining region 3 for antibody 24298
ARSLPWAEAEY

SEQ ID NO: 48597 - protein, 9 aa, Homo sapiens
  light chain complementarity determining region 3 for antibody 24299
QQSYSTPYT

SEQ ID NO: 48598 - protein, 16 aa, Homo sapiens
  heavy chain complementarity determining region 3 for antibody 24299
AREHYVWGSYRADFDY

SEQ ID NO: 48599 - protein, 9 aa, Homo sapiens
  light chain complementarity determining region 3 for antibody 24300
QQSYSTPYT

SEQ ID NO: 48600 - protein, 17 aa, Homo sapiens
  heavy chain complementarity determining region 3 for antibody 24300
ARDSRGSSGWYGSGFDY

SEQ ID NO: 48601 - protein, 9 aa, Homo sapiens
  light chain complementarity determining region 3 for antibody 24301
QQSYSTPHT

SEQ ID NO: 48602 - protein, 16 aa, Homo sapiens
  heavy chain complementarity determining region 3 for antibody 24301
ARLNPPHLAAPDAFDI

SEQ ID NO: 48603 - protein, 8 aa, Homo sapiens
  light chain complementarity determining region 3 for antibody 24302
QQSYSAWT

SEQ ID NO: 48604 - protein, 14 aa, Homo sapiens
  heavy chain complementarity determining region 3 for antibody 24302
ARYCSGNSCYSMDH

SEQ ID NO: 48605 - protein, 9 aa, Homo sapiens
  light chain complementarity determining region 3 for antibody 24303
QQSNSFPRT

SEQ ID NO: 48606 - protein, 11 aa, Homo sapiens
  heavy chain complementarity determining region 3 for antibody 24303
ARERAVYGVDV

SEQ ID NO: 48607 - protein, 10 aa, Homo sapiens
  light chain complementarity determining region 3 for antibody 24304
QQRYNWPPYT

SEQ ID NO: 48608 - protein, 11 aa, Homo sapiens
  heavy chain complementarity determining region 3 for antibody 24304
ARGVGSYPFDS

SEQ ID NO: 48609 - protein, 11 aa, Homo sapiens
  light chain complementarity determining region 3 for antibody 24305
QQRSSWPRALT

SEQ ID NO: 48610 - protein, 19 aa, Homo sapiens
  heavy chain complementarity determining region 3 for antibody 24305
TRGDYYDSSGYHYEGYFDH

SEQ ID NO: 48611 - protein, 8 aa, Homo sapiens
  light chain complementarity determining region 3 for antibody 24306
QQRANWVT

SEQ ID NO: 48612 - protein, 14 aa, Homo sapiens
  heavy chain complementarity determining region 3 for antibody 24306
ARDASRASQYYFDY

SEQ ID NO: 48613 - protein, 9 aa, Homo sapiens
  light chain complementarity determining region 3 for antibody 24307
QQLSNYPHT

SEQ ID NO: 48614 - protein, 26 aa, Homo sapiens
  heavy chain complementarity determining region 3 for antibody 24307
ARGSRGYKDENSSLRRLQYYQYGMDV

SEQ ID NO: 48615 - protein, 9 aa, Homo sapiens
  light chain complementarity determining region 3 for antibody 24308
QHYSDIPWA

SEQ ID NO: 48616 - protein, 14 aa, Homo sapiens
  heavy chain complementarity determining region 3 for antibody 24308
AKCGHSYGNDAFDI

SEQ ID NO: 48617 - protein, 9 aa, Homo sapiens
  light chain complementarity determining region 3 for antibody 24309
QHYNQRPLT

SEQ ID NO: 48618 - protein, 15 aa, Homo sapiens
  heavy chain complementarity determining region 3 for antibody 24309
AREVIETTASDGFDM

SEQ ID NO: 48619 - protein, 9 aa, Homo sapiens
  light chain complementarity determining region 3 for antibody 24310
MQSRQTVRT

SEQ ID NO: 48620 - protein, 18 aa, Homo sapiens
  heavy chain complementarity determining region 3 for antibody 24310
ARLDYYYGSGMPGRGFDH

SEQ ID NO: 48621 - protein, 9 aa, Homo sapiens
  light chain complementarity determining region 3 for antibody 24311
LQHNSYPWT

SEQ ID NO: 48622 - protein, 14 aa, Homo sapiens
  heavy chain complementarity determining region 3 for antibody 24311
ARDLSGVLIGAWSH

SEQ ID NO: 48623 - protein, 9 aa, Homo sapiens
  light chain complementarity determining region 3 for antibody 24312
HHYGSSLYT

SEQ ID NO: 48624 - protein, 18 aa, Homo sapiens
  heavy chain complementarity determining region 3 for antibody 24312
ARGFGGYSGYTGREHIDF

SEQ ID NO: 48625 - protein, 11 aa, Homo sapiens
  light chain complementarity determining region 3 for antibody 24313
QRYDTSPPRYS

SEQ ID NO: 48626 - protein, 14 aa, Homo sapiens
  heavy chain complementarity determining region 3 for antibody 24313
ARHKQESGTRGFDF

SEQ ID NO: 48627 - protein, 10 aa, Homo sapiens
  light chain complementarity determining region 3 for antibody 24314
QRYDISQVYT

SEQ ID NO: 48628 - protein, 22 aa, Homo sapiens
  heavy chain complementarity determining region 3 for antibody 24314
ARVSRFSLVRGMTTYYYYGMDV

SEQ ID NO: 48629 - protein, 9 aa, Homo sapiens
  light chain complementarity determining region 3 for antibody 24315
QQYNSYPYT

SEQ ID NO: 48630 - protein, 15 aa, Homo sapiens
  heavy chain complementarity determining region 3 for antibody 24315
AKDRSNLYTSGWYVN

SEQ ID NO: 48631 - protein, 9 aa, Homo sapiens
  light chain complementarity determining region 3 for antibody 24316
QQYNSYPRT

SEQ ID NO: 48632 - protein, 14 aa, Homo sapiens
  heavy chain complementarity determining region 3 for antibody 24316
ARSGYCSGGSCPDY

SEQ ID NO: 48633 - protein, 9 aa, Homo sapiens
  light chain complementarity determining region 3 for antibody 24317
QQYNSYPRT

SEQ ID NO: 48634 - protein, 7 aa, Homo sapiens
  heavy chain complementarity determining region 3 for antibody 24317
ARGPFDY

SEQ ID NO: 48635 - protein, 9 aa, Homo sapiens
  light chain complementarity determining region 3 for antibody 24318
QQYKTYPFT

SEQ ID NO: 48636 - protein, 14 aa, Homo sapiens
  heavy chain complementarity determining region 3 for antibody 24318
AKSSDTSGYSLFDY

SEQ ID NO: 48637 - protein, 9 aa, Homo sapiens
  light chain complementarity determining region 3 for antibody 24319
QQYGSSPRT

SEQ ID NO: 48638 - protein, 17 aa, Homo sapiens
  heavy chain complementarity determining region 3 for antibody 24319
ARDMATAPPGTTENFDH

SEQ ID NO: 48639 - protein, 9 aa, Homo sapiens
  light chain complementarity determining region 3 for antibody 24320
QQYGSSPIT

SEQ ID NO: 48640 - protein, 17 aa, Homo sapiens
  heavy chain complementarity determining region 3 for antibody 24320
ARGRTRRRDSSGYLFDY

SEQ ID NO: 48641 - protein, 8 aa, Homo sapiens
  light chain complementarity determining region 3 for antibody 24321
QQYGSSLT

SEQ ID NO: 48642 - protein, 18 aa, Homo sapiens
  heavy chain complementarity determining region 3 for antibody 24321
ARAIVYDSSDYYRYYFDS

SEQ ID NO: 48643 - protein, 10 aa, Homo sapiens
  light chain complementarity determining region 3 for antibody 24322
QQYGSSLLIT

SEQ ID NO: 48644 - protein, 17 aa, Homo sapiens
  heavy chain complementarity determining region 3 for antibody 24322
ARRSRYSSNWYSHFFDY

SEQ ID NO: 48645 - protein, 9 aa, Homo sapiens
  light chain complementarity determining region 3 for antibody 24323
QQYGSSIFT

SEQ ID NO: 48646 - protein, 12 aa, Homo sapiens
  heavy chain complementarity determining region 3 for antibody 24323
ARHGGGTWYTDY

SEQ ID NO: 48647 - protein, 11 aa, Homo sapiens
  light chain complementarity determining region 3 for antibody 24324
QQYGRSPPGYT

SEQ ID NO: 48648 - protein, 14 aa, Homo sapiens
  heavy chain complementarity determining region 3 for antibody 24324
ARETNNSRKRSFDQ

SEQ ID NO: 48649 - protein, 9 aa, Homo sapiens
  light chain complementarity determining region 3 for antibody 24325
QQYDNLPLT

SEQ ID NO: 48650 - protein, 13 aa, Homo sapiens
  heavy chain complementarity determining region 3 for antibody 24325
ARDRAVGDHIFDY

SEQ ID NO: 48651 - protein, 9 aa, Homo sapiens
  light chain complementarity determining region 3 for antibody 24326
QQSYSTPWT

SEQ ID NO: 48652 - protein, 15 aa, Homo sapiens
  heavy chain complementarity determining region 3 for antibody 24326
ASRYSSGWYYYGMDV

SEQ ID NO: 48653 - protein, 8 aa, Homo sapiens
  light chain complementarity determining region 3 for antibody 24327
QQSYSSRA

SEQ ID NO: 48654 - protein, 13 aa, Homo sapiens
  heavy chain complementarity determining region 3 for antibody 24327
AMSSMGRGVSFVN

SEQ ID NO: 48655 - protein, 9 aa, Homo sapiens
  light chain complementarity determining region 3 for antibody 24328
QQSSSTFRT

SEQ ID NO: 48656 - protein, 23 aa, Homo sapiens
  heavy chain complementarity determining region 3 for antibody 24328
ARDVRLVNFDWLSQPNYYYAMDV

SEQ ID NO: 48657 - protein, 8 aa, Homo sapiens
  light chain complementarity determining region 3 for antibody 24329
QQSSDWLT

SEQ ID NO: 48658 - protein, 12 aa, Homo sapiens
  heavy chain complementarity determining region 3 for antibody 24329
ARTQWHTMSIDY

SEQ ID NO: 48659 - protein, 10 aa, Homo sapiens
  light chain complementarity determining region 3 for antibody 24330
QQSGSSPQIT

SEQ ID NO: 48660 - protein, 10 aa, Homo sapiens
  heavy chain complementarity determining region 3 for antibody 24330
ARGDPAPFDS

SEQ ID NO: 48661 - protein, 9 aa, Homo sapiens
  light chain complementarity determining region 3 for antibody 24331
QQRGNLPLT

SEQ ID NO: 48662 - protein, 11 aa, Homo sapiens
  heavy chain complementarity determining region 3 for antibody 24331
ARDRGYWINDY

SEQ ID NO: 48663 - protein, 9 aa, Homo sapiens
  light chain complementarity determining region 3 for antibody 24332
QQLNSYPYT

SEQ ID NO: 48664 - protein, 16 aa, Homo sapiens
  heavy chain complementarity determining region 3 for antibody 24332
ARDLAIVMVTVYGMDV

SEQ ID NO: 48665 - protein, 10 aa, Homo sapiens
  light chain complementarity determining region 3 for antibody 24333
QHYGSSPGFT

SEQ ID NO: 48666 - protein, 12 aa, Homo sapiens
  heavy chain complementarity determining region 3 for antibody 24333
AHSDTPLGALYP

SEQ ID NO: 48667 - protein, 9 aa, Homo sapiens
  light chain complementarity determining region 3 for antibody 24334
MQGTHWPLT

SEQ ID NO: 48668 - protein, 11 aa, Homo sapiens
  heavy chain complementarity determining region 3 for antibody 24334
ARDIGWNALDL

SEQ ID NO: 48669 - protein, 9 aa, Homo sapiens
  light chain complementarity determining region 3 for antibody 24335
MQGLQTPYT

SEQ ID NO: 48670 - protein, 10 aa, Homo sapiens
  heavy chain complementarity determining region 3 for antibody 24335
ARDVVGSDDQ

SEQ ID NO: 48671 - protein, 9 aa, Homo sapiens
  light chain complementarity determining region 3 for antibody 24336
MQGIHWPGT

SEQ ID NO: 48672 - protein, 6 aa, Homo sapiens
  heavy chain complementarity determining region 3 for antibody 24336
AREGSV

SEQ ID NO: 48673 - protein, 8 aa, Homo sapiens
  light chain complementarity determining region 3 for antibody 24337
MQALRGFT

SEQ ID NO: 48674 - protein, 14 aa, Homo sapiens
  heavy chain complementarity determining region 3 for antibody 24337
AYNSPTVLTPGFDY

SEQ ID NO: 48675 - protein, 10 aa, Homo sapiens
  light chain complementarity determining region 3 for antibody 24338
MQALHTPLFT

SEQ ID NO: 48676 - protein, 15 aa, Homo sapiens
  heavy chain complementarity determining region 3 for antibody 24338
APYYFDTSAYYGGGY

SEQ ID NO: 48677 - protein, 9 aa, Homo sapiens
  light chain complementarity determining region 3 for antibody 24339
MQALETPLT

SEQ ID NO: 48678 - protein, 12 aa, Homo sapiens
  heavy chain complementarity determining region 3 for antibody 24339
THRLNWGSGFDY

SEQ ID NO: 48679 - protein, 9 aa, Homo sapiens
  light chain complementarity determining region 3 for antibody 24340
HQSSSLPHT

SEQ ID NO: 48680 - protein, 13 aa, Homo sapiens
  heavy chain complementarity determining region 3 for antibody 24340
ARDLAFGEGYFDS

SEQ ID NO: 48681 - protein, 11 aa, Homo sapiens
  light chain complementarity determining region 3 for antibody 24341
HLYGSSPPGYT

SEQ ID NO: 48682 - protein, 11 aa, Homo sapiens
  heavy chain complementarity determining region 3 for antibody 24341
ARHGTDYYFDY

SEQ ID NO: 48683 - protein, 9 aa, Homo sapiens
  light chain complementarity determining region 3 for antibody 24342
HKYNSALGT

SEQ ID NO: 48684 - protein, 12 aa, Homo sapiens
  heavy chain complementarity determining region 3 for antibody 24342
ARDGYNNKESDY

SEQ ID NO: 48685 - protein, 9 aa, Homo sapiens
  light chain complementarity determining region 3 for antibody 24343
EQRHNWPVT

SEQ ID NO: 48686 - protein, 13 aa, Homo sapiens
  heavy chain complementarity determining region 3 for antibody 24343
VRDRGYTGYPLDF

SEQ ID NO: 48687 - protein, 9 aa, Homo sapiens
  light chain complementarity determining region 3 for antibody 24344
QQYSTYPYT

SEQ ID NO: 48688 - protein, 13 aa, Homo sapiens
  heavy chain complementarity determining region 3 for antibody 24344
AKRDILPREAFDI

SEQ ID NO: 48689 - protein, 9 aa, Homo sapiens
  light chain complementarity determining region 3 for antibody 24345
QQYRSYPRT

SEQ ID NO: 48690 - protein, 10 aa, Homo sapiens
  heavy chain complementarity determining region 3 for antibody 24345
ARGSGNYPDN

SEQ ID NO: 48691 - protein, 8 aa, Homo sapiens
  light chain complementarity determining region 3 for antibody 24346
QQYNTYST

SEQ ID NO: 48692 - protein, 19 aa, Homo sapiens
  heavy chain complementarity determining region 3 for antibody 24346
VRQGYCSSSACSVGWYIDL

SEQ ID NO: 48693 - protein, 9 aa, Homo sapiens
  light chain complementarity determining region 3 for antibody 24347
QQYNDWPIT

SEQ ID NO: 48694 - protein, 14 aa, Homo sapiens
  heavy chain complementarity determining region 3 for antibody 24347
ALTGDLRLRAYFEY

SEQ ID NO: 48695 - protein, 9 aa, Homo sapiens
  light chain complementarity determining region 3 for antibody 24348
QQYNAYPFT

SEQ ID NO: 48696 - protein, 14 aa, Homo sapiens
  heavy chain complementarity determining region 3 for antibody 24348
ARDWGRSGDDAFDI

SEQ ID NO: 48697 - protein, 9 aa, Homo sapiens
  light chain complementarity determining region 3 for antibody 24349
QQYDNLRLT

SEQ ID NO: 48698 - protein, 18 aa, Homo sapiens
  heavy chain complementarity determining region 3 for antibody 24349
ARQKRDGSGSYYDWYFDL

SEQ ID NO: 48699 - protein, 9 aa, Homo sapiens
  light chain complementarity determining region 3 for antibody 24350
QQTYSTPLT

SEQ ID NO: 48700 - protein, 15 aa, Homo sapiens
  heavy chain complementarity determining region 3 for antibody 24350
AKDKGWLPQFWYFDY

SEQ ID NO: 48701 - protein, 9 aa, Homo sapiens
  light chain complementarity determining region 3 for antibody 24351
QQSYSTPLT

SEQ ID NO: 48702 - protein, 12 aa, Homo sapiens
  heavy chain complementarity determining region 3 for antibody 24351
TTTQWLDEYFQH

SEQ ID NO: 48703 - protein, 9 aa, Homo sapiens
  light chain complementarity determining region 3 for antibody 24352
QQSYSSPRT

SEQ ID NO: 48704 - protein, 12 aa, Homo sapiens
  heavy chain complementarity determining region 3 for antibody 24352
ARSRTLRDAFDI

SEQ ID NO: 48705 - protein, 9 aa, Homo sapiens
  light chain complementarity determining region 3 for antibody 24353
QQSSFSPLT

SEQ ID NO: 48706 - protein, 10 aa, Homo sapiens
  heavy chain complementarity determining region 3 for antibody 24353
AGGSGWLPDH

SEQ ID NO: 48707 - protein, 9 aa, Homo sapiens
  light chain complementarity determining region 3 for antibody 24354
QQNLNLPLT

SEQ ID NO: 48708 - protein, 16 aa, Homo sapiens
  heavy chain complementarity determining region 3 for antibody 24354
ASSAAAEGTASAMFDF

SEQ ID NO: 48709 - protein, 9 aa, Homo sapiens
  light chain complementarity determining region 3 for antibody 24355
QQLNSYPQD

SEQ ID NO: 48710 - protein, 16 aa, Homo sapiens
  heavy chain complementarity determining region 3 for antibody 24355
ARIKRSLVGAQDAFDI

SEQ ID NO: 48711 - protein, 9 aa, Homo sapiens
  light chain complementarity determining region 3 for antibody 24356
QQGYSTPRT

SEQ ID NO: 48712 - protein, 12 aa, Homo sapiens
  heavy chain complementarity determining region 3 for antibody 24356
ARVGSGWSYFDY

SEQ ID NO: 48713 - protein, 9 aa, Homo sapiens
  light chain complementarity determining region 3 for antibody 24357
QQGNGHPYT

SEQ ID NO: 48714 - protein, 15 aa, Homo sapiens
  heavy chain complementarity determining region 3 for antibody 24357
ARDGWLPATKSFFNY

SEQ ID NO: 48715 - protein, 9 aa, Homo sapiens
  light chain complementarity determining region 3 for antibody 24358
QQCKSWPLT

SEQ ID NO: 48716 - protein, 11 aa, Homo sapiens
  heavy chain complementarity determining region 3 for antibody 24358
AAATRWLAFDS

SEQ ID NO: 48717 - protein, 9 aa, Homo sapiens
  light chain complementarity determining region 3 for antibody 24359
QQCDTLPRT

SEQ ID NO: 48718 - protein, 19 aa, Homo sapiens
  heavy chain complementarity determining region 3 for antibody 24359
ARDIQVFLGELNYQYGIDV

SEQ ID NO: 48719 - protein, 9 aa, Homo sapiens
  light chain complementarity determining region 3 for antibody 24360
QQANSFPFT

SEQ ID NO: 48720 - protein, 12 aa, Homo sapiens
  heavy chain complementarity determining region 3 for antibody 24360
TREPKRSGSFDY

SEQ ID NO: 48721 - protein, 9 aa, Homo sapiens
  light chain complementarity determining region 3 for antibody 24361
QQAHSFPFT

SEQ ID NO: 48722 - protein, 18 aa, Homo sapiens
  heavy chain complementarity determining region 3 for antibody 24361
AKEGSGMGLATRYWYFDV

SEQ ID NO: 48723 - protein, 9 aa, Homo sapiens
  light chain complementarity determining region 3 for antibody 24362
QHTHSRPFT

SEQ ID NO: 48724 - protein, 20 aa, Homo sapiens
  heavy chain complementarity determining region 3 for antibody 24362
AKGIAVAALRTVYYYYGLDV

SEQ ID NO: 48725 - protein, 9 aa, Homo sapiens
  light chain complementarity determining region 3 for antibody 24363
MQGTHWPYT

SEQ ID NO: 48726 - protein, 11 aa, Homo sapiens
  heavy chain complementarity determining region 3 for antibody 24363
ARDPAWGALDI

SEQ ID NO: 48727 - protein, 9 aa, Homo sapiens
  light chain complementarity determining region 3 for antibody 24364
MQGTHWPRT

SEQ ID NO: 48728 - protein, 17 aa, Homo sapiens
  heavy chain complementarity determining region 3 for antibody 24364
ARDAGSSWYLIVDAFDI

SEQ ID NO: 48729 - protein, 9 aa, Homo sapiens
  light chain complementarity determining region 3 for antibody 24365
MQGSHWPYT

SEQ ID NO: 48730 - protein, 10 aa, Homo sapiens
  heavy chain complementarity determining region 3 for antibody 24365
GRDNHGSIDY

SEQ ID NO: 48731 - protein, 9 aa, Homo sapiens
  light chain complementarity determining region 3 for antibody 24366
MQGLQIPFT

SEQ ID NO: 48732 - protein, 17 aa, Homo sapiens
  heavy chain complementarity determining region 3 for antibody 24366
ARDTEKATIGAEGAFDI

SEQ ID NO: 48733 - protein, 10 aa, Homo sapiens
  light chain complementarity determining region 3 for antibody 24367
MQALQTPGDT

SEQ ID NO: 48734 - protein, 14 aa, Homo sapiens
  heavy chain complementarity determining region 3 for antibody 24367
ARISKGTASIGFDP

SEQ ID NO: 48735 - protein, 9 aa, Homo sapiens
  light chain complementarity determining region 3 for antibody 24368
LHHNNYRWT

SEQ ID NO: 48736 - protein, 22 aa, Homo sapiens
  heavy chain complementarity determining region 3 for antibody 24368
TTDPSTQILGFLEWEYHYGTDV

SEQ ID NO: 48737 - protein, 10 aa, Homo sapiens
  light chain complementarity determining region 3 for antibody 24369
KQYGGSPKYS

SEQ ID NO: 48738 - protein, 15 aa, Homo sapiens
  heavy chain complementarity determining region 3 for antibody 24369
ATDGGRSQVHDGFDF

SEQ ID NO: 48739 - protein, 9 aa, Homo sapiens
  light chain complementarity determining region 3 for antibody 24370
HQYGSSPWT

SEQ ID NO: 48740 - protein, 14 aa, Homo sapiens
  heavy chain complementarity determining region 3 for antibody 24370
ARDLSLGMPGGFDY

SEQ ID NO: 48741 - protein, 9 aa, Homo sapiens
  light chain complementarity determining region 3 for antibody 24371
QQYSDVPLT

SEQ ID NO: 48742 - protein, 9 aa, Homo sapiens
  heavy chain complementarity determining region 3 for antibody 24371
VCLGVTPPV

SEQ ID NO: 48743 - protein, 9 aa, Homo sapiens
  light chain complementarity determining region 3 for antibody 24372
QQYQNHPPT

SEQ ID NO: 48744 - protein, 15 aa, Homo sapiens
  heavy chain complementarity determining region 3 for antibody 24372
ARDLTIFGVLMTFDY

SEQ ID NO: 48745 - protein, 9 aa, Homo sapiens
  light chain complementarity determining region 3 for antibody 24373
QQYNSYSRT

SEQ ID NO: 48746 - protein, 12 aa, Homo sapiens
  heavy chain complementarity determining region 3 for antibody 24373
ARDIGSEDYFDY

SEQ ID NO: 48747 - protein, 9 aa, Homo sapiens
  light chain complementarity determining region 3 for antibody 24374
QQYNSFPYT

SEQ ID NO: 48748 - protein, 8 aa, Homo sapiens
  heavy chain complementarity determining region 3 for antibody 24374
TRGFAFDY

SEQ ID NO: 48749 - protein, 10 aa, Homo sapiens
  light chain complementarity determining region 3 for antibody 24375
QQYNNWPSYT

SEQ ID NO: 48750 - protein, 24 aa, Homo sapiens
  heavy chain complementarity determining region 3 for antibody 24375
ARDQRRSLTDISIFGGVRDYGLDV

SEQ ID NO: 48751 - protein, 10 aa, Homo sapiens
  light chain complementarity determining region 3 for antibody 24376
QQYNEWPAFT

SEQ ID NO: 48752 - protein, 15 aa, Homo sapiens
  heavy chain complementarity determining region 3 for antibody 24376
ARPLVIDGLYTGSDY

SEQ ID NO: 48753 - protein, 9 aa, Homo sapiens
  light chain complementarity determining region 3 for antibody 24377
QQYNDWLLT

SEQ ID NO: 48754 - protein, 23 aa, Homo sapiens
  heavy chain complementarity determining region 3 for antibody 24377
ARGPNIFSGSGTSYTGGFNWFDP

SEQ ID NO: 48755 - protein, 8 aa, Homo sapiens
  light chain complementarity determining region 3 for antibody 24378
QQYGSPIT

SEQ ID NO: 48756 - protein, 17 aa, Homo sapiens
  heavy chain complementarity determining region 3 for antibody 24378
ARMRGGVDRLLRYYHDY

SEQ ID NO: 48757 - protein, 9 aa, Homo sapiens
  light chain complementarity determining region 3 for antibody 24379
QQYGGSSYT

SEQ ID NO: 48758 - protein, 15 aa, Homo sapiens
  heavy chain complementarity determining region 3 for antibody 24379
AKDMLPGDTSMVFDY

SEQ ID NO: 48759 - protein, 8 aa, Homo sapiens
  light chain complementarity determining region 3 for antibody 24380
QQYDNLPT

SEQ ID NO: 48760 - protein, 10 aa, Homo sapiens
  heavy chain complementarity determining region 3 for antibody 24380
AKHNWYTFDY

SEQ ID NO: 48761 - protein, 9 aa, Homo sapiens
  light chain complementarity determining region 3 for antibody 24381
QQYDNLPPT

SEQ ID NO: 48762 - protein, 15 aa, Homo sapiens
  heavy chain complementarity determining region 3 for antibody 24381
SRDADYGDYVGFLDY

SEQ ID NO: 48763 - protein, 9 aa, Homo sapiens
  light chain complementarity determining region 3 for antibody 24382
QQSYSTPLT

SEQ ID NO: 48764 - protein, 15 aa, Homo sapiens
  heavy chain complementarity determining region 3 for antibody 24382
ARDGGGSDFGGSFDY

SEQ ID NO: 48765 - protein, 9 aa, Homo sapiens
  light chain complementarity determining region 3 for antibody 24383
QQSYSMSFT

SEQ ID NO: 48766 - protein, 15 aa, Homo sapiens
  heavy chain complementarity determining region 3 for antibody 24383
ARDPPLWSGYGVSDF

SEQ ID NO: 48767 - protein, 9 aa, Homo sapiens
  light chain complementarity determining region 3 for antibody 24384
QQSYSARWA

SEQ ID NO: 48768 - protein, 20 aa, Homo sapiens
  heavy chain complementarity determining region 3 for antibody 24384
VRDGTPATHESNSVWNAFDI

SEQ ID NO: 48769 - protein, 9 aa, Homo sapiens
  light chain complementarity determining region 3 for antibody 24385
QQSSSFPRT

SEQ ID NO: 48770 - protein, 13 aa, Homo sapiens
  heavy chain complementarity determining region 3 for antibody 24385
AREHIAGHRVLGG

SEQ ID NO: 48771 - protein, 10 aa, Homo sapiens
  light chain complementarity determining region 3 for antibody 24386
QQRSTWTPLT

SEQ ID NO: 48772 - protein, 9 aa, Homo sapiens
  heavy chain complementarity determining region 3 for antibody 24386
ATPFGETPF

SEQ ID NO: 48773 - protein, 9 aa, Homo sapiens
  light chain complementarity determining region 3 for antibody 24387
QQRSNWPQT

SEQ ID NO: 48774 - protein, 12 aa, Homo sapiens
  heavy chain complementarity determining region 3 for antibody 24387
AKDHSRSYFFDY

SEQ ID NO: 48775 - protein, 8 aa, Homo sapiens
  light chain complementarity determining region 3 for antibody 24388
QQRSNWLT

SEQ ID NO: 48776 - protein, 17 aa, Homo sapiens
  heavy chain complementarity determining region 3 for antibody 24388
ARPFRGGGVPSVWYFDL

SEQ ID NO: 48777 - protein, 8 aa, Homo sapiens
  light chain complementarity determining region 3 for antibody 24389
QQRSNLYT

SEQ ID NO: 48778 - protein, 12 aa, Homo sapiens
  heavy chain complementarity determining region 3 for antibody 24389
ARISDDTSAFDP

SEQ ID NO: 48779 - protein, 9 aa, Homo sapiens
  light chain complementarity determining region 3 for antibody 24390
QHYASSPQT

SEQ ID NO: 48780 - protein, 14 aa, Homo sapiens
  heavy chain complementarity determining region 3 for antibody 24390
ARDSLTLPGQPLDY

SEQ ID NO: 48781 - protein, 7 aa, Homo sapiens
  light chain complementarity determining region 3 for antibody 24391
QEYNGWT

SEQ ID NO: 48782 - protein, 10 aa, Homo sapiens
  heavy chain complementarity determining region 3 for antibody 24391
ARAGYGAFDL

SEQ ID NO: 48783 - protein, 9 aa, Homo sapiens
  light chain complementarity determining region 3 for antibody 24392
MQGTQWPYT

SEQ ID NO: 48784 - protein, 10 aa, Homo sapiens
  heavy chain complementarity determining region 3 for antibody 24392
ASGQFYQFDF

SEQ ID NO: 48785 - protein, 9 aa, Homo sapiens
  light chain complementarity determining region 3 for antibody 24393
MQGTHWPWT

SEQ ID NO: 48786 - protein, 12 aa, Homo sapiens
  heavy chain complementarity determining region 3 for antibody 24393
AKGPLITMTGMV

SEQ ID NO: 48787 - protein, 9 aa, Homo sapiens
  light chain complementarity determining region 3 for antibody 24394
MQALHTPRA

SEQ ID NO: 48788 - protein, 14 aa, Homo sapiens
  heavy chain complementarity determining region 3 for antibody 24394
VTLDYYYGSGSNLY

SEQ ID NO: 48789 - protein, 9 aa, Homo sapiens
  light chain complementarity determining region 3 for antibody 24395
LQYNSYPWT

SEQ ID NO: 48790 - protein, 12 aa, Homo sapiens
  heavy chain complementarity determining region 3 for antibody 24395
ARAIAAAAVSSD

SEQ ID NO: 48791 - protein, 8 aa, Homo sapiens
  light chain complementarity determining region 3 for antibody 24396
LQYGSSPT

SEQ ID NO: 48792 - protein, 11 aa, Homo sapiens
  heavy chain complementarity determining region 3 for antibody 24396
SMGGGIAVSHE

SEQ ID NO: 48793 - protein, 9 aa, Homo sapiens
  light chain complementarity determining region 3 for antibody 24397
LQHNSYPYT

SEQ ID NO: 48794 - protein, 15 aa, Homo sapiens
  heavy chain complementarity determining region 3 for antibody 24397
ARDYYGSGYYNGMDV

SEQ ID NO: 48795 - protein, 9 aa, Homo sapiens
  light chain complementarity determining region 3 for antibody 24398
LQHNRYPWT

SEQ ID NO: 48796 - protein, 6 aa, Homo sapiens
  heavy chain complementarity determining region 3 for antibody 24398
AKGPFI

SEQ ID NO: 48797 - protein, 9 aa, Homo sapiens
  light chain complementarity determining region 3 for antibody 24399
HQTGGLPHT

SEQ ID NO: 48798 - protein, 7 aa, Homo sapiens
  heavy chain complementarity determining region 3 for antibody 24399
VSVTRGV

SEQ ID NO: 48799 - protein, 9 aa, Homo sapiens
  light chain complementarity determining region 3 for antibody 24400
HQSGDLPYT

SEQ ID NO: 48800 - protein, 12 aa, Homo sapiens
  heavy chain complementarity determining region 3 for antibody 24400
ARVDSGSYWEDY

SEQ ID NO: 48801 - protein, 9 aa, Homo sapiens
  light chain complementarity determining region 3 for antibody 24401
HHYVRSPLS

SEQ ID NO: 48802 - protein, 14 aa, Homo sapiens
  heavy chain complementarity determining region 3 for antibody 24401
AGRIVAPTKTPFEF

SEQ ID NO: 48803 - protein, 9 aa, Homo sapiens
  light chain complementarity determining region 3 for antibody 24402
QQYYSYPLT

SEQ ID NO: 48804 - protein, 13 aa, Homo sapiens
  heavy chain complementarity determining region 3 for antibody 24402
ARLYRESPMVPDY

SEQ ID NO: 48805 - protein, 9 aa, Homo sapiens
  light chain complementarity determining region 3 for antibody 24403
QQYYSTPVT

SEQ ID NO: 48806 - protein, 14 aa, Homo sapiens
  heavy chain complementarity determining region 3 for antibody 24403
ARHEHDGSGSVIDY

SEQ ID NO: 48807 - protein, 9 aa, Homo sapiens
  light chain complementarity determining region 3 for antibody 24404
QQYSQYPWT

SEQ ID NO: 48808 - protein, 16 aa, Homo sapiens
  heavy chain complementarity determining region 3 for antibody 24404
AAVPNYGWNSDDAFHI

SEQ ID NO: 48809 - protein, 9 aa, Homo sapiens
  light chain complementarity determining region 3 for antibody 24405
QQYNNWPWT

SEQ ID NO: 48810 - protein, 15 aa, Homo sapiens
  heavy chain complementarity determining region 3 for antibody 24405
ARDFSSLWELLPFDY

SEQ ID NO: 48811 - protein, 9 aa, Homo sapiens
  light chain complementarity determining region 3 for antibody 24406
QQYMSYPLN

SEQ ID NO: 48812 - protein, 12 aa, Homo sapiens
  heavy chain complementarity determining region 3 for antibody 24406
IRVVSGTNHLDF

SEQ ID NO: 48813 - protein, 8 aa, Homo sapiens
  light chain complementarity determining region 3 for antibody 24407
QQYHTYWT

SEQ ID NO: 48814 - protein, 15 aa, Homo sapiens
  heavy chain complementarity determining region 3 for antibody 24407
ARGCGADCYAEYFQH

SEQ ID NO: 48815 - protein, 9 aa, Homo sapiens
  light chain complementarity determining region 3 for antibody 24408
QQYGTPPRT

SEQ ID NO: 48816 - protein, 15 aa, Homo sapiens
  heavy chain complementarity determining region 3 for antibody 24408
AHRPNYYDKAGAFDI

SEQ ID NO: 48817 - protein, 9 aa, Homo sapiens
  light chain complementarity determining region 3 for antibody 24409
QQYGTLPST

SEQ ID NO: 48818 - protein, 17 aa, Homo sapiens
  heavy chain complementarity determining region 3 for antibody 24409
ARPSYGSGRHGRYPLDP

SEQ ID NO: 48819 - protein, 9 aa, Homo sapiens
  light chain complementarity determining region 3 for antibody 24410
QQYGSSPRT

SEQ ID NO: 48820 - protein, 13 aa, Homo sapiens
  heavy chain complementarity determining region 3 for antibody 24410
AHINVRGVIPFDY

SEQ ID NO: 48821 - protein, 9 aa, Homo sapiens
  light chain complementarity determining region 3 for antibody 24411
QQYGSSPLT

SEQ ID NO: 48822 - protein, 15 aa, Homo sapiens
  heavy chain complementarity determining region 3 for antibody 24411
AKDEGGWYSGDAFDI

SEQ ID NO: 48823 - protein, 10 aa, Homo sapiens
  light chain complementarity determining region 3 for antibody 24412
QQYGSSPIFT

SEQ ID NO: 48824 - protein, 10 aa, Homo sapiens
  heavy chain complementarity determining region 3 for antibody 24412
ETFEIPSGTD

SEQ ID NO: 48825 - protein, 9 aa, Homo sapiens
  light chain complementarity determining region 3 for antibody 24413
QQYGGTRGT

SEQ ID NO: 48826 - protein, 16 aa, Homo sapiens
  heavy chain complementarity determining region 3 for antibody 24413
ARVVWGGSWYVGYFDP

SEQ ID NO: 48827 - protein, 10 aa, Homo sapiens
  light chain complementarity determining region 3 for antibody 24414
QQYGGSPMYT

SEQ ID NO: 48828 - protein, 15 aa, Homo sapiens
  heavy chain complementarity determining region 3 for antibody 24414
LRHYRALVAGTEEDY

SEQ ID NO: 48829 - protein, 9 aa, Homo sapiens
  light chain complementarity determining region 3 for antibody 24415
QQYGGSLFT

SEQ ID NO: 48830 - protein, 20 aa, Homo sapiens
  heavy chain complementarity determining region 3 for antibody 24415
ARNIETAVTTQGYYYYGMDV

SEQ ID NO: 48831 - protein, 9 aa, Homo sapiens
  light chain complementarity determining region 3 for antibody 24416
QQYDNLPYT

SEQ ID NO: 48832 - protein, 16 aa, Homo sapiens
  heavy chain complementarity determining region 3 for antibody 24416
VTAHSSYSTGLDAFDI

SEQ ID NO: 48833 - protein, 8 aa, Homo sapiens
  light chain complementarity determining region 3 for antibody 24417
QQYDILYT

SEQ ID NO: 48834 - protein, 12 aa, Homo sapiens
  heavy chain complementarity determining region 3 for antibody 24417
ARGETVESVFDY

SEQ ID NO: 48835 - protein, 9 aa, Homo sapiens
  light chain complementarity determining region 3 for antibody 24418
QQYDDRPET

SEQ ID NO: 48836 - protein, 17 aa, Homo sapiens
  heavy chain complementarity determining region 3 for antibody 24418
SRRQILGTRVRGRPTDY

SEQ ID NO: 48837 - protein, 9 aa, Homo sapiens
  light chain complementarity determining region 3 for antibody 24419
QQSYSTPYT

SEQ ID NO: 48838 - protein, 11 aa, Homo sapiens
  heavy chain complementarity determining region 3 for antibody 24419
VEGFDGCVAEN

SEQ ID NO: 48839 - protein, 10 aa, Homo sapiens
  light chain complementarity determining region 3 for antibody 24420
QQSYSTPSWT

SEQ ID NO: 48840 - protein, 13 aa, Homo sapiens
  heavy chain complementarity determining region 3 for antibody 24420
ATDWTLERHAFDI

SEQ ID NO: 48841 - protein, 9 aa, Homo sapiens
  light chain complementarity determining region 3 for antibody 24421
QQSYSTPLT

SEQ ID NO: 48842 - protein, 13 aa, Homo sapiens
  heavy chain complementarity determining region 3 for antibody 24421
ARGHGNKYGLFDY

SEQ ID NO: 48843 - protein, 9 aa, Homo sapiens
  light chain complementarity determining region 3 for antibody 24422
QQSYSSPPT

SEQ ID NO: 48844 - protein, 17 aa, Homo sapiens
  heavy chain complementarity determining region 3 for antibody 24422
ARDPLQLGILTADAFDV

SEQ ID NO: 48845 - protein, 9 aa, Homo sapiens
  light chain complementarity determining region 3 for antibody 24423
QQSYSKPVT

SEQ ID NO: 48846 - protein, 11 aa, Homo sapiens
  heavy chain complementarity determining region 3 for antibody 24423
ARGGNWEYFDY

SEQ ID NO: 48847 - protein, 9 aa, Homo sapiens
  light chain complementarity determining region 3 for antibody 24424
QQSFTTPRT

SEQ ID NO: 48848 - protein, 16 aa, Homo sapiens
  heavy chain complementarity determining region 3 for antibody 24424
ARGRRAGRLLWFRIDS

SEQ ID NO: 48849 - protein, 9 aa, Homo sapiens
  light chain complementarity determining region 3 for antibody 24425
QQRSNWPLV

SEQ ID NO: 48850 - protein, 12 aa, Homo sapiens
  heavy chain complementarity determining region 3 for antibody 24425
ARVIEDHWYFDL

SEQ ID NO: 48851 - protein, 11 aa, Homo sapiens
  light chain complementarity determining region 3 for antibody 24426
QQRGSWPPGLT

SEQ ID NO: 48852 - protein, 23 aa, Homo sapiens
  heavy chain complementarity determining region 3 for antibody 24426
AARNVSHDSSGYPLADYFYGMDV

SEQ ID NO: 48853 - protein, 9 aa, Homo sapiens
  light chain complementarity determining region 3 for antibody 24427
QQLNSYPST

SEQ ID NO: 48854 - protein, 13 aa, Homo sapiens
  heavy chain complementarity determining region 3 for antibody 24427
ARDGYSYGYESDY

SEQ ID NO: 48855 - protein, 9 aa, Homo sapiens
  light chain complementarity determining region 3 for antibody 24428
QQLNSYPFT

SEQ ID NO: 48856 - protein, 14 aa, Homo sapiens
  heavy chain complementarity determining region 3 for antibody 24428
ARPNNSGWRHPFDI

SEQ ID NO: 48857 - protein, 9 aa, Homo sapiens
  light chain complementarity determining region 3 for antibody 24429
QQFGSSPLT

SEQ ID NO: 48858 - protein, 13 aa, Homo sapiens
  heavy chain complementarity determining region 3 for antibody 24429
ARRLLLTGYRFDP

SEQ ID NO: 48859 - protein, 9 aa, Homo sapiens
  light chain complementarity determining region 3 for antibody 24430
QQAYSSVLT

SEQ ID NO: 48860 - protein, 16 aa, Homo sapiens
  heavy chain complementarity determining region 3 for antibody 24430
AREEGTTYTSRRAFDC

SEQ ID NO: 48861 - protein, 9 aa, Homo sapiens
  light chain complementarity determining region 3 for antibody 24431
QHTSTFPRT

SEQ ID NO: 48862 - protein, 20 aa, Homo sapiens
  heavy chain complementarity determining region 3 for antibody 24431
ARGRRIAALSTAHYYYGMDV

SEQ ID NO: 48863 - protein, 10 aa, Homo sapiens
  light chain complementarity determining region 3 for antibody 24432
QEYDNHPPYI

SEQ ID NO: 48864 - protein, 12 aa, Homo sapiens
  heavy chain complementarity determining region 3 for antibody 24432
ARSPRRVGYFQH

SEQ ID NO: 48865 - protein, 9 aa, Homo sapiens
  light chain complementarity determining region 3 for antibody 24433
MQALRTRLT

SEQ ID NO: 48866 - protein, 23 aa, Homo sapiens
  heavy chain complementarity determining region 3 for antibody 24433
ARVSQNLGEWSGSSRYGINAFDP

SEQ ID NO: 48867 - protein, 9 aa, Homo sapiens
  light chain complementarity determining region 3 for antibody 24434
LQYYTYPRT

SEQ ID NO: 48868 - protein, 20 aa, Homo sapiens
  heavy chain complementarity determining region 3 for antibody 24434
VRDCYGLPDETHYDYCLFTD

SEQ ID NO: 48869 - protein, 9 aa, Homo sapiens
  light chain complementarity determining region 3 for antibody 24435
LQHYNYPYT

SEQ ID NO: 48870 - protein, 11 aa, Homo sapiens
  heavy chain complementarity determining region 3 for antibody 24435
TKTPVTGAFDT

SEQ ID NO: 48871 - protein, 9 aa, Homo sapiens
  light chain complementarity determining region 3 for antibody 24436
LHDYNYPVS

SEQ ID NO: 48872 - protein, 15 aa, Homo sapiens
  heavy chain complementarity determining region 3 for antibody 24436
ARVTRYGGTWETLDY

SEQ ID NO: 48873 - protein, 9 aa, Homo sapiens
  light chain complementarity determining region 3 for antibody 24437
QQYYTSLRT

SEQ ID NO: 48874 - protein, 12 aa, Homo sapiens
  heavy chain complementarity determining region 3 for antibody 24437
VKDCGLGGPRDY

SEQ ID NO: 48875 - protein, 9 aa, Homo sapiens
  light chain complementarity determining region 3 for antibody 24438
QQYNTFTWT

SEQ ID NO: 48876 - protein, 20 aa, Homo sapiens
  heavy chain complementarity determining region 3 for antibody 24438
ATRRSIAFYAVGVTENAFDI

SEQ ID NO: 48877 - protein, 9 aa, Homo sapiens
  light chain complementarity determining region 3 for antibody 24439
QQYNSYSWT

SEQ ID NO: 48878 - protein, 13 aa, Homo sapiens
  heavy chain complementarity determining region 3 for antibody 24439
ATSGSFYKSPFDY

SEQ ID NO: 48879 - protein, 9 aa, Homo sapiens
  light chain complementarity determining region 3 for antibody 24440
QQYNSYSGA

SEQ ID NO: 48880 - protein, 13 aa, Homo sapiens
  heavy chain complementarity determining region 3 for antibody 24440
VRDQATTVNWFDP

SEQ ID NO: 48881 - protein, 9 aa, Homo sapiens
  light chain complementarity determining region 3 for antibody 24441
QQYNSFPYT

SEQ ID NO: 48882 - protein, 9 aa, Homo sapiens
  heavy chain complementarity determining region 3 for antibody 24441
TRGPGLLWF

SEQ ID NO: 48883 - protein, 9 aa, Homo sapiens
  light chain complementarity determining region 3 for antibody 24442
QQYNNWPLT

SEQ ID NO: 48884 - protein, 14 aa, Homo sapiens
  heavy chain complementarity determining region 3 for antibody 24442
TRQYYYDGSGVFNY

SEQ ID NO: 48885 - protein, 9 aa, Homo sapiens
  light chain complementarity determining region 3 for antibody 24443
QQYNDWPWT

SEQ ID NO: 48886 - protein, 19 aa, Homo sapiens
  heavy chain complementarity determining region 3 for antibody 24443
ARRLWSTSSSTLGPAIVDF

SEQ ID NO: 48887 - protein, 9 aa, Homo sapiens
  light chain complementarity determining region 3 for antibody 24444
QQYGTSPFT

SEQ ID NO: 48888 - protein, 9 aa, Homo sapiens
  heavy chain complementarity determining region 3 for antibody 24444
ARGAGSLSY

SEQ ID NO: 48889 - protein, 9 aa, Homo sapiens
  light chain complementarity determining region 3 for antibody 24445
QQYGNIPRS

SEQ ID NO: 48890 - protein, 13 aa, Homo sapiens
  heavy chain complementarity determining region 3 for antibody 24445
AGGTWHSGIYYES

SEQ ID NO: 48891 - protein, 9 aa, Homo sapiens
  light chain complementarity determining region 3 for antibody 24446
QQYENLPFT

SEQ ID NO: 48892 - protein, 19 aa, Homo sapiens
  heavy chain complementarity determining region 3 for antibody 24446
ARDRAVDTFAAYYYYGMGL

SEQ ID NO: 48893 - protein, 9 aa, Homo sapiens
  light chain complementarity determining region 3 for antibody 24447
QQYDTYPYT

SEQ ID NO: 48894 - protein, 20 aa, Homo sapiens
  heavy chain complementarity determining region 3 for antibody 24447
ARGGHIVVVTSFHNDGPLSA

SEQ ID NO: 48895 - protein, 10 aa, Homo sapiens
  light chain complementarity determining region 3 for antibody 24448
QQYDTHSPWT

SEQ ID NO: 48896 - protein, 20 aa, Homo sapiens
  heavy chain complementarity determining region 3 for antibody 24448
AKPEGWWDGSGTYPTYYFDY

SEQ ID NO: 48897 - protein, 9 aa, Homo sapiens
  light chain complementarity determining region 3 for antibody 24449
QQYDNFPPT

SEQ ID NO: 48898 - protein, 9 aa, Homo sapiens
  heavy chain complementarity determining region 3 for antibody 24449
ARGLEWYSP

SEQ ID NO: 48899 - protein, 9 aa, Homo sapiens
  light chain complementarity determining region 3 for antibody 24450
QQTHSSSPT

SEQ ID NO: 48900 - protein, 11 aa, Homo sapiens
  heavy chain complementarity determining region 3 for antibody 24450
AKKGPGSSFDF

SEQ ID NO: 48901 - protein, 9 aa, Homo sapiens
  light chain complementarity determining region 3 for antibody 24451
QQSYSTPYT

SEQ ID NO: 48902 - protein, 9 aa, Homo sapiens
  heavy chain complementarity determining region 3 for antibody 24451
ARGVRPLVS

SEQ ID NO: 48903 - protein, 9 aa, Homo sapiens
  light chain complementarity determining region 3 for antibody 24452
QQSYSTPWT

SEQ ID NO: 48904 - protein, 14 aa, Homo sapiens
  heavy chain complementarity determining region 3 for antibody 24452
ARYCSGNSCYSMDH

SEQ ID NO: 48905 - protein, 9 aa, Homo sapiens
  light chain complementarity determining region 3 for antibody 24453
QQSYSTPQT

SEQ ID NO: 48906 - protein, 11 aa, Homo sapiens
  heavy chain complementarity determining region 3 for antibody 24453
ARDPAWGAYDL

SEQ ID NO: 48907 - protein, 9 aa, Homo sapiens
  light chain complementarity determining region 3 for antibody 24454
QQSYSTPMT

SEQ ID NO: 48908 - protein, 17 aa, Homo sapiens
  heavy chain complementarity determining region 3 for antibody 24454
AKKQQGYYYDRTPYYGV

SEQ ID NO: 48909 - protein, 9 aa, Homo sapiens
  light chain complementarity determining region 3 for antibody 24455
QQSYSTPLT

SEQ ID NO: 48910 - protein, 13 aa, Homo sapiens
  heavy chain complementarity determining region 3 for antibody 24455
ARHMAYWGSALDS

SEQ ID NO: 48911 - protein, 9 aa, Homo sapiens
  light chain complementarity determining region 3 for antibody 24456
QQSYSSTWT

SEQ ID NO: 48912 - protein, 6 aa, Homo sapiens
  heavy chain complementarity determining region 3 for antibody 24456
GSLFEY

SEQ ID NO: 48913 - protein, 9 aa, Homo sapiens
  light chain complementarity determining region 3 for antibody 24457
QQRINWPWT

SEQ ID NO: 48914 - protein, 12 aa, Homo sapiens
  heavy chain complementarity determining region 3 for antibody 24457
ARPDIVDTAMVY

SEQ ID NO: 48915 - protein, 6 aa, Homo sapiens
  light chain complementarity determining region 3 for antibody 24458
QQRGFT

SEQ ID NO: 48916 - protein, 13 aa, Homo sapiens
  heavy chain complementarity determining region 3 for antibody 24458
AHLDKLRGYDFDY

SEQ ID NO: 48917 - protein, 9 aa, Homo sapiens
  light chain complementarity determining region 3 for antibody 24459
QQNVHLPLT

SEQ ID NO: 48918 - protein, 13 aa, Homo sapiens
  heavy chain complementarity determining region 3 for antibody 24459
TRGEERNTGEMDL

SEQ ID NO: 48919 - protein, 9 aa, Homo sapiens
  light chain complementarity determining region 3 for antibody 24460
QQLKSYPPT

SEQ ID NO: 48920 - protein, 14 aa, Homo sapiens
  heavy chain complementarity determining region 3 for antibody 24460
ARENSVPAARAYDY

SEQ ID NO: 48921 - protein, 9 aa, Homo sapiens
  light chain complementarity determining region 3 for antibody 24461
QKYNSVPPT

SEQ ID NO: 48922 - protein, 14 aa, Homo sapiens
  heavy chain complementarity determining region 3 for antibody 24461
ARDPSYGGFYYFDS

SEQ ID NO: 48923 - protein, 9 aa, Homo sapiens
  light chain complementarity determining region 3 for antibody 24462
QHYHTSPWT

SEQ ID NO: 48924 - protein, 11 aa, Homo sapiens
  heavy chain complementarity determining region 3 for antibody 24462
STWYFLSDVDV

SEQ ID NO: 48925 - protein, 10 aa, Homo sapiens
  light chain complementarity determining region 3 for antibody 24463
QHYGSSPPIT

SEQ ID NO: 48926 - protein, 13 aa, Homo sapiens
  heavy chain complementarity determining region 3 for antibody 24463
AHSRVWFGAAFDY

SEQ ID NO: 48927 - protein, 10 aa, Homo sapiens
  light chain complementarity determining region 3 for antibody 24464
QHTYGAPPYT

SEQ ID NO: 48928 - protein, 11 aa, Homo sapiens
  heavy chain complementarity determining region 3 for antibody 24464
AREVVTGFPDY

SEQ ID NO: 48929 - protein, 9 aa, Homo sapiens
  light chain complementarity determining region 3 for antibody 24465
QDTYRIPLT

SEQ ID NO: 48930 - protein, 14 aa, Homo sapiens
  heavy chain complementarity determining region 3 for antibody 24465
VRGTWDWGGWDFVY

SEQ ID NO: 48931 - protein, 9 aa, Homo sapiens
  light chain complementarity determining region 3 for antibody 24466
MQAHQTPLT

SEQ ID NO: 48932 - protein, 15 aa, Homo sapiens
  heavy chain complementarity determining region 3 for antibody 24466
ARTGSSTWYGYGMDV

SEQ ID NO: 48933 - protein, 9 aa, Homo sapiens
  light chain complementarity determining region 3 for antibody 24467
LQDFNYPRT

SEQ ID NO: 48934 - protein, 14 aa, Homo sapiens
  heavy chain complementarity determining region 3 for antibody 24467
ARFCSTVKCFAFDY

SEQ ID NO: 48935 - protein, 9 aa, Homo sapiens
  light chain complementarity determining region 3 for antibody 24468
GQYNRYPRT

SEQ ID NO: 48936 - protein, 6 aa, Homo sapiens
  heavy chain complementarity determining region 3 for antibody 24468
TRALDY

SEQ ID NO: 48937 - protein, 9 aa, Homo sapiens
  light chain complementarity determining region 3 for antibody 24469
SQRSIWPWT

SEQ ID NO: 48938 - protein, 9 aa, Homo sapiens
  heavy chain complementarity determining region 3 for antibody 24469
ARVLVAGGG

SEQ ID NO: 48939 - protein, 11 aa, Homo sapiens
  light chain complementarity determining region 3 for antibody 24470
QYYDNWPPTWT

SEQ ID NO: 48940 - protein, 16 aa, Homo sapiens
  heavy chain complementarity determining region 3 for antibody 24470
ARVSAHDPGRSLGMDV

SEQ ID NO: 48941 - protein, 8 aa, Homo sapiens
  light chain complementarity determining region 3 for antibody 24471
QQYNSYYT

SEQ ID NO: 48942 - protein, 15 aa, Homo sapiens
  heavy chain complementarity determining region 3 for antibody 24471
ARLHRPTWIRDYFDY

SEQ ID NO: 48943 - protein, 9 aa, Homo sapiens
  light chain complementarity determining region 3 for antibody 24472
QQYNSYPYT

SEQ ID NO: 48944 - protein, 14 aa, Homo sapiens
  heavy chain complementarity determining region 3 for antibody 24472
ARARIALDYGDYRD

SEQ ID NO: 48945 - protein, 8 aa, Homo sapiens
  light chain complementarity determining region 3 for antibody 24473
QQYNSYPT

SEQ ID NO: 48946 - protein, 12 aa, Homo sapiens
  heavy chain complementarity determining region 3 for antibody 24473
ASTTVTTLYFQH

SEQ ID NO: 48947 - protein, 9 aa, Homo sapiens
  light chain complementarity determining region 3 for antibody 24474
QQYNSYPFT

SEQ ID NO: 48948 - protein, 19 aa, Homo sapiens
  heavy chain complementarity determining region 3 for antibody 24474
AHKKRAKYSAYGITGGFDY

SEQ ID NO: 48949 - protein, 9 aa, Homo sapiens
  light chain complementarity determining region 3 for antibody 24475
QQYNSIPWT

SEQ ID NO: 48950 - protein, 14 aa, Homo sapiens
  heavy chain complementarity determining region 3 for antibody 24475
TKCAYNYGNDAFDV

SEQ ID NO: 48951 - protein, 9 aa, Homo sapiens
  light chain complementarity determining region 3 for antibody 24476
QQYHSYPLT

SEQ ID NO: 48952 - protein, 14 aa, Homo sapiens
  heavy chain complementarity determining region 3 for antibody 24476
ARGHWSGYYTSFDY

SEQ ID NO: 48953 - protein, 10 aa, Homo sapiens
  light chain complementarity determining region 3 for antibody 24477
QQYGSSPALT

SEQ ID NO: 48954 - protein, 23 aa, Homo sapiens
  heavy chain complementarity determining region 3 for antibody 24477
ARAPSQYYYDSSGYYYPTNWFDP

SEQ ID NO: 48955 - protein, 9 aa, Homo sapiens
  light chain complementarity determining region 3 for antibody 24478
QQYGSSLYT

SEQ ID NO: 48956 - protein, 24 aa, Homo sapiens
  heavy chain complementarity determining region 3 for antibody 24478
ARASVIYYDSRDGLDMSYLYYFDS

SEQ ID NO: 48957 - protein, 9 aa, Homo sapiens
  light chain complementarity determining region 3 for antibody 24479
QQYGSFPPT

SEQ ID NO: 48958 - protein, 17 aa, Homo sapiens
  heavy chain complementarity determining region 3 for antibody 24479
ARGLMERWLVPLYYFDL

SEQ ID NO: 48959 - protein, 9 aa, Homo sapiens
  light chain complementarity determining region 3 for antibody 24480
QQYDTYPWT

SEQ ID NO: 48960 - protein, 14 aa, Homo sapiens
  heavy chain complementarity determining region 3 for antibody 24480
AKGTYNILTGPFDY

SEQ ID NO: 48961 - protein, 9 aa, Homo sapiens
  light chain complementarity determining region 3 for antibody 24481
QQYDNLPLT

SEQ ID NO: 48962 - protein, 10 aa, Homo sapiens
  heavy chain complementarity determining region 3 for antibody 24481
VRGGGYYFDY

SEQ ID NO: 48963 - protein, 9 aa, Homo sapiens
  light chain complementarity determining region 3 for antibody 24482
QQYDNLPLT

SEQ ID NO: 48964 - protein, 15 aa, Homo sapiens
  heavy chain complementarity determining region 3 for antibody 24482
ARLSLDMSTTGAFDI

SEQ ID NO: 48965 - protein, 9 aa, Homo sapiens
  light chain complementarity determining region 3 for antibody 24483
QQTYSSPLT

SEQ ID NO: 48966 - protein, 17 aa, Homo sapiens
  heavy chain complementarity determining region 3 for antibody 24483
ARSGPEWLVHADRPLDY

SEQ ID NO: 48967 - protein, 9 aa, Homo sapiens
  light chain complementarity determining region 3 for antibody 24484
QQSYSVPPT

SEQ ID NO: 48968 - protein, 13 aa, Homo sapiens
  heavy chain complementarity determining region 3 for antibody 24484
VRHAVVRPMVVDD

SEQ ID NO: 48969 - protein, 9 aa, Homo sapiens
  light chain complementarity determining region 3 for antibody 24485
QQSYSTPWT

SEQ ID NO: 48970 - protein, 12 aa, Homo sapiens
  heavy chain complementarity determining region 3 for antibody 24485
ASYNFWSHYWDY

SEQ ID NO: 48971 - protein, 9 aa, Homo sapiens
  light chain complementarity determining region 3 for antibody 24486
QQSYSSPLT

SEQ ID NO: 48972 - protein, 14 aa, Homo sapiens
  heavy chain complementarity determining region 3 for antibody 24486
ARGRGGRSYYDLDC

SEQ ID NO: 48973 - protein, 9 aa, Homo sapiens
  light chain complementarity determining region 3 for antibody 24487
QQSYITQVT

SEQ ID NO: 48974 - protein, 18 aa, Homo sapiens
  heavy chain complementarity determining region 3 for antibody 24487
AREQDTMVARKSYNLFDP

SEQ ID NO: 48975 - protein, 9 aa, Homo sapiens
  light chain complementarity determining region 3 for antibody 24488
QQSSTIPRT

SEQ ID NO: 48976 - protein, 13 aa, Homo sapiens
  heavy chain complementarity determining region 3 for antibody 24488
AREHIAGRRVLAG

SEQ ID NO: 48977 - protein, 8 aa, Homo sapiens
  light chain complementarity determining region 3 for antibody 24489
QQRSSGYT

SEQ ID NO: 48978 - protein, 13 aa, Homo sapiens
  heavy chain complementarity determining region 3 for antibody 24489
ARNSGSYPNCFDP

SEQ ID NO: 48979 - protein, 10 aa, Homo sapiens
  light chain complementarity determining region 3 for antibody 24490
QQRSDWPPYT

SEQ ID NO: 48980 - protein, 13 aa, Homo sapiens
  heavy chain complementarity determining region 3 for antibody 24490
ARETRYSWGYFDH

SEQ ID NO: 48981 - protein, 9 aa, Homo sapiens
  light chain complementarity determining region 3 for antibody 24491
QQDNSYPFT

SEQ ID NO: 48982 - protein, 15 aa, Homo sapiens
  heavy chain complementarity determining region 3 for antibody 24491
AKHGGDGIYYYGVDV

SEQ ID NO: 48983 - protein, 9 aa, Homo sapiens
  light chain complementarity determining region 3 for antibody 24492
QQANTFPWT

SEQ ID NO: 48984 - protein, 12 aa, Homo sapiens
  heavy chain complementarity determining region 3 for antibody 24492
ARVHEKSRSSDS

SEQ ID NO: 48985 - protein, 9 aa, Homo sapiens
  light chain complementarity determining region 3 for antibody 24493
QNYNADPYN

SEQ ID NO: 48986 - protein, 15 aa, Homo sapiens
  heavy chain complementarity determining region 3 for antibody 24493
ARHSWGDFGFDAFDM

SEQ ID NO: 48987 - protein, 9 aa, Homo sapiens
  light chain complementarity determining region 3 for antibody 24494
QKYDTVPFT

SEQ ID NO: 48988 - protein, 17 aa, Homo sapiens
  heavy chain complementarity determining region 3 for antibody 24494
ARDRIYGSEDHNPPLKS

SEQ ID NO: 48989 - protein, 9 aa, Homo sapiens
  light chain complementarity determining region 3 for antibody 24495
QKVNSLPFT

SEQ ID NO: 48990 - protein, 15 aa, Homo sapiens
  heavy chain complementarity determining region 3 for antibody 24495
AREAFDSGGRYRADY

SEQ ID NO: 48991 - protein, 10 aa, Homo sapiens
  light chain complementarity determining region 3 for antibody 24496
QHYGSSPAVT

SEQ ID NO: 48992 - protein, 14 aa, Homo sapiens
  heavy chain complementarity determining region 3 for antibody 24496
ARHEHDGSGSVIDY

SEQ ID NO: 48993 - protein, 9 aa, Homo sapiens
  light chain complementarity determining region 3 for antibody 24497
QESYRTPRT

SEQ ID NO: 48994 - protein, 13 aa, Homo sapiens
  heavy chain complementarity determining region 3 for antibody 24497
ARDENVVAGWFDP

SEQ ID NO: 48995 - protein, 9 aa, Homo sapiens
  light chain complementarity determining region 3 for antibody 24498
MQGTHWPPT

SEQ ID NO: 48996 - protein, 11 aa, Homo sapiens
  heavy chain complementarity determining region 3 for antibody 24498
TGGQQLVNFDF

SEQ ID NO: 48997 - protein, 9 aa, Homo sapiens
  light chain complementarity determining region 3 for antibody 24499
LQDYNYPYT

SEQ ID NO: 48998 - protein, 11 aa, Homo sapiens
  heavy chain complementarity determining region 3 for antibody 24499
TRGLDDAKTGY

SEQ ID NO: 48999 - protein, 11 aa, Homo sapiens
  light chain complementarity determining region 3 for antibody 24500
HQYYDWPLRLT

SEQ ID NO: 49000 - protein, 18 aa, Homo sapiens
  heavy chain complementarity determining region 3 for antibody 24500
ARDAESRSHYSYYNGMDV

SEQ ID NO: 49001 - protein, 9 aa, Homo sapiens
  light chain complementarity determining region 3 for antibody 24501
HQYGSSPYT

SEQ ID NO: 49002 - protein, 11 aa, Homo sapiens
  heavy chain complementarity determining region 3 for antibody 24501
ARGVTMAGSGY

SEQ ID NO: 49003 - protein, 9 aa, Homo sapiens
  light chain complementarity determining region 3 for antibody 24502
HQSYSPPFT

SEQ ID NO: 49004 - protein, 14 aa, Homo sapiens
  heavy chain complementarity determining region 3 for antibody 24502
ARSYDTSGYSGFDY

SEQ ID NO: 49005 - protein, 9 aa, Homo sapiens
  light chain complementarity determining region 3 for antibody 24503
HQSSTLPQT

SEQ ID NO: 49006 - protein, 9 aa, Homo sapiens
  heavy chain complementarity determining region 3 for antibody 24503
ARDGGPFDY

SEQ ID NO: 49007 - protein, 10 aa, Homo sapiens
  light chain complementarity determining region 3 for antibody 24504
QQYYNWPPLT

SEQ ID NO: 49008 - protein, 14 aa, Homo sapiens
  heavy chain complementarity determining region 3 for antibody 24504
AREATAMLRGYFDY

SEQ ID NO: 49009 - protein, 7 aa, Homo sapiens
  light chain complementarity determining region 3 for antibody 24505
QQYNTYS

SEQ ID NO: 49010 - protein, 14 aa, Homo sapiens
  heavy chain complementarity determining region 3 for antibody 24505
ARGAPIAGRRPFDP

SEQ ID NO: 49011 - protein, 9 aa, Homo sapiens
  light chain complementarity determining region 3 for antibody 24506
QQYNGYPFT

SEQ ID NO: 49012 - protein, 16 aa, Homo sapiens
  heavy chain complementarity determining region 3 for antibody 24506
AYCSTISCNRAGAMDV

SEQ ID NO: 49013 - protein, 10 aa, Homo sapiens
  light chain complementarity determining region 3 for antibody 24507
QQYKNWPTWT

SEQ ID NO: 49014 - protein, 20 aa, Homo sapiens
  heavy chain complementarity determining region 3 for antibody 24507
ARGDMVRGALAFYRFYALDV

SEQ ID NO: 49015 - protein, 12 aa, Homo sapiens
  light chain complementarity determining region 3 for antibody 24508
QQYGTSVPWPWT

SEQ ID NO: 49016 - protein, 14 aa, Homo sapiens
  heavy chain complementarity determining region 3 for antibody 24508
VRGGSSGYNHQVDY

SEQ ID NO: 49017 - protein, 9 aa, Homo sapiens
  light chain complementarity determining region 3 for antibody 24509
QQYGTSPFT

SEQ ID NO: 49018 - protein, 14 aa, Homo sapiens
  heavy chain complementarity determining region 3 for antibody 24509
ARMTSSWYPEYFHH

SEQ ID NO: 49019 - protein, 9 aa, Homo sapiens
  light chain complementarity determining region 3 for antibody 24510
QQYGSSPYT

SEQ ID NO: 49020 - protein, 14 aa, Homo sapiens
  heavy chain complementarity determining region 3 for antibody 24510
AKGGPLGYYEYFQH

SEQ ID NO: 49021 - protein, 9 aa, Homo sapiens
  light chain complementarity determining region 3 for antibody 24511
QQYGSSPFT

SEQ ID NO: 49022 - protein, 23 aa, Homo sapiens
  heavy chain complementarity determining region 3 for antibody 24511
ARGLRSSDWSKIMDMDSYYALDV

SEQ ID NO: 49023 - protein, 8 aa, Homo sapiens
  light chain complementarity determining region 3 for antibody 24512
QQYETLYT

SEQ ID NO: 49024 - protein, 12 aa, Homo sapiens
  heavy chain complementarity determining region 3 for antibody 24512
TTLVFAESGFDY

SEQ ID NO: 49025 - protein, 9 aa, Homo sapiens
  light chain complementarity determining region 3 for antibody 24513
QQYDEFPIT

SEQ ID NO: 49026 - protein, 11 aa, Homo sapiens
  heavy chain complementarity determining region 3 for antibody 24513
AAGRSFFNLDT

SEQ ID NO: 49027 - protein, 9 aa, Homo sapiens
  light chain complementarity determining region 3 for antibody 24514
QQTYSIPWT

SEQ ID NO: 49028 - protein, 12 aa, Homo sapiens
  heavy chain complementarity determining region 3 for antibody 24514
ARVAKYYYGLDV

SEQ ID NO: 49029 - protein, 9 aa, Homo sapiens
  light chain complementarity determining region 3 for antibody 24515
QQSYSTPIT

SEQ ID NO: 49030 - protein, 17 aa, Homo sapiens
  heavy chain complementarity determining region 3 for antibody 24515
AKDRRSNGYSVLDAFAI

SEQ ID NO: 49031 - protein, 10 aa, Homo sapiens
  light chain complementarity determining region 3 for antibody 24516
QQSYSAPPYT

SEQ ID NO: 49032 - protein, 13 aa, Homo sapiens
  heavy chain complementarity determining region 3 for antibody 24516
TTIGAFLDDAFEF

SEQ ID NO: 49033 - protein, 9 aa, Homo sapiens
  light chain complementarity determining region 3 for antibody 24517
QQSSSLPLT

SEQ ID NO: 49034 - protein, 16 aa, Homo sapiens
  heavy chain complementarity determining region 3 for antibody 24517
ARGRALRMVFANWFDP

SEQ ID NO: 49035 - protein, 9 aa, Homo sapiens
  light chain complementarity determining region 3 for antibody 24518
QQSSSIPYT

SEQ ID NO: 49036 - protein, 13 aa, Homo sapiens
  heavy chain complementarity determining region 3 for antibody 24518
SRMTWHTPLMFDY

SEQ ID NO: 49037 - protein, 8 aa, Homo sapiens
  light chain complementarity determining region 3 for antibody 24519
QQRYNWYT

SEQ ID NO: 49038 - protein, 9 aa, Homo sapiens
  heavy chain complementarity determining region 3 for antibody 24519
ARDAGGSHD

SEQ ID NO: 49039 - protein, 9 aa, Homo sapiens
  light chain complementarity determining region 3 for antibody 24520
QQRSNWPQT

SEQ ID NO: 49040 - protein, 17 aa, Homo sapiens
  heavy chain complementarity determining region 3 for antibody 24520
ARDPDEQALYYYYGMDV

SEQ ID NO: 49041 - protein, 10 aa, Homo sapiens
  light chain complementarity determining region 3 for antibody 24521
QQRSNWPPIT

SEQ ID NO: 49042 - protein, 21 aa, Homo sapiens
  heavy chain complementarity determining region 3 for antibody 24521
TGWFGELLHHPFRYYYYNMDV

SEQ ID NO: 49043 - protein, 9 aa, Homo sapiens
  light chain complementarity determining region 3 for antibody 24522
QQRSNWPLT

SEQ ID NO: 49044 - protein, 17 aa, Homo sapiens
  heavy chain complementarity determining region 3 for antibody 24522
ARLGGSGWNRGHNWFDP

SEQ ID NO: 49045 - protein, 9 aa, Homo sapiens
  light chain complementarity determining region 3 for antibody 24523
QQAKSSPLS

SEQ ID NO: 49046 - protein, 16 aa, Homo sapiens
  heavy chain complementarity determining region 3 for antibody 24523
ARALVVPATAWSWFDP

SEQ ID NO: 49047 - protein, 9 aa, Homo sapiens
  light chain complementarity determining region 3 for antibody 24524
MQGTYWPYT

SEQ ID NO: 49048 - protein, 10 aa, Homo sapiens
  heavy chain complementarity determining region 3 for antibody 24524
VRGGGWLADY

SEQ ID NO: 49049 - protein, 9 aa, Homo sapiens
  light chain complementarity determining region 3 for antibody 24525
MQGSHWPYT

SEQ ID NO: 49050 - protein, 10 aa, Homo sapiens
  heavy chain complementarity determining region 3 for antibody 24525
GRDNRGSIDF

SEQ ID NO: 49051 - protein, 9 aa, Homo sapiens
  light chain complementarity determining region 3 for antibody 24526
MQALQTPQT

SEQ ID NO: 49052 - protein, 15 aa, Homo sapiens
  heavy chain complementarity determining region 3 for antibody 24526
ARGGKVSYSSGRWDY

SEQ ID NO: 49053 - protein, 8 aa, Homo sapiens
  light chain complementarity determining region 3 for antibody 24527
MQALESIT

SEQ ID NO: 49054 - protein, 11 aa, Homo sapiens
  heavy chain complementarity determining region 3 for antibody 24527
AISNLRGAFDI

SEQ ID NO: 49055 - protein, 9 aa, Homo sapiens
  light chain complementarity determining region 3 for antibody 24528
LQYKSYPRT

SEQ ID NO: 49056 - protein, 6 aa, Homo sapiens
  heavy chain complementarity determining region 3 for antibody 24528
SRALDY

SEQ ID NO: 49057 - protein, 9 aa, Homo sapiens
  light chain complementarity determining region 3 for antibody 24529
LQHNSYPRT

SEQ ID NO: 49058 - protein, 11 aa, Homo sapiens
  heavy chain complementarity determining region 3 for antibody 24529
TTGLGSEGTNY

SEQ ID NO: 49059 - protein, 7 aa, Homo sapiens
  light chain complementarity determining region 3 for antibody 24530
HQYDNLP

SEQ ID NO: 49060 - protein, 14 aa, Homo sapiens
  heavy chain complementarity determining region 3 for antibody 24530
AKGVSAYISGWLDY

SEQ ID NO: 49061 - protein, 10 aa, Homo sapiens
  light chain complementarity determining region 3 for antibody 24531
QRYDNLPSFS

SEQ ID NO: 49062 - protein, 13 aa, Homo sapiens
  heavy chain complementarity determining region 3 for antibody 24531
ARTFLAVAGTFDY

SEQ ID NO: 49063 - protein, 11 aa, Homo sapiens
  light chain complementarity determining region 3 for antibody 24532
QQYYSTPTMNT

SEQ ID NO: 49064 - protein, 14 aa, Homo sapiens
  heavy chain complementarity determining region 3 for antibody 24532
ARDIVGAHPYYFDY

SEQ ID NO: 49065 - protein, 9 aa, Homo sapiens
  light chain complementarity determining region 3 for antibody 24533
QQYYRIPPT

SEQ ID NO: 49066 - protein, 17 aa, Homo sapiens
  heavy chain complementarity determining region 3 for antibody 24533
ANAQRGSAPSTTFYFES

SEQ ID NO: 49067 - protein, 9 aa, Homo sapiens
  light chain complementarity determining region 3 for antibody 24534
QQYNSYPYT

SEQ ID NO: 49068 - protein, 14 aa, Homo sapiens
  heavy chain complementarity determining region 3 for antibody 24534
AKDVTPMVMGYSDY

SEQ ID NO: 49069 - protein, 9 aa, Homo sapiens
  light chain complementarity determining region 3 for antibody 24535
QQYNSYPLT

SEQ ID NO: 49070 - protein, 16 aa, Homo sapiens
  heavy chain complementarity determining region 3 for antibody 24535
ARDQYTSDYYIRPFDV

SEQ ID NO: 49071 - protein, 9 aa, Homo sapiens
  light chain complementarity determining region 3 for antibody 24536
QQYNSYPFT

SEQ ID NO: 49072 - protein, 20 aa, Homo sapiens
  heavy chain complementarity determining region 3 for antibody 24536
VRAEHYHDSSGNYCGPHFDN

SEQ ID NO: 49073 - protein, 9 aa, Homo sapiens
  light chain complementarity determining region 3 for antibody 24537
QQYGSSSIT

SEQ ID NO: 49074 - protein, 13 aa, Homo sapiens
  heavy chain complementarity determining region 3 for antibody 24537
VKEFFLVFDAFHM

SEQ ID NO: 49075 - protein, 9 aa, Homo sapiens
  light chain complementarity determining region 3 for antibody 24538
QQYGSSPWT

SEQ ID NO: 49076 - protein, 15 aa, Homo sapiens
  heavy chain complementarity determining region 3 for antibody 24538
ARDLWELGAHSPGAH

SEQ ID NO: 49077 - protein, 8 aa, Homo sapiens
  light chain complementarity determining region 3 for antibody 24539
QQYGNSWT

SEQ ID NO: 49078 - protein, 21 aa, Homo sapiens
  heavy chain complementarity determining region 3 for antibody 24539
AARGDSSGWYPGSDYFYGMDV

SEQ ID NO: 49079 - protein, 9 aa, Homo sapiens
  light chain complementarity determining region 3 for antibody 24540
QQYDTSPWT

SEQ ID NO: 49080 - protein, 15 aa, Homo sapiens
  heavy chain complementarity determining region 3 for antibody 24540
VHTQLWFGDQCYFDF

SEQ ID NO: 49081 - protein, 9 aa, Homo sapiens
  light chain complementarity determining region 3 for antibody 24541
QQYDTSPWT

SEQ ID NO: 49082 - protein, 9 aa, Homo sapiens
  heavy chain complementarity determining region 3 for antibody 24541
ATGGGSYSH

SEQ ID NO: 49083 - protein, 9 aa, Homo sapiens
  light chain complementarity determining region 3 for antibody 24542
QQYDRSPRT

SEQ ID NO: 49084 - protein, 21 aa, Homo sapiens
  heavy chain complementarity determining region 3 for antibody 24542
CRESEYFDILTTSWTVDGFDI

SEQ ID NO: 49085 - protein, 8 aa, Homo sapiens
  light chain complementarity determining region 3 for antibody 24543
QQYDNLPT

SEQ ID NO: 49086 - protein, 16 aa, Homo sapiens
  heavy chain complementarity determining region 3 for antibody 24543
ARGSAGSYYNVDYFVY

SEQ ID NO: 49087 - protein, 9 aa, Homo sapiens
  light chain complementarity determining region 3 for antibody 24544
QQTYTIGVT

SEQ ID NO: 49088 - protein, 15 aa, Homo sapiens
  heavy chain complementarity determining region 3 for antibody 24544
ARDSFDGSYSGSFDY

SEQ ID NO: 49089 - protein, 9 aa, Homo sapiens
  light chain complementarity determining region 3 for antibody 24545
QQSYSTPYT

SEQ ID NO: 49090 - protein, 8 aa, Homo sapiens
  heavy chain complementarity determining region 3 for antibody 24545
TAWGSSQH

SEQ ID NO: 49091 - protein, 10 aa, Homo sapiens
  light chain complementarity determining region 3 for antibody 24546
QQSYSTPQWT

SEQ ID NO: 49092 - protein, 15 aa, Homo sapiens
  heavy chain complementarity determining region 3 for antibody 24546
ARVRALRGVPSFFDY

SEQ ID NO: 49093 - protein, 10 aa, Homo sapiens
  light chain complementarity determining region 3 for antibody 24547
QQRSNWPPYT

SEQ ID NO: 49094 - protein, 14 aa, Homo sapiens
  heavy chain complementarity determining region 3 for antibody 24547
ARGPSYFYETKFDF

SEQ ID NO: 49095 - protein, 9 aa, Homo sapiens
  light chain complementarity determining region 3 for antibody 24548
QQLNTYPLT

SEQ ID NO: 49096 - protein, 19 aa, Homo sapiens
  heavy chain complementarity determining region 3 for antibody 24548
ASGYCSAGTCYHYITPGGY

SEQ ID NO: 49097 - protein, 9 aa, Homo sapiens
  light chain complementarity determining region 3 for antibody 24549
QQANSFPLS

SEQ ID NO: 49098 - protein, 15 aa, Homo sapiens
  heavy chain complementarity determining region 3 for antibody 24549
ARDRIFDGRFGEIGT

SEQ ID NO: 49099 - protein, 9 aa, Homo sapiens
  light chain complementarity determining region 3 for antibody 24550
QQANSFPIT

SEQ ID NO: 49100 - protein, 14 aa, Homo sapiens
  heavy chain complementarity determining region 3 for antibody 24550
ARQGSGRWPDAFDI

SEQ ID NO: 49101 - protein, 9 aa, Homo sapiens
  light chain complementarity determining region 3 for antibody 24551
QHLNSYPRT

SEQ ID NO: 49102 - protein, 9 aa, Homo sapiens
  heavy chain complementarity determining region 3 for antibody 24551
AVGLVPPEY

SEQ ID NO: 49103 - protein, 9 aa, Homo sapiens
  light chain complementarity determining region 3 for antibody 24552
MQPLESPAT

SEQ ID NO: 49104 - protein, 20 aa, Homo sapiens
  heavy chain complementarity determining region 3 for antibody 24552
AAGARFDYIGGTYRPCQLDS

SEQ ID NO: 49105 - protein, 9 aa, Homo sapiens
  light chain complementarity determining region 3 for antibody 24553
MQGTHWPYT

SEQ ID NO: 49106 - protein, 15 aa, Homo sapiens
  heavy chain complementarity determining region 3 for antibody 24553
ARDIRGSWYGTSVDY

SEQ ID NO: 49107 - protein, 9 aa, Homo sapiens
  light chain complementarity determining region 3 for antibody 24554
MQGTHWPWT

SEQ ID NO: 49108 - protein, 13 aa, Homo sapiens
  heavy chain complementarity determining region 3 for antibody 24554
ATMLRGHHGADGD

SEQ ID NO: 49109 - protein, 9 aa, Homo sapiens
  light chain complementarity determining region 3 for antibody 24555
MQALETPLT

SEQ ID NO: 49110 - protein, 24 aa, Homo sapiens
  heavy chain complementarity determining region 3 for antibody 24555
ARDGGPLVRGIIHPSLYYYYGLDV

SEQ ID NO: 49111 - protein, 9 aa, Homo sapiens
  light chain complementarity determining region 3 for antibody 24556
LQHNSYPRS

SEQ ID NO: 49112 - protein, 13 aa, Homo sapiens
  heavy chain complementarity determining region 3 for antibody 24556
AREIYSSSFSFDY

SEQ ID NO: 49113 - protein, 9 aa, Homo sapiens
  light chain complementarity determining region 3 for antibody 24557
LQHNSYLWT

SEQ ID NO: 49114 - protein, 18 aa, Homo sapiens
  heavy chain complementarity determining region 3 for antibody 24557
TTPYYYDGSGYMEGLDDC

SEQ ID NO: 49115 - protein, 9 aa, Homo sapiens
  light chain complementarity determining region 3 for antibody 24558
LQHHGLPYT

SEQ ID NO: 49116 - protein, 8 aa, Homo sapiens
  heavy chain complementarity determining region 3 for antibody 24558
ADVGAPDS

SEQ ID NO: 49117 - protein, 9 aa, Homo sapiens
  light chain complementarity determining region 3 for antibody 24559
LQDYNYPWT

SEQ ID NO: 49118 - protein, 18 aa, Homo sapiens
  heavy chain complementarity determining region 3 for antibody 24559
ARDGGDKDFWSGYRGMDV

SEQ ID NO: 49119 - protein, 9 aa, Homo sapiens
  light chain complementarity determining region 3 for antibody 24560
LQDFNYPWT

SEQ ID NO: 49120 - protein, 14 aa, Homo sapiens
  heavy chain complementarity determining region 3 for antibody 24560
ASLAYGANQDAFDL

SEQ ID NO: 49121 - protein, 8 aa, Homo sapiens
  light chain complementarity determining region 3 for antibody 24561
HQSYTTWT

SEQ ID NO: 49122 - protein, 13 aa, Homo sapiens
  heavy chain complementarity determining region 3 for antibody 24561
AREGSSGWYGIDS

SEQ ID NO: 49123 - protein, 8 aa, Homo sapiens
  light chain complementarity determining region 3 for antibody 24562
QQYSTFVT

SEQ ID NO: 49124 - protein, 16 aa, Homo sapiens
  heavy chain complementarity determining region 3 for antibody 24562
VKDASLYDDTGYHLDH

SEQ ID NO: 49125 - protein, 8 aa, Homo sapiens
  light chain complementarity determining region 3 for antibody 24563
QQYRSSFP

SEQ ID NO: 49126 - protein, 13 aa, Homo sapiens
  heavy chain complementarity determining region 3 for antibody 24563
ATESGWYQGAFDI

SEQ ID NO: 49127 - protein, 10 aa, Homo sapiens
  light chain complementarity determining region 3 for antibody 24564
QQYNSYSLWT

SEQ ID NO: 49128 - protein, 13 aa, Homo sapiens
  heavy chain complementarity determining region 3 for antibody 24564
VKDLAYYLGYFQH

SEQ ID NO: 49129 - protein, 9 aa, Homo sapiens
  light chain complementarity determining region 3 for antibody 24565
QQYNSYPFT

SEQ ID NO: 49130 - protein, 10 aa, Homo sapiens
  heavy chain complementarity determining region 3 for antibody 24565
ATYGDTSLHP

SEQ ID NO: 49131 - protein, 9 aa, Homo sapiens
  light chain complementarity determining region 3 for antibody 24566
QQYNSFSRT

SEQ ID NO: 49132 - protein, 11 aa, Homo sapiens
  heavy chain complementarity determining region 3 for antibody 24566
ARPPRGHDGGY

SEQ ID NO: 49133 - protein, 9 aa, Homo sapiens
  light chain complementarity determining region 3 for antibody 24567
QQYNKYPWT

SEQ ID NO: 49134 - protein, 14 aa, Homo sapiens
  heavy chain complementarity determining region 3 for antibody 24567
AKEESDGYYRTADY

SEQ ID NO: 49135 - protein, 9 aa, Homo sapiens
  light chain complementarity determining region 3 for antibody 24568
QQYNIWPRT

SEQ ID NO: 49136 - protein, 20 aa, Homo sapiens
  heavy chain complementarity determining region 3 for antibody 24568
ARDTNYYDSSRYYSGGYFDS

SEQ ID NO: 49137 - protein, 9 aa, Homo sapiens
  light chain complementarity determining region 3 for antibody 24569
QQYKTYPIT

SEQ ID NO: 49138 - protein, 15 aa, Homo sapiens
  heavy chain complementarity determining region 3 for antibody 24569
RTTLLVVITEDYFDY

SEQ ID NO: 49139 - protein, 10 aa, Homo sapiens
  light chain complementarity determining region 3 for antibody 24570
QQYHDWPPYT

SEQ ID NO: 49140 - protein, 22 aa, Homo sapiens
  heavy chain complementarity determining region 3 for antibody 24570
AKDQASTVVVVSRPWEVSDLTF

SEQ ID NO: 49141 - protein, 8 aa, Homo sapiens
  light chain complementarity determining region 3 for antibody 24571
QQYGSSPT

SEQ ID NO: 49142 - protein, 22 aa, Homo sapiens
  heavy chain complementarity determining region 3 for antibody 24571
ARDDYVWGSYRYGGQGSQAFDI

SEQ ID NO: 49143 - protein, 8 aa, Homo sapiens
  light chain complementarity determining region 3 for antibody 24572
QQYGSSLT

SEQ ID NO: 49144 - protein, 16 aa, Homo sapiens
  heavy chain complementarity determining region 3 for antibody 24572
VRDRPRSSSSWTSFEY

SEQ ID NO: 49145 - protein, 9 aa, Homo sapiens
  light chain complementarity determining region 3 for antibody 24573
QQYEDLPFT

SEQ ID NO: 49146 - protein, 15 aa, Homo sapiens
  heavy chain complementarity determining region 3 for antibody 24573
TTSPGSWDHGELVDY

SEQ ID NO: 49147 - protein, 10 aa, Homo sapiens
  light chain complementarity determining region 3 for antibody 24574
QQYDNLPPLT

SEQ ID NO: 49148 - protein, 14 aa, Homo sapiens
  heavy chain complementarity determining region 3 for antibody 24574
AKGHRIVGATYFDY

SEQ ID NO: 49149 - protein, 9 aa, Homo sapiens
  light chain complementarity determining region 3 for antibody 24575
QQYDNIPRT

SEQ ID NO: 49150 - protein, 15 aa, Homo sapiens
  heavy chain complementarity determining region 3 for antibody 24575
AKDGYSGNYWGRGDF

SEQ ID NO: 49151 - protein, 9 aa, Homo sapiens
  light chain complementarity determining region 3 for antibody 24576
QQYDGLPRT

SEQ ID NO: 49152 - protein, 19 aa, Homo sapiens
  heavy chain complementarity determining region 3 for antibody 24576
ARAGPYYYDSNGSFRDFDH

SEQ ID NO: 49153 - protein, 11 aa, Homo sapiens
  light chain complementarity determining region 3 for antibody 24577
QQWGTSGSRYT

SEQ ID NO: 49154 - protein, 14 aa, Homo sapiens
  heavy chain complementarity determining region 3 for antibody 24577
ARHTSMAGLRGFDQ

SEQ ID NO: 49155 - protein, 9 aa, Homo sapiens
  light chain complementarity determining region 3 for antibody 24578
QQVEDYPIT

SEQ ID NO: 49156 - protein, 16 aa, Homo sapiens
  heavy chain complementarity determining region 3 for antibody 24578
SRVVAKSILPQPPNDY

SEQ ID NO: 49157 - protein, 10 aa, Homo sapiens
  light chain complementarity determining region 3 for antibody 24579
QQTYSTLGYT

SEQ ID NO: 49158 - protein, 14 aa, Homo sapiens
  heavy chain complementarity determining region 3 for antibody 24579
ARDLTGYRAPYFDY

SEQ ID NO: 49159 - protein, 10 aa, Homo sapiens
  light chain complementarity determining region 3 for antibody 24580
QQTYNTPPYT

SEQ ID NO: 49160 - protein, 14 aa, Homo sapiens
  heavy chain complementarity determining region 3 for antibody 24580
AKVTPSPYGDSLND

SEQ ID NO: 49161 - protein, 9 aa, Homo sapiens
  light chain complementarity determining region 3 for antibody 24581
QQSYSTSWT

SEQ ID NO: 49162 - protein, 12 aa, Homo sapiens
  heavy chain complementarity determining region 3 for antibody 24581
ARVEYGDYCVDY

SEQ ID NO: 49163 - protein, 9 aa, Homo sapiens
  light chain complementarity determining region 3 for antibody 24582
QQSYSTPWT

SEQ ID NO: 49164 - protein, 10 aa, Homo sapiens
  heavy chain complementarity determining region 3 for antibody 24582
ASLNRRTSRR

SEQ ID NO: 49165 - protein, 9 aa, Homo sapiens
  light chain complementarity determining region 3 for antibody 24583
QQSYNTPLT

SEQ ID NO: 49166 - protein, 15 aa, Homo sapiens
  heavy chain complementarity determining region 3 for antibody 24583
AKAYGDYVTPYFFDS

SEQ ID NO: 49167 - protein, 10 aa, Homo sapiens
  light chain complementarity determining region 3 for antibody 24584
QQRSNWPRFT

SEQ ID NO: 49168 - protein, 15 aa, Homo sapiens
  heavy chain complementarity determining region 3 for antibody 24584
ARDWETATQWYYFDY

SEQ ID NO: 49169 - protein, 9 aa, Homo sapiens
  light chain complementarity determining region 3 for antibody 24585
QQLNSYPRT

SEQ ID NO: 49170 - protein, 17 aa, Homo sapiens
  heavy chain complementarity determining region 3 for antibody 24585
AKSPAVYTWGHLSLFDS

SEQ ID NO: 49171 - protein, 11 aa, Homo sapiens
  light chain complementarity determining region 3 for antibody 24586
QQLNGYPPMYT

SEQ ID NO: 49172 - protein, 19 aa, Homo sapiens
  heavy chain complementarity determining region 3 for antibody 24586
ARGFREVLSATDGYNWFDP

SEQ ID NO: 49173 - protein, 9 aa, Homo sapiens
  light chain complementarity determining region 3 for antibody 24587
QQHNSYPWT

SEQ ID NO: 49174 - protein, 15 aa, Homo sapiens
  heavy chain complementarity determining region 3 for antibody 24587
AKAQVIWGQLYYFES

SEQ ID NO: 49175 - protein, 9 aa, Homo sapiens
  light chain complementarity determining region 3 for antibody 24588
QQAYSFPYT

SEQ ID NO: 49176 - protein, 15 aa, Homo sapiens
  heavy chain complementarity determining region 3 for antibody 24588
AHRGYSTDSWDAFDI

SEQ ID NO: 49177 - protein, 9 aa, Homo sapiens
  light chain complementarity determining region 3 for antibody 24589
QQANSFPYT

SEQ ID NO: 49178 - protein, 23 aa, Homo sapiens
  heavy chain complementarity determining region 3 for antibody 24589
TRGHYDYVWGSYRYSGSGDAFDI

SEQ ID NO: 49179 - protein, 10 aa, Homo sapiens
  light chain complementarity determining region 3 for antibody 24590
QLYSRSPTGT

SEQ ID NO: 49180 - protein, 19 aa, Homo sapiens
  heavy chain complementarity determining region 3 for antibody 24590
ARESYYPDIGGYTPRAFDI

SEQ ID NO: 49181 - protein, 9 aa, Homo sapiens
  light chain complementarity determining region 3 for antibody 24591
QKYNNVPLT

SEQ ID NO: 49182 - protein, 9 aa, Homo sapiens
  heavy chain complementarity determining region 3 for antibody 24591
VESRNVFDI

SEQ ID NO: 49183 - protein, 9 aa, Homo sapiens
  light chain complementarity determining region 3 for antibody 24592
QHTHTFPRT

SEQ ID NO: 49184 - protein, 20 aa, Homo sapiens
  heavy chain complementarity determining region 3 for antibody 24592
ARGRRIAALSTAHYYYGMDV

SEQ ID NO: 49185 - protein, 9 aa, Homo sapiens
  light chain complementarity determining region 3 for antibody 24593
QHFDSSPWT

SEQ ID NO: 49186 - protein, 24 aa, Homo sapiens
  heavy chain complementarity determining region 3 for antibody 24593
ARVPFRVNRGVDLVPDYLFRAMDV

SEQ ID NO: 49187 - protein, 10 aa, Homo sapiens
  light chain complementarity determining region 3 for antibody 24594
QEYSPSLLFT

SEQ ID NO: 49188 - protein, 5 aa, Homo sapiens
  heavy chain complementarity determining region 3 for antibody 24594
GTREF

SEQ ID NO: 49189 - protein, 9 aa, Homo sapiens
  light chain complementarity determining region 3 for antibody 24595
QDYGSPLIT

SEQ ID NO: 49190 - protein, 15 aa, Homo sapiens
  heavy chain complementarity determining region 3 for antibody 24595
ARDRHWGGPVDALDF

SEQ ID NO: 49191 - protein, 9 aa, Homo sapiens
  light chain complementarity determining region 3 for antibody 24596
MQGTHWPPT

SEQ ID NO: 49192 - protein, 13 aa, Homo sapiens
  heavy chain complementarity determining region 3 for antibody 24596
AGGNGVYDYFCDY

SEQ ID NO: 49193 - protein, 9 aa, Homo sapiens
  light chain complementarity determining region 3 for antibody 24597
MQGTHWPKT

SEQ ID NO: 49194 - protein, 9 aa, Homo sapiens
  heavy chain complementarity determining region 3 for antibody 24597
AKGYYDSSY

SEQ ID NO: 49195 - protein, 8 aa, Homo sapiens
  light chain complementarity determining region 3 for antibody 24598
MQGTDMYT

SEQ ID NO: 49196 - protein, 14 aa, Homo sapiens
  heavy chain complementarity determining region 3 for antibody 24598
ARGSMIRGVPDIDY

SEQ ID NO: 49197 - protein, 9 aa, Homo sapiens
  light chain complementarity determining region 3 for antibody 24599
MQDTHWPLT

SEQ ID NO: 49198 - protein, 8 aa, Homo sapiens
  heavy chain complementarity determining region 3 for antibody 24599
ARTRTFDI

SEQ ID NO: 49199 - protein, 9 aa, Homo sapiens
  light chain complementarity determining region 3 for antibody 24600
MQARQTPWT

SEQ ID NO: 49200 - protein, 27 aa, Homo sapiens
  heavy chain complementarity determining region 3 for antibody 24600
AAALLGASDPYGRSSSGMRGWGYGLDV

SEQ ID NO: 49201 - protein, 9 aa, Homo sapiens
  light chain complementarity determining region 3 for antibody 24601
LQYNDWPFI

SEQ ID NO: 49202 - protein, 9 aa, Homo sapiens
  heavy chain complementarity determining region 3 for antibody 24601
AGWFGTLYL

SEQ ID NO: 49203 - protein, 9 aa, Homo sapiens
  light chain complementarity determining region 3 for antibody 24602
LQVHNYPYI

SEQ ID NO: 49204 - protein, 14 aa, Homo sapiens
  heavy chain complementarity determining region 3 for antibody 24602
ARDSSTTTGTGIDY

SEQ ID NO: 49205 - protein, 9 aa, Homo sapiens
  light chain complementarity determining region 3 for antibody 24603
LQTLQTPWT

SEQ ID NO: 49206 - protein, 13 aa, Homo sapiens
  heavy chain complementarity determining region 3 for antibody 24603
AKVVSYGSGGLQY

SEQ ID NO: 49207 - protein, 9 aa, Homo sapiens
  light chain complementarity determining region 3 for antibody 24604
LQDYSYPRT

SEQ ID NO: 49208 - protein, 18 aa, Homo sapiens
  heavy chain complementarity determining region 3 for antibody 24604
VRDDSHSISSRWYDGLDV

SEQ ID NO: 49209 - protein, 9 aa, Homo sapiens
  light chain complementarity determining region 3 for antibody 24605
HQSYTTPPA

SEQ ID NO: 49210 - protein, 13 aa, Homo sapiens
  heavy chain complementarity determining region 3 for antibody 24605
ARMREYATDAFDV

SEQ ID NO: 49211 - protein, 9 aa, Homo sapiens
  light chain complementarity determining region 3 for antibody 24606
RQYGSSPYA

SEQ ID NO: 49212 - protein, 13 aa, Homo sapiens
  heavy chain complementarity determining region 3 for antibody 24606
ARALQYSGRIFDY

SEQ ID NO: 49213 - protein, 8 aa, Homo sapiens
  light chain complementarity determining region 3 for antibody 24607
QQYYSNPF

SEQ ID NO: 49214 - protein, 20 aa, Homo sapiens
  heavy chain complementarity determining region 3 for antibody 24607
ARAAKVSGYYINRWGDAFDI

SEQ ID NO: 49215 - protein, 9 aa, Homo sapiens
  light chain complementarity determining region 3 for antibody 24608
QQYYDTPRT

SEQ ID NO: 49216 - protein, 19 aa, Homo sapiens
  heavy chain complementarity determining region 3 for antibody 24608
ARDGRPDCKDDICYSWFDL

SEQ ID NO: 49217 - protein, 11 aa, Homo sapiens
  light chain complementarity determining region 3 for antibody 24609
QQYNTYSPPCT

SEQ ID NO: 49218 - protein, 15 aa, Homo sapiens
  heavy chain complementarity determining region 3 for antibody 24609
AGGPSGVWLGYYFDY

SEQ ID NO: 49219 - protein, 8 aa, Homo sapiens
  light chain complementarity determining region 3 for antibody 24610
QQYNTFWT

SEQ ID NO: 49220 - protein, 15 aa, Homo sapiens
  heavy chain complementarity determining region 3 for antibody 24610
VTERNTSTWFSAFDM

SEQ ID NO: 49221 - protein, 8 aa, Homo sapiens
  light chain complementarity determining region 3 for antibody 24611
QQYNSYYT

SEQ ID NO: 49222 - protein, 11 aa, Homo sapiens
  heavy chain complementarity determining region 3 for antibody 24611
TNAGRRYQFDD

SEQ ID NO: 49223 - protein, 8 aa, Homo sapiens
  light chain complementarity determining region 3 for antibody 24612
QQYNSYYT

SEQ ID NO: 49224 - protein, 10 aa, Homo sapiens
  heavy chain complementarity determining region 3 for antibody 24612
GRDSDGQWLL

SEQ ID NO: 49225 - protein, 8 aa, Homo sapiens
  light chain complementarity determining region 3 for antibody 24613
QQYNSYWT

SEQ ID NO: 49226 - protein, 17 aa, Homo sapiens
  heavy chain complementarity determining region 3 for antibody 24613
AKQPFGGWFESYWYFDL

SEQ ID NO: 49227 - protein, 9 aa, Homo sapiens
  light chain complementarity determining region 3 for antibody 24614
QQYNSYSWP

SEQ ID NO: 49228 - protein, 10 aa, Homo sapiens
  heavy chain complementarity determining region 3 for antibody 24614
ARVSVGGFDP

SEQ ID NO: 49229 - protein, 8 aa, Homo sapiens
  light chain complementarity determining region 3 for antibody 24615
QQYNSYST

SEQ ID NO: 49230 - protein, 13 aa, Homo sapiens
  heavy chain complementarity determining region 3 for antibody 24615
ATESGPRRRTLNY

SEQ ID NO: 49231 - protein, 8 aa, Homo sapiens
  light chain complementarity determining region 3 for antibody 24616
QQYNSYST

SEQ ID NO: 49232 - protein, 16 aa, Homo sapiens
  heavy chain complementarity determining region 3 for antibody 24616
ARDGLPLTSKPYYFDY

SEQ ID NO: 49233 - protein, 9 aa, Homo sapiens
  light chain complementarity determining region 3 for antibody 24617
QQYNSYSRT

SEQ ID NO: 49234 - protein, 11 aa, Homo sapiens
  heavy chain complementarity determining region 3 for antibody 24617
ARGWAGDAFDI

SEQ ID NO: 49235 - protein, 9 aa, Homo sapiens
  light chain complementarity determining region 3 for antibody 24618
QQYNSYPYT

SEQ ID NO: 49236 - protein, 17 aa, Homo sapiens
  heavy chain complementarity determining region 3 for antibody 24618
AREFRYSSNWYTGFLDY

SEQ ID NO: 49237 - protein, 8 aa, Homo sapiens
  light chain complementarity determining region 3 for antibody 24619
QQYNFWRT

SEQ ID NO: 49238 - protein, 10 aa, Homo sapiens
  heavy chain complementarity determining region 3 for antibody 24619
SRVYYGVQDY

SEQ ID NO: 49239 - protein, 9 aa, Homo sapiens
  light chain complementarity determining region 3 for antibody 24620
QQYKSYSYT

SEQ ID NO: 49240 - protein, 13 aa, Homo sapiens
  heavy chain complementarity determining region 3 for antibody 24620
ARARDSYNLYFDY

SEQ ID NO: 49241 - protein, 9 aa, Homo sapiens
  light chain complementarity determining region 3 for antibody 24621
QQYGTSVLT

SEQ ID NO: 49242 - protein, 17 aa, Homo sapiens
  heavy chain complementarity determining region 3 for antibody 24621
ARPGSGFGYDNEDAFDI

SEQ ID NO: 49243 - protein, 9 aa, Homo sapiens
  light chain complementarity determining region 3 for antibody 24622
QQYGTSSWT

SEQ ID NO: 49244 - protein, 16 aa, Homo sapiens
  heavy chain complementarity determining region 3 for antibody 24622
VKDLGNEFFSGPMMDS

SEQ ID NO: 49245 - protein, 7 aa, Homo sapiens
  light chain complementarity determining region 3 for antibody 24623
QQYGSSP

SEQ ID NO: 49246 - protein, 16 aa, Homo sapiens
  heavy chain complementarity determining region 3 for antibody 24623
SSGTPFSVAVAGSFDY

SEQ ID NO: 49247 - protein, 9 aa, Homo sapiens
  light chain complementarity determining region 3 for antibody 24624
QQYGSSPRA

SEQ ID NO: 49248 - protein, 21 aa, Homo sapiens
  heavy chain complementarity determining region 3 for antibody 24624
ARDGLVRVTMIVATDFYGLDI

SEQ ID NO: 49249 - protein, 9 aa, Homo sapiens
  light chain complementarity determining region 3 for antibody 24625
QQYGRLPLT

SEQ ID NO: 49250 - protein, 15 aa, Homo sapiens
  heavy chain complementarity determining region 3 for antibody 24625
AHRPNYYDKAGAFDI

SEQ ID NO: 49251 - protein, 9 aa, Homo sapiens
  light chain complementarity determining region 3 for antibody 24626
QQYDISPMT

SEQ ID NO: 49252 - protein, 16 aa, Homo sapiens
  heavy chain complementarity determining region 3 for antibody 24626
AREAKDYGDYVDAFDV

SEQ ID NO: 49253 - protein, 8 aa, Homo sapiens
  light chain complementarity determining region 3 for antibody 24627
QQYADWLT

SEQ ID NO: 49254 - protein, 15 aa, Homo sapiens
  heavy chain complementarity determining region 3 for antibody 24627
VKNPGGWRDTYYFHY

SEQ ID NO: 49255 - protein, 9 aa, Homo sapiens
  light chain complementarity determining region 3 for antibody 24628
QQSYTIPFT

SEQ ID NO: 49256 - protein, 13 aa, Homo sapiens
  heavy chain complementarity determining region 3 for antibody 24628
SWRCCEEHDAFDF

SEQ ID NO: 49257 - protein, 9 aa, Homo sapiens
  light chain complementarity determining region 3 for antibody 24629
QQSYSTPPA

SEQ ID NO: 49258 - protein, 23 aa, Homo sapiens
  heavy chain complementarity determining region 3 for antibody 24629
ARSATRGRRRTEASGTYEGYFDF

SEQ ID NO: 49259 - protein, 10 aa, Homo sapiens
  light chain complementarity determining region 3 for antibody 24630
QQSYSTPLYT

SEQ ID NO: 49260 - protein, 13 aa, Homo sapiens
  heavy chain complementarity determining region 3 for antibody 24630
ARNEAFSSDEFDY

SEQ ID NO: 49261 - protein, 9 aa, Homo sapiens
  light chain complementarity determining region 3 for antibody 24631
QQSYSTLFT

SEQ ID NO: 49262 - protein, 10 aa, Homo sapiens
  heavy chain complementarity determining region 3 for antibody 24631
ASLNRRTSRR

SEQ ID NO: 49263 - protein, 9 aa, Homo sapiens
  light chain complementarity determining region 3 for antibody 24632
QQSYNSPLT

SEQ ID NO: 49264 - protein, 11 aa, Homo sapiens
  heavy chain complementarity determining region 3 for antibody 24632
ARDLRFGIFDY

SEQ ID NO: 49265 - protein, 9 aa, Homo sapiens
  light chain complementarity determining region 3 for antibody 24633
QQSSSTPYT

SEQ ID NO: 49266 - protein, 16 aa, Homo sapiens
  heavy chain complementarity determining region 3 for antibody 24633
ASEGVVREFIIWAFDI

SEQ ID NO: 49267 - protein, 9 aa, Homo sapiens
  light chain complementarity determining region 3 for antibody 24634
QQSKSFPLT

SEQ ID NO: 49268 - protein, 14 aa, Homo sapiens
  heavy chain complementarity determining region 3 for antibody 24634
ARDPVIGTPDWFDP

SEQ ID NO: 49269 - protein, 8 aa, Homo sapiens
  light chain complementarity determining region 3 for antibody 24635
QQRSNWPT

SEQ ID NO: 49270 - protein, 17 aa, Homo sapiens
  heavy chain complementarity determining region 3 for antibody 24635
ARCSGGSCNDPTSYFDS

SEQ ID NO: 49271 - protein, 9 aa, Homo sapiens
  light chain complementarity determining region 3 for antibody 24636
QQRSNWPLT

SEQ ID NO: 49272 - protein, 20 aa, Homo sapiens
  heavy chain complementarity determining region 3 for antibody 24636
AKDQTPFYSSGWKWGQYFDY

SEQ ID NO: 49273 - protein, 9 aa, Homo sapiens
  light chain complementarity determining region 3 for antibody 24637
QQRKNWPRT

SEQ ID NO: 49274 - protein, 13 aa, Homo sapiens
  heavy chain complementarity determining region 3 for antibody 24637
ARDFPSQRGFFDY

SEQ ID NO: 49275 - protein, 9 aa, Homo sapiens
  light chain complementarity determining region 3 for antibody 24638
QQPHSFPLT

SEQ ID NO: 49276 - protein, 15 aa, Homo sapiens
  heavy chain complementarity determining region 3 for antibody 24638
AKDPSCDSIWNYFDY

SEQ ID NO: 49277 - protein, 9 aa, Homo sapiens
  light chain complementarity determining region 3 for antibody 24639
QQNYSPPWT

SEQ ID NO: 49278 - protein, 20 aa, Homo sapiens
  heavy chain complementarity determining region 3 for antibody 24639
ARVLGYCDTITCYHKGDFDY

SEQ ID NO: 49279 - protein, 9 aa, Homo sapiens
  light chain complementarity determining region 3 for antibody 24640
QQGYSSPYT

SEQ ID NO: 49280 - protein, 14 aa, Homo sapiens
  heavy chain complementarity determining region 3 for antibody 24640
ARDPQGGKPDYFDY

SEQ ID NO: 49281 - protein, 8 aa, Homo sapiens
  light chain complementarity determining region 3 for antibody 24641
QQANSFPS

SEQ ID NO: 49282 - protein, 21 aa, Homo sapiens
  heavy chain complementarity determining region 3 for antibody 24641
ARSGPIVVGTAIPYYYYGMDV

SEQ ID NO: 49283 - protein, 11 aa, Homo sapiens
  light chain complementarity determining region 3 for antibody 24642
QNYNTALRGLT

SEQ ID NO: 49284 - protein, 14 aa, Homo sapiens
  heavy chain complementarity determining region 3 for antibody 24642
AKPRNSYWLYYFDY

SEQ ID NO: 49285 - protein, 9 aa, Homo sapiens
  light chain complementarity determining region 3 for antibody 24643
QKYNNAHLT

SEQ ID NO: 49286 - protein, 11 aa, Homo sapiens
  heavy chain complementarity determining region 3 for antibody 24643
ARGGYDYYFEY

SEQ ID NO: 49287 - protein, 11 aa, Homo sapiens
  light chain complementarity determining region 3 for antibody 24644
QHYGSSPPMYT

SEQ ID NO: 49288 - protein, 10 aa, Homo sapiens
  heavy chain complementarity determining region 3 for antibody 24644
VSNGYYCLEY

SEQ ID NO: 49289 - protein, 7 aa, Homo sapiens
  light chain complementarity determining region 3 for antibody 24645
QELKSRA

SEQ ID NO: 49290 - protein, 13 aa, Homo sapiens
  heavy chain complementarity determining region 3 for antibody 24645
TRGTIVSAAGFDF

SEQ ID NO: 49291 - protein, 9 aa, Homo sapiens
  light chain complementarity determining region 3 for antibody 24646
MQGTYWPNT

SEQ ID NO: 49292 - protein, 11 aa, Homo sapiens
  heavy chain complementarity determining region 3 for antibody 24646
ARNPDWGALDY

SEQ ID NO: 49293 - protein, 9 aa, Homo sapiens
  light chain complementarity determining region 3 for antibody 24647
MQGLQTPYT

SEQ ID NO: 49294 - protein, 10 aa, Homo sapiens
  heavy chain complementarity determining region 3 for antibody 24647
GRDLTGSKDY

SEQ ID NO: 49295 - protein, 9 aa, Homo sapiens
  light chain complementarity determining region 3 for antibody 24648
LQDYNYPWT

SEQ ID NO: 49296 - protein, 8 aa, Homo sapiens
  heavy chain complementarity determining region 3 for antibody 24648
TTGGRDGC

SEQ ID NO: 49297 - protein, 9 aa, Homo sapiens
  light chain complementarity determining region 3 for antibody 24649
HQYGTSPRT

SEQ ID NO: 49298 - protein, 13 aa, Homo sapiens
  heavy chain complementarity determining region 3 for antibody 24649
ATESGSYYGGLDY

SEQ ID NO: 49299 - protein, 9 aa, Homo sapiens
  light chain complementarity determining region 3 for antibody 24650
HQYATSPRT

SEQ ID NO: 49300 - protein, 17 aa, Homo sapiens
  heavy chain complementarity determining region 3 for antibody 24650
VKPRETYSSGWVDAFDV

SEQ ID NO: 49301 - protein, 9 aa, Homo sapiens
  light chain complementarity determining region 3 for antibody 24651
HQTYSDLRT

SEQ ID NO: 49302 - protein, 16 aa, Homo sapiens
  heavy chain complementarity determining region 3 for antibody 24651
AVMEDSGSYIADAFDM

SEQ ID NO: 49303 - protein, 10 aa, Homo sapiens
  light chain complementarity determining region 3 for antibody 24652
QQYSHWPWYT

SEQ ID NO: 49304 - protein, 11 aa, Homo sapiens
  heavy chain complementarity determining region 3 for antibody 24652
TRGGSGWPVDY

SEQ ID NO: 49305 - protein, 9 aa, Homo sapiens
  light chain complementarity determining region 3 for antibody 24653
QQYNSYSPT

SEQ ID NO: 49306 - protein, 16 aa, Homo sapiens
  heavy chain complementarity determining region 3 for antibody 24653
AVPRQMATIRNDAFDI

SEQ ID NO: 49307 - protein, 10 aa, Homo sapiens
  light chain complementarity determining region 3 for antibody 24654
QQYNSYSPDT

SEQ ID NO: 49308 - protein, 12 aa, Homo sapiens
  heavy chain complementarity determining region 3 for antibody 24654
TPHPQFWSGSDY

SEQ ID NO: 49309 - protein, 9 aa, Homo sapiens
  light chain complementarity determining region 3 for antibody 24655
QQYNSFPWT

SEQ ID NO: 49310 - protein, 23 aa, Homo sapiens
  heavy chain complementarity determining region 3 for antibody 24655
TRGKFRFLQWVGTSYSYYYDMDV

SEQ ID NO: 49311 - protein, 9 aa, Homo sapiens
  light chain complementarity determining region 3 for antibody 24656
QQYNQWPYS

SEQ ID NO: 49312 - protein, 8 aa, Homo sapiens
  heavy chain complementarity determining region 3 for antibody 24656
ARDIVLYH

SEQ ID NO: 49313 - protein, 9 aa, Homo sapiens
  light chain complementarity determining region 3 for antibody 24657
QQYNNWPYT

SEQ ID NO: 49314 - protein, 11 aa, Homo sapiens
  heavy chain complementarity determining region 3 for antibody 24657
CGYYHGGPFGY

SEQ ID NO: 49315 - protein, 10 aa, Homo sapiens [sequence omitted]

SEQ ID NO: 49316 - protein, 17 aa, Homo sapiens
  heavy chain complementarity determining region 3 for antibody 24658
AREKPEAGRGGDCYFDY

SEQ ID NO: 49317 - protein, 8 aa, Homo sapiens
  light chain complementarity determining region 3 for antibody 24659
QQYHTLIT

SEQ ID NO: 49318 - protein, 14 aa, Homo sapiens
  heavy chain complementarity determining region 3 for antibody 24659
TKDRSARSGYAFDL

SEQ ID NO: 49319 - protein, 9 aa, Homo sapiens
  light chain complementarity determining region 3 for antibody 24660
QQYGSSWGT

SEQ ID NO: 49320 - protein, 20 aa, Homo sapiens
  heavy chain complementarity determining region 3 for antibody 24660
AREGGHRQWLEIYDPGYFHH

SEQ ID NO: 49321 - protein, 10 aa, Homo sapiens
  light chain complementarity determining region 3 for antibody 24661
QQYGSSPLGT

SEQ ID NO: 49322 - protein, 18 aa, Homo sapiens
  heavy chain complementarity determining region 3 for antibody 24661
RKIQQLATSYYYYYGMDV

SEQ ID NO: 49323 - protein, 9 aa, Homo sapiens
  light chain complementarity determining region 3 for antibody 24662
QQYGRSPRT

SEQ ID NO: 49324 - protein, 15 aa, Homo sapiens
  heavy chain complementarity determining region 3 for antibody 24662
AKDGPYCGSDCYFGH

SEQ ID NO: 49325 - protein, 9 aa, Homo sapiens
  light chain complementarity determining region 3 for antibody 24663
QQYGNLPRT

SEQ ID NO: 49326 - protein, 13 aa, Homo sapiens
  heavy chain complementarity determining region 3 for antibody 24663
AGGNFHSGGYGDY

SEQ ID NO: 49327 - protein, 10 aa, Homo sapiens
  light chain complementarity determining region 3 for antibody 24664
QQYGGSPLIT

SEQ ID NO: 49328 - protein, 14 aa, Homo sapiens
  heavy chain complementarity determining region 3 for antibody 24664
ARDPVAGSPDYFDY

SEQ ID NO: 49329 - protein, 9 aa, Homo sapiens
  light chain complementarity determining region 3 for antibody 24665
QQYDSLPVT

SEQ ID NO: 49330 - protein, 16 aa, Homo sapiens
  heavy chain complementarity determining region 3 for antibody 24665
AKDRRRMATISAHFDS

SEQ ID NO: 49331 - protein, 8 aa, Homo sapiens
  light chain complementarity determining region 3 for antibody 24666
QQSYSNPT

SEQ ID NO: 49332 - protein, 12 aa, Homo sapiens
  heavy chain complementarity determining region 3 for antibody 24666
AREGGMAAAPEF

SEQ ID NO: 49333 - protein, 9 aa, Homo sapiens
  light chain complementarity determining region 3 for antibody 24667
QQSYSNPRT

SEQ ID NO: 49334 - protein, 14 aa, Homo sapiens
  heavy chain complementarity determining region 3 for antibody 24667
ARDLSGSVTGPFDY

SEQ ID NO: 49335 - protein, 9 aa, Homo sapiens
  light chain complementarity determining region 3 for antibody 24668
QQSYSIPVT

SEQ ID NO: 49336 - protein, 10 aa, Homo sapiens
  heavy chain complementarity determining region 3 for antibody 24668
ARTDILTGYK

SEQ ID NO: 49337 - protein, 9 aa, Homo sapiens
  light chain complementarity determining region 3 for antibody 24669
QQSYGTHFT

SEQ ID NO: 49338 - protein, 15 aa, Homo sapiens
  heavy chain complementarity determining region 3 for antibody 24669
ANRGGGYGYGYYFDS

SEQ ID NO: 49339 - protein, 9 aa, Homo sapiens
  light chain complementarity determining region 3 for antibody 24670
QQSFVTPRT

SEQ ID NO: 49340 - protein, 15 aa, Homo sapiens
  heavy chain complementarity determining region 3 for antibody 24670
ASMPYNNVPFPPFDH

SEQ ID NO: 49341 - protein, 9 aa, Homo sapiens
  light chain complementarity determining region 3 for antibody 24671
QQRSNWQLT

SEQ ID NO: 49342 - protein, 10 aa, Homo sapiens
  heavy chain complementarity determining region 3 for antibody 24671
ASLNRRTSRR

SEQ ID NO: 49343 - protein, 9 aa, Homo sapiens
  light chain complementarity determining region 3 for antibody 24672
QQNYSTPPT

SEQ ID NO: 49344 - protein, 16 aa, Homo sapiens
  heavy chain complementarity determining region 3 for antibody 24672
AVGADTAMVTFGNFDY

SEQ ID NO: 49345 - protein, 6 aa, Homo sapiens
  light chain complementarity determining region 3 for antibody 24673
QQLNNL

SEQ ID NO: 49346 - protein, 10 aa, Homo sapiens
  heavy chain complementarity determining region 3 for antibody 24673
ATDVTGTTYY

SEQ ID NO: 49347 - protein, 11 aa, Homo sapiens
  light chain complementarity determining region 3 for antibody 24674
QQLKDYPRELT

SEQ ID NO: 49348 - protein, 14 aa, Homo sapiens
  heavy chain complementarity determining region 3 for antibody 24674
ARDLFGGSPGAFDS

SEQ ID NO: 49349 - protein, 9 aa, Homo sapiens
  light chain complementarity determining region 3 for antibody 24675
QQFNTYPFT

SEQ ID NO: 49350 - protein, 15 aa, Homo sapiens
  heavy chain complementarity determining region 3 for antibody 24675
ARGLMVRGINDGVDI

SEQ ID NO: 49351 - protein, 7 aa, Homo sapiens
  light chain complementarity determining region 3 for antibody 24676
QQANSFL

SEQ ID NO: 49352 - protein, 14 aa, Homo sapiens
  heavy chain complementarity determining region 3 for antibody 24676
ARPAAAVLKEYFQH

SEQ ID NO: 49353 - protein, 9 aa, Homo sapiens
  light chain complementarity determining region 3 for antibody 24677
QQANGFPIT

SEQ ID NO: 49354 - protein, 16 aa, Homo sapiens
  heavy chain complementarity determining region 3 for antibody 24677
ARSQNQFGDFLFTYDY

SEQ ID NO: 49355 - protein, 8 aa, Homo sapiens
  light chain complementarity determining region 3 for antibody 24678
QHRSDWPP

SEQ ID NO: 49356 - protein, 18 aa, Homo sapiens
  heavy chain complementarity determining region 3 for antibody 24678
AKKRAAAGIHPGGYYFDS

SEQ ID NO: 49357 - protein, 7 aa, Homo sapiens
  light chain complementarity determining region 3 for antibody 24679
QELETYV

SEQ ID NO: 49358 - protein, 17 aa, Homo sapiens
  heavy chain complementarity determining region 3 for antibody 24679
VKDMGPLFGSGLDAFDV

SEQ ID NO: 49359 - protein, 9 aa, Homo sapiens
  light chain complementarity determining region 3 for antibody 24680
MQVSHWPGT

SEQ ID NO: 49360 - protein, 10 aa, Homo sapiens
  heavy chain complementarity determining region 3 for antibody 24680
AKDYEGAGSD

SEQ ID NO: 49361 - protein, 9 aa, Homo sapiens
  light chain complementarity determining region 3 for antibody 24681
MQGALWPLT

SEQ ID NO: 49362 - protein, 11 aa, Homo sapiens
  heavy chain complementarity determining region 3 for antibody 24681
ARGGFWGDAAP

SEQ ID NO: 49363 - protein, 9 aa, Homo sapiens
  light chain complementarity determining region 3 for antibody 24682
MQALQTPHT

SEQ ID NO: 49364 - protein, 14 aa, Homo sapiens
  heavy chain complementarity determining region 3 for antibody 24682
AREMSSSSWYGMDV

SEQ ID NO: 49365 - protein, 9 aa, Homo sapiens
  light chain complementarity determining region 3 for antibody 24683
LQTYRTPLT

SEQ ID NO: 49366 - protein, 14 aa, Homo sapiens
  heavy chain complementarity determining region 3 for antibody 24683
ARLSVTQRRDAFDI

SEQ ID NO: 49367 - protein, 9 aa, Homo sapiens
  light chain complementarity determining region 3 for antibody 24684
LQDYIYPWT

SEQ ID NO: 49368 - protein, 17 aa, Homo sapiens
  heavy chain complementarity determining region 3 for antibody 24684
ARLADLDYDGNSGGFDY

SEQ ID NO: 49369 - protein, 9 aa, Homo sapiens
  light chain complementarity determining region 3 for antibody 24685
LQDNNYPLT

SEQ ID NO: 49370 - protein, 14 aa, Homo sapiens
  heavy chain complementarity determining region 3 for antibody 24685
TRGKDLRYSSTFDY

SEQ ID NO: 49371 - protein, 9 aa, Homo sapiens
  light chain complementarity determining region 3 for antibody 24686
LQCHNLPLI

SEQ ID NO: 49372 - protein, 13 aa, Homo sapiens
  heavy chain complementarity determining region 3 for antibody 24686
AKDIFPHILQPNH

SEQ ID NO: 49373 - protein, 9 aa, Homo sapiens
  light chain complementarity determining region 3 for antibody 24687
QQYSSYSRT

SEQ ID NO: 49374 - protein, 20 aa, Homo sapiens
  heavy chain complementarity determining region 3 for antibody 24687
ARDPALYYDHNNYLRPPFDY

SEQ ID NO: 49375 - protein, 9 aa, Homo sapiens
  light chain complementarity determining region 3 for antibody 24688
QQYSSPPWT

SEQ ID NO: 49376 - protein, 19 aa, Homo sapiens
  heavy chain complementarity determining region 3 for antibody 24688
ARGSSLVEHFGGAYYFFDY

SEQ ID NO: 49377 - protein, 9 aa, Homo sapiens
  light chain complementarity determining region 3 for antibody 24689
QQYNSYSRT

SEQ ID NO: 49378 - protein, 20 aa, Homo sapiens
  heavy chain complementarity determining region 3 for antibody 24689
ARNTGTSSWSPLSYYYGMDV

SEQ ID NO: 49379 - protein, 9 aa, Homo sapiens
  light chain complementarity determining region 3 for antibody 24690
QQYNSYPWT

SEQ ID NO: 49380 - protein, 10 aa, Homo sapiens
  heavy chain complementarity determining region 3 for antibody 24690
ARYGDSGFDY

SEQ ID NO: 49381 - protein, 9 aa, Homo sapiens
  light chain complementarity determining region 3 for antibody 24691
QQYNSYPWT

SEQ ID NO: 49382 - protein, 16 aa, Homo sapiens
  heavy chain complementarity determining region 3 for antibody 24691
ARERRGFGVVIGPLDY

SEQ ID NO: 49383 - protein, 8 aa, Homo sapiens
  light chain complementarity determining region 3 for antibody 24692
QQYNSWVA

SEQ ID NO: 49384 - protein, 17 aa, Homo sapiens
  heavy chain complementarity determining region 3 for antibody 24692
ATKPVSDNWFWEYFFDY

SEQ ID NO: 49385 - protein, 8 aa, Homo sapiens
  light chain complementarity determining region 3 for antibody 24693
QQYNNYRT

SEQ ID NO: 49386 - protein, 18 aa, Homo sapiens
  heavy chain complementarity determining region 3 for antibody 24693
ARGRRDYVWGSYRSAVDY

SEQ ID NO: 49387 - protein, 9 aa, Homo sapiens
  light chain complementarity determining region 3 for antibody 24694
QQYNNWPRT

SEQ ID NO: 49388 - protein, 17 aa, Homo sapiens
  heavy chain complementarity determining region 3 for antibody 24694
ARACGAGGGWHCGVFDD

SEQ ID NO: 49389 - protein, 10 aa, Homo sapiens
  light chain complementarity determining region 3 for antibody 24695
QQYNNWPPYT

SEQ ID NO: 49390 - protein, 14 aa, Homo sapiens
  heavy chain complementarity determining region 3 for antibody 24695
AKDVLEAVVEVFHH

SEQ ID NO: 49391 - protein, 9 aa, Homo sapiens
  light chain complementarity determining region 3 for antibody 24696
QQYNLYPYT

SEQ ID NO: 49392 - protein, 17 aa, Homo sapiens
  heavy chain complementarity determining region 3 for antibody 24696
AREEIVVGIDTDGIVDN

SEQ ID NO: 49393 - protein, 9 aa, Homo sapiens
  light chain complementarity determining region 3 for antibody 24697
QQYNDWPWT

SEQ ID NO: 49394 - protein, 13 aa, Homo sapiens
  heavy chain complementarity determining region 3 for antibody 24697
VRSYSSAWTPGSF

SEQ ID NO: 49395 - protein, 9 aa, Homo sapiens
  light chain complementarity determining region 3 for antibody 24698
QQYGSSPWT

SEQ ID NO: 49396 - protein, 16 aa, Homo sapiens
  heavy chain complementarity determining region 3 for antibody 24698
ARLKRYSGYEDDGMDV

SEQ ID NO: 49397 - protein, 9 aa, Homo sapiens
  light chain complementarity determining region 3 for antibody 24699
QQYGSSPWT

SEQ ID NO: 49398 - protein, 15 aa, Homo sapiens
  heavy chain complementarity determining region 3 for antibody 24699
ARGVAGFGDLEYFDY

SEQ ID NO: 49399 - protein, 9 aa, Homo sapiens
  light chain complementarity determining region 3 for antibody 24700
QQYGSSPGT

SEQ ID NO: 49400 - protein, 15 aa, Homo sapiens
  heavy chain complementarity determining region 3 for antibody 24700
ARANIKLRLRSPLDY

SEQ ID NO: 49401 - protein, 9 aa, Homo sapiens
  light chain complementarity determining region 3 for antibody 24701
QQYGSSPFT

SEQ ID NO: 49402 - protein, 16 aa, Homo sapiens
  heavy chain complementarity determining region 3 for antibody 24701
ARERRGFGVVIGPLDY

SEQ ID NO: 49403 - protein, 10 aa, Homo sapiens
  light chain complementarity determining region 3 for antibody 24702
QQYGSSLPIT

SEQ ID NO: 49404 - protein, 18 aa, Homo sapiens
  heavy chain complementarity determining region 3 for antibody 24702
ATEGVYDVWSGYVQYFPH

SEQ ID NO: 49405 - protein, 10 aa, Homo sapiens
  light chain complementarity determining region 3 for antibody 24703
QQYGSSLPCT

SEQ ID NO: 49406 - protein, 23 aa, Homo sapiens
  heavy chain complementarity determining region 3 for antibody 24703
ARAQPRWGIAVAGPPGRYYGMDV

SEQ ID NO: 49407 - protein, 9 aa, Homo sapiens
  light chain complementarity determining region 3 for antibody 24704
QQYDSFPYT

SEQ ID NO: 49408 - protein, 15 aa, Homo sapiens
  heavy chain complementarity determining region 3 for antibody 24704
ARETRYDTRGRAFDI

SEQ ID NO: 49409 - protein, 9 aa, Homo sapiens
  light chain complementarity determining region 3 for antibody 24705
QQYDNWRCT

SEQ ID NO: 49410 - protein, 26 aa, Homo sapiens
  heavy chain complementarity determining region 3 for antibody 24705
SRGLGYSYTLRAKSLGLRAKAYFFDY

SEQ ID NO: 49411 - protein, 8 aa, Homo sapiens
  light chain complementarity determining region 3 for antibody 24706
QQYDNLFT

SEQ ID NO: 49412 - protein, 17 aa, Homo sapiens
  heavy chain complementarity determining region 3 for antibody 24706
ARVRAPYGGNSGHPFDI

SEQ ID NO: 49413 - protein, 9 aa, Homo sapiens
  light chain complementarity determining region 3 for antibody 24707
QQYDNFPIT

SEQ ID NO: 49414 - protein, 21 aa, Homo sapiens
  heavy chain complementarity determining region 3 for antibody 24707
ARDPFVVVTPTGARYYYGMDV

SEQ ID NO: 49415 - protein, 8 aa, Homo sapiens
  light chain complementarity determining region 3 for antibody 24708
QQYANDWA

SEQ ID NO: 49416 - protein, 11 aa, Homo sapiens
  heavy chain complementarity determining region 3 for antibody 24708
ARGAYGVGIVQ

SEQ ID NO: 49417 - protein, 9 aa, Homo sapiens
  light chain complementarity determining region 3 for antibody 24709
QQVNSYPLT

SEQ ID NO: 49418 - protein, 13 aa, Homo sapiens
  heavy chain complementarity determining region 3 for antibody 24709
ARGRYSRYYGMDV

SEQ ID NO: 49419 - protein, 10 aa, Homo sapiens
  light chain complementarity determining region 3 for antibody 24710
QQSYSTPSIT

SEQ ID NO: 49420 - protein, 16 aa, Homo sapiens
  heavy chain complementarity determining region 3 for antibody 24710
ATEPCSGGSCYPQMDS

SEQ ID NO: 49421 - protein, 9 aa, Homo sapiens
  light chain complementarity determining region 3 for antibody 24711
QQSYSTPLT

SEQ ID NO: 49422 - protein, 12 aa, Homo sapiens
  heavy chain complementarity determining region 3 for antibody 24711
ARDYVAGDAFDV

SEQ ID NO: 49423 - protein, 10 aa, Homo sapiens
  light chain complementarity determining region 3 for antibody 24712
QQSYSTLMYT

SEQ ID NO: 49424 - protein, 13 aa, Homo sapiens
  heavy chain complementarity determining region 3 for antibody 24712
AREVLLWFGDFDY

SEQ ID NO: 49425 - protein, 9 aa, Homo sapiens
  light chain complementarity determining region 3 for antibody 24713
QQSYNTPYT

SEQ ID NO: 49426 - protein, 10 aa, Homo sapiens
  heavy chain complementarity determining region 3 for antibody 24713
ARRSVGAFDL

SEQ ID NO: 49427 - protein, 8 aa, Homo sapiens
  light chain complementarity determining region 3 for antibody 24714
QQSHTTLT

SEQ ID NO: 49428 - protein, 12 aa, Homo sapiens
  heavy chain complementarity determining region 3 for antibody 24714
ARRGGFGRTFDF

SEQ ID NO: 49429 - protein, 9 aa, Homo sapiens
  light chain complementarity determining region 3 for antibody 24715
QQRSNWPGT

SEQ ID NO: 49430 - protein, 11 aa, Homo sapiens
  heavy chain complementarity determining region 3 for antibody 24715
VRDLQSRYFDN

SEQ ID NO: 49431 - protein, 9 aa, Homo sapiens
  light chain complementarity determining region 3 for antibody 24716
QQRSNWLYT

SEQ ID NO: 49432 - protein, 11 aa, Homo sapiens
  heavy chain complementarity determining region 3 for antibody 24716
ARESLGHSFDI

SEQ ID NO: 49433 - protein, 10 aa, Homo sapiens
  light chain complementarity determining region 3 for antibody 24717
QQRGDWPLYT

SEQ ID NO: 49434 - protein, 14 aa, Homo sapiens
  heavy chain complementarity determining region 3 for antibody 24717
VRRGAWPSLSHFDY

SEQ ID NO: 49435 - protein, 9 aa, Homo sapiens
  light chain complementarity determining region 3 for antibody 24718
QQLNSYPIT

SEQ ID NO: 49436 - protein, 15 aa, Homo sapiens
  heavy chain complementarity determining region 3 for antibody 24718
ARSSVVRADKYGMDV

SEQ ID NO: 49437 - protein, 10 aa, Homo sapiens
  light chain complementarity determining region 3 for antibody 24719
QQFGGSPMFT

SEQ ID NO: 49438 - protein, 10 aa, Homo sapiens
  heavy chain complementarity determining region 3 for antibody 24719
ARHGDYWLDP

SEQ ID NO: 49439 - protein, 10 aa, Homo sapiens
  light chain complementarity determining region 3 for antibody 24720
QQDGSSPMYS

SEQ ID NO: 49440 - protein, 11 aa, Homo sapiens
  heavy chain complementarity determining region 3 for antibody 24720
ARGGQWGSLDY

SEQ ID NO: 49441 - protein, 9 aa, Homo sapiens
  light chain complementarity determining region 3 for antibody 24721
QQANTFPWT

SEQ ID NO: 49442 - protein, 11 aa, Homo sapiens
  heavy chain complementarity determining region 3 for antibody 24721
ARVRGLSGFDY

SEQ ID NO: 49443 - protein, 9 aa, Homo sapiens
  light chain complementarity determining region 3 for antibody 24722
QQANSFPLT

SEQ ID NO: 49444 - protein, 14 aa, Homo sapiens
  heavy chain complementarity determining region 3 for antibody 24722
ARHTGVSGLRGFDQ

SEQ ID NO: 49445 - protein, 9 aa, Homo sapiens
  light chain complementarity determining region 3 for antibody 24723
QKYNNVPLT

SEQ ID NO: 49446 - protein, 16 aa, Homo sapiens
  heavy chain complementarity determining region 3 for antibody 24723
ARIKVDSSSWYSSLDY

SEQ ID NO: 49447 - protein, 9 aa, Homo sapiens
  light chain complementarity determining region 3 for antibody 24724
QKYDGVPPT

SEQ ID NO: 49448 - protein, 14 aa, Homo sapiens
  heavy chain complementarity determining region 3 for antibody 24724
TSPMYFYDGSGIDH

SEQ ID NO: 49449 - protein, 9 aa, Homo sapiens
  light chain complementarity determining region 3 for antibody 24725
QHSNNFPYT

SEQ ID NO: 49450 - protein, 12 aa, Homo sapiens
  heavy chain complementarity determining region 3 for antibody 24725
ARASGYHAPFGF

SEQ ID NO: 49451 - protein, 9 aa, Homo sapiens
  light chain complementarity determining region 3 for antibody 24726
MQVLQTPLT

SEQ ID NO: 49452 - protein, 12 aa, Homo sapiens
  heavy chain complementarity determining region 3 for antibody 24726
AKDSAKKWELLD

SEQ ID NO: 49453 - protein, 9 aa, Homo sapiens
  light chain complementarity determining region 3 for antibody 24727
LQYGGSLWT

SEQ ID NO: 49454 - protein, 17 aa, Homo sapiens
  heavy chain complementarity determining region 3 for antibody 24727
ARIGYYYDGNRYSYDDY

SEQ ID NO: 49455 - protein, 9 aa, Homo sapiens
  light chain complementarity determining region 3 for antibody 24728
LQHNSYPQT

SEQ ID NO: 49456 - protein, 9 aa, Homo sapiens
  heavy chain complementarity determining region 3 for antibody 24728
ARDGFSNYD

SEQ ID NO: 49457 - protein, 9 aa, Homo sapiens
  light chain complementarity determining region 3 for antibody 24729
LQHNIYPWT

SEQ ID NO: 49458 - protein, 16 aa, Homo sapiens
  heavy chain complementarity determining region 3 for antibody 24729
ARGRPIIPPVTQGPDY

SEQ ID NO: 49459 - protein, 9 aa, Homo sapiens
  light chain complementarity determining region 3 for antibody 24730
LHYDSTSET

SEQ ID NO: 49460 - protein, 21 aa, Homo sapiens
  heavy chain complementarity determining region 3 for antibody 24730
ARGIIRGFSSGRYSRYDYLHH

SEQ ID NO: 49461 - protein, 9 aa, Homo sapiens
  light chain complementarity determining region 3 for antibody 24731
HQSSGFPVT

SEQ ID NO: 49462 - protein, 19 aa, Homo sapiens
  heavy chain complementarity determining region 3 for antibody 24731
ARDAAYSSTWYLVLYGMDV

SEQ ID NO: 49463 - protein, 9 aa, Homo sapiens
  light chain complementarity determining region 3 for antibody 24732
HQFYSVPWT

SEQ ID NO: 49464 - protein, 11 aa, Homo sapiens
  heavy chain complementarity determining region 3 for antibody 24732
AGGEQMFPSSR

SEQ ID NO: 49465 - protein, 9 aa, Homo sapiens
  light chain complementarity determining region 3 for antibody 24733
QRYNSAPRT

SEQ ID NO: 49466 - protein, 13 aa, Homo sapiens
  heavy chain complementarity determining region 3 for antibody 24733
ASPFSGIAPAGGY

SEQ ID NO: 49467 - protein, 10 aa, Homo sapiens
  light chain complementarity determining region 3 for antibody 24734
QQYYSDPPLT

SEQ ID NO: 49468 - protein, 11 aa, Homo sapiens
  heavy chain complementarity determining region 3 for antibody 24734
ARGGIAARMQA

SEQ ID NO: 49469 - protein, 9 aa, Homo sapiens
  light chain complementarity determining region 3 for antibody 24735
QQYSSYPRT

SEQ ID NO: 49470 - protein, 14 aa, Homo sapiens
  heavy chain complementarity determining region 3 for antibody 24735
SRGGLYEQRAYFDY

SEQ ID NO: 49471 - protein, 9 aa, Homo sapiens
  light chain complementarity determining region 3 for antibody 24736
QQYSSLPLT

SEQ ID NO: 49472 - protein, 23 aa, Homo sapiens
  heavy chain complementarity determining region 3 for antibody 24736
VKEGRGDVLTFLEWSPRRGLLDY

SEQ ID NO: 49473 - protein, 9 aa, Homo sapiens
  light chain complementarity determining region 3 for antibody 24737
QQYSAYPLT

SEQ ID NO: 49474 - protein, 18 aa, Homo sapiens
  heavy chain complementarity determining region 3 for antibody 24737
ARHDWVPADGDKPDWFDP

SEQ ID NO: 49475 - protein, 8 aa, Homo sapiens
  light chain complementarity determining region 3 for antibody 24738
QQYNYLWT

SEQ ID NO: 49476 - protein, 10 aa, Homo sapiens
  heavy chain complementarity determining region 3 for antibody 24738
ARDRRSVYDS

SEQ ID NO: 49477 - protein, 10 aa, Homo sapiens
  light chain complementarity determining region 3 for antibody 24739
QQYNTWPLST

SEQ ID NO: 49478 - protein, 15 aa, Homo sapiens
  heavy chain complementarity determining region 3 for antibody 24739
ATVGAGSWYRGFFDH

SEQ ID NO: 49479 - protein, 9 aa, Homo sapiens
  light chain complementarity determining region 3 for antibody 24740
QQYNSYSRT

SEQ ID NO: 49480 - protein, 17 aa, Homo sapiens
  heavy chain complementarity determining region 3 for antibody 24740
AKGVTYYHYWHGFAFDF

SEQ ID NO: 49481 - protein, 7 aa, Homo sapiens
  light chain complementarity determining region 3 for antibody 24741
QQYNSYS

SEQ ID NO: 49482 - protein, 11 aa, Homo sapiens
  heavy chain complementarity determining region 3 for antibody 24741
ARRRSGFPLDY

SEQ ID NO: 49483 - protein, 9 aa, Homo sapiens
  light chain complementarity determining region 3 for antibody 24742
QQYNSYPWT

SEQ ID NO: 49484 - protein, 15 aa, Homo sapiens
  heavy chain complementarity determining region 3 for antibody 24742
ARGRSKWQQLVRIDS

SEQ ID NO: 49485 - protein, 9 aa, Homo sapiens
  light chain complementarity determining region 3 for antibody 24743
QQYNNWPFT

SEQ ID NO: 49486 - protein, 9 aa, Homo sapiens
  heavy chain complementarity determining region 3 for antibody 24743
ARGGGSSDV

SEQ ID NO: 49487 - protein, 8 aa, Homo sapiens
  light chain complementarity determining region 3 for antibody 24744
QQYNGYYT

SEQ ID NO: 49488 - protein, 22 aa, Homo sapiens
  heavy chain complementarity determining region 3 for antibody 24744
ARDATQHLTYSYDTSGVGGFDY

SEQ ID NO: 49489 - protein, 11 aa, Homo sapiens
  light chain complementarity determining region 3 for antibody 24745
QQYGTSPWAWT

SEQ ID NO: 49490 - protein, 13 aa, Homo sapiens
  heavy chain complementarity determining region 3 for antibody 24745
ARVAVPGLGYFQH

SEQ ID NO: 49491 - protein, 9 aa, Homo sapiens
  light chain complementarity determining region 3 for antibody 24746
QQYGSSPRT

SEQ ID NO: 49492 - protein, 25 aa, Homo sapiens
  heavy chain complementarity determining region 3 for antibody 24746
ARLRIDRLRLPGAMRWPLYDCGLNV

SEQ ID NO: 49493 - protein, 9 aa, Homo sapiens
  light chain complementarity determining region 3 for antibody 24747
QQYGGLPRT

SEQ ID NO: 49494 - protein, 16 aa, Homo sapiens
  heavy chain complementarity determining region 3 for antibody 24747
VKDQVAANGICDPFDI

SEQ ID NO: 49495 - protein, 9 aa, Homo sapiens
  light chain complementarity determining region 3 for antibody 24748
QQYDNPMYT

SEQ ID NO: 49496 - protein, 15 aa, Homo sapiens
  heavy chain complementarity determining region 3 for antibody 24748
ARGAYYDFWSGYSDY

SEQ ID NO: 49497 - protein, 10 aa, Homo sapiens
  light chain complementarity determining region 3 for antibody 24749
QQYDNLPLYT

SEQ ID NO: 49498 - protein, 11 aa, Homo sapiens
  heavy chain complementarity determining region 3 for antibody 24749
AREVVRGVFDF

SEQ ID NO: 49499 - protein, 9 aa, Homo sapiens
  light chain complementarity determining region 3 for antibody 24750
QQYDNLPLT

SEQ ID NO: 49500 - protein, 19 aa, Homo sapiens
  heavy chain complementarity determining region 3 for antibody 24750
AREAYYDSSGYFPSRYFDL

SEQ ID NO: 49501 - protein, 9 aa, Homo sapiens
  light chain complementarity determining region 3 for antibody 24751
QQYDLLPPT

SEQ ID NO: 49502 - protein, 21 aa, Homo sapiens
  heavy chain complementarity determining region 3 for antibody 24751
ARGLHIVVVTSIYRGFWHFGL

SEQ ID NO: 49503 - protein, 8 aa, Homo sapiens
  light chain complementarity determining region 3 for antibody 24752
QQYAVSPT

SEQ ID NO: 49504 - protein, 16 aa, Homo sapiens
  heavy chain complementarity determining region 3 for antibody 24752
ARPNVVQIWWESYFDF

SEQ ID NO: 49505 - protein, 9 aa, Homo sapiens
  light chain complementarity determining region 3 for antibody 24753
QQTFNSPLT

SEQ ID NO: 49506 - protein, 16 aa, Homo sapiens
  heavy chain complementarity determining region 3 for antibody 24753
ATDLEARGYYQYFFSS

SEQ ID NO: 49507 - protein, 9 aa, Homo sapiens
  light chain complementarity determining region 3 for antibody 24754
QQSYYWPWT

SEQ ID NO: 49508 - protein, 8 aa, Homo sapiens
  heavy chain complementarity determining region 3 for antibody 24754
SHSFYDVP

SEQ ID NO: 49509 - protein, 9 aa, Homo sapiens
  light chain complementarity determining region 3 for antibody 24755
QQSYTTPHT

SEQ ID NO: 49510 - protein, 11 aa, Homo sapiens
  heavy chain complementarity determining region 3 for antibody 24755
ARVQSGYWYDS

SEQ ID NO: 49511 - protein, 9 aa, Homo sapiens
  light chain complementarity determining region 3 for antibody 24756
QQSYSTPVT

SEQ ID NO: 49512 - protein, 21 aa, Homo sapiens
  heavy chain complementarity determining region 3 for antibody 24756
TTVADSSGYYYVRGLNDAFDI

SEQ ID NO: 49513 - protein, 10 aa, Homo sapiens
  light chain complementarity determining region 3 for antibody 24757
QQSYSTPSIT

SEQ ID NO: 49514 - protein, 14 aa, Homo sapiens
  heavy chain complementarity determining region 3 for antibody 24757
ASSISRSYYNWFDA

SEQ ID NO: 49515 - protein, 9 aa, Homo sapiens
  light chain complementarity determining region 3 for antibody 24758
QQSYSTPPT

SEQ ID NO: 49516 - protein, 16 aa, Homo sapiens
  heavy chain complementarity determining region 3 for antibody 24758
VTVLWGAVAAPGWFDP

SEQ ID NO: 49517 - protein, 9 aa, Homo sapiens
  light chain complementarity determining region 3 for antibody 24759
QQSYSTPIT

SEQ ID NO: 49518 - protein, 18 aa, Homo sapiens
  heavy chain complementarity determining region 3 for antibody 24759
ARELHEIVAAAGHDAFDI

SEQ ID NO: 49519 - protein, 9 aa, Homo sapiens
  light chain complementarity determining region 3 for antibody 24760
QQSYSTPFT

SEQ ID NO: 49520 - protein, 10 aa, Homo sapiens
  heavy chain complementarity determining region 3 for antibody 24760
TTMTTAGSDS

SEQ ID NO: 49521 - protein, 9 aa, Homo sapiens
  light chain complementarity determining region 3 for antibody 24761
QQSYSNPPT

SEQ ID NO: 49522 - protein, 19 aa, Homo sapiens
  heavy chain complementarity determining region 3 for antibody 24761
ARVGHYDSSASYWGNWFDP

SEQ ID NO: 49523 - protein, 9 aa, Homo sapiens
  light chain complementarity determining region 3 for antibody 24762
QQSYGIPLT

SEQ ID NO: 49524 - protein, 11 aa, Homo sapiens
  heavy chain complementarity determining region 3 for antibody 24762
VRVRHGDSFDS

SEQ ID NO: 49525 - protein, 10 aa, Homo sapiens
  light chain complementarity determining region 3 for antibody 24763
QQSSTTPRWT

SEQ ID NO: 49526 - protein, 16 aa, Homo sapiens
  heavy chain complementarity determining region 3 for antibody 24763
ARAERYSSNFYSCPDV

SEQ ID NO: 49527 - protein, 10 aa, Homo sapiens
  light chain complementarity determining region 3 for antibody 24764
QQSHSTPMYS

SEQ ID NO: 49528 - protein, 18 aa, Homo sapiens
  heavy chain complementarity determining region 3 for antibody 24764
ARDFVAVPGYNGDEYFQH

SEQ ID NO: 49529 - protein, 9 aa, Homo sapiens
  light chain complementarity determining region 3 for antibody 24765
QQSDSVPQT

SEQ ID NO: 49530 - protein, 18 aa, Homo sapiens
  heavy chain complementarity determining region 3 for antibody 24765
ARHLGHGGYSYSSDAFNI

SEQ ID NO: 49531 - protein, 10 aa, Homo sapiens
  light chain complementarity determining region 3 for antibody 24766
QQRSNWPPYT

SEQ ID NO: 49532 - protein, 21 aa, Homo sapiens
  heavy chain complementarity determining region 3 for antibody 24766
ATMKRNNDFWTGHFGKYYFEY

SEQ ID NO: 49533 - protein, 11 aa, Homo sapiens
  light chain complementarity determining region 3 for antibody 24767
QQRSNWPPAWT

SEQ ID NO: 49534 - protein, 17 aa, Homo sapiens
  heavy chain complementarity determining region 3 for antibody 24767
ARLRWTRSQDYGDAFDI

SEQ ID NO: 49535 - protein, 9 aa, Homo sapiens
  light chain complementarity determining region 3 for antibody 24768
QQRSNWPFT

SEQ ID NO: 49536 - protein, 18 aa, Homo sapiens
  heavy chain complementarity determining region 3 for antibody 24768
ARSLITMVRGVIMHGFDY

SEQ ID NO: 49537 - protein, 11 aa, Homo sapiens
  light chain complementarity determining region 3 for antibody 24769
QQRQPRSNWLT

SEQ ID NO: 49538 - protein, 15 aa, Homo sapiens
  heavy chain complementarity determining region 3 for antibody 24769
ARGGYSSSWYYWFDP

SEQ ID NO: 49539 - protein, 8 aa, Homo sapiens
  light chain complementarity determining region 3 for antibody 24770
QQRNTWPT

SEQ ID NO: 49540 - protein, 13 aa, Homo sapiens
  heavy chain complementarity determining region 3 for antibody 24770
ARVSVHQFLLIDY

SEQ ID NO: 49541 - protein, 9 aa, Homo sapiens
  light chain complementarity determining region 3 for antibody 24771
QQLNSYPLT

SEQ ID NO: 49542 - protein, 11 aa, Homo sapiens
  heavy chain complementarity determining region 3 for antibody 24771
TRISGYWYFDL

SEQ ID NO: 49543 - protein, 9 aa, Homo sapiens
  light chain complementarity determining region 3 for antibody 24772
QQFGSLPFT

SEQ ID NO: 49544 - protein, 11 aa, Homo sapiens
  heavy chain complementarity determining region 3 for antibody 24772
ARAPTNFGVDY

SEQ ID NO: 49545 - protein, 9 aa, Homo sapiens
  light chain complementarity determining region 3 for antibody 24773
QQDGSLPLT

SEQ ID NO: 49546 - protein, 15 aa, Homo sapiens
  heavy chain complementarity determining region 3 for antibody 24773
AHRPNYYDKAGAFDI

SEQ ID NO: 49547 - protein, 9 aa, Homo sapiens
  light chain complementarity determining region 3 for antibody 24774
QQCYSIPRT

SEQ ID NO: 49548 - protein, 12 aa, Homo sapiens
  heavy chain complementarity determining region 3 for antibody 24774
TTLVFAESGFDY

SEQ ID NO: 49549 - protein, 9 aa, Homo sapiens
  light chain complementarity determining region 3 for antibody 24775
QQANSFPPT

SEQ ID NO: 49550 - protein, 9 aa, Homo sapiens
  heavy chain complementarity determining region 3 for antibody 24775
ARGKIYFDF

SEQ ID NO: 49551 - protein, 8 aa, Homo sapiens
  light chain complementarity determining region 3 for antibody 24776
QQANSFPL

SEQ ID NO: 49552 - protein, 14 aa, Homo sapiens
  heavy chain complementarity determining region 3 for antibody 24776
ARGGFIVAWGLFDY

SEQ ID NO: 49553 - protein, 9 aa, Homo sapiens
  light chain complementarity determining region 3 for antibody 24777
QKYNSFPLT

SEQ ID NO: 49554 - protein, 14 aa, Homo sapiens
  heavy chain complementarity determining region 3 for antibody 24777
ARPRYSTSLYPFDY

SEQ ID NO: 49555 - protein, 8 aa, Homo sapiens
  light chain complementarity determining region 3 for antibody 24778
QHYHNSSA

SEQ ID NO: 49556 - protein, 14 aa, Homo sapiens
  heavy chain complementarity determining region 3 for antibody 24778
AKPRNSYWLYYFDY

SEQ ID NO: 49557 - protein, 10 aa, Homo sapiens
  light chain complementarity determining region 3 for antibody 24779
QEYTTYSRRA

SEQ ID NO: 49558 - protein, 16 aa, Homo sapiens
  heavy chain complementarity determining region 3 for antibody 24779
ARGLSAAGRKSGALEI

SEQ ID NO: 49559 - protein, 11 aa, Homo sapiens
  light chain complementarity determining region 3 for antibody 24780
QESYNNPPQYT

SEQ ID NO: 49560 - protein, 15 aa, Homo sapiens
  heavy chain complementarity determining region 3 for antibody 24780
ARGRGITGSTYGIDY

SEQ ID NO: 49561 - protein, 9 aa, Homo sapiens
  light chain complementarity determining region 3 for antibody 24781
MQTLQTPLT

SEQ ID NO: 49562 - protein, 18 aa, Homo sapiens
  heavy chain complementarity determining region 3 for antibody 24781
ARAQGSGWELGSWGAYDF

SEQ ID NO: 49563 - protein, 10 aa, Homo sapiens
  light chain complementarity determining region 3 for antibody 24782
LQQSYFPLRT

SEQ ID NO: 49564 - protein, 14 aa, Homo sapiens
  heavy chain complementarity determining region 3 for antibody 24782
ATITGRDFYNWFDP

SEQ ID NO: 49565 - protein, 9 aa, Homo sapiens
  light chain complementarity determining region 3 for antibody 24783
LQDYDYPYT

SEQ ID NO: 49566 - protein, 7 aa, Homo sapiens
  heavy chain complementarity determining region 3 for antibody 24783
AVGAPDY

SEQ ID NO: 49567 - protein, 9 aa, Homo sapiens
  light chain complementarity determining region 3 for antibody 24784
HQYLSSPQT

SEQ ID NO: 49568 - protein, 18 aa, Homo sapiens
  heavy chain complementarity determining region 3 for antibody 24784
AYRPPLARVGGNPEPFDP

SEQ ID NO: 49569 - protein, 9 aa, Homo sapiens
  light chain complementarity determining region 3 for antibody 24785
HHYDDLPIT

SEQ ID NO: 49570 - protein, 15 aa, Homo sapiens
  heavy chain complementarity determining region 3 for antibody 24785
VRDPTEEHRGYDLDY

SEQ ID NO: 49571 - protein, 10 aa, Homo sapiens
  light chain complementarity determining region 3 for antibody 24786
QRYDTLSGLT

SEQ ID NO: 49572 - protein, 11 aa, Homo sapiens
  heavy chain complementarity determining region 3 for antibody 24786
AADSRNCWFFY

SEQ ID NO: 49573 - protein, 9 aa, Homo sapiens
  light chain complementarity determining region 3 for antibody 24787
QQYYTSVRT

SEQ ID NO: 49574 - protein, 12 aa, Homo sapiens
  heavy chain complementarity determining region 3 for antibody 24787
VKDCGLGGPRDY

SEQ ID NO: 49575 - protein, 9 aa, Homo sapiens
  light chain complementarity determining region 3 for antibody 24788
QQYYTSFRT

SEQ ID NO: 49576 - protein, 12 aa, Homo sapiens
  heavy chain complementarity determining region 3 for antibody 24788
VKDCGLGGSRDS

SEQ ID NO: 49577 - protein, 9 aa, Homo sapiens
  light chain complementarity determining region 3 for antibody 24789
QQYYSTPWT

SEQ ID NO: 49578 - protein, 10 aa, Homo sapiens
  heavy chain complementarity determining region 3 for antibody 24789
STPSRVGAKF

SEQ ID NO: 49579 - protein, 9 aa, Homo sapiens
  light chain complementarity determining region 3 for antibody 24790
QQYYRYPVT

SEQ ID NO: 49580 - protein, 15 aa, Homo sapiens
  heavy chain complementarity determining region 3 for antibody 24790
AHGQHTTTVTSYFNY

SEQ ID NO: 49581 - protein, 9 aa, Homo sapiens
  light chain complementarity determining region 3 for antibody 24791
QQYNTYPLT

SEQ ID NO: 49582 - protein, 11 aa, Homo sapiens
  heavy chain complementarity determining region 3 for antibody 24791
AKDSSVAPFDH

SEQ ID NO: 49583 - protein, 7 aa, Homo sapiens
  light chain complementarity determining region 3 for antibody 24792
QQYNSYT

SEQ ID NO: 49584 - protein, 13 aa, Homo sapiens
  heavy chain complementarity determining region 3 for antibody 24792
THNSDGYLGYFHH

SEQ ID NO: 49585 - protein, 7 aa, Homo sapiens
  light chain complementarity determining region 3 for antibody 24793
QQYNSYS

SEQ ID NO: 49586 - protein, 9 aa, Homo sapiens
  heavy chain complementarity determining region 3 for antibody 24793
ARTYHAFDI

SEQ ID NO: 49587 - protein, 9 aa, Homo sapiens
  light chain complementarity determining region 3 for antibody 24794
QQYNSYLWA

SEQ ID NO: 49588 - protein, 11 aa, Homo sapiens
  heavy chain complementarity determining region 3 for antibody 24794
ATGDRRYAHDN

SEQ ID NO: 49589 - protein, 9 aa, Homo sapiens
  light chain complementarity determining region 3 for antibody 24795
QQYNSWPRT

SEQ ID NO: 49590 - protein, 16 aa, Homo sapiens
  heavy chain complementarity determining region 3 for antibody 24795
AKDHGSGNYYNSALDV

SEQ ID NO: 49591 - protein, 8 aa, Homo sapiens
  light chain complementarity determining region 3 for antibody 24796
QQYNSGWT

SEQ ID NO: 49592 - protein, 17 aa, Homo sapiens
  heavy chain complementarity determining region 3 for antibody 24796
ARLGGSGWNRGHNWFDP

SEQ ID NO: 49593 - protein, 7 aa, Homo sapiens
  light chain complementarity determining region 3 for antibody 24797
QQYKTFS

SEQ ID NO: 49594 - protein, 19 aa, Homo sapiens
  heavy chain complementarity determining region 3 for antibody 24797
ATRTPRYYDTAGHEGAFDI

SEQ ID NO: 49595 - protein, 11 aa, Homo sapiens
  light chain complementarity determining region 3 for antibody 24798
QQYITSPPGYT

SEQ ID NO: 49596 - protein, 11 aa, Homo sapiens
  heavy chain complementarity determining region 3 for antibody 24798
ARHGNDFYFDY

SEQ ID NO: 49597 - protein, 9 aa, Homo sapiens
  light chain complementarity determining region 3 for antibody 24799
QQYHYTPFT

SEQ ID NO: 49598 - protein, 14 aa, Homo sapiens
  heavy chain complementarity determining region 3 for antibody 24799
ARHEEMGTTAAFDV

SEQ ID NO: 49599 - protein, 9 aa, Homo sapiens
  light chain complementarity determining region 3 for antibody 24800
QQYHDYSWT

SEQ ID NO: 49600 - protein, 19 aa, Homo sapiens
  heavy chain complementarity determining region 3 for antibody 24800
ARDDGSRADSYGIAYFFDS

SEQ ID NO: 49601 - protein, 9 aa, Homo sapiens
  light chain complementarity determining region 3 for antibody 24801
QQYGSTWGT

SEQ ID NO: 49602 - protein, 15 aa, Homo sapiens
  heavy chain complementarity determining region 3 for antibody 24801
ARHMARDSIGYYHDF

SEQ ID NO: 49603 - protein, 9 aa, Homo sapiens
  light chain complementarity determining region 3 for antibody 24802
QQYGSSWYT

SEQ ID NO: 49604 - protein, 12 aa, Homo sapiens
  heavy chain complementarity determining region 3 for antibody 24802
ARESEDDDAFDI

SEQ ID NO: 49605 - protein, 9 aa, Homo sapiens
  light chain complementarity determining region 3 for antibody 24803
QQYGSSRYT

SEQ ID NO: 49606 - protein, 17 aa, Homo sapiens
  heavy chain complementarity determining region 3 for antibody 24803
ARDLLLYSSSWSGAFGY

SEQ ID NO: 49607 - protein, 9 aa, Homo sapiens
  light chain complementarity determining region 3 for antibody 24804
QQYGSSPWT

SEQ ID NO: 49608 - protein, 8 aa, Homo sapiens
  heavy chain complementarity determining region 3 for antibody 24804
ARDWGVPQ

SEQ ID NO: 49609 - protein, 9 aa, Homo sapiens
  light chain complementarity determining region 3 for antibody 24805
QQYGSSPQT

SEQ ID NO: 49610 - protein, 32 aa, Homo sapiens
  heavy chain complementarity determining region 3 for antibody 24805
ARGIAGRVSGFSYGVGVGDRIRHPQKGDYFDS

SEQ ID NO: 49611 - protein, 9 aa, Homo sapiens
  light chain complementarity determining region 3 for antibody 24806
QQYGSRPRT

SEQ ID NO: 49612 - protein, 9 aa, Homo sapiens
  heavy chain complementarity determining region 3 for antibody 24806
AREWSALDF

SEQ ID NO: 49613 - protein, 9 aa, Homo sapiens
  light chain complementarity determining region 3 for antibody 24807
QQYGHLPRT

SEQ ID NO: 49614 - protein, 13 aa, Homo sapiens
  heavy chain complementarity determining region 3 for antibody 24807
AGGDFHRGGYSEY

SEQ ID NO: 49615 - protein, 9 aa, Homo sapiens
  light chain complementarity determining region 3 for antibody 24808
QQYDSHSYA

SEQ ID NO: 49616 - protein, 11 aa, Homo sapiens
  heavy chain complementarity determining region 3 for antibody 24808
ARGEDTWYSDS

SEQ ID NO: 49617 - protein, 9 aa, Homo sapiens
  light chain complementarity determining region 3 for antibody 24809
QQYDNSRAT

SEQ ID NO: 49618 - protein, 11 aa, Homo sapiens
  heavy chain complementarity determining region 3 for antibody 24809
ARHYIHGWNDY

SEQ ID NO: 49619 - protein, 9 aa, Homo sapiens
  light chain complementarity determining region 3 for antibody 24810
QQYDNLSLT

SEQ ID NO: 49620 - protein, 18 aa, Homo sapiens
  heavy chain complementarity determining region 3 for antibody 24810
ARHAPDLEYATSSNGMDV

SEQ ID NO: 49621 - protein, 9 aa, Homo sapiens
  light chain complementarity determining region 3 for antibody 24811
QQYDNLPYT

SEQ ID NO: 49622 - protein, 13 aa, Homo sapiens
  heavy chain complementarity determining region 3 for antibody 24811
ARPYFSGSYPRDY

SEQ ID NO: 49623 - protein, 9 aa, Homo sapiens
  light chain complementarity determining region 3 for antibody 24812
QQYDNLPIT

SEQ ID NO: 49624 - protein, 12 aa, Homo sapiens
  heavy chain complementarity determining region 3 for antibody 24812
AKDSEQKWELHD

SEQ ID NO: 49625 - protein, 9 aa, Homo sapiens
  light chain complementarity determining region 3 for antibody 24813
QQSYSVPLT

SEQ ID NO: 49626 - protein, 21 aa, Homo sapiens
  heavy chain complementarity determining region 3 for antibody 24813
ARQRPVSMVRGPPLRNGYFDL

SEQ ID NO: 49627 - protein, 9 aa, Homo sapiens
  light chain complementarity determining region 3 for antibody 24814
QQSYSTSWT

SEQ ID NO: 49628 - protein, 13 aa, Homo sapiens
  heavy chain complementarity determining region 3 for antibody 24814
ARVLSRFAAGLDY

SEQ ID NO: 49629 - protein, 9 aa, Homo sapiens
  light chain complementarity determining region 3 for antibody 24815
QQSYSTPYT

SEQ ID NO: 49630 - protein, 18 aa, Homo sapiens
  heavy chain complementarity determining region 3 for antibody 24815
ARFTTGGSTGLILYFFDY

SEQ ID NO: 49631 - protein, 9 aa, Homo sapiens
  light chain complementarity determining region 3 for antibody 24816
QQSYSTPRT

SEQ ID NO: 49632 - protein, 15 aa, Homo sapiens
  heavy chain complementarity determining region 3 for antibody 24816
VRHYRELTTGIEGDS

SEQ ID NO: 49633 - protein, 9 aa, Homo sapiens
  light chain complementarity determining region 3 for antibody 24817
QQSYSTPPT

SEQ ID NO: 49634 - protein, 18 aa, Homo sapiens
  heavy chain complementarity determining region 3 for antibody 24817
VQLSGYCIDHGYCPPFAD

SEQ ID NO: 49635 - protein, 9 aa, Homo sapiens
  light chain complementarity determining region 3 for antibody 24818
QQSYSTPLT

SEQ ID NO: 49636 - protein, 17 aa, Homo sapiens
  heavy chain complementarity determining region 3 for antibody 24818
AKDLSGVIGGSYGSFDF

SEQ ID NO: 49637 - protein, 10 aa, Homo sapiens
  light chain complementarity determining region 3 for antibody 24819
QQSYSTLALT

SEQ ID NO: 49638 - protein, 16 aa, Homo sapiens
  heavy chain complementarity determining region 3 for antibody 24819
ARRKTVFGGAHHWFDP

SEQ ID NO: 49639 - protein, 9 aa, Homo sapiens
  light chain complementarity determining region 3 for antibody 24820
QQSYSIPLT

SEQ ID NO: 49640 - protein, 10 aa, Homo sapiens
  heavy chain complementarity determining region 3 for antibody 24820
ARTYKDGFDT

SEQ ID NO: 49641 - protein, 9 aa, Homo sapiens
  light chain complementarity determining region 3 for antibody 24821
QQSYNSPWT

SEQ ID NO: 49642 - protein, 14 aa, Homo sapiens
  heavy chain complementarity determining region 3 for antibody 24821
ARFGGAYSYGYFDF

SEQ ID NO: 49643 - protein, 9 aa, Homo sapiens
  light chain complementarity determining region 3 for antibody 24822
QQSLFAPYT

SEQ ID NO: 49644 - protein, 21 aa, Homo sapiens
  heavy chain complementarity determining region 3 for antibody 24822
AKGGEANSAGVYSESDDAFEN

SEQ ID NO: 49645 - protein, 9 aa, Homo sapiens
  light chain complementarity determining region 3 for antibody 24823
QQSHSTPFT

SEQ ID NO: 49646 - protein, 14 aa, Homo sapiens
  heavy chain complementarity determining region 3 for antibody 24823
ARSYDTSGFSALDY

SEQ ID NO: 49647 - protein, 9 aa, Homo sapiens
  light chain complementarity determining region 3 for antibody 24824
QQSFSTPQT

SEQ ID NO: 49648 - protein, 18 aa, Homo sapiens
  heavy chain complementarity determining region 3 for antibody 24824
ARGRQAMCDLGRCDYFDY

SEQ ID NO: 49649 - protein, 8 aa, Homo sapiens
  light chain complementarity determining region 3 for antibody 24825
QQRSTLYT

SEQ ID NO: 49650 - protein, 17 aa, Homo sapiens
  heavy chain complementarity determining region 3 for antibody 24825
ARRYWNPSSGWFQDFDY

SEQ ID NO: 49651 - protein, 10 aa, Homo sapiens
  light chain complementarity determining region 3 for antibody 24826
QQRSNWPPYT

SEQ ID NO: 49652 - protein, 16 aa, Homo sapiens
  heavy chain complementarity determining region 3 for antibody 24826
ARDRRDSWPGGHYFDS

SEQ ID NO: 49653 - protein, 10 aa, Homo sapiens
  light chain complementarity determining region 3 for antibody 24827
QQRSNWPPFT

SEQ ID NO: 49654 - protein, 14 aa, Homo sapiens
  heavy chain complementarity determining region 3 for antibody 24827
AKYSGAYYNLNFDY

SEQ ID NO: 49655 - protein, 11 aa, Homo sapiens
  light chain complementarity determining region 3 for antibody 24828
QQLNSYPGALT

SEQ ID NO: 49656 - protein, 18 aa, Homo sapiens
  heavy chain complementarity determining region 3 for antibody 24828
ARDLTPIIATTGTGTFDI

SEQ ID NO: 49657 - protein, 9 aa, Homo sapiens
  light chain complementarity determining region 3 for antibody 24829
QQHYSTQWT

SEQ ID NO: 49658 - protein, 15 aa, Homo sapiens
  heavy chain complementarity determining region 3 for antibody 24829
AKDLQSLEYYGVFDY

SEQ ID NO: 49659 - protein, 9 aa, Homo sapiens
  light chain complementarity determining region 3 for antibody 24830
QQHGSSPWT

SEQ ID NO: 49660 - protein, 14 aa, Homo sapiens
  heavy chain complementarity determining region 3 for antibody 24830
ATKKHLVHYYALDA

SEQ ID NO: 49661 - protein, 7 aa, Homo sapiens
  light chain complementarity determining region 3 for antibody 24831
QQFDDLL

SEQ ID NO: 49662 - protein, 11 aa, Homo sapiens
  heavy chain complementarity determining region 3 for antibody 24831
ASLLPTTSGDC

SEQ ID NO: 49663 - protein, 9 aa, Homo sapiens
  light chain complementarity determining region 3 for antibody 24832
QQANSFPRT

SEQ ID NO: 49664 - protein, 12 aa, Homo sapiens
  heavy chain complementarity determining region 3 for antibody 24832
ARQGGGGRAFDI

SEQ ID NO: 49665 - protein, 9 aa, Homo sapiens
  light chain complementarity determining region 3 for antibody 24833
QKYNSAPWT

SEQ ID NO: 49666 - protein, 15 aa, Homo sapiens
  heavy chain complementarity determining region 3 for antibody 24833
AREGLYSNGWYYIDY

SEQ ID NO: 49667 - protein, 9 aa, Homo sapiens
  light chain complementarity determining region 3 for antibody 24834
QKTYSGPRT

SEQ ID NO: 49668 - protein, 18 aa, Homo sapiens
  heavy chain complementarity determining region 3 for antibody 24834
AREGGGFCSGDSCYFDVH

SEQ ID NO: 49669 - protein, 9 aa, Homo sapiens
  light chain complementarity determining region 3 for antibody 24835
QHYSSSHNT

SEQ ID NO: 49670 - protein, 13 aa, Homo sapiens
  heavy chain complementarity determining region 3 for antibody 24835
AKNYGPGTPYFDY

SEQ ID NO: 49671 - protein, 9 aa, Homo sapiens
  light chain complementarity determining region 3 for antibody 24836
QHYQGYPIT

SEQ ID NO: 49672 - protein, 21 aa, Homo sapiens
  heavy chain complementarity determining region 3 for antibody 24836
VRGPGGEAPAGSETYYYPMDL

SEQ ID NO: 49673 - protein, 9 aa, Homo sapiens
  light chain complementarity determining region 3 for antibody 24837
QHYNNYRWT

SEQ ID NO: 49674 - protein, 12 aa, Homo sapiens
  heavy chain complementarity determining region 3 for antibody 24837
AKWGKTRVSSYN

SEQ ID NO: 49675 - protein, 9 aa, Homo sapiens
  light chain complementarity determining region 3 for antibody 24838
QHYKSYPYA

SEQ ID NO: 49676 - protein, 13 aa, Homo sapiens
  heavy chain complementarity determining region 3 for antibody 24838
ARDLRVGRNGLDV

SEQ ID NO: 49677 - protein, 9 aa, Homo sapiens
  light chain complementarity determining region 3 for antibody 24839
QHYGSSPFP

SEQ ID NO: 49678 - protein, 18 aa, Homo sapiens
  heavy chain complementarity determining region 3 for antibody 24839
ARRANYCTNGFCFRVFDY

SEQ ID NO: 49679 - protein, 9 aa, Homo sapiens
  light chain complementarity determining region 3 for antibody 24840
QHTYTFPRT

SEQ ID NO: 49680 - protein, 20 aa, Homo sapiens
  heavy chain complementarity determining region 3 for antibody 24840
ARGRRIAALSTAHYYYGMDV

SEQ ID NO: 49681 - protein, 7 aa, Homo sapiens
  light chain complementarity determining region 3 for antibody 24841
QHLETYA

SEQ ID NO: 49682 - protein, 17 aa, Homo sapiens
  heavy chain complementarity determining region 3 for antibody 24841
AKDMGPLFGSGLDAFDV

SEQ ID NO: 49683 - protein, 9 aa, Homo sapiens
  light chain complementarity determining region 3 for antibody 24842
QESHSGSPT

SEQ ID NO: 49684 - protein, 18 aa, Homo sapiens
  heavy chain complementarity determining region 3 for antibody 24842
TQLSGYCRDAGICPPFAY

SEQ ID NO: 49685 - protein, 9 aa, Homo sapiens
  light chain complementarity determining region 3 for antibody 24843
MQPLQTPVT

SEQ ID NO: 49686 - protein, 18 aa, Homo sapiens
  heavy chain complementarity determining region 3 for antibody 24843
ARSHISLIVGVASDGFDL

SEQ ID NO: 49687 - protein, 9 aa, Homo sapiens
  light chain complementarity determining region 3 for antibody 24844
MQGTHWPLT

SEQ ID NO: 49688 - protein, 11 aa, Homo sapiens
  heavy chain complementarity determining region 3 for antibody 24844
ATDLLAVTQHY

SEQ ID NO: 49689 - protein, 9 aa, Homo sapiens
  light chain complementarity determining region 3 for antibody 24845
MQGPQWPWT

SEQ ID NO: 49690 - protein, 7 aa, Homo sapiens
  heavy chain complementarity determining region 3 for antibody 24845
STDFLDL

SEQ ID NO: 49691 - protein, 9 aa, Homo sapiens
  light chain complementarity determining region 3 for antibody 24846
MQALQTPIT

SEQ ID NO: 49692 - protein, 10 aa, Homo sapiens
  heavy chain complementarity determining region 3 for antibody 24846
ATGSSSWIDY

SEQ ID NO: 49693 - protein, 9 aa, Homo sapiens
  light chain complementarity determining region 3 for antibody 24847
MQALQSPLT

SEQ ID NO: 49694 - protein, 15 aa, Homo sapiens
  heavy chain complementarity determining region 3 for antibody 24847
ARHGLGSYWKWDIEL

SEQ ID NO: 49695 - protein, 9 aa, Homo sapiens
  light chain complementarity determining region 3 for antibody 24848
LQYNTYPFT

SEQ ID NO: 49696 - protein, 7 aa, Homo sapiens
  heavy chain complementarity determining region 3 for antibody 24848
TVFGLDY

SEQ ID NO: 49697 - protein, 9 aa, Homo sapiens
  light chain complementarity determining region 3 for antibody 24849
LQHYNYPWA

SEQ ID NO: 49698 - protein, 17 aa, Homo sapiens
  heavy chain complementarity determining region 3 for antibody 24849
TRAHYWQSSGYYEDFDF

SEQ ID NO: 49699 - protein, 9 aa, Homo sapiens
  light chain complementarity determining region 3 for antibody 24850
LQHNTYPWT

SEQ ID NO: 49700 - protein, 11 aa, Homo sapiens
  heavy chain complementarity determining region 3 for antibody 24850
ARGPARGYFDY

SEQ ID NO: 49701 - protein, 9 aa, Homo sapiens
  light chain complementarity determining region 3 for antibody 24851
LQHNSYPRT

SEQ ID NO: 49702 - protein, 15 aa, Homo sapiens
  heavy chain complementarity determining region 3 for antibody 24851
ARDSLVGATSLAFDI

SEQ ID NO: 49703 - protein, 9 aa, Homo sapiens
  light chain complementarity determining region 3 for antibody 24852
LHHLRFPLS

SEQ ID NO: 49704 - protein, 16 aa, Homo sapiens
  heavy chain complementarity determining region 3 for antibody 24852
ARYWDGRTPVRVILDH

SEQ ID NO: 49705 - protein, 9 aa, Homo sapiens
  light chain complementarity determining region 3 for antibody 24853
HQYNTYPWT

SEQ ID NO: 49706 - protein, 14 aa, Homo sapiens
  heavy chain complementarity determining region 3 for antibody 24853
ALNVPGYSHGRELP

SEQ ID NO: 49707 - protein, 9 aa, Homo sapiens
  light chain complementarity determining region 3 for antibody 24854
HQTIAVPHT

SEQ ID NO: 49708 - protein, 15 aa, Homo sapiens
  heavy chain complementarity determining region 3 for antibody 24854
GRDGYFYGPHWYIDL

SEQ ID NO: 49709 - protein, 10 aa, Homo sapiens
  light chain complementarity determining region 3 for antibody 24855
HHYGKSPPWM

SEQ ID NO: 49710 - protein, 15 aa, Homo sapiens
  heavy chain complementarity determining region 3 for antibody 24855
ARHRAPDTRKSALGY

SEQ ID NO: 49711 - protein, 8 aa, Homo sapiens
  light chain complementarity determining region 3 for antibody 24856
QSYNIVFT

SEQ ID NO: 49712 - protein, 15 aa, Homo sapiens
  heavy chain complementarity determining region 3 for antibody 24856
ARGLGGILRGYYFDS

SEQ ID NO: 49713 - protein, 9 aa, Homo sapiens
  light chain complementarity determining region 3 for antibody 24857
QQYYSTPLT

SEQ ID NO: 49714 - protein, 20 aa, Homo sapiens
  heavy chain complementarity determining region 3 for antibody 24857
ARDQAYYYGSGSSGVDWFDP

SEQ ID NO: 49715 - protein, 8 aa, Homo sapiens
  light chain complementarity determining region 3 for antibody 24858
QQYYNVPT

SEQ ID NO: 49716 - protein, 15 aa, Homo sapiens
  heavy chain complementarity determining region 3 for antibody 24858
AKTRPFRGAALPSDY

SEQ ID NO: 49717 - protein, 9 aa, Homo sapiens
  light chain complementarity determining region 3 for antibody 24859
QQYSSYPKT

SEQ ID NO: 49718 - protein, 10 aa, Homo sapiens
  heavy chain complementarity determining region 3 for antibody 24859
ATSQLWFEAH

SEQ ID NO: 49719 - protein, 9 aa, Homo sapiens
  light chain complementarity determining region 3 for antibody 24860
QQYSSYPFT

SEQ ID NO: 49720 - protein, 12 aa, Homo sapiens
  heavy chain complementarity determining region 3 for antibody 24860
ARVQTGDQGFDY

SEQ ID NO: 49721 - protein, 9 aa, Homo sapiens
  light chain complementarity determining region 3 for antibody 24861
QQYNSYSWT

SEQ ID NO: 49722 - protein, 12 aa, Homo sapiens
  heavy chain complementarity determining region 3 for antibody 24861
ARGWGSLGAFDI

SEQ ID NO: 49723 - protein, 9 aa, Homo sapiens
  light chain complementarity determining region 3 for antibody 24862
QQYNSYSRT

SEQ ID NO: 49724 - protein, 11 aa, Homo sapiens
  heavy chain complementarity determining region 3 for antibody 24862
SRCWDQTYFDY

SEQ ID NO: 49725 - protein, 9 aa, Homo sapiens
  light chain complementarity determining region 3 for antibody 24863
QQYNSYSGT

SEQ ID NO: 49726 - protein, 16 aa, Homo sapiens
  heavy chain complementarity determining region 3 for antibody 24863
ARMPCDSRGYYCYPDY

SEQ ID NO: 49727 - protein, 8 aa, Homo sapiens
  light chain complementarity determining region 3 for antibody 24864
QQYNSYRT

SEQ ID NO: 49728 - protein, 13 aa, Homo sapiens
  heavy chain complementarity determining region 3 for antibody 24864
GRDKGGSYYGMDV

SEQ ID NO: 49729 - protein, 9 aa, Homo sapiens
  light chain complementarity determining region 3 for antibody 24865
QQYNSYPYT

SEQ ID NO: 49730 - protein, 17 aa, Homo sapiens
  heavy chain complementarity determining region 3 for antibody 24865
ARDPGVQWLLTNDVFDI

SEQ ID NO: 49731 - protein, 9 aa, Homo sapiens
  light chain complementarity determining region 3 for antibody 24866
QQYNSYPYT

SEQ ID NO: 49732 - protein, 6 aa, Homo sapiens
  heavy chain complementarity determining region 3 for antibody 24866
AKSLDY

SEQ ID NO: 49733 - protein, 9 aa, Homo sapiens
  light chain complementarity determining region 3 for antibody 24867
QQYNSYPLT

SEQ ID NO: 49734 - protein, 16 aa, Homo sapiens
  heavy chain complementarity determining region 3 for antibody 24867
ARPLADFWSGYYTTDY

SEQ ID NO: 49735 - protein, 9 aa, Homo sapiens
  light chain complementarity determining region 3 for antibody 24868
QQYNSYPLT

SEQ ID NO: 49736 - protein, 20 aa, Homo sapiens
  heavy chain complementarity determining region 3 for antibody 24868
AKERSHYDSNKFHPPFFFDY

SEQ ID NO: 49737 - protein, 9 aa, Homo sapiens
  light chain complementarity determining region 3 for antibody 24869
QQYNSYAYT

SEQ ID NO: 49738 - protein, 13 aa, Homo sapiens
  heavy chain complementarity determining region 3 for antibody 24869
ARGYDYVQDAFDI

SEQ ID NO: 49739 - protein, 10 aa, Homo sapiens
  light chain complementarity determining region 3 for antibody 24870
QQYNSFAAWK

SEQ ID NO: 49740 - protein, 18 aa, Homo sapiens
  heavy chain complementarity determining region 3 for antibody 24870
ARDRSAMPLRDPYDGFDI

SEQ ID NO: 49741 - protein, 9 aa, Homo sapiens
  light chain complementarity determining region 3 for antibody 24871
QQYNSDSGT

SEQ ID NO: 49742 - protein, 17 aa, Homo sapiens
  heavy chain complementarity determining region 3 for antibody 24871
ARTPFPRTNLNGRHLQL

SEQ ID NO: 49743 - protein, 10 aa, Homo sapiens
  light chain complementarity determining region 3 for antibody 24872
QQYNNWPPIT

SEQ ID NO: 49744 - protein, 16 aa, Homo sapiens
  heavy chain complementarity determining region 3 for antibody 24872
ARAGSSGWNKAGGYDI

SEQ ID NO: 49745 - protein, 9 aa, Homo sapiens
  light chain complementarity determining region 3 for antibody 24873
QQYNNWPLT

SEQ ID NO: 49746 - protein, 15 aa, Homo sapiens
  heavy chain complementarity determining region 3 for antibody 24873
ARKPEATPGNDCFGP

SEQ ID NO: 49747 - protein, 9 aa, Homo sapiens
  light chain complementarity determining region 3 for antibody 24874
QQYLTTPLT

SEQ ID NO: 49748 - protein, 13 aa, Homo sapiens
  heavy chain complementarity determining region 3 for antibody 24874
VKDPDFNYGSWVS

SEQ ID NO: 49749 - protein, 9 aa, Homo sapiens
  light chain complementarity determining region 3 for antibody 24875
QQYLSHELT

SEQ ID NO: 49750 - protein, 13 aa, Homo sapiens
  heavy chain complementarity determining region 3 for antibody 24875
VRLPTGFPNWFDP

SEQ ID NO: 49751 - protein, 9 aa, Homo sapiens
  light chain complementarity determining region 3 for antibody 24876
QQYGTSPLT

SEQ ID NO: 49752 - protein, 13 aa, Homo sapiens
  heavy chain complementarity determining region 3 for antibody 24876
ARVQWLGDDVFDL

SEQ ID NO: 49753 - protein, 9 aa, Homo sapiens
  light chain complementarity determining region 3 for antibody 24877
QQYGSTWWP

SEQ ID NO: 49754 - protein, 15 aa, Homo sapiens
  heavy chain complementarity determining region 3 for antibody 24877
ARHMARDSIGYYHDF

SEQ ID NO: 49755 - protein, 9 aa, Homo sapiens
  light chain complementarity determining region 3 for antibody 24878
QQYGSSPRT

SEQ ID NO: 49756 - protein, 14 aa, Homo sapiens
  heavy chain complementarity determining region 3 for antibody 24878
AGGDFCGGDCYSEY

SEQ ID NO: 49757 - protein, 9 aa, Homo sapiens
  light chain complementarity determining region 3 for antibody 24879
QQYGSSPRP

SEQ ID NO: 49758 - protein, 25 aa, Homo sapiens
  heavy chain complementarity determining region 3 for antibody 24879
ARLRIDRLRLPGAMRGPLYDCGLNV

SEQ ID NO: 49759 - protein, 11 aa, Homo sapiens
  light chain complementarity determining region 3 for antibody 24880
QQYGSSPPRYT

SEQ ID NO: 49760 - protein, 12 aa, Homo sapiens
  heavy chain complementarity determining region 3 for antibody 24880
ATTGSYYRSFDY

SEQ ID NO: 49761 - protein, 8 aa, Homo sapiens
  light chain complementarity determining region 3 for antibody 24881
QQYGCSLT

SEQ ID NO: 49762 - protein, 20 aa, Homo sapiens
  heavy chain complementarity determining region 3 for antibody 24881
ARRSGYCGGDTCNSDDAFDT

SEQ ID NO: 49763 - protein, 10 aa, Homo sapiens
  light chain complementarity determining region 3 for antibody 24882
QQYDSSPPLT

SEQ ID NO: 49764 - protein, 16 aa, Homo sapiens
  heavy chain complementarity determining region 3 for antibody 24882
ATDISYGSEMGYYFEN

SEQ ID NO: 49765 - protein, 11 aa, Homo sapiens
  light chain complementarity determining region 3 for antibody 24883
QQYDNWPPGRA

SEQ ID NO: 49766 - protein, 16 aa, Homo sapiens
  heavy chain complementarity determining region 3 for antibody 24883
AKGNTVTGYSSGWYMF

SEQ ID NO: 49767 - protein, 10 aa, Homo sapiens
  light chain complementarity determining region 3 for antibody 24884
QQYDNLPPIT

SEQ ID NO: 49768 - protein, 17 aa, Homo sapiens
  heavy chain complementarity determining region 3 for antibody 24884
VRPSDYTSGWYGVAFDT

SEQ ID NO: 49769 - protein, 10 aa, Homo sapiens
  light chain complementarity determining region 3 for antibody 24885
QQSYYTLSYT

SEQ ID NO: 49770 - protein, 14 aa, Homo sapiens
  heavy chain complementarity determining region 3 for antibody 24885
AREDTASIYSFFDP

SEQ ID NO: 49771 - protein, 9 aa, Homo sapiens
  light chain complementarity determining region 3 for antibody 24886
QQSYSTPYT

SEQ ID NO: 49772 - protein, 14 aa, Homo sapiens
  heavy chain complementarity determining region 3 for antibody 24886
GRYDTSSSSHAMDV

SEQ ID NO: 49773 - protein, 9 aa, Homo sapiens
  light chain complementarity determining region 3 for antibody 24887
QQSYSTPWA

SEQ ID NO: 49774 - protein, 17 aa, Homo sapiens
  heavy chain complementarity determining region 3 for antibody 24887
GRDPYKTRGYKEDYFDY

SEQ ID NO: 49775 - protein, 9 aa, Homo sapiens
  light chain complementarity determining region 3 for antibody 24888
QQSYSLMYT

SEQ ID NO: 49776 - protein, 16 aa, Homo sapiens
  heavy chain complementarity determining region 3 for antibody 24888
ARDPGNGDRSPYCFDY

SEQ ID NO: 49777 - protein, 9 aa, Homo sapiens
  light chain complementarity determining region 3 for antibody 24889
QQSYAAPYT

SEQ ID NO: 49778 - protein, 24 aa, Homo sapiens
  heavy chain complementarity determining region 3 for antibody 24889
AKERPDYGEHGPGGEYDQYYGMDI

SEQ ID NO: 49779 - protein, 9 aa, Homo sapiens
  light chain complementarity determining region 3 for antibody 24890
QQSFSNPVT

SEQ ID NO: 49780 - protein, 18 aa, Homo sapiens
  heavy chain complementarity determining region 3 for antibody 24890
AREEDHYTSGTYYNIFDL

SEQ ID NO: 49781 - protein, 9 aa, Homo sapiens
  light chain complementarity determining region 3 for antibody 24891
QQSFDSPLT

SEQ ID NO: 49782 - protein, 14 aa, Homo sapiens
  heavy chain complementarity determining region 3 for antibody 24891
AKVYDGNGNLGIDY

SEQ ID NO: 49783 - protein, 11 aa, Homo sapiens
  light chain complementarity determining region 3 for antibody 24892
QQRTNWPLSIT

SEQ ID NO: 49784 - protein, 17 aa, Homo sapiens
  heavy chain complementarity determining region 3 for antibody 24892
ARVKGYGGNSYPDAFHI

SEQ ID NO: 49785 - protein, 9 aa, Homo sapiens
  light chain complementarity determining region 3 for antibody 24893
QQRSNWPPT

SEQ ID NO: 49786 - protein, 15 aa, Homo sapiens
  heavy chain complementarity determining region 3 for antibody 24893
ARVGLSIDYGSGFDP

SEQ ID NO: 49787 - protein, 9 aa, Homo sapiens
  light chain complementarity determining region 3 for antibody 24894
QQGYSTPLI

SEQ ID NO: 49788 - protein, 15 aa, Homo sapiens
  heavy chain complementarity determining region 3 for antibody 24894
VRAQVIWGQLYYFDY

SEQ ID NO: 49789 - protein, 9 aa, Homo sapiens
  light chain complementarity determining region 3 for antibody 24895
QQGNSFPFT

SEQ ID NO: 49790 - protein, 14 aa, Homo sapiens
  heavy chain complementarity determining region 3 for antibody 24895
ARVRYASGTYYTES

SEQ ID NO: 49791 - protein, 9 aa, Homo sapiens
  light chain complementarity determining region 3 for antibody 24896
QQGFSTPLT

SEQ ID NO: 49792 - protein, 21 aa, Homo sapiens
  heavy chain complementarity determining region 3 for antibody 24896
TREEGDIVAVASATYPHGMDV

SEQ ID NO: 49793 - protein, 10 aa, Homo sapiens
  light chain complementarity determining region 3 for antibody 24897
QLYSSSPSIT

SEQ ID NO: 49794 - protein, 18 aa, Homo sapiens
  heavy chain complementarity determining region 3 for antibody 24897
ARARNPYSPNWYAYYFDL

SEQ ID NO: 49795 - protein, 9 aa, Homo sapiens
  light chain complementarity determining region 3 for antibody 24898
QLYGSSAWT

SEQ ID NO: 49796 - protein, 16 aa, Homo sapiens
  heavy chain complementarity determining region 3 for antibody 24898
ASGYCSSTSCHWGLDY

SEQ ID NO: 49797 - protein, 9 aa, Homo sapiens
  light chain complementarity determining region 3 for antibody 24899
QKFDSLPLT

SEQ ID NO: 49798 - protein, 15 aa, Homo sapiens
  heavy chain complementarity determining region 3 for antibody 24899
ATYGHLNSWFQAFDT

SEQ ID NO: 49799 - protein, 10 aa, Homo sapiens
  light chain complementarity determining region 3 for antibody 24900
QHYNGWPPVT

SEQ ID NO: 49800 - protein, 14 aa, Homo sapiens
  heavy chain complementarity determining region 3 for antibody 24900
ARERTMTASGYYDF

SEQ ID NO: 49801 - protein, 10 aa, Homo sapiens
  light chain complementarity determining region 3 for antibody 24901
QHYETSPGLT

SEQ ID NO: 49802 - protein, 11 aa, Homo sapiens
  heavy chain complementarity determining region 3 for antibody 24901
ASDSNNCWFFD

SEQ ID NO: 49803 - protein, 11 aa, Homo sapiens
  light chain complementarity determining region 3 for antibody 24902
QHSGSSPPRVT

SEQ ID NO: 49804 - protein, 13 aa, Homo sapiens
  heavy chain complementarity determining region 3 for antibody 24902
VRGFGVVSPDFDY

SEQ ID NO: 49805 - protein, 9 aa, Homo sapiens
  light chain complementarity determining region 3 for antibody 24903
QHFNNYPLS

SEQ ID NO: 49806 - protein, 14 aa, Homo sapiens
  heavy chain complementarity determining region 3 for antibody 24903
TRARPVRGSSFFDY

SEQ ID NO: 49807 - protein, 9 aa, Homo sapiens
  light chain complementarity determining region 3 for antibody 24904
MQTLQTPWA

SEQ ID NO: 49808 - protein, 13 aa, Homo sapiens
  heavy chain complementarity determining region 3 for antibody 24904
AKVVSYGSGGLQY

SEQ ID NO: 49809 - protein, 9 aa, Homo sapiens
  light chain complementarity determining region 3 for antibody 24905
MQGTHWPPT

SEQ ID NO: 49810 - protein, 15 aa, Homo sapiens
  heavy chain complementarity determining region 3 for antibody 24905
AKSSGPNIAVAGFDC

SEQ ID NO: 49811 - protein, 10 aa, Homo sapiens
  light chain complementarity determining region 3 for antibody 24906
MQGTHWPPGT

SEQ ID NO: 49812 - protein, 17 aa, Homo sapiens
  heavy chain complementarity determining region 3 for antibody 24906
VRDGYTASGRRNAPGAN

SEQ ID NO: 49813 - protein, 9 aa, Homo sapiens
  light chain complementarity determining region 3 for antibody 24907
MQGLQNPLT

SEQ ID NO: 49814 - protein, 12 aa, Homo sapiens
  heavy chain complementarity determining region 3 for antibody 24907
VRNDYGDYGFQY

SEQ ID NO: 49815 - protein, 9 aa, Homo sapiens
  light chain complementarity determining region 3 for antibody 24908
MQAQQTPFT

SEQ ID NO: 49816 - protein, 9 aa, Homo sapiens
  heavy chain complementarity determining region 3 for antibody 24908
AKDLGYYDD

SEQ ID NO: 49817 - protein, 9 aa, Homo sapiens
  light chain complementarity determining region 3 for antibody 24909
MQALQVPYT

SEQ ID NO: 49818 - protein, 12 aa, Homo sapiens
  heavy chain complementarity determining region 3 for antibody 24909
ARARGVAGKLDS

SEQ ID NO: 49819 - protein, 9 aa, Homo sapiens
  light chain complementarity determining region 3 for antibody 24910
MQALQTPWT

SEQ ID NO: 49820 - protein, 17 aa, Homo sapiens
  heavy chain complementarity determining region 3 for antibody 24910
SRRRKNGSPGRNNWFDP

SEQ ID NO: 49821 - protein, 9 aa, Homo sapiens
  light chain complementarity determining region 3 for antibody 24911
MQALQTPPT

SEQ ID NO: 49822 - protein, 13 aa, Homo sapiens
  heavy chain complementarity determining region 3 for antibody 24911
ARGEDYSYQTSYY

SEQ ID NO: 49823 - protein, 9 aa, Homo sapiens
  light chain complementarity determining region 3 for antibody 24912
MQALQIPWT

SEQ ID NO: 49824 - protein, 10 aa, Homo sapiens
  heavy chain complementarity determining region 3 for antibody 24912
ARLRPWGYDS

SEQ ID NO: 49825 - protein, 9 aa, Homo sapiens
  light chain complementarity determining region 3 for antibody 24913
LQHNTYPLT

SEQ ID NO: 49826 - protein, 22 aa, Homo sapiens
  heavy chain complementarity determining region 3 for antibody 24913
AKDQASTVVVVSRPWEVSDLTF

SEQ ID NO: 49827 - protein, 9 aa, Homo sapiens
  light chain complementarity determining region 3 for antibody 24914
LQHDDYLLT

SEQ ID NO: 49828 - protein, 12 aa, Homo sapiens
  heavy chain complementarity determining region 3 for antibody 24914
TTLYRIQLWPDL

SEQ ID NO: 49829 - protein, 8 aa, Homo sapiens
  light chain complementarity determining region 3 for antibody 24915
LDYYNVPL

SEQ ID NO: 49830 - protein, 15 aa, Homo sapiens
  heavy chain complementarity determining region 3 for antibody 24915
ATTRPLRGAALPSDY

SEQ ID NO: 49831 - protein, 9 aa, Homo sapiens
  light chain complementarity determining region 3 for antibody 24916
HQYYSAPLT

SEQ ID NO: 49832 - protein, 21 aa, Homo sapiens
  heavy chain complementarity determining region 3 for antibody 24916
AKDEGLSVFRSFDGLFDAFDI

SEQ ID NO: 49833 - protein, 9 aa, Homo sapiens
  light chain complementarity determining region 3 for antibody 24917
HQFNNWAGT

SEQ ID NO: 49834 - protein, 18 aa, Homo sapiens
  heavy chain complementarity determining region 3 for antibody 24917
ARAHWFGESPRYFHGLDV

SEQ ID NO: 49835 - protein, 9 aa, Homo sapiens
  light chain complementarity determining region 3 for antibody 24918
QQYYTPPRT

SEQ ID NO: 49836 - protein, 8 aa, Homo sapiens
  heavy chain complementarity determining region 3 for antibody 24918
ARDGAFDS

SEQ ID NO: 49837 - protein, 8 aa, Homo sapiens
  light chain complementarity determining region 3 for antibody 24919
QQYYSMFT

SEQ ID NO: 49838 - protein, 17 aa, Homo sapiens
  heavy chain complementarity determining region 3 for antibody 24919
ARFKSSSWYRAPYYFDY

SEQ ID NO: 49839 - protein, 10 aa, Homo sapiens
  light chain complementarity determining region 3 for antibody 24920
QQYYRPFMYT

SEQ ID NO: 49840 - protein, 11 aa, Homo sapiens
  heavy chain complementarity determining region 3 for antibody 24920
ASLSGEDAFDF

SEQ ID NO: 49841 - protein, 9 aa, Homo sapiens
  light chain complementarity determining region 3 for antibody 24921
QQYWSSPLT

SEQ ID NO: 49842 - protein, 19 aa, Homo sapiens
  heavy chain complementarity determining region 3 for antibody 24921
AITLSLYYHDSSGYDAFDI

SEQ ID NO: 49843 - protein, 9 aa, Homo sapiens
  light chain complementarity determining region 3 for antibody 24922
QQYWDSPGT

SEQ ID NO: 49844 - protein, 22 aa, Homo sapiens
  heavy chain complementarity determining region 3 for antibody 24922
ARPKTQGGYYEASGYERGAFDI

SEQ ID NO: 49845 - protein, 8 aa, Homo sapiens
  light chain complementarity determining region 3 for antibody 24923
QQYNSYWT

SEQ ID NO: 49846 - protein, 14 aa, Homo sapiens
  heavy chain complementarity determining region 3 for antibody 24923
ARDRVAPAGEYFQH

SEQ ID NO: 49847 - protein, 9 aa, Homo sapiens
  light chain complementarity determining region 3 for antibody 24924
QQYNSYSVT

SEQ ID NO: 49848 - protein, 19 aa, Homo sapiens
  heavy chain complementarity determining region 3 for antibody 24924
ARAQILWFGELFERGGLDI

SEQ ID NO: 49849 - protein, 9 aa, Homo sapiens
  light chain complementarity determining region 3 for antibody 24925
QQYNSYSPT

SEQ ID NO: 49850 - protein, 14 aa, Homo sapiens
  heavy chain complementarity determining region 3 for antibody 24925
ARGGSSGYYSQLDF

SEQ ID NO: 49851 - protein, 11 aa, Homo sapiens
  light chain complementarity determining region 3 for antibody 24926
QQYNSYSPLFT

SEQ ID NO: 49852 - protein, 14 aa, Homo sapiens
  heavy chain complementarity determining region 3 for antibody 24926
ARGHQLGNPVSQDY

SEQ ID NO: 49853 - protein, 9 aa, Homo sapiens
  light chain complementarity determining region 3 for antibody 24927
QQYNSYSNP

SEQ ID NO: 49854 - protein, 12 aa, Homo sapiens
  heavy chain complementarity determining region 3 for antibody 24927
ARPRYRSGFFDY

SEQ ID NO: 49855 - protein, 9 aa, Homo sapiens
  light chain complementarity determining region 3 for antibody 24928
QQYNNWPRT

SEQ ID NO: 49856 - protein, 14 aa, Homo sapiens
  heavy chain complementarity determining region 3 for antibody 24928
VKGHCSSTSCYNDY

SEQ ID NO: 49857 - protein, 10 aa, Homo sapiens
  light chain complementarity determining region 3 for antibody 24929
QQYNNWPPLT

SEQ ID NO: 49858 - protein, 18 aa, Homo sapiens
  heavy chain complementarity determining region 3 for antibody 24929
ARERVPVTTLADRDAFEI

SEQ ID NO: 49859 - protein, 10 aa, Homo sapiens
  light chain complementarity determining region 3 for antibody 24930
QQYNDWPPLT

SEQ ID NO: 49860 - protein, 16 aa, Homo sapiens
  heavy chain complementarity determining region 3 for antibody 24930
ARDRVSTYFDSGTFDS

SEQ ID NO: 49861 - protein, 10 aa, Homo sapiens
  light chain complementarity determining region 3 for antibody 24931
QQYGSSPPYT

SEQ ID NO: 49862 - protein, 14 aa, Homo sapiens
  heavy chain complementarity determining region 3 for antibody 24931
ARHEHDGSGSVIDY

SEQ ID NO: 49863 - protein, 10 aa, Homo sapiens
  light chain complementarity determining region 3 for antibody 24932
QQYGSSPPYT

SEQ ID NO: 49864 - protein, 23 aa, Homo sapiens
  heavy chain complementarity determining region 3 for antibody 24932
ARDGAHDYIHRLRKKHRIDAFDI

SEQ ID NO: 49865 - protein, 9 aa, Homo sapiens
  light chain complementarity determining region 3 for antibody 24933
QQYGSLPRT

SEQ ID NO: 49866 - protein, 14 aa, Homo sapiens
  heavy chain complementarity determining region 3 for antibody 24933
AGGIFCGGDCYSEY

SEQ ID NO: 49867 - protein, 9 aa, Homo sapiens
  light chain complementarity determining region 3 for antibody 24934
QQYDNLPVT

SEQ ID NO: 49868 - protein, 10 aa, Homo sapiens
  heavy chain complementarity determining region 3 for antibody 24934
ASGGGHTYGY

SEQ ID NO: 49869 - protein, 9 aa, Homo sapiens
  light chain complementarity determining region 3 for antibody 24935
QQYDNLPLT

SEQ ID NO: 49870 - protein, 18 aa, Homo sapiens
  heavy chain complementarity determining region 3 for antibody 24935
AREKRGYSYGFRVDYFDH

SEQ ID NO: 49871 - protein, 9 aa, Homo sapiens
  light chain complementarity determining region 3 for antibody 24936
QQYDDYPPT

SEQ ID NO: 49872 - protein, 17 aa, Homo sapiens
  heavy chain complementarity determining region 3 for antibody 24936
ASEGRRPASGTVWLSDY

SEQ ID NO: 49873 - protein, 9 aa, Homo sapiens
  light chain complementarity determining region 3 for antibody 24937
QQTYSTLYT

SEQ ID NO: 49874 - protein, 13 aa, Homo sapiens
  heavy chain complementarity determining region 3 for antibody 24937
ARGGISTRPSHDC

SEQ ID NO: 49875 - protein, 9 aa, Homo sapiens
  light chain complementarity determining region 3 for antibody 24938
QQSYSTPYN

SEQ ID NO: 49876 - protein, 20 aa, Homo sapiens
  heavy chain complementarity determining region 3 for antibody 24938
AREFPDVSDGSGYPPSHFDY

SEQ ID NO: 49877 - protein, 9 aa, Homo sapiens
  light chain complementarity determining region 3 for antibody 24939
QQSYSTPVT

SEQ ID NO: 49878 - protein, 24 aa, Homo sapiens
  heavy chain complementarity determining region 3 for antibody 24939
ARTAENHLESMVRGVITFLGYFDY

SEQ ID NO: 49879 - protein, 10 aa, Homo sapiens
  light chain complementarity determining region 3 for antibody 24940
QQSYSTPPVT

SEQ ID NO: 49880 - protein, 15 aa, Homo sapiens
  heavy chain complementarity determining region 3 for antibody 24940
ARRYFDWLFSRYFDL

SEQ ID NO: 49881 - protein, 9 aa, Homo sapiens
  light chain complementarity determining region 3 for antibody 24941
QQSYSSPRT

SEQ ID NO: 49882 - protein, 17 aa, Homo sapiens
  heavy chain complementarity determining region 3 for antibody 24941
ARDSARFAVAARTPIDY

SEQ ID NO: 49883 - protein, 10 aa, Homo sapiens
  light chain complementarity determining region 3 for antibody 24942
QQSYSSPPFT

SEQ ID NO: 49884 - protein, 15 aa, Homo sapiens
  heavy chain complementarity determining region 3 for antibody 24942
ARDNLRTAQHGGLDP

SEQ ID NO: 49885 - protein, 9 aa, Homo sapiens
  light chain complementarity determining region 3 for antibody 24943
QQSYSPPFT

SEQ ID NO: 49886 - protein, 12 aa, Homo sapiens
  heavy chain complementarity determining region 3 for antibody 24943
VTDRLRFLEWSY

SEQ ID NO: 49887 - protein, 10 aa, Homo sapiens
  light chain complementarity determining region 3 for antibody 24944
QQSYSLPPRT

SEQ ID NO: 49888 - protein, 21 aa, Homo sapiens
  heavy chain complementarity determining region 3 for antibody 24944
ARELMLSSGYYSFSYWWHFDL

SEQ ID NO: 49889 - protein, 9 aa, Homo sapiens
  light chain complementarity determining region 3 for antibody 24945
QQSYSIPYT

SEQ ID NO: 49890 - protein, 14 aa, Homo sapiens
  heavy chain complementarity determining region 3 for antibody 24945
ARFHCSGGTCYSGV

SEQ ID NO: 49891 - protein, 9 aa, Homo sapiens
  light chain complementarity determining region 3 for antibody 24946
QQSYSGPPT

SEQ ID NO: 49892 - protein, 19 aa, Homo sapiens
  heavy chain complementarity determining region 3 for antibody 24946
ARPNTYYYDRSGYHYYFDW

SEQ ID NO: 49893 - protein, 9 aa, Homo sapiens
  light chain complementarity determining region 3 for antibody 24947
QQSYGTSYT

SEQ ID NO: 49894 - protein, 15 aa, Homo sapiens
  heavy chain complementarity determining region 3 for antibody 24947
ARGGRGYSHHGPFGY

SEQ ID NO: 49895 - protein, 10 aa, Homo sapiens
  light chain complementarity determining region 3 for antibody 24948
QQSYGTPMYS

SEQ ID NO: 49896 - protein, 15 aa, Homo sapiens
  heavy chain complementarity determining region 3 for antibody 24948
ARDGSSSGWEAKLDF

SEQ ID NO: 49897 - protein, 9 aa, Homo sapiens
  light chain complementarity determining region 3 for antibody 24949
QQSYGTPLT

SEQ ID NO: 49898 - protein, 15 aa, Homo sapiens
  heavy chain complementarity determining region 3 for antibody 24949
ARDRESGYTNYDFDS

SEQ ID NO: 49899 - protein, 9 aa, Homo sapiens
  light chain complementarity determining region 3 for antibody 24950
QQSDSTPIT

SEQ ID NO: 49900 - protein, 16 aa, Homo sapiens
  heavy chain complementarity determining region 3 for antibody 24950
SRGAYYSSSWYGWFDP

SEQ ID NO: 49901 - protein, 8 aa, Homo sapiens
  light chain complementarity determining region 3 for antibody 24951
QQRSNWPT

SEQ ID NO: 49902 - protein, 15 aa, Homo sapiens
  heavy chain complementarity determining region 3 for antibody 24951
ARRDYDFWSGRYFDL

SEQ ID NO: 49903 - protein, 11 aa, Homo sapiens
  light chain complementarity determining region 3 for antibody 24952
QQRSNWPPSYT

SEQ ID NO: 49904 - protein, 14 aa, Homo sapiens
  heavy chain complementarity determining region 3 for antibody 24952
AKDKAVTGLYYFDY

SEQ ID NO: 49905 - protein, 11 aa, Homo sapiens
  light chain complementarity determining region 3 for antibody 24953
QQRSNWPPMYT

SEQ ID NO: 49906 - protein, 16 aa, Homo sapiens
  heavy chain complementarity determining region 3 for antibody 24953
ARVESRGGIAVDWFDY

SEQ ID NO: 49907 - protein, 11 aa, Homo sapiens
  light chain complementarity determining region 3 for antibody 24954
QQRSDWPPVIT

SEQ ID NO: 49908 - protein, 22 aa, Homo sapiens
  heavy chain complementarity determining region 3 for antibody 24954
ARHRQAENYDSGGYSLPDGFDI

SEQ ID NO: 49909 - protein, 8 aa, Homo sapiens
  light chain complementarity determining region 3 for antibody 24955
QQRNFRLT

SEQ ID NO: 49910 - protein, 13 aa, Homo sapiens
  heavy chain complementarity determining region 3 for antibody 24955
TTDAAFVPYYFTY

SEQ ID NO: 49911 - protein, 9 aa, Homo sapiens
  light chain complementarity determining region 3 for antibody 24956
QQLKNYFFT

SEQ ID NO: 49912 - protein, 19 aa, Homo sapiens
  heavy chain complementarity determining region 3 for antibody 24956
AKAASVPNRRSVTTAPFDY

SEQ ID NO: 49913 - protein, 9 aa, Homo sapiens
  light chain complementarity determining region 3 for antibody 24957
QQGYSTPYT

SEQ ID NO: 49914 - protein, 14 aa, Homo sapiens
  heavy chain complementarity determining region 3 for antibody 24957
ARDPQLGKPDYFDY

SEQ ID NO: 49915 - protein, 9 aa, Homo sapiens
  light chain complementarity determining region 3 for antibody 24958
QQFYSPPPT

SEQ ID NO: 49916 - protein, 17 aa, Homo sapiens
  heavy chain complementarity determining region 3 for antibody 24958
VRDFGHDYGDPFYAFDI

SEQ ID NO: 49917 - protein, 6 aa, Homo sapiens
  light chain complementarity determining region 3 for antibody 24959
QQCPGT

SEQ ID NO: 49918 - protein, 22 aa, Homo sapiens
  heavy chain complementarity determining region 3 for antibody 24959
ARDRRSSGWSPGGQYYYYGMDV

SEQ ID NO: 49919 - protein, 9 aa, Homo sapiens
  light chain complementarity determining region 3 for antibody 24960
QQAHSLPQT

SEQ ID NO: 49920 - protein, 17 aa, Homo sapiens
  heavy chain complementarity determining region 3 for antibody 24960
AREDYSSYGGRLRGFDI

SEQ ID NO: 49921 - protein, 9 aa, Homo sapiens
  light chain complementarity determining region 3 for antibody 24961
QKYNSAPLT

SEQ ID NO: 49922 - protein, 14 aa, Homo sapiens
  heavy chain complementarity determining region 3 for antibody 24961
ARGGFIVAWGLFDY

SEQ ID NO: 49923 - protein, 9 aa, Homo sapiens
  light chain complementarity determining region 3 for antibody 24962
QHYYIYPYT

SEQ ID NO: 49924 - protein, 16 aa, Homo sapiens
  heavy chain complementarity determining region 3 for antibody 24962
SRAPPRDSSAYRPFEY

SEQ ID NO: 49925 - protein, 10 aa, Homo sapiens
  light chain complementarity determining region 3 for antibody 24963
QHYGNLLMFP

SEQ ID NO: 49926 - protein, 21 aa, Homo sapiens
  heavy chain complementarity determining region 3 for antibody 24963
ARGRGPTAITMRGVGYYGMDV

SEQ ID NO: 49927 - protein, 10 aa, Homo sapiens
  light chain complementarity determining region 3 for antibody 24964
QGYDSSSLWT

SEQ ID NO: 49928 - protein, 19 aa, Homo sapiens
  heavy chain complementarity determining region 3 for antibody 24964
ARESFVRKVGGQRPYYFDI

SEQ ID NO: 49929 - protein, 6 aa, Homo sapiens
  light chain complementarity determining region 3 for antibody 24965
QEYGGP

SEQ ID NO: 49930 - protein, 18 aa, Homo sapiens
  heavy chain complementarity determining region 3 for antibody 24965
ATTKLTFMGGFDYYGLDV

SEQ ID NO: 49931 - protein, 9 aa, Homo sapiens
  light chain complementarity determining region 3 for antibody 24966
MQSRRWPPT

SEQ ID NO: 49932 - protein, 8 aa, Homo sapiens
  heavy chain complementarity determining region 3 for antibody 24966
TAWGSSQH

SEQ ID NO: 49933 - protein, 9 aa, Homo sapiens
  light chain complementarity determining region 3 for antibody 24967
MQGTHWPLG

SEQ ID NO: 49934 - protein, 18 aa, Homo sapiens
  heavy chain complementarity determining region 3 for antibody 24967
ARDERDTCTNGLCYYFDY

SEQ ID NO: 49935 - protein, 9 aa, Homo sapiens
  light chain complementarity determining region 3 for antibody 24968
MQGLQSLYT

SEQ ID NO: 49936 - protein, 15 aa, Homo sapiens
  heavy chain complementarity determining region 3 for antibody 24968
ARHRYYGSGNYEFDY

SEQ ID NO: 49937 - protein, 9 aa, Homo sapiens
  light chain complementarity determining region 3 for antibody 24969
MQALQTPRT

SEQ ID NO: 49938 - protein, 13 aa, Homo sapiens
  heavy chain complementarity determining region 3 for antibody 24969
ATHPDPDLYYFDY

SEQ ID NO: 49939 - protein, 9 aa, Homo sapiens
  light chain complementarity determining region 3 for antibody 24970
MQALQTLIT

SEQ ID NO: 49940 - protein, 15 aa, Homo sapiens
  heavy chain complementarity determining region 3 for antibody 24970
ARGVVGATTVSWFDP

SEQ ID NO: 49941 - protein, 9 aa, Homo sapiens
  light chain complementarity determining region 3 for antibody 24971
MQALETPFT

SEQ ID NO: 49942 - protein, 15 aa, Homo sapiens
  heavy chain complementarity determining region 3 for antibody 24971
LRHYRSLATGTEGDC

SEQ ID NO: 49943 - protein, 10 aa, Homo sapiens
  light chain complementarity determining region 3 for antibody 24972
MESLQTPQHS

SEQ ID NO: 49944 - protein, 12 aa, Homo sapiens
  heavy chain complementarity determining region 3 for antibody 24972
ARLSYELFAFDI

SEQ ID NO: 49945 - protein, 9 aa, Homo sapiens
  light chain complementarity determining region 3 for antibody 24973
LQYYSTPWT

SEQ ID NO: 49946 - protein, 15 aa, Homo sapiens
  heavy chain complementarity determining region 3 for antibody 24973
IRQSKVDNYYNYPDF

SEQ ID NO: 49947 - protein, 9 aa, Homo sapiens
  light chain complementarity determining region 3 for antibody 24974
LQYKDYPRT

SEQ ID NO: 49948 - protein, 27 aa, Homo sapiens
  heavy chain complementarity determining region 3 for antibody 24974
ATDDLSLLGGYLSWGPKEDDYFRGLDV

SEQ ID NO: 49949 - protein, 9 aa, Homo sapiens
  light chain complementarity determining region 3 for antibody 24975
LQHNSYPLT

SEQ ID NO: 49950 - protein, 11 aa, Homo sapiens
  heavy chain complementarity determining region 3 for antibody 24975
ARFEIWFGLDR

SEQ ID NO: 49951 - protein, 9 aa, Homo sapiens
  light chain complementarity determining region 3 for antibody 24976
LQDYSYPLT

SEQ ID NO: 49952 - protein, 13 aa, Homo sapiens
  heavy chain complementarity determining region 3 for antibody 24976
ARRTYGDYGYFDF

SEQ ID NO: 49953 - protein, 9 aa, Homo sapiens
  light chain complementarity determining region 3 for antibody 24977
LQDYNYPRT

SEQ ID NO: 49954 - protein, 18 aa, Homo sapiens
  heavy chain complementarity determining region 3 for antibody 24977
ARDSSYASNPYYYDSFDY

SEQ ID NO: 49955 - protein, 9 aa, Homo sapiens
  light chain complementarity determining region 3 for antibody 24978
HQSSSLPQT

SEQ ID NO: 49956 - protein, 14 aa, Homo sapiens
  heavy chain complementarity determining region 3 for antibody 24978
AHLQVGATPRAFDI

SEQ ID NO: 49957 - protein, 11 aa, Homo sapiens
  light chain complementarity determining region 3 for antibody 24979
QRYDLSPPRYS

SEQ ID NO: 49958 - protein, 14 aa, Homo sapiens
  heavy chain complementarity determining region 3 for antibody 24979
ARHKQESGTRGFDF

SEQ ID NO: 49959 - protein, 10 aa, Homo sapiens
  light chain complementarity determining region 3 for antibody 24980
QQYYGTPPFT

SEQ ID NO: 49960 - protein, 14 aa, Homo sapiens
  heavy chain complementarity determining region 3 for antibody 24980
AKDLLKLWGSCSGD

SEQ ID NO: 49961 - protein, 8 aa, Homo sapiens
  light chain complementarity determining region 3 for antibody 24981
QQYNSYST

SEQ ID NO: 49962 - protein, 20 aa, Homo sapiens
  heavy chain complementarity determining region 3 for antibody 24981
AREKSRFSEWFVSRDWCFDL

SEQ ID NO: 49963 - protein, 8 aa, Homo sapiens
  light chain complementarity determining region 3 for antibody 24982
QQYNSYST

SEQ ID NO: 49964 - protein, 23 aa, Homo sapiens
  heavy chain complementarity determining region 3 for antibody 24982
ARDAYAGRSSGWYAKLDYWYFDL

SEQ ID NO: 49965 - protein, 8 aa, Homo sapiens
  light chain complementarity determining region 3 for antibody 24983
QQYNSLWT

SEQ ID NO: 49966 - protein, 13 aa, Homo sapiens
  heavy chain complementarity determining region 3 for antibody 24983
AREVITSGGTYDY

SEQ ID NO: 49967 - protein, 10 aa, Homo sapiens
  light chain complementarity determining region 3 for antibody 24984
QQYNNWPPYT

SEQ ID NO: 49968 - protein, 13 aa, Homo sapiens
  heavy chain complementarity determining region 3 for antibody 24984
ARVTGYSSRYIGY

SEQ ID NO: 49969 - protein, 10 aa, Homo sapiens
  light chain complementarity determining region 3 for antibody 24985
QQYNNWPLFT

SEQ ID NO: 49970 - protein, 13 aa, Homo sapiens
  heavy chain complementarity determining region 3 for antibody 24985
TVDLGGSSSSFDL

SEQ ID NO: 49971 - protein, 11 aa, Homo sapiens
  light chain complementarity determining region 3 for antibody 24986
QQYITSFPGYT

SEQ ID NO: 49972 - protein, 11 aa, Homo sapiens
  heavy chain complementarity determining region 3 for antibody 24986
ARHGDHYYFDY

SEQ ID NO: 49973 - protein, 9 aa, Homo sapiens
  light chain complementarity determining region 3 for antibody 24987
QQYHSSPQT

SEQ ID NO: 49974 - protein, 9 aa, Homo sapiens
  heavy chain complementarity determining region 3 for antibody 24987
ARANYHFDL

SEQ ID NO: 49975 - protein, 9 aa, Homo sapiens
  light chain complementarity determining region 3 for antibody 24988
QQYGSSPWT

SEQ ID NO: 49976 - protein, 24 aa, Homo sapiens
  heavy chain complementarity determining region 3 for antibody 24988
ARVRVIMTRRVDVVVNYDHHGMDV

SEQ ID NO: 49977 - protein, 10 aa, Homo sapiens
  light chain complementarity determining region 3 for antibody 24989
QQYGSSPMYR

SEQ ID NO: 49978 - protein, 11 aa, Homo sapiens
  heavy chain complementarity determining region 3 for antibody 24989
ARGGQWGSLDY

SEQ ID NO: 49979 - protein, 9 aa, Homo sapiens
  light chain complementarity determining region 3 for antibody 24990
QQYGRSPYT

SEQ ID NO: 49980 - protein, 21 aa, Homo sapiens
  heavy chain complementarity determining region 3 for antibody 24990
ARVYGGYSSGWSDEYLYYFDY

SEQ ID NO: 49981 - protein, 8 aa, Homo sapiens
  light chain complementarity determining region 3 for antibody 24991
QQYGDSMT

SEQ ID NO: 49982 - protein, 16 aa, Homo sapiens
  heavy chain complementarity determining region 3 for antibody 24991
ARGLSIIRGVMSLFDL

SEQ ID NO: 49983 - protein, 9 aa, Homo sapiens
  light chain complementarity determining region 3 for antibody 24992
QQYEGLPYT

SEQ ID NO: 49984 - protein, 15 aa, Homo sapiens
  heavy chain complementarity determining region 3 for antibody 24992
LRASYYSDSRGATQQ

SEQ ID NO: 49985 - protein, 9 aa, Homo sapiens
  light chain complementarity determining region 3 for antibody 24993
QQYDNSLWT

SEQ ID NO: 49986 - protein, 20 aa, Homo sapiens
  heavy chain complementarity determining region 3 for antibody 24993
ATPDTRYGSGRYHDTYAFDI

SEQ ID NO: 49987 - protein, 8 aa, Homo sapiens
  light chain complementarity determining region 3 for antibody 24994
QQYDDLHT

SEQ ID NO: 49988 - protein, 13 aa, Homo sapiens
  heavy chain complementarity determining region 3 for antibody 24994
ARQSAWFLGAFDI

SEQ ID NO: 49989 - protein, 9 aa, Homo sapiens
  light chain complementarity determining region 3 for antibody 24995
QQSYSTPYT

SEQ ID NO: 49990 - protein, 12 aa, Homo sapiens
  heavy chain complementarity determining region 3 for antibody 24995
ARDRNSYGRFDY

SEQ ID NO: 49991 - protein, 9 aa, Homo sapiens
  light chain complementarity determining region 3 for antibody 24996
QQSYSTPYI

SEQ ID NO: 49992 - protein, 13 aa, Homo sapiens
  heavy chain complementarity determining region 3 for antibody 24996
ARDRIRSSDGIDY

SEQ ID NO: 49993 - protein, 9 aa, Homo sapiens
  light chain complementarity determining region 3 for antibody 24997
QQSYSTPLT

SEQ ID NO: 49994 - protein, 21 aa, Homo sapiens
  heavy chain complementarity determining region 3 for antibody 24997
ARDGYYYGSQLPRGGYYGVDV

SEQ ID NO: 49995 - protein, 9 aa, Homo sapiens
  light chain complementarity determining region 3 for antibody 24998
QQSYSTPGT

SEQ ID NO: 49996 - protein, 13 aa, Homo sapiens
  heavy chain complementarity determining region 3 for antibody 24998
ARDYGSGTYYTDY

SEQ ID NO: 49997 - protein, 9 aa, Homo sapiens
  light chain complementarity determining region 3 for antibody 24999
QQSYSTLLT

SEQ ID NO: 49998 - protein, 16 aa, Homo sapiens
  heavy chain complementarity determining region 3 for antibody 24999
AREGGGTYTSNRAFDY

SEQ ID NO: 49999 - protein, 11 aa, Homo sapiens
  light chain complementarity determining region 3 for antibody 25000
QQSYSNPHFFS

SEQ ID NO: 50000 - protein, 15 aa, Homo sapiens
  heavy chain complementarity determining region 3 for antibody 25000
ARASNLWEKTEAYEF

SEQ ID NO: 50001 - protein, 9 aa, Homo sapiens
  light chain complementarity determining region 3 for antibody 25001
QQSYGTPYT

SEQ ID NO: 50002 - protein, 11 aa, Homo sapiens
  heavy chain complementarity determining region 3 for antibody 25001
ARMLGSGWFWD

SEQ ID NO: 50003 - protein, 9 aa, Homo sapiens
  light chain complementarity determining region 3 for antibody 25002
QQRSSWPYT

SEQ ID NO: 50004 - protein, 19 aa, Homo sapiens
  heavy chain complementarity determining region 3 for antibody 25002
ARHVYDTSHYYSLVDAFEI

SEQ ID NO: 50005 - protein, 8 aa, Homo sapiens
  light chain complementarity determining region 3 for antibody 25003
QQRSNWPT

SEQ ID NO: 50006 - protein, 18 aa, Homo sapiens
  heavy chain complementarity determining region 3 for antibody 25003
AREFAGLPSGEDAEYLQH

SEQ ID NO: 50007 - protein, 11 aa, Homo sapiens
  light chain complementarity determining region 3 for antibody 25004
QQRSNWPPMYT

SEQ ID NO: 50008 - protein, 13 aa, Homo sapiens
  heavy chain complementarity determining region 3 for antibody 25004
ARDGLRFLEWLVN

SEQ ID NO: 50009 - protein, 10 aa, Homo sapiens
  light chain complementarity determining region 3 for antibody 25005
QQRSNWPMYT

SEQ ID NO: 50010 - protein, 12 aa, Homo sapiens
  heavy chain complementarity determining region 3 for antibody 25005
ARTTSGRDWVDP

SEQ ID NO: 50011 - protein, 11 aa, Homo sapiens
  light chain complementarity determining region 3 for antibody 25006
QQRSDWPPRVT

SEQ ID NO: 50012 - protein, 14 aa, Homo sapiens
  heavy chain complementarity determining region 3 for antibody 25006
ARQGVTYGRRWFDP

SEQ ID NO: 50013 - protein, 10 aa, Homo sapiens
  light chain complementarity determining region 3 for antibody 25007
QQFGTSSRFT

SEQ ID NO: 50014 - protein, 9 aa, Homo sapiens
  heavy chain complementarity determining region 3 for antibody 25007
ARGYTELDS

SEQ ID NO: 50015 - protein, 9 aa, Homo sapiens
  light chain complementarity determining region 3 for antibody 25008
QQFDLPPRT

SEQ ID NO: 50016 - protein, 15 aa, Homo sapiens
  heavy chain complementarity determining region 3 for antibody 25008
ARMPPRGDWYGAFDV

SEQ ID NO: 50017 - protein, 9 aa, Homo sapiens
  light chain complementarity determining region 3 for antibody 25009
QQDGSTWWT

SEQ ID NO: 50018 - protein, 15 aa, Homo sapiens
  heavy chain complementarity determining region 3 for antibody 25009
ARHMARDSIGYYHDF

SEQ ID NO: 50019 - protein, 9 aa, Homo sapiens
  light chain complementarity determining region 3 for antibody 25010
QQCYTYSWT

SEQ ID NO: 50020 - protein, 13 aa, Homo sapiens
  heavy chain complementarity determining region 3 for antibody 25010
AKGRHFLPPPLDY

SEQ ID NO: 50021 - protein, 9 aa, Homo sapiens
  light chain complementarity determining region 3 for antibody 25011
QKYNSGPFT

SEQ ID NO: 50022 - protein, 11 aa, Homo sapiens
  heavy chain complementarity determining region 3 for antibody 25011
ARLKLMSVGDY

SEQ ID NO: 50023 - protein, 10 aa, Homo sapiens
  light chain complementarity determining region 3 for antibody 25012
QIYERFQGIT

SEQ ID NO: 50024 - protein, 17 aa, Homo sapiens
  heavy chain complementarity determining region 3 for antibody 25012
ARERDWYDNRGRREVDY

SEQ ID NO: 50025 - protein, 9 aa, Homo sapiens
  light chain complementarity determining region 3 for antibody 25013
QHYENLPFT

SEQ ID NO: 50026 - protein, 17 aa, Homo sapiens
  heavy chain complementarity determining region 3 for antibody 25013
AKDLSGVIGGSYGSFDF

SEQ ID NO: 50027 - protein, 8 aa, Homo sapiens
  light chain complementarity determining region 3 for antibody 25014
MQTLQGFT

SEQ ID NO: 50028 - protein, 12 aa, Homo sapiens
  heavy chain complementarity determining region 3 for antibody 25014
VRGAPDYGVFDF

SEQ ID NO: 50029 - protein, 9 aa, Homo sapiens
  light chain complementarity determining region 3 for antibody 25015
LQYNYYPPT

SEQ ID NO: 50030 - protein, 18 aa, Homo sapiens
  heavy chain complementarity determining region 3 for antibody 25015
ARDMSGYYGSGSYATFDY

SEQ ID NO: 50031 - protein, 9 aa, Homo sapiens
  light chain complementarity determining region 3 for antibody 25016
LQHSLDPWT

SEQ ID NO: 50032 - protein, 7 aa, Homo sapiens
  heavy chain complementarity determining region 3 for antibody 25016
ARGGSDY

SEQ ID NO: 50033 - protein, 9 aa, Homo sapiens
  light chain complementarity determining region 3 for antibody 25017
LQHNSYPFT

SEQ ID NO: 50034 - protein, 13 aa, Homo sapiens
  heavy chain complementarity determining region 3 for antibody 25017
SLTTGTGDMTMTS

SEQ ID NO: 50035 - protein, 9 aa, Homo sapiens
  light chain complementarity determining region 3 for antibody 25018
LQDSKYPRT

SEQ ID NO: 50036 - protein, 12 aa, Homo sapiens
  heavy chain complementarity determining region 3 for antibody 25018
ASTTVTTLYFQH

SEQ ID NO: 50037 - protein, 9 aa, Homo sapiens
  light chain complementarity determining region 3 for antibody 25019
HQTGNIPRT

SEQ ID NO: 50038 - protein, 5 aa, Homo sapiens
  heavy chain complementarity determining region 3 for antibody 25019
TTDLT

SEQ ID NO: 50039 - protein, 9 aa, Homo sapiens
  light chain complementarity determining region 3 for antibody 25020
HQNYSTPLT

SEQ ID NO: 50040 - protein, 14 aa, Homo sapiens
  heavy chain complementarity determining region 3 for antibody 25020
AKDLRSRYWDAFDI

SEQ ID NO: 50041 - protein, 9 aa, Homo sapiens
  light chain complementarity determining region 3 for antibody 25021
HQAYSPPQT

SEQ ID NO: 50042 - protein, 24 aa, Homo sapiens
  heavy chain complementarity determining region 3 for antibody 25021
AKGSLEWYYDGSGYYYAPGDAFDV

SEQ ID NO: 50043 - protein, 9 aa, Homo sapiens
  light chain complementarity determining region 3 for antibody 25022
HHYGSSPYT

SEQ ID NO: 50044 - protein, 18 aa, Homo sapiens
  heavy chain complementarity determining region 3 for antibody 25022
KGDSSGYYFGKIPYYFDF

SEQ ID NO: 50045 - protein, 9 aa, Homo sapiens
  light chain complementarity determining region 3 for antibody 25023
EQYGSPPLT

SEQ ID NO: 50046 - protein, 13 aa, Homo sapiens
  heavy chain complementarity determining region 3 for antibody 25023
ASHSRGWYRVFDW

SEQ ID NO: 50047 - protein, 10 aa, Homo sapiens
  light chain complementarity determining region 3 for antibody 25024
VLEAHWPPYT

SEQ ID NO: 50048 - protein, 12 aa, Homo sapiens
  heavy chain complementarity determining region 3 for antibody 25024
TTLGMTSVHSDF

SEQ ID NO: 50049 - protein, 9 aa, Homo sapiens
  light chain complementarity determining region 3 for antibody 25025
QRLNRYPVI

SEQ ID NO: 50050 - protein, 16 aa, Homo sapiens
  heavy chain complementarity determining region 3 for antibody 25025
AKYCTVAECPMNYADI

SEQ ID NO: 50051 - protein, 8 aa, Homo sapiens
  light chain complementarity determining region 3 for antibody 25026
QQYYSYWT

SEQ ID NO: 50052 - protein, 14 aa, Homo sapiens
  heavy chain complementarity determining region 3 for antibody 25026
ARVPGRDGYNHLDY

SEQ ID NO: 50053 - protein, 9 aa, Homo sapiens
  light chain complementarity determining region 3 for antibody 25027
QQYYSYPYT

SEQ ID NO: 50054 - protein, 13 aa, Homo sapiens
  heavy chain complementarity determining region 3 for antibody 25027
ARDNLEWEVYFDY

SEQ ID NO: 50055 - protein, 9 aa, Homo sapiens
  light chain complementarity determining region 3 for antibody 25028
QQYYSTPWT

SEQ ID NO: 50056 - protein, 15 aa, Homo sapiens
  heavy chain complementarity determining region 3 for antibody 25028
IRQSKMNNNWDYPDS

SEQ ID NO: 50057 - protein, 9 aa, Homo sapiens
  light chain complementarity determining region 3 for antibody 25029
QQYYSFSWT

SEQ ID NO: 50058 - protein, 16 aa, Homo sapiens
  heavy chain complementarity determining region 3 for antibody 25029
ARGGDYDFWSGYPTDY

SEQ ID NO: 50059 - protein, 9 aa, Homo sapiens
  light chain complementarity determining region 3 for antibody 25030
QQYYSAPLT

SEQ ID NO: 50060 - protein, 10 aa, Homo sapiens
  heavy chain complementarity determining region 3 for antibody 25030
ARGAVGGHDY

SEQ ID NO: 50061 - protein, 9 aa, Homo sapiens
  light chain complementarity determining region 3 for antibody 25031
QQYNSYSYT

SEQ ID NO: 50062 - protein, 11 aa, Homo sapiens
  heavy chain complementarity determining region 3 for antibody 25031
AGAVAEGYFDS

SEQ ID NO: 50063 - protein, 9 aa, Homo sapiens
  light chain complementarity determining region 3 for antibody 25032
QQYNSYSNT

SEQ ID NO: 50064 - protein, 20 aa, Homo sapiens
  heavy chain complementarity determining region 3 for antibody 25032
ARESADSGSYTGSLGYYFDN

SEQ ID NO: 50065 - protein, 9 aa, Homo sapiens
  light chain complementarity determining region 3 for antibody 25033
QQYNSYPYT

SEQ ID NO: 50066 - protein, 15 aa, Homo sapiens
  heavy chain complementarity determining region 3 for antibody 25033
ASPRNYYDTRDAFDV

SEQ ID NO: 50067 - protein, 8 aa, Homo sapiens
  light chain complementarity determining region 3 for antibody 25034
QQYNSQSS

SEQ ID NO: 50068 - protein, 16 aa, Homo sapiens
  heavy chain complementarity determining region 3 for antibody 25034
IKEKRTERVGFDALEV

SEQ ID NO: 50069 - protein, 10 aa, Homo sapiens
  light chain complementarity determining region 3 for antibody 25035
QQYNNWPPLT

SEQ ID NO: 50070 - protein, 15 aa, Homo sapiens
  heavy chain complementarity determining region 3 for antibody 25035
ARDRSGSYSVHAFDI

SEQ ID NO: 50071 - protein, 9 aa, Homo sapiens
  light chain complementarity determining region 3 for antibody 25036
QQYNNWPPA

SEQ ID NO: 50072 - protein, 22 aa, Homo sapiens
  heavy chain complementarity determining region 3 for antibody 25036
ARVGRHGTKSPPAGKAWGWFDP

SEQ ID NO: 50073 - protein, 9 aa, Homo sapiens
  light chain complementarity determining region 3 for antibody 25037
QQYNANPWT

SEQ ID NO: 50074 - protein, 13 aa, Homo sapiens
  heavy chain complementarity determining region 3 for antibody 25037
VRGRLAVAGTVDS

SEQ ID NO: 50075 - protein, 8 aa, Homo sapiens
  light chain complementarity determining region 3 for antibody 25038
QQYNALWT

SEQ ID NO: 50076 - protein, 16 aa, Homo sapiens
  heavy chain complementarity determining region 3 for antibody 25038
ARDWPPSGLRRYYFDY

SEQ ID NO: 50077 - protein, 9 aa, Homo sapiens
  light chain complementarity determining region 3 for antibody 25039
QQYGSSPWA

SEQ ID NO: 50078 - protein, 22 aa, Homo sapiens
  heavy chain complementarity determining region 3 for antibody 25039
TRVSIGIYDTVNGYYHPGPMDS

SEQ ID NO: 50079 - protein, 9 aa, Homo sapiens
  light chain complementarity determining region 3 for antibody 25040
QQYGSSPPT

SEQ ID NO: 50080 - protein, 11 aa, Homo sapiens
  heavy chain complementarity determining region 3 for antibody 25040
ARGDLWSAFDI

SEQ ID NO: 50081 - protein, 10 aa, Homo sapiens
  light chain complementarity determining region 3 for antibody 25041
QQYGSSPMNS

SEQ ID NO: 50082 - protein, 11 aa, Homo sapiens
  heavy chain complementarity determining region 3 for antibody 25041
ARGGQWGSLDY

SEQ ID NO: 50083 - protein, 10 aa, Homo sapiens
  light chain complementarity determining region 3 for antibody 25042
QQYGSSPLYS

SEQ ID NO: 50084 - protein, 11 aa, Homo sapiens
  heavy chain complementarity determining region 3 for antibody 25042
ARGGQWGSLDY

SEQ ID NO: 50085 - protein, 11 aa, Homo sapiens
  light chain complementarity determining region 3 for antibody 25043
QQYGSPVPVYS

SEQ ID NO: 50086 - protein, 16 aa, Homo sapiens
  heavy chain complementarity determining region 3 for antibody 25043
VKDQVAANGICDPFDI

SEQ ID NO: 50087 - protein, 8 aa, Homo sapiens
  light chain complementarity determining region 3 for antibody 25044
QQYGNSRT

SEQ ID NO: 50088 - protein, 12 aa, Homo sapiens
  heavy chain complementarity determining region 3 for antibody 25044
AHRIKLGDWFDP

SEQ ID NO: 50089 - protein, 9 aa, Homo sapiens
  light chain complementarity determining region 3 for antibody 25045
QQYGGSPIT

SEQ ID NO: 50090 - protein, 16 aa, Homo sapiens
  heavy chain complementarity determining region 3 for antibody 25045
ARSTIGFLEWFGAFEI

SEQ ID NO: 50091 - protein, 9 aa, Homo sapiens
  light chain complementarity determining region 3 for antibody 25046
QQYGASTMT

SEQ ID NO: 50092 - protein, 14 aa, Homo sapiens
  heavy chain complementarity determining region 3 for antibody 25046
VRQDEKRPYRVVDY

SEQ ID NO: 50093 - protein, 9 aa, Homo sapiens
  light chain complementarity determining region 3 for antibody 25047
QQYESLPPT

SEQ ID NO: 50094 - protein, 12 aa, Homo sapiens
  heavy chain complementarity determining region 3 for antibody 25047
VRDRVAGDAFDT

SEQ ID NO: 50095 - protein, 9 aa, Homo sapiens
  light chain complementarity determining region 3 for antibody 25048
QQYDSSPFT

SEQ ID NO: 50096 - protein, 17 aa, Homo sapiens
  heavy chain complementarity determining region 3 for antibody 25048
ARDRGSSWYSCAEHFQY

SEQ ID NO: 50097 - protein, 9 aa, Homo sapiens
  light chain complementarity determining region 3 for antibody 25049
QQYDNLPVT

SEQ ID NO: 50098 - protein, 15 aa, Homo sapiens
  heavy chain complementarity determining region 3 for antibody 25049
ARYYCGGQCYSTFDS

SEQ ID NO: 50099 - protein, 9 aa, Homo sapiens
  light chain complementarity determining region 3 for antibody 25050
QQYDKYSWT

SEQ ID NO: 50100 - protein, 12 aa, Homo sapiens
  heavy chain complementarity determining region 3 for antibody 25050
AKDSAKKWELLD

SEQ ID NO: 50101 - protein, 8 aa, Homo sapiens
  light chain complementarity determining region 3 for antibody 25051
QQYAFSLT

SEQ ID NO: 50102 - protein, 12 aa, Homo sapiens
  heavy chain complementarity determining region 3 for antibody 25051
AGEIDTTGYFDP

SEQ ID NO: 50103 - protein, 9 aa, Homo sapiens
  light chain complementarity determining region 3 for antibody 25052
QQTYSTPYT

SEQ ID NO: 50104 - protein, 22 aa, Homo sapiens
  heavy chain complementarity determining region 3 for antibody 25052
ARNGFYDFWSGNYAGAHYGLDV

SEQ ID NO: 50105 - protein, 8 aa, Homo sapiens
  light chain complementarity determining region 3 for antibody 25053
QQSYSTRP

SEQ ID NO: 50106 - protein, 19 aa, Homo sapiens
  heavy chain complementarity determining region 3 for antibody 25053
ARETYYDILSPKDYYVMDV

SEQ ID NO: 50107 - protein, 9 aa, Homo sapiens
  light chain complementarity determining region 3 for antibody 25054
QQSYSTPYT

SEQ ID NO: 50108 - protein, 17 aa, Homo sapiens
  heavy chain complementarity determining region 3 for antibody 25054
AVYTSTDGIFNKDAFDI

SEQ ID NO: 50109 - protein, 9 aa, Homo sapiens
  light chain complementarity determining region 3 for antibody 25055
QQSSTTPYT

SEQ ID NO: 50110 - protein, 19 aa, Homo sapiens
  heavy chain complementarity determining region 3 for antibody 25055
ARCNPIVLGPGDYYYGMDV

SEQ ID NO: 50111 - protein, 10 aa, Homo sapiens
  light chain complementarity determining region 3 for antibody 25056
QQRSNWPPLT

SEQ ID NO: 50112 - protein, 20 aa, Homo sapiens
  heavy chain complementarity determining region 3 for antibody 25056
ARQNDYLWGTFRLRVPYFDF

SEQ ID NO: 50113 - protein, 8 aa, Homo sapiens
  light chain complementarity determining region 3 for antibody 25057
QQLNTYRS

SEQ ID NO: 50114 - protein, 14 aa, Homo sapiens
  heavy chain complementarity determining region 3 for antibody 25057
ARDGVYSSSFVGVV

SEQ ID NO: 50115 - protein, 10 aa, Homo sapiens
  light chain complementarity determining region 3 for antibody 25058
QQGYSSPLLS

SEQ ID NO: 50116 - protein, 14 aa, Homo sapiens
  heavy chain complementarity determining region 3 for antibody 25058
ARGRYSTSGAYFDY

SEQ ID NO: 50117 - protein, 8 aa, Homo sapiens
  light chain complementarity determining region 3 for antibody 25059
QQGSNWPS

SEQ ID NO: 50118 - protein, 14 aa, Homo sapiens
  heavy chain complementarity determining region 3 for antibody 25059
ARISKGTASIGFDP

SEQ ID NO: 50119 - protein, 9 aa, Homo sapiens
  light chain complementarity determining region 3 for antibody 25060
QQGNSLPFT

SEQ ID NO: 50120 - protein, 15 aa, Homo sapiens
  heavy chain complementarity determining region 3 for antibody 25060
AKVATRPLRDYYFDS

SEQ ID NO: 50121 - protein, 9 aa, Homo sapiens
  light chain complementarity determining region 3 for antibody 25061
QQFYSYPWT

SEQ ID NO: 50122 - protein, 15 aa, Homo sapiens
  heavy chain complementarity determining region 3 for antibody 25061
ARVATVTPRLWFFDL

SEQ ID NO: 50123 - protein, 9 aa, Homo sapiens
  light chain complementarity determining region 3 for antibody 25062
QQANSFPYT

SEQ ID NO: 50124 - protein, 12 aa, Homo sapiens
  heavy chain complementarity determining region 3 for antibody 25062
AKGLGGSSWLDY

SEQ ID NO: 50125 - protein, 10 aa, Homo sapiens
  light chain complementarity determining region 3 for antibody 25063
QLYGYSPPWT

SEQ ID NO: 50126 - protein, 14 aa, Homo sapiens
  heavy chain complementarity determining region 3 for antibody 25063
ARGGSSGYDHQFDY

SEQ ID NO: 50127 - protein, 9 aa, Homo sapiens
  light chain complementarity determining region 3 for antibody 25064
QKYNSAPRT

SEQ ID NO: 50128 - protein, 8 aa, Homo sapiens
  heavy chain complementarity determining region 3 for antibody 25064
AKGYGFDC

SEQ ID NO: 50129 - protein, 9 aa, Homo sapiens
  light chain complementarity determining region 3 for antibody 25065
QKFKDVPWT

SEQ ID NO: 50130 - protein, 19 aa, Homo sapiens
  heavy chain complementarity determining region 3 for antibody 25065
AKDRRDYNLWGSSSGGMDV

SEQ ID NO: 50131 - protein, 9 aa, Homo sapiens
  light chain complementarity determining region 3 for antibody 25066
QHYGTSQYT

SEQ ID NO: 50132 - protein, 20 aa, Homo sapiens
  heavy chain complementarity determining region 3 for antibody 25066
TKDMREMAPKGNSYHYGMDV

SEQ ID NO: 50133 - protein, 10 aa, Homo sapiens
  light chain complementarity determining region 3 for antibody 25067
MQGSYWPPGT

SEQ ID NO: 50134 - protein, 11 aa, Homo sapiens
  heavy chain complementarity determining region 3 for antibody 25067
ARDTPGVGIDY

SEQ ID NO: 50135 - protein, 8 aa, Homo sapiens
  light chain complementarity determining region 3 for antibody 25068
MQALQIPH

SEQ ID NO: 50136 - protein, 15 aa, Homo sapiens
  heavy chain complementarity determining region 3 for antibody 25068
ARGRGITGSTYGIDY

SEQ ID NO: 50137 - protein, 10 aa, Homo sapiens
  light chain complementarity determining region 3 for antibody 25069
LQYNSYPRLT

SEQ ID NO: 50138 - protein, 17 aa, Homo sapiens
  heavy chain complementarity determining region 3 for antibody 25069
TKVDGSNYFYDEEGIDY

SEQ ID NO: 50139 - protein, 10 aa, Homo sapiens
  light chain complementarity determining region 3 for antibody 25070
LQTYSSLPWT

SEQ ID NO: 50140 - protein, 12 aa, Homo sapiens
  heavy chain complementarity determining region 3 for antibody 25070
ATLGSGYLRFDY

SEQ ID NO: 50141 - protein, 9 aa, Homo sapiens
  light chain complementarity determining region 3 for antibody 25071
LQCNSYPIT

SEQ ID NO: 50142 - protein, 16 aa, Homo sapiens
  heavy chain complementarity determining region 3 for antibody 25071
ARYNSWPVLEVHYFDS

SEQ ID NO: 50143 - protein, 9 aa, Homo sapiens
  light chain complementarity determining region 3 for antibody 25072
KQFKTFPIT

SEQ ID NO: 50144 - protein, 11 aa, Homo sapiens
  heavy chain complementarity determining region 3 for antibody 25072
VMDGGHWDFYF

SEQ ID NO: 50145 - protein, 10 aa, Homo sapiens
  light chain complementarity determining region 3 for antibody 25073
HYYGSSPGGT

SEQ ID NO: 50146 - protein, 18 aa, Homo sapiens
  heavy chain complementarity determining region 3 for antibody 25073
ARGGFGVHWRGHFYGLDV

SEQ ID NO: 50147 - protein, 9 aa, Homo sapiens
  light chain complementarity determining region 3 for antibody 25074
HQSSSLPQT

SEQ ID NO: 50148 - protein, 11 aa, Homo sapiens
  heavy chain complementarity determining region 3 for antibody 25074
ARHGPEMEVDF

SEQ ID NO: 50149 - protein, 9 aa, Homo sapiens
  light chain complementarity determining region 3 for antibody 25075
HQSSSLPQT

SEQ ID NO: 50150 - protein, 24 aa, Homo sapiens
  heavy chain complementarity determining region 3 for antibody 25075
ARGRPPSGWYRLKDRTYYYYGLDV

SEQ ID NO: 50151 - protein, 9 aa, Homo sapiens
  light chain complementarity determining region 3 for antibody 25076
QQYYSVPRT

SEQ ID NO: 50152 - protein, 17 aa, Homo sapiens
  heavy chain complementarity determining region 3 for antibody 25076
ARGSSSGPCTSCEYFQH

SEQ ID NO: 50153 - protein, 9 aa, Homo sapiens
  light chain complementarity determining region 3 for antibody 25077
QQYYSTPYT

SEQ ID NO: 50154 - protein, 20 aa, Homo sapiens
  heavy chain complementarity determining region 3 for antibody 25077
ARGNYSSSWHTTDYYYGMHV

SEQ ID NO: 50155 - protein, 9 aa, Homo sapiens
  light chain complementarity determining region 3 for antibody 25078
QQYNTYLYT

SEQ ID NO: 50156 - protein, 16 aa, Homo sapiens
  heavy chain complementarity determining region 3 for antibody 25078
ASAPPGLDWFLHYFDS

SEQ ID NO: 50157 - protein, 10 aa, Homo sapiens
  light chain complementarity determining region 3 for antibody 25079
QQYNTWPPWT

SEQ ID NO: 50158 - protein, 13 aa, Homo sapiens
  heavy chain complementarity determining region 3 for antibody 25079
AKDLATVTTAFDY

SEQ ID NO: 50159 - protein, 9 aa, Homo sapiens
  light chain complementarity determining region 3 for antibody 25080
QQYNSYYPT

SEQ ID NO: 50160 - protein, 15 aa, Homo sapiens
  heavy chain complementarity determining region 3 for antibody 25080
AKGPVVTTLSDAFHM

SEQ ID NO: 50161 - protein, 10 aa, Homo sapiens
  light chain complementarity determining region 3 for antibody 25081
QQYNSYSPIT

SEQ ID NO: 50162 - protein, 15 aa, Homo sapiens
  heavy chain complementarity determining region 3 for antibody 25081
AKDPSCDSIWNYFDY

SEQ ID NO: 50163 - protein, 9 aa, Homo sapiens
  light chain complementarity determining region 3 for antibody 25082
QQYNSYRWT

SEQ ID NO: 50164 - protein, 14 aa, Homo sapiens
  heavy chain complementarity determining region 3 for antibody 25082
ATRLRWELRDAFDV

SEQ ID NO: 50165 - protein, 9 aa, Homo sapiens
  light chain complementarity determining region 3 for antibody 25083
QQYNSYPLT

SEQ ID NO: 50166 - protein, 18 aa, Homo sapiens
  heavy chain complementarity determining region 3 for antibody 25083
ARITGRRDGSDWALWFDP

SEQ ID NO: 50167 - protein, 9 aa, Homo sapiens
  light chain complementarity determining region 3 for antibody 25084
QQYNSYPFT

SEQ ID NO: 50168 - protein, 16 aa, Homo sapiens
  heavy chain complementarity determining region 3 for antibody 25084
AKERVGSGWSLDVFDY

SEQ ID NO: 50169 - protein, 8 aa, Homo sapiens
  light chain complementarity determining region 3 for antibody 25085
QQYNNWLT

SEQ ID NO: 50170 - protein, 14 aa, Homo sapiens
  heavy chain complementarity determining region 3 for antibody 25085
AGGDFCGGDCYSEY

SEQ ID NO: 50171 - protein, 9 aa, Homo sapiens
  light chain complementarity determining region 3 for antibody 25086
QQYNHWLYT

SEQ ID NO: 50172 - protein, 13 aa, Homo sapiens
  heavy chain complementarity determining region 3 for antibody 25086
ARMDSVGYGFFDY

SEQ ID NO: 50173 - protein, 9 aa, Homo sapiens
  light chain complementarity determining region 3 for antibody 25087
QQYKSYPWT

SEQ ID NO: 50174 - protein, 13 aa, Homo sapiens
  heavy chain complementarity determining region 3 for antibody 25087
AREGTGNLGGFDS

SEQ ID NO: 50175 - protein, 9 aa, Homo sapiens
  light chain complementarity determining region 3 for antibody 25088
QQYHSDPLT

SEQ ID NO: 50176 - protein, 10 aa, Homo sapiens
  heavy chain complementarity determining region 3 for antibody 25088
AGGTGWILDT

SEQ ID NO: 50177 - protein, 9 aa, Homo sapiens
  light chain complementarity determining region 3 for antibody 25089
QQYGSLPLP

SEQ ID NO: 50178 - protein, 15 aa, Homo sapiens
  heavy chain complementarity determining region 3 for antibody 25089
AHRPNYYDKAGAFDI

SEQ ID NO: 50179 - protein, 8 aa, Homo sapiens
  light chain complementarity determining region 3 for antibody 25090
QQYGCSPS

SEQ ID NO: 50180 - protein, 16 aa, Homo sapiens
  heavy chain complementarity determining region 3 for antibody 25090
ATDWGSGTQWIRAFDV

SEQ ID NO: 50181 - protein, 9 aa, Homo sapiens
  light chain complementarity determining region 3 for antibody 25091
QQYENFPYT

SEQ ID NO: 50182 - protein, 12 aa, Homo sapiens
  heavy chain complementarity determining region 3 for antibody 25091
VIYDVLDGHHNH

SEQ ID NO: 50183 - protein, 10 aa, Homo sapiens
  light chain complementarity determining region 3 for antibody 25092
QQYDYVLGVT

SEQ ID NO: 50184 - protein, 15 aa, Homo sapiens
  heavy chain complementarity determining region 3 for antibody 25092
ARDKAGGDYFYGMDV

SEQ ID NO: 50185 - protein, 8 aa, Homo sapiens
  light chain complementarity determining region 3 for antibody 25093
QQYDYLWT

SEQ ID NO: 50186 - protein, 10 aa, Homo sapiens
  heavy chain complementarity determining region 3 for antibody 25093
AGREVSGSPF

SEQ ID NO: 50187 - protein, 10 aa, Homo sapiens
  light chain complementarity determining region 3 for antibody 25094
QQYDNLPMYT

SEQ ID NO: 50188 - protein, 14 aa, Homo sapiens
  heavy chain complementarity determining region 3 for antibody 25094
ARMTSSWYPEYFHH

SEQ ID NO: 50189 - protein, 9 aa, Homo sapiens
  light chain complementarity determining region 3 for antibody 25095
QQYDAYSYT

SEQ ID NO: 50190 - protein, 16 aa, Homo sapiens
  heavy chain complementarity determining region 3 for antibody 25095
ARQSKVVPGSKNAFDV

SEQ ID NO: 50191 - protein, 10 aa, Homo sapiens
  light chain complementarity determining region 3 for antibody 25096
QQTYNVSAIT

SEQ ID NO: 50192 - protein, 9 aa, Homo sapiens
  heavy chain complementarity determining region 3 for antibody 25096
ARNQYRFDY

SEQ ID NO: 50193 - protein, 9 aa, Homo sapiens
  light chain complementarity determining region 3 for antibody 25097
QQSYSYPQT

SEQ ID NO: 50194 - protein, 11 aa, Homo sapiens
  heavy chain complementarity determining region 3 for antibody 25097
AREWSQNYFDY

SEQ ID NO: 50195 - protein, 9 aa, Homo sapiens
  light chain complementarity determining region 3 for antibody 25098
QQSYSTRLT

SEQ ID NO: 50196 - protein, 19 aa, Homo sapiens
  heavy chain complementarity determining region 3 for antibody 25098
ATFRGDSYRNPRHFDAFNI

SEQ ID NO: 50197 - protein, 9 aa, Homo sapiens
  light chain complementarity determining region 3 for antibody 25099
QQSYSTPYT

SEQ ID NO: 50198 - protein, 12 aa, Homo sapiens
  heavy chain complementarity determining region 3 for antibody 25099
ARRLGVSGSYHN

SEQ ID NO: 50199 - protein, 9 aa, Homo sapiens
  light chain complementarity determining region 3 for antibody 25100
QQSYSTPRT

SEQ ID NO: 50200 - protein, 14 aa, Homo sapiens
  heavy chain complementarity determining region 3 for antibody 25100
AREGRDFWSGYYDY

SEQ ID NO: 50201 - protein, 10 aa, Homo sapiens
  light chain complementarity determining region 3 for antibody 25101
QQSYSTLMYT

SEQ ID NO: 50202 - protein, 20 aa, Homo sapiens
  heavy chain complementarity determining region 3 for antibody 25101
ARHLGYCTGGSCYSYYGLDV

SEQ ID NO: 50203 - protein, 10 aa, Homo sapiens
  light chain complementarity determining region 3 for antibody 25102
QQSYSISSIT

SEQ ID NO: 50204 - protein, 18 aa, Homo sapiens
  heavy chain complementarity determining region 3 for antibody 25102
AKDMGRGNNYVLSGNFDF

SEQ ID NO: 50205 - protein, 9 aa, Homo sapiens
  light chain complementarity determining region 3 for antibody 25103
QQSYSIPLT

SEQ ID NO: 50206 - protein, 15 aa, Homo sapiens
  heavy chain complementarity determining region 3 for antibody 25103
ARWGGGYDYYYGIDV

SEQ ID NO: 50207 - protein, 10 aa, Homo sapiens
  light chain complementarity determining region 3 for antibody 25104
QQSYSGLYWT

SEQ ID NO: 50208 - protein, 25 aa, Homo sapiens
  heavy chain complementarity determining region 3 for antibody 25104
VRVHNFEGNIYNWPFRDLINGAFGI

SEQ ID NO: 50209 - protein, 9 aa, Homo sapiens
  light chain complementarity determining region 3 for antibody 25105
QQSYNTPYT

SEQ ID NO: 50210 - protein, 19 aa, Homo sapiens
  heavy chain complementarity determining region 3 for antibody 25105
ARGFSSDIVVVPGLAAFDI

SEQ ID NO: 50211 - protein, 9 aa, Homo sapiens
  light chain complementarity determining region 3 for antibody 25106
QQSYISPWT

SEQ ID NO: 50212 - protein, 13 aa, Homo sapiens
  heavy chain complementarity determining region 3 for antibody 25106
ARTPHFAWDAGRY

SEQ ID NO: 50213 - protein, 7 aa, Homo sapiens
  light chain complementarity determining region 3 for antibody 25107
QQSYGFT

SEQ ID NO: 50214 - protein, 16 aa, Homo sapiens
  heavy chain complementarity determining region 3 for antibody 25107
ARGGASGSRSASYFDY

SEQ ID NO: 50215 - protein, 8 aa, Homo sapiens
  light chain complementarity determining region 3 for antibody 25108
QQSSSSLT

SEQ ID NO: 50216 - protein, 18 aa, Homo sapiens
  heavy chain complementarity determining region 3 for antibody 25108
ARTFSTRVGYSGYEYFDY

SEQ ID NO: 50217 - protein, 9 aa, Homo sapiens
  light chain complementarity determining region 3 for antibody 25109
QQSHTTPWT

SEQ ID NO: 50218 - protein, 11 aa, Homo sapiens
  heavy chain complementarity determining region 3 for antibody 25109
ARAALTYYFDY

SEQ ID NO: 50219 - protein, 9 aa, Homo sapiens
  light chain complementarity determining region 3 for antibody 25110
QQSFTTLVT

SEQ ID NO: 50220 - protein, 11 aa, Homo sapiens
  heavy chain complementarity determining region 3 for antibody 25110
ARGGNWNYFNQ

SEQ ID NO: 50221 - protein, 9 aa, Homo sapiens
  light chain complementarity determining region 3 for antibody 25111
QQSDISPYT

SEQ ID NO: 50222 - protein, 14 aa, Homo sapiens
  heavy chain complementarity determining region 3 for antibody 25111
ARGGRLRLFSFSDY

SEQ ID NO: 50223 - protein, 10 aa, Homo sapiens
  light chain complementarity determining region 3 for antibody 25112
QQRTNWPPIT

SEQ ID NO: 50224 - protein, 9 aa, Homo sapiens
  heavy chain complementarity determining region 3 for antibody 25112
ATYGSGRPY

SEQ ID NO: 50225 - protein, 10 aa, Homo sapiens
  light chain complementarity determining region 3 for antibody 25113
QQLNSAFLFT

SEQ ID NO: 50226 - protein, 17 aa, Homo sapiens
  heavy chain complementarity determining region 3 for antibody 25113
ARDKLRFLEGIPYGLDV

SEQ ID NO: 50227 - protein, 9 aa, Homo sapiens
  light chain complementarity determining region 3 for antibody 25114
QQHNNWPYT

SEQ ID NO: 50228 - protein, 12 aa, Homo sapiens
  heavy chain complementarity determining region 3 for antibody 25114
ANRIAVAGTLDH

SEQ ID NO: 50229 - protein, 9 aa, Homo sapiens
  light chain complementarity determining region 3 for antibody 25115
QQGNSFPPT

SEQ ID NO: 50230 - protein, 20 aa, Homo sapiens
  heavy chain complementarity determining region 3 for antibody 25115
ARESWWELKEGRWKFDAFDI

SEQ ID NO: 50231 - protein, 9 aa, Homo sapiens
  light chain complementarity determining region 3 for antibody 25116
QQFNTYLLT

SEQ ID NO: 50232 - protein, 12 aa, Homo sapiens
  heavy chain complementarity determining region 3 for antibody 25116
ARGSVGGWYFDL

SEQ ID NO: 50233 - protein, 10 aa, Homo sapiens
  light chain complementarity determining region 3 for antibody 25117
QQCHTFSRVT

SEQ ID NO: 50234 - protein, 17 aa, Homo sapiens
  heavy chain complementarity determining region 3 for antibody 25117
ARTRVTGGYLRRGAFDI

SEQ ID NO: 50235 - protein, 9 aa, Homo sapiens
  light chain complementarity determining region 3 for antibody 25118
QQCATSPLT

SEQ ID NO: 50236 - protein, 10 aa, Homo sapiens
  heavy chain complementarity determining region 3 for antibody 25118
AWGRGWTSDY

SEQ ID NO: 50237 - protein, 9 aa, Homo sapiens
  light chain complementarity determining region 3 for antibody 25119
QQAHSLPFT

SEQ ID NO: 50238 - protein, 18 aa, Homo sapiens
  heavy chain complementarity determining region 3 for antibody 25119
AKEGSGMGVAMRYWYFDV

SEQ ID NO: 50239 - protein, 9 aa, Homo sapiens
  light chain complementarity determining region 3 for antibody 25120
QKYSSVPIT

SEQ ID NO: 50240 - protein, 15 aa, Homo sapiens
  heavy chain complementarity determining region 3 for antibody 25120
AHSQCTGGTCFLLDY

SEQ ID NO: 50241 - protein, 9 aa, Homo sapiens
  light chain complementarity determining region 3 for antibody 25121
QKYNSAPWT

SEQ ID NO: 50242 - protein, 15 aa, Homo sapiens
  heavy chain complementarity determining region 3 for antibody 25121
ARVRGDYVLFDAFDI

SEQ ID NO: 50243 - protein, 9 aa, Homo sapiens
  light chain complementarity determining region 3 for antibody 25122
QKYDTYPWT

SEQ ID NO: 50244 - protein, 17 aa, Homo sapiens
  heavy chain complementarity determining region 3 for antibody 25122
ARQRRAKWERQTEAFDI

SEQ ID NO: 50245 - protein, 9 aa, Homo sapiens
  light chain complementarity determining region 3 for antibody 25123
QHYNIYQGT

SEQ ID NO: 50246 - protein, 12 aa, Homo sapiens
  heavy chain complementarity determining region 3 for antibody 25123
AKDRLLHKVLTN

SEQ ID NO: 50247 - protein, 9 aa, Homo sapiens
  light chain complementarity determining region 3 for antibody 25124
QHYKTYPET

SEQ ID NO: 50248 - protein, 12 aa, Homo sapiens
  heavy chain complementarity determining region 3 for antibody 25124
ARADRSGWYNDY

SEQ ID NO: 50249 - protein, 9 aa, Homo sapiens
  light chain complementarity determining region 3 for antibody 25125
QHYKSYPYT

SEQ ID NO: 50250 - protein, 19 aa, Homo sapiens
  heavy chain complementarity determining region 3 for antibody 25125
AKGDDDSCGYTYYCRGLDV

SEQ ID NO: 50251 - protein, 11 aa, Homo sapiens
  light chain complementarity determining region 3 for antibody 25126
QHRSNWPPPYT

SEQ ID NO: 50252 - protein, 18 aa, Homo sapiens
  heavy chain complementarity determining region 3 for antibody 25126
ARAVVAGTPVLYYYGMDV

SEQ ID NO: 50253 - protein, 9 aa, Homo sapiens
  light chain complementarity determining region 3 for antibody 25127
QEYHSHPLT

SEQ ID NO: 50254 - protein, 6 aa, Homo sapiens
  heavy chain complementarity determining region 3 for antibody 25127
VRMEAA

SEQ ID NO: 50255 - protein, 9 aa, Homo sapiens
  light chain complementarity determining region 3 for antibody 25128
MQSLQTPRT

SEQ ID NO: 50256 - protein, 30 aa, Homo sapiens
  heavy chain complementarity determining region 3 for antibody 25128
ARGLTRTLPFIDKFGSGTNLPQPEVEWFDP

SEQ ID NO: 50257 - protein, 9 aa, Homo sapiens
  light chain complementarity determining region 3 for antibody 25129
MQGTHWPYT

SEQ ID NO: 50258 - protein, 11 aa, Homo sapiens
  heavy chain complementarity determining region 3 for antibody 25129
ATLRTVGAVDY

SEQ ID NO: 50259 - protein, 8 aa, Homo sapiens
  light chain complementarity determining region 3 for antibody 25130
MQALQTPG

SEQ ID NO: 50260 - protein, 19 aa, Homo sapiens
  heavy chain complementarity determining region 3 for antibody 25130
ANFGSGNFYNVRYYYGMDV

SEQ ID NO: 50261 - protein, 9 aa, Homo sapiens
  light chain complementarity determining region 3 for antibody 25131
LQHNTYPLT

SEQ ID NO: 50262 - protein, 21 aa, Homo sapiens
  heavy chain complementarity determining region 3 for antibody 25131
ARGEHVVVVTSFRGRSQGINS

SEQ ID NO: 50263 - protein, 9 aa, Homo sapiens
  light chain complementarity determining region 3 for antibody 25132
LQHNSFPRT

SEQ ID NO: 50264 - protein, 16 aa, Homo sapiens
  heavy chain complementarity determining region 3 for antibody 25132
ARPGLPSSYGSSSYSH

SEQ ID NO: 50265 - protein, 9 aa, Homo sapiens
  light chain complementarity determining region 3 for antibody 25133
LQDYTYPWT

SEQ ID NO: 50266 - protein, 23 aa, Homo sapiens
  heavy chain complementarity determining region 3 for antibody 25133
ARDFGQRERVRLIYKYNNYGMDV

SEQ ID NO: 50267 - protein, 9 aa, Homo sapiens
  light chain complementarity determining region 3 for antibody 25134
LQDYNYPRT

SEQ ID NO: 50268 - protein, 23 aa, Homo sapiens
  heavy chain complementarity determining region 3 for antibody 25134
ALMAKQSPYCSSTSCRDYYGMDV

SEQ ID NO: 50269 - protein, 8 aa, Homo sapiens
  light chain complementarity determining region 3 for antibody 25135
HQYRDSFP

SEQ ID NO: 50270 - protein, 13 aa, Homo sapiens
  heavy chain complementarity determining region 3 for antibody 25135
ATESGKYQGALDF

SEQ ID NO: 50271 - protein, 8 aa, Homo sapiens
  light chain complementarity determining region 3 for antibody 25136
HQYNGYWT

SEQ ID NO: 50272 - protein, 21 aa, Homo sapiens
  heavy chain complementarity determining region 3 for antibody 25136
TTRSDDYLWGSYRLLAYRFDY

SEQ ID NO: 50273 - protein, 9 aa, Homo sapiens
  light chain complementarity determining region 3 for antibody 25137
HQYGSLPGT

SEQ ID NO: 50274 - protein, 20 aa, Homo sapiens
  heavy chain complementarity determining region 3 for antibody 25137
ARPRGVSHLATAGSPDYFDL

SEQ ID NO: 50275 - protein, 9 aa, Homo sapiens
  light chain complementarity determining region 3 for antibody 25138
VQGKYWPYT

SEQ ID NO: 50276 - protein, 11 aa, Homo sapiens
  heavy chain complementarity determining region 3 for antibody 25138
AKDDAAGSIDS

SEQ ID NO: 50277 - protein, 10 aa, Homo sapiens
  light chain complementarity determining region 3 for antibody 25139
QRYDYLPSLT

SEQ ID NO: 50278 - protein, 17 aa, Homo sapiens
  heavy chain complementarity determining region 3 for antibody 25139
ARLYCGGDCYSLGYLDH

SEQ ID NO: 50279 - protein, 9 aa, Homo sapiens
  light chain complementarity determining region 3 for antibody 25140
QQYYTTPRP

SEQ ID NO: 50280 - protein, 8 aa, Homo sapiens
  heavy chain complementarity determining region 3 for antibody 25140
ARDGAFDS

SEQ ID NO: 50281 - protein, 9 aa, Homo sapiens
  light chain complementarity determining region 3 for antibody 25141
QQYYSSPPT

SEQ ID NO: 50282 - protein, 13 aa, Homo sapiens
  heavy chain complementarity determining region 3 for antibody 25141
ARQAYGSGSYYNV

SEQ ID NO: 50283 - protein, 10 aa, Homo sapiens
  light chain complementarity determining region 3 for antibody 25142
QQYYSARPFT

SEQ ID NO: 50284 - protein, 11 aa, Homo sapiens
  heavy chain complementarity determining region 3 for antibody 25142
AGGHGGNLEDY

SEQ ID NO: 50285 - protein, 9 aa, Homo sapiens
  light chain complementarity determining region 3 for antibody 25143
QQYYGAPLS

SEQ ID NO: 50286 - protein, 10 aa, Homo sapiens
  heavy chain complementarity determining region 3 for antibody 25143
AKDSYSKADY

SEQ ID NO: 50287 - protein, 9 aa, Homo sapiens
  light chain complementarity determining region 3 for antibody 25144
QQYRSLPYT

SEQ ID NO: 50288 - protein, 24 aa, Homo sapiens
  heavy chain complementarity determining region 3 for antibody 25144
ATDLVVVTATTHNPLHEGPADADY

SEQ ID NO: 50289 - protein, 9 aa, Homo sapiens
  light chain complementarity determining region 3 for antibody 25145
QQYRGDPYS

SEQ ID NO: 50290 - protein, 20 aa, Homo sapiens
  heavy chain complementarity determining region 3 for antibody 25145
ARDVDYCENGVCYSYWYFDL

SEQ ID NO: 50291 - protein, 8 aa, Homo sapiens
  light chain complementarity determining region 3 for antibody 25146
QQYNSYWT

SEQ ID NO: 50292 - protein, 20 aa, Homo sapiens
  heavy chain complementarity determining region 3 for antibody 25146
ARYGQTYYDFWSGKETHFDY

SEQ ID NO: 50293 - protein, 9 aa, Homo sapiens
  light chain complementarity determining region 3 for antibody 25147
QQYNSYPWT

SEQ ID NO: 50294 - protein, 20 aa, Homo sapiens
  heavy chain complementarity determining region 3 for antibody 25147
ATGSALFYYDTRVRGYYFDS

SEQ ID NO: 50295 - protein, 10 aa, Homo sapiens
  light chain complementarity determining region 3 for antibody 25148
QQYNNWPPYT

SEQ ID NO: 50296 - protein, 20 aa, Homo sapiens
  heavy chain complementarity determining region 3 for antibody 25148
AKDSNYYGSGSYYNSHFFQH

SEQ ID NO: 50297 - protein, 9 aa, Homo sapiens
  light chain complementarity determining region 3 for antibody 25149
QQYNNWPLT

SEQ ID NO: 50298 - protein, 14 aa, Homo sapiens
  heavy chain complementarity determining region 3 for antibody 25149
ARNTGSGVGFYSDY

SEQ ID NO: 50299 - protein, 9 aa, Homo sapiens
  light chain complementarity determining region 3 for antibody 25150
QQYKGYSYT

SEQ ID NO: 50300 - protein, 16 aa, Homo sapiens
  heavy chain complementarity determining region 3 for antibody 25150
ARVTIRGNWFWTPFEY

SEQ ID NO: 50301 - protein, 11 aa, Homo sapiens
  light chain complementarity determining region 3 for antibody 25151
QQYITSPPGYT

SEQ ID NO: 50302 - protein, 11 aa, Homo sapiens
  heavy chain complementarity determining region 3 for antibody 25151
ARHGNGYYFDY

SEQ ID NO: 50303 - protein, 8 aa, Homo sapiens
  light chain complementarity determining region 3 for antibody 25152
QQYHHLLT

SEQ ID NO: 50304 - protein, 11 aa, Homo sapiens
  heavy chain complementarity determining region 3 for antibody 25152
ARRRFTDAFDI

SEQ ID NO: 50305 - protein, 9 aa, Homo sapiens
  light chain complementarity determining region 3 for antibody 25153
QQYGTSPFT

SEQ ID NO: 50306 - protein, 15 aa, Homo sapiens
  heavy chain complementarity determining region 3 for antibody 25153
ARQNDFLSGPGEFDP

SEQ ID NO: 50307 - protein, 9 aa, Homo sapiens
  light chain complementarity determining region 3 for antibody 25154
QQYGSSSIT

SEQ ID NO: 50308 - protein, 13 aa, Homo sapiens
  heavy chain complementarity determining region 3 for antibody 25154
VKEFFMVFDAFHM

SEQ ID NO: 50309 - protein, 9 aa, Homo sapiens
  light chain complementarity determining region 3 for antibody 25155
QQYGSSPLT

SEQ ID NO: 50310 - protein, 20 aa, Homo sapiens
  heavy chain complementarity determining region 3 for antibody 25155
ARSLFIVPRSVAVTGTALGY

SEQ ID NO: 50311 - protein, 9 aa, Homo sapiens
  light chain complementarity determining region 3 for antibody 25156
QQYGSSLYP

SEQ ID NO: 50312 - protein, 9 aa, Homo sapiens
  heavy chain complementarity determining region 3 for antibody 25156
IYEINAFDI

SEQ ID NO: 50313 - protein, 10 aa, Homo sapiens
  light chain complementarity determining region 3 for antibody 25157
QQYGRSPWGA

SEQ ID NO: 50314 - protein, 17 aa, Homo sapiens
  heavy chain complementarity determining region 3 for antibody 25157
AKDYGTVTKDLVGYLDY

SEQ ID NO: 50315 - protein, 9 aa, Homo sapiens
  light chain complementarity determining region 3 for antibody 25158
QQYGNLPFT

SEQ ID NO: 50316 - protein, 24 aa, Homo sapiens
  heavy chain complementarity determining region 3 for antibody 25158
ARCRYHHHAFWNGPGSFYYYAMDV

SEQ ID NO: 50317 - protein, 9 aa, Homo sapiens
  light chain complementarity determining region 3 for antibody 25159
QQYDTPPWT

SEQ ID NO: 50318 - protein, 13 aa, Homo sapiens
  heavy chain complementarity determining region 3 for antibody 25159
ARETLIHLPAFEH

SEQ ID NO: 50319 - protein, 8 aa, Homo sapiens
  light chain complementarity determining region 3 for antibody 25160
QQYDRYPS

SEQ ID NO: 50320 - protein, 15 aa, Homo sapiens
  heavy chain complementarity determining region 3 for antibody 25160
VKRGDDGRYPGYFDL

SEQ ID NO: 50321 - protein, 9 aa, Homo sapiens
  light chain complementarity determining region 3 for antibody 25161
QQYDNLPYT

SEQ ID NO: 50322 - protein, 9 aa, Homo sapiens
  heavy chain complementarity determining region 3 for antibody 25161
ARGDYSFDY

SEQ ID NO: 50323 - protein, 9 aa, Homo sapiens
  light chain complementarity determining region 3 for antibody 25162
QQYDFFRET

SEQ ID NO: 50324 - protein, 16 aa, Homo sapiens
  heavy chain complementarity determining region 3 for antibody 25162
ARWGVECSGGYCYFEY

SEQ ID NO: 50325 - protein, 9 aa, Homo sapiens
  light chain complementarity determining region 3 for antibody 25163
QQTYSPPFT

SEQ ID NO: 50326 - protein, 14 aa, Homo sapiens
  heavy chain complementarity determining region 3 for antibody 25163
ARGRDTSGYSGLDH

SEQ ID NO: 50327 - protein, 8 aa, Homo sapiens
  light chain complementarity determining region 3 for antibody 25164
QQTYRTPR

SEQ ID NO: 50328 - protein, 16 aa, Homo sapiens
  heavy chain complementarity determining region 3 for antibody 25164
ARDLADVWRFSWRFDP

SEQ ID NO: 50329 - protein, 9 aa, Homo sapiens
  light chain complementarity determining region 3 for antibody 25165
QQTNITQCT

SEQ ID NO: 50330 - protein, 14 aa, Homo sapiens
  heavy chain complementarity determining region 3 for antibody 25165
TRAPSRIGIYYPQL

SEQ ID NO: 50331 - protein, 10 aa, Homo sapiens
  light chain complementarity determining region 3 for antibody 25166
QQTFSTLALT

SEQ ID NO: 50332 - protein, 14 aa, Homo sapiens
  heavy chain complementarity determining region 3 for antibody 25166
ATMTGRDFYNWFDP

SEQ ID NO: 50333 - protein, 10 aa, Homo sapiens
  light chain complementarity determining region 3 for antibody 25167
QQTFSPLALT

SEQ ID NO: 50334 - protein, 23 aa, Homo sapiens
  heavy chain complementarity determining region 3 for antibody 25167
ARTPPFGDLSSVTFYQFFYGMDV

SEQ ID NO: 50335 - protein, 9 aa, Homo sapiens
  light chain complementarity determining region 3 for antibody 25168
QQSYSTPHT

SEQ ID NO: 50336 - protein, 17 aa, Homo sapiens
  heavy chain complementarity determining region 3 for antibody 25168
ARVVRLTSKGFFDWFDP

SEQ ID NO: 50337 - protein, 8 aa, Homo sapiens
  light chain complementarity determining region 3 for antibody 25169
QQSYSTLT

SEQ ID NO: 50338 - protein, 10 aa, Homo sapiens
  heavy chain complementarity determining region 3 for antibody 25169
VSAGYYSLDY

SEQ ID NO: 50339 - protein, 10 aa, Homo sapiens
  light chain complementarity determining region 3 for antibody 25170
QQSNSIFPHT

SEQ ID NO: 50340 - protein, 13 aa, Homo sapiens
  heavy chain complementarity determining region 3 for antibody 25170
ARDTIPGMSVLDV

SEQ ID NO: 50341 - protein, 9 aa, Homo sapiens
  light chain complementarity determining region 3 for antibody 25171
QQSNITPWT

SEQ ID NO: 50342 - protein, 19 aa, Homo sapiens
  heavy chain complementarity determining region 3 for antibody 25171
ARNRRYGSGIAEYYYGLDV

SEQ ID NO: 50343 - protein, 9 aa, Homo sapiens
  light chain complementarity determining region 3 for antibody 25172
QQSDSTPPT

SEQ ID NO: 50344 - protein, 11 aa, Homo sapiens
  heavy chain complementarity determining region 3 for antibody 25172
TGERAGTIVDF

SEQ ID NO: 50345 - protein, 10 aa, Homo sapiens
  light chain complementarity determining region 3 for antibody 25173
QQRSNWPRLT

SEQ ID NO: 50346 - protein, 11 aa, Homo sapiens
  heavy chain complementarity determining region 3 for antibody 25173
ARAALTYYFDY

SEQ ID NO: 50347 - protein, 8 aa, Homo sapiens
  light chain complementarity determining region 3 for antibody 25174
QQRSNWLT

SEQ ID NO: 50348 - protein, 13 aa, Homo sapiens
  heavy chain complementarity determining region 3 for antibody 25174
AKLLYGAHSEFDY

SEQ ID NO: 50349 - protein, 10 aa, Homo sapiens
  light chain complementarity determining region 3 for antibody 25175
QQRSDWPPLP

SEQ ID NO: 50350 - protein, 10 aa, Homo sapiens
  heavy chain complementarity determining region 3 for antibody 25175
ARDYTMTFDY

SEQ ID NO: 50351 - protein, 9 aa, Homo sapiens
  light chain complementarity determining region 3 for antibody 25176
QQNYNTPYT

SEQ ID NO: 50352 - protein, 12 aa, Homo sapiens
  heavy chain complementarity determining region 3 for antibody 25176
ARGDMIRAAFHP

SEQ ID NO: 50353 - protein, 10 aa, Homo sapiens
  light chain complementarity determining region 3 for antibody 25177
QQLNSYPSFT

SEQ ID NO: 50354 - protein, 13 aa, Homo sapiens
  heavy chain complementarity determining region 3 for antibody 25177
ALEVVGPSRGFHP

SEQ ID NO: 50355 - protein, 9 aa, Homo sapiens
  light chain complementarity determining region 3 for antibody 25178
QQGHIYPFT

SEQ ID NO: 50356 - protein, 12 aa, Homo sapiens
  heavy chain complementarity determining region 3 for antibody 25178
ARPLDGDFGFDP

SEQ ID NO: 50357 - protein, 9 aa, Homo sapiens
  light chain complementarity determining region 3 for antibody 25179
QQFNVLPII

SEQ ID NO: 50358 - protein, 18 aa, Homo sapiens
  heavy chain complementarity determining region 3 for antibody 25179
AKLGRYHYDSKTHDAFDL

SEQ ID NO: 50359 - protein, 9 aa, Homo sapiens
  light chain complementarity determining region 3 for antibody 25180
QQANSFPRT

SEQ ID NO: 50360 - protein, 18 aa, Homo sapiens
  heavy chain complementarity determining region 3 for antibody 25180
ARGWPDYGDYLKIGAFDI

SEQ ID NO: 50361 - protein, 9 aa, Homo sapiens
  light chain complementarity determining region 3 for antibody 25181
QQANSFPIT

SEQ ID NO: 50362 - protein, 15 aa, Homo sapiens
  heavy chain complementarity determining region 3 for antibody 25181
VRAAVPVLGYNWFDP

SEQ ID NO: 50363 - protein, 9 aa, Homo sapiens
  light chain complementarity determining region 3 for antibody 25182
QQANSFPFT

SEQ ID NO: 50364 - protein, 13 aa, Homo sapiens
  heavy chain complementarity determining region 3 for antibody 25182
ARDRGYSGYDFGY

SEQ ID NO: 50365 - protein, 9 aa, Homo sapiens
  light chain complementarity determining region 3 for antibody 25183
QQANRFPPT

SEQ ID NO: 50366 - protein, 16 aa, Homo sapiens
  heavy chain complementarity determining region 3 for antibody 25183
AKYMWIVVVSPATFDS

SEQ ID NO: 50367 - protein, 10 aa, Homo sapiens
  light chain complementarity determining region 3 for antibody 25184
QKYGSSPPYT

SEQ ID NO: 50368 - protein, 9 aa, Homo sapiens
  heavy chain complementarity determining region 3 for antibody 25184
GSGTWTIDY

SEQ ID NO: 50369 - protein, 10 aa, Homo sapiens
  light chain complementarity determining region 3 for antibody 25185
QHYDNLPSII

SEQ ID NO: 50370 - protein, 11 aa, Homo sapiens
  heavy chain complementarity determining region 3 for antibody 25185
ARAPYGAKIDS

SEQ ID NO: 50371 - protein, 9 aa, Homo sapiens
  light chain complementarity determining region 3 for antibody 25186
QEYNGAPWT

SEQ ID NO: 50372 - protein, 16 aa, Homo sapiens
  heavy chain complementarity determining region 3 for antibody 25186
ARDDGDSRVVLAALDY

SEQ ID NO: 50373 - protein, 9 aa, Homo sapiens
  light chain complementarity determining region 3 for antibody 25187
MQTFQIPLT

SEQ ID NO: 50374 - protein, 11 aa, Homo sapiens
  heavy chain complementarity determining region 3 for antibody 25187
AHKSSGSSYTS

SEQ ID NO: 50375 - protein, 9 aa, Homo sapiens
  light chain complementarity determining region 3 for antibody 25188
MQRRRWPHT

SEQ ID NO: 50376 - protein, 8 aa, Homo sapiens
  heavy chain complementarity determining region 3 for antibody 25188
TAWGSSQH

SEQ ID NO: 50377 - protein, 9 aa, Homo sapiens
  light chain complementarity determining region 3 for antibody 25189
MQGTHWPLE

SEQ ID NO: 50378 - protein, 18 aa, Homo sapiens
  heavy chain complementarity determining region 3 for antibody 25189
ARDERDTCRNGLCYYFDY

SEQ ID NO: 50379 - protein, 9 aa, Homo sapiens
  light chain complementarity determining region 3 for antibody 25190
MQGSHWPHT

SEQ ID NO: 50380 - protein, 11 aa, Homo sapiens
  heavy chain complementarity determining region 3 for antibody 25190
ARDPAWGARDY

SEQ ID NO: 50381 - protein, 9 aa, Homo sapiens
  light chain complementarity determining region 3 for antibody 25191
MQGPQWPGT

SEQ ID NO: 50382 - protein, 7 aa, Homo sapiens
  heavy chain complementarity determining region 3 for antibody 25191
STDFLDL

SEQ ID NO: 50383 - protein, 9 aa, Homo sapiens
  light chain complementarity determining region 3 for antibody 25192
MQGLQGLPS

SEQ ID NO: 50384 - protein, 16 aa, Homo sapiens
  heavy chain complementarity determining region 3 for antibody 25192
SPSYYYGSGSGHQTDY

SEQ ID NO: 50385 - protein, 9 aa, Homo sapiens
  light chain complementarity determining region 3 for antibody 25193
MQALRSPWT

SEQ ID NO: 50386 - protein, 12 aa, Homo sapiens
  heavy chain complementarity determining region 3 for antibody 25193
ANNGLEGGTYDR

SEQ ID NO: 50387 - protein, 8 aa, Homo sapiens
  light chain complementarity determining region 3 for antibody 25194
MQALQTST

SEQ ID NO: 50388 - protein, 14 aa, Homo sapiens
  heavy chain complementarity determining region 3 for antibody 25194
ARHLELELPYGMDV

SEQ ID NO: 50389 - protein, 9 aa, Homo sapiens
  light chain complementarity determining region 3 for antibody 25195
MQALQSPPT

SEQ ID NO: 50390 - protein, 26 aa, Homo sapiens
  heavy chain complementarity determining region 3 for antibody 25195
AAPNYHHDSSGYYYVRPVAFHFGMDV

SEQ ID NO: 50391 - protein, 9 aa, Homo sapiens
  light chain complementarity determining region 3 for antibody 25196
LQYRNYTWT

SEQ ID NO: 50392 - protein, 16 aa, Homo sapiens
  heavy chain complementarity determining region 3 for antibody 25196
VKWAPRGLKELRRDDA

SEQ ID NO: 50393 - protein, 9 aa, Homo sapiens
  light chain complementarity determining region 3 for antibody 25197
HQYGDPPRT

SEQ ID NO: 50394 - protein, 16 aa, Homo sapiens
  heavy chain complementarity determining region 3 for antibody 25197
AGLSASGHLAPNTFDV

SEQ ID NO: 50395 - protein, 9 aa, Homo sapiens
  light chain complementarity determining region 3 for antibody 25198
HQSRTFPVT

SEQ ID NO: 50396 - protein, 19 aa, Homo sapiens
  heavy chain complementarity determining region 3 for antibody 25198
ARVSARRILTAPRYPLIDS

SEQ ID NO: 50397 - protein, 8 aa, Homo sapiens
  light chain complementarity determining region 3 for antibody 25199
HQRSNFLS

SEQ ID NO: 50398 - protein, 15 aa, Homo sapiens
  heavy chain complementarity determining region 3 for antibody 25199
ARGGRSMVRLVNEEF

SEQ ID NO: 50399 - protein, 9 aa, Homo sapiens
  light chain complementarity determining region 3 for antibody 25200
HQRGALPWT

SEQ ID NO: 50400 - protein, 14 aa, Homo sapiens
  heavy chain complementarity determining region 3 for antibody 25200
VRDASGNSGWYADS

SEQ ID NO: 50401 - protein, 9 aa, Homo sapiens
  light chain complementarity determining region 3 for antibody 25201
VQYNRNPRT

SEQ ID NO: 50402 - protein, 6 aa, Homo sapiens
  heavy chain complementarity determining region 3 for antibody 25201
TRALDY

SEQ ID NO: 50403 - protein, 9 aa, Homo sapiens
  light chain complementarity determining region 3 for antibody 25202
VQAERFPLT

SEQ ID NO: 50404 - protein, 17 aa, Homo sapiens
  heavy chain complementarity determining region 3 for antibody 25202
VKDRVAAIYGVISDLDS

SEQ ID NO: 50405 - protein, 9 aa, Homo sapiens
  light chain complementarity determining region 3 for antibody 25203
TQLTHWPWT

SEQ ID NO: 50406 - protein, 15 aa, Homo sapiens
  heavy chain complementarity determining region 3 for antibody 25203
ARDSPPRASGDDHIP

SEQ ID NO: 50407 - protein, 11 aa, Homo sapiens
  light chain complementarity determining region 3 for antibody 25204
RQRSDWPLLFT

SEQ ID NO: 50408 - protein, 10 aa, Homo sapiens
  heavy chain complementarity determining region 3 for antibody 25204
AWSSSDWAED

SEQ ID NO: 50409 - protein, 9 aa, Homo sapiens
  light chain complementarity determining region 3 for antibody 25205
QQYYSSPFT

SEQ ID NO: 50410 - protein, 14 aa, Homo sapiens
  heavy chain complementarity determining region 3 for antibody 25205
AMTTVTSVAWYFDL

SEQ ID NO: 50411 - protein, 9 aa, Homo sapiens
  light chain complementarity determining region 3 for antibody 25206
QQYYNWPYT

SEQ ID NO: 50412 - protein, 18 aa, Homo sapiens
  heavy chain complementarity determining region 3 for antibody 25206
ARDSGGSDWYYTMYYFDY

SEQ ID NO: 50413 - protein, 14 aa, Homo sapiens
  light chain complementarity determining region 3 for antibody 25207
QQYYGQQYGTSPIT

SEQ ID NO: 50414 - protein, 15 aa, Homo sapiens
  heavy chain complementarity determining region 3 for antibody 25207
ARHWRGRPDVLPNDL

SEQ ID NO: 50415 - protein, 9 aa, Homo sapiens
  light chain complementarity determining region 3 for antibody 25208
QQYSNWPHT

SEQ ID NO: 50416 - protein, 12 aa, Homo sapiens
  heavy chain complementarity determining region 3 for antibody 25208
ATWGFSLLKEDF

SEQ ID NO: 50417 - protein, 9 aa, Homo sapiens
  light chain complementarity determining region 3 for antibody 25209
QQYNTYPYT

SEQ ID NO: 50418 - protein, 11 aa, Homo sapiens
  heavy chain complementarity determining region 3 for antibody 25209
ARVTWLVIYDS

SEQ ID NO: 50419 - protein, 8 aa, Homo sapiens
  light chain complementarity determining region 3 for antibody 25210
QQYNSWWT

SEQ ID NO: 50420 - protein, 16 aa, Homo sapiens
  heavy chain complementarity determining region 3 for antibody 25210
ARHGWHGWGRRGWFHP

SEQ ID NO: 50421 - protein, 10 aa, Homo sapiens
  light chain complementarity determining region 3 for antibody 25211
QQYNNWPPIT

SEQ ID NO: 50422 - protein, 11 aa, Homo sapiens
  heavy chain complementarity determining region 3 for antibody 25211
ARAYYGEEYDY

SEQ ID NO: 50423 - protein, 11 aa, Homo sapiens
  light chain complementarity determining region 3 for antibody 25212
QQYNNWPPIFT

SEQ ID NO: 50424 - protein, 22 aa, Homo sapiens
  heavy chain complementarity determining region 3 for antibody 25212
AREPFYFGSGSYIQGYWGTFDY

SEQ ID NO: 50425 - protein, 8 aa, Homo sapiens
  light chain complementarity determining region 3 for antibody 25213
QQYKSYSG

SEQ ID NO: 50426 - protein, 19 aa, Homo sapiens
  heavy chain complementarity determining region 3 for antibody 25213
ARRKYISSWYILSDGAFDI

SEQ ID NO: 50427 - protein, 9 aa, Homo sapiens
  light chain complementarity determining region 3 for antibody 25214
QQYKNFPWT

SEQ ID NO: 50428 - protein, 16 aa, Homo sapiens
  heavy chain complementarity determining region 3 for antibody 25214
ARLKRDGGSQQYYFAS

SEQ ID NO: 50429 - protein, 11 aa, Homo sapiens
  light chain complementarity determining region 3 for antibody 25215
QQYGTSPPMYT

SEQ ID NO: 50430 - protein, 23 aa, Homo sapiens
  heavy chain complementarity determining region 3 for antibody 25215
ARGNRGYRRSNSRMDFYNFGMDV

SEQ ID NO: 50431 - protein, 9 aa, Homo sapiens
  light chain complementarity determining region 3 for antibody 25216
QQYGSSPRT

SEQ ID NO: 50432 - protein, 12 aa, Homo sapiens
  heavy chain complementarity determining region 3 for antibody 25216
ARQYSTTWYEDY

SEQ ID NO: 50433 - protein, 10 aa, Homo sapiens
  light chain complementarity determining region 3 for antibody 25217
QQYGSSPMDS

SEQ ID NO: 50434 - protein, 11 aa, Homo sapiens
  heavy chain complementarity determining region 3 for antibody 25217
ARGGQWGSLDY

SEQ ID NO: 50435 - protein, 10 aa, Homo sapiens
  light chain complementarity determining region 3 for antibody 25218
QQYGSSPGFT

SEQ ID NO: 50436 - protein, 17 aa, Homo sapiens
  heavy chain complementarity determining region 3 for antibody 25218
AREISRVREVVIRPVDY

SEQ ID NO: 50437 - protein, 9 aa, Homo sapiens
  light chain complementarity determining region 3 for antibody 25219
QQYGNLPRT

SEQ ID NO: 50438 - protein, 14 aa, Homo sapiens
  heavy chain complementarity determining region 3 for antibody 25219
AGGTFDSSGYYYEY

SEQ ID NO: 50439 - protein, 9 aa, Homo sapiens
  light chain complementarity determining region 3 for antibody 25220
QQYETYPLT

SEQ ID NO: 50440 - protein, 23 aa, Homo sapiens
  heavy chain complementarity determining region 3 for antibody 25220
ARGRTYYFDSSGYPDYYFYLMDV

SEQ ID NO: 50441 - protein, 9 aa, Homo sapiens
  light chain complementarity determining region 3 for antibody 25221
QQYERPPFT

SEQ ID NO: 50442 - protein, 14 aa, Homo sapiens
  heavy chain complementarity determining region 3 for antibody 25221
TSPNKASSRGYFDN

SEQ ID NO: 50443 - protein, 9 aa, Homo sapiens
  light chain complementarity determining region 3 for antibody 25222
QQYDNLSWT

SEQ ID NO: 50444 - protein, 17 aa, Homo sapiens
  heavy chain complementarity determining region 3 for antibody 25222
ARPRGTLDYGDQNAFDI

SEQ ID NO: 50445 - protein, 9 aa, Homo sapiens
  light chain complementarity determining region 3 for antibody 25223
QQYDNLPLT

SEQ ID NO: 50446 - protein, 15 aa, Homo sapiens
  heavy chain complementarity determining region 3 for antibody 25223
ASPAGGTYYHYGMDV

SEQ ID NO: 50447 - protein, 9 aa, Homo sapiens
  light chain complementarity determining region 3 for antibody 25224
QQYCTTPIT

SEQ ID NO: 50448 - protein, 8 aa, Homo sapiens
  heavy chain complementarity determining region 3 for antibody 25224
VKFSDGIK

SEQ ID NO: 50449 - protein, 9 aa, Homo sapiens
  light chain complementarity determining region 3 for antibody 25225
QQVKNDPLT

SEQ ID NO: 50450 - protein, 15 aa, Homo sapiens
  heavy chain complementarity determining region 3 for antibody 25225
ATDPWGYGSERKFDY

SEQ ID NO: 50451 - protein, 9 aa, Homo sapiens
  light chain complementarity determining region 3 for antibody 25226
QQVHSYPYT

SEQ ID NO: 50452 - protein, 16 aa, Homo sapiens
  heavy chain complementarity determining region 3 for antibody 25226
AKNGELLDYYYYGMDV

SEQ ID NO: 50453 - protein, 9 aa, Homo sapiens
  light chain complementarity determining region 3 for antibody 25227
QQTYSTPWT

SEQ ID NO: 50454 - protein, 20 aa, Homo sapiens
  heavy chain complementarity determining region 3 for antibody 25227
ARASNRDGRPVTGDPYYCDN

SEQ ID NO: 50455 - protein, 9 aa, Homo sapiens
  light chain complementarity determining region 3 for antibody 25228
QQSYSTRYT

SEQ ID NO: 50456 - protein, 15 aa, Homo sapiens
  heavy chain complementarity determining region 3 for antibody 25228
AREDRDAAGFTTFDY

SEQ ID NO: 50457 - protein, 9 aa, Homo sapiens
  light chain complementarity determining region 3 for antibody 25229
QQSYSTPWT

SEQ ID NO: 50458 - protein, 18 aa, Homo sapiens
  heavy chain complementarity determining region 3 for antibody 25229
ARAGWAMVRGVIPYYFDY

SEQ ID NO: 50459 - protein, 9 aa, Homo sapiens
  light chain complementarity determining region 3 for antibody 25230
QQSYSTPLT

SEQ ID NO: 50460 - protein, 10 aa, Homo sapiens
  heavy chain complementarity determining region 3 for antibody 25230
ARSIARGFDP

SEQ ID NO: 50461 - protein, 9 aa, Homo sapiens
  light chain complementarity determining region 3 for antibody 25231
QQSYSTPFT

SEQ ID NO: 50462 - protein, 14 aa, Homo sapiens
  heavy chain complementarity determining region 3 for antibody 25231
ARSYDTSGYSALDY

SEQ ID NO: 50463 - protein, 8 aa, Homo sapiens
  light chain complementarity determining region 3 for antibody 25232
QQSYSTHS

SEQ ID NO: 50464 - protein, 11 aa, Homo sapiens
  heavy chain complementarity determining region 3 for antibody 25232
VRVGVNWFFDI

SEQ ID NO: 50465 - protein, 9 aa, Homo sapiens
  light chain complementarity determining region 3 for antibody 25233
QQSYNTPRT

SEQ ID NO: 50466 - protein, 13 aa, Homo sapiens
  heavy chain complementarity determining region 3 for antibody 25233
ARETSGWDDAFDI

SEQ ID NO: 50467 - protein, 9 aa, Homo sapiens
  light chain complementarity determining region 3 for antibody 25234
QQSYNSPRT

SEQ ID NO: 50468 - protein, 15 aa, Homo sapiens
  heavy chain complementarity determining region 3 for antibody 25234
ARDDRQGSRKEAFDY

SEQ ID NO: 50469 - protein, 9 aa, Homo sapiens
  light chain complementarity determining region 3 for antibody 25235
QQRYNWPLT

SEQ ID NO: 50470 - protein, 17 aa, Homo sapiens
  heavy chain complementarity determining region 3 for antibody 25235
TTESRIRGVIINDGFDV

SEQ ID NO: 50471 - protein, 9 aa, Homo sapiens
  light chain complementarity determining region 3 for antibody 25236
QQRTNWRFT

SEQ ID NO: 50472 - protein, 16 aa, Homo sapiens
  heavy chain complementarity determining region 3 for antibody 25236
ARDQGFCRGPNCYMLF

SEQ ID NO: 50473 - protein, 10 aa, Homo sapiens
  light chain complementarity determining region 3 for antibody 25237
QQRSNWPPIT

SEQ ID NO: 50474 - protein, 11 aa, Homo sapiens
  heavy chain complementarity determining region 3 for antibody 25237
ARDWRSGGMDV

SEQ ID NO: 50475 - protein, 8 aa, Homo sapiens
  light chain complementarity determining region 3 for antibody 25238
QQRHTRPS

SEQ ID NO: 50476 - protein, 11 aa, Homo sapiens
  heavy chain complementarity determining region 3 for antibody 25238
ASGSMGWVFDH

SEQ ID NO: 50477 - protein, 9 aa, Homo sapiens
  light chain complementarity determining region 3 for antibody 25239
QQRGNWPPT

SEQ ID NO: 50478 - protein, 15 aa, Homo sapiens
  heavy chain complementarity determining region 3 for antibody 25239
AREPSWGSTPENFDY

SEQ ID NO: 50479 - protein, 9 aa, Homo sapiens
  light chain complementarity determining region 3 for antibody 25240
QQLNSYPYT

SEQ ID NO: 50480 - protein, 15 aa, Homo sapiens
  heavy chain complementarity determining region 3 for antibody 25240
ARDLRDYYGSGSLDI

SEQ ID NO: 50481 - protein, 9 aa, Homo sapiens
  light chain complementarity determining region 3 for antibody 25241
QQGYMTPFT

SEQ ID NO: 50482 - protein, 15 aa, Homo sapiens
  heavy chain complementarity determining region 3 for antibody 25241
AKSQVIWGQLFYFES

SEQ ID NO: 50483 - protein, 9 aa, Homo sapiens
  light chain complementarity determining region 3 for antibody 25242
QQDDSLPIT

SEQ ID NO: 50484 - protein, 20 aa, Homo sapiens
  heavy chain complementarity determining region 3 for antibody 25242
TRGPHIVVLTSIPWRWSLGL

SEQ ID NO: 50485 - protein, 9 aa, Homo sapiens
  light chain complementarity determining region 3 for antibody 25243
QQCSNWPLT

SEQ ID NO: 50486 - protein, 24 aa, Homo sapiens
  heavy chain complementarity determining region 3 for antibody 25243
ARGRPPSGWYRLKDRTYYYYGLDV

SEQ ID NO: 50487 - protein, 9 aa, Homo sapiens
  light chain complementarity determining region 3 for antibody 25244
QQALTFPIT

SEQ ID NO: 50488 - protein, 11 aa, Homo sapiens
  heavy chain complementarity determining region 3 for antibody 25244
ARDTPGIGIDY

SEQ ID NO: 50489 - protein, 9 aa, Homo sapiens
  light chain complementarity determining region 3 for antibody 25245
QKYNTYPYT

SEQ ID NO: 50490 - protein, 17 aa, Homo sapiens
  heavy chain complementarity determining region 3 for antibody 25245
ARDRWYYGSGNYYPSDY

SEQ ID NO: 50491 - protein, 8 aa, Homo sapiens
  light chain complementarity determining region 3 for antibody 25246
QHYNGYCM

SEQ ID NO: 50492 - protein, 18 aa, Homo sapiens
  heavy chain complementarity determining region 3 for antibody 25246
ARGHYYDNGGYPYDVFDI

SEQ ID NO: 50493 - protein, 10 aa, Homo sapiens
  light chain complementarity determining region 3 for antibody 25247
QHYGPGSPWS

SEQ ID NO: 50494 - protein, 12 aa, Homo sapiens
  heavy chain complementarity determining region 3 for antibody 25247
ATYYVGLGGRGF

SEQ ID NO: 50495 - protein, 10 aa, Homo sapiens
  light chain complementarity determining region 3 for antibody 25248
MQGTHWPPWT

SEQ ID NO: 50496 - protein, 12 aa, Homo sapiens
  heavy chain complementarity determining region 3 for antibody 25248
TTGLNWGWEPDC

SEQ ID NO: 50497 - protein, 9 aa, Homo sapiens
  light chain complementarity determining region 3 for antibody 25249
MQGTHWPAT

SEQ ID NO: 50498 - protein, 15 aa, Homo sapiens
  heavy chain complementarity determining region 3 for antibody 25249
VHTQLWFGDQCYFDF

SEQ ID NO: 50499 - protein, 9 aa, Homo sapiens
  light chain complementarity determining region 3 for antibody 25250
MQATHWPLT

SEQ ID NO: 50500 - protein, 19 aa, Homo sapiens
  heavy chain complementarity determining region 3 for antibody 25250
VKDQDGSGSYYKTPPTFDY

SEQ ID NO: 50501 - protein, 9 aa, Homo sapiens
  light chain complementarity determining region 3 for antibody 25251
MQALQTPYT

SEQ ID NO: 50502 - protein, 21 aa, Homo sapiens
  heavy chain complementarity determining region 3 for antibody 25251
ARDKNTWNSDGRYYYYWGLDV

SEQ ID NO: 50503 - protein, 9 aa, Homo sapiens
  light chain complementarity determining region 3 for antibody 25252
MQALQTPRT

SEQ ID NO: 50504 - protein, 23 aa, Homo sapiens
  heavy chain complementarity determining region 3 for antibody 25252
ARHREYASGPYYSPLYYYYGVDV

SEQ ID NO: 50505 - protein, 9 aa, Homo sapiens
  light chain complementarity determining region 3 for antibody 25253
MQALETPLT

SEQ ID NO: 50506 - protein, 24 aa, Homo sapiens
  heavy chain complementarity determining region 3 for antibody 25253
ARVGLNYFDISGYSRIYYYYGMDV

SEQ ID NO: 50507 - protein, 9 aa, Homo sapiens
  light chain complementarity determining region 3 for antibody 25254
LRLDTYPPA

SEQ ID NO: 50508 - protein, 17 aa, Homo sapiens
  heavy chain complementarity determining region 3 for antibody 25254
TSPGVLRSFDWLQPLDY

SEQ ID NO: 50509 - protein, 9 aa, Homo sapiens
  light chain complementarity determining region 3 for antibody 25255
LQYNSYPWT

SEQ ID NO: 50510 - protein, 24 aa, Homo sapiens
  heavy chain complementarity determining region 3 for antibody 25255
ARGSPRMYYDDSRGYNRGPYRLDV

SEQ ID NO: 50511 - protein, 9 aa, Homo sapiens
  light chain complementarity determining region 3 for antibody 25256
LQYGSSPRT

SEQ ID NO: 50512 - protein, 9 aa, Homo sapiens
  heavy chain complementarity determining region 3 for antibody 25256
AREYSSFEY

SEQ ID NO: 50513 - protein, 9 aa, Homo sapiens
  light chain complementarity determining region 3 for antibody 25257
LQSYDVPLT

SEQ ID NO: 50514 - protein, 7 aa, Homo sapiens
  heavy chain complementarity determining region 3 for antibody 25257
ISILVGG

SEQ ID NO: 50515 - protein, 9 aa, Homo sapiens
  light chain complementarity determining region 3 for antibody 25258
LQHNSYPYT

SEQ ID NO: 50516 - protein, 18 aa, Homo sapiens
  heavy chain complementarity determining region 3 for antibody 25258
AREEYSSGWYVHADGLDV

SEQ ID NO: 50517 - protein, 9 aa, Homo sapiens
  light chain complementarity determining region 3 for antibody 25259
LQHNSVPYT

SEQ ID NO: 50518 - protein, 19 aa, Homo sapiens
  heavy chain complementarity determining region 3 for antibody 25259
TTSYYYDHGGQYHAGHFQY

SEQ ID NO: 50519 - protein, 9 aa, Homo sapiens
  light chain complementarity determining region 3 for antibody 25260
LQDYTYPRT

SEQ ID NO: 50520 - protein, 18 aa, Homo sapiens
  heavy chain complementarity determining region 3 for antibody 25260
ARDSSPSVARIGYDAYDI

SEQ ID NO: 50521 - protein, 11 aa, Homo sapiens
  light chain complementarity determining region 3 for antibody 25261
LHYNNWPLMYT

SEQ ID NO: 50522 - protein, 12 aa, Homo sapiens
  heavy chain complementarity determining region 3 for antibody 25261
ATGITTISNFDY

SEQ ID NO: 50523 - protein, 9 aa, Homo sapiens
  light chain complementarity determining region 3 for antibody 25262
HQSGYLPRT

SEQ ID NO: 50524 - protein, 15 aa, Homo sapiens
  heavy chain complementarity determining region 3 for antibody 25262
VHTQLWFGDQCYFDF

SEQ ID NO: 50525 - protein, 9 aa, Homo sapiens
  light chain complementarity determining region 3 for antibody 25263
VQYNSYPRT

SEQ ID NO: 50526 - protein, 6 aa, Homo sapiens
  heavy chain complementarity determining region 3 for antibody 25263
TRALDY

SEQ ID NO: 50527 - protein, 8 aa, Homo sapiens
  light chain complementarity determining region 3 for antibody 25264
QYYGSSPT

SEQ ID NO: 50528 - protein, 9 aa, Homo sapiens
  heavy chain complementarity determining region 3 for antibody 25264
ARGYDAFDF

SEQ ID NO: 50529 - protein, 8 aa, Homo sapiens
  light chain complementarity determining region 3 for antibody 25265
QYLNGYLV

SEQ ID NO: 50530 - protein, 9 aa, Homo sapiens
  heavy chain complementarity determining region 3 for antibody 25265
ARDYLGFDS

SEQ ID NO: 50531 - protein, 9 aa, Homo sapiens
  light chain complementarity determining region 3 for antibody 25266
QQYYSTPWT

SEQ ID NO: 50532 - protein, 13 aa, Homo sapiens
  heavy chain complementarity determining region 3 for antibody 25266
ARERMAVAGVLDY

SEQ ID NO: 50533 - protein, 9 aa, Homo sapiens
  light chain complementarity determining region 3 for antibody 25267
QQYTTYPWT

SEQ ID NO: 50534 - protein, 17 aa, Homo sapiens
  heavy chain complementarity determining region 3 for antibody 25267
AREGGYSYGLYGDAFDI

SEQ ID NO: 50535 - protein, 7 aa, Homo sapiens
  light chain complementarity determining region 3 for antibody 25268
QQYNSYT

SEQ ID NO: 50536 - protein, 20 aa, Homo sapiens
  heavy chain complementarity determining region 3 for antibody 25268
SRRHVLVGGDRVAAGRAADY

SEQ ID NO: 50537 - protein, 11 aa, Homo sapiens
  light chain complementarity determining region 3 for antibody 25269
QQYNSYSPQYT

SEQ ID NO: 50538 - protein, 15 aa, Homo sapiens
  heavy chain complementarity determining region 3 for antibody 25269
ARSASMYSSSSLFDY

SEQ ID NO: 50539 - protein, 9 aa, Homo sapiens
  light chain complementarity determining region 3 for antibody 25270
QQYNSPMYT

SEQ ID NO: 50540 - protein, 14 aa, Homo sapiens
  heavy chain complementarity determining region 3 for antibody 25270
ARDRFGDSRISFDY

SEQ ID NO: 50541 - protein, 9 aa, Homo sapiens
  light chain complementarity determining region 3 for antibody 25271
QQYNNYPYT

SEQ ID NO: 50542 - protein, 14 aa, Homo sapiens
  heavy chain complementarity determining region 3 for antibody 25271
ARSTSYGDFFNLIS

SEQ ID NO: 50543 - protein, 10 aa, Homo sapiens [sequence omitted]

SEQ ID NO: 50544 - protein, 23 aa, Homo sapiens
  heavy chain complementarity determining region 3 for antibody 25272
ARARPKYYFDSSGHHYVPNAFDI

SEQ ID NO: 50545 - protein, 9 aa, Homo sapiens
  light chain complementarity determining region 3 for antibody 25273
QQYLTTPPT

SEQ ID NO: 50546 - protein, 13 aa, Homo sapiens
  heavy chain complementarity determining region 3 for antibody 25273
VKDPDFNYGSWVS

SEQ ID NO: 50547 - protein, 8 aa, Homo sapiens
  light chain complementarity determining region 3 for antibody 25274
QQYHSYWT

SEQ ID NO: 50548 - protein, 18 aa, Homo sapiens
  heavy chain complementarity determining region 3 for antibody 25274
ASAFGEVVADTNAGAFDI

SEQ ID NO: 50549 - protein, 9 aa, Homo sapiens
  light chain complementarity determining region 3 for antibody 25275
QQYHRYSWT

SEQ ID NO: 50550 - protein, 19 aa, Homo sapiens
  heavy chain complementarity determining region 3 for antibody 25275
ATAPTGGGVIFDMAGALRD

SEQ ID NO: 50551 - protein, 10 aa, Homo sapiens
  light chain complementarity determining region 3 for antibody 25276
QQYHQWPPIT

SEQ ID NO: 50552 - protein, 9 aa, Homo sapiens
  heavy chain complementarity determining region 3 for antibody 25276
ARVHYGLDA

SEQ ID NO: 50553 - protein, 11 aa, Homo sapiens
  light chain complementarity determining region 3 for antibody 25277
QQYGTSPPGYT

SEQ ID NO: 50554 - protein, 17 aa, Homo sapiens
  heavy chain complementarity determining region 3 for antibody 25277
ARGLALIRGLVTKDIDD

SEQ ID NO: 50555 - protein, 9 aa, Homo sapiens
  light chain complementarity determining region 3 for antibody 25278
QQYGSTWRT

SEQ ID NO: 50556 - protein, 15 aa, Homo sapiens
  heavy chain complementarity determining region 3 for antibody 25278
ARHMARDSIGYYHDF

SEQ ID NO: 50557 - protein, 9 aa, Homo sapiens
  light chain complementarity determining region 3 for antibody 25279
QQYGSSPYT

SEQ ID NO: 50558 - protein, 15 aa, Homo sapiens
  heavy chain complementarity determining region 3 for antibody 25279
ARGGDILTGYYCLVY

SEQ ID NO: 50559 - protein, 9 aa, Homo sapiens
  light chain complementarity determining region 3 for antibody 25280
QQYGSSPLT

SEQ ID NO: 50560 - protein, 17 aa, Homo sapiens
  heavy chain complementarity determining region 3 for antibody 25280
ARASDYGGNSGVYYFDY

SEQ ID NO: 50561 - protein, 10 aa, Homo sapiens
  light chain complementarity determining region 3 for antibody 25281
QQYGGSPPLT

SEQ ID NO: 50562 - protein, 12 aa, Homo sapiens
  heavy chain complementarity determining region 3 for antibody 25281
ARLHYFDYYFDY

SEQ ID NO: 50563 - protein, 10 aa, Homo sapiens
  light chain complementarity determining region 3 for antibody 25282
QQYGDSPPYT

SEQ ID NO: 50564 - protein, 15 aa, Homo sapiens
  heavy chain complementarity determining region 3 for antibody 25282
ARGGSSSWAYSYFAL

SEQ ID NO: 50565 - protein, 8 aa, Homo sapiens
  light chain complementarity determining region 3 for antibody 25283
QQYGDSMT

SEQ ID NO: 50566 - protein, 16 aa, Homo sapiens
  heavy chain complementarity determining region 3 for antibody 25283
ARGLSIIRGVMSPFDF

SEQ ID NO: 50567 - protein, 9 aa, Homo sapiens
  light chain complementarity determining region 3 for antibody 25284
QQYENLPLT

SEQ ID NO: 50568 - protein, 15 aa, Homo sapiens
  heavy chain complementarity determining region 3 for antibody 25284
TRGFSWGSELFRFDY

SEQ ID NO: 50569 - protein, 7 aa, Homo sapiens
  light chain complementarity determining region 3 for antibody 25285
QQYDRPT

SEQ ID NO: 50570 - protein, 17 aa, Homo sapiens
  heavy chain complementarity determining region 3 for antibody 25285
ARARTQFGSGAHYCFDY

SEQ ID NO: 50571 - protein, 9 aa, Homo sapiens
  light chain complementarity determining region 3 for antibody 25286
QQYDKPPRT

SEQ ID NO: 50572 - protein, 16 aa, Homo sapiens
  heavy chain complementarity determining region 3 for antibody 25286
ARLSPMRYYGFSGLDV

SEQ ID NO: 50573 - protein, 10 aa, Homo sapiens
  light chain complementarity determining region 3 for antibody 25287
QQYDDLPSLT

SEQ ID NO: 50574 - protein, 16 aa, Homo sapiens
  heavy chain complementarity determining region 3 for antibody 25287
VRRPSSSWYYLHGMDV

SEQ ID NO: 50575 - protein, 9 aa, Homo sapiens
  light chain complementarity determining region 3 for antibody 25288
QQSYSTPYT

SEQ ID NO: 50576 - protein, 17 aa, Homo sapiens
  heavy chain complementarity determining region 3 for antibody 25288
AKESGSSGWYLSGGMDV

SEQ ID NO: 50577 - protein, 10 aa, Homo sapiens
  light chain complementarity determining region 3 for antibody 25289
QQSYSTPPFT

SEQ ID NO: 50578 - protein, 19 aa, Homo sapiens
  heavy chain complementarity determining region 3 for antibody 25289
VKDSTWGSSGYYSSEYFQH

SEQ ID NO: 50579 - protein, 9 aa, Homo sapiens
  light chain complementarity determining region 3 for antibody 25290
QQSYSTPLT

SEQ ID NO: 50580 - protein, 16 aa, Homo sapiens
  heavy chain complementarity determining region 3 for antibody 25290
AKSAYHILTGYNWFDP

SEQ ID NO: 50581 - protein, 9 aa, Homo sapiens
  light chain complementarity determining region 3 for antibody 25291
QQSYSTPIT

SEQ ID NO: 50582 - protein, 14 aa, Homo sapiens
  heavy chain complementarity determining region 3 for antibody 25291
VRDFGPGRYNWFDP

SEQ ID NO: 50583 - protein, 9 aa, Homo sapiens
  light chain complementarity determining region 3 for antibody 25292
QQSYSTPHT

SEQ ID NO: 50584 - protein, 23 aa, Homo sapiens
  heavy chain complementarity determining region 3 for antibody 25292
ARIESDATMVRGVIITKGNWFDP

SEQ ID NO: 50585 - protein, 10 aa, Homo sapiens
  light chain complementarity determining region 3 for antibody 25293
QQSYSTLPLT

SEQ ID NO: 50586 - protein, 18 aa, Homo sapiens
  heavy chain complementarity determining region 3 for antibody 25293
ARDRYSCDSGGCFHWFDP

SEQ ID NO: 50587 - protein, 9 aa, Homo sapiens
  light chain complementarity determining region 3 for antibody 25294
QQSYSTLFS

SEQ ID NO: 50588 - protein, 19 aa, Homo sapiens
  heavy chain complementarity determining region 3 for antibody 25294
ARGGDGSGSYSQWYKGMDV

SEQ ID NO: 50589 - protein, 9 aa, Homo sapiens
  light chain complementarity determining region 3 for antibody 25295
QQSYSPPWT

SEQ ID NO: 50590 - protein, 13 aa, Homo sapiens
  heavy chain complementarity determining region 3 for antibody 25295
ARVVSAAVDFFDY

SEQ ID NO: 50591 - protein, 9 aa, Homo sapiens
  light chain complementarity determining region 3 for antibody 25296
QQSYRTPLT

SEQ ID NO: 50592 - protein, 25 aa, Homo sapiens
  heavy chain complementarity determining region 3 for antibody 25296
ARDPRYSISSYYVVGSTGWYHSFDP

SEQ ID NO: 50593 - protein, 8 aa, Homo sapiens
  light chain complementarity determining region 3 for antibody 25297
QQSYRAPR

SEQ ID NO: 50594 - protein, 12 aa, Homo sapiens
  heavy chain complementarity determining region 3 for antibody 25297
ARDPHDYSCFDY

SEQ ID NO: 50595 - protein, 10 aa, Homo sapiens
  light chain complementarity determining region 3 for antibody 25298
QQSYNTPRLT

SEQ ID NO: 50596 - protein, 16 aa, Homo sapiens
  heavy chain complementarity determining region 3 for antibody 25298
ARPSRNFPPGYNAFDI

SEQ ID NO: 50597 - protein, 9 aa, Homo sapiens
  light chain complementarity determining region 3 for antibody 25299
QQSSSSPLT

SEQ ID NO: 50598 - protein, 15 aa, Homo sapiens
  heavy chain complementarity determining region 3 for antibody 25299
AHTFTVTRGLAGFDF

SEQ ID NO: 50599 - protein, 9 aa, Homo sapiens
  light chain complementarity determining region 3 for antibody 25300
QQSSDVPLT

SEQ ID NO: 50600 - protein, 9 aa, Homo sapiens
  heavy chain complementarity determining region 3 for antibody 25300
VCLGVTPPV

SEQ ID NO: 50601 - protein, 11 aa, Homo sapiens
  light chain complementarity determining region 3 for antibody 25301
QQSFTTPLMYT

SEQ ID NO: 50602 - protein, 16 aa, Homo sapiens
  heavy chain complementarity determining region 3 for antibody 25301
ARGSTVTSFSGLCPDS

SEQ ID NO: 50603 - protein, 10 aa, Homo sapiens
  light chain complementarity determining region 3 for antibody 25302
QQRTNWPRGT

SEQ ID NO: 50604 - protein, 18 aa, Homo sapiens
  heavy chain complementarity determining region 3 for antibody 25302
ARDNYGSGSYSNLEYFQH

SEQ ID NO: 50605 - protein, 10 aa, Homo sapiens
  light chain complementarity determining region 3 for antibody 25303
QQRSNWPPYT

SEQ ID NO: 50606 - protein, 10 aa, Homo sapiens
  heavy chain complementarity determining region 3 for antibody 25303
ARDSGAGVDY

SEQ ID NO: 50607 - protein, 10 aa, Homo sapiens
  light chain complementarity determining region 3 for antibody 25304
QQRSNWPPST

SEQ ID NO: 50608 - protein, 11 aa, Homo sapiens
  heavy chain complementarity determining region 3 for antibody 25304
ARLRPWDGMDV

SEQ ID NO: 50609 - protein, 11 aa, Homo sapiens
  light chain complementarity determining region 3 for antibody 25305
QQRSNWPPIFT

SEQ ID NO: 50610 - protein, 18 aa, Homo sapiens
  heavy chain complementarity determining region 3 for antibody 25305
ARLGRNHYDSIGVDAFDI

SEQ ID NO: 50611 - protein, 10 aa, Homo sapiens
  light chain complementarity determining region 3 for antibody 25306
QQRSNWPPGT

SEQ ID NO: 50612 - protein, 16 aa, Homo sapiens
  heavy chain complementarity determining region 3 for antibody 25306
ARAVLYSGSAPYVLDI

SEQ ID NO: 50613 - protein, 10 aa, Homo sapiens
  light chain complementarity determining region 3 for antibody 25307
QQRRNWPPIT

SEQ ID NO: 50614 - protein, 22 aa, Homo sapiens
  heavy chain complementarity determining region 3 for antibody 25307
ARMKKSDVTLYCNGGTCHIFDY

SEQ ID NO: 50615 - protein, 6 aa, Homo sapiens
  light chain complementarity determining region 3 for antibody 25308
QQNGRP

SEQ ID NO: 50616 - protein, 12 aa, Homo sapiens
  heavy chain complementarity determining region 3 for antibody 25308
AKLVNSWYPYDY

SEQ ID NO: 50617 - protein, 9 aa, Homo sapiens
  light chain complementarity determining region 3 for antibody 25309
QQLYVYPLG

SEQ ID NO: 50618 - protein, 15 aa, Homo sapiens
  heavy chain complementarity determining region 3 for antibody 25309
VRHYRETVAGIEGDS

SEQ ID NO: 50619 - protein, 9 aa, Homo sapiens
  light chain complementarity determining region 3 for antibody 25310
QQLRSYPLT

SEQ ID NO: 50620 - protein, 19 aa, Homo sapiens
  heavy chain complementarity determining region 3 for antibody 25310
ARHNSKDYYSSSLLPGNDH

SEQ ID NO: 50621 - protein, 9 aa, Homo sapiens
  light chain complementarity determining region 3 for antibody 25311
QQLNNYPST

SEQ ID NO: 50622 - protein, 20 aa, Homo sapiens
  heavy chain complementarity determining region 3 for antibody 25311
ARDSGVGSGLYVPAAEYFQY

SEQ ID NO: 50623 - protein, 10 aa, Homo sapiens
  light chain complementarity determining region 3 for antibody 25312
QQLKSYPSIT

SEQ ID NO: 50624 - protein, 18 aa, Homo sapiens
  heavy chain complementarity determining region 3 for antibody 25312
LRGADFTGYSSGYYAMDV

SEQ ID NO: 50625 - protein, 9 aa, Homo sapiens
  light chain complementarity determining region 3 for antibody 25313
QQLKFYPFT

SEQ ID NO: 50626 - protein, 10 aa, Homo sapiens
  heavy chain complementarity determining region 3 for antibody 25313
ATGAGWLVDY

SEQ ID NO: 50627 - protein, 8 aa, Homo sapiens
  light chain complementarity determining region 3 for antibody 25314
QQICTTRT

SEQ ID NO: 50628 - protein, 8 aa, Homo sapiens
  heavy chain complementarity determining region 3 for antibody 25314
AKGYGFDS

SEQ ID NO: 50629 - protein, 9 aa, Homo sapiens
  light chain complementarity determining region 3 for antibody 25315
QQHDNLSIT

SEQ ID NO: 50630 - protein, 15 aa, Homo sapiens
  heavy chain complementarity determining region 3 for antibody 25315
SRADDRSGYFGIITY

SEQ ID NO: 50631 - protein, 9 aa, Homo sapiens
  light chain complementarity determining region 3 for antibody 25316
QQGNSFPYN

SEQ ID NO: 50632 - protein, 15 aa, Homo sapiens
  heavy chain complementarity determining region 3 for antibody 25316
AREVTGDGYHKTFDI

SEQ ID NO: 50633 - protein, 9 aa, Homo sapiens
  light chain complementarity determining region 3 for antibody 25317
QQFNNYPFT

SEQ ID NO: 50634 - protein, 14 aa, Homo sapiens
  heavy chain complementarity determining region 3 for antibody 25317
ARENSISRKRSFDQ

SEQ ID NO: 50635 - protein, 9 aa, Homo sapiens
  light chain complementarity determining region 3 for antibody 25318
QQDGSSPRT

SEQ ID NO: 50636 - protein, 25 aa, Homo sapiens
  heavy chain complementarity determining region 3 for antibody 25318
ARLRIDRLRLPGAMRGPLYDCGLNV

SEQ ID NO: 50637 - protein, 9 aa, Homo sapiens
  light chain complementarity determining region 3 for antibody 25319
QQANSFPFT

SEQ ID NO: 50638 - protein, 15 aa, Homo sapiens
  heavy chain complementarity determining region 3 for antibody 25319
ARQRAHGSGRGYFDY

SEQ ID NO: 50639 - protein, 11 aa, Homo sapiens
  light chain complementarity determining region 3 for antibody 25320
QLYDTSPPGYT

SEQ ID NO: 50640 - protein, 14 aa, Homo sapiens
  heavy chain complementarity determining region 3 for antibody 25320
AREITISRKTSFDQ

SEQ ID NO: 50641 - protein, 10 aa, Homo sapiens
  light chain complementarity determining region 3 for antibody 25321
QLRSNWPLFT

SEQ ID NO: 50642 - protein, 22 aa, Homo sapiens
  heavy chain complementarity determining region 3 for antibody 25321
ARDGPTYYYDSSGRFWPTYFDS

SEQ ID NO: 50643 - protein, 8 aa, Homo sapiens
  light chain complementarity determining region 3 for antibody 25322
QKYGSSYT

SEQ ID NO: 50644 - protein, 24 aa, Homo sapiens
  heavy chain complementarity determining region 3 for antibody 25322
ARPREDFGSGLPKRYKYNYFDLDV

SEQ ID NO: 50645 - protein, 8 aa, Homo sapiens
  light chain complementarity determining region 3 for antibody 25323
QHYNSYVT

SEQ ID NO: 50646 - protein, 16 aa, Homo sapiens
  heavy chain complementarity determining region 3 for antibody 25323
ARDRHALTGYPYENDF

SEQ ID NO: 50647 - protein, 11 aa, Homo sapiens
  light chain complementarity determining region 3 for antibody 25324
QHYDNLPPMYT

SEQ ID NO: 50648 - protein, 8 aa, Homo sapiens
  heavy chain complementarity determining region 3 for antibody 25324
ARGDYTDY

SEQ ID NO: 50649 - protein, 9 aa, Homo sapiens
  light chain complementarity determining region 3 for antibody 25325
QHYATLLGA

SEQ ID NO: 50650 - protein, 7 aa, Homo sapiens
  heavy chain complementarity determining region 3 for antibody 25325
ARVGGLL

SEQ ID NO: 50651 - protein, 10 aa, Homo sapiens
  light chain complementarity determining region 3 for antibody 25326
QHWVSSPAYT

SEQ ID NO: 50652 - protein, 12 aa, Homo sapiens
  heavy chain complementarity determining region 3 for antibody 25326
ARETTRFGELDH

SEQ ID NO: 50653 - protein, 9 aa, Homo sapiens
  light chain complementarity determining region 3 for antibody 25327
QHSHSAPRT

SEQ ID NO: 50654 - protein, 14 aa, Homo sapiens
  heavy chain complementarity determining region 3 for antibody 25327
SRDRLDISGWYSDY

SEQ ID NO: 50655 - protein, 9 aa, Homo sapiens
  light chain complementarity determining region 3 for antibody 25328
QHRRTWLYS

SEQ ID NO: 50656 - protein, 20 aa, Homo sapiens
  heavy chain complementarity determining region 3 for antibody 25328
ARDGSAGMAARGTPYYGLDV

SEQ ID NO: 50657 - protein, 9 aa, Homo sapiens
  light chain complementarity determining region 3 for antibody 25329
QHLNSYLIT

SEQ ID NO: 50658 - protein, 21 aa, Homo sapiens
  heavy chain complementarity determining region 3 for antibody 25329
ARDKWTQVWSRNPNFHYGMDV

SEQ ID NO: 50659 - protein, 9 aa, Homo sapiens
  light chain complementarity determining region 3 for antibody 25330
QHANGLPYT

SEQ ID NO: 50660 - protein, 17 aa, Homo sapiens
  heavy chain complementarity determining region 3 for antibody 25330
ARMGGGSSSETGYDFDT

SEQ ID NO: 50661 - protein, 9 aa, Homo sapiens
  light chain complementarity determining region 3 for antibody 25331
PQVNSCPFT

SEQ ID NO: 50662 - protein, 8 aa, Homo sapiens
  heavy chain complementarity determining region 3 for antibody 25331
ARGRFYYV

SEQ ID NO: 50663 - protein, 9 aa, Homo sapiens
  light chain complementarity determining region 3 for antibody 25332
MQGTHRPFT

SEQ ID NO: 50664 - protein, 21 aa, Homo sapiens
  heavy chain complementarity determining region 3 for antibody 25332
ARGGDYGDYWVRYYYYYGMDV

SEQ ID NO: 50665 - protein, 10 aa, Homo sapiens
  light chain complementarity determining region 3 for antibody 25333
MQGTDWPQWT

SEQ ID NO: 50666 - protein, 9 aa, Homo sapiens
  heavy chain complementarity determining region 3 for antibody 25333
TRDDWGFDF

SEQ ID NO: 50667 - protein, 9 aa, Homo sapiens
  light chain complementarity determining region 3 for antibody 25334
MQALQTPRT

SEQ ID NO: 50668 - protein, 16 aa, Homo sapiens
  heavy chain complementarity determining region 3 for antibody 25334
ARVVYSDYDWAGFVDY

SEQ ID NO: 50669 - protein, 9 aa, Homo sapiens
  light chain complementarity determining region 3 for antibody 25335
MQALQTPPT

SEQ ID NO: 50670 - protein, 15 aa, Homo sapiens
  heavy chain complementarity determining region 3 for antibody 25335
ARDGLRDGFSDAFDI

SEQ ID NO: 50671 - protein, 10 aa, Homo sapiens
  light chain complementarity determining region 3 for antibody 25336
MQALQTPKVT

SEQ ID NO: 50672 - protein, 18 aa, Homo sapiens
  heavy chain complementarity determining region 3 for antibody 25336
ARRPRLMHMIISGDFVDP

SEQ ID NO: 50673 - protein, 9 aa, Homo sapiens
  light chain complementarity determining region 3 for antibody 25337
LQYGNSPRT

SEQ ID NO: 50674 - protein, 14 aa, Homo sapiens
  heavy chain complementarity determining region 3 for antibody 25337
VRLKSGWYSPYFDY

SEQ ID NO: 50675 - protein, 9 aa, Homo sapiens
  light chain complementarity determining region 3 for antibody 25338
VQYNRHPRT

SEQ ID NO: 50676 - protein, 6 aa, Homo sapiens
  heavy chain complementarity determining region 3 for antibody 25338
TRALDY

SEQ ID NO: 50677 - protein, 10 aa, Homo sapiens
  light chain complementarity determining region 3 for antibody 25339
QYYGLSPPFT

SEQ ID NO: 50678 - protein, 20 aa, Homo sapiens
  heavy chain complementarity determining region 3 for antibody 25339
ARDEGWGSMIVMWTDYYLQY

SEQ ID NO: 50679 - protein, 9 aa, Homo sapiens
  light chain complementarity determining region 3 for antibody 25340
QQYYTSVRP

SEQ ID NO: 50680 - protein, 12 aa, Homo sapiens
  heavy chain complementarity determining region 3 for antibody 25340
VKDCGLGGSRDF

SEQ ID NO: 50681 - protein, 9 aa, Homo sapiens
  light chain complementarity determining region 3 for antibody 25341
QQYYSTPRT

SEQ ID NO: 50682 - protein, 17 aa, Homo sapiens
  heavy chain complementarity determining region 3 for antibody 25341
ARSGVCSSTSCYLAFDY

SEQ ID NO: 50683 - protein, 9 aa, Homo sapiens
  light chain complementarity determining region 3 for antibody 25342
QQYSSYPWT

SEQ ID NO: 50684 - protein, 17 aa, Homo sapiens
  heavy chain complementarity determining region 3 for antibody 25342
SGAETFYHDNLDHPGDY

SEQ ID NO: 50685 - protein, 9 aa, Homo sapiens
  light chain complementarity determining region 3 for antibody 25343
QQYSNWPLT

SEQ ID NO: 50686 - protein, 20 aa, Homo sapiens
  heavy chain complementarity determining region 3 for antibody 25343
AKWHMITFGGAIVEPDTFEI

SEQ ID NO: 50687 - protein, 9 aa, Homo sapiens
  light chain complementarity determining region 3 for antibody 25344
QQYSDWPRT

SEQ ID NO: 50688 - protein, 23 aa, Homo sapiens
  heavy chain complementarity determining region 3 for antibody 25344
ARDRSPVIDYFDDSGPYGEYFDY

SEQ ID NO: 50689 - protein, 9 aa, Homo sapiens
  light chain complementarity determining region 3 for antibody 25345
QQYNTYPPT

SEQ ID NO: 50690 - protein, 15 aa, Homo sapiens
  heavy chain complementarity determining region 3 for antibody 25345
ASKGGLPVYQYGMDV

SEQ ID NO: 50691 - protein, 9 aa, Homo sapiens
  light chain complementarity determining region 3 for antibody 25346
QQYNSYSAT

SEQ ID NO: 50692 - protein, 20 aa, Homo sapiens
  heavy chain complementarity determining region 3 for antibody 25346
ARDRPSGYSGYDWGVGAFDI

SEQ ID NO: 50693 - protein, 9 aa, Homo sapiens
  light chain complementarity determining region 3 for antibody 25347
QQYNSYPYG

SEQ ID NO: 50694 - protein, 6 aa, Homo sapiens
  heavy chain complementarity determining region 3 for antibody 25347
ASLADY

SEQ ID NO: 50695 - protein, 9 aa, Homo sapiens
  light chain complementarity determining region 3 for antibody 25348
QQYNSYPWT

SEQ ID NO: 50696 - protein, 14 aa, Homo sapiens
  heavy chain complementarity determining region 3 for antibody 25348
VKSRTMVPGDAFDI

SEQ ID NO: 50697 - protein, 9 aa, Homo sapiens
  light chain complementarity determining region 3 for antibody 25349
QQYNSYPRT

SEQ ID NO: 50698 - protein, 24 aa, Homo sapiens
  heavy chain complementarity determining region 3 for antibody 25349
ARGRLPSGWYRLKDRTYYYFGLDV

SEQ ID NO: 50699 - protein, 9 aa, Homo sapiens
  light chain complementarity determining region 3 for antibody 25350
QQYNSFPRT

SEQ ID NO: 50700 - protein, 13 aa, Homo sapiens
  heavy chain complementarity determining region 3 for antibody 25350
AKADGSGYNYFDF

SEQ ID NO: 50701 - protein, 8 aa, Homo sapiens
  light chain complementarity determining region 3 for antibody 25351
QQYNNYPT

SEQ ID NO: 50702 - protein, 18 aa, Homo sapiens
  heavy chain complementarity determining region 3 for antibody 25351
AHVDAHTTGWNGWWYFDL

SEQ ID NO: 50703 - protein, 10 aa, Homo sapiens
  light chain complementarity determining region 3 for antibody 25352
QQYNNWLLRT

SEQ ID NO: 50704 - protein, 19 aa, Homo sapiens
  heavy chain complementarity determining region 3 for antibody 25352
ARGPHKYEYSVVGNANIDS

SEQ ID NO: 50705 - protein, 9 aa, Homo sapiens
  light chain complementarity determining region 3 for antibody 25353
QQYHSYPLT

SEQ ID NO: 50706 - protein, 13 aa, Homo sapiens
  heavy chain complementarity determining region 3 for antibody 25353
ATDLTVVTETHHY

SEQ ID NO: 50707 - protein, 10 aa, Homo sapiens
  light chain complementarity determining region 3 for antibody 25354
QQYGTSPALT

SEQ ID NO: 50708 - protein, 15 aa, Homo sapiens
  heavy chain complementarity determining region 3 for antibody 25354
ARAPVQLWFSDAFDV

SEQ ID NO: 50709 - protein, 8 aa, Homo sapiens
  light chain complementarity determining region 3 for antibody 25355
QQYGTSLT

SEQ ID NO: 50710 - protein, 15 aa, Homo sapiens
  heavy chain complementarity determining region 3 for antibody 25355
ASRTISGVIMTYFDS

SEQ ID NO: 50711 - protein, 9 aa, Homo sapiens
  light chain complementarity determining region 3 for antibody 25356
QQYGSSPVT

SEQ ID NO: 50712 - protein, 11 aa, Homo sapiens
  heavy chain complementarity determining region 3 for antibody 25356
ARGGYYTHAGP

SEQ ID NO: 50713 - protein, 10 aa, Homo sapiens
  light chain complementarity determining region 3 for antibody 25357
QQYGSSPMYT

SEQ ID NO: 50714 - protein, 16 aa, Homo sapiens
  heavy chain complementarity determining region 3 for antibody 25357
ARGRGYSAYVSYYFDY

SEQ ID NO: 50715 - protein, 10 aa, Homo sapiens
  light chain complementarity determining region 3 for antibody 25358
QQYGSSPLYT

SEQ ID NO: 50716 - protein, 17 aa, Homo sapiens
  heavy chain complementarity determining region 3 for antibody 25358
VRNYLAVFGRAPDAFDI

SEQ ID NO: 50717 - protein, 9 aa, Homo sapiens
  light chain complementarity determining region 3 for antibody 25359
QQYGSIPRT

SEQ ID NO: 50718 - protein, 14 aa, Homo sapiens
  heavy chain complementarity determining region 3 for antibody 25359
AGGKFCGGDCYRDY

SEQ ID NO: 50719 - protein, 8 aa, Homo sapiens
  light chain complementarity determining region 3 for antibody 25360
QQYGLGLT

SEQ ID NO: 50720 - protein, 16 aa, Homo sapiens
  heavy chain complementarity determining region 3 for antibody 25360
ARPRFSGSYSNDAFDI

SEQ ID NO: 50721 - protein, 10 aa, Homo sapiens
  light chain complementarity determining region 3 for antibody 25361
QQYDNLPSVT

SEQ ID NO: 50722 - protein, 19 aa, Homo sapiens
  heavy chain complementarity determining region 3 for antibody 25361
ARDRSPCTGGNCHLGWLVF

SEQ ID NO: 50723 - protein, 9 aa, Homo sapiens
  light chain complementarity determining region 3 for antibody 25362
QQYDNLPLT

SEQ ID NO: 50724 - protein, 17 aa, Homo sapiens
  heavy chain complementarity determining region 3 for antibody 25362
ARGYYDVSGFASHAFDI

SEQ ID NO: 50725 - protein, 8 aa, Homo sapiens
  light chain complementarity determining region 3 for antibody 25363
QQYAFSLT

SEQ ID NO: 50726 - protein, 18 aa, Homo sapiens
  heavy chain complementarity determining region 3 for antibody 25363
ARVIVYDSSDYYKYYFDY

SEQ ID NO: 50727 - protein, 9 aa, Homo sapiens
  light chain complementarity determining region 3 for antibody 25364
QQTYTTPWT

SEQ ID NO: 50728 - protein, 24 aa, Homo sapiens
  heavy chain complementarity determining region 3 for antibody 25364
ARAFPLKGSCSGGTCFRTHWYLDL

SEQ ID NO: 50729 - protein, 10 aa, Homo sapiens
  light chain complementarity determining region 3 for antibody 25365
QQTYSTPSCT

SEQ ID NO: 50730 - protein, 12 aa, Homo sapiens
  heavy chain complementarity determining region 3 for antibody 25365
ATDYGDYGAFDN

SEQ ID NO: 50731 - protein, 8 aa, Homo sapiens
  light chain complementarity determining region 3 for antibody 25366
QQTYSSKT

SEQ ID NO: 50732 - protein, 18 aa, Homo sapiens
  heavy chain complementarity determining region 3 for antibody 25366
ARRHYYDGTAFRAEYFDD

SEQ ID NO: 50733 - protein, 9 aa, Homo sapiens
  light chain complementarity determining region 3 for antibody 25367
QQTYSPPQT

SEQ ID NO: 50734 - protein, 24 aa, Homo sapiens
  heavy chain complementarity determining region 3 for antibody 25367
ARGSLEWYYDSSGYYYAPGDAFDI

SEQ ID NO: 50735 - protein, 9 aa, Homo sapiens
  light chain complementarity determining region 3 for antibody 25368
QQSYYFPIT

SEQ ID NO: 50736 - protein, 25 aa, Homo sapiens
  heavy chain complementarity determining region 3 for antibody 25368
ARGIDPARYNGGWYKSHNNYSGMDV

SEQ ID NO: 50737 - protein, 9 aa, Homo sapiens
  light chain complementarity determining region 3 for antibody 25369
QQSYTTPLT

SEQ ID NO: 50738 - protein, 14 aa, Homo sapiens
  heavy chain complementarity determining region 3 for antibody 25369
ARGTHYFGSETYDY

SEQ ID NO: 50739 - protein, 9 aa, Homo sapiens
  light chain complementarity determining region 3 for antibody 25370
QQSYSTPYT

SEQ ID NO: 50740 - protein, 19 aa, Homo sapiens
  heavy chain complementarity determining region 3 for antibody 25370
ATSGEDSSAWQPEPSGFGY

SEQ ID NO: 50741 - protein, 10 aa, Homo sapiens
  light chain complementarity determining region 3 for antibody 25371
QQSYSTPSYT

SEQ ID NO: 50742 - protein, 19 aa, Homo sapiens
  heavy chain complementarity determining region 3 for antibody 25371
ARGCWVIQYHSGWCDDFDK

SEQ ID NO: 50743 - protein, 10 aa, Homo sapiens
  light chain complementarity determining region 3 for antibody 25372
QQSYSTPMYT

SEQ ID NO: 50744 - protein, 22 aa, Homo sapiens
  heavy chain complementarity determining region 3 for antibody 25372
ARELGPRCSRSTCYPSRRGLDV

SEQ ID NO: 50745 - protein, 9 aa, Homo sapiens
  light chain complementarity determining region 3 for antibody 25373
QQSYSIPLA

SEQ ID NO: 50746 - protein, 10 aa, Homo sapiens
  heavy chain complementarity determining region 3 for antibody 25373
ARTYKDGFDT

SEQ ID NO: 50747 - protein, 9 aa, Homo sapiens
  light chain complementarity determining region 3 for antibody 25374
QQSFYTPRT

SEQ ID NO: 50748 - protein, 14 aa, Homo sapiens
  heavy chain complementarity determining region 3 for antibody 25374
ARRFLEWQGGWFDP

SEQ ID NO: 50749 - protein, 9 aa, Homo sapiens
  light chain complementarity determining region 3 for antibody 25375
QQSFTTPPT

SEQ ID NO: 50750 - protein, 18 aa, Homo sapiens
  heavy chain complementarity determining region 3 for antibody 25375
AREMDVAVDRVMFNILDS

SEQ ID NO: 50751 - protein, 9 aa, Homo sapiens
  light chain complementarity determining region 3 for antibody 25376
QQSFNTLYT

SEQ ID NO: 50752 - protein, 14 aa, Homo sapiens
  heavy chain complementarity determining region 3 for antibody 25376
ARDVLQYGHRLFDS

SEQ ID NO: 50753 - protein, 9 aa, Homo sapiens
  light chain complementarity determining region 3 for antibody 25377
QQSDNFPFT

SEQ ID NO: 50754 - protein, 20 aa, Homo sapiens
  heavy chain complementarity determining region 3 for antibody 25377
ARARITKIVVLIKPNWNFDV

SEQ ID NO: 50755 - protein, 10 aa, Homo sapiens
  light chain complementarity determining region 3 for antibody 25378
QQRSSWPPFT

SEQ ID NO: 50756 - protein, 10 aa, Homo sapiens
  heavy chain complementarity determining region 3 for antibody 25378
ARRYKGFFGY

SEQ ID NO: 50757 - protein, 8 aa, Homo sapiens
  light chain complementarity determining region 3 for antibody 25379
QQRSSWLT

SEQ ID NO: 50758 - protein, 14 aa, Homo sapiens
  heavy chain complementarity determining region 3 for antibody 25379
ARVYSLGWHWYFDL

SEQ ID NO: 50759 - protein, 10 aa, Homo sapiens
  light chain complementarity determining region 3 for antibody 25380
QQRSNWPPYT

SEQ ID NO: 50760 - protein, 14 aa, Homo sapiens
  heavy chain complementarity determining region 3 for antibody 25380
AVEGVVDKALALDY

SEQ ID NO: 50761 - protein, 9 aa, Homo sapiens
  light chain complementarity determining region 3 for antibody 25381
QQRSNWPPT

SEQ ID NO: 50762 - protein, 20 aa, Homo sapiens
  heavy chain complementarity determining region 3 for antibody 25381
ARAQRLLSGRYYGGGDWFDP

SEQ ID NO: 50763 - protein, 11 aa, Homo sapiens
  light chain complementarity determining region 3 for antibody 25382
QQRSNWPPGLT

SEQ ID NO: 50764 - protein, 15 aa, Homo sapiens
  heavy chain complementarity determining region 3 for antibody 25382
ARGRSVARVYYGMDV

SEQ ID NO: 50765 - protein, 9 aa, Homo sapiens
  light chain complementarity determining region 3 for antibody 25383
QQRSNWPIT

SEQ ID NO: 50766 - protein, 19 aa, Homo sapiens
  heavy chain complementarity determining region 3 for antibody 25383
AIHDPFYRGYSYGDDAFDI

SEQ ID NO: 50767 - protein, 9 aa, Homo sapiens
  light chain complementarity determining region 3 for antibody 25384
QQRNNWPLA

SEQ ID NO: 50768 - protein, 12 aa, Homo sapiens
  heavy chain complementarity determining region 3 for antibody 25384
ARQGSAGDYIYY

SEQ ID NO: 50769 - protein, 9 aa, Homo sapiens
  light chain complementarity determining region 3 for antibody 25385
QQLNSYPHT

SEQ ID NO: 50770 - protein, 17 aa, Homo sapiens
  heavy chain complementarity determining region 3 for antibody 25385
ARGPPIAVAGTSRKFDY

SEQ ID NO: 50771 - protein, 9 aa, Homo sapiens
  light chain complementarity determining region 3 for antibody 25386
QQLNSYPFT

SEQ ID NO: 50772 - protein, 16 aa, Homo sapiens
  heavy chain complementarity determining region 3 for antibody 25386
ARHPPPFYDTSAYYDN

SEQ ID NO: 50773 - protein, 9 aa, Homo sapiens
  light chain complementarity determining region 3 for antibody 25387
QQLNSYPFT

SEQ ID NO: 50774 - protein, 20 aa, Homo sapiens
  heavy chain complementarity determining region 3 for antibody 25387
AKDQRIAVPGRAYHYYALDV

SEQ ID NO: 50775 - protein, 9 aa, Homo sapiens
  light chain complementarity determining region 3 for antibody 25388
QQLNAYPRT

SEQ ID NO: 50776 - protein, 20 aa, Homo sapiens
  heavy chain complementarity determining region 3 for antibody 25388
ARETYYYDSSAYNNYWYFDL

SEQ ID NO: 50777 - protein, 9 aa, Homo sapiens
  light chain complementarity determining region 3 for antibody 25389
QQATHWPWT

SEQ ID NO: 50778 - protein, 15 aa, Homo sapiens
  heavy chain complementarity determining region 3 for antibody 25389
ASAVRGAPFGNWFDP

SEQ ID NO: 50779 - protein, 9 aa, Homo sapiens
  light chain complementarity determining region 3 for antibody 25390
QHYNSFPYT

SEQ ID NO: 50780 - protein, 22 aa, Homo sapiens
  heavy chain complementarity determining region 3 for antibody 25390
AREVRASGYDDFYNYYYYGLDV

SEQ ID NO: 50781 - protein, 9 aa, Homo sapiens
  light chain complementarity determining region 3 for antibody 25391
QHYGSSPYS

SEQ ID NO: 50782 - protein, 14 aa, Homo sapiens
  heavy chain complementarity determining region 3 for antibody 25391
ARVGVTAYGQIFDF

SEQ ID NO: 50783 - protein, 9 aa, Homo sapiens
  light chain complementarity determining region 3 for antibody 25392
QHYDTLPYT

SEQ ID NO: 50784 - protein, 14 aa, Homo sapiens
  heavy chain complementarity determining region 3 for antibody 25392
ARSRDGYNYRHFDS

SEQ ID NO: 50785 - protein, 9 aa, Homo sapiens
  light chain complementarity determining region 3 for antibody 25393
QHYDDLSFT

SEQ ID NO: 50786 - protein, 17 aa, Homo sapiens
  heavy chain complementarity determining region 3 for antibody 25393
ARHNNYYSDSYFVGFDF

SEQ ID NO: 50787 - protein, 8 aa, Homo sapiens
  light chain complementarity determining region 3 for antibody 25394
QGLQLPLT

SEQ ID NO: 50788 - protein, 15 aa, Homo sapiens
  heavy chain complementarity determining region 3 for antibody 25394
AKAQFYGGTWYAPDY

SEQ ID NO: 50789 - protein, 9 aa, Homo sapiens
  light chain complementarity determining region 3 for antibody 25395
MQPLQAPWT

SEQ ID NO: 50790 - protein, 21 aa, Homo sapiens
  heavy chain complementarity determining region 3 for antibody 25395
AREGQKPPPIISSGSRGGLDY

SEQ ID NO: 50791 - protein, 9 aa, Homo sapiens
  light chain complementarity determining region 3 for antibody 25396
MQGTHWPRT

SEQ ID NO: 50792 - protein, 23 aa, Homo sapiens
  heavy chain complementarity determining region 3 for antibody 25396
ARAQPRWGIAVAGPPGRYYGMDV

SEQ ID NO: 50793 - protein, 9 aa, Homo sapiens
  light chain complementarity determining region 3 for antibody 25397
MQGTHWPPT

SEQ ID NO: 50794 - protein, 20 aa, Homo sapiens
  heavy chain complementarity determining region 3 for antibody 25397
ARGRQRTGYSSSWYLGHFDY

SEQ ID NO: 50795 - protein, 10 aa, Homo sapiens
  light chain complementarity determining region 3 for antibody 25398
MQGSYWPPGT

SEQ ID NO: 50796 - protein, 11 aa, Homo sapiens
  heavy chain complementarity determining region 3 for antibody 25398
ARDTPGIGIDY

SEQ ID NO: 50797 - protein, 9 aa, Homo sapiens
  light chain complementarity determining region 3 for antibody 25399
MQATNWPRT

SEQ ID NO: 50798 - protein, 8 aa, Homo sapiens
  heavy chain complementarity determining region 3 for antibody 25399
AKDWQFDY

SEQ ID NO: 50799 - protein, 9 aa, Homo sapiens
  light chain complementarity determining region 3 for antibody 25400
MQATHWPRT

SEQ ID NO: 50800 - protein, 8 aa, Homo sapiens
  heavy chain complementarity determining region 3 for antibody 25400
AKDWQFDY

SEQ ID NO: 50801 - protein, 8 aa, Homo sapiens
  light chain complementarity determining region 3 for antibody 25401
MQALRPLT

SEQ ID NO: 50802 - protein, 16 aa, Homo sapiens
  heavy chain complementarity determining region 3 for antibody 25401
AKVGWLVGYDLSRGSA

SEQ ID NO: 50803 - protein, 8 aa, Homo sapiens
  light chain complementarity determining region 3 for antibody 25402
MQALQTPT

SEQ ID NO: 50804 - protein, 18 aa, Homo sapiens
  heavy chain complementarity determining region 3 for antibody 25402
ARVRVSWEILGADWYLDV

SEQ ID NO: 50805 - protein, 9 aa, Homo sapiens
  light chain complementarity determining region 3 for antibody 25403
MQALQLPYT

SEQ ID NO: 50806 - protein, 10 aa, Homo sapiens
  heavy chain complementarity determining region 3 for antibody 25403
ARRNQGKFDT

SEQ ID NO: 50807 - protein, 8 aa, Homo sapiens
  light chain complementarity determining region 3 for antibody 25404
MEALQTLT

SEQ ID NO: 50808 - protein, 20 aa, Homo sapiens
  heavy chain complementarity determining region 3 for antibody 25404
ARVKFGGRATIKYYYYGMDV

SEQ ID NO: 50809 - protein, 9 aa, Homo sapiens
  light chain complementarity determining region 3 for antibody 25405
LQRTHGPPG

SEQ ID NO: 50810 - protein, 18 aa, Homo sapiens
  heavy chain complementarity determining region 3 for antibody 25405
ARDRYSCDSGGCFHWFDP

SEQ ID NO: 50811 - protein, 9 aa, Homo sapiens
  light chain complementarity determining region 3 for antibody 25406
LQHNSYPLT

SEQ ID NO: 50812 - protein, 16 aa, Homo sapiens
  heavy chain complementarity determining region 3 for antibody 25406
AKSPSSGWANHDRFDI

SEQ ID NO: 50813 - protein, 9 aa, Homo sapiens
  light chain complementarity determining region 3 for antibody 25407
LQCHSYPWT

SEQ ID NO: 50814 - protein, 16 aa, Homo sapiens
  heavy chain complementarity determining region 3 for antibody 25407
ARDSRLANYYYHGMDV

SEQ ID NO: 50815 - protein, 9 aa, Homo sapiens
  light chain complementarity determining region 3 for antibody 25408
QQYYTSVRT

SEQ ID NO: 50816 - protein, 12 aa, Homo sapiens
  heavy chain complementarity determining region 3 for antibody 25408
VKDCSLGGSRDS

SEQ ID NO: 50817 - protein, 9 aa, Homo sapiens
  light chain complementarity determining region 3 for antibody 25409
QQYTNWPLT

SEQ ID NO: 50818 - protein, 12 aa, Homo sapiens
  heavy chain complementarity determining region 3 for antibody 25409
ARVFLAEAWTDY

SEQ ID NO: 50819 - protein, 9 aa, Homo sapiens
  light chain complementarity determining region 3 for antibody 25410
QQYSNWPRT

SEQ ID NO: 50820 - protein, 19 aa, Homo sapiens
  heavy chain complementarity determining region 3 for antibody 25410
ARGPWARGADDYGDTAYDY

SEQ ID NO: 50821 - protein, 8 aa, Homo sapiens
  light chain complementarity determining region 3 for antibody 25411
QQYRDSFP

SEQ ID NO: 50822 - protein, 13 aa, Homo sapiens
  heavy chain complementarity determining region 3 for antibody 25411
ATESGSYQGAFDI

SEQ ID NO: 50823 - protein, 9 aa, Homo sapiens
  light chain complementarity determining region 3 for antibody 25412
QQYNSYSWT

SEQ ID NO: 50824 - protein, 19 aa, Homo sapiens
  heavy chain complementarity determining region 3 for antibody 25412
ARDEGGGGWYDTNINAFDI

SEQ ID NO: 50825 - protein, 9 aa, Homo sapiens
  light chain complementarity determining region 3 for antibody 25413
QQYNSYSRT

SEQ ID NO: 50826 - protein, 11 aa, Homo sapiens
  heavy chain complementarity determining region 3 for antibody 25413
TGERAGTIVDF

SEQ ID NO: 50827 - protein, 9 aa, Homo sapiens
  light chain complementarity determining region 3 for antibody 25414
QQYNSYSRT

SEQ ID NO: 50828 - protein, 20 aa, Homo sapiens
  heavy chain complementarity determining region 3 for antibody 25414
ARLHRYCRGGHCYSPGSFDI

SEQ ID NO: 50829 - protein, 9 aa, Homo sapiens
  light chain complementarity determining region 3 for antibody 25415
QQYNSYSGT

SEQ ID NO: 50830 - protein, 12 aa, Homo sapiens
  heavy chain complementarity determining region 3 for antibody 25415
ARETTNIGELDY

SEQ ID NO: 50831 - protein, 9 aa, Homo sapiens
  light chain complementarity determining region 3 for antibody 25416
QQYNSYPYT

SEQ ID NO: 50832 - protein, 15 aa, Homo sapiens
  heavy chain complementarity determining region 3 for antibody 25416
ARDAFRGVIITTIDY

SEQ ID NO: 50833 - protein, 9 aa, Homo sapiens
  light chain complementarity determining region 3 for antibody 25417
QQYNSYLLT

SEQ ID NO: 50834 - protein, 18 aa, Homo sapiens
  heavy chain complementarity determining region 3 for antibody 25417
ARHEAAGSFAGGWNPADS

SEQ ID NO: 50835 - protein, 9 aa, Homo sapiens
  light chain complementarity determining region 3 for antibody 25418
QQYNSSSRT

SEQ ID NO: 50836 - protein, 13 aa, Homo sapiens
  heavy chain complementarity determining region 3 for antibody 25418
ARGSPGYYYVFAY

SEQ ID NO: 50837 - protein, 9 aa, Homo sapiens
  light chain complementarity determining region 3 for antibody 25419
QQYHKSPWT

SEQ ID NO: 50838 - protein, 17 aa, Homo sapiens
  heavy chain complementarity determining region 3 for antibody 25419
ARTLIYHFTWGRGAYDI

SEQ ID NO: 50839 - protein, 11 aa, Homo sapiens
  light chain complementarity determining region 3 for antibody 25420
QQYGTSPWAGT

SEQ ID NO: 50840 - protein, 13 aa, Homo sapiens
  heavy chain complementarity determining region 3 for antibody 25420
ARVAVPGLGYFQH

SEQ ID NO: 50841 - protein, 10 aa, Homo sapiens
  light chain complementarity determining region 3 for antibody 25421
QQYGTSPLYT

SEQ ID NO: 50842 - protein, 20 aa, Homo sapiens
  heavy chain complementarity determining region 3 for antibody 25421
ARGHYDYVWGSYRYTGELDY

SEQ ID NO: 50843 - protein, 9 aa, Homo sapiens
  light chain complementarity determining region 3 for antibody 25422
QQYGPTGVT

SEQ ID NO: 50844 - protein, 19 aa, Homo sapiens
  heavy chain complementarity determining region 3 for antibody 25422
AREAYYDSSGYFPSRYFDL

SEQ ID NO: 50845 - protein, 9 aa, Homo sapiens
  light chain complementarity determining region 3 for antibody 25423
QQYGNSPWT

SEQ ID NO: 50846 - protein, 20 aa, Homo sapiens
  heavy chain complementarity determining region 3 for antibody 25423
ARQHDYFSEGWRFPLGWFDS

SEQ ID NO: 50847 - protein, 9 aa, Homo sapiens
  light chain complementarity determining region 3 for antibody 25424
QQYGNLPRT

SEQ ID NO: 50848 - protein, 13 aa, Homo sapiens
  heavy chain complementarity determining region 3 for antibody 25424
AGGDFHSGGYSEF

SEQ ID NO: 50849 - protein, 11 aa, Homo sapiens
  light chain complementarity determining region 3 for antibody 25425
QQYGISPPPWA

SEQ ID NO: 50850 - protein, 12 aa, Homo sapiens
  heavy chain complementarity determining region 3 for antibody 25425
VKEKGGVRVFDF

SEQ ID NO: 50851 - protein, 8 aa, Homo sapiens
  light chain complementarity determining region 3 for antibody 25426
QQYDNLPT

SEQ ID NO: 50852 - protein, 14 aa, Homo sapiens
  heavy chain complementarity determining region 3 for antibody 25426
AKVRGSWYFGGLDY

SEQ ID NO: 50853 - protein, 9 aa, Homo sapiens
  light chain complementarity determining region 3 for antibody 25427
QQYDNLPFT

SEQ ID NO: 50854 - protein, 16 aa, Homo sapiens
  heavy chain complementarity determining region 3 for antibody 25427
ATDVTYFTSGSYQFDC

SEQ ID NO: 50855 - protein, 9 aa, Homo sapiens
  light chain complementarity determining region 3 for antibody 25428
QQYDNLPET

SEQ ID NO: 50856 - protein, 16 aa, Homo sapiens
  heavy chain complementarity determining region 3 for antibody 25428
VRGASALTTITGPSDP

SEQ ID NO: 50857 - protein, 9 aa, Homo sapiens
  light chain complementarity determining region 3 for antibody 25429
QQYDNFPPT

SEQ ID NO: 50858 - protein, 14 aa, Homo sapiens
  heavy chain complementarity determining region 3 for antibody 25429
ARGGPELGDWYFDL

SEQ ID NO: 50859 - protein, 10 aa, Homo sapiens
  light chain complementarity determining region 3 for antibody 25430
QQYDKYSPWA

SEQ ID NO: 50860 - protein, 15 aa, Homo sapiens
  heavy chain complementarity determining region 3 for antibody 25430
ARVLSDSRGWYHFDF

SEQ ID NO: 50861 - protein, 10 aa, Homo sapiens
  light chain complementarity determining region 3 for antibody 25431
QQTYSTPPLT

SEQ ID NO: 50862 - protein, 21 aa, Homo sapiens
  heavy chain complementarity determining region 3 for antibody 25431
AKDTYSGSFLEPYYYYYGMDV

SEQ ID NO: 50863 - protein, 9 aa, Homo sapiens
  light chain complementarity determining region 3 for antibody 25432
QQSYTTPWT

SEQ ID NO: 50864 - protein, 18 aa, Homo sapiens
  heavy chain complementarity determining region 3 for antibody 25432
ARAYRFRATIITFDGLDM

SEQ ID NO: 50865 - protein, 9 aa, Homo sapiens
  light chain complementarity determining region 3 for antibody 25433
QQSYTNPIT

SEQ ID NO: 50866 - protein, 19 aa, Homo sapiens
  heavy chain complementarity determining region 3 for antibody 25433
ASSQGIATDFTWRGSASDY

SEQ ID NO: 50867 - protein, 9 aa, Homo sapiens
  light chain complementarity determining region 3 for antibody 25434
QQSYSTPYT

SEQ ID NO: 50868 - protein, 18 aa, Homo sapiens
  heavy chain complementarity determining region 3 for antibody 25434
ARDAGLYSSGWYSEGFDY

SEQ ID NO: 50869 - protein, 9 aa, Homo sapiens
  light chain complementarity determining region 3 for antibody 25435
QQSYSTPWT

SEQ ID NO: 50870 - protein, 12 aa, Homo sapiens
  heavy chain complementarity determining region 3 for antibody 25435
ARAPGGWGYFDL

SEQ ID NO: 50871 - protein, 9 aa, Homo sapiens
  light chain complementarity determining region 3 for antibody 25436
QQSYSTELT

SEQ ID NO: 50872 - protein, 16 aa, Homo sapiens
  heavy chain complementarity determining region 3 for antibody 25436
AKDLRPGVSAPSGFDY

SEQ ID NO: 50873 - protein, 9 aa, Homo sapiens
  light chain complementarity determining region 3 for antibody 25437
QQSYSLPWT

SEQ ID NO: 50874 - protein, 16 aa, Homo sapiens
  heavy chain complementarity determining region 3 for antibody 25437
ARVVYSDYDWAGFVDY

SEQ ID NO: 50875 - protein, 9 aa, Homo sapiens
  light chain complementarity determining region 3 for antibody 25438
QQSYSHPPT

SEQ ID NO: 50876 - protein, 16 aa, Homo sapiens
  heavy chain complementarity determining region 3 for antibody 25438
ARDLQLHSTSSGVFGT

SEQ ID NO: 50877 - protein, 9 aa, Homo sapiens
  light chain complementarity determining region 3 for antibody 25439
QQSYITPGT

SEQ ID NO: 50878 - protein, 19 aa, Homo sapiens
  heavy chain complementarity determining region 3 for antibody 25439
ARQVAAVLRGGHSYWHFDL

SEQ ID NO: 50879 - protein, 10 aa, Homo sapiens
  light chain complementarity determining region 3 for antibody 25440
QQSHSDPPCT

SEQ ID NO: 50880 - protein, 13 aa, Homo sapiens
  heavy chain complementarity determining region 3 for antibody 25440
ARGGVATRNYLDY

SEQ ID NO: 50881 - protein, 9 aa, Homo sapiens
  light chain complementarity determining region 3 for antibody 25441
QQSFSTLYT

SEQ ID NO: 50882 - protein, 19 aa, Homo sapiens
  heavy chain complementarity determining region 3 for antibody 25441
ARAVQDFSSGWYPHHYFDF

SEQ ID NO: 50883 - protein, 10 aa, Homo sapiens
  light chain complementarity determining region 3 for antibody 25442
QQRSSWPRLT

SEQ ID NO: 50884 - protein, 14 aa, Homo sapiens
  heavy chain complementarity determining region 3 for antibody 25442
SKDAGLKGASFFDH

SEQ ID NO: 50885 - protein, 11 aa, Homo sapiens
  light chain complementarity determining region 3 for antibody 25443
QQRSSWPLMYT

SEQ ID NO: 50886 - protein, 16 aa, Homo sapiens
  heavy chain complementarity determining region 3 for antibody 25443
ARDHMTNRNSFYGLDV

SEQ ID NO: 50887 - protein, 10 aa, Homo sapiens
  light chain complementarity determining region 3 for antibody 25444
QQRSNWPPLT

SEQ ID NO: 50888 - protein, 18 aa, Homo sapiens
  heavy chain complementarity determining region 3 for antibody 25444
ARDSRGFLEWLLQGSTDY

SEQ ID NO: 50889 - protein, 10 aa, Homo sapiens
  light chain complementarity determining region 3 for antibody 25445
QQRSNWPPIT

SEQ ID NO: 50890 - protein, 16 aa, Homo sapiens
  heavy chain complementarity determining region 3 for antibody 25445
ARASGIVRRTPYFFNH

SEQ ID NO: 50891 - protein, 10 aa, Homo sapiens
  light chain complementarity determining region 3 for antibody 25446
QQRSNWPPIT

SEQ ID NO: 50892 - protein, 17 aa, Homo sapiens
  heavy chain complementarity determining region 3 for antibody 25446
AAGCHSESLSADDVFDM

SEQ ID NO: 50893 - protein, 10 aa, Homo sapiens
  light chain complementarity determining region 3 for antibody 25447
QQRSNWPLLT

SEQ ID NO: 50894 - protein, 12 aa, Homo sapiens
  heavy chain complementarity determining region 3 for antibody 25447
VKVWGQWLAFDY

SEQ ID NO: 50895 - protein, 10 aa, Homo sapiens
  light chain complementarity determining region 3 for antibody 25448
QQCTNSPPWT

SEQ ID NO: 50896 - protein, 14 aa, Homo sapiens
  heavy chain complementarity determining region 3 for antibody 25448
ASLAYGANQDAFDL

SEQ ID NO: 50897 - protein, 10 aa, Homo sapiens
  light chain complementarity determining region 3 for antibody 25449
QQCFSTPGYT

SEQ ID NO: 50898 - protein, 11 aa, Homo sapiens
  heavy chain complementarity determining region 3 for antibody 25449
AKTYNSGWFDY

SEQ ID NO: 50899 - protein, 11 aa, Homo sapiens
  light chain complementarity determining region 3 for antibody 25450
QLYETSPPGYT

SEQ ID NO: 50900 - protein, 14 aa, Homo sapiens
  heavy chain complementarity determining region 3 for antibody 25450
AREHTISRKRSFDQ

SEQ ID NO: 50901 - protein, 9 aa, Homo sapiens
  light chain complementarity determining region 3 for antibody 25451
QKYNSAPYT

SEQ ID NO: 50902 - protein, 17 aa, Homo sapiens
  heavy chain complementarity determining region 3 for antibody 25451
VTNGPGPVEAPYGYFDY

SEQ ID NO: 50903 - protein, 9 aa, Homo sapiens
  light chain complementarity determining region 3 for antibody 25452
QHYYTSLRT

SEQ ID NO: 50904 - protein, 12 aa, Homo sapiens
  heavy chain complementarity determining region 3 for antibody 25452
VKDCGLGGSRDS

SEQ ID NO: 50905 - protein, 8 aa, Homo sapiens
  light chain complementarity determining region 3 for antibody 25453
QCLNGYLV

SEQ ID NO: 50906 - protein, 9 aa, Homo sapiens
  heavy chain complementarity determining region 3 for antibody 25453
ARDYLGFDS

SEQ ID NO: 50907 - protein, 9 aa, Homo sapiens
  light chain complementarity determining region 3 for antibody 25454
MQVLQTPRT

SEQ ID NO: 50908 - protein, 20 aa, Homo sapiens
  heavy chain complementarity determining region 3 for antibody 25454
TTGTKLYITGTIYHYFAMDV

SEQ ID NO: 50909 - protein, 9 aa, Homo sapiens
  light chain complementarity determining region 3 for antibody 25455
MQGTHWPYT

SEQ ID NO: 50910 - protein, 17 aa, Homo sapiens
  heavy chain complementarity determining region 3 for antibody 25455
AGGEGTISGGMGFGMDV

SEQ ID NO: 50911 - protein, 11 aa, Homo sapiens
  light chain complementarity determining region 3 for antibody 25456
MQGTHWPPSYT

SEQ ID NO: 50912 - protein, 16 aa, Homo sapiens
  heavy chain complementarity determining region 3 for antibody 25456
AVPRQMATIRNDAFDI

SEQ ID NO: 50913 - protein, 12 aa, Homo sapiens
  light chain complementarity determining region 3 for antibody 25457
MQGTHWPPDQFT

SEQ ID NO: 50914 - protein, 12 aa, Homo sapiens
  heavy chain complementarity determining region 3 for antibody 25457
ARRGELDDAFDI

SEQ ID NO: 50915 - protein, 9 aa, Homo sapiens
  light chain complementarity determining region 3 for antibody 25458
MQGLQTPLT

SEQ ID NO: 50916 - protein, 14 aa, Homo sapiens
  heavy chain complementarity determining region 3 for antibody 25458
ARDNRGAYYYAMDV

SEQ ID NO: 50917 - protein, 9 aa, Homo sapiens
  light chain complementarity determining region 3 for antibody 25459
MQGLQTLLT

SEQ ID NO: 50918 - protein, 14 aa, Homo sapiens
  heavy chain complementarity determining region 3 for antibody 25459
ARAPSVEFTWGFGY

SEQ ID NO: 50919 - protein, 9 aa, Homo sapiens
  light chain complementarity determining region 3 for antibody 25460
MQALQTPRT

SEQ ID NO: 50920 - protein, 14 aa, Homo sapiens
  heavy chain complementarity determining region 3 for antibody 25460
ARVYGTSMSASGYY

SEQ ID NO: 50921 - protein, 9 aa, Homo sapiens
  light chain complementarity determining region 3 for antibody 25461
MQALQAPPG

SEQ ID NO: 50922 - protein, 19 aa, Homo sapiens
  heavy chain complementarity determining region 3 for antibody 25461
ARDLGYYDFWSGYLEGMDY

SEQ ID NO: 50923 - protein, 9 aa, Homo sapiens
  light chain complementarity determining region 3 for antibody 25462
LQYNRYPWT

SEQ ID NO: 50924 - protein, 15 aa, Homo sapiens
  heavy chain complementarity determining region 3 for antibody 25462
VREGTSRPGWSEIEY

SEQ ID NO: 50925 - protein, 9 aa, Homo sapiens
  light chain complementarity determining region 3 for antibody 25463
LQHNSYPRT

SEQ ID NO: 50926 - protein, 12 aa, Homo sapiens
  heavy chain complementarity determining region 3 for antibody 25463
GSTSSWYFQFDY

SEQ ID NO: 50927 - protein, 9 aa, Homo sapiens
  light chain complementarity determining region 3 for antibody 25464
LQHNSYPRT

SEQ ID NO: 50928 - protein, 17 aa, Homo sapiens
  heavy chain complementarity determining region 3 for antibody 25464
AKGGDYYDTSGYYFFDY

SEQ ID NO: 50929 - protein, 9 aa, Homo sapiens
  light chain complementarity determining region 3 for antibody 25465
LQHNSYPQT

SEQ ID NO: 50930 - protein, 11 aa, Homo sapiens
  heavy chain complementarity determining region 3 for antibody 25465
ARYDWYYGMDV

SEQ ID NO: 50931 - protein, 9 aa, Homo sapiens
  light chain complementarity determining region 3 for antibody 25466
LQHNSYPPT

SEQ ID NO: 50932 - protein, 16 aa, Homo sapiens
  heavy chain complementarity determining region 3 for antibody 25466
SREKFRGQQPRDVFDI

SEQ ID NO: 50933 - protein, 9 aa, Homo sapiens
  light chain complementarity determining region 3 for antibody 25467
HQYNSYLYT

SEQ ID NO: 50934 - protein, 14 aa, Homo sapiens
  heavy chain complementarity determining region 3 for antibody 25467
TTDPFEWQWLSFDY

SEQ ID NO: 50935 - protein, 9 aa, Homo sapiens
  light chain complementarity determining region 3 for antibody 25468
HQYGSSPRT

SEQ ID NO: 50936 - protein, 20 aa, Homo sapiens
  heavy chain complementarity determining region 3 for antibody 25468
AREAGVAAGNYYYQYYGMDV

SEQ ID NO: 50937 - protein, 10 aa, Homo sapiens
  light chain complementarity determining region 3 for antibody 25469
HQRAGWPQVT

SEQ ID NO: 50938 - protein, 14 aa, Homo sapiens
  heavy chain complementarity determining region 3 for antibody 25469
ARDTKWGSTWFFDL

SEQ ID NO: 50939 - protein, 6 aa, Homo sapiens
  light chain complementarity determining region 3 for antibody 25470
RQYGET

SEQ ID NO: 50940 - protein, 12 aa, Homo sapiens
  heavy chain complementarity determining region 3 for antibody 25470
ARDHSSGWSLSN

SEQ ID NO: 50941 - protein, 9 aa, Homo sapiens
  light chain complementarity determining region 3 for antibody 25471
QQYYTSLRP

SEQ ID NO: 50942 - protein, 12 aa, Homo sapiens
  heavy chain complementarity determining region 3 for antibody 25471
VKDCGLGGSRDS

SEQ ID NO: 50943 - protein, 9 aa, Homo sapiens
  light chain complementarity determining region 3 for antibody 25472
QQYYTNPRT

SEQ ID NO: 50944 - protein, 8 aa, Homo sapiens
  heavy chain complementarity determining region 3 for antibody 25472
ARDGAFDS

SEQ ID NO: 50945 - protein, 9 aa, Homo sapiens
  light chain complementarity determining region 3 for antibody 25473
QQYYSTPRT

SEQ ID NO: 50946 - protein, 18 aa, Homo sapiens
  heavy chain complementarity determining region 3 for antibody 25473
ARGGRNRYGYSSSWPTDY

SEQ ID NO: 50947 - protein, 9 aa, Homo sapiens
  light chain complementarity determining region 3 for antibody 25474
QQYYHSPRN

SEQ ID NO: 50948 - protein, 13 aa, Homo sapiens
  heavy chain complementarity determining region 3 for antibody 25474
ARGQSGDPRTYDC

SEQ ID NO: 50949 - protein, 9 aa, Homo sapiens
  light chain complementarity determining region 3 for antibody 25475
QQYQTYPIT

SEQ ID NO: 50950 - protein, 10 aa, Homo sapiens
  heavy chain complementarity determining region 3 for antibody 25475
ARDAEHGVDV

SEQ ID NO: 50951 - protein, 9 aa, Homo sapiens
  light chain complementarity determining region 3 for antibody 25476
QQYNSYSQT

SEQ ID NO: 50952 - protein, 17 aa, Homo sapiens
  heavy chain complementarity determining region 3 for antibody 25476
ARGCSGGSCYPQRGFDY

SEQ ID NO: 50953 - protein, 9 aa, Homo sapiens
  light chain complementarity determining region 3 for antibody 25477
QQYNSYPYT

SEQ ID NO: 50954 - protein, 16 aa, Homo sapiens
  heavy chain complementarity determining region 3 for antibody 25477
TRDRAGSSWYIDGFDI

SEQ ID NO: 50955 - protein, 9 aa, Homo sapiens
  light chain complementarity determining region 3 for antibody 25478
QQYNSYPYT

SEQ ID NO: 50956 - protein, 20 aa, Homo sapiens
  heavy chain complementarity determining region 3 for antibody 25478
ARERQYCSANSCYYQSVLDY

SEQ ID NO: 50957 - protein, 9 aa, Homo sapiens
  light chain complementarity determining region 3 for antibody 25479
QQYNSYPLT

SEQ ID NO: 50958 - protein, 16 aa, Homo sapiens
  heavy chain complementarity determining region 3 for antibody 25479
ARQGLVVVVTASAFDI

SEQ ID NO: 50959 - protein, 9 aa, Homo sapiens
  light chain complementarity determining region 3 for antibody 25480
QQYNSYLFT

SEQ ID NO: 50960 - protein, 17 aa, Homo sapiens
  heavy chain complementarity determining region 3 for antibody 25480
ATTGGDGYNYSPRPLDY

SEQ ID NO: 50961 - protein, 10 aa, Homo sapiens
  light chain complementarity determining region 3 for antibody 25481
QQYNSSSPVT

SEQ ID NO: 50962 - protein, 11 aa, Homo sapiens
  heavy chain complementarity determining region 3 for antibody 25481
ARGVTNRFFDL

SEQ ID NO: 50963 - protein, 9 aa, Homo sapiens
  light chain complementarity determining region 3 for antibody 25482
QQYNNWPRT

SEQ ID NO: 50964 - protein, 11 aa, Homo sapiens
  heavy chain complementarity determining region 3 for antibody 25482
ARLRYQGYFDV

SEQ ID NO: 50965 - protein, 8 aa, Homo sapiens
  light chain complementarity determining region 3 for antibody 25483
QQYNKFLT

SEQ ID NO: 50966 - protein, 15 aa, Homo sapiens
  heavy chain complementarity determining region 3 for antibody 25483
AKGLTASSGWYVFDL

SEQ ID NO: 50967 - protein, 9 aa, Homo sapiens
  light chain complementarity determining region 3 for antibody 25484
QQYNGYSPT

SEQ ID NO: 50968 - protein, 14 aa, Homo sapiens
  heavy chain complementarity determining region 3 for antibody 25484
ARALGSGWNYYFEF

SEQ ID NO: 50969 - protein, 8 aa, Homo sapiens
  light chain complementarity determining region 3 for antibody 25485
QQYMSPFT

SEQ ID NO: 50970 - protein, 12 aa, Homo sapiens
  heavy chain complementarity determining region 3 for antibody 25485
ARALSASWYACY

SEQ ID NO: 50971 - protein, 9 aa, Homo sapiens
  light chain complementarity determining region 3 for antibody 25486
QQYKSYPIT

SEQ ID NO: 50972 - protein, 15 aa, Homo sapiens
  heavy chain complementarity determining region 3 for antibody 25486
AKIGEYSGGWPNFDY

SEQ ID NO: 50973 - protein, 9 aa, Homo sapiens
  light chain complementarity determining region 3 for antibody 25487
QQYISYPLT

SEQ ID NO: 50974 - protein, 14 aa, Homo sapiens
  heavy chain complementarity determining region 3 for antibody 25487
AKSLVVMGRGYFDL

SEQ ID NO: 50975 - protein, 9 aa, Homo sapiens
  light chain complementarity determining region 3 for antibody 25488
QQYHTSPLT

SEQ ID NO: 50976 - protein, 13 aa, Homo sapiens
  heavy chain complementarity determining region 3 for antibody 25488
AKDPPRHWGSWGN

SEQ ID NO: 50977 - protein, 9 aa, Homo sapiens
  light chain complementarity determining region 3 for antibody 25489
QQYHNLPLS

SEQ ID NO: 50978 - protein, 18 aa, Homo sapiens
  heavy chain complementarity determining region 3 for antibody 25489
ARDPRCPLSWRAVCFPDY

SEQ ID NO: 50979 - protein, 9 aa, Homo sapiens
  light chain complementarity determining region 3 for antibody 25490
QQYHDWPRT

SEQ ID NO: 50980 - protein, 23 aa, Homo sapiens
  heavy chain complementarity determining region 3 for antibody 25490
ARMERIVLMNSDSSVHFYGWLDP

SEQ ID NO: 50981 - protein, 9 aa, Homo sapiens
  light chain complementarity determining region 3 for antibody 25491
QQYGSSPRT

SEQ ID NO: 50982 - protein, 17 aa, Homo sapiens
  heavy chain complementarity determining region 3 for antibody 25491
ARAMEQSRYFDWMTFEI

SEQ ID NO: 50983 - protein, 10 aa, Homo sapiens
  light chain complementarity determining region 3 for antibody 25492
QQYGSSPPIT

SEQ ID NO: 50984 - protein, 21 aa, Homo sapiens
  heavy chain complementarity determining region 3 for antibody 25492
ARDHYDTSAYYYNGVPWDFDY

SEQ ID NO: 50985 - protein, 10 aa, Homo sapiens
  light chain complementarity determining region 3 for antibody 25493
QQYGSSPLYT

SEQ ID NO: 50986 - protein, 13 aa, Homo sapiens
  heavy chain complementarity determining region 3 for antibody 25493
AAIRDPVSWSCSE

SEQ ID NO: 50987 - protein, 9 aa, Homo sapiens
  light chain complementarity determining region 3 for antibody 25494
QQYGSSPLT

SEQ ID NO: 50988 - protein, 19 aa, Homo sapiens
  heavy chain complementarity determining region 3 for antibody 25494
ARGSNSSRRRAAVVGDFDL

SEQ ID NO: 50989 - protein, 6 aa, Homo sapiens
  light chain complementarity determining region 3 for antibody 25495
QQYGRT

SEQ ID NO: 50990 - protein, 12 aa, Homo sapiens
  heavy chain complementarity determining region 3 for antibody 25495
ARFMNSWYPYDY

SEQ ID NO: 50991 - protein, 9 aa, Homo sapiens
  light chain complementarity determining region 3 for antibody 25496
QQYGNIPRT

SEQ ID NO: 50992 - protein, 14 aa, Homo sapiens
  heavy chain complementarity determining region 3 for antibody 25496
AGGTFDSSGYYYDY

SEQ ID NO: 50993 - protein, 8 aa, Homo sapiens
  light chain complementarity determining region 3 for antibody 25497
QQYGISRT

SEQ ID NO: 50994 - protein, 15 aa, Homo sapiens
  heavy chain complementarity determining region 3 for antibody 25497
AREVTTYYIYYGLDV

SEQ ID NO: 50995 - protein, 9 aa, Homo sapiens
  light chain complementarity determining region 3 for antibody 25498
QQYDSYSYT

SEQ ID NO: 50996 - protein, 16 aa, Homo sapiens
  heavy chain complementarity determining region 3 for antibody 25498
ARHSKVVAGSKNAFDI

SEQ ID NO: 50997 - protein, 11 aa, Homo sapiens
  light chain complementarity determining region 3 for antibody 25499
QQYDNLPPALT

SEQ ID NO: 50998 - protein, 15 aa, Homo sapiens
  heavy chain complementarity determining region 3 for antibody 25499
ASMPYNNVPFPPFDH

SEQ ID NO: 50999 - protein, 10 aa, Homo sapiens
  light chain complementarity determining region 3 for antibody 25500
QQYDNLLMYS

SEQ ID NO: 51000 - protein, 14 aa, Homo sapiens
  heavy chain complementarity determining region 3 for antibody 25500
ASHVYGDERNAFDL

SEQ ID NO: 51001 - protein, 9 aa, Homo sapiens
  light chain complementarity determining region 3 for antibody 25501
QQVNSYPFT

SEQ ID NO: 51002 - protein, 8 aa, Homo sapiens
  heavy chain complementarity determining region 3 for antibody 25501
ARGRFYYV

SEQ ID NO: 51003 - protein, 9 aa, Homo sapiens
  light chain complementarity determining region 3 for antibody 25502
QQVNGYPLT

SEQ ID NO: 51004 - protein, 28 aa, Homo sapiens
  heavy chain complementarity determining region 3 for antibody 25502
ARDTSRGRMTFYDILTGYTNRASEYFDY

SEQ ID NO: 51005 - protein, 9 aa, Homo sapiens
  light chain complementarity determining region 3 for antibody 25503
QQSYTTPFS

SEQ ID NO: 51006 - protein, 20 aa, Homo sapiens
  heavy chain complementarity determining region 3 for antibody 25503
ARRSPLRLIDDYDVDYGMDV

SEQ ID NO: 51007 - protein, 9 aa, Homo sapiens
  light chain complementarity determining region 3 for antibody 25504
QQSYSTPLT

SEQ ID NO: 51008 - protein, 17 aa, Homo sapiens
  heavy chain complementarity determining region 3 for antibody 25504
AKDLGSAGYSNGHGFDS

SEQ ID NO: 51009 - protein, 8 aa, Homo sapiens
  light chain complementarity determining region 3 for antibody 25505
QQSYSTPL

SEQ ID NO: 51010 - protein, 21 aa, Homo sapiens
  heavy chain complementarity determining region 3 for antibody 25505
ARVYGGYSSGWSDEYLYYFDY

SEQ ID NO: 51011 - protein, 9 aa, Homo sapiens
  light chain complementarity determining region 3 for antibody 25506
QQSYSTPIT

SEQ ID NO: 51012 - protein, 17 aa, Homo sapiens
  heavy chain complementarity determining region 3 for antibody 25506
AKVDTIVGATGYWYFDL

SEQ ID NO: 51013 - protein, 10 aa, Homo sapiens
  light chain complementarity determining region 3 for antibody 25507
QQSYSTLPLT

SEQ ID NO: 51014 - protein, 19 aa, Homo sapiens
  heavy chain complementarity determining region 3 for antibody 25507
ARYTYYYHISGSHYHGFDF

SEQ ID NO: 51015 - protein, 10 aa, Homo sapiens
  light chain complementarity determining region 3 for antibody 25508
QQSYSAPMYT

SEQ ID NO: 51016 - protein, 16 aa, Homo sapiens
  heavy chain complementarity determining region 3 for antibody 25508
VRDTQPGLGASNAFDI

SEQ ID NO: 51017 - protein, 10 aa, Homo sapiens
  light chain complementarity determining region 3 for antibody 25509
QQSNVYSPFA

SEQ ID NO: 51018 - protein, 16 aa, Homo sapiens
  heavy chain complementarity determining region 3 for antibody 25509
AKDGSKMNWGHWFFDL

SEQ ID NO: 51019 - protein, 9 aa, Homo sapiens
  light chain complementarity determining region 3 for antibody 25510
QQSNGFPLT

SEQ ID NO: 51020 - protein, 19 aa, Homo sapiens
  heavy chain complementarity determining region 3 for antibody 25510
AKAPEAFTSGANGGDAFDI

SEQ ID NO: 51021 - protein, 9 aa, Homo sapiens
  light chain complementarity determining region 3 for antibody 25511
QQSFLTPHT

SEQ ID NO: 51022 - protein, 14 aa, Homo sapiens
  heavy chain complementarity determining region 3 for antibody 25511
ARRDSYGYSLAFDI

SEQ ID NO: 51023 - protein, 9 aa, Homo sapiens
  light chain complementarity determining region 3 for antibody 25512
QQSFDDPPT

SEQ ID NO: 51024 - protein, 18 aa, Homo sapiens
  heavy chain complementarity determining region 3 for antibody 25512
AREVSSFANGAAYVLFDP

SEQ ID NO: 51025 - protein, 11 aa, Homo sapiens
  light chain complementarity determining region 3 for antibody 25513
QQRTNWPPIYP

SEQ ID NO: 51026 - protein, 14 aa, Homo sapiens
  heavy chain complementarity determining region 3 for antibody 25513
ARGGLGIWGNSSDI

SEQ ID NO: 51027 - protein, 10 aa, Homo sapiens
  light chain complementarity determining region 3 for antibody 25514
QQRSTWPPLT

SEQ ID NO: 51028 - protein, 16 aa, Homo sapiens
  heavy chain complementarity determining region 3 for antibody 25514
ATCLLRPPPEDQLFDP

SEQ ID NO: 51029 - protein, 10 aa, Homo sapiens
  light chain complementarity determining region 3 for antibody 25515
QQRSNWPPNT

SEQ ID NO: 51030 - protein, 15 aa, Homo sapiens
  heavy chain complementarity determining region 3 for antibody 25515
ARSGSSTWYGYGMDV

SEQ ID NO: 51031 - protein, 11 aa, Homo sapiens
  light chain complementarity determining region 3 for antibody 25516
QQRSNWPPALT

SEQ ID NO: 51032 - protein, 15 aa, Homo sapiens
  heavy chain complementarity determining region 3 for antibody 25516
ARVPDNWNYAEVSDY

SEQ ID NO: 51033 - protein, 10 aa, Homo sapiens
  light chain complementarity determining region 3 for antibody 25517
QQRSNWPMYT

SEQ ID NO: 51034 - protein, 10 aa, Homo sapiens
  heavy chain complementarity determining region 3 for antibody 25517
ARVVGYYFDS

SEQ ID NO: 51035 - protein, 10 aa, Homo sapiens
  light chain complementarity determining region 3 for antibody 25518
QQRSNWPLYT

SEQ ID NO: 51036 - protein, 17 aa, Homo sapiens
  heavy chain complementarity determining region 3 for antibody 25518
ARGAVDFWSGRTGSHDP

SEQ ID NO: 51037 - protein, 10 aa, Homo sapiens
  light chain complementarity determining region 3 for antibody 25519
QQRINWPPLT

SEQ ID NO: 51038 - protein, 14 aa, Homo sapiens
  heavy chain complementarity determining region 3 for antibody 25519
ASFSRYSYGKSIDY

SEQ ID NO: 51039 - protein, 10 aa, Homo sapiens
  light chain complementarity determining region 3 for antibody 25520
QQNSNFVAYT

SEQ ID NO: 51040 - protein, 12 aa, Homo sapiens
  heavy chain complementarity determining region 3 for antibody 25520
AREMTHLGELDY

SEQ ID NO: 51041 - protein, 9 aa, Homo sapiens
  light chain complementarity determining region 3 for antibody 25521
QQNGSLPLT

SEQ ID NO: 51042 - protein, 15 aa, Homo sapiens
  heavy chain complementarity determining region 3 for antibody 25521
AHRPNYYDKAGAFDI

SEQ ID NO: 51043 - protein, 9 aa, Homo sapiens
  light chain complementarity determining region 3 for antibody 25522
QQLNSYPIT

SEQ ID NO: 51044 - protein, 18 aa, Homo sapiens
  heavy chain complementarity determining region 3 for antibody 25522
ARPLAYTIIAIQPAGIEH

SEQ ID NO: 51045 - protein, 9 aa, Homo sapiens
  light chain complementarity determining region 3 for antibody 25523
QQGYSSPFT

SEQ ID NO: 51046 - protein, 20 aa, Homo sapiens
  heavy chain complementarity determining region 3 for antibody 25523
AHRGYNSFFGIVTKSDWFDP

SEQ ID NO: 51047 - protein, 9 aa, Homo sapiens
  light chain complementarity determining region 3 for antibody 25524
QQGNLFPWT

SEQ ID NO: 51048 - protein, 16 aa, Homo sapiens
  heavy chain complementarity determining region 3 for antibody 25524
ARGAMSLLEGLYALDI

SEQ ID NO: 51049 - protein, 9 aa, Homo sapiens
  light chain complementarity determining region 3 for antibody 25525
QQFDNVPVT

SEQ ID NO: 51050 - protein, 25 aa, Homo sapiens
  heavy chain complementarity determining region 3 for antibody 25525
ARGELVFSMVRGSIITVTNNYYFDR

SEQ ID NO: 51051 - protein, 9 aa, Homo sapiens
  light chain complementarity determining region 3 for antibody 25526
QQDGSSLYT

SEQ ID NO: 51052 - protein, 9 aa, Homo sapiens
  heavy chain complementarity determining region 3 for antibody 25526
IYEINAFDI

SEQ ID NO: 51053 - protein, 9 aa, Homo sapiens
  light chain complementarity determining region 3 for antibody 25527
QQANSFPRT

SEQ ID NO: 51054 - protein, 15 aa, Homo sapiens
  heavy chain complementarity determining region 3 for antibody 25527
ARGVPHLGVWHAFDI

SEQ ID NO: 51055 - protein, 10 aa, Homo sapiens
  light chain complementarity determining region 3 for antibody 25528
QPYNRYYPWT

SEQ ID NO: 51056 - protein, 13 aa, Homo sapiens
  heavy chain complementarity determining region 3 for antibody 25528
AADSHVSSADFDY

SEQ ID NO: 51057 - protein, 9 aa, Homo sapiens
  light chain complementarity determining region 3 for antibody 25529
QHYLDLPLT

SEQ ID NO: 51058 - protein, 18 aa, Homo sapiens
  heavy chain complementarity determining region 3 for antibody 25529
ARDFPKGETHGPYDSLDT

SEQ ID NO: 51059 - protein, 9 aa, Homo sapiens
  light chain complementarity determining region 3 for antibody 25530
MQVLQTPPT

SEQ ID NO: 51060 - protein, 12 aa, Homo sapiens
  heavy chain complementarity determining region 3 for antibody 25530
VKDSDKKWELLD

SEQ ID NO: 51061 - protein, 9 aa, Homo sapiens
  light chain complementarity determining region 3 for antibody 25531
MQGTHWPLT

SEQ ID NO: 51062 - protein, 9 aa, Homo sapiens
  heavy chain complementarity determining region 3 for antibody 25531
ARNNWGIDY

SEQ ID NO: 51063 - protein, 9 aa, Homo sapiens
  light chain complementarity determining region 3 for antibody 25532
MQALQTPYT

SEQ ID NO: 51064 - protein, 19 aa, Homo sapiens
  heavy chain complementarity determining region 3 for antibody 25532
ARGEKGIATRPSGNNWFDP

SEQ ID NO: 51065 - protein, 9 aa, Homo sapiens
  light chain complementarity determining region 3 for antibody 25533
MQALETPFP

SEQ ID NO: 51066 - protein, 15 aa, Homo sapiens
  heavy chain complementarity determining region 3 for antibody 25533
VRHYRETVAGIEGDS

SEQ ID NO: 51067 - protein, 9 aa, Homo sapiens
  light chain complementarity determining region 3 for antibody 25534
MGTLQTPPT

SEQ ID NO: 51068 - protein, 15 aa, Homo sapiens
  heavy chain complementarity determining region 3 for antibody 25534
TRDGKKDGHNDAFDV

SEQ ID NO: 51069 - protein, 9 aa, Homo sapiens
  light chain complementarity determining region 3 for antibody 25535
LQDYNYPRT

SEQ ID NO: 51070 - protein, 22 aa, Homo sapiens
  heavy chain complementarity determining region 3 for antibody 25535
ARDLTPTSYSDTSLFYYDALDI

SEQ ID NO: 51071 - protein, 9 aa, Homo sapiens
  light chain complementarity determining region 3 for antibody 25536
LQDYNYPHT

SEQ ID NO: 51072 - protein, 10 aa, Homo sapiens
  heavy chain complementarity determining region 3 for antibody 25536
ARRGLYFGES

SEQ ID NO: 51073 - protein, 9 aa, Homo sapiens
  light chain complementarity determining region 3 for antibody 25537
LQDYKYPYT

SEQ ID NO: 51074 - protein, 19 aa, Homo sapiens
  heavy chain complementarity determining region 3 for antibody 25537
ARDRDDYNQRGYYFYGMDV

SEQ ID NO: 51075 - protein, 9 aa, Homo sapiens
  light chain complementarity determining region 3 for antibody 25538
HQYNYYPGT

SEQ ID NO: 51076 - protein, 16 aa, Homo sapiens
  heavy chain complementarity determining region 3 for antibody 25538
ARVMTAITTRYFYFDL

SEQ ID NO: 51077 - protein, 9 aa, Homo sapiens
  light chain complementarity determining region 3 for antibody 25539
HQYGSSPGT

SEQ ID NO: 51078 - protein, 20 aa, Homo sapiens
  heavy chain complementarity determining region 3 for antibody 25539
ARPRGVSHLATAGSPDYFDL

SEQ ID NO: 51079 - protein, 9 aa, Homo sapiens
  light chain complementarity determining region 3 for antibody 25540
QQYYTYSVT

SEQ ID NO: 51080 - protein, 21 aa, Homo sapiens
  heavy chain complementarity determining region 3 for antibody 25540
ARGRHIVVVTSDFGTADNFGR

SEQ ID NO: 51081 - protein, 9 aa, Homo sapiens
  light chain complementarity determining region 3 for antibody 25541
QQYYTSFRT

SEQ ID NO: 51082 - protein, 12 aa, Homo sapiens
  heavy chain complementarity determining region 3 for antibody 25541
VKDCGLGGSRDF

SEQ ID NO: 51083 - protein, 9 aa, Homo sapiens
  light chain complementarity determining region 3 for antibody 25542
QQYYATPQT

SEQ ID NO: 51084 - protein, 11 aa, Homo sapiens
  heavy chain complementarity determining region 3 for antibody 25542
AHRRRGGSFDF

SEQ ID NO: 51085 - protein, 9 aa, Homo sapiens
  light chain complementarity determining region 3 for antibody 25543
QQYNTYPDT

SEQ ID NO: 51086 - protein, 16 aa, Homo sapiens
  heavy chain complementarity determining region 3 for antibody 25543
ARGGYCGGGSCYALSH

SEQ ID NO: 51087 - protein, 9 aa, Homo sapiens
  light chain complementarity determining region 3 for antibody 25544
QQYNSYSWT

SEQ ID NO: 51088 - protein, 11 aa, Homo sapiens
  heavy chain complementarity determining region 3 for antibody 25544
ARENWNFAYDY

SEQ ID NO: 51089 - protein, 8 aa, Homo sapiens
  light chain complementarity determining region 3 for antibody 25545
QQYNSYST

SEQ ID NO: 51090 - protein, 24 aa, Homo sapiens
  heavy chain complementarity determining region 3 for antibody 25545
ARGRPPSGWYRLKDRTYYYYGLDV

SEQ ID NO: 51091 - protein, 10 aa, Homo sapiens
  light chain complementarity determining region 3 for antibody 25546
QQYNSYSPLT

SEQ ID NO: 51092 - protein, 23 aa, Homo sapiens
  heavy chain complementarity determining region 3 for antibody 25546
ARASRGYRRSDSRMEFFFYGLDV

SEQ ID NO: 51093 - protein, 8 aa, Homo sapiens
  light chain complementarity determining region 3 for antibody 25547
QQYNSYRT

SEQ ID NO: 51094 - protein, 13 aa, Homo sapiens
  heavy chain complementarity determining region 3 for antibody 25547
ARNAYSGYVPFDY

SEQ ID NO: 51095 - protein, 9 aa, Homo sapiens
  light chain complementarity determining region 3 for antibody 25548
QQYNNWPRT

SEQ ID NO: 51096 - protein, 9 aa, Homo sapiens
  heavy chain complementarity determining region 3 for antibody 25548
ATGAGSEHY

SEQ ID NO: 51097 - protein, 9 aa, Homo sapiens
  light chain complementarity determining region 3 for antibody 25549
QQYNNWPRT

SEQ ID NO: 51098 - protein, 14 aa, Homo sapiens
  heavy chain complementarity determining region 3 for antibody 25549
ATAPGYYSSSPFDY

SEQ ID NO: 51099 - protein, 11 aa, Homo sapiens
  light chain complementarity determining region 3 for antibody 25550
QQYNNWPPAVT

SEQ ID NO: 51100 - protein, 13 aa, Homo sapiens
  heavy chain complementarity determining region 3 for antibody 25550
TRLSMATLKPFDY

SEQ ID NO: 51101 - protein, 9 aa, Homo sapiens
  light chain complementarity determining region 3 for antibody 25551
QQYKSYPFT

SEQ ID NO: 51102 - protein, 25 aa, Homo sapiens
  heavy chain complementarity determining region 3 for antibody 25551
ARDRYYYDTTGDSRDWGYYYYGMDV

SEQ ID NO: 51103 - protein, 9 aa, Homo sapiens
  light chain complementarity determining region 3 for antibody 25552
QQYISYPGT

SEQ ID NO: 51104 - protein, 19 aa, Homo sapiens
  heavy chain complementarity determining region 3 for antibody 25552
ARVSARRILTAPRYPLIDS

SEQ ID NO: 51105 - protein, 9 aa, Homo sapiens
  light chain complementarity determining region 3 for antibody 25553
QQYGTSPPT

SEQ ID NO: 51106 - protein, 15 aa, Homo sapiens
  heavy chain complementarity determining region 3 for antibody 25553
TRAGRGQLWLRFFDF

SEQ ID NO: 51107 - protein, 14 aa, Homo sapiens
  light chain complementarity determining region 3 for antibody 25554
QQYGTSPHDGSPWT

SEQ ID NO: 51108 - protein, 13 aa, Homo sapiens
  heavy chain complementarity determining region 3 for antibody 25554
ARVAVPGMGYFQY

SEQ ID NO: 51109 - protein, 9 aa, Homo sapiens
  light chain complementarity determining region 3 for antibody 25555
QQYGSTWWA

SEQ ID NO: 51110 - protein, 15 aa, Homo sapiens
  heavy chain complementarity determining region 3 for antibody 25555
ARHMARDSIGYYHDF

SEQ ID NO: 51111 - protein, 9 aa, Homo sapiens
  light chain complementarity determining region 3 for antibody 25556
QQYGSTPWT

SEQ ID NO: 51112 - protein, 16 aa, Homo sapiens
  heavy chain complementarity determining region 3 for antibody 25556
ARRGWGDDLGPHPLDY

SEQ ID NO: 51113 - protein, 10 aa, Homo sapiens
  light chain complementarity determining region 3 for antibody 25557
QQYGSSPTWT

SEQ ID NO: 51114 - protein, 20 aa, Homo sapiens
  heavy chain complementarity determining region 3 for antibody 25557
ATLRRRITLGRGVIPDAFDI

SEQ ID NO: 51115 - protein, 9 aa, Homo sapiens
  light chain complementarity determining region 3 for antibody 25558
QQYGSSPPP

SEQ ID NO: 51116 - protein, 12 aa, Homo sapiens
  heavy chain complementarity determining region 3 for antibody 25558
ARGPQLWFYFDY

SEQ ID NO: 51117 - protein, 10 aa, Homo sapiens
  light chain complementarity determining region 3 for antibody 25559
QQYGSSPMSS

SEQ ID NO: 51118 - protein, 11 aa, Homo sapiens
  heavy chain complementarity determining region 3 for antibody 25559
ARGGQWGSLDY

SEQ ID NO: 51119 - protein, 9 aa, Homo sapiens
  light chain complementarity determining region 3 for antibody 25560
QQYGSSPGT

SEQ ID NO: 51120 - protein, 14 aa, Homo sapiens
  heavy chain complementarity determining region 3 for antibody 25560
ARDSFRGSGSYFAN

SEQ ID NO: 51121 - protein, 9 aa, Homo sapiens
  light chain complementarity determining region 3 for antibody 25561
QQYGSLPPT

SEQ ID NO: 51122 - protein, 15 aa, Homo sapiens
  heavy chain complementarity determining region 3 for antibody 25561
AHRPNYYDKAGAFDI

SEQ ID NO: 51123 - protein, 10 aa, Homo sapiens
  light chain complementarity determining region 3 for antibody 25562
QQYGGSPPWT

SEQ ID NO: 51124 - protein, 14 aa, Homo sapiens
  heavy chain complementarity determining region 3 for antibody 25562
ARGGNSTYYHQFDY

SEQ ID NO: 51125 - protein, 9 aa, Homo sapiens
  light chain complementarity determining region 3 for antibody 25563
QQYGASRRT

SEQ ID NO: 51126 - protein, 11 aa, Homo sapiens
  heavy chain complementarity determining region 3 for antibody 25563
TTGGSYAPFDI

SEQ ID NO: 51127 - protein, 9 aa, Homo sapiens
  light chain complementarity determining region 3 for antibody 25564
QQYDVSTLT

SEQ ID NO: 51128 - protein, 22 aa, Homo sapiens
  heavy chain complementarity determining region 3 for antibody 25564
ARGRRPYGIYAYPRIPYSFFDD

SEQ ID NO: 51129 - protein, 10 aa, Homo sapiens
  light chain complementarity determining region 3 for antibody 25565
QQYDSLSPLT

SEQ ID NO: 51130 - protein, 18 aa, Homo sapiens
  heavy chain complementarity determining region 3 for antibody 25565
ARLMTSSRPDYYYYGLDV

SEQ ID NO: 51131 - protein, 11 aa, Homo sapiens
  light chain complementarity determining region 3 for antibody 25566
QQYDRSPPGFP

SEQ ID NO: 51132 - protein, 14 aa, Homo sapiens
  heavy chain complementarity determining region 3 for antibody 25566
ARETHNSRKRSFDQ

SEQ ID NO: 51133 - protein, 11 aa, Homo sapiens
  light chain complementarity determining region 3 for antibody 25567
QQYDNLPPSFT

SEQ ID NO: 51134 - protein, 20 aa, Homo sapiens
  heavy chain complementarity determining region 3 for antibody 25567
ARDRGITMVRGVITYWYFDL

SEQ ID NO: 51135 - protein, 10 aa, Homo sapiens
  light chain complementarity determining region 3 for antibody 25568
QQYDNLPPFT

SEQ ID NO: 51136 - protein, 24 aa, Homo sapiens
  heavy chain complementarity determining region 3 for antibody 25568
ARLRKRGFVYDGSGSAAVEGTFDF

SEQ ID NO: 51137 - protein, 8 aa, Homo sapiens
  light chain complementarity determining region 3 for antibody 25569
QQYDNLLT

SEQ ID NO: 51138 - protein, 20 aa, Homo sapiens
  heavy chain complementarity determining region 3 for antibody 25569
ARSFRRGSDFWSGQNYGLDV

SEQ ID NO: 51139 - protein, 10 aa, Homo sapiens
  light chain complementarity determining region 3 for antibody 25570
QQYDNLLRCT

SEQ ID NO: 51140 - protein, 20 aa, Homo sapiens
  heavy chain complementarity determining region 3 for antibody 25570
ARDRGITMVRGVITYWYFDL

SEQ ID NO: 51141 - protein, 11 aa, Homo sapiens
  light chain complementarity determining region 3 for antibody 25571
QQYDNFLFSYT

SEQ ID NO: 51142 - protein, 16 aa, Homo sapiens
  heavy chain complementarity determining region 3 for antibody 25571
VRGASALTTITGPSDP

SEQ ID NO: 51143 - protein, 10 aa, Homo sapiens
  light chain complementarity determining region 3 for antibody 25572
QQTFSTLALT

SEQ ID NO: 51144 - protein, 14 aa, Homo sapiens
  heavy chain complementarity determining region 3 for antibody 25572
ATITGRDFYNWFDP

SEQ ID NO: 51145 - protein, 9 aa, Homo sapiens
  light chain complementarity determining region 3 for antibody 25573
QQSYTPPWT

SEQ ID NO: 51146 - protein, 14 aa, Homo sapiens
  heavy chain complementarity determining region 3 for antibody 25573
ARDVDDSNYGTFIY

SEQ ID NO: 51147 - protein, 8 aa, Homo sapiens
  light chain complementarity determining region 3 for antibody 25574
QQSYSTYT

SEQ ID NO: 51148 - protein, 25 aa, Homo sapiens
  heavy chain complementarity determining region 3 for antibody 25574
ARLRIDRLRLPGAMRGPLYDCGLNV

SEQ ID NO: 51149 - protein, 9 aa, Homo sapiens
  light chain complementarity determining region 3 for antibody 25575
QQSYSTPPT

SEQ ID NO: 51150 - protein, 21 aa, Homo sapiens
  heavy chain complementarity determining region 3 for antibody 25575
ARDAPVSRPYSSGWYSSAFDY

SEQ ID NO: 51151 - protein, 9 aa, Homo sapiens
  light chain complementarity determining region 3 for antibody 25576
QQSYSTPLT

SEQ ID NO: 51152 - protein, 15 aa, Homo sapiens
  heavy chain complementarity determining region 3 for antibody 25576
AKDRWGGVEESAFDI

SEQ ID NO: 51153 - protein, 9 aa, Homo sapiens
  light chain complementarity determining region 3 for antibody 25577
QQSYITPFT

SEQ ID NO: 51154 - protein, 21 aa, Homo sapiens
  heavy chain complementarity determining region 3 for antibody 25577
AREVVVVDGADLTFYYYGMDV

SEQ ID NO: 51155 - protein, 9 aa, Homo sapiens
  light chain complementarity determining region 3 for antibody 25578
QQSSSSPPT

SEQ ID NO: 51156 - protein, 16 aa, Homo sapiens
  heavy chain complementarity determining region 3 for antibody 25578
ARDHALYSRSSGVFGY

SEQ ID NO: 51157 - protein, 9 aa, Homo sapiens
  light chain complementarity determining region 3 for antibody 25579
QQSHSVPLT

SEQ ID NO: 51158 - protein, 16 aa, Homo sapiens
  heavy chain complementarity determining region 3 for antibody 25579
ARVYATVTSQALGVDY

SEQ ID NO: 51159 - protein, 9 aa, Homo sapiens
  light chain complementarity determining region 3 for antibody 25580
QQRSNWPRT

SEQ ID NO: 51160 - protein, 11 aa, Homo sapiens
  heavy chain complementarity determining region 3 for antibody 25580
AHMLGGTELDY

SEQ ID NO: 51161 - protein, 10 aa, Homo sapiens
  light chain complementarity determining region 3 for antibody 25581
QQRSNWPPYP

SEQ ID NO: 51162 - protein, 13 aa, Homo sapiens
  heavy chain complementarity determining region 3 for antibody 25581
ARVGQQRLRGFDI

SEQ ID NO: 51163 - protein, 9 aa, Homo sapiens
  light chain complementarity determining region 3 for antibody 25582
QQRSNWPLT

SEQ ID NO: 51164 - protein, 11 aa, Homo sapiens
  heavy chain complementarity determining region 3 for antibody 25582
ARVGTAAALDY

SEQ ID NO: 51165 - protein, 11 aa, Homo sapiens
  light chain complementarity determining region 3 for antibody 25583
QQRRNWPPRFT

SEQ ID NO: 51166 - protein, 13 aa, Homo sapiens
  heavy chain complementarity determining region 3 for antibody 25583
ARDEGRFGELMLY

SEQ ID NO: 51167 - protein, 10 aa, Homo sapiens
  light chain complementarity determining region 3 for antibody 25584
QQLNSYPPWT

SEQ ID NO: 51168 - protein, 11 aa, Homo sapiens
  heavy chain complementarity determining region 3 for antibody 25584
ARIRIAVAADY

SEQ ID NO: 51169 - protein, 11 aa, Homo sapiens
  light chain complementarity determining region 3 for antibody 25585
QQLNSYPHPYT

SEQ ID NO: 51170 - protein, 15 aa, Homo sapiens
  heavy chain complementarity determining region 3 for antibody 25585
AREGMTTVVRYGMDV

SEQ ID NO: 51171 - protein, 9 aa, Homo sapiens
  light chain complementarity determining region 3 for antibody 25586
QQLGSAPLS

SEQ ID NO: 51172 - protein, 17 aa, Homo sapiens
  heavy chain complementarity determining region 3 for antibody 25586
ARGPSSIPVIMVVPFVF

SEQ ID NO: 51173 - protein, 8 aa, Homo sapiens
  light chain complementarity determining region 3 for antibody 25587
QQLDNLIT

SEQ ID NO: 51174 - protein, 17 aa, Homo sapiens
  heavy chain complementarity determining region 3 for antibody 25587
AKVRTEYRAAQPYYFDR

SEQ ID NO: 51175 - protein, 9 aa, Homo sapiens
  light chain complementarity determining region 3 for antibody 25588
QQHGTSPWT

SEQ ID NO: 51176 - protein, 15 aa, Homo sapiens
  heavy chain complementarity determining region 3 for antibody 25588
ARDYFEGSYYGYFDH

SEQ ID NO: 51177 - protein, 8 aa, Homo sapiens
  light chain complementarity determining region 3 for antibody 25589
QQFSNDWA

SEQ ID NO: 51178 - protein, 11 aa, Homo sapiens
  heavy chain complementarity determining region 3 for antibody 25589
ARGQFRVGIIH

SEQ ID NO: 51179 - protein, 9 aa, Homo sapiens
  light chain complementarity determining region 3 for antibody 25590
QQFNSSPLT

SEQ ID NO: 51180 - protein, 10 aa, Homo sapiens
  heavy chain complementarity determining region 3 for antibody 25590
GRDLTGSKDY

SEQ ID NO: 51181 - protein, 9 aa, Homo sapiens
  light chain complementarity determining region 3 for antibody 25591
QQDGSSPPT

SEQ ID NO: 51182 - protein, 17 aa, Homo sapiens
  heavy chain complementarity determining region 3 for antibody 25591
ARPYFGPVRAGTNGYDM

SEQ ID NO: 51183 - protein, 9 aa, Homo sapiens
  light chain complementarity determining region 3 for antibody 25592
QQDGNLPRT

SEQ ID NO: 51184 - protein, 13 aa, Homo sapiens
  heavy chain complementarity determining region 3 for antibody 25592
AGGNFHSGGYGEY

SEQ ID NO: 51185 - protein, 9 aa, Homo sapiens
  light chain complementarity determining region 3 for antibody 25593
QQDAYSPIT

SEQ ID NO: 51186 - protein, 10 aa, Homo sapiens
  heavy chain complementarity determining region 3 for antibody 25593
ATGAGWLVDY

SEQ ID NO: 51187 - protein, 9 aa, Homo sapiens
  light chain complementarity determining region 3 for antibody 25594
QQATHWPGT

SEQ ID NO: 51188 - protein, 15 aa, Homo sapiens
  heavy chain complementarity determining region 3 for antibody 25594
ASAVRGAPFGNWFDP

SEQ ID NO: 51189 - protein, 9 aa, Homo sapiens
  light chain complementarity determining region 3 for antibody 25595
QQANSFPLT

SEQ ID NO: 51190 - protein, 15 aa, Homo sapiens
  heavy chain complementarity determining region 3 for antibody 25595
SRDADYGDYVGFLDY

SEQ ID NO: 51191 - protein, 10 aa, Homo sapiens
  light chain complementarity determining region 3 for antibody 25596
QPYNRRYPWT

SEQ ID NO: 51192 - protein, 13 aa, Homo sapiens
  heavy chain complementarity determining region 3 for antibody 25596
AADSHASWADFDH

SEQ ID NO: 51193 - protein, 10 aa, Homo sapiens
  light chain complementarity determining region 3 for antibody 25597
QKYNSALGWT

SEQ ID NO: 51194 - protein, 20 aa, Homo sapiens
  heavy chain complementarity determining region 3 for antibody 25597
ARDLGYYGTSTDYFFDTFDI

SEQ ID NO: 51195 - protein, 11 aa, Homo sapiens
  light chain complementarity determining region 3 for antibody 25598
QKYDTGPPGLT

SEQ ID NO: 51196 - protein, 11 aa, Homo sapiens
  heavy chain complementarity determining region 3 for antibody 25598
ASARGGTYFDY

SEQ ID NO: 51197 - protein, 10 aa, Homo sapiens
  light chain complementarity determining region 3 for antibody 25599
QHYSNSPPWT

SEQ ID NO: 51198 - protein, 16 aa, Homo sapiens
  heavy chain complementarity determining region 3 for antibody 25599
VRRQWVRGLFRGGLDS

SEQ ID NO: 51199 - protein, 10 aa, Homo sapiens
  light chain complementarity determining region 3 for antibody 25600
QHYGRSPRVT

SEQ ID NO: 51200 - protein, 17 aa, Homo sapiens
  heavy chain complementarity determining region 3 for antibody 25600
ARVSIPRRNDYFYGMDV

SEQ ID NO: 51201 - protein, 9 aa, Homo sapiens
  light chain complementarity determining region 3 for antibody 25601
QHSFANPWT

SEQ ID NO: 51202 - protein, 18 aa, Homo sapiens
  heavy chain complementarity determining region 3 for antibody 25601
AKDKPQGFGEGGGYGMDV

SEQ ID NO: 51203 - protein, 11 aa, Homo sapiens
  light chain complementarity determining region 3 for antibody 25602
QHRSNWPPGYT

SEQ ID NO: 51204 - protein, 14 aa, Homo sapiens
  heavy chain complementarity determining region 3 for antibody 25602
AREGSDWGLGWFDP

SEQ ID NO: 51205 - protein, 9 aa, Homo sapiens
  light chain complementarity determining region 3 for antibody 25603
PQYYTSLRT

SEQ ID NO: 51206 - protein, 12 aa, Homo sapiens
  heavy chain complementarity determining region 3 for antibody 25603
VKDCGLGGSRDS

SEQ ID NO: 51207 - protein, 9 aa, Homo sapiens
  light chain complementarity determining region 3 for antibody 25604
PQYDNLPPT

SEQ ID NO: 51208 - protein, 17 aa, Homo sapiens
  heavy chain complementarity determining region 3 for antibody 25604
ATSTTAREGYNVALFDY

SEQ ID NO: 51209 - protein, 9 aa, Homo sapiens
  light chain complementarity determining region 3 for antibody 25605
MQTVQFVWT

SEQ ID NO: 51210 - protein, 14 aa, Homo sapiens
  heavy chain complementarity determining region 3 for antibody 25605
ARSVNTGQYYGLGY

SEQ ID NO: 51211 - protein, 9 aa, Homo sapiens
  light chain complementarity determining region 3 for antibody 25606
MQGAYWPRP

SEQ ID NO: 51212 - protein, 11 aa, Homo sapiens
  heavy chain complementarity determining region 3 for antibody 25606
ARDPAWGAYDL

SEQ ID NO: 51213 - protein, 8 aa, Homo sapiens
  light chain complementarity determining region 3 for antibody 25607
MQALQTPT

SEQ ID NO: 51214 - protein, 17 aa, Homo sapiens
  heavy chain complementarity determining region 3 for antibody 25607
ARGQSRWLGNFYYALDV

SEQ ID NO: 51215 - protein, 9 aa, Homo sapiens
  light chain complementarity determining region 3 for antibody 25608
MQALQTPRT

SEQ ID NO: 51216 - protein, 13 aa, Homo sapiens
  heavy chain complementarity determining region 3 for antibody 25608
ARQHIYGDYGFDP

SEQ ID NO: 51217 - protein, 9 aa, Homo sapiens
  light chain complementarity determining region 3 for antibody 25609
MQALQTLYT

SEQ ID NO: 51218 - protein, 20 aa, Homo sapiens
  heavy chain complementarity determining region 3 for antibody 25609
AREDRETLGEVRNYYYGMDV

SEQ ID NO: 51219 - protein, 8 aa, Homo sapiens
  light chain complementarity determining region 3 for antibody 25610
MQALQTLT

SEQ ID NO: 51220 - protein, 18 aa, Homo sapiens
  heavy chain complementarity determining region 3 for antibody 25610
ARDSGGYSDTTGLSPADY

SEQ ID NO: 51221 - protein, 9 aa, Homo sapiens
  light chain complementarity determining region 3 for antibody 25611
MQALQTLRT

SEQ ID NO: 51222 - protein, 17 aa, Homo sapiens
  heavy chain complementarity determining region 3 for antibody 25611
VRVTMTLVVRGEDAFDI

SEQ ID NO: 51223 - protein, 10 aa, Homo sapiens
  light chain complementarity determining region 3 for antibody 25612
MQALQPHRNT

SEQ ID NO: 51224 - protein, 20 aa, Homo sapiens
  heavy chain complementarity determining region 3 for antibody 25612
ARLKAASAGLPSYYYAGMDV

SEQ ID NO: 51225 - protein, 9 aa, Homo sapiens
  light chain complementarity determining region 3 for antibody 25613
LQYYATPGT

SEQ ID NO: 51226 - protein, 15 aa, Homo sapiens
  heavy chain complementarity determining region 3 for antibody 25613
VRQSKVDNNYNYPDF

SEQ ID NO: 51227 - protein, 9 aa, Homo sapiens
  light chain complementarity determining region 3 for antibody 25614
LQDYNFPYT

SEQ ID NO: 51228 - protein, 21 aa, Homo sapiens
  heavy chain complementarity determining region 3 for antibody 25614
AKKGAAVLCTDGGCYGDAFDV

SEQ ID NO: 51229 - protein, 9 aa, Homo sapiens
  light chain complementarity determining region 3 for antibody 25615
LQDCDYPRT

SEQ ID NO: 51230 - protein, 22 aa, Homo sapiens
  heavy chain complementarity determining region 3 for antibody 25615
ARDSSPRYWYDGRDYYVDVLDV

SEQ ID NO: 51231 - protein, 9 aa, Homo sapiens
  light chain complementarity determining region 3 for antibody 25616
HQYDTVSHT

SEQ ID NO: 51232 - protein, 21 aa, Homo sapiens
  heavy chain complementarity determining region 3 for antibody 25616
ARLKPSYYGGSASDGYSRLDP

SEQ ID NO: 51233 - protein, 9 aa, Homo sapiens
  light chain complementarity determining region 3 for antibody 25617
HQTYDTPYT

SEQ ID NO: 51234 - protein, 14 aa, Homo sapiens
  heavy chain complementarity determining region 3 for antibody 25617
ATALTAFSGYDLEH

SEQ ID NO: 51235 - protein, 9 aa, Homo sapiens
  light chain complementarity determining region 3 for antibody 25618
HQFATSPHT

SEQ ID NO: 51236 - protein, 24 aa, Homo sapiens
  heavy chain complementarity determining region 3 for antibody 25618
ARGRPPSGWYRLKDRTYYYYGLDV

SEQ ID NO: 51237 - protein, 9 aa, Homo sapiens
  light chain complementarity determining region 3 for antibody 25619
HQARSTPYT

SEQ ID NO: 51238 - protein, 14 aa, Homo sapiens
  heavy chain complementarity determining region 3 for antibody 25619
ARDSVRGSPDYLDY

SEQ ID NO: 51239 - protein, 9 aa, Homo sapiens
  light chain complementarity determining region 3 for antibody 25620
EQYDSLPRT

SEQ ID NO: 51240 - protein, 20 aa, Homo sapiens
  heavy chain complementarity determining region 3 for antibody 25620
ARDSRPGPSDFRSGRGPYAY

SEQ ID NO: 51241 - protein, 9 aa, Homo sapiens
  light chain complementarity determining region 3 for antibody 25621
QQYYTSPRT

SEQ ID NO: 51242 - protein, 12 aa, Homo sapiens
  heavy chain complementarity determining region 3 for antibody 25621
VKDCGLGGSRDS

SEQ ID NO: 51243 - protein, 9 aa, Homo sapiens
  light chain complementarity determining region 3 for antibody 25622
QQYYTFLRT

SEQ ID NO: 51244 - protein, 12 aa, Homo sapiens
  heavy chain complementarity determining region 3 for antibody 25622
VKDCGLGGSRDS

SEQ ID NO: 51245 - protein, 9 aa, Homo sapiens
  light chain complementarity determining region 3 for antibody 25623
QQYYSTPWT

SEQ ID NO: 51246 - protein, 14 aa, Homo sapiens
  heavy chain complementarity determining region 3 for antibody 25623
ARGLHYDFWSGSLP

SEQ ID NO: 51247 - protein, 9 aa, Homo sapiens
  light chain complementarity determining region 3 for antibody 25624
QQYYSEPET

SEQ ID NO: 51248 - protein, 17 aa, Homo sapiens
  heavy chain complementarity determining region 3 for antibody 25624
ARDARSHGSGWEGGDDC

SEQ ID NO: 51249 - protein, 9 aa, Homo sapiens
  light chain complementarity determining region 3 for antibody 25625
QQYYISVRT

SEQ ID NO: 51250 - protein, 12 aa, Homo sapiens
  heavy chain complementarity determining region 3 for antibody 25625
VKDCGLGGSRDS

SEQ ID NO: 51251 - protein, 9 aa, Homo sapiens
  light chain complementarity determining region 3 for antibody 25626
QQYRSSPST

SEQ ID NO: 51252 - protein, 17 aa, Homo sapiens
  heavy chain complementarity determining region 3 for antibody 25626
AGLSSRLGDGAPSLFDY

SEQ ID NO: 51253 - protein, 10 aa, Homo sapiens
  light chain complementarity determining region 3 for antibody 25627
QQYQSSPGGT

SEQ ID NO: 51254 - protein, 31 aa, Homo sapiens
  heavy chain complementarity determining region 3 for antibody 25627
ARVELLRLSVDSSGYWGPKITHTQNVQYFEY

SEQ ID NO: 51255 - protein, 10 aa, Homo sapiens
  light chain complementarity determining region 3 for antibody 25628
QQYQSFGTVT

SEQ ID NO: 51256 - protein, 15 aa, Homo sapiens
  heavy chain complementarity determining region 3 for antibody 25628
ARGGSTLTPLDAVDI

SEQ ID NO: 51257 - protein, 9 aa, Homo sapiens
  light chain complementarity determining region 3 for antibody 25629
QQYNSYSWT

SEQ ID NO: 51258 - protein, 17 aa, Homo sapiens
  heavy chain complementarity determining region 3 for antibody 25629
ARVKGVGGVIVRGYFDY

SEQ ID NO: 51259 - protein, 9 aa, Homo sapiens
  light chain complementarity determining region 3 for antibody 25630
QQYNSYSWT

SEQ ID NO: 51260 - protein, 14 aa, Homo sapiens
  heavy chain complementarity determining region 3 for antibody 25630
AKVIVGATSNYFDY

SEQ ID NO: 51261 - protein, 10 aa, Homo sapiens
  light chain complementarity determining region 3 for antibody 25631
QQYNSYSPYT

SEQ ID NO: 51262 - protein, 19 aa, Homo sapiens
  heavy chain complementarity determining region 3 for antibody 25631
ARSAPSLGLAPAGTRMFDF

SEQ ID NO: 51263 - protein, 9 aa, Homo sapiens
  light chain complementarity determining region 3 for antibody 25632
QQYNSYSGT

SEQ ID NO: 51264 - protein, 12 aa, Homo sapiens
  heavy chain complementarity determining region 3 for antibody 25632
ARRMDYWAYFEH

SEQ ID NO: 51265 - protein, 10 aa, Homo sapiens
  light chain complementarity determining region 3 for antibody 25633
QQYNNWPPYT

SEQ ID NO: 51266 - protein, 14 aa, Homo sapiens
  heavy chain complementarity determining region 3 for antibody 25633
ARGGGYSSRWPGES

SEQ ID NO: 51267 - protein, 10 aa, Homo sapiens
  light chain complementarity determining region 3 for antibody 25634
QQYNNWPPGT

SEQ ID NO: 51268 - protein, 10 aa, Homo sapiens
  heavy chain complementarity determining region 3 for antibody 25634
ARDRVGYFDY

SEQ ID NO: 51269 - protein, 9 aa, Homo sapiens
  light chain complementarity determining region 3 for antibody 25635
QQYNIYSPT

SEQ ID NO: 51270 - protein, 20 aa, Homo sapiens
  heavy chain complementarity determining region 3 for antibody 25635
ARDNYYYHSGGYYSPSYFDY

SEQ ID NO: 51271 - protein, 10 aa, Homo sapiens
  light chain complementarity determining region 3 for antibody 25636
QQYNHWAKLS

SEQ ID NO: 51272 - protein, 12 aa, Homo sapiens
  heavy chain complementarity determining region 3 for antibody 25636
AKAYYFDTSGSF

SEQ ID NO: 51273 - protein, 9 aa, Homo sapiens
  light chain complementarity determining region 3 for antibody 25637
QQYNDWPRT

SEQ ID NO: 51274 - protein, 15 aa, Homo sapiens
  heavy chain complementarity determining region 3 for antibody 25637
ARDPDWGLVGGTFDI

SEQ ID NO: 51275 - protein, 9 aa, Homo sapiens
  light chain complementarity determining region 3 for antibody 25638
QQYGTSPRT

SEQ ID NO: 51276 - protein, 16 aa, Homo sapiens
  heavy chain complementarity determining region 3 for antibody 25638
ARLPPLGAENSLAFDI

SEQ ID NO: 51277 - protein, 9 aa, Homo sapiens
  light chain complementarity determining region 3 for antibody 25639
QQYGSSSIT

SEQ ID NO: 51278 - protein, 12 aa, Homo sapiens
  heavy chain complementarity determining region 3 for antibody 25639
VKVWGQWLAFDY

SEQ ID NO: 51279 - protein, 9 aa, Homo sapiens
  light chain complementarity determining region 3 for antibody 25640
QQYGSSPRT

SEQ ID NO: 51280 - protein, 10 aa, Homo sapiens
  heavy chain complementarity determining region 3 for antibody 25640
ASSGWNGFDF

SEQ ID NO: 51281 - protein, 9 aa, Homo sapiens
  light chain complementarity determining region 3 for antibody 25641
QQYGSSPRT

SEQ ID NO: 51282 - protein, 25 aa, Homo sapiens
  heavy chain complementarity determining region 3 for antibody 25641
ARLRIDRLRLPGAMRGPLYDCGLSV

SEQ ID NO: 51283 - protein, 10 aa, Homo sapiens
  light chain complementarity determining region 3 for antibody 25642
QQYGSSPPYT

SEQ ID NO: 51284 - protein, 15 aa, Homo sapiens
  heavy chain complementarity determining region 3 for antibody 25642
TRDAIFGVTGGAFDI

SEQ ID NO: 51285 - protein, 10 aa, Homo sapiens
  light chain complementarity determining region 3 for antibody 25643
QQYGSSPMYG

SEQ ID NO: 51286 - protein, 11 aa, Homo sapiens
  heavy chain complementarity determining region 3 for antibody 25643
ARGGQWGSLDY

SEQ ID NO: 51287 - protein, 10 aa, Homo sapiens
  light chain complementarity determining region 3 for antibody 25644
QQYGSSPLYT

SEQ ID NO: 51288 - protein, 12 aa, Homo sapiens
  heavy chain complementarity determining region 3 for antibody 25644
ARPRYRSGFFDY

SEQ ID NO: 51289 - protein, 9 aa, Homo sapiens
  light chain complementarity determining region 3 for antibody 25645
QQYGSSLLT

SEQ ID NO: 51290 - protein, 25 aa, Homo sapiens
  heavy chain complementarity determining region 3 for antibody 25645
ARARQYSSSWYRPHGGNYYYYGMDV

SEQ ID NO: 51291 - protein, 9 aa, Homo sapiens
  light chain complementarity determining region 3 for antibody 25646
QQYGSSLDT

SEQ ID NO: 51292 - protein, 9 aa, Homo sapiens
  heavy chain complementarity determining region 3 for antibody 25646
IYEINAFDI

SEQ ID NO: 51293 - protein, 9 aa, Homo sapiens
  light chain complementarity determining region 3 for antibody 25647
QQYGSSHLT

SEQ ID NO: 51294 - protein, 20 aa, Homo sapiens
  heavy chain complementarity determining region 3 for antibody 25647
ARGHHDFWSGYYSGRGWFDP

SEQ ID NO: 51295 - protein, 12 aa, Homo sapiens
  light chain complementarity determining region 3 for antibody 25648
QQYGRSVQDAWT

SEQ ID NO: 51296 - protein, 13 aa, Homo sapiens
  heavy chain complementarity determining region 3 for antibody 25648
ARLPSRKQQLVRE

SEQ ID NO: 51297 - protein, 10 aa, Homo sapiens
  light chain complementarity determining region 3 for antibody 25649
QQYGGSAGWR

SEQ ID NO: 51298 - protein, 14 aa, Homo sapiens
  heavy chain complementarity determining region 3 for antibody 25649
AREFCRGGNCCFDS

SEQ ID NO: 51299 - protein, 9 aa, Homo sapiens
  light chain complementarity determining region 3 for antibody 25650
QQYFTTPIT

SEQ ID NO: 51300 - protein, 10 aa, Homo sapiens
  heavy chain complementarity determining region 3 for antibody 25650
ARSGGYGWDS

SEQ ID NO: 51301 - protein, 11 aa, Homo sapiens
  light chain complementarity determining region 3 for antibody 25651
QQYETSPPGDT

SEQ ID NO: 51302 - protein, 14 aa, Homo sapiens
  heavy chain complementarity determining region 3 for antibody 25651
ARENSISRKRSFDQ

SEQ ID NO: 51303 - protein, 10 aa, Homo sapiens
  light chain complementarity determining region 3 for antibody 25652
QQYDSSPPWT

SEQ ID NO: 51304 - protein, 14 aa, Homo sapiens
  heavy chain complementarity determining region 3 for antibody 25652
VTHASGWYRRPFDI

SEQ ID NO: 51305 - protein, 11 aa, Homo sapiens
  light chain complementarity determining region 3 for antibody 25653
QQYDNSALEFP

SEQ ID NO: 51306 - protein, 15 aa, Homo sapiens
  heavy chain complementarity determining region 3 for antibody 25653
VREVVTMIEPGGFDV

SEQ ID NO: 51307 - protein, 10 aa, Homo sapiens
  light chain complementarity determining region 3 for antibody 25654
QQYDNLPRYT

SEQ ID NO: 51308 - protein, 22 aa, Homo sapiens
  heavy chain complementarity determining region 3 for antibody 25654
TTLKYFHEPGSRSPYFYFGMDF

SEQ ID NO: 51309 - protein, 9 aa, Homo sapiens
  light chain complementarity determining region 3 for antibody 25655
QQYDNLPLT

SEQ ID NO: 51310 - protein, 8 aa, Homo sapiens
  heavy chain complementarity determining region 3 for antibody 25655
ANGRYFEH

SEQ ID NO: 51311 - protein, 8 aa, Homo sapiens
  light chain complementarity determining region 3 for antibody 25656
QQYDNLLT

SEQ ID NO: 51312 - protein, 13 aa, Homo sapiens
  heavy chain complementarity determining region 3 for antibody 25656
ARRGDSYGQQLDY

SEQ ID NO: 51313 - protein, 9 aa, Homo sapiens
  light chain complementarity determining region 3 for antibody 25657
QQVNSYPYT

SEQ ID NO: 51314 - protein, 14 aa, Homo sapiens
  heavy chain complementarity determining region 3 for antibody 25657
ARATSDGGTVYFDY

SEQ ID NO: 51315 - protein, 9 aa, Homo sapiens
  light chain complementarity determining region 3 for antibody 25658
QQTYSTPLT

SEQ ID NO: 51316 - protein, 14 aa, Homo sapiens
  heavy chain complementarity determining region 3 for antibody 25658
ARRFMVRGYDAFDI

SEQ ID NO: 51317 - protein, 10 aa, Homo sapiens
  light chain complementarity determining region 3 for antibody 25659
QQSYYTSPFT

SEQ ID NO: 51318 - protein, 16 aa, Homo sapiens
  heavy chain complementarity determining region 3 for antibody 25659
ARGGHASAGIAWYFDF

SEQ ID NO: 51319 - protein, 9 aa, Homo sapiens
  light chain complementarity determining region 3 for antibody 25660
QQSYVTPIT

SEQ ID NO: 51320 - protein, 18 aa, Homo sapiens
  heavy chain complementarity determining region 3 for antibody 25660
TRDLEGYYYHLGIEAGDY

SEQ ID NO: 51321 - protein, 8 aa, Homo sapiens
  light chain complementarity determining region 3 for antibody 25661
QQSYTTWT

SEQ ID NO: 51322 - protein, 12 aa, Homo sapiens
  heavy chain complementarity determining region 3 for antibody 25661
ARALSLAGTLDY

SEQ ID NO: 51323 - protein, 9 aa, Homo sapiens
  light chain complementarity determining region 3 for antibody 25662
QQSYTTPGT

SEQ ID NO: 51324 - protein, 16 aa, Homo sapiens
  heavy chain complementarity determining region 3 for antibody 25662
ARLGPYSSSWWAKFDY

SEQ ID NO: 51325 - protein, 9 aa, Homo sapiens
  light chain complementarity determining region 3 for antibody 25663
QQSYSTPWT

SEQ ID NO: 51326 - protein, 15 aa, Homo sapiens
  heavy chain complementarity determining region 3 for antibody 25663
ARGDSNYVGGDAFDV

SEQ ID NO: 51327 - protein, 9 aa, Homo sapiens
  light chain complementarity determining region 3 for antibody 25664
QQSYSIPLT

SEQ ID NO: 51328 - protein, 16 aa, Homo sapiens
  heavy chain complementarity determining region 3 for antibody 25664
AKDRLRRFRGTTPSDY

SEQ ID NO: 51329 - protein, 10 aa, Homo sapiens
  light chain complementarity determining region 3 for antibody 25665
QQSYNTPPYT

SEQ ID NO: 51330 - protein, 16 aa, Homo sapiens
  heavy chain complementarity determining region 3 for antibody 25665
ARVSGGEGLENDAFDI

SEQ ID NO: 51331 - protein, 9 aa, Homo sapiens
  light chain complementarity determining region 3 for antibody 25666
QQSYITPLT

SEQ ID NO: 51332 - protein, 18 aa, Homo sapiens
  heavy chain complementarity determining region 3 for antibody 25666
ARGAYCSGATCHYNSFDY

SEQ ID NO: 51333 - protein, 9 aa, Homo sapiens
  light chain complementarity determining region 3 for antibody 25667
QQSNTYPLT

SEQ ID NO: 51334 - protein, 8 aa, Homo sapiens
  heavy chain complementarity determining region 3 for antibody 25667
INYNTGWS

SEQ ID NO: 51335 - protein, 9 aa, Homo sapiens
  light chain complementarity determining region 3 for antibody 25668
QQSLFTPYT

SEQ ID NO: 51336 - protein, 18 aa, Homo sapiens
  heavy chain complementarity determining region 3 for antibody 25668
ARDSSPVSDYIWDDVFDM

SEQ ID NO: 51337 - protein, 6 aa, Homo sapiens
  light chain complementarity determining region 3 for antibody 25669
QQSGET

SEQ ID NO: 51338 - protein, 12 aa, Homo sapiens
  heavy chain complementarity determining region 3 for antibody 25669
ARDHDSGWSLSS

SEQ ID NO: 51339 - protein, 12 aa, Homo sapiens
  light chain complementarity determining region 3 for antibody 25670
QQRSNWPPYMYT

SEQ ID NO: 51340 - protein, 12 aa, Homo sapiens
  heavy chain complementarity determining region 3 for antibody 25670
GRLYSSSDKLDY

SEQ ID NO: 51341 - protein, 11 aa, Homo sapiens
  light chain complementarity determining region 3 for antibody 25671
QQRSNWPPAYT

SEQ ID NO: 51342 - protein, 18 aa, Homo sapiens
  heavy chain complementarity determining region 3 for antibody 25671
ARELHEIVAAAGHDAFDI

SEQ ID NO: 51343 - protein, 9 aa, Homo sapiens
  light chain complementarity determining region 3 for antibody 25672
QQRSNWPGT

SEQ ID NO: 51344 - protein, 11 aa, Homo sapiens
  heavy chain complementarity determining region 3 for antibody 25672
VHMFTDYYFES

SEQ ID NO: 51345 - protein, 9 aa, Homo sapiens
  light chain complementarity determining region 3 for antibody 25673
QQRSNWPGT

SEQ ID NO: 51346 - protein, 14 aa, Homo sapiens
  heavy chain complementarity determining region 3 for antibody 25673
AVTHYYDSSTIGDY

SEQ ID NO: 51347 - protein, 9 aa, Homo sapiens
  light chain complementarity determining region 3 for antibody 25674
QQRNNWMLT

SEQ ID NO: 51348 - protein, 17 aa, Homo sapiens
  heavy chain complementarity determining region 3 for antibody 25674
ARDPSNPDMYYYYGMDV

SEQ ID NO: 51349 - protein, 9 aa, Homo sapiens
  light chain complementarity determining region 3 for antibody 25675
QQRAIWPPT

SEQ ID NO: 51350 - protein, 15 aa, Homo sapiens
  heavy chain complementarity determining region 3 for antibody 25675
ARRLAVPGNHDGFDL

SEQ ID NO: 51351 - protein, 9 aa, Homo sapiens
  light chain complementarity determining region 3 for antibody 25676
QQNGSSPQT

SEQ ID NO: 51352 - protein, 11 aa, Homo sapiens
  heavy chain complementarity determining region 3 for antibody 25676
ARGDLWSAFDI

SEQ ID NO: 51353 - protein, 9 aa, Homo sapiens
  light chain complementarity determining region 3 for antibody 25677
QQLNSYPRT

SEQ ID NO: 51354 - protein, 13 aa, Homo sapiens
  heavy chain complementarity determining region 3 for antibody 25677
SRDSGYTSVAGGY

SEQ ID NO: 51355 - protein, 10 aa, Homo sapiens
  light chain complementarity determining region 3 for antibody 25678
QQLNSYPRLT

SEQ ID NO: 51356 - protein, 13 aa, Homo sapiens
  heavy chain complementarity determining region 3 for antibody 25678
ARAFSMMIVVPGY

SEQ ID NO: 51357 - protein, 10 aa, Homo sapiens
  light chain complementarity determining region 3 for antibody 25679
QQFGVSPPWA

SEQ ID NO: 51358 - protein, 12 aa, Homo sapiens
  heavy chain complementarity determining region 3 for antibody 25679
ARVPYFYYAMDV

SEQ ID NO: 51359 - protein, 11 aa, Homo sapiens
  light chain complementarity determining region 3 for antibody 25680
QQCETSPPMFT

SEQ ID NO: 51360 - protein, 23 aa, Homo sapiens
  heavy chain complementarity determining region 3 for antibody 25680
ARASRGYRRSDSRMEFFFYGLDV

SEQ ID NO: 51361 - protein, 9 aa, Homo sapiens
  light chain complementarity determining region 3 for antibody 25681
QQANSFPVT

SEQ ID NO: 51362 - protein, 17 aa, Homo sapiens
  heavy chain complementarity determining region 3 for antibody 25681
ATGDYDYDSSGYYHPDS

SEQ ID NO: 51363 - protein, 9 aa, Homo sapiens
  light chain complementarity determining region 3 for antibody 25682
QQAGSFPIT

SEQ ID NO: 51364 - protein, 17 aa, Homo sapiens
  heavy chain complementarity determining region 3 for antibody 25682
AQGPAPYNWTYGFFFDH

SEQ ID NO: 51365 - protein, 10 aa, Homo sapiens
  light chain complementarity determining region 3 for antibody 25683
QNYNTALRFT

SEQ ID NO: 51366 - protein, 13 aa, Homo sapiens
  heavy chain complementarity determining region 3 for antibody 25683
AKVWFGESDAFDM

SEQ ID NO: 51367 - protein, 9 aa, Homo sapiens
  light chain complementarity determining region 3 for antibody 25684
QKYNSAPLT

SEQ ID NO: 51368 - protein, 23 aa, Homo sapiens
  heavy chain complementarity determining region 3 for antibody 25684
AKDVEKGYTMVRGIYYYYYAMDV

SEQ ID NO: 51369 - protein, 7 aa, Homo sapiens
  light chain complementarity determining region 3 for antibody 25685
QHYQTWP

SEQ ID NO: 51370 - protein, 17 aa, Homo sapiens
  heavy chain complementarity determining region 3 for antibody 25685
ARAFLHDSSDRSGYIDY

SEQ ID NO: 51371 - protein, 9 aa, Homo sapiens
  light chain complementarity determining region 3 for antibody 25686
QHYNSYPWT

SEQ ID NO: 51372 - protein, 16 aa, Homo sapiens
  heavy chain complementarity determining region 3 for antibody 25686
AGAPQSDASGYPVFQH

SEQ ID NO: 51373 - protein, 10 aa, Homo sapiens
  light chain complementarity determining region 3 for antibody 25687
QHYNNWPRWT

SEQ ID NO: 51374 - protein, 14 aa, Homo sapiens
  heavy chain complementarity determining region 3 for antibody 25687
ARDLGLQLGRGFDP

SEQ ID NO: 51375 - protein, 9 aa, Homo sapiens
  light chain complementarity determining region 3 for antibody 25688
QHFGGSPLP

SEQ ID NO: 51376 - protein, 11 aa, Homo sapiens
  heavy chain complementarity determining region 3 for antibody 25688
ARKGTGAPFDY

SEQ ID NO: 51377 - protein, 11 aa, Homo sapiens
  light chain complementarity determining region 3 for antibody 25689
QGYGASPPMYP

SEQ ID NO: 51378 - protein, 12 aa, Homo sapiens
  heavy chain complementarity determining region 3 for antibody 25689
AKDLHGSGSFDH

SEQ ID NO: 51379 - protein, 9 aa, Homo sapiens
  light chain complementarity determining region 3 for antibody 25690
MQSRRWPHP

SEQ ID NO: 51380 - protein, 8 aa, Homo sapiens
  heavy chain complementarity determining region 3 for antibody 25690
TAWGSSQH

SEQ ID NO: 51381 - protein, 9 aa, Homo sapiens
  light chain complementarity determining region 3 for antibody 25691
MQGLQTPYT

SEQ ID NO: 51382 - protein, 14 aa, Homo sapiens
  heavy chain complementarity determining region 3 for antibody 25691
AKDWDSSGSNCFDP

SEQ ID NO: 51383 - protein, 9 aa, Homo sapiens
  light chain complementarity determining region 3 for antibody 25692
MQGLQTPWT

SEQ ID NO: 51384 - protein, 14 aa, Homo sapiens
  heavy chain complementarity determining region 3 for antibody 25692
AREDSAVGYYGMDV

SEQ ID NO: 51385 - protein, 9 aa, Homo sapiens
  light chain complementarity determining region 3 for antibody 25693
MQALQTPPT

SEQ ID NO: 51386 - protein, 18 aa, Homo sapiens
  heavy chain complementarity determining region 3 for antibody 25693
TRDLEGYYYHLGIEAGDY

SEQ ID NO: 51387 - protein, 9 aa, Homo sapiens
  light chain complementarity determining region 3 for antibody 25694
MQALQTPPD

SEQ ID NO: 51388 - protein, 18 aa, Homo sapiens
  heavy chain complementarity determining region 3 for antibody 25694
ARRWGPRDVASPGGTRDY

SEQ ID NO: 51389 - protein, 9 aa, Homo sapiens
  light chain complementarity determining region 3 for antibody 25695
MQALQTPPA

SEQ ID NO: 51390 - protein, 13 aa, Homo sapiens
  heavy chain complementarity determining region 3 for antibody 25695
ARGVDGYDPYLDY

SEQ ID NO: 51391 - protein, 9 aa, Homo sapiens
  light chain complementarity determining region 3 for antibody 25696
MQALQTPFT

SEQ ID NO: 51392 - protein, 15 aa, Homo sapiens
  heavy chain complementarity determining region 3 for antibody 25696
LRHYRALVAGTEEDY

SEQ ID NO: 51393 - protein, 8 aa, Homo sapiens
  light chain complementarity determining region 3 for antibody 25697
MQALQAIT

SEQ ID NO: 51394 - protein, 11 aa, Homo sapiens
  heavy chain complementarity determining region 3 for antibody 25697
ARRDTDKIFDN

SEQ ID NO: 51395 - protein, 9 aa, Homo sapiens
  light chain complementarity determining region 3 for antibody 25698
LQFDNLPLT

SEQ ID NO: 51396 - protein, 21 aa, Homo sapiens
  heavy chain complementarity determining region 3 for antibody 25698
ARGKHIVVVTSTWGGKWGLNF

SEQ ID NO: 51397 - protein, 9 aa, Homo sapiens
  light chain complementarity determining region 3 for antibody 25699
LHHNTYPWT

SEQ ID NO: 51398 - protein, 17 aa, Homo sapiens
  heavy chain complementarity determining region 3 for antibody 25699
ARGRVGTSYDYPSVLDY

SEQ ID NO: 51399 - protein, 8 aa, Homo sapiens
  light chain complementarity determining region 3 for antibody 25700
HQYGSSFT

SEQ ID NO: 51400 - protein, 16 aa, Homo sapiens
  heavy chain complementarity determining region 3 for antibody 25700
AHSRYSSNIYPVPFDD

SEQ ID NO: 51401 - protein, 9 aa, Homo sapiens
  light chain complementarity determining region 3 for antibody 25701
HQYGRSPET

SEQ ID NO: 51402 - protein, 19 aa, Homo sapiens
  heavy chain complementarity determining region 3 for antibody 25701
AREMRHYGSQSFYYYGMDV

SEQ ID NO: 51403 - protein, 9 aa, Homo sapiens
  light chain complementarity determining region 3 for antibody 25702
HQYGDTPRT

SEQ ID NO: 51404 - protein, 16 aa, Homo sapiens
  heavy chain complementarity determining region 3 for antibody 25702
AGLSASGHLAPNPFDV

SEQ ID NO: 51405 - protein, 9 aa, Homo sapiens
  light chain complementarity determining region 3 for antibody 25703
HQTNSLPPT

SEQ ID NO: 51406 - protein, 21 aa, Homo sapiens
  heavy chain complementarity determining region 3 for antibody 25703
ASRLSHFFDGQSHYYDNWLDS

SEQ ID NO: 51407 - protein, 9 aa, Homo sapiens
  light chain complementarity determining region 3 for antibody 25704
VQYHATPVT

SEQ ID NO: 51408 - protein, 9 aa, Homo sapiens
  heavy chain complementarity determining region 3 for antibody 25704
ATGVDADDG

SEQ ID NO: 51409 - protein, 9 aa, Homo sapiens
  light chain complementarity determining region 3 for antibody 25705
QRYDDLSFT

SEQ ID NO: 51410 - protein, 17 aa, Homo sapiens
  heavy chain complementarity determining region 3 for antibody 25705
ARHNNYYSDSYFVGFDF

SEQ ID NO: 51411 - protein, 9 aa, Homo sapiens
  light chain complementarity determining region 3 for antibody 25706
QQYYSTPWT

SEQ ID NO: 51412 - protein, 12 aa, Homo sapiens
  heavy chain complementarity determining region 3 for antibody 25706
AHRPHYDIPFDY

SEQ ID NO: 51413 - protein, 9 aa, Homo sapiens
  light chain complementarity determining region 3 for antibody 25707
QQYYSIPYT

SEQ ID NO: 51414 - protein, 12 aa, Homo sapiens
  heavy chain complementarity determining region 3 for antibody 25707
ARGGGSSSWYGY

SEQ ID NO: 51415 - protein, 9 aa, Homo sapiens
  light chain complementarity determining region 3 for antibody 25708
QQYYSAPPT

SEQ ID NO: 51416 - protein, 10 aa, Homo sapiens
  heavy chain complementarity determining region 3 for antibody 25708
ARGAVGGHDY

SEQ ID NO: 51417 - protein, 10 aa, Homo sapiens
  light chain complementarity determining region 3 for antibody 25709
QQYSYWPPGT

SEQ ID NO: 51418 - protein, 11 aa, Homo sapiens
  heavy chain complementarity determining region 3 for antibody 25709
ARDPLEHYFDY

SEQ ID NO: 51419 - protein, 10 aa, Homo sapiens
  light chain complementarity determining region 3 for antibody 25710
QQYSSYSPWT

SEQ ID NO: 51420 - protein, 17 aa, Homo sapiens
  heavy chain complementarity determining region 3 for antibody 25710
ARDRYYYGSVPGNWFDP

SEQ ID NO: 51421 - protein, 10 aa, Homo sapiens [sequence omitted]

SEQ ID NO: 51422 - protein, 13 aa, Homo sapiens
  heavy chain complementarity determining region 3 for antibody 25711
GRGGYTSSWYWVY

SEQ ID NO: 51423 - protein, 11 aa, Homo sapiens
  light chain complementarity determining region 3 for antibody 25712
QQYNNWPLALT

SEQ ID NO: 51424 - protein, 23 aa, Homo sapiens
  heavy chain complementarity determining region 3 for antibody 25712
ARVSQNLGEWSGSSRYGINAFDP

SEQ ID NO: 51425 - protein, 8 aa, Homo sapiens
  light chain complementarity determining region 3 for antibody 25713
QQYKSYYT

SEQ ID NO: 51426 - protein, 24 aa, Homo sapiens
  heavy chain complementarity determining region 3 for antibody 25713
TRDRPEADGSERNYKSIYFYGMDV

SEQ ID NO: 51427 - protein, 9 aa, Homo sapiens
  light chain complementarity determining region 3 for antibody 25714
QQYGSSPRT

SEQ ID NO: 51428 - protein, 25 aa, Homo sapiens
  heavy chain complementarity determining region 3 for antibody 25714
ARLRSDRLRLPGAMRGPLYDCGLNV

SEQ ID NO: 51429 - protein, 9 aa, Homo sapiens
  light chain complementarity determining region 3 for antibody 25715
QQYGSLPLT

SEQ ID NO: 51430 - protein, 15 aa, Homo sapiens
  heavy chain complementarity determining region 3 for antibody 25715
AHRPNCYDKAGAFDI

SEQ ID NO: 51431 - protein, 9 aa, Homo sapiens
  light chain complementarity determining region 3 for antibody 25716
QQYGNSLWT

SEQ ID NO: 51432 - protein, 15 aa, Homo sapiens
  heavy chain complementarity determining region 3 for antibody 25716
VTARIVVIIPRHFDY

SEQ ID NO: 51433 - protein, 9 aa, Homo sapiens
  light chain complementarity determining region 3 for antibody 25717
QQYGKSPGT

SEQ ID NO: 51434 - protein, 22 aa, Homo sapiens
  heavy chain complementarity determining region 3 for antibody 25717
ARGEYSYDGSNYLWLEVEYFQN

SEQ ID NO: 51435 - protein, 9 aa, Homo sapiens
  light chain complementarity determining region 3 for antibody 25718
QQYGGSSYP

SEQ ID NO: 51436 - protein, 16 aa, Homo sapiens
  heavy chain complementarity determining region 3 for antibody 25718
ANWFGSVGDFLGPFDY

SEQ ID NO: 51437 - protein, 8 aa, Homo sapiens
  light chain complementarity determining region 3 for antibody 25719
QQYGGSPR

SEQ ID NO: 51438 - protein, 16 aa, Homo sapiens
  heavy chain complementarity determining region 3 for antibody 25719
ATDWGSGTQWIRAFDV

SEQ ID NO: 51439 - protein, 10 aa, Homo sapiens
  light chain complementarity determining region 3 for antibody 25720
QQYGGSPAVT

SEQ ID NO: 51440 - protein, 12 aa, Homo sapiens
  heavy chain complementarity determining region 3 for antibody 25720
AKAKIRIIYFDY

SEQ ID NO: 51441 - protein, 9 aa, Homo sapiens
  light chain complementarity determining region 3 for antibody 25721
QQYFSHLYT

SEQ ID NO: 51442 - protein, 18 aa, Homo sapiens
  heavy chain complementarity determining region 3 for antibody 25721
AQERDGYCDSHACYGLDV

SEQ ID NO: 51443 - protein, 9 aa, Homo sapiens
  light chain complementarity determining region 3 for antibody 25722
QQYDSYSRT

SEQ ID NO: 51444 - protein, 20 aa, Homo sapiens
  heavy chain complementarity determining region 3 for antibody 25722
ARDNEGDFWDGYYTNYYFDS

SEQ ID NO: 51445 - protein, 9 aa, Homo sapiens
  light chain complementarity determining region 3 for antibody 25723
QQYDNWRIS

SEQ ID NO: 51446 - protein, 16 aa, Homo sapiens
  heavy chain complementarity determining region 3 for antibody 25723
ARDHSVTVAGRRWFDP

SEQ ID NO: 51447 - protein, 9 aa, Homo sapiens
  light chain complementarity determining region 3 for antibody 25724
QQYDNLPPT

SEQ ID NO: 51448 - protein, 15 aa, Homo sapiens
  heavy chain complementarity determining region 3 for antibody 25724
AKSRRQLVMAPRFGP

SEQ ID NO: 51449 - protein, 9 aa, Homo sapiens
  light chain complementarity determining region 3 for antibody 25725
QQYDNLPIT

SEQ ID NO: 51450 - protein, 18 aa, Homo sapiens
  heavy chain complementarity determining region 3 for antibody 25725
ARDFGGRAYTKVENAFDI

SEQ ID NO: 51451 - protein, 8 aa, Homo sapiens
  light chain complementarity determining region 3 for antibody 25726
QQYDNGYT

SEQ ID NO: 51452 - protein, 19 aa, Homo sapiens
  heavy chain complementarity determining region 3 for antibody 25726
ARQMHGVFTVGGTDDVFDV

SEQ ID NO: 51453 - protein, 9 aa, Homo sapiens
  light chain complementarity determining region 3 for antibody 25727
QQYDHVPPT

SEQ ID NO: 51454 - protein, 27 aa, Homo sapiens
  heavy chain complementarity determining region 3 for antibody 25727
AKDLGWTRFYGSGSDSFDVQREPGTDF

SEQ ID NO: 51455 - protein, 10 aa, Homo sapiens
  light chain complementarity determining region 3 for antibody 25728
QQYDGYWGYS

SEQ ID NO: 51456 - protein, 13 aa, Homo sapiens
  heavy chain complementarity determining region 3 for antibody 25728
AKVPYDSTGEFDF

SEQ ID NO: 51457 - protein, 10 aa, Homo sapiens
  light chain complementarity determining region 3 for antibody 25729
QQYDDWPPIT

SEQ ID NO: 51458 - protein, 21 aa, Homo sapiens
  heavy chain complementarity determining region 3 for antibody 25729
ARHFLQYFDDGSYYPEGLFDL

SEQ ID NO: 51459 - protein, 9 aa, Homo sapiens
  light chain complementarity determining region 3 for antibody 25730
QQTHSDLWA

SEQ ID NO: 51460 - protein, 19 aa, Homo sapiens
  heavy chain complementarity determining region 3 for antibody 25730
ARAGDFYDNGGYWVHALDI

SEQ ID NO: 51461 - protein, 9 aa, Homo sapiens
  light chain complementarity determining region 3 for antibody 25731
QQSYSTPYT

SEQ ID NO: 51462 - protein, 8 aa, Homo sapiens
  heavy chain complementarity determining region 3 for antibody 25731
TAWGSSHH

SEQ ID NO: 51463 - protein, 10 aa, Homo sapiens
  light chain complementarity determining region 3 for antibody 25732
QQSYSTPQYT

SEQ ID NO: 51464 - protein, 13 aa, Homo sapiens
  heavy chain complementarity determining region 3 for antibody 25732
ARPTGHSYGYADY

SEQ ID NO: 51465 - protein, 9 aa, Homo sapiens
  light chain complementarity determining region 3 for antibody 25733
QQSYSTPQT

SEQ ID NO: 51466 - protein, 11 aa, Homo sapiens
  heavy chain complementarity determining region 3 for antibody 25733
ARGPAWGAYDL

SEQ ID NO: 51467 - protein, 10 aa, Homo sapiens
  light chain complementarity determining region 3 for antibody 25734
QQSYSTGGFT

SEQ ID NO: 51468 - protein, 16 aa, Homo sapiens
  heavy chain complementarity determining region 3 for antibody 25734
ARMPCDSRGYYCYPDY

SEQ ID NO: 51469 - protein, 9 aa, Homo sapiens
  light chain complementarity determining region 3 for antibody 25735
QQSNSYPRT

SEQ ID NO: 51470 - protein, 9 aa, Homo sapiens
  heavy chain complementarity determining region 3 for antibody 25735
ARGAKEFEY

SEQ ID NO: 51471 - protein, 9 aa, Homo sapiens
  light chain complementarity determining region 3 for antibody 25736
QQSHTYPVT

SEQ ID NO: 51472 - protein, 14 aa, Homo sapiens
  heavy chain complementarity determining region 3 for antibody 25736
ARDLGGYGGYDYNY

SEQ ID NO: 51473 - protein, 9 aa, Homo sapiens
  light chain complementarity determining region 3 for antibody 25737
QQSHTTPPT

SEQ ID NO: 51474 - protein, 18 aa, Homo sapiens
  heavy chain complementarity determining region 3 for antibody 25737
VQLLGYCRDHGYCPPFAY

SEQ ID NO: 51475 - protein, 9 aa, Homo sapiens
  light chain complementarity determining region 3 for antibody 25738
QQSGTSPIT

SEQ ID NO: 51476 - protein, 24 aa, Homo sapiens
  heavy chain complementarity determining region 3 for antibody 25738
ARARSAFYSDSSGHYSQRNDALDI

SEQ ID NO: 51477 - protein, 11 aa, Homo sapiens
  light chain complementarity determining region 3 for antibody 25739
QQRSNWPRTLT

SEQ ID NO: 51478 - protein, 19 aa, Homo sapiens
  heavy chain complementarity determining region 3 for antibody 25739
ARDLGYYDFWSGYLEGMDY

SEQ ID NO: 51479 - protein, 9 aa, Homo sapiens
  light chain complementarity determining region 3 for antibody 25740
QQRSNWPGT

SEQ ID NO: 51480 - protein, 17 aa, Homo sapiens
  heavy chain complementarity determining region 3 for antibody 25740
ARGSSSGPCTSCEYFQH

SEQ ID NO: 51481 - protein, 10 aa, Homo sapiens
  light chain complementarity determining region 3 for antibody 25741
QQRSDWRGIT

SEQ ID NO: 51482 - protein, 21 aa, Homo sapiens
  heavy chain complementarity determining region 3 for antibody 25741
ARGNRYFSDNSNYYFRKYFDS

SEQ ID NO: 51483 - protein, 9 aa, Homo sapiens
  light chain complementarity determining region 3 for antibody 25742
QQNGSSPRT

SEQ ID NO: 51484 - protein, 25 aa, Homo sapiens
  heavy chain complementarity determining region 3 for antibody 25742
ARLRIDRLRLPGAMRGPLYDCGLNV

SEQ ID NO: 51485 - protein, 9 aa, Homo sapiens
  light chain complementarity determining region 3 for antibody 25743
QQNDAQSWT

SEQ ID NO: 51486 - protein, 11 aa, Homo sapiens
  heavy chain complementarity determining region 3 for antibody 25743
ARGWRDNSFDY

SEQ ID NO: 51487 - protein, 9 aa, Homo sapiens
  light chain complementarity determining region 3 for antibody 25744
QQHDNLSIT

SEQ ID NO: 51488 - protein, 14 aa, Homo sapiens
  heavy chain complementarity determining region 3 for antibody 25744
VRSRGSGHDAAFDY

SEQ ID NO: 51489 - protein, 9 aa, Homo sapiens
  light chain complementarity determining region 3 for antibody 25745
QQGSNWPLT

SEQ ID NO: 51490 - protein, 11 aa, Homo sapiens
  heavy chain complementarity determining region 3 for antibody 25745
ARGGHYDFSFS

SEQ ID NO: 51491 - protein, 9 aa, Homo sapiens
  light chain complementarity determining region 3 for antibody 25746
QQGNSFPHT

SEQ ID NO: 51492 - protein, 14 aa, Homo sapiens
  heavy chain complementarity determining region 3 for antibody 25746
ARYCSGTRCYSMDY

SEQ ID NO: 51493 - protein, 8 aa, Homo sapiens
  light chain complementarity determining region 3 for antibody 25747
QQFDSPFT

SEQ ID NO: 51494 - protein, 16 aa, Homo sapiens
  heavy chain complementarity determining region 3 for antibody 25747
AREKSTISVVRGAHDH

SEQ ID NO: 51495 - protein, 9 aa, Homo sapiens
  light chain complementarity determining region 3 for antibody 25748
QQDVKSPWT

SEQ ID NO: 51496 - protein, 11 aa, Homo sapiens
  heavy chain complementarity determining region 3 for antibody 25748
AREDWPDGFDI

SEQ ID NO: 51497 - protein, 9 aa, Homo sapiens
  light chain complementarity determining region 3 for antibody 25749
QQANSFPLT

SEQ ID NO: 51498 - protein, 21 aa, Homo sapiens
  heavy chain complementarity determining region 3 for antibody 25749
GSDYQRGPLVVVVGRNPHVDS

SEQ ID NO: 51499 - protein, 8 aa, Homo sapiens
  light chain complementarity determining region 3 for antibody 25750
QKYNSAPT

SEQ ID NO: 51500 - protein, 17 aa, Homo sapiens
  heavy chain complementarity determining region 3 for antibody 25750
ARGRSSLLRLLGGWFDP

SEQ ID NO: 51501 - protein, 9 aa, Homo sapiens
  light chain complementarity determining region 3 for antibody 25751
QKYNSAPGT

SEQ ID NO: 51502 - protein, 18 aa, Homo sapiens
  heavy chain complementarity determining region 3 for antibody 25751
ARGWGVLLWFGEYAGMDV

SEQ ID NO: 51503 - protein, 9 aa, Homo sapiens
  light chain complementarity determining region 3 for antibody 25752
QKYNSAHWT

SEQ ID NO: 51504 - protein, 17 aa, Homo sapiens
  heavy chain complementarity determining region 3 for antibody 25752
ARRPWVRGLFMPYYFDY

SEQ ID NO: 51505 - protein, 10 aa, Homo sapiens
  light chain complementarity determining region 3 for antibody 25753
QHYVSPPAYP

SEQ ID NO: 51506 - protein, 12 aa, Homo sapiens
  heavy chain complementarity determining region 3 for antibody 25753
ARETTRFGELDY

SEQ ID NO: 51507 - protein, 9 aa, Homo sapiens
  light chain complementarity determining region 3 for antibody 25754
QHYGNSPLT

SEQ ID NO: 51508 - protein, 13 aa, Homo sapiens
  heavy chain complementarity determining region 3 for antibody 25754
ASKTSVRTYSSDL

SEQ ID NO: 51509 - protein, 9 aa, Homo sapiens
  light chain complementarity determining region 3 for antibody 25755
QEYGSSPWT

SEQ ID NO: 51510 - protein, 12 aa, Homo sapiens
  heavy chain complementarity determining region 3 for antibody 25755
ATLARGSYYMKS

SEQ ID NO: 51511 - protein, 9 aa, Homo sapiens
  light chain complementarity determining region 3 for antibody 25756
MQNSHWPGT

SEQ ID NO: 51512 - protein, 10 aa, Homo sapiens
  heavy chain complementarity determining region 3 for antibody 25756
VCDYSGSGRD

SEQ ID NO: 51513 - protein, 9 aa, Homo sapiens
  light chain complementarity determining region 3 for antibody 25757
MQGSHWPYT

SEQ ID NO: 51514 - protein, 18 aa, Homo sapiens
  heavy chain complementarity determining region 3 for antibody 25757
ARSPKHIVRGLTLYDMDV

SEQ ID NO: 51515 - protein, 9 aa, Homo sapiens
  light chain complementarity determining region 3 for antibody 25758
MQGQQTPRT

SEQ ID NO: 51516 - protein, 23 aa, Homo sapiens
  heavy chain complementarity determining region 3 for antibody 25758
AREREYASGPYYSPLYYYYGVDV

SEQ ID NO: 51517 - protein, 9 aa, Homo sapiens
  light chain complementarity determining region 3 for antibody 25759
MQGLQTWGT

SEQ ID NO: 51518 - protein, 10 aa, Homo sapiens
  heavy chain complementarity determining region 3 for antibody 25759
ARYSWHKSDY

SEQ ID NO: 51519 - protein, 8 aa, Homo sapiens
  light chain complementarity determining region 3 for antibody 25760
MQAVHTRT

SEQ ID NO: 51520 - protein, 11 aa, Homo sapiens
  heavy chain complementarity determining region 3 for antibody 25760
ASDDSAATTPL

SEQ ID NO: 51521 - protein, 9 aa, Homo sapiens
  light chain complementarity determining region 3 for antibody 25761
MQALQTPTT

SEQ ID NO: 51522 - protein, 14 aa, Homo sapiens
  heavy chain complementarity determining region 3 for antibody 25761
ARALSSAWYDWFDP

SEQ ID NO: 51523 - protein, 10 aa, Homo sapiens
  light chain complementarity determining region 3 for antibody 25762
MQALQTPPYT

SEQ ID NO: 51524 - protein, 9 aa, Homo sapiens
  heavy chain complementarity determining region 3 for antibody 25762
ATGVDADYG

SEQ ID NO: 51525 - protein, 8 aa, Homo sapiens
  light chain complementarity determining region 3 for antibody 25763
MQALQTLP

SEQ ID NO: 51526 - protein, 16 aa, Homo sapiens
  heavy chain complementarity determining region 3 for antibody 25763
AKAGWLVGYDLSRGCA

SEQ ID NO: 51527 - protein, 10 aa, Homo sapiens
  light chain complementarity determining region 3 for antibody 25764
MQALQTLFFT

SEQ ID NO: 51528 - protein, 19 aa, Homo sapiens
  heavy chain complementarity determining region 3 for antibody 25764
ARGGRWELLPAVYYYGMDV

SEQ ID NO: 51529 - protein, 9 aa, Homo sapiens
  light chain complementarity determining region 3 for antibody 25765
MQALEAPFT

SEQ ID NO: 51530 - protein, 15 aa, Homo sapiens
  heavy chain complementarity determining region 3 for antibody 25765
VRHYRELATGIEGDS

SEQ ID NO: 51531 - protein, 9 aa, Homo sapiens
  light chain complementarity determining region 3 for antibody 25766
MEALQIPWT

SEQ ID NO: 51532 - protein, 16 aa, Homo sapiens
  heavy chain complementarity determining region 3 for antibody 25766
ARLGGAGTNYYYGMDV

SEQ ID NO: 51533 - protein, 9 aa, Homo sapiens
  light chain complementarity determining region 3 for antibody 25767
LQYDIPPRT

SEQ ID NO: 51534 - protein, 12 aa, Homo sapiens
  heavy chain complementarity determining region 3 for antibody 25767
TTMYGFLHSIDY

SEQ ID NO: 51535 - protein, 9 aa, Homo sapiens
  light chain complementarity determining region 3 for antibody 25768
LQTLQTPGT

SEQ ID NO: 51536 - protein, 13 aa, Homo sapiens
  heavy chain complementarity determining region 3 for antibody 25768
AKVVSYGSGGLQY

SEQ ID NO: 51537 - protein, 9 aa, Homo sapiens
  light chain complementarity determining region 3 for antibody 25769
LQHNSYPLT

SEQ ID NO: 51538 - protein, 22 aa, Homo sapiens
  heavy chain complementarity determining region 3 for antibody 25769
AKDQASTVVVVSRPWEVSDLTF

SEQ ID NO: 51539 - protein, 9 aa, Homo sapiens
  light chain complementarity determining region 3 for antibody 25770
LQHDNFPWT

SEQ ID NO: 51540 - protein, 23 aa, Homo sapiens
  heavy chain complementarity determining region 3 for antibody 25770
ARDRPVTVALAGNRYTGDWFFDL

SEQ ID NO: 51541 - protein, 11 aa, Homo sapiens
  light chain complementarity determining region 3 for antibody 25771
LHYNNWPPGYT

SEQ ID NO: 51542 - protein, 15 aa, Homo sapiens
  heavy chain complementarity determining region 3 for antibody 25771
GRDQGPVFSHPTIDY

SEQ ID NO: 51543 - protein, 9 aa, Homo sapiens
  light chain complementarity determining region 3 for antibody 25772
HQSYSSPFT

SEQ ID NO: 51544 - protein, 14 aa, Homo sapiens
  heavy chain complementarity determining region 3 for antibody 25772
ARKTERMVGIPFDY

SEQ ID NO: 51545 - protein, 9 aa, Homo sapiens
  light chain complementarity determining region 3 for antibody 25773
EQAFSAPPT

SEQ ID NO: 51546 - protein, 20 aa, Homo sapiens
  heavy chain complementarity determining region 3 for antibody 25773
AREESYYAHTTNINIVTMDV

SEQ ID NO: 51547 - protein, 9 aa, Homo sapiens
  light chain complementarity determining region 3 for antibody 25774
QYYGRSPRT

SEQ ID NO: 51548 - protein, 17 aa, Homo sapiens
  heavy chain complementarity determining region 3 for antibody 25774
ARDTADDFWSGYYPFDH

SEQ ID NO: 51549 - protein, 9 aa, Homo sapiens
  light chain complementarity determining region 3 for antibody 25775
QQYYTYPLT

SEQ ID NO: 51550 - protein, 18 aa, Homo sapiens
  heavy chain complementarity determining region 3 for antibody 25775
ARDGNYDFWSGAISGMDV

SEQ ID NO: 51551 - protein, 9 aa, Homo sapiens
  light chain complementarity determining region 3 for antibody 25776
QQYYTSVRP

SEQ ID NO: 51552 - protein, 12 aa, Homo sapiens
  heavy chain complementarity determining region 3 for antibody 25776
VKDCGLGGSRDS

SEQ ID NO: 51553 - protein, 9 aa, Homo sapiens
  light chain complementarity determining region 3 for antibody 25777
QQYYTSPPT

SEQ ID NO: 51554 - protein, 17 aa, Homo sapiens
  heavy chain complementarity determining region 3 for antibody 25777
AILSASLTQGHRYYFDS

SEQ ID NO: 51555 - protein, 9 aa, Homo sapiens
  light chain complementarity determining region 3 for antibody 25778
QQYYSTPLT

SEQ ID NO: 51556 - protein, 20 aa, Homo sapiens
  heavy chain complementarity determining region 3 for antibody 25778
ARDQAYFYALGSSGVDWLDP

SEQ ID NO: 51557 - protein, 8 aa, Homo sapiens
  light chain complementarity determining region 3 for antibody 25779
QQYYSTLT

SEQ ID NO: 51558 - protein, 15 aa, Homo sapiens
  heavy chain complementarity determining region 3 for antibody 25779
AKGTLRLGATHYFDY

SEQ ID NO: 51559 - protein, 9 aa, Homo sapiens
  light chain complementarity determining region 3 for antibody 25780
QQYYSPPLT

SEQ ID NO: 51560 - protein, 13 aa, Homo sapiens
  heavy chain complementarity determining region 3 for antibody 25780
ARHAEWEVGRFDY

SEQ ID NO: 51561 - protein, 9 aa, Homo sapiens
  light chain complementarity determining region 3 for antibody 25781
QQYYSNPST

SEQ ID NO: 51562 - protein, 12 aa, Homo sapiens
  heavy chain complementarity determining region 3 for antibody 25781
ASGQLVRWYFDY

SEQ ID NO: 51563 - protein, 9 aa, Homo sapiens
  light chain complementarity determining region 3 for antibody 25782
QQYYSIPPT

SEQ ID NO: 51564 - protein, 11 aa, Homo sapiens
  heavy chain complementarity determining region 3 for antibody 25782
ARVGFLVPFDC

SEQ ID NO: 51565 - protein, 10 aa, Homo sapiens
  light chain complementarity determining region 3 for antibody 25783
QQYYNYSGGT

SEQ ID NO: 51566 - protein, 17 aa, Homo sapiens
  heavy chain complementarity determining region 3 for antibody 25783
GYSPSMIGGLIPGAFHY

SEQ ID NO: 51567 - protein, 9 aa, Homo sapiens
  light chain complementarity determining region 3 for antibody 25784
QQYYASPIT

SEQ ID NO: 51568 - protein, 10 aa, Homo sapiens
  heavy chain complementarity determining region 3 for antibody 25784
AGGTGWISDY

SEQ ID NO: 51569 - protein, 9 aa, Homo sapiens
  light chain complementarity determining region 3 for antibody 25785
QQYNSYSWT

SEQ ID NO: 51570 - protein, 17 aa, Homo sapiens
  heavy chain complementarity determining region 3 for antibody 25785
ARVKGVGGVIIRGYFDY

SEQ ID NO: 51571 - protein, 9 aa, Homo sapiens
  light chain complementarity determining region 3 for antibody 25786
QQYNSYSGT

SEQ ID NO: 51572 - protein, 12 aa, Homo sapiens
  heavy chain complementarity determining region 3 for antibody 25786
ARRMDYWAYFDH

SEQ ID NO: 51573 - protein, 9 aa, Homo sapiens
  light chain complementarity determining region 3 for antibody 25787
QQYNSYPWT

SEQ ID NO: 51574 - protein, 13 aa, Homo sapiens
  heavy chain complementarity determining region 3 for antibody 25787
ARGVGYGRHYFDF

SEQ ID NO: 51575 - protein, 9 aa, Homo sapiens
  light chain complementarity determining region 3 for antibody 25788
QQYNSYPWT

SEQ ID NO: 51576 - protein, 23 aa, Homo sapiens
  heavy chain complementarity determining region 3 for antibody 25788
AKGGDYYDSSGYYINVLASAFDI

SEQ ID NO: 51577 - protein, 10 aa, Homo sapiens
  light chain complementarity determining region 3 for antibody 25789
QQYNNWPPYT

SEQ ID NO: 51578 - protein, 11 aa, Homo sapiens
  heavy chain complementarity determining region 3 for antibody 25789
AGITGDGAFDI

SEQ ID NO: 51579 - protein, 9 aa, Homo sapiens
  light chain complementarity determining region 3 for antibody 25790
QQYNNWPLT

SEQ ID NO: 51580 - protein, 9 aa, Homo sapiens
  heavy chain complementarity determining region 3 for antibody 25790
ARGLRWVDY

SEQ ID NO: 51581 - protein, 9 aa, Homo sapiens
  light chain complementarity determining region 3 for antibody 25791
QQYNNWPFT

SEQ ID NO: 51582 - protein, 19 aa, Homo sapiens
  heavy chain complementarity determining region 3 for antibody 25791
ARDIFPRTIAAAGMNVFDL

SEQ ID NO: 51583 - protein, 10 aa, Homo sapiens
  light chain complementarity determining region 3 for antibody 25792
QQYNNWLGGT

SEQ ID NO: 51584 - protein, 13 aa, Homo sapiens
  heavy chain complementarity determining region 3 for antibody 25792
ARHGRRSGWYYTY

SEQ ID NO: 51585 - protein, 8 aa, Homo sapiens
  light chain complementarity determining region 3 for antibody 25793
QQYNFLVT

SEQ ID NO: 51586 - protein, 18 aa, Homo sapiens
  heavy chain complementarity determining region 3 for antibody 25793
ARGGRGSCRGTYCYWLDS

SEQ ID NO: 51587 - protein, 10 aa, Homo sapiens
  light chain complementarity determining region 3 for antibody 25794
QQYNDWPPYT

SEQ ID NO: 51588 - protein, 24 aa, Homo sapiens
  heavy chain complementarity determining region 3 for antibody 25794
ARGGALGYCSGGRCYGGYQNGMDV

SEQ ID NO: 51589 - protein, 9 aa, Homo sapiens
  light chain complementarity determining region 3 for antibody 25795
QQYHGFPWA

SEQ ID NO: 51590 - protein, 15 aa, Homo sapiens
  heavy chain complementarity determining region 3 for antibody 25795
ARFGAESSSSRYIGF

SEQ ID NO: 51591 - protein, 9 aa, Homo sapiens
  light chain complementarity determining region 3 for antibody 25796
QQYGSSPRT

SEQ ID NO: 51592 - protein, 25 aa, Homo sapiens
  heavy chain complementarity determining region 3 for antibody 25796
ASLRIDRLRLPGAMRGPLYDCGLNV

SEQ ID NO: 51593 - protein, 9 aa, Homo sapiens
  light chain complementarity determining region 3 for antibody 25797
QQYGSSPRT

SEQ ID NO: 51594 - protein, 15 aa, Homo sapiens
  heavy chain complementarity determining region 3 for antibody 25797
ARANGVIITTGVLSY

SEQ ID NO: 51595 - protein, 9 aa, Homo sapiens
  light chain complementarity determining region 3 for antibody 25798
QQYGSSPPT

SEQ ID NO: 51596 - protein, 11 aa, Homo sapiens
  heavy chain complementarity determining region 3 for antibody 25798
ARHRVGTPFDS

SEQ ID NO: 51597 - protein, 10 aa, Homo sapiens
  light chain complementarity determining region 3 for antibody 25799
QQYGSSPMYT

SEQ ID NO: 51598 - protein, 30 aa, Homo sapiens
  heavy chain complementarity determining region 3 for antibody 25799
ARGGLEVAGHRNQWLVPGRERDYYYYAMDV

SEQ ID NO: 51599 - protein, 9 aa, Homo sapiens
  light chain complementarity determining region 3 for antibody 25800
QQYGSSPLT

SEQ ID NO: 51600 - protein, 18 aa, Homo sapiens
  heavy chain complementarity determining region 3 for antibody 25800
AKLPAPYGNKPRLYYFDY

SEQ ID NO: 51601 - protein, 8 aa, Homo sapiens
  light chain complementarity determining region 3 for antibody 25801
QQYGSSLT

SEQ ID NO: 51602 - protein, 21 aa, Homo sapiens
  heavy chain complementarity determining region 3 for antibody 25801
TTLKGPSYDFWSGYGTYYFDY

SEQ ID NO: 51603 - protein, 9 aa, Homo sapiens
  light chain complementarity determining region 3 for antibody 25802
QQYGSSLST

SEQ ID NO: 51604 - protein, 9 aa, Homo sapiens
  heavy chain complementarity determining region 3 for antibody 25802
IYEINAFDI

SEQ ID NO: 51605 - protein, 9 aa, Homo sapiens
  light chain complementarity determining region 3 for antibody 25803
QQYGRIPRT

SEQ ID NO: 51606 - protein, 14 aa, Homo sapiens
  heavy chain complementarity determining region 3 for antibody 25803
AGGKFCGGDCYREY

SEQ ID NO: 51607 - protein, 9 aa, Homo sapiens
  light chain complementarity determining region 3 for antibody 25804
QQYGKSPGT

SEQ ID NO: 51608 - protein, 22 aa, Homo sapiens
  heavy chain complementarity determining region 3 for antibody 25804
ARGEYSYGGSNYLWLEVEYFQN

SEQ ID NO: 51609 - protein, 9 aa, Homo sapiens
  light chain complementarity determining region 3 for antibody 25805
QQYDNLPRT

SEQ ID NO: 51610 - protein, 19 aa, Homo sapiens
  heavy chain complementarity determining region 3 for antibody 25805
ARLVGTVVRGIPKRGLFNS

SEQ ID NO: 51611 - protein, 6 aa, Homo sapiens
  light chain complementarity determining region 3 for antibody 25806
QQYDNL

SEQ ID NO: 51612 - protein, 16 aa, Homo sapiens
  heavy chain complementarity determining region 3 for antibody 25806
ATDRLEWLFTPHPLDV

SEQ ID NO: 51613 - protein, 9 aa, Homo sapiens
  light chain complementarity determining region 3 for antibody 25807
QQYATSPLT

SEQ ID NO: 51614 - protein, 10 aa, Homo sapiens
  heavy chain complementarity determining region 3 for antibody 25807
ATGGGWLVDY

SEQ ID NO: 51615 - protein, 9 aa, Homo sapiens
  light chain complementarity determining region 3 for antibody 25808
QQYATSPLP

SEQ ID NO: 51616 - protein, 10 aa, Homo sapiens
  heavy chain complementarity determining region 3 for antibody 25808
TTGGGWLVDY

SEQ ID NO: 51617 - protein, 9 aa, Homo sapiens
  light chain complementarity determining region 3 for antibody 25809
QQVGGAPRT

SEQ ID NO: 51618 - protein, 16 aa, Homo sapiens
  heavy chain complementarity determining region 3 for antibody 25809
ARDPRGGVAVPADFNY

SEQ ID NO: 51619 - protein, 9 aa, Homo sapiens
  light chain complementarity determining region 3 for antibody 25810
QQTYYLPLT

SEQ ID NO: 51620 - protein, 6 aa, Homo sapiens
  heavy chain complementarity determining region 3 for antibody 25810
TTVFDY

SEQ ID NO: 51621 - protein, 9 aa, Homo sapiens
  light chain complementarity determining region 3 for antibody 25811
QQTNITQCT

SEQ ID NO: 51622 - protein, 14 aa, Homo sapiens
  heavy chain complementarity determining region 3 for antibody 25811
TRAPSRIGIYYPHL

SEQ ID NO: 51623 - protein, 10 aa, Homo sapiens
  light chain complementarity determining region 3 for antibody 25812
QQTFSTLALT

SEQ ID NO: 51624 - protein, 14 aa, Homo sapiens
  heavy chain complementarity determining region 3 for antibody 25812
ATISGRDFYNWFDP

SEQ ID NO: 51625 - protein, 9 aa, Homo sapiens
  light chain complementarity determining region 3 for antibody 25813
QQTDSFPIT

SEQ ID NO: 51626 - protein, 14 aa, Homo sapiens
  heavy chain complementarity determining region 3 for antibody 25813
ARFMVRDVLYYFDL

SEQ ID NO: 51627 - protein, 9 aa, Homo sapiens
  light chain complementarity determining region 3 for antibody 25814
QQSYSTPPA

SEQ ID NO: 51628 - protein, 19 aa, Homo sapiens
  heavy chain complementarity determining region 3 for antibody 25814
ARGSGRMVTAGLLVVAFDI

SEQ ID NO: 51629 - protein, 9 aa, Homo sapiens
  light chain complementarity determining region 3 for antibody 25815
QQSYSTPPA

SEQ ID NO: 51630 - protein, 16 aa, Homo sapiens
  heavy chain complementarity determining region 3 for antibody 25815
ARDKIPQLVPSYYFDY

SEQ ID NO: 51631 - protein, 9 aa, Homo sapiens
  light chain complementarity determining region 3 for antibody 25816
QQSYSTPLT

SEQ ID NO: 51632 - protein, 17 aa, Homo sapiens
  heavy chain complementarity determining region 3 for antibody 25816
ARAVTSGNYPPVGYFDY

SEQ ID NO: 51633 - protein, 10 aa, Homo sapiens
  light chain complementarity determining region 3 for antibody 25817
QQRSNWPPFT

SEQ ID NO: 51634 - protein, 12 aa, Homo sapiens
  heavy chain complementarity determining region 3 for antibody 25817
AREGDFGDYIDY

SEQ ID NO: 51635 - protein, 9 aa, Homo sapiens
  light chain complementarity determining region 3 for antibody 25818
QQRSNWPIT

SEQ ID NO: 51636 - protein, 10 aa, Homo sapiens
  heavy chain complementarity determining region 3 for antibody 25818
ARENWAGPDY

SEQ ID NO: 51637 - protein, 10 aa, Homo sapiens
  light chain complementarity determining region 3 for antibody 25819
QQRSDWPPPT

SEQ ID NO: 51638 - protein, 10 aa, Homo sapiens
  heavy chain complementarity determining region 3 for antibody 25819
ARDYTMTFDY

SEQ ID NO: 51639 - protein, 9 aa, Homo sapiens
  light chain complementarity determining region 3 for antibody 25820
QQRRNWPLT

SEQ ID NO: 51640 - protein, 10 aa, Homo sapiens
  heavy chain complementarity determining region 3 for antibody 25820
ATPTAAPVDY

SEQ ID NO: 51641 - protein, 8 aa, Homo sapiens
  light chain complementarity determining region 3 for antibody 25821
QQRRDLIT

SEQ ID NO: 51642 - protein, 18 aa, Homo sapiens
  heavy chain complementarity determining region 3 for antibody 25821
AKASLGHCSGRNCYYLDS

SEQ ID NO: 51643 - protein, 9 aa, Homo sapiens
  light chain complementarity determining region 3 for antibody 25822
QQRIDWPGT

SEQ ID NO: 51644 - protein, 12 aa, Homo sapiens
  heavy chain complementarity determining region 3 for antibody 25822
GREDYRTGYVDS

SEQ ID NO: 51645 - protein, 10 aa, Homo sapiens
  light chain complementarity determining region 3 for antibody 25823
QQNGSSPMYS

SEQ ID NO: 51646 - protein, 11 aa, Homo sapiens
  heavy chain complementarity determining region 3 for antibody 25823
ARGGQWGSLDY

SEQ ID NO: 51647 - protein, 9 aa, Homo sapiens
  light chain complementarity determining region 3 for antibody 25824
QQLNSYPRT

SEQ ID NO: 51648 - protein, 13 aa, Homo sapiens
  heavy chain complementarity determining region 3 for antibody 25824
ARGRSRDRHPFDT

SEQ ID NO: 51649 - protein, 9 aa, Homo sapiens
  light chain complementarity determining region 3 for antibody 25825
QQLNSYALT

SEQ ID NO: 51650 - protein, 26 aa, Homo sapiens
  heavy chain complementarity determining region 3 for antibody 25825
ARKFRRGGGRGYYFDNSGRNGDVFDI

SEQ ID NO: 51651 - protein, 9 aa, Homo sapiens
  light chain complementarity determining region 3 for antibody 25826
QQLKDYPWT

SEQ ID NO: 51652 - protein, 25 aa, Homo sapiens
  heavy chain complementarity determining region 3 for antibody 25826
ARMDLLYDYWSRDPQRGLQYYGMDV

SEQ ID NO: 51653 - protein, 9 aa, Homo sapiens
  light chain complementarity determining region 3 for antibody 25827
QQIYSTPDT

SEQ ID NO: 51654 - protein, 7 aa, Homo sapiens
  heavy chain complementarity determining region 3 for antibody 25827
ATKMGDY

SEQ ID NO: 51655 - protein, 9 aa, Homo sapiens
  light chain complementarity determining region 3 for antibody 25828
QQHGSSPRT

SEQ ID NO: 51656 - protein, 25 aa, Homo sapiens
  heavy chain complementarity determining region 3 for antibody 25828
ARLRIDRLRLPGAMRGPLYDCGLNV

SEQ ID NO: 51657 - protein, 9 aa, Homo sapiens
  light chain complementarity determining region 3 for antibody 25829
QQGYSTPLT

SEQ ID NO: 51658 - protein, 15 aa, Homo sapiens
  heavy chain complementarity determining region 3 for antibody 25829
ARAQVIWGQLYYFDF

SEQ ID NO: 51659 - protein, 9 aa, Homo sapiens
  light chain complementarity determining region 3 for antibody 25830
QQFYSSPPA

SEQ ID NO: 51660 - protein, 11 aa, Homo sapiens
  heavy chain complementarity determining region 3 for antibody 25830
GRVYSWGAVDI

SEQ ID NO: 51661 - protein, 9 aa, Homo sapiens
  light chain complementarity determining region 3 for antibody 25831
QQFNTYSPT

SEQ ID NO: 51662 - protein, 15 aa, Homo sapiens
  heavy chain complementarity determining region 3 for antibody 25831
ARVGIQLWRGGWFDP

SEQ ID NO: 51663 - protein, 9 aa, Homo sapiens
  light chain complementarity determining region 3 for antibody 25832
QQFAFPSFT

SEQ ID NO: 51664 - protein, 17 aa, Homo sapiens
  heavy chain complementarity determining region 3 for antibody 25832
AQSPRGVVLLIKGHLRH

SEQ ID NO: 51665 - protein, 9 aa, Homo sapiens
  light chain complementarity determining region 3 for antibody 25833
QQDTSLPIT

SEQ ID NO: 51666 - protein, 20 aa, Homo sapiens
  heavy chain complementarity determining region 3 for antibody 25833
VRGPHIVVLTSFPWRWSLGL

SEQ ID NO: 51667 - protein, 9 aa, Homo sapiens
  light chain complementarity determining region 3 for antibody 25834
QQDGSSPQT

SEQ ID NO: 51668 - protein, 11 aa, Homo sapiens
  heavy chain complementarity determining region 3 for antibody 25834
ARGDLWSAFDI

SEQ ID NO: 51669 - protein, 9 aa, Homo sapiens
  light chain complementarity determining region 3 for antibody 25835
QQDGSSPPT

SEQ ID NO: 51670 - protein, 12 aa, Homo sapiens
  heavy chain complementarity determining region 3 for antibody 25835
ARGPQLWFYFDY

SEQ ID NO: 51671 - protein, 9 aa, Homo sapiens
  light chain complementarity determining region 3 for antibody 25836
QPYYTSVRT

SEQ ID NO: 51672 - protein, 12 aa, Homo sapiens
  heavy chain complementarity determining region 3 for antibody 25836
VKDCGLGGSRDF

SEQ ID NO: 51673 - protein, 9 aa, Homo sapiens
  light chain complementarity determining region 3 for antibody 25837
QPYYTSLRT

SEQ ID NO: 51674 - protein, 12 aa, Homo sapiens
  heavy chain complementarity determining region 3 for antibody 25837
VKDCGLGGSRDS

SEQ ID NO: 51675 - protein, 9 aa, Homo sapiens
  light chain complementarity determining region 3 for antibody 25838
QNYDDAPWT

SEQ ID NO: 51676 - protein, 16 aa, Homo sapiens
  heavy chain complementarity determining region 3 for antibody 25838
AKKGGPVKATGNYFDL

SEQ ID NO: 51677 - protein, 10 aa, Homo sapiens
  light chain complementarity determining region 3 for antibody 25839
QLYSRSPTWR

SEQ ID NO: 51678 - protein, 19 aa, Homo sapiens
  heavy chain complementarity determining region 3 for antibody 25839
ARESYYPDIGGYTPRAFDI

SEQ ID NO: 51679 - protein, 10 aa, Homo sapiens
  light chain complementarity determining region 3 for antibody 25840
QLYDSSSPVT

SEQ ID NO: 51680 - protein, 13 aa, Homo sapiens
  heavy chain complementarity determining region 3 for antibody 25840
ATPGPILTAAYLI

SEQ ID NO: 51681 - protein, 9 aa, Homo sapiens
  light chain complementarity determining region 3 for antibody 25841
QKYNSAPFT

SEQ ID NO: 51682 - protein, 23 aa, Homo sapiens
  heavy chain complementarity determining region 3 for antibody 25841
VREDRTLLWVGEFLNYHYYGMNA

SEQ ID NO: 51683 - protein, 9 aa, Homo sapiens
  light chain complementarity determining region 3 for antibody 25842
QKYNSAPFT

SEQ ID NO: 51684 - protein, 19 aa, Homo sapiens
  heavy chain complementarity determining region 3 for antibody 25842
ARGLHDMENGFPPHDGFDL

SEQ ID NO: 51685 - protein, 9 aa, Homo sapiens
  light chain complementarity determining region 3 for antibody 25843
QKYGSAPYT

SEQ ID NO: 51686 - protein, 13 aa, Homo sapiens
  heavy chain complementarity determining region 3 for antibody 25843
AKGLADYKDALDI

SEQ ID NO: 51687 - protein, 10 aa, Homo sapiens
  light chain complementarity determining region 3 for antibody 25844
QHRSHRPPYT

SEQ ID NO: 51688 - protein, 13 aa, Homo sapiens
  heavy chain complementarity determining region 3 for antibody 25844
ATSIFGVPNRRDY

SEQ ID NO: 51689 - protein, 8 aa, Homo sapiens
  light chain complementarity determining region 3 for antibody 25845
QHHVSSPT

SEQ ID NO: 51690 - protein, 12 aa, Homo sapiens
  heavy chain complementarity determining region 3 for antibody 25845
AKELTSYGYFDY

SEQ ID NO: 51691 - protein, 8 aa, Homo sapiens
  light chain complementarity determining region 3 for antibody 25846
QGYDGITT

SEQ ID NO: 51692 - protein, 7 aa, Homo sapiens
  heavy chain complementarity determining region 3 for antibody 25846
ITTSVDL

SEQ ID NO: 51693 - protein, 11 aa, Homo sapiens
  light chain complementarity determining region 3 for antibody 25847
QEYNNWPPKYT

SEQ ID NO: 51694 - protein, 13 aa, Homo sapiens
  heavy chain complementarity determining region 3 for antibody 25847
AKGGSSWSDPFES

SEQ ID NO: 51695 - protein, 10 aa, Homo sapiens
  light chain complementarity determining region 3 for antibody 25848
QEYKSWPAFP

SEQ ID NO: 51696 - protein, 11 aa, Homo sapiens
  heavy chain complementarity determining region 3 for antibody 25848
ARRWGSAPFDH

SEQ ID NO: 51697 - protein, 8 aa, Homo sapiens
  light chain complementarity determining region 3 for antibody 25849
QEYGDLLT

SEQ ID NO: 51698 - protein, 12 aa, Homo sapiens
  heavy chain complementarity determining region 3 for antibody 25849
VNWVFGHWSFDY

SEQ ID NO: 51699 - protein, 9 aa, Homo sapiens
  light chain complementarity determining region 3 for antibody 25850
QESYSNLWT

SEQ ID NO: 51700 - protein, 13 aa, Homo sapiens
  heavy chain complementarity determining region 3 for antibody 25850
ARDSSSLYNWFGP

SEQ ID NO: 51701 - protein, 9 aa, Homo sapiens
  light chain complementarity determining region 3 for antibody 25851
QESYSAQWT

SEQ ID NO: 51702 - protein, 23 aa, Homo sapiens
  heavy chain complementarity determining region 3 for antibody 25851
ARLSRDPIAVRTSPLDYYYGMDV

SEQ ID NO: 51703 - protein, 9 aa, Homo sapiens
  light chain complementarity determining region 3 for antibody 25852
MQVLQTPLP

SEQ ID NO: 51704 - protein, 12 aa, Homo sapiens
  heavy chain complementarity determining region 3 for antibody 25852
VKDSDKKWELLD

SEQ ID NO: 51705 - protein, 9 aa, Homo sapiens
  light chain complementarity determining region 3 for antibody 25853
MQGTQGPYT

SEQ ID NO: 51706 - protein, 10 aa, Homo sapiens
  heavy chain complementarity determining region 3 for antibody 25853
ASGQFYQFDF

SEQ ID NO: 51707 - protein, 9 aa, Homo sapiens
  light chain complementarity determining region 3 for antibody 25854
MQGTPWPPT

SEQ ID NO: 51708 - protein, 11 aa, Homo sapiens
  heavy chain complementarity determining region 3 for antibody 25854
ARDPGWGARDY

SEQ ID NO: 51709 - protein, 8 aa, Homo sapiens
  light chain complementarity determining region 3 for antibody 25855
MQGLPTPL

SEQ ID NO: 51710 - protein, 17 aa, Homo sapiens
  heavy chain complementarity determining region 3 for antibody 25855
ARVDMGTSYLSYFGMDV

SEQ ID NO: 51711 - protein, 8 aa, Homo sapiens
  light chain complementarity determining region 3 for antibody 25856
MQALQTWT

SEQ ID NO: 51712 - protein, 14 aa, Homo sapiens
  heavy chain complementarity determining region 3 for antibody 25856
VTDLSVGQTYARDY

SEQ ID NO: 51713 - protein, 9 aa, Homo sapiens
  light chain complementarity determining region 3 for antibody 25857
MQALQTSYT

SEQ ID NO: 51714 - protein, 19 aa, Homo sapiens
  heavy chain complementarity determining region 3 for antibody 25857
ARGDYDSGDYWSRPSWFAP

SEQ ID NO: 51715 - protein, 8 aa, Homo sapiens
  light chain complementarity determining region 3 for antibody 25858
MQALQTPT

SEQ ID NO: 51716 - protein, 17 aa, Homo sapiens
  heavy chain complementarity determining region 3 for antibody 25858
ARVAQPGAGIRCYGMDV

SEQ ID NO: 51717 - protein, 9 aa, Homo sapiens
  light chain complementarity determining region 3 for antibody 25859
MQALQTLYT

SEQ ID NO: 51718 - protein, 14 aa, Homo sapiens
  heavy chain complementarity determining region 3 for antibody 25859
ARPPGSSWQSGVVY

SEQ ID NO: 51719 - protein, 9 aa, Homo sapiens
  light chain complementarity determining region 3 for antibody 25860
MQALQIPPT

SEQ ID NO: 51720 - protein, 19 aa, Homo sapiens
  heavy chain complementarity determining region 3 for antibody 25860
ARVVFWRSEGRYYFHGVDV

SEQ ID NO: 51721 - protein, 11 aa, Homo sapiens
  light chain complementarity determining region 3 for antibody 25861
LVFNNSPPTWT

SEQ ID NO: 51722 - protein, 15 aa, Homo sapiens
  heavy chain complementarity determining region 3 for antibody 25861
VRDFSYGALMSYFEY

SEQ ID NO: 51723 - protein, 9 aa, Homo sapiens
  light chain complementarity determining region 3 for antibody 25862
LQYNEFPYI

SEQ ID NO: 51724 - protein, 13 aa, Homo sapiens
  heavy chain complementarity determining region 3 for antibody 25862
ARSPYSSGWYPDL

SEQ ID NO: 51725 - protein, 9 aa, Homo sapiens
  light chain complementarity determining region 3 for antibody 25863
LQYGGPPLT

SEQ ID NO: 51726 - protein, 8 aa, Homo sapiens
  heavy chain complementarity determining region 3 for antibody 25863
VRIMDPGY

SEQ ID NO: 51727 - protein, 9 aa, Homo sapiens
  light chain complementarity determining region 3 for antibody 25864
LQHYSYPLT

SEQ ID NO: 51728 - protein, 22 aa, Homo sapiens
  heavy chain complementarity determining region 3 for antibody 25864
AKDQASTVVVVSRPWEVSDLAF

SEQ ID NO: 51729 - protein, 9 aa, Homo sapiens
  light chain complementarity determining region 3 for antibody 25865
LQHYGLPYT

SEQ ID NO: 51730 - protein, 14 aa, Homo sapiens
  heavy chain complementarity determining region 3 for antibody 25865
ARDFSSPLKPAFDI

SEQ ID NO: 51731 - protein, 9 aa, Homo sapiens
  light chain complementarity determining region 3 for antibody 25866
LQHNTYPLT

SEQ ID NO: 51732 - protein, 17 aa, Homo sapiens
  heavy chain complementarity determining region 3 for antibody 25866
AKMRGYGVVGSEDGFDI

SEQ ID NO: 51733 - protein, 9 aa, Homo sapiens
  light chain complementarity determining region 3 for antibody 25867
LQHNSYPLT

SEQ ID NO: 51734 - protein, 20 aa, Homo sapiens
  heavy chain complementarity determining region 3 for antibody 25867
ARPSEDVLKWGPQGDWHYDL

SEQ ID NO: 51735 - protein, 8 aa, Homo sapiens
  light chain complementarity determining region 3 for antibody 25868
HQYGTPIT

SEQ ID NO: 51736 - protein, 16 aa, Homo sapiens
  heavy chain complementarity determining region 3 for antibody 25868
AHSRYGSNIYPVPFDN

SEQ ID NO: 51737 - protein, 9 aa, Homo sapiens
  light chain complementarity determining region 3 for antibody 25869
HHHGSSPYN

SEQ ID NO: 51738 - protein, 14 aa, Homo sapiens
  heavy chain complementarity determining region 3 for antibody 25869
ARLKTGGYMYESSI

SEQ ID NO: 51739 - protein, 9 aa, Homo sapiens
  light chain complementarity determining region 3 for antibody 25870
QQYYTSIRT

SEQ ID NO: 51740 - protein, 12 aa, Homo sapiens
  heavy chain complementarity determining region 3 for antibody 25870
VKDCGLGGSRDS

SEQ ID NO: 51741 - protein, 9 aa, Homo sapiens
  light chain complementarity determining region 3 for antibody 25871
QQYYTHPPT

SEQ ID NO: 51742 - protein, 13 aa, Homo sapiens
  heavy chain complementarity determining region 3 for antibody 25871
AKDPSGNYGSWVH

SEQ ID NO: 51743 - protein, 9 aa, Homo sapiens
  light chain complementarity determining region 3 for antibody 25872
QQYYSTPYT

SEQ ID NO: 51744 - protein, 17 aa, Homo sapiens
  heavy chain complementarity determining region 3 for antibody 25872
ARDQKDDSSGNYGGFDP

SEQ ID NO: 51745 - protein, 9 aa, Homo sapiens
  light chain complementarity determining region 3 for antibody 25873
QQYYSTPPT

SEQ ID NO: 51746 - protein, 17 aa, Homo sapiens
  heavy chain complementarity determining region 3 for antibody 25873
ARVITMIVVLTHDAFDI

SEQ ID NO: 51747 - protein, 9 aa, Homo sapiens
  light chain complementarity determining region 3 for antibody 25874
QQYYSTPPT

SEQ ID NO: 51748 - protein, 14 aa, Homo sapiens
  heavy chain complementarity determining region 3 for antibody 25874
ARSLSSAWYDWSDP

SEQ ID NO: 51749 - protein, 9 aa, Homo sapiens
  light chain complementarity determining region 3 for antibody 25875
QQYYSTLIT

SEQ ID NO: 51750 - protein, 15 aa, Homo sapiens
  heavy chain complementarity determining region 3 for antibody 25875
ARSVRYNGGWSNFDY

SEQ ID NO: 51751 - protein, 9 aa, Homo sapiens
  light chain complementarity determining region 3 for antibody 25876
QQYYRIPPT

SEQ ID NO: 51752 - protein, 17 aa, Homo sapiens
  heavy chain complementarity determining region 3 for antibody 25876
ANAQRGSAPSTTFYFDS

SEQ ID NO: 51753 - protein, 9 aa, Homo sapiens
  light chain complementarity determining region 3 for antibody 25877
QQYYNIPVT

SEQ ID NO: 51754 - protein, 18 aa, Homo sapiens
  heavy chain complementarity determining region 3 for antibody 25877
ARDLGGCGGNFCSYYFDI

SEQ ID NO: 51755 - protein, 9 aa, Homo sapiens
  light chain complementarity determining region 3 for antibody 25878
QQYTTYPPT

SEQ ID NO: 51756 - protein, 15 aa, Homo sapiens
  heavy chain complementarity determining region 3 for antibody 25878
AKDYGDYVIYWYLDV

SEQ ID NO: 51757 - protein, 9 aa, Homo sapiens
  light chain complementarity determining region 3 for antibody 25879
QQYSSSPQT

SEQ ID NO: 51758 - protein, 20 aa, Homo sapiens
  heavy chain complementarity determining region 3 for antibody 25879
ATLKAKYSSAWHAKLGWFDP

SEQ ID NO: 51759 - protein, 8 aa, Homo sapiens
  light chain complementarity determining region 3 for antibody 25880
QQYNTYWT

SEQ ID NO: 51760 - protein, 17 aa, Homo sapiens
  heavy chain complementarity determining region 3 for antibody 25880
TRGVRRDGHNSKVQIDY

SEQ ID NO: 51761 - protein, 9 aa, Homo sapiens
  light chain complementarity determining region 3 for antibody 25881
QQYNSYPLK

SEQ ID NO: 51762 - protein, 16 aa, Homo sapiens
  heavy chain complementarity determining region 3 for antibody 25881
ARDGSRQQLVNWYFDL

SEQ ID NO: 51763 - protein, 10 aa, Homo sapiens
  light chain complementarity determining region 3 for antibody 25882
QQYNSWPPLT

SEQ ID NO: 51764 - protein, 14 aa, Homo sapiens
  heavy chain complementarity determining region 3 for antibody 25882
AKRVAVAGIWYFDN

SEQ ID NO: 51765 - protein, 9 aa, Homo sapiens
  light chain complementarity determining region 3 for antibody 25883
QQYNRYPYT

SEQ ID NO: 51766 - protein, 11 aa, Homo sapiens
  heavy chain complementarity determining region 3 for antibody 25883
ARQPRGNAIST

SEQ ID NO: 51767 - protein, 10 aa, Homo sapiens [sequence omitted]

SEQ ID NO: 51768 - protein, 10 aa, Homo sapiens
  heavy chain complementarity determining region 3 for antibody 25884
ARRAMGEFDF

SEQ ID NO: 51769 - protein, 10 aa, Homo sapiens
  light chain complementarity determining region 3 for antibody 25885
QQYNNWPPLT

SEQ ID NO: 51770 - protein, 6 aa, Homo sapiens
  heavy chain complementarity determining region 3 for antibody 25885
VFGGSN

SEQ ID NO: 51771 - protein, 9 aa, Homo sapiens
  light chain complementarity determining region 3 for antibody 25886
QQYNASSWT

SEQ ID NO: 51772 - protein, 16 aa, Homo sapiens
  heavy chain complementarity determining region 3 for antibody 25886
ASLGGAHYYGSGSHYF

SEQ ID NO: 51773 - protein, 8 aa, Homo sapiens
  light chain complementarity determining region 3 for antibody 25887
QQYMSPFT

SEQ ID NO: 51774 - protein, 12 aa, Homo sapiens
  heavy chain complementarity determining region 3 for antibody 25887
ARALSASWYAYY

SEQ ID NO: 51775 - protein, 9 aa, Homo sapiens
  light chain complementarity determining region 3 for antibody 25888
QQYHSYPLT

SEQ ID NO: 51776 - protein, 15 aa, Homo sapiens
  heavy chain complementarity determining region 3 for antibody 25888
ARRASRVRYHWNFDL

SEQ ID NO: 51777 - protein, 9 aa, Homo sapiens
  light chain complementarity determining region 3 for antibody 25889
QQYHSPPWT

SEQ ID NO: 51778 - protein, 11 aa, Homo sapiens
  heavy chain complementarity determining region 3 for antibody 25889
TRGLDDAKTGY

SEQ ID NO: 51779 - protein, 8 aa, Homo sapiens
  light chain complementarity determining region 3 for antibody 25890
QQYGTSGT

SEQ ID NO: 51780 - protein, 19 aa, Homo sapiens
  heavy chain complementarity determining region 3 for antibody 25890
ARSHGAYYSASGTSAYFDY

SEQ ID NO: 51781 - protein, 9 aa, Homo sapiens
  light chain complementarity determining region 3 for antibody 25891
QQYGTPPRT

SEQ ID NO: 51782 - protein, 25 aa, Homo sapiens
  heavy chain complementarity determining region 3 for antibody 25891
ASLRVDRLRLPGAMRGPLYDRGLNV

SEQ ID NO: 51783 - protein, 10 aa, Homo sapiens
  light chain complementarity determining region 3 for antibody 25892
QQYGSSVTLT

SEQ ID NO: 51784 - protein, 18 aa, Homo sapiens
  heavy chain complementarity determining region 3 for antibody 25892
AGGRCSSFSCYVLYAFDL

SEQ ID NO: 51785 - protein, 10 aa, Homo sapiens
  light chain complementarity determining region 3 for antibody 25893
QQYGSSQVLT

SEQ ID NO: 51786 - protein, 13 aa, Homo sapiens
  heavy chain complementarity determining region 3 for antibody 25893
ARGRGYGDTVLGY

SEQ ID NO: 51787 - protein, 11 aa, Homo sapiens
  light chain complementarity determining region 3 for antibody 25894
QQYGSSPSMYT

SEQ ID NO: 51788 - protein, 15 aa, Homo sapiens
  heavy chain complementarity determining region 3 for antibody 25894
AKTVSPFSVAAPLDY

SEQ ID NO: 51789 - protein, 9 aa, Homo sapiens
  light chain complementarity determining region 3 for antibody 25895
QQYGSSPRT

SEQ ID NO: 51790 - protein, 25 aa, Homo sapiens
  heavy chain complementarity determining region 3 for antibody 25895
ARLRIDRLRLPGAMRGPLYDCGLDV

SEQ ID NO: 51791 - protein, 9 aa, Homo sapiens
  light chain complementarity determining region 3 for antibody 25896
QQYGSSPRT

SEQ ID NO: 51792 - protein, 25 aa, Homo sapiens
  heavy chain complementarity determining region 3 for antibody 25896
ARLRIARLRLPGAMRGPLYDCGLNV

SEQ ID NO: 51793 - protein, 10 aa, Homo sapiens
  light chain complementarity determining region 3 for antibody 25897
QQYGSSPMFS

SEQ ID NO: 51794 - protein, 11 aa, Homo sapiens
  heavy chain complementarity determining region 3 for antibody 25897
ARGGQWGSLDY

SEQ ID NO: 51795 - protein, 9 aa, Homo sapiens
  light chain complementarity determining region 3 for antibody 25898
QQYGSSLWT

SEQ ID NO: 51796 - protein, 10 aa, Homo sapiens
  heavy chain complementarity determining region 3 for antibody 25898
ARGRSSSVAY

SEQ ID NO: 51797 - protein, 8 aa, Homo sapiens
  light chain complementarity determining region 3 for antibody 25899
QQYGSSLT

SEQ ID NO: 51798 - protein, 16 aa, Homo sapiens
  heavy chain complementarity determining region 3 for antibody 25899
AKANSPYSSSWYYFDY

SEQ ID NO: 51799 - protein, 9 aa, Homo sapiens
  light chain complementarity determining region 3 for antibody 25900
QQYGSLPLT

SEQ ID NO: 51800 - protein, 15 aa, Homo sapiens
  heavy chain complementarity determining region 3 for antibody 25900
AHRPNYYDKAGALDI

SEQ ID NO: 51801 - protein, 9 aa, Homo sapiens
  light chain complementarity determining region 3 for antibody 25901
QQYGSLPIT

SEQ ID NO: 51802 - protein, 15 aa, Homo sapiens
  heavy chain complementarity determining region 3 for antibody 25901
AHRPNYYDKAGAFDI

SEQ ID NO: 51803 - protein, 9 aa, Homo sapiens
  light chain complementarity determining region 3 for antibody 25902
QQYGSFPYS

SEQ ID NO: 51804 - protein, 17 aa, Homo sapiens
  heavy chain complementarity determining region 3 for antibody 25902
AREAFDSDVADFHGLDV

SEQ ID NO: 51805 - protein, 9 aa, Homo sapiens
  light chain complementarity determining region 3 for antibody 25903
QQYGRSPPT

SEQ ID NO: 51806 - protein, 17 aa, Homo sapiens
  heavy chain complementarity determining region 3 for antibody 25903
ARPYFGPVRAGTNGYDM

SEQ ID NO: 51807 - protein, 11 aa, Homo sapiens
  light chain complementarity determining region 3 for antibody 25904
QQYGPSPPLYP

SEQ ID NO: 51808 - protein, 10 aa, Homo sapiens
  heavy chain complementarity determining region 3 for antibody 25904
ARNDVYRIDH

SEQ ID NO: 51809 - protein, 9 aa, Homo sapiens
  light chain complementarity determining region 3 for antibody 25905
QQYGNSPLT

SEQ ID NO: 51810 - protein, 13 aa, Homo sapiens
  heavy chain complementarity determining region 3 for antibody 25905
SSKTSVRTYSSDL

SEQ ID NO: 51811 - protein, 9 aa, Homo sapiens
  light chain complementarity determining region 3 for antibody 25906
QQYGNSPLP

SEQ ID NO: 51812 - protein, 13 aa, Homo sapiens
  heavy chain complementarity determining region 3 for antibody 25906
ASKTSVRTYSSDL

SEQ ID NO: 51813 - protein, 9 aa, Homo sapiens
  light chain complementarity determining region 3 for antibody 25907
QQYGNIPRT

SEQ ID NO: 51814 - protein, 13 aa, Homo sapiens
  heavy chain complementarity determining region 3 for antibody 25907
AGGLYDRSGYSEY

SEQ ID NO: 51815 - protein, 9 aa, Homo sapiens
  light chain complementarity determining region 3 for antibody 25908
QQYGGSSST

SEQ ID NO: 51816 - protein, 16 aa, Homo sapiens
  heavy chain complementarity determining region 3 for antibody 25908
ANWFGSVGDFLGPFDY

SEQ ID NO: 51817 - protein, 10 aa, Homo sapiens
  light chain complementarity determining region 3 for antibody 25909
QQYGDSPPGR

SEQ ID NO: 51818 - protein, 19 aa, Homo sapiens
  heavy chain complementarity determining region 3 for antibody 25909
ARQIWIAVAGTVRLAYFDY

SEQ ID NO: 51819 - protein, 9 aa, Homo sapiens
  light chain complementarity determining region 3 for antibody 25910
QQYFTSPFS

SEQ ID NO: 51820 - protein, 16 aa, Homo sapiens
  heavy chain complementarity determining region 3 for antibody 25910
TKDHGHSCGFYNYFDY

SEQ ID NO: 51821 - protein, 9 aa, Homo sapiens
  light chain complementarity determining region 3 for antibody 25911
QQYESSLWT

SEQ ID NO: 51822 - protein, 12 aa, Homo sapiens
  heavy chain complementarity determining region 3 for antibody 25911
ARDLGLYQEPDS

SEQ ID NO: 51823 - protein, 8 aa, Homo sapiens
  light chain complementarity determining region 3 for antibody 25912
QQYEGNWT

SEQ ID NO: 51824 - protein, 11 aa, Homo sapiens
  heavy chain complementarity determining region 3 for antibody 25912
ARDGRSWGGHR

SEQ ID NO: 51825 - protein, 11 aa, Homo sapiens
  light chain complementarity determining region 3 for antibody 25913
QQYDSSPPMYT

SEQ ID NO: 51826 - protein, 23 aa, Homo sapiens
  heavy chain complementarity determining region 3 for antibody 25913
ARAHRGYRRSNSRVDYYNFGMDV

SEQ ID NO: 51827 - protein, 9 aa, Homo sapiens
  light chain complementarity determining region 3 for antibody 25914
QQYDNPLVT

SEQ ID NO: 51828 - protein, 18 aa, Homo sapiens
  heavy chain complementarity determining region 3 for antibody 25914
ARDRPYDYVWGSYRSFDS

SEQ ID NO: 51829 - protein, 9 aa, Homo sapiens
  light chain complementarity determining region 3 for antibody 25915
QQYDNLPIT

SEQ ID NO: 51830 - protein, 17 aa, Homo sapiens
  heavy chain complementarity determining region 3 for antibody 25915
AKDSPSSIAVAGGNFDY

SEQ ID NO: 51831 - protein, 10 aa, Homo sapiens
  light chain complementarity determining region 3 for antibody 25916
QQTYSTPLYT

SEQ ID NO: 51832 - protein, 22 aa, Homo sapiens
  heavy chain complementarity determining region 3 for antibody 25916
ARIHRFNRDSSGYSPLGDWFDP

SEQ ID NO: 51833 - protein, 9 aa, Homo sapiens
  light chain complementarity determining region 3 for antibody 25917
QQTYSLPWT

SEQ ID NO: 51834 - protein, 21 aa, Homo sapiens
  heavy chain complementarity determining region 3 for antibody 25917
ARGGTRMSMVRGVINPPKFDY

SEQ ID NO: 51835 - protein, 9 aa, Homo sapiens
  light chain complementarity determining region 3 for antibody 25918
QQTYSGHPT

SEQ ID NO: 51836 - protein, 16 aa, Homo sapiens
  heavy chain complementarity determining region 3 for antibody 25918
TRDHLLHNTASGIFVY

SEQ ID NO: 51837 - protein, 9 aa, Homo sapiens
  light chain complementarity determining region 3 for antibody 25919
QQSYSYSWT

SEQ ID NO: 51838 - protein, 16 aa, Homo sapiens
  heavy chain complementarity determining region 3 for antibody 25919
ARDRDSSSWYRDAFDI

SEQ ID NO: 51839 - protein, 9 aa, Homo sapiens
  light chain complementarity determining region 3 for antibody 25920
QQSYSTPYT

SEQ ID NO: 51840 - protein, 17 aa, Homo sapiens
  heavy chain complementarity determining region 3 for antibody 25920
ASGVLGFGELLSLWFDP

SEQ ID NO: 51841 - protein, 9 aa, Homo sapiens
  light chain complementarity determining region 3 for antibody 25921
QQSYSTPWT

SEQ ID NO: 51842 - protein, 12 aa, Homo sapiens
  heavy chain complementarity determining region 3 for antibody 25921
ARVQTGDQGFDY

SEQ ID NO: 51843 - protein, 10 aa, Homo sapiens
  light chain complementarity determining region 3 for antibody 25922
QQSYSTPLLT

SEQ ID NO: 51844 - protein, 20 aa, Homo sapiens
  heavy chain complementarity determining region 3 for antibody 25922
AKAHTPYSNFPPNFYYSLDV

SEQ ID NO: 51845 - protein, 9 aa, Homo sapiens
  light chain complementarity determining region 3 for antibody 25923
QQSYSTAKT

SEQ ID NO: 51846 - protein, 20 aa, Homo sapiens
  heavy chain complementarity determining region 3 for antibody 25923
TTERFYYDDTGNYRESAFDL

SEQ ID NO: 51847 - protein, 9 aa, Homo sapiens
  light chain complementarity determining region 3 for antibody 25924
QQSNRTPNT

SEQ ID NO: 51848 - protein, 14 aa, Homo sapiens
  heavy chain complementarity determining region 3 for antibody 25924
ATEGPSRMGKFFDS

SEQ ID NO: 51849 - protein, 9 aa, Homo sapiens
  light chain complementarity determining region 3 for antibody 25925
QQSHSQPPT

SEQ ID NO: 51850 - protein, 17 aa, Homo sapiens
  heavy chain complementarity determining region 3 for antibody 25925
ATDRHNWNYGPKGLFDR

SEQ ID NO: 51851 - protein, 11 aa, Homo sapiens
  light chain complementarity determining region 3 for antibody 25926
QQRTSWPPQYT

SEQ ID NO: 51852 - protein, 14 aa, Homo sapiens
  heavy chain complementarity determining region 3 for antibody 25926
ARTVLDTAADAFDF

SEQ ID NO: 51853 - protein, 11 aa, Homo sapiens
  light chain complementarity determining region 3 for antibody 25927
QQRTSWPPKYP

SEQ ID NO: 51854 - protein, 14 aa, Homo sapiens
  heavy chain complementarity determining region 3 for antibody 25927
ARTVLDTAADAFDF

SEQ ID NO: 51855 - protein, 11 aa, Homo sapiens
  light chain complementarity determining region 3 for antibody 25928
QQRTSWPPKDT

SEQ ID NO: 51856 - protein, 14 aa, Homo sapiens
  heavy chain complementarity determining region 3 for antibody 25928
ARTVLDTAADAFDF

SEQ ID NO: 51857 - protein, 9 aa, Homo sapiens
  light chain complementarity determining region 3 for antibody 25929
QQRSVWPFT

SEQ ID NO: 51858 - protein, 13 aa, Homo sapiens
  heavy chain complementarity determining region 3 for antibody 25929
ARDWDSTVTTRDY

SEQ ID NO: 51859 - protein, 10 aa, Homo sapiens
  light chain complementarity determining region 3 for antibody 25930
QQRSNWPRYT

SEQ ID NO: 51860 - protein, 14 aa, Homo sapiens
  heavy chain complementarity determining region 3 for antibody 25930
ARRVVRGIIHYFDP

SEQ ID NO: 51861 - protein, 11 aa, Homo sapiens
  light chain complementarity determining region 3 for antibody 25931
QQRSNWPPRVT

SEQ ID NO: 51862 - protein, 22 aa, Homo sapiens
  heavy chain complementarity determining region 3 for antibody 25931
TTDPSTQILGFLEWEYHYGTDV

SEQ ID NO: 51863 - protein, 10 aa, Homo sapiens
  light chain complementarity determining region 3 for antibody 25932
QQRSNWPPIT

SEQ ID NO: 51864 - protein, 15 aa, Homo sapiens
  heavy chain complementarity determining region 3 for antibody 25932
VKVKNYYDNNGFFDF

SEQ ID NO: 51865 - protein, 10 aa, Homo sapiens
  light chain complementarity determining region 3 for antibody 25933
QQRSNWPPIT

SEQ ID NO: 51866 - protein, 17 aa, Homo sapiens
  heavy chain complementarity determining region 3 for antibody 25933
AAGYHSGSLSADDVFDI

SEQ ID NO: 51867 - protein, 11 aa, Homo sapiens
  light chain complementarity determining region 3 for antibody 25934
QQRSNWPPAPT

SEQ ID NO: 51868 - protein, 14 aa, Homo sapiens
  heavy chain complementarity determining region 3 for antibody 25934
AREGTAMVKDAFEI

SEQ ID NO: 51869 - protein, 11 aa, Homo sapiens
  light chain complementarity determining region 3 for antibody 25935
QQRSNWPPALP

SEQ ID NO: 51870 - protein, 14 aa, Homo sapiens
  heavy chain complementarity determining region 3 for antibody 25935
AREGTAMVKDAFEI

SEQ ID NO: 51871 - protein, 9 aa, Homo sapiens
  light chain complementarity determining region 3 for antibody 25936
QQRSHWLWT

SEQ ID NO: 51872 - protein, 12 aa, Homo sapiens
  heavy chain complementarity determining region 3 for antibody 25936
ARVTPLVRAIDS

SEQ ID NO: 51873 - protein, 9 aa, Homo sapiens
  light chain complementarity determining region 3 for antibody 25937
QQNGNLPRT

SEQ ID NO: 51874 - protein, 13 aa, Homo sapiens
  heavy chain complementarity determining region 3 for antibody 25937
AGGNFHSGGYGEY

SEQ ID NO: 51875 - protein, 9 aa, Homo sapiens
  light chain complementarity determining region 3 for antibody 25938
QQNDNLPLT

SEQ ID NO: 51876 - protein, 16 aa, Homo sapiens
  heavy chain complementarity determining region 3 for antibody 25938
ARGGHASAGIAWYFDF

SEQ ID NO: 51877 - protein, 11 aa, Homo sapiens
  light chain complementarity determining region 3 for antibody 25939
QQLKDYPRELT

SEQ ID NO: 51878 - protein, 14 aa, Homo sapiens
  heavy chain complementarity determining region 3 for antibody 25939
ARDLFGGGPGAFDS

SEQ ID NO: 51879 - protein, 9 aa, Homo sapiens
  light chain complementarity determining region 3 for antibody 25940
QQHNTWPST

SEQ ID NO: 51880 - protein, 14 aa, Homo sapiens
  heavy chain complementarity determining region 3 for antibody 25940
VSDLLTMTTVTTNY

SEQ ID NO: 51881 - protein, 9 aa, Homo sapiens
  light chain complementarity determining region 3 for antibody 25941
QQGYSTPLI

SEQ ID NO: 51882 - protein, 15 aa, Homo sapiens
  heavy chain complementarity determining region 3 for antibody 25941
VRAQDIWGQLYYFDY

SEQ ID NO: 51883 - protein, 9 aa, Homo sapiens
  light chain complementarity determining region 3 for antibody 25942
QQGYIPPIT

SEQ ID NO: 51884 - protein, 16 aa, Homo sapiens
  heavy chain complementarity determining region 3 for antibody 25942
ARGSVSSSGWYGYYQY

SEQ ID NO: 51885 - protein, 9 aa, Homo sapiens
  light chain complementarity determining region 3 for antibody 25943
QQGHRFPLT

SEQ ID NO: 51886 - protein, 12 aa, Homo sapiens
  heavy chain complementarity determining region 3 for antibody 25943
AGSSCDDCAFDI

SEQ ID NO: 51887 - protein, 9 aa, Homo sapiens
  light chain complementarity determining region 3 for antibody 25944
QQFYSTPLT

SEQ ID NO: 51888 - protein, 16 aa, Homo sapiens
  heavy chain complementarity determining region 3 for antibody 25944
AGLALTGVGGRGWIDA

SEQ ID NO: 51889 - protein, 9 aa, Homo sapiens
  light chain complementarity determining region 3 for antibody 25945
QQFHTTPLT

SEQ ID NO: 51890 - protein, 15 aa, Homo sapiens
  heavy chain complementarity determining region 3 for antibody 25945
ARDRTASTSHDGFDL

SEQ ID NO: 51891 - protein, 10 aa, Homo sapiens
  light chain complementarity determining region 3 for antibody 25946
QQFGSSPLFT

SEQ ID NO: 51892 - protein, 22 aa, Homo sapiens
  heavy chain complementarity determining region 3 for antibody 25946
TTGFQYSVSGSSIYFYYYAMAV

SEQ ID NO: 51893 - protein, 9 aa, Homo sapiens
  light chain complementarity determining region 3 for antibody 25947
QQDGSSPTT

SEQ ID NO: 51894 - protein, 17 aa, Homo sapiens
  heavy chain complementarity determining region 3 for antibody 25947
ARLGGSGWNRGHNWFDP

SEQ ID NO: 51895 - protein, 9 aa, Homo sapiens
  light chain complementarity determining region 3 for antibody 25948
QQDGSSPRT

SEQ ID NO: 51896 - protein, 15 aa, Homo sapiens
  heavy chain complementarity determining region 3 for antibody 25948
ARANGVIITTGVLRY

SEQ ID NO: 51897 - protein, 9 aa, Homo sapiens
  light chain complementarity determining region 3 for antibody 25949
QQDDSSSYT

SEQ ID NO: 51898 - protein, 11 aa, Homo sapiens
  heavy chain complementarity determining region 3 for antibody 25949
ARGGFYGSFDF

SEQ ID NO: 51899 - protein, 9 aa, Homo sapiens
  light chain complementarity determining region 3 for antibody 25950
QQANSFPPT

SEQ ID NO: 51900 - protein, 14 aa, Homo sapiens
  heavy chain complementarity determining region 3 for antibody 25950
ARDQRGYSPDVFDM

SEQ ID NO: 51901 - protein, 10 aa, Homo sapiens
  light chain complementarity determining region 3 for antibody 25951
QKYNSAPLTT

SEQ ID NO: 51902 - protein, 20 aa, Homo sapiens
  heavy chain complementarity determining region 3 for antibody 25951
ARGTVTPSDDFTSPELVFDY

SEQ ID NO: 51903 - protein, 9 aa, Homo sapiens
  light chain complementarity determining region 3 for antibody 25952
QHYNSYPLT

SEQ ID NO: 51904 - protein, 15 aa, Homo sapiens
  heavy chain complementarity determining region 3 for antibody 25952
ARDGGITGAANWFDP

SEQ ID NO: 51905 - protein, 8 aa, Homo sapiens
  light chain complementarity determining region 3 for antibody 25953
QHYHNSSS

SEQ ID NO: 51906 - protein, 14 aa, Homo sapiens
  heavy chain complementarity determining region 3 for antibody 25953
ARPRNSFWLYYFDY

SEQ ID NO: 51907 - protein, 9 aa, Homo sapiens
  light chain complementarity determining region 3 for antibody 25954
QHYGSSSYT

SEQ ID NO: 51908 - protein, 19 aa, Homo sapiens
  heavy chain complementarity determining region 3 for antibody 25954
ARDMTSRFTLNWGSGYFDL

SEQ ID NO: 51909 - protein, 9 aa, Homo sapiens
  light chain complementarity determining region 3 for antibody 25955
QHRSYWPGT

SEQ ID NO: 51910 - protein, 17 aa, Homo sapiens
  heavy chain complementarity determining region 3 for antibody 25955
GREYYDARSGSGNWFDP

SEQ ID NO: 51911 - protein, 11 aa, Homo sapiens
  light chain complementarity determining region 3 for antibody 25956
QHHYISPPAYT

SEQ ID NO: 51912 - protein, 12 aa, Homo sapiens
  heavy chain complementarity determining region 3 for antibody 25956
ARGTTKFGELDN

SEQ ID NO: 51913 - protein, 8 aa, Homo sapiens
  light chain complementarity determining region 3 for antibody 25957
QEYNNYWT

SEQ ID NO: 51914 - protein, 18 aa, Homo sapiens
  heavy chain complementarity determining region 3 for antibody 25957
ARSPYGDYPYMYLGYFDV

SEQ ID NO: 51915 - protein, 9 aa, Homo sapiens
  light chain complementarity determining region 3 for antibody 25958
QEYHSHPLT

SEQ ID NO: 51916 - protein, 6 aa, Homo sapiens
  heavy chain complementarity determining region 3 for antibody 25958
VRKEAA

SEQ ID NO: 51917 - protein, 9 aa, Homo sapiens
  light chain complementarity determining region 3 for antibody 25959
PQYYTTPRT

SEQ ID NO: 51918 - protein, 8 aa, Homo sapiens
  heavy chain complementarity determining region 3 for antibody 25959
ARDGAFDS

SEQ ID NO: 51919 - protein, 9 aa, Homo sapiens
  light chain complementarity determining region 3 for antibody 25960
PQYYTSVRT

SEQ ID NO: 51920 - protein, 12 aa, Homo sapiens
  heavy chain complementarity determining region 3 for antibody 25960
VKDCGLGGSRDF

SEQ ID NO: 51921 - protein, 9 aa, Homo sapiens
  light chain complementarity determining region 3 for antibody 25961
MQVLQSPWS

SEQ ID NO: 51922 - protein, 12 aa, Homo sapiens
  heavy chain complementarity determining region 3 for antibody 25961
TRDPDSHYGMEV

SEQ ID NO: 51923 - protein, 9 aa, Homo sapiens
  light chain complementarity determining region 3 for antibody 25962
MQSTHWPYT

SEQ ID NO: 51924 - protein, 12 aa, Homo sapiens
  heavy chain complementarity determining region 3 for antibody 25962
ARDKSNHNPLVY

SEQ ID NO: 51925 - protein, 9 aa, Homo sapiens
  light chain complementarity determining region 3 for antibody 25963
MQRRRWPHT

SEQ ID NO: 51926 - protein, 8 aa, Homo sapiens
  heavy chain complementarity determining region 3 for antibody 25963
TAWGSSHH

SEQ ID NO: 51927 - protein, 10 aa, Homo sapiens
  light chain complementarity determining region 3 for antibody 25964
MQGTHWPLGT

SEQ ID NO: 51928 - protein, 12 aa, Homo sapiens
  heavy chain complementarity determining region 3 for antibody 25964
TTGLNWGWEPDY

SEQ ID NO: 51929 - protein, 9 aa, Homo sapiens
  light chain complementarity determining region 3 for antibody 25965
MQGTHWPLG

SEQ ID NO: 51930 - protein, 18 aa, Homo sapiens
  heavy chain complementarity determining region 3 for antibody 25965
ARDERDTCRNGLCYYFDY

SEQ ID NO: 51931 - protein, 9 aa, Homo sapiens
  light chain complementarity determining region 3 for antibody 25966
MQGTHWLGT

SEQ ID NO: 51932 - protein, 21 aa, Homo sapiens
  heavy chain complementarity determining region 3 for antibody 25966
ARDDKGYCSSSSCYRDDAFDM

SEQ ID NO: 51933 - protein, 9 aa, Homo sapiens
  light chain complementarity determining region 3 for antibody 25967
MQGTHGPRT

SEQ ID NO: 51934 - protein, 12 aa, Homo sapiens
  heavy chain complementarity determining region 3 for antibody 25967
ATLSMANAKFDH

SEQ ID NO: 51935 - protein, 9 aa, Homo sapiens
  light chain complementarity determining region 3 for antibody 25968
MQGPQGPWT

SEQ ID NO: 51936 - protein, 7 aa, Homo sapiens
  heavy chain complementarity determining region 3 for antibody 25968
STDFLDL

SEQ ID NO: 51937 - protein, 8 aa, Homo sapiens
  light chain complementarity determining region 3 for antibody 25969
MQALQTPP

SEQ ID NO: 51938 - protein, 15 aa, Homo sapiens
  heavy chain complementarity determining region 3 for antibody 25969
ARRDYYDSSGYRLDY

SEQ ID NO: 51939 - protein, 9 aa, Homo sapiens
  light chain complementarity determining region 3 for antibody 25970
MQALQTPHA

SEQ ID NO: 51940 - protein, 21 aa, Homo sapiens
  heavy chain complementarity determining region 3 for antibody 25970
ARVMRRRFGELVSYDYYGMDV

SEQ ID NO: 51941 - protein, 9 aa, Homo sapiens
  light chain complementarity determining region 3 for antibody 25971
MQALEIPFT

SEQ ID NO: 51942 - protein, 15 aa, Homo sapiens
  heavy chain complementarity determining region 3 for antibody 25971
VRHYRETVAGIEGDS

SEQ ID NO: 51943 - protein, 9 aa, Homo sapiens
  light chain complementarity determining region 3 for antibody 25972
LQYYAPPWT

SEQ ID NO: 51944 - protein, 15 aa, Homo sapiens
  heavy chain complementarity determining region 3 for antibody 25972
VRQSKVDNNYNYPDF

SEQ ID NO: 51945 - protein, 9 aa, Homo sapiens
  light chain complementarity determining region 3 for antibody 25973
LQLNSYPIT

SEQ ID NO: 51946 - protein, 20 aa, Homo sapiens
  heavy chain complementarity determining region 3 for antibody 25973
ARRGAGLGLDNPESSGYADY

SEQ ID NO: 51947 - protein, 8 aa, Homo sapiens
  light chain complementarity determining region 3 for antibody 25974
HQYGSSVT

SEQ ID NO: 51948 - protein, 15 aa, Homo sapiens
  heavy chain complementarity determining region 3 for antibody 25974
ARGSIMGGIQTPLDH

SEQ ID NO: 51949 - protein, 9 aa, Homo sapiens
  light chain complementarity determining region 3 for antibody 25975
HQYGSSPRT

SEQ ID NO: 51950 - protein, 22 aa, Homo sapiens
  heavy chain complementarity determining region 3 for antibody 25975
ARNGHLHSCIGDNCYIHDAYDM

SEQ ID NO: 51951 - protein, 9 aa, Homo sapiens
  light chain complementarity determining region 3 for antibody 25976
HQYGSPPYT

SEQ ID NO: 51952 - protein, 18 aa, Homo sapiens
  heavy chain complementarity determining region 3 for antibody 25976
ARTGVWFGDFIVPDAFDI

SEQ ID NO: 51953 - protein, 9 aa, Homo sapiens
  light chain complementarity determining region 3 for antibody 25977
HQYGDSPRM

SEQ ID NO: 51954 - protein, 16 aa, Homo sapiens
  heavy chain complementarity determining region 3 for antibody 25977
AKSVGMDTMTTRVYDS

SEQ ID NO: 51955 - protein, 9 aa, Homo sapiens
  light chain complementarity determining region 3 for antibody 25978
VQYNRDPRT

SEQ ID NO: 51956 - protein, 6 aa, Homo sapiens
  heavy chain complementarity determining region 3 for antibody 25978
TRALDY

SEQ ID NO: 51957 - protein, 9 aa, Homo sapiens
  light chain complementarity determining region 3 for antibody 25979
VQDNRYPRT

SEQ ID NO: 51958 - protein, 6 aa, Homo sapiens
  heavy chain complementarity determining region 3 for antibody 25979
TRALDY

SEQ ID NO: 51959 - protein, 9 aa, Homo sapiens
  light chain complementarity determining region 3 for antibody 25980
QWYDDLLFG

SEQ ID NO: 51960 - protein, 11 aa, Homo sapiens
  heavy chain complementarity determining region 3 for antibody 25980
ARQARVGSFDI

SEQ ID NO: 51961 - protein, 10 aa, Homo sapiens
  light chain complementarity determining region 3 for antibody 25981
QRNHWPPALT

SEQ ID NO: 51962 - protein, 15 aa, Homo sapiens
  heavy chain complementarity determining region 3 for antibody 25981
VRDEADGDQAGILVY

SEQ ID NO: 51963 - protein, 9 aa, Homo sapiens
  light chain complementarity determining region 3 for antibody 25982
QQYYTSART

SEQ ID NO: 51964 - protein, 12 aa, Homo sapiens
  heavy chain complementarity determining region 3 for antibody 25982
VKDCGLGGSRDS

SEQ ID NO: 51965 - protein, 9 aa, Homo sapiens
  light chain complementarity determining region 3 for antibody 25983
QQYYTSART

SEQ ID NO: 51966 - protein, 12 aa, Homo sapiens
  heavy chain complementarity determining region 3 for antibody 25983
VKDCGLGGSRDF

SEQ ID NO: 51967 - protein, 9 aa, Homo sapiens
  light chain complementarity determining region 3 for antibody 25984
QQYYTHPLT

SEQ ID NO: 51968 - protein, 13 aa, Homo sapiens
  heavy chain complementarity determining region 3 for antibody 25984
AKDPSGNYGSWVH

SEQ ID NO: 51969 - protein, 9 aa, Homo sapiens
  light chain complementarity determining region 3 for antibody 25985
QQYYSYPQT

SEQ ID NO: 51970 - protein, 20 aa, Homo sapiens
  heavy chain complementarity determining region 3 for antibody 25985
ASRTYYFGSGSYYKEGYFDY

SEQ ID NO: 51971 - protein, 9 aa, Homo sapiens
  light chain complementarity determining region 3 for antibody 25986
QQYYSYPFT

SEQ ID NO: 51972 - protein, 15 aa, Homo sapiens
  heavy chain complementarity determining region 3 for antibody 25986
VRHYRETVAGIEGDS

SEQ ID NO: 51973 - protein, 9 aa, Homo sapiens
  light chain complementarity determining region 3 for antibody 25987
QQYYSTPGT

SEQ ID NO: 51974 - protein, 10 aa, Homo sapiens
  heavy chain complementarity determining region 3 for antibody 25987
STPSRVGAKF

SEQ ID NO: 51975 - protein, 8 aa, Homo sapiens
  light chain complementarity determining region 3 for antibody 25988
QQYYRYST

SEQ ID NO: 51976 - protein, 16 aa, Homo sapiens
  heavy chain complementarity determining region 3 for antibody 25988
SRQRLGEPGTGFLSDF

SEQ ID NO: 51977 - protein, 9 aa, Homo sapiens
  light chain complementarity determining region 3 for antibody 25989
QQYYRTPST

SEQ ID NO: 51978 - protein, 15 aa, Homo sapiens
  heavy chain complementarity determining region 3 for antibody 25989
ARVGVDPNYYYGLDV

SEQ ID NO: 51979 - protein, 8 aa, Homo sapiens
  light chain complementarity determining region 3 for antibody 25990
QQYYNVPS

SEQ ID NO: 51980 - protein, 15 aa, Homo sapiens
  heavy chain complementarity determining region 3 for antibody 25990
AKTRPFRGAALPSDF

SEQ ID NO: 51981 - protein, 9 aa, Homo sapiens
  light chain complementarity determining region 3 for antibody 25991
QQYTGYFPT

SEQ ID NO: 51982 - protein, 13 aa, Homo sapiens
  heavy chain complementarity determining region 3 for antibody 25991
ARHGHTGILWLDS

SEQ ID NO: 51983 - protein, 9 aa, Homo sapiens
  light chain complementarity determining region 3 for antibody 25992
QQYSRTPYA

SEQ ID NO: 51984 - protein, 15 aa, Homo sapiens
  heavy chain complementarity determining region 3 for antibody 25992
TRGEKWDLLSDASDI

SEQ ID NO: 51985 - protein, 9 aa, Homo sapiens
  light chain complementarity determining region 3 for antibody 25993
QQYQSYSRT

SEQ ID NO: 51986 - protein, 11 aa, Homo sapiens
  heavy chain complementarity determining region 3 for antibody 25993
ARDKGGGVYDY

SEQ ID NO: 51987 - protein, 9 aa, Homo sapiens
  light chain complementarity determining region 3 for antibody 25994
QQYNVYPLT

SEQ ID NO: 51988 - protein, 21 aa, Homo sapiens
  heavy chain complementarity determining region 3 for antibody 25994
ATEGGILRFLDRSQAAYPINW

SEQ ID NO: 51989 - protein, 9 aa, Homo sapiens
  light chain complementarity determining region 3 for antibody 25995
QQYNTSAWT

SEQ ID NO: 51990 - protein, 16 aa, Homo sapiens
  heavy chain complementarity determining region 3 for antibody 25995
ARGIPSRYSSSWAPDY

SEQ ID NO: 51991 - protein, 10 aa, Homo sapiens
  light chain complementarity determining region 3 for antibody 25996
QQYNSYSPLT

SEQ ID NO: 51992 - protein, 23 aa, Homo sapiens
  heavy chain complementarity determining region 3 for antibody 25996
VRASRGYRRSDSRMEFFFYGLDV

SEQ ID NO: 51993 - protein, 9 aa, Homo sapiens
  light chain complementarity determining region 3 for antibody 25997
QQYNSYSLT

SEQ ID NO: 51994 - protein, 15 aa, Homo sapiens
  heavy chain complementarity determining region 3 for antibody 25997
AKAPGGSSWSYYFDY

SEQ ID NO: 51995 - protein, 9 aa, Homo sapiens
  light chain complementarity determining region 3 for antibody 25998
QQYNSYSET

SEQ ID NO: 51996 - protein, 17 aa, Homo sapiens
  heavy chain complementarity determining region 3 for antibody 25998
ARDFRRGPPFNYYFFDF

SEQ ID NO: 51997 - protein, 9 aa, Homo sapiens
  light chain complementarity determining region 3 for antibody 25999
QQYNSYPWT

SEQ ID NO: 51998 - protein, 19 aa, Homo sapiens
  heavy chain complementarity determining region 3 for antibody 25999
AREVPYYDSSGHRMGAFDI

SEQ ID NO: 51999 - protein, 8 aa, Homo sapiens
  light chain complementarity determining region 3 for antibody 26000
QQYNSLYT

SEQ ID NO: 52000 - protein, 6 aa, Homo sapiens
  heavy chain complementarity determining region 3 for antibody 26000
ASVFEF

SEQ ID NO: 52001 - protein, 10 aa, Homo sapiens
  light chain complementarity determining region 3 for antibody 26001
QQYNNWPRYT

SEQ ID NO: 52002 - protein, 16 aa, Homo sapiens
  heavy chain complementarity determining region 3 for antibody 26001
AGLSASGHLAPNTFDV

SEQ ID NO: 52003 - protein, 9 aa, Homo sapiens
  light chain complementarity determining region 3 for antibody 26002
QQYNNWPQT

SEQ ID NO: 52004 - protein, 12 aa, Homo sapiens
  heavy chain complementarity determining region 3 for antibody 26002
ARPFDDYGENDY

SEQ ID NO: 52005 - protein, 11 aa, Homo sapiens
  light chain complementarity determining region 3 for antibody 26003
QQYNNWPPRAT

SEQ ID NO: 52006 - protein, 13 aa, Homo sapiens
  heavy chain complementarity determining region 3 for antibody 26003
AIQSSSQDYYFPF

SEQ ID NO: 52007 - protein, 10 aa, Homo sapiens
  light chain complementarity determining region 3 for antibody 26004
QQYNNWPHWT

SEQ ID NO: 52008 - protein, 14 aa, Homo sapiens
  heavy chain complementarity determining region 3 for antibody 26004
ARTSSSSWYTNLQH

SEQ ID NO: 52009 - protein, 10 aa, Homo sapiens
  light chain complementarity determining region 3 for antibody 26005
QQYNNWLPYT

SEQ ID NO: 52010 - protein, 13 aa, Homo sapiens
  heavy chain complementarity determining region 3 for antibody 26005
ARLGPSVAAIIGY

SEQ ID NO: 52011 - protein, 10 aa, Homo sapiens
  light chain complementarity determining region 3 for antibody 26006
QQYNDWPPYT

SEQ ID NO: 52012 - protein, 15 aa, Homo sapiens
  heavy chain complementarity determining region 3 for antibody 26006
ARYNLGSHLFDPFDH

SEQ ID NO: 52013 - protein, 10 aa, Homo sapiens
  light chain complementarity determining region 3 for antibody 26007
QQYKSWPPLT

SEQ ID NO: 52014 - protein, 13 aa, Homo sapiens
  heavy chain complementarity determining region 3 for antibody 26007
ASSGMPDFNWFAS

SEQ ID NO: 52015 - protein, 9 aa, Homo sapiens
  light chain complementarity determining region 3 for antibody 26008
QQYHSYPYT

SEQ ID NO: 52016 - protein, 17 aa, Homo sapiens
  heavy chain complementarity determining region 3 for antibody 26008
ARLSRTGYSSSWYYRDY

SEQ ID NO: 52017 - protein, 10 aa, Homo sapiens
  light chain complementarity determining region 3 for antibody 26009
QQYHHWPPYT

SEQ ID NO: 52018 - protein, 13 aa, Homo sapiens
  heavy chain complementarity determining region 3 for antibody 26009
AGGRSPHLWFFGV

SEQ ID NO: 52019 - protein, 12 aa, Homo sapiens
  light chain complementarity determining region 3 for antibody 26010
QQYGTSVPWPGT

SEQ ID NO: 52020 - protein, 14 aa, Homo sapiens
  heavy chain complementarity determining region 3 for antibody 26010
VRGGSSGYNHQVDY

SEQ ID NO: 52021 - protein, 9 aa, Homo sapiens
  light chain complementarity determining region 3 for antibody 26011
QQYGTSPLT

SEQ ID NO: 52022 - protein, 13 aa, Homo sapiens
  heavy chain complementarity determining region 3 for antibody 26011
ASKTSVRTYSSDL

SEQ ID NO: 52023 - protein, 8 aa, Homo sapiens
  light chain complementarity determining region 3 for antibody 26012
QQYGSWYT

SEQ ID NO: 52024 - protein, 12 aa, Homo sapiens
  heavy chain complementarity determining region 3 for antibody 26012
VKDCGLGGPRDY

SEQ ID NO: 52025 - protein, 9 aa, Homo sapiens
  light chain complementarity determining region 3 for antibody 26013
QQYGSSSYT

SEQ ID NO: 52026 - protein, 11 aa, Homo sapiens
  heavy chain complementarity determining region 3 for antibody 26013
ADTMILGAFNI

SEQ ID NO: 52027 - protein, 9 aa, Homo sapiens
  light chain complementarity determining region 3 for antibody 26014
QQYGSSPYT

SEQ ID NO: 52028 - protein, 9 aa, Homo sapiens
  heavy chain complementarity determining region 3 for antibody 26014
IYEINAFDI

SEQ ID NO: 52029 - protein, 9 aa, Homo sapiens
  light chain complementarity determining region 3 for antibody 26015
QQYGSSPRT

SEQ ID NO: 52030 - protein, 25 aa, Homo sapiens
  heavy chain complementarity determining region 3 for antibody 26015
ARLRIDRLRLPGATRGPLYDCGLNV

SEQ ID NO: 52031 - protein, 10 aa, Homo sapiens
  light chain complementarity determining region 3 for antibody 26016
QQYGSSPRLT

SEQ ID NO: 52032 - protein, 18 aa, Homo sapiens
  heavy chain complementarity determining region 3 for antibody 26016
ARDVYCSDGVCQPRPFDM

SEQ ID NO: 52033 - protein, 10 aa, Homo sapiens
  light chain complementarity determining region 3 for antibody 26017
QQYGSSPPIT

SEQ ID NO: 52034 - protein, 17 aa, Homo sapiens
  heavy chain complementarity determining region 3 for antibody 26017
AIVFNSGSYLSGNPFEI

SEQ ID NO: 52035 - protein, 10 aa, Homo sapiens
  light chain complementarity determining region 3 for antibody 26018
QQYGSSPMCT

SEQ ID NO: 52036 - protein, 13 aa, Homo sapiens
  heavy chain complementarity determining region 3 for antibody 26018
ARVYSSTGYYFDY

SEQ ID NO: 52037 - protein, 10 aa, Homo sapiens
  light chain complementarity determining region 3 for antibody 26019
QQYGSSPLYS

SEQ ID NO: 52038 - protein, 14 aa, Homo sapiens
  heavy chain complementarity determining region 3 for antibody 26019
ARPDPGPYGNSFGY

SEQ ID NO: 52039 - protein, 9 aa, Homo sapiens
  light chain complementarity determining region 3 for antibody 26020
QQYGSSPLT

SEQ ID NO: 52040 - protein, 25 aa, Homo sapiens
  heavy chain complementarity determining region 3 for antibody 26020
ARLRIDRLRLPGAMRGPLYDCGLNV

SEQ ID NO: 52041 - protein, 9 aa, Homo sapiens
  light chain complementarity determining region 3 for antibody 26021
QQYGSSPGT

SEQ ID NO: 52042 - protein, 21 aa, Homo sapiens
  heavy chain complementarity determining region 3 for antibody 26021
GSDYQRGPLVVVVGRNPHVDS

SEQ ID NO: 52043 - protein, 9 aa, Homo sapiens
  light chain complementarity determining region 3 for antibody 26022
QQYGSSPCT

SEQ ID NO: 52044 - protein, 16 aa, Homo sapiens
  heavy chain complementarity determining region 3 for antibody 26022
AKVGWLVGYDLSRGSA

SEQ ID NO: 52045 - protein, 10 aa, Homo sapiens
  light chain complementarity determining region 3 for antibody 26023
QQYGSSLGDT

SEQ ID NO: 52046 - protein, 13 aa, Homo sapiens
  heavy chain complementarity determining region 3 for antibody 26023
AHSGYQVYYGMDV

SEQ ID NO: 52047 - protein, 11 aa, Homo sapiens
  light chain complementarity determining region 3 for antibody 26024
QQYGSPVPGYS

SEQ ID NO: 52048 - protein, 16 aa, Homo sapiens
  heavy chain complementarity determining region 3 for antibody 26024
VKDQVAANGICDPFDI

SEQ ID NO: 52049 - protein, 9 aa, Homo sapiens
  light chain complementarity determining region 3 for antibody 26025
QQYGSLPRT

SEQ ID NO: 52050 - protein, 14 aa, Homo sapiens
  heavy chain complementarity determining region 3 for antibody 26025
AGGKFCGGDCYREY

SEQ ID NO: 52051 - protein, 9 aa, Homo sapiens
  light chain complementarity determining region 3 for antibody 26026
QQYGSKWWT

SEQ ID NO: 52052 - protein, 15 aa, Homo sapiens
  heavy chain complementarity determining region 3 for antibody 26026
ARHMARDSIGYYHDF

SEQ ID NO: 52053 - protein, 9 aa, Homo sapiens
  light chain complementarity determining region 3 for antibody 26027
QQYGNLPRK

SEQ ID NO: 52054 - protein, 13 aa, Homo sapiens
  heavy chain complementarity determining region 3 for antibody 26027
AGGNYETGRYEEY

SEQ ID NO: 52055 - protein, 9 aa, Homo sapiens
  light chain complementarity determining region 3 for antibody 26028
QQYGNLPRK

SEQ ID NO: 52056 - protein, 13 aa, Homo sapiens
  heavy chain complementarity determining region 3 for antibody 26028
AGGNFHSGGYGEY

SEQ ID NO: 52057 - protein, 9 aa, Homo sapiens
  light chain complementarity determining region 3 for antibody 26029
QQYGNIPRP

SEQ ID NO: 52058 - protein, 14 aa, Homo sapiens
  heavy chain complementarity determining region 3 for antibody 26029
AGGTFDSSGYYYEY

SEQ ID NO: 52059 - protein, 9 aa, Homo sapiens
  light chain complementarity determining region 3 for antibody 26030
QQYGLSPEP

SEQ ID NO: 52060 - protein, 15 aa, Homo sapiens
  heavy chain complementarity determining region 3 for antibody 26030
AFRGIQVVNGVRFDY

SEQ ID NO: 52061 - protein, 9 aa, Homo sapiens
  light chain complementarity determining region 3 for antibody 26031
QQYGKSPWT

SEQ ID NO: 52062 - protein, 11 aa, Homo sapiens
  heavy chain complementarity determining region 3 for antibody 26031
AREDWPDGFDI

SEQ ID NO: 52063 - protein, 10 aa, Homo sapiens
  light chain complementarity determining region 3 for antibody 26032
QQYGGSPPGT

SEQ ID NO: 52064 - protein, 14 aa, Homo sapiens
  heavy chain complementarity determining region 3 for antibody 26032
ARGGKSTYIPHFDY

SEQ ID NO: 52065 - protein, 10 aa, Homo sapiens
  light chain complementarity determining region 3 for antibody 26033
QQYGGSPGGT

SEQ ID NO: 52066 - protein, 14 aa, Homo sapiens
  heavy chain complementarity determining region 3 for antibody 26033
ARHGGWRLLEPLDY

SEQ ID NO: 52067 - protein, 6 aa, Homo sapiens
  light chain complementarity determining region 3 for antibody 26034
QQYGDT

SEQ ID NO: 52068 - protein, 12 aa, Homo sapiens
  heavy chain complementarity determining region 3 for antibody 26034
ARDHSSGWSLSN

SEQ ID NO: 52069 - protein, 9 aa, Homo sapiens
  light chain complementarity determining region 3 for antibody 26035
QQYGDSLRT

SEQ ID NO: 52070 - protein, 17 aa, Homo sapiens
  heavy chain complementarity determining region 3 for antibody 26035
AREGGYYYDNRGELLGY

SEQ ID NO: 52071 - protein, 9 aa, Homo sapiens
  light chain complementarity determining region 3 for antibody 26036
QQYFSAPWT

SEQ ID NO: 52072 - protein, 18 aa, Homo sapiens
  heavy chain complementarity determining region 3 for antibody 26036
ARGVGGYCNNGVCHYFDY

SEQ ID NO: 52073 - protein, 9 aa, Homo sapiens
  light chain complementarity determining region 3 for antibody 26037
QQYDTYPLT

SEQ ID NO: 52074 - protein, 19 aa, Homo sapiens
  heavy chain complementarity determining region 3 for antibody 26037
AKEAPNYYDSSSYAAFTDH

SEQ ID NO: 52075 - protein, 11 aa, Homo sapiens
  light chain complementarity determining region 3 for antibody 26038
QQYDTSPPGYT

SEQ ID NO: 52076 - protein, 14 aa, Homo sapiens
  heavy chain complementarity determining region 3 for antibody 26038
ARETSNSRKRSFDQ

SEQ ID NO: 52077 - protein, 10 aa, Homo sapiens
  light chain complementarity determining region 3 for antibody 26039
QQYDSLLRLT

SEQ ID NO: 52078 - protein, 11 aa, Homo sapiens
  heavy chain complementarity determining region 3 for antibody 26039
ALFGFAELKEF

SEQ ID NO: 52079 - protein, 9 aa, Homo sapiens
  light chain complementarity determining region 3 for antibody 26040
QQYDSHPWT

SEQ ID NO: 52080 - protein, 17 aa, Homo sapiens
  heavy chain complementarity determining region 3 for antibody 26040
ARNYYWFLAVAGYYFDS

SEQ ID NO: 52081 - protein, 9 aa, Homo sapiens
  light chain complementarity determining region 3 for antibody 26041
QQYDSFPLT

SEQ ID NO: 52082 - protein, 14 aa, Homo sapiens
  heavy chain complementarity determining region 3 for antibody 26041
ASHVYGDERNAFDL

SEQ ID NO: 52083 - protein, 9 aa, Homo sapiens
  light chain complementarity determining region 3 for antibody 26042
QQYDNLPLT

SEQ ID NO: 52084 - protein, 23 aa, Homo sapiens
  heavy chain complementarity determining region 3 for antibody 26042
ARDPWKNVLSFLEQKYYYNGVDV

SEQ ID NO: 52085 - protein, 10 aa, Homo sapiens
  light chain complementarity determining region 3 for antibody 26043
QQYDGSPPWT

SEQ ID NO: 52086 - protein, 16 aa, Homo sapiens
  heavy chain complementarity determining region 3 for antibody 26043
ATNFYSSSGQDRYFDL

SEQ ID NO: 52087 - protein, 9 aa, Homo sapiens
  light chain complementarity determining region 3 for antibody 26044
QQYDDLPVT

SEQ ID NO: 52088 - protein, 12 aa, Homo sapiens
  heavy chain complementarity determining region 3 for antibody 26044
ARNVASRNNYDS

SEQ ID NO: 52089 - protein, 9 aa, Homo sapiens
  light chain complementarity determining region 3 for antibody 26045
QQYARAPLT

SEQ ID NO: 52090 - protein, 13 aa, Homo sapiens
  heavy chain complementarity determining region 3 for antibody 26045
ATGDGPGSFRIDF

SEQ ID NO: 52091 - protein, 9 aa, Homo sapiens
  light chain complementarity determining region 3 for antibody 26046
QQVNDYPIT

SEQ ID NO: 52092 - protein, 16 aa, Homo sapiens
  heavy chain complementarity determining region 3 for antibody 26046
ARVVHKSLLTQPPNDY

SEQ ID NO: 52093 - protein, 10 aa, Homo sapiens
  light chain complementarity determining region 3 for antibody 26047
QQSYTTPIFT

SEQ ID NO: 52094 - protein, 17 aa, Homo sapiens
  heavy chain complementarity determining region 3 for antibody 26047
AVYTSTDGIFNKDAFDI

SEQ ID NO: 52095 - protein, 10 aa, Homo sapiens
  light chain complementarity determining region 3 for antibody 26048
QQSYSTPRST

SEQ ID NO: 52096 - protein, 12 aa, Homo sapiens
  heavy chain complementarity determining region 3 for antibody 26048
ARHGGRWLQFGW

SEQ ID NO: 52097 - protein, 9 aa, Homo sapiens
  light chain complementarity determining region 3 for antibody 26049
QQSYSTPPT

SEQ ID NO: 52098 - protein, 17 aa, Homo sapiens
  heavy chain complementarity determining region 3 for antibody 26049
ARVLGNTTLVSTWYFVL

SEQ ID NO: 52099 - protein, 9 aa, Homo sapiens
  light chain complementarity determining region 3 for antibody 26050
QQSYSPPPA

SEQ ID NO: 52100 - protein, 12 aa, Homo sapiens
  heavy chain complementarity determining region 3 for antibody 26050
AHLTGARRYFDY

SEQ ID NO: 52101 - protein, 10 aa, Homo sapiens
  light chain complementarity determining region 3 for antibody 26051
QQSYSKSSIT

SEQ ID NO: 52102 - protein, 21 aa, Homo sapiens
  heavy chain complementarity determining region 3 for antibody 26051
ARDRVNYYDSSGYYYDLYFDL

SEQ ID NO: 52103 - protein, 9 aa, Homo sapiens
  light chain complementarity determining region 3 for antibody 26052
QQSYRTALT

SEQ ID NO: 52104 - protein, 12 aa, Homo sapiens
  heavy chain complementarity determining region 3 for antibody 26052
ARYDDLVTSFEY

SEQ ID NO: 52105 - protein, 9 aa, Homo sapiens
  light chain complementarity determining region 3 for antibody 26053
QQSYRSVFT

SEQ ID NO: 52106 - protein, 15 aa, Homo sapiens
  heavy chain complementarity determining region 3 for antibody 26053
AFLPMVLVSSGHLEY

SEQ ID NO: 52107 - protein, 10 aa, Homo sapiens
  light chain complementarity determining region 3 for antibody 26054
QQSYFTPPLT

SEQ ID NO: 52108 - protein, 20 aa, Homo sapiens
  heavy chain complementarity determining region 3 for antibody 26054
ARNTGTSSWSPLSYYYGMDV

SEQ ID NO: 52109 - protein, 9 aa, Homo sapiens
  light chain complementarity determining region 3 for antibody 26055
QQSNKYPLT

SEQ ID NO: 52110 - protein, 21 aa, Homo sapiens
  heavy chain complementarity determining region 3 for antibody 26055
ARGRRRITVVRGVREQFWFDP

SEQ ID NO: 52111 - protein, 10 aa, Homo sapiens
  light chain complementarity determining region 3 for antibody 26056
QQSDSTLRFT

SEQ ID NO: 52112 - protein, 16 aa, Homo sapiens
  heavy chain complementarity determining region 3 for antibody 26056
AKVSTSWSVYYYGMDV

SEQ ID NO: 52113 - protein, 10 aa, Homo sapiens
  light chain complementarity determining region 3 for antibody 26057
QQRYNWPPYP

SEQ ID NO: 52114 - protein, 15 aa, Homo sapiens
  heavy chain complementarity determining region 3 for antibody 26057
AREGSGYPAATGFDI

SEQ ID NO: 52115 - protein, 11 aa, Homo sapiens
  light chain complementarity determining region 3 for antibody 26058
QQRTSWPPKNT

SEQ ID NO: 52116 - protein, 14 aa, Homo sapiens
  heavy chain complementarity determining region 3 for antibody 26058
ARTVLDTAADAFDF

SEQ ID NO: 52117 - protein, 10 aa, Homo sapiens
  light chain complementarity determining region 3 for antibody 26059
QQRTDRPPSP

SEQ ID NO: 52118 - protein, 15 aa, Homo sapiens
  heavy chain complementarity determining region 3 for antibody 26059
ARLMGDWELPRGTDY

SEQ ID NO: 52119 - protein, 8 aa, Homo sapiens
  light chain complementarity determining region 3 for antibody 26060
QQRSNWWT

SEQ ID NO: 52120 - protein, 12 aa, Homo sapiens
  heavy chain complementarity determining region 3 for antibody 26060
VKDCGLGGSRDS

SEQ ID NO: 52121 - protein, 10 aa, Homo sapiens
  light chain complementarity determining region 3 for antibody 26061
QQRSNWPPYT

SEQ ID NO: 52122 - protein, 19 aa, Homo sapiens
  heavy chain complementarity determining region 3 for antibody 26061
ARVPPSGTFSSKLGRWFDP

SEQ ID NO: 52123 - protein, 10 aa, Homo sapiens
  light chain complementarity determining region 3 for antibody 26062
QQRSNWPPIP

SEQ ID NO: 52124 - protein, 17 aa, Homo sapiens
  heavy chain complementarity determining region 3 for antibody 26062
AAGYHSESLSADDVFDM

SEQ ID NO: 52125 - protein, 10 aa, Homo sapiens
  light chain complementarity determining region 3 for antibody 26063
QQRSNWPPGT

SEQ ID NO: 52126 - protein, 16 aa, Homo sapiens
  heavy chain complementarity determining region 3 for antibody 26063
AHSRYGSNIYPVPFDN

SEQ ID NO: 52127 - protein, 9 aa, Homo sapiens
  light chain complementarity determining region 3 for antibody 26064
QQRSNWPLT

SEQ ID NO: 52128 - protein, 15 aa, Homo sapiens
  heavy chain complementarity determining region 3 for antibody 26064
AKMGGTVGSGWYFGY

SEQ ID NO: 52129 - protein, 9 aa, Homo sapiens
  light chain complementarity determining region 3 for antibody 26065
QQRSNWLVT

SEQ ID NO: 52130 - protein, 14 aa, Homo sapiens
  heavy chain complementarity determining region 3 for antibody 26065
ARPGRSGSYSYFDL

SEQ ID NO: 52131 - protein, 10 aa, Homo sapiens
  light chain complementarity determining region 3 for antibody 26066
QQRSDWPPLT

SEQ ID NO: 52132 - protein, 10 aa, Homo sapiens
  heavy chain complementarity determining region 3 for antibody 26066
ARDYTMPFDY

SEQ ID NO: 52133 - protein, 9 aa, Homo sapiens
  light chain complementarity determining region 3 for antibody 26067
QQRSAWPLP

SEQ ID NO: 52134 - protein, 7 aa, Homo sapiens
  heavy chain complementarity determining region 3 for antibody 26067
VRDEWWP

SEQ ID NO: 52135 - protein, 10 aa, Homo sapiens
  light chain complementarity determining region 3 for antibody 26068
QQRRNWPPIT

SEQ ID NO: 52136 - protein, 22 aa, Homo sapiens
  heavy chain complementarity determining region 3 for antibody 26068
ARMKKSDVPLYCNGGPCHIFDY

SEQ ID NO: 52137 - protein, 10 aa, Homo sapiens
  light chain complementarity determining region 3 for antibody 26069
QQRNKWPPGI

SEQ ID NO: 52138 - protein, 12 aa, Homo sapiens
  heavy chain complementarity determining region 3 for antibody 26069
VRDGSSGWHFDY

SEQ ID NO: 52139 - protein, 9 aa, Homo sapiens
  light chain complementarity determining region 3 for antibody 26070
QQRNDWPLT

SEQ ID NO: 52140 - protein, 14 aa, Homo sapiens
  heavy chain complementarity determining region 3 for antibody 26070
AKAYTSGVSRAYDV

SEQ ID NO: 52141 - protein, 10 aa, Homo sapiens
  light chain complementarity determining region 3 for antibody 26071
QQRINWPLCT

SEQ ID NO: 52142 - protein, 17 aa, Homo sapiens
  heavy chain complementarity determining region 3 for antibody 26071
AKDIWYGELSAPYYFDY

SEQ ID NO: 52143 - protein, 9 aa, Homo sapiens
  light chain complementarity determining region 3 for antibody 26072
QQRFNWPPT

SEQ ID NO: 52144 - protein, 19 aa, Homo sapiens
  heavy chain complementarity determining region 3 for antibody 26072
AREVSSADHYGVGKNWFDP

SEQ ID NO: 52145 - protein, 9 aa, Homo sapiens
  light chain complementarity determining region 3 for antibody 26073
QQNTGDLWT

SEQ ID NO: 52146 - protein, 11 aa, Homo sapiens
  heavy chain complementarity determining region 3 for antibody 26073
ARGWDSAKVGS

SEQ ID NO: 52147 - protein, 9 aa, Homo sapiens
  light chain complementarity determining region 3 for antibody 26074
QQNAYSPIT

SEQ ID NO: 52148 - protein, 10 aa, Homo sapiens
  heavy chain complementarity determining region 3 for antibody 26074
ATGAGWLVDY

SEQ ID NO: 52149 - protein, 9 aa, Homo sapiens
  light chain complementarity determining region 3 for antibody 26075
QQLNSYPLT

SEQ ID NO: 52150 - protein, 19 aa, Homo sapiens
  heavy chain complementarity determining region 3 for antibody 26075
AKPPTPYSGSDPRTFYFDY

SEQ ID NO: 52151 - protein, 9 aa, Homo sapiens
  light chain complementarity determining region 3 for antibody 26076
QQFYSTPQT

SEQ ID NO: 52152 - protein, 25 aa, Homo sapiens
  heavy chain complementarity determining region 3 for antibody 26076
ARGRGFLLGELPRDPARRRTAVFDV

SEQ ID NO: 52153 - protein, 9 aa, Homo sapiens
  light chain complementarity determining region 3 for antibody 26077
QQFYNTPWT

SEQ ID NO: 52154 - protein, 15 aa, Homo sapiens
  heavy chain complementarity determining region 3 for antibody 26077
IGQSKVDANWNYPDF

SEQ ID NO: 52155 - protein, 9 aa, Homo sapiens
  light chain complementarity determining region 3 for antibody 26078
QQFNVLPII

SEQ ID NO: 52156 - protein, 15 aa, Homo sapiens
  heavy chain complementarity determining region 3 for antibody 26078
AKSPQRRMRAYYFDL

SEQ ID NO: 52157 - protein, 9 aa, Homo sapiens
  light chain complementarity determining region 3 for antibody 26079
QQFGSSPRT

SEQ ID NO: 52158 - protein, 10 aa, Homo sapiens
  heavy chain complementarity determining region 3 for antibody 26079
TFVYRGYFDY

SEQ ID NO: 52159 - protein, 8 aa, Homo sapiens
  light chain complementarity determining region 3 for antibody 26080
QQFGRSLT

SEQ ID NO: 52160 - protein, 15 aa, Homo sapiens
  heavy chain complementarity determining region 3 for antibody 26080
ARLRDTTLGRWYFDS

SEQ ID NO: 52161 - protein, 10 aa, Homo sapiens
  light chain complementarity determining region 3 for antibody 26081
QQFGNSPPGT

SEQ ID NO: 52162 - protein, 12 aa, Homo sapiens
  heavy chain complementarity determining region 3 for antibody 26081
AKEGLIGGYFDL

SEQ ID NO: 52163 - protein, 9 aa, Homo sapiens
  light chain complementarity determining region 3 for antibody 26082
QQFDTSPWT

SEQ ID NO: 52164 - protein, 19 aa, Homo sapiens
  heavy chain complementarity determining region 3 for antibody 26082
AREASTTIFGVTSRGAFDA

SEQ ID NO: 52165 - protein, 9 aa, Homo sapiens
  light chain complementarity determining region 3 for antibody 26083
QQDSSSLIT

SEQ ID NO: 52166 - protein, 12 aa, Homo sapiens
  heavy chain complementarity determining region 3 for antibody 26083
ARDYVAGDAFDV

SEQ ID NO: 52167 - protein, 9 aa, Homo sapiens
  light chain complementarity determining region 3 for antibody 26084
QQDNNLPWT

SEQ ID NO: 52168 - protein, 12 aa, Homo sapiens
  heavy chain complementarity determining region 3 for antibody 26084
ARGLSSGWGLDY

SEQ ID NO: 52169 - protein, 9 aa, Homo sapiens
  light chain complementarity determining region 3 for antibody 26085
QQDGGSSYT

SEQ ID NO: 52170 - protein, 16 aa, Homo sapiens
  heavy chain complementarity determining region 3 for antibody 26085
ANWFGSVGDFLGPFDY

SEQ ID NO: 52171 - protein, 9 aa, Homo sapiens
  light chain complementarity determining region 3 for antibody 26086
QQDDNSPPT

SEQ ID NO: 52172 - protein, 19 aa, Homo sapiens
  heavy chain complementarity determining region 3 for antibody 26086
ARDHFPLARGVVSYFYYNY

SEQ ID NO: 52173 - protein, 9 aa, Homo sapiens
  light chain complementarity determining region 3 for antibody 26087
QQDDLFRET

SEQ ID NO: 52174 - protein, 16 aa, Homo sapiens
  heavy chain complementarity determining region 3 for antibody 26087
ARWGVECSGGYCYFEY

SEQ ID NO: 52175 - protein, 9 aa, Homo sapiens
  light chain complementarity determining region 3 for antibody 26088
QQDDAQSWT

SEQ ID NO: 52176 - protein, 11 aa, Homo sapiens
  heavy chain complementarity determining region 3 for antibody 26088
ARGWRDNSFDY

SEQ ID NO: 52177 - protein, 9 aa, Homo sapiens
  light chain complementarity determining region 3 for antibody 26089
QQANSLPPT

SEQ ID NO: 52178 - protein, 22 aa, Homo sapiens
  heavy chain complementarity determining region 3 for antibody 26089
AKTSLEYCTGGGATCSDKWFGP

SEQ ID NO: 52179 - protein, 9 aa, Homo sapiens
  light chain complementarity determining region 3 for antibody 26090
QQADSYPLS

SEQ ID NO: 52180 - protein, 16 aa, Homo sapiens
  heavy chain complementarity determining region 3 for antibody 26090
ARDASPHSSGWYYFDS

SEQ ID NO: 52181 - protein, 9 aa, Homo sapiens
  light chain complementarity determining region 3 for antibody 26091
QPYISYSYT

SEQ ID NO: 52182 - protein, 18 aa, Homo sapiens
  heavy chain complementarity determining region 3 for antibody 26091
ARDRYSCDSGGCFHWFDP

SEQ ID NO: 52183 - protein, 9 aa, Homo sapiens
  light chain complementarity determining region 3 for antibody 26092
QPYGSSPRT

SEQ ID NO: 52184 - protein, 25 aa, Homo sapiens
  heavy chain complementarity determining region 3 for antibody 26092
ARLRIDRLRLPGAMRGPLYDCGLNV

SEQ ID NO: 52185 - protein, 9 aa, Homo sapiens
  light chain complementarity determining region 3 for antibody 26093
QNWGSYPLT

SEQ ID NO: 52186 - protein, 11 aa, Homo sapiens
  heavy chain complementarity determining region 3 for antibody 26093
ARRGSNLHADY

SEQ ID NO: 52187 - protein, 11 aa, Homo sapiens
  light chain complementarity determining region 3 for antibody 26094
QLYDTSPPGYP

SEQ ID NO: 52188 - protein, 14 aa, Homo sapiens
  heavy chain complementarity determining region 3 for antibody 26094
AREITISRKTSFDQ

SEQ ID NO: 52189 - protein, 9 aa, Homo sapiens
  light chain complementarity determining region 3 for antibody 26095
QKYNSAPLT

SEQ ID NO: 52190 - protein, 23 aa, Homo sapiens
  heavy chain complementarity determining region 3 for antibody 26095
ARGRTYYFPGSGYPDYFFYLMDI

SEQ ID NO: 52191 - protein, 9 aa, Homo sapiens
  light chain complementarity determining region 3 for antibody 26096
QHYYTSVRT

SEQ ID NO: 52192 - protein, 12 aa, Homo sapiens
  heavy chain complementarity determining region 3 for antibody 26096
VKDCGLGGSRDF

SEQ ID NO: 52193 - protein, 9 aa, Homo sapiens
  light chain complementarity determining region 3 for antibody 26097
QHYSDIPGA

SEQ ID NO: 52194 - protein, 14 aa, Homo sapiens
  heavy chain complementarity determining region 3 for antibody 26097
AKCGHSYGNDAFDI

SEQ ID NO: 52195 - protein, 8 aa, Homo sapiens
  light chain complementarity determining region 3 for antibody 26098
QHYMSPFT

SEQ ID NO: 52196 - protein, 12 aa, Homo sapiens
  heavy chain complementarity determining region 3 for antibody 26098
ARALSASWYAFY

SEQ ID NO: 52197 - protein, 11 aa, Homo sapiens
  light chain complementarity determining region 3 for antibody 26099
QHYGSSPPRVT

SEQ ID NO: 52198 - protein, 28 aa, Homo sapiens
  heavy chain complementarity determining region 3 for antibody 26099
ARGAKKEKLIFVRPRDRGGDTRHWYFDL

SEQ ID NO: 52199 - protein, 9 aa, Homo sapiens
  light chain complementarity determining region 3 for antibody 26100
QHYGLSPET

SEQ ID NO: 52200 - protein, 15 aa, Homo sapiens
  heavy chain complementarity determining region 3 for antibody 26100
AFRGIQVVNGVRFDY

SEQ ID NO: 52201 - protein, 10 aa, Homo sapiens
  light chain complementarity determining region 3 for antibody 26101
QHYGISPRFP

SEQ ID NO: 52202 - protein, 12 aa, Homo sapiens
  heavy chain complementarity determining region 3 for antibody 26101
ARDVVGATASDF

SEQ ID NO: 52203 - protein, 8 aa, Homo sapiens
  light chain complementarity determining region 3 for antibody 26102
QHYDIPWT

SEQ ID NO: 52204 - protein, 10 aa, Homo sapiens
  heavy chain complementarity determining region 3 for antibody 26102
AKTTDWYGHY

SEQ ID NO: 52205 - protein, 10 aa, Homo sapiens
  light chain complementarity determining region 3 for antibody 26103
QEDKSWPAFT

SEQ ID NO: 52206 - protein, 11 aa, Homo sapiens
  heavy chain complementarity determining region 3 for antibody 26103
ARRWGSAPFDH

SEQ ID NO: 52207 - protein, 9 aa, Homo sapiens
  light chain complementarity determining region 3 for antibody 26104
PQYGSSPRT

SEQ ID NO: 52208 - protein, 25 aa, Homo sapiens
  heavy chain complementarity determining region 3 for antibody 26104
ARLRIDRLRLPGAMRGPLYDCGLNV

SEQ ID NO: 52209 - protein, 10 aa, Homo sapiens
  light chain complementarity determining region 3 for antibody 26105
PEYKSWPAFT

SEQ ID NO: 52210 - protein, 11 aa, Homo sapiens
  heavy chain complementarity determining region 3 for antibody 26105
ARRWGSAPFDH

SEQ ID NO: 52211 - protein, 9 aa, Homo sapiens
  light chain complementarity determining region 3 for antibody 26106
MQSRRWPQT

SEQ ID NO: 52212 - protein, 8 aa, Homo sapiens
  heavy chain complementarity determining region 3 for antibody 26106
TAWGSSQH

SEQ ID NO: 52213 - protein, 9 aa, Homo sapiens
  light chain complementarity determining region 3 for antibody 26107
MQSRRGPHT

SEQ ID NO: 52214 - protein, 8 aa, Homo sapiens
  heavy chain complementarity determining region 3 for antibody 26107
TAWGSSHH

SEQ ID NO: 52215 - protein, 9 aa, Homo sapiens
  light chain complementarity determining region 3 for antibody 26108
MQSRGWPHT

SEQ ID NO: 52216 - protein, 8 aa, Homo sapiens
  heavy chain complementarity determining region 3 for antibody 26108
TAWGSSQH

SEQ ID NO: 52217 - protein, 10 aa, Homo sapiens
  light chain complementarity determining region 3 for antibody 26109
MQSIQPPGWT

SEQ ID NO: 52218 - protein, 8 aa, Homo sapiens
  heavy chain complementarity determining region 3 for antibody 26109
AKGYGFDC

SEQ ID NO: 52219 - protein, 9 aa, Homo sapiens
  light chain complementarity determining region 3 for antibody 26110
MQGTPGPHT

SEQ ID NO: 52220 - protein, 11 aa, Homo sapiens
  heavy chain complementarity determining region 3 for antibody 26110
ARDPGWGARDY

SEQ ID NO: 52221 - protein, 9 aa, Homo sapiens
  light chain complementarity determining region 3 for antibody 26111
MQGTHWPQT

SEQ ID NO: 52222 - protein, 13 aa, Homo sapiens
  heavy chain complementarity determining region 3 for antibody 26111
ARTGQWLGGQYDY

SEQ ID NO: 52223 - protein, 9 aa, Homo sapiens
  light chain complementarity determining region 3 for antibody 26112
MQGTHWPPN

SEQ ID NO: 52224 - protein, 14 aa, Homo sapiens
  heavy chain complementarity determining region 3 for antibody 26112
AKSPLKAGVTDLDY

SEQ ID NO: 52225 - protein, 10 aa, Homo sapiens
  light chain complementarity determining region 3 for antibody 26113
MQGTHWPPIT

SEQ ID NO: 52226 - protein, 14 aa, Homo sapiens
  heavy chain complementarity determining region 3 for antibody 26113
ARSNYGDDGFGMDV

SEQ ID NO: 52227 - protein, 9 aa, Homo sapiens
  light chain complementarity determining region 3 for antibody 26114
MQGTHWPGT

SEQ ID NO: 52228 - protein, 15 aa, Homo sapiens
  heavy chain complementarity determining region 3 for antibody 26114
VRDPPSTTAANTRDY

SEQ ID NO: 52229 - protein, 9 aa, Homo sapiens
  light chain complementarity determining region 3 for antibody 26115
MQGTHWPGT

SEQ ID NO: 52230 - protein, 12 aa, Homo sapiens
  heavy chain complementarity determining region 3 for antibody 26115
AKGPLITMTGMV

SEQ ID NO: 52231 - protein, 9 aa, Homo sapiens
  light chain complementarity determining region 3 for antibody 26116
MQGTHWPFT

SEQ ID NO: 52232 - protein, 9 aa, Homo sapiens
  heavy chain complementarity determining region 3 for antibody 26116
AEDPRTLPH

SEQ ID NO: 52233 - protein, 9 aa, Homo sapiens
  light chain complementarity determining region 3 for antibody 26117
MQGTHWPDT

SEQ ID NO: 52234 - protein, 10 aa, Homo sapiens
  heavy chain complementarity determining region 3 for antibody 26117
ARDGDFVLDY

SEQ ID NO: 52235 - protein, 9 aa, Homo sapiens
  light chain complementarity determining region 3 for antibody 26118
MQGTHWLRT

SEQ ID NO: 52236 - protein, 21 aa, Homo sapiens
  heavy chain complementarity determining region 3 for antibody 26118
ARDDKGYCSSSSCYRDDAFDM

SEQ ID NO: 52237 - protein, 9 aa, Homo sapiens
  light chain complementarity determining region 3 for antibody 26119
MQGTHGPYT

SEQ ID NO: 52238 - protein, 10 aa, Homo sapiens
  heavy chain complementarity determining region 3 for antibody 26119
ARDGDFVLDY

SEQ ID NO: 52239 - protein, 9 aa, Homo sapiens
  light chain complementarity determining region 3 for antibody 26120
MQGLQTPRT

SEQ ID NO: 52240 - protein, 15 aa, Homo sapiens
  heavy chain complementarity determining region 3 for antibody 26120
ARDPKRSDYYSGFDT

SEQ ID NO: 52241 - protein, 9 aa, Homo sapiens
  light chain complementarity determining region 3 for antibody 26121
MQGLQTPLT

SEQ ID NO: 52242 - protein, 12 aa, Homo sapiens
  heavy chain complementarity determining region 3 for antibody 26121
VKDSDKKWELLD

SEQ ID NO: 52243 - protein, 9 aa, Homo sapiens
  light chain complementarity determining region 3 for antibody 26122
MQGLQGLPS

SEQ ID NO: 52244 - protein, 15 aa, Homo sapiens
  heavy chain complementarity determining region 3 for antibody 26122
ARVKFETSDYHGLDV

SEQ ID NO: 52245 - protein, 9 aa, Homo sapiens
  light chain complementarity determining region 3 for antibody 26123
MQGANWPYT

SEQ ID NO: 52246 - protein, 11 aa, Homo sapiens
  heavy chain complementarity determining region 3 for antibody 26123
ATVRLVGAVDY

SEQ ID NO: 52247 - protein, 9 aa, Homo sapiens
  light chain complementarity determining region 3 for antibody 26124
MQALRSPGT

SEQ ID NO: 52248 - protein, 12 aa, Homo sapiens
  heavy chain complementarity determining region 3 for antibody 26124
ANNGLEGGTYDR

SEQ ID NO: 52249 - protein, 9 aa, Homo sapiens
  light chain complementarity determining region 3 for antibody 26125
MQALQTPPT

SEQ ID NO: 52250 - protein, 20 aa, Homo sapiens
  heavy chain complementarity determining region 3 for antibody 26125
ARENSGSLLWSLMGGWYFDL

SEQ ID NO: 52251 - protein, 9 aa, Homo sapiens
  light chain complementarity determining region 3 for antibody 26126
MQALQTPLT

SEQ ID NO: 52252 - protein, 13 aa, Homo sapiens
  heavy chain complementarity determining region 3 for antibody 26126
ATSRGSATSYDDF

SEQ ID NO: 52253 - protein, 9 aa, Homo sapiens
  light chain complementarity determining region 3 for antibody 26127
MQALQTPLT

SEQ ID NO: 52254 - protein, 15 aa, Homo sapiens
  heavy chain complementarity determining region 3 for antibody 26127
ARTRIVATIGLDFDY

SEQ ID NO: 52255 - protein, 9 aa, Homo sapiens
  light chain complementarity determining region 3 for antibody 26128
MQALQTPFT

SEQ ID NO: 52256 - protein, 17 aa, Homo sapiens
  heavy chain complementarity determining region 3 for antibody 26128
TRGYCTTTSCQLNWFDP

SEQ ID NO: 52257 - protein, 9 aa, Homo sapiens
  light chain complementarity determining region 3 for antibody 26129
MQALQTGGT

SEQ ID NO: 52258 - protein, 14 aa, Homo sapiens
  heavy chain complementarity determining region 3 for antibody 26129
ARSADTGLSSSLDD

SEQ ID NO: 52259 - protein, 9 aa, Homo sapiens
  light chain complementarity determining region 3 for antibody 26130
MQALQSPRT

SEQ ID NO: 52260 - protein, 12 aa, Homo sapiens
  heavy chain complementarity determining region 3 for antibody 26130
ARDETSVAHLDT

SEQ ID NO: 52261 - protein, 10 aa, Homo sapiens
  light chain complementarity determining region 3 for antibody 26131
MQALQPHGYT

SEQ ID NO: 52262 - protein, 20 aa, Homo sapiens
  heavy chain complementarity determining region 3 for antibody 26131
ARLKAASAGLPSYYYAGMDV

SEQ ID NO: 52263 - protein, 10 aa, Homo sapiens
  light chain complementarity determining region 3 for antibody 26132
MQALQNPPIT

SEQ ID NO: 52264 - protein, 11 aa, Homo sapiens
  heavy chain complementarity determining region 3 for antibody 26132
ARDSLGELLDY

SEQ ID NO: 52265 - protein, 9 aa, Homo sapiens
  light chain complementarity determining region 3 for antibody 26133
MQALQIPPT

SEQ ID NO: 52266 - protein, 11 aa, Homo sapiens
  heavy chain complementarity determining region 3 for antibody 26133
TRYFDRQSFDY

SEQ ID NO: 52267 - protein, 9 aa, Homo sapiens
  light chain complementarity determining region 3 for antibody 26134
MQALETPPT

SEQ ID NO: 52268 - protein, 19 aa, Homo sapiens
  heavy chain complementarity determining region 3 for antibody 26134
ARATSYSSPWVVFYYGVDL

SEQ ID NO: 52269 - protein, 9 aa, Homo sapiens
  light chain complementarity determining region 3 for antibody 26135
MQAHQTPPT

SEQ ID NO: 52270 - protein, 15 aa, Homo sapiens
  heavy chain complementarity determining region 3 for antibody 26135
ARTGSSTWYGYGMDV

SEQ ID NO: 52271 - protein, 8 aa, Homo sapiens
  light chain complementarity determining region 3 for antibody 26136
LQYNSQNT

SEQ ID NO: 52272 - protein, 21 aa, Homo sapiens
  heavy chain complementarity determining region 3 for antibody 26136
ASGPRDYCPAANCRIYNWFDP

SEQ ID NO: 52273 - protein, 9 aa, Homo sapiens
  light chain complementarity determining region 3 for antibody 26137
LQTYNTPYT

SEQ ID NO: 52274 - protein, 13 aa, Homo sapiens
  heavy chain complementarity determining region 3 for antibody 26137
ARRGDMIRDALDI

SEQ ID NO: 52275 - protein, 9 aa, Homo sapiens
  light chain complementarity determining region 3 for antibody 26138
LQHNSYPRT

SEQ ID NO: 52276 - protein, 10 aa, Homo sapiens
  heavy chain complementarity determining region 3 for antibody 26138
TGLGSEGTNY

SEQ ID NO: 52277 - protein, 9 aa, Homo sapiens
  light chain complementarity determining region 3 for antibody 26139
LQHEYWPRT

SEQ ID NO: 52278 - protein, 11 aa, Homo sapiens
  heavy chain complementarity determining region 3 for antibody 26139
VRVGGAGYFDH

SEQ ID NO: 52279 - protein, 9 aa, Homo sapiens
  light chain complementarity determining region 3 for antibody 26140
LHHLRFPLS

SEQ ID NO: 52280 - protein, 16 aa, Homo sapiens
  heavy chain complementarity determining region 3 for antibody 26140
ARYWDGRTPVRVIFDY

SEQ ID NO: 52281 - protein, 9 aa, Homo sapiens
  light chain complementarity determining region 3 for antibody 26141
HQYNNYPWT

SEQ ID NO: 52282 - protein, 10 aa, Homo sapiens
  heavy chain complementarity determining region 3 for antibody 26141
ARRRGAVAAH

SEQ ID NO: 52283 - protein, 10 aa, Homo sapiens
  light chain complementarity determining region 3 for antibody 26142
HQYGSSPPWT

SEQ ID NO: 52284 - protein, 26 aa, Homo sapiens
  heavy chain complementarity determining region 3 for antibody 26142
ARTGRGLVFDTSGLHRFPSTRGYLQH

SEQ ID NO: 52285 - protein, 9 aa, Homo sapiens
  light chain complementarity determining region 3 for antibody 26143
HQRRTFPVT

SEQ ID NO: 52286 - protein, 14 aa, Homo sapiens
  heavy chain complementarity determining region 3 for antibody 26143
IRQSKSDNWNYPDY

SEQ ID NO: 52287 - protein, 9 aa, Homo sapiens
  light chain complementarity determining region 3 for antibody 26144
HQHAAAPLT

SEQ ID NO: 52288 - protein, 10 aa, Homo sapiens
  heavy chain complementarity determining region 3 for antibody 26144
AHGAGWVSDY

SEQ ID NO: 52289 - protein, 9 aa, Homo sapiens
  light chain complementarity determining region 3 for antibody 26145
HHTSTFPRP

SEQ ID NO: 52290 - protein, 20 aa, Homo sapiens
  heavy chain complementarity determining region 3 for antibody 26145
ARGRRIAALSTAHYYYGMDV

SEQ ID NO: 52291 - protein, 10 aa, Homo sapiens
  light chain complementarity determining region 3 for antibody 26146
HHSGPSALIP

SEQ ID NO: 52292 - protein, 16 aa, Homo sapiens
  heavy chain complementarity determining region 3 for antibody 26146
ITIGTVSPWVYYALDV

SEQ ID NO: 52293 - protein, 9 aa, Homo sapiens
  light chain complementarity determining region 3 for antibody 26147
YQYGWSPRA

SEQ ID NO: 52294 - protein, 14 aa, Homo sapiens
  heavy chain complementarity determining region 3 for antibody 26147
AKDAGAVAVHYFDH

SEQ ID NO: 52295 - protein, 9 aa, Homo sapiens
  light chain complementarity determining region 3 for antibody 26148
VQYNRYPRP

SEQ ID NO: 52296 - protein, 6 aa, Homo sapiens
  heavy chain complementarity determining region 3 for antibody 26148
TRALDY

SEQ ID NO: 52297 - protein, 9 aa, Homo sapiens
  light chain complementarity determining region 3 for antibody 26149
VQYHATPVT

SEQ ID NO: 52298 - protein, 9 aa, Homo sapiens
  heavy chain complementarity determining region 3 for antibody 26149
ATGVDADYA

SEQ ID NO: 52299 - protein, 9 aa, Homo sapiens
  light chain complementarity determining region 3 for antibody 26150
VQNNRYPRT

SEQ ID NO: 52300 - protein, 6 aa, Homo sapiens
  heavy chain complementarity determining region 3 for antibody 26150
TRALDY

SEQ ID NO: 52301 - protein, 9 aa, Homo sapiens
  light chain complementarity determining region 3 for antibody 26151
VQHNRYPRT

SEQ ID NO: 52302 - protein, 6 aa, Homo sapiens
  heavy chain complementarity determining region 3 for antibody 26151
TRALDY

SEQ ID NO: 52303 - protein, 9 aa, Homo sapiens
  light chain complementarity determining region 3 for antibody 26152
RQSRRWPHT

SEQ ID NO: 52304 - protein, 8 aa, Homo sapiens
  heavy chain complementarity determining region 3 for antibody 26152
TAWGSSQH

SEQ ID NO: 52305 - protein, 8 aa, Homo sapiens
  light chain complementarity determining region 3 for antibody 26153
RQALQTPT

SEQ ID NO: 52306 - protein, 9 aa, Homo sapiens
  heavy chain complementarity determining region 3 for antibody 26153
ARDSSAFGP

SEQ ID NO: 52307 - protein, 8 aa, Homo sapiens
  light chain complementarity determining region 3 for antibody 26154
QYYSNRPT

SEQ ID NO: 52308 - protein, 15 aa, Homo sapiens
  heavy chain complementarity determining region 3 for antibody 26154
AKEVLTRSSDWYWVD

SEQ ID NO: 52309 - protein, 8 aa, Homo sapiens
  light chain complementarity determining region 3 for antibody 26155
QYYSNRPP

SEQ ID NO: 52310 - protein, 15 aa, Homo sapiens
  heavy chain complementarity determining region 3 for antibody 26155
AKEVLTRSSDWYWLD

SEQ ID NO: 52311 - protein, 9 aa, Homo sapiens
  light chain complementarity determining region 3 for antibody 26156
QQYYTYLRT

SEQ ID NO: 52312 - protein, 12 aa, Homo sapiens
  heavy chain complementarity determining region 3 for antibody 26156
VKDCGLGGSRDS

SEQ ID NO: 52313 - protein, 9 aa, Homo sapiens
  light chain complementarity determining region 3 for antibody 26157
QQYYTPPRP

SEQ ID NO: 52314 - protein, 8 aa, Homo sapiens
  heavy chain complementarity determining region 3 for antibody 26157
ARDGAFDS

SEQ ID NO: 52315 - protein, 9 aa, Homo sapiens
  light chain complementarity determining region 3 for antibody 26158
QQYYTFVRT

SEQ ID NO: 52316 - protein, 12 aa, Homo sapiens
  heavy chain complementarity determining region 3 for antibody 26158
VKDCGLGGSRDF

SEQ ID NO: 52317 - protein, 9 aa, Homo sapiens
  light chain complementarity determining region 3 for antibody 26159
QQYYSTPPT

SEQ ID NO: 52318 - protein, 20 aa, Homo sapiens
  heavy chain complementarity determining region 3 for antibody 26159
THRRPDTRGYYHVDAEYFHH

SEQ ID NO: 52319 - protein, 9 aa, Homo sapiens
  light chain complementarity determining region 3 for antibody 26160
QQYYSTPPT

SEQ ID NO: 52320 - protein, 20 aa, Homo sapiens
  heavy chain complementarity determining region 3 for antibody 26160
ARDQAYYYGSGSSGVDWFDP

SEQ ID NO: 52321 - protein, 9 aa, Homo sapiens
  light chain complementarity determining region 3 for antibody 26161
QQYYSSVRT

SEQ ID NO: 52322 - protein, 12 aa, Homo sapiens
  heavy chain complementarity determining region 3 for antibody 26161
VKDCSLGGSRDS

SEQ ID NO: 52323 - protein, 9 aa, Homo sapiens
  light chain complementarity determining region 3 for antibody 26162
QQYYRTPYT

SEQ ID NO: 52324 - protein, 11 aa, Homo sapiens
  heavy chain complementarity determining region 3 for antibody 26162
AKDNSNYLFDY

SEQ ID NO: 52325 - protein, 10 aa, Homo sapiens
  light chain complementarity determining region 3 for antibody 26163
QQYYNWPPGA

SEQ ID NO: 52326 - protein, 13 aa, Homo sapiens
  heavy chain complementarity determining region 3 for antibody 26163
VRTSGGFLGYFDF

SEQ ID NO: 52327 - protein, 9 aa, Homo sapiens
  light chain complementarity determining region 3 for antibody 26164
QQYYNSPPT

SEQ ID NO: 52328 - protein, 23 aa, Homo sapiens
  heavy chain complementarity determining region 3 for antibody 26164
ARGAPPDVVTAMVPSPYVDLFDF

SEQ ID NO: 52329 - protein, 9 aa, Homo sapiens
  light chain complementarity determining region 3 for antibody 26165
QQYYNIPLT

SEQ ID NO: 52330 - protein, 19 aa, Homo sapiens
  heavy chain complementarity determining region 3 for antibody 26165
ARHNSKDYYSSSLLPGNDH

SEQ ID NO: 52331 - protein, 9 aa, Homo sapiens
  light chain complementarity determining region 3 for antibody 26166
QQYYITPRT

SEQ ID NO: 52332 - protein, 8 aa, Homo sapiens
  heavy chain complementarity determining region 3 for antibody 26166
ARDGAFDS

SEQ ID NO: 52333 - protein, 9 aa, Homo sapiens
  light chain complementarity determining region 3 for antibody 26167
QQYYISLRT

SEQ ID NO: 52334 - protein, 12 aa, Homo sapiens
  heavy chain complementarity determining region 3 for antibody 26167
VKDCGLGGSRDS

SEQ ID NO: 52335 - protein, 8 aa, Homo sapiens
  light chain complementarity determining region 3 for antibody 26168
QQYYDTRT

SEQ ID NO: 52336 - protein, 10 aa, Homo sapiens
  heavy chain complementarity determining region 3 for antibody 26168
ARSWIEIDDY

SEQ ID NO: 52337 - protein, 9 aa, Homo sapiens
  light chain complementarity determining region 3 for antibody 26169
QQYSVVPLT

SEQ ID NO: 52338 - protein, 9 aa, Homo sapiens
  heavy chain complementarity determining region 3 for antibody 26169
VCLGVTPPV

SEQ ID NO: 52339 - protein, 9 aa, Homo sapiens
  light chain complementarity determining region 3 for antibody 26170
QQYSSFPGT

SEQ ID NO: 52340 - protein, 22 aa, Homo sapiens
  heavy chain complementarity determining region 3 for antibody 26170
ARPKTQGGFYDSSGYERGAFDI

SEQ ID NO: 52341 - protein, 8 aa, Homo sapiens
  light chain complementarity determining region 3 for antibody 26171
QQYSNWGA

SEQ ID NO: 52342 - protein, 15 aa, Homo sapiens
  heavy chain complementarity determining region 3 for antibody 26171
AREGWSGNYPRYFDH

SEQ ID NO: 52343 - protein, 8 aa, Homo sapiens
  light chain complementarity determining region 3 for antibody 26172
QQYSIYWT

SEQ ID NO: 52344 - protein, 14 aa, Homo sapiens
  heavy chain complementarity determining region 3 for antibody 26172
AVLGSNWQVYNFDY

SEQ ID NO: 52345 - protein, 9 aa, Homo sapiens
  light chain complementarity determining region 3 for antibody 26173
QQYNWYPLT

SEQ ID NO: 52346 - protein, 12 aa, Homo sapiens
  heavy chain complementarity determining region 3 for antibody 26173
ARDKEFRSYSIY

SEQ ID NO: 52347 - protein, 8 aa, Homo sapiens
  light chain complementarity determining region 3 for antibody 26174
QQYNTYST

SEQ ID NO: 52348 - protein, 17 aa, Homo sapiens
  heavy chain complementarity determining region 3 for antibody 26174
AHRLDHNGMWNEGIFDH

SEQ ID NO: 52349 - protein, 8 aa, Homo sapiens
  light chain complementarity determining region 3 for antibody 26175
QQYNTYAP

SEQ ID NO: 52350 - protein, 17 aa, Homo sapiens
  heavy chain complementarity determining region 3 for antibody 26175
AHRLDHNGMWNEGIFDH

SEQ ID NO: 52351 - protein, 9 aa, Homo sapiens
  light chain complementarity determining region 3 for antibody 26176
QQYNSYSYI

SEQ ID NO: 52352 - protein, 11 aa, Homo sapiens
  heavy chain complementarity determining region 3 for antibody 26176
VRENGEDAFDL

SEQ ID NO: 52353 - protein, 9 aa, Homo sapiens
  light chain complementarity determining region 3 for antibody 26177
QQYNSYPYT

SEQ ID NO: 52354 - protein, 15 aa, Homo sapiens
  heavy chain complementarity determining region 3 for antibody 26177
AIPYGSGTYYGSFDY

SEQ ID NO: 52355 - protein, 9 aa, Homo sapiens
  light chain complementarity determining region 3 for antibody 26178
QQYNSYPWT

SEQ ID NO: 52356 - protein, 16 aa, Homo sapiens
  heavy chain complementarity determining region 3 for antibody 26178
AREQAPLMVRGVFSDF

SEQ ID NO: 52357 - protein, 7 aa, Homo sapiens
  light chain complementarity determining region 3 for antibody 26179
QQYNSYP

SEQ ID NO: 52358 - protein, 13 aa, Homo sapiens
  heavy chain complementarity determining region 3 for antibody 26179
THNSDGYLGYFQH

SEQ ID NO: 52359 - protein, 9 aa, Homo sapiens
  light chain complementarity determining region 3 for antibody 26180
QQYNSYPIT

SEQ ID NO: 52360 - protein, 26 aa, Homo sapiens
  heavy chain complementarity determining region 3 for antibody 26180
ARSGREFKKEHIVVVTAIPRAEYFQH

SEQ ID NO: 52361 - protein, 9 aa, Homo sapiens
  light chain complementarity determining region 3 for antibody 26181
QQYNSYLFT

SEQ ID NO: 52362 - protein, 16 aa, Homo sapiens
  heavy chain complementarity determining region 3 for antibody 26181
AKAGRVCSGGSCYVDS

SEQ ID NO: 52363 - protein, 8 aa, Homo sapiens
  light chain complementarity determining region 3 for antibody 26182
QQYNSYGS

SEQ ID NO: 52364 - protein, 12 aa, Homo sapiens
  heavy chain complementarity determining region 3 for antibody 26182
ARNRIWFGDFHF

SEQ ID NO: 52365 - protein, 9 aa, Homo sapiens
  light chain complementarity determining region 3 for antibody 26183
QQYNSVPLT

SEQ ID NO: 52366 - protein, 14 aa, Homo sapiens
  heavy chain complementarity determining region 3 for antibody 26183
ARPQTWDLLYAFDM

SEQ ID NO: 52367 - protein, 9 aa, Homo sapiens
  light chain complementarity determining region 3 for antibody 26184
QQYNNYPLT

SEQ ID NO: 52368 - protein, 17 aa, Homo sapiens
  heavy chain complementarity determining region 3 for antibody 26184
ATGLVAGFGQTYRPPVF

SEQ ID NO: 52369 - protein, 9 aa, Homo sapiens
  light chain complementarity determining region 3 for antibody 26185
QQYNNWPRT

SEQ ID NO: 52370 - protein, 14 aa, Homo sapiens
  heavy chain complementarity determining region 3 for antibody 26185
ARGRLEVAGIILDQ

SEQ ID NO: 52371 - protein, 10 aa, Homo sapiens [sequence omitted]

SEQ ID NO: 52372 - protein, 10 aa, Homo sapiens
  heavy chain complementarity determining region 3 for antibody 26186
ARGTSGSYFY

SEQ ID NO: 52373 - protein, 10 aa, Homo sapiens
  light chain complementarity determining region 3 for antibody 26187
QQYNNWPPST

SEQ ID NO: 52374 - protein, 14 aa, Homo sapiens
  heavy chain complementarity determining region 3 for antibody 26187
ARGGRLRLFSFSDY

SEQ ID NO: 52375 - protein, 10 aa, Homo sapiens
  light chain complementarity determining region 3 for antibody 26188
QQYNNWPPLT

SEQ ID NO: 52376 - protein, 11 aa, Homo sapiens
  heavy chain complementarity determining region 3 for antibody 26188
ARGYDFSSFDY

SEQ ID NO: 52377 - protein, 10 aa, Homo sapiens
  light chain complementarity determining region 3 for antibody 26189
QQYNNWLGWT

SEQ ID NO: 52378 - protein, 13 aa, Homo sapiens
  heavy chain complementarity determining region 3 for antibody 26189
ARHGRRSGWYYAY

SEQ ID NO: 52379 - protein, 10 aa, Homo sapiens
  light chain complementarity determining region 3 for antibody 26190
QQYNNWLGRT

SEQ ID NO: 52380 - protein, 13 aa, Homo sapiens
  heavy chain complementarity determining region 3 for antibody 26190
ARHGRRSGWYYTY

SEQ ID NO: 52381 - protein, 9 aa, Homo sapiens
  light chain complementarity determining region 3 for antibody 26191
QQYNDHFIT

SEQ ID NO: 52382 - protein, 17 aa, Homo sapiens
  heavy chain complementarity determining region 3 for antibody 26191
AREGGFCIGAGCRWFDL

SEQ ID NO: 52383 - protein, 8 aa, Homo sapiens
  light chain complementarity determining region 3 for antibody 26192
QQYMSPFT

SEQ ID NO: 52384 - protein, 12 aa, Homo sapiens
  heavy chain complementarity determining region 3 for antibody 26192
ARALSASWYAVY

SEQ ID NO: 52385 - protein, 9 aa, Homo sapiens
  light chain complementarity determining region 3 for antibody 26193
QQYLSHEPT

SEQ ID NO: 52386 - protein, 13 aa, Homo sapiens
  heavy chain complementarity determining region 3 for antibody 26193
VRLPTGFPNWFDP

SEQ ID NO: 52387 - protein, 8 aa, Homo sapiens
  light chain complementarity determining region 3 for antibody 26194
QQYIYWQT

SEQ ID NO: 52388 - protein, 13 aa, Homo sapiens
  heavy chain complementarity determining region 3 for antibody 26194
ARKGGGDFYYFPY

SEQ ID NO: 52389 - protein, 9 aa, Homo sapiens
  light chain complementarity determining region 3 for antibody 26195
QQYHTSPPT

SEQ ID NO: 52390 - protein, 13 aa, Homo sapiens
  heavy chain complementarity determining region 3 for antibody 26195
AKDPPRHWGSWGN

SEQ ID NO: 52391 - protein, 12 aa, Homo sapiens
  light chain complementarity determining region 3 for antibody 26196
QQYGTSVPWPWP

SEQ ID NO: 52392 - protein, 14 aa, Homo sapiens
  heavy chain complementarity determining region 3 for antibody 26196
VRGGSSGYNHQVDY

SEQ ID NO: 52393 - protein, 11 aa, Homo sapiens
  light chain complementarity determining region 3 for antibody 26197
QQYGTSSPPWA

SEQ ID NO: 52394 - protein, 12 aa, Homo sapiens
  heavy chain complementarity determining region 3 for antibody 26197
VKEKRGVRVFDL

SEQ ID NO: 52395 - protein, 10 aa, Homo sapiens
  light chain complementarity determining region 3 for antibody 26198
QQYGTSLPWT

SEQ ID NO: 52396 - protein, 14 aa, Homo sapiens
  heavy chain complementarity determining region 3 for antibody 26198
ARGGSSGYYSQLDF

SEQ ID NO: 52397 - protein, 9 aa, Homo sapiens
  light chain complementarity determining region 3 for antibody 26199
QQYGTAPGT

SEQ ID NO: 52398 - protein, 14 aa, Homo sapiens
  heavy chain complementarity determining region 3 for antibody 26199
ARDLFRGIPDYLDY

SEQ ID NO: 52399 - protein, 9 aa, Homo sapiens
  light chain complementarity determining region 3 for antibody 26200
QQYGSTWWT

SEQ ID NO: 52400 - protein, 15 aa, Homo sapiens
  heavy chain complementarity determining region 3 for antibody 26200
ARHMARDSIGYSHDF

SEQ ID NO: 52401 - protein, 9 aa, Homo sapiens
  light chain complementarity determining region 3 for antibody 26201
QQYGSSWGT

SEQ ID NO: 52402 - protein, 15 aa, Homo sapiens
  heavy chain complementarity determining region 3 for antibody 26201
ARHVARDDIGYYHDL

SEQ ID NO: 52403 - protein, 9 aa, Homo sapiens
  light chain complementarity determining region 3 for antibody 26202
QQYGSSSYT

SEQ ID NO: 52404 - protein, 14 aa, Homo sapiens
  heavy chain complementarity determining region 3 for antibody 26202
AHSVRFLEWSLADY

SEQ ID NO: 52405 - protein, 9 aa, Homo sapiens
  light chain complementarity determining region 3 for antibody 26203
QQYGSSPYP

SEQ ID NO: 52406 - protein, 9 aa, Homo sapiens
  heavy chain complementarity determining region 3 for antibody 26203
ARETEGFDI

SEQ ID NO: 52407 - protein, 9 aa, Homo sapiens
  light chain complementarity determining region 3 for antibody 26204
QQYGSSPPP

SEQ ID NO: 52408 - protein, 23 aa, Homo sapiens
  heavy chain complementarity determining region 3 for antibody 26204
ARDGAHDYIHRLRKKHRIDAFDI

SEQ ID NO: 52409 - protein, 9 aa, Homo sapiens
  light chain complementarity determining region 3 for antibody 26205
QQYGSSPLT

SEQ ID NO: 52410 - protein, 11 aa, Homo sapiens
  heavy chain complementarity determining region 3 for antibody 26205
AREGNYKPHDY

SEQ ID NO: 52411 - protein, 9 aa, Homo sapiens
  light chain complementarity determining region 3 for antibody 26206
QQYGSSPFT

SEQ ID NO: 52412 - protein, 14 aa, Homo sapiens
  heavy chain complementarity determining region 3 for antibody 26206
ARTWDYAPRGAFDV

SEQ ID NO: 52413 - protein, 9 aa, Homo sapiens
  light chain complementarity determining region 3 for antibody 26207
QQYGSSPFP

SEQ ID NO: 52414 - protein, 21 aa, Homo sapiens
  heavy chain complementarity determining region 3 for antibody 26207
ARVGVERNRYGRTLPVWYFDY

SEQ ID NO: 52415 - protein, 10 aa, Homo sapiens
  light chain complementarity determining region 3 for antibody 26208
QQYGSSPALP

SEQ ID NO: 52416 - protein, 23 aa, Homo sapiens
  heavy chain complementarity determining region 3 for antibody 26208
ARAPSQYYYDSSGYYYPTNWFDP

SEQ ID NO: 52417 - protein, 10 aa, Homo sapiens
  light chain complementarity determining region 3 for antibody 26209
QQYGSSLLYT

SEQ ID NO: 52418 - protein, 13 aa, Homo sapiens
  heavy chain complementarity determining region 3 for antibody 26209
ARSSWTGWDYFDY

SEQ ID NO: 52419 - protein, 9 aa, Homo sapiens
  light chain complementarity determining region 3 for antibody 26210
QQYGSLPLT

SEQ ID NO: 52420 - protein, 15 aa, Homo sapiens
  heavy chain complementarity determining region 3 for antibody 26210
AHRPKYYDKAGAFDI

SEQ ID NO: 52421 - protein, 9 aa, Homo sapiens
  light chain complementarity determining region 3 for antibody 26211
QQYGSLPLN

SEQ ID NO: 52422 - protein, 15 aa, Homo sapiens
  heavy chain complementarity determining region 3 for antibody 26211
AHRPNYYDKAGAFDI

SEQ ID NO: 52423 - protein, 7 aa, Homo sapiens
  light chain complementarity determining region 3 for antibody 26212
QQYGSLA

SEQ ID NO: 52424 - protein, 11 aa, Homo sapiens
  heavy chain complementarity determining region 3 for antibody 26212
AVVDTTLAMPK

SEQ ID NO: 52425 - protein, 9 aa, Homo sapiens
  light chain complementarity determining region 3 for antibody 26213
QQYGSAPRT

SEQ ID NO: 52426 - protein, 25 aa, Homo sapiens
  heavy chain complementarity determining region 3 for antibody 26213
ARLRIDRLRLPGAMRGPLYDCGLNV

SEQ ID NO: 52427 - protein, 9 aa, Homo sapiens
  light chain complementarity determining region 3 for antibody 26214
QQYGRTWWT

SEQ ID NO: 52428 - protein, 15 aa, Homo sapiens
  heavy chain complementarity determining region 3 for antibody 26214
ARHMARDSIGYYHDF

SEQ ID NO: 52429 - protein, 8 aa, Homo sapiens
  light chain complementarity determining region 3 for antibody 26215
QQYGRSLT

SEQ ID NO: 52430 - protein, 15 aa, Homo sapiens
  heavy chain complementarity determining region 3 for antibody 26215
ARGGLPLRRNGYFDS

SEQ ID NO: 52431 - protein, 11 aa, Homo sapiens
  light chain complementarity determining region 3 for antibody 26216
QQYGPSPPLST

SEQ ID NO: 52432 - protein, 10 aa, Homo sapiens
  heavy chain complementarity determining region 3 for antibody 26216
ARNDVYRIDH

SEQ ID NO: 52433 - protein, 9 aa, Homo sapiens
  light chain complementarity determining region 3 for antibody 26217
QQYGNSPLT

SEQ ID NO: 52434 - protein, 13 aa, Homo sapiens
  heavy chain complementarity determining region 3 for antibody 26217
ASKTAVRTYSSDL

SEQ ID NO: 52435 - protein, 9 aa, Homo sapiens
  light chain complementarity determining region 3 for antibody 26218
QQYGNSPGT

SEQ ID NO: 52436 - protein, 15 aa, Homo sapiens
  heavy chain complementarity determining region 3 for antibody 26218
ARDWGVSTTGGPFDY

SEQ ID NO: 52437 - protein, 10 aa, Homo sapiens
  light chain complementarity determining region 3 for antibody 26219
QQYGNPTPIT

SEQ ID NO: 52438 - protein, 16 aa, Homo sapiens
  heavy chain complementarity determining region 3 for antibody 26219
TREIRGVIKPEEDFDY

SEQ ID NO: 52439 - protein, 9 aa, Homo sapiens
  light chain complementarity determining region 3 for antibody 26220
QQYGNLPRP

SEQ ID NO: 52440 - protein, 13 aa, Homo sapiens
  heavy chain complementarity determining region 3 for antibody 26220
AGGNFHSGGYGEY

SEQ ID NO: 52441 - protein, 9 aa, Homo sapiens
  light chain complementarity determining region 3 for antibody 26221
QQYGHSPLT

SEQ ID NO: 52442 - protein, 13 aa, Homo sapiens
  heavy chain complementarity determining region 3 for antibody 26221
ASKTSVRTYSSDL

SEQ ID NO: 52443 - protein, 6 aa, Homo sapiens
  light chain complementarity determining region 3 for antibody 26222
QQYGET

SEQ ID NO: 52444 - protein, 12 aa, Homo sapiens
  heavy chain complementarity determining region 3 for antibody 26222
ARDHSSGWSLAN

SEQ ID NO: 52445 - protein, 9 aa, Homo sapiens
  light chain complementarity determining region 3 for antibody 26223
QQYFTSPFS

SEQ ID NO: 52446 - protein, 16 aa, Homo sapiens
  heavy chain complementarity determining region 3 for antibody 26223
TKDHGHSYGFYNYFDY

SEQ ID NO: 52447 - protein, 11 aa, Homo sapiens
  light chain complementarity determining region 3 for antibody 26224
QQYETSPPGYP

SEQ ID NO: 52448 - protein, 14 aa, Homo sapiens
  heavy chain complementarity determining region 3 for antibody 26224
ARENSISRKRSFDQ

SEQ ID NO: 52449 - protein, 10 aa, Homo sapiens
  light chain complementarity determining region 3 for antibody 26225
QQYDYWPPLT

SEQ ID NO: 52450 - protein, 19 aa, Homo sapiens
  heavy chain complementarity determining region 3 for antibody 26225
ATSYYEILTGYRSQYYFTS

SEQ ID NO: 52451 - protein, 9 aa, Homo sapiens
  light chain complementarity determining region 3 for antibody 26226
QQYDVLPLT

SEQ ID NO: 52452 - protein, 16 aa, Homo sapiens
  heavy chain complementarity determining region 3 for antibody 26226
AHRRVDTITGYDYFDS

SEQ ID NO: 52453 - protein, 9 aa, Homo sapiens
  light chain complementarity determining region 3 for antibody 26227
QQYDTYSHT

SEQ ID NO: 52454 - protein, 22 aa, Homo sapiens
  heavy chain complementarity determining region 3 for antibody 26227
AMRTRGMFYFNSGAYSGSPADY

SEQ ID NO: 52455 - protein, 9 aa, Homo sapiens
  light chain complementarity determining region 3 for antibody 26228
QQYDSPPRT

SEQ ID NO: 52456 - protein, 12 aa, Homo sapiens
  heavy chain complementarity determining region 3 for antibody 26228
ARGFYSTTWYLV

SEQ ID NO: 52457 - protein, 9 aa, Homo sapiens
  light chain complementarity determining region 3 for antibody 26229
QQYDNLPPT

SEQ ID NO: 52458 - protein, 14 aa, Homo sapiens
  heavy chain complementarity determining region 3 for antibody 26229
AKGTHYYDSNGYNY

SEQ ID NO: 52459 - protein, 10 aa, Homo sapiens
  light chain complementarity determining region 3 for antibody 26230
QQYDNLPPLT

SEQ ID NO: 52460 - protein, 14 aa, Homo sapiens
  heavy chain complementarity determining region 3 for antibody 26230
AKDRWGAVAGMLDY

SEQ ID NO: 52461 - protein, 9 aa, Homo sapiens
  light chain complementarity determining region 3 for antibody 26231
QQYDLFRET

SEQ ID NO: 52462 - protein, 16 aa, Homo sapiens
  heavy chain complementarity determining region 3 for antibody 26231
ARWGVECSGGYCYFDY

SEQ ID NO: 52463 - protein, 9 aa, Homo sapiens
  light chain complementarity determining region 3 for antibody 26232
QQYAFSPIT

SEQ ID NO: 52464 - protein, 10 aa, Homo sapiens
  heavy chain complementarity determining region 3 for antibody 26232
ATGAGWLVDY

SEQ ID NO: 52465 - protein, 9 aa, Homo sapiens
  light chain complementarity determining region 3 for antibody 26233
QQVHIYPPT

SEQ ID NO: 52466 - protein, 12 aa, Homo sapiens
  heavy chain complementarity determining region 3 for antibody 26233
ARDTDGSFGLDV

SEQ ID NO: 52467 - protein, 10 aa, Homo sapiens
  light chain complementarity determining region 3 for antibody 26234
QQTYSTPAWT

SEQ ID NO: 52468 - protein, 14 aa, Homo sapiens
  heavy chain complementarity determining region 3 for antibody 26234
ARLSAAAGTFHFDY

SEQ ID NO: 52469 - protein, 9 aa, Homo sapiens
  light chain complementarity determining region 3 for antibody 26235
QQTYSIPLT

SEQ ID NO: 52470 - protein, 22 aa, Homo sapiens
  heavy chain complementarity determining region 3 for antibody 26235
ARDLESARDVENIGMVWKPFDY

SEQ ID NO: 52471 - protein, 9 aa, Homo sapiens
  light chain complementarity determining region 3 for antibody 26236
QQTYRTPIT

SEQ ID NO: 52472 - protein, 13 aa, Homo sapiens
  heavy chain complementarity determining region 3 for antibody 26236
ARANDYGDYYLEY

SEQ ID NO: 52473 - protein, 13 aa, Homo sapiens
  light chain complementarity determining region 3 for antibody 26237
QQTYMLTYSGRVT

SEQ ID NO: 52474 - protein, 15 aa, Homo sapiens
  heavy chain complementarity determining region 3 for antibody 26237
ARDSFDGSYSGSFDY

SEQ ID NO: 52475 - protein, 10 aa, Homo sapiens
  light chain complementarity determining region 3 for antibody 26238
QQSYTTSSIT

SEQ ID NO: 52476 - protein, 12 aa, Homo sapiens
  heavy chain complementarity determining region 3 for antibody 26238
ARYYDILTGWTN

SEQ ID NO: 52477 - protein, 10 aa, Homo sapiens
  light chain complementarity determining region 3 for antibody 26239
QQSYTTPLKT

SEQ ID NO: 52478 - protein, 14 aa, Homo sapiens
  heavy chain complementarity determining region 3 for antibody 26239
ARDRQTRLGDNLDI

SEQ ID NO: 52479 - protein, 9 aa, Homo sapiens
  light chain complementarity determining region 3 for antibody 26240
QQSYSTPLT

SEQ ID NO: 52480 - protein, 12 aa, Homo sapiens
  heavy chain complementarity determining region 3 for antibody 26240
ARETYGVPRFDS

SEQ ID NO: 52481 - protein, 9 aa, Homo sapiens
  light chain complementarity determining region 3 for antibody 26241
QQSSRTPLT

SEQ ID NO: 52482 - protein, 16 aa, Homo sapiens
  heavy chain complementarity determining region 3 for antibody 26241
ARGGPLEWLGSDAFDF

SEQ ID NO: 52483 - protein, 10 aa, Homo sapiens
  light chain complementarity determining region 3 for antibody 26242
QQSHNNPPYT

SEQ ID NO: 52484 - protein, 21 aa, Homo sapiens
  heavy chain complementarity determining region 3 for antibody 26242
ARTGRHYSDSTVYYYRPRIDY

SEQ ID NO: 52485 - protein, 8 aa, Homo sapiens
  light chain complementarity determining region 3 for antibody 26243
QQRSTGLT

SEQ ID NO: 52486 - protein, 13 aa, Homo sapiens
  heavy chain complementarity determining region 3 for antibody 26243
AREPNGPLNAFDL

SEQ ID NO: 52487 - protein, 11 aa, Homo sapiens
  light chain complementarity determining region 3 for antibody 26244
QQRSNWPPMGT

SEQ ID NO: 52488 - protein, 13 aa, Homo sapiens
  heavy chain complementarity determining region 3 for antibody 26244
ATDRAAGKYYFSF

SEQ ID NO: 52489 - protein, 10 aa, Homo sapiens
  light chain complementarity determining region 3 for antibody 26245
QQRSNWPPIT

SEQ ID NO: 52490 - protein, 11 aa, Homo sapiens
  heavy chain complementarity determining region 3 for antibody 26245
ASGGWVAYFDY

SEQ ID NO: 52491 - protein, 11 aa, Homo sapiens
  light chain complementarity determining region 3 for antibody 26246
QQRSNWPLMYT

SEQ ID NO: 52492 - protein, 14 aa, Homo sapiens
  heavy chain complementarity determining region 3 for antibody 26246
ARDVDGNNYVPFEY

SEQ ID NO: 52493 - protein, 9 aa, Homo sapiens
  light chain complementarity determining region 3 for antibody 26247
QQRSIWPLT

SEQ ID NO: 52494 - protein, 12 aa, Homo sapiens
  heavy chain complementarity determining region 3 for antibody 26247
TSRSFVLDAFEV

SEQ ID NO: 52495 - protein, 9 aa, Homo sapiens
  light chain complementarity determining region 3 for antibody 26248
QQRSDWPLT

SEQ ID NO: 52496 - protein, 20 aa, Homo sapiens
  heavy chain complementarity determining region 3 for antibody 26248
ARGGHIVVVTSIGDQAAFNV

SEQ ID NO: 52497 - protein, 11 aa, Homo sapiens
  light chain complementarity determining region 3 for antibody 26249
QQRQPRRNWLT

SEQ ID NO: 52498 - protein, 15 aa, Homo sapiens
  heavy chain complementarity determining region 3 for antibody 26249
ARGGYSSSWYYWFDP

SEQ ID NO: 52499 - protein, 10 aa, Homo sapiens
  light chain complementarity determining region 3 for antibody 26250
QQRINWPPFT

SEQ ID NO: 52500 - protein, 18 aa, Homo sapiens
  heavy chain complementarity determining region 3 for antibody 26250
VTIPPYRRGWDTKGYFDN

SEQ ID NO: 52501 - protein, 9 aa, Homo sapiens
  light chain complementarity determining region 3 for antibody 26251
QQRGKGPLT

SEQ ID NO: 52502 - protein, 15 aa, Homo sapiens
  heavy chain complementarity determining region 3 for antibody 26251
ARIGGYYDSGTISDY

SEQ ID NO: 52503 - protein, 9 aa, Homo sapiens
  light chain complementarity determining region 3 for antibody 26252
QQNGSTWWT

SEQ ID NO: 52504 - protein, 15 aa, Homo sapiens
  heavy chain complementarity determining region 3 for antibody 26252
ARHMARDSIGYYHDF

SEQ ID NO: 52505 - protein, 9 aa, Homo sapiens
  light chain complementarity determining region 3 for antibody 26253
QQLNSYPYT

SEQ ID NO: 52506 - protein, 12 aa, Homo sapiens
  heavy chain complementarity determining region 3 for antibody 26253
AIWGGAKGGLHY

SEQ ID NO: 52507 - protein, 6 aa, Homo sapiens
  light chain complementarity determining region 3 for antibody 26254
QQHNRG

SEQ ID NO: 52508 - protein, 5 aa, Homo sapiens
  heavy chain complementarity determining region 3 for antibody 26254
VRDSR

SEQ ID NO: 52509 - protein, 9 aa, Homo sapiens
  light chain complementarity determining region 3 for antibody 26255
QQHHTTPWT

SEQ ID NO: 52510 - protein, 5 aa, Homo sapiens
  heavy chain complementarity determining region 3 for antibody 26255
TTSRY

SEQ ID NO: 52511 - protein, 9 aa, Homo sapiens
  light chain complementarity determining region 3 for antibody 26256
QQHGGFPGT

SEQ ID NO: 52512 - protein, 18 aa, Homo sapiens
  heavy chain complementarity determining region 3 for antibody 26256
ARVTYCPSGTCFSGEIHY

SEQ ID NO: 52513 - protein, 9 aa, Homo sapiens
  light chain complementarity determining region 3 for antibody 26257
QQGYSPPFI

SEQ ID NO: 52514 - protein, 15 aa, Homo sapiens
  heavy chain complementarity determining region 3 for antibody 26257
TRAQVIWGQLYYFDY

SEQ ID NO: 52515 - protein, 9 aa, Homo sapiens
  light chain complementarity determining region 3 for antibody 26258
QQFYSNLRT

SEQ ID NO: 52516 - protein, 21 aa, Homo sapiens
  heavy chain complementarity determining region 3 for antibody 26258
AKDSMDSRGTVPGTVVGAFDY

SEQ ID NO: 52517 - protein, 11 aa, Homo sapiens
  light chain complementarity determining region 3 for antibody 26259
QQFTNWPPLFT

SEQ ID NO: 52518 - protein, 14 aa, Homo sapiens
  heavy chain complementarity determining region 3 for antibody 26259
ARLNGIVGYYAFDM

SEQ ID NO: 52519 - protein, 9 aa, Homo sapiens
  light chain complementarity determining region 3 for antibody 26260
QQFNNYPFT

SEQ ID NO: 52520 - protein, 14 aa, Homo sapiens
  heavy chain complementarity determining region 3 for antibody 26260
ARDPGDYGDYYFDY

SEQ ID NO: 52521 - protein, 10 aa, Homo sapiens
  light chain complementarity determining region 3 for antibody 26261
QQDGYSPKLT

SEQ ID NO: 52522 - protein, 18 aa, Homo sapiens
  heavy chain complementarity determining region 3 for antibody 26261
ATGHPLRLHDYYYFVMDV

SEQ ID NO: 52523 - protein, 9 aa, Homo sapiens
  light chain complementarity determining region 3 for antibody 26262
QQDGRSPRT

SEQ ID NO: 52524 - protein, 15 aa, Homo sapiens
  heavy chain complementarity determining region 3 for antibody 26262
AKDGEFCGSNCYFGS

SEQ ID NO: 52525 - protein, 9 aa, Homo sapiens
  light chain complementarity determining region 3 for antibody 26263
QQDGNIPRT

SEQ ID NO: 52526 - protein, 14 aa, Homo sapiens
  heavy chain complementarity determining region 3 for antibody 26263
AGGTFDSSGYYYEY

SEQ ID NO: 52527 - protein, 9 aa, Homo sapiens
  light chain complementarity determining region 3 for antibody 26264
QQDGDSPLT

SEQ ID NO: 52528 - protein, 15 aa, Homo sapiens
  heavy chain complementarity determining region 3 for antibody 26264
AKGRRGSYSHDAFDV

SEQ ID NO: 52529 - protein, 9 aa, Homo sapiens
  light chain complementarity determining region 3 for antibody 26265
QQANTFPLT

SEQ ID NO: 52530 - protein, 20 aa, Homo sapiens
  heavy chain complementarity determining region 3 for antibody 26265
ARDSNTPTLSDYDYHYCMDV

SEQ ID NO: 52531 - protein, 9 aa, Homo sapiens
  light chain complementarity determining region 3 for antibody 26266
QQANSFPWT

SEQ ID NO: 52532 - protein, 9 aa, Homo sapiens
  heavy chain complementarity determining region 3 for antibody 26266
ARGLRWVDY

SEQ ID NO: 52533 - protein, 9 aa, Homo sapiens
  light chain complementarity determining region 3 for antibody 26267
QQAHSFPRP

SEQ ID NO: 52534 - protein, 13 aa, Homo sapiens
  heavy chain complementarity determining region 3 for antibody 26267
ARDLRVGRNGLDV

SEQ ID NO: 52535 - protein, 9 aa, Homo sapiens
  light chain complementarity determining region 3 for antibody 26268
QKYNSAPRT

SEQ ID NO: 52536 - protein, 20 aa, Homo sapiens
  heavy chain complementarity determining region 3 for antibody 26268
ARFKRTTFRLGFYNYYGMDV

SEQ ID NO: 52537 - protein, 9 aa, Homo sapiens
  light chain complementarity determining region 3 for antibody 26269
QHYYTTPRT

SEQ ID NO: 52538 - protein, 8 aa, Homo sapiens
  heavy chain complementarity determining region 3 for antibody 26269
ARDGAFDS

SEQ ID NO: 52539 - protein, 9 aa, Homo sapiens
  light chain complementarity determining region 3 for antibody 26270
QHYYTSVRT

SEQ ID NO: 52540 - protein, 12 aa, Homo sapiens
  heavy chain complementarity determining region 3 for antibody 26270
VKDCGLGGSRDS

SEQ ID NO: 52541 - protein, 9 aa, Homo sapiens
  light chain complementarity determining region 3 for antibody 26271
QHYGTSPWT

SEQ ID NO: 52542 - protein, 14 aa, Homo sapiens
  heavy chain complementarity determining region 3 for antibody 26271
ARACRFDCLEASDS

SEQ ID NO: 52543 - protein, 10 aa, Homo sapiens
  light chain complementarity determining region 3 for antibody 26272
QHYGTSPRWT

SEQ ID NO: 52544 - protein, 18 aa, Homo sapiens
  heavy chain complementarity determining region 3 for antibody 26272
VRDLPIDTALVTVAGGDF

SEQ ID NO: 52545 - protein, 9 aa, Homo sapiens
  light chain complementarity determining region 3 for antibody 26273
QHYFITPLT

SEQ ID NO: 52546 - protein, 18 aa, Homo sapiens
  heavy chain complementarity determining region 3 for antibody 26273
ARAAGGAGDVRFLSWIDA

SEQ ID NO: 52547 - protein, 8 aa, Homo sapiens
  light chain complementarity determining region 3 for antibody 26274
QHYDITGT

SEQ ID NO: 52548 - protein, 10 aa, Homo sapiens
  heavy chain complementarity determining region 3 for antibody 26274
AKTTDWYGHY

SEQ ID NO: 52549 - protein, 11 aa, Homo sapiens
  light chain complementarity determining region 3 for antibody 26275
QHSGSSPPRVP

SEQ ID NO: 52550 - protein, 13 aa, Homo sapiens
  heavy chain complementarity determining region 3 for antibody 26275
VRGFGVVSPDFDY

SEQ ID NO: 52551 - protein, 9 aa, Homo sapiens
  light chain complementarity determining region 3 for antibody 26276
QHSFTVPFT

SEQ ID NO: 52552 - protein, 21 aa, Homo sapiens
  heavy chain complementarity determining region 3 for antibody 26276
ARAGESQMSALYTERDDAFQT

SEQ ID NO: 52553 - protein, 9 aa, Homo sapiens
  light chain complementarity determining region 3 for antibody 26277
QHNYNPPFT

SEQ ID NO: 52554 - protein, 13 aa, Homo sapiens
  heavy chain complementarity determining region 3 for antibody 26277
VRGKNYDRDGFDP

SEQ ID NO: 52555 - protein, 9 aa, Homo sapiens
  light chain complementarity determining region 3 for antibody 26278
QHFGSSHFT

SEQ ID NO: 52556 - protein, 13 aa, Homo sapiens
  heavy chain complementarity determining region 3 for antibody 26278
ATSEFSASYYFDI

SEQ ID NO: 52557 - protein, 10 aa, Homo sapiens
  light chain complementarity determining region 3 for antibody 26279
QHFDNLPMLT

SEQ ID NO: 52558 - protein, 16 aa, Homo sapiens
  heavy chain complementarity determining region 3 for antibody 26279
ARVPRGSYASGTLFDY

SEQ ID NO: 52559 - protein, 9 aa, Homo sapiens
  light chain complementarity determining region 3 for antibody 26280
QEYNTYSRT

SEQ ID NO: 52560 - protein, 17 aa, Homo sapiens
  heavy chain complementarity determining region 3 for antibody 26280
ARDYGAQSDSTIWAFDL

SEQ ID NO: 52561 - protein, 10 aa, Homo sapiens
  light chain complementarity determining region 3 for antibody 26281
QEYKSWPAVT

SEQ ID NO: 52562 - protein, 11 aa, Homo sapiens
  heavy chain complementarity determining region 3 for antibody 26281
ARRWGSAPFDH

SEQ ID NO: 52563 - protein, 10 aa, Homo sapiens
  light chain complementarity determining region 3 for antibody 26282
QEYKSWPALT

SEQ ID NO: 52564 - protein, 11 aa, Homo sapiens
  heavy chain complementarity determining region 3 for antibody 26282
ARRWGSAPFDH

SEQ ID NO: 52565 - protein, 10 aa, Homo sapiens
  light chain complementarity determining region 3 for antibody 26283
QEYDNHPPYI

SEQ ID NO: 52566 - protein, 12 aa, Homo sapiens
  heavy chain complementarity determining region 3 for antibody 26283
ARSPRRVGYFHH

SEQ ID NO: 52567 - protein, 9 aa, Homo sapiens
  light chain complementarity determining region 3 for antibody 26284
QESYSTQWT

SEQ ID NO: 52568 - protein, 23 aa, Homo sapiens
  heavy chain complementarity determining region 3 for antibody 26284
ARLSRDPIAVRTSPLDYYYGMDV

SEQ ID NO: 52569 - protein, 10 aa, Homo sapiens
  light chain complementarity determining region 3 for antibody 26285
QEHKSWPAFT

SEQ ID NO: 52570 - protein, 11 aa, Homo sapiens
  heavy chain complementarity determining region 3 for antibody 26285
ARRWGSAPFDH

SEQ ID NO: 52571 - protein, 9 aa, Homo sapiens
  light chain complementarity determining region 3 for antibody 26286
MQTLQTPPT

SEQ ID NO: 52572 - protein, 18 aa, Homo sapiens
  heavy chain complementarity determining region 3 for antibody 26286
ARAQGSGWELGSWGAYDF

SEQ ID NO: 52573 - protein, 9 aa, Homo sapiens
  light chain complementarity determining region 3 for antibody 26287
MQTLQTPGA

SEQ ID NO: 52574 - protein, 13 aa, Homo sapiens
  heavy chain complementarity determining region 3 for antibody 26287
AKVVSYGSGGLQY

SEQ ID NO: 52575 - protein, 8 aa, Homo sapiens
  light chain complementarity determining region 3 for antibody 26288
MQTLQGFI

SEQ ID NO: 52576 - protein, 12 aa, Homo sapiens
  heavy chain complementarity determining region 3 for antibody 26288
VRGAPDYGVFDF

SEQ ID NO: 52577 - protein, 9 aa, Homo sapiens
  light chain complementarity determining region 3 for antibody 26289
MQSSRWPHT

SEQ ID NO: 52578 - protein, 8 aa, Homo sapiens
  heavy chain complementarity determining region 3 for antibody 26289
TAWGSSQH

SEQ ID NO: 52579 - protein, 9 aa, Homo sapiens
  light chain complementarity determining region 3 for antibody 26290
MQSLETHLT

SEQ ID NO: 52580 - protein, 22 aa, Homo sapiens
  heavy chain complementarity determining region 3 for antibody 26290
ARIRPPALSPYYYETAADISDY

SEQ ID NO: 52581 - protein, 9 aa, Homo sapiens
  light chain complementarity determining region 3 for antibody 26291
MQRRRGPHT

SEQ ID NO: 52582 - protein, 8 aa, Homo sapiens
  heavy chain complementarity determining region 3 for antibody 26291
TAWGSSQH

SEQ ID NO: 52583 - protein, 10 aa, Homo sapiens
  light chain complementarity determining region 3 for antibody 26292
MQRIQPPRWT

SEQ ID NO: 52584 - protein, 8 aa, Homo sapiens
  heavy chain complementarity determining region 3 for antibody 26292
AKGYGFDC

SEQ ID NO: 52585 - protein, 9 aa, Homo sapiens
  light chain complementarity determining region 3 for antibody 26293
MQGTYGPYT

SEQ ID NO: 52586 - protein, 10 aa, Homo sapiens
  heavy chain complementarity determining region 3 for antibody 26293
VRGGGWLADY

SEQ ID NO: 52587 - protein, 10 aa, Homo sapiens
  light chain complementarity determining region 3 for antibody 26294
MQGTHWPPYT

SEQ ID NO: 52588 - protein, 19 aa, Homo sapiens
  heavy chain complementarity determining region 3 for antibody 26294
ARIECMHASPGSLCDAFDV

SEQ ID NO: 52589 - protein, 8 aa, Homo sapiens
  light chain complementarity determining region 3 for antibody 26295
MQGTHWPP

SEQ ID NO: 52590 - protein, 21 aa, Homo sapiens
  heavy chain complementarity determining region 3 for antibody 26295
AKDRPNYYESNGQYYTPKGDL

SEQ ID NO: 52591 - protein, 9 aa, Homo sapiens
  light chain complementarity determining region 3 for antibody 26296
MQGTHWPDT

SEQ ID NO: 52592 - protein, 11 aa, Homo sapiens
  heavy chain complementarity determining region 3 for antibody 26296
IKDMSPGGADV

SEQ ID NO: 52593 - protein, 10 aa, Homo sapiens
  light chain complementarity determining region 3 for antibody 26297
MQGTHGPPRT

SEQ ID NO: 52594 - protein, 12 aa, Homo sapiens
  heavy chain complementarity determining region 3 for antibody 26297
VRDPQIGDVSDY

SEQ ID NO: 52595 - protein, 9 aa, Homo sapiens
  light chain complementarity determining region 3 for antibody 26298
MQGTHGPLE

SEQ ID NO: 52596 - protein, 18 aa, Homo sapiens
  heavy chain complementarity determining region 3 for antibody 26298
ARDERDTCRNGLCYYFDY

SEQ ID NO: 52597 - protein, 9 aa, Homo sapiens
  light chain complementarity determining region 3 for antibody 26299
MQGLQSPLS

SEQ ID NO: 52598 - protein, 12 aa, Homo sapiens
  heavy chain complementarity determining region 3 for antibody 26299
TRDPDSHYGMEV

SEQ ID NO: 52599 - protein, 9 aa, Homo sapiens
  light chain complementarity determining region 3 for antibody 26300
MQALQTPYT

SEQ ID NO: 52600 - protein, 14 aa, Homo sapiens
  heavy chain complementarity determining region 3 for antibody 26300
TRRLIANFEDSFDV

SEQ ID NO: 52601 - protein, 9 aa, Homo sapiens
  light chain complementarity determining region 3 for antibody 26301
MQALQTPPT

SEQ ID NO: 52602 - protein, 21 aa, Homo sapiens
  heavy chain complementarity determining region 3 for antibody 26301
ARDAPVSRPYSSGWYSSAFDY

SEQ ID NO: 52603 - protein, 9 aa, Homo sapiens
  light chain complementarity determining region 3 for antibody 26302
MQALQTPPS

SEQ ID NO: 52604 - protein, 13 aa, Homo sapiens
  heavy chain complementarity determining region 3 for antibody 26302
ARHDYGDYGSFDS

SEQ ID NO: 52605 - protein, 8 aa, Homo sapiens
  light chain complementarity determining region 3 for antibody 26303
MQALQTPP

SEQ ID NO: 52606 - protein, 9 aa, Homo sapiens
  heavy chain complementarity determining region 3 for antibody 26303
ARDSSAFGP

SEQ ID NO: 52607 - protein, 9 aa, Homo sapiens
  light chain complementarity determining region 3 for antibody 26304
MQALQTPIT

SEQ ID NO: 52608 - protein, 16 aa, Homo sapiens
  heavy chain complementarity determining region 3 for antibody 26304
ARDVTDNDHLYADFDH

SEQ ID NO: 52609 - protein, 9 aa, Homo sapiens
  light chain complementarity determining region 3 for antibody 26305
MQALQTAFT

SEQ ID NO: 52610 - protein, 12 aa, Homo sapiens
  heavy chain complementarity determining region 3 for antibody 26305
ARDLYDSSRGDF

SEQ ID NO: 52611 - protein, 9 aa, Homo sapiens
  light chain complementarity determining region 3 for antibody 26306
MQALQSPWT

SEQ ID NO: 52612 - protein, 12 aa, Homo sapiens
  heavy chain complementarity determining region 3 for antibody 26306
ARNYESSGYFGY

SEQ ID NO: 52613 - protein, 8 aa, Homo sapiens
  light chain complementarity determining region 3 for antibody 26307
MQALQPLP

SEQ ID NO: 52614 - protein, 16 aa, Homo sapiens
  heavy chain complementarity determining region 3 for antibody 26307
AKAGWVVGYDLSRGCA

SEQ ID NO: 52615 - protein, 9 aa, Homo sapiens
  light chain complementarity determining region 3 for antibody 26308
MQALKTPFT

SEQ ID NO: 52616 - protein, 15 aa, Homo sapiens
  heavy chain complementarity determining region 3 for antibody 26308
VRHYRELATGIEGDS

SEQ ID NO: 52617 - protein, 9 aa, Homo sapiens
  light chain complementarity determining region 3 for antibody 26309
MQALETPFT

SEQ ID NO: 52618 - protein, 15 aa, Homo sapiens
  heavy chain complementarity determining region 3 for antibody 26309
VRHYRETVTGIEGDS

SEQ ID NO: 52619 - protein, 9 aa, Homo sapiens
  light chain complementarity determining region 3 for antibody 26310
LQVVSSPRT

SEQ ID NO: 52620 - protein, 8 aa, Homo sapiens
  heavy chain complementarity determining region 3 for antibody 26310
ARNSGWYD

SEQ ID NO: 52621 - protein, 8 aa, Homo sapiens
  light chain complementarity determining region 3 for antibody 26311
LQNDNFPF

SEQ ID NO: 52622 - protein, 16 aa, Homo sapiens
  heavy chain complementarity determining region 3 for antibody 26311
ARHSLGLEWEFQWGAY

SEQ ID NO: 52623 - protein, 9 aa, Homo sapiens
  light chain complementarity determining region 3 for antibody 26312
LQHNSYPPT

SEQ ID NO: 52624 - protein, 18 aa, Homo sapiens
  heavy chain complementarity determining region 3 for antibody 26312
AKVDTPHSSGYYYYGMDV

SEQ ID NO: 52625 - protein, 9 aa, Homo sapiens
  light chain complementarity determining region 3 for antibody 26313
LQANSFPLT

SEQ ID NO: 52626 - protein, 19 aa, Homo sapiens
  heavy chain complementarity determining region 3 for antibody 26313
ARGEYNDGSKSYIGGRVDS

SEQ ID NO: 52627 - protein, 8 aa, Homo sapiens
  light chain complementarity determining region 3 for antibody 26314
LHYLSSGT

SEQ ID NO: 52628 - protein, 15 aa, Homo sapiens
  heavy chain complementarity determining region 3 for antibody 26314
ARESFDISGNNWFAP

SEQ ID NO: 52629 - protein, 9 aa, Homo sapiens
  light chain complementarity determining region 3 for antibody 26315
HQYYTPPLT

SEQ ID NO: 52630 - protein, 13 aa, Homo sapiens
  heavy chain complementarity determining region 3 for antibody 26315
ARGGGYSYGPPDF

SEQ ID NO: 52631 - protein, 9 aa, Homo sapiens
  light chain complementarity determining region 3 for antibody 26316
HQYGGSPRT

SEQ ID NO: 52632 - protein, 11 aa, Homo sapiens
  heavy chain complementarity determining region 3 for antibody 26316
ARSLPYREIEF

SEQ ID NO: 52633 - protein, 9 aa, Homo sapiens
  light chain complementarity determining region 3 for antibody 26317
HQYGDTPRP

SEQ ID NO: 52634 - protein, 16 aa, Homo sapiens
  heavy chain complementarity determining region 3 for antibody 26317
AGLSASGHLAPNTFDV

SEQ ID NO: 52635 - protein, 9 aa, Homo sapiens
  light chain complementarity determining region 3 for antibody 26318
HQSSSLPWT

SEQ ID NO: 52636 - protein, 14 aa, Homo sapiens
  heavy chain complementarity determining region 3 for antibody 26318
ARGGLGIWGNSSDI

SEQ ID NO: 52637 - protein, 9 aa, Homo sapiens
  light chain complementarity determining region 3 for antibody 26319
HQRSSLPQT

SEQ ID NO: 52638 - protein, 14 aa, Homo sapiens
  heavy chain complementarity determining region 3 for antibody 26319
AHLQVGATPRAFDI

SEQ ID NO: 52639 - protein, 8 aa, Homo sapiens
  light chain complementarity determining region 3 for antibody 26320
HQRNNFPL

SEQ ID NO: 52640 - protein, 10 aa, Homo sapiens
  heavy chain complementarity determining region 3 for antibody 26320
ARDHSGPLDF

SEQ ID NO: 52641 - protein, 11 aa, Homo sapiens
  light chain complementarity determining region 3 for antibody 26321
HLYGSSPPGYP

SEQ ID NO: 52642 - protein, 11 aa, Homo sapiens
  heavy chain complementarity determining region 3 for antibody 26321
ARHGTDYYFDY

SEQ ID NO: 52643 - protein, 9 aa, Homo sapiens
  light chain complementarity determining region 3 for antibody 26322
HHLKSYPLS

SEQ ID NO: 52644 - protein, 11 aa, Homo sapiens
  heavy chain complementarity determining region 3 for antibody 26322
TRDQPFSSFDL

SEQ ID NO: 52645 - protein, 9 aa, Homo sapiens
  light chain complementarity determining region 3 for antibody 26323
VQYNMYPRT

SEQ ID NO: 52646 - protein, 6 aa, Homo sapiens
  heavy chain complementarity determining region 3 for antibody 26323
TRALDY

SEQ ID NO: 52647 - protein, 9 aa, Homo sapiens
  light chain complementarity determining region 3 for antibody 26324
VQTQQTPYT

SEQ ID NO: 52648 - protein, 14 aa, Homo sapiens
  heavy chain complementarity determining region 3 for antibody 26324
RGVITQGVESAVDI

SEQ ID NO: 52649 - protein, 9 aa, Homo sapiens
  light chain complementarity determining region 3 for antibody 26325
VPYNRYPRT

SEQ ID NO: 52650 - protein, 6 aa, Homo sapiens
  heavy chain complementarity determining region 3 for antibody 26325
TRALDY

SEQ ID NO: 52651 - protein, 9 aa, Homo sapiens
  light chain complementarity determining region 3 for antibody 26326
RQALETPFT

SEQ ID NO: 52652 - protein, 15 aa, Homo sapiens
  heavy chain complementarity determining region 3 for antibody 26326
VRHYRETVAGIEGDS

SEQ ID NO: 52653 - protein, 9 aa, Homo sapiens
  light chain complementarity determining region 3 for antibody 26327
QRYDNVPLT

SEQ ID NO: 52654 - protein, 13 aa, Homo sapiens
  heavy chain complementarity determining region 3 for antibody 26327
AEDGEHGDYVIDN

SEQ ID NO: 52655 - protein, 11 aa, Homo sapiens
  light chain complementarity determining region 3 for antibody 26328
QRYDLSPPRYR

SEQ ID NO: 52656 - protein, 14 aa, Homo sapiens
  heavy chain complementarity determining region 3 for antibody 26328
ARHKQESGTRGFDF

SEQ ID NO: 52657 - protein, 9 aa, Homo sapiens
  light chain complementarity determining region 3 for antibody 26329
QQYYTSPRT

SEQ ID NO: 52658 - protein, 8 aa, Homo sapiens
  heavy chain complementarity determining region 3 for antibody 26329
ARDGAFDS

SEQ ID NO: 52659 - protein, 9 aa, Homo sapiens
  light chain complementarity determining region 3 for antibody 26330
QQYYSTPWT

SEQ ID NO: 52660 - protein, 15 aa, Homo sapiens
  heavy chain complementarity determining region 3 for antibody 26330
IRQSKVDNNYNYPDF

SEQ ID NO: 52661 - protein, 9 aa, Homo sapiens
  light chain complementarity determining region 3 for antibody 26331
QQYYSTPFT

SEQ ID NO: 52662 - protein, 18 aa, Homo sapiens
  heavy chain complementarity determining region 3 for antibody 26331
AREVIRSTGLTELPGMDV

SEQ ID NO: 52663 - protein, 9 aa, Homo sapiens
  light chain complementarity determining region 3 for antibody 26332
QQYYSTLWT

SEQ ID NO: 52664 - protein, 8 aa, Homo sapiens
  heavy chain complementarity determining region 3 for antibody 26332
ARGGGFDP

SEQ ID NO: 52665 - protein, 9 aa, Homo sapiens
  light chain complementarity determining region 3 for antibody 26333
QQYYSSPYT

SEQ ID NO: 52666 - protein, 10 aa, Homo sapiens
  heavy chain complementarity determining region 3 for antibody 26333
VRDGGDYGDY

SEQ ID NO: 52667 - protein, 9 aa, Homo sapiens
  light chain complementarity determining region 3 for antibody 26334
QQYYSSPRT

SEQ ID NO: 52668 - protein, 15 aa, Homo sapiens
  heavy chain complementarity determining region 3 for antibody 26334
ARDRSAAGTGWWFDP

SEQ ID NO: 52669 - protein, 9 aa, Homo sapiens
  light chain complementarity determining region 3 for antibody 26335
QQYYSSPGT

SEQ ID NO: 52670 - protein, 15 aa, Homo sapiens
  heavy chain complementarity determining region 3 for antibody 26335
ARAPSGTSSPHHFDH

SEQ ID NO: 52671 - protein, 10 aa, Homo sapiens
  light chain complementarity determining region 3 for antibody 26336
QQYYDWPPLT

SEQ ID NO: 52672 - protein, 21 aa, Homo sapiens
  heavy chain complementarity determining region 3 for antibody 26336
ATSVASVAAGGPVHYYYAVDV

SEQ ID NO: 52673 - protein, 9 aa, Homo sapiens
  light chain complementarity determining region 3 for antibody 26337
QQYVTYPLT

SEQ ID NO: 52674 - protein, 13 aa, Homo sapiens
  heavy chain complementarity determining region 3 for antibody 26337
GRGGYTSSWYWVY

SEQ ID NO: 52675 - protein, 9 aa, Homo sapiens
  light chain complementarity determining region 3 for antibody 26338
QQYSTYPGT

SEQ ID NO: 52676 - protein, 16 aa, Homo sapiens
  heavy chain complementarity determining region 3 for antibody 26338
ARVRYPISADNRVVDH

SEQ ID NO: 52677 - protein, 9 aa, Homo sapiens
  light chain complementarity determining region 3 for antibody 26339
QQYSSTPLT

SEQ ID NO: 52678 - protein, 18 aa, Homo sapiens
  heavy chain complementarity determining region 3 for antibody 26339
AKGLHPRRKGYDFHPFDY

SEQ ID NO: 52679 - protein, 10 aa, Homo sapiens
  light chain complementarity determining region 3 for antibody 26340
QQYSISPKGT

SEQ ID NO: 52680 - protein, 17 aa, Homo sapiens
  heavy chain complementarity determining region 3 for antibody 26340
ARDPCKKATDVVCAWDS

SEQ ID NO: 52681 - protein, 9 aa, Homo sapiens
  light chain complementarity determining region 3 for antibody 26341
QQYNSYSRT

SEQ ID NO: 52682 - protein, 17 aa, Homo sapiens
  heavy chain complementarity determining region 3 for antibody 26341
ARDYGAQSDSTIWAFDV

SEQ ID NO: 52683 - protein, 9 aa, Homo sapiens
  light chain complementarity determining region 3 for antibody 26342
QQYNSIPGT

SEQ ID NO: 52684 - protein, 14 aa, Homo sapiens
  heavy chain complementarity determining region 3 for antibody 26342
TKCAYNYGNDAFDV

SEQ ID NO: 52685 - protein, 8 aa, Homo sapiens
  light chain complementarity determining region 3 for antibody 26343
QQYNNWPT

SEQ ID NO: 52686 - protein, 13 aa, Homo sapiens
  heavy chain complementarity determining region 3 for antibody 26343
AHSRFGSGTHFDY

SEQ ID NO: 52687 - protein, 10 aa, Homo sapiens [sequence omitted]

SEQ ID NO: 52688 - protein, 17 aa, Homo sapiens
  heavy chain complementarity determining region 3 for antibody 26344
ARDWHCIGGSCGDVFDV

SEQ ID NO: 52689 - protein, 10 aa, Homo sapiens
  light chain complementarity determining region 3 for antibody 26345
QQYNNWPPLT

SEQ ID NO: 52690 - protein, 15 aa, Homo sapiens
  heavy chain complementarity determining region 3 for antibody 26345
ARNGRQLSVDDAFHV

SEQ ID NO: 52691 - protein, 10 aa, Homo sapiens
  light chain complementarity determining region 3 for antibody 26346
QQYNNWPPLP

SEQ ID NO: 52692 - protein, 17 aa, Homo sapiens
  heavy chain complementarity determining region 3 for antibody 26346
ARDRLLLRASGGGGFDF

SEQ ID NO: 52693 - protein, 10 aa, Homo sapiens
  light chain complementarity determining region 3 for antibody 26347
QQYNKWPPWT

SEQ ID NO: 52694 - protein, 13 aa, Homo sapiens
  heavy chain complementarity determining region 3 for antibody 26347
SRGFQPLPDGMDV

SEQ ID NO: 52695 - protein, 11 aa, Homo sapiens
  light chain complementarity determining region 3 for antibody 26348
QQYITSFPGYP

SEQ ID NO: 52696 - protein, 11 aa, Homo sapiens
  heavy chain complementarity determining region 3 for antibody 26348
ARHGDHYYFDY

SEQ ID NO: 52697 - protein, 9 aa, Homo sapiens
  light chain complementarity determining region 3 for antibody 26349
QQYISYPWT

SEQ ID NO: 52698 - protein, 19 aa, Homo sapiens
  heavy chain complementarity determining region 3 for antibody 26349
ARVSARRMLTAPRYPLIDS

SEQ ID NO: 52699 - protein, 9 aa, Homo sapiens
  light chain complementarity determining region 3 for antibody 26350
QQYHYTPFP

SEQ ID NO: 52700 - protein, 14 aa, Homo sapiens
  heavy chain complementarity determining region 3 for antibody 26350
ARHEEMGTTAAFDV

SEQ ID NO: 52701 - protein, 8 aa, Homo sapiens
  light chain complementarity determining region 3 for antibody 26351
QQYHTYWT

SEQ ID NO: 52702 - protein, 15 aa, Homo sapiens
  heavy chain complementarity determining region 3 for antibody 26351
ARGCGADCYAEYFHH

SEQ ID NO: 52703 - protein, 8 aa, Homo sapiens
  light chain complementarity determining region 3 for antibody 26352
QQYHTYWT

SEQ ID NO: 52704 - protein, 14 aa, Homo sapiens
  heavy chain complementarity determining region 3 for antibody 26352
ARDQTRAGPTTFDY

SEQ ID NO: 52705 - protein, 9 aa, Homo sapiens
  light chain complementarity determining region 3 for antibody 26353
QQYHSDPPT

SEQ ID NO: 52706 - protein, 10 aa, Homo sapiens
  heavy chain complementarity determining region 3 for antibody 26353
AGGTGWILDT

SEQ ID NO: 52707 - protein, 8 aa, Homo sapiens
  light chain complementarity determining region 3 for antibody 26354
QQYGTSRT

SEQ ID NO: 52708 - protein, 15 aa, Homo sapiens
  heavy chain complementarity determining region 3 for antibody 26354
ARGEFYRDSRGYRDD

SEQ ID NO: 52709 - protein, 14 aa, Homo sapiens
  light chain complementarity determining region 3 for antibody 26355
QQYGTSPHDGSPGT

SEQ ID NO: 52710 - protein, 13 aa, Homo sapiens
  heavy chain complementarity determining region 3 for antibody 26355
ARVAVPGMGYFQY

SEQ ID NO: 52711 - protein, 9 aa, Homo sapiens
  light chain complementarity determining region 3 for antibody 26356
QQYGTLPRT

SEQ ID NO: 52712 - protein, 13 aa, Homo sapiens
  heavy chain complementarity determining region 3 for antibody 26356
AGGNFHSGGYGEY

SEQ ID NO: 52713 - protein, 9 aa, Homo sapiens
  light chain complementarity determining region 3 for antibody 26357
QQYGSTWWN

SEQ ID NO: 52714 - protein, 15 aa, Homo sapiens
  heavy chain complementarity determining region 3 for antibody 26357
ARHMARDSIGYYHDF

SEQ ID NO: 52715 - protein, 9 aa, Homo sapiens
  light chain complementarity determining region 3 for antibody 26358
QQYGSSPYT

SEQ ID NO: 52716 - protein, 17 aa, Homo sapiens
  heavy chain complementarity determining region 3 for antibody 26358
ATVELSQMVRDENWFDP

SEQ ID NO: 52717 - protein, 9 aa, Homo sapiens
  light chain complementarity determining region 3 for antibody 26359
QQYGSSPYT

SEQ ID NO: 52718 - protein, 14 aa, Homo sapiens
  heavy chain complementarity determining region 3 for antibody 26359
AKGGPLGYYEYFHH

SEQ ID NO: 52719 - protein, 9 aa, Homo sapiens
  light chain complementarity determining region 3 for antibody 26360
QQYGSSPWT

SEQ ID NO: 52720 - protein, 13 aa, Homo sapiens
  heavy chain complementarity determining region 3 for antibody 26360
ARINIVGATGFDF

SEQ ID NO: 52721 - protein, 9 aa, Homo sapiens
  light chain complementarity determining region 3 for antibody 26361
QQYGSSPWT

SEQ ID NO: 52722 - protein, 13 aa, Homo sapiens
  heavy chain complementarity determining region 3 for antibody 26361
ARHLYTTVTPFDY

SEQ ID NO: 52723 - protein, 9 aa, Homo sapiens
  light chain complementarity determining region 3 for antibody 26362
QQYGSSPWT

SEQ ID NO: 52724 - protein, 13 aa, Homo sapiens
  heavy chain complementarity determining region 3 for antibody 26362
ARHLYTTVMPFDY

SEQ ID NO: 52725 - protein, 9 aa, Homo sapiens
  light chain complementarity determining region 3 for antibody 26363
QQYGSSPST

SEQ ID NO: 52726 - protein, 17 aa, Homo sapiens
  heavy chain complementarity determining region 3 for antibody 26363
ARGTGYNYGYGGVHFDY

SEQ ID NO: 52727 - protein, 9 aa, Homo sapiens
  light chain complementarity determining region 3 for antibody 26364
QQYGSSPRT

SEQ ID NO: 52728 - protein, 25 aa, Homo sapiens
  heavy chain complementarity determining region 3 for antibody 26364
ARLRIDRRRLPGAMRGPLYDCGLNV

SEQ ID NO: 52729 - protein, 9 aa, Homo sapiens
  light chain complementarity determining region 3 for antibody 26365
QQYGSSPRT

SEQ ID NO: 52730 - protein, 25 aa, Homo sapiens
  heavy chain complementarity determining region 3 for antibody 26365
ARLRIDRLRLPGARRGPLYDCGLNV

SEQ ID NO: 52731 - protein, 9 aa, Homo sapiens
  light chain complementarity determining region 3 for antibody 26366
QQYGSSPRK

SEQ ID NO: 52732 - protein, 25 aa, Homo sapiens
  heavy chain complementarity determining region 3 for antibody 26366
ARLRIDRLRLPGAMRGPLYDCGLNV

SEQ ID NO: 52733 - protein, 9 aa, Homo sapiens
  light chain complementarity determining region 3 for antibody 26367
QQYGSSPQK

SEQ ID NO: 52734 - protein, 11 aa, Homo sapiens
  heavy chain complementarity determining region 3 for antibody 26367
ARGDLWSAFDI

SEQ ID NO: 52735 - protein, 10 aa, Homo sapiens
  light chain complementarity determining region 3 for antibody 26368
QQYGSSPPWT

SEQ ID NO: 52736 - protein, 11 aa, Homo sapiens
  heavy chain complementarity determining region 3 for antibody 26368
TREKVGGYFDY

SEQ ID NO: 52737 - protein, 9 aa, Homo sapiens
  light chain complementarity determining region 3 for antibody 26369
QQYGSSPPT

SEQ ID NO: 52738 - protein, 14 aa, Homo sapiens
  heavy chain complementarity determining region 3 for antibody 26369
ARDMFVGGYDAFDI

SEQ ID NO: 52739 - protein, 9 aa, Homo sapiens
  light chain complementarity determining region 3 for antibody 26370
QQYGSSPPT

SEQ ID NO: 52740 - protein, 11 aa, Homo sapiens
  heavy chain complementarity determining region 3 for antibody 26370
AKDNSNYLFDY

SEQ ID NO: 52741 - protein, 10 aa, Homo sapiens
  light chain complementarity determining region 3 for antibody 26371
QQYGSSPPFP

SEQ ID NO: 52742 - protein, 14 aa, Homo sapiens
  heavy chain complementarity determining region 3 for antibody 26371
ARDLRWLVLGRLDY

SEQ ID NO: 52743 - protein, 9 aa, Homo sapiens
  light chain complementarity determining region 3 for antibody 26372
QQYGSSPDT

SEQ ID NO: 52744 - protein, 17 aa, Homo sapiens
  heavy chain complementarity determining region 3 for antibody 26372
ARGTGYNYGYGGVHFDY

SEQ ID NO: 52745 - protein, 9 aa, Homo sapiens
  light chain complementarity determining region 3 for antibody 26373
QQYGSLPRT

SEQ ID NO: 52746 - protein, 15 aa, Homo sapiens
  heavy chain complementarity determining region 3 for antibody 26373
AHRPNYYDKAGAFDI

SEQ ID NO: 52747 - protein, 9 aa, Homo sapiens
  light chain complementarity determining region 3 for antibody 26374
QQYGSIPRP

SEQ ID NO: 52748 - protein, 14 aa, Homo sapiens
  heavy chain complementarity determining region 3 for antibody 26374
AGGKFCGGDCYREY

SEQ ID NO: 52749 - protein, 9 aa, Homo sapiens
  light chain complementarity determining region 3 for antibody 26375
QQYGSFPLT

SEQ ID NO: 52750 - protein, 15 aa, Homo sapiens
  heavy chain complementarity determining region 3 for antibody 26375
AHRPNYYDKAGAFDI

SEQ ID NO: 52751 - protein, 7 aa, Homo sapiens
  light chain complementarity determining region 3 for antibody 26376
QQYGRWA

SEQ ID NO: 52752 - protein, 11 aa, Homo sapiens
  heavy chain complementarity determining region 3 for antibody 26376
AVVDTTLAMPK

SEQ ID NO: 52753 - protein, 9 aa, Homo sapiens
  light chain complementarity determining region 3 for antibody 26377
QQYGRSPWM

SEQ ID NO: 52754 - protein, 14 aa, Homo sapiens
  heavy chain complementarity determining region 3 for antibody 26377
ASKKHLVHYYAMDV

SEQ ID NO: 52755 - protein, 9 aa, Homo sapiens
  light chain complementarity determining region 3 for antibody 26378
QQYGRSPST

SEQ ID NO: 52756 - protein, 17 aa, Homo sapiens
  heavy chain complementarity determining region 3 for antibody 26378
AGLSSRLGDGSPSLFDY

SEQ ID NO: 52757 - protein, 9 aa, Homo sapiens
  light chain complementarity determining region 3 for antibody 26379
QQYGNSPFP

SEQ ID NO: 52758 - protein, 15 aa, Homo sapiens
  heavy chain complementarity determining region 3 for antibody 26379
ARQKGQRASAGYFDS

SEQ ID NO: 52759 - protein, 10 aa, Homo sapiens
  light chain complementarity determining region 3 for antibody 26380
QQYGNPPQIT

SEQ ID NO: 52760 - protein, 16 aa, Homo sapiens
  heavy chain complementarity determining region 3 for antibody 26380
TREIRGVIKPEEDFDY

SEQ ID NO: 52761 - protein, 9 aa, Homo sapiens
  light chain complementarity determining region 3 for antibody 26381
QQYGNLPVT

SEQ ID NO: 52762 - protein, 24 aa, Homo sapiens
  heavy chain complementarity determining region 3 for antibody 26381
ARCRYHHHAFWNGPGSFYYYAMDV

SEQ ID NO: 52763 - protein, 10 aa, Homo sapiens
  light chain complementarity determining region 3 for antibody 26382
QQYGGTPSVT

SEQ ID NO: 52764 - protein, 14 aa, Homo sapiens
  heavy chain complementarity determining region 3 for antibody 26382
ARRSGTSWGYAFDI

SEQ ID NO: 52765 - protein, 9 aa, Homo sapiens
  light chain complementarity determining region 3 for antibody 26383
QQYFTSVRT

SEQ ID NO: 52766 - protein, 12 aa, Homo sapiens
  heavy chain complementarity determining region 3 for antibody 26383
VKDCGLGGSRDS

SEQ ID NO: 52767 - protein, 9 aa, Homo sapiens
  light chain complementarity determining region 3 for antibody 26384
QQYFTSLRT

SEQ ID NO: 52768 - protein, 12 aa, Homo sapiens
  heavy chain complementarity determining region 3 for antibody 26384
VKDCGLGGSRDS

SEQ ID NO: 52769 - protein, 9 aa, Homo sapiens
  light chain complementarity determining region 3 for antibody 26385
QQYDTYSWT

SEQ ID NO: 52770 - protein, 16 aa, Homo sapiens
  heavy chain complementarity determining region 3 for antibody 26385
ASLGGAHYYGSGSHYF

SEQ ID NO: 52771 - protein, 9 aa, Homo sapiens
  light chain complementarity determining region 3 for antibody 26386
QQYDTYPWT

SEQ ID NO: 52772 - protein, 17 aa, Homo sapiens
  heavy chain complementarity determining region 3 for antibody 26386
VRRGGGLPDDRDYGLDV

SEQ ID NO: 52773 - protein, 9 aa, Homo sapiens
  light chain complementarity determining region 3 for antibody 26387
QQYDTSSRT

SEQ ID NO: 52774 - protein, 17 aa, Homo sapiens
  heavy chain complementarity determining region 3 for antibody 26387
ARGGRYDFWSRYSGIDN

SEQ ID NO: 52775 - protein, 9 aa, Homo sapiens
  light chain complementarity determining region 3 for antibody 26388
QQYDNWPRT

SEQ ID NO: 52776 - protein, 17 aa, Homo sapiens
  heavy chain complementarity determining region 3 for antibody 26388
ARDPSCSGNGCYSYFEH

SEQ ID NO: 52777 - protein, 9 aa, Homo sapiens
  light chain complementarity determining region 3 for antibody 26389
QQYDNLPYT

SEQ ID NO: 52778 - protein, 17 aa, Homo sapiens
  heavy chain complementarity determining region 3 for antibody 26389
ARLSRTGYSSSWYYRDY

SEQ ID NO: 52779 - protein, 9 aa, Homo sapiens
  light chain complementarity determining region 3 for antibody 26390
QQYDNLPRT

SEQ ID NO: 52780 - protein, 16 aa, Homo sapiens
  heavy chain complementarity determining region 3 for antibody 26390
ITIGTVSPWVYYALDV

SEQ ID NO: 52781 - protein, 10 aa, Homo sapiens
  light chain complementarity determining region 3 for antibody 26391
QQYDNLPPFT

SEQ ID NO: 52782 - protein, 17 aa, Homo sapiens
  heavy chain complementarity determining region 3 for antibody 26391
VRDHSESSVIPSDGFDF

SEQ ID NO: 52783 - protein, 9 aa, Homo sapiens
  light chain complementarity determining region 3 for antibody 26392
QQYDNLPIT

SEQ ID NO: 52784 - protein, 14 aa, Homo sapiens
  heavy chain complementarity determining region 3 for antibody 26392
ARHTSMAGLRGFDQ

SEQ ID NO: 52785 - protein, 9 aa, Homo sapiens
  light chain complementarity determining region 3 for antibody 26393
QQYDGYSVS

SEQ ID NO: 52786 - protein, 11 aa, Homo sapiens
  heavy chain complementarity determining region 3 for antibody 26393
ARGNSGYHIDY

SEQ ID NO: 52787 - protein, 9 aa, Homo sapiens
  light chain complementarity determining region 3 for antibody 26394
QQYDAQSWK

SEQ ID NO: 52788 - protein, 11 aa, Homo sapiens
  heavy chain complementarity determining region 3 for antibody 26394
ARGWRDNSFDY

SEQ ID NO: 52789 - protein, 9 aa, Homo sapiens
  light chain complementarity determining region 3 for antibody 26395
QQYCTPPIT

SEQ ID NO: 52790 - protein, 8 aa, Homo sapiens
  heavy chain complementarity determining region 3 for antibody 26395
VKLSDGIK

SEQ ID NO: 52791 - protein, 9 aa, Homo sapiens
  light chain complementarity determining region 3 for antibody 26396
QQYAYLPIT

SEQ ID NO: 52792 - protein, 10 aa, Homo sapiens
  heavy chain complementarity determining region 3 for antibody 26396
ATGAGWLVDY

SEQ ID NO: 52793 - protein, 9 aa, Homo sapiens
  light chain complementarity determining region 3 for antibody 26397
QQYAGAPRT

SEQ ID NO: 52794 - protein, 14 aa, Homo sapiens
  heavy chain complementarity determining region 3 for antibody 26397
TRDGDNFLCGNYHY

SEQ ID NO: 52795 - protein, 9 aa, Homo sapiens
  light chain complementarity determining region 3 for antibody 26398
QQYAGAPRP

SEQ ID NO: 52796 - protein, 14 aa, Homo sapiens
  heavy chain complementarity determining region 3 for antibody 26398
TRDGDNFLWGNYHY

SEQ ID NO: 52797 - protein, 9 aa, Homo sapiens
  light chain complementarity determining region 3 for antibody 26399
QQVHIYPFP

SEQ ID NO: 52798 - protein, 12 aa, Homo sapiens
  heavy chain complementarity determining region 3 for antibody 26399
ARPLDGDFGFDP

SEQ ID NO: 52799 - protein, 9 aa, Homo sapiens
  light chain complementarity determining region 3 for antibody 26400
QQVHIFPFT

SEQ ID NO: 52800 - protein, 12 aa, Homo sapiens
  heavy chain complementarity determining region 3 for antibody 26400
ARPLDGDFGFDP

SEQ ID NO: 52801 - protein, 10 aa, Homo sapiens
  light chain complementarity determining region 3 for antibody 26401
QQTYSTPLST

SEQ ID NO: 52802 - protein, 16 aa, Homo sapiens
  heavy chain complementarity determining region 3 for antibody 26401
ARGPDGDSDNSAYLDH

SEQ ID NO: 52803 - protein, 9 aa, Homo sapiens
  light chain complementarity determining region 3 for antibody 26402
QQTETFPHT

SEQ ID NO: 52804 - protein, 13 aa, Homo sapiens
  heavy chain complementarity determining region 3 for antibody 26402
AVSRTGDGDASDI

SEQ ID NO: 52805 - protein, 9 aa, Homo sapiens
  light chain complementarity determining region 3 for antibody 26403
QQSYSTPWT

SEQ ID NO: 52806 - protein, 19 aa, Homo sapiens
  heavy chain complementarity determining region 3 for antibody 26403
ARQDLKVINNYATTPYFDY

SEQ ID NO: 52807 - protein, 9 aa, Homo sapiens
  light chain complementarity determining region 3 for antibody 26404
QQSYSTPRT

SEQ ID NO: 52808 - protein, 20 aa, Homo sapiens
  heavy chain complementarity determining region 3 for antibody 26404
ARIMSYILERYRPKTPQFDS

SEQ ID NO: 52809 - protein, 9 aa, Homo sapiens
  light chain complementarity determining region 3 for antibody 26405
QQSYSTPLT

SEQ ID NO: 52810 - protein, 14 aa, Homo sapiens
  heavy chain complementarity determining region 3 for antibody 26405
AKGRDTSGYSAFDI

SEQ ID NO: 52811 - protein, 9 aa, Homo sapiens
  light chain complementarity determining region 3 for antibody 26406
QQSYSTPFP

SEQ ID NO: 52812 - protein, 15 aa, Homo sapiens
  heavy chain complementarity determining region 3 for antibody 26406
SRDADYGDYVGFLDY

SEQ ID NO: 52813 - protein, 9 aa, Homo sapiens
  light chain complementarity determining region 3 for antibody 26407
QQSYNTPRT

SEQ ID NO: 52814 - protein, 18 aa, Homo sapiens
  heavy chain complementarity determining region 3 for antibody 26407
ATDGAWDLHLPHGGYFDY

SEQ ID NO: 52815 - protein, 9 aa, Homo sapiens
  light chain complementarity determining region 3 for antibody 26408
QQSYIPPYT

SEQ ID NO: 52816 - protein, 19 aa, Homo sapiens
  heavy chain complementarity determining region 3 for antibody 26408
ATGRPPPMRLRDNYYGMDA

SEQ ID NO: 52817 - protein, 9 aa, Homo sapiens
  light chain complementarity determining region 3 for antibody 26409
QQSYGTPRT

SEQ ID NO: 52818 - protein, 14 aa, Homo sapiens
  heavy chain complementarity determining region 3 for antibody 26409
TTDSIGFRSGGMDV

SEQ ID NO: 52819 - protein, 9 aa, Homo sapiens
  light chain complementarity determining region 3 for antibody 26410
QQSHSPPLP

SEQ ID NO: 52820 - protein, 14 aa, Homo sapiens
  heavy chain complementarity determining region 3 for antibody 26410
ARDSQWLVQYGMDV

SEQ ID NO: 52821 - protein, 9 aa, Homo sapiens
  light chain complementarity determining region 3 for antibody 26411
QQSHNTPLT

SEQ ID NO: 52822 - protein, 22 aa, Homo sapiens
  heavy chain complementarity determining region 3 for antibody 26411
AREMFFDTGLSWRAPVRYYFDH

SEQ ID NO: 52823 - protein, 9 aa, Homo sapiens
  light chain complementarity determining region 3 for antibody 26412
QQSGSSPRT

SEQ ID NO: 52824 - protein, 25 aa, Homo sapiens
  heavy chain complementarity determining region 3 for antibody 26412
ARLRIDRLRLPGAMRGPLYDCGLNV

SEQ ID NO: 52825 - protein, 9 aa, Homo sapiens
  light chain complementarity determining region 3 for antibody 26413
QQSFNDPPT

SEQ ID NO: 52826 - protein, 18 aa, Homo sapiens
  heavy chain complementarity determining region 3 for antibody 26413
AREVDCWSGYVSFNCFEP

SEQ ID NO: 52827 - protein, 9 aa, Homo sapiens
  light chain complementarity determining region 3 for antibody 26414
QQSAHVPPT

SEQ ID NO: 52828 - protein, 14 aa, Homo sapiens
  heavy chain complementarity determining region 3 for antibody 26414
ARHSTGTESDHLDL

SEQ ID NO: 52829 - protein, 11 aa, Homo sapiens
  light chain complementarity determining region 3 for antibody 26415
QQRTSWPPKYT

SEQ ID NO: 52830 - protein, 23 aa, Homo sapiens
  heavy chain complementarity determining region 3 for antibody 26415
ARHPSRSPGQAPTPPDYYYGMDV

SEQ ID NO: 52831 - protein, 11 aa, Homo sapiens
  light chain complementarity determining region 3 for antibody 26416
QQRTNWPPSRT

SEQ ID NO: 52832 - protein, 9 aa, Homo sapiens
  heavy chain complementarity determining region 3 for antibody 26416
AKYDDSGEY

SEQ ID NO: 52833 - protein, 10 aa, Homo sapiens
  light chain complementarity determining region 3 for antibody 26417
QQRTDRPPDP

SEQ ID NO: 52834 - protein, 15 aa, Homo sapiens
  heavy chain complementarity determining region 3 for antibody 26417
ARLMGDWELPRGTDY

SEQ ID NO: 52835 - protein, 9 aa, Homo sapiens
  light chain complementarity determining region 3 for antibody 26418
QQRSSWPYP

SEQ ID NO: 52836 - protein, 11 aa, Homo sapiens
  heavy chain complementarity determining region 3 for antibody 26418
VKRWGGSSIDY

SEQ ID NO: 52837 - protein, 11 aa, Homo sapiens
  light chain complementarity determining region 3 for antibody 26419
QQRSSWPRLLT

SEQ ID NO: 52838 - protein, 19 aa, Homo sapiens
  heavy chain complementarity determining region 3 for antibody 26419
ARHDFRPASTYSSGWQSDF

SEQ ID NO: 52839 - protein, 10 aa, Homo sapiens
  light chain complementarity determining region 3 for antibody 26420
QQRSSWPPIT

SEQ ID NO: 52840 - protein, 15 aa, Homo sapiens
  heavy chain complementarity determining region 3 for antibody 26420
VRWGGSSSLPVPFDY

SEQ ID NO: 52841 - protein, 9 aa, Homo sapiens
  light chain complementarity determining region 3 for antibody 26421
QQRSSGPYT

SEQ ID NO: 52842 - protein, 11 aa, Homo sapiens
  heavy chain complementarity determining region 3 for antibody 26421
VKRWGGSSIDY

SEQ ID NO: 52843 - protein, 10 aa, Homo sapiens
  light chain complementarity determining region 3 for antibody 26422
QQRSNWPPYT

SEQ ID NO: 52844 - protein, 12 aa, Homo sapiens
  heavy chain complementarity determining region 3 for antibody 26422
ARVGQQRLRGYI

SEQ ID NO: 52845 - protein, 9 aa, Homo sapiens
  light chain complementarity determining region 3 for antibody 26423
QQRSNWPPT

SEQ ID NO: 52846 - protein, 11 aa, Homo sapiens
  heavy chain complementarity determining region 3 for antibody 26423
ARAQRLLSGRY

SEQ ID NO: 52847 - protein, 10 aa, Homo sapiens
  light chain complementarity determining region 3 for antibody 26424
QQRSNWPPST

SEQ ID NO: 52848 - protein, 13 aa, Homo sapiens
  heavy chain complementarity determining region 3 for antibody 26424
ARVGQQRLRGFDI

SEQ ID NO: 52849 - protein, 10 aa, Homo sapiens
  light chain complementarity determining region 3 for antibody 26425
QQRSNWPPIT

SEQ ID NO: 52850 - protein, 12 aa, Homo sapiens
  heavy chain complementarity determining region 3 for antibody 26425
ALPVGSYYGMDV

SEQ ID NO: 52851 - protein, 9 aa, Homo sapiens
  light chain complementarity determining region 3 for antibody 26426
QQRSNWPLT

SEQ ID NO: 52852 - protein, 12 aa, Homo sapiens
  heavy chain complementarity determining region 3 for antibody 26426
GTTADIVTGNDY

SEQ ID NO: 52853 - protein, 9 aa, Homo sapiens
  light chain complementarity determining region 3 for antibody 26427
QQRSAWPIT

SEQ ID NO: 52854 - protein, 20 aa, Homo sapiens
  heavy chain complementarity determining region 3 for antibody 26427
ARGGHIVVVTSIGDQAAFNV

SEQ ID NO: 52855 - protein, 9 aa, Homo sapiens
  light chain complementarity determining region 3 for antibody 26428
QQRHNWPWT

SEQ ID NO: 52856 - protein, 17 aa, Homo sapiens
  heavy chain complementarity determining region 3 for antibody 26428
VVPQFSRTDWPTDPSDY

SEQ ID NO: 52857 - protein, 9 aa, Homo sapiens
  light chain complementarity determining region 3 for antibody 26429
QQRGNWHLT

SEQ ID NO: 52858 - protein, 16 aa, Homo sapiens
  heavy chain complementarity determining region 3 for antibody 26429
ATEITMVRGVIKKFDY

SEQ ID NO: 52859 - protein, 9 aa, Homo sapiens
  light chain complementarity determining region 3 for antibody 26430
QQRDSTPLT

SEQ ID NO: 52860 - protein, 14 aa, Homo sapiens
  heavy chain complementarity determining region 3 for antibody 26430
AKAIAPSGWYYFDY

SEQ ID NO: 52861 - protein, 8 aa, Homo sapiens
  light chain complementarity determining region 3 for antibody 26431
QQRANWVP

SEQ ID NO: 52862 - protein, 14 aa, Homo sapiens
  heavy chain complementarity determining region 3 for antibody 26431
ARDASRASQYYFDY

SEQ ID NO: 52863 - protein, 9 aa, Homo sapiens
  light chain complementarity determining region 3 for antibody 26432
QQNISYPWT

SEQ ID NO: 52864 - protein, 19 aa, Homo sapiens
  heavy chain complementarity determining region 3 for antibody 26432
ARVSARRILTAPRYPLIDS

SEQ ID NO: 52865 - protein, 7 aa, Homo sapiens
  light chain complementarity determining region 3 for antibody 26433
QQNGSWA

SEQ ID NO: 52866 - protein, 11 aa, Homo sapiens
  heavy chain complementarity determining region 3 for antibody 26433
AVVDTTLAMPK

SEQ ID NO: 52867 - protein, 9 aa, Homo sapiens
  light chain complementarity determining region 3 for antibody 26434
QQNGNSPWT

SEQ ID NO: 52868 - protein, 17 aa, Homo sapiens
  heavy chain complementarity determining region 3 for antibody 26434
ALASVAAPGRIQWYFDL

SEQ ID NO: 52869 - protein, 6 aa, Homo sapiens
  light chain complementarity determining region 3 for antibody 26435
QQNGGT

SEQ ID NO: 52870 - protein, 12 aa, Homo sapiens
  heavy chain complementarity determining region 3 for antibody 26435
AKLVNSWYPYDY

SEQ ID NO: 52871 - protein, 8 aa, Homo sapiens
  light chain complementarity determining region 3 for antibody 26436
QQNDKLYT

SEQ ID NO: 52872 - protein, 13 aa, Homo sapiens
  heavy chain complementarity determining region 3 for antibody 26436
VTGGIYTTGPLDF

SEQ ID NO: 52873 - protein, 9 aa, Homo sapiens
  light chain complementarity determining region 3 for antibody 26437
QQHYSTQGT

SEQ ID NO: 52874 - protein, 15 aa, Homo sapiens
  heavy chain complementarity determining region 3 for antibody 26437
AKDLQSLEYYGVFDY

SEQ ID NO: 52875 - protein, 8 aa, Homo sapiens
  light chain complementarity determining region 3 for antibody 26438
QQGNSYPR

SEQ ID NO: 52876 - protein, 20 aa, Homo sapiens
  heavy chain complementarity determining region 3 for antibody 26438
ARDGAVIAPRTRGPGFYFDS

SEQ ID NO: 52877 - protein, 9 aa, Homo sapiens
  light chain complementarity determining region 3 for antibody 26439
QQGNNFPIS

SEQ ID NO: 52878 - protein, 14 aa, Homo sapiens
  heavy chain complementarity determining region 3 for antibody 26439
ARTIVGATFNAFDK

SEQ ID NO: 52879 - protein, 9 aa, Homo sapiens
  light chain complementarity determining region 3 for antibody 26440
QQFNDYPLT

SEQ ID NO: 52880 - protein, 10 aa, Homo sapiens
  heavy chain complementarity determining region 3 for antibody 26440
ARDPYGRGGY

SEQ ID NO: 52881 - protein, 10 aa, Homo sapiens
  light chain complementarity determining region 3 for antibody 26441
QQFGNSPLYP

SEQ ID NO: 52882 - protein, 23 aa, Homo sapiens
  heavy chain complementarity determining region 3 for antibody 26441
ARGRREYFWGSYRNAPYYYGMEI

SEQ ID NO: 52883 - protein, 9 aa, Homo sapiens
  light chain complementarity determining region 3 for antibody 26442
QQFGGAPRP

SEQ ID NO: 52884 - protein, 16 aa, Homo sapiens
  heavy chain complementarity determining region 3 for antibody 26442
ARDPRGGVAVPADFNY

SEQ ID NO: 52885 - protein, 9 aa, Homo sapiens
  light chain complementarity determining region 3 for antibody 26443
QQFGGAPRA

SEQ ID NO: 52886 - protein, 16 aa, Homo sapiens
  heavy chain complementarity determining region 3 for antibody 26443
ARDPRGGVAVPADFNY

SEQ ID NO: 52887 - protein, 9 aa, Homo sapiens
  light chain complementarity determining region 3 for antibody 26444
QQFFSPPPT

SEQ ID NO: 52888 - protein, 13 aa, Homo sapiens
  heavy chain complementarity determining region 3 for antibody 26444
AKWGFTEYNWFDP

SEQ ID NO: 52889 - protein, 9 aa, Homo sapiens
  light chain complementarity determining region 3 for antibody 26445
QQDGSSPYA

SEQ ID NO: 52890 - protein, 13 aa, Homo sapiens
  heavy chain complementarity determining region 3 for antibody 26445
ARALQYSGRIFDY

SEQ ID NO: 52891 - protein, 9 aa, Homo sapiens
  light chain complementarity determining region 3 for antibody 26446
QQDGSSPPT

SEQ ID NO: 52892 - protein, 12 aa, Homo sapiens
  heavy chain complementarity determining region 3 for antibody 26446
VVGYSSGWYEVD

SEQ ID NO: 52893 - protein, 9 aa, Homo sapiens
  light chain complementarity determining region 3 for antibody 26447
QQDGSSPLT

SEQ ID NO: 52894 - protein, 17 aa, Homo sapiens
  heavy chain complementarity determining region 3 for antibody 26447
ARAPAPYRSDWRDPFDI

SEQ ID NO: 52895 - protein, 9 aa, Homo sapiens
  light chain complementarity determining region 3 for antibody 26448
QQDGRSPLT

SEQ ID NO: 52896 - protein, 11 aa, Homo sapiens
  heavy chain complementarity determining region 3 for antibody 26448
AREGNYKPHDY

SEQ ID NO: 52897 - protein, 9 aa, Homo sapiens
  light chain complementarity determining region 3 for antibody 26449
QQDGGSTGT

SEQ ID NO: 52898 - protein, 15 aa, Homo sapiens
  heavy chain complementarity determining region 3 for antibody 26449
ARGGRGPGMAHCFDL

SEQ ID NO: 52899 - protein, 9 aa, Homo sapiens
  light chain complementarity determining region 3 for antibody 26450
QQDDSSPFT

SEQ ID NO: 52900 - protein, 17 aa, Homo sapiens
  heavy chain complementarity determining region 3 for antibody 26450
ARDRGSSWYSGAEHFQY

SEQ ID NO: 52901 - protein, 9 aa, Homo sapiens
  light chain complementarity determining region 3 for antibody 26451
QQDDGLTLT

SEQ ID NO: 52902 - protein, 12 aa, Homo sapiens
  heavy chain complementarity determining region 3 for antibody 26451
ARALWPWNGFDI

SEQ ID NO: 52903 - protein, 9 aa, Homo sapiens
  light chain complementarity determining region 3 for antibody 26452
QQDATSPLT

SEQ ID NO: 52904 - protein, 10 aa, Homo sapiens
  heavy chain complementarity determining region 3 for antibody 26452
TTGGGWLVDY

SEQ ID NO: 52905 - protein, 9 aa, Homo sapiens
  light chain complementarity determining region 3 for antibody 26453
QQCATAPLT

SEQ ID NO: 52906 - protein, 10 aa, Homo sapiens
  heavy chain complementarity determining region 3 for antibody 26453
AWGFGWSSDY

SEQ ID NO: 52907 - protein, 7 aa, Homo sapiens
  light chain complementarity determining region 3 for antibody 26454
QQANSFT

SEQ ID NO: 52908 - protein, 18 aa, Homo sapiens
  heavy chain complementarity determining region 3 for antibody 26454
AKAEWELQIFSGAVWFDS

SEQ ID NO: 52909 - protein, 9 aa, Homo sapiens
  light chain complementarity determining region 3 for antibody 26455
QQANSFPPT

SEQ ID NO: 52910 - protein, 15 aa, Homo sapiens
  heavy chain complementarity determining region 3 for antibody 26455
ARGGYGGSLYWYFDL

SEQ ID NO: 52911 - protein, 9 aa, Homo sapiens
  light chain complementarity determining region 3 for antibody 26456
QPYYTTPRT

SEQ ID NO: 52912 - protein, 8 aa, Homo sapiens
  heavy chain complementarity determining region 3 for antibody 26456
ARDGAFDS

SEQ ID NO: 52913 - protein, 9 aa, Homo sapiens
  light chain complementarity determining region 3 for antibody 26457
QPYYTSVRT

SEQ ID NO: 52914 - protein, 12 aa, Homo sapiens
  heavy chain complementarity determining region 3 for antibody 26457
VKDCGLGGSRDS

SEQ ID NO: 52915 - protein, 10 aa, Homo sapiens
  light chain complementarity determining region 3 for antibody 26458
QLYSRSPTRT

SEQ ID NO: 52916 - protein, 19 aa, Homo sapiens
  heavy chain complementarity determining region 3 for antibody 26458
ARESYYPDIGGYTPRAFDI

SEQ ID NO: 52917 - protein, 10 aa, Homo sapiens
  light chain complementarity determining region 3 for antibody 26459
QLYSRSPPWT

SEQ ID NO: 52918 - protein, 19 aa, Homo sapiens
  heavy chain complementarity determining region 3 for antibody 26459
ARESYYPDIGGYTPRAFDI

SEQ ID NO: 52919 - protein, 11 aa, Homo sapiens
  light chain complementarity determining region 3 for antibody 26460
QLYERSLPMSS

SEQ ID NO: 52920 - protein, 14 aa, Homo sapiens
  heavy chain complementarity determining region 3 for antibody 26460
ASHIVINGKRGFDH

SEQ ID NO: 52921 - protein, 10 aa, Homo sapiens
  light chain complementarity determining region 3 for antibody 26461
QLDSRSPTWT

SEQ ID NO: 52922 - protein, 19 aa, Homo sapiens
  heavy chain complementarity determining region 3 for antibody 26461
ARESYYPDIGGYTPRAFDI

SEQ ID NO: 52923 - protein, 9 aa, Homo sapiens
  light chain complementarity determining region 3 for antibody 26462
QKYNSAPWT

SEQ ID NO: 52924 - protein, 11 aa, Homo sapiens
  heavy chain complementarity determining region 3 for antibody 26462
AKDDAAGSIDS

SEQ ID NO: 52925 - protein, 10 aa, Homo sapiens
  light chain complementarity determining region 3 for antibody 26463
QKYNSAPLIT

SEQ ID NO: 52926 - protein, 20 aa, Homo sapiens
  heavy chain complementarity determining region 3 for antibody 26463
ARGTVTPSDDFTSPELVFDY

SEQ ID NO: 52927 - protein, 9 aa, Homo sapiens
  light chain complementarity determining region 3 for antibody 26464
QKYNSAPLA

SEQ ID NO: 52928 - protein, 18 aa, Homo sapiens
  heavy chain complementarity determining region 3 for antibody 26464
ARDEEDSTGWYTGWYFGL

SEQ ID NO: 52929 - protein, 8 aa, Homo sapiens
  light chain complementarity determining region 3 for antibody 26465
QKYGSSPL

SEQ ID NO: 52930 - protein, 14 aa, Homo sapiens
  heavy chain complementarity determining region 3 for antibody 26465
ARDMWDVGDTPPAY

SEQ ID NO: 52931 - protein, 9 aa, Homo sapiens
  light chain complementarity determining region 3 for antibody 26466
QKYGSLPLT

SEQ ID NO: 52932 - protein, 15 aa, Homo sapiens
  heavy chain complementarity determining region 3 for antibody 26466
AHRPNYYDKAGAFDI

SEQ ID NO: 52933 - protein, 9 aa, Homo sapiens
  light chain complementarity determining region 3 for antibody 26467
QKYDSAPRT

SEQ ID NO: 52934 - protein, 12 aa, Homo sapiens
  heavy chain complementarity determining region 3 for antibody 26467
AKGSTYDPTFDF

SEQ ID NO: 52935 - protein, 9 aa, Homo sapiens
  light chain complementarity determining region 3 for antibody 26468
QKNGSSPRP

SEQ ID NO: 52936 - protein, 13 aa, Homo sapiens
  heavy chain complementarity determining region 3 for antibody 26468
ARGEYVSGNYEEN

SEQ ID NO: 52937 - protein, 10 aa, Homo sapiens
  light chain complementarity determining region 3 for antibody 26469
QHYVSPPAST

SEQ ID NO: 52938 - protein, 12 aa, Homo sapiens
  heavy chain complementarity determining region 3 for antibody 26469
ARETTRFGELDY

SEQ ID NO: 52939 - protein, 11 aa, Homo sapiens
  light chain complementarity determining region 3 for antibody 26470
QHYSGSPPTYT

SEQ ID NO: 52940 - protein, 10 aa, Homo sapiens
  heavy chain complementarity determining region 3 for antibody 26470
ASSGWNGFDF

SEQ ID NO: 52941 - protein, 9 aa, Homo sapiens
  light chain complementarity determining region 3 for antibody 26471
QHYRRYPIT

SEQ ID NO: 52942 - protein, 18 aa, Homo sapiens
  heavy chain complementarity determining region 3 for antibody 26471
MINPYYYGAWHYKGDFDI

SEQ ID NO: 52943 - protein, 11 aa, Homo sapiens
  light chain complementarity determining region 3 for antibody 26472
QHYGTSPALYT

SEQ ID NO: 52944 - protein, 16 aa, Homo sapiens
  heavy chain complementarity determining region 3 for antibody 26472
ATPYLAVSGPLDAFDI

SEQ ID NO: 52945 - protein, 11 aa, Homo sapiens
  light chain complementarity determining region 3 for antibody 26473
QHYGSSPPMYP

SEQ ID NO: 52946 - protein, 10 aa, Homo sapiens
  heavy chain complementarity determining region 3 for antibody 26473
VSNGYYCLEY

SEQ ID NO: 52947 - protein, 11 aa, Homo sapiens
  light chain complementarity determining region 3 for antibody 26474
QHYGISPPHWA

SEQ ID NO: 52948 - protein, 12 aa, Homo sapiens
  heavy chain complementarity determining region 3 for antibody 26474
VKEKGGVRVFDF

SEQ ID NO: 52949 - protein, 9 aa, Homo sapiens
  light chain complementarity determining region 3 for antibody 26475
QHSHSRPFT

SEQ ID NO: 52950 - protein, 20 aa, Homo sapiens
  heavy chain complementarity determining region 3 for antibody 26475
AKGISVAALRTVYYYYDMDV

SEQ ID NO: 52951 - protein, 11 aa, Homo sapiens
  light chain complementarity determining region 3 for antibody 26476
QHRSNWPPGDT

SEQ ID NO: 52952 - protein, 14 aa, Homo sapiens
  heavy chain complementarity determining region 3 for antibody 26476
AREGSDWGLGWFDP

SEQ ID NO: 52953 - protein, 9 aa, Homo sapiens
  light chain complementarity determining region 3 for antibody 26477
QHFGTSLIT

SEQ ID NO: 52954 - protein, 22 aa, Homo sapiens
  heavy chain complementarity determining region 3 for antibody 26477
ARYCPGGPCSSLADSYKYGMDV

SEQ ID NO: 52955 - protein, 11 aa, Homo sapiens
  light chain complementarity determining region 3 for antibody 26478
QGYGASPPMSP

SEQ ID NO: 52956 - protein, 12 aa, Homo sapiens
  heavy chain complementarity determining region 3 for antibody 26478
AKDLHGSGSFDH

SEQ ID NO: 52957 - protein, 10 aa, Homo sapiens
  light chain complementarity determining region 3 for antibody 26479
QESYSTPSTT

SEQ ID NO: 52958 - protein, 16 aa, Homo sapiens
  heavy chain complementarity determining region 3 for antibody 26479
AKAKNSVTFGGVIIDH

SEQ ID NO: 52959 - protein, 9 aa, Homo sapiens
  light chain complementarity determining region 3 for antibody 26480
PQRSSWPYT

SEQ ID NO: 52960 - protein, 11 aa, Homo sapiens
  heavy chain complementarity determining region 3 for antibody 26480
VKRWGGSSIDY

SEQ ID NO: 52961 - protein, 9 aa, Homo sapiens
  light chain complementarity determining region 3 for antibody 26481
MQVLQTPPT

SEQ ID NO: 52962 - protein, 12 aa, Homo sapiens
  heavy chain complementarity determining region 3 for antibody 26481
AKDSEQKWELHD

SEQ ID NO: 52963 - protein, 10 aa, Homo sapiens
  light chain complementarity determining region 3 for antibody 26482
MQSIQPPRRT

SEQ ID NO: 52964 - protein, 8 aa, Homo sapiens
  heavy chain complementarity determining region 3 for antibody 26482
AKGYGFDC

SEQ ID NO: 52965 - protein, 9 aa, Homo sapiens
  light chain complementarity determining region 3 for antibody 26483
MQPLHTPFT

SEQ ID NO: 52966 - protein, 18 aa, Homo sapiens
  heavy chain complementarity determining region 3 for antibody 26483
ARPFYDSYTYHYYYGLDV

SEQ ID NO: 52967 - protein, 9 aa, Homo sapiens
  light chain complementarity determining region 3 for antibody 26484
MQILQTPFT

SEQ ID NO: 52968 - protein, 12 aa, Homo sapiens
  heavy chain complementarity determining region 3 for antibody 26484
ARDGGSSWSEFT

SEQ ID NO: 52969 - protein, 9 aa, Homo sapiens
  light chain complementarity determining region 3 for antibody 26485
MQGTRWPYT

SEQ ID NO: 52970 - protein, 10 aa, Homo sapiens
  heavy chain complementarity determining region 3 for antibody 26485
ARNSWWSVDC

SEQ ID NO: 52971 - protein, 9 aa, Homo sapiens
  light chain complementarity determining region 3 for antibody 26486
MQGTQWPYS

SEQ ID NO: 52972 - protein, 11 aa, Homo sapiens
  heavy chain complementarity determining region 3 for antibody 26486
GRGDRAGSIDY

SEQ ID NO: 52973 - protein, 9 aa, Homo sapiens
  light chain complementarity determining region 3 for antibody 26487
MQGTHWPYT

SEQ ID NO: 52974 - protein, 10 aa, Homo sapiens
  heavy chain complementarity determining region 3 for antibody 26487
ARDNWGSLDY

SEQ ID NO: 52975 - protein, 11 aa, Homo sapiens
  light chain complementarity determining region 3 for antibody 26488
MQGTHWLTPGV

SEQ ID NO: 52976 - protein, 19 aa, Homo sapiens
  heavy chain complementarity determining region 3 for antibody 26488
ARDGGPIVLMGFAIYGMDV

SEQ ID NO: 52977 - protein, 9 aa, Homo sapiens
  light chain complementarity determining region 3 for antibody 26489
MQGTHRPPT

SEQ ID NO: 52978 - protein, 18 aa, Homo sapiens
  heavy chain complementarity determining region 3 for antibody 26489
ARPPISGTYAFYYYGLGG

SEQ ID NO: 52979 - protein, 10 aa, Homo sapiens
  light chain complementarity determining region 3 for antibody 26490
MQGTHGPPWT

SEQ ID NO: 52980 - protein, 17 aa, Homo sapiens
  heavy chain complementarity determining region 3 for antibody 26490
VRDGYTASGRRNAPGAN

SEQ ID NO: 52981 - protein, 10 aa, Homo sapiens
  light chain complementarity determining region 3 for antibody 26491
MQGTHGPLWT

SEQ ID NO: 52982 - protein, 12 aa, Homo sapiens
  heavy chain complementarity determining region 3 for antibody 26491
TTGLNWGWEPDY

SEQ ID NO: 52983 - protein, 10 aa, Homo sapiens
  light chain complementarity determining region 3 for antibody 26492
MQGTDWPQGT

SEQ ID NO: 52984 - protein, 9 aa, Homo sapiens
  heavy chain complementarity determining region 3 for antibody 26492
TRDDWGFDF

SEQ ID NO: 52985 - protein, 10 aa, Homo sapiens
  light chain complementarity determining region 3 for antibody 26493
MQGSYWPPWT

SEQ ID NO: 52986 - protein, 11 aa, Homo sapiens
  heavy chain complementarity determining region 3 for antibody 26493
ARDAPGVGIDY

SEQ ID NO: 52987 - protein, 9 aa, Homo sapiens
  light chain complementarity determining region 3 for antibody 26494
MQGLRTPYI

SEQ ID NO: 52988 - protein, 17 aa, Homo sapiens
  heavy chain complementarity determining region 3 for antibody 26494
ARWYYYDSSGYYSHFDY

SEQ ID NO: 52989 - protein, 9 aa, Homo sapiens
  light chain complementarity determining region 3 for antibody 26495
MQGLQTPNT

SEQ ID NO: 52990 - protein, 15 aa, Homo sapiens
  heavy chain complementarity determining region 3 for antibody 26495
ARDVMTTLTRGWLDP

SEQ ID NO: 52991 - protein, 9 aa, Homo sapiens
  light chain complementarity determining region 3 for antibody 26496
MQGAHWPST

SEQ ID NO: 52992 - protein, 11 aa, Homo sapiens
  heavy chain complementarity determining region 3 for antibody 26496
ATVRLVGAVDY

SEQ ID NO: 52993 - protein, 9 aa, Homo sapiens
  light chain complementarity determining region 3 for antibody 26497
MQGAHWPPS

SEQ ID NO: 52994 - protein, 13 aa, Homo sapiens
  heavy chain complementarity determining region 3 for antibody 26497
VRDRGDGYNQIDH

SEQ ID NO: 52995 - protein, 9 aa, Homo sapiens
  light chain complementarity determining region 3 for antibody 26498
MQCREWPCT

SEQ ID NO: 52996 - protein, 20 aa, Homo sapiens
  heavy chain complementarity determining region 3 for antibody 26498
ARDGDYGDSAWDGDRDAYGI

SEQ ID NO: 52997 - protein, 9 aa, Homo sapiens
  light chain complementarity determining region 3 for antibody 26499
MQARQTPGT

SEQ ID NO: 52998 - protein, 27 aa, Homo sapiens
  heavy chain complementarity determining region 3 for antibody 26499
AAALLGASDPYGRSSSGMRGWGYGLDV

SEQ ID NO: 52999 - protein, 8 aa, Homo sapiens
  light chain complementarity determining region 3 for antibody 26500
MQALRGFP

SEQ ID NO: 53000 - protein, 14 aa, Homo sapiens
  heavy chain complementarity determining region 3 for antibody 26500
AYNSPTVLTPGFDY

SEQ ID NO: 53001 - protein, 9 aa, Homo sapiens
  light chain complementarity determining region 3 for antibody 26501
MQALQTGWT

SEQ ID NO: 53002 - protein, 14 aa, Homo sapiens
  heavy chain complementarity determining region 3 for antibody 26501
ARSADTGLSSSLDD

SEQ ID NO: 53003 - protein, 9 aa, Homo sapiens
  light chain complementarity determining region 3 for antibody 26502
MQALKTRFT

SEQ ID NO: 53004 - protein, 12 aa, Homo sapiens
  heavy chain complementarity determining region 3 for antibody 26502
SKMVGWTYGMDV

SEQ ID NO: 53005 - protein, 9 aa, Homo sapiens
  light chain complementarity determining region 3 for antibody 26503
MQALETPFT

SEQ ID NO: 53006 - protein, 15 aa, Homo sapiens
  heavy chain complementarity determining region 3 for antibody 26503
LRHYRSLVTGTEADS

SEQ ID NO: 53007 - protein, 9 aa, Homo sapiens
  light chain complementarity determining region 3 for antibody 26504
MQALETPFP

SEQ ID NO: 53008 - protein, 15 aa, Homo sapiens
  heavy chain complementarity determining region 3 for antibody 26504
VRHYRELATGIEGDS

SEQ ID NO: 53009 - protein, 10 aa, Homo sapiens
  light chain complementarity determining region 3 for antibody 26505
MESLQTPQPS

SEQ ID NO: 53010 - protein, 12 aa, Homo sapiens
  heavy chain complementarity determining region 3 for antibody 26505
ARLSYELFAFDI

SEQ ID NO: 53011 - protein, 9 aa, Homo sapiens
  light chain complementarity determining region 3 for antibody 26506
LQYYATPWP

SEQ ID NO: 53012 - protein, 15 aa, Homo sapiens
  heavy chain complementarity determining region 3 for antibody 26506
VRQSKVDNNYNYPDF

SEQ ID NO: 53013 - protein, 10 aa, Homo sapiens
  light chain complementarity determining region 3 for antibody 26507
LQYNNWPPWT

SEQ ID NO: 53014 - protein, 16 aa, Homo sapiens
  heavy chain complementarity determining region 3 for antibody 26507
VTPVSPWMTATGPFDY

SEQ ID NO: 53015 - protein, 9 aa, Homo sapiens
  light chain complementarity determining region 3 for antibody 26508
LQYGLAQYS

SEQ ID NO: 53016 - protein, 18 aa, Homo sapiens
  heavy chain complementarity determining region 3 for antibody 26508
TGVHGLTMLRGATKPFDF

SEQ ID NO: 53017 - protein, 9 aa, Homo sapiens
  light chain complementarity determining region 3 for antibody 26509
LQRTHWPRG

SEQ ID NO: 53018 - protein, 18 aa, Homo sapiens
  heavy chain complementarity determining region 3 for antibody 26509
ARDRYSCDSGGCFHWFDP

SEQ ID NO: 53019 - protein, 9 aa, Homo sapiens
  light chain complementarity determining region 3 for antibody 26510
LQNGYWPRT

SEQ ID NO: 53020 - protein, 11 aa, Homo sapiens
  heavy chain complementarity determining region 3 for antibody 26510
VRVGGAGYFDH

SEQ ID NO: 53021 - protein, 9 aa, Homo sapiens
  light chain complementarity determining region 3 for antibody 26511
LQNEYWPRP

SEQ ID NO: 53022 - protein, 11 aa, Homo sapiens
  heavy chain complementarity determining region 3 for antibody 26511
VRVGGAGYFDH

SEQ ID NO: 53023 - protein, 9 aa, Homo sapiens
  light chain complementarity determining region 3 for antibody 26512
LQGNSFPHT

SEQ ID NO: 53024 - protein, 14 aa, Homo sapiens
  heavy chain complementarity determining region 3 for antibody 26512
ARYCSGNSCYSMDH

SEQ ID NO: 53025 - protein, 9 aa, Homo sapiens
  light chain complementarity determining region 3 for antibody 26513
HQYYSSPRR

SEQ ID NO: 53026 - protein, 13 aa, Homo sapiens
  heavy chain complementarity determining region 3 for antibody 26513
ARGQSGDPRTYDY

SEQ ID NO: 53027 - protein, 10 aa, Homo sapiens
  light chain complementarity determining region 3 for antibody 26514
HQYVTSPPWT

SEQ ID NO: 53028 - protein, 16 aa, Homo sapiens
  heavy chain complementarity determining region 3 for antibody 26514
ARRQWVRGLFRGGLDY

SEQ ID NO: 53029 - protein, 9 aa, Homo sapiens
  light chain complementarity determining region 3 for antibody 26515
HQYNTLPYT

SEQ ID NO: 53030 - protein, 6 aa, Homo sapiens
  heavy chain complementarity determining region 3 for antibody 26515
ATLSSS

SEQ ID NO: 53031 - protein, 10 aa, Homo sapiens
  light chain complementarity determining region 3 for antibody 26516
HQYGSSPPYP

SEQ ID NO: 53032 - protein, 14 aa, Homo sapiens
  heavy chain complementarity determining region 3 for antibody 26516
ARRGQWLVREAIDY

SEQ ID NO: 53033 - protein, 9 aa, Homo sapiens
  light chain complementarity determining region 3 for antibody 26517
HQYATSPWP

SEQ ID NO: 53034 - protein, 14 aa, Homo sapiens
  heavy chain complementarity determining region 3 for antibody 26517
ARFGWLDYYYGMDV

SEQ ID NO: 53035 - protein, 9 aa, Homo sapiens
  light chain complementarity determining region 3 for antibody 26518
HQYATSPGT

SEQ ID NO: 53036 - protein, 14 aa, Homo sapiens
  heavy chain complementarity determining region 3 for antibody 26518
ARFGWLDYYYGMDV

SEQ ID NO: 53037 - protein, 9 aa, Homo sapiens
  light chain complementarity determining region 3 for antibody 26519
HQSYNTWYT

SEQ ID NO: 53038 - protein, 12 aa, Homo sapiens
  heavy chain complementarity determining region 3 for antibody 26519
ARDLRPGGAFDI

SEQ ID NO: 53039 - protein, 9 aa, Homo sapiens
  light chain complementarity determining region 3 for antibody 26520
HQSSGFPGT

SEQ ID NO: 53040 - protein, 19 aa, Homo sapiens
  heavy chain complementarity determining region 3 for antibody 26520
ARDAAYSSTWYLVLYGMDV

SEQ ID NO: 53041 - protein, 9 aa, Homo sapiens
  light chain complementarity determining region 3 for antibody 26521
HQSRTFPVP

SEQ ID NO: 53042 - protein, 14 aa, Homo sapiens
  heavy chain complementarity determining region 3 for antibody 26521
IRQSKSDNWNYPDY

SEQ ID NO: 53043 - protein, 9 aa, Homo sapiens
  light chain complementarity determining region 3 for antibody 26522
HQSGSLPGT

SEQ ID NO: 53044 - protein, 8 aa, Homo sapiens
  heavy chain complementarity determining region 3 for antibody 26522
AVYSSLDY

SEQ ID NO: 53045 - protein, 9 aa, Homo sapiens
  light chain complementarity determining region 3 for antibody 26523
HQSGAFPWT

SEQ ID NO: 53046 - protein, 14 aa, Homo sapiens
  heavy chain complementarity determining region 3 for antibody 26523
VRDASGNSGWYADS

SEQ ID NO: 53047 - protein, 9 aa, Homo sapiens
  light chain complementarity determining region 3 for antibody 26524
HQHSNWPPT

SEQ ID NO: 53048 - protein, 14 aa, Homo sapiens
  heavy chain complementarity determining region 3 for antibody 26524
ARPSLAVGDYPPAH

SEQ ID NO: 53049 - protein, 9 aa, Homo sapiens
  light chain complementarity determining region 3 for antibody 26525
HQDASSPLT

SEQ ID NO: 53050 - protein, 10 aa, Homo sapiens
  heavy chain complementarity determining region 3 for antibody 26525
AKGGGWLTDY

SEQ ID NO: 53051 - protein, 8 aa, Homo sapiens
  light chain complementarity determining region 3 for antibody 26526
HKRVNGPL

SEQ ID NO: 53052 - protein, 13 aa, Homo sapiens
  heavy chain complementarity determining region 3 for antibody 26526
AKWGFTEYNWFDP

SEQ ID NO: 53053 - protein, 9 aa, Homo sapiens
  light chain complementarity determining region 3 for antibody 26527
HHYGASPRP

SEQ ID NO: 53054 - protein, 18 aa, Homo sapiens
  heavy chain complementarity determining region 3 for antibody 26527
AREVPDKRGSNSNPYADV

SEQ ID NO: 53055 - protein, 9 aa, Homo sapiens
  light chain complementarity determining region 3 for antibody 26528
HHYDNLPRT

SEQ ID NO: 53056 - protein, 18 aa, Homo sapiens
  heavy chain complementarity determining region 3 for antibody 26528
VTLPPQYCSGVNCYDVDY

SEQ ID NO: 53057 - protein, 9 aa, Homo sapiens
  light chain complementarity determining region 3 for antibody 26529
HHTYTFPRT

SEQ ID NO: 53058 - protein, 20 aa, Homo sapiens
  heavy chain complementarity determining region 3 for antibody 26529
ARGCRIAALSTAHYYYGMDV

SEQ ID NO: 53059 - protein, 9 aa, Homo sapiens
  light chain complementarity determining region 3 for antibody 26530
HHTYTFPRP

SEQ ID NO: 53060 - protein, 20 aa, Homo sapiens
  heavy chain complementarity determining region 3 for antibody 26530
ARGRRIAALSTAHYYYGMDV

SEQ ID NO: 53061 - protein, 9 aa, Homo sapiens
  light chain complementarity determining region 3 for antibody 26531
YQYGWSPRG

SEQ ID NO: 53062 - protein, 14 aa, Homo sapiens
  heavy chain complementarity determining region 3 for antibody 26531
AKDAGAVAVHYFDH

SEQ ID NO: 53063 - protein, 9 aa, Homo sapiens
  light chain complementarity determining region 3 for antibody 26532
YQDGWSPRA

SEQ ID NO: 53064 - protein, 14 aa, Homo sapiens
  heavy chain complementarity determining region 3 for antibody 26532
AKDAGAVAVHYFDH

SEQ ID NO: 53065 - protein, 9 aa, Homo sapiens
  light chain complementarity determining region 3 for antibody 26533
VQYHATPVT

SEQ ID NO: 53066 - protein, 9 aa, Homo sapiens
  heavy chain complementarity determining region 3 for antibody 26533
ATGVDADYV

SEQ ID NO: 53067 - protein, 9 aa, Homo sapiens
  light chain complementarity determining region 3 for antibody 26534
VQYHAPPVT

SEQ ID NO: 53068 - protein, 9 aa, Homo sapiens
  heavy chain complementarity determining region 3 for antibody 26534
ATGVDADYG

SEQ ID NO: 53069 - protein, 9 aa, Homo sapiens
  light chain complementarity determining region 3 for antibody 26535
VQSNRYPRT

SEQ ID NO: 53070 - protein, 6 aa, Homo sapiens
  heavy chain complementarity determining region 3 for antibody 26535
TRALDY

SEQ ID NO: 53071 - protein, 9 aa, Homo sapiens
  light chain complementarity determining region 3 for antibody 26536
VQALQTPYT

SEQ ID NO: 53072 - protein, 17 aa, Homo sapiens
  heavy chain complementarity determining region 3 for antibody 26536
ARSALDRVIVVVHAFDI

SEQ ID NO: 53073 - protein, 9 aa, Homo sapiens
  light chain complementarity determining region 3 for antibody 26537
SQRSIWPGT

SEQ ID NO: 53074 - protein, 9 aa, Homo sapiens
  heavy chain complementarity determining region 3 for antibody 26537
ARVLVAGGG

SEQ ID NO: 53075 - protein, 9 aa, Homo sapiens
  light chain complementarity determining region 3 for antibody 26538
RQYGSSLIT

SEQ ID NO: 53076 - protein, 13 aa, Homo sapiens
  heavy chain complementarity determining region 3 for antibody 26538
ARGSGSHQDECDY

SEQ ID NO: 53077 - protein, 9 aa, Homo sapiens
  light chain complementarity determining region 3 for antibody 26539
RQSRRWPHT

SEQ ID NO: 53078 - protein, 8 aa, Homo sapiens
  heavy chain complementarity determining region 3 for antibody 26539
TAWGSSHH

SEQ ID NO: 53079 - protein, 9 aa, Homo sapiens
  light chain complementarity determining region 3 for antibody 26540
RQNEYWPRT

SEQ ID NO: 53080 - protein, 11 aa, Homo sapiens
  heavy chain complementarity determining region 3 for antibody 26540
VRVGGAGYFDH

SEQ ID NO: 53081 - protein, 9 aa, Homo sapiens
  light chain complementarity determining region 3 for antibody 26541
RQALQTRFT

SEQ ID NO: 53082 - protein, 12 aa, Homo sapiens
  heavy chain complementarity determining region 3 for antibody 26541
SKMVGWTYGMDV

SEQ ID NO: 53083 - protein, 9 aa, Homo sapiens
  light chain complementarity determining region 3 for antibody 26542
RHFGGSPLT

SEQ ID NO: 53084 - protein, 11 aa, Homo sapiens
  heavy chain complementarity determining region 3 for antibody 26542
ARKGTGAPFDY

SEQ ID NO: 53085 - protein, 8 aa, Homo sapiens
  light chain complementarity determining region 3 for antibody 26543
QYYGSSPT

SEQ ID NO: 53086 - protein, 9 aa, Homo sapiens
  heavy chain complementarity determining region 3 for antibody 26543
ARGYDAFDY

SEQ ID NO: 53087 - protein, 10 aa, Homo sapiens
  light chain complementarity determining region 3 for antibody 26544
QVYDSSSLWR

SEQ ID NO: 53088 - protein, 19 aa, Homo sapiens
  heavy chain complementarity determining region 3 for antibody 26544
ARESFVRKVGGQRPYYFDI

SEQ ID NO: 53089 - protein, 10 aa, Homo sapiens
  light chain complementarity determining region 3 for antibody 26545
QVDDSSSLWT

SEQ ID NO: 53090 - protein, 19 aa, Homo sapiens
  heavy chain complementarity determining region 3 for antibody 26545
ARESFVRKVGGQRPYYFDI

SEQ ID NO: 53091 - protein, 11 aa, Homo sapiens
  light chain complementarity determining region 3 for antibody 26546
QRYDTSPPRYR

SEQ ID NO: 53092 - protein, 14 aa, Homo sapiens
  heavy chain complementarity determining region 3 for antibody 26546
ARHKQESGTRGFDF

SEQ ID NO: 53093 - protein, 9 aa, Homo sapiens
  light chain complementarity determining region 3 for antibody 26547
QRSDSKPFT

SEQ ID NO: 53094 - protein, 14 aa, Homo sapiens
  heavy chain complementarity determining region 3 for antibody 26547
ARDNSNNWYEGMDV

SEQ ID NO: 53095 - protein, 9 aa, Homo sapiens
  light chain complementarity determining region 3 for antibody 26548
QQYYTTLRT

SEQ ID NO: 53096 - protein, 8 aa, Homo sapiens
  heavy chain complementarity determining region 3 for antibody 26548
ARDGAFDS

SEQ ID NO: 53097 - protein, 9 aa, Homo sapiens
  light chain complementarity determining region 3 for antibody 26549
QQYYTSGRT

SEQ ID NO: 53098 - protein, 12 aa, Homo sapiens
  heavy chain complementarity determining region 3 for antibody 26549
VKDCGLGGSRDS

SEQ ID NO: 53099 - protein, 9 aa, Homo sapiens
  light chain complementarity determining region 3 for antibody 26550
QQYYTSGRT

SEQ ID NO: 53100 - protein, 12 aa, Homo sapiens
  heavy chain complementarity determining region 3 for antibody 26550
VKDCGLGGSRDF

SEQ ID NO: 53101 - protein, 9 aa, Homo sapiens
  light chain complementarity determining region 3 for antibody 26551
QQYYSTTYT

SEQ ID NO: 53102 - protein, 15 aa, Homo sapiens
  heavy chain complementarity determining region 3 for antibody 26551
ARATRQWLDHNCFDP

SEQ ID NO: 53103 - protein, 10 aa, Homo sapiens
  light chain complementarity determining region 3 for antibody 26552
QQYYSTRALT

SEQ ID NO: 53104 - protein, 19 aa, Homo sapiens
  heavy chain complementarity determining region 3 for antibody 26552
ARGGDYGSGSYARFRAFDI

SEQ ID NO: 53105 - protein, 9 aa, Homo sapiens
  light chain complementarity determining region 3 for antibody 26553
QQYYSTPWT

SEQ ID NO: 53106 - protein, 18 aa, Homo sapiens
  heavy chain complementarity determining region 3 for antibody 26553
AGRPCSGGSCYAGGWFDP

SEQ ID NO: 53107 - protein, 9 aa, Homo sapiens
  light chain complementarity determining region 3 for antibody 26554
QQYYSTPPT

SEQ ID NO: 53108 - protein, 18 aa, Homo sapiens
  heavy chain complementarity determining region 3 for antibody 26554
ARSNPTNIGVAGTVWFDP

SEQ ID NO: 53109 - protein, 10 aa, Homo sapiens
  light chain complementarity determining region 3 for antibody 26555
QQYYSNRALT

SEQ ID NO: 53110 - protein, 19 aa, Homo sapiens
  heavy chain complementarity determining region 3 for antibody 26555
ARGGDYGSGTYARFRAFDI

SEQ ID NO: 53111 - protein, 9 aa, Homo sapiens
  light chain complementarity determining region 3 for antibody 26556
QQYYRTPYT

SEQ ID NO: 53112 - protein, 12 aa, Homo sapiens
  heavy chain complementarity determining region 3 for antibody 26556
ARGPLLRFFPDF

SEQ ID NO: 53113 - protein, 9 aa, Homo sapiens
  light chain complementarity determining region 3 for antibody 26557
QQYYRTPDT

SEQ ID NO: 53114 - protein, 15 aa, Homo sapiens
  heavy chain complementarity determining region 3 for antibody 26557
ARVGVDPNYYYGLDV

SEQ ID NO: 53115 - protein, 9 aa, Homo sapiens
  light chain complementarity determining region 3 for antibody 26558
QQYYPTPRT

SEQ ID NO: 53116 - protein, 8 aa, Homo sapiens
  heavy chain complementarity determining region 3 for antibody 26558
ARDGAFDS

SEQ ID NO: 53117 - protein, 9 aa, Homo sapiens
  light chain complementarity determining region 3 for antibody 26559
QQYYPSLRT

SEQ ID NO: 53118 - protein, 12 aa, Homo sapiens
  heavy chain complementarity determining region 3 for antibody 26559
VKDCGLGGSRDS

SEQ ID NO: 53119 - protein, 9 aa, Homo sapiens
  light chain complementarity determining region 3 for antibody 26560
QQYYHTPFT

SEQ ID NO: 53120 - protein, 17 aa, Homo sapiens
  heavy chain complementarity determining region 3 for antibody 26560
ARAMSPYSGYDSSPLAY

SEQ ID NO: 53121 - protein, 9 aa, Homo sapiens
  light chain complementarity determining region 3 for antibody 26561
QQYVKSPRT

SEQ ID NO: 53122 - protein, 11 aa, Homo sapiens
  heavy chain complementarity determining region 3 for antibody 26561
AREDWPDGFDI

SEQ ID NO: 53123 - protein, 9 aa, Homo sapiens
  light chain complementarity determining region 3 for antibody 26562
QQYSSSPRT

SEQ ID NO: 53124 - protein, 13 aa, Homo sapiens
  heavy chain complementarity determining region 3 for antibody 26562
ARGSTNWRNWFDP

SEQ ID NO: 53125 - protein, 9 aa, Homo sapiens
  light chain complementarity determining region 3 for antibody 26563
QQYSDWPPL

SEQ ID NO: 53126 - protein, 20 aa, Homo sapiens
  heavy chain complementarity determining region 3 for antibody 26563
AREGGQGPTANGWFGGGADY

SEQ ID NO: 53127 - protein, 9 aa, Homo sapiens
  light chain complementarity determining region 3 for antibody 26564
QQYRRSPSP

SEQ ID NO: 53128 - protein, 17 aa, Homo sapiens
  heavy chain complementarity determining region 3 for antibody 26564
AGLSSRLGDGSPSLFDY

SEQ ID NO: 53129 - protein, 8 aa, Homo sapiens
  light chain complementarity determining region 3 for antibody 26565
QQYNTYAT

SEQ ID NO: 53130 - protein, 17 aa, Homo sapiens
  heavy chain complementarity determining region 3 for antibody 26565
AHRLDHNGMWNEGIFGH

SEQ ID NO: 53131 - protein, 9 aa, Homo sapiens
  light chain complementarity determining region 3 for antibody 26566
QQYNSYSWT

SEQ ID NO: 53132 - protein, 15 aa, Homo sapiens
  heavy chain complementarity determining region 3 for antibody 26566
ARSKFVDTGKTLIDY

SEQ ID NO: 53133 - protein, 10 aa, Homo sapiens
  light chain complementarity determining region 3 for antibody 26567
QQYNSYSLWT

SEQ ID NO: 53134 - protein, 13 aa, Homo sapiens
  heavy chain complementarity determining region 3 for antibody 26567
VKDLAYYLGYFHH

SEQ ID NO: 53135 - protein, 9 aa, Homo sapiens
  light chain complementarity determining region 3 for antibody 26568
QQYNSAPRT

SEQ ID NO: 53136 - protein, 10 aa, Homo sapiens
  heavy chain complementarity determining region 3 for antibody 26568
ARDRLGAFDI

SEQ ID NO: 53137 - protein, 9 aa, Homo sapiens
  light chain complementarity determining region 3 for antibody 26569
QQYNQWPYR

SEQ ID NO: 53138 - protein, 8 aa, Homo sapiens
  heavy chain complementarity determining region 3 for antibody 26569
ARDIVLYH

SEQ ID NO: 53139 - protein, 9 aa, Homo sapiens
  light chain complementarity determining region 3 for antibody 26570
QQYNNWPWT

SEQ ID NO: 53140 - protein, 11 aa, Homo sapiens
  heavy chain complementarity determining region 3 for antibody 26570
AAIGRLGAIDL

SEQ ID NO: 53141 - protein, 9 aa, Homo sapiens
  light chain complementarity determining region 3 for antibody 26571
QQYNNWPRT

SEQ ID NO: 53142 - protein, 31 aa, Homo sapiens
  heavy chain complementarity determining region 3 for antibody 26571
ARRGTILCETGLNVVVTPIYVGQTPREFFHH

SEQ ID NO: 53143 - protein, 10 aa, Homo sapiens
  light chain complementarity determining region 3 for antibody 26572
QQYNNWPPYT

SEQ ID NO: 53144 - protein, 16 aa, Homo sapiens
  heavy chain complementarity determining region 3 for antibody 26572
ARVRSDSSWYDGYFLH

SEQ ID NO: 53145 - protein, 10 aa, Homo sapiens [sequence omitted]

SEQ ID NO: 53146 - protein, 20 aa, Homo sapiens
  heavy chain complementarity determining region 3 for antibody 26573
ARRARYGDCIGGHCYYAGGH

SEQ ID NO: 53147 - protein, 9 aa, Homo sapiens
  light chain complementarity determining region 3 for antibody 26574
QQYNNWPPT

SEQ ID NO: 53148 - protein, 17 aa, Homo sapiens
  heavy chain complementarity determining region 3 for antibody 26574
ASYYDSGGYYYVNYFDY

SEQ ID NO: 53149 - protein, 11 aa, Homo sapiens
  light chain complementarity determining region 3 for antibody 26575
QQYNNWPPAVT

SEQ ID NO: 53150 - protein, 13 aa, Homo sapiens
  heavy chain complementarity determining region 3 for antibody 26575
TRLSMAALIPFDY

SEQ ID NO: 53151 - protein, 8 aa, Homo sapiens
  light chain complementarity determining region 3 for antibody 26576
QQYNNWPG

SEQ ID NO: 53152 - protein, 14 aa, Homo sapiens
  heavy chain complementarity determining region 3 for antibody 26576
AGKGYSASGNYYAN

SEQ ID NO: 53153 - protein, 8 aa, Homo sapiens
  light chain complementarity determining region 3 for antibody 26577
QQYKSYST

SEQ ID NO: 53154 - protein, 15 aa, Homo sapiens
  heavy chain complementarity determining region 3 for antibody 26577
AKDKAMSGWYGPIDY

SEQ ID NO: 53155 - protein, 11 aa, Homo sapiens
  light chain complementarity determining region 3 for antibody 26578
QQYITSPPGYP

SEQ ID NO: 53156 - protein, 11 aa, Homo sapiens
  heavy chain complementarity determining region 3 for antibody 26578
ARHGNGYYFDY

SEQ ID NO: 53157 - protein, 8 aa, Homo sapiens
  light chain complementarity determining region 3 for antibody 26579
QQYISYST

SEQ ID NO: 53158 - protein, 16 aa, Homo sapiens
  heavy chain complementarity determining region 3 for antibody 26579
ARGGSTTVVTPFAFDI

SEQ ID NO: 53159 - protein, 9 aa, Homo sapiens
  light chain complementarity determining region 3 for antibody 26580
QQYHSYSYT

SEQ ID NO: 53160 - protein, 16 aa, Homo sapiens
  heavy chain complementarity determining region 3 for antibody 26580
ARGRLTFGGVIVSHDY

SEQ ID NO: 53161 - protein, 9 aa, Homo sapiens
  light chain complementarity determining region 3 for antibody 26581
QQYHFTPFT

SEQ ID NO: 53162 - protein, 14 aa, Homo sapiens
  heavy chain complementarity determining region 3 for antibody 26581
ARHEEMGTTAAFDV

SEQ ID NO: 53163 - protein, 6 aa, Homo sapiens
  light chain complementarity determining region 3 for antibody 26582
QQYGVT

SEQ ID NO: 53164 - protein, 12 aa, Homo sapiens
  heavy chain complementarity determining region 3 for antibody 26582
ARFANSWYPYDF

SEQ ID NO: 53165 - protein, 8 aa, Homo sapiens
  light chain complementarity determining region 3 for antibody 26583
QQYGTSRT

SEQ ID NO: 53166 - protein, 15 aa, Homo sapiens
  heavy chain complementarity determining region 3 for antibody 26583
ARGESYRDSRGYRED

SEQ ID NO: 53167 - protein, 9 aa, Homo sapiens
  light chain complementarity determining region 3 for antibody 26584
QQYGTSPFT

SEQ ID NO: 53168 - protein, 13 aa, Homo sapiens
  heavy chain complementarity determining region 3 for antibody 26584
STPPRSGSSAGGY

SEQ ID NO: 53169 - protein, 9 aa, Homo sapiens
  light chain complementarity determining region 3 for antibody 26585
QQYGSYPRT

SEQ ID NO: 53170 - protein, 25 aa, Homo sapiens
  heavy chain complementarity determining region 3 for antibody 26585
ARLRIDRLRLPGAMRGPLYDCGLNV

SEQ ID NO: 53171 - protein, 7 aa, Homo sapiens
  light chain complementarity determining region 3 for antibody 26586
QQYGSWG

SEQ ID NO: 53172 - protein, 11 aa, Homo sapiens
  heavy chain complementarity determining region 3 for antibody 26586
AVVDTTLAMPK

SEQ ID NO: 53173 - protein, 7 aa, Homo sapiens
  light chain complementarity determining region 3 for antibody 26587
QQYGSWA

SEQ ID NO: 53174 - protein, 11 aa, Homo sapiens
  heavy chain complementarity determining region 3 for antibody 26587
AVVDTTVAMPK

SEQ ID NO: 53175 - protein, 7 aa, Homo sapiens
  light chain complementarity determining region 3 for antibody 26588
QQYGSWA

SEQ ID NO: 53176 - protein, 11 aa, Homo sapiens
  heavy chain complementarity determining region 3 for antibody 26588
AVVDTTLAMPN

SEQ ID NO: 53177 - protein, 9 aa, Homo sapiens
  light chain complementarity determining region 3 for antibody 26589
QQYGSTWWS

SEQ ID NO: 53178 - protein, 15 aa, Homo sapiens
  heavy chain complementarity determining region 3 for antibody 26589
ARHMARDSIGYYHDF

SEQ ID NO: 53179 - protein, 9 aa, Homo sapiens
  light chain complementarity determining region 3 for antibody 26590
QQYGSSWWT

SEQ ID NO: 53180 - protein, 15 aa, Homo sapiens
  heavy chain complementarity determining region 3 for antibody 26590
ARHMARDSIGYYHDF

SEQ ID NO: 53181 - protein, 9 aa, Homo sapiens
  light chain complementarity determining region 3 for antibody 26591
QQYGSSPYT

SEQ ID NO: 53182 - protein, 7 aa, Homo sapiens
  heavy chain complementarity determining region 3 for antibody 26591
VRDEWWP

SEQ ID NO: 53183 - protein, 9 aa, Homo sapiens
  light chain complementarity determining region 3 for antibody 26592
QQYGSSPYP

SEQ ID NO: 53184 - protein, 16 aa, Homo sapiens
  heavy chain complementarity determining region 3 for antibody 26592
ATPGQHNSGWDYRFDY

SEQ ID NO: 53185 - protein, 9 aa, Homo sapiens
  light chain complementarity determining region 3 for antibody 26593
QQYGSSPWT

SEQ ID NO: 53186 - protein, 13 aa, Homo sapiens
  heavy chain complementarity determining region 3 for antibody 26593
ARTPWRTGRCFDY

SEQ ID NO: 53187 - protein, 9 aa, Homo sapiens
  light chain complementarity determining region 3 for antibody 26594
QQYGSSPWT

SEQ ID NO: 53188 - protein, 25 aa, Homo sapiens
  heavy chain complementarity determining region 3 for antibody 26594
ARLRIDRLRLPGAMRGPLYDCGLNV

SEQ ID NO: 53189 - protein, 9 aa, Homo sapiens
  light chain complementarity determining region 3 for antibody 26595
QQYGSSPVT

SEQ ID NO: 53190 - protein, 13 aa, Homo sapiens
  heavy chain complementarity determining region 3 for antibody 26595
GRGGYTSSWYWVY

SEQ ID NO: 53191 - protein, 9 aa, Homo sapiens
  light chain complementarity determining region 3 for antibody 26596
QQYGSSPRT

SEQ ID NO: 53192 - protein, 13 aa, Homo sapiens
  heavy chain complementarity determining region 3 for antibody 26596
ATGFFDSSRYLEY

SEQ ID NO: 53193 - protein, 9 aa, Homo sapiens
  light chain complementarity determining region 3 for antibody 26597
QQYGSSPRT

SEQ ID NO: 53194 - protein, 25 aa, Homo sapiens
  heavy chain complementarity determining region 3 for antibody 26597
ARRRIDRLRLPGAMRGPLYDCGLNV

SEQ ID NO: 53195 - protein, 9 aa, Homo sapiens
  light chain complementarity determining region 3 for antibody 26598
QQYGSSPRT

SEQ ID NO: 53196 - protein, 13 aa, Homo sapiens
  heavy chain complementarity determining region 3 for antibody 26598
ARAGRGPFGWFDP

SEQ ID NO: 53197 - protein, 9 aa, Homo sapiens
  light chain complementarity determining region 3 for antibody 26599
QQYGSSPRP

SEQ ID NO: 53198 - protein, 15 aa, Homo sapiens
  heavy chain complementarity determining region 3 for antibody 26599
ARANGVIITTGVLRY

SEQ ID NO: 53199 - protein, 10 aa, Homo sapiens
  light chain complementarity determining region 3 for antibody 26600
QQYGSSPPYT

SEQ ID NO: 53200 - protein, 14 aa, Homo sapiens
  heavy chain complementarity determining region 3 for antibody 26600
ARHKHDGSGSVIDY

SEQ ID NO: 53201 - protein, 10 aa, Homo sapiens
  light chain complementarity determining region 3 for antibody 26601
QQYGSSPPYP

SEQ ID NO: 53202 - protein, 14 aa, Homo sapiens
  heavy chain complementarity determining region 3 for antibody 26601
ARHEHDGSGSVIDY

SEQ ID NO: 53203 - protein, 10 aa, Homo sapiens
  light chain complementarity determining region 3 for antibody 26602
QQYGSSPMYS

SEQ ID NO: 53204 - protein, 11 aa, Homo sapiens
  heavy chain complementarity determining region 3 for antibody 26602
ARGGQWGSRDY

SEQ ID NO: 53205 - protein, 10 aa, Homo sapiens
  light chain complementarity determining region 3 for antibody 26603
QQYGSSPMHS

SEQ ID NO: 53206 - protein, 11 aa, Homo sapiens
  heavy chain complementarity determining region 3 for antibody 26603
ARGGQWGSLDY

SEQ ID NO: 53207 - protein, 9 aa, Homo sapiens
  light chain complementarity determining region 3 for antibody 26604
QQYGSSPLT

SEQ ID NO: 53208 - protein, 13 aa, Homo sapiens
  heavy chain complementarity determining region 3 for antibody 26604
AKLWFGELYVFDY

SEQ ID NO: 53209 - protein, 9 aa, Homo sapiens
  light chain complementarity determining region 3 for antibody 26605
QQYGSSPLP

SEQ ID NO: 53210 - protein, 19 aa, Homo sapiens
  heavy chain complementarity determining region 3 for antibody 26605
ARGSSSSRRRAAVVGYFDL

SEQ ID NO: 53211 - protein, 10 aa, Homo sapiens
  light chain complementarity determining region 3 for antibody 26606
QQYGSSPIYS

SEQ ID NO: 53212 - protein, 11 aa, Homo sapiens
  heavy chain complementarity determining region 3 for antibody 26606
ARGGQWGSLDY

SEQ ID NO: 53213 - protein, 9 aa, Homo sapiens
  light chain complementarity determining region 3 for antibody 26607
QQYGSSPHT

SEQ ID NO: 53214 - protein, 17 aa, Homo sapiens
  heavy chain complementarity determining region 3 for antibody 26607
ARGTGYNYGYGGVHFDY

SEQ ID NO: 53215 - protein, 9 aa, Homo sapiens
  light chain complementarity determining region 3 for antibody 26608
QQYGSSPGT

SEQ ID NO: 53216 - protein, 25 aa, Homo sapiens
  heavy chain complementarity determining region 3 for antibody 26608
ARLRIDRLRLPGAMRGPLYDCGLNV

SEQ ID NO: 53217 - protein, 9 aa, Homo sapiens
  light chain complementarity determining region 3 for antibody 26609
QQYGSSPDT

SEQ ID NO: 53218 - protein, 9 aa, Homo sapiens
  heavy chain complementarity determining region 3 for antibody 26609
ARETEGFDI

SEQ ID NO: 53219 - protein, 8 aa, Homo sapiens
  light chain complementarity determining region 3 for antibody 26610
QQYGSSLT

SEQ ID NO: 53220 - protein, 15 aa, Homo sapiens
  heavy chain complementarity determining region 3 for antibody 26610
VRNFGSGTYHDAFHI

SEQ ID NO: 53221 - protein, 9 aa, Homo sapiens
  light chain complementarity determining region 3 for antibody 26611
QQYGSSLFT

SEQ ID NO: 53222 - protein, 12 aa, Homo sapiens
  heavy chain complementarity determining region 3 for antibody 26611
ARHGGGTWYTDY

SEQ ID NO: 53223 - protein, 10 aa, Homo sapiens
  light chain complementarity determining region 3 for antibody 26612
QQYGSPPMYS

SEQ ID NO: 53224 - protein, 11 aa, Homo sapiens
  heavy chain complementarity determining region 3 for antibody 26612
ARGGQWGSLDY

SEQ ID NO: 53225 - protein, 9 aa, Homo sapiens
  light chain complementarity determining region 3 for antibody 26613
QQYGSLSLT

SEQ ID NO: 53226 - protein, 15 aa, Homo sapiens
  heavy chain complementarity determining region 3 for antibody 26613
AHRPNYYDKAGAFDI

SEQ ID NO: 53227 - protein, 9 aa, Homo sapiens
  light chain complementarity determining region 3 for antibody 26614
QQYGSLPLT

SEQ ID NO: 53228 - protein, 15 aa, Homo sapiens
  heavy chain complementarity determining region 3 for antibody 26614
AHRPNYYDKAGASDI

SEQ ID NO: 53229 - protein, 6 aa, Homo sapiens
  light chain complementarity determining region 3 for antibody 26615
QQYGRT

SEQ ID NO: 53230 - protein, 12 aa, Homo sapiens
  heavy chain complementarity determining region 3 for antibody 26615
ARFANSWYPYDF

SEQ ID NO: 53231 - protein, 9 aa, Homo sapiens
  light chain complementarity determining region 3 for antibody 26616
QQYGRSWWT

SEQ ID NO: 53232 - protein, 15 aa, Homo sapiens
  heavy chain complementarity determining region 3 for antibody 26616
ARHVARDDIGYYHDL

SEQ ID NO: 53233 - protein, 9 aa, Homo sapiens
  light chain complementarity determining region 3 for antibody 26617
QQYGRSPPT

SEQ ID NO: 53234 - protein, 12 aa, Homo sapiens
  heavy chain complementarity determining region 3 for antibody 26617
ARGPQLWFYFDY

SEQ ID NO: 53235 - protein, 9 aa, Homo sapiens
  light chain complementarity determining region 3 for antibody 26618
QQYGRSPGT

SEQ ID NO: 53236 - protein, 18 aa, Homo sapiens
  heavy chain complementarity determining region 3 for antibody 26618
ATNPSIAEPGNIYWYFDL

SEQ ID NO: 53237 - protein, 9 aa, Homo sapiens
  light chain complementarity determining region 3 for antibody 26619
QQYGRSLYT

SEQ ID NO: 53238 - protein, 16 aa, Homo sapiens
  heavy chain complementarity determining region 3 for antibody 26619
ARAKHYGDYYYYGMDA

SEQ ID NO: 53239 - protein, 9 aa, Homo sapiens
  light chain complementarity determining region 3 for antibody 26620
QQYGRLPIT

SEQ ID NO: 53240 - protein, 11 aa, Homo sapiens
  heavy chain complementarity determining region 3 for antibody 26620
AHRFRTYYFDY

SEQ ID NO: 53241 - protein, 9 aa, Homo sapiens
  light chain complementarity determining region 3 for antibody 26621
QQYGNSPWG

SEQ ID NO: 53242 - protein, 11 aa, Homo sapiens
  heavy chain complementarity determining region 3 for antibody 26621
ARKGLYAPLDV

SEQ ID NO: 53243 - protein, 9 aa, Homo sapiens
  light chain complementarity determining region 3 for antibody 26622
QQYGNSPRA

SEQ ID NO: 53244 - protein, 11 aa, Homo sapiens
  heavy chain complementarity determining region 3 for antibody 26622
ARKGLYAPLDV

SEQ ID NO: 53245 - protein, 9 aa, Homo sapiens
  light chain complementarity determining region 3 for antibody 26623
QQYGNSPLT

SEQ ID NO: 53246 - protein, 13 aa, Homo sapiens
  heavy chain complementarity determining region 3 for antibody 26623
ASRTSVRTYSSDL

SEQ ID NO: 53247 - protein, 9 aa, Homo sapiens
  light chain complementarity determining region 3 for antibody 26624
QQYGNSPLT

SEQ ID NO: 53248 - protein, 13 aa, Homo sapiens
  heavy chain complementarity determining region 3 for antibody 26624
ASKASVRTYSSDL

SEQ ID NO: 53249 - protein, 8 aa, Homo sapiens
  light chain complementarity determining region 3 for antibody 26625
QQYGNSGT

SEQ ID NO: 53250 - protein, 21 aa, Homo sapiens
  heavy chain complementarity determining region 3 for antibody 26625
AARGDSSGWYPGSDYFYGMDV

SEQ ID NO: 53251 - protein, 10 aa, Homo sapiens
  light chain complementarity determining region 3 for antibody 26626
QQYGNPTQIP

SEQ ID NO: 53252 - protein, 16 aa, Homo sapiens
  heavy chain complementarity determining region 3 for antibody 26626
TREIRGVIKPEEDFDY

SEQ ID NO: 53253 - protein, 9 aa, Homo sapiens
  light chain complementarity determining region 3 for antibody 26627
QQYGNLPWT

SEQ ID NO: 53254 - protein, 13 aa, Homo sapiens
  heavy chain complementarity determining region 3 for antibody 26627
AGGNFHSGGYGEY

SEQ ID NO: 53255 - protein, 9 aa, Homo sapiens
  light chain complementarity determining region 3 for antibody 26628
QQYGNLPRR

SEQ ID NO: 53256 - protein, 13 aa, Homo sapiens
  heavy chain complementarity determining region 3 for antibody 26628
AGGNFHSGGYGEY

SEQ ID NO: 53257 - protein, 9 aa, Homo sapiens
  light chain complementarity determining region 3 for antibody 26629
QQYGNFPRT

SEQ ID NO: 53258 - protein, 13 aa, Homo sapiens
  heavy chain complementarity determining region 3 for antibody 26629
AGGNFHSGGYGEY

SEQ ID NO: 53259 - protein, 9 aa, Homo sapiens
  light chain complementarity determining region 3 for antibody 26630
QQYGGSPYT

SEQ ID NO: 53260 - protein, 15 aa, Homo sapiens
  heavy chain complementarity determining region 3 for antibody 26630
ARGQLDYYDNSGYNY

SEQ ID NO: 53261 - protein, 10 aa, Homo sapiens
  light chain complementarity determining region 3 for antibody 26631
QQYGGSPQDT

SEQ ID NO: 53262 - protein, 15 aa, Homo sapiens
  heavy chain complementarity determining region 3 for antibody 26631
ARDDRFATRFHSLDT

SEQ ID NO: 53263 - protein, 10 aa, Homo sapiens
  light chain complementarity determining region 3 for antibody 26632
QQYGGSPPWR

SEQ ID NO: 53264 - protein, 14 aa, Homo sapiens
  heavy chain complementarity determining region 3 for antibody 26632
ARGGKSTYIPHFDY

SEQ ID NO: 53265 - protein, 9 aa, Homo sapiens
  light chain complementarity determining region 3 for antibody 26633
QQYGGSGDT

SEQ ID NO: 53266 - protein, 17 aa, Homo sapiens
  heavy chain complementarity determining region 3 for antibody 26633
ARPAVTEFRGINDALDI

SEQ ID NO: 53267 - protein, 9 aa, Homo sapiens
  light chain complementarity determining region 3 for antibody 26634
QQYGGLPLT

SEQ ID NO: 53268 - protein, 15 aa, Homo sapiens
  heavy chain complementarity determining region 3 for antibody 26634
AHRPNYYDKAGAFDI

SEQ ID NO: 53269 - protein, 10 aa, Homo sapiens
  light chain complementarity determining region 3 for antibody 26635
QQYGDSPDVT

SEQ ID NO: 53270 - protein, 16 aa, Homo sapiens
  heavy chain complementarity determining region 3 for antibody 26635
ARDAAFWFGEFTFFDH

SEQ ID NO: 53271 - protein, 10 aa, Homo sapiens
  light chain complementarity determining region 3 for antibody 26636
QQYGDSPDVP

SEQ ID NO: 53272 - protein, 16 aa, Homo sapiens
  heavy chain complementarity determining region 3 for antibody 26636
ARDATFWFGEFTFFDH

SEQ ID NO: 53273 - protein, 10 aa, Homo sapiens
  light chain complementarity determining region 3 for antibody 26637
QQYGDSPDGT

SEQ ID NO: 53274 - protein, 16 aa, Homo sapiens
  heavy chain complementarity determining region 3 for antibody 26637
ARDATFWFGEFTFFDH

SEQ ID NO: 53275 - protein, 10 aa, Homo sapiens
  light chain complementarity determining region 3 for antibody 26638
QQYGDSFLFT

SEQ ID NO: 53276 - protein, 16 aa, Homo sapiens
  heavy chain complementarity determining region 3 for antibody 26638
ARVYGDNDPTQGAFDI

SEQ ID NO: 53277 - protein, 9 aa, Homo sapiens
  light chain complementarity determining region 3 for antibody 26639
QQYFTSVRT

SEQ ID NO: 53278 - protein, 12 aa, Homo sapiens
  heavy chain complementarity determining region 3 for antibody 26639
VKDCGLGGSRDF

SEQ ID NO: 53279 - protein, 9 aa, Homo sapiens
  light chain complementarity determining region 3 for antibody 26640
QQYFSTPWT

SEQ ID NO: 53280 - protein, 15 aa, Homo sapiens
  heavy chain complementarity determining region 3 for antibody 26640
IRQSKMNNNWDYPDS

SEQ ID NO: 53281 - protein, 9 aa, Homo sapiens
  light chain complementarity determining region 3 for antibody 26641
QQYFSHVYT

SEQ ID NO: 53282 - protein, 18 aa, Homo sapiens
  heavy chain complementarity determining region 3 for antibody 26641
AQERDGYCDRHACYGLDV

SEQ ID NO: 53283 - protein, 9 aa, Homo sapiens
  light chain complementarity determining region 3 for antibody 26642
QQYEGLPYT

SEQ ID NO: 53284 - protein, 15 aa, Homo sapiens
  heavy chain complementarity determining region 3 for antibody 26642
LRASYYSDSRGATHQ

SEQ ID NO: 53285 - protein, 9 aa, Homo sapiens
  light chain complementarity determining region 3 for antibody 26643
QQYDTYPYT

SEQ ID NO: 53286 - protein, 6 aa, Homo sapiens
  heavy chain complementarity determining region 3 for antibody 26643
MTMGAP

SEQ ID NO: 53287 - protein, 9 aa, Homo sapiens
  light chain complementarity determining region 3 for antibody 26644
QQYDSSPLT

SEQ ID NO: 53288 - protein, 17 aa, Homo sapiens
  heavy chain complementarity determining region 3 for antibody 26644
ARDRGSSWYSGAEHFQY

SEQ ID NO: 53289 - protein, 9 aa, Homo sapiens
  light chain complementarity determining region 3 for antibody 26645
QQYDSLPLT

SEQ ID NO: 53290 - protein, 15 aa, Homo sapiens
  heavy chain complementarity determining region 3 for antibody 26645
ARAYTGYDYYYGMDL

SEQ ID NO: 53291 - protein, 9 aa, Homo sapiens
  light chain complementarity determining region 3 for antibody 26646
QQYDSLPGT

SEQ ID NO: 53292 - protein, 19 aa, Homo sapiens
  heavy chain complementarity determining region 3 for antibody 26646
ARTAIGKRYWASSGDQFDY

SEQ ID NO: 53293 - protein, 10 aa, Homo sapiens
  light chain complementarity determining region 3 for antibody 26647
QQYDNWPLYT

SEQ ID NO: 53294 - protein, 15 aa, Homo sapiens
  heavy chain complementarity determining region 3 for antibody 26647
ARSPADRGHQNAFDI

SEQ ID NO: 53295 - protein, 9 aa, Homo sapiens
  light chain complementarity determining region 3 for antibody 26648
QQYDNSPPP

SEQ ID NO: 53296 - protein, 19 aa, Homo sapiens
  heavy chain complementarity determining region 3 for antibody 26648
ARDHFPLARGVVSYFYYNY

SEQ ID NO: 53297 - protein, 10 aa, Homo sapiens
  light chain complementarity determining region 3 for antibody 26649
QQYDNRPPYT

SEQ ID NO: 53298 - protein, 28 aa, Homo sapiens
  heavy chain complementarity determining region 3 for antibody 26649
AKVLRQSNHDFWTGSDPLRKYFYHGMDV

SEQ ID NO: 53299 - protein, 9 aa, Homo sapiens
  light chain complementarity determining region 3 for antibody 26650
QQYDFLPPT

SEQ ID NO: 53300 - protein, 21 aa, Homo sapiens
  heavy chain complementarity determining region 3 for antibody 26650
ARGLHVVVVTSILRGFWYFGL

SEQ ID NO: 53301 - protein, 9 aa, Homo sapiens
  light chain complementarity determining region 3 for antibody 26651
QQYAYSPIP

SEQ ID NO: 53302 - protein, 10 aa, Homo sapiens
  heavy chain complementarity determining region 3 for antibody 26651
ATGAGWLVDY

SEQ ID NO: 53303 - protein, 9 aa, Homo sapiens
  light chain complementarity determining region 3 for antibody 26652
QQYAYSPFT

SEQ ID NO: 53304 - protein, 10 aa, Homo sapiens
  heavy chain complementarity determining region 3 for antibody 26652
ATGAGWLVDY

SEQ ID NO: 53305 - protein, 9 aa, Homo sapiens
  light chain complementarity determining region 3 for antibody 26653
QQYAGSPRT

SEQ ID NO: 53306 - protein, 14 aa, Homo sapiens
  heavy chain complementarity determining region 3 for antibody 26653
TRDGDNFLWGNYHY

SEQ ID NO: 53307 - protein, 9 aa, Homo sapiens
  light chain complementarity determining region 3 for antibody 26654
QQVPIYPFT

SEQ ID NO: 53308 - protein, 12 aa, Homo sapiens
  heavy chain complementarity determining region 3 for antibody 26654
ARPLDGDFGFDP

SEQ ID NO: 53309 - protein, 9 aa, Homo sapiens
  light chain complementarity determining region 3 for antibody 26655
QQVNRFPLT

SEQ ID NO: 53310 - protein, 14 aa, Homo sapiens
  heavy chain complementarity determining region 3 for antibody 26655
TTDSPLRRYNYFDY

SEQ ID NO: 53311 - protein, 8 aa, Homo sapiens
  light chain complementarity determining region 3 for antibody 26656
QQVGSSLT

SEQ ID NO: 53312 - protein, 15 aa, Homo sapiens
  heavy chain complementarity determining region 3 for antibody 26656
ARLRDTTLGRWYFDS

SEQ ID NO: 53313 - protein, 10 aa, Homo sapiens
  light chain complementarity determining region 3 for antibody 26657
QQTYSTPPST

SEQ ID NO: 53314 - protein, 19 aa, Homo sapiens
  heavy chain complementarity determining region 3 for antibody 26657
AKDRDSSGWDNYYYYGMDV

SEQ ID NO: 53315 - protein, 10 aa, Homo sapiens
  light chain complementarity determining region 3 for antibody 26658
QQTYSTPPHT

SEQ ID NO: 53316 - protein, 19 aa, Homo sapiens
  heavy chain complementarity determining region 3 for antibody 26658
AKDRDSSGWDNYYYYGMDV

SEQ ID NO: 53317 - protein, 9 aa, Homo sapiens
  light chain complementarity determining region 3 for antibody 26659
QQTYSTPLP

SEQ ID NO: 53318 - protein, 18 aa, Homo sapiens
  heavy chain complementarity determining region 3 for antibody 26659
ARSGRRDSSGFLVNWFDY

SEQ ID NO: 53319 - protein, 9 aa, Homo sapiens
  light chain complementarity determining region 3 for antibody 26660
QQTFSSPPP

SEQ ID NO: 53320 - protein, 16 aa, Homo sapiens
  heavy chain complementarity determining region 3 for antibody 26660
VTYRDTVTASGYGLDD

SEQ ID NO: 53321 - protein, 9 aa, Homo sapiens
  light chain complementarity determining region 3 for antibody 26661
QQSYTSLRT

SEQ ID NO: 53322 - protein, 12 aa, Homo sapiens
  heavy chain complementarity determining region 3 for antibody 26661
VKDCGLGGSRDS

SEQ ID NO: 53323 - protein, 9 aa, Homo sapiens
  light chain complementarity determining region 3 for antibody 26662
QQSYSTPWT

SEQ ID NO: 53324 - protein, 16 aa, Homo sapiens
  heavy chain complementarity determining region 3 for antibody 26662
ARGWEHYYATSGYPDH

SEQ ID NO: 53325 - protein, 9 aa, Homo sapiens
  light chain complementarity determining region 3 for antibody 26663
QQSYSTPRT

SEQ ID NO: 53326 - protein, 19 aa, Homo sapiens
  heavy chain complementarity determining region 3 for antibody 26663
GRVGRRYIFNRQYNIAMDV

SEQ ID NO: 53327 - protein, 9 aa, Homo sapiens
  light chain complementarity determining region 3 for antibody 26664
QQSYSTPPP

SEQ ID NO: 53328 - protein, 18 aa, Homo sapiens
  heavy chain complementarity determining region 3 for antibody 26664
ARVVDSSSWYFYFYGMDV

SEQ ID NO: 53329 - protein, 9 aa, Homo sapiens
  light chain complementarity determining region 3 for antibody 26665
QQSYSTPHT

SEQ ID NO: 53330 - protein, 23 aa, Homo sapiens
  heavy chain complementarity determining region 3 for antibody 26665
ARIESDATMVRGVIIAKGNWFDP

SEQ ID NO: 53331 - protein, 9 aa, Homo sapiens
  light chain complementarity determining region 3 for antibody 26666
QQSYSTPAA

SEQ ID NO: 53332 - protein, 14 aa, Homo sapiens
  heavy chain complementarity determining region 3 for antibody 26666
ARESFHNSGYALDY

SEQ ID NO: 53333 - protein, 8 aa, Homo sapiens
  light chain complementarity determining region 3 for antibody 26667
QQSYSTLT

SEQ ID NO: 53334 - protein, 16 aa, Homo sapiens
  heavy chain complementarity determining region 3 for antibody 26667
ARGHDDTNGYNYYFDY

SEQ ID NO: 53335 - protein, 10 aa, Homo sapiens
  light chain complementarity determining region 3 for antibody 26668
QQSYSTLPLT

SEQ ID NO: 53336 - protein, 18 aa, Homo sapiens
  heavy chain complementarity determining region 3 for antibody 26668
ARDRYSCDSGGCFHWFGP

SEQ ID NO: 53337 - protein, 9 aa, Homo sapiens
  light chain complementarity determining region 3 for antibody 26669
QQSYSSPWT

SEQ ID NO: 53338 - protein, 6 aa, Homo sapiens
  heavy chain complementarity determining region 3 for antibody 26669
GSLFEY

SEQ ID NO: 53339 - protein, 9 aa, Homo sapiens
  light chain complementarity determining region 3 for antibody 26670
QQSYSSPRT

SEQ ID NO: 53340 - protein, 13 aa, Homo sapiens
  heavy chain complementarity determining region 3 for antibody 26670
ARENGAPGGWFDP

SEQ ID NO: 53341 - protein, 10 aa, Homo sapiens
  light chain complementarity determining region 3 for antibody 26671
QQSYSSFSIP

SEQ ID NO: 53342 - protein, 14 aa, Homo sapiens
  heavy chain complementarity determining region 3 for antibody 26671
ARDFVRGLWRSFDI

SEQ ID NO: 53343 - protein, 9 aa, Homo sapiens
  light chain complementarity determining region 3 for antibody 26672
QQSYITPLT

SEQ ID NO: 53344 - protein, 18 aa, Homo sapiens
  heavy chain complementarity determining region 3 for antibody 26672
ARGAYCSGAPCHYNSFDY

SEQ ID NO: 53345 - protein, 9 aa, Homo sapiens
  light chain complementarity determining region 3 for antibody 26673
QQSSEFPYT

SEQ ID NO: 53346 - protein, 26 aa, Homo sapiens
  heavy chain complementarity determining region 3 for antibody 26673
ARDPEGGYYYEPSGVYGNYYYYGMDV

SEQ ID NO: 53347 - protein, 9 aa, Homo sapiens
  light chain complementarity determining region 3 for antibody 26674
QQSNTYPLP

SEQ ID NO: 53348 - protein, 8 aa, Homo sapiens
  heavy chain complementarity determining region 3 for antibody 26674
INYNTGWS

SEQ ID NO: 53349 - protein, 9 aa, Homo sapiens
  light chain complementarity determining region 3 for antibody 26675
QQSNSTPYT

SEQ ID NO: 53350 - protein, 14 aa, Homo sapiens
  heavy chain complementarity determining region 3 for antibody 26675
ATEGPSRMGKFFDS

SEQ ID NO: 53351 - protein, 9 aa, Homo sapiens
  light chain complementarity determining region 3 for antibody 26676
QQSNNWPPT

SEQ ID NO: 53352 - protein, 12 aa, Homo sapiens
  heavy chain complementarity determining region 3 for antibody 26676
ARTLVQALIWDY

SEQ ID NO: 53353 - protein, 9 aa, Homo sapiens
  light chain complementarity determining region 3 for antibody 26677
QQSHSPPWT

SEQ ID NO: 53354 - protein, 12 aa, Homo sapiens
  heavy chain complementarity determining region 3 for antibody 26677
AKRMLAEDAYDI

SEQ ID NO: 53355 - protein, 9 aa, Homo sapiens
  light chain complementarity determining region 3 for antibody 26678
QQSGSSPYT

SEQ ID NO: 53356 - protein, 13 aa, Homo sapiens
  heavy chain complementarity determining region 3 for antibody 26678
TAPYNFWDVGFDP

SEQ ID NO: 53357 - protein, 10 aa, Homo sapiens
  light chain complementarity determining region 3 for antibody 26679
QQSGSSPPIT

SEQ ID NO: 53358 - protein, 10 aa, Homo sapiens
  heavy chain complementarity determining region 3 for antibody 26679
ARGDPAPFDS

SEQ ID NO: 53359 - protein, 9 aa, Homo sapiens
  light chain complementarity determining region 3 for antibody 26680
QQSFTTPRT

SEQ ID NO: 53360 - protein, 21 aa, Homo sapiens
  heavy chain complementarity determining region 3 for antibody 26680
TRDFALNWNDETGYYYHGLDV

SEQ ID NO: 53361 - protein, 9 aa, Homo sapiens
  light chain complementarity determining region 3 for antibody 26681
QQSFNTPYT

SEQ ID NO: 53362 - protein, 14 aa, Homo sapiens
  heavy chain complementarity determining region 3 for antibody 26681
ARGTSGTHSDYLDH

SEQ ID NO: 53363 - protein, 8 aa, Homo sapiens
  light chain complementarity determining region 3 for antibody 26682
QQSDSTPP

SEQ ID NO: 53364 - protein, 13 aa, Homo sapiens
  heavy chain complementarity determining region 3 for antibody 26682
ARPTSDYNWNFGY

SEQ ID NO: 53365 - protein, 9 aa, Homo sapiens
  light chain complementarity determining region 3 for antibody 26683
QQSDSTPLT

SEQ ID NO: 53366 - protein, 14 aa, Homo sapiens
  heavy chain complementarity determining region 3 for antibody 26683
AKAIAPSGWYYLDY

SEQ ID NO: 53367 - protein, 9 aa, Homo sapiens
  light chain complementarity determining region 3 for antibody 26684
QQSAGPPPT

SEQ ID NO: 53368 - protein, 14 aa, Homo sapiens
  heavy chain complementarity determining region 3 for antibody 26684
ARDSQWLVQYGMDV

SEQ ID NO: 53369 - protein, 8 aa, Homo sapiens
  light chain complementarity determining region 3 for antibody 26685
QQRYSTPT

SEQ ID NO: 53370 - protein, 17 aa, Homo sapiens
  heavy chain complementarity determining region 3 for antibody 26685
ARDSRGYNYSPGYAFDI

SEQ ID NO: 53371 - protein, 10 aa, Homo sapiens
  light chain complementarity determining region 3 for antibody 26686
QQRYSSFSIT

SEQ ID NO: 53372 - protein, 14 aa, Homo sapiens
  heavy chain complementarity determining region 3 for antibody 26686
ARDFVRGLWRSFDI

SEQ ID NO: 53373 - protein, 10 aa, Homo sapiens
  light chain complementarity determining region 3 for antibody 26687
QQRYNWPPYP

SEQ ID NO: 53374 - protein, 11 aa, Homo sapiens
  heavy chain complementarity determining region 3 for antibody 26687
ARGVGSYVFES

SEQ ID NO: 53375 - protein, 10 aa, Homo sapiens
  light chain complementarity determining region 3 for antibody 26688
QQRYNWPPYP

SEQ ID NO: 53376 - protein, 11 aa, Homo sapiens
  heavy chain complementarity determining region 3 for antibody 26688
ARGVGSYPFDS

SEQ ID NO: 53377 - protein, 10 aa, Homo sapiens
  light chain complementarity determining region 3 for antibody 26689
QQRYNWPPNT

SEQ ID NO: 53378 - protein, 15 aa, Homo sapiens
  heavy chain complementarity determining region 3 for antibody 26689
AREGSGYPAATGFDI

SEQ ID NO: 53379 - protein, 10 aa, Homo sapiens
  light chain complementarity determining region 3 for antibody 26690
QQRYNWPPHT

SEQ ID NO: 53380 - protein, 15 aa, Homo sapiens
  heavy chain complementarity determining region 3 for antibody 26690
AREGSGYPAATGFDI

SEQ ID NO: 53381 - protein, 11 aa, Homo sapiens
  light chain complementarity determining region 3 for antibody 26691
QQRTSWPPTYT

SEQ ID NO: 53382 - protein, 14 aa, Homo sapiens
  heavy chain complementarity determining region 3 for antibody 26691
ARTVLDTAADAFDF

SEQ ID NO: 53383 - protein, 11 aa, Homo sapiens
  light chain complementarity determining region 3 for antibody 26692
QQRTNWPPIST

SEQ ID NO: 53384 - protein, 14 aa, Homo sapiens
  heavy chain complementarity determining region 3 for antibody 26692
ARGGLGIWGNSSDI

SEQ ID NO: 53385 - protein, 9 aa, Homo sapiens
  light chain complementarity determining region 3 for antibody 26693
QQRSSWPLP

SEQ ID NO: 53386 - protein, 17 aa, Homo sapiens
  heavy chain complementarity determining region 3 for antibody 26693
ARAGEYHDFWSAYYFDF

SEQ ID NO: 53387 - protein, 9 aa, Homo sapiens
  light chain complementarity determining region 3 for antibody 26694
QQRSNWPST

SEQ ID NO: 53388 - protein, 13 aa, Homo sapiens
  heavy chain complementarity determining region 3 for antibody 26694
ATGEAYSGYDGDY

SEQ ID NO: 53389 - protein, 10 aa, Homo sapiens
  light chain complementarity determining region 3 for antibody 26695
QQRSNWPPVT

SEQ ID NO: 53390 - protein, 14 aa, Homo sapiens
  heavy chain complementarity determining region 3 for antibody 26695
ARDPSGVLIGAWSH

SEQ ID NO: 53391 - protein, 10 aa, Homo sapiens
  light chain complementarity determining region 3 for antibody 26696
QQRSNWPPLT

SEQ ID NO: 53392 - protein, 18 aa, Homo sapiens
  heavy chain complementarity determining region 3 for antibody 26696
ARPFYDSYTYHYYYGLDV

SEQ ID NO: 53393 - protein, 10 aa, Homo sapiens
  light chain complementarity determining region 3 for antibody 26697
QQRSNWPPLP

SEQ ID NO: 53394 - protein, 15 aa, Homo sapiens
  heavy chain complementarity determining region 3 for antibody 26697
ARLAMVTGRGTDFDY

SEQ ID NO: 53395 - protein, 11 aa, Homo sapiens
  light chain complementarity determining region 3 for antibody 26698
QQRSNWPPIFT

SEQ ID NO: 53396 - protein, 18 aa, Homo sapiens
  heavy chain complementarity determining region 3 for antibody 26698
ARIPPYDSSGYYYYVLDY

SEQ ID NO: 53397 - protein, 10 aa, Homo sapiens
  light chain complementarity determining region 3 for antibody 26699
QQRSNWPPHT

SEQ ID NO: 53398 - protein, 13 aa, Homo sapiens
  heavy chain complementarity determining region 3 for antibody 26699
ARVGQQRLRGFDI

SEQ ID NO: 53399 - protein, 10 aa, Homo sapiens
  light chain complementarity determining region 3 for antibody 26700
QQRSNWPPGT

SEQ ID NO: 53400 - protein, 14 aa, Homo sapiens
  heavy chain complementarity determining region 3 for antibody 26700
ARDLSGVLIGAWSH

SEQ ID NO: 53401 - protein, 8 aa, Homo sapiens
  light chain complementarity determining region 3 for antibody 26701
QQRSNWPP

SEQ ID NO: 53402 - protein, 17 aa, Homo sapiens
  heavy chain complementarity determining region 3 for antibody 26701
AKDHGPYSSSPTFSFDY

SEQ ID NO: 53403 - protein, 9 aa, Homo sapiens
  light chain complementarity determining region 3 for antibody 26702
QQRSNWPLT

SEQ ID NO: 53404 - protein, 15 aa, Homo sapiens
  heavy chain complementarity determining region 3 for antibody 26702
AKYYYDSSGYSPFDY

SEQ ID NO: 53405 - protein, 9 aa, Homo sapiens
  light chain complementarity determining region 3 for antibody 26703
QQRSNWPLT

SEQ ID NO: 53406 - protein, 14 aa, Homo sapiens
  heavy chain complementarity determining region 3 for antibody 26703
AKSRGYNTDDAFDI

SEQ ID NO: 53407 - protein, 9 aa, Homo sapiens
  light chain complementarity determining region 3 for antibody 26704
QQRSNWLYT

SEQ ID NO: 53408 - protein, 11 aa, Homo sapiens
  heavy chain complementarity determining region 3 for antibody 26704
SRCWDQTYFDY

SEQ ID NO: 53409 - protein, 8 aa, Homo sapiens
  light chain complementarity determining region 3 for antibody 26705
QQRSNLFT

SEQ ID NO: 53410 - protein, 20 aa, Homo sapiens
  heavy chain complementarity determining region 3 for antibody 26705
ARGRIRRDRLVHYYYYGMDV

SEQ ID NO: 53411 - protein, 10 aa, Homo sapiens
  light chain complementarity determining region 3 for antibody 26706
QQRSKRPPLT

SEQ ID NO: 53412 - protein, 9 aa, Homo sapiens
  heavy chain complementarity determining region 3 for antibody 26706
ARVDGYFDY

SEQ ID NO: 53413 - protein, 11 aa, Homo sapiens
  light chain complementarity determining region 3 for antibody 26707
QQRSDWPPVIP

SEQ ID NO: 53414 - protein, 22 aa, Homo sapiens
  heavy chain complementarity determining region 3 for antibody 26707
ARHRQAENYDSGGYSLPDGFDI

SEQ ID NO: 53415 - protein, 9 aa, Homo sapiens
  light chain complementarity determining region 3 for antibody 26708
QQRNTWPQT

SEQ ID NO: 53416 - protein, 20 aa, Homo sapiens
  heavy chain complementarity determining region 3 for antibody 26708
ARDGAAAGAGSFYHYSGLDV

SEQ ID NO: 53417 - protein, 9 aa, Homo sapiens
  light chain complementarity determining region 3 for antibody 26709
QQRNRTPYT

SEQ ID NO: 53418 - protein, 14 aa, Homo sapiens
  heavy chain complementarity determining region 3 for antibody 26709
ATEGPSRMGKFFDS

SEQ ID NO: 53419 - protein, 10 aa, Homo sapiens
  light chain complementarity determining region 3 for antibody 26710
QQRNKRPPVI

SEQ ID NO: 53420 - protein, 12 aa, Homo sapiens
  heavy chain complementarity determining region 3 for antibody 26710
VRDGSSGWHFDY

SEQ ID NO: 53421 - protein, 10 aa, Homo sapiens
  light chain complementarity determining region 3 for antibody 26711
QQRNKGPPVI

SEQ ID NO: 53422 - protein, 12 aa, Homo sapiens
  heavy chain complementarity determining region 3 for antibody 26711
VRDGSSGWHFDY

SEQ ID NO: 53423 - protein, 10 aa, Homo sapiens
  light chain complementarity determining region 3 for antibody 26712
QQRNDRPPYP

SEQ ID NO: 53424 - protein, 15 aa, Homo sapiens
  heavy chain complementarity determining region 3 for antibody 26712
ARLMGDWELPRGTDY

SEQ ID NO: 53425 - protein, 9 aa, Homo sapiens
  light chain complementarity determining region 3 for antibody 26713
QQRHNWPGT

SEQ ID NO: 53426 - protein, 17 aa, Homo sapiens
  heavy chain complementarity determining region 3 for antibody 26713
VVPQFSRTDWPTEPSDY

SEQ ID NO: 53427 - protein, 12 aa, Homo sapiens
  light chain complementarity determining region 3 for antibody 26714
QQRFNWPPPRFT

SEQ ID NO: 53428 - protein, 14 aa, Homo sapiens
  heavy chain complementarity determining region 3 for antibody 26714
ARDGGIAAALSFDY

SEQ ID NO: 53429 - protein, 9 aa, Homo sapiens
  light chain complementarity determining region 3 for antibody 26715
QQRFKRPPT

SEQ ID NO: 53430 - protein, 19 aa, Homo sapiens
  heavy chain complementarity determining region 3 for antibody 26715
AREVSSADHYGVGKNWFDP

SEQ ID NO: 53431 - protein, 9 aa, Homo sapiens
  light chain complementarity determining region 3 for antibody 26716
QQPFSSPPT

SEQ ID NO: 53432 - protein, 16 aa, Homo sapiens
  heavy chain complementarity determining region 3 for antibody 26716
VTYRDTVTASGYGLDD

SEQ ID NO: 53433 - protein, 9 aa, Homo sapiens
  light chain complementarity determining region 3 for antibody 26717
QQNGSSPYT

SEQ ID NO: 53434 - protein, 17 aa, Homo sapiens
  heavy chain complementarity determining region 3 for antibody 26717
ARGTGYNYGYGGVHFDY

SEQ ID NO: 53435 - protein, 9 aa, Homo sapiens
  light chain complementarity determining region 3 for antibody 26718
QQNGSSPPT

SEQ ID NO: 53436 - protein, 17 aa, Homo sapiens
  heavy chain complementarity determining region 3 for antibody 26718
ARPYFGPVRAGTNGYDM

SEQ ID NO: 53437 - protein, 9 aa, Homo sapiens
  light chain complementarity determining region 3 for antibody 26719
QQNGSSPPT

SEQ ID NO: 53438 - protein, 13 aa, Homo sapiens
  heavy chain complementarity determining region 3 for antibody 26719
AKPMWRKLYYFDY

SEQ ID NO: 53439 - protein, 9 aa, Homo sapiens
  light chain complementarity determining region 3 for antibody 26720
QQNGSSPFT

SEQ ID NO: 53440 - protein, 21 aa, Homo sapiens
  heavy chain complementarity determining region 3 for antibody 26720
ARVGVERNRYGRTLPVWYFDY

SEQ ID NO: 53441 - protein, 9 aa, Homo sapiens
  light chain complementarity determining region 3 for antibody 26721
QQNGSSLYT

SEQ ID NO: 53442 - protein, 9 aa, Homo sapiens
  heavy chain complementarity determining region 3 for antibody 26721
IYEINAFDI

SEQ ID NO: 53443 - protein, 9 aa, Homo sapiens
  light chain complementarity determining region 3 for antibody 26722
QQNGRSPRT

SEQ ID NO: 53444 - protein, 15 aa, Homo sapiens
  heavy chain complementarity determining region 3 for antibody 26722
AKDGEFCGSNCYFGS

SEQ ID NO: 53445 - protein, 9 aa, Homo sapiens
  light chain complementarity determining region 3 for antibody 26723
QQNGGSSYT

SEQ ID NO: 53446 - protein, 16 aa, Homo sapiens
  heavy chain complementarity determining region 3 for antibody 26723
ANWFGSVGDFLGPFDY

SEQ ID NO: 53447 - protein, 9 aa, Homo sapiens
  light chain complementarity determining region 3 for antibody 26724
QQNATSPLT

SEQ ID NO: 53448 - protein, 10 aa, Homo sapiens
  heavy chain complementarity determining region 3 for antibody 26724
TTGGGWLVDY

SEQ ID NO: 53449 - protein, 9 aa, Homo sapiens
  light chain complementarity determining region 3 for antibody 26725
QQLNTYPLT

SEQ ID NO: 53450 - protein, 19 aa, Homo sapiens
  heavy chain complementarity determining region 3 for antibody 26725
ARDVIRNCGSDCYFWYFDL

SEQ ID NO: 53451 - protein, 9 aa, Homo sapiens
  light chain complementarity determining region 3 for antibody 26726
QQLNSYPYT

SEQ ID NO: 53452 - protein, 12 aa, Homo sapiens
  heavy chain complementarity determining region 3 for antibody 26726
ASWGGAKGGLPY

SEQ ID NO: 53453 - protein, 9 aa, Homo sapiens
  light chain complementarity determining region 3 for antibody 26727
QQLNSYPYT

SEQ ID NO: 53454 - protein, 12 aa, Homo sapiens
  heavy chain complementarity determining region 3 for antibody 26727
AIWAGAKGGLHY

SEQ ID NO: 53455 - protein, 9 aa, Homo sapiens
  light chain complementarity determining region 3 for antibody 26728
QQLNSYPLT

SEQ ID NO: 53456 - protein, 14 aa, Homo sapiens
  heavy chain complementarity determining region 3 for antibody 26728
AREGFGYTNYWFDP

SEQ ID NO: 53457 - protein, 6 aa, Homo sapiens
  light chain complementarity determining region 3 for antibody 26729
QQLNRL

SEQ ID NO: 53458 - protein, 9 aa, Homo sapiens
  heavy chain complementarity determining region 3 for antibody 26729
DADGGDRVY

SEQ ID NO: 53459 - protein, 12 aa, Homo sapiens
  light chain complementarity determining region 3 for antibody 26730
QQLNNYSPFRVG

SEQ ID NO: 53460 - protein, 15 aa, Homo sapiens
  heavy chain complementarity determining region 3 for antibody 26730
ARGITLGRGSWSFDY

SEQ ID NO: 53461 - protein, 9 aa, Homo sapiens
  light chain complementarity determining region 3 for antibody 26731
QQLNIYPPT

SEQ ID NO: 53462 - protein, 24 aa, Homo sapiens
  heavy chain complementarity determining region 3 for antibody 26731
ARDKRSAYYYDSSDYYLVPHAFDM

SEQ ID NO: 53463 - protein, 9 aa, Homo sapiens
  light chain complementarity determining region 3 for antibody 26732
QQHSRGPIT

SEQ ID NO: 53464 - protein, 15 aa, Homo sapiens
  heavy chain complementarity determining region 3 for antibody 26732
ARDWGSSGWYNWFDP

SEQ ID NO: 53465 - protein, 9 aa, Homo sapiens
  light chain complementarity determining region 3 for antibody 26733
QQHNSYPYT

SEQ ID NO: 53466 - protein, 15 aa, Homo sapiens
  heavy chain complementarity determining region 3 for antibody 26733
ASPRNYYDTRDAFDV

SEQ ID NO: 53467 - protein, 9 aa, Homo sapiens
  light chain complementarity determining region 3 for antibody 26734
QQHNKWPLT

SEQ ID NO: 53468 - protein, 8 aa, Homo sapiens
  heavy chain complementarity determining region 3 for antibody 26734
AKGYGFDC

SEQ ID NO: 53469 - protein, 9 aa, Homo sapiens
  light chain complementarity determining region 3 for antibody 26735
QQHGSTWWT

SEQ ID NO: 53470 - protein, 15 aa, Homo sapiens
  heavy chain complementarity determining region 3 for antibody 26735
ARHMARDSIGYYHDF

SEQ ID NO: 53471 - protein, 9 aa, Homo sapiens
  light chain complementarity determining region 3 for antibody 26736
QQHGSLPLT

SEQ ID NO: 53472 - protein, 15 aa, Homo sapiens
  heavy chain complementarity determining region 3 for antibody 26736
AHRPNYYDKAGAFDI

SEQ ID NO: 53473 - protein, 6 aa, Homo sapiens
  light chain complementarity determining region 3 for antibody 26737
QQHGRT

SEQ ID NO: 53474 - protein, 12 aa, Homo sapiens
  heavy chain complementarity determining region 3 for antibody 26737
AKLVNSWYPYDY

SEQ ID NO: 53475 - protein, 9 aa, Homo sapiens
  light chain complementarity determining region 3 for antibody 26738
QQGYRPPFI

SEQ ID NO: 53476 - protein, 15 aa, Homo sapiens
  heavy chain complementarity determining region 3 for antibody 26738
TRAQVIWGHLYYFDY

SEQ ID NO: 53477 - protein, 10 aa, Homo sapiens
  light chain complementarity determining region 3 for antibody 26739
QQGYGTPLYT

SEQ ID NO: 53478 - protein, 15 aa, Homo sapiens
  heavy chain complementarity determining region 3 for antibody 26739
ARFAESSRYYRPFDY

SEQ ID NO: 53479 - protein, 9 aa, Homo sapiens
  light chain complementarity determining region 3 for antibody 26740
QQGSTTPRP

SEQ ID NO: 53480 - protein, 22 aa, Homo sapiens
  heavy chain complementarity determining region 3 for antibody 26740
AREGLCTSSRCDVVDHYNGMDV

SEQ ID NO: 53481 - protein, 11 aa, Homo sapiens
  light chain complementarity determining region 3 for antibody 26741
QQGETSPPMYT

SEQ ID NO: 53482 - protein, 23 aa, Homo sapiens
  heavy chain complementarity determining region 3 for antibody 26741
ARASRGYRRSDSRMEFFFYGLDV

SEQ ID NO: 53483 - protein, 9 aa, Homo sapiens
  light chain complementarity determining region 3 for antibody 26742
QQFNNYPHA

SEQ ID NO: 53484 - protein, 15 aa, Homo sapiens
  heavy chain complementarity determining region 3 for antibody 26742
ARAGGARSSGWNFDY

SEQ ID NO: 53485 - protein, 8 aa, Homo sapiens
  light chain complementarity determining region 3 for antibody 26743
QQFGSSLT

SEQ ID NO: 53486 - protein, 15 aa, Homo sapiens
  heavy chain complementarity determining region 3 for antibody 26743
ARLRDTPLGRWYFDS

SEQ ID NO: 53487 - protein, 9 aa, Homo sapiens
  light chain complementarity determining region 3 for antibody 26744
QQFDTSPWT

SEQ ID NO: 53488 - protein, 24 aa, Homo sapiens
  heavy chain complementarity determining region 3 for antibody 26744
ARVPIRISRRVDIAADYVSRAMDV

SEQ ID NO: 53489 - protein, 9 aa, Homo sapiens
  light chain complementarity determining region 3 for antibody 26745
QQDVTSPWT

SEQ ID NO: 53490 - protein, 12 aa, Homo sapiens
  heavy chain complementarity determining region 3 for antibody 26745
SRGLRSGWGLDY

SEQ ID NO: 53491 - protein, 9 aa, Homo sapiens
  light chain complementarity determining region 3 for antibody 26746
QQDHIYPFT

SEQ ID NO: 53492 - protein, 12 aa, Homo sapiens
  heavy chain complementarity determining region 3 for antibody 26746
ARPLDGDFGFDP

SEQ ID NO: 53493 - protein, 8 aa, Homo sapiens
  light chain complementarity determining region 3 for antibody 26747
QQDGTSPT

SEQ ID NO: 53494 - protein, 22 aa, Homo sapiens
  heavy chain complementarity determining region 3 for antibody 26747
ARGRGTVIRGATTKSYFNVMDV

SEQ ID NO: 53495 - protein, 7 aa, Homo sapiens
  light chain complementarity determining region 3 for antibody 26748
QQDGSWA

SEQ ID NO: 53496 - protein, 11 aa, Homo sapiens
  heavy chain complementarity determining region 3 for antibody 26748
AVVDTTLAMPK

SEQ ID NO: 53497 - protein, 9 aa, Homo sapiens
  light chain complementarity determining region 3 for antibody 26749
QQDGSSWVT

SEQ ID NO: 53498 - protein, 20 aa, Homo sapiens
  heavy chain complementarity determining region 3 for antibody 26749
AREGGHRQWLEIYDPGYFHH

SEQ ID NO: 53499 - protein, 9 aa, Homo sapiens
  light chain complementarity determining region 3 for antibody 26750
QQDGSSPRT

SEQ ID NO: 53500 - protein, 14 aa, Homo sapiens
  heavy chain complementarity determining region 3 for antibody 26750
ATGFFDSSRYYLEY

SEQ ID NO: 53501 - protein, 10 aa, Homo sapiens
  light chain complementarity determining region 3 for antibody 26751
QQDGSSPPFT

SEQ ID NO: 53502 - protein, 14 aa, Homo sapiens
  heavy chain complementarity determining region 3 for antibody 26751
ARDLRWLVLGRLDY

SEQ ID NO: 53503 - protein, 9 aa, Homo sapiens
  light chain complementarity determining region 3 for antibody 26752
QQDGSSPGT

SEQ ID NO: 53504 - protein, 16 aa, Homo sapiens
  heavy chain complementarity determining region 3 for antibody 26752
ARAVWGASWSVGWFDS

SEQ ID NO: 53505 - protein, 8 aa, Homo sapiens
  light chain complementarity determining region 3 for antibody 26753
QQDGSSIT

SEQ ID NO: 53506 - protein, 15 aa, Homo sapiens
  heavy chain complementarity determining region 3 for antibody 26753
VRNFGSGTYHDAFHI

SEQ ID NO: 53507 - protein, 9 aa, Homo sapiens
  light chain complementarity determining region 3 for antibody 26754
QQDGRLPLT

SEQ ID NO: 53508 - protein, 15 aa, Homo sapiens
  heavy chain complementarity determining region 3 for antibody 26754
AHRPNYYDKAGAFDI

SEQ ID NO: 53509 - protein, 9 aa, Homo sapiens
  light chain complementarity determining region 3 for antibody 26755
QQDGNSPWT

SEQ ID NO: 53510 - protein, 17 aa, Homo sapiens
  heavy chain complementarity determining region 3 for antibody 26755
ALASVAAPGRIQWYFDL

SEQ ID NO: 53511 - protein, 10 aa, Homo sapiens
  light chain complementarity determining region 3 for antibody 26756
QQDGDSPDVT

SEQ ID NO: 53512 - protein, 16 aa, Homo sapiens
  heavy chain complementarity determining region 3 for antibody 26756
ARDATFWFGEFTFFDH

SEQ ID NO: 53513 - protein, 8 aa, Homo sapiens
  light chain complementarity determining region 3 for antibody 26757
QQDGDSMT

SEQ ID NO: 53514 - protein, 16 aa, Homo sapiens
  heavy chain complementarity determining region 3 for antibody 26757
ARGLSIIRGVMSPFDL

SEQ ID NO: 53515 - protein, 11 aa, Homo sapiens
  light chain complementarity determining region 3 for antibody 26758
QQDDNSALEFT

SEQ ID NO: 53516 - protein, 15 aa, Homo sapiens
  heavy chain complementarity determining region 3 for antibody 26758
VREVVTMIEPGGFDV

SEQ ID NO: 53517 - protein, 9 aa, Homo sapiens
  light chain complementarity determining region 3 for antibody 26759
QQDAGAPRT

SEQ ID NO: 53518 - protein, 14 aa, Homo sapiens
  heavy chain complementarity determining region 3 for antibody 26759
TRDGDNFLWGNYHY

SEQ ID NO: 53519 - protein, 9 aa, Homo sapiens
  light chain complementarity determining region 3 for antibody 26760
QQAYSFPFP

SEQ ID NO: 53520 - protein, 15 aa, Homo sapiens
  heavy chain complementarity determining region 3 for antibody 26760
ARVLLEGQLGRALDY

SEQ ID NO: 53521 - protein, 9 aa, Homo sapiens
  light chain complementarity determining region 3 for antibody 26761
QQAYRFPFT

SEQ ID NO: 53522 - protein, 15 aa, Homo sapiens
  heavy chain complementarity determining region 3 for antibody 26761
ARVLLEGQLGRALDY

SEQ ID NO: 53523 - protein, 9 aa, Homo sapiens
  light chain complementarity determining region 3 for antibody 26762
QQANSFPLT

SEQ ID NO: 53524 - protein, 22 aa, Homo sapiens
  heavy chain complementarity determining region 3 for antibody 26762
AKISLPYSSLKDSVSAYWYFDL

SEQ ID NO: 53525 - protein, 9 aa, Homo sapiens
  light chain complementarity determining region 3 for antibody 26763
QQANSFPLS

SEQ ID NO: 53526 - protein, 15 aa, Homo sapiens
  heavy chain complementarity determining region 3 for antibody 26763
ARDRIFDGRFGEIGP

SEQ ID NO: 53527 - protein, 8 aa, Homo sapiens
  light chain complementarity determining region 3 for antibody 26764
QPYMSPFT

SEQ ID NO: 53528 - protein, 12 aa, Homo sapiens
  heavy chain complementarity determining region 3 for antibody 26764
ARALSASWYAFY

SEQ ID NO: 53529 - protein, 10 aa, Homo sapiens
  light chain complementarity determining region 3 for antibody 26765
QPYGSSPMYS

SEQ ID NO: 53530 - protein, 11 aa, Homo sapiens
  heavy chain complementarity determining region 3 for antibody 26765
ARGGQWGSLDY

SEQ ID NO: 53531 - protein, 9 aa, Homo sapiens
  light chain complementarity determining region 3 for antibody 26766
QPYGSLPLT

SEQ ID NO: 53532 - protein, 15 aa, Homo sapiens
  heavy chain complementarity determining region 3 for antibody 26766
AHRPNYYDKAGAFDI

SEQ ID NO: 53533 - protein, 10 aa, Homo sapiens
  light chain complementarity determining region 3 for antibody 26767
QPRTDRPPYP

SEQ ID NO: 53534 - protein, 15 aa, Homo sapiens
  heavy chain complementarity determining region 3 for antibody 26767
ARLMGDWELPRGTDY

SEQ ID NO: 53535 - protein, 10 aa, Homo sapiens
  light chain complementarity determining region 3 for antibody 26768
QLYSSSPTWT

SEQ ID NO: 53536 - protein, 19 aa, Homo sapiens
  heavy chain complementarity determining region 3 for antibody 26768
ARESYYPDIGGYTPRAFDI

SEQ ID NO: 53537 - protein, 9 aa, Homo sapiens
  light chain complementarity determining region 3 for antibody 26769
QKYNSAQLT

SEQ ID NO: 53538 - protein, 15 aa, Homo sapiens
  heavy chain complementarity determining region 3 for antibody 26769
ARRSNDSWSGYHPDY

SEQ ID NO: 53539 - protein, 9 aa, Homo sapiens
  light chain complementarity determining region 3 for antibody 26770
QKYNSALGT

SEQ ID NO: 53540 - protein, 11 aa, Homo sapiens
  heavy chain complementarity determining region 3 for antibody 26770
AREIDPEALDL

SEQ ID NO: 53541 - protein, 6 aa, Homo sapiens
  light chain complementarity determining region 3 for antibody 26771
QKYNSA

SEQ ID NO: 53542 - protein, 16 aa, Homo sapiens
  heavy chain complementarity determining region 3 for antibody 26771
ARALVVPATAWSWFDP

SEQ ID NO: 53543 - protein, 9 aa, Homo sapiens
  light chain complementarity determining region 3 for antibody 26772
QKYNNAHLT

SEQ ID NO: 53544 - protein, 11 aa, Homo sapiens
  heavy chain complementarity determining region 3 for antibody 26772
ARGGYDYYFDY

SEQ ID NO: 53545 - protein, 9 aa, Homo sapiens
  light chain complementarity determining region 3 for antibody 26773
QKYGSSPRT

SEQ ID NO: 53546 - protein, 25 aa, Homo sapiens
  heavy chain complementarity determining region 3 for antibody 26773
ARLRIDRLRLPGAMRGPLYDCGLNV

SEQ ID NO: 53547 - protein, 9 aa, Homo sapiens
  light chain complementarity determining region 3 for antibody 26774
QKCNSAPYT

SEQ ID NO: 53548 - protein, 14 aa, Homo sapiens
  heavy chain complementarity determining region 3 for antibody 26774
ATLYNIYYSRSLDV

SEQ ID NO: 53549 - protein, 9 aa, Homo sapiens
  light chain complementarity determining region 3 for antibody 26775
QHYNNIYGT

SEQ ID NO: 53550 - protein, 15 aa, Homo sapiens
  heavy chain complementarity determining region 3 for antibody 26775
ATSLWELSTANAFDI

SEQ ID NO: 53551 - protein, 9 aa, Homo sapiens
  light chain complementarity determining region 3 for antibody 26776
QHYHTSPRT

SEQ ID NO: 53552 - protein, 14 aa, Homo sapiens
  heavy chain complementarity determining region 3 for antibody 26776
AREGDLDFHYGMDV

SEQ ID NO: 53553 - protein, 9 aa, Homo sapiens
  light chain complementarity determining region 3 for antibody 26777
QHYGTSLWT

SEQ ID NO: 53554 - protein, 16 aa, Homo sapiens
  heavy chain complementarity determining region 3 for antibody 26777
ASLLPAGSLTPQMIPV

SEQ ID NO: 53555 - protein, 9 aa, Homo sapiens
  light chain complementarity determining region 3 for antibody 26778
QHYGTAPVT

SEQ ID NO: 53556 - protein, 14 aa, Homo sapiens
  heavy chain complementarity determining region 3 for antibody 26778
ARDLFRGIPDYLDY

SEQ ID NO: 53557 - protein, 9 aa, Homo sapiens
  light chain complementarity determining region 3 for antibody 26779
QHYGSSRWT

SEQ ID NO: 53558 - protein, 18 aa, Homo sapiens
  heavy chain complementarity determining region 3 for antibody 26779
ARGPDHGSSDRVNYFFDL

SEQ ID NO: 53559 - protein, 10 aa, Homo sapiens
  light chain complementarity determining region 3 for antibody 26780
QHYGSSPGFT

SEQ ID NO: 53560 - protein, 12 aa, Homo sapiens
  heavy chain complementarity determining region 3 for antibody 26780
AHSDTPLGALDP

SEQ ID NO: 53561 - protein, 10 aa, Homo sapiens
  light chain complementarity determining region 3 for antibody 26781
QHYGSSPAGT

SEQ ID NO: 53562 - protein, 14 aa, Homo sapiens
  heavy chain complementarity determining region 3 for antibody 26781
ARHEHDGSGSVIDY

SEQ ID NO: 53563 - protein, 9 aa, Homo sapiens
  light chain complementarity determining region 3 for antibody 26782
QHYFSYSYT

SEQ ID NO: 53564 - protein, 18 aa, Homo sapiens
  heavy chain complementarity determining region 3 for antibody 26782
ARDRYSCDSGGCFHWFDP

SEQ ID NO: 53565 - protein, 9 aa, Homo sapiens
  light chain complementarity determining region 3 for antibody 26783
QHYESSLWT

SEQ ID NO: 53566 - protein, 12 aa, Homo sapiens
  heavy chain complementarity determining region 3 for antibody 26783
ARDFGLYQEPDS

SEQ ID NO: 53567 - protein, 9 aa, Homo sapiens
  light chain complementarity determining region 3 for antibody 26784
QHYDPSLFT

SEQ ID NO: 53568 - protein, 13 aa, Homo sapiens
  heavy chain complementarity determining region 3 for antibody 26784
ARGITIRQPDLDY

SEQ ID NO: 53569 - protein, 9 aa, Homo sapiens
  light chain complementarity determining region 3 for antibody 26785
QHTNNLPVR

SEQ ID NO: 53570 - protein, 25 aa, Homo sapiens
  heavy chain complementarity determining region 3 for antibody 26785
ARERHDFSSGSYTGGREYYYYGLDV

SEQ ID NO: 53571 - protein, 11 aa, Homo sapiens
  light chain complementarity determining region 3 for antibody 26786
QHRTFWPPSLT

SEQ ID NO: 53572 - protein, 16 aa, Homo sapiens
  heavy chain complementarity determining region 3 for antibody 26786
ATEGRWYSYDWTGVDY

SEQ ID NO: 53573 - protein, 9 aa, Homo sapiens
  light chain complementarity determining region 3 for antibody 26787
QHRSTWPLT

SEQ ID NO: 53574 - protein, 18 aa, Homo sapiens
  heavy chain complementarity determining region 3 for antibody 26787
AQDYGSGEVNYSWGTFHH

SEQ ID NO: 53575 - protein, 10 aa, Homo sapiens
  light chain complementarity determining region 3 for antibody 26788
QHRSNWPPYT

SEQ ID NO: 53576 - protein, 13 aa, Homo sapiens
  heavy chain complementarity determining region 3 for antibody 26788
ARVGQQRLRGFDI

SEQ ID NO: 53577 - protein, 11 aa, Homo sapiens
  light chain complementarity determining region 3 for antibody 26789
QHRSNWPPPYP

SEQ ID NO: 53578 - protein, 18 aa, Homo sapiens
  heavy chain complementarity determining region 3 for antibody 26789
ARAVVAGTPVLYYYGMDV

SEQ ID NO: 53579 - protein, 9 aa, Homo sapiens
  light chain complementarity determining region 3 for antibody 26790
QHNHSRPFT

SEQ ID NO: 53580 - protein, 20 aa, Homo sapiens
  heavy chain complementarity determining region 3 for antibody 26790
AKGIAVAALRTVYYYYGLDV

SEQ ID NO: 53581 - protein, 10 aa, Homo sapiens
  light chain complementarity determining region 3 for antibody 26791
QHLYNWPPLT

SEQ ID NO: 53582 - protein, 22 aa, Homo sapiens
  heavy chain complementarity determining region 3 for antibody 26791
ARVDCSSTNCYVGYYYYFGLDV

SEQ ID NO: 53583 - protein, 9 aa, Homo sapiens
  light chain complementarity determining region 3 for antibody 26792
QHHHTYWPT

SEQ ID NO: 53584 - protein, 12 aa, Homo sapiens
  heavy chain complementarity determining region 3 for antibody 26792
AGDPSGNSYFDY

SEQ ID NO: 53585 - protein, 9 aa, Homo sapiens
  light chain complementarity determining region 3 for antibody 26793
QHFGGSPPT

SEQ ID NO: 53586 - protein, 11 aa, Homo sapiens
  heavy chain complementarity determining region 3 for antibody 26793
ARKGTGAPFDY

SEQ ID NO: 53587 - protein, 10 aa, Homo sapiens
  light chain complementarity determining region 3 for antibody 26794
QHFDNLPLFT

SEQ ID NO: 53588 - protein, 16 aa, Homo sapiens
  heavy chain complementarity determining region 3 for antibody 26794
ARVPRGSYASGTLFDY

SEQ ID NO: 53589 - protein, 10 aa, Homo sapiens
  light chain complementarity determining region 3 for antibody 26795
QEYKRWPAFT

SEQ ID NO: 53590 - protein, 11 aa, Homo sapiens
  heavy chain complementarity determining region 3 for antibody 26795
ARRWGSAPFDH

SEQ ID NO: 53591 - protein, 10 aa, Homo sapiens
  light chain complementarity determining region 3 for antibody 26796
QEYKGWPAFT

SEQ ID NO: 53592 - protein, 11 aa, Homo sapiens
  heavy chain complementarity determining region 3 for antibody 26796
ARRWGSAPFDH

SEQ ID NO: 53593 - protein, 10 aa, Homo sapiens
  light chain complementarity determining region 3 for antibody 26797
QAYKSWPAFT

SEQ ID NO: 53594 - protein, 11 aa, Homo sapiens
  heavy chain complementarity determining region 3 for antibody 26797
ARRWGSAPFDH

SEQ ID NO: 53595 - protein, 10 aa, Homo sapiens
  light chain complementarity determining region 3 for antibody 26798
PQYGSSPMYS

SEQ ID NO: 53596 - protein, 11 aa, Homo sapiens
  heavy chain complementarity determining region 3 for antibody 26798
ARGGQWGSLDY

SEQ ID NO: 53597 - protein, 9 aa, Homo sapiens
  light chain complementarity determining region 3 for antibody 26799
PQYGSSLYT

SEQ ID NO: 53598 - protein, 9 aa, Homo sapiens
  heavy chain complementarity determining region 3 for antibody 26799
IYEINAFDI

SEQ ID NO: 53599 - protein, 8 aa, Homo sapiens
  light chain complementarity determining region 3 for antibody 26800
MRGVEPDP

SEQ ID NO: 53600 - protein, 7 aa, Homo sapiens
  heavy chain complementarity determining region 3 for antibody 26800
ATKMGDY

SEQ ID NO: 53601 - protein, 9 aa, Homo sapiens
  light chain complementarity determining region 3 for antibody 26801
MQVLQTPLT

SEQ ID NO: 53602 - protein, 12 aa, Homo sapiens
  heavy chain complementarity determining region 3 for antibody 26801
ARDSEQKWELHD

SEQ ID NO: 53603 - protein, 9 aa, Homo sapiens
  light chain complementarity determining region 3 for antibody 26802
MQVLQSPLS

SEQ ID NO: 53604 - protein, 12 aa, Homo sapiens
  heavy chain complementarity determining region 3 for antibody 26802
TRDPDSHYGMDV

SEQ ID NO: 53605 - protein, 9 aa, Homo sapiens
  light chain complementarity determining region 3 for antibody 26803
MQVLQSPLR

SEQ ID NO: 53606 - protein, 12 aa, Homo sapiens
  heavy chain complementarity determining region 3 for antibody 26803
TRDPDSHYGMEV

SEQ ID NO: 53607 - protein, 9 aa, Homo sapiens
  light chain complementarity determining region 3 for antibody 26804
MQVLETPFT

SEQ ID NO: 53608 - protein, 15 aa, Homo sapiens
  heavy chain complementarity determining region 3 for antibody 26804
VRHYRETVAGIEGDS

SEQ ID NO: 53609 - protein, 9 aa, Homo sapiens
  light chain complementarity determining region 3 for antibody 26805
MQTTQYPYT

SEQ ID NO: 53610 - protein, 13 aa, Homo sapiens
  heavy chain complementarity determining region 3 for antibody 26805
ARLPARGSWHFQP

SEQ ID NO: 53611 - protein, 8 aa, Homo sapiens
  light chain complementarity determining region 3 for antibody 26806
MQSTQWPT

SEQ ID NO: 53612 - protein, 21 aa, Homo sapiens
  heavy chain complementarity determining region 3 for antibody 26806
AKDRPNYYGSNAGYYTPGGDL

SEQ ID NO: 53613 - protein, 9 aa, Homo sapiens
  light chain complementarity determining region 3 for antibody 26807
MQSRRGPPT

SEQ ID NO: 53614 - protein, 8 aa, Homo sapiens
  heavy chain complementarity determining region 3 for antibody 26807
TAWGSSQH

SEQ ID NO: 53615 - protein, 8 aa, Homo sapiens
  light chain complementarity determining region 3 for antibody 26808
MQSLHPWT

SEQ ID NO: 53616 - protein, 13 aa, Homo sapiens
  heavy chain complementarity determining region 3 for antibody 26808
ARKSDSHPSDFNY

SEQ ID NO: 53617 - protein, 9 aa, Homo sapiens
  light chain complementarity determining region 3 for antibody 26809
MQILQTPVT

SEQ ID NO: 53618 - protein, 12 aa, Homo sapiens
  heavy chain complementarity determining region 3 for antibody 26809
ARDGGSSWSEFT

SEQ ID NO: 53619 - protein, 9 aa, Homo sapiens
  light chain complementarity determining region 3 for antibody 26810
MQGTRWPDT

SEQ ID NO: 53620 - protein, 10 aa, Homo sapiens
  heavy chain complementarity determining region 3 for antibody 26810
ARNSGWSVDC

SEQ ID NO: 53621 - protein, 9 aa, Homo sapiens
  light chain complementarity determining region 3 for antibody 26811
MQGTNWPYT

SEQ ID NO: 53622 - protein, 10 aa, Homo sapiens
  heavy chain complementarity determining region 3 for antibody 26811
ARDGDFVLDY

SEQ ID NO: 53623 - protein, 10 aa, Homo sapiens
  light chain complementarity determining region 3 for antibody 26812
MQGTNWPPRT

SEQ ID NO: 53624 - protein, 12 aa, Homo sapiens
  heavy chain complementarity determining region 3 for antibody 26812
VRDPQIGDVSDY

SEQ ID NO: 53625 - protein, 8 aa, Homo sapiens
  light chain complementarity determining region 3 for antibody 26813
MQGTHWPR

SEQ ID NO: 53626 - protein, 21 aa, Homo sapiens
  heavy chain complementarity determining region 3 for antibody 26813
AKDRPNYYESNGQYYTPKGDL

SEQ ID NO: 53627 - protein, 12 aa, Homo sapiens
  light chain complementarity determining region 3 for antibody 26814
MQGTHWPPGQFT

SEQ ID NO: 53628 - protein, 12 aa, Homo sapiens
  heavy chain complementarity determining region 3 for antibody 26814
ARRGELDDAFDI

SEQ ID NO: 53629 - protein, 10 aa, Homo sapiens
  light chain complementarity determining region 3 for antibody 26815
MQGTHWPLWR

SEQ ID NO: 53630 - protein, 12 aa, Homo sapiens
  heavy chain complementarity determining region 3 for antibody 26815
TTGLNWGWEPDY

SEQ ID NO: 53631 - protein, 9 aa, Homo sapiens
  light chain complementarity determining region 3 for antibody 26816
MQGTHWPDT

SEQ ID NO: 53632 - protein, 11 aa, Homo sapiens
  heavy chain complementarity determining region 3 for antibody 26816
GKDLLPGGLDV

SEQ ID NO: 53633 - protein, 9 aa, Homo sapiens
  light chain complementarity determining region 3 for antibody 26817
MQGTHGPLG

SEQ ID NO: 53634 - protein, 18 aa, Homo sapiens
  heavy chain complementarity determining region 3 for antibody 26817
ARDERDTCTNGLCYYFDY

SEQ ID NO: 53635 - protein, 10 aa, Homo sapiens
  light chain complementarity determining region 3 for antibody 26818
MQGSYWPPRT

SEQ ID NO: 53636 - protein, 11 aa, Homo sapiens
  heavy chain complementarity determining region 3 for antibody 26818
ARDTPGIGIDY

SEQ ID NO: 53637 - protein, 9 aa, Homo sapiens
  light chain complementarity determining region 3 for antibody 26819
MQGRRWPHT

SEQ ID NO: 53638 - protein, 8 aa, Homo sapiens
  heavy chain complementarity determining region 3 for antibody 26819
TAWGSSQH

SEQ ID NO: 53639 - protein, 9 aa, Homo sapiens
  light chain complementarity determining region 3 for antibody 26820
MQGAHWPDT

SEQ ID NO: 53640 - protein, 11 aa, Homo sapiens
  heavy chain complementarity determining region 3 for antibody 26820
ATVRLVGAVDY

SEQ ID NO: 53641 - protein, 9 aa, Homo sapiens
  light chain complementarity determining region 3 for antibody 26821
MQALRTRFT

SEQ ID NO: 53642 - protein, 23 aa, Homo sapiens
  heavy chain complementarity determining region 3 for antibody 26821
ARVSQNLGEWSGSSRYGINAFDP

SEQ ID NO: 53643 - protein, 8 aa, Homo sapiens
  light chain complementarity determining region 3 for antibody 26822
MQALRPLP

SEQ ID NO: 53644 - protein, 16 aa, Homo sapiens
  heavy chain complementarity determining region 3 for antibody 26822
AKVGWLVGYDLSRGSA

SEQ ID NO: 53645 - protein, 9 aa, Homo sapiens
  light chain complementarity determining region 3 for antibody 26823
MQALQTPWT

SEQ ID NO: 53646 - protein, 9 aa, Homo sapiens
  heavy chain complementarity determining region 3 for antibody 26823
ATLNWGSRT

SEQ ID NO: 53647 - protein, 10 aa, Homo sapiens
  light chain complementarity determining region 3 for antibody 26824
MQALQTPRWT

SEQ ID NO: 53648 - protein, 14 aa, Homo sapiens
  heavy chain complementarity determining region 3 for antibody 26824
ARAAPEYEWLVPDY

SEQ ID NO: 53649 - protein, 9 aa, Homo sapiens
  light chain complementarity determining region 3 for antibody 26825
MQALQTPPT

SEQ ID NO: 53650 - protein, 12 aa, Homo sapiens
  heavy chain complementarity determining region 3 for antibody 26825
AKDSEQKWELRD

SEQ ID NO: 53651 - protein, 8 aa, Homo sapiens
  light chain complementarity determining region 3 for antibody 26826
MQALQTPP

SEQ ID NO: 53652 - protein, 17 aa, Homo sapiens
  heavy chain complementarity determining region 3 for antibody 26826
ARVAQPGAGIRCYGMDV

SEQ ID NO: 53653 - protein, 10 aa, Homo sapiens
  light chain complementarity determining region 3 for antibody 26827
MQALQTLPKT

SEQ ID NO: 53654 - protein, 13 aa, Homo sapiens
  heavy chain complementarity determining region 3 for antibody 26827
ARQGNTYYYGMDV

SEQ ID NO: 53655 - protein, 10 aa, Homo sapiens
  light chain complementarity determining region 3 for antibody 26828
MQALQTLLFT

SEQ ID NO: 53656 - protein, 12 aa, Homo sapiens
  heavy chain complementarity determining region 3 for antibody 26828
TSRSFVLDAFEV

SEQ ID NO: 53657 - protein, 8 aa, Homo sapiens
  light chain complementarity determining region 3 for antibody 26829
MQALETRT

SEQ ID NO: 53658 - protein, 20 aa, Homo sapiens
  heavy chain complementarity determining region 3 for antibody 26829
ARDMDEYCGGDCYYYSGMDV

SEQ ID NO: 53659 - protein, 9 aa, Homo sapiens
  light chain complementarity determining region 3 for antibody 26830
MQALETPFT

SEQ ID NO: 53660 - protein, 15 aa, Homo sapiens
  heavy chain complementarity determining region 3 for antibody 26830
VRHYRETVAGIGGDS

SEQ ID NO: 53661 - protein, 9 aa, Homo sapiens
  light chain complementarity determining region 3 for antibody 26831
MQALEIPFT

SEQ ID NO: 53662 - protein, 15 aa, Homo sapiens
  heavy chain complementarity determining region 3 for antibody 26831
VRHYRELATGIEGDS

SEQ ID NO: 53663 - protein, 9 aa, Homo sapiens
  light chain complementarity determining region 3 for antibody 26832
MQAHQTQLT

SEQ ID NO: 53664 - protein, 15 aa, Homo sapiens
  heavy chain complementarity determining region 3 for antibody 26832
ARTGSSTWYGYGMDV

SEQ ID NO: 53665 - protein, 9 aa, Homo sapiens
  light chain complementarity determining region 3 for antibody 26833
LQYGRSPWT

SEQ ID NO: 53666 - protein, 11 aa, Homo sapiens
  heavy chain complementarity determining region 3 for antibody 26833
ATWAFYHGLDV

SEQ ID NO: 53667 - protein, 9 aa, Homo sapiens
  light chain complementarity determining region 3 for antibody 26834
LQYDISPRT

SEQ ID NO: 53668 - protein, 12 aa, Homo sapiens
  heavy chain complementarity determining region 3 for antibody 26834
TTMYGFFHSIDY

SEQ ID NO: 53669 - protein, 9 aa, Homo sapiens
  light chain complementarity determining region 3 for antibody 26835
LQTEYWPRT

SEQ ID NO: 53670 - protein, 11 aa, Homo sapiens
  heavy chain complementarity determining region 3 for antibody 26835
VRVGGAGYFDH

SEQ ID NO: 53671 - protein, 9 aa, Homo sapiens
  light chain complementarity determining region 3 for antibody 26836
LQSLQGPFT

SEQ ID NO: 53672 - protein, 13 aa, Homo sapiens
  heavy chain complementarity determining region 3 for antibody 26836
ATSDVWLGELFDF

SEQ ID NO: 53673 - protein, 9 aa, Homo sapiens
  light chain complementarity determining region 3 for antibody 26837
LQSLPSPFT

SEQ ID NO: 53674 - protein, 13 aa, Homo sapiens
  heavy chain complementarity determining region 3 for antibody 26837
ATSDVWLGELFDF

SEQ ID NO: 53675 - protein, 12 aa, Homo sapiens
  light chain complementarity determining region 3 for antibody 26838
LQRSNWTSGQLT

SEQ ID NO: 53676 - protein, 13 aa, Homo sapiens
  heavy chain complementarity determining region 3 for antibody 26838
ARGLLWYSSGMDV

SEQ ID NO: 53677 - protein, 9 aa, Homo sapiens
  light chain complementarity determining region 3 for antibody 26839
LQNAYWPRT

SEQ ID NO: 53678 - protein, 11 aa, Homo sapiens
  heavy chain complementarity determining region 3 for antibody 26839
VRVGGAGYFDH

SEQ ID NO: 53679 - protein, 9 aa, Homo sapiens
  light chain complementarity determining region 3 for antibody 26840
LQHNSYPWT

SEQ ID NO: 53680 - protein, 11 aa, Homo sapiens
  heavy chain complementarity determining region 3 for antibody 26840
ARGPARGYFDY

SEQ ID NO: 53681 - protein, 9 aa, Homo sapiens
  light chain complementarity determining region 3 for antibody 26841
LQHNSYPWT

SEQ ID NO: 53682 - protein, 14 aa, Homo sapiens
  heavy chain complementarity determining region 3 for antibody 26841
ARDPSGVLIGAWSH

SEQ ID NO: 53683 - protein, 9 aa, Homo sapiens
  light chain complementarity determining region 3 for antibody 26842
LQHNRYPGT

SEQ ID NO: 53684 - protein, 6 aa, Homo sapiens
  heavy chain complementarity determining region 3 for antibody 26842
AKGPFI

SEQ ID NO: 53685 - protein, 9 aa, Homo sapiens
  light chain complementarity determining region 3 for antibody 26843
LQHDYWPRT

SEQ ID NO: 53686 - protein, 11 aa, Homo sapiens
  heavy chain complementarity determining region 3 for antibody 26843
VRVGGAGYFDH

SEQ ID NO: 53687 - protein, 9 aa, Homo sapiens
  light chain complementarity determining region 3 for antibody 26844
LQHDNFPLH

SEQ ID NO: 53688 - protein, 20 aa, Homo sapiens
  heavy chain complementarity determining region 3 for antibody 26844
ARVYKLSAFRGGGWYGAFDI

SEQ ID NO: 53689 - protein, 9 aa, Homo sapiens
  light chain complementarity determining region 3 for antibody 26845
LQEYTYPVS

SEQ ID NO: 53690 - protein, 15 aa, Homo sapiens
  heavy chain complementarity determining region 3 for antibody 26845
ARIRRYGSTWDTLDH

SEQ ID NO: 53691 - protein, 9 aa, Homo sapiens
  light chain complementarity determining region 3 for antibody 26846
LPNEYWPRT

SEQ ID NO: 53692 - protein, 11 aa, Homo sapiens
  heavy chain complementarity determining region 3 for antibody 26846
VRVGGAGYFDH

SEQ ID NO: 53693 - protein, 9 aa, Homo sapiens
  light chain complementarity determining region 3 for antibody 26847
LHNNNFPYA

SEQ ID NO: 53694 - protein, 14 aa, Homo sapiens
  heavy chain complementarity determining region 3 for antibody 26847
TRTEWSSGWRLFDY

SEQ ID NO: 53695 - protein, 8 aa, Homo sapiens
  light chain complementarity determining region 3 for antibody 26848
LDYYNVPL

SEQ ID NO: 53696 - protein, 15 aa, Homo sapiens
  heavy chain complementarity determining region 3 for antibody 26848
ATTRPLRGAAPPSDY

SEQ ID NO: 53697 - protein, 10 aa, Homo sapiens
  light chain complementarity determining region 3 for antibody 26849
KQYNNWPPFT

SEQ ID NO: 53698 - protein, 13 aa, Homo sapiens
  heavy chain complementarity determining region 3 for antibody 26849
ARDDILADNGFDY

SEQ ID NO: 53699 - protein, 9 aa, Homo sapiens
  light chain complementarity determining region 3 for antibody 26850
KQFKSFPIT

SEQ ID NO: 53700 - protein, 11 aa, Homo sapiens
  heavy chain complementarity determining region 3 for antibody 26850
TNDGGHWDFDF

SEQ ID NO: 53701 - protein, 9 aa, Homo sapiens
  light chain complementarity determining region 3 for antibody 26851
HQYHSSPRP

SEQ ID NO: 53702 - protein, 13 aa, Homo sapiens
  heavy chain complementarity determining region 3 for antibody 26851
ARTGRISGVEGAT

SEQ ID NO: 53703 - protein, 9 aa, Homo sapiens
  light chain complementarity determining region 3 for antibody 26852
HQYGSSPRT

SEQ ID NO: 53704 - protein, 25 aa, Homo sapiens
  heavy chain complementarity determining region 3 for antibody 26852
ARLRIDRLRLPGAMRGPLYDCGLNV

SEQ ID NO: 53705 - protein, 9 aa, Homo sapiens
  light chain complementarity determining region 3 for antibody 26853
HQYGLSPRP

SEQ ID NO: 53706 - protein, 13 aa, Homo sapiens
  heavy chain complementarity determining region 3 for antibody 26853
ARTGRVAGVEGAS

SEQ ID NO: 53707 - protein, 9 aa, Homo sapiens
  light chain complementarity determining region 3 for antibody 26854
HQYGESPRR

SEQ ID NO: 53708 - protein, 16 aa, Homo sapiens
  heavy chain complementarity determining region 3 for antibody 26854
AKSLGVDAMTTRVYDS

SEQ ID NO: 53709 - protein, 10 aa, Homo sapiens
  light chain complementarity determining region 3 for antibody 26855
HQYASSPPPT

SEQ ID NO: 53710 - protein, 18 aa, Homo sapiens
  heavy chain complementarity determining region 3 for antibody 26855
AKEGYYYNSGSYYNPLDY

SEQ ID NO: 53711 - protein, 9 aa, Homo sapiens
  light chain complementarity determining region 3 for antibody 26856
HQTASLPLT

SEQ ID NO: 53712 - protein, 21 aa, Homo sapiens
  heavy chain complementarity determining region 3 for antibody 26856
AKDVGYCGGGNCDRDYKGMDV

SEQ ID NO: 53713 - protein, 9 aa, Homo sapiens
  light chain complementarity determining region 3 for antibody 26857
HQSSTFPQT

SEQ ID NO: 53714 - protein, 9 aa, Homo sapiens
  heavy chain complementarity determining region 3 for antibody 26857
ARDGGPFDY

SEQ ID NO: 53715 - protein, 9 aa, Homo sapiens
  light chain complementarity determining region 3 for antibody 26858
HQSSSFPHT

SEQ ID NO: 53716 - protein, 13 aa, Homo sapiens
  heavy chain complementarity determining region 3 for antibody 26858
ARDLAFGEGYFDS

SEQ ID NO: 53717 - protein, 9 aa, Homo sapiens
  light chain complementarity determining region 3 for antibody 26859
HQSNSFPWT

SEQ ID NO: 53718 - protein, 13 aa, Homo sapiens
  heavy chain complementarity determining region 3 for antibody 26859
ARVIAQTAPPFDS

SEQ ID NO: 53719 - protein, 9 aa, Homo sapiens
  light chain complementarity determining region 3 for antibody 26860
HQRSDWPGT

SEQ ID NO: 53720 - protein, 9 aa, Homo sapiens
  heavy chain complementarity determining region 3 for antibody 26860
ASGDYAFDL

SEQ ID NO: 53721 - protein, 9 aa, Homo sapiens
  light chain complementarity determining region 3 for antibody 26861
HQRSDWPEP

SEQ ID NO: 53722 - protein, 9 aa, Homo sapiens
  heavy chain complementarity determining region 3 for antibody 26861
ASGDYAFDL

SEQ ID NO: 53723 - protein, 9 aa, Homo sapiens
  light chain complementarity determining region 3 for antibody 26862
HQGYRTPFT

SEQ ID NO: 53724 - protein, 15 aa, Homo sapiens
  heavy chain complementarity determining region 3 for antibody 26862
AKAQVIWGQLYYFDS

SEQ ID NO: 53725 - protein, 9 aa, Homo sapiens
  light chain complementarity determining region 3 for antibody 26863
HQDGLSPRT

SEQ ID NO: 53726 - protein, 13 aa, Homo sapiens
  heavy chain complementarity determining region 3 for antibody 26863
ARTGRVAGVEGAS

SEQ ID NO: 53727 - protein, 9 aa, Homo sapiens
  light chain complementarity determining region 3 for antibody 26864
HQDATSPWT

SEQ ID NO: 53728 - protein, 14 aa, Homo sapiens
  heavy chain complementarity determining region 3 for antibody 26864
ARFGWLDYYYGMDV

SEQ ID NO: 53729 - protein, 11 aa, Homo sapiens
  light chain complementarity determining region 3 for antibody 26865
HLYGSSPPGNT

SEQ ID NO: 53730 - protein, 11 aa, Homo sapiens
  heavy chain complementarity determining region 3 for antibody 26865
ARHGTDYYFDY

SEQ ID NO: 53731 - protein, 9 aa, Homo sapiens
  light chain complementarity determining region 3 for antibody 26866
HKYGSGPRT

SEQ ID NO: 53732 - protein, 12 aa, Homo sapiens
  heavy chain complementarity determining region 3 for antibody 26866
ARAVRYQLLSDP

SEQ ID NO: 53733 - protein, 9 aa, Homo sapiens
  light chain complementarity determining region 3 for antibody 26867
HHPSTFPRT

SEQ ID NO: 53734 - protein, 20 aa, Homo sapiens
  heavy chain complementarity determining region 3 for antibody 26867
ARGRRIAALSTAHYYYGMDV

SEQ ID NO: 53735 - protein, 9 aa, Homo sapiens
  light chain complementarity determining region 3 for antibody 26868
EQYDSLPRT

SEQ ID NO: 53736 - protein, 20 aa, Homo sapiens
  heavy chain complementarity determining region 3 for antibody 26868
AGDSRPGPSDFRSGRGPYAY

SEQ ID NO: 53737 - protein, 9 aa, Homo sapiens
  light chain complementarity determining region 3 for antibody 26869
VQNHATPVT

SEQ ID NO: 53738 - protein, 9 aa, Homo sapiens
  heavy chain complementarity determining region 3 for antibody 26869
ATGVDADYG

SEQ ID NO: 53739 - protein, 9 aa, Homo sapiens
  light chain complementarity determining region 3 for antibody 26870
VQGKYWPDT

SEQ ID NO: 53740 - protein, 11 aa, Homo sapiens
  heavy chain complementarity determining region 3 for antibody 26870
AKDDAAGSIDS

SEQ ID NO: 53741 - protein, 9 aa, Homo sapiens
  light chain complementarity determining region 3 for antibody 26871
TQSYYTPLT

SEQ ID NO: 53742 - protein, 16 aa, Homo sapiens
  heavy chain complementarity determining region 3 for antibody 26871
ARHHNWGYGDKVGLDY

SEQ ID NO: 53743 - protein, 9 aa, Homo sapiens
  light chain complementarity determining region 3 for antibody 26872
RQYDHSPRT

SEQ ID NO: 53744 - protein, 22 aa, Homo sapiens
  heavy chain complementarity determining region 3 for antibody 26872
VRDWERQAYCDGGGCQQDAFDI

SEQ ID NO: 53745 - protein, 9 aa, Homo sapiens
  light chain complementarity determining region 3 for antibody 26873
RQVLQTPLT

SEQ ID NO: 53746 - protein, 12 aa, Homo sapiens
  heavy chain complementarity determining region 3 for antibody 26873
AKDSEQKWELHD

SEQ ID NO: 53747 - protein, 9 aa, Homo sapiens
  light chain complementarity determining region 3 for antibody 26874
RQRTHWPPG

SEQ ID NO: 53748 - protein, 18 aa, Homo sapiens
  heavy chain complementarity determining region 3 for antibody 26874
ARDRYSCDSGGCFHWFDP

SEQ ID NO: 53749 - protein, 9 aa, Homo sapiens
  light chain complementarity determining region 3 for antibody 26875
RQGTHWPLT

SEQ ID NO: 53750 - protein, 11 aa, Homo sapiens
  heavy chain complementarity determining region 3 for antibody 26875
ARDIGWNALDL

SEQ ID NO: 53751 - protein, 9 aa, Homo sapiens
  light chain complementarity determining region 3 for antibody 26876
RKYNSAPWT

SEQ ID NO: 53752 - protein, 14 aa, Homo sapiens
  heavy chain complementarity determining region 3 for antibody 26876
AKSSGTTVTTSFDY

SEQ ID NO: 53753 - protein, 8 aa, Homo sapiens
  light chain complementarity determining region 3 for antibody 26877
RHALQTPG

SEQ ID NO: 53754 - protein, 19 aa, Homo sapiens
  heavy chain complementarity determining region 3 for antibody 26877
ANFGSGNFYNVRYYYGMDV

SEQ ID NO: 53755 - protein, 10 aa, Homo sapiens
  light chain complementarity determining region 3 for antibody 26878
QYYGLSPPFT

SEQ ID NO: 53756 - protein, 20 aa, Homo sapiens
  heavy chain complementarity determining region 3 for antibody 26878
ARDEGWGSMIVMWTDYYLHY

SEQ ID NO: 53757 - protein, 10 aa, Homo sapiens
  light chain complementarity determining region 3 for antibody 26879
QVYDSSFLWT

SEQ ID NO: 53758 - protein, 19 aa, Homo sapiens
  heavy chain complementarity determining region 3 for antibody 26879
ARESFVRKVGGQRPYYFDI

SEQ ID NO: 53759 - protein, 8 aa, Homo sapiens
  light chain complementarity determining region 3 for antibody 26880
QRYDWSHT

SEQ ID NO: 53760 - protein, 14 aa, Homo sapiens
  heavy chain complementarity determining region 3 for antibody 26880
ARHGGSVWYKGFDI

SEQ ID NO: 53761 - protein, 11 aa, Homo sapiens
  light chain complementarity determining region 3 for antibody 26881
QRYDTSPPRSS

SEQ ID NO: 53762 - protein, 14 aa, Homo sapiens
  heavy chain complementarity determining region 3 for antibody 26881
ARHKQESGTRGFDF

SEQ ID NO: 53763 - protein, 9 aa, Homo sapiens
  light chain complementarity determining region 3 for antibody 26882
QRYDSLPLT

SEQ ID NO: 53764 - protein, 15 aa, Homo sapiens
  heavy chain complementarity determining region 3 for antibody 26882
ARAYTGYDYYYGMDL

SEQ ID NO: 53765 - protein, 10 aa, Homo sapiens
  light chain complementarity determining region 3 for antibody 26883
QRYDISQVNT

SEQ ID NO: 53766 - protein, 22 aa, Homo sapiens
  heavy chain complementarity determining region 3 for antibody 26883
ARVSRFSLVRGMTTYYYYGMDV

SEQ ID NO: 53767 - protein, 9 aa, Homo sapiens
  light chain complementarity determining region 3 for antibody 26884
QRSDRKPLT

SEQ ID NO: 53768 - protein, 14 aa, Homo sapiens
  heavy chain complementarity determining region 3 for antibody 26884
ARDNSNNWYEGMDV

SEQ ID NO: 53769 - protein, 10 aa, Homo sapiens
  light chain complementarity determining region 3 for antibody 26885
QRDDISQVYT

SEQ ID NO: 53770 - protein, 22 aa, Homo sapiens
  heavy chain complementarity determining region 3 for antibody 26885
ARVSRFSLVRGMTTYYYYGMDV

SEQ ID NO: 53771 - protein, 9 aa, Homo sapiens
  light chain complementarity determining region 3 for antibody 26886
QRADRKPFT

SEQ ID NO: 53772 - protein, 14 aa, Homo sapiens
  heavy chain complementarity determining region 3 for antibody 26886
ARDNSNNWYEGMDV

SEQ ID NO: 53773 - protein, 9 aa, Homo sapiens
  light chain complementarity determining region 3 for antibody 26887
QQYYTTPRT

SEQ ID NO: 53774 - protein, 15 aa, Homo sapiens
  heavy chain complementarity determining region 3 for antibody 26887
ASLSPAWYDSSGYSA

SEQ ID NO: 53775 - protein, 9 aa, Homo sapiens
  light chain complementarity determining region 3 for antibody 26888
QQYYTTPRI

SEQ ID NO: 53776 - protein, 8 aa, Homo sapiens
  heavy chain complementarity determining region 3 for antibody 26888
ARDGAFDS

SEQ ID NO: 53777 - protein, 9 aa, Homo sapiens
  light chain complementarity determining region 3 for antibody 26889
QQYYTSVRT

SEQ ID NO: 53778 - protein, 12 aa, Homo sapiens
  heavy chain complementarity determining region 3 for antibody 26889
VKDCGLGGSCDF

SEQ ID NO: 53779 - protein, 9 aa, Homo sapiens
  light chain complementarity determining region 3 for antibody 26890
QQYYTSLRP

SEQ ID NO: 53780 - protein, 12 aa, Homo sapiens
  heavy chain complementarity determining region 3 for antibody 26890
VKDCGLGGPRDY

SEQ ID NO: 53781 - protein, 9 aa, Homo sapiens
  light chain complementarity determining region 3 for antibody 26891
QQYYTFVRT

SEQ ID NO: 53782 - protein, 12 aa, Homo sapiens
  heavy chain complementarity determining region 3 for antibody 26891
VKDCGLGGSRDS

SEQ ID NO: 53783 - protein, 9 aa, Homo sapiens
  light chain complementarity determining region 3 for antibody 26892
QQYYSTPYT

SEQ ID NO: 53784 - protein, 15 aa, Homo sapiens
  heavy chain complementarity determining region 3 for antibody 26892
ARVGVDPNYYYGLDV

SEQ ID NO: 53785 - protein, 9 aa, Homo sapiens
  light chain complementarity determining region 3 for antibody 26893
QQYYSTPWT

SEQ ID NO: 53786 - protein, 22 aa, Homo sapiens
  heavy chain complementarity determining region 3 for antibody 26893
ARKGVLRFLEWLLPGERGYFDY

SEQ ID NO: 53787 - protein, 9 aa, Homo sapiens
  light chain complementarity determining region 3 for antibody 26894
QQYYSTPLT

SEQ ID NO: 53788 - protein, 15 aa, Homo sapiens
  heavy chain complementarity determining region 3 for antibody 26894
ARVRSTVTTYDAFDI

SEQ ID NO: 53789 - protein, 9 aa, Homo sapiens
  light chain complementarity determining region 3 for antibody 26895
QQYYSSPFT

SEQ ID NO: 53790 - protein, 14 aa, Homo sapiens
  heavy chain complementarity determining region 3 for antibody 26895
ARSADTGLSSSLDD

SEQ ID NO: 53791 - protein, 9 aa, Homo sapiens
  light chain complementarity determining region 3 for antibody 26896
QQYYSSPFT

SEQ ID NO: 53792 - protein, 17 aa, Homo sapiens
  heavy chain complementarity determining region 3 for antibody 26896
ARDHPWVVAANRRAFDI

SEQ ID NO: 53793 - protein, 9 aa, Homo sapiens
  light chain complementarity determining region 3 for antibody 26897
QQYYSPPPT

SEQ ID NO: 53794 - protein, 13 aa, Homo sapiens
  heavy chain complementarity determining region 3 for antibody 26897
ARHAEWEVGRFDY

SEQ ID NO: 53795 - protein, 9 aa, Homo sapiens
  light chain complementarity determining region 3 for antibody 26898
QQYYSNPWT

SEQ ID NO: 53796 - protein, 15 aa, Homo sapiens
  heavy chain complementarity determining region 3 for antibody 26898
IRQSKMNNNWDYPDS

SEQ ID NO: 53797 - protein, 9 aa, Homo sapiens
  light chain complementarity determining region 3 for antibody 26899
QQYYSGPPT

SEQ ID NO: 53798 - protein, 19 aa, Homo sapiens
  heavy chain complementarity determining region 3 for antibody 26899
TRHGLGGLGSGWYEDFFDY

SEQ ID NO: 53799 - protein, 9 aa, Homo sapiens
  light chain complementarity determining region 3 for antibody 26900
QQYYRYPGT

SEQ ID NO: 53800 - protein, 15 aa, Homo sapiens
  heavy chain complementarity determining region 3 for antibody 26900
AHGQHTTTVTSYFNY

SEQ ID NO: 53801 - protein, 9 aa, Homo sapiens
  light chain complementarity determining region 3 for antibody 26901
QQYYPSVRT

SEQ ID NO: 53802 - protein, 12 aa, Homo sapiens
  heavy chain complementarity determining region 3 for antibody 26901
VKDCGLGGSRDS

SEQ ID NO: 53803 - protein, 9 aa, Homo sapiens
  light chain complementarity determining region 3 for antibody 26902
QQYYLIPYT

SEQ ID NO: 53804 - protein, 13 aa, Homo sapiens
  heavy chain complementarity determining region 3 for antibody 26902
TTVDRTSSWTFDI

SEQ ID NO: 53805 - protein, 9 aa, Homo sapiens
  light chain complementarity determining region 3 for antibody 26903
QQYYIIPLT

SEQ ID NO: 53806 - protein, 17 aa, Homo sapiens
  heavy chain complementarity determining region 3 for antibody 26903
ARNFPTTVIIRGTGFDI

SEQ ID NO: 53807 - protein, 8 aa, Homo sapiens
  light chain complementarity determining region 3 for antibody 26904
QQYVHLYT

SEQ ID NO: 53808 - protein, 13 aa, Homo sapiens
  heavy chain complementarity determining region 3 for antibody 26904
ARRAGRPKGYFDS

SEQ ID NO: 53809 - protein, 10 aa, Homo sapiens
  light chain complementarity determining region 3 for antibody 26905
QQYTNWPLFT

SEQ ID NO: 53810 - protein, 13 aa, Homo sapiens
  heavy chain complementarity determining region 3 for antibody 26905
ATDLGGSNSNFDC

SEQ ID NO: 53811 - protein, 9 aa, Homo sapiens
  light chain complementarity determining region 3 for antibody 26906
QQYSSVPIT

SEQ ID NO: 53812 - protein, 15 aa, Homo sapiens
  heavy chain complementarity determining region 3 for antibody 26906
AHSQCTGGTCFLLDY

SEQ ID NO: 53813 - protein, 8 aa, Homo sapiens
  light chain complementarity determining region 3 for antibody 26907
QQYSSLWT

SEQ ID NO: 53814 - protein, 20 aa, Homo sapiens
  heavy chain complementarity determining region 3 for antibody 26907
ARPSEDVLKWGPQGDWHYDL

SEQ ID NO: 53815 - protein, 9 aa, Homo sapiens
  light chain complementarity determining region 3 for antibody 26908
QQYSQYPWP

SEQ ID NO: 53816 - protein, 16 aa, Homo sapiens
  heavy chain complementarity determining region 3 for antibody 26908
AAVPNYGWNSDDAFHI

SEQ ID NO: 53817 - protein, 10 aa, Homo sapiens
  light chain complementarity determining region 3 for antibody 26909
QQYSISPTWT

SEQ ID NO: 53818 - protein, 17 aa, Homo sapiens
  heavy chain complementarity determining region 3 for antibody 26909
ARDPCKKATDVVCAWDS

SEQ ID NO: 53819 - protein, 10 aa, Homo sapiens
  light chain complementarity determining region 3 for antibody 26910
QQYSHWPPGT

SEQ ID NO: 53820 - protein, 16 aa, Homo sapiens
  heavy chain complementarity determining region 3 for antibody 26910
ATYYSNWPYFYYGFDV

SEQ ID NO: 53821 - protein, 10 aa, Homo sapiens
  light chain complementarity determining region 3 for antibody 26911
QQYSHWPPAT

SEQ ID NO: 53822 - protein, 16 aa, Homo sapiens
  heavy chain complementarity determining region 3 for antibody 26911
ATYYSNWPYFYYGFDV

SEQ ID NO: 53823 - protein, 9 aa, Homo sapiens
  light chain complementarity determining region 3 for antibody 26912
QQYSFSPWT

SEQ ID NO: 53824 - protein, 13 aa, Homo sapiens
  heavy chain complementarity determining region 3 for antibody 26912
ARGSTNWRNWFDP

SEQ ID NO: 53825 - protein, 11 aa, Homo sapiens
  light chain complementarity determining region 3 for antibody 26913
QQYSDWPPSFT

SEQ ID NO: 53826 - protein, 14 aa, Homo sapiens
  heavy chain complementarity determining region 3 for antibody 26913
ARASGSNVKMPFDF

SEQ ID NO: 53827 - protein, 9 aa, Homo sapiens
  light chain complementarity determining region 3 for antibody 26914
QQYSDGPLT

SEQ ID NO: 53828 - protein, 9 aa, Homo sapiens
  heavy chain complementarity determining region 3 for antibody 26914
VCLGVTPPV

SEQ ID NO: 53829 - protein, 9 aa, Homo sapiens
  light chain complementarity determining region 3 for antibody 26915
QQYRTYPWT

SEQ ID NO: 53830 - protein, 16 aa, Homo sapiens
  heavy chain complementarity determining region 3 for antibody 26915
ARVRYPISADNRVVDH

SEQ ID NO: 53831 - protein, 9 aa, Homo sapiens
  light chain complementarity determining region 3 for antibody 26916
QQYRSSPGT

SEQ ID NO: 53832 - protein, 22 aa, Homo sapiens
  heavy chain complementarity determining region 3 for antibody 26916
ARAVSTNRWGRSTGDWGGAYDI

SEQ ID NO: 53833 - protein, 9 aa, Homo sapiens
  light chain complementarity determining region 3 for antibody 26917
QQYRRSPRT

SEQ ID NO: 53834 - protein, 17 aa, Homo sapiens
  heavy chain complementarity determining region 3 for antibody 26917
AGLSSRLGDGSPSLFDY

SEQ ID NO: 53835 - protein, 8 aa, Homo sapiens
  light chain complementarity determining region 3 for antibody 26918
QQYQSGYT

SEQ ID NO: 53836 - protein, 13 aa, Homo sapiens
  heavy chain complementarity determining region 3 for antibody 26918
ARGRGRGWFYFDF

SEQ ID NO: 53837 - protein, 8 aa, Homo sapiens
  light chain complementarity determining region 3 for antibody 26919
QQYNTYST

SEQ ID NO: 53838 - protein, 19 aa, Homo sapiens
  heavy chain complementarity determining region 3 for antibody 26919
VRQGYCSSSACSVGWYIGL

SEQ ID NO: 53839 - protein, 9 aa, Homo sapiens
  light chain complementarity determining region 3 for antibody 26920
QQYNTYPLT

SEQ ID NO: 53840 - protein, 7 aa, Homo sapiens
  heavy chain complementarity determining region 3 for antibody 26920
VSIKVGA

SEQ ID NO: 53841 - protein, 9 aa, Homo sapiens
  light chain complementarity determining region 3 for antibody 26921
QQYNTWPRT

SEQ ID NO: 53842 - protein, 22 aa, Homo sapiens
  heavy chain complementarity determining region 3 for antibody 26921
AREVRASGYDDFYNYYSYGLDV

SEQ ID NO: 53843 - protein, 9 aa, Homo sapiens
  light chain complementarity determining region 3 for antibody 26922
QQYNTSPRT

SEQ ID NO: 53844 - protein, 14 aa, Homo sapiens
  heavy chain complementarity determining region 3 for antibody 26922
AREGDLDFHYGMDV

SEQ ID NO: 53845 - protein, 9 aa, Homo sapiens
  light chain complementarity determining region 3 for antibody 26923
QQYNSYSRT

SEQ ID NO: 53846 - protein, 7 aa, Homo sapiens
  heavy chain complementarity determining region 3 for antibody 26923
ARGPFDY

SEQ ID NO: 53847 - protein, 9 aa, Homo sapiens
  light chain complementarity determining region 3 for antibody 26924
QQYNSYSGP

SEQ ID NO: 53848 - protein, 13 aa, Homo sapiens
  heavy chain complementarity determining region 3 for antibody 26924
ARCVSGWFAPYDY

SEQ ID NO: 53849 - protein, 9 aa, Homo sapiens
  light chain complementarity determining region 3 for antibody 26925
QQYNSYLYT

SEQ ID NO: 53850 - protein, 22 aa, Homo sapiens
  heavy chain complementarity determining region 3 for antibody 26925
ARGGTGNRNSGWYRNFYYGMDV

SEQ ID NO: 53851 - protein, 8 aa, Homo sapiens
  light chain complementarity determining region 3 for antibody 26926
QQYNSQSS

SEQ ID NO: 53852 - protein, 16 aa, Homo sapiens
  heavy chain complementarity determining region 3 for antibody 26926
IKEKRTERVGFDALDV

SEQ ID NO: 53853 - protein, 9 aa, Homo sapiens
  light chain complementarity determining region 3 for antibody 26927
QQYNSFPRT

SEQ ID NO: 53854 - protein, 13 aa, Homo sapiens
  heavy chain complementarity determining region 3 for antibody 26927
AKADGSGYNYLDF

SEQ ID NO: 53855 - protein, 10 aa, Homo sapiens
  light chain complementarity determining region 3 for antibody 26928
QQYNSAPPWT

SEQ ID NO: 53856 - protein, 12 aa, Homo sapiens
  heavy chain complementarity determining region 3 for antibody 26928
ASGTARGYYFDN

SEQ ID NO: 53857 - protein, 8 aa, Homo sapiens
  light chain complementarity determining region 3 for antibody 26929
QQYNNWPT

SEQ ID NO: 53858 - protein, 16 aa, Homo sapiens
  heavy chain complementarity determining region 3 for antibody 26929
ARVGGGYSYPPVAFDI

SEQ ID NO: 53859 - protein, 9 aa, Homo sapiens
  light chain complementarity determining region 3 for antibody 26930
QQYNNWPQT

SEQ ID NO: 53860 - protein, 24 aa, Homo sapiens
  heavy chain complementarity determining region 3 for antibody 26930
ARRTLPRGRLYSSGFLAGPGAFDI

SEQ ID NO: 53861 - protein, 10 aa, Homo sapiens
  light chain complementarity determining region 3 for antibody 26931
QQYNNWPPYT

SEQ ID NO: 53862 - protein, 14 aa, Homo sapiens
  heavy chain complementarity determining region 3 for antibody 26931
ARGGRLRLFSVSDY

SEQ ID NO: 53863 - protein, 10 aa, Homo sapiens
  light chain complementarity determining region 3 for antibody 26932
QQYNNWPPFT

SEQ ID NO: 53864 - protein, 14 aa, Homo sapiens
  heavy chain complementarity determining region 3 for antibody 26932
ARGGRLRLFSFSDY

SEQ ID NO: 53865 - protein, 9 aa, Homo sapiens
  light chain complementarity determining region 3 for antibody 26933
QQYNNWLWT

SEQ ID NO: 53866 - protein, 15 aa, Homo sapiens
  heavy chain complementarity determining region 3 for antibody 26933
ARALGISAKDGYSDY

SEQ ID NO: 53867 - protein, 10 aa, Homo sapiens
  light chain complementarity determining region 3 for antibody 26934
QQYNNWLGWP

SEQ ID NO: 53868 - protein, 13 aa, Homo sapiens
  heavy chain complementarity determining region 3 for antibody 26934
ARHGRRSGWYYTY

SEQ ID NO: 53869 - protein, 9 aa, Homo sapiens
  light chain complementarity determining region 3 for antibody 26935
QQYNNLPRT

SEQ ID NO: 53870 - protein, 12 aa, Homo sapiens
  heavy chain complementarity determining region 3 for antibody 26935
ARGLSSGWGLDY

SEQ ID NO: 53871 - protein, 9 aa, Homo sapiens
  light chain complementarity determining region 3 for antibody 26936
QQYNNLPPT

SEQ ID NO: 53872 - protein, 12 aa, Homo sapiens
  heavy chain complementarity determining region 3 for antibody 26936
ARTLVQALIWDY

SEQ ID NO: 53873 - protein, 10 aa, Homo sapiens
  light chain complementarity determining region 3 for antibody 26937
QQYNNCPPYT

SEQ ID NO: 53874 - protein, 14 aa, Homo sapiens
  heavy chain complementarity determining region 3 for antibody 26937
ARGGRLRLFSFSDY

SEQ ID NO: 53875 - protein, 10 aa, Homo sapiens
  light chain complementarity determining region 3 for antibody 26938
QQYNKWPPWT

SEQ ID NO: 53876 - protein, 9 aa, Homo sapiens
  heavy chain complementarity determining region 3 for antibody 26938
ARGLNLFDP

SEQ ID NO: 53877 - protein, 9 aa, Homo sapiens
  light chain complementarity determining region 3 for antibody 26939
QQYNDYRYT

SEQ ID NO: 53878 - protein, 14 aa, Homo sapiens
  heavy chain complementarity determining region 3 for antibody 26939
TRLFSSAARRVFDP

SEQ ID NO: 53879 - protein, 10 aa, Homo sapiens
  light chain complementarity determining region 3 for antibody 26940
QQYNDWPPLT

SEQ ID NO: 53880 - protein, 13 aa, Homo sapiens
  heavy chain complementarity determining region 3 for antibody 26940
ARHVQYMVAALAY

SEQ ID NO: 53881 - protein, 9 aa, Homo sapiens
  light chain complementarity determining region 3 for antibody 26941
QQYNASSLT

SEQ ID NO: 53882 - protein, 16 aa, Homo sapiens
  heavy chain complementarity determining region 3 for antibody 26941
ASLGGAHYYGSGSHYF

SEQ ID NO: 53883 - protein, 8 aa, Homo sapiens
  light chain complementarity determining region 3 for antibody 26942
QQYMSPLT

SEQ ID NO: 53884 - protein, 12 aa, Homo sapiens
  heavy chain complementarity determining region 3 for antibody 26942
ARALSASWYAFY

SEQ ID NO: 53885 - protein, 8 aa, Homo sapiens
  light chain complementarity determining region 3 for antibody 26943
QQYMPPFT

SEQ ID NO: 53886 - protein, 12 aa, Homo sapiens
  heavy chain complementarity determining region 3 for antibody 26943
ARALSASWYAFY

SEQ ID NO: 53887 - protein, 9 aa, Homo sapiens
  light chain complementarity determining region 3 for antibody 26944
QQYLSGPWT

SEQ ID NO: 53888 - protein, 13 aa, Homo sapiens
  heavy chain complementarity determining region 3 for antibody 26944
ARLDNGGFYYVPY

SEQ ID NO: 53889 - protein, 8 aa, Homo sapiens
  light chain complementarity determining region 3 for antibody 26945
QQYKTAST

SEQ ID NO: 53890 - protein, 16 aa, Homo sapiens
  heavy chain complementarity determining region 3 for antibody 26945
ARDGLPVTSKPYYFDY

SEQ ID NO: 53891 - protein, 9 aa, Homo sapiens
  light chain complementarity determining region 3 for antibody 26946
QQYKSFPIT

SEQ ID NO: 53892 - protein, 16 aa, Homo sapiens
  heavy chain complementarity determining region 3 for antibody 26946
VTVHSSYSTGLDAFDF

SEQ ID NO: 53893 - protein, 10 aa, Homo sapiens
  light chain complementarity determining region 3 for antibody 26947
QQYKNWPPLT

SEQ ID NO: 53894 - protein, 15 aa, Homo sapiens
  heavy chain complementarity determining region 3 for antibody 26947
ARVKTYFDNSGYIDS

SEQ ID NO: 53895 - protein, 9 aa, Homo sapiens
  light chain complementarity determining region 3 for antibody 26948
QQYKGYSYT

SEQ ID NO: 53896 - protein, 16 aa, Homo sapiens
  heavy chain complementarity determining region 3 for antibody 26948
ARVTIRSNWFWTPFEY

SEQ ID NO: 53897 - protein, 11 aa, Homo sapiens
  light chain complementarity determining region 3 for antibody 26949
QQYITSPPGDT

SEQ ID NO: 53898 - protein, 11 aa, Homo sapiens
  heavy chain complementarity determining region 3 for antibody 26949
ARHGNDFYFDY

SEQ ID NO: 53899 - protein, 9 aa, Homo sapiens
  light chain complementarity determining region 3 for antibody 26950
QQYISYPWT

SEQ ID NO: 53900 - protein, 19 aa, Homo sapiens
  heavy chain complementarity determining region 3 for antibody 26950
ARVAARRILTAPRYPLIDS

SEQ ID NO: 53901 - protein, 9 aa, Homo sapiens
  light chain complementarity determining region 3 for antibody 26951
QQYISTPFT

SEQ ID NO: 53902 - protein, 8 aa, Homo sapiens
  heavy chain complementarity determining region 3 for antibody 26951
ARHAWLSP

SEQ ID NO: 53903 - protein, 8 aa, Homo sapiens
  light chain complementarity determining region 3 for antibody 26952
QQYHTLFT

SEQ ID NO: 53904 - protein, 14 aa, Homo sapiens
  heavy chain complementarity determining region 3 for antibody 26952
TKDRSARSGYAFDL

SEQ ID NO: 53905 - protein, 9 aa, Homo sapiens
  light chain complementarity determining region 3 for antibody 26953
QQYHSYPLT

SEQ ID NO: 53906 - protein, 16 aa, Homo sapiens
  heavy chain complementarity determining region 3 for antibody 26953
ARDRGRDSSGWLWFDP

SEQ ID NO: 53907 - protein, 10 aa, Homo sapiens
  light chain complementarity determining region 3 for antibody 26954
QQYHNWPPWT

SEQ ID NO: 53908 - protein, 12 aa, Homo sapiens
  heavy chain complementarity determining region 3 for antibody 26954
AASEWSGATFNY

SEQ ID NO: 53909 - protein, 10 aa, Homo sapiens
  light chain complementarity determining region 3 for antibody 26955
QQYHNWPPRT

SEQ ID NO: 53910 - protein, 21 aa, Homo sapiens
  heavy chain complementarity determining region 3 for antibody 26955
ARTGAEPNSWSSAPEDSWFDP

SEQ ID NO: 53911 - protein, 10 aa, Homo sapiens
  light chain complementarity determining region 3 for antibody 26956
QQYHNWPPGT

SEQ ID NO: 53912 - protein, 21 aa, Homo sapiens
  heavy chain complementarity determining region 3 for antibody 26956
ARTGAEPNSWSSAPEDSWFDP

SEQ ID NO: 53913 - protein, 10 aa, Homo sapiens
  light chain complementarity determining region 3 for antibody 26957
QQYGYSPKPT

SEQ ID NO: 53914 - protein, 18 aa, Homo sapiens
  heavy chain complementarity determining region 3 for antibody 26957
ATGHPLRLHDYYYFVMDV

SEQ ID NO: 53915 - protein, 10 aa, Homo sapiens
  light chain complementarity determining region 3 for antibody 26958
QQYGYSPKLT

SEQ ID NO: 53916 - protein, 18 aa, Homo sapiens
  heavy chain complementarity determining region 3 for antibody 26958
AAGHPLRLHDYYYFVMDV

SEQ ID NO: 53917 - protein, 10 aa, Homo sapiens
  light chain complementarity determining region 3 for antibody 26959
QQYGYPPPYP

SEQ ID NO: 53918 - protein, 11 aa, Homo sapiens
  heavy chain complementarity determining region 3 for antibody 26959
TRWRSDGHFDY

SEQ ID NO: 53919 - protein, 9 aa, Homo sapiens
  light chain complementarity determining region 3 for antibody 26960
QQYGTYPGT

SEQ ID NO: 53920 - protein, 11 aa, Homo sapiens
  heavy chain complementarity determining region 3 for antibody 26960
THRLVWEGVGH

SEQ ID NO: 53921 - protein, 9 aa, Homo sapiens
  light chain complementarity determining region 3 for antibody 26961
QQYGTSWDT

SEQ ID NO: 53922 - protein, 12 aa, Homo sapiens
  heavy chain complementarity determining region 3 for antibody 26961
ARESEDDDAFDI

SEQ ID NO: 53923 - protein, 12 aa, Homo sapiens
  light chain complementarity determining region 3 for antibody 26962
QQYGTSVPWPGA

SEQ ID NO: 53924 - protein, 14 aa, Homo sapiens
  heavy chain complementarity determining region 3 for antibody 26962
VRGGSSGYNHQVDY

SEQ ID NO: 53925 - protein, 11 aa, Homo sapiens
  light chain complementarity determining region 3 for antibody 26963
QQYGTSSTHWA

SEQ ID NO: 53926 - protein, 12 aa, Homo sapiens
  heavy chain complementarity determining region 3 for antibody 26963
VKEKRGVRVFDL

SEQ ID NO: 53927 - protein, 10 aa, Homo sapiens
  light chain complementarity determining region 3 for antibody 26964
QQYGTSSMYT

SEQ ID NO: 53928 - protein, 9 aa, Homo sapiens
  heavy chain complementarity determining region 3 for antibody 26964
ARGAAGFDY

SEQ ID NO: 53929 - protein, 9 aa, Homo sapiens
  light chain complementarity determining region 3 for antibody 26965
QQYGTSPWT

SEQ ID NO: 53930 - protein, 12 aa, Homo sapiens
  heavy chain complementarity determining region 3 for antibody 26965
SRGLRSGWGLDY

SEQ ID NO: 53931 - protein, 11 aa, Homo sapiens
  light chain complementarity determining region 3 for antibody 26966
QQYGTSPWAWA

SEQ ID NO: 53932 - protein, 13 aa, Homo sapiens
  heavy chain complementarity determining region 3 for antibody 26966
ARVAVPGLGYFQH

SEQ ID NO: 53933 - protein, 8 aa, Homo sapiens
  light chain complementarity determining region 3 for antibody 26967
QQYGTSPT

SEQ ID NO: 53934 - protein, 22 aa, Homo sapiens
  heavy chain complementarity determining region 3 for antibody 26967
ARGRGTVSRGATTKSYFNVMDV

SEQ ID NO: 53935 - protein, 8 aa, Homo sapiens
  light chain complementarity determining region 3 for antibody 26968
QQYGTSPT

SEQ ID NO: 53936 - protein, 22 aa, Homo sapiens
  heavy chain complementarity determining region 3 for antibody 26968
ARGRGTVIRGATTKPYFNVMDV

SEQ ID NO: 53937 - protein, 9 aa, Homo sapiens
  light chain complementarity determining region 3 for antibody 26969
QQYGTSPRT

SEQ ID NO: 53938 - protein, 13 aa, Homo sapiens
  heavy chain complementarity determining region 3 for antibody 26969
PIGFYDRSGYHDY

SEQ ID NO: 53939 - protein, 11 aa, Homo sapiens
  light chain complementarity determining region 3 for antibody 26970
QQYGTSPPGDT

SEQ ID NO: 53940 - protein, 17 aa, Homo sapiens
  heavy chain complementarity determining region 3 for antibody 26970
ARGLALIRGLVTKDIDD

SEQ ID NO: 53941 - protein, 8 aa, Homo sapiens
  light chain complementarity determining region 3 for antibody 26971
QQYGTSPP

SEQ ID NO: 53942 - protein, 22 aa, Homo sapiens
  heavy chain complementarity determining region 3 for antibody 26971
ARGRGTVIRGATTKSYFNVMDV

SEQ ID NO: 53943 - protein, 9 aa, Homo sapiens
  light chain complementarity determining region 3 for antibody 26972
QQYGTSLLT

SEQ ID NO: 53944 - protein, 21 aa, Homo sapiens
  heavy chain complementarity determining region 3 for antibody 26972
ARDGPRYSSSWYGPSSWYFDL

SEQ ID NO: 53945 - protein, 9 aa, Homo sapiens
  light chain complementarity determining region 3 for antibody 26973
QQYGTLPRT

SEQ ID NO: 53946 - protein, 13 aa, Homo sapiens
  heavy chain complementarity determining region 3 for antibody 26973
AGGLFDSSGYSEF

SEQ ID NO: 53947 - protein, 9 aa, Homo sapiens
  light chain complementarity determining region 3 for antibody 26974
QQYGTIPRT

SEQ ID NO: 53948 - protein, 13 aa, Homo sapiens
  heavy chain complementarity determining region 3 for antibody 26974
AGGLFDSSGYSDF

SEQ ID NO: 53949 - protein, 9 aa, Homo sapiens
  light chain complementarity determining region 3 for antibody 26975
QQYGTAPVP

SEQ ID NO: 53950 - protein, 14 aa, Homo sapiens
  heavy chain complementarity determining region 3 for antibody 26975
ARDLFRGIPDYLDY

SEQ ID NO: 53951 - protein, 9 aa, Homo sapiens
  light chain complementarity determining region 3 for antibody 26976
QQYGSTWWT

SEQ ID NO: 53952 - protein, 15 aa, Homo sapiens
  heavy chain complementarity determining region 3 for antibody 26976
ARHMARDSIGYYHDS

SEQ ID NO: 53953 - protein, 9 aa, Homo sapiens
  light chain complementarity determining region 3 for antibody 26977
QQYGSTWWT

SEQ ID NO: 53954 - protein, 15 aa, Homo sapiens
  heavy chain complementarity determining region 3 for antibody 26977
ARHMARDSIGYCHDF

SEQ ID NO: 53955 - protein, 9 aa, Homo sapiens
  light chain complementarity determining region 3 for antibody 26978
QQYGSTGWT

SEQ ID NO: 53956 - protein, 15 aa, Homo sapiens
  heavy chain complementarity determining region 3 for antibody 26978
ARHMARDSIGYYHDF

SEQ ID NO: 53957 - protein, 9 aa, Homo sapiens
  light chain complementarity determining region 3 for antibody 26979
QQYGSTCWT

SEQ ID NO: 53958 - protein, 15 aa, Homo sapiens
  heavy chain complementarity determining region 3 for antibody 26979
ARHMARDSIGYYHDF

SEQ ID NO: 53959 - protein, 9 aa, Homo sapiens
  light chain complementarity determining region 3 for antibody 26980
QQYGSSWWT

SEQ ID NO: 53960 - protein, 15 aa, Homo sapiens
  heavy chain complementarity determining region 3 for antibody 26980
ARHVARDDIGYYHDF

SEQ ID NO: 53961 - protein, 9 aa, Homo sapiens
  light chain complementarity determining region 3 for antibody 26981
QQYGSSWRT

SEQ ID NO: 53962 - protein, 15 aa, Homo sapiens
  heavy chain complementarity determining region 3 for antibody 26981
ARHVARDDIGYYHDL

SEQ ID NO: 53963 - protein, 9 aa, Homo sapiens
  light chain complementarity determining region 3 for antibody 26982
QQYGSSRYT

SEQ ID NO: 53964 - protein, 9 aa, Homo sapiens
  heavy chain complementarity determining region 3 for antibody 26982
IYEINAFDI

SEQ ID NO: 53965 - protein, 9 aa, Homo sapiens
  light chain complementarity determining region 3 for antibody 26983
QQYGSSRRT

SEQ ID NO: 53966 - protein, 18 aa, Homo sapiens
  heavy chain complementarity determining region 3 for antibody 26983
ARGPDHGSSDRVNYFFDL

SEQ ID NO: 53967 - protein, 9 aa, Homo sapiens
  light chain complementarity determining region 3 for antibody 26984
QQYGSSRGT

SEQ ID NO: 53968 - protein, 18 aa, Homo sapiens
  heavy chain complementarity determining region 3 for antibody 26984
ARGPDHGSSDRVNYFFDL

SEQ ID NO: 53969 - protein, 9 aa, Homo sapiens
  light chain complementarity determining region 3 for antibody 26985
QQYGSSPYT

SEQ ID NO: 53970 - protein, 16 aa, Homo sapiens
  heavy chain complementarity determining region 3 for antibody 26985
AAPGQHNSGWDYRFDY

SEQ ID NO: 53971 - protein, 9 aa, Homo sapiens
  light chain complementarity determining region 3 for antibody 26986
QQYGSSPYP

SEQ ID NO: 53972 - protein, 17 aa, Homo sapiens
  heavy chain complementarity determining region 3 for antibody 26986
ARGTGYNYGYGGVHFDY

SEQ ID NO: 53973 - protein, 9 aa, Homo sapiens
  light chain complementarity determining region 3 for antibody 26987
QQYGSSPVT

SEQ ID NO: 53974 - protein, 13 aa, Homo sapiens
  heavy chain complementarity determining region 3 for antibody 26987
ARGHDYSNYAPDF

SEQ ID NO: 53975 - protein, 8 aa, Homo sapiens
  light chain complementarity determining region 3 for antibody 26988
QQYGSSPT

SEQ ID NO: 53976 - protein, 13 aa, Homo sapiens
  heavy chain complementarity determining region 3 for antibody 26988
TRHIYTMITPFDC

SEQ ID NO: 53977 - protein, 9 aa, Homo sapiens
  light chain complementarity determining region 3 for antibody 26989
QQYGSSPST

SEQ ID NO: 53978 - protein, 15 aa, Homo sapiens
  heavy chain complementarity determining region 3 for antibody 26989
ARGWYNSGIYYSPGE

SEQ ID NO: 53979 - protein, 9 aa, Homo sapiens
  light chain complementarity determining region 3 for antibody 26990
QQYGSSPRT

SEQ ID NO: 53980 - protein, 14 aa, Homo sapiens
  heavy chain complementarity determining region 3 for antibody 26990
TRERGSSWYPPFQH

SEQ ID NO: 53981 - protein, 9 aa, Homo sapiens
  light chain complementarity determining region 3 for antibody 26991
QQYGSSPRT

SEQ ID NO: 53982 - protein, 14 aa, Homo sapiens
  heavy chain complementarity determining region 3 for antibody 26991
ATGFFDSSRYYLDY

SEQ ID NO: 53983 - protein, 9 aa, Homo sapiens
  light chain complementarity determining region 3 for antibody 26992
QQYGSSPRT

SEQ ID NO: 53984 - protein, 13 aa, Homo sapiens
  heavy chain complementarity determining region 3 for antibody 26992
ARVKYESSGYKEN

SEQ ID NO: 53985 - protein, 9 aa, Homo sapiens
  light chain complementarity determining region 3 for antibody 26993
QQYGSSPRT

SEQ ID NO: 53986 - protein, 25 aa, Homo sapiens
  heavy chain complementarity determining region 3 for antibody 26993
ARLRIDRLRLPGAMRGPLYGCGLNV

SEQ ID NO: 53987 - protein, 9 aa, Homo sapiens
  light chain complementarity determining region 3 for antibody 26994
QQYGSSPRT

SEQ ID NO: 53988 - protein, 25 aa, Homo sapiens
  heavy chain complementarity determining region 3 for antibody 26994
ARLRIDRLRLPGAMRGPLYDCGLHV

SEQ ID NO: 53989 - protein, 9 aa, Homo sapiens
  light chain complementarity determining region 3 for antibody 26995
QQYGSSPRT

SEQ ID NO: 53990 - protein, 25 aa, Homo sapiens
  heavy chain complementarity determining region 3 for antibody 26995
ARLRIDRLRLPGAMRGPLCDCGLNV

SEQ ID NO: 53991 - protein, 9 aa, Homo sapiens
  light chain complementarity determining region 3 for antibody 26996
QQYGSSPRT

SEQ ID NO: 53992 - protein, 25 aa, Homo sapiens
  heavy chain complementarity determining region 3 for antibody 26996
ARLRIDQLRFPGAMRGALYHCGMDV

SEQ ID NO: 53993 - protein, 9 aa, Homo sapiens
  light chain complementarity determining region 3 for antibody 26997
QQYGSSPRT

SEQ ID NO: 53994 - protein, 15 aa, Homo sapiens
  heavy chain complementarity determining region 3 for antibody 26997
ARANGVIITPGVLRY

SEQ ID NO: 53995 - protein, 9 aa, Homo sapiens
  light chain complementarity determining region 3 for antibody 26998
QQYGSSPRS

SEQ ID NO: 53996 - protein, 25 aa, Homo sapiens
  heavy chain complementarity determining region 3 for antibody 26998
ARLRIDRLRLPGAMRGPLYDCGLNV

SEQ ID NO: 53997 - protein, 9 aa, Homo sapiens
  light chain complementarity determining region 3 for antibody 26999
QQYGSSPQT

SEQ ID NO: 53998 - protein, 16 aa, Homo sapiens
  heavy chain complementarity determining region 3 for antibody 26999
ARGSPTVEDFSWPADF

SEQ ID NO: 53999 - protein, 9 aa, Homo sapiens
  light chain complementarity determining region 3 for antibody 27000
QQYGSSPQT

SEQ ID NO: 54000 - protein, 11 aa, Homo sapiens
  heavy chain complementarity determining region 3 for antibody 27000
AKDNSNSLFDY

SEQ ID NO: 54001 - protein, 10 aa, Homo sapiens
  light chain complementarity determining region 3 for antibody 27001
QQYGSSPPWT

SEQ ID NO: 54002 - protein, 20 aa, Homo sapiens
  heavy chain complementarity determining region 3 for antibody 27001
ARRSGYCGGDTCNSDDAFDT

SEQ ID NO: 54003 - protein, 11 aa, Homo sapiens
  light chain complementarity determining region 3 for antibody 27002
QQYGSSPPRNT

SEQ ID NO: 54004 - protein, 12 aa, Homo sapiens
  heavy chain complementarity determining region 3 for antibody 27002
ATTGSYYRSFDY

SEQ ID NO: 54005 - protein, 10 aa, Homo sapiens
  light chain complementarity determining region 3 for antibody 27003
QQYGSSPPFT

SEQ ID NO: 54006 - protein, 14 aa, Homo sapiens
  heavy chain complementarity determining region 3 for antibody 27003
ARDLRWLVLGSLDY

SEQ ID NO: 54007 - protein, 10 aa, Homo sapiens
  light chain complementarity determining region 3 for antibody 27004
QQYGSSPLYP

SEQ ID NO: 54008 - protein, 12 aa, Homo sapiens
  heavy chain complementarity determining region 3 for antibody 27004
ARPRYRSGFFDY

SEQ ID NO: 54009 - protein, 9 aa, Homo sapiens
  light chain complementarity determining region 3 for antibody 27005
QQYGSSPLP

SEQ ID NO: 54010 - protein, 12 aa, Homo sapiens
  heavy chain complementarity determining region 3 for antibody 27005
ARASWFLSVFDS

SEQ ID NO: 54011 - protein, 9 aa, Homo sapiens
  light chain complementarity determining region 3 for antibody 27006
QQYGSSPLP

SEQ ID NO: 54012 - protein, 17 aa, Homo sapiens
  heavy chain complementarity determining region 3 for antibody 27006
ARAPAPYRSDWRDPFDI

SEQ ID NO: 54013 - protein, 9 aa, Homo sapiens
  light chain complementarity determining region 3 for antibody 27007
QQYGSSPFT

SEQ ID NO: 54014 - protein, 6 aa, Homo sapiens
  heavy chain complementarity determining region 3 for antibody 27007
VSLMVA

SEQ ID NO: 54015 - protein, 9 aa, Homo sapiens
  light chain complementarity determining region 3 for antibody 27008
QQYGSSPFP

SEQ ID NO: 54016 - protein, 16 aa, Homo sapiens
  heavy chain complementarity determining region 3 for antibody 27008
ARERRGFGVVIGPLDY

SEQ ID NO: 54017 - protein, 9 aa, Homo sapiens
  light chain complementarity determining region 3 for antibody 27009
QQYGSSPDA

SEQ ID NO: 54018 - protein, 13 aa, Homo sapiens
  heavy chain complementarity determining region 3 for antibody 27009
ARALQYSGRIFDY

SEQ ID NO: 54019 - protein, 9 aa, Homo sapiens
  light chain complementarity determining region 3 for antibody 27010
QQYGSSLYN

SEQ ID NO: 54020 - protein, 9 aa, Homo sapiens
  heavy chain complementarity determining region 3 for antibody 27010
IYEINAFDI

SEQ ID NO: 54021 - protein, 10 aa, Homo sapiens
  light chain complementarity determining region 3 for antibody 27011
QQYGSSLGNT

SEQ ID NO: 54022 - protein, 13 aa, Homo sapiens
  heavy chain complementarity determining region 3 for antibody 27011
AHSGYQVYYGMDV

SEQ ID NO: 54023 - protein, 9 aa, Homo sapiens
  light chain complementarity determining region 3 for antibody 27012
QQYGSPPRT

SEQ ID NO: 54024 - protein, 12 aa, Homo sapiens
  heavy chain complementarity determining region 3 for antibody 27012
ARVRGSGSYPDY

SEQ ID NO: 54025 - protein, 9 aa, Homo sapiens
  light chain complementarity determining region 3 for antibody 27013
QQYGSPPRT

SEQ ID NO: 54026 - protein, 25 aa, Homo sapiens
  heavy chain complementarity determining region 3 for antibody 27013
ARLRIDRLRLPGAMRGPLYDCGLNV

SEQ ID NO: 54027 - protein, 9 aa, Homo sapiens
  light chain complementarity determining region 3 for antibody 27014
QQYGSPPQT

SEQ ID NO: 54028 - protein, 11 aa, Homo sapiens
  heavy chain complementarity determining region 3 for antibody 27014
ARGDLWSAFDI

SEQ ID NO: 54029 - protein, 9 aa, Homo sapiens
  light chain complementarity determining region 3 for antibody 27015
QQYGSPPPT

SEQ ID NO: 54030 - protein, 16 aa, Homo sapiens
  heavy chain complementarity determining region 3 for antibody 27015
AKDISGGFDGWWFFDY

SEQ ID NO: 54031 - protein, 9 aa, Homo sapiens
  light chain complementarity determining region 3 for antibody 27016
QQYGSLQLT

SEQ ID NO: 54032 - protein, 15 aa, Homo sapiens
  heavy chain complementarity determining region 3 for antibody 27016
AHRPNYYDKAGAFDI

SEQ ID NO: 54033 - protein, 9 aa, Homo sapiens
  light chain complementarity determining region 3 for antibody 27017
QQYGSLPRT

SEQ ID NO: 54034 - protein, 25 aa, Homo sapiens
  heavy chain complementarity determining region 3 for antibody 27017
ARLRIDRLRLPGAMRGPLYDCGLNV

SEQ ID NO: 54035 - protein, 9 aa, Homo sapiens
  light chain complementarity determining region 3 for antibody 27018
QQYGSLPRT

SEQ ID NO: 54036 - protein, 14 aa, Homo sapiens
  heavy chain complementarity determining region 3 for antibody 27018
AGGDFCGGDCYSEY

SEQ ID NO: 54037 - protein, 9 aa, Homo sapiens
  light chain complementarity determining region 3 for antibody 27019
QQYGSLPPT

SEQ ID NO: 54038 - protein, 17 aa, Homo sapiens
  heavy chain complementarity determining region 3 for antibody 27019
ARPYFGPVRAGTNGYDM

SEQ ID NO: 54039 - protein, 9 aa, Homo sapiens
  light chain complementarity determining region 3 for antibody 27020
QQYGSLPLT

SEQ ID NO: 54040 - protein, 15 aa, Homo sapiens
  heavy chain complementarity determining region 3 for antibody 27020
AHRPDYYDKAGAFDI

SEQ ID NO: 54041 - protein, 9 aa, Homo sapiens
  light chain complementarity determining region 3 for antibody 27021
QQYGSLPFT

SEQ ID NO: 54042 - protein, 15 aa, Homo sapiens
  heavy chain complementarity determining region 3 for antibody 27021
AHRPNYYDKAGAFDI

SEQ ID NO: 54043 - protein, 9 aa, Homo sapiens
  light chain complementarity determining region 3 for antibody 27022
QQYGSKRGT

SEQ ID NO: 54044 - protein, 16 aa, Homo sapiens
  heavy chain complementarity determining region 3 for antibody 27022
ARVVWGASWYVGYFDL

SEQ ID NO: 54045 - protein, 9 aa, Homo sapiens
  light chain complementarity determining region 3 for antibody 27023
QQYGRTTLT

SEQ ID NO: 54046 - protein, 15 aa, Homo sapiens
  heavy chain complementarity determining region 3 for antibody 27023
ARGPHPPYYGGFFHR

SEQ ID NO: 54047 - protein, 12 aa, Homo sapiens
  light chain complementarity determining region 3 for antibody 27024
QQYGRSVQDAGT

SEQ ID NO: 54048 - protein, 13 aa, Homo sapiens
  heavy chain complementarity determining region 3 for antibody 27024
ARLPSRKQQLVRE

SEQ ID NO: 54049 - protein, 9 aa, Homo sapiens
  light chain complementarity determining region 3 for antibody 27025
QQYGRSPRT

SEQ ID NO: 54050 - protein, 18 aa, Homo sapiens
  heavy chain complementarity determining region 3 for antibody 27025
ATNPSIAEPGNIYWYFDL

SEQ ID NO: 54051 - protein, 9 aa, Homo sapiens
  light chain complementarity determining region 3 for antibody 27026
QQYGRSPRT

SEQ ID NO: 54052 - protein, 25 aa, Homo sapiens
  heavy chain complementarity determining region 3 for antibody 27026
ARLRIDRLRLPGAMRGPLYDCGLNV

SEQ ID NO: 54053 - protein, 9 aa, Homo sapiens
  light chain complementarity determining region 3 for antibody 27027
QQYGRSPRT

SEQ ID NO: 54054 - protein, 11 aa, Homo sapiens
  heavy chain complementarity determining region 3 for antibody 27027
AREGNYKPHDY

SEQ ID NO: 54055 - protein, 9 aa, Homo sapiens
  light chain complementarity determining region 3 for antibody 27028
QQYGRSPRT

SEQ ID NO: 54056 - protein, 15 aa, Homo sapiens
  heavy chain complementarity determining region 3 for antibody 27028
AKDGEFCGANCYFGS

SEQ ID NO: 54057 - protein, 9 aa, Homo sapiens
  light chain complementarity determining region 3 for antibody 27029
QQYGRSPQT

SEQ ID NO: 54058 - protein, 11 aa, Homo sapiens
  heavy chain complementarity determining region 3 for antibody 27029
ARGDLWSAFDI

SEQ ID NO: 54059 - protein, 9 aa, Homo sapiens
  light chain complementarity determining region 3 for antibody 27030
QQYGRSPPT

SEQ ID NO: 54060 - protein, 11 aa, Homo sapiens
  heavy chain complementarity determining region 3 for antibody 27030
AREGNYKPHDY

SEQ ID NO: 54061 - protein, 11 aa, Homo sapiens
  light chain complementarity determining region 3 for antibody 27031
QQYGRSPPGYP

SEQ ID NO: 54062 - protein, 14 aa, Homo sapiens
  heavy chain complementarity determining region 3 for antibody 27031
ARETNNSRKRSFDQ

SEQ ID NO: 54063 - protein, 11 aa, Homo sapiens
  light chain complementarity determining region 3 for antibody 27032
QQYGRSPPGNT

SEQ ID NO: 54064 - protein, 14 aa, Homo sapiens
  heavy chain complementarity determining region 3 for antibody 27032
ARETNNSRKRSFDQ

SEQ ID NO: 54065 - protein, 10 aa, Homo sapiens
  light chain complementarity determining region 3 for antibody 27033
QQYGRSPMYS

SEQ ID NO: 54066 - protein, 11 aa, Homo sapiens
  heavy chain complementarity determining region 3 for antibody 27033
ARGGQWGSLDY

SEQ ID NO: 54067 - protein, 9 aa, Homo sapiens
  light chain complementarity determining region 3 for antibody 27034
QQYGRSLYT

SEQ ID NO: 54068 - protein, 9 aa, Homo sapiens
  heavy chain complementarity determining region 3 for antibody 27034
IYEINAFDI

SEQ ID NO: 54069 - protein, 11 aa, Homo sapiens
  light chain complementarity determining region 3 for antibody 27035
QQYGPSPPLSP

SEQ ID NO: 54070 - protein, 10 aa, Homo sapiens
  heavy chain complementarity determining region 3 for antibody 27035
ARNDVYRIDH

SEQ ID NO: 54071 - protein, 9 aa, Homo sapiens
  light chain complementarity determining region 3 for antibody 27036
QQYGNSPPT

SEQ ID NO: 54072 - protein, 13 aa, Homo sapiens
  heavy chain complementarity determining region 3 for antibody 27036
ASKTSVRTYSSDL

SEQ ID NO: 54073 - protein, 9 aa, Homo sapiens
  light chain complementarity determining region 3 for antibody 27037
QQYGNSPPT

SEQ ID NO: 54074 - protein, 19 aa, Homo sapiens
  heavy chain complementarity determining region 3 for antibody 27037
ARDHFPLARGVVSYFYYNY

SEQ ID NO: 54075 - protein, 9 aa, Homo sapiens
  light chain complementarity determining region 3 for antibody 27038
QQYGNSPLT

SEQ ID NO: 54076 - protein, 13 aa, Homo sapiens
  heavy chain complementarity determining region 3 for antibody 27038
ASKSSVRTYSSDL

SEQ ID NO: 54077 - protein, 9 aa, Homo sapiens
  light chain complementarity determining region 3 for antibody 27039
QQYGNPPLT

SEQ ID NO: 54078 - protein, 13 aa, Homo sapiens
  heavy chain complementarity determining region 3 for antibody 27039
ASKTSVRTYSSDL

SEQ ID NO: 54079 - protein, 9 aa, Homo sapiens
  light chain complementarity determining region 3 for antibody 27040
QQYGNLPRT

SEQ ID NO: 54080 - protein, 13 aa, Homo sapiens
  heavy chain complementarity determining region 3 for antibody 27040
AGGDFHSGGYSDF

SEQ ID NO: 54081 - protein, 9 aa, Homo sapiens
  light chain complementarity determining region 3 for antibody 27041
QQYGLSPLT

SEQ ID NO: 54082 - protein, 15 aa, Homo sapiens
  heavy chain complementarity determining region 3 for antibody 27041
ARRAGGARRKYYFDS

SEQ ID NO: 54083 - protein, 9 aa, Homo sapiens
  light chain complementarity determining region 3 for antibody 27042
QQYGISPRT

SEQ ID NO: 54084 - protein, 13 aa, Homo sapiens
  heavy chain complementarity determining region 3 for antibody 27042
ARDVAGWPLVNNY

SEQ ID NO: 54085 - protein, 9 aa, Homo sapiens
  light chain complementarity determining region 3 for antibody 27043
QQYGISPRP

SEQ ID NO: 54086 - protein, 13 aa, Homo sapiens
  heavy chain complementarity determining region 3 for antibody 27043
ARDVAGWPFVNNY

SEQ ID NO: 54087 - protein, 11 aa, Homo sapiens
  light chain complementarity determining region 3 for antibody 27044
QQYGISPPHWG

SEQ ID NO: 54088 - protein, 12 aa, Homo sapiens
  heavy chain complementarity determining region 3 for antibody 27044
VKEKGGVRVFDF

SEQ ID NO: 54089 - protein, 6 aa, Homo sapiens
  light chain complementarity determining region 3 for antibody 27045
QQYGGT

SEQ ID NO: 54090 - protein, 12 aa, Homo sapiens
  heavy chain complementarity determining region 3 for antibody 27045
ARDHSSGWSLSN

SEQ ID NO: 54091 - protein, 9 aa, Homo sapiens
  light chain complementarity determining region 3 for antibody 27046
QQYGGSTGR

SEQ ID NO: 54092 - protein, 15 aa, Homo sapiens
  heavy chain complementarity determining region 3 for antibody 27046
ARGGRGPGMAHCFDL

SEQ ID NO: 54093 - protein, 9 aa, Homo sapiens
  light chain complementarity determining region 3 for antibody 27047
QQYGGSPRT

SEQ ID NO: 54094 - protein, 25 aa, Homo sapiens
  heavy chain complementarity determining region 3 for antibody 27047
ARLRIDQLRLPGAMRGALYHCGMDV

SEQ ID NO: 54095 - protein, 10 aa, Homo sapiens
  light chain complementarity determining region 3 for antibody 27048
QQYGGSPMYS

SEQ ID NO: 54096 - protein, 11 aa, Homo sapiens
  heavy chain complementarity determining region 3 for antibody 27048
ARGGQWGSLDY

SEQ ID NO: 54097 - protein, 9 aa, Homo sapiens
  light chain complementarity determining region 3 for antibody 27049
QQYGGSPGT

SEQ ID NO: 54098 - protein, 15 aa, Homo sapiens
  heavy chain complementarity determining region 3 for antibody 27049
ARGGRGPGMAHCFDL

SEQ ID NO: 54099 - protein, 9 aa, Homo sapiens
  light chain complementarity determining region 3 for antibody 27050
QQYGGSGNT

SEQ ID NO: 54100 - protein, 17 aa, Homo sapiens
  heavy chain complementarity determining region 3 for antibody 27050
ARPAVTEFRGINDALDI

SEQ ID NO: 54101 - protein, 10 aa, Homo sapiens
  light chain complementarity determining region 3 for antibody 27051
QQYGFSPEYT

SEQ ID NO: 54102 - protein, 18 aa, Homo sapiens
  heavy chain complementarity determining region 3 for antibody 27051
ARTGGDSDWSFAYWYLDL

SEQ ID NO: 54103 - protein, 9 aa, Homo sapiens
  light chain complementarity determining region 3 for antibody 27052
QQYGFPPYT

SEQ ID NO: 54104 - protein, 14 aa, Homo sapiens
  heavy chain complementarity determining region 3 for antibody 27052
ARHSRMLRKDAFDI

SEQ ID NO: 54105 - protein, 6 aa, Homo sapiens
  light chain complementarity determining region 3 for antibody 27053
QQYGET

SEQ ID NO: 54106 - protein, 12 aa, Homo sapiens
  heavy chain complementarity determining region 3 for antibody 27053
ARDHSSGWSLYN

SEQ ID NO: 54107 - protein, 10 aa, Homo sapiens
  light chain complementarity determining region 3 for antibody 27054
QQYGDSPEVT

SEQ ID NO: 54108 - protein, 16 aa, Homo sapiens
  heavy chain complementarity determining region 3 for antibody 27054
ARDATFWFGEFTFFDH

SEQ ID NO: 54109 - protein, 10 aa, Homo sapiens
  light chain complementarity determining region 3 for antibody 27055
QQYGDSPDVI

SEQ ID NO: 54110 - protein, 16 aa, Homo sapiens
  heavy chain complementarity determining region 3 for antibody 27055
ARDATFWFGEFTFFDH

SEQ ID NO: 54111 - protein, 8 aa, Homo sapiens
  light chain complementarity determining region 3 for antibody 27056
QQYGDSMT

SEQ ID NO: 54112 - protein, 16 aa, Homo sapiens
  heavy chain complementarity determining region 3 for antibody 27056
ARGLSIIRGVMSLFDF

SEQ ID NO: 54113 - protein, 9 aa, Homo sapiens
  light chain complementarity determining region 3 for antibody 27057
QQYGDLPIT

SEQ ID NO: 54114 - protein, 24 aa, Homo sapiens
  heavy chain complementarity determining region 3 for antibody 27057
ARVQRQYDYWSGHRSYYFYYAMDV

SEQ ID NO: 54115 - protein, 9 aa, Homo sapiens
  light chain complementarity determining region 3 for antibody 27058
QQYGCSPRT

SEQ ID NO: 54116 - protein, 25 aa, Homo sapiens
  heavy chain complementarity determining region 3 for antibody 27058
ARLRIDRLRLPGAMRGPLYDCGLNV

SEQ ID NO: 54117 - protein, 10 aa, Homo sapiens
  light chain complementarity determining region 3 for antibody 27059
QQYGASPDVT

SEQ ID NO: 54118 - protein, 16 aa, Homo sapiens
  heavy chain complementarity determining region 3 for antibody 27059
ARDATFWFGEFTFFDH

SEQ ID NO: 54119 - protein, 9 aa, Homo sapiens
  light chain complementarity determining region 3 for antibody 27060
QQYFTFLRT

SEQ ID NO: 54120 - protein, 12 aa, Homo sapiens
  heavy chain complementarity determining region 3 for antibody 27060
VKDCGLGGSRDS

SEQ ID NO: 54121 - protein, 9 aa, Homo sapiens
  light chain complementarity determining region 3 for antibody 27061
QQYFNTPVT

SEQ ID NO: 54122 - protein, 11 aa, Homo sapiens
  heavy chain complementarity determining region 3 for antibody 27061
AGAVAEGYFDS

SEQ ID NO: 54123 - protein, 11 aa, Homo sapiens
  light chain complementarity determining region 3 for antibody 27062
QQYETSPPGST

SEQ ID NO: 54124 - protein, 14 aa, Homo sapiens
  heavy chain complementarity determining region 3 for antibody 27062
ARENSISRKRSFDQ

SEQ ID NO: 54125 - protein, 11 aa, Homo sapiens
  light chain complementarity determining region 3 for antibody 27063
QQYETSPPGDP

SEQ ID NO: 54126 - protein, 14 aa, Homo sapiens
  heavy chain complementarity determining region 3 for antibody 27063
ARENSISRKRSFDQ

SEQ ID NO: 54127 - protein, 9 aa, Homo sapiens
  light chain complementarity determining region 3 for antibody 27064
QQYESSLWK

SEQ ID NO: 54128 - protein, 12 aa, Homo sapiens
  heavy chain complementarity determining region 3 for antibody 27064
ARDFGLYQEPDS

SEQ ID NO: 54129 - protein, 9 aa, Homo sapiens
  light chain complementarity determining region 3 for antibody 27065
QQYESSLRT

SEQ ID NO: 54130 - protein, 12 aa, Homo sapiens
  heavy chain complementarity determining region 3 for antibody 27065
ARDFGLYQEPDS

SEQ ID NO: 54131 - protein, 9 aa, Homo sapiens
  light chain complementarity determining region 3 for antibody 27066
QQYESSLGT

SEQ ID NO: 54132 - protein, 12 aa, Homo sapiens
  heavy chain complementarity determining region 3 for antibody 27066
ARDFGLYQEPDS

SEQ ID NO: 54133 - protein, 9 aa, Homo sapiens
  light chain complementarity determining region 3 for antibody 27067
QQYENIPWT

SEQ ID NO: 54134 - protein, 14 aa, Homo sapiens
  heavy chain complementarity determining region 3 for antibody 27067
AKCGHSYGNDAFDI

SEQ ID NO: 54135 - protein, 10 aa, Homo sapiens
  light chain complementarity determining region 3 for antibody 27068
QQYDTHSPWT

SEQ ID NO: 54136 - protein, 20 aa, Homo sapiens
  heavy chain complementarity determining region 3 for antibody 27068
ANPEGWWDGSGTYPTYYFDY

SEQ ID NO: 54137 - protein, 9 aa, Homo sapiens
  light chain complementarity determining region 3 for antibody 27069
QQYDSSSYP

SEQ ID NO: 54138 - protein, 11 aa, Homo sapiens
  heavy chain complementarity determining region 3 for antibody 27069
ARGGFYGSFDF

SEQ ID NO: 54139 - protein, 9 aa, Homo sapiens
  light chain complementarity determining region 3 for antibody 27070
QQYDSSSYN

SEQ ID NO: 54140 - protein, 11 aa, Homo sapiens
  heavy chain complementarity determining region 3 for antibody 27070
ARGGFYGSFDF

SEQ ID NO: 54141 - protein, 10 aa, Homo sapiens
  light chain complementarity determining region 3 for antibody 27071
QQYDSSSYFP

SEQ ID NO: 54142 - protein, 14 aa, Homo sapiens
  heavy chain complementarity determining region 3 for antibody 27071
ASVKRGGGRPRFDN

SEQ ID NO: 54143 - protein, 9 aa, Homo sapiens
  light chain complementarity determining region 3 for antibody 27072
QQYDSSSST

SEQ ID NO: 54144 - protein, 11 aa, Homo sapiens
  heavy chain complementarity determining region 3 for antibody 27072
ARGGFYGSFDF

SEQ ID NO: 54145 - protein, 9 aa, Homo sapiens
  light chain complementarity determining region 3 for antibody 27073
QQYDSSPFT

SEQ ID NO: 54146 - protein, 17 aa, Homo sapiens
  heavy chain complementarity determining region 3 for antibody 27073
ARDRGSSWYSGADHFQY

SEQ ID NO: 54147 - protein, 9 aa, Homo sapiens
  light chain complementarity determining region 3 for antibody 27074
QQYDSSPFP

SEQ ID NO: 54148 - protein, 17 aa, Homo sapiens
  heavy chain complementarity determining region 3 for antibody 27074
ARDRGSSWYSGAEHFQY

SEQ ID NO: 54149 - protein, 9 aa, Homo sapiens
  light chain complementarity determining region 3 for antibody 27075
QQYDSSLWT

SEQ ID NO: 54150 - protein, 12 aa, Homo sapiens
  heavy chain complementarity determining region 3 for antibody 27075
ARDFGLYQEPDS

SEQ ID NO: 54151 - protein, 9 aa, Homo sapiens
  light chain complementarity determining region 3 for antibody 27076
QQYDSNSYA

SEQ ID NO: 54152 - protein, 11 aa, Homo sapiens
  heavy chain complementarity determining region 3 for antibody 27076
ARGEDTWYSDS

SEQ ID NO: 54153 - protein, 9 aa, Homo sapiens
  light chain complementarity determining region 3 for antibody 27077
QQYDRFPWT

SEQ ID NO: 54154 - protein, 15 aa, Homo sapiens
  heavy chain complementarity determining region 3 for antibody 27077
ARGWDYADRRGRFES

SEQ ID NO: 54155 - protein, 13 aa, Homo sapiens
  light chain complementarity determining region 3 for antibody 27078
QQYDNYGGSPPYT

SEQ ID NO: 54156 - protein, 10 aa, Homo sapiens
  heavy chain complementarity determining region 3 for antibody 27078
VRENWGTFDY

SEQ ID NO: 54157 - protein, 9 aa, Homo sapiens
  light chain complementarity determining region 3 for antibody 27079
QQYDNWRCP

SEQ ID NO: 54158 - protein, 26 aa, Homo sapiens
  heavy chain complementarity determining region 3 for antibody 27079
SRGLGYSYTLRAKSLGLRAKAYFFDY

SEQ ID NO: 54159 - protein, 10 aa, Homo sapiens
  light chain complementarity determining region 3 for antibody 27080
QQYDNWPPLT

SEQ ID NO: 54160 - protein, 17 aa, Homo sapiens
  heavy chain complementarity determining region 3 for antibody 27080
ARVVLSTSGWDMIGFDI

SEQ ID NO: 54161 - protein, 9 aa, Homo sapiens
  light chain complementarity determining region 3 for antibody 27081
QQYDNSPKT

SEQ ID NO: 54162 - protein, 20 aa, Homo sapiens
  heavy chain complementarity determining region 3 for antibody 27081
ARTSLGSMVRGVFITNWFDP

SEQ ID NO: 54163 - protein, 8 aa, Homo sapiens
  light chain complementarity determining region 3 for antibody 27082
QQYDNLLT

SEQ ID NO: 54164 - protein, 17 aa, Homo sapiens
  heavy chain complementarity determining region 3 for antibody 27082
ARVRAPYGGNSGHPFDI

SEQ ID NO: 54165 - protein, 9 aa, Homo sapiens
  light chain complementarity determining region 3 for antibody 27083
QQYDNIPWT

SEQ ID NO: 54166 - protein, 14 aa, Homo sapiens
  heavy chain complementarity determining region 3 for antibody 27083
AKCGYSYGNDAFDI

SEQ ID NO: 54167 - protein, 9 aa, Homo sapiens
  light chain complementarity determining region 3 for antibody 27084
QQYDLFRGT

SEQ ID NO: 54168 - protein, 16 aa, Homo sapiens
  heavy chain complementarity determining region 3 for antibody 27084
ARWGVECSGGYCYFEY

SEQ ID NO: 54169 - protein, 9 aa, Homo sapiens
  light chain complementarity determining region 3 for antibody 27085
QQYDGQSWT

SEQ ID NO: 54170 - protein, 11 aa, Homo sapiens
  heavy chain complementarity determining region 3 for antibody 27085
ARGWRDNSFDY

SEQ ID NO: 54171 - protein, 8 aa, Homo sapiens
  light chain complementarity determining region 3 for antibody 27086
QQYDFAIT

SEQ ID NO: 54172 - protein, 7 aa, Homo sapiens
  heavy chain complementarity determining region 3 for antibody 27086
AREYGDP

SEQ ID NO: 54173 - protein, 9 aa, Homo sapiens
  light chain complementarity determining region 3 for antibody 27087
QQYATSPLA

SEQ ID NO: 54174 - protein, 18 aa, Homo sapiens
  heavy chain complementarity determining region 3 for antibody 27087
ARPGYCTGGSCYFGAFDI

SEQ ID NO: 54175 - protein, 10 aa, Homo sapiens
  light chain complementarity determining region 3 for antibody 27088
QQYANQPPIT

SEQ ID NO: 54176 - protein, 12 aa, Homo sapiens
  heavy chain complementarity determining region 3 for antibody 27088
ARVLDSLSPAVH

SEQ ID NO: 54177 - protein, 10 aa, Homo sapiens
  light chain complementarity determining region 3 for antibody 27089
QQYANQPPIT

SEQ ID NO: 54178 - protein, 12 aa, Homo sapiens
  heavy chain complementarity determining region 3 for antibody 27089
ARVLDSLSPACH

SEQ ID NO: 54179 - protein, 8 aa, Homo sapiens
  light chain complementarity determining region 3 for antibody 27090
QQWSDLIT

SEQ ID NO: 54180 - protein, 18 aa, Homo sapiens
  heavy chain complementarity determining region 3 for antibody 27090
AKGSLRSCGGRRCYYFDS

SEQ ID NO: 54181 - protein, 9 aa, Homo sapiens
  light chain complementarity determining region 3 for antibody 27091
QQVNSFPLT

SEQ ID NO: 54182 - protein, 14 aa, Homo sapiens
  heavy chain complementarity determining region 3 for antibody 27091
TTDSPLRRYNYFVY

SEQ ID NO: 54183 - protein, 9 aa, Homo sapiens
  light chain complementarity determining region 3 for antibody 27092
QQVKDYPIT

SEQ ID NO: 54184 - protein, 16 aa, Homo sapiens
  heavy chain complementarity determining region 3 for antibody 27092
ARVVHKSLLPQPPNDY

SEQ ID NO: 54185 - protein, 10 aa, Homo sapiens
  light chain complementarity determining region 3 for antibody 27093
QQTYSTPPYP

SEQ ID NO: 54186 - protein, 19 aa, Homo sapiens
  heavy chain complementarity determining region 3 for antibody 27093
AKDRDSSGWDNYYYYGMDV

SEQ ID NO: 54187 - protein, 9 aa, Homo sapiens
  light chain complementarity determining region 3 for antibody 27094
QQSYTSVRT

SEQ ID NO: 54188 - protein, 12 aa, Homo sapiens
  heavy chain complementarity determining region 3 for antibody 27094
VKDCGLGGSRDS

SEQ ID NO: 54189 - protein, 9 aa, Homo sapiens
  light chain complementarity determining region 3 for antibody 27095
QQSYSVPPT

SEQ ID NO: 54190 - protein, 10 aa, Homo sapiens
  heavy chain complementarity determining region 3 for antibody 27095
ARDLRGYDSF

SEQ ID NO: 54191 - protein, 9 aa, Homo sapiens
  light chain complementarity determining region 3 for antibody 27096
QQSYSTPWT

SEQ ID NO: 54192 - protein, 20 aa, Homo sapiens
  heavy chain complementarity determining region 3 for antibody 27096
ARGENYVESNGAYPPDGFDI

SEQ ID NO: 54193 - protein, 9 aa, Homo sapiens
  light chain complementarity determining region 3 for antibody 27097
QQSYSTPWT

SEQ ID NO: 54194 - protein, 15 aa, Homo sapiens
  heavy chain complementarity determining region 3 for antibody 27097
ARAPMIVVVTGDFDY

SEQ ID NO: 54195 - protein, 10 aa, Homo sapiens
  light chain complementarity determining region 3 for antibody 27098
QQSYSTPSLT

SEQ ID NO: 54196 - protein, 14 aa, Homo sapiens
  heavy chain complementarity determining region 3 for antibody 27098
ARESHSSSYYYFDY

SEQ ID NO: 54197 - protein, 8 aa, Homo sapiens
  light chain complementarity determining region 3 for antibody 27099
QQSYSTPP

SEQ ID NO: 54198 - protein, 17 aa, Homo sapiens
  heavy chain complementarity determining region 3 for antibody 27099
ARDSRGYNYSPGYAFDI

SEQ ID NO: 54199 - protein, 9 aa, Homo sapiens
  light chain complementarity determining region 3 for antibody 27100
QQSYSSVLT

SEQ ID NO: 54200 - protein, 16 aa, Homo sapiens
  heavy chain complementarity determining region 3 for antibody 27100
AREGGGTYPSSRAFDF

SEQ ID NO: 54201 - protein, 9 aa, Homo sapiens
  light chain complementarity determining region 3 for antibody 27101
QQSYSSFLT

SEQ ID NO: 54202 - protein, 16 aa, Homo sapiens
  heavy chain complementarity determining region 3 for antibody 27101
AREGGGTYTSSRAFDF

SEQ ID NO: 54203 - protein, 9 aa, Homo sapiens
  light chain complementarity determining region 3 for antibody 27102
QQSYSPPLA

SEQ ID NO: 54204 - protein, 12 aa, Homo sapiens
  heavy chain complementarity determining region 3 for antibody 27102
ARLTGARRYFDY

SEQ ID NO: 54205 - protein, 8 aa, Homo sapiens
  light chain complementarity determining region 3 for antibody 27103
QQSYRTPT

SEQ ID NO: 54206 - protein, 17 aa, Homo sapiens
  heavy chain complementarity determining region 3 for antibody 27103
ARDSRGYNYSPGYAFDI

SEQ ID NO: 54207 - protein, 9 aa, Homo sapiens
  light chain complementarity determining region 3 for antibody 27104
QQSYRTAFT

SEQ ID NO: 54208 - protein, 15 aa, Homo sapiens
  heavy chain complementarity determining region 3 for antibody 27104
AVLPMVLVSNGHLEY

SEQ ID NO: 54209 - protein, 9 aa, Homo sapiens
  light chain complementarity determining region 3 for antibody 27105
QQSYNNSPT

SEQ ID NO: 54210 - protein, 21 aa, Homo sapiens
  heavy chain complementarity determining region 3 for antibody 27105
AKRTDHHYHSTGYQYRSVFDI

SEQ ID NO: 54211 - protein, 9 aa, Homo sapiens
  light chain complementarity determining region 3 for antibody 27106
QQSYFTPYT

SEQ ID NO: 54212 - protein, 15 aa, Homo sapiens
  heavy chain complementarity determining region 3 for antibody 27106
VRDSEIRGLTDWFDP

SEQ ID NO: 54213 - protein, 8 aa, Homo sapiens
  light chain complementarity determining region 3 for antibody 27107
QQSSSSLP

SEQ ID NO: 54214 - protein, 18 aa, Homo sapiens
  heavy chain complementarity determining region 3 for antibody 27107
ARTFSTRVGYSGYEYFDY

SEQ ID NO: 54215 - protein, 9 aa, Homo sapiens
  light chain complementarity determining region 3 for antibody 27108
QQSNRTPST

SEQ ID NO: 54216 - protein, 14 aa, Homo sapiens
  heavy chain complementarity determining region 3 for antibody 27108
ATEGPSRMGKFFDS

SEQ ID NO: 54217 - protein, 8 aa, Homo sapiens
  light chain complementarity determining region 3 for antibody 27109
QQSIGTRT

SEQ ID NO: 54218 - protein, 14 aa, Homo sapiens
  heavy chain complementarity determining region 3 for antibody 27109
AREADTGYGYYCDL

SEQ ID NO: 54219 - protein, 10 aa, Homo sapiens
  light chain complementarity determining region 3 for antibody 27110
QQSGSSPQIP

SEQ ID NO: 54220 - protein, 10 aa, Homo sapiens
  heavy chain complementarity determining region 3 for antibody 27110
ARGDPAPFDS

SEQ ID NO: 54221 - protein, 10 aa, Homo sapiens
  light chain complementarity determining region 3 for antibody 27111
QQSGSSPMYS

SEQ ID NO: 54222 - protein, 11 aa, Homo sapiens
  heavy chain complementarity determining region 3 for antibody 27111
ARGGQWGSLDY

SEQ ID NO: 54223 - protein, 9 aa, Homo sapiens
  light chain complementarity determining region 3 for antibody 27112
QQSGLSPET

SEQ ID NO: 54224 - protein, 15 aa, Homo sapiens
  heavy chain complementarity determining region 3 for antibody 27112
AFRGIQVVNGVRFDY

SEQ ID NO: 54225 - protein, 9 aa, Homo sapiens
  light chain complementarity determining region 3 for antibody 27113
QQSFNNLPT

SEQ ID NO: 54226 - protein, 18 aa, Homo sapiens
  heavy chain complementarity determining region 3 for antibody 27113
VREMDVAVHRVMFNIFDS

SEQ ID NO: 54227 - protein, 9 aa, Homo sapiens
  light chain complementarity determining region 3 for antibody 27114
QQSFNDPPT

SEQ ID NO: 54228 - protein, 18 aa, Homo sapiens
  heavy chain complementarity determining region 3 for antibody 27114
AREVDCWSGYVSFNCFDP

SEQ ID NO: 54229 - protein, 9 aa, Homo sapiens
  light chain complementarity determining region 3 for antibody 27115
QQSFDDPPT

SEQ ID NO: 54230 - protein, 18 aa, Homo sapiens
  heavy chain complementarity determining region 3 for antibody 27115
AREVSSFDNGAAYVLFDP

SEQ ID NO: 54231 - protein, 9 aa, Homo sapiens
  light chain complementarity determining region 3 for antibody 27116
QQSDGPPLT

SEQ ID NO: 54232 - protein, 14 aa, Homo sapiens
  heavy chain complementarity determining region 3 for antibody 27116
ARDSQWLVQYGMDV

SEQ ID NO: 54233 - protein, 9 aa, Homo sapiens
  light chain complementarity determining region 3 for antibody 27117
QQSAGPPLP

SEQ ID NO: 54234 - protein, 14 aa, Homo sapiens
  heavy chain complementarity determining region 3 for antibody 27117
ARDSQWLVQYGMDV

SEQ ID NO: 54235 - protein, 10 aa, Homo sapiens
  light chain complementarity determining region 3 for antibody 27118
QQRYTTPLKT

SEQ ID NO: 54236 - protein, 14 aa, Homo sapiens
  heavy chain complementarity determining region 3 for antibody 27118
ARDRKTRLGDNLDI

SEQ ID NO: 54237 - protein, 9 aa, Homo sapiens
  light chain complementarity determining region 3 for antibody 27119
QQRYSTPFT

SEQ ID NO: 54238 - protein, 15 aa, Homo sapiens
  heavy chain complementarity determining region 3 for antibody 27119
SRDADYGDYVGFLDY

SEQ ID NO: 54239 - protein, 10 aa, Homo sapiens
  light chain complementarity determining region 3 for antibody 27120
QQRYNWPPYT

SEQ ID NO: 54240 - protein, 11 aa, Homo sapiens
  heavy chain complementarity determining region 3 for antibody 27120
ARGVGSYVFDS

SEQ ID NO: 54241 - protein, 10 aa, Homo sapiens
  light chain complementarity determining region 3 for antibody 27121
QQRYNWPPST

SEQ ID NO: 54242 - protein, 11 aa, Homo sapiens
  heavy chain complementarity determining region 3 for antibody 27121
ARGVGSYVFES

SEQ ID NO: 54243 - protein, 11 aa, Homo sapiens
  light chain complementarity determining region 3 for antibody 27122
QQRTSWPPKCT

SEQ ID NO: 54244 - protein, 14 aa, Homo sapiens
  heavy chain complementarity determining region 3 for antibody 27122
ARTVLDTAADAFDF

SEQ ID NO: 54245 - protein, 11 aa, Homo sapiens
  light chain complementarity determining region 3 for antibody 27123
QQRTNRPPIYT

SEQ ID NO: 54246 - protein, 14 aa, Homo sapiens
  heavy chain complementarity determining region 3 for antibody 27123
ARGGLGIWGNSSDI

SEQ ID NO: 54247 - protein, 10 aa, Homo sapiens
  light chain complementarity determining region 3 for antibody 27124
QQRTDRPPHP

SEQ ID NO: 54248 - protein, 15 aa, Homo sapiens
  heavy chain complementarity determining region 3 for antibody 27124
ARLMGDWELPRGTDY

SEQ ID NO: 54249 - protein, 8 aa, Homo sapiens
  light chain complementarity determining region 3 for antibody 27125
QQRSSWPT

SEQ ID NO: 54250 - protein, 17 aa, Homo sapiens
  heavy chain complementarity determining region 3 for antibody 27125
ARAPAGISGGWYPIFDS

SEQ ID NO: 54251 - protein, 9 aa, Homo sapiens
  light chain complementarity determining region 3 for antibody 27126
QQRSSWPST

SEQ ID NO: 54252 - protein, 11 aa, Homo sapiens
  heavy chain complementarity determining region 3 for antibody 27126
VKRWGGSSIDY

SEQ ID NO: 54253 - protein, 11 aa, Homo sapiens
  light chain complementarity determining region 3 for antibody 27127
QQRSSWPRSLT

SEQ ID NO: 54254 - protein, 19 aa, Homo sapiens
  heavy chain complementarity determining region 3 for antibody 27127
TRGDYYDSSGYHYEGYFDH

SEQ ID NO: 54255 - protein, 8 aa, Homo sapiens
  light chain complementarity determining region 3 for antibody 27128
QQRSSRPS

SEQ ID NO: 54256 - protein, 11 aa, Homo sapiens
  heavy chain complementarity determining region 3 for antibody 27128
ASGSMGWVFDY

SEQ ID NO: 54257 - protein, 9 aa, Homo sapiens
  light chain complementarity determining region 3 for antibody 27129
QQRSNWPWP

SEQ ID NO: 54258 - protein, 14 aa, Homo sapiens
  heavy chain complementarity determining region 3 for antibody 27129
AVTHYYDSSTIGDY

SEQ ID NO: 54259 - protein, 11 aa, Homo sapiens
  light chain complementarity determining region 3 for antibody 27130
QQRSNWPRGYT

SEQ ID NO: 54260 - protein, 10 aa, Homo sapiens
  heavy chain complementarity determining region 3 for antibody 27130
ARDSGAGVDY

SEQ ID NO: 54261 - protein, 10 aa, Homo sapiens
  light chain complementarity determining region 3 for antibody 27131
QQRSNWPPYT

SEQ ID NO: 54262 - protein, 21 aa, Homo sapiens
  heavy chain complementarity determining region 3 for antibody 27131
ATMKRNNDFWTGHFGKYYFDY

SEQ ID NO: 54263 - protein, 12 aa, Homo sapiens
  light chain complementarity determining region 3 for antibody 27132
QQRSNWPPYMYP

SEQ ID NO: 54264 - protein, 12 aa, Homo sapiens
  heavy chain complementarity determining region 3 for antibody 27132
GRLYSSSDKLDY

SEQ ID NO: 54265 - protein, 9 aa, Homo sapiens
  light chain complementarity determining region 3 for antibody 27133
QQRSNWPPT

SEQ ID NO: 54266 - protein, 15 aa, Homo sapiens
  heavy chain complementarity determining region 3 for antibody 27133
ARTERRGNGWYLYDF

SEQ ID NO: 54267 - protein, 10 aa, Homo sapiens
  light chain complementarity determining region 3 for antibody 27134
QQRSNWPPRT

SEQ ID NO: 54268 - protein, 13 aa, Homo sapiens
  heavy chain complementarity determining region 3 for antibody 27134
AREAFPPGGGLDY

SEQ ID NO: 54269 - protein, 10 aa, Homo sapiens
  light chain complementarity determining region 3 for antibody 27135
QQRSNWPPLT

SEQ ID NO: 54270 - protein, 11 aa, Homo sapiens
  heavy chain complementarity determining region 3 for antibody 27135
ARRRFTDAFDI

SEQ ID NO: 54271 - protein, 10 aa, Homo sapiens
  light chain complementarity determining region 3 for antibody 27136
QQRSNWPPIP

SEQ ID NO: 54272 - protein, 17 aa, Homo sapiens
  heavy chain complementarity determining region 3 for antibody 27136
AAGYHSGSLSADDVFDM

SEQ ID NO: 54273 - protein, 11 aa, Homo sapiens
  light chain complementarity determining region 3 for antibody 27137
QQRSNWPPGYT

SEQ ID NO: 54274 - protein, 12 aa, Homo sapiens
  heavy chain complementarity determining region 3 for antibody 27137
VKDCGLGGSRDS

SEQ ID NO: 54275 - protein, 10 aa, Homo sapiens
  light chain complementarity determining region 3 for antibody 27138
QQRSNWPPGT

SEQ ID NO: 54276 - protein, 13 aa, Homo sapiens
  heavy chain complementarity determining region 3 for antibody 27138
AREAFPPGGGLDY

SEQ ID NO: 54277 - protein, 10 aa, Homo sapiens
  light chain complementarity determining region 3 for antibody 27139
QQRSNWPPDT

SEQ ID NO: 54278 - protein, 13 aa, Homo sapiens
  heavy chain complementarity determining region 3 for antibody 27139
ARVGQQRLRGFDI

SEQ ID NO: 54279 - protein, 11 aa, Homo sapiens
  light chain complementarity determining region 3 for antibody 27140
QQRSNWPPAPP

SEQ ID NO: 54280 - protein, 14 aa, Homo sapiens
  heavy chain complementarity determining region 3 for antibody 27140
AREGTAMVKDAFEI

SEQ ID NO: 54281 - protein, 9 aa, Homo sapiens
  light chain complementarity determining region 3 for antibody 27141
QQRSNWPLT

SEQ ID NO: 54282 - protein, 13 aa, Homo sapiens
  heavy chain complementarity determining region 3 for antibody 27141
ARGKDGYNWLFDS

SEQ ID NO: 54283 - protein, 9 aa, Homo sapiens
  light chain complementarity determining region 3 for antibody 27142
QQRSNWPLT

SEQ ID NO: 54284 - protein, 17 aa, Homo sapiens
  heavy chain complementarity determining region 3 for antibody 27142
AKDLSPYGDYKSDYFDH

SEQ ID NO: 54285 - protein, 9 aa, Homo sapiens
  light chain complementarity determining region 3 for antibody 27143
QQRSNWPLP

SEQ ID NO: 54286 - protein, 14 aa, Homo sapiens
  heavy chain complementarity determining region 3 for antibody 27143
AKSRGYNTDDAFEI

SEQ ID NO: 54287 - protein, 9 aa, Homo sapiens
  light chain complementarity determining region 3 for antibody 27144
QQRSNWPLG

SEQ ID NO: 54288 - protein, 12 aa, Homo sapiens
  heavy chain complementarity determining region 3 for antibody 27144
ARVIEDHWYFDL

SEQ ID NO: 54289 - protein, 9 aa, Homo sapiens
  light chain complementarity determining region 3 for antibody 27145
QQRSNWPFT

SEQ ID NO: 54290 - protein, 14 aa, Homo sapiens
  heavy chain complementarity determining region 3 for antibody 27145
AKDKSGYSYGYFDC

SEQ ID NO: 54291 - protein, 9 aa, Homo sapiens
  light chain complementarity determining region 3 for antibody 27146
QQRSNWLWT

SEQ ID NO: 54292 - protein, 18 aa, Homo sapiens
  heavy chain complementarity determining region 3 for antibody 27146
AKEIGYCSGGSCYGGLDN

SEQ ID NO: 54293 - protein, 8 aa, Homo sapiens
  light chain complementarity determining region 3 for antibody 27147
QQRSNRPS

SEQ ID NO: 54294 - protein, 11 aa, Homo sapiens
  heavy chain complementarity determining region 3 for antibody 27147
ASGSIGWVFDY

SEQ ID NO: 54295 - protein, 8 aa, Homo sapiens
  light chain complementarity determining region 3 for antibody 27148
QQRSNFYT

SEQ ID NO: 54296 - protein, 12 aa, Homo sapiens
  heavy chain complementarity determining region 3 for antibody 27148
ARISDDTSAFDP

SEQ ID NO: 54297 - protein, 9 aa, Homo sapiens
  light chain complementarity determining region 3 for antibody 27149
QQRSHWPWT

SEQ ID NO: 54298 - protein, 12 aa, Homo sapiens
  heavy chain complementarity determining region 3 for antibody 27149
ARVTPLVRAIDS

SEQ ID NO: 54299 - protein, 10 aa, Homo sapiens
  light chain complementarity determining region 3 for antibody 27150
QQRSDWPPLT

SEQ ID NO: 54300 - protein, 10 aa, Homo sapiens
  heavy chain complementarity determining region 3 for antibody 27150
ARDYPMTFDY

SEQ ID NO: 54301 - protein, 10 aa, Homo sapiens
  light chain complementarity determining region 3 for antibody 27151
QQRSDGPPLT

SEQ ID NO: 54302 - protein, 10 aa, Homo sapiens
  heavy chain complementarity determining region 3 for antibody 27151
ARDYTMTFDY

SEQ ID NO: 54303 - protein, 10 aa, Homo sapiens
  light chain complementarity determining region 3 for antibody 27152
QQRSAWPPLT

SEQ ID NO: 54304 - protein, 10 aa, Homo sapiens
  heavy chain complementarity determining region 3 for antibody 27152
ARDYTMTFDY

SEQ ID NO: 54305 - protein, 10 aa, Homo sapiens
  light chain complementarity determining region 3 for antibody 27153
QQRRNWPPIT

SEQ ID NO: 54306 - protein, 22 aa, Homo sapiens
  heavy chain complementarity determining region 3 for antibody 27153
ARMKKSDVPLYCNGGTCHIFDY

SEQ ID NO: 54307 - protein, 10 aa, Homo sapiens
  light chain complementarity determining region 3 for antibody 27154
QQRRNWPPIT

SEQ ID NO: 54308 - protein, 22 aa, Homo sapiens
  heavy chain complementarity determining region 3 for antibody 27154
ARMKKSAVTLYCNGGTCHIFDY

SEQ ID NO: 54309 - protein, 11 aa, Homo sapiens
  light chain complementarity determining region 3 for antibody 27155
QQRQPRSNWRT

SEQ ID NO: 54310 - protein, 15 aa, Homo sapiens
  heavy chain complementarity determining region 3 for antibody 27155
ARGGYSSSWYYWFDP

SEQ ID NO: 54311 - protein, 11 aa, Homo sapiens
  light chain complementarity determining region 3 for antibody 27156
QQRQESTNWLN

SEQ ID NO: 54312 - protein, 15 aa, Homo sapiens
  heavy chain complementarity determining region 3 for antibody 27156
ARGGYSSNWYWWFDP

SEQ ID NO: 54313 - protein, 9 aa, Homo sapiens
  light chain complementarity determining region 3 for antibody 27157
QQRLFTPYT

SEQ ID NO: 54314 - protein, 18 aa, Homo sapiens
  heavy chain complementarity determining region 3 for antibody 27157
ARDSSPVSDYIWDDVFDM

SEQ ID NO: 54315 - protein, 9 aa, Homo sapiens
  light chain complementarity determining region 3 for antibody 27158
QQRKTFGQG

SEQ ID NO: 54316 - protein, 12 aa, Homo sapiens
  heavy chain complementarity determining region 3 for antibody 27158
ARVSSAYDRSDY

SEQ ID NO: 54317 - protein, 10 aa, Homo sapiens
  light chain complementarity determining region 3 for antibody 27159
QQRINWPPLP

SEQ ID NO: 54318 - protein, 14 aa, Homo sapiens
  heavy chain complementarity determining region 3 for antibody 27159
ASFSRYSYGKSIDY

SEQ ID NO: 54319 - protein, 8 aa, Homo sapiens
  light chain complementarity determining region 3 for antibody 27160
QQRHSWPP

SEQ ID NO: 54320 - protein, 11 aa, Homo sapiens
  heavy chain complementarity determining region 3 for antibody 27160
ARDDRRELPEL

SEQ ID NO: 54321 - protein, 9 aa, Homo sapiens
  light chain complementarity determining region 3 for antibody 27161
QQRHNWPWP

SEQ ID NO: 54322 - protein, 17 aa, Homo sapiens
  heavy chain complementarity determining region 3 for antibody 27161
VVPQFSRTDWPTEPSDY

SEQ ID NO: 54323 - protein, 9 aa, Homo sapiens
  light chain complementarity determining region 3 for antibody 27162
QQRHNCPWT

SEQ ID NO: 54324 - protein, 17 aa, Homo sapiens
  heavy chain complementarity determining region 3 for antibody 27162
VVPQFSRTDWPTEPSDY

SEQ ID NO: 54325 - protein, 11 aa, Homo sapiens
  light chain complementarity determining region 3 for antibody 27163
QQRGRWPPGLT

SEQ ID NO: 54326 - protein, 23 aa, Homo sapiens
  heavy chain complementarity determining region 3 for antibody 27163
AARNVSHDSSGYPLADYFYGMDV

SEQ ID NO: 54327 - protein, 10 aa, Homo sapiens
  light chain complementarity determining region 3 for antibody 27164
QQRGNWPPWT

SEQ ID NO: 54328 - protein, 13 aa, Homo sapiens
  heavy chain complementarity determining region 3 for antibody 27164
AREAFPPGGGLDY

SEQ ID NO: 54329 - protein, 9 aa, Homo sapiens
  light chain complementarity determining region 3 for antibody 27165
QQRGNWPPT

SEQ ID NO: 54330 - protein, 26 aa, Homo sapiens
  heavy chain complementarity determining region 3 for antibody 27165
ARDLGLRSLEWKSRNTNTNYYYGMDV

SEQ ID NO: 54331 - protein, 9 aa, Homo sapiens
  light chain complementarity determining region 3 for antibody 27166
QQRFKGPPT

SEQ ID NO: 54332 - protein, 19 aa, Homo sapiens
  heavy chain complementarity determining region 3 for antibody 27166
AREVSSADHYGVGKNWFDP

SEQ ID NO: 54333 - protein, 9 aa, Homo sapiens
  light chain complementarity determining region 3 for antibody 27167
QQRFIAPFT

SEQ ID NO: 54334 - protein, 13 aa, Homo sapiens
  heavy chain complementarity determining region 3 for antibody 27167
ARRRSDLSWQFDY

SEQ ID NO: 54335 - protein, 9 aa, Homo sapiens
  light chain complementarity determining region 3 for antibody 27168
QQRCKWPPT

SEQ ID NO: 54336 - protein, 19 aa, Homo sapiens
  heavy chain complementarity determining region 3 for antibody 27168
AREVSSADHYGVGKNWFDP

SEQ ID NO: 54337 - protein, 9 aa, Homo sapiens
  light chain complementarity determining region 3 for antibody 27169
QQRAGPPLT

SEQ ID NO: 54338 - protein, 14 aa, Homo sapiens
  heavy chain complementarity determining region 3 for antibody 27169
ARDSQWLVQYGMDV

SEQ ID NO: 54339 - protein, 9 aa, Homo sapiens
  light chain complementarity determining region 3 for antibody 27170
QQNYTTPRT

SEQ ID NO: 54340 - protein, 8 aa, Homo sapiens
  heavy chain complementarity determining region 3 for antibody 27170
ARDGAFDS

SEQ ID NO: 54341 - protein, 8 aa, Homo sapiens
  light chain complementarity determining region 3 for antibody 27171
QQNGTSRT

SEQ ID NO: 54342 - protein, 15 aa, Homo sapiens
  heavy chain complementarity determining region 3 for antibody 27171
ARGEFYRDSRGYRED

SEQ ID NO: 54343 - protein, 9 aa, Homo sapiens
  light chain complementarity determining region 3 for antibody 27172
QQNGSSPPT

SEQ ID NO: 54344 - protein, 12 aa, Homo sapiens
  heavy chain complementarity determining region 3 for antibody 27172
ARGPQLWFYFDY

SEQ ID NO: 54345 - protein, 10 aa, Homo sapiens
  light chain complementarity determining region 3 for antibody 27173
QQNGSSPPFT

SEQ ID NO: 54346 - protein, 14 aa, Homo sapiens
  heavy chain complementarity determining region 3 for antibody 27173
ARDLRWLVLGRLDY

SEQ ID NO: 54347 - protein, 6 aa, Homo sapiens
  light chain complementarity determining region 3 for antibody 27174
QQNGRK

SEQ ID NO: 54348 - protein, 12 aa, Homo sapiens
  heavy chain complementarity determining region 3 for antibody 27174
AKLVNSWYPYDY

SEQ ID NO: 54349 - protein, 8 aa, Homo sapiens
  light chain complementarity determining region 3 for antibody 27175
QQNGGSPS

SEQ ID NO: 54350 - protein, 16 aa, Homo sapiens
  heavy chain complementarity determining region 3 for antibody 27175
ATDWGSGTQWIRAFDV

SEQ ID NO: 54351 - protein, 9 aa, Homo sapiens
  light chain complementarity determining region 3 for antibody 27176
QQNDSSSYT

SEQ ID NO: 54352 - protein, 11 aa, Homo sapiens
  heavy chain complementarity determining region 3 for antibody 27176
ARGGFYGSFDF

SEQ ID NO: 54353 - protein, 9 aa, Homo sapiens
  light chain complementarity determining region 3 for antibody 27177
QQNDNLPPT

SEQ ID NO: 54354 - protein, 17 aa, Homo sapiens
  heavy chain complementarity determining region 3 for antibody 27177
GYSYGSRESYYYYGMDV

SEQ ID NO: 54355 - protein, 8 aa, Homo sapiens
  light chain complementarity determining region 3 for antibody 27178
QQLNTYRS

SEQ ID NO: 54356 - protein, 14 aa, Homo sapiens
  heavy chain complementarity determining region 3 for antibody 27178
ARDGVCSSSFVGVV

SEQ ID NO: 54357 - protein, 9 aa, Homo sapiens
  light chain complementarity determining region 3 for antibody 27179
QQLNSYPNT

SEQ ID NO: 54358 - protein, 12 aa, Homo sapiens
  heavy chain complementarity determining region 3 for antibody 27179
AIWGGAKGGLPY

SEQ ID NO: 54359 - protein, 9 aa, Homo sapiens
  light chain complementarity determining region 3 for antibody 27180
QQLNSYPNT

SEQ ID NO: 54360 - protein, 12 aa, Homo sapiens
  heavy chain complementarity determining region 3 for antibody 27180
AIWAGAKGGLPY

SEQ ID NO: 54361 - protein, 9 aa, Homo sapiens
  light chain complementarity determining region 3 for antibody 27181
QQLNRYLGT

SEQ ID NO: 54362 - protein, 18 aa, Homo sapiens
  heavy chain complementarity determining region 3 for antibody 27181
ARHSLTGFLILEHDAFDI

SEQ ID NO: 54363 - protein, 9 aa, Homo sapiens
  light chain complementarity determining region 3 for antibody 27182
QQLHSYPFT

SEQ ID NO: 54364 - protein, 26 aa, Homo sapiens
  heavy chain complementarity determining region 3 for antibody 27182
AKDVIEFQSIAGDREVDYSYYYAMDV

SEQ ID NO: 54365 - protein, 8 aa, Homo sapiens
  light chain complementarity determining region 3 for antibody 27183
QQLGSSLT

SEQ ID NO: 54366 - protein, 15 aa, Homo sapiens
  heavy chain complementarity determining region 3 for antibody 27183
ARLRDTTLGRWYFDS

SEQ ID NO: 54367 - protein, 10 aa, Homo sapiens
  light chain complementarity determining region 3 for antibody 27184
QQLDSSPPGT

SEQ ID NO: 54368 - protein, 13 aa, Homo sapiens
  heavy chain complementarity determining region 3 for antibody 27184
ARLIYVDYVFLDY

SEQ ID NO: 54369 - protein, 9 aa, Homo sapiens
  light chain complementarity determining region 3 for antibody 27185
QQHYRTPYT

SEQ ID NO: 54370 - protein, 15 aa, Homo sapiens
  heavy chain complementarity determining region 3 for antibody 27185
ARVGVDPNYYYGLDV

SEQ ID NO: 54371 - protein, 9 aa, Homo sapiens
  light chain complementarity determining region 3 for antibody 27186
QQHRSSPWT

SEQ ID NO: 54372 - protein, 22 aa, Homo sapiens
  heavy chain complementarity determining region 3 for antibody 27186
ARAVSTNRWGRSTGDWGGAYDI

SEQ ID NO: 54373 - protein, 8 aa, Homo sapiens
  light chain complementarity determining region 3 for antibody 27187
QQHRSSFP

SEQ ID NO: 54374 - protein, 13 aa, Homo sapiens
  heavy chain complementarity determining region 3 for antibody 27187
ATESGWYQGAFDI

SEQ ID NO: 54375 - protein, 10 aa, Homo sapiens
  light chain complementarity determining region 3 for antibody 27188
QQHGSSTPFT

SEQ ID NO: 54376 - protein, 13 aa, Homo sapiens
  heavy chain complementarity determining region 3 for antibody 27188
ARVVVPGRGYFQH

SEQ ID NO: 54377 - protein, 9 aa, Homo sapiens
  light chain complementarity determining region 3 for antibody 27189
QQHGSSLYT

SEQ ID NO: 54378 - protein, 9 aa, Homo sapiens
  heavy chain complementarity determining region 3 for antibody 27189
IYEINAFDI

SEQ ID NO: 54379 - protein, 9 aa, Homo sapiens
  light chain complementarity determining region 3 for antibody 27190
QQHGNLPRT

SEQ ID NO: 54380 - protein, 13 aa, Homo sapiens
  heavy chain complementarity determining region 3 for antibody 27190
AGGNFHSGGYGEY

SEQ ID NO: 54381 - protein, 9 aa, Homo sapiens
  light chain complementarity determining region 3 for antibody 27191
QQHGGFPVP

SEQ ID NO: 54382 - protein, 18 aa, Homo sapiens
  heavy chain complementarity determining region 3 for antibody 27191
ARVTYCPSGTCFSGEIHY

SEQ ID NO: 54383 - protein, 9 aa, Homo sapiens
  light chain complementarity determining region 3 for antibody 27192
QQGYTSPPT

SEQ ID NO: 54384 - protein, 13 aa, Homo sapiens
  heavy chain complementarity determining region 3 for antibody 27192
ARGMTMADFSADY

SEQ ID NO: 54385 - protein, 9 aa, Homo sapiens
  light chain complementarity determining region 3 for antibody 27193
QQGSTYPLT

SEQ ID NO: 54386 - protein, 20 aa, Homo sapiens
  heavy chain complementarity determining region 3 for antibody 27193
ARSPRREHNPGTTGYYSFDY

SEQ ID NO: 54387 - protein, 9 aa, Homo sapiens
  light chain complementarity determining region 3 for antibody 27194
QQGSTYPLT

SEQ ID NO: 54388 - protein, 20 aa, Homo sapiens
  heavy chain complementarity determining region 3 for antibody 27194
ARCPRREHNPGTTGYYSFDY

SEQ ID NO: 54389 - protein, 9 aa, Homo sapiens
  light chain complementarity determining region 3 for antibody 27195
QQGNSLPPT

SEQ ID NO: 54390 - protein, 20 aa, Homo sapiens
  heavy chain complementarity determining region 3 for antibody 27195
ARDPTGYGDYVPLYFYGMDV

SEQ ID NO: 54391 - protein, 9 aa, Homo sapiens
  light chain complementarity determining region 3 for antibody 27196
QQGNRFPPT

SEQ ID NO: 54392 - protein, 14 aa, Homo sapiens
  heavy chain complementarity determining region 3 for antibody 27196
ARYCSGTRCYSMDY

SEQ ID NO: 54393 - protein, 9 aa, Homo sapiens
  light chain complementarity determining region 3 for antibody 27197
QQFYTSVRT

SEQ ID NO: 54394 - protein, 12 aa, Homo sapiens
  heavy chain complementarity determining region 3 for antibody 27197
VKDCGLGGSRDS

SEQ ID NO: 54395 - protein, 9 aa, Homo sapiens
  light chain complementarity determining region 3 for antibody 27198
QQFYSPPYT

SEQ ID NO: 54396 - protein, 22 aa, Homo sapiens
  heavy chain complementarity determining region 3 for antibody 27198
ARAGQNVRVLRGWRTKKNWFDP

SEQ ID NO: 54397 - protein, 9 aa, Homo sapiens
  light chain complementarity determining region 3 for antibody 27199
QQFHTTPPT

SEQ ID NO: 54398 - protein, 15 aa, Homo sapiens
  heavy chain complementarity determining region 3 for antibody 27199
ARDRTASTSHDGFDL

SEQ ID NO: 54399 - protein, 8 aa, Homo sapiens
  light chain complementarity determining region 3 for antibody 27200
QQFGSLLT

SEQ ID NO: 54400 - protein, 15 aa, Homo sapiens
  heavy chain complementarity determining region 3 for antibody 27200
ARLRDTTLGRWYFDS

SEQ ID NO: 54401 - protein, 10 aa, Homo sapiens
  light chain complementarity determining region 3 for antibody 27201
QQFGNSPPWR

SEQ ID NO: 54402 - protein, 12 aa, Homo sapiens
  heavy chain complementarity determining region 3 for antibody 27201
AKEGLIGGYFDL

SEQ ID NO: 54403 - protein, 10 aa, Homo sapiens
  light chain complementarity determining region 3 for antibody 27202
QQFGGSPMFP

SEQ ID NO: 54404 - protein, 10 aa, Homo sapiens
  heavy chain complementarity determining region 3 for antibody 27202
ARHGDYWLDP

SEQ ID NO: 54405 - protein, 10 aa, Homo sapiens
  light chain complementarity determining region 3 for antibody 27203
QQFGGSPLFT

SEQ ID NO: 54406 - protein, 10 aa, Homo sapiens
  heavy chain complementarity determining region 3 for antibody 27203
ARHGDYWLDP

SEQ ID NO: 54407 - protein, 10 aa, Homo sapiens
  light chain complementarity determining region 3 for antibody 27204
QQFDNRPSLP

SEQ ID NO: 54408 - protein, 11 aa, Homo sapiens
  heavy chain complementarity determining region 3 for antibody 27204
ARAAGGENFDS

SEQ ID NO: 54409 - protein, 9 aa, Homo sapiens
  light chain complementarity determining region 3 for antibody 27205
QQDRSSPWT

SEQ ID NO: 54410 - protein, 22 aa, Homo sapiens
  heavy chain complementarity determining region 3 for antibody 27205
ARAVSTNRWGRSTGDWGGAYDI

SEQ ID NO: 54411 - protein, 9 aa, Homo sapiens
  light chain complementarity determining region 3 for antibody 27206
QQDRSSPST

SEQ ID NO: 54412 - protein, 17 aa, Homo sapiens
  heavy chain complementarity determining region 3 for antibody 27206
AGLSSRLGDGAPSLFDY

SEQ ID NO: 54413 - protein, 10 aa, Homo sapiens
  light chain complementarity determining region 3 for antibody 27207
QQDNNWPPYT

SEQ ID NO: 54414 - protein, 14 aa, Homo sapiens
  heavy chain complementarity determining region 3 for antibody 27207
ARGGRLRLFSFSDY

SEQ ID NO: 54415 - protein, 9 aa, Homo sapiens
  light chain complementarity determining region 3 for antibody 27208
QQDNDWLLT

SEQ ID NO: 54416 - protein, 23 aa, Homo sapiens
  heavy chain complementarity determining region 3 for antibody 27208
ARGPNIFSGSGTSYTGGFNWFDP

SEQ ID NO: 54417 - protein, 8 aa, Homo sapiens
  light chain complementarity determining region 3 for antibody 27209
QQDGTSRT

SEQ ID NO: 54418 - protein, 15 aa, Homo sapiens
  heavy chain complementarity determining region 3 for antibody 27209
ARGEFYRDSRGYRED

SEQ ID NO: 54419 - protein, 9 aa, Homo sapiens
  light chain complementarity determining region 3 for antibody 27210
QQDGSSWGT

SEQ ID NO: 54420 - protein, 20 aa, Homo sapiens
  heavy chain complementarity determining region 3 for antibody 27210
AREGGHRQWLEIYDPGYFHH

SEQ ID NO: 54421 - protein, 8 aa, Homo sapiens
  light chain complementarity determining region 3 for antibody 27211
QQDGSSVT

SEQ ID NO: 54422 - protein, 21 aa, Homo sapiens
  heavy chain complementarity determining region 3 for antibody 27211
ARGSFEHCSGGSCYFYYGMDV

SEQ ID NO: 54423 - protein, 9 aa, Homo sapiens
  light chain complementarity determining region 3 for antibody 27212
QQDGSSPYT

SEQ ID NO: 54424 - protein, 9 aa, Homo sapiens
  heavy chain complementarity determining region 3 for antibody 27212
ARETEGFDI

SEQ ID NO: 54425 - protein, 8 aa, Homo sapiens
  light chain complementarity determining region 3 for antibody 27213
QQDGSSPT

SEQ ID NO: 54426 - protein, 22 aa, Homo sapiens
  heavy chain complementarity determining region 3 for antibody 27213
ARDDYVWGSYRYGGQGSQAFDI

SEQ ID NO: 54427 - protein, 9 aa, Homo sapiens
  light chain complementarity determining region 3 for antibody 27214
QQDGSSPPT

SEQ ID NO: 54428 - protein, 13 aa, Homo sapiens
  heavy chain complementarity determining region 3 for antibody 27214
AKPMWRKLYYFDY

SEQ ID NO: 54429 - protein, 10 aa, Homo sapiens
  light chain complementarity determining region 3 for antibody 27215
QQDGSSPPLT

SEQ ID NO: 54430 - protein, 20 aa, Homo sapiens
  heavy chain complementarity determining region 3 for antibody 27215
ARLRKQLVLSNVYYYYGMDV

SEQ ID NO: 54431 - protein, 10 aa, Homo sapiens
  light chain complementarity determining region 3 for antibody 27216
QQDGSSPMYR

SEQ ID NO: 54432 - protein, 11 aa, Homo sapiens
  heavy chain complementarity determining region 3 for antibody 27216
ARGGQWGSLDY

SEQ ID NO: 54433 - protein, 9 aa, Homo sapiens
  light chain complementarity determining region 3 for antibody 27217
QQDGSSPFT

SEQ ID NO: 54434 - protein, 6 aa, Homo sapiens
  heavy chain complementarity determining region 3 for antibody 27217
VSLMFA

SEQ ID NO: 54435 - protein, 9 aa, Homo sapiens
  light chain complementarity determining region 3 for antibody 27218
QQDGSSPFT

SEQ ID NO: 54436 - protein, 21 aa, Homo sapiens
  heavy chain complementarity determining region 3 for antibody 27218
ARVGVERNRYGRTLPVWYFDY

SEQ ID NO: 54437 - protein, 9 aa, Homo sapiens
  light chain complementarity determining region 3 for antibody 27219
QQDGSSLYT

SEQ ID NO: 54438 - protein, 15 aa, Homo sapiens
  heavy chain complementarity determining region 3 for antibody 27219
ARLPEYSSSWYYFDF

SEQ ID NO: 54439 - protein, 9 aa, Homo sapiens
  light chain complementarity determining region 3 for antibody 27220
QQDGSSLYT

SEQ ID NO: 54440 - protein, 16 aa, Homo sapiens
  heavy chain complementarity determining region 3 for antibody 27220
ARAKHYGDYYYYGMDA

SEQ ID NO: 54441 - protein, 10 aa, Homo sapiens
  light chain complementarity determining region 3 for antibody 27221
QQDGSSLLIT

SEQ ID NO: 54442 - protein, 17 aa, Homo sapiens
  heavy chain complementarity determining region 3 for antibody 27221
ARRSRYSSNWYSHFFDY

SEQ ID NO: 54443 - protein, 9 aa, Homo sapiens
  light chain complementarity determining region 3 for antibody 27222
QQDGRSPWT

SEQ ID NO: 54444 - protein, 18 aa, Homo sapiens
  heavy chain complementarity determining region 3 for antibody 27222
ATNPSIAEPGNIYWYFDL

SEQ ID NO: 54445 - protein, 9 aa, Homo sapiens
  light chain complementarity determining region 3 for antibody 27223
QQDGNSPWA

SEQ ID NO: 54446 - protein, 11 aa, Homo sapiens
  heavy chain complementarity determining region 3 for antibody 27223
ARKGLYAPLDV

SEQ ID NO: 54447 - protein, 9 aa, Homo sapiens
  light chain complementarity determining region 3 for antibody 27224
QQDGNLPRT

SEQ ID NO: 54448 - protein, 13 aa, Homo sapiens
  heavy chain complementarity determining region 3 for antibody 27224
AGGNYETGRYEEY

SEQ ID NO: 54449 - protein, 9 aa, Homo sapiens
  light chain complementarity determining region 3 for antibody 27225
QQDDSLPWT

SEQ ID NO: 54450 - protein, 19 aa, Homo sapiens
  heavy chain complementarity determining region 3 for antibody 27225
ARTAIGKRYWASSGDQFDY

SEQ ID NO: 54451 - protein, 9 aa, Homo sapiens
  light chain complementarity determining region 3 for antibody 27226
QQAYTPPRT

SEQ ID NO: 54452 - protein, 14 aa, Homo sapiens
  heavy chain complementarity determining region 3 for antibody 27226
ARAISRAAVSRFDF

SEQ ID NO: 54453 - protein, 9 aa, Homo sapiens
  light chain complementarity determining region 3 for antibody 27227
QQAYSSVLT

SEQ ID NO: 54454 - protein, 16 aa, Homo sapiens
  heavy chain complementarity determining region 3 for antibody 27227
AREEGTTYTSRRTFDC

SEQ ID NO: 54455 - protein, 9 aa, Homo sapiens
  light chain complementarity determining region 3 for antibody 27228
QQANTYPLT

SEQ ID NO: 54456 - protein, 8 aa, Homo sapiens
  heavy chain complementarity determining region 3 for antibody 27228
INYNTGWS

SEQ ID NO: 54457 - protein, 9 aa, Homo sapiens
  light chain complementarity determining region 3 for antibody 27229
QQANSSPLS

SEQ ID NO: 54458 - protein, 16 aa, Homo sapiens
  heavy chain complementarity determining region 3 for antibody 27229
ARALVVPATAWSWFDP

SEQ ID NO: 54459 - protein, 9 aa, Homo sapiens
  light chain complementarity determining region 3 for antibody 27230
QQAHIYPFT

SEQ ID NO: 54460 - protein, 12 aa, Homo sapiens
  heavy chain complementarity determining region 3 for antibody 27230
ARPLDGDFGFDP

SEQ ID NO: 54461 - protein, 9 aa, Homo sapiens
  light chain complementarity determining region 3 for antibody 27231
QPYYTSLRT

SEQ ID NO: 54462 - protein, 12 aa, Homo sapiens
  heavy chain complementarity determining region 3 for antibody 27231
VKDCGLGGPRDY

SEQ ID NO: 54463 - protein, 9 aa, Homo sapiens
  light chain complementarity determining region 3 for antibody 27232
QPYRRSPST

SEQ ID NO: 54464 - protein, 17 aa, Homo sapiens
  heavy chain complementarity determining region 3 for antibody 27232
AGLSSRLGDGSPSLFDY

SEQ ID NO: 54465 - protein, 9 aa, Homo sapiens
  light chain complementarity determining region 3 for antibody 27233
QPYGSSPQT

SEQ ID NO: 54466 - protein, 11 aa, Homo sapiens
  heavy chain complementarity determining region 3 for antibody 27233
ARGDLWSAFDI

SEQ ID NO: 54467 - protein, 9 aa, Homo sapiens
  light chain complementarity determining region 3 for antibody 27234
QPYGSSLYT

SEQ ID NO: 54468 - protein, 9 aa, Homo sapiens
  heavy chain complementarity determining region 3 for antibody 27234
IYEINAFDI

SEQ ID NO: 54469 - protein, 9 aa, Homo sapiens
  light chain complementarity determining region 3 for antibody 27235
QPYDAQSWT

SEQ ID NO: 54470 - protein, 11 aa, Homo sapiens
  heavy chain complementarity determining region 3 for antibody 27235
ARGWRDNSFDY

SEQ ID NO: 54471 - protein, 11 aa, Homo sapiens
  light chain complementarity determining region 3 for antibody 27236
QNYNTALPGLT

SEQ ID NO: 54472 - protein, 14 aa, Homo sapiens
  heavy chain complementarity determining region 3 for antibody 27236
AKPRNSYWLYYFDY

SEQ ID NO: 54473 - protein, 10 aa, Homo sapiens
  light chain complementarity determining region 3 for antibody 27237
QLYSRSPTWA

SEQ ID NO: 54474 - protein, 19 aa, Homo sapiens
  heavy chain complementarity determining region 3 for antibody 27237
ARESYYPDIGGYTPRAFDI

SEQ ID NO: 54475 - protein, 10 aa, Homo sapiens
  light chain complementarity determining region 3 for antibody 27238
QLYRRSPTWT

SEQ ID NO: 54476 - protein, 19 aa, Homo sapiens
  heavy chain complementarity determining region 3 for antibody 27238
ARESYYPDIGGYTPRAFDI

SEQ ID NO: 54477 - protein, 11 aa, Homo sapiens
  light chain complementarity determining region 3 for antibody 27239
QLYERSLPMNS

SEQ ID NO: 54478 - protein, 14 aa, Homo sapiens
  heavy chain complementarity determining region 3 for antibody 27239
ASHIVINGKRGFDH

SEQ ID NO: 54479 - protein, 10 aa, Homo sapiens
  light chain complementarity determining region 3 for antibody 27240
QLYDSSSPGT

SEQ ID NO: 54480 - protein, 13 aa, Homo sapiens
  heavy chain complementarity determining region 3 for antibody 27240
ATPGPILTAAYLI

SEQ ID NO: 54481 - protein, 11 aa, Homo sapiens
  light chain complementarity determining region 3 for antibody 27241
QLRGNWPPPYT

SEQ ID NO: 54482 - protein, 22 aa, Homo sapiens
  heavy chain complementarity determining region 3 for antibody 27241
ATLRPRDVGFCSGGSCPYYFDY

SEQ ID NO: 54483 - protein, 9 aa, Homo sapiens
  light chain complementarity determining region 3 for antibody 27242
QKYYTSLRT

SEQ ID NO: 54484 - protein, 12 aa, Homo sapiens
  heavy chain complementarity determining region 3 for antibody 27242
VKDCGLGGSRDS

SEQ ID NO: 54485 - protein, 9 aa, Homo sapiens
  light chain complementarity determining region 3 for antibody 27243
QKYNSAPWP

SEQ ID NO: 54486 - protein, 15 aa, Homo sapiens
  heavy chain complementarity determining region 3 for antibody 27243
ARVRGDYVLFDAFDI

SEQ ID NO: 54487 - protein, 9 aa, Homo sapiens
  light chain complementarity determining region 3 for antibody 27244
QKYNSAPRP

SEQ ID NO: 54488 - protein, 10 aa, Homo sapiens
  heavy chain complementarity determining region 3 for antibody 27244
ARDRLGAFDI

SEQ ID NO: 54489 - protein, 9 aa, Homo sapiens
  light chain complementarity determining region 3 for antibody 27245
QKNNSAPRT

SEQ ID NO: 54490 - protein, 10 aa, Homo sapiens
  heavy chain complementarity determining region 3 for antibody 27245
ARDRLGAFDI

SEQ ID NO: 54491 - protein, 6 aa, Homo sapiens
  light chain complementarity determining region 3 for antibody 27246
QKNGRT

SEQ ID NO: 54492 - protein, 12 aa, Homo sapiens
  heavy chain complementarity determining region 3 for antibody 27246
AKLVNSWYPYDY

SEQ ID NO: 54493 - protein, 9 aa, Homo sapiens
  light chain complementarity determining region 3 for antibody 27247
QKHDSAPLT

SEQ ID NO: 54494 - protein, 15 aa, Homo sapiens
  heavy chain complementarity determining region 3 for antibody 27247
ARDGGPYQVLLPFSD

SEQ ID NO: 54495 - protein, 9 aa, Homo sapiens
  light chain complementarity determining region 3 for antibody 27248
QKDDSAPLT

SEQ ID NO: 54496 - protein, 15 aa, Homo sapiens
  heavy chain complementarity determining region 3 for antibody 27248
ARDGGPYQVLLPFSD

SEQ ID NO: 54497 - protein, 9 aa, Homo sapiens
  light chain complementarity determining region 3 for antibody 27249
QHYYIYPYT

SEQ ID NO: 54498 - protein, 16 aa, Homo sapiens
  heavy chain complementarity determining region 3 for antibody 27249
SRAPPRDSSAYRPFDY

SEQ ID NO: 54499 - protein, 10 aa, Homo sapiens
  light chain complementarity determining region 3 for antibody 27250
QHYVSPPPYT

SEQ ID NO: 54500 - protein, 12 aa, Homo sapiens
  heavy chain complementarity determining region 3 for antibody 27250
ARETTRFGELDY

SEQ ID NO: 54501 - protein, 8 aa, Homo sapiens
  light chain complementarity determining region 3 for antibody 27251
QHYVRSLT

SEQ ID NO: 54502 - protein, 15 aa, Homo sapiens
  heavy chain complementarity determining region 3 for antibody 27251
ARGGLPLRRNGYFDS

SEQ ID NO: 54503 - protein, 9 aa, Homo sapiens
  light chain complementarity determining region 3 for antibody 27252
QHYSHWPHT

SEQ ID NO: 54504 - protein, 12 aa, Homo sapiens
  heavy chain complementarity determining region 3 for antibody 27252
VRKPPGNHHYDY

SEQ ID NO: 54505 - protein, 9 aa, Homo sapiens
  light chain complementarity determining region 3 for antibody 27253
QHYSDFPWA

SEQ ID NO: 54506 - protein, 14 aa, Homo sapiens
  heavy chain complementarity determining region 3 for antibody 27253
AKCGHSYGNDAFDI

SEQ ID NO: 54507 - protein, 9 aa, Homo sapiens
  light chain complementarity determining region 3 for antibody 27254
QHYQGDPIT

SEQ ID NO: 54508 - protein, 21 aa, Homo sapiens
  heavy chain complementarity determining region 3 for antibody 27254
VRGPGGEAPAGSETYYYPMDL

SEQ ID NO: 54509 - protein, 8 aa, Homo sapiens
  light chain complementarity determining region 3 for antibody 27255
QHYNYYYP

SEQ ID NO: 54510 - protein, 12 aa, Homo sapiens
  heavy chain complementarity determining region 3 for antibody 27255
VREQGPHKSFDY

SEQ ID NO: 54511 - protein, 9 aa, Homo sapiens
  light chain complementarity determining region 3 for antibody 27256
QHYNTWPRT

SEQ ID NO: 54512 - protein, 16 aa, Homo sapiens
  heavy chain complementarity determining region 3 for antibody 27256
AREFLAAALYLKGLDV

SEQ ID NO: 54513 - protein, 10 aa, Homo sapiens
  light chain complementarity determining region 3 for antibody 27257
QHYNNWPRGT

SEQ ID NO: 54514 - protein, 15 aa, Homo sapiens
  heavy chain complementarity determining region 3 for antibody 27257
ARLGGRLLRSAPFDY

SEQ ID NO: 54515 - protein, 9 aa, Homo sapiens
  light chain complementarity determining region 3 for antibody 27258
QHYNGHSKT

SEQ ID NO: 54516 - protein, 11 aa, Homo sapiens
  heavy chain complementarity determining region 3 for antibody 27258
AVVDTTLAMPK

SEQ ID NO: 54517 - protein, 10 aa, Homo sapiens
  light chain complementarity determining region 3 for antibody 27259
QHYHNWPPWT

SEQ ID NO: 54518 - protein, 13 aa, Homo sapiens
  heavy chain complementarity determining region 3 for antibody 27259
AKGRVRELYYFET

SEQ ID NO: 54519 - protein, 11 aa, Homo sapiens
  light chain complementarity determining region 3 for antibody 27260
QHYGTSPAMYP

SEQ ID NO: 54520 - protein, 16 aa, Homo sapiens
  heavy chain complementarity determining region 3 for antibody 27260
ATPYLAVSGPLDAFDI

SEQ ID NO: 54521 - protein, 9 aa, Homo sapiens
  light chain complementarity determining region 3 for antibody 27261
QHYGTSLWT

SEQ ID NO: 54522 - protein, 16 aa, Homo sapiens
  heavy chain complementarity determining region 3 for antibody 27261
ARLLPAGSLTPQMMPV

SEQ ID NO: 54523 - protein, 10 aa, Homo sapiens
  light chain complementarity determining region 3 for antibody 27262
QHYGSSPRFT

SEQ ID NO: 54524 - protein, 12 aa, Homo sapiens
  heavy chain complementarity determining region 3 for antibody 27262
ARDVVGATASDF

SEQ ID NO: 54525 - protein, 11 aa, Homo sapiens
  light chain complementarity determining region 3 for antibody 27263
QHYGSSPPLYT

SEQ ID NO: 54526 - protein, 10 aa, Homo sapiens
  heavy chain complementarity determining region 3 for antibody 27263
VSNGYYCLEY

SEQ ID NO: 54527 - protein, 9 aa, Homo sapiens
  light chain complementarity determining region 3 for antibody 27264
QHYGSSPLT

SEQ ID NO: 54528 - protein, 12 aa, Homo sapiens
  heavy chain complementarity determining region 3 for antibody 27264
VRADISGYYFDF

SEQ ID NO: 54529 - protein, 10 aa, Homo sapiens
  light chain complementarity determining region 3 for antibody 27265
QHYGISPRFI

SEQ ID NO: 54530 - protein, 12 aa, Homo sapiens
  heavy chain complementarity determining region 3 for antibody 27265
ARDVVGATASDF

SEQ ID NO: 54531 - protein, 9 aa, Homo sapiens
  light chain complementarity determining region 3 for antibody 27266
QHYGAYSGP

SEQ ID NO: 54532 - protein, 10 aa, Homo sapiens
  heavy chain complementarity determining region 3 for antibody 27266
ARDVYDGWDR

SEQ ID NO: 54533 - protein, 10 aa, Homo sapiens
  light chain complementarity determining region 3 for antibody 27267
QHYETSPGPT

SEQ ID NO: 54534 - protein, 11 aa, Homo sapiens
  heavy chain complementarity determining region 3 for antibody 27267
ASDSNNCWFFD

SEQ ID NO: 54535 - protein, 9 aa, Homo sapiens
  light chain complementarity determining region 3 for antibody 27268
QHYASSPRT

SEQ ID NO: 54536 - protein, 12 aa, Homo sapiens
  heavy chain complementarity determining region 3 for antibody 27268
TTKRGYIYGADY

SEQ ID NO: 54537 - protein, 9 aa, Homo sapiens
  light chain complementarity determining region 3 for antibody 27269
QHYASSPRP

SEQ ID NO: 54538 - protein, 12 aa, Homo sapiens
  heavy chain complementarity determining region 3 for antibody 27269
TTKRGYIYGAEY

SEQ ID NO: 54539 - protein, 9 aa, Homo sapiens
  light chain complementarity determining region 3 for antibody 27270
QHYASSPQT

SEQ ID NO: 54540 - protein, 14 aa, Homo sapiens
  heavy chain complementarity determining region 3 for antibody 27270
TRDSLTLPGQPLDY

SEQ ID NO: 54541 - protein, 10 aa, Homo sapiens
  light chain complementarity determining region 3 for antibody 27271
QHYANQPPIT

SEQ ID NO: 54542 - protein, 12 aa, Homo sapiens
  heavy chain complementarity determining region 3 for antibody 27271
ARVLDSLSPAFH

SEQ ID NO: 54543 - protein, 8 aa, Homo sapiens
  light chain complementarity determining region 3 for antibody 27272
QHYAITWT

SEQ ID NO: 54544 - protein, 10 aa, Homo sapiens
  heavy chain complementarity determining region 3 for antibody 27272
AKTTDWYGHY

SEQ ID NO: 54545 - protein, 9 aa, Homo sapiens
  light chain complementarity determining region 3 for antibody 27273
QHTYTSPFN

SEQ ID NO: 54546 - protein, 18 aa, Homo sapiens
  heavy chain complementarity determining region 3 for antibody 27273
AKDLIPDVSVLRGGSPES

SEQ ID NO: 54547 - protein, 9 aa, Homo sapiens
  light chain complementarity determining region 3 for antibody 27274
QHTYNTPPT

SEQ ID NO: 54548 - protein, 11 aa, Homo sapiens
  heavy chain complementarity determining region 3 for antibody 27274
TAERAGTIVDY

SEQ ID NO: 54549 - protein, 9 aa, Homo sapiens
  light chain complementarity determining region 3 for antibody 27275
QHTHTFPRT

SEQ ID NO: 54550 - protein, 4 aa, Homo sapiens
  heavy chain complementarity determining region 3 for antibody 27275
GMDV

SEQ ID NO: 54551 - protein, 9 aa, Homo sapiens
  light chain complementarity determining region 3 for antibody 27276
QHTFSTPPT

SEQ ID NO: 54552 - protein, 19 aa, Homo sapiens
  heavy chain complementarity determining region 3 for antibody 27276
AKVTLHCRGANCYGDYLDH

SEQ ID NO: 54553 - protein, 9 aa, Homo sapiens
  light chain complementarity determining region 3 for antibody 27277
QHSYSAPYT

SEQ ID NO: 54554 - protein, 18 aa, Homo sapiens
  heavy chain complementarity determining region 3 for antibody 27277
AREKEYAGEATDSEIFDY

SEQ ID NO: 54555 - protein, 9 aa, Homo sapiens
  light chain complementarity determining region 3 for antibody 27278
QHSNSRPFT

SEQ ID NO: 54556 - protein, 20 aa, Homo sapiens
  heavy chain complementarity determining region 3 for antibody 27278
AKGISVAALRTVYYYYGMDV

SEQ ID NO: 54557 - protein, 6 aa, Homo sapiens
  light chain complementarity determining region 3 for antibody 27279
QHRGRS

SEQ ID NO: 54558 - protein, 17 aa, Homo sapiens
  heavy chain complementarity determining region 3 for antibody 27279
ATFSRQVVTGYYWYSDL

SEQ ID NO: 54559 - protein, 9 aa, Homo sapiens
  light chain complementarity determining region 3 for antibody 27280
QHRANWPIT

SEQ ID NO: 54560 - protein, 18 aa, Homo sapiens
  heavy chain complementarity determining region 3 for antibody 27280
ARGYDEYILTGDGYYFDS

SEQ ID NO: 54561 - protein, 9 aa, Homo sapiens
  light chain complementarity determining region 3 for antibody 27281
QHHQTYWPP

SEQ ID NO: 54562 - protein, 12 aa, Homo sapiens
  heavy chain complementarity determining region 3 for antibody 27281
AGDPSGNSYFDY

SEQ ID NO: 54563 - protein, 10 aa, Homo sapiens
  light chain complementarity determining region 3 for antibody 27282
QGFNRAPPFT

SEQ ID NO: 54564 - protein, 25 aa, Homo sapiens
  heavy chain complementarity determining region 3 for antibody 27282
TTASGGRYDYVWGGYRLRSADSFDV

SEQ ID NO: 54565 - protein, 9 aa, Homo sapiens
  light chain complementarity determining region 3 for antibody 27283
QEYNGAPGT

SEQ ID NO: 54566 - protein, 16 aa, Homo sapiens
  heavy chain complementarity determining region 3 for antibody 27283
ARDDGDSRVVLAALDY

SEQ ID NO: 54567 - protein, 10 aa, Homo sapiens
  light chain complementarity determining region 3 for antibody 27284
QESYSTLPTT

SEQ ID NO: 54568 - protein, 16 aa, Homo sapiens
  heavy chain complementarity determining region 3 for antibody 27284
AKAKNSVTFGGVIIDH

SEQ ID NO: 54569 - protein, 10 aa, Homo sapiens
  light chain complementarity determining region 3 for antibody 27285
QERYSTLSTT

SEQ ID NO: 54570 - protein, 16 aa, Homo sapiens
  heavy chain complementarity determining region 3 for antibody 27285
AKAKNSVTFGGVIIDH

SEQ ID NO: 54571 - protein, 9 aa, Homo sapiens
  light chain complementarity determining region 3 for antibody 27286
PQYVTYPIT

SEQ ID NO: 54572 - protein, 13 aa, Homo sapiens
  heavy chain complementarity determining region 3 for antibody 27286
GRGGYTSSWYWVY

SEQ ID NO: 54573 - protein, 9 aa, Homo sapiens
  light chain complementarity determining region 3 for antibody 27287
PQYGSSPPT

SEQ ID NO: 54574 - protein, 12 aa, Homo sapiens
  heavy chain complementarity determining region 3 for antibody 27287
ARGPQLWFYFDY

SEQ ID NO: 54575 - protein, 9 aa, Homo sapiens
  light chain complementarity determining region 3 for antibody 27288
PQYGSLPLT

SEQ ID NO: 54576 - protein, 15 aa, Homo sapiens
  heavy chain complementarity determining region 3 for antibody 27288
AHRPNYYDKAGAFDI

SEQ ID NO: 54577 - protein, 9 aa, Homo sapiens
  light chain complementarity determining region 3 for antibody 27289
PQYGNLPRT

SEQ ID NO: 54578 - protein, 13 aa, Homo sapiens
  heavy chain complementarity determining region 3 for antibody 27289
AGGNFHSGGYGEY

SEQ ID NO: 54579 - protein, 8 aa, Homo sapiens
  light chain complementarity determining region 3 for antibody 27290
PQRHTRLS

SEQ ID NO: 54580 - protein, 11 aa, Homo sapiens
  heavy chain complementarity determining region 3 for antibody 27290
ASGSMGWVFDH

SEQ ID NO: 54581 - protein, 9 aa, Homo sapiens
  light chain complementarity determining region 3 for antibody 27291
MQVLQTPLT

SEQ ID NO: 54582 - protein, 12 aa, Homo sapiens
  heavy chain complementarity determining region 3 for antibody 27291
VKDSDKKWELRD

SEQ ID NO: 54583 - protein, 9 aa, Homo sapiens
  light chain complementarity determining region 3 for antibody 27292
MQVLQTPLT

SEQ ID NO: 54584 - protein, 12 aa, Homo sapiens
  heavy chain complementarity determining region 3 for antibody 27292
VKDSDKKWDLLD

SEQ ID NO: 54585 - protein, 9 aa, Homo sapiens
  light chain complementarity determining region 3 for antibody 27293
MQVLHTPLT

SEQ ID NO: 54586 - protein, 12 aa, Homo sapiens
  heavy chain complementarity determining region 3 for antibody 27293
AKDSEQKWELHD

SEQ ID NO: 54587 - protein, 9 aa, Homo sapiens
  light chain complementarity determining region 3 for antibody 27294
MQSRSWPHT

SEQ ID NO: 54588 - protein, 8 aa, Homo sapiens
  heavy chain complementarity determining region 3 for antibody 27294
TAWGSSQH

SEQ ID NO: 54589 - protein, 9 aa, Homo sapiens
  light chain complementarity determining region 3 for antibody 27295
MQSRQTGRT

SEQ ID NO: 54590 - protein, 18 aa, Homo sapiens
  heavy chain complementarity determining region 3 for antibody 27295
ARLDYYYGSGMPGRGFDH

SEQ ID NO: 54591 - protein, 9 aa, Homo sapiens
  light chain complementarity determining region 3 for antibody 27296
MQRRRWPPT

SEQ ID NO: 54592 - protein, 8 aa, Homo sapiens
  heavy chain complementarity determining region 3 for antibody 27296
TAWGSSQH

SEQ ID NO: 54593 - protein, 9 aa, Homo sapiens
  light chain complementarity determining region 3 for antibody 27297
MQHAHWPHT

SEQ ID NO: 54594 - protein, 9 aa, Homo sapiens
  heavy chain complementarity determining region 3 for antibody 27297
AGWGDGSNY

SEQ ID NO: 54595 - protein, 9 aa, Homo sapiens
  light chain complementarity determining region 3 for antibody 27298
MQGTRGPYT

SEQ ID NO: 54596 - protein, 10 aa, Homo sapiens
  heavy chain complementarity determining region 3 for antibody 27298
ARNSGWSVDC

SEQ ID NO: 54597 - protein, 9 aa, Homo sapiens
  light chain complementarity determining region 3 for antibody 27299
MQGTPWRHT

SEQ ID NO: 54598 - protein, 11 aa, Homo sapiens
  heavy chain complementarity determining region 3 for antibody 27299
ARDPGWGARDY

SEQ ID NO: 54599 - protein, 9 aa, Homo sapiens
  light chain complementarity determining region 3 for antibody 27300
MQGTPRPPT

SEQ ID NO: 54600 - protein, 15 aa, Homo sapiens
  heavy chain complementarity determining region 3 for antibody 27300
AKSSGPSIAVTGFDY

SEQ ID NO: 54601 - protein, 9 aa, Homo sapiens
  light chain complementarity determining region 3 for antibody 27301
MQGTHWPYP

SEQ ID NO: 54602 - protein, 10 aa, Homo sapiens
  heavy chain complementarity determining region 3 for antibody 27301
ARDGDFVLDY

SEQ ID NO: 54603 - protein, 9 aa, Homo sapiens
  light chain complementarity determining region 3 for antibody 27302
MQGTHWPRE

SEQ ID NO: 54604 - protein, 18 aa, Homo sapiens
  heavy chain complementarity determining region 3 for antibody 27302
ARDERDTCTNGLCYYFDY

SEQ ID NO: 54605 - protein, 10 aa, Homo sapiens
  light chain complementarity determining region 3 for antibody 27303
MQGTHWPPWT

SEQ ID NO: 54606 - protein, 17 aa, Homo sapiens
  heavy chain complementarity determining region 3 for antibody 27303
VRDGSTASGRRNAPGAN

SEQ ID NO: 54607 - protein, 9 aa, Homo sapiens
  light chain complementarity determining region 3 for antibody 27304
MQGTHWPNT

SEQ ID NO: 54608 - protein, 10 aa, Homo sapiens
  heavy chain complementarity determining region 3 for antibody 27304
ARDGDFVLDY

SEQ ID NO: 54609 - protein, 8 aa, Homo sapiens
  light chain complementarity determining region 3 for antibody 27305
MQGTHWPA

SEQ ID NO: 54610 - protein, 21 aa, Homo sapiens
  heavy chain complementarity determining region 3 for antibody 27305
AKDRPNYYESNGQYYTPKGDL

SEQ ID NO: 54611 - protein, 9 aa, Homo sapiens
  light chain complementarity determining region 3 for antibody 27306
MQGTHGPYT

SEQ ID NO: 54612 - protein, 11 aa, Homo sapiens
  heavy chain complementarity determining region 3 for antibody 27306
ARDPAWGALDI

SEQ ID NO: 54613 - protein, 9 aa, Homo sapiens
  light chain complementarity determining region 3 for antibody 27307
MQGTHGPYT

SEQ ID NO: 54614 - protein, 15 aa, Homo sapiens
  heavy chain complementarity determining region 3 for antibody 27307
ARDIRGSWYGTSVDY

SEQ ID NO: 54615 - protein, 10 aa, Homo sapiens
  light chain complementarity determining region 3 for antibody 27308
MQGTHGPPGT

SEQ ID NO: 54616 - protein, 12 aa, Homo sapiens
  heavy chain complementarity determining region 3 for antibody 27308
TTGLNWGWEPDC

SEQ ID NO: 54617 - protein, 12 aa, Homo sapiens
  light chain complementarity determining region 3 for antibody 27309
MQGTHGPPDQFT

SEQ ID NO: 54618 - protein, 12 aa, Homo sapiens
  heavy chain complementarity determining region 3 for antibody 27309
ARRGELDDAFDI

SEQ ID NO: 54619 - protein, 8 aa, Homo sapiens
  light chain complementarity determining region 3 for antibody 27310
MQGTDRYT

SEQ ID NO: 54620 - protein, 14 aa, Homo sapiens
  heavy chain complementarity determining region 3 for antibody 27310
ARGSMIRGVPDIDY

SEQ ID NO: 54621 - protein, 8 aa, Homo sapiens
  light chain complementarity determining region 3 for antibody 27311
MQGTDMYP

SEQ ID NO: 54622 - protein, 14 aa, Homo sapiens
  heavy chain complementarity determining region 3 for antibody 27311
ARGSMIRGVPDIDY

SEQ ID NO: 54623 - protein, 8 aa, Homo sapiens
  light chain complementarity determining region 3 for antibody 27312
MQGTDMHT

SEQ ID NO: 54624 - protein, 14 aa, Homo sapiens
  heavy chain complementarity determining region 3 for antibody 27312
ARGSMIRGVPDIDY

SEQ ID NO: 54625 - protein, 10 aa, Homo sapiens
  light chain complementarity determining region 3 for antibody 27313
MQGSYWPPRT

SEQ ID NO: 54626 - protein, 11 aa, Homo sapiens
  heavy chain complementarity determining region 3 for antibody 27313
ARDTPGVGIDY

SEQ ID NO: 54627 - protein, 10 aa, Homo sapiens
  light chain complementarity determining region 3 for antibody 27314
MQGSYGPPWT

SEQ ID NO: 54628 - protein, 11 aa, Homo sapiens
  heavy chain complementarity determining region 3 for antibody 27314
ARDTPGIGIDY

SEQ ID NO: 54629 - protein, 9 aa, Homo sapiens
  light chain complementarity determining region 3 for antibody 27315
MQGSHWPST

SEQ ID NO: 54630 - protein, 10 aa, Homo sapiens
  heavy chain complementarity determining region 3 for antibody 27315
GRDNHGSIDY

SEQ ID NO: 54631 - protein, 9 aa, Homo sapiens
  light chain complementarity determining region 3 for antibody 27316
MQGSHWPDT

SEQ ID NO: 54632 - protein, 10 aa, Homo sapiens
  heavy chain complementarity determining region 3 for antibody 27316
GRDNHGSIDY

SEQ ID NO: 54633 - protein, 9 aa, Homo sapiens
  light chain complementarity determining region 3 for antibody 27317
MQGRHWPWP

SEQ ID NO: 54634 - protein, 10 aa, Homo sapiens
  heavy chain complementarity determining region 3 for antibody 27317
TTEIVDLFDH

SEQ ID NO: 54635 - protein, 9 aa, Homo sapiens
  light chain complementarity determining region 3 for antibody 27318
MQGRHGPWT

SEQ ID NO: 54636 - protein, 10 aa, Homo sapiens
  heavy chain complementarity determining region 3 for antibody 27318
TTEIVDLFDH

SEQ ID NO: 54637 - protein, 9 aa, Homo sapiens
  light chain complementarity determining region 3 for antibody 27319
MQGPQGPGT

SEQ ID NO: 54638 - protein, 7 aa, Homo sapiens
  heavy chain complementarity determining region 3 for antibody 27319
STDFLDL

SEQ ID NO: 54639 - protein, 8 aa, Homo sapiens
  light chain complementarity determining region 3 for antibody 27320
MQGLQTPT

SEQ ID NO: 54640 - protein, 9 aa, Homo sapiens
  heavy chain complementarity determining region 3 for antibody 27320
ARDSSAFGP

SEQ ID NO: 54641 - protein, 9 aa, Homo sapiens
  light chain complementarity determining region 3 for antibody 27321
MQGLQPPWT

SEQ ID NO: 54642 - protein, 17 aa, Homo sapiens
  heavy chain complementarity determining region 3 for antibody 27321
ARPEYYFAGSGYHAFDI

SEQ ID NO: 54643 - protein, 9 aa, Homo sapiens
  light chain complementarity determining region 3 for antibody 27322
MQGLQAPLT

SEQ ID NO: 54644 - protein, 12 aa, Homo sapiens
  heavy chain complementarity determining region 3 for antibody 27322
VKDRDYYGQFEA

SEQ ID NO: 54645 - protein, 9 aa, Homo sapiens
  light chain complementarity determining region 3 for antibody 27323
MQGLHTPYT

SEQ ID NO: 54646 - protein, 15 aa, Homo sapiens
  heavy chain complementarity determining region 3 for antibody 27323
VKAERRAVWLSAFEI

SEQ ID NO: 54647 - protein, 9 aa, Homo sapiens
  light chain complementarity determining region 3 for antibody 27324
MQGAPWPYT

SEQ ID NO: 54648 - protein, 11 aa, Homo sapiens
  heavy chain complementarity determining region 3 for antibody 27324
ATVRLVGAVDY

SEQ ID NO: 54649 - protein, 9 aa, Homo sapiens
  light chain complementarity determining region 3 for antibody 27325
MQGAHGPYT

SEQ ID NO: 54650 - protein, 11 aa, Homo sapiens
  heavy chain complementarity determining region 3 for antibody 27325
ATVRLVGAVDY

SEQ ID NO: 54651 - protein, 9 aa, Homo sapiens
  light chain complementarity determining region 3 for antibody 27326
MQDTHWPPT

SEQ ID NO: 54652 - protein, 8 aa, Homo sapiens
  heavy chain complementarity determining region 3 for antibody 27326
ARTRTFDI

SEQ ID NO: 54653 - protein, 9 aa, Homo sapiens
  light chain complementarity determining region 3 for antibody 27327
MQDTHGPLT

SEQ ID NO: 54654 - protein, 8 aa, Homo sapiens
  heavy chain complementarity determining region 3 for antibody 27327
ARTRTFDI

SEQ ID NO: 54655 - protein, 9 aa, Homo sapiens
  light chain complementarity determining region 3 for antibody 27328
MQDLETPFT

SEQ ID NO: 54656 - protein, 15 aa, Homo sapiens
  heavy chain complementarity determining region 3 for antibody 27328
VRHYRETVAGIEGDS

SEQ ID NO: 54657 - protein, 9 aa, Homo sapiens
  light chain complementarity determining region 3 for antibody 27329
MQATNGPRT

SEQ ID NO: 54658 - protein, 8 aa, Homo sapiens
  heavy chain complementarity determining region 3 for antibody 27329
AKDWQFDY

SEQ ID NO: 54659 - protein, 9 aa, Homo sapiens
  light chain complementarity determining region 3 for antibody 27330
MQATHWPPT

SEQ ID NO: 54660 - protein, 19 aa, Homo sapiens
  heavy chain complementarity determining region 3 for antibody 27330
VKDQDGSGSYYKTPPTFDY

SEQ ID NO: 54661 - protein, 9 aa, Homo sapiens
  light chain complementarity determining region 3 for antibody 27331
MQARQTPRT

SEQ ID NO: 54662 - protein, 11 aa, Homo sapiens
  heavy chain complementarity determining region 3 for antibody 27331
TRDIDRGSALN

SEQ ID NO: 54663 - protein, 9 aa, Homo sapiens
  light chain complementarity determining region 3 for antibody 27332
MQALQVPGT

SEQ ID NO: 54664 - protein, 14 aa, Homo sapiens
  heavy chain complementarity determining region 3 for antibody 27332
ARGPRYYDSRCLID

SEQ ID NO: 54665 - protein, 8 aa, Homo sapiens
  light chain complementarity determining region 3 for antibody 27333
MQALQTRT

SEQ ID NO: 54666 - protein, 16 aa, Homo sapiens
  heavy chain complementarity determining region 3 for antibody 27333
AKAGWLVGYDLSRGCA

SEQ ID NO: 54667 - protein, 8 aa, Homo sapiens
  light chain complementarity determining region 3 for antibody 27334
MQALQTPT

SEQ ID NO: 54668 - protein, 23 aa, Homo sapiens
  heavy chain complementarity determining region 3 for antibody 27334
ARGTYYDGSGSYRGYYYYYGMDV

SEQ ID NO: 54669 - protein, 8 aa, Homo sapiens
  light chain complementarity determining region 3 for antibody 27335
MQALQTPR

SEQ ID NO: 54670 - protein, 9 aa, Homo sapiens
  heavy chain complementarity determining region 3 for antibody 27335
ARDSSAFGP

SEQ ID NO: 54671 - protein, 9 aa, Homo sapiens
  light chain complementarity determining region 3 for antibody 27336
MQALQTPLT

SEQ ID NO: 54672 - protein, 17 aa, Homo sapiens
  heavy chain complementarity determining region 3 for antibody 27336
ARRPWVRGLFMPYYFDY

SEQ ID NO: 54673 - protein, 10 aa, Homo sapiens
  light chain complementarity determining region 3 for antibody 27337
MQALQTPKLT

SEQ ID NO: 54674 - protein, 15 aa, Homo sapiens
  heavy chain complementarity determining region 3 for antibody 27337
AREGEDQYSGREVVD

SEQ ID NO: 54675 - protein, 9 aa, Homo sapiens
  light chain complementarity determining region 3 for antibody 27338
MQALQTPGT

SEQ ID NO: 54676 - protein, 25 aa, Homo sapiens
  heavy chain complementarity determining region 3 for antibody 27338
ARGAGRDGVVVADARSWAYYYGMDV

SEQ ID NO: 54677 - protein, 9 aa, Homo sapiens
  light chain complementarity determining region 3 for antibody 27339
MQALQTPFT

SEQ ID NO: 54678 - protein, 20 aa, Homo sapiens
  heavy chain complementarity determining region 3 for antibody 27339
AKPRSPVSRRYLYYHYGMDV

SEQ ID NO: 54679 - protein, 8 aa, Homo sapiens
  light chain complementarity determining region 3 for antibody 27340
MQALQTPA

SEQ ID NO: 54680 - protein, 18 aa, Homo sapiens
  heavy chain complementarity determining region 3 for antibody 27340
ARVRVSWEILGADWYLDV

SEQ ID NO: 54681 - protein, 9 aa, Homo sapiens
  light chain complementarity determining region 3 for antibody 27341
MQALQSPPT

SEQ ID NO: 54682 - protein, 14 aa, Homo sapiens
  heavy chain complementarity determining region 3 for antibody 27341
ASGYSHDRAGAFNI

SEQ ID NO: 54683 - protein, 10 aa, Homo sapiens
  light chain complementarity determining region 3 for antibody 27342
MQALQPHRDT

SEQ ID NO: 54684 - protein, 20 aa, Homo sapiens
  heavy chain complementarity determining region 3 for antibody 27342
ARLKAASAGLPSYYYAGMDV

SEQ ID NO: 54685 - protein, 8 aa, Homo sapiens
  light chain complementarity determining region 3 for antibody 27343
MQALPTPT

SEQ ID NO: 54686 - protein, 9 aa, Homo sapiens
  heavy chain complementarity determining region 3 for antibody 27343
ARDSSAFGP

SEQ ID NO: 54687 - protein, 9 aa, Homo sapiens
  light chain complementarity determining region 3 for antibody 27344
MQALGTPFT

SEQ ID NO: 54688 - protein, 15 aa, Homo sapiens
  heavy chain complementarity determining region 3 for antibody 27344
VRHYRELATGIEGDS

SEQ ID NO: 54689 - protein, 9 aa, Homo sapiens
  light chain complementarity determining region 3 for antibody 27345
MQALETPST

SEQ ID NO: 54690 - protein, 15 aa, Homo sapiens
  heavy chain complementarity determining region 3 for antibody 27345
VRHYRETVAGIEGDS

SEQ ID NO: 54691 - protein, 9 aa, Homo sapiens
  light chain complementarity determining region 3 for antibody 27346
MQALETPLT

SEQ ID NO: 54692 - protein, 15 aa, Homo sapiens
  heavy chain complementarity determining region 3 for antibody 27346
VRHYRETVAGIEGDS

SEQ ID NO: 54693 - protein, 9 aa, Homo sapiens
  light chain complementarity determining region 3 for antibody 27347
MQALETPLP

SEQ ID NO: 54694 - protein, 19 aa, Homo sapiens
  heavy chain complementarity determining region 3 for antibody 27347
ARATSYSSPWVVFYYGVDL

SEQ ID NO: 54695 - protein, 9 aa, Homo sapiens
  light chain complementarity determining region 3 for antibody 27348
MQALENPFT

SEQ ID NO: 54696 - protein, 15 aa, Homo sapiens
  heavy chain complementarity determining region 3 for antibody 27348
VRHYRETVAGIEGDS

SEQ ID NO: 54697 - protein, 9 aa, Homo sapiens
  light chain complementarity determining region 3 for antibody 27349
MQALDTPFT

SEQ ID NO: 54698 - protein, 15 aa, Homo sapiens
  heavy chain complementarity determining region 3 for antibody 27349
VRHYRETVAGIEGDS

SEQ ID NO: 54699 - protein, 9 aa, Homo sapiens
  light chain complementarity determining region 3 for antibody 27350
MQAIETPFT

SEQ ID NO: 54700 - protein, 15 aa, Homo sapiens
  heavy chain complementarity determining region 3 for antibody 27350
VRHYRELATGIEGDS

SEQ ID NO: 54701 - protein, 9 aa, Homo sapiens
  light chain complementarity determining region 3 for antibody 27351
MQAFQSPLT

SEQ ID NO: 54702 - protein, 14 aa, Homo sapiens
  heavy chain complementarity determining region 3 for antibody 27351
ASGYSHDRAGAFNI

SEQ ID NO: 54703 - protein, 8 aa, Homo sapiens
  light chain complementarity determining region 3 for antibody 27352
MKGTQGGP

SEQ ID NO: 54704 - protein, 15 aa, Homo sapiens
  heavy chain complementarity determining region 3 for antibody 27352
ATDWSFQMIEGNFHH

SEQ ID NO: 54705 - protein, 9 aa, Homo sapiens
  light chain complementarity determining region 3 for antibody 27353
MGTLQTPPP

SEQ ID NO: 54706 - protein, 15 aa, Homo sapiens
  heavy chain complementarity determining region 3 for antibody 27353
TRDGKKDGHNDAFDV

SEQ ID NO: 54707 - protein, 9 aa, Homo sapiens
  light chain complementarity determining region 3 for antibody 27354
LQYNNYPYT

SEQ ID NO: 54708 - protein, 9 aa, Homo sapiens
  heavy chain complementarity determining region 3 for antibody 27354
GRGVRSFSP

SEQ ID NO: 54709 - protein, 9 aa, Homo sapiens
  light chain complementarity determining region 3 for antibody 27355
LQYNDWPFI

SEQ ID NO: 54710 - protein, 9 aa, Homo sapiens
  heavy chain complementarity determining region 3 for antibody 27355
AGWFGEFDL

SEQ ID NO: 54711 - protein, 9 aa, Homo sapiens
  light chain complementarity determining region 3 for antibody 27356
LQYGFAQYR

SEQ ID NO: 54712 - protein, 18 aa, Homo sapiens
  heavy chain complementarity determining region 3 for antibody 27356
TGVHGLTMLRGATKPFDF

SEQ ID NO: 54713 - protein, 9 aa, Homo sapiens
  light chain complementarity determining region 3 for antibody 27357
LQYDISPRP

SEQ ID NO: 54714 - protein, 12 aa, Homo sapiens
  heavy chain complementarity determining region 3 for antibody 27357
TTMYGFLHSIDY

SEQ ID NO: 54715 - protein, 9 aa, Homo sapiens
  light chain complementarity determining region 3 for antibody 27358
LQVVSFPRP

SEQ ID NO: 54716 - protein, 8 aa, Homo sapiens
  heavy chain complementarity determining region 3 for antibody 27358
ARNSGWYD

SEQ ID NO: 54717 - protein, 9 aa, Homo sapiens
  light chain complementarity determining region 3 for antibody 27359
LQSRRWPHT

SEQ ID NO: 54718 - protein, 8 aa, Homo sapiens
  heavy chain complementarity determining region 3 for antibody 27359
TAWGSSQH

SEQ ID NO: 54719 - protein, 10 aa, Homo sapiens
  light chain complementarity determining region 3 for antibody 27360
LQRSNWHRIT

SEQ ID NO: 54720 - protein, 15 aa, Homo sapiens
  heavy chain complementarity determining region 3 for antibody 27360
ARDSACSGGTCYSDS

SEQ ID NO: 54721 - protein, 9 aa, Homo sapiens
  light chain complementarity determining region 3 for antibody 27361
LQRDRWPLT

SEQ ID NO: 54722 - protein, 18 aa, Homo sapiens
  heavy chain complementarity determining region 3 for antibody 27361
ATTQFCSGDTGGRCYFGS

SEQ ID NO: 54723 - protein, 9 aa, Homo sapiens
  light chain complementarity determining region 3 for antibody 27362
LQNNDWPFI

SEQ ID NO: 54724 - protein, 9 aa, Homo sapiens
  heavy chain complementarity determining region 3 for antibody 27362
AGWFGEFYL

SEQ ID NO: 54725 - protein, 9 aa, Homo sapiens
  light chain complementarity determining region 3 for antibody 27363
LQNEYWPRS

SEQ ID NO: 54726 - protein, 11 aa, Homo sapiens
  heavy chain complementarity determining region 3 for antibody 27363
VRVGGAGYFDH

SEQ ID NO: 54727 - protein, 9 aa, Homo sapiens
  light chain complementarity determining region 3 for antibody 27364
LQHSDYPRT

SEQ ID NO: 54728 - protein, 17 aa, Homo sapiens
  heavy chain complementarity determining region 3 for antibody 27364
AREPDYYDSTASYPFDF

SEQ ID NO: 54729 - protein, 10 aa, Homo sapiens
  light chain complementarity determining region 3 for antibody 27365
LQHNSYPPRT

SEQ ID NO: 54730 - protein, 12 aa, Homo sapiens
  heavy chain complementarity determining region 3 for antibody 27365
ARVEYGDYCVDY

SEQ ID NO: 54731 - protein, 9 aa, Homo sapiens
  light chain complementarity determining region 3 for antibody 27366
LQHNSYPLP

SEQ ID NO: 54732 - protein, 13 aa, Homo sapiens
  heavy chain complementarity determining region 3 for antibody 27366
VRHAVVRPMVVDD

SEQ ID NO: 54733 - protein, 9 aa, Homo sapiens
  light chain complementarity determining region 3 for antibody 27367
LQHNSNPFT

SEQ ID NO: 54734 - protein, 10 aa, Homo sapiens
  heavy chain complementarity determining region 3 for antibody 27367
GRIGDSSRGY

SEQ ID NO: 54735 - protein, 9 aa, Homo sapiens
  light chain complementarity determining region 3 for antibody 27368
LQHNSFPWT

SEQ ID NO: 54736 - protein, 11 aa, Homo sapiens
  heavy chain complementarity determining region 3 for antibody 27368
VRDVPTAHFDY

SEQ ID NO: 54737 - protein, 7 aa, Homo sapiens
  light chain complementarity determining region 3 for antibody 27369
LQHDNVH

SEQ ID NO: 54738 - protein, 15 aa, Homo sapiens
  heavy chain complementarity determining region 3 for antibody 27369
ARESWDGSDRSAFDI

SEQ ID NO: 54739 - protein, 10 aa, Homo sapiens
  light chain complementarity determining region 3 for antibody 27370
LQFNTWPPLP

SEQ ID NO: 54740 - protein, 14 aa, Homo sapiens
  heavy chain complementarity determining region 3 for antibody 27370
ARSKWEAPGTPPDY

SEQ ID NO: 54741 - protein, 9 aa, Homo sapiens
  light chain complementarity determining region 3 for antibody 27371
LQEYTYPVS

SEQ ID NO: 54742 - protein, 15 aa, Homo sapiens
  heavy chain complementarity determining region 3 for antibody 27371
ARIRRYGSTWEPLDH

SEQ ID NO: 54743 - protein, 9 aa, Homo sapiens
  light chain complementarity determining region 3 for antibody 27372
LQEYTCPVS

SEQ ID NO: 54744 - protein, 15 aa, Homo sapiens
  heavy chain complementarity determining region 3 for antibody 27372
ARIRRYGSTWETLDH

SEQ ID NO: 54745 - protein, 9 aa, Homo sapiens
  light chain complementarity determining region 3 for antibody 27373
LQDYNYPYT

SEQ ID NO: 54746 - protein, 21 aa, Homo sapiens
  heavy chain complementarity determining region 3 for antibody 27373
AKKGAAVFCNDNSCYGDAFDI

SEQ ID NO: 54747 - protein, 9 aa, Homo sapiens
  light chain complementarity determining region 3 for antibody 27374
LQDYNSPLT

SEQ ID NO: 54748 - protein, 14 aa, Homo sapiens
  heavy chain complementarity determining region 3 for antibody 27374
ARVIVAGWTNAFDI

SEQ ID NO: 54749 - protein, 9 aa, Homo sapiens
  light chain complementarity determining region 3 for antibody 27375
LQDVSFPRT

SEQ ID NO: 54750 - protein, 8 aa, Homo sapiens
  heavy chain complementarity determining region 3 for antibody 27375
ARNSGWYD

SEQ ID NO: 54751 - protein, 9 aa, Homo sapiens
  light chain complementarity determining region 3 for antibody 27376
LQDSNYPRT

SEQ ID NO: 54752 - protein, 12 aa, Homo sapiens
  heavy chain complementarity determining region 3 for antibody 27376
ASTTVTTLYFQH

SEQ ID NO: 54753 - protein, 9 aa, Homo sapiens
  light chain complementarity determining region 3 for antibody 27377
LQAVSFPRT

SEQ ID NO: 54754 - protein, 8 aa, Homo sapiens
  heavy chain complementarity determining region 3 for antibody 27377
ARNSGWYD

SEQ ID NO: 54755 - protein, 9 aa, Homo sapiens
  light chain complementarity determining region 3 for antibody 27378
LHYYATPWT

SEQ ID NO: 54756 - protein, 15 aa, Homo sapiens
  heavy chain complementarity determining region 3 for antibody 27378
VRQSKVDNNYNYPDF

SEQ ID NO: 54757 - protein, 9 aa, Homo sapiens
  light chain complementarity determining region 3 for antibody 27379
LHYDISPRT

SEQ ID NO: 54758 - protein, 12 aa, Homo sapiens
  heavy chain complementarity determining region 3 for antibody 27379
TTMYGFLHSIDY

SEQ ID NO: 54759 - protein, 9 aa, Homo sapiens
  light chain complementarity determining region 3 for antibody 27380
LHDYNYPGT

SEQ ID NO: 54760 - protein, 12 aa, Homo sapiens
  heavy chain complementarity determining region 3 for antibody 27380
ARFGGDGGYLDY

SEQ ID NO: 54761 - protein, 9 aa, Homo sapiens
  light chain complementarity determining region 3 for antibody 27381
HQYYTPPPT

SEQ ID NO: 54762 - protein, 13 aa, Homo sapiens
  heavy chain complementarity determining region 3 for antibody 27381
ARGGGYSYGPPDF

SEQ ID NO: 54763 - protein, 9 aa, Homo sapiens
  light chain complementarity determining region 3 for antibody 27382
HQYYSAPLP

SEQ ID NO: 54764 - protein, 21 aa, Homo sapiens
  heavy chain complementarity determining region 3 for antibody 27382
AKDEGLSVFRSFDGLFDAFDI

SEQ ID NO: 54765 - protein, 11 aa, Homo sapiens
  light chain complementarity determining region 3 for antibody 27383
HQYYDWPLRPT

SEQ ID NO: 54766 - protein, 18 aa, Homo sapiens
  heavy chain complementarity determining region 3 for antibody 27383
ARDAESRSHYSYYNGMDV

SEQ ID NO: 54767 - protein, 9 aa, Homo sapiens
  light chain complementarity determining region 3 for antibody 27384
HQYSSTPYT

SEQ ID NO: 54768 - protein, 17 aa, Homo sapiens
  heavy chain complementarity determining region 3 for antibody 27384
TRGPGSSWLRGADGLDI

SEQ ID NO: 54769 - protein, 9 aa, Homo sapiens
  light chain complementarity determining region 3 for antibody 27385
HQYNTYPWT

SEQ ID NO: 54770 - protein, 17 aa, Homo sapiens
  heavy chain complementarity determining region 3 for antibody 27385
ARGQMIEGRDLSGDLDY

SEQ ID NO: 54771 - protein, 8 aa, Homo sapiens
  light chain complementarity determining region 3 for antibody 27386
HQYNNWPT

SEQ ID NO: 54772 - protein, 16 aa, Homo sapiens
  heavy chain complementarity determining region 3 for antibody 27386
ARVMEDSNYRDYPIDY

SEQ ID NO: 54773 - protein, 8 aa, Homo sapiens
  light chain complementarity determining region 3 for antibody 27387
HQYGTSIP

SEQ ID NO: 54774 - protein, 16 aa, Homo sapiens
  heavy chain complementarity determining region 3 for antibody 27387
AHSRYGSNIYPVPFDN

SEQ ID NO: 54775 - protein, 9 aa, Homo sapiens
  light chain complementarity determining region 3 for antibody 27388
HQYGSSPLT

SEQ ID NO: 54776 - protein, 15 aa, Homo sapiens
  heavy chain complementarity determining region 3 for antibody 27388
VHRDPTQLQGLLFDY

SEQ ID NO: 54777 - protein, 9 aa, Homo sapiens
  light chain complementarity determining region 3 for antibody 27389
HQYGSSPAT

SEQ ID NO: 54778 - protein, 20 aa, Homo sapiens
  heavy chain complementarity determining region 3 for antibody 27389
ARRTPNPAPGMRYYYYGMDV

SEQ ID NO: 54779 - protein, 9 aa, Homo sapiens
  light chain complementarity determining region 3 for antibody 27390
HQYGRSPET

SEQ ID NO: 54780 - protein, 19 aa, Homo sapiens
  heavy chain complementarity determining region 3 for antibody 27390
AGEMRHYGSQSFYYYGMDV

SEQ ID NO: 54781 - protein, 9 aa, Homo sapiens
  light chain complementarity determining region 3 for antibody 27391
HQSSSFPQT

SEQ ID NO: 54782 - protein, 14 aa, Homo sapiens
  heavy chain complementarity determining region 3 for antibody 27391
AHLQVGATPRAFDI

SEQ ID NO: 54783 - protein, 9 aa, Homo sapiens
  light chain complementarity determining region 3 for antibody 27392
HQSSASPRP

SEQ ID NO: 54784 - protein, 7 aa, Homo sapiens
  heavy chain complementarity determining region 3 for antibody 27392
GGRDLDY

SEQ ID NO: 54785 - protein, 9 aa, Homo sapiens
  light chain complementarity determining region 3 for antibody 27393
HQSRTFPGT

SEQ ID NO: 54786 - protein, 14 aa, Homo sapiens
  heavy chain complementarity determining region 3 for antibody 27393
IRQSKSDNWNYPDY

SEQ ID NO: 54787 - protein, 9 aa, Homo sapiens
  light chain complementarity determining region 3 for antibody 27394
HQSRTFPAT

SEQ ID NO: 54788 - protein, 14 aa, Homo sapiens
  heavy chain complementarity determining region 3 for antibody 27394
IRQSKSDNWNYPDY

SEQ ID NO: 54789 - protein, 9 aa, Homo sapiens
  light chain complementarity determining region 3 for antibody 27395
HQSGSFPET

SEQ ID NO: 54790 - protein, 8 aa, Homo sapiens
  heavy chain complementarity determining region 3 for antibody 27395
AVYSSLDY

SEQ ID NO: 54791 - protein, 9 aa, Homo sapiens
  light chain complementarity determining region 3 for antibody 27396
HQSGALPWP

SEQ ID NO: 54792 - protein, 14 aa, Homo sapiens
  heavy chain complementarity determining region 3 for antibody 27396
VRDASGNSGWYADS

SEQ ID NO: 54793 - protein, 9 aa, Homo sapiens
  light chain complementarity determining region 3 for antibody 27397
HQRSSWPYT

SEQ ID NO: 54794 - protein, 11 aa, Homo sapiens
  heavy chain complementarity determining region 3 for antibody 27397
VKRWGGSSIDY

SEQ ID NO: 54795 - protein, 9 aa, Homo sapiens
  light chain complementarity determining region 3 for antibody 27398
HQRSDWPAT

SEQ ID NO: 54796 - protein, 9 aa, Homo sapiens
  heavy chain complementarity determining region 3 for antibody 27398
ASGDYAFDL

SEQ ID NO: 54797 - protein, 9 aa, Homo sapiens
  light chain complementarity determining region 3 for antibody 27399
HQRSAWPET

SEQ ID NO: 54798 - protein, 9 aa, Homo sapiens
  heavy chain complementarity determining region 3 for antibody 27399
ASGDYAFDL

SEQ ID NO: 54799 - protein, 9 aa, Homo sapiens
  light chain complementarity determining region 3 for antibody 27400
HQRSASPRT

SEQ ID NO: 54800 - protein, 7 aa, Homo sapiens
  heavy chain complementarity determining region 3 for antibody 27400
GGRDLDY

SEQ ID NO: 54801 - protein, 10 aa, Homo sapiens
  light chain complementarity determining region 3 for antibody 27401
HQRAGWPQVT

SEQ ID NO: 54802 - protein, 14 aa, Homo sapiens
  heavy chain complementarity determining region 3 for antibody 27401
ARDTKRGSTWFFDL

SEQ ID NO: 54803 - protein, 10 aa, Homo sapiens
  light chain complementarity determining region 3 for antibody 27402
HQRAGWPPVT

SEQ ID NO: 54804 - protein, 14 aa, Homo sapiens
  heavy chain complementarity determining region 3 for antibody 27402
ARDTKWGSTWFFDL

SEQ ID NO: 54805 - protein, 9 aa, Homo sapiens
  light chain complementarity determining region 3 for antibody 27403
HQNDASPYT

SEQ ID NO: 54806 - protein, 17 aa, Homo sapiens
  heavy chain complementarity determining region 3 for antibody 27403
ASLLVVPGAIYYYGMDV

SEQ ID NO: 54807 - protein, 9 aa, Homo sapiens
  light chain complementarity determining region 3 for antibody 27404
HQNATSPWT

SEQ ID NO: 54808 - protein, 14 aa, Homo sapiens
  heavy chain complementarity determining region 3 for antibody 27404
ARFGWLDYYYGMDV

SEQ ID NO: 54809 - protein, 9 aa, Homo sapiens
  light chain complementarity determining region 3 for antibody 27405
HQALSFPIT

SEQ ID NO: 54810 - protein, 11 aa, Homo sapiens
  heavy chain complementarity determining region 3 for antibody 27405
ATYYSRGWFDP

SEQ ID NO: 54811 - protein, 9 aa, Homo sapiens
  light chain complementarity determining region 3 for antibody 27406
HQALSFPIT

SEQ ID NO: 54812 - protein, 11 aa, Homo sapiens
  heavy chain complementarity determining region 3 for antibody 27406
ATYYAGGWFDP

SEQ ID NO: 54813 - protein, 11 aa, Homo sapiens
  light chain complementarity determining region 3 for antibody 27407
HLYGSSPPGNP

SEQ ID NO: 54814 - protein, 11 aa, Homo sapiens
  heavy chain complementarity determining region 3 for antibody 27407
ARHGTDYYFDY

SEQ ID NO: 54815 - protein, 11 aa, Homo sapiens
  light chain complementarity determining region 3 for antibody 27408
HLYGSSPPGDT

SEQ ID NO: 54816 - protein, 11 aa, Homo sapiens
  heavy chain complementarity determining region 3 for antibody 27408
ARHGTDYYFDY

SEQ ID NO: 54817 - protein, 9 aa, Homo sapiens
  light chain complementarity determining region 3 for antibody 27409
HKYNSAPRT

SEQ ID NO: 54818 - protein, 10 aa, Homo sapiens
  heavy chain complementarity determining region 3 for antibody 27409
ARDRLGAFDI

SEQ ID NO: 54819 - protein, 9 aa, Homo sapiens
  light chain complementarity determining region 3 for antibody 27410
HHYYSSPRL

SEQ ID NO: 54820 - protein, 13 aa, Homo sapiens
  heavy chain complementarity determining region 3 for antibody 27410
ARGQSGDPRTYDY

SEQ ID NO: 54821 - protein, 9 aa, Homo sapiens
  light chain complementarity determining region 3 for antibody 27411
HHYGSLPRP

SEQ ID NO: 54822 - protein, 18 aa, Homo sapiens
  heavy chain complementarity determining region 3 for antibody 27411
AREVPDKRGSNSNPYADV

SEQ ID NO: 54823 - protein, 10 aa, Homo sapiens
  light chain complementarity determining region 3 for antibody 27412
HHYGKSPPGM

SEQ ID NO: 54824 - protein, 15 aa, Homo sapiens
  heavy chain complementarity determining region 3 for antibody 27412
ARHRAPDTRKSALGY

SEQ ID NO: 54825 - protein, 9 aa, Homo sapiens
  light chain complementarity determining region 3 for antibody 27413
YQHAAAPLT

SEQ ID NO: 54826 - protein, 10 aa, Homo sapiens
  heavy chain complementarity determining region 3 for antibody 27413
AHGAGWVSDY

SEQ ID NO: 54827 - protein, 9 aa, Homo sapiens
  light chain complementarity determining region 3 for antibody 27414
VQYNRYPRT

SEQ ID NO: 54828 - protein, 6 aa, Homo sapiens
  heavy chain complementarity determining region 3 for antibody 27414
TRSLDY

SEQ ID NO: 54829 - protein, 9 aa, Homo sapiens
  light chain complementarity determining region 3 for antibody 27415
VQYNRYPRT

SEQ ID NO: 54830 - protein, 6 aa, Homo sapiens
  heavy chain complementarity determining region 3 for antibody 27415
ARALDY

SEQ ID NO: 54831 - protein, 9 aa, Homo sapiens
  light chain complementarity determining region 3 for antibody 27416
VQYNRYPRK

SEQ ID NO: 54832 - protein, 6 aa, Homo sapiens
  heavy chain complementarity determining region 3 for antibody 27416
TRALDY

SEQ ID NO: 54833 - protein, 9 aa, Homo sapiens
  light chain complementarity determining region 3 for antibody 27417
VQYNRSPRT

SEQ ID NO: 54834 - protein, 6 aa, Homo sapiens
  heavy chain complementarity determining region 3 for antibody 27417
TRALDY

SEQ ID NO: 54835 - protein, 9 aa, Homo sapiens
  light chain complementarity determining region 3 for antibody 27418
VQYNGYPRT

SEQ ID NO: 54836 - protein, 6 aa, Homo sapiens
  heavy chain complementarity determining region 3 for antibody 27418
TRALDY

SEQ ID NO: 54837 - protein, 9 aa, Homo sapiens
  light chain complementarity determining region 3 for antibody 27419
VQYHATPVT

SEQ ID NO: 54838 - protein, 9 aa, Homo sapiens
  heavy chain complementarity determining region 3 for antibody 27419
ATGVDADYE

SEQ ID NO: 54839 - protein, 9 aa, Homo sapiens
  light chain complementarity determining region 3 for antibody 27420
VQYHATPVT

SEQ ID NO: 54840 - protein, 9 aa, Homo sapiens
  heavy chain complementarity determining region 3 for antibody 27420
ATGVDADDV

SEQ ID NO: 54841 - protein, 9 aa, Homo sapiens
  light chain complementarity determining region 3 for antibody 27421
VQYHATPVT

SEQ ID NO: 54842 - protein, 9 aa, Homo sapiens
  heavy chain complementarity determining region 3 for antibody 27421
AAGVDADYG

SEQ ID NO: 54843 - protein, 9 aa, Homo sapiens
  light chain complementarity determining region 3 for antibody 27422
VQYHATPGT

SEQ ID NO: 54844 - protein, 9 aa, Homo sapiens
  heavy chain complementarity determining region 3 for antibody 27422
ATGVDADYG

SEQ ID NO: 54845 - protein, 10 aa, Homo sapiens
  light chain complementarity determining region 3 for antibody 27423
VLEAHGPPYT

SEQ ID NO: 54846 - protein, 12 aa, Homo sapiens
  heavy chain complementarity determining region 3 for antibody 27423
TTLGMTSVHSDF

SEQ ID NO: 54847 - protein, 9 aa, Homo sapiens
  light chain complementarity determining region 3 for antibody 27424
TQLTPWPWT

SEQ ID NO: 54848 - protein, 15 aa, Homo sapiens
  heavy chain complementarity determining region 3 for antibody 27424
ARDSPPRASGDDHIP

SEQ ID NO: 54849 - protein, 10 aa, Homo sapiens
  light chain complementarity determining region 3 for antibody 27425
SQSTYWPPYT

SEQ ID NO: 54850 - protein, 16 aa, Homo sapiens
  heavy chain complementarity determining region 3 for antibody 27425
VRLSRTGGALLDAFDV

SEQ ID NO: 54851 - protein, 9 aa, Homo sapiens
  light chain complementarity determining region 3 for antibody 27426
SQRSIWPWP

SEQ ID NO: 54852 - protein, 9 aa, Homo sapiens
  heavy chain complementarity determining region 3 for antibody 27426
ARVLVAGGG

SEQ ID NO: 54853 - protein, 9 aa, Homo sapiens
  light chain complementarity determining region 3 for antibody 27427
SQRSICPWT

SEQ ID NO: 54854 - protein, 9 aa, Homo sapiens
  heavy chain complementarity determining region 3 for antibody 27427
ARVLVAGGG

SEQ ID NO: 54855 - protein, 9 aa, Homo sapiens
  light chain complementarity determining region 3 for antibody 27428
RQYSDWPPF

SEQ ID NO: 54856 - protein, 20 aa, Homo sapiens
  heavy chain complementarity determining region 3 for antibody 27428
AREGGQGPTANGWFGGGADY

SEQ ID NO: 54857 - protein, 9 aa, Homo sapiens
  light chain complementarity determining region 3 for antibody 27429
RQYNSYSGT

SEQ ID NO: 54858 - protein, 16 aa, Homo sapiens
  heavy chain complementarity determining region 3 for antibody 27429
ARMPCDSRGYYCYPDY

SEQ ID NO: 54859 - protein, 9 aa, Homo sapiens
  light chain complementarity determining region 3 for antibody 27430
RQYGSSPRT

SEQ ID NO: 54860 - protein, 25 aa, Homo sapiens
  heavy chain complementarity determining region 3 for antibody 27430
ARLRIDRLRLPGAMRGPLYDCGLNV

SEQ ID NO: 54861 - protein, 9 aa, Homo sapiens
  light chain complementarity determining region 3 for antibody 27431
RQYGSSPPT

SEQ ID NO: 54862 - protein, 17 aa, Homo sapiens
  heavy chain complementarity determining region 3 for antibody 27431
ARPYFGPVRAGTNGYDM

SEQ ID NO: 54863 - protein, 9 aa, Homo sapiens
  light chain complementarity determining region 3 for antibody 27432
RQYGSLPLT

SEQ ID NO: 54864 - protein, 15 aa, Homo sapiens
  heavy chain complementarity determining region 3 for antibody 27432
AHRPNYYDKAGAFDI

SEQ ID NO: 54865 - protein, 9 aa, Homo sapiens
  light chain complementarity determining region 3 for antibody 27433
RQYGNIPRT

SEQ ID NO: 54866 - protein, 14 aa, Homo sapiens
  heavy chain complementarity determining region 3 for antibody 27433
AGGTFDSSGYYYEY

SEQ ID NO: 54867 - protein, 9 aa, Homo sapiens
  light chain complementarity determining region 3 for antibody 27434
RQVLQSPLS

SEQ ID NO: 54868 - protein, 12 aa, Homo sapiens
  heavy chain complementarity determining region 3 for antibody 27434
TRDPDSHYGMEV

SEQ ID NO: 54869 - protein, 9 aa, Homo sapiens
  light chain complementarity determining region 3 for antibody 27435
RQSRRGPHT

SEQ ID NO: 54870 - protein, 8 aa, Homo sapiens
  heavy chain complementarity determining region 3 for antibody 27435
TAWGSSQH

SEQ ID NO: 54871 - protein, 9 aa, Homo sapiens
  light chain complementarity determining region 3 for antibody 27436
RQSRQTVRT

SEQ ID NO: 54872 - protein, 18 aa, Homo sapiens
  heavy chain complementarity determining region 3 for antibody 27436
ARLDYYYGSGMPGRGFDH

SEQ ID NO: 54873 - protein, 11 aa, Homo sapiens
  light chain complementarity determining region 3 for antibody 27437
RQRTNWPPIYT

SEQ ID NO: 54874 - protein, 14 aa, Homo sapiens
  heavy chain complementarity determining region 3 for antibody 27437
ARGGLGIWGNSSDI

SEQ ID NO: 54875 - protein, 9 aa, Homo sapiens
  light chain complementarity determining region 3 for antibody 27438
RQRSNWQLT

SEQ ID NO: 54876 - protein, 10 aa, Homo sapiens
  heavy chain complementarity determining region 3 for antibody 27438
ASLNRRTSRR

SEQ ID NO: 54877 - protein, 9 aa, Homo sapiens
  light chain complementarity determining region 3 for antibody 27439
RQRSNWPWT

SEQ ID NO: 54878 - protein, 14 aa, Homo sapiens
  heavy chain complementarity determining region 3 for antibody 27439
AVTHYYDSSTIGDY

SEQ ID NO: 54879 - protein, 11 aa, Homo sapiens
  light chain complementarity determining region 3 for antibody 27440
RQRSDWPLLST

SEQ ID NO: 54880 - protein, 10 aa, Homo sapiens
  heavy chain complementarity determining region 3 for antibody 27440
AWSSSDWAED

SEQ ID NO: 54881 - protein, 9 aa, Homo sapiens
  light chain complementarity determining region 3 for antibody 27441
RQGTYWPHI

SEQ ID NO: 54882 - protein, 11 aa, Homo sapiens
  heavy chain complementarity determining region 3 for antibody 27441
ARDPFFGALDC

SEQ ID NO: 54883 - protein, 9 aa, Homo sapiens
  light chain complementarity determining region 3 for antibody 27442
RQGTHWPYT

SEQ ID NO: 54884 - protein, 10 aa, Homo sapiens
  heavy chain complementarity determining region 3 for antibody 27442
ARDGDFVLDY

SEQ ID NO: 54885 - protein, 10 aa, Homo sapiens
  light chain complementarity determining region 3 for antibody 27443
RQGTHWPPRT

SEQ ID NO: 54886 - protein, 12 aa, Homo sapiens
  heavy chain complementarity determining region 3 for antibody 27443
VRDPQIGDVSDY

SEQ ID NO: 54887 - protein, 9 aa, Homo sapiens
  light chain complementarity determining region 3 for antibody 27444
RQDGSSPYA

SEQ ID NO: 54888 - protein, 13 aa, Homo sapiens
  heavy chain complementarity determining region 3 for antibody 27444
ARALQYSGRIFDY

SEQ ID NO: 54889 - protein, 9 aa, Homo sapiens
  light chain complementarity determining region 3 for antibody 27445
RQALQPPWT

SEQ ID NO: 54890 - protein, 17 aa, Homo sapiens
  heavy chain complementarity determining region 3 for antibody 27445
ARPEYYFAGSGYHAFDI

SEQ ID NO: 54891 - protein, 9 aa, Homo sapiens
  light chain complementarity determining region 3 for antibody 27446
RQALETPFT

SEQ ID NO: 54892 - protein, 15 aa, Homo sapiens
  heavy chain complementarity determining region 3 for antibody 27446
VRHYRELATGIEGDS

SEQ ID NO: 54893 - protein, 10 aa, Homo sapiens
  light chain complementarity determining region 3 for antibody 27447
RHYNSYSHST

SEQ ID NO: 54894 - protein, 18 aa, Homo sapiens
  heavy chain complementarity determining region 3 for antibody 27447
ARGAGTGYSSNWKIPAGW

SEQ ID NO: 54895 - protein, 9 aa, Homo sapiens
  light chain complementarity determining region 3 for antibody 27448
RHNYNPPFT

SEQ ID NO: 54896 - protein, 13 aa, Homo sapiens
  heavy chain complementarity determining region 3 for antibody 27448
VRGRNYDRDGFDP

SEQ ID NO: 54897 - protein, 8 aa, Homo sapiens
  light chain complementarity determining region 3 for antibody 27449
QYYSNRPT

SEQ ID NO: 54898 - protein, 15 aa, Homo sapiens
  heavy chain complementarity determining region 3 for antibody 27449
AKEVLTRSSDRYWLD

SEQ ID NO: 54899 - protein, 11 aa, Homo sapiens
  light chain complementarity determining region 3 for antibody 27450
QYYDNWSPTWT

SEQ ID NO: 54900 - protein, 16 aa, Homo sapiens
  heavy chain complementarity determining region 3 for antibody 27450
ARVSAHDPGRSLGMDV

SEQ ID NO: 54901 - protein, 11 aa, Homo sapiens
  light chain complementarity determining region 3 for antibody 27451
QYYDNWPPTGT

SEQ ID NO: 54902 - protein, 16 aa, Homo sapiens
  heavy chain complementarity determining region 3 for antibody 27451
ARVSAHDPGRSLGMDV

SEQ ID NO: 54903 - protein, 11 aa, Homo sapiens
  light chain complementarity determining region 3 for antibody 27452
QYYDNWPPPWT

SEQ ID NO: 54904 - protein, 16 aa, Homo sapiens
  heavy chain complementarity determining region 3 for antibody 27452
ARVSAHDPGRSLGMDV

SEQ ID NO: 54905 - protein, 10 aa, Homo sapiens
  light chain complementarity determining region 3 for antibody 27453
QVYDSSSLWP

SEQ ID NO: 54906 - protein, 19 aa, Homo sapiens
  heavy chain complementarity determining region 3 for antibody 27453
ARESFVRKVGGQRPYYFDI

SEQ ID NO: 54907 - protein, 10 aa, Homo sapiens
  light chain complementarity determining region 3 for antibody 27454
QVYDSSSLWA

SEQ ID NO: 54908 - protein, 19 aa, Homo sapiens
  heavy chain complementarity determining region 3 for antibody 27454
ARESFVRKVGGQRPYYFDI

SEQ ID NO: 54909 - protein, 10 aa, Homo sapiens
  light chain complementarity determining region 3 for antibody 27455
QVNDSSSLWT

SEQ ID NO: 54910 - protein, 19 aa, Homo sapiens
  heavy chain complementarity determining region 3 for antibody 27455
ARESFVRKVGGQRPYYFDI

SEQ ID NO: 54911 - protein, 8 aa, Homo sapiens
  light chain complementarity determining region 3 for antibody 27456
QSYNIVFT

SEQ ID NO: 54912 - protein, 15 aa, Homo sapiens
  heavy chain complementarity determining region 3 for antibody 27456
ASGLGGILRGYYFDS

SEQ ID NO: 54913 - protein, 9 aa, Homo sapiens
  light chain complementarity determining region 3 for antibody 27457
QRYGNLPRT

SEQ ID NO: 54914 - protein, 13 aa, Homo sapiens
  heavy chain complementarity determining region 3 for antibody 27457
AGGNFHSGGYGEY

SEQ ID NO: 54915 - protein, 9 aa, Homo sapiens
  light chain complementarity determining region 3 for antibody 27458
QRYGLSPET

SEQ ID NO: 54916 - protein, 15 aa, Homo sapiens
  heavy chain complementarity determining region 3 for antibody 27458
AFRGIQVVNGVRFDY

SEQ ID NO: 54917 - protein, 10 aa, Homo sapiens
  light chain complementarity determining region 3 for antibody 27459
QRYGISQVYT

SEQ ID NO: 54918 - protein, 22 aa, Homo sapiens
  heavy chain complementarity determining region 3 for antibody 27459
ARVSRFSLVRGMTTYYYYGMDV

SEQ ID NO: 54919 - protein, 11 aa, Homo sapiens
  light chain complementarity determining region 3 for antibody 27460
QRYDTSPPRNS

SEQ ID NO: 54920 - protein, 14 aa, Homo sapiens
  heavy chain complementarity determining region 3 for antibody 27460
ARHKQESGTRGFDF

SEQ ID NO: 54921 - protein, 10 aa, Homo sapiens
  light chain complementarity determining region 3 for antibody 27461
QRYDTLSGLT

SEQ ID NO: 54922 - protein, 11 aa, Homo sapiens
  heavy chain complementarity determining region 3 for antibody 27461
AADSRNCWFYY

SEQ ID NO: 54923 - protein, 11 aa, Homo sapiens
  light chain complementarity determining region 3 for antibody 27462
QRYDLSPPRSS

SEQ ID NO: 54924 - protein, 14 aa, Homo sapiens
  heavy chain complementarity determining region 3 for antibody 27462
ARHKQESGTRGFDF

SEQ ID NO: 54925 - protein, 11 aa, Homo sapiens
  light chain complementarity determining region 3 for antibody 27463
QRYDLSPPRNS

SEQ ID NO: 54926 - protein, 14 aa, Homo sapiens
  heavy chain complementarity determining region 3 for antibody 27463
ARHKQESGTRGFDF

SEQ ID NO: 54927 - protein, 10 aa, Homo sapiens
  light chain complementarity determining region 3 for antibody 27464
QRYDISQGYT

SEQ ID NO: 54928 - protein, 22 aa, Homo sapiens
  heavy chain complementarity determining region 3 for antibody 27464
ARVSRFSLVRGMTTYYYYGMDV

SEQ ID NO: 54929 - protein, 11 aa, Homo sapiens
  light chain complementarity determining region 3 for antibody 27465
QRYDFSPPRYS

SEQ ID NO: 54930 - protein, 14 aa, Homo sapiens
  heavy chain complementarity determining region 3 for antibody 27465
ARHKQESGTRGFDF

SEQ ID NO: 54931 - protein, 9 aa, Homo sapiens
  light chain complementarity determining region 3 for antibody 27466
QQYYYTPFT

SEQ ID NO: 54932 - protein, 18 aa, Homo sapiens
  heavy chain complementarity determining region 3 for antibody 27466
ARGTEYRRGWFRENWFDP

SEQ ID NO: 54933 - protein, 9 aa, Homo sapiens
  light chain complementarity determining region 3 for antibody 27467
QQYYTYPYT

SEQ ID NO: 54934 - protein, 15 aa, Homo sapiens
  heavy chain complementarity determining region 3 for antibody 27467
ARGQGAGTYNPYFAF

SEQ ID NO: 54935 - protein, 9 aa, Homo sapiens
  light chain complementarity determining region 3 for antibody 27468
QQYYTTPRT

SEQ ID NO: 54936 - protein, 15 aa, Homo sapiens
  heavy chain complementarity determining region 3 for antibody 27468
IREPPHYYGSGRFDD

SEQ ID NO: 54937 - protein, 9 aa, Homo sapiens
  light chain complementarity determining region 3 for antibody 27469
QQYYTTPRT

SEQ ID NO: 54938 - protein, 8 aa, Homo sapiens
  heavy chain complementarity determining region 3 for antibody 27469
ARDGACDS

SEQ ID NO: 54939 - protein, 9 aa, Homo sapiens
  light chain complementarity determining region 3 for antibody 27470
QQYYTTPRH

SEQ ID NO: 54940 - protein, 8 aa, Homo sapiens
  heavy chain complementarity determining region 3 for antibody 27470
ARDGAFDS

SEQ ID NO: 54941 - protein, 9 aa, Homo sapiens
  light chain complementarity determining region 3 for antibody 27471
QQYYTTPPT

SEQ ID NO: 54942 - protein, 13 aa, Homo sapiens
  heavy chain complementarity determining region 3 for antibody 27471
AKDPSDSYGSWVH

SEQ ID NO: 54943 - protein, 9 aa, Homo sapiens
  light chain complementarity determining region 3 for antibody 27472
QQYYTSVRT

SEQ ID NO: 54944 - protein, 12 aa, Homo sapiens
  heavy chain complementarity determining region 3 for antibody 27472
VKDRGLGGSRDS

SEQ ID NO: 54945 - protein, 9 aa, Homo sapiens
  light chain complementarity determining region 3 for antibody 27473
QQYYTSVRR

SEQ ID NO: 54946 - protein, 12 aa, Homo sapiens
  heavy chain complementarity determining region 3 for antibody 27473
VKDCGLGGSRDF

SEQ ID NO: 54947 - protein, 9 aa, Homo sapiens
  light chain complementarity determining region 3 for antibody 27474
QQYYTSVRQ

SEQ ID NO: 54948 - protein, 12 aa, Homo sapiens
  heavy chain complementarity determining region 3 for antibody 27474
VKDCGLGGSRDS

SEQ ID NO: 54949 - protein, 9 aa, Homo sapiens
  light chain complementarity determining region 3 for antibody 27475
QQYYTSVRP

SEQ ID NO: 54950 - protein, 12 aa, Homo sapiens
  heavy chain complementarity determining region 3 for antibody 27475
VKDCGLGGPRDY

SEQ ID NO: 54951 - protein, 9 aa, Homo sapiens
  light chain complementarity determining region 3 for antibody 27476
QQYYTSVRA

SEQ ID NO: 54952 - protein, 12 aa, Homo sapiens
  heavy chain complementarity determining region 3 for antibody 27476
VKDCGLGGSRDS

SEQ ID NO: 54953 - protein, 9 aa, Homo sapiens
  light chain complementarity determining region 3 for antibody 27477
QQYYTSPWT

SEQ ID NO: 54954 - protein, 13 aa, Homo sapiens
  heavy chain complementarity determining region 3 for antibody 27477
ARHAHGDYELVEY

SEQ ID NO: 54955 - protein, 9 aa, Homo sapiens
  light chain complementarity determining region 3 for antibody 27478
QQYYTSLRT

SEQ ID NO: 54956 - protein, 12 aa, Homo sapiens
  heavy chain complementarity determining region 3 for antibody 27478
IKDCGLGGPRDY

SEQ ID NO: 54957 - protein, 9 aa, Homo sapiens
  light chain complementarity determining region 3 for antibody 27479
QQYYTSLRR

SEQ ID NO: 54958 - protein, 12 aa, Homo sapiens
  heavy chain complementarity determining region 3 for antibody 27479
VKDCGLGGSRDS

SEQ ID NO: 54959 - protein, 9 aa, Homo sapiens
  light chain complementarity determining region 3 for antibody 27480
QQYYTSFRT

SEQ ID NO: 54960 - protein, 12 aa, Homo sapiens
  heavy chain complementarity determining region 3 for antibody 27480
VKDCGLGGPRDY

SEQ ID NO: 54961 - protein, 9 aa, Homo sapiens
  light chain complementarity determining region 3 for antibody 27481
QQYYTSFRP

SEQ ID NO: 54962 - protein, 12 aa, Homo sapiens
  heavy chain complementarity determining region 3 for antibody 27481
VKDCGLGGSRDS

SEQ ID NO: 54963 - protein, 9 aa, Homo sapiens
  light chain complementarity determining region 3 for antibody 27482
QQYYTDTVT

SEQ ID NO: 54964 - protein, 19 aa, Homo sapiens
  heavy chain complementarity determining region 3 for antibody 27482
ARLMYYYIGSIYTPEAFDI

SEQ ID NO: 54965 - protein, 9 aa, Homo sapiens
  light chain complementarity determining region 3 for antibody 27483
QQYYSTPWT

SEQ ID NO: 54966 - protein, 15 aa, Homo sapiens
  heavy chain complementarity determining region 3 for antibody 27483
IRQSKVDGNYNYPDF

SEQ ID NO: 54967 - protein, 9 aa, Homo sapiens
  light chain complementarity determining region 3 for antibody 27484
QQYYSTPVI

SEQ ID NO: 54968 - protein, 14 aa, Homo sapiens
  heavy chain complementarity determining region 3 for antibody 27484
ARHEHDGSGSVIDY

SEQ ID NO: 54969 - protein, 9 aa, Homo sapiens
  light chain complementarity determining region 3 for antibody 27485
QQYYSTPRT

SEQ ID NO: 54970 - protein, 18 aa, Homo sapiens
  heavy chain complementarity determining region 3 for antibody 27485
ARGGRNRCGYSSSWPTDY

SEQ ID NO: 54971 - protein, 9 aa, Homo sapiens
  light chain complementarity determining region 3 for antibody 27486
QQYYSTPPT

SEQ ID NO: 54972 - protein, 20 aa, Homo sapiens
  heavy chain complementarity determining region 3 for antibody 27486
ARDQAYFYALGSSGVDWLDP

SEQ ID NO: 54973 - protein, 9 aa, Homo sapiens
  light chain complementarity determining region 3 for antibody 27487
QQYYSTPLT

SEQ ID NO: 54974 - protein, 16 aa, Homo sapiens
  heavy chain complementarity determining region 3 for antibody 27487
ARGDYSGSSTANHFDY

SEQ ID NO: 54975 - protein, 9 aa, Homo sapiens
  light chain complementarity determining region 3 for antibody 27488
QQYYSPPYT

SEQ ID NO: 54976 - protein, 20 aa, Homo sapiens
  heavy chain complementarity determining region 3 for antibody 27488
ARGNYSSSWHTTDYYYGMHV

SEQ ID NO: 54977 - protein, 9 aa, Homo sapiens
  light chain complementarity determining region 3 for antibody 27489
QQYYSPPWT

SEQ ID NO: 54978 - protein, 10 aa, Homo sapiens
  heavy chain complementarity determining region 3 for antibody 27489
STPSRVGAKF

SEQ ID NO: 54979 - protein, 9 aa, Homo sapiens
  light chain complementarity determining region 3 for antibody 27490
QQYYSPPGT

SEQ ID NO: 54980 - protein, 10 aa, Homo sapiens
  heavy chain complementarity determining region 3 for antibody 27490
STPSRVGAKF

SEQ ID NO: 54981 - protein, 8 aa, Homo sapiens
  light chain complementarity determining region 3 for antibody 27491
QQYYSLFT

SEQ ID NO: 54982 - protein, 17 aa, Homo sapiens
  heavy chain complementarity determining region 3 for antibody 27491
ARFKSSSWYRAPYYFDY

SEQ ID NO: 54983 - protein, 9 aa, Homo sapiens
  light chain complementarity determining region 3 for antibody 27492
QQYYRSSHT

SEQ ID NO: 54984 - protein, 19 aa, Homo sapiens
  heavy chain complementarity determining region 3 for antibody 27492
ARDPGIGGMAAGASLAFDI

SEQ ID NO: 54985 - protein, 9 aa, Homo sapiens
  light chain complementarity determining region 3 for antibody 27493
QQYYRIPPP

SEQ ID NO: 54986 - protein, 17 aa, Homo sapiens
  heavy chain complementarity determining region 3 for antibody 27493
ANAQRGSAPSTTFYFES

SEQ ID NO: 54987 - protein, 9 aa, Homo sapiens
  light chain complementarity determining region 3 for antibody 27494
QQYYPSVRT

SEQ ID NO: 54988 - protein, 12 aa, Homo sapiens
  heavy chain complementarity determining region 3 for antibody 27494
VKDCGLGGSRDF

SEQ ID NO: 54989 - protein, 9 aa, Homo sapiens
  light chain complementarity determining region 3 for antibody 27495
QQYYPSLRT

SEQ ID NO: 54990 - protein, 12 aa, Homo sapiens
  heavy chain complementarity determining region 3 for antibody 27495
VKDCGLGGPRDY

SEQ ID NO: 54991 - protein, 10 aa, Homo sapiens
  light chain complementarity determining region 3 for antibody 27496
QQYYNYPPST

SEQ ID NO: 54992 - protein, 16 aa, Homo sapiens
  heavy chain complementarity determining region 3 for antibody 27496
ARDTAYDYVWGSPIDY

SEQ ID NO: 54993 - protein, 9 aa, Homo sapiens
  light chain complementarity determining region 3 for antibody 27497
QQYYNWPLT

SEQ ID NO: 54994 - protein, 19 aa, Homo sapiens
  heavy chain complementarity determining region 3 for antibody 27497
VKDQDGSGSYYKTPPTFDY

SEQ ID NO: 54995 - protein, 9 aa, Homo sapiens
  light chain complementarity determining region 3 for antibody 27498
QQYYNTPRT

SEQ ID NO: 54996 - protein, 18 aa, Homo sapiens
  heavy chain complementarity determining region 3 for antibody 27498
AREPGTPDSDGYDWHFDL

SEQ ID NO: 54997 - protein, 9 aa, Homo sapiens
  light chain complementarity determining region 3 for antibody 27499
QQYYITLWT

SEQ ID NO: 54998 - protein, 8 aa, Homo sapiens
  heavy chain complementarity determining region 3 for antibody 27499
ARGGGFDP

SEQ ID NO: 54999 - protein, 9 aa, Homo sapiens
  light chain complementarity determining region 3 for antibody 27500
QQYYISVRT

SEQ ID NO: 55000 - protein, 12 aa, Homo sapiens
  heavy chain complementarity determining region 3 for antibody 27500
VKDCGLGGSRDF

SEQ ID NO: 55001 - protein, 10 aa, Homo sapiens
  light chain complementarity determining region 3 for antibody 27501
QQYYGTPPFP

SEQ ID NO: 55002 - protein, 14 aa, Homo sapiens
  heavy chain complementarity determining region 3 for antibody 27501
AKDLLKLWGSCSGD

SEQ ID NO: 55003 - protein, 10 aa, Homo sapiens
  light chain complementarity determining region 3 for antibody 27502
QQYYDWPPKT

SEQ ID NO: 55004 - protein, 13 aa, Homo sapiens
  heavy chain complementarity determining region 3 for antibody 27502
ARDTLGRYPPVEY

SEQ ID NO: 55005 - protein, 9 aa, Homo sapiens
  light chain complementarity determining region 3 for antibody 27503
QQYYDTPRP

SEQ ID NO: 55006 - protein, 19 aa, Homo sapiens
  heavy chain complementarity determining region 3 for antibody 27503
ARDGRPDCKDDICYSWFDL

SEQ ID NO: 55007 - protein, 9 aa, Homo sapiens
  light chain complementarity determining region 3 for antibody 27504
QQYVTYPIT

SEQ ID NO: 55008 - protein, 13 aa, Homo sapiens
  heavy chain complementarity determining region 3 for antibody 27504
GRGGYPSSWYWVY

SEQ ID NO: 55009 - protein, 9 aa, Homo sapiens
  light chain complementarity determining region 3 for antibody 27505
QQYVKSPWP

SEQ ID NO: 55010 - protein, 11 aa, Homo sapiens
  heavy chain complementarity determining region 3 for antibody 27505
AREDWPDGFDI

SEQ ID NO: 55011 - protein, 9 aa, Homo sapiens
  light chain complementarity determining region 3 for antibody 27506
QQYVKSPGT

SEQ ID NO: 55012 - protein, 11 aa, Homo sapiens
  heavy chain complementarity determining region 3 for antibody 27506
AREDWPDGFDI

SEQ ID NO: 55013 - protein, 9 aa, Homo sapiens
  light chain complementarity determining region 3 for antibody 27507
QQYTTWPRT

SEQ ID NO: 55014 - protein, 22 aa, Homo sapiens
  heavy chain complementarity determining region 3 for antibody 27507
AREVRASGYDDFYNYYYYGLDV

SEQ ID NO: 55015 - protein, 9 aa, Homo sapiens
  light chain complementarity determining region 3 for antibody 27508
QQYTTPLYT

SEQ ID NO: 55016 - protein, 12 aa, Homo sapiens
  heavy chain complementarity determining region 3 for antibody 27508
AREPPETCYFDY

SEQ ID NO: 55017 - protein, 8 aa, Homo sapiens
  light chain complementarity determining region 3 for antibody 27509
QQYTDLLT

SEQ ID NO: 55018 - protein, 12 aa, Homo sapiens
  heavy chain complementarity determining region 3 for antibody 27509
ARYVSHWGKFDH

SEQ ID NO: 55019 - protein, 8 aa, Homo sapiens
  light chain complementarity determining region 3 for antibody 27510
QQYTDLFP

SEQ ID NO: 55020 - protein, 12 aa, Homo sapiens
  heavy chain complementarity determining region 3 for antibody 27510
ARYVSHWGKFDH

SEQ ID NO: 55021 - protein, 9 aa, Homo sapiens
  light chain complementarity determining region 3 for antibody 27511
QQYSTYPYT

SEQ ID NO: 55022 - protein, 13 aa, Homo sapiens
  heavy chain complementarity determining region 3 for antibody 27511
AKRDVLPREAFDI

SEQ ID NO: 55023 - protein, 10 aa, Homo sapiens
  light chain complementarity determining region 3 for antibody 27512
QQYSSYGGGT

SEQ ID NO: 55024 - protein, 15 aa, Homo sapiens
  heavy chain complementarity determining region 3 for antibody 27512
ARAGSTLSPLDAFDI

SEQ ID NO: 55025 - protein, 9 aa, Homo sapiens
  light chain complementarity determining region 3 for antibody 27513
QQYSSSPWT

SEQ ID NO: 55026 - protein, 13 aa, Homo sapiens
  heavy chain complementarity determining region 3 for antibody 27513
ARGSPNWRNWFDP

SEQ ID NO: 55027 - protein, 9 aa, Homo sapiens
  light chain complementarity determining region 3 for antibody 27514
QQYSSDSNT

SEQ ID NO: 55028 - protein, 18 aa, Homo sapiens
  heavy chain complementarity determining region 3 for antibody 27514
AKTDRYFENLEKNYYFDI

SEQ ID NO: 55029 - protein, 9 aa, Homo sapiens
  light chain complementarity determining region 3 for antibody 27515
QQYSRSPST

SEQ ID NO: 55030 - protein, 17 aa, Homo sapiens
  heavy chain complementarity determining region 3 for antibody 27515
AGLSSRLGDGSPSLFDY

SEQ ID NO: 55031 - protein, 9 aa, Homo sapiens
  light chain complementarity determining region 3 for antibody 27516
QQYSRSPGT

SEQ ID NO: 55032 - protein, 15 aa, Homo sapiens
  heavy chain complementarity determining region 3 for antibody 27516
AREPNSYGLEYYFTY

SEQ ID NO: 55033 - protein, 10 aa, Homo sapiens
  light chain complementarity determining region 3 for antibody 27517
QQYSISPKRT

SEQ ID NO: 55034 - protein, 17 aa, Homo sapiens
  heavy chain complementarity determining region 3 for antibody 27517
ARDPCKKATDVVCAWDS

SEQ ID NO: 55035 - protein, 10 aa, Homo sapiens
  light chain complementarity determining region 3 for antibody 27518
QQYSFWPPLT

SEQ ID NO: 55036 - protein, 19 aa, Homo sapiens
  heavy chain complementarity determining region 3 for antibody 27518
VRAEYDFWSGHQGEYYFDS

SEQ ID NO: 55037 - protein, 11 aa, Homo sapiens
  light chain complementarity determining region 3 for antibody 27519
QQYSDWPTSFP

SEQ ID NO: 55038 - protein, 14 aa, Homo sapiens
  heavy chain complementarity determining region 3 for antibody 27519
ARASGSNVKMPFDF

SEQ ID NO: 55039 - protein, 11 aa, Homo sapiens
  light chain complementarity determining region 3 for antibody 27520
QQYSDWPNSFT

SEQ ID NO: 55040 - protein, 14 aa, Homo sapiens
  heavy chain complementarity determining region 3 for antibody 27520
ARASGSNVKMPFDF

SEQ ID NO: 55041 - protein, 9 aa, Homo sapiens
  light chain complementarity determining region 3 for antibody 27521
QQYSDVPLP

SEQ ID NO: 55042 - protein, 9 aa, Homo sapiens
  heavy chain complementarity determining region 3 for antibody 27521
VCLGVTPPV

SEQ ID NO: 55043 - protein, 9 aa, Homo sapiens
  light chain complementarity determining region 3 for antibody 27522
QQYRSSPWP

SEQ ID NO: 55044 - protein, 22 aa, Homo sapiens
  heavy chain complementarity determining region 3 for antibody 27522
ARAVSTNRWGRSTGDWGGAYDI

SEQ ID NO: 55045 - protein, 8 aa, Homo sapiens
  light chain complementarity determining region 3 for antibody 27523
QQYRSSFP

SEQ ID NO: 55046 - protein, 13 aa, Homo sapiens
  heavy chain complementarity determining region 3 for antibody 27523
ATESGWYQGAFGI

SEQ ID NO: 55047 - protein, 9 aa, Homo sapiens
  light chain complementarity determining region 3 for antibody 27524
QQYRRSTST

SEQ ID NO: 55048 - protein, 17 aa, Homo sapiens
  heavy chain complementarity determining region 3 for antibody 27524
AGLSSRLGDGSPSLFDY

SEQ ID NO: 55049 - protein, 9 aa, Homo sapiens
  light chain complementarity determining region 3 for antibody 27525
QQYRGDPDS

SEQ ID NO: 55050 - protein, 20 aa, Homo sapiens
  heavy chain complementarity determining region 3 for antibody 27525
ARDVDYCENGVCYSYWYFDL

SEQ ID NO: 55051 - protein, 11 aa, Homo sapiens
  light chain complementarity determining region 3 for antibody 27526
QQYRDWPTSFT

SEQ ID NO: 55052 - protein, 14 aa, Homo sapiens
  heavy chain complementarity determining region 3 for antibody 27526
ARASGSNVKMPFDF

SEQ ID NO: 55053 - protein, 9 aa, Homo sapiens
  light chain complementarity determining region 3 for antibody 27527
QQYQTYPYP

SEQ ID NO: 55054 - protein, 13 aa, Homo sapiens
  heavy chain complementarity determining region 3 for antibody 27527
AHIAYGGYAYFDH

SEQ ID NO: 55055 - protein, 10 aa, Homo sapiens
  light chain complementarity determining region 3 for antibody 27528
QQYPNWPPWT

SEQ ID NO: 55056 - protein, 21 aa, Homo sapiens
  heavy chain complementarity determining region 3 for antibody 27528
ARTGAEPNSWSSAPEDSWFDP

SEQ ID NO: 55057 - protein, 10 aa, Homo sapiens
  light chain complementarity determining region 3 for antibody 27529
QQYNVYSGLT

SEQ ID NO: 55058 - protein, 7 aa, Homo sapiens
  heavy chain complementarity determining region 3 for antibody 27529
ARGLGVD

SEQ ID NO: 55059 - protein, 10 aa, Homo sapiens
  light chain complementarity determining region 3 for antibody 27530
QQYNVYSGLT

SEQ ID NO: 55060 - protein, 7 aa, Homo sapiens
  heavy chain complementarity determining region 3 for antibody 27530
ARGLGCD

SEQ ID NO: 55061 - protein, 9 aa, Homo sapiens
  light chain complementarity determining region 3 for antibody 27531
QQYNTYSWT

SEQ ID NO: 55062 - protein, 13 aa, Homo sapiens
  heavy chain complementarity determining region 3 for antibody 27531
ATAPGADYYGLDV

SEQ ID NO: 55063 - protein, 9 aa, Homo sapiens
  light chain complementarity determining region 3 for antibody 27532
QQYNTYSRT

SEQ ID NO: 55064 - protein, 12 aa, Homo sapiens
  heavy chain complementarity determining region 3 for antibody 27532
AGAFDSSGYFDY

SEQ ID NO: 55065 - protein, 8 aa, Homo sapiens
  light chain complementarity determining region 3 for antibody 27533
QQYNTYPT

SEQ ID NO: 55066 - protein, 17 aa, Homo sapiens
  heavy chain complementarity determining region 3 for antibody 27533
AHRLDHNGMWNEGIFDH

SEQ ID NO: 55067 - protein, 9 aa, Homo sapiens
  light chain complementarity determining region 3 for antibody 27534
QQYNTYPFT

SEQ ID NO: 55068 - protein, 14 aa, Homo sapiens
  heavy chain complementarity determining region 3 for antibody 27534
AKSSDTSGYSLFDY

SEQ ID NO: 55069 - protein, 8 aa, Homo sapiens
  light chain complementarity determining region 3 for antibody 27535
QQYNTYAA

SEQ ID NO: 55070 - protein, 17 aa, Homo sapiens
  heavy chain complementarity determining region 3 for antibody 27535
AHRLDHNGMWNEGIFDH

SEQ ID NO: 55071 - protein, 9 aa, Homo sapiens
  light chain complementarity determining region 3 for antibody 27536
QQYNTWPYT

SEQ ID NO: 55072 - protein, 12 aa, Homo sapiens
  heavy chain complementarity determining region 3 for antibody 27536
PQIPVGRDAFDI

SEQ ID NO: 55073 - protein, 8 aa, Homo sapiens
  light chain complementarity determining region 3 for antibody 27537
QQYNTWPS

SEQ ID NO: 55074 - protein, 12 aa, Homo sapiens
  heavy chain complementarity determining region 3 for antibody 27537
ARLLWDSYYFDS

SEQ ID NO: 55075 - protein, 9 aa, Homo sapiens
  light chain complementarity determining region 3 for antibody 27538
QQYNTWPRT

SEQ ID NO: 55076 - protein, 22 aa, Homo sapiens
  heavy chain complementarity determining region 3 for antibody 27538
AREVRASGYDDFYTYYYYGLDV

SEQ ID NO: 55077 - protein, 9 aa, Homo sapiens
  light chain complementarity determining region 3 for antibody 27539
QQYNTFPWT

SEQ ID NO: 55078 - protein, 23 aa, Homo sapiens
  heavy chain complementarity determining region 3 for antibody 27539
TRGKFRFLQWVETSYSYYYDMDV

SEQ ID NO: 55079 - protein, 8 aa, Homo sapiens
  light chain complementarity determining region 3 for antibody 27540
QQYNSYWT

SEQ ID NO: 55080 - protein, 14 aa, Homo sapiens
  heavy chain complementarity determining region 3 for antibody 27540
AKVQGVGAYRPFDS

SEQ ID NO: 55081 - protein, 9 aa, Homo sapiens
  light chain complementarity determining region 3 for antibody 27541
QQYNSYSWT

SEQ ID NO: 55082 - protein, 20 aa, Homo sapiens
  heavy chain complementarity determining region 3 for antibody 27541
VRVKHSHDSSGYYYYYGMDV

SEQ ID NO: 55083 - protein, 8 aa, Homo sapiens
  light chain complementarity determining region 3 for antibody 27542
QQYNSYST

SEQ ID NO: 55084 - protein, 13 aa, Homo sapiens
  heavy chain complementarity determining region 3 for antibody 27542
ATESGPRRRPLNY

SEQ ID NO: 55085 - protein, 8 aa, Homo sapiens
  light chain complementarity determining region 3 for antibody 27543
QQYNSYST

SEQ ID NO: 55086 - protein, 14 aa, Homo sapiens
  heavy chain complementarity determining region 3 for antibody 27543
ARNRVLWSDGGFDS

SEQ ID NO: 55087 - protein, 9 aa, Homo sapiens
  light chain complementarity determining region 3 for antibody 27544
QQYNSYSRT

SEQ ID NO: 55088 - protein, 20 aa, Homo sapiens
  heavy chain complementarity determining region 3 for antibody 27544
ARNAGTSSWSPLSYYYGMDV

SEQ ID NO: 55089 - protein, 9 aa, Homo sapiens
  light chain complementarity determining region 3 for antibody 27545
QQYNSYSRT

SEQ ID NO: 55090 - protein, 16 aa, Homo sapiens
  heavy chain complementarity determining region 3 for antibody 27545
AAGAGMGRGISTTFDY

SEQ ID NO: 55091 - protein, 8 aa, Homo sapiens
  light chain complementarity determining region 3 for antibody 27546
QQYNSYSP

SEQ ID NO: 55092 - protein, 16 aa, Homo sapiens
  heavy chain complementarity determining region 3 for antibody 27546
ARDGLPLTSKPYYFDY

SEQ ID NO: 55093 - protein, 9 aa, Homo sapiens
  light chain complementarity determining region 3 for antibody 27547
QQYNSYSGT

SEQ ID NO: 55094 - protein, 12 aa, Homo sapiens
  heavy chain complementarity determining region 3 for antibody 27547
ARGWGSLGAFDI

SEQ ID NO: 55095 - protein, 9 aa, Homo sapiens
  light chain complementarity determining region 3 for antibody 27548
QQYNSYSGT

SEQ ID NO: 55096 - protein, 19 aa, Homo sapiens
  heavy chain complementarity determining region 3 for antibody 27548
ARAQILWFGELFERGGLDI

SEQ ID NO: 55097 - protein, 9 aa, Homo sapiens
  light chain complementarity determining region 3 for antibody 27549
QQYNSYPYT

SEQ ID NO: 55098 - protein, 14 aa, Homo sapiens
  heavy chain complementarity determining region 3 for antibody 27549
ARERIPGTPAAFDI

SEQ ID NO: 55099 - protein, 9 aa, Homo sapiens
  light chain complementarity determining region 3 for antibody 27550
QQYNSYFRT

SEQ ID NO: 55100 - protein, 16 aa, Homo sapiens
  heavy chain complementarity determining region 3 for antibody 27550
AAGVGMGRGISTTFDY

SEQ ID NO: 55101 - protein, 9 aa, Homo sapiens
  light chain complementarity determining region 3 for antibody 27551
QQYNSAPWT

SEQ ID NO: 55102 - protein, 15 aa, Homo sapiens
  heavy chain complementarity determining region 3 for antibody 27551
ARVRGDYVLFDAFDI

SEQ ID NO: 55103 - protein, 9 aa, Homo sapiens
  light chain complementarity determining region 3 for antibody 27552
QQYNSAPFT

SEQ ID NO: 55104 - protein, 16 aa, Homo sapiens
  heavy chain complementarity determining region 3 for antibody 27552
AKGVAADGLKSYYFDY

SEQ ID NO: 55105 - protein, 9 aa, Homo sapiens
  light chain complementarity determining region 3 for antibody 27553
QQYNRYSQT

SEQ ID NO: 55106 - protein, 13 aa, Homo sapiens
  heavy chain complementarity determining region 3 for antibody 27553
ARGITIRQPDLDY

SEQ ID NO: 55107 - protein, 9 aa, Homo sapiens
  light chain complementarity determining region 3 for antibody 27554
QQYNRYLWA

SEQ ID NO: 55108 - protein, 11 aa, Homo sapiens
  heavy chain complementarity determining region 3 for antibody 27554
ATGDRRYAHDN

SEQ ID NO: 55109 - protein, 10 aa, Homo sapiens
  light chain complementarity determining region 3 for antibody 27555
QQYNPWARLS

SEQ ID NO: 55110 - protein, 12 aa, Homo sapiens
  heavy chain complementarity determining region 3 for antibody 27555
AKAYYFDTSGSF

SEQ ID NO: 55111 - protein, 9 aa, Homo sapiens
  light chain complementarity determining region 3 for antibody 27556
QQYNNWPRA

SEQ ID NO: 55112 - protein, 10 aa, Homo sapiens
  heavy chain complementarity determining region 3 for antibody 27556
ARSLNSLLDY

SEQ ID NO: 55113 - protein, 10 aa, Homo sapiens
  light chain complementarity determining region 3 for antibody 27557
QQYNNWPPYT

SEQ ID NO: 55114 - protein, 14 aa, Homo sapiens
  heavy chain complementarity determining region 3 for antibody 27557
ARGGRLRLFYFSDY

SEQ ID NO: 55115 - protein, 10 aa, Homo sapiens
  light chain complementarity determining region 3 for antibody 27558
QQYNNWPPYT

SEQ ID NO: 55116 - protein, 14 aa, Homo sapiens
  heavy chain complementarity determining region 3 for antibody 27558
ARGGRLRLFSCSDY

SEQ ID NO: 55117 - protein, 10 aa, Homo sapiens [sequence omitted]

SEQ ID NO: 55118 - protein, 13 aa, Homo sapiens
  heavy chain complementarity determining region 3 for antibody 27559
ARVYSSTGYYFDY

SEQ ID NO: 55119 - protein, 10 aa, Homo sapiens [sequence omitted]

SEQ ID NO: 55120 - protein, 17 aa, Homo sapiens
  heavy chain complementarity determining region 3 for antibody 27560
ARSALDRVIVVVHAFDI

SEQ ID NO: 55121 - protein, 10 aa, Homo sapiens [sequence omitted]

SEQ ID NO: 55122 - protein, 24 aa, Homo sapiens
  heavy chain complementarity determining region 3 for antibody 27561
ARDRGMGVSCSGGGCYSDYYGMDV

SEQ ID NO: 55123 - protein, 9 aa, Homo sapiens
  light chain complementarity determining region 3 for antibody 27562
QQYNNWPPT

SEQ ID NO: 55124 - protein, 12 aa, Homo sapiens
  heavy chain complementarity determining region 3 for antibody 27562
ARALVQALIWDY

SEQ ID NO: 55125 - protein, 10 aa, Homo sapiens
  light chain complementarity determining region 3 for antibody 27563
QQYNNWPPLT

SEQ ID NO: 55126 - protein, 18 aa, Homo sapiens
  heavy chain complementarity determining region 3 for antibody 27563
ARERVPVTTLADRDAFDI

SEQ ID NO: 55127 - protein, 10 aa, Homo sapiens
  light chain complementarity determining region 3 for antibody 27564
QQYNNWPPLP

SEQ ID NO: 55128 - protein, 15 aa, Homo sapiens
  heavy chain complementarity determining region 3 for antibody 27564
ARDRSGSYSVHAFDI

SEQ ID NO: 55129 - protein, 10 aa, Homo sapiens
  light chain complementarity determining region 3 for antibody 27565
QQYNNWPLYT

SEQ ID NO: 55130 - protein, 15 aa, Homo sapiens
  heavy chain complementarity determining region 3 for antibody 27565
ARAQVIWGQLYYFDS

SEQ ID NO: 55131 - protein, 10 aa, Homo sapiens
  light chain complementarity determining region 3 for antibody 27566
QQYNNWPGWT

SEQ ID NO: 55132 - protein, 13 aa, Homo sapiens
  heavy chain complementarity determining region 3 for antibody 27566
ARHGRRSGWYYTY

SEQ ID NO: 55133 - protein, 9 aa, Homo sapiens
  light chain complementarity determining region 3 for antibody 27567
QQYNMSPRT

SEQ ID NO: 55134 - protein, 22 aa, Homo sapiens
  heavy chain complementarity determining region 3 for antibody 27567
VREWEWLAYCNGGGCQQDAFDI

SEQ ID NO: 55135 - protein, 9 aa, Homo sapiens
  light chain complementarity determining region 3 for antibody 27568
QQYNIWPRT

SEQ ID NO: 55136 - protein, 20 aa, Homo sapiens
  heavy chain complementarity determining region 3 for antibody 27568
ARDTNYYDSSCYYSGGYFDS

SEQ ID NO: 55137 - protein, 10 aa, Homo sapiens
  light chain complementarity determining region 3 for antibody 27569
QQYNIRPPDT

SEQ ID NO: 55138 - protein, 14 aa, Homo sapiens
  heavy chain complementarity determining region 3 for antibody 27569
ARDPPGIALAGNAG

SEQ ID NO: 55139 - protein, 10 aa, Homo sapiens
  light chain complementarity determining region 3 for antibody 27570
QQYNIRPPDP

SEQ ID NO: 55140 - protein, 14 aa, Homo sapiens
  heavy chain complementarity determining region 3 for antibody 27570
ARDPPGIALAGNSG

SEQ ID NO: 55141 - protein, 10 aa, Homo sapiens
  light chain complementarity determining region 3 for antibody 27571
QQYNIRPPAT

SEQ ID NO: 55142 - protein, 14 aa, Homo sapiens
  heavy chain complementarity determining region 3 for antibody 27571
ARDPPGIALAGNSG

SEQ ID NO: 55143 - protein, 9 aa, Homo sapiens
  light chain complementarity determining region 3 for antibody 27572
QQYNGYSRT

SEQ ID NO: 55144 - protein, 18 aa, Homo sapiens
  heavy chain complementarity determining region 3 for antibody 27572
ARDFGGRAYTKVEDAFDI

SEQ ID NO: 55145 - protein, 9 aa, Homo sapiens
  light chain complementarity determining region 3 for antibody 27573
QQYNGYSPT

SEQ ID NO: 55146 - protein, 14 aa, Homo sapiens
  heavy chain complementarity determining region 3 for antibody 27573
ARALGSGWNYYFDF

SEQ ID NO: 55147 - protein, 10 aa, Homo sapiens
  light chain complementarity determining region 3 for antibody 27574
QQYNGYSGLT

SEQ ID NO: 55148 - protein, 7 aa, Homo sapiens
  heavy chain complementarity determining region 3 for antibody 27574
ARGLGFD

SEQ ID NO: 55149 - protein, 10 aa, Homo sapiens
  light chain complementarity determining region 3 for antibody 27575
QQYNFRPPDT

SEQ ID NO: 55150 - protein, 14 aa, Homo sapiens
  heavy chain complementarity determining region 3 for antibody 27575
ARDPPGIALAGNSG

SEQ ID NO: 55151 - protein, 9 aa, Homo sapiens
  light chain complementarity determining region 3 for antibody 27576
QQYNDYRYT

SEQ ID NO: 55152 - protein, 14 aa, Homo sapiens
  heavy chain complementarity determining region 3 for antibody 27576
TRRFSSASRRVFDP

SEQ ID NO: 55153 - protein, 9 aa, Homo sapiens
  light chain complementarity determining region 3 for antibody 27577
QQYNDYRYT

SEQ ID NO: 55154 - protein, 14 aa, Homo sapiens
  heavy chain complementarity determining region 3 for antibody 27577
TRLVSSASRRVFDP

SEQ ID NO: 55155 - protein, 9 aa, Homo sapiens
  light chain complementarity determining region 3 for antibody 27578
QQYNDYRYT

SEQ ID NO: 55156 - protein, 14 aa, Homo sapiens
  heavy chain complementarity determining region 3 for antibody 27578
TRLCSSASRRVFDP

SEQ ID NO: 55157 - protein, 9 aa, Homo sapiens
  light chain complementarity determining region 3 for antibody 27579
QQYNDYRST

SEQ ID NO: 55158 - protein, 14 aa, Homo sapiens
  heavy chain complementarity determining region 3 for antibody 27579
TRLFSSASRRVFDP

SEQ ID NO: 55159 - protein, 9 aa, Homo sapiens
  light chain complementarity determining region 3 for antibody 27580
QQYNDWPWT

SEQ ID NO: 55160 - protein, 13 aa, Homo sapiens
  heavy chain complementarity determining region 3 for antibody 27580
VRSYSSAWTPGGF

SEQ ID NO: 55161 - protein, 9 aa, Homo sapiens
  light chain complementarity determining region 3 for antibody 27581
QQYNDWPLT

SEQ ID NO: 55162 - protein, 14 aa, Homo sapiens
  heavy chain complementarity determining region 3 for antibody 27581
ALTGDLRLRAYFEY

SEQ ID NO: 55163 - protein, 10 aa, Homo sapiens
  light chain complementarity determining region 3 for antibody 27582
QQYNDWPAFT

SEQ ID NO: 55164 - protein, 15 aa, Homo sapiens
  heavy chain complementarity determining region 3 for antibody 27582
ARPLVIDGLYTGSDY

SEQ ID NO: 55165 - protein, 9 aa, Homo sapiens
  light chain complementarity determining region 3 for antibody 27583
QQYNDHFIT

SEQ ID NO: 55166 - protein, 17 aa, Homo sapiens
  heavy chain complementarity determining region 3 for antibody 27583
AREGGFCIGAGCGWFDL

SEQ ID NO: 55167 - protein, 9 aa, Homo sapiens
  light chain complementarity determining region 3 for antibody 27584
QQYNASSWK

SEQ ID NO: 55168 - protein, 16 aa, Homo sapiens
  heavy chain complementarity determining region 3 for antibody 27584
ASLGGAHYYGSGSHYF

SEQ ID NO: 55169 - protein, 8 aa, Homo sapiens
  light chain complementarity determining region 3 for antibody 27585
QQYMSPFP

SEQ ID NO: 55170 - protein, 12 aa, Homo sapiens
  heavy chain complementarity determining region 3 for antibody 27585
ARALSASWYAFY

SEQ ID NO: 55171 - protein, 8 aa, Homo sapiens
  light chain complementarity determining region 3 for antibody 27586
QQYMSPFN

SEQ ID NO: 55172 - protein, 12 aa, Homo sapiens
  heavy chain complementarity determining region 3 for antibody 27586
ARALSASWYAFY

SEQ ID NO: 55173 - protein, 8 aa, Homo sapiens
  light chain complementarity determining region 3 for antibody 27587
QQYMAPFT

SEQ ID NO: 55174 - protein, 12 aa, Homo sapiens
  heavy chain complementarity determining region 3 for antibody 27587
ARALSASWYAFY

SEQ ID NO: 55175 - protein, 9 aa, Homo sapiens
  light chain complementarity determining region 3 for antibody 27588
QQYLTTPPP

SEQ ID NO: 55176 - protein, 13 aa, Homo sapiens
  heavy chain complementarity determining region 3 for antibody 27588
VKDPDFNYGSWVS

SEQ ID NO: 55177 - protein, 10 aa, Homo sapiens
  light chain complementarity determining region 3 for antibody 27589
QQYKNWPTRT

SEQ ID NO: 55178 - protein, 20 aa, Homo sapiens
  heavy chain complementarity determining region 3 for antibody 27589
ARGDMVRGALAFYRFYALDV

SEQ ID NO: 55179 - protein, 11 aa, Homo sapiens
  light chain complementarity determining region 3 for antibody 27590
QQYKNWPPRLT

SEQ ID NO: 55180 - protein, 19 aa, Homo sapiens
  heavy chain complementarity determining region 3 for antibody 27590
ASLSGLAYAFGGGWGAFDL

SEQ ID NO: 55181 - protein, 9 aa, Homo sapiens
  light chain complementarity determining region 3 for antibody 27591
QQYKADPWT

SEQ ID NO: 55182 - protein, 13 aa, Homo sapiens
  heavy chain complementarity determining region 3 for antibody 27591
TRWQEYSVSSGPD

SEQ ID NO: 55183 - protein, 11 aa, Homo sapiens
  light chain complementarity determining region 3 for antibody 27592
QQYITSPPGST

SEQ ID NO: 55184 - protein, 11 aa, Homo sapiens
  heavy chain complementarity determining region 3 for antibody 27592
ARHGNDFYFDY

SEQ ID NO: 55185 - protein, 11 aa, Homo sapiens
  light chain complementarity determining region 3 for antibody 27593
QQYITSPPGNT

SEQ ID NO: 55186 - protein, 11 aa, Homo sapiens
  heavy chain complementarity determining region 3 for antibody 27593
ARHGNGYYFDY

SEQ ID NO: 55187 - protein, 9 aa, Homo sapiens
  light chain complementarity determining region 3 for antibody 27594
QQYISYPWT

SEQ ID NO: 55188 - protein, 19 aa, Homo sapiens
  heavy chain complementarity determining region 3 for antibody 27594
ARVSARRILAAPRYPLIDS

SEQ ID NO: 55189 - protein, 9 aa, Homo sapiens
  light chain complementarity determining region 3 for antibody 27595
QQYISYPWP

SEQ ID NO: 55190 - protein, 19 aa, Homo sapiens
  heavy chain complementarity determining region 3 for antibody 27595
ARVSARRILTAPRYPLIDS

SEQ ID NO: 55191 - protein, 8 aa, Homo sapiens
  light chain complementarity determining region 3 for antibody 27596
QQYISPFT

SEQ ID NO: 55192 - protein, 12 aa, Homo sapiens
  heavy chain complementarity determining region 3 for antibody 27596
ARALSASWYAFY

SEQ ID NO: 55193 - protein, 9 aa, Homo sapiens
  light chain complementarity determining region 3 for antibody 27597
QQYIRYPWT

SEQ ID NO: 55194 - protein, 19 aa, Homo sapiens
  heavy chain complementarity determining region 3 for antibody 27597
ARVSARRILTAPRYPLIDS

SEQ ID NO: 55195 - protein, 9 aa, Homo sapiens
  light chain complementarity determining region 3 for antibody 27598
QQYHRYPWS

SEQ ID NO: 55196 - protein, 19 aa, Homo sapiens
  heavy chain complementarity determining region 3 for antibody 27598
AKDQDEHCCGADRVCFFDS

SEQ ID NO: 55197 - protein, 10 aa, Homo sapiens
  light chain complementarity determining region 3 for antibody 27599
QQYHDWPPYT

SEQ ID NO: 55198 - protein, 22 aa, Homo sapiens
  heavy chain complementarity determining region 3 for antibody 27599
AKDQASTVVVVSRPWEVSDLAF

SEQ ID NO: 55199 - protein, 10 aa, Homo sapiens
  light chain complementarity determining region 3 for antibody 27600
QQYGYSPKLP

SEQ ID NO: 55200 - protein, 18 aa, Homo sapiens
  heavy chain complementarity determining region 3 for antibody 27600
ATGHPLRLHDYYYFVMDV

SEQ ID NO: 55201 - protein, 10 aa, Homo sapiens
  light chain complementarity determining region 3 for antibody 27601
QQYGYSPDVT

SEQ ID NO: 55202 - protein, 16 aa, Homo sapiens
  heavy chain complementarity determining region 3 for antibody 27601
ARDATFWFGEFTFFDH

SEQ ID NO: 55203 - protein, 8 aa, Homo sapiens
  light chain complementarity determining region 3 for antibody 27602
QQYGTSVT

SEQ ID NO: 55204 - protein, 17 aa, Homo sapiens
  heavy chain complementarity determining region 3 for antibody 27602
ARHAHDSDVSGFYPYEH

SEQ ID NO: 55205 - protein, 12 aa, Homo sapiens
  light chain complementarity determining region 3 for antibody 27603
QQYGTSVPWPGP

SEQ ID NO: 55206 - protein, 14 aa, Homo sapiens
  heavy chain complementarity determining region 3 for antibody 27603
VRGGSSGYNHQVDY

SEQ ID NO: 55207 - protein, 11 aa, Homo sapiens
  light chain complementarity determining region 3 for antibody 27604
QQYGTSPWAWP

SEQ ID NO: 55208 - protein, 13 aa, Homo sapiens
  heavy chain complementarity determining region 3 for antibody 27604
ARVAVPGLGYFQH

SEQ ID NO: 55209 - protein, 9 aa, Homo sapiens
  light chain complementarity determining region 3 for antibody 27605
QQYGTSPRP

SEQ ID NO: 55210 - protein, 13 aa, Homo sapiens
  heavy chain complementarity determining region 3 for antibody 27605
PIGFYDRSGYHEY

SEQ ID NO: 55211 - protein, 11 aa, Homo sapiens
  light chain complementarity determining region 3 for antibody 27606
QQYGTSPPMDT

SEQ ID NO: 55212 - protein, 23 aa, Homo sapiens
  heavy chain complementarity determining region 3 for antibody 27606
ARGNRGYRRSNSRMDFYNFGMDV

SEQ ID NO: 55213 - protein, 9 aa, Homo sapiens
  light chain complementarity determining region 3 for antibody 27607
QQYGTSPLT

SEQ ID NO: 55214 - protein, 14 aa, Homo sapiens
  heavy chain complementarity determining region 3 for antibody 27607
ARMTSSWYPEYFHH

SEQ ID NO: 55215 - protein, 9 aa, Homo sapiens
  light chain complementarity determining region 3 for antibody 27608
QQYGTSPLP

SEQ ID NO: 55216 - protein, 12 aa, Homo sapiens
  heavy chain complementarity determining region 3 for antibody 27608
ARVNWGLNAFDI

SEQ ID NO: 55217 - protein, 9 aa, Homo sapiens
  light chain complementarity determining region 3 for antibody 27609
QQYGTSPLP

SEQ ID NO: 55218 - protein, 14 aa, Homo sapiens
  heavy chain complementarity determining region 3 for antibody 27609
ARRARGWGSNYFDY

SEQ ID NO: 55219 - protein, 14 aa, Homo sapiens
  light chain complementarity determining region 3 for antibody 27610
QQYGTSPHDGPPGT

SEQ ID NO: 55220 - protein, 13 aa, Homo sapiens
  heavy chain complementarity determining region 3 for antibody 27610
ARVAVPGMGYFQY

SEQ ID NO: 55221 - protein, 9 aa, Homo sapiens
  light chain complementarity determining region 3 for antibody 27611
QQYGTSPFT

SEQ ID NO: 55222 - protein, 13 aa, Homo sapiens
  heavy chain complementarity determining region 3 for antibody 27611
STPPRSSSSAGDY

SEQ ID NO: 55223 - protein, 9 aa, Homo sapiens
  light chain complementarity determining region 3 for antibody 27612
QQYGTSPFP

SEQ ID NO: 55224 - protein, 14 aa, Homo sapiens
  heavy chain complementarity determining region 3 for antibody 27612
ARMTSSWYPEYFHH

SEQ ID NO: 55225 - protein, 10 aa, Homo sapiens
  light chain complementarity determining region 3 for antibody 27613
QQYGTSPALP

SEQ ID NO: 55226 - protein, 15 aa, Homo sapiens
  heavy chain complementarity determining region 3 for antibody 27613
ARAPVQLWFSDAFDV

SEQ ID NO: 55227 - protein, 9 aa, Homo sapiens
  light chain complementarity determining region 3 for antibody 27614
QQYGTIPRT

SEQ ID NO: 55228 - protein, 13 aa, Homo sapiens
  heavy chain complementarity determining region 3 for antibody 27614
AGGLFHSSGYSEF

SEQ ID NO: 55229 - protein, 9 aa, Homo sapiens
  light chain complementarity determining region 3 for antibody 27615
QQYGTAPET

SEQ ID NO: 55230 - protein, 14 aa, Homo sapiens
  heavy chain complementarity determining region 3 for antibody 27615
ARDLFRGIPDYLDY

SEQ ID NO: 55231 - protein, 9 aa, Homo sapiens
  light chain complementarity determining region 3 for antibody 27616
QQYGSYSNT

SEQ ID NO: 55232 - protein, 12 aa, Homo sapiens
  heavy chain complementarity determining region 3 for antibody 27616
ARADRSGWYNDY

SEQ ID NO: 55233 - protein, 9 aa, Homo sapiens
  light chain complementarity determining region 3 for antibody 27617
QQYGSYLYT

SEQ ID NO: 55234 - protein, 9 aa, Homo sapiens
  heavy chain complementarity determining region 3 for antibody 27617
IYEINAFDI

SEQ ID NO: 55235 - protein, 7 aa, Homo sapiens
  light chain complementarity determining region 3 for antibody 27618
QQYGSWA

SEQ ID NO: 55236 - protein, 11 aa, Homo sapiens
  heavy chain complementarity determining region 3 for antibody 27618
AVVDTTLAMHK

SEQ ID NO: 55237 - protein, 9 aa, Homo sapiens
  light chain complementarity determining region 3 for antibody 27619
QQYGSTWWT

SEQ ID NO: 55238 - protein, 15 aa, Homo sapiens
  heavy chain complementarity determining region 3 for antibody 27619
ARHMARDSMGYYHDF

SEQ ID NO: 55239 - protein, 9 aa, Homo sapiens
  light chain complementarity determining region 3 for antibody 27620
QQYGSTRWT

SEQ ID NO: 55240 - protein, 15 aa, Homo sapiens
  heavy chain complementarity determining region 3 for antibody 27620
ARHMARDSIGYYHDF

SEQ ID NO: 55241 - protein, 9 aa, Homo sapiens
  light chain complementarity determining region 3 for antibody 27621
QQYGSTRGP

SEQ ID NO: 55242 - protein, 16 aa, Homo sapiens
  heavy chain complementarity determining region 3 for antibody 27621
ARVVWGASWYVGYFDL

SEQ ID NO: 55243 - protein, 9 aa, Homo sapiens
  light chain complementarity determining region 3 for antibody 27622
QQYGSTPRT

SEQ ID NO: 55244 - protein, 14 aa, Homo sapiens
  heavy chain complementarity determining region 3 for antibody 27622
AREWVSTIRGWFDP

SEQ ID NO: 55245 - protein, 9 aa, Homo sapiens
  light chain complementarity determining region 3 for antibody 27623
QQYGSTLWT

SEQ ID NO: 55246 - protein, 15 aa, Homo sapiens
  heavy chain complementarity determining region 3 for antibody 27623
ARHMARDSIGYYHDF

SEQ ID NO: 55247 - protein, 9 aa, Homo sapiens
  light chain complementarity determining region 3 for antibody 27624
QQYGSSWWK

SEQ ID NO: 55248 - protein, 15 aa, Homo sapiens
  heavy chain complementarity determining region 3 for antibody 27624
ARHVARDDIGYYHDL

SEQ ID NO: 55249 - protein, 10 aa, Homo sapiens
  light chain complementarity determining region 3 for antibody 27625
QQYGSSTPFP

SEQ ID NO: 55250 - protein, 13 aa, Homo sapiens
  heavy chain complementarity determining region 3 for antibody 27625
ARVVVPGRGYFQH

SEQ ID NO: 55251 - protein, 9 aa, Homo sapiens
  light chain complementarity determining region 3 for antibody 27626
QQYGSSSYT

SEQ ID NO: 55252 - protein, 11 aa, Homo sapiens
  heavy chain complementarity determining region 3 for antibody 27626
ARGGFYGSFDF

SEQ ID NO: 55253 - protein, 9 aa, Homo sapiens
  light chain complementarity determining region 3 for antibody 27627
QQYGSSSRT

SEQ ID NO: 55254 - protein, 25 aa, Homo sapiens
  heavy chain complementarity determining region 3 for antibody 27627
ARLRIDRLRLPGAMRGPLYDCGLNV

SEQ ID NO: 55255 - protein, 10 aa, Homo sapiens
  light chain complementarity determining region 3 for antibody 27628
QQYGSSSLFT

SEQ ID NO: 55256 - protein, 10 aa, Homo sapiens
  heavy chain complementarity determining region 3 for antibody 27628
ARQGGWYFDL

SEQ ID NO: 55257 - protein, 9 aa, Homo sapiens
  light chain complementarity determining region 3 for antibody 27629
QQYGSSRWT

SEQ ID NO: 55258 - protein, 18 aa, Homo sapiens
  heavy chain complementarity determining region 3 for antibody 27629
ARGPDHGSSDRVNCFFDL

SEQ ID NO: 55259 - protein, 9 aa, Homo sapiens
  light chain complementarity determining region 3 for antibody 27630
QQYGSSQWT

SEQ ID NO: 55260 - protein, 26 aa, Homo sapiens
  heavy chain complementarity determining region 3 for antibody 27630
ARDRFLGYYDDTDGLYSPGFADGMDV

SEQ ID NO: 55261 - protein, 9 aa, Homo sapiens
  light chain complementarity determining region 3 for antibody 27631
QQYGSSPWT

SEQ ID NO: 55262 - protein, 20 aa, Homo sapiens
  heavy chain complementarity determining region 3 for antibody 27631
ARVKAASAGLPSYYYAGMDV

SEQ ID NO: 55263 - protein, 9 aa, Homo sapiens
  light chain complementarity determining region 3 for antibody 27632
QQYGSSPWT

SEQ ID NO: 55264 - protein, 20 aa, Homo sapiens
  heavy chain complementarity determining region 3 for antibody 27632
ARLRKQLVLSNVYYYYGMDV

SEQ ID NO: 55265 - protein, 9 aa, Homo sapiens
  light chain complementarity determining region 3 for antibody 27633
QQYGSSPWT

SEQ ID NO: 55266 - protein, 19 aa, Homo sapiens
  heavy chain complementarity determining region 3 for antibody 27633
ARDSFWPGSGNYFGDILDS

SEQ ID NO: 55267 - protein, 9 aa, Homo sapiens
  light chain complementarity determining region 3 for antibody 27634
QQYGSSPWP

SEQ ID NO: 55268 - protein, 20 aa, Homo sapiens
  heavy chain complementarity determining region 3 for antibody 27634
ARLKAASAGLPSYYYAGMDV

SEQ ID NO: 55269 - protein, 9 aa, Homo sapiens
  light chain complementarity determining region 3 for antibody 27635
QQYGSSPWP

SEQ ID NO: 55270 - protein, 14 aa, Homo sapiens
  heavy chain complementarity determining region 3 for antibody 27635
ARGQSGSLYDTFDM

SEQ ID NO: 55271 - protein, 9 aa, Homo sapiens
  light chain complementarity determining region 3 for antibody 27636
QQYGSSPWK

SEQ ID NO: 55272 - protein, 14 aa, Homo sapiens
  heavy chain complementarity determining region 3 for antibody 27636
ARGQSGSLYDTFDM

SEQ ID NO: 55273 - protein, 10 aa, Homo sapiens
  light chain complementarity determining region 3 for antibody 27637
QQYGSSPTYS

SEQ ID NO: 55274 - protein, 11 aa, Homo sapiens
  heavy chain complementarity determining region 3 for antibody 27637
ARGGQWGSLDY

SEQ ID NO: 55275 - protein, 9 aa, Homo sapiens
  light chain complementarity determining region 3 for antibody 27638
QQYGSSPTT

SEQ ID NO: 55276 - protein, 17 aa, Homo sapiens
  heavy chain complementarity determining region 3 for antibody 27638
ASLGGSGWNRGHNWFDP

SEQ ID NO: 55277 - protein, 9 aa, Homo sapiens
  light chain complementarity determining region 3 for antibody 27639
QQYGSSPTP

SEQ ID NO: 55278 - protein, 17 aa, Homo sapiens
  heavy chain complementarity determining region 3 for antibody 27639
ARLGGSGWNRGHNWFDP

SEQ ID NO: 55279 - protein, 10 aa, Homo sapiens
  light chain complementarity determining region 3 for antibody 27640
QQYGSSPRYS

SEQ ID NO: 55280 - protein, 11 aa, Homo sapiens
  heavy chain complementarity determining region 3 for antibody 27640
ARGGQWGSLDY

SEQ ID NO: 55281 - protein, 9 aa, Homo sapiens
  light chain complementarity determining region 3 for antibody 27641
QQYGSSPRT

SEQ ID NO: 55282 - protein, 10 aa, Homo sapiens
  heavy chain complementarity determining region 3 for antibody 27641
GRDLSGARDY

SEQ ID NO: 55283 - protein, 9 aa, Homo sapiens
  light chain complementarity determining region 3 for antibody 27642
QQYGSSPRT

SEQ ID NO: 55284 - protein, 13 aa, Homo sapiens
  heavy chain complementarity determining region 3 for antibody 27642
ASSGYGDYDDLHY

SEQ ID NO: 55285 - protein, 9 aa, Homo sapiens
  light chain complementarity determining region 3 for antibody 27643
QQYGSSPRT

SEQ ID NO: 55286 - protein, 25 aa, Homo sapiens
  heavy chain complementarity determining region 3 for antibody 27643
ARLRVDRLRLPGAMRGPLYDCGLNV

SEQ ID NO: 55287 - protein, 9 aa, Homo sapiens
  light chain complementarity determining region 3 for antibody 27644
QQYGSSPRT

SEQ ID NO: 55288 - protein, 25 aa, Homo sapiens
  heavy chain complementarity determining region 3 for antibody 27644
ARLRIVRLRLPGAMRGPLYDCGLNV

SEQ ID NO: 55289 - protein, 9 aa, Homo sapiens
  light chain complementarity determining region 3 for antibody 27645
QQYGSSPRT

SEQ ID NO: 55290 - protein, 25 aa, Homo sapiens
  heavy chain complementarity determining region 3 for antibody 27645
ARLRIDRLRLPGAMRGPWYDCGLNV

SEQ ID NO: 55291 - protein, 9 aa, Homo sapiens
  light chain complementarity determining region 3 for antibody 27646
QQYGSSPRT

SEQ ID NO: 55292 - protein, 25 aa, Homo sapiens
  heavy chain complementarity determining region 3 for antibody 27646
ARLRIDRLRLPGAMRGPLYDCGLNA

SEQ ID NO: 55293 - protein, 9 aa, Homo sapiens
  light chain complementarity determining region 3 for antibody 27647
QQYGSSPRT

SEQ ID NO: 55294 - protein, 12 aa, Homo sapiens
  heavy chain complementarity determining region 3 for antibody 27647
ARLHPYNPEFDY

SEQ ID NO: 55295 - protein, 9 aa, Homo sapiens
  light chain complementarity determining region 3 for antibody 27648
QQYGSSPRT

SEQ ID NO: 55296 - protein, 13 aa, Homo sapiens
  heavy chain complementarity determining region 3 for antibody 27648
ARGKYGSSGYKEN

SEQ ID NO: 55297 - protein, 9 aa, Homo sapiens
  light chain complementarity determining region 3 for antibody 27649
QQYGSSPRT

SEQ ID NO: 55298 - protein, 14 aa, Homo sapiens
  heavy chain complementarity determining region 3 for antibody 27649
ARDRGSSWYPPFHH

SEQ ID NO: 55299 - protein, 9 aa, Homo sapiens
  light chain complementarity determining region 3 for antibody 27650
QQYGSSPRP

SEQ ID NO: 55300 - protein, 14 aa, Homo sapiens
  heavy chain complementarity determining region 3 for antibody 27650
ATGFFDSSRYYLEY

SEQ ID NO: 55301 - protein, 9 aa, Homo sapiens
  light chain complementarity determining region 3 for antibody 27651
QQYGSSPRP

SEQ ID NO: 55302 - protein, 13 aa, Homo sapiens
  heavy chain complementarity determining region 3 for antibody 27651
ARGEYVSGNYEEN

SEQ ID NO: 55303 - protein, 9 aa, Homo sapiens
  light chain complementarity determining region 3 for antibody 27652
QQYGSSPRK

SEQ ID NO: 55304 - protein, 15 aa, Homo sapiens
  heavy chain complementarity determining region 3 for antibody 27652
ARANGVIITTGVLRY

SEQ ID NO: 55305 - protein, 9 aa, Homo sapiens
  light chain complementarity determining region 3 for antibody 27653
QQYGSSPRA

SEQ ID NO: 55306 - protein, 25 aa, Homo sapiens
  heavy chain complementarity determining region 3 for antibody 27653
ARLRIDRLRLPGAMRGPLYDCGLNV

SEQ ID NO: 55307 - protein, 10 aa, Homo sapiens
  light chain complementarity determining region 3 for antibody 27654
QQYGSSPQRT

SEQ ID NO: 55308 - protein, 11 aa, Homo sapiens
  heavy chain complementarity determining region 3 for antibody 27654
TREKVGGYFDY

SEQ ID NO: 55309 - protein, 10 aa, Homo sapiens
  light chain complementarity determining region 3 for antibody 27655
QQYGSSPQGT

SEQ ID NO: 55310 - protein, 11 aa, Homo sapiens
  heavy chain complementarity determining region 3 for antibody 27655
TREKVGGYFDY

SEQ ID NO: 55311 - protein, 10 aa, Homo sapiens
  light chain complementarity determining region 3 for antibody 27656
QQYGSSPPWR

SEQ ID NO: 55312 - protein, 14 aa, Homo sapiens
  heavy chain complementarity determining region 3 for antibody 27656
ARGGIRGVIIPLLS

SEQ ID NO: 55313 - protein, 10 aa, Homo sapiens
  light chain complementarity determining region 3 for antibody 27657
QQYGSSPPVT

SEQ ID NO: 55314 - protein, 14 aa, Homo sapiens
  heavy chain complementarity determining region 3 for antibody 27657
ARDLRWLVLGRLDY

SEQ ID NO: 55315 - protein, 9 aa, Homo sapiens
  light chain complementarity determining region 3 for antibody 27658
QQYGSSPPT

SEQ ID NO: 55316 - protein, 8 aa, Homo sapiens
  heavy chain complementarity determining region 3 for antibody 27658
TRGGDFDY

SEQ ID NO: 55317 - protein, 9 aa, Homo sapiens
  light chain complementarity determining region 3 for antibody 27659
QQYGSSPPT

SEQ ID NO: 55318 - protein, 17 aa, Homo sapiens
  heavy chain complementarity determining region 3 for antibody 27659
ARPYFGPVRAGTNGYDI

SEQ ID NO: 55319 - protein, 9 aa, Homo sapiens
  light chain complementarity determining region 3 for antibody 27660
QQYGSSPPT

SEQ ID NO: 55320 - protein, 17 aa, Homo sapiens
  heavy chain complementarity determining region 3 for antibody 27660
ARPYCGPVRAGTNGYDM

SEQ ID NO: 55321 - protein, 9 aa, Homo sapiens
  light chain complementarity determining region 3 for antibody 27661
QQYGSSPPT

SEQ ID NO: 55322 - protein, 17 aa, Homo sapiens
  heavy chain complementarity determining region 3 for antibody 27661
ARLGGSGWNRGHNWFDP

SEQ ID NO: 55323 - protein, 9 aa, Homo sapiens
  light chain complementarity determining region 3 for antibody 27662
QQYGSSPPT

SEQ ID NO: 55324 - protein, 19 aa, Homo sapiens
  heavy chain complementarity determining region 3 for antibody 27662
ARGSSSSRRRAAVVGYFDL

SEQ ID NO: 55325 - protein, 9 aa, Homo sapiens
  light chain complementarity determining region 3 for antibody 27663
QQYGSSPPT

SEQ ID NO: 55326 - protein, 11 aa, Homo sapiens
  heavy chain complementarity determining region 3 for antibody 27663
AREGNYKPHDY

SEQ ID NO: 55327 - protein, 11 aa, Homo sapiens
  light chain complementarity determining region 3 for antibody 27664
QQYGSSPPSYT

SEQ ID NO: 55328 - protein, 24 aa, Homo sapiens
  heavy chain complementarity determining region 3 for antibody 27664
AVNHGIFGVVIHPSLRNSYYGMDV

SEQ ID NO: 55329 - protein, 11 aa, Homo sapiens
  light chain complementarity determining region 3 for antibody 27665
QQYGSSPPSYP

SEQ ID NO: 55330 - protein, 24 aa, Homo sapiens
  heavy chain complementarity determining region 3 for antibody 27665
AVNHGIFGVVIHPSLRNSYYGMDV

SEQ ID NO: 55331 - protein, 9 aa, Homo sapiens
  light chain complementarity determining region 3 for antibody 27666
QQYGSSPPS

SEQ ID NO: 55332 - protein, 12 aa, Homo sapiens
  heavy chain complementarity determining region 3 for antibody 27666
ARGPQLWFYFDY

SEQ ID NO: 55333 - protein, 11 aa, Homo sapiens
  light chain complementarity determining region 3 for antibody 27667
QQYGSSPPRYP

SEQ ID NO: 55334 - protein, 12 aa, Homo sapiens
  heavy chain complementarity determining region 3 for antibody 27667
ATTGSYYRSFDY

SEQ ID NO: 55335 - protein, 11 aa, Homo sapiens
  light chain complementarity determining region 3 for antibody 27668
QQYGSSPPRLT

SEQ ID NO: 55336 - protein, 18 aa, Homo sapiens
  heavy chain complementarity determining region 3 for antibody 27668
ALTDLTGSIAETPAPLDY

SEQ ID NO: 55337 - protein, 10 aa, Homo sapiens
  light chain complementarity determining region 3 for antibody 27669
QQYGSSPPLP

SEQ ID NO: 55338 - protein, 20 aa, Homo sapiens
  heavy chain complementarity determining region 3 for antibody 27669
ARLRKQLVLSNVYYYYGMDV

SEQ ID NO: 55339 - protein, 10 aa, Homo sapiens
  light chain complementarity determining region 3 for antibody 27670
QQYGSSPPFS

SEQ ID NO: 55340 - protein, 14 aa, Homo sapiens
  heavy chain complementarity determining region 3 for antibody 27670
ARDLRWLVLGRLDY

SEQ ID NO: 55341 - protein, 10 aa, Homo sapiens
  light chain complementarity determining region 3 for antibody 27671
QQYGSSPMYI

SEQ ID NO: 55342 - protein, 11 aa, Homo sapiens
  heavy chain complementarity determining region 3 for antibody 27671
ARGGQWGSLDY

SEQ ID NO: 55343 - protein, 9 aa, Homo sapiens
  light chain complementarity determining region 3 for antibody 27672
QQYGSSPLT

SEQ ID NO: 55344 - protein, 15 aa, Homo sapiens
  heavy chain complementarity determining region 3 for antibody 27672
ARLVEWELLYWYFDL

SEQ ID NO: 55345 - protein, 9 aa, Homo sapiens
  light chain complementarity determining region 3 for antibody 27673
QQYGSSPLT

SEQ ID NO: 55346 - protein, 14 aa, Homo sapiens
  heavy chain complementarity determining region 3 for antibody 27673
ARGVPRKKYWYFDL

SEQ ID NO: 55347 - protein, 9 aa, Homo sapiens
  light chain complementarity determining region 3 for antibody 27674
QQYGSSPIT

SEQ ID NO: 55348 - protein, 16 aa, Homo sapiens
  heavy chain complementarity determining region 3 for antibody 27674
ARGWDSGGYAYDAFDS

SEQ ID NO: 55349 - protein, 10 aa, Homo sapiens
  light chain complementarity determining region 3 for antibody 27675
QQYGSSPIFP

SEQ ID NO: 55350 - protein, 10 aa, Homo sapiens
  heavy chain complementarity determining region 3 for antibody 27675
ETFEIPSGTD

SEQ ID NO: 55351 - protein, 9 aa, Homo sapiens
  light chain complementarity determining region 3 for antibody 27676
QQYGSSPHT

SEQ ID NO: 55352 - protein, 16 aa, Homo sapiens
  heavy chain complementarity determining region 3 for antibody 27676
ATPGQHNSGWDYRFDY

SEQ ID NO: 55353 - protein, 9 aa, Homo sapiens
  light chain complementarity determining region 3 for antibody 27677
QQYGSSPHT

SEQ ID NO: 55354 - protein, 9 aa, Homo sapiens
  heavy chain complementarity determining region 3 for antibody 27677
ARETEGFDI

SEQ ID NO: 55355 - protein, 9 aa, Homo sapiens
  light chain complementarity determining region 3 for antibody 27678
QQYGSSPGT

SEQ ID NO: 55356 - protein, 17 aa, Homo sapiens
  heavy chain complementarity determining region 3 for antibody 27678
ASPGSSGYWGHDDAYDI

SEQ ID NO: 55357 - protein, 9 aa, Homo sapiens
  light chain complementarity determining region 3 for antibody 27679
QQYGSSPGP

SEQ ID NO: 55358 - protein, 16 aa, Homo sapiens
  heavy chain complementarity determining region 3 for antibody 27679
ARAVWGASWSVGWFDS

SEQ ID NO: 55359 - protein, 10 aa, Homo sapiens
  light chain complementarity determining region 3 for antibody 27680
QQYGSSPGLT

SEQ ID NO: 55360 - protein, 19 aa, Homo sapiens
  heavy chain complementarity determining region 3 for antibody 27680
GRVGRRYIFNRQYNIAMDV

SEQ ID NO: 55361 - protein, 9 aa, Homo sapiens
  light chain complementarity determining region 3 for antibody 27681
QQYGSSPFT

SEQ ID NO: 55362 - protein, 21 aa, Homo sapiens
  heavy chain complementarity determining region 3 for antibody 27681
ARVGVERDRYGRTLPVWYFDY

SEQ ID NO: 55363 - protein, 9 aa, Homo sapiens
  light chain complementarity determining region 3 for antibody 27682
QQYGSSPFT

SEQ ID NO: 55364 - protein, 11 aa, Homo sapiens
  heavy chain complementarity determining region 3 for antibody 27682
ARGGYYTHAGP

SEQ ID NO: 55365 - protein, 9 aa, Homo sapiens
  light chain complementarity determining region 3 for antibody 27683
QQYGSSNWT

SEQ ID NO: 55366 - protein, 16 aa, Homo sapiens
  heavy chain complementarity determining region 3 for antibody 27683
ARVGRRGSYYNGAFDI

SEQ ID NO: 55367 - protein, 9 aa, Homo sapiens
  light chain complementarity determining region 3 for antibody 27684
QQYGSSLYT

SEQ ID NO: 55368 - protein, 9 aa, Homo sapiens
  heavy chain complementarity determining region 3 for antibody 27684
IYEVNAFDI

SEQ ID NO: 55369 - protein, 9 aa, Homo sapiens
  light chain complementarity determining region 3 for antibody 27685
QQYGSSLYT

SEQ ID NO: 55370 - protein, 9 aa, Homo sapiens
  heavy chain complementarity determining region 3 for antibody 27685
IYEINAFDV

SEQ ID NO: 55371 - protein, 9 aa, Homo sapiens
  light chain complementarity determining region 3 for antibody 27686
QQYGSSLYI

SEQ ID NO: 55372 - protein, 9 aa, Homo sapiens
  heavy chain complementarity determining region 3 for antibody 27686
IYEINAFDI

SEQ ID NO: 55373 - protein, 10 aa, Homo sapiens
  light chain complementarity determining region 3 for antibody 27687
QQYGSSLPWT

SEQ ID NO: 55374 - protein, 23 aa, Homo sapiens
  heavy chain complementarity determining region 3 for antibody 27687
ARAQPRWGIAVAGPPGRYYGMDV

SEQ ID NO: 55375 - protein, 10 aa, Homo sapiens
  light chain complementarity determining region 3 for antibody 27688
QQYGSSLPGT

SEQ ID NO: 55376 - protein, 23 aa, Homo sapiens
  heavy chain complementarity determining region 3 for antibody 27688
ARAQPRWGIAVAGPPGRYYGMDV

SEQ ID NO: 55377 - protein, 9 aa, Homo sapiens
  light chain complementarity determining region 3 for antibody 27689
QQYGSSLHT

SEQ ID NO: 55378 - protein, 9 aa, Homo sapiens
  heavy chain complementarity determining region 3 for antibody 27689
IYEINAFDI

SEQ ID NO: 55379 - protein, 9 aa, Homo sapiens
  light chain complementarity determining region 3 for antibody 27690
QQYGSSLFT

SEQ ID NO: 55380 - protein, 9 aa, Homo sapiens
  heavy chain complementarity determining region 3 for antibody 27690
IYEINAFDI

SEQ ID NO: 55381 - protein, 9 aa, Homo sapiens
  light chain complementarity determining region 3 for antibody 27691
QQYGSSHRT

SEQ ID NO: 55382 - protein, 25 aa, Homo sapiens
  heavy chain complementarity determining region 3 for antibody 27691
ARLRIDRLRLPGAMRGPLYDCGLNV

SEQ ID NO: 55383 - protein, 9 aa, Homo sapiens
  light chain complementarity determining region 3 for antibody 27692
QQYGSSHIP

SEQ ID NO: 55384 - protein, 23 aa, Homo sapiens
  heavy chain complementarity determining region 3 for antibody 27692
AKDGLESYYDSSGTNLAYWYFDL

SEQ ID NO: 55385 - protein, 9 aa, Homo sapiens
  light chain complementarity determining region 3 for antibody 27693
QQYGSPWWP

SEQ ID NO: 55386 - protein, 15 aa, Homo sapiens
  heavy chain complementarity determining region 3 for antibody 27693
ARHMARDSIGYYHDF

SEQ ID NO: 55387 - protein, 9 aa, Homo sapiens
  light chain complementarity determining region 3 for antibody 27694
QQYGSPWRT

SEQ ID NO: 55388 - protein, 15 aa, Homo sapiens
  heavy chain complementarity determining region 3 for antibody 27694
ARHMARDSIGYYHDF

SEQ ID NO: 55389 - protein, 9 aa, Homo sapiens
  light chain complementarity determining region 3 for antibody 27695
QQYGSPPYT

SEQ ID NO: 55390 - protein, 9 aa, Homo sapiens
  heavy chain complementarity determining region 3 for antibody 27695
ARETEGFDI

SEQ ID NO: 55391 - protein, 9 aa, Homo sapiens
  light chain complementarity determining region 3 for antibody 27696
QQYGSPPIT

SEQ ID NO: 55392 - protein, 9 aa, Homo sapiens
  heavy chain complementarity determining region 3 for antibody 27696
ARRRGYYNH

SEQ ID NO: 55393 - protein, 9 aa, Homo sapiens
  light chain complementarity determining region 3 for antibody 27697
QQYGSPGWT

SEQ ID NO: 55394 - protein, 15 aa, Homo sapiens
  heavy chain complementarity determining region 3 for antibody 27697
ARHMARDSIGYYHDF

SEQ ID NO: 55395 - protein, 9 aa, Homo sapiens
  light chain complementarity determining region 3 for antibody 27698
QQYGSLPYT

SEQ ID NO: 55396 - protein, 14 aa, Homo sapiens
  heavy chain complementarity determining region 3 for antibody 27698
ARGGFIVAWGLFDY

SEQ ID NO: 55397 - protein, 9 aa, Homo sapiens
  light chain complementarity determining region 3 for antibody 27699
QQYGSLPYT

SEQ ID NO: 55398 - protein, 9 aa, Homo sapiens
  heavy chain complementarity determining region 3 for antibody 27699
ARETEGFDI

SEQ ID NO: 55399 - protein, 9 aa, Homo sapiens
  light chain complementarity determining region 3 for antibody 27700
QQYGSLPRT

SEQ ID NO: 55400 - protein, 13 aa, Homo sapiens
  heavy chain complementarity determining region 3 for antibody 27700
GKGYPNIYKVYDY

SEQ ID NO: 55401 - protein, 9 aa, Homo sapiens
  light chain complementarity determining region 3 for antibody 27701
QQYGSLPRT

SEQ ID NO: 55402 - protein, 13 aa, Homo sapiens
  heavy chain complementarity determining region 3 for antibody 27701
AKDMDTKVTGSDH

SEQ ID NO: 55403 - protein, 9 aa, Homo sapiens
  light chain complementarity determining region 3 for antibody 27702
QQYGSLPRT

SEQ ID NO: 55404 - protein, 15 aa, Homo sapiens
  heavy chain complementarity determining region 3 for antibody 27702
AKDGPYCGSDCYFEF

SEQ ID NO: 55405 - protein, 9 aa, Homo sapiens
  light chain complementarity determining region 3 for antibody 27703
QQYGSLPRT

SEQ ID NO: 55406 - protein, 14 aa, Homo sapiens
  heavy chain complementarity determining region 3 for antibody 27703
AGGDFCGSDCYSDY

SEQ ID NO: 55407 - protein, 10 aa, Homo sapiens
  light chain complementarity determining region 3 for antibody 27704
QQYGSLPMYS

SEQ ID NO: 55408 - protein, 11 aa, Homo sapiens
  heavy chain complementarity determining region 3 for antibody 27704
ARGGQWGSLDY

SEQ ID NO: 55409 - protein, 9 aa, Homo sapiens
  light chain complementarity determining region 3 for antibody 27705
QQYGSLPLT

SEQ ID NO: 55410 - protein, 15 aa, Homo sapiens
  heavy chain complementarity determining region 3 for antibody 27705
AHRPNDYDKAGAFDI

SEQ ID NO: 55411 - protein, 9 aa, Homo sapiens
  light chain complementarity determining region 3 for antibody 27706
QQYGSLPFT

SEQ ID NO: 55412 - protein, 21 aa, Homo sapiens
  heavy chain complementarity determining region 3 for antibody 27706
ARVGVERNRYGRTLPVWYFDY

SEQ ID NO: 55413 - protein, 9 aa, Homo sapiens
  light chain complementarity determining region 3 for antibody 27707
QQYGSLLLT

SEQ ID NO: 55414 - protein, 15 aa, Homo sapiens
  heavy chain complementarity determining region 3 for antibody 27707
AHRPNYYDKAGAFDI

SEQ ID NO: 55415 - protein, 9 aa, Homo sapiens
  light chain complementarity determining region 3 for antibody 27708
QQYGSITRT

SEQ ID NO: 55416 - protein, 14 aa, Homo sapiens
  heavy chain complementarity determining region 3 for antibody 27708
AGGKFCGGDCYREY

SEQ ID NO: 55417 - protein, 9 aa, Homo sapiens
  light chain complementarity determining region 3 for antibody 27709
QQYGSIPRT

SEQ ID NO: 55418 - protein, 14 aa, Homo sapiens
  heavy chain complementarity determining region 3 for antibody 27709
AGGKCCGGDCYREY

SEQ ID NO: 55419 - protein, 9 aa, Homo sapiens
  light chain complementarity determining region 3 for antibody 27710
QQYGSFPPP

SEQ ID NO: 55420 - protein, 17 aa, Homo sapiens
  heavy chain complementarity determining region 3 for antibody 27710
ARGLMERWLVPLYYFDL

SEQ ID NO: 55421 - protein, 9 aa, Homo sapiens
  light chain complementarity determining region 3 for antibody 27711
QQYGSFPDT

SEQ ID NO: 55422 - protein, 14 aa, Homo sapiens
  heavy chain complementarity determining region 3 for antibody 27711
ARGGFIVAWGLFDY

SEQ ID NO: 55423 - protein, 9 aa, Homo sapiens
  light chain complementarity determining region 3 for antibody 27712
QQYGSAWWT

SEQ ID NO: 55424 - protein, 15 aa, Homo sapiens
  heavy chain complementarity determining region 3 for antibody 27712
ARHMARDSIGYYHDF

SEQ ID NO: 55425 - protein, 9 aa, Homo sapiens
  light chain complementarity determining region 3 for antibody 27713
QQYGRTRGT

SEQ ID NO: 55426 - protein, 16 aa, Homo sapiens
  heavy chain complementarity determining region 3 for antibody 27713
ARVVWGASWYVGYFDL

SEQ ID NO: 55427 - protein, 9 aa, Homo sapiens
  light chain complementarity determining region 3 for antibody 27714
QQYGRTPWT

SEQ ID NO: 55428 - protein, 16 aa, Homo sapiens
  heavy chain complementarity determining region 3 for antibody 27714
ARRGWGDDLGPHPLDY

SEQ ID NO: 55429 - protein, 12 aa, Homo sapiens
  light chain complementarity determining region 3 for antibody 27715
QQYGRSVQDAWR

SEQ ID NO: 55430 - protein, 13 aa, Homo sapiens
  heavy chain complementarity determining region 3 for antibody 27715
ARLPSRKQQLVRE

SEQ ID NO: 55431 - protein, 9 aa, Homo sapiens
  light chain complementarity determining region 3 for antibody 27716
QQYGRSPWT

SEQ ID NO: 55432 - protein, 18 aa, Homo sapiens
  heavy chain complementarity determining region 3 for antibody 27716
ATNPSIAEPGNRYWYFDL

SEQ ID NO: 55433 - protein, 9 aa, Homo sapiens
  light chain complementarity determining region 3 for antibody 27717
QQYGRSPWT

SEQ ID NO: 55434 - protein, 18 aa, Homo sapiens
  heavy chain complementarity determining region 3 for antibody 27717
ATKPSIAEPGNIYWYFDL

SEQ ID NO: 55435 - protein, 9 aa, Homo sapiens
  light chain complementarity determining region 3 for antibody 27718
QQYGRSPWP

SEQ ID NO: 55436 - protein, 18 aa, Homo sapiens
  heavy chain complementarity determining region 3 for antibody 27718
ATNPSIAEPGNIYWYFDL

SEQ ID NO: 55437 - protein, 9 aa, Homo sapiens
  light chain complementarity determining region 3 for antibody 27719
QQYGRSPRT

SEQ ID NO: 55438 - protein, 15 aa, Homo sapiens
  heavy chain complementarity determining region 3 for antibody 27719
AKDGEFCGSNCYFGA

SEQ ID NO: 55439 - protein, 9 aa, Homo sapiens
  light chain complementarity determining region 3 for antibody 27720
QQYGRSPRT

SEQ ID NO: 55440 - protein, 15 aa, Homo sapiens
  heavy chain complementarity determining region 3 for antibody 27720
AKDGECCGSNCYFGS

SEQ ID NO: 55441 - protein, 10 aa, Homo sapiens
  light chain complementarity determining region 3 for antibody 27721
QQYGRSPPFT

SEQ ID NO: 55442 - protein, 14 aa, Homo sapiens
  heavy chain complementarity determining region 3 for antibody 27721
ARDLRWLVLGRLDY

SEQ ID NO: 55443 - protein, 9 aa, Homo sapiens
  light chain complementarity determining region 3 for antibody 27722
QQYGRSPFT

SEQ ID NO: 55444 - protein, 21 aa, Homo sapiens
  heavy chain complementarity determining region 3 for antibody 27722
ARVGVERNRYGRTLPVWYFDY

SEQ ID NO: 55445 - protein, 9 aa, Homo sapiens
  light chain complementarity determining region 3 for antibody 27723
QQYGRRPRT

SEQ ID NO: 55446 - protein, 9 aa, Homo sapiens
  heavy chain complementarity determining region 3 for antibody 27723
AREWSALDF

SEQ ID NO: 55447 - protein, 9 aa, Homo sapiens
  light chain complementarity determining region 3 for antibody 27724
QQYGRPWWT

SEQ ID NO: 55448 - protein, 15 aa, Homo sapiens
  heavy chain complementarity determining region 3 for antibody 27724
ARHMARDSIGYYHDF

SEQ ID NO: 55449 - protein, 6 aa, Homo sapiens
  light chain complementarity determining region 3 for antibody 27725
QQYGRP

SEQ ID NO: 55450 - protein, 9 aa, Homo sapiens
  heavy chain complementarity determining region 3 for antibody 27725
ARGGHWFDP

SEQ ID NO: 55451 - protein, 9 aa, Homo sapiens
  light chain complementarity determining region 3 for antibody 27726
QQYGRLPIT

SEQ ID NO: 55452 - protein, 11 aa, Homo sapiens
  heavy chain complementarity determining region 3 for antibody 27726
AHRFRPYYFDF

SEQ ID NO: 55453 - protein, 9 aa, Homo sapiens
  light chain complementarity determining region 3 for antibody 27727
QQYGRFPYT

SEQ ID NO: 55454 - protein, 14 aa, Homo sapiens
  heavy chain complementarity determining region 3 for antibody 27727
ARGGFIVAWGLFDY

SEQ ID NO: 55455 - protein, 9 aa, Homo sapiens
  light chain complementarity determining region 3 for antibody 27728
QQYGNVPYT

SEQ ID NO: 55456 - protein, 15 aa, Homo sapiens
  heavy chain complementarity determining region 3 for antibody 27728
VRDHSNTSYVDYYDL

SEQ ID NO: 55457 - protein, 9 aa, Homo sapiens
  light chain complementarity determining region 3 for antibody 27729
QQYGNVPST

SEQ ID NO: 55458 - protein, 15 aa, Homo sapiens
  heavy chain complementarity determining region 3 for antibody 27729
VRDHSNTYYVDYYDL

SEQ ID NO: 55459 - protein, 9 aa, Homo sapiens
  light chain complementarity determining region 3 for antibody 27730
QQYGNVPHT

SEQ ID NO: 55460 - protein, 15 aa, Homo sapiens
  heavy chain complementarity determining region 3 for antibody 27730
VRDHSNTYYVDYYDL

SEQ ID NO: 55461 - protein, 9 aa, Homo sapiens
  light chain complementarity determining region 3 for antibody 27731
QQYGNSPWT

SEQ ID NO: 55462 - protein, 17 aa, Homo sapiens
  heavy chain complementarity determining region 3 for antibody 27731
ARASVAAPGRIQWYFDL

SEQ ID NO: 55463 - protein, 9 aa, Homo sapiens
  light chain complementarity determining region 3 for antibody 27732
QQYGNSPLT

SEQ ID NO: 55464 - protein, 13 aa, Homo sapiens
  heavy chain complementarity determining region 3 for antibody 27732
ASKTSVRTCSSDL

SEQ ID NO: 55465 - protein, 9 aa, Homo sapiens
  light chain complementarity determining region 3 for antibody 27733
QQYGNSPLT

SEQ ID NO: 55466 - protein, 17 aa, Homo sapiens
  heavy chain complementarity determining region 3 for antibody 27733
ALASVAAPGRIQWYFDL

SEQ ID NO: 55467 - protein, 9 aa, Homo sapiens
  light chain complementarity determining region 3 for antibody 27734
QQYGNSPLN

SEQ ID NO: 55468 - protein, 13 aa, Homo sapiens
  heavy chain complementarity determining region 3 for antibody 27734
ASKTSVRTYSSDL

SEQ ID NO: 55469 - protein, 9 aa, Homo sapiens
  light chain complementarity determining region 3 for antibody 27735
QQYGNSPIT

SEQ ID NO: 55470 - protein, 13 aa, Homo sapiens
  heavy chain complementarity determining region 3 for antibody 27735
ASKTSVRTYSSDL

SEQ ID NO: 55471 - protein, 9 aa, Homo sapiens
  light chain complementarity determining region 3 for antibody 27736
QQYGNSPFT

SEQ ID NO: 55472 - protein, 15 aa, Homo sapiens
  heavy chain complementarity determining region 3 for antibody 27736
ARQKGQRAAAGYFDS

SEQ ID NO: 55473 - protein, 9 aa, Homo sapiens
  light chain complementarity determining region 3 for antibody 27737
QQYGNLPRT

SEQ ID NO: 55474 - protein, 13 aa, Homo sapiens
  heavy chain complementarity determining region 3 for antibody 27737
ASGYGSGTYYREN

SEQ ID NO: 55475 - protein, 9 aa, Homo sapiens
  light chain complementarity determining region 3 for antibody 27738
QQYGNLPRT

SEQ ID NO: 55476 - protein, 13 aa, Homo sapiens
  heavy chain complementarity determining region 3 for antibody 27738
AGGLFHSSGYSEF

SEQ ID NO: 55477 - protein, 9 aa, Homo sapiens
  light chain complementarity determining region 3 for antibody 27739
QQYGNLPRT

SEQ ID NO: 55478 - protein, 13 aa, Homo sapiens
  heavy chain complementarity determining region 3 for antibody 27739
AGGDFHRGGYSDY

SEQ ID NO: 55479 - protein, 9 aa, Homo sapiens
  light chain complementarity determining region 3 for antibody 27740
QQYGNLPGT

SEQ ID NO: 55480 - protein, 13 aa, Homo sapiens
  heavy chain complementarity determining region 3 for antibody 27740
AGGNFHSGGYGEY

SEQ ID NO: 55481 - protein, 9 aa, Homo sapiens
  light chain complementarity determining region 3 for antibody 27741
QQYGNKPRT

SEQ ID NO: 55482 - protein, 14 aa, Homo sapiens
  heavy chain complementarity determining region 3 for antibody 27741
AGGTFDSSGYYYEY

SEQ ID NO: 55483 - protein, 9 aa, Homo sapiens
  light chain complementarity determining region 3 for antibody 27742
QQYGNIPWT

SEQ ID NO: 55484 - protein, 14 aa, Homo sapiens
  heavy chain complementarity determining region 3 for antibody 27742
AKCGYSYGNDAFDI

SEQ ID NO: 55485 - protein, 9 aa, Homo sapiens
  light chain complementarity determining region 3 for antibody 27743
QQYGNIPRP

SEQ ID NO: 55486 - protein, 13 aa, Homo sapiens
  heavy chain complementarity determining region 3 for antibody 27743
AGGTWHSGIYYES

SEQ ID NO: 55487 - protein, 9 aa, Homo sapiens
  light chain complementarity determining region 3 for antibody 27744
QQYGNFPRT

SEQ ID NO: 55488 - protein, 13 aa, Homo sapiens
  heavy chain complementarity determining region 3 for antibody 27744
AGGLYDRSGYSEY

SEQ ID NO: 55489 - protein, 9 aa, Homo sapiens
  light chain complementarity determining region 3 for antibody 27745
QQYGMSVLT

SEQ ID NO: 55490 - protein, 17 aa, Homo sapiens
  heavy chain complementarity determining region 3 for antibody 27745
ARPGSGFGYDNEDAFDI

SEQ ID NO: 55491 - protein, 9 aa, Homo sapiens
  light chain complementarity determining region 3 for antibody 27746
QQYGLSPGT

SEQ ID NO: 55492 - protein, 15 aa, Homo sapiens
  heavy chain complementarity determining region 3 for antibody 27746
AFRGIQVVNGVRFDY

SEQ ID NO: 55493 - protein, 9 aa, Homo sapiens
  light chain complementarity determining region 3 for antibody 27747
QQYGLFRET

SEQ ID NO: 55494 - protein, 16 aa, Homo sapiens
  heavy chain complementarity determining region 3 for antibody 27747
ARWGVECSGGYCYFEY

SEQ ID NO: 55495 - protein, 9 aa, Homo sapiens
  light chain complementarity determining region 3 for antibody 27748
QQYGKSPGT

SEQ ID NO: 55496 - protein, 22 aa, Homo sapiens
  heavy chain complementarity determining region 3 for antibody 27748
ARGECSYDGSNYLWLEVEYFQN

SEQ ID NO: 55497 - protein, 6 aa, Homo sapiens
  light chain complementarity determining region 3 for antibody 27749
QQYGIT

SEQ ID NO: 55498 - protein, 12 aa, Homo sapiens
  heavy chain complementarity determining region 3 for antibody 27749
ARFANSWYPYDF

SEQ ID NO: 55499 - protein, 11 aa, Homo sapiens
  light chain complementarity determining region 3 for antibody 27750
QQYGISPPHWP

SEQ ID NO: 55500 - protein, 12 aa, Homo sapiens
  heavy chain complementarity determining region 3 for antibody 27750
VKEKGGVRVFDF

SEQ ID NO: 55501 - protein, 9 aa, Homo sapiens
  light chain complementarity determining region 3 for antibody 27751
QQYGILPRT

SEQ ID NO: 55502 - protein, 13 aa, Homo sapiens
  heavy chain complementarity determining region 3 for antibody 27751
AGGNFHSGGYGEY

SEQ ID NO: 55503 - protein, 10 aa, Homo sapiens
  light chain complementarity determining region 3 for antibody 27752
QQYGHPTQIT

SEQ ID NO: 55504 - protein, 16 aa, Homo sapiens
  heavy chain complementarity determining region 3 for antibody 27752
TREIRGVIKPEEDFDY

SEQ ID NO: 55505 - protein, 9 aa, Homo sapiens
  light chain complementarity determining region 3 for antibody 27753
QQYGHLPRT

SEQ ID NO: 55506 - protein, 13 aa, Homo sapiens
  heavy chain complementarity determining region 3 for antibody 27753
AGGNFHSGGYGEY

SEQ ID NO: 55507 - protein, 9 aa, Homo sapiens
  light chain complementarity determining region 3 for antibody 27754
QQYGGTWWT

SEQ ID NO: 55508 - protein, 15 aa, Homo sapiens
  heavy chain complementarity determining region 3 for antibody 27754
ARHMARDSIGYYHDF

SEQ ID NO: 55509 - protein, 9 aa, Homo sapiens
  light chain complementarity determining region 3 for antibody 27755
QQYGGSTRT

SEQ ID NO: 55510 - protein, 15 aa, Homo sapiens
  heavy chain complementarity determining region 3 for antibody 27755
ARGGRGPGMAHCFDL

SEQ ID NO: 55511 - protein, 9 aa, Homo sapiens
  light chain complementarity determining region 3 for antibody 27756
QQYGGSTGP

SEQ ID NO: 55512 - protein, 15 aa, Homo sapiens
  heavy chain complementarity determining region 3 for antibody 27756
ARGGRGPGMAHCFDL

SEQ ID NO: 55513 - protein, 9 aa, Homo sapiens
  light chain complementarity determining region 3 for antibody 27757
QQYGGSSYT

SEQ ID NO: 55514 - protein, 16 aa, Homo sapiens
  heavy chain complementarity determining region 3 for antibody 27757
ANWFGSVGGFLGPFDY

SEQ ID NO: 55515 - protein, 9 aa, Homo sapiens
  light chain complementarity determining region 3 for antibody 27758
QQYGGSSYT

SEQ ID NO: 55516 - protein, 16 aa, Homo sapiens
  heavy chain complementarity determining region 3 for antibody 27758
ANWFGSVGAFLGPFDY

SEQ ID NO: 55517 - protein, 9 aa, Homo sapiens
  light chain complementarity determining region 3 for antibody 27759
QQYGGSSYT

SEQ ID NO: 55518 - protein, 16 aa, Homo sapiens
  heavy chain complementarity determining region 3 for antibody 27759
ANWCGSVGDFLGPFDY

SEQ ID NO: 55519 - protein, 9 aa, Homo sapiens
  light chain complementarity determining region 3 for antibody 27760
QQYGGSSYP

SEQ ID NO: 55520 - protein, 15 aa, Homo sapiens
  heavy chain complementarity determining region 3 for antibody 27760
AKDMLPGDTSMVFDY

SEQ ID NO: 55521 - protein, 9 aa, Homo sapiens
  light chain complementarity determining region 3 for antibody 27761
QQYGGSSST

SEQ ID NO: 55522 - protein, 15 aa, Homo sapiens
  heavy chain complementarity determining region 3 for antibody 27761
AKDMLPGDTSMVFDY

SEQ ID NO: 55523 - protein, 9 aa, Homo sapiens
  light chain complementarity determining region 3 for antibody 27762
QQYGGSSFT

SEQ ID NO: 55524 - protein, 16 aa, Homo sapiens
  heavy chain complementarity determining region 3 for antibody 27762
ANWFGSVGDFLGPFDY

SEQ ID NO: 55525 - protein, 9 aa, Homo sapiens
  light chain complementarity determining region 3 for antibody 27763
QQYGGSSDT

SEQ ID NO: 55526 - protein, 16 aa, Homo sapiens
  heavy chain complementarity determining region 3 for antibody 27763
ANWFGSVGDFLGPFDY

SEQ ID NO: 55527 - protein, 8 aa, Homo sapiens
  light chain complementarity determining region 3 for antibody 27764
QQYGGSPS

SEQ ID NO: 55528 - protein, 16 aa, Homo sapiens
  heavy chain complementarity determining region 3 for antibody 27764
AADWGSGTQWIRAFDV

SEQ ID NO: 55529 - protein, 10 aa, Homo sapiens
  light chain complementarity determining region 3 for antibody 27765
QQYGGSPQHT

SEQ ID NO: 55530 - protein, 15 aa, Homo sapiens
  heavy chain complementarity determining region 3 for antibody 27765
ARDDRFATRFHSLDT

SEQ ID NO: 55531 - protein, 10 aa, Homo sapiens
  light chain complementarity determining region 3 for antibody 27766
QQYGGSPQFT

SEQ ID NO: 55532 - protein, 15 aa, Homo sapiens
  heavy chain complementarity determining region 3 for antibody 27766
ARDDRFATRFHSLDT

SEQ ID NO: 55533 - protein, 10 aa, Homo sapiens
  light chain complementarity determining region 3 for antibody 27767
QQYGGSPPIT

SEQ ID NO: 55534 - protein, 15 aa, Homo sapiens
  heavy chain complementarity determining region 3 for antibody 27767
AKRTPQDLGNYYFDS

SEQ ID NO: 55535 - protein, 11 aa, Homo sapiens
  light chain complementarity determining region 3 for antibody 27768
QQYGGSPPALT

SEQ ID NO: 55536 - protein, 17 aa, Homo sapiens
  heavy chain complementarity determining region 3 for antibody 27768
ARVSGGGYYKLYYGMDV

SEQ ID NO: 55537 - protein, 10 aa, Homo sapiens
  light chain complementarity determining region 3 for antibody 27769
QQYGGSPAVP

SEQ ID NO: 55538 - protein, 12 aa, Homo sapiens
  heavy chain complementarity determining region 3 for antibody 27769
AKAKIRIIYFDY

SEQ ID NO: 55539 - protein, 10 aa, Homo sapiens
  light chain complementarity determining region 3 for antibody 27770
QQYGGSAGGT

SEQ ID NO: 55540 - protein, 14 aa, Homo sapiens
  heavy chain complementarity determining region 3 for antibody 27770
AREFCRGGNCCFDS

SEQ ID NO: 55541 - protein, 9 aa, Homo sapiens
  light chain complementarity determining region 3 for antibody 27771
QQYGGPTGT

SEQ ID NO: 55542 - protein, 15 aa, Homo sapiens
  heavy chain complementarity determining region 3 for antibody 27771
ARGGRGPGMAHCFDL

SEQ ID NO: 55543 - protein, 9 aa, Homo sapiens
  light chain complementarity determining region 3 for antibody 27772
QQYGGPSYT

SEQ ID NO: 55544 - protein, 16 aa, Homo sapiens
  heavy chain complementarity determining region 3 for antibody 27772
ANWFGSVGDFLGPFDY

SEQ ID NO: 55545 - protein, 9 aa, Homo sapiens
  light chain complementarity determining region 3 for antibody 27773
QQYGGPRGT

SEQ ID NO: 55546 - protein, 16 aa, Homo sapiens
  heavy chain complementarity determining region 3 for antibody 27773
ARVVWGGSWYVGYFDP

SEQ ID NO: 55547 - protein, 9 aa, Homo sapiens
  light chain complementarity determining region 3 for antibody 27774
QQYGGASYT

SEQ ID NO: 55548 - protein, 16 aa, Homo sapiens
  heavy chain complementarity determining region 3 for antibody 27774
ANWFGSVGDFLGPFDY

SEQ ID NO: 55549 - protein, 10 aa, Homo sapiens
  light chain complementarity determining region 3 for antibody 27775
QQYGDSPPYP

SEQ ID NO: 55550 - protein, 15 aa, Homo sapiens
  heavy chain complementarity determining region 3 for antibody 27775
ARGGSSSWAYSYFAL

SEQ ID NO: 55551 - protein, 9 aa, Homo sapiens
  light chain complementarity determining region 3 for antibody 27776
QQYGDSPLP

SEQ ID NO: 55552 - protein, 15 aa, Homo sapiens
  heavy chain complementarity determining region 3 for antibody 27776
AKGRRGSYSHDAFDV

SEQ ID NO: 55553 - protein, 10 aa, Homo sapiens
  light chain complementarity determining region 3 for antibody 27777
QQYGDSPDVT

SEQ ID NO: 55554 - protein, 16 aa, Homo sapiens
  heavy chain complementarity determining region 3 for antibody 27777
ARDATFWFGEFTFLDH

SEQ ID NO: 55555 - protein, 10 aa, Homo sapiens
  light chain complementarity determining region 3 for antibody 27778
QQYGDSPDVA

SEQ ID NO: 55556 - protein, 16 aa, Homo sapiens
  heavy chain complementarity determining region 3 for antibody 27778
ARDATFWFGEFTFFDH

SEQ ID NO: 55557 - protein, 10 aa, Homo sapiens
  light chain complementarity determining region 3 for antibody 27779
QQYGDSPAVT

SEQ ID NO: 55558 - protein, 16 aa, Homo sapiens
  heavy chain complementarity determining region 3 for antibody 27779
ARDATFWFGEFTFFDH

SEQ ID NO: 55559 - protein, 8 aa, Homo sapiens
  light chain complementarity determining region 3 for antibody 27780
QQYGDSMT

SEQ ID NO: 55560 - protein, 16 aa, Homo sapiens
  heavy chain complementarity determining region 3 for antibody 27780
ARVLSIIRGVMSPFDL

SEQ ID NO: 55561 - protein, 9 aa, Homo sapiens
  light chain complementarity determining region 3 for antibody 27781
QQYGDFPFT

SEQ ID NO: 55562 - protein, 13 aa, Homo sapiens
  heavy chain complementarity determining region 3 for antibody 27781
ARDANWFGSGIPD

SEQ ID NO: 55563 - protein, 9 aa, Homo sapiens
  light chain complementarity determining region 3 for antibody 27782
QQYGCSSYT

SEQ ID NO: 55564 - protein, 16 aa, Homo sapiens
  heavy chain complementarity determining region 3 for antibody 27782
ANWFGSVGDFLGPFDY

SEQ ID NO: 55565 - protein, 9 aa, Homo sapiens
  light chain complementarity determining region 3 for antibody 27783
QQYGCLPLT

SEQ ID NO: 55566 - protein, 15 aa, Homo sapiens
  heavy chain complementarity determining region 3 for antibody 27783
AHRPNYYDKAGAFDI

SEQ ID NO: 55567 - protein, 9 aa, Homo sapiens
  light chain complementarity determining region 3 for antibody 27784
QQYFTSLRP

SEQ ID NO: 55568 - protein, 12 aa, Homo sapiens
  heavy chain complementarity determining region 3 for antibody 27784
VKDCGLGGSRDS

SEQ ID NO: 55569 - protein, 9 aa, Homo sapiens
  light chain complementarity determining region 3 for antibody 27785
QQYFSAPGT

SEQ ID NO: 55570 - protein, 18 aa, Homo sapiens
  heavy chain complementarity determining region 3 for antibody 27785
ARGVGGYCNNGVCHYFDY

SEQ ID NO: 55571 - protein, 9 aa, Homo sapiens
  light chain complementarity determining region 3 for antibody 27786
QQYETYPWP

SEQ ID NO: 55572 - protein, 17 aa, Homo sapiens
  heavy chain complementarity determining region 3 for antibody 27786
VRRGGGLPDDRDYGLDV

SEQ ID NO: 55573 - protein, 11 aa, Homo sapiens
  light chain complementarity determining region 3 for antibody 27787
QQYETSPPGNT

SEQ ID NO: 55574 - protein, 14 aa, Homo sapiens
  heavy chain complementarity determining region 3 for antibody 27787
ARENSISRKRSFDQ

SEQ ID NO: 55575 - protein, 11 aa, Homo sapiens
  light chain complementarity determining region 3 for antibody 27788
QQYETSPPGHT

SEQ ID NO: 55576 - protein, 14 aa, Homo sapiens
  heavy chain complementarity determining region 3 for antibody 27788
ARENSISRKRSFDQ

SEQ ID NO: 55577 - protein, 8 aa, Homo sapiens
  light chain complementarity determining region 3 for antibody 27789
QQYETFSS

SEQ ID NO: 55578 - protein, 22 aa, Homo sapiens
  heavy chain complementarity determining region 3 for antibody 27789
VRGEYFYDGSHYLWLTTEYFQH

SEQ ID NO: 55579 - protein, 9 aa, Homo sapiens
  light chain complementarity determining region 3 for antibody 27790
QQYETFPWT

SEQ ID NO: 55580 - protein, 17 aa, Homo sapiens
  heavy chain complementarity determining region 3 for antibody 27790
VRRGGGLPDDRDYGLDV

SEQ ID NO: 55581 - protein, 9 aa, Homo sapiens
  light chain complementarity determining region 3 for antibody 27791
QQYESLPPT

SEQ ID NO: 55582 - protein, 12 aa, Homo sapiens
  heavy chain complementarity determining region 3 for antibody 27791
VRDRVAGDAFDP

SEQ ID NO: 55583 - protein, 9 aa, Homo sapiens
  light chain complementarity determining region 3 for antibody 27792
QQYERSPWT

SEQ ID NO: 55584 - protein, 18 aa, Homo sapiens
  heavy chain complementarity determining region 3 for antibody 27792
ARQIDYGDYASYHGYCDV

SEQ ID NO: 55585 - protein, 8 aa, Homo sapiens
  light chain complementarity determining region 3 for antibody 27793
QQYDYFPA

SEQ ID NO: 55586 - protein, 12 aa, Homo sapiens
  heavy chain complementarity determining region 3 for antibody 27793
ARSNWNIIAFDL

SEQ ID NO: 55587 - protein, 9 aa, Homo sapiens
  light chain complementarity determining region 3 for antibody 27794
QQYDTYPLT

SEQ ID NO: 55588 - protein, 23 aa, Homo sapiens
  heavy chain complementarity determining region 3 for antibody 27794
ARGRTYYFDSSGYPDYYFYLMDV

SEQ ID NO: 55589 - protein, 11 aa, Homo sapiens
  light chain complementarity determining region 3 for antibody 27795
QQYDTSPPGYP

SEQ ID NO: 55590 - protein, 14 aa, Homo sapiens
  heavy chain complementarity determining region 3 for antibody 27795
ARETSNSRKRSFDQ

SEQ ID NO: 55591 - protein, 9 aa, Homo sapiens
  light chain complementarity determining region 3 for antibody 27796
QQYDTPPWT

SEQ ID NO: 55592 - protein, 15 aa, Homo sapiens
  heavy chain complementarity determining region 3 for antibody 27796
VHTQLWFGDQCYFDF

SEQ ID NO: 55593 - protein, 9 aa, Homo sapiens
  light chain complementarity determining region 3 for antibody 27797
QQYDTPPWT

SEQ ID NO: 55594 - protein, 13 aa, Homo sapiens
  heavy chain complementarity determining region 3 for antibody 27797
ARETLIHLPAFDH

SEQ ID NO: 55595 - protein, 9 aa, Homo sapiens
  light chain complementarity determining region 3 for antibody 27798
QQYDSSPWT

SEQ ID NO: 55596 - protein, 18 aa, Homo sapiens
  heavy chain complementarity determining region 3 for antibody 27798
ARQIDYGDYASYHGYCDV

SEQ ID NO: 55597 - protein, 8 aa, Homo sapiens
  light chain complementarity determining region 3 for antibody 27799
QQYDSSPT

SEQ ID NO: 55598 - protein, 18 aa, Homo sapiens
  heavy chain complementarity determining region 3 for antibody 27799
VRDRLNSGRFGLCGAFEI

SEQ ID NO: 55599 - protein, 9 aa, Homo sapiens
  light chain complementarity determining region 3 for antibody 27800
QQYDSSPFT

SEQ ID NO: 55600 - protein, 17 aa, Homo sapiens
  heavy chain complementarity determining region 3 for antibody 27800
ARDRGSSWYAGAEHFQY

SEQ ID NO: 55601 - protein, 9 aa, Homo sapiens
  light chain complementarity determining region 3 for antibody 27801
QQYDSLPLT

SEQ ID NO: 55602 - protein, 19 aa, Homo sapiens
  heavy chain complementarity determining region 3 for antibody 27801
ARTAIGKRYWASSGDQFDY

SEQ ID NO: 55603 - protein, 9 aa, Homo sapiens
  light chain complementarity determining region 3 for antibody 27802
QQYDRSSYT

SEQ ID NO: 55604 - protein, 11 aa, Homo sapiens
  heavy chain complementarity determining region 3 for antibody 27802
ARGGFYGSFDF

SEQ ID NO: 55605 - protein, 8 aa, Homo sapiens
  light chain complementarity determining region 3 for antibody 27803
QQYDRLPT

SEQ ID NO: 55606 - protein, 17 aa, Homo sapiens
  heavy chain complementarity determining region 3 for antibody 27803
AVPTLGKHDPLPAAFNV

SEQ ID NO: 55607 - protein, 9 aa, Homo sapiens
  light chain complementarity determining region 3 for antibody 27804
QQYDNYSWT

SEQ ID NO: 55608 - protein, 12 aa, Homo sapiens
  heavy chain complementarity determining region 3 for antibody 27804
AKDSAKKWELLD

SEQ ID NO: 55609 - protein, 8 aa, Homo sapiens
  light chain complementarity determining region 3 for antibody 27805
QQYDNVPP

SEQ ID NO: 55610 - protein, 15 aa, Homo sapiens
  heavy chain complementarity determining region 3 for antibody 27805
ARTSTIFGMVIAFDY

SEQ ID NO: 55611 - protein, 9 aa, Homo sapiens
  light chain complementarity determining region 3 for antibody 27806
QQYDNSRLP

SEQ ID NO: 55612 - protein, 23 aa, Homo sapiens
  heavy chain complementarity determining region 3 for antibody 27806
ARGPAGAAYGTTFARPRGGYFGV

SEQ ID NO: 55613 - protein, 9 aa, Homo sapiens
  light chain complementarity determining region 3 for antibody 27807
QQYDNSPPT

SEQ ID NO: 55614 - protein, 19 aa, Homo sapiens
  heavy chain complementarity determining region 3 for antibody 27807
ARDHFPWARGVVSYFYYNY

SEQ ID NO: 55615 - protein, 9 aa, Homo sapiens
  light chain complementarity determining region 3 for antibody 27808
QQYDNSLFT

SEQ ID NO: 55616 - protein, 15 aa, Homo sapiens
  heavy chain complementarity determining region 3 for antibody 27808
AMTGIVGFPQEDVDV

SEQ ID NO: 55617 - protein, 11 aa, Homo sapiens
  light chain complementarity determining region 3 for antibody 27809
QQYDNSDLEFT

SEQ ID NO: 55618 - protein, 15 aa, Homo sapiens
  heavy chain complementarity determining region 3 for antibody 27809
VREVVTMIEPGGFDV

SEQ ID NO: 55619 - protein, 11 aa, Homo sapiens
  light chain complementarity determining region 3 for antibody 27810
QQYDNSALELT

SEQ ID NO: 55620 - protein, 15 aa, Homo sapiens
  heavy chain complementarity determining region 3 for antibody 27810
VREVVTMIEPGGFDV

SEQ ID NO: 55621 - protein, 11 aa, Homo sapiens
  light chain complementarity determining region 3 for antibody 27811
QQYDNSALEFT

SEQ ID NO: 55622 - protein, 15 aa, Homo sapiens
  heavy chain complementarity determining region 3 for antibody 27811
VREVVTMIDPGGFDV

SEQ ID NO: 55623 - protein, 10 aa, Homo sapiens
  light chain complementarity determining region 3 for antibody 27812
QQYDNLPTYT

SEQ ID NO: 55624 - protein, 17 aa, Homo sapiens
  heavy chain complementarity determining region 3 for antibody 27812
ARTSGSYWGYYYYGMDV

SEQ ID NO: 55625 - protein, 9 aa, Homo sapiens
  light chain complementarity determining region 3 for antibody 27813
QQYDNLPPT

SEQ ID NO: 55626 - protein, 17 aa, Homo sapiens
  heavy chain complementarity determining region 3 for antibody 27813
GYSYGARESYYYYGMDV

SEQ ID NO: 55627 - protein, 9 aa, Homo sapiens
  light chain complementarity determining region 3 for antibody 27814
QQYDNLPPT

SEQ ID NO: 55628 - protein, 17 aa, Homo sapiens
  heavy chain complementarity determining region 3 for antibody 27814
GCSYGSRESYYYYGMDV

SEQ ID NO: 55629 - protein, 9 aa, Homo sapiens
  light chain complementarity determining region 3 for antibody 27815
QQYDNFPPT

SEQ ID NO: 55630 - protein, 9 aa, Homo sapiens
  heavy chain complementarity determining region 3 for antibody 27815
ARGLEWYAP

SEQ ID NO: 55631 - protein, 9 aa, Homo sapiens
  light chain complementarity determining region 3 for antibody 27816
QQYDLLRET

SEQ ID NO: 55632 - protein, 16 aa, Homo sapiens
  heavy chain complementarity determining region 3 for antibody 27816
ARWGVECSGGYCYFEY

SEQ ID NO: 55633 - protein, 9 aa, Homo sapiens
  light chain complementarity determining region 3 for antibody 27817
QQYDLFREP

SEQ ID NO: 55634 - protein, 16 aa, Homo sapiens
  heavy chain complementarity determining region 3 for antibody 27817
ARWGVECSGGYCYFEY

SEQ ID NO: 55635 - protein, 8 aa, Homo sapiens
  light chain complementarity determining region 3 for antibody 27818
QQYDKVYT

SEQ ID NO: 55636 - protein, 13 aa, Homo sapiens
  heavy chain complementarity determining region 3 for antibody 27818
VTGGIYTTGPLDF

SEQ ID NO: 55637 - protein, 8 aa, Homo sapiens
  light chain complementarity determining region 3 for antibody 27819
QQYDKLYT

SEQ ID NO: 55638 - protein, 13 aa, Homo sapiens
  heavy chain complementarity determining region 3 for antibody 27819
VTGGIYTPGPLDF

SEQ ID NO: 55639 - protein, 8 aa, Homo sapiens
  light chain complementarity determining region 3 for antibody 27820
QQYDKLYT

SEQ ID NO: 55640 - protein, 13 aa, Homo sapiens
  heavy chain complementarity determining region 3 for antibody 27820
VTGGIYATGPLDF

SEQ ID NO: 55641 - protein, 9 aa, Homo sapiens
  light chain complementarity determining region 3 for antibody 27821
QQYDISPLT

SEQ ID NO: 55642 - protein, 16 aa, Homo sapiens
  heavy chain complementarity determining region 3 for antibody 27821
AREAKDYGDYVDAFDV

SEQ ID NO: 55643 - protein, 10 aa, Homo sapiens
  light chain complementarity determining region 3 for antibody 27822
QQYDGWPPIT

SEQ ID NO: 55644 - protein, 12 aa, Homo sapiens
  heavy chain complementarity determining region 3 for antibody 27822
VRHGVVTAEHDS

SEQ ID NO: 55645 - protein, 8 aa, Homo sapiens
  light chain complementarity determining region 3 for antibody 27823
QQYDFAIS

SEQ ID NO: 55646 - protein, 7 aa, Homo sapiens
  heavy chain complementarity determining region 3 for antibody 27823
ARDFGDY

SEQ ID NO: 55647 - protein, 9 aa, Homo sapiens
  light chain complementarity determining region 3 for antibody 27824
QQYDDRPEP

SEQ ID NO: 55648 - protein, 17 aa, Homo sapiens
  heavy chain complementarity determining region 3 for antibody 27824
SRRQILGTRVRGRPTDY

SEQ ID NO: 55649 - protein, 9 aa, Homo sapiens
  light chain complementarity determining region 3 for antibody 27825
QQYDDLPYT

SEQ ID NO: 55650 - protein, 13 aa, Homo sapiens
  heavy chain complementarity determining region 3 for antibody 27825
ARGITIRQPDLDY

SEQ ID NO: 55651 - protein, 9 aa, Homo sapiens
  light chain complementarity determining region 3 for antibody 27826
QQYDDFPIT

SEQ ID NO: 55652 - protein, 11 aa, Homo sapiens
  heavy chain complementarity determining region 3 for antibody 27826
AAGRSFFNLDT

SEQ ID NO: 55653 - protein, 9 aa, Homo sapiens
  light chain complementarity determining region 3 for antibody 27827
QQYDCLPYT

SEQ ID NO: 55654 - protein, 17 aa, Homo sapiens
  heavy chain complementarity determining region 3 for antibody 27827
ARSRGYSRGWYSGQFDN

SEQ ID NO: 55655 - protein, 9 aa, Homo sapiens
  light chain complementarity determining region 3 for antibody 27828
QQYDAQSWR

SEQ ID NO: 55656 - protein, 11 aa, Homo sapiens
  heavy chain complementarity determining region 3 for antibody 27828
ARGWRDNSFDY

SEQ ID NO: 55657 - protein, 9 aa, Homo sapiens
  light chain complementarity determining region 3 for antibody 27829
QQYDAQSRT

SEQ ID NO: 55658 - protein, 11 aa, Homo sapiens
  heavy chain complementarity determining region 3 for antibody 27829
ARGWRDNSFDY

SEQ ID NO: 55659 - protein, 9 aa, Homo sapiens
  light chain complementarity determining region 3 for antibody 27830
QQYDAQSGT

SEQ ID NO: 55660 - protein, 11 aa, Homo sapiens
  heavy chain complementarity determining region 3 for antibody 27830
ARGWRDNSFDY

SEQ ID NO: 55661 - protein, 9 aa, Homo sapiens
  light chain complementarity determining region 3 for antibody 27831
QQYDAPSWT

SEQ ID NO: 55662 - protein, 11 aa, Homo sapiens
  heavy chain complementarity determining region 3 for antibody 27831
ARGWRDNSFDY

SEQ ID NO: 55663 - protein, 9 aa, Homo sapiens
  light chain complementarity determining region 3 for antibody 27832
QQYCTTPTT

SEQ ID NO: 55664 - protein, 8 aa, Homo sapiens
  heavy chain complementarity determining region 3 for antibody 27832
VKLSDGIK

SEQ ID NO: 55665 - protein, 9 aa, Homo sapiens
  light chain complementarity determining region 3 for antibody 27833
QQYCTTPIT

SEQ ID NO: 55666 - protein, 8 aa, Homo sapiens
  heavy chain complementarity determining region 3 for antibody 27833
VKLSDGIN

SEQ ID NO: 55667 - protein, 9 aa, Homo sapiens
  light chain complementarity determining region 3 for antibody 27834
QQYCTTPIT

SEQ ID NO: 55668 - protein, 8 aa, Homo sapiens
  heavy chain complementarity determining region 3 for antibody 27834
VKFSDGSK

SEQ ID NO: 55669 - protein, 9 aa, Homo sapiens
  light chain complementarity determining region 3 for antibody 27835
QQYCSSPRT

SEQ ID NO: 55670 - protein, 25 aa, Homo sapiens
  heavy chain complementarity determining region 3 for antibody 27835
ARLRIDRLRLPGAMRGPLYDCGLNV

SEQ ID NO: 55671 - protein, 9 aa, Homo sapiens
  light chain complementarity determining region 3 for antibody 27836
QQYCRSPST

SEQ ID NO: 55672 - protein, 17 aa, Homo sapiens
  heavy chain complementarity determining region 3 for antibody 27836
AGLSSRLGDGSPSLFDY

SEQ ID NO: 55673 - protein, 9 aa, Homo sapiens
  light chain complementarity determining region 3 for antibody 27837
QQYAYSTIT

SEQ ID NO: 55674 - protein, 10 aa, Homo sapiens
  heavy chain complementarity determining region 3 for antibody 27837
ATGAGWLVDY

SEQ ID NO: 55675 - protein, 9 aa, Homo sapiens
  light chain complementarity determining region 3 for antibody 27838
QQYAYSPTT

SEQ ID NO: 55676 - protein, 10 aa, Homo sapiens
  heavy chain complementarity determining region 3 for antibody 27838
ATGAGWLVDY

SEQ ID NO: 55677 - protein, 9 aa, Homo sapiens
  light chain complementarity determining region 3 for antibody 27839
QQYAYSPLT

SEQ ID NO: 55678 - protein, 10 aa, Homo sapiens
  heavy chain complementarity determining region 3 for antibody 27839
ATGAGWLVDY

SEQ ID NO: 55679 - protein, 9 aa, Homo sapiens
  light chain complementarity determining region 3 for antibody 27840
QQYATSPRT

SEQ ID NO: 55680 - protein, 10 aa, Homo sapiens
  heavy chain complementarity determining region 3 for antibody 27840
VAGAGWLPDY

SEQ ID NO: 55681 - protein, 9 aa, Homo sapiens
  light chain complementarity determining region 3 for antibody 27841
QQYATSPPT

SEQ ID NO: 55682 - protein, 10 aa, Homo sapiens
  heavy chain complementarity determining region 3 for antibody 27841
VAGAGWLPDY

SEQ ID NO: 55683 - protein, 9 aa, Homo sapiens
  light chain complementarity determining region 3 for antibody 27842
QQYATSPPT

SEQ ID NO: 55684 - protein, 10 aa, Homo sapiens
  heavy chain complementarity determining region 3 for antibody 27842
TTGGGWLVDY

SEQ ID NO: 55685 - protein, 9 aa, Homo sapiens
  light chain complementarity determining region 3 for antibody 27843
QQYATSPLT

SEQ ID NO: 55686 - protein, 10 aa, Homo sapiens
  heavy chain complementarity determining region 3 for antibody 27843
TTGGGWLFDY

SEQ ID NO: 55687 - protein, 9 aa, Homo sapiens
  light chain complementarity determining region 3 for antibody 27844
QQYAPSPLT

SEQ ID NO: 55688 - protein, 10 aa, Homo sapiens
  heavy chain complementarity determining region 3 for antibody 27844
TTGGGWLVDY

SEQ ID NO: 55689 - protein, 9 aa, Homo sapiens
  light chain complementarity determining region 3 for antibody 27845
QQYANSPPT

SEQ ID NO: 55690 - protein, 19 aa, Homo sapiens
  heavy chain complementarity determining region 3 for antibody 27845
ARDHFPLARGVVSYFYYNY

SEQ ID NO: 55691 - protein, 9 aa, Homo sapiens
  light chain complementarity determining region 3 for antibody 27846
QQYALFRET

SEQ ID NO: 55692 - protein, 16 aa, Homo sapiens
  heavy chain complementarity determining region 3 for antibody 27846
ARWGVECSGGYCYFEY

SEQ ID NO: 55693 - protein, 9 aa, Homo sapiens
  light chain complementarity determining region 3 for antibody 27847
QQYAGEPRT

SEQ ID NO: 55694 - protein, 14 aa, Homo sapiens
  heavy chain complementarity determining region 3 for antibody 27847
TRDGDNFLWGNYHY

SEQ ID NO: 55695 - protein, 9 aa, Homo sapiens
  light chain complementarity determining region 3 for antibody 27848
QQYAGAPRT

SEQ ID NO: 55696 - protein, 14 aa, Homo sapiens
  heavy chain complementarity determining region 3 for antibody 27848
TRDGDNCLWGNYHY

SEQ ID NO: 55697 - protein, 8 aa, Homo sapiens
  light chain complementarity determining region 3 for antibody 27849
QQYADWPT

SEQ ID NO: 55698 - protein, 15 aa, Homo sapiens
  heavy chain complementarity determining region 3 for antibody 27849
VKNPGGWRDTYYFHY

SEQ ID NO: 55699 - protein, 11 aa, Homo sapiens
  light chain complementarity determining region 3 for antibody 27850
QQWSTSGSSYS

SEQ ID NO: 55700 - protein, 14 aa, Homo sapiens
  heavy chain complementarity determining region 3 for antibody 27850
ARHTEMTGLRGFDR

SEQ ID NO: 55701 - protein, 11 aa, Homo sapiens
  light chain complementarity determining region 3 for antibody 27851
QQWSTSGSRSS

SEQ ID NO: 55702 - protein, 14 aa, Homo sapiens
  heavy chain complementarity determining region 3 for antibody 27851
ARHTEMTGLRGFDR

SEQ ID NO: 55703 - protein, 11 aa, Homo sapiens
  light chain complementarity determining region 3 for antibody 27852
QQWGTSGSRYP

SEQ ID NO: 55704 - protein, 14 aa, Homo sapiens
  heavy chain complementarity determining region 3 for antibody 27852
ARHTSMAGLRGFDQ

SEQ ID NO: 55705 - protein, 9 aa, Homo sapiens
  light chain complementarity determining region 3 for antibody 27853
QQWATAPLT

SEQ ID NO: 55706 - protein, 10 aa, Homo sapiens
  heavy chain complementarity determining region 3 for antibody 27853
AWGFGWSSDY

SEQ ID NO: 55707 - protein, 9 aa, Homo sapiens
  light chain complementarity determining region 3 for antibody 27854
QQVYIYPFT

SEQ ID NO: 55708 - protein, 12 aa, Homo sapiens
  heavy chain complementarity determining region 3 for antibody 27854
ARPLDGDFGFDP

SEQ ID NO: 55709 - protein, 8 aa, Homo sapiens
  light chain complementarity determining region 3 for antibody 27855
QQVNSYPR

SEQ ID NO: 55710 - protein, 20 aa, Homo sapiens
  heavy chain complementarity determining region 3 for antibody 27855
ARDGAVIAPRTRGPGCYFDS

SEQ ID NO: 55711 - protein, 9 aa, Homo sapiens
  light chain complementarity determining region 3 for antibody 27856
QQVNRFPPT

SEQ ID NO: 55712 - protein, 14 aa, Homo sapiens
  heavy chain complementarity determining region 3 for antibody 27856
TTDSPLRRYNYFVY

SEQ ID NO: 55713 - protein, 9 aa, Homo sapiens
  light chain complementarity determining region 3 for antibody 27857
QQVNGFPLT

SEQ ID NO: 55714 - protein, 14 aa, Homo sapiens
  heavy chain complementarity determining region 3 for antibody 27857
TTDSPLRRYNYFVY

SEQ ID NO: 55715 - protein, 9 aa, Homo sapiens
  light chain complementarity determining region 3 for antibody 27858
QQVLIYPFT

SEQ ID NO: 55716 - protein, 12 aa, Homo sapiens
  heavy chain complementarity determining region 3 for antibody 27858
ARPLDGDFGFDP

SEQ ID NO: 55717 - protein, 9 aa, Homo sapiens
  light chain complementarity determining region 3 for antibody 27859
QQVKDYPIT

SEQ ID NO: 55718 - protein, 16 aa, Homo sapiens
  heavy chain complementarity determining region 3 for antibody 27859
ARVVHKALLTQPPNDY

SEQ ID NO: 55719 - protein, 9 aa, Homo sapiens
  light chain complementarity determining region 3 for antibody 27860
QQVHSFPPT

SEQ ID NO: 55720 - protein, 12 aa, Homo sapiens
  heavy chain complementarity determining region 3 for antibody 27860
ARDADGSFGLDV

SEQ ID NO: 55721 - protein, 9 aa, Homo sapiens
  light chain complementarity determining region 3 for antibody 27861
QQVHNYPFT

SEQ ID NO: 55722 - protein, 12 aa, Homo sapiens
  heavy chain complementarity determining region 3 for antibody 27861
ARPLDGDFGFDP

SEQ ID NO: 55723 - protein, 9 aa, Homo sapiens
  light chain complementarity determining region 3 for antibody 27862
QQVHIYPFT

SEQ ID NO: 55724 - protein, 12 aa, Homo sapiens
  heavy chain complementarity determining region 3 for antibody 27862
ARPLDGDCGFDP

SEQ ID NO: 55725 - protein, 9 aa, Homo sapiens
  light chain complementarity determining region 3 for antibody 27863
QQVHFYPFT

SEQ ID NO: 55726 - protein, 12 aa, Homo sapiens
  heavy chain complementarity determining region 3 for antibody 27863
ARPLDGDFGFDP

SEQ ID NO: 55727 - protein, 9 aa, Homo sapiens
  light chain complementarity determining region 3 for antibody 27864
QQTYTIWVT

SEQ ID NO: 55728 - protein, 15 aa, Homo sapiens
  heavy chain complementarity determining region 3 for antibody 27864
ARDSFDGSYSGSFDY

SEQ ID NO: 55729 - protein, 10 aa, Homo sapiens
  light chain complementarity determining region 3 for antibody 27865
QQTYSTPPYT

SEQ ID NO: 55730 - protein, 19 aa, Homo sapiens
  heavy chain complementarity determining region 3 for antibody 27865
AKERDSSGWDNYYYYGMDV

SEQ ID NO: 55731 - protein, 9 aa, Homo sapiens
  light chain complementarity determining region 3 for antibody 27866
QQTYSTPPT

SEQ ID NO: 55732 - protein, 18 aa, Homo sapiens
  heavy chain complementarity determining region 3 for antibody 27866
ARSGRRDSSGFLVNWFDY

SEQ ID NO: 55733 - protein, 9 aa, Homo sapiens
  light chain complementarity determining region 3 for antibody 27867
QQTYSTLYT

SEQ ID NO: 55734 - protein, 13 aa, Homo sapiens
  heavy chain complementarity determining region 3 for antibody 27867
VRGGISTRPSHDC

SEQ ID NO: 55735 - protein, 9 aa, Homo sapiens
  light chain complementarity determining region 3 for antibody 27868
QQTYSPPFP

SEQ ID NO: 55736 - protein, 14 aa, Homo sapiens
  heavy chain complementarity determining region 3 for antibody 27868
ARARDTSGYSGLDY

SEQ ID NO: 55737 - protein, 13 aa, Homo sapiens
  light chain complementarity determining region 3 for antibody 27869
QQTYMLTYSGRGT

SEQ ID NO: 55738 - protein, 15 aa, Homo sapiens
  heavy chain complementarity determining region 3 for antibody 27869
ARDSFDGSYSGSFDY

SEQ ID NO: 55739 - protein, 9 aa, Homo sapiens
  light chain complementarity determining region 3 for antibody 27870
QQTNSSSPT

SEQ ID NO: 55740 - protein, 11 aa, Homo sapiens
  heavy chain complementarity determining region 3 for antibody 27870
AKKGPGSSFDF

SEQ ID NO: 55741 - protein, 9 aa, Homo sapiens
  light chain complementarity determining region 3 for antibody 27871
QQTKTFPHT

SEQ ID NO: 55742 - protein, 13 aa, Homo sapiens
  heavy chain complementarity determining region 3 for antibody 27871
AVSRTGDGDASDI

SEQ ID NO: 55743 - protein, 9 aa, Homo sapiens
  light chain complementarity determining region 3 for antibody 27872
QQTFSSPPT

SEQ ID NO: 55744 - protein, 16 aa, Homo sapiens
  heavy chain complementarity determining region 3 for antibody 27872
VTYRGTVTASGYGLDD

SEQ ID NO: 55745 - protein, 10 aa, Homo sapiens
  light chain complementarity determining region 3 for antibody 27873
QQTFSPLALP

SEQ ID NO: 55746 - protein, 23 aa, Homo sapiens
  heavy chain complementarity determining region 3 for antibody 27873
ARTPPFGDFSSVTFYQFFYGMDV

SEQ ID NO: 55747 - protein, 9 aa, Homo sapiens
  light chain complementarity determining region 3 for antibody 27874
QQSYYFPIT

SEQ ID NO: 55748 - protein, 25 aa, Homo sapiens
  heavy chain complementarity determining region 3 for antibody 27874
ARGIDPARYNGGWYKSHNNYAGMDV

SEQ ID NO: 55749 - protein, 9 aa, Homo sapiens
  light chain complementarity determining region 3 for antibody 27875
QQSYTTPRT

SEQ ID NO: 55750 - protein, 20 aa, Homo sapiens
  heavy chain complementarity determining region 3 for antibody 27875
ARESGVFPICDWLPYTWFDP

SEQ ID NO: 55751 - protein, 10 aa, Homo sapiens
  light chain complementarity determining region 3 for antibody 27876
QQSYTTPLRT

SEQ ID NO: 55752 - protein, 14 aa, Homo sapiens
  heavy chain complementarity determining region 3 for antibody 27876
ARDRKTRLGDNLDI

SEQ ID NO: 55753 - protein, 10 aa, Homo sapiens
  light chain complementarity determining region 3 for antibody 27877
QQSYTTPLKN

SEQ ID NO: 55754 - protein, 14 aa, Homo sapiens
  heavy chain complementarity determining region 3 for antibody 27877
ARDRKTRLGDNLDI

SEQ ID NO: 55755 - protein, 9 aa, Homo sapiens
  light chain complementarity determining region 3 for antibody 27878
QQSYTSVRT

SEQ ID NO: 55756 - protein, 12 aa, Homo sapiens
  heavy chain complementarity determining region 3 for antibody 27878
VKDCGLGGSRDF

SEQ ID NO: 55757 - protein, 9 aa, Homo sapiens
  light chain complementarity determining region 3 for antibody 27879
QQSYSTSWT

SEQ ID NO: 55758 - protein, 12 aa, Homo sapiens
  heavy chain complementarity determining region 3 for antibody 27879
ARVEYGDCCVDY

SEQ ID NO: 55759 - protein, 9 aa, Homo sapiens
  light chain complementarity determining region 3 for antibody 27880
QQSYSTPYT

SEQ ID NO: 55760 - protein, 11 aa, Homo sapiens
  heavy chain complementarity determining region 3 for antibody 27880
VEGFDGCVADN

SEQ ID NO: 55761 - protein, 9 aa, Homo sapiens
  light chain complementarity determining region 3 for antibody 27881
QQSYSTPYT

SEQ ID NO: 55762 - protein, 19 aa, Homo sapiens
  heavy chain complementarity determining region 3 for antibody 27881
ATAGEDSSAWQPEPSGFGY

SEQ ID NO: 55763 - protein, 9 aa, Homo sapiens
  light chain complementarity determining region 3 for antibody 27882
QQSYSTPYT

SEQ ID NO: 55764 - protein, 16 aa, Homo sapiens
  heavy chain complementarity determining region 3 for antibody 27882
ASEGVVREFIIWAFDI

SEQ ID NO: 55765 - protein, 9 aa, Homo sapiens
  light chain complementarity determining region 3 for antibody 27883
QQSYSTPYT

SEQ ID NO: 55766 - protein, 9 aa, Homo sapiens
  heavy chain complementarity determining region 3 for antibody 27883
ARGVRPLDS

SEQ ID NO: 55767 - protein, 9 aa, Homo sapiens
  light chain complementarity determining region 3 for antibody 27884
QQSYSTPWT

SEQ ID NO: 55768 - protein, 9 aa, Homo sapiens
  heavy chain complementarity determining region 3 for antibody 27884
ARVGNWKMD

SEQ ID NO: 55769 - protein, 10 aa, Homo sapiens
  light chain complementarity determining region 3 for antibody 27885
QQSYSTPQWP

SEQ ID NO: 55770 - protein, 15 aa, Homo sapiens
  heavy chain complementarity determining region 3 for antibody 27885
ARVRALRGVPSFFDY

SEQ ID NO: 55771 - protein, 10 aa, Homo sapiens
  light chain complementarity determining region 3 for antibody 27886
QQSYSTPQST

SEQ ID NO: 55772 - protein, 15 aa, Homo sapiens
  heavy chain complementarity determining region 3 for antibody 27886
ARQHDYGNYWRAFDI

SEQ ID NO: 55773 - protein, 10 aa, Homo sapiens
  light chain complementarity determining region 3 for antibody 27887
QQSYSTPQNT

SEQ ID NO: 55774 - protein, 15 aa, Homo sapiens
  heavy chain complementarity determining region 3 for antibody 27887
ARQHDYGNYWRAFDI

SEQ ID NO: 55775 - protein, 9 aa, Homo sapiens
  light chain complementarity determining region 3 for antibody 27888
QQSYSTPPT

SEQ ID NO: 55776 - protein, 16 aa, Homo sapiens
  heavy chain complementarity determining region 3 for antibody 27888
ARLNPPHLAAPDAFDI

SEQ ID NO: 55777 - protein, 10 aa, Homo sapiens
  light chain complementarity determining region 3 for antibody 27889
QQSYSTPPST

SEQ ID NO: 55778 - protein, 12 aa, Homo sapiens
  heavy chain complementarity determining region 3 for antibody 27889
ARESSGWSFFDL

SEQ ID NO: 55779 - protein, 10 aa, Homo sapiens
  light chain complementarity determining region 3 for antibody 27890
QQSYSTPPLT

SEQ ID NO: 55780 - protein, 19 aa, Homo sapiens
  heavy chain complementarity determining region 3 for antibody 27890
VKDSTWGSSGYYSSEYFQH

SEQ ID NO: 55781 - protein, 9 aa, Homo sapiens
  light chain complementarity determining region 3 for antibody 27891
QQSYSTPNT

SEQ ID NO: 55782 - protein, 15 aa, Homo sapiens
  heavy chain complementarity determining region 3 for antibody 27891
ARDRGQLWSEDAFDI

SEQ ID NO: 55783 - protein, 9 aa, Homo sapiens
  light chain complementarity determining region 3 for antibody 27892
QQSYSTPLP

SEQ ID NO: 55784 - protein, 17 aa, Homo sapiens
  heavy chain complementarity determining region 3 for antibody 27892
AKDLSGVIGGSYGSFDF

SEQ ID NO: 55785 - protein, 9 aa, Homo sapiens
  light chain complementarity determining region 3 for antibody 27893
QQSYSTPKT

SEQ ID NO: 55786 - protein, 15 aa, Homo sapiens
  heavy chain complementarity determining region 3 for antibody 27893
ARDRGQLWSEDAFDV

SEQ ID NO: 55787 - protein, 9 aa, Homo sapiens
  light chain complementarity determining region 3 for antibody 27894
QQSYSTPGT

SEQ ID NO: 55788 - protein, 21 aa, Homo sapiens
  heavy chain complementarity determining region 3 for antibody 27894
ARGAYQYYYDSSGYSNDAFDI

SEQ ID NO: 55789 - protein, 9 aa, Homo sapiens
  light chain complementarity determining region 3 for antibody 27895
QQSYSTPGA

SEQ ID NO: 55790 - protein, 17 aa, Homo sapiens
  heavy chain complementarity determining region 3 for antibody 27895
GRDPYKTRGYKEDYFDY

SEQ ID NO: 55791 - protein, 9 aa, Homo sapiens
  light chain complementarity determining region 3 for antibody 27896
QQSYSTPDT

SEQ ID NO: 55792 - protein, 17 aa, Homo sapiens
  heavy chain complementarity determining region 3 for antibody 27896
AVYTSTDGIFNKDAFDI

SEQ ID NO: 55793 - protein, 9 aa, Homo sapiens
  light chain complementarity determining region 3 for antibody 27897
QQSYSTPDN

SEQ ID NO: 55794 - protein, 20 aa, Homo sapiens
  heavy chain complementarity determining region 3 for antibody 27897
AREFPDVSDGSGYPPSHFDY

SEQ ID NO: 55795 - protein, 10 aa, Homo sapiens
  light chain complementarity determining region 3 for antibody 27898
QQSYSTLVYT

SEQ ID NO: 55796 - protein, 12 aa, Homo sapiens
  heavy chain complementarity determining region 3 for antibody 27898
ASGTARGYYFDN

SEQ ID NO: 55797 - protein, 10 aa, Homo sapiens
  light chain complementarity determining region 3 for antibody 27899
QQSYSTLLLT

SEQ ID NO: 55798 - protein, 20 aa, Homo sapiens
  heavy chain complementarity determining region 3 for antibody 27899
AREVYYDRSGYYYNHKWFAP

SEQ ID NO: 55799 - protein, 10 aa, Homo sapiens
  light chain complementarity determining region 3 for antibody 27900
QQSYSTLGYT

SEQ ID NO: 55800 - protein, 17 aa, Homo sapiens
  heavy chain complementarity determining region 3 for antibody 27900
AKALAPVDIAKIANFDH

SEQ ID NO: 55801 - protein, 10 aa, Homo sapiens
  light chain complementarity determining region 3 for antibody 27901
QQSYSSFSLT

SEQ ID NO: 55802 - protein, 14 aa, Homo sapiens
  heavy chain complementarity determining region 3 for antibody 27901
ARDFVRGLWRSFDI

SEQ ID NO: 55803 - protein, 10 aa, Homo sapiens
  light chain complementarity determining region 3 for antibody 27902
QQSYSSFSFT

SEQ ID NO: 55804 - protein, 14 aa, Homo sapiens
  heavy chain complementarity determining region 3 for antibody 27902
ARDFVRGLWRSFDI

SEQ ID NO: 55805 - protein, 9 aa, Homo sapiens
  light chain complementarity determining region 3 for antibody 27903
QQSYSPPRT

SEQ ID NO: 55806 - protein, 13 aa, Homo sapiens
  heavy chain complementarity determining region 3 for antibody 27903
ARGGEFLGRWFDP

SEQ ID NO: 55807 - protein, 9 aa, Homo sapiens
  light chain complementarity determining region 3 for antibody 27904
QQSYSPPGT

SEQ ID NO: 55808 - protein, 13 aa, Homo sapiens
  heavy chain complementarity determining region 3 for antibody 27904
ARGGEFLGRWFDP

SEQ ID NO: 55809 - protein, 8 aa, Homo sapiens
  light chain complementarity determining region 3 for antibody 27905
QQSYSNPT

SEQ ID NO: 55810 - protein, 12 aa, Homo sapiens
  heavy chain complementarity determining region 3 for antibody 27905
AREGGMAAAPDF

SEQ ID NO: 55811 - protein, 9 aa, Homo sapiens
  light chain complementarity determining region 3 for antibody 27906
QQSYSNAWT

SEQ ID NO: 55812 - protein, 12 aa, Homo sapiens
  heavy chain complementarity determining region 3 for antibody 27906
ARAPALRSGLNY

SEQ ID NO: 55813 - protein, 9 aa, Homo sapiens
  light chain complementarity determining region 3 for antibody 27907
QQSYSIPYT

SEQ ID NO: 55814 - protein, 13 aa, Homo sapiens
  heavy chain complementarity determining region 3 for antibody 27907
ARGLRGVPHWFDP

SEQ ID NO: 55815 - protein, 9 aa, Homo sapiens
  light chain complementarity determining region 3 for antibody 27908
QQSYSFPRP

SEQ ID NO: 55816 - protein, 22 aa, Homo sapiens
  heavy chain complementarity determining region 3 for antibody 27908
AREMIKLRVAADGSQRDYIMDV

SEQ ID NO: 55817 - protein, 9 aa, Homo sapiens
  light chain complementarity determining region 3 for antibody 27909
QQSYRMPLT

SEQ ID NO: 55818 - protein, 15 aa, Homo sapiens
  heavy chain complementarity determining region 3 for antibody 27909
ARDQTMIVLDWKFDL

SEQ ID NO: 55819 - protein, 9 aa, Homo sapiens
  light chain complementarity determining region 3 for antibody 27910
QQSYNTPWT

SEQ ID NO: 55820 - protein, 21 aa, Homo sapiens
  heavy chain complementarity determining region 3 for antibody 27910
TRNNALMWNDETGYYYYGMDV

SEQ ID NO: 55821 - protein, 9 aa, Homo sapiens
  light chain complementarity determining region 3 for antibody 27911
QQSYNTMGT

SEQ ID NO: 55822 - protein, 13 aa, Homo sapiens
  heavy chain complementarity determining region 3 for antibody 27911
ARRKYGSTWYDDY

SEQ ID NO: 55823 - protein, 9 aa, Homo sapiens
  light chain complementarity determining region 3 for antibody 27912
QQSYNTLGT

SEQ ID NO: 55824 - protein, 13 aa, Homo sapiens
  heavy chain complementarity determining region 3 for antibody 27912
ARRKYGSTWYDDY

SEQ ID NO: 55825 - protein, 9 aa, Homo sapiens
  light chain complementarity determining region 3 for antibody 27913
QQSYNTLFT

SEQ ID NO: 55826 - protein, 15 aa, Homo sapiens
  heavy chain complementarity determining region 3 for antibody 27913
TRVGTMVTLDDAFDS

SEQ ID NO: 55827 - protein, 9 aa, Homo sapiens
  light chain complementarity determining region 3 for antibody 27914
QQSYNNSPP

SEQ ID NO: 55828 - protein, 21 aa, Homo sapiens
  heavy chain complementarity determining region 3 for antibody 27914
AKRTDHHYHSTGYQYRSVFDM

SEQ ID NO: 55829 - protein, 9 aa, Homo sapiens
  light chain complementarity determining region 3 for antibody 27915
QQSYITPLT

SEQ ID NO: 55830 - protein, 18 aa, Homo sapiens
  heavy chain complementarity determining region 3 for antibody 27915
ARGAYCGGATCHYNSFDY

SEQ ID NO: 55831 - protein, 9 aa, Homo sapiens
  light chain complementarity determining region 3 for antibody 27916
QQSYFTPYT

SEQ ID NO: 55832 - protein, 15 aa, Homo sapiens
  heavy chain complementarity determining region 3 for antibody 27916
VRDSKVRGLTDWFDP

SEQ ID NO: 55833 - protein, 9 aa, Homo sapiens
  light chain complementarity determining region 3 for antibody 27917
QQSSTTPHT

SEQ ID NO: 55834 - protein, 19 aa, Homo sapiens
  heavy chain complementarity determining region 3 for antibody 27917
ARCNPIVLGPGDYYYGMDV

SEQ ID NO: 55835 - protein, 9 aa, Homo sapiens
  light chain complementarity determining region 3 for antibody 27918
QQSSSYPPT

SEQ ID NO: 55836 - protein, 16 aa, Homo sapiens
  heavy chain complementarity determining region 3 for antibody 27918
ARDHELYGRSAGVFGY

SEQ ID NO: 55837 - protein, 9 aa, Homo sapiens
  light chain complementarity determining region 3 for antibody 27919
QQSSGVPLT

SEQ ID NO: 55838 - protein, 9 aa, Homo sapiens
  heavy chain complementarity determining region 3 for antibody 27919
VCLGVTPPV

SEQ ID NO: 55839 - protein, 9 aa, Homo sapiens
  light chain complementarity determining region 3 for antibody 27920
QQSSFSPLP

SEQ ID NO: 55840 - protein, 10 aa, Homo sapiens
  heavy chain complementarity determining region 3 for antibody 27920
AGGSGWLPDH

SEQ ID NO: 55841 - protein, 9 aa, Homo sapiens
  light chain complementarity determining region 3 for antibody 27921
QQSNTYPPT

SEQ ID NO: 55842 - protein, 8 aa, Homo sapiens
  heavy chain complementarity determining region 3 for antibody 27921
INYNTGWS

SEQ ID NO: 55843 - protein, 9 aa, Homo sapiens
  light chain complementarity determining region 3 for antibody 27922
QQSNTWPRT

SEQ ID NO: 55844 - protein, 22 aa, Homo sapiens
  heavy chain complementarity determining region 3 for antibody 27922
AREVRASGYDDFYNYYYYGLDV

SEQ ID NO: 55845 - protein, 7 aa, Homo sapiens
  light chain complementarity determining region 3 for antibody 27923
QQSNSYS

SEQ ID NO: 55846 - protein, 9 aa, Homo sapiens
  heavy chain complementarity determining region 3 for antibody 27923
ATHGDGFDY

SEQ ID NO: 55847 - protein, 9 aa, Homo sapiens
  light chain complementarity determining region 3 for antibody 27924
QQSNSYPLT

SEQ ID NO: 55848 - protein, 16 aa, Homo sapiens
  heavy chain complementarity determining region 3 for antibody 27924
ARDQYTSDYYIRPFDV

SEQ ID NO: 55849 - protein, 10 aa, Homo sapiens
  light chain complementarity determining region 3 for antibody 27925
QQSNSTPMYS

SEQ ID NO: 55850 - protein, 18 aa, Homo sapiens
  heavy chain complementarity determining region 3 for antibody 27925
ARDFVAVPGYNGDEYFQH

SEQ ID NO: 55851 - protein, 9 aa, Homo sapiens
  light chain complementarity determining region 3 for antibody 27926
QQSNRTPYP

SEQ ID NO: 55852 - protein, 14 aa, Homo sapiens
  heavy chain complementarity determining region 3 for antibody 27926
ATEGPSRMGKFFDS

SEQ ID NO: 55853 - protein, 9 aa, Homo sapiens
  light chain complementarity determining region 3 for antibody 27927
QQSLFAPST

SEQ ID NO: 55854 - protein, 21 aa, Homo sapiens
  heavy chain complementarity determining region 3 for antibody 27927
AKGGEANSAGVYSESDDAFEN

SEQ ID NO: 55855 - protein, 9 aa, Homo sapiens
  light chain complementarity determining region 3 for antibody 27928
QQSISIPWT

SEQ ID NO: 55856 - protein, 10 aa, Homo sapiens
  heavy chain complementarity determining region 3 for antibody 27928
ATGTSVGAKY

SEQ ID NO: 55857 - protein, 8 aa, Homo sapiens
  light chain complementarity determining region 3 for antibody 27929
QQSHTTPT

SEQ ID NO: 55858 - protein, 12 aa, Homo sapiens
  heavy chain complementarity determining region 3 for antibody 27929
ARRGGFGRTFDF

SEQ ID NO: 55859 - protein, 9 aa, Homo sapiens
  light chain complementarity determining region 3 for antibody 27930
QQSHSPPLT

SEQ ID NO: 55860 - protein, 14 aa, Homo sapiens
  heavy chain complementarity determining region 3 for antibody 27930
ARGSQWLVQYGMDV

SEQ ID NO: 55861 - protein, 9 aa, Homo sapiens
  light chain complementarity determining region 3 for antibody 27931
QQSHSPPLT

SEQ ID NO: 55862 - protein, 14 aa, Homo sapiens
  heavy chain complementarity determining region 3 for antibody 27931
ARDSQWLVQYGIDV

SEQ ID NO: 55863 - protein, 10 aa, Homo sapiens
  light chain complementarity determining region 3 for antibody 27932
QQSHNNTPYT

SEQ ID NO: 55864 - protein, 21 aa, Homo sapiens
  heavy chain complementarity determining region 3 for antibody 27932
ARTGRHYSDSTGYYYRPRIDY

SEQ ID NO: 55865 - protein, 10 aa, Homo sapiens
  light chain complementarity determining region 3 for antibody 27933
QQSHNNTPHT

SEQ ID NO: 55866 - protein, 21 aa, Homo sapiens
  heavy chain complementarity determining region 3 for antibody 27933
ARTGRHYSDSTVYYYRPRIDY

SEQ ID NO: 55867 - protein, 9 aa, Homo sapiens
  light chain complementarity determining region 3 for antibody 27934
QQSGSSPYT

SEQ ID NO: 55868 - protein, 9 aa, Homo sapiens
  heavy chain complementarity determining region 3 for antibody 27934
ARETEGFDI

SEQ ID NO: 55869 - protein, 11 aa, Homo sapiens
  light chain complementarity determining region 3 for antibody 27935
QQSFTTPLMYP

SEQ ID NO: 55870 - protein, 16 aa, Homo sapiens
  heavy chain complementarity determining region 3 for antibody 27935
ARGSTVTSFSGLCPDS

SEQ ID NO: 55871 - protein, 9 aa, Homo sapiens
  light chain complementarity determining region 3 for antibody 27936
QQSFSTPPT

SEQ ID NO: 55872 - protein, 18 aa, Homo sapiens
  heavy chain complementarity determining region 3 for antibody 27936
ARGRQAMCDLGRCDYFDY

SEQ ID NO: 55873 - protein, 9 aa, Homo sapiens
  light chain complementarity determining region 3 for antibody 27937
QQSFSDPRT

SEQ ID NO: 55874 - protein, 21 aa, Homo sapiens
  heavy chain complementarity determining region 3 for antibody 27937
VRESALQWNDQTGYYYYGMDV

SEQ ID NO: 55875 - protein, 9 aa, Homo sapiens
  light chain complementarity determining region 3 for antibody 27938
QQSFNNPPP

SEQ ID NO: 55876 - protein, 18 aa, Homo sapiens
  heavy chain complementarity determining region 3 for antibody 27938
VREMDVAVHRVMFNIFDS

SEQ ID NO: 55877 - protein, 9 aa, Homo sapiens
  light chain complementarity determining region 3 for antibody 27939
QQSDTSPYT

SEQ ID NO: 55878 - protein, 14 aa, Homo sapiens
  heavy chain complementarity determining region 3 for antibody 27939
ARGGRLRLFSFSDY

SEQ ID NO: 55879 - protein, 9 aa, Homo sapiens
  light chain complementarity determining region 3 for antibody 27940
QQSDRTPLT

SEQ ID NO: 55880 - protein, 17 aa, Homo sapiens
  heavy chain complementarity determining region 3 for antibody 27940
ARGPYGDYVDYSHGMDV

SEQ ID NO: 55881 - protein, 9 aa, Homo sapiens
  light chain complementarity determining region 3 for antibody 27941
QQSDRTPLT

SEQ ID NO: 55882 - protein, 14 aa, Homo sapiens
  heavy chain complementarity determining region 3 for antibody 27941
AKAIAPSGWYYFDY

SEQ ID NO: 55883 - protein, 9 aa, Homo sapiens
  light chain complementarity determining region 3 for antibody 27942
QQSDRNPFT

SEQ ID NO: 55884 - protein, 14 aa, Homo sapiens
  heavy chain complementarity determining region 3 for antibody 27942
ARDNSNNWYEGMDV

SEQ ID NO: 55885 - protein, 9 aa, Homo sapiens
  light chain complementarity determining region 3 for antibody 27943
QQSCSMPLT

SEQ ID NO: 55886 - protein, 15 aa, Homo sapiens
  heavy chain complementarity determining region 3 for antibody 27943
ARDQTMIVLDWKFDL

SEQ ID NO: 55887 - protein, 9 aa, Homo sapiens
  light chain complementarity determining region 3 for antibody 27944
QQRYSVPLT

SEQ ID NO: 55888 - protein, 21 aa, Homo sapiens
  heavy chain complementarity determining region 3 for antibody 27944
ARQRPVSMVRGPPLRNGYFDL

SEQ ID NO: 55889 - protein, 9 aa, Homo sapiens
  light chain complementarity determining region 3 for antibody 27945
QQRYSTPWT

SEQ ID NO: 55890 - protein, 15 aa, Homo sapiens
  heavy chain complementarity determining region 3 for antibody 27945
ASRYSSGWYYYGMDV

SEQ ID NO: 55891 - protein, 8 aa, Homo sapiens
  light chain complementarity determining region 3 for antibody 27946
QQRYSTPS

SEQ ID NO: 55892 - protein, 15 aa, Homo sapiens
  heavy chain complementarity determining region 3 for antibody 27946
ARAQTGGYSYGTEDY

SEQ ID NO: 55893 - protein, 9 aa, Homo sapiens
  light chain complementarity determining region 3 for antibody 27947
QQRYSTPRT

SEQ ID NO: 55894 - protein, 15 aa, Homo sapiens
  heavy chain complementarity determining region 3 for antibody 27947
VRHYRETVAGIEGDS

SEQ ID NO: 55895 - protein, 9 aa, Homo sapiens
  light chain complementarity determining region 3 for antibody 27948
QQRYSSVLT

SEQ ID NO: 55896 - protein, 16 aa, Homo sapiens
  heavy chain complementarity determining region 3 for antibody 27948
AREGGGTYTSSRAFDF

SEQ ID NO: 55897 - protein, 9 aa, Homo sapiens
  light chain complementarity determining region 3 for antibody 27949
QQRYSMPLT

SEQ ID NO: 55898 - protein, 15 aa, Homo sapiens
  heavy chain complementarity determining region 3 for antibody 27949
ARDQTMIVLDWKFDL

SEQ ID NO: 55899 - protein, 9 aa, Homo sapiens
  light chain complementarity determining region 3 for antibody 27950
QQRYSFPRT

SEQ ID NO: 55900 - protein, 22 aa, Homo sapiens
  heavy chain complementarity determining region 3 for antibody 27950
AREMIKLRVAADGSQRDYIMDV

SEQ ID NO: 55901 - protein, 10 aa, Homo sapiens
  light chain complementarity determining region 3 for antibody 27951
QQRYNWPPYT

SEQ ID NO: 55902 - protein, 15 aa, Homo sapiens
  heavy chain complementarity determining region 3 for antibody 27951
AREGSGYTAATGFDI

SEQ ID NO: 55903 - protein, 10 aa, Homo sapiens
  light chain complementarity determining region 3 for antibody 27952
QQRYNWPPDT

SEQ ID NO: 55904 - protein, 15 aa, Homo sapiens
  heavy chain complementarity determining region 3 for antibody 27952
AREGSGYPAATGFDI

SEQ ID NO: 55905 - protein, 9 aa, Homo sapiens
  light chain complementarity determining region 3 for antibody 27953
QQRYNWPLT

SEQ ID NO: 55906 - protein, 14 aa, Homo sapiens
  heavy chain complementarity determining region 3 for antibody 27953
AKGDSYGIFSVFDF

SEQ ID NO: 55907 - protein, 10 aa, Homo sapiens
  light chain complementarity determining region 3 for antibody 27954
QQRYNRPPYT

SEQ ID NO: 55908 - protein, 11 aa, Homo sapiens
  heavy chain complementarity determining region 3 for antibody 27954
ARGVGSYPFDS

SEQ ID NO: 55909 - protein, 10 aa, Homo sapiens
  light chain complementarity determining region 3 for antibody 27955
QQRYNIPPFT

SEQ ID NO: 55910 - protein, 14 aa, Homo sapiens
  heavy chain complementarity determining region 3 for antibody 27955
AKSVGSSWGQRFDS

SEQ ID NO: 55911 - protein, 9 aa, Homo sapiens
  light chain complementarity determining region 3 for antibody 27956
QQRYIWPDT

SEQ ID NO: 55912 - protein, 17 aa, Homo sapiens
  heavy chain complementarity determining region 3 for antibody 27956
ARLYGATTDESYDVFDI

SEQ ID NO: 55913 - protein, 11 aa, Homo sapiens
  light chain complementarity determining region 3 for antibody 27957
QQRTSWPPQDT

SEQ ID NO: 55914 - protein, 14 aa, Homo sapiens
  heavy chain complementarity determining region 3 for antibody 27957
ARTVLDTAADAFDF

SEQ ID NO: 55915 - protein, 11 aa, Homo sapiens
  light chain complementarity determining region 3 for antibody 27958
QQRTSWPPKYT

SEQ ID NO: 55916 - protein, 14 aa, Homo sapiens
  heavy chain complementarity determining region 3 for antibody 27958
ARTVLDTAADAFDS

SEQ ID NO: 55917 - protein, 11 aa, Homo sapiens
  light chain complementarity determining region 3 for antibody 27959
QQRTSWPPKST

SEQ ID NO: 55918 - protein, 14 aa, Homo sapiens
  heavy chain complementarity determining region 3 for antibody 27959
ARTVLDTAADAFDF

SEQ ID NO: 55919 - protein, 9 aa, Homo sapiens
  light chain complementarity determining region 3 for antibody 27960
QQRTNWRFT

SEQ ID NO: 55920 - protein, 16 aa, Homo sapiens
  heavy chain complementarity determining region 3 for antibody 27960
ARDQGYCLGTNCYLLH

SEQ ID NO: 55921 - protein, 11 aa, Homo sapiens
  light chain complementarity determining region 3 for antibody 27961
QQRTNWPPIHT

SEQ ID NO: 55922 - protein, 14 aa, Homo sapiens
  heavy chain complementarity determining region 3 for antibody 27961
ARGGLGIWGNSSDI

SEQ ID NO: 55923 - protein, 11 aa, Homo sapiens
  light chain complementarity determining region 3 for antibody 27962
QQRTNWPLSFT

SEQ ID NO: 55924 - protein, 17 aa, Homo sapiens
  heavy chain complementarity determining region 3 for antibody 27962
ARVKGYGGNSYPDAFHI

SEQ ID NO: 55925 - protein, 10 aa, Homo sapiens
  light chain complementarity determining region 3 for antibody 27963
QQRSYWPPWT

SEQ ID NO: 55926 - protein, 13 aa, Homo sapiens
  heavy chain complementarity determining region 3 for antibody 27963
AREAFPPGGGLDY

SEQ ID NO: 55927 - protein, 10 aa, Homo sapiens
  light chain complementarity determining region 3 for antibody 27964
QQRSTWTPRT

SEQ ID NO: 55928 - protein, 9 aa, Homo sapiens
  heavy chain complementarity determining region 3 for antibody 27964
ATPFGETPF

SEQ ID NO: 55929 - protein, 10 aa, Homo sapiens
  light chain complementarity determining region 3 for antibody 27965
QQRSTWPQLT

SEQ ID NO: 55930 - protein, 20 aa, Homo sapiens
  heavy chain complementarity determining region 3 for antibody 27965
ARVLITSNRVGRKVPYGMDV

SEQ ID NO: 55931 - protein, 9 aa, Homo sapiens
  light chain complementarity determining region 3 for antibody 27966
QQRSSWPYT

SEQ ID NO: 55932 - protein, 11 aa, Homo sapiens
  heavy chain complementarity determining region 3 for antibody 27966
VKRWGGSSIGY

SEQ ID NO: 55933 - protein, 9 aa, Homo sapiens
  light chain complementarity determining region 3 for antibody 27967
QQRSSWPYN

SEQ ID NO: 55934 - protein, 11 aa, Homo sapiens
  heavy chain complementarity determining region 3 for antibody 27967
VKRWGGSSIDY

SEQ ID NO: 55935 - protein, 9 aa, Homo sapiens
  light chain complementarity determining region 3 for antibody 27968
QQRSSWPRT

SEQ ID NO: 55936 - protein, 11 aa, Homo sapiens
  heavy chain complementarity determining region 3 for antibody 27968
ATEIEPEAFDY

SEQ ID NO: 55937 - protein, 10 aa, Homo sapiens
  light chain complementarity determining region 3 for antibody 27969
QQRSSWPPIT

SEQ ID NO: 55938 - protein, 17 aa, Homo sapiens
  heavy chain complementarity determining region 3 for antibody 27969
ARSGAGAVGGWYLYYDV

SEQ ID NO: 55939 - protein, 9 aa, Homo sapiens
  light chain complementarity determining region 3 for antibody 27970
QQRSSWPLT

SEQ ID NO: 55940 - protein, 17 aa, Homo sapiens
  heavy chain complementarity determining region 3 for antibody 27970
ARAGEYHDFWSAYYFDL

SEQ ID NO: 55941 - protein, 9 aa, Homo sapiens
  light chain complementarity determining region 3 for antibody 27971
QQRSSRPLT

SEQ ID NO: 55942 - protein, 17 aa, Homo sapiens
  heavy chain complementarity determining region 3 for antibody 27971
ARAGEYHDFWSAYYFDF

SEQ ID NO: 55943 - protein, 11 aa, Homo sapiens
  light chain complementarity determining region 3 for antibody 27972
QQRSNWPRTLP

SEQ ID NO: 55944 - protein, 19 aa, Homo sapiens
  heavy chain complementarity determining region 3 for antibody 27972
ARDLGYYDFWSGYLEGMDY

SEQ ID NO: 55945 - protein, 10 aa, Homo sapiens
  light chain complementarity determining region 3 for antibody 27973
QQRSNWPRLP

SEQ ID NO: 55946 - protein, 11 aa, Homo sapiens
  heavy chain complementarity determining region 3 for antibody 27973
ARAALTYYFDY

SEQ ID NO: 55947 - protein, 11 aa, Homo sapiens
  light chain complementarity determining region 3 for antibody 27974
QQRSNWPRGDT

SEQ ID NO: 55948 - protein, 10 aa, Homo sapiens
  heavy chain complementarity determining region 3 for antibody 27974
ARDSGAGVDY

SEQ ID NO: 55949 - protein, 9 aa, Homo sapiens
  light chain complementarity determining region 3 for antibody 27975
QQRSNWPQT

SEQ ID NO: 55950 - protein, 17 aa, Homo sapiens
  heavy chain complementarity determining region 3 for antibody 27975
ARDPDEQALYYYDGMDV

SEQ ID NO: 55951 - protein, 10 aa, Homo sapiens
  light chain complementarity determining region 3 for antibody 27976
QQRSNWPPYT

SEQ ID NO: 55952 - protein, 14 aa, Homo sapiens
  heavy chain complementarity determining region 3 for antibody 27976
ARGRGSTPPYYLDY

SEQ ID NO: 55953 - protein, 10 aa, Homo sapiens
  light chain complementarity determining region 3 for antibody 27977
QQRSNWPPYP

SEQ ID NO: 55954 - protein, 14 aa, Homo sapiens
  heavy chain complementarity determining region 3 for antibody 27977
ARGPSYFYETKFDF

SEQ ID NO: 55955 - protein, 10 aa, Homo sapiens
  light chain complementarity determining region 3 for antibody 27978
QQRSNWPPST

SEQ ID NO: 55956 - protein, 14 aa, Homo sapiens
  heavy chain complementarity determining region 3 for antibody 27978
ARGPSYFYETKFDF

SEQ ID NO: 55957 - protein, 11 aa, Homo sapiens
  light chain complementarity determining region 3 for antibody 27979
QQRSNWPPPLT

SEQ ID NO: 55958 - protein, 14 aa, Homo sapiens
  heavy chain complementarity determining region 3 for antibody 27979
AREGTAMVKDAFEI

SEQ ID NO: 55959 - protein, 11 aa, Homo sapiens
  light chain complementarity determining region 3 for antibody 27980
QQRSNWPPMVT

SEQ ID NO: 55960 - protein, 13 aa, Homo sapiens
  heavy chain complementarity determining region 3 for antibody 27980
ATDRAAGKYYFAF

SEQ ID NO: 55961 - protein, 11 aa, Homo sapiens
  light chain complementarity determining region 3 for antibody 27981
QQRSNWPPMVT

SEQ ID NO: 55962 - protein, 15 aa, Homo sapiens
  heavy chain complementarity determining region 3 for antibody 27981
AKADLAVEDAGTFDS

SEQ ID NO: 55963 - protein, 11 aa, Homo sapiens
  light chain complementarity determining region 3 for antibody 27982
QQRSNWPPLYT

SEQ ID NO: 55964 - protein, 16 aa, Homo sapiens
  heavy chain complementarity determining region 3 for antibody 27982
ARVESRGGIAVDWFDY

SEQ ID NO: 55965 - protein, 10 aa, Homo sapiens
  light chain complementarity determining region 3 for antibody 27983
QQRSNWPPLT

SEQ ID NO: 55966 - protein, 12 aa, Homo sapiens
  heavy chain complementarity determining region 3 for antibody 27983
VKDWGAVAGHDY

SEQ ID NO: 55967 - protein, 10 aa, Homo sapiens
  light chain complementarity determining region 3 for antibody 27984
QQRSNWPPLT

SEQ ID NO: 55968 - protein, 15 aa, Homo sapiens
  heavy chain complementarity determining region 3 for antibody 27984
ARLAMVTGRGIDFDY

SEQ ID NO: 55969 - protein, 10 aa, Homo sapiens
  light chain complementarity determining region 3 for antibody 27985
QQRSNWPPIP

SEQ ID NO: 55970 - protein, 12 aa, Homo sapiens
  heavy chain complementarity determining region 3 for antibody 27985
VKDWGAVAGHDY

SEQ ID NO: 55971 - protein, 10 aa, Homo sapiens
  light chain complementarity determining region 3 for antibody 27986
QQRSNWPPFT

SEQ ID NO: 55972 - protein, 12 aa, Homo sapiens
  heavy chain complementarity determining region 3 for antibody 27986
AREGGFGDYIDY

SEQ ID NO: 55973 - protein, 10 aa, Homo sapiens
  light chain complementarity determining region 3 for antibody 27987
QQRSNWPPDT

SEQ ID NO: 55974 - protein, 12 aa, Homo sapiens
  heavy chain complementarity determining region 3 for antibody 27987
VRGDPGSPRFDY

SEQ ID NO: 55975 - protein, 10 aa, Homo sapiens
  light chain complementarity determining region 3 for antibody 27988
QQRSNWPPDT

SEQ ID NO: 55976 - protein, 21 aa, Homo sapiens
  heavy chain complementarity determining region 3 for antibody 27988
ATMKRNNDFWTGHFGKYYFEY

SEQ ID NO: 55977 - protein, 10 aa, Homo sapiens
  light chain complementarity determining region 3 for antibody 27989
QQRSNWPPDP

SEQ ID NO: 55978 - protein, 12 aa, Homo sapiens
  heavy chain complementarity determining region 3 for antibody 27989
VRGDPGSPRFDY

SEQ ID NO: 55979 - protein, 9 aa, Homo sapiens
  light chain complementarity determining region 3 for antibody 27990
QQRSNWPLP

SEQ ID NO: 55980 - protein, 11 aa, Homo sapiens
  heavy chain complementarity determining region 3 for antibody 27990
AKDSSVAPFDH

SEQ ID NO: 55981 - protein, 9 aa, Homo sapiens
  light chain complementarity determining region 3 for antibody 27991
QQRSNWPLP

SEQ ID NO: 55982 - protein, 17 aa, Homo sapiens
  heavy chain complementarity determining region 3 for antibody 27991
AKDFSPYGDYKSDYFDH

SEQ ID NO: 55983 - protein, 8 aa, Homo sapiens
  light chain complementarity determining region 3 for antibody 27992
QQRSNWLT

SEQ ID NO: 55984 - protein, 18 aa, Homo sapiens
  heavy chain complementarity determining region 3 for antibody 27992
ARVGHYDGGGYSLDDFDI

SEQ ID NO: 55985 - protein, 9 aa, Homo sapiens
  light chain complementarity determining region 3 for antibody 27993
QQRSNRPWT

SEQ ID NO: 55986 - protein, 14 aa, Homo sapiens
  heavy chain complementarity determining region 3 for antibody 27993
AVTHYYDSSTIGDY

SEQ ID NO: 55987 - protein, 8 aa, Homo sapiens
  light chain complementarity determining region 3 for antibody 27994
QQRSNRLY

SEQ ID NO: 55988 - protein, 11 aa, Homo sapiens
  heavy chain complementarity determining region 3 for antibody 27994
ASGSIGWVFDY

SEQ ID NO: 55989 - protein, 10 aa, Homo sapiens
  light chain complementarity determining region 3 for antibody 27995
QQRSNCPPWT

SEQ ID NO: 55990 - protein, 13 aa, Homo sapiens
  heavy chain complementarity determining region 3 for antibody 27995
AREAFPPGGGLDY

SEQ ID NO: 55991 - protein, 10 aa, Homo sapiens
  light chain complementarity determining region 3 for antibody 27996
QQRSKWPPRT

SEQ ID NO: 55992 - protein, 9 aa, Homo sapiens
  heavy chain complementarity determining region 3 for antibody 27996
ARVDGYFDY

SEQ ID NO: 55993 - protein, 10 aa, Homo sapiens
  light chain complementarity determining region 3 for antibody 27997
QQRSKWPPLP

SEQ ID NO: 55994 - protein, 9 aa, Homo sapiens
  heavy chain complementarity determining region 3 for antibody 27997
ARVDGYFDY

SEQ ID NO: 55995 - protein, 10 aa, Homo sapiens
  light chain complementarity determining region 3 for antibody 27998
QQRSKGPPLT

SEQ ID NO: 55996 - protein, 9 aa, Homo sapiens
  heavy chain complementarity determining region 3 for antibody 27998
ARVDGYFDY

SEQ ID NO: 55997 - protein, 10 aa, Homo sapiens
  light chain complementarity determining region 3 for antibody 27999
QQRSEWPPLT

SEQ ID NO: 55998 - protein, 9 aa, Homo sapiens
  heavy chain complementarity determining region 3 for antibody 27999
ARVDGYFDY

SEQ ID NO: 55999 - protein, 11 aa, Homo sapiens
  light chain complementarity determining region 3 for antibody 28000
QQRSDWPPRVT

SEQ ID NO: 56000 - protein, 14 aa, Homo sapiens
  heavy chain complementarity determining region 3 for antibody 28000
ARQGVTYGRRWSDP

SEQ ID NO: 56001 - protein, 11 aa, Homo sapiens
  light chain complementarity determining region 3 for antibody 28001
QQRSDWPPRGT

SEQ ID NO: 56002 - protein, 14 aa, Homo sapiens
  heavy chain complementarity determining region 3 for antibody 28001
ARQGVTYGRRWFDP

SEQ ID NO: 56003 - protein, 9 aa, Homo sapiens
  light chain complementarity determining region 3 for antibody 28002
QQRSDWPIT

SEQ ID NO: 56004 - protein, 11 aa, Homo sapiens
  heavy chain complementarity determining region 3 for antibody 28002
ARGGHSGGDFH

SEQ ID NO: 56005 - protein, 9 aa, Homo sapiens
  light chain complementarity determining region 3 for antibody 28003
QQRSDWPET

SEQ ID NO: 56006 - protein, 9 aa, Homo sapiens
  heavy chain complementarity determining region 3 for antibody 28003
ASGDYAFDL

SEQ ID NO: 56007 - protein, 8 aa, Homo sapiens
  light chain complementarity determining region 3 for antibody 28004
QQRSDLFT

SEQ ID NO: 56008 - protein, 18 aa, Homo sapiens
  heavy chain complementarity determining region 3 for antibody 28004
AKGSVRSCSSRNCYYFDS

SEQ ID NO: 56009 - protein, 10 aa, Homo sapiens
  light chain complementarity determining region 3 for antibody 28005
QQRRNWPPIT

SEQ ID NO: 56010 - protein, 22 aa, Homo sapiens
  heavy chain complementarity determining region 3 for antibody 28005
ARMKKSDVTLYCNGGPCHIFDY

SEQ ID NO: 56011 - protein, 10 aa, Homo sapiens
  light chain complementarity determining region 3 for antibody 28006
QQRRNWPPIT

SEQ ID NO: 56012 - protein, 22 aa, Homo sapiens
  heavy chain complementarity determining region 3 for antibody 28006
ARMKKSDVTLYCKGGTCHIFDY

SEQ ID NO: 56013 - protein, 11 aa, Homo sapiens
  light chain complementarity determining region 3 for antibody 28007
QQRQPRSNWLP

SEQ ID NO: 56014 - protein, 15 aa, Homo sapiens
  heavy chain complementarity determining region 3 for antibody 28007
ARGGYSSSWYYWFDP

SEQ ID NO: 56015 - protein, 9 aa, Homo sapiens
  light chain complementarity determining region 3 for antibody 28008
QQRPNWPLT

SEQ ID NO: 56016 - protein, 14 aa, Homo sapiens
  heavy chain complementarity determining region 3 for antibody 28008
AKGDSYGIFSVFDF

SEQ ID NO: 56017 - protein, 9 aa, Homo sapiens
  light chain complementarity determining region 3 for antibody 28009
QQRNSWPYT

SEQ ID NO: 56018 - protein, 11 aa, Homo sapiens
  heavy chain complementarity determining region 3 for antibody 28009
VKRWGGSSIDY

SEQ ID NO: 56019 - protein, 11 aa, Homo sapiens
  light chain complementarity determining region 3 for antibody 28010
QQRNNWPPEGP

SEQ ID NO: 56020 - protein, 16 aa, Homo sapiens
  heavy chain complementarity determining region 3 for antibody 28010
ATWSYLPQRHYWYFDL

SEQ ID NO: 56021 - protein, 10 aa, Homo sapiens
  light chain complementarity determining region 3 for antibody 28011
QQRNNGPPVI

SEQ ID NO: 56022 - protein, 12 aa, Homo sapiens
  heavy chain complementarity determining region 3 for antibody 28011
VRDGSSGWHFDY

SEQ ID NO: 56023 - protein, 10 aa, Homo sapiens
  light chain complementarity determining region 3 for antibody 28012
QQRNKWPPVL

SEQ ID NO: 56024 - protein, 12 aa, Homo sapiens
  heavy chain complementarity determining region 3 for antibody 28012
VRDGSSGWHFDY

SEQ ID NO: 56025 - protein, 9 aa, Homo sapiens
  light chain complementarity determining region 3 for antibody 28013
QQRNITPWT

SEQ ID NO: 56026 - protein, 19 aa, Homo sapiens
  heavy chain complementarity determining region 3 for antibody 28013
ARNRRYGSGIAEYYYGLDV

SEQ ID NO: 56027 - protein, 8 aa, Homo sapiens
  light chain complementarity determining region 3 for antibody 28014
QQRNFRLP

SEQ ID NO: 56028 - protein, 13 aa, Homo sapiens
  heavy chain complementarity determining region 3 for antibody 28014
TTDAAFVPYYFTY

SEQ ID NO: 56029 - protein, 9 aa, Homo sapiens
  light chain complementarity determining region 3 for antibody 28015
QQRNDWPWT

SEQ ID NO: 56030 - protein, 12 aa, Homo sapiens
  heavy chain complementarity determining region 3 for antibody 28015
GREDYRTGYVDS

SEQ ID NO: 56031 - protein, 9 aa, Homo sapiens
  light chain complementarity determining region 3 for antibody 28016
QQRINWPGT

SEQ ID NO: 56032 - protein, 12 aa, Homo sapiens
  heavy chain complementarity determining region 3 for antibody 28016
ARPDIVDTAMVY

SEQ ID NO: 56033 - protein, 9 aa, Homo sapiens
  light chain complementarity determining region 3 for antibody 28017
QQRIDWPWP

SEQ ID NO: 56034 - protein, 12 aa, Homo sapiens
  heavy chain complementarity determining region 3 for antibody 28017
GREDYRTGYVDS

SEQ ID NO: 56035 - protein, 9 aa, Homo sapiens
  light chain complementarity determining region 3 for antibody 28018
QQRIDWPRT

SEQ ID NO: 56036 - protein, 12 aa, Homo sapiens
  heavy chain complementarity determining region 3 for antibody 28018
GREDYRTGYVDS

SEQ ID NO: 56037 - protein, 9 aa, Homo sapiens
  light chain complementarity determining region 3 for antibody 28019
QQRIDRPWT

SEQ ID NO: 56038 - protein, 12 aa, Homo sapiens
  heavy chain complementarity determining region 3 for antibody 28019
GREDYRTGYVDS

SEQ ID NO: 56039 - protein, 9 aa, Homo sapiens
  light chain complementarity determining region 3 for antibody 28020
QQRIAWPWT

SEQ ID NO: 56040 - protein, 12 aa, Homo sapiens
  heavy chain complementarity determining region 3 for antibody 28020
GREDYRTGYVDS

SEQ ID NO: 56041 - protein, 9 aa, Homo sapiens
  light chain complementarity determining region 3 for antibody 28021
QQRHTWPWT

SEQ ID NO: 56042 - protein, 17 aa, Homo sapiens
  heavy chain complementarity determining region 3 for antibody 28021
VVPQFSRTDWPTEPSDY

SEQ ID NO: 56043 - protein, 8 aa, Homo sapiens
  light chain complementarity determining region 3 for antibody 28022
QQRHSWPT

SEQ ID NO: 56044 - protein, 11 aa, Homo sapiens
  heavy chain complementarity determining region 3 for antibody 28022
ARDDRRELPDL

SEQ ID NO: 56045 - protein, 9 aa, Homo sapiens
  light chain complementarity determining region 3 for antibody 28023
QQRHNWPRT

SEQ ID NO: 56046 - protein, 17 aa, Homo sapiens
  heavy chain complementarity determining region 3 for antibody 28023
VVPQFSRTDWPTEPSDY

SEQ ID NO: 56047 - protein, 9 aa, Homo sapiens
  light chain complementarity determining region 3 for antibody 28024
QQRHNRPWT

SEQ ID NO: 56048 - protein, 17 aa, Homo sapiens
  heavy chain complementarity determining region 3 for antibody 28024
VVPQFSRTDWPTEPSDY

SEQ ID NO: 56049 - protein, 9 aa, Homo sapiens
  light chain complementarity determining region 3 for antibody 28025
QQRGNWPST

SEQ ID NO: 56050 - protein, 13 aa, Homo sapiens
  heavy chain complementarity determining region 3 for antibody 28025
TTGEAYSGYDGDY

SEQ ID NO: 56051 - protein, 9 aa, Homo sapiens
  light chain complementarity determining region 3 for antibody 28026
QQRGKWPLP

SEQ ID NO: 56052 - protein, 15 aa, Homo sapiens
  heavy chain complementarity determining region 3 for antibody 28026
ARIGGYYDSGTISDY

SEQ ID NO: 56053 - protein, 9 aa, Homo sapiens
  light chain complementarity determining region 3 for antibody 28027
QQRFKWPPN

SEQ ID NO: 56054 - protein, 19 aa, Homo sapiens
  heavy chain complementarity determining region 3 for antibody 28027
AREVSSADHYGVGKNWFDP

SEQ ID NO: 56055 - protein, 9 aa, Homo sapiens
  light chain complementarity determining region 3 for antibody 28028
QQRENWPPP

SEQ ID NO: 56056 - protein, 13 aa, Homo sapiens
  heavy chain complementarity determining region 3 for antibody 28028
ARDMDDSGDLFDY

SEQ ID NO: 56057 - protein, 8 aa, Homo sapiens
  light chain complementarity determining region 3 for antibody 28029
QQRDSTPT

SEQ ID NO: 56058 - protein, 13 aa, Homo sapiens
  heavy chain complementarity determining region 3 for antibody 28029
ARPTSDYNWNFGY

SEQ ID NO: 56059 - protein, 9 aa, Homo sapiens
  light chain complementarity determining region 3 for antibody 28030
QQRDNWPFT

SEQ ID NO: 56060 - protein, 12 aa, Homo sapiens
  heavy chain complementarity determining region 3 for antibody 28030
ARGSSSDKVADF

SEQ ID NO: 56061 - protein, 9 aa, Homo sapiens
  light chain complementarity determining region 3 for antibody 28031
QQPYTIGVT

SEQ ID NO: 56062 - protein, 15 aa, Homo sapiens
  heavy chain complementarity determining region 3 for antibody 28031
ARDSFDGSYSGSFDY

SEQ ID NO: 56063 - protein, 9 aa, Homo sapiens
  light chain complementarity determining region 3 for antibody 28032
QQPYSTPLT

SEQ ID NO: 56064 - protein, 18 aa, Homo sapiens
  heavy chain complementarity determining region 3 for antibody 28032
ARSGRRDSSGFLVNWFDY

SEQ ID NO: 56065 - protein, 9 aa, Homo sapiens
  light chain complementarity determining region 3 for antibody 28033
QQPYSPPFT

SEQ ID NO: 56066 - protein, 14 aa, Homo sapiens
  heavy chain complementarity determining region 3 for antibody 28033
ARARDTSGYSGLDY

SEQ ID NO: 56067 - protein, 9 aa, Homo sapiens
  light chain complementarity determining region 3 for antibody 28034
QQPNSFPPT

SEQ ID NO: 56068 - protein, 17 aa, Homo sapiens
  heavy chain complementarity determining region 3 for antibody 28034
ARDPIVGASIPFYGMDV

SEQ ID NO: 56069 - protein, 9 aa, Homo sapiens
  light chain complementarity determining region 3 for antibody 28035
QQNVKSPWT

SEQ ID NO: 56070 - protein, 11 aa, Homo sapiens
  heavy chain complementarity determining region 3 for antibody 28035
AREDWPDGFDI

SEQ ID NO: 56071 - protein, 9 aa, Homo sapiens
  light chain complementarity determining region 3 for antibody 28036
QQNNWYPLT

SEQ ID NO: 56072 - protein, 12 aa, Homo sapiens
  heavy chain complementarity determining region 3 for antibody 28036
ARDKEFRSYSIY

SEQ ID NO: 56073 - protein, 9 aa, Homo sapiens
  light chain complementarity determining region 3 for antibody 28037
QQNNNWPYT

SEQ ID NO: 56074 - protein, 12 aa, Homo sapiens
  heavy chain complementarity determining region 3 for antibody 28037
PQIPVGRDAFDI

SEQ ID NO: 56075 - protein, 10 aa, Homo sapiens
  light chain complementarity determining region 3 for antibody 28038
QQNNNWLGRT

SEQ ID NO: 56076 - protein, 13 aa, Homo sapiens
  heavy chain complementarity determining region 3 for antibody 28038
ARHGRRSGWYYTY

SEQ ID NO: 56077 - protein, 9 aa, Homo sapiens
  light chain complementarity determining region 3 for antibody 28039
QQNNNLPWT

SEQ ID NO: 56078 - protein, 12 aa, Homo sapiens
  heavy chain complementarity determining region 3 for antibody 28039
ARGLSSGWGLDY

SEQ ID NO: 56079 - protein, 9 aa, Homo sapiens
  light chain complementarity determining region 3 for antibody 28040
QQNKTYPFT

SEQ ID NO: 56080 - protein, 14 aa, Homo sapiens
  heavy chain complementarity determining region 3 for antibody 28040
AKSSDTSGYSLFDY

SEQ ID NO: 56081 - protein, 8 aa, Homo sapiens
  light chain complementarity determining region 3 for antibody 28041
QQNGTSPT

SEQ ID NO: 56082 - protein, 22 aa, Homo sapiens
  heavy chain complementarity determining region 3 for antibody 28041
ARGRGTVIRGATTKSYFNVMDV

SEQ ID NO: 56083 - protein, 9 aa, Homo sapiens
  light chain complementarity determining region 3 for antibody 28042
QQNGTSPLT

SEQ ID NO: 56084 - protein, 12 aa, Homo sapiens
  heavy chain complementarity determining region 3 for antibody 28042
ARVNWGLNAFDI

SEQ ID NO: 56085 - protein, 9 aa, Homo sapiens
  light chain complementarity determining region 3 for antibody 28043
QQNGSSPRT

SEQ ID NO: 56086 - protein, 13 aa, Homo sapiens
  heavy chain complementarity determining region 3 for antibody 28043
ASSGYGDYDDLPY

SEQ ID NO: 56087 - protein, 8 aa, Homo sapiens
  light chain complementarity determining region 3 for antibody 28044
QQNGSSIT

SEQ ID NO: 56088 - protein, 15 aa, Homo sapiens
  heavy chain complementarity determining region 3 for antibody 28044
VRNFGSGTYHDAFHI

SEQ ID NO: 56089 - protein, 9 aa, Homo sapiens
  light chain complementarity determining region 3 for antibody 28045
QQNGSSHIT

SEQ ID NO: 56090 - protein, 23 aa, Homo sapiens
  heavy chain complementarity determining region 3 for antibody 28045
AKDGLESYYDSSGTNLAYWYFDL

SEQ ID NO: 56091 - protein, 9 aa, Homo sapiens
  light chain complementarity determining region 3 for antibody 28046
QQNGSPWWT

SEQ ID NO: 56092 - protein, 15 aa, Homo sapiens
  heavy chain complementarity determining region 3 for antibody 28046
ARHMARDSIGYYHDF

SEQ ID NO: 56093 - protein, 6 aa, Homo sapiens
  light chain complementarity determining region 3 for antibody 28047
QQNGRT

SEQ ID NO: 56094 - protein, 12 aa, Homo sapiens
  heavy chain complementarity determining region 3 for antibody 28047
AKLVNSWSPYDY

SEQ ID NO: 56095 - protein, 9 aa, Homo sapiens
  light chain complementarity determining region 3 for antibody 28048
QQNGRSPLT

SEQ ID NO: 56096 - protein, 11 aa, Homo sapiens
  heavy chain complementarity determining region 3 for antibody 28048
AREGNYKPHDY

SEQ ID NO: 56097 - protein, 6 aa, Homo sapiens
  light chain complementarity determining region 3 for antibody 28049
QQNGMT

SEQ ID NO: 56098 - protein, 12 aa, Homo sapiens
  heavy chain complementarity determining region 3 for antibody 28049
ARFANSWYPYDF

SEQ ID NO: 56099 - protein, 10 aa, Homo sapiens
  light chain complementarity determining region 3 for antibody 28050
QQNGGSAGWT

SEQ ID NO: 56100 - protein, 14 aa, Homo sapiens
  heavy chain complementarity determining region 3 for antibody 28050
AREFCRGGNCCFDS

SEQ ID NO: 56101 - protein, 9 aa, Homo sapiens
  light chain complementarity determining region 3 for antibody 28051
QQNDTSPWT

SEQ ID NO: 56102 - protein, 15 aa, Homo sapiens
  heavy chain complementarity determining region 3 for antibody 28051
VHTQLWFGDQCYFDF

SEQ ID NO: 56103 - protein, 9 aa, Homo sapiens
  light chain complementarity determining region 3 for antibody 28052
QQNDNSPPT

SEQ ID NO: 56104 - protein, 19 aa, Homo sapiens
  heavy chain complementarity determining region 3 for antibody 28052
ARDHFPLARGVVSYFYYNY

SEQ ID NO: 56105 - protein, 10 aa, Homo sapiens
  light chain complementarity determining region 3 for antibody 28053
QQNDNLPPLT

SEQ ID NO: 56106 - protein, 14 aa, Homo sapiens
  heavy chain complementarity determining region 3 for antibody 28053
AKGHRIVGATYFDY

SEQ ID NO: 56107 - protein, 10 aa, Homo sapiens
  light chain complementarity determining region 3 for antibody 28054
QQNDNLPPIT

SEQ ID NO: 56108 - protein, 17 aa, Homo sapiens
  heavy chain complementarity determining region 3 for antibody 28054
VRPSDYTSGWYGVAFDT

SEQ ID NO: 56109 - protein, 9 aa, Homo sapiens
  light chain complementarity determining region 3 for antibody 28055
QQLNTYPIT

SEQ ID NO: 56110 - protein, 19 aa, Homo sapiens
  heavy chain complementarity determining region 3 for antibody 28055
ARDVIGNCGSDCYFWYFDL

SEQ ID NO: 56111 - protein, 9 aa, Homo sapiens
  light chain complementarity determining region 3 for antibody 28056
QQLNTYPFT

SEQ ID NO: 56112 - protein, 15 aa, Homo sapiens
  heavy chain complementarity determining region 3 for antibody 28056
ARGLMVRGINDGVDI

SEQ ID NO: 56113 - protein, 9 aa, Homo sapiens
  light chain complementarity determining region 3 for antibody 28057
QQLNSYPYP

SEQ ID NO: 56114 - protein, 12 aa, Homo sapiens
  heavy chain complementarity determining region 3 for antibody 28057
AIWGGAKGGLPY

SEQ ID NO: 56115 - protein, 9 aa, Homo sapiens
  light chain complementarity determining region 3 for antibody 28058
QQLNSYPST

SEQ ID NO: 56116 - protein, 12 aa, Homo sapiens
  heavy chain complementarity determining region 3 for antibody 28058
AIWGGAKGGLPY

SEQ ID NO: 56117 - protein, 9 aa, Homo sapiens
  light chain complementarity determining region 3 for antibody 28059
QQLNSYPQY

SEQ ID NO: 56118 - protein, 16 aa, Homo sapiens
  heavy chain complementarity determining region 3 for antibody 28059
ARIKRSLVGAQDAFDI

SEQ ID NO: 56119 - protein, 9 aa, Homo sapiens
  light chain complementarity determining region 3 for antibody 28060
QQLNSYPPT

SEQ ID NO: 56120 - protein, 12 aa, Homo sapiens
  heavy chain complementarity determining region 3 for antibody 28060
ARTSLSHDYGYY

SEQ ID NO: 56121 - protein, 9 aa, Homo sapiens
  light chain complementarity determining region 3 for antibody 28061
QQLNSYPLT

SEQ ID NO: 56122 - protein, 15 aa, Homo sapiens
  heavy chain complementarity determining region 3 for antibody 28061
AREVYGSGSYYLIDY

SEQ ID NO: 56123 - protein, 9 aa, Homo sapiens
  light chain complementarity determining region 3 for antibody 28062
QQLNSYPIT

SEQ ID NO: 56124 - protein, 18 aa, Homo sapiens
  heavy chain complementarity determining region 3 for antibody 28062
ARPLAYTIIAIHPAGIEH

SEQ ID NO: 56125 - protein, 9 aa, Homo sapiens
  light chain complementarity determining region 3 for antibody 28063
QQLNSYPHT

SEQ ID NO: 56126 - protein, 12 aa, Homo sapiens
  heavy chain complementarity determining region 3 for antibody 28063
ARTSLSHDYGDY

SEQ ID NO: 56127 - protein, 9 aa, Homo sapiens
  light chain complementarity determining region 3 for antibody 28064
QQLNNYPYT

SEQ ID NO: 56128 - protein, 25 aa, Homo sapiens
  heavy chain complementarity determining region 3 for antibody 28064
ARDFGGWREDYDYVWGSWRSDGLDY

SEQ ID NO: 56129 - protein, 9 aa, Homo sapiens
  light chain complementarity determining region 3 for antibody 28065
QQLNNYPIT

SEQ ID NO: 56130 - protein, 19 aa, Homo sapiens
  heavy chain complementarity determining region 3 for antibody 28065
ARDVIRNCGSDCYFWYFDL

SEQ ID NO: 56131 - protein, 9 aa, Homo sapiens
  light chain complementarity determining region 3 for antibody 28066
QQLKSYPPT

SEQ ID NO: 56132 - protein, 13 aa, Homo sapiens
  heavy chain complementarity determining region 3 for antibody 28066
VPVMEVTLGAFAF

SEQ ID NO: 56133 - protein, 9 aa, Homo sapiens
  light chain complementarity determining region 3 for antibody 28067
QQLKSYPLP

SEQ ID NO: 56134 - protein, 13 aa, Homo sapiens
  heavy chain complementarity determining region 3 for antibody 28067
VPVMEVTLGAFAF

SEQ ID NO: 56135 - protein, 11 aa, Homo sapiens
  light chain complementarity determining region 3 for antibody 28068
QQLKDYPRELT

SEQ ID NO: 56136 - protein, 14 aa, Homo sapiens
  heavy chain complementarity determining region 3 for antibody 28068
ARDLFGGRPGAFDS

SEQ ID NO: 56137 - protein, 11 aa, Homo sapiens
  light chain complementarity determining region 3 for antibody 28069
QQLKDYPRELT

SEQ ID NO: 56138 - protein, 14 aa, Homo sapiens
  heavy chain complementarity determining region 3 for antibody 28069
ARDLFGGCPGAFDS

SEQ ID NO: 56139 - protein, 9 aa, Homo sapiens
  light chain complementarity determining region 3 for antibody 28070
QQLHKSPWP

SEQ ID NO: 56140 - protein, 14 aa, Homo sapiens
  heavy chain complementarity determining region 3 for antibody 28070
ARAAPEYEWLVPDY

SEQ ID NO: 56141 - protein, 10 aa, Homo sapiens
  light chain complementarity determining region 3 for antibody 28071
QQLDSSPPRT

SEQ ID NO: 56142 - protein, 13 aa, Homo sapiens
  heavy chain complementarity determining region 3 for antibody 28071
ARLIYVDYVFLDY

SEQ ID NO: 56143 - protein, 9 aa, Homo sapiens
  light chain complementarity determining region 3 for antibody 28072
QQLDSSPLT

SEQ ID NO: 56144 - protein, 15 aa, Homo sapiens
  heavy chain complementarity determining region 3 for antibody 28072
AKDKGPGVRVYFCDS

SEQ ID NO: 56145 - protein, 9 aa, Homo sapiens
  light chain complementarity determining region 3 for antibody 28073
QQKYSTPPT

SEQ ID NO: 56146 - protein, 16 aa, Homo sapiens
  heavy chain complementarity determining region 3 for antibody 28073
AVGADTAMVTFGNFDY

SEQ ID NO: 56147 - protein, 9 aa, Homo sapiens
  light chain complementarity determining region 3 for antibody 28074
QQIYTTPFT

SEQ ID NO: 56148 - protein, 11 aa, Homo sapiens
  heavy chain complementarity determining region 3 for antibody 28074
ARDSGSHYLDN

SEQ ID NO: 56149 - protein, 8 aa, Homo sapiens
  light chain complementarity determining region 3 for antibody 28075
QQICATRT

SEQ ID NO: 56150 - protein, 8 aa, Homo sapiens
  heavy chain complementarity determining region 3 for antibody 28075
AKGYGFDS

SEQ ID NO: 56151 - protein, 9 aa, Homo sapiens
  light chain complementarity determining region 3 for antibody 28076
QQHYTTPPS

SEQ ID NO: 56152 - protein, 17 aa, Homo sapiens
  heavy chain complementarity determining region 3 for antibody 28076
GRGSMAAGGTRSSVLDY

SEQ ID NO: 56153 - protein, 9 aa, Homo sapiens
  light chain complementarity determining region 3 for antibody 28077
QQHYTLPPT

SEQ ID NO: 56154 - protein, 20 aa, Homo sapiens
  heavy chain complementarity determining region 3 for antibody 28077
AHLLGYCTSYCYGRGFLFDY

SEQ ID NO: 56155 - protein, 8 aa, Homo sapiens
  light chain complementarity determining region 3 for antibody 28078
QQHRNPFT

SEQ ID NO: 56156 - protein, 15 aa, Homo sapiens
  heavy chain complementarity determining region 3 for antibody 28078
ARAWGAATTSYSCDN

SEQ ID NO: 56157 - protein, 8 aa, Homo sapiens
  light chain complementarity determining region 3 for antibody 28079
QQHNTYAT

SEQ ID NO: 56158 - protein, 17 aa, Homo sapiens
  heavy chain complementarity determining region 3 for antibody 28079
AHRLDHNGMWNEGIFDH

SEQ ID NO: 56159 - protein, 8 aa, Homo sapiens
  light chain complementarity determining region 3 for antibody 28080
QQHNSYYT

SEQ ID NO: 56160 - protein, 10 aa, Homo sapiens
  heavy chain complementarity determining region 3 for antibody 28080
GRDSDGQWLL

SEQ ID NO: 56161 - protein, 9 aa, Homo sapiens
  light chain complementarity determining region 3 for antibody 28081
QQHNSYPYT

SEQ ID NO: 56162 - protein, 14 aa, Homo sapiens
  heavy chain complementarity determining region 3 for antibody 28081
AKDVTPMVMGYSDY

SEQ ID NO: 56163 - protein, 9 aa, Homo sapiens
  light chain complementarity determining region 3 for antibody 28082
QQHNSYPLT

SEQ ID NO: 56164 - protein, 13 aa, Homo sapiens
  heavy chain complementarity determining region 3 for antibody 28082
ATRITRFGVESEY

SEQ ID NO: 56165 - protein, 9 aa, Homo sapiens
  light chain complementarity determining region 3 for antibody 28083
QQHISYPWT

SEQ ID NO: 56166 - protein, 19 aa, Homo sapiens
  heavy chain complementarity determining region 3 for antibody 28083
ARVSARRILTAPRYPLIDS

SEQ ID NO: 56167 - protein, 9 aa, Homo sapiens
  light chain complementarity determining region 3 for antibody 28084
QQHGSSPPT

SEQ ID NO: 56168 - protein, 12 aa, Homo sapiens
  heavy chain complementarity determining region 3 for antibody 28084
ARGPQLWFYFDY

SEQ ID NO: 56169 - protein, 8 aa, Homo sapiens
  light chain complementarity determining region 3 for antibody 28085
QQHGSPIT

SEQ ID NO: 56170 - protein, 14 aa, Homo sapiens
  heavy chain complementarity determining region 3 for antibody 28085
TRDPVEGPPDYFDY

SEQ ID NO: 56171 - protein, 9 aa, Homo sapiens
  light chain complementarity determining region 3 for antibody 28086
QQHGRSPWT

SEQ ID NO: 56172 - protein, 18 aa, Homo sapiens
  heavy chain complementarity determining region 3 for antibody 28086
ATMPSLAEPGRIYWYFDL

SEQ ID NO: 56173 - protein, 6 aa, Homo sapiens
  light chain complementarity determining region 3 for antibody 28087
QQHGMT

SEQ ID NO: 56174 - protein, 12 aa, Homo sapiens
  heavy chain complementarity determining region 3 for antibody 28087
ARFANSWYPYDF

SEQ ID NO: 56175 - protein, 8 aa, Homo sapiens
  light chain complementarity determining region 3 for antibody 28088
QQHGGSPS

SEQ ID NO: 56176 - protein, 16 aa, Homo sapiens
  heavy chain complementarity determining region 3 for antibody 28088
ATDWGSGTQWIRAFDV

SEQ ID NO: 56177 - protein, 9 aa, Homo sapiens
  light chain complementarity determining region 3 for antibody 28089
QQHDSSSYT

SEQ ID NO: 56178 - protein, 11 aa, Homo sapiens
  heavy chain complementarity determining region 3 for antibody 28089
ARGGFYGSFDF

SEQ ID NO: 56179 - protein, 8 aa, Homo sapiens
  light chain complementarity determining region 3 for antibody 28090
QQHDKLYT

SEQ ID NO: 56180 - protein, 13 aa, Homo sapiens
  heavy chain complementarity determining region 3 for antibody 28090
VTGGIYTTGPLDF

SEQ ID NO: 56181 - protein, 9 aa, Homo sapiens
  light chain complementarity determining region 3 for antibody 28091
QQGYSSPYA

SEQ ID NO: 56182 - protein, 14 aa, Homo sapiens
  heavy chain complementarity determining region 3 for antibody 28091
ARDPQGGKPDYFDY

SEQ ID NO: 56183 - protein, 9 aa, Homo sapiens
  light chain complementarity determining region 3 for antibody 28092
QQGYRHPFI

SEQ ID NO: 56184 - protein, 15 aa, Homo sapiens
  heavy chain complementarity determining region 3 for antibody 28092
TRAQVIWGQLYYFDY

SEQ ID NO: 56185 - protein, 9 aa, Homo sapiens
  light chain complementarity determining region 3 for antibody 28093
QQGYDTPRT

SEQ ID NO: 56186 - protein, 12 aa, Homo sapiens
  heavy chain complementarity determining region 3 for antibody 28093
ASGGSRVTTLRY

SEQ ID NO: 56187 - protein, 9 aa, Homo sapiens
  light chain complementarity determining region 3 for antibody 28094
QQGVSFPIT

SEQ ID NO: 56188 - protein, 12 aa, Homo sapiens
  heavy chain complementarity determining region 3 for antibody 28094
TRHRSSERKFDP

SEQ ID NO: 56189 - protein, 9 aa, Homo sapiens
  light chain complementarity determining region 3 for antibody 28095
QQGSTYPLT

SEQ ID NO: 56190 - protein, 20 aa, Homo sapiens
  heavy chain complementarity determining region 3 for antibody 28095
ARYPRREHSPGTTGYYSFDY

SEQ ID NO: 56191 - protein, 9 aa, Homo sapiens
  light chain complementarity determining region 3 for antibody 28096
QQGSTYPLP

SEQ ID NO: 56192 - protein, 20 aa, Homo sapiens
  heavy chain complementarity determining region 3 for antibody 28096
ARYPRREHNPGTTGYYSFDY

SEQ ID NO: 56193 - protein, 9 aa, Homo sapiens
  light chain complementarity determining region 3 for antibody 28097
QQGRTYPLT

SEQ ID NO: 56194 - protein, 20 aa, Homo sapiens
  heavy chain complementarity determining region 3 for antibody 28097
ARYPRREHNPGTTGYYSFDY

SEQ ID NO: 56195 - protein, 9 aa, Homo sapiens
  light chain complementarity determining region 3 for antibody 28098
QQGNSYPLT

SEQ ID NO: 56196 - protein, 12 aa, Homo sapiens
  heavy chain complementarity determining region 3 for antibody 28098
TRGGGPNSPFHY

SEQ ID NO: 56197 - protein, 9 aa, Homo sapiens
  light chain complementarity determining region 3 for antibody 28099
QQGHSSPVS

SEQ ID NO: 56198 - protein, 12 aa, Homo sapiens
  heavy chain complementarity determining region 3 for antibody 28099
ASATITWRHLWS

SEQ ID NO: 56199 - protein, 9 aa, Homo sapiens
  light chain complementarity determining region 3 for antibody 28100
QQGDSNPYT

SEQ ID NO: 56200 - protein, 14 aa, Homo sapiens
  heavy chain complementarity determining region 3 for antibody 28100
GTDPAPDKPDYIDY

SEQ ID NO: 56201 - protein, 9 aa, Homo sapiens
  light chain complementarity determining region 3 for antibody 28101
QQGCSSPLS

SEQ ID NO: 56202 - protein, 15 aa, Homo sapiens
  heavy chain complementarity determining region 3 for antibody 28101
ARAQVIWGQLYYFDS

SEQ ID NO: 56203 - protein, 9 aa, Homo sapiens
  light chain complementarity determining region 3 for antibody 28102
QQGATAPLT

SEQ ID NO: 56204 - protein, 10 aa, Homo sapiens
  heavy chain complementarity determining region 3 for antibody 28102
AWGFGWSSDY

SEQ ID NO: 56205 - protein, 9 aa, Homo sapiens
  light chain complementarity determining region 3 for antibody 28103
QQGASIPYT

SEQ ID NO: 56206 - protein, 14 aa, Homo sapiens
  heavy chain complementarity determining region 3 for antibody 28103
GTDPAPDKPDYIDY

SEQ ID NO: 56207 - protein, 9 aa, Homo sapiens
  light chain complementarity determining region 3 for antibody 28104
QQFYTTPRT

SEQ ID NO: 56208 - protein, 8 aa, Homo sapiens
  heavy chain complementarity determining region 3 for antibody 28104
ARDGAFDS

SEQ ID NO: 56209 - protein, 9 aa, Homo sapiens
  light chain complementarity determining region 3 for antibody 28105
QQFTYSPWT

SEQ ID NO: 56210 - protein, 9 aa, Homo sapiens
  heavy chain complementarity determining region 3 for antibody 28105
ATGISGWTH

SEQ ID NO: 56211 - protein, 9 aa, Homo sapiens
  light chain complementarity determining region 3 for antibody 28106
QQFNSYSGT

SEQ ID NO: 56212 - protein, 16 aa, Homo sapiens
  heavy chain complementarity determining region 3 for antibody 28106
ARAPLGYSASLGGLDI

SEQ ID NO: 56213 - protein, 9 aa, Homo sapiens
  light chain complementarity determining region 3 for antibody 28107
QQFNSYPST

SEQ ID NO: 56214 - protein, 13 aa, Homo sapiens
  heavy chain complementarity determining region 3 for antibody 28107
ARDGYSYGYESDY

SEQ ID NO: 56215 - protein, 10 aa, Homo sapiens
  light chain complementarity determining region 3 for antibody 28108
QQFGVSPPWA

SEQ ID NO: 56216 - protein, 12 aa, Homo sapiens
  heavy chain complementarity determining region 3 for antibody 28108
ARVPYFYYTMDV

SEQ ID NO: 56217 - protein, 9 aa, Homo sapiens
  light chain complementarity determining region 3 for antibody 28109
QQFGSSPRT

SEQ ID NO: 56218 - protein, 23 aa, Homo sapiens
  heavy chain complementarity determining region 3 for antibody 28109
ATAFNFERSASNYVQGLRGPFDI

SEQ ID NO: 56219 - protein, 9 aa, Homo sapiens
  light chain complementarity determining region 3 for antibody 28110
QQFGSSPLP

SEQ ID NO: 56220 - protein, 13 aa, Homo sapiens
  heavy chain complementarity determining region 3 for antibody 28110
ARRLLLTGYRFDP

SEQ ID NO: 56221 - protein, 9 aa, Homo sapiens
  light chain complementarity determining region 3 for antibody 28111
QQFDDSGHT

SEQ ID NO: 56222 - protein, 13 aa, Homo sapiens
  heavy chain complementarity determining region 3 for antibody 28111
VRERHPGAFYFDF

SEQ ID NO: 56223 - protein, 9 aa, Homo sapiens
  light chain complementarity determining region 3 for antibody 28112
QQFDDSGDT

SEQ ID NO: 56224 - protein, 13 aa, Homo sapiens
  heavy chain complementarity determining region 3 for antibody 28112
VRERHPGAFYFDF

SEQ ID NO: 56225 - protein, 9 aa, Homo sapiens
  light chain complementarity determining region 3 for antibody 28113
QQDYTSVRT

SEQ ID NO: 56226 - protein, 12 aa, Homo sapiens
  heavy chain complementarity determining region 3 for antibody 28113
VKDCGLGGSRDS

SEQ ID NO: 56227 - protein, 9 aa, Homo sapiens
  light chain complementarity determining region 3 for antibody 28114
QQDSSSPWT

SEQ ID NO: 56228 - protein, 13 aa, Homo sapiens
  heavy chain complementarity determining region 3 for antibody 28114
ARGSTNWRNWFDP

SEQ ID NO: 56229 - protein, 9 aa, Homo sapiens
  light chain complementarity determining region 3 for antibody 28115
QQDSNWPLT

SEQ ID NO: 56230 - protein, 20 aa, Homo sapiens
  heavy chain complementarity determining region 3 for antibody 28115
AKWHMITFGGAIVEPDTFEI

SEQ ID NO: 56231 - protein, 9 aa, Homo sapiens
  light chain complementarity determining region 3 for antibody 28116
QQDSDVPLT

SEQ ID NO: 56232 - protein, 9 aa, Homo sapiens
  heavy chain complementarity determining region 3 for antibody 28116
VCLGVTPPV

SEQ ID NO: 56233 - protein, 9 aa, Homo sapiens
  light chain complementarity determining region 3 for antibody 28117
QQDRRSPST

SEQ ID NO: 56234 - protein, 17 aa, Homo sapiens
  heavy chain complementarity determining region 3 for antibody 28117
AGLSSRLGDGSPSLFDY

SEQ ID NO: 56235 - protein, 9 aa, Homo sapiens
  light chain complementarity determining region 3 for antibody 28118
QQDNRFPLT

SEQ ID NO: 56236 - protein, 14 aa, Homo sapiens
  heavy chain complementarity determining region 3 for antibody 28118
TTDSPLRRYNYFVY

SEQ ID NO: 56237 - protein, 9 aa, Homo sapiens
  light chain complementarity determining region 3 for antibody 28119
QQDNNWPNT

SEQ ID NO: 56238 - protein, 16 aa, Homo sapiens
  heavy chain complementarity determining region 3 for antibody 28119
ARGLSSLASKPGACDF

SEQ ID NO: 56239 - protein, 9 aa, Homo sapiens
  light chain complementarity determining region 3 for antibody 28120
QQDGTSPRT

SEQ ID NO: 56240 - protein, 13 aa, Homo sapiens
  heavy chain complementarity determining region 3 for antibody 28120
PIGFYDRSGYHEY

SEQ ID NO: 56241 - protein, 9 aa, Homo sapiens
  light chain complementarity determining region 3 for antibody 28121
QQDGTPPRT

SEQ ID NO: 56242 - protein, 25 aa, Homo sapiens
  heavy chain complementarity determining region 3 for antibody 28121
ARLRVDRLRLPGAMRGPLYDRGLNV

SEQ ID NO: 56243 - protein, 9 aa, Homo sapiens
  light chain complementarity determining region 3 for antibody 28122
QQDGSSPYT

SEQ ID NO: 56244 - protein, 17 aa, Homo sapiens
  heavy chain complementarity determining region 3 for antibody 28122
ARGTGYNYGYGGVHFDY

SEQ ID NO: 56245 - protein, 9 aa, Homo sapiens
  light chain complementarity determining region 3 for antibody 28123
QQDGSSPWT

SEQ ID NO: 56246 - protein, 20 aa, Homo sapiens
  heavy chain complementarity determining region 3 for antibody 28123
ARLKAASAGLPSYYYAGMDV

SEQ ID NO: 56247 - protein, 9 aa, Homo sapiens
  light chain complementarity determining region 3 for antibody 28124
QQDGSSPVT

SEQ ID NO: 56248 - protein, 21 aa, Homo sapiens
  heavy chain complementarity determining region 3 for antibody 28124
ARVPPRYDSSGYPTPGGYMDV

SEQ ID NO: 56249 - protein, 9 aa, Homo sapiens
  light chain complementarity determining region 3 for antibody 28125
QQDGSSPRT

SEQ ID NO: 56250 - protein, 13 aa, Homo sapiens
  heavy chain complementarity determining region 3 for antibody 28125
ASSGYGDYDDLPY

SEQ ID NO: 56251 - protein, 10 aa, Homo sapiens
  light chain complementarity determining region 3 for antibody 28126
QQDGSSPQWT

SEQ ID NO: 56252 - protein, 11 aa, Homo sapiens
  heavy chain complementarity determining region 3 for antibody 28126
TREKVGGYFDY

SEQ ID NO: 56253 - protein, 9 aa, Homo sapiens
  light chain complementarity determining region 3 for antibody 28127
QQDGSSPPT

SEQ ID NO: 56254 - protein, 11 aa, Homo sapiens
  heavy chain complementarity determining region 3 for antibody 28127
ARGDLWSAFDI

SEQ ID NO: 56255 - protein, 10 aa, Homo sapiens
  light chain complementarity determining region 3 for antibody 28128
QQDGSSPLFT

SEQ ID NO: 56256 - protein, 15 aa, Homo sapiens
  heavy chain complementarity determining region 3 for antibody 28128
TTAGYSYGYRFFFDY

SEQ ID NO: 56257 - protein, 9 aa, Homo sapiens
  light chain complementarity determining region 3 for antibody 28129
QQDGSSPFT

SEQ ID NO: 56258 - protein, 23 aa, Homo sapiens
  heavy chain complementarity determining region 3 for antibody 28129
ARGLRSSDWSKIMDMDSYYALDV

SEQ ID NO: 56259 - protein, 9 aa, Homo sapiens
  light chain complementarity determining region 3 for antibody 28130
QQDGSSPFT

SEQ ID NO: 56260 - protein, 16 aa, Homo sapiens
  heavy chain complementarity determining region 3 for antibody 28130
ARERRGFGVVIGPLDY

SEQ ID NO: 56261 - protein, 10 aa, Homo sapiens
  light chain complementarity determining region 3 for antibody 28131
QQDGSSPALP

SEQ ID NO: 56262 - protein, 23 aa, Homo sapiens
  heavy chain complementarity determining region 3 for antibody 28131
ARAPSQYYYDSSGYYYPTNWFDP

SEQ ID NO: 56263 - protein, 8 aa, Homo sapiens
  light chain complementarity determining region 3 for antibody 28132
QQDGSSLT

SEQ ID NO: 56264 - protein, 16 aa, Homo sapiens
  heavy chain complementarity determining region 3 for antibody 28132
VRDRPRSSSSWTSFEY

SEQ ID NO: 56265 - protein, 9 aa, Homo sapiens
  light chain complementarity determining region 3 for antibody 28133
QQDGSSLIT

SEQ ID NO: 56266 - protein, 13 aa, Homo sapiens
  heavy chain complementarity determining region 3 for antibody 28133
ARGSGSHQDECDY

SEQ ID NO: 56267 - protein, 9 aa, Homo sapiens
  light chain complementarity determining region 3 for antibody 28134
QQDGSSIFT

SEQ ID NO: 56268 - protein, 12 aa, Homo sapiens
  heavy chain complementarity determining region 3 for antibody 28134
ARHGGGTWYTDY

SEQ ID NO: 56269 - protein, 11 aa, Homo sapiens
  light chain complementarity determining region 3 for antibody 28135
QQDGSPVPVYS

SEQ ID NO: 56270 - protein, 16 aa, Homo sapiens
  heavy chain complementarity determining region 3 for antibody 28135
VKDQVAANGICDPFDI

SEQ ID NO: 56271 - protein, 9 aa, Homo sapiens
  light chain complementarity determining region 3 for antibody 28136
QQDGSLPRT

SEQ ID NO: 56272 - protein, 14 aa, Homo sapiens
  heavy chain complementarity determining region 3 for antibody 28136
AGGDFCGSDCYSEY

SEQ ID NO: 56273 - protein, 9 aa, Homo sapiens
  light chain complementarity determining region 3 for antibody 28137
QQDGSIPRT

SEQ ID NO: 56274 - protein, 14 aa, Homo sapiens
  heavy chain complementarity determining region 3 for antibody 28137
AGGKFCGGDCYREY

SEQ ID NO: 56275 - protein, 9 aa, Homo sapiens
  light chain complementarity determining region 3 for antibody 28138
QQDGSFPYT

SEQ ID NO: 56276 - protein, 14 aa, Homo sapiens
  heavy chain complementarity determining region 3 for antibody 28138
ARGGFIVAWGLFDY

SEQ ID NO: 56277 - protein, 6 aa, Homo sapiens
  light chain complementarity determining region 3 for antibody 28139
QQDGRT

SEQ ID NO: 56278 - protein, 12 aa, Homo sapiens
  heavy chain complementarity determining region 3 for antibody 28139
AKLVNSWYPYDY

SEQ ID NO: 56279 - protein, 9 aa, Homo sapiens
  light chain complementarity determining region 3 for antibody 28140
QQDGRSPYT

SEQ ID NO: 56280 - protein, 21 aa, Homo sapiens
  heavy chain complementarity determining region 3 for antibody 28140
ARVYGGYSSGWSDEYLYYFDY

SEQ ID NO: 56281 - protein, 9 aa, Homo sapiens
  light chain complementarity determining region 3 for antibody 28141
QQDGRSPWT

SEQ ID NO: 56282 - protein, 18 aa, Homo sapiens
  heavy chain complementarity determining region 3 for antibody 28141
ATMPSLAEPGRIYWYFDL

SEQ ID NO: 56283 - protein, 9 aa, Homo sapiens
  light chain complementarity determining region 3 for antibody 28142
QQDGRLPIT

SEQ ID NO: 56284 - protein, 11 aa, Homo sapiens
  heavy chain complementarity determining region 3 for antibody 28142
AHRFRTYYFDF

SEQ ID NO: 56285 - protein, 9 aa, Homo sapiens
  light chain complementarity determining region 3 for antibody 28143
QQDGNSPLT

SEQ ID NO: 56286 - protein, 15 aa, Homo sapiens
  heavy chain complementarity determining region 3 for antibody 28143
AKSDSQYYYYYAMDV

SEQ ID NO: 56287 - protein, 9 aa, Homo sapiens
  light chain complementarity determining region 3 for antibody 28144
QQDGNSPFT

SEQ ID NO: 56288 - protein, 15 aa, Homo sapiens
  heavy chain complementarity determining region 3 for antibody 28144
ARQKGQRASAGYFDS

SEQ ID NO: 56289 - protein, 9 aa, Homo sapiens
  light chain complementarity determining region 3 for antibody 28145
QQDGISPRT

SEQ ID NO: 56290 - protein, 13 aa, Homo sapiens
  heavy chain complementarity determining region 3 for antibody 28145
ARDVAGWPFVNNY

SEQ ID NO: 56291 - protein, 9 aa, Homo sapiens
  light chain complementarity determining region 3 for antibody 28146
QQDGHLPRT

SEQ ID NO: 56292 - protein, 13 aa, Homo sapiens
  heavy chain complementarity determining region 3 for antibody 28146
AGGDFHRGGYSEY

SEQ ID NO: 56293 - protein, 8 aa, Homo sapiens
  light chain complementarity determining region 3 for antibody 28147
QQDGGSPS

SEQ ID NO: 56294 - protein, 16 aa, Homo sapiens
  heavy chain complementarity determining region 3 for antibody 28147
ATDWGSGTQWIRAFDV

SEQ ID NO: 56295 - protein, 10 aa, Homo sapiens
  light chain complementarity determining region 3 for antibody 28148
QQDGGSPQYT

SEQ ID NO: 56296 - protein, 15 aa, Homo sapiens
  heavy chain complementarity determining region 3 for antibody 28148
ARDDRFATRFHSLDT

SEQ ID NO: 56297 - protein, 9 aa, Homo sapiens
  light chain complementarity determining region 3 for antibody 28149
QQDGGSGYT

SEQ ID NO: 56298 - protein, 17 aa, Homo sapiens
  heavy chain complementarity determining region 3 for antibody 28149
ARPAVTEFRGINDALDI

SEQ ID NO: 56299 - protein, 9 aa, Homo sapiens
  light chain complementarity determining region 3 for antibody 28150
QQDGASPRT

SEQ ID NO: 56300 - protein, 16 aa, Homo sapiens
  heavy chain complementarity determining region 3 for antibody 28150
AKSLGWDTMTTRVYDS

SEQ ID NO: 56301 - protein, 10 aa, Homo sapiens
  light chain complementarity determining region 3 for antibody 28151
QQDDSSSYFT

SEQ ID NO: 56302 - protein, 14 aa, Homo sapiens
  heavy chain complementarity determining region 3 for antibody 28151
ASVKRGGGRPRFDN

SEQ ID NO: 56303 - protein, 9 aa, Homo sapiens
  light chain complementarity determining region 3 for antibody 28152
QQDDSLPIP

SEQ ID NO: 56304 - protein, 20 aa, Homo sapiens
  heavy chain complementarity determining region 3 for antibody 28152
ARGPHIVVLTSIPWRWSFGL

SEQ ID NO: 56305 - protein, 9 aa, Homo sapiens
  light chain complementarity determining region 3 for antibody 28153
QQDDNWPQA

SEQ ID NO: 56306 - protein, 16 aa, Homo sapiens
  heavy chain complementarity determining region 3 for antibody 28153
ASLPRGGTYWKNVLDV

SEQ ID NO: 56307 - protein, 8 aa, Homo sapiens
  light chain complementarity determining region 3 for antibody 28154
QQDDKLYT

SEQ ID NO: 56308 - protein, 13 aa, Homo sapiens
  heavy chain complementarity determining region 3 for antibody 28154
VTGGIYTTGPLDF

SEQ ID NO: 56309 - protein, 9 aa, Homo sapiens
  light chain complementarity determining region 3 for antibody 28155
QQCYSAPFH

SEQ ID NO: 56310 - protein, 16 aa, Homo sapiens
  heavy chain complementarity determining region 3 for antibody 28155
ARGLVHDSSSWYGIDF

SEQ ID NO: 56311 - protein, 10 aa, Homo sapiens
  light chain complementarity determining region 3 for antibody 28156
QQCYGTPMYT

SEQ ID NO: 56312 - protein, 15 aa, Homo sapiens
  heavy chain complementarity determining region 3 for antibody 28156
ARFAESSRYYRPFDY

SEQ ID NO: 56313 - protein, 9 aa, Homo sapiens
  light chain complementarity determining region 3 for antibody 28157
QQCYALPYT

SEQ ID NO: 56314 - protein, 11 aa, Homo sapiens
  heavy chain complementarity determining region 3 for antibody 28157
VRLNGWGRFDA

SEQ ID NO: 56315 - protein, 9 aa, Homo sapiens
  light chain complementarity determining region 3 for antibody 28158
QQCVSFPIT

SEQ ID NO: 56316 - protein, 12 aa, Homo sapiens
  heavy chain complementarity determining region 3 for antibody 28158
TRHRSSDRKFDP

SEQ ID NO: 56317 - protein, 9 aa, Homo sapiens
  light chain complementarity determining region 3 for antibody 28159
QQCVSFPFT

SEQ ID NO: 56318 - protein, 12 aa, Homo sapiens
  heavy chain complementarity determining region 3 for antibody 28159
TRHRSSERKFDP

SEQ ID NO: 56319 - protein, 10 aa, Homo sapiens
  light chain complementarity determining region 3 for antibody 28160
QQCHTFSRFT

SEQ ID NO: 56320 - protein, 17 aa, Homo sapiens
  heavy chain complementarity determining region 3 for antibody 28160
ARTRVTGGYLRRGAFDI

SEQ ID NO: 56321 - protein, 10 aa, Homo sapiens
  light chain complementarity determining region 3 for antibody 28161
QQCHATPPYT

SEQ ID NO: 56322 - protein, 14 aa, Homo sapiens
  heavy chain complementarity determining region 3 for antibody 28161
TTDAGLIHRPSFDY

SEQ ID NO: 56323 - protein, 9 aa, Homo sapiens
  light chain complementarity determining region 3 for antibody 28162
QQCGDSPWT

SEQ ID NO: 56324 - protein, 15 aa, Homo sapiens
  heavy chain complementarity determining region 3 for antibody 28162
ASPPVGDYPKGVLDI

SEQ ID NO: 56325 - protein, 11 aa, Homo sapiens
  light chain complementarity determining region 3 for antibody 28163
QQCETPPPMYT

SEQ ID NO: 56326 - protein, 23 aa, Homo sapiens
  heavy chain complementarity determining region 3 for antibody 28163
ARASRGYRRSDSRMEFFFYGLDV

SEQ ID NO: 56327 - protein, 9 aa, Homo sapiens
  light chain complementarity determining region 3 for antibody 28164
QQCDDLPLT

SEQ ID NO: 56328 - protein, 16 aa, Homo sapiens
  heavy chain complementarity determining region 3 for antibody 28164
ARDTQGGGSESGSLDY

SEQ ID NO: 56329 - protein, 9 aa, Homo sapiens
  light chain complementarity determining region 3 for antibody 28165
QQATDFPFT

SEQ ID NO: 56330 - protein, 15 aa, Homo sapiens
  heavy chain complementarity determining region 3 for antibody 28165
VRVEYRGDPTPYFAL

SEQ ID NO: 56331 - protein, 9 aa, Homo sapiens
  light chain complementarity determining region 3 for antibody 28166
QQARSGPLT

SEQ ID NO: 56332 - protein, 15 aa, Homo sapiens
  heavy chain complementarity determining region 3 for antibody 28166
ARRPAQWTAGIWFDA

SEQ ID NO: 56333 - protein, 9 aa, Homo sapiens
  light chain complementarity determining region 3 for antibody 28167
QQARSGPIT

SEQ ID NO: 56334 - protein, 15 aa, Homo sapiens
  heavy chain complementarity determining region 3 for antibody 28167
ARRPAQWTAGIWFDA

SEQ ID NO: 56335 - protein, 9 aa, Homo sapiens
  light chain complementarity determining region 3 for antibody 28168
QQANTFPLT

SEQ ID NO: 56336 - protein, 20 aa, Homo sapiens
  heavy chain complementarity determining region 3 for antibody 28168
ARDSNAPTLSDYDYHYGMDV

SEQ ID NO: 56337 - protein, 9 aa, Homo sapiens
  light chain complementarity determining region 3 for antibody 28169
QQANSFPLT

SEQ ID NO: 56338 - protein, 21 aa, Homo sapiens
  heavy chain complementarity determining region 3 for antibody 28169
GSDYQRGPLVVVVGRSPHVDS

SEQ ID NO: 56339 - protein, 9 aa, Homo sapiens
  light chain complementarity determining region 3 for antibody 28170
QQANSFPHT

SEQ ID NO: 56340 - protein, 15 aa, Homo sapiens
  heavy chain complementarity determining region 3 for antibody 28170
ARGGYGGSLYWYFDL

SEQ ID NO: 56341 - protein, 9 aa, Homo sapiens
  light chain complementarity determining region 3 for antibody 28171
QQALTFPLT

SEQ ID NO: 56342 - protein, 11 aa, Homo sapiens
  heavy chain complementarity determining region 3 for antibody 28171
ARDTPGIGIDY

SEQ ID NO: 56343 - protein, 9 aa, Homo sapiens
  light chain complementarity determining region 3 for antibody 28172
QQAHSFPRT

SEQ ID NO: 56344 - protein, 13 aa, Homo sapiens
  heavy chain complementarity determining region 3 for antibody 28172
ARDLRVGRDGLDV

SEQ ID NO: 56345 - protein, 9 aa, Homo sapiens
  light chain complementarity determining region 3 for antibody 28173
QQADRKPFT

SEQ ID NO: 56346 - protein, 14 aa, Homo sapiens
  heavy chain complementarity determining region 3 for antibody 28173
ARDNSNNWYEGMDV

SEQ ID NO: 56347 - protein, 10 aa, Homo sapiens
  light chain complementarity determining region 3 for antibody 28174
QPYYNWPPLT

SEQ ID NO: 56348 - protein, 14 aa, Homo sapiens
  heavy chain complementarity determining region 3 for antibody 28174
AREATAMLRGYFDY

SEQ ID NO: 56349 - protein, 8 aa, Homo sapiens
  light chain complementarity determining region 3 for antibody 28175
QPYNTFWT

SEQ ID NO: 56350 - protein, 15 aa, Homo sapiens
  heavy chain complementarity determining region 3 for antibody 28175
VTERNTSTWFSAFDM

SEQ ID NO: 56351 - protein, 9 aa, Homo sapiens
  light chain complementarity determining region 3 for antibody 28176
QPYHYTPFT

SEQ ID NO: 56352 - protein, 14 aa, Homo sapiens
  heavy chain complementarity determining region 3 for antibody 28176
ARHEEMGTTAAFDV

SEQ ID NO: 56353 - protein, 10 aa, Homo sapiens
  light chain complementarity determining region 3 for antibody 28177
QPYGSSPPWT

SEQ ID NO: 56354 - protein, 14 aa, Homo sapiens
  heavy chain complementarity determining region 3 for antibody 28177
ARGGIRGVIIPLLS

SEQ ID NO: 56355 - protein, 9 aa, Homo sapiens
  light chain complementarity determining region 3 for antibody 28178
QPYGSSPPT

SEQ ID NO: 56356 - protein, 12 aa, Homo sapiens
  heavy chain complementarity determining region 3 for antibody 28178
ARGPQLWFYFDY

SEQ ID NO: 56357 - protein, 9 aa, Homo sapiens
  light chain complementarity determining region 3 for antibody 28179
QPYGSSPLT

SEQ ID NO: 56358 - protein, 17 aa, Homo sapiens
  heavy chain complementarity determining region 3 for antibody 28179
ARAPAPYRSDWRDPFDI

SEQ ID NO: 56359 - protein, 9 aa, Homo sapiens
  light chain complementarity determining region 3 for antibody 28180
QPYGSLPRT

SEQ ID NO: 56360 - protein, 14 aa, Homo sapiens
  heavy chain complementarity determining region 3 for antibody 28180
AGGDFCGSDCYSEY

SEQ ID NO: 56361 - protein, 9 aa, Homo sapiens
  light chain complementarity determining region 3 for antibody 28181
QPYGNIPRS

SEQ ID NO: 56362 - protein, 13 aa, Homo sapiens
  heavy chain complementarity determining region 3 for antibody 28181
AGGTWHSGIYYES

SEQ ID NO: 56363 - protein, 9 aa, Homo sapiens
  light chain complementarity determining region 3 for antibody 28182
QPYGGSSYT

SEQ ID NO: 56364 - protein, 16 aa, Homo sapiens
  heavy chain complementarity determining region 3 for antibody 28182
ANWFGSVGDFLGPFDY

SEQ ID NO: 56365 - protein, 8 aa, Homo sapiens
  light chain complementarity determining region 3 for antibody 28183
QPYGGSPS

SEQ ID NO: 56366 - protein, 16 aa, Homo sapiens
  heavy chain complementarity determining region 3 for antibody 28183
ATDWGSGTQWIRAFDV

SEQ ID NO: 56367 - protein, 9 aa, Homo sapiens
  light chain complementarity determining region 3 for antibody 28184
QPYAYSPIT

SEQ ID NO: 56368 - protein, 10 aa, Homo sapiens
  heavy chain complementarity determining region 3 for antibody 28184
ATGAGWLVDY

SEQ ID NO: 56369 - protein, 9 aa, Homo sapiens
  light chain complementarity determining region 3 for antibody 28185
QPYAGAPRT

SEQ ID NO: 56370 - protein, 14 aa, Homo sapiens
  heavy chain complementarity determining region 3 for antibody 28185
TRDGDNFLWGNYHY

SEQ ID NO: 56371 - protein, 9 aa, Homo sapiens
  light chain complementarity determining region 3 for antibody 28186
QPTSTFPRT

SEQ ID NO: 56372 - protein, 20 aa, Homo sapiens
  heavy chain complementarity determining region 3 for antibody 28186
ARGRRIAALSTAHYYYGMDV

SEQ ID NO: 56373 - protein, 9 aa, Homo sapiens
  light chain complementarity determining region 3 for antibody 28187
QPTNNLPVS

SEQ ID NO: 56374 - protein, 25 aa, Homo sapiens
  heavy chain complementarity determining region 3 for antibody 28187
ARERHDFSSGSYTGGREYYYYGLDV

SEQ ID NO: 56375 - protein, 9 aa, Homo sapiens
  light chain complementarity determining region 3 for antibody 28188
QPFGGAPRT

SEQ ID NO: 56376 - protein, 16 aa, Homo sapiens
  heavy chain complementarity determining region 3 for antibody 28188
ARDPRGGVAVPADFNY

SEQ ID NO: 56377 - protein, 11 aa, Homo sapiens
  light chain complementarity determining region 3 for antibody 28189
QNYNTALRGLP

SEQ ID NO: 56378 - protein, 14 aa, Homo sapiens
  heavy chain complementarity determining region 3 for antibody 28189
AKPRNSYWLYYFDY

SEQ ID NO: 56379 - protein, 9 aa, Homo sapiens
  light chain complementarity determining region 3 for antibody 28190
QNFGGSPLT

SEQ ID NO: 56380 - protein, 11 aa, Homo sapiens
  heavy chain complementarity determining region 3 for antibody 28190
ARKGTGAPFDY

SEQ ID NO: 56381 - protein, 9 aa, Homo sapiens
  light chain complementarity determining region 3 for antibody 28191
QNCGSYPPT

SEQ ID NO: 56382 - protein, 11 aa, Homo sapiens
  heavy chain complementarity determining region 3 for antibody 28191
ARRGSNLHADY

SEQ ID NO: 56383 - protein, 9 aa, Homo sapiens
  light chain complementarity determining region 3 for antibody 28192
QNCGSYPLT

SEQ ID NO: 56384 - protein, 11 aa, Homo sapiens
  heavy chain complementarity determining region 3 for antibody 28192
ARRGSTLHADY

SEQ ID NO: 56385 - protein, 11 aa, Homo sapiens
  light chain complementarity determining region 3 for antibody 28193
QMYDGSPPRFT

SEQ ID NO: 56386 - protein, 16 aa, Homo sapiens
  heavy chain complementarity determining region 3 for antibody 28193
AREYCDTNKCYQSFDY

SEQ ID NO: 56387 - protein, 10 aa, Homo sapiens
  light chain complementarity determining region 3 for antibody 28194
QLYSRSPTGR

SEQ ID NO: 56388 - protein, 19 aa, Homo sapiens
  heavy chain complementarity determining region 3 for antibody 28194
ARESYYPDIGGYTPRAFDI

SEQ ID NO: 56389 - protein, 11 aa, Homo sapiens
  light chain complementarity determining region 3 for antibody 28195
QLYETSPPGYP

SEQ ID NO: 56390 - protein, 14 aa, Homo sapiens
  heavy chain complementarity determining region 3 for antibody 28195
AREHTISRKRSFDQ

SEQ ID NO: 56391 - protein, 11 aa, Homo sapiens
  light chain complementarity determining region 3 for antibody 28196
QLYDTSPPGSP

SEQ ID NO: 56392 - protein, 14 aa, Homo sapiens
  heavy chain complementarity determining region 3 for antibody 28196
AREITISRKTSFDQ

SEQ ID NO: 56393 - protein, 9 aa, Homo sapiens
  light chain complementarity determining region 3 for antibody 28197
QLSYSSPPT

SEQ ID NO: 56394 - protein, 17 aa, Homo sapiens
  heavy chain complementarity determining region 3 for antibody 28197
ARDPLQLGILTADAFDV

SEQ ID NO: 56395 - protein, 11 aa, Homo sapiens
  light chain complementarity determining region 3 for antibody 28198
QLRGNWPPTYP

SEQ ID NO: 56396 - protein, 22 aa, Homo sapiens
  heavy chain complementarity determining region 3 for antibody 28198
ATLRPRDVGFCSGGSCPYYFDY

SEQ ID NO: 56397 - protein, 10 aa, Homo sapiens
  light chain complementarity determining region 3 for antibody 28199
QLFSRSPTWT

SEQ ID NO: 56398 - protein, 19 aa, Homo sapiens
  heavy chain complementarity determining region 3 for antibody 28199
ARESYYPDIGGYTPRAFDI

SEQ ID NO: 56399 - protein, 10 aa, Homo sapiens
  light chain complementarity determining region 3 for antibody 28200
QLFGSSFRIT

SEQ ID NO: 56400 - protein, 10 aa, Homo sapiens
  heavy chain complementarity determining region 3 for antibody 28200
GKANWNSVSY

SEQ ID NO: 56401 - protein, 9 aa, Homo sapiens
  light chain complementarity determining region 3 for antibody 28201
QKYSSAPYT

SEQ ID NO: 56402 - protein, 15 aa, Homo sapiens
  heavy chain complementarity determining region 3 for antibody 28201
ARVGGHFYSGGYEDY

SEQ ID NO: 56403 - protein, 9 aa, Homo sapiens
  light chain complementarity determining region 3 for antibody 28202
QKYNSGPLT

SEQ ID NO: 56404 - protein, 14 aa, Homo sapiens
  heavy chain complementarity determining region 3 for antibody 28202
ARPQTWDLLYAFDM

SEQ ID NO: 56405 - protein, 9 aa, Homo sapiens
  light chain complementarity determining region 3 for antibody 28203
QKYNSDTFT

SEQ ID NO: 56406 - protein, 13 aa, Homo sapiens
  heavy chain complementarity determining region 3 for antibody 28203
TKAFSSATGPFDI

SEQ ID NO: 56407 - protein, 9 aa, Homo sapiens
  light chain complementarity determining region 3 for antibody 28204
QKYNSAPRT

SEQ ID NO: 56408 - protein, 23 aa, Homo sapiens
  heavy chain complementarity determining region 3 for antibody 28204
ARHPSRSPGQAPTPPDYYYGMDV

SEQ ID NO: 56409 - protein, 10 aa, Homo sapiens
  light chain complementarity determining region 3 for antibody 28205
QKYNSAPPRT

SEQ ID NO: 56410 - protein, 14 aa, Homo sapiens
  heavy chain complementarity determining region 3 for antibody 28205
AKGEKWLSSGAFDI

SEQ ID NO: 56411 - protein, 9 aa, Homo sapiens
  light chain complementarity determining region 3 for antibody 28206
QKYNSAPLT

SEQ ID NO: 56412 - protein, 12 aa, Homo sapiens
  heavy chain complementarity determining region 3 for antibody 28206
ARVEEWEVPGGY

SEQ ID NO: 56413 - protein, 9 aa, Homo sapiens
  light chain complementarity determining region 3 for antibody 28207
QKYNSAPLT

SEQ ID NO: 56414 - protein, 17 aa, Homo sapiens
  heavy chain complementarity determining region 3 for antibody 28207
ARSDILTGFTTPGLSDV

SEQ ID NO: 56415 - protein, 9 aa, Homo sapiens
  light chain complementarity determining region 3 for antibody 28208
QKYNRVPLT

SEQ ID NO: 56416 - protein, 14 aa, Homo sapiens
  heavy chain complementarity determining region 3 for antibody 28208
ARPQTWDLLYAFDM

SEQ ID NO: 56417 - protein, 9 aa, Homo sapiens
  light chain complementarity determining region 3 for antibody 28209
QKYNRAPRT

SEQ ID NO: 56418 - protein, 10 aa, Homo sapiens
  heavy chain complementarity determining region 3 for antibody 28209
ARDRLGAFDI

SEQ ID NO: 56419 - protein, 9 aa, Homo sapiens
  light chain complementarity determining region 3 for antibody 28210
QKYNNGPLT

SEQ ID NO: 56420 - protein, 16 aa, Homo sapiens
  heavy chain complementarity determining region 3 for antibody 28210
ARIKVDSSSWYSSLDY

SEQ ID NO: 56421 - protein, 9 aa, Homo sapiens
  light chain complementarity determining region 3 for antibody 28211
QKYNNALWT

SEQ ID NO: 56422 - protein, 16 aa, Homo sapiens
  heavy chain complementarity determining region 3 for antibody 28211
ARPTAVVTQYDWYFDV

SEQ ID NO: 56423 - protein, 9 aa, Homo sapiens
  light chain complementarity determining region 3 for antibody 28212
QKYKSAHWT

SEQ ID NO: 56424 - protein, 17 aa, Homo sapiens
  heavy chain complementarity determining region 3 for antibody 28212
ARRPWVRGLFMPYYFDY

SEQ ID NO: 56425 - protein, 9 aa, Homo sapiens
  light chain complementarity determining region 3 for antibody 28213
QKYGNSPLT

SEQ ID NO: 56426 - protein, 13 aa, Homo sapiens
  heavy chain complementarity determining region 3 for antibody 28213
ASKTSVRTYSSDL

SEQ ID NO: 56427 - protein, 9 aa, Homo sapiens
  light chain complementarity determining region 3 for antibody 28214
QKYDSAPLT

SEQ ID NO: 56428 - protein, 15 aa, Homo sapiens
  heavy chain complementarity determining region 3 for antibody 28214
ARDGGPYQVFLPFSD

SEQ ID NO: 56429 - protein, 9 aa, Homo sapiens
  light chain complementarity determining region 3 for antibody 28215
QKYDRAPLT

SEQ ID NO: 56430 - protein, 15 aa, Homo sapiens
  heavy chain complementarity determining region 3 for antibody 28215
ARDGGPYQVLLPFSD

SEQ ID NO: 56431 - protein, 9 aa, Homo sapiens
  light chain complementarity determining region 3 for antibody 28216
QKNNSVPLT

SEQ ID NO: 56432 - protein, 14 aa, Homo sapiens
  heavy chain complementarity determining region 3 for antibody 28216
ARPQTWDLLYAFDM

SEQ ID NO: 56433 - protein, 9 aa, Homo sapiens
  light chain complementarity determining region 3 for antibody 28217
QKNNSAQLT

SEQ ID NO: 56434 - protein, 15 aa, Homo sapiens
  heavy chain complementarity determining region 3 for antibody 28217
ARRSNDFWSGYHPDY

SEQ ID NO: 56435 - protein, 9 aa, Homo sapiens
  light chain complementarity determining region 3 for antibody 28218
QKHNSVPLT

SEQ ID NO: 56436 - protein, 14 aa, Homo sapiens
  heavy chain complementarity determining region 3 for antibody 28218
ARPQTWDLLYAFDM

SEQ ID NO: 56437 - protein, 9 aa, Homo sapiens
  light chain complementarity determining region 3 for antibody 28219
QKDNSVPLT

SEQ ID NO: 56438 - protein, 14 aa, Homo sapiens
  heavy chain complementarity determining region 3 for antibody 28219
ARPQTWDLLYAFDM

SEQ ID NO: 56439 - protein, 9 aa, Homo sapiens
  light chain complementarity determining region 3 for antibody 28220
QKDGSSPRP

SEQ ID NO: 56440 - protein, 13 aa, Homo sapiens
  heavy chain complementarity determining region 3 for antibody 28220
ARGEYVSGNYEEN

SEQ ID NO: 56441 - protein, 9 aa, Homo sapiens
  light chain complementarity determining region 3 for antibody 28221
QHYYTYSYT

SEQ ID NO: 56442 - protein, 16 aa, Homo sapiens
  heavy chain complementarity determining region 3 for antibody 28221
ARHGARCSGGNCYFDI

SEQ ID NO: 56443 - protein, 9 aa, Homo sapiens
  light chain complementarity determining region 3 for antibody 28222
QHYYTSVRT

SEQ ID NO: 56444 - protein, 12 aa, Homo sapiens
  heavy chain complementarity determining region 3 for antibody 28222
VKDCSLGGSRDS

SEQ ID NO: 56445 - protein, 9 aa, Homo sapiens
  light chain complementarity determining region 3 for antibody 28223
QHYYTSLRT

SEQ ID NO: 56446 - protein, 12 aa, Homo sapiens
  heavy chain complementarity determining region 3 for antibody 28223
VKDCGLGGSRDF

SEQ ID NO: 56447 - protein, 9 aa, Homo sapiens
  light chain complementarity determining region 3 for antibody 28224
QHYYTSLRT

SEQ ID NO: 56448 - protein, 12 aa, Homo sapiens
  heavy chain complementarity determining region 3 for antibody 28224
VKDCGLGGPRDY

SEQ ID NO: 56449 - protein, 9 aa, Homo sapiens
  light chain complementarity determining region 3 for antibody 28225
QHYYTSFRT

SEQ ID NO: 56450 - protein, 12 aa, Homo sapiens
  heavy chain complementarity determining region 3 for antibody 28225
VKDCGLGGSRDS

SEQ ID NO: 56451 - protein, 9 aa, Homo sapiens
  light chain complementarity determining region 3 for antibody 28226
QHYYSTPYT

SEQ ID NO: 56452 - protein, 20 aa, Homo sapiens
  heavy chain complementarity determining region 3 for antibody 28226
ARGNYSSSWHTTDYYYGMHV

SEQ ID NO: 56453 - protein, 9 aa, Homo sapiens
  light chain complementarity determining region 3 for antibody 28227
QHYYEYPRT

SEQ ID NO: 56454 - protein, 17 aa, Homo sapiens
  heavy chain complementarity determining region 3 for antibody 28227
VRVTSKGLIYAGGYFDS

SEQ ID NO: 56455 - protein, 10 aa, Homo sapiens
  light chain complementarity determining region 3 for antibody 28228
QHYVSPPAYT

SEQ ID NO: 56456 - protein, 12 aa, Homo sapiens
  heavy chain complementarity determining region 3 for antibody 28228
ARETTRFGELGY

SEQ ID NO: 56457 - protein, 10 aa, Homo sapiens
  light chain complementarity determining region 3 for antibody 28229
QHYVSPPADT

SEQ ID NO: 56458 - protein, 12 aa, Homo sapiens
  heavy chain complementarity determining region 3 for antibody 28229
ARETTRFGELDY

SEQ ID NO: 56459 - protein, 9 aa, Homo sapiens
  light chain complementarity determining region 3 for antibody 28230
QHYSRSHNT

SEQ ID NO: 56460 - protein, 13 aa, Homo sapiens
  heavy chain complementarity determining region 3 for antibody 28230
AKNYGPGTPYFDY

SEQ ID NO: 56461 - protein, 9 aa, Homo sapiens
  light chain complementarity determining region 3 for antibody 28231
QHYSGSPWT

SEQ ID NO: 56462 - protein, 9 aa, Homo sapiens
  heavy chain complementarity determining region 3 for antibody 28231
ARAARGLDV

SEQ ID NO: 56463 - protein, 9 aa, Homo sapiens
  light chain complementarity determining region 3 for antibody 28232
QHYRGYPIT

SEQ ID NO: 56464 - protein, 21 aa, Homo sapiens
  heavy chain complementarity determining region 3 for antibody 28232
VRGPGGEAPAGSETYYYPMDL

SEQ ID NO: 56465 - protein, 10 aa, Homo sapiens
  light chain complementarity determining region 3 for antibody 28233
QHYNVWPPWT

SEQ ID NO: 56466 - protein, 16 aa, Homo sapiens
  heavy chain complementarity determining region 3 for antibody 28233
ARERNVRGAASGIFDY

SEQ ID NO: 56467 - protein, 10 aa, Homo sapiens
  light chain complementarity determining region 3 for antibody 28234
QHYNSYSHST

SEQ ID NO: 56468 - protein, 18 aa, Homo sapiens
  heavy chain complementarity determining region 3 for antibody 28234
ARGAGAGYSSNWKIPAGC

SEQ ID NO: 56469 - protein, 10 aa, Homo sapiens
  light chain complementarity determining region 3 for antibody 28235
QHYNSYSHSP

SEQ ID NO: 56470 - protein, 18 aa, Homo sapiens
  heavy chain complementarity determining region 3 for antibody 28235
ARGAGTGYSSNWKIPAGW

SEQ ID NO: 56471 - protein, 9 aa, Homo sapiens
  light chain complementarity determining region 3 for antibody 28236
QHYNHRPLT

SEQ ID NO: 56472 - protein, 15 aa, Homo sapiens
  heavy chain complementarity determining region 3 for antibody 28236
AREVIETTASDGFDM

SEQ ID NO: 56473 - protein, 9 aa, Homo sapiens
  light chain complementarity determining region 3 for antibody 28237
QHYNADPYN

SEQ ID NO: 56474 - protein, 15 aa, Homo sapiens
  heavy chain complementarity determining region 3 for antibody 28237
ARHSWGDFGFDAFDM

SEQ ID NO: 56475 - protein, 9 aa, Homo sapiens
  light chain complementarity determining region 3 for antibody 28238
QHYLTTPLT

SEQ ID NO: 56476 - protein, 13 aa, Homo sapiens
  heavy chain complementarity determining region 3 for antibody 28238
VKDPDFNYGSWVS

SEQ ID NO: 56477 - protein, 9 aa, Homo sapiens
  light chain complementarity determining region 3 for antibody 28239
QHYISYSST

SEQ ID NO: 56478 - protein, 18 aa, Homo sapiens
  heavy chain complementarity determining region 3 for antibody 28239
ARDRYSCDSGGCFHWFDP

SEQ ID NO: 56479 - protein, 9 aa, Homo sapiens
  light chain complementarity determining region 3 for antibody 28240
QHYHTSPWP

SEQ ID NO: 56480 - protein, 11 aa, Homo sapiens
  heavy chain complementarity determining region 3 for antibody 28240
STWYFLSDVDV

SEQ ID NO: 56481 - protein, 8 aa, Homo sapiens
  light chain complementarity determining region 3 for antibody 28241
QHYHSPIT

SEQ ID NO: 56482 - protein, 10 aa, Homo sapiens
  heavy chain complementarity determining region 3 for antibody 28241
VRGRGWTLDH

SEQ ID NO: 56483 - protein, 11 aa, Homo sapiens
  light chain complementarity determining region 3 for antibody 28242
QHYGTSPAMDT

SEQ ID NO: 56484 - protein, 16 aa, Homo sapiens
  heavy chain complementarity determining region 3 for antibody 28242
ATPYLAVSGPLDAFDI

SEQ ID NO: 56485 - protein, 9 aa, Homo sapiens
  light chain complementarity determining region 3 for antibody 28243
QHYGTAPVP

SEQ ID NO: 56486 - protein, 14 aa, Homo sapiens
  heavy chain complementarity determining region 3 for antibody 28243
ARDLFRGIPDYLDY

SEQ ID NO: 56487 - protein, 11 aa, Homo sapiens
  light chain complementarity determining region 3 for antibody 28244
QHYGSSPPRVT

SEQ ID NO: 56488 - protein, 28 aa, Homo sapiens
  heavy chain complementarity determining region 3 for antibody 28244
ARGAKKEKLIFVRPRARGGDTRHWYFDL

SEQ ID NO: 56489 - protein, 11 aa, Homo sapiens
  light chain complementarity determining region 3 for antibody 28245
QHYGSSPPRGT

SEQ ID NO: 56490 - protein, 28 aa, Homo sapiens
  heavy chain complementarity determining region 3 for antibody 28245
ARGAKKEKLIFVRPRDRGGDTRHWYFDL

SEQ ID NO: 56491 - protein, 10 aa, Homo sapiens
  light chain complementarity determining region 3 for antibody 28246
QHYGSSPPIP

SEQ ID NO: 56492 - protein, 13 aa, Homo sapiens
  heavy chain complementarity determining region 3 for antibody 28246
AHSRVWFGAAFDY

SEQ ID NO: 56493 - protein, 10 aa, Homo sapiens
  light chain complementarity determining region 3 for antibody 28247
QHYGSSPAVP

SEQ ID NO: 56494 - protein, 14 aa, Homo sapiens
  heavy chain complementarity determining region 3 for antibody 28247
ARHEHDGSGSVIDY

SEQ ID NO: 56495 - protein, 9 aa, Homo sapiens
  light chain complementarity determining region 3 for antibody 28248
QHYGSIPRT

SEQ ID NO: 56496 - protein, 14 aa, Homo sapiens
  heavy chain complementarity determining region 3 for antibody 28248
AGGDFCGGDCYSEY

SEQ ID NO: 56497 - protein, 10 aa, Homo sapiens
  light chain complementarity determining region 3 for antibody 28249
QHYGISPRLT

SEQ ID NO: 56498 - protein, 12 aa, Homo sapiens
  heavy chain complementarity determining region 3 for antibody 28249
ARDVVGATASDF

SEQ ID NO: 56499 - protein, 10 aa, Homo sapiens
  light chain complementarity determining region 3 for antibody 28250
QHYGISPPLT

SEQ ID NO: 56500 - protein, 20 aa, Homo sapiens
  heavy chain complementarity determining region 3 for antibody 28250
AKDFHPNYYGSGSYYTFPGL

SEQ ID NO: 56501 - protein, 9 aa, Homo sapiens
  light chain complementarity determining region 3 for antibody 28251
QHYFSHVYT

SEQ ID NO: 56502 - protein, 18 aa, Homo sapiens
  heavy chain complementarity determining region 3 for antibody 28251
AQERDGYCDSHACYGLDV

SEQ ID NO: 56503 - protein, 9 aa, Homo sapiens
  light chain complementarity determining region 3 for antibody 28252
QHYFITPPT

SEQ ID NO: 56504 - protein, 18 aa, Homo sapiens
  heavy chain complementarity determining region 3 for antibody 28252
ARAAGGAGDVRFLSWIDA

SEQ ID NO: 56505 - protein, 9 aa, Homo sapiens
  light chain complementarity determining region 3 for antibody 28253
QHYDSSPRT

SEQ ID NO: 56506 - protein, 12 aa, Homo sapiens
  heavy chain complementarity determining region 3 for antibody 28253
TTKRGYIYGAEY

SEQ ID NO: 56507 - protein, 8 aa, Homo sapiens
  light chain complementarity determining region 3 for antibody 28254
QHYDITWT

SEQ ID NO: 56508 - protein, 10 aa, Homo sapiens
  heavy chain complementarity determining region 3 for antibody 28254
AKPTDWYGHY

SEQ ID NO: 56509 - protein, 10 aa, Homo sapiens
  light chain complementarity determining region 3 for antibody 28255
QHYDGYSPRT

SEQ ID NO: 56510 - protein, 12 aa, Homo sapiens
  heavy chain complementarity determining region 3 for antibody 28255
AKVYSSSWYFDY

SEQ ID NO: 56511 - protein, 9 aa, Homo sapiens
  light chain complementarity determining region 3 for antibody 28256
QHYDDSPWA

SEQ ID NO: 56512 - protein, 16 aa, Homo sapiens
  heavy chain complementarity determining region 3 for antibody 28256
AKAFTFGGVGGHLYDY

SEQ ID NO: 56513 - protein, 10 aa, Homo sapiens
  light chain complementarity determining region 3 for antibody 28257
QHWVSSPANT

SEQ ID NO: 56514 - protein, 12 aa, Homo sapiens
  heavy chain complementarity determining region 3 for antibody 28257
ARETTRFGELDH

SEQ ID NO: 56515 - protein, 10 aa, Homo sapiens
  light chain complementarity determining region 3 for antibody 28258
QHTYGAPPST

SEQ ID NO: 56516 - protein, 11 aa, Homo sapiens
  heavy chain complementarity determining region 3 for antibody 28258
AREVVTGFPDY

SEQ ID NO: 56517 - protein, 10 aa, Homo sapiens
  light chain complementarity determining region 3 for antibody 28259
QHTYGAPPFT

SEQ ID NO: 56518 - protein, 11 aa, Homo sapiens
  heavy chain complementarity determining region 3 for antibody 28259
AREVVTGFPDY

SEQ ID NO: 56519 - protein, 9 aa, Homo sapiens
  light chain complementarity determining region 3 for antibody 28260
QHTSPFPRT

SEQ ID NO: 56520 - protein, 20 aa, Homo sapiens
  heavy chain complementarity determining region 3 for antibody 28260
ARGRRIAALSTAHYYYGMDV

SEQ ID NO: 56521 - protein, 9 aa, Homo sapiens
  light chain complementarity determining region 3 for antibody 28261
QHTNTFPRT

SEQ ID NO: 56522 - protein, 20 aa, Homo sapiens
  heavy chain complementarity determining region 3 for antibody 28261
GRGRRIAALSTAHYYYGMDV

SEQ ID NO: 56523 - protein, 9 aa, Homo sapiens
  light chain complementarity determining region 3 for antibody 28262
QHSNRTPYT

SEQ ID NO: 56524 - protein, 14 aa, Homo sapiens
  heavy chain complementarity determining region 3 for antibody 28262
ATEGPSRMGKFFDS

SEQ ID NO: 56525 - protein, 9 aa, Homo sapiens
  light chain complementarity determining region 3 for antibody 28263
QHSNNFPNT

SEQ ID NO: 56526 - protein, 12 aa, Homo sapiens
  heavy chain complementarity determining region 3 for antibody 28263
ARASGYHAPFGF

SEQ ID NO: 56527 - protein, 9 aa, Homo sapiens
  light chain complementarity determining region 3 for antibody 28264
QHSHSRPFT

SEQ ID NO: 56528 - protein, 20 aa, Homo sapiens
  heavy chain complementarity determining region 3 for antibody 28264
AKGISVAALRTVYCYYGMDV

SEQ ID NO: 56529 - protein, 6 aa, Homo sapiens
  light chain complementarity determining region 3 for antibody 28265
QHSGAT

SEQ ID NO: 56530 - protein, 13 aa, Homo sapiens
  heavy chain complementarity determining region 3 for antibody 28265
ASPRAYRYHAFDI

SEQ ID NO: 56531 - protein, 9 aa, Homo sapiens
  light chain complementarity determining region 3 for antibody 28266
QHSFNTPYP

SEQ ID NO: 56532 - protein, 14 aa, Homo sapiens
  heavy chain complementarity determining region 3 for antibody 28266
ARLGTMASRHPLDY

SEQ ID NO: 56533 - protein, 11 aa, Homo sapiens
  light chain complementarity determining region 3 for antibody 28267
QHRTSWPPKYT

SEQ ID NO: 56534 - protein, 14 aa, Homo sapiens
  heavy chain complementarity determining region 3 for antibody 28267
ARTVLDTAADAFDF

SEQ ID NO: 56535 - protein, 9 aa, Homo sapiens
  light chain complementarity determining region 3 for antibody 28268
QHRSYWPWT

SEQ ID NO: 56536 - protein, 17 aa, Homo sapiens
  heavy chain complementarity determining region 3 for antibody 28268
GREYYDARSGSGNWSDP

SEQ ID NO: 56537 - protein, 6 aa, Homo sapiens
  light chain complementarity determining region 3 for antibody 28269
QHRGRP

SEQ ID NO: 56538 - protein, 17 aa, Homo sapiens
  heavy chain complementarity determining region 3 for antibody 28269
ATFSRQVVTGYYWYFDL

SEQ ID NO: 56539 - protein, 9 aa, Homo sapiens
  light chain complementarity determining region 3 for antibody 28270
QHLNSYPRT

SEQ ID NO: 56540 - protein, 17 aa, Homo sapiens
  heavy chain complementarity determining region 3 for antibody 28270
AKSPAVYTWGHLSLFDS

SEQ ID NO: 56541 - protein, 9 aa, Homo sapiens
  light chain complementarity determining region 3 for antibody 28271
QHHQTYLPT

SEQ ID NO: 56542 - protein, 12 aa, Homo sapiens
  heavy chain complementarity determining region 3 for antibody 28271
AGDPSGNSYFDY

SEQ ID NO: 56543 - protein, 9 aa, Homo sapiens
  light chain complementarity determining region 3 for antibody 28272
QHFGGPPLT

SEQ ID NO: 56544 - protein, 11 aa, Homo sapiens
  heavy chain complementarity determining region 3 for antibody 28272
ARKGTGAPFDY

SEQ ID NO: 56545 - protein, 9 aa, Homo sapiens
  light chain complementarity determining region 3 for antibody 28273
QHFGCSPLT

SEQ ID NO: 56546 - protein, 11 aa, Homo sapiens
  heavy chain complementarity determining region 3 for antibody 28273
ARKGTGAPFDY

SEQ ID NO: 56547 - protein, 10 aa, Homo sapiens
  light chain complementarity determining region 3 for antibody 28274
QHFDNLPMFP

SEQ ID NO: 56548 - protein, 16 aa, Homo sapiens
  heavy chain complementarity determining region 3 for antibody 28274
ARVPRGSYASGTLFDY

SEQ ID NO: 56549 - protein, 10 aa, Homo sapiens
  light chain complementarity determining region 3 for antibody 28275
QHFDNIPMFT

SEQ ID NO: 56550 - protein, 16 aa, Homo sapiens
  heavy chain complementarity determining region 3 for antibody 28275
ARVPRGSYASGTLFDY

SEQ ID NO: 56551 - protein, 9 aa, Homo sapiens
  light chain complementarity determining region 3 for antibody 28276
QHDYSPPWT

SEQ ID NO: 56552 - protein, 15 aa, Homo sapiens
  heavy chain complementarity determining region 3 for antibody 28276
TKEGGHNPLGAGLDQ

SEQ ID NO: 56553 - protein, 9 aa, Homo sapiens
  light chain complementarity determining region 3 for antibody 28277
QHCGSYPLT

SEQ ID NO: 56554 - protein, 11 aa, Homo sapiens
  heavy chain complementarity determining region 3 for antibody 28277
ARRGSNLHADY

SEQ ID NO: 56555 - protein, 10 aa, Homo sapiens
  light chain complementarity determining region 3 for antibody 28278
QGYKSWPAFT

SEQ ID NO: 56556 - protein, 11 aa, Homo sapiens
  heavy chain complementarity determining region 3 for antibody 28278
ARRWGSAPFDH

SEQ ID NO: 56557 - protein, 8 aa, Homo sapiens
  light chain complementarity determining region 3 for antibody 28279
QGYDGIPT

SEQ ID NO: 56558 - protein, 7 aa, Homo sapiens
  heavy chain complementarity determining region 3 for antibody 28279
ITTSVDL

SEQ ID NO: 56559 - protein, 7 aa, Homo sapiens
  light chain complementarity determining region 3 for antibody 28280
QGTHWPT

SEQ ID NO: 56560 - protein, 21 aa, Homo sapiens
  heavy chain complementarity determining region 3 for antibody 28280
AKDRPNYYESNGQYYTPKGDL

SEQ ID NO: 56561 - protein, 10 aa, Homo sapiens
  light chain complementarity determining region 3 for antibody 28281
QGDDSSSLWT

SEQ ID NO: 56562 - protein, 19 aa, Homo sapiens
  heavy chain complementarity determining region 3 for antibody 28281
ARESFVRKVGGQRPYYFDI

SEQ ID NO: 56563 - protein, 10 aa, Homo sapiens
  light chain complementarity determining region 3 for antibody 28282
QEYKSWPGFT

SEQ ID NO: 56564 - protein, 11 aa, Homo sapiens
  heavy chain complementarity determining region 3 for antibody 28282
ARRWGSAPFDH

SEQ ID NO: 56565 - protein, 10 aa, Homo sapiens
  light chain complementarity determining region 3 for antibody 28283
QEYKSWPAIT

SEQ ID NO: 56566 - protein, 11 aa, Homo sapiens
  heavy chain complementarity determining region 3 for antibody 28283
ARRWGSAPFDH

SEQ ID NO: 56567 - protein, 10 aa, Homo sapiens
  light chain complementarity determining region 3 for antibody 28284
QEYKSWPAFN

SEQ ID NO: 56568 - protein, 11 aa, Homo sapiens
  heavy chain complementarity determining region 3 for antibody 28284
ARRWGSAPFDH

SEQ ID NO: 56569 - protein, 11 aa, Homo sapiens
  light chain complementarity determining region 3 for antibody 28285
QESYNNPPQNT

SEQ ID NO: 56570 - protein, 15 aa, Homo sapiens
  heavy chain complementarity determining region 3 for antibody 28285
ARGRGITGSTYGIDY

SEQ ID NO: 56571 - protein, 9 aa, Homo sapiens
  light chain complementarity determining region 3 for antibody 28286
QESYGTPRT

SEQ ID NO: 56572 - protein, 10 aa, Homo sapiens
  heavy chain complementarity determining region 3 for antibody 28286
ARDYWGSLDY

SEQ ID NO: 56573 - protein, 9 aa, Homo sapiens
  light chain complementarity determining region 3 for antibody 28287
QESFSWSPT

SEQ ID NO: 56574 - protein, 18 aa, Homo sapiens
  heavy chain complementarity determining region 3 for antibody 28287
TQLLGYCRDAGYCPPFAY

SEQ ID NO: 56575 - protein, 10 aa, Homo sapiens
  light chain complementarity determining region 3 for antibody 28288
QENKSWPAFT

SEQ ID NO: 56576 - protein, 11 aa, Homo sapiens
  heavy chain complementarity determining region 3 for antibody 28288
ARRWGSAPFDH

SEQ ID NO: 56577 - protein, 9 aa, Homo sapiens
  light chain complementarity determining region 3 for antibody 28289
QDYGSPLFT

SEQ ID NO: 56578 - protein, 15 aa, Homo sapiens
  heavy chain complementarity determining region 3 for antibody 28289
ARDRHWGGPVDALDF

SEQ ID NO: 56579 - protein, 9 aa, Homo sapiens
  light chain complementarity determining region 3 for antibody 28290
PQYVKSPWT

SEQ ID NO: 56580 - protein, 11 aa, Homo sapiens
  heavy chain complementarity determining region 3 for antibody 28290
AREDWPDGFDI

SEQ ID NO: 56581 - protein, 9 aa, Homo sapiens
  light chain complementarity determining region 3 for antibody 28291
PQYSTYPWT

SEQ ID NO: 56582 - protein, 16 aa, Homo sapiens
  heavy chain complementarity determining region 3 for antibody 28291
ARVRYPISADNRVVDH

SEQ ID NO: 56583 - protein, 9 aa, Homo sapiens
  light chain complementarity determining region 3 for antibody 28292
PQYSNWLWT

SEQ ID NO: 56584 - protein, 20 aa, Homo sapiens
  heavy chain complementarity determining region 3 for antibody 28292
AHRRVRDTARGNYYSDGMDV

SEQ ID NO: 56585 - protein, 11 aa, Homo sapiens
  light chain complementarity determining region 3 for antibody 28293
PQYSDWPTSFT

SEQ ID NO: 56586 - protein, 14 aa, Homo sapiens
  heavy chain complementarity determining region 3 for antibody 28293
ARASGSNVKMPFDF

SEQ ID NO: 56587 - protein, 9 aa, Homo sapiens
  light chain complementarity determining region 3 for antibody 28294
PQYRSSPWT

SEQ ID NO: 56588 - protein, 22 aa, Homo sapiens
  heavy chain complementarity determining region 3 for antibody 28294
ARAVSTNRWGRSTGDWGGAYDI

SEQ ID NO: 56589 - protein, 9 aa, Homo sapiens
  light chain complementarity determining region 3 for antibody 28295
PQYNTWPRT

SEQ ID NO: 56590 - protein, 22 aa, Homo sapiens
  heavy chain complementarity determining region 3 for antibody 28295
AREVRASGYDDFYNYYYYGLDV

SEQ ID NO: 56591 - protein, 8 aa, Homo sapiens
  light chain complementarity determining region 3 for antibody 28296
PQYGSSFT

SEQ ID NO: 56592 - protein, 16 aa, Homo sapiens
  heavy chain complementarity determining region 3 for antibody 28296
AHSRYSSNIYPVPFDN

SEQ ID NO: 56593 - protein, 9 aa, Homo sapiens
  light chain complementarity determining region 3 for antibody 28297
PQYGRSPWT

SEQ ID NO: 56594 - protein, 18 aa, Homo sapiens
  heavy chain complementarity determining region 3 for antibody 28297
ATNPSIAEPGNIYWYFDL

SEQ ID NO: 56595 - protein, 9 aa, Homo sapiens
  light chain complementarity determining region 3 for antibody 28298
PQYGLSPET

SEQ ID NO: 56596 - protein, 15 aa, Homo sapiens
  heavy chain complementarity determining region 3 for antibody 28298
AFRGIQVVNGVRFDY

SEQ ID NO: 56597 - protein, 6 aa, Homo sapiens
  light chain complementarity determining region 3 for antibody 28299
PQYGET

SEQ ID NO: 56598 - protein, 12 aa, Homo sapiens
  heavy chain complementarity determining region 3 for antibody 28299
ARDHSSGWSLSN

SEQ ID NO: 56599 - protein, 9 aa, Homo sapiens
  light chain complementarity determining region 3 for antibody 28300
PQYDISPRT

SEQ ID NO: 56600 - protein, 12 aa, Homo sapiens
  heavy chain complementarity determining region 3 for antibody 28300
TTMYGFLHSIDY

SEQ ID NO: 56601 - protein, 9 aa, Homo sapiens
  light chain complementarity determining region 3 for antibody 28301
PQVHIYPFT

SEQ ID NO: 56602 - protein, 12 aa, Homo sapiens
  heavy chain complementarity determining region 3 for antibody 28301
ARPLDGDFGFDP
